United States Patent 7,888,497 (BIOINFORMATICALLY DETECTABLE GROUP OF NOVEL REGULATORY OLIGONUCLEOTIDES AND USES THEREOF) - sequence listing, part 130

SEQ ID NO: 5510536 - DNA, 19 bp, Homo sapiens
tagcttttaaaaaatattt

SEQ ID NO: 5510537 - DNA, 17 bp, Homo sapiens
tagcttttagcctggct

SEQ ID NO: 5510538 - DNA, 23 bp, Homo sapiens
tagcttttatgtgatatgtttta

SEQ ID NO: 5510539 - DNA, 13 bp, Homo sapiens
tagcttttcaaac

SEQ ID NO: 5510540 - DNA, 14 bp, Homo sapiens
tagcttttcacctt

SEQ ID NO: 5510541 - DNA, 14 bp, Homo sapiens
tagcttttccctgt

SEQ ID NO: 5510542 - DNA, 13 bp, Homo sapiens
tagcttttccctt

SEQ ID NO: 5510543 - DNA, 22 bp, Homo sapiens
tagcttttcttaaagactgaaa

SEQ ID NO: 5510544 - DNA, 15 bp, Homo sapiens
tagcttttgatgtct

SEQ ID NO: 5510545 - DNA, 22 bp, Homo sapiens
tagcttttgcaacatggtccag

SEQ ID NO: 5510546 - DNA, 20 bp, Homo sapiens
tagcttttgccagtattatg

SEQ ID NO: 5510547 - DNA, 19 bp, Homo sapiens
tagcttttgtgggggactg

SEQ ID NO: 5510548 - DNA, 14 bp, Homo sapiens
tagctttttaattg

SEQ ID NO: 5510549 - DNA, 18 bp, Homo sapiens
tagctttttattatttta

SEQ ID NO: 5510550 - DNA, 22 bp, Homo sapiens
tagcttttttcctcctttctct

SEQ ID NO: 5510551 - DNA, 23 bp, Homo sapiens
tagcttttttcctcctttctctg

SEQ ID NO: 5510552 - DNA, 20 bp, Homo sapiens
taggaaaaaaactgggataa

SEQ ID NO: 5510553 - DNA, 16 bp, Homo sapiens
taggaaaaactgattt

SEQ ID NO: 5510554 - DNA, 17 bp, Homo sapiens
taggaaaaactgatttt

SEQ ID NO: 5510555 - DNA, 17 bp, Homo sapiens
taggaaaaagctttact

SEQ ID NO: 5510556 - DNA, 21 bp, Homo sapiens
taggaaaaagctttactcttt

SEQ ID NO: 5510557 - DNA, 20 bp, Homo sapiens
taggaaaacctcaagcagta

SEQ ID NO: 5510558 - DNA, 15 bp, Homo sapiens
taggaaaagaaatct

SEQ ID NO: 5510559 - DNA, 15 bp, Homo sapiens
taggaaaagaaggct

SEQ ID NO: 5510560 - DNA, 12 bp, Homo sapiens
taggaaaatgag

SEQ ID NO: 5510561 - DNA, 18 bp, Homo sapiens
taggaaaatgcttattga

SEQ ID NO: 5510562 - DNA, 14 bp, Homo sapiens
taggaaaatgtaca

SEQ ID NO: 5510563 - DNA, 12 bp, Homo sapiens
taggaaaatttt

SEQ ID NO: 5510564 - DNA, 16 bp, Homo sapiens
taggaaacagaaaaga

SEQ ID NO: 5510565 - DNA, 23 bp, Homo sapiens
taggaaacagaaaagagaagaaa

SEQ ID NO: 5510566 - DNA, 22 bp, Homo sapiens
taggaaaccccccaatgtctgt

SEQ ID NO: 5510567 - DNA, 14 bp, Homo sapiens
taggaaactgaagc

SEQ ID NO: 5510568 - DNA, 23 bp, Homo sapiens
taggaaagaggaggcagaaagat

SEQ ID NO: 5510569 - DNA, 17 bp, Homo sapiens
taggaaagatttaatgt

SEQ ID NO: 5510570 - DNA, 21 bp, Homo sapiens
taggaaagcaccgcagcatgt

SEQ ID NO: 5510571 - DNA, 13 bp, Homo sapiens
taggaaaggcaga

SEQ ID NO: 5510572 - DNA, 14 bp, Homo sapiens
taggaaaggcagaa

SEQ ID NO: 5510573 - DNA, 15 bp, Homo sapiens
taggaaaggcagaaa

SEQ ID NO: 5510574 - DNA, 17 bp, Homo sapiens
taggaaataaatctaaa

SEQ ID NO: 5510575 - DNA, 18 bp, Homo sapiens
taggaaatatttatttta

SEQ ID NO: 5510576 - DNA, 18 bp, Homo sapiens
taggaaatgaatgtgtgt

SEQ ID NO: 5510577 - DNA, 18 bp, Homo sapiens
taggaaattgattttgaa

SEQ ID NO: 5510578 - DNA, 13 bp, Homo sapiens
taggaacaaatct

SEQ ID NO: 5510579 - DNA, 14 bp, Homo sapiens
taggaacaaatctt

SEQ ID NO: 5510580 - DNA, 16 bp, Homo sapiens
taggaacaaatcttcc

SEQ ID NO: 5510581 - DNA, 23 bp, Homo sapiens
taggaacaagctggcttctgtga

SEQ ID NO: 5510582 - DNA, 15 bp, Homo sapiens
taggaacagcagtgt

SEQ ID NO: 5510583 - DNA, 22 bp, Homo sapiens
taggaacagctcttcactcagc

SEQ ID NO: 5510584 - DNA, 17 bp, Homo sapiens
taggaacagtaaaatcc

SEQ ID NO: 5510585 - DNA, 19 bp, Homo sapiens
taggaacagtaaaatccaa

SEQ ID NO: 5510586 - DNA, 16 bp, Homo sapiens
taggaacatatgaaaa

SEQ ID NO: 5510587 - DNA, 14 bp, Homo sapiens
taggaaccctggag

SEQ ID NO: 5510588 - DNA, 15 bp, Homo sapiens
taggaaccttctccc

SEQ ID NO: 5510589 - DNA, 16 bp, Homo sapiens
taggaactcactcttt

SEQ ID NO: 5510590 - DNA, 15 bp, Homo sapiens
taggaactgctgggc

SEQ ID NO: 5510591 - DNA, 13 bp, Homo sapiens
taggaagaaaaat

SEQ ID NO: 5510592 - DNA, 16 bp, Homo sapiens
taggaagaaaatgtca

SEQ ID NO: 5510593 - DNA, 17 bp, Homo sapiens
taggaagaaagaagaca

SEQ ID NO: 5510594 - DNA, 16 bp, Homo sapiens
taggaagaaagatttg

SEQ ID NO: 5510595 - DNA, 14 bp, Homo sapiens
taggaagaacagta

SEQ ID NO: 5510596 - DNA, 23 bp, Homo sapiens
taggaagaacgttttttcctcag

SEQ ID NO: 5510597 - DNA, 22 bp, Homo sapiens
taggaagaagtggtactagtgt

SEQ ID NO: 5510598 - DNA, 17 bp, Homo sapiens
taggaagacataaaact

SEQ ID NO: 5510599 - DNA, 18 bp, Homo sapiens
taggaagacataaaactt

SEQ ID NO: 5510600 - DNA, 15 bp, Homo sapiens
taggaagagaaacca

SEQ ID NO: 5510601 - DNA, 13 bp, Homo sapiens
taggaagagaggt

SEQ ID NO: 5510602 - DNA, 16 bp, Homo sapiens
taggaagagaggtcca

SEQ ID NO: 5510603 - DNA, 18 bp, Homo sapiens
taggctatttgtaaatct

SEQ ID NO: 5510604 - DNA, 20 bp, Homo sapiens
taggctcatttactgtttta

SEQ ID NO: 5510605 - DNA, 15 bp, Homo sapiens
taggctccagacagg

SEQ ID NO: 5510606 - DNA, 22 bp, Homo sapiens
taggctccgtcagtatcaggcc

SEQ ID NO: 5510607 - DNA, 12 bp, Homo sapiens
taggctcctctt

SEQ ID NO: 5510608 - DNA, 12 bp, Homo sapiens
taggctcctggg

SEQ ID NO: 5510609 - DNA, 14 bp, Homo sapiens
taggctccttcctg

SEQ ID NO: 5510610 - DNA, 17 bp, Homo sapiens
taggctcgccttccctc

SEQ ID NO: 5510611 - DNA, 11 bp, Homo sapiens
taggctctgca

SEQ ID NO: 5510612 - DNA, 15 bp, Homo sapiens
taggctctgcacaga

SEQ ID NO: 5510613 - DNA, 15 bp, Homo sapiens
taggctctgccttcg

SEQ ID NO: 5510614 - DNA, 16 bp, Homo sapiens
taggctcttaagcagc

SEQ ID NO: 5510615 - DNA, 20 bp, Homo sapiens
taggctcttatgtgtgcctt

SEQ ID NO: 5510616 - DNA, 21 bp, Homo sapiens
taggctgccccgggtccccag

SEQ ID NO: 5510617 - DNA, 14 bp, Homo sapiens
taggctgctgccct

SEQ ID NO: 5510618 - DNA, 16 bp, Homo sapiens
taggctgctgggagat

SEQ ID NO: 5510619 - DNA, 12 bp, Homo sapiens
taggctggaagg

SEQ ID NO: 5510620 - DNA, 17 bp, Homo sapiens
taggctggagaagctca

SEQ ID NO: 5510621 - DNA, 16 bp, Homo sapiens
taggctggagcccagg

SEQ ID NO: 5510622 - DNA, 20 bp, Homo sapiens
taggctggggcggggcccag

SEQ ID NO: 5510623 - DNA, 22 bp, Homo sapiens
taggctggggcggggcccagga

SEQ ID NO: 5510624 - DNA, 15 bp, Homo sapiens
taggctggtggccca

SEQ ID NO: 5510625 - DNA, 19 bp, Homo sapiens
taggctggtggcccaggac

SEQ ID NO: 5510626 - DNA, 21 bp, Homo sapiens
taggctgtaactactttataa

SEQ ID NO: 5510627 - DNA, 21 bp, Homo sapiens
taggctgtacatcagacagaa

SEQ ID NO: 5510628 - DNA, 22 bp, Homo sapiens
taggctgtggggtctggctgtg

SEQ ID NO: 5510629 - DNA, 16 bp, Homo sapiens
taggctgtggggtggg

SEQ ID NO: 5510630 - DNA, 23 bp, Homo sapiens
taggctgtggtgcagtaaccatt

SEQ ID NO: 5510631 - DNA, 15 bp, Homo sapiens
taggctgttcccttt

SEQ ID NO: 5510632 - DNA, 16 bp, Homo sapiens
taggctgttccctttg

SEQ ID NO: 5510633 - DNA, 18 bp, Homo sapiens
taggctgttccctttgcc

SEQ ID NO: 5510634 - DNA, 19 bp, Homo sapiens
taggctgttccctttgcct

SEQ ID NO: 5510635 - DNA, 21 bp, Homo sapiens
taggctgttccctttgcctta

SEQ ID NO: 5510636 - DNA, 20 bp, Homo sapiens
taggctgttccttgtactct

SEQ ID NO: 5510637 - DNA, 13 bp, Homo sapiens
taggctgttttct

SEQ ID NO: 5510638 - DNA, 22 bp, Homo sapiens
taggcttacaatgtgcactgaa

SEQ ID NO: 5510639 - DNA, 18 bp, Homo sapiens
taggcttatcaaaatctt

SEQ ID NO: 5510640 - DNA, 20 bp, Homo sapiens
taggcttcaggccgagccag

SEQ ID NO: 5510641 - DNA, 20 bp, Homo sapiens
taggcttcaggttgcattgg

SEQ ID NO: 5510642 - DNA, 17 bp, Homo sapiens
taggcttctacctgcag

SEQ ID NO: 5510643 - DNA, 13 bp, Homo sapiens
taggcttctatta

SEQ ID NO: 5510644 - DNA, 18 bp, Homo sapiens
taggctttatgctgtgtt

SEQ ID NO: 5510645 - DNA, 18 bp, Homo sapiens
taggctttcaaaataagg

SEQ ID NO: 5510646 - DNA, 14 bp, Homo sapiens
taggctttcagctt

SEQ ID NO: 5510647 - DNA, 15 bp, Homo sapiens
taggcttttctgcct

SEQ ID NO: 5510648 - DNA, 20 bp, Homo sapiens
tagggaaaaaaatgcttctt

SEQ ID NO: 5510649 - DNA, 21 bp, Homo sapiens
tagggaaaacacggccctcct

SEQ ID NO: 5510650 - DNA, 13 bp, Homo sapiens
tagggaaaacatt

SEQ ID NO: 5510651 - DNA, 16 bp, Homo sapiens
tagggaaaccttggag

SEQ ID NO: 5510652 - DNA, 14 bp, Homo sapiens
tagggaaaggtttt

SEQ ID NO: 5510653 - DNA, 18 bp, Homo sapiens
tagggaaaggttttgtat

SEQ ID NO: 5510654 - DNA, 19 bp, Homo sapiens
tagggaaatccaactccag

SEQ ID NO: 5510655 - DNA, 20 bp, Homo sapiens
tagggaaatccaactccagg

SEQ ID NO: 5510656 - DNA, 15 bp, Homo sapiens
tagggaacaatttgg

SEQ ID NO: 5510657 - DNA, 13 bp, Homo sapiens
tagggaactctgg

SEQ ID NO: 5510658 - DNA, 15 bp, Homo sapiens
tagggaactggggaa

SEQ ID NO: 5510659 - DNA, 12 bp, Homo sapiens
tagggaactgta

SEQ ID NO: 5510660 - DNA, 14 bp, Homo sapiens
tagggaactttgat

SEQ ID NO: 5510661 - DNA, 14 bp, Homo sapiens
tagggaagcaggga

SEQ ID NO: 5510662 - DNA, 15 bp, Homo sapiens
tagggaagcagggac

SEQ ID NO: 5510663 - DNA, 20 bp, Homo sapiens
tagggaagggtggtggagcc

SEQ ID NO: 5510664 - DNA, 21 bp, Homo sapiens
tagggaagggtggtggagcca

SEQ ID NO: 5510665 - DNA, 14 bp, Homo sapiens
tagggaagtaacag

SEQ ID NO: 5510666 - DNA, 22 bp, Homo sapiens
tagggaataaaatcctaagaca

SEQ ID NO: 5510667 - DNA, 21 bp, Homo sapiens
tagggaatatgtaagtcagga

SEQ ID NO: 5510668 - DNA, 14 bp, Homo sapiens
tagggaatctggat

SEQ ID NO: 5510669 - DNA, 16 bp, Homo sapiens
tagggaatctggatta

SEQ ID NO: 5510670 - DNA, 21 bp, Homo sapiens
tagggaatgagagttccttct

SEQ ID NO: 5510671 - DNA, 21 bp, Homo sapiens
tagggaatggcacagcccaaa

SEQ ID NO: 5510672 - DNA, 20 bp, Homo sapiens
tagggacaggaccccagctc

SEQ ID NO: 5510673 - DNA, 21 bp, Homo sapiens
tagggacaggaccccagctct

SEQ ID NO: 5510674 - DNA, 22 bp, Homo sapiens
tagggacaggaccccagctctg

SEQ ID NO: 5510675 - DNA, 14 bp, Homo sapiens
tagggaccagaacc

SEQ ID NO: 5510676 - DNA, 15 bp, Homo sapiens
tagggacccctcctc

SEQ ID NO: 5510677 - DNA, 15 bp, Homo sapiens
tagggacctttaaaa

SEQ ID NO: 5510678 - DNA, 17 bp, Homo sapiens
tagggactgaccagcag

SEQ ID NO: 5510679 - DNA, 16 bp, Homo sapiens
tagggagacagggtag

SEQ ID NO: 5510680 - DNA, 18 bp, Homo sapiens
tagggagacccaataaag

SEQ ID NO: 5510681 - DNA, 16 bp, Homo sapiens
tagggagagagaagca

SEQ ID NO: 5510682 - DNA, 13 bp, Homo sapiens
tagggagagggaa

SEQ ID NO: 5510683 - DNA, 17 bp, Homo sapiens
tagggagagtcatattt

SEQ ID NO: 5510684 - DNA, 19 bp, Homo sapiens
tagggagatggagaaaatg

SEQ ID NO: 5510685 - DNA, 11 bp, Homo sapiens
tagggagcctc

SEQ ID NO: 5510686 - DNA, 20 bp, Homo sapiens
tagggagcctcccctccctg

SEQ ID NO: 5510687 - DNA, 23 bp, Homo sapiens
tagggaggaccagggcagggcca

SEQ ID NO: 5510688 - DNA, 13 bp, Homo sapiens
tagggaggcagcc

SEQ ID NO: 5510689 - DNA, 21 bp, Homo sapiens
tagggaggcctttagcttaag

SEQ ID NO: 5510690 - DNA, 19 bp, Homo sapiens
tagggagtggttcctgtgg

SEQ ID NO: 5510691 - DNA, 20 bp, Homo sapiens
tagggataagaattgtctct

SEQ ID NO: 5510692 - DNA, 13 bp, Homo sapiens
tagggataattta

SEQ ID NO: 5510693 - DNA, 13 bp, Homo sapiens
tagggatctgggg

SEQ ID NO: 5510694 - DNA, 22 bp, Homo sapiens
tagggatctggggaaggaccaa

SEQ ID NO: 5510695 - DNA, 18 bp, Homo sapiens
tagggatgttctggccct

SEQ ID NO: 5510696 - DNA, 19 bp, Homo sapiens
tagggattgtccctgtgtt

SEQ ID NO: 5510697 - DNA, 18 bp, Homo sapiens
tagggcaattaattcctt

SEQ ID NO: 5510698 - DNA, 23 bp, Homo sapiens
tagggcaattaattccttcagca

SEQ ID NO: 5510699 - DNA, 20 bp, Homo sapiens
tagggcacatgaaaaatttt

SEQ ID NO: 5510700 - DNA, 11 bp, Homo sapiens
tagggcagagt

SEQ ID NO: 5510701 - DNA, 16 bp, Homo sapiens
tagggcattgtatctg

SEQ ID NO: 5510702 - DNA, 18 bp, Homo sapiens
tagggcatttgagaaatg

SEQ ID NO: 5510703 - DNA, 16 bp, Homo sapiens
tagggcatttttcttg

SEQ ID NO: 5510704 - DNA, 20 bp, Homo sapiens
tagggcatttttcttggatc

SEQ ID NO: 5510705 - DNA, 11 bp, Homo sapiens
tagggccaggc

SEQ ID NO: 5510706 - DNA, 20 bp, Homo sapiens
tagggccctgacaggccttc

SEQ ID NO: 5510707 - DNA, 16 bp, Homo sapiens
tagggccctggaggcg

SEQ ID NO: 5510708 - DNA, 14 bp, Homo sapiens
tagggcctcggagg

SEQ ID NO: 5510709 - DNA, 16 bp, Homo sapiens
tagggcctcggaggct

SEQ ID NO: 5510710 - DNA, 19 bp, Homo sapiens
tagggcctcggaggctcct

SEQ ID NO: 5510711 - DNA, 21 bp, Homo sapiens
tagggcctggtccctgggagg

SEQ ID NO: 5510712 - DNA, 16 bp, Homo sapiens
tagggccttttctgtg

SEQ ID NO: 5510713 - DNA, 17 bp, Homo sapiens
tagggctaaatgtttaa

SEQ ID NO: 5510714 - DNA, 20 bp, Homo sapiens
tagggctaaatgtttaaaga

SEQ ID NO: 5510715 - DNA, 14 bp, Homo sapiens
tagggctgctgctt

SEQ ID NO: 5510716 - DNA, 20 bp, Homo sapiens
tagggctgctgcttctgctc

SEQ ID NO: 5510717 - DNA, 21 bp, Homo sapiens
tagggctgctgcttctgctcc

SEQ ID NO: 5510718 - DNA, 19 bp, Homo sapiens
tagggctggctggaggaag

SEQ ID NO: 5510719 - DNA, 16 bp, Homo sapiens
tagggctggggactgg

SEQ ID NO: 5510720 - DNA, 18 bp, Homo sapiens
tagggcttatggccaggg

SEQ ID NO: 5510721 - DNA, 22 bp, Homo sapiens
tagggctttgtaaactccacag

SEQ ID NO: 5510722 - DNA, 20 bp, Homo sapiens
tagggcttttattttttctt

SEQ ID NO: 5510723 - DNA, 15 bp, Homo sapiens
taggggaacagacca

SEQ ID NO: 5510724 - DNA, 15 bp, Homo sapiens
taggggaagaataat

SEQ ID NO: 5510725 - DNA, 18 bp, Homo sapiens
taggggaaggagaagtaa

SEQ ID NO: 5510726 - DNA, 15 bp, Homo sapiens
taggggaagtgtgct

SEQ ID NO: 5510727 - DNA, 16 bp, Homo sapiens
taggggaagtgtgctg

SEQ ID NO: 5510728 - DNA, 17 bp, Homo sapiens
taggggaatgagggggc

SEQ ID NO: 5510729 - DNA, 15 bp, Homo sapiens
taggggacttgggga

SEQ ID NO: 5510730 - DNA, 15 bp, Homo sapiens
taggggagggcaggc

SEQ ID NO: 5510731 - DNA, 21 bp, Homo sapiens
taggggaggggctcctttcca

SEQ ID NO: 5510732 - DNA, 20 bp, Homo sapiens
taggggaggggggagccaga

SEQ ID NO: 5510733 - DNA, 14 bp, Homo sapiens
taggggagtgtggg

SEQ ID NO: 5510734 - DNA, 15 bp, Homo sapiens
taggggatggggagg

SEQ ID NO: 5510735 - DNA, 15 bp, Homo sapiens
taggggattttaaaa

SEQ ID NO: 5510736 - DNA, 17 bp, Homo sapiens
taggggcaaaaatttga

SEQ ID NO: 5510737 - DNA, 12 bp, Homo sapiens
taggggccacct

SEQ ID NO: 5510738 - DNA, 18 bp, Homo sapiens
taggggccacctcctccc

SEQ ID NO: 5510739 - DNA, 22 bp, Homo sapiens
taggggccacctcctccccctg

SEQ ID NO: 5510740 - DNA, 19 bp, Homo sapiens
taggggcccctctcagccc

SEQ ID NO: 5510741 - DNA, 23 bp, Homo sapiens
taggggcccctctcagccctcac

SEQ ID NO: 5510742 - DNA, 21 bp, Homo sapiens
taggggccgagtccaggagcc

SEQ ID NO: 5510743 - DNA, 14 bp, Homo sapiens
taggggctgcaggg

SEQ ID NO: 5510744 - DNA, 21 bp, Homo sapiens
taggggcttataataaaggac

SEQ ID NO: 5510745 - DNA, 13 bp, Homo sapiens
tagggggctgcac

SEQ ID NO: 5510746 - DNA, 14 bp, Homo sapiens
tagggggctgcacg

SEQ ID NO: 5510747 - DNA, 15 bp, Homo sapiens
tagggggctgcacgg

SEQ ID NO: 5510748 - DNA, 18 bp, Homo sapiens
tagggggctggaggagcc

SEQ ID NO: 5510749 - DNA, 16 bp, Homo sapiens
tagggggtgggagggg

SEQ ID NO: 5510750 - DNA, 15 bp, Homo sapiens
tagggggtgtcagaa

SEQ ID NO: 5510751 - DNA, 17 bp, Homo sapiens
taggggtaccactgaat

SEQ ID NO: 5510752 - DNA, 15 bp, Homo sapiens
taggggtagggagcc

SEQ ID NO: 5510753 - DNA, 17 bp, Homo sapiens
taggggtagggagcctc

SEQ ID NO: 5510754 - DNA, 23 bp, Homo sapiens
taggggtgcgctcacctgcagcc

SEQ ID NO: 5510755 - DNA, 11 bp, Homo sapiens
taggggtgggg

SEQ ID NO: 5510756 - DNA, 14 bp, Homo sapiens
taggggtgggggag

SEQ ID NO: 5510757 - DNA, 19 bp, Homo sapiens
taggggtgggggagaatgg

SEQ ID NO: 5510758 - DNA, 17 bp, Homo sapiens
taggggtgttgacacac

SEQ ID NO: 5510759 - DNA, 15 bp, Homo sapiens
taggggttctattta

SEQ ID NO: 5510760 - DNA, 13 bp, Homo sapiens
taggggttgctaa

SEQ ID NO: 5510761 - DNA, 22 bp, Homo sapiens
tagggtaaatcagtaagaggtg

SEQ ID NO: 5510762 - DNA, 15 bp, Homo sapiens
tagggtaaggtgcct

SEQ ID NO: 5510763 - DNA, 20 bp, Homo sapiens
tagggtactaaatttaaatt

SEQ ID NO: 5510764 - DNA, 18 bp, Homo sapiens
tagggtagaatgattaat

SEQ ID NO: 5510765 - DNA, 18 bp, Homo sapiens
tagggtataatgtgtctg

SEQ ID NO: 5510766 - DNA, 15 bp, Homo sapiens
tagggtatgatcctt

SEQ ID NO: 5510767 - DNA, 18 bp, Homo sapiens
tagggtccactttggtaa

SEQ ID NO: 5510768 - DNA, 14 bp, Homo sapiens
tagggtcctcaggc

SEQ ID NO: 5510769 - DNA, 18 bp, Homo sapiens
tagggtcctcaggcagtg

SEQ ID NO: 5510770 - DNA, 23 bp, Homo sapiens
tagggtcctcaggcagtggccca

SEQ ID NO: 5510771 - DNA, 17 bp, Homo sapiens
tagggtcctggccctct

SEQ ID NO: 5510772 - DNA, 18 bp, Homo sapiens
tagggtctaccaatacaa

SEQ ID NO: 5510773 - DNA, 19 bp, Homo sapiens
tagggtctgcagcctgctg

SEQ ID NO: 5510774 - DNA, 22 bp, Homo sapiens
tagggtctgcagcctgctgggg

SEQ ID NO: 5510775 - DNA, 24 bp, Homo sapiens
tagggtctgcagcctgctggggct

SEQ ID NO: 5510776 - DNA, 16 bp, Homo sapiens
tagggtctgtcccggg

SEQ ID NO: 5510777 - DNA, 13 bp, Homo sapiens
tagggtctttctt

SEQ ID NO: 5510778 - DNA, 22 bp, Homo sapiens
tagggtgctctgaatctgtaca

SEQ ID NO: 5510779 - DNA, 16 bp, Homo sapiens
tagggtggacagaagc

SEQ ID NO: 5510780 - DNA, 16 bp, Homo sapiens
tagggtggagagccac

SEQ ID NO: 5510781 - DNA, 17 bp, Homo sapiens
tagggtggcacatctgt

SEQ ID NO: 5510782 - DNA, 21 bp, Homo sapiens
tagggtggcacatctgtcctg

SEQ ID NO: 5510783 - DNA, 15 bp, Homo sapiens
tagggtggcactggg

SEQ ID NO: 5510784 - DNA, 19 bp, Homo sapiens
tagggtggctttaattgta

SEQ ID NO: 5510785 - DNA, 19 bp, Homo sapiens
tagggtgggtaagaaagcc

SEQ ID NO: 5510786 - DNA, 15 bp, Homo sapiens
tagggtgtgtgttca

SEQ ID NO: 5510787 - DNA, 17 bp, Homo sapiens
tagggtgttctggcttt

SEQ ID NO: 5510788 - DNA, 13 bp, Homo sapiens
tagggtgttttaa

SEQ ID NO: 5510789 - DNA, 15 bp, Homo sapiens
tagggttataataat

SEQ ID NO: 5510790 - DNA, 13 bp, Homo sapiens
tagggttatattt

SEQ ID NO: 5510791 - DNA, 13 bp, Homo sapiens
tagggttctaaat

SEQ ID NO: 5510792 - DNA, 18 bp, Homo sapiens
tagggttctaaatgcaat

SEQ ID NO: 5510793 - DNA, 19 bp, Homo sapiens
tagggttctatatttactg

SEQ ID NO: 5510794 - DNA, 21 bp, Homo sapiens
tagggttctgatcacattgca

SEQ ID NO: 5510795 - DNA, 14 bp, Homo sapiens
tagggttctgcctc

SEQ ID NO: 5510796 - DNA, 15 bp, Homo sapiens
tagggttctgcctct

SEQ ID NO: 5510797 - DNA, 13 bp, Homo sapiens
tagggttctgctt

SEQ ID NO: 5510798 - DNA, 19 bp, Homo sapiens
tagggttctgcttttaagt

SEQ ID NO: 5510799 - DNA, 18 bp, Homo sapiens
tagggttgctggagcctg

SEQ ID NO: 5510800 - DNA, 16 bp, Homo sapiens
tagggtttagccgggc

SEQ ID NO: 5510801 - DNA, 18 bp, Homo sapiens
tagggtttggaagaaagg

SEQ ID NO: 5510802 - DNA, 16 bp, Homo sapiens
tagggtttggacagac

SEQ ID NO: 5510803 - DNA, 19 bp, Homo sapiens
tagggtttgtgacagggcg

SEQ ID NO: 5510804 - DNA, 18 bp, Homo sapiens
tagggtttgtttgctgct

SEQ ID NO: 5510805 - DNA, 17 bp, Homo sapiens
tagggttttctatttct

SEQ ID NO: 5510806 - DNA, 19 bp, Homo sapiens
tagggttttgcaataactt

SEQ ID NO: 5510807 - DNA, 16 bp, Homo sapiens
tagggttttggcctgc

SEQ ID NO: 5510808 - DNA, 21 bp, Homo sapiens
tagggttttttcttctttctt

SEQ ID NO: 5510809 - DNA, 22 bp, Homo sapiens
tagggttttttttaatgtgaat

SEQ ID NO: 5510810 - DNA, 14 bp, Homo sapiens
taggtaaaatgtat

SEQ ID NO: 5510811 - DNA, 15 bp, Homo sapiens
taggtaaaatgtatt

SEQ ID NO: 5510812 - DNA, 16 bp, Homo sapiens
taggtaaaatgtattt

SEQ ID NO: 5510813 - DNA, 14 bp, Homo sapiens
taggtaaataaagc

SEQ ID NO: 5510814 - DNA, 15 bp, Homo sapiens
taggtaaataaagct

SEQ ID NO: 5510815 - DNA, 18 bp, Homo sapiens
taggtaaataaagctcaa

SEQ ID NO: 5510816 - DNA, 12 bp, Homo sapiens
taggtaaatcta

SEQ ID NO: 5510817 - DNA, 22 bp, Homo sapiens
taggtaaccttatatttacaat

SEQ ID NO: 5510818 - DNA, 19 bp, Homo sapiens
taggtaacttattagaaac

SEQ ID NO: 5510819 - DNA, 15 bp, Homo sapiens
taggtaagctgtgcc

SEQ ID NO: 5510820 - DNA, 13 bp, Homo sapiens
taggtaagtgggg

SEQ ID NO: 5510821 - DNA, 17 bp, Homo sapiens
taggtaatctataacta

SEQ ID NO: 5510822 - DNA, 13 bp, Homo sapiens
taggtaatgatta

SEQ ID NO: 5510823 - DNA, 14 bp, Homo sapiens
taggtaatgattat

SEQ ID NO: 5510824 - DNA, 15 bp, Homo sapiens
taggtaatgttttgt

SEQ ID NO: 5510825 - DNA, 17 bp, Homo sapiens
taggtaatgttttgtat

SEQ ID NO: 5510826 - DNA, 18 bp, Homo sapiens
taggtactttttgtgaag

SEQ ID NO: 5510827 - DNA, 15 bp, Homo sapiens
taggtagaattgtgg

SEQ ID NO: 5510828 - DNA, 15 bp, Homo sapiens
taggtagactttgct

SEQ ID NO: 5510829 - DNA, 14 bp, Homo sapiens
taggtagatgttca

SEQ ID NO: 5510830 - DNA, 15 bp, Homo sapiens
taggtagatgttcag

SEQ ID NO: 5510831 - DNA, 23 bp, Homo sapiens
taggtagccttgtgttctgagta

SEQ ID NO: 5510832 - DNA, 14 bp, Homo sapiens
taggtaggaaatgt

SEQ ID NO: 5510833 - DNA, 16 bp, Homo sapiens
taggtagtaccaaaat

SEQ ID NO: 5510834 - DNA, 20 bp, Homo sapiens
taggtagtcatgctgtgcat

SEQ ID NO: 5510835 - DNA, 17 bp, Homo sapiens
taggtataaaaaataag

SEQ ID NO: 5510836 - DNA, 17 bp, Homo sapiens
taggtatacaaaagact

SEQ ID NO: 5510837 - DNA, 14 bp, Homo sapiens
taggtatctttata

SEQ ID NO: 5510838 - DNA, 14 bp, Homo sapiens
taggtatgtttgca

SEQ ID NO: 5510839 - DNA, 16 bp, Homo sapiens
taggtattgtctactc

SEQ ID NO: 5510840 - DNA, 16 bp, Homo sapiens
taggtatttaagactg

SEQ ID NO: 5510841 - DNA, 14 bp, Homo sapiens
taggtatttcaaaa

SEQ ID NO: 5510842 - DNA, 21 bp, Homo sapiens
taggtatttctaacgccagca

SEQ ID NO: 5510843 - DNA, 11 bp, Homo sapiens
taggtattttg

SEQ ID NO: 5510844 - DNA, 18 bp, Homo sapiens
taggtcaattttttttct

SEQ ID NO: 5510845 - DNA, 14 bp, Homo sapiens
taggtcactggctc

SEQ ID NO: 5510846 - DNA, 24 bp, Homo sapiens
taggtcactggctctccaagtgcc

SEQ ID NO: 5510847 - DNA, 14 bp, Homo sapiens
taggtcacttgaag

SEQ ID NO: 5510848 - DNA, 17 bp, Homo sapiens
taggtcacttgaagcca

SEQ ID NO: 5510849 - DNA, 18 bp, Homo sapiens
taggtcagatatttgaga

SEQ ID NO: 5510850 - DNA, 20 bp, Homo sapiens
taggtcatgatttctgtgaa

SEQ ID NO: 5510851 - DNA, 12 bp, Homo sapiens
taggtcattttc

SEQ ID NO: 5510852 - DNA, 19 bp, Homo sapiens
taggtcattttcagtgact

SEQ ID NO: 5510853 - DNA, 22 bp, Homo sapiens
taggtccaagccccccacacct

SEQ ID NO: 5510854 - DNA, 17 bp, Homo sapiens
taggtccacttcaatgt

SEQ ID NO: 5510855 - DNA, 21 bp, Homo sapiens
taggtccagatccgctccagc

SEQ ID NO: 5510856 - DNA, 23 bp, Homo sapiens
taggtcccaattcggggcctgct

SEQ ID NO: 5510857 - DNA, 18 bp, Homo sapiens
taggtcccggccagctct

SEQ ID NO: 5510858 - DNA, 19 bp, Homo sapiens
taggtcccggccagctctg

SEQ ID NO: 5510859 - DNA, 14 bp, Homo sapiens
taggtccctgacat

SEQ ID NO: 5510860 - DNA, 20 bp, Homo sapiens
taggtcctcacttctgtctc

SEQ ID NO: 5510861 - DNA, 21 bp, Homo sapiens
taggtcctcacttctgtctcc

SEQ ID NO: 5510862 - DNA, 19 bp, Homo sapiens
taggtcctcacttggggga

SEQ ID NO: 5510863 - DNA, 12 bp, Homo sapiens
taggtcctggct

SEQ ID NO: 5510864 - DNA, 15 bp, Homo sapiens
taggtcctttagaaa

SEQ ID NO: 5510865 - DNA, 16 bp, Homo sapiens
taggtcctttagaaac

SEQ ID NO: 5510866 - DNA, 19 bp, Homo sapiens
taggtcgggtgttaaagtt

SEQ ID NO: 5510867 - DNA, 19 bp, Homo sapiens
taggtcgttttccaaagag

SEQ ID NO: 5510868 - DNA, 19 bp, Homo sapiens
taggtctatgatgtccaaa

SEQ ID NO: 5510869 - DNA, 15 bp, Homo sapiens
taggtctcaatattt

SEQ ID NO: 5510870 - DNA, 13 bp, Homo sapiens
taggtctcatctc

SEQ ID NO: 5510871 - DNA, 18 bp, Homo sapiens
taggtctcatctcttcag

SEQ ID NO: 5510872 - DNA, 12 bp, Homo sapiens
taggtctccacc

SEQ ID NO: 5510873 - DNA, 16 bp, Homo sapiens
taggtctccacccctc

SEQ ID NO: 5510874 - DNA, 23 bp, Homo sapiens
taggtctccacccctcaagccag

SEQ ID NO: 5510875 - DNA, 20 bp, Homo sapiens
taggtctcctcagggtgggg

SEQ ID NO: 5510876 - DNA, 18 bp, Homo sapiens
taggtctcttctcccaga

SEQ ID NO: 5510877 - DNA, 15 bp, Homo sapiens
taggtctgaaggcct

SEQ ID NO: 5510878 - DNA, 23 bp, Homo sapiens
taggtctgaccaaaaccagaggg

SEQ ID NO: 5510879 - DNA, 17 bp, Homo sapiens
taggtctgatattcaaa

SEQ ID NO: 5510880 - DNA, 14 bp, Homo sapiens
taggtctgcatttt

SEQ ID NO: 5510881 - DNA, 17 bp, Homo sapiens
taggtctgcattttctc

SEQ ID NO: 5510882 - DNA, 13 bp, Homo sapiens
taggtcttgctgg

SEQ ID NO: 5510883 - DNA, 15 bp, Homo sapiens
taggtctttctctca

SEQ ID NO: 5510884 - DNA, 17 bp, Homo sapiens
taggtgaaagaacaagt

SEQ ID NO: 5510885 - DNA, 17 bp, Homo sapiens
taggtgaaagtgtaata

SEQ ID NO: 5510886 - DNA, 16 bp, Homo sapiens
taggtgaaggcagaag

SEQ ID NO: 5510887 - DNA, 15 bp, Homo sapiens
taggtgaagggatgg

SEQ ID NO: 5510888 - DNA, 22 bp, Homo sapiens
taggtgaagggatgggggaaga

SEQ ID NO: 5510889 - DNA, 11 bp, Homo sapiens
taggtgacaga

SEQ ID NO: 5510890 - DNA, 16 bp, Homo sapiens
taggtgacagagtgag

SEQ ID NO: 5510891 - DNA, 16 bp, Homo sapiens
taggtgacatgtctac

SEQ ID NO: 5510892 - DNA, 14 bp, Homo sapiens
taggtgagcctggg

SEQ ID NO: 5510893 - DNA, 16 bp, Homo sapiens
taggtgagcctgggca

SEQ ID NO: 5510894 - DNA, 17 bp, Homo sapiens
taggtgagcctgggcag

SEQ ID NO: 5510895 - DNA, 21 bp, Homo sapiens
taggtgatccactcgccttca

SEQ ID NO: 5510896 - DNA, 21 bp, Homo sapiens
taggtgatctcatttaatcct

SEQ ID NO: 5510897 - DNA, 20 bp, Homo sapiens
taggtgatgtttccagctgc

SEQ ID NO: 5510898 - DNA, 21 bp, Homo sapiens
taggtgatgtttccagctgcc

SEQ ID NO: 5510899 - DNA, 23 bp, Homo sapiens
taggtgcaaaaataaaaggaaaa

SEQ ID NO: 5510900 - DNA, 22 bp, Homo sapiens
taggtgcaatttcaaggttcta

SEQ ID NO: 5510901 - DNA, 13 bp, Homo sapiens
taggtgcccaggg

SEQ ID NO: 5510902 - DNA, 16 bp, Homo sapiens
taggtgcccagggcca

SEQ ID NO: 5510903 - DNA, 19 bp, Homo sapiens
taggtgcccagtcttgagt

SEQ ID NO: 5510904 - DNA, 23 bp, Homo sapiens
taggtgcccagtcttgagtgggc

SEQ ID NO: 5510905 - DNA, 19 bp, Homo sapiens
taggtgcccttggaggcca

SEQ ID NO: 5510906 - DNA, 13 bp, Homo sapiens
taggtgcctcctg

SEQ ID NO: 5510907 - DNA, 16 bp, Homo sapiens
taggtgcctcctgtct

SEQ ID NO: 5510908 - DNA, 19 bp, Homo sapiens
taggtgctaattaataaag

SEQ ID NO: 5510909 - DNA, 22 bp, Homo sapiens
taggtgctacaaaaacacagca

SEQ ID NO: 5510910 - DNA, 19 bp, Homo sapiens
taggtgctatttgtcatct

SEQ ID NO: 5510911 - DNA, 16 bp, Homo sapiens
taggtgctcataacta

SEQ ID NO: 5510912 - DNA, 14 bp, Homo sapiens
taggtgctggcctc

SEQ ID NO: 5510913 - DNA, 13 bp, Homo sapiens
taggtggagaggt

SEQ ID NO: 5510914 - DNA, 15 bp, Homo sapiens
taggtggcaaggctg

SEQ ID NO: 5510915 - DNA, 15 bp, Homo sapiens
taggtggcagggctg

SEQ ID NO: 5510916 - DNA, 20 bp, Homo sapiens
taggtggctctgggaatggg

SEQ ID NO: 5510917 - DNA, 19 bp, Homo sapiens
taggtgggagccaccactc

SEQ ID NO: 5510918 - DNA, 23 bp, Homo sapiens
taggtgggagccaccactcctgc

SEQ ID NO: 5510919 - DNA, 23 bp, Homo sapiens
taggtgggccagcccctcccacc

SEQ ID NO: 5510920 - DNA, 20 bp, Homo sapiens
taggtgggttgaaagccaag

SEQ ID NO: 5510921 - DNA, 14 bp, Homo sapiens
taggtgtctctggg

SEQ ID NO: 5510922 - DNA, 15 bp, Homo sapiens
taggtgtctctgggc

SEQ ID NO: 5510923 - DNA, 20 bp, Homo sapiens
taggtgtctctgggcctgtg

SEQ ID NO: 5510924 - DNA, 13 bp, Homo sapiens
taggtgtctttta

SEQ ID NO: 5510925 - DNA, 23 bp, Homo sapiens
taggtgtcttttaatgatactgt

SEQ ID NO: 5510926 - DNA, 19 bp, Homo sapiens
taggtgtgactgaatttct

SEQ ID NO: 5510927 - DNA, 18 bp, Homo sapiens
taggtgtgtgtgtccaga

SEQ ID NO: 5510928 - DNA, 20 bp, Homo sapiens
taggttaaaaaaaaaagtca

SEQ ID NO: 5510929 - DNA, 17 bp, Homo sapiens
taggttaaagctaaact

SEQ ID NO: 5510930 - DNA, 15 bp, Homo sapiens
taggttaaaggccag

SEQ ID NO: 5510931 - DNA, 12 bp, Homo sapiens
taggttaagtct

SEQ ID NO: 5510932 - DNA, 15 bp, Homo sapiens
taggttaataaagat

SEQ ID NO: 5510933 - DNA, 15 bp, Homo sapiens
taggttactacctat

SEQ ID NO: 5510934 - DNA, 12 bp, Homo sapiens
taggttataaga

SEQ ID NO: 5510935 - DNA, 14 bp, Homo sapiens
taggttatacaata

SEQ ID NO: 5510936 - DNA, 15 bp, Homo sapiens
taggttatacaataa

SEQ ID NO: 5510937 - DNA, 21 bp, Homo sapiens
taggttatacaataacccagt

SEQ ID NO: 5510938 - DNA, 20 bp, Homo sapiens
taggttattatgattagctt

SEQ ID NO: 5510939 - DNA, 14 bp, Homo sapiens
taggttcagccaag

SEQ ID NO: 5510940 - DNA, 21 bp, Homo sapiens
taggttccccagagagcaggc

SEQ ID NO: 5510941 - DNA, 23 bp, Homo sapiens
taggttccccagagagcaggcag

SEQ ID NO: 5510942 - DNA, 22 bp, Homo sapiens
taggttccctgttcttcctcca

SEQ ID NO: 5510943 - DNA, 13 bp, Homo sapiens
taggttctaaagt

SEQ ID NO: 5510944 - DNA, 15 bp, Homo sapiens
taggttctaaagttc

SEQ ID NO: 5510945 - DNA, 17 bp, Homo sapiens
taggttctaaagttcta

SEQ ID NO: 5510946 - DNA, 19 bp, Homo sapiens
taggttctgtagagccaat

SEQ ID NO: 5510947 - DNA, 15 bp, Homo sapiens
taggttcttaaggat

SEQ ID NO: 5510948 - DNA, 11 bp, Homo sapiens
taggttctttt

SEQ ID NO: 5510949 - DNA, 17 bp, Homo sapiens
taggttgcacactttgg

SEQ ID NO: 5510950 - DNA, 18 bp, Homo sapiens
taggttgcacactttggt

SEQ ID NO: 5510951 - DNA, 23 bp, Homo sapiens
taggttggagatgacagaaatat

SEQ ID NO: 5510952 - DNA, 21 bp, Homo sapiens
taggttggcaaaaaggcagga

SEQ ID NO: 5510953 - DNA, 14 bp, Homo sapiens
taggttgtagcaga

SEQ ID NO: 5510954 - DNA, 17 bp, Homo sapiens
taggttgtccatttatg

SEQ ID NO: 5510955 - DNA, 22 bp, Homo sapiens
taggttgtttttaaaaccacta

SEQ ID NO: 5510956 - DNA, 19 bp, Homo sapiens
taggtttaaaacagcctgg

SEQ ID NO: 5510957 - DNA, 18 bp, Homo sapiens
taggtttaacataaaggt

SEQ ID NO: 5510958 - DNA, 21 bp, Homo sapiens
taggtttaactcagatcacta

SEQ ID NO: 5510959 - DNA, 13 bp, Homo sapiens
taggtttactgtg

SEQ ID NO: 5510960 - DNA, 18 bp, Homo sapiens
tagtctttgccagtcatt

SEQ ID NO: 5510961 - DNA, 24 bp, Homo sapiens
tagtctttgtttacatgagttcaa

SEQ ID NO: 5510962 - DNA, 13 bp, Homo sapiens
tagtcttttgctt

SEQ ID NO: 5510963 - DNA, 17 bp, Homo sapiens
tagtcttttgcttttgc

SEQ ID NO: 5510964 - DNA, 20 bp, Homo sapiens
tagtgaaaattgtttagtga

SEQ ID NO: 5510965 - DNA, 17 bp, Homo sapiens
tagtgaaacataataat

SEQ ID NO: 5510966 - DNA, 19 bp, Homo sapiens
tagtgaaacatgtactttg

SEQ ID NO: 5510967 - DNA, 14 bp, Homo sapiens
tagtgaaacttttc

SEQ ID NO: 5510968 - DNA, 23 bp, Homo sapiens
tagtgaaataaattctgattctt

SEQ ID NO: 5510969 - DNA, 17 bp, Homo sapiens
tagtgaaatggctgggg

SEQ ID NO: 5510970 - DNA, 16 bp, Homo sapiens
tagtgaacaattcggt

SEQ ID NO: 5510971 - DNA, 18 bp, Homo sapiens
tagtgaactaagttattg

SEQ ID NO: 5510972 - DNA, 14 bp, Homo sapiens
tagtgaacttgaaa

SEQ ID NO: 5510973 - DNA, 17 bp, Homo sapiens
tagtgaagactccagaa

SEQ ID NO: 5510974 - DNA, 15 bp, Homo sapiens
tagtgaagatgttgt

SEQ ID NO: 5510975 - DNA, 17 bp, Homo sapiens
tagtgaagcaatttgaa

SEQ ID NO: 5510976 - DNA, 18 bp, Homo sapiens
tagtgaagctctcaccca

SEQ ID NO: 5510977 - DNA, 19 bp, Homo sapiens
tagtgaaggcttctctctg

SEQ ID NO: 5510978 - DNA, 21 bp, Homo sapiens
tagtgaaggcttctctctgtg

SEQ ID NO: 5510979 - DNA, 21 bp, Homo sapiens
tagtgaatcacgtaaagctag

SEQ ID NO: 5510980 - DNA, 20 bp, Homo sapiens
tagtgaattggcttccttga

SEQ ID NO: 5510981 - DNA, 17 bp, Homo sapiens
tagtgaattttaaaatg

SEQ ID NO: 5510982 - DNA, 22 bp, Homo sapiens
tagtgaattttaaaatgtagaa

SEQ ID NO: 5510983 - DNA, 16 bp, Homo sapiens
tagtgacaaaaataaa

SEQ ID NO: 5510984 - DNA, 17 bp, Homo sapiens
tagtgacacacactgtc

SEQ ID NO: 5510985 - DNA, 13 bp, Homo sapiens
tagtgacaggttt

SEQ ID NO: 5510986 - DNA, 11 bp, Homo sapiens
tagtgacattt

SEQ ID NO: 5510987 - DNA, 17 bp, Homo sapiens
tagtgacatttaatgcc

SEQ ID NO: 5510988 - DNA, 19 bp, Homo sapiens
tagtgacatttaatgccat

SEQ ID NO: 5510989 - DNA, 10 bp, Homo sapiens
tagtgaccaa

SEQ ID NO: 5510990 - DNA, 21 bp, Homo sapiens
tagtgaccaatcgggagtagc

SEQ ID NO: 5510991 - DNA, 22 bp, Homo sapiens
tagtgaccatcttcataatttg

SEQ ID NO: 5510992 - DNA, 15 bp, Homo sapiens
tagtgacccacatgc

SEQ ID NO: 5510993 - DNA, 17 bp, Homo sapiens
tagtgacccggaggcca

SEQ ID NO: 5510994 - DNA, 17 bp, Homo sapiens
tagtgacctgtgtttca

SEQ ID NO: 5510995 - DNA, 23 bp, Homo sapiens
tagtgactaaaccattgtgcatt

SEQ ID NO: 5510996 - DNA, 14 bp, Homo sapiens
tagtgacttcctgg

SEQ ID NO: 5510997 - DNA, 16 bp, Homo sapiens
tagtgacttgtgtccc

SEQ ID NO: 5510998 - DNA, 19 bp, Homo sapiens
tagtgacttttcaagtatt

SEQ ID NO: 5510999 - DNA, 18 bp, Homo sapiens
tagtgagaagaatattgt

SEQ ID NO: 5511000 - DNA, 18 bp, Homo sapiens
tagtgagacccctgtctc

SEQ ID NO: 5511001 - DNA, 15 bp, Homo sapiens
tagtgagattaaaaa

SEQ ID NO: 5511002 - DNA, 12 bp, Homo sapiens
tagtgagccaag

SEQ ID NO: 5511003 - DNA, 17 bp, Homo sapiens
tagtgagccatgatttt

SEQ ID NO: 5511004 - DNA, 20 bp, Homo sapiens
tagtgagcgagtggatgctg

SEQ ID NO: 5511005 - DNA, 19 bp, Homo sapiens
tagtgaggaagacaagcat

SEQ ID NO: 5511006 - DNA, 20 bp, Homo sapiens
tagtgaggaagacaagcatt

SEQ ID NO: 5511007 - DNA, 18 bp, Homo sapiens
tagtgagttgcatgtttt

SEQ ID NO: 5511008 - DNA, 13 bp, Homo sapiens
tagtgatagatgt

SEQ ID NO: 5511009 - DNA, 17 bp, Homo sapiens
tagtgatatttctctag

SEQ ID NO: 5511010 - DNA, 17 bp, Homo sapiens
tagtgatctattttgag

SEQ ID NO: 5511011 - DNA, 21 bp, Homo sapiens
tagtgatggagttccttctgg

SEQ ID NO: 5511012 - DNA, 21 bp, Homo sapiens
tagtgatgtccttaaaatgtg

SEQ ID NO: 5511013 - DNA, 20 bp, Homo sapiens
tagtgatgttgtttgggaga

SEQ ID NO: 5511014 - DNA, 19 bp, Homo sapiens
tagtgattaaatatatcta

SEQ ID NO: 5511015 - DNA, 20 bp, Homo sapiens
tagtgattctgatttcagtt

SEQ ID NO: 5511016 - DNA, 14 bp, Homo sapiens
tagtgattgctttt

SEQ ID NO: 5511017 - DNA, 13 bp, Homo sapiens
tagtgattgtaac

SEQ ID NO: 5511018 - DNA, 15 bp, Homo sapiens
tagtgatttacacag

SEQ ID NO: 5511019 - DNA, 15 bp, Homo sapiens
tagtgatttcattac

SEQ ID NO: 5511020 - DNA, 21 bp, Homo sapiens
tagtgatttttatgccacctg

SEQ ID NO: 5511021 - DNA, 22 bp, Homo sapiens
tagtgatttttatgccacctga

SEQ ID NO: 5511022 - DNA, 20 bp, Homo sapiens
tagtgcaataaaactccctt

SEQ ID NO: 5511023 - DNA, 18 bp, Homo sapiens
tagtgcaatagtgcaaca

SEQ ID NO: 5511024 - DNA, 16 bp, Homo sapiens
tagtgcaatatatttt

SEQ ID NO: 5511025 - DNA, 22 bp, Homo sapiens
tagtgcaatatattttgtatgc

SEQ ID NO: 5511026 - DNA, 21 bp, Homo sapiens
tagtgcaattccaagaaaata

SEQ ID NO: 5511027 - DNA, 22 bp, Homo sapiens
tagtgcaatttcttctgtagct

SEQ ID NO: 5511028 - DNA, 15 bp, Homo sapiens
tagtgcacaaaatga

SEQ ID NO: 5511029 - DNA, 13 bp, Homo sapiens
tagtgcacacttg

SEQ ID NO: 5511030 - DNA, 16 bp, Homo sapiens
tagtgcacacttgtat

SEQ ID NO: 5511031 - DNA, 16 bp, Homo sapiens
tagtgcagagaggttg

SEQ ID NO: 5511032 - DNA, 17 bp, Homo sapiens
tagtgcagctgaaattg

SEQ ID NO: 5511033 - DNA, 20 bp, Homo sapiens
tagtgcagctgattttaaca

SEQ ID NO: 5511034 - DNA, 19 bp, Homo sapiens
tagtgcagtcaccctgtgg

SEQ ID NO: 5511035 - DNA, 23 bp, Homo sapiens
tagtgcatagaattctagctttt

SEQ ID NO: 5511036 - DNA, 22 bp, Homo sapiens
tagtgcatccagttaaccaagt

SEQ ID NO: 5511037 - DNA, 19 bp, Homo sapiens
tagtgcatctttgcctctc

SEQ ID NO: 5511038 - DNA, 21 bp, Homo sapiens
tagtgcattgtttctgtgggc

SEQ ID NO: 5511039 - DNA, 17 bp, Homo sapiens
tagtgcatttttaaact

SEQ ID NO: 5511040 - DNA, 18 bp, Homo sapiens
tagtgcatttttaaactt

SEQ ID NO: 5511041 - DNA, 19 bp, Homo sapiens
tagtgccaaaaggcccctt

SEQ ID NO: 5511042 - DNA, 20 bp, Homo sapiens
tagtgccagaattttaggaa

SEQ ID NO: 5511043 - DNA, 20 bp, Homo sapiens
tagtgccagctactcaggag

SEQ ID NO: 5511044 - DNA, 11 bp, Homo sapiens
tagtgccaggc

SEQ ID NO: 5511045 - DNA, 14 bp, Homo sapiens
tagtgccatggcca

SEQ ID NO: 5511046 - DNA, 14 bp, Homo sapiens
tagtgccccagact

SEQ ID NO: 5511047 - DNA, 14 bp, Homo sapiens
tagtgccctgcccc

SEQ ID NO: 5511048 - DNA, 15 bp, Homo sapiens
tagtgccctgccccc

SEQ ID NO: 5511049 - DNA, 20 bp, Homo sapiens
tagtgccctgccccctggct

SEQ ID NO: 5511050 - DNA, 23 bp, Homo sapiens
tagtgccgtagggagtacctgct

SEQ ID NO: 5511051 - DNA, 18 bp, Homo sapiens
tagtgcctaaaattgtat

SEQ ID NO: 5511052 - DNA, 23 bp, Homo sapiens
tagtgcctaaaattgtatgaaaa

SEQ ID NO: 5511053 - DNA, 18 bp, Homo sapiens
tagtgcctacaatgggaa

SEQ ID NO: 5511054 - DNA, 13 bp, Homo sapiens
tagtgcctcagcg

SEQ ID NO: 5511055 - DNA, 16 bp, Homo sapiens
tagtgccttctaaagg

SEQ ID NO: 5511056 - DNA, 15 bp, Homo sapiens
tagtgccttgatttt

SEQ ID NO: 5511057 - DNA, 18 bp, Homo sapiens
tagtgccttgcccacagg

SEQ ID NO: 5511058 - DNA, 22 bp, Homo sapiens
tagtgctaaacctatctgtatt

SEQ ID NO: 5511059 - DNA, 14 bp, Homo sapiens
tagtgctaagtgtg

SEQ ID NO: 5511060 - DNA, 17 bp, Homo sapiens
tagtgctaagtgtgaac

SEQ ID NO: 5511061 - DNA, 15 bp, Homo sapiens
tagtgctatatatat

SEQ ID NO: 5511062 - DNA, 15 bp, Homo sapiens
tagtgctatgtgtga

SEQ ID NO: 5511063 - DNA, 16 bp, Homo sapiens
tagtgctcagaatcca

SEQ ID NO: 5511064 - DNA, 12 bp, Homo sapiens
tagtgctgaagc

SEQ ID NO: 5511065 - DNA, 18 bp, Homo sapiens
tagtgctgcaataaacat

SEQ ID NO: 5511066 - DNA, 22 bp, Homo sapiens
tagtgctgctgaagatgaatca

SEQ ID NO: 5511067 - DNA, 18 bp, Homo sapiens
tagtgctggtcagagaga

SEQ ID NO: 5511068 - DNA, 18 bp, Homo sapiens
tagtgctggtcctaggtc

SEQ ID NO: 5511069 - DNA, 23 bp, Homo sapiens
tagtgctgtagagttcactgttg

SEQ ID NO: 5511070 - DNA, 13 bp, Homo sapiens
tagtgctgtgaaa

SEQ ID NO: 5511071 - DNA, 16 bp, Homo sapiens
tagtgctgtgaaaaaa

SEQ ID NO: 5511072 - DNA, 15 bp, Homo sapiens
tagtgcttcagagtt

SEQ ID NO: 5511073 - DNA, 13 bp, Homo sapiens
tagtgcttgctgg

SEQ ID NO: 5511074 - DNA, 18 bp, Homo sapiens
tagtgctttaagaatgaa

SEQ ID NO: 5511075 - DNA, 22 bp, Homo sapiens
tagtgctttaagaatgaacaca

SEQ ID NO: 5511076 - DNA, 15 bp, Homo sapiens
tagtggaaagattgt

SEQ ID NO: 5511077 - DNA, 14 bp, Homo sapiens
tagtggaaagtcag

SEQ ID NO: 5511078 - DNA, 18 bp, Homo sapiens
tagtggaagagcagcctg

SEQ ID NO: 5511079 - DNA, 15 bp, Homo sapiens
tagtggacatggtca

SEQ ID NO: 5511080 - DNA, 22 bp, Homo sapiens
tagtggaccacttggaaataaa

SEQ ID NO: 5511081 - DNA, 18 bp, Homo sapiens
tagtggaccctgaaatgt

SEQ ID NO: 5511082 - DNA, 19 bp, Homo sapiens
tagtggaccctgaaatgtg

SEQ ID NO: 5511083 - DNA, 14 bp, Homo sapiens
tagtggagccaggt

SEQ ID NO: 5511084 - DNA, 22 bp, Homo sapiens
tagtggaggaggtggcttcatg

SEQ ID NO: 5511085 - DNA, 21 bp, Homo sapiens
tagtggagggttggagaagga

SEQ ID NO: 5511086 - DNA, 21 bp, Homo sapiens
tagtggatgactgttgatgaa

SEQ ID NO: 5511087 - DNA, 14 bp, Homo sapiens
tagtggatggacag

SEQ ID NO: 5511088 - DNA, 18 bp, Homo sapiens
tagtggatggacagatgg

SEQ ID NO: 5511089 - DNA, 17 bp, Homo sapiens
tagtggattactgccat

SEQ ID NO: 5511090 - DNA, 19 bp, Homo sapiens
tagtggcaaaaaagaacag

SEQ ID NO: 5511091 - DNA, 17 bp, Homo sapiens
tagtggcaaagagaggt

SEQ ID NO: 5511092 - DNA, 21 bp, Homo sapiens
tagtggcataccaaatggcac

SEQ ID NO: 5511093 - DNA, 14 bp, Homo sapiens
tagtggccactggg

SEQ ID NO: 5511094 - DNA, 17 bp, Homo sapiens
tagtggccagaccagag

SEQ ID NO: 5511095 - DNA, 19 bp, Homo sapiens
tagtggccagaccagagct

SEQ ID NO: 5511096 - DNA, 13 bp, Homo sapiens
tagtggctggggt

SEQ ID NO: 5511097 - DNA, 19 bp, Homo sapiens
tagtggcttcagcccctgg

SEQ ID NO: 5511098 - DNA, 20 bp, Homo sapiens
tagtggcttcattagagcag

SEQ ID NO: 5511099 - DNA, 14 bp, Homo sapiens
tagtgggaaagata

SEQ ID NO: 5511100 - DNA, 16 bp, Homo sapiens
tagtgggaagagctgg

SEQ ID NO: 5511101 - DNA, 16 bp, Homo sapiens
tagtgggagcccagca

SEQ ID NO: 5511102 - DNA, 13 bp, Homo sapiens
tagtgggcaggtg

SEQ ID NO: 5511103 - DNA, 14 bp, Homo sapiens
tagtgggcaggtgg

SEQ ID NO: 5511104 - DNA, 16 bp, Homo sapiens
tagtggggtaattctg

SEQ ID NO: 5511105 - DNA, 21 bp, Homo sapiens
tagtggggtctccctctcctg

SEQ ID NO: 5511106 - DNA, 23 bp, Homo sapiens
tagtggggtctccctctcctgcc

SEQ ID NO: 5511107 - DNA, 12 bp, Homo sapiens
tagtgggttgac

SEQ ID NO: 5511108 - DNA, 13 bp, Homo sapiens
tagtggtatttta

SEQ ID NO: 5511109 - DNA, 21 bp, Homo sapiens
tagtggtcatttggtggctct

SEQ ID NO: 5511110 - DNA, 21 bp, Homo sapiens
tagtggtctctactgtggcaa

SEQ ID NO: 5511111 - DNA, 22 bp, Homo sapiens
tagtggtctctactgtggcaaa

SEQ ID NO: 5511112 - DNA, 15 bp, Homo sapiens
tagtggtctttgtaa

SEQ ID NO: 5511113 - DNA, 17 bp, Homo sapiens
tagtggtggctctgaga

SEQ ID NO: 5511114 - DNA, 18 bp, Homo sapiens
tagtggtggtagaaatga

SEQ ID NO: 5511115 - DNA, 13 bp, Homo sapiens
tagtgtaaaaatg

SEQ ID NO: 5511116 - DNA, 18 bp, Homo sapiens
tagtgtaaaaatgagaac

SEQ ID NO: 5511117 - DNA, 13 bp, Homo sapiens
tagtgtaaaataa

SEQ ID NO: 5511118 - DNA, 19 bp, Homo sapiens
tagtgtaaaataagaatga

SEQ ID NO: 5511119 - DNA, 14 bp, Homo sapiens
tagtgtaaacaaat

SEQ ID NO: 5511120 - DNA, 17 bp, Homo sapiens
tagtgtaagaactgtac

SEQ ID NO: 5511121 - DNA, 17 bp, Homo sapiens
tagtgtaataagactta

SEQ ID NO: 5511122 - DNA, 15 bp, Homo sapiens
tagtgtaataatgtt

SEQ ID NO: 5511123 - DNA, 22 bp, Homo sapiens
tagtgtaggataatataaaaag

SEQ ID NO: 5511124 - DNA, 23 bp, Homo sapiens
tagtgtaggctttacttagctta

SEQ ID NO: 5511125 - DNA, 18 bp, Homo sapiens
tagtgtataccacctgta

SEQ ID NO: 5511126 - DNA, 19 bp, Homo sapiens
tagtgtatcaaaatgctct

SEQ ID NO: 5511127 - DNA, 20 bp, Homo sapiens
tagtgtcaacttttaacttt

SEQ ID NO: 5511128 - DNA, 13 bp, Homo sapiens
tagtgtcacctgc

SEQ ID NO: 5511129 - DNA, 18 bp, Homo sapiens
tagtgtcacttttttcct

SEQ ID NO: 5511130 - DNA, 23 bp, Homo sapiens
tagtgtcacttttttcctgtcaa

SEQ ID NO: 5511131 - DNA, 16 bp, Homo sapiens
tagtgtccataaataa

SEQ ID NO: 5511132 - DNA, 20 bp, Homo sapiens
tagtgtccccatgggctccc

SEQ ID NO: 5511133 - DNA, 22 bp, Homo sapiens
tagtgtccccatgggctcccac

SEQ ID NO: 5511134 - DNA, 20 bp, Homo sapiens
tagtgtccccccttgaagca

SEQ ID NO: 5511135 - DNA, 21 bp, Homo sapiens
tagtgtccccccttgaagcaa

SEQ ID NO: 5511136 - DNA, 12 bp, Homo sapiens
tagtgtcctgcc

SEQ ID NO: 5511137 - DNA, 15 bp, Homo sapiens
tagtgtcctgcccac

SEQ ID NO: 5511138 - DNA, 13 bp, Homo sapiens
tagtgtctaagga

SEQ ID NO: 5511139 - DNA, 12 bp, Homo sapiens
tagtgtctgacc

SEQ ID NO: 5511140 - DNA, 21 bp, Homo sapiens
tagtgtctgggtttggcccaa

SEQ ID NO: 5511141 - DNA, 23 bp, Homo sapiens
tagtgtctgggtttggcccaaga

SEQ ID NO: 5511142 - DNA, 12 bp, Homo sapiens
tagtgtctgtcc

SEQ ID NO: 5511143 - DNA, 18 bp, Homo sapiens
tagtgtgaagatctttgg

SEQ ID NO: 5511144 - DNA, 12 bp, Homo sapiens
tagtgtgactcc

SEQ ID NO: 5511145 - DNA, 13 bp, Homo sapiens
tagtgtgactcct

SEQ ID NO: 5511146 - DNA, 20 bp, Homo sapiens
tagtgtgagtggcagccatg

SEQ ID NO: 5511147 - DNA, 19 bp, Homo sapiens
tagtgtgctcggacacagt

SEQ ID NO: 5511148 - DNA, 21 bp, Homo sapiens
tagtgtgctgctgttctgtgt

SEQ ID NO: 5511149 - DNA, 12 bp, Homo sapiens
tagtgtgtaaaa

SEQ ID NO: 5511150 - DNA, 14 bp, Homo sapiens
tagtgtgtaaaatt

SEQ ID NO: 5511151 - DNA, 17 bp, Homo sapiens
tagtgtgtgtgcatgtg

SEQ ID NO: 5511152 - DNA, 18 bp, Homo sapiens
tagtgtgtgtgcatgtgt

SEQ ID NO: 5511153 - DNA, 20 bp, Homo sapiens
tagtgtgtgttgcaaatcac

SEQ ID NO: 5511154 - DNA, 20 bp, Homo sapiens
tagtgtgttctgattagaaa

SEQ ID NO: 5511155 - DNA, 12 bp, Homo sapiens
tagtgtgttgtg

SEQ ID NO: 5511156 - DNA, 12 bp, Homo sapiens
tagtgttaatca

SEQ ID NO: 5511157 - DNA, 15 bp, Homo sapiens
tagtgttaatccaga

SEQ ID NO: 5511158 - DNA, 20 bp, Homo sapiens
tagtgttaatgactctttct

SEQ ID NO: 5511159 - DNA, 13 bp, Homo sapiens
tagtgttatatga

SEQ ID NO: 5511160 - DNA, 18 bp, Homo sapiens
tagtgttatatgaacata

SEQ ID NO: 5511161 - DNA, 17 bp, Homo sapiens
tagtgttcacaaactgt

SEQ ID NO: 5511162 - DNA, 18 bp, Homo sapiens
tagtgttcacaaactgtg

SEQ ID NO: 5511163 - DNA, 17 bp, Homo sapiens
tagtgttctgctcctgc

SEQ ID NO: 5511164 - DNA, 24 bp, Homo sapiens
tagtgttctgctcctgcttttctg

SEQ ID NO: 5511165 - DNA, 15 bp, Homo sapiens
tagtgttctgttcac

SEQ ID NO: 5511166 - DNA, 17 bp, Homo sapiens
tagtgttggagaagaac

SEQ ID NO: 5511167 - DNA, 23 bp, Homo sapiens
tagtgttggagaagaactgaaat

SEQ ID NO: 5511168 - DNA, 13 bp, Homo sapiens
tagtgttgtattt

SEQ ID NO: 5511169 - DNA, 20 bp, Homo sapiens
tagtgttgtgcacttcatgt

SEQ ID NO: 5511170 - DNA, 16 bp, Homo sapiens
tagtgtttaactggca

SEQ ID NO: 5511171 - DNA, 22 bp, Homo sapiens
tagtgttttcaattttaaacat

SEQ ID NO: 5511172 - DNA, 12 bp, Homo sapiens
tagtgttttcat

SEQ ID NO: 5511173 - DNA, 22 bp, Homo sapiens
tagtgttttcattctggtcctt

SEQ ID NO: 5511174 - DNA, 17 bp, Homo sapiens
tagtgttttgtacttgt

SEQ ID NO: 5511175 - DNA, 20 bp, Homo sapiens
tagttaaaactcatcacata

SEQ ID NO: 5511176 - DNA, 19 bp, Homo sapiens
tagttaaaagactgcagct

SEQ ID NO: 5511177 - DNA, 22 bp, Homo sapiens
tagttaaaagactgcagctgct

SEQ ID NO: 5511178 - DNA, 14 bp, Homo sapiens
tagttaaaagcctt

SEQ ID NO: 5511179 - DNA, 13 bp, Homo sapiens
tagttaaagaaag

SEQ ID NO: 5511180 - DNA, 20 bp, Homo sapiens
tagttaaatgttacctctga

SEQ ID NO: 5511181 - DNA, 19 bp, Homo sapiens
tagttaaattgaagaaagt

SEQ ID NO: 5511182 - DNA, 15 bp, Homo sapiens
tagttaaattggctt

SEQ ID NO: 5511183 - DNA, 20 bp, Homo sapiens
tagttaacacatcaaatatt

SEQ ID NO: 5511184 - DNA, 14 bp, Homo sapiens
tagttaagaattga

SEQ ID NO: 5511185 - DNA, 23 bp, Homo sapiens
tagttaagacatgatttccttga

SEQ ID NO: 5511186 - DNA, 13 bp, Homo sapiens
tagttaagtcgct

SEQ ID NO: 5511187 - DNA, 19 bp, Homo sapiens
tagttaagtcgctgaacaa

SEQ ID NO: 5511188 - DNA, 13 bp, Homo sapiens
tagttaatggatt

SEQ ID NO: 5511189 - DNA, 18 bp, Homo sapiens
tagttaattgtggcttta

SEQ ID NO: 5511190 - DNA, 14 bp, Homo sapiens
tagttaatttatct

SEQ ID NO: 5511191 - DNA, 15 bp, Homo sapiens
tagttaatttatcta

SEQ ID NO: 5511192 - DNA, 21 bp, Homo sapiens
tagttacagtaaatacactgt

SEQ ID NO: 5511193 - DNA, 22 bp, Homo sapiens
tagttacagtaaatacactgtg

SEQ ID NO: 5511194 - DNA, 23 bp, Homo sapiens
tagttacagtaaatacactgtga

SEQ ID NO: 5511195 - DNA, 14 bp, Homo sapiens
tagttacataatca

SEQ ID NO: 5511196 - DNA, 15 bp, Homo sapiens
tagttacatttctat

SEQ ID NO: 5511197 - DNA, 21 bp, Homo sapiens
tagttaccgagacatgaatac

SEQ ID NO: 5511198 - DNA, 12 bp, Homo sapiens
tagttaccttat

SEQ ID NO: 5511199 - DNA, 21 bp, Homo sapiens
tagttaccttatagttactgt

SEQ ID NO: 5511200 - DNA, 12 bp, Homo sapiens
tagttactaaaa

SEQ ID NO: 5511201 - DNA, 12 bp, Homo sapiens
tagttactcaag

SEQ ID NO: 5511202 - DNA, 13 bp, Homo sapiens
tagttactcaagc

SEQ ID NO: 5511203 - DNA, 12 bp, Homo sapiens
tagttactgtaa

SEQ ID NO: 5511204 - DNA, 20 bp, Homo sapiens
tagttactgtaaaatgcaaa

SEQ ID NO: 5511205 - DNA, 17 bp, Homo sapiens
tagttactgttgtgacc

SEQ ID NO: 5511206 - DNA, 18 bp, Homo sapiens
tagttactgttgtgacct

SEQ ID NO: 5511207 - DNA, 21 bp, Homo sapiens
tagttacttgctataaataga

SEQ ID NO: 5511208 - DNA, 19 bp, Homo sapiens
tagttactttggaacacta

SEQ ID NO: 5511209 - DNA, 14 bp, Homo sapiens
tagttagattccaa

SEQ ID NO: 5511210 - DNA, 15 bp, Homo sapiens
tagttagcaggaaat

SEQ ID NO: 5511211 - DNA, 18 bp, Homo sapiens
tagttagcaggaaatagt

SEQ ID NO: 5511212 - DNA, 15 bp, Homo sapiens
tagttagctgcttta

SEQ ID NO: 5511213 - DNA, 16 bp, Homo sapiens
tagttagcttaagtag

SEQ ID NO: 5511214 - DNA, 21 bp, Homo sapiens
tagttaggaaataaaaccttt

SEQ ID NO: 5511215 - DNA, 23 bp, Homo sapiens
tagttaggaaataaaacctttca

SEQ ID NO: 5511216 - DNA, 19 bp, Homo sapiens
tagttaggatattgattta

SEQ ID NO: 5511217 - DNA, 17 bp, Homo sapiens
tagttaggtgtgccaaa

SEQ ID NO: 5511218 - DNA, 15 bp, Homo sapiens
tagttagtagcatgt

SEQ ID NO: 5511219 - DNA, 23 bp, Homo sapiens
tagttagtttggaaatggtactt

SEQ ID NO: 5511220 - DNA, 12 bp, Homo sapiens
tagttagttttg

SEQ ID NO: 5511221 - DNA, 16 bp, Homo sapiens
tagttataaaaggctt

SEQ ID NO: 5511222 - DNA, 14 bp, Homo sapiens
tagttataaaccaa

SEQ ID NO: 5511223 - DNA, 15 bp, Homo sapiens
tagttataaatagcc

SEQ ID NO: 5511224 - DNA, 15 bp, Homo sapiens
tagttatagtttcag

SEQ ID NO: 5511225 - DNA, 13 bp, Homo sapiens
tagttatatagat

SEQ ID NO: 5511226 - DNA, 15 bp, Homo sapiens
tagttatatgtacag

SEQ ID NO: 5511227 - DNA, 11 bp, Homo sapiens
tagttatcatg

SEQ ID NO: 5511228 - DNA, 16 bp, Homo sapiens
tagttatgtgagaaag

SEQ ID NO: 5511229 - DNA, 15 bp, Homo sapiens
tagttattaaatgtt

SEQ ID NO: 5511230 - DNA, 16 bp, Homo sapiens
tagttattaaatgttt

SEQ ID NO: 5511231 - DNA, 17 bp, Homo sapiens
tagttattattgctgtt

SEQ ID NO: 5511232 - DNA, 15 bp, Homo sapiens
tagttattatttaat

SEQ ID NO: 5511233 - DNA, 17 bp, Homo sapiens
tagttattcacaaaaat

SEQ ID NO: 5511234 - DNA, 17 bp, Homo sapiens
tagttattctgccttcc

SEQ ID NO: 5511235 - DNA, 14 bp, Homo sapiens
tagttatttaagaa

SEQ ID NO: 5511236 - DNA, 17 bp, Homo sapiens
tagttattttaatacct

SEQ ID NO: 5511237 - DNA, 19 bp, Homo sapiens
tagttattttaataccttt

SEQ ID NO: 5511238 - DNA, 20 bp, Homo sapiens
tagttattttacaaattgtt

SEQ ID NO: 5511239 - DNA, 15 bp, Homo sapiens
tagttattttatagg

SEQ ID NO: 5511240 - DNA, 17 bp, Homo sapiens
tagttcaaactgcagct

SEQ ID NO: 5511241 - DNA, 20 bp, Homo sapiens
tagttcaagaaatgaagagc

SEQ ID NO: 5511242 - DNA, 13 bp, Homo sapiens
tagttcaatacag

SEQ ID NO: 5511243 - DNA, 15 bp, Homo sapiens
tagttcacagacata

SEQ ID NO: 5511244 - DNA, 21 bp, Homo sapiens
tagttcaccccttatcctgag

SEQ ID NO: 5511245 - DNA, 15 bp, Homo sapiens
tagttcacttactct

SEQ ID NO: 5511246 - DNA, 16 bp, Homo sapiens
tagttcagaatttagt

SEQ ID NO: 5511247 - DNA, 22 bp, Homo sapiens
tagttcagcatccgcaggtgct

SEQ ID NO: 5511248 - DNA, 19 bp, Homo sapiens
tagttcagtagaattacca

SEQ ID NO: 5511249 - DNA, 14 bp, Homo sapiens
tagttcatccaatc

SEQ ID NO: 5511250 - DNA, 18 bp, Homo sapiens
tagttcatccaatcctca

SEQ ID NO: 5511251 - DNA, 15 bp, Homo sapiens
tagttcatgtaaata

SEQ ID NO: 5511252 - DNA, 22 bp, Homo sapiens
tagttcatgtaaataatacatt

SEQ ID NO: 5511253 - DNA, 16 bp, Homo sapiens
tagttcattgtaaatg

SEQ ID NO: 5511254 - DNA, 20 bp, Homo sapiens
tagttccaccatcaagccac

SEQ ID NO: 5511255 - DNA, 15 bp, Homo sapiens
tagttccactgagac

SEQ ID NO: 5511256 - DNA, 16 bp, Homo sapiens
tagttccagagggttg

SEQ ID NO: 5511257 - DNA, 16 bp, Homo sapiens
tagttccagataaaaa

SEQ ID NO: 5511258 - DNA, 16 bp, Homo sapiens
tagttccagtttctcc

SEQ ID NO: 5511259 - DNA, 20 bp, Homo sapiens
tagttccagtttctccttga

SEQ ID NO: 5511260 - DNA, 17 bp, Homo sapiens
tagttccattcttggtc

SEQ ID NO: 5511261 - DNA, 21 bp, Homo sapiens
tagttccccgtgaacttcctt

SEQ ID NO: 5511262 - DNA, 23 bp, Homo sapiens
tagttcccctgtttattcatatg

SEQ ID NO: 5511263 - DNA, 23 bp, Homo sapiens
tagttccctgaaaacccagagag

SEQ ID NO: 5511264 - DNA, 20 bp, Homo sapiens
tagttccctttgccaacaga

SEQ ID NO: 5511265 - DNA, 14 bp, Homo sapiens
tagttcctaagaag

SEQ ID NO: 5511266 - DNA, 16 bp, Homo sapiens
tagttcctattttcta

SEQ ID NO: 5511267 - DNA, 19 bp, Homo sapiens
tagttccttgccttaataa

SEQ ID NO: 5511268 - DNA, 15 bp, Homo sapiens
tagttcgtagctttc

SEQ ID NO: 5511269 - DNA, 22 bp, Homo sapiens
tagttctagaaaaacaggcact

SEQ ID NO: 5511270 - DNA, 14 bp, Homo sapiens
tagttctataagaa

SEQ ID NO: 5511271 - DNA, 12 bp, Homo sapiens
tagttctatttc

SEQ ID NO: 5511272 - DNA, 14 bp, Homo sapiens
tagttctatttcta

SEQ ID NO: 5511273 - DNA, 19 bp, Homo sapiens
tagttctcttctcctgtgt

SEQ ID NO: 5511274 - DNA, 22 bp, Homo sapiens
tagttctcttggtgttaaaaca

SEQ ID NO: 5511275 - DNA, 14 bp, Homo sapiens
tagttctgactttg

SEQ ID NO: 5511276 - DNA, 21 bp, Homo sapiens
tagttctgactttgaatttat

SEQ ID NO: 5511277 - DNA, 12 bp, Homo sapiens
tagttctgccag

SEQ ID NO: 5511278 - DNA, 14 bp, Homo sapiens
tagttctgccaggc

SEQ ID NO: 5511279 - DNA, 15 bp, Homo sapiens
tagttctgctccaga

SEQ ID NO: 5511280 - DNA, 18 bp, Homo sapiens
tagttctgctccagacag

SEQ ID NO: 5511281 - DNA, 13 bp, Homo sapiens
tagttctgtagaa

SEQ ID NO: 5511282 - DNA, 15 bp, Homo sapiens
tagttctgtagaaat

SEQ ID NO: 5511283 - DNA, 12 bp, Homo sapiens
tagttctgtatt

SEQ ID NO: 5511284 - DNA, 19 bp, Homo sapiens
tagttctgtatttgaaagt

SEQ ID NO: 5511285 - DNA, 16 bp, Homo sapiens
tagttctgtgcctccc

SEQ ID NO: 5511286 - DNA, 13 bp, Homo sapiens
tagttctgttaaa

SEQ ID NO: 5511287 - DNA, 19 bp, Homo sapiens
tagttctgttaaatatttt

SEQ ID NO: 5511288 - DNA, 17 bp, Homo sapiens
tagttcttactgcttaa

SEQ ID NO: 5511289 - DNA, 18 bp, Homo sapiens
tagttcttagctttgaaa

SEQ ID NO: 5511290 - DNA, 21 bp, Homo sapiens
tagttcttgaattgttatgaa

SEQ ID NO: 5511291 - DNA, 23 bp, Homo sapiens
tagttcttgggggaggccacccc

SEQ ID NO: 5511292 - DNA, 14 bp, Homo sapiens
tagttcttgtgcat

SEQ ID NO: 5511293 - DNA, 19 bp, Homo sapiens
tagttcttgtgcatgttta

SEQ ID NO: 5511294 - DNA, 15 bp, Homo sapiens
tagttctttaaactg

SEQ ID NO: 5511295 - DNA, 20 bp, Homo sapiens
tagttctttaaactgtcgtg

SEQ ID NO: 5511296 - DNA, 15 bp, Homo sapiens
tagttctttgttcct

SEQ ID NO: 5511297 - DNA, 19 bp, Homo sapiens
tagttgaaacgcagacact

SEQ ID NO: 5511298 - DNA, 19 bp, Homo sapiens
tagttgaaaggcctcaaga

SEQ ID NO: 5511299 - DNA, 13 bp, Homo sapiens
tagttgaaagtaa

SEQ ID NO: 5511300 - DNA, 21 bp, Homo sapiens
tagttgaacaagatttcccta

SEQ ID NO: 5511301 - DNA, 20 bp, Homo sapiens
tagttgaactgatagttact

SEQ ID NO: 5511302 - DNA, 16 bp, Homo sapiens
tagttgaatttcagtc

SEQ ID NO: 5511303 - DNA, 23 bp, Homo sapiens
tagttgaattttttttaacattc

SEQ ID NO: 5511304 - DNA, 20 bp, Homo sapiens
tagttgacaacctagaatgt

SEQ ID NO: 5511305 - DNA, 15 bp, Homo sapiens
tagttgacaattctg

SEQ ID NO: 5511306 - DNA, 18 bp, Homo sapiens
tagttgacaattctgcat

SEQ ID NO: 5511307 - DNA, 19 bp, Homo sapiens
tagttgacaattctgcatg

SEQ ID NO: 5511308 - DNA, 15 bp, Homo sapiens
tagttgacagtatta

SEQ ID NO: 5511309 - DNA, 18 bp, Homo sapiens
tagttgacagtattaaca

SEQ ID NO: 5511310 - DNA, 21 bp, Homo sapiens
tagttgaccaactatattgcg

SEQ ID NO: 5511311 - DNA, 19 bp, Homo sapiens
tagttgagacgctgttgca

SEQ ID NO: 5511312 - DNA, 20 bp, Homo sapiens
tagttgagccagcagacatt

SEQ ID NO: 5511313 - DNA, 21 bp, Homo sapiens
tagttgagccagcagacattg

SEQ ID NO: 5511314 - DNA, 12 bp, Homo sapiens
tagttgagcccc

SEQ ID NO: 5511315 - DNA, 13 bp, Homo sapiens
tagttgagcccca

SEQ ID NO: 5511316 - DNA, 22 bp, Homo sapiens
tataaatatgtgattatcattt

SEQ ID NO: 5511317 - DNA, 23 bp, Homo sapiens
tataaatcaacaccttaatatgc

SEQ ID NO: 5511318 - DNA, 15 bp, Homo sapiens
tataaatcaatctta

SEQ ID NO: 5511319 - DNA, 15 bp, Homo sapiens
tataaatcaatgtca

SEQ ID NO: 5511320 - DNA, 14 bp, Homo sapiens
tataaatcatattg

SEQ ID NO: 5511321 - DNA, 20 bp, Homo sapiens
tataaatcgcttttgataat

SEQ ID NO: 5511322 - DNA, 22 bp, Homo sapiens
tataaatcttacccttcaatgt

SEQ ID NO: 5511323 - DNA, 15 bp, Homo sapiens
tataaatgaaaaaca

SEQ ID NO: 5511324 - DNA, 17 bp, Homo sapiens
tataaatgaaatttgca

SEQ ID NO: 5511325 - DNA, 15 bp, Homo sapiens
tataaatgaagatgc

SEQ ID NO: 5511326 - DNA, 20 bp, Homo sapiens
tataaatgaagtttatacag

SEQ ID NO: 5511327 - DNA, 16 bp, Homo sapiens
tataaatgaatgaaat

SEQ ID NO: 5511328 - DNA, 22 bp, Homo sapiens
tataaatgaatgaaatataaac

SEQ ID NO: 5511329 - DNA, 13 bp, Homo sapiens
tataaatgactat

SEQ ID NO: 5511330 - DNA, 13 bp, Homo sapiens
tataaatgagcaa

SEQ ID NO: 5511331 - DNA, 15 bp, Homo sapiens
tataaatgatatcaa

SEQ ID NO: 5511332 - DNA, 22 bp, Homo sapiens
tataaatgatatctatattcta

SEQ ID NO: 5511333 - DNA, 12 bp, Homo sapiens
tataaatgcaaa

SEQ ID NO: 5511334 - DNA, 17 bp, Homo sapiens
tataaatgcaaataaca

SEQ ID NO: 5511335 - DNA, 13 bp, Homo sapiens
tataaatgcatga

SEQ ID NO: 5511336 - DNA, 18 bp, Homo sapiens
tataaatgcatgatttta

SEQ ID NO: 5511337 - DNA, 19 bp, Homo sapiens
tataaatgcatgattttat

SEQ ID NO: 5511338 - DNA, 18 bp, Homo sapiens
tataaatgccaaagtctt

SEQ ID NO: 5511339 - DNA, 14 bp, Homo sapiens
tataaatgccagag

SEQ ID NO: 5511340 - DNA, 18 bp, Homo sapiens
tataaatgccagagccaa

SEQ ID NO: 5511341 - DNA, 22 bp, Homo sapiens
tataaatgccagagccaacctg

SEQ ID NO: 5511342 - DNA, 16 bp, Homo sapiens
tataaatgctattttt

SEQ ID NO: 5511343 - DNA, 17 bp, Homo sapiens
tataaatggaatcacac

SEQ ID NO: 5511344 - DNA, 12 bp, Homo sapiens
tataaatggact

SEQ ID NO: 5511345 - DNA, 22 bp, Homo sapiens
tataaatggacttgcttcttgt

SEQ ID NO: 5511346 - DNA, 19 bp, Homo sapiens
tataaatggtgagaattaa

SEQ ID NO: 5511347 - DNA, 23 bp, Homo sapiens
tataaatggtgtcataactagag

SEQ ID NO: 5511348 - DNA, 16 bp, Homo sapiens
tataaatggtgttttt

SEQ ID NO: 5511349 - DNA, 19 bp, Homo sapiens
tataaatgtactacatttg

SEQ ID NO: 5511350 - DNA, 18 bp, Homo sapiens
tataaatgtatatacaca

SEQ ID NO: 5511351 - DNA, 20 bp, Homo sapiens
tataaatgtatatacacata

SEQ ID NO: 5511352 - DNA, 14 bp, Homo sapiens
tataaatgtcctaa

SEQ ID NO: 5511353 - DNA, 14 bp, Homo sapiens
tataaatgtctatt

SEQ ID NO: 5511354 - DNA, 13 bp, Homo sapiens
tataaatgtgtgg

SEQ ID NO: 5511355 - DNA, 16 bp, Homo sapiens
tataaatgtgtgtatg

SEQ ID NO: 5511356 - DNA, 14 bp, Homo sapiens
tataaatgttagtt

SEQ ID NO: 5511357 - DNA, 22 bp, Homo sapiens
tataaatgttctggtatgcatt

SEQ ID NO: 5511358 - DNA, 15 bp, Homo sapiens
tataaatgtttcatg

SEQ ID NO: 5511359 - DNA, 14 bp, Homo sapiens
tataaatgtttgga

SEQ ID NO: 5511360 - DNA, 15 bp, Homo sapiens
tataaatgttttaaa

SEQ ID NO: 5511361 - DNA, 12 bp, Homo sapiens
tataaattaaaa

SEQ ID NO: 5511362 - DNA, 16 bp, Homo sapiens
tataaattaaataaac

SEQ ID NO: 5511363 - DNA, 22 bp, Homo sapiens
tataaattaaataaactgtttt

SEQ ID NO: 5511364 - DNA, 23 bp, Homo sapiens
tataaattaaatatatgtatgta

SEQ ID NO: 5511365 - DNA, 18 bp, Homo sapiens
tataaattaagactttaa

SEQ ID NO: 5511366 - DNA, 15 bp, Homo sapiens
tataaattaatttgt

SEQ ID NO: 5511367 - DNA, 17 bp, Homo sapiens
tataaattaatttgtta

SEQ ID NO: 5511368 - DNA, 22 bp, Homo sapiens
tataaattactatctgttgaaa

SEQ ID NO: 5511369 - DNA, 17 bp, Homo sapiens
tataaattatagaatct

SEQ ID NO: 5511370 - DNA, 13 bp, Homo sapiens
tataaattatctg

SEQ ID NO: 5511371 - DNA, 15 bp, Homo sapiens
tataaattattactt

SEQ ID NO: 5511372 - DNA, 15 bp, Homo sapiens
tataaattattcaga

SEQ ID NO: 5511373 - DNA, 14 bp, Homo sapiens
tataaattcagaac

SEQ ID NO: 5511374 - DNA, 14 bp, Homo sapiens
tataaattcctctt

SEQ ID NO: 5511375 - DNA, 19 bp, Homo sapiens
tataaattctactaagtta

SEQ ID NO: 5511376 - DNA, 22 bp, Homo sapiens
tataaattgtctttaaaaactg

SEQ ID NO: 5511377 - DNA, 16 bp, Homo sapiens
tataaatttaagaaaa

SEQ ID NO: 5511378 - DNA, 18 bp, Homo sapiens
tataaatttaagaaaaca

SEQ ID NO: 5511379 - DNA, 22 bp, Homo sapiens
tataaatttatcaactgtcaaa

SEQ ID NO: 5511380 - DNA, 14 bp, Homo sapiens
tataaatttattta

SEQ ID NO: 5511381 - DNA, 16 bp, Homo sapiens
tataaatttatttact

SEQ ID NO: 5511382 - DNA, 22 bp, Homo sapiens
tataaatttatttactgctagt

SEQ ID NO: 5511383 - DNA, 16 bp, Homo sapiens
tataaatttgtgtaat

SEQ ID NO: 5511384 - DNA, 13 bp, Homo sapiens
tataaattttgta

SEQ ID NO: 5511385 - DNA, 15 bp, Homo sapiens
tataaatttttacct

SEQ ID NO: 5511386 - DNA, 20 bp, Homo sapiens
tataacaaaggatacttatt

SEQ ID NO: 5511387 - DNA, 22 bp, Homo sapiens
tataacaaaggatacttattta

SEQ ID NO: 5511388 - DNA, 18 bp, Homo sapiens
tataacaacaacaacaaa

SEQ ID NO: 5511389 - DNA, 14 bp, Homo sapiens
tataacaacactaa

SEQ ID NO: 5511390 - DNA, 14 bp, Homo sapiens
tataacaactattt

SEQ ID NO: 5511391 - DNA, 22 bp, Homo sapiens
tataacaaggttcttctaaaat

SEQ ID NO: 5511392 - DNA, 17 bp, Homo sapiens
tataacaatataactga

SEQ ID NO: 5511393 - DNA, 13 bp, Homo sapiens
tataacacatttt

SEQ ID NO: 5511394 - DNA, 22 bp, Homo sapiens
tataacacatttttttgcatgc

SEQ ID NO: 5511395 - DNA, 22 bp, Homo sapiens
tataacacttaggactagaaga

SEQ ID NO: 5511396 - DNA, 14 bp, Homo sapiens
tataacagatacat

SEQ ID NO: 5511397 - DNA, 14 bp, Homo sapiens
tataacagcaaata

SEQ ID NO: 5511398 - DNA, 16 bp, Homo sapiens
tataacagcaaatgaa

SEQ ID NO: 5511399 - DNA, 15 bp, Homo sapiens
tataacagctcaaag

SEQ ID NO: 5511400 - DNA, 21 bp, Homo sapiens
tataacagtgtggtagttaat

SEQ ID NO: 5511401 - DNA, 16 bp, Homo sapiens
tataacagtgtttaaa

SEQ ID NO: 5511402 - DNA, 14 bp, Homo sapiens
tataacagttatat

SEQ ID NO: 5511403 - DNA, 22 bp, Homo sapiens
tataacagttttgagtaattca

SEQ ID NO: 5511404 - DNA, 19 bp, Homo sapiens
tataacatatatggaagag

SEQ ID NO: 5511405 - DNA, 14 bp, Homo sapiens
tataacatgaaatg

SEQ ID NO: 5511406 - DNA, 14 bp, Homo sapiens
tataacatgtaaaa

SEQ ID NO: 5511407 - DNA, 16 bp, Homo sapiens
tataacattatataac

SEQ ID NO: 5511408 - DNA, 17 bp, Homo sapiens
tataacattatataaca

SEQ ID NO: 5511409 - DNA, 22 bp, Homo sapiens
tataacatttgctgaatatgca

SEQ ID NO: 5511410 - DNA, 19 bp, Homo sapiens
tataaccaacttttctatt

SEQ ID NO: 5511411 - DNA, 17 bp, Homo sapiens
tataaccaatgtttaaa

SEQ ID NO: 5511412 - DNA, 18 bp, Homo sapiens
tataaccacatttctaag

SEQ ID NO: 5511413 - DNA, 17 bp, Homo sapiens
tataaccagctgaagtt

SEQ ID NO: 5511414 - DNA, 18 bp, Homo sapiens
tataaccatgagaatttt

SEQ ID NO: 5511415 - DNA, 15 bp, Homo sapiens
tataaccatgttcta

SEQ ID NO: 5511416 - DNA, 18 bp, Homo sapiens
tataaccatgttctatat

SEQ ID NO: 5511417 - DNA, 14 bp, Homo sapiens
tataaccccagcct

SEQ ID NO: 5511418 - DNA, 17 bp, Homo sapiens
tataacccctgcctgga

SEQ ID NO: 5511419 - DNA, 16 bp, Homo sapiens
tataaccctgttacaa

SEQ ID NO: 5511420 - DNA, 15 bp, Homo sapiens
tataacctggcaaaa

SEQ ID NO: 5511421 - DNA, 16 bp, Homo sapiens
tataacctggcaaaat

SEQ ID NO: 5511422 - DNA, 15 bp, Homo sapiens
tataaccttaattta

SEQ ID NO: 5511423 - DNA, 17 bp, Homo sapiens
tataacgtgatacattt

SEQ ID NO: 5511424 - DNA, 14 bp, Homo sapiens
tataacgtgttcaa

SEQ ID NO: 5511425 - DNA, 15 bp, Homo sapiens
tataactaacagcat

SEQ ID NO: 5511426 - DNA, 18 bp, Homo sapiens
tataactaatatggtttt

SEQ ID NO: 5511427 - DNA, 15 bp, Homo sapiens
tataactaatttgct

SEQ ID NO: 5511428 - DNA, 23 bp, Homo sapiens
tataactaatttgctctgtggta

SEQ ID NO: 5511429 - DNA, 22 bp, Homo sapiens
tataactacattaaaagcttta

SEQ ID NO: 5511430 - DNA, 16 bp, Homo sapiens
tataactagctagaag

SEQ ID NO: 5511431 - DNA, 14 bp, Homo sapiens
tataactaggcaaa

SEQ ID NO: 5511432 - DNA, 15 bp, Homo sapiens
tataactatataaat

SEQ ID NO: 5511433 - DNA, 23 bp, Homo sapiens
tataactatataaatgacattat

SEQ ID NO: 5511434 - DNA, 17 bp, Homo sapiens
tataactattacagtgt

SEQ ID NO: 5511435 - DNA, 18 bp, Homo sapiens
tataactattacagtgtt

SEQ ID NO: 5511436 - DNA, 19 bp, Homo sapiens
tataactattacagtgttg

SEQ ID NO: 5511437 - DNA, 21 bp, Homo sapiens
tataactcatcataaaataaa

SEQ ID NO: 5511438 - DNA, 16 bp, Homo sapiens
tataactgagatgaat

SEQ ID NO: 5511439 - DNA, 19 bp, Homo sapiens
tataactgccttaaaactt

SEQ ID NO: 5511440 - DNA, 20 bp, Homo sapiens
tataactgccttaaaacttt

SEQ ID NO: 5511441 - DNA, 16 bp, Homo sapiens
tataactggaaagaag

SEQ ID NO: 5511442 - DNA, 13 bp, Homo sapiens
tataactgtattt

SEQ ID NO: 5511443 - DNA, 23 bp, Homo sapiens
tataactgtatttgaaataagaa

SEQ ID NO: 5511444 - DNA, 19 bp, Homo sapiens
tataactgttcttcaataa

SEQ ID NO: 5511445 - DNA, 12 bp, Homo sapiens
tataactgttgt

SEQ ID NO: 5511446 - DNA, 19 bp, Homo sapiens
tataactgttgttgataag

SEQ ID NO: 5511447 - DNA, 14 bp, Homo sapiens
tataactgttttag

SEQ ID NO: 5511448 - DNA, 19 bp, Homo sapiens
tataactgttttagaaatt

SEQ ID NO: 5511449 - DNA, 22 bp, Homo sapiens
tataactgttttagaaattggt

SEQ ID NO: 5511450 - DNA, 19 bp, Homo sapiens
tataacttaaaaaaatgac

SEQ ID NO: 5511451 - DNA, 18 bp, Homo sapiens
tataacttaaaatatttt

SEQ ID NO: 5511452 - DNA, 14 bp, Homo sapiens
tataacttaatgaa

SEQ ID NO: 5511453 - DNA, 18 bp, Homo sapiens
tataacttaatgaaaaca

SEQ ID NO: 5511454 - DNA, 12 bp, Homo sapiens
tataacttgatg

SEQ ID NO: 5511455 - DNA, 13 bp, Homo sapiens
tataacttgtaag

SEQ ID NO: 5511456 - DNA, 18 bp, Homo sapiens
tataacttgtaagtctga

SEQ ID NO: 5511457 - DNA, 17 bp, Homo sapiens
tataactttaacttctg

SEQ ID NO: 5511458 - DNA, 15 bp, Homo sapiens
tataactttagaaat

SEQ ID NO: 5511459 - DNA, 22 bp, Homo sapiens
tataagaaaaaattctttcact

SEQ ID NO: 5511460 - DNA, 12 bp, Homo sapiens
tataagaaaaac

SEQ ID NO: 5511461 - DNA, 13 bp, Homo sapiens
tataagaaaaact

SEQ ID NO: 5511462 - DNA, 17 bp, Homo sapiens
tataagaaaacatgtaa

SEQ ID NO: 5511463 - DNA, 22 bp, Homo sapiens
tataagaaaactacatgtaaaa

SEQ ID NO: 5511464 - DNA, 21 bp, Homo sapiens
tataagaaaagtaatgaagaa

SEQ ID NO: 5511465 - DNA, 17 bp, Homo sapiens
tataagaaagacatctt

SEQ ID NO: 5511466 - DNA, 15 bp, Homo sapiens
tataagaaagcctga

SEQ ID NO: 5511467 - DNA, 17 bp, Homo sapiens
tataagaaatgcatatg

SEQ ID NO: 5511468 - DNA, 21 bp, Homo sapiens
tataagaaattttattagaca

SEQ ID NO: 5511469 - DNA, 20 bp, Homo sapiens
tataagaagcaatctttgaa

SEQ ID NO: 5511470 - DNA, 22 bp, Homo sapiens
tataagaagccttaatttgcac

SEQ ID NO: 5511471 - DNA, 12 bp, Homo sapiens
tataagaagtag

SEQ ID NO: 5511472 - DNA, 19 bp, Homo sapiens
tataagaagtcctatctca

SEQ ID NO: 5511473 - DNA, 17 bp, Homo sapiens
tataagaatgagcctgt

SEQ ID NO: 5511474 - DNA, 14 bp, Homo sapiens
tataagaattaatc

SEQ ID NO: 5511475 - DNA, 17 bp, Homo sapiens
tataagacactttgcca

SEQ ID NO: 5511476 - DNA, 12 bp, Homo sapiens
tataagacatta

SEQ ID NO: 5511477 - DNA, 14 bp, Homo sapiens
tataagacattaag

SEQ ID NO: 5511478 - DNA, 19 bp, Homo sapiens
tataagacatttgtttgct

SEQ ID NO: 5511479 - DNA, 19 bp, Homo sapiens
tataagactactattcctt

SEQ ID NO: 5511480 - DNA, 14 bp, Homo sapiens
tataagactattcc

SEQ ID NO: 5511481 - DNA, 16 bp, Homo sapiens
tataagagaagtctca

SEQ ID NO: 5511482 - DNA, 24 bp, Homo sapiens
tataagagaagtctcattcgcctt

SEQ ID NO: 5511483 - DNA, 16 bp, Homo sapiens
tataagagcatgaaat

SEQ ID NO: 5511484 - DNA, 22 bp, Homo sapiens
tataagagggctttttaaattt

SEQ ID NO: 5511485 - DNA, 16 bp, Homo sapiens
tataagatttaattgt

SEQ ID NO: 5511486 - DNA, 21 bp, Homo sapiens
tataagatttgtacatattat

SEQ ID NO: 5511487 - DNA, 23 bp, Homo sapiens
tataagcaacatgaattaagaac

SEQ ID NO: 5511488 - DNA, 16 bp, Homo sapiens
tataagcaagacagtg

SEQ ID NO: 5511489 - DNA, 20 bp, Homo sapiens
tataagcacagacaattcta

SEQ ID NO: 5511490 - DNA, 18 bp, Homo sapiens
tataagcactgaaaaaca

SEQ ID NO: 5511491 - DNA, 16 bp, Homo sapiens
tataagcatgctttct

SEQ ID NO: 5511492 - DNA, 23 bp, Homo sapiens
tataagccaaaattaaggtgttt

SEQ ID NO: 5511493 - DNA, 11 bp, Homo sapiens
tataagccata

SEQ ID NO: 5511494 - DNA, 16 bp, Homo sapiens
tatacatgtgtacata

SEQ ID NO: 5511495 - DNA, 17 bp, Homo sapiens
tatacatgtgtacatat

SEQ ID NO: 5511496 - DNA, 19 bp, Homo sapiens
tatacatgtgtacatatat

SEQ ID NO: 5511497 - DNA, 23 bp, Homo sapiens
tatacatgtgtacatatatgtat

SEQ ID NO: 5511498 - DNA, 17 bp, Homo sapiens
tatacatgtgtgtatat

SEQ ID NO: 5511499 - DNA, 20 bp, Homo sapiens
tatacatgtgtgtatatatg

SEQ ID NO: 5511500 - DNA, 14 bp, Homo sapiens
tatacatgttggaa

SEQ ID NO: 5511501 - DNA, 18 bp, Homo sapiens
tatacatgtttagtatta

SEQ ID NO: 5511502 - DNA, 15 bp, Homo sapiens
tatacatgtttatgt

SEQ ID NO: 5511503 - DNA, 18 bp, Homo sapiens
tatacatgtttatgtaaa

SEQ ID NO: 5511504 - DNA, 19 bp, Homo sapiens
tatacatgtttatgtaaac

SEQ ID NO: 5511505 - DNA, 22 bp, Homo sapiens
tatacatgtttgcagtgttaag

SEQ ID NO: 5511506 - DNA, 18 bp, Homo sapiens
tatacattagttttaatc

SEQ ID NO: 5511507 - DNA, 22 bp, Homo sapiens
tatacattagttttaatctctt

SEQ ID NO: 5511508 - DNA, 20 bp, Homo sapiens
tatacattcctgagattctg

SEQ ID NO: 5511509 - DNA, 17 bp, Homo sapiens
tatacattctttatctt

SEQ ID NO: 5511510 - DNA, 16 bp, Homo sapiens
tatacattgtcttgat

SEQ ID NO: 5511511 - DNA, 17 bp, Homo sapiens
tatacatttaaagattt

SEQ ID NO: 5511512 - DNA, 22 bp, Homo sapiens
tatacattttctaaataaaaat

SEQ ID NO: 5511513 - DNA, 13 bp, Homo sapiens
tatacattttgaa

SEQ ID NO: 5511514 - DNA, 21 bp, Homo sapiens
tatacattttgttatagaata

SEQ ID NO: 5511515 - DNA, 22 bp, Homo sapiens
tatacattttttaggacatctt

SEQ ID NO: 5511516 - DNA, 23 bp, Homo sapiens
tataccaactgggcctctgatgt

SEQ ID NO: 5511517 - DNA, 12 bp, Homo sapiens
tataccaataaa

SEQ ID NO: 5511518 - DNA, 14 bp, Homo sapiens
tataccaataaagt

SEQ ID NO: 5511519 - DNA, 14 bp, Homo sapiens
tataccaatgtgtt

SEQ ID NO: 5511520 - DNA, 14 bp, Homo sapiens
tataccacctgtac

SEQ ID NO: 5511521 - DNA, 17 bp, Homo sapiens
tataccacctgtacata

SEQ ID NO: 5511522 - DNA, 14 bp, Homo sapiens
tataccagagaagg

SEQ ID NO: 5511523 - DNA, 14 bp, Homo sapiens
tataccagcagaaa

SEQ ID NO: 5511524 - DNA, 19 bp, Homo sapiens
tataccaggatttattttg

SEQ ID NO: 5511525 - DNA, 19 bp, Homo sapiens
tataccagtataattgagt

SEQ ID NO: 5511526 - DNA, 18 bp, Homo sapiens
tataccatgtgtgctaat

SEQ ID NO: 5511527 - DNA, 22 bp, Homo sapiens
tatacccacccagaatgagaca

SEQ ID NO: 5511528 - DNA, 15 bp, Homo sapiens
tatacccactgcatc

SEQ ID NO: 5511529 - DNA, 13 bp, Homo sapiens
tatacccagcaga

SEQ ID NO: 5511530 - DNA, 20 bp, Homo sapiens
tataccccgtgaagcatcca

SEQ ID NO: 5511531 - DNA, 20 bp, Homo sapiens
tatacccgggaccaaactca

SEQ ID NO: 5511532 - DNA, 16 bp, Homo sapiens
tataccctttttcatt

SEQ ID NO: 5511533 - DNA, 22 bp, Homo sapiens
tataccgatcaggaatcttgct

SEQ ID NO: 5511534 - DNA, 17 bp, Homo sapiens
tataccgcagagtattt

SEQ ID NO: 5511535 - DNA, 21 bp, Homo sapiens
tataccggagctccagtttct

SEQ ID NO: 5511536 - DNA, 22 bp, Homo sapiens
tatacctcaattttcactgtgt

SEQ ID NO: 5511537 - DNA, 11 bp, Homo sapiens
tatacctcagt

SEQ ID NO: 5511538 - DNA, 14 bp, Homo sapiens
tatacctctctcaa

SEQ ID NO: 5511539 - DNA, 23 bp, Homo sapiens
tatacctgaaatattttcttcct

SEQ ID NO: 5511540 - DNA, 13 bp, Homo sapiens
tatacctgagcct

SEQ ID NO: 5511541 - DNA, 14 bp, Homo sapiens
tatacctgagcctc

SEQ ID NO: 5511542 - DNA, 19 bp, Homo sapiens
tatacctgcacgttcataa

SEQ ID NO: 5511543 - DNA, 19 bp, Homo sapiens
tatacctgccttttaagtt

SEQ ID NO: 5511544 - DNA, 16 bp, Homo sapiens
tatacctggcttttta

SEQ ID NO: 5511545 - DNA, 22 bp, Homo sapiens
tatacctgggcatactaataaa

SEQ ID NO: 5511546 - DNA, 18 bp, Homo sapiens
tatacctgtacacacaca

SEQ ID NO: 5511547 - DNA, 19 bp, Homo sapiens
tatacctgtgcctcggctt

SEQ ID NO: 5511548 - DNA, 12 bp, Homo sapiens
tatacctgtgtt

SEQ ID NO: 5511549 - DNA, 22 bp, Homo sapiens
tatacctgtgtttcttgcctca

SEQ ID NO: 5511550 - DNA, 13 bp, Homo sapiens
tataccttctcaa

SEQ ID NO: 5511551 - DNA, 18 bp, Homo sapiens
tataccttctgacagccc

SEQ ID NO: 5511552 - DNA, 16 bp, Homo sapiens
tatacctttgccttgg

SEQ ID NO: 5511553 - DNA, 21 bp, Homo sapiens
tataccttttgttaccacaga

SEQ ID NO: 5511554 - DNA, 15 bp, Homo sapiens
tataccttttttgtt

SEQ ID NO: 5511555 - DNA, 16 bp, Homo sapiens
tatacgaaataattgt

SEQ ID NO: 5511556 - DNA, 17 bp, Homo sapiens
tatacgaaataattgtt

SEQ ID NO: 5511557 - DNA, 16 bp, Homo sapiens
tatacgagaacaggca

SEQ ID NO: 5511558 - DNA, 19 bp, Homo sapiens
tatacgtataaatatcagt

SEQ ID NO: 5511559 - DNA, 20 bp, Homo sapiens
tatacgtataaatatcagta

SEQ ID NO: 5511560 - DNA, 15 bp, Homo sapiens
tatacgtgtagctat

SEQ ID NO: 5511561 - DNA, 16 bp, Homo sapiens
tatactaaaaaatgtc

SEQ ID NO: 5511562 - DNA, 20 bp, Homo sapiens
tatactaaaccaactctaat

SEQ ID NO: 5511563 - DNA, 23 bp, Homo sapiens
tatactaaaccaactctaatatt

SEQ ID NO: 5511564 - DNA, 15 bp, Homo sapiens
tatactaagaaaaga

SEQ ID NO: 5511565 - DNA, 12 bp, Homo sapiens
tatactaataaa

SEQ ID NO: 5511566 - DNA, 14 bp, Homo sapiens
tatactaataaaaa

SEQ ID NO: 5511567 - DNA, 21 bp, Homo sapiens
tatactactttgttaggattt

SEQ ID NO: 5511568 - DNA, 17 bp, Homo sapiens
tatactatacaacaatg

SEQ ID NO: 5511569 - DNA, 21 bp, Homo sapiens
tatactatattaacttttatt

SEQ ID NO: 5511570 - DNA, 21 bp, Homo sapiens
tatactattaaaaaggtttac

SEQ ID NO: 5511571 - DNA, 17 bp, Homo sapiens
tatactcactttctaga

SEQ ID NO: 5511572 - DNA, 22 bp, Homo sapiens
tatactcagggattccttctaa

SEQ ID NO: 5511573 - DNA, 16 bp, Homo sapiens
tatactcattagaatt

SEQ ID NO: 5511574 - DNA, 21 bp, Homo sapiens
tatactcatttggatataaat

SEQ ID NO: 5511575 - DNA, 22 bp, Homo sapiens
tatactccagtgtacatagtgt

SEQ ID NO: 5511576 - DNA, 18 bp, Homo sapiens
tatactctctgaaatata

SEQ ID NO: 5511577 - DNA, 19 bp, Homo sapiens
tatactctgtagtctcagt

SEQ ID NO: 5511578 - DNA, 20 bp, Homo sapiens
tatactcttatagacaacat

SEQ ID NO: 5511579 - DNA, 22 bp, Homo sapiens
tatactcttgaattcctctcaa

SEQ ID NO: 5511580 - DNA, 16 bp, Homo sapiens
tatactctttctgtat

SEQ ID NO: 5511581 - DNA, 17 bp, Homo sapiens
tatactcttttttcatg

SEQ ID NO: 5511582 - DNA, 20 bp, Homo sapiens
tatactgaaagatctctgtc

SEQ ID NO: 5511583 - DNA, 23 bp, Homo sapiens
tatactgaaagatctctgtcaca

SEQ ID NO: 5511584 - DNA, 22 bp, Homo sapiens
tatactgaagtcttttctgtca

SEQ ID NO: 5511585 - DNA, 12 bp, Homo sapiens
tatactgagggg

SEQ ID NO: 5511586 - DNA, 17 bp, Homo sapiens
tatactgcatacttttt

SEQ ID NO: 5511587 - DNA, 17 bp, Homo sapiens
tatactgctctataaat

SEQ ID NO: 5511588 - DNA, 22 bp, Homo sapiens
tatactggaacccttttaaagt

SEQ ID NO: 5511589 - DNA, 23 bp, Homo sapiens
tatactggcatgctaaagccttc

SEQ ID NO: 5511590 - DNA, 14 bp, Homo sapiens
tatactgggtttca

SEQ ID NO: 5511591 - DNA, 15 bp, Homo sapiens
tatactggttattga

SEQ ID NO: 5511592 - DNA, 11 bp, Homo sapiens
tatactgtaaa

SEQ ID NO: 5511593 - DNA, 16 bp, Homo sapiens
tatactgtaaaagtta

SEQ ID NO: 5511594 - DNA, 16 bp, Homo sapiens
tatactgtaaagaaag

SEQ ID NO: 5511595 - DNA, 17 bp, Homo sapiens
tatactgtaaagaaaga

SEQ ID NO: 5511596 - DNA, 20 bp, Homo sapiens
tatactgtaaagaaagagag

SEQ ID NO: 5511597 - DNA, 14 bp, Homo sapiens
tatactgtaattta

SEQ ID NO: 5511598 - DNA, 22 bp, Homo sapiens
tatactgtaatttagttattga

SEQ ID NO: 5511599 - DNA, 21 bp, Homo sapiens
tatactgtacaataaaaacat

SEQ ID NO: 5511600 - DNA, 12 bp, Homo sapiens
tatactgtacat

SEQ ID NO: 5511601 - DNA, 17 bp, Homo sapiens
tatactgtacatgctat

SEQ ID NO: 5511602 - DNA, 16 bp, Homo sapiens
tatactgtacttaata

SEQ ID NO: 5511603 - DNA, 23 bp, Homo sapiens
tatactgtagatttcagtagttt

SEQ ID NO: 5511604 - DNA, 14 bp, Homo sapiens
tatactgtaggtgt

SEQ ID NO: 5511605 - DNA, 13 bp, Homo sapiens
tatactgtatatg

SEQ ID NO: 5511606 - DNA, 13 bp, Homo sapiens
tatactgtattaa

SEQ ID NO: 5511607 - DNA, 17 bp, Homo sapiens
tatactgtattaagagt

SEQ ID NO: 5511608 - DNA, 14 bp, Homo sapiens
tatactgtcttgtc

SEQ ID NO: 5511609 - DNA, 15 bp, Homo sapiens
tatactgtcttgtct

SEQ ID NO: 5511610 - DNA, 19 bp, Homo sapiens
tatactgtgaagttacatg

SEQ ID NO: 5511611 - DNA, 18 bp, Homo sapiens
tatactgtgtgcttgttt

SEQ ID NO: 5511612 - DNA, 22 bp, Homo sapiens
tatactgtgtgggatacttagt

SEQ ID NO: 5511613 - DNA, 23 bp, Homo sapiens
tatactgtgtgtgagtgtgaata

SEQ ID NO: 5511614 - DNA, 14 bp, Homo sapiens
tatactgttatcca

SEQ ID NO: 5511615 - DNA, 15 bp, Homo sapiens
tatactgttatccat

SEQ ID NO: 5511616 - DNA, 14 bp, Homo sapiens
tatacttaaaaaat

SEQ ID NO: 5511617 - DNA, 13 bp, Homo sapiens
tatacttaaaatg

SEQ ID NO: 5511618 - DNA, 22 bp, Homo sapiens
tatacttaaaatgacaaagcca

SEQ ID NO: 5511619 - DNA, 22 bp, Homo sapiens
tatacttaaatggaaaaaatga

SEQ ID NO: 5511620 - DNA, 17 bp, Homo sapiens
tatacttaataaaacat

SEQ ID NO: 5511621 - DNA, 18 bp, Homo sapiens
tatacttacactgtattg

SEQ ID NO: 5511622 - DNA, 15 bp, Homo sapiens
tatacttcaaatgtc

SEQ ID NO: 5511623 - DNA, 21 bp, Homo sapiens
tatacttcaaatgtcatttca

SEQ ID NO: 5511624 - DNA, 14 bp, Homo sapiens
tatacttcactcac

SEQ ID NO: 5511625 - DNA, 16 bp, Homo sapiens
tatacttgaaaaatgt

SEQ ID NO: 5511626 - DNA, 16 bp, Homo sapiens
tatacttgaatgaaaa

SEQ ID NO: 5511627 - DNA, 15 bp, Homo sapiens
tatacttgactctaa

SEQ ID NO: 5511628 - DNA, 18 bp, Homo sapiens
tatacttgactctaatat

SEQ ID NO: 5511629 - DNA, 16 bp, Homo sapiens
tatacttgtaaaacca

SEQ ID NO: 5511630 - DNA, 14 bp, Homo sapiens
tatacttgtaatta

SEQ ID NO: 5511631 - DNA, 15 bp, Homo sapiens
tatacttgtaattat

SEQ ID NO: 5511632 - DNA, 22 bp, Homo sapiens
tatacttgtaattatggagtca

SEQ ID NO: 5511633 - DNA, 18 bp, Homo sapiens
tatacttgtggttttcaa

SEQ ID NO: 5511634 - DNA, 20 bp, Homo sapiens
tatacttgtttttgtaaaga

SEQ ID NO: 5511635 - DNA, 20 bp, Homo sapiens
tatactttatataaggcatt

SEQ ID NO: 5511636 - DNA, 18 bp, Homo sapiens
tatactttatatctgtaa

SEQ ID NO: 5511637 - DNA, 15 bp, Homo sapiens
tatactttattgaaa

SEQ ID NO: 5511638 - DNA, 16 bp, Homo sapiens
tatactttccctaccc

SEQ ID NO: 5511639 - DNA, 13 bp, Homo sapiens
tatactttctcac

SEQ ID NO: 5511640 - DNA, 20 bp, Homo sapiens
tatactttgctgttgaagaa

SEQ ID NO: 5511641 - DNA, 12 bp, Homo sapiens
tatactttgttc

SEQ ID NO: 5511642 - DNA, 15 bp, Homo sapiens
tatactttgttctgt

SEQ ID NO: 5511643 - DNA, 19 bp, Homo sapiens
tatacttttcccctgttaa

SEQ ID NO: 5511644 - DNA, 20 bp, Homo sapiens
tatacttttcccctgttaaa

SEQ ID NO: 5511645 - DNA, 23 bp, Homo sapiens
tatacttttcccctgttaaacag

SEQ ID NO: 5511646 - DNA, 16 bp, Homo sapiens
tatacttttgcttggt

SEQ ID NO: 5511647 - DNA, 21 bp, Homo sapiens
tatacttttgcttggttcatt

SEQ ID NO: 5511648 - DNA, 15 bp, Homo sapiens
tatactttttcatga

SEQ ID NO: 5511649 - DNA, 21 bp, Homo sapiens
tatacttttttcttatttaac

SEQ ID NO: 5511650 - DNA, 20 bp, Homo sapiens
tatactttttttgttataga

SEQ ID NO: 5511651 - DNA, 22 bp, Homo sapiens
tatagaaaaataaaaatctctt

SEQ ID NO: 5511652 - DNA, 15 bp, Homo sapiens
tatagaaaatggaaa

SEQ ID NO: 5511653 - DNA, 19 bp, Homo sapiens
tatagaaacaatactgttc

SEQ ID NO: 5511654 - DNA, 13 bp, Homo sapiens
tatagaaagaaaa

SEQ ID NO: 5511655 - DNA, 18 bp, Homo sapiens
tatagaaagcaagatgta

SEQ ID NO: 5511656 - DNA, 22 bp, Homo sapiens
tatagaaagcaagatgtactat

SEQ ID NO: 5511657 - DNA, 20 bp, Homo sapiens
tatagaaagtgttctgttac

SEQ ID NO: 5511658 - DNA, 23 bp, Homo sapiens
tatagaaagtgttctgttacaaa

SEQ ID NO: 5511659 - DNA, 21 bp, Homo sapiens
tatagaaatatatacgaacaa

SEQ ID NO: 5511660 - DNA, 15 bp, Homo sapiens
tatagaaattctgaa

SEQ ID NO: 5511661 - DNA, 14 bp, Homo sapiens
tatagaaccatgaa

SEQ ID NO: 5511662 - DNA, 17 bp, Homo sapiens
tatagaacttcatggat

SEQ ID NO: 5511663 - DNA, 11 bp, Homo sapiens
tatagaagaaa

SEQ ID NO: 5511664 - DNA, 20 bp, Homo sapiens
tatagaagaatgcatgcttt

SEQ ID NO: 5511665 - DNA, 16 bp, Homo sapiens
tatagaagtcttcatg

SEQ ID NO: 5511666 - DNA, 19 bp, Homo sapiens
tatagaagtcttcatgaaa

SEQ ID NO: 5511667 - DNA, 17 bp, Homo sapiens
tatagaagtggtgtttt

SEQ ID NO: 5511668 - DNA, 19 bp, Homo sapiens
tatagaataaaagctataa

SEQ ID NO: 5511669 - DNA, 14 bp, Homo sapiens
tatagaataatttc

SEQ ID NO: 5511670 - DNA, 17 bp, Homo sapiens
tatagaatagcctgagg

SEQ ID NO: 5511671 - DNA, 14 bp, Homo sapiens
tatagttctgtgta

SEQ ID NO: 5511672 - DNA, 14 bp, Homo sapiens
tatagttgcttgcc

SEQ ID NO: 5511673 - DNA, 14 bp, Homo sapiens
tatagttgtcagta

SEQ ID NO: 5511674 - DNA, 21 bp, Homo sapiens
tatagttgtcagtattattct

SEQ ID NO: 5511675 - DNA, 20 bp, Homo sapiens
tatagttgtctttctttgct

SEQ ID NO: 5511676 - DNA, 19 bp, Homo sapiens
tatagtttattgacaataa

SEQ ID NO: 5511677 - DNA, 13 bp, Homo sapiens
tatagtttcagat

SEQ ID NO: 5511678 - DNA, 13 bp, Homo sapiens
tatagtttgacag

SEQ ID NO: 5511679 - DNA, 20 bp, Homo sapiens
tatagtttgctttgcttttt

SEQ ID NO: 5511680 - DNA, 14 bp, Homo sapiens
tatagtttgtcatc

SEQ ID NO: 5511681 - DNA, 21 bp, Homo sapiens
tatagtttgttttctttttct

SEQ ID NO: 5511682 - DNA, 17 bp, Homo sapiens
tatagttttacactcta

SEQ ID NO: 5511683 - DNA, 23 bp, Homo sapiens
tatagttttacttttaaactgtg

SEQ ID NO: 5511684 - DNA, 22 bp, Homo sapiens
tatagttttgaatcctttgcct

SEQ ID NO: 5511685 - DNA, 23 bp, Homo sapiens
tatagttttgaatcctttgcctg

SEQ ID NO: 5511686 - DNA, 18 bp, Homo sapiens
tatataaaaaatatatgt

SEQ ID NO: 5511687 - DNA, 18 bp, Homo sapiens
tatataaaaagaaaagat

SEQ ID NO: 5511688 - DNA, 11 bp, Homo sapiens
tatataaaaat

SEQ ID NO: 5511689 - DNA, 15 bp, Homo sapiens
tatataaaaatatat

SEQ ID NO: 5511690 - DNA, 21 bp, Homo sapiens
tatataaaaatatatatagtg

SEQ ID NO: 5511691 - DNA, 15 bp, Homo sapiens
tatataaaaatggct

SEQ ID NO: 5511692 - DNA, 12 bp, Homo sapiens
tatataaaacaa

SEQ ID NO: 5511693 - DNA, 14 bp, Homo sapiens
tatataaaagaaat

SEQ ID NO: 5511694 - DNA, 18 bp, Homo sapiens
tatataaaataaatatac

SEQ ID NO: 5511695 - DNA, 22 bp, Homo sapiens
tatataaaataaatatactaat

SEQ ID NO: 5511696 - DNA, 18 bp, Homo sapiens
tatataaaataaatatat

SEQ ID NO: 5511697 - DNA, 23 bp, Homo sapiens
tatataaaataaatatatataaa

SEQ ID NO: 5511698 - DNA, 16 bp, Homo sapiens
tatataaaatacacgt

SEQ ID NO: 5511699 - DNA, 21 bp, Homo sapiens
tatataaaatacacgtgtata

SEQ ID NO: 5511700 - DNA, 22 bp, Homo sapiens
tatataaaatacacgtgtatat

SEQ ID NO: 5511701 - DNA, 12 bp, Homo sapiens
tatataaaatat

SEQ ID NO: 5511702 - DNA, 14 bp, Homo sapiens
tatataaaatatct

SEQ ID NO: 5511703 - DNA, 16 bp, Homo sapiens
tatataaaatatctat

SEQ ID NO: 5511704 - DNA, 20 bp, Homo sapiens
tatataaaatatctatattc

SEQ ID NO: 5511705 - DNA, 14 bp, Homo sapiens
tatataaaatgtat

SEQ ID NO: 5511706 - DNA, 18 bp, Homo sapiens
tatataaaatgtattcaa

SEQ ID NO: 5511707 - DNA, 21 bp, Homo sapiens
tatataaaatgtattcaagca

SEQ ID NO: 5511708 - DNA, 14 bp, Homo sapiens
tatataaaatgtgc

SEQ ID NO: 5511709 - DNA, 16 bp, Homo sapiens
tatataaaatgtgcga

SEQ ID NO: 5511710 - DNA, 23 bp, Homo sapiens
tatataaacaataaaaacaactt

SEQ ID NO: 5511711 - DNA, 23 bp, Homo sapiens
tatataaacactccacagtgttt

SEQ ID NO: 5511712 - DNA, 13 bp, Homo sapiens
tatataaacatat

SEQ ID NO: 5511713 - DNA, 21 bp, Homo sapiens
tatataaacctaaaaaagata

SEQ ID NO: 5511714 - DNA, 20 bp, Homo sapiens
tatataaacgatatatgtaa

SEQ ID NO: 5511715 - DNA, 16 bp, Homo sapiens
tatataaactgtgcca

SEQ ID NO: 5511716 - DNA, 18 bp, Homo sapiens
tatataaagaatatatat

SEQ ID NO: 5511717 - DNA, 22 bp, Homo sapiens
tatataaagacaacaaaagaaa

SEQ ID NO: 5511718 - DNA, 14 bp, Homo sapiens
tatataaagagaaa

SEQ ID NO: 5511719 - DNA, 16 bp, Homo sapiens
tatataaagagaaaat

SEQ ID NO: 5511720 - DNA, 23 bp, Homo sapiens
tatataaagagaaaattgaattt

SEQ ID NO: 5511721 - DNA, 18 bp, Homo sapiens
tatataaaggcaaggaaa

SEQ ID NO: 5511722 - DNA, 14 bp, Homo sapiens
tatataaaggtttt

SEQ ID NO: 5511723 - DNA, 12 bp, Homo sapiens
tatataaagtat

SEQ ID NO: 5511724 - DNA, 14 bp, Homo sapiens
tatataaagtatag

SEQ ID NO: 5511725 - DNA, 16 bp, Homo sapiens
tatataaagtcagtga

SEQ ID NO: 5511726 - DNA, 19 bp, Homo sapiens
tatataaataaatatatat

SEQ ID NO: 5511727 - DNA, 13 bp, Homo sapiens
tatataaataagc

SEQ ID NO: 5511728 - DNA, 12 bp, Homo sapiens
tatataaatact

SEQ ID NO: 5511729 - DNA, 14 bp, Homo sapiens
tatataaatactat

SEQ ID NO: 5511730 - DNA, 15 bp, Homo sapiens
tatataaatatatat

SEQ ID NO: 5511731 - DNA, 16 bp, Homo sapiens
tatataaatgacatta

SEQ ID NO: 5511732 - DNA, 12 bp, Homo sapiens
tatataaatgct

SEQ ID NO: 5511733 - DNA, 14 bp, Homo sapiens
tatataaatgggaa

SEQ ID NO: 5511734 - DNA, 17 bp, Homo sapiens
tatataaatgggaacat

SEQ ID NO: 5511735 - DNA, 13 bp, Homo sapiens
tatataaatgtat

SEQ ID NO: 5511736 - DNA, 12 bp, Homo sapiens
tatataaattat

SEQ ID NO: 5511737 - DNA, 23 bp, Homo sapiens
tatataaattgagcttgcttctt

SEQ ID NO: 5511738 - DNA, 13 bp, Homo sapiens
tatataacaatgc

SEQ ID NO: 5511739 - DNA, 17 bp, Homo sapiens
tatataacaatgctgta

SEQ ID NO: 5511740 - DNA, 20 bp, Homo sapiens
tatataaccacatttctaag

SEQ ID NO: 5511741 - DNA, 22 bp, Homo sapiens
tatataacccactgctgaaaaa

SEQ ID NO: 5511742 - DNA, 22 bp, Homo sapiens
tatataaccctaggaatttaga

SEQ ID NO: 5511743 - DNA, 15 bp, Homo sapiens
tatataactacatta

SEQ ID NO: 5511744 - DNA, 16 bp, Homo sapiens
tatataactttagaaa

SEQ ID NO: 5511745 - DNA, 13 bp, Homo sapiens
tatataacttttt

SEQ ID NO: 5511746 - DNA, 14 bp, Homo sapiens
tatataagacatta

SEQ ID NO: 5511747 - DNA, 18 bp, Homo sapiens
tatataagatggaagctt

SEQ ID NO: 5511748 - DNA, 18 bp, Homo sapiens
tatataagcaaaatgaaa

SEQ ID NO: 5511749 - DNA, 13 bp, Homo sapiens
tatataataaatt

SEQ ID NO: 5511750 - DNA, 15 bp, Homo sapiens
tatataataacttta

SEQ ID NO: 5511751 - DNA, 15 bp, Homo sapiens
tatataatactaaag

SEQ ID NO: 5511752 - DNA, 16 bp, Homo sapiens
tatataatactaaagt

SEQ ID NO: 5511753 - DNA, 23 bp, Homo sapiens
tatataatactgactgagaatat

SEQ ID NO: 5511754 - DNA, 13 bp, Homo sapiens
tatataatatcta

SEQ ID NO: 5511755 - DNA, 14 bp, Homo sapiens
tatataatatgtca

SEQ ID NO: 5511756 - DNA, 17 bp, Homo sapiens
tatataatatgtcacct

SEQ ID NO: 5511757 - DNA, 14 bp, Homo sapiens
tatataatcaaaat

SEQ ID NO: 5511758 - DNA, 16 bp, Homo sapiens
tatataatcatgctca

SEQ ID NO: 5511759 - DNA, 20 bp, Homo sapiens
tatataatggtgatgtcata

SEQ ID NO: 5511760 - DNA, 15 bp, Homo sapiens
tatataatggtttac

SEQ ID NO: 5511761 - DNA, 22 bp, Homo sapiens
tatataatggtttactgctgtc

SEQ ID NO: 5511762 - DNA, 17 bp, Homo sapiens
tatataattatgttatt

SEQ ID NO: 5511763 - DNA, 21 bp, Homo sapiens
tatataattcactcaagcact

SEQ ID NO: 5511764 - DNA, 15 bp, Homo sapiens
tatataattgtgaag

SEQ ID NO: 5511765 - DNA, 20 bp, Homo sapiens
tatataatttgagtgtatat

SEQ ID NO: 5511766 - DNA, 22 bp, Homo sapiens
tatatacaatgagtaaaatcac

SEQ ID NO: 5511767 - DNA, 22 bp, Homo sapiens
tatatacacacacaaagagagt

SEQ ID NO: 5511768 - DNA, 16 bp, Homo sapiens
tatatacagaggaaat

SEQ ID NO: 5511769 - DNA, 23 bp, Homo sapiens
tatatacagaggaaatctgtaac

SEQ ID NO: 5511770 - DNA, 20 bp, Homo sapiens
tatatacagggtattaagaa

SEQ ID NO: 5511771 - DNA, 12 bp, Homo sapiens
tatatacagtta

SEQ ID NO: 5511772 - DNA, 14 bp, Homo sapiens
tatatacagttatt

SEQ ID NO: 5511773 - DNA, 13 bp, Homo sapiens
tatatacataaaa

SEQ ID NO: 5511774 - DNA, 13 bp, Homo sapiens
tatatacatatgt

SEQ ID NO: 5511775 - DNA, 14 bp, Homo sapiens
tatatacatatgta

SEQ ID NO: 5511776 - DNA, 13 bp, Homo sapiens
tatatacatatta

SEQ ID NO: 5511777 - DNA, 18 bp, Homo sapiens
tatatacatattataaat

SEQ ID NO: 5511778 - DNA, 16 bp, Homo sapiens
tatatacatgtatagt

SEQ ID NO: 5511779 - DNA, 19 bp, Homo sapiens
tatatacattagacacaca

SEQ ID NO: 5511780 - DNA, 20 bp, Homo sapiens
tatatacccgtacaacgtgt

SEQ ID NO: 5511781 - DNA, 20 bp, Homo sapiens
tatatacttgttgtttaatg

SEQ ID NO: 5511782 - DNA, 13 bp, Homo sapiens
tatatagaaaaga

SEQ ID NO: 5511783 - DNA, 17 bp, Homo sapiens
tatatagaaatatatac

SEQ ID NO: 5511784 - DNA, 23 bp, Homo sapiens
tatatagaacacaagggatataa

SEQ ID NO: 5511785 - DNA, 22 bp, Homo sapiens
tatatagaatttcctgtaatat

SEQ ID NO: 5511786 - DNA, 21 bp, Homo sapiens
tatatagagacttctaaatca

SEQ ID NO: 5511787 - DNA, 13 bp, Homo sapiens
tatatagagatgt

SEQ ID NO: 5511788 - DNA, 16 bp, Homo sapiens
tatatagagatgtttt

SEQ ID NO: 5511789 - DNA, 20 bp, Homo sapiens
tatatagatgtcagcaatta

SEQ ID NO: 5511790 - DNA, 22 bp, Homo sapiens
tatatagatgtctgtgtataca

SEQ ID NO: 5511791 - DNA, 21 bp, Homo sapiens
tatatagcaaagatatatatt

SEQ ID NO: 5511792 - DNA, 23 bp, Homo sapiens
tatatagcaagtgctatttcagc

SEQ ID NO: 5511793 - DNA, 15 bp, Homo sapiens
tatatagcagtaaaa

SEQ ID NO: 5511794 - DNA, 22 bp, Homo sapiens
tatataggaaactaagcattgt

SEQ ID NO: 5511795 - DNA, 16 bp, Homo sapiens
tatataggatattgct

SEQ ID NO: 5511796 - DNA, 17 bp, Homo sapiens
tatataggatattgcta

SEQ ID NO: 5511797 - DNA, 17 bp, Homo sapiens
tatataggcagttgcat

SEQ ID NO: 5511798 - DNA, 18 bp, Homo sapiens
tatataggcatcacattt

SEQ ID NO: 5511799 - DNA, 17 bp, Homo sapiens
tatataggttgtgcaaa

SEQ ID NO: 5511800 - DNA, 13 bp, Homo sapiens
tatatagtatatt

SEQ ID NO: 5511801 - DNA, 21 bp, Homo sapiens
tatatagttacaacattaatt

SEQ ID NO: 5511802 - DNA, 21 bp, Homo sapiens
tatatagttagctttattgaa

SEQ ID NO: 5511803 - DNA, 23 bp, Homo sapiens
tatatagttagctttattgaagt

SEQ ID NO: 5511804 - DNA, 18 bp, Homo sapiens
tatatagttccttgcctt

SEQ ID NO: 5511805 - DNA, 22 bp, Homo sapiens
tatatagtttattgacaataat

SEQ ID NO: 5511806 - DNA, 16 bp, Homo sapiens
tatatataaacctaaa

SEQ ID NO: 5511807 - DNA, 15 bp, Homo sapiens
tatatataaagtata

SEQ ID NO: 5511808 - DNA, 15 bp, Homo sapiens
tatatataagaaaga

SEQ ID NO: 5511809 - DNA, 15 bp, Homo sapiens
tatatataataaata

SEQ ID NO: 5511810 - DNA, 18 bp, Homo sapiens
tatatataattctgtaca

SEQ ID NO: 5511811 - DNA, 15 bp, Homo sapiens
tatatatacacacac

SEQ ID NO: 5511812 - DNA, 13 bp, Homo sapiens
tatatatacagta

SEQ ID NO: 5511813 - DNA, 12 bp, Homo sapiens
tatatatacata

SEQ ID NO: 5511814 - DNA, 13 bp, Homo sapiens
tatatatacataa

SEQ ID NO: 5511815 - DNA, 22 bp, Homo sapiens
tatatatacatacacttgtata

SEQ ID NO: 5511816 - DNA, 18 bp, Homo sapiens
tatatatacatatgtaga

SEQ ID NO: 5511817 - DNA, 15 bp, Homo sapiens
tatatatacatgtat

SEQ ID NO: 5511818 - DNA, 23 bp, Homo sapiens
tatatatacattagacacacata

SEQ ID NO: 5511819 - DNA, 15 bp, Homo sapiens
tatatatagaaatat

SEQ ID NO: 5511820 - DNA, 12 bp, Homo sapiens
tatatatagaat

SEQ ID NO: 5511821 - DNA, 12 bp, Homo sapiens
tatatatagtaa

SEQ ID NO: 5511822 - DNA, 19 bp, Homo sapiens
tatatatagtgctatatat

SEQ ID NO: 5511823 - DNA, 15 bp, Homo sapiens
tatatatagtttatt

SEQ ID NO: 5511824 - DNA, 11 bp, Homo sapiens
tatatatataa

SEQ ID NO: 5511825 - DNA, 14 bp, Homo sapiens
tatatatataaagt

SEQ ID NO: 5511826 - DNA, 14 bp, Homo sapiens
tatatatataaatg

SEQ ID NO: 5511827 - DNA, 16 bp, Homo sapiens
tatatatatacacata

SEQ ID NO: 5511828 - DNA, 13 bp, Homo sapiens
tatatatatatat

SEQ ID NO: 5511829 - DNA, 15 bp, Homo sapiens
tatatatatatataa

SEQ ID NO: 5511830 - DNA, 14 bp, Homo sapiens
tatatatatatatg

SEQ ID NO: 5511831 - DNA, 13 bp, Homo sapiens
tatatatatatgt

SEQ ID NO: 5511832 - DNA, 13 bp, Homo sapiens
tatatatatattt

SEQ ID NO: 5511833 - DNA, 11 bp, Homo sapiens
tatatatatca

SEQ ID NO: 5511834 - DNA, 15 bp, Homo sapiens
tatatatatgtatat

SEQ ID NO: 5511835 - DNA, 12 bp, Homo sapiens
tatatatatgtg

SEQ ID NO: 5511836 - DNA, 13 bp, Homo sapiens
tatatatatttgt

SEQ ID NO: 5511837 - DNA, 14 bp, Homo sapiens
tatatatatttgta

SEQ ID NO: 5511838 - DNA, 15 bp, Homo sapiens
tatatatatttgtaa

SEQ ID NO: 5511839 - DNA, 14 bp, Homo sapiens
tatatatcactcta

SEQ ID NO: 5511840 - DNA, 16 bp, Homo sapiens
tatatatcagtttgat

SEQ ID NO: 5511841 - DNA, 17 bp, Homo sapiens
tatatatcctatttgat

SEQ ID NO: 5511842 - DNA, 14 bp, Homo sapiens
tatatatcctctgt

SEQ ID NO: 5511843 - DNA, 16 bp, Homo sapiens
tatatatcctctgtat

SEQ ID NO: 5511844 - DNA, 17 bp, Homo sapiens
tatatatctattattca

SEQ ID NO: 5511845 - DNA, 20 bp, Homo sapiens
tatatatctattattcaaaa

SEQ ID NO: 5511846 - DNA, 21 bp, Homo sapiens
tatatatctgctgtccagaca

SEQ ID NO: 5511847 - DNA, 13 bp, Homo sapiens
tatatatcttata

SEQ ID NO: 5511848 - DNA, 15 bp, Homo sapiens
tatatatgaaaacta

SEQ ID NO: 5511849 - DNA, 16 bp, Homo sapiens
tatatatgaagtaagt

SEQ ID NO: 5511850 - DNA, 16 bp, Homo sapiens
tatatatgatcattga

SEQ ID NO: 5511851 - DNA, 17 bp, Homo sapiens
tatatgcctttttccta

SEQ ID NO: 5511852 - DNA, 12 bp, Homo sapiens
tatatgctgcat

SEQ ID NO: 5511853 - DNA, 19 bp, Homo sapiens
tatatgctgtatttctttg

SEQ ID NO: 5511854 - DNA, 21 bp, Homo sapiens
tatatgcttactgatatattt

SEQ ID NO: 5511855 - DNA, 19 bp, Homo sapiens
tatatgcttccagaatggg

SEQ ID NO: 5511856 - DNA, 19 bp, Homo sapiens
tatatgctttttctcagat

SEQ ID NO: 5511857 - DNA, 14 bp, Homo sapiens
tatatggaaatata

SEQ ID NO: 5511858 - DNA, 18 bp, Homo sapiens
tatatggaaatatatatt

SEQ ID NO: 5511859 - DNA, 17 bp, Homo sapiens
tatatggaaattctgct

SEQ ID NO: 5511860 - DNA, 15 bp, Homo sapiens
tatatggaagaaagt

SEQ ID NO: 5511861 - DNA, 16 bp, Homo sapiens
tatatggaataagtgt

SEQ ID NO: 5511862 - DNA, 15 bp, Homo sapiens
tatatggacatggca

SEQ ID NO: 5511863 - DNA, 23 bp, Homo sapiens
tatatggaggattctttccccag

SEQ ID NO: 5511864 - DNA, 13 bp, Homo sapiens
tatatggataatg

SEQ ID NO: 5511865 - DNA, 18 bp, Homo sapiens
tatatggatgattcagaa

SEQ ID NO: 5511866 - DNA, 18 bp, Homo sapiens
tatatggcagagttgtaa

SEQ ID NO: 5511867 - DNA, 14 bp, Homo sapiens
tatatggcaggagc

SEQ ID NO: 5511868 - DNA, 15 bp, Homo sapiens
tatatggcaggagct

SEQ ID NO: 5511869 - DNA, 22 bp, Homo sapiens
tatatgggcttttacctgtgca

SEQ ID NO: 5511870 - DNA, 21 bp, Homo sapiens
tatatggggatggtagttttt

SEQ ID NO: 5511871 - DNA, 22 bp, Homo sapiens
tatatggtatatatacatatat

SEQ ID NO: 5511872 - DNA, 17 bp, Homo sapiens
tatatggtctaatgttt

SEQ ID NO: 5511873 - DNA, 22 bp, Homo sapiens
tatatggtggtaataagggaaa

SEQ ID NO: 5511874 - DNA, 17 bp, Homo sapiens
tatatggttctccaaga

SEQ ID NO: 5511875 - DNA, 22 bp, Homo sapiens
tatatggttctccaagaaactg

SEQ ID NO: 5511876 - DNA, 14 bp, Homo sapiens
tatatgtaaattac

SEQ ID NO: 5511877 - DNA, 22 bp, Homo sapiens
tatatgtaacttcagatgtttc

SEQ ID NO: 5511878 - DNA, 18 bp, Homo sapiens
tatatgtaatatatacat

SEQ ID NO: 5511879 - DNA, 13 bp, Homo sapiens
tatatgtacagtt

SEQ ID NO: 5511880 - DNA, 16 bp, Homo sapiens
tatatgtacatacata

SEQ ID NO: 5511881 - DNA, 18 bp, Homo sapiens
tatatgtaccctctgaaa

SEQ ID NO: 5511882 - DNA, 14 bp, Homo sapiens
tatatgtactgttt

SEQ ID NO: 5511883 - DNA, 14 bp, Homo sapiens
tatatgtagagaaa

SEQ ID NO: 5511884 - DNA, 15 bp, Homo sapiens
tatatgtagatgtat

SEQ ID NO: 5511885 - DNA, 11 bp, Homo sapiens
tatatgtagcc

SEQ ID NO: 5511886 - DNA, 18 bp, Homo sapiens
tatatgtagccagacagt

SEQ ID NO: 5511887 - DNA, 19 bp, Homo sapiens
tatatgtagtgcattttta

SEQ ID NO: 5511888 - DNA, 15 bp, Homo sapiens
tatatgtataatata

SEQ ID NO: 5511889 - DNA, 15 bp, Homo sapiens
tatatgtatacatat

SEQ ID NO: 5511890 - DNA, 13 bp, Homo sapiens
tatatgtatatat

SEQ ID NO: 5511891 - DNA, 21 bp, Homo sapiens
tatatgtatatatatatagta

SEQ ID NO: 5511892 - DNA, 15 bp, Homo sapiens
tatatgtatatattt

SEQ ID NO: 5511893 - DNA, 20 bp, Homo sapiens
tatatgtatatatttattat

SEQ ID NO: 5511894 - DNA, 18 bp, Homo sapiens
tatatgtatatgtatata

SEQ ID NO: 5511895 - DNA, 12 bp, Homo sapiens
tatatgtatatt

SEQ ID NO: 5511896 - DNA, 12 bp, Homo sapiens
tatatgtatgtg

SEQ ID NO: 5511897 - DNA, 14 bp, Homo sapiens
tatatgtatgtgtt

SEQ ID NO: 5511898 - DNA, 15 bp, Homo sapiens
tatatgtatgtgttt

SEQ ID NO: 5511899 - DNA, 19 bp, Homo sapiens
tatatgtattcccttgtat

SEQ ID NO: 5511900 - DNA, 20 bp, Homo sapiens
tatatgtatttaaaaaaatc

SEQ ID NO: 5511901 - DNA, 18 bp, Homo sapiens
tatatgtatttaaaaaca

SEQ ID NO: 5511902 - DNA, 20 bp, Homo sapiens
tatatgtatttaaaaacaaa

SEQ ID NO: 5511903 - DNA, 12 bp, Homo sapiens
tatatgtatttt

SEQ ID NO: 5511904 - DNA, 21 bp, Homo sapiens
tatatgtattttttgaatcta

SEQ ID NO: 5511905 - DNA, 12 bp, Homo sapiens
tatatgtcaata

SEQ ID NO: 5511906 - DNA, 14 bp, Homo sapiens
tatatgtcagacat

SEQ ID NO: 5511907 - DNA, 18 bp, Homo sapiens
tatatgtcagacatgaaa

SEQ ID NO: 5511908 - DNA, 20 bp, Homo sapiens
tatatgtcagagctgttata

SEQ ID NO: 5511909 - DNA, 14 bp, Homo sapiens
tatatgtcattatt

SEQ ID NO: 5511910 - DNA, 23 bp, Homo sapiens
tatatgtgaaaaaaatgagactt

SEQ ID NO: 5511911 - DNA, 14 bp, Homo sapiens
tatatgtgaacttt

SEQ ID NO: 5511912 - DNA, 12 bp, Homo sapiens
tatatgtgagga

SEQ ID NO: 5511913 - DNA, 16 bp, Homo sapiens
tatatgtgatgatcta

SEQ ID NO: 5511914 - DNA, 23 bp, Homo sapiens
tatatgtgattttcaaatatgta

SEQ ID NO: 5511915 - DNA, 23 bp, Homo sapiens
tatatgtgtaattttttaaatga

SEQ ID NO: 5511916 - DNA, 17 bp, Homo sapiens
tatatgtgtatatatac

SEQ ID NO: 5511917 - DNA, 13 bp, Homo sapiens
tatatgtgtccat

SEQ ID NO: 5511918 - DNA, 16 bp, Homo sapiens
tatatgtgtgccctgg

SEQ ID NO: 5511919 - DNA, 17 bp, Homo sapiens
tatatgtgtgccctgga

SEQ ID NO: 5511920 - DNA, 12 bp, Homo sapiens
tatatgtgtgtg

SEQ ID NO: 5511921 - DNA, 15 bp, Homo sapiens
tatatgtgtgtttaa

SEQ ID NO: 5511922 - DNA, 16 bp, Homo sapiens
tatatgtgtgtttaaa

SEQ ID NO: 5511923 - DNA, 13 bp, Homo sapiens
tatatgttattaa

SEQ ID NO: 5511924 - DNA, 15 bp, Homo sapiens
tatatgttattaaac

SEQ ID NO: 5511925 - DNA, 16 bp, Homo sapiens
tatatgttattaaaca

SEQ ID NO: 5511926 - DNA, 14 bp, Homo sapiens
tatatgttcactgt

SEQ ID NO: 5511927 - DNA, 20 bp, Homo sapiens
tatatgttctaattaataaa

SEQ ID NO: 5511928 - DNA, 17 bp, Homo sapiens
tatatgttctgcaagaa

SEQ ID NO: 5511929 - DNA, 17 bp, Homo sapiens
tatatgttggtttaatt

SEQ ID NO: 5511930 - DNA, 14 bp, Homo sapiens
tatatgtttacaca

SEQ ID NO: 5511931 - DNA, 15 bp, Homo sapiens
tatatgtttatacac

SEQ ID NO: 5511932 - DNA, 16 bp, Homo sapiens
tatatgtttggctgaa

SEQ ID NO: 5511933 - DNA, 22 bp, Homo sapiens
tatatgtttggctgaaattatg

SEQ ID NO: 5511934 - DNA, 11 bp, Homo sapiens
tatatgtttta

SEQ ID NO: 5511935 - DNA, 16 bp, Homo sapiens
tatatgttttgagaaa

SEQ ID NO: 5511936 - DNA, 17 bp, Homo sapiens
tatatgttttgagaaaa

SEQ ID NO: 5511937 - DNA, 19 bp, Homo sapiens
tatatgtttttgaaggcag

SEQ ID NO: 5511938 - DNA, 15 bp, Homo sapiens
tatattaaaaatggt

SEQ ID NO: 5511939 - DNA, 16 bp, Homo sapiens
tatattaaaaatggta

SEQ ID NO: 5511940 - DNA, 22 bp, Homo sapiens
tatattaaaaatggtaaaattg

SEQ ID NO: 5511941 - DNA, 15 bp, Homo sapiens
tatattaaaacaata

SEQ ID NO: 5511942 - DNA, 20 bp, Homo sapiens
tatattaaaacaataatgca

SEQ ID NO: 5511943 - DNA, 22 bp, Homo sapiens
tatattaaaacaataatgcaat

SEQ ID NO: 5511944 - DNA, 11 bp, Homo sapiens
tatattaaaat

SEQ ID NO: 5511945 - DNA, 21 bp, Homo sapiens
tatattaaaatagcatactgt

SEQ ID NO: 5511946 - DNA, 14 bp, Homo sapiens
tatattaaagaaaa

SEQ ID NO: 5511947 - DNA, 13 bp, Homo sapiens
tatattaaagtgt

SEQ ID NO: 5511948 - DNA, 12 bp, Homo sapiens
tatattaaatga

SEQ ID NO: 5511949 - DNA, 17 bp, Homo sapiens
tatattaacttttatta

SEQ ID NO: 5511950 - DNA, 14 bp, Homo sapiens
tatattaagcagaa

SEQ ID NO: 5511951 - DNA, 15 bp, Homo sapiens
tatattaagcagaaa

SEQ ID NO: 5511952 - DNA, 15 bp, Homo sapiens
tatattaatagtaat

SEQ ID NO: 5511953 - DNA, 22 bp, Homo sapiens
tatattaatagtaatttgtaaa

SEQ ID NO: 5511954 - DNA, 12 bp, Homo sapiens
tatattaatata

SEQ ID NO: 5511955 - DNA, 14 bp, Homo sapiens
tatattaatattta

SEQ ID NO: 5511956 - DNA, 20 bp, Homo sapiens
tatattaatcaccttctttg

SEQ ID NO: 5511957 - DNA, 22 bp, Homo sapiens
tatattaatcaccttctttgta

SEQ ID NO: 5511958 - DNA, 17 bp, Homo sapiens
tatattaatgtacttgt

SEQ ID NO: 5511959 - DNA, 12 bp, Homo sapiens
tatattacaatg

SEQ ID NO: 5511960 - DNA, 22 bp, Homo sapiens
tatattacactacacactgtgt

SEQ ID NO: 5511961 - DNA, 18 bp, Homo sapiens
tatattaccagcaagaat

SEQ ID NO: 5511962 - DNA, 21 bp, Homo sapiens
tatattaccagcaagaataaa

SEQ ID NO: 5511963 - DNA, 18 bp, Homo sapiens
tatattacccaatggaaa

SEQ ID NO: 5511964 - DNA, 13 bp, Homo sapiens
tatattacctcaa

SEQ ID NO: 5511965 - DNA, 21 bp, Homo sapiens
tatattacctcaaattcctaa

SEQ ID NO: 5511966 - DNA, 17 bp, Homo sapiens
tatattactaataactt

SEQ ID NO: 5511967 - DNA, 15 bp, Homo sapiens
tatattactgaattg

SEQ ID NO: 5511968 - DNA, 16 bp, Homo sapiens
tatattactgacattt

SEQ ID NO: 5511969 - DNA, 15 bp, Homo sapiens
tatattactgattta

SEQ ID NO: 5511970 - DNA, 23 bp, Homo sapiens
tatattacttgcctatctgactt

SEQ ID NO: 5511971 - DNA, 18 bp, Homo sapiens
tatattacttttgtaaat

SEQ ID NO: 5511972 - DNA, 19 bp, Homo sapiens
tatattacttttgtaaata

SEQ ID NO: 5511973 - DNA, 20 bp, Homo sapiens
tatattacttttgtaaatat

SEQ ID NO: 5511974 - DNA, 16 bp, Homo sapiens
tatattagataaccat

SEQ ID NO: 5511975 - DNA, 21 bp, Homo sapiens
tatattagataaccatattca

SEQ ID NO: 5511976 - DNA, 16 bp, Homo sapiens
tatattagcatttagt

SEQ ID NO: 5511977 - DNA, 18 bp, Homo sapiens
tatattaggatctgcaaa

SEQ ID NO: 5511978 - DNA, 15 bp, Homo sapiens
tatattagtaattta

SEQ ID NO: 5511979 - DNA, 22 bp, Homo sapiens
tatattagtgaagatggtttca

SEQ ID NO: 5511980 - DNA, 14 bp, Homo sapiens
tatattataagatt

SEQ ID NO: 5511981 - DNA, 15 bp, Homo sapiens
tatattataagattt

SEQ ID NO: 5511982 - DNA, 14 bp, Homo sapiens
tatattataagttg

SEQ ID NO: 5511983 - DNA, 13 bp, Homo sapiens
tatattataatag

SEQ ID NO: 5511984 - DNA, 18 bp, Homo sapiens
tatattataattggaagt

SEQ ID NO: 5511985 - DNA, 13 bp, Homo sapiens
tatattatataag

SEQ ID NO: 5511986 - DNA, 16 bp, Homo sapiens
tatattatatatatct

SEQ ID NO: 5511987 - DNA, 20 bp, Homo sapiens
tatattatatatatctatat

SEQ ID NO: 5511988 - DNA, 13 bp, Homo sapiens
tatattatatatg

SEQ ID NO: 5511989 - DNA, 15 bp, Homo sapiens
tatattatatatgga

SEQ ID NO: 5511990 - DNA, 14 bp, Homo sapiens
tatattatatggaa

SEQ ID NO: 5511991 - DNA, 12 bp, Homo sapiens
tatattatcata

SEQ ID NO: 5511992 - DNA, 15 bp, Homo sapiens
tatattatcataaga

SEQ ID NO: 5511993 - DNA, 20 bp, Homo sapiens
tatattatcatgcaaatgct

SEQ ID NO: 5511994 - DNA, 15 bp, Homo sapiens
tatattatgaaaatt

SEQ ID NO: 5511995 - DNA, 14 bp, Homo sapiens
tatattatgaataa

SEQ ID NO: 5511996 - DNA, 16 bp, Homo sapiens
tatattatggtgtaat

SEQ ID NO: 5511997 - DNA, 19 bp, Homo sapiens
tatattatggtgtaatgca

SEQ ID NO: 5511998 - DNA, 24 bp, Homo sapiens
tatattatggtgtaatgcacaatt

SEQ ID NO: 5511999 - DNA, 13 bp, Homo sapiens
tatattatgtctt

SEQ ID NO: 5512000 - DNA, 20 bp, Homo sapiens
tatattattacttgtaaata

SEQ ID NO: 5512001 - DNA, 20 bp, Homo sapiens
tatattattccgtattacat

SEQ ID NO: 5512002 - DNA, 17 bp, Homo sapiens
tatattattctcattta

SEQ ID NO: 5512003 - DNA, 21 bp, Homo sapiens
tatattattctcatttagtgc

SEQ ID NO: 5512004 - DNA, 19 bp, Homo sapiens
tatattattgctatatttg

SEQ ID NO: 5512005 - DNA, 14 bp, Homo sapiens
tatattattgtaag

SEQ ID NO: 5512006 - DNA, 21 bp, Homo sapiens
tatattattgtaagttgtaca

SEQ ID NO: 5512007 - DNA, 16 bp, Homo sapiens
tatattatttctagga

SEQ ID NO: 5512008 - DNA, 22 bp, Homo sapiens
tatattatttctaggaagaatt

SEQ ID NO: 5512009 - DNA, 22 bp, Homo sapiens
tatattatttggcagtttggta

SEQ ID NO: 5512010 - DNA, 16 bp, Homo sapiens
tatattattttactgc

SEQ ID NO: 5512011 - DNA, 16 bp, Homo sapiens
tatattattttctgta

SEQ ID NO: 5512012 - DNA, 16 bp, Homo sapiens
tatattcaaaaattat

SEQ ID NO: 5512013 - DNA, 19 bp, Homo sapiens
tatattcaaattatgtata

SEQ ID NO: 5512014 - DNA, 21 bp, Homo sapiens
tatattcaaccatggacttta

SEQ ID NO: 5512015 - DNA, 20 bp, Homo sapiens
tatattcaatgcatttaaaa

SEQ ID NO: 5512016 - DNA, 14 bp, Homo sapiens
tatattcacagttt

SEQ ID NO: 5512017 - DNA, 15 bp, Homo sapiens
tatattcacagtttt

SEQ ID NO: 5512018 - DNA, 21 bp, Homo sapiens
tatattcagagatgtaccatg

SEQ ID NO: 5512019 - DNA, 13 bp, Homo sapiens
tatattcataaag

SEQ ID NO: 5512020 - DNA, 15 bp, Homo sapiens
tatattcataaagtt

SEQ ID NO: 5512021 - DNA, 18 bp, Homo sapiens
tatattcatcagaatgtt

SEQ ID NO: 5512022 - DNA, 21 bp, Homo sapiens
tatattcatctattttctcag

SEQ ID NO: 5512023 - DNA, 18 bp, Homo sapiens
tatattcatgtaataaat

SEQ ID NO: 5512024 - DNA, 18 bp, Homo sapiens
tatattccaccattcaca

SEQ ID NO: 5512025 - DNA, 19 bp, Homo sapiens
tatattccaccattcacat

SEQ ID NO: 5512026 - DNA, 18 bp, Homo sapiens
tatattccatttacataa

SEQ ID NO: 5512027 - DNA, 18 bp, Homo sapiens
tatattcccaatagcaac

SEQ ID NO: 5512028 - DNA, 19 bp, Homo sapiens
tatattcctcttgcatttc

SEQ ID NO: 5512029 - DNA, 12 bp, Homo sapiens
tatattccttgt

SEQ ID NO: 5512030 - DNA, 21 bp, Homo sapiens
tatattcgggcaggactgttg

SEQ ID NO: 5512031 - DNA, 17 bp, Homo sapiens
tatcactctaaaaaaca

SEQ ID NO: 5512032 - DNA, 19 bp, Homo sapiens
tatcactctaaaaaacatt

SEQ ID NO: 5512033 - DNA, 18 bp, Homo sapiens
tatcactctaatataata

SEQ ID NO: 5512034 - DNA, 15 bp, Homo sapiens
tatcactctagaaaa

SEQ ID NO: 5512035 - DNA, 16 bp, Homo sapiens
tatcactgcagtcacc

SEQ ID NO: 5512036 - DNA, 23 bp, Homo sapiens
tatcactgcagtcacctcttcta

SEQ ID NO: 5512037 - DNA, 20 bp, Homo sapiens
tatcactgcattatcttgct

SEQ ID NO: 5512038 - DNA, 20 bp, Homo sapiens
tatcactgtgcagttgctgt

SEQ ID NO: 5512039 - DNA, 14 bp, Homo sapiens
tatcacttatatat

SEQ ID NO: 5512040 - DNA, 15 bp, Homo sapiens
tatcactttttgaac

SEQ ID NO: 5512041 - DNA, 22 bp, Homo sapiens
tatcactttttgaactaagaaa

SEQ ID NO: 5512042 - DNA, 15 bp, Homo sapiens
tatcagaaaagtaga

SEQ ID NO: 5512043 - DNA, 22 bp, Homo sapiens
tatcagaaaagtagaattatat

SEQ ID NO: 5512044 - DNA, 23 bp, Homo sapiens
tatcagaaaagtagaattatatc

SEQ ID NO: 5512045 - DNA, 21 bp, Homo sapiens
tatcagaaacagtattttctt

SEQ ID NO: 5512046 - DNA, 23 bp, Homo sapiens
tatcagaaacagtattttcttcc

SEQ ID NO: 5512047 - DNA, 22 bp, Homo sapiens
tatcagaactcctttctaagga

SEQ ID NO: 5512048 - DNA, 14 bp, Homo sapiens
tatcagaagaccac

SEQ ID NO: 5512049 - DNA, 23 bp, Homo sapiens
tatcagaagaccacaaaaattga

SEQ ID NO: 5512050 - DNA, 15 bp, Homo sapiens
tatcagaagagaggg

SEQ ID NO: 5512051 - DNA, 16 bp, Homo sapiens
tatcagaagagagggg

SEQ ID NO: 5512052 - DNA, 23 bp, Homo sapiens
tatcagaaggtggtttgacagca

SEQ ID NO: 5512053 - DNA, 16 bp, Homo sapiens
tatcagaataggaaga

SEQ ID NO: 5512054 - DNA, 18 bp, Homo sapiens
tatcagaatctgtgtgaa

SEQ ID NO: 5512055 - DNA, 17 bp, Homo sapiens
tatcagaattctcagaa

SEQ ID NO: 5512056 - DNA, 18 bp, Homo sapiens
tatcagaattgaaacact

SEQ ID NO: 5512057 - DNA, 17 bp, Homo sapiens
tatcagacaagcactat

SEQ ID NO: 5512058 - DNA, 20 bp, Homo sapiens
tatcagacaagcactatttt

SEQ ID NO: 5512059 - DNA, 14 bp, Homo sapiens
tatcagacctctga

SEQ ID NO: 5512060 - DNA, 16 bp, Homo sapiens
tatcagacctctgatc

SEQ ID NO: 5512061 - DNA, 24 bp, Homo sapiens
tatcagactcagttttttgtaact

SEQ ID NO: 5512062 - DNA, 14 bp, Homo sapiens
tatcagagatgtcc

SEQ ID NO: 5512063 - DNA, 20 bp, Homo sapiens
tatcagaggcctataatgaa

SEQ ID NO: 5512064 - DNA, 14 bp, Homo sapiens
tatcagagggtgga

SEQ ID NO: 5512065 - DNA, 15 bp, Homo sapiens
tatcagatacatcac

SEQ ID NO: 5512066 - DNA, 14 bp, Homo sapiens
tatcagatgctcat

SEQ ID NO: 5512067 - DNA, 20 bp, Homo sapiens
tatcagatgctcattgcttt

SEQ ID NO: 5512068 - DNA, 14 bp, Homo sapiens
tatcagattgcttt

SEQ ID NO: 5512069 - DNA, 22 bp, Homo sapiens
tatcagcaatactcatcagagc

SEQ ID NO: 5512070 - DNA, 12 bp, Homo sapiens
tatcagcaatgc

SEQ ID NO: 5512071 - DNA, 20 bp, Homo sapiens
tatcagcacatattttctgt

SEQ ID NO: 5512072 - DNA, 11 bp, Homo sapiens
tatcagcacta

SEQ ID NO: 5512073 - DNA, 18 bp, Homo sapiens
tatcagctacttaagaga

SEQ ID NO: 5512074 - DNA, 19 bp, Homo sapiens
tatcagctacttaagagaa

SEQ ID NO: 5512075 - DNA, 17 bp, Homo sapiens
tatcagctctaaagcag

SEQ ID NO: 5512076 - DNA, 16 bp, Homo sapiens
tatcagctctgcataa

SEQ ID NO: 5512077 - DNA, 22 bp, Homo sapiens
tatcagctctgcataagattat

SEQ ID NO: 5512078 - DNA, 18 bp, Homo sapiens
tatcagctttgataattg

SEQ ID NO: 5512079 - DNA, 21 bp, Homo sapiens
tatcaggactgtgaccaaagc

SEQ ID NO: 5512080 - DNA, 22 bp, Homo sapiens
tatcaggactgtgaccaaagca

SEQ ID NO: 5512081 - DNA, 15 bp, Homo sapiens
tatcaggaggggaag

SEQ ID NO: 5512082 - DNA, 23 bp, Homo sapiens
tatcaggatttcctcttgaacca

SEQ ID NO: 5512083 - DNA, 19 bp, Homo sapiens
tatcaggcaaatttgcatt

SEQ ID NO: 5512084 - DNA, 20 bp, Homo sapiens
tatcaggcaggaccaggtgg

SEQ ID NO: 5512085 - DNA, 21 bp, Homo sapiens
tatcagggatcctctctccag

SEQ ID NO: 5512086 - DNA, 17 bp, Homo sapiens
tatcaggggaatttcag

SEQ ID NO: 5512087 - DNA, 17 bp, Homo sapiens
tatcaggtgcccctctt

SEQ ID NO: 5512088 - DNA, 19 bp, Homo sapiens
tatcaggtgctgccatcca

SEQ ID NO: 5512089 - DNA, 17 bp, Homo sapiens
tatcaggtgtataaatg

SEQ ID NO: 5512090 - DNA, 16 bp, Homo sapiens
tatcagtacaattctt

SEQ ID NO: 5512091 - DNA, 15 bp, Homo sapiens
tatcagtacttttat

SEQ ID NO: 5512092 - DNA, 16 bp, Homo sapiens
tatcagtagtgtacat

SEQ ID NO: 5512093 - DNA, 17 bp, Homo sapiens
tatcagtagtgtacatt

SEQ ID NO: 5512094 - DNA, 21 bp, Homo sapiens
tatcagtatggtgctaatgtg

SEQ ID NO: 5512095 - DNA, 13 bp, Homo sapiens
tatcagtattctg

SEQ ID NO: 5512096 - DNA, 20 bp, Homo sapiens
tatcagtattctgacatgta

SEQ ID NO: 5512097 - DNA, 21 bp, Homo sapiens
tatcagtattctgacatgtaa

SEQ ID NO: 5512098 - DNA, 20 bp, Homo sapiens
tatcagtcaatatttttaga

SEQ ID NO: 5512099 - DNA, 22 bp, Homo sapiens
tatcagtcataactaaataaag

SEQ ID NO: 5512100 - DNA, 23 bp, Homo sapiens
tatcagtcgttttagtgtctgac

SEQ ID NO: 5512101 - DNA, 13 bp, Homo sapiens
tatcagtgaatat

SEQ ID NO: 5512102 - DNA, 15 bp, Homo sapiens
tatcagtgacagagt

SEQ ID NO: 5512103 - DNA, 13 bp, Homo sapiens
tatcagtgcttcc

SEQ ID NO: 5512104 - DNA, 16 bp, Homo sapiens
tatcagtgtcctttcc

SEQ ID NO: 5512105 - DNA, 17 bp, Homo sapiens
tatcagtgtgcccccca

SEQ ID NO: 5512106 - DNA, 17 bp, Homo sapiens
tatcagtgttttaaatt

SEQ ID NO: 5512107 - DNA, 16 bp, Homo sapiens
tatcagttacagtggc

SEQ ID NO: 5512108 - DNA, 17 bp, Homo sapiens
tatcagttacagtggca

SEQ ID NO: 5512109 - DNA, 16 bp, Homo sapiens
tatcagttactcagcc

SEQ ID NO: 5512110 - DNA, 17 bp, Homo sapiens
tatcagttactcagccc

SEQ ID NO: 5512111 - DNA, 19 bp, Homo sapiens
tatcagttactcagccctg

SEQ ID NO: 5512112 - DNA, 21 bp, Homo sapiens
tatcagttactcagccctggg

SEQ ID NO: 5512113 - DNA, 15 bp, Homo sapiens
tatcagttatatgat

SEQ ID NO: 5512114 - DNA, 17 bp, Homo sapiens
tatcagttatcctttgt

SEQ ID NO: 5512115 - DNA, 15 bp, Homo sapiens
tatcagttgcaataa

SEQ ID NO: 5512116 - DNA, 21 bp, Homo sapiens
tatcagttgcaataatacttc

SEQ ID NO: 5512117 - DNA, 17 bp, Homo sapiens
tatcagttgcaggtgcc

SEQ ID NO: 5512118 - DNA, 15 bp, Homo sapiens
tatcagttggacagt

SEQ ID NO: 5512119 - DNA, 12 bp, Homo sapiens
tatcagtttgat

SEQ ID NO: 5512120 - DNA, 20 bp, Homo sapiens
tatcagtttgtcctgtagag

SEQ ID NO: 5512121 - DNA, 22 bp, Homo sapiens
tatcataaacattttacatgca

SEQ ID NO: 5512122 - DNA, 19 bp, Homo sapiens
tatcataaaggatatttca

SEQ ID NO: 5512123 - DNA, 22 bp, Homo sapiens
tatcataaaggatatttcaaat

SEQ ID NO: 5512124 - DNA, 23 bp, Homo sapiens
tatcataaaggatatttcaaatg

SEQ ID NO: 5512125 - DNA, 14 bp, Homo sapiens
tatcataaagtatg

SEQ ID NO: 5512126 - DNA, 18 bp, Homo sapiens
tatcataacatctgggtc

SEQ ID NO: 5512127 - DNA, 23 bp, Homo sapiens
tatcataagttatgcctctgaca

SEQ ID NO: 5512128 - DNA, 12 bp, Homo sapiens
tatcatacagtt

SEQ ID NO: 5512129 - DNA, 20 bp, Homo sapiens
tatcataccctttattctca

SEQ ID NO: 5512130 - DNA, 23 bp, Homo sapiens
tatcatacgttgatagtttacaa

SEQ ID NO: 5512131 - DNA, 15 bp, Homo sapiens
tatcatactcttcta

SEQ ID NO: 5512132 - DNA, 17 bp, Homo sapiens
tatcatactcttctaaa

SEQ ID NO: 5512133 - DNA, 14 bp, Homo sapiens
tatcatagaaatgt

SEQ ID NO: 5512134 - DNA, 18 bp, Homo sapiens
tatcatagaaatgtaact

SEQ ID NO: 5512135 - DNA, 23 bp, Homo sapiens
tatcatagaaatgtaacttttgt

SEQ ID NO: 5512136 - DNA, 14 bp, Homo sapiens
tatcataggtacaa

SEQ ID NO: 5512137 - DNA, 16 bp, Homo sapiens
tatcatagttaacata

SEQ ID NO: 5512138 - DNA, 18 bp, Homo sapiens
tatcatagttattaatgt

SEQ ID NO: 5512139 - DNA, 17 bp, Homo sapiens
tatcatatgtatctaaa

SEQ ID NO: 5512140 - DNA, 18 bp, Homo sapiens
tatcatcaagcaggaatt

SEQ ID NO: 5512141 - DNA, 19 bp, Homo sapiens
tatcatcaatctttatgta

SEQ ID NO: 5512142 - DNA, 18 bp, Homo sapiens
tatcatcacgtatgttat

SEQ ID NO: 5512143 - DNA, 14 bp, Homo sapiens
tatcatcagtattg

SEQ ID NO: 5512144 - DNA, 17 bp, Homo sapiens
tatcatccacacatgaa

SEQ ID NO: 5512145 - DNA, 22 bp, Homo sapiens
tatcatccacattgttttaaaa

SEQ ID NO: 5512146 - DNA, 20 bp, Homo sapiens
tatcatccccaaatgtgtct

SEQ ID NO: 5512147 - DNA, 21 bp, Homo sapiens
tatcatctcaattttttcaaa

SEQ ID NO: 5512148 - DNA, 18 bp, Homo sapiens
tatcatctcttaaatttt

SEQ ID NO: 5512149 - DNA, 15 bp, Homo sapiens
tatcatctgtcatta

SEQ ID NO: 5512150 - DNA, 18 bp, Homo sapiens
tatcatctgtcattatat

SEQ ID NO: 5512151 - DNA, 20 bp, Homo sapiens
tatcatctgtcattatattc

SEQ ID NO: 5512152 - DNA, 12 bp, Homo sapiens
tatcatgaagcc

SEQ ID NO: 5512153 - DNA, 13 bp, Homo sapiens
tatcatgaagcct

SEQ ID NO: 5512154 - DNA, 24 bp, Homo sapiens
tatcatgaattttaaagtatgcat

SEQ ID NO: 5512155 - DNA, 17 bp, Homo sapiens
tatcatgacaaagactg

SEQ ID NO: 5512156 - DNA, 13 bp, Homo sapiens
tatcatgacatgt

SEQ ID NO: 5512157 - DNA, 14 bp, Homo sapiens
tatcatgacatgtt

SEQ ID NO: 5512158 - DNA, 15 bp, Homo sapiens
tatcatgcaaatgct

SEQ ID NO: 5512159 - DNA, 17 bp, Homo sapiens
tatcatgcatgtcctgt

SEQ ID NO: 5512160 - DNA, 19 bp, Homo sapiens
tatcatgcatgtcctgtaa

SEQ ID NO: 5512161 - DNA, 15 bp, Homo sapiens
tatcatgctaaaatt

SEQ ID NO: 5512162 - DNA, 18 bp, Homo sapiens
tatcatgctaaaattcta

SEQ ID NO: 5512163 - DNA, 22 bp, Homo sapiens
tatcatgctaaaattctataga

SEQ ID NO: 5512164 - DNA, 13 bp, Homo sapiens
tatcatgcttcta

SEQ ID NO: 5512165 - DNA, 23 bp, Homo sapiens
tatcatgctttaaagtgtaataa

SEQ ID NO: 5512166 - DNA, 17 bp, Homo sapiens
tatcatgctttgaaaaa

SEQ ID NO: 5512167 - DNA, 13 bp, Homo sapiens
tatcatggaagaa

SEQ ID NO: 5512168 - DNA, 12 bp, Homo sapiens
tatcatggaatt

SEQ ID NO: 5512169 - DNA, 15 bp, Homo sapiens
tatcatggtatttga

SEQ ID NO: 5512170 - DNA, 16 bp, Homo sapiens
tatcatgtcaaacgtg

SEQ ID NO: 5512171 - DNA, 21 bp, Homo sapiens
tatcatgtcaaacgtgaaaat

SEQ ID NO: 5512172 - DNA, 11 bp, Homo sapiens
tatcatgtgta

SEQ ID NO: 5512173 - DNA, 19 bp, Homo sapiens
tatcatgttaaattagaat

SEQ ID NO: 5512174 - DNA, 13 bp, Homo sapiens
tatcattaaaaat

SEQ ID NO: 5512175 - DNA, 12 bp, Homo sapiens
tatcattaaaat

SEQ ID NO: 5512176 - DNA, 13 bp, Homo sapiens
tatcattaaaata

SEQ ID NO: 5512177 - DNA, 16 bp, Homo sapiens
tatcattaaacaaata

SEQ ID NO: 5512178 - DNA, 14 bp, Homo sapiens
tatcattaaacatg

SEQ ID NO: 5512179 - DNA, 15 bp, Homo sapiens
tatcattaaacatga

SEQ ID NO: 5512180 - DNA, 13 bp, Homo sapiens
tatcattaaagtt

SEQ ID NO: 5512181 - DNA, 15 bp, Homo sapiens
tatcattaaagttct

SEQ ID NO: 5512182 - DNA, 18 bp, Homo sapiens
tatcattactaacttctt

SEQ ID NO: 5512183 - DNA, 20 bp, Homo sapiens
tatcattatctttgctgtta

SEQ ID NO: 5512184 - DNA, 13 bp, Homo sapiens
tatcattcaagtg

SEQ ID NO: 5512185 - DNA, 14 bp, Homo sapiens
tatcattcagcaac

SEQ ID NO: 5512186 - DNA, 13 bp, Homo sapiens
tatcattcatctt

SEQ ID NO: 5512187 - DNA, 19 bp, Homo sapiens
tatcattcatcttcttctt

SEQ ID NO: 5512188 - DNA, 16 bp, Homo sapiens
tatcattccaattcta

SEQ ID NO: 5512189 - DNA, 17 bp, Homo sapiens
tatcattccaattctaa

SEQ ID NO: 5512190 - DNA, 23 bp, Homo sapiens
tatcattccaattctaaatccga

SEQ ID NO: 5512191 - DNA, 23 bp, Homo sapiens
tatcattctaaagatagagtaaa

SEQ ID NO: 5512192 - DNA, 14 bp, Homo sapiens
tatcattctacaga

SEQ ID NO: 5512193 - DNA, 19 bp, Homo sapiens
tatcattctacagaataat

SEQ ID NO: 5512194 - DNA, 13 bp, Homo sapiens
tatcattctcagt

SEQ ID NO: 5512195 - DNA, 16 bp, Homo sapiens
tatcattcttataaca

SEQ ID NO: 5512196 - DNA, 12 bp, Homo sapiens
tatcattctttg

SEQ ID NO: 5512197 - DNA, 21 bp, Homo sapiens
tatcattctttgtatcttaaa

SEQ ID NO: 5512198 - DNA, 13 bp, Homo sapiens
tatcattgaaaca

SEQ ID NO: 5512199 - DNA, 17 bp, Homo sapiens
tatcattgaaacattta

SEQ ID NO: 5512200 - DNA, 22 bp, Homo sapiens
tatcattgctcccctgatagaa

SEQ ID NO: 5512201 - DNA, 21 bp, Homo sapiens
tatcattgttggtgttaattg

SEQ ID NO: 5512202 - DNA, 22 bp, Homo sapiens
tatcattgttggtgttaattga

SEQ ID NO: 5512203 - DNA, 16 bp, Homo sapiens
tatcattgtttgtcct

SEQ ID NO: 5512204 - DNA, 22 bp, Homo sapiens
tatcatttaataatatacttgt

SEQ ID NO: 5512205 - DNA, 13 bp, Homo sapiens
tatcatttactct

SEQ ID NO: 5512206 - DNA, 20 bp, Homo sapiens
tatcatttattttttacatt

SEQ ID NO: 5512207 - DNA, 18 bp, Homo sapiens
tatcatttctaattttaa

SEQ ID NO: 5512208 - DNA, 13 bp, Homo sapiens
tatcatttctctt

SEQ ID NO: 5512209 - DNA, 13 bp, Homo sapiens
tatcatttgtgaa

SEQ ID NO: 5512210 - DNA, 15 bp, Homo sapiens
tatcattttaaaatg

SEQ ID NO: 5512211 - DNA, 17 bp, Homo sapiens
tatcattttatagaaaa

SEQ ID NO: 5512212 - DNA, 13 bp, Homo sapiens
tatcatttttgta

SEQ ID NO: 5512213 - DNA, 17 bp, Homo sapiens
tatcatttttgtacagt

SEQ ID NO: 5512214 - DNA, 21 bp, Homo sapiens
tatcatttttgtacagtttgc

SEQ ID NO: 5512215 - DNA, 14 bp, Homo sapiens
tatcatttttgtat

SEQ ID NO: 5512216 - DNA, 16 bp, Homo sapiens
tatcatttttgtataa

SEQ ID NO: 5512217 - DNA, 15 bp, Homo sapiens
tatcatttttgtgca

SEQ ID NO: 5512218 - DNA, 18 bp, Homo sapiens
tatcatttttgtgcacag

SEQ ID NO: 5512219 - DNA, 16 bp, Homo sapiens
tatcattttttcctgt

SEQ ID NO: 5512220 - DNA, 18 bp, Homo sapiens
tatccaaaataatgagga

SEQ ID NO: 5512221 - DNA, 14 bp, Homo sapiens
tatccaaacatgta

SEQ ID NO: 5512222 - DNA, 23 bp, Homo sapiens
tatccaaagaacttgatttgcat

SEQ ID NO: 5512223 - DNA, 16 bp, Homo sapiens
tatccaaagcattgca

SEQ ID NO: 5512224 - DNA, 23 bp, Homo sapiens
tatccaaagggaatactcacatt

SEQ ID NO: 5512225 - DNA, 14 bp, Homo sapiens
tatccaaataatga

SEQ ID NO: 5512226 - DNA, 19 bp, Homo sapiens
tatccaaatcctaagggga

SEQ ID NO: 5512227 - DNA, 20 bp, Homo sapiens
tatccaaatctgaagattgc

SEQ ID NO: 5512228 - DNA, 19 bp, Homo sapiens
tatccaacacaactatcaa

SEQ ID NO: 5512229 - DNA, 19 bp, Homo sapiens
tatccaacatcaacatctt

SEQ ID NO: 5512230 - DNA, 18 bp, Homo sapiens
tatccaaccaacttggtt

SEQ ID NO: 5512231 - DNA, 15 bp, Homo sapiens
tatccaatcaatctt

SEQ ID NO: 5512232 - DNA, 14 bp, Homo sapiens
tatccaatctcatc

SEQ ID NO: 5512233 - DNA, 14 bp, Homo sapiens
tatccaatcttgtt

SEQ ID NO: 5512234 - DNA, 17 bp, Homo sapiens
tatccaattatgtgaca

SEQ ID NO: 5512235 - DNA, 21 bp, Homo sapiens
tatccaattatgtgacaacct

SEQ ID NO: 5512236 - DNA, 22 bp, Homo sapiens
tatccacaaagtactcctcact

SEQ ID NO: 5512237 - DNA, 16 bp, Homo sapiens
tatccacaaatgctat

SEQ ID NO: 5512238 - DNA, 20 bp, Homo sapiens
tatccacaatagctgacggc

SEQ ID NO: 5512239 - DNA, 20 bp, Homo sapiens
tatccacaatagtcagaaaa

SEQ ID NO: 5512240 - DNA, 21 bp, Homo sapiens
tatccacaatagtcagaaaac

SEQ ID NO: 5512241 - DNA, 22 bp, Homo sapiens
tatccacagactccctcccctg

SEQ ID NO: 5512242 - DNA, 21 bp, Homo sapiens
tatccacaggatattaaacgt

SEQ ID NO: 5512243 - DNA, 19 bp, Homo sapiens
tatccacagtactcacttt

SEQ ID NO: 5512244 - DNA, 22 bp, Homo sapiens
tatccacatccctaacatcatg

SEQ ID NO: 5512245 - DNA, 12 bp, Homo sapiens
tatccaccaccc

SEQ ID NO: 5512246 - DNA, 14 bp, Homo sapiens
tatccaccacccca

SEQ ID NO: 5512247 - DNA, 12 bp, Homo sapiens
tatccacccagc

SEQ ID NO: 5512248 - DNA, 13 bp, Homo sapiens
tatccacccagca

SEQ ID NO: 5512249 - DNA, 13 bp, Homo sapiens
tatccacccagcc

SEQ ID NO: 5512250 - DNA, 20 bp, Homo sapiens
tatccacccagcccattctc

SEQ ID NO: 5512251 - DNA, 13 bp, Homo sapiens
tatccacttgtcc

SEQ ID NO: 5512252 - DNA, 15 bp, Homo sapiens
tatccactttgcaca

SEQ ID NO: 5512253 - DNA, 23 bp, Homo sapiens
tatccagaagtattgtttacatt

SEQ ID NO: 5512254 - DNA, 16 bp, Homo sapiens
tatccagaccttgaaa

SEQ ID NO: 5512255 - DNA, 15 bp, Homo sapiens
tatccagagctgttt

SEQ ID NO: 5512256 - DNA, 13 bp, Homo sapiens
tatccagcagtca

SEQ ID NO: 5512257 - DNA, 19 bp, Homo sapiens
tatccagccagtacagtat

SEQ ID NO: 5512258 - DNA, 15 bp, Homo sapiens
tatccaggaattgat

SEQ ID NO: 5512259 - DNA, 19 bp, Homo sapiens
tatccaggaattgatacgt

SEQ ID NO: 5512260 - DNA, 11 bp, Homo sapiens
tatccaggact

SEQ ID NO: 5512261 - DNA, 15 bp, Homo sapiens
tatccaggtcaacag

SEQ ID NO: 5512262 - DNA, 19 bp, Homo sapiens
tatccaggttccctcccag

SEQ ID NO: 5512263 - DNA, 21 bp, Homo sapiens
tatccagtgacttgttctgag

SEQ ID NO: 5512264 - DNA, 19 bp, Homo sapiens
tatccagtgatgtgctgga

SEQ ID NO: 5512265 - DNA, 14 bp, Homo sapiens
tatccagttactgc

SEQ ID NO: 5512266 - DNA, 14 bp, Homo sapiens
tatccagttcctgc

SEQ ID NO: 5512267 - DNA, 14 bp, Homo sapiens
tatccataaaattg

SEQ ID NO: 5512268 - DNA, 17 bp, Homo sapiens
tatccataaaattggat

SEQ ID NO: 5512269 - DNA, 16 bp, Homo sapiens
tatccataatgatgga

SEQ ID NO: 5512270 - DNA, 23 bp, Homo sapiens
tatccataggtttctctccctcc

SEQ ID NO: 5512271 - DNA, 19 bp, Homo sapiens
tatccatagtgacttttca

SEQ ID NO: 5512272 - DNA, 22 bp, Homo sapiens
tatccatagtgacttttcaagt

SEQ ID NO: 5512273 - DNA, 17 bp, Homo sapiens
tatccatatagaaatct

SEQ ID NO: 5512274 - DNA, 21 bp, Homo sapiens
tatccatattacgttgtttct

SEQ ID NO: 5512275 - DNA, 22 bp, Homo sapiens
tatccatattgagtcaaatggt

SEQ ID NO: 5512276 - DNA, 14 bp, Homo sapiens
tatccatattttat

SEQ ID NO: 5512277 - DNA, 13 bp, Homo sapiens
tatccatctcctg

SEQ ID NO: 5512278 - DNA, 17 bp, Homo sapiens
tatccatgatcacacag

SEQ ID NO: 5512279 - DNA, 18 bp, Homo sapiens
tatccatgatcacacagc

SEQ ID NO: 5512280 - DNA, 20 bp, Homo sapiens
tatccatgtaataagcactt

SEQ ID NO: 5512281 - DNA, 14 bp, Homo sapiens
tatccatgtactgt

SEQ ID NO: 5512282 - DNA, 19 bp, Homo sapiens
tatccattacgtgcattta

SEQ ID NO: 5512283 - DNA, 15 bp, Homo sapiens
tatccattataaaca

SEQ ID NO: 5512284 - DNA, 14 bp, Homo sapiens
tatccattatcatg

SEQ ID NO: 5512285 - DNA, 15 bp, Homo sapiens
tatccattatcatgt

SEQ ID NO: 5512286 - DNA, 16 bp, Homo sapiens
tatccattatcatgtg

SEQ ID NO: 5512287 - DNA, 17 bp, Homo sapiens
tatccattatcatgtgt

SEQ ID NO: 5512288 - DNA, 14 bp, Homo sapiens
tatccattcccaag

SEQ ID NO: 5512289 - DNA, 21 bp, Homo sapiens
tatccattctcgttttaggac

SEQ ID NO: 5512290 - DNA, 15 bp, Homo sapiens
tatccattctctcct

SEQ ID NO: 5512291 - DNA, 22 bp, Homo sapiens
tatccattctctccttccctct

SEQ ID NO: 5512292 - DNA, 14 bp, Homo sapiens
tatccattctttct

SEQ ID NO: 5512293 - DNA, 15 bp, Homo sapiens
tatccattgtggaaa

SEQ ID NO: 5512294 - DNA, 15 bp, Homo sapiens
tatccatttctcatg

SEQ ID NO: 5512295 - DNA, 23 bp, Homo sapiens
tatccatttcttttactctgtgt

SEQ ID NO: 5512296 - DNA, 20 bp, Homo sapiens
tatccattttttttactgtt

SEQ ID NO: 5512297 - DNA, 16 bp, Homo sapiens
tatcccaaacttcgga

SEQ ID NO: 5512298 - DNA, 17 bp, Homo sapiens
tatcccaaacttcggaa

SEQ ID NO: 5512299 - DNA, 17 bp, Homo sapiens
tatcccaacattctgca

SEQ ID NO: 5512300 - DNA, 21 bp, Homo sapiens
tatcccaacattctgcaatgg

SEQ ID NO: 5512301 - DNA, 20 bp, Homo sapiens
tatcccaagaccctgccccc

SEQ ID NO: 5512302 - DNA, 15 bp, Homo sapiens
tatcccaagccaacc

SEQ ID NO: 5512303 - DNA, 21 bp, Homo sapiens
tatcccaatcaaagaattaca

SEQ ID NO: 5512304 - DNA, 20 bp, Homo sapiens
tatcccacccaacagctcag

SEQ ID NO: 5512305 - DNA, 21 bp, Homo sapiens
tatcccacccaacagctcaga

SEQ ID NO: 5512306 - DNA, 12 bp, Homo sapiens
tatcccacctcc

SEQ ID NO: 5512307 - DNA, 22 bp, Homo sapiens
tatcccacctgacatgtccttc

SEQ ID NO: 5512308 - DNA, 19 bp, Homo sapiens
tatcccacggaaaatgcca

SEQ ID NO: 5512309 - DNA, 14 bp, Homo sapiens
tatcccagaaatta

SEQ ID NO: 5512310 - DNA, 14 bp, Homo sapiens
tatcccagagaaca

SEQ ID NO: 5512311 - DNA, 16 bp, Homo sapiens
tatcccagctgcctag

SEQ ID NO: 5512312 - DNA, 20 bp, Homo sapiens
tatcccagcttgctgagggg

SEQ ID NO: 5512313 - DNA, 23 bp, Homo sapiens
tatcccagctttaaaaagaaaaa

SEQ ID NO: 5512314 - DNA, 12 bp, Homo sapiens
tatcccatccca

SEQ ID NO: 5512315 - DNA, 19 bp, Homo sapiens
tatcccattctccctctca

SEQ ID NO: 5512316 - DNA, 13 bp, Homo sapiens
tatccccaaatta

SEQ ID NO: 5512317 - DNA, 13 bp, Homo sapiens
tatccccagctgt

SEQ ID NO: 5512318 - DNA, 13 bp, Homo sapiens
tatccccaggcca

SEQ ID NO: 5512319 - DNA, 15 bp, Homo sapiens
tatccccaggccagg

SEQ ID NO: 5512320 - DNA, 17 bp, Homo sapiens
tatccccaggccaggtc

SEQ ID NO: 5512321 - DNA, 17 bp, Homo sapiens
tatccccatctccctgc

SEQ ID NO: 5512322 - DNA, 21 bp, Homo sapiens
tatccccatctccctgcctgg

SEQ ID NO: 5512323 - DNA, 13 bp, Homo sapiens
tatcccccaccaa

SEQ ID NO: 5512324 - DNA, 15 bp, Homo sapiens
tatccccccatcttg

SEQ ID NO: 5512325 - DNA, 19 bp, Homo sapiens
tatccccccatcttgcttc

SEQ ID NO: 5512326 - DNA, 21 bp, Homo sapiens
tatcccccccctgtatagtta

SEQ ID NO: 5512327 - DNA, 21 bp, Homo sapiens
tatccccctacaaccccagcc

SEQ ID NO: 5512328 - DNA, 15 bp, Homo sapiens
tatcccctcccagtc

SEQ ID NO: 5512329 - DNA, 13 bp, Homo sapiens
tatcccctgctac

SEQ ID NO: 5512330 - DNA, 15 bp, Homo sapiens
tatcccgggagcagt

SEQ ID NO: 5512331 - DNA, 17 bp, Homo sapiens
tatccctaacaggctgt

SEQ ID NO: 5512332 - DNA, 18 bp, Homo sapiens
tatccctaacaggctgta

SEQ ID NO: 5512333 - DNA, 14 bp, Homo sapiens
tatccctcatttca

SEQ ID NO: 5512334 - DNA, 14 bp, Homo sapiens
tatccctcccctct

SEQ ID NO: 5512335 - DNA, 14 bp, Homo sapiens
tatccctcctgttg

SEQ ID NO: 5512336 - DNA, 17 bp, Homo sapiens
tatccctctcttcccct

SEQ ID NO: 5512337 - DNA, 14 bp, Homo sapiens
tatccctcttgtaa

SEQ ID NO: 5512338 - DNA, 19 bp, Homo sapiens
tatccctgcacataaactc

SEQ ID NO: 5512339 - DNA, 17 bp, Homo sapiens
tatccctgcccagcctg

SEQ ID NO: 5512340 - DNA, 13 bp, Homo sapiens
tatccctgcccat

SEQ ID NO: 5512341 - DNA, 15 bp, Homo sapiens
tatccctggccacct

SEQ ID NO: 5512342 - DNA, 15 bp, Homo sapiens
tatccctggcttccc

SEQ ID NO: 5512343 - DNA, 19 bp, Homo sapiens
tatccctggcttccccttc

SEQ ID NO: 5512344 - DNA, 17 bp, Homo sapiens
tatcccttctcagaaaa

SEQ ID NO: 5512345 - DNA, 15 bp, Homo sapiens
tatccctttacaatg

SEQ ID NO: 5512346 - DNA, 20 bp, Homo sapiens
tatccctttacaatgtgaat

SEQ ID NO: 5512347 - DNA, 13 bp, Homo sapiens
tatccctttcctg

SEQ ID NO: 5512348 - DNA, 16 bp, Homo sapiens
tatccgaactactgtt

SEQ ID NO: 5512349 - DNA, 21 bp, Homo sapiens
tatccgggtgctcaataaact

SEQ ID NO: 5512350 - DNA, 23 bp, Homo sapiens
tatccgggtgctcaataaacttg

SEQ ID NO: 5512351 - DNA, 16 bp, Homo sapiens
tatcctaaacatcatt

SEQ ID NO: 5512352 - DNA, 12 bp, Homo sapiens
tatcctaataaa

SEQ ID NO: 5512353 - DNA, 15 bp, Homo sapiens
tatcctaataaaaag

SEQ ID NO: 5512354 - DNA, 15 bp, Homo sapiens
tatcctacaacaaga

SEQ ID NO: 5512355 - DNA, 20 bp, Homo sapiens
tatcctagagaggctggcaa

SEQ ID NO: 5512356 - DNA, 20 bp, Homo sapiens
tatcctagcacatgcttcaa

SEQ ID NO: 5512357 - DNA, 24 bp, Homo sapiens
tatcctagcacatgcttcaatagt

SEQ ID NO: 5512358 - DNA, 20 bp, Homo sapiens
tatcctcaagttgtgtgcta

SEQ ID NO: 5512359 - DNA, 16 bp, Homo sapiens
tatcctcaattatctt

SEQ ID NO: 5512360 - DNA, 16 bp, Homo sapiens
tatcctcactgccctc

SEQ ID NO: 5512361 - DNA, 21 bp, Homo sapiens
tatcctccaggtttttcaatt

SEQ ID NO: 5512362 - DNA, 15 bp, Homo sapiens
tatcctccctgccca

SEQ ID NO: 5512363 - DNA, 14 bp, Homo sapiens
tatcctccctgtaa

SEQ ID NO: 5512364 - DNA, 22 bp, Homo sapiens
tatcctccgccctttttgtcct

SEQ ID NO: 5512365 - DNA, 19 bp, Homo sapiens
tatcctctccccctcctcc

SEQ ID NO: 5512366 - DNA, 18 bp, Homo sapiens
tatcctctctctcttcta

SEQ ID NO: 5512367 - DNA, 14 bp, Homo sapiens
tatcctctcttcct

SEQ ID NO: 5512368 - DNA, 18 bp, Homo sapiens
tatcctctcttcctcttc

SEQ ID NO: 5512369 - DNA, 11 bp, Homo sapiens
tatcctctgat

SEQ ID NO: 5512370 - DNA, 20 bp, Homo sapiens
tatcctctgatctccatggc

SEQ ID NO: 5512371 - DNA, 13 bp, Homo sapiens
tatcctctttgta

SEQ ID NO: 5512372 - DNA, 16 bp, Homo sapiens
tatcctgaaatttcag

SEQ ID NO: 5512373 - DNA, 13 bp, Homo sapiens
tatcctgaataac

SEQ ID NO: 5512374 - DNA, 22 bp, Homo sapiens
tatcctgacagcgccatgtgtg

SEQ ID NO: 5512375 - DNA, 23 bp, Homo sapiens
tatcctgacagcgccatgtgtgt

SEQ ID NO: 5512376 - DNA, 18 bp, Homo sapiens
tatcctgagagcccagaa

SEQ ID NO: 5512377 - DNA, 14 bp, Homo sapiens
tatcctgataaaca

SEQ ID NO: 5512378 - DNA, 21 bp, Homo sapiens
tatcctgatcaagcatggaac

SEQ ID NO: 5512379 - DNA, 22 bp, Homo sapiens
tatcctgattataggattttaa

SEQ ID NO: 5512380 - DNA, 15 bp, Homo sapiens
tatcctgattccaaa

SEQ ID NO: 5512381 - DNA, 14 bp, Homo sapiens
tatcctgcaccctc

SEQ ID NO: 5512382 - DNA, 16 bp, Homo sapiens
tatcctgcaccctctg

SEQ ID NO: 5512383 - DNA, 16 bp, Homo sapiens
tatcctgcccagtgtt

SEQ ID NO: 5512384 - DNA, 11 bp, Homo sapiens
tatcctgcctc

SEQ ID NO: 5512385 - DNA, 16 bp, Homo sapiens
tatcctgcctcagccc

SEQ ID NO: 5512386 - DNA, 18 bp, Homo sapiens
tatcctgctagctgtaga

SEQ ID NO: 5512387 - DNA, 20 bp, Homo sapiens
tatctgtttcctgacattgt

SEQ ID NO: 5512388 - DNA, 22 bp, Homo sapiens
tatctgtttcctgacattgtct

SEQ ID NO: 5512389 - DNA, 17 bp, Homo sapiens
tatctgtttgcttctaa

SEQ ID NO: 5512390 - DNA, 20 bp, Homo sapiens
tatctgtttgtatatttgca

SEQ ID NO: 5512391 - DNA, 23 bp, Homo sapiens
tatctgtttgtatatttgcaaac

SEQ ID NO: 5512392 - DNA, 19 bp, Homo sapiens
tatctgttttgtttcttga

SEQ ID NO: 5512393 - DNA, 20 bp, Homo sapiens
tatcttaaaagggtggtagt

SEQ ID NO: 5512394 - DNA, 12 bp, Homo sapiens
tatcttaaaata

SEQ ID NO: 5512395 - DNA, 21 bp, Homo sapiens
tatcttaaaattggttaatga

SEQ ID NO: 5512396 - DNA, 15 bp, Homo sapiens
tatcttaaactgttc

SEQ ID NO: 5512397 - DNA, 20 bp, Homo sapiens
tatcttaaagaaacagcttt

SEQ ID NO: 5512398 - DNA, 14 bp, Homo sapiens
tatcttaaagcact

SEQ ID NO: 5512399 - DNA, 16 bp, Homo sapiens
tatcttaaaggacata

SEQ ID NO: 5512400 - DNA, 19 bp, Homo sapiens
tatcttaaaggacataaaa

SEQ ID NO: 5512401 - DNA, 13 bp, Homo sapiens
tatcttaaatatg

SEQ ID NO: 5512402 - DNA, 17 bp, Homo sapiens
tatcttaaatatgaatt

SEQ ID NO: 5512403 - DNA, 16 bp, Homo sapiens
tatcttaaatctgtga

SEQ ID NO: 5512404 - DNA, 17 bp, Homo sapiens
tatcttaagataatatt

SEQ ID NO: 5512405 - DNA, 20 bp, Homo sapiens
tatcttacaactcccccacc

SEQ ID NO: 5512406 - DNA, 14 bp, Homo sapiens
tatcttacaatatt

SEQ ID NO: 5512407 - DNA, 19 bp, Homo sapiens
tatcttacgtttaagctta

SEQ ID NO: 5512408 - DNA, 20 bp, Homo sapiens
tatcttagagtttacagttt

SEQ ID NO: 5512409 - DNA, 19 bp, Homo sapiens
tatcttagatgtttcacac

SEQ ID NO: 5512410 - DNA, 14 bp, Homo sapiens
tatcttataactgt

SEQ ID NO: 5512411 - DNA, 16 bp, Homo sapiens
tatcttataactgttt

SEQ ID NO: 5512412 - DNA, 17 bp, Homo sapiens
tatcttatccaattcat

SEQ ID NO: 5512413 - DNA, 18 bp, Homo sapiens
tatcttatctcagatatt

SEQ ID NO: 5512414 - DNA, 23 bp, Homo sapiens
tatcttatctcagatatttgcac

SEQ ID NO: 5512415 - DNA, 14 bp, Homo sapiens
tatcttatgaaaac

SEQ ID NO: 5512416 - DNA, 14 bp, Homo sapiens
tatcttatgttaaa

SEQ ID NO: 5512417 - DNA, 22 bp, Homo sapiens
tatcttatttaatttttgcaat

SEQ ID NO: 5512418 - DNA, 14 bp, Homo sapiens
tatcttcaaacttt

SEQ ID NO: 5512419 - DNA, 18 bp, Homo sapiens
tatcttcaaactttcact

SEQ ID NO: 5512420 - DNA, 19 bp, Homo sapiens
tatcttcacattgtgtgaa

SEQ ID NO: 5512421 - DNA, 18 bp, Homo sapiens
tatcttcagctctttttg

SEQ ID NO: 5512422 - DNA, 20 bp, Homo sapiens
tatcttcatatgtcaccttt

SEQ ID NO: 5512423 - DNA, 10 bp, Homo sapiens
tatcttcatc

SEQ ID NO: 5512424 - DNA, 14 bp, Homo sapiens
tatcttcatgtaaa

SEQ ID NO: 5512425 - DNA, 15 bp, Homo sapiens
tatcttcatgtaaat

SEQ ID NO: 5512426 - DNA, 16 bp, Homo sapiens
tatcttcatgtaaatt

SEQ ID NO: 5512427 - DNA, 14 bp, Homo sapiens
tatcttctgatttg

SEQ ID NO: 5512428 - DNA, 15 bp, Homo sapiens
tatcttctggactat

SEQ ID NO: 5512429 - DNA, 12 bp, Homo sapiens
tatcttctggat

SEQ ID NO: 5512430 - DNA, 13 bp, Homo sapiens
tatcttctggatt

SEQ ID NO: 5512431 - DNA, 21 bp, Homo sapiens
tatcttctggattagaatgcc

SEQ ID NO: 5512432 - DNA, 14 bp, Homo sapiens
tatcttctggtgca

SEQ ID NO: 5512433 - DNA, 12 bp, Homo sapiens
tatcttctgttt

SEQ ID NO: 5512434 - DNA, 18 bp, Homo sapiens
tatcttctgtttttctca

SEQ ID NO: 5512435 - DNA, 21 bp, Homo sapiens
tatcttctgtttttctcaaat

SEQ ID NO: 5512436 - DNA, 17 bp, Homo sapiens
tatcttcttaacagttt

SEQ ID NO: 5512437 - DNA, 20 bp, Homo sapiens
tatcttcttcaaatacaaag

SEQ ID NO: 5512438 - DNA, 19 bp, Homo sapiens
tatcttctttattattcct

SEQ ID NO: 5512439 - DNA, 16 bp, Homo sapiens
tatcttctttccacct

SEQ ID NO: 5512440 - DNA, 14 bp, Homo sapiens
tatcttctttggac

SEQ ID NO: 5512441 - DNA, 15 bp, Homo sapiens
tatcttgaagacttt

SEQ ID NO: 5512442 - DNA, 15 bp, Homo sapiens
tatcttgaataatgt

SEQ ID NO: 5512443 - DNA, 20 bp, Homo sapiens
tatcttgaccatactaataa

SEQ ID NO: 5512444 - DNA, 13 bp, Homo sapiens
tatcttgcatcta

SEQ ID NO: 5512445 - DNA, 15 bp, Homo sapiens
tatcttgctcattct

SEQ ID NO: 5512446 - DNA, 17 bp, Homo sapiens
tatcttgctctgtaatc

SEQ ID NO: 5512447 - DNA, 15 bp, Homo sapiens
tatcttgctttggag

SEQ ID NO: 5512448 - DNA, 16 bp, Homo sapiens
tatcttggaatcatgc

SEQ ID NO: 5512449 - DNA, 20 bp, Homo sapiens
tatcttggactgacatttag

SEQ ID NO: 5512450 - DNA, 19 bp, Homo sapiens
tatcttggggcaagactgc

SEQ ID NO: 5512451 - DNA, 20 bp, Homo sapiens
tatcttggggcaagactgca

SEQ ID NO: 5512452 - DNA, 19 bp, Homo sapiens
tatcttgggtgtattctct

SEQ ID NO: 5512453 - DNA, 23 bp, Homo sapiens
tatcttgtaaataaagacattca

SEQ ID NO: 5512454 - DNA, 16 bp, Homo sapiens
tatcttgtatggtttg

SEQ ID NO: 5512455 - DNA, 14 bp, Homo sapiens
tatcttgtcctgga

SEQ ID NO: 5512456 - DNA, 15 bp, Homo sapiens
tatcttgtctctggg

SEQ ID NO: 5512457 - DNA, 14 bp, Homo sapiens
tatcttgtgaagtt

SEQ ID NO: 5512458 - DNA, 12 bp, Homo sapiens
tatcttgtgctt

SEQ ID NO: 5512459 - DNA, 13 bp, Homo sapiens
tatcttgtgtatg

SEQ ID NO: 5512460 - DNA, 13 bp, Homo sapiens
tatcttgtgttgt

SEQ ID NO: 5512461 - DNA, 22 bp, Homo sapiens
tatcttgtttttccactactgc

SEQ ID NO: 5512462 - DNA, 21 bp, Homo sapiens
tatctttaaaaaaaaatcttg

SEQ ID NO: 5512463 - DNA, 15 bp, Homo sapiens
tatctttaaaactta

SEQ ID NO: 5512464 - DNA, 17 bp, Homo sapiens
tatctttaaataaatgt

SEQ ID NO: 5512465 - DNA, 15 bp, Homo sapiens
tatctttaagaaaaa

SEQ ID NO: 5512466 - DNA, 15 bp, Homo sapiens
tatctttaattgtat

SEQ ID NO: 5512467 - DNA, 21 bp, Homo sapiens
tatctttaccaaaaaccatgt

SEQ ID NO: 5512468 - DNA, 22 bp, Homo sapiens
tatctttagttgaattccaagt

SEQ ID NO: 5512469 - DNA, 12 bp, Homo sapiens
tatctttatact

SEQ ID NO: 5512470 - DNA, 20 bp, Homo sapiens
tatctttatacttaaacagc

SEQ ID NO: 5512471 - DNA, 22 bp, Homo sapiens
tatctttatacttaaacagctt

SEQ ID NO: 5512472 - DNA, 12 bp, Homo sapiens
tatctttatgct

SEQ ID NO: 5512473 - DNA, 15 bp, Homo sapiens
tatctttattaatca

SEQ ID NO: 5512474 - DNA, 17 bp, Homo sapiens
tatctttcaaaatgtat

SEQ ID NO: 5512475 - DNA, 14 bp, Homo sapiens
tatctttcaggaaa

SEQ ID NO: 5512476 - DNA, 13 bp, Homo sapiens
tatctttccctct

SEQ ID NO: 5512477 - DNA, 12 bp, Homo sapiens
tatctttctaca

SEQ ID NO: 5512478 - DNA, 12 bp, Homo sapiens
tatctttctcat

SEQ ID NO: 5512479 - DNA, 23 bp, Homo sapiens
tatctttctcattaccagtgact

SEQ ID NO: 5512480 - DNA, 14 bp, Homo sapiens
tatctttctcttac

SEQ ID NO: 5512481 - DNA, 17 bp, Homo sapiens
tatctttctttccattt

SEQ ID NO: 5512482 - DNA, 16 bp, Homo sapiens
tatctttctttctcta

SEQ ID NO: 5512483 - DNA, 18 bp, Homo sapiens
tatctttgacaattctgg

SEQ ID NO: 5512484 - DNA, 12 bp, Homo sapiens
tatctttgataa

SEQ ID NO: 5512485 - DNA, 22 bp, Homo sapiens
tatctttgattctccttcagcc

SEQ ID NO: 5512486 - DNA, 11 bp, Homo sapiens
tatctttgcca

SEQ ID NO: 5512487 - DNA, 15 bp, Homo sapiens
tatctttgtaaatta

SEQ ID NO: 5512488 - DNA, 16 bp, Homo sapiens
tatctttgtaaattat

SEQ ID NO: 5512489 - DNA, 19 bp, Homo sapiens
tatctttgtattcttcatg

SEQ ID NO: 5512490 - DNA, 21 bp, Homo sapiens
tatctttgtattcttcatgaa

SEQ ID NO: 5512491 - DNA, 22 bp, Homo sapiens
tatctttgtattcttcatgaaa

SEQ ID NO: 5512492 - DNA, 16 bp, Homo sapiens
tatctttgtctaaaca

SEQ ID NO: 5512493 - DNA, 16 bp, Homo sapiens
tatcttttaattacag

SEQ ID NO: 5512494 - DNA, 19 bp, Homo sapiens
tatcttttatgtttgaata

SEQ ID NO: 5512495 - DNA, 20 bp, Homo sapiens
tatcttttattttcctgtct

SEQ ID NO: 5512496 - DNA, 23 bp, Homo sapiens
tatcttttcatacattttctaag

SEQ ID NO: 5512497 - DNA, 21 bp, Homo sapiens
tatcttttcatttatcaagca

SEQ ID NO: 5512498 - DNA, 23 bp, Homo sapiens
tatcttttctattgtttattctt

SEQ ID NO: 5512499 - DNA, 20 bp, Homo sapiens
tatcttttctttagagaact

SEQ ID NO: 5512500 - DNA, 22 bp, Homo sapiens
tatcttttctttagagaactga

SEQ ID NO: 5512501 - DNA, 13 bp, Homo sapiens
tatcttttgacct

SEQ ID NO: 5512502 - DNA, 19 bp, Homo sapiens
tatcttttgacctgtggtg

SEQ ID NO: 5512503 - DNA, 22 bp, Homo sapiens
tatcttttgtttccttttttcc

SEQ ID NO: 5512504 - DNA, 17 bp, Homo sapiens
tatctttttaaaaactc

SEQ ID NO: 5512505 - DNA, 15 bp, Homo sapiens
tatctttttattgat

SEQ ID NO: 5512506 - DNA, 19 bp, Homo sapiens
tatctttttattgatgtgc

SEQ ID NO: 5512507 - DNA, 17 bp, Homo sapiens
tatcttttttaaactgt

SEQ ID NO: 5512508 - DNA, 20 bp, Homo sapiens
tatcttttttcctagttttt

SEQ ID NO: 5512509 - DNA, 22 bp, Homo sapiens
tatgaaaaaaaaattatttgcc

SEQ ID NO: 5512510 - DNA, 13 bp, Homo sapiens
tatgaaaaaatat

SEQ ID NO: 5512511 - DNA, 13 bp, Homo sapiens
tatgaaaaaatgt

SEQ ID NO: 5512512 - DNA, 19 bp, Homo sapiens
tatgaaaaaatgttcaaat

SEQ ID NO: 5512513 - DNA, 12 bp, Homo sapiens
tatgaaaaacat

SEQ ID NO: 5512514 - DNA, 22 bp, Homo sapiens
tatgaaaaacatcccaaacttt

SEQ ID NO: 5512515 - DNA, 18 bp, Homo sapiens
tatgaaaaatatgatatt

SEQ ID NO: 5512516 - DNA, 16 bp, Homo sapiens
tatgaaaaatgtaaat

SEQ ID NO: 5512517 - DNA, 18 bp, Homo sapiens
tatgaaaacatggaacag

SEQ ID NO: 5512518 - DNA, 22 bp, Homo sapiens
tatgaaaaccctcgatgttcat

SEQ ID NO: 5512519 - DNA, 22 bp, Homo sapiens
tatgaaaactatacaacaaagg

SEQ ID NO: 5512520 - DNA, 13 bp, Homo sapiens
tatgaaaacttat

SEQ ID NO: 5512521 - DNA, 16 bp, Homo sapiens
tatgaaaagaataaaa

SEQ ID NO: 5512522 - DNA, 13 bp, Homo sapiens
tatgaaaagcaac

SEQ ID NO: 5512523 - DNA, 14 bp, Homo sapiens
tatgaaaagctaga

SEQ ID NO: 5512524 - DNA, 21 bp, Homo sapiens
tatgaaaatatagacattctc

SEQ ID NO: 5512525 - DNA, 23 bp, Homo sapiens
tatgaaaatgggatgaattcttt

SEQ ID NO: 5512526 - DNA, 14 bp, Homo sapiens
tatgaaaatgtaag

SEQ ID NO: 5512527 - DNA, 16 bp, Homo sapiens
tatgaaacaaatatac

SEQ ID NO: 5512528 - DNA, 17 bp, Homo sapiens
tatgaaacaaatatact

SEQ ID NO: 5512529 - DNA, 19 bp, Homo sapiens
tatgaaacaaatatactca

SEQ ID NO: 5512530 - DNA, 19 bp, Homo sapiens
tatgaaacaatcttccaaa

SEQ ID NO: 5512531 - DNA, 20 bp, Homo sapiens
tatgaaaccaactgttgaca

SEQ ID NO: 5512532 - DNA, 18 bp, Homo sapiens
tatgaaactcatctgtaa

SEQ ID NO: 5512533 - DNA, 22 bp, Homo sapiens
tatgaaactggtttataataaa

SEQ ID NO: 5512534 - DNA, 14 bp, Homo sapiens
tatgaaacttgaaa

SEQ ID NO: 5512535 - DNA, 14 bp, Homo sapiens
tatgaaacttgtgt

SEQ ID NO: 5512536 - DNA, 13 bp, Homo sapiens
tatgaaagagaaa

SEQ ID NO: 5512537 - DNA, 14 bp, Homo sapiens
tatgaaagagaaaa

SEQ ID NO: 5512538 - DNA, 20 bp, Homo sapiens
tatgaaagatggctgtgcct

SEQ ID NO: 5512539 - DNA, 19 bp, Homo sapiens
tatgaaagcaacaaagaaa

SEQ ID NO: 5512540 - DNA, 19 bp, Homo sapiens
tatgaaagctatgaatgtt

SEQ ID NO: 5512541 - DNA, 14 bp, Homo sapiens
tatgaaataaaaag

SEQ ID NO: 5512542 - DNA, 17 bp, Homo sapiens
tatgaaatactcagggt

SEQ ID NO: 5512543 - DNA, 18 bp, Homo sapiens
tatgaaatataaattatc

SEQ ID NO: 5512544 - DNA, 20 bp, Homo sapiens
tatgaaatataaattatctg

SEQ ID NO: 5512545 - DNA, 22 bp, Homo sapiens
tatgaaatataaattatctgaa

SEQ ID NO: 5512546 - DNA, 20 bp, Homo sapiens
tatgaaatatgtataacttt

SEQ ID NO: 5512547 - DNA, 22 bp, Homo sapiens
tatgaaatattttgaatacaca

SEQ ID NO: 5512548 - DNA, 18 bp, Homo sapiens
tatgaaatcatagtatat

SEQ ID NO: 5512549 - DNA, 12 bp, Homo sapiens
tatgaaatgata

SEQ ID NO: 5512550 - DNA, 22 bp, Homo sapiens
tatgaaatgataaagatgtcaa

SEQ ID NO: 5512551 - DNA, 23 bp, Homo sapiens
tatgaaatgtcccctcaaactca

SEQ ID NO: 5512552 - DNA, 17 bp, Homo sapiens
tatgaaatgtttcacta

SEQ ID NO: 5512553 - DNA, 20 bp, Homo sapiens
tatgaaatttaatatagcta

SEQ ID NO: 5512554 - DNA, 22 bp, Homo sapiens
tatgaaatttaatatagctatt

SEQ ID NO: 5512555 - DNA, 23 bp, Homo sapiens
tatgaacaaagaaaaaaatatat

SEQ ID NO: 5512556 - DNA, 14 bp, Homo sapiens
tatgaacaacagta

SEQ ID NO: 5512557 - DNA, 23 bp, Homo sapiens
tatgaacacagacaaagtgctat

SEQ ID NO: 5512558 - DNA, 15 bp, Homo sapiens
tatgaacactgtcat

SEQ ID NO: 5512559 - DNA, 23 bp, Homo sapiens
tatgaacagaaactacatttcta

SEQ ID NO: 5512560 - DNA, 14 bp, Homo sapiens
tatgaacagacttt

SEQ ID NO: 5512561 - DNA, 14 bp, Homo sapiens
tatgaacagctgtg

SEQ ID NO: 5512562 - DNA, 15 bp, Homo sapiens
tatgaacagctgtgt

SEQ ID NO: 5512563 - DNA, 17 bp, Homo sapiens
tatgaacatattgttga

SEQ ID NO: 5512564 - DNA, 22 bp, Homo sapiens
tatgaacccttcctgagcttta

SEQ ID NO: 5512565 - DNA, 13 bp, Homo sapiens
tatgagggccttg

SEQ ID NO: 5512566 - DNA, 19 bp, Homo sapiens
tatgaggggactgcatgca

SEQ ID NO: 5512567 - DNA, 22 bp, Homo sapiens
tatgaggggactgcatgcaagc

SEQ ID NO: 5512568 - DNA, 21 bp, Homo sapiens
tatgagggttgaagacggaaa

SEQ ID NO: 5512569 - DNA, 19 bp, Homo sapiens
tatgaggtcctcaggtcag

SEQ ID NO: 5512570 - DNA, 18 bp, Homo sapiens
tatgagtagatactctca

SEQ ID NO: 5512571 - DNA, 14 bp, Homo sapiens
tatgagtagccagg

SEQ ID NO: 5512572 - DNA, 17 bp, Homo sapiens
tatgagtataatacatt

SEQ ID NO: 5512573 - DNA, 14 bp, Homo sapiens
tatgagtatacaat

SEQ ID NO: 5512574 - DNA, 23 bp, Homo sapiens
tatgagtatacaatatataaaaa

SEQ ID NO: 5512575 - DNA, 21 bp, Homo sapiens
tatgagtatctttaaatataa

SEQ ID NO: 5512576 - DNA, 15 bp, Homo sapiens
tatgagtcaatgtgc

SEQ ID NO: 5512577 - DNA, 17 bp, Homo sapiens
tatgagtcagtctctct

SEQ ID NO: 5512578 - DNA, 14 bp, Homo sapiens
tatgagtctagatg

SEQ ID NO: 5512579 - DNA, 19 bp, Homo sapiens
tatgagtgcaagcaaagca

SEQ ID NO: 5512580 - DNA, 18 bp, Homo sapiens
tatgagtgggaaataaat

SEQ ID NO: 5512581 - DNA, 15 bp, Homo sapiens
tatgagttactgaag

SEQ ID NO: 5512582 - DNA, 15 bp, Homo sapiens
tatgagttagctttc

SEQ ID NO: 5512583 - DNA, 19 bp, Homo sapiens
tatgagttcacatgtgccc

SEQ ID NO: 5512584 - DNA, 18 bp, Homo sapiens
tatgagttccctaaacaa

SEQ ID NO: 5512585 - DNA, 16 bp, Homo sapiens
tatgagttcttgtttt

SEQ ID NO: 5512586 - DNA, 18 bp, Homo sapiens
tatgagttgttttcagac

SEQ ID NO: 5512587 - DNA, 19 bp, Homo sapiens
tatgataaaaaattttgta

SEQ ID NO: 5512588 - DNA, 21 bp, Homo sapiens
tatgataaaaaattttgtaat

SEQ ID NO: 5512589 - DNA, 14 bp, Homo sapiens
tatgataaaaggaa

SEQ ID NO: 5512590 - DNA, 20 bp, Homo sapiens
tatgataaacagttgaataa

SEQ ID NO: 5512591 - DNA, 17 bp, Homo sapiens
tatgataacaacactgt

SEQ ID NO: 5512592 - DNA, 12 bp, Homo sapiens
tatgataactat

SEQ ID NO: 5512593 - DNA, 13 bp, Homo sapiens
tatgataatatat

SEQ ID NO: 5512594 - DNA, 18 bp, Homo sapiens
tatgataattacaataca

SEQ ID NO: 5512595 - DNA, 22 bp, Homo sapiens
tatgatacaccattatgtttaa

SEQ ID NO: 5512596 - DNA, 14 bp, Homo sapiens
tatgatactgatgc

SEQ ID NO: 5512597 - DNA, 15 bp, Homo sapiens
tatgatactgtctct

SEQ ID NO: 5512598 - DNA, 23 bp, Homo sapiens
tatgatacttcgacactgttctt

SEQ ID NO: 5512599 - DNA, 23 bp, Homo sapiens
tatgatacttgaattttttgaaa

SEQ ID NO: 5512600 - DNA, 21 bp, Homo sapiens
tatgatagatgacaaattggg

SEQ ID NO: 5512601 - DNA, 14 bp, Homo sapiens
tatgataggcagca

SEQ ID NO: 5512602 - DNA, 14 bp, Homo sapiens
tatgatatatatgt

SEQ ID NO: 5512603 - DNA, 16 bp, Homo sapiens
tatgatatatttatat

SEQ ID NO: 5512604 - DNA, 14 bp, Homo sapiens
tatgatatgcatgt

SEQ ID NO: 5512605 - DNA, 22 bp, Homo sapiens
tatgatattccccatttcctgt

SEQ ID NO: 5512606 - DNA, 15 bp, Homo sapiens
tatgatattgtttaa

SEQ ID NO: 5512607 - DNA, 22 bp, Homo sapiens
tatgatatttttttaagtcttt

SEQ ID NO: 5512608 - DNA, 19 bp, Homo sapiens
tatgatcaaaaactgcctt

SEQ ID NO: 5512609 - DNA, 15 bp, Homo sapiens
tatgatcaaatactc

SEQ ID NO: 5512610 - DNA, 13 bp, Homo sapiens
tatgatcaaatgt

SEQ ID NO: 5512611 - DNA, 15 bp, Homo sapiens
tatgatcaaatgttt

SEQ ID NO: 5512612 - DNA, 14 bp, Homo sapiens
tatgatcacagtga

SEQ ID NO: 5512613 - DNA, 21 bp, Homo sapiens
tatgatcacggctcactgcag

SEQ ID NO: 5512614 - DNA, 23 bp, Homo sapiens
tatgatcacggctcactgcagcc

SEQ ID NO: 5512615 - DNA, 13 bp, Homo sapiens
tatgatcagtgtt

SEQ ID NO: 5512616 - DNA, 16 bp, Homo sapiens
tatgatcagtgttact

SEQ ID NO: 5512617 - DNA, 17 bp, Homo sapiens
tatgatcagtgttactg

SEQ ID NO: 5512618 - DNA, 17 bp, Homo sapiens
tatgatcagtgttgttg

SEQ ID NO: 5512619 - DNA, 10 bp, Homo sapiens
tatgatccag

SEQ ID NO: 5512620 - DNA, 14 bp, Homo sapiens
tatgatccagagca

SEQ ID NO: 5512621 - DNA, 18 bp, Homo sapiens
tatgatccagagcagagt

SEQ ID NO: 5512622 - DNA, 20 bp, Homo sapiens
tatgatccagagcagagttt

SEQ ID NO: 5512623 - DNA, 20 bp, Homo sapiens
tatgatccagcagattattc

SEQ ID NO: 5512624 - DNA, 19 bp, Homo sapiens
tatgatccttttttgtcat

SEQ ID NO: 5512625 - DNA, 17 bp, Homo sapiens
tatgatctaataaactt

SEQ ID NO: 5512626 - DNA, 18 bp, Homo sapiens
tatgatctaataaacttt

SEQ ID NO: 5512627 - DNA, 15 bp, Homo sapiens
tatgatctatttgta

SEQ ID NO: 5512628 - DNA, 13 bp, Homo sapiens
tatgatctcagga

SEQ ID NO: 5512629 - DNA, 19 bp, Homo sapiens
tatgatctcaggttctcct

SEQ ID NO: 5512630 - DNA, 18 bp, Homo sapiens
tatgatctcttctggtgt

SEQ ID NO: 5512631 - DNA, 15 bp, Homo sapiens
tatgatctgtggaga

SEQ ID NO: 5512632 - DNA, 17 bp, Homo sapiens
tatgatctgtggagaat

SEQ ID NO: 5512633 - DNA, 21 bp, Homo sapiens
tatgatctgtggagaatgtac

SEQ ID NO: 5512634 - DNA, 21 bp, Homo sapiens
tatgatcttagggaactttga

SEQ ID NO: 5512635 - DNA, 22 bp, Homo sapiens
tatgatcttgagtataagaaat

SEQ ID NO: 5512636 - DNA, 15 bp, Homo sapiens
tatgatgaaaataat

SEQ ID NO: 5512637 - DNA, 10 bp, Homo sapiens
tatgatgaca

SEQ ID NO: 5512638 - DNA, 21 bp, Homo sapiens
tatgatgactcccttaaaata

SEQ ID NO: 5512639 - DNA, 15 bp, Homo sapiens
tatgatgactgtttt

SEQ ID NO: 5512640 - DNA, 22 bp, Homo sapiens
tatgatgatacaagattagaag

SEQ ID NO: 5512641 - DNA, 22 bp, Homo sapiens
tatgatgatgaaaattttacca

SEQ ID NO: 5512642 - DNA, 17 bp, Homo sapiens
tatgatgcatacagttt

SEQ ID NO: 5512643 - DNA, 21 bp, Homo sapiens
tatgatgcatacagttttcta

SEQ ID NO: 5512644 - DNA, 18 bp, Homo sapiens
tatgatgggctccccagg

SEQ ID NO: 5512645 - DNA, 20 bp, Homo sapiens
tatgatgggcttctgttctc

SEQ ID NO: 5512646 - DNA, 21 bp, Homo sapiens
tatgatgggtgtttttagcag

SEQ ID NO: 5512647 - DNA, 19 bp, Homo sapiens
tatgatgtatactgccact

SEQ ID NO: 5512648 - DNA, 14 bp, Homo sapiens
tatgatgtattagt

SEQ ID NO: 5512649 - DNA, 20 bp, Homo sapiens
tatgatgtgctgctgggaat

SEQ ID NO: 5512650 - DNA, 17 bp, Homo sapiens
tatgatgtgttgtgata

SEQ ID NO: 5512651 - DNA, 18 bp, Homo sapiens
tatgatgttaaaaaaata

SEQ ID NO: 5512652 - DNA, 19 bp, Homo sapiens
tatgatgtttaaaagcata

SEQ ID NO: 5512653 - DNA, 17 bp, Homo sapiens
tatgattaaaaatatca

SEQ ID NO: 5512654 - DNA, 21 bp, Homo sapiens
tatgattaaaaatatcaaatt

SEQ ID NO: 5512655 - DNA, 23 bp, Homo sapiens
tatgattaaaaatatcaaattaa

SEQ ID NO: 5512656 - DNA, 16 bp, Homo sapiens
tatgattaaattatca

SEQ ID NO: 5512657 - DNA, 20 bp, Homo sapiens
tatgattaagtaatgataac

SEQ ID NO: 5512658 - DNA, 21 bp, Homo sapiens
tatgattagctttgtcactgt

SEQ ID NO: 5512659 - DNA, 16 bp, Homo sapiens
tatgattagtaaagaa

SEQ ID NO: 5512660 - DNA, 18 bp, Homo sapiens
tatgattagttatgtctt

SEQ ID NO: 5512661 - DNA, 20 bp, Homo sapiens
tatgattagttatgtctttt

SEQ ID NO: 5512662 - DNA, 22 bp, Homo sapiens
tatgattcactatttaaactat

SEQ ID NO: 5512663 - DNA, 17 bp, Homo sapiens
tatgattcagtgcattt

SEQ ID NO: 5512664 - DNA, 16 bp, Homo sapiens
tatgattctagtacat

SEQ ID NO: 5512665 - DNA, 22 bp, Homo sapiens
tatgattctcttgagataaggt

SEQ ID NO: 5512666 - DNA, 14 bp, Homo sapiens
tatgattctgcttt

SEQ ID NO: 5512667 - DNA, 19 bp, Homo sapiens
tatgattctgcttttacca

SEQ ID NO: 5512668 - DNA, 19 bp, Homo sapiens
tatgattgaaaagaagaaa

SEQ ID NO: 5512669 - DNA, 18 bp, Homo sapiens
tatgattgtaacatattt

SEQ ID NO: 5512670 - DNA, 15 bp, Homo sapiens
tatgattgtactttg

SEQ ID NO: 5512671 - DNA, 19 bp, Homo sapiens
tatgattgtataatgtgat

SEQ ID NO: 5512672 - DNA, 22 bp, Homo sapiens
tatgatttaaaaaataaatata

SEQ ID NO: 5512673 - DNA, 17 bp, Homo sapiens
tatgatttaaaaacaac

SEQ ID NO: 5512674 - DNA, 14 bp, Homo sapiens
tatgatttaataaa

SEQ ID NO: 5512675 - DNA, 17 bp, Homo sapiens
tatgatttaggcttcta

SEQ ID NO: 5512676 - DNA, 14 bp, Homo sapiens
tatgatttatagtt

SEQ ID NO: 5512677 - DNA, 15 bp, Homo sapiens
tatgatttatagttt

SEQ ID NO: 5512678 - DNA, 14 bp, Homo sapiens
tatgatttcaacat

SEQ ID NO: 5512679 - DNA, 21 bp, Homo sapiens
tatgatttcactagaaaagct

SEQ ID NO: 5512680 - DNA, 12 bp, Homo sapiens
tatgatttcatg

SEQ ID NO: 5512681 - DNA, 12 bp, Homo sapiens
tatgatttcttg

SEQ ID NO: 5512682 - DNA, 17 bp, Homo sapiens
tatgatttcttgctttg

SEQ ID NO: 5512683 - DNA, 12 bp, Homo sapiens
tatgatttgcat

SEQ ID NO: 5512684 - DNA, 12 bp, Homo sapiens
tatgatttgtag

SEQ ID NO: 5512685 - DNA, 20 bp, Homo sapiens
tatgatttgtagctctaggt

SEQ ID NO: 5512686 - DNA, 15 bp, Homo sapiens
tatgatttgttcctt

SEQ ID NO: 5512687 - DNA, 19 bp, Homo sapiens
tatgatttgttttgaattt

SEQ ID NO: 5512688 - DNA, 21 bp, Homo sapiens
tatgattttctatttttcttc

SEQ ID NO: 5512689 - DNA, 12 bp, Homo sapiens
tatgatttttaa

SEQ ID NO: 5512690 - DNA, 22 bp, Homo sapiens
tatgattttttaagtctatgtt

SEQ ID NO: 5512691 - DNA, 19 bp, Homo sapiens
tatgatttttttttcatac

SEQ ID NO: 5512692 - DNA, 15 bp, Homo sapiens
tatgcaaaagcagct

SEQ ID NO: 5512693 - DNA, 16 bp, Homo sapiens
tatgcaaaagcagcta

SEQ ID NO: 5512694 - DNA, 20 bp, Homo sapiens
tatgcaaaatagacatcttt

SEQ ID NO: 5512695 - DNA, 14 bp, Homo sapiens
tatgcaaaatggaa

SEQ ID NO: 5512696 - DNA, 16 bp, Homo sapiens
tatgcaaaatttagaa

SEQ ID NO: 5512697 - DNA, 17 bp, Homo sapiens
tatgcaaacctcatctt

SEQ ID NO: 5512698 - DNA, 15 bp, Homo sapiens
tatgcaaagaactca

SEQ ID NO: 5512699 - DNA, 12 bp, Homo sapiens
tatgcaaagcac

SEQ ID NO: 5512700 - DNA, 23 bp, Homo sapiens
tatgcaaagtctctcatttcttt

SEQ ID NO: 5512701 - DNA, 23 bp, Homo sapiens
tatgcaaataaaacccaatactt

SEQ ID NO: 5512702 - DNA, 11 bp, Homo sapiens
tatgcaaatac

SEQ ID NO: 5512703 - DNA, 14 bp, Homo sapiens
tatgcaaatatttt

SEQ ID NO: 5512704 - DNA, 20 bp, Homo sapiens
tatgcaaatatttttttgta

SEQ ID NO: 5512705 - DNA, 20 bp, Homo sapiens
tatgcaaatgagatttcttt

SEQ ID NO: 5512706 - DNA, 20 bp, Homo sapiens
tatgcaaatgcctccaagcc

SEQ ID NO: 5512707 - DNA, 15 bp, Homo sapiens
tatgcaaattcccag

SEQ ID NO: 5512708 - DNA, 15 bp, Homo sapiens
tatgcaacctgtgca

SEQ ID NO: 5512709 - DNA, 16 bp, Homo sapiens
tatgcaacctgtgcaa

SEQ ID NO: 5512710 - DNA, 17 bp, Homo sapiens
tatgcaagaagaatata

SEQ ID NO: 5512711 - DNA, 19 bp, Homo sapiens
tatgcaagatatttttgaa

SEQ ID NO: 5512712 - DNA, 13 bp, Homo sapiens
tatgcaagcacaa

SEQ ID NO: 5512713 - DNA, 12 bp, Homo sapiens
tatgcaagcagc

SEQ ID NO: 5512714 - DNA, 19 bp, Homo sapiens
tatgcaagcagctttttat

SEQ ID NO: 5512715 - DNA, 16 bp, Homo sapiens
tatgcaagcagtttca

SEQ ID NO: 5512716 - DNA, 19 bp, Homo sapiens
tatgcaaggggaaacctgt

SEQ ID NO: 5512717 - DNA, 21 bp, Homo sapiens
tatgcaaggtatttctccagt

SEQ ID NO: 5512718 - DNA, 19 bp, Homo sapiens
tatgcaagtcgccaggcag

SEQ ID NO: 5512719 - DNA, 14 bp, Homo sapiens
tatgcaagtctgtg

SEQ ID NO: 5512720 - DNA, 21 bp, Homo sapiens
tatgcaagttttgtgactgag

SEQ ID NO: 5512721 - DNA, 12 bp, Homo sapiens
tatgcaataaaa

SEQ ID NO: 5512722 - DNA, 15 bp, Homo sapiens
tatgcacaattccat

SEQ ID NO: 5512723 - DNA, 20 bp, Homo sapiens
tatgcacaattccatgacaa

SEQ ID NO: 5512724 - DNA, 16 bp, Homo sapiens
tatgcacacacatata

SEQ ID NO: 5512725 - DNA, 13 bp, Homo sapiens
tatgcacacattt

SEQ ID NO: 5512726 - DNA, 21 bp, Homo sapiens
tatgcacaccaaattgctgag

SEQ ID NO: 5512727 - DNA, 21 bp, Homo sapiens
tatgcacacctcccaccccct

SEQ ID NO: 5512728 - DNA, 13 bp, Homo sapiens
tatgcacagccta

SEQ ID NO: 5512729 - DNA, 17 bp, Homo sapiens
tatgcacagtctatttt

SEQ ID NO: 5512730 - DNA, 23 bp, Homo sapiens
tatgcacagtctattttttgtat

SEQ ID NO: 5512731 - DNA, 13 bp, Homo sapiens
tatgcacatttgt

SEQ ID NO: 5512732 - DNA, 16 bp, Homo sapiens
tatgcacctataaata

SEQ ID NO: 5512733 - DNA, 14 bp, Homo sapiens
tatgcaccttgtgt

SEQ ID NO: 5512734 - DNA, 15 bp, Homo sapiens
tatgcacgaccttgg

SEQ ID NO: 5512735 - DNA, 17 bp, Homo sapiens
tatgcactaagtctctt

SEQ ID NO: 5512736 - DNA, 21 bp, Homo sapiens
tatgcactgaagagctcttgg

SEQ ID NO: 5512737 - DNA, 17 bp, Homo sapiens
tatgcactggccaccca

SEQ ID NO: 5512738 - DNA, 22 bp, Homo sapiens
tatgcactgtggtttcagatgt

SEQ ID NO: 5512739 - DNA, 11 bp, Homo sapiens
tatgcactttc

SEQ ID NO: 5512740 - DNA, 12 bp, Homo sapiens
tatgcactttta

SEQ ID NO: 5512741 - DNA, 13 bp, Homo sapiens
tatgcacttttag

SEQ ID NO: 5512742 - DNA, 20 bp, Homo sapiens
tatgcacttttagaaatgca

SEQ ID NO: 5512743 - DNA, 19 bp, Homo sapiens
tatggaacttccctccccc

SEQ ID NO: 5512744 - DNA, 13 bp, Homo sapiens
tatggaacttcta

SEQ ID NO: 5512745 - DNA, 15 bp, Homo sapiens
tatggaagacaaata

SEQ ID NO: 5512746 - DNA, 20 bp, Homo sapiens
tatggaagacaaatacacat

SEQ ID NO: 5512747 - DNA, 19 bp, Homo sapiens
tatggaagataattttatg

SEQ ID NO: 5512748 - DNA, 19 bp, Homo sapiens
tatggaagccaccgggaga

SEQ ID NO: 5512749 - DNA, 13 bp, Homo sapiens
tatggaaggattt

SEQ ID NO: 5512750 - DNA, 16 bp, Homo sapiens
tatggaagggaggggt

SEQ ID NO: 5512751 - DNA, 16 bp, Homo sapiens
tatggaaggtggagcg

SEQ ID NO: 5512752 - DNA, 17 bp, Homo sapiens
tatggaagtaaaggcat

SEQ ID NO: 5512753 - DNA, 21 bp, Homo sapiens
tatggaagtaaaggcattcca

SEQ ID NO: 5512754 - DNA, 23 bp, Homo sapiens
tatggaagtaaaggcattccaca

SEQ ID NO: 5512755 - DNA, 16 bp, Homo sapiens
tatggaatatcatctg

SEQ ID NO: 5512756 - DNA, 14 bp, Homo sapiens
tatggaatattcat

SEQ ID NO: 5512757 - DNA, 18 bp, Homo sapiens
tatggaatattcatttta

SEQ ID NO: 5512758 - DNA, 14 bp, Homo sapiens
tatggaattacatg

SEQ ID NO: 5512759 - DNA, 19 bp, Homo sapiens
tatggaattgatttgcatt

SEQ ID NO: 5512760 - DNA, 20 bp, Homo sapiens
tatggaatttataattcagt

SEQ ID NO: 5512761 - DNA, 15 bp, Homo sapiens
tatggaattttgcaa

SEQ ID NO: 5512762 - DNA, 20 bp, Homo sapiens
tatggaatttttcattgata

SEQ ID NO: 5512763 - DNA, 16 bp, Homo sapiens
tatggacaaaacaaga

SEQ ID NO: 5512764 - DNA, 16 bp, Homo sapiens
tatggacaacttattt

SEQ ID NO: 5512765 - DNA, 22 bp, Homo sapiens
tatggacaacttatttaaaaat

SEQ ID NO: 5512766 - DNA, 17 bp, Homo sapiens
tatggacaatgacccag

SEQ ID NO: 5512767 - DNA, 14 bp, Homo sapiens
tatggacacagggt

SEQ ID NO: 5512768 - DNA, 12 bp, Homo sapiens
tatggacactgt

SEQ ID NO: 5512769 - DNA, 17 bp, Homo sapiens
tatggacactgtgacaa

SEQ ID NO: 5512770 - DNA, 20 bp, Homo sapiens
tatggacactgtgacaatga

SEQ ID NO: 5512771 - DNA, 18 bp, Homo sapiens
tatggacagggctgtctc

SEQ ID NO: 5512772 - DNA, 14 bp, Homo sapiens
tatggacatgtaaa

SEQ ID NO: 5512773 - DNA, 14 bp, Homo sapiens
tatggaccactttt

SEQ ID NO: 5512774 - DNA, 16 bp, Homo sapiens
tatggacctagcttga

SEQ ID NO: 5512775 - DNA, 15 bp, Homo sapiens
tatggacgtgtgtga

SEQ ID NO: 5512776 - DNA, 18 bp, Homo sapiens
tatggactgttttgatag

SEQ ID NO: 5512777 - DNA, 15 bp, Homo sapiens
tatggagaacatgtt

SEQ ID NO: 5512778 - DNA, 19 bp, Homo sapiens
tatggagaacatgttttat

SEQ ID NO: 5512779 - DNA, 16 bp, Homo sapiens
tatggagaattgctga

SEQ ID NO: 5512780 - DNA, 17 bp, Homo sapiens
tatggagaattgctgaa

SEQ ID NO: 5512781 - DNA, 17 bp, Homo sapiens
tatggagactttgctgt

SEQ ID NO: 5512782 - DNA, 15 bp, Homo sapiens
tatggagagaaaaca

SEQ ID NO: 5512783 - DNA, 14 bp, Homo sapiens
tatggagagccctg

SEQ ID NO: 5512784 - DNA, 17 bp, Homo sapiens
tatggagatactattta

SEQ ID NO: 5512785 - DNA, 22 bp, Homo sapiens
tatggagcagccggaagtctgt

SEQ ID NO: 5512786 - DNA, 13 bp, Homo sapiens
tatggagcctggc

SEQ ID NO: 5512787 - DNA, 17 bp, Homo sapiens
tatggagctcagagagg

SEQ ID NO: 5512788 - DNA, 23 bp, Homo sapiens
tatggaggagagtgtttaactga

SEQ ID NO: 5512789 - DNA, 16 bp, Homo sapiens
tatggagtcattttta

SEQ ID NO: 5512790 - DNA, 16 bp, Homo sapiens
tatggagtcttgtgaa

SEQ ID NO: 5512791 - DNA, 23 bp, Homo sapiens
tatggagtgagtcacctgctcca

SEQ ID NO: 5512792 - DNA, 14 bp, Homo sapiens
tatggagtgcctgt

SEQ ID NO: 5512793 - DNA, 16 bp, Homo sapiens
tatggagttaaataaa

SEQ ID NO: 5512794 - DNA, 23 bp, Homo sapiens
tatggagttggcagacaggatgt

SEQ ID NO: 5512795 - DNA, 17 bp, Homo sapiens
tatggataatctgagca

SEQ ID NO: 5512796 - DNA, 18 bp, Homo sapiens
tatggatatgaaaaatga

SEQ ID NO: 5512797 - DNA, 18 bp, Homo sapiens
tatggatatgctgcttta

SEQ ID NO: 5512798 - DNA, 16 bp, Homo sapiens
tatggatgattaaatt

SEQ ID NO: 5512799 - DNA, 20 bp, Homo sapiens
tatggatgattaaattttag

SEQ ID NO: 5512800 - DNA, 21 bp, Homo sapiens
tatggatggggcccaggggct

SEQ ID NO: 5512801 - DNA, 19 bp, Homo sapiens
tatggatgtgtgtgtgtgc

SEQ ID NO: 5512802 - DNA, 20 bp, Homo sapiens
tatggattcacttctattta

SEQ ID NO: 5512803 - DNA, 22 bp, Homo sapiens
tatggattcatttataagaaga

SEQ ID NO: 5512804 - DNA, 15 bp, Homo sapiens
tatggattctaaaat

SEQ ID NO: 5512805 - DNA, 15 bp, Homo sapiens
tatggatttccagtt

SEQ ID NO: 5512806 - DNA, 15 bp, Homo sapiens
tatggatttgttaca

SEQ ID NO: 5512807 - DNA, 21 bp, Homo sapiens
tatggattttctattgttact

SEQ ID NO: 5512808 - DNA, 21 bp, Homo sapiens
tatggcaacgttcatgttcat

SEQ ID NO: 5512809 - DNA, 13 bp, Homo sapiens
tatggcaagcaac

SEQ ID NO: 5512810 - DNA, 11 bp, Homo sapiens
tatggcaaggg

SEQ ID NO: 5512811 - DNA, 23 bp, Homo sapiens
tatggcaagtgatatcacctctc

SEQ ID NO: 5512812 - DNA, 23 bp, Homo sapiens
tatggcaagtttttggtaatgat

SEQ ID NO: 5512813 - DNA, 13 bp, Homo sapiens
tatggcacctatt

SEQ ID NO: 5512814 - DNA, 18 bp, Homo sapiens
tatggcacctatttcttt

SEQ ID NO: 5512815 - DNA, 18 bp, Homo sapiens
tatggcactatttttatt

SEQ ID NO: 5512816 - DNA, 12 bp, Homo sapiens
tatggcacttct

SEQ ID NO: 5512817 - DNA, 13 bp, Homo sapiens
tatggcacttctc

SEQ ID NO: 5512818 - DNA, 12 bp, Homo sapiens
tatggcagaaga

SEQ ID NO: 5512819 - DNA, 14 bp, Homo sapiens
tatggcagaagaca

SEQ ID NO: 5512820 - DNA, 15 bp, Homo sapiens
tatggcagaagacac

SEQ ID NO: 5512821 - DNA, 22 bp, Homo sapiens
tatggcagaagacaccagagca

SEQ ID NO: 5512822 - DNA, 13 bp, Homo sapiens
tatggcagcccgg

SEQ ID NO: 5512823 - DNA, 18 bp, Homo sapiens
tatggcagcccggctgct

SEQ ID NO: 5512824 - DNA, 15 bp, Homo sapiens
tatggcaggactcct

SEQ ID NO: 5512825 - DNA, 22 bp, Homo sapiens
tatggcaggactcctggcaggg

SEQ ID NO: 5512826 - DNA, 12 bp, Homo sapiens
tatggcaggagc

SEQ ID NO: 5512827 - DNA, 17 bp, Homo sapiens
tatggcaggagctactg

SEQ ID NO: 5512828 - DNA, 15 bp, Homo sapiens
tatggcagggaagct

SEQ ID NO: 5512829 - DNA, 21 bp, Homo sapiens
tatggcagtccagccagctcc

SEQ ID NO: 5512830 - DNA, 22 bp, Homo sapiens
tatggcagtccagccagctcct

SEQ ID NO: 5512831 - DNA, 15 bp, Homo sapiens
tatggcagtgggaga

SEQ ID NO: 5512832 - DNA, 14 bp, Homo sapiens
tatggcatatttat

SEQ ID NO: 5512833 - DNA, 17 bp, Homo sapiens
tatggcatatttatatt

SEQ ID NO: 5512834 - DNA, 19 bp, Homo sapiens
tatggcatatttatattgt

SEQ ID NO: 5512835 - DNA, 20 bp, Homo sapiens
tatggcatatttatattgta

SEQ ID NO: 5512836 - DNA, 12 bp, Homo sapiens
tatggcatctca

SEQ ID NO: 5512837 - DNA, 15 bp, Homo sapiens
tatggcatttctatt

SEQ ID NO: 5512838 - DNA, 16 bp, Homo sapiens
tatggccaaggctctc

SEQ ID NO: 5512839 - DNA, 21 bp, Homo sapiens
tatggccaatctattctcaaa

SEQ ID NO: 5512840 - DNA, 11 bp, Homo sapiens
tatggccaggg

SEQ ID NO: 5512841 - DNA, 17 bp, Homo sapiens
tatggccatgccctaga

SEQ ID NO: 5512842 - DNA, 12 bp, Homo sapiens
tatggcccagaa

SEQ ID NO: 5512843 - DNA, 18 bp, Homo sapiens
tatggcccagaaacaaca

SEQ ID NO: 5512844 - DNA, 23 bp, Homo sapiens
tatggcccagaaacaacagggga

SEQ ID NO: 5512845 - DNA, 22 bp, Homo sapiens
tatggcccagtgtcaagttgtg

SEQ ID NO: 5512846 - DNA, 23 bp, Homo sapiens
tatggcctaaatttattaaataa

SEQ ID NO: 5512847 - DNA, 14 bp, Homo sapiens
tatggcctgtgtca

SEQ ID NO: 5512848 - DNA, 16 bp, Homo sapiens
tatggccttgaagtgt

SEQ ID NO: 5512849 - DNA, 16 bp, Homo sapiens
tatggcggcctgcagt

SEQ ID NO: 5512850 - DNA, 18 bp, Homo sapiens
tatggcgtaagtacagag

SEQ ID NO: 5512851 - DNA, 19 bp, Homo sapiens
tatggcgtaagtacagaga

SEQ ID NO: 5512852 - DNA, 20 bp, Homo sapiens
tatggcgtaagtacagagaa

SEQ ID NO: 5512853 - DNA, 22 bp, Homo sapiens
tatggcgtaagtacagagaagc

SEQ ID NO: 5512854 - DNA, 18 bp, Homo sapiens
tatggcgttttgtctgtg

SEQ ID NO: 5512855 - DNA, 21 bp, Homo sapiens
tatggcgttttgtctgtgttg

SEQ ID NO: 5512856 - DNA, 22 bp, Homo sapiens
tatggcgttttgtctgtgttgc

SEQ ID NO: 5512857 - DNA, 20 bp, Homo sapiens
tatggcgtttttctcgtccc

SEQ ID NO: 5512858 - DNA, 17 bp, Homo sapiens
tatggctagaatatcct

SEQ ID NO: 5512859 - DNA, 21 bp, Homo sapiens
tatggctagaatatcctactt

SEQ ID NO: 5512860 - DNA, 21 bp, Homo sapiens
tatggctagacaggaaccctt

SEQ ID NO: 5512861 - DNA, 17 bp, Homo sapiens
tatggctataggtgcta

SEQ ID NO: 5512862 - DNA, 19 bp, Homo sapiens
tatggctatctatacctgc

SEQ ID NO: 5512863 - DNA, 22 bp, Homo sapiens
tatggctatctatacctgcctt

SEQ ID NO: 5512864 - DNA, 17 bp, Homo sapiens
tatggctcactatgaat

SEQ ID NO: 5512865 - DNA, 18 bp, Homo sapiens
tatggctcatgtctgaaa

SEQ ID NO: 5512866 - DNA, 21 bp, Homo sapiens
tatggctgcatagtattccat

SEQ ID NO: 5512867 - DNA, 14 bp, Homo sapiens
tatggctgcccagg

SEQ ID NO: 5512868 - DNA, 13 bp, Homo sapiens
tatggctgtattt

SEQ ID NO: 5512869 - DNA, 15 bp, Homo sapiens
tatggctgtattttt

SEQ ID NO: 5512870 - DNA, 20 bp, Homo sapiens
tatggctgtatttttagaga

SEQ ID NO: 5512871 - DNA, 17 bp, Homo sapiens
tatggcttataaatgtg

SEQ ID NO: 5512872 - DNA, 15 bp, Homo sapiens
tatggcttatttcta

SEQ ID NO: 5512873 - DNA, 16 bp, Homo sapiens
tatggcttcaccaaga

SEQ ID NO: 5512874 - DNA, 21 bp, Homo sapiens
tatggctttatttttttgaac

SEQ ID NO: 5512875 - DNA, 14 bp, Homo sapiens
tatggctttgtgct

SEQ ID NO: 5512876 - DNA, 15 bp, Homo sapiens
tatggctttgtgctt

SEQ ID NO: 5512877 - DNA, 21 bp, Homo sapiens
tatggcttttgtgcattatct

SEQ ID NO: 5512878 - DNA, 23 bp, Homo sapiens
tatggcttttgtgcattatctag

SEQ ID NO: 5512879 - DNA, 16 bp, Homo sapiens
tatgggaacaagtgta

SEQ ID NO: 5512880 - DNA, 20 bp, Homo sapiens
tatgggaaccagaatagata

SEQ ID NO: 5512881 - DNA, 19 bp, Homo sapiens
tatgggaatcagctggtgg

SEQ ID NO: 5512882 - DNA, 16 bp, Homo sapiens
tatgggagagtgtcaa

SEQ ID NO: 5512883 - DNA, 22 bp, Homo sapiens
tatgggagagtgtcaaccagac

SEQ ID NO: 5512884 - DNA, 13 bp, Homo sapiens
tatgggagctgtc

SEQ ID NO: 5512885 - DNA, 18 bp, Homo sapiens
tatgggaggaacaaagac

SEQ ID NO: 5512886 - DNA, 20 bp, Homo sapiens
tatgggatcatttttccagg

SEQ ID NO: 5512887 - DNA, 14 bp, Homo sapiens
tatgggatccaagg

SEQ ID NO: 5512888 - DNA, 15 bp, Homo sapiens
tatgggatgtaaaca

SEQ ID NO: 5512889 - DNA, 15 bp, Homo sapiens
tatgggcattgacaa

SEQ ID NO: 5512890 - DNA, 17 bp, Homo sapiens
tatgggcattgtagtta

SEQ ID NO: 5512891 - DNA, 13 bp, Homo sapiens
tatgggcgggcag

SEQ ID NO: 5512892 - DNA, 21 bp, Homo sapiens
tatgggctgggggctatgtat

SEQ ID NO: 5512893 - DNA, 17 bp, Homo sapiens
tatgggctgttctgttt

SEQ ID NO: 5512894 - DNA, 16 bp, Homo sapiens
tatgggcttggaccac

SEQ ID NO: 5512895 - DNA, 17 bp, Homo sapiens
tatggggatagatgtgt

SEQ ID NO: 5512896 - DNA, 22 bp, Homo sapiens
tatggggccctgtccaggtaga

SEQ ID NO: 5512897 - DNA, 15 bp, Homo sapiens
tatgggggcatctct

SEQ ID NO: 5512898 - DNA, 20 bp, Homo sapiens
tatgggggcatctcttcccc

SEQ ID NO: 5512899 - DNA, 19 bp, Homo sapiens
tatggggggggcaagaaag

SEQ ID NO: 5512900 - DNA, 18 bp, Homo sapiens
tatgggtagggtaaatca

SEQ ID NO: 5512901 - DNA, 19 bp, Homo sapiens
tatgggtagggtaaatcag

SEQ ID NO: 5512902 - DNA, 17 bp, Homo sapiens
tatgggtatatattcat

SEQ ID NO: 5512903 - DNA, 18 bp, Homo sapiens
tatgggtcattctcacct

SEQ ID NO: 5512904 - DNA, 22 bp, Homo sapiens
tatgggtgtgtgtttgtgtgag

SEQ ID NO: 5512905 - DNA, 15 bp, Homo sapiens
tatggtaaaaaattt

SEQ ID NO: 5512906 - DNA, 20 bp, Homo sapiens
tatggtaaagagatgtcaaa

SEQ ID NO: 5512907 - DNA, 15 bp, Homo sapiens
tatggtaaagatatt

SEQ ID NO: 5512908 - DNA, 19 bp, Homo sapiens
tatggtaaataactgtgac

SEQ ID NO: 5512909 - DNA, 21 bp, Homo sapiens
tatggtacatttttcaacttt

SEQ ID NO: 5512910 - DNA, 17 bp, Homo sapiens
tatggtaccagatgcag

SEQ ID NO: 5512911 - DNA, 17 bp, Homo sapiens
tatggtacctctgtcta

SEQ ID NO: 5512912 - DNA, 18 bp, Homo sapiens
tatggtacctctgtctat

SEQ ID NO: 5512913 - DNA, 20 bp, Homo sapiens
tatggtaggaccctcgagag

SEQ ID NO: 5512914 - DNA, 18 bp, Homo sapiens
tatggtaggggagggcag

SEQ ID NO: 5512915 - DNA, 19 bp, Homo sapiens
tatggtatgctggccagca

SEQ ID NO: 5512916 - DNA, 14 bp, Homo sapiens
tatggtatgtagcc

SEQ ID NO: 5512917 - DNA, 21 bp, Homo sapiens
tatggtattatatctctgtat

SEQ ID NO: 5512918 - DNA, 14 bp, Homo sapiens
tatggtatttgagt

SEQ ID NO: 5512919 - DNA, 22 bp, Homo sapiens
tatggtattttcgtgcatttgt

SEQ ID NO: 5512920 - DNA, 15 bp, Homo sapiens
tatgttaaaaagaaa

SEQ ID NO: 5512921 - DNA, 14 bp, Homo sapiens
tatgttaaagagaa

SEQ ID NO: 5512922 - DNA, 13 bp, Homo sapiens
tatgttaaagttt

SEQ ID NO: 5512923 - DNA, 12 bp, Homo sapiens
tatgttaaatac

SEQ ID NO: 5512924 - DNA, 14 bp, Homo sapiens
tatgttaaatactg

SEQ ID NO: 5512925 - DNA, 16 bp, Homo sapiens
tatgttaaatactgtg

SEQ ID NO: 5512926 - DNA, 19 bp, Homo sapiens
tatgttaaatactgtgcag

SEQ ID NO: 5512927 - DNA, 21 bp, Homo sapiens
tatgttaaatactgtgcagaa

SEQ ID NO: 5512928 - DNA, 22 bp, Homo sapiens
tatgttaagcagctaaattttc

SEQ ID NO: 5512929 - DNA, 14 bp, Homo sapiens
tatgttaagctctt

SEQ ID NO: 5512930 - DNA, 19 bp, Homo sapiens
tatgttaagggaagaattc

SEQ ID NO: 5512931 - DNA, 15 bp, Homo sapiens
tatgttaagttactt

SEQ ID NO: 5512932 - DNA, 20 bp, Homo sapiens
tatgttaatatctgatactg

SEQ ID NO: 5512933 - DNA, 14 bp, Homo sapiens
tatgttaatatgtt

SEQ ID NO: 5512934 - DNA, 13 bp, Homo sapiens
tatgttaatattt

SEQ ID NO: 5512935 - DNA, 14 bp, Homo sapiens
tatgttaatatttt

SEQ ID NO: 5512936 - DNA, 18 bp, Homo sapiens
tatgttaatattttatgt

SEQ ID NO: 5512937 - DNA, 20 bp, Homo sapiens
tatgttaatttgttatgtat

SEQ ID NO: 5512938 - DNA, 20 bp, Homo sapiens
tatgttacttaaacatcatt

SEQ ID NO: 5512939 - DNA, 17 bp, Homo sapiens
tatgttagattttgcat

SEQ ID NO: 5512940 - DNA, 16 bp, Homo sapiens
tatgttatacaaggca

SEQ ID NO: 5512941 - DNA, 17 bp, Homo sapiens
tatgttatacaaggcaa

SEQ ID NO: 5512942 - DNA, 21 bp, Homo sapiens
tatgttatagaacttcatgga

SEQ ID NO: 5512943 - DNA, 15 bp, Homo sapiens
tatgttatatataaa

SEQ ID NO: 5512944 - DNA, 19 bp, Homo sapiens
tatgttatatataaatata

SEQ ID NO: 5512945 - DNA, 21 bp, Homo sapiens
tatgttatcaccttccaaaca

SEQ ID NO: 5512946 - DNA, 15 bp, Homo sapiens
tatgttatgaacatg

SEQ ID NO: 5512947 - DNA, 13 bp, Homo sapiens
tatgttattcctg

SEQ ID NO: 5512948 - DNA, 14 bp, Homo sapiens
tatgttattgaaaa

SEQ ID NO: 5512949 - DNA, 19 bp, Homo sapiens
tatgttatttgatgactga

SEQ ID NO: 5512950 - DNA, 17 bp, Homo sapiens
tatgttattttcagtgc

SEQ ID NO: 5512951 - DNA, 16 bp, Homo sapiens
tatgttcaaagtcaaa

SEQ ID NO: 5512952 - DNA, 21 bp, Homo sapiens
tatgttcaactaggatcagaa

SEQ ID NO: 5512953 - DNA, 12 bp, Homo sapiens
tatgttcaatgc

SEQ ID NO: 5512954 - DNA, 20 bp, Homo sapiens
tatgttcaccaggagattac

SEQ ID NO: 5512955 - DNA, 20 bp, Homo sapiens
tatgttcagaaatgtaaatg

SEQ ID NO: 5512956 - DNA, 16 bp, Homo sapiens
tatgttcagaagaaat

SEQ ID NO: 5512957 - DNA, 15 bp, Homo sapiens
tatgttcataaaaaa

SEQ ID NO: 5512958 - DNA, 20 bp, Homo sapiens
tatgttcattaaattttcta

SEQ ID NO: 5512959 - DNA, 13 bp, Homo sapiens
tatgttcatttgt

SEQ ID NO: 5512960 - DNA, 17 bp, Homo sapiens
tatgttcatttgtttgt

SEQ ID NO: 5512961 - DNA, 12 bp, Homo sapiens
tatgttcatttt

SEQ ID NO: 5512962 - DNA, 16 bp, Homo sapiens
tatgttccattaaacg

SEQ ID NO: 5512963 - DNA, 20 bp, Homo sapiens
tatgttccattaaacgattt

SEQ ID NO: 5512964 - DNA, 15 bp, Homo sapiens
tatgttcctcaaatc

SEQ ID NO: 5512965 - DNA, 16 bp, Homo sapiens
tatgttcctgctgtat

SEQ ID NO: 5512966 - DNA, 17 bp, Homo sapiens
tatgttcctgctgtatt

SEQ ID NO: 5512967 - DNA, 21 bp, Homo sapiens
tatgttcctgctgtatttcct

SEQ ID NO: 5512968 - DNA, 12 bp, Homo sapiens
tatgttctcaac

SEQ ID NO: 5512969 - DNA, 12 bp, Homo sapiens
tatgttctctga

SEQ ID NO: 5512970 - DNA, 16 bp, Homo sapiens
tatgttctctgaatga

SEQ ID NO: 5512971 - DNA, 21 bp, Homo sapiens
tatgttctctgaatgagcctt

SEQ ID NO: 5512972 - DNA, 13 bp, Homo sapiens
tatgttctgtctt

SEQ ID NO: 5512973 - DNA, 18 bp, Homo sapiens
tatgttctgtcttcccaa

SEQ ID NO: 5512974 - DNA, 23 bp, Homo sapiens
tatgttcttagcaataaatgctt

SEQ ID NO: 5512975 - DNA, 22 bp, Homo sapiens
tatgttcttagtggatgttctg

SEQ ID NO: 5512976 - DNA, 13 bp, Homo sapiens
tatgttcttatag

SEQ ID NO: 5512977 - DNA, 14 bp, Homo sapiens
tatgttcttataga

SEQ ID NO: 5512978 - DNA, 18 bp, Homo sapiens
tatgttctttagtttgct

SEQ ID NO: 5512979 - DNA, 16 bp, Homo sapiens
tatgttgaaaaaattt

SEQ ID NO: 5512980 - DNA, 17 bp, Homo sapiens
tatgttgaagcctttgt

SEQ ID NO: 5512981 - DNA, 18 bp, Homo sapiens
tatgttgacctaagattt

SEQ ID NO: 5512982 - DNA, 14 bp, Homo sapiens
tatgttgataaaag

SEQ ID NO: 5512983 - DNA, 23 bp, Homo sapiens
tatgttgataaaccaaaaacatt

SEQ ID NO: 5512984 - DNA, 18 bp, Homo sapiens
tatgttgatccatccagc

SEQ ID NO: 5512985 - DNA, 15 bp, Homo sapiens
tatgttgatgaaaaa

SEQ ID NO: 5512986 - DNA, 21 bp, Homo sapiens
tatgttgcccaagctggtctt

SEQ ID NO: 5512987 - DNA, 13 bp, Homo sapiens
tatgttgcccagg

SEQ ID NO: 5512988 - DNA, 16 bp, Homo sapiens
tatgttgcccaggcag

SEQ ID NO: 5512989 - DNA, 19 bp, Homo sapiens
tatgttgcccaggcaggtc

SEQ ID NO: 5512990 - DNA, 21 bp, Homo sapiens
tatgttgcccaggcaggtctt

SEQ ID NO: 5512991 - DNA, 18 bp, Homo sapiens
tatgttgcctttatggtt

SEQ ID NO: 5512992 - DNA, 18 bp, Homo sapiens
tatgttggtagattctaa

SEQ ID NO: 5512993 - DNA, 15 bp, Homo sapiens
tatgttggtttaatt

SEQ ID NO: 5512994 - DNA, 16 bp, Homo sapiens
tatgttgtacaatcaa

SEQ ID NO: 5512995 - DNA, 13 bp, Homo sapiens
tatgttgtatgat

SEQ ID NO: 5512996 - DNA, 18 bp, Homo sapiens
tatgttgtattaactggg

SEQ ID NO: 5512997 - DNA, 13 bp, Homo sapiens
tatgttgtcaaag

SEQ ID NO: 5512998 - DNA, 14 bp, Homo sapiens
tatgttgtcataac

SEQ ID NO: 5512999 - DNA, 18 bp, Homo sapiens
tatgttgtcataacattt

SEQ ID NO: 5513000 - DNA, 19 bp, Homo sapiens
tatgttgtcataacattta

SEQ ID NO: 5513001 - DNA, 12 bp, Homo sapiens
tatgtttacaaa

SEQ ID NO: 5513002 - DNA, 13 bp, Homo sapiens
tatgtttacactg

SEQ ID NO: 5513003 - DNA, 15 bp, Homo sapiens
tatgtttacactgtc

SEQ ID NO: 5513004 - DNA, 18 bp, Homo sapiens
tatgtttacactgtcaaa

SEQ ID NO: 5513005 - DNA, 16 bp, Homo sapiens
tatgtttacctcactg

SEQ ID NO: 5513006 - DNA, 22 bp, Homo sapiens
tatgtttagatagggctgggca

SEQ ID NO: 5513007 - DNA, 15 bp, Homo sapiens
tatgtttatacacac

SEQ ID NO: 5513008 - DNA, 16 bp, Homo sapiens
tatgtttatacacaca

SEQ ID NO: 5513009 - DNA, 18 bp, Homo sapiens
tatgtttatataaatgct

SEQ ID NO: 5513010 - DNA, 17 bp, Homo sapiens
tatgtttattcaaaata

SEQ ID NO: 5513011 - DNA, 19 bp, Homo sapiens
tatgtttattcaaaatatt

SEQ ID NO: 5513012 - DNA, 18 bp, Homo sapiens
tatgtttatttactaatt

SEQ ID NO: 5513013 - DNA, 14 bp, Homo sapiens
tatgtttatttcat

SEQ ID NO: 5513014 - DNA, 23 bp, Homo sapiens
tatgtttcaccctgtccctctaa

SEQ ID NO: 5513015 - DNA, 15 bp, Homo sapiens
tatgtttccatagct

SEQ ID NO: 5513016 - DNA, 19 bp, Homo sapiens
tatgtttccatcttcagtt

SEQ ID NO: 5513017 - DNA, 23 bp, Homo sapiens
tatgtttccatcttcagtttctg

SEQ ID NO: 5513018 - DNA, 19 bp, Homo sapiens
tatgtttccccatctctgt

SEQ ID NO: 5513019 - DNA, 23 bp, Homo sapiens
tatgtttccccatctctgtctgg

SEQ ID NO: 5513020 - DNA, 24 bp, Homo sapiens
tatgtttccccatctctgtctggg

SEQ ID NO: 5513021 - DNA, 20 bp, Homo sapiens
tatgtttctacacattgcta

SEQ ID NO: 5513022 - DNA, 23 bp, Homo sapiens
tatgtttctacacattgctacct

SEQ ID NO: 5513023 - DNA, 23 bp, Homo sapiens
tatgtttcttattctctgtttgc

SEQ ID NO: 5513024 - DNA, 16 bp, Homo sapiens
tatgtttcttctttct

SEQ ID NO: 5513025 - DNA, 21 bp, Homo sapiens
tatgtttcttgctgtattata

SEQ ID NO: 5513026 - DNA, 14 bp, Homo sapiens
tatgtttgaatatg

SEQ ID NO: 5513027 - DNA, 16 bp, Homo sapiens
tatgtttgaatatgga

SEQ ID NO: 5513028 - DNA, 22 bp, Homo sapiens
tatgtttgcattaaatgctttg

SEQ ID NO: 5513029 - DNA, 22 bp, Homo sapiens
tatgtttgccactttgcaaagg

SEQ ID NO: 5513030 - DNA, 16 bp, Homo sapiens
tatgtttggctgaaat

SEQ ID NO: 5513031 - DNA, 16 bp, Homo sapiens
tatgtttgtaactttt

SEQ ID NO: 5513032 - DNA, 13 bp, Homo sapiens
tatgtttgtacac

SEQ ID NO: 5513033 - DNA, 17 bp, Homo sapiens
tatgtttgtatttggaa

SEQ ID NO: 5513034 - DNA, 18 bp, Homo sapiens
tatgtttgtctcactttt

SEQ ID NO: 5513035 - DNA, 13 bp, Homo sapiens
tatgttttaacaa

SEQ ID NO: 5513036 - DNA, 14 bp, Homo sapiens
tatgttttaacaaa

SEQ ID NO: 5513037 - DNA, 19 bp, Homo sapiens
tatgttttaagaggcaggg

SEQ ID NO: 5513038 - DNA, 19 bp, Homo sapiens
tatgttttggagagagcaa

SEQ ID NO: 5513039 - DNA, 18 bp, Homo sapiens
tatgttttgtttctgaaa

SEQ ID NO: 5513040 - DNA, 18 bp, Homo sapiens
tatgtttttaatatgcat

SEQ ID NO: 5513041 - DNA, 14 bp, Homo sapiens
tatgtttttactga

SEQ ID NO: 5513042 - DNA, 15 bp, Homo sapiens
tatgtttttactgaa

SEQ ID NO: 5513043 - DNA, 12 bp, Homo sapiens
tatgtttttagg

SEQ ID NO: 5513044 - DNA, 16 bp, Homo sapiens
tatgtttttcagttca

SEQ ID NO: 5513045 - DNA, 18 bp, Homo sapiens
tatgtttttcagttcaaa

SEQ ID NO: 5513046 - DNA, 13 bp, Homo sapiens
tatgtttttctgt

SEQ ID NO: 5513047 - DNA, 15 bp, Homo sapiens
tatgtttttctgtgt

SEQ ID NO: 5513048 - DNA, 22 bp, Homo sapiens
tatgtttttctgtgtgtcagtt

SEQ ID NO: 5513049 - DNA, 17 bp, Homo sapiens
tatgtttttgactcttt

SEQ ID NO: 5513050 - DNA, 21 bp, Homo sapiens
tatgtttttgactcttttgag

SEQ ID NO: 5513051 - DNA, 14 bp, Homo sapiens
tatgtttttgtgta

SEQ ID NO: 5513052 - DNA, 16 bp, Homo sapiens
tatgtttttgttcaaa

SEQ ID NO: 5513053 - DNA, 20 bp, Homo sapiens
tatgtttttgtttttttcct

SEQ ID NO: 5513054 - DNA, 15 bp, Homo sapiens
tatgttttttttctg

SEQ ID NO: 5513055 - DNA, 21 bp, Homo sapiens
tattaaaaaaaaatactcttt

SEQ ID NO: 5513056 - DNA, 22 bp, Homo sapiens
tattaaaaaacaattaactgcc

SEQ ID NO: 5513057 - DNA, 15 bp, Homo sapiens
tattaaaaaacttca

SEQ ID NO: 5513058 - DNA, 18 bp, Homo sapiens
tattaaaaaacttcatgt

SEQ ID NO: 5513059 - DNA, 17 bp, Homo sapiens
tattaaaaaagagacat

SEQ ID NO: 5513060 - DNA, 20 bp, Homo sapiens
tattaaaaaggtttacagaa

SEQ ID NO: 5513061 - DNA, 14 bp, Homo sapiens
tattaaaaagtctt

SEQ ID NO: 5513062 - DNA, 17 bp, Homo sapiens
tattaaaaagtctttta

SEQ ID NO: 5513063 - DNA, 19 bp, Homo sapiens
tattaaaaagtcttttaaa

SEQ ID NO: 5513064 - DNA, 20 bp, Homo sapiens
tattaaaaatatggaacttc

SEQ ID NO: 5513065 - DNA, 23 bp, Homo sapiens
tattaaaaatctcaaatttctaa

SEQ ID NO: 5513066 - DNA, 14 bp, Homo sapiens
tattaaaaatggta

SEQ ID NO: 5513067 - DNA, 15 bp, Homo sapiens
tattaaaaatggtaa

SEQ ID NO: 5513068 - DNA, 20 bp, Homo sapiens
tattaaaaatggtaaaattg

SEQ ID NO: 5513069 - DNA, 21 bp, Homo sapiens
tattaaaaatgttctcaaata

SEQ ID NO: 5513070 - DNA, 16 bp, Homo sapiens
tattaaaaattaattc

SEQ ID NO: 5513071 - DNA, 21 bp, Homo sapiens
tattaaaaattaattctttat

SEQ ID NO: 5513072 - DNA, 20 bp, Homo sapiens
tattaaaacacaaagtcctt

SEQ ID NO: 5513073 - DNA, 23 bp, Homo sapiens
tattaaaacacattatgtatctt

SEQ ID NO: 5513074 - DNA, 18 bp, Homo sapiens
tattaaaacattggatta

SEQ ID NO: 5513075 - DNA, 19 bp, Homo sapiens
tattaaaacattggattat

SEQ ID NO: 5513076 - DNA, 13 bp, Homo sapiens
tattaaaaccagt

SEQ ID NO: 5513077 - DNA, 14 bp, Homo sapiens
tattaaaactaaat

SEQ ID NO: 5513078 - DNA, 17 bp, Homo sapiens
tattaaaactaaatttc

SEQ ID NO: 5513079 - DNA, 12 bp, Homo sapiens
tattaaaagact

SEQ ID NO: 5513080 - DNA, 13 bp, Homo sapiens
tattaaaagactc

SEQ ID NO: 5513081 - DNA, 16 bp, Homo sapiens
tattaaaagactcatc

SEQ ID NO: 5513082 - DNA, 18 bp, Homo sapiens
tattaaaagactcatccg

SEQ ID NO: 5513083 - DNA, 15 bp, Homo sapiens
tattaaaatactgtt

SEQ ID NO: 5513084 - DNA, 17 bp, Homo sapiens
tattaaaatatttcagg

SEQ ID NO: 5513085 - DNA, 13 bp, Homo sapiens
tattaaaatcaca

SEQ ID NO: 5513086 - DNA, 12 bp, Homo sapiens
tattaaaatgta

SEQ ID NO: 5513087 - DNA, 13 bp, Homo sapiens
tattaaaatgtaa

SEQ ID NO: 5513088 - DNA, 13 bp, Homo sapiens
tattaaaatgtat

SEQ ID NO: 5513089 - DNA, 14 bp, Homo sapiens
tattaaaattctga

SEQ ID NO: 5513090 - DNA, 20 bp, Homo sapiens
tattaaaattctgatgtttc

SEQ ID NO: 5513091 - DNA, 11 bp, Homo sapiens
tattaaaattg

SEQ ID NO: 5513092 - DNA, 16 bp, Homo sapiens
tattaaaattgattgt

SEQ ID NO: 5513093 - DNA, 13 bp, Homo sapiens
tattaaaattgtt

SEQ ID NO: 5513094 - DNA, 19 bp, Homo sapiens
tattaaaattgttaatatg

SEQ ID NO: 5513095 - DNA, 21 bp, Homo sapiens
tattaaacaaaaacaaagaaa

SEQ ID NO: 5513096 - DNA, 22 bp, Homo sapiens
tattaaacaagtcaattctgtg

SEQ ID NO: 5513097 - DNA, 23 bp, Homo sapiens
tattaaacaagtcaattctgtgt

SEQ ID NO: 5513098 - DNA, 13 bp, Homo sapiens
tattaaacagata

SEQ ID NO: 5513099 - DNA, 17 bp, Homo sapiens
tattaaacagatatctt

SEQ ID NO: 5513100 - DNA, 20 bp, Homo sapiens
tattaaacagatttttacaa

SEQ ID NO: 5513101 - DNA, 23 bp, Homo sapiens
tattaaacagatttttacaaatg

SEQ ID NO: 5513102 - DNA, 17 bp, Homo sapiens
tattaaacagtgaactt

SEQ ID NO: 5513103 - DNA, 16 bp, Homo sapiens
tattaaacattttcat

SEQ ID NO: 5513104 - DNA, 20 bp, Homo sapiens
tattaaaccataagatggca

SEQ ID NO: 5513105 - DNA, 21 bp, Homo sapiens
tattaaacgtatgcatgtgaa

SEQ ID NO: 5513106 - DNA, 22 bp, Homo sapiens
tattaaacgtatgcatgtgaag

SEQ ID NO: 5513107 - DNA, 21 bp, Homo sapiens
tattaaactgtaaatcataat

SEQ ID NO: 5513108 - DNA, 23 bp, Homo sapiens
tattaaagaatccttatctataa

SEQ ID NO: 5513109 - DNA, 22 bp, Homo sapiens
tattaaagaatgctgcaacttt

SEQ ID NO: 5513110 - DNA, 23 bp, Homo sapiens
tattaaagaatgctgcaactttt

SEQ ID NO: 5513111 - DNA, 17 bp, Homo sapiens
tattaaagataagactt

SEQ ID NO: 5513112 - DNA, 19 bp, Homo sapiens
tattaaagatctgcaacta

SEQ ID NO: 5513113 - DNA, 22 bp, Homo sapiens
tattaaagatgcaggttttcta

SEQ ID NO: 5513114 - DNA, 13 bp, Homo sapiens
tattaaagatgtg

SEQ ID NO: 5513115 - DNA, 16 bp, Homo sapiens
tattaaagatgtgttg

SEQ ID NO: 5513116 - DNA, 18 bp, Homo sapiens
tattaaagattggaatgt

SEQ ID NO: 5513117 - DNA, 12 bp, Homo sapiens
tattaaagattt

SEQ ID NO: 5513118 - DNA, 17 bp, Homo sapiens
tattaaagcatttccta

SEQ ID NO: 5513119 - DNA, 17 bp, Homo sapiens
tattaaagccatgttta

SEQ ID NO: 5513120 - DNA, 18 bp, Homo sapiens
tattaaagccatgtttat

SEQ ID NO: 5513121 - DNA, 22 bp, Homo sapiens
tattaaagcctcatgtgtgaaa

SEQ ID NO: 5513122 - DNA, 19 bp, Homo sapiens
tattaaaggttaaattgct

SEQ ID NO: 5513123 - DNA, 22 bp, Homo sapiens
tattaaaggttcctttgttccc

SEQ ID NO: 5513124 - DNA, 18 bp, Homo sapiens
tattaaagtgctaaggtt

SEQ ID NO: 5513125 - DNA, 24 bp, Homo sapiens
tattaaagtgctaaggttctaagg

SEQ ID NO: 5513126 - DNA, 16 bp, Homo sapiens
tattaaagtttcaaaa

SEQ ID NO: 5513127 - DNA, 19 bp, Homo sapiens
tattaaataataaagtatg

SEQ ID NO: 5513128 - DNA, 18 bp, Homo sapiens
tattaaatacaaaacttc

SEQ ID NO: 5513129 - DNA, 15 bp, Homo sapiens
tattaaatagaaggt

SEQ ID NO: 5513130 - DNA, 23 bp, Homo sapiens
tattaaatataaatatccccagg

SEQ ID NO: 5513131 - DNA, 20 bp, Homo sapiens
tattaaatatttaacatagg

SEQ ID NO: 5513132 - DNA, 22 bp, Homo sapiens
tattaaatcgtttaatgtttat

SEQ ID NO: 5513133 - DNA, 24 bp, Homo sapiens
tattaaatcgtttaatgtttatac

SEQ ID NO: 5513134 - DNA, 14 bp, Homo sapiens
tattaaatcttaaa

SEQ ID NO: 5513135 - DNA, 14 bp, Homo sapiens
tattaaatcttttt

SEQ ID NO: 5513136 - DNA, 17 bp, Homo sapiens
tattaaatgcccagccc

SEQ ID NO: 5513137 - DNA, 18 bp, Homo sapiens
tattaaatggaaactgaa

SEQ ID NO: 5513138 - DNA, 17 bp, Homo sapiens
tattaaatgtttcaaaa

SEQ ID NO: 5513139 - DNA, 19 bp, Homo sapiens
tattaaattctcaaagttt

SEQ ID NO: 5513140 - DNA, 22 bp, Homo sapiens
tattaaattgtgtacactttca

SEQ ID NO: 5513141 - DNA, 17 bp, Homo sapiens
tattaaatttatttgaa

SEQ ID NO: 5513142 - DNA, 20 bp, Homo sapiens
tattaaattttttaaaaagc

SEQ ID NO: 5513143 - DNA, 20 bp, Homo sapiens
tattaaattttttgttgaca

SEQ ID NO: 5513144 - DNA, 16 bp, Homo sapiens
tattaacaaacaggat

SEQ ID NO: 5513145 - DNA, 16 bp, Homo sapiens
tattaacaaagttact

SEQ ID NO: 5513146 - DNA, 16 bp, Homo sapiens
tattaacaaattatgt

SEQ ID NO: 5513147 - DNA, 18 bp, Homo sapiens
tattaacaaattatgtta

SEQ ID NO: 5513148 - DNA, 16 bp, Homo sapiens
tattaacaaattgcat

SEQ ID NO: 5513149 - DNA, 17 bp, Homo sapiens
tattaacaactgtgaat

SEQ ID NO: 5513150 - DNA, 15 bp, Homo sapiens
tattaacaattaatt

SEQ ID NO: 5513151 - DNA, 20 bp, Homo sapiens
tattaacaattaattgtctt

SEQ ID NO: 5513152 - DNA, 19 bp, Homo sapiens
tattaacatattatttcat

SEQ ID NO: 5513153 - DNA, 20 bp, Homo sapiens
tattaacatattatttcatt

SEQ ID NO: 5513154 - DNA, 14 bp, Homo sapiens
tattaacatgcaat

SEQ ID NO: 5513155 - DNA, 19 bp, Homo sapiens
tattaaccttttttgtctt

SEQ ID NO: 5513156 - DNA, 12 bp, Homo sapiens
tattaactacat

SEQ ID NO: 5513157 - DNA, 20 bp, Homo sapiens
tattaactactgtagaactg

SEQ ID NO: 5513158 - DNA, 18 bp, Homo sapiens
tattaactatcttctttg

SEQ ID NO: 5513159 - DNA, 15 bp, Homo sapiens
tattaactgccaaaa

SEQ ID NO: 5513160 - DNA, 22 bp, Homo sapiens
tattaactgctcagtgtttcat

SEQ ID NO: 5513161 - DNA, 22 bp, Homo sapiens
tattaactggctactgggaaat

SEQ ID NO: 5513162 - DNA, 21 bp, Homo sapiens
tattaactgtattttctttca

SEQ ID NO: 5513163 - DNA, 23 bp, Homo sapiens
tattaactgtattttctttcact

SEQ ID NO: 5513164 - DNA, 15 bp, Homo sapiens
tattaacttaataat

SEQ ID NO: 5513165 - DNA, 20 bp, Homo sapiens
tattaacttaataatcaaga

SEQ ID NO: 5513166 - DNA, 17 bp, Homo sapiens
tattaactttaatgttt

SEQ ID NO: 5513167 - DNA, 18 bp, Homo sapiens
tattaactttaatgtttt

SEQ ID NO: 5513168 - DNA, 13 bp, Homo sapiens
tattaacttttaa

SEQ ID NO: 5513169 - DNA, 23 bp, Homo sapiens
tattaagaaaggaagcattgtaa

SEQ ID NO: 5513170 - DNA, 24 bp, Homo sapiens
tattaagaaaggaagcattgtaaa

SEQ ID NO: 5513171 - DNA, 13 bp, Homo sapiens
tattaagaacatt

SEQ ID NO: 5513172 - DNA, 20 bp, Homo sapiens
tattaagaagcaataactat

SEQ ID NO: 5513173 - DNA, 12 bp, Homo sapiens
tattaagaatga

SEQ ID NO: 5513174 - DNA, 13 bp, Homo sapiens
tattaagacagtg

SEQ ID NO: 5513175 - DNA, 16 bp, Homo sapiens
tattaagacagtgtac

SEQ ID NO: 5513176 - DNA, 17 bp, Homo sapiens
tattaagacagtgtaca

SEQ ID NO: 5513177 - DNA, 21 bp, Homo sapiens
tattaagacagtgtacaaaac

SEQ ID NO: 5513178 - DNA, 15 bp, Homo sapiens
tattaagaccaaaga

SEQ ID NO: 5513179 - DNA, 13 bp, Homo sapiens
tattaagagctat

SEQ ID NO: 5513180 - DNA, 17 bp, Homo sapiens
tattaagagctatttta

SEQ ID NO: 5513181 - DNA, 13 bp, Homo sapiens
tattaagatggat

SEQ ID NO: 5513182 - DNA, 17 bp, Homo sapiens
tattaagattataattg

SEQ ID NO: 5513183 - DNA, 14 bp, Homo sapiens
tattaagattggaa

SEQ ID NO: 5513184 - DNA, 21 bp, Homo sapiens
tattaagcaaccttaaagcaa

SEQ ID NO: 5513185 - DNA, 12 bp, Homo sapiens
tattaagcacat

SEQ ID NO: 5513186 - DNA, 14 bp, Homo sapiens
tattaagcacatta

SEQ ID NO: 5513187 - DNA, 23 bp, Homo sapiens
tattaagcacattattgtagaga

SEQ ID NO: 5513188 - DNA, 23 bp, Homo sapiens
tattaagcagactggaaaagtga

SEQ ID NO: 5513189 - DNA, 14 bp, Homo sapiens
tattaagcagtaaa

SEQ ID NO: 5513190 - DNA, 19 bp, Homo sapiens
tattaagcagtaaaaactg

SEQ ID NO: 5513191 - DNA, 16 bp, Homo sapiens
tattaagcatatattt

SEQ ID NO: 5513192 - DNA, 21 bp, Homo sapiens
tattaagcccacagtatattt

SEQ ID NO: 5513193 - DNA, 20 bp, Homo sapiens
tattaagcctaccgtatttc

SEQ ID NO: 5513194 - DNA, 14 bp, Homo sapiens
tattaaggaagaca

SEQ ID NO: 5513195 - DNA, 18 bp, Homo sapiens
tattaaggggatcagaag

SEQ ID NO: 5513196 - DNA, 24 bp, Homo sapiens
tattaaggtaactactgctaatgt

SEQ ID NO: 5513197 - DNA, 14 bp, Homo sapiens
tattaagtgaaatt

SEQ ID NO: 5513198 - DNA, 18 bp, Homo sapiens
tattaagtgaaattttaa

SEQ ID NO: 5513199 - DNA, 22 bp, Homo sapiens
tattaagtgaaattttaaatgc

SEQ ID NO: 5513200 - DNA, 12 bp, Homo sapiens
tattaagtgact

SEQ ID NO: 5513201 - DNA, 19 bp, Homo sapiens
tattaagtgactgaccatg

SEQ ID NO: 5513202 - DNA, 23 bp, Homo sapiens
tattaagtgactgaccatgcact

SEQ ID NO: 5513203 - DNA, 17 bp, Homo sapiens
tattaagtgtgccaaat

SEQ ID NO: 5513204 - DNA, 15 bp, Homo sapiens
tattaagttgttaat

SEQ ID NO: 5513205 - DNA, 14 bp, Homo sapiens
tattaagtttgaaa

SEQ ID NO: 5513206 - DNA, 12 bp, Homo sapiens
tattaataaagc

SEQ ID NO: 5513207 - DNA, 15 bp, Homo sapiens
tattaataaagcatt

SEQ ID NO: 5513208 - DNA, 17 bp, Homo sapiens
tattaataaagcattct

SEQ ID NO: 5513209 - DNA, 14 bp, Homo sapiens
tattaataaatttt

SEQ ID NO: 5513210 - DNA, 14 bp, Homo sapiens
tattaataatattt

SEQ ID NO: 5513211 - DNA, 13 bp, Homo sapiens
tattaatacagat

SEQ ID NO: 5513212 - DNA, 17 bp, Homo sapiens
tattaataccaaatatt

SEQ ID NO: 5513213 - DNA, 17 bp, Homo sapiens
tattaatactacccata

SEQ ID NO: 5513214 - DNA, 19 bp, Homo sapiens
tattaatataaccataaat

SEQ ID NO: 5513215 - DNA, 18 bp, Homo sapiens
tattaatataagtttctt

SEQ ID NO: 5513216 - DNA, 20 bp, Homo sapiens
tattaatatatatctgctgt

SEQ ID NO: 5513217 - DNA, 12 bp, Homo sapiens
tattaatatcaa

SEQ ID NO: 5513218 - DNA, 20 bp, Homo sapiens
tattaatatcaactctgaag

SEQ ID NO: 5513219 - DNA, 22 bp, Homo sapiens
tattaatattgtgcttaaatta

SEQ ID NO: 5513220 - DNA, 13 bp, Homo sapiens
tattaatatttaa

SEQ ID NO: 5513221 - DNA, 16 bp, Homo sapiens
tattaatatttatgtg

SEQ ID NO: 5513222 - DNA, 15 bp, Homo sapiens
tattaatattttaat

SEQ ID NO: 5513223 - DNA, 21 bp, Homo sapiens
tattaatcaccttctttgtaa

SEQ ID NO: 5513224 - DNA, 14 bp, Homo sapiens
tattaatcactgtg

SEQ ID NO: 5513225 - DNA, 17 bp, Homo sapiens
tattaatcactgtgtat

SEQ ID NO: 5513226 - DNA, 20 bp, Homo sapiens
tattaatcactgtgtatatt

SEQ ID NO: 5513227 - DNA, 14 bp, Homo sapiens
tattaatcagaata

SEQ ID NO: 5513228 - DNA, 20 bp, Homo sapiens
tattaatcatacaaactctc

SEQ ID NO: 5513229 - DNA, 19 bp, Homo sapiens
tattaatcatagattatta

SEQ ID NO: 5513230 - DNA, 13 bp, Homo sapiens
tattaatcattcc

SEQ ID NO: 5513231 - DNA, 17 bp, Homo sapiens
tattaatccacaaatat

SEQ ID NO: 5513232 - DNA, 21 bp, Homo sapiens
tattaatccacaaatatgcta

SEQ ID NO: 5513233 - DNA, 18 bp, Homo sapiens
tattaatctactgtatca

SEQ ID NO: 5513234 - DNA, 14 bp, Homo sapiens
tattaatcttagtg

SEQ ID NO: 5513235 - DNA, 21 bp, Homo sapiens
tattaatcttggatagctaat

SEQ ID NO: 5513236 - DNA, 12 bp, Homo sapiens
tattaatcttgt

SEQ ID NO: 5513237 - DNA, 19 bp, Homo sapiens
tattaatctttcttttgat

SEQ ID NO: 5513238 - DNA, 13 bp, Homo sapiens
tattaatgaaaat

SEQ ID NO: 5513239 - DNA, 12 bp, Homo sapiens
tattaatgcact

SEQ ID NO: 5513240 - DNA, 20 bp, Homo sapiens
tattaatgcactttctatcc

SEQ ID NO: 5513241 - DNA, 15 bp, Homo sapiens
tattaatgcccagac

SEQ ID NO: 5513242 - DNA, 14 bp, Homo sapiens
tattaatgccttta

SEQ ID NO: 5513243 - DNA, 23 bp, Homo sapiens
tattaatgcctttaaagtatgaa

SEQ ID NO: 5513244 - DNA, 19 bp, Homo sapiens
tattaatgcgatttcttcc

SEQ ID NO: 5513245 - DNA, 15 bp, Homo sapiens
tattaatgctaaggg

SEQ ID NO: 5513246 - DNA, 17 bp, Homo sapiens
tattaatggacaaataa

SEQ ID NO: 5513247 - DNA, 19 bp, Homo sapiens
tattaatggcatgtaatat

SEQ ID NO: 5513248 - DNA, 18 bp, Homo sapiens
tattaatgtctaactaca

SEQ ID NO: 5513249 - DNA, 18 bp, Homo sapiens
tattaatgttttcaaaag

SEQ ID NO: 5513250 - DNA, 15 bp, Homo sapiens
tattaattaaagaaa

SEQ ID NO: 5513251 - DNA, 15 bp, Homo sapiens
tattaattatctgat

SEQ ID NO: 5513252 - DNA, 13 bp, Homo sapiens
tattaattccaag

SEQ ID NO: 5513253 - DNA, 23 bp, Homo sapiens
tattaattccaggaacacatgtt

SEQ ID NO: 5513254 - DNA, 18 bp, Homo sapiens
tattaattccatgtgata

SEQ ID NO: 5513255 - DNA, 14 bp, Homo sapiens
tattaattgcctgt

SEQ ID NO: 5513256 - DNA, 20 bp, Homo sapiens
tattaattgcctgttaaata

SEQ ID NO: 5513257 - DNA, 14 bp, Homo sapiens
tattaattgctttg

SEQ ID NO: 5513258 - DNA, 18 bp, Homo sapiens
tattaattgtcctgtgtc

SEQ ID NO: 5513259 - DNA, 11 bp, Homo sapiens
tattaatttat

SEQ ID NO: 5513260 - DNA, 15 bp, Homo sapiens
tattaatttcattgt

SEQ ID NO: 5513261 - DNA, 12 bp, Homo sapiens
tattaatttgaa

SEQ ID NO: 5513262 - DNA, 14 bp, Homo sapiens
tattaattttagtt

SEQ ID NO: 5513263 - DNA, 21 bp, Homo sapiens
tattaattttagtttttcatt

SEQ ID NO: 5513264 - DNA, 16 bp, Homo sapiens
tattacaaaaacaaaa

SEQ ID NO: 5513265 - DNA, 21 bp, Homo sapiens
tattacaaatattgtcatctt

SEQ ID NO: 5513266 - DNA, 16 bp, Homo sapiens
tattacaaatgcaaat

SEQ ID NO: 5513267 - DNA, 19 bp, Homo sapiens
tattacaaattttcactgc

SEQ ID NO: 5513268 - DNA, 16 bp, Homo sapiens
tattacaagaaaacta

SEQ ID NO: 5513269 - DNA, 15 bp, Homo sapiens
tattacaagtggctc

SEQ ID NO: 5513270 - DNA, 21 bp, Homo sapiens
tattacaagtggctccccacc

SEQ ID NO: 5513271 - DNA, 20 bp, Homo sapiens
tattacaataccgttaagat

SEQ ID NO: 5513272 - DNA, 13 bp, Homo sapiens
tattacaatattt

SEQ ID NO: 5513273 - DNA, 15 bp, Homo sapiens
tattacaatatttgt

SEQ ID NO: 5513274 - DNA, 19 bp, Homo sapiens
tattacaatatttgtgtgc

SEQ ID NO: 5513275 - DNA, 19 bp, Homo sapiens
tattacaatggccagccca

SEQ ID NO: 5513276 - DNA, 12 bp, Homo sapiens
tattcagaaata

SEQ ID NO: 5513277 - DNA, 20 bp, Homo sapiens
tattcagaaattaaaatatt

SEQ ID NO: 5513278 - DNA, 20 bp, Homo sapiens
tattcagaactatttaaaat

SEQ ID NO: 5513279 - DNA, 20 bp, Homo sapiens
tattcagaatcaaacctttt

SEQ ID NO: 5513280 - DNA, 21 bp, Homo sapiens
tattcagaatcaaaccttttt

SEQ ID NO: 5513281 - DNA, 21 bp, Homo sapiens
tattcagacaaaatggataca

SEQ ID NO: 5513282 - DNA, 14 bp, Homo sapiens
tattcagagaaaac

SEQ ID NO: 5513283 - DNA, 21 bp, Homo sapiens
tattcagagttagatattatt

SEQ ID NO: 5513284 - DNA, 14 bp, Homo sapiens
tattcagataatta

SEQ ID NO: 5513285 - DNA, 19 bp, Homo sapiens
tattcagcaccaagcatgt

SEQ ID NO: 5513286 - DNA, 23 bp, Homo sapiens
tattcagcaccaagcatgtccca

SEQ ID NO: 5513287 - DNA, 22 bp, Homo sapiens
tattcagcatttgatttccatg

SEQ ID NO: 5513288 - DNA, 16 bp, Homo sapiens
tattcagccagcttaa

SEQ ID NO: 5513289 - DNA, 14 bp, Homo sapiens
tattcagctagaat

SEQ ID NO: 5513290 - DNA, 19 bp, Homo sapiens
tattcagctagaatttctg

SEQ ID NO: 5513291 - DNA, 16 bp, Homo sapiens
tattcagcttcatttg

SEQ ID NO: 5513292 - DNA, 17 bp, Homo sapiens
tattcaggaaaagcctc

SEQ ID NO: 5513293 - DNA, 17 bp, Homo sapiens
tattcaggaaatgttca

SEQ ID NO: 5513294 - DNA, 21 bp, Homo sapiens
tattcaggaccccatctgctg

SEQ ID NO: 5513295 - DNA, 20 bp, Homo sapiens
tattcagggaaggaggagcc

SEQ ID NO: 5513296 - DNA, 16 bp, Homo sapiens
tattcaggtggccaga

SEQ ID NO: 5513297 - DNA, 14 bp, Homo sapiens
tattcagtaaaaaa

SEQ ID NO: 5513298 - DNA, 13 bp, Homo sapiens
tattcagtaaaca

SEQ ID NO: 5513299 - DNA, 12 bp, Homo sapiens
tattcagtaact

SEQ ID NO: 5513300 - DNA, 20 bp, Homo sapiens
tattcagtaataactctacc

SEQ ID NO: 5513301 - DNA, 12 bp, Homo sapiens
tattcagtcctg

SEQ ID NO: 5513302 - DNA, 16 bp, Homo sapiens
tattcagtgacttctg

SEQ ID NO: 5513303 - DNA, 15 bp, Homo sapiens
tattcagtgtcactg

SEQ ID NO: 5513304 - DNA, 17 bp, Homo sapiens
tattcagttaagaaaaa

SEQ ID NO: 5513305 - DNA, 17 bp, Homo sapiens
tattcagttccaatact

SEQ ID NO: 5513306 - DNA, 20 bp, Homo sapiens
tattcagttccaatacttca

SEQ ID NO: 5513307 - DNA, 14 bp, Homo sapiens
tattcagttcccag

SEQ ID NO: 5513308 - DNA, 15 bp, Homo sapiens
tattcagttcttaca

SEQ ID NO: 5513309 - DNA, 23 bp, Homo sapiens
tattcagttcttacacattccat

SEQ ID NO: 5513310 - DNA, 23 bp, Homo sapiens
tattcataaagagaaaatgatga

SEQ ID NO: 5513311 - DNA, 16 bp, Homo sapiens
tattcataataaacta

SEQ ID NO: 5513312 - DNA, 19 bp, Homo sapiens
tattcataataaactagat

SEQ ID NO: 5513313 - DNA, 16 bp, Homo sapiens
tattcataatgaatta

SEQ ID NO: 5513314 - DNA, 20 bp, Homo sapiens
tattcataatgaattataac

SEQ ID NO: 5513315 - DNA, 21 bp, Homo sapiens
tattcataatgaattataaca

SEQ ID NO: 5513316 - DNA, 13 bp, Homo sapiens
tattcatacaaat

SEQ ID NO: 5513317 - DNA, 15 bp, Homo sapiens
tattcatacaacaaa

SEQ ID NO: 5513318 - DNA, 20 bp, Homo sapiens
tattcatacaacaaagagga

SEQ ID NO: 5513319 - DNA, 14 bp, Homo sapiens
tattcatacagcac

SEQ ID NO: 5513320 - DNA, 16 bp, Homo sapiens
tattcatactttccaa

SEQ ID NO: 5513321 - DNA, 22 bp, Homo sapiens
tattcatagtatactgatttaa

SEQ ID NO: 5513322 - DNA, 16 bp, Homo sapiens
tattcatagtttaatt

SEQ ID NO: 5513323 - DNA, 23 bp, Homo sapiens
tattcatatacaaacatgtatgt

SEQ ID NO: 5513324 - DNA, 21 bp, Homo sapiens
tattcatatattatcaaaatt

SEQ ID NO: 5513325 - DNA, 14 bp, Homo sapiens
tattcatatattgc

SEQ ID NO: 5513326 - DNA, 16 bp, Homo sapiens
tattcatatgcatatt

SEQ ID NO: 5513327 - DNA, 11 bp, Homo sapiens
tattcatatta

SEQ ID NO: 5513328 - DNA, 15 bp, Homo sapiens
tattcatatttgtac

SEQ ID NO: 5513329 - DNA, 17 bp, Homo sapiens
tattcatatttgtactt

SEQ ID NO: 5513330 - DNA, 21 bp, Homo sapiens
tattcatattttctttcaaaa

SEQ ID NO: 5513331 - DNA, 23 bp, Homo sapiens
tattcatcaatgaagattaacac

SEQ ID NO: 5513332 - DNA, 16 bp, Homo sapiens
tattcatcagaatgtt

SEQ ID NO: 5513333 - DNA, 17 bp, Homo sapiens
tattcatccaagttaaa

SEQ ID NO: 5513334 - DNA, 14 bp, Homo sapiens
tattcatccagcag

SEQ ID NO: 5513335 - DNA, 15 bp, Homo sapiens
tattcatccagcagt

SEQ ID NO: 5513336 - DNA, 16 bp, Homo sapiens
tattcatccagcagtg

SEQ ID NO: 5513337 - DNA, 17 bp, Homo sapiens
tattcatccagcagtgt

SEQ ID NO: 5513338 - DNA, 14 bp, Homo sapiens
tattcatctgcaat

SEQ ID NO: 5513339 - DNA, 15 bp, Homo sapiens
tattcatgaaatgtg

SEQ ID NO: 5513340 - DNA, 18 bp, Homo sapiens
tattcatgccatctgttt

SEQ ID NO: 5513341 - DNA, 15 bp, Homo sapiens
tattcatgctgcctg

SEQ ID NO: 5513342 - DNA, 16 bp, Homo sapiens
tattcatgctgcctgc

SEQ ID NO: 5513343 - DNA, 20 bp, Homo sapiens
tattcatgctgcctgccatg

SEQ ID NO: 5513344 - DNA, 16 bp, Homo sapiens
tattcatgctttctcc

SEQ ID NO: 5513345 - DNA, 19 bp, Homo sapiens
tattcatgctttctccttt

SEQ ID NO: 5513346 - DNA, 12 bp, Homo sapiens
tattcatggcta

SEQ ID NO: 5513347 - DNA, 13 bp, Homo sapiens
tattcatgtaaac

SEQ ID NO: 5513348 - DNA, 13 bp, Homo sapiens
tattcatgtaata

SEQ ID NO: 5513349 - DNA, 19 bp, Homo sapiens
tattcatgtaataaatctg

SEQ ID NO: 5513350 - DNA, 22 bp, Homo sapiens
tattcatgtgtacagaaacaac

SEQ ID NO: 5513351 - DNA, 20 bp, Homo sapiens
tattcattaagtaatctttt

SEQ ID NO: 5513352 - DNA, 21 bp, Homo sapiens
tattcattaagtaatcttttt

SEQ ID NO: 5513353 - DNA, 23 bp, Homo sapiens
tattcattatttgtcaaattgtc

SEQ ID NO: 5513354 - DNA, 20 bp, Homo sapiens
tattcattcagtgagacaca

SEQ ID NO: 5513355 - DNA, 15 bp, Homo sapiens
tattcattcattttg

SEQ ID NO: 5513356 - DNA, 15 bp, Homo sapiens
tattcattcctcaca

SEQ ID NO: 5513357 - DNA, 19 bp, Homo sapiens
tattcattctgcattgcta

SEQ ID NO: 5513358 - DNA, 23 bp, Homo sapiens
tattcattctttttgaaatgtca

SEQ ID NO: 5513359 - DNA, 20 bp, Homo sapiens
tattcattgaagtcagatgt

SEQ ID NO: 5513360 - DNA, 22 bp, Homo sapiens
tattcattggcagctcaaagac

SEQ ID NO: 5513361 - DNA, 18 bp, Homo sapiens
tattcattgtggtcatag

SEQ ID NO: 5513362 - DNA, 15 bp, Homo sapiens
tattcatttaaaatg

SEQ ID NO: 5513363 - DNA, 16 bp, Homo sapiens
tattcatttaaaatga

SEQ ID NO: 5513364 - DNA, 14 bp, Homo sapiens
tattcattttctct

SEQ ID NO: 5513365 - DNA, 17 bp, Homo sapiens
tattccaagacatgtct

SEQ ID NO: 5513366 - DNA, 19 bp, Homo sapiens
tattccaagacatgtctgt

SEQ ID NO: 5513367 - DNA, 18 bp, Homo sapiens
tattccacagatatcttt

SEQ ID NO: 5513368 - DNA, 13 bp, Homo sapiens
tattccacatcta

SEQ ID NO: 5513369 - DNA, 21 bp, Homo sapiens
tattccactatttgcagaggc

SEQ ID NO: 5513370 - DNA, 13 bp, Homo sapiens
tattccagaagaa

SEQ ID NO: 5513371 - DNA, 21 bp, Homo sapiens
tattccagaatgctgtacatc

SEQ ID NO: 5513372 - DNA, 12 bp, Homo sapiens
tattccagagct

SEQ ID NO: 5513373 - DNA, 17 bp, Homo sapiens
tattccagagctgccag

SEQ ID NO: 5513374 - DNA, 22 bp, Homo sapiens
tattccagatctttcagaaata

SEQ ID NO: 5513375 - DNA, 17 bp, Homo sapiens
tattccagcgtcttcta

SEQ ID NO: 5513376 - DNA, 22 bp, Homo sapiens
tattccagctgtccccccactc

SEQ ID NO: 5513377 - DNA, 16 bp, Homo sapiens
tattccatagtatatt

SEQ ID NO: 5513378 - DNA, 23 bp, Homo sapiens
tattccatagtatattaaaaatg

SEQ ID NO: 5513379 - DNA, 20 bp, Homo sapiens
tattccatattagaaaactt

SEQ ID NO: 5513380 - DNA, 11 bp, Homo sapiens
tattccatcaa

SEQ ID NO: 5513381 - DNA, 19 bp, Homo sapiens
tattccatcaataaatgct

SEQ ID NO: 5513382 - DNA, 12 bp, Homo sapiens
tattccatcagg

SEQ ID NO: 5513383 - DNA, 17 bp, Homo sapiens
tattccatcttctccat

SEQ ID NO: 5513384 - DNA, 15 bp, Homo sapiens
tattccatgactgct

SEQ ID NO: 5513385 - DNA, 18 bp, Homo sapiens
tattccatgttttaaaat

SEQ ID NO: 5513386 - DNA, 19 bp, Homo sapiens
tattccatgttttaaaatt

SEQ ID NO: 5513387 - DNA, 23 bp, Homo sapiens
tattccatgttttaaaattatat

SEQ ID NO: 5513388 - DNA, 20 bp, Homo sapiens
tattcccaagcccatgagtc

SEQ ID NO: 5513389 - DNA, 18 bp, Homo sapiens
tattcccaagtatgcctt

SEQ ID NO: 5513390 - DNA, 16 bp, Homo sapiens
tattcccactcaccag

SEQ ID NO: 5513391 - DNA, 20 bp, Homo sapiens
tattcccactcaccagccct

SEQ ID NO: 5513392 - DNA, 23 bp, Homo sapiens
tattcccatggtagactgtgaca

SEQ ID NO: 5513393 - DNA, 16 bp, Homo sapiens
tattccccagtgactc

SEQ ID NO: 5513394 - DNA, 18 bp, Homo sapiens
tattccccagtgactcca

SEQ ID NO: 5513395 - DNA, 20 bp, Homo sapiens
tattccccagtgactccagg

SEQ ID NO: 5513396 - DNA, 21 bp, Homo sapiens
tattccccagtgactccaggg

SEQ ID NO: 5513397 - DNA, 17 bp, Homo sapiens
tattccccattcttcct

SEQ ID NO: 5513398 - DNA, 16 bp, Homo sapiens
tattcccccctaagct

SEQ ID NO: 5513399 - DNA, 22 bp, Homo sapiens
tattcccctatctctagaattt

SEQ ID NO: 5513400 - DNA, 16 bp, Homo sapiens
tattccctgaattgtt

SEQ ID NO: 5513401 - DNA, 21 bp, Homo sapiens
tattccctgcacacacatgca

SEQ ID NO: 5513402 - DNA, 21 bp, Homo sapiens
tattccctggaattcaccctc

SEQ ID NO: 5513403 - DNA, 23 bp, Homo sapiens
tattcccttaactctaaccctgt

SEQ ID NO: 5513404 - DNA, 11 bp, Homo sapiens
tattccctttg

SEQ ID NO: 5513405 - DNA, 19 bp, Homo sapiens
tattcccttttatttccaa

SEQ ID NO: 5513406 - DNA, 14 bp, Homo sapiens
tattcctacttgca

SEQ ID NO: 5513407 - DNA, 21 bp, Homo sapiens
tattcctagtggatgactgtt

SEQ ID NO: 5513408 - DNA, 21 bp, Homo sapiens
tattcctatatagtttattga

SEQ ID NO: 5513409 - DNA, 22 bp, Homo sapiens
tattcctatatagtttattgac

SEQ ID NO: 5513410 - DNA, 18 bp, Homo sapiens
tattcctcagattgctga

SEQ ID NO: 5513411 - DNA, 19 bp, Homo sapiens
tattcctcagattgctgaa

SEQ ID NO: 5513412 - DNA, 15 bp, Homo sapiens
tattcctccagctgg

SEQ ID NO: 5513413 - DNA, 13 bp, Homo sapiens
tattcctcctggg

SEQ ID NO: 5513414 - DNA, 15 bp, Homo sapiens
tattcctctaggcaa

SEQ ID NO: 5513415 - DNA, 21 bp, Homo sapiens
tattcctctaggcaagcagga

SEQ ID NO: 5513416 - DNA, 14 bp, Homo sapiens
tattcctctgtcct

SEQ ID NO: 5513417 - DNA, 14 bp, Homo sapiens
tattcctgaatgaa

SEQ ID NO: 5513418 - DNA, 16 bp, Homo sapiens
tattcctgaccctccc

SEQ ID NO: 5513419 - DNA, 15 bp, Homo sapiens
tattcctgcctttga

SEQ ID NO: 5513420 - DNA, 14 bp, Homo sapiens
tattcctgtatgtt

SEQ ID NO: 5513421 - DNA, 16 bp, Homo sapiens
tattcctgttgctgtc

SEQ ID NO: 5513422 - DNA, 19 bp, Homo sapiens
tattccttctggcctttcc

SEQ ID NO: 5513423 - DNA, 18 bp, Homo sapiens
tattccttggcccagcag

SEQ ID NO: 5513424 - DNA, 16 bp, Homo sapiens
tattcctttaaaatat

SEQ ID NO: 5513425 - DNA, 17 bp, Homo sapiens
tattcctttcccttcct

SEQ ID NO: 5513426 - DNA, 13 bp, Homo sapiens
tattccttttaaa

SEQ ID NO: 5513427 - DNA, 17 bp, Homo sapiens
tattccttttaaagaag

SEQ ID NO: 5513428 - DNA, 20 bp, Homo sapiens
tattccttttaaagaagctt

SEQ ID NO: 5513429 - DNA, 21 bp, Homo sapiens
tattccttttaaagaagcttt

SEQ ID NO: 5513430 - DNA, 14 bp, Homo sapiens
tattccttttcata

SEQ ID NO: 5513431 - DNA, 20 bp, Homo sapiens
tattccttttgtgtacagtg

SEQ ID NO: 5513432 - DNA, 21 bp, Homo sapiens
tattccttttgtgtacagtgt

SEQ ID NO: 5513433 - DNA, 17 bp, Homo sapiens
tattcgaaacctgtgat

SEQ ID NO: 5513434 - DNA, 17 bp, Homo sapiens
tattcgaaatgagctca

SEQ ID NO: 5513435 - DNA, 22 bp, Homo sapiens
tattcgatactgcgactttctg

SEQ ID NO: 5513436 - DNA, 13 bp, Homo sapiens
tattcgccatctg

SEQ ID NO: 5513437 - DNA, 14 bp, Homo sapiens
tattcgccatctga

SEQ ID NO: 5513438 - DNA, 13 bp, Homo sapiens
tattcgcccaccc

SEQ ID NO: 5513439 - DNA, 14 bp, Homo sapiens
tattcgcccacccg

SEQ ID NO: 5513440 - DNA, 14 bp, Homo sapiens
tattcgcttgagaa

SEQ ID NO: 5513441 - DNA, 22 bp, Homo sapiens
tattcgcttgagaaaaaaagaa

SEQ ID NO: 5513442 - DNA, 20 bp, Homo sapiens
tattctaaaaaaataaacaa

SEQ ID NO: 5513443 - DNA, 14 bp, Homo sapiens
tattctaaaaaaga

SEQ ID NO: 5513444 - DNA, 15 bp, Homo sapiens
tattctaaaaaagat

SEQ ID NO: 5513445 - DNA, 18 bp, Homo sapiens
tattctaaaaaagatact

SEQ ID NO: 5513446 - DNA, 21 bp, Homo sapiens
tattctaaagagctacttcta

SEQ ID NO: 5513447 - DNA, 14 bp, Homo sapiens
tattctaaatttta

SEQ ID NO: 5513448 - DNA, 14 bp, Homo sapiens
tattctaacatttg

SEQ ID NO: 5513449 - DNA, 16 bp, Homo sapiens
tattctaacatttgat

SEQ ID NO: 5513450 - DNA, 14 bp, Homo sapiens
tattctaacttatt

SEQ ID NO: 5513451 - DNA, 12 bp, Homo sapiens
tattctaagact

SEQ ID NO: 5513452 - DNA, 22 bp, Homo sapiens
tattctaagacttactctaaga

SEQ ID NO: 5513453 - DNA, 16 bp, Homo sapiens
tattctaaggagcaaa

SEQ ID NO: 5513454 - DNA, 23 bp, Homo sapiens
tattgggatgtgagccccagggg

SEQ ID NO: 5513455 - DNA, 14 bp, Homo sapiens
tattgggcaataaa

SEQ ID NO: 5513456 - DNA, 14 bp, Homo sapiens
tattgggcaggagg

SEQ ID NO: 5513457 - DNA, 13 bp, Homo sapiens
tattgggcttaat

SEQ ID NO: 5513458 - DNA, 19 bp, Homo sapiens
tattggggaattaaatagt

SEQ ID NO: 5513459 - DNA, 21 bp, Homo sapiens
tattggggaattaaatagtgt

SEQ ID NO: 5513460 - DNA, 20 bp, Homo sapiens
tattggggtcttttggctct

SEQ ID NO: 5513461 - DNA, 21 bp, Homo sapiens
tattggggttgagagggaaaa

SEQ ID NO: 5513462 - DNA, 21 bp, Homo sapiens
tattggggttggttggggtgg

SEQ ID NO: 5513463 - DNA, 23 bp, Homo sapiens
tattgggtagatattttttctga

SEQ ID NO: 5513464 - DNA, 14 bp, Homo sapiens
tattgggttcatta

SEQ ID NO: 5513465 - DNA, 20 bp, Homo sapiens
tattgggttcattattggaa

SEQ ID NO: 5513466 - DNA, 15 bp, Homo sapiens
tattgggtttggtca

SEQ ID NO: 5513467 - DNA, 22 bp, Homo sapiens
tattggtaacatcctttctatt

SEQ ID NO: 5513468 - DNA, 13 bp, Homo sapiens
tattggtattaaa

SEQ ID NO: 5513469 - DNA, 14 bp, Homo sapiens
tattggtattaaag

SEQ ID NO: 5513470 - DNA, 20 bp, Homo sapiens
tattggtcttgccctattat

SEQ ID NO: 5513471 - DNA, 20 bp, Homo sapiens
tattggtgcttgactctcac

SEQ ID NO: 5513472 - DNA, 14 bp, Homo sapiens
tattggtgctttgt

SEQ ID NO: 5513473 - DNA, 18 bp, Homo sapiens
tattggtgctttgtgtct

SEQ ID NO: 5513474 - DNA, 16 bp, Homo sapiens
tattggtggctttcct

SEQ ID NO: 5513475 - DNA, 18 bp, Homo sapiens
tattggtggctttccttg

SEQ ID NO: 5513476 - DNA, 13 bp, Homo sapiens
tattggttctatt

SEQ ID NO: 5513477 - DNA, 20 bp, Homo sapiens
tattggtttaaagaaagtgt

SEQ ID NO: 5513478 - DNA, 14 bp, Homo sapiens
tattggtttgcaca

SEQ ID NO: 5513479 - DNA, 15 bp, Homo sapiens
tattggtttgcacaa

SEQ ID NO: 5513480 - DNA, 17 bp, Homo sapiens
tattggttttaaaaaag

SEQ ID NO: 5513481 - DNA, 15 bp, Homo sapiens
tattgtaaaaaattc

SEQ ID NO: 5513482 - DNA, 16 bp, Homo sapiens
tattgtaaaaaattca

SEQ ID NO: 5513483 - DNA, 18 bp, Homo sapiens
tattgtaaaacattcaca

SEQ ID NO: 5513484 - DNA, 18 bp, Homo sapiens
tattgtaaacagaaggag

SEQ ID NO: 5513485 - DNA, 15 bp, Homo sapiens
tattgtaaacatgtg

SEQ ID NO: 5513486 - DNA, 17 bp, Homo sapiens
tattgtaaacatgtgtt

SEQ ID NO: 5513487 - DNA, 21 bp, Homo sapiens
tattgtaaactttttcaatgg

SEQ ID NO: 5513488 - DNA, 14 bp, Homo sapiens
tattgtaaatactg

SEQ ID NO: 5513489 - DNA, 18 bp, Homo sapiens
tattgtaaatactggact

SEQ ID NO: 5513490 - DNA, 15 bp, Homo sapiens
tattgtaaatatgtt

SEQ ID NO: 5513491 - DNA, 15 bp, Homo sapiens
tattgtaaatattgt

SEQ ID NO: 5513492 - DNA, 18 bp, Homo sapiens
tattgtaaatgtggattt

SEQ ID NO: 5513493 - DNA, 16 bp, Homo sapiens
tattgtaacagacatt

SEQ ID NO: 5513494 - DNA, 17 bp, Homo sapiens
tattgtaacagacattg

SEQ ID NO: 5513495 - DNA, 12 bp, Homo sapiens
tattgtaagata

SEQ ID NO: 5513496 - DNA, 14 bp, Homo sapiens
tattgtaaggtctt

SEQ ID NO: 5513497 - DNA, 18 bp, Homo sapiens
tattgtaaggtctttgta

SEQ ID NO: 5513498 - DNA, 16 bp, Homo sapiens
tattgtaagttgtaca

SEQ ID NO: 5513499 - DNA, 18 bp, Homo sapiens
tattgtaagttgtacaaa

SEQ ID NO: 5513500 - DNA, 18 bp, Homo sapiens
tattgtaatcgtgtgcca

SEQ ID NO: 5513501 - DNA, 14 bp, Homo sapiens
tattgtaatgaata

SEQ ID NO: 5513502 - DNA, 18 bp, Homo sapiens
tattgtaatgagtgaatt

SEQ ID NO: 5513503 - DNA, 13 bp, Homo sapiens
tattgtaatgtaa

SEQ ID NO: 5513504 - DNA, 17 bp, Homo sapiens
tattgtacagactgttt

SEQ ID NO: 5513505 - DNA, 11 bp, Homo sapiens
tattgtacagt

SEQ ID NO: 5513506 - DNA, 15 bp, Homo sapiens
tattgtacagttttt

SEQ ID NO: 5513507 - DNA, 22 bp, Homo sapiens
tattgtacataaaagaattttt

SEQ ID NO: 5513508 - DNA, 17 bp, Homo sapiens
tattgtaccaaagctgt

SEQ ID NO: 5513509 - DNA, 16 bp, Homo sapiens
tattgtacgtttaaag

SEQ ID NO: 5513510 - DNA, 17 bp, Homo sapiens
tattgtagcatcctgga

SEQ ID NO: 5513511 - DNA, 20 bp, Homo sapiens
tattgtagcatcctggaata

SEQ ID NO: 5513512 - DNA, 15 bp, Homo sapiens
tattgtagcatttct

SEQ ID NO: 5513513 - DNA, 16 bp, Homo sapiens
tattgtagcatttctt

SEQ ID NO: 5513514 - DNA, 17 bp, Homo sapiens
tattgtagcatttcttg

SEQ ID NO: 5513515 - DNA, 22 bp, Homo sapiens
tattgtagtaaactattcttaa

SEQ ID NO: 5513516 - DNA, 14 bp, Homo sapiens
tattgtagtttgaa

SEQ ID NO: 5513517 - DNA, 13 bp, Homo sapiens
tattgtataaaaa

SEQ ID NO: 5513518 - DNA, 16 bp, Homo sapiens
tattgtataaactatc

SEQ ID NO: 5513519 - DNA, 16 bp, Homo sapiens
tattgtatattacaat

SEQ ID NO: 5513520 - DNA, 17 bp, Homo sapiens
tattgtatattacaatg

SEQ ID NO: 5513521 - DNA, 17 bp, Homo sapiens
tattgtatattctggaa

SEQ ID NO: 5513522 - DNA, 18 bp, Homo sapiens
tattgtatattctggaaa

SEQ ID NO: 5513523 - DNA, 19 bp, Homo sapiens
tattgtatattctggaaaa

SEQ ID NO: 5513524 - DNA, 20 bp, Homo sapiens
tattgtatattctggaaaaa

SEQ ID NO: 5513525 - DNA, 15 bp, Homo sapiens
tattgtatgtaagta

SEQ ID NO: 5513526 - DNA, 14 bp, Homo sapiens
tattgtatgtacct

SEQ ID NO: 5513527 - DNA, 18 bp, Homo sapiens
tattgtattatcatatat

SEQ ID NO: 5513528 - DNA, 22 bp, Homo sapiens
tattgtattatcatatatgctt

SEQ ID NO: 5513529 - DNA, 13 bp, Homo sapiens
tattgtattctgg

SEQ ID NO: 5513530 - DNA, 18 bp, Homo sapiens
tattgtattgttagatgt

SEQ ID NO: 5513531 - DNA, 16 bp, Homo sapiens
tattgtatttattcaa

SEQ ID NO: 5513532 - DNA, 17 bp, Homo sapiens
tattgtatttattcaat

SEQ ID NO: 5513533 - DNA, 15 bp, Homo sapiens
tattgtatttattcc

SEQ ID NO: 5513534 - DNA, 19 bp, Homo sapiens
tattgtatttgagaaaata

SEQ ID NO: 5513535 - DNA, 12 bp, Homo sapiens
tattgtattttg

SEQ ID NO: 5513536 - DNA, 13 bp, Homo sapiens
tattgtattttga

SEQ ID NO: 5513537 - DNA, 22 bp, Homo sapiens
tattgtcaacactatataaata

SEQ ID NO: 5513538 - DNA, 19 bp, Homo sapiens
tattgtcagaaaagtgatt

SEQ ID NO: 5513539 - DNA, 11 bp, Homo sapiens
tattgtcatct

SEQ ID NO: 5513540 - DNA, 17 bp, Homo sapiens
tattgtcattaaaggta

SEQ ID NO: 5513541 - DNA, 14 bp, Homo sapiens
tattgtccaccatg

SEQ ID NO: 5513542 - DNA, 17 bp, Homo sapiens
tattgtccattgtccaa

SEQ ID NO: 5513543 - DNA, 11 bp, Homo sapiens
tattgtcccac

SEQ ID NO: 5513544 - DNA, 19 bp, Homo sapiens
tattgtcctcaccttcaaa

SEQ ID NO: 5513545 - DNA, 19 bp, Homo sapiens
tattgtcgctatgtgactt

SEQ ID NO: 5513546 - DNA, 19 bp, Homo sapiens
tattgtctactctgaagac

SEQ ID NO: 5513547 - DNA, 14 bp, Homo sapiens
tattgtctagtaat

SEQ ID NO: 5513548 - DNA, 17 bp, Homo sapiens
tattgtctagtgaaact

SEQ ID NO: 5513549 - DNA, 23 bp, Homo sapiens
tattgtctgaacttgcattgtga

SEQ ID NO: 5513550 - DNA, 14 bp, Homo sapiens
tattgtctgtaaat

SEQ ID NO: 5513551 - DNA, 19 bp, Homo sapiens
tattgtctgtctacatttc

SEQ ID NO: 5513552 - DNA, 20 bp, Homo sapiens
tattgtctgtctacatttct

SEQ ID NO: 5513553 - DNA, 18 bp, Homo sapiens
tattgtctgttttccttc

SEQ ID NO: 5513554 - DNA, 23 bp, Homo sapiens
tattgtcttaaataaatcaagaa

SEQ ID NO: 5513555 - DNA, 17 bp, Homo sapiens
tattgtgaaatttgtta

SEQ ID NO: 5513556 - DNA, 14 bp, Homo sapiens
tattgtgaacattt

SEQ ID NO: 5513557 - DNA, 15 bp, Homo sapiens
tattgtgaagtacat

SEQ ID NO: 5513558 - DNA, 19 bp, Homo sapiens
tattgtgaagtacatatta

SEQ ID NO: 5513559 - DNA, 13 bp, Homo sapiens
tattgtgaatatt

SEQ ID NO: 5513560 - DNA, 13 bp, Homo sapiens
tattgtgaatgat

SEQ ID NO: 5513561 - DNA, 18 bp, Homo sapiens
tattgtgacttcactgta

SEQ ID NO: 5513562 - DNA, 21 bp, Homo sapiens
tattgtgatctatcaatagtc

SEQ ID NO: 5513563 - DNA, 18 bp, Homo sapiens
tattgtgatttgactgtt

SEQ ID NO: 5513564 - DNA, 20 bp, Homo sapiens
tattgtgatttgactgtttt

SEQ ID NO: 5513565 - DNA, 19 bp, Homo sapiens
tattgtgcaatgtaaatat

SEQ ID NO: 5513566 - DNA, 23 bp, Homo sapiens
tattgtgcaatgtgtataaacaa

SEQ ID NO: 5513567 - DNA, 22 bp, Homo sapiens
tattgtgcctatgataaattca

SEQ ID NO: 5513568 - DNA, 17 bp, Homo sapiens
tattgtgctcagagaca

SEQ ID NO: 5513569 - DNA, 14 bp, Homo sapiens
tattgtggctccct

SEQ ID NO: 5513570 - DNA, 22 bp, Homo sapiens
tattgtggtaggccttttaaca

SEQ ID NO: 5513571 - DNA, 13 bp, Homo sapiens
tattgtggtattg

SEQ ID NO: 5513572 - DNA, 18 bp, Homo sapiens
tattgtgtaattgattta

SEQ ID NO: 5513573 - DNA, 20 bp, Homo sapiens
tattgtgtaatttaagtgac

SEQ ID NO: 5513574 - DNA, 18 bp, Homo sapiens
tattgtgtaggaaatctg

SEQ ID NO: 5513575 - DNA, 18 bp, Homo sapiens
tattgtgtcttttgcatg

SEQ ID NO: 5513576 - DNA, 17 bp, Homo sapiens
tattgtgtgcgctgcct

SEQ ID NO: 5513577 - DNA, 18 bp, Homo sapiens
tattgtgtgcgctgcctg

SEQ ID NO: 5513578 - DNA, 19 bp, Homo sapiens
tattgtgtgcgctgcctgg

SEQ ID NO: 5513579 - DNA, 22 bp, Homo sapiens
tattgtgtggtctggttcctgt

SEQ ID NO: 5513580 - DNA, 21 bp, Homo sapiens
tattgtgtggtttcccctttc

SEQ ID NO: 5513581 - DNA, 17 bp, Homo sapiens
tattgtgttgactttat

SEQ ID NO: 5513582 - DNA, 21 bp, Homo sapiens
tattgtgttgccttagcactt

SEQ ID NO: 5513583 - DNA, 19 bp, Homo sapiens
tattgtgttggctttacaa

SEQ ID NO: 5513584 - DNA, 20 bp, Homo sapiens
tattgtgttggctttacaaa

SEQ ID NO: 5513585 - DNA, 17 bp, Homo sapiens
tattgtgtttgtcatta

SEQ ID NO: 5513586 - DNA, 15 bp, Homo sapiens
tattgtgttttaaca

SEQ ID NO: 5513587 - DNA, 22 bp, Homo sapiens
tattgtgttttgctttggaaac

SEQ ID NO: 5513588 - DNA, 20 bp, Homo sapiens
tattgttaaaaccttactta

SEQ ID NO: 5513589 - DNA, 16 bp, Homo sapiens
tattgttaaattacat

SEQ ID NO: 5513590 - DNA, 17 bp, Homo sapiens
tattgttaactcttgtc

SEQ ID NO: 5513591 - DNA, 21 bp, Homo sapiens
tattgttaactcttgtctatt

SEQ ID NO: 5513592 - DNA, 20 bp, Homo sapiens
tattgttaatattaatttat

SEQ ID NO: 5513593 - DNA, 22 bp, Homo sapiens
tattgttaattatgtacaacat

SEQ ID NO: 5513594 - DNA, 14 bp, Homo sapiens
tattgttagatgtt

SEQ ID NO: 5513595 - DNA, 21 bp, Homo sapiens
tattgttagggtcagccattt

SEQ ID NO: 5513596 - DNA, 16 bp, Homo sapiens
tattgttcaaacaata

SEQ ID NO: 5513597 - DNA, 21 bp, Homo sapiens
tattgttcacacaaagcctgt

SEQ ID NO: 5513598 - DNA, 17 bp, Homo sapiens
tattgttcagcatgcaa

SEQ ID NO: 5513599 - DNA, 18 bp, Homo sapiens
tattgttctaatgcaaca

SEQ ID NO: 5513600 - DNA, 16 bp, Homo sapiens
tattgttcttgtaaaa

SEQ ID NO: 5513601 - DNA, 20 bp, Homo sapiens
tattgttcttgtaaaactgt

SEQ ID NO: 5513602 - DNA, 21 bp, Homo sapiens
tattgttgaacatacttcaaa

SEQ ID NO: 5513603 - DNA, 17 bp, Homo sapiens
tattgttgaataaatgt

SEQ ID NO: 5513604 - DNA, 14 bp, Homo sapiens
tattgttgtataat

SEQ ID NO: 5513605 - DNA, 13 bp, Homo sapiens
tattgttgtcctt

SEQ ID NO: 5513606 - DNA, 22 bp, Homo sapiens
tattgttgtccttttcataggt

SEQ ID NO: 5513607 - DNA, 13 bp, Homo sapiens
tattgttgttact

SEQ ID NO: 5513608 - DNA, 15 bp, Homo sapiens
tattgtttaaaatca

SEQ ID NO: 5513609 - DNA, 17 bp, Homo sapiens
tattgtttaaaatgtaa

SEQ ID NO: 5513610 - DNA, 15 bp, Homo sapiens
tattgtttaaaattc

SEQ ID NO: 5513611 - DNA, 20 bp, Homo sapiens
tattgtttaaaattcagttt

SEQ ID NO: 5513612 - DNA, 15 bp, Homo sapiens
tattgtttaagcaga

SEQ ID NO: 5513613 - DNA, 13 bp, Homo sapiens
tattgtttacatt

SEQ ID NO: 5513614 - DNA, 16 bp, Homo sapiens
tattgtttataggaaa

SEQ ID NO: 5513615 - DNA, 12 bp, Homo sapiens
tattgtttcaat

SEQ ID NO: 5513616 - DNA, 16 bp, Homo sapiens
tattgtttcagtgttc

SEQ ID NO: 5513617 - DNA, 15 bp, Homo sapiens
tattgtttctacaat

SEQ ID NO: 5513618 - DNA, 13 bp, Homo sapiens
tattgtttctgca

SEQ ID NO: 5513619 - DNA, 15 bp, Homo sapiens
tattgtttctgcatt

SEQ ID NO: 5513620 - DNA, 15 bp, Homo sapiens
tattgtttgaaagac

SEQ ID NO: 5513621 - DNA, 14 bp, Homo sapiens
tattgtttgaaatg

SEQ ID NO: 5513622 - DNA, 19 bp, Homo sapiens
tattgttttactccttttt

SEQ ID NO: 5513623 - DNA, 15 bp, Homo sapiens
tattgttttataaat

SEQ ID NO: 5513624 - DNA, 20 bp, Homo sapiens
tattgttttcccaagtgtaa

SEQ ID NO: 5513625 - DNA, 22 bp, Homo sapiens
tattgttttctgtaaataacct

SEQ ID NO: 5513626 - DNA, 15 bp, Homo sapiens
tattgtttttatttc

SEQ ID NO: 5513627 - DNA, 22 bp, Homo sapiens
tatttaaaaaaaaacattcaaa

SEQ ID NO: 5513628 - DNA, 16 bp, Homo sapiens
tatttaaaaaaaaagt

SEQ ID NO: 5513629 - DNA, 13 bp, Homo sapiens
tatttaaaaaact

SEQ ID NO: 5513630 - DNA, 21 bp, Homo sapiens
tatttaaaaaattatggaata

SEQ ID NO: 5513631 - DNA, 19 bp, Homo sapiens
tatttaaaaacaaaaggca

SEQ ID NO: 5513632 - DNA, 15 bp, Homo sapiens
tatttaaaaacattt

SEQ ID NO: 5513633 - DNA, 19 bp, Homo sapiens
tcaaatgtcattatgtaga

SEQ ID NO: 5513634 - DNA, 20 bp, Homo sapiens
tcaaatgtcattatgtagaa

SEQ ID NO: 5513635 - DNA, 22 bp, Homo sapiens
tcaaatgtgcaatttgtaaata

SEQ ID NO: 5513636 - DNA, 14 bp, Homo sapiens
tcaaatgtgtaact

SEQ ID NO: 5513637 - DNA, 18 bp, Homo sapiens
tcaaatgtgtaactttat

SEQ ID NO: 5513638 - DNA, 18 bp, Homo sapiens
tcaaatgtgtcaaataca

SEQ ID NO: 5513639 - DNA, 23 bp, Homo sapiens
tcaaatgtgtctcacatctacac

SEQ ID NO: 5513640 - DNA, 22 bp, Homo sapiens
tcaaatgtgtgttcctgctttt

SEQ ID NO: 5513641 - DNA, 16 bp, Homo sapiens
tcaaatgtgttttggt

SEQ ID NO: 5513642 - DNA, 13 bp, Homo sapiens
tcaaatgttacaa

SEQ ID NO: 5513643 - DNA, 16 bp, Homo sapiens
tcaaatgttacaaaaa

SEQ ID NO: 5513644 - DNA, 13 bp, Homo sapiens
tcaaatgttctaa

SEQ ID NO: 5513645 - DNA, 15 bp, Homo sapiens
tcaaatgttctaagt

SEQ ID NO: 5513646 - DNA, 17 bp, Homo sapiens
tcaaatgtttaatcata

SEQ ID NO: 5513647 - DNA, 18 bp, Homo sapiens
tcaaatgtttaatcatat

SEQ ID NO: 5513648 - DNA, 21 bp, Homo sapiens
tcaaatgtttaatcatataaa

SEQ ID NO: 5513649 - DNA, 16 bp, Homo sapiens
tcaaatgtttccttaa

SEQ ID NO: 5513650 - DNA, 20 bp, Homo sapiens
tcaaatgtttccttaaacat

SEQ ID NO: 5513651 - DNA, 13 bp, Homo sapiens
tcaaatgttttct

SEQ ID NO: 5513652 - DNA, 22 bp, Homo sapiens
tcaaatgttttgcaaacatcac

SEQ ID NO: 5513653 - DNA, 15 bp, Homo sapiens
tcaaattaaagtgct

SEQ ID NO: 5513654 - DNA, 12 bp, Homo sapiens
tcaaattaaata

SEQ ID NO: 5513655 - DNA, 17 bp, Homo sapiens
tcaaattaataatctta

SEQ ID NO: 5513656 - DNA, 15 bp, Homo sapiens
tcaaattaatacaat

SEQ ID NO: 5513657 - DNA, 17 bp, Homo sapiens
tcaaattaatctttcta

SEQ ID NO: 5513658 - DNA, 18 bp, Homo sapiens
tcaaattaatctttctat

SEQ ID NO: 5513659 - DNA, 13 bp, Homo sapiens
tcaaattaattgt

SEQ ID NO: 5513660 - DNA, 17 bp, Homo sapiens
tcaaattactaatgatt

SEQ ID NO: 5513661 - DNA, 17 bp, Homo sapiens
tcaaattagaagacatt

SEQ ID NO: 5513662 - DNA, 22 bp, Homo sapiens
tcaaattagaagacatttatac

SEQ ID NO: 5513663 - DNA, 19 bp, Homo sapiens
tcaaattaggcaaatcttt

SEQ ID NO: 5513664 - DNA, 19 bp, Homo sapiens
tcaaattatttttaagttt

SEQ ID NO: 5513665 - DNA, 13 bp, Homo sapiens
tcaaattcaatga

SEQ ID NO: 5513666 - DNA, 15 bp, Homo sapiens
tcaaattcaatgatt

SEQ ID NO: 5513667 - DNA, 18 bp, Homo sapiens
tcaaattcaatgattctt

SEQ ID NO: 5513668 - DNA, 17 bp, Homo sapiens
tcaaattcaatgcttct

SEQ ID NO: 5513669 - DNA, 16 bp, Homo sapiens
tcaaattcagctctga

SEQ ID NO: 5513670 - DNA, 20 bp, Homo sapiens
tcaaattcatttttttcact

SEQ ID NO: 5513671 - DNA, 21 bp, Homo sapiens
tcaaattcctatttttaaata

SEQ ID NO: 5513672 - DNA, 21 bp, Homo sapiens
tcaaattctccctaaagtgtt

SEQ ID NO: 5513673 - DNA, 13 bp, Homo sapiens
tcaaattctctat

SEQ ID NO: 5513674 - DNA, 17 bp, Homo sapiens
tcaaattctgattatta

SEQ ID NO: 5513675 - DNA, 23 bp, Homo sapiens
tcaaattctgattattacaacaa

SEQ ID NO: 5513676 - DNA, 12 bp, Homo sapiens
tcaaattctgtc

SEQ ID NO: 5513677 - DNA, 18 bp, Homo sapiens
tcaaattctgtctgggga

SEQ ID NO: 5513678 - DNA, 14 bp, Homo sapiens
tcaaattcttctga

SEQ ID NO: 5513679 - DNA, 21 bp, Homo sapiens
tcaaattcttctgaactcaaa

SEQ ID NO: 5513680 - DNA, 22 bp, Homo sapiens
tcaaattctttttttattatta

SEQ ID NO: 5513681 - DNA, 15 bp, Homo sapiens
tcaaattgaaatgac

SEQ ID NO: 5513682 - DNA, 13 bp, Homo sapiens
tcaaattgaattt

SEQ ID NO: 5513683 - DNA, 12 bp, Homo sapiens
tcaaattgctgc

SEQ ID NO: 5513684 - DNA, 14 bp, Homo sapiens
tcaaattgctgctt

SEQ ID NO: 5513685 - DNA, 14 bp, Homo sapiens
tcaaattgcttaaa

SEQ ID NO: 5513686 - DNA, 16 bp, Homo sapiens
tcaaattgtaattaat

SEQ ID NO: 5513687 - DNA, 13 bp, Homo sapiens
tcaaattgtatct

SEQ ID NO: 5513688 - DNA, 21 bp, Homo sapiens
tcaaattgtcagcatgacaaa

SEQ ID NO: 5513689 - DNA, 14 bp, Homo sapiens
tcaaattgtgtgaa

SEQ ID NO: 5513690 - DNA, 18 bp, Homo sapiens
tcaaattgtgtgaaaggt

SEQ ID NO: 5513691 - DNA, 23 bp, Homo sapiens
tcaaatttactgtcttaaatcag

SEQ ID NO: 5513692 - DNA, 22 bp, Homo sapiens
tcaaatttactttaaaaagaaa

SEQ ID NO: 5513693 - DNA, 21 bp, Homo sapiens
tcaaatttattttaatgtaaa

SEQ ID NO: 5513694 - DNA, 12 bp, Homo sapiens
tcaaatttcaca

SEQ ID NO: 5513695 - DNA, 23 bp, Homo sapiens
tcaaatttgccatgacatttcat

SEQ ID NO: 5513696 - DNA, 21 bp, Homo sapiens
tcaaatttgtaataaaactat

SEQ ID NO: 5513697 - DNA, 23 bp, Homo sapiens
tcaaatttgtacaggactgtaaa

SEQ ID NO: 5513698 - DNA, 15 bp, Homo sapiens
tcaaatttgtgtcat

SEQ ID NO: 5513699 - DNA, 20 bp, Homo sapiens
tcaaattttgagcaaagaaa

SEQ ID NO: 5513700 - DNA, 16 bp, Homo sapiens
tcaaattttgcattgt

SEQ ID NO: 5513701 - DNA, 16 bp, Homo sapiens
tcaaatttttcatctc

SEQ ID NO: 5513702 - DNA, 22 bp, Homo sapiens
tcaaatttttcatctcttcaat

SEQ ID NO: 5513703 - DNA, 14 bp, Homo sapiens
tcaacaaaaagaca

SEQ ID NO: 5513704 - DNA, 21 bp, Homo sapiens
tcaacaaaaagacatggaagg

SEQ ID NO: 5513705 - DNA, 15 bp, Homo sapiens
tcaacaaaaattgtc

SEQ ID NO: 5513706 - DNA, 18 bp, Homo sapiens
tcaacaaactatttctta

SEQ ID NO: 5513707 - DNA, 13 bp, Homo sapiens
tcaacaaactgca

SEQ ID NO: 5513708 - DNA, 21 bp, Homo sapiens
tcaacaaagaaacaaagatgt

SEQ ID NO: 5513709 - DNA, 15 bp, Homo sapiens
tcaacaaagaaatat

SEQ ID NO: 5513710 - DNA, 16 bp, Homo sapiens
tcaacaaagaaatatt

SEQ ID NO: 5513711 - DNA, 15 bp, Homo sapiens
tcaacaaagcacagt

SEQ ID NO: 5513712 - DNA, 23 bp, Homo sapiens
tcaacaaagcacagtgttaaatg

SEQ ID NO: 5513713 - DNA, 22 bp, Homo sapiens
tcaacaaatattcactggcccc

SEQ ID NO: 5513714 - DNA, 17 bp, Homo sapiens
tcaacaaattaaataaa

SEQ ID NO: 5513715 - DNA, 20 bp, Homo sapiens
tcaacaaattaaataaatta

SEQ ID NO: 5513716 - DNA, 21 bp, Homo sapiens
tcaacaaatttcattgcactt

SEQ ID NO: 5513717 - DNA, 23 bp, Homo sapiens
tcaacaacaattttaaataagat

SEQ ID NO: 5513718 - DNA, 16 bp, Homo sapiens
tcaacaacatccactg

SEQ ID NO: 5513719 - DNA, 17 bp, Homo sapiens
tcaacaacatccactgt

SEQ ID NO: 5513720 - DNA, 17 bp, Homo sapiens
tcaacaacgtgagagaa

SEQ ID NO: 5513721 - DNA, 21 bp, Homo sapiens
tcaacaactttgtgctttcct

SEQ ID NO: 5513722 - DNA, 22 bp, Homo sapiens
tcaacaagatttccttgtgcaa

SEQ ID NO: 5513723 - DNA, 15 bp, Homo sapiens
tcaacaagcctgaaa

SEQ ID NO: 5513724 - DNA, 17 bp, Homo sapiens
tcaacaagcctgaaagt

SEQ ID NO: 5513725 - DNA, 22 bp, Homo sapiens
tcaacaaggatcaggctgctgg

SEQ ID NO: 5513726 - DNA, 21 bp, Homo sapiens
tcaacaaggcaaaaacaaaga

SEQ ID NO: 5513727 - DNA, 20 bp, Homo sapiens
tcaacaaggcttgctgcaga

SEQ ID NO: 5513728 - DNA, 16 bp, Homo sapiens
tcaacaagggagagac

SEQ ID NO: 5513729 - DNA, 17 bp, Homo sapiens
tcaacaagggagagacc

SEQ ID NO: 5513730 - DNA, 20 bp, Homo sapiens
tcaacaagggagagacctca

SEQ ID NO: 5513731 - DNA, 21 bp, Homo sapiens
tcaacaaggtatacctcagtt

SEQ ID NO: 5513732 - DNA, 22 bp, Homo sapiens
tcaacaatcagtcatcatgggt

SEQ ID NO: 5513733 - DNA, 11 bp, Homo sapiens
tcaacaattag

SEQ ID NO: 5513734 - DNA, 17 bp, Homo sapiens
tcaacaattctaaaatg

SEQ ID NO: 5513735 - DNA, 23 bp, Homo sapiens
tcaacaattggtgtcattttctt

SEQ ID NO: 5513736 - DNA, 22 bp, Homo sapiens
tcaacacaaagacacaggaaga

SEQ ID NO: 5513737 - DNA, 22 bp, Homo sapiens
tcaacacacaacagcagatggc

SEQ ID NO: 5513738 - DNA, 18 bp, Homo sapiens
tcaacaccaccgagctct

SEQ ID NO: 5513739 - DNA, 22 bp, Homo sapiens
tcaacaccaccgagctctgtgg

SEQ ID NO: 5513740 - DNA, 19 bp, Homo sapiens
tcaacaccctgcttctccc

SEQ ID NO: 5513741 - DNA, 21 bp, Homo sapiens
tcaacaccctgcttctcccgg

SEQ ID NO: 5513742 - DNA, 18 bp, Homo sapiens
tcaacactatatatttta

SEQ ID NO: 5513743 - DNA, 19 bp, Homo sapiens
tcaacacttattttctgaa

SEQ ID NO: 5513744 - DNA, 17 bp, Homo sapiens
tcaacacttttctccag

SEQ ID NO: 5513745 - DNA, 20 bp, Homo sapiens
tcaacagaacatatgttgca

SEQ ID NO: 5513746 - DNA, 18 bp, Homo sapiens
tcaacagaagcatttgta

SEQ ID NO: 5513747 - DNA, 22 bp, Homo sapiens
tcaacagaagcatttgtatttt

SEQ ID NO: 5513748 - DNA, 16 bp, Homo sapiens
tcaacagaattgttct

SEQ ID NO: 5513749 - DNA, 14 bp, Homo sapiens
tcaacagacaatta

SEQ ID NO: 5513750 - DNA, 22 bp, Homo sapiens
tcaacagagaaggcaggaatgt

SEQ ID NO: 5513751 - DNA, 21 bp, Homo sapiens
tcaacagagagggagaaagga

SEQ ID NO: 5513752 - DNA, 17 bp, Homo sapiens
tcaacagagaggggcag

SEQ ID NO: 5513753 - DNA, 23 bp, Homo sapiens
tcaacagatgaccgtgtacaata

SEQ ID NO: 5513754 - DNA, 19 bp, Homo sapiens
tcaacagatgatagtccaa

SEQ ID NO: 5513755 - DNA, 21 bp, Homo sapiens
tcaacagattcagaatgagaa

SEQ ID NO: 5513756 - DNA, 15 bp, Homo sapiens
tcaacagatttaaag

SEQ ID NO: 5513757 - DNA, 19 bp, Homo sapiens
tcaacagcaggaggcacag

SEQ ID NO: 5513758 - DNA, 19 bp, Homo sapiens
tcaacagcagggtgggctt

SEQ ID NO: 5513759 - DNA, 17 bp, Homo sapiens
tcaacagccaagtgtga

SEQ ID NO: 5513760 - DNA, 22 bp, Homo sapiens
tcaacagcgttcctagagaaga

SEQ ID NO: 5513761 - DNA, 16 bp, Homo sapiens
tcaacagctatgctgg

SEQ ID NO: 5513762 - DNA, 18 bp, Homo sapiens
tcaacagctatgctggta

SEQ ID NO: 5513763 - DNA, 15 bp, Homo sapiens
tcaacagctgatgcc

SEQ ID NO: 5513764 - DNA, 12 bp, Homo sapiens
tcaacaggccca

SEQ ID NO: 5513765 - DNA, 17 bp, Homo sapiens
tcaacaggcccagggag

SEQ ID NO: 5513766 - DNA, 21 bp, Homo sapiens
tcaacaggcctcagggctcct

SEQ ID NO: 5513767 - DNA, 23 bp, Homo sapiens
tcaacaggcctcagggctccttg

SEQ ID NO: 5513768 - DNA, 23 bp, Homo sapiens
tcaacaggggcgtgaggtcccag

SEQ ID NO: 5513769 - DNA, 17 bp, Homo sapiens
tcaacagtgaacagctt

SEQ ID NO: 5513770 - DNA, 15 bp, Homo sapiens
tcaacagtgaagaca

SEQ ID NO: 5513771 - DNA, 16 bp, Homo sapiens
tcaacagtgagagact

SEQ ID NO: 5513772 - DNA, 17 bp, Homo sapiens
tcaacagttcaaagaag

SEQ ID NO: 5513773 - DNA, 16 bp, Homo sapiens
tcaacagtttccagtc

SEQ ID NO: 5513774 - DNA, 17 bp, Homo sapiens
tcaacagtttccagtca

SEQ ID NO: 5513775 - DNA, 19 bp, Homo sapiens
tcaacagtttccagtcatg

SEQ ID NO: 5513776 - DNA, 20 bp, Homo sapiens
tcaacagttttcctatgctt

SEQ ID NO: 5513777 - DNA, 22 bp, Homo sapiens
tcaacagttttcctatgctttg

SEQ ID NO: 5513778 - DNA, 23 bp, Homo sapiens
tcaacagttttcctatgctttga

SEQ ID NO: 5513779 - DNA, 23 bp, Homo sapiens
tcaacatacattggttttgaaat

SEQ ID NO: 5513780 - DNA, 15 bp, Homo sapiens
tcaacatcaaaactt

SEQ ID NO: 5513781 - DNA, 17 bp, Homo sapiens
tcaacatcaaaacttaa

SEQ ID NO: 5513782 - DNA, 18 bp, Homo sapiens
tcaacatcaatgttcatt

SEQ ID NO: 5513783 - DNA, 19 bp, Homo sapiens
tcaacatcaatgttcattg

SEQ ID NO: 5513784 - DNA, 20 bp, Homo sapiens
tcaacatcaatgttcattgt

SEQ ID NO: 5513785 - DNA, 21 bp, Homo sapiens
tcaacatcaatgttcattgta

SEQ ID NO: 5513786 - DNA, 23 bp, Homo sapiens
tcaacatcaattgggttttgatc

SEQ ID NO: 5513787 - DNA, 15 bp, Homo sapiens
tcaacatcactgaaa

SEQ ID NO: 5513788 - DNA, 16 bp, Homo sapiens
tcaacatcctgccagc

SEQ ID NO: 5513789 - DNA, 18 bp, Homo sapiens
tcaacatcctgccagccc

SEQ ID NO: 5513790 - DNA, 23 bp, Homo sapiens
tcaacatctcttgagtgtctatt

SEQ ID NO: 5513791 - DNA, 15 bp, Homo sapiens
tcaacatcttctctc

SEQ ID NO: 5513792 - DNA, 15 bp, Homo sapiens
tcaacatgaaacacc

SEQ ID NO: 5513793 - DNA, 14 bp, Homo sapiens
tcaacatgcatatg

SEQ ID NO: 5513794 - DNA, 16 bp, Homo sapiens
tcaacatggaaaaatc

SEQ ID NO: 5513795 - DNA, 19 bp, Homo sapiens
tcaacatgtgctcgctctg

SEQ ID NO: 5513796 - DNA, 21 bp, Homo sapiens
tcaacatgtgctcgctctgca

SEQ ID NO: 5513797 - DNA, 22 bp, Homo sapiens
tcaacatgttactgaccagcaa

SEQ ID NO: 5513798 - DNA, 23 bp, Homo sapiens
tcaacatgttattcaatgtgaca

SEQ ID NO: 5513799 - DNA, 16 bp, Homo sapiens
tcaacattccagggat

SEQ ID NO: 5513800 - DNA, 18 bp, Homo sapiens
tcaacattccagggatga

SEQ ID NO: 5513801 - DNA, 19 bp, Homo sapiens
tcaacattccagggatgag

SEQ ID NO: 5513802 - DNA, 18 bp, Homo sapiens
tcaacattcttgtgtctg

SEQ ID NO: 5513803 - DNA, 16 bp, Homo sapiens
tcaacatttacatgta

SEQ ID NO: 5513804 - DNA, 19 bp, Homo sapiens
tcaaccaaagttagttcag

SEQ ID NO: 5513805 - DNA, 14 bp, Homo sapiens
tcaaccaaatggta

SEQ ID NO: 5513806 - DNA, 19 bp, Homo sapiens
tcaaccaacctccccgcag

SEQ ID NO: 5513807 - DNA, 16 bp, Homo sapiens
tcaaccaactgcacaa

SEQ ID NO: 5513808 - DNA, 14 bp, Homo sapiens
tcaaccaagttaca

SEQ ID NO: 5513809 - DNA, 17 bp, Homo sapiens
tcaaccacacacacctg

SEQ ID NO: 5513810 - DNA, 21 bp, Homo sapiens
tcaaccacgtggagaaaatca

SEQ ID NO: 5513811 - DNA, 22 bp, Homo sapiens
tcaaccacgtggagaaaatcaa

SEQ ID NO: 5513812 - DNA, 11 bp, Homo sapiens
tcaaccactgt

SEQ ID NO: 5513813 - DNA, 18 bp, Homo sapiens
tcaaccacttttaaacat

SEQ ID NO: 5513814 - DNA, 12 bp, Homo sapiens
tcaaccagacag

SEQ ID NO: 5513815 - DNA, 13 bp, Homo sapiens
tcaaccagacaga

SEQ ID NO: 5513816 - DNA, 18 bp, Homo sapiens
tcaaccagcattttacta

SEQ ID NO: 5513817 - DNA, 13 bp, Homo sapiens
tcaaccaggaaga

SEQ ID NO: 5513818 - DNA, 16 bp, Homo sapiens
tcaaccatcgctttat

SEQ ID NO: 5513819 - DNA, 21 bp, Homo sapiens
tcaaccatgacctcacccctc

SEQ ID NO: 5513820 - DNA, 17 bp, Homo sapiens
tcaaccatggactttat

SEQ ID NO: 5513821 - DNA, 18 bp, Homo sapiens
tcaaccattccccatggg

SEQ ID NO: 5513822 - DNA, 22 bp, Homo sapiens
tcaaccattgaagggggatgca

SEQ ID NO: 5513823 - DNA, 19 bp, Homo sapiens
tcaacccaagctctgggga

SEQ ID NO: 5513824 - DNA, 20 bp, Homo sapiens
tcaacccaagctctggggat

SEQ ID NO: 5513825 - DNA, 23 bp, Homo sapiens
tcaacccaggagcatccacctcc

SEQ ID NO: 5513826 - DNA, 22 bp, Homo sapiens
tcaaccccaccatatgaattgt

SEQ ID NO: 5513827 - DNA, 11 bp, Homo sapiens
tcaaccccaga

SEQ ID NO: 5513828 - DNA, 14 bp, Homo sapiens
tcaacccccagcta

SEQ ID NO: 5513829 - DNA, 13 bp, Homo sapiens
tcaacccccctcc

SEQ ID NO: 5513830 - DNA, 21 bp, Homo sapiens
tcaacccccctcccagacagg

SEQ ID NO: 5513831 - DNA, 16 bp, Homo sapiens
tcaacccctcccctcc

SEQ ID NO: 5513832 - DNA, 23 bp, Homo sapiens
tcaacccctcccctccatccctg

SEQ ID NO: 5513833 - DNA, 20 bp, Homo sapiens
tcaaccccttcgctcctgtg

SEQ ID NO: 5513834 - DNA, 23 bp, Homo sapiens
tcaaccccttcgctcctgtgtct

SEQ ID NO: 5513835 - DNA, 19 bp, Homo sapiens
tcaacccgctgcttccagg

SEQ ID NO: 5513836 - DNA, 17 bp, Homo sapiens
tcaaccctcagccttga

SEQ ID NO: 5513837 - DNA, 14 bp, Homo sapiens
tcaaccctccctca

SEQ ID NO: 5513838 - DNA, 18 bp, Homo sapiens
tcaaccctccctcagccc

SEQ ID NO: 5513839 - DNA, 21 bp, Homo sapiens
tcaaccctccctcagcccctc

SEQ ID NO: 5513840 - DNA, 19 bp, Homo sapiens
tcaacctaagcaacagaaa

SEQ ID NO: 5513841 - DNA, 21 bp, Homo sapiens
tcaacctacagtggagggaga

SEQ ID NO: 5513842 - DNA, 22 bp, Homo sapiens
tcaacctaccaccccttcctgt

SEQ ID NO: 5513843 - DNA, 22 bp, Homo sapiens
tcaacctacctcgagtggcgag

SEQ ID NO: 5513844 - DNA, 12 bp, Homo sapiens
tcaacctcctgg

SEQ ID NO: 5513845 - DNA, 13 bp, Homo sapiens
tcaacctcctggg

SEQ ID NO: 5513846 - DNA, 21 bp, Homo sapiens
tcaacctcgcgcttgctggcc

SEQ ID NO: 5513847 - DNA, 17 bp, Homo sapiens
tcaacctcttctggctc

SEQ ID NO: 5513848 - DNA, 18 bp, Homo sapiens
tcaacctcttctggctca

SEQ ID NO: 5513849 - DNA, 13 bp, Homo sapiens
tcaacctgcctga

SEQ ID NO: 5513850 - DNA, 11 bp, Homo sapiens
tcaacctgctc

SEQ ID NO: 5513851 - DNA, 17 bp, Homo sapiens
tcaacctggtggcacca

SEQ ID NO: 5513852 - DNA, 19 bp, Homo sapiens
tcaacctgtaaattatttt

SEQ ID NO: 5513853 - DNA, 15 bp, Homo sapiens
tcaacctgtgtctta

SEQ ID NO: 5513854 - DNA, 19 bp, Homo sapiens
tcaacctgttcatcttgaa

SEQ ID NO: 5513855 - DNA, 13 bp, Homo sapiens
tcaaccttaccaa

SEQ ID NO: 5513856 - DNA, 14 bp, Homo sapiens
tcaaccttaccaaa

SEQ ID NO: 5513857 - DNA, 19 bp, Homo sapiens
tcaaccttcaagtatccaa

SEQ ID NO: 5513858 - DNA, 20 bp, Homo sapiens
tcaaccttccaacttcctgt

SEQ ID NO: 5513859 - DNA, 17 bp, Homo sapiens
tcaaccttgagacagct

SEQ ID NO: 5513860 - DNA, 18 bp, Homo sapiens
tcaaccttgagacagctt

SEQ ID NO: 5513861 - DNA, 17 bp, Homo sapiens
tcaaccttggccttctc

SEQ ID NO: 5513862 - DNA, 23 bp, Homo sapiens
tcaacctttgtaagaaaaccaaa

SEQ ID NO: 5513863 - DNA, 19 bp, Homo sapiens
tcaacctttgtgtggctcc

SEQ ID NO: 5513864 - DNA, 14 bp, Homo sapiens
tcaacgcagccctg

SEQ ID NO: 5513865 - DNA, 18 bp, Homo sapiens
tcaacgcagccctgcttt

SEQ ID NO: 5513866 - DNA, 15 bp, Homo sapiens
tcaacgcctccccct

SEQ ID NO: 5513867 - DNA, 19 bp, Homo sapiens
tcaacgcttaaaggtgtct

SEQ ID NO: 5513868 - DNA, 17 bp, Homo sapiens
tcaacggccctgtttat

SEQ ID NO: 5513869 - DNA, 16 bp, Homo sapiens
tcaacggggggctcct

SEQ ID NO: 5513870 - DNA, 22 bp, Homo sapiens
tcaacggggggctcctgcccag

SEQ ID NO: 5513871 - DNA, 14 bp, Homo sapiens
tcaacgttgtactg

SEQ ID NO: 5513872 - DNA, 23 bp, Homo sapiens
tcaactaaaagtggcatagagaa

SEQ ID NO: 5513873 - DNA, 23 bp, Homo sapiens
tcaactaaagaatagtgcctcag

SEQ ID NO: 5513874 - DNA, 21 bp, Homo sapiens
tcaactaaagttgtactttaa

SEQ ID NO: 5513875 - DNA, 15 bp, Homo sapiens
tcaactaatttttgt

SEQ ID NO: 5513876 - DNA, 22 bp, Homo sapiens
tcaactacggttgggagaatga

SEQ ID NO: 5513877 - DNA, 21 bp, Homo sapiens
tcaactagtggggtttcctgg

SEQ ID NO: 5513878 - DNA, 22 bp, Homo sapiens
tcaactagtggggtttcctggc

SEQ ID NO: 5513879 - DNA, 13 bp, Homo sapiens
tcaactattctgt

SEQ ID NO: 5513880 - DNA, 16 bp, Homo sapiens
tcaactcagactagtt

SEQ ID NO: 5513881 - DNA, 20 bp, Homo sapiens
tcaactcagactagtttagt

SEQ ID NO: 5513882 - DNA, 19 bp, Homo sapiens
tcaactccaaactgactct

SEQ ID NO: 5513883 - DNA, 15 bp, Homo sapiens
tcaactccaaggcaa

SEQ ID NO: 5513884 - DNA, 11 bp, Homo sapiens
tcaactccaga

SEQ ID NO: 5513885 - DNA, 18 bp, Homo sapiens
tcaactccagagcccctt

SEQ ID NO: 5513886 - DNA, 11 bp, Homo sapiens
tcaactcccaa

SEQ ID NO: 5513887 - DNA, 20 bp, Homo sapiens
tcaactcccaacttcttcct

SEQ ID NO: 5513888 - DNA, 21 bp, Homo sapiens
tcaactccctgccccccagcc

SEQ ID NO: 5513889 - DNA, 15 bp, Homo sapiens
tcaactcctgggctc

SEQ ID NO: 5513890 - DNA, 19 bp, Homo sapiens
tcaactcgggggcgcctgg

SEQ ID NO: 5513891 - DNA, 20 bp, Homo sapiens
tcaactcgggggcgcctgga

SEQ ID NO: 5513892 - DNA, 18 bp, Homo sapiens
tcaactctacccctgctc

SEQ ID NO: 5513893 - DNA, 23 bp, Homo sapiens
tcaactctacccctgctcccatt

SEQ ID NO: 5513894 - DNA, 16 bp, Homo sapiens
tcaactctgaatcaaa

SEQ ID NO: 5513895 - DNA, 15 bp, Homo sapiens
tcaactctgctgagg

SEQ ID NO: 5513896 - DNA, 14 bp, Homo sapiens
tcaactctttgtta

SEQ ID NO: 5513897 - DNA, 22 bp, Homo sapiens
tcaactctttgttatttgaaaa

SEQ ID NO: 5513898 - DNA, 23 bp, Homo sapiens
tcaactgaaaagactcagtgttc

SEQ ID NO: 5513899 - DNA, 22 bp, Homo sapiens
tcaactgaaagtgtttccttca

SEQ ID NO: 5513900 - DNA, 12 bp, Homo sapiens
tcaactgaaggg

SEQ ID NO: 5513901 - DNA, 21 bp, Homo sapiens
tcaactgagaagccaagcctg

SEQ ID NO: 5513902 - DNA, 20 bp, Homo sapiens
tcaactgagggccagggacc

SEQ ID NO: 5513903 - DNA, 21 bp, Homo sapiens
tcaactgagggccagggaccc

SEQ ID NO: 5513904 - DNA, 19 bp, Homo sapiens
tcaactgatgatagacttc

SEQ ID NO: 5513905 - DNA, 12 bp, Homo sapiens
tcaactgctctg

SEQ ID NO: 5513906 - DNA, 22 bp, Homo sapiens
tcaactgctgttttatgtcata

SEQ ID NO: 5513907 - DNA, 17 bp, Homo sapiens
tcaactggaaattaaaa

SEQ ID NO: 5513908 - DNA, 20 bp, Homo sapiens
tcaactggacatcacagcag

SEQ ID NO: 5513909 - DNA, 20 bp, Homo sapiens
tcaactggagtctatgctta

SEQ ID NO: 5513910 - DNA, 15 bp, Homo sapiens
tcaactggctgggac

SEQ ID NO: 5513911 - DNA, 17 bp, Homo sapiens
tcaactggggaaaagga

SEQ ID NO: 5513912 - DNA, 19 bp, Homo sapiens
tcaactggggggaccaaat

SEQ ID NO: 5513913 - DNA, 16 bp, Homo sapiens
tcaactggttgtatat

SEQ ID NO: 5513914 - DNA, 12 bp, Homo sapiens
tcaactgtataa

SEQ ID NO: 5513915 - DNA, 17 bp, Homo sapiens
tcaactgtatgtacata

SEQ ID NO: 5513916 - DNA, 19 bp, Homo sapiens
tcaactgtatgtacatacc

SEQ ID NO: 5513917 - DNA, 16 bp, Homo sapiens
tcaactgtattgggcc

SEQ ID NO: 5513918 - DNA, 22 bp, Homo sapiens
tcaactgtctcctacctctgct

SEQ ID NO: 5513919 - DNA, 16 bp, Homo sapiens
tcaactgtcttcctca

SEQ ID NO: 5513920 - DNA, 16 bp, Homo sapiens
tcaacttaaatcactg

SEQ ID NO: 5513921 - DNA, 13 bp, Homo sapiens
tcaacttatttct

SEQ ID NO: 5513922 - DNA, 14 bp, Homo sapiens
tcaacttcagaagg

SEQ ID NO: 5513923 - DNA, 18 bp, Homo sapiens
tcaacttcagtactcaaa

SEQ ID NO: 5513924 - DNA, 19 bp, Homo sapiens
tcaacttcagtactcaaat

SEQ ID NO: 5513925 - DNA, 20 bp, Homo sapiens
tcaacttcagttgaaaagag

SEQ ID NO: 5513926 - DNA, 19 bp, Homo sapiens
tcaacttctggctcctcaa

SEQ ID NO: 5513927 - DNA, 18 bp, Homo sapiens
tcaacttgaagcaagctt

SEQ ID NO: 5513928 - DNA, 16 bp, Homo sapiens
tcaacttgcaaaatca

SEQ ID NO: 5513929 - DNA, 20 bp, Homo sapiens
tcaacttgcaaaatcagttt

SEQ ID NO: 5513930 - DNA, 19 bp, Homo sapiens
tcaacttgcaatttgcaag

SEQ ID NO: 5513931 - DNA, 20 bp, Homo sapiens
tcaacttgggctactgaact

SEQ ID NO: 5513932 - DNA, 18 bp, Homo sapiens
tcaactttactgtaatat

SEQ ID NO: 5513933 - DNA, 14 bp, Homo sapiens
tcaactttatgcag

SEQ ID NO: 5513934 - DNA, 13 bp, Homo sapiens
tcaactttatgta

SEQ ID NO: 5513935 - DNA, 12 bp, Homo sapiens
tcaactttcaga

SEQ ID NO: 5513936 - DNA, 17 bp, Homo sapiens
tcaactttcatttgaaa

SEQ ID NO: 5513937 - DNA, 15 bp, Homo sapiens
tcaactttgaataaa

SEQ ID NO: 5513938 - DNA, 19 bp, Homo sapiens
tcaactttgtaaaaatctt

SEQ ID NO: 5513939 - DNA, 14 bp, Homo sapiens
tcaacttttaactt

SEQ ID NO: 5513940 - DNA, 13 bp, Homo sapiens
tcaacttttatgc

SEQ ID NO: 5513941 - DNA, 13 bp, Homo sapiens
tcaacttttctaa

SEQ ID NO: 5513942 - DNA, 21 bp, Homo sapiens
tcaactttttattgccttctc

SEQ ID NO: 5513943 - DNA, 20 bp, Homo sapiens
tcaagaaaaatataaaaaca

SEQ ID NO: 5513944 - DNA, 22 bp, Homo sapiens
tcaagaaaaatataaaaacaac

SEQ ID NO: 5513945 - DNA, 18 bp, Homo sapiens
tcaagaaaaattattgta

SEQ ID NO: 5513946 - DNA, 23 bp, Homo sapiens
tcaagaaaatctttgttgaagtt

SEQ ID NO: 5513947 - DNA, 16 bp, Homo sapiens
tcaagaaaattttgca

SEQ ID NO: 5513948 - DNA, 20 bp, Homo sapiens
tcaagaaaattttgcagaag

SEQ ID NO: 5513949 - DNA, 13 bp, Homo sapiens
tcaagaaacagcc

SEQ ID NO: 5513950 - DNA, 15 bp, Homo sapiens
tcaagaaacagccag

SEQ ID NO: 5513951 - DNA, 16 bp, Homo sapiens
tcaagaaacagccagc

SEQ ID NO: 5513952 - DNA, 18 bp, Homo sapiens
tcaagaaacagccagcaa

SEQ ID NO: 5513953 - DNA, 18 bp, Homo sapiens
tcaagaaactgaggaatt

SEQ ID NO: 5513954 - DNA, 21 bp, Homo sapiens
tcaagaaagatatctatgact

SEQ ID NO: 5513955 - DNA, 21 bp, Homo sapiens
tcaagaaagcttcaaactgca

SEQ ID NO: 5513956 - DNA, 14 bp, Homo sapiens
tcaagaaaggaggg

SEQ ID NO: 5513957 - DNA, 21 bp, Homo sapiens
tcaagaaataaaaggaagcca

SEQ ID NO: 5513958 - DNA, 17 bp, Homo sapiens
tcaagaaataagttttt

SEQ ID NO: 5513959 - DNA, 20 bp, Homo sapiens
tcaagaaatcattattgagt

SEQ ID NO: 5513960 - DNA, 18 bp, Homo sapiens
tcaagaaatgaagagctg

SEQ ID NO: 5513961 - DNA, 18 bp, Homo sapiens
tcaagaaatgtctctgct

SEQ ID NO: 5513962 - DNA, 21 bp, Homo sapiens
tcaagaaatgtctctgctcct

SEQ ID NO: 5513963 - DNA, 14 bp, Homo sapiens
tcaagaacaaacac

SEQ ID NO: 5513964 - DNA, 14 bp, Homo sapiens
tcaagaacctggaa

SEQ ID NO: 5513965 - DNA, 16 bp, Homo sapiens
tcaagaacttgtttaa

SEQ ID NO: 5513966 - DNA, 18 bp, Homo sapiens
tcaagaagaaagtgttca

SEQ ID NO: 5513967 - DNA, 22 bp, Homo sapiens
tcaagaagaaagtgttcaaatt

SEQ ID NO: 5513968 - DNA, 20 bp, Homo sapiens
tcaagaagacggattatcta

SEQ ID NO: 5513969 - DNA, 20 bp, Homo sapiens
tcaagaagactatggtcctg

SEQ ID NO: 5513970 - DNA, 23 bp, Homo sapiens
tcaagaagcaggctacactgaca

SEQ ID NO: 5513971 - DNA, 14 bp, Homo sapiens
tcaagaagggctgc

SEQ ID NO: 5513972 - DNA, 20 bp, Homo sapiens
tcaagaagtaatcagtatgc

SEQ ID NO: 5513973 - DNA, 22 bp, Homo sapiens
tcaagaagtatttttttaattt

SEQ ID NO: 5513974 - DNA, 19 bp, Homo sapiens
tcaagaagtcttgaagttg

SEQ ID NO: 5513975 - DNA, 22 bp, Homo sapiens
tcaagaagttctttgattctgt

SEQ ID NO: 5513976 - DNA, 20 bp, Homo sapiens
tcaagaatcagacagcagga

SEQ ID NO: 5513977 - DNA, 15 bp, Homo sapiens
tcaagaatcctctgg

SEQ ID NO: 5513978 - DNA, 18 bp, Homo sapiens
tcaagaatctagaagatg

SEQ ID NO: 5513979 - DNA, 15 bp, Homo sapiens
tcaagaatgaaaaat

SEQ ID NO: 5513980 - DNA, 14 bp, Homo sapiens
tcaagaatgagaaa

SEQ ID NO: 5513981 - DNA, 17 bp, Homo sapiens
tcaagaatgtttcagtt

SEQ ID NO: 5513982 - DNA, 16 bp, Homo sapiens
tcaagacagattgtga

SEQ ID NO: 5513983 - DNA, 16 bp, Homo sapiens
tcaagacagggaagga

SEQ ID NO: 5513984 - DNA, 22 bp, Homo sapiens
tcaagttccatgcttgagcaat

SEQ ID NO: 5513985 - DNA, 18 bp, Homo sapiens
tcaagttccgtctcctct

SEQ ID NO: 5513986 - DNA, 14 bp, Homo sapiens
tcaagttcctttgg

SEQ ID NO: 5513987 - DNA, 15 bp, Homo sapiens
tcaagttctaagatt

SEQ ID NO: 5513988 - DNA, 17 bp, Homo sapiens
tcaagttctaagattct

SEQ ID NO: 5513989 - DNA, 18 bp, Homo sapiens
tcaagttctaagattcta

SEQ ID NO: 5513990 - DNA, 13 bp, Homo sapiens
tcaagttcttgga

SEQ ID NO: 5513991 - DNA, 16 bp, Homo sapiens
tcaagttcttggacca

SEQ ID NO: 5513992 - DNA, 21 bp, Homo sapiens
tcaagttgattagaaagacca

SEQ ID NO: 5513993 - DNA, 16 bp, Homo sapiens
tcaagttgcacactca

SEQ ID NO: 5513994 - DNA, 20 bp, Homo sapiens
tcaagttgcacactcactgg

SEQ ID NO: 5513995 - DNA, 13 bp, Homo sapiens
tcaagttgtaaaa

SEQ ID NO: 5513996 - DNA, 16 bp, Homo sapiens
tcaagttgtgataaat

SEQ ID NO: 5513997 - DNA, 13 bp, Homo sapiens
tcaagttgtgcca

SEQ ID NO: 5513998 - DNA, 13 bp, Homo sapiens
tcaagttgtgctt

SEQ ID NO: 5513999 - DNA, 17 bp, Homo sapiens
tcaagttgtgcttgttt

SEQ ID NO: 5514000 - DNA, 16 bp, Homo sapiens
tcaagttgtgtgctat

SEQ ID NO: 5514001 - DNA, 19 bp, Homo sapiens
tcaagttgtttaactgtgc

SEQ ID NO: 5514002 - DNA, 20 bp, Homo sapiens
tcaagttgtttaactgtgca

SEQ ID NO: 5514003 - DNA, 17 bp, Homo sapiens
tcaagttgtttcatgag

SEQ ID NO: 5514004 - DNA, 14 bp, Homo sapiens
tcaagtttacactt

SEQ ID NO: 5514005 - DNA, 23 bp, Homo sapiens
tcaagtttccccagcttcatctt

SEQ ID NO: 5514006 - DNA, 15 bp, Homo sapiens
tcaagtttgctgcaa

SEQ ID NO: 5514007 - DNA, 19 bp, Homo sapiens
tcaagttttgggtatgttt

SEQ ID NO: 5514008 - DNA, 21 bp, Homo sapiens
tcaagtttttatagttattaa

SEQ ID NO: 5514009 - DNA, 23 bp, Homo sapiens
tcaagtttttcatactgtacaca

SEQ ID NO: 5514010 - DNA, 17 bp, Homo sapiens
tcaagttttttatactg

SEQ ID NO: 5514011 - DNA, 19 bp, Homo sapiens
tcaataaaaaaaagaaatg

SEQ ID NO: 5514012 - DNA, 17 bp, Homo sapiens
tcaataaaaaacaaata

SEQ ID NO: 5514013 - DNA, 13 bp, Homo sapiens
tcaataaaaaatt

SEQ ID NO: 5514014 - DNA, 17 bp, Homo sapiens
tcaataaaaataaatct

SEQ ID NO: 5514015 - DNA, 21 bp, Homo sapiens
tcaataaaaatctttgattca

SEQ ID NO: 5514016 - DNA, 15 bp, Homo sapiens
tcaataaaagagctg

SEQ ID NO: 5514017 - DNA, 20 bp, Homo sapiens
tcaataaaagagctgtctga

SEQ ID NO: 5514018 - DNA, 22 bp, Homo sapiens
tcaataaaagcctttgaaaata

SEQ ID NO: 5514019 - DNA, 14 bp, Homo sapiens
tcaataaaatcatg

SEQ ID NO: 5514020 - DNA, 21 bp, Homo sapiens
tcaataaaatcatgtacattt

SEQ ID NO: 5514021 - DNA, 21 bp, Homo sapiens
tcaataaaatccatacatttg

SEQ ID NO: 5514022 - DNA, 22 bp, Homo sapiens
tcaataaaatgtgatttttctg

SEQ ID NO: 5514023 - DNA, 23 bp, Homo sapiens
tcaataaaatgtgatttttctga

SEQ ID NO: 5514024 - DNA, 15 bp, Homo sapiens
tcaataaaattatag

SEQ ID NO: 5514025 - DNA, 19 bp, Homo sapiens
tcaataaaattctgtaatt

SEQ ID NO: 5514026 - DNA, 17 bp, Homo sapiens
tcaataaacaacagctg

SEQ ID NO: 5514027 - DNA, 13 bp, Homo sapiens
tcaataaacactt

SEQ ID NO: 5514028 - DNA, 14 bp, Homo sapiens
tcaataaacacttg

SEQ ID NO: 5514029 - DNA, 12 bp, Homo sapiens
tcaataaacagc

SEQ ID NO: 5514030 - DNA, 13 bp, Homo sapiens
tcaataaacagtc

SEQ ID NO: 5514031 - DNA, 14 bp, Homo sapiens
tcaataaacagtca

SEQ ID NO: 5514032 - DNA, 15 bp, Homo sapiens
tcaataaacagtcac

SEQ ID NO: 5514033 - DNA, 21 bp, Homo sapiens
tcaataaaccttttgtttcct

SEQ ID NO: 5514034 - DNA, 16 bp, Homo sapiens
tcaataaagaaaactt

SEQ ID NO: 5514035 - DNA, 21 bp, Homo sapiens
tcaataaagaaaacttccata

SEQ ID NO: 5514036 - DNA, 14 bp, Homo sapiens
tcaataaagcacta

SEQ ID NO: 5514037 - DNA, 17 bp, Homo sapiens
tcaataaagcactattg

SEQ ID NO: 5514038 - DNA, 20 bp, Homo sapiens
tcaataaagcactattgttt

SEQ ID NO: 5514039 - DNA, 18 bp, Homo sapiens
tcaataaagcactgagca

SEQ ID NO: 5514040 - DNA, 15 bp, Homo sapiens
tcaataaagcagagc

SEQ ID NO: 5514041 - DNA, 19 bp, Homo sapiens
tcaataaagcagagccaag

SEQ ID NO: 5514042 - DNA, 12 bp, Homo sapiens
tcaataaagcat

SEQ ID NO: 5514043 - DNA, 15 bp, Homo sapiens
tcaataaagcattta

SEQ ID NO: 5514044 - DNA, 18 bp, Homo sapiens
tcaataaagtatttaatt

SEQ ID NO: 5514045 - DNA, 11 bp, Homo sapiens
tcaataaagtt

SEQ ID NO: 5514046 - DNA, 14 bp, Homo sapiens
tcaataaagttgtt

SEQ ID NO: 5514047 - DNA, 18 bp, Homo sapiens
tcaataaagttgttgcat

SEQ ID NO: 5514048 - DNA, 19 bp, Homo sapiens
tcaataaagttgttgcatt

SEQ ID NO: 5514049 - DNA, 20 bp, Homo sapiens
tcaataaagttgttgcattc

SEQ ID NO: 5514050 - DNA, 13 bp, Homo sapiens
tcaataaagtttg

SEQ ID NO: 5514051 - DNA, 18 bp, Homo sapiens
tcaataaagtttgatctt

SEQ ID NO: 5514052 - DNA, 15 bp, Homo sapiens
tcaataaatgacacc

SEQ ID NO: 5514053 - DNA, 13 bp, Homo sapiens
tcaataaatgata

SEQ ID NO: 5514054 - DNA, 23 bp, Homo sapiens
tcaataaatgtatcatttttgtg

SEQ ID NO: 5514055 - DNA, 19 bp, Homo sapiens
tcaataaatgttgaaaagt

SEQ ID NO: 5514056 - DNA, 22 bp, Homo sapiens
tcaataaattattagagatttt

SEQ ID NO: 5514057 - DNA, 15 bp, Homo sapiens
tcaataaattgcaac

SEQ ID NO: 5514058 - DNA, 15 bp, Homo sapiens
tcaataaatttgctt

SEQ ID NO: 5514059 - DNA, 20 bp, Homo sapiens
tcaataacagccgctccaga

SEQ ID NO: 5514060 - DNA, 17 bp, Homo sapiens
tcaataacctttcactt

SEQ ID NO: 5514061 - DNA, 22 bp, Homo sapiens
tcaataacgaagttgggcaata

SEQ ID NO: 5514062 - DNA, 15 bp, Homo sapiens
tcaataactctgatt

SEQ ID NO: 5514063 - DNA, 16 bp, Homo sapiens
tcaataactctgattt

SEQ ID NO: 5514064 - DNA, 13 bp, Homo sapiens
tcaataagtgttg

SEQ ID NO: 5514065 - DNA, 18 bp, Homo sapiens
tcaataatatattttctg

SEQ ID NO: 5514066 - DNA, 20 bp, Homo sapiens
tcaataattgtggagaggag

SEQ ID NO: 5514067 - DNA, 22 bp, Homo sapiens
tcaataattgtggagaggagag

SEQ ID NO: 5514068 - DNA, 23 bp, Homo sapiens
tcaataatttgtggtgatttgga

SEQ ID NO: 5514069 - DNA, 21 bp, Homo sapiens
tcaatacacacacacagacat

SEQ ID NO: 5514070 - DNA, 14 bp, Homo sapiens
tcaatacactagtt

SEQ ID NO: 5514071 - DNA, 14 bp, Homo sapiens
tcaatacagatata

SEQ ID NO: 5514072 - DNA, 15 bp, Homo sapiens
tcaatacagatatat

SEQ ID NO: 5514073 - DNA, 16 bp, Homo sapiens
tcaatacagatatatt

SEQ ID NO: 5514074 - DNA, 19 bp, Homo sapiens
tcaatacagtacaggcagc

SEQ ID NO: 5514075 - DNA, 20 bp, Homo sapiens
tcaatacagtacaggcagca

SEQ ID NO: 5514076 - DNA, 22 bp, Homo sapiens
tcaatacagtttataaagccaa

SEQ ID NO: 5514077 - DNA, 15 bp, Homo sapiens
tcaataccagggaag

SEQ ID NO: 5514078 - DNA, 22 bp, Homo sapiens
tcaataccccaagtccacctgc

SEQ ID NO: 5514079 - DNA, 18 bp, Homo sapiens
tcaatacccttggcactg

SEQ ID NO: 5514080 - DNA, 22 bp, Homo sapiens
tcaatacctggcctcatttaaa

SEQ ID NO: 5514081 - DNA, 12 bp, Homo sapiens
tcaatactacct

SEQ ID NO: 5514082 - DNA, 14 bp, Homo sapiens
tcaatactacctct

SEQ ID NO: 5514083 - DNA, 17 bp, Homo sapiens
tcaatactacctctgaa

SEQ ID NO: 5514084 - DNA, 15 bp, Homo sapiens
tcaatactctctgag

SEQ ID NO: 5514085 - DNA, 16 bp, Homo sapiens
tcaatactctctgagt

SEQ ID NO: 5514086 - DNA, 22 bp, Homo sapiens
tcaatactgcacactgcacatt

SEQ ID NO: 5514087 - DNA, 17 bp, Homo sapiens
tcaatactttgaacaca

SEQ ID NO: 5514088 - DNA, 21 bp, Homo sapiens
tcaatacttttgtgtattctg

SEQ ID NO: 5514089 - DNA, 22 bp, Homo sapiens
tcaatagaaagtcatctttgag

SEQ ID NO: 5514090 - DNA, 16 bp, Homo sapiens
tcaatagatctccagc

SEQ ID NO: 5514091 - DNA, 21 bp, Homo sapiens
tcaatagattgtaatacacat

SEQ ID NO: 5514092 - DNA, 22 bp, Homo sapiens
tcaatagattgtaatacacata

SEQ ID NO: 5514093 - DNA, 21 bp, Homo sapiens
tcaatagatttaggagcagaa

SEQ ID NO: 5514094 - DNA, 12 bp, Homo sapiens
tcaatagcattg

SEQ ID NO: 5514095 - DNA, 22 bp, Homo sapiens
tcaatagccactaaccttgcct

SEQ ID NO: 5514096 - DNA, 23 bp, Homo sapiens
tcaatagccactaaccttgcctg

SEQ ID NO: 5514097 - DNA, 13 bp, Homo sapiens
tcaataggaaaaa

SEQ ID NO: 5514098 - DNA, 19 bp, Homo sapiens
tcaataggaaaaactgatt

SEQ ID NO: 5514099 - DNA, 16 bp, Homo sapiens
tcaataggaattgcat

SEQ ID NO: 5514100 - DNA, 21 bp, Homo sapiens
tcaataggagggatgttccag

SEQ ID NO: 5514101 - DNA, 18 bp, Homo sapiens
tcaatagtgcaactgttt

SEQ ID NO: 5514102 - DNA, 21 bp, Homo sapiens
tcaatagtgcaactgttttga

SEQ ID NO: 5514103 - DNA, 22 bp, Homo sapiens
tcaatagtggcataccaaatgg

SEQ ID NO: 5514104 - DNA, 19 bp, Homo sapiens
tcaatagtgtcctatgcaa

SEQ ID NO: 5514105 - DNA, 21 bp, Homo sapiens
tcaatagtgtcctatgcaata

SEQ ID NO: 5514106 - DNA, 14 bp, Homo sapiens
tcaatagttcaagg

SEQ ID NO: 5514107 - DNA, 15 bp, Homo sapiens
tcaatagttgaatta

SEQ ID NO: 5514108 - DNA, 15 bp, Homo sapiens
tcaatatataataaa

SEQ ID NO: 5514109 - DNA, 20 bp, Homo sapiens
tcaatatataataaatggga

SEQ ID NO: 5514110 - DNA, 21 bp, Homo sapiens
tcaatatatagagacttctaa

SEQ ID NO: 5514111 - DNA, 17 bp, Homo sapiens
tcaatatattgaacttt

SEQ ID NO: 5514112 - DNA, 14 bp, Homo sapiens
tcaatatcattact

SEQ ID NO: 5514113 - DNA, 16 bp, Homo sapiens
tcaatatcattactaa

SEQ ID NO: 5514114 - DNA, 17 bp, Homo sapiens
tcaatatcccaacattc

SEQ ID NO: 5514115 - DNA, 18 bp, Homo sapiens
tcaatatcccaacattct

SEQ ID NO: 5514116 - DNA, 23 bp, Homo sapiens
tcaatatcccaacattctgcaat

SEQ ID NO: 5514117 - DNA, 18 bp, Homo sapiens
tcaatatccctcttgtaa

SEQ ID NO: 5514118 - DNA, 19 bp, Homo sapiens
tcaatatccctcttgtaag

SEQ ID NO: 5514119 - DNA, 16 bp, Homo sapiens
tcaatatcctttgcct

SEQ ID NO: 5514120 - DNA, 22 bp, Homo sapiens
tcaatatgaaggaaatgaacca

SEQ ID NO: 5514121 - DNA, 23 bp, Homo sapiens
tcaatatgaaggaaatgaaccac

SEQ ID NO: 5514122 - DNA, 17 bp, Homo sapiens
tcaatatgcaagcagct

SEQ ID NO: 5514123 - DNA, 16 bp, Homo sapiens
tcaatatgtgattttt

SEQ ID NO: 5514124 - DNA, 21 bp, Homo sapiens
tcaatattaaatacagacact

SEQ ID NO: 5514125 - DNA, 15 bp, Homo sapiens
tcaatattcaataaa

SEQ ID NO: 5514126 - DNA, 16 bp, Homo sapiens
tcaatattcaataaag

SEQ ID NO: 5514127 - DNA, 15 bp, Homo sapiens
tcaatattgaatttt

SEQ ID NO: 5514128 - DNA, 19 bp, Homo sapiens
tcaatattgacatttgtag

SEQ ID NO: 5514129 - DNA, 18 bp, Homo sapiens
tcaatattgtcattcctg

SEQ ID NO: 5514130 - DNA, 10 bp, Homo sapiens
tcaatattta

SEQ ID NO: 5514131 - DNA, 19 bp, Homo sapiens
tcaatatttaagagattaa

SEQ ID NO: 5514132 - DNA, 17 bp, Homo sapiens
tcaatatttaagtttgt

SEQ ID NO: 5514133 - DNA, 17 bp, Homo sapiens
tcaatatttactgagac

SEQ ID NO: 5514134 - DNA, 22 bp, Homo sapiens
tcaatatttagaaaattttgta

SEQ ID NO: 5514135 - DNA, 18 bp, Homo sapiens
tcaatattttccatgaaa

SEQ ID NO: 5514136 - DNA, 20 bp, Homo sapiens
tcaatattttctgcaatcca

SEQ ID NO: 5514137 - DNA, 16 bp, Homo sapiens
tcaatatttttatatc

SEQ ID NO: 5514138 - DNA, 13 bp, Homo sapiens
tcaatatttttct

SEQ ID NO: 5514139 - DNA, 19 bp, Homo sapiens
tcaatcaaactttcagctt

SEQ ID NO: 5514140 - DNA, 14 bp, Homo sapiens
tcaatcaaagctac

SEQ ID NO: 5514141 - DNA, 18 bp, Homo sapiens
tcaatcaaagctaccttt

SEQ ID NO: 5514142 - DNA, 15 bp, Homo sapiens
tcaatcaacactacc

SEQ ID NO: 5514143 - DNA, 13 bp, Homo sapiens
tcaatcaacatct

SEQ ID NO: 5514144 - DNA, 14 bp, Homo sapiens
tcaatcaacatctc

SEQ ID NO: 5514145 - DNA, 23 bp, Homo sapiens
tcaatcaacatctcttgagtgtc

SEQ ID NO: 5514146 - DNA, 24 bp, Homo sapiens
tcaatcaaccaaagttagttcagt

SEQ ID NO: 5514147 - DNA, 17 bp, Homo sapiens
tcaatcaagatgggtga

SEQ ID NO: 5514148 - DNA, 20 bp, Homo sapiens
tcaatcacagcttgtatttt

SEQ ID NO: 5514149 - DNA, 19 bp, Homo sapiens
tcaatcactgtaacctgat

SEQ ID NO: 5514150 - DNA, 12 bp, Homo sapiens
tcaatcactgtc

SEQ ID NO: 5514151 - DNA, 15 bp, Homo sapiens
tcaatcagcctttag

SEQ ID NO: 5514152 - DNA, 14 bp, Homo sapiens
tcaatcagtataat

SEQ ID NO: 5514153 - DNA, 21 bp, Homo sapiens
tcaatcagtctcagaatgtca

SEQ ID NO: 5514154 - DNA, 16 bp, Homo sapiens
tcaatcagtgcagtga

SEQ ID NO: 5514155 - DNA, 14 bp, Homo sapiens
tcaatcattgtaca

SEQ ID NO: 5514156 - DNA, 16 bp, Homo sapiens
tcaatcattgtacagt

SEQ ID NO: 5514157 - DNA, 15 bp, Homo sapiens
tcaatcattgtcaga

SEQ ID NO: 5514158 - DNA, 13 bp, Homo sapiens
tcaatcatttcta

SEQ ID NO: 5514159 - DNA, 16 bp, Homo sapiens
tcaatcatttctatta

SEQ ID NO: 5514160 - DNA, 16 bp, Homo sapiens
tcaatcatttggatca

SEQ ID NO: 5514161 - DNA, 22 bp, Homo sapiens
tcacacagagcgcctcacctgc

SEQ ID NO: 5514162 - DNA, 13 bp, Homo sapiens
tcacacagcccag

SEQ ID NO: 5514163 - DNA, 14 bp, Homo sapiens
tcacacagcccagt

SEQ ID NO: 5514164 - DNA, 20 bp, Homo sapiens
tcacacagctagtgaagacc

SEQ ID NO: 5514165 - DNA, 13 bp, Homo sapiens
tcacacagctggg

SEQ ID NO: 5514166 - DNA, 22 bp, Homo sapiens
tcacacagctggggctgtagca

SEQ ID NO: 5514167 - DNA, 21 bp, Homo sapiens
tcacacaggacccccttcccc

SEQ ID NO: 5514168 - DNA, 19 bp, Homo sapiens
tcacacaggcatttcctgg

SEQ ID NO: 5514169 - DNA, 17 bp, Homo sapiens
tcacacagggctctttg

SEQ ID NO: 5514170 - DNA, 21 bp, Homo sapiens
tcacacagtattacttctgct

SEQ ID NO: 5514171 - DNA, 13 bp, Homo sapiens
tcacacagtgagt

SEQ ID NO: 5514172 - DNA, 23 bp, Homo sapiens
tcacacagtgagtcgaggacagg

SEQ ID NO: 5514173 - DNA, 21 bp, Homo sapiens
tcacacagtggcactagcatt

SEQ ID NO: 5514174 - DNA, 12 bp, Homo sapiens
tcacacagtgtt

SEQ ID NO: 5514175 - DNA, 19 bp, Homo sapiens
tcacacagtgttagtgctg

SEQ ID NO: 5514176 - DNA, 17 bp, Homo sapiens
tcacacatatcagcagg

SEQ ID NO: 5514177 - DNA, 18 bp, Homo sapiens
tcacacatccccagccag

SEQ ID NO: 5514178 - DNA, 16 bp, Homo sapiens
tcacacatcctgtcag

SEQ ID NO: 5514179 - DNA, 16 bp, Homo sapiens
tcacacatctgggtgc

SEQ ID NO: 5514180 - DNA, 15 bp, Homo sapiens
tcacacatgaataaa

SEQ ID NO: 5514181 - DNA, 21 bp, Homo sapiens
tcacacatgagcatcaggcca

SEQ ID NO: 5514182 - DNA, 19 bp, Homo sapiens
tcacacatgcacttttggg

SEQ ID NO: 5514183 - DNA, 18 bp, Homo sapiens
tcacacatgccactatga

SEQ ID NO: 5514184 - DNA, 16 bp, Homo sapiens
tcacacattatagaaa

SEQ ID NO: 5514185 - DNA, 19 bp, Homo sapiens
tcacacattatagaaatta

SEQ ID NO: 5514186 - DNA, 23 bp, Homo sapiens
tcacacattcccccaccagctgc

SEQ ID NO: 5514187 - DNA, 16 bp, Homo sapiens
tcacaccaaggaagct

SEQ ID NO: 5514188 - DNA, 15 bp, Homo sapiens
tcacaccactagcct

SEQ ID NO: 5514189 - DNA, 19 bp, Homo sapiens
tcacaccactgcactccag

SEQ ID NO: 5514190 - DNA, 14 bp, Homo sapiens
tcacaccagccctg

SEQ ID NO: 5514191 - DNA, 16 bp, Homo sapiens
tcacaccagctaagga

SEQ ID NO: 5514192 - DNA, 21 bp, Homo sapiens
tcacaccaggcttgcctgcag

SEQ ID NO: 5514193 - DNA, 22 bp, Homo sapiens
tcacaccaggcttgcctgcagg

SEQ ID NO: 5514194 - DNA, 24 bp, Homo sapiens
tcacaccagttacttgtgttcatt

SEQ ID NO: 5514195 - DNA, 19 bp, Homo sapiens
tcacaccattcattctggt

SEQ ID NO: 5514196 - DNA, 19 bp, Homo sapiens
tcacaccattctcctgcct

SEQ ID NO: 5514197 - DNA, 18 bp, Homo sapiens
tcacacccaccccctgcc

SEQ ID NO: 5514198 - DNA, 19 bp, Homo sapiens
tcacacccaccccctgcct

SEQ ID NO: 5514199 - DNA, 23 bp, Homo sapiens
tcacacccaccccctgcctggtt

SEQ ID NO: 5514200 - DNA, 15 bp, Homo sapiens
tcacacccaccgtcc

SEQ ID NO: 5514201 - DNA, 21 bp, Homo sapiens
tcacacccaccgtccgccctg

SEQ ID NO: 5514202 - DNA, 13 bp, Homo sapiens
tcacacccacctg

SEQ ID NO: 5514203 - DNA, 16 bp, Homo sapiens
tcacacccacctgctg

SEQ ID NO: 5514204 - DNA, 17 bp, Homo sapiens
tcacacccacctgctgc

SEQ ID NO: 5514205 - DNA, 21 bp, Homo sapiens
tcacacccacctgctgctgta

SEQ ID NO: 5514206 - DNA, 14 bp, Homo sapiens
tcacacccactccc

SEQ ID NO: 5514207 - DNA, 12 bp, Homo sapiens
tcacaccccacc

SEQ ID NO: 5514208 - DNA, 13 bp, Homo sapiens
tcacaccccacct

SEQ ID NO: 5514209 - DNA, 16 bp, Homo sapiens
tcacaccccacctgcg

SEQ ID NO: 5514210 - DNA, 18 bp, Homo sapiens
tcacaccccacctgcgct

SEQ ID NO: 5514211 - DNA, 21 bp, Homo sapiens
tcacacccctcagcgctccct

SEQ ID NO: 5514212 - DNA, 14 bp, Homo sapiens
tcacacccctgccc

SEQ ID NO: 5514213 - DNA, 13 bp, Homo sapiens
tcacacccctgtc

SEQ ID NO: 5514214 - DNA, 15 bp, Homo sapiens
tcacacccctgtccc

SEQ ID NO: 5514215 - DNA, 18 bp, Homo sapiens
tcacaccctaccttcccc

SEQ ID NO: 5514216 - DNA, 19 bp, Homo sapiens
tcacaccctaccttcccca

SEQ ID NO: 5514217 - DNA, 22 bp, Homo sapiens
tcacaccctaccttccccagac

SEQ ID NO: 5514218 - DNA, 23 bp, Homo sapiens
tcacaccctaccttccccagact

SEQ ID NO: 5514219 - DNA, 15 bp, Homo sapiens
tcacaccctgcaagg

SEQ ID NO: 5514220 - DNA, 21 bp, Homo sapiens
tcacaccctgcaaggcccaca

SEQ ID NO: 5514221 - DNA, 16 bp, Homo sapiens
tcacaccggcactgtg

SEQ ID NO: 5514222 - DNA, 15 bp, Homo sapiens
tcacacctagcgtca

SEQ ID NO: 5514223 - DNA, 15 bp, Homo sapiens
tcacacctcactctt

SEQ ID NO: 5514224 - DNA, 22 bp, Homo sapiens
tcacacctcactctttatagtg

SEQ ID NO: 5514225 - DNA, 20 bp, Homo sapiens
tcacacctcactgtcatctg

SEQ ID NO: 5514226 - DNA, 23 bp, Homo sapiens
tcacacctcactgtcatctgcca

SEQ ID NO: 5514227 - DNA, 17 bp, Homo sapiens
tcacacctcagtgggaa

SEQ ID NO: 5514228 - DNA, 18 bp, Homo sapiens
tcacacctcagtgggaag

SEQ ID NO: 5514229 - DNA, 16 bp, Homo sapiens
tcacacctcccttcat

SEQ ID NO: 5514230 - DNA, 13 bp, Homo sapiens
tcacacctctggg

SEQ ID NO: 5514231 - DNA, 15 bp, Homo sapiens
tcacacctgacaaat

SEQ ID NO: 5514232 - DNA, 17 bp, Homo sapiens
tcacacctgactctgaa

SEQ ID NO: 5514233 - DNA, 18 bp, Homo sapiens
tcacacctgactctgaaa

SEQ ID NO: 5514234 - DNA, 16 bp, Homo sapiens
tcacacctgccctaaa

SEQ ID NO: 5514235 - DNA, 24 bp, Homo sapiens
tcacacctgggcccgggcaggcca

SEQ ID NO: 5514236 - DNA, 22 bp, Homo sapiens
tcacacctgtaatcccagcact

SEQ ID NO: 5514237 - DNA, 18 bp, Homo sapiens
tcacacctgtccttctca

SEQ ID NO: 5514238 - DNA, 22 bp, Homo sapiens
tcacacctgtccttctcaggct

SEQ ID NO: 5514239 - DNA, 18 bp, Homo sapiens
tcacaccttacaaagcca

SEQ ID NO: 5514240 - DNA, 23 bp, Homo sapiens
tcacaccttacaaagccagctct

SEQ ID NO: 5514241 - DNA, 12 bp, Homo sapiens
tcacacggccac

SEQ ID NO: 5514242 - DNA, 18 bp, Homo sapiens
tcacacggccacccgccc

SEQ ID NO: 5514243 - DNA, 21 bp, Homo sapiens
tcacacggcttgtgggcactg

SEQ ID NO: 5514244 - DNA, 17 bp, Homo sapiens
tcacacggggtatttta

SEQ ID NO: 5514245 - DNA, 22 bp, Homo sapiens
tcacacgtctggcttcacagat

SEQ ID NO: 5514246 - DNA, 19 bp, Homo sapiens
tcacacgtttaatcccagc

SEQ ID NO: 5514247 - DNA, 20 bp, Homo sapiens
tcacacgtttaatcccagca

SEQ ID NO: 5514248 - DNA, 21 bp, Homo sapiens
tcacacgtttaatcccagcac

SEQ ID NO: 5514249 - DNA, 15 bp, Homo sapiens
tcacactaaaattta

SEQ ID NO: 5514250 - DNA, 21 bp, Homo sapiens
tcacactaagagggcagactg

SEQ ID NO: 5514251 - DNA, 15 bp, Homo sapiens
tcacactacacatca

SEQ ID NO: 5514252 - DNA, 22 bp, Homo sapiens
tcacactactgtatttcattat

SEQ ID NO: 5514253 - DNA, 20 bp, Homo sapiens
tcacactacttgagaaaatg

SEQ ID NO: 5514254 - DNA, 13 bp, Homo sapiens
tcacactatttta

SEQ ID NO: 5514255 - DNA, 15 bp, Homo sapiens
tcacactcaaacttt

SEQ ID NO: 5514256 - DNA, 15 bp, Homo sapiens
tcacactcaaggaca

SEQ ID NO: 5514257 - DNA, 21 bp, Homo sapiens
tcacactcaaggacaggagcc

SEQ ID NO: 5514258 - DNA, 15 bp, Homo sapiens
tcacactcagaaaga

SEQ ID NO: 5514259 - DNA, 16 bp, Homo sapiens
tcacactcagaaagag

SEQ ID NO: 5514260 - DNA, 12 bp, Homo sapiens
tcacactcatcc

SEQ ID NO: 5514261 - DNA, 13 bp, Homo sapiens
tcacactcatcca

SEQ ID NO: 5514262 - DNA, 24 bp, Homo sapiens
tcacactccagaattacccttcct

SEQ ID NO: 5514263 - DNA, 17 bp, Homo sapiens
tcacactccccgcggtt

SEQ ID NO: 5514264 - DNA, 11 bp, Homo sapiens
tcacactccta

SEQ ID NO: 5514265 - DNA, 13 bp, Homo sapiens
tcacactcctcct

SEQ ID NO: 5514266 - DNA, 15 bp, Homo sapiens
tcacactcctcctgc

SEQ ID NO: 5514267 - DNA, 17 bp, Homo sapiens
tcacactcctcctgcca

SEQ ID NO: 5514268 - DNA, 19 bp, Homo sapiens
tcacactcctcctgccagc

SEQ ID NO: 5514269 - DNA, 22 bp, Homo sapiens
tcacactcctcctgccagctct

SEQ ID NO: 5514270 - DNA, 20 bp, Homo sapiens
tcacactcctgggctctgaa

SEQ ID NO: 5514271 - DNA, 18 bp, Homo sapiens
tcacactctaactgtata

SEQ ID NO: 5514272 - DNA, 12 bp, Homo sapiens
tcacactctctg

SEQ ID NO: 5514273 - DNA, 15 bp, Homo sapiens
tcacactctctgcag

SEQ ID NO: 5514274 - DNA, 19 bp, Homo sapiens
tcacactctcttcttactg

SEQ ID NO: 5514275 - DNA, 20 bp, Homo sapiens
tcacactgagaatgtaagaa

SEQ ID NO: 5514276 - DNA, 20 bp, Homo sapiens
tcacactgatacataaaaat

SEQ ID NO: 5514277 - DNA, 23 bp, Homo sapiens
tcacactgatacataaaaattaa

SEQ ID NO: 5514278 - DNA, 11 bp, Homo sapiens
tcacactgatg

SEQ ID NO: 5514279 - DNA, 20 bp, Homo sapiens
tcacactgatgggctggggc

SEQ ID NO: 5514280 - DNA, 21 bp, Homo sapiens
tcacactgcaagagccttggt

SEQ ID NO: 5514281 - DNA, 18 bp, Homo sapiens
tcacactgcagagactaa

SEQ ID NO: 5514282 - DNA, 18 bp, Homo sapiens
tcacactgcgcaggtctc

SEQ ID NO: 5514283 - DNA, 13 bp, Homo sapiens
tcacactgctggg

SEQ ID NO: 5514284 - DNA, 16 bp, Homo sapiens
tcacactgctgggaag

SEQ ID NO: 5514285 - DNA, 23 bp, Homo sapiens
tcacactgctgtcctctccccct

SEQ ID NO: 5514286 - DNA, 19 bp, Homo sapiens
tcacactggccacaaggac

SEQ ID NO: 5514287 - DNA, 22 bp, Homo sapiens
tcacactgggtggtggcctggt

SEQ ID NO: 5514288 - DNA, 17 bp, Homo sapiens
tcacactggtgctgagt

SEQ ID NO: 5514289 - DNA, 16 bp, Homo sapiens
tcacactggttctcaa

SEQ ID NO: 5514290 - DNA, 21 bp, Homo sapiens
tcacactggtttgccaggcca

SEQ ID NO: 5514291 - DNA, 14 bp, Homo sapiens
tcacactgtcttcc

SEQ ID NO: 5514292 - DNA, 21 bp, Homo sapiens
tcacactgtgcgttttagagt

SEQ ID NO: 5514293 - DNA, 20 bp, Homo sapiens
tcacactgtggaacactaaa

SEQ ID NO: 5514294 - DNA, 18 bp, Homo sapiens
tcacactgttactccaca

SEQ ID NO: 5514295 - DNA, 20 bp, Homo sapiens
tcacactgttactccacagc

SEQ ID NO: 5514296 - DNA, 23 bp, Homo sapiens
tcacactgttactccacagcgga

SEQ ID NO: 5514297 - DNA, 17 bp, Homo sapiens
tcacactgtttttcata

SEQ ID NO: 5514298 - DNA, 23 bp, Homo sapiens
tcacacttactgtaagacattag

SEQ ID NO: 5514299 - DNA, 21 bp, Homo sapiens
tcacacttcattgtaaatcac

SEQ ID NO: 5514300 - DNA, 16 bp, Homo sapiens
tcacacttctgtgaga

SEQ ID NO: 5514301 - DNA, 23 bp, Homo sapiens
tcacacttctgtgagacccccac

SEQ ID NO: 5514302 - DNA, 17 bp, Homo sapiens
tcacacttgcaaatgaa

SEQ ID NO: 5514303 - DNA, 23 bp, Homo sapiens
tcacacttggagctaattaaggt

SEQ ID NO: 5514304 - DNA, 24 bp, Homo sapiens
tcacacttgtaatcccagcaattt

SEQ ID NO: 5514305 - DNA, 11 bp, Homo sapiens
tcacacttgtg

SEQ ID NO: 5514306 - DNA, 13 bp, Homo sapiens
tcacacttgtttc

SEQ ID NO: 5514307 - DNA, 11 bp, Homo sapiens
tcacactttgc

SEQ ID NO: 5514308 - DNA, 17 bp, Homo sapiens
tcacacttttcagcaaa

SEQ ID NO: 5514309 - DNA, 20 bp, Homo sapiens
tcacagaaaggcaggtttca

SEQ ID NO: 5514310 - DNA, 21 bp, Homo sapiens
tcacagaaattatgatcctct

SEQ ID NO: 5514311 - DNA, 22 bp, Homo sapiens
tcacagaacctactgttccttt

SEQ ID NO: 5514312 - DNA, 18 bp, Homo sapiens
tcacagaagtagtggttt

SEQ ID NO: 5514313 - DNA, 16 bp, Homo sapiens
tcacagaatctccatt

SEQ ID NO: 5514314 - DNA, 14 bp, Homo sapiens
tcacagaccacagg

SEQ ID NO: 5514315 - DNA, 17 bp, Homo sapiens
tcacagaccccagctgg

SEQ ID NO: 5514316 - DNA, 14 bp, Homo sapiens
tcacagacctggag

SEQ ID NO: 5514317 - DNA, 18 bp, Homo sapiens
tcacagacctggagcccc

SEQ ID NO: 5514318 - DNA, 19 bp, Homo sapiens
tcacagacctggagcccct

SEQ ID NO: 5514319 - DNA, 22 bp, Homo sapiens
tcacagacctggagcccctggg

SEQ ID NO: 5514320 - DNA, 18 bp, Homo sapiens
tcacagactcttccacca

SEQ ID NO: 5514321 - DNA, 16 bp, Homo sapiens
tcacagactggagaca

SEQ ID NO: 5514322 - DNA, 13 bp, Homo sapiens
tcacagagaaaaa

SEQ ID NO: 5514323 - DNA, 11 bp, Homo sapiens
tcacagagaag

SEQ ID NO: 5514324 - DNA, 19 bp, Homo sapiens
tcacagagaagctcctgct

SEQ ID NO: 5514325 - DNA, 15 bp, Homo sapiens
tcacagagacacagg

SEQ ID NO: 5514326 - DNA, 23 bp, Homo sapiens
tcacagagacattcctccgagcc

SEQ ID NO: 5514327 - DNA, 12 bp, Homo sapiens
tcacagagagct

SEQ ID NO: 5514328 - DNA, 15 bp, Homo sapiens
tcacagagcagagtc

SEQ ID NO: 5514329 - DNA, 14 bp, Homo sapiens
tcacagagcagcaa

SEQ ID NO: 5514330 - DNA, 13 bp, Homo sapiens
tcacagagccact

SEQ ID NO: 5514331 - DNA, 22 bp, Homo sapiens
tcacagagccactcttcaagta

SEQ ID NO: 5514332 - DNA, 15 bp, Homo sapiens
tcacagaggaagaac

SEQ ID NO: 5514333 - DNA, 17 bp, Homo sapiens
tcacagagtcaaggcct

SEQ ID NO: 5514334 - DNA, 15 bp, Homo sapiens
tcacagagtgtgctg

SEQ ID NO: 5514335 - DNA, 19 bp, Homo sapiens
tcacagagtgtgctggagg

SEQ ID NO: 5514336 - DNA, 13 bp, Homo sapiens
tcacagatattta

SEQ ID NO: 5514337 - DNA, 18 bp, Homo sapiens
tcacagatcgcatttcct

SEQ ID NO: 5514338 - DNA, 16 bp, Homo sapiens
tcacagatgaggcccc

SEQ ID NO: 5514339 - DNA, 22 bp, Homo sapiens
tcacagatgagttatctaagaa

SEQ ID NO: 5514340 - DNA, 14 bp, Homo sapiens
tcacagatgctggc

SEQ ID NO: 5514341 - DNA, 17 bp, Homo sapiens
tcacagatgctggcctc

SEQ ID NO: 5514342 - DNA, 14 bp, Homo sapiens
tcacagatgggtgc

SEQ ID NO: 5514343 - DNA, 15 bp, Homo sapiens
tcacagatgggtgct

SEQ ID NO: 5514344 - DNA, 19 bp, Homo sapiens
tcacagatgtgcccagagt

SEQ ID NO: 5514345 - DNA, 20 bp, Homo sapiens
tcacagatgtgcccagagta

SEQ ID NO: 5514346 - DNA, 23 bp, Homo sapiens
tcacagatgtgtgattcacagtg

SEQ ID NO: 5514347 - DNA, 23 bp, Homo sapiens
tcacagatttttggtagtttctg

SEQ ID NO: 5514348 - DNA, 19 bp, Homo sapiens
tcacagattttttctttaa

SEQ ID NO: 5514349 - DNA, 17 bp, Homo sapiens
tcacagcaacactctac

SEQ ID NO: 5514350 - DNA, 16 bp, Homo sapiens
tcacagcaatatttaa

SEQ ID NO: 5514351 - DNA, 16 bp, Homo sapiens
tcacagcacactcagc

SEQ ID NO: 5514352 - DNA, 18 bp, Homo sapiens
tcacagcacagagaagac

SEQ ID NO: 5514353 - DNA, 13 bp, Homo sapiens
tcacagcacagta

SEQ ID NO: 5514354 - DNA, 19 bp, Homo sapiens
tcacagcacatgctggcca

SEQ ID NO: 5514355 - DNA, 20 bp, Homo sapiens
tcacagcacatgctggccag

SEQ ID NO: 5514356 - DNA, 21 bp, Homo sapiens
tcacagcacatgctggccagc

SEQ ID NO: 5514357 - DNA, 16 bp, Homo sapiens
tcacagcacatttgtt

SEQ ID NO: 5514358 - DNA, 14 bp, Homo sapiens
tcacagcagggcct

SEQ ID NO: 5514359 - DNA, 20 bp, Homo sapiens
tcacagcagggccttctgcc

SEQ ID NO: 5514360 - DNA, 16 bp, Homo sapiens
tcacagcagtcacagg

SEQ ID NO: 5514361 - DNA, 22 bp, Homo sapiens
tcacagcagtcacaggcccagg

SEQ ID NO: 5514362 - DNA, 14 bp, Homo sapiens
tcacagcatgtgca

SEQ ID NO: 5514363 - DNA, 21 bp, Homo sapiens
tcacagccacacctggactga

SEQ ID NO: 5514364 - DNA, 12 bp, Homo sapiens
tcacagccagcc

SEQ ID NO: 5514365 - DNA, 13 bp, Homo sapiens
tcacagccagccc

SEQ ID NO: 5514366 - DNA, 15 bp, Homo sapiens
tcacagccagcccag

SEQ ID NO: 5514367 - DNA, 16 bp, Homo sapiens
tcacagccagcccagc

SEQ ID NO: 5514368 - DNA, 18 bp, Homo sapiens
tcacagccagcccagctc

SEQ ID NO: 5514369 - DNA, 20 bp, Homo sapiens
tcacagccagcgaactgaca

SEQ ID NO: 5514370 - DNA, 22 bp, Homo sapiens
tcacagccaggcgctagcacag

SEQ ID NO: 5514371 - DNA, 13 bp, Homo sapiens
tcacagccatttc

SEQ ID NO: 5514372 - DNA, 16 bp, Homo sapiens
tcacagcccagaacca

SEQ ID NO: 5514373 - DNA, 13 bp, Homo sapiens
tcacagcccagcc

SEQ ID NO: 5514374 - DNA, 15 bp, Homo sapiens
tcacagccccaccct

SEQ ID NO: 5514375 - DNA, 22 bp, Homo sapiens
tcacagcccgggtgtgcctgcc

SEQ ID NO: 5514376 - DNA, 23 bp, Homo sapiens
tcacagccctgcttaccagataa

SEQ ID NO: 5514377 - DNA, 16 bp, Homo sapiens
tcacagccgtttgaat

SEQ ID NO: 5514378 - DNA, 16 bp, Homo sapiens
tcacagcctaggacca

SEQ ID NO: 5514379 - DNA, 20 bp, Homo sapiens
tcacagcctcaagtcactcc

SEQ ID NO: 5514380 - DNA, 21 bp, Homo sapiens
tcacagcctcacccctgcccc

SEQ ID NO: 5514381 - DNA, 19 bp, Homo sapiens
tcacagcctcctctgtctg

SEQ ID NO: 5514382 - DNA, 13 bp, Homo sapiens
tcacagcctctcc

SEQ ID NO: 5514383 - DNA, 12 bp, Homo sapiens
tcacagcctctg

SEQ ID NO: 5514384 - DNA, 13 bp, Homo sapiens
tcacagcctctga

SEQ ID NO: 5514385 - DNA, 18 bp, Homo sapiens
tcacagcctctgacccct

SEQ ID NO: 5514386 - DNA, 12 bp, Homo sapiens
tcacagccttgg

SEQ ID NO: 5514387 - DNA, 16 bp, Homo sapiens
tcacagccttggctcc

SEQ ID NO: 5514388 - DNA, 17 bp, Homo sapiens
tcacagcgcctcctgga

SEQ ID NO: 5514389 - DNA, 22 bp, Homo sapiens
tcacagcgcctcctggacctga

SEQ ID NO: 5514390 - DNA, 11 bp, Homo sapiens
tcacagctact

SEQ ID NO: 5514391 - DNA, 14 bp, Homo sapiens
tcacagctcctccc

SEQ ID NO: 5514392 - DNA, 16 bp, Homo sapiens
tcacagctcctcccac

SEQ ID NO: 5514393 - DNA, 14 bp, Homo sapiens
tcacagctcttgtt

SEQ ID NO: 5514394 - DNA, 11 bp, Homo sapiens
tcacagctgca

SEQ ID NO: 5514395 - DNA, 15 bp, Homo sapiens
tcacagctgcagctg

SEQ ID NO: 5514396 - DNA, 18 bp, Homo sapiens
tcacagctgcagctgggc

SEQ ID NO: 5514397 - DNA, 13 bp, Homo sapiens
tcacagctggaga

SEQ ID NO: 5514398 - DNA, 22 bp, Homo sapiens
tcacagcttatttcctcatttt

SEQ ID NO: 5514399 - DNA, 16 bp, Homo sapiens
tcacagcttcagccag

SEQ ID NO: 5514400 - DNA, 17 bp, Homo sapiens
tcacagcttcagccagg

SEQ ID NO: 5514401 - DNA, 15 bp, Homo sapiens
tcacagcttctccaa

SEQ ID NO: 5514402 - DNA, 17 bp, Homo sapiens
tcacagcttgttttgga

SEQ ID NO: 5514403 - DNA, 16 bp, Homo sapiens
tcacagctttcccagg

SEQ ID NO: 5514404 - DNA, 16 bp, Homo sapiens
tcacagcttttcttga

SEQ ID NO: 5514405 - DNA, 19 bp, Homo sapiens
tcacagcttttcttgatag

SEQ ID NO: 5514406 - DNA, 14 bp, Homo sapiens
tcacaggaagtaga

SEQ ID NO: 5514407 - DNA, 22 bp, Homo sapiens
tcacaggacgatttcactgaca

SEQ ID NO: 5514408 - DNA, 17 bp, Homo sapiens
tcacaggactctgcaga

SEQ ID NO: 5514409 - DNA, 12 bp, Homo sapiens
tcacaggagcag

SEQ ID NO: 5514410 - DNA, 18 bp, Homo sapiens
tcacaggaggccagtggg

SEQ ID NO: 5514411 - DNA, 19 bp, Homo sapiens
tcacaggagggagggggaa

SEQ ID NO: 5514412 - DNA, 23 bp, Homo sapiens
tcacaggagttggttagaatttc

SEQ ID NO: 5514413 - DNA, 14 bp, Homo sapiens
tcacaggatgccag

SEQ ID NO: 5514414 - DNA, 17 bp, Homo sapiens
tcacaggatgccagccc

SEQ ID NO: 5514415 - DNA, 22 bp, Homo sapiens
tcacaggatgccagcccctgcc

SEQ ID NO: 5514416 - DNA, 23 bp, Homo sapiens
tcacaggcagccagtgccctgag

SEQ ID NO: 5514417 - DNA, 19 bp, Homo sapiens
tcacaggcagctctgagcc

SEQ ID NO: 5514418 - DNA, 16 bp, Homo sapiens
tcacaggcaggtccag

SEQ ID NO: 5514419 - DNA, 17 bp, Homo sapiens
tcacaggcagtgcatgt

SEQ ID NO: 5514420 - DNA, 22 bp, Homo sapiens
tcacaggcatattccctgcaca

SEQ ID NO: 5514421 - DNA, 23 bp, Homo sapiens
tcacaggccagatgttgttcctg

SEQ ID NO: 5514422 - DNA, 12 bp, Homo sapiens
tcacaggcccag

SEQ ID NO: 5514423 - DNA, 13 bp, Homo sapiens
tcacaggcccaga

SEQ ID NO: 5514424 - DNA, 15 bp, Homo sapiens
tcacaggcccagaag

SEQ ID NO: 5514425 - DNA, 16 bp, Homo sapiens
tcacaggcctctcttt

SEQ ID NO: 5514426 - DNA, 12 bp, Homo sapiens
tcacaggctaat

SEQ ID NO: 5514427 - DNA, 14 bp, Homo sapiens
tcacaggctgagaa

SEQ ID NO: 5514428 - DNA, 14 bp, Homo sapiens
tcacaggctgtaaa

SEQ ID NO: 5514429 - DNA, 23 bp, Homo sapiens
tcacagggaatggccacaaacct

SEQ ID NO: 5514430 - DNA, 17 bp, Homo sapiens
tcacagggacagatctg

SEQ ID NO: 5514431 - DNA, 14 bp, Homo sapiens
tcacagggagctgg

SEQ ID NO: 5514432 - DNA, 14 bp, Homo sapiens
tcacagggatgctg

SEQ ID NO: 5514433 - DNA, 16 bp, Homo sapiens
tcacagggatgctggt

SEQ ID NO: 5514434 - DNA, 11 bp, Homo sapiens
tcacagggcag

SEQ ID NO: 5514435 - DNA, 12 bp, Homo sapiens
tcacagggccaa

SEQ ID NO: 5514436 - DNA, 16 bp, Homo sapiens
tcacagggccccagaa

SEQ ID NO: 5514437 - DNA, 15 bp, Homo sapiens
tcacaggggcggggc

SEQ ID NO: 5514438 - DNA, 16 bp, Homo sapiens
tcacagggtgggcctc

SEQ ID NO: 5514439 - DNA, 18 bp, Homo sapiens
tcacagggtgttggaaga

SEQ ID NO: 5514440 - DNA, 17 bp, Homo sapiens
tcacagggttgggccca

SEQ ID NO: 5514441 - DNA, 23 bp, Homo sapiens
tcacagggttgggcccagatctg

SEQ ID NO: 5514442 - DNA, 16 bp, Homo sapiens
tcacaggtgactctaa

SEQ ID NO: 5514443 - DNA, 21 bp, Homo sapiens
tcacaggttggaagagaatca

SEQ ID NO: 5514444 - DNA, 20 bp, Homo sapiens
tcacaggttttatgtgttct

SEQ ID NO: 5514445 - DNA, 16 bp, Homo sapiens
tcacagtaaaaataaa

SEQ ID NO: 5514446 - DNA, 18 bp, Homo sapiens
tcacagtaaaaataaaat

SEQ ID NO: 5514447 - DNA, 21 bp, Homo sapiens
tcacagtaaaaataaaatact

SEQ ID NO: 5514448 - DNA, 13 bp, Homo sapiens
tcacagtaaccca

SEQ ID NO: 5514449 - DNA, 17 bp, Homo sapiens
tcacagtaatgcaagca

SEQ ID NO: 5514450 - DNA, 17 bp, Homo sapiens
tcacagtacaatgtttc

SEQ ID NO: 5514451 - DNA, 19 bp, Homo sapiens
tcacagtacagcatgtgcc

SEQ ID NO: 5514452 - DNA, 18 bp, Homo sapiens
tcacagtacttcccaaca

SEQ ID NO: 5514453 - DNA, 17 bp, Homo sapiens
tcacagtactttccagc

SEQ ID NO: 5514454 - DNA, 21 bp, Homo sapiens
tcacagtactttccagcagtc

SEQ ID NO: 5514455 - DNA, 16 bp, Homo sapiens
tcacagtagagccagc

SEQ ID NO: 5514456 - DNA, 20 bp, Homo sapiens
tcacagtagagccagcttgg

SEQ ID NO: 5514457 - DNA, 14 bp, Homo sapiens
tcacagtattgctc

SEQ ID NO: 5514458 - DNA, 19 bp, Homo sapiens
tcacagtcacatgcttgat

SEQ ID NO: 5514459 - DNA, 16 bp, Homo sapiens
tcacagtccaaccaga

SEQ ID NO: 5514460 - DNA, 19 bp, Homo sapiens
tcacagtctcagttctctt

SEQ ID NO: 5514461 - DNA, 16 bp, Homo sapiens
tcacagtctctggaaa

SEQ ID NO: 5514462 - DNA, 21 bp, Homo sapiens
tcacagtgaacataactgtaa

SEQ ID NO: 5514463 - DNA, 16 bp, Homo sapiens
tcacagtgaagtgcct

SEQ ID NO: 5514464 - DNA, 23 bp, Homo sapiens
tcacagtgaagtgcctttttcct

SEQ ID NO: 5514465 - DNA, 16 bp, Homo sapiens
tcacagtgacccttcc

SEQ ID NO: 5514466 - DNA, 12 bp, Homo sapiens
tcacagtgcagc

SEQ ID NO: 5514467 - DNA, 22 bp, Homo sapiens
tcacagtgcagcttgcagtccg

SEQ ID NO: 5514468 - DNA, 15 bp, Homo sapiens
tcacagtgcccaaga

SEQ ID NO: 5514469 - DNA, 13 bp, Homo sapiens
tcacagtgctgag

SEQ ID NO: 5514470 - DNA, 18 bp, Homo sapiens
tcacagtggcgagaggag

SEQ ID NO: 5514471 - DNA, 22 bp, Homo sapiens
tcacagtggcgagaggagagga

SEQ ID NO: 5514472 - DNA, 16 bp, Homo sapiens
tcacagtgggaagaat

SEQ ID NO: 5514473 - DNA, 17 bp, Homo sapiens
tcacagtgggaagaata

SEQ ID NO: 5514474 - DNA, 18 bp, Homo sapiens
tcacagtgggaagaatag

SEQ ID NO: 5514475 - DNA, 14 bp, Homo sapiens
tcacagtgggcggc

SEQ ID NO: 5514476 - DNA, 21 bp, Homo sapiens
tcacagtgggcggcttccctg

SEQ ID NO: 5514477 - DNA, 16 bp, Homo sapiens
tcacagtgtgattttg

SEQ ID NO: 5514478 - DNA, 16 bp, Homo sapiens
tcacagtgttatgtag

SEQ ID NO: 5514479 - DNA, 16 bp, Homo sapiens
tcacagtgtttacact

SEQ ID NO: 5514480 - DNA, 14 bp, Homo sapiens
tcacagtgtttcga

SEQ ID NO: 5514481 - DNA, 14 bp, Homo sapiens
tcacagtgtttctt

SEQ ID NO: 5514482 - DNA, 15 bp, Homo sapiens
tcacagtgtttctta

SEQ ID NO: 5514483 - DNA, 14 bp, Homo sapiens
tcacagtgtttgca

SEQ ID NO: 5514484 - DNA, 18 bp, Homo sapiens
tcacagtgtttgcaatgg

SEQ ID NO: 5514485 - DNA, 14 bp, Homo sapiens
tcacagttcctcgc

SEQ ID NO: 5514486 - DNA, 22 bp, Homo sapiens
tcacagttcctcgccctgggtc

SEQ ID NO: 5514487 - DNA, 12 bp, Homo sapiens
tcacagttctgt

SEQ ID NO: 5514488 - DNA, 13 bp, Homo sapiens
tcacagttgacaa

SEQ ID NO: 5514489 - DNA, 17 bp, Homo sapiens
tcacagttggccttcag

SEQ ID NO: 5514490 - DNA, 17 bp, Homo sapiens
tcacagtttgaaataag

SEQ ID NO: 5514491 - DNA, 17 bp, Homo sapiens
tcacagtttgttcagtg

SEQ ID NO: 5514492 - DNA, 21 bp, Homo sapiens
tcacagttttggttgctttaa

SEQ ID NO: 5514493 - DNA, 23 bp, Homo sapiens
tcacagttttggttgctttaata

SEQ ID NO: 5514494 - DNA, 23 bp, Homo sapiens
tcacataaaaaagaagcactttg

SEQ ID NO: 5514495 - DNA, 17 bp, Homo sapiens
tcacataaaacctcatt

SEQ ID NO: 5514496 - DNA, 18 bp, Homo sapiens
tcacataaagaaattcaa

SEQ ID NO: 5514497 - DNA, 20 bp, Homo sapiens
tcacataaagaaattcaaga

SEQ ID NO: 5514498 - DNA, 18 bp, Homo sapiens
tcacataaatgcagccca

SEQ ID NO: 5514499 - DNA, 19 bp, Homo sapiens
tcacataaatgcagcccat

SEQ ID NO: 5514500 - DNA, 20 bp, Homo sapiens
tcacataaatggattaatta

SEQ ID NO: 5514501 - DNA, 18 bp, Homo sapiens
tcacataaccccttgaaa

SEQ ID NO: 5514502 - DNA, 23 bp, Homo sapiens
tcacataataaacgatgttgtga

SEQ ID NO: 5514503 - DNA, 15 bp, Homo sapiens
tcacatacaatttgc

SEQ ID NO: 5514504 - DNA, 19 bp, Homo sapiens
tcacatacaatttgcactg

SEQ ID NO: 5514505 - DNA, 21 bp, Homo sapiens
tcacatacaatttgcactgtt

SEQ ID NO: 5514506 - DNA, 15 bp, Homo sapiens
tcacataccctcccc

SEQ ID NO: 5514507 - DNA, 18 bp, Homo sapiens
tcacatagagatcatcct

SEQ ID NO: 5514508 - DNA, 17 bp, Homo sapiens
tcacatagagtgatctt

SEQ ID NO: 5514509 - DNA, 15 bp, Homo sapiens
tcacatagatgtccc

SEQ ID NO: 5514510 - DNA, 20 bp, Homo sapiens
tcacatagccaactctccca

SEQ ID NO: 5514511 - DNA, 19 bp, Homo sapiens
tcacatagcccacttacat

SEQ ID NO: 5514512 - DNA, 21 bp, Homo sapiens
tcacatagctacccaaaagag

SEQ ID NO: 5514513 - DNA, 14 bp, Homo sapiens
tcacatagctggga

SEQ ID NO: 5514514 - DNA, 21 bp, Homo sapiens
tcacataggaagggatctgag

SEQ ID NO: 5514515 - DNA, 22 bp, Homo sapiens
tcacataggaagggatctgaga

SEQ ID NO: 5514516 - DNA, 15 bp, Homo sapiens
tcaccctcatgaaaa

SEQ ID NO: 5514517 - DNA, 14 bp, Homo sapiens
tcaccctccacttc

SEQ ID NO: 5514518 - DNA, 15 bp, Homo sapiens
tcaccctccacttcc

SEQ ID NO: 5514519 - DNA, 14 bp, Homo sapiens
tcaccctcctgagc

SEQ ID NO: 5514520 - DNA, 17 bp, Homo sapiens
tcaccctcctgagcctc

SEQ ID NO: 5514521 - DNA, 20 bp, Homo sapiens
tcaccctcctgagcctcacc

SEQ ID NO: 5514522 - DNA, 20 bp, Homo sapiens
tcaccctctgtccccacgag

SEQ ID NO: 5514523 - DNA, 20 bp, Homo sapiens
tcaccctctgtccttccccc

SEQ ID NO: 5514524 - DNA, 18 bp, Homo sapiens
tcaccctcttcctgtgat

SEQ ID NO: 5514525 - DNA, 14 bp, Homo sapiens
tcaccctgactgtg

SEQ ID NO: 5514526 - DNA, 13 bp, Homo sapiens
tcaccctgagccc

SEQ ID NO: 5514527 - DNA, 13 bp, Homo sapiens
tcaccctgcagag

SEQ ID NO: 5514528 - DNA, 16 bp, Homo sapiens
tcaccctgcaggactt

SEQ ID NO: 5514529 - DNA, 13 bp, Homo sapiens
tcaccctgccacc

SEQ ID NO: 5514530 - DNA, 19 bp, Homo sapiens
tcaccctgccaccctctgc

SEQ ID NO: 5514531 - DNA, 20 bp, Homo sapiens
tcaccctgcccgctcccaac

SEQ ID NO: 5514532 - DNA, 21 bp, Homo sapiens
tcaccctgcccgctcccaacc

SEQ ID NO: 5514533 - DNA, 15 bp, Homo sapiens
tcaccctgccttatc

SEQ ID NO: 5514534 - DNA, 12 bp, Homo sapiens
tcaccctgcttg

SEQ ID NO: 5514535 - DNA, 19 bp, Homo sapiens
tcaccctgcttggggcctg

SEQ ID NO: 5514536 - DNA, 20 bp, Homo sapiens
tcaccctgcttggggcctgg

SEQ ID NO: 5514537 - DNA, 15 bp, Homo sapiens
tcaccctggccacca

SEQ ID NO: 5514538 - DNA, 13 bp, Homo sapiens
tcaccctggcccc

SEQ ID NO: 5514539 - DNA, 15 bp, Homo sapiens
tcaccctggggctgc

SEQ ID NO: 5514540 - DNA, 23 bp, Homo sapiens
tcaccctgtaatggttgggacca

SEQ ID NO: 5514541 - DNA, 13 bp, Homo sapiens
tcaccctgtcaag

SEQ ID NO: 5514542 - DNA, 13 bp, Homo sapiens
tcaccctgtgaaa

SEQ ID NO: 5514543 - DNA, 22 bp, Homo sapiens
tcaccctgtgggaccgcctggc

SEQ ID NO: 5514544 - DNA, 21 bp, Homo sapiens
tcacccttaaaattctcctgt

SEQ ID NO: 5514545 - DNA, 17 bp, Homo sapiens
tcacccttaacccaagg

SEQ ID NO: 5514546 - DNA, 18 bp, Homo sapiens
tcacccttaacccaagga

SEQ ID NO: 5514547 - DNA, 22 bp, Homo sapiens
tcacccttaacccaaggagcac

SEQ ID NO: 5514548 - DNA, 11 bp, Homo sapiens
tcacccttccc

SEQ ID NO: 5514549 - DNA, 13 bp, Homo sapiens
tcacccttcctgg

SEQ ID NO: 5514550 - DNA, 16 bp, Homo sapiens
tcacccttcctggccc

SEQ ID NO: 5514551 - DNA, 18 bp, Homo sapiens
tcacccttcctggcccag

SEQ ID NO: 5514552 - DNA, 19 bp, Homo sapiens
tcacccttcctggcccagg

SEQ ID NO: 5514553 - DNA, 21 bp, Homo sapiens
tcacccttcctggcccaggcc

SEQ ID NO: 5514554 - DNA, 11 bp, Homo sapiens
tcacccttggc

SEQ ID NO: 5514555 - DNA, 12 bp, Homo sapiens
tcacccttttct

SEQ ID NO: 5514556 - DNA, 15 bp, Homo sapiens
tcaccgaaaacgtgg

SEQ ID NO: 5514557 - DNA, 19 bp, Homo sapiens
tcaccgaaaacgtggctgc

SEQ ID NO: 5514558 - DNA, 20 bp, Homo sapiens
tcaccgaaaacgtggctgct

SEQ ID NO: 5514559 - DNA, 17 bp, Homo sapiens
tcaccgacgcgtctcct

SEQ ID NO: 5514560 - DNA, 22 bp, Homo sapiens
tcaccgactgaaaatattgttt

SEQ ID NO: 5514561 - DNA, 19 bp, Homo sapiens
tcaccgacttattctgatt

SEQ ID NO: 5514562 - DNA, 20 bp, Homo sapiens
tcaccgagacggctggacct

SEQ ID NO: 5514563 - DNA, 21 bp, Homo sapiens
tcaccgagacggctggacctg

SEQ ID NO: 5514564 - DNA, 17 bp, Homo sapiens
tcaccgagactcagcct

SEQ ID NO: 5514565 - DNA, 19 bp, Homo sapiens
tcaccgagactcagcctct

SEQ ID NO: 5514566 - DNA, 14 bp, Homo sapiens
tcaccgattcttcc

SEQ ID NO: 5514567 - DNA, 17 bp, Homo sapiens
tcaccgattcttccttg

SEQ ID NO: 5514568 - DNA, 14 bp, Homo sapiens
tcaccgcaggtgct

SEQ ID NO: 5514569 - DNA, 14 bp, Homo sapiens
tcaccgcattccag

SEQ ID NO: 5514570 - DNA, 16 bp, Homo sapiens
tcaccgcattccaggg

SEQ ID NO: 5514571 - DNA, 18 bp, Homo sapiens
tcaccgcattccaggggc

SEQ ID NO: 5514572 - DNA, 21 bp, Homo sapiens
tcaccgcattccaggggctgc

SEQ ID NO: 5514573 - DNA, 16 bp, Homo sapiens
tcaccgccgtggggtg

SEQ ID NO: 5514574 - DNA, 21 bp, Homo sapiens
tcaccgcctgctacacaggca

SEQ ID NO: 5514575 - DNA, 23 bp, Homo sapiens
tcaccgcctgctacacaggcagg

SEQ ID NO: 5514576 - DNA, 21 bp, Homo sapiens
tcaccgcggacgtgctggcct

SEQ ID NO: 5514577 - DNA, 22 bp, Homo sapiens
tcaccgcggacgtgctggcctt

SEQ ID NO: 5514578 - DNA, 14 bp, Homo sapiens
tcaccgcggctgga

SEQ ID NO: 5514579 - DNA, 17 bp, Homo sapiens
tcaccgcggctggatgg

SEQ ID NO: 5514580 - DNA, 16 bp, Homo sapiens
tcaccgctcaccctcc

SEQ ID NO: 5514581 - DNA, 12 bp, Homo sapiens
tcaccgctgggt

SEQ ID NO: 5514582 - DNA, 14 bp, Homo sapiens
tcaccggagctttc

SEQ ID NO: 5514583 - DNA, 23 bp, Homo sapiens
tcaccggagctttcaaagaagga

SEQ ID NO: 5514584 - DNA, 13 bp, Homo sapiens
tcaccggaggagc

SEQ ID NO: 5514585 - DNA, 16 bp, Homo sapiens
tcaccggcatgctggc

SEQ ID NO: 5514586 - DNA, 18 bp, Homo sapiens
tcaccggcatgctggcct

SEQ ID NO: 5514587 - DNA, 19 bp, Homo sapiens
tcaccggccgatggagaca

SEQ ID NO: 5514588 - DNA, 20 bp, Homo sapiens
tcaccgggagggctgctggg

SEQ ID NO: 5514589 - DNA, 19 bp, Homo sapiens
tcaccgtattagccaggat

SEQ ID NO: 5514590 - DNA, 22 bp, Homo sapiens
tcaccgtcattgatggagcctg

SEQ ID NO: 5514591 - DNA, 16 bp, Homo sapiens
tcaccgtgcagagctg

SEQ ID NO: 5514592 - DNA, 14 bp, Homo sapiens
tcaccgtggctacc

SEQ ID NO: 5514593 - DNA, 19 bp, Homo sapiens
tcaccgtgggctccctgac

SEQ ID NO: 5514594 - DNA, 16 bp, Homo sapiens
tcacctaaaccctctg

SEQ ID NO: 5514595 - DNA, 18 bp, Homo sapiens
tcacctaaaccctctgtg

SEQ ID NO: 5514596 - DNA, 20 bp, Homo sapiens
tcacctaaaccctctgtgaa

SEQ ID NO: 5514597 - DNA, 22 bp, Homo sapiens
tcacctaactcatactgtgctg

SEQ ID NO: 5514598 - DNA, 22 bp, Homo sapiens
tcacctaagagattctgatttg

SEQ ID NO: 5514599 - DNA, 21 bp, Homo sapiens
tcacctaatgtttatgagcca

SEQ ID NO: 5514600 - DNA, 17 bp, Homo sapiens
tcacctaattaatttca

SEQ ID NO: 5514601 - DNA, 15 bp, Homo sapiens
tcacctacaggactg

SEQ ID NO: 5514602 - DNA, 22 bp, Homo sapiens
tcacctacatatgctgatcttt

SEQ ID NO: 5514603 - DNA, 23 bp, Homo sapiens
tcacctactcaatgcctggagac

SEQ ID NO: 5514604 - DNA, 17 bp, Homo sapiens
tcacctacttcctcctc

SEQ ID NO: 5514605 - DNA, 19 bp, Homo sapiens
tcacctacttcctcctcct

SEQ ID NO: 5514606 - DNA, 15 bp, Homo sapiens
tcacctagaaattga

SEQ ID NO: 5514607 - DNA, 20 bp, Homo sapiens
tcacctagaacgtgcatcct

SEQ ID NO: 5514608 - DNA, 15 bp, Homo sapiens
tcacctagaccttgc

SEQ ID NO: 5514609 - DNA, 21 bp, Homo sapiens
tcacctagaccttgcctcccc

SEQ ID NO: 5514610 - DNA, 18 bp, Homo sapiens
tcacctagagccagacca

SEQ ID NO: 5514611 - DNA, 16 bp, Homo sapiens
tcacctagctgaatgt

SEQ ID NO: 5514612 - DNA, 20 bp, Homo sapiens
tcacctagctgaatgttttt

SEQ ID NO: 5514613 - DNA, 22 bp, Homo sapiens
tcacctagctgaatgtttttct

SEQ ID NO: 5514614 - DNA, 14 bp, Homo sapiens
tcacctaggaagcc

SEQ ID NO: 5514615 - DNA, 15 bp, Homo sapiens
tcacctaggaagcct

SEQ ID NO: 5514616 - DNA, 19 bp, Homo sapiens
tcacctaggaagcctcaga

SEQ ID NO: 5514617 - DNA, 16 bp, Homo sapiens
tcacctatctggaaaa

SEQ ID NO: 5514618 - DNA, 14 bp, Homo sapiens
tcacctcactcagc

SEQ ID NO: 5514619 - DNA, 21 bp, Homo sapiens
tcacctcactcagcaccactc

SEQ ID NO: 5514620 - DNA, 17 bp, Homo sapiens
tcacctcagatggcagc

SEQ ID NO: 5514621 - DNA, 20 bp, Homo sapiens
tcacctcagatggcagcttt

SEQ ID NO: 5514622 - DNA, 21 bp, Homo sapiens
tcacctcagatggcagctttt

SEQ ID NO: 5514623 - DNA, 23 bp, Homo sapiens
tcacctcagatggcagcttttaa

SEQ ID NO: 5514624 - DNA, 12 bp, Homo sapiens
tcacctcagcac

SEQ ID NO: 5514625 - DNA, 13 bp, Homo sapiens
tcacctcagcctc

SEQ ID NO: 5514626 - DNA, 15 bp, Homo sapiens
tcacctcagcctgga

SEQ ID NO: 5514627 - DNA, 16 bp, Homo sapiens
tcacctcagcctggag

SEQ ID NO: 5514628 - DNA, 20 bp, Homo sapiens
tcacctcagcctggagaggc

SEQ ID NO: 5514629 - DNA, 18 bp, Homo sapiens
tcacctcaggccaggtgc

SEQ ID NO: 5514630 - DNA, 17 bp, Homo sapiens
tcacctcagtagaaaag

SEQ ID NO: 5514631 - DNA, 13 bp, Homo sapiens
tcacctcatgccc

SEQ ID NO: 5514632 - DNA, 20 bp, Homo sapiens
tcacctcatgcccaccccct

SEQ ID NO: 5514633 - DNA, 12 bp, Homo sapiens
tcacctcatgga

SEQ ID NO: 5514634 - DNA, 13 bp, Homo sapiens
tcacctcatggaa

SEQ ID NO: 5514635 - DNA, 20 bp, Homo sapiens
tcacctccaagcatttcatg

SEQ ID NO: 5514636 - DNA, 17 bp, Homo sapiens
tcacctccatatcagaa

SEQ ID NO: 5514637 - DNA, 15 bp, Homo sapiens
tcacctccatgtcat

SEQ ID NO: 5514638 - DNA, 15 bp, Homo sapiens
tcacctcccagggct

SEQ ID NO: 5514639 - DNA, 14 bp, Homo sapiens
tcacctccccacat

SEQ ID NO: 5514640 - DNA, 13 bp, Homo sapiens
tcacctcccctcc

SEQ ID NO: 5514641 - DNA, 17 bp, Homo sapiens
tcacctccctgctcagt

SEQ ID NO: 5514642 - DNA, 17 bp, Homo sapiens
tcacctcctccactcac

SEQ ID NO: 5514643 - DNA, 21 bp, Homo sapiens
tcacctcctccactcactcca

SEQ ID NO: 5514644 - DNA, 13 bp, Homo sapiens
tcacctcctgctg

SEQ ID NO: 5514645 - DNA, 16 bp, Homo sapiens
tcacctccttccccag

SEQ ID NO: 5514646 - DNA, 17 bp, Homo sapiens
tcacctccttccccagc

SEQ ID NO: 5514647 - DNA, 20 bp, Homo sapiens
tcacctccttccccagctcc

SEQ ID NO: 5514648 - DNA, 22 bp, Homo sapiens
tcacctccttccccagctcccc

SEQ ID NO: 5514649 - DNA, 21 bp, Homo sapiens
tcacctccttctgcagtcaga

SEQ ID NO: 5514650 - DNA, 22 bp, Homo sapiens
tcacctcggagggatggagaaa

SEQ ID NO: 5514651 - DNA, 23 bp, Homo sapiens
tcacctctaggtccccatactcc

SEQ ID NO: 5514652 - DNA, 18 bp, Homo sapiens
tcacctctcagctgctgg

SEQ ID NO: 5514653 - DNA, 15 bp, Homo sapiens
tcacctctcccttgg

SEQ ID NO: 5514654 - DNA, 13 bp, Homo sapiens
tcacctctctcag

SEQ ID NO: 5514655 - DNA, 15 bp, Homo sapiens
tcacctctctcagag

SEQ ID NO: 5514656 - DNA, 22 bp, Homo sapiens
tcacctctcttcagcccctagt

SEQ ID NO: 5514657 - DNA, 10 bp, Homo sapiens
tcacctctga

SEQ ID NO: 5514658 - DNA, 14 bp, Homo sapiens
tcacctctgaggac

SEQ ID NO: 5514659 - DNA, 23 bp, Homo sapiens
tcacctctgatagactttgtgaa

SEQ ID NO: 5514660 - DNA, 13 bp, Homo sapiens
tcacctctgcctc

SEQ ID NO: 5514661 - DNA, 14 bp, Homo sapiens
tcacctctgcctca

SEQ ID NO: 5514662 - DNA, 12 bp, Homo sapiens
tcacctctgcta

SEQ ID NO: 5514663 - DNA, 18 bp, Homo sapiens
tcacctctggactggcta

SEQ ID NO: 5514664 - DNA, 19 bp, Homo sapiens
tcacctctggctttgtctc

SEQ ID NO: 5514665 - DNA, 13 bp, Homo sapiens
tcacctctgtaat

SEQ ID NO: 5514666 - DNA, 15 bp, Homo sapiens
tcacctctgtgaccc

SEQ ID NO: 5514667 - DNA, 13 bp, Homo sapiens
tcacctctgttaa

SEQ ID NO: 5514668 - DNA, 17 bp, Homo sapiens
tcacctcttaaagaaaa

SEQ ID NO: 5514669 - DNA, 14 bp, Homo sapiens
tcacctcttccgac

SEQ ID NO: 5514670 - DNA, 13 bp, Homo sapiens
tcacctcttcctc

SEQ ID NO: 5514671 - DNA, 17 bp, Homo sapiens
tcacctcttcctctggt

SEQ ID NO: 5514672 - DNA, 16 bp, Homo sapiens
tcacctctttgctccc

SEQ ID NO: 5514673 - DNA, 15 bp, Homo sapiens
tcacctgaaacactg

SEQ ID NO: 5514674 - DNA, 22 bp, Homo sapiens
tcacctgaaacactggacctgg

SEQ ID NO: 5514675 - DNA, 13 bp, Homo sapiens
tcacctgaaatgc

SEQ ID NO: 5514676 - DNA, 22 bp, Homo sapiens
tcacctgaaccccagaggcaga

SEQ ID NO: 5514677 - DNA, 23 bp, Homo sapiens
tcacctgaaccccagaggcagag

SEQ ID NO: 5514678 - DNA, 19 bp, Homo sapiens
tcacctgaagactcattct

SEQ ID NO: 5514679 - DNA, 19 bp, Homo sapiens
tcacctgaataagggactt

SEQ ID NO: 5514680 - DNA, 22 bp, Homo sapiens
tcacctgaataagggactttgg

SEQ ID NO: 5514681 - DNA, 15 bp, Homo sapiens
tcacctgaattatta

SEQ ID NO: 5514682 - DNA, 20 bp, Homo sapiens
tcacctgaattcgagacagg

SEQ ID NO: 5514683 - DNA, 18 bp, Homo sapiens
tcacctgacattaattat

SEQ ID NO: 5514684 - DNA, 14 bp, Homo sapiens
tcacctgacctctg

SEQ ID NO: 5514685 - DNA, 16 bp, Homo sapiens
tcacctgagacctcca

SEQ ID NO: 5514686 - DNA, 12 bp, Homo sapiens
tcacctgaggtc

SEQ ID NO: 5514687 - DNA, 23 bp, Homo sapiens
tcacctgaggtcaggagttcaag

SEQ ID NO: 5514688 - DNA, 21 bp, Homo sapiens
tcacctgattcaactaaaaaa

SEQ ID NO: 5514689 - DNA, 15 bp, Homo sapiens
tcacctgcaagcccc

SEQ ID NO: 5514690 - DNA, 18 bp, Homo sapiens
tcacctgcaagccccagg

SEQ ID NO: 5514691 - DNA, 21 bp, Homo sapiens
tcacctgcaagccccagggcc

SEQ ID NO: 5514692 - DNA, 15 bp, Homo sapiens
tcacctgcagagaaa

SEQ ID NO: 5514693 - DNA, 16 bp, Homo sapiens
tcacctgcagagaaac

SEQ ID NO: 5514694 - DNA, 13 bp, Homo sapiens
tcacgtggcctcc

SEQ ID NO: 5514695 - DNA, 22 bp, Homo sapiens
tcacgtggcctccgcagtgtct

SEQ ID NO: 5514696 - DNA, 17 bp, Homo sapiens
tcacgtgtactggctcc

SEQ ID NO: 5514697 - DNA, 19 bp, Homo sapiens
tcacgtgttttccatccca

SEQ ID NO: 5514698 - DNA, 13 bp, Homo sapiens
tcacgttggtctt

SEQ ID NO: 5514699 - DNA, 16 bp, Homo sapiens
tcacgttttctttaca

SEQ ID NO: 5514700 - DNA, 16 bp, Homo sapiens
tcactaaaagcatgaa

SEQ ID NO: 5514701 - DNA, 15 bp, Homo sapiens
tcactaaaagtgtgt

SEQ ID NO: 5514702 - DNA, 20 bp, Homo sapiens
tcactaaaccgataatgcat

SEQ ID NO: 5514703 - DNA, 23 bp, Homo sapiens
tcactaaaccgataatgcatgaa

SEQ ID NO: 5514704 - DNA, 15 bp, Homo sapiens
tcactaaactttatt

SEQ ID NO: 5514705 - DNA, 15 bp, Homo sapiens
tcactaaagcatgaa

SEQ ID NO: 5514706 - DNA, 18 bp, Homo sapiens
tcactaaagcatgaaatg

SEQ ID NO: 5514707 - DNA, 23 bp, Homo sapiens
tcactaaagcatgaaatgtgaat

SEQ ID NO: 5514708 - DNA, 15 bp, Homo sapiens
tcactaaagtgtcat

SEQ ID NO: 5514709 - DNA, 20 bp, Homo sapiens
tcactaaatatctagtgcta

SEQ ID NO: 5514710 - DNA, 22 bp, Homo sapiens
tcactaaatatctagtgctaaa

SEQ ID NO: 5514711 - DNA, 15 bp, Homo sapiens
tcactaaatttctca

SEQ ID NO: 5514712 - DNA, 19 bp, Homo sapiens
tcactaacagggagaagta

SEQ ID NO: 5514713 - DNA, 12 bp, Homo sapiens
tcactaacatta

SEQ ID NO: 5514714 - DNA, 15 bp, Homo sapiens
tcactaacattatat

SEQ ID NO: 5514715 - DNA, 15 bp, Homo sapiens
tcactaaccaacaag

SEQ ID NO: 5514716 - DNA, 13 bp, Homo sapiens
tcactaagaaaga

SEQ ID NO: 5514717 - DNA, 18 bp, Homo sapiens
tcactaagaaagaaagga

SEQ ID NO: 5514718 - DNA, 19 bp, Homo sapiens
tcactaagaaagaaaggaa

SEQ ID NO: 5514719 - DNA, 17 bp, Homo sapiens
tcactaataaagtctgt

SEQ ID NO: 5514720 - DNA, 15 bp, Homo sapiens
tcactaatacacagt

SEQ ID NO: 5514721 - DNA, 23 bp, Homo sapiens
tcactaattggtacttttaaaaa

SEQ ID NO: 5514722 - DNA, 22 bp, Homo sapiens
tcactaatttggctttcacatt

SEQ ID NO: 5514723 - DNA, 18 bp, Homo sapiens
tcactacaaaaagaagag

SEQ ID NO: 5514724 - DNA, 21 bp, Homo sapiens
tcactacaacattagaatatt

SEQ ID NO: 5514725 - DNA, 23 bp, Homo sapiens
tcactacaacattagaatattgt

SEQ ID NO: 5514726 - DNA, 18 bp, Homo sapiens
tcactacaacctccacct

SEQ ID NO: 5514727 - DNA, 13 bp, Homo sapiens
tcactacaagctt

SEQ ID NO: 5514728 - DNA, 18 bp, Homo sapiens
tcactacaggttaaaaga

SEQ ID NO: 5514729 - DNA, 22 bp, Homo sapiens
tcactaccattgtaacttggat

SEQ ID NO: 5514730 - DNA, 22 bp, Homo sapiens
tcactacccatcggtgtccatt

SEQ ID NO: 5514731 - DNA, 20 bp, Homo sapiens
tcactaccctattctctctt

SEQ ID NO: 5514732 - DNA, 20 bp, Homo sapiens
tcactaccctcctgtaaaat

SEQ ID NO: 5514733 - DNA, 22 bp, Homo sapiens
tcactaccctcctgtaaaatac

SEQ ID NO: 5514734 - DNA, 16 bp, Homo sapiens
tcactaccctgattct

SEQ ID NO: 5514735 - DNA, 15 bp, Homo sapiens
tcactacctcctcag

SEQ ID NO: 5514736 - DNA, 21 bp, Homo sapiens
tcactacctgccatgcataca

SEQ ID NO: 5514737 - DNA, 22 bp, Homo sapiens
tcactacctttatagctcatca

SEQ ID NO: 5514738 - DNA, 15 bp, Homo sapiens
tcactactacatctg

SEQ ID NO: 5514739 - DNA, 19 bp, Homo sapiens
tcactactcacagtctctt

SEQ ID NO: 5514740 - DNA, 20 bp, Homo sapiens
tcactactcgagcccaccca

SEQ ID NO: 5514741 - DNA, 15 bp, Homo sapiens
tcactactggtctgt

SEQ ID NO: 5514742 - DNA, 16 bp, Homo sapiens
tcactactggtctgta

SEQ ID NO: 5514743 - DNA, 21 bp, Homo sapiens
tcactacttgaccattctcac

SEQ ID NO: 5514744 - DNA, 23 bp, Homo sapiens
tcactacttgaccattctcaccc

SEQ ID NO: 5514745 - DNA, 15 bp, Homo sapiens
tcactagaagaaaag

SEQ ID NO: 5514746 - DNA, 21 bp, Homo sapiens
tcactagaagaaaagcccatt

SEQ ID NO: 5514747 - DNA, 14 bp, Homo sapiens
tcactagaatggat

SEQ ID NO: 5514748 - DNA, 12 bp, Homo sapiens
tcactagagctg

SEQ ID NO: 5514749 - DNA, 14 bp, Homo sapiens
tcactagagctggg

SEQ ID NO: 5514750 - DNA, 21 bp, Homo sapiens
tcactagccctcctttttcca

SEQ ID NO: 5514751 - DNA, 13 bp, Homo sapiens
tcactagctcccc

SEQ ID NO: 5514752 - DNA, 22 bp, Homo sapiens
tcactaggaatttttttcagta

SEQ ID NO: 5514753 - DNA, 18 bp, Homo sapiens
tcactaggctaaactcaa

SEQ ID NO: 5514754 - DNA, 21 bp, Homo sapiens
tcactaggctcgtgtttgcta

SEQ ID NO: 5514755 - DNA, 21 bp, Homo sapiens
tcactagggaatcctgcggca

SEQ ID NO: 5514756 - DNA, 19 bp, Homo sapiens
tcactagggctgaggggcc

SEQ ID NO: 5514757 - DNA, 14 bp, Homo sapiens
tcactaggtaactt

SEQ ID NO: 5514758 - DNA, 17 bp, Homo sapiens
tcactaggtaacttatt

SEQ ID NO: 5514759 - DNA, 16 bp, Homo sapiens
tcactagtcaagaaaa

SEQ ID NO: 5514760 - DNA, 12 bp, Homo sapiens
tcactagtcttt

SEQ ID NO: 5514761 - DNA, 16 bp, Homo sapiens
tcactagtgaacaatt

SEQ ID NO: 5514762 - DNA, 20 bp, Homo sapiens
tcactagtgaccccttccct

SEQ ID NO: 5514763 - DNA, 15 bp, Homo sapiens
tcactagttgtcagc

SEQ ID NO: 5514764 - DNA, 20 bp, Homo sapiens
tcactagtttttcctgtgca

SEQ ID NO: 5514765 - DNA, 13 bp, Homo sapiens
tcactataaatgg

SEQ ID NO: 5514766 - DNA, 22 bp, Homo sapiens
tcactataaccatcagttactg

SEQ ID NO: 5514767 - DNA, 15 bp, Homo sapiens
tcactatctttctga

SEQ ID NO: 5514768 - DNA, 22 bp, Homo sapiens
tcactatgaatgggttgttaaa

SEQ ID NO: 5514769 - DNA, 14 bp, Homo sapiens
tcactatgacactg

SEQ ID NO: 5514770 - DNA, 15 bp, Homo sapiens
tcactatgcatttta

SEQ ID NO: 5514771 - DNA, 17 bp, Homo sapiens
tcactatgggtgagcat

SEQ ID NO: 5514772 - DNA, 17 bp, Homo sapiens
tcactatggtatgctgg

SEQ ID NO: 5514773 - DNA, 17 bp, Homo sapiens
tcactatgttgcccagg

SEQ ID NO: 5514774 - DNA, 19 bp, Homo sapiens
tcactatgttgcccaggct

SEQ ID NO: 5514775 - DNA, 15 bp, Homo sapiens
tcactatgtttctca

SEQ ID NO: 5514776 - DNA, 19 bp, Homo sapiens
tcactattatctaaaagaa

SEQ ID NO: 5514777 - DNA, 17 bp, Homo sapiens
tcactattcaaggatga

SEQ ID NO: 5514778 - DNA, 12 bp, Homo sapiens
tcactattcatc

SEQ ID NO: 5514779 - DNA, 18 bp, Homo sapiens
tcactattcatcaatgaa

SEQ ID NO: 5514780 - DNA, 20 bp, Homo sapiens
tcactattcatcaatgaaga

SEQ ID NO: 5514781 - DNA, 17 bp, Homo sapiens
tcactattcctaggagg

SEQ ID NO: 5514782 - DNA, 12 bp, Homo sapiens
tcactattctta

SEQ ID NO: 5514783 - DNA, 15 bp, Homo sapiens
tcactatttaaacta

SEQ ID NO: 5514784 - DNA, 13 bp, Homo sapiens
tcactatttcctt

SEQ ID NO: 5514785 - DNA, 15 bp, Homo sapiens
tcactatttccttta

SEQ ID NO: 5514786 - DNA, 18 bp, Homo sapiens
tcactatttcctttataa

SEQ ID NO: 5514787 - DNA, 19 bp, Homo sapiens
tcactcaaatgaatttgct

SEQ ID NO: 5514788 - DNA, 17 bp, Homo sapiens
tcactcaagcactgata

SEQ ID NO: 5514789 - DNA, 20 bp, Homo sapiens
tcactcaagttcaaggacca

SEQ ID NO: 5514790 - DNA, 18 bp, Homo sapiens
tcactcacactggccaca

SEQ ID NO: 5514791 - DNA, 22 bp, Homo sapiens
tcactcacactggccacaagga

SEQ ID NO: 5514792 - DNA, 16 bp, Homo sapiens
tcactcacagagtcaa

SEQ ID NO: 5514793 - DNA, 16 bp, Homo sapiens
tcactcaccactacca

SEQ ID NO: 5514794 - DNA, 21 bp, Homo sapiens
tcactcaccactaccagccag

SEQ ID NO: 5514795 - DNA, 15 bp, Homo sapiens
tcactcactcactcc

SEQ ID NO: 5514796 - DNA, 17 bp, Homo sapiens
tcactcactcactccaa

SEQ ID NO: 5514797 - DNA, 14 bp, Homo sapiens
tcactcactcccca

SEQ ID NO: 5514798 - DNA, 14 bp, Homo sapiens
tcactcactctggg

SEQ ID NO: 5514799 - DNA, 20 bp, Homo sapiens
tcactcactgaggccatcag

SEQ ID NO: 5514800 - DNA, 16 bp, Homo sapiens
tcactcactgtcaatg

SEQ ID NO: 5514801 - DNA, 18 bp, Homo sapiens
tcactcagaagtccagag

SEQ ID NO: 5514802 - DNA, 23 bp, Homo sapiens
tcactcagaattattcatagctg

SEQ ID NO: 5514803 - DNA, 13 bp, Homo sapiens
tcactcagagcag

SEQ ID NO: 5514804 - DNA, 15 bp, Homo sapiens
tcactcagcaccact

SEQ ID NO: 5514805 - DNA, 17 bp, Homo sapiens
tcactcagcaccactca

SEQ ID NO: 5514806 - DNA, 14 bp, Homo sapiens
tcactcagccacac

SEQ ID NO: 5514807 - DNA, 20 bp, Homo sapiens
tcactcagccaccctgagtt

SEQ ID NO: 5514808 - DNA, 17 bp, Homo sapiens
tcactcaggaaccctgg

SEQ ID NO: 5514809 - DNA, 22 bp, Homo sapiens
tcactcatactgtcatataatg

SEQ ID NO: 5514810 - DNA, 22 bp, Homo sapiens
tcactcatggaacactcatgtc

SEQ ID NO: 5514811 - DNA, 18 bp, Homo sapiens
tcactcattaatgaatca

SEQ ID NO: 5514812 - DNA, 17 bp, Homo sapiens
tcactcattgacatgat

SEQ ID NO: 5514813 - DNA, 15 bp, Homo sapiens
tcactcattgctgag

SEQ ID NO: 5514814 - DNA, 18 bp, Homo sapiens
tcactcattgctgagcct

SEQ ID NO: 5514815 - DNA, 19 bp, Homo sapiens
tcactcattgctgagcctc

SEQ ID NO: 5514816 - DNA, 22 bp, Homo sapiens
tcactcattgctgagcctctgc

SEQ ID NO: 5514817 - DNA, 14 bp, Homo sapiens
tcactcatttattt

SEQ ID NO: 5514818 - DNA, 15 bp, Homo sapiens
tcactccaaaaacag

SEQ ID NO: 5514819 - DNA, 21 bp, Homo sapiens
tcactccaaaccttactctga

SEQ ID NO: 5514820 - DNA, 23 bp, Homo sapiens
tcactccaaaccttactctgagc

SEQ ID NO: 5514821 - DNA, 18 bp, Homo sapiens
tcactccaagaccaccag

SEQ ID NO: 5514822 - DNA, 20 bp, Homo sapiens
tcactccaagaccaccaggg

SEQ ID NO: 5514823 - DNA, 22 bp, Homo sapiens
tcactccaagaccaccagggtc

SEQ ID NO: 5514824 - DNA, 13 bp, Homo sapiens
tcactccacagag

SEQ ID NO: 5514825 - DNA, 14 bp, Homo sapiens
tcactccacagagt

SEQ ID NO: 5514826 - DNA, 19 bp, Homo sapiens
tcactccaccatccccacc

SEQ ID NO: 5514827 - DNA, 12 bp, Homo sapiens
tcactccactcc

SEQ ID NO: 5514828 - DNA, 20 bp, Homo sapiens
tcactccacttggacatggg

SEQ ID NO: 5514829 - DNA, 14 bp, Homo sapiens
tcactccagccaaa

SEQ ID NO: 5514830 - DNA, 15 bp, Homo sapiens
tcactccagccaaag

SEQ ID NO: 5514831 - DNA, 19 bp, Homo sapiens
tcactccagtagctcctgg

SEQ ID NO: 5514832 - DNA, 13 bp, Homo sapiens
tcactccagtcaa

SEQ ID NO: 5514833 - DNA, 17 bp, Homo sapiens
tcactccagtcaacaga

SEQ ID NO: 5514834 - DNA, 16 bp, Homo sapiens
tcactccagtgctcag

SEQ ID NO: 5514835 - DNA, 13 bp, Homo sapiens
tcactccataaaa

SEQ ID NO: 5514836 - DNA, 18 bp, Homo sapiens
tcactccataaaaagaaa

SEQ ID NO: 5514837 - DNA, 23 bp, Homo sapiens
tcactccataaaaagaaagctaa

SEQ ID NO: 5514838 - DNA, 17 bp, Homo sapiens
tcactcccaagggacag

SEQ ID NO: 5514839 - DNA, 11 bp, Homo sapiens
tcactcccaga

SEQ ID NO: 5514840 - DNA, 21 bp, Homo sapiens
tcactcccagcactccccttg

SEQ ID NO: 5514841 - DNA, 22 bp, Homo sapiens
tcactcccagcactccccttgc

SEQ ID NO: 5514842 - DNA, 21 bp, Homo sapiens
tcactcccatacctttaatgg

SEQ ID NO: 5514843 - DNA, 12 bp, Homo sapiens
tcactccccact

SEQ ID NO: 5514844 - DNA, 19 bp, Homo sapiens
tcactccccagcctgggcc

SEQ ID NO: 5514845 - DNA, 15 bp, Homo sapiens
tcactccccgcctcc

SEQ ID NO: 5514846 - DNA, 16 bp, Homo sapiens
tcactcccctctcctc

SEQ ID NO: 5514847 - DNA, 19 bp, Homo sapiens
tcactcccctctcctcccc

SEQ ID NO: 5514848 - DNA, 20 bp, Homo sapiens
tcactcccgaggatgtgtcc

SEQ ID NO: 5514849 - DNA, 16 bp, Homo sapiens
tcactccctaggccca

SEQ ID NO: 5514850 - DNA, 15 bp, Homo sapiens
tcactccctccatca

SEQ ID NO: 5514851 - DNA, 15 bp, Homo sapiens
tcactcccttctacc

SEQ ID NO: 5514852 - DNA, 23 bp, Homo sapiens
tcactcccttctccttgataaca

SEQ ID NO: 5514853 - DNA, 15 bp, Homo sapiens
tcactccgcaaatat

SEQ ID NO: 5514854 - DNA, 17 bp, Homo sapiens
tcactccggtgtgcctg

SEQ ID NO: 5514855 - DNA, 20 bp, Homo sapiens
tcactccggtgtgcctgcag

SEQ ID NO: 5514856 - DNA, 22 bp, Homo sapiens
tcactcctaggagagccaacct

SEQ ID NO: 5514857 - DNA, 18 bp, Homo sapiens
tcactcctgaattcagtt

SEQ ID NO: 5514858 - DNA, 20 bp, Homo sapiens
tcactcctgagacccctggc

SEQ ID NO: 5514859 - DNA, 14 bp, Homo sapiens
tcactcctgcgctg

SEQ ID NO: 5514860 - DNA, 20 bp, Homo sapiens
tcactcctgcgctgacaagg

SEQ ID NO: 5514861 - DNA, 15 bp, Homo sapiens
tcactcctgctgtaa

SEQ ID NO: 5514862 - DNA, 16 bp, Homo sapiens
tcactcctgctgtaaa

SEQ ID NO: 5514863 - DNA, 12 bp, Homo sapiens
tcactcctgctt

SEQ ID NO: 5514864 - DNA, 15 bp, Homo sapiens
tcactcctgcttctc

SEQ ID NO: 5514865 - DNA, 14 bp, Homo sapiens
tcactcctggaggc

SEQ ID NO: 5514866 - DNA, 20 bp, Homo sapiens
tcactcctggggcctcttgg

SEQ ID NO: 5514867 - DNA, 17 bp, Homo sapiens
tcactccttttaaagaa

SEQ ID NO: 5514868 - DNA, 18 bp, Homo sapiens
tcactccttttaaagaaa

SEQ ID NO: 5514869 - DNA, 14 bp, Homo sapiens
tcactcgataataa

SEQ ID NO: 5514870 - DNA, 15 bp, Homo sapiens
tcactcgcccccggg

SEQ ID NO: 5514871 - DNA, 16 bp, Homo sapiens
tcactcggctgtggag

SEQ ID NO: 5514872 - DNA, 18 bp, Homo sapiens
tcactgctccctgaagcc

SEQ ID NO: 5514873 - DNA, 21 bp, Homo sapiens
tcactgctccctgaagccagc

SEQ ID NO: 5514874 - DNA, 24 bp, Homo sapiens
tcactgctccctgaagccagcctt

SEQ ID NO: 5514875 - DNA, 14 bp, Homo sapiens
tcactgctctgccc

SEQ ID NO: 5514876 - DNA, 17 bp, Homo sapiens
tcactgctctgccccca

SEQ ID NO: 5514877 - DNA, 13 bp, Homo sapiens
tcactgctgaaga

SEQ ID NO: 5514878 - DNA, 15 bp, Homo sapiens
tcactgctgctcctc

SEQ ID NO: 5514879 - DNA, 14 bp, Homo sapiens
tcactgctgctgcc

SEQ ID NO: 5514880 - DNA, 17 bp, Homo sapiens
tcactgctggctgcctt

SEQ ID NO: 5514881 - DNA, 14 bp, Homo sapiens
tcactgctgtcagc

SEQ ID NO: 5514882 - DNA, 16 bp, Homo sapiens
tcactgctgtcagcca

SEQ ID NO: 5514883 - DNA, 15 bp, Homo sapiens
tcactgctgtcatca

SEQ ID NO: 5514884 - DNA, 14 bp, Homo sapiens
tcactgcttaactt

SEQ ID NO: 5514885 - DNA, 15 bp, Homo sapiens
tcactgcttaacttc

SEQ ID NO: 5514886 - DNA, 16 bp, Homo sapiens
tcactgcttctgcttt

SEQ ID NO: 5514887 - DNA, 17 bp, Homo sapiens
tcactgcttctgctttt

SEQ ID NO: 5514888 - DNA, 13 bp, Homo sapiens
tcactgcttgagg

SEQ ID NO: 5514889 - DNA, 21 bp, Homo sapiens
tcactgcttgatgaagcaagg

SEQ ID NO: 5514890 - DNA, 11 bp, Homo sapiens
tcactgctttg

SEQ ID NO: 5514891 - DNA, 14 bp, Homo sapiens
tcactgctttgtag

SEQ ID NO: 5514892 - DNA, 19 bp, Homo sapiens
tcactgcttttggcctgga

SEQ ID NO: 5514893 - DNA, 19 bp, Homo sapiens
tcactgctttttccttagc

SEQ ID NO: 5514894 - DNA, 14 bp, Homo sapiens
tcactggaaaggaa

SEQ ID NO: 5514895 - DNA, 20 bp, Homo sapiens
tcactggaaaggaaagatga

SEQ ID NO: 5514896 - DNA, 17 bp, Homo sapiens
tcactggaaaggggaga

SEQ ID NO: 5514897 - DNA, 18 bp, Homo sapiens
tcactggaaaggggagag

SEQ ID NO: 5514898 - DNA, 21 bp, Homo sapiens
tcactggaaaggggagagcct

SEQ ID NO: 5514899 - DNA, 14 bp, Homo sapiens
tcactggaaattga

SEQ ID NO: 5514900 - DNA, 14 bp, Homo sapiens
tcactggagcacaa

SEQ ID NO: 5514901 - DNA, 14 bp, Homo sapiens
tcactggagcccag

SEQ ID NO: 5514902 - DNA, 19 bp, Homo sapiens
tcactggagttacattaat

SEQ ID NO: 5514903 - DNA, 21 bp, Homo sapiens
tcactggagttacattaatgt

SEQ ID NO: 5514904 - DNA, 13 bp, Homo sapiens
tcactggatgaaa

SEQ ID NO: 5514905 - DNA, 21 bp, Homo sapiens
tcactggccacagttgtttga

SEQ ID NO: 5514906 - DNA, 21 bp, Homo sapiens
tcactggccagtagctgccaa

SEQ ID NO: 5514907 - DNA, 11 bp, Homo sapiens
tcactggcctg

SEQ ID NO: 5514908 - DNA, 13 bp, Homo sapiens
tcactggcgcctt

SEQ ID NO: 5514909 - DNA, 17 bp, Homo sapiens
tcactggctcatgcccc

SEQ ID NO: 5514910 - DNA, 20 bp, Homo sapiens
tcactggctctccaagtgcc

SEQ ID NO: 5514911 - DNA, 14 bp, Homo sapiens
tcactggctgcctc

SEQ ID NO: 5514912 - DNA, 20 bp, Homo sapiens
tcactggctgcctccactcc

SEQ ID NO: 5514913 - DNA, 21 bp, Homo sapiens
tcactggctgcctccactccc

SEQ ID NO: 5514914 - DNA, 20 bp, Homo sapiens
tcactggctggactggaggc

SEQ ID NO: 5514915 - DNA, 13 bp, Homo sapiens
tcactggctggct

SEQ ID NO: 5514916 - DNA, 15 bp, Homo sapiens
tcactggctgggagt

SEQ ID NO: 5514917 - DNA, 13 bp, Homo sapiens
tcactggctgggg

SEQ ID NO: 5514918 - DNA, 19 bp, Homo sapiens
tcactggctggggcagagg

SEQ ID NO: 5514919 - DNA, 22 bp, Homo sapiens
tcactgggaagaagcaagggca

SEQ ID NO: 5514920 - DNA, 23 bp, Homo sapiens
tcactgggaagctcccaccccac

SEQ ID NO: 5514921 - DNA, 14 bp, Homo sapiens
tcactgggcccaga

SEQ ID NO: 5514922 - DNA, 15 bp, Homo sapiens
tcactgggcccagag

SEQ ID NO: 5514923 - DNA, 19 bp, Homo sapiens
tcactgggcccagaggaga

SEQ ID NO: 5514924 - DNA, 20 bp, Homo sapiens
tcactgggcccagaggagag

SEQ ID NO: 5514925 - DNA, 15 bp, Homo sapiens
tcactgggctaccgt

SEQ ID NO: 5514926 - DNA, 21 bp, Homo sapiens
tcactgggctcactgcaggca

SEQ ID NO: 5514927 - DNA, 13 bp, Homo sapiens
tcactggggcaga

SEQ ID NO: 5514928 - DNA, 17 bp, Homo sapiens
tcactggggcctacagc

SEQ ID NO: 5514929 - DNA, 21 bp, Homo sapiens
tcactggggtcctggggcctc

SEQ ID NO: 5514930 - DNA, 18 bp, Homo sapiens
tcactgggtggggtgagg

SEQ ID NO: 5514931 - DNA, 20 bp, Homo sapiens
tcactgggtggggtgaggac

SEQ ID NO: 5514932 - DNA, 19 bp, Homo sapiens
tcactggtagaccaaaata

SEQ ID NO: 5514933 - DNA, 16 bp, Homo sapiens
tcactggtccatttct

SEQ ID NO: 5514934 - DNA, 18 bp, Homo sapiens
tcactggtgcatttaaaa

SEQ ID NO: 5514935 - DNA, 22 bp, Homo sapiens
tcactggtgcatttaaaatgga

SEQ ID NO: 5514936 - DNA, 19 bp, Homo sapiens
tcactggttttacttacaa

SEQ ID NO: 5514937 - DNA, 23 bp, Homo sapiens
tcactggttttacttacaaaaat

SEQ ID NO: 5514938 - DNA, 15 bp, Homo sapiens
tcactgtaaagacaa

SEQ ID NO: 5514939 - DNA, 15 bp, Homo sapiens
tcactgtactgcatg

SEQ ID NO: 5514940 - DNA, 21 bp, Homo sapiens
tcactgtagaatgatttcatg

SEQ ID NO: 5514941 - DNA, 16 bp, Homo sapiens
tcactgtagttttgag

SEQ ID NO: 5514942 - DNA, 22 bp, Homo sapiens
tcactgtagttttgagtgtata

SEQ ID NO: 5514943 - DNA, 23 bp, Homo sapiens
tcactgtagttttgagtgtatac

SEQ ID NO: 5514944 - DNA, 14 bp, Homo sapiens
tcactgtataaata

SEQ ID NO: 5514945 - DNA, 24 bp, Homo sapiens
tcactgtataaataggagaggatg

SEQ ID NO: 5514946 - DNA, 18 bp, Homo sapiens
tcactgtatataaacata

SEQ ID NO: 5514947 - DNA, 13 bp, Homo sapiens
tcactgtattaaa

SEQ ID NO: 5514948 - DNA, 23 bp, Homo sapiens
tcactgtcaatgattattttcat

SEQ ID NO: 5514949 - DNA, 15 bp, Homo sapiens
tcactgtcactgccg

SEQ ID NO: 5514950 - DNA, 16 bp, Homo sapiens
tcactgtcactgccga

SEQ ID NO: 5514951 - DNA, 14 bp, Homo sapiens
tcactgtcagtccc

SEQ ID NO: 5514952 - DNA, 22 bp, Homo sapiens
tcactgtcagtcccactgcacc

SEQ ID NO: 5514953 - DNA, 23 bp, Homo sapiens
tcactgtcatgtgcgaacacagt

SEQ ID NO: 5514954 - DNA, 15 bp, Homo sapiens
tcactgtccattcca

SEQ ID NO: 5514955 - DNA, 18 bp, Homo sapiens
tcactgtccctcaaatga

SEQ ID NO: 5514956 - DNA, 15 bp, Homo sapiens
tcactgtcctccaag

SEQ ID NO: 5514957 - DNA, 16 bp, Homo sapiens
tcactgtcctccaagc

SEQ ID NO: 5514958 - DNA, 19 bp, Homo sapiens
tcactgtcctccaagccag

SEQ ID NO: 5514959 - DNA, 15 bp, Homo sapiens
tcactgtcctggctt

SEQ ID NO: 5514960 - DNA, 12 bp, Homo sapiens
tcactgtcctgt

SEQ ID NO: 5514961 - DNA, 15 bp, Homo sapiens
tcactgtctcctggt

SEQ ID NO: 5514962 - DNA, 15 bp, Homo sapiens
tcactgtctgagagt

SEQ ID NO: 5514963 - DNA, 14 bp, Homo sapiens
tcactgtcttttaa

SEQ ID NO: 5514964 - DNA, 17 bp, Homo sapiens
tcactgtcttttaaaaa

SEQ ID NO: 5514965 - DNA, 21 bp, Homo sapiens
tcactgtcttttgattcttga

SEQ ID NO: 5514966 - DNA, 11 bp, Homo sapiens
tcactgtgaaa

SEQ ID NO: 5514967 - DNA, 13 bp, Homo sapiens
tcactgtgaaatt

SEQ ID NO: 5514968 - DNA, 21 bp, Homo sapiens
tcactgtgaaatttcatgatt

SEQ ID NO: 5514969 - DNA, 22 bp, Homo sapiens
tcactgtgaaccaacccccatc

SEQ ID NO: 5514970 - DNA, 20 bp, Homo sapiens
tcactgtgaggggaaggcct

SEQ ID NO: 5514971 - DNA, 18 bp, Homo sapiens
tcactgtgggaaggccag

SEQ ID NO: 5514972 - DNA, 16 bp, Homo sapiens
tcactgtggggaaaca

SEQ ID NO: 5514973 - DNA, 18 bp, Homo sapiens
tcactgtggggaaacaat

SEQ ID NO: 5514974 - DNA, 19 bp, Homo sapiens
tcactgtggggaaacaatt

SEQ ID NO: 5514975 - DNA, 20 bp, Homo sapiens
tcactgtggtaaatgccaca

SEQ ID NO: 5514976 - DNA, 21 bp, Homo sapiens
tcactgtggtaaatgccacac

SEQ ID NO: 5514977 - DNA, 17 bp, Homo sapiens
tcactgtggtcctatgc

SEQ ID NO: 5514978 - DNA, 21 bp, Homo sapiens
tcactgtgtataggaatttgt

SEQ ID NO: 5514979 - DNA, 22 bp, Homo sapiens
tcactgtgtcacccagactgga

SEQ ID NO: 5514980 - DNA, 15 bp, Homo sapiens
tcactgtgtccaggt

SEQ ID NO: 5514981 - DNA, 13 bp, Homo sapiens
tcactgtgtctca

SEQ ID NO: 5514982 - DNA, 16 bp, Homo sapiens
tcactgtgttgcccag

SEQ ID NO: 5514983 - DNA, 21 bp, Homo sapiens
tcactgtgttggccaggctgg

SEQ ID NO: 5514984 - DNA, 22 bp, Homo sapiens
tcactgttagctttttaaaaca

SEQ ID NO: 5514985 - DNA, 23 bp, Homo sapiens
tcactgttagctttttaaaacat

SEQ ID NO: 5514986 - DNA, 16 bp, Homo sapiens
tcactgttataaattt

SEQ ID NO: 5514987 - DNA, 17 bp, Homo sapiens
tcactgttataaatttt

SEQ ID NO: 5514988 - DNA, 22 bp, Homo sapiens
tcactgttataaattttgtaca

SEQ ID NO: 5514989 - DNA, 17 bp, Homo sapiens
tcactgttccccaaaac

SEQ ID NO: 5514990 - DNA, 15 bp, Homo sapiens
tcactgttccctctg

SEQ ID NO: 5514991 - DNA, 18 bp, Homo sapiens
tcactgttccctctgctc

SEQ ID NO: 5514992 - DNA, 19 bp, Homo sapiens
tcactgttccctctgctcc

SEQ ID NO: 5514993 - DNA, 18 bp, Homo sapiens
tcactgttccctctggct

SEQ ID NO: 5514994 - DNA, 12 bp, Homo sapiens
tcactgttctgc

SEQ ID NO: 5514995 - DNA, 16 bp, Homo sapiens
tcactgttctgcaaag

SEQ ID NO: 5514996 - DNA, 15 bp, Homo sapiens
tcactgttgaaaatt

SEQ ID NO: 5514997 - DNA, 18 bp, Homo sapiens
tcactgttgaaaattatt

SEQ ID NO: 5514998 - DNA, 20 bp, Homo sapiens
tcactgttgcagtggcctgg

SEQ ID NO: 5514999 - DNA, 14 bp, Homo sapiens
tcactgttgcccag

SEQ ID NO: 5515000 - DNA, 15 bp, Homo sapiens
tcactgttgcccagg

SEQ ID NO: 5515001 - DNA, 16 bp, Homo sapiens
tcactgttgctttgaa

SEQ ID NO: 5515002 - DNA, 14 bp, Homo sapiens
tcactgttgtgaat

SEQ ID NO: 5515003 - DNA, 20 bp, Homo sapiens
tcactgtttaaagctttgaa

SEQ ID NO: 5515004 - DNA, 16 bp, Homo sapiens
tcactgtttagatttg

SEQ ID NO: 5515005 - DNA, 17 bp, Homo sapiens
tcactgtttagatttgc

SEQ ID NO: 5515006 - DNA, 15 bp, Homo sapiens
tcactgtttcactac

SEQ ID NO: 5515007 - DNA, 19 bp, Homo sapiens
tcacttaaaagctggcttt

SEQ ID NO: 5515008 - DNA, 22 bp, Homo sapiens
tcacttaaacttgcatcactta

SEQ ID NO: 5515009 - DNA, 17 bp, Homo sapiens
tcacttaaactttgtca

SEQ ID NO: 5515010 - DNA, 19 bp, Homo sapiens
tcacttaaaggcacaaata

SEQ ID NO: 5515011 - DNA, 20 bp, Homo sapiens
tcacttaaaggcacaaatag

SEQ ID NO: 5515012 - DNA, 20 bp, Homo sapiens
tcacttaacattcctaaaat

SEQ ID NO: 5515013 - DNA, 22 bp, Homo sapiens
tcacttaacattcctaaaatgc

SEQ ID NO: 5515014 - DNA, 23 bp, Homo sapiens
tcacttaactataaggtgcctca

SEQ ID NO: 5515015 - DNA, 15 bp, Homo sapiens
tcacttaagcccagg

SEQ ID NO: 5515016 - DNA, 23 bp, Homo sapiens
tcacttaagttgagatttttgct

SEQ ID NO: 5515017 - DNA, 17 bp, Homo sapiens
tcacttaagtttttcca

SEQ ID NO: 5515018 - DNA, 16 bp, Homo sapiens
tcacttaatctttcta

SEQ ID NO: 5515019 - DNA, 17 bp, Homo sapiens
tcacttaatgaaccacg

SEQ ID NO: 5515020 - DNA, 20 bp, Homo sapiens
tcacttacagaaccaattca

SEQ ID NO: 5515021 - DNA, 13 bp, Homo sapiens
tcacttactattg

SEQ ID NO: 5515022 - DNA, 18 bp, Homo sapiens
tcacttactattgttgct

SEQ ID NO: 5515023 - DNA, 15 bp, Homo sapiens
tcacttactcttaca

SEQ ID NO: 5515024 - DNA, 19 bp, Homo sapiens
tcacttagcagcaactgaa

SEQ ID NO: 5515025 - DNA, 13 bp, Homo sapiens
tcacttagccatg

SEQ ID NO: 5515026 - DNA, 20 bp, Homo sapiens
tcacttagggataacactgt

SEQ ID NO: 5515027 - DNA, 12 bp, Homo sapiens
tcacttagtcct

SEQ ID NO: 5515028 - DNA, 17 bp, Homo sapiens
tcacttagtcctttatc

SEQ ID NO: 5515029 - DNA, 12 bp, Homo sapiens
tcacttatacca

SEQ ID NO: 5515030 - DNA, 20 bp, Homo sapiens
tcacttataccaaagggaaa

SEQ ID NO: 5515031 - DNA, 17 bp, Homo sapiens
tcacttatatgttctaa

SEQ ID NO: 5515032 - DNA, 13 bp, Homo sapiens
tcacttatcagtt

SEQ ID NO: 5515033 - DNA, 20 bp, Homo sapiens
tcacttattattaataatga

SEQ ID NO: 5515034 - DNA, 24 bp, Homo sapiens
tcacttcaaacatgccctcaggct

SEQ ID NO: 5515035 - DNA, 23 bp, Homo sapiens
tcacttcaagctcaccctgctcc

SEQ ID NO: 5515036 - DNA, 14 bp, Homo sapiens
tcacttcaatgaac

SEQ ID NO: 5515037 - DNA, 14 bp, Homo sapiens
tcacttcaatgtgt

SEQ ID NO: 5515038 - DNA, 21 bp, Homo sapiens
tcacttcactgtgctgttgtt

SEQ ID NO: 5515039 - DNA, 20 bp, Homo sapiens
tcacttcaggagaaactgct

SEQ ID NO: 5515040 - DNA, 21 bp, Homo sapiens
tcacttcaggtatacctcact

SEQ ID NO: 5515041 - DNA, 16 bp, Homo sapiens
tcacttcataatccag

SEQ ID NO: 5515042 - DNA, 16 bp, Homo sapiens
tcacttcatacttcta

SEQ ID NO: 5515043 - DNA, 17 bp, Homo sapiens
tcacttcatcaatcaaa

SEQ ID NO: 5515044 - DNA, 20 bp, Homo sapiens
tcacttccagtgttggctgt

SEQ ID NO: 5515045 - DNA, 18 bp, Homo sapiens
tcacttccatacagctct

SEQ ID NO: 5515046 - DNA, 19 bp, Homo sapiens
tcacttccatacagctcta

SEQ ID NO: 5515047 - DNA, 14 bp, Homo sapiens
tcacttccccaaga

SEQ ID NO: 5515048 - DNA, 15 bp, Homo sapiens
tcacttccccaagat

SEQ ID NO: 5515049 - DNA, 14 bp, Homo sapiens
tcagacaacattat

SEQ ID NO: 5515050 - DNA, 20 bp, Homo sapiens
tcagacaacattatgatcta

SEQ ID NO: 5515051 - DNA, 22 bp, Homo sapiens
tcagacaacattatgatctaat

SEQ ID NO: 5515052 - DNA, 15 bp, Homo sapiens
tcagacaagacagag

SEQ ID NO: 5515053 - DNA, 11 bp, Homo sapiens
tcagacaagca

SEQ ID NO: 5515054 - DNA, 18 bp, Homo sapiens
tcagacaataccactggt

SEQ ID NO: 5515055 - DNA, 15 bp, Homo sapiens
tcagacaatatatca

SEQ ID NO: 5515056 - DNA, 19 bp, Homo sapiens
tcagacacaattagagaag

SEQ ID NO: 5515057 - DNA, 13 bp, Homo sapiens
tcagacacagctc

SEQ ID NO: 5515058 - DNA, 21 bp, Homo sapiens
tcagacacagctcttccaggg

SEQ ID NO: 5515059 - DNA, 19 bp, Homo sapiens
tcagacacaggaaaaataa

SEQ ID NO: 5515060 - DNA, 14 bp, Homo sapiens
tcagacacattttt

SEQ ID NO: 5515061 - DNA, 17 bp, Homo sapiens
tcagacacatttttgga

SEQ ID NO: 5515062 - DNA, 13 bp, Homo sapiens
tcagacaccaagg

SEQ ID NO: 5515063 - DNA, 17 bp, Homo sapiens
tcagacaccctcaacct

SEQ ID NO: 5515064 - DNA, 23 bp, Homo sapiens
tcagacaccctcaacctcttctg

SEQ ID NO: 5515065 - DNA, 18 bp, Homo sapiens
tcagacaccctctcctta

SEQ ID NO: 5515066 - DNA, 15 bp, Homo sapiens
tcagacacctagact

SEQ ID NO: 5515067 - DNA, 20 bp, Homo sapiens
tcagacacctgttcacagaa

SEQ ID NO: 5515068 - DNA, 20 bp, Homo sapiens
tcagacactaaatgcagaca

SEQ ID NO: 5515069 - DNA, 16 bp, Homo sapiens
tcagacactaccccat

SEQ ID NO: 5515070 - DNA, 18 bp, Homo sapiens
tcagacactctggctggt

SEQ ID NO: 5515071 - DNA, 21 bp, Homo sapiens
tcagacactgccgacatcagc

SEQ ID NO: 5515072 - DNA, 19 bp, Homo sapiens
tcagacacttcatggacca

SEQ ID NO: 5515073 - DNA, 12 bp, Homo sapiens
tcagacagactt

SEQ ID NO: 5515074 - DNA, 22 bp, Homo sapiens
tcagacagatctggaatgtgaa

SEQ ID NO: 5515075 - DNA, 12 bp, Homo sapiens
tcagacagcagg

SEQ ID NO: 5515076 - DNA, 13 bp, Homo sapiens
tcagacagcagga

SEQ ID NO: 5515077 - DNA, 14 bp, Homo sapiens
tcagacagctgcct

SEQ ID NO: 5515078 - DNA, 20 bp, Homo sapiens
tcagacagctgcctgggatc

SEQ ID NO: 5515079 - DNA, 22 bp, Homo sapiens
tcagacagcttatggggtattt

SEQ ID NO: 5515080 - DNA, 21 bp, Homo sapiens
tcagacatacagctgcctacc

SEQ ID NO: 5515081 - DNA, 22 bp, Homo sapiens
tcagacatacagctgcctacct

SEQ ID NO: 5515082 - DNA, 19 bp, Homo sapiens
tcagacatagaattaacac

SEQ ID NO: 5515083 - DNA, 18 bp, Homo sapiens
tcagacatctccagtgtg

SEQ ID NO: 5515084 - DNA, 19 bp, Homo sapiens
tcagacatgaaaactattt

SEQ ID NO: 5515085 - DNA, 16 bp, Homo sapiens
tcagacattataagta

SEQ ID NO: 5515086 - DNA, 15 bp, Homo sapiens
tcagacattccaagg

SEQ ID NO: 5515087 - DNA, 12 bp, Homo sapiens
tcagacatttct

SEQ ID NO: 5515088 - DNA, 19 bp, Homo sapiens
tcagacatttctttggaaa

SEQ ID NO: 5515089 - DNA, 13 bp, Homo sapiens
tcagacattttca

SEQ ID NO: 5515090 - DNA, 15 bp, Homo sapiens
tcagacattttcact

SEQ ID NO: 5515091 - DNA, 20 bp, Homo sapiens
tcagacattttcactggaag

SEQ ID NO: 5515092 - DNA, 14 bp, Homo sapiens
tcagaccacatgcc

SEQ ID NO: 5515093 - DNA, 20 bp, Homo sapiens
tcagaccaggtggaattact

SEQ ID NO: 5515094 - DNA, 15 bp, Homo sapiens
tcagaccataatgtt

SEQ ID NO: 5515095 - DNA, 23 bp, Homo sapiens
tcagaccataatgttacattatt

SEQ ID NO: 5515096 - DNA, 12 bp, Homo sapiens
tcagacccagag

SEQ ID NO: 5515097 - DNA, 11 bp, Homo sapiens
tcagacccagg

SEQ ID NO: 5515098 - DNA, 14 bp, Homo sapiens
tcagacccaggagt

SEQ ID NO: 5515099 - DNA, 15 bp, Homo sapiens
tcagacccaggagtc

SEQ ID NO: 5515100 - DNA, 16 bp, Homo sapiens
tcagacccaggagtcc

SEQ ID NO: 5515101 - DNA, 21 bp, Homo sapiens
tcagacccaggagtccagacc

SEQ ID NO: 5515102 - DNA, 22 bp, Homo sapiens
tcagacccaggagtccagaccc

SEQ ID NO: 5515103 - DNA, 19 bp, Homo sapiens
tcagacccaggagtccagc

SEQ ID NO: 5515104 - DNA, 21 bp, Homo sapiens
tcagacccaggggtccaggcc

SEQ ID NO: 5515105 - DNA, 22 bp, Homo sapiens
tcagacccaggggtccaggccc

SEQ ID NO: 5515106 - DNA, 22 bp, Homo sapiens
tcagacccccactctcattccc

SEQ ID NO: 5515107 - DNA, 18 bp, Homo sapiens
tcagacccctcagcccca

SEQ ID NO: 5515108 - DNA, 13 bp, Homo sapiens
tcagacccctgcc

SEQ ID NO: 5515109 - DNA, 17 bp, Homo sapiens
tcagaccctaggaagct

SEQ ID NO: 5515110 - DNA, 14 bp, Homo sapiens
tcagaccctgctta

SEQ ID NO: 5515111 - DNA, 17 bp, Homo sapiens
tcagacccttgaagatg

SEQ ID NO: 5515112 - DNA, 13 bp, Homo sapiens
tcagaccctttag

SEQ ID NO: 5515113 - DNA, 14 bp, Homo sapiens
tcagaccgtcttcc

SEQ ID NO: 5515114 - DNA, 21 bp, Homo sapiens
tcagacctagcagggaaggtg

SEQ ID NO: 5515115 - DNA, 12 bp, Homo sapiens
tcagacctctga

SEQ ID NO: 5515116 - DNA, 22 bp, Homo sapiens
tcagacctgacaccgtccctca

SEQ ID NO: 5515117 - DNA, 16 bp, Homo sapiens
tcagacctgtcttcca

SEQ ID NO: 5515118 - DNA, 18 bp, Homo sapiens
tcagacctgtcttccaag

SEQ ID NO: 5515119 - DNA, 20 bp, Homo sapiens
tcagacctgtcttccaagga

SEQ ID NO: 5515120 - DNA, 18 bp, Homo sapiens
tcagacgactagcccagg

SEQ ID NO: 5515121 - DNA, 19 bp, Homo sapiens
tcagacgactagcccagga

SEQ ID NO: 5515122 - DNA, 23 bp, Homo sapiens
tcagacgagacaccctaactctt

SEQ ID NO: 5515123 - DNA, 13 bp, Homo sapiens
tcagacggcggcc

SEQ ID NO: 5515124 - DNA, 17 bp, Homo sapiens
tcagacggcggccaggc

SEQ ID NO: 5515125 - DNA, 18 bp, Homo sapiens
tcagacggcggccaggca

SEQ ID NO: 5515126 - DNA, 21 bp, Homo sapiens
tcagacggcggccaggcacag

SEQ ID NO: 5515127 - DNA, 22 bp, Homo sapiens
tcagacggcggccaggcacagg

SEQ ID NO: 5515128 - DNA, 23 bp, Homo sapiens
tcagacgtgtgacctccatactg

SEQ ID NO: 5515129 - DNA, 18 bp, Homo sapiens
tcagacgttgcctgagaa

SEQ ID NO: 5515130 - DNA, 18 bp, Homo sapiens
tcagactaaaaatacacc

SEQ ID NO: 5515131 - DNA, 17 bp, Homo sapiens
tcagactatccatttta

SEQ ID NO: 5515132 - DNA, 18 bp, Homo sapiens
tcagactcagaggtccag

SEQ ID NO: 5515133 - DNA, 15 bp, Homo sapiens
tcagactcagttttt

SEQ ID NO: 5515134 - DNA, 17 bp, Homo sapiens
tcagactcagttttttg

SEQ ID NO: 5515135 - DNA, 22 bp, Homo sapiens
tcagactcccattcctgaagaa

SEQ ID NO: 5515136 - DNA, 13 bp, Homo sapiens
tcagactccgccc

SEQ ID NO: 5515137 - DNA, 22 bp, Homo sapiens
tcagactccgccctcctcgggc

SEQ ID NO: 5515138 - DNA, 16 bp, Homo sapiens
tcagactctcagccca

SEQ ID NO: 5515139 - DNA, 19 bp, Homo sapiens
tcagactctcagcccagaa

SEQ ID NO: 5515140 - DNA, 16 bp, Homo sapiens
tcagactctccttcag

SEQ ID NO: 5515141 - DNA, 16 bp, Homo sapiens
tcagactctctcctct

SEQ ID NO: 5515142 - DNA, 17 bp, Homo sapiens
tcagactctctcctctc

SEQ ID NO: 5515143 - DNA, 19 bp, Homo sapiens
tcagactgaacatgtacac

SEQ ID NO: 5515144 - DNA, 17 bp, Homo sapiens
tcagactgacactacta

SEQ ID NO: 5515145 - DNA, 13 bp, Homo sapiens
tcagactgataga

SEQ ID NO: 5515146 - DNA, 15 bp, Homo sapiens
tcagactgcacccag

SEQ ID NO: 5515147 - DNA, 18 bp, Homo sapiens
tcagactgctctttcata

SEQ ID NO: 5515148 - DNA, 13 bp, Homo sapiens
tcagactgctggg

SEQ ID NO: 5515149 - DNA, 23 bp, Homo sapiens
tcagactgctgggactggccagg

SEQ ID NO: 5515150 - DNA, 20 bp, Homo sapiens
tcagactggaggtcgaagca

SEQ ID NO: 5515151 - DNA, 12 bp, Homo sapiens
tcagactggccc

SEQ ID NO: 5515152 - DNA, 13 bp, Homo sapiens
tcagactggctgg

SEQ ID NO: 5515153 - DNA, 20 bp, Homo sapiens
tcagactggctggctgcagt

SEQ ID NO: 5515154 - DNA, 13 bp, Homo sapiens
tcagactggggca

SEQ ID NO: 5515155 - DNA, 20 bp, Homo sapiens
tcagactgtcaggcaagccc

SEQ ID NO: 5515156 - DNA, 16 bp, Homo sapiens
tcagactgtgcaatac

SEQ ID NO: 5515157 - DNA, 17 bp, Homo sapiens
tcagacttagtttttat

SEQ ID NO: 5515158 - DNA, 20 bp, Homo sapiens
tcagacttagtttttataaa

SEQ ID NO: 5515159 - DNA, 16 bp, Homo sapiens
tcagacttcaccaaat

SEQ ID NO: 5515160 - DNA, 17 bp, Homo sapiens
tcagacttcaccaaata

SEQ ID NO: 5515161 - DNA, 23 bp, Homo sapiens
tcagacttgccatgtgactctgg

SEQ ID NO: 5515162 - DNA, 18 bp, Homo sapiens
tcagacttgcggccacag

SEQ ID NO: 5515163 - DNA, 19 bp, Homo sapiens
tcagacttgcggccacagc

SEQ ID NO: 5515164 - DNA, 15 bp, Homo sapiens
tcagacttgtcaagc

SEQ ID NO: 5515165 - DNA, 16 bp, Homo sapiens
tcagactttaaagaat

SEQ ID NO: 5515166 - DNA, 12 bp, Homo sapiens
tcagactttgct

SEQ ID NO: 5515167 - DNA, 19 bp, Homo sapiens
tcagactttggaaaatgca

SEQ ID NO: 5515168 - DNA, 20 bp, Homo sapiens
tcagactttggaaaatgcat

SEQ ID NO: 5515169 - DNA, 14 bp, Homo sapiens
tcagacttttgtac

SEQ ID NO: 5515170 - DNA, 17 bp, Homo sapiens
tcagagaaaacactttc

SEQ ID NO: 5515171 - DNA, 19 bp, Homo sapiens
tcagagaaaatgagaaagg

SEQ ID NO: 5515172 - DNA, 20 bp, Homo sapiens
tcagagaaattatgttttca

SEQ ID NO: 5515173 - DNA, 19 bp, Homo sapiens
tcagagaacctaataagtg

SEQ ID NO: 5515174 - DNA, 14 bp, Homo sapiens
tcagagaaggccag

SEQ ID NO: 5515175 - DNA, 20 bp, Homo sapiens
tcagagacaggaagtcttca

SEQ ID NO: 5515176 - DNA, 19 bp, Homo sapiens
tcagagaccagcactcagc

SEQ ID NO: 5515177 - DNA, 21 bp, Homo sapiens
tcagagaccaggccctggcta

SEQ ID NO: 5515178 - DNA, 17 bp, Homo sapiens
tcagagacctgaagtgt

SEQ ID NO: 5515179 - DNA, 16 bp, Homo sapiens
tcagagaccttaattt

SEQ ID NO: 5515180 - DNA, 19 bp, Homo sapiens
tcagagactcagggcccca

SEQ ID NO: 5515181 - DNA, 23 bp, Homo sapiens
tcagagactcctgcaggcagcca

SEQ ID NO: 5515182 - DNA, 18 bp, Homo sapiens
tcagagacttagaagcat

SEQ ID NO: 5515183 - DNA, 19 bp, Homo sapiens
tcagagacttagaagcatc

SEQ ID NO: 5515184 - DNA, 18 bp, Homo sapiens
tcagagagcagtgctttt

SEQ ID NO: 5515185 - DNA, 17 bp, Homo sapiens
tcagagagcatcttttc

SEQ ID NO: 5515186 - DNA, 11 bp, Homo sapiens
tcagagagcct

SEQ ID NO: 5515187 - DNA, 16 bp, Homo sapiens
tcagagagctggtagt

SEQ ID NO: 5515188 - DNA, 19 bp, Homo sapiens
tcagagaggacaaaataaa

SEQ ID NO: 5515189 - DNA, 17 bp, Homo sapiens
tcagagaggagtcagag

SEQ ID NO: 5515190 - DNA, 20 bp, Homo sapiens
tcagagaggagtcagagaga

SEQ ID NO: 5515191 - DNA, 22 bp, Homo sapiens
tcagagaggcatgtgatgtgca

SEQ ID NO: 5515192 - DNA, 21 bp, Homo sapiens
tcagagaggccttttggaatg

SEQ ID NO: 5515193 - DNA, 22 bp, Homo sapiens
tcagagaggccttttgtttaaa

SEQ ID NO: 5515194 - DNA, 11 bp, Homo sapiens
tcagagagggt

SEQ ID NO: 5515195 - DNA, 16 bp, Homo sapiens
tcagagagggtgggag

SEQ ID NO: 5515196 - DNA, 23 bp, Homo sapiens
tcagagaggtagcactctcagag

SEQ ID NO: 5515197 - DNA, 17 bp, Homo sapiens
tcagagaggtctcaggt

SEQ ID NO: 5515198 - DNA, 18 bp, Homo sapiens
tcagagagtacactgtgt

SEQ ID NO: 5515199 - DNA, 20 bp, Homo sapiens
tcagagagtacactgtgtct

SEQ ID NO: 5515200 - DNA, 23 bp, Homo sapiens
tcagagagtacactgtgtctcta

SEQ ID NO: 5515201 - DNA, 16 bp, Homo sapiens
tcagagagtgtacatc

SEQ ID NO: 5515202 - DNA, 18 bp, Homo sapiens
tcagagatctcccttctc

SEQ ID NO: 5515203 - DNA, 18 bp, Homo sapiens
tcagagatcttggtatgg

SEQ ID NO: 5515204 - DNA, 16 bp, Homo sapiens
tcagagatgcaccacc

SEQ ID NO: 5515205 - DNA, 21 bp, Homo sapiens
tcagagatgcaccaccaagcc

SEQ ID NO: 5515206 - DNA, 22 bp, Homo sapiens
tcagagatgcaccaccaagcca

SEQ ID NO: 5515207 - DNA, 19 bp, Homo sapiens
tcagagatgtccattttta

SEQ ID NO: 5515208 - DNA, 12 bp, Homo sapiens
tcagagatgttt

SEQ ID NO: 5515209 - DNA, 16 bp, Homo sapiens
tcagagatgttttcaa

SEQ ID NO: 5515210 - DNA, 14 bp, Homo sapiens
tcagagattaaaaa

SEQ ID NO: 5515211 - DNA, 19 bp, Homo sapiens
tcagagattaaaaaaggta

SEQ ID NO: 5515212 - DNA, 18 bp, Homo sapiens
tcagagatttatataaat

SEQ ID NO: 5515213 - DNA, 23 bp, Homo sapiens
tcagagcaaaagacttgagccat

SEQ ID NO: 5515214 - DNA, 14 bp, Homo sapiens
tcagagcaagcctt

SEQ ID NO: 5515215 - DNA, 13 bp, Homo sapiens
tcagagcacagcc

SEQ ID NO: 5515216 - DNA, 22 bp, Homo sapiens
tcagagcactgtgttcacactt

SEQ ID NO: 5515217 - DNA, 20 bp, Homo sapiens
tcagagcagcagtgaaaaca

SEQ ID NO: 5515218 - DNA, 14 bp, Homo sapiens
tcagagcaggacct

SEQ ID NO: 5515219 - DNA, 18 bp, Homo sapiens
tcagagcaggacctccct

SEQ ID NO: 5515220 - DNA, 15 bp, Homo sapiens
tcagagcaggagcat

SEQ ID NO: 5515221 - DNA, 13 bp, Homo sapiens
tcagagcagggcc

SEQ ID NO: 5515222 - DNA, 19 bp, Homo sapiens
tcagagcaggtgctggctc

SEQ ID NO: 5515223 - DNA, 17 bp, Homo sapiens
tcagagcatgtgtcaga

SEQ ID NO: 5515224 - DNA, 18 bp, Homo sapiens
tcagagccaagtcctccc

SEQ ID NO: 5515225 - DNA, 14 bp, Homo sapiens
tcagagccacaggg

SEQ ID NO: 5515226 - DNA, 22 bp, Homo sapiens
tcagagccacccaggccactga

SEQ ID NO: 5515227 - DNA, 15 bp, Homo sapiens
tcagagccagcctgg

SEQ ID NO: 5515228 - DNA, 21 bp, Homo sapiens
tcagagccaggctctgcctgg

SEQ ID NO: 5515229 - DNA, 15 bp, Homo sapiens
tcagagccagtgaag

SEQ ID NO: 5515230 - DNA, 18 bp, Homo sapiens
tcagagcccacatggccg

SEQ ID NO: 5515231 - DNA, 16 bp, Homo sapiens
tcagagcccagcccag

SEQ ID NO: 5515232 - DNA, 16 bp, Homo sapiens
tcagagcccaggggag

SEQ ID NO: 5515233 - DNA, 13 bp, Homo sapiens
tcagagccccgcc

SEQ ID NO: 5515234 - DNA, 20 bp, Homo sapiens
tcagagccccgccccacccc

SEQ ID NO: 5515235 - DNA, 18 bp, Homo sapiens
tcagagcccctacagcat

SEQ ID NO: 5515236 - DNA, 16 bp, Homo sapiens
tcagagcccctccctg

SEQ ID NO: 5515237 - DNA, 18 bp, Homo sapiens
tcagagcccctccctgct

SEQ ID NO: 5515238 - DNA, 10 bp, Homo sapiens
tcagagccct

SEQ ID NO: 5515239 - DNA, 12 bp, Homo sapiens
tcagagccctgc

SEQ ID NO: 5515240 - DNA, 16 bp, Homo sapiens
tcagagccctggctgg

SEQ ID NO: 5515241 - DNA, 18 bp, Homo sapiens
tcagagccctggctgggt

SEQ ID NO: 5515242 - DNA, 20 bp, Homo sapiens
tcagagccctggctgggttc

SEQ ID NO: 5515243 - DNA, 20 bp, Homo sapiens
tcagagccgtggtcctttgg

SEQ ID NO: 5515244 - DNA, 15 bp, Homo sapiens
tcagagcctaccttc

SEQ ID NO: 5515245 - DNA, 19 bp, Homo sapiens
tcagagcctaccttcacca

SEQ ID NO: 5515246 - DNA, 15 bp, Homo sapiens
tcagagcctcagctt

SEQ ID NO: 5515247 - DNA, 11 bp, Homo sapiens
tcagagcctga

SEQ ID NO: 5515248 - DNA, 14 bp, Homo sapiens
tcagagcctgacct

SEQ ID NO: 5515249 - DNA, 20 bp, Homo sapiens
tcagagcctttcctcaaaac

SEQ ID NO: 5515250 - DNA, 17 bp, Homo sapiens
tcagagcgccaggaagc

SEQ ID NO: 5515251 - DNA, 17 bp, Homo sapiens
tcagagctacttgggcc

SEQ ID NO: 5515252 - DNA, 18 bp, Homo sapiens
tcagagctacttgggcca

SEQ ID NO: 5515253 - DNA, 13 bp, Homo sapiens
tcagagctaggcc

SEQ ID NO: 5515254 - DNA, 15 bp, Homo sapiens
tcagagctctcgagg

SEQ ID NO: 5515255 - DNA, 14 bp, Homo sapiens
tcagagctctctct

SEQ ID NO: 5515256 - DNA, 22 bp, Homo sapiens
tcagagctcttcaagctgtccc

SEQ ID NO: 5515257 - DNA, 15 bp, Homo sapiens
tcagagctgccctct

SEQ ID NO: 5515258 - DNA, 21 bp, Homo sapiens
tcagagctgccctctcctggg

SEQ ID NO: 5515259 - DNA, 23 bp, Homo sapiens
tcagagctgccctctcctgggca

SEQ ID NO: 5515260 - DNA, 12 bp, Homo sapiens
tcagagctgcgg

SEQ ID NO: 5515261 - DNA, 16 bp, Homo sapiens
tcagagctgcgggctg

SEQ ID NO: 5515262 - DNA, 21 bp, Homo sapiens
tcagagctgcgggctgagggc

SEQ ID NO: 5515263 - DNA, 16 bp, Homo sapiens
tcagagctgctgagca

SEQ ID NO: 5515264 - DNA, 15 bp, Homo sapiens
tcagagctgttggcc

SEQ ID NO: 5515265 - DNA, 19 bp, Homo sapiens
tcagagctgttggcctcgc

SEQ ID NO: 5515266 - DNA, 22 bp, Homo sapiens
tcagagctgttggcctcgcctg

SEQ ID NO: 5515267 - DNA, 15 bp, Homo sapiens
tcagagcttcctggg

SEQ ID NO: 5515268 - DNA, 22 bp, Homo sapiens
tcagagcttcctggggaccaag

SEQ ID NO: 5515269 - DNA, 16 bp, Homo sapiens
tcagagcttgaagatt

SEQ ID NO: 5515270 - DNA, 18 bp, Homo sapiens
tcagagctttaaaagtat

SEQ ID NO: 5515271 - DNA, 14 bp, Homo sapiens
tcagagctttgtca

SEQ ID NO: 5515272 - DNA, 19 bp, Homo sapiens
tcagagctttgtcacttgc

SEQ ID NO: 5515273 - DNA, 21 bp, Homo sapiens
tcagagctttgtcacttgcca

SEQ ID NO: 5515274 - DNA, 23 bp, Homo sapiens
tcagagctttgtcacttgccaca

SEQ ID NO: 5515275 - DNA, 23 bp, Homo sapiens
tcagagcttttcgaactgtgctc

SEQ ID NO: 5515276 - DNA, 20 bp, Homo sapiens
tcagaggaaaaacagaggat

SEQ ID NO: 5515277 - DNA, 23 bp, Homo sapiens
tcagaggaaaaatgggagccagg

SEQ ID NO: 5515278 - DNA, 14 bp, Homo sapiens
tcagaggaacaaac

SEQ ID NO: 5515279 - DNA, 17 bp, Homo sapiens
tcagaggacccacctgg

SEQ ID NO: 5515280 - DNA, 18 bp, Homo sapiens
tcagaggaccccagggtg

SEQ ID NO: 5515281 - DNA, 21 bp, Homo sapiens
tcagaggacctgtatttaagc

SEQ ID NO: 5515282 - DNA, 22 bp, Homo sapiens
tcagaggagtggatctgtagaa

SEQ ID NO: 5515283 - DNA, 18 bp, Homo sapiens
tcagaggcagagacctcc

SEQ ID NO: 5515284 - DNA, 19 bp, Homo sapiens
tcagaggcatttgagcagc

SEQ ID NO: 5515285 - DNA, 12 bp, Homo sapiens
tcagaggcccca

SEQ ID NO: 5515286 - DNA, 18 bp, Homo sapiens
tcagaggccccttgctgc

SEQ ID NO: 5515287 - DNA, 22 bp, Homo sapiens
tcagaggccccttgctgctggc

SEQ ID NO: 5515288 - DNA, 14 bp, Homo sapiens
tcagaggccctgga

SEQ ID NO: 5515289 - DNA, 15 bp, Homo sapiens
tcagaggcctataat

SEQ ID NO: 5515290 - DNA, 12 bp, Homo sapiens
tcagaggccttg

SEQ ID NO: 5515291 - DNA, 17 bp, Homo sapiens
tcagaggccttgctgtg

SEQ ID NO: 5515292 - DNA, 14 bp, Homo sapiens
tcagaggctgagcc

SEQ ID NO: 5515293 - DNA, 15 bp, Homo sapiens
tcagaggctgggagc

SEQ ID NO: 5515294 - DNA, 20 bp, Homo sapiens
tcagaggctgggagcatagc

SEQ ID NO: 5515295 - DNA, 16 bp, Homo sapiens
tcagaggctgggggag

SEQ ID NO: 5515296 - DNA, 19 bp, Homo sapiens
tcagagggactgtcagctg

SEQ ID NO: 5515297 - DNA, 20 bp, Homo sapiens
tcagagggcccaaatggcag

SEQ ID NO: 5515298 - DNA, 17 bp, Homo sapiens
tcagagggggactgctg

SEQ ID NO: 5515299 - DNA, 23 bp, Homo sapiens
tcagagggtggagatgtcagtct

SEQ ID NO: 5515300 - DNA, 13 bp, Homo sapiens
tcagaggtccagg

SEQ ID NO: 5515301 - DNA, 21 bp, Homo sapiens
tcagaggtgaattaatggaca

SEQ ID NO: 5515302 - DNA, 19 bp, Homo sapiens
tcagaggtgctaaattgtc

SEQ ID NO: 5515303 - DNA, 15 bp, Homo sapiens
tcagaggtgtacact

SEQ ID NO: 5515304 - DNA, 16 bp, Homo sapiens
tcagaggtgtacacta

SEQ ID NO: 5515305 - DNA, 19 bp, Homo sapiens
tcagagtaagctgcttttg

SEQ ID NO: 5515306 - DNA, 21 bp, Homo sapiens
tcagagtaatccaagcaaatg

SEQ ID NO: 5515307 - DNA, 15 bp, Homo sapiens
tcagagtacgtcctg

SEQ ID NO: 5515308 - DNA, 22 bp, Homo sapiens
tcagagtacgtcctgcctggca

SEQ ID NO: 5515309 - DNA, 24 bp, Homo sapiens
tcagagtaggtgggtaggagccct

SEQ ID NO: 5515310 - DNA, 16 bp, Homo sapiens
tcagagtataattttg

SEQ ID NO: 5515311 - DNA, 13 bp, Homo sapiens
tcagagtatctga

SEQ ID NO: 5515312 - DNA, 14 bp, Homo sapiens
tcagagtatctgaa

SEQ ID NO: 5515313 - DNA, 14 bp, Homo sapiens
tcagagtccaggcc

SEQ ID NO: 5515314 - DNA, 19 bp, Homo sapiens
tcagagtctataacagaaa

SEQ ID NO: 5515315 - DNA, 17 bp, Homo sapiens
tcagagtctggcctgcc

SEQ ID NO: 5515316 - DNA, 18 bp, Homo sapiens
tcagagtctggcctgcca

SEQ ID NO: 5515317 - DNA, 20 bp, Homo sapiens
tcagagtctggcctgccagg

SEQ ID NO: 5515318 - DNA, 15 bp, Homo sapiens
tcagagtcttgtccc

SEQ ID NO: 5515319 - DNA, 18 bp, Homo sapiens
tcagagtgaagagtgaag

SEQ ID NO: 5515320 - DNA, 16 bp, Homo sapiens
tcagagtgaccctcag

SEQ ID NO: 5515321 - DNA, 17 bp, Homo sapiens
tcagagtgaccctcagc

SEQ ID NO: 5515322 - DNA, 17 bp, Homo sapiens
tcagagtgagtgtaggg

SEQ ID NO: 5515323 - DNA, 23 bp, Homo sapiens
tcagagtgcaagcccctgctcca

SEQ ID NO: 5515324 - DNA, 12 bp, Homo sapiens
tcagagtgccac

SEQ ID NO: 5515325 - DNA, 17 bp, Homo sapiens
tcagagtggaatgcttc

SEQ ID NO: 5515326 - DNA, 13 bp, Homo sapiens
tcagagtggagtt

SEQ ID NO: 5515327 - DNA, 21 bp, Homo sapiens
tcagagtggccaatccctgtg

SEQ ID NO: 5515328 - DNA, 20 bp, Homo sapiens
tcagagtggcgtgagctgcc

SEQ ID NO: 5515329 - DNA, 14 bp, Homo sapiens
tcagagtggctcac

SEQ ID NO: 5515330 - DNA, 21 bp, Homo sapiens
tcagagtggctcactggctgg

SEQ ID NO: 5515331 - DNA, 13 bp, Homo sapiens
tcagagtgtattt

SEQ ID NO: 5515332 - DNA, 15 bp, Homo sapiens
tcagagttaaaatat

SEQ ID NO: 5515333 - DNA, 17 bp, Homo sapiens
tcagagttccacagttg

SEQ ID NO: 5515334 - DNA, 20 bp, Homo sapiens
tcagagttcccaagaaagga

SEQ ID NO: 5515335 - DNA, 16 bp, Homo sapiens
tcagagttctttttga

SEQ ID NO: 5515336 - DNA, 21 bp, Homo sapiens
tcagagttgactttcctccca

SEQ ID NO: 5515337 - DNA, 20 bp, Homo sapiens
tcagagttgtacactgtgta

SEQ ID NO: 5515338 - DNA, 18 bp, Homo sapiens
tcagagtttgtgtgtatt

SEQ ID NO: 5515339 - DNA, 20 bp, Homo sapiens
tcagagtttgtgtgtatttg

SEQ ID NO: 5515340 - DNA, 15 bp, Homo sapiens
tcagataaatcatgg

SEQ ID NO: 5515341 - DNA, 21 bp, Homo sapiens
tcagataaatcatgggcattg

SEQ ID NO: 5515342 - DNA, 17 bp, Homo sapiens
tcagataacaactgtga

SEQ ID NO: 5515343 - DNA, 13 bp, Homo sapiens
tcagataactgtt

SEQ ID NO: 5515344 - DNA, 17 bp, Homo sapiens
tcagataagtgtaaata

SEQ ID NO: 5515345 - DNA, 18 bp, Homo sapiens
tcagataagtgtaaatag

SEQ ID NO: 5515346 - DNA, 15 bp, Homo sapiens
tcagataatcggtgc

SEQ ID NO: 5515347 - DNA, 15 bp, Homo sapiens
tcagataatggtaat

SEQ ID NO: 5515348 - DNA, 17 bp, Homo sapiens
tcagataatggtaattt

SEQ ID NO: 5515349 - DNA, 15 bp, Homo sapiens
tcagatacatcactg

SEQ ID NO: 5515350 - DNA, 16 bp, Homo sapiens
tcagatactggattgt

SEQ ID NO: 5515351 - DNA, 19 bp, Homo sapiens
tcagatactggattgtact

SEQ ID NO: 5515352 - DNA, 23 bp, Homo sapiens
tcagatagaaaacagcccccact

SEQ ID NO: 5515353 - DNA, 14 bp, Homo sapiens
tcagatagacctgt

SEQ ID NO: 5515354 - DNA, 13 bp, Homo sapiens
tcagatagcagga

SEQ ID NO: 5515355 - DNA, 13 bp, Homo sapiens
tcagatagtctat

SEQ ID NO: 5515356 - DNA, 15 bp, Homo sapiens
tcagatataaatact

SEQ ID NO: 5515357 - DNA, 15 bp, Homo sapiens
tcagatataagagaa

SEQ ID NO: 5515358 - DNA, 18 bp, Homo sapiens
tcagatatatatcatatt

SEQ ID NO: 5515359 - DNA, 23 bp, Homo sapiens
tcagatatatttttcacagtttt

SEQ ID NO: 5515360 - DNA, 16 bp, Homo sapiens
tcagatatcaaaattc

SEQ ID NO: 5515361 - DNA, 22 bp, Homo sapiens
tcagatatcatactgattttta

SEQ ID NO: 5515362 - DNA, 23 bp, Homo sapiens
tcagatatcttggacaaatcaca

SEQ ID NO: 5515363 - DNA, 16 bp, Homo sapiens
tcagatatgattcaaa

SEQ ID NO: 5515364 - DNA, 17 bp, Homo sapiens
tcagatatgattcaaat

SEQ ID NO: 5515365 - DNA, 18 bp, Homo sapiens
tcagatatgattcaaatg

SEQ ID NO: 5515366 - DNA, 18 bp, Homo sapiens
tcagatattctgctctat

SEQ ID NO: 5515367 - DNA, 13 bp, Homo sapiens
tcagatatttgca

SEQ ID NO: 5515368 - DNA, 14 bp, Homo sapiens
tcagatatttgcac

SEQ ID NO: 5515369 - DNA, 22 bp, Homo sapiens
tcagatattttcatatttaaag

SEQ ID NO: 5515370 - DNA, 23 bp, Homo sapiens
tcagatattttttcagaaatatg

SEQ ID NO: 5515371 - DNA, 19 bp, Homo sapiens
tcagatcaccccagcctca

SEQ ID NO: 5515372 - DNA, 21 bp, Homo sapiens
tcagatcactgaatttataaa

SEQ ID NO: 5515373 - DNA, 23 bp, Homo sapiens
tcagatcagtgtaccatttgcct

SEQ ID NO: 5515374 - DNA, 16 bp, Homo sapiens
tcagatcatggcatcc

SEQ ID NO: 5515375 - DNA, 21 bp, Homo sapiens
tcagatcatttcaaaactcat

SEQ ID NO: 5515376 - DNA, 14 bp, Homo sapiens
tcagatccaggagc

SEQ ID NO: 5515377 - DNA, 16 bp, Homo sapiens
tcagatccccagcttt

SEQ ID NO: 5515378 - DNA, 13 bp, Homo sapiens
tcagatcctcctc

SEQ ID NO: 5515379 - DNA, 15 bp, Homo sapiens
tcagatcctcctcat

SEQ ID NO: 5515380 - DNA, 20 bp, Homo sapiens
tcagatcctgatcttaagag

SEQ ID NO: 5515381 - DNA, 13 bp, Homo sapiens
tcagatcctgctg

SEQ ID NO: 5515382 - DNA, 15 bp, Homo sapiens
tcagatcctgctgcc

SEQ ID NO: 5515383 - DNA, 17 bp, Homo sapiens
tcagatcctgctgccgc

SEQ ID NO: 5515384 - DNA, 15 bp, Homo sapiens
tcagatcctgggcat

SEQ ID NO: 5515385 - DNA, 17 bp, Homo sapiens
tcagatcctgggcatga

SEQ ID NO: 5515386 - DNA, 20 bp, Homo sapiens
tcagatcctggtctgcacct

SEQ ID NO: 5515387 - DNA, 16 bp, Homo sapiens
tcagatcctgttactt

SEQ ID NO: 5515388 - DNA, 22 bp, Homo sapiens
tcagatcctgttacttgcttca

SEQ ID NO: 5515389 - DNA, 16 bp, Homo sapiens
tcagatccttgtttca

SEQ ID NO: 5515390 - DNA, 17 bp, Homo sapiens
tcagatccttgtttcaa

SEQ ID NO: 5515391 - DNA, 19 bp, Homo sapiens
tcagatcgtattaattatc

SEQ ID NO: 5515392 - DNA, 16 bp, Homo sapiens
tcagatctctaacttc

SEQ ID NO: 5515393 - DNA, 15 bp, Homo sapiens
tcagatctgaagtag

SEQ ID NO: 5515394 - DNA, 22 bp, Homo sapiens
tcagatctgaagtagtgtgagt

SEQ ID NO: 5515395 - DNA, 14 bp, Homo sapiens
tcagatctgaggtt

SEQ ID NO: 5515396 - DNA, 13 bp, Homo sapiens
tcagatctgatca

SEQ ID NO: 5515397 - DNA, 21 bp, Homo sapiens
tcagatctgcactcctgtctc

SEQ ID NO: 5515398 - DNA, 15 bp, Homo sapiens
tcagatctgcctaag

SEQ ID NO: 5515399 - DNA, 21 bp, Homo sapiens
tcagatctgcctaaggacttc

SEQ ID NO: 5515400 - DNA, 18 bp, Homo sapiens
tcagatctttctccttga

SEQ ID NO: 5515401 - DNA, 13 bp, Homo sapiens
tcagatctttgca

SEQ ID NO: 5515402 - DNA, 17 bp, Homo sapiens
tcagatgaaaataaaat

SEQ ID NO: 5515403 - DNA, 21 bp, Homo sapiens
tcagatgaactcttagaaatg

SEQ ID NO: 5515404 - DNA, 16 bp, Homo sapiens
tcagcccagctggcca

SEQ ID NO: 5515405 - DNA, 19 bp, Homo sapiens
tcagcccagctggccacct

SEQ ID NO: 5515406 - DNA, 14 bp, Homo sapiens
tcagcccaggtctc

SEQ ID NO: 5515407 - DNA, 16 bp, Homo sapiens
tcagcccaggtctcct

SEQ ID NO: 5515408 - DNA, 18 bp, Homo sapiens
tcagcccatcccctgcct

SEQ ID NO: 5515409 - DNA, 19 bp, Homo sapiens
tcagcccatcccctgcctc

SEQ ID NO: 5515410 - DNA, 21 bp, Homo sapiens
tcagcccatcccctgcctcta

SEQ ID NO: 5515411 - DNA, 19 bp, Homo sapiens
tcagcccatgtcaatcaag

SEQ ID NO: 5515412 - DNA, 15 bp, Homo sapiens
tcagccccaagggct

SEQ ID NO: 5515413 - DNA, 15 bp, Homo sapiens
tcagccccaccccag

SEQ ID NO: 5515414 - DNA, 20 bp, Homo sapiens
tcagccccaccccaggtcct

SEQ ID NO: 5515415 - DNA, 14 bp, Homo sapiens
tcagccccactgac

SEQ ID NO: 5515416 - DNA, 20 bp, Homo sapiens
tcagccccactgacacccag

SEQ ID NO: 5515417 - DNA, 18 bp, Homo sapiens
tcagccccagcccagaca

SEQ ID NO: 5515418 - DNA, 16 bp, Homo sapiens
tcagccccagcccagc

SEQ ID NO: 5515419 - DNA, 22 bp, Homo sapiens
tcagccccagcccagcccagct

SEQ ID NO: 5515420 - DNA, 15 bp, Homo sapiens
tcagccccaggagaa

SEQ ID NO: 5515421 - DNA, 20 bp, Homo sapiens
tcagccccaggagaagggac

SEQ ID NO: 5515422 - DNA, 14 bp, Homo sapiens
tcagccccaggcca

SEQ ID NO: 5515423 - DNA, 15 bp, Homo sapiens
tcagccccaggccag

SEQ ID NO: 5515424 - DNA, 18 bp, Homo sapiens
tcagccccaggccagctg

SEQ ID NO: 5515425 - DNA, 14 bp, Homo sapiens
tcagccccagggcc

SEQ ID NO: 5515426 - DNA, 23 bp, Homo sapiens
tcagccccagggccctgctcagg

SEQ ID NO: 5515427 - DNA, 15 bp, Homo sapiens
tcagcccccaccagg

SEQ ID NO: 5515428 - DNA, 22 bp, Homo sapiens
tcagcccccaccaggggaagga

SEQ ID NO: 5515429 - DNA, 12 bp, Homo sapiens
tcagcccccagc

SEQ ID NO: 5515430 - DNA, 16 bp, Homo sapiens
tcagcccccagcccct

SEQ ID NO: 5515431 - DNA, 18 bp, Homo sapiens
tcagcccccagcccctcc

SEQ ID NO: 5515432 - DNA, 19 bp, Homo sapiens
tcagcccccagcccctccc

SEQ ID NO: 5515433 - DNA, 20 bp, Homo sapiens
tcagcccccagcccctcccc

SEQ ID NO: 5515434 - DNA, 14 bp, Homo sapiens
tcagcccccagcct

SEQ ID NO: 5515435 - DNA, 18 bp, Homo sapiens
tcagcccccaggccaggt

SEQ ID NO: 5515436 - DNA, 17 bp, Homo sapiens
tcagccccctgcttcag

SEQ ID NO: 5515437 - DNA, 16 bp, Homo sapiens
tcagccccgagctgtc

SEQ ID NO: 5515438 - DNA, 13 bp, Homo sapiens
tcagccccggcca

SEQ ID NO: 5515439 - DNA, 14 bp, Homo sapiens
tcagccccggccac

SEQ ID NO: 5515440 - DNA, 23 bp, Homo sapiens
tcagccccggccactccctgcca

SEQ ID NO: 5515441 - DNA, 19 bp, Homo sapiens
tcagccccgggcctgcctc

SEQ ID NO: 5515442 - DNA, 18 bp, Homo sapiens
tcagcccctacccctgcc

SEQ ID NO: 5515443 - DNA, 19 bp, Homo sapiens
tcagcccctacccctgccc

SEQ ID NO: 5515444 - DNA, 14 bp, Homo sapiens
tcagcccctaggag

SEQ ID NO: 5515445 - DNA, 16 bp, Homo sapiens
tcagcccctaggagta

SEQ ID NO: 5515446 - DNA, 23 bp, Homo sapiens
tcagcccctcaaagggagagaaa

SEQ ID NO: 5515447 - DNA, 20 bp, Homo sapiens
tcagcccctcatcagccttt

SEQ ID NO: 5515448 - DNA, 13 bp, Homo sapiens
tcagcccctcctc

SEQ ID NO: 5515449 - DNA, 15 bp, Homo sapiens
tcagcccctcctctg

SEQ ID NO: 5515450 - DNA, 16 bp, Homo sapiens
tcagcccctcctctgc

SEQ ID NO: 5515451 - DNA, 18 bp, Homo sapiens
tcagcccctcctctgcca

SEQ ID NO: 5515452 - DNA, 19 bp, Homo sapiens
tcagcccctcctctgccac

SEQ ID NO: 5515453 - DNA, 20 bp, Homo sapiens
tcagcccctcctctgccacc

SEQ ID NO: 5515454 - DNA, 17 bp, Homo sapiens
tcagcccctcttccctt

SEQ ID NO: 5515455 - DNA, 20 bp, Homo sapiens
tcagcccctcttgcccccca

SEQ ID NO: 5515456 - DNA, 21 bp, Homo sapiens
tcagcccctgatctctgacct

SEQ ID NO: 5515457 - DNA, 18 bp, Homo sapiens
tcagcccctgctgctcct

SEQ ID NO: 5515458 - DNA, 17 bp, Homo sapiens
tcagcccctgggaacag

SEQ ID NO: 5515459 - DNA, 16 bp, Homo sapiens
tcagcccgcttggcca

SEQ ID NO: 5515460 - DNA, 13 bp, Homo sapiens
tcagcccgggaca

SEQ ID NO: 5515461 - DNA, 17 bp, Homo sapiens
tcagcccgtttcagaag

SEQ ID NO: 5515462 - DNA, 18 bp, Homo sapiens
tcagcccgtttcagaagg

SEQ ID NO: 5515463 - DNA, 20 bp, Homo sapiens
tcagccctagaggcgagcca

SEQ ID NO: 5515464 - DNA, 19 bp, Homo sapiens
tcagccctagccctcagcc

SEQ ID NO: 5515465 - DNA, 15 bp, Homo sapiens
tcagccctccctgcc

SEQ ID NO: 5515466 - DNA, 17 bp, Homo sapiens
tcagccctccctgcccc

SEQ ID NO: 5515467 - DNA, 13 bp, Homo sapiens
tcagccctgaaaa

SEQ ID NO: 5515468 - DNA, 15 bp, Homo sapiens
tcagccctgagctgg

SEQ ID NO: 5515469 - DNA, 12 bp, Homo sapiens
tcagccctgctc

SEQ ID NO: 5515470 - DNA, 20 bp, Homo sapiens
tcagccctgctccctgcctc

SEQ ID NO: 5515471 - DNA, 12 bp, Homo sapiens
tcagccctggag

SEQ ID NO: 5515472 - DNA, 12 bp, Homo sapiens
tcagccctggcc

SEQ ID NO: 5515473 - DNA, 13 bp, Homo sapiens
tcagccctggcca

SEQ ID NO: 5515474 - DNA, 16 bp, Homo sapiens
tcagccctggccctgc

SEQ ID NO: 5515475 - DNA, 13 bp, Homo sapiens
tcagccctggcct

SEQ ID NO: 5515476 - DNA, 12 bp, Homo sapiens
tcagccctgggc

SEQ ID NO: 5515477 - DNA, 19 bp, Homo sapiens
tcagcccttggcttctgct

SEQ ID NO: 5515478 - DNA, 11 bp, Homo sapiens
tcagccctttg

SEQ ID NO: 5515479 - DNA, 14 bp, Homo sapiens
tcagccctttgctc

SEQ ID NO: 5515480 - DNA, 16 bp, Homo sapiens
tcagccgggccctgag

SEQ ID NO: 5515481 - DNA, 20 bp, Homo sapiens
tcagccgtagggtggcactg

SEQ ID NO: 5515482 - DNA, 10 bp, Homo sapiens
tcagccgtgc

SEQ ID NO: 5515483 - DNA, 23 bp, Homo sapiens
tcagccgtgtaaccatggaccca

SEQ ID NO: 5515484 - DNA, 21 bp, Homo sapiens
tcagcctaagaaacactcatg

SEQ ID NO: 5515485 - DNA, 20 bp, Homo sapiens
tcagcctaccgctggccctg

SEQ ID NO: 5515486 - DNA, 19 bp, Homo sapiens
tcagcctagccgacctcag

SEQ ID NO: 5515487 - DNA, 20 bp, Homo sapiens
tcagcctagccgacctcagc

SEQ ID NO: 5515488 - DNA, 19 bp, Homo sapiens
tcagcctagtggcttgtcc

SEQ ID NO: 5515489 - DNA, 17 bp, Homo sapiens
tcagcctcatcctgaga

SEQ ID NO: 5515490 - DNA, 18 bp, Homo sapiens
tcagcctcattcagcatg

SEQ ID NO: 5515491 - DNA, 23 bp, Homo sapiens
tcagcctccaaagtggagctggg

SEQ ID NO: 5515492 - DNA, 23 bp, Homo sapiens
tcagcctccaatgcattggcctc

SEQ ID NO: 5515493 - DNA, 12 bp, Homo sapiens
tcagcctccact

SEQ ID NO: 5515494 - DNA, 14 bp, Homo sapiens
tcagcctccactcc

SEQ ID NO: 5515495 - DNA, 21 bp, Homo sapiens
tcagcctccactccctgtctg

SEQ ID NO: 5515496 - DNA, 11 bp, Homo sapiens
tcagcctccag

SEQ ID NO: 5515497 - DNA, 16 bp, Homo sapiens
tcagcctccagcctct

SEQ ID NO: 5515498 - DNA, 17 bp, Homo sapiens
tcagcctccagcctctg

SEQ ID NO: 5515499 - DNA, 18 bp, Homo sapiens
tcagcctccagcctctgt

SEQ ID NO: 5515500 - DNA, 13 bp, Homo sapiens
tcagcctcccaaa

SEQ ID NO: 5515501 - DNA, 21 bp, Homo sapiens
tcagcctcccaaagtgctggg

SEQ ID NO: 5515502 - DNA, 22 bp, Homo sapiens
tcagcctcccaaagtgctggga

SEQ ID NO: 5515503 - DNA, 23 bp, Homo sapiens
tcagcctcccaaagtgctgggat

SEQ ID NO: 5515504 - DNA, 19 bp, Homo sapiens
tcagcctcccaaccccagg

SEQ ID NO: 5515505 - DNA, 22 bp, Homo sapiens
tcagcctcccaagtagctggga

SEQ ID NO: 5515506 - DNA, 17 bp, Homo sapiens
tcagcctccccctgctg

SEQ ID NO: 5515507 - DNA, 21 bp, Homo sapiens
tcagcctccccctgctgctca

SEQ ID NO: 5515508 - DNA, 14 bp, Homo sapiens
tcagcctccccttc

SEQ ID NO: 5515509 - DNA, 16 bp, Homo sapiens
tcagcctccccttctt

SEQ ID NO: 5515510 - DNA, 17 bp, Homo sapiens
tcagcctccccttcttc

SEQ ID NO: 5515511 - DNA, 22 bp, Homo sapiens
tcagcctccccttcttcccgcc

SEQ ID NO: 5515512 - DNA, 22 bp, Homo sapiens
tcagcctcccgaatagctggga

SEQ ID NO: 5515513 - DNA, 20 bp, Homo sapiens
tcagcctcccgagtagctgg

SEQ ID NO: 5515514 - DNA, 12 bp, Homo sapiens
tcagcctccctc

SEQ ID NO: 5515515 - DNA, 13 bp, Homo sapiens
tcagcctccctca

SEQ ID NO: 5515516 - DNA, 14 bp, Homo sapiens
tcagcctccctcag

SEQ ID NO: 5515517 - DNA, 22 bp, Homo sapiens
tcagcctccctcagcccccagg

SEQ ID NO: 5515518 - DNA, 20 bp, Homo sapiens
tcagcctccctggtagctgg

SEQ ID NO: 5515519 - DNA, 21 bp, Homo sapiens
tcagcctcctaagcagctggg

SEQ ID NO: 5515520 - DNA, 22 bp, Homo sapiens
tcagcctcctaagcagctggga

SEQ ID NO: 5515521 - DNA, 23 bp, Homo sapiens
tcagcctcctaagcagctgggac

SEQ ID NO: 5515522 - DNA, 13 bp, Homo sapiens
tcagcctcctcat

SEQ ID NO: 5515523 - DNA, 12 bp, Homo sapiens
tcagcctcctga

SEQ ID NO: 5515524 - DNA, 13 bp, Homo sapiens
tcagcctcctgag

SEQ ID NO: 5515525 - DNA, 21 bp, Homo sapiens
tcagcctcctgagtagctggg

SEQ ID NO: 5515526 - DNA, 22 bp, Homo sapiens
tcagcctcctgagtagctggga

SEQ ID NO: 5515527 - DNA, 15 bp, Homo sapiens
tcagcctcctgggta

SEQ ID NO: 5515528 - DNA, 14 bp, Homo sapiens
tcagcctcctgtct

SEQ ID NO: 5515529 - DNA, 14 bp, Homo sapiens
tcagcctcctgtgt

SEQ ID NO: 5515530 - DNA, 13 bp, Homo sapiens
tcagcctcgcagg

SEQ ID NO: 5515531 - DNA, 21 bp, Homo sapiens
tcagcctctcaaatagctggg

SEQ ID NO: 5515532 - DNA, 20 bp, Homo sapiens
tcagcctctcaagtagctgg

SEQ ID NO: 5515533 - DNA, 18 bp, Homo sapiens
tcagcctctctcccagtc

SEQ ID NO: 5515534 - DNA, 19 bp, Homo sapiens
tcagcctctctcccagtct

SEQ ID NO: 5515535 - DNA, 13 bp, Homo sapiens
tcagcctctgcca

SEQ ID NO: 5515536 - DNA, 13 bp, Homo sapiens
tcagcctctgctg

SEQ ID NO: 5515537 - DNA, 18 bp, Homo sapiens
tcagcctctgctggagaa

SEQ ID NO: 5515538 - DNA, 13 bp, Homo sapiens
tcagcctctggcc

SEQ ID NO: 5515539 - DNA, 15 bp, Homo sapiens
tcagcctctggccag

SEQ ID NO: 5515540 - DNA, 21 bp, Homo sapiens
tcagcctcttaaagctgcctg

SEQ ID NO: 5515541 - DNA, 22 bp, Homo sapiens
tcagcctcttaaagctgcctgt

SEQ ID NO: 5515542 - DNA, 17 bp, Homo sapiens
tcagcctcttaccttcc

SEQ ID NO: 5515543 - DNA, 10 bp, Homo sapiens
tcagcctgag

SEQ ID NO: 5515544 - DNA, 22 bp, Homo sapiens
tcagcctgatcaggcttcctgg

SEQ ID NO: 5515545 - DNA, 12 bp, Homo sapiens
tcagcctgcaca

SEQ ID NO: 5515546 - DNA, 20 bp, Homo sapiens
tcagcctgcagttaattagc

SEQ ID NO: 5515547 - DNA, 20 bp, Homo sapiens
tcagcctgcctgaagagagg

SEQ ID NO: 5515548 - DNA, 14 bp, Homo sapiens
tcagcctgcctggg

SEQ ID NO: 5515549 - DNA, 16 bp, Homo sapiens
tcagcctgcctgggag

SEQ ID NO: 5515550 - DNA, 19 bp, Homo sapiens
tcagcctgctccagctgtt

SEQ ID NO: 5515551 - DNA, 21 bp, Homo sapiens
tcagcctgctgcccaggctgt

SEQ ID NO: 5515552 - DNA, 22 bp, Homo sapiens
tcagcctgctgcccaggctgtg

SEQ ID NO: 5515553 - DNA, 13 bp, Homo sapiens
tcagcctgcttct

SEQ ID NO: 5515554 - DNA, 17 bp, Homo sapiens
tcagcctgctttcctgc

SEQ ID NO: 5515555 - DNA, 11 bp, Homo sapiens
tcagcctggaa

SEQ ID NO: 5515556 - DNA, 12 bp, Homo sapiens
tcagcctggaag

SEQ ID NO: 5515557 - DNA, 18 bp, Homo sapiens
tcagcctggagaggcctg

SEQ ID NO: 5515558 - DNA, 19 bp, Homo sapiens
tcagcctggagaggcctgg

SEQ ID NO: 5515559 - DNA, 12 bp, Homo sapiens
tcagcctggatt

SEQ ID NO: 5515560 - DNA, 12 bp, Homo sapiens
tcagcctggcca

SEQ ID NO: 5515561 - DNA, 15 bp, Homo sapiens
tcagcctggccagac

SEQ ID NO: 5515562 - DNA, 16 bp, Homo sapiens
tcagcctggccagaca

SEQ ID NO: 5515563 - DNA, 21 bp, Homo sapiens
tcagcctggcctgcccgtgcc

SEQ ID NO: 5515564 - DNA, 22 bp, Homo sapiens
tcagcctggctgggctctggtg

SEQ ID NO: 5515565 - DNA, 20 bp, Homo sapiens
tcagcctgggcccctcagcc

SEQ ID NO: 5515566 - DNA, 23 bp, Homo sapiens
tcagcctgggcccctcagccacc

SEQ ID NO: 5515567 - DNA, 16 bp, Homo sapiens
tcagcctgggcgctgg

SEQ ID NO: 5515568 - DNA, 19 bp, Homo sapiens
tcagcctgggcgctggtcc

SEQ ID NO: 5515569 - DNA, 12 bp, Homo sapiens
tcagcctggggc

SEQ ID NO: 5515570 - DNA, 22 bp, Homo sapiens
tcagcctggggctctctgaccc

SEQ ID NO: 5515571 - DNA, 12 bp, Homo sapiens
tcagcctggggt

SEQ ID NO: 5515572 - DNA, 17 bp, Homo sapiens
tcagcctggtttctggg

SEQ ID NO: 5515573 - DNA, 20 bp, Homo sapiens
tcagcctgtctcgggctgac

SEQ ID NO: 5515574 - DNA, 16 bp, Homo sapiens
tcagcctgtctcttcc

SEQ ID NO: 5515575 - DNA, 12 bp, Homo sapiens
tcagcctgtgaa

SEQ ID NO: 5515576 - DNA, 17 bp, Homo sapiens
tcagcctgtgctgcccg

SEQ ID NO: 5515577 - DNA, 16 bp, Homo sapiens
tcagcctgtgctgtgg

SEQ ID NO: 5515578 - DNA, 19 bp, Homo sapiens
tcagcctgtgctgtggcat

SEQ ID NO: 5515579 - DNA, 22 bp, Homo sapiens
tcagcctgttccagaaggagga

SEQ ID NO: 5515580 - DNA, 16 bp, Homo sapiens
tcagccttacatttgt

SEQ ID NO: 5515581 - DNA, 18 bp, Homo sapiens
tcagccttatccaggttg

SEQ ID NO: 5515582 - DNA, 22 bp, Homo sapiens
tcagccttatgtggaagaactg

SEQ ID NO: 5515583 - DNA, 13 bp, Homo sapiens
tcaggaggcaggg

SEQ ID NO: 5515584 - DNA, 18 bp, Homo sapiens
tcaggaggccctggtgtc

SEQ ID NO: 5515585 - DNA, 21 bp, Homo sapiens
tcaggaggccctggtgtcagg

SEQ ID NO: 5515586 - DNA, 21 bp, Homo sapiens
tcaggaggcgaataaatgttc

SEQ ID NO: 5515587 - DNA, 18 bp, Homo sapiens
tcaggaggcgcagcccga

SEQ ID NO: 5515588 - DNA, 14 bp, Homo sapiens
tcaggaggctgaga

SEQ ID NO: 5515589 - DNA, 22 bp, Homo sapiens
tcaggaggctgagacaggagaa

SEQ ID NO: 5515590 - DNA, 18 bp, Homo sapiens
tcaggaggctgaggcaga

SEQ ID NO: 5515591 - DNA, 18 bp, Homo sapiens
tcaggaggctgaggggag

SEQ ID NO: 5515592 - DNA, 17 bp, Homo sapiens
tcaggagggcaggctga

SEQ ID NO: 5515593 - DNA, 21 bp, Homo sapiens
tcaggagggtgacgcccagct

SEQ ID NO: 5515594 - DNA, 23 bp, Homo sapiens
tcaggaggtcacctgccgccctg

SEQ ID NO: 5515595 - DNA, 24 bp, Homo sapiens
tcaggaggtgtctcctaccctctt

SEQ ID NO: 5515596 - DNA, 17 bp, Homo sapiens
tcaggagtccactgcct

SEQ ID NO: 5515597 - DNA, 22 bp, Homo sapiens
tcaggagtctctggtagcctgc

SEQ ID NO: 5515598 - DNA, 15 bp, Homo sapiens
tcaggagtctgccac

SEQ ID NO: 5515599 - DNA, 23 bp, Homo sapiens
tcaggagttagaaatctccagtg

SEQ ID NO: 5515600 - DNA, 20 bp, Homo sapiens
tcaggagttcgagaccagcc

SEQ ID NO: 5515601 - DNA, 23 bp, Homo sapiens
tcaggagttcgagaccagcccag

SEQ ID NO: 5515602 - DNA, 18 bp, Homo sapiens
tcaggagtttgagaccag

SEQ ID NO: 5515603 - DNA, 22 bp, Homo sapiens
tcaggagtttgagaccaggctg

SEQ ID NO: 5515604 - DNA, 18 bp, Homo sapiens
tcaggatactctgtcaga

SEQ ID NO: 5515605 - DNA, 15 bp, Homo sapiens
tcaggatactgtagt

SEQ ID NO: 5515606 - DNA, 22 bp, Homo sapiens
tcaggatatccttatcagagct

SEQ ID NO: 5515607 - DNA, 23 bp, Homo sapiens
tcaggatattagttaatgagcca

SEQ ID NO: 5515608 - DNA, 20 bp, Homo sapiens
tcaggatattggttcttccc

SEQ ID NO: 5515609 - DNA, 22 bp, Homo sapiens
tcaggatccaagctaagcactg

SEQ ID NO: 5515610 - DNA, 21 bp, Homo sapiens
tcaggatccaagtgacaaagt

SEQ ID NO: 5515611 - DNA, 20 bp, Homo sapiens
tcaggatccagtctggaaaa

SEQ ID NO: 5515612 - DNA, 13 bp, Homo sapiens
tcaggatccagtg

SEQ ID NO: 5515613 - DNA, 17 bp, Homo sapiens
tcaggatccagtgacat

SEQ ID NO: 5515614 - DNA, 16 bp, Homo sapiens
tcaggatgaacccagg

SEQ ID NO: 5515615 - DNA, 14 bp, Homo sapiens
tcaggatgaggccc

SEQ ID NO: 5515616 - DNA, 20 bp, Homo sapiens
tcaggatgcacggtttctgt

SEQ ID NO: 5515617 - DNA, 20 bp, Homo sapiens
tcaggatgccaagtggccct

SEQ ID NO: 5515618 - DNA, 14 bp, Homo sapiens
tcaggatgcccagg

SEQ ID NO: 5515619 - DNA, 15 bp, Homo sapiens
tcaggatgcccaggg

SEQ ID NO: 5515620 - DNA, 22 bp, Homo sapiens
tcaggatgggaagaaaaaggaa

SEQ ID NO: 5515621 - DNA, 21 bp, Homo sapiens
tcaggatgtcctttgtgtcca

SEQ ID NO: 5515622 - DNA, 18 bp, Homo sapiens
tcaggattaactaaagaa

SEQ ID NO: 5515623 - DNA, 17 bp, Homo sapiens
tcaggattctgttcctt

SEQ ID NO: 5515624 - DNA, 23 bp, Homo sapiens
tcaggattgaggatgaactcagg

SEQ ID NO: 5515625 - DNA, 18 bp, Homo sapiens
tcaggattgcaggtgcct

SEQ ID NO: 5515626 - DNA, 13 bp, Homo sapiens
tcaggattgcgag

SEQ ID NO: 5515627 - DNA, 21 bp, Homo sapiens
tcaggattgcgagagatgtgt

SEQ ID NO: 5515628 - DNA, 13 bp, Homo sapiens
tcaggattgtctg

SEQ ID NO: 5515629 - DNA, 17 bp, Homo sapiens
tcaggatttcctcttga

SEQ ID NO: 5515630 - DNA, 18 bp, Homo sapiens
tcaggatttggtttttct

SEQ ID NO: 5515631 - DNA, 21 bp, Homo sapiens
tcaggatttttacaagttggt

SEQ ID NO: 5515632 - DNA, 15 bp, Homo sapiens
tcaggatttttggta

SEQ ID NO: 5515633 - DNA, 15 bp, Homo sapiens
tcaggcaagcccctc

SEQ ID NO: 5515634 - DNA, 21 bp, Homo sapiens
tcaggcaagcccctcagccct

SEQ ID NO: 5515635 - DNA, 20 bp, Homo sapiens
tcaggcaaggaggaggagtc

SEQ ID NO: 5515636 - DNA, 13 bp, Homo sapiens
tcaggcaaggcag

SEQ ID NO: 5515637 - DNA, 14 bp, Homo sapiens
tcaggcaaggcagc

SEQ ID NO: 5515638 - DNA, 16 bp, Homo sapiens
tcaggcaaggcagctc

SEQ ID NO: 5515639 - DNA, 17 bp, Homo sapiens
tcaggcaaggtctggcc

SEQ ID NO: 5515640 - DNA, 22 bp, Homo sapiens
tcaggcaatgccctgcggctct

SEQ ID NO: 5515641 - DNA, 22 bp, Homo sapiens
tcaggcaattcctacctcttca

SEQ ID NO: 5515642 - DNA, 19 bp, Homo sapiens
tcaggcaattgattgtgaa

SEQ ID NO: 5515643 - DNA, 20 bp, Homo sapiens
tcaggcaattgattgtgaat

SEQ ID NO: 5515644 - DNA, 20 bp, Homo sapiens
tcaggcacacaaggggccct

SEQ ID NO: 5515645 - DNA, 13 bp, Homo sapiens
tcaggcacacagc

SEQ ID NO: 5515646 - DNA, 17 bp, Homo sapiens
tcaggcacaggcaggaa

SEQ ID NO: 5515647 - DNA, 13 bp, Homo sapiens
tcaggcacaggtc

SEQ ID NO: 5515648 - DNA, 15 bp, Homo sapiens
tcaggcacatgtgtt

SEQ ID NO: 5515649 - DNA, 17 bp, Homo sapiens
tcaggcacatgtgttca

SEQ ID NO: 5515650 - DNA, 18 bp, Homo sapiens
tcaggcaccagtccctgt

SEQ ID NO: 5515651 - DNA, 16 bp, Homo sapiens
tcaggcacgtctcctg

SEQ ID NO: 5515652 - DNA, 18 bp, Homo sapiens
tcaggcacgtctcctgct

SEQ ID NO: 5515653 - DNA, 19 bp, Homo sapiens
tcaggcacgtctcctgctg

SEQ ID NO: 5515654 - DNA, 23 bp, Homo sapiens
tcaggcacgtctcctgctgcgtg

SEQ ID NO: 5515655 - DNA, 16 bp, Homo sapiens
tcaggcactagccttt

SEQ ID NO: 5515656 - DNA, 17 bp, Homo sapiens
tcaggcactggtggcat

SEQ ID NO: 5515657 - DNA, 15 bp, Homo sapiens
tcaggcagacaagag

SEQ ID NO: 5515658 - DNA, 20 bp, Homo sapiens
tcaggcagacaagagctgct

SEQ ID NO: 5515659 - DNA, 22 bp, Homo sapiens
tcaggcagacaagagctgctgt

SEQ ID NO: 5515660 - DNA, 22 bp, Homo sapiens
tcaggcagagctgtggcacaga

SEQ ID NO: 5515661 - DNA, 19 bp, Homo sapiens
tcaggcagaggatgttctg

SEQ ID NO: 5515662 - DNA, 15 bp, Homo sapiens
tcaggcagcaccaca

SEQ ID NO: 5515663 - DNA, 14 bp, Homo sapiens
tcaggcagcactga

SEQ ID NO: 5515664 - DNA, 13 bp, Homo sapiens
tcaggcagccagt

SEQ ID NO: 5515665 - DNA, 14 bp, Homo sapiens
tcaggcagcctgtg

SEQ ID NO: 5515666 - DNA, 12 bp, Homo sapiens
tcaggcagcctt

SEQ ID NO: 5515667 - DNA, 17 bp, Homo sapiens
tcaggcaggaccaggtg

SEQ ID NO: 5515668 - DNA, 15 bp, Homo sapiens
tcaggcagtagcagc

SEQ ID NO: 5515669 - DNA, 21 bp, Homo sapiens
tcaggcagtagcagctgtgtt

SEQ ID NO: 5515670 - DNA, 15 bp, Homo sapiens
tcaggcagtgtttaa

SEQ ID NO: 5515671 - DNA, 20 bp, Homo sapiens
tcaggcataggcctgggtgc

SEQ ID NO: 5515672 - DNA, 19 bp, Homo sapiens
tcaggcatgaacatgtact

SEQ ID NO: 5515673 - DNA, 17 bp, Homo sapiens
tcaggcatgcctgtgtg

SEQ ID NO: 5515674 - DNA, 22 bp, Homo sapiens
tcaggcatgcgaatgagctggg

SEQ ID NO: 5515675 - DNA, 12 bp, Homo sapiens
tcaggcatggct

SEQ ID NO: 5515676 - DNA, 21 bp, Homo sapiens
tcaggcattgaatgacaagca

SEQ ID NO: 5515677 - DNA, 22 bp, Homo sapiens
tcaggcattttcccccttggct

SEQ ID NO: 5515678 - DNA, 13 bp, Homo sapiens
tcaggcattttgt

SEQ ID NO: 5515679 - DNA, 17 bp, Homo sapiens
tcaggcatttttccaaa

SEQ ID NO: 5515680 - DNA, 19 bp, Homo sapiens
tcaggccaaagacctccca

SEQ ID NO: 5515681 - DNA, 18 bp, Homo sapiens
tcaggccaaccccaaaga

SEQ ID NO: 5515682 - DNA, 13 bp, Homo sapiens
tcaggccacttga

SEQ ID NO: 5515683 - DNA, 15 bp, Homo sapiens
tcaggccagcccagc

SEQ ID NO: 5515684 - DNA, 18 bp, Homo sapiens
tcaggccagcctgtccct

SEQ ID NO: 5515685 - DNA, 20 bp, Homo sapiens
tcaggccagctgcttgggct

SEQ ID NO: 5515686 - DNA, 12 bp, Homo sapiens
tcaggccaggcc

SEQ ID NO: 5515687 - DNA, 18 bp, Homo sapiens
tcaggccaggccctctgc

SEQ ID NO: 5515688 - DNA, 19 bp, Homo sapiens
tcaggccaggccctctgcc

SEQ ID NO: 5515689 - DNA, 21 bp, Homo sapiens
tcaggccaggccctctgccca

SEQ ID NO: 5515690 - DNA, 22 bp, Homo sapiens
tcaggccaggccctctgcccac

SEQ ID NO: 5515691 - DNA, 13 bp, Homo sapiens
tcaggccagggct

SEQ ID NO: 5515692 - DNA, 11 bp, Homo sapiens
tcaggccaggt

SEQ ID NO: 5515693 - DNA, 22 bp, Homo sapiens
tcaggccaggtagcagcaaata

SEQ ID NO: 5515694 - DNA, 16 bp, Homo sapiens
tcaggccaggtgcagt

SEQ ID NO: 5515695 - DNA, 14 bp, Homo sapiens
tcaggccagtgcca

SEQ ID NO: 5515696 - DNA, 20 bp, Homo sapiens
tcaggccagtgccaggacag

SEQ ID NO: 5515697 - DNA, 22 bp, Homo sapiens
tcaggccatcatcagtggagcc

SEQ ID NO: 5515698 - DNA, 15 bp, Homo sapiens
tcaggccatggctcc

SEQ ID NO: 5515699 - DNA, 15 bp, Homo sapiens
tcaggccattcccca

SEQ ID NO: 5515700 - DNA, 13 bp, Homo sapiens
tcaggcccacatt

SEQ ID NO: 5515701 - DNA, 17 bp, Homo sapiens
tcaggcccactgcagag

SEQ ID NO: 5515702 - DNA, 22 bp, Homo sapiens
tcaggcccagcctctctggctc

SEQ ID NO: 5515703 - DNA, 24 bp, Homo sapiens
tcaggcccagcctctctggctcag

SEQ ID NO: 5515704 - DNA, 16 bp, Homo sapiens
tcaggcccagctgctc

SEQ ID NO: 5515705 - DNA, 15 bp, Homo sapiens
tcaggcccaggagtc

SEQ ID NO: 5515706 - DNA, 18 bp, Homo sapiens
tcaggcccaggagtccag

SEQ ID NO: 5515707 - DNA, 12 bp, Homo sapiens
tcaggcccaggc

SEQ ID NO: 5515708 - DNA, 17 bp, Homo sapiens
tcaggccccacccctgt

SEQ ID NO: 5515709 - DNA, 21 bp, Homo sapiens
tcaggcccccagtgggaccac

SEQ ID NO: 5515710 - DNA, 22 bp, Homo sapiens
tcaggcccccgccttggcctgt

SEQ ID NO: 5515711 - DNA, 22 bp, Homo sapiens
tcaggccccgccccatgggccc

SEQ ID NO: 5515712 - DNA, 19 bp, Homo sapiens
tcaggcccgtcggagctgc

SEQ ID NO: 5515713 - DNA, 14 bp, Homo sapiens
tcaggccctcagct

SEQ ID NO: 5515714 - DNA, 16 bp, Homo sapiens
tcaggccctctgcctg

SEQ ID NO: 5515715 - DNA, 18 bp, Homo sapiens
tcaggccctctgcctgca

SEQ ID NO: 5515716 - DNA, 19 bp, Homo sapiens
tcaggccctctgcctgcac

SEQ ID NO: 5515717 - DNA, 20 bp, Homo sapiens
tcaggccctctgcctgcact

SEQ ID NO: 5515718 - DNA, 16 bp, Homo sapiens
tcaggccctgactcct

SEQ ID NO: 5515719 - DNA, 18 bp, Homo sapiens
tcaggccctgactcctct

SEQ ID NO: 5515720 - DNA, 15 bp, Homo sapiens
tcaggccgagagcct

SEQ ID NO: 5515721 - DNA, 18 bp, Homo sapiens
tcaggccggcagccccag

SEQ ID NO: 5515722 - DNA, 22 bp, Homo sapiens
tcaggccggcagccccagcctg

SEQ ID NO: 5515723 - DNA, 17 bp, Homo sapiens
tcaggcctagaggcctg

SEQ ID NO: 5515724 - DNA, 17 bp, Homo sapiens
tcaggcctaggaggccc

SEQ ID NO: 5515725 - DNA, 20 bp, Homo sapiens
tcaggcctcacccctcccct

SEQ ID NO: 5515726 - DNA, 14 bp, Homo sapiens
tcaggcctcacctg

SEQ ID NO: 5515727 - DNA, 22 bp, Homo sapiens
tcaggcctcacctggcttccca

SEQ ID NO: 5515728 - DNA, 11 bp, Homo sapiens
tcaggcctcca

SEQ ID NO: 5515729 - DNA, 11 bp, Homo sapiens
tcaggcctctg

SEQ ID NO: 5515730 - DNA, 21 bp, Homo sapiens
tcaggcctctgagcccaagct

SEQ ID NO: 5515731 - DNA, 15 bp, Homo sapiens
tcaggcctctgagga

SEQ ID NO: 5515732 - DNA, 16 bp, Homo sapiens
tcaggcctctgaggag

SEQ ID NO: 5515733 - DNA, 17 bp, Homo sapiens
tcaggcctgccaatgcc

SEQ ID NO: 5515734 - DNA, 21 bp, Homo sapiens
tcaggcctgccaatgccacag

SEQ ID NO: 5515735 - DNA, 22 bp, Homo sapiens
tcaggcctgccaatgccacagc

SEQ ID NO: 5515736 - DNA, 15 bp, Homo sapiens
tcaggcctggccctt

SEQ ID NO: 5515737 - DNA, 18 bp, Homo sapiens
tcaggcctggccctttca

SEQ ID NO: 5515738 - DNA, 16 bp, Homo sapiens
tcaggcctgggcagga

SEQ ID NO: 5515739 - DNA, 21 bp, Homo sapiens
tcaggcctgggggctgggcag

SEQ ID NO: 5515740 - DNA, 17 bp, Homo sapiens
tcaggcctgtgcccact

SEQ ID NO: 5515741 - DNA, 21 bp, Homo sapiens
tcaggcgatccacctgtctca

SEQ ID NO: 5515742 - DNA, 16 bp, Homo sapiens
tcaggcgcctggcaca

SEQ ID NO: 5515743 - DNA, 21 bp, Homo sapiens
tcaggcggggaggaggagctg

SEQ ID NO: 5515744 - DNA, 23 bp, Homo sapiens
tcaggcgtagatcaccagaataa

SEQ ID NO: 5515745 - DNA, 16 bp, Homo sapiens
tcaggctaagaccctg

SEQ ID NO: 5515746 - DNA, 17 bp, Homo sapiens
tcaggctaagaccctgt

SEQ ID NO: 5515747 - DNA, 19 bp, Homo sapiens
tcaggctacctttttctgg

SEQ ID NO: 5515748 - DNA, 21 bp, Homo sapiens
tcaggctactgttcttgacaa

SEQ ID NO: 5515749 - DNA, 13 bp, Homo sapiens
tcaggctagatgt

SEQ ID NO: 5515750 - DNA, 13 bp, Homo sapiens
tcaggctagccct

SEQ ID NO: 5515751 - DNA, 18 bp, Homo sapiens
tcaggctagccctgccct

SEQ ID NO: 5515752 - DNA, 14 bp, Homo sapiens
tcaggctagctgtg

SEQ ID NO: 5515753 - DNA, 17 bp, Homo sapiens
tcaggctaggccagcag

SEQ ID NO: 5515754 - DNA, 22 bp, Homo sapiens
tcaggctatatgcagtccttta

SEQ ID NO: 5515755 - DNA, 12 bp, Homo sapiens
tcaggctcaacc

SEQ ID NO: 5515756 - DNA, 15 bp, Homo sapiens
tcaggctcaagtttt

SEQ ID NO: 5515757 - DNA, 20 bp, Homo sapiens
tcaggctccattaggatttg

SEQ ID NO: 5515758 - DNA, 12 bp, Homo sapiens
tcaggctcccag

SEQ ID NO: 5515759 - DNA, 14 bp, Homo sapiens
tcaggctccccaga

SEQ ID NO: 5515760 - DNA, 17 bp, Homo sapiens
tcaggctccccagtgct

SEQ ID NO: 5515761 - DNA, 15 bp, Homo sapiens
tcaggctcgccaagg

SEQ ID NO: 5515762 - DNA, 18 bp, Homo sapiens
tcaggctcgccaaggcct

SEQ ID NO: 5515763 - DNA, 19 bp, Homo sapiens
tcaggctctgccctgccct

SEQ ID NO: 5515764 - DNA, 13 bp, Homo sapiens
tcaggctctgctg

SEQ ID NO: 5515765 - DNA, 12 bp, Homo sapiens
tcaggctctggc

SEQ ID NO: 5515766 - DNA, 18 bp, Homo sapiens
tcaggctctgttcctcaa

SEQ ID NO: 5515767 - DNA, 16 bp, Homo sapiens
tcaggctcttctcctt

SEQ ID NO: 5515768 - DNA, 16 bp, Homo sapiens
tcaggctgaaaacaat

SEQ ID NO: 5515769 - DNA, 13 bp, Homo sapiens
tcaggctgagccc

SEQ ID NO: 5515770 - DNA, 19 bp, Homo sapiens
tcaggctgagggaggcaga

SEQ ID NO: 5515771 - DNA, 17 bp, Homo sapiens
tcaggctgcagaggcac

SEQ ID NO: 5515772 - DNA, 12 bp, Homo sapiens
tcaggctgcagc

SEQ ID NO: 5515773 - DNA, 12 bp, Homo sapiens
tcaggctgctgg

SEQ ID NO: 5515774 - DNA, 14 bp, Homo sapiens
tcaggctgctggcg

SEQ ID NO: 5515775 - DNA, 22 bp, Homo sapiens
tcaggctgctggcgcctctgca

SEQ ID NO: 5515776 - DNA, 15 bp, Homo sapiens
tcaggctgcttggga

SEQ ID NO: 5515777 - DNA, 14 bp, Homo sapiens
tcaggctggcatct

SEQ ID NO: 5515778 - DNA, 22 bp, Homo sapiens
tcaggctggcatctcccccacc

SEQ ID NO: 5515779 - DNA, 12 bp, Homo sapiens
tcaggctggctc

SEQ ID NO: 5515780 - DNA, 11 bp, Homo sapiens
tcaggctggga

SEQ ID NO: 5515781 - DNA, 20 bp, Homo sapiens
tcaggctgggcagccccaga

SEQ ID NO: 5515782 - DNA, 22 bp, Homo sapiens
tcaggctgggcagccccagaga

SEQ ID NO: 5515783 - DNA, 14 bp, Homo sapiens
tcaggctggtggga

SEQ ID NO: 5515784 - DNA, 16 bp, Homo sapiens
tcaggctggtgggagg

SEQ ID NO: 5515785 - DNA, 23 bp, Homo sapiens
tcaggctgtcagtgtttggtgca

SEQ ID NO: 5515786 - DNA, 13 bp, Homo sapiens
tcaggctgtccca

SEQ ID NO: 5515787 - DNA, 21 bp, Homo sapiens
tcaggctgtgcttacctgtga

SEQ ID NO: 5515788 - DNA, 13 bp, Homo sapiens
tcaggcttcctgg

SEQ ID NO: 5515789 - DNA, 19 bp, Homo sapiens
tcaggcttcctggtgagaa

SEQ ID NO: 5515790 - DNA, 23 bp, Homo sapiens
tcaggcttccttggcatcacagg

SEQ ID NO: 5515791 - DNA, 12 bp, Homo sapiens
tcaggcttctca

SEQ ID NO: 5515792 - DNA, 18 bp, Homo sapiens
tcaggcttgaaatgcatt

SEQ ID NO: 5515793 - DNA, 18 bp, Homo sapiens
tcaggcttggaatgaatt

SEQ ID NO: 5515794 - DNA, 21 bp, Homo sapiens
tcaggctttcactatttcctt

SEQ ID NO: 5515795 - DNA, 16 bp, Homo sapiens
tcagggaaaagcagct

SEQ ID NO: 5515796 - DNA, 18 bp, Homo sapiens
tcagggaaaagcagctct

SEQ ID NO: 5515797 - DNA, 13 bp, Homo sapiens
tcagggaaagcat

SEQ ID NO: 5515798 - DNA, 22 bp, Homo sapiens
tcagggaaagcatttaaagggt

SEQ ID NO: 5515799 - DNA, 17 bp, Homo sapiens
tcagggaaatggagggt

SEQ ID NO: 5515800 - DNA, 15 bp, Homo sapiens
tcagggaaatggcct

SEQ ID NO: 5515801 - DNA, 16 bp, Homo sapiens
tcagggaaatggcctt

SEQ ID NO: 5515802 - DNA, 17 bp, Homo sapiens
tcagggaagcaggcaga

SEQ ID NO: 5515803 - DNA, 15 bp, Homo sapiens
tcagggaagcccagc

SEQ ID NO: 5515804 - DNA, 20 bp, Homo sapiens
tcagggaagcccagctccag

SEQ ID NO: 5515805 - DNA, 17 bp, Homo sapiens
tcagggaaggtgaaaca

SEQ ID NO: 5515806 - DNA, 22 bp, Homo sapiens
tcagggaatccagctccctaga

SEQ ID NO: 5515807 - DNA, 23 bp, Homo sapiens
tcagggacagagacacctgcacc

SEQ ID NO: 5515808 - DNA, 14 bp, Homo sapiens
tcagggacagagcc

SEQ ID NO: 5515809 - DNA, 15 bp, Homo sapiens
tcagggacagagcca

SEQ ID NO: 5515810 - DNA, 14 bp, Homo sapiens
tcagggacagcagc

SEQ ID NO: 5515811 - DNA, 15 bp, Homo sapiens
tcagggaccaaggag

SEQ ID NO: 5515812 - DNA, 19 bp, Homo sapiens
tcagggaccaaggagatgg

SEQ ID NO: 5515813 - DNA, 13 bp, Homo sapiens
tcagggaccacag

SEQ ID NO: 5515814 - DNA, 14 bp, Homo sapiens
tcagggaccacagc

SEQ ID NO: 5515815 - DNA, 16 bp, Homo sapiens
tcagggaccacagcaa

SEQ ID NO: 5515816 - DNA, 17 bp, Homo sapiens
tcagggaccaccagagg

SEQ ID NO: 5515817 - DNA, 14 bp, Homo sapiens
tcagggacccctgc

SEQ ID NO: 5515818 - DNA, 15 bp, Homo sapiens
tcagggacctgctgc

SEQ ID NO: 5515819 - DNA, 12 bp, Homo sapiens
tcagggacttgg

SEQ ID NO: 5515820 - DNA, 21 bp, Homo sapiens
tcagggagaaactccaaagtc

SEQ ID NO: 5515821 - DNA, 17 bp, Homo sapiens
tcagggagagctgggca

SEQ ID NO: 5515822 - DNA, 18 bp, Homo sapiens
tcagggagagctgggcag

SEQ ID NO: 5515823 - DNA, 23 bp, Homo sapiens
tcagggagagctgggcagacagg

SEQ ID NO: 5515824 - DNA, 13 bp, Homo sapiens
tcagggagcactg

SEQ ID NO: 5515825 - DNA, 18 bp, Homo sapiens
tcagggagcactggaggc

SEQ ID NO: 5515826 - DNA, 14 bp, Homo sapiens
tcagggagccctgg

SEQ ID NO: 5515827 - DNA, 22 bp, Homo sapiens
tcagggagcgatccaggggaag

SEQ ID NO: 5515828 - DNA, 23 bp, Homo sapiens
tcagggagcgatccaggggaagc

SEQ ID NO: 5515829 - DNA, 19 bp, Homo sapiens
tcagggaggccctgtgccc

SEQ ID NO: 5515830 - DNA, 10 bp, Homo sapiens
tcagggaggg

SEQ ID NO: 5515831 - DNA, 16 bp, Homo sapiens
tcagggagggccaggg

SEQ ID NO: 5515832 - DNA, 20 bp, Homo sapiens
tcagggagggctgttcaagt

SEQ ID NO: 5515833 - DNA, 22 bp, Homo sapiens
tcagggagggctgttcaagttt

SEQ ID NO: 5515834 - DNA, 17 bp, Homo sapiens
tcagggaggggcaacca

SEQ ID NO: 5515835 - DNA, 22 bp, Homo sapiens
tcagggagggttagcctgcacc

SEQ ID NO: 5515836 - DNA, 17 bp, Homo sapiens
tcagggagtgctggctc

SEQ ID NO: 5515837 - DNA, 19 bp, Homo sapiens
tcagggagtgctggctcac

SEQ ID NO: 5515838 - DNA, 22 bp, Homo sapiens
tcagggagtgctggctcacagt

SEQ ID NO: 5515839 - DNA, 19 bp, Homo sapiens
tcagggagtgttccctatc

SEQ ID NO: 5515840 - DNA, 22 bp, Homo sapiens
tcagggatggagggaagacctg

SEQ ID NO: 5515841 - DNA, 21 bp, Homo sapiens
tcagggatggccgttggccac

SEQ ID NO: 5515842 - DNA, 21 bp, Homo sapiens
tcagggatgtgggaatctccc

SEQ ID NO: 5515843 - DNA, 20 bp, Homo sapiens
tcagggattttttttttaaa

SEQ ID NO: 5515844 - DNA, 13 bp, Homo sapiens
tcagggcaagctc

SEQ ID NO: 5515845 - DNA, 19 bp, Homo sapiens
tcagggcagcccctgcaga

SEQ ID NO: 5515846 - DNA, 24 bp, Homo sapiens
tcagggcagcccctgcagacgtct

SEQ ID NO: 5515847 - DNA, 19 bp, Homo sapiens
tcagggcagcgccaggctg

SEQ ID NO: 5515848 - DNA, 12 bp, Homo sapiens
tcagggcagctg

SEQ ID NO: 5515849 - DNA, 15 bp, Homo sapiens
tcagggcagctgcct

SEQ ID NO: 5515850 - DNA, 17 bp, Homo sapiens
tcagggcagctgcctgg

SEQ ID NO: 5515851 - DNA, 14 bp, Homo sapiens
tcagggcaggcttg

SEQ ID NO: 5515852 - DNA, 15 bp, Homo sapiens
tcagggcagtggcca

SEQ ID NO: 5515853 - DNA, 20 bp, Homo sapiens
tcagggcagtggccaagcct

SEQ ID NO: 5515854 - DNA, 21 bp, Homo sapiens
tcagggcagtggccaagcctg

SEQ ID NO: 5515855 - DNA, 23 bp, Homo sapiens
tcagggcagtggccaagcctgct

SEQ ID NO: 5515856 - DNA, 19 bp, Homo sapiens
tcagggccagactggaaga

SEQ ID NO: 5515857 - DNA, 14 bp, Homo sapiens
tcagggccaggaag

SEQ ID NO: 5515858 - DNA, 13 bp, Homo sapiens
tcagggccaggcc

SEQ ID NO: 5515859 - DNA, 15 bp, Homo sapiens
tcagggccaggccca

SEQ ID NO: 5515860 - DNA, 23 bp, Homo sapiens
tcagggccaggtcctcacagcag

SEQ ID NO: 5515861 - DNA, 23 bp, Homo sapiens
tcagggccaggtgcagaccttgg

SEQ ID NO: 5515862 - DNA, 22 bp, Homo sapiens
tcagggccagtcctcctgggag

SEQ ID NO: 5515863 - DNA, 17 bp, Homo sapiens
tcagggccatgctgagg

SEQ ID NO: 5515864 - DNA, 19 bp, Homo sapiens
tcagggccatgctgaggcc

SEQ ID NO: 5515865 - DNA, 23 bp, Homo sapiens
tcagggccatgctgaggcctggg

SEQ ID NO: 5515866 - DNA, 18 bp, Homo sapiens
tcagggcccaagtccctg

SEQ ID NO: 5515867 - DNA, 19 bp, Homo sapiens
tcagggcccacctcctcca

SEQ ID NO: 5515868 - DNA, 13 bp, Homo sapiens
tcagggcccagag

SEQ ID NO: 5515869 - DNA, 17 bp, Homo sapiens
tcagggcccagaggctg

SEQ ID NO: 5515870 - DNA, 19 bp, Homo sapiens
tcagggcccagaggctgag

SEQ ID NO: 5515871 - DNA, 16 bp, Homo sapiens
tcagggccccagcact

SEQ ID NO: 5515872 - DNA, 22 bp, Homo sapiens
tcagggccctgccccaggcctg

SEQ ID NO: 5515873 - DNA, 18 bp, Homo sapiens
tcagggccgagaggacag

SEQ ID NO: 5515874 - DNA, 20 bp, Homo sapiens
tcagggcctgacagtgtggg

SEQ ID NO: 5515875 - DNA, 17 bp, Homo sapiens
tcagggcctgccccctg

SEQ ID NO: 5515876 - DNA, 17 bp, Homo sapiens
tcagggcctggcaggcc

SEQ ID NO: 5515877 - DNA, 18 bp, Homo sapiens
tcagggcctggcaggcca

SEQ ID NO: 5515878 - DNA, 21 bp, Homo sapiens
tcagggcctggcaggccagtg

SEQ ID NO: 5515879 - DNA, 16 bp, Homo sapiens
tcagggcctggctcag

SEQ ID NO: 5515880 - DNA, 18 bp, Homo sapiens
tcagggcctggggcctga

SEQ ID NO: 5515881 - DNA, 15 bp, Homo sapiens
tcagggccttggccc

SEQ ID NO: 5515882 - DNA, 23 bp, Homo sapiens
tcagggcgataaaactaaatata

SEQ ID NO: 5515883 - DNA, 18 bp, Homo sapiens
tcagggcgctcagacggc

SEQ ID NO: 5515884 - DNA, 23 bp, Homo sapiens
tcagggcgctcagacggcggcca

SEQ ID NO: 5515885 - DNA, 16 bp, Homo sapiens
tcagggcggggctggc

SEQ ID NO: 5515886 - DNA, 15 bp, Homo sapiens
tcagggctcagagtg

SEQ ID NO: 5515887 - DNA, 18 bp, Homo sapiens
tcagggctcctcccagct

SEQ ID NO: 5515888 - DNA, 14 bp, Homo sapiens
tcagggctcctgcc

SEQ ID NO: 5515889 - DNA, 20 bp, Homo sapiens
tcagggctcctgccttctgt

SEQ ID NO: 5515890 - DNA, 23 bp, Homo sapiens
tcagggctcctgccttctgtcct

SEQ ID NO: 5515891 - DNA, 14 bp, Homo sapiens
tcagggctcctggg

SEQ ID NO: 5515892 - DNA, 18 bp, Homo sapiens
tcagggctgagtgttctg

SEQ ID NO: 5515893 - DNA, 24 bp, Homo sapiens
tcagggctggaaaagtcacacaga

SEQ ID NO: 5515894 - DNA, 14 bp, Homo sapiens
tcagggctggagcc

SEQ ID NO: 5515895 - DNA, 17 bp, Homo sapiens
tcagggctggagcctgg

SEQ ID NO: 5515896 - DNA, 20 bp, Homo sapiens
tcagggctggagcctggggt

SEQ ID NO: 5515897 - DNA, 22 bp, Homo sapiens
tcagggctggattggcaggtgt

SEQ ID NO: 5515898 - DNA, 23 bp, Homo sapiens
tcagggctggattggcaggtgtg

SEQ ID NO: 5515899 - DNA, 22 bp, Homo sapiens
tcagggctgggcaggtcctggg

SEQ ID NO: 5515900 - DNA, 18 bp, Homo sapiens
tcagggctggggccaaga

SEQ ID NO: 5515901 - DNA, 23 bp, Homo sapiens
tcagggctggggccaagaggaaa

SEQ ID NO: 5515902 - DNA, 18 bp, Homo sapiens
tcagggctgtcccagccc

SEQ ID NO: 5515903 - DNA, 22 bp, Homo sapiens
tcagggcttctagtttctctta

SEQ ID NO: 5515904 - DNA, 17 bp, Homo sapiens
tcaggggaaaactgtta

SEQ ID NO: 5515905 - DNA, 16 bp, Homo sapiens
tcaggggaagctgcta

SEQ ID NO: 5515906 - DNA, 15 bp, Homo sapiens
tcaggggaagggcag

SEQ ID NO: 5515907 - DNA, 19 bp, Homo sapiens
tcaggggacaaaccagggg

SEQ ID NO: 5515908 - DNA, 20 bp, Homo sapiens
tcaggggacaaaccaggggt

SEQ ID NO: 5515909 - DNA, 16 bp, Homo sapiens
tcaggggactcagccc

SEQ ID NO: 5515910 - DNA, 20 bp, Homo sapiens
tcaggggagtcccgtcagga

SEQ ID NO: 5515911 - DNA, 19 bp, Homo sapiens
tcaggggcaggtggtggag

SEQ ID NO: 5515912 - DNA, 22 bp, Homo sapiens
tcaggggcaggtggtggagggg

SEQ ID NO: 5515913 - DNA, 14 bp, Homo sapiens
tcaggggccagaga

SEQ ID NO: 5515914 - DNA, 16 bp, Homo sapiens
tcaggggcctggaggt

SEQ ID NO: 5515915 - DNA, 13 bp, Homo sapiens
tcaggggctccat

SEQ ID NO: 5515916 - DNA, 22 bp, Homo sapiens
tcaggggctccatgctgggtct

SEQ ID NO: 5515917 - DNA, 20 bp, Homo sapiens
tcaggggctctagggactgc

SEQ ID NO: 5515918 - DNA, 15 bp, Homo sapiens
tcaggggctctgtgt

SEQ ID NO: 5515919 - DNA, 20 bp, Homo sapiens
tcaggggctgggcatcccag

SEQ ID NO: 5515920 - DNA, 18 bp, Homo sapiens
tcaggggctgtttgagga

SEQ ID NO: 5515921 - DNA, 12 bp, Homo sapiens
tcaggggcttgg

SEQ ID NO: 5515922 - DNA, 16 bp, Homo sapiens
tcaggggctttgggcc

SEQ ID NO: 5515923 - DNA, 18 bp, Homo sapiens
tcaggggctttgggccca

SEQ ID NO: 5515924 - DNA, 22 bp, Homo sapiens
tcaggggctttgggcccaagaa

SEQ ID NO: 5515925 - DNA, 12 bp, Homo sapiens
tcagggggccag

SEQ ID NO: 5515926 - DNA, 13 bp, Homo sapiens
tcagggggccagc

SEQ ID NO: 5515927 - DNA, 21 bp, Homo sapiens
tcagggggccagctggggaga

SEQ ID NO: 5515928 - DNA, 13 bp, Homo sapiens
tcaggggggagaa

SEQ ID NO: 5515929 - DNA, 20 bp, Homo sapiens
tcagggggtaggagagcact

SEQ ID NO: 5515930 - DNA, 23 bp, Homo sapiens
tcagggggtaggagagcactgcc

SEQ ID NO: 5515931 - DNA, 16 bp, Homo sapiens
tcaggggtcaggtgtc

SEQ ID NO: 5515932 - DNA, 19 bp, Homo sapiens
tcaggggtcaggtgtcagg

SEQ ID NO: 5515933 - DNA, 23 bp, Homo sapiens
tcaggggtcaggtgtcaggcccg

SEQ ID NO: 5515934 - DNA, 15 bp, Homo sapiens
tcaggggtgacacag

SEQ ID NO: 5515935 - DNA, 17 bp, Homo sapiens
tcaggggtgacacagac

SEQ ID NO: 5515936 - DNA, 22 bp, Homo sapiens
tcagtgccagcccctgctggct

SEQ ID NO: 5515937 - DNA, 13 bp, Homo sapiens
tcagtgcccacca

SEQ ID NO: 5515938 - DNA, 16 bp, Homo sapiens
tcagtgcccatgtgta

SEQ ID NO: 5515939 - DNA, 18 bp, Homo sapiens
tcagtgcccatgtgtatg

SEQ ID NO: 5515940 - DNA, 23 bp, Homo sapiens
tcagtgccccgtctacagctccc

SEQ ID NO: 5515941 - DNA, 14 bp, Homo sapiens
tcagtgccctccag

SEQ ID NO: 5515942 - DNA, 18 bp, Homo sapiens
tcagtgccggaggccttg

SEQ ID NO: 5515943 - DNA, 15 bp, Homo sapiens
tcagtgcctgctgtt

SEQ ID NO: 5515944 - DNA, 11 bp, Homo sapiens
tcagtgcctta

SEQ ID NO: 5515945 - DNA, 14 bp, Homo sapiens
tcagtgccttatgg

SEQ ID NO: 5515946 - DNA, 16 bp, Homo sapiens
tcagtgccttatggaa

SEQ ID NO: 5515947 - DNA, 23 bp, Homo sapiens
tcagtgccttatggaacactctg

SEQ ID NO: 5515948 - DNA, 14 bp, Homo sapiens
tcagtgccttctct

SEQ ID NO: 5515949 - DNA, 15 bp, Homo sapiens
tcagtgccttctctc

SEQ ID NO: 5515950 - DNA, 20 bp, Homo sapiens
tcagtgccttctctcagctc

SEQ ID NO: 5515951 - DNA, 17 bp, Homo sapiens
tcagtgccttggagcag

SEQ ID NO: 5515952 - DNA, 24 bp, Homo sapiens
tcagtgccttttggtttcaccttc

SEQ ID NO: 5515953 - DNA, 18 bp, Homo sapiens
tcagtgctataaatgcca

SEQ ID NO: 5515954 - DNA, 14 bp, Homo sapiens
tcagtgctcagaaa

SEQ ID NO: 5515955 - DNA, 13 bp, Homo sapiens
tcagtgctccctc

SEQ ID NO: 5515956 - DNA, 19 bp, Homo sapiens
tcagtgctccctcacatgt

SEQ ID NO: 5515957 - DNA, 15 bp, Homo sapiens
tcagtgctcggcagt

SEQ ID NO: 5515958 - DNA, 20 bp, Homo sapiens
tcagtgctctcagctggcag

SEQ ID NO: 5515959 - DNA, 13 bp, Homo sapiens
tcagtgctgtgct

SEQ ID NO: 5515960 - DNA, 19 bp, Homo sapiens
tcagtgctgtggcctgggc

SEQ ID NO: 5515961 - DNA, 22 bp, Homo sapiens
tcagtgctgtggcctgggcaag

SEQ ID NO: 5515962 - DNA, 15 bp, Homo sapiens
tcagtgcttcgcaga

SEQ ID NO: 5515963 - DNA, 21 bp, Homo sapiens
tcagtgcttctctgtgcagga

SEQ ID NO: 5515964 - DNA, 13 bp, Homo sapiens
tcagtgcttgggc

SEQ ID NO: 5515965 - DNA, 20 bp, Homo sapiens
tcagtgctttttccttttca

SEQ ID NO: 5515966 - DNA, 20 bp, Homo sapiens
tcagtggaaaccctgagagt

SEQ ID NO: 5515967 - DNA, 15 bp, Homo sapiens
tcagtggatcacaca

SEQ ID NO: 5515968 - DNA, 13 bp, Homo sapiens
tcagtggcagctg

SEQ ID NO: 5515969 - DNA, 15 bp, Homo sapiens
tcagtggcagctgct

SEQ ID NO: 5515970 - DNA, 14 bp, Homo sapiens
tcagtggcagggct

SEQ ID NO: 5515971 - DNA, 16 bp, Homo sapiens
tcagtggcagggctca

SEQ ID NO: 5515972 - DNA, 14 bp, Homo sapiens
tcagtggccaggtg

SEQ ID NO: 5515973 - DNA, 15 bp, Homo sapiens
tcagtggctctgggt

SEQ ID NO: 5515974 - DNA, 19 bp, Homo sapiens
tcagtggcttctccatcct

SEQ ID NO: 5515975 - DNA, 22 bp, Homo sapiens
tcagtgggaacgtgactgcccc

SEQ ID NO: 5515976 - DNA, 22 bp, Homo sapiens
tcagtgggaatgcagtgggtgg

SEQ ID NO: 5515977 - DNA, 21 bp, Homo sapiens
tcagtgggaattgcagcatat

SEQ ID NO: 5515978 - DNA, 17 bp, Homo sapiens
tcagtgggcaggataaa

SEQ ID NO: 5515979 - DNA, 20 bp, Homo sapiens
tcagtgggctgtttctgctt

SEQ ID NO: 5515980 - DNA, 19 bp, Homo sapiens
tcagtggggccccaaagcc

SEQ ID NO: 5515981 - DNA, 16 bp, Homo sapiens
tcagtggggctctctg

SEQ ID NO: 5515982 - DNA, 19 bp, Homo sapiens
tcagtggggctggcatcaa

SEQ ID NO: 5515983 - DNA, 23 bp, Homo sapiens
tcagtgggttaacatcagttttg

SEQ ID NO: 5515984 - DNA, 15 bp, Homo sapiens
tcagtggtgttacat

SEQ ID NO: 5515985 - DNA, 17 bp, Homo sapiens
tcagtggtgttacattt

SEQ ID NO: 5515986 - DNA, 16 bp, Homo sapiens
tcagtggtttctactt

SEQ ID NO: 5515987 - DNA, 19 bp, Homo sapiens
tcagtggtttctacttccc

SEQ ID NO: 5515988 - DNA, 22 bp, Homo sapiens
tcagtgtaaaaaggaaaaccca

SEQ ID NO: 5515989 - DNA, 17 bp, Homo sapiens
tcagtgtaatgtgactt

SEQ ID NO: 5515990 - DNA, 14 bp, Homo sapiens
tcagtgtaatttct

SEQ ID NO: 5515991 - DNA, 18 bp, Homo sapiens
tcagtgtacacgtctgga

SEQ ID NO: 5515992 - DNA, 20 bp, Homo sapiens
tcagtgtacatggaataaca

SEQ ID NO: 5515993 - DNA, 22 bp, Homo sapiens
tcagtgtaccgcgtctaccctg

SEQ ID NO: 5515994 - DNA, 19 bp, Homo sapiens
tcagtgtagccccaagaag

SEQ ID NO: 5515995 - DNA, 18 bp, Homo sapiens
tcagtgtagcgggaggaa

SEQ ID NO: 5515996 - DNA, 12 bp, Homo sapiens
tcagtgtatcta

SEQ ID NO: 5515997 - DNA, 23 bp, Homo sapiens
tcagtgtatttttgtaaaaaata

SEQ ID NO: 5515998 - DNA, 14 bp, Homo sapiens
tcagtgtcaaataa

SEQ ID NO: 5515999 - DNA, 17 bp, Homo sapiens
tcagtgtcaaataaaca

SEQ ID NO: 5516000 - DNA, 19 bp, Homo sapiens
tcagtgtcaaataaacact

SEQ ID NO: 5516001 - DNA, 16 bp, Homo sapiens
tcagtgtcagcgggtg

SEQ ID NO: 5516002 - DNA, 20 bp, Homo sapiens
tcagtgtccagcttccaaag

SEQ ID NO: 5516003 - DNA, 21 bp, Homo sapiens
tcagtgtcccaccttgaccaa

SEQ ID NO: 5516004 - DNA, 17 bp, Homo sapiens
tcagtgtcctcagggct

SEQ ID NO: 5516005 - DNA, 18 bp, Homo sapiens
tcagtgtcgggaattttc

SEQ ID NO: 5516006 - DNA, 14 bp, Homo sapiens
tcagtgtctcacac

SEQ ID NO: 5516007 - DNA, 12 bp, Homo sapiens
tcagtgtctctg

SEQ ID NO: 5516008 - DNA, 15 bp, Homo sapiens
tcagtgtctctgttt

SEQ ID NO: 5516009 - DNA, 12 bp, Homo sapiens
tcagtgtgaagc

SEQ ID NO: 5516010 - DNA, 13 bp, Homo sapiens
tcagtgtgactga

SEQ ID NO: 5516011 - DNA, 17 bp, Homo sapiens
tcagtgtgactgatctc

SEQ ID NO: 5516012 - DNA, 17 bp, Homo sapiens
tcagtgtgagtcagaat

SEQ ID NO: 5516013 - DNA, 22 bp, Homo sapiens
tcagtgtgccaccctctgcagg

SEQ ID NO: 5516014 - DNA, 24 bp, Homo sapiens
tcagtgtgccaccctctgcagggc

SEQ ID NO: 5516015 - DNA, 22 bp, Homo sapiens
tcagtgtgctaacctcactgcc

SEQ ID NO: 5516016 - DNA, 22 bp, Homo sapiens
tcagtgtggactgggaagcatt

SEQ ID NO: 5516017 - DNA, 16 bp, Homo sapiens
tcagtgtgtaaataat

SEQ ID NO: 5516018 - DNA, 20 bp, Homo sapiens
tcagtgtgtcagtttttcct

SEQ ID NO: 5516019 - DNA, 19 bp, Homo sapiens
tcagtgtgtctaaatttga

SEQ ID NO: 5516020 - DNA, 15 bp, Homo sapiens
tcagtgttaaaaaat

SEQ ID NO: 5516021 - DNA, 23 bp, Homo sapiens
tcagtgttaaaaaatttttgaaa

SEQ ID NO: 5516022 - DNA, 20 bp, Homo sapiens
tcagtgttaaagtggtctga

SEQ ID NO: 5516023 - DNA, 21 bp, Homo sapiens
tcagtgttaaatgtgatgaat

SEQ ID NO: 5516024 - DNA, 18 bp, Homo sapiens
tcagtgttaatactgaga

SEQ ID NO: 5516025 - DNA, 20 bp, Homo sapiens
tcagtgttaatactgagaaa

SEQ ID NO: 5516026 - DNA, 18 bp, Homo sapiens
tcagtgttataaaatctg

SEQ ID NO: 5516027 - DNA, 14 bp, Homo sapiens
tcagtgttattagt

SEQ ID NO: 5516028 - DNA, 21 bp, Homo sapiens
tcagtgttcagccaaacagta

SEQ ID NO: 5516029 - DNA, 12 bp, Homo sapiens
tcagtgttgaca

SEQ ID NO: 5516030 - DNA, 13 bp, Homo sapiens
tcagtgttgacat

SEQ ID NO: 5516031 - DNA, 15 bp, Homo sapiens
tcagtgttgacatag

SEQ ID NO: 5516032 - DNA, 16 bp, Homo sapiens
tcagtgttgacatagc

SEQ ID NO: 5516033 - DNA, 22 bp, Homo sapiens
tcagtgttgacatagcctttgt

SEQ ID NO: 5516034 - DNA, 14 bp, Homo sapiens
tcagtgttgattct

SEQ ID NO: 5516035 - DNA, 18 bp, Homo sapiens
tcagtgttgttgctctag

SEQ ID NO: 5516036 - DNA, 18 bp, Homo sapiens
tcagtgtttatgtgctat

SEQ ID NO: 5516037 - DNA, 15 bp, Homo sapiens
tcagtgtttcacgta

SEQ ID NO: 5516038 - DNA, 12 bp, Homo sapiens
tcagtgtttcat

SEQ ID NO: 5516039 - DNA, 15 bp, Homo sapiens
tcagtgtttctgggg

SEQ ID NO: 5516040 - DNA, 22 bp, Homo sapiens
tcagtgtttgggtcacccctcc

SEQ ID NO: 5516041 - DNA, 13 bp, Homo sapiens
tcagtgtttgttg

SEQ ID NO: 5516042 - DNA, 18 bp, Homo sapiens
tcagtgttttaaattctg

SEQ ID NO: 5516043 - DNA, 23 bp, Homo sapiens
tcagtgttttggactccatctct

SEQ ID NO: 5516044 - DNA, 23 bp, Homo sapiens
tcagtgtttttgaaacccacagt

SEQ ID NO: 5516045 - DNA, 14 bp, Homo sapiens
tcagttaaacacac

SEQ ID NO: 5516046 - DNA, 14 bp, Homo sapiens
tcagttaacgtcac

SEQ ID NO: 5516047 - DNA, 16 bp, Homo sapiens
tcagttaactattgca

SEQ ID NO: 5516048 - DNA, 16 bp, Homo sapiens
tcagttaagcctttgg

SEQ ID NO: 5516049 - DNA, 14 bp, Homo sapiens
tcagttaattctta

SEQ ID NO: 5516050 - DNA, 17 bp, Homo sapiens
tcagttaattcttagat

SEQ ID NO: 5516051 - DNA, 21 bp, Homo sapiens
tcagttacaaagtaatttctt

SEQ ID NO: 5516052 - DNA, 20 bp, Homo sapiens
tcagttacaagattgtaagt

SEQ ID NO: 5516053 - DNA, 13 bp, Homo sapiens
tcagttacagtgg

SEQ ID NO: 5516054 - DNA, 17 bp, Homo sapiens
tcagttaccaaacatta

SEQ ID NO: 5516055 - DNA, 15 bp, Homo sapiens
tcagttactcagccc

SEQ ID NO: 5516056 - DNA, 19 bp, Homo sapiens
tcagttactcagccctggg

SEQ ID NO: 5516057 - DNA, 17 bp, Homo sapiens
tcagttactctgaaggg

SEQ ID NO: 5516058 - DNA, 14 bp, Homo sapiens
tcagttactggtat

SEQ ID NO: 5516059 - DNA, 22 bp, Homo sapiens
tcagttaggattaggtttagaa

SEQ ID NO: 5516060 - DNA, 20 bp, Homo sapiens
tcagttaggctagagacaga

SEQ ID NO: 5516061 - DNA, 17 bp, Homo sapiens
tcagttataaagtcaag

SEQ ID NO: 5516062 - DNA, 20 bp, Homo sapiens
tcagttatctgtttgttact

SEQ ID NO: 5516063 - DNA, 19 bp, Homo sapiens
tcagttatgacatccacaa

SEQ ID NO: 5516064 - DNA, 22 bp, Homo sapiens
tcagttatgagtataatacatt

SEQ ID NO: 5516065 - DNA, 16 bp, Homo sapiens
tcagttattcattctg

SEQ ID NO: 5516066 - DNA, 18 bp, Homo sapiens
tcagttattttgtcaccc

SEQ ID NO: 5516067 - DNA, 15 bp, Homo sapiens
tcagttcaaaaggag

SEQ ID NO: 5516068 - DNA, 12 bp, Homo sapiens
tcagttcaaagt

SEQ ID NO: 5516069 - DNA, 13 bp, Homo sapiens
tcagttcaaagtc

SEQ ID NO: 5516070 - DNA, 22 bp, Homo sapiens
tcagttcaaagtcatgatgttt

SEQ ID NO: 5516071 - DNA, 14 bp, Homo sapiens
tcagttcaatcaaa

SEQ ID NO: 5516072 - DNA, 20 bp, Homo sapiens
tcagttcaccgctaaggaaa

SEQ ID NO: 5516073 - DNA, 20 bp, Homo sapiens
tcagttcagaatcacttctg

SEQ ID NO: 5516074 - DNA, 21 bp, Homo sapiens
tcagttcagcggttgaggaga

SEQ ID NO: 5516075 - DNA, 14 bp, Homo sapiens
tcagttcataatat

SEQ ID NO: 5516076 - DNA, 21 bp, Homo sapiens
tcagttcatatttcatttcca

SEQ ID NO: 5516077 - DNA, 20 bp, Homo sapiens
tcagttccaaagtcacagga

SEQ ID NO: 5516078 - DNA, 18 bp, Homo sapiens
tcagttccacggttgcta

SEQ ID NO: 5516079 - DNA, 12 bp, Homo sapiens
tcagttccagct

SEQ ID NO: 5516080 - DNA, 18 bp, Homo sapiens
tcagttccagcttttgta

SEQ ID NO: 5516081 - DNA, 17 bp, Homo sapiens
tcagttcccaccatctg

SEQ ID NO: 5516082 - DNA, 19 bp, Homo sapiens
tcagttcccagacagcttt

SEQ ID NO: 5516083 - DNA, 13 bp, Homo sapiens
tcagttcccagct

SEQ ID NO: 5516084 - DNA, 17 bp, Homo sapiens
tcagttcccagctcccc

SEQ ID NO: 5516085 - DNA, 19 bp, Homo sapiens
tcagttcccagctcccccc

SEQ ID NO: 5516086 - DNA, 23 bp, Homo sapiens
tcagttcccagctccccccgccc

SEQ ID NO: 5516087 - DNA, 20 bp, Homo sapiens
tcagttcccgctctgcattg

SEQ ID NO: 5516088 - DNA, 18 bp, Homo sapiens
tcagttccctcctgccca

SEQ ID NO: 5516089 - DNA, 21 bp, Homo sapiens
tcagttccctcctgcccagga

SEQ ID NO: 5516090 - DNA, 17 bp, Homo sapiens
tcagttcccttggcctc

SEQ ID NO: 5516091 - DNA, 22 bp, Homo sapiens
tcagttcccttggcctcagaat

SEQ ID NO: 5516092 - DNA, 18 bp, Homo sapiens
tcagttcgaccaaactca

SEQ ID NO: 5516093 - DNA, 19 bp, Homo sapiens
tcagttcgtgtttgattcc

SEQ ID NO: 5516094 - DNA, 13 bp, Homo sapiens
tcagttctaggaa

SEQ ID NO: 5516095 - DNA, 15 bp, Homo sapiens
tcagttctaggaaaa

SEQ ID NO: 5516096 - DNA, 19 bp, Homo sapiens
tcagttctagtctctctgg

SEQ ID NO: 5516097 - DNA, 13 bp, Homo sapiens
tcagttctattta

SEQ ID NO: 5516098 - DNA, 14 bp, Homo sapiens
tcagttctcatctt

SEQ ID NO: 5516099 - DNA, 15 bp, Homo sapiens
tcagttctcatcttg

SEQ ID NO: 5516100 - DNA, 16 bp, Homo sapiens
tcagttctcatcttgt

SEQ ID NO: 5516101 - DNA, 20 bp, Homo sapiens
tcagttctctactccctctt

SEQ ID NO: 5516102 - DNA, 17 bp, Homo sapiens
tcagttctcttcactca

SEQ ID NO: 5516103 - DNA, 19 bp, Homo sapiens
tcagttctcttgattttca

SEQ ID NO: 5516104 - DNA, 12 bp, Homo sapiens
tcagttctgcct

SEQ ID NO: 5516105 - DNA, 15 bp, Homo sapiens
tcagttctgccttat

SEQ ID NO: 5516106 - DNA, 22 bp, Homo sapiens
tcagttctgcttgctcccaagc

SEQ ID NO: 5516107 - DNA, 19 bp, Homo sapiens
tcagttctgtgtacatttt

SEQ ID NO: 5516108 - DNA, 13 bp, Homo sapiens
tcagttctgtgtg

SEQ ID NO: 5516109 - DNA, 13 bp, Homo sapiens
tcagttcttggcc

SEQ ID NO: 5516110 - DNA, 16 bp, Homo sapiens
tcagttcttggcctgc

SEQ ID NO: 5516111 - DNA, 13 bp, Homo sapiens
tcagttgaaaaga

SEQ ID NO: 5516112 - DNA, 22 bp, Homo sapiens
tcagttgacaaaatatataatg

SEQ ID NO: 5516113 - DNA, 16 bp, Homo sapiens
tcagttgattaagtta

SEQ ID NO: 5516114 - DNA, 17 bp, Homo sapiens
tcagttgcaataatact

SEQ ID NO: 5516115 - DNA, 16 bp, Homo sapiens
tcagttgcagaaaatg

SEQ ID NO: 5516116 - DNA, 13 bp, Homo sapiens
tcagttgcaggtg

SEQ ID NO: 5516117 - DNA, 16 bp, Homo sapiens
tcagttgctaaacact

SEQ ID NO: 5516118 - DNA, 17 bp, Homo sapiens
tcagttgctaaacactg

SEQ ID NO: 5516119 - DNA, 20 bp, Homo sapiens
tcagttgctcaaaaagaaat

SEQ ID NO: 5516120 - DNA, 18 bp, Homo sapiens
tcagttgctctctgttca

SEQ ID NO: 5516121 - DNA, 19 bp, Homo sapiens
tcagttgctctctgttcaa

SEQ ID NO: 5516122 - DNA, 16 bp, Homo sapiens
tcagttggagtttgtg

SEQ ID NO: 5516123 - DNA, 16 bp, Homo sapiens
tcagttggttgtgtct

SEQ ID NO: 5516124 - DNA, 13 bp, Homo sapiens
tcagttgtacagt

SEQ ID NO: 5516125 - DNA, 18 bp, Homo sapiens
tcagttgtacttctgctc

SEQ ID NO: 5516126 - DNA, 18 bp, Homo sapiens
tcagttgtagaatgtatt

SEQ ID NO: 5516127 - DNA, 21 bp, Homo sapiens
tcagttgtccttaaatttgta

SEQ ID NO: 5516128 - DNA, 13 bp, Homo sapiens
tcagttgtctctg

SEQ ID NO: 5516129 - DNA, 13 bp, Homo sapiens
tcagttgtgcagc

SEQ ID NO: 5516130 - DNA, 19 bp, Homo sapiens
tcagttgtggcctcattca

SEQ ID NO: 5516131 - DNA, 18 bp, Homo sapiens
tcagttgtgttttttaag

SEQ ID NO: 5516132 - DNA, 19 bp, Homo sapiens
tcagtttaaaagcacgaca

SEQ ID NO: 5516133 - DNA, 15 bp, Homo sapiens
tcagtttaatccttc

SEQ ID NO: 5516134 - DNA, 22 bp, Homo sapiens
tcagtttaatgtctcctttgct

SEQ ID NO: 5516135 - DNA, 18 bp, Homo sapiens
tcagtttaggccttggct

SEQ ID NO: 5516136 - DNA, 18 bp, Homo sapiens
tcagtttataccttgcct

SEQ ID NO: 5516137 - DNA, 22 bp, Homo sapiens
tcagtttatcctgacatattca

SEQ ID NO: 5516138 - DNA, 21 bp, Homo sapiens
tcagtttatgttgtacaatgt

SEQ ID NO: 5516139 - DNA, 15 bp, Homo sapiens
tcagtttattaaatc

SEQ ID NO: 5516140 - DNA, 16 bp, Homo sapiens
tcagtttcaacatgaa

SEQ ID NO: 5516141 - DNA, 17 bp, Homo sapiens
tcagtttcacagaaaat

SEQ ID NO: 5516142 - DNA, 17 bp, Homo sapiens
tcagtttcactccctct

SEQ ID NO: 5516143 - DNA, 22 bp, Homo sapiens
tcagtttcactccctcttggtt

SEQ ID NO: 5516144 - DNA, 14 bp, Homo sapiens
tcagtttcataaaa

SEQ ID NO: 5516145 - DNA, 16 bp, Homo sapiens
tcagtttcatgaaatg

SEQ ID NO: 5516146 - DNA, 17 bp, Homo sapiens
tcagtttcatgaaatga

SEQ ID NO: 5516147 - DNA, 14 bp, Homo sapiens
tcagtttcccctct

SEQ ID NO: 5516148 - DNA, 18 bp, Homo sapiens
tcagtttccgaatctctt

SEQ ID NO: 5516149 - DNA, 20 bp, Homo sapiens
tcagtttcctggtctgtaga

SEQ ID NO: 5516150 - DNA, 12 bp, Homo sapiens
tcagtttctaca

SEQ ID NO: 5516151 - DNA, 12 bp, Homo sapiens
tcagtttctgaa

SEQ ID NO: 5516152 - DNA, 17 bp, Homo sapiens
tcagtttctgcctgggc

SEQ ID NO: 5516153 - DNA, 19 bp, Homo sapiens
tcagtttctgcctgggcaa

SEQ ID NO: 5516154 - DNA, 20 bp, Homo sapiens
tcagtttgaaggctgcacac

SEQ ID NO: 5516155 - DNA, 23 bp, Homo sapiens
tcagtttgcagcagcaagtacaa

SEQ ID NO: 5516156 - DNA, 14 bp, Homo sapiens
tcagtttggctgta

SEQ ID NO: 5516157 - DNA, 12 bp, Homo sapiens
tcagtttggttg

SEQ ID NO: 5516158 - DNA, 14 bp, Homo sapiens
tcagtttgtataga

SEQ ID NO: 5516159 - DNA, 18 bp, Homo sapiens
tcagtttgtccacacaag

SEQ ID NO: 5516160 - DNA, 18 bp, Homo sapiens
tcagtttgtcctgtagag

SEQ ID NO: 5516161 - DNA, 14 bp, Homo sapiens
tcagtttgtgaagt

SEQ ID NO: 5516162 - DNA, 15 bp, Homo sapiens
tcagtttgtgtgtct

SEQ ID NO: 5516163 - DNA, 14 bp, Homo sapiens
tcagtttgttggaa

SEQ ID NO: 5516164 - DNA, 13 bp, Homo sapiens
tcagttttaacta

SEQ ID NO: 5516165 - DNA, 19 bp, Homo sapiens
tcagttttagtttcaaaat

SEQ ID NO: 5516166 - DNA, 14 bp, Homo sapiens
tcagttttcacaga

SEQ ID NO: 5516167 - DNA, 22 bp, Homo sapiens
tcagttttcccactttttggta

SEQ ID NO: 5516168 - DNA, 16 bp, Homo sapiens
tcagttttccttctgt

SEQ ID NO: 5516169 - DNA, 14 bp, Homo sapiens
tcagttttggaatc

SEQ ID NO: 5516170 - DNA, 23 bp, Homo sapiens
tcagttttggaatctaagctgtt

SEQ ID NO: 5516171 - DNA, 23 bp, Homo sapiens
tcagttttgtgtacagtatgtgt

SEQ ID NO: 5516172 - DNA, 16 bp, Homo sapiens
tcagtttttcacttct

SEQ ID NO: 5516173 - DNA, 20 bp, Homo sapiens
tcagtttttcatttgttttg

SEQ ID NO: 5516174 - DNA, 15 bp, Homo sapiens
tcagtttttcttaat

SEQ ID NO: 5516175 - DNA, 12 bp, Homo sapiens
tcagtttttgta

SEQ ID NO: 5516176 - DNA, 13 bp, Homo sapiens
tcagtttttgtat

SEQ ID NO: 5516177 - DNA, 14 bp, Homo sapiens
tcagtttttgtatc

SEQ ID NO: 5516178 - DNA, 15 bp, Homo sapiens
tcagtttttgtgaaa

SEQ ID NO: 5516179 - DNA, 12 bp, Homo sapiens
tcagtttttgtt

SEQ ID NO: 5516180 - DNA, 19 bp, Homo sapiens
tcagtttttgttcttaaaa

SEQ ID NO: 5516181 - DNA, 17 bp, Homo sapiens
tcagttttttgtaacta

SEQ ID NO: 5516182 - DNA, 22 bp, Homo sapiens
tcagtttttttttatacactgt

SEQ ID NO: 5516183 - DNA, 13 bp, Homo sapiens
tcataaaaataaa

SEQ ID NO: 5516184 - DNA, 13 bp, Homo sapiens
tcataaaaataac

SEQ ID NO: 5516185 - DNA, 17 bp, Homo sapiens
tcataaaactgtgacta

SEQ ID NO: 5516186 - DNA, 22 bp, Homo sapiens
tcataaaaggtgacccttctgt

SEQ ID NO: 5516187 - DNA, 21 bp, Homo sapiens
tcataaaatagaataattctt

SEQ ID NO: 5516188 - DNA, 17 bp, Homo sapiens
tcataaaatgaaacttt

SEQ ID NO: 5516189 - DNA, 11 bp, Homo sapiens
tcataaaatgc

SEQ ID NO: 5516190 - DNA, 14 bp, Homo sapiens
tcataaaatgctat

SEQ ID NO: 5516191 - DNA, 18 bp, Homo sapiens
tcataaaatgctatttta

SEQ ID NO: 5516192 - DNA, 22 bp, Homo sapiens
tcataaaatgctattttaaaat

SEQ ID NO: 5516193 - DNA, 14 bp, Homo sapiens
tcataaacagcatt

SEQ ID NO: 5516194 - DNA, 15 bp, Homo sapiens
tcataaacagcattt

SEQ ID NO: 5516195 - DNA, 13 bp, Homo sapiens
tcataaactgagc

SEQ ID NO: 5516196 - DNA, 13 bp, Homo sapiens
tcataaactgtgt

SEQ ID NO: 5516197 - DNA, 15 bp, Homo sapiens
tcataaactgtgtgc

SEQ ID NO: 5516198 - DNA, 23 bp, Homo sapiens
tcataaagcattggagtttcaaa

SEQ ID NO: 5516199 - DNA, 11 bp, Homo sapiens
tcataaagtca

SEQ ID NO: 5516200 - DNA, 22 bp, Homo sapiens
tcataaagtgagaaaactgtga

SEQ ID NO: 5516201 - DNA, 19 bp, Homo sapiens
tcataaagttagaatctat

SEQ ID NO: 5516202 - DNA, 20 bp, Homo sapiens
tcataaagttagaatctatt

SEQ ID NO: 5516203 - DNA, 13 bp, Homo sapiens
tcataaatactgt

SEQ ID NO: 5516204 - DNA, 16 bp, Homo sapiens
tcataaatactgtcaa

SEQ ID NO: 5516205 - DNA, 17 bp, Homo sapiens
tcataaatcagaaagtt

SEQ ID NO: 5516206 - DNA, 18 bp, Homo sapiens
tcataaatcagaaagttt

SEQ ID NO: 5516207 - DNA, 19 bp, Homo sapiens
tcataaatcatgttgttgt

SEQ ID NO: 5516208 - DNA, 13 bp, Homo sapiens
tcataaatctatt

SEQ ID NO: 5516209 - DNA, 12 bp, Homo sapiens
tcataaatgaag

SEQ ID NO: 5516210 - DNA, 16 bp, Homo sapiens
tcataaatgtcacaat

SEQ ID NO: 5516211 - DNA, 17 bp, Homo sapiens
tcataaattatttctaa

SEQ ID NO: 5516212 - DNA, 18 bp, Homo sapiens
tcataaattatttctaaa

SEQ ID NO: 5516213 - DNA, 22 bp, Homo sapiens
tcataaattatttgattattta

SEQ ID NO: 5516214 - DNA, 12 bp, Homo sapiens
tcataaattggc

SEQ ID NO: 5516215 - DNA, 16 bp, Homo sapiens
tcataaattggctcct

SEQ ID NO: 5516216 - DNA, 21 bp, Homo sapiens
tcataaattggctcctttccc

SEQ ID NO: 5516217 - DNA, 23 bp, Homo sapiens
tcataaattggctcctttcccac

SEQ ID NO: 5516218 - DNA, 19 bp, Homo sapiens
tcataaatttgaataagca

SEQ ID NO: 5516219 - DNA, 14 bp, Homo sapiens
tcataacaaaccat

SEQ ID NO: 5516220 - DNA, 17 bp, Homo sapiens
tcataacaatgtatgtg

SEQ ID NO: 5516221 - DNA, 19 bp, Homo sapiens
tcataacatccagagcttt

SEQ ID NO: 5516222 - DNA, 13 bp, Homo sapiens
tcataacatcttt

SEQ ID NO: 5516223 - DNA, 15 bp, Homo sapiens
tcataacatttaaag

SEQ ID NO: 5516224 - DNA, 15 bp, Homo sapiens
tcataaccaacaata

SEQ ID NO: 5516225 - DNA, 16 bp, Homo sapiens
tcataaccaacaatat

SEQ ID NO: 5516226 - DNA, 22 bp, Homo sapiens
tcataaccaacaatataaaccg

SEQ ID NO: 5516227 - DNA, 14 bp, Homo sapiens
tcataaccattccc

SEQ ID NO: 5516228 - DNA, 16 bp, Homo sapiens
tcataacggatcagaa

SEQ ID NO: 5516229 - DNA, 19 bp, Homo sapiens
tcataacggatcagaaata

SEQ ID NO: 5516230 - DNA, 16 bp, Homo sapiens
tcataactaatgaatt

SEQ ID NO: 5516231 - DNA, 15 bp, Homo sapiens
tcataactagaactg

SEQ ID NO: 5516232 - DNA, 19 bp, Homo sapiens
tcataactagagtatgtgt

SEQ ID NO: 5516233 - DNA, 15 bp, Homo sapiens
tcataacttattgct

SEQ ID NO: 5516234 - DNA, 20 bp, Homo sapiens
tcataacttattgctgattt

SEQ ID NO: 5516235 - DNA, 15 bp, Homo sapiens
tcataacttgctgaa

SEQ ID NO: 5516236 - DNA, 21 bp, Homo sapiens
tcataacttgctgaatttcag

SEQ ID NO: 5516237 - DNA, 13 bp, Homo sapiens
tcataagacaaga

SEQ ID NO: 5516238 - DNA, 19 bp, Homo sapiens
tcataagactttgggatag

SEQ ID NO: 5516239 - DNA, 22 bp, Homo sapiens
tcataagatagttacatttatg

SEQ ID NO: 5516240 - DNA, 16 bp, Homo sapiens
tcataagatattcttt

SEQ ID NO: 5516241 - DNA, 16 bp, Homo sapiens
tcataagatattttat

SEQ ID NO: 5516242 - DNA, 21 bp, Homo sapiens
tcataagatatttttcatgat

SEQ ID NO: 5516243 - DNA, 21 bp, Homo sapiens
tcataagcacctaaaacccaa

SEQ ID NO: 5516244 - DNA, 20 bp, Homo sapiens
tcataagccaatttttctgc

SEQ ID NO: 5516245 - DNA, 22 bp, Homo sapiens
tcataagccaatttttctgcac

SEQ ID NO: 5516246 - DNA, 15 bp, Homo sapiens
tcataagctttgtaa

SEQ ID NO: 5516247 - DNA, 17 bp, Homo sapiens
tcataaggcctgccctc

SEQ ID NO: 5516248 - DNA, 18 bp, Homo sapiens
tcataaggcctgccctcc

SEQ ID NO: 5516249 - DNA, 19 bp, Homo sapiens
tcataaggcctgccctccc

SEQ ID NO: 5516250 - DNA, 15 bp, Homo sapiens
tcataaggcttcaaa

SEQ ID NO: 5516251 - DNA, 16 bp, Homo sapiens
tcataagtaaacctag

SEQ ID NO: 5516252 - DNA, 15 bp, Homo sapiens
tcataagtctttggt

SEQ ID NO: 5516253 - DNA, 22 bp, Homo sapiens
tcataagtttgtttaaacactt

SEQ ID NO: 5516254 - DNA, 18 bp, Homo sapiens
tcataataaaagtgaagt

SEQ ID NO: 5516255 - DNA, 11 bp, Homo sapiens
tcataataaat

SEQ ID NO: 5516256 - DNA, 15 bp, Homo sapiens
tcataataaatagac

SEQ ID NO: 5516257 - DNA, 16 bp, Homo sapiens
tcataataagttgcat

SEQ ID NO: 5516258 - DNA, 21 bp, Homo sapiens
tcataatacataaagttctct

SEQ ID NO: 5516259 - DNA, 15 bp, Homo sapiens
tcataataggtagtt

SEQ ID NO: 5516260 - DNA, 20 bp, Homo sapiens
tcataataggtagtttggat

SEQ ID NO: 5516261 - DNA, 22 bp, Homo sapiens
tcataatatataaaagaaatat

SEQ ID NO: 5516262 - DNA, 17 bp, Homo sapiens
tcataatatattgtgtt

SEQ ID NO: 5516263 - DNA, 20 bp, Homo sapiens
tcataatatttgaacaaaaa

SEQ ID NO: 5516264 - DNA, 20 bp, Homo sapiens
tcataatcagtaaatagtgt

SEQ ID NO: 5516265 - DNA, 22 bp, Homo sapiens
tcataatcatggctcttagaaa

SEQ ID NO: 5516266 - DNA, 12 bp, Homo sapiens
tcataatgaaaa

SEQ ID NO: 5516267 - DNA, 20 bp, Homo sapiens
tcataatgaataaagtgcaa

SEQ ID NO: 5516268 - DNA, 16 bp, Homo sapiens
tcataatgtaactgaa

SEQ ID NO: 5516269 - DNA, 23 bp, Homo sapiens
tcataatgtaactgaagcataaa

SEQ ID NO: 5516270 - DNA, 17 bp, Homo sapiens
tcataatgtattattta

SEQ ID NO: 5516271 - DNA, 12 bp, Homo sapiens
tcataatgtgaa

SEQ ID NO: 5516272 - DNA, 15 bp, Homo sapiens
tcataatgtgaagtg

SEQ ID NO: 5516273 - DNA, 19 bp, Homo sapiens
tcataatgtgaagtgttaa

SEQ ID NO: 5516274 - DNA, 23 bp, Homo sapiens
tcataatgtgagatggttcccaa

SEQ ID NO: 5516275 - DNA, 12 bp, Homo sapiens
tcataattacat

SEQ ID NO: 5516276 - DNA, 19 bp, Homo sapiens
tcataattacattcctaac

SEQ ID NO: 5516277 - DNA, 13 bp, Homo sapiens
tcataattagaac

SEQ ID NO: 5516278 - DNA, 17 bp, Homo sapiens
tcataattcatttaaga

SEQ ID NO: 5516279 - DNA, 18 bp, Homo sapiens
tcataattcctacagcac

SEQ ID NO: 5516280 - DNA, 19 bp, Homo sapiens
tcataattgcattgacttt

SEQ ID NO: 5516281 - DNA, 18 bp, Homo sapiens
tcataattgcctacattt

SEQ ID NO: 5516282 - DNA, 23 bp, Homo sapiens
tcataattgtcaaaaaccagaat

SEQ ID NO: 5516283 - DNA, 23 bp, Homo sapiens
tcataatttccatgatacaaaga

SEQ ID NO: 5516284 - DNA, 12 bp, Homo sapiens
tcataatttctt

SEQ ID NO: 5516285 - DNA, 13 bp, Homo sapiens
tcataattttcaa

SEQ ID NO: 5516286 - DNA, 19 bp, Homo sapiens
tcataattttcaaaagaaa

SEQ ID NO: 5516287 - DNA, 14 bp, Homo sapiens
tcataattttcaag

SEQ ID NO: 5516288 - DNA, 15 bp, Homo sapiens
tcatacaaactctca

SEQ ID NO: 5516289 - DNA, 16 bp, Homo sapiens
tcatacaaactctcac

SEQ ID NO: 5516290 - DNA, 14 bp, Homo sapiens
tcatacaaatacta

SEQ ID NO: 5516291 - DNA, 12 bp, Homo sapiens
tcatacaagcca

SEQ ID NO: 5516292 - DNA, 22 bp, Homo sapiens
tcatacaaggcccaggaggctt

SEQ ID NO: 5516293 - DNA, 16 bp, Homo sapiens
tcatcatccctccctg

SEQ ID NO: 5516294 - DNA, 17 bp, Homo sapiens
tcatcatccctccctgc

SEQ ID NO: 5516295 - DNA, 22 bp, Homo sapiens
tcatcatctcttgataaaggag

SEQ ID NO: 5516296 - DNA, 23 bp, Homo sapiens
tcatcatctcttgataaaggaga

SEQ ID NO: 5516297 - DNA, 20 bp, Homo sapiens
tcatcatctttttgtgtgca

SEQ ID NO: 5516298 - DNA, 16 bp, Homo sapiens
tcatcatgaactggct

SEQ ID NO: 5516299 - DNA, 23 bp, Homo sapiens
tcatcatgaactggcttgtacat

SEQ ID NO: 5516300 - DNA, 16 bp, Homo sapiens
tcatcatgataattca

SEQ ID NO: 5516301 - DNA, 12 bp, Homo sapiens
tcatcatgcagc

SEQ ID NO: 5516302 - DNA, 16 bp, Homo sapiens
tcatcatgcttatgtt

SEQ ID NO: 5516303 - DNA, 14 bp, Homo sapiens
tcatcatggccagc

SEQ ID NO: 5516304 - DNA, 17 bp, Homo sapiens
tcatcatggccagctgg

SEQ ID NO: 5516305 - DNA, 14 bp, Homo sapiens
tcatcatgtagaat

SEQ ID NO: 5516306 - DNA, 13 bp, Homo sapiens
tcatcatgtctat

SEQ ID NO: 5516307 - DNA, 20 bp, Homo sapiens
tcatcatgttggccaggctg

SEQ ID NO: 5516308 - DNA, 18 bp, Homo sapiens
tcatcattaataagtgaa

SEQ ID NO: 5516309 - DNA, 14 bp, Homo sapiens
tcatcattccctct

SEQ ID NO: 5516310 - DNA, 18 bp, Homo sapiens
tcatcattctctgtctca

SEQ ID NO: 5516311 - DNA, 15 bp, Homo sapiens
tcatcattcttgtgg

SEQ ID NO: 5516312 - DNA, 22 bp, Homo sapiens
tcatcattcttgtgggagacag

SEQ ID NO: 5516313 - DNA, 21 bp, Homo sapiens
tcatcattggccctcattcca

SEQ ID NO: 5516314 - DNA, 23 bp, Homo sapiens
tcatcattggccctcattccaag

SEQ ID NO: 5516315 - DNA, 19 bp, Homo sapiens
tcatcattgtatatatgtg

SEQ ID NO: 5516316 - DNA, 20 bp, Homo sapiens
tcatcattgtatatatgtgt

SEQ ID NO: 5516317 - DNA, 13 bp, Homo sapiens
tcatcattgttgt

SEQ ID NO: 5516318 - DNA, 18 bp, Homo sapiens
tcatcattgttgtgtata

SEQ ID NO: 5516319 - DNA, 12 bp, Homo sapiens
tcatcattgttt

SEQ ID NO: 5516320 - DNA, 15 bp, Homo sapiens
tcatcatttcagcca

SEQ ID NO: 5516321 - DNA, 18 bp, Homo sapiens
tcatcatttgtcctgttc

SEQ ID NO: 5516322 - DNA, 21 bp, Homo sapiens
tcatcattttctacttgtttt

SEQ ID NO: 5516323 - DNA, 20 bp, Homo sapiens
tcatccaaaagtgaccagca

SEQ ID NO: 5516324 - DNA, 13 bp, Homo sapiens
tcatccaaaatat

SEQ ID NO: 5516325 - DNA, 20 bp, Homo sapiens
tcatccaaaatattttttgc

SEQ ID NO: 5516326 - DNA, 12 bp, Homo sapiens
tcatccaaatgg

SEQ ID NO: 5516327 - DNA, 12 bp, Homo sapiens
tcatccaacaag

SEQ ID NO: 5516328 - DNA, 13 bp, Homo sapiens
tcatccaacaaga

SEQ ID NO: 5516329 - DNA, 14 bp, Homo sapiens
tcatccaacaagaa

SEQ ID NO: 5516330 - DNA, 15 bp, Homo sapiens
tcatccaacttccaa

SEQ ID NO: 5516331 - DNA, 22 bp, Homo sapiens
tcatccaaggaacctaattgaa

SEQ ID NO: 5516332 - DNA, 20 bp, Homo sapiens
tcatccaatcctcactgggt

SEQ ID NO: 5516333 - DNA, 14 bp, Homo sapiens
tcatccaatgtgaa

SEQ ID NO: 5516334 - DNA, 18 bp, Homo sapiens
tcatccacacaacaccag

SEQ ID NO: 5516335 - DNA, 20 bp, Homo sapiens
tcatccacacaacaccagga

SEQ ID NO: 5516336 - DNA, 19 bp, Homo sapiens
tcatccacataccctgacc

SEQ ID NO: 5516337 - DNA, 14 bp, Homo sapiens
tcatccacattgtt

SEQ ID NO: 5516338 - DNA, 16 bp, Homo sapiens
tcatccacattgtttt

SEQ ID NO: 5516339 - DNA, 17 bp, Homo sapiens
tcatccacattgtttta

SEQ ID NO: 5516340 - DNA, 19 bp, Homo sapiens
tcatccacattgttttaaa

SEQ ID NO: 5516341 - DNA, 22 bp, Homo sapiens
tcatccacattgttttaaaaag

SEQ ID NO: 5516342 - DNA, 21 bp, Homo sapiens
tcatccaccaatctctaagcc

SEQ ID NO: 5516343 - DNA, 14 bp, Homo sapiens
tcatccaccccatc

SEQ ID NO: 5516344 - DNA, 16 bp, Homo sapiens
tcatccaccccatccc

SEQ ID NO: 5516345 - DNA, 20 bp, Homo sapiens
tcatccaccccatccctccc

SEQ ID NO: 5516346 - DNA, 19 bp, Homo sapiens
tcatccacccgctgcccct

SEQ ID NO: 5516347 - DNA, 20 bp, Homo sapiens
tcatccacccgctgcccctc

SEQ ID NO: 5516348 - DNA, 21 bp, Homo sapiens
tcatccactaggtgcccagtc

SEQ ID NO: 5516349 - DNA, 21 bp, Homo sapiens
tcatccactagtgcaaatcat

SEQ ID NO: 5516350 - DNA, 21 bp, Homo sapiens
tcatccactgtgccatgtgcc

SEQ ID NO: 5516351 - DNA, 16 bp, Homo sapiens
tcatccagccactgcc

SEQ ID NO: 5516352 - DNA, 17 bp, Homo sapiens
tcatccagcctcagaga

SEQ ID NO: 5516353 - DNA, 14 bp, Homo sapiens
tcatccaggactga

SEQ ID NO: 5516354 - DNA, 21 bp, Homo sapiens
tcatccagggctctgaccagt

SEQ ID NO: 5516355 - DNA, 21 bp, Homo sapiens
tcatccagttgcaataaaata

SEQ ID NO: 5516356 - DNA, 22 bp, Homo sapiens
tcatccagtttgttctccgggt

SEQ ID NO: 5516357 - DNA, 13 bp, Homo sapiens
tcatccatagaca

SEQ ID NO: 5516358 - DNA, 15 bp, Homo sapiens
tcatccatatttctt

SEQ ID NO: 5516359 - DNA, 14 bp, Homo sapiens
tcatccatcatcat

SEQ ID NO: 5516360 - DNA, 13 bp, Homo sapiens
tcatccatcctga

SEQ ID NO: 5516361 - DNA, 18 bp, Homo sapiens
tcatccatcctgagccaa

SEQ ID NO: 5516362 - DNA, 18 bp, Homo sapiens
tcatcccaacagcccagc

SEQ ID NO: 5516363 - DNA, 14 bp, Homo sapiens
tcatcccacttcct

SEQ ID NO: 5516364 - DNA, 18 bp, Homo sapiens
tcatcccagcacctgcca

SEQ ID NO: 5516365 - DNA, 19 bp, Homo sapiens
tcatcccagcacctgccag

SEQ ID NO: 5516366 - DNA, 16 bp, Homo sapiens
tcatcccagtcctgat

SEQ ID NO: 5516367 - DNA, 21 bp, Homo sapiens
tcatcccatctaagctgcagc

SEQ ID NO: 5516368 - DNA, 21 bp, Homo sapiens
tcatcccattaatcatttccc

SEQ ID NO: 5516369 - DNA, 14 bp, Homo sapiens
tcatcccattccag

SEQ ID NO: 5516370 - DNA, 16 bp, Homo sapiens
tcatcccattccaggc

SEQ ID NO: 5516371 - DNA, 15 bp, Homo sapiens
tcatcccattgtctt

SEQ ID NO: 5516372 - DNA, 17 bp, Homo sapiens
tcatccccacaatctgg

SEQ ID NO: 5516373 - DNA, 20 bp, Homo sapiens
tcatccccaggggtcccagc

SEQ ID NO: 5516374 - DNA, 21 bp, Homo sapiens
tcatccccaggggtcccagcc

SEQ ID NO: 5516375 - DNA, 15 bp, Homo sapiens
tcatccccctgtgga

SEQ ID NO: 5516376 - DNA, 16 bp, Homo sapiens
tcatccccgagggcgg

SEQ ID NO: 5516377 - DNA, 14 bp, Homo sapiens
tcatcccctcagaa

SEQ ID NO: 5516378 - DNA, 15 bp, Homo sapiens
tcatcccctcgtcct

SEQ ID NO: 5516379 - DNA, 18 bp, Homo sapiens
tcatcccctcgtcctgtc

SEQ ID NO: 5516380 - DNA, 16 bp, Homo sapiens
tcatcccctctcagga

SEQ ID NO: 5516381 - DNA, 11 bp, Homo sapiens
tcatcccctta

SEQ ID NO: 5516382 - DNA, 15 bp, Homo sapiens
tcatccctccctgcc

SEQ ID NO: 5516383 - DNA, 22 bp, Homo sapiens
tcatccctccctgcctaaggaa

SEQ ID NO: 5516384 - DNA, 19 bp, Homo sapiens
tcatccctctcacccagaa

SEQ ID NO: 5516385 - DNA, 11 bp, Homo sapiens
tcatccctgga

SEQ ID NO: 5516386 - DNA, 14 bp, Homo sapiens
tcatccctttctcc

SEQ ID NO: 5516387 - DNA, 17 bp, Homo sapiens
tcatccgaaagtgagga

SEQ ID NO: 5516388 - DNA, 15 bp, Homo sapiens
tcatccgcctgtggg

SEQ ID NO: 5516389 - DNA, 17 bp, Homo sapiens
tcatccggcagcctgga

SEQ ID NO: 5516390 - DNA, 17 bp, Homo sapiens
tcatcctaaagaacaaa

SEQ ID NO: 5516391 - DNA, 18 bp, Homo sapiens
tcatcctattctttcgaa

SEQ ID NO: 5516392 - DNA, 14 bp, Homo sapiens
tcatcctcaaagaa

SEQ ID NO: 5516393 - DNA, 14 bp, Homo sapiens
tcatcctcacatgt

SEQ ID NO: 5516394 - DNA, 16 bp, Homo sapiens
tcatcctcacatgtgg

SEQ ID NO: 5516395 - DNA, 13 bp, Homo sapiens
tcatcctcagcaa

SEQ ID NO: 5516396 - DNA, 15 bp, Homo sapiens
tcatcctcagcagca

SEQ ID NO: 5516397 - DNA, 20 bp, Homo sapiens
tcatcctcattgcctcctgt

SEQ ID NO: 5516398 - DNA, 16 bp, Homo sapiens
tcatcctcccattgcc

SEQ ID NO: 5516399 - DNA, 20 bp, Homo sapiens
tcatcctcccattgcccagt

SEQ ID NO: 5516400 - DNA, 13 bp, Homo sapiens
tcatcctccctga

SEQ ID NO: 5516401 - DNA, 21 bp, Homo sapiens
tcatcctcccttgccccaggc

SEQ ID NO: 5516402 - DNA, 19 bp, Homo sapiens
tcatcctcctcagatcttc

SEQ ID NO: 5516403 - DNA, 16 bp, Homo sapiens
tcatcctcctccccag

SEQ ID NO: 5516404 - DNA, 23 bp, Homo sapiens
tcatcctcctccccagctcttct

SEQ ID NO: 5516405 - DNA, 11 bp, Homo sapiens
tcatcctcctg

SEQ ID NO: 5516406 - DNA, 15 bp, Homo sapiens
tcatcctcctggaac

SEQ ID NO: 5516407 - DNA, 12 bp, Homo sapiens
tcatcctccttt

SEQ ID NO: 5516408 - DNA, 11 bp, Homo sapiens
tcatcctctgg

SEQ ID NO: 5516409 - DNA, 18 bp, Homo sapiens
tcatcctgccctgcagca

SEQ ID NO: 5516410 - DNA, 22 bp, Homo sapiens
tcatcctgctcttttgtgatga

SEQ ID NO: 5516411 - DNA, 21 bp, Homo sapiens
tcatcctgcttctcttttcct

SEQ ID NO: 5516412 - DNA, 22 bp, Homo sapiens
tcatcctggaggggtgttgtat

SEQ ID NO: 5516413 - DNA, 16 bp, Homo sapiens
tcatcctggcacgccc

SEQ ID NO: 5516414 - DNA, 21 bp, Homo sapiens
tcatcctggcacgccctactc

SEQ ID NO: 5516415 - DNA, 22 bp, Homo sapiens
tcatcctggcacgccctactcc

SEQ ID NO: 5516416 - DNA, 13 bp, Homo sapiens
tcatcctggcctc

SEQ ID NO: 5516417 - DNA, 19 bp, Homo sapiens
tcatcctgtgtggggaggc

SEQ ID NO: 5516418 - DNA, 22 bp, Homo sapiens
tcatccttctaaagtgctggga

SEQ ID NO: 5516419 - DNA, 14 bp, Homo sapiens
tcatccttctggaa

SEQ ID NO: 5516420 - DNA, 21 bp, Homo sapiens
tcatccttctttccttgttca

SEQ ID NO: 5516421 - DNA, 20 bp, Homo sapiens
tcatccttgcccatcgggac

SEQ ID NO: 5516422 - DNA, 21 bp, Homo sapiens
tcatccttggtctttgtatct

SEQ ID NO: 5516423 - DNA, 22 bp, Homo sapiens
tcatccttggtgctcttgcttt

SEQ ID NO: 5516424 - DNA, 20 bp, Homo sapiens
tcatcctttcacttctttcc

SEQ ID NO: 5516425 - DNA, 23 bp, Homo sapiens
tcatcctttcacttctttccctt

SEQ ID NO: 5516426 - DNA, 15 bp, Homo sapiens
tcatcctttcctcta

SEQ ID NO: 5516427 - DNA, 16 bp, Homo sapiens
tcatcctttgttctga

SEQ ID NO: 5516428 - DNA, 20 bp, Homo sapiens
tcatcctttgttctgagcat

SEQ ID NO: 5516429 - DNA, 14 bp, Homo sapiens
tcatccttttctcc

SEQ ID NO: 5516430 - DNA, 15 bp, Homo sapiens
tcatccttttttctc

SEQ ID NO: 5516431 - DNA, 19 bp, Homo sapiens
tcatccttttttctcttct

SEQ ID NO: 5516432 - DNA, 22 bp, Homo sapiens
tcatcgaaaattcatttcacat

SEQ ID NO: 5516433 - DNA, 15 bp, Homo sapiens
tcatcgaacaaactg

SEQ ID NO: 5516434 - DNA, 17 bp, Homo sapiens
tcatcgaacaaactgat

SEQ ID NO: 5516435 - DNA, 14 bp, Homo sapiens
tcatcgaatctact

SEQ ID NO: 5516436 - DNA, 21 bp, Homo sapiens
tcatcgaatctactaattcca

SEQ ID NO: 5516437 - DNA, 23 bp, Homo sapiens
tcatcgattcaaactgctccaag

SEQ ID NO: 5516438 - DNA, 17 bp, Homo sapiens
tcatcgcgtcctcctac

SEQ ID NO: 5516439 - DNA, 18 bp, Homo sapiens
tcatcgcgtcctcctacc

SEQ ID NO: 5516440 - DNA, 18 bp, Homo sapiens
tcatcgctcccaaaggaa

SEQ ID NO: 5516441 - DNA, 23 bp, Homo sapiens
tcatcggaggctgggcccctggg

SEQ ID NO: 5516442 - DNA, 21 bp, Homo sapiens
tcatcggagttgacagtgaaa

SEQ ID NO: 5516443 - DNA, 23 bp, Homo sapiens
tcatcggagttgacagtgaaaca

SEQ ID NO: 5516444 - DNA, 20 bp, Homo sapiens
tcatcggcaggcgcatgagt

SEQ ID NO: 5516445 - DNA, 19 bp, Homo sapiens
tcatcgggaatactaggga

SEQ ID NO: 5516446 - DNA, 16 bp, Homo sapiens
tcatcgggcccaggga

SEQ ID NO: 5516447 - DNA, 17 bp, Homo sapiens
tcatcgggcccagggac

SEQ ID NO: 5516448 - DNA, 14 bp, Homo sapiens
tcatcggtgcctgg

SEQ ID NO: 5516449 - DNA, 15 bp, Homo sapiens
tcatcgtaaagtgct

SEQ ID NO: 5516450 - DNA, 20 bp, Homo sapiens
tcatcgtaggtgatttgaag

SEQ ID NO: 5516451 - DNA, 18 bp, Homo sapiens
tcatcgttccccacccct

SEQ ID NO: 5516452 - DNA, 20 bp, Homo sapiens
tcatctaaaatttttctaga

SEQ ID NO: 5516453 - DNA, 13 bp, Homo sapiens
tcatctaaatgaa

SEQ ID NO: 5516454 - DNA, 19 bp, Homo sapiens
tcatctaagtcagtaccca

SEQ ID NO: 5516455 - DNA, 13 bp, Homo sapiens
tcatctaataaat

SEQ ID NO: 5516456 - DNA, 20 bp, Homo sapiens
tcatctacctagatttaata

SEQ ID NO: 5516457 - DNA, 15 bp, Homo sapiens
tcatctaccttttct

SEQ ID NO: 5516458 - DNA, 16 bp, Homo sapiens
tcatctaccttttctc

SEQ ID NO: 5516459 - DNA, 19 bp, Homo sapiens
tcatctactgaatgacctc

SEQ ID NO: 5516460 - DNA, 14 bp, Homo sapiens
tcatctagcccctt

SEQ ID NO: 5516461 - DNA, 22 bp, Homo sapiens
tcatctagtcttgacctctcca

SEQ ID NO: 5516462 - DNA, 13 bp, Homo sapiens
tcatctataaaga

SEQ ID NO: 5516463 - DNA, 17 bp, Homo sapiens
tcatctatgaggaaagg

SEQ ID NO: 5516464 - DNA, 14 bp, Homo sapiens
tcatctatggaggg

SEQ ID NO: 5516465 - DNA, 21 bp, Homo sapiens
tcatctatggcagtccagcca

SEQ ID NO: 5516466 - DNA, 23 bp, Homo sapiens
tcatctatggcagtccagccagc

SEQ ID NO: 5516467 - DNA, 17 bp, Homo sapiens
tcatctatggttctaaa

SEQ ID NO: 5516468 - DNA, 11 bp, Homo sapiens
tcatctatttc

SEQ ID NO: 5516469 - DNA, 14 bp, Homo sapiens
tcatctatttctga

SEQ ID NO: 5516470 - DNA, 15 bp, Homo sapiens
tcatctatttctgag

SEQ ID NO: 5516471 - DNA, 13 bp, Homo sapiens
tcatggaaatatt

SEQ ID NO: 5516472 - DNA, 14 bp, Homo sapiens
tcatggaagaaaag

SEQ ID NO: 5516473 - DNA, 15 bp, Homo sapiens
tcatggaagccacca

SEQ ID NO: 5516474 - DNA, 15 bp, Homo sapiens
tcatggaatcttgct

SEQ ID NO: 5516475 - DNA, 17 bp, Homo sapiens
tcatggaatggacatcc

SEQ ID NO: 5516476 - DNA, 21 bp, Homo sapiens
tcatggaatggttataaaagt

SEQ ID NO: 5516477 - DNA, 17 bp, Homo sapiens
tcatggacagctgagca

SEQ ID NO: 5516478 - DNA, 21 bp, Homo sapiens
tcatggaccaaatgtgccata

SEQ ID NO: 5516479 - DNA, 19 bp, Homo sapiens
tcatggaccactgtttctt

SEQ ID NO: 5516480 - DNA, 21 bp, Homo sapiens
tcatggaccactgtttcttgc

SEQ ID NO: 5516481 - DNA, 22 bp, Homo sapiens
tcatggaccactgtttcttgct

SEQ ID NO: 5516482 - DNA, 22 bp, Homo sapiens
tcatggaccaggtcttgttcaa

SEQ ID NO: 5516483 - DNA, 19 bp, Homo sapiens
tcatggactgttgccacca

SEQ ID NO: 5516484 - DNA, 21 bp, Homo sapiens
tcatggagaaccacctacccc

SEQ ID NO: 5516485 - DNA, 20 bp, Homo sapiens
tcatggagaagcagaaatac

SEQ ID NO: 5516486 - DNA, 17 bp, Homo sapiens
tcatggagcagccccca

SEQ ID NO: 5516487 - DNA, 15 bp, Homo sapiens
tcatggagtagcctg

SEQ ID NO: 5516488 - DNA, 23 bp, Homo sapiens
tcatggagtagcctggactgttt

SEQ ID NO: 5516489 - DNA, 20 bp, Homo sapiens
tcatggatcgtgttggtatt

SEQ ID NO: 5516490 - DNA, 20 bp, Homo sapiens
tcatggattcattacagctt

SEQ ID NO: 5516491 - DNA, 17 bp, Homo sapiens
tcatggcaagtggggct

SEQ ID NO: 5516492 - DNA, 20 bp, Homo sapiens
tcatggcaagtggggctggt

SEQ ID NO: 5516493 - DNA, 21 bp, Homo sapiens
tcatggcagatgtaggaggga

SEQ ID NO: 5516494 - DNA, 15 bp, Homo sapiens
tcatggcagtgggac

SEQ ID NO: 5516495 - DNA, 22 bp, Homo sapiens
tcatggcattcgcagtgcccag

SEQ ID NO: 5516496 - DNA, 15 bp, Homo sapiens
tcatggccacactgt

SEQ ID NO: 5516497 - DNA, 23 bp, Homo sapiens
tcatggccagcgcccctcagcct

SEQ ID NO: 5516498 - DNA, 22 bp, Homo sapiens
tcatggcccatcaggggcagga

SEQ ID NO: 5516499 - DNA, 17 bp, Homo sapiens
tcatggcccccaggggc

SEQ ID NO: 5516500 - DNA, 18 bp, Homo sapiens
tcatggcccccaggggca

SEQ ID NO: 5516501 - DNA, 13 bp, Homo sapiens
tcatggcccctct

SEQ ID NO: 5516502 - DNA, 18 bp, Homo sapiens
tcatggcccctctgacct

SEQ ID NO: 5516503 - DNA, 15 bp, Homo sapiens
tcatggccctgtagt

SEQ ID NO: 5516504 - DNA, 15 bp, Homo sapiens
tcatggcctcttgaa

SEQ ID NO: 5516505 - DNA, 21 bp, Homo sapiens
tcatggctaagcttaaaaaaa

SEQ ID NO: 5516506 - DNA, 23 bp, Homo sapiens
tcatggctaagcttaaaaaaaac

SEQ ID NO: 5516507 - DNA, 16 bp, Homo sapiens
tcatggctacctcaga

SEQ ID NO: 5516508 - DNA, 18 bp, Homo sapiens
tcatggctcaaggattca

SEQ ID NO: 5516509 - DNA, 18 bp, Homo sapiens
tcatggctcactgcagcc

SEQ ID NO: 5516510 - DNA, 19 bp, Homo sapiens
tcatggctgtcccctgcaa

SEQ ID NO: 5516511 - DNA, 14 bp, Homo sapiens
tcatggcttaatgt

SEQ ID NO: 5516512 - DNA, 15 bp, Homo sapiens
tcatggcttaatgtt

SEQ ID NO: 5516513 - DNA, 15 bp, Homo sapiens
tcatggcttagaaat

SEQ ID NO: 5516514 - DNA, 12 bp, Homo sapiens
tcatggctttgt

SEQ ID NO: 5516515 - DNA, 17 bp, Homo sapiens
tcatgggaagcatgtgg

SEQ ID NO: 5516516 - DNA, 18 bp, Homo sapiens
tcatgggaattttaactt

SEQ ID NO: 5516517 - DNA, 17 bp, Homo sapiens
tcatgggagcatgctta

SEQ ID NO: 5516518 - DNA, 18 bp, Homo sapiens
tcatgggcaccaacctgc

SEQ ID NO: 5516519 - DNA, 19 bp, Homo sapiens
tcatgggcagaggatgagg

SEQ ID NO: 5516520 - DNA, 17 bp, Homo sapiens
tcatgggcccctctgac

SEQ ID NO: 5516521 - DNA, 21 bp, Homo sapiens
tcatggggatcaattttcatt

SEQ ID NO: 5516522 - DNA, 19 bp, Homo sapiens
tcatggggggagcaccctg

SEQ ID NO: 5516523 - DNA, 14 bp, Homo sapiens
tcatgggtcctagc

SEQ ID NO: 5516524 - DNA, 22 bp, Homo sapiens
tcatgggtcctagcccttccct

SEQ ID NO: 5516525 - DNA, 13 bp, Homo sapiens
tcatggtaccagg

SEQ ID NO: 5516526 - DNA, 16 bp, Homo sapiens
tcatggtactacccca

SEQ ID NO: 5516527 - DNA, 20 bp, Homo sapiens
tcatggtcaagttcccaact

SEQ ID NO: 5516528 - DNA, 12 bp, Homo sapiens
tcatggtcagct

SEQ ID NO: 5516529 - DNA, 17 bp, Homo sapiens
tcatggtccgcctgcct

SEQ ID NO: 5516530 - DNA, 13 bp, Homo sapiens
tcatggtctcttc

SEQ ID NO: 5516531 - DNA, 14 bp, Homo sapiens
tcatggtgaaatta

SEQ ID NO: 5516532 - DNA, 21 bp, Homo sapiens
tcatggtgaccaccccctgtt

SEQ ID NO: 5516533 - DNA, 14 bp, Homo sapiens
tcatggtgcaattt

SEQ ID NO: 5516534 - DNA, 22 bp, Homo sapiens
tcatggtggatatggtgcagag

SEQ ID NO: 5516535 - DNA, 23 bp, Homo sapiens
tcatggtgggttcaggggactca

SEQ ID NO: 5516536 - DNA, 15 bp, Homo sapiens
tcatggtgtaataag

SEQ ID NO: 5516537 - DNA, 18 bp, Homo sapiens
tcatggtgtaataagaca

SEQ ID NO: 5516538 - DNA, 22 bp, Homo sapiens
tcatggtgtaataagacataac

SEQ ID NO: 5516539 - DNA, 13 bp, Homo sapiens
tcatggttcaagt

SEQ ID NO: 5516540 - DNA, 16 bp, Homo sapiens
tcatggtttataaaaa

SEQ ID NO: 5516541 - DNA, 17 bp, Homo sapiens
tcatggttttaaagcta

SEQ ID NO: 5516542 - DNA, 15 bp, Homo sapiens
tcatgtaaaacagaa

SEQ ID NO: 5516543 - DNA, 16 bp, Homo sapiens
tcatgtaaaataagaa

SEQ ID NO: 5516544 - DNA, 22 bp, Homo sapiens
tcatgtaaacataccaacatgt

SEQ ID NO: 5516545 - DNA, 16 bp, Homo sapiens
tcatgtaaagaaatgt

SEQ ID NO: 5516546 - DNA, 13 bp, Homo sapiens
tcatgtaaataat

SEQ ID NO: 5516547 - DNA, 19 bp, Homo sapiens
tcatgtaaataatacatta

SEQ ID NO: 5516548 - DNA, 16 bp, Homo sapiens
tcatgtaaatgattat

SEQ ID NO: 5516549 - DNA, 22 bp, Homo sapiens
tcatgtaaattgactgtactag

SEQ ID NO: 5516550 - DNA, 17 bp, Homo sapiens
tcatgtaaattttgtat

SEQ ID NO: 5516551 - DNA, 14 bp, Homo sapiens
tcatgtaacacata

SEQ ID NO: 5516552 - DNA, 12 bp, Homo sapiens
tcatgtaacatt

SEQ ID NO: 5516553 - DNA, 20 bp, Homo sapiens
tcatgtaacttccctgaaaa

SEQ ID NO: 5516554 - DNA, 16 bp, Homo sapiens
tcatgtaactttttta

SEQ ID NO: 5516555 - DNA, 15 bp, Homo sapiens
tcatgtaataaatct

SEQ ID NO: 5516556 - DNA, 15 bp, Homo sapiens
tcatgtaatactgaa

SEQ ID NO: 5516557 - DNA, 21 bp, Homo sapiens
tcatgtaatactgaaccactt

SEQ ID NO: 5516558 - DNA, 15 bp, Homo sapiens
tcatgtaatataagt

SEQ ID NO: 5516559 - DNA, 15 bp, Homo sapiens
tcatgtaatcctcaa

SEQ ID NO: 5516560 - DNA, 17 bp, Homo sapiens
tcatgtaatgtggtcac

SEQ ID NO: 5516561 - DNA, 19 bp, Homo sapiens
tcatgtacagcattaaaat

SEQ ID NO: 5516562 - DNA, 17 bp, Homo sapiens
tcatgtaccaagtgctt

SEQ ID NO: 5516563 - DNA, 16 bp, Homo sapiens
tcatgtaccatcaata

SEQ ID NO: 5516564 - DNA, 18 bp, Homo sapiens
tcatgtaccatcaataaa

SEQ ID NO: 5516565 - DNA, 14 bp, Homo sapiens
tcatgtacttcctg

SEQ ID NO: 5516566 - DNA, 16 bp, Homo sapiens
tcatgtacttcctgtg

SEQ ID NO: 5516567 - DNA, 17 bp, Homo sapiens
tcatgtacttcctgtgt

SEQ ID NO: 5516568 - DNA, 14 bp, Homo sapiens
tcatgtacttcttt

SEQ ID NO: 5516569 - DNA, 20 bp, Homo sapiens
tcatgtacttttaaattata

SEQ ID NO: 5516570 - DNA, 22 bp, Homo sapiens
tcatgtactttttagtaatttc

SEQ ID NO: 5516571 - DNA, 22 bp, Homo sapiens
tcatgtagaactcagcagttga

SEQ ID NO: 5516572 - DNA, 19 bp, Homo sapiens
tcatgtagagaaaagcaca

SEQ ID NO: 5516573 - DNA, 21 bp, Homo sapiens
tcatgtagccagcagaactga

SEQ ID NO: 5516574 - DNA, 17 bp, Homo sapiens
tcatgtaggtgagcctg

SEQ ID NO: 5516575 - DNA, 17 bp, Homo sapiens
tcatgtaggttgtctaa

SEQ ID NO: 5516576 - DNA, 15 bp, Homo sapiens
tcatgtagtaagatt

SEQ ID NO: 5516577 - DNA, 23 bp, Homo sapiens
tcatgtatattacccaatggaaa

SEQ ID NO: 5516578 - DNA, 16 bp, Homo sapiens
tcatgtatatttagtt

SEQ ID NO: 5516579 - DNA, 19 bp, Homo sapiens
tcatgtatcatctggatag

SEQ ID NO: 5516580 - DNA, 15 bp, Homo sapiens
tcatgtatgatgagc

SEQ ID NO: 5516581 - DNA, 15 bp, Homo sapiens
tcatgtatgtatata

SEQ ID NO: 5516582 - DNA, 21 bp, Homo sapiens
tcatgtatgtatataatcatg

SEQ ID NO: 5516583 - DNA, 20 bp, Homo sapiens
tcatgtatgtatgagacaga

SEQ ID NO: 5516584 - DNA, 14 bp, Homo sapiens
tcatgtatgtttct

SEQ ID NO: 5516585 - DNA, 14 bp, Homo sapiens
tcatgtatttcttt

SEQ ID NO: 5516586 - DNA, 17 bp, Homo sapiens
tcatgtattttacacaa

SEQ ID NO: 5516587 - DNA, 16 bp, Homo sapiens
tcatgtcaacttctgg

SEQ ID NO: 5516588 - DNA, 20 bp, Homo sapiens
tcatgtcagaaggagacaga

SEQ ID NO: 5516589 - DNA, 20 bp, Homo sapiens
tcatgtccagtgagcagtgt

SEQ ID NO: 5516590 - DNA, 21 bp, Homo sapiens
tcatgtccatcccttttcctg

SEQ ID NO: 5516591 - DNA, 14 bp, Homo sapiens
tcatgtccccttcc

SEQ ID NO: 5516592 - DNA, 13 bp, Homo sapiens
tcatgtccctcca

SEQ ID NO: 5516593 - DNA, 15 bp, Homo sapiens
tcatgtccctccagg

SEQ ID NO: 5516594 - DNA, 21 bp, Homo sapiens
tcatgtcctatagtttgtcat

SEQ ID NO: 5516595 - DNA, 16 bp, Homo sapiens
tcatgtcctgtcctgg

SEQ ID NO: 5516596 - DNA, 15 bp, Homo sapiens
tcatgtcctgtgtca

SEQ ID NO: 5516597 - DNA, 16 bp, Homo sapiens
tcatgtcgatcctggg

SEQ ID NO: 5516598 - DNA, 13 bp, Homo sapiens
tcatgtctctgat

SEQ ID NO: 5516599 - DNA, 19 bp, Homo sapiens
tcatgtctgaaaaatgcct

SEQ ID NO: 5516600 - DNA, 18 bp, Homo sapiens
tcatgtctgaaacagaga

SEQ ID NO: 5516601 - DNA, 13 bp, Homo sapiens
tcatgtctggcta

SEQ ID NO: 5516602 - DNA, 23 bp, Homo sapiens
tcatgtcttcattttttaatgtg

SEQ ID NO: 5516603 - DNA, 16 bp, Homo sapiens
tcatgtcttctcacaa

SEQ ID NO: 5516604 - DNA, 21 bp, Homo sapiens
tcatgtctttattagtaacat

SEQ ID NO: 5516605 - DNA, 23 bp, Homo sapiens
tcatgtctttccacttctctggg

SEQ ID NO: 5516606 - DNA, 17 bp, Homo sapiens
tcatgtgaaatcattca

SEQ ID NO: 5516607 - DNA, 18 bp, Homo sapiens
tcatgtgactctttccaa

SEQ ID NO: 5516608 - DNA, 15 bp, Homo sapiens
tcatgtgatgtcatg

SEQ ID NO: 5516609 - DNA, 16 bp, Homo sapiens
tcatgtgatgtcatga

SEQ ID NO: 5516610 - DNA, 15 bp, Homo sapiens
tcatgtgcaaagtga

SEQ ID NO: 5516611 - DNA, 22 bp, Homo sapiens
tcatgtgcaaagtgactatttg

SEQ ID NO: 5516612 - DNA, 21 bp, Homo sapiens
tcatgtgcattattttccaga

SEQ ID NO: 5516613 - DNA, 17 bp, Homo sapiens
tcatgtgcctctgtcct

SEQ ID NO: 5516614 - DNA, 17 bp, Homo sapiens
tcatgtgcgaacacagt

SEQ ID NO: 5516615 - DNA, 15 bp, Homo sapiens
tcatgtgcttgtgcc

SEQ ID NO: 5516616 - DNA, 13 bp, Homo sapiens
tcatgtggactgg

SEQ ID NO: 5516617 - DNA, 18 bp, Homo sapiens
tcatgtggcattctctct

SEQ ID NO: 5516618 - DNA, 20 bp, Homo sapiens
tcatgtggcccaactctcct

SEQ ID NO: 5516619 - DNA, 23 bp, Homo sapiens
tcatgtggcctaatattgaaaat

SEQ ID NO: 5516620 - DNA, 16 bp, Homo sapiens
tcatgtggctggaaga

SEQ ID NO: 5516621 - DNA, 21 bp, Homo sapiens
tcatgtggctggaagatcctg

SEQ ID NO: 5516622 - DNA, 22 bp, Homo sapiens
tcatgtgggtgagccagtggaa

SEQ ID NO: 5516623 - DNA, 18 bp, Homo sapiens
tcatgtggtactactgaa

SEQ ID NO: 5516624 - DNA, 18 bp, Homo sapiens
tcatgtggtgaatatgca

SEQ ID NO: 5516625 - DNA, 18 bp, Homo sapiens
tcatgtgtaatcaataaa

SEQ ID NO: 5516626 - DNA, 20 bp, Homo sapiens
tcatgtgtacaaaagtttca

SEQ ID NO: 5516627 - DNA, 15 bp, Homo sapiens
tcatgtgtacagaaa

SEQ ID NO: 5516628 - DNA, 11 bp, Homo sapiens
tcatgtgtacc

SEQ ID NO: 5516629 - DNA, 15 bp, Homo sapiens
tcatgtgtagatatt

SEQ ID NO: 5516630 - DNA, 20 bp, Homo sapiens
tcatgtgtcagctgtagaaa

SEQ ID NO: 5516631 - DNA, 14 bp, Homo sapiens
tcatgtgtcccaga

SEQ ID NO: 5516632 - DNA, 13 bp, Homo sapiens
tcatgtgtgcatg

SEQ ID NO: 5516633 - DNA, 17 bp, Homo sapiens
tcatgtgtgcatgtgag

SEQ ID NO: 5516634 - DNA, 16 bp, Homo sapiens
tcatgtgtgtccacga

SEQ ID NO: 5516635 - DNA, 23 bp, Homo sapiens
tcatgtgtgtccacgactgtctc

SEQ ID NO: 5516636 - DNA, 15 bp, Homo sapiens
tcatgtgttcccttt

SEQ ID NO: 5516637 - DNA, 17 bp, Homo sapiens
tcatgtgttccctttgt

SEQ ID NO: 5516638 - DNA, 15 bp, Homo sapiens
tcatgtgttgcaaat

SEQ ID NO: 5516639 - DNA, 23 bp, Homo sapiens
tcatgtgttgcaaattattctag

SEQ ID NO: 5516640 - DNA, 17 bp, Homo sapiens
tcatgtgtttgaacttc

SEQ ID NO: 5516641 - DNA, 13 bp, Homo sapiens
tcatgttaaatta

SEQ ID NO: 5516642 - DNA, 23 bp, Homo sapiens
tcatgttaccaaagcaatatttc

SEQ ID NO: 5516643 - DNA, 16 bp, Homo sapiens
tcatgttactcagtgt

SEQ ID NO: 5516644 - DNA, 14 bp, Homo sapiens
tcatgttacttgag

SEQ ID NO: 5516645 - DNA, 14 bp, Homo sapiens
tcatgttagtaata

SEQ ID NO: 5516646 - DNA, 18 bp, Homo sapiens
tcatgttagtaatacctc

SEQ ID NO: 5516647 - DNA, 23 bp, Homo sapiens
tcatgttagttaccttatagtta

SEQ ID NO: 5516648 - DNA, 22 bp, Homo sapiens
tcatgttatatttaatgcatta

SEQ ID NO: 5516649 - DNA, 20 bp, Homo sapiens
tcatgttatgatttgtaaca

SEQ ID NO: 5516650 - DNA, 15 bp, Homo sapiens
tcatgttatgcagtg

SEQ ID NO: 5516651 - DNA, 18 bp, Homo sapiens
tcatgttcatatgtactt

SEQ ID NO: 5516652 - DNA, 21 bp, Homo sapiens
tcatgttccttcaagatcatg

SEQ ID NO: 5516653 - DNA, 13 bp, Homo sapiens
tcatgttgatgac

SEQ ID NO: 5516654 - DNA, 17 bp, Homo sapiens
tcatgttgatgtgtccg

SEQ ID NO: 5516655 - DNA, 23 bp, Homo sapiens
tcatgttgcttgtcgctttctca

SEQ ID NO: 5516656 - DNA, 13 bp, Homo sapiens
tcatgttggccaa

SEQ ID NO: 5516657 - DNA, 17 bp, Homo sapiens
tcatgttggccaggctg

SEQ ID NO: 5516658 - DNA, 19 bp, Homo sapiens
tcatgttggccaggctggt

SEQ ID NO: 5516659 - DNA, 17 bp, Homo sapiens
tcatgttggtaccctgg

SEQ ID NO: 5516660 - DNA, 15 bp, Homo sapiens
tcatgttggtttatt

SEQ ID NO: 5516661 - DNA, 20 bp, Homo sapiens
tcatgttggtttattttcac

SEQ ID NO: 5516662 - DNA, 18 bp, Homo sapiens
tcatgttgttcccacaca

SEQ ID NO: 5516663 - DNA, 20 bp, Homo sapiens
tcatgttgttcccacacaca

SEQ ID NO: 5516664 - DNA, 22 bp, Homo sapiens
tcatgttgttgtgtgtatatgt

SEQ ID NO: 5516665 - DNA, 22 bp, Homo sapiens
tcatgtttaagaaatgagaaat

SEQ ID NO: 5516666 - DNA, 17 bp, Homo sapiens
tcatgtttacagaggac

SEQ ID NO: 5516667 - DNA, 14 bp, Homo sapiens
tcatgtttatgaaa

SEQ ID NO: 5516668 - DNA, 16 bp, Homo sapiens
tcatgtttatgaaaat

SEQ ID NO: 5516669 - DNA, 15 bp, Homo sapiens
tcatgtttattttga

SEQ ID NO: 5516670 - DNA, 23 bp, Homo sapiens
tcatgtttctcccataggctgtg

SEQ ID NO: 5516671 - DNA, 11 bp, Homo sapiens
tcatgtttctt

SEQ ID NO: 5516672 - DNA, 15 bp, Homo sapiens
tcatgtttcttaaat

SEQ ID NO: 5516673 - DNA, 16 bp, Homo sapiens
tcatgtttcttaaatg

SEQ ID NO: 5516674 - DNA, 14 bp, Homo sapiens
tcatgtttctttga

SEQ ID NO: 5516675 - DNA, 18 bp, Homo sapiens
tcatgttttaaaagtttg

SEQ ID NO: 5516676 - DNA, 22 bp, Homo sapiens
tcatgttttaaaagtttgtcct

SEQ ID NO: 5516677 - DNA, 18 bp, Homo sapiens
tcatgttttaacaaaaac

SEQ ID NO: 5516678 - DNA, 15 bp, Homo sapiens
tcatgttttaatgta

SEQ ID NO: 5516679 - DNA, 20 bp, Homo sapiens
tcatgttttactacataggt

SEQ ID NO: 5516680 - DNA, 14 bp, Homo sapiens
tcatgttttgctaa

SEQ ID NO: 5516681 - DNA, 15 bp, Homo sapiens
tcatgttttgctaat

SEQ ID NO: 5516682 - DNA, 17 bp, Homo sapiens
tcatgtttttgttttaa

SEQ ID NO: 5516683 - DNA, 23 bp, Homo sapiens
tcatgttttttctgcaatgactg

SEQ ID NO: 5516684 - DNA, 15 bp, Homo sapiens
tcattaaaaacattt

SEQ ID NO: 5516685 - DNA, 21 bp, Homo sapiens
tcattaaaaacatttttttaa

SEQ ID NO: 5516686 - DNA, 19 bp, Homo sapiens
tcattaaaacaagagacca

SEQ ID NO: 5516687 - DNA, 18 bp, Homo sapiens
tcattaaaaggaaaaaag

SEQ ID NO: 5516688 - DNA, 20 bp, Homo sapiens
tcattaaaagttttatgtac

SEQ ID NO: 5516689 - DNA, 17 bp, Homo sapiens
tcattaaaatatatgtt

SEQ ID NO: 5516690 - DNA, 20 bp, Homo sapiens
tcattaaaatatatgttctg

SEQ ID NO: 5516691 - DNA, 23 bp, Homo sapiens
tcattaaaatatatgttctgcaa

SEQ ID NO: 5516692 - DNA, 14 bp, Homo sapiens
tcattaaacaaaca

SEQ ID NO: 5516693 - DNA, 15 bp, Homo sapiens
tcattaaacttgaag

SEQ ID NO: 5516694 - DNA, 16 bp, Homo sapiens
tcattaaactttttta

SEQ ID NO: 5516695 - DNA, 15 bp, Homo sapiens
tcattaaagcattta

SEQ ID NO: 5516696 - DNA, 17 bp, Homo sapiens
tcattaaagtgcactgt

SEQ ID NO: 5516697 - DNA, 19 bp, Homo sapiens
tcattaaagtgcactgtgt

SEQ ID NO: 5516698 - DNA, 12 bp, Homo sapiens
tcattaaagttc

SEQ ID NO: 5516699 - DNA, 13 bp, Homo sapiens
tcattaaagttct

SEQ ID NO: 5516700 - DNA, 21 bp, Homo sapiens
tcattaaatattctgtacatt

SEQ ID NO: 5516701 - DNA, 13 bp, Homo sapiens
tcattaaatggaa

SEQ ID NO: 5516702 - DNA, 13 bp, Homo sapiens
tcattaaatgttt

SEQ ID NO: 5516703 - DNA, 15 bp, Homo sapiens
tcattaaattttcta

SEQ ID NO: 5516704 - DNA, 14 bp, Homo sapiens
tcattaacacattg

SEQ ID NO: 5516705 - DNA, 15 bp, Homo sapiens
tcattaacacattgt

SEQ ID NO: 5516706 - DNA, 22 bp, Homo sapiens
tcattaaccttatcataaattc

SEQ ID NO: 5516707 - DNA, 23 bp, Homo sapiens
tcattaaggtattattttttcca

SEQ ID NO: 5516708 - DNA, 16 bp, Homo sapiens
tcattaagtaatcttt

SEQ ID NO: 5516709 - DNA, 13 bp, Homo sapiens
tcattaatactgt

SEQ ID NO: 5516710 - DNA, 15 bp, Homo sapiens
tcattaatactgtgt

SEQ ID NO: 5516711 - DNA, 17 bp, Homo sapiens
tcattaatagctgcctt

SEQ ID NO: 5516712 - DNA, 23 bp, Homo sapiens
tcattaatagctgccttcaagga

SEQ ID NO: 5516713 - DNA, 14 bp, Homo sapiens
tcattaatcaattt

SEQ ID NO: 5516714 - DNA, 15 bp, Homo sapiens
tcattaatgacactt

SEQ ID NO: 5516715 - DNA, 19 bp, Homo sapiens
tcattaatgacacttgtcc

SEQ ID NO: 5516716 - DNA, 21 bp, Homo sapiens
tcattaatgacacttgtcccc

SEQ ID NO: 5516717 - DNA, 14 bp, Homo sapiens
tcattaatgtaata

SEQ ID NO: 5516718 - DNA, 15 bp, Homo sapiens
tcattaattcaatga

SEQ ID NO: 5516719 - DNA, 21 bp, Homo sapiens
tcattaattcaatgaaatgga

SEQ ID NO: 5516720 - DNA, 21 bp, Homo sapiens
tcattaattcaattaaaacca

SEQ ID NO: 5516721 - DNA, 13 bp, Homo sapiens
tcattaattctat

SEQ ID NO: 5516722 - DNA, 18 bp, Homo sapiens
tcattacaattttctgta

SEQ ID NO: 5516723 - DNA, 20 bp, Homo sapiens
tcattacaattttctgtaag

SEQ ID NO: 5516724 - DNA, 23 bp, Homo sapiens
tcattacagattctgctagcctg

SEQ ID NO: 5516725 - DNA, 21 bp, Homo sapiens
tcattacagttctttcctctt

SEQ ID NO: 5516726 - DNA, 18 bp, Homo sapiens
tcattacatcctctgctt

SEQ ID NO: 5516727 - DNA, 17 bp, Homo sapiens
tcattaccaagttactt

SEQ ID NO: 5516728 - DNA, 18 bp, Homo sapiens
tcattaccaagttacttg

SEQ ID NO: 5516729 - DNA, 18 bp, Homo sapiens
tcattaccctacagacag

SEQ ID NO: 5516730 - DNA, 18 bp, Homo sapiens
tcattaccttaaagcatc

SEQ ID NO: 5516731 - DNA, 22 bp, Homo sapiens
tcattaccttttaccagctttt

SEQ ID NO: 5516732 - DNA, 20 bp, Homo sapiens
tcattaccttttttgataaa

SEQ ID NO: 5516733 - DNA, 17 bp, Homo sapiens
tcattactaacttcttc

SEQ ID NO: 5516734 - DNA, 12 bp, Homo sapiens
tcattactataa

SEQ ID NO: 5516735 - DNA, 13 bp, Homo sapiens
tcattactgcaaa

SEQ ID NO: 5516736 - DNA, 14 bp, Homo sapiens
tcattactgcaaat

SEQ ID NO: 5516737 - DNA, 18 bp, Homo sapiens
tcattactgcccagatgt

SEQ ID NO: 5516738 - DNA, 20 bp, Homo sapiens
tcattactgcccagatgttt

SEQ ID NO: 5516739 - DNA, 15 bp, Homo sapiens
tcattactgcctttg

SEQ ID NO: 5516740 - DNA, 16 bp, Homo sapiens
tcattactgcctttgg

SEQ ID NO: 5516741 - DNA, 17 bp, Homo sapiens
tcattactgcttcattt

SEQ ID NO: 5516742 - DNA, 20 bp, Homo sapiens
tcattactgcttcatttttg

SEQ ID NO: 5516743 - DNA, 13 bp, Homo sapiens
tcattactggtaa

SEQ ID NO: 5516744 - DNA, 17 bp, Homo sapiens
tcattactggtaaagcc

SEQ ID NO: 5516745 - DNA, 22 bp, Homo sapiens
tcattacttctgagccccagcc

SEQ ID NO: 5516746 - DNA, 21 bp, Homo sapiens
tcattacttgattaagatttt

SEQ ID NO: 5516747 - DNA, 12 bp, Homo sapiens
tcattactttct

SEQ ID NO: 5516748 - DNA, 15 bp, Homo sapiens
tcattagaaaggcta

SEQ ID NO: 5516749 - DNA, 17 bp, Homo sapiens
tcattagaattaccatt

SEQ ID NO: 5516750 - DNA, 13 bp, Homo sapiens
tcattagactcct

SEQ ID NO: 5516751 - DNA, 13 bp, Homo sapiens
tcattagagcagg

SEQ ID NO: 5516752 - DNA, 18 bp, Homo sapiens
tcattagcaaaaaaagtt

SEQ ID NO: 5516753 - DNA, 22 bp, Homo sapiens
tcattagcaaaaaaagttgtat

SEQ ID NO: 5516754 - DNA, 18 bp, Homo sapiens
tcattagcttgtctatta

SEQ ID NO: 5516755 - DNA, 18 bp, Homo sapiens
tcattaggaaaacatctt

SEQ ID NO: 5516756 - DNA, 16 bp, Homo sapiens
tcattagggtaatatc

SEQ ID NO: 5516757 - DNA, 18 bp, Homo sapiens
tcattagggtaatatcat

SEQ ID NO: 5516758 - DNA, 16 bp, Homo sapiens
tcattaggtgtgactg

SEQ ID NO: 5516759 - DNA, 16 bp, Homo sapiens
tcattagtcctttgtc

SEQ ID NO: 5516760 - DNA, 22 bp, Homo sapiens
tcattataatgtcattaaacat

SEQ ID NO: 5516761 - DNA, 18 bp, Homo sapiens
tcattatagcatgtaata

SEQ ID NO: 5516762 - DNA, 15 bp, Homo sapiens
tcattatcagaacat

SEQ ID NO: 5516763 - DNA, 19 bp, Homo sapiens
tcattatctcaaaactgca

SEQ ID NO: 5516764 - DNA, 20 bp, Homo sapiens
tcattatctcaaaactgcac

SEQ ID NO: 5516765 - DNA, 18 bp, Homo sapiens
tcattatctgtactgaaa

SEQ ID NO: 5516766 - DNA, 14 bp, Homo sapiens
tcattatgaagatg

SEQ ID NO: 5516767 - DNA, 23 bp, Homo sapiens
tcattatgacatttcttaaaact

SEQ ID NO: 5516768 - DNA, 23 bp, Homo sapiens
tcattatgcacttttagaaatgc

SEQ ID NO: 5516769 - DNA, 15 bp, Homo sapiens
tcattatgctttgaa

SEQ ID NO: 5516770 - DNA, 19 bp, Homo sapiens
tcattatgctttgaacttt

SEQ ID NO: 5516771 - DNA, 13 bp, Homo sapiens
tcattatgtaaaa

SEQ ID NO: 5516772 - DNA, 13 bp, Homo sapiens
tcattatgtagaa

SEQ ID NO: 5516773 - DNA, 14 bp, Homo sapiens
tcattatgtagaaa

SEQ ID NO: 5516774 - DNA, 16 bp, Homo sapiens
tcattatgtagaaata

SEQ ID NO: 5516775 - DNA, 18 bp, Homo sapiens
tcattatgtcaaccaggt

SEQ ID NO: 5516776 - DNA, 21 bp, Homo sapiens
tcattatgttcatgtaagaag

SEQ ID NO: 5516777 - DNA, 13 bp, Homo sapiens
tcattattcctca

SEQ ID NO: 5516778 - DNA, 23 bp, Homo sapiens
tcattattcctcagattgctgaa

SEQ ID NO: 5516779 - DNA, 15 bp, Homo sapiens
tcattattctcataa

SEQ ID NO: 5516780 - DNA, 20 bp, Homo sapiens
tcattattctcataatcctt

SEQ ID NO: 5516781 - DNA, 16 bp, Homo sapiens
tcattattgagtcacc

SEQ ID NO: 5516782 - DNA, 18 bp, Homo sapiens
tcattattgagtcaccat

SEQ ID NO: 5516783 - DNA, 13 bp, Homo sapiens
tcattattgtagt

SEQ ID NO: 5516784 - DNA, 21 bp, Homo sapiens
tcattattgtagtttgaaagt

SEQ ID NO: 5516785 - DNA, 11 bp, Homo sapiens
tcattatttat

SEQ ID NO: 5516786 - DNA, 18 bp, Homo sapiens
tcattatttattaaattt

SEQ ID NO: 5516787 - DNA, 21 bp, Homo sapiens
tcattatttattgttaaatta

SEQ ID NO: 5516788 - DNA, 13 bp, Homo sapiens
tcattatttcatg

SEQ ID NO: 5516789 - DNA, 14 bp, Homo sapiens
tcattatttcatga

SEQ ID NO: 5516790 - DNA, 22 bp, Homo sapiens
tcattatttgataacattttgt

SEQ ID NO: 5516791 - DNA, 13 bp, Homo sapiens
tcattatttgtca

SEQ ID NO: 5516792 - DNA, 14 bp, Homo sapiens
tcattatttgtcaa

SEQ ID NO: 5516793 - DNA, 13 bp, Homo sapiens
tcattattttatt

SEQ ID NO: 5516794 - DNA, 14 bp, Homo sapiens
tcattattttatta

SEQ ID NO: 5516795 - DNA, 15 bp, Homo sapiens
tcattattttattat

SEQ ID NO: 5516796 - DNA, 19 bp, Homo sapiens
tcattattttattatgaaa

SEQ ID NO: 5516797 - DNA, 13 bp, Homo sapiens
tcattattttccc

SEQ ID NO: 5516798 - DNA, 20 bp, Homo sapiens
tcattattttgggaagaaaa

SEQ ID NO: 5516799 - DNA, 15 bp, Homo sapiens
tcattatttttcaat

SEQ ID NO: 5516800 - DNA, 16 bp, Homo sapiens
tcattatttttcaatt

SEQ ID NO: 5516801 - DNA, 16 bp, Homo sapiens
tcattcaaaaagccaa

SEQ ID NO: 5516802 - DNA, 16 bp, Homo sapiens
tcattcaaaagttgaa

SEQ ID NO: 5516803 - DNA, 18 bp, Homo sapiens
tcattcaaactgcacttt

SEQ ID NO: 5516804 - DNA, 20 bp, Homo sapiens
tcattcaaactgcactttta

SEQ ID NO: 5516805 - DNA, 22 bp, Homo sapiens
tcattcaaatcagtgatctatg

SEQ ID NO: 5516806 - DNA, 19 bp, Homo sapiens
tcattcaacacatttttaa

SEQ ID NO: 5516807 - DNA, 14 bp, Homo sapiens
tcattcaagctatt

SEQ ID NO: 5516808 - DNA, 13 bp, Homo sapiens
tcattcaataaat

SEQ ID NO: 5516809 - DNA, 24 bp, Homo sapiens
tcattcaccagtacattctcagtt

SEQ ID NO: 5516810 - DNA, 13 bp, Homo sapiens
tcattcagaaaaa

SEQ ID NO: 5516811 - DNA, 22 bp, Homo sapiens
tcattcagaatgtgcaaagcag

SEQ ID NO: 5516812 - DNA, 15 bp, Homo sapiens
tcattcagagactgc

SEQ ID NO: 5516813 - DNA, 19 bp, Homo sapiens
tcattcagagactgccctt

SEQ ID NO: 5516814 - DNA, 20 bp, Homo sapiens
tcattcagcaaatgcctttt

SEQ ID NO: 5516815 - DNA, 15 bp, Homo sapiens
tcattcagcagtcag

SEQ ID NO: 5516816 - DNA, 14 bp, Homo sapiens
tcattcagcatctg

SEQ ID NO: 5516817 - DNA, 12 bp, Homo sapiens
tcattcaggaaa

SEQ ID NO: 5516818 - DNA, 21 bp, Homo sapiens
tcattcagtgagttaaacacg

SEQ ID NO: 5516819 - DNA, 15 bp, Homo sapiens
tcattcagttctagg

SEQ ID NO: 5516820 - DNA, 17 bp, Homo sapiens
tcattcagttctaggcc

SEQ ID NO: 5516821 - DNA, 23 bp, Homo sapiens
tcattcagttctaggcctttcct

SEQ ID NO: 5516822 - DNA, 15 bp, Homo sapiens
tcattcatactcaaa

SEQ ID NO: 5516823 - DNA, 16 bp, Homo sapiens
tcattcatactcaaag

SEQ ID NO: 5516824 - DNA, 21 bp, Homo sapiens
tcattcatatcctccgccctt

SEQ ID NO: 5516825 - DNA, 15 bp, Homo sapiens
tcattcatattacaa

SEQ ID NO: 5516826 - DNA, 20 bp, Homo sapiens
tcatttggtgttcctggaag

SEQ ID NO: 5516827 - DNA, 13 bp, Homo sapiens
tcatttggttaaa

SEQ ID NO: 5516828 - DNA, 17 bp, Homo sapiens
tcatttggttggcacta

SEQ ID NO: 5516829 - DNA, 12 bp, Homo sapiens
tcatttgtagat

SEQ ID NO: 5516830 - DNA, 13 bp, Homo sapiens
tcatttgtagata

SEQ ID NO: 5516831 - DNA, 14 bp, Homo sapiens
tcatttgtagatat

SEQ ID NO: 5516832 - DNA, 15 bp, Homo sapiens
tcatttgtagatata

SEQ ID NO: 5516833 - DNA, 23 bp, Homo sapiens
tcatttgtagatatatatttcca

SEQ ID NO: 5516834 - DNA, 16 bp, Homo sapiens
tcatttgtatgtcaaa

SEQ ID NO: 5516835 - DNA, 18 bp, Homo sapiens
tcatttgtattgcttatt

SEQ ID NO: 5516836 - DNA, 18 bp, Homo sapiens
tcatttgtgccagaatgc

SEQ ID NO: 5516837 - DNA, 12 bp, Homo sapiens
tcatttgtgtca

SEQ ID NO: 5516838 - DNA, 15 bp, Homo sapiens
tcatttgtgtcaatg

SEQ ID NO: 5516839 - DNA, 16 bp, Homo sapiens
tcatttgtgtgctcat

SEQ ID NO: 5516840 - DNA, 22 bp, Homo sapiens
tcatttgttaaaattatcaata

SEQ ID NO: 5516841 - DNA, 16 bp, Homo sapiens
tcatttgttattctta

SEQ ID NO: 5516842 - DNA, 19 bp, Homo sapiens
tcatttgttattcttaaga

SEQ ID NO: 5516843 - DNA, 13 bp, Homo sapiens
tcatttgttcatt

SEQ ID NO: 5516844 - DNA, 22 bp, Homo sapiens
tcatttgttctgggagtataaa

SEQ ID NO: 5516845 - DNA, 20 bp, Homo sapiens
tcatttgttgtgatgtcttt

SEQ ID NO: 5516846 - DNA, 12 bp, Homo sapiens
tcatttgtttaa

SEQ ID NO: 5516847 - DNA, 13 bp, Homo sapiens
tcatttgtttaaa

SEQ ID NO: 5516848 - DNA, 17 bp, Homo sapiens
tcatttgtttaaacaat

SEQ ID NO: 5516849 - DNA, 19 bp, Homo sapiens
tcatttgtttgttttcctt

SEQ ID NO: 5516850 - DNA, 14 bp, Homo sapiens
tcatttgttttgct

SEQ ID NO: 5516851 - DNA, 15 bp, Homo sapiens
tcatttgttttgctt

SEQ ID NO: 5516852 - DNA, 15 bp, Homo sapiens
tcatttgtttttctc

SEQ ID NO: 5516853 - DNA, 16 bp, Homo sapiens
tcatttgttttttcaa

SEQ ID NO: 5516854 - DNA, 17 bp, Homo sapiens
tcatttgttttttcaat

SEQ ID NO: 5516855 - DNA, 17 bp, Homo sapiens
tcattttaaaaacttta

SEQ ID NO: 5516856 - DNA, 16 bp, Homo sapiens
tcattttaaaatctga

SEQ ID NO: 5516857 - DNA, 17 bp, Homo sapiens
tcattttaaaatctgat

SEQ ID NO: 5516858 - DNA, 14 bp, Homo sapiens
tcattttaaaatgt

SEQ ID NO: 5516859 - DNA, 13 bp, Homo sapiens
tcattttaaatga

SEQ ID NO: 5516860 - DNA, 23 bp, Homo sapiens
tcattttaaatgaagggccagca

SEQ ID NO: 5516861 - DNA, 16 bp, Homo sapiens
tcattttaaattccac

SEQ ID NO: 5516862 - DNA, 23 bp, Homo sapiens
tcattttaaattccactgaaaat

SEQ ID NO: 5516863 - DNA, 20 bp, Homo sapiens
tcattttaacatctgagaaa

SEQ ID NO: 5516864 - DNA, 22 bp, Homo sapiens
tcattttaacatctgagaaaag

SEQ ID NO: 5516865 - DNA, 16 bp, Homo sapiens
tcattttaactggcat

SEQ ID NO: 5516866 - DNA, 14 bp, Homo sapiens
tcattttaatatat

SEQ ID NO: 5516867 - DNA, 19 bp, Homo sapiens
tcattttaatgtaaagatt

SEQ ID NO: 5516868 - DNA, 17 bp, Homo sapiens
tcattttactcttatga

SEQ ID NO: 5516869 - DNA, 17 bp, Homo sapiens
tcattttactgtatatt

SEQ ID NO: 5516870 - DNA, 19 bp, Homo sapiens
tcattttaggaataataaa

SEQ ID NO: 5516871 - DNA, 17 bp, Homo sapiens
tcattttaggcctcctc

SEQ ID NO: 5516872 - DNA, 21 bp, Homo sapiens
tcattttaggcctcctctctg

SEQ ID NO: 5516873 - DNA, 20 bp, Homo sapiens
tcattttaggggtagcattt

SEQ ID NO: 5516874 - DNA, 17 bp, Homo sapiens
tcattttagtgactgta

SEQ ID NO: 5516875 - DNA, 17 bp, Homo sapiens
tcattttagtgtatctt

SEQ ID NO: 5516876 - DNA, 22 bp, Homo sapiens
tcattttatatatgaaaactaa

SEQ ID NO: 5516877 - DNA, 15 bp, Homo sapiens
tcattttatattgaa

SEQ ID NO: 5516878 - DNA, 15 bp, Homo sapiens
tcattttatatttaa

SEQ ID NO: 5516879 - DNA, 17 bp, Homo sapiens
tcattttatatttaaaa

SEQ ID NO: 5516880 - DNA, 22 bp, Homo sapiens
tcattttatgaatatcattgat

SEQ ID NO: 5516881 - DNA, 14 bp, Homo sapiens
tcattttatgtcaa

SEQ ID NO: 5516882 - DNA, 15 bp, Homo sapiens
tcattttatgttaag

SEQ ID NO: 5516883 - DNA, 21 bp, Homo sapiens
tcattttattctgtcaatgaa

SEQ ID NO: 5516884 - DNA, 17 bp, Homo sapiens
tcattttatttacagct

SEQ ID NO: 5516885 - DNA, 20 bp, Homo sapiens
tcattttatttacagctgtg

SEQ ID NO: 5516886 - DNA, 23 bp, Homo sapiens
tcattttatttacagctgtgctc

SEQ ID NO: 5516887 - DNA, 22 bp, Homo sapiens
tcattttattttcatgcttttt

SEQ ID NO: 5516888 - DNA, 21 bp, Homo sapiens
tcattttattttttccctcct

SEQ ID NO: 5516889 - DNA, 22 bp, Homo sapiens
tcattttcaagactgaattcca

SEQ ID NO: 5516890 - DNA, 13 bp, Homo sapiens
tcattttcacctc

SEQ ID NO: 5516891 - DNA, 15 bp, Homo sapiens
tcattttcactttta

SEQ ID NO: 5516892 - DNA, 12 bp, Homo sapiens
tcattttcagag

SEQ ID NO: 5516893 - DNA, 15 bp, Homo sapiens
tcattttcagagtga

SEQ ID NO: 5516894 - DNA, 18 bp, Homo sapiens
tcattttcatcactggga

SEQ ID NO: 5516895 - DNA, 14 bp, Homo sapiens
tcattttcattatt

SEQ ID NO: 5516896 - DNA, 14 bp, Homo sapiens
tcattttccaatac

SEQ ID NO: 5516897 - DNA, 10 bp, Homo sapiens
tcattttcct

SEQ ID NO: 5516898 - DNA, 17 bp, Homo sapiens
tcattttcctgacattt

SEQ ID NO: 5516899 - DNA, 16 bp, Homo sapiens
tcattttcctgggagt

SEQ ID NO: 5516900 - DNA, 15 bp, Homo sapiens
tcattttcctttctg

SEQ ID NO: 5516901 - DNA, 22 bp, Homo sapiens
tcattttctacgtcatgtattt

SEQ ID NO: 5516902 - DNA, 20 bp, Homo sapiens
tcattttctagatacaataa

SEQ ID NO: 5516903 - DNA, 10 bp, Homo sapiens
tcattttctc

SEQ ID NO: 5516904 - DNA, 15 bp, Homo sapiens
tcattttctctaata

SEQ ID NO: 5516905 - DNA, 15 bp, Homo sapiens
tcattttctctcagg

SEQ ID NO: 5516906 - DNA, 16 bp, Homo sapiens
tcattttctctcctcg

SEQ ID NO: 5516907 - DNA, 20 bp, Homo sapiens
tcattttctgatgcccaccg

SEQ ID NO: 5516908 - DNA, 18 bp, Homo sapiens
tcattttctgcaagcctg

SEQ ID NO: 5516909 - DNA, 13 bp, Homo sapiens
tcattttctggtt

SEQ ID NO: 5516910 - DNA, 12 bp, Homo sapiens
tcattttcttga

SEQ ID NO: 5516911 - DNA, 21 bp, Homo sapiens
tcattttctttaggacataaa

SEQ ID NO: 5516912 - DNA, 17 bp, Homo sapiens
tcattttctttcctttc

SEQ ID NO: 5516913 - DNA, 16 bp, Homo sapiens
tcattttcttttttaa

SEQ ID NO: 5516914 - DNA, 12 bp, Homo sapiens
tcattttgaaaa

SEQ ID NO: 5516915 - DNA, 14 bp, Homo sapiens
tcattttgaaattg

SEQ ID NO: 5516916 - DNA, 16 bp, Homo sapiens
tcattttgaaattgtt

SEQ ID NO: 5516917 - DNA, 20 bp, Homo sapiens
tcattttgaattatgtgcac

SEQ ID NO: 5516918 - DNA, 19 bp, Homo sapiens
tcattttgacaaagtgcct

SEQ ID NO: 5516919 - DNA, 18 bp, Homo sapiens
tcattttgaccatataga

SEQ ID NO: 5516920 - DNA, 17 bp, Homo sapiens
tcattttgactggcttg

SEQ ID NO: 5516921 - DNA, 16 bp, Homo sapiens
tcattttgagaacatt

SEQ ID NO: 5516922 - DNA, 18 bp, Homo sapiens
tcattttgagtattttta

SEQ ID NO: 5516923 - DNA, 22 bp, Homo sapiens
tcattttgcaccttattcagaa

SEQ ID NO: 5516924 - DNA, 15 bp, Homo sapiens
tcattttgcttccca

SEQ ID NO: 5516925 - DNA, 13 bp, Homo sapiens
tcattttggagct

SEQ ID NO: 5516926 - DNA, 20 bp, Homo sapiens
tcattttggcatctgcaaag

SEQ ID NO: 5516927 - DNA, 17 bp, Homo sapiens
tcattttggtctgtttt

SEQ ID NO: 5516928 - DNA, 11 bp, Homo sapiens
tcattttgtaa

SEQ ID NO: 5516929 - DNA, 20 bp, Homo sapiens
tcattttgtaacaaatgaac

SEQ ID NO: 5516930 - DNA, 18 bp, Homo sapiens
tcattttgtatgtatgtg

SEQ ID NO: 5516931 - DNA, 22 bp, Homo sapiens
tcattttgtatgtatgtgtagt

SEQ ID NO: 5516932 - DNA, 19 bp, Homo sapiens
tcattttgtgttgaagagc

SEQ ID NO: 5516933 - DNA, 16 bp, Homo sapiens
tcattttgttctgaaa

SEQ ID NO: 5516934 - DNA, 21 bp, Homo sapiens
tcattttgttgcttttgtgaa

SEQ ID NO: 5516935 - DNA, 19 bp, Homo sapiens
tcattttgttttgctctga

SEQ ID NO: 5516936 - DNA, 16 bp, Homo sapiens
tcattttgtttttgtt

SEQ ID NO: 5516937 - DNA, 18 bp, Homo sapiens
tcatttttaaagcctggc

SEQ ID NO: 5516938 - DNA, 20 bp, Homo sapiens
tcatttttaaagcctggctt

SEQ ID NO: 5516939 - DNA, 21 bp, Homo sapiens
tcatttttaaagcctggcttc

SEQ ID NO: 5516940 - DNA, 22 bp, Homo sapiens
tcatttttaaagcctggcttct

SEQ ID NO: 5516941 - DNA, 14 bp, Homo sapiens
tcatttttaaatgt

SEQ ID NO: 5516942 - DNA, 15 bp, Homo sapiens
tcatttttaacagca

SEQ ID NO: 5516943 - DNA, 19 bp, Homo sapiens
tcatttttaactactgtat

SEQ ID NO: 5516944 - DNA, 13 bp, Homo sapiens
tcatttttaagaa

SEQ ID NO: 5516945 - DNA, 20 bp, Homo sapiens
tcatttttaagaaaggaagc

SEQ ID NO: 5516946 - DNA, 11 bp, Homo sapiens
tcatttttaat

SEQ ID NO: 5516947 - DNA, 16 bp, Homo sapiens
tcatttttaatcatga

SEQ ID NO: 5516948 - DNA, 19 bp, Homo sapiens
tcatttttaatcatgaaat

SEQ ID NO: 5516949 - DNA, 17 bp, Homo sapiens
tcatttttaatgtatct

SEQ ID NO: 5516950 - DNA, 12 bp, Homo sapiens
tcatttttacaa

SEQ ID NO: 5516951 - DNA, 14 bp, Homo sapiens
tcatttttataacc

SEQ ID NO: 5516952 - DNA, 21 bp, Homo sapiens
tcatttttataacctggcaaa

SEQ ID NO: 5516953 - DNA, 23 bp, Homo sapiens
tcatttttataacctggcaaaat

SEQ ID NO: 5516954 - DNA, 22 bp, Homo sapiens
tcatttttatcccttcctgtct

SEQ ID NO: 5516955 - DNA, 17 bp, Homo sapiens
tcatttttccaggactc

SEQ ID NO: 5516956 - DNA, 18 bp, Homo sapiens
tcatttttccatgacatt

SEQ ID NO: 5516957 - DNA, 13 bp, Homo sapiens
tcatttttccttt

SEQ ID NO: 5516958 - DNA, 17 bp, Homo sapiens
tcatttttgccatacat

SEQ ID NO: 5516959 - DNA, 13 bp, Homo sapiens
tcatttttgtaat

SEQ ID NO: 5516960 - DNA, 17 bp, Homo sapiens
tcatttttgtaataaca

SEQ ID NO: 5516961 - DNA, 19 bp, Homo sapiens
tcatttttgtaataacatt

SEQ ID NO: 5516962 - DNA, 21 bp, Homo sapiens
tcatttttgtaataacattta

SEQ ID NO: 5516963 - DNA, 16 bp, Homo sapiens
tcatttttgtacagtt

SEQ ID NO: 5516964 - DNA, 23 bp, Homo sapiens
tcatttttgtacagtttgctgta

SEQ ID NO: 5516965 - DNA, 21 bp, Homo sapiens
tcatttttgtaggaagcattt

SEQ ID NO: 5516966 - DNA, 16 bp, Homo sapiens
tcattttttaaaaaag

SEQ ID NO: 5516967 - DNA, 22 bp, Homo sapiens
tcattttttatatatatgcata

SEQ ID NO: 5516968 - DNA, 23 bp, Homo sapiens
tcattttttatggctgcatagta

SEQ ID NO: 5516969 - DNA, 12 bp, Homo sapiens
tcattttttccc

SEQ ID NO: 5516970 - DNA, 12 bp, Homo sapiens
tcattttttcct

SEQ ID NO: 5516971 - DNA, 13 bp, Homo sapiens
tcattttttctta

SEQ ID NO: 5516972 - DNA, 16 bp, Homo sapiens
tcatttttttaacaca

SEQ ID NO: 5516973 - DNA, 20 bp, Homo sapiens
tcatttttttctctctggag

SEQ ID NO: 5516974 - DNA, 13 bp, Homo sapiens
tcattttttttaa

SEQ ID NO: 5516975 - DNA, 16 bp, Homo sapiens
tcattttttttgcttc

SEQ ID NO: 5516976 - DNA, 18 bp, Homo sapiens
tcattttttttttatcag

SEQ ID NO: 5516977 - DNA, 23 bp, Homo sapiens
tccaaaaaaaggaaaaataatca

SEQ ID NO: 5516978 - DNA, 13 bp, Homo sapiens
tccaaaaaaatac

SEQ ID NO: 5516979 - DNA, 15 bp, Homo sapiens
tccaaaaaaatactg

SEQ ID NO: 5516980 - DNA, 19 bp, Homo sapiens
tccaaaaaagaaacattgt

SEQ ID NO: 5516981 - DNA, 19 bp, Homo sapiens
tccaaaaaagcaaacacaa

SEQ ID NO: 5516982 - DNA, 14 bp, Homo sapiens
tccaaaaaattaaa

SEQ ID NO: 5516983 - DNA, 13 bp, Homo sapiens
tccaaaaacaaag

SEQ ID NO: 5516984 - DNA, 22 bp, Homo sapiens
tccaaaaagaacaataatgaga

SEQ ID NO: 5516985 - DNA, 19 bp, Homo sapiens
tccaaaaagattttcagaa

SEQ ID NO: 5516986 - DNA, 13 bp, Homo sapiens
tccaaaaattatt

SEQ ID NO: 5516987 - DNA, 14 bp, Homo sapiens
tccaaaaattatta

SEQ ID NO: 5516988 - DNA, 14 bp, Homo sapiens
tccaaaacatttct

SEQ ID NO: 5516989 - DNA, 19 bp, Homo sapiens
tccaaaaccgccagctctg

SEQ ID NO: 5516990 - DNA, 17 bp, Homo sapiens
tccaaaacctgcttcct

SEQ ID NO: 5516991 - DNA, 19 bp, Homo sapiens
tccaaaacctgcttccttc

SEQ ID NO: 5516992 - DNA, 15 bp, Homo sapiens
tccaaaactcctgcc

SEQ ID NO: 5516993 - DNA, 13 bp, Homo sapiens
tccaaaactgcct

SEQ ID NO: 5516994 - DNA, 21 bp, Homo sapiens
tccaaaacttagacccatgct

SEQ ID NO: 5516995 - DNA, 13 bp, Homo sapiens
tccaaaagaaaaa

SEQ ID NO: 5516996 - DNA, 18 bp, Homo sapiens
tccaaaagaagcccccag

SEQ ID NO: 5516997 - DNA, 21 bp, Homo sapiens
tccaaaagaagcccccagcta

SEQ ID NO: 5516998 - DNA, 17 bp, Homo sapiens
tccaaaagcgccctcac

SEQ ID NO: 5516999 - DNA, 20 bp, Homo sapiens
tccaaaataaaaaccttcca

SEQ ID NO: 5517000 - DNA, 21 bp, Homo sapiens
tccaaaataaaacctcagcta

SEQ ID NO: 5517001 - DNA, 17 bp, Homo sapiens
tccaaaataaaactttt

SEQ ID NO: 5517002 - DNA, 21 bp, Homo sapiens
tccaaaataatctatattaaa

SEQ ID NO: 5517003 - DNA, 19 bp, Homo sapiens
tccaaaataattttaagaa

SEQ ID NO: 5517004 - DNA, 21 bp, Homo sapiens
tccaaaatagtcatgtttctg

SEQ ID NO: 5517005 - DNA, 20 bp, Homo sapiens
tccaagttcctgcactccag

SEQ ID NO: 5517006 - DNA, 19 bp, Homo sapiens
tccaagttcttcacctcta

SEQ ID NO: 5517007 - DNA, 21 bp, Homo sapiens
tccaagttcttcacctctatc

SEQ ID NO: 5517008 - DNA, 22 bp, Homo sapiens
tccaagttgttcgggccaagga

SEQ ID NO: 5517009 - DNA, 21 bp, Homo sapiens
tccaagtttactcaaccctct

SEQ ID NO: 5517010 - DNA, 15 bp, Homo sapiens
tccaagtttccaaac

SEQ ID NO: 5517011 - DNA, 19 bp, Homo sapiens
tccaagtttgacttgtata

SEQ ID NO: 5517012 - DNA, 20 bp, Homo sapiens
tccaataaaaatcaggagcc

SEQ ID NO: 5517013 - DNA, 24 bp, Homo sapiens
tccaataaaaatcaggagcctgct

SEQ ID NO: 5517014 - DNA, 17 bp, Homo sapiens
tccaataaaatgcctca

SEQ ID NO: 5517015 - DNA, 12 bp, Homo sapiens
tccaataaacag

SEQ ID NO: 5517016 - DNA, 17 bp, Homo sapiens
tccaataaagcagcctc

SEQ ID NO: 5517017 - DNA, 21 bp, Homo sapiens
tccaataaagtgccttctggg

SEQ ID NO: 5517018 - DNA, 15 bp, Homo sapiens
tccaataatcagaaa

SEQ ID NO: 5517019 - DNA, 15 bp, Homo sapiens
tccaataattgactg

SEQ ID NO: 5517020 - DNA, 14 bp, Homo sapiens
tccaataccctaga

SEQ ID NO: 5517021 - DNA, 11 bp, Homo sapiens
tccaatacctc

SEQ ID NO: 5517022 - DNA, 11 bp, Homo sapiens
tccaatactgc

SEQ ID NO: 5517023 - DNA, 17 bp, Homo sapiens
tccaatagaaagaaact

SEQ ID NO: 5517024 - DNA, 16 bp, Homo sapiens
tccaataggaatgcta

SEQ ID NO: 5517025 - DNA, 17 bp, Homo sapiens
tccaatagtctgccaca

SEQ ID NO: 5517026 - DNA, 12 bp, Homo sapiens
tccaatataaat

SEQ ID NO: 5517027 - DNA, 19 bp, Homo sapiens
tccaatatttataattaaa

SEQ ID NO: 5517028 - DNA, 16 bp, Homo sapiens
tccaatatttctgctt

SEQ ID NO: 5517029 - DNA, 23 bp, Homo sapiens
tccaatatttctgctttctttga

SEQ ID NO: 5517030 - DNA, 12 bp, Homo sapiens
tccaatatttgg

SEQ ID NO: 5517031 - DNA, 11 bp, Homo sapiens
tccaatatttt

SEQ ID NO: 5517032 - DNA, 18 bp, Homo sapiens
tccaatcacccccaggac

SEQ ID NO: 5517033 - DNA, 22 bp, Homo sapiens
tccaatcagagaataaacatca

SEQ ID NO: 5517034 - DNA, 23 bp, Homo sapiens
tccaatcagagaccaggccctgg

SEQ ID NO: 5517035 - DNA, 14 bp, Homo sapiens
tccaatcatacaaa

SEQ ID NO: 5517036 - DNA, 14 bp, Homo sapiens
tccaatccagcctt

SEQ ID NO: 5517037 - DNA, 15 bp, Homo sapiens
tccaatccagccttc

SEQ ID NO: 5517038 - DNA, 16 bp, Homo sapiens
tccaatccagccttct

SEQ ID NO: 5517039 - DNA, 19 bp, Homo sapiens
tccaatccccactcctccg

SEQ ID NO: 5517040 - DNA, 19 bp, Homo sapiens
tccaatccgttcccttctg

SEQ ID NO: 5517041 - DNA, 15 bp, Homo sapiens
tccaatcctcactgg

SEQ ID NO: 5517042 - DNA, 13 bp, Homo sapiens
tccaatcctcagg

SEQ ID NO: 5517043 - DNA, 13 bp, Homo sapiens
tccaatcctgccc

SEQ ID NO: 5517044 - DNA, 14 bp, Homo sapiens
tccaatcctgcccc

SEQ ID NO: 5517045 - DNA, 16 bp, Homo sapiens
tccaatcctgccccct

SEQ ID NO: 5517046 - DNA, 18 bp, Homo sapiens
tccaatcctgccccctga

SEQ ID NO: 5517047 - DNA, 17 bp, Homo sapiens
tccaatctcaaggaatc

SEQ ID NO: 5517048 - DNA, 19 bp, Homo sapiens
tccaatctcaaggaatctt

SEQ ID NO: 5517049 - DNA, 16 bp, Homo sapiens
tccaatctcagtcact

SEQ ID NO: 5517050 - DNA, 14 bp, Homo sapiens
tccaatctcatctc

SEQ ID NO: 5517051 - DNA, 22 bp, Homo sapiens
tccaatctgctcagcaggccct

SEQ ID NO: 5517052 - DNA, 18 bp, Homo sapiens
tccaatctgtaatttcac

SEQ ID NO: 5517053 - DNA, 14 bp, Homo sapiens
tccaatcttgtttc

SEQ ID NO: 5517054 - DNA, 21 bp, Homo sapiens
tccaatgaagataaatgcttt

SEQ ID NO: 5517055 - DNA, 14 bp, Homo sapiens
tccaatgaaggaaa

SEQ ID NO: 5517056 - DNA, 16 bp, Homo sapiens
tccaatgagctttctg

SEQ ID NO: 5517057 - DNA, 20 bp, Homo sapiens
tccaatgagctttctgaaca

SEQ ID NO: 5517058 - DNA, 21 bp, Homo sapiens
tccaatgatacccaacagttt

SEQ ID NO: 5517059 - DNA, 22 bp, Homo sapiens
tccaatgatacccaacagttta

SEQ ID NO: 5517060 - DNA, 23 bp, Homo sapiens
tccaatgatataggaaaatacat

SEQ ID NO: 5517061 - DNA, 17 bp, Homo sapiens
tccaatgatgcttacta

SEQ ID NO: 5517062 - DNA, 17 bp, Homo sapiens
tccaatgccaattcatc

SEQ ID NO: 5517063 - DNA, 22 bp, Homo sapiens
tccaatgccacatacttgcagc

SEQ ID NO: 5517064 - DNA, 15 bp, Homo sapiens
tccaatgcttcttat

SEQ ID NO: 5517065 - DNA, 18 bp, Homo sapiens
tccaatggggccagcact

SEQ ID NO: 5517066 - DNA, 19 bp, Homo sapiens
tccaatggggccagcactg

SEQ ID NO: 5517067 - DNA, 21 bp, Homo sapiens
tccaatggtaggaatttcaag

SEQ ID NO: 5517068 - DNA, 19 bp, Homo sapiens
tccaatgtcctgaaacatg

SEQ ID NO: 5517069 - DNA, 14 bp, Homo sapiens
tccaatgtcttttg

SEQ ID NO: 5517070 - DNA, 22 bp, Homo sapiens
tccaatgtgaaagattatttaa

SEQ ID NO: 5517071 - DNA, 23 bp, Homo sapiens
tccaatgtgaagttcatcttgca

SEQ ID NO: 5517072 - DNA, 15 bp, Homo sapiens
tccaatgtgcccagt

SEQ ID NO: 5517073 - DNA, 18 bp, Homo sapiens
tccaatgtgcccagtcat

SEQ ID NO: 5517074 - DNA, 19 bp, Homo sapiens
tccaatgtgcccagtcatg

SEQ ID NO: 5517075 - DNA, 18 bp, Homo sapiens
tccaatgtggcaaggaaa

SEQ ID NO: 5517076 - DNA, 23 bp, Homo sapiens
tccaatgtggtggcaataaatgt

SEQ ID NO: 5517077 - DNA, 18 bp, Homo sapiens
tccaatgtggttggtcaa

SEQ ID NO: 5517078 - DNA, 16 bp, Homo sapiens
tccaatgttgtgtgca

SEQ ID NO: 5517079 - DNA, 17 bp, Homo sapiens
tccaatgtttagcaaat

SEQ ID NO: 5517080 - DNA, 15 bp, Homo sapiens
tccaatgtttcaagc

SEQ ID NO: 5517081 - DNA, 14 bp, Homo sapiens
tccaatgttttatt

SEQ ID NO: 5517082 - DNA, 16 bp, Homo sapiens
tccaattaaggatttt

SEQ ID NO: 5517083 - DNA, 15 bp, Homo sapiens
tccaattagtttcct

SEQ ID NO: 5517084 - DNA, 16 bp, Homo sapiens
tccaattagtttcctt

SEQ ID NO: 5517085 - DNA, 19 bp, Homo sapiens
tccaattagtttccttttt

SEQ ID NO: 5517086 - DNA, 15 bp, Homo sapiens
tccaattatgtgaca

SEQ ID NO: 5517087 - DNA, 22 bp, Homo sapiens
tccaattcattatgtcaattca

SEQ ID NO: 5517088 - DNA, 15 bp, Homo sapiens
tccaattccaaaatt

SEQ ID NO: 5517089 - DNA, 21 bp, Homo sapiens
tccaattccacagtctctggg

SEQ ID NO: 5517090 - DNA, 14 bp, Homo sapiens
tccaattccactgt

SEQ ID NO: 5517091 - DNA, 15 bp, Homo sapiens
tccaattctgaaata

SEQ ID NO: 5517092 - DNA, 23 bp, Homo sapiens
tccaattggtgcttcagccctgg

SEQ ID NO: 5517093 - DNA, 13 bp, Homo sapiens
tccaattgtaaaa

SEQ ID NO: 5517094 - DNA, 15 bp, Homo sapiens
tccaattgtaaaaaa

SEQ ID NO: 5517095 - DNA, 16 bp, Homo sapiens
tccaatttcaaaatgt

SEQ ID NO: 5517096 - DNA, 18 bp, Homo sapiens
tccaatttcaaaatgtct

SEQ ID NO: 5517097 - DNA, 21 bp, Homo sapiens
tccaattttaaaatgaaatgc

SEQ ID NO: 5517098 - DNA, 19 bp, Homo sapiens
tccaattttcctaagtttc

SEQ ID NO: 5517099 - DNA, 15 bp, Homo sapiens
tccaatttttactca

SEQ ID NO: 5517100 - DNA, 23 bp, Homo sapiens
tccacaaaattatgctgcatttg

SEQ ID NO: 5517101 - DNA, 17 bp, Homo sapiens
tccacaaacacattata

SEQ ID NO: 5517102 - DNA, 14 bp, Homo sapiens
tccacaaagaaaat

SEQ ID NO: 5517103 - DNA, 15 bp, Homo sapiens
tccacaaagagacca

SEQ ID NO: 5517104 - DNA, 19 bp, Homo sapiens
tccacaaagagaccagggg

SEQ ID NO: 5517105 - DNA, 13 bp, Homo sapiens
tccacaaagcagt

SEQ ID NO: 5517106 - DNA, 23 bp, Homo sapiens
tccacaaagccgtgcctttctct

SEQ ID NO: 5517107 - DNA, 15 bp, Homo sapiens
tccacaaatgctatt

SEQ ID NO: 5517108 - DNA, 16 bp, Homo sapiens
tccacaaatgctattc

SEQ ID NO: 5517109 - DNA, 14 bp, Homo sapiens
tccacaaatgtcct

SEQ ID NO: 5517110 - DNA, 20 bp, Homo sapiens
tccacaaatgtcctcagagg

SEQ ID NO: 5517111 - DNA, 20 bp, Homo sapiens
tccacaaattattaatgaaa

SEQ ID NO: 5517112 - DNA, 21 bp, Homo sapiens
tccacaaattattaatgaaaa

SEQ ID NO: 5517113 - DNA, 14 bp, Homo sapiens
tccacaacacacag

SEQ ID NO: 5517114 - DNA, 15 bp, Homo sapiens
tccacaacactgtgt

SEQ ID NO: 5517115 - DNA, 21 bp, Homo sapiens
tccacaagacagaagctgaag

SEQ ID NO: 5517116 - DNA, 19 bp, Homo sapiens
tccacaagagcccaggcct

SEQ ID NO: 5517117 - DNA, 20 bp, Homo sapiens
tccacaagagcccaggcctc

SEQ ID NO: 5517118 - DNA, 21 bp, Homo sapiens
tccacaagagcccaggcctcc

SEQ ID NO: 5517119 - DNA, 17 bp, Homo sapiens
tccacaaggaataaatg

SEQ ID NO: 5517120 - DNA, 13 bp, Homo sapiens
tccacaaggaatc

SEQ ID NO: 5517121 - DNA, 19 bp, Homo sapiens
tccacaaggtccccccacc

SEQ ID NO: 5517122 - DNA, 24 bp, Homo sapiens
tccacaaggtccccccaccgctca

SEQ ID NO: 5517123 - DNA, 20 bp, Homo sapiens
tccacaagtgtgtggccccg

SEQ ID NO: 5517124 - DNA, 17 bp, Homo sapiens
tccacaagttaaataaa

SEQ ID NO: 5517125 - DNA, 18 bp, Homo sapiens
tccacaagttaaataaat

SEQ ID NO: 5517126 - DNA, 19 bp, Homo sapiens
tccacaattattggcaaag

SEQ ID NO: 5517127 - DNA, 16 bp, Homo sapiens
tccacaattcttctgt

SEQ ID NO: 5517128 - DNA, 20 bp, Homo sapiens
tccacaattcttctgtcaag

SEQ ID NO: 5517129 - DNA, 17 bp, Homo sapiens
tccacaattttgtctct

SEQ ID NO: 5517130 - DNA, 18 bp, Homo sapiens
tccacacaaagattttct

SEQ ID NO: 5517131 - DNA, 18 bp, Homo sapiens
tccacacaacaccaggac

SEQ ID NO: 5517132 - DNA, 21 bp, Homo sapiens
tccacacaacaccaggactta

SEQ ID NO: 5517133 - DNA, 23 bp, Homo sapiens
tccacacaacatatccgtatata

SEQ ID NO: 5517134 - DNA, 13 bp, Homo sapiens
tccacacaagaca

SEQ ID NO: 5517135 - DNA, 18 bp, Homo sapiens
tccacacaagacagcaga

SEQ ID NO: 5517136 - DNA, 23 bp, Homo sapiens
tccacacaagggaaggacagaaa

SEQ ID NO: 5517137 - DNA, 22 bp, Homo sapiens
tccacacaattatttatttcat

SEQ ID NO: 5517138 - DNA, 13 bp, Homo sapiens
tccacacacacaa

SEQ ID NO: 5517139 - DNA, 12 bp, Homo sapiens
tccacacacaga

SEQ ID NO: 5517140 - DNA, 15 bp, Homo sapiens
tccacacacagagga

SEQ ID NO: 5517141 - DNA, 22 bp, Homo sapiens
tccacacacagaggaagagcag

SEQ ID NO: 5517142 - DNA, 15 bp, Homo sapiens
tccacacacagcagc

SEQ ID NO: 5517143 - DNA, 19 bp, Homo sapiens
tccacacacagcagctcca

SEQ ID NO: 5517144 - DNA, 23 bp, Homo sapiens
tccacacacagcagctccaacct

SEQ ID NO: 5517145 - DNA, 21 bp, Homo sapiens
tccacacacagctgggctgtg

SEQ ID NO: 5517146 - DNA, 17 bp, Homo sapiens
tccacacacataatggc

SEQ ID NO: 5517147 - DNA, 19 bp, Homo sapiens
tccacacacgcaggaactc

SEQ ID NO: 5517148 - DNA, 23 bp, Homo sapiens
tccacacagaactggcaggagcc

SEQ ID NO: 5517149 - DNA, 17 bp, Homo sapiens
tccacacagcagtgtcc

SEQ ID NO: 5517150 - DNA, 13 bp, Homo sapiens
tccacacagcctg

SEQ ID NO: 5517151 - DNA, 13 bp, Homo sapiens
tccacacaggccc

SEQ ID NO: 5517152 - DNA, 22 bp, Homo sapiens
tccacacaggcccatgccctcc

SEQ ID NO: 5517153 - DNA, 22 bp, Homo sapiens
tccacacaggggtggagtttct

SEQ ID NO: 5517154 - DNA, 23 bp, Homo sapiens
tccacacaggtgttccgtgggac

SEQ ID NO: 5517155 - DNA, 18 bp, Homo sapiens
tccacacatctttcttga

SEQ ID NO: 5517156 - DNA, 13 bp, Homo sapiens
tccacacatgaat

SEQ ID NO: 5517157 - DNA, 18 bp, Homo sapiens
tccacacattccagccag

SEQ ID NO: 5517158 - DNA, 19 bp, Homo sapiens
tccacacatttaaaacatt

SEQ ID NO: 5517159 - DNA, 19 bp, Homo sapiens
tccacaccagctgctgctg

SEQ ID NO: 5517160 - DNA, 18 bp, Homo sapiens
tccacaccagtggcctcg

SEQ ID NO: 5517161 - DNA, 18 bp, Homo sapiens
tccacacccaattccact

SEQ ID NO: 5517162 - DNA, 15 bp, Homo sapiens
tccacacccaccccc

SEQ ID NO: 5517163 - DNA, 22 bp, Homo sapiens
tccacacccaccccctctggag

SEQ ID NO: 5517164 - DNA, 13 bp, Homo sapiens
tccacacccagcc

SEQ ID NO: 5517165 - DNA, 15 bp, Homo sapiens
tccacacccagcctg

SEQ ID NO: 5517166 - DNA, 17 bp, Homo sapiens
tccacacccagcctgtc

SEQ ID NO: 5517167 - DNA, 19 bp, Homo sapiens
tccacacccagcctgtccc

SEQ ID NO: 5517168 - DNA, 18 bp, Homo sapiens
tccacacccatgactgcc

SEQ ID NO: 5517169 - DNA, 19 bp, Homo sapiens
tccacacccatgactgccc

SEQ ID NO: 5517170 - DNA, 12 bp, Homo sapiens
tccacacccgcg

SEQ ID NO: 5517171 - DNA, 21 bp, Homo sapiens
tccacaccctctcccaggacc

SEQ ID NO: 5517172 - DNA, 15 bp, Homo sapiens
tccacaccctctcct

SEQ ID NO: 5517173 - DNA, 15 bp, Homo sapiens
tccacacctccaccc

SEQ ID NO: 5517174 - DNA, 15 bp, Homo sapiens
tccacacctccaccg

SEQ ID NO: 5517175 - DNA, 15 bp, Homo sapiens
tccacacctgcggcc

SEQ ID NO: 5517176 - DNA, 15 bp, Homo sapiens
tccacaccttttatt

SEQ ID NO: 5517177 - DNA, 14 bp, Homo sapiens
tccacactatgtgt

SEQ ID NO: 5517178 - DNA, 20 bp, Homo sapiens
tccacactatgtgtgttgtt

SEQ ID NO: 5517179 - DNA, 12 bp, Homo sapiens
tccacactcaga

SEQ ID NO: 5517180 - DNA, 16 bp, Homo sapiens
tccacactcagaaaat

SEQ ID NO: 5517181 - DNA, 22 bp, Homo sapiens
tccacactcagaaaattccctg

SEQ ID NO: 5517182 - DNA, 13 bp, Homo sapiens
tccacactgcaca

SEQ ID NO: 5517183 - DNA, 15 bp, Homo sapiens
tccacactgcacaat

SEQ ID NO: 5517184 - DNA, 18 bp, Homo sapiens
tccacactgcagggagga

SEQ ID NO: 5517185 - DNA, 12 bp, Homo sapiens
tccacacttctg

SEQ ID NO: 5517186 - DNA, 18 bp, Homo sapiens
tccacacttgctcttctg

SEQ ID NO: 5517187 - DNA, 18 bp, Homo sapiens
tccacagaacctttgtca

SEQ ID NO: 5517188 - DNA, 19 bp, Homo sapiens
tccacagaacctttgtcaa

SEQ ID NO: 5517189 - DNA, 22 bp, Homo sapiens
tccacagagactgtttgaatgt

SEQ ID NO: 5517190 - DNA, 17 bp, Homo sapiens
tccacagagatgtttat

SEQ ID NO: 5517191 - DNA, 18 bp, Homo sapiens
tccacagagtaagacatt

SEQ ID NO: 5517192 - DNA, 18 bp, Homo sapiens
tccacagagttactgcca

SEQ ID NO: 5517193 - DNA, 21 bp, Homo sapiens
tccacagatatctttttcatt

SEQ ID NO: 5517194 - DNA, 17 bp, Homo sapiens
tccacagatgcctccac

SEQ ID NO: 5517195 - DNA, 11 bp, Homo sapiens
tccacagattg

SEQ ID NO: 5517196 - DNA, 13 bp, Homo sapiens
tccacagattttt

SEQ ID NO: 5517197 - DNA, 17 bp, Homo sapiens
tccacagcaaccccagg

SEQ ID NO: 5517198 - DNA, 15 bp, Homo sapiens
tccacagccatccca

SEQ ID NO: 5517199 - DNA, 20 bp, Homo sapiens
tccacagccccaacctccca

SEQ ID NO: 5517200 - DNA, 15 bp, Homo sapiens
tccacagcctgcaag

SEQ ID NO: 5517201 - DNA, 19 bp, Homo sapiens
tccacagctgaagagcaag

SEQ ID NO: 5517202 - DNA, 22 bp, Homo sapiens
tccacagctggcctggtttcct

SEQ ID NO: 5517203 - DNA, 12 bp, Homo sapiens
tccacagcttcc

SEQ ID NO: 5517204 - DNA, 23 bp, Homo sapiens
tccacagcttcccctctctcctc

SEQ ID NO: 5517205 - DNA, 22 bp, Homo sapiens
tccacagcttttacgtagtaaa

SEQ ID NO: 5517206 - DNA, 21 bp, Homo sapiens
tccacaggacacgaaggctgc

SEQ ID NO: 5517207 - DNA, 21 bp, Homo sapiens
tccacaggacgaatgcatatt

SEQ ID NO: 5517208 - DNA, 14 bp, Homo sapiens
tccacaggagcctc

SEQ ID NO: 5517209 - DNA, 19 bp, Homo sapiens
tccacaggagcctctgcag

SEQ ID NO: 5517210 - DNA, 23 bp, Homo sapiens
tccacaggatcatcatttaaaaa

SEQ ID NO: 5517211 - DNA, 16 bp, Homo sapiens
tccacaggcttctgag

SEQ ID NO: 5517212 - DNA, 23 bp, Homo sapiens
tccacagggacacagtctggtgc

SEQ ID NO: 5517213 - DNA, 13 bp, Homo sapiens
tccacagggacca

SEQ ID NO: 5517214 - DNA, 20 bp, Homo sapiens
tccacagggaccagggccac

SEQ ID NO: 5517215 - DNA, 19 bp, Homo sapiens
tccacagggagcaaacact

SEQ ID NO: 5517216 - DNA, 20 bp, Homo sapiens
tccacagggagcaaacactt

SEQ ID NO: 5517217 - DNA, 13 bp, Homo sapiens
tccacaggggcag

SEQ ID NO: 5517218 - DNA, 18 bp, Homo sapiens
tccacaggggcaggcctg

SEQ ID NO: 5517219 - DNA, 23 bp, Homo sapiens
tccacaggggcaggcctgggacc

SEQ ID NO: 5517220 - DNA, 14 bp, Homo sapiens
tccacaggggccac

SEQ ID NO: 5517221 - DNA, 24 bp, Homo sapiens
tccacaggggctatcccttctcag

SEQ ID NO: 5517222 - DNA, 19 bp, Homo sapiens
tccacaggggtgtttgtgt

SEQ ID NO: 5517223 - DNA, 16 bp, Homo sapiens
tccacaggtccaagga

SEQ ID NO: 5517224 - DNA, 16 bp, Homo sapiens
tccacaggtctagact

SEQ ID NO: 5517225 - DNA, 15 bp, Homo sapiens
tccacaggtctcaga

SEQ ID NO: 5517226 - DNA, 16 bp, Homo sapiens
tccacagtagcatttc

SEQ ID NO: 5517227 - DNA, 21 bp, Homo sapiens
tccacagtagcatttcttatt

SEQ ID NO: 5517228 - DNA, 12 bp, Homo sapiens
tccacagtattg

SEQ ID NO: 5517229 - DNA, 15 bp, Homo sapiens
tccacagtcccccac

SEQ ID NO: 5517230 - DNA, 22 bp, Homo sapiens
tccacagtcccccacccacctc

SEQ ID NO: 5517231 - DNA, 23 bp, Homo sapiens
tccacagtcccccacccacctcc

SEQ ID NO: 5517232 - DNA, 19 bp, Homo sapiens
tccacagtcctgaagcagc

SEQ ID NO: 5517233 - DNA, 18 bp, Homo sapiens
tccacagtctcccattct

SEQ ID NO: 5517234 - DNA, 14 bp, Homo sapiens
tccacagtctctgg

SEQ ID NO: 5517235 - DNA, 22 bp, Homo sapiens
tccacagtgactgggccctgtc

SEQ ID NO: 5517236 - DNA, 23 bp, Homo sapiens
tccacagtgactgggccctgtcc

SEQ ID NO: 5517237 - DNA, 24 bp, Homo sapiens
tccacagtgactgggccctgtcca

SEQ ID NO: 5517238 - DNA, 13 bp, Homo sapiens
tccacagtgctgc

SEQ ID NO: 5517239 - DNA, 15 bp, Homo sapiens
tccacagtgctgctt

SEQ ID NO: 5517240 - DNA, 16 bp, Homo sapiens
tccacagtggaaccag

SEQ ID NO: 5517241 - DNA, 11 bp, Homo sapiens
tccacagtggc

SEQ ID NO: 5517242 - DNA, 23 bp, Homo sapiens
tccacagtgtgaagacactgtgc

SEQ ID NO: 5517243 - DNA, 13 bp, Homo sapiens
tccacagtgttta

SEQ ID NO: 5517244 - DNA, 15 bp, Homo sapiens
tccacagtgtttata

SEQ ID NO: 5517245 - DNA, 15 bp, Homo sapiens
tccacagttatctta

SEQ ID NO: 5517246 - DNA, 19 bp, Homo sapiens
tccacagttatcttagctg

SEQ ID NO: 5517247 - DNA, 22 bp, Homo sapiens
tccacagttatcttagctggat

SEQ ID NO: 5517248 - DNA, 23 bp, Homo sapiens
tccacagttcagtggcagggctc

SEQ ID NO: 5517249 - DNA, 16 bp, Homo sapiens
tccacagttgccacca

SEQ ID NO: 5517250 - DNA, 19 bp, Homo sapiens
tccacataaaagaagaaac

SEQ ID NO: 5517251 - DNA, 23 bp, Homo sapiens
tccacataaccctgtcacccaca

SEQ ID NO: 5517252 - DNA, 22 bp, Homo sapiens
tccacataaggaaactgggttc

SEQ ID NO: 5517253 - DNA, 14 bp, Homo sapiens
tccacatacactgc

SEQ ID NO: 5517254 - DNA, 16 bp, Homo sapiens
tccacatcatgttact

SEQ ID NO: 5517255 - DNA, 18 bp, Homo sapiens
tccacatcccagcagccc

SEQ ID NO: 5517256 - DNA, 19 bp, Homo sapiens
tccacatcccagcagccca

SEQ ID NO: 5517257 - DNA, 19 bp, Homo sapiens
tccacatccccaccttcca

SEQ ID NO: 5517258 - DNA, 19 bp, Homo sapiens
tccacatccccagagccca

SEQ ID NO: 5517259 - DNA, 22 bp, Homo sapiens
tccacatccccagagcccagct

SEQ ID NO: 5517260 - DNA, 14 bp, Homo sapiens
tccacatcccggga

SEQ ID NO: 5517261 - DNA, 18 bp, Homo sapiens
tccacatccggaggagaa

SEQ ID NO: 5517262 - DNA, 14 bp, Homo sapiens
tccacatcctgtgt

SEQ ID NO: 5517263 - DNA, 17 bp, Homo sapiens
tccacatctaacaaagt

SEQ ID NO: 5517264 - DNA, 19 bp, Homo sapiens
tccacatctacgtttttgg

SEQ ID NO: 5517265 - DNA, 21 bp, Homo sapiens
tccacatctacgtttttggtg

SEQ ID NO: 5517266 - DNA, 16 bp, Homo sapiens
tccacatctgcctcct

SEQ ID NO: 5517267 - DNA, 22 bp, Homo sapiens
tccacatctgcctcctctcctc

SEQ ID NO: 5517268 - DNA, 14 bp, Homo sapiens
tccacatctgcctt

SEQ ID NO: 5517269 - DNA, 23 bp, Homo sapiens
tccacatctgtttcaaactgaat

SEQ ID NO: 5517270 - DNA, 18 bp, Homo sapiens
tccacatctttaagtatt

SEQ ID NO: 5517271 - DNA, 17 bp, Homo sapiens
tccacatgacagaacca

SEQ ID NO: 5517272 - DNA, 20 bp, Homo sapiens
tccacatgacagaaccaatt

SEQ ID NO: 5517273 - DNA, 17 bp, Homo sapiens
tccacatgctgcctggc

SEQ ID NO: 5517274 - DNA, 19 bp, Homo sapiens
tccacatgctgcctggcac

SEQ ID NO: 5517275 - DNA, 13 bp, Homo sapiens
tccacatggcaga

SEQ ID NO: 5517276 - DNA, 12 bp, Homo sapiens
tccacatgtaca

SEQ ID NO: 5517277 - DNA, 20 bp, Homo sapiens
tccacatgtgaactttttct

SEQ ID NO: 5517278 - DNA, 21 bp, Homo sapiens
tccacatgtggggacagggct

SEQ ID NO: 5517279 - DNA, 14 bp, Homo sapiens
tccacatgttactg

SEQ ID NO: 5517280 - DNA, 22 bp, Homo sapiens
tccacattcatgtacaatgatg

SEQ ID NO: 5517281 - DNA, 14 bp, Homo sapiens
tccacattctactt

SEQ ID NO: 5517282 - DNA, 20 bp, Homo sapiens
tccacattctgctgccccca

SEQ ID NO: 5517283 - DNA, 23 bp, Homo sapiens
tccacattctgctgcccccagac

SEQ ID NO: 5517284 - DNA, 23 bp, Homo sapiens
tccacattgcataagtggaccca

SEQ ID NO: 5517285 - DNA, 15 bp, Homo sapiens
tccacattgttttaa

SEQ ID NO: 5517286 - DNA, 16 bp, Homo sapiens
tccacattgttttaaa

SEQ ID NO: 5517287 - DNA, 15 bp, Homo sapiens
tccacatttctaaaa

SEQ ID NO: 5517288 - DNA, 21 bp, Homo sapiens
tccacattttacaggcaagga

SEQ ID NO: 5517289 - DNA, 12 bp, Homo sapiens
tccacattttct

SEQ ID NO: 5517290 - DNA, 17 bp, Homo sapiens
tccacatttttgcacag

SEQ ID NO: 5517291 - DNA, 21 bp, Homo sapiens
tccaccaaatacaattcaaat

SEQ ID NO: 5517292 - DNA, 21 bp, Homo sapiens
tccaccaaccccgcggcccag

SEQ ID NO: 5517293 - DNA, 17 bp, Homo sapiens
tccaccaagacagtgct

SEQ ID NO: 5517294 - DNA, 20 bp, Homo sapiens
tccaccaagtgtctagagtc

SEQ ID NO: 5517295 - DNA, 13 bp, Homo sapiens
tccaccaagttct

SEQ ID NO: 5517296 - DNA, 13 bp, Homo sapiens
tccaccaatctct

SEQ ID NO: 5517297 - DNA, 16 bp, Homo sapiens
tccaccacaagagctc

SEQ ID NO: 5517298 - DNA, 14 bp, Homo sapiens
tccaccaccactgg

SEQ ID NO: 5517299 - DNA, 19 bp, Homo sapiens
tccaccaccccacccacct

SEQ ID NO: 5517300 - DNA, 22 bp, Homo sapiens
tccaccaccgcccgtctgtgtg

SEQ ID NO: 5517301 - DNA, 11 bp, Homo sapiens
tccaccactgt

SEQ ID NO: 5517302 - DNA, 16 bp, Homo sapiens
tccaccactgtgcact

SEQ ID NO: 5517303 - DNA, 22 bp, Homo sapiens
tccaccagagcaggggctgctg

SEQ ID NO: 5517304 - DNA, 12 bp, Homo sapiens
tccaccagcctg

SEQ ID NO: 5517305 - DNA, 14 bp, Homo sapiens
tccaccagcctgca

SEQ ID NO: 5517306 - DNA, 15 bp, Homo sapiens
tccaccagcctgcac

SEQ ID NO: 5517307 - DNA, 15 bp, Homo sapiens
tccaccagcctgctg

SEQ ID NO: 5517308 - DNA, 15 bp, Homo sapiens
tccaccaggaacctc

SEQ ID NO: 5517309 - DNA, 12 bp, Homo sapiens
tccaccagggcc

SEQ ID NO: 5517310 - DNA, 21 bp, Homo sapiens
tccaccagggccagagcagct

SEQ ID NO: 5517311 - DNA, 14 bp, Homo sapiens
tccaccagtcattt

SEQ ID NO: 5517312 - DNA, 14 bp, Homo sapiens
tccaccagtttata

SEQ ID NO: 5517313 - DNA, 18 bp, Homo sapiens
tccaccatcaagccacca

SEQ ID NO: 5517314 - DNA, 23 bp, Homo sapiens
tccaccatcactcactcactccc

SEQ ID NO: 5517315 - DNA, 12 bp, Homo sapiens
tccaccatcccc

SEQ ID NO: 5517316 - DNA, 14 bp, Homo sapiens
tccaccatgcagaa

SEQ ID NO: 5517317 - DNA, 24 bp, Homo sapiens
tccaccatggctaaggcaccagcc

SEQ ID NO: 5517318 - DNA, 17 bp, Homo sapiens
tccaccattcacatttg

SEQ ID NO: 5517319 - DNA, 13 bp, Homo sapiens
tccaccattcctt

SEQ ID NO: 5517320 - DNA, 20 bp, Homo sapiens
tccacccaaaccccttccca

SEQ ID NO: 5517321 - DNA, 10 bp, Homo sapiens
tccacccaca

SEQ ID NO: 5517322 - DNA, 11 bp, Homo sapiens
tccacccacaa

SEQ ID NO: 5517323 - DNA, 21 bp, Homo sapiens
tccacccacaaactccaggct

SEQ ID NO: 5517324 - DNA, 22 bp, Homo sapiens
tccacccacaaactccaggctg

SEQ ID NO: 5517325 - DNA, 16 bp, Homo sapiens
tccacccacacgactg

SEQ ID NO: 5517326 - DNA, 21 bp, Homo sapiens
tccacccaccagtcagggaca

SEQ ID NO: 5517327 - DNA, 12 bp, Homo sapiens
tccacccacccc

SEQ ID NO: 5517328 - DNA, 14 bp, Homo sapiens
tccacccaccccct

SEQ ID NO: 5517329 - DNA, 20 bp, Homo sapiens
tccacccaccccctttggtt

SEQ ID NO: 5517330 - DNA, 12 bp, Homo sapiens
tccacccacctc

SEQ ID NO: 5517331 - DNA, 17 bp, Homo sapiens
tccacccacctcagcct

SEQ ID NO: 5517332 - DNA, 13 bp, Homo sapiens
tccacccacctgg

SEQ ID NO: 5517333 - DNA, 23 bp, Homo sapiens
tccacccacctggcttcatacag

SEQ ID NO: 5517334 - DNA, 17 bp, Homo sapiens
tccacccaccttggcct

SEQ ID NO: 5517335 - DNA, 21 bp, Homo sapiens
tccacccaccttggcctccca

SEQ ID NO: 5517336 - DNA, 19 bp, Homo sapiens
tccacccacttagtccact

SEQ ID NO: 5517337 - DNA, 13 bp, Homo sapiens
tccacccagaccc

SEQ ID NO: 5517338 - DNA, 23 bp, Homo sapiens
tccacccagaccctccttcccca

SEQ ID NO: 5517339 - DNA, 16 bp, Homo sapiens
tccacccagaggtctc

SEQ ID NO: 5517340 - DNA, 21 bp, Homo sapiens
tccacccagcaggcagagtgg

SEQ ID NO: 5517341 - DNA, 13 bp, Homo sapiens
tccacccagccca

SEQ ID NO: 5517342 - DNA, 16 bp, Homo sapiens
tccacccagcccctgg

SEQ ID NO: 5517343 - DNA, 17 bp, Homo sapiens
tccacccagcccctggc

SEQ ID NO: 5517344 - DNA, 13 bp, Homo sapiens
tccacccaggctg

SEQ ID NO: 5517345 - DNA, 17 bp, Homo sapiens
tccacccaggctgcact

SEQ ID NO: 5517346 - DNA, 22 bp, Homo sapiens
tccacccaggctgcactgcagt

SEQ ID NO: 5517347 - DNA, 13 bp, Homo sapiens
tccacccagtgct

SEQ ID NO: 5517348 - DNA, 17 bp, Homo sapiens
tccacccagtgctgcca

SEQ ID NO: 5517349 - DNA, 19 bp, Homo sapiens
tccacccagtgctgccatg

SEQ ID NO: 5517350 - DNA, 23 bp, Homo sapiens
tccacccatgacctttttcactg

SEQ ID NO: 5517351 - DNA, 19 bp, Homo sapiens
tccaccccaagagaactcg

SEQ ID NO: 5517352 - DNA, 22 bp, Homo sapiens
tccaccccaatcctcccagaaa

SEQ ID NO: 5517353 - DNA, 19 bp, Homo sapiens
tccaccccagccccactgc

SEQ ID NO: 5517354 - DNA, 23 bp, Homo sapiens
tccaccccagtgcacccactctg

SEQ ID NO: 5517355 - DNA, 22 bp, Homo sapiens
tccaccccataataaccctgcc

SEQ ID NO: 5517356 - DNA, 14 bp, Homo sapiens
tccacccccaagaa

SEQ ID NO: 5517357 - DNA, 15 bp, Homo sapiens
tccacccccagctcc

SEQ ID NO: 5517358 - DNA, 16 bp, Homo sapiens
tccacccccagctgct

SEQ ID NO: 5517359 - DNA, 23 bp, Homo sapiens
tccagaactgaggtcactgggtt

SEQ ID NO: 5517360 - DNA, 14 bp, Homo sapiens
tccagaactgcaca

SEQ ID NO: 5517361 - DNA, 21 bp, Homo sapiens
tccagaagaaagatggaaatt

SEQ ID NO: 5517362 - DNA, 13 bp, Homo sapiens
tccagaagaaatt

SEQ ID NO: 5517363 - DNA, 22 bp, Homo sapiens
tccagaagaaattatttaatat

SEQ ID NO: 5517364 - DNA, 13 bp, Homo sapiens
tccagaagaacaa

SEQ ID NO: 5517365 - DNA, 15 bp, Homo sapiens
tccagaagaacaact

SEQ ID NO: 5517366 - DNA, 18 bp, Homo sapiens
tccagaagaagagaagct

SEQ ID NO: 5517367 - DNA, 17 bp, Homo sapiens
tccagaagaatattcag

SEQ ID NO: 5517368 - DNA, 14 bp, Homo sapiens
tccagaagacccca

SEQ ID NO: 5517369 - DNA, 17 bp, Homo sapiens
tccagaagaccccactt

SEQ ID NO: 5517370 - DNA, 21 bp, Homo sapiens
tccagaagacgtggtctagac

SEQ ID NO: 5517371 - DNA, 20 bp, Homo sapiens
tccagaagatgccagcttct

SEQ ID NO: 5517372 - DNA, 18 bp, Homo sapiens
tccagaagatgccctcca

SEQ ID NO: 5517373 - DNA, 15 bp, Homo sapiens
tccagaagcagcagc

SEQ ID NO: 5517374 - DNA, 17 bp, Homo sapiens
tccagaagcctccttac

SEQ ID NO: 5517375 - DNA, 22 bp, Homo sapiens
tccagaagcctccttacattaa

SEQ ID NO: 5517376 - DNA, 17 bp, Homo sapiens
tccagaagcctctggct

SEQ ID NO: 5517377 - DNA, 21 bp, Homo sapiens
tccagaagcggcctgtgcgtt

SEQ ID NO: 5517378 - DNA, 14 bp, Homo sapiens
tccagaaggagaca

SEQ ID NO: 5517379 - DNA, 19 bp, Homo sapiens
tccagaaggagacaggcag

SEQ ID NO: 5517380 - DNA, 16 bp, Homo sapiens
tccagaaggccacagg

SEQ ID NO: 5517381 - DNA, 19 bp, Homo sapiens
tccagaaggccacaggcca

SEQ ID NO: 5517382 - DNA, 15 bp, Homo sapiens
tccagaaggggagct

SEQ ID NO: 5517383 - DNA, 18 bp, Homo sapiens
tccagaaggggagctttt

SEQ ID NO: 5517384 - DNA, 16 bp, Homo sapiens
tccagaagtgtattca

SEQ ID NO: 5517385 - DNA, 22 bp, Homo sapiens
tccagaagtgtattcatattac

SEQ ID NO: 5517386 - DNA, 15 bp, Homo sapiens
tccagaagtgtgact

SEQ ID NO: 5517387 - DNA, 15 bp, Homo sapiens
tccagaagtgtgatt

SEQ ID NO: 5517388 - DNA, 15 bp, Homo sapiens
tccagaataagtgct

SEQ ID NO: 5517389 - DNA, 14 bp, Homo sapiens
tccagaatctaaag

SEQ ID NO: 5517390 - DNA, 19 bp, Homo sapiens
tccagaatctaaagccagt

SEQ ID NO: 5517391 - DNA, 18 bp, Homo sapiens
tccagaatctgctgttgc

SEQ ID NO: 5517392 - DNA, 21 bp, Homo sapiens
tccagaatcttgactttctga

SEQ ID NO: 5517393 - DNA, 12 bp, Homo sapiens
tccagaatgaag

SEQ ID NO: 5517394 - DNA, 16 bp, Homo sapiens
tccagaatgctgtaca

SEQ ID NO: 5517395 - DNA, 17 bp, Homo sapiens
tccagaatgctgtacat

SEQ ID NO: 5517396 - DNA, 18 bp, Homo sapiens
tccagaatgctgtacatc

SEQ ID NO: 5517397 - DNA, 14 bp, Homo sapiens
tccagaatgtaaga

SEQ ID NO: 5517398 - DNA, 15 bp, Homo sapiens
tccagaatgtaagaa

SEQ ID NO: 5517399 - DNA, 17 bp, Homo sapiens
tccagaattacccttcc

SEQ ID NO: 5517400 - DNA, 19 bp, Homo sapiens
tccagaattacccttcctc

SEQ ID NO: 5517401 - DNA, 19 bp, Homo sapiens
tccagaattcattccccag

SEQ ID NO: 5517402 - DNA, 21 bp, Homo sapiens
tccagaatttattagtttaaa

SEQ ID NO: 5517403 - DNA, 22 bp, Homo sapiens
tccagaatttattagtttaaaa

SEQ ID NO: 5517404 - DNA, 15 bp, Homo sapiens
tccagaatttcccaa

SEQ ID NO: 5517405 - DNA, 16 bp, Homo sapiens
tccagaatttcccaaa

SEQ ID NO: 5517406 - DNA, 19 bp, Homo sapiens
tccagaatttggaagctag

SEQ ID NO: 5517407 - DNA, 16 bp, Homo sapiens
tccagacaagccctgc

SEQ ID NO: 5517408 - DNA, 22 bp, Homo sapiens
tccagacaagccctgcttgctg

SEQ ID NO: 5517409 - DNA, 13 bp, Homo sapiens
tccagacacatgt

SEQ ID NO: 5517410 - DNA, 14 bp, Homo sapiens
tccagacagacagg

SEQ ID NO: 5517411 - DNA, 19 bp, Homo sapiens
tccagacagacagggggct

SEQ ID NO: 5517412 - DNA, 15 bp, Homo sapiens
tccagacagcctgta

SEQ ID NO: 5517413 - DNA, 12 bp, Homo sapiens
tccagacaggag

SEQ ID NO: 5517414 - DNA, 16 bp, Homo sapiens
tccagacagggtgggg

SEQ ID NO: 5517415 - DNA, 18 bp, Homo sapiens
tccagacagggtggggct

SEQ ID NO: 5517416 - DNA, 21 bp, Homo sapiens
tccagacatcatgaattttac

SEQ ID NO: 5517417 - DNA, 19 bp, Homo sapiens
tccagacattctcgcttcc

SEQ ID NO: 5517418 - DNA, 14 bp, Homo sapiens
tccagacattgtat

SEQ ID NO: 5517419 - DNA, 12 bp, Homo sapiens
tccagaccacct

SEQ ID NO: 5517420 - DNA, 15 bp, Homo sapiens
tccagaccacctgcc

SEQ ID NO: 5517421 - DNA, 19 bp, Homo sapiens
tccagaccacctgccagcc

SEQ ID NO: 5517422 - DNA, 21 bp, Homo sapiens
tccagaccacctgccagccat

SEQ ID NO: 5517423 - DNA, 20 bp, Homo sapiens
tccagaccagcctgggcaac

SEQ ID NO: 5517424 - DNA, 15 bp, Homo sapiens
tccagaccattgtct

SEQ ID NO: 5517425 - DNA, 17 bp, Homo sapiens
tccagaccattgtcttc

SEQ ID NO: 5517426 - DNA, 22 bp, Homo sapiens
tccagaccattgtcttccaacc

SEQ ID NO: 5517427 - DNA, 15 bp, Homo sapiens
tccagacccagaggc

SEQ ID NO: 5517428 - DNA, 14 bp, Homo sapiens
tccagacccccacc

SEQ ID NO: 5517429 - DNA, 22 bp, Homo sapiens
tccagaccccccagcccctcct

SEQ ID NO: 5517430 - DNA, 22 bp, Homo sapiens
tccagacccctaccctttccca

SEQ ID NO: 5517431 - DNA, 13 bp, Homo sapiens
tccagacccctgg

SEQ ID NO: 5517432 - DNA, 14 bp, Homo sapiens
tccagacccggctg

SEQ ID NO: 5517433 - DNA, 22 bp, Homo sapiens
tccagaccctgaagatttcaga

SEQ ID NO: 5517434 - DNA, 13 bp, Homo sapiens
tccagaccctgcc

SEQ ID NO: 5517435 - DNA, 15 bp, Homo sapiens
tccagaccctgcctg

SEQ ID NO: 5517436 - DNA, 15 bp, Homo sapiens
tccagacctgaagaa

SEQ ID NO: 5517437 - DNA, 16 bp, Homo sapiens
tccagacctgaagaat

SEQ ID NO: 5517438 - DNA, 23 bp, Homo sapiens
tccagacctgagcgggagtcagg

SEQ ID NO: 5517439 - DNA, 13 bp, Homo sapiens
tccagacctggct

SEQ ID NO: 5517440 - DNA, 18 bp, Homo sapiens
tccagacctgggccctgg

SEQ ID NO: 5517441 - DNA, 19 bp, Homo sapiens
tccagacctgggccctggt

SEQ ID NO: 5517442 - DNA, 21 bp, Homo sapiens
tccagaccttgttcacactct

SEQ ID NO: 5517443 - DNA, 22 bp, Homo sapiens
tccagactcaaacggaggaagc

SEQ ID NO: 5517444 - DNA, 14 bp, Homo sapiens
tccagactctctgt

SEQ ID NO: 5517445 - DNA, 21 bp, Homo sapiens
tccagactgcggagcagcctc

SEQ ID NO: 5517446 - DNA, 12 bp, Homo sapiens
tccagactgtaa

SEQ ID NO: 5517447 - DNA, 13 bp, Homo sapiens
tccagacttcaaa

SEQ ID NO: 5517448 - DNA, 14 bp, Homo sapiens
tccagacttcaaaa

SEQ ID NO: 5517449 - DNA, 15 bp, Homo sapiens
tccagacttcaaaag

SEQ ID NO: 5517450 - DNA, 17 bp, Homo sapiens
tccagacttcaaaagga

SEQ ID NO: 5517451 - DNA, 18 bp, Homo sapiens
tccagacttcaaaaggaa

SEQ ID NO: 5517452 - DNA, 14 bp, Homo sapiens
tccagacttccttg

SEQ ID NO: 5517453 - DNA, 12 bp, Homo sapiens
tccagactttct

SEQ ID NO: 5517454 - DNA, 18 bp, Homo sapiens
tccagactttctttttct

SEQ ID NO: 5517455 - DNA, 19 bp, Homo sapiens
tccagagaaacccagggag

SEQ ID NO: 5517456 - DNA, 22 bp, Homo sapiens
tccagagaaacccagggaggaa

SEQ ID NO: 5517457 - DNA, 20 bp, Homo sapiens
tccagagaaagcacaattta

SEQ ID NO: 5517458 - DNA, 22 bp, Homo sapiens
tccagagaaagcacaatttaaa

SEQ ID NO: 5517459 - DNA, 15 bp, Homo sapiens
tccagagaacccccc

SEQ ID NO: 5517460 - DNA, 18 bp, Homo sapiens
tccagagaacctgtgggc

SEQ ID NO: 5517461 - DNA, 12 bp, Homo sapiens
tccagagaactg

SEQ ID NO: 5517462 - DNA, 13 bp, Homo sapiens
tccagagaagccc

SEQ ID NO: 5517463 - DNA, 13 bp, Homo sapiens
tccagagacagga

SEQ ID NO: 5517464 - DNA, 17 bp, Homo sapiens
tccagagacaggaaaga

SEQ ID NO: 5517465 - DNA, 20 bp, Homo sapiens
tccagagacatgggcctccc

SEQ ID NO: 5517466 - DNA, 15 bp, Homo sapiens
tccagagaccaaata

SEQ ID NO: 5517467 - DNA, 18 bp, Homo sapiens
tccagagaccaaataatt

SEQ ID NO: 5517468 - DNA, 15 bp, Homo sapiens
tccagagaccacacc

SEQ ID NO: 5517469 - DNA, 18 bp, Homo sapiens
tccagagaccacaccact

SEQ ID NO: 5517470 - DNA, 16 bp, Homo sapiens
tccagagacctgctcc

SEQ ID NO: 5517471 - DNA, 19 bp, Homo sapiens
tccagagacctgctccaga

SEQ ID NO: 5517472 - DNA, 22 bp, Homo sapiens
tccagagacctgctccagatcc

SEQ ID NO: 5517473 - DNA, 23 bp, Homo sapiens
tccagagacctgctccagatcct

SEQ ID NO: 5517474 - DNA, 18 bp, Homo sapiens
tccagagactcgagtccc

SEQ ID NO: 5517475 - DNA, 14 bp, Homo sapiens
tccagagactggga

SEQ ID NO: 5517476 - DNA, 10 bp, Homo sapiens
tccagagaga

SEQ ID NO: 5517477 - DNA, 21 bp, Homo sapiens
tccagagagaagcaccccacc

SEQ ID NO: 5517478 - DNA, 14 bp, Homo sapiens
tccagagagaccga

SEQ ID NO: 5517479 - DNA, 21 bp, Homo sapiens
tccagagagaggatgcagagg

SEQ ID NO: 5517480 - DNA, 15 bp, Homo sapiens
tccagagagcaaaca

SEQ ID NO: 5517481 - DNA, 21 bp, Homo sapiens
tccagagagcaaacataggaa

SEQ ID NO: 5517482 - DNA, 20 bp, Homo sapiens
tccagagagcttaaattgtc

SEQ ID NO: 5517483 - DNA, 20 bp, Homo sapiens
tccagagaggctggatgact

SEQ ID NO: 5517484 - DNA, 15 bp, Homo sapiens
tccagagagtcctct

SEQ ID NO: 5517485 - DNA, 15 bp, Homo sapiens
tccagagagtggaga

SEQ ID NO: 5517486 - DNA, 22 bp, Homo sapiens
tccagagagtggagagagcagg

SEQ ID NO: 5517487 - DNA, 16 bp, Homo sapiens
tccagagagtggctcc

SEQ ID NO: 5517488 - DNA, 22 bp, Homo sapiens
tccagagagtggctcctcccgg

SEQ ID NO: 5517489 - DNA, 17 bp, Homo sapiens
tccagagataaaaatca

SEQ ID NO: 5517490 - DNA, 17 bp, Homo sapiens
tccagagcactgctcca

SEQ ID NO: 5517491 - DNA, 23 bp, Homo sapiens
tccagagcaggaggcagggctct

SEQ ID NO: 5517492 - DNA, 12 bp, Homo sapiens
tccagagcattc

SEQ ID NO: 5517493 - DNA, 20 bp, Homo sapiens
tccagagcattccagtcagg

SEQ ID NO: 5517494 - DNA, 10 bp, Homo sapiens
tccagagcca

SEQ ID NO: 5517495 - DNA, 15 bp, Homo sapiens
tccagagccagcctg

SEQ ID NO: 5517496 - DNA, 22 bp, Homo sapiens
tccagagcccaaggtcagggag

SEQ ID NO: 5517497 - DNA, 22 bp, Homo sapiens
tccagagccggcatccttgcct

SEQ ID NO: 5517498 - DNA, 20 bp, Homo sapiens
tccagagcctaagaaaatca

SEQ ID NO: 5517499 - DNA, 13 bp, Homo sapiens
tccagagctctga

SEQ ID NO: 5517500 - DNA, 14 bp, Homo sapiens
tccagagctgcaga

SEQ ID NO: 5517501 - DNA, 20 bp, Homo sapiens
tccagagctgcttctgtctg

SEQ ID NO: 5517502 - DNA, 13 bp, Homo sapiens
tccagagctgttt

SEQ ID NO: 5517503 - DNA, 10 bp, Homo sapiens
tccagagctt

SEQ ID NO: 5517504 - DNA, 22 bp, Homo sapiens
tccagagcttcagggctgggca

SEQ ID NO: 5517505 - DNA, 13 bp, Homo sapiens
tccagagcttgtg

SEQ ID NO: 5517506 - DNA, 16 bp, Homo sapiens
tccagagcttgtgctc

SEQ ID NO: 5517507 - DNA, 18 bp, Homo sapiens
tccagagcttgtgctcct

SEQ ID NO: 5517508 - DNA, 12 bp, Homo sapiens
tccagaggacct

SEQ ID NO: 5517509 - DNA, 16 bp, Homo sapiens
tccagaggacctgaga

SEQ ID NO: 5517510 - DNA, 15 bp, Homo sapiens
tccagaggactctgc

SEQ ID NO: 5517511 - DNA, 19 bp, Homo sapiens
tccagaggactctgcttaa

SEQ ID NO: 5517512 - DNA, 12 bp, Homo sapiens
tccagaggagag

SEQ ID NO: 5517513 - DNA, 19 bp, Homo sapiens
tccagaggaggtgcccggg

SEQ ID NO: 5517514 - DNA, 23 bp, Homo sapiens
tccagaggaggtgcccgggcagg

SEQ ID NO: 5517515 - DNA, 17 bp, Homo sapiens
tccagagggcactctgc

SEQ ID NO: 5517516 - DNA, 13 bp, Homo sapiens
tccagaggtgagg

SEQ ID NO: 5517517 - DNA, 19 bp, Homo sapiens
tccagaggtggaggtgggc

SEQ ID NO: 5517518 - DNA, 22 bp, Homo sapiens
tccagagtaggtgggtcttgga

SEQ ID NO: 5517519 - DNA, 18 bp, Homo sapiens
tccagagtatgagtgcaa

SEQ ID NO: 5517520 - DNA, 20 bp, Homo sapiens
tccagagtccggaggcagca

SEQ ID NO: 5517521 - DNA, 17 bp, Homo sapiens
tccagagtcctggccct

SEQ ID NO: 5517522 - DNA, 21 bp, Homo sapiens
tccagagtcctggcccttgat

SEQ ID NO: 5517523 - DNA, 15 bp, Homo sapiens
tccagagtctgagcc

SEQ ID NO: 5517524 - DNA, 17 bp, Homo sapiens
tccagagtctgagcccc

SEQ ID NO: 5517525 - DNA, 14 bp, Homo sapiens
tccagagtgattct

SEQ ID NO: 5517526 - DNA, 18 bp, Homo sapiens
tccagagtggagatccca

SEQ ID NO: 5517527 - DNA, 18 bp, Homo sapiens
tccagagtgtgcagactg

SEQ ID NO: 5517528 - DNA, 23 bp, Homo sapiens
tccagataaaaacaatatatgta

SEQ ID NO: 5517529 - DNA, 16 bp, Homo sapiens
tccagataactctctt

SEQ ID NO: 5517530 - DNA, 20 bp, Homo sapiens
tccagataactctctttcct

SEQ ID NO: 5517531 - DNA, 22 bp, Homo sapiens
tccagataactctctttccttg

SEQ ID NO: 5517532 - DNA, 13 bp, Homo sapiens
tccagataagtta

SEQ ID NO: 5517533 - DNA, 14 bp, Homo sapiens
tccagataagttat

SEQ ID NO: 5517534 - DNA, 20 bp, Homo sapiens
tccagataagttatttataa

SEQ ID NO: 5517535 - DNA, 21 bp, Homo sapiens
tccagataagttatttataat

SEQ ID NO: 5517536 - DNA, 21 bp, Homo sapiens
tccagataattggtggatcaa

SEQ ID NO: 5517537 - DNA, 13 bp, Homo sapiens
tccaggagctcca

SEQ ID NO: 5517538 - DNA, 15 bp, Homo sapiens
tccaggagctccagt

SEQ ID NO: 5517539 - DNA, 19 bp, Homo sapiens
tccaggaggagttagccaa

SEQ ID NO: 5517540 - DNA, 15 bp, Homo sapiens
tccaggaggcagtgg

SEQ ID NO: 5517541 - DNA, 17 bp, Homo sapiens
tccaggaggcagtggac

SEQ ID NO: 5517542 - DNA, 18 bp, Homo sapiens
tccaggagggaccaccct

SEQ ID NO: 5517543 - DNA, 19 bp, Homo sapiens
tccaggagggctaattaga

SEQ ID NO: 5517544 - DNA, 22 bp, Homo sapiens
tccaggaggggcctgggcagcc

SEQ ID NO: 5517545 - DNA, 23 bp, Homo sapiens
tccaggataaggagactgaggct

SEQ ID NO: 5517546 - DNA, 15 bp, Homo sapiens
tccaggatcctgcag

SEQ ID NO: 5517547 - DNA, 16 bp, Homo sapiens
tccaggatcctgcagg

SEQ ID NO: 5517548 - DNA, 20 bp, Homo sapiens
tccaggatctttgactgaaa

SEQ ID NO: 5517549 - DNA, 19 bp, Homo sapiens
tccaggatgctaacatcta

SEQ ID NO: 5517550 - DNA, 16 bp, Homo sapiens
tccaggatggggaggg

SEQ ID NO: 5517551 - DNA, 16 bp, Homo sapiens
tccaggattccaaagt

SEQ ID NO: 5517552 - DNA, 20 bp, Homo sapiens
tccaggattgtccacaaatg

SEQ ID NO: 5517553 - DNA, 22 bp, Homo sapiens
tccaggattgtccacaaatgtc

SEQ ID NO: 5517554 - DNA, 17 bp, Homo sapiens
tccaggatttataaagc

SEQ ID NO: 5517555 - DNA, 18 bp, Homo sapiens
tccaggcaaagctggaga

SEQ ID NO: 5517556 - DNA, 21 bp, Homo sapiens
tccaggcaatcgttctgctgg

SEQ ID NO: 5517557 - DNA, 15 bp, Homo sapiens
tccaggcacagctga

SEQ ID NO: 5517558 - DNA, 18 bp, Homo sapiens
tccaggcacaggatgctg

SEQ ID NO: 5517559 - DNA, 17 bp, Homo sapiens
tccaggcaccctcaggg

SEQ ID NO: 5517560 - DNA, 18 bp, Homo sapiens
tccaggcaccctcaggga

SEQ ID NO: 5517561 - DNA, 20 bp, Homo sapiens
tccaggcaccctcagggagc

SEQ ID NO: 5517562 - DNA, 15 bp, Homo sapiens
tccaggcacccttct

SEQ ID NO: 5517563 - DNA, 19 bp, Homo sapiens
tccaggcacccttctttcc

SEQ ID NO: 5517564 - DNA, 18 bp, Homo sapiens
tccaggcaccgcctgccc

SEQ ID NO: 5517565 - DNA, 14 bp, Homo sapiens
tccaggcactgaga

SEQ ID NO: 5517566 - DNA, 19 bp, Homo sapiens
tccaggcagaaggagatgg

SEQ ID NO: 5517567 - DNA, 22 bp, Homo sapiens
tccaggcagagacaataaaaca

SEQ ID NO: 5517568 - DNA, 13 bp, Homo sapiens
tccaggcagatcc

SEQ ID NO: 5517569 - DNA, 14 bp, Homo sapiens
tccaggcagatcca

SEQ ID NO: 5517570 - DNA, 16 bp, Homo sapiens
tccaggcagatccagg

SEQ ID NO: 5517571 - DNA, 17 bp, Homo sapiens
tccaggcagatccagga

SEQ ID NO: 5517572 - DNA, 18 bp, Homo sapiens
tccaggcagcacccaggt

SEQ ID NO: 5517573 - DNA, 17 bp, Homo sapiens
tccaggcagcagacaca

SEQ ID NO: 5517574 - DNA, 18 bp, Homo sapiens
tccaggcagcagacacat

SEQ ID NO: 5517575 - DNA, 18 bp, Homo sapiens
tccaggcagcctctgtca

SEQ ID NO: 5517576 - DNA, 11 bp, Homo sapiens
tccaggcagga

SEQ ID NO: 5517577 - DNA, 22 bp, Homo sapiens
tccaggcaggacgagactcctc

SEQ ID NO: 5517578 - DNA, 18 bp, Homo sapiens
tccaggcaggaggatcac

SEQ ID NO: 5517579 - DNA, 12 bp, Homo sapiens
tccaggcaggcc

SEQ ID NO: 5517580 - DNA, 14 bp, Homo sapiens
tccaggcaggccag

SEQ ID NO: 5517581 - DNA, 19 bp, Homo sapiens
tccaggcagtagatcattt

SEQ ID NO: 5517582 - DNA, 22 bp, Homo sapiens
tccaggcagtagatcatttttt

SEQ ID NO: 5517583 - DNA, 20 bp, Homo sapiens
tccaggcagttctctcgaat

SEQ ID NO: 5517584 - DNA, 20 bp, Homo sapiens
tccaggcatatgtttcccca

SEQ ID NO: 5517585 - DNA, 22 bp, Homo sapiens
tccaggcatatgtttccccatc

SEQ ID NO: 5517586 - DNA, 15 bp, Homo sapiens
tccaggcatgaccct

SEQ ID NO: 5517587 - DNA, 21 bp, Homo sapiens
tccaggcatgaccctggagcc

SEQ ID NO: 5517588 - DNA, 18 bp, Homo sapiens
tccaggcatgctggcctc

SEQ ID NO: 5517589 - DNA, 21 bp, Homo sapiens
tccaggcatgggtcccttccc

SEQ ID NO: 5517590 - DNA, 16 bp, Homo sapiens
tccaggccaaagcccc

SEQ ID NO: 5517591 - DNA, 21 bp, Homo sapiens
tccaggccaaagccccatgtg

SEQ ID NO: 5517592 - DNA, 19 bp, Homo sapiens
tccaggccaccgctctcct

SEQ ID NO: 5517593 - DNA, 14 bp, Homo sapiens
tccaggccactgtg

SEQ ID NO: 5517594 - DNA, 17 bp, Homo sapiens
tccaggccactgtggcc

SEQ ID NO: 5517595 - DNA, 19 bp, Homo sapiens
tccaggccactgtggccag

SEQ ID NO: 5517596 - DNA, 11 bp, Homo sapiens
tccaggccagg

SEQ ID NO: 5517597 - DNA, 13 bp, Homo sapiens
tccaggccagggc

SEQ ID NO: 5517598 - DNA, 14 bp, Homo sapiens
tccaggccagggct

SEQ ID NO: 5517599 - DNA, 22 bp, Homo sapiens
tccaggccagggctcctgtggc

SEQ ID NO: 5517600 - DNA, 14 bp, Homo sapiens
tccaggccagtggg

SEQ ID NO: 5517601 - DNA, 15 bp, Homo sapiens
tccaggcccaaggct

SEQ ID NO: 5517602 - DNA, 17 bp, Homo sapiens
tccaggcccaaggctcc

SEQ ID NO: 5517603 - DNA, 18 bp, Homo sapiens
tccaggcccaaggctccc

SEQ ID NO: 5517604 - DNA, 19 bp, Homo sapiens
tccaggcccaaggctcccg

SEQ ID NO: 5517605 - DNA, 12 bp, Homo sapiens
tccaggcccagc

SEQ ID NO: 5517606 - DNA, 13 bp, Homo sapiens
tccaggcccagcc

SEQ ID NO: 5517607 - DNA, 15 bp, Homo sapiens
tccaggcccagcctg

SEQ ID NO: 5517608 - DNA, 18 bp, Homo sapiens
tccaggcccagcctggcc

SEQ ID NO: 5517609 - DNA, 20 bp, Homo sapiens
tccaggcccagcctggcccc

SEQ ID NO: 5517610 - DNA, 17 bp, Homo sapiens
tccaggccccaggctgg

SEQ ID NO: 5517611 - DNA, 19 bp, Homo sapiens
tccaggccccaggctggat

SEQ ID NO: 5517612 - DNA, 19 bp, Homo sapiens
tccaggcccccaacccctc

SEQ ID NO: 5517613 - DNA, 13 bp, Homo sapiens
tccaggcccccag

SEQ ID NO: 5517614 - DNA, 21 bp, Homo sapiens
tccaggcccccgttgaagccg

SEQ ID NO: 5517615 - DNA, 17 bp, Homo sapiens
tccaggcccctccctct

SEQ ID NO: 5517616 - DNA, 16 bp, Homo sapiens
tccaggcccctgagga

SEQ ID NO: 5517617 - DNA, 17 bp, Homo sapiens
tccaggcccctgaggac

SEQ ID NO: 5517618 - DNA, 21 bp, Homo sapiens
tccaggcccctgaggactgga

SEQ ID NO: 5517619 - DNA, 16 bp, Homo sapiens
tccaggcccgtctgtc

SEQ ID NO: 5517620 - DNA, 19 bp, Homo sapiens
tccaggcccgtctgtccat

SEQ ID NO: 5517621 - DNA, 23 bp, Homo sapiens
tccaggcccgtctgtccatctgc

SEQ ID NO: 5517622 - DNA, 19 bp, Homo sapiens
tccaggccctcagatggca

SEQ ID NO: 5517623 - DNA, 15 bp, Homo sapiens
tccaggccctccagt

SEQ ID NO: 5517624 - DNA, 13 bp, Homo sapiens
tccaggcccttag

SEQ ID NO: 5517625 - DNA, 19 bp, Homo sapiens
tccaggcccttagggaagt

SEQ ID NO: 5517626 - DNA, 19 bp, Homo sapiens
tccaggccgacaggaggcc

SEQ ID NO: 5517627 - DNA, 18 bp, Homo sapiens
tccaggcctactcctgtc

SEQ ID NO: 5517628 - DNA, 13 bp, Homo sapiens
tccaggcctgacc

SEQ ID NO: 5517629 - DNA, 13 bp, Homo sapiens
tccaggcctgagg

SEQ ID NO: 5517630 - DNA, 14 bp, Homo sapiens
tccaggcctgaggc

SEQ ID NO: 5517631 - DNA, 20 bp, Homo sapiens
tccaggcctgaggctgctga

SEQ ID NO: 5517632 - DNA, 19 bp, Homo sapiens
tccaggcctgatcttgcct

SEQ ID NO: 5517633 - DNA, 12 bp, Homo sapiens
tccaggcctgca

SEQ ID NO: 5517634 - DNA, 14 bp, Homo sapiens
tccaggcctgcagc

SEQ ID NO: 5517635 - DNA, 14 bp, Homo sapiens
tccaggcctgcctc

SEQ ID NO: 5517636 - DNA, 18 bp, Homo sapiens
tccaggcctgcctcccac

SEQ ID NO: 5517637 - DNA, 14 bp, Homo sapiens
tccaggcgtagggc

SEQ ID NO: 5517638 - DNA, 16 bp, Homo sapiens
tccaggcgtagggcca

SEQ ID NO: 5517639 - DNA, 21 bp, Homo sapiens
tccaggcgtagggccagggct

SEQ ID NO: 5517640 - DNA, 23 bp, Homo sapiens
tccaggcgtagggccagggctct

SEQ ID NO: 5517641 - DNA, 13 bp, Homo sapiens
tccaggctagtcc

SEQ ID NO: 5517642 - DNA, 19 bp, Homo sapiens
tccaggctagtccggaccc

SEQ ID NO: 5517643 - DNA, 10 bp, Homo sapiens
tccaggctcc

SEQ ID NO: 5517644 - DNA, 12 bp, Homo sapiens
tccaggctccag

SEQ ID NO: 5517645 - DNA, 14 bp, Homo sapiens
tccaggctccaggc

SEQ ID NO: 5517646 - DNA, 17 bp, Homo sapiens
tccaggctccaggctga

SEQ ID NO: 5517647 - DNA, 21 bp, Homo sapiens
tccaggctccctccctcccag

SEQ ID NO: 5517648 - DNA, 22 bp, Homo sapiens
tccaggctccctccctcccaga

SEQ ID NO: 5517649 - DNA, 23 bp, Homo sapiens
tccaggctcctcatgaggccatg

SEQ ID NO: 5517650 - DNA, 22 bp, Homo sapiens
tccaggctcctttagcgcccag

SEQ ID NO: 5517651 - DNA, 18 bp, Homo sapiens
tccaggctctgggcacag

SEQ ID NO: 5517652 - DNA, 14 bp, Homo sapiens
tccaggctcttcct

SEQ ID NO: 5517653 - DNA, 23 bp, Homo sapiens
tccaggctgactgggggcctctg

SEQ ID NO: 5517654 - DNA, 14 bp, Homo sapiens
tccaggctgagcca

SEQ ID NO: 5517655 - DNA, 18 bp, Homo sapiens
tccaggctgagccatgag

SEQ ID NO: 5517656 - DNA, 19 bp, Homo sapiens
tccaggctgcatagaagga

SEQ ID NO: 5517657 - DNA, 14 bp, Homo sapiens
tccaggctgggaga

SEQ ID NO: 5517658 - DNA, 23 bp, Homo sapiens
tccaggctgggagagccttccag

SEQ ID NO: 5517659 - DNA, 12 bp, Homo sapiens
tccaggctgggc

SEQ ID NO: 5517660 - DNA, 15 bp, Homo sapiens
tccaggctgggctga

SEQ ID NO: 5517661 - DNA, 17 bp, Homo sapiens
tccaggctgggctgagc

SEQ ID NO: 5517662 - DNA, 17 bp, Homo sapiens
tccaggctggggcctgg

SEQ ID NO: 5517663 - DNA, 19 bp, Homo sapiens
tccaggctggtcttgaatt

SEQ ID NO: 5517664 - DNA, 22 bp, Homo sapiens
tccaggctggtcttgaattcct

SEQ ID NO: 5517665 - DNA, 13 bp, Homo sapiens
tccaggctggttc

SEQ ID NO: 5517666 - DNA, 12 bp, Homo sapiens
tccaggctgtgt

SEQ ID NO: 5517667 - DNA, 15 bp, Homo sapiens
tccaggctgtgtttg

SEQ ID NO: 5517668 - DNA, 15 bp, Homo sapiens
tccaggctgttctca

SEQ ID NO: 5517669 - DNA, 20 bp, Homo sapiens
tccaggctgttctcagcgtt

SEQ ID NO: 5517670 - DNA, 21 bp, Homo sapiens
tccaggctgttctcagcgttt

SEQ ID NO: 5517671 - DNA, 21 bp, Homo sapiens
tccaggcttccacacttctgg

SEQ ID NO: 5517672 - DNA, 15 bp, Homo sapiens
tccaggcttcctgcc

SEQ ID NO: 5517673 - DNA, 16 bp, Homo sapiens
tccaggcttcctgccc

SEQ ID NO: 5517674 - DNA, 14 bp, Homo sapiens
tccaggcttctccc

SEQ ID NO: 5517675 - DNA, 13 bp, Homo sapiens
tccaggcttgcct

SEQ ID NO: 5517676 - DNA, 15 bp, Homo sapiens
tccaggcttgcctca

SEQ ID NO: 5517677 - DNA, 17 bp, Homo sapiens
tccaggcttggatgtaa

SEQ ID NO: 5517678 - DNA, 23 bp, Homo sapiens
tccaggcttgggctccattccca

SEQ ID NO: 5517679 - DNA, 18 bp, Homo sapiens
tccaggctttcccacttc

SEQ ID NO: 5517680 - DNA, 20 bp, Homo sapiens
tccaggctttgtacagagtg

SEQ ID NO: 5517681 - DNA, 20 bp, Homo sapiens
tccagggaaacagcctctct

SEQ ID NO: 5517682 - DNA, 12 bp, Homo sapiens
tccagggaagct

SEQ ID NO: 5517683 - DNA, 14 bp, Homo sapiens
tccagggaagctgg

SEQ ID NO: 5517684 - DNA, 20 bp, Homo sapiens
tccagggaaggtggccacag

SEQ ID NO: 5517685 - DNA, 21 bp, Homo sapiens
tccagggaaggtggccacagc

SEQ ID NO: 5517686 - DNA, 23 bp, Homo sapiens
tccagggaattcttacagccaag

SEQ ID NO: 5517687 - DNA, 17 bp, Homo sapiens
tccagggacagaagcag

SEQ ID NO: 5517688 - DNA, 18 bp, Homo sapiens
tccagggacagaagcagg

SEQ ID NO: 5517689 - DNA, 19 bp, Homo sapiens
tccagggacagaggcccca

SEQ ID NO: 5517690 - DNA, 21 bp, Homo sapiens
tccagggacagaggccccagc

SEQ ID NO: 5517691 - DNA, 22 bp, Homo sapiens
tccagggaggggccggccctgt

SEQ ID NO: 5517692 - DNA, 15 bp, Homo sapiens
tccagggaggggtcc

SEQ ID NO: 5517693 - DNA, 20 bp, Homo sapiens
tccagggaggggtccctgca

SEQ ID NO: 5517694 - DNA, 20 bp, Homo sapiens
tccagggagggtatttattg

SEQ ID NO: 5517695 - DNA, 18 bp, Homo sapiens
tccagggagtcccctccc

SEQ ID NO: 5517696 - DNA, 17 bp, Homo sapiens
tccagggagtggggagg

SEQ ID NO: 5517697 - DNA, 19 bp, Homo sapiens
tccagggagtggggaggag

SEQ ID NO: 5517698 - DNA, 18 bp, Homo sapiens
tccagggatgattcaagc

SEQ ID NO: 5517699 - DNA, 18 bp, Homo sapiens
tccagggatttgcctcac

SEQ ID NO: 5517700 - DNA, 14 bp, Homo sapiens
tccagggcagcagc

SEQ ID NO: 5517701 - DNA, 15 bp, Homo sapiens
tccagggcagcagcc

SEQ ID NO: 5517702 - DNA, 19 bp, Homo sapiens
tccagggcagcaggccaga

SEQ ID NO: 5517703 - DNA, 22 bp, Homo sapiens
tccagggcagcaggccagagaa

SEQ ID NO: 5517704 - DNA, 23 bp, Homo sapiens
tccagggcagcaggccagagaaa

SEQ ID NO: 5517705 - DNA, 14 bp, Homo sapiens
tccagggcagcctc

SEQ ID NO: 5517706 - DNA, 15 bp, Homo sapiens
tccagggcagcggct

SEQ ID NO: 5517707 - DNA, 21 bp, Homo sapiens
tccagggcatccgcagcccag

SEQ ID NO: 5517708 - DNA, 22 bp, Homo sapiens
tccagggcatccgcagcccagg

SEQ ID NO: 5517709 - DNA, 22 bp, Homo sapiens
tccagggcattgctcagcccgc

SEQ ID NO: 5517710 - DNA, 23 bp, Homo sapiens
tccagggcattgctcagcccgct

SEQ ID NO: 5517711 - DNA, 17 bp, Homo sapiens
tccagggccacgtgcca

SEQ ID NO: 5517712 - DNA, 23 bp, Homo sapiens
tccagggccacgtgccaggcccg

SEQ ID NO: 5517713 - DNA, 14 bp, Homo sapiens
tccagggccagatg

SEQ ID NO: 5517714 - DNA, 16 bp, Homo sapiens
tccagtgaggctctgc

SEQ ID NO: 5517715 - DNA, 19 bp, Homo sapiens
tccagtgaggctctgccct

SEQ ID NO: 5517716 - DNA, 18 bp, Homo sapiens
tccagtgatgttgaaatt

SEQ ID NO: 5517717 - DNA, 20 bp, Homo sapiens
tccagtgccgctcctgcttc

SEQ ID NO: 5517718 - DNA, 12 bp, Homo sapiens
tccagtgctcag

SEQ ID NO: 5517719 - DNA, 15 bp, Homo sapiens
tccagtgctgcatgc

SEQ ID NO: 5517720 - DNA, 19 bp, Homo sapiens
tccagtgctgctcccttta

SEQ ID NO: 5517721 - DNA, 16 bp, Homo sapiens
tccagtgctggatttg

SEQ ID NO: 5517722 - DNA, 18 bp, Homo sapiens
tccagtgctggctgctgg

SEQ ID NO: 5517723 - DNA, 19 bp, Homo sapiens
tccagtgctggctgctggc

SEQ ID NO: 5517724 - DNA, 22 bp, Homo sapiens
tccagtggaagaagaaaacact

SEQ ID NO: 5517725 - DNA, 22 bp, Homo sapiens
tccagtggaagttcttcaagag

SEQ ID NO: 5517726 - DNA, 23 bp, Homo sapiens
tccagtggaagttcttcaagagg

SEQ ID NO: 5517727 - DNA, 12 bp, Homo sapiens
tccagtggaccc

SEQ ID NO: 5517728 - DNA, 20 bp, Homo sapiens
tccagtggaccctggaccat

SEQ ID NO: 5517729 - DNA, 13 bp, Homo sapiens
tccagtggactct

SEQ ID NO: 5517730 - DNA, 22 bp, Homo sapiens
tccagtggaggtttgtcgggca

SEQ ID NO: 5517731 - DNA, 14 bp, Homo sapiens
tccagtggcagaca

SEQ ID NO: 5517732 - DNA, 20 bp, Homo sapiens
tccagtggcctggctccgct

SEQ ID NO: 5517733 - DNA, 23 bp, Homo sapiens
tccagtggcctggctccgctgtg

SEQ ID NO: 5517734 - DNA, 19 bp, Homo sapiens
tccagtggctggtttctga

SEQ ID NO: 5517735 - DNA, 20 bp, Homo sapiens
tccagtggctggtttctgag

SEQ ID NO: 5517736 - DNA, 20 bp, Homo sapiens
tccagtggggaacaggtccc

SEQ ID NO: 5517737 - DNA, 19 bp, Homo sapiens
tccagtggggcaagatttt

SEQ ID NO: 5517738 - DNA, 16 bp, Homo sapiens
tccagtggtaccagct

SEQ ID NO: 5517739 - DNA, 17 bp, Homo sapiens
tccagtggtaccagctc

SEQ ID NO: 5517740 - DNA, 23 bp, Homo sapiens
tccagtggtaccagctcactccc

SEQ ID NO: 5517741 - DNA, 20 bp, Homo sapiens
tccagtggtcatgctcagcc

SEQ ID NO: 5517742 - DNA, 21 bp, Homo sapiens
tccagtggtcattgggcagtg

SEQ ID NO: 5517743 - DNA, 12 bp, Homo sapiens
tccagtggtgaa

SEQ ID NO: 5517744 - DNA, 19 bp, Homo sapiens
tccagtggtgaagaaaact

SEQ ID NO: 5517745 - DNA, 13 bp, Homo sapiens
tccagtggtgggt

SEQ ID NO: 5517746 - DNA, 14 bp, Homo sapiens
tccagtggtgggta

SEQ ID NO: 5517747 - DNA, 16 bp, Homo sapiens
tccagtggtgggtaat

SEQ ID NO: 5517748 - DNA, 19 bp, Homo sapiens
tccagtggtgggtaattgt

SEQ ID NO: 5517749 - DNA, 23 bp, Homo sapiens
tccagtggtgggtaattgtacaa

SEQ ID NO: 5517750 - DNA, 17 bp, Homo sapiens
tccagtgtcacctctct

SEQ ID NO: 5517751 - DNA, 21 bp, Homo sapiens
tccagtgtcacctctctcaga

SEQ ID NO: 5517752 - DNA, 13 bp, Homo sapiens
tccagtgtcattt

SEQ ID NO: 5517753 - DNA, 16 bp, Homo sapiens
tccagtgtcctgagct

SEQ ID NO: 5517754 - DNA, 17 bp, Homo sapiens
tccagtgtccttagaac

SEQ ID NO: 5517755 - DNA, 16 bp, Homo sapiens
tccagtgtctgtctga

SEQ ID NO: 5517756 - DNA, 22 bp, Homo sapiens
tccagtgtgcacccctccccat

SEQ ID NO: 5517757 - DNA, 23 bp, Homo sapiens
tccagtgtgcacccctccccatt

SEQ ID NO: 5517758 - DNA, 19 bp, Homo sapiens
tccagtgtggctcccacag

SEQ ID NO: 5517759 - DNA, 16 bp, Homo sapiens
tccagtgttggctgtg

SEQ ID NO: 5517760 - DNA, 19 bp, Homo sapiens
tccagtgttggctgtgtga

SEQ ID NO: 5517761 - DNA, 21 bp, Homo sapiens
tccagtgttggctgtgtgaca

SEQ ID NO: 5517762 - DNA, 13 bp, Homo sapiens
tccagtgttttct

SEQ ID NO: 5517763 - DNA, 16 bp, Homo sapiens
tccagtgttttcttgt

SEQ ID NO: 5517764 - DNA, 19 bp, Homo sapiens
tccagtgttttcttgtgtt

SEQ ID NO: 5517765 - DNA, 16 bp, Homo sapiens
tccagttactttccaa

SEQ ID NO: 5517766 - DNA, 13 bp, Homo sapiens
tccagttataaga

SEQ ID NO: 5517767 - DNA, 16 bp, Homo sapiens
tccagttcatgagaat

SEQ ID NO: 5517768 - DNA, 18 bp, Homo sapiens
tccagttcccagaaggca

SEQ ID NO: 5517769 - DNA, 13 bp, Homo sapiens
tccagttcctgct

SEQ ID NO: 5517770 - DNA, 17 bp, Homo sapiens
tccagttcctgctctct

SEQ ID NO: 5517771 - DNA, 20 bp, Homo sapiens
tccagttcctgctctctgct

SEQ ID NO: 5517772 - DNA, 14 bp, Homo sapiens
tccagttctgatga

SEQ ID NO: 5517773 - DNA, 15 bp, Homo sapiens
tccagttctgatgag

SEQ ID NO: 5517774 - DNA, 19 bp, Homo sapiens
tccagttcttcgactgttg

SEQ ID NO: 5517775 - DNA, 23 bp, Homo sapiens
tccagttcttcgactgttgttat

SEQ ID NO: 5517776 - DNA, 18 bp, Homo sapiens
tccagttgattgtacgta

SEQ ID NO: 5517777 - DNA, 16 bp, Homo sapiens
tccagttgcaataaaa

SEQ ID NO: 5517778 - DNA, 20 bp, Homo sapiens
tccagttgcaattcataact

SEQ ID NO: 5517779 - DNA, 21 bp, Homo sapiens
tccagttggactgtggcctca

SEQ ID NO: 5517780 - DNA, 16 bp, Homo sapiens
tccagttgttactgaa

SEQ ID NO: 5517781 - DNA, 23 bp, Homo sapiens
tccagtttagcccttccctgcct

SEQ ID NO: 5517782 - DNA, 15 bp, Homo sapiens
tccagtttcagaagc

SEQ ID NO: 5517783 - DNA, 16 bp, Homo sapiens
tccagtttcagaagca

SEQ ID NO: 5517784 - DNA, 17 bp, Homo sapiens
tccagtttcagaagcag

SEQ ID NO: 5517785 - DNA, 12 bp, Homo sapiens
tccagtttccca

SEQ ID NO: 5517786 - DNA, 17 bp, Homo sapiens
tccagtttctttcccca

SEQ ID NO: 5517787 - DNA, 17 bp, Homo sapiens
tccagtttgtcttggat

SEQ ID NO: 5517788 - DNA, 18 bp, Homo sapiens
tccagtttgttctccggg

SEQ ID NO: 5517789 - DNA, 20 bp, Homo sapiens
tccagttttgtttggaccaa

SEQ ID NO: 5517790 - DNA, 12 bp, Homo sapiens
tccagtttttct

SEQ ID NO: 5517791 - DNA, 13 bp, Homo sapiens
tccagtttttctt

SEQ ID NO: 5517792 - DNA, 20 bp, Homo sapiens
tccagttttttgttatatag

SEQ ID NO: 5517793 - DNA, 19 bp, Homo sapiens
tccataaaaagaaagctaa

SEQ ID NO: 5517794 - DNA, 22 bp, Homo sapiens
tccataaaattggattacagta

SEQ ID NO: 5517795 - DNA, 16 bp, Homo sapiens
tccataaacatgaaaa

SEQ ID NO: 5517796 - DNA, 21 bp, Homo sapiens
tccataaactaagagaaactg

SEQ ID NO: 5517797 - DNA, 17 bp, Homo sapiens
tccataaagaagatgtt

SEQ ID NO: 5517798 - DNA, 13 bp, Homo sapiens
tccataaagaccc

SEQ ID NO: 5517799 - DNA, 21 bp, Homo sapiens
tccataaagcaagctcaacct

SEQ ID NO: 5517800 - DNA, 12 bp, Homo sapiens
tccataaagtaa

SEQ ID NO: 5517801 - DNA, 13 bp, Homo sapiens
tccataaagtaca

SEQ ID NO: 5517802 - DNA, 16 bp, Homo sapiens
tccataaagtacaaat

SEQ ID NO: 5517803 - DNA, 24 bp, Homo sapiens
tccataaagtacaaatgaagaaag

SEQ ID NO: 5517804 - DNA, 14 bp, Homo sapiens
tccataaagtgtaa

SEQ ID NO: 5517805 - DNA, 13 bp, Homo sapiens
tccataaatgtgt

SEQ ID NO: 5517806 - DNA, 15 bp, Homo sapiens
tccataaatgtgttc

SEQ ID NO: 5517807 - DNA, 21 bp, Homo sapiens
tccataaccccaggcatccca

SEQ ID NO: 5517808 - DNA, 17 bp, Homo sapiens
tccataagatttgcaaa

SEQ ID NO: 5517809 - DNA, 13 bp, Homo sapiens
tccataagctatt

SEQ ID NO: 5517810 - DNA, 12 bp, Homo sapiens
tccataaggatt

SEQ ID NO: 5517811 - DNA, 14 bp, Homo sapiens
tccataagtaagaa

SEQ ID NO: 5517812 - DNA, 19 bp, Homo sapiens
tccataagtttaactttaa

SEQ ID NO: 5517813 - DNA, 14 bp, Homo sapiens
tccataataattct

SEQ ID NO: 5517814 - DNA, 20 bp, Homo sapiens
tccataataattctgcttta

SEQ ID NO: 5517815 - DNA, 13 bp, Homo sapiens
tccataatcatgt

SEQ ID NO: 5517816 - DNA, 13 bp, Homo sapiens
tccataatgatgg

SEQ ID NO: 5517817 - DNA, 14 bp, Homo sapiens
tccataatgatgga

SEQ ID NO: 5517818 - DNA, 23 bp, Homo sapiens
tccataatgatggatttaacagc

SEQ ID NO: 5517819 - DNA, 22 bp, Homo sapiens
tccataatgcattcttctctgt

SEQ ID NO: 5517820 - DNA, 17 bp, Homo sapiens
tccataatgttctgcta

SEQ ID NO: 5517821 - DNA, 17 bp, Homo sapiens
tccataattatgacagt

SEQ ID NO: 5517822 - DNA, 18 bp, Homo sapiens
tccataattccatatgct

SEQ ID NO: 5517823 - DNA, 19 bp, Homo sapiens
tccataatttggtcatttg

SEQ ID NO: 5517824 - DNA, 23 bp, Homo sapiens
tccatacaatgactagtcacctg

SEQ ID NO: 5517825 - DNA, 19 bp, Homo sapiens
tccatacacacgctgcctt

SEQ ID NO: 5517826 - DNA, 15 bp, Homo sapiens
tccatacacagagga

SEQ ID NO: 5517827 - DNA, 18 bp, Homo sapiens
tccatacacagaggagtg

SEQ ID NO: 5517828 - DNA, 17 bp, Homo sapiens
tccatacacatccccag

SEQ ID NO: 5517829 - DNA, 22 bp, Homo sapiens
tccataccccctgccccagaga

SEQ ID NO: 5517830 - DNA, 20 bp, Homo sapiens
tccataccttttctcttttc

SEQ ID NO: 5517831 - DNA, 22 bp, Homo sapiens
tccatactgaaaaaatgctgag

SEQ ID NO: 5517832 - DNA, 20 bp, Homo sapiens
tccatactgtagacactctg

SEQ ID NO: 5517833 - DNA, 21 bp, Homo sapiens
tccatactgtagacactctga

SEQ ID NO: 5517834 - DNA, 15 bp, Homo sapiens
tccatactgtttaat

SEQ ID NO: 5517835 - DNA, 24 bp, Homo sapiens
tccatactgtttgcccattttcat

SEQ ID NO: 5517836 - DNA, 15 bp, Homo sapiens
tccatacttctctca

SEQ ID NO: 5517837 - DNA, 12 bp, Homo sapiens
tccatactttgg

SEQ ID NO: 5517838 - DNA, 15 bp, Homo sapiens
tccatagacacagta

SEQ ID NO: 5517839 - DNA, 17 bp, Homo sapiens
tccatagaccttttcat

SEQ ID NO: 5517840 - DNA, 19 bp, Homo sapiens
tccatagatttattttaca

SEQ ID NO: 5517841 - DNA, 20 bp, Homo sapiens
tccatagatttattttacat

SEQ ID NO: 5517842 - DNA, 21 bp, Homo sapiens
tccatagatttattttacatt

SEQ ID NO: 5517843 - DNA, 22 bp, Homo sapiens
tccatagatttattttacattt

SEQ ID NO: 5517844 - DNA, 22 bp, Homo sapiens
tccatagcctaatccctgggca

SEQ ID NO: 5517845 - DNA, 20 bp, Homo sapiens
tccatagctactatatgcat

SEQ ID NO: 5517846 - DNA, 12 bp, Homo sapiens
tccatagctcct

SEQ ID NO: 5517847 - DNA, 20 bp, Homo sapiens
tccatagctcttcacttcct

SEQ ID NO: 5517848 - DNA, 21 bp, Homo sapiens
tccatagctcttcacttcctc

SEQ ID NO: 5517849 - DNA, 18 bp, Homo sapiens
tccataggaaggctgtga

SEQ ID NO: 5517850 - DNA, 20 bp, Homo sapiens
tccataggaatcatgttgga

SEQ ID NO: 5517851 - DNA, 22 bp, Homo sapiens
tccataggactaccgcaggccc

SEQ ID NO: 5517852 - DNA, 19 bp, Homo sapiens
tccataggtttctctccct

SEQ ID NO: 5517853 - DNA, 17 bp, Homo sapiens
tccatagtatattaaaa

SEQ ID NO: 5517854 - DNA, 16 bp, Homo sapiens
tccatagtgctacctg

SEQ ID NO: 5517855 - DNA, 13 bp, Homo sapiens
tccatagttttga

SEQ ID NO: 5517856 - DNA, 19 bp, Homo sapiens
tccatagttttgatgactg

SEQ ID NO: 5517857 - DNA, 16 bp, Homo sapiens
tccatatagtttgttt

SEQ ID NO: 5517858 - DNA, 19 bp, Homo sapiens
tccatatagtttgttttct

SEQ ID NO: 5517859 - DNA, 18 bp, Homo sapiens
tccatatatatgaaatgt

SEQ ID NO: 5517860 - DNA, 12 bp, Homo sapiens
tccatatattgg

SEQ ID NO: 5517861 - DNA, 17 bp, Homo sapiens
tccatatattggcactg

SEQ ID NO: 5517862 - DNA, 13 bp, Homo sapiens
tccatatcacaca

SEQ ID NO: 5517863 - DNA, 15 bp, Homo sapiens
tccatatcacacaca

SEQ ID NO: 5517864 - DNA, 12 bp, Homo sapiens
tccatatccata

SEQ ID NO: 5517865 - DNA, 16 bp, Homo sapiens
tccatatcccgggagc

SEQ ID NO: 5517866 - DNA, 23 bp, Homo sapiens
tccatatccctttctctcttgtc

SEQ ID NO: 5517867 - DNA, 18 bp, Homo sapiens
tccatatccgggtgctca

SEQ ID NO: 5517868 - DNA, 14 bp, Homo sapiens
tccatatctaacca

SEQ ID NO: 5517869 - DNA, 18 bp, Homo sapiens
tccatatgacctcatgca

SEQ ID NO: 5517870 - DNA, 14 bp, Homo sapiens
tccatatgctccag

SEQ ID NO: 5517871 - DNA, 23 bp, Homo sapiens
tccatatggagcatttttcagag

SEQ ID NO: 5517872 - DNA, 16 bp, Homo sapiens
tccatatggatccact

SEQ ID NO: 5517873 - DNA, 15 bp, Homo sapiens
tccatattagaaaac

SEQ ID NO: 5517874 - DNA, 17 bp, Homo sapiens
tccatattagaaaactt

SEQ ID NO: 5517875 - DNA, 14 bp, Homo sapiens
tccatattattgtg

SEQ ID NO: 5517876 - DNA, 15 bp, Homo sapiens
tccatatttggaaga

SEQ ID NO: 5517877 - DNA, 17 bp, Homo sapiens
tccatatttggaagaaa

SEQ ID NO: 5517878 - DNA, 17 bp, Homo sapiens
tccatattttattactg

SEQ ID NO: 5517879 - DNA, 13 bp, Homo sapiens
tccatattttcac

SEQ ID NO: 5517880 - DNA, 18 bp, Homo sapiens
tccatattttcacaggtg

SEQ ID NO: 5517881 - DNA, 20 bp, Homo sapiens
tccatattttttgcacagct

SEQ ID NO: 5517882 - DNA, 16 bp, Homo sapiens
tccatatttttttcct

SEQ ID NO: 5517883 - DNA, 22 bp, Homo sapiens
tccatatttttttccttacata

SEQ ID NO: 5517884 - DNA, 15 bp, Homo sapiens
tccatcaaaagatgt

SEQ ID NO: 5517885 - DNA, 17 bp, Homo sapiens
tccatcaactaaaacat

SEQ ID NO: 5517886 - DNA, 23 bp, Homo sapiens
tccatcaataaatgctctatttt

SEQ ID NO: 5517887 - DNA, 16 bp, Homo sapiens
tccatcacagccagcc

SEQ ID NO: 5517888 - DNA, 17 bp, Homo sapiens
tccatcacagccagccc

SEQ ID NO: 5517889 - DNA, 18 bp, Homo sapiens
tccatcacagccagccca

SEQ ID NO: 5517890 - DNA, 20 bp, Homo sapiens
tccatcacagccagcccagc

SEQ ID NO: 5517891 - DNA, 13 bp, Homo sapiens
tccatgcccaacc

SEQ ID NO: 5517892 - DNA, 12 bp, Homo sapiens
tccatgcccact

SEQ ID NO: 5517893 - DNA, 18 bp, Homo sapiens
tccatgcccactgctggt

SEQ ID NO: 5517894 - DNA, 14 bp, Homo sapiens
tccatgccccagct

SEQ ID NO: 5517895 - DNA, 15 bp, Homo sapiens
tccatgccccagctc

SEQ ID NO: 5517896 - DNA, 16 bp, Homo sapiens
tccatgccccagctct

SEQ ID NO: 5517897 - DNA, 18 bp, Homo sapiens
tccatgccccagctctgg

SEQ ID NO: 5517898 - DNA, 23 bp, Homo sapiens
tccatgcccccgccacctcccca

SEQ ID NO: 5517899 - DNA, 15 bp, Homo sapiens
tccatgcccgagtcc

SEQ ID NO: 5517900 - DNA, 21 bp, Homo sapiens
tccatgccctgggatgcctca

SEQ ID NO: 5517901 - DNA, 18 bp, Homo sapiens
tccatgcctctggaggcc

SEQ ID NO: 5517902 - DNA, 20 bp, Homo sapiens
tccatgcctgtagctttcct

SEQ ID NO: 5517903 - DNA, 21 bp, Homo sapiens
tccatgccttaaacctacctc

SEQ ID NO: 5517904 - DNA, 17 bp, Homo sapiens
tccatgcggagtccatt

SEQ ID NO: 5517905 - DNA, 21 bp, Homo sapiens
tccatgcggccggcctggggc

SEQ ID NO: 5517906 - DNA, 18 bp, Homo sapiens
tccatgcgtgtttctgac

SEQ ID NO: 5517907 - DNA, 20 bp, Homo sapiens
tccatgcgtgtttctgactc

SEQ ID NO: 5517908 - DNA, 17 bp, Homo sapiens
tccatgctataaaaact

SEQ ID NO: 5517909 - DNA, 13 bp, Homo sapiens
tccatgctcccaa

SEQ ID NO: 5517910 - DNA, 21 bp, Homo sapiens
tccatgctcctcacctgtcta

SEQ ID NO: 5517911 - DNA, 22 bp, Homo sapiens
tccatgctcctcactgcccgca

SEQ ID NO: 5517912 - DNA, 17 bp, Homo sapiens
tccatgctccttgagag

SEQ ID NO: 5517913 - DNA, 12 bp, Homo sapiens
tccatgctcttt

SEQ ID NO: 5517914 - DNA, 22 bp, Homo sapiens
tccatgctctttcaccctgcca

SEQ ID NO: 5517915 - DNA, 19 bp, Homo sapiens
tccatgctgcaaaggagaa

SEQ ID NO: 5517916 - DNA, 15 bp, Homo sapiens
tccatgctgggtctg

SEQ ID NO: 5517917 - DNA, 22 bp, Homo sapiens
tccatgctggtgtggccaaggc

SEQ ID NO: 5517918 - DNA, 15 bp, Homo sapiens
tccatgctgtccctg

SEQ ID NO: 5517919 - DNA, 18 bp, Homo sapiens
tccatgctgtccctgtgg

SEQ ID NO: 5517920 - DNA, 22 bp, Homo sapiens
tccatgctgtgcgcccagggct

SEQ ID NO: 5517921 - DNA, 22 bp, Homo sapiens
tccatgcttagtcactgcctgc

SEQ ID NO: 5517922 - DNA, 20 bp, Homo sapiens
tccatgctttgctctcaagg

SEQ ID NO: 5517923 - DNA, 15 bp, Homo sapiens
tccatggaaataaaa

SEQ ID NO: 5517924 - DNA, 12 bp, Homo sapiens
tccatggaggag

SEQ ID NO: 5517925 - DNA, 15 bp, Homo sapiens
tccatggaggaggtg

SEQ ID NO: 5517926 - DNA, 20 bp, Homo sapiens
tccatggaggaggtgtccca

SEQ ID NO: 5517927 - DNA, 23 bp, Homo sapiens
tccatggaggaggtgtcccaagc

SEQ ID NO: 5517928 - DNA, 24 bp, Homo sapiens
tccatggattgattcagtcttctg

SEQ ID NO: 5517929 - DNA, 14 bp, Homo sapiens
tccatggattttgg

SEQ ID NO: 5517930 - DNA, 17 bp, Homo sapiens
tccatggcaattttgta

SEQ ID NO: 5517931 - DNA, 17 bp, Homo sapiens
tccatggcaccagcccc

SEQ ID NO: 5517932 - DNA, 23 bp, Homo sapiens
tccatggcagcagccagggaccc

SEQ ID NO: 5517933 - DNA, 16 bp, Homo sapiens
tccatggccagcagca

SEQ ID NO: 5517934 - DNA, 14 bp, Homo sapiens
tccatggcttcctg

SEQ ID NO: 5517935 - DNA, 16 bp, Homo sapiens
tccatggcttcctgag

SEQ ID NO: 5517936 - DNA, 18 bp, Homo sapiens
tccatgggagaaaataga

SEQ ID NO: 5517937 - DNA, 16 bp, Homo sapiens
tccatgggagcaaata

SEQ ID NO: 5517938 - DNA, 20 bp, Homo sapiens
tccatgggagccagctgctt

SEQ ID NO: 5517939 - DNA, 22 bp, Homo sapiens
tccatgggagccagctgctttt

SEQ ID NO: 5517940 - DNA, 23 bp, Homo sapiens
tccatgggagccagctgcttttt

SEQ ID NO: 5517941 - DNA, 20 bp, Homo sapiens
tccatgggatggttagtgtg

SEQ ID NO: 5517942 - DNA, 22 bp, Homo sapiens
tccatgggcagagcccaaggga

SEQ ID NO: 5517943 - DNA, 20 bp, Homo sapiens
tccatgggccatatgaaaag

SEQ ID NO: 5517944 - DNA, 22 bp, Homo sapiens
tccatgggccccaccatttatg

SEQ ID NO: 5517945 - DNA, 20 bp, Homo sapiens
tccatgggctagtgtgagtg

SEQ ID NO: 5517946 - DNA, 12 bp, Homo sapiens
tccatggggagg

SEQ ID NO: 5517947 - DNA, 20 bp, Homo sapiens
tccatgggggctcagccagg

SEQ ID NO: 5517948 - DNA, 15 bp, Homo sapiens
tccatggggggagaa

SEQ ID NO: 5517949 - DNA, 15 bp, Homo sapiens
tccatggggtaggag

SEQ ID NO: 5517950 - DNA, 19 bp, Homo sapiens
tccatggggtctctcacag

SEQ ID NO: 5517951 - DNA, 14 bp, Homo sapiens
tccatggggtgggg

SEQ ID NO: 5517952 - DNA, 15 bp, Homo sapiens
tccatggggtggggg

SEQ ID NO: 5517953 - DNA, 15 bp, Homo sapiens
tccatgggtctggct

SEQ ID NO: 5517954 - DNA, 16 bp, Homo sapiens
tccatgggtctggcta

SEQ ID NO: 5517955 - DNA, 21 bp, Homo sapiens
tccatgggttccagtttcaga

SEQ ID NO: 5517956 - DNA, 21 bp, Homo sapiens
tccatggtgaactgaagcaga

SEQ ID NO: 5517957 - DNA, 13 bp, Homo sapiens
tccatggtgcctc

SEQ ID NO: 5517958 - DNA, 18 bp, Homo sapiens
tccatggtggtttcagaa

SEQ ID NO: 5517959 - DNA, 19 bp, Homo sapiens
tccatggttctcaatttat

SEQ ID NO: 5517960 - DNA, 20 bp, Homo sapiens
tccatgtaataagcacttgc

SEQ ID NO: 5517961 - DNA, 16 bp, Homo sapiens
tccatgtaatgatctt

SEQ ID NO: 5517962 - DNA, 13 bp, Homo sapiens
tccatgtactgta

SEQ ID NO: 5517963 - DNA, 14 bp, Homo sapiens
tccatgtactgtag

SEQ ID NO: 5517964 - DNA, 23 bp, Homo sapiens
tccatgtagaagagggagaagga

SEQ ID NO: 5517965 - DNA, 14 bp, Homo sapiens
tccatgtcaagatt

SEQ ID NO: 5517966 - DNA, 18 bp, Homo sapiens
tccatgtcaggccagcct

SEQ ID NO: 5517967 - DNA, 17 bp, Homo sapiens
tccatgtcccctcccag

SEQ ID NO: 5517968 - DNA, 19 bp, Homo sapiens
tccatgtcctatgcctcac

SEQ ID NO: 5517969 - DNA, 17 bp, Homo sapiens
tccatgtcgcctctgca

SEQ ID NO: 5517970 - DNA, 15 bp, Homo sapiens
tccatgtcggcctct

SEQ ID NO: 5517971 - DNA, 21 bp, Homo sapiens
tccatgtcggcctctaacccc

SEQ ID NO: 5517972 - DNA, 16 bp, Homo sapiens
tccatgtgaaatttac

SEQ ID NO: 5517973 - DNA, 17 bp, Homo sapiens
tccatgtgaccattctg

SEQ ID NO: 5517974 - DNA, 18 bp, Homo sapiens
tccatgtgaccattctgc

SEQ ID NO: 5517975 - DNA, 23 bp, Homo sapiens
tccatgtgattaatgttttcatt

SEQ ID NO: 5517976 - DNA, 19 bp, Homo sapiens
tccatgtgccccctctacc

SEQ ID NO: 5517977 - DNA, 16 bp, Homo sapiens
tccatgtgcctttctt

SEQ ID NO: 5517978 - DNA, 16 bp, Homo sapiens
tccatgtggacttagg

SEQ ID NO: 5517979 - DNA, 20 bp, Homo sapiens
tccatgtggacttaggaagg

SEQ ID NO: 5517980 - DNA, 22 bp, Homo sapiens
tccatgtggagaaaggagtgaa

SEQ ID NO: 5517981 - DNA, 11 bp, Homo sapiens
tccatgtggcc

SEQ ID NO: 5517982 - DNA, 12 bp, Homo sapiens
tccatgtgtccc

SEQ ID NO: 5517983 - DNA, 13 bp, Homo sapiens
tccatgtgtcccc

SEQ ID NO: 5517984 - DNA, 11 bp, Homo sapiens
tccatgtgtgt

SEQ ID NO: 5517985 - DNA, 14 bp, Homo sapiens
tccatgtgttttgc

SEQ ID NO: 5517986 - DNA, 20 bp, Homo sapiens
tccatgttagtaatggcaga

SEQ ID NO: 5517987 - DNA, 20 bp, Homo sapiens
tccatgttattctctcacag

SEQ ID NO: 5517988 - DNA, 15 bp, Homo sapiens
tccatgttctatttt

SEQ ID NO: 5517989 - DNA, 21 bp, Homo sapiens
tccatgttctgggtgatggaa

SEQ ID NO: 5517990 - DNA, 13 bp, Homo sapiens
tccatgttgactg

SEQ ID NO: 5517991 - DNA, 12 bp, Homo sapiens
tccatgttgctg

SEQ ID NO: 5517992 - DNA, 15 bp, Homo sapiens
tccatgttgctgact

SEQ ID NO: 5517993 - DNA, 19 bp, Homo sapiens
tccatgttggtcaggctgg

SEQ ID NO: 5517994 - DNA, 22 bp, Homo sapiens
tccatgttggtcaggctggtct

SEQ ID NO: 5517995 - DNA, 14 bp, Homo sapiens
tccatgtttatcca

SEQ ID NO: 5517996 - DNA, 19 bp, Homo sapiens
tccatgtttccaccaaatg

SEQ ID NO: 5517997 - DNA, 16 bp, Homo sapiens
tccatgtttgtaaaac

SEQ ID NO: 5517998 - DNA, 19 bp, Homo sapiens
tccatgtttgtaaaactac

SEQ ID NO: 5517999 - DNA, 21 bp, Homo sapiens
tccatgttttaaaattatata

SEQ ID NO: 5518000 - DNA, 15 bp, Homo sapiens
tccattaaacttcta

SEQ ID NO: 5518001 - DNA, 21 bp, Homo sapiens
tccattaaacttctactgagc

SEQ ID NO: 5518002 - DNA, 22 bp, Homo sapiens
tccattaaacttctactgagca

SEQ ID NO: 5518003 - DNA, 14 bp, Homo sapiens
tccattaacaaatg

SEQ ID NO: 5518004 - DNA, 15 bp, Homo sapiens
tccattaacagcaat

SEQ ID NO: 5518005 - DNA, 19 bp, Homo sapiens
tccattaactgctttccac

SEQ ID NO: 5518006 - DNA, 21 bp, Homo sapiens
tccattaagggtccaagaagt

SEQ ID NO: 5518007 - DNA, 22 bp, Homo sapiens
tccattaataactgaataaaaa

SEQ ID NO: 5518008 - DNA, 20 bp, Homo sapiens
tccattaatacccatgcttt

SEQ ID NO: 5518009 - DNA, 16 bp, Homo sapiens
tccattaatgtagata

SEQ ID NO: 5518010 - DNA, 17 bp, Homo sapiens
tccattaatttaaatga

SEQ ID NO: 5518011 - DNA, 22 bp, Homo sapiens
tccattaatttaaatgatttaa

SEQ ID NO: 5518012 - DNA, 22 bp, Homo sapiens
tccattacaggggcagtgcctt

SEQ ID NO: 5518013 - DNA, 17 bp, Homo sapiens
tccattacctccatcca

SEQ ID NO: 5518014 - DNA, 18 bp, Homo sapiens
tccattacctccatccat

SEQ ID NO: 5518015 - DNA, 15 bp, Homo sapiens
tccattacgtgcatt

SEQ ID NO: 5518016 - DNA, 15 bp, Homo sapiens
tccattagaatgcta

SEQ ID NO: 5518017 - DNA, 23 bp, Homo sapiens
tccattagcgacagtaggatttt

SEQ ID NO: 5518018 - DNA, 17 bp, Homo sapiens
tccattaggccagcaac

SEQ ID NO: 5518019 - DNA, 18 bp, Homo sapiens
tccattagtaaaacacaa

SEQ ID NO: 5518020 - DNA, 15 bp, Homo sapiens
tccattatcatgtgt

SEQ ID NO: 5518021 - DNA, 16 bp, Homo sapiens
tccattatcatgtgta

SEQ ID NO: 5518022 - DNA, 17 bp, Homo sapiens
tccattatcatgtgtaa

SEQ ID NO: 5518023 - DNA, 16 bp, Homo sapiens
tccattatccattccc

SEQ ID NO: 5518024 - DNA, 17 bp, Homo sapiens
tccattatccattccca

SEQ ID NO: 5518025 - DNA, 14 bp, Homo sapiens
tccattatccttta

SEQ ID NO: 5518026 - DNA, 15 bp, Homo sapiens
tccattatctgctgt

SEQ ID NO: 5518027 - DNA, 15 bp, Homo sapiens
tccattatgaaaatc

SEQ ID NO: 5518028 - DNA, 15 bp, Homo sapiens
tccattatgattctt

SEQ ID NO: 5518029 - DNA, 18 bp, Homo sapiens
tccattattcaagaaaga

SEQ ID NO: 5518030 - DNA, 20 bp, Homo sapiens
tccattattgagttcctcct

SEQ ID NO: 5518031 - DNA, 12 bp, Homo sapiens
tccattatttat

SEQ ID NO: 5518032 - DNA, 15 bp, Homo sapiens
tccattatttatatt

SEQ ID NO: 5518033 - DNA, 21 bp, Homo sapiens
tccattattttattttatagt

SEQ ID NO: 5518034 - DNA, 15 bp, Homo sapiens
tccattcaactggaa

SEQ ID NO: 5518035 - DNA, 20 bp, Homo sapiens
tccattcacaagcctcctgt

SEQ ID NO: 5518036 - DNA, 14 bp, Homo sapiens
tccattcactccca

SEQ ID NO: 5518037 - DNA, 15 bp, Homo sapiens
tccattcactttcag

SEQ ID NO: 5518038 - DNA, 18 bp, Homo sapiens
tccattcactttcaggaa

SEQ ID NO: 5518039 - DNA, 15 bp, Homo sapiens
tccattcagtctgca

SEQ ID NO: 5518040 - DNA, 19 bp, Homo sapiens
tccattcagtctgcagcta

SEQ ID NO: 5518041 - DNA, 15 bp, Homo sapiens
tccattcagtgcagc

SEQ ID NO: 5518042 - DNA, 14 bp, Homo sapiens
tccattcatctcat

SEQ ID NO: 5518043 - DNA, 23 bp, Homo sapiens
tccattcattaattagttccagt

SEQ ID NO: 5518044 - DNA, 17 bp, Homo sapiens
tccattccatggaaata

SEQ ID NO: 5518045 - DNA, 17 bp, Homo sapiens
tccattccattaataac

SEQ ID NO: 5518046 - DNA, 10 bp, Homo sapiens
tccattccca

SEQ ID NO: 5518047 - DNA, 20 bp, Homo sapiens
tccattcccaactagacatt

SEQ ID NO: 5518048 - DNA, 18 bp, Homo sapiens
tccattcccaagatgcct

SEQ ID NO: 5518049 - DNA, 21 bp, Homo sapiens
tccattcccaagatgcctgat

SEQ ID NO: 5518050 - DNA, 16 bp, Homo sapiens
tccattcccacccctc

SEQ ID NO: 5518051 - DNA, 13 bp, Homo sapiens
tccattccctagc

SEQ ID NO: 5518052 - DNA, 13 bp, Homo sapiens
tccattcctcagg

SEQ ID NO: 5518053 - DNA, 12 bp, Homo sapiens
tccattcctgag

SEQ ID NO: 5518054 - DNA, 18 bp, Homo sapiens
tccattcctggagcccga

SEQ ID NO: 5518055 - DNA, 21 bp, Homo sapiens
tccattctatgactcttgtct

SEQ ID NO: 5518056 - DNA, 19 bp, Homo sapiens
tccattctcacctatccac

SEQ ID NO: 5518057 - DNA, 15 bp, Homo sapiens
tccattctcccaggt

SEQ ID NO: 5518058 - DNA, 14 bp, Homo sapiens
tccattctctctgc

SEQ ID NO: 5518059 - DNA, 20 bp, Homo sapiens
tccattctgctccttcccca

SEQ ID NO: 5518060 - DNA, 12 bp, Homo sapiens
tccattctggaa

SEQ ID NO: 5518061 - DNA, 14 bp, Homo sapiens
tccattctgggtgt

SEQ ID NO: 5518062 - DNA, 19 bp, Homo sapiens
tccattcttcagtgtctct

SEQ ID NO: 5518063 - DNA, 20 bp, Homo sapiens
tccattcttcagtgtctctg

SEQ ID NO: 5518064 - DNA, 12 bp, Homo sapiens
tccattcttggt

SEQ ID NO: 5518065 - DNA, 13 bp, Homo sapiens
tccattctttctt

SEQ ID NO: 5518066 - DNA, 14 bp, Homo sapiens
tccattctttcttc

SEQ ID NO: 5518067 - DNA, 15 bp, Homo sapiens
tccattctttcttcc

SEQ ID NO: 5518068 - DNA, 16 bp, Homo sapiens
tccattctttcttcct

SEQ ID NO: 5518069 - DNA, 15 bp, Homo sapiens
tcccaccattcctgc

SEQ ID NO: 5518070 - DNA, 19 bp, Homo sapiens
tcccacccaacagctcaga

SEQ ID NO: 5518071 - DNA, 13 bp, Homo sapiens
tcccacccaagga

SEQ ID NO: 5518072 - DNA, 23 bp, Homo sapiens
tcccacccacacagctgccctag

SEQ ID NO: 5518073 - DNA, 19 bp, Homo sapiens
tcccacccacagccataga

SEQ ID NO: 5518074 - DNA, 22 bp, Homo sapiens
tcccacccacatgtgacacata

SEQ ID NO: 5518075 - DNA, 14 bp, Homo sapiens
tcccacccacccgc

SEQ ID NO: 5518076 - DNA, 22 bp, Homo sapiens
tcccacccacccgccgcctccc

SEQ ID NO: 5518077 - DNA, 23 bp, Homo sapiens
tcccacccacccgccgcctccca

SEQ ID NO: 5518078 - DNA, 12 bp, Homo sapiens
tcccacccaccg

SEQ ID NO: 5518079 - DNA, 19 bp, Homo sapiens
tcccacccaccgccacaat

SEQ ID NO: 5518080 - DNA, 16 bp, Homo sapiens
tcccacccacctcacc

SEQ ID NO: 5518081 - DNA, 15 bp, Homo sapiens
tcccacccaggaaag

SEQ ID NO: 5518082 - DNA, 15 bp, Homo sapiens
tcccacccatctcca

SEQ ID NO: 5518083 - DNA, 19 bp, Homo sapiens
tcccaccccaacctgctct

SEQ ID NO: 5518084 - DNA, 23 bp, Homo sapiens
tcccaccccaacctgctctcctc

SEQ ID NO: 5518085 - DNA, 11 bp, Homo sapiens
tcccaccccac

SEQ ID NO: 5518086 - DNA, 20 bp, Homo sapiens
tcccaccccacccccttcag

SEQ ID NO: 5518087 - DNA, 14 bp, Homo sapiens
tcccaccccactca

SEQ ID NO: 5518088 - DNA, 21 bp, Homo sapiens
tcccaccccactcaggggacc

SEQ ID NO: 5518089 - DNA, 15 bp, Homo sapiens
tcccaccccactcca

SEQ ID NO: 5518090 - DNA, 17 bp, Homo sapiens
tcccaccccactccagc

SEQ ID NO: 5518091 - DNA, 18 bp, Homo sapiens
tcccaccccagaaatcac

SEQ ID NO: 5518092 - DNA, 21 bp, Homo sapiens
tcccaccccagaaatcactgt

SEQ ID NO: 5518093 - DNA, 19 bp, Homo sapiens
tcccaccccatcctccagg

SEQ ID NO: 5518094 - DNA, 22 bp, Homo sapiens
tcccaccccattttctgtgggc

SEQ ID NO: 5518095 - DNA, 13 bp, Homo sapiens
tcccacccccagc

SEQ ID NO: 5518096 - DNA, 19 bp, Homo sapiens
tcccacccccagcagctca

SEQ ID NO: 5518097 - DNA, 14 bp, Homo sapiens
tcccacccccagcc

SEQ ID NO: 5518098 - DNA, 20 bp, Homo sapiens
tcccacccccatctctccct

SEQ ID NO: 5518099 - DNA, 16 bp, Homo sapiens
tcccacccccgaccct

SEQ ID NO: 5518100 - DNA, 21 bp, Homo sapiens
tcccacccccgaccctgccct

SEQ ID NO: 5518101 - DNA, 21 bp, Homo sapiens
tcccaccccctcctcccccag

SEQ ID NO: 5518102 - DNA, 22 bp, Homo sapiens
tcccacccccttctctgctcca

SEQ ID NO: 5518103 - DNA, 19 bp, Homo sapiens
tcccaccccggcctccact

SEQ ID NO: 5518104 - DNA, 22 bp, Homo sapiens
tcccacccctagccaccagtgt

SEQ ID NO: 5518105 - DNA, 22 bp, Homo sapiens
tcccacccctataccctaggtc

SEQ ID NO: 5518106 - DNA, 19 bp, Homo sapiens
tcccacccctccctctgtc

SEQ ID NO: 5518107 - DNA, 16 bp, Homo sapiens
tcccacccggccacag

SEQ ID NO: 5518108 - DNA, 22 bp, Homo sapiens
tcccacccggccacagctgctg

SEQ ID NO: 5518109 - DNA, 17 bp, Homo sapiens
tcccaccctaagggcag

SEQ ID NO: 5518110 - DNA, 16 bp, Homo sapiens
tcccaccctatggcca

SEQ ID NO: 5518111 - DNA, 17 bp, Homo sapiens
tcccaccctatggccac

SEQ ID NO: 5518112 - DNA, 14 bp, Homo sapiens
tcccaccctcccct

SEQ ID NO: 5518113 - DNA, 16 bp, Homo sapiens
tcccaccctcctgccc

SEQ ID NO: 5518114 - DNA, 17 bp, Homo sapiens
tcccaccctcctgcccc

SEQ ID NO: 5518115 - DNA, 21 bp, Homo sapiens
tcccaccctcttcctactggt

SEQ ID NO: 5518116 - DNA, 19 bp, Homo sapiens
tcccaccctgcgggccagg

SEQ ID NO: 5518117 - DNA, 11 bp, Homo sapiens
tcccaccctgt

SEQ ID NO: 5518118 - DNA, 19 bp, Homo sapiens
tcccaccctttctgccagg

SEQ ID NO: 5518119 - DNA, 21 bp, Homo sapiens
tcccaccctttctgccaggga

SEQ ID NO: 5518120 - DNA, 23 bp, Homo sapiens
tcccaccgcccagcggcttgcct

SEQ ID NO: 5518121 - DNA, 16 bp, Homo sapiens
tcccaccgcccccacc

SEQ ID NO: 5518122 - DNA, 16 bp, Homo sapiens
tcccaccgctgcctcg

SEQ ID NO: 5518123 - DNA, 12 bp, Homo sapiens
tcccaccgggag

SEQ ID NO: 5518124 - DNA, 17 bp, Homo sapiens
tcccaccggtgccaaac

SEQ ID NO: 5518125 - DNA, 20 bp, Homo sapiens
tcccaccgtacaaccccctc

SEQ ID NO: 5518126 - DNA, 16 bp, Homo sapiens
tcccacctagcccagg

SEQ ID NO: 5518127 - DNA, 19 bp, Homo sapiens
tcccacctagtgccccaga

SEQ ID NO: 5518128 - DNA, 22 bp, Homo sapiens
tcccacctagtgccccagactg

SEQ ID NO: 5518129 - DNA, 14 bp, Homo sapiens
tcccacctcacccg

SEQ ID NO: 5518130 - DNA, 13 bp, Homo sapiens
tcccacctcagcc

SEQ ID NO: 5518131 - DNA, 20 bp, Homo sapiens
tcccacctccagcccacagt

SEQ ID NO: 5518132 - DNA, 16 bp, Homo sapiens
tcccacctccagcccg

SEQ ID NO: 5518133 - DNA, 13 bp, Homo sapiens
tcccacctccagt

SEQ ID NO: 5518134 - DNA, 23 bp, Homo sapiens
tcccacctccccctcccccttct

SEQ ID NO: 5518135 - DNA, 18 bp, Homo sapiens
tcccacctccctgcccag

SEQ ID NO: 5518136 - DNA, 20 bp, Homo sapiens
tcccacctccctgcccaggc

SEQ ID NO: 5518137 - DNA, 14 bp, Homo sapiens
tcccacctctctca

SEQ ID NO: 5518138 - DNA, 17 bp, Homo sapiens
tcccacctctctcactc

SEQ ID NO: 5518139 - DNA, 16 bp, Homo sapiens
tcccacctctgaggac

SEQ ID NO: 5518140 - DNA, 20 bp, Homo sapiens
tcccacctctgtgacctcag

SEQ ID NO: 5518141 - DNA, 22 bp, Homo sapiens
tcccacctctgtgacctcaggc

SEQ ID NO: 5518142 - DNA, 16 bp, Homo sapiens
tcccacctctttcttc

SEQ ID NO: 5518143 - DNA, 15 bp, Homo sapiens
tcccacctctttgga

SEQ ID NO: 5518144 - DNA, 13 bp, Homo sapiens
tcccacctgacac

SEQ ID NO: 5518145 - DNA, 20 bp, Homo sapiens
tcccacctggctctgtggcg

SEQ ID NO: 5518146 - DNA, 17 bp, Homo sapiens
tcccacctgtttctgga

SEQ ID NO: 5518147 - DNA, 15 bp, Homo sapiens
tcccaccttcccacc

SEQ ID NO: 5518148 - DNA, 14 bp, Homo sapiens
tcccaccttggcct

SEQ ID NO: 5518149 - DNA, 17 bp, Homo sapiens
tcccaccttggctgcag

SEQ ID NO: 5518150 - DNA, 21 bp, Homo sapiens
tcccaccttggctgcagggag

SEQ ID NO: 5518151 - DNA, 16 bp, Homo sapiens
tcccacgaatggaccc

SEQ ID NO: 5518152 - DNA, 23 bp, Homo sapiens
tcccacgactgttgtacaagctc

SEQ ID NO: 5518153 - DNA, 24 bp, Homo sapiens
tcccacgactgttgtacaagctca

SEQ ID NO: 5518154 - DNA, 16 bp, Homo sapiens
tcccacgatgtcaagg

SEQ ID NO: 5518155 - DNA, 20 bp, Homo sapiens
tcccacgccaggccagcagg

SEQ ID NO: 5518156 - DNA, 15 bp, Homo sapiens
tcccacgccctcctc

SEQ ID NO: 5518157 - DNA, 19 bp, Homo sapiens
tcccacgccctcctccctc

SEQ ID NO: 5518158 - DNA, 21 bp, Homo sapiens
tcccacgccctcctccctccg

SEQ ID NO: 5518159 - DNA, 22 bp, Homo sapiens
tcccacgccctcctccctccgc

SEQ ID NO: 5518160 - DNA, 23 bp, Homo sapiens
tcccacgccctcctccctccgct

SEQ ID NO: 5518161 - DNA, 16 bp, Homo sapiens
tcccacgcctgcttct

SEQ ID NO: 5518162 - DNA, 23 bp, Homo sapiens
tcccacggaaaatgccaatctct

SEQ ID NO: 5518163 - DNA, 23 bp, Homo sapiens
tcccacggggaccactgggcccc

SEQ ID NO: 5518164 - DNA, 21 bp, Homo sapiens
tcccacggggtccccgtagcc

SEQ ID NO: 5518165 - DNA, 21 bp, Homo sapiens
tcccacgtctcctcctcgaag

SEQ ID NO: 5518166 - DNA, 14 bp, Homo sapiens
tcccacgtctggcc

SEQ ID NO: 5518167 - DNA, 22 bp, Homo sapiens
tcccacgtcttcttgctgcagc

SEQ ID NO: 5518168 - DNA, 15 bp, Homo sapiens
tcccacgtgcacagc

SEQ ID NO: 5518169 - DNA, 18 bp, Homo sapiens
tcccactaagctttctcc

SEQ ID NO: 5518170 - DNA, 22 bp, Homo sapiens
tcccactaagctttctcctttg

SEQ ID NO: 5518171 - DNA, 22 bp, Homo sapiens
tcccactaaggtgaccagagtg

SEQ ID NO: 5518172 - DNA, 18 bp, Homo sapiens
tcccactacgggcaccta

SEQ ID NO: 5518173 - DNA, 17 bp, Homo sapiens
tcccactcaagccaagc

SEQ ID NO: 5518174 - DNA, 17 bp, Homo sapiens
tcccactcacaacagct

SEQ ID NO: 5518175 - DNA, 22 bp, Homo sapiens
tcccactcacaacagctgcctg

SEQ ID NO: 5518176 - DNA, 13 bp, Homo sapiens
tcccactcaccag

SEQ ID NO: 5518177 - DNA, 15 bp, Homo sapiens
tcccactcaccagcc

SEQ ID NO: 5518178 - DNA, 13 bp, Homo sapiens
tcccactccacta

SEQ ID NO: 5518179 - DNA, 16 bp, Homo sapiens
tcccactccagctgac

SEQ ID NO: 5518180 - DNA, 18 bp, Homo sapiens
tcccactccagctgacag

SEQ ID NO: 5518181 - DNA, 12 bp, Homo sapiens
tcccactcccat

SEQ ID NO: 5518182 - DNA, 15 bp, Homo sapiens
tcccactcccatctc

SEQ ID NO: 5518183 - DNA, 14 bp, Homo sapiens
tcccactcccatgg

SEQ ID NO: 5518184 - DNA, 11 bp, Homo sapiens
tcccactcccg

SEQ ID NO: 5518185 - DNA, 14 bp, Homo sapiens
tcccactcccggcc

SEQ ID NO: 5518186 - DNA, 13 bp, Homo sapiens
tcccactcccttt

SEQ ID NO: 5518187 - DNA, 15 bp, Homo sapiens
tcccactccctttcc

SEQ ID NO: 5518188 - DNA, 18 bp, Homo sapiens
tcccactccctttccaac

SEQ ID NO: 5518189 - DNA, 11 bp, Homo sapiens
tcccactccta

SEQ ID NO: 5518190 - DNA, 20 bp, Homo sapiens
tcccactcctgctgcacagg

SEQ ID NO: 5518191 - DNA, 17 bp, Homo sapiens
tcccactctagggcagt

SEQ ID NO: 5518192 - DNA, 20 bp, Homo sapiens
tcccactctgggcaaagccc

SEQ ID NO: 5518193 - DNA, 16 bp, Homo sapiens
tcccactcttgaagag

SEQ ID NO: 5518194 - DNA, 17 bp, Homo sapiens
tcccactcttgaagagg

SEQ ID NO: 5518195 - DNA, 12 bp, Homo sapiens
tcccactctttg

SEQ ID NO: 5518196 - DNA, 20 bp, Homo sapiens
tcccactgcaacttgtgaac

SEQ ID NO: 5518197 - DNA, 15 bp, Homo sapiens
tcccactgcactcca

SEQ ID NO: 5518198 - DNA, 21 bp, Homo sapiens
tcccactgcactccagcctga

SEQ ID NO: 5518199 - DNA, 17 bp, Homo sapiens
tcccactgcacttggtg

SEQ ID NO: 5518200 - DNA, 18 bp, Homo sapiens
tcccactgccaggatttt

SEQ ID NO: 5518201 - DNA, 19 bp, Homo sapiens
tcccactgcccctgcacct

SEQ ID NO: 5518202 - DNA, 14 bp, Homo sapiens
tcccactgccctgg

SEQ ID NO: 5518203 - DNA, 23 bp, Homo sapiens
tcccactgcctcaggttcctatg

SEQ ID NO: 5518204 - DNA, 17 bp, Homo sapiens
tcccactggctcctcca

SEQ ID NO: 5518205 - DNA, 20 bp, Homo sapiens
tcccactggctcctcccagc

SEQ ID NO: 5518206 - DNA, 11 bp, Homo sapiens
tcccactggga

SEQ ID NO: 5518207 - DNA, 12 bp, Homo sapiens
tcccactgggac

SEQ ID NO: 5518208 - DNA, 13 bp, Homo sapiens
tcccactgggact

SEQ ID NO: 5518209 - DNA, 22 bp, Homo sapiens
tcccactgggactcccagcaga

SEQ ID NO: 5518210 - DNA, 13 bp, Homo sapiens
tcccactggggcc

SEQ ID NO: 5518211 - DNA, 16 bp, Homo sapiens
tcccactgtcctttct

SEQ ID NO: 5518212 - DNA, 18 bp, Homo sapiens
tcccactgtcctttctcc

SEQ ID NO: 5518213 - DNA, 19 bp, Homo sapiens
tcccactgtcctttctcca

SEQ ID NO: 5518214 - DNA, 22 bp, Homo sapiens
tcccactgtcctttctccaggc

SEQ ID NO: 5518215 - DNA, 13 bp, Homo sapiens
tcccactgttctg

SEQ ID NO: 5518216 - DNA, 18 bp, Homo sapiens
tcccacttaaaaattaaa

SEQ ID NO: 5518217 - DNA, 17 bp, Homo sapiens
tcccacttcaaaacaaa

SEQ ID NO: 5518218 - DNA, 14 bp, Homo sapiens
tcccacttcactgt

SEQ ID NO: 5518219 - DNA, 16 bp, Homo sapiens
tcccacttcactgtga

SEQ ID NO: 5518220 - DNA, 14 bp, Homo sapiens
tcccacttcccact

SEQ ID NO: 5518221 - DNA, 15 bp, Homo sapiens
tcccacttccccatc

SEQ ID NO: 5518222 - DNA, 20 bp, Homo sapiens
tcccacttccccatctgtgt

SEQ ID NO: 5518223 - DNA, 21 bp, Homo sapiens
tcccacttccccatctgtgtg

SEQ ID NO: 5518224 - DNA, 15 bp, Homo sapiens
tcccacttcccctcc

SEQ ID NO: 5518225 - DNA, 20 bp, Homo sapiens
tcccacttcccctcctaccc

SEQ ID NO: 5518226 - DNA, 17 bp, Homo sapiens
tcccacttcctcctacc

SEQ ID NO: 5518227 - DNA, 18 bp, Homo sapiens
tcccacttcctcctacct

SEQ ID NO: 5518228 - DNA, 20 bp, Homo sapiens
tcccacttcctcctacctgg

SEQ ID NO: 5518229 - DNA, 12 bp, Homo sapiens
tcccacttcctt

SEQ ID NO: 5518230 - DNA, 13 bp, Homo sapiens
tcccacttggcca

SEQ ID NO: 5518231 - DNA, 14 bp, Homo sapiens
tcccactttctgtt

SEQ ID NO: 5518232 - DNA, 20 bp, Homo sapiens
tcccactttcttctaccaga

SEQ ID NO: 5518233 - DNA, 18 bp, Homo sapiens
tcccactttgtctgtaca

SEQ ID NO: 5518234 - DNA, 19 bp, Homo sapiens
tcccactttgtctgtacat

SEQ ID NO: 5518235 - DNA, 23 bp, Homo sapiens
tcccactttttggtaatatatat

SEQ ID NO: 5518236 - DNA, 20 bp, Homo sapiens
tcccagaaaaactggctctg

SEQ ID NO: 5518237 - DNA, 18 bp, Homo sapiens
tcccagaaacatctctgg

SEQ ID NO: 5518238 - DNA, 19 bp, Homo sapiens
tcccagaaacatctctggc

SEQ ID NO: 5518239 - DNA, 17 bp, Homo sapiens
tcccagaacacactcca

SEQ ID NO: 5518240 - DNA, 22 bp, Homo sapiens
tcccagaacacggcagctgctg

SEQ ID NO: 5518241 - DNA, 11 bp, Homo sapiens
tcccagaacct

SEQ ID NO: 5518242 - DNA, 16 bp, Homo sapiens
tcccagaacctctaag

SEQ ID NO: 5518243 - DNA, 16 bp, Homo sapiens
tcccagaaccttgatg

SEQ ID NO: 5518244 - DNA, 19 bp, Homo sapiens
tcccagaaccttgatgggg

SEQ ID NO: 5518245 - DNA, 20 bp, Homo sapiens
tcccagaaggacctcctgag

SEQ ID NO: 5518246 - DNA, 12 bp, Homo sapiens
tcccagctgcac

SEQ ID NO: 5518247 - DNA, 13 bp, Homo sapiens
tcccagctgcact

SEQ ID NO: 5518248 - DNA, 17 bp, Homo sapiens
tcccagctgcccctccc

SEQ ID NO: 5518249 - DNA, 14 bp, Homo sapiens
tcccagctgcctag

SEQ ID NO: 5518250 - DNA, 11 bp, Homo sapiens
tcccagctgct

SEQ ID NO: 5518251 - DNA, 17 bp, Homo sapiens
tcccagctgctcctaga

SEQ ID NO: 5518252 - DNA, 20 bp, Homo sapiens
tcccagctggtgtcactctg

SEQ ID NO: 5518253 - DNA, 23 bp, Homo sapiens
tcccagctgtaccggccactgca

SEQ ID NO: 5518254 - DNA, 14 bp, Homo sapiens
tcccagctgtctgt

SEQ ID NO: 5518255 - DNA, 17 bp, Homo sapiens
tcccagctgtgctgtgg

SEQ ID NO: 5518256 - DNA, 16 bp, Homo sapiens
tcccagcttcaaatgc

SEQ ID NO: 5518257 - DNA, 15 bp, Homo sapiens
tcccagcttgccccc

SEQ ID NO: 5518258 - DNA, 17 bp, Homo sapiens
tcccagcttgcccccgc

SEQ ID NO: 5518259 - DNA, 18 bp, Homo sapiens
tcccagctttaaaaagaa

SEQ ID NO: 5518260 - DNA, 23 bp, Homo sapiens
tcccaggaacaatcgatggcctt

SEQ ID NO: 5518261 - DNA, 16 bp, Homo sapiens
tcccaggaactgggcc

SEQ ID NO: 5518262 - DNA, 16 bp, Homo sapiens
tcccaggaagcccagg

SEQ ID NO: 5518263 - DNA, 15 bp, Homo sapiens
tcccaggacaagcac

SEQ ID NO: 5518264 - DNA, 15 bp, Homo sapiens
tcccaggacaccaca

SEQ ID NO: 5518265 - DNA, 23 bp, Homo sapiens
tcccaggacaccacacccagcct

SEQ ID NO: 5518266 - DNA, 19 bp, Homo sapiens
tcccaggaccacaggctca

SEQ ID NO: 5518267 - DNA, 13 bp, Homo sapiens
tcccaggaccctg

SEQ ID NO: 5518268 - DNA, 19 bp, Homo sapiens
tcccaggacctgagcctgg

SEQ ID NO: 5518269 - DNA, 20 bp, Homo sapiens
tcccaggacctgagcctggc

SEQ ID NO: 5518270 - DNA, 21 bp, Homo sapiens
tcccaggacctgagcctggcc

SEQ ID NO: 5518271 - DNA, 10 bp, Homo sapiens
tcccaggacg

SEQ ID NO: 5518272 - DNA, 22 bp, Homo sapiens
tcccaggactagagcacaacat

SEQ ID NO: 5518273 - DNA, 22 bp, Homo sapiens
tcccaggagacagttcaagaaa

SEQ ID NO: 5518274 - DNA, 10 bp, Homo sapiens
tcccaggagg

SEQ ID NO: 5518275 - DNA, 12 bp, Homo sapiens
tcccaggagggg

SEQ ID NO: 5518276 - DNA, 15 bp, Homo sapiens
tcccaggaggggcct

SEQ ID NO: 5518277 - DNA, 15 bp, Homo sapiens
tcccaggagttctgc

SEQ ID NO: 5518278 - DNA, 16 bp, Homo sapiens
tcccaggatgagcatc

SEQ ID NO: 5518279 - DNA, 18 bp, Homo sapiens
tcccaggatgctgggtgg

SEQ ID NO: 5518280 - DNA, 14 bp, Homo sapiens
tcccaggcagcgcc

SEQ ID NO: 5518281 - DNA, 19 bp, Homo sapiens
tcccaggcagcgccactgt

SEQ ID NO: 5518282 - DNA, 16 bp, Homo sapiens
tcccaggcatgcagct

SEQ ID NO: 5518283 - DNA, 17 bp, Homo sapiens
tcccaggcatgcagctg

SEQ ID NO: 5518284 - DNA, 22 bp, Homo sapiens
tcccaggcattccccaggaggc

SEQ ID NO: 5518285 - DNA, 23 bp, Homo sapiens
tcccaggcattccccaggaggcc

SEQ ID NO: 5518286 - DNA, 12 bp, Homo sapiens
tcccaggccacc

SEQ ID NO: 5518287 - DNA, 12 bp, Homo sapiens
tcccaggccagc

SEQ ID NO: 5518288 - DNA, 12 bp, Homo sapiens
tcccaggccagg

SEQ ID NO: 5518289 - DNA, 21 bp, Homo sapiens
tcccaggccaggctccttcct

SEQ ID NO: 5518290 - DNA, 11 bp, Homo sapiens
tcccaggcccc

SEQ ID NO: 5518291 - DNA, 14 bp, Homo sapiens
tcccaggccccagg

SEQ ID NO: 5518292 - DNA, 23 bp, Homo sapiens
tcccaggccccatgacctccagc

SEQ ID NO: 5518293 - DNA, 17 bp, Homo sapiens
tcccaggccccctgcat

SEQ ID NO: 5518294 - DNA, 16 bp, Homo sapiens
tcccaggcccctggag

SEQ ID NO: 5518295 - DNA, 19 bp, Homo sapiens
tcccaggccctttggcttc

SEQ ID NO: 5518296 - DNA, 10 bp, Homo sapiens
tcccaggccg

SEQ ID NO: 5518297 - DNA, 16 bp, Homo sapiens
tcccaggcctctgccc

SEQ ID NO: 5518298 - DNA, 20 bp, Homo sapiens
tcccaggcctttggagggga

SEQ ID NO: 5518299 - DNA, 22 bp, Homo sapiens
tcccaggcgatcttgtgtctac

SEQ ID NO: 5518300 - DNA, 16 bp, Homo sapiens
tcccaggcgccccttc

SEQ ID NO: 5518301 - DNA, 20 bp, Homo sapiens
tcccaggcgccccttccccc

SEQ ID NO: 5518302 - DNA, 15 bp, Homo sapiens
tcccaggctgagcct

SEQ ID NO: 5518303 - DNA, 19 bp, Homo sapiens
tcccaggctgagcctcagt

SEQ ID NO: 5518304 - DNA, 14 bp, Homo sapiens
tcccaggctgcccc

SEQ ID NO: 5518305 - DNA, 23 bp, Homo sapiens
tcccaggctgctggagtgcagtg

SEQ ID NO: 5518306 - DNA, 22 bp, Homo sapiens
tcccaggcttcaccctgaatgg

SEQ ID NO: 5518307 - DNA, 22 bp, Homo sapiens
tcccagggaaatatcagccttg

SEQ ID NO: 5518308 - DNA, 18 bp, Homo sapiens
tcccagggaagtgctctg

SEQ ID NO: 5518309 - DNA, 16 bp, Homo sapiens
tcccagggacacctgg

SEQ ID NO: 5518310 - DNA, 12 bp, Homo sapiens
tcccagggacct

SEQ ID NO: 5518311 - DNA, 14 bp, Homo sapiens
tcccagggaccttg

SEQ ID NO: 5518312 - DNA, 16 bp, Homo sapiens
tcccagggaccttgga

SEQ ID NO: 5518313 - DNA, 17 bp, Homo sapiens
tcccagggaccttggaa

SEQ ID NO: 5518314 - DNA, 21 bp, Homo sapiens
tcccagggagcaagggcaggg

SEQ ID NO: 5518315 - DNA, 21 bp, Homo sapiens
tcccagggagcatgagaggag

SEQ ID NO: 5518316 - DNA, 22 bp, Homo sapiens
tcccagggagcatgagaggagg

SEQ ID NO: 5518317 - DNA, 18 bp, Homo sapiens
tcccagggagctctgcat

SEQ ID NO: 5518318 - DNA, 19 bp, Homo sapiens
tcccagggagtgagcagct

SEQ ID NO: 5518319 - DNA, 23 bp, Homo sapiens
tcccagggagtgagcagctactg

SEQ ID NO: 5518320 - DNA, 17 bp, Homo sapiens
tcccagggcacccaggc

SEQ ID NO: 5518321 - DNA, 17 bp, Homo sapiens
tcccagggccagggccc

SEQ ID NO: 5518322 - DNA, 22 bp, Homo sapiens
tcccagggccagggccctgcag

SEQ ID NO: 5518323 - DNA, 19 bp, Homo sapiens
tcccagggccctcccagcc

SEQ ID NO: 5518324 - DNA, 17 bp, Homo sapiens
tcccagggccctggatg

SEQ ID NO: 5518325 - DNA, 14 bp, Homo sapiens
tcccagggcctcct

SEQ ID NO: 5518326 - DNA, 10 bp, Homo sapiens
tcccagggct

SEQ ID NO: 5518327 - DNA, 21 bp, Homo sapiens
tcccagggctactcactcaag

SEQ ID NO: 5518328 - DNA, 13 bp, Homo sapiens
tcccagggctctc

SEQ ID NO: 5518329 - DNA, 17 bp, Homo sapiens
tcccagggctctctgga

SEQ ID NO: 5518330 - DNA, 11 bp, Homo sapiens
tcccagggctg

SEQ ID NO: 5518331 - DNA, 12 bp, Homo sapiens
tcccaggggacc

SEQ ID NO: 5518332 - DNA, 17 bp, Homo sapiens
tcccaggggaccacacc

SEQ ID NO: 5518333 - DNA, 17 bp, Homo sapiens
tcccaggggactgttcc

SEQ ID NO: 5518334 - DNA, 15 bp, Homo sapiens
tcccaggggagccag

SEQ ID NO: 5518335 - DNA, 20 bp, Homo sapiens
tcccaggggagccagctgct

SEQ ID NO: 5518336 - DNA, 23 bp, Homo sapiens
tcccaggggagccagctgcttga

SEQ ID NO: 5518337 - DNA, 17 bp, Homo sapiens
tcccaggggctccacct

SEQ ID NO: 5518338 - DNA, 20 bp, Homo sapiens
tcccaggggtctccctgagc

SEQ ID NO: 5518339 - DNA, 22 bp, Homo sapiens
tcccagggtagcccgcctgcca

SEQ ID NO: 5518340 - DNA, 14 bp, Homo sapiens
tcccagggtcccac

SEQ ID NO: 5518341 - DNA, 12 bp, Homo sapiens
tcccagggtcct

SEQ ID NO: 5518342 - DNA, 11 bp, Homo sapiens
tcccagggtgg

SEQ ID NO: 5518343 - DNA, 20 bp, Homo sapiens
tcccagggtggaggaaggtg

SEQ ID NO: 5518344 - DNA, 18 bp, Homo sapiens
tcccaggtaccagctgcg

SEQ ID NO: 5518345 - DNA, 15 bp, Homo sapiens
tcccaggtagctggg

SEQ ID NO: 5518346 - DNA, 21 bp, Homo sapiens
tcccaggtagctgggattaca

SEQ ID NO: 5518347 - DNA, 15 bp, Homo sapiens
tcccaggtcgggcag

SEQ ID NO: 5518348 - DNA, 18 bp, Homo sapiens
tcccaggtcgggcagtgg

SEQ ID NO: 5518349 - DNA, 20 bp, Homo sapiens
tcccaggtcgggcagtggag

SEQ ID NO: 5518350 - DNA, 17 bp, Homo sapiens
tcccaggtgagaattca

SEQ ID NO: 5518351 - DNA, 22 bp, Homo sapiens
tcccaggtgaggaatttgaagc

SEQ ID NO: 5518352 - DNA, 17 bp, Homo sapiens
tcccaggtgcagccaga

SEQ ID NO: 5518353 - DNA, 21 bp, Homo sapiens
tcccaggtgcgtgtgtctctg

SEQ ID NO: 5518354 - DNA, 15 bp, Homo sapiens
tcccaggttccagca

SEQ ID NO: 5518355 - DNA, 15 bp, Homo sapiens
tcccaggttggctct

SEQ ID NO: 5518356 - DNA, 17 bp, Homo sapiens
tcccaggttggctctgc

SEQ ID NO: 5518357 - DNA, 19 bp, Homo sapiens
tcccaggttggctctgcca

SEQ ID NO: 5518358 - DNA, 20 bp, Homo sapiens
tcccaggttggctctgccag

SEQ ID NO: 5518359 - DNA, 21 bp, Homo sapiens
tcccaggtttcttctctggag

SEQ ID NO: 5518360 - DNA, 21 bp, Homo sapiens
tcccagtaagggcgtggctct

SEQ ID NO: 5518361 - DNA, 22 bp, Homo sapiens
tcccagtaagtttcccctctgg

SEQ ID NO: 5518362 - DNA, 17 bp, Homo sapiens
tcccagtacctcctgtc

SEQ ID NO: 5518363 - DNA, 22 bp, Homo sapiens
tcccagtataagatttttgaaa

SEQ ID NO: 5518364 - DNA, 16 bp, Homo sapiens
tcccagtatacctcat

SEQ ID NO: 5518365 - DNA, 19 bp, Homo sapiens
tcccagtattctcagagca

SEQ ID NO: 5518366 - DNA, 11 bp, Homo sapiens
tcccagtattt

SEQ ID NO: 5518367 - DNA, 22 bp, Homo sapiens
tcccagtcaccttgtggcaagc

SEQ ID NO: 5518368 - DNA, 17 bp, Homo sapiens
tcccagtcactcctctc

SEQ ID NO: 5518369 - DNA, 19 bp, Homo sapiens
tcccagtcactcctctcta

SEQ ID NO: 5518370 - DNA, 20 bp, Homo sapiens
tcccagtccaaatgtcctcc

SEQ ID NO: 5518371 - DNA, 15 bp, Homo sapiens
tcccagtcccagcct

SEQ ID NO: 5518372 - DNA, 19 bp, Homo sapiens
tcccagtcccagcctctgg

SEQ ID NO: 5518373 - DNA, 14 bp, Homo sapiens
tcccagtccctcgc

SEQ ID NO: 5518374 - DNA, 15 bp, Homo sapiens
tcccagtccggtgcc

SEQ ID NO: 5518375 - DNA, 15 bp, Homo sapiens
tcccagtcctccaga

SEQ ID NO: 5518376 - DNA, 17 bp, Homo sapiens
tcccagtcctgatggcc

SEQ ID NO: 5518377 - DNA, 13 bp, Homo sapiens
tcccagtcctgcc

SEQ ID NO: 5518378 - DNA, 15 bp, Homo sapiens
tcccagtcctgcctg

SEQ ID NO: 5518379 - DNA, 16 bp, Homo sapiens
tcccagtcctgcctga

SEQ ID NO: 5518380 - DNA, 16 bp, Homo sapiens
tcccagtctctggcag

SEQ ID NO: 5518381 - DNA, 19 bp, Homo sapiens
tcccagtgaactcctgcca

SEQ ID NO: 5518382 - DNA, 18 bp, Homo sapiens
tcccagtgaataaatatt

SEQ ID NO: 5518383 - DNA, 19 bp, Homo sapiens
tcccagtgacacttcagag

SEQ ID NO: 5518384 - DNA, 20 bp, Homo sapiens
tcccagtgagcctctgcgcc

SEQ ID NO: 5518385 - DNA, 22 bp, Homo sapiens
tcccagtgccgagaaggaagcc

SEQ ID NO: 5518386 - DNA, 14 bp, Homo sapiens
tcccagtgccttct

SEQ ID NO: 5518387 - DNA, 12 bp, Homo sapiens
tcccagtggcct

SEQ ID NO: 5518388 - DNA, 10 bp, Homo sapiens
tcccagtggg

SEQ ID NO: 5518389 - DNA, 15 bp, Homo sapiens
tcccagtgggagggg

SEQ ID NO: 5518390 - DNA, 21 bp, Homo sapiens
tcccagtgggaggggcaggct

SEQ ID NO: 5518391 - DNA, 17 bp, Homo sapiens
tcccagtgggtgatgct

SEQ ID NO: 5518392 - DNA, 20 bp, Homo sapiens
tcccagtgtcagtatttact

SEQ ID NO: 5518393 - DNA, 16 bp, Homo sapiens
tcccagtgtctggccc

SEQ ID NO: 5518394 - DNA, 17 bp, Homo sapiens
tcccagtgtctggccca

SEQ ID NO: 5518395 - DNA, 18 bp, Homo sapiens
tcccagtgtctggcccag

SEQ ID NO: 5518396 - DNA, 17 bp, Homo sapiens
tcccagtgtcttcctgt

SEQ ID NO: 5518397 - DNA, 13 bp, Homo sapiens
tcccagttcatgt

SEQ ID NO: 5518398 - DNA, 17 bp, Homo sapiens
tcccagttcatgttgct

SEQ ID NO: 5518399 - DNA, 18 bp, Homo sapiens
tcccagttctacaagcat

SEQ ID NO: 5518400 - DNA, 20 bp, Homo sapiens
tcccagttggggaagccagg

SEQ ID NO: 5518401 - DNA, 14 bp, Homo sapiens
tcccagttgtccgt

SEQ ID NO: 5518402 - DNA, 13 bp, Homo sapiens
tcccagttttgtt

SEQ ID NO: 5518403 - DNA, 20 bp, Homo sapiens
tcccataaaatgtaagaaaa

SEQ ID NO: 5518404 - DNA, 16 bp, Homo sapiens
tcccataaagaaagtg

SEQ ID NO: 5518405 - DNA, 22 bp, Homo sapiens
tcccataaccgctgattctcag

SEQ ID NO: 5518406 - DNA, 12 bp, Homo sapiens
tcccataagcta

SEQ ID NO: 5518407 - DNA, 21 bp, Homo sapiens
tcccataattgctttgccaaa

SEQ ID NO: 5518408 - DNA, 17 bp, Homo sapiens
tcccatagccaggaaac

SEQ ID NO: 5518409 - DNA, 17 bp, Homo sapiens
tcccatagcccttacct

SEQ ID NO: 5518410 - DNA, 17 bp, Homo sapiens
tcccatagcgctggctc

SEQ ID NO: 5518411 - DNA, 21 bp, Homo sapiens
tcccatatatttaatatgtca

SEQ ID NO: 5518412 - DNA, 22 bp, Homo sapiens
tcccatatatttaatatgtcaa

SEQ ID NO: 5518413 - DNA, 14 bp, Homo sapiens
tcccatatcatata

SEQ ID NO: 5518414 - DNA, 15 bp, Homo sapiens
tcccatatcctgcct

SEQ ID NO: 5518415 - DNA, 17 bp, Homo sapiens
tcccatatcttgccttc

SEQ ID NO: 5518416 - DNA, 13 bp, Homo sapiens
tcccatatttact

SEQ ID NO: 5518417 - DNA, 17 bp, Homo sapiens
tcccatcaccccttccc

SEQ ID NO: 5518418 - DNA, 17 bp, Homo sapiens
tcccatcactgctgtcc

SEQ ID NO: 5518419 - DNA, 22 bp, Homo sapiens
tcccatcattacccttccctgc

SEQ ID NO: 5518420 - DNA, 11 bp, Homo sapiens
tcccatccagc

SEQ ID NO: 5518421 - DNA, 15 bp, Homo sapiens
tcccatccagcgtct

SEQ ID NO: 5518422 - DNA, 17 bp, Homo sapiens
tcccatccagcgtctgc

SEQ ID NO: 5518423 - DNA, 17 bp, Homo sapiens
tcccatccagctaccac

SEQ ID NO: 5518424 - DNA, 13 bp, Homo sapiens
tcccatccaggca

SEQ ID NO: 5518425 - DNA, 22 bp, Homo sapiens
tccccaaccgtgtctgtctggc

SEQ ID NO: 5518426 - DNA, 15 bp, Homo sapiens
tccccaacctgcaat

SEQ ID NO: 5518427 - DNA, 19 bp, Homo sapiens
tccccaacctgcaataaat

SEQ ID NO: 5518428 - DNA, 15 bp, Homo sapiens
tccccaacgtcccct

SEQ ID NO: 5518429 - DNA, 13 bp, Homo sapiens
tccccaactccct

SEQ ID NO: 5518430 - DNA, 17 bp, Homo sapiens
tccccaactccttcctc

SEQ ID NO: 5518431 - DNA, 17 bp, Homo sapiens
tccccaactgctccagc

SEQ ID NO: 5518432 - DNA, 17 bp, Homo sapiens
tccccaagaaagcctca

SEQ ID NO: 5518433 - DNA, 20 bp, Homo sapiens
tccccaagacacttcccctt

SEQ ID NO: 5518434 - DNA, 17 bp, Homo sapiens
tccccaagatctgccag

SEQ ID NO: 5518435 - DNA, 16 bp, Homo sapiens
tccccaagcctggcag

SEQ ID NO: 5518436 - DNA, 17 bp, Homo sapiens
tccccaagcctggcagg

SEQ ID NO: 5518437 - DNA, 14 bp, Homo sapiens
tccccaagctggcc

SEQ ID NO: 5518438 - DNA, 13 bp, Homo sapiens
tccccaaggaaga

SEQ ID NO: 5518439 - DNA, 17 bp, Homo sapiens
tccccaaggatgaccac

SEQ ID NO: 5518440 - DNA, 23 bp, Homo sapiens
tccccaaggccccctgcctgccc

SEQ ID NO: 5518441 - DNA, 14 bp, Homo sapiens
tccccaaggcctct

SEQ ID NO: 5518442 - DNA, 22 bp, Homo sapiens
tccccaaggcctctctctgcct

SEQ ID NO: 5518443 - DNA, 23 bp, Homo sapiens
tccccaaggcctctctctgcctg

SEQ ID NO: 5518444 - DNA, 18 bp, Homo sapiens
tccccaagggccaaaccc

SEQ ID NO: 5518445 - DNA, 19 bp, Homo sapiens
tccccaagggccaaaccca

SEQ ID NO: 5518446 - DNA, 21 bp, Homo sapiens
tccccaagggccaaacccact

SEQ ID NO: 5518447 - DNA, 19 bp, Homo sapiens
tccccaagggccctggcac

SEQ ID NO: 5518448 - DNA, 17 bp, Homo sapiens
tccccaataaagccttt

SEQ ID NO: 5518449 - DNA, 22 bp, Homo sapiens
tccccaatccaacccatgcatg

SEQ ID NO: 5518450 - DNA, 17 bp, Homo sapiens
tccccaatccctgaccc

SEQ ID NO: 5518451 - DNA, 21 bp, Homo sapiens
tccccaatgctgtacctggct

SEQ ID NO: 5518452 - DNA, 23 bp, Homo sapiens
tccccaattacagggtgactcac

SEQ ID NO: 5518453 - DNA, 16 bp, Homo sapiens
tccccaattctcccct

SEQ ID NO: 5518454 - DNA, 21 bp, Homo sapiens
tccccaattctgcctgcctcc

SEQ ID NO: 5518455 - DNA, 17 bp, Homo sapiens
tccccacacacaggcct

SEQ ID NO: 5518456 - DNA, 18 bp, Homo sapiens
tccccacacacaggcctt

SEQ ID NO: 5518457 - DNA, 21 bp, Homo sapiens
tccccacacacaggccttctg

SEQ ID NO: 5518458 - DNA, 16 bp, Homo sapiens
tccccacacagcctct

SEQ ID NO: 5518459 - DNA, 14 bp, Homo sapiens
tccccacacagggc

SEQ ID NO: 5518460 - DNA, 21 bp, Homo sapiens
tccccacacagggcactgact

SEQ ID NO: 5518461 - DNA, 15 bp, Homo sapiens
tccccacaccctgga

SEQ ID NO: 5518462 - DNA, 19 bp, Homo sapiens
tccccacaccttccagggc

SEQ ID NO: 5518463 - DNA, 16 bp, Homo sapiens
tccccacactccactc

SEQ ID NO: 5518464 - DNA, 20 bp, Homo sapiens
tccccacactccactctgat

SEQ ID NO: 5518465 - DNA, 14 bp, Homo sapiens
tccccacactccta

SEQ ID NO: 5518466 - DNA, 22 bp, Homo sapiens
tccccacagactgccccagcca

SEQ ID NO: 5518467 - DNA, 12 bp, Homo sapiens
tccccacagcct

SEQ ID NO: 5518468 - DNA, 20 bp, Homo sapiens
tccccacagcctctggctcc

SEQ ID NO: 5518469 - DNA, 21 bp, Homo sapiens
tccccacagcctctggctcca

SEQ ID NO: 5518470 - DNA, 17 bp, Homo sapiens
tccccacagcgtccctg

SEQ ID NO: 5518471 - DNA, 19 bp, Homo sapiens
tccccacagctttgcaccc

SEQ ID NO: 5518472 - DNA, 23 bp, Homo sapiens
tccccacaggcacattaactgtt

SEQ ID NO: 5518473 - DNA, 15 bp, Homo sapiens
tccccacaggtgaaa

SEQ ID NO: 5518474 - DNA, 20 bp, Homo sapiens
tccccacagtcctcacagcc

SEQ ID NO: 5518475 - DNA, 23 bp, Homo sapiens
tccccacagtcctcacagcctct

SEQ ID NO: 5518476 - DNA, 15 bp, Homo sapiens
tccccacagtgccac

SEQ ID NO: 5518477 - DNA, 19 bp, Homo sapiens
tccccacagtgccacccat

SEQ ID NO: 5518478 - DNA, 17 bp, Homo sapiens
tccccacattctatagc

SEQ ID NO: 5518479 - DNA, 15 bp, Homo sapiens
tccccaccagagctg

SEQ ID NO: 5518480 - DNA, 18 bp, Homo sapiens
tccccaccagagctgcct

SEQ ID NO: 5518481 - DNA, 20 bp, Homo sapiens
tccccaccagagctgcctcc

SEQ ID NO: 5518482 - DNA, 15 bp, Homo sapiens
tccccaccagatgct

SEQ ID NO: 5518483 - DNA, 12 bp, Homo sapiens
tccccaccagct

SEQ ID NO: 5518484 - DNA, 13 bp, Homo sapiens
tccccaccagtga

SEQ ID NO: 5518485 - DNA, 22 bp, Homo sapiens
tccccacccaccaaccctcagg

SEQ ID NO: 5518486 - DNA, 15 bp, Homo sapiens
tccccacccatgcgc

SEQ ID NO: 5518487 - DNA, 17 bp, Homo sapiens
tccccaccccagtggga

SEQ ID NO: 5518488 - DNA, 12 bp, Homo sapiens
tccccacccctc

SEQ ID NO: 5518489 - DNA, 22 bp, Homo sapiens
tccccacccctgcccccagccc

SEQ ID NO: 5518490 - DNA, 13 bp, Homo sapiens
tccccaccccttc

SEQ ID NO: 5518491 - DNA, 15 bp, Homo sapiens
tccccaccctcccct

SEQ ID NO: 5518492 - DNA, 20 bp, Homo sapiens
tccccaccctcctcttggaa

SEQ ID NO: 5518493 - DNA, 22 bp, Homo sapiens
tccccaccctcctggcctcaga

SEQ ID NO: 5518494 - DNA, 17 bp, Homo sapiens
tccccacccttgagaag

SEQ ID NO: 5518495 - DNA, 15 bp, Homo sapiens
tccccaccgcagaca

SEQ ID NO: 5518496 - DNA, 11 bp, Homo sapiens
tccccacctct

SEQ ID NO: 5518497 - DNA, 15 bp, Homo sapiens
tccccacctgctcac

SEQ ID NO: 5518498 - DNA, 14 bp, Homo sapiens
tccccacctgggac

SEQ ID NO: 5518499 - DNA, 16 bp, Homo sapiens
tccccaccttccaagg

SEQ ID NO: 5518500 - DNA, 20 bp, Homo sapiens
tccccaccttccccagactc

SEQ ID NO: 5518501 - DNA, 20 bp, Homo sapiens
tccccacgacccctgcctcg

SEQ ID NO: 5518502 - DNA, 22 bp, Homo sapiens
tccccacgaggggacccatggg

SEQ ID NO: 5518503 - DNA, 20 bp, Homo sapiens
tccccacgagtcacctgcaa

SEQ ID NO: 5518504 - DNA, 15 bp, Homo sapiens
tccccacgccacagc

SEQ ID NO: 5518505 - DNA, 16 bp, Homo sapiens
tccccacgccacagcc

SEQ ID NO: 5518506 - DNA, 14 bp, Homo sapiens
tccccacgccctcc

SEQ ID NO: 5518507 - DNA, 18 bp, Homo sapiens
tccccactcagccttttg

SEQ ID NO: 5518508 - DNA, 13 bp, Homo sapiens
tccccactcccgt

SEQ ID NO: 5518509 - DNA, 17 bp, Homo sapiens
tccccactcccgtgatg

SEQ ID NO: 5518510 - DNA, 22 bp, Homo sapiens
tccccactccctggctctcaga

SEQ ID NO: 5518511 - DNA, 14 bp, Homo sapiens
tccccactccctgt

SEQ ID NO: 5518512 - DNA, 13 bp, Homo sapiens
tccccactcctcc

SEQ ID NO: 5518513 - DNA, 18 bp, Homo sapiens
tccccactcctctcccac

SEQ ID NO: 5518514 - DNA, 20 bp, Homo sapiens
tccccactctgctcccagcc

SEQ ID NO: 5518515 - DNA, 17 bp, Homo sapiens
tccccactctgctctga

SEQ ID NO: 5518516 - DNA, 18 bp, Homo sapiens
tccccactctgctctgat

SEQ ID NO: 5518517 - DNA, 19 bp, Homo sapiens
tccccactgacagcctccc

SEQ ID NO: 5518518 - DNA, 15 bp, Homo sapiens
tccccactgctgagc

SEQ ID NO: 5518519 - DNA, 15 bp, Homo sapiens
tccccactggagcag

SEQ ID NO: 5518520 - DNA, 14 bp, Homo sapiens
tccccactgtccta

SEQ ID NO: 5518521 - DNA, 21 bp, Homo sapiens
tccccagaactctgcctgccc

SEQ ID NO: 5518522 - DNA, 16 bp, Homo sapiens
tccccagaactggctg

SEQ ID NO: 5518523 - DNA, 19 bp, Homo sapiens
tccccagaactggctgggc

SEQ ID NO: 5518524 - DNA, 20 bp, Homo sapiens
tccccagaactggctgggcc

SEQ ID NO: 5518525 - DNA, 23 bp, Homo sapiens
tccccagaactggctgggcccct

SEQ ID NO: 5518526 - DNA, 11 bp, Homo sapiens
tccccagacac

SEQ ID NO: 5518527 - DNA, 14 bp, Homo sapiens
tccccagacacatt

SEQ ID NO: 5518528 - DNA, 18 bp, Homo sapiens
tccccagacagggctcca

SEQ ID NO: 5518529 - DNA, 20 bp, Homo sapiens
tccccagacagggctccagc

SEQ ID NO: 5518530 - DNA, 21 bp, Homo sapiens
tccccagaccagtagtgacca

SEQ ID NO: 5518531 - DNA, 21 bp, Homo sapiens
tccccagacccagaggtccag

SEQ ID NO: 5518532 - DNA, 22 bp, Homo sapiens
tccccagacccttcttgcctgc

SEQ ID NO: 5518533 - DNA, 23 bp, Homo sapiens
tccccagacccttcttgcctgct

SEQ ID NO: 5518534 - DNA, 21 bp, Homo sapiens
tccccagacgcctggctgctg

SEQ ID NO: 5518535 - DNA, 17 bp, Homo sapiens
tccccagactcagctcc

SEQ ID NO: 5518536 - DNA, 22 bp, Homo sapiens
tccccagactccaccaagcctg

SEQ ID NO: 5518537 - DNA, 17 bp, Homo sapiens
tccccagactctgccta

SEQ ID NO: 5518538 - DNA, 20 bp, Homo sapiens
tccccagacttctctttctt

SEQ ID NO: 5518539 - DNA, 14 bp, Homo sapiens
tccccagacttgca

SEQ ID NO: 5518540 - DNA, 19 bp, Homo sapiens
tccccagacttgcactggg

SEQ ID NO: 5518541 - DNA, 11 bp, Homo sapiens
tccccagagaa

SEQ ID NO: 5518542 - DNA, 17 bp, Homo sapiens
tccccagagaaagcgca

SEQ ID NO: 5518543 - DNA, 23 bp, Homo sapiens
tccccagagaaagcgcagatgct

SEQ ID NO: 5518544 - DNA, 19 bp, Homo sapiens
tccccagagagcaggcagg

SEQ ID NO: 5518545 - DNA, 23 bp, Homo sapiens
tccccagagagcaggcaggggca

SEQ ID NO: 5518546 - DNA, 19 bp, Homo sapiens
tccccagagaggcactcag

SEQ ID NO: 5518547 - DNA, 16 bp, Homo sapiens
tccccagagcccagct

SEQ ID NO: 5518548 - DNA, 20 bp, Homo sapiens
tccccagagcccagctcttg

SEQ ID NO: 5518549 - DNA, 14 bp, Homo sapiens
tccccagagccctg

SEQ ID NO: 5518550 - DNA, 16 bp, Homo sapiens
tccccagagccctgca

SEQ ID NO: 5518551 - DNA, 19 bp, Homo sapiens
tccccagagccctgcagtc

SEQ ID NO: 5518552 - DNA, 12 bp, Homo sapiens
tccccagagctg

SEQ ID NO: 5518553 - DNA, 17 bp, Homo sapiens
tccccagagctgcctgc

SEQ ID NO: 5518554 - DNA, 15 bp, Homo sapiens
tccccagagctggcg

SEQ ID NO: 5518555 - DNA, 20 bp, Homo sapiens
tccccagagctggcgctcag

SEQ ID NO: 5518556 - DNA, 16 bp, Homo sapiens
tccccagagctgtgcc

SEQ ID NO: 5518557 - DNA, 20 bp, Homo sapiens
tccccagagctgtgccagca

SEQ ID NO: 5518558 - DNA, 21 bp, Homo sapiens
tccccagagctgtgccagcag

SEQ ID NO: 5518559 - DNA, 18 bp, Homo sapiens
tccccagagttccccatg

SEQ ID NO: 5518560 - DNA, 20 bp, Homo sapiens
tccccagagttccccatgca

SEQ ID NO: 5518561 - DNA, 18 bp, Homo sapiens
tccccagattgcaacagg

SEQ ID NO: 5518562 - DNA, 19 bp, Homo sapiens
tccccagattgcaacaggc

SEQ ID NO: 5518563 - DNA, 20 bp, Homo sapiens
tccccagcaagtgagagctg

SEQ ID NO: 5518564 - DNA, 19 bp, Homo sapiens
tccccagcaggtggggagg

SEQ ID NO: 5518565 - DNA, 12 bp, Homo sapiens
tccccagccaca

SEQ ID NO: 5518566 - DNA, 14 bp, Homo sapiens
tccccagccagaag

SEQ ID NO: 5518567 - DNA, 15 bp, Homo sapiens
tccccagccagccct

SEQ ID NO: 5518568 - DNA, 17 bp, Homo sapiens
tccccagccagcccttc

SEQ ID NO: 5518569 - DNA, 14 bp, Homo sapiens
tccccagccagcct

SEQ ID NO: 5518570 - DNA, 20 bp, Homo sapiens
tccccagccagggagcttgc

SEQ ID NO: 5518571 - DNA, 23 bp, Homo sapiens
tccccagccagggagcttgccac

SEQ ID NO: 5518572 - DNA, 10 bp, Homo sapiens
tccccagccc

SEQ ID NO: 5518573 - DNA, 13 bp, Homo sapiens
tccccagcccacc

SEQ ID NO: 5518574 - DNA, 19 bp, Homo sapiens
tccccagcccactggatca

SEQ ID NO: 5518575 - DNA, 17 bp, Homo sapiens
tccccagcccagcaccc

SEQ ID NO: 5518576 - DNA, 22 bp, Homo sapiens
tccccagcccagcaccccttcc

SEQ ID NO: 5518577 - DNA, 13 bp, Homo sapiens
tccccagcccagg

SEQ ID NO: 5518578 - DNA, 17 bp, Homo sapiens
tccccagcccaggaaaa

SEQ ID NO: 5518579 - DNA, 15 bp, Homo sapiens
tccccagcccagggt

SEQ ID NO: 5518580 - DNA, 20 bp, Homo sapiens
tccccagccccagccccttc

SEQ ID NO: 5518581 - DNA, 20 bp, Homo sapiens
tccccagcccccacccatgc

SEQ ID NO: 5518582 - DNA, 17 bp, Homo sapiens
tccccagccccctccca

SEQ ID NO: 5518583 - DNA, 19 bp, Homo sapiens
tccccagcccctagcccag

SEQ ID NO: 5518584 - DNA, 23 bp, Homo sapiens
tccccagcccctcctccctcaga

SEQ ID NO: 5518585 - DNA, 12 bp, Homo sapiens
tccccagccctg

SEQ ID NO: 5518586 - DNA, 13 bp, Homo sapiens
tccccagccctgg

SEQ ID NO: 5518587 - DNA, 21 bp, Homo sapiens
tccccagccctgggcttggct

SEQ ID NO: 5518588 - DNA, 23 bp, Homo sapiens
tccccagccctgggcttggctct

SEQ ID NO: 5518589 - DNA, 14 bp, Homo sapiens
tccccagccctgtc

SEQ ID NO: 5518590 - DNA, 18 bp, Homo sapiens
tccccagccctgtcctgg

SEQ ID NO: 5518591 - DNA, 19 bp, Homo sapiens
tccccagcccttagcacag

SEQ ID NO: 5518592 - DNA, 18 bp, Homo sapiens
tccccagcccttcctctg

SEQ ID NO: 5518593 - DNA, 22 bp, Homo sapiens
tccccagcccttcctctgctcc

SEQ ID NO: 5518594 - DNA, 14 bp, Homo sapiens
tccccagcccttct

SEQ ID NO: 5518595 - DNA, 16 bp, Homo sapiens
tccccagcccttctgc

SEQ ID NO: 5518596 - DNA, 15 bp, Homo sapiens
tccccagccctttgc

SEQ ID NO: 5518597 - DNA, 14 bp, Homo sapiens
tccccagcctagga

SEQ ID NO: 5518598 - DNA, 12 bp, Homo sapiens
tccccagcctct

SEQ ID NO: 5518599 - DNA, 12 bp, Homo sapiens
tccccagcctgc

SEQ ID NO: 5518600 - DNA, 14 bp, Homo sapiens
tccccagcctgcgc

SEQ ID NO: 5518601 - DNA, 21 bp, Homo sapiens
tccccagcctgggcccatctc

SEQ ID NO: 5518602 - DNA, 20 bp, Homo sapiens
tcccccagccatgccagctg

SEQ ID NO: 5518603 - DNA, 20 bp, Homo sapiens
tcccccagccccatcctctg

SEQ ID NO: 5518604 - DNA, 22 bp, Homo sapiens
tcccccagccccatcctctgta

SEQ ID NO: 5518605 - DNA, 13 bp, Homo sapiens
tcccccagccctc

SEQ ID NO: 5518606 - DNA, 16 bp, Homo sapiens
tcccccagccctcagt

SEQ ID NO: 5518607 - DNA, 17 bp, Homo sapiens
tcccccagccctgtgga

SEQ ID NO: 5518608 - DNA, 18 bp, Homo sapiens
tcccccagcgcttagaaa

SEQ ID NO: 5518609 - DNA, 12 bp, Homo sapiens
tcccccagctcc

SEQ ID NO: 5518610 - DNA, 18 bp, Homo sapiens
tcccccagctctggtgag

SEQ ID NO: 5518611 - DNA, 13 bp, Homo sapiens
tcccccagctgcg

SEQ ID NO: 5518612 - DNA, 15 bp, Homo sapiens
tcccccagctgcgtt

SEQ ID NO: 5518613 - DNA, 14 bp, Homo sapiens
tcccccaggagcag

SEQ ID NO: 5518614 - DNA, 20 bp, Homo sapiens
tcccccaggagcagctggca

SEQ ID NO: 5518615 - DNA, 22 bp, Homo sapiens
tcccccaggagcagctggcact

SEQ ID NO: 5518616 - DNA, 23 bp, Homo sapiens
tcccccaggagcagctggcactg

SEQ ID NO: 5518617 - DNA, 16 bp, Homo sapiens
tcccccaggaggcagc

SEQ ID NO: 5518618 - DNA, 14 bp, Homo sapiens
tcccccaggcagaa

SEQ ID NO: 5518619 - DNA, 13 bp, Homo sapiens
tcccccaggctgc

SEQ ID NO: 5518620 - DNA, 14 bp, Homo sapiens
tcccccaggctgtt

SEQ ID NO: 5518621 - DNA, 17 bp, Homo sapiens
tcccccaggctgttctc

SEQ ID NO: 5518622 - DNA, 12 bp, Homo sapiens
tcccccagggtc

SEQ ID NO: 5518623 - DNA, 12 bp, Homo sapiens
tcccccatagcc

SEQ ID NO: 5518624 - DNA, 23 bp, Homo sapiens
tcccccatcatgtggcccaactc

SEQ ID NO: 5518625 - DNA, 18 bp, Homo sapiens
tcccccatcccctttcct

SEQ ID NO: 5518626 - DNA, 12 bp, Homo sapiens
tcccccatcctt

SEQ ID NO: 5518627 - DNA, 13 bp, Homo sapiens
tcccccatctccc

SEQ ID NO: 5518628 - DNA, 15 bp, Homo sapiens
tcccccatctcccac

SEQ ID NO: 5518629 - DNA, 17 bp, Homo sapiens
tcccccatctcccaccc

SEQ ID NO: 5518630 - DNA, 13 bp, Homo sapiens
tcccccatcttca

SEQ ID NO: 5518631 - DNA, 15 bp, Homo sapiens
tcccccatcttcatc

SEQ ID NO: 5518632 - DNA, 15 bp, Homo sapiens
tcccccatgccacca

SEQ ID NO: 5518633 - DNA, 16 bp, Homo sapiens
tcccccatgccaccac

SEQ ID NO: 5518634 - DNA, 15 bp, Homo sapiens
tcccccatgtggctg

SEQ ID NO: 5518635 - DNA, 16 bp, Homo sapiens
tcccccatgttctgtc

SEQ ID NO: 5518636 - DNA, 17 bp, Homo sapiens
tcccccatttttcccag

SEQ ID NO: 5518637 - DNA, 13 bp, Homo sapiens
tccccccaaatct

SEQ ID NO: 5518638 - DNA, 12 bp, Homo sapiens
tccccccaccgc

SEQ ID NO: 5518639 - DNA, 18 bp, Homo sapiens
tccccccactccctcaca

SEQ ID NO: 5518640 - DNA, 18 bp, Homo sapiens
tccccccactgcaggccc

SEQ ID NO: 5518641 - DNA, 11 bp, Homo sapiens
tccccccactt

SEQ ID NO: 5518642 - DNA, 12 bp, Homo sapiens
tccccccagacc

SEQ ID NO: 5518643 - DNA, 14 bp, Homo sapiens
tccccccagcccct

SEQ ID NO: 5518644 - DNA, 22 bp, Homo sapiens
tccccccagcccctcctcccct

SEQ ID NO: 5518645 - DNA, 19 bp, Homo sapiens
tccccccagctccctgcac

SEQ ID NO: 5518646 - DNA, 21 bp, Homo sapiens
tccccccatagagaccaggag

SEQ ID NO: 5518647 - DNA, 16 bp, Homo sapiens
tccccccatcccaggg

SEQ ID NO: 5518648 - DNA, 13 bp, Homo sapiens
tccccccatcccg

SEQ ID NO: 5518649 - DNA, 22 bp, Homo sapiens
tccccccatcttgcttccctaa

SEQ ID NO: 5518650 - DNA, 14 bp, Homo sapiens
tcccccccagtgca

SEQ ID NO: 5518651 - DNA, 13 bp, Homo sapiens
tcccccccatgca

SEQ ID NO: 5518652 - DNA, 17 bp, Homo sapiens
tcccccccatgcactgt

SEQ ID NO: 5518653 - DNA, 19 bp, Homo sapiens
tccccccccaacctttccc

SEQ ID NO: 5518654 - DNA, 14 bp, Homo sapiens
tcccccccggggct

SEQ ID NO: 5518655 - DNA, 18 bp, Homo sapiens
tccccccgaccagatcct

SEQ ID NO: 5518656 - DNA, 14 bp, Homo sapiens
tccccccgcccacc

SEQ ID NO: 5518657 - DNA, 14 bp, Homo sapiens
tcccccctcaccag

SEQ ID NO: 5518658 - DNA, 14 bp, Homo sapiens
tcccccctccattc

SEQ ID NO: 5518659 - DNA, 15 bp, Homo sapiens
tcccccctcctctga

SEQ ID NO: 5518660 - DNA, 17 bp, Homo sapiens
tcccccctcctctgaaa

SEQ ID NO: 5518661 - DNA, 21 bp, Homo sapiens
tcccccctctcctcccagctg

SEQ ID NO: 5518662 - DNA, 13 bp, Homo sapiens
tcccccctgctgc

SEQ ID NO: 5518663 - DNA, 14 bp, Homo sapiens
tcccccctgctgcc

SEQ ID NO: 5518664 - DNA, 18 bp, Homo sapiens
tcccccctgctgcccagt

SEQ ID NO: 5518665 - DNA, 20 bp, Homo sapiens
tcccccctgctgcccagtgc

SEQ ID NO: 5518666 - DNA, 13 bp, Homo sapiens
tcccccctgtggt

SEQ ID NO: 5518667 - DNA, 18 bp, Homo sapiens
tcccccctgtggtctgtg

SEQ ID NO: 5518668 - DNA, 17 bp, Homo sapiens
tcccccgacactgctgc

SEQ ID NO: 5518669 - DNA, 18 bp, Homo sapiens
tcccccgacactgctgca

SEQ ID NO: 5518670 - DNA, 19 bp, Homo sapiens
tcccccgacactgctgcac

SEQ ID NO: 5518671 - DNA, 20 bp, Homo sapiens
tcccccgaccaatccccagc

SEQ ID NO: 5518672 - DNA, 13 bp, Homo sapiens
tcccccgagctct

SEQ ID NO: 5518673 - DNA, 21 bp, Homo sapiens
tcccccgcagtccccagccct

SEQ ID NO: 5518674 - DNA, 14 bp, Homo sapiens
tcccccgccacctg

SEQ ID NO: 5518675 - DNA, 15 bp, Homo sapiens
tcccccgccccatcc

SEQ ID NO: 5518676 - DNA, 17 bp, Homo sapiens
tcccccgccccatcctc

SEQ ID NO: 5518677 - DNA, 16 bp, Homo sapiens
tcccccgctggcagcc

SEQ ID NO: 5518678 - DNA, 15 bp, Homo sapiens
tcccccggctgggcc

SEQ ID NO: 5518679 - DNA, 16 bp, Homo sapiens
tcccccggtgcctctc

SEQ ID NO: 5518680 - DNA, 17 bp, Homo sapiens
tcccccgtggtgcctgc

SEQ ID NO: 5518681 - DNA, 18 bp, Homo sapiens
tcccccgtggtgcctgca

SEQ ID NO: 5518682 - DNA, 17 bp, Homo sapiens
tcccccgttgtgcctgg

SEQ ID NO: 5518683 - DNA, 20 bp, Homo sapiens
tcccccgttgtgcctggttc

SEQ ID NO: 5518684 - DNA, 19 bp, Homo sapiens
tcccccgtttctccttttc

SEQ ID NO: 5518685 - DNA, 20 bp, Homo sapiens
tccccctacagatcctccgc

SEQ ID NO: 5518686 - DNA, 14 bp, Homo sapiens
tccccctacccacc

SEQ ID NO: 5518687 - DNA, 15 bp, Homo sapiens
tccccctagccattt

SEQ ID NO: 5518688 - DNA, 21 bp, Homo sapiens
tccccctagtccggttcttct

SEQ ID NO: 5518689 - DNA, 15 bp, Homo sapiens
tccccctatccttgg

SEQ ID NO: 5518690 - DNA, 13 bp, Homo sapiens
tccccctatgctc

SEQ ID NO: 5518691 - DNA, 21 bp, Homo sapiens
tccccctatgctccagtatgg

SEQ ID NO: 5518692 - DNA, 20 bp, Homo sapiens
tccccctatttattgacttt

SEQ ID NO: 5518693 - DNA, 21 bp, Homo sapiens
tccccctatttattgactttg

SEQ ID NO: 5518694 - DNA, 17 bp, Homo sapiens
tccccctcaacctcacc

SEQ ID NO: 5518695 - DNA, 17 bp, Homo sapiens
tccccctcacccccacc

SEQ ID NO: 5518696 - DNA, 18 bp, Homo sapiens
tccccctcacccccacct

SEQ ID NO: 5518697 - DNA, 17 bp, Homo sapiens
tccccctcagctctccc

SEQ ID NO: 5518698 - DNA, 22 bp, Homo sapiens
tccccctccagtgcttggctgc

SEQ ID NO: 5518699 - DNA, 17 bp, Homo sapiens
tccccctcccagggcca

SEQ ID NO: 5518700 - DNA, 18 bp, Homo sapiens
tccccctccccctcctgc

SEQ ID NO: 5518701 - DNA, 18 bp, Homo sapiens
tccccctcccccttctcc

SEQ ID NO: 5518702 - DNA, 20 bp, Homo sapiens
tccccctccccggccacatg

SEQ ID NO: 5518703 - DNA, 17 bp, Homo sapiens
tccccctcccctcccag

SEQ ID NO: 5518704 - DNA, 15 bp, Homo sapiens
tccccctcctagggg

SEQ ID NO: 5518705 - DNA, 12 bp, Homo sapiens
tccccctcctca

SEQ ID NO: 5518706 - DNA, 16 bp, Homo sapiens
tccccctcctcagcca

SEQ ID NO: 5518707 - DNA, 14 bp, Homo sapiens
tccccctcctccat

SEQ ID NO: 5518708 - DNA, 17 bp, Homo sapiens
tccccctcctccatgct

SEQ ID NO: 5518709 - DNA, 18 bp, Homo sapiens
tccccctcctctccacca

SEQ ID NO: 5518710 - DNA, 12 bp, Homo sapiens
tccccctcctgc

SEQ ID NO: 5518711 - DNA, 13 bp, Homo sapiens
tccccctcctgca

SEQ ID NO: 5518712 - DNA, 16 bp, Homo sapiens
tccccctcctgctgtg

SEQ ID NO: 5518713 - DNA, 20 bp, Homo sapiens
tccccctccttcccagctgc

SEQ ID NO: 5518714 - DNA, 21 bp, Homo sapiens
tccccctccttcccagctgcc

SEQ ID NO: 5518715 - DNA, 13 bp, Homo sapiens
tccccctccttgc

SEQ ID NO: 5518716 - DNA, 14 bp, Homo sapiens
tccccctccttgcc

SEQ ID NO: 5518717 - DNA, 18 bp, Homo sapiens
tccccctccttgtgcctt

SEQ ID NO: 5518718 - DNA, 13 bp, Homo sapiens
tccccctctgccc

SEQ ID NO: 5518719 - DNA, 14 bp, Homo sapiens
tccccctctgcttc

SEQ ID NO: 5518720 - DNA, 16 bp, Homo sapiens
tccccctctgcttctc

SEQ ID NO: 5518721 - DNA, 13 bp, Homo sapiens
tccccctctggct

SEQ ID NO: 5518722 - DNA, 18 bp, Homo sapiens
tccccctctgtcttctct

SEQ ID NO: 5518723 - DNA, 21 bp, Homo sapiens
tccccctgcaacttccgctga

SEQ ID NO: 5518724 - DNA, 17 bp, Homo sapiens
tccccctgcagccgtgc

SEQ ID NO: 5518725 - DNA, 14 bp, Homo sapiens
tccccctgcagcta

SEQ ID NO: 5518726 - DNA, 21 bp, Homo sapiens
tccccctgccagaggcctggt

SEQ ID NO: 5518727 - DNA, 16 bp, Homo sapiens
tccccctgccagtgcc

SEQ ID NO: 5518728 - DNA, 12 bp, Homo sapiens
tccccctgccct

SEQ ID NO: 5518729 - DNA, 15 bp, Homo sapiens
tccccctgccctcgt

SEQ ID NO: 5518730 - DNA, 20 bp, Homo sapiens
tccccctgccctcgtggcca

SEQ ID NO: 5518731 - DNA, 13 bp, Homo sapiens
tccccctgccctg

SEQ ID NO: 5518732 - DNA, 19 bp, Homo sapiens
tccccctgcctcccattct

SEQ ID NO: 5518733 - DNA, 12 bp, Homo sapiens
tccccctgcctt

SEQ ID NO: 5518734 - DNA, 17 bp, Homo sapiens
tccccctgcctttgaaa

SEQ ID NO: 5518735 - DNA, 17 bp, Homo sapiens
tccccctgcgccccgca

SEQ ID NO: 5518736 - DNA, 14 bp, Homo sapiens
tccccctgctgatc

SEQ ID NO: 5518737 - DNA, 17 bp, Homo sapiens
tccccctgcttccacct

SEQ ID NO: 5518738 - DNA, 19 bp, Homo sapiens
tccccctgcttccacctca

SEQ ID NO: 5518739 - DNA, 10 bp, Homo sapiens
tccccctggg

SEQ ID NO: 5518740 - DNA, 15 bp, Homo sapiens
tccccctgggctctg

SEQ ID NO: 5518741 - DNA, 22 bp, Homo sapiens
tccccctgggctctgccccagc

SEQ ID NO: 5518742 - DNA, 18 bp, Homo sapiens
tccccctgtagactagtg

SEQ ID NO: 5518743 - DNA, 16 bp, Homo sapiens
tccccctgtcccctca

SEQ ID NO: 5518744 - DNA, 17 bp, Homo sapiens
tccccctgtggaatgtt

SEQ ID NO: 5518745 - DNA, 17 bp, Homo sapiens
tccccctgttcacatcc

SEQ ID NO: 5518746 - DNA, 21 bp, Homo sapiens
tccccctgtttttagagcttc

SEQ ID NO: 5518747 - DNA, 21 bp, Homo sapiens
tcccccttaaagaaaattgca

SEQ ID NO: 5518748 - DNA, 15 bp, Homo sapiens
tcccccttcacaaag

SEQ ID NO: 5518749 - DNA, 22 bp, Homo sapiens
tcccccttcacaaagcccaagg

SEQ ID NO: 5518750 - DNA, 12 bp, Homo sapiens
tcccccttcagc

SEQ ID NO: 5518751 - DNA, 20 bp, Homo sapiens
tcccccttcagctcctgagt

SEQ ID NO: 5518752 - DNA, 15 bp, Homo sapiens
tcccccttccatgga

SEQ ID NO: 5518753 - DNA, 21 bp, Homo sapiens
tcccccttccatggactttgt

SEQ ID NO: 5518754 - DNA, 14 bp, Homo sapiens
tcccccttcccagt

SEQ ID NO: 5518755 - DNA, 13 bp, Homo sapiens
tcccccttcccct

SEQ ID NO: 5518756 - DNA, 13 bp, Homo sapiens
tcccccttcccgc

SEQ ID NO: 5518757 - DNA, 18 bp, Homo sapiens
tcccccttccgccttctc

SEQ ID NO: 5518758 - DNA, 14 bp, Homo sapiens
tcccccttcctagt

SEQ ID NO: 5518759 - DNA, 15 bp, Homo sapiens
tcccccttcttcctc

SEQ ID NO: 5518760 - DNA, 18 bp, Homo sapiens
tcccccttcttcctcccc

SEQ ID NO: 5518761 - DNA, 13 bp, Homo sapiens
tcccccttgatcg

SEQ ID NO: 5518762 - DNA, 12 bp, Homo sapiens
tcccccttgcca

SEQ ID NO: 5518763 - DNA, 16 bp, Homo sapiens
tcccccttgccacccc

SEQ ID NO: 5518764 - DNA, 17 bp, Homo sapiens
tcccccttgccacccca

SEQ ID NO: 5518765 - DNA, 16 bp, Homo sapiens
tcccccttgtcttccc

SEQ ID NO: 5518766 - DNA, 18 bp, Homo sapiens
tcccccttgtcttccccc

SEQ ID NO: 5518767 - DNA, 9 bp, Homo sapiens
tcccccttt

SEQ ID NO: 5518768 - DNA, 16 bp, Homo sapiens
tccccctttcaaggaa

SEQ ID NO: 5518769 - DNA, 16 bp, Homo sapiens
tccccctttctctgcc

SEQ ID NO: 5518770 - DNA, 17 bp, Homo sapiens
tccccctttctctgcct

SEQ ID NO: 5518771 - DNA, 18 bp, Homo sapiens
tccccctttctctgcctg

SEQ ID NO: 5518772 - DNA, 21 bp, Homo sapiens
tccccctttctctgcctggca

SEQ ID NO: 5518773 - DNA, 21 bp, Homo sapiens
tccccctttcttcctcattcc

SEQ ID NO: 5518774 - DNA, 19 bp, Homo sapiens
tcccccttttttgtccccc

SEQ ID NO: 5518775 - DNA, 20 bp, Homo sapiens
tccccgaagagtcagccccg

SEQ ID NO: 5518776 - DNA, 19 bp, Homo sapiens
tccccgaaggtgctggagg

SEQ ID NO: 5518777 - DNA, 20 bp, Homo sapiens
tccccgacagtggctctcca

SEQ ID NO: 5518778 - DNA, 14 bp, Homo sapiens
tccccgacccccct

SEQ ID NO: 5518779 - DNA, 14 bp, Homo sapiens
tccccgagccgagc

SEQ ID NO: 5518780 - DNA, 15 bp, Homo sapiens
tccccgaggctgccc

SEQ ID NO: 5518781 - DNA, 21 bp, Homo sapiens
tccccgagggatgatgccaca

SEQ ID NO: 5518782 - DNA, 21 bp, Homo sapiens
tccccgagggcgaaggccatt

SEQ ID NO: 5518783 - DNA, 16 bp, Homo sapiens
tcccctcgctgtcctg

SEQ ID NO: 5518784 - DNA, 21 bp, Homo sapiens
tcccctcgcttcataggcaga

SEQ ID NO: 5518785 - DNA, 17 bp, Homo sapiens
tcccctcggagaagagc

SEQ ID NO: 5518786 - DNA, 20 bp, Homo sapiens
tcccctcgtcctgtcccaga

SEQ ID NO: 5518787 - DNA, 23 bp, Homo sapiens
tcccctcgtcctgtcccagaggt

SEQ ID NO: 5518788 - DNA, 19 bp, Homo sapiens
tcccctcgtgtcagctcag

SEQ ID NO: 5518789 - DNA, 20 bp, Homo sapiens
tcccctcgtgtcagctcagg

SEQ ID NO: 5518790 - DNA, 19 bp, Homo sapiens
tcccctctaactggacagc

SEQ ID NO: 5518791 - DNA, 21 bp, Homo sapiens
tcccctctaactggacagcct

SEQ ID NO: 5518792 - DNA, 16 bp, Homo sapiens
tcccctctcagaacat

SEQ ID NO: 5518793 - DNA, 11 bp, Homo sapiens
tcccctctcat

SEQ ID NO: 5518794 - DNA, 15 bp, Homo sapiens
tcccctctcatcccc

SEQ ID NO: 5518795 - DNA, 22 bp, Homo sapiens
tcccctctcatccccctgtgga

SEQ ID NO: 5518796 - DNA, 19 bp, Homo sapiens
tcccctctcatctgacctt

SEQ ID NO: 5518797 - DNA, 15 bp, Homo sapiens
tcccctctcccaggg

SEQ ID NO: 5518798 - DNA, 22 bp, Homo sapiens
tcccctctcccagggatgctct

SEQ ID NO: 5518799 - DNA, 15 bp, Homo sapiens
tcccctctccccttg

SEQ ID NO: 5518800 - DNA, 15 bp, Homo sapiens
tcccctctcccttcc

SEQ ID NO: 5518801 - DNA, 14 bp, Homo sapiens
tcccctctcctagc

SEQ ID NO: 5518802 - DNA, 12 bp, Homo sapiens
tcccctctcctg

SEQ ID NO: 5518803 - DNA, 17 bp, Homo sapiens
tcccctctcctgagcct

SEQ ID NO: 5518804 - DNA, 18 bp, Homo sapiens
tcccctctcctgcatccc

SEQ ID NO: 5518805 - DNA, 11 bp, Homo sapiens
tcccctctctc

SEQ ID NO: 5518806 - DNA, 13 bp, Homo sapiens
tcccctctctctg

SEQ ID NO: 5518807 - DNA, 15 bp, Homo sapiens
tcccctctctctggg

SEQ ID NO: 5518808 - DNA, 12 bp, Homo sapiens
tcccctctctgc

SEQ ID NO: 5518809 - DNA, 13 bp, Homo sapiens
tcccctctctgcc

SEQ ID NO: 5518810 - DNA, 15 bp, Homo sapiens
tcccctctctgcccc

SEQ ID NO: 5518811 - DNA, 18 bp, Homo sapiens
tcccctctctgcccctga

SEQ ID NO: 5518812 - DNA, 20 bp, Homo sapiens
tcccctctcttgcacccgcc

SEQ ID NO: 5518813 - DNA, 21 bp, Homo sapiens
tcccctctcttgtcagatgcc

SEQ ID NO: 5518814 - DNA, 21 bp, Homo sapiens
tcccctctgaaagttgtacat

SEQ ID NO: 5518815 - DNA, 18 bp, Homo sapiens
tcccctctgcaacccccc

SEQ ID NO: 5518816 - DNA, 19 bp, Homo sapiens
tcccctctgccccaccctc

SEQ ID NO: 5518817 - DNA, 14 bp, Homo sapiens
tcccctctgctgct

SEQ ID NO: 5518818 - DNA, 17 bp, Homo sapiens
tcccctctgctgctgtc

SEQ ID NO: 5518819 - DNA, 20 bp, Homo sapiens
tcccctctgctgctgtccct

SEQ ID NO: 5518820 - DNA, 12 bp, Homo sapiens
tcccctctggaa

SEQ ID NO: 5518821 - DNA, 13 bp, Homo sapiens
tcccctctggctt

SEQ ID NO: 5518822 - DNA, 14 bp, Homo sapiens
tcccctctggcttg

SEQ ID NO: 5518823 - DNA, 21 bp, Homo sapiens
tcccctcttatgtacctcttt

SEQ ID NO: 5518824 - DNA, 15 bp, Homo sapiens
tcccctcttcctgga

SEQ ID NO: 5518825 - DNA, 14 bp, Homo sapiens
tcccctcttctgag

SEQ ID NO: 5518826 - DNA, 23 bp, Homo sapiens
tcccctcttttgttaaataatat

SEQ ID NO: 5518827 - DNA, 15 bp, Homo sapiens
tcccctgaatcctca

SEQ ID NO: 5518828 - DNA, 19 bp, Homo sapiens
tcccctgaggacctttctg

SEQ ID NO: 5518829 - DNA, 21 bp, Homo sapiens
tcccctgaggctggcatcctg

SEQ ID NO: 5518830 - DNA, 14 bp, Homo sapiens
tcccctgatccaga

SEQ ID NO: 5518831 - DNA, 16 bp, Homo sapiens
tcccctgcaagtggac

SEQ ID NO: 5518832 - DNA, 21 bp, Homo sapiens
tcccctgcaatgcgtcttgtg

SEQ ID NO: 5518833 - DNA, 18 bp, Homo sapiens
tcccctgcacctggcctg

SEQ ID NO: 5518834 - DNA, 19 bp, Homo sapiens
tcccctgcactaggcaggt

SEQ ID NO: 5518835 - DNA, 15 bp, Homo sapiens
tcccctgcactcccg

SEQ ID NO: 5518836 - DNA, 13 bp, Homo sapiens
tcccctgcactgt

SEQ ID NO: 5518837 - DNA, 17 bp, Homo sapiens
tcccctgcactgtaaaa

SEQ ID NO: 5518838 - DNA, 19 bp, Homo sapiens
tcccctgcactgtaaaatg

SEQ ID NO: 5518839 - DNA, 23 bp, Homo sapiens
tcccctgcagacggatgcccatt

SEQ ID NO: 5518840 - DNA, 13 bp, Homo sapiens
tcccctgcagccc

SEQ ID NO: 5518841 - DNA, 17 bp, Homo sapiens
tcccctgcagccctggc

SEQ ID NO: 5518842 - DNA, 16 bp, Homo sapiens
tcccctgcagcctggg

SEQ ID NO: 5518843 - DNA, 18 bp, Homo sapiens
tcccctgcaggctgagtg

SEQ ID NO: 5518844 - DNA, 16 bp, Homo sapiens
tcccctgccacactga

SEQ ID NO: 5518845 - DNA, 12 bp, Homo sapiens
tcccctgccacc

SEQ ID NO: 5518846 - DNA, 16 bp, Homo sapiens
tcccctgccaccaggc

SEQ ID NO: 5518847 - DNA, 17 bp, Homo sapiens
tcccctgccaccaggcc

SEQ ID NO: 5518848 - DNA, 19 bp, Homo sapiens
tcccctgccaccaggccac

SEQ ID NO: 5518849 - DNA, 15 bp, Homo sapiens
tcccctgccaccgac

SEQ ID NO: 5518850 - DNA, 22 bp, Homo sapiens
tcccctgccaccgactgcccag

SEQ ID NO: 5518851 - DNA, 12 bp, Homo sapiens
tcccctgccagg

SEQ ID NO: 5518852 - DNA, 14 bp, Homo sapiens
tcccctgccagggc

SEQ ID NO: 5518853 - DNA, 14 bp, Homo sapiens
tcccctgcccatgc

SEQ ID NO: 5518854 - DNA, 18 bp, Homo sapiens
tcccctgccccagaggtc

SEQ ID NO: 5518855 - DNA, 13 bp, Homo sapiens
tcccctgccccca

SEQ ID NO: 5518856 - DNA, 18 bp, Homo sapiens
tcccctgcccccatccca

SEQ ID NO: 5518857 - DNA, 22 bp, Homo sapiens
tcccctgcccccatcccacatg

SEQ ID NO: 5518858 - DNA, 16 bp, Homo sapiens
tcccctgccccctgca

SEQ ID NO: 5518859 - DNA, 17 bp, Homo sapiens
tcccctgccccctgcag

SEQ ID NO: 5518860 - DNA, 13 bp, Homo sapiens
tcccctgccccgt

SEQ ID NO: 5518861 - DNA, 17 bp, Homo sapiens
tcccctgcccctcacaa

SEQ ID NO: 5518862 - DNA, 19 bp, Homo sapiens
tcccctgccccttccttta

SEQ ID NO: 5518863 - DNA, 15 bp, Homo sapiens
tcccctgccctgctg

SEQ ID NO: 5518864 - DNA, 13 bp, Homo sapiens
tcccctgccctgg

SEQ ID NO: 5518865 - DNA, 24 bp, Homo sapiens
tcccctgccctggtccagggaagc

SEQ ID NO: 5518866 - DNA, 20 bp, Homo sapiens
tcccctgcccttcctcctga

SEQ ID NO: 5518867 - DNA, 20 bp, Homo sapiens
tcccctgccgcctcccggga

SEQ ID NO: 5518868 - DNA, 22 bp, Homo sapiens
tcccctgccggtgcacaggcct

SEQ ID NO: 5518869 - DNA, 12 bp, Homo sapiens
tcccctgcctcc

SEQ ID NO: 5518870 - DNA, 15 bp, Homo sapiens
tcccctgcctccatc

SEQ ID NO: 5518871 - DNA, 17 bp, Homo sapiens
tcccctgcctccatcct

SEQ ID NO: 5518872 - DNA, 13 bp, Homo sapiens
tcccctgcctccg

SEQ ID NO: 5518873 - DNA, 15 bp, Homo sapiens
tcccctgcctcctac

SEQ ID NO: 5518874 - DNA, 19 bp, Homo sapiens
tcccctgcctcctgccacc

SEQ ID NO: 5518875 - DNA, 12 bp, Homo sapiens
tcccctgcctgg

SEQ ID NO: 5518876 - DNA, 17 bp, Homo sapiens
tcccctgcctgtgagtg

SEQ ID NO: 5518877 - DNA, 15 bp, Homo sapiens
tcccctgccttaacc

SEQ ID NO: 5518878 - DNA, 22 bp, Homo sapiens
tcccctgccttaacctgggacc

SEQ ID NO: 5518879 - DNA, 19 bp, Homo sapiens
tcccctgcgcaggccctcc

SEQ ID NO: 5518880 - DNA, 20 bp, Homo sapiens
tcccctgcgcaggccctccg

SEQ ID NO: 5518881 - DNA, 17 bp, Homo sapiens
tcccctgcgccctccct

SEQ ID NO: 5518882 - DNA, 20 bp, Homo sapiens
tcccctgcggagctgcatgg

SEQ ID NO: 5518883 - DNA, 17 bp, Homo sapiens
tcccctgcggtcaggct

SEQ ID NO: 5518884 - DNA, 18 bp, Homo sapiens
tcccctgcggtcaggctg

SEQ ID NO: 5518885 - DNA, 13 bp, Homo sapiens
tcccctgctaccc

SEQ ID NO: 5518886 - DNA, 14 bp, Homo sapiens
tcccctgctaccct

SEQ ID NO: 5518887 - DNA, 20 bp, Homo sapiens
tcccctgctactcctgtgct

SEQ ID NO: 5518888 - DNA, 21 bp, Homo sapiens
tcccctgctcggcaccgccag

SEQ ID NO: 5518889 - DNA, 23 bp, Homo sapiens
tcccctgctgaccttggaggaat

SEQ ID NO: 5518890 - DNA, 16 bp, Homo sapiens
tcccctgctgaggcag

SEQ ID NO: 5518891 - DNA, 23 bp, Homo sapiens
tcccctgctgcaggggctctgga

SEQ ID NO: 5518892 - DNA, 13 bp, Homo sapiens
tcccctgctggcc

SEQ ID NO: 5518893 - DNA, 20 bp, Homo sapiens
tcccctgctgggtgtggcgc

SEQ ID NO: 5518894 - DNA, 18 bp, Homo sapiens
tcccctgcttctggctcc

SEQ ID NO: 5518895 - DNA, 20 bp, Homo sapiens
tcccctggaactgtctctca

SEQ ID NO: 5518896 - DNA, 20 bp, Homo sapiens
tcccctggaagcagtgccca

SEQ ID NO: 5518897 - DNA, 21 bp, Homo sapiens
tcccctggaagcagtgcccag

SEQ ID NO: 5518898 - DNA, 20 bp, Homo sapiens
tcccctggaagttgtccttt

SEQ ID NO: 5518899 - DNA, 16 bp, Homo sapiens
tcccctggacagaggc

SEQ ID NO: 5518900 - DNA, 21 bp, Homo sapiens
tcccctggacagaggcggggc

SEQ ID NO: 5518901 - DNA, 22 bp, Homo sapiens
tcccctggagccagcagggctg

SEQ ID NO: 5518902 - DNA, 23 bp, Homo sapiens
tcccctggagtgtgtcagagccc

SEQ ID NO: 5518903 - DNA, 13 bp, Homo sapiens
tcccctggcaggg

SEQ ID NO: 5518904 - DNA, 12 bp, Homo sapiens
tcccctggccct

SEQ ID NO: 5518905 - DNA, 19 bp, Homo sapiens
tcccctggcccttccttca

SEQ ID NO: 5518906 - DNA, 12 bp, Homo sapiens
tcccctggcctc

SEQ ID NO: 5518907 - DNA, 13 bp, Homo sapiens
tcccctggcctca

SEQ ID NO: 5518908 - DNA, 19 bp, Homo sapiens
tcccctggcctcagttccc

SEQ ID NO: 5518909 - DNA, 12 bp, Homo sapiens
tcccctggcctt

SEQ ID NO: 5518910 - DNA, 16 bp, Homo sapiens
tcccctggctggctcc

SEQ ID NO: 5518911 - DNA, 18 bp, Homo sapiens
tcccctggctggctccta

SEQ ID NO: 5518912 - DNA, 22 bp, Homo sapiens
tcccctgggactttcccaccca

SEQ ID NO: 5518913 - DNA, 23 bp, Homo sapiens
tcccctgggactttcccacccag

SEQ ID NO: 5518914 - DNA, 18 bp, Homo sapiens
tcccctgggatgctgacc

SEQ ID NO: 5518915 - DNA, 13 bp, Homo sapiens
tcccctgggcagg

SEQ ID NO: 5518916 - DNA, 21 bp, Homo sapiens
tcccctgggcatcttctggct

SEQ ID NO: 5518917 - DNA, 15 bp, Homo sapiens
tcccctgggccaccc

SEQ ID NO: 5518918 - DNA, 21 bp, Homo sapiens
tcccctgggccacccttcacg

SEQ ID NO: 5518919 - DNA, 19 bp, Homo sapiens
tcccctggggacagcaagg

SEQ ID NO: 5518920 - DNA, 15 bp, Homo sapiens
tcccctggggaccca

SEQ ID NO: 5518921 - DNA, 14 bp, Homo sapiens
tcccctggggacgc

SEQ ID NO: 5518922 - DNA, 13 bp, Homo sapiens
tcccctggggctg

SEQ ID NO: 5518923 - DNA, 14 bp, Homo sapiens
tcccctggtcctgc

SEQ ID NO: 5518924 - DNA, 17 bp, Homo sapiens
tcccctggtcctgcact

SEQ ID NO: 5518925 - DNA, 17 bp, Homo sapiens
tcccctggtctcctccc

SEQ ID NO: 5518926 - DNA, 14 bp, Homo sapiens
tcccctggtgcccc

SEQ ID NO: 5518927 - DNA, 15 bp, Homo sapiens
tcccctggtgcccct

SEQ ID NO: 5518928 - DNA, 22 bp, Homo sapiens
tcccctggtgcccctccactct

SEQ ID NO: 5518929 - DNA, 19 bp, Homo sapiens
tcccctgtagagtgggagc

SEQ ID NO: 5518930 - DNA, 22 bp, Homo sapiens
tcccctgtagagtgggagctga

SEQ ID NO: 5518931 - DNA, 15 bp, Homo sapiens
tcccctgtcccacca

SEQ ID NO: 5518932 - DNA, 18 bp, Homo sapiens
tcccctgtcccaccaact

SEQ ID NO: 5518933 - DNA, 20 bp, Homo sapiens
tcccctgtcccaccaactct

SEQ ID NO: 5518934 - DNA, 16 bp, Homo sapiens
tcccctgtcctgtgaa

SEQ ID NO: 5518935 - DNA, 18 bp, Homo sapiens
tcccctgtcctgtgaatg

SEQ ID NO: 5518936 - DNA, 20 bp, Homo sapiens
tcccctgtcctgtgaatgga

SEQ ID NO: 5518937 - DNA, 23 bp, Homo sapiens
tcccctgtcctgtgaatggaagc

SEQ ID NO: 5518938 - DNA, 12 bp, Homo sapiens
tcccctgtctac

SEQ ID NO: 5518939 - DNA, 18 bp, Homo sapiens
tcccctgtcttcacctgc

SEQ ID NO: 5518940 - DNA, 20 bp, Homo sapiens
tcccctgtcttcacctgcca

SEQ ID NO: 5518941 - DNA, 19 bp, Homo sapiens
tcccctgtcttctctcaaa

SEQ ID NO: 5518942 - DNA, 12 bp, Homo sapiens
tcccctgtgggg

SEQ ID NO: 5518943 - DNA, 20 bp, Homo sapiens
tcccctgtggggatctcagg

SEQ ID NO: 5518944 - DNA, 21 bp, Homo sapiens
tcccctgtggtgatgtgcctg

SEQ ID NO: 5518945 - DNA, 12 bp, Homo sapiens
tcccctgtgtca

SEQ ID NO: 5518946 - DNA, 20 bp, Homo sapiens
tcccctgttcccctctccct

SEQ ID NO: 5518947 - DNA, 15 bp, Homo sapiens
tcccctgtttattca

SEQ ID NO: 5518948 - DNA, 21 bp, Homo sapiens
tcccctgtttgtttctgaaag

SEQ ID NO: 5518949 - DNA, 19 bp, Homo sapiens
tccccttaattaggatgca

SEQ ID NO: 5518950 - DNA, 17 bp, Homo sapiens
tccccttacccttagaa

SEQ ID NO: 5518951 - DNA, 21 bp, Homo sapiens
tccccttagagtgctgtgaga

SEQ ID NO: 5518952 - DNA, 17 bp, Homo sapiens
tccccttatcctccctg

SEQ ID NO: 5518953 - DNA, 19 bp, Homo sapiens
tccccttatcctccctgta

SEQ ID NO: 5518954 - DNA, 20 bp, Homo sapiens
tccccttatcctccctgtaa

SEQ ID NO: 5518955 - DNA, 23 bp, Homo sapiens
tccccttatcctccctgtaactt

SEQ ID NO: 5518956 - DNA, 15 bp, Homo sapiens
tccccttatcgtccc

SEQ ID NO: 5518957 - DNA, 13 bp, Homo sapiens
tccccttcactcc

SEQ ID NO: 5518958 - DNA, 17 bp, Homo sapiens
tccccttcagaccttgc

SEQ ID NO: 5518959 - DNA, 12 bp, Homo sapiens
tccccttccaac

SEQ ID NO: 5518960 - DNA, 18 bp, Homo sapiens
tccccttccactgagggc

SEQ ID NO: 5518961 - DNA, 16 bp, Homo sapiens
tccctcagcccctctt

SEQ ID NO: 5518962 - DNA, 17 bp, Homo sapiens
tccctcagccctcatta

SEQ ID NO: 5518963 - DNA, 11 bp, Homo sapiens
tccctcagcct

SEQ ID NO: 5518964 - DNA, 19 bp, Homo sapiens
tccctcagcctaagaaaca

SEQ ID NO: 5518965 - DNA, 16 bp, Homo sapiens
tccctcagcctcagag

SEQ ID NO: 5518966 - DNA, 18 bp, Homo sapiens
tccctcagcctcagagga

SEQ ID NO: 5518967 - DNA, 14 bp, Homo sapiens
tccctcagcctccc

SEQ ID NO: 5518968 - DNA, 21 bp, Homo sapiens
tccctcagcctccccttcttc

SEQ ID NO: 5518969 - DNA, 14 bp, Homo sapiens
tccctcaggctctg

SEQ ID NO: 5518970 - DNA, 14 bp, Homo sapiens
tccctcagggagcg

SEQ ID NO: 5518971 - DNA, 15 bp, Homo sapiens
tccctcagggagcga

SEQ ID NO: 5518972 - DNA, 13 bp, Homo sapiens
tccctcaggggca

SEQ ID NO: 5518973 - DNA, 16 bp, Homo sapiens
tccctcaggggcaggt

SEQ ID NO: 5518974 - DNA, 19 bp, Homo sapiens
tccctcaggttctattttc

SEQ ID NO: 5518975 - DNA, 18 bp, Homo sapiens
tccctcagtctggccctt

SEQ ID NO: 5518976 - DNA, 21 bp, Homo sapiens
tccctcagtctggcccttcct

SEQ ID NO: 5518977 - DNA, 16 bp, Homo sapiens
tccctcagtgccctca

SEQ ID NO: 5518978 - DNA, 17 bp, Homo sapiens
tccctcattcatcttgc

SEQ ID NO: 5518979 - DNA, 15 bp, Homo sapiens
tccctcatttcagga

SEQ ID NO: 5518980 - DNA, 14 bp, Homo sapiens
tccctcatttcatt

SEQ ID NO: 5518981 - DNA, 14 bp, Homo sapiens
tccctccaagcctg

SEQ ID NO: 5518982 - DNA, 23 bp, Homo sapiens
tccctccaagtggtccacaagct

SEQ ID NO: 5518983 - DNA, 12 bp, Homo sapiens
tccctccacacc

SEQ ID NO: 5518984 - DNA, 19 bp, Homo sapiens
tccctccacacctccaccc

SEQ ID NO: 5518985 - DNA, 16 bp, Homo sapiens
tccctccaccagcctg

SEQ ID NO: 5518986 - DNA, 19 bp, Homo sapiens
tccctccacccacttgcct

SEQ ID NO: 5518987 - DNA, 17 bp, Homo sapiens
tccctccaccccaggac

SEQ ID NO: 5518988 - DNA, 20 bp, Homo sapiens
tccctccacctcaagacccc

SEQ ID NO: 5518989 - DNA, 15 bp, Homo sapiens
tccctccacctccct

SEQ ID NO: 5518990 - DNA, 21 bp, Homo sapiens
tccctccacctccctgcaata

SEQ ID NO: 5518991 - DNA, 20 bp, Homo sapiens
tccctccacgttcacccctc

SEQ ID NO: 5518992 - DNA, 14 bp, Homo sapiens
tccctccactcctc

SEQ ID NO: 5518993 - DNA, 18 bp, Homo sapiens
tccctccactcctcccaa

SEQ ID NO: 5518994 - DNA, 23 bp, Homo sapiens
tccctccactccttcctgccacc

SEQ ID NO: 5518995 - DNA, 22 bp, Homo sapiens
tccctccaggcaaatgcccttc

SEQ ID NO: 5518996 - DNA, 19 bp, Homo sapiens
tccctccaggcccatctca

SEQ ID NO: 5518997 - DNA, 13 bp, Homo sapiens
tccctccagggtc

SEQ ID NO: 5518998 - DNA, 21 bp, Homo sapiens
tccctccagtattgccccctc

SEQ ID NO: 5518999 - DNA, 13 bp, Homo sapiens
tccctccagtgaa

SEQ ID NO: 5519000 - DNA, 15 bp, Homo sapiens
tccctccatccaccc

SEQ ID NO: 5519001 - DNA, 12 bp, Homo sapiens
tccctccatggc

SEQ ID NO: 5519002 - DNA, 18 bp, Homo sapiens
tccctccattcatccttc

SEQ ID NO: 5519003 - DNA, 20 bp, Homo sapiens
tccctccattcatccttcca

SEQ ID NO: 5519004 - DNA, 16 bp, Homo sapiens
tccctccatttttctc

SEQ ID NO: 5519005 - DNA, 19 bp, Homo sapiens
tccctccatttttctccca

SEQ ID NO: 5519006 - DNA, 12 bp, Homo sapiens
tccctcccaagg

SEQ ID NO: 5519007 - DNA, 14 bp, Homo sapiens
tccctcccacccaa

SEQ ID NO: 5519008 - DNA, 21 bp, Homo sapiens
tccctcccacccaaccaactt

SEQ ID NO: 5519009 - DNA, 13 bp, Homo sapiens
tccctcccacctc

SEQ ID NO: 5519010 - DNA, 23 bp, Homo sapiens
tccctcccagaggagccaccagt

SEQ ID NO: 5519011 - DNA, 16 bp, Homo sapiens
tccctcccagatccag

SEQ ID NO: 5519012 - DNA, 16 bp, Homo sapiens
tccctcccagcgctct

SEQ ID NO: 5519013 - DNA, 17 bp, Homo sapiens
tccctcccagctgcact

SEQ ID NO: 5519014 - DNA, 14 bp, Homo sapiens
tccctcccaggact

SEQ ID NO: 5519015 - DNA, 14 bp, Homo sapiens
tccctcccatcctc

SEQ ID NO: 5519016 - DNA, 17 bp, Homo sapiens
tccctcccatcctccag

SEQ ID NO: 5519017 - DNA, 22 bp, Homo sapiens
tccctcccatcctccagccctg

SEQ ID NO: 5519018 - DNA, 14 bp, Homo sapiens
tccctccccaaatg

SEQ ID NO: 5519019 - DNA, 19 bp, Homo sapiens
tccctccccaaatggctgc

SEQ ID NO: 5519020 - DNA, 15 bp, Homo sapiens
tccctccccacccaa

SEQ ID NO: 5519021 - DNA, 17 bp, Homo sapiens
tccctccccagaaacag

SEQ ID NO: 5519022 - DNA, 13 bp, Homo sapiens
tccctccccagct

SEQ ID NO: 5519023 - DNA, 14 bp, Homo sapiens
tccctccccagctc

SEQ ID NO: 5519024 - DNA, 15 bp, Homo sapiens
tccctccccagctcc

SEQ ID NO: 5519025 - DNA, 13 bp, Homo sapiens
tccctccccagtg

SEQ ID NO: 5519026 - DNA, 14 bp, Homo sapiens
tccctcccccagca

SEQ ID NO: 5519027 - DNA, 23 bp, Homo sapiens
tccctcccccagccaccaccctc

SEQ ID NO: 5519028 - DNA, 11 bp, Homo sapiens
tccctcccccg

SEQ ID NO: 5519029 - DNA, 14 bp, Homo sapiens
tccctcccccttgt

SEQ ID NO: 5519030 - DNA, 18 bp, Homo sapiens
tccctccccgctgccctt

SEQ ID NO: 5519031 - DNA, 21 bp, Homo sapiens
tccctccccgctgccctttgg

SEQ ID NO: 5519032 - DNA, 22 bp, Homo sapiens
tccctccccgctgccctttggc

SEQ ID NO: 5519033 - DNA, 17 bp, Homo sapiens
tccctcccctctcagaa

SEQ ID NO: 5519034 - DNA, 17 bp, Homo sapiens
tccctcccctgccctcg

SEQ ID NO: 5519035 - DNA, 19 bp, Homo sapiens
tccctcccctgccctggtc

SEQ ID NO: 5519036 - DNA, 17 bp, Homo sapiens
tccctcccgcagagact

SEQ ID NO: 5519037 - DNA, 20 bp, Homo sapiens
tccctcccgtagtctcctgg

SEQ ID NO: 5519038 - DNA, 19 bp, Homo sapiens
tccctccctagcccttcca

SEQ ID NO: 5519039 - DNA, 23 bp, Homo sapiens
tccctccctagcccttccagcct

SEQ ID NO: 5519040 - DNA, 15 bp, Homo sapiens
tccctccctccacac

SEQ ID NO: 5519041 - DNA, 17 bp, Homo sapiens
tccctccctcccagatc

SEQ ID NO: 5519042 - DNA, 15 bp, Homo sapiens
tccctccctcctggc

SEQ ID NO: 5519043 - DNA, 14 bp, Homo sapiens
tccctccctgcagg

SEQ ID NO: 5519044 - DNA, 15 bp, Homo sapiens
tccctccctgcaggg

SEQ ID NO: 5519045 - DNA, 14 bp, Homo sapiens
tccctccctgcctg

SEQ ID NO: 5519046 - DNA, 18 bp, Homo sapiens
tccctcccttcctctttc

SEQ ID NO: 5519047 - DNA, 14 bp, Homo sapiens
tccctcccttcctt

SEQ ID NO: 5519048 - DNA, 15 bp, Homo sapiens
tccctccctttgaaa

SEQ ID NO: 5519049 - DNA, 15 bp, Homo sapiens
tccctccgccttctc

SEQ ID NO: 5519050 - DNA, 14 bp, Homo sapiens
tccctccgggacct

SEQ ID NO: 5519051 - DNA, 15 bp, Homo sapiens
tccctccgggcaggg

SEQ ID NO: 5519052 - DNA, 22 bp, Homo sapiens
tccctccgggcaggggagccag

SEQ ID NO: 5519053 - DNA, 15 bp, Homo sapiens
tccctcctcacactc

SEQ ID NO: 5519054 - DNA, 12 bp, Homo sapiens
tccctcctcacc

SEQ ID NO: 5519055 - DNA, 14 bp, Homo sapiens
tccctcctcacctc

SEQ ID NO: 5519056 - DNA, 16 bp, Homo sapiens
tccctcctcacctctg

SEQ ID NO: 5519057 - DNA, 14 bp, Homo sapiens
tccctcctcactcc

SEQ ID NO: 5519058 - DNA, 13 bp, Homo sapiens
tccctcctcagct

SEQ ID NO: 5519059 - DNA, 16 bp, Homo sapiens
tccctcctcagctcca

SEQ ID NO: 5519060 - DNA, 13 bp, Homo sapiens
tccctcctcaggg

SEQ ID NO: 5519061 - DNA, 22 bp, Homo sapiens
tccctcctcagggatcacactg

SEQ ID NO: 5519062 - DNA, 16 bp, Homo sapiens
tccctcctccaggcct

SEQ ID NO: 5519063 - DNA, 14 bp, Homo sapiens
tccctcctcccaca

SEQ ID NO: 5519064 - DNA, 19 bp, Homo sapiens
tccctcctcccacagcctg

SEQ ID NO: 5519065 - DNA, 22 bp, Homo sapiens
tccctcctcccccacgcctcca

SEQ ID NO: 5519066 - DNA, 12 bp, Homo sapiens
tccctcctctgg

SEQ ID NO: 5519067 - DNA, 14 bp, Homo sapiens
tccctcctctggcc

SEQ ID NO: 5519068 - DNA, 14 bp, Homo sapiens
tccctcctgagctc

SEQ ID NO: 5519069 - DNA, 14 bp, Homo sapiens
tccctcctgcacac

SEQ ID NO: 5519070 - DNA, 16 bp, Homo sapiens
tccctcctgcacacag

SEQ ID NO: 5519071 - DNA, 13 bp, Homo sapiens
tccctcctgcagg

SEQ ID NO: 5519072 - DNA, 14 bp, Homo sapiens
tccctcctgcaggc

SEQ ID NO: 5519073 - DNA, 15 bp, Homo sapiens
tccctcctgcaggct

SEQ ID NO: 5519074 - DNA, 21 bp, Homo sapiens
tccctcctgccgactcctggg

SEQ ID NO: 5519075 - DNA, 16 bp, Homo sapiens
tccctcctgcctgcgc

SEQ ID NO: 5519076 - DNA, 22 bp, Homo sapiens
tccctcctgctttgcgtgcccg

SEQ ID NO: 5519077 - DNA, 13 bp, Homo sapiens
tccctcctggagc

SEQ ID NO: 5519078 - DNA, 16 bp, Homo sapiens
tccctcctggagcatc

SEQ ID NO: 5519079 - DNA, 21 bp, Homo sapiens
tccctcctggagctctgtggg

SEQ ID NO: 5519080 - DNA, 16 bp, Homo sapiens
tccctcctggctcaca

SEQ ID NO: 5519081 - DNA, 20 bp, Homo sapiens
tccctcctggctcacagcca

SEQ ID NO: 5519082 - DNA, 11 bp, Homo sapiens
tccctcctggt

SEQ ID NO: 5519083 - DNA, 12 bp, Homo sapiens
tccctcctggtc

SEQ ID NO: 5519084 - DNA, 17 bp, Homo sapiens
tccctcctggtcctgga

SEQ ID NO: 5519085 - DNA, 13 bp, Homo sapiens
tccctcctggtga

SEQ ID NO: 5519086 - DNA, 17 bp, Homo sapiens
tccctcctgtgccccag

SEQ ID NO: 5519087 - DNA, 12 bp, Homo sapiens
tccctccttccc

SEQ ID NO: 5519088 - DNA, 18 bp, Homo sapiens
tccctccttcccttctct

SEQ ID NO: 5519089 - DNA, 21 bp, Homo sapiens
tccctccttgagcaccagccc

SEQ ID NO: 5519090 - DNA, 13 bp, Homo sapiens
tccctccttgggt

SEQ ID NO: 5519091 - DNA, 15 bp, Homo sapiens
tccctccttgggtca

SEQ ID NO: 5519092 - DNA, 22 bp, Homo sapiens
tccctccttgggtcattgacct

SEQ ID NO: 5519093 - DNA, 23 bp, Homo sapiens
tccctccttgggtcattgacctc

SEQ ID NO: 5519094 - DNA, 15 bp, Homo sapiens
tccctcctttagtga

SEQ ID NO: 5519095 - DNA, 14 bp, Homo sapiens
tccctcctttcctt

SEQ ID NO: 5519096 - DNA, 13 bp, Homo sapiens
tccctccttttaa

SEQ ID NO: 5519097 - DNA, 20 bp, Homo sapiens
tccctcgaacccacactgca

SEQ ID NO: 5519098 - DNA, 21 bp, Homo sapiens
tccctcgcatccgcctctgag

SEQ ID NO: 5519099 - DNA, 21 bp, Homo sapiens
tccctcgccgtccctcccagg

SEQ ID NO: 5519100 - DNA, 22 bp, Homo sapiens
tccctcgccgtccctcccaggt

SEQ ID NO: 5519101 - DNA, 22 bp, Homo sapiens
tccctcgctgcacaaatactcc

SEQ ID NO: 5519102 - DNA, 14 bp, Homo sapiens
tccctcgctgtatg

SEQ ID NO: 5519103 - DNA, 16 bp, Homo sapiens
tccctcggacccacca

SEQ ID NO: 5519104 - DNA, 21 bp, Homo sapiens
tccctcggcgttagtccctag

SEQ ID NO: 5519105 - DNA, 22 bp, Homo sapiens
tccctcgtagttggcaggagct

SEQ ID NO: 5519106 - DNA, 17 bp, Homo sapiens
tccctcgtcttcagctg

SEQ ID NO: 5519107 - DNA, 19 bp, Homo sapiens
tccctcgtcttcagctgca

SEQ ID NO: 5519108 - DNA, 21 bp, Homo sapiens
tccctcgtcttcagctgcatt

SEQ ID NO: 5519109 - DNA, 15 bp, Homo sapiens
tccctcgttttcaaa

SEQ ID NO: 5519110 - DNA, 17 bp, Homo sapiens
tccctctaacccagtgg

SEQ ID NO: 5519111 - DNA, 19 bp, Homo sapiens
tccctctaacccagtggct

SEQ ID NO: 5519112 - DNA, 15 bp, Homo sapiens
tccctctaacccctt

SEQ ID NO: 5519113 - DNA, 15 bp, Homo sapiens
tccctctaatttctc

SEQ ID NO: 5519114 - DNA, 22 bp, Homo sapiens
tccctctacagagcttccctga

SEQ ID NO: 5519115 - DNA, 15 bp, Homo sapiens
tccctctacatggac

SEQ ID NO: 5519116 - DNA, 22 bp, Homo sapiens
tccctctactaaggctttccta

SEQ ID NO: 5519117 - DNA, 16 bp, Homo sapiens
tccctctactcttcct

SEQ ID NO: 5519118 - DNA, 18 bp, Homo sapiens
tccctctaggctctgcct

SEQ ID NO: 5519119 - DNA, 17 bp, Homo sapiens
tccctctcaacacccag

SEQ ID NO: 5519120 - DNA, 19 bp, Homo sapiens
tccctctcaggcatgcctg

SEQ ID NO: 5519121 - DNA, 21 bp, Homo sapiens
tccctctcagtgccttctctc

SEQ ID NO: 5519122 - DNA, 10 bp, Homo sapiens
tccctctcat

SEQ ID NO: 5519123 - DNA, 20 bp, Homo sapiens
tccctctcatgtccctccag

SEQ ID NO: 5519124 - DNA, 21 bp, Homo sapiens
tccctctcatttagcctgtcc

SEQ ID NO: 5519125 - DNA, 15 bp, Homo sapiens
tccctctccaagaca

SEQ ID NO: 5519126 - DNA, 19 bp, Homo sapiens
tccctctccaagacagcag

SEQ ID NO: 5519127 - DNA, 22 bp, Homo sapiens
tccctctccactcttctctcct

SEQ ID NO: 5519128 - DNA, 15 bp, Homo sapiens
tccctctccagcagg

SEQ ID NO: 5519129 - DNA, 12 bp, Homo sapiens
tccctctcccag

SEQ ID NO: 5519130 - DNA, 16 bp, Homo sapiens
tccctctcccaggccc

SEQ ID NO: 5519131 - DNA, 17 bp, Homo sapiens
tccctctcccaggcccg

SEQ ID NO: 5519132 - DNA, 16 bp, Homo sapiens
tccctctcccagtcca

SEQ ID NO: 5519133 - DNA, 18 bp, Homo sapiens
tccctctcccagtccatt

SEQ ID NO: 5519134 - DNA, 12 bp, Homo sapiens
tccctctccctc

SEQ ID NO: 5519135 - DNA, 19 bp, Homo sapiens
tccctctccctctctctgg

SEQ ID NO: 5519136 - DNA, 20 bp, Homo sapiens
tccctctccgcgggagaccc

SEQ ID NO: 5519137 - DNA, 18 bp, Homo sapiens
tccctctcctctgccctc

SEQ ID NO: 5519138 - DNA, 16 bp, Homo sapiens
tccctctcctctgtcc

SEQ ID NO: 5519139 - DNA, 13 bp, Homo sapiens
tccctctcctgcc

SEQ ID NO: 5519140 - DNA, 16 bp, Homo sapiens
tccctctcctgcctac

SEQ ID NO: 5519141 - DNA, 14 bp, Homo sapiens
tccctgcccaatcc

SEQ ID NO: 5519142 - DNA, 21 bp, Homo sapiens
tccctgcccaatcctccctgg

SEQ ID NO: 5519143 - DNA, 15 bp, Homo sapiens
tccctgcccagcctg

SEQ ID NO: 5519144 - DNA, 19 bp, Homo sapiens
tccctgcccaggccggcca

SEQ ID NO: 5519145 - DNA, 13 bp, Homo sapiens
tccctgcccatcc

SEQ ID NO: 5519146 - DNA, 22 bp, Homo sapiens
tccctgccccgacccgggtctg

SEQ ID NO: 5519147 - DNA, 18 bp, Homo sapiens
tccctgccccgcccccca

SEQ ID NO: 5519148 - DNA, 20 bp, Homo sapiens
tccctgccccgccccccaga

SEQ ID NO: 5519149 - DNA, 21 bp, Homo sapiens
tccctgccccgccccccagag

SEQ ID NO: 5519150 - DNA, 23 bp, Homo sapiens
tccctgccccgccccccagagcc

SEQ ID NO: 5519151 - DNA, 14 bp, Homo sapiens
tccctgcccctgtg

SEQ ID NO: 5519152 - DNA, 15 bp, Homo sapiens
tccctgcccctgtgc

SEQ ID NO: 5519153 - DNA, 15 bp, Homo sapiens
tccctgccctgtcct

SEQ ID NO: 5519154 - DNA, 18 bp, Homo sapiens
tccctgccgaacacacat

SEQ ID NO: 5519155 - DNA, 20 bp, Homo sapiens
tccctgccggccccccaagg

SEQ ID NO: 5519156 - DNA, 16 bp, Homo sapiens
tccctgcctcaggcca

SEQ ID NO: 5519157 - DNA, 17 bp, Homo sapiens
tccctgcctcagtggct

SEQ ID NO: 5519158 - DNA, 15 bp, Homo sapiens
tccctgcctccagct

SEQ ID NO: 5519159 - DNA, 17 bp, Homo sapiens
tccctgcctccagctgt

SEQ ID NO: 5519160 - DNA, 13 bp, Homo sapiens
tccctgcctgagg

SEQ ID NO: 5519161 - DNA, 15 bp, Homo sapiens
tccctgcctgctcct

SEQ ID NO: 5519162 - DNA, 19 bp, Homo sapiens
tccctgcctgctccttggc

SEQ ID NO: 5519163 - DNA, 21 bp, Homo sapiens
tccctgcctgctccttggcac

SEQ ID NO: 5519164 - DNA, 23 bp, Homo sapiens
tccctgcctgctccttggcaccc

SEQ ID NO: 5519165 - DNA, 11 bp, Homo sapiens
tccctgcctgg

SEQ ID NO: 5519166 - DNA, 16 bp, Homo sapiens
tccctgcctggaggct

SEQ ID NO: 5519167 - DNA, 12 bp, Homo sapiens
tccctgcctggc

SEQ ID NO: 5519168 - DNA, 13 bp, Homo sapiens
tccctgcctggcg

SEQ ID NO: 5519169 - DNA, 13 bp, Homo sapiens
tccctgcctgtgg

SEQ ID NO: 5519170 - DNA, 20 bp, Homo sapiens
tccctgccttaggcctacct

SEQ ID NO: 5519171 - DNA, 12 bp, Homo sapiens
tccctgccttca

SEQ ID NO: 5519172 - DNA, 22 bp, Homo sapiens
tccctgccttcactgtgctcca

SEQ ID NO: 5519173 - DNA, 23 bp, Homo sapiens
tccctgccttgctgacaataaag

SEQ ID NO: 5519174 - DNA, 24 bp, Homo sapiens
tccctgcgacggaggcaggaccag

SEQ ID NO: 5519175 - DNA, 15 bp, Homo sapiens
tccctgcgagacgca

SEQ ID NO: 5519176 - DNA, 15 bp, Homo sapiens
tccctgcgcccttga

SEQ ID NO: 5519177 - DNA, 17 bp, Homo sapiens
tccctgcgcccttgagg

SEQ ID NO: 5519178 - DNA, 21 bp, Homo sapiens
tccctgcgcccttgaggggcc

SEQ ID NO: 5519179 - DNA, 16 bp, Homo sapiens
tccctgcgcctgtgat

SEQ ID NO: 5519180 - DNA, 18 bp, Homo sapiens
tccctgcgcttcatctca

SEQ ID NO: 5519181 - DNA, 15 bp, Homo sapiens
tccctgcgcttcctg

SEQ ID NO: 5519182 - DNA, 17 bp, Homo sapiens
tccctgcgcttcctgag

SEQ ID NO: 5519183 - DNA, 20 bp, Homo sapiens
tccctgcgcttcctgagcag

SEQ ID NO: 5519184 - DNA, 22 bp, Homo sapiens
tccctgcggcctccacacctga

SEQ ID NO: 5519185 - DNA, 15 bp, Homo sapiens
tccctgcgggccagg

SEQ ID NO: 5519186 - DNA, 15 bp, Homo sapiens
tccctgctaatctcc

SEQ ID NO: 5519187 - DNA, 21 bp, Homo sapiens
tccctgctaccaaggcccagc

SEQ ID NO: 5519188 - DNA, 12 bp, Homo sapiens
tccctgctcagc

SEQ ID NO: 5519189 - DNA, 12 bp, Homo sapiens
tccctgctcagt

SEQ ID NO: 5519190 - DNA, 15 bp, Homo sapiens
tccctgctcagtgct

SEQ ID NO: 5519191 - DNA, 10 bp, Homo sapiens
tccctgctcc

SEQ ID NO: 5519192 - DNA, 14 bp, Homo sapiens
tccctgctcccagc

SEQ ID NO: 5519193 - DNA, 15 bp, Homo sapiens
tccctgctcccagct

SEQ ID NO: 5519194 - DNA, 18 bp, Homo sapiens
tccctgctcccagctctc

SEQ ID NO: 5519195 - DNA, 14 bp, Homo sapiens
tccctgctcccagg

SEQ ID NO: 5519196 - DNA, 14 bp, Homo sapiens
tccctgctcccctt

SEQ ID NO: 5519197 - DNA, 21 bp, Homo sapiens
tccctgctccctccctccacc

SEQ ID NO: 5519198 - DNA, 15 bp, Homo sapiens
tccctgctctctgag

SEQ ID NO: 5519199 - DNA, 16 bp, Homo sapiens
tccctgctctggtccc

SEQ ID NO: 5519200 - DNA, 11 bp, Homo sapiens
tccctgctgaa

SEQ ID NO: 5519201 - DNA, 11 bp, Homo sapiens
tccctgctggg

SEQ ID NO: 5519202 - DNA, 24 bp, Homo sapiens
tccctgctgtatcttccagaacct

SEQ ID NO: 5519203 - DNA, 23 bp, Homo sapiens
tccctgctgtcattgcttcttct

SEQ ID NO: 5519204 - DNA, 13 bp, Homo sapiens
tccctgctgtccc

SEQ ID NO: 5519205 - DNA, 19 bp, Homo sapiens
tccctgctgtcgtcttagc

SEQ ID NO: 5519206 - DNA, 14 bp, Homo sapiens
tccctgctgtgcca

SEQ ID NO: 5519207 - DNA, 22 bp, Homo sapiens
tccctgctgtgccatgctgggc

SEQ ID NO: 5519208 - DNA, 17 bp, Homo sapiens
tccctgcttacctgacg

SEQ ID NO: 5519209 - DNA, 22 bp, Homo sapiens
tccctgcttatctgaaacttcc

SEQ ID NO: 5519210 - DNA, 15 bp, Homo sapiens
tccctgcttcatatc

SEQ ID NO: 5519211 - DNA, 20 bp, Homo sapiens
tccctgcttcatatctctcc

SEQ ID NO: 5519212 - DNA, 21 bp, Homo sapiens
tccctgcttcatatctctccc

SEQ ID NO: 5519213 - DNA, 12 bp, Homo sapiens
tccctgcttcca

SEQ ID NO: 5519214 - DNA, 14 bp, Homo sapiens
tccctgcttctggc

SEQ ID NO: 5519215 - DNA, 16 bp, Homo sapiens
tccctgcttgcccgct

SEQ ID NO: 5519216 - DNA, 22 bp, Homo sapiens
tccctgcttgcccgctcccaca

SEQ ID NO: 5519217 - DNA, 20 bp, Homo sapiens
tccctgcttggcttatgaaa

SEQ ID NO: 5519218 - DNA, 22 bp, Homo sapiens
tccctgcttggcttatgaaaac

SEQ ID NO: 5519219 - DNA, 14 bp, Homo sapiens
tccctgctttctgg

SEQ ID NO: 5519220 - DNA, 13 bp, Homo sapiens
tccctgctttgca

SEQ ID NO: 5519221 - DNA, 18 bp, Homo sapiens
tccctgctttgcatcttt

SEQ ID NO: 5519222 - DNA, 14 bp, Homo sapiens
tccctgctttggct

SEQ ID NO: 5519223 - DNA, 23 bp, Homo sapiens
tccctgctttggctgaggggctt

SEQ ID NO: 5519224 - DNA, 18 bp, Homo sapiens
tccctgctttggtcttgc

SEQ ID NO: 5519225 - DNA, 21 bp, Homo sapiens
tccctgcttttctcccagaag

SEQ ID NO: 5519226 - DNA, 22 bp, Homo sapiens
tccctgcttttctcccagaagg

SEQ ID NO: 5519227 - DNA, 14 bp, Homo sapiens
tccctggaaaagga

SEQ ID NO: 5519228 - DNA, 22 bp, Homo sapiens
tccctggaaaccttccacccag

SEQ ID NO: 5519229 - DNA, 20 bp, Homo sapiens
tccctggaaatccctttctg

SEQ ID NO: 5519230 - DNA, 17 bp, Homo sapiens
tccctggaaccttctag

SEQ ID NO: 5519231 - DNA, 20 bp, Homo sapiens
tccctggaagctctccgagc

SEQ ID NO: 5519232 - DNA, 20 bp, Homo sapiens
tccctggaatgagttgaggc

SEQ ID NO: 5519233 - DNA, 19 bp, Homo sapiens
tccctggacacagctcttc

SEQ ID NO: 5519234 - DNA, 16 bp, Homo sapiens
tccctggacaggcagc

SEQ ID NO: 5519235 - DNA, 17 bp, Homo sapiens
tccctggacaggcagcc

SEQ ID NO: 5519236 - DNA, 16 bp, Homo sapiens
tccctggaccacgagg

SEQ ID NO: 5519237 - DNA, 19 bp, Homo sapiens
tccctggaccagatgctga

SEQ ID NO: 5519238 - DNA, 13 bp, Homo sapiens
tccctggactctg

SEQ ID NO: 5519239 - DNA, 17 bp, Homo sapiens
tccctggactctgtggg

SEQ ID NO: 5519240 - DNA, 19 bp, Homo sapiens
tccctggacttctgggaga

SEQ ID NO: 5519241 - DNA, 23 bp, Homo sapiens
tccctggagaaaaaaattgctct

SEQ ID NO: 5519242 - DNA, 18 bp, Homo sapiens
tccctggagatcatccta

SEQ ID NO: 5519243 - DNA, 19 bp, Homo sapiens
tccctggagcaggagcccc

SEQ ID NO: 5519244 - DNA, 23 bp, Homo sapiens
tccctggagcaggagccccgcca

SEQ ID NO: 5519245 - DNA, 19 bp, Homo sapiens
tccctggagccagactctg

SEQ ID NO: 5519246 - DNA, 13 bp, Homo sapiens
tccctggagccct

SEQ ID NO: 5519247 - DNA, 17 bp, Homo sapiens
tccctggagccctgttg

SEQ ID NO: 5519248 - DNA, 15 bp, Homo sapiens
tccctggagctgagg

SEQ ID NO: 5519249 - DNA, 19 bp, Homo sapiens
tccctggaggcacgcacca

SEQ ID NO: 5519250 - DNA, 19 bp, Homo sapiens
tccctggagggcaagccct

SEQ ID NO: 5519251 - DNA, 14 bp, Homo sapiens
tccctggagtcagg

SEQ ID NO: 5519252 - DNA, 17 bp, Homo sapiens
tccctggagtcagggtg

SEQ ID NO: 5519253 - DNA, 22 bp, Homo sapiens
tccctggagtgtggctgaggag

SEQ ID NO: 5519254 - DNA, 22 bp, Homo sapiens
tccctggatcacataccaggtc

SEQ ID NO: 5519255 - DNA, 19 bp, Homo sapiens
tccctggatctacctggag

SEQ ID NO: 5519256 - DNA, 22 bp, Homo sapiens
tccctggatctacctggaggga

SEQ ID NO: 5519257 - DNA, 21 bp, Homo sapiens
tccctggatgtgtggggcatg

SEQ ID NO: 5519258 - DNA, 22 bp, Homo sapiens
tccctggatgtgtggggcatgg

SEQ ID NO: 5519259 - DNA, 18 bp, Homo sapiens
tccctggatttttaccag

SEQ ID NO: 5519260 - DNA, 21 bp, Homo sapiens
tccctggcaggatgctgagct

SEQ ID NO: 5519261 - DNA, 20 bp, Homo sapiens
tccctggcatgaccatcctg

SEQ ID NO: 5519262 - DNA, 14 bp, Homo sapiens
tccctggcatgatg

SEQ ID NO: 5519263 - DNA, 16 bp, Homo sapiens
tccctggcatgtcaga

SEQ ID NO: 5519264 - DNA, 22 bp, Homo sapiens
tccctggccacctgccaggcct

SEQ ID NO: 5519265 - DNA, 16 bp, Homo sapiens
tccctggccatctctg

SEQ ID NO: 5519266 - DNA, 17 bp, Homo sapiens
tccctggcccagccagc

SEQ ID NO: 5519267 - DNA, 15 bp, Homo sapiens
tccctggccccagtg

SEQ ID NO: 5519268 - DNA, 20 bp, Homo sapiens
tccctggccccctccctgga

SEQ ID NO: 5519269 - DNA, 13 bp, Homo sapiens
tccctggcctgtt

SEQ ID NO: 5519270 - DNA, 14 bp, Homo sapiens
tccctggccttgcc

SEQ ID NO: 5519271 - DNA, 11 bp, Homo sapiens
tccctggcgca

SEQ ID NO: 5519272 - DNA, 16 bp, Homo sapiens
tccctggcgtcctctc

SEQ ID NO: 5519273 - DNA, 18 bp, Homo sapiens
tccctggctaacagtcta

SEQ ID NO: 5519274 - DNA, 17 bp, Homo sapiens
tccctggctacttccct

SEQ ID NO: 5519275 - DNA, 17 bp, Homo sapiens
tccctggctcactggca

SEQ ID NO: 5519276 - DNA, 16 bp, Homo sapiens
tccctggctcctccgt

SEQ ID NO: 5519277 - DNA, 11 bp, Homo sapiens
tccctggctga

SEQ ID NO: 5519278 - DNA, 13 bp, Homo sapiens
tccctggctgacc

SEQ ID NO: 5519279 - DNA, 15 bp, Homo sapiens
tccctggctgacctg

SEQ ID NO: 5519280 - DNA, 16 bp, Homo sapiens
tccctggctgacctgc

SEQ ID NO: 5519281 - DNA, 20 bp, Homo sapiens
tccctggctgacctgctgtg

SEQ ID NO: 5519282 - DNA, 19 bp, Homo sapiens
tccctggctgcagcctccg

SEQ ID NO: 5519283 - DNA, 14 bp, Homo sapiens
tccctggctgccct

SEQ ID NO: 5519284 - DNA, 16 bp, Homo sapiens
tccctggctgccctgg

SEQ ID NO: 5519285 - DNA, 23 bp, Homo sapiens
tccctggctgccctggccctgag

SEQ ID NO: 5519286 - DNA, 16 bp, Homo sapiens
tccctggctgcctctg

SEQ ID NO: 5519287 - DNA, 18 bp, Homo sapiens
tccctggctgtgagcagc

SEQ ID NO: 5519288 - DNA, 12 bp, Homo sapiens
tccctggcttcc

SEQ ID NO: 5519289 - DNA, 23 bp, Homo sapiens
tccctgggaaccgccctcctgat

SEQ ID NO: 5519290 - DNA, 18 bp, Homo sapiens
tccctgggaactcatcct

SEQ ID NO: 5519291 - DNA, 19 bp, Homo sapiens
tccctgggaccccctcccc

SEQ ID NO: 5519292 - DNA, 21 bp, Homo sapiens
tccctgggcaccctgcaggca

SEQ ID NO: 5519293 - DNA, 18 bp, Homo sapiens
tccctgggcattgctttc

SEQ ID NO: 5519294 - DNA, 16 bp, Homo sapiens
tccctgggccacctcc

SEQ ID NO: 5519295 - DNA, 17 bp, Homo sapiens
tccctgggccacctcct

SEQ ID NO: 5519296 - DNA, 19 bp, Homo sapiens
tccctgggccacctcctac

SEQ ID NO: 5519297 - DNA, 16 bp, Homo sapiens
tccctgggccagggtc

SEQ ID NO: 5519298 - DNA, 15 bp, Homo sapiens
tccctgggcccctcc

SEQ ID NO: 5519299 - DNA, 16 bp, Homo sapiens
tccctgggcccctcca

SEQ ID NO: 5519300 - DNA, 19 bp, Homo sapiens
tccctgggcccctccacgc

SEQ ID NO: 5519301 - DNA, 20 bp, Homo sapiens
tccctgggcccctccacgcc

SEQ ID NO: 5519302 - DNA, 12 bp, Homo sapiens
tccctgggcctc

SEQ ID NO: 5519303 - DNA, 13 bp, Homo sapiens
tccctgggcctca

SEQ ID NO: 5519304 - DNA, 17 bp, Homo sapiens
tccctgggcctcagcct

SEQ ID NO: 5519305 - DNA, 13 bp, Homo sapiens
tccctgggcctgc

SEQ ID NO: 5519306 - DNA, 15 bp, Homo sapiens
tccctgggcctgctg

SEQ ID NO: 5519307 - DNA, 17 bp, Homo sapiens
tccctgggcctgctgct

SEQ ID NO: 5519308 - DNA, 18 bp, Homo sapiens
tccctgggcctgctgctg

SEQ ID NO: 5519309 - DNA, 15 bp, Homo sapiens
tccctgggcctgtct

SEQ ID NO: 5519310 - DNA, 23 bp, Homo sapiens
tccctgggcctgtctcagattgg

SEQ ID NO: 5519311 - DNA, 15 bp, Homo sapiens
tccctgggccttggg

SEQ ID NO: 5519312 - DNA, 23 bp, Homo sapiens
tccctgggctggcatggggaggg

SEQ ID NO: 5519313 - DNA, 18 bp, Homo sapiens
tccctggggaccaggagc

SEQ ID NO: 5519314 - DNA, 20 bp, Homo sapiens
tccctggggaccaggagcta

SEQ ID NO: 5519315 - DNA, 21 bp, Homo sapiens
tccctggggaccaggagctag

SEQ ID NO: 5519316 - DNA, 18 bp, Homo sapiens
tccctggggacggggctc

SEQ ID NO: 5519317 - DNA, 20 bp, Homo sapiens
tccctggggacggggctccc

SEQ ID NO: 5519318 - DNA, 15 bp, Homo sapiens
tccctggggagccct

SEQ ID NO: 5519319 - DNA, 11 bp, Homo sapiens
tcccttccctc

SEQ ID NO: 5519320 - DNA, 14 bp, Homo sapiens
tcccttccctcacc

SEQ ID NO: 5519321 - DNA, 19 bp, Homo sapiens
tcccttccctcacccctga

SEQ ID NO: 5519322 - DNA, 20 bp, Homo sapiens
tcccttcccttgagatgagt

SEQ ID NO: 5519323 - DNA, 20 bp, Homo sapiens
tcccttccgaccctctggga

SEQ ID NO: 5519324 - DNA, 20 bp, Homo sapiens
tcccttccgtccatccccct

SEQ ID NO: 5519325 - DNA, 13 bp, Homo sapiens
tcccttcctacag

SEQ ID NO: 5519326 - DNA, 13 bp, Homo sapiens
tcccttcctccat

SEQ ID NO: 5519327 - DNA, 15 bp, Homo sapiens
tcccttcctccattg

SEQ ID NO: 5519328 - DNA, 14 bp, Homo sapiens
tcccttcctcccca

SEQ ID NO: 5519329 - DNA, 15 bp, Homo sapiens
tcccttcctccccag

SEQ ID NO: 5519330 - DNA, 13 bp, Homo sapiens
tcccttcctccgc

SEQ ID NO: 5519331 - DNA, 15 bp, Homo sapiens
tcccttcctccgctc

SEQ ID NO: 5519332 - DNA, 14 bp, Homo sapiens
tcccttcctcggtg

SEQ ID NO: 5519333 - DNA, 21 bp, Homo sapiens
tcccttcctcggtggctctgg

SEQ ID NO: 5519334 - DNA, 17 bp, Homo sapiens
tcccttcctctgtgcca

SEQ ID NO: 5519335 - DNA, 18 bp, Homo sapiens
tcccttcctcttcctgcc

SEQ ID NO: 5519336 - DNA, 22 bp, Homo sapiens
tcccttcctcttcctgcccttg

SEQ ID NO: 5519337 - DNA, 17 bp, Homo sapiens
tcccttcctcttcggcc

SEQ ID NO: 5519338 - DNA, 16 bp, Homo sapiens
tcccttcctgaccctc

SEQ ID NO: 5519339 - DNA, 14 bp, Homo sapiens
tcccttcctgccac

SEQ ID NO: 5519340 - DNA, 17 bp, Homo sapiens
tcccttcctgcttcctg

SEQ ID NO: 5519341 - DNA, 14 bp, Homo sapiens
tcccttcctgtcct

SEQ ID NO: 5519342 - DNA, 15 bp, Homo sapiens
tcccttccttatgca

SEQ ID NO: 5519343 - DNA, 20 bp, Homo sapiens
tcccttccttgtagcctttt

SEQ ID NO: 5519344 - DNA, 13 bp, Homo sapiens
tcccttcctttct

SEQ ID NO: 5519345 - DNA, 17 bp, Homo sapiens
tcccttccttttccctg

SEQ ID NO: 5519346 - DNA, 19 bp, Homo sapiens
tcccttccttttccctgct

SEQ ID NO: 5519347 - DNA, 16 bp, Homo sapiens
tcccttcgctctgctg

SEQ ID NO: 5519348 - DNA, 17 bp, Homo sapiens
tcccttctacaaggact

SEQ ID NO: 5519349 - DNA, 20 bp, Homo sapiens
tcccttctacaaggactcca

SEQ ID NO: 5519350 - DNA, 17 bp, Homo sapiens
tcccttctactgcttct

SEQ ID NO: 5519351 - DNA, 21 bp, Homo sapiens
tcccttctaggtgtggtccca

SEQ ID NO: 5519352 - DNA, 15 bp, Homo sapiens
tcccttctcacagca

SEQ ID NO: 5519353 - DNA, 16 bp, Homo sapiens
tcccttctcacagcac

SEQ ID NO: 5519354 - DNA, 22 bp, Homo sapiens
tcccttctccatctctctggcc

SEQ ID NO: 5519355 - DNA, 13 bp, Homo sapiens
tcccttctcccca

SEQ ID NO: 5519356 - DNA, 15 bp, Homo sapiens
tcccttctccccagc

SEQ ID NO: 5519357 - DNA, 16 bp, Homo sapiens
tcccttctcccccttg

SEQ ID NO: 5519358 - DNA, 19 bp, Homo sapiens
tcccttctcccccttgtct

SEQ ID NO: 5519359 - DNA, 16 bp, Homo sapiens
tcccttctccctggat

SEQ ID NO: 5519360 - DNA, 20 bp, Homo sapiens
tcccttctccttgataacag

SEQ ID NO: 5519361 - DNA, 15 bp, Homo sapiens
tcccttctctcagcc

SEQ ID NO: 5519362 - DNA, 20 bp, Homo sapiens
tcccttctctcagcctccac

SEQ ID NO: 5519363 - DNA, 17 bp, Homo sapiens
tcccttctctccttccc

SEQ ID NO: 5519364 - DNA, 12 bp, Homo sapiens
tcccttctctct

SEQ ID NO: 5519365 - DNA, 20 bp, Homo sapiens
tcccttctctgtagggaact

SEQ ID NO: 5519366 - DNA, 15 bp, Homo sapiens
tcccttctcttccag

SEQ ID NO: 5519367 - DNA, 14 bp, Homo sapiens
tcccttctcttggg

SEQ ID NO: 5519368 - DNA, 12 bp, Homo sapiens
tcccttctgctt

SEQ ID NO: 5519369 - DNA, 16 bp, Homo sapiens
tcccttctgcttgtcc

SEQ ID NO: 5519370 - DNA, 18 bp, Homo sapiens
tcccttctggctgtcagt

SEQ ID NO: 5519371 - DNA, 19 bp, Homo sapiens
tcccttctgtagtttttaa

SEQ ID NO: 5519372 - DNA, 17 bp, Homo sapiens
tcccttctgtccctcac

SEQ ID NO: 5519373 - DNA, 16 bp, Homo sapiens
tcccttcttgcatcct

SEQ ID NO: 5519374 - DNA, 16 bp, Homo sapiens
tcccttcttgggtagg

SEQ ID NO: 5519375 - DNA, 16 bp, Homo sapiens
tcccttcttgggtctg

SEQ ID NO: 5519376 - DNA, 18 bp, Homo sapiens
tcccttcttgggtctgcc

SEQ ID NO: 5519377 - DNA, 20 bp, Homo sapiens
tcccttcttgggtctgccct

SEQ ID NO: 5519378 - DNA, 16 bp, Homo sapiens
tcccttcttgtgccct

SEQ ID NO: 5519379 - DNA, 17 bp, Homo sapiens
tcccttctttaccttca

SEQ ID NO: 5519380 - DNA, 13 bp, Homo sapiens
tcccttctttcct

SEQ ID NO: 5519381 - DNA, 15 bp, Homo sapiens
tcccttctttcctac

SEQ ID NO: 5519382 - DNA, 17 bp, Homo sapiens
tcccttctttccttcct

SEQ ID NO: 5519383 - DNA, 18 bp, Homo sapiens
tcccttctttccttcctt

SEQ ID NO: 5519384 - DNA, 22 bp, Homo sapiens
tcccttctttgcttctttttct

SEQ ID NO: 5519385 - DNA, 23 bp, Homo sapiens
tcccttcttttcctgggtgctca

SEQ ID NO: 5519386 - DNA, 12 bp, Homo sapiens
tcccttcttttt

SEQ ID NO: 5519387 - DNA, 17 bp, Homo sapiens
tcccttctttttcttct

SEQ ID NO: 5519388 - DNA, 15 bp, Homo sapiens
tcccttgaaggaaga

SEQ ID NO: 5519389 - DNA, 17 bp, Homo sapiens
tcccttgaccaggcctg

SEQ ID NO: 5519390 - DNA, 22 bp, Homo sapiens
tcccttgagctggttttctctg

SEQ ID NO: 5519391 - DNA, 15 bp, Homo sapiens
tcccttgagggctgc

SEQ ID NO: 5519392 - DNA, 16 bp, Homo sapiens
tcccttgatgcacaga

SEQ ID NO: 5519393 - DNA, 17 bp, Homo sapiens
tcccttgatggggtcca

SEQ ID NO: 5519394 - DNA, 19 bp, Homo sapiens
tcccttgcactgtatcatt

SEQ ID NO: 5519395 - DNA, 20 bp, Homo sapiens
tcccttgcaggggtcccccc

SEQ ID NO: 5519396 - DNA, 13 bp, Homo sapiens
tcccttgccactt

SEQ ID NO: 5519397 - DNA, 21 bp, Homo sapiens
tcccttgccatcctaaaagcc

SEQ ID NO: 5519398 - DNA, 18 bp, Homo sapiens
tcccttgccccaggccag

SEQ ID NO: 5519399 - DNA, 21 bp, Homo sapiens
tcccttgccctgggctgcctc

SEQ ID NO: 5519400 - DNA, 13 bp, Homo sapiens
tcccttgcctctg

SEQ ID NO: 5519401 - DNA, 19 bp, Homo sapiens
tcccttgccttatgggctg

SEQ ID NO: 5519402 - DNA, 21 bp, Homo sapiens
tcccttgcctttcgaggcctg

SEQ ID NO: 5519403 - DNA, 22 bp, Homo sapiens
tcccttgcctttcgaggcctga

SEQ ID NO: 5519404 - DNA, 13 bp, Homo sapiens
tcccttgctcatg

SEQ ID NO: 5519405 - DNA, 16 bp, Homo sapiens
tcccttgctgaacaca

SEQ ID NO: 5519406 - DNA, 19 bp, Homo sapiens
tcccttgctgaacacacac

SEQ ID NO: 5519407 - DNA, 23 bp, Homo sapiens
tcccttgctgacatggctttgct

SEQ ID NO: 5519408 - DNA, 19 bp, Homo sapiens
tcccttgctggccccagcc

SEQ ID NO: 5519409 - DNA, 19 bp, Homo sapiens
tcccttgcttagcctgtgc

SEQ ID NO: 5519410 - DNA, 13 bp, Homo sapiens
tcccttgctttgt

SEQ ID NO: 5519411 - DNA, 15 bp, Homo sapiens
tcccttgcttttccc

SEQ ID NO: 5519412 - DNA, 19 bp, Homo sapiens
tcccttgcttttccctctt

SEQ ID NO: 5519413 - DNA, 23 bp, Homo sapiens
tcccttggaaacctgccctgcct

SEQ ID NO: 5519414 - DNA, 21 bp, Homo sapiens
tcccttggaaagttcagccag

SEQ ID NO: 5519415 - DNA, 12 bp, Homo sapiens
tcccttggagct

SEQ ID NO: 5519416 - DNA, 11 bp, Homo sapiens
tcccttggagg

SEQ ID NO: 5519417 - DNA, 14 bp, Homo sapiens
tcccttggagggag

SEQ ID NO: 5519418 - DNA, 16 bp, Homo sapiens
tcccttggatcagagg

SEQ ID NO: 5519419 - DNA, 21 bp, Homo sapiens
tcccttggccacggcctggga

SEQ ID NO: 5519420 - DNA, 13 bp, Homo sapiens
tcccttggcccct

SEQ ID NO: 5519421 - DNA, 15 bp, Homo sapiens
tcccttggcccctct

SEQ ID NO: 5519422 - DNA, 17 bp, Homo sapiens
tcccttggcccctctct

SEQ ID NO: 5519423 - DNA, 12 bp, Homo sapiens
tcccttggcctc

SEQ ID NO: 5519424 - DNA, 13 bp, Homo sapiens
tcccttggcctca

SEQ ID NO: 5519425 - DNA, 15 bp, Homo sapiens
tcccttggctgttaa

SEQ ID NO: 5519426 - DNA, 22 bp, Homo sapiens
tcccttgggaaggacacagcag

SEQ ID NO: 5519427 - DNA, 23 bp, Homo sapiens
tcccttgggaaggacacagcagt

SEQ ID NO: 5519428 - DNA, 23 bp, Homo sapiens
tcccttgggcacgtgtgctggga

SEQ ID NO: 5519429 - DNA, 13 bp, Homo sapiens
tcccttgggctct

SEQ ID NO: 5519430 - DNA, 17 bp, Homo sapiens
tcccttgggctctgatg

SEQ ID NO: 5519431 - DNA, 18 bp, Homo sapiens
tcccttgggctggaagaa

SEQ ID NO: 5519432 - DNA, 23 bp, Homo sapiens
tcccttgtaaagacagagtgaat

SEQ ID NO: 5519433 - DNA, 22 bp, Homo sapiens
tcccttgtcaccaggcaaccag

SEQ ID NO: 5519434 - DNA, 16 bp, Homo sapiens
tcccttgtggccctct

SEQ ID NO: 5519435 - DNA, 22 bp, Homo sapiens
tcccttgtggcttgggacatgg

SEQ ID NO: 5519436 - DNA, 19 bp, Homo sapiens
tcccttgtgtcaagacatt

SEQ ID NO: 5519437 - DNA, 22 bp, Homo sapiens
tcccttgtgtcaagacatttct

SEQ ID NO: 5519438 - DNA, 13 bp, Homo sapiens
tcccttgtgtgtg

SEQ ID NO: 5519439 - DNA, 15 bp, Homo sapiens
tcccttgtgttcctt

SEQ ID NO: 5519440 - DNA, 17 bp, Homo sapiens
tccctttaaagcctttt

SEQ ID NO: 5519441 - DNA, 16 bp, Homo sapiens
tccctttacaatgtga

SEQ ID NO: 5519442 - DNA, 17 bp, Homo sapiens
tccctttacaatgtgaa

SEQ ID NO: 5519443 - DNA, 18 bp, Homo sapiens
tccctttacaatgtgaat

SEQ ID NO: 5519444 - DNA, 20 bp, Homo sapiens
tccctttacatctgtgttct

SEQ ID NO: 5519445 - DNA, 13 bp, Homo sapiens
tccctttagaacg

SEQ ID NO: 5519446 - DNA, 20 bp, Homo sapiens
tccctttagcacgtttaaag

SEQ ID NO: 5519447 - DNA, 23 bp, Homo sapiens
tccctttatcatgtgtttctgtg

SEQ ID NO: 5519448 - DNA, 21 bp, Homo sapiens
tccctttcacaaaattttatt

SEQ ID NO: 5519449 - DNA, 18 bp, Homo sapiens
tccctttcactgaagtga

SEQ ID NO: 5519450 - DNA, 16 bp, Homo sapiens
tccctttccaacctca

SEQ ID NO: 5519451 - DNA, 20 bp, Homo sapiens
tccctttcccatgatccaga

SEQ ID NO: 5519452 - DNA, 15 bp, Homo sapiens
tccctttccccagca

SEQ ID NO: 5519453 - DNA, 13 bp, Homo sapiens
tccctttccccat

SEQ ID NO: 5519454 - DNA, 16 bp, Homo sapiens
tccctttcccctagat

SEQ ID NO: 5519455 - DNA, 13 bp, Homo sapiens
tccctttccctac

SEQ ID NO: 5519456 - DNA, 14 bp, Homo sapiens
tccctttccctacc

SEQ ID NO: 5519457 - DNA, 13 bp, Homo sapiens
tccctttcccttc

SEQ ID NO: 5519458 - DNA, 15 bp, Homo sapiens
tccctttcccttggt

SEQ ID NO: 5519459 - DNA, 17 bp, Homo sapiens
tccctttccttccatcc

SEQ ID NO: 5519460 - DNA, 19 bp, Homo sapiens
tccctttccttccatccct

SEQ ID NO: 5519461 - DNA, 16 bp, Homo sapiens
tccctttccttcctaa

SEQ ID NO: 5519462 - DNA, 15 bp, Homo sapiens
tccctttcctttcct

SEQ ID NO: 5519463 - DNA, 20 bp, Homo sapiens
tccctttcctttcctttcat

SEQ ID NO: 5519464 - DNA, 21 bp, Homo sapiens
tccctttctaagcaaccacac

SEQ ID NO: 5519465 - DNA, 17 bp, Homo sapiens
tccctttctaagcagga

SEQ ID NO: 5519466 - DNA, 13 bp, Homo sapiens
tccctttctcagg

SEQ ID NO: 5519467 - DNA, 14 bp, Homo sapiens
tccctttctcccag

SEQ ID NO: 5519468 - DNA, 17 bp, Homo sapiens
tccctttctcccctgcc

SEQ ID NO: 5519469 - DNA, 17 bp, Homo sapiens
tccctttctctctcctc

SEQ ID NO: 5519470 - DNA, 18 bp, Homo sapiens
tccctttctctctcctct

SEQ ID NO: 5519471 - DNA, 19 bp, Homo sapiens
tccctttctctctcctctc

SEQ ID NO: 5519472 - DNA, 22 bp, Homo sapiens
tccctttctcttctgactggta

SEQ ID NO: 5519473 - DNA, 17 bp, Homo sapiens
tccctttctcttcttcc

SEQ ID NO: 5519474 - DNA, 19 bp, Homo sapiens
tccctttctgcttgtgtta

SEQ ID NO: 5519475 - DNA, 17 bp, Homo sapiens
tccctttcttggccagt

SEQ ID NO: 5519476 - DNA, 15 bp, Homo sapiens
tccctttgaaatgaa

SEQ ID NO: 5519477 - DNA, 13 bp, Homo sapiens
tccctttgacttc

SEQ ID NO: 5519478 - DNA, 17 bp, Homo sapiens
tccctttgacttcagct

SEQ ID NO: 5519479 - DNA, 18 bp, Homo sapiens
tccctttgcacctgagac

SEQ ID NO: 5519480 - DNA, 13 bp, Homo sapiens
tccctttgccagc

SEQ ID NO: 5519481 - DNA, 21 bp, Homo sapiens
tccctttgccagccacccctc

SEQ ID NO: 5519482 - DNA, 20 bp, Homo sapiens
tccctttgccttaaacctga

SEQ ID NO: 5519483 - DNA, 22 bp, Homo sapiens
tccctttgcgtcaggagcagca

SEQ ID NO: 5519484 - DNA, 22 bp, Homo sapiens
tccctttgctccaccccactca

SEQ ID NO: 5519485 - DNA, 16 bp, Homo sapiens
tccctttgctcccggc

SEQ ID NO: 5519486 - DNA, 12 bp, Homo sapiens
tccctttggtta

SEQ ID NO: 5519487 - DNA, 13 bp, Homo sapiens
tccctttgtgtat

SEQ ID NO: 5519488 - DNA, 14 bp, Homo sapiens
tcccttttaatata

SEQ ID NO: 5519489 - DNA, 19 bp, Homo sapiens
tcccttttacattctgtgt

SEQ ID NO: 5519490 - DNA, 17 bp, Homo sapiens
tcccttttaggtgaggg

SEQ ID NO: 5519491 - DNA, 21 bp, Homo sapiens
tcccttttataattaatgttt

SEQ ID NO: 5519492 - DNA, 22 bp, Homo sapiens
tcccttttataattaatgtttg

SEQ ID NO: 5519493 - DNA, 14 bp, Homo sapiens
tcccttttccctta

SEQ ID NO: 5519494 - DNA, 17 bp, Homo sapiens
tcccttttcctctagaa

SEQ ID NO: 5519495 - DNA, 14 bp, Homo sapiens
tcccttttctgttc

SEQ ID NO: 5519496 - DNA, 16 bp, Homo sapiens
tcccttttctgttcta

SEQ ID NO: 5519497 - DNA, 22 bp, Homo sapiens
tcccttttctgtttaggaagaa

SEQ ID NO: 5519498 - DNA, 15 bp, Homo sapiens
tccgctcccaccgcc

SEQ ID NO: 5519499 - DNA, 20 bp, Homo sapiens
tccgctcccaccgcccccac

SEQ ID NO: 5519500 - DNA, 23 bp, Homo sapiens
tccgctcccaccgcccccacccc

SEQ ID NO: 5519501 - DNA, 18 bp, Homo sapiens
tccgctcccctttcccat

SEQ ID NO: 5519502 - DNA, 14 bp, Homo sapiens
tccgctccctggat

SEQ ID NO: 5519503 - DNA, 13 bp, Homo sapiens
tccgctctcttcc

SEQ ID NO: 5519504 - DNA, 17 bp, Homo sapiens
tccgctctcttcctgcc

SEQ ID NO: 5519505 - DNA, 13 bp, Homo sapiens
tccgctctgaggc

SEQ ID NO: 5519506 - DNA, 23 bp, Homo sapiens
tccgctgccaccacgtctgccag

SEQ ID NO: 5519507 - DNA, 16 bp, Homo sapiens
tccgctgccagccttg

SEQ ID NO: 5519508 - DNA, 18 bp, Homo sapiens
tccgctgccccatgtgtc

SEQ ID NO: 5519509 - DNA, 19 bp, Homo sapiens
tccgctgcgggcccagctg

SEQ ID NO: 5519510 - DNA, 16 bp, Homo sapiens
tccgctgctccttggc

SEQ ID NO: 5519511 - DNA, 14 bp, Homo sapiens
tccgctggaggtgg

SEQ ID NO: 5519512 - DNA, 23 bp, Homo sapiens
tccgctggctttgggaaagccca

SEQ ID NO: 5519513 - DNA, 13 bp, Homo sapiens
tccgctgggcttc

SEQ ID NO: 5519514 - DNA, 14 bp, Homo sapiens
tccgctgggcttca

SEQ ID NO: 5519515 - DNA, 22 bp, Homo sapiens
tccgctgtcacccagcaaggca

SEQ ID NO: 5519516 - DNA, 20 bp, Homo sapiens
tccgctgtcgccccaggccc

SEQ ID NO: 5519517 - DNA, 16 bp, Homo sapiens
tccgctgtctccctcc

SEQ ID NO: 5519518 - DNA, 15 bp, Homo sapiens
tccgcttatcctgct

SEQ ID NO: 5519519 - DNA, 16 bp, Homo sapiens
tccgcttatcctgcta

SEQ ID NO: 5519520 - DNA, 13 bp, Homo sapiens
tccgcttccctgg

SEQ ID NO: 5519521 - DNA, 16 bp, Homo sapiens
tccgcttccctggttc

SEQ ID NO: 5519522 - DNA, 23 bp, Homo sapiens
tccgcttctctcttttaaagtat

SEQ ID NO: 5519523 - DNA, 21 bp, Homo sapiens
tccgctttgaaagaagcaaga

SEQ ID NO: 5519524 - DNA, 19 bp, Homo sapiens
tccggaaactagtgtacat

SEQ ID NO: 5519525 - DNA, 12 bp, Homo sapiens
tccggaaagaag

SEQ ID NO: 5519526 - DNA, 16 bp, Homo sapiens
tccggaacagccaaag

SEQ ID NO: 5519527 - DNA, 19 bp, Homo sapiens
tccggaagtaaatacagca

SEQ ID NO: 5519528 - DNA, 16 bp, Homo sapiens
tccggaatagatgtct

SEQ ID NO: 5519529 - DNA, 16 bp, Homo sapiens
tccggaatgccaccca

SEQ ID NO: 5519530 - DNA, 15 bp, Homo sapiens
tccggactctctgct

SEQ ID NO: 5519531 - DNA, 14 bp, Homo sapiens
tccggactggtgcc

SEQ ID NO: 5519532 - DNA, 16 bp, Homo sapiens
tccggactggtgccct

SEQ ID NO: 5519533 - DNA, 18 bp, Homo sapiens
tccggagaattgcctcta

SEQ ID NO: 5519534 - DNA, 18 bp, Homo sapiens
tccggagagagagagagg

SEQ ID NO: 5519535 - DNA, 22 bp, Homo sapiens
tccggagcctcatgttctcttc

SEQ ID NO: 5519536 - DNA, 23 bp, Homo sapiens
tccggagcgaccctggctctgcc

SEQ ID NO: 5519537 - DNA, 13 bp, Homo sapiens
tccggagcgccct

SEQ ID NO: 5519538 - DNA, 17 bp, Homo sapiens
tccggaggactgagccc

SEQ ID NO: 5519539 - DNA, 20 bp, Homo sapiens
tccggaggactgagccccca

SEQ ID NO: 5519540 - DNA, 14 bp, Homo sapiens
tccggaggagcagc

SEQ ID NO: 5519541 - DNA, 17 bp, Homo sapiens
tccggaggatattaaaa

SEQ ID NO: 5519542 - DNA, 17 bp, Homo sapiens
tccggagggggtcctcc

SEQ ID NO: 5519543 - DNA, 18 bp, Homo sapiens
tccggagggggtcctcct

SEQ ID NO: 5519544 - DNA, 16 bp, Homo sapiens
tccggatttaatttga

SEQ ID NO: 5519545 - DNA, 17 bp, Homo sapiens
tccggcacactgccaaa

SEQ ID NO: 5519546 - DNA, 16 bp, Homo sapiens
tccggcaccagtagca

SEQ ID NO: 5519547 - DNA, 14 bp, Homo sapiens
tccggcagaggcag

SEQ ID NO: 5519548 - DNA, 18 bp, Homo sapiens
tccggcagaggcagggcc

SEQ ID NO: 5519549 - DNA, 19 bp, Homo sapiens
tccggcagcttctgccccc

SEQ ID NO: 5519550 - DNA, 21 bp, Homo sapiens
tccggccaaggtgccaccacc

SEQ ID NO: 5519551 - DNA, 19 bp, Homo sapiens
tccggccaggtgcctcctg

SEQ ID NO: 5519552 - DNA, 16 bp, Homo sapiens
tccggcccagtgccac

SEQ ID NO: 5519553 - DNA, 22 bp, Homo sapiens
tccggcccagtgccactgcccc

SEQ ID NO: 5519554 - DNA, 14 bp, Homo sapiens
tccggcccccagag

SEQ ID NO: 5519555 - DNA, 23 bp, Homo sapiens
tccggccctcctaccctgcgccc

SEQ ID NO: 5519556 - DNA, 12 bp, Homo sapiens
tccggccctgcc

SEQ ID NO: 5519557 - DNA, 14 bp, Homo sapiens
tccggccctgcccc

SEQ ID NO: 5519558 - DNA, 14 bp, Homo sapiens
tccggcctcccctc

SEQ ID NO: 5519559 - DNA, 15 bp, Homo sapiens
tccggcctctccagc

SEQ ID NO: 5519560 - DNA, 18 bp, Homo sapiens
tccggcctctccctgcct

SEQ ID NO: 5519561 - DNA, 19 bp, Homo sapiens
tccggcctctccctgcctg

SEQ ID NO: 5519562 - DNA, 20 bp, Homo sapiens
tccggcctctccctgcctgt

SEQ ID NO: 5519563 - DNA, 15 bp, Homo sapiens
tccggcctgcactcc

SEQ ID NO: 5519564 - DNA, 18 bp, Homo sapiens
tccggcctgcactccccc

SEQ ID NO: 5519565 - DNA, 14 bp, Homo sapiens
tccggcctgcagcc

SEQ ID NO: 5519566 - DNA, 15 bp, Homo sapiens
tccggcctgcagccc

SEQ ID NO: 5519567 - DNA, 16 bp, Homo sapiens
tccggcctgcagccca

SEQ ID NO: 5519568 - DNA, 14 bp, Homo sapiens
tccggcctggcctt

SEQ ID NO: 5519569 - DNA, 19 bp, Homo sapiens
tccggcggccccgccgcag

SEQ ID NO: 5519570 - DNA, 17 bp, Homo sapiens
tccggcgtcagcctcca

SEQ ID NO: 5519571 - DNA, 19 bp, Homo sapiens
tccggcgtcagcctccagc

SEQ ID NO: 5519572 - DNA, 17 bp, Homo sapiens
tccggctaagcaggcgc

SEQ ID NO: 5519573 - DNA, 18 bp, Homo sapiens
tccggctcccagcctcag

SEQ ID NO: 5519574 - DNA, 17 bp, Homo sapiens
tccggctcctgtgcttt

SEQ ID NO: 5519575 - DNA, 17 bp, Homo sapiens
tccggctgctcctccag

SEQ ID NO: 5519576 - DNA, 21 bp, Homo sapiens
tccggctgctcctccagccct

SEQ ID NO: 5519577 - DNA, 19 bp, Homo sapiens
tccggctgtgctgggagaa

SEQ ID NO: 5519578 - DNA, 20 bp, Homo sapiens
tccggcttggctagtcacat

SEQ ID NO: 5519579 - DNA, 20 bp, Homo sapiens
tccgggaacagtgcatgtgc

SEQ ID NO: 5519580 - DNA, 13 bp, Homo sapiens
tccgggaccccca

SEQ ID NO: 5519581 - DNA, 19 bp, Homo sapiens
tccgggacgcttccagacc

SEQ ID NO: 5519582 - DNA, 21 bp, Homo sapiens
tccgggacgcttccagaccac

SEQ ID NO: 5519583 - DNA, 14 bp, Homo sapiens
tccgggactgacct

SEQ ID NO: 5519584 - DNA, 13 bp, Homo sapiens
tccgggaggcaga

SEQ ID NO: 5519585 - DNA, 24 bp, Homo sapiens
tccgggatccccagcctactgcct

SEQ ID NO: 5519586 - DNA, 18 bp, Homo sapiens
tccgggcaaatgccaggg

SEQ ID NO: 5519587 - DNA, 14 bp, Homo sapiens
tccgggcagagacc

SEQ ID NO: 5519588 - DNA, 12 bp, Homo sapiens
tccgggcagggg

SEQ ID NO: 5519589 - DNA, 14 bp, Homo sapiens
tccgggcaggggag

SEQ ID NO: 5519590 - DNA, 17 bp, Homo sapiens
tccgggcctcggcctgg

SEQ ID NO: 5519591 - DNA, 21 bp, Homo sapiens
tccgggcctcggcctggcttc

SEQ ID NO: 5519592 - DNA, 22 bp, Homo sapiens
tccgggcctcggcctggcttca

SEQ ID NO: 5519593 - DNA, 16 bp, Homo sapiens
tccggggagcgcccgc

SEQ ID NO: 5519594 - DNA, 16 bp, Homo sapiens
tccggggccagctccg

SEQ ID NO: 5519595 - DNA, 14 bp, Homo sapiens
tccggggtctgtgc

SEQ ID NO: 5519596 - DNA, 16 bp, Homo sapiens
tccgggtcactgctgt

SEQ ID NO: 5519597 - DNA, 14 bp, Homo sapiens
tccgggtctcgcag

SEQ ID NO: 5519598 - DNA, 16 bp, Homo sapiens
tccgggtctcgcagcc

SEQ ID NO: 5519599 - DNA, 18 bp, Homo sapiens
tccgggtctcgcagcctg

SEQ ID NO: 5519600 - DNA, 19 bp, Homo sapiens
tccgggtctcgcagcctga

SEQ ID NO: 5519601 - DNA, 16 bp, Homo sapiens
tccgggtgccagggct

SEQ ID NO: 5519602 - DNA, 16 bp, Homo sapiens
tccgggtgccattccc

SEQ ID NO: 5519603 - DNA, 22 bp, Homo sapiens
tccgggtgcgtgaccggcccgc

SEQ ID NO: 5519604 - DNA, 13 bp, Homo sapiens
tccgggtgctcaa

SEQ ID NO: 5519605 - DNA, 18 bp, Homo sapiens
tccgggtgctcaataaac

SEQ ID NO: 5519606 - DNA, 22 bp, Homo sapiens
tccgggtgtagattcccttgca

SEQ ID NO: 5519607 - DNA, 16 bp, Homo sapiens
tccgggtgtggcctca

SEQ ID NO: 5519608 - DNA, 17 bp, Homo sapiens
tccgggtgtggcctcag

SEQ ID NO: 5519609 - DNA, 18 bp, Homo sapiens
tccgggtgtggcctcagc

SEQ ID NO: 5519610 - DNA, 20 bp, Homo sapiens
tccgggtgtggcctcagccc

SEQ ID NO: 5519611 - DNA, 17 bp, Homo sapiens
tccggtagggaggcagc

SEQ ID NO: 5519612 - DNA, 15 bp, Homo sapiens
tccggtcagccaagt

SEQ ID NO: 5519613 - DNA, 20 bp, Homo sapiens
tccggtgccttccaccctgc

SEQ ID NO: 5519614 - DNA, 16 bp, Homo sapiens
tccggtgtgagatata

SEQ ID NO: 5519615 - DNA, 12 bp, Homo sapiens
tccggtgtgcct

SEQ ID NO: 5519616 - DNA, 17 bp, Homo sapiens
tccggtgtgcctgcagc

SEQ ID NO: 5519617 - DNA, 18 bp, Homo sapiens
tccggtgtgcctgcagcc

SEQ ID NO: 5519618 - DNA, 18 bp, Homo sapiens
tccggtgtgtcagatttt

SEQ ID NO: 5519619 - DNA, 14 bp, Homo sapiens
tccggtgttctaag

SEQ ID NO: 5519620 - DNA, 19 bp, Homo sapiens
tccggttgcatactggact

SEQ ID NO: 5519621 - DNA, 19 bp, Homo sapiens
tccggtttgggctgtctta

SEQ ID NO: 5519622 - DNA, 13 bp, Homo sapiens
tccgtaaaaatga

SEQ ID NO: 5519623 - DNA, 22 bp, Homo sapiens
tccgtaacccaactctcctgga

SEQ ID NO: 5519624 - DNA, 20 bp, Homo sapiens
tccgtaataacacccttcct

SEQ ID NO: 5519625 - DNA, 22 bp, Homo sapiens
tccgtaggtagatgtgtaacct

SEQ ID NO: 5519626 - DNA, 20 bp, Homo sapiens
tccgtatctccctggagaag

SEQ ID NO: 5519627 - DNA, 15 bp, Homo sapiens
tccgtattgaatttg

SEQ ID NO: 5519628 - DNA, 16 bp, Homo sapiens
tccgtatttaaagttg

SEQ ID NO: 5519629 - DNA, 13 bp, Homo sapiens
tccgtatttcaga

SEQ ID NO: 5519630 - DNA, 16 bp, Homo sapiens
tccgtcaaaacagatt

SEQ ID NO: 5519631 - DNA, 22 bp, Homo sapiens
tccgtcacatatacaaaagcaa

SEQ ID NO: 5519632 - DNA, 22 bp, Homo sapiens
tccgtcaccagaattagtcctc

SEQ ID NO: 5519633 - DNA, 14 bp, Homo sapiens
tccgtcaccctggg

SEQ ID NO: 5519634 - DNA, 18 bp, Homo sapiens
tccgtcactacctggctg

SEQ ID NO: 5519635 - DNA, 17 bp, Homo sapiens
tccgtcattgctgctgc

SEQ ID NO: 5519636 - DNA, 18 bp, Homo sapiens
tccgtcattgctgctgct

SEQ ID NO: 5519637 - DNA, 13 bp, Homo sapiens
tccgtccacccag

SEQ ID NO: 5519638 - DNA, 20 bp, Homo sapiens
tccgtccacccaggctgcac

SEQ ID NO: 5519639 - DNA, 16 bp, Homo sapiens
tccgtccacccttcca

SEQ ID NO: 5519640 - DNA, 21 bp, Homo sapiens
tccgtccacccttccatcagc

SEQ ID NO: 5519641 - DNA, 14 bp, Homo sapiens
tccgtccatccccc

SEQ ID NO: 5519642 - DNA, 15 bp, Homo sapiens
tccgtccatccccct

SEQ ID NO: 5519643 - DNA, 16 bp, Homo sapiens
tccgtccatccccctt

SEQ ID NO: 5519644 - DNA, 20 bp, Homo sapiens
tccgtccatccgactgcccc

SEQ ID NO: 5519645 - DNA, 21 bp, Homo sapiens
tccgtccatccgactgcccct

SEQ ID NO: 5519646 - DNA, 19 bp, Homo sapiens
tccgtcccaaacagagggc

SEQ ID NO: 5519647 - DNA, 19 bp, Homo sapiens
tccgtcccacatcagggcg

SEQ ID NO: 5519648 - DNA, 13 bp, Homo sapiens
tccgtccccaggg

SEQ ID NO: 5519649 - DNA, 19 bp, Homo sapiens
tccgtccccccccaggccc

SEQ ID NO: 5519650 - DNA, 20 bp, Homo sapiens
tccgtccctttttctccaca

SEQ ID NO: 5519651 - DNA, 13 bp, Homo sapiens
tccgtcctctccc

SEQ ID NO: 5519652 - DNA, 23 bp, Homo sapiens
tccgtcctctccccagcctggca

SEQ ID NO: 5519653 - DNA, 17 bp, Homo sapiens
tccgtcctgctcgccct

SEQ ID NO: 5519654 - DNA, 14 bp, Homo sapiens
tccgtcctggcagg

SEQ ID NO: 5519655 - DNA, 18 bp, Homo sapiens
tccgtcctggcagggcag

SEQ ID NO: 5519656 - DNA, 17 bp, Homo sapiens
tccgtcctgtcactgat

SEQ ID NO: 5519657 - DNA, 22 bp, Homo sapiens
tccgtctaagtcatgagctgag

SEQ ID NO: 5519658 - DNA, 13 bp, Homo sapiens
tccgtctcccctc

SEQ ID NO: 5519659 - DNA, 14 bp, Homo sapiens
tccgtctcccctcg

SEQ ID NO: 5519660 - DNA, 17 bp, Homo sapiens
tccgtctcctctccagc

SEQ ID NO: 5519661 - DNA, 20 bp, Homo sapiens
tccgtctcctctccagccct

SEQ ID NO: 5519662 - DNA, 20 bp, Homo sapiens
tccgtctctcttgcttgagg

SEQ ID NO: 5519663 - DNA, 13 bp, Homo sapiens
tccgtctgtcctg

SEQ ID NO: 5519664 - DNA, 18 bp, Homo sapiens
tccgtctgtcctgcgcct

SEQ ID NO: 5519665 - DNA, 15 bp, Homo sapiens
tccgtctgtgtatgt

SEQ ID NO: 5519666 - DNA, 14 bp, Homo sapiens
tccgtcttcacact

SEQ ID NO: 5519667 - DNA, 19 bp, Homo sapiens
tccgtgaagggatttctta

SEQ ID NO: 5519668 - DNA, 23 bp, Homo sapiens
tccgtgaagggcaccgagaactc

SEQ ID NO: 5519669 - DNA, 16 bp, Homo sapiens
tccgtgaattctcgga

SEQ ID NO: 5519670 - DNA, 15 bp, Homo sapiens
tccgtgagacacaag

SEQ ID NO: 5519671 - DNA, 16 bp, Homo sapiens
tccgtgagacacaaga

SEQ ID NO: 5519672 - DNA, 11 bp, Homo sapiens
tccgtgagccc

SEQ ID NO: 5519673 - DNA, 13 bp, Homo sapiens
tccgtgagccctt

SEQ ID NO: 5519674 - DNA, 17 bp, Homo sapiens
tccgtgaggcagggaca

SEQ ID NO: 5519675 - DNA, 14 bp, Homo sapiens
tccgtgaggctgct

SEQ ID NO: 5519676 - DNA, 19 bp, Homo sapiens
tccgtgaggctgctgccat

SEQ ID NO: 5519677 - DNA, 21 bp, Homo sapiens
tcctacctcagcctcctgggt

SEQ ID NO: 5519678 - DNA, 17 bp, Homo sapiens
tcctacctccactctct

SEQ ID NO: 5519679 - DNA, 21 bp, Homo sapiens
tcctacctccactctctgccc

SEQ ID NO: 5519680 - DNA, 14 bp, Homo sapiens
tcctacctgaaggc

SEQ ID NO: 5519681 - DNA, 20 bp, Homo sapiens
tcctacctgaaggcagggct

SEQ ID NO: 5519682 - DNA, 18 bp, Homo sapiens
tcctacctgctgctgcta

SEQ ID NO: 5519683 - DNA, 22 bp, Homo sapiens
tcctacctggctggagaccgag

SEQ ID NO: 5519684 - DNA, 21 bp, Homo sapiens
tcctacctgggggcagaactc

SEQ ID NO: 5519685 - DNA, 17 bp, Homo sapiens
tcctacctgtctgctgc

SEQ ID NO: 5519686 - DNA, 18 bp, Homo sapiens
tcctacctgtctgctgcc

SEQ ID NO: 5519687 - DNA, 14 bp, Homo sapiens
tcctaccttgcttt

SEQ ID NO: 5519688 - DNA, 18 bp, Homo sapiens
tcctaccttggtcctgcc

SEQ ID NO: 5519689 - DNA, 23 bp, Homo sapiens
tcctacgcaccattttgtcaggt

SEQ ID NO: 5519690 - DNA, 17 bp, Homo sapiens
tcctactaataaaccag

SEQ ID NO: 5519691 - DNA, 19 bp, Homo sapiens
tcctactactttgtgtttt

SEQ ID NO: 5519692 - DNA, 16 bp, Homo sapiens
tcctactaggcaaaat

SEQ ID NO: 5519693 - DNA, 11 bp, Homo sapiens
tcctactccag

SEQ ID NO: 5519694 - DNA, 17 bp, Homo sapiens
tcctactcctacctggt

SEQ ID NO: 5519695 - DNA, 13 bp, Homo sapiens
tcctactcctgac

SEQ ID NO: 5519696 - DNA, 15 bp, Homo sapiens
tcctactcctggagc

SEQ ID NO: 5519697 - DNA, 16 bp, Homo sapiens
tcctactcggctctgc

SEQ ID NO: 5519698 - DNA, 22 bp, Homo sapiens
tcctactctcacactggttctc

SEQ ID NO: 5519699 - DNA, 14 bp, Homo sapiens
tcctactctgtgtc

SEQ ID NO: 5519700 - DNA, 15 bp, Homo sapiens
tcctactctgtgtca

SEQ ID NO: 5519701 - DNA, 19 bp, Homo sapiens
tcctactgcgcctcgtgct

SEQ ID NO: 5519702 - DNA, 16 bp, Homo sapiens
tcctactggtctctct

SEQ ID NO: 5519703 - DNA, 19 bp, Homo sapiens
tcctactggtctctctatg

SEQ ID NO: 5519704 - DNA, 13 bp, Homo sapiens
tcctactgtcctc

SEQ ID NO: 5519705 - DNA, 14 bp, Homo sapiens
tcctactgtcctca

SEQ ID NO: 5519706 - DNA, 14 bp, Homo sapiens
tcctactgtcctgg

SEQ ID NO: 5519707 - DNA, 18 bp, Homo sapiens
tcctactttacatatgct

SEQ ID NO: 5519708 - DNA, 17 bp, Homo sapiens
tcctactttagccactg

SEQ ID NO: 5519709 - DNA, 13 bp, Homo sapiens
tcctactttctat

SEQ ID NO: 5519710 - DNA, 18 bp, Homo sapiens
tcctactttgcttctctc

SEQ ID NO: 5519711 - DNA, 17 bp, Homo sapiens
tcctacttttaaagaat

SEQ ID NO: 5519712 - DNA, 17 bp, Homo sapiens
tcctacttttccttccc

SEQ ID NO: 5519713 - DNA, 16 bp, Homo sapiens
tcctagaaaacccttc

SEQ ID NO: 5519714 - DNA, 21 bp, Homo sapiens
tcctagaaattccccaccctg

SEQ ID NO: 5519715 - DNA, 20 bp, Homo sapiens
tcctagaactggtgatataa

SEQ ID NO: 5519716 - DNA, 17 bp, Homo sapiens
tcctagaagaaccaaat

SEQ ID NO: 5519717 - DNA, 19 bp, Homo sapiens
tcctagaagcccctgtcgc

SEQ ID NO: 5519718 - DNA, 17 bp, Homo sapiens
tcctagaattcgaaggc

SEQ ID NO: 5519719 - DNA, 23 bp, Homo sapiens
tcctagactaattaaaatctgga

SEQ ID NO: 5519720 - DNA, 16 bp, Homo sapiens
tcctagactgctcctg

SEQ ID NO: 5519721 - DNA, 18 bp, Homo sapiens
tcctagactgctcctggg

SEQ ID NO: 5519722 - DNA, 19 bp, Homo sapiens
tcctagactgctcctgggc

SEQ ID NO: 5519723 - DNA, 14 bp, Homo sapiens
tcctagagaactgt

SEQ ID NO: 5519724 - DNA, 18 bp, Homo sapiens
tcctagagaagacaggct

SEQ ID NO: 5519725 - DNA, 20 bp, Homo sapiens
tcctagagaagacaggctgg

SEQ ID NO: 5519726 - DNA, 18 bp, Homo sapiens
tcctagagacagaagcag

SEQ ID NO: 5519727 - DNA, 19 bp, Homo sapiens
tcctagagacagaagcagg

SEQ ID NO: 5519728 - DNA, 21 bp, Homo sapiens
tcctagagagcagaaataaaa

SEQ ID NO: 5519729 - DNA, 17 bp, Homo sapiens
tcctagagcatctgtcc

SEQ ID NO: 5519730 - DNA, 20 bp, Homo sapiens
tcctagagcatctgtcccac

SEQ ID NO: 5519731 - DNA, 14 bp, Homo sapiens
tcctagagctcctg

SEQ ID NO: 5519732 - DNA, 19 bp, Homo sapiens
tcctagagctcctgtccct

SEQ ID NO: 5519733 - DNA, 19 bp, Homo sapiens
tcctagaggccctttgctg

SEQ ID NO: 5519734 - DNA, 21 bp, Homo sapiens
tcctagaggccctttgctgtc

SEQ ID NO: 5519735 - DNA, 17 bp, Homo sapiens
tcctagagggaggggcc

SEQ ID NO: 5519736 - DNA, 18 bp, Homo sapiens
tcctagaggtgggcagct

SEQ ID NO: 5519737 - DNA, 20 bp, Homo sapiens
tcctagaggtgggcagctgg

SEQ ID NO: 5519738 - DNA, 13 bp, Homo sapiens
tcctagagtctta

SEQ ID NO: 5519739 - DNA, 16 bp, Homo sapiens
tcctagataaaaagat

SEQ ID NO: 5519740 - DNA, 16 bp, Homo sapiens
tcctagatctgcaggc

SEQ ID NO: 5519741 - DNA, 18 bp, Homo sapiens
tcctagatctgcaggctg

SEQ ID NO: 5519742 - DNA, 22 bp, Homo sapiens
tcctagatctgcaggctgcacc

SEQ ID NO: 5519743 - DNA, 22 bp, Homo sapiens
tcctagatggcagtcactgaat

SEQ ID NO: 5519744 - DNA, 19 bp, Homo sapiens
tcctagatgtgttctaagc

SEQ ID NO: 5519745 - DNA, 21 bp, Homo sapiens
tcctagattacatctgcctta

SEQ ID NO: 5519746 - DNA, 20 bp, Homo sapiens
tcctagattatatcaaagta

SEQ ID NO: 5519747 - DNA, 18 bp, Homo sapiens
tcctagcacacacttttg

SEQ ID NO: 5519748 - DNA, 19 bp, Homo sapiens
tcctagcacacacttttgg

SEQ ID NO: 5519749 - DNA, 15 bp, Homo sapiens
tcctagcacagatgg

SEQ ID NO: 5519750 - DNA, 12 bp, Homo sapiens
tcctagcactgc

SEQ ID NO: 5519751 - DNA, 22 bp, Homo sapiens
tcctagcactttgggaggctga

SEQ ID NO: 5519752 - DNA, 19 bp, Homo sapiens
tcctagcagacactgcctt

SEQ ID NO: 5519753 - DNA, 22 bp, Homo sapiens
tcctagcagacagaaactggat

SEQ ID NO: 5519754 - DNA, 21 bp, Homo sapiens
tcctagcaggatctgcccaca

SEQ ID NO: 5519755 - DNA, 22 bp, Homo sapiens
tcctagcaggatctgcccacac

SEQ ID NO: 5519756 - DNA, 19 bp, Homo sapiens
tcctagcatcagtagattt

SEQ ID NO: 5519757 - DNA, 13 bp, Homo sapiens
tcctagccactca

SEQ ID NO: 5519758 - DNA, 20 bp, Homo sapiens
tcctagccaggtctcctggg

SEQ ID NO: 5519759 - DNA, 16 bp, Homo sapiens
tcctagcccagtgctt

SEQ ID NO: 5519760 - DNA, 12 bp, Homo sapiens
tcctagccccac

SEQ ID NO: 5519761 - DNA, 15 bp, Homo sapiens
tcctagccccaccca

SEQ ID NO: 5519762 - DNA, 18 bp, Homo sapiens
tcctagccccacccagag

SEQ ID NO: 5519763 - DNA, 19 bp, Homo sapiens
tcctagcccctctctcaca

SEQ ID NO: 5519764 - DNA, 20 bp, Homo sapiens
tcctagcccctctctcacac

SEQ ID NO: 5519765 - DNA, 12 bp, Homo sapiens
tcctagcccctt

SEQ ID NO: 5519766 - DNA, 14 bp, Homo sapiens
tcctagcccttccc

SEQ ID NO: 5519767 - DNA, 16 bp, Homo sapiens
tcctagcccttccctg

SEQ ID NO: 5519768 - DNA, 18 bp, Homo sapiens
tcctagcccttccctgag

SEQ ID NO: 5519769 - DNA, 14 bp, Homo sapiens
tcctagcctctccg

SEQ ID NO: 5519770 - DNA, 15 bp, Homo sapiens
tcctagcctgctctg

SEQ ID NO: 5519771 - DNA, 23 bp, Homo sapiens
tcctagcgcagccatgtgattac

SEQ ID NO: 5519772 - DNA, 22 bp, Homo sapiens
tcctagctaggagcaggcttgt

SEQ ID NO: 5519773 - DNA, 21 bp, Homo sapiens
tcctagctggagaggagccct

SEQ ID NO: 5519774 - DNA, 23 bp, Homo sapiens
tcctagctggagaggagccctgc

SEQ ID NO: 5519775 - DNA, 21 bp, Homo sapiens
tcctagctggagtgccatggc

SEQ ID NO: 5519776 - DNA, 15 bp, Homo sapiens
tcctagctgtgtgca

SEQ ID NO: 5519777 - DNA, 20 bp, Homo sapiens
tcctagctgtgttattcctg

SEQ ID NO: 5519778 - DNA, 17 bp, Homo sapiens
tcctagctgttctaatt

SEQ ID NO: 5519779 - DNA, 20 bp, Homo sapiens
tcctagcttatctccctgct

SEQ ID NO: 5519780 - DNA, 21 bp, Homo sapiens
tcctaggaaaccagctcgtgg

SEQ ID NO: 5519781 - DNA, 22 bp, Homo sapiens
tcctaggagaagcagcctccta

SEQ ID NO: 5519782 - DNA, 19 bp, Homo sapiens
tcctaggagagccaacctc

SEQ ID NO: 5519783 - DNA, 18 bp, Homo sapiens
tcctaggaggtaatgacc

SEQ ID NO: 5519784 - DNA, 16 bp, Homo sapiens
tcctaggatgtcatgt

SEQ ID NO: 5519785 - DNA, 19 bp, Homo sapiens
tcctaggcaaacattgcaa

SEQ ID NO: 5519786 - DNA, 19 bp, Homo sapiens
tcctaggcaggacatgctg

SEQ ID NO: 5519787 - DNA, 13 bp, Homo sapiens
tcctaggccacac

SEQ ID NO: 5519788 - DNA, 16 bp, Homo sapiens
tcctaggcccaggcct

SEQ ID NO: 5519789 - DNA, 20 bp, Homo sapiens
tcctaggcccaggcctgggt

SEQ ID NO: 5519790 - DNA, 21 bp, Homo sapiens
tcctaggcccaggcctgggtt

SEQ ID NO: 5519791 - DNA, 17 bp, Homo sapiens
tcctaggcctcaactcc

SEQ ID NO: 5519792 - DNA, 18 bp, Homo sapiens
tcctaggcgctcagaggc

SEQ ID NO: 5519793 - DNA, 22 bp, Homo sapiens
tcctaggcgctcagaggccgct

SEQ ID NO: 5519794 - DNA, 20 bp, Homo sapiens
tcctaggctccaccccatcc

SEQ ID NO: 5519795 - DNA, 14 bp, Homo sapiens
tcctaggctccctg

SEQ ID NO: 5519796 - DNA, 15 bp, Homo sapiens
tcctaggctccctga

SEQ ID NO: 5519797 - DNA, 18 bp, Homo sapiens
tcctaggctccctgaggt

SEQ ID NO: 5519798 - DNA, 20 bp, Homo sapiens
tcctaggctctgggtgcagt

SEQ ID NO: 5519799 - DNA, 19 bp, Homo sapiens
tcctagggaagggtggtgg

SEQ ID NO: 5519800 - DNA, 22 bp, Homo sapiens
tcctagggcacttctagtttca

SEQ ID NO: 5519801 - DNA, 23 bp, Homo sapiens
tcctagggcacttctagtttcac

SEQ ID NO: 5519802 - DNA, 22 bp, Homo sapiens
tcctaggggaacagaccagtga

SEQ ID NO: 5519803 - DNA, 14 bp, Homo sapiens
tcctaggggaaggg

SEQ ID NO: 5519804 - DNA, 20 bp, Homo sapiens
tcctaggggaagggggtgca

SEQ ID NO: 5519805 - DNA, 18 bp, Homo sapiens
tcctaggggaatgagggg

SEQ ID NO: 5519806 - DNA, 23 bp, Homo sapiens
tcctaggggtgcgctcacctgca

SEQ ID NO: 5519807 - DNA, 15 bp, Homo sapiens
tcctagggtgggaag

SEQ ID NO: 5519808 - DNA, 20 bp, Homo sapiens
tcctagggtgttttaaacac

SEQ ID NO: 5519809 - DNA, 13 bp, Homo sapiens
tcctaggtcactt

SEQ ID NO: 5519810 - DNA, 23 bp, Homo sapiens
tcctaggtcacttgaagccaaac

SEQ ID NO: 5519811 - DNA, 17 bp, Homo sapiens
tcctagtatgccctgta

SEQ ID NO: 5519812 - DNA, 17 bp, Homo sapiens
tcctagtcattcttccc

SEQ ID NO: 5519813 - DNA, 14 bp, Homo sapiens
tcctagtgaaagag

SEQ ID NO: 5519814 - DNA, 20 bp, Homo sapiens
tcctagtgaaccacaggttt

SEQ ID NO: 5519815 - DNA, 21 bp, Homo sapiens
tcctagtgaaccacaggtttt

SEQ ID NO: 5519816 - DNA, 20 bp, Homo sapiens
tcctagtgaacctcaccccg

SEQ ID NO: 5519817 - DNA, 23 bp, Homo sapiens
tcctagtgagtgtgctgactttt

SEQ ID NO: 5519818 - DNA, 22 bp, Homo sapiens
tcctagtgctttccttttttaa

SEQ ID NO: 5519819 - DNA, 23 bp, Homo sapiens
tcctagtggagttttataaatta

SEQ ID NO: 5519820 - DNA, 16 bp, Homo sapiens
tcctagtgggttagtg

SEQ ID NO: 5519821 - DNA, 21 bp, Homo sapiens
tcctagtggtaggtcagaaga

SEQ ID NO: 5519822 - DNA, 21 bp, Homo sapiens
tcctagtgtctattccctgga

SEQ ID NO: 5519823 - DNA, 20 bp, Homo sapiens
tcctagttcatcccttctct

SEQ ID NO: 5519824 - DNA, 14 bp, Homo sapiens
tcctagttccacca

SEQ ID NO: 5519825 - DNA, 18 bp, Homo sapiens
tcctagttccattcttgg

SEQ ID NO: 5519826 - DNA, 17 bp, Homo sapiens
tcctagttctagaaaaa

SEQ ID NO: 5519827 - DNA, 18 bp, Homo sapiens
tcctagttctagaaaaac

SEQ ID NO: 5519828 - DNA, 16 bp, Homo sapiens
tcctagttctgtagaa

SEQ ID NO: 5519829 - DNA, 21 bp, Homo sapiens
tcctagttggtgagaaacctg

SEQ ID NO: 5519830 - DNA, 14 bp, Homo sapiens
tcctagtttgctgt

SEQ ID NO: 5519831 - DNA, 19 bp, Homo sapiens
tcctagttttatgtttctt

SEQ ID NO: 5519832 - DNA, 16 bp, Homo sapiens
tcctagttttcctact

SEQ ID NO: 5519833 - DNA, 17 bp, Homo sapiens
tcctagttttcctactt

SEQ ID NO: 5519834 - DNA, 22 bp, Homo sapiens
tcctataaagggcccacacctg

SEQ ID NO: 5519835 - DNA, 21 bp, Homo sapiens
tcctataaagtgcctcggaca

SEQ ID NO: 5519836 - DNA, 22 bp, Homo sapiens
tcctataaagtgcctcggacag

SEQ ID NO: 5519837 - DNA, 16 bp, Homo sapiens
tcctataacttcttcc

SEQ ID NO: 5519838 - DNA, 20 bp, Homo sapiens
tcctataatacaaatacaca

SEQ ID NO: 5519839 - DNA, 20 bp, Homo sapiens
tcctataatataataaatat

SEQ ID NO: 5519840 - DNA, 22 bp, Homo sapiens
tcctataatctgtcaaaacact

SEQ ID NO: 5519841 - DNA, 23 bp, Homo sapiens
tcctataatctgtcaaaacactg

SEQ ID NO: 5519842 - DNA, 20 bp, Homo sapiens
tcctataattccctatcttt

SEQ ID NO: 5519843 - DNA, 13 bp, Homo sapiens
tcctataccattt

SEQ ID NO: 5519844 - DNA, 20 bp, Homo sapiens
tcctataccggagctccagt

SEQ ID NO: 5519845 - DNA, 16 bp, Homo sapiens
tcctatatacctaata

SEQ ID NO: 5519846 - DNA, 15 bp, Homo sapiens
tcctatatagtttat

SEQ ID NO: 5519847 - DNA, 18 bp, Homo sapiens
tcctatatagtttattga

SEQ ID NO: 5519848 - DNA, 18 bp, Homo sapiens
tcctatatctgtttgtat

SEQ ID NO: 5519849 - DNA, 21 bp, Homo sapiens
tcctatattgttttcagtgta

SEQ ID NO: 5519850 - DNA, 19 bp, Homo sapiens
tcctatcacctatttccat

SEQ ID NO: 5519851 - DNA, 22 bp, Homo sapiens
tcctatcagcctgtctcttcca

SEQ ID NO: 5519852 - DNA, 12 bp, Homo sapiens
tcctcccacctc

SEQ ID NO: 5519853 - DNA, 14 bp, Homo sapiens
tcctcccactggga

SEQ ID NO: 5519854 - DNA, 10 bp, Homo sapiens
tcctcccagc

SEQ ID NO: 5519855 - DNA, 14 bp, Homo sapiens
tcctcccagcattg

SEQ ID NO: 5519856 - DNA, 17 bp, Homo sapiens
tcctcccagcgtgtgta

SEQ ID NO: 5519857 - DNA, 20 bp, Homo sapiens
tcctcccagcgtgtgtatcc

SEQ ID NO: 5519858 - DNA, 14 bp, Homo sapiens
tcctcccagctgct

SEQ ID NO: 5519859 - DNA, 13 bp, Homo sapiens
tcctcccagctgt

SEQ ID NO: 5519860 - DNA, 21 bp, Homo sapiens
tcctcccaggcgccccttccc

SEQ ID NO: 5519861 - DNA, 23 bp, Homo sapiens
tcctcccagggttttaactttgt

SEQ ID NO: 5519862 - DNA, 21 bp, Homo sapiens
tcctcccaggtttcttctctg

SEQ ID NO: 5519863 - DNA, 11 bp, Homo sapiens
tcctcccagtg

SEQ ID NO: 5519864 - DNA, 22 bp, Homo sapiens
tcctcccagtgagactgcccca

SEQ ID NO: 5519865 - DNA, 15 bp, Homo sapiens
tcctcccagtgcctt

SEQ ID NO: 5519866 - DNA, 16 bp, Homo sapiens
tcctcccatcccctca

SEQ ID NO: 5519867 - DNA, 18 bp, Homo sapiens
tcctcccatcccctggac

SEQ ID NO: 5519868 - DNA, 16 bp, Homo sapiens
tcctcccatctccttc

SEQ ID NO: 5519869 - DNA, 14 bp, Homo sapiens
tcctcccatggcct

SEQ ID NO: 5519870 - DNA, 20 bp, Homo sapiens
tcctcccatggccttccctc

SEQ ID NO: 5519871 - DNA, 13 bp, Homo sapiens
tcctcccattccc

SEQ ID NO: 5519872 - DNA, 15 bp, Homo sapiens
tcctcccattgccca

SEQ ID NO: 5519873 - DNA, 16 bp, Homo sapiens
tcctcccattgcccag

SEQ ID NO: 5519874 - DNA, 18 bp, Homo sapiens
tcctcccattgcccagtg

SEQ ID NO: 5519875 - DNA, 19 bp, Homo sapiens
tcctccccaaggagacaca

SEQ ID NO: 5519876 - DNA, 23 bp, Homo sapiens
tcctccccacactccactctgat

SEQ ID NO: 5519877 - DNA, 11 bp, Homo sapiens
tcctccccacc

SEQ ID NO: 5519878 - DNA, 19 bp, Homo sapiens
tcctccccaccagagctgc

SEQ ID NO: 5519879 - DNA, 22 bp, Homo sapiens
tcctccccaccagagctgcctc

SEQ ID NO: 5519880 - DNA, 14 bp, Homo sapiens
tcctccccaccctc

SEQ ID NO: 5519881 - DNA, 16 bp, Homo sapiens
tcctccccacctgtag

SEQ ID NO: 5519882 - DNA, 17 bp, Homo sapiens
tcctccccacctgtagc

SEQ ID NO: 5519883 - DNA, 14 bp, Homo sapiens
tcctccccaccttc

SEQ ID NO: 5519884 - DNA, 22 bp, Homo sapiens
tcctccccaccttcaatgactt

SEQ ID NO: 5519885 - DNA, 21 bp, Homo sapiens
tcctccccacttgtccgctgg

SEQ ID NO: 5519886 - DNA, 14 bp, Homo sapiens
tcctccccaggtgg

SEQ ID NO: 5519887 - DNA, 22 bp, Homo sapiens
tcctccccagtctacgttctcc

SEQ ID NO: 5519888 - DNA, 13 bp, Homo sapiens
tcctccccataca

SEQ ID NO: 5519889 - DNA, 16 bp, Homo sapiens
tcctccccatacacac

SEQ ID NO: 5519890 - DNA, 22 bp, Homo sapiens
tcctccccattagagtcagcct

SEQ ID NO: 5519891 - DNA, 15 bp, Homo sapiens
tcctcccccacgcct

SEQ ID NO: 5519892 - DNA, 23 bp, Homo sapiens
tcctcccccacgcctccatccac

SEQ ID NO: 5519893 - DNA, 15 bp, Homo sapiens
tcctccccctcctcc

SEQ ID NO: 5519894 - DNA, 18 bp, Homo sapiens
tcctccccctcctccatg

SEQ ID NO: 5519895 - DNA, 15 bp, Homo sapiens
tcctccccctgccag

SEQ ID NO: 5519896 - DNA, 14 bp, Homo sapiens
tcctccccctgctc

SEQ ID NO: 5519897 - DNA, 11 bp, Homo sapiens
tcctccccctt

SEQ ID NO: 5519898 - DNA, 13 bp, Homo sapiens
tcctccccctttg

SEQ ID NO: 5519899 - DNA, 18 bp, Homo sapiens
tcctccccgatccccgac

SEQ ID NO: 5519900 - DNA, 15 bp, Homo sapiens
tcctccccgctccgt

SEQ ID NO: 5519901 - DNA, 19 bp, Homo sapiens
tcctcccctcacagcctct

SEQ ID NO: 5519902 - DNA, 19 bp, Homo sapiens
tcctcccctccagctccct

SEQ ID NO: 5519903 - DNA, 18 bp, Homo sapiens
tcctcccctccctcagag

SEQ ID NO: 5519904 - DNA, 13 bp, Homo sapiens
tcctcccctcctc

SEQ ID NO: 5519905 - DNA, 22 bp, Homo sapiens
tcctcccctcctcctggactcc

SEQ ID NO: 5519906 - DNA, 16 bp, Homo sapiens
tcctcccctgccgcct

SEQ ID NO: 5519907 - DNA, 17 bp, Homo sapiens
tcctcccctgccgcctc

SEQ ID NO: 5519908 - DNA, 20 bp, Homo sapiens
tcctcccctgccgcctcccg

SEQ ID NO: 5519909 - DNA, 14 bp, Homo sapiens
tcctcccctggact

SEQ ID NO: 5519910 - DNA, 13 bp, Homo sapiens
tcctcccctggag

SEQ ID NO: 5519911 - DNA, 14 bp, Homo sapiens
tcctcccctgtagg

SEQ ID NO: 5519912 - DNA, 11 bp, Homo sapiens
tcctccccttc

SEQ ID NO: 5519913 - DNA, 13 bp, Homo sapiens
tcctccccttcct

SEQ ID NO: 5519914 - DNA, 19 bp, Homo sapiens
tcctccccttcctgcaccc

SEQ ID NO: 5519915 - DNA, 22 bp, Homo sapiens
tcctccccttttttttctgatt

SEQ ID NO: 5519916 - DNA, 16 bp, Homo sapiens
tcctcccgactgacca

SEQ ID NO: 5519917 - DNA, 20 bp, Homo sapiens
tcctcccgagctcctcttcc

SEQ ID NO: 5519918 - DNA, 22 bp, Homo sapiens
tcctcccgccaggagcttcttc

SEQ ID NO: 5519919 - DNA, 14 bp, Homo sapiens
tcctcccgccccgc

SEQ ID NO: 5519920 - DNA, 16 bp, Homo sapiens
tcctcccgccccgccc

SEQ ID NO: 5519921 - DNA, 14 bp, Homo sapiens
tcctcccgggccct

SEQ ID NO: 5519922 - DNA, 15 bp, Homo sapiens
tcctcccgggccctc

SEQ ID NO: 5519923 - DNA, 19 bp, Homo sapiens
tcctcccgggccctccctt

SEQ ID NO: 5519924 - DNA, 21 bp, Homo sapiens
tcctcccgggccctcccttgg

SEQ ID NO: 5519925 - DNA, 18 bp, Homo sapiens
tcctcccggggccttcct

SEQ ID NO: 5519926 - DNA, 13 bp, Homo sapiens
tcctccctcaaac

SEQ ID NO: 5519927 - DNA, 13 bp, Homo sapiens
tcctccctcagac

SEQ ID NO: 5519928 - DNA, 16 bp, Homo sapiens
tcctccctcagaccca

SEQ ID NO: 5519929 - DNA, 18 bp, Homo sapiens
tcctccctcagacccagc

SEQ ID NO: 5519930 - DNA, 18 bp, Homo sapiens
tcctccctcagactcaga

SEQ ID NO: 5519931 - DNA, 23 bp, Homo sapiens
tcctccctcagactcagaggtcc

SEQ ID NO: 5519932 - DNA, 13 bp, Homo sapiens
tcctccctcagcc

SEQ ID NO: 5519933 - DNA, 12 bp, Homo sapiens
tcctccctccaa

SEQ ID NO: 5519934 - DNA, 21 bp, Homo sapiens
tcctccctccaagcctggcac

SEQ ID NO: 5519935 - DNA, 23 bp, Homo sapiens
tcctccctccaagcctggcaccc

SEQ ID NO: 5519936 - DNA, 12 bp, Homo sapiens
tcctccctccac

SEQ ID NO: 5519937 - DNA, 11 bp, Homo sapiens
tcctccctccc

SEQ ID NO: 5519938 - DNA, 13 bp, Homo sapiens
tcctccctcccaa

SEQ ID NO: 5519939 - DNA, 16 bp, Homo sapiens
tcctccctcccagctg

SEQ ID NO: 5519940 - DNA, 19 bp, Homo sapiens
tcctccctcccagctgcac

SEQ ID NO: 5519941 - DNA, 15 bp, Homo sapiens
tcctccctccccttc

SEQ ID NO: 5519942 - DNA, 13 bp, Homo sapiens
tcctccctccctc

SEQ ID NO: 5519943 - DNA, 15 bp, Homo sapiens
tcctccctccctctt

SEQ ID NO: 5519944 - DNA, 17 bp, Homo sapiens
tcctccctccctctttc

SEQ ID NO: 5519945 - DNA, 17 bp, Homo sapiens
tcctccctccctgcagg

SEQ ID NO: 5519946 - DNA, 18 bp, Homo sapiens
tcctccctcctcactccc

SEQ ID NO: 5519947 - DNA, 16 bp, Homo sapiens
tcctccctctgcctca

SEQ ID NO: 5519948 - DNA, 19 bp, Homo sapiens
tcctccctctgcctcatcc

SEQ ID NO: 5519949 - DNA, 19 bp, Homo sapiens
tcctccctctgtccctctc

SEQ ID NO: 5519950 - DNA, 17 bp, Homo sapiens
tcctccctgatgtacag

SEQ ID NO: 5519951 - DNA, 14 bp, Homo sapiens
tcctccctgccccc

SEQ ID NO: 5519952 - DNA, 14 bp, Homo sapiens
tcctccctgctcct

SEQ ID NO: 5519953 - DNA, 12 bp, Homo sapiens
tcctccctggag

SEQ ID NO: 5519954 - DNA, 14 bp, Homo sapiens
tcctccctggagaa

SEQ ID NO: 5519955 - DNA, 13 bp, Homo sapiens
tcctccctggagc

SEQ ID NO: 5519956 - DNA, 15 bp, Homo sapiens
tcctccctggcagac

SEQ ID NO: 5519957 - DNA, 12 bp, Homo sapiens
tcctccctggct

SEQ ID NO: 5519958 - DNA, 20 bp, Homo sapiens
tcctccctggctgcagcctc

SEQ ID NO: 5519959 - DNA, 19 bp, Homo sapiens
tcctccctgggcagaaagt

SEQ ID NO: 5519960 - DNA, 14 bp, Homo sapiens
tcctccctgggggc

SEQ ID NO: 5519961 - DNA, 20 bp, Homo sapiens
tcctccctgggggcgggact

SEQ ID NO: 5519962 - DNA, 12 bp, Homo sapiens
tcctccctgtaa

SEQ ID NO: 5519963 - DNA, 13 bp, Homo sapiens
tcctccctgtctc

SEQ ID NO: 5519964 - DNA, 12 bp, Homo sapiens
tcctccctgtta

SEQ ID NO: 5519965 - DNA, 18 bp, Homo sapiens
tcctcccttacagagcat

SEQ ID NO: 5519966 - DNA, 17 bp, Homo sapiens
tcctcccttccccactc

SEQ ID NO: 5519967 - DNA, 18 bp, Homo sapiens
tcctcccttccttttccc

SEQ ID NO: 5519968 - DNA, 23 bp, Homo sapiens
tcctcccttgccccaggccaggt

SEQ ID NO: 5519969 - DNA, 19 bp, Homo sapiens
tcctcccttgggttctgat

SEQ ID NO: 5519970 - DNA, 20 bp, Homo sapiens
tcctcccttgggttctgata

SEQ ID NO: 5519971 - DNA, 19 bp, Homo sapiens
tcctccctttttccttgtc

SEQ ID NO: 5519972 - DNA, 14 bp, Homo sapiens
tcctccgagaccca

SEQ ID NO: 5519973 - DNA, 14 bp, Homo sapiens
tcctccgcatgcca

SEQ ID NO: 5519974 - DNA, 19 bp, Homo sapiens
tcctccgcctactgtccct

SEQ ID NO: 5519975 - DNA, 16 bp, Homo sapiens
tcctccgcctgtgtcc

SEQ ID NO: 5519976 - DNA, 19 bp, Homo sapiens
tcctccgcggaggcccctg

SEQ ID NO: 5519977 - DNA, 21 bp, Homo sapiens
tcctccggagcctcatgttct

SEQ ID NO: 5519978 - DNA, 23 bp, Homo sapiens
tcctccggagcctcatgttctct

SEQ ID NO: 5519979 - DNA, 19 bp, Homo sapiens
tcctccggttcttcctcgg

SEQ ID NO: 5519980 - DNA, 20 bp, Homo sapiens
tcctccggttgcatactgga

SEQ ID NO: 5519981 - DNA, 23 bp, Homo sapiens
tcctccggttgcatactggactc

SEQ ID NO: 5519982 - DNA, 16 bp, Homo sapiens
tcctccgtagggtctt

SEQ ID NO: 5519983 - DNA, 14 bp, Homo sapiens
tcctccgtccaccc

SEQ ID NO: 5519984 - DNA, 17 bp, Homo sapiens
tcctccgtccacccagg

SEQ ID NO: 5519985 - DNA, 21 bp, Homo sapiens
tcctccgtccacccaggctgc

SEQ ID NO: 5519986 - DNA, 13 bp, Homo sapiens
tcctccgtctgac

SEQ ID NO: 5519987 - DNA, 19 bp, Homo sapiens
tcctccgtgagcaccacca

SEQ ID NO: 5519988 - DNA, 13 bp, Homo sapiens
tcctccgtggcac

SEQ ID NO: 5519989 - DNA, 14 bp, Homo sapiens
tcctccgtggcaca

SEQ ID NO: 5519990 - DNA, 15 bp, Homo sapiens
tcctccgtggcacat

SEQ ID NO: 5519991 - DNA, 18 bp, Homo sapiens
tcctccgtgggcagctcc

SEQ ID NO: 5519992 - DNA, 19 bp, Homo sapiens
tcctcctaagtcccttcct

SEQ ID NO: 5519993 - DNA, 22 bp, Homo sapiens
tcctcctaccgaaaccttgcct

SEQ ID NO: 5519994 - DNA, 19 bp, Homo sapiens
tcctcctacctcagcctcc

SEQ ID NO: 5519995 - DNA, 16 bp, Homo sapiens
tcctcctacctgggga

SEQ ID NO: 5519996 - DNA, 22 bp, Homo sapiens
tcctcctacctggggactcctc

SEQ ID NO: 5519997 - DNA, 14 bp, Homo sapiens
tcctcctacttaca

SEQ ID NO: 5519998 - DNA, 12 bp, Homo sapiens
tcctcctagctg

SEQ ID NO: 5519999 - DNA, 21 bp, Homo sapiens
tcctcctaggcgctcagaggc

SEQ ID NO: 5520000 - DNA, 22 bp, Homo sapiens
tcctcctatctccctggctcac

SEQ ID NO: 5520001 - DNA, 19 bp, Homo sapiens
tcctcctatgtgtgcctcc

SEQ ID NO: 5520002 - DNA, 15 bp, Homo sapiens
tcctcctcagccccc

SEQ ID NO: 5520003 - DNA, 23 bp, Homo sapiens
tcctcctcagcccccaggccagg

SEQ ID NO: 5520004 - DNA, 16 bp, Homo sapiens
tcctcctcagcctccc

SEQ ID NO: 5520005 - DNA, 15 bp, Homo sapiens
tcctcctccacagtg

SEQ ID NO: 5520006 - DNA, 16 bp, Homo sapiens
tcctcctccacagtgc

SEQ ID NO: 5520007 - DNA, 18 bp, Homo sapiens
tcctcctccacagtgctg

SEQ ID NO: 5520008 - DNA, 20 bp, Homo sapiens
tcctcctccacagtgctgct

SEQ ID NO: 5520009 - DNA, 13 bp, Homo sapiens
tcctcctccacca

SEQ ID NO: 5520010 - DNA, 15 bp, Homo sapiens
tcctcctccaccacc

SEQ ID NO: 5520011 - DNA, 15 bp, Homo sapiens
tcctcctccagccca

SEQ ID NO: 5520012 - DNA, 12 bp, Homo sapiens
tcctcctccagg

SEQ ID NO: 5520013 - DNA, 16 bp, Homo sapiens
tcctcctccagggaca

SEQ ID NO: 5520014 - DNA, 15 bp, Homo sapiens
tcctcctccagggtg

SEQ ID NO: 5520015 - DNA, 14 bp, Homo sapiens
tcctcctccatcac

SEQ ID NO: 5520016 - DNA, 17 bp, Homo sapiens
tcctcctcccagtgcct

SEQ ID NO: 5520017 - DNA, 20 bp, Homo sapiens
tcctcctcccagtgccttct

SEQ ID NO: 5520018 - DNA, 15 bp, Homo sapiens
tcctcctcccccaga

SEQ ID NO: 5520019 - DNA, 19 bp, Homo sapiens
tcctcctccctcctcactc

SEQ ID NO: 5520020 - DNA, 13 bp, Homo sapiens
tcctcctccctgc

SEQ ID NO: 5520021 - DNA, 13 bp, Homo sapiens
tcctcctcctcat

SEQ ID NO: 5520022 - DNA, 14 bp, Homo sapiens
tcctcctcctcctc

SEQ ID NO: 5520023 - DNA, 13 bp, Homo sapiens
tcctcctcctgcc

SEQ ID NO: 5520024 - DNA, 14 bp, Homo sapiens
tcctcctcctgccc

SEQ ID NO: 5520025 - DNA, 16 bp, Homo sapiens
tcctcctcctgccctc

SEQ ID NO: 5520026 - DNA, 13 bp, Homo sapiens
tcctcctcctggg

SEQ ID NO: 5520027 - DNA, 12 bp, Homo sapiens
tcctcctcgctc

SEQ ID NO: 5520028 - DNA, 23 bp, Homo sapiens
tcctcctcgctcctccttcccag

SEQ ID NO: 5520029 - DNA, 14 bp, Homo sapiens
tcctcctctacctc

SEQ ID NO: 5520030 - DNA, 15 bp, Homo sapiens
tcctcctctacctct

SEQ ID NO: 5520031 - DNA, 22 bp, Homo sapiens
tcctcctctcaaacctggcaga

SEQ ID NO: 5520032 - DNA, 15 bp, Homo sapiens
tcctcctctccatgc

SEQ ID NO: 5520033 - DNA, 21 bp, Homo sapiens
tcctcttagcctctggatcta

SEQ ID NO: 5520034 - DNA, 17 bp, Homo sapiens
tcctcttagctcagctg

SEQ ID NO: 5520035 - DNA, 19 bp, Homo sapiens
tcctcttatatgtgcccct

SEQ ID NO: 5520036 - DNA, 18 bp, Homo sapiens
tcctcttattcctttaaa

SEQ ID NO: 5520037 - DNA, 19 bp, Homo sapiens
tcctcttattcctttaaag

SEQ ID NO: 5520038 - DNA, 18 bp, Homo sapiens
tcctcttcaccaggtgca

SEQ ID NO: 5520039 - DNA, 13 bp, Homo sapiens
tcctcttcagaac

SEQ ID NO: 5520040 - DNA, 14 bp, Homo sapiens
tcctcttccagagt

SEQ ID NO: 5520041 - DNA, 14 bp, Homo sapiens
tcctcttccccaga

SEQ ID NO: 5520042 - DNA, 18 bp, Homo sapiens
tcctcttccccttgccct

SEQ ID NO: 5520043 - DNA, 13 bp, Homo sapiens
tcctcttcctctg

SEQ ID NO: 5520044 - DNA, 16 bp, Homo sapiens
tcctcttcctctgagg

SEQ ID NO: 5520045 - DNA, 14 bp, Homo sapiens
tcctcttcctgccc

SEQ ID NO: 5520046 - DNA, 15 bp, Homo sapiens
tcctcttcctgccct

SEQ ID NO: 5520047 - DNA, 15 bp, Homo sapiens
tcctcttccttctct

SEQ ID NO: 5520048 - DNA, 16 bp, Homo sapiens
tcctcttccttctcta

SEQ ID NO: 5520049 - DNA, 19 bp, Homo sapiens
tcctcttccttctctactc

SEQ ID NO: 5520050 - DNA, 18 bp, Homo sapiens
tcctcttcggccctcaga

SEQ ID NO: 5520051 - DNA, 21 bp, Homo sapiens
tcctcttcggccctcagatgt

SEQ ID NO: 5520052 - DNA, 21 bp, Homo sapiens
tcctcttctaaaatagcaata

SEQ ID NO: 5520053 - DNA, 23 bp, Homo sapiens
tcctcttctaaaatagcaataac

SEQ ID NO: 5520054 - DNA, 23 bp, Homo sapiens
tcctcttctactcacttttccca

SEQ ID NO: 5520055 - DNA, 21 bp, Homo sapiens
tcctcttctcccctcactttt

SEQ ID NO: 5520056 - DNA, 22 bp, Homo sapiens
tcctcttctgtaaaatgggtat

SEQ ID NO: 5520057 - DNA, 23 bp, Homo sapiens
tcctcttctgtgagtcagtcagc

SEQ ID NO: 5520058 - DNA, 17 bp, Homo sapiens
tcctcttgaccctgcac

SEQ ID NO: 5520059 - DNA, 13 bp, Homo sapiens
tcctcttgactct

SEQ ID NO: 5520060 - DNA, 17 bp, Homo sapiens
tcctcttgcatttcact

SEQ ID NO: 5520061 - DNA, 16 bp, Homo sapiens
tcctcttgccacatct

SEQ ID NO: 5520062 - DNA, 17 bp, Homo sapiens
tcctcttgccacatctt

SEQ ID NO: 5520063 - DNA, 16 bp, Homo sapiens
tcctcttgccagctca

SEQ ID NO: 5520064 - DNA, 12 bp, Homo sapiens
tcctcttgccat

SEQ ID NO: 5520065 - DNA, 17 bp, Homo sapiens
tcctcttgcctcctgga

SEQ ID NO: 5520066 - DNA, 13 bp, Homo sapiens
tcctcttgctcaa

SEQ ID NO: 5520067 - DNA, 14 bp, Homo sapiens
tcctcttggagctg

SEQ ID NO: 5520068 - DNA, 15 bp, Homo sapiens
tcctcttggagctga

SEQ ID NO: 5520069 - DNA, 19 bp, Homo sapiens
tcctcttggcaagatgttt

SEQ ID NO: 5520070 - DNA, 23 bp, Homo sapiens
tcctcttggcaagatgtttctta

SEQ ID NO: 5520071 - DNA, 20 bp, Homo sapiens
tcctcttggccatccttctg

SEQ ID NO: 5520072 - DNA, 16 bp, Homo sapiens
tcctcttggtgggtgt

SEQ ID NO: 5520073 - DNA, 21 bp, Homo sapiens
tcctcttggtgtcaaattttt

SEQ ID NO: 5520074 - DNA, 23 bp, Homo sapiens
tcctcttggtgtcaaatttttaa

SEQ ID NO: 5520075 - DNA, 19 bp, Homo sapiens
tcctcttgtcctacaatga

SEQ ID NO: 5520076 - DNA, 21 bp, Homo sapiens
tcctcttgtcctggcccttca

SEQ ID NO: 5520077 - DNA, 23 bp, Homo sapiens
tcctcttgtcctggcccttcagt

SEQ ID NO: 5520078 - DNA, 16 bp, Homo sapiens
tcctcttgttcctgaa

SEQ ID NO: 5520079 - DNA, 13 bp, Homo sapiens
tcctctttcagct

SEQ ID NO: 5520080 - DNA, 12 bp, Homo sapiens
tcctctttctgc

SEQ ID NO: 5520081 - DNA, 15 bp, Homo sapiens
tcctctttctgctct

SEQ ID NO: 5520082 - DNA, 16 bp, Homo sapiens
tcctctttctgctctg

SEQ ID NO: 5520083 - DNA, 19 bp, Homo sapiens
tcctctttctgctctgcca

SEQ ID NO: 5520084 - DNA, 14 bp, Homo sapiens
tcctctttgcagtg

SEQ ID NO: 5520085 - DNA, 14 bp, Homo sapiens
tcctctttgcatgg

SEQ ID NO: 5520086 - DNA, 17 bp, Homo sapiens
tcctctttgcatggaat

SEQ ID NO: 5520087 - DNA, 16 bp, Homo sapiens
tcctctttgctttgct

SEQ ID NO: 5520088 - DNA, 20 bp, Homo sapiens
tcctctttgctttgctttct

SEQ ID NO: 5520089 - DNA, 23 bp, Homo sapiens
tcctctttgctttgctttctgct

SEQ ID NO: 5520090 - DNA, 19 bp, Homo sapiens
tcctctttggtctacactg

SEQ ID NO: 5520091 - DNA, 23 bp, Homo sapiens
tcctctttggtctacactgtgct

SEQ ID NO: 5520092 - DNA, 15 bp, Homo sapiens
tcctctttgttttgt

SEQ ID NO: 5520093 - DNA, 21 bp, Homo sapiens
tcctcttttatcttggactga

SEQ ID NO: 5520094 - DNA, 15 bp, Homo sapiens
tcctcttttcctggc

SEQ ID NO: 5520095 - DNA, 19 bp, Homo sapiens
tcctcttttcctggcagct

SEQ ID NO: 5520096 - DNA, 20 bp, Homo sapiens
tcctcttttcctggcagctg

SEQ ID NO: 5520097 - DNA, 21 bp, Homo sapiens
tcctcttttgtattgtttcta

SEQ ID NO: 5520098 - DNA, 23 bp, Homo sapiens
tcctcttttgtattgtttctaca

SEQ ID NO: 5520099 - DNA, 21 bp, Homo sapiens
tcctcttttgtgctgcttctc

SEQ ID NO: 5520100 - DNA, 22 bp, Homo sapiens
tcctcttttgttgtttcttaat

SEQ ID NO: 5520101 - DNA, 18 bp, Homo sapiens
tcctctttttctgtgtga

SEQ ID NO: 5520102 - DNA, 21 bp, Homo sapiens
tcctctttttctgtgtgaggt

SEQ ID NO: 5520103 - DNA, 22 bp, Homo sapiens
tcctgaaaagctgcatttaaat

SEQ ID NO: 5520104 - DNA, 21 bp, Homo sapiens
tcctgaaaaggtttatgaaaa

SEQ ID NO: 5520105 - DNA, 17 bp, Homo sapiens
tcctgaaacaacttgga

SEQ ID NO: 5520106 - DNA, 20 bp, Homo sapiens
tcctgaaacccaaagccctg

SEQ ID NO: 5520107 - DNA, 21 bp, Homo sapiens
tcctgaaacccaaagccctgg

SEQ ID NO: 5520108 - DNA, 23 bp, Homo sapiens
tcctgaaacccaaagccctggta

SEQ ID NO: 5520109 - DNA, 16 bp, Homo sapiens
tcctgaaacgctcctt

SEQ ID NO: 5520110 - DNA, 22 bp, Homo sapiens
tcctgaaacgctcctttgtgtg

SEQ ID NO: 5520111 - DNA, 19 bp, Homo sapiens
tcctgaaacttacacacaa

SEQ ID NO: 5520112 - DNA, 21 bp, Homo sapiens
tcctgaaagaaacagttaact

SEQ ID NO: 5520113 - DNA, 19 bp, Homo sapiens
tcctgaaagccagcaaagc

SEQ ID NO: 5520114 - DNA, 15 bp, Homo sapiens
tcctgaaagcggctg

SEQ ID NO: 5520115 - DNA, 22 bp, Homo sapiens
tcctgaaagcggctgcctccat

SEQ ID NO: 5520116 - DNA, 15 bp, Homo sapiens
tcctgaaagctgttg

SEQ ID NO: 5520117 - DNA, 14 bp, Homo sapiens
tcctgaaagtctgt

SEQ ID NO: 5520118 - DNA, 12 bp, Homo sapiens
tcctgaaataaa

SEQ ID NO: 5520119 - DNA, 19 bp, Homo sapiens
tcctgaaatctacaggcct

SEQ ID NO: 5520120 - DNA, 16 bp, Homo sapiens
tcctgaaatgccaagt

SEQ ID NO: 5520121 - DNA, 18 bp, Homo sapiens
tcctgaaatgccaagtgc

SEQ ID NO: 5520122 - DNA, 12 bp, Homo sapiens
tcctgaaattca

SEQ ID NO: 5520123 - DNA, 15 bp, Homo sapiens
tcctgaacagcatgg

SEQ ID NO: 5520124 - DNA, 23 bp, Homo sapiens
tcctgaacagcatggcactccct

SEQ ID NO: 5520125 - DNA, 14 bp, Homo sapiens
tcctgaaccagtcc

SEQ ID NO: 5520126 - DNA, 15 bp, Homo sapiens
tcctgaaccagtcct

SEQ ID NO: 5520127 - DNA, 14 bp, Homo sapiens
tcctgaaccatgtg

SEQ ID NO: 5520128 - DNA, 16 bp, Homo sapiens
tcctgaaccgcacagc

SEQ ID NO: 5520129 - DNA, 17 bp, Homo sapiens
tcctgaaccgcacagct

SEQ ID NO: 5520130 - DNA, 20 bp, Homo sapiens
tcctgaaccgcacagctcag

SEQ ID NO: 5520131 - DNA, 18 bp, Homo sapiens
tcctgaacctggaaatga

SEQ ID NO: 5520132 - DNA, 17 bp, Homo sapiens
tcctgaacctttcaaaa

SEQ ID NO: 5520133 - DNA, 17 bp, Homo sapiens
tcctgaactttctccct

SEQ ID NO: 5520134 - DNA, 21 bp, Homo sapiens
tcctgaactttctccctcatc

SEQ ID NO: 5520135 - DNA, 20 bp, Homo sapiens
tcctgaagaaaccacaggtt

SEQ ID NO: 5520136 - DNA, 13 bp, Homo sapiens
tcctgaagaacca

SEQ ID NO: 5520137 - DNA, 20 bp, Homo sapiens
tcctgaagaatctcgactct

SEQ ID NO: 5520138 - DNA, 20 bp, Homo sapiens
tcctgaagaggcgggccagc

SEQ ID NO: 5520139 - DNA, 13 bp, Homo sapiens
tcctgaagccaga

SEQ ID NO: 5520140 - DNA, 18 bp, Homo sapiens
tcctgaagccctctgtct

SEQ ID NO: 5520141 - DNA, 15 bp, Homo sapiens
tcctgaagcctctgc

SEQ ID NO: 5520142 - DNA, 19 bp, Homo sapiens
tcctgaagcctctgccctg

SEQ ID NO: 5520143 - DNA, 13 bp, Homo sapiens
tcctgaagctgag

SEQ ID NO: 5520144 - DNA, 19 bp, Homo sapiens
tcctgaagctgctggagcc

SEQ ID NO: 5520145 - DNA, 15 bp, Homo sapiens
tcctgaagctgctgt

SEQ ID NO: 5520146 - DNA, 20 bp, Homo sapiens
tcctgaaggaggcggggctc

SEQ ID NO: 5520147 - DNA, 21 bp, Homo sapiens
tcctgaaggaggcggggctct

SEQ ID NO: 5520148 - DNA, 14 bp, Homo sapiens
tcctgaagggaact

SEQ ID NO: 5520149 - DNA, 17 bp, Homo sapiens
tcctgaataaaccagta

SEQ ID NO: 5520150 - DNA, 12 bp, Homo sapiens
tcctgaatattt

SEQ ID NO: 5520151 - DNA, 18 bp, Homo sapiens
tcctgaatccctttcagt

SEQ ID NO: 5520152 - DNA, 19 bp, Homo sapiens
tcctgaatggctttgtctt

SEQ ID NO: 5520153 - DNA, 22 bp, Homo sapiens
tcctgaatggctttgtcttgaa

SEQ ID NO: 5520154 - DNA, 15 bp, Homo sapiens
tcctgaattctattt

SEQ ID NO: 5520155 - DNA, 13 bp, Homo sapiens
tcctgacaaatat

SEQ ID NO: 5520156 - DNA, 17 bp, Homo sapiens
tcctgacacattttcaa

SEQ ID NO: 5520157 - DNA, 15 bp, Homo sapiens
tcctgacaccccact

SEQ ID NO: 5520158 - DNA, 14 bp, Homo sapiens
tcctgacacctcca

SEQ ID NO: 5520159 - DNA, 17 bp, Homo sapiens
tcctgacagaaggtgcc

SEQ ID NO: 5520160 - DNA, 23 bp, Homo sapiens
tcctgacagatgcctggtgagca

SEQ ID NO: 5520161 - DNA, 15 bp, Homo sapiens
tcctgacagcactcc

SEQ ID NO: 5520162 - DNA, 20 bp, Homo sapiens
tcctgacagcgccatgtgtg

SEQ ID NO: 5520163 - DNA, 21 bp, Homo sapiens
tcctgacagcgccatgtgtgt

SEQ ID NO: 5520164 - DNA, 15 bp, Homo sapiens
tcctgacatattcaa

SEQ ID NO: 5520165 - DNA, 16 bp, Homo sapiens
tcctgacatattcaag

SEQ ID NO: 5520166 - DNA, 16 bp, Homo sapiens
tcctgacatcacagca

SEQ ID NO: 5520167 - DNA, 21 bp, Homo sapiens
tcctgacatcacagcagcctc

SEQ ID NO: 5520168 - DNA, 14 bp, Homo sapiens
tcctgacattaaga

SEQ ID NO: 5520169 - DNA, 15 bp, Homo sapiens
tcctgacattgtctc

SEQ ID NO: 5520170 - DNA, 13 bp, Homo sapiens
tcctgacatttgt

SEQ ID NO: 5520171 - DNA, 13 bp, Homo sapiens
tcctgaccaaaga

SEQ ID NO: 5520172 - DNA, 15 bp, Homo sapiens
tcctgaccaagactg

SEQ ID NO: 5520173 - DNA, 20 bp, Homo sapiens
tcctgaccaccctcccctct

SEQ ID NO: 5520174 - DNA, 13 bp, Homo sapiens
tcctgaccagggc

SEQ ID NO: 5520175 - DNA, 22 bp, Homo sapiens
tcctgaccagggcaaggcccct

SEQ ID NO: 5520176 - DNA, 21 bp, Homo sapiens
tcctgaccagttgcagtcact

SEQ ID NO: 5520177 - DNA, 15 bp, Homo sapiens
tcctgacccaggccg

SEQ ID NO: 5520178 - DNA, 19 bp, Homo sapiens
tcctgacccaggccgcagc

SEQ ID NO: 5520179 - DNA, 15 bp, Homo sapiens
tcctgacccagtccc

SEQ ID NO: 5520180 - DNA, 18 bp, Homo sapiens
tcctgacccattgctgtt

SEQ ID NO: 5520181 - DNA, 17 bp, Homo sapiens
tcctgacccccatgtaa

SEQ ID NO: 5520182 - DNA, 18 bp, Homo sapiens
tcctgacccccatgtaaa

SEQ ID NO: 5520183 - DNA, 24 bp, Homo sapiens
tcctgacccctccctgcaggggct

SEQ ID NO: 5520184 - DNA, 18 bp, Homo sapiens
tcctgacccctctcctca

SEQ ID NO: 5520185 - DNA, 22 bp, Homo sapiens
tcctgacccggattggccctgc

SEQ ID NO: 5520186 - DNA, 19 bp, Homo sapiens
tcctgaccctcccactccc

SEQ ID NO: 5520187 - DNA, 22 bp, Homo sapiens
tcctgaccctcccactcccatc

SEQ ID NO: 5520188 - DNA, 14 bp, Homo sapiens
tcctgaccctccct

SEQ ID NO: 5520189 - DNA, 15 bp, Homo sapiens
tcctgacctcaggtg

SEQ ID NO: 5520190 - DNA, 21 bp, Homo sapiens
tcctgacctccatatgctgta

SEQ ID NO: 5520191 - DNA, 20 bp, Homo sapiens
tcctgacctcctcctgccct

SEQ ID NO: 5520192 - DNA, 15 bp, Homo sapiens
tcctgacctcctgga

SEQ ID NO: 5520193 - DNA, 17 bp, Homo sapiens
tcctgacctcctggact

SEQ ID NO: 5520194 - DNA, 20 bp, Homo sapiens
tcctgacctcgtgatctacc

SEQ ID NO: 5520195 - DNA, 16 bp, Homo sapiens
tcctgacctgaggctc

SEQ ID NO: 5520196 - DNA, 14 bp, Homo sapiens
tcctgaccttgggt

SEQ ID NO: 5520197 - DNA, 18 bp, Homo sapiens
tcctgacgagataagcag

SEQ ID NO: 5520198 - DNA, 15 bp, Homo sapiens
tcctgacgccctgcg

SEQ ID NO: 5520199 - DNA, 23 bp, Homo sapiens
tcctgacgccctgcgttggagcc

SEQ ID NO: 5520200 - DNA, 22 bp, Homo sapiens
tcctgacggcgcccccagtgtg

SEQ ID NO: 5520201 - DNA, 20 bp, Homo sapiens
tcctgacgtctgaagcttga

SEQ ID NO: 5520202 - DNA, 14 bp, Homo sapiens
tcctgactaagcct

SEQ ID NO: 5520203 - DNA, 22 bp, Homo sapiens
tcctgactattatgttgttaga

SEQ ID NO: 5520204 - DNA, 13 bp, Homo sapiens
tcctgactcatcc

SEQ ID NO: 5520205 - DNA, 19 bp, Homo sapiens
tcctgactcatccgcctgg

SEQ ID NO: 5520206 - DNA, 22 bp, Homo sapiens
tcctgactcctacctgccctgg

SEQ ID NO: 5520207 - DNA, 14 bp, Homo sapiens
tcctgactctgccc

SEQ ID NO: 5520208 - DNA, 23 bp, Homo sapiens
tcctgactctgccccctgctggc

SEQ ID NO: 5520209 - DNA, 20 bp, Homo sapiens
tcctgactgaaagtaggggg

SEQ ID NO: 5520210 - DNA, 18 bp, Homo sapiens
tcctgactgacacaggcc

SEQ ID NO: 5520211 - DNA, 20 bp, Homo sapiens
tcctgactgacacaggccag

SEQ ID NO: 5520212 - DNA, 15 bp, Homo sapiens
tcctgactggtgctg

SEQ ID NO: 5520213 - DNA, 23 bp, Homo sapiens
tcctgactgtctcccgggactac

SEQ ID NO: 5520214 - DNA, 14 bp, Homo sapiens
tcctgactgttctc

SEQ ID NO: 5520215 - DNA, 18 bp, Homo sapiens
tcctgactgttctcttac

SEQ ID NO: 5520216 - DNA, 22 bp, Homo sapiens
tcctgacttcaggggctgcccg

SEQ ID NO: 5520217 - DNA, 23 bp, Homo sapiens
tcctgacttccctggaggagaag

SEQ ID NO: 5520218 - DNA, 13 bp, Homo sapiens
tcctgacttctaa

SEQ ID NO: 5520219 - DNA, 21 bp, Homo sapiens
tcctgagaaacgtccatctct

SEQ ID NO: 5520220 - DNA, 19 bp, Homo sapiens
tcctgagaaagcccacctg

SEQ ID NO: 5520221 - DNA, 22 bp, Homo sapiens
tcctgagaaagcccacctgggc

SEQ ID NO: 5520222 - DNA, 15 bp, Homo sapiens
tcctgagaaagctca

SEQ ID NO: 5520223 - DNA, 18 bp, Homo sapiens
tcctgagaaaggtgagga

SEQ ID NO: 5520224 - DNA, 19 bp, Homo sapiens
tcctgagaaaggtgaggag

SEQ ID NO: 5520225 - DNA, 22 bp, Homo sapiens
tcctgagaaaggtgaggagggc

SEQ ID NO: 5520226 - DNA, 16 bp, Homo sapiens
tcctgagaccacagag

SEQ ID NO: 5520227 - DNA, 15 bp, Homo sapiens
tcctgagaccagcca

SEQ ID NO: 5520228 - DNA, 16 bp, Homo sapiens
tcctgagacccctggc

SEQ ID NO: 5520229 - DNA, 18 bp, Homo sapiens
tcctgagacccctggcct

SEQ ID NO: 5520230 - DNA, 19 bp, Homo sapiens
tcctgagacccctggcctc

SEQ ID NO: 5520231 - DNA, 21 bp, Homo sapiens
tcctgagacccctggcctccg

SEQ ID NO: 5520232 - DNA, 13 bp, Homo sapiens
tcctgagagacct

SEQ ID NO: 5520233 - DNA, 20 bp, Homo sapiens
tcctgagagacctgccctct

SEQ ID NO: 5520234 - DNA, 13 bp, Homo sapiens
tcctgagagctgc

SEQ ID NO: 5520235 - DNA, 16 bp, Homo sapiens
tcctgagagctgttcc

SEQ ID NO: 5520236 - DNA, 20 bp, Homo sapiens
tcctgagagggagagactgc

SEQ ID NO: 5520237 - DNA, 18 bp, Homo sapiens
tcctgagaggtgctgcag

SEQ ID NO: 5520238 - DNA, 17 bp, Homo sapiens
tcctgagattctgggaa

SEQ ID NO: 5520239 - DNA, 22 bp, Homo sapiens
tcctgagattctgggaaaggtg

SEQ ID NO: 5520240 - DNA, 17 bp, Homo sapiens
tcctgagcataactcca

SEQ ID NO: 5520241 - DNA, 13 bp, Homo sapiens
tcctgagccagat

SEQ ID NO: 5520242 - DNA, 17 bp, Homo sapiens
tcctgagccagatttca

SEQ ID NO: 5520243 - DNA, 18 bp, Homo sapiens
tcctgagccagatttcac

SEQ ID NO: 5520244 - DNA, 21 bp, Homo sapiens
tcctgagccagggaacagccc

SEQ ID NO: 5520245 - DNA, 23 bp, Homo sapiens
tcctgagccagggaacagcccca

SEQ ID NO: 5520246 - DNA, 23 bp, Homo sapiens
tcctgagccagtgtcaggaggaa

SEQ ID NO: 5520247 - DNA, 13 bp, Homo sapiens
tcctgagcccaac

SEQ ID NO: 5520248 - DNA, 14 bp, Homo sapiens
tcctgagccccagg

SEQ ID NO: 5520249 - DNA, 17 bp, Homo sapiens
tcctgagccccagggag

SEQ ID NO: 5520250 - DNA, 13 bp, Homo sapiens
tcctgagccccca

SEQ ID NO: 5520251 - DNA, 12 bp, Homo sapiens
tcctgagccccg

SEQ ID NO: 5520252 - DNA, 14 bp, Homo sapiens
tcctgagccccgcc

SEQ ID NO: 5520253 - DNA, 12 bp, Homo sapiens
tcctgagcctca

SEQ ID NO: 5520254 - DNA, 13 bp, Homo sapiens
tcctgagcctcac

SEQ ID NO: 5520255 - DNA, 14 bp, Homo sapiens
tcctgagcctgtct

SEQ ID NO: 5520256 - DNA, 17 bp, Homo sapiens
tcctgagcctgtctctc

SEQ ID NO: 5520257 - DNA, 19 bp, Homo sapiens
tcctgagcgaaaacaggag

SEQ ID NO: 5520258 - DNA, 20 bp, Homo sapiens
tcctgagcgaaaacaggaga

SEQ ID NO: 5520259 - DNA, 17 bp, Homo sapiens
tcctgagctaaatgctt

SEQ ID NO: 5520260 - DNA, 13 bp, Homo sapiens
tcctgagctagca

SEQ ID NO: 5520261 - DNA, 14 bp, Homo sapiens
tcctgagctcagcg

SEQ ID NO: 5520262 - DNA, 23 bp, Homo sapiens
tcctgagctcggggggctctgcc

SEQ ID NO: 5520263 - DNA, 15 bp, Homo sapiens
tcctgagctgtcgct

SEQ ID NO: 5520264 - DNA, 19 bp, Homo sapiens
tcctgagctgtcgctgcct

SEQ ID NO: 5520265 - DNA, 22 bp, Homo sapiens
tcctgagctgtcgctgcctcca

SEQ ID NO: 5520266 - DNA, 15 bp, Homo sapiens
tcctgagcttggcca

SEQ ID NO: 5520267 - DNA, 22 bp, Homo sapiens
tcctgagcttggccagaagggg

SEQ ID NO: 5520268 - DNA, 19 bp, Homo sapiens
tcctgaggacagctgtcct

SEQ ID NO: 5520269 - DNA, 16 bp, Homo sapiens
tcctgaggaccgcccc

SEQ ID NO: 5520270 - DNA, 21 bp, Homo sapiens
tcctgaggaccgccccaaccc

SEQ ID NO: 5520271 - DNA, 22 bp, Homo sapiens
tcctgaggaccgccccaaccct

SEQ ID NO: 5520272 - DNA, 17 bp, Homo sapiens
tcctgaggagcagccca

SEQ ID NO: 5520273 - DNA, 20 bp, Homo sapiens
tcctgaggagccctgaggac

SEQ ID NO: 5520274 - DNA, 22 bp, Homo sapiens
tcctgaggagtgtcctgtctgc

SEQ ID NO: 5520275 - DNA, 19 bp, Homo sapiens
tcctgaggatcagaaagta

SEQ ID NO: 5520276 - DNA, 18 bp, Homo sapiens
tcctgaggcagaacctgg

SEQ ID NO: 5520277 - DNA, 22 bp, Homo sapiens
tcctgaggctctctaagaaaag

SEQ ID NO: 5520278 - DNA, 14 bp, Homo sapiens
tcctgaggctgttt

SEQ ID NO: 5520279 - DNA, 21 bp, Homo sapiens
tcctgaggggatatccctatg

SEQ ID NO: 5520280 - DNA, 19 bp, Homo sapiens
tcctgagggtccccacctg

SEQ ID NO: 5520281 - DNA, 17 bp, Homo sapiens
tcctgagggttttctca

SEQ ID NO: 5520282 - DNA, 21 bp, Homo sapiens
tcctgaggtcatctgtaaaat

SEQ ID NO: 5520283 - DNA, 16 bp, Homo sapiens
tcctgaggtgcctccc

SEQ ID NO: 5520284 - DNA, 19 bp, Homo sapiens
tcctgaggtgcctcccagt

SEQ ID NO: 5520285 - DNA, 20 bp, Homo sapiens
tcctgaggtggatttactga

SEQ ID NO: 5520286 - DNA, 20 bp, Homo sapiens
tcctgagtagatgggactac

SEQ ID NO: 5520287 - DNA, 16 bp, Homo sapiens
tcctgagtagctgggc

SEQ ID NO: 5520288 - DNA, 14 bp, Homo sapiens
tcctgagtctgcct

SEQ ID NO: 5520289 - DNA, 14 bp, Homo sapiens
tcctgagtgcccca

SEQ ID NO: 5520290 - DNA, 15 bp, Homo sapiens
tcctgagtgccccac

SEQ ID NO: 5520291 - DNA, 19 bp, Homo sapiens
tcctgataaacattaaaca

SEQ ID NO: 5520292 - DNA, 21 bp, Homo sapiens
tcctgataattgtgcacacct

SEQ ID NO: 5520293 - DNA, 17 bp, Homo sapiens
tcctgatactgggtaca

SEQ ID NO: 5520294 - DNA, 19 bp, Homo sapiens
tcctgatactgggtacaag

SEQ ID NO: 5520295 - DNA, 22 bp, Homo sapiens
tcctgatagcctgttacaggaa

SEQ ID NO: 5520296 - DNA, 17 bp, Homo sapiens
tcctgatagtcacctgc

SEQ ID NO: 5520297 - DNA, 24 bp, Homo sapiens
tcctgatatgatttaaaacatgta

SEQ ID NO: 5520298 - DNA, 17 bp, Homo sapiens
tcctgatcaaggtgctc

SEQ ID NO: 5520299 - DNA, 19 bp, Homo sapiens
tcctgatcaaggtgctctt

SEQ ID NO: 5520300 - DNA, 15 bp, Homo sapiens
tcctgatcagaggca

SEQ ID NO: 5520301 - DNA, 14 bp, Homo sapiens
tcctgatccctcca

SEQ ID NO: 5520302 - DNA, 20 bp, Homo sapiens
tcctgatccctccaccccca

SEQ ID NO: 5520303 - DNA, 17 bp, Homo sapiens
tcctgatcctaaccctg

SEQ ID NO: 5520304 - DNA, 14 bp, Homo sapiens
tcctgatctgtgat

SEQ ID NO: 5520305 - DNA, 13 bp, Homo sapiens
tcctgatcttccc

SEQ ID NO: 5520306 - DNA, 23 bp, Homo sapiens
tcctgatgacagaacacagatct

SEQ ID NO: 5520307 - DNA, 15 bp, Homo sapiens
tcctgatgacccagg

SEQ ID NO: 5520308 - DNA, 16 bp, Homo sapiens
tcctgatgacccaggc

SEQ ID NO: 5520309 - DNA, 22 bp, Homo sapiens
tcctgatgacccaggctgcctg

SEQ ID NO: 5520310 - DNA, 13 bp, Homo sapiens
tcctgatgatgat

SEQ ID NO: 5520311 - DNA, 14 bp, Homo sapiens
tcctgatgatgctg

SEQ ID NO: 5520312 - DNA, 19 bp, Homo sapiens
tcctgatgccatggaatga

SEQ ID NO: 5520313 - DNA, 15 bp, Homo sapiens
tcctgatgcccctga

SEQ ID NO: 5520314 - DNA, 14 bp, Homo sapiens
tcctgatggccaag

SEQ ID NO: 5520315 - DNA, 18 bp, Homo sapiens
tcctgatggtcagctccc

SEQ ID NO: 5520316 - DNA, 13 bp, Homo sapiens
tcctgatgttttt

SEQ ID NO: 5520317 - DNA, 19 bp, Homo sapiens
tcctgatgtttttctgtgt

SEQ ID NO: 5520318 - DNA, 23 bp, Homo sapiens
tcctgattaaatgtctgacacat

SEQ ID NO: 5520319 - DNA, 18 bp, Homo sapiens
tcctgattaccagtctga

SEQ ID NO: 5520320 - DNA, 20 bp, Homo sapiens
tcctgattattttcagaagc

SEQ ID NO: 5520321 - DNA, 21 bp, Homo sapiens
tcctgattattttcagaagct

SEQ ID NO: 5520322 - DNA, 22 bp, Homo sapiens
tcctgattattttcagaagctg

SEQ ID NO: 5520323 - DNA, 14 bp, Homo sapiens
tcctgattccaaat

SEQ ID NO: 5520324 - DNA, 23 bp, Homo sapiens
tcctgattcccgcatggttttta

SEQ ID NO: 5520325 - DNA, 23 bp, Homo sapiens
tcctgattcgaggtcctcctggc

SEQ ID NO: 5520326 - DNA, 14 bp, Homo sapiens
tcctgattctctta

SEQ ID NO: 5520327 - DNA, 13 bp, Homo sapiens
tcctgattgctct

SEQ ID NO: 5520328 - DNA, 18 bp, Homo sapiens
tcctgattgctctggaag

SEQ ID NO: 5520329 - DNA, 19 bp, Homo sapiens
tcctgattgctctggaagc

SEQ ID NO: 5520330 - DNA, 23 bp, Homo sapiens
tcctgatttctagaacccgtgac

SEQ ID NO: 5520331 - DNA, 15 bp, Homo sapiens
tcctgatttctctga

SEQ ID NO: 5520332 - DNA, 17 bp, Homo sapiens
tcctgatttctctgaac

SEQ ID NO: 5520333 - DNA, 18 bp, Homo sapiens
tcctgatttctctgaaca

SEQ ID NO: 5520334 - DNA, 15 bp, Homo sapiens
tcctgatttttatct

SEQ ID NO: 5520335 - DNA, 17 bp, Homo sapiens
tcctgcaaaaacccttg

SEQ ID NO: 5520336 - DNA, 20 bp, Homo sapiens
tcctgcaaaaggaggtgaaa

SEQ ID NO: 5520337 - DNA, 19 bp, Homo sapiens
tcctgcaaaattttatagc

SEQ ID NO: 5520338 - DNA, 20 bp, Homo sapiens
tcctgcaaaggcccttgtca

SEQ ID NO: 5520339 - DNA, 18 bp, Homo sapiens
tcctgcaaagtctccaga

SEQ ID NO: 5520340 - DNA, 21 bp, Homo sapiens
tcctgcaaatttagtttgtta

SEQ ID NO: 5520341 - DNA, 23 bp, Homo sapiens
tcctgcaaccaaactcccatcag

SEQ ID NO: 5520342 - DNA, 20 bp, Homo sapiens
tcctgcaaccactctgtggc

SEQ ID NO: 5520343 - DNA, 23 bp, Homo sapiens
tcctgcaaccactctgtggccag

SEQ ID NO: 5520344 - DNA, 21 bp, Homo sapiens
tcctgcaagggacaggaaggt

SEQ ID NO: 5520345 - DNA, 15 bp, Homo sapiens
tcctgcaaggtgaaa

SEQ ID NO: 5520346 - DNA, 21 bp, Homo sapiens
tcctgcaatctccagggctgc

SEQ ID NO: 5520347 - DNA, 20 bp, Homo sapiens
tcctgcaatgaagtctctga

SEQ ID NO: 5520348 - DNA, 15 bp, Homo sapiens
tcctgcaatgggaga

SEQ ID NO: 5520349 - DNA, 15 bp, Homo sapiens
tcctgcaattttcta

SEQ ID NO: 5520350 - DNA, 12 bp, Homo sapiens
tcctgcacacag

SEQ ID NO: 5520351 - DNA, 21 bp, Homo sapiens
tcctgcacacagaatgctcag

SEQ ID NO: 5520352 - DNA, 23 bp, Homo sapiens
tcctgcacacagaatgctcaggg

SEQ ID NO: 5520353 - DNA, 21 bp, Homo sapiens
tcctgcacacgctccttcctc

SEQ ID NO: 5520354 - DNA, 18 bp, Homo sapiens
tcctgcacagattcccag

SEQ ID NO: 5520355 - DNA, 20 bp, Homo sapiens
tcctgcacagattcccaggc

SEQ ID NO: 5520356 - DNA, 20 bp, Homo sapiens
tcctgcacagttttctggct

SEQ ID NO: 5520357 - DNA, 19 bp, Homo sapiens
tcctgcacatgagtggaaa

SEQ ID NO: 5520358 - DNA, 15 bp, Homo sapiens
tcctgcaccccagca

SEQ ID NO: 5520359 - DNA, 21 bp, Homo sapiens
tcctgcaccccagcattccag

SEQ ID NO: 5520360 - DNA, 12 bp, Homo sapiens
tcctgcaccctc

SEQ ID NO: 5520361 - DNA, 16 bp, Homo sapiens
tcctgcaccctctgct

SEQ ID NO: 5520362 - DNA, 15 bp, Homo sapiens
tcctgcactccagaa

SEQ ID NO: 5520363 - DNA, 15 bp, Homo sapiens
tcctgcactgtcccg

SEQ ID NO: 5520364 - DNA, 17 bp, Homo sapiens
tcctgcactgtcccgga

SEQ ID NO: 5520365 - DNA, 18 bp, Homo sapiens
tcctgcagacacctggac

SEQ ID NO: 5520366 - DNA, 19 bp, Homo sapiens
tcctgcagacacctggact

SEQ ID NO: 5520367 - DNA, 17 bp, Homo sapiens
tcctgcagaccacgccc

SEQ ID NO: 5520368 - DNA, 14 bp, Homo sapiens
tcctgcagacctgg

SEQ ID NO: 5520369 - DNA, 16 bp, Homo sapiens
tcctgcagacctggct

SEQ ID NO: 5520370 - DNA, 20 bp, Homo sapiens
tcctgcagacctggctgggc

SEQ ID NO: 5520371 - DNA, 16 bp, Homo sapiens
tcctgcagagctgggg

SEQ ID NO: 5520372 - DNA, 20 bp, Homo sapiens
tcctgcagaggaccacagtg

SEQ ID NO: 5520373 - DNA, 22 bp, Homo sapiens
tcctgcagcatggtccctgcct

SEQ ID NO: 5520374 - DNA, 18 bp, Homo sapiens
tcctgcagcctcctcctg

SEQ ID NO: 5520375 - DNA, 19 bp, Homo sapiens
tcctgcagcctcctcctga

SEQ ID NO: 5520376 - DNA, 22 bp, Homo sapiens
tcctgcagcctcctcctgacca

SEQ ID NO: 5520377 - DNA, 13 bp, Homo sapiens
tcctgcagcctgc

SEQ ID NO: 5520378 - DNA, 21 bp, Homo sapiens
tcctgcaggaaatataaactt

SEQ ID NO: 5520379 - DNA, 20 bp, Homo sapiens
tcctgcaggaacgagcactg

SEQ ID NO: 5520380 - DNA, 14 bp, Homo sapiens
tcctgcaggagtgc

SEQ ID NO: 5520381 - DNA, 12 bp, Homo sapiens
tcctgcaggcag

SEQ ID NO: 5520382 - DNA, 15 bp, Homo sapiens
tcctgcaggcagcca

SEQ ID NO: 5520383 - DNA, 12 bp, Homo sapiens
tcctgcaggctg

SEQ ID NO: 5520384 - DNA, 20 bp, Homo sapiens
tcctgcaggctggctgttgg

SEQ ID NO: 5520385 - DNA, 16 bp, Homo sapiens
tcctggaggcaggggc

SEQ ID NO: 5520386 - DNA, 24 bp, Homo sapiens
tcctggaggcaggggctgctgcct

SEQ ID NO: 5520387 - DNA, 19 bp, Homo sapiens
tcctggagggcgcccagca

SEQ ID NO: 5520388 - DNA, 22 bp, Homo sapiens
tcctggagggcgcccagcagcc

SEQ ID NO: 5520389 - DNA, 19 bp, Homo sapiens
tcctggagggggcaagcct

SEQ ID NO: 5520390 - DNA, 22 bp, Homo sapiens
tcctggaggggtgttgtatggc

SEQ ID NO: 5520391 - DNA, 22 bp, Homo sapiens
tcctggaggttccccagcccca

SEQ ID NO: 5520392 - DNA, 16 bp, Homo sapiens
tcctggagtctcactg

SEQ ID NO: 5520393 - DNA, 17 bp, Homo sapiens
tcctggagtctgaagcc

SEQ ID NO: 5520394 - DNA, 20 bp, Homo sapiens
tcctggagtctgaagcctgc

SEQ ID NO: 5520395 - DNA, 23 bp, Homo sapiens
tcctggagtgatatgatccagag

SEQ ID NO: 5520396 - DNA, 14 bp, Homo sapiens
tcctggagtgccct

SEQ ID NO: 5520397 - DNA, 24 bp, Homo sapiens
tcctggagtgccctgcaggcacag

SEQ ID NO: 5520398 - DNA, 13 bp, Homo sapiens
tcctggagttttg

SEQ ID NO: 5520399 - DNA, 21 bp, Homo sapiens
tcctggataaaaaagaaaaca

SEQ ID NO: 5520400 - DNA, 18 bp, Homo sapiens
tcctggatccaggataat

SEQ ID NO: 5520401 - DNA, 14 bp, Homo sapiens
tcctggatcccttt

SEQ ID NO: 5520402 - DNA, 18 bp, Homo sapiens
tcctggatgggcctttga

SEQ ID NO: 5520403 - DNA, 16 bp, Homo sapiens
tcctggatggggcaga

SEQ ID NO: 5520404 - DNA, 14 bp, Homo sapiens
tcctggatttatag

SEQ ID NO: 5520405 - DNA, 17 bp, Homo sapiens
tcctggcaaataatact

SEQ ID NO: 5520406 - DNA, 17 bp, Homo sapiens
tcctggcaatagtcaaa

SEQ ID NO: 5520407 - DNA, 23 bp, Homo sapiens
tcctggcaatagtgtgttctgat

SEQ ID NO: 5520408 - DNA, 18 bp, Homo sapiens
tcctggcacaatgttgga

SEQ ID NO: 5520409 - DNA, 21 bp, Homo sapiens
tcctggcacaatgttggagca

SEQ ID NO: 5520410 - DNA, 22 bp, Homo sapiens
tcctggcacagtttttgtaaag

SEQ ID NO: 5520411 - DNA, 22 bp, Homo sapiens
tcctggcacccggcccctgctg

SEQ ID NO: 5520412 - DNA, 13 bp, Homo sapiens
tcctggcactgct

SEQ ID NO: 5520413 - DNA, 21 bp, Homo sapiens
tcctggcactggaccccagca

SEQ ID NO: 5520414 - DNA, 15 bp, Homo sapiens
tcctggcagaatgct

SEQ ID NO: 5520415 - DNA, 14 bp, Homo sapiens
tcctggcagcccag

SEQ ID NO: 5520416 - DNA, 16 bp, Homo sapiens
tcctggcagcccagag

SEQ ID NO: 5520417 - DNA, 19 bp, Homo sapiens
tcctggcagcccagagact

SEQ ID NO: 5520418 - DNA, 14 bp, Homo sapiens
tcctggcagctgct

SEQ ID NO: 5520419 - DNA, 23 bp, Homo sapiens
tcctggcaggaagtctctcccga

SEQ ID NO: 5520420 - DNA, 17 bp, Homo sapiens
tcctggcagggccacct

SEQ ID NO: 5520421 - DNA, 10 bp, Homo sapiens
tcctggcagt

SEQ ID NO: 5520422 - DNA, 20 bp, Homo sapiens
tcctggcagtttaaaaaaat

SEQ ID NO: 5520423 - DNA, 16 bp, Homo sapiens
tcctggcatgacactc

SEQ ID NO: 5520424 - DNA, 22 bp, Homo sapiens
tcctggcatgggaatgaatgtc

SEQ ID NO: 5520425 - DNA, 15 bp, Homo sapiens
tcctggcatttgctg

SEQ ID NO: 5520426 - DNA, 15 bp, Homo sapiens
tcctggccagatgtc

SEQ ID NO: 5520427 - DNA, 14 bp, Homo sapiens
tcctggccatccca

SEQ ID NO: 5520428 - DNA, 15 bp, Homo sapiens
tcctggccatcccac

SEQ ID NO: 5520429 - DNA, 19 bp, Homo sapiens
tcctggccattttcttgcc

SEQ ID NO: 5520430 - DNA, 20 bp, Homo sapiens
tcctggccattttcttgcct

SEQ ID NO: 5520431 - DNA, 17 bp, Homo sapiens
tcctggcccactgcatc

SEQ ID NO: 5520432 - DNA, 13 bp, Homo sapiens
tcctggcccaggc

SEQ ID NO: 5520433 - DNA, 13 bp, Homo sapiens
tcctggcccaggg

SEQ ID NO: 5520434 - DNA, 16 bp, Homo sapiens
tcctggcccagggcat

SEQ ID NO: 5520435 - DNA, 13 bp, Homo sapiens
tcctggcccatca

SEQ ID NO: 5520436 - DNA, 14 bp, Homo sapiens
tcctggcccatcag

SEQ ID NO: 5520437 - DNA, 12 bp, Homo sapiens
tcctggccccct

SEQ ID NO: 5520438 - DNA, 20 bp, Homo sapiens
tcctggccccgggctctggc

SEQ ID NO: 5520439 - DNA, 21 bp, Homo sapiens
tcctggccccgggctctggcc

SEQ ID NO: 5520440 - DNA, 14 bp, Homo sapiens
tcctggcccctcaa

SEQ ID NO: 5520441 - DNA, 15 bp, Homo sapiens
tcctggcccctcatg

SEQ ID NO: 5520442 - DNA, 23 bp, Homo sapiens
tcctggcccctcatggcgggact

SEQ ID NO: 5520443 - DNA, 13 bp, Homo sapiens
tcctggcccctgc

SEQ ID NO: 5520444 - DNA, 19 bp, Homo sapiens
tcctggcccgccctcacct

SEQ ID NO: 5520445 - DNA, 22 bp, Homo sapiens
tcctggcccgccctcacctctg

SEQ ID NO: 5520446 - DNA, 14 bp, Homo sapiens
tcctggccctgggg

SEQ ID NO: 5520447 - DNA, 22 bp, Homo sapiens
tcctggccctgggggtctgggc

SEQ ID NO: 5520448 - DNA, 14 bp, Homo sapiens
tcctggcccttcag

SEQ ID NO: 5520449 - DNA, 17 bp, Homo sapiens
tcctggcccttcagtct

SEQ ID NO: 5520450 - DNA, 19 bp, Homo sapiens
tcctggcccttcagtctgc

SEQ ID NO: 5520451 - DNA, 23 bp, Homo sapiens
tcctggcccttcagtctgctcca

SEQ ID NO: 5520452 - DNA, 14 bp, Homo sapiens
tcctggccgcctgg

SEQ ID NO: 5520453 - DNA, 21 bp, Homo sapiens
tcctggccggccgcccacatc

SEQ ID NO: 5520454 - DNA, 19 bp, Homo sapiens
tcctggccggtgtgggggc

SEQ ID NO: 5520455 - DNA, 22 bp, Homo sapiens
tcctggcctatccgctgccagc

SEQ ID NO: 5520456 - DNA, 22 bp, Homo sapiens
tcctggcctcaagtgatctgcc

SEQ ID NO: 5520457 - DNA, 20 bp, Homo sapiens
tcctggcctcactggctggg

SEQ ID NO: 5520458 - DNA, 22 bp, Homo sapiens
tcctggcctcactggctggggc

SEQ ID NO: 5520459 - DNA, 13 bp, Homo sapiens
tcctggcctcaga

SEQ ID NO: 5520460 - DNA, 14 bp, Homo sapiens
tcctggcctcagac

SEQ ID NO: 5520461 - DNA, 17 bp, Homo sapiens
tcctggcctcagactgc

SEQ ID NO: 5520462 - DNA, 18 bp, Homo sapiens
tcctggcctcagagcttc

SEQ ID NO: 5520463 - DNA, 22 bp, Homo sapiens
tcctggcctcagagcttcctgg

SEQ ID NO: 5520464 - DNA, 21 bp, Homo sapiens
tcctggcctcagccagctgcc

SEQ ID NO: 5520465 - DNA, 18 bp, Homo sapiens
tcctggcctcatacagaa

SEQ ID NO: 5520466 - DNA, 17 bp, Homo sapiens
tcctggcctccttcccc

SEQ ID NO: 5520467 - DNA, 21 bp, Homo sapiens
tcctggcctcttctgggctac

SEQ ID NO: 5520468 - DNA, 17 bp, Homo sapiens
tcctggcctgagagtca

SEQ ID NO: 5520469 - DNA, 16 bp, Homo sapiens
tcctggcctgagcgca

SEQ ID NO: 5520470 - DNA, 18 bp, Homo sapiens
tcctggcctgagcgcagc

SEQ ID NO: 5520471 - DNA, 16 bp, Homo sapiens
tcctggccttcctcgt

SEQ ID NO: 5520472 - DNA, 15 bp, Homo sapiens
tcctggccttctgaa

SEQ ID NO: 5520473 - DNA, 18 bp, Homo sapiens
tcctggccttctgaactc

SEQ ID NO: 5520474 - DNA, 22 bp, Homo sapiens
tcctggccttgtgtcactggct

SEQ ID NO: 5520475 - DNA, 16 bp, Homo sapiens
tcctggctcagcctca

SEQ ID NO: 5520476 - DNA, 15 bp, Homo sapiens
tcctggctcaggccc

SEQ ID NO: 5520477 - DNA, 16 bp, Homo sapiens
tcctggctcaggccca

SEQ ID NO: 5520478 - DNA, 19 bp, Homo sapiens
tcctggctcaggcccagct

SEQ ID NO: 5520479 - DNA, 16 bp, Homo sapiens
tcctggctcctgaggg

SEQ ID NO: 5520480 - DNA, 20 bp, Homo sapiens
tcctggctccttcactgaac

SEQ ID NO: 5520481 - DNA, 19 bp, Homo sapiens
tcctggctctaccctgtct

SEQ ID NO: 5520482 - DNA, 20 bp, Homo sapiens
tcctggctctaccctgtctg

SEQ ID NO: 5520483 - DNA, 12 bp, Homo sapiens
tcctggctctgg

SEQ ID NO: 5520484 - DNA, 19 bp, Homo sapiens
tcctggctgatgatccaga

SEQ ID NO: 5520485 - DNA, 13 bp, Homo sapiens
tcctggctgcact

SEQ ID NO: 5520486 - DNA, 12 bp, Homo sapiens
tcctggctgcgg

SEQ ID NO: 5520487 - DNA, 13 bp, Homo sapiens
tcctggctggctg

SEQ ID NO: 5520488 - DNA, 14 bp, Homo sapiens
tcctggctggctgt

SEQ ID NO: 5520489 - DNA, 19 bp, Homo sapiens
tcctggctggctgtgtcct

SEQ ID NO: 5520490 - DNA, 11 bp, Homo sapiens
tcctggctggg

SEQ ID NO: 5520491 - DNA, 18 bp, Homo sapiens
tcctggctgggccatcct

SEQ ID NO: 5520492 - DNA, 14 bp, Homo sapiens
tcctggctgtaaat

SEQ ID NO: 5520493 - DNA, 23 bp, Homo sapiens
tcctggctgtcctaccatcagct

SEQ ID NO: 5520494 - DNA, 13 bp, Homo sapiens
tcctggctgtgca

SEQ ID NO: 5520495 - DNA, 14 bp, Homo sapiens
tcctggctgtgccc

SEQ ID NO: 5520496 - DNA, 19 bp, Homo sapiens
tcctggctgtgcccagcag

SEQ ID NO: 5520497 - DNA, 20 bp, Homo sapiens
tcctggctgtgcccagcagg

SEQ ID NO: 5520498 - DNA, 23 bp, Homo sapiens
tcctggctgtgcccagcaggccc

SEQ ID NO: 5520499 - DNA, 21 bp, Homo sapiens
tcctggcttcccatccccagc

SEQ ID NO: 5520500 - DNA, 20 bp, Homo sapiens
tcctggcttctgggagcctt

SEQ ID NO: 5520501 - DNA, 13 bp, Homo sapiens
tcctggcttgcct

SEQ ID NO: 5520502 - DNA, 17 bp, Homo sapiens
tcctggctttgacatga

SEQ ID NO: 5520503 - DNA, 16 bp, Homo sapiens
tcctggctttgcccaa

SEQ ID NO: 5520504 - DNA, 13 bp, Homo sapiens
tcctggcttttaa

SEQ ID NO: 5520505 - DNA, 15 bp, Homo sapiens
tcctgggaaagggag

SEQ ID NO: 5520506 - DNA, 21 bp, Homo sapiens
tcctgggaaggaagcttggct

SEQ ID NO: 5520507 - DNA, 19 bp, Homo sapiens
tcctgggaaggagggagct

SEQ ID NO: 5520508 - DNA, 22 bp, Homo sapiens
tcctgggaaggagggagctgct

SEQ ID NO: 5520509 - DNA, 17 bp, Homo sapiens
tcctgggaaggccacct

SEQ ID NO: 5520510 - DNA, 20 bp, Homo sapiens
tcctgggaatggaataacta

SEQ ID NO: 5520511 - DNA, 21 bp, Homo sapiens
tcctgggaatggaataactat

SEQ ID NO: 5520512 - DNA, 21 bp, Homo sapiens
tcctgggaccccctcgccagc

SEQ ID NO: 5520513 - DNA, 19 bp, Homo sapiens
tcctgggacctccccagcc

SEQ ID NO: 5520514 - DNA, 9 bp, Homo sapiens
tcctgggag

SEQ ID NO: 5520515 - DNA, 18 bp, Homo sapiens
tcctgggagaacctcagg

SEQ ID NO: 5520516 - DNA, 22 bp, Homo sapiens
tcctgggagaggacagggactt

SEQ ID NO: 5520517 - DNA, 11 bp, Homo sapiens
tcctgggagga

SEQ ID NO: 5520518 - DNA, 14 bp, Homo sapiens
tcctgggaggacag

SEQ ID NO: 5520519 - DNA, 19 bp, Homo sapiens
tcctgggaggccctggcag

SEQ ID NO: 5520520 - DNA, 14 bp, Homo sapiens
tcctgggaggctgc

SEQ ID NO: 5520521 - DNA, 15 bp, Homo sapiens
tcctgggaggctgca

SEQ ID NO: 5520522 - DNA, 17 bp, Homo sapiens
tcctgggaggctgcagc

SEQ ID NO: 5520523 - DNA, 23 bp, Homo sapiens
tcctgggaggctgcagccaggcc

SEQ ID NO: 5520524 - DNA, 22 bp, Homo sapiens
tcctgggagggagactcagcct

SEQ ID NO: 5520525 - DNA, 20 bp, Homo sapiens
tcctgggagtgggagtcaag

SEQ ID NO: 5520526 - DNA, 17 bp, Homo sapiens
tcctgggatgatgtgtg

SEQ ID NO: 5520527 - DNA, 18 bp, Homo sapiens
tcctgggatgtggctgca

SEQ ID NO: 5520528 - DNA, 11 bp, Homo sapiens
tcctgggcaca

SEQ ID NO: 5520529 - DNA, 18 bp, Homo sapiens
tcctgggcacacgctgct

SEQ ID NO: 5520530 - DNA, 23 bp, Homo sapiens
tcctgggcacccttaatcttcag

SEQ ID NO: 5520531 - DNA, 16 bp, Homo sapiens
tcctgggcagcccaga

SEQ ID NO: 5520532 - DNA, 18 bp, Homo sapiens
tcctgggcagcccagaga

SEQ ID NO: 5520533 - DNA, 14 bp, Homo sapiens
tcctgggcagctgc

SEQ ID NO: 5520534 - DNA, 15 bp, Homo sapiens
tcctgggcagctgcc

SEQ ID NO: 5520535 - DNA, 16 bp, Homo sapiens
tcctgggcagctgcct

SEQ ID NO: 5520536 - DNA, 18 bp, Homo sapiens
tcctgggcagctgcctcc

SEQ ID NO: 5520537 - DNA, 19 bp, Homo sapiens
tcctgggcagctgcctccc

SEQ ID NO: 5520538 - DNA, 22 bp, Homo sapiens
tcctgggcagctgcctcccctc

SEQ ID NO: 5520539 - DNA, 23 bp, Homo sapiens
tcctgggcagctgcctcccctcc

SEQ ID NO: 5520540 - DNA, 22 bp, Homo sapiens
tcctgggcaggtgggagctgaa

SEQ ID NO: 5520541 - DNA, 20 bp, Homo sapiens
tcctgggcatccccagcccc

SEQ ID NO: 5520542 - DNA, 17 bp, Homo sapiens
tcctgggcatctggccc

SEQ ID NO: 5520543 - DNA, 19 bp, Homo sapiens
tcctgggcatctggccctg

SEQ ID NO: 5520544 - DNA, 23 bp, Homo sapiens
tcctgggcatgggtccagggcct

SEQ ID NO: 5520545 - DNA, 20 bp, Homo sapiens
tcctgggccagggatctctc

SEQ ID NO: 5520546 - DNA, 14 bp, Homo sapiens
tcctgggccagggt

SEQ ID NO: 5520547 - DNA, 23 bp, Homo sapiens
tcctgggccagggtctcgtcagg

SEQ ID NO: 5520548 - DNA, 14 bp, Homo sapiens
tcctgggcccaggc

SEQ ID NO: 5520549 - DNA, 16 bp, Homo sapiens
tcctgggcccaggcag

SEQ ID NO: 5520550 - DNA, 11 bp, Homo sapiens
tcctgggcccc

SEQ ID NO: 5520551 - DNA, 16 bp, Homo sapiens
tcctgggcccccagag

SEQ ID NO: 5520552 - DNA, 17 bp, Homo sapiens
tcctgggccccctggga

SEQ ID NO: 5520553 - DNA, 18 bp, Homo sapiens
tcctgggccccctgggag

SEQ ID NO: 5520554 - DNA, 22 bp, Homo sapiens
tcctgggcccctccctacctca

SEQ ID NO: 5520555 - DNA, 21 bp, Homo sapiens
tcctgggccctctctgctctg

SEQ ID NO: 5520556 - DNA, 21 bp, Homo sapiens
tcctgggccggctgagtggca

SEQ ID NO: 5520557 - DNA, 16 bp, Homo sapiens
tcctgggcctgcagaa

SEQ ID NO: 5520558 - DNA, 14 bp, Homo sapiens
tcctgggcctgccc

SEQ ID NO: 5520559 - DNA, 15 bp, Homo sapiens
tcctgggccttacct

SEQ ID NO: 5520560 - DNA, 18 bp, Homo sapiens
tcctgggccttacctccc

SEQ ID NO: 5520561 - DNA, 21 bp, Homo sapiens
tcctgggccttctcagctctc

SEQ ID NO: 5520562 - DNA, 13 bp, Homo sapiens
tcctgggcctttg

SEQ ID NO: 5520563 - DNA, 16 bp, Homo sapiens
tcctgggcgccctgga

SEQ ID NO: 5520564 - DNA, 20 bp, Homo sapiens
tcctgggctcaagtgatcct

SEQ ID NO: 5520565 - DNA, 14 bp, Homo sapiens
tcctgggctccaga

SEQ ID NO: 5520566 - DNA, 15 bp, Homo sapiens
tcctgggctctgaac

SEQ ID NO: 5520567 - DNA, 18 bp, Homo sapiens
tcctgggctctgaacaca

SEQ ID NO: 5520568 - DNA, 22 bp, Homo sapiens
tcctgggctctgaacacacacg

SEQ ID NO: 5520569 - DNA, 20 bp, Homo sapiens
tcctgggctggggccaccat

SEQ ID NO: 5520570 - DNA, 18 bp, Homo sapiens
tcctggggaacctgaccc

SEQ ID NO: 5520571 - DNA, 19 bp, Homo sapiens
tcctggggaacctgacccc

SEQ ID NO: 5520572 - DNA, 23 bp, Homo sapiens
tcctggggaccccactccctgct

SEQ ID NO: 5520573 - DNA, 14 bp, Homo sapiens
tcctggggaggctg

SEQ ID NO: 5520574 - DNA, 17 bp, Homo sapiens
tcctggggaggctgaga

SEQ ID NO: 5520575 - DNA, 20 bp, Homo sapiens
tcctggggaggctgagactg

SEQ ID NO: 5520576 - DNA, 16 bp, Homo sapiens
tcctggggatggccag

SEQ ID NO: 5520577 - DNA, 14 bp, Homo sapiens
tcctggggcagaga

SEQ ID NO: 5520578 - DNA, 16 bp, Homo sapiens
tcctggggcagcactc

SEQ ID NO: 5520579 - DNA, 20 bp, Homo sapiens
tcctggggcagcactcccca

SEQ ID NO: 5520580 - DNA, 12 bp, Homo sapiens
tcctggggccag

SEQ ID NO: 5520581 - DNA, 14 bp, Homo sapiens
tcctggggccaggc

SEQ ID NO: 5520582 - DNA, 22 bp, Homo sapiens
tcctggggcccaaatgctggct

SEQ ID NO: 5520583 - DNA, 19 bp, Homo sapiens
tcctggggccgcctgccct

SEQ ID NO: 5520584 - DNA, 15 bp, Homo sapiens
tcctggggcctcttg

SEQ ID NO: 5520585 - DNA, 15 bp, Homo sapiens
tcctggggcgtccag

SEQ ID NO: 5520586 - DNA, 16 bp, Homo sapiens
tcctggggctcagcct

SEQ ID NO: 5520587 - DNA, 16 bp, Homo sapiens
tcctggggctcccttc

SEQ ID NO: 5520588 - DNA, 14 bp, Homo sapiens
tcctgggggaagag

SEQ ID NO: 5520589 - DNA, 19 bp, Homo sapiens
tcctgggggaagaggagat

SEQ ID NO: 5520590 - DNA, 16 bp, Homo sapiens
tcctgggggatgcaaa

SEQ ID NO: 5520591 - DNA, 22 bp, Homo sapiens
tcctgggggctgctgcactgcc

SEQ ID NO: 5520592 - DNA, 22 bp, Homo sapiens
tcctgggggtggaggcctgcct

SEQ ID NO: 5520593 - DNA, 13 bp, Homo sapiens
tcctgggggtggc

SEQ ID NO: 5520594 - DNA, 15 bp, Homo sapiens
tcctgggggtggcag

SEQ ID NO: 5520595 - DNA, 19 bp, Homo sapiens
tcctgggggtggcaggcac

SEQ ID NO: 5520596 - DNA, 18 bp, Homo sapiens
tcctggggtggttggagg

SEQ ID NO: 5520597 - DNA, 16 bp, Homo sapiens
tcctggggttgccctg

SEQ ID NO: 5520598 - DNA, 21 bp, Homo sapiens
tcctgggtactgaggtgctat

SEQ ID NO: 5520599 - DNA, 14 bp, Homo sapiens
tcctgggtatttat

SEQ ID NO: 5520600 - DNA, 19 bp, Homo sapiens
tcctgggtgagtttttctt

SEQ ID NO: 5520601 - DNA, 19 bp, Homo sapiens
tcctgggtgctcagggcat

SEQ ID NO: 5520602 - DNA, 16 bp, Homo sapiens
tcctgggtgctgtcat

SEQ ID NO: 5520603 - DNA, 22 bp, Homo sapiens
tcctgggtgctgtcatgcccag

SEQ ID NO: 5520604 - DNA, 15 bp, Homo sapiens
tcctgggtggtctgc

SEQ ID NO: 5520605 - DNA, 21 bp, Homo sapiens
tcctgggtggtctgcaggcag

SEQ ID NO: 5520606 - DNA, 17 bp, Homo sapiens
tcctgggttggagggaa

SEQ ID NO: 5520607 - DNA, 14 bp, Homo sapiens
tcctgggtttcctg

SEQ ID NO: 5520608 - DNA, 20 bp, Homo sapiens
tcctgggtttcctgcaggca

SEQ ID NO: 5520609 - DNA, 18 bp, Homo sapiens
tcctggtaacataacaac

SEQ ID NO: 5520610 - DNA, 15 bp, Homo sapiens
tcctggtaattaaaa

SEQ ID NO: 5520611 - DNA, 16 bp, Homo sapiens
tcctggtaattaaaag

SEQ ID NO: 5520612 - DNA, 22 bp, Homo sapiens
tcctggtaattcctctccaggc

SEQ ID NO: 5520613 - DNA, 17 bp, Homo sapiens
tcctggtacccagccat

SEQ ID NO: 5520614 - DNA, 18 bp, Homo sapiens
tcctggtacccagccatc

SEQ ID NO: 5520615 - DNA, 22 bp, Homo sapiens
tcctggtattgtaatattaaaa

SEQ ID NO: 5520616 - DNA, 18 bp, Homo sapiens
tcctggtcaaagctcctt

SEQ ID NO: 5520617 - DNA, 17 bp, Homo sapiens
tcctggtcacctaggaa

SEQ ID NO: 5520618 - DNA, 20 bp, Homo sapiens
tcctggtcacctaggaagcc

SEQ ID NO: 5520619 - DNA, 21 bp, Homo sapiens
tcctggtcacctaggaagcct

SEQ ID NO: 5520620 - DNA, 20 bp, Homo sapiens
tcctggtcagttttcacaga

SEQ ID NO: 5520621 - DNA, 23 bp, Homo sapiens
tcctggtcccctcagctctgcct

SEQ ID NO: 5520622 - DNA, 13 bp, Homo sapiens
tcctggtccctca

SEQ ID NO: 5520623 - DNA, 15 bp, Homo sapiens
tcctggtcctggaca

SEQ ID NO: 5520624 - DNA, 19 bp, Homo sapiens
tcctggtcctggacacctc

SEQ ID NO: 5520625 - DNA, 23 bp, Homo sapiens
tcctggtcctggacacctcccag

SEQ ID NO: 5520626 - DNA, 16 bp, Homo sapiens
tcctggtcctggctgc

SEQ ID NO: 5520627 - DNA, 19 bp, Homo sapiens
tcctggtcctggctgcact

SEQ ID NO: 5520628 - DNA, 14 bp, Homo sapiens
tcctggtctgaaaa

SEQ ID NO: 5520629 - DNA, 17 bp, Homo sapiens
tcctggtctgcacctct

SEQ ID NO: 5520630 - DNA, 13 bp, Homo sapiens
tcctggtctgtgc

SEQ ID NO: 5520631 - DNA, 14 bp, Homo sapiens
tcctggtgagaaaa

SEQ ID NO: 5520632 - DNA, 16 bp, Homo sapiens
tcctggtgaggcccag

SEQ ID NO: 5520633 - DNA, 22 bp, Homo sapiens
tcctggtgaggcccagcctgtc

SEQ ID NO: 5520634 - DNA, 22 bp, Homo sapiens
tcctggtgcaggtctccacctg

SEQ ID NO: 5520635 - DNA, 16 bp, Homo sapiens
tcctggtgcccacagc

SEQ ID NO: 5520636 - DNA, 18 bp, Homo sapiens
tcctggtgcccacagcag

SEQ ID NO: 5520637 - DNA, 21 bp, Homo sapiens
tcctggtgcccctcgccagct

SEQ ID NO: 5520638 - DNA, 13 bp, Homo sapiens
tcctggtgccctg

SEQ ID NO: 5520639 - DNA, 13 bp, Homo sapiens
tcctggtgctgcc

SEQ ID NO: 5520640 - DNA, 17 bp, Homo sapiens
tcctggtgctgccgagg

SEQ ID NO: 5520641 - DNA, 18 bp, Homo sapiens
tcctggtgctgccgaggg

SEQ ID NO: 5520642 - DNA, 20 bp, Homo sapiens
tcctggtgctgccgagggct

SEQ ID NO: 5520643 - DNA, 12 bp, Homo sapiens
tcctggtgctgg

SEQ ID NO: 5520644 - DNA, 22 bp, Homo sapiens
tcctggtggccttctgctgccc

SEQ ID NO: 5520645 - DNA, 19 bp, Homo sapiens
tcctggtggctgggcccag

SEQ ID NO: 5520646 - DNA, 20 bp, Homo sapiens
tcctggtggctgggcccagc

SEQ ID NO: 5520647 - DNA, 23 bp, Homo sapiens
tcctggtggctgggcccagcagg

SEQ ID NO: 5520648 - DNA, 16 bp, Homo sapiens
tcctggtggggcagct

SEQ ID NO: 5520649 - DNA, 21 bp, Homo sapiens
tcctggtgggtcagcccagca

SEQ ID NO: 5520650 - DNA, 22 bp, Homo sapiens
tcctggtgggtcagcccagcac

SEQ ID NO: 5520651 - DNA, 23 bp, Homo sapiens
tcctggtgggtcagcccagcacc

SEQ ID NO: 5520652 - DNA, 22 bp, Homo sapiens
tcctggtgggtccaggggcccc

SEQ ID NO: 5520653 - DNA, 16 bp, Homo sapiens
tcctggtggtattttc

SEQ ID NO: 5520654 - DNA, 18 bp, Homo sapiens
tcctggtggtattttcaa

SEQ ID NO: 5520655 - DNA, 18 bp, Homo sapiens
tcctggtgtcaccccaga

SEQ ID NO: 5520656 - DNA, 19 bp, Homo sapiens
tcctggtgtcaccccagag

SEQ ID NO: 5520657 - DNA, 20 bp, Homo sapiens
tcctggtgtcaccccagagc

SEQ ID NO: 5520658 - DNA, 22 bp, Homo sapiens
tcctggtgtcaccccagagcca

SEQ ID NO: 5520659 - DNA, 14 bp, Homo sapiens
tcctggtgtcactt

SEQ ID NO: 5520660 - DNA, 21 bp, Homo sapiens
tcctggtgtcacttactgttt

SEQ ID NO: 5520661 - DNA, 15 bp, Homo sapiens
tcctggtgtctagtt

SEQ ID NO: 5520662 - DNA, 14 bp, Homo sapiens
tcctggtgtgggta

SEQ ID NO: 5520663 - DNA, 21 bp, Homo sapiens
tcctggtgtttttctctctgg

SEQ ID NO: 5520664 - DNA, 22 bp, Homo sapiens
tcctggtgtttttctctctgga

SEQ ID NO: 5520665 - DNA, 23 bp, Homo sapiens
tcctggttccttcctatgcccag

SEQ ID NO: 5520666 - DNA, 16 bp, Homo sapiens
tcctggttgtctgaac

SEQ ID NO: 5520667 - DNA, 23 bp, Homo sapiens
tcctggttgtctgaacccaggca

SEQ ID NO: 5520668 - DNA, 19 bp, Homo sapiens
tcctggttgttcctgcatc

SEQ ID NO: 5520669 - DNA, 10 bp, Homo sapiens
tcctggtttc

SEQ ID NO: 5520670 - DNA, 22 bp, Homo sapiens
tcctggtttcataacttcctgt

SEQ ID NO: 5520671 - DNA, 23 bp, Homo sapiens
tcctggtttcataacttcctgta

SEQ ID NO: 5520672 - DNA, 17 bp, Homo sapiens
tcctggtttcctcagcc

SEQ ID NO: 5520673 - DNA, 21 bp, Homo sapiens
tcctggtttcgtgtgctgccc

SEQ ID NO: 5520674 - DNA, 15 bp, Homo sapiens
tcctggtttgactca

SEQ ID NO: 5520675 - DNA, 19 bp, Homo sapiens
tcctggttttgtacactgc

SEQ ID NO: 5520676 - DNA, 22 bp, Homo sapiens
tcctggttttgtacactgctgt

SEQ ID NO: 5520677 - DNA, 15 bp, Homo sapiens
tcctgtaaaatccat

SEQ ID NO: 5520678 - DNA, 20 bp, Homo sapiens
tcctgtaacacaagccacag

SEQ ID NO: 5520679 - DNA, 23 bp, Homo sapiens
tcctgtaacacaagccacagaag

SEQ ID NO: 5520680 - DNA, 21 bp, Homo sapiens
tcctgtaacctcatcgggatt

SEQ ID NO: 5520681 - DNA, 18 bp, Homo sapiens
tcctgtaactgttacagt

SEQ ID NO: 5520682 - DNA, 13 bp, Homo sapiens
tcctgtaagaagc

SEQ ID NO: 5520683 - DNA, 17 bp, Homo sapiens
tcctgtaagccaaagaa

SEQ ID NO: 5520684 - DNA, 14 bp, Homo sapiens
tcctgtaatatatt

SEQ ID NO: 5520685 - DNA, 21 bp, Homo sapiens
tcctgtaattcctacctccct

SEQ ID NO: 5520686 - DNA, 14 bp, Homo sapiens
tcctgtacaatcat

SEQ ID NO: 5520687 - DNA, 14 bp, Homo sapiens
tcctgtacattgtg

SEQ ID NO: 5520688 - DNA, 15 bp, Homo sapiens
tcctgtaccaaatct

SEQ ID NO: 5520689 - DNA, 15 bp, Homo sapiens
tcctgtacctcagtg

SEQ ID NO: 5520690 - DNA, 16 bp, Homo sapiens
tcctgtacctcagtgg

SEQ ID NO: 5520691 - DNA, 20 bp, Homo sapiens
tcctgtacctcagtggatct

SEQ ID NO: 5520692 - DNA, 18 bp, Homo sapiens
tcctgtactactgccttg

SEQ ID NO: 5520693 - DNA, 18 bp, Homo sapiens
tcctgtacttgtcctcag

SEQ ID NO: 5520694 - DNA, 20 bp, Homo sapiens
tcctgtacttgtcctcagct

SEQ ID NO: 5520695 - DNA, 23 bp, Homo sapiens
tcctgtagacctagggaggacct

SEQ ID NO: 5520696 - DNA, 20 bp, Homo sapiens
tcctgtagagagagacctag

SEQ ID NO: 5520697 - DNA, 15 bp, Homo sapiens
tcctgtagcatcttc

SEQ ID NO: 5520698 - DNA, 19 bp, Homo sapiens
tcctgtagcatcttctgga

SEQ ID NO: 5520699 - DNA, 21 bp, Homo sapiens
tcctgtagccttctgtaggaa

SEQ ID NO: 5520700 - DNA, 16 bp, Homo sapiens
tcctgtagctctccct

SEQ ID NO: 5520701 - DNA, 23 bp, Homo sapiens
tcctgtagttgcgtggactctgc

SEQ ID NO: 5520702 - DNA, 15 bp, Homo sapiens
tcctgtagttttatt

SEQ ID NO: 5520703 - DNA, 17 bp, Homo sapiens
tcctgtagttttatttt

SEQ ID NO: 5520704 - DNA, 22 bp, Homo sapiens
tcctgtataatctctctcctgt

SEQ ID NO: 5520705 - DNA, 19 bp, Homo sapiens
tcctgtatgaaagattgtg

SEQ ID NO: 5520706 - DNA, 13 bp, Homo sapiens
tcctgtatgttgt

SEQ ID NO: 5520707 - DNA, 17 bp, Homo sapiens
tcctgtattcttgtttg

SEQ ID NO: 5520708 - DNA, 19 bp, Homo sapiens
tcctgtattcttgtttgaa

SEQ ID NO: 5520709 - DNA, 17 bp, Homo sapiens
tcctgtatttgttccca

SEQ ID NO: 5520710 - DNA, 19 bp, Homo sapiens
tcctgtatttgttcccaag

SEQ ID NO: 5520711 - DNA, 17 bp, Homo sapiens
tcctgtcaatgtttgct

SEQ ID NO: 5520712 - DNA, 19 bp, Homo sapiens
tcctgtcaatgtttgcttt

SEQ ID NO: 5520713 - DNA, 16 bp, Homo sapiens
tcctgtcaccctggcc

SEQ ID NO: 5520714 - DNA, 18 bp, Homo sapiens
tcctgtcaccctggcccc

SEQ ID NO: 5520715 - DNA, 19 bp, Homo sapiens
tcctgtcaccctggcccca

SEQ ID NO: 5520716 - DNA, 16 bp, Homo sapiens
tcctgtcactcactga

SEQ ID NO: 5520717 - DNA, 17 bp, Homo sapiens
tcctgtcactcactgag

SEQ ID NO: 5520718 - DNA, 16 bp, Homo sapiens
tcctgtcactgatgga

SEQ ID NO: 5520719 - DNA, 22 bp, Homo sapiens
tcctgtcactgatggaaggttt

SEQ ID NO: 5520720 - DNA, 14 bp, Homo sapiens
tcctgtcagtgagg

SEQ ID NO: 5520721 - DNA, 17 bp, Homo sapiens
tcctgtcatctgagaat

SEQ ID NO: 5520722 - DNA, 19 bp, Homo sapiens
tcctgtcatctgagaatga

SEQ ID NO: 5520723 - DNA, 12 bp, Homo sapiens
tcctgtccactc

SEQ ID NO: 5520724 - DNA, 22 bp, Homo sapiens
tcctgtccactctcggggccct

SEQ ID NO: 5520725 - DNA, 13 bp, Homo sapiens
tcctgtccagctc

SEQ ID NO: 5520726 - DNA, 15 bp, Homo sapiens
tcctgtccagctcca

SEQ ID NO: 5520727 - DNA, 17 bp, Homo sapiens
tcctgtccagctccaac

SEQ ID NO: 5520728 - DNA, 14 bp, Homo sapiens
tcctgtcccagagg

SEQ ID NO: 5520729 - DNA, 18 bp, Homo sapiens
tcctgtcccatgggctct

SEQ ID NO: 5520730 - DNA, 20 bp, Homo sapiens
tcctgtcccatgggctctgg

SEQ ID NO: 5520731 - DNA, 17 bp, Homo sapiens
tcctgtccccaaaatgt

SEQ ID NO: 5520732 - DNA, 13 bp, Homo sapiens
tcctgtccccagg

SEQ ID NO: 5520733 - DNA, 16 bp, Homo sapiens
tcctgtccccatctgt

SEQ ID NO: 5520734 - DNA, 17 bp, Homo sapiens
tcctgtccccatctgtc

SEQ ID NO: 5520735 - DNA, 12 bp, Homo sapiens
tcctgtcccctc

SEQ ID NO: 5520736 - DNA, 18 bp, Homo sapiens
tcctgtcccgccttcctc

SEQ ID NO: 5520737 - DNA, 22 bp, Homo sapiens
tcctgtcccgccttcctcctcc

SEQ ID NO: 5520738 - DNA, 13 bp, Homo sapiens
tccttcactctga

SEQ ID NO: 5520739 - DNA, 15 bp, Homo sapiens
tccttcactggcgcc

SEQ ID NO: 5520740 - DNA, 19 bp, Homo sapiens
tccttcactggcgccttct

SEQ ID NO: 5520741 - DNA, 15 bp, Homo sapiens
tccttcactgttccc

SEQ ID NO: 5520742 - DNA, 16 bp, Homo sapiens
tccttcactgttccct

SEQ ID NO: 5520743 - DNA, 19 bp, Homo sapiens
tccttcactgttccctctg

SEQ ID NO: 5520744 - DNA, 21 bp, Homo sapiens
tccttcactgttccctctggc

SEQ ID NO: 5520745 - DNA, 23 bp, Homo sapiens
tccttcagacaccctcaacctct

SEQ ID NO: 5520746 - DNA, 19 bp, Homo sapiens
tccttcagagagcagtgct

SEQ ID NO: 5520747 - DNA, 20 bp, Homo sapiens
tccttcagagagcagtgctt

SEQ ID NO: 5520748 - DNA, 22 bp, Homo sapiens
tccttcagagagcagtgctttt

SEQ ID NO: 5520749 - DNA, 23 bp, Homo sapiens
tccttcagagagcagtgcttttg

SEQ ID NO: 5520750 - DNA, 12 bp, Homo sapiens
tccttcagagct

SEQ ID NO: 5520751 - DNA, 14 bp, Homo sapiens
tccttcagatttgg

SEQ ID NO: 5520752 - DNA, 19 bp, Homo sapiens
tccttcagccctcacccct

SEQ ID NO: 5520753 - DNA, 21 bp, Homo sapiens
tccttcagccctcacccctgg

SEQ ID NO: 5520754 - DNA, 18 bp, Homo sapiens
tccttcagcttccatttc

SEQ ID NO: 5520755 - DNA, 20 bp, Homo sapiens
tccttcaggactctgcggga

SEQ ID NO: 5520756 - DNA, 17 bp, Homo sapiens
tccttcaggcagctgaa

SEQ ID NO: 5520757 - DNA, 22 bp, Homo sapiens
tccttcagtcttctagaaacag

SEQ ID NO: 5520758 - DNA, 18 bp, Homo sapiens
tccttcagtgagcccctc

SEQ ID NO: 5520759 - DNA, 23 bp, Homo sapiens
tccttcagtgagcccctccccag

SEQ ID NO: 5520760 - DNA, 14 bp, Homo sapiens
tccttcagtgcctt

SEQ ID NO: 5520761 - DNA, 15 bp, Homo sapiens
tccttcagtgcctta

SEQ ID NO: 5520762 - DNA, 20 bp, Homo sapiens
tccttcagttctgcttgctc

SEQ ID NO: 5520763 - DNA, 12 bp, Homo sapiens
tccttcataatt

SEQ ID NO: 5520764 - DNA, 11 bp, Homo sapiens
tccttcatttc

SEQ ID NO: 5520765 - DNA, 18 bp, Homo sapiens
tccttcatttccaccagg

SEQ ID NO: 5520766 - DNA, 19 bp, Homo sapiens
tccttcatttccaccaggc

SEQ ID NO: 5520767 - DNA, 24 bp, Homo sapiens
tccttcatttccaccaggccgtgc

SEQ ID NO: 5520768 - DNA, 14 bp, Homo sapiens
tccttcatttcctc

SEQ ID NO: 5520769 - DNA, 15 bp, Homo sapiens
tccttcatttcctcc

SEQ ID NO: 5520770 - DNA, 15 bp, Homo sapiens
tccttccaaagaatt

SEQ ID NO: 5520771 - DNA, 21 bp, Homo sapiens
tccttccaacaggagctggga

SEQ ID NO: 5520772 - DNA, 20 bp, Homo sapiens
tccttccaactgctgcccca

SEQ ID NO: 5520773 - DNA, 14 bp, Homo sapiens
tccttccacatgta

SEQ ID NO: 5520774 - DNA, 16 bp, Homo sapiens
tccttccactgtagct

SEQ ID NO: 5520775 - DNA, 15 bp, Homo sapiens
tccttccagaagagt

SEQ ID NO: 5520776 - DNA, 14 bp, Homo sapiens
tccttccagccttt

SEQ ID NO: 5520777 - DNA, 16 bp, Homo sapiens
tccttccagccttttt

SEQ ID NO: 5520778 - DNA, 22 bp, Homo sapiens
tccttccagctagtgacccaca

SEQ ID NO: 5520779 - DNA, 12 bp, Homo sapiens
tccttccaggcc

SEQ ID NO: 5520780 - DNA, 13 bp, Homo sapiens
tccttccagtggc

SEQ ID NO: 5520781 - DNA, 24 bp, Homo sapiens
tccttccagtgtcatttctcatcc

SEQ ID NO: 5520782 - DNA, 16 bp, Homo sapiens
tccttccatcctgagg

SEQ ID NO: 5520783 - DNA, 15 bp, Homo sapiens
tccttccatccttga

SEQ ID NO: 5520784 - DNA, 20 bp, Homo sapiens
tccttccatctcttccttca

SEQ ID NO: 5520785 - DNA, 13 bp, Homo sapiens
tccttccatgctc

SEQ ID NO: 5520786 - DNA, 17 bp, Homo sapiens
tccttccatgctcccaa

SEQ ID NO: 5520787 - DNA, 14 bp, Homo sapiens
tccttccattccac

SEQ ID NO: 5520788 - DNA, 21 bp, Homo sapiens
tccttccattgctcccagtgc

SEQ ID NO: 5520789 - DNA, 23 bp, Homo sapiens
tccttccattgctcccagtgcca

SEQ ID NO: 5520790 - DNA, 19 bp, Homo sapiens
tccttcccaagaagagaga

SEQ ID NO: 5520791 - DNA, 12 bp, Homo sapiens
tccttcccaagg

SEQ ID NO: 5520792 - DNA, 16 bp, Homo sapiens
tccttcccaatcttct

SEQ ID NO: 5520793 - DNA, 18 bp, Homo sapiens
tccttcccaatcttcttt

SEQ ID NO: 5520794 - DNA, 14 bp, Homo sapiens
tccttcccacaaaa

SEQ ID NO: 5520795 - DNA, 14 bp, Homo sapiens
tccttcccactgtc

SEQ ID NO: 5520796 - DNA, 15 bp, Homo sapiens
tccttcccactgtcc

SEQ ID NO: 5520797 - DNA, 22 bp, Homo sapiens
tccttcccactgtcctttctcc

SEQ ID NO: 5520798 - DNA, 16 bp, Homo sapiens
tccttcccagaatgtt

SEQ ID NO: 5520799 - DNA, 12 bp, Homo sapiens
tccttcccagag

SEQ ID NO: 5520800 - DNA, 12 bp, Homo sapiens
tccttcccagct

SEQ ID NO: 5520801 - DNA, 21 bp, Homo sapiens
tccttcccagctgcccctccc

SEQ ID NO: 5520802 - DNA, 20 bp, Homo sapiens
tccttcccaggagtggagga

SEQ ID NO: 5520803 - DNA, 17 bp, Homo sapiens
tccttcccaggcccttt

SEQ ID NO: 5520804 - DNA, 22 bp, Homo sapiens
tccttcccagggaccagcacct

SEQ ID NO: 5520805 - DNA, 18 bp, Homo sapiens
tccttcccatgcctgtct

SEQ ID NO: 5520806 - DNA, 21 bp, Homo sapiens
tccttcccatgcctgtctctg

SEQ ID NO: 5520807 - DNA, 15 bp, Homo sapiens
tccttccccacccca

SEQ ID NO: 5520808 - DNA, 17 bp, Homo sapiens
tccttccccaccccata

SEQ ID NO: 5520809 - DNA, 14 bp, Homo sapiens
tccttccccagacc

SEQ ID NO: 5520810 - DNA, 16 bp, Homo sapiens
tccttccccagaccca

SEQ ID NO: 5520811 - DNA, 17 bp, Homo sapiens
tccttccccagacccag

SEQ ID NO: 5520812 - DNA, 18 bp, Homo sapiens
tccttccccagacccaga

SEQ ID NO: 5520813 - DNA, 22 bp, Homo sapiens
tccttccccagacccagaggtc

SEQ ID NO: 5520814 - DNA, 12 bp, Homo sapiens
tccttccccagc

SEQ ID NO: 5520815 - DNA, 16 bp, Homo sapiens
tccttcccccagcaca

SEQ ID NO: 5520816 - DNA, 19 bp, Homo sapiens
tccttcccccagcccaata

SEQ ID NO: 5520817 - DNA, 22 bp, Homo sapiens
tccttcccccatcccctttcct

SEQ ID NO: 5520818 - DNA, 12 bp, Homo sapiens
tccttcccctgc

SEQ ID NO: 5520819 - DNA, 16 bp, Homo sapiens
tccttcccctgcacct

SEQ ID NO: 5520820 - DNA, 14 bp, Homo sapiens
tccttccccttccc

SEQ ID NO: 5520821 - DNA, 15 bp, Homo sapiens
tccttccctaaagac

SEQ ID NO: 5520822 - DNA, 14 bp, Homo sapiens
tccttccctcctgt

SEQ ID NO: 5520823 - DNA, 15 bp, Homo sapiens
tccttccctcctttt

SEQ ID NO: 5520824 - DNA, 15 bp, Homo sapiens
tccttccctctctga

SEQ ID NO: 5520825 - DNA, 19 bp, Homo sapiens
tccttccctctctgatgtc

SEQ ID NO: 5520826 - DNA, 15 bp, Homo sapiens
tccttccctgatggc

SEQ ID NO: 5520827 - DNA, 16 bp, Homo sapiens
tccttccctgatggcc

SEQ ID NO: 5520828 - DNA, 11 bp, Homo sapiens
tccttccctgc

SEQ ID NO: 5520829 - DNA, 14 bp, Homo sapiens
tccttccctgggaa

SEQ ID NO: 5520830 - DNA, 18 bp, Homo sapiens
tccttccctgggaaggct

SEQ ID NO: 5520831 - DNA, 20 bp, Homo sapiens
tccttccctgggctgtgcta

SEQ ID NO: 5520832 - DNA, 11 bp, Homo sapiens
tccttccctgt

SEQ ID NO: 5520833 - DNA, 19 bp, Homo sapiens
tccttccctgtgcctcctc

SEQ ID NO: 5520834 - DNA, 17 bp, Homo sapiens
tccttccctgtgtcttt

SEQ ID NO: 5520835 - DNA, 14 bp, Homo sapiens
tccttccctgttct

SEQ ID NO: 5520836 - DNA, 14 bp, Homo sapiens
tccttcccttctct

SEQ ID NO: 5520837 - DNA, 18 bp, Homo sapiens
tccttcccttctctcctt

SEQ ID NO: 5520838 - DNA, 17 bp, Homo sapiens
tccttcccttctcttgg

SEQ ID NO: 5520839 - DNA, 18 bp, Homo sapiens
tccttccgctcctttacc

SEQ ID NO: 5520840 - DNA, 20 bp, Homo sapiens
tccttcctaatttcccttct

SEQ ID NO: 5520841 - DNA, 22 bp, Homo sapiens
tccttcctacacccttggactt

SEQ ID NO: 5520842 - DNA, 12 bp, Homo sapiens
tccttcctatgc

SEQ ID NO: 5520843 - DNA, 16 bp, Homo sapiens
tccttcctcacaccag

SEQ ID NO: 5520844 - DNA, 13 bp, Homo sapiens
tccttcctccaca

SEQ ID NO: 5520845 - DNA, 16 bp, Homo sapiens
tccttcctgcagacct

SEQ ID NO: 5520846 - DNA, 20 bp, Homo sapiens
tccttcctgcagacctggct

SEQ ID NO: 5520847 - DNA, 22 bp, Homo sapiens
tccttcctgcagacctggctgg

SEQ ID NO: 5520848 - DNA, 21 bp, Homo sapiens
tccttcctgccccaaaattat

SEQ ID NO: 5520849 - DNA, 20 bp, Homo sapiens
tccttcctgccctgtacctc

SEQ ID NO: 5520850 - DNA, 13 bp, Homo sapiens
tccttcctgtctt

SEQ ID NO: 5520851 - DNA, 14 bp, Homo sapiens
tccttcctgtcttc

SEQ ID NO: 5520852 - DNA, 17 bp, Homo sapiens
tccttcctgtcttcctg

SEQ ID NO: 5520853 - DNA, 16 bp, Homo sapiens
tccttcctgtgggtgg

SEQ ID NO: 5520854 - DNA, 23 bp, Homo sapiens
tccttcctgtgggtggggcttct

SEQ ID NO: 5520855 - DNA, 14 bp, Homo sapiens
tccttcctgttctg

SEQ ID NO: 5520856 - DNA, 19 bp, Homo sapiens
tccttcctgttctgaactg

SEQ ID NO: 5520857 - DNA, 14 bp, Homo sapiens
tccttccttagttt

SEQ ID NO: 5520858 - DNA, 16 bp, Homo sapiens
tccttccttcaggact

SEQ ID NO: 5520859 - DNA, 15 bp, Homo sapiens
tccttccttcagggt

SEQ ID NO: 5520860 - DNA, 14 bp, Homo sapiens
tccttccttcccac

SEQ ID NO: 5520861 - DNA, 16 bp, Homo sapiens
tccttccttgaccagc

SEQ ID NO: 5520862 - DNA, 19 bp, Homo sapiens
tccttccttgctgtcctag

SEQ ID NO: 5520863 - DNA, 18 bp, Homo sapiens
tccttcgaaaggccttca

SEQ ID NO: 5520864 - DNA, 20 bp, Homo sapiens
tccttcgagggttccaggct

SEQ ID NO: 5520865 - DNA, 21 bp, Homo sapiens
tccttcggaatccagtgcttc

SEQ ID NO: 5520866 - DNA, 20 bp, Homo sapiens
tccttcggggaccagcccac

SEQ ID NO: 5520867 - DNA, 19 bp, Homo sapiens
tccttcggtcttttgtatt

SEQ ID NO: 5520868 - DNA, 23 bp, Homo sapiens
tccttctaagacattctgttgga

SEQ ID NO: 5520869 - DNA, 23 bp, Homo sapiens
tccttctaatctgctatgcttga

SEQ ID NO: 5520870 - DNA, 14 bp, Homo sapiens
tccttctacttaca

SEQ ID NO: 5520871 - DNA, 20 bp, Homo sapiens
tccttctaggatagcgctcc

SEQ ID NO: 5520872 - DNA, 18 bp, Homo sapiens
tccttctagtttcccaca

SEQ ID NO: 5520873 - DNA, 15 bp, Homo sapiens
tccttctattctagc

SEQ ID NO: 5520874 - DNA, 15 bp, Homo sapiens
tccttctcactgcca

SEQ ID NO: 5520875 - DNA, 17 bp, Homo sapiens
tccttctcactgccatg

SEQ ID NO: 5520876 - DNA, 13 bp, Homo sapiens
tccttctcagcac

SEQ ID NO: 5520877 - DNA, 18 bp, Homo sapiens
tccttctcattgctgccc

SEQ ID NO: 5520878 - DNA, 13 bp, Homo sapiens
tccttctccagga

SEQ ID NO: 5520879 - DNA, 12 bp, Homo sapiens
tccttctcccct

SEQ ID NO: 5520880 - DNA, 16 bp, Homo sapiens
tccttctcccctccag

SEQ ID NO: 5520881 - DNA, 12 bp, Homo sapiens
tccttctccctt

SEQ ID NO: 5520882 - DNA, 23 bp, Homo sapiens
tccttctccgaggggctggagcg

SEQ ID NO: 5520883 - DNA, 10 bp, Homo sapiens
tccttctcct

SEQ ID NO: 5520884 - DNA, 18 bp, Homo sapiens
tccttctcgtcttcctct

SEQ ID NO: 5520885 - DNA, 22 bp, Homo sapiens
tccttctctactcatgccagat

SEQ ID NO: 5520886 - DNA, 20 bp, Homo sapiens
tccttctctcacctcctaaa

SEQ ID NO: 5520887 - DNA, 15 bp, Homo sapiens
tccttctctgaacac

SEQ ID NO: 5520888 - DNA, 16 bp, Homo sapiens
tccttctctgccccca

SEQ ID NO: 5520889 - DNA, 12 bp, Homo sapiens
tccttctctggg

SEQ ID NO: 5520890 - DNA, 13 bp, Homo sapiens
tccttctctgggt

SEQ ID NO: 5520891 - DNA, 12 bp, Homo sapiens
tccttctctgtc

SEQ ID NO: 5520892 - DNA, 16 bp, Homo sapiens
tccttctcttctcttc

SEQ ID NO: 5520893 - DNA, 21 bp, Homo sapiens
tccttctcttctcttctttgg

SEQ ID NO: 5520894 - DNA, 23 bp, Homo sapiens
tccttctgaagtctgagcccatt

SEQ ID NO: 5520895 - DNA, 22 bp, Homo sapiens
tccttctgaagtgtgtccatcc

SEQ ID NO: 5520896 - DNA, 14 bp, Homo sapiens
tccttctgacccca

SEQ ID NO: 5520897 - DNA, 14 bp, Homo sapiens
tccttctgagctcc

SEQ ID NO: 5520898 - DNA, 20 bp, Homo sapiens
tccttctgagctccacctct

SEQ ID NO: 5520899 - DNA, 23 bp, Homo sapiens
tccttctgcaaagtggcagggac

SEQ ID NO: 5520900 - DNA, 18 bp, Homo sapiens
tccttctgcacccagaaa

SEQ ID NO: 5520901 - DNA, 13 bp, Homo sapiens
tccttctgccctt

SEQ ID NO: 5520902 - DNA, 17 bp, Homo sapiens
tccttctgcccttcctc

SEQ ID NO: 5520903 - DNA, 22 bp, Homo sapiens
tccttctgcccttcctccagga

SEQ ID NO: 5520904 - DNA, 18 bp, Homo sapiens
tccttctgcctgagcttc

SEQ ID NO: 5520905 - DNA, 17 bp, Homo sapiens
tccttctgcggccagag

SEQ ID NO: 5520906 - DNA, 15 bp, Homo sapiens
tccttctggctccaa

SEQ ID NO: 5520907 - DNA, 13 bp, Homo sapiens
tccttctgtagtg

SEQ ID NO: 5520908 - DNA, 19 bp, Homo sapiens
tccttctgtcctactctgt

SEQ ID NO: 5520909 - DNA, 12 bp, Homo sapiens
tccttctgtgaa

SEQ ID NO: 5520910 - DNA, 13 bp, Homo sapiens
tccttctgtgaag

SEQ ID NO: 5520911 - DNA, 14 bp, Homo sapiens
tccttctgtgaaga

SEQ ID NO: 5520912 - DNA, 15 bp, Homo sapiens
tccttctgttgctgg

SEQ ID NO: 5520913 - DNA, 16 bp, Homo sapiens
tccttctgttgctggt

SEQ ID NO: 5520914 - DNA, 20 bp, Homo sapiens
tccttcttaactctgcagga

SEQ ID NO: 5520915 - DNA, 14 bp, Homo sapiens
tccttcttcagcag

SEQ ID NO: 5520916 - DNA, 16 bp, Homo sapiens
tccttcttcagcagga

SEQ ID NO: 5520917 - DNA, 13 bp, Homo sapiens
tccttcttcccaa

SEQ ID NO: 5520918 - DNA, 20 bp, Homo sapiens
tccttttccatcccactcca

SEQ ID NO: 5520919 - DNA, 13 bp, Homo sapiens
tccttttccctgc

SEQ ID NO: 5520920 - DNA, 15 bp, Homo sapiens
tccttttccctgctt

SEQ ID NO: 5520921 - DNA, 20 bp, Homo sapiens
tccttttcctaattcacaca

SEQ ID NO: 5520922 - DNA, 14 bp, Homo sapiens
tccttttcctatcc

SEQ ID NO: 5520923 - DNA, 19 bp, Homo sapiens
tccttttccttatttgcct

SEQ ID NO: 5520924 - DNA, 14 bp, Homo sapiens
tccttttctaggaa

SEQ ID NO: 5520925 - DNA, 12 bp, Homo sapiens
tccttttctcca

SEQ ID NO: 5520926 - DNA, 13 bp, Homo sapiens
tccttttctccca

SEQ ID NO: 5520927 - DNA, 23 bp, Homo sapiens
tccttttctcccatttcttgcta

SEQ ID NO: 5520928 - DNA, 19 bp, Homo sapiens
tccttttctcctatcttca

SEQ ID NO: 5520929 - DNA, 15 bp, Homo sapiens
tccttttctctcctg

SEQ ID NO: 5520930 - DNA, 16 bp, Homo sapiens
tccttttctctgccct

SEQ ID NO: 5520931 - DNA, 13 bp, Homo sapiens
tccttttctcttt

SEQ ID NO: 5520932 - DNA, 13 bp, Homo sapiens
tccttttctgtga

SEQ ID NO: 5520933 - DNA, 14 bp, Homo sapiens
tccttttctgtgtt

SEQ ID NO: 5520934 - DNA, 18 bp, Homo sapiens
tccttttcttccctgacc

SEQ ID NO: 5520935 - DNA, 15 bp, Homo sapiens
tccttttcttctagc

SEQ ID NO: 5520936 - DNA, 18 bp, Homo sapiens
tccttttcttgtctctga

SEQ ID NO: 5520937 - DNA, 20 bp, Homo sapiens
tccttttcttgtctctgagg

SEQ ID NO: 5520938 - DNA, 13 bp, Homo sapiens
tccttttcttgtt

SEQ ID NO: 5520939 - DNA, 17 bp, Homo sapiens
tccttttcttttgttac

SEQ ID NO: 5520940 - DNA, 20 bp, Homo sapiens
tccttttcttttgttactgt

SEQ ID NO: 5520941 - DNA, 21 bp, Homo sapiens
tccttttcttttgttactgtt

SEQ ID NO: 5520942 - DNA, 22 bp, Homo sapiens
tccttttcttttgttactgttc

SEQ ID NO: 5520943 - DNA, 12 bp, Homo sapiens
tccttttgaaat

SEQ ID NO: 5520944 - DNA, 21 bp, Homo sapiens
tccttttgaagctcaactgtt

SEQ ID NO: 5520945 - DNA, 20 bp, Homo sapiens
tccttttgacactgctctaa

SEQ ID NO: 5520946 - DNA, 22 bp, Homo sapiens
tccttttgacactgctctaaca

SEQ ID NO: 5520947 - DNA, 20 bp, Homo sapiens
tccttttgaccttcatttca

SEQ ID NO: 5520948 - DNA, 20 bp, Homo sapiens
tccttttgactccttttgga

SEQ ID NO: 5520949 - DNA, 14 bp, Homo sapiens
tccttttgaggctt

SEQ ID NO: 5520950 - DNA, 14 bp, Homo sapiens
tccttttgatgggg

SEQ ID NO: 5520951 - DNA, 22 bp, Homo sapiens
tccttttgatggggagaaaggg

SEQ ID NO: 5520952 - DNA, 21 bp, Homo sapiens
tccttttgcaacaagacaaag

SEQ ID NO: 5520953 - DNA, 11 bp, Homo sapiens
tccttttgcac

SEQ ID NO: 5520954 - DNA, 14 bp, Homo sapiens
tccttttgcacatt

SEQ ID NO: 5520955 - DNA, 15 bp, Homo sapiens
tccttttgctgtgtg

SEQ ID NO: 5520956 - DNA, 22 bp, Homo sapiens
tccttttgctgtgtgaaatctt

SEQ ID NO: 5520957 - DNA, 18 bp, Homo sapiens
tccttttgcttcatctgg

SEQ ID NO: 5520958 - DNA, 19 bp, Homo sapiens
tccttttggaacatttctt

SEQ ID NO: 5520959 - DNA, 23 bp, Homo sapiens
tccttttggagtcagacagatgt

SEQ ID NO: 5520960 - DNA, 17 bp, Homo sapiens
tccttttggcctggggg

SEQ ID NO: 5520961 - DNA, 16 bp, Homo sapiens
tccttttggctgggga

SEQ ID NO: 5520962 - DNA, 15 bp, Homo sapiens
tccttttgggaagaa

SEQ ID NO: 5520963 - DNA, 15 bp, Homo sapiens
tccttttggtgtgtt

SEQ ID NO: 5520964 - DNA, 12 bp, Homo sapiens
tccttttgtaaa

SEQ ID NO: 5520965 - DNA, 19 bp, Homo sapiens
tccttttgtaaagtaaaat

SEQ ID NO: 5520966 - DNA, 15 bp, Homo sapiens
tccttttgtaaagtg

SEQ ID NO: 5520967 - DNA, 20 bp, Homo sapiens
tccttttgtaaagtgaagaa

SEQ ID NO: 5520968 - DNA, 12 bp, Homo sapiens
tccttttgtaga

SEQ ID NO: 5520969 - DNA, 14 bp, Homo sapiens
tccttttgtcttct

SEQ ID NO: 5520970 - DNA, 19 bp, Homo sapiens
tccttttgtgttccaaaca

SEQ ID NO: 5520971 - DNA, 19 bp, Homo sapiens
tcctttttaaatgtgaatt

SEQ ID NO: 5520972 - DNA, 20 bp, Homo sapiens
tcctttttaaattcagtcct

SEQ ID NO: 5520973 - DNA, 12 bp, Homo sapiens
tcctttttaata

SEQ ID NO: 5520974 - DNA, 21 bp, Homo sapiens
tcctttttattccttttaaaa

SEQ ID NO: 5520975 - DNA, 23 bp, Homo sapiens
tcctttttatttatatgtatgtg

SEQ ID NO: 5520976 - DNA, 22 bp, Homo sapiens
tcctttttcaaaaaccagccag

SEQ ID NO: 5520977 - DNA, 13 bp, Homo sapiens
tcctttttcatgt

SEQ ID NO: 5520978 - DNA, 15 bp, Homo sapiens
tcctttttccaacaa

SEQ ID NO: 5520979 - DNA, 20 bp, Homo sapiens
tcctttttccaatgttttat

SEQ ID NO: 5520980 - DNA, 21 bp, Homo sapiens
tcctttttccaatgttttatt

SEQ ID NO: 5520981 - DNA, 16 bp, Homo sapiens
tcctttttccatcatt

SEQ ID NO: 5520982 - DNA, 17 bp, Homo sapiens
tcctttttccatcattt

SEQ ID NO: 5520983 - DNA, 21 bp, Homo sapiens
tcctttttcctctccacacag

SEQ ID NO: 5520984 - DNA, 13 bp, Homo sapiens
tcctttttctatg

SEQ ID NO: 5520985 - DNA, 14 bp, Homo sapiens
tcctttttctccct

SEQ ID NO: 5520986 - DNA, 12 bp, Homo sapiens
tcctttttctgc

SEQ ID NO: 5520987 - DNA, 15 bp, Homo sapiens
tcctttttgcagtat

SEQ ID NO: 5520988 - DNA, 23 bp, Homo sapiens
tcctttttgcagtatatttctga

SEQ ID NO: 5520989 - DNA, 19 bp, Homo sapiens
tccttttttaaaataaaat

SEQ ID NO: 5520990 - DNA, 14 bp, Homo sapiens
tccttttttataca

SEQ ID NO: 5520991 - DNA, 17 bp, Homo sapiens
tccttttttatacagga

SEQ ID NO: 5520992 - DNA, 19 bp, Homo sapiens
tccttttttcaatatgcaa

SEQ ID NO: 5520993 - DNA, 17 bp, Homo sapiens
tccttttttgagatttt

SEQ ID NO: 5520994 - DNA, 14 bp, Homo sapiens
tccttttttgtcta

SEQ ID NO: 5520995 - DNA, 15 bp, Homo sapiens
tccttttttgtctat

SEQ ID NO: 5520996 - DNA, 13 bp, Homo sapiens
tcgaaaaaataat

SEQ ID NO: 5520997 - DNA, 18 bp, Homo sapiens
tcgaaaaaataattattt

SEQ ID NO: 5520998 - DNA, 14 bp, Homo sapiens
tcgaaaacagatga

SEQ ID NO: 5520999 - DNA, 13 bp, Homo sapiens
tcgaaaacataaa

SEQ ID NO: 5521000 - DNA, 14 bp, Homo sapiens
tcgaaaagaaattg

SEQ ID NO: 5521001 - DNA, 23 bp, Homo sapiens
tcgaaaagaaattgtccttgaag

SEQ ID NO: 5521002 - DNA, 19 bp, Homo sapiens
tcgaaaattcatttcacat

SEQ ID NO: 5521003 - DNA, 20 bp, Homo sapiens
tcgaaacctacaagatttcc

SEQ ID NO: 5521004 - DNA, 20 bp, Homo sapiens
tcgaaacctgtccataaagt

SEQ ID NO: 5521005 - DNA, 21 bp, Homo sapiens
tcgaaacctgtccataaagta

SEQ ID NO: 5521006 - DNA, 17 bp, Homo sapiens
tcgaaactgccaagggt

SEQ ID NO: 5521007 - DNA, 14 bp, Homo sapiens
tcgaaagctctaga

SEQ ID NO: 5521008 - DNA, 20 bp, Homo sapiens
tcgaaagtgtcatcaatttg

SEQ ID NO: 5521009 - DNA, 21 bp, Homo sapiens
tcgaaagtgtcatcaatttgt

SEQ ID NO: 5521010 - DNA, 18 bp, Homo sapiens
tcgaaccaaggcagcctc

SEQ ID NO: 5521011 - DNA, 19 bp, Homo sapiens
tcgaaccaaggcagcctcc

SEQ ID NO: 5521012 - DNA, 22 bp, Homo sapiens
tcgaaccaaggcagcctccaga

SEQ ID NO: 5521013 - DNA, 13 bp, Homo sapiens
tcgaacccacact

SEQ ID NO: 5521014 - DNA, 14 bp, Homo sapiens
tcgaacccactccg

SEQ ID NO: 5521015 - DNA, 14 bp, Homo sapiens
tcgaactcctgacc

SEQ ID NO: 5521016 - DNA, 19 bp, Homo sapiens
tcgaactcctgacctcagg

SEQ ID NO: 5521017 - DNA, 15 bp, Homo sapiens
tcgaactcctggcct

SEQ ID NO: 5521018 - DNA, 16 bp, Homo sapiens
tcgaactcctgggctc

SEQ ID NO: 5521019 - DNA, 13 bp, Homo sapiens
tcgaactgctttc

SEQ ID NO: 5521020 - DNA, 21 bp, Homo sapiens
tcgaagaaaataattctctat

SEQ ID NO: 5521021 - DNA, 23 bp, Homo sapiens
tcgaagaacaatgtcagaaactc

SEQ ID NO: 5521022 - DNA, 21 bp, Homo sapiens
tcgaagaattggcagaagcag

SEQ ID NO: 5521023 - DNA, 21 bp, Homo sapiens
tcgaagaggccagtaggagac

SEQ ID NO: 5521024 - DNA, 19 bp, Homo sapiens
tcgaagcaatcagcaaaca

SEQ ID NO: 5521025 - DNA, 16 bp, Homo sapiens
tcgaagctcagcccac

SEQ ID NO: 5521026 - DNA, 18 bp, Homo sapiens
tcgaagctcagcccaccc

SEQ ID NO: 5521027 - DNA, 19 bp, Homo sapiens
tcgaagctcagcccacccc

SEQ ID NO: 5521028 - DNA, 16 bp, Homo sapiens
tcgaagctgttctctg

SEQ ID NO: 5521029 - DNA, 22 bp, Homo sapiens
tcgaaggatgctctttcccttt

SEQ ID NO: 5521030 - DNA, 18 bp, Homo sapiens
tcgaaggctctctctttc

SEQ ID NO: 5521031 - DNA, 14 bp, Homo sapiens
tcgaagtattcaat

SEQ ID NO: 5521032 - DNA, 18 bp, Homo sapiens
tcgaagtcattaaactgg

SEQ ID NO: 5521033 - DNA, 20 bp, Homo sapiens
tcgaagtcttccatcagcag

SEQ ID NO: 5521034 - DNA, 15 bp, Homo sapiens
tcgaagttcattttt

SEQ ID NO: 5521035 - DNA, 17 bp, Homo sapiens
tcgaatactttgaatgt

SEQ ID NO: 5521036 - DNA, 14 bp, Homo sapiens
tcgaatgaaaagct

SEQ ID NO: 5521037 - DNA, 12 bp, Homo sapiens
tcgaatgaaatt

SEQ ID NO: 5521038 - DNA, 11 bp, Homo sapiens
tcgaatgtaat

SEQ ID NO: 5521039 - DNA, 15 bp, Homo sapiens
tcgaattaatagctt

SEQ ID NO: 5521040 - DNA, 16 bp, Homo sapiens
tcgaattaatagcttt

SEQ ID NO: 5521041 - DNA, 21 bp, Homo sapiens
tcgaattaatagcttttattg

SEQ ID NO: 5521042 - DNA, 16 bp, Homo sapiens
tcgaattctcagacga

SEQ ID NO: 5521043 - DNA, 22 bp, Homo sapiens
tcgaattttgttttcttgattt

SEQ ID NO: 5521044 - DNA, 20 bp, Homo sapiens
tcgacaaaggccacaggcag

SEQ ID NO: 5521045 - DNA, 23 bp, Homo sapiens
tcgacactaagaatgaggaatag

SEQ ID NO: 5521046 - DNA, 22 bp, Homo sapiens
tcgacagcattttcctctgctt

SEQ ID NO: 5521047 - DNA, 19 bp, Homo sapiens
tcgacagcgcccctgctgt

SEQ ID NO: 5521048 - DNA, 20 bp, Homo sapiens
tcgacagcgcccctgctgtc

SEQ ID NO: 5521049 - DNA, 16 bp, Homo sapiens
tcgacagctgggctgg

SEQ ID NO: 5521050 - DNA, 19 bp, Homo sapiens
tcgacataccccactgggc

SEQ ID NO: 5521051 - DNA, 22 bp, Homo sapiens
tcgacatccgtcattgctgctg

SEQ ID NO: 5521052 - DNA, 15 bp, Homo sapiens
tcgacatcctagccc

SEQ ID NO: 5521053 - DNA, 18 bp, Homo sapiens
tcgacatcctagccccac

SEQ ID NO: 5521054 - DNA, 21 bp, Homo sapiens
tcgacatcctagccccaccca

SEQ ID NO: 5521055 - DNA, 16 bp, Homo sapiens
tcgacatgctgccagg

SEQ ID NO: 5521056 - DNA, 17 bp, Homo sapiens
tcgaccaattcaaccct

SEQ ID NO: 5521057 - DNA, 21 bp, Homo sapiens
tcgaccacagcaagccatcat

SEQ ID NO: 5521058 - DNA, 23 bp, Homo sapiens
tcgaccccaaaggaacactgaca

SEQ ID NO: 5521059 - DNA, 13 bp, Homo sapiens
tcgaccctgtccc

SEQ ID NO: 5521060 - DNA, 17 bp, Homo sapiens
tcgaccctgtcccctag

SEQ ID NO: 5521061 - DNA, 20 bp, Homo sapiens
tcgaccctgtgcaggagcta

SEQ ID NO: 5521062 - DNA, 15 bp, Homo sapiens
tcgacctcactgtca

SEQ ID NO: 5521063 - DNA, 15 bp, Homo sapiens
tcgacctccctggct

SEQ ID NO: 5521064 - DNA, 16 bp, Homo sapiens
tcgacctccctggctt

SEQ ID NO: 5521065 - DNA, 18 bp, Homo sapiens
tcgacctgatttacagtt

SEQ ID NO: 5521066 - DNA, 19 bp, Homo sapiens
tcgacctgatttacagttt

SEQ ID NO: 5521067 - DNA, 13 bp, Homo sapiens
tcgacctgcctcg

SEQ ID NO: 5521068 - DNA, 20 bp, Homo sapiens
tcgacgtttgactagccatc

SEQ ID NO: 5521069 - DNA, 15 bp, Homo sapiens
tcgactactgctcct

SEQ ID NO: 5521070 - DNA, 17 bp, Homo sapiens
tcgactcccccctggcc

SEQ ID NO: 5521071 - DNA, 23 bp, Homo sapiens
tcgactctgtgctggccagcgag

SEQ ID NO: 5521072 - DNA, 16 bp, Homo sapiens
tcgactgtgacctgtg

SEQ ID NO: 5521073 - DNA, 22 bp, Homo sapiens
tcgacttcttggttttctctct

SEQ ID NO: 5521074 - DNA, 23 bp, Homo sapiens
tcgacttcttggttttctctctg

SEQ ID NO: 5521075 - DNA, 21 bp, Homo sapiens
tcgacttgaccctttcctccc

SEQ ID NO: 5521076 - DNA, 14 bp, Homo sapiens
tcgacttgcatttt

SEQ ID NO: 5521077 - DNA, 20 bp, Homo sapiens
tcgagaaagaggcaccagga

SEQ ID NO: 5521078 - DNA, 15 bp, Homo sapiens
tcgagaactttcatt

SEQ ID NO: 5521079 - DNA, 16 bp, Homo sapiens
tcgagacacagtgaag

SEQ ID NO: 5521080 - DNA, 13 bp, Homo sapiens
tcgagaccagcct

SEQ ID NO: 5521081 - DNA, 14 bp, Homo sapiens
tcgagaccagcctc

SEQ ID NO: 5521082 - DNA, 15 bp, Homo sapiens
tcgagaccagcctgg

SEQ ID NO: 5521083 - DNA, 16 bp, Homo sapiens
tcgagaccagcctggc

SEQ ID NO: 5521084 - DNA, 18 bp, Homo sapiens
tcgagaccagcctggcca

SEQ ID NO: 5521085 - DNA, 19 bp, Homo sapiens
tcgagaccagcctggccaa

SEQ ID NO: 5521086 - DNA, 23 bp, Homo sapiens
tcgagaccatcctggcccctcca

SEQ ID NO: 5521087 - DNA, 14 bp, Homo sapiens
tcgagactgcaatg

SEQ ID NO: 5521088 - DNA, 17 bp, Homo sapiens
tcgagagcagcctggcc

SEQ ID NO: 5521089 - DNA, 17 bp, Homo sapiens
tcgagagccttacttca

SEQ ID NO: 5521090 - DNA, 19 bp, Homo sapiens
tcgagagctggccaaagag

SEQ ID NO: 5521091 - DNA, 18 bp, Homo sapiens
tcgagagggctgagcccc

SEQ ID NO: 5521092 - DNA, 23 bp, Homo sapiens
tcgagatgttcgctcgtgcagta

SEQ ID NO: 5521093 - DNA, 16 bp, Homo sapiens
tcgagatttgggagct

SEQ ID NO: 5521094 - DNA, 21 bp, Homo sapiens
tcgagcagtcctgcctcagcc

SEQ ID NO: 5521095 - DNA, 24 bp, Homo sapiens
tcgagcatcaggctaagaccctgt

SEQ ID NO: 5521096 - DNA, 20 bp, Homo sapiens
tcgagcatgcggagccagca

SEQ ID NO: 5521097 - DNA, 21 bp, Homo sapiens
tcgagcatgcggagccagcag

SEQ ID NO: 5521098 - DNA, 15 bp, Homo sapiens
tcgagccactgcact

SEQ ID NO: 5521099 - DNA, 11 bp, Homo sapiens
tcgagccatgg

SEQ ID NO: 5521100 - DNA, 14 bp, Homo sapiens
tcgagccccctgga

SEQ ID NO: 5521101 - DNA, 14 bp, Homo sapiens
tcgagccctccccc

SEQ ID NO: 5521102 - DNA, 14 bp, Homo sapiens
tcgagcgccctgca

SEQ ID NO: 5521103 - DNA, 17 bp, Homo sapiens
tcgagcgccctgcagac

SEQ ID NO: 5521104 - DNA, 18 bp, Homo sapiens
tcgagcgccctgcagacc

SEQ ID NO: 5521105 - DNA, 19 bp, Homo sapiens
tcgagctatatttaagtat

SEQ ID NO: 5521106 - DNA, 18 bp, Homo sapiens
tcgagctctgtagcctgg

SEQ ID NO: 5521107 - DNA, 18 bp, Homo sapiens
tcgagctgggaaggttcc

SEQ ID NO: 5521108 - DNA, 12 bp, Homo sapiens
tcgagctgtgct

SEQ ID NO: 5521109 - DNA, 13 bp, Homo sapiens
tcgagctgtgctc

SEQ ID NO: 5521110 - DNA, 19 bp, Homo sapiens
tcgaggagataaactgaaa

SEQ ID NO: 5521111 - DNA, 20 bp, Homo sapiens
tcgaggagtaacaatacaaa

SEQ ID NO: 5521112 - DNA, 22 bp, Homo sapiens
tcgaggcaccggcgctgcaggt

SEQ ID NO: 5521113 - DNA, 21 bp, Homo sapiens
tcgaggcatggggcatgtcct

SEQ ID NO: 5521114 - DNA, 22 bp, Homo sapiens
tcgaggccacattgctggctgc

SEQ ID NO: 5521115 - DNA, 18 bp, Homo sapiens
tcgaggcccagcgacctc

SEQ ID NO: 5521116 - DNA, 12 bp, Homo sapiens
tcgaggcctgaa

SEQ ID NO: 5521117 - DNA, 20 bp, Homo sapiens
tcgaggctggtaagggacct

SEQ ID NO: 5521118 - DNA, 17 bp, Homo sapiens
tcgagggccgcctgcct

SEQ ID NO: 5521119 - DNA, 19 bp, Homo sapiens
tcgagggccgcctgcctta

SEQ ID NO: 5521120 - DNA, 14 bp, Homo sapiens
tcgaggggcccagg

SEQ ID NO: 5521121 - DNA, 14 bp, Homo sapiens
tcgaggggctctca

SEQ ID NO: 5521122 - DNA, 20 bp, Homo sapiens
tcgaggggctctcagctcag

SEQ ID NO: 5521123 - DNA, 23 bp, Homo sapiens
tcgaggggtcctcacctggttga

SEQ ID NO: 5521124 - DNA, 16 bp, Homo sapiens
tcgagggttccaggct

SEQ ID NO: 5521125 - DNA, 13 bp, Homo sapiens
tcgagggtttgag

SEQ ID NO: 5521126 - DNA, 21 bp, Homo sapiens
tcgaggtagagtttgaaggag

SEQ ID NO: 5521127 - DNA, 19 bp, Homo sapiens
tcgaggtcctcctggcctg

SEQ ID NO: 5521128 - DNA, 15 bp, Homo sapiens
tcgaggtgtcaccct

SEQ ID NO: 5521129 - DNA, 17 bp, Homo sapiens
tcgagtaaacttgaaaa

SEQ ID NO: 5521130 - DNA, 13 bp, Homo sapiens
tcgagtactgtgg

SEQ ID NO: 5521131 - DNA, 14 bp, Homo sapiens
tcgagtactgtggg

SEQ ID NO: 5521132 - DNA, 17 bp, Homo sapiens
tcgagtccaaaatcatt

SEQ ID NO: 5521133 - DNA, 17 bp, Homo sapiens
tcgagtccagtcctttg

SEQ ID NO: 5521134 - DNA, 13 bp, Homo sapiens
tcgagtccccatg

SEQ ID NO: 5521135 - DNA, 13 bp, Homo sapiens
tcgagtctttgtg

SEQ ID NO: 5521136 - DNA, 16 bp, Homo sapiens
tcgagtgaatttctaa

SEQ ID NO: 5521137 - DNA, 15 bp, Homo sapiens
tcgagtgcccctgca

SEQ ID NO: 5521138 - DNA, 16 bp, Homo sapiens
tcgagtggcccaacag

SEQ ID NO: 5521139 - DNA, 16 bp, Homo sapiens
tcgagtgtagctgtga

SEQ ID NO: 5521140 - DNA, 18 bp, Homo sapiens
tcgagtgtagctgtgaaa

SEQ ID NO: 5521141 - DNA, 19 bp, Homo sapiens
tcgagtgtagctgtgaaat

SEQ ID NO: 5521142 - DNA, 19 bp, Homo sapiens
tcgagtgtttaaatgctgt

SEQ ID NO: 5521143 - DNA, 23 bp, Homo sapiens
tcgatacctggagcagaggaggg

SEQ ID NO: 5521144 - DNA, 14 bp, Homo sapiens
tcgatactgcgact

SEQ ID NO: 5521145 - DNA, 20 bp, Homo sapiens
tcgatactgcgactttctgc

SEQ ID NO: 5521146 - DNA, 23 bp, Homo sapiens
tcgatactgcgactttctgcctg

SEQ ID NO: 5521147 - DNA, 17 bp, Homo sapiens
tcgatatcctgatctcg

SEQ ID NO: 5521148 - DNA, 15 bp, Homo sapiens
tcgatattcccaggg

SEQ ID NO: 5521149 - DNA, 13 bp, Homo sapiens
tcgatatttccat

SEQ ID NO: 5521150 - DNA, 21 bp, Homo sapiens
tcgatcaaaaccttccttccc

SEQ ID NO: 5521151 - DNA, 17 bp, Homo sapiens
tcgatcatatttcccct

SEQ ID NO: 5521152 - DNA, 13 bp, Homo sapiens
tcgatcctggatt

SEQ ID NO: 5521153 - DNA, 23 bp, Homo sapiens
tcgatgaagcccaataaacctct

SEQ ID NO: 5521154 - DNA, 23 bp, Homo sapiens
tcgatgaatgtgttgatttgaga

SEQ ID NO: 5521155 - DNA, 22 bp, Homo sapiens
tcgatgactgtgaactgggcat

SEQ ID NO: 5521156 - DNA, 17 bp, Homo sapiens
tcgatgcaagtgtttct

SEQ ID NO: 5521157 - DNA, 19 bp, Homo sapiens
tcgatgcaagtgtttctgt

SEQ ID NO: 5521158 - DNA, 15 bp, Homo sapiens
tcgatgcgtattctg

SEQ ID NO: 5521159 - DNA, 17 bp, Homo sapiens
tcgatgcgtattctgtg

SEQ ID NO: 5521160 - DNA, 16 bp, Homo sapiens
tcgatgctcactgctt

SEQ ID NO: 5521161 - DNA, 13 bp, Homo sapiens
tcgatgctgctgg

SEQ ID NO: 5521162 - DNA, 21 bp, Homo sapiens
tcgatgggaagggtagaaaac

SEQ ID NO: 5521163 - DNA, 19 bp, Homo sapiens
tcgatgggggatgcttcat

SEQ ID NO: 5521164 - DNA, 23 bp, Homo sapiens
tcgatggtacgtgaccctctgct

SEQ ID NO: 5521165 - DNA, 22 bp, Homo sapiens
tcgatggtggcgctttctcctg

SEQ ID NO: 5521166 - DNA, 17 bp, Homo sapiens
tcgatgtcctcctctgt

SEQ ID NO: 5521167 - DNA, 21 bp, Homo sapiens
tcgatgtcctcctctgtgaaa

SEQ ID NO: 5521168 - DNA, 17 bp, Homo sapiens
tcgattcatattgaata

SEQ ID NO: 5521169 - DNA, 23 bp, Homo sapiens
tcgattgaaggtgacctctgccc

SEQ ID NO: 5521170 - DNA, 21 bp, Homo sapiens
tcgattgtgtagcaattgaca

SEQ ID NO: 5521171 - DNA, 13 bp, Homo sapiens
tcgatttctacct

SEQ ID NO: 5521172 - DNA, 14 bp, Homo sapiens
tcgatttctacctc

SEQ ID NO: 5521173 - DNA, 19 bp, Homo sapiens
tcgattttaccatatggaa

SEQ ID NO: 5521174 - DNA, 13 bp, Homo sapiens
tcgattttgtatc

SEQ ID NO: 5521175 - DNA, 12 bp, Homo sapiens
tcgcaaccctgc

SEQ ID NO: 5521176 - DNA, 18 bp, Homo sapiens
tcgcaaccctgcctgtca

SEQ ID NO: 5521177 - DNA, 12 bp, Homo sapiens
tcgcaactgaag

SEQ ID NO: 5521178 - DNA, 19 bp, Homo sapiens
tcgcaaggcctgtgctgca

SEQ ID NO: 5521179 - DNA, 23 bp, Homo sapiens
tcgcaatagttttttacttctct

SEQ ID NO: 5521180 - DNA, 23 bp, Homo sapiens
tcgcacaaggacatttgggactg

SEQ ID NO: 5521181 - DNA, 23 bp, Homo sapiens
tcgcacacacccatgtaaccact

SEQ ID NO: 5521182 - DNA, 14 bp, Homo sapiens
tcgcacacagggct

SEQ ID NO: 5521183 - DNA, 16 bp, Homo sapiens
tcgcacacagggctca

SEQ ID NO: 5521184 - DNA, 16 bp, Homo sapiens
tcgcacaggccctagc

SEQ ID NO: 5521185 - DNA, 18 bp, Homo sapiens
tcgcacagggcatgcctg

SEQ ID NO: 5521186 - DNA, 21 bp, Homo sapiens
tcgcaccactgtgtatttaac

SEQ ID NO: 5521187 - DNA, 22 bp, Homo sapiens
tcgcacccccctgttctaaggg

SEQ ID NO: 5521188 - DNA, 16 bp, Homo sapiens
tcgcaccgtgctgggc

SEQ ID NO: 5521189 - DNA, 12 bp, Homo sapiens
tcgcacctacca

SEQ ID NO: 5521190 - DNA, 17 bp, Homo sapiens
tcgcaccttttatacca

SEQ ID NO: 5521191 - DNA, 22 bp, Homo sapiens
tcgcacttgcagaggagcccag

SEQ ID NO: 5521192 - DNA, 21 bp, Homo sapiens
tcgcagagaggccaggtgcag

SEQ ID NO: 5521193 - DNA, 19 bp, Homo sapiens
tcgcagagcttttcagatt

SEQ ID NO: 5521194 - DNA, 22 bp, Homo sapiens
tcgcagcagctccgcctggcac

SEQ ID NO: 5521195 - DNA, 16 bp, Homo sapiens
tcgcagcaggtgcaag

SEQ ID NO: 5521196 - DNA, 21 bp, Homo sapiens
tcgcagcaggtgcaagagaca

SEQ ID NO: 5521197 - DNA, 20 bp, Homo sapiens
tcgcagccaccctgaggagt

SEQ ID NO: 5521198 - DNA, 23 bp, Homo sapiens
tcgcagccaccctgaggagtctg

SEQ ID NO: 5521199 - DNA, 13 bp, Homo sapiens
tcgcagcccccgc

SEQ ID NO: 5521200 - DNA, 23 bp, Homo sapiens
tcgcagcccccgcgccctccctc

SEQ ID NO: 5521201 - DNA, 17 bp, Homo sapiens
tcgcagccccgggcgga

SEQ ID NO: 5521202 - DNA, 17 bp, Homo sapiens
tcgcagcccctgttgga

SEQ ID NO: 5521203 - DNA, 17 bp, Homo sapiens
tcgcagcctgaagcctg

SEQ ID NO: 5521204 - DNA, 19 bp, Homo sapiens
tcgcagcctgaagcctgga

SEQ ID NO: 5521205 - DNA, 22 bp, Homo sapiens
tcgcagcctggcggggcaggag

SEQ ID NO: 5521206 - DNA, 15 bp, Homo sapiens
tcgcagctaccctca

SEQ ID NO: 5521207 - DNA, 21 bp, Homo sapiens
tcgcagctaccctcagcctcc

SEQ ID NO: 5521208 - DNA, 20 bp, Homo sapiens
tcgcaggaagacccaacaca

SEQ ID NO: 5521209 - DNA, 21 bp, Homo sapiens
tcgcaggaccaagggggcggg

SEQ ID NO: 5521210 - DNA, 18 bp, Homo sapiens
tcgcaggatccgctgcca

SEQ ID NO: 5521211 - DNA, 20 bp, Homo sapiens
tcgcaggatccgctgccacc

SEQ ID NO: 5521212 - DNA, 17 bp, Homo sapiens
tcgcaggattcttcctc

SEQ ID NO: 5521213 - DNA, 20 bp, Homo sapiens
tcgcagggaatgcagcagga

SEQ ID NO: 5521214 - DNA, 16 bp, Homo sapiens
tcgcagggtgcaggag

SEQ ID NO: 5521215 - DNA, 14 bp, Homo sapiens
tcgcagtcgcagga

SEQ ID NO: 5521216 - DNA, 23 bp, Homo sapiens
tcgcagtctcttagaatttgttt

SEQ ID NO: 5521217 - DNA, 14 bp, Homo sapiens
tcgcagtgcccagt

SEQ ID NO: 5521218 - DNA, 14 bp, Homo sapiens
tcgcataaagaaga

SEQ ID NO: 5521219 - DNA, 22 bp, Homo sapiens
tcgcatagaaatcaataatttg

SEQ ID NO: 5521220 - DNA, 15 bp, Homo sapiens
tcgcatcaaaagaca

SEQ ID NO: 5521221 - DNA, 20 bp, Homo sapiens
tcgcatcaaaagacaattct

SEQ ID NO: 5521222 - DNA, 21 bp, Homo sapiens
tcgcatcaaaagacaattctt

SEQ ID NO: 5521223 - DNA, 22 bp, Homo sapiens
tcgcatcaaaagacaattcttt

SEQ ID NO: 5521224 - DNA, 23 bp, Homo sapiens
tcgcatcaaaagacaattcttta

SEQ ID NO: 5521225 - DNA, 15 bp, Homo sapiens
tcgcatcattgcaga

SEQ ID NO: 5521226 - DNA, 13 bp, Homo sapiens
tcgcatccaccgc

SEQ ID NO: 5521227 - DNA, 21 bp, Homo sapiens
tcgcatccaccgccaccccac

SEQ ID NO: 5521228 - DNA, 24 bp, Homo sapiens
tcgcatccaccgccaccccactga

SEQ ID NO: 5521229 - DNA, 23 bp, Homo sapiens
tcgcatccgcctctgagccagga

SEQ ID NO: 5521230 - DNA, 13 bp, Homo sapiens
tcgcatccgtcct

SEQ ID NO: 5521231 - DNA, 16 bp, Homo sapiens
tcgcatccgtcctggg

SEQ ID NO: 5521232 - DNA, 17 bp, Homo sapiens
tcgcatccgtcctgggc

SEQ ID NO: 5521233 - DNA, 23 bp, Homo sapiens
tcgcatgaacaatgggagcacat

SEQ ID NO: 5521234 - DNA, 20 bp, Homo sapiens
tcgcatggtcacacactgat

SEQ ID NO: 5521235 - DNA, 14 bp, Homo sapiens
tcgcattaagcaca

SEQ ID NO: 5521236 - DNA, 13 bp, Homo sapiens
tcgcatttcctaa

SEQ ID NO: 5521237 - DNA, 13 bp, Homo sapiens
tcgcatttgtcaa

SEQ ID NO: 5521238 - DNA, 15 bp, Homo sapiens
tcgcatttgtcaatg

SEQ ID NO: 5521239 - DNA, 16 bp, Homo sapiens
tcgccaacatggtgaa

SEQ ID NO: 5521240 - DNA, 18 bp, Homo sapiens
tcgccaacttgtctctgt

SEQ ID NO: 5521241 - DNA, 13 bp, Homo sapiens
tcgccaaggccta

SEQ ID NO: 5521242 - DNA, 14 bp, Homo sapiens
tcgccaaggcctag

SEQ ID NO: 5521243 - DNA, 16 bp, Homo sapiens
tcgccacacccggctc

SEQ ID NO: 5521244 - DNA, 22 bp, Homo sapiens
tcgccacacccggctccccctg

SEQ ID NO: 5521245 - DNA, 18 bp, Homo sapiens
tcgccacctggcattcct

SEQ ID NO: 5521246 - DNA, 15 bp, Homo sapiens
tcgccacgctcagtg

SEQ ID NO: 5521247 - DNA, 16 bp, Homo sapiens
tcgccagctgatgact

SEQ ID NO: 5521248 - DNA, 14 bp, Homo sapiens
tcgccagcttctcc

SEQ ID NO: 5521249 - DNA, 15 bp, Homo sapiens
tcgccagcttctcct

SEQ ID NO: 5521250 - DNA, 16 bp, Homo sapiens
tcgccagcttctcctg

SEQ ID NO: 5521251 - DNA, 18 bp, Homo sapiens
tcgccagcttctcctgcg

SEQ ID NO: 5521252 - DNA, 22 bp, Homo sapiens
tcgccaggactggtgaatataa

SEQ ID NO: 5521253 - DNA, 16 bp, Homo sapiens
tcgccagtcactgctg

SEQ ID NO: 5521254 - DNA, 16 bp, Homo sapiens
tcgccatctcctgggc

SEQ ID NO: 5521255 - DNA, 17 bp, Homo sapiens
tcgccatcttcttccct

SEQ ID NO: 5521256 - DNA, 13 bp, Homo sapiens
tcgccatgtgctg

SEQ ID NO: 5521257 - DNA, 15 bp, Homo sapiens
tcgccattcactgat

SEQ ID NO: 5521258 - DNA, 17 bp, Homo sapiens
tcgcccaaagccagaca

SEQ ID NO: 5521259 - DNA, 23 bp, Homo sapiens
tcgcccacaagccttactcacct

SEQ ID NO: 5521260 - DNA, 16 bp, Homo sapiens
tcgcccacccagctgg

SEQ ID NO: 5521261 - DNA, 20 bp, Homo sapiens
tcgcccacccagctggtcct

SEQ ID NO: 5521262 - DNA, 14 bp, Homo sapiens
tcgcccaccgcatg

SEQ ID NO: 5521263 - DNA, 21 bp, Homo sapiens
tcgcccaccgcatgccccctc

SEQ ID NO: 5521264 - DNA, 19 bp, Homo sapiens
tcgcccacgggtgtggctc

SEQ ID NO: 5521265 - DNA, 11 bp, Homo sapiens
tcgcccagcag

SEQ ID NO: 5521266 - DNA, 12 bp, Homo sapiens
tcgcccagcagg

SEQ ID NO: 5521267 - DNA, 21 bp, Homo sapiens
tcgcccagcggcatcaggctt

SEQ ID NO: 5521268 - DNA, 14 bp, Homo sapiens
tcgcccaggaaggc

SEQ ID NO: 5521269 - DNA, 12 bp, Homo sapiens
tcgcccaggaga

SEQ ID NO: 5521270 - DNA, 14 bp, Homo sapiens
tcgcccaggctgga

SEQ ID NO: 5521271 - DNA, 19 bp, Homo sapiens
tcgcccaggctggagtgca

SEQ ID NO: 5521272 - DNA, 22 bp, Homo sapiens
tcgcccatacccgtgacagtgg

SEQ ID NO: 5521273 - DNA, 22 bp, Homo sapiens
tcgggcagcacaagtgtaatga

SEQ ID NO: 5521274 - DNA, 19 bp, Homo sapiens
tcgggcaggggctggaggg

SEQ ID NO: 5521275 - DNA, 15 bp, Homo sapiens
tcgggcaggtcagcg

SEQ ID NO: 5521276 - DNA, 15 bp, Homo sapiens
tcgggcagtcctgtg

SEQ ID NO: 5521277 - DNA, 19 bp, Homo sapiens
tcgggcagtggaggctgct

SEQ ID NO: 5521278 - DNA, 12 bp, Homo sapiens
tcgggcatgagt

SEQ ID NO: 5521279 - DNA, 18 bp, Homo sapiens
tcgggcccacctggccac

SEQ ID NO: 5521280 - DNA, 21 bp, Homo sapiens
tcgggcccacctggccacctg

SEQ ID NO: 5521281 - DNA, 12 bp, Homo sapiens
tcgggcccagcc

SEQ ID NO: 5521282 - DNA, 14 bp, Homo sapiens
tcgggcccagcccc

SEQ ID NO: 5521283 - DNA, 15 bp, Homo sapiens
tcgggcccagccccc

SEQ ID NO: 5521284 - DNA, 13 bp, Homo sapiens
tcgggcccaggga

SEQ ID NO: 5521285 - DNA, 23 bp, Homo sapiens
tcgggccccatcctcatccctga

SEQ ID NO: 5521286 - DNA, 17 bp, Homo sapiens
tcgggcccctgagcctg

SEQ ID NO: 5521287 - DNA, 15 bp, Homo sapiens
tcgggcccctgcctg

SEQ ID NO: 5521288 - DNA, 20 bp, Homo sapiens
tcgggcccgcactcaggagc

SEQ ID NO: 5521289 - DNA, 21 bp, Homo sapiens
tcgggcccttcttgctgccct

SEQ ID NO: 5521290 - DNA, 15 bp, Homo sapiens
tcgggccgcctcctc

SEQ ID NO: 5521291 - DNA, 16 bp, Homo sapiens
tcgggccgcctcctcc

SEQ ID NO: 5521292 - DNA, 17 bp, Homo sapiens
tcgggccgcctcctcca

SEQ ID NO: 5521293 - DNA, 19 bp, Homo sapiens
tcgggccgggcaccacccc

SEQ ID NO: 5521294 - DNA, 18 bp, Homo sapiens
tcgggcgctgtggctcct

SEQ ID NO: 5521295 - DNA, 20 bp, Homo sapiens
tcgggcgctgtggctcctgc

SEQ ID NO: 5521296 - DNA, 23 bp, Homo sapiens
tcgggcgctgtggctcctgcctt

SEQ ID NO: 5521297 - DNA, 18 bp, Homo sapiens
tcgggcgtgggtctctgg

SEQ ID NO: 5521298 - DNA, 20 bp, Homo sapiens
tcgggcgtgggtctctgggg

SEQ ID NO: 5521299 - DNA, 16 bp, Homo sapiens
tcgggctaaggtccct

SEQ ID NO: 5521300 - DNA, 18 bp, Homo sapiens
tcgggctaagtccagctc

SEQ ID NO: 5521301 - DNA, 12 bp, Homo sapiens
tcgggctcagct

SEQ ID NO: 5521302 - DNA, 16 bp, Homo sapiens
tcgggctcagctctgg

SEQ ID NO: 5521303 - DNA, 14 bp, Homo sapiens
tcgggctcctgtgc

SEQ ID NO: 5521304 - DNA, 16 bp, Homo sapiens
tcgggctcctgtgccc

SEQ ID NO: 5521305 - DNA, 14 bp, Homo sapiens
tcgggctgccagcc

SEQ ID NO: 5521306 - DNA, 16 bp, Homo sapiens
tcgggctgccagccca

SEQ ID NO: 5521307 - DNA, 19 bp, Homo sapiens
tcgggctggagcctccgac

SEQ ID NO: 5521308 - DNA, 19 bp, Homo sapiens
tcgggcttccctggcctcc

SEQ ID NO: 5521309 - DNA, 11 bp, Homo sapiens
tcggggagggc

SEQ ID NO: 5521310 - DNA, 15 bp, Homo sapiens
tcggggcaggccagg

SEQ ID NO: 5521311 - DNA, 17 bp, Homo sapiens
tcggggcatgctggggc

SEQ ID NO: 5521312 - DNA, 14 bp, Homo sapiens
tcggggccagaggc

SEQ ID NO: 5521313 - DNA, 13 bp, Homo sapiens
tcggggcccctgc

SEQ ID NO: 5521314 - DNA, 14 bp, Homo sapiens
tcggggcctgctgg

SEQ ID NO: 5521315 - DNA, 19 bp, Homo sapiens
tcggggcgacccctcagtg

SEQ ID NO: 5521316 - DNA, 21 bp, Homo sapiens
tcggggcgatgctccctcagc

SEQ ID NO: 5521317 - DNA, 16 bp, Homo sapiens
tcggggctgggaagtc

SEQ ID NO: 5521318 - DNA, 15 bp, Homo sapiens
tcggggctgggcaga

SEQ ID NO: 5521319 - DNA, 21 bp, Homo sapiens
tcggggctgggggctgcaggg

SEQ ID NO: 5521320 - DNA, 11 bp, Homo sapiens
tcgggggagga

SEQ ID NO: 5521321 - DNA, 17 bp, Homo sapiens
tcgggggaggagcaccc

SEQ ID NO: 5521322 - DNA, 16 bp, Homo sapiens
tcgggggcctgtggtg

SEQ ID NO: 5521323 - DNA, 18 bp, Homo sapiens
tcgggggctcttccccta

SEQ ID NO: 5521324 - DNA, 16 bp, Homo sapiens
tcgggggctggcctag

SEQ ID NO: 5521325 - DNA, 21 bp, Homo sapiens
tcggggggcgagggaggggag

SEQ ID NO: 5521326 - DNA, 10 bp, Homo sapiens
tcggggggtg

SEQ ID NO: 5521327 - DNA, 20 bp, Homo sapiens
tcgggggtgagcgaagcccc

SEQ ID NO: 5521328 - DNA, 21 bp, Homo sapiens
tcggggtaaaaagtggctgcg

SEQ ID NO: 5521329 - DNA, 16 bp, Homo sapiens
tcggggtagaggctgg

SEQ ID NO: 5521330 - DNA, 13 bp, Homo sapiens
tcggggtccacca

SEQ ID NO: 5521331 - DNA, 18 bp, Homo sapiens
tcggggtggcccactgag

SEQ ID NO: 5521332 - DNA, 19 bp, Homo sapiens
tcggggttggggtgggagg

SEQ ID NO: 5521333 - DNA, 19 bp, Homo sapiens
tcgggtccccaacccgtgc

SEQ ID NO: 5521334 - DNA, 17 bp, Homo sapiens
tcgggtctccccacctg

SEQ ID NO: 5521335 - DNA, 15 bp, Homo sapiens
tcgggtgcccaggac

SEQ ID NO: 5521336 - DNA, 14 bp, Homo sapiens
tcgggtggggctgg

SEQ ID NO: 5521337 - DNA, 14 bp, Homo sapiens
tcgggttaagaaat

SEQ ID NO: 5521338 - DNA, 15 bp, Homo sapiens
tcgggttaagaaata

SEQ ID NO: 5521339 - DNA, 14 bp, Homo sapiens
tcgggttctcccat

SEQ ID NO: 5521340 - DNA, 13 bp, Homo sapiens
tcggtcagcaccg

SEQ ID NO: 5521341 - DNA, 14 bp, Homo sapiens
tcggtcatgtgtgt

SEQ ID NO: 5521342 - DNA, 15 bp, Homo sapiens
tcggtccactcttgt

SEQ ID NO: 5521343 - DNA, 23 bp, Homo sapiens
tcggtctcccaaagtgctgggat

SEQ ID NO: 5521344 - DNA, 19 bp, Homo sapiens
tcggtctcccttccgtcca

SEQ ID NO: 5521345 - DNA, 20 bp, Homo sapiens
tcggtctcccttccgtccat

SEQ ID NO: 5521346 - DNA, 12 bp, Homo sapiens
tcggtgaagaaa

SEQ ID NO: 5521347 - DNA, 23 bp, Homo sapiens
tcggtgcagcggtggaaggagcc

SEQ ID NO: 5521348 - DNA, 14 bp, Homo sapiens
tcggtgctccatct

SEQ ID NO: 5521349 - DNA, 18 bp, Homo sapiens
tcggtgctccatctccgc

SEQ ID NO: 5521350 - DNA, 22 bp, Homo sapiens
tcggtggagactatcagcccaa

SEQ ID NO: 5521351 - DNA, 14 bp, Homo sapiens
tcggtggccatgct

SEQ ID NO: 5521352 - DNA, 22 bp, Homo sapiens
tcggtggccctgactgtcaggg

SEQ ID NO: 5521353 - DNA, 12 bp, Homo sapiens
tcggtggctctg

SEQ ID NO: 5521354 - DNA, 13 bp, Homo sapiens
tcggtgggacagc

SEQ ID NO: 5521355 - DNA, 15 bp, Homo sapiens
tcggtgggacagccc

SEQ ID NO: 5521356 - DNA, 18 bp, Homo sapiens
tcggtgggacagccccag

SEQ ID NO: 5521357 - DNA, 15 bp, Homo sapiens
tcggtgtccatttat

SEQ ID NO: 5521358 - DNA, 21 bp, Homo sapiens
tcggtgtccccaccatctgct

SEQ ID NO: 5521359 - DNA, 18 bp, Homo sapiens
tcggtgtggacgctgtgc

SEQ ID NO: 5521360 - DNA, 16 bp, Homo sapiens
tcggtgttacttccct

SEQ ID NO: 5521361 - DNA, 22 bp, Homo sapiens
tcggtgtttggaggctgctgcc

SEQ ID NO: 5521362 - DNA, 23 bp, Homo sapiens
tcggtgtttggaggctgctgccc

SEQ ID NO: 5521363 - DNA, 14 bp, Homo sapiens
tcggtttctgagca

SEQ ID NO: 5521364 - DNA, 17 bp, Homo sapiens
tcgtaaacatctcagag

SEQ ID NO: 5521365 - DNA, 20 bp, Homo sapiens
tcgtaagatttccttctttt

SEQ ID NO: 5521366 - DNA, 16 bp, Homo sapiens
tcgtaagttctgtgca

SEQ ID NO: 5521367 - DNA, 16 bp, Homo sapiens
tcgtaatagcttctgt

SEQ ID NO: 5521368 - DNA, 18 bp, Homo sapiens
tcgtaatagcttctgtgt

SEQ ID NO: 5521369 - DNA, 19 bp, Homo sapiens
tcgtaatagcttctgtgtg

SEQ ID NO: 5521370 - DNA, 19 bp, Homo sapiens
tcgtaatgggtatattgat

SEQ ID NO: 5521371 - DNA, 14 bp, Homo sapiens
tcgtacagttcttc

SEQ ID NO: 5521372 - DNA, 15 bp, Homo sapiens
tcgtacataatactg

SEQ ID NO: 5521373 - DNA, 16 bp, Homo sapiens
tcgtacattgtgccct

SEQ ID NO: 5521374 - DNA, 14 bp, Homo sapiens
tcgtaccagccagg

SEQ ID NO: 5521375 - DNA, 15 bp, Homo sapiens
tcgtaccgcttcctt

SEQ ID NO: 5521376 - DNA, 16 bp, Homo sapiens
tcgtaccgcttcctta

SEQ ID NO: 5521377 - DNA, 13 bp, Homo sapiens
tcgtacctgtccc

SEQ ID NO: 5521378 - DNA, 14 bp, Homo sapiens
tcgtacctgtccct

SEQ ID NO: 5521379 - DNA, 15 bp, Homo sapiens
tcgtagagccctcca

SEQ ID NO: 5521380 - DNA, 13 bp, Homo sapiens
tcgtaggcagcca

SEQ ID NO: 5521381 - DNA, 14 bp, Homo sapiens
tcgtaggcagccac

SEQ ID NO: 5521382 - DNA, 14 bp, Homo sapiens
tcgtataaggaaat

SEQ ID NO: 5521383 - DNA, 22 bp, Homo sapiens
tcgtataaggaaatccagcccc

SEQ ID NO: 5521384 - DNA, 13 bp, Homo sapiens
tcgtatagaaaaa

SEQ ID NO: 5521385 - DNA, 18 bp, Homo sapiens
tcgtatagaaaaagcaca

SEQ ID NO: 5521386 - DNA, 16 bp, Homo sapiens
tcgtatagaagtcttc

SEQ ID NO: 5521387 - DNA, 20 bp, Homo sapiens
tcgtatagaagtcttcatga

SEQ ID NO: 5521388 - DNA, 17 bp, Homo sapiens
tcgtatcataatttctt

SEQ ID NO: 5521389 - DNA, 20 bp, Homo sapiens
tcgtatcccgagtctgggac

SEQ ID NO: 5521390 - DNA, 18 bp, Homo sapiens
tcgtatgatacttcgaca

SEQ ID NO: 5521391 - DNA, 15 bp, Homo sapiens
tcgtatggatttcta

SEQ ID NO: 5521392 - DNA, 17 bp, Homo sapiens
tcgtattgcaaataaga

SEQ ID NO: 5521393 - DNA, 14 bp, Homo sapiens
tcgtcaccccagcc

SEQ ID NO: 5521394 - DNA, 13 bp, Homo sapiens
tcgtcagcctccc

SEQ ID NO: 5521395 - DNA, 15 bp, Homo sapiens
tcgtcagcctccctg

SEQ ID NO: 5521396 - DNA, 13 bp, Homo sapiens
tcgtcatcttccc

SEQ ID NO: 5521397 - DNA, 14 bp, Homo sapiens
tcgtcatcttccct

SEQ ID NO: 5521398 - DNA, 16 bp, Homo sapiens
tcgtcatgttggccag

SEQ ID NO: 5521399 - DNA, 20 bp, Homo sapiens
tcgtcatgttggccaggctg

SEQ ID NO: 5521400 - DNA, 18 bp, Homo sapiens
tcgtcattttatatttag

SEQ ID NO: 5521401 - DNA, 22 bp, Homo sapiens
tcgtcattttctttcccagaag

SEQ ID NO: 5521402 - DNA, 18 bp, Homo sapiens
tcgtccaaggcagttctg

SEQ ID NO: 5521403 - DNA, 16 bp, Homo sapiens
tcgtccaagggacagc

SEQ ID NO: 5521404 - DNA, 21 bp, Homo sapiens
tcgtccacaggggcaggcctg

SEQ ID NO: 5521405 - DNA, 18 bp, Homo sapiens
tcgtcccatcttcactct

SEQ ID NO: 5521406 - DNA, 14 bp, Homo sapiens
tcgtccccaagtga

SEQ ID NO: 5521407 - DNA, 14 bp, Homo sapiens
tcgtccccagacca

SEQ ID NO: 5521408 - DNA, 14 bp, Homo sapiens
tcgtcccctgcctc

SEQ ID NO: 5521409 - DNA, 20 bp, Homo sapiens
tcgtccctatatcagggcct

SEQ ID NO: 5521410 - DNA, 13 bp, Homo sapiens
tcgtccgctcagc

SEQ ID NO: 5521411 - DNA, 16 bp, Homo sapiens
tcgtccggcctgcagc

SEQ ID NO: 5521412 - DNA, 14 bp, Homo sapiens
tcgtcctccccctg

SEQ ID NO: 5521413 - DNA, 17 bp, Homo sapiens
tcgtcctggattcactg

SEQ ID NO: 5521414 - DNA, 21 bp, Homo sapiens
tcgtcctgtagcacgctgcct

SEQ ID NO: 5521415 - DNA, 14 bp, Homo sapiens
tcgtcctgtcccag

SEQ ID NO: 5521416 - DNA, 16 bp, Homo sapiens
tcgtcctgtcccagag

SEQ ID NO: 5521417 - DNA, 15 bp, Homo sapiens
tcgtccttactcctg

SEQ ID NO: 5521418 - DNA, 14 bp, Homo sapiens
tcgtccttcctctc

SEQ ID NO: 5521419 - DNA, 21 bp, Homo sapiens
tcgtcgaaaggtgcagctgcg

SEQ ID NO: 5521420 - DNA, 22 bp, Homo sapiens
tcgtcgaaaggtgcagctgcgt

SEQ ID NO: 5521421 - DNA, 23 bp, Homo sapiens
tcgtctaatgggggcagtctccc

SEQ ID NO: 5521422 - DNA, 14 bp, Homo sapiens
tcgtctactgcaag

SEQ ID NO: 5521423 - DNA, 18 bp, Homo sapiens
tcgtctatatatacatat

SEQ ID NO: 5521424 - DNA, 17 bp, Homo sapiens
tcgtctcatcctccttt

SEQ ID NO: 5521425 - DNA, 18 bp, Homo sapiens
tcgtctcatgtaaaataa

SEQ ID NO: 5521426 - DNA, 16 bp, Homo sapiens
tcgtctccctcgacag

SEQ ID NO: 5521427 - DNA, 21 bp, Homo sapiens
tcgtctccctggtgcctctgt

SEQ ID NO: 5521428 - DNA, 22 bp, Homo sapiens
tcgtctccctggtgcctctgtg

SEQ ID NO: 5521429 - DNA, 15 bp, Homo sapiens
tcgtctcggcccctc

SEQ ID NO: 5521430 - DNA, 19 bp, Homo sapiens
tcgtctcggcccctctgat

SEQ ID NO: 5521431 - DNA, 21 bp, Homo sapiens
tcgtctcggccttcacaatct

SEQ ID NO: 5521432 - DNA, 14 bp, Homo sapiens
tcgtctgatgtttt

SEQ ID NO: 5521433 - DNA, 12 bp, Homo sapiens
tcgtctgtccca

SEQ ID NO: 5521434 - DNA, 13 bp, Homo sapiens
tcgtctgtcccag

SEQ ID NO: 5521435 - DNA, 12 bp, Homo sapiens
tcgtctgtgaat

SEQ ID NO: 5521436 - DNA, 17 bp, Homo sapiens
tcgtctgtgaatgctaa

SEQ ID NO: 5521437 - DNA, 12 bp, Homo sapiens
tcgtcttcctct

SEQ ID NO: 5521438 - DNA, 18 bp, Homo sapiens
tcgtcttcctctctctca

SEQ ID NO: 5521439 - DNA, 19 bp, Homo sapiens
tcgtcttgagcccaggagt

SEQ ID NO: 5521440 - DNA, 16 bp, Homo sapiens
tcgtcttgtgtttgct

SEQ ID NO: 5521441 - DNA, 15 bp, Homo sapiens
tcgtcttgttgttat

SEQ ID NO: 5521442 - DNA, 13 bp, Homo sapiens
tcgtctttcagcg

SEQ ID NO: 5521443 - DNA, 14 bp, Homo sapiens
tcgtctttcagcga

SEQ ID NO: 5521444 - DNA, 20 bp, Homo sapiens
tcgtctttcccatggggagg

SEQ ID NO: 5521445 - DNA, 18 bp, Homo sapiens
tcgtctttgcttgtcctg

SEQ ID NO: 5521446 - DNA, 18 bp, Homo sapiens
tcgtgaaaaccaaccctg

SEQ ID NO: 5521447 - DNA, 21 bp, Homo sapiens
tcgtgaaaaccaaccctgtgg

SEQ ID NO: 5521448 - DNA, 17 bp, Homo sapiens
tcgtgaacatagagttt

SEQ ID NO: 5521449 - DNA, 14 bp, Homo sapiens
tcgtgaacatcccc

SEQ ID NO: 5521450 - DNA, 19 bp, Homo sapiens
tcgtgaacatcccctccca

SEQ ID NO: 5521451 - DNA, 14 bp, Homo sapiens
tcgtgaactcctga

SEQ ID NO: 5521452 - DNA, 21 bp, Homo sapiens
tcgtgaagaagcctgtaacac

SEQ ID NO: 5521453 - DNA, 17 bp, Homo sapiens
tcgtgaagtatactgta

SEQ ID NO: 5521454 - DNA, 18 bp, Homo sapiens
tcgtgacaatgtttacaa

SEQ ID NO: 5521455 - DNA, 22 bp, Homo sapiens
tcgtgacgctgaataaatgtct

SEQ ID NO: 5521456 - DNA, 18 bp, Homo sapiens
tcgtgactcagaaacaga

SEQ ID NO: 5521457 - DNA, 16 bp, Homo sapiens
tcgtgagctcttgtga

SEQ ID NO: 5521458 - DNA, 19 bp, Homo sapiens
tcgtgagctggaggaacat

SEQ ID NO: 5521459 - DNA, 14 bp, Homo sapiens
tcgtgagctgggga

SEQ ID NO: 5521460 - DNA, 18 bp, Homo sapiens
tcgtgagctggggactca

SEQ ID NO: 5521461 - DNA, 14 bp, Homo sapiens
tcgtgagtcattta

SEQ ID NO: 5521462 - DNA, 19 bp, Homo sapiens
tcgtgagtcatttaaatgt

SEQ ID NO: 5521463 - DNA, 14 bp, Homo sapiens
tcgtgatatgctgc

SEQ ID NO: 5521464 - DNA, 18 bp, Homo sapiens
tcgtgatatgctgcttgt

SEQ ID NO: 5521465 - DNA, 21 bp, Homo sapiens
tcgtgatgacatatcacatgt

SEQ ID NO: 5521466 - DNA, 22 bp, Homo sapiens
tcgtgatgggcccgcctcggcc

SEQ ID NO: 5521467 - DNA, 11 bp, Homo sapiens
tcgtgatgtgg

SEQ ID NO: 5521468 - DNA, 13 bp, Homo sapiens
tcgtgcactttct

SEQ ID NO: 5521469 - DNA, 13 bp, Homo sapiens
tcgtgcagagctg

SEQ ID NO: 5521470 - DNA, 15 bp, Homo sapiens
tcgtgcagagctggg

SEQ ID NO: 5521471 - DNA, 19 bp, Homo sapiens
tcgtgcagcatatgaggat

SEQ ID NO: 5521472 - DNA, 14 bp, Homo sapiens
tcgtgcatttcaac

SEQ ID NO: 5521473 - DNA, 13 bp, Homo sapiens
tcgtgcatttgtg

SEQ ID NO: 5521474 - DNA, 14 bp, Homo sapiens
tcgtgcatttgtta

SEQ ID NO: 5521475 - DNA, 22 bp, Homo sapiens
tcgtgccaccccgagggctgag

SEQ ID NO: 5521476 - DNA, 11 bp, Homo sapiens
tcgtgccagca

SEQ ID NO: 5521477 - DNA, 18 bp, Homo sapiens
tcgtgccagcagcctcgc

SEQ ID NO: 5521478 - DNA, 18 bp, Homo sapiens
tcgtgccattacactcca

SEQ ID NO: 5521479 - DNA, 23 bp, Homo sapiens
tcgtgccgtggagcttggagccc

SEQ ID NO: 5521480 - DNA, 20 bp, Homo sapiens
tcgtgccgttactctccaac

SEQ ID NO: 5521481 - DNA, 23 bp, Homo sapiens
tcgtgccgttactctccaacctg

SEQ ID NO: 5521482 - DNA, 12 bp, Homo sapiens
tcgtgcctgaga

SEQ ID NO: 5521483 - DNA, 15 bp, Homo sapiens
tcgtgcctgagacca

SEQ ID NO: 5521484 - DNA, 22 bp, Homo sapiens
tcgtgcctgagaccagggtggc

SEQ ID NO: 5521485 - DNA, 21 bp, Homo sapiens
tcgtgcctgtgtccatgcgct

SEQ ID NO: 5521486 - DNA, 19 bp, Homo sapiens
tcgtgcgcaacaacaagga

SEQ ID NO: 5521487 - DNA, 15 bp, Homo sapiens
tcgtgctccgcaggg

SEQ ID NO: 5521488 - DNA, 22 bp, Homo sapiens
tcgtgctggcggacgcagctgg

SEQ ID NO: 5521489 - DNA, 13 bp, Homo sapiens
tcgtgctgtgctc

SEQ ID NO: 5521490 - DNA, 14 bp, Homo sapiens
tcgtgctttaagtg

SEQ ID NO: 5521491 - DNA, 23 bp, Homo sapiens
tcgtggaaagggtgctgcttccc

SEQ ID NO: 5521492 - DNA, 18 bp, Homo sapiens
tcgtggacacacacagac

SEQ ID NO: 5521493 - DNA, 12 bp, Homo sapiens
tcgtggacacct

SEQ ID NO: 5521494 - DNA, 14 bp, Homo sapiens
tcgtggacacctgc

SEQ ID NO: 5521495 - DNA, 17 bp, Homo sapiens
tcgtggagaatttttac

SEQ ID NO: 5521496 - DNA, 16 bp, Homo sapiens
tcgtggagagctagga

SEQ ID NO: 5521497 - DNA, 16 bp, Homo sapiens
tcgtggagatgtcttc

SEQ ID NO: 5521498 - DNA, 19 bp, Homo sapiens
tcgtggagatgtcttcgta

SEQ ID NO: 5521499 - DNA, 19 bp, Homo sapiens
tcgtggcacgtattgctgt

SEQ ID NO: 5521500 - DNA, 22 bp, Homo sapiens
tcgtggcacgtattgctgtgtc

SEQ ID NO: 5521501 - DNA, 15 bp, Homo sapiens
tcgtggccaaaagtt

SEQ ID NO: 5521502 - DNA, 13 bp, Homo sapiens
tcgtggccagccc

SEQ ID NO: 5521503 - DNA, 15 bp, Homo sapiens
tcgtggccagcccgg

SEQ ID NO: 5521504 - DNA, 11 bp, Homo sapiens
tcgtggccttc

SEQ ID NO: 5521505 - DNA, 19 bp, Homo sapiens
tcgtggccttccccagcct

SEQ ID NO: 5521506 - DNA, 20 bp, Homo sapiens
tcgtggccttccccagcctc

SEQ ID NO: 5521507 - DNA, 20 bp, Homo sapiens
tcgtggctaaggtaagaacg

SEQ ID NO: 5521508 - DNA, 12 bp, Homo sapiens
tcgtggctgtca

SEQ ID NO: 5521509 - DNA, 15 bp, Homo sapiens
tcgtgggaaagggga

SEQ ID NO: 5521510 - DNA, 13 bp, Homo sapiens
tcgtgggaaggag

SEQ ID NO: 5521511 - DNA, 23 bp, Homo sapiens
tcgtgggagagagacgtgtacat

SEQ ID NO: 5521512 - DNA, 15 bp, Homo sapiens
tcgtggggtgtgctg

SEQ ID NO: 5521513 - DNA, 14 bp, Homo sapiens
tcgtgggtcccaga

SEQ ID NO: 5521514 - DNA, 19 bp, Homo sapiens
tcgtgggtctgttttcctt

SEQ ID NO: 5521515 - DNA, 15 bp, Homo sapiens
tcgtgggtgtgtgta

SEQ ID NO: 5521516 - DNA, 22 bp, Homo sapiens
tcgtgggtgtgtgtagccaagg

SEQ ID NO: 5521517 - DNA, 15 bp, Homo sapiens
tcgtggtaggactgt

SEQ ID NO: 5521518 - DNA, 14 bp, Homo sapiens
tcgtggtgggggag

SEQ ID NO: 5521519 - DNA, 19 bp, Homo sapiens
tcgtggttattagcaaggc

SEQ ID NO: 5521520 - DNA, 17 bp, Homo sapiens
tcgtggttcttaaatgt

SEQ ID NO: 5521521 - DNA, 20 bp, Homo sapiens
tcgtgtaattacttatccct

SEQ ID NO: 5521522 - DNA, 18 bp, Homo sapiens
tcgtgtatcctggggctc

SEQ ID NO: 5521523 - DNA, 12 bp, Homo sapiens
tcgtgtcctgct

SEQ ID NO: 5521524 - DNA, 21 bp, Homo sapiens
tcgtgtctagtagaacaatgt

SEQ ID NO: 5521525 - DNA, 14 bp, Homo sapiens
tcgtgtctctccca

SEQ ID NO: 5521526 - DNA, 23 bp, Homo sapiens
tcgtgtctggcgttgtggggatg

SEQ ID NO: 5521527 - DNA, 19 bp, Homo sapiens
tcgtgtgcaacagacaagt

SEQ ID NO: 5521528 - DNA, 18 bp, Homo sapiens
tcgtgtggatcttgccac

SEQ ID NO: 5521529 - DNA, 15 bp, Homo sapiens
tcgtgtggctcctgg

SEQ ID NO: 5521530 - DNA, 15 bp, Homo sapiens
tcgtgttatgaatct

SEQ ID NO: 5521531 - DNA, 21 bp, Homo sapiens
tcgtgttatgaatctgtgctg

SEQ ID NO: 5521532 - DNA, 20 bp, Homo sapiens
tcgtgttggaaaatgtgtct

SEQ ID NO: 5521533 - DNA, 21 bp, Homo sapiens
tcgtgttgtgttctttataac

SEQ ID NO: 5521534 - DNA, 13 bp, Homo sapiens
tcgtgtttacaaa

SEQ ID NO: 5521535 - DNA, 14 bp, Homo sapiens
tcgtgtttacaaaa

SEQ ID NO: 5521536 - DNA, 17 bp, Homo sapiens
tcgtgtttgattccatt

SEQ ID NO: 5521537 - DNA, 16 bp, Homo sapiens
tcgtgtttgcaaaggt

SEQ ID NO: 5521538 - DNA, 22 bp, Homo sapiens
tcgttaactgtgtatgtacata

SEQ ID NO: 5521539 - DNA, 13 bp, Homo sapiens
tcgttaagcagta

SEQ ID NO: 5521540 - DNA, 17 bp, Homo sapiens
tcgttaagcagtacatc

SEQ ID NO: 5521541 - DNA, 19 bp, Homo sapiens
tcgttaagcagtacatctt

SEQ ID NO: 5521542 - DNA, 21 bp, Homo sapiens
tcgttaagcagtacatcttgt

SEQ ID NO: 5521543 - DNA, 16 bp, Homo sapiens
tcgttaattaatgtca

SEQ ID NO: 5521544 - DNA, 19 bp, Homo sapiens
tcgttacattgtgtcctgc

SEQ ID NO: 5521545 - DNA, 15 bp, Homo sapiens
tcgttacccatttct

SEQ ID NO: 5521546 - DNA, 15 bp, Homo sapiens
tcgttagaccgctct

SEQ ID NO: 5521547 - DNA, 23 bp, Homo sapiens
tcgttagaccgctctcttttctg

SEQ ID NO: 5521548 - DNA, 21 bp, Homo sapiens
tcgttagagaatggcctgaga

SEQ ID NO: 5521549 - DNA, 18 bp, Homo sapiens
tcgttaggacaaggctgt

SEQ ID NO: 5521550 - DNA, 18 bp, Homo sapiens
tcgttaggatactgcctc

SEQ ID NO: 5521551 - DNA, 20 bp, Homo sapiens
tcgttagggaagagaaacag

SEQ ID NO: 5521552 - DNA, 18 bp, Homo sapiens
tcgttagtaatctgtata

SEQ ID NO: 5521553 - DNA, 15 bp, Homo sapiens
tcgttatgtgtgtat

SEQ ID NO: 5521554 - DNA, 17 bp, Homo sapiens
tcgttattataaatgtt

SEQ ID NO: 5521555 - DNA, 21 bp, Homo sapiens
tcgttatttctgtttgtttaa

SEQ ID NO: 5521556 - DNA, 14 bp, Homo sapiens
tcgttcaaaacatt

SEQ ID NO: 5521557 - DNA, 20 bp, Homo sapiens
tcgttcaaaacattccaaga

SEQ ID NO: 5521558 - DNA, 15 bp, Homo sapiens
tcgttcccatagatt

SEQ ID NO: 5521559 - DNA, 19 bp, Homo sapiens
tcgttcccatagatttgaa

SEQ ID NO: 5521560 - DNA, 18 bp, Homo sapiens
tcgttcccttgtgtctgt

SEQ ID NO: 5521561 - DNA, 20 bp, Homo sapiens
tcgttccggttatgttgtgt

SEQ ID NO: 5521562 - DNA, 20 bp, Homo sapiens
tcgttcctgcagccagaaag

SEQ ID NO: 5521563 - DNA, 15 bp, Homo sapiens
tcgttcgatttaagc

SEQ ID NO: 5521564 - DNA, 14 bp, Homo sapiens
tcgttcgctcgctc

SEQ ID NO: 5521565 - DNA, 13 bp, Homo sapiens
tcgttctctgcct

SEQ ID NO: 5521566 - DNA, 22 bp, Homo sapiens
tcgttctctgggtggccggctt

SEQ ID NO: 5521567 - DNA, 17 bp, Homo sapiens
tcgttctgctcagaggc

SEQ ID NO: 5521568 - DNA, 18 bp, Homo sapiens
tcgttctgctgaccaaat

SEQ ID NO: 5521569 - DNA, 12 bp, Homo sapiens
tcgttctgctgg

SEQ ID NO: 5521570 - DNA, 13 bp, Homo sapiens
tcgttctgctggc

SEQ ID NO: 5521571 - DNA, 11 bp, Homo sapiens
tcgttctgtgg

SEQ ID NO: 5521572 - DNA, 15 bp, Homo sapiens
tcgttcttgttagta

SEQ ID NO: 5521573 - DNA, 15 bp, Homo sapiens
tcgttcttgttctgt

SEQ ID NO: 5521574 - DNA, 21 bp, Homo sapiens
tcgttgccgcagcggtgggaa

SEQ ID NO: 5521575 - DNA, 15 bp, Homo sapiens
tcgttgcctctgatt

SEQ ID NO: 5521576 - DNA, 15 bp, Homo sapiens
tcgttggagactgaa

SEQ ID NO: 5521577 - DNA, 12 bp, Homo sapiens
tcgttggagagc

SEQ ID NO: 5521578 - DNA, 15 bp, Homo sapiens
tcgttggttgtttct

SEQ ID NO: 5521579 - DNA, 21 bp, Homo sapiens
tcgttgtcacacccatggcct

SEQ ID NO: 5521580 - DNA, 12 bp, Homo sapiens
tcgttgtgaggg

SEQ ID NO: 5521581 - DNA, 14 bp, Homo sapiens
tcgttgttattatt

SEQ ID NO: 5521582 - DNA, 20 bp, Homo sapiens
tcgtttaatgaatgcttaaa

SEQ ID NO: 5521583 - DNA, 12 bp, Homo sapiens
tcgtttaatgtt

SEQ ID NO: 5521584 - DNA, 14 bp, Homo sapiens
tcgtttaatgttta

SEQ ID NO: 5521585 - DNA, 16 bp, Homo sapiens
tcgtttaatgtttata

SEQ ID NO: 5521586 - DNA, 19 bp, Homo sapiens
tcgtttagaatcagaataa

SEQ ID NO: 5521587 - DNA, 16 bp, Homo sapiens
tcgtttcacatctgta

SEQ ID NO: 5521588 - DNA, 13 bp, Homo sapiens
tcgtttctgacat

SEQ ID NO: 5521589 - DNA, 13 bp, Homo sapiens
tcgtttctgtata

SEQ ID NO: 5521590 - DNA, 23 bp, Homo sapiens
tcgtttcttagacctcttcctgg

SEQ ID NO: 5521591 - DNA, 17 bp, Homo sapiens
tcgtttgaatcacagta

SEQ ID NO: 5521592 - DNA, 16 bp, Homo sapiens
tcgtttggatctgtga

SEQ ID NO: 5521593 - DNA, 17 bp, Homo sapiens
tcgtttggatctgtgac

SEQ ID NO: 5521594 - DNA, 22 bp, Homo sapiens
tcgtttgtattctacctttgta

SEQ ID NO: 5521595 - DNA, 19 bp, Homo sapiens
tcgttttagtgtctgacct

SEQ ID NO: 5521596 - DNA, 12 bp, Homo sapiens
tcgttttcaaag

SEQ ID NO: 5521597 - DNA, 18 bp, Homo sapiens
tcgttttctttgctgtgc

SEQ ID NO: 5521598 - DNA, 16 bp, Homo sapiens
tcgtttttcagcaccc

SEQ ID NO: 5521599 - DNA, 17 bp, Homo sapiens
tctaaaaaaaaaaactg

SEQ ID NO: 5521600 - DNA, 13 bp, Homo sapiens
tctaaaaaaataa

SEQ ID NO: 5521601 - DNA, 18 bp, Homo sapiens
tctaaaaaaataaacaaa

SEQ ID NO: 5521602 - DNA, 18 bp, Homo sapiens
tctaaaaaacagaggcca

SEQ ID NO: 5521603 - DNA, 15 bp, Homo sapiens
tctaaaaaacatttt

SEQ ID NO: 5521604 - DNA, 17 bp, Homo sapiens
tctaaaaaacattttta

SEQ ID NO: 5521605 - DNA, 21 bp, Homo sapiens
tctaaaaaagatactgtatat

SEQ ID NO: 5521606 - DNA, 22 bp, Homo sapiens
tctaaaaaagatactgtatatg

SEQ ID NO: 5521607 - DNA, 13 bp, Homo sapiens
tctaaaaagaaaa

SEQ ID NO: 5521608 - DNA, 15 bp, Homo sapiens
tctaaaaagaagcca

SEQ ID NO: 5521609 - DNA, 15 bp, Homo sapiens
tctaaaaagtcagat

SEQ ID NO: 5521610 - DNA, 15 bp, Homo sapiens
tctaaaaataaagct

SEQ ID NO: 5521611 - DNA, 15 bp, Homo sapiens
tctaaaaatatacat

SEQ ID NO: 5521612 - DNA, 23 bp, Homo sapiens
tctaaaaattttgcatttcatgc

SEQ ID NO: 5521613 - DNA, 24 bp, Homo sapiens
tctaaaaattttgcatttcatgct

SEQ ID NO: 5521614 - DNA, 16 bp, Homo sapiens
tctaaaacaaaatctg

SEQ ID NO: 5521615 - DNA, 19 bp, Homo sapiens
tctaaaacaaaatctgaac

SEQ ID NO: 5521616 - DNA, 15 bp, Homo sapiens
tctaaaacaataaaa

SEQ ID NO: 5521617 - DNA, 20 bp, Homo sapiens
tctaaaacacaacaagaaac

SEQ ID NO: 5521618 - DNA, 16 bp, Homo sapiens
tctaaaacattcccct

SEQ ID NO: 5521619 - DNA, 17 bp, Homo sapiens
tctaaaactactgcctt

SEQ ID NO: 5521620 - DNA, 20 bp, Homo sapiens
tctaaaactactgcctttca

SEQ ID NO: 5521621 - DNA, 13 bp, Homo sapiens
tctaaaactatgg

SEQ ID NO: 5521622 - DNA, 23 bp, Homo sapiens
tctaaaactatggttcccaataa

SEQ ID NO: 5521623 - DNA, 12 bp, Homo sapiens
tctaaaactgta

SEQ ID NO: 5521624 - DNA, 15 bp, Homo sapiens
tctaaaactgtactt

SEQ ID NO: 5521625 - DNA, 19 bp, Homo sapiens
tctaaaactgtactttgat

SEQ ID NO: 5521626 - DNA, 14 bp, Homo sapiens
tctaaaacttcaaa

SEQ ID NO: 5521627 - DNA, 17 bp, Homo sapiens
tctaaaagatccttttt

SEQ ID NO: 5521628 - DNA, 22 bp, Homo sapiens
tctaaaagtaataaattccaat

SEQ ID NO: 5521629 - DNA, 13 bp, Homo sapiens
tctaaaataaatg

SEQ ID NO: 5521630 - DNA, 14 bp, Homo sapiens
tctaaaataaatgt

SEQ ID NO: 5521631 - DNA, 16 bp, Homo sapiens
tctaaaataaatgttt

SEQ ID NO: 5521632 - DNA, 12 bp, Homo sapiens
tctaaaatagca

SEQ ID NO: 5521633 - DNA, 17 bp, Homo sapiens
tctaaaatagcaataac

SEQ ID NO: 5521634 - DNA, 16 bp, Homo sapiens
tctaatggtaactttt

SEQ ID NO: 5521635 - DNA, 19 bp, Homo sapiens
tctaatggtaacttttgta

SEQ ID NO: 5521636 - DNA, 20 bp, Homo sapiens
tctaatggtaacttttgtag

SEQ ID NO: 5521637 - DNA, 13 bp, Homo sapiens
tctaatgtaaatt

SEQ ID NO: 5521638 - DNA, 13 bp, Homo sapiens
tctaatgtagcta

SEQ ID NO: 5521639 - DNA, 14 bp, Homo sapiens
tctaatgtagctat

SEQ ID NO: 5521640 - DNA, 20 bp, Homo sapiens
tctaatgtagctatttttct

SEQ ID NO: 5521641 - DNA, 24 bp, Homo sapiens
tctaatgtattttattgtaacaga

SEQ ID NO: 5521642 - DNA, 20 bp, Homo sapiens
tctaatgtctcttcctctgt

SEQ ID NO: 5521643 - DNA, 17 bp, Homo sapiens
tctaatgtctgcagctc

SEQ ID NO: 5521644 - DNA, 16 bp, Homo sapiens
tctaatgtgaaaatca

SEQ ID NO: 5521645 - DNA, 20 bp, Homo sapiens
tctaatgtgagtgtgaagct

SEQ ID NO: 5521646 - DNA, 14 bp, Homo sapiens
tctaatgtgtgaat

SEQ ID NO: 5521647 - DNA, 15 bp, Homo sapiens
tctaatgttccccgt

SEQ ID NO: 5521648 - DNA, 20 bp, Homo sapiens
tctaatgttccccgtggcta

SEQ ID NO: 5521649 - DNA, 16 bp, Homo sapiens
tctaatgtttactata

SEQ ID NO: 5521650 - DNA, 17 bp, Homo sapiens
tctaatgtttactatat

SEQ ID NO: 5521651 - DNA, 13 bp, Homo sapiens
tctaatgtttgca

SEQ ID NO: 5521652 - DNA, 16 bp, Homo sapiens
tctaattaaaacactt

SEQ ID NO: 5521653 - DNA, 12 bp, Homo sapiens
tctaattaaaat

SEQ ID NO: 5521654 - DNA, 21 bp, Homo sapiens
tctaattaaaatgtgcagtat

SEQ ID NO: 5521655 - DNA, 15 bp, Homo sapiens
tctaattaaatggca

SEQ ID NO: 5521656 - DNA, 15 bp, Homo sapiens
tctaattaattgtaa

SEQ ID NO: 5521657 - DNA, 21 bp, Homo sapiens
tctaattacaaagttcactgt

SEQ ID NO: 5521658 - DNA, 17 bp, Homo sapiens
tctaattagagaactgg

SEQ ID NO: 5521659 - DNA, 18 bp, Homo sapiens
tctaattagtctatcaaa

SEQ ID NO: 5521660 - DNA, 19 bp, Homo sapiens
tctaattatgtagctcttt

SEQ ID NO: 5521661 - DNA, 21 bp, Homo sapiens
tctaattccatccataaatcc

SEQ ID NO: 5521662 - DNA, 16 bp, Homo sapiens
tctaattcctgtttgt

SEQ ID NO: 5521663 - DNA, 12 bp, Homo sapiens
tctaattctaac

SEQ ID NO: 5521664 - DNA, 21 bp, Homo sapiens
tctaattctaaccagagcaag

SEQ ID NO: 5521665 - DNA, 20 bp, Homo sapiens
tctaattctaaggaatatga

SEQ ID NO: 5521666 - DNA, 15 bp, Homo sapiens
tctaattctctgtgg

SEQ ID NO: 5521667 - DNA, 16 bp, Homo sapiens
tctaattctcttttca

SEQ ID NO: 5521668 - DNA, 12 bp, Homo sapiens
tctaattctgat

SEQ ID NO: 5521669 - DNA, 15 bp, Homo sapiens
tctaattctgtgatt

SEQ ID NO: 5521670 - DNA, 16 bp, Homo sapiens
tctaattcttcattat

SEQ ID NO: 5521671 - DNA, 18 bp, Homo sapiens
tctaattcttcctttgta

SEQ ID NO: 5521672 - DNA, 18 bp, Homo sapiens
tctaattcttttcaaaat

SEQ ID NO: 5521673 - DNA, 17 bp, Homo sapiens
tctaattgcatctcaaa

SEQ ID NO: 5521674 - DNA, 13 bp, Homo sapiens
tctaattgccatg

SEQ ID NO: 5521675 - DNA, 16 bp, Homo sapiens
tctaattgctgtgtgt

SEQ ID NO: 5521676 - DNA, 12 bp, Homo sapiens
tctaattgctta

SEQ ID NO: 5521677 - DNA, 18 bp, Homo sapiens
tctaattgcttatttatt

SEQ ID NO: 5521678 - DNA, 21 bp, Homo sapiens
tctaattgtaagtgaaattaa

SEQ ID NO: 5521679 - DNA, 17 bp, Homo sapiens
tctaattgtcagtgatt

SEQ ID NO: 5521680 - DNA, 18 bp, Homo sapiens
tctaattgtcagtgattt

SEQ ID NO: 5521681 - DNA, 16 bp, Homo sapiens
tctaatttaacttatt

SEQ ID NO: 5521682 - DNA, 14 bp, Homo sapiens
tctaatttatacaa

SEQ ID NO: 5521683 - DNA, 15 bp, Homo sapiens
tctaatttatacaaa

SEQ ID NO: 5521684 - DNA, 14 bp, Homo sapiens
tctaatttattaat

SEQ ID NO: 5521685 - DNA, 20 bp, Homo sapiens
tctaatttcaaaaatataac

SEQ ID NO: 5521686 - DNA, 15 bp, Homo sapiens
tctaatttgaactgg

SEQ ID NO: 5521687 - DNA, 19 bp, Homo sapiens
tctaattttattttgtgaa

SEQ ID NO: 5521688 - DNA, 15 bp, Homo sapiens
tctaattttggatgg

SEQ ID NO: 5521689 - DNA, 15 bp, Homo sapiens
tctaatttttaagaa

SEQ ID NO: 5521690 - DNA, 17 bp, Homo sapiens
tctacaaaaaaccagga

SEQ ID NO: 5521691 - DNA, 16 bp, Homo sapiens
tctacaaaaaggtata

SEQ ID NO: 5521692 - DNA, 22 bp, Homo sapiens
tctacaaaaaggtataaataat

SEQ ID NO: 5521693 - DNA, 18 bp, Homo sapiens
tctacaaaaagtaaaaat

SEQ ID NO: 5521694 - DNA, 13 bp, Homo sapiens
tctacaaaacatt

SEQ ID NO: 5521695 - DNA, 19 bp, Homo sapiens
tctacaaaagcaaagtgaa

SEQ ID NO: 5521696 - DNA, 14 bp, Homo sapiens
tctacaacataatg

SEQ ID NO: 5521697 - DNA, 16 bp, Homo sapiens
tctacaaccagagccc

SEQ ID NO: 5521698 - DNA, 21 bp, Homo sapiens
tctacaactcatacactcgta

SEQ ID NO: 5521699 - DNA, 20 bp, Homo sapiens
tctacaagcatatttgagaa

SEQ ID NO: 5521700 - DNA, 16 bp, Homo sapiens
tctacaagcatttgcc

SEQ ID NO: 5521701 - DNA, 13 bp, Homo sapiens
tctacaaggactc

SEQ ID NO: 5521702 - DNA, 15 bp, Homo sapiens
tctacaaggactcca

SEQ ID NO: 5521703 - DNA, 15 bp, Homo sapiens
tctacaaggtgttca

SEQ ID NO: 5521704 - DNA, 14 bp, Homo sapiens
tctacaagtatatg

SEQ ID NO: 5521705 - DNA, 16 bp, Homo sapiens
tctacaatacaacaca

SEQ ID NO: 5521706 - DNA, 14 bp, Homo sapiens
tctacaatacatat

SEQ ID NO: 5521707 - DNA, 22 bp, Homo sapiens
tctacaatatatattatatata

SEQ ID NO: 5521708 - DNA, 19 bp, Homo sapiens
tctacaatcagttgacttt

SEQ ID NO: 5521709 - DNA, 23 bp, Homo sapiens
tctacaatctcccttcacaagtt

SEQ ID NO: 5521710 - DNA, 22 bp, Homo sapiens
tctacaatctctttttgtttgc

SEQ ID NO: 5521711 - DNA, 19 bp, Homo sapiens
tctacaatgtgaactttat

SEQ ID NO: 5521712 - DNA, 19 bp, Homo sapiens
tctacaattcctctgataa

SEQ ID NO: 5521713 - DNA, 16 bp, Homo sapiens
tctacacaatttaatt

SEQ ID NO: 5521714 - DNA, 23 bp, Homo sapiens
tctacacacaccagtggcagctg

SEQ ID NO: 5521715 - DNA, 18 bp, Homo sapiens
tctacacactcagccaca

SEQ ID NO: 5521716 - DNA, 19 bp, Homo sapiens
tctacacactcagccacaa

SEQ ID NO: 5521717 - DNA, 14 bp, Homo sapiens
tctacacagagcag

SEQ ID NO: 5521718 - DNA, 21 bp, Homo sapiens
tctacacagcgagaaaacttc

SEQ ID NO: 5521719 - DNA, 22 bp, Homo sapiens
tctacacaggggccctgtacag

SEQ ID NO: 5521720 - DNA, 15 bp, Homo sapiens
tctacacatacagaa

SEQ ID NO: 5521721 - DNA, 19 bp, Homo sapiens
tctacacatataaacacag

SEQ ID NO: 5521722 - DNA, 17 bp, Homo sapiens
tctacacatatatgtat

SEQ ID NO: 5521723 - DNA, 17 bp, Homo sapiens
tctacacatatcttgtt

SEQ ID NO: 5521724 - DNA, 16 bp, Homo sapiens
tctacacatgtaaaat

SEQ ID NO: 5521725 - DNA, 17 bp, Homo sapiens
tctacacattgctacct

SEQ ID NO: 5521726 - DNA, 17 bp, Homo sapiens
tctacacatttcatcta

SEQ ID NO: 5521727 - DNA, 19 bp, Homo sapiens
tctacacatttcatctaat

SEQ ID NO: 5521728 - DNA, 16 bp, Homo sapiens
tctacaccaatgaaaa

SEQ ID NO: 5521729 - DNA, 15 bp, Homo sapiens
tctacaccctctgcc

SEQ ID NO: 5521730 - DNA, 12 bp, Homo sapiens
tctacacctgga

SEQ ID NO: 5521731 - DNA, 21 bp, Homo sapiens
tctacacggactgaggtgcct

SEQ ID NO: 5521732 - DNA, 21 bp, Homo sapiens
tctacactaagagagaatgag

SEQ ID NO: 5521733 - DNA, 17 bp, Homo sapiens
tctacactccagtgaga

SEQ ID NO: 5521734 - DNA, 16 bp, Homo sapiens
tctacactctcctggg

SEQ ID NO: 5521735 - DNA, 19 bp, Homo sapiens
tctacactgcaatcatatg

SEQ ID NO: 5521736 - DNA, 12 bp, Homo sapiens
tctacactgcct

SEQ ID NO: 5521737 - DNA, 21 bp, Homo sapiens
tctacagaaaatgctggctga

SEQ ID NO: 5521738 - DNA, 20 bp, Homo sapiens
tctacagaaataacagctgg

SEQ ID NO: 5521739 - DNA, 22 bp, Homo sapiens
tctacagaaataacagctgggg

SEQ ID NO: 5521740 - DNA, 15 bp, Homo sapiens
tctacagaagccaag

SEQ ID NO: 5521741 - DNA, 23 bp, Homo sapiens
tctacagaataatccagtattgc

SEQ ID NO: 5521742 - DNA, 23 bp, Homo sapiens
tctacagaccatatttttaaaga

SEQ ID NO: 5521743 - DNA, 12 bp, Homo sapiens
tctacagactcc

SEQ ID NO: 5521744 - DNA, 16 bp, Homo sapiens
tctacagacttctcca

SEQ ID NO: 5521745 - DNA, 17 bp, Homo sapiens
tctacagacttctccag

SEQ ID NO: 5521746 - DNA, 22 bp, Homo sapiens
tctacagatcctttttccatca

SEQ ID NO: 5521747 - DNA, 20 bp, Homo sapiens
tctacagctaatcagcattc

SEQ ID NO: 5521748 - DNA, 23 bp, Homo sapiens
tctacagctaatcagcattctca

SEQ ID NO: 5521749 - DNA, 18 bp, Homo sapiens
tctacagcttctgagaat

SEQ ID NO: 5521750 - DNA, 17 bp, Homo sapiens
tctacaggaaatacaga

SEQ ID NO: 5521751 - DNA, 15 bp, Homo sapiens
tctacaggacaaagg

SEQ ID NO: 5521752 - DNA, 11 bp, Homo sapiens
tctacaggcat

SEQ ID NO: 5521753 - DNA, 22 bp, Homo sapiens
tctacaggcctcttcctgttgt

SEQ ID NO: 5521754 - DNA, 12 bp, Homo sapiens
tctacaggcctg

SEQ ID NO: 5521755 - DNA, 19 bp, Homo sapiens
tctacaggcctgcagcccc

SEQ ID NO: 5521756 - DNA, 23 bp, Homo sapiens
tctacaggtttgggtacaagtgg

SEQ ID NO: 5521757 - DNA, 15 bp, Homo sapiens
tctacagtaatgaaa

SEQ ID NO: 5521758 - DNA, 15 bp, Homo sapiens
tctacagtactgaca

SEQ ID NO: 5521759 - DNA, 21 bp, Homo sapiens
tctacagtactgacagaaagc

SEQ ID NO: 5521760 - DNA, 23 bp, Homo sapiens
tctacagtggttttatactgaag

SEQ ID NO: 5521761 - DNA, 20 bp, Homo sapiens
tctacagttaattatgtgca

SEQ ID NO: 5521762 - DNA, 12 bp, Homo sapiens
tctacagttgtg

SEQ ID NO: 5521763 - DNA, 19 bp, Homo sapiens
tctacataaaatacaaaaa

SEQ ID NO: 5521764 - DNA, 17 bp, Homo sapiens
tctacataagtaattca

SEQ ID NO: 5521765 - DNA, 22 bp, Homo sapiens
tctacataagtaattcaagaaa

SEQ ID NO: 5521766 - DNA, 22 bp, Homo sapiens
tctacataccacacttaaaaga

SEQ ID NO: 5521767 - DNA, 15 bp, Homo sapiens
tctacatattcttta

SEQ ID NO: 5521768 - DNA, 11 bp, Homo sapiens
tctacatgaat

SEQ ID NO: 5521769 - DNA, 13 bp, Homo sapiens
tctacatgaatgc

SEQ ID NO: 5521770 - DNA, 20 bp, Homo sapiens
tctacatgaggaactgtaga

SEQ ID NO: 5521771 - DNA, 14 bp, Homo sapiens
tctacatgccatgc

SEQ ID NO: 5521772 - DNA, 22 bp, Homo sapiens
tctacatgccatgcctatgggc

SEQ ID NO: 5521773 - DNA, 19 bp, Homo sapiens
tctacatggctttgataat

SEQ ID NO: 5521774 - DNA, 21 bp, Homo sapiens
tctacatgtaactatttcttc

SEQ ID NO: 5521775 - DNA, 17 bp, Homo sapiens
tctacatgtaatgacac

SEQ ID NO: 5521776 - DNA, 14 bp, Homo sapiens
tctacatgtgagat

SEQ ID NO: 5521777 - DNA, 19 bp, Homo sapiens
tctacattaaaatgacaaa

SEQ ID NO: 5521778 - DNA, 21 bp, Homo sapiens
tctacattaaaatgacaaaca

SEQ ID NO: 5521779 - DNA, 22 bp, Homo sapiens
tctacattaaaatgacaaacat

SEQ ID NO: 5521780 - DNA, 14 bp, Homo sapiens
tctacattaaacaa

SEQ ID NO: 5521781 - DNA, 22 bp, Homo sapiens
tctacattaacttgaaaatttt

SEQ ID NO: 5521782 - DNA, 19 bp, Homo sapiens
tctacattataataaaatt

SEQ ID NO: 5521783 - DNA, 18 bp, Homo sapiens
tctacattataccgcaga

SEQ ID NO: 5521784 - DNA, 14 bp, Homo sapiens
tctacattattgct

SEQ ID NO: 5521785 - DNA, 13 bp, Homo sapiens
tctacattctcta

SEQ ID NO: 5521786 - DNA, 22 bp, Homo sapiens
tctacattctctatttttgtta

SEQ ID NO: 5521787 - DNA, 16 bp, Homo sapiens
tctacattctgctctg

SEQ ID NO: 5521788 - DNA, 17 bp, Homo sapiens
tctacattctgctctgc

SEQ ID NO: 5521789 - DNA, 15 bp, Homo sapiens
tctacattcttggtt

SEQ ID NO: 5521790 - DNA, 18 bp, Homo sapiens
tctacatttaaacaagta

SEQ ID NO: 5521791 - DNA, 13 bp, Homo sapiens
tctacatttgcag

SEQ ID NO: 5521792 - DNA, 18 bp, Homo sapiens
tctaccaaaaaaaggaag

SEQ ID NO: 5521793 - DNA, 16 bp, Homo sapiens
tctaccaactggaagc

SEQ ID NO: 5521794 - DNA, 20 bp, Homo sapiens
tctaccaactggaagcacag

SEQ ID NO: 5521795 - DNA, 16 bp, Homo sapiens
tctaccaagacataat

SEQ ID NO: 5521796 - DNA, 20 bp, Homo sapiens
tctaccaagctatcctggct

SEQ ID NO: 5521797 - DNA, 13 bp, Homo sapiens
tctaccaagctgt

SEQ ID NO: 5521798 - DNA, 16 bp, Homo sapiens
tctaccaagctgtcac

SEQ ID NO: 5521799 - DNA, 21 bp, Homo sapiens
tctaccaattatagatcaaat

SEQ ID NO: 5521800 - DNA, 18 bp, Homo sapiens
tctaccacacacagcctg

SEQ ID NO: 5521801 - DNA, 16 bp, Homo sapiens
tctaccagactgtgta

SEQ ID NO: 5521802 - DNA, 17 bp, Homo sapiens
tctaccaggcaaattca

SEQ ID NO: 5521803 - DNA, 21 bp, Homo sapiens
tctaccagtgcaggctggcca

SEQ ID NO: 5521804 - DNA, 19 bp, Homo sapiens
tctaccagtggtgctcaat

SEQ ID NO: 5521805 - DNA, 16 bp, Homo sapiens
tctaccagttggcaga

SEQ ID NO: 5521806 - DNA, 21 bp, Homo sapiens
tctaccatggttctgcctcct

SEQ ID NO: 5521807 - DNA, 23 bp, Homo sapiens
tctaccatggttctgcctcctgg

SEQ ID NO: 5521808 - DNA, 18 bp, Homo sapiens
tctaccattgaaggaaag

SEQ ID NO: 5521809 - DNA, 15 bp, Homo sapiens
tctaccatttcagag

SEQ ID NO: 5521810 - DNA, 20 bp, Homo sapiens
tctaccattttctggttctt

SEQ ID NO: 5521811 - DNA, 20 bp, Homo sapiens
tctacccaagggcagaaagt

SEQ ID NO: 5521812 - DNA, 18 bp, Homo sapiens
tctaggactgggggtctt

SEQ ID NO: 5521813 - DNA, 12 bp, Homo sapiens
tctaggacttca

SEQ ID NO: 5521814 - DNA, 13 bp, Homo sapiens
tctaggacttcaa

SEQ ID NO: 5521815 - DNA, 15 bp, Homo sapiens
tctaggagatgcttt

SEQ ID NO: 5521816 - DNA, 14 bp, Homo sapiens
tctaggagctcctt

SEQ ID NO: 5521817 - DNA, 18 bp, Homo sapiens
tctaggagctgggaggaa

SEQ ID NO: 5521818 - DNA, 17 bp, Homo sapiens
tctaggagctgtctcca

SEQ ID NO: 5521819 - DNA, 19 bp, Homo sapiens
tctaggagctgtctccagg

SEQ ID NO: 5521820 - DNA, 14 bp, Homo sapiens
tctaggaggatgct

SEQ ID NO: 5521821 - DNA, 15 bp, Homo sapiens
tctaggaggatgctg

SEQ ID NO: 5521822 - DNA, 18 bp, Homo sapiens
tctaggaggatgctgtgc

SEQ ID NO: 5521823 - DNA, 14 bp, Homo sapiens
tctaggatagctaa

SEQ ID NO: 5521824 - DNA, 23 bp, Homo sapiens
tctaggatagttgatgcatgtta

SEQ ID NO: 5521825 - DNA, 22 bp, Homo sapiens
tctaggatgggaacaaggaagg

SEQ ID NO: 5521826 - DNA, 16 bp, Homo sapiens
tctaggattgggcctc

SEQ ID NO: 5521827 - DNA, 17 bp, Homo sapiens
tctaggcaagcaggacc

SEQ ID NO: 5521828 - DNA, 20 bp, Homo sapiens
tctaggcaagcaggacctgg

SEQ ID NO: 5521829 - DNA, 16 bp, Homo sapiens
tctaggcactgagcag

SEQ ID NO: 5521830 - DNA, 20 bp, Homo sapiens
tctaggcatacttttcaaag

SEQ ID NO: 5521831 - DNA, 21 bp, Homo sapiens
tctaggcccattgtcctcctt

SEQ ID NO: 5521832 - DNA, 22 bp, Homo sapiens
tctaggcccattgtcctccttt

SEQ ID NO: 5521833 - DNA, 15 bp, Homo sapiens
tctaggcctcagtgt

SEQ ID NO: 5521834 - DNA, 20 bp, Homo sapiens
tctaggcctcctggcccagg

SEQ ID NO: 5521835 - DNA, 16 bp, Homo sapiens
tctaggcctttcctct

SEQ ID NO: 5521836 - DNA, 17 bp, Homo sapiens
tctaggcctttcctctg

SEQ ID NO: 5521837 - DNA, 19 bp, Homo sapiens
tctaggcgaggcgaagctg

SEQ ID NO: 5521838 - DNA, 19 bp, Homo sapiens
tctaggctgctgcacacca

SEQ ID NO: 5521839 - DNA, 23 bp, Homo sapiens
tctaggcttcaggttgcattggg

SEQ ID NO: 5521840 - DNA, 22 bp, Homo sapiens
tctagggaaaaaccagcgtgtg

SEQ ID NO: 5521841 - DNA, 13 bp, Homo sapiens
tctagggaaatga

SEQ ID NO: 5521842 - DNA, 20 bp, Homo sapiens
tctagggaaggccacctgca

SEQ ID NO: 5521843 - DNA, 23 bp, Homo sapiens
tctagggaaggccacctgcaggt

SEQ ID NO: 5521844 - DNA, 21 bp, Homo sapiens
tctagggaatgggactgtgag

SEQ ID NO: 5521845 - DNA, 15 bp, Homo sapiens
tctagggacccctcc

SEQ ID NO: 5521846 - DNA, 17 bp, Homo sapiens
tctagggacccctcctc

SEQ ID NO: 5521847 - DNA, 21 bp, Homo sapiens
tctagggactgccaggctgtt

SEQ ID NO: 5521848 - DNA, 18 bp, Homo sapiens
tctagggagccctgggcc

SEQ ID NO: 5521849 - DNA, 23 bp, Homo sapiens
tctagggatagtcaccttttaaa

SEQ ID NO: 5521850 - DNA, 18 bp, Homo sapiens
tctagggatataaaaaca

SEQ ID NO: 5521851 - DNA, 21 bp, Homo sapiens
tctagggatataaaaacagat

SEQ ID NO: 5521852 - DNA, 18 bp, Homo sapiens
tctagggcagagtatgtt

SEQ ID NO: 5521853 - DNA, 14 bp, Homo sapiens
tctagggcagggtg

SEQ ID NO: 5521854 - DNA, 16 bp, Homo sapiens
tctagggcctctccag

SEQ ID NO: 5521855 - DNA, 16 bp, Homo sapiens
tctaggggcagcctcc

SEQ ID NO: 5521856 - DNA, 15 bp, Homo sapiens
tctaggggcaggtga

SEQ ID NO: 5521857 - DNA, 20 bp, Homo sapiens
tctagggtacatggtgctgg

SEQ ID NO: 5521858 - DNA, 23 bp, Homo sapiens
tctagggtccctgaacgccctgg

SEQ ID NO: 5521859 - DNA, 17 bp, Homo sapiens
tctagggtgggccccag

SEQ ID NO: 5521860 - DNA, 15 bp, Homo sapiens
tctagggtgttctgt

SEQ ID NO: 5521861 - DNA, 18 bp, Homo sapiens
tctagggtttcttaaata

SEQ ID NO: 5521862 - DNA, 17 bp, Homo sapiens
tctaggtaggaaatgtg

SEQ ID NO: 5521863 - DNA, 14 bp, Homo sapiens
tctaggtaggaaga

SEQ ID NO: 5521864 - DNA, 20 bp, Homo sapiens
tctaggtaggaagagcccgc

SEQ ID NO: 5521865 - DNA, 20 bp, Homo sapiens
tctaggtaggggcccacttc

SEQ ID NO: 5521866 - DNA, 16 bp, Homo sapiens
tctaggtcaaggcctg

SEQ ID NO: 5521867 - DNA, 21 bp, Homo sapiens
tctaggtcagtacccacctga

SEQ ID NO: 5521868 - DNA, 14 bp, Homo sapiens
tctaggtcctggct

SEQ ID NO: 5521869 - DNA, 14 bp, Homo sapiens
tctaggtctcctca

SEQ ID NO: 5521870 - DNA, 16 bp, Homo sapiens
tctaggtctcctcagg

SEQ ID NO: 5521871 - DNA, 17 bp, Homo sapiens
tctaggtctcctcaggg

SEQ ID NO: 5521872 - DNA, 15 bp, Homo sapiens
tctaggtcttggtta

SEQ ID NO: 5521873 - DNA, 17 bp, Homo sapiens
tctaggtggagttgaaa

SEQ ID NO: 5521874 - DNA, 19 bp, Homo sapiens
tctaggtggagttgaaaga

SEQ ID NO: 5521875 - DNA, 17 bp, Homo sapiens
tctaggtggcaaggctg

SEQ ID NO: 5521876 - DNA, 19 bp, Homo sapiens
tctaggtgtggctgtgaag

SEQ ID NO: 5521877 - DNA, 17 bp, Homo sapiens
tctaggttaaagctaaa

SEQ ID NO: 5521878 - DNA, 21 bp, Homo sapiens
tctaggttaaagctaaactga

SEQ ID NO: 5521879 - DNA, 17 bp, Homo sapiens
tctaggttatacaataa

SEQ ID NO: 5521880 - DNA, 15 bp, Homo sapiens
tctaggtttcaaaga

SEQ ID NO: 5521881 - DNA, 19 bp, Homo sapiens
tctaggtttcaaagatgct

SEQ ID NO: 5521882 - DNA, 16 bp, Homo sapiens
tctaggtttctcttgt

SEQ ID NO: 5521883 - DNA, 17 bp, Homo sapiens
tctagtaacagtatttc

SEQ ID NO: 5521884 - DNA, 15 bp, Homo sapiens
tctagtaataaagac

SEQ ID NO: 5521885 - DNA, 21 bp, Homo sapiens
tctagtaatatatttaaaggg

SEQ ID NO: 5521886 - DNA, 16 bp, Homo sapiens
tctagtaattgggaaa

SEQ ID NO: 5521887 - DNA, 16 bp, Homo sapiens
tctagtacacttttat

SEQ ID NO: 5521888 - DNA, 13 bp, Homo sapiens
tctagtactgtga

SEQ ID NO: 5521889 - DNA, 15 bp, Homo sapiens
tctagtactgtgaat

SEQ ID NO: 5521890 - DNA, 15 bp, Homo sapiens
tctagtagaaagaaa

SEQ ID NO: 5521891 - DNA, 19 bp, Homo sapiens
tctagtagctgaaatgcaa

SEQ ID NO: 5521892 - DNA, 17 bp, Homo sapiens
tctagtagttaaaacag

SEQ ID NO: 5521893 - DNA, 15 bp, Homo sapiens
tctagtagttagaaa

SEQ ID NO: 5521894 - DNA, 22 bp, Homo sapiens
tctagtatttatgggtggattt

SEQ ID NO: 5521895 - DNA, 23 bp, Homo sapiens
tctagtatttgtatcctggcaaa

SEQ ID NO: 5521896 - DNA, 21 bp, Homo sapiens
tctagtattttatctggaaca

SEQ ID NO: 5521897 - DNA, 15 bp, Homo sapiens
tctagtcaactgctg

SEQ ID NO: 5521898 - DNA, 19 bp, Homo sapiens
tctagtcacaaagactcct

SEQ ID NO: 5521899 - DNA, 17 bp, Homo sapiens
tctagtcagtaaacatt

SEQ ID NO: 5521900 - DNA, 15 bp, Homo sapiens
tctagtcagtgtagt

SEQ ID NO: 5521901 - DNA, 15 bp, Homo sapiens
tctagtcattgtcat

SEQ ID NO: 5521902 - DNA, 23 bp, Homo sapiens
tctagtcatttgttaatatttct

SEQ ID NO: 5521903 - DNA, 17 bp, Homo sapiens
tctagtccccaaggcct

SEQ ID NO: 5521904 - DNA, 20 bp, Homo sapiens
tctagtccccaaggcctctc

SEQ ID NO: 5521905 - DNA, 21 bp, Homo sapiens
tctagtccccaaggcctctct

SEQ ID NO: 5521906 - DNA, 16 bp, Homo sapiens
tctagtcccttctctc

SEQ ID NO: 5521907 - DNA, 20 bp, Homo sapiens
tctagtcccttctctctttc

SEQ ID NO: 5521908 - DNA, 17 bp, Homo sapiens
tctagtccgtcctggca

SEQ ID NO: 5521909 - DNA, 23 bp, Homo sapiens
tctagtcctggatgactcggtct

SEQ ID NO: 5521910 - DNA, 18 bp, Homo sapiens
tctagtctctctggggcc

SEQ ID NO: 5521911 - DNA, 14 bp, Homo sapiens
tctagtctctgatt

SEQ ID NO: 5521912 - DNA, 15 bp, Homo sapiens
tctagtctgtcttcc

SEQ ID NO: 5521913 - DNA, 19 bp, Homo sapiens
tctagtcttgacctctcca

SEQ ID NO: 5521914 - DNA, 22 bp, Homo sapiens
tctagtcttgacctctccagca

SEQ ID NO: 5521915 - DNA, 21 bp, Homo sapiens
tctagtgaaactgcattattt

SEQ ID NO: 5521916 - DNA, 15 bp, Homo sapiens
tctagtgacttcctg

SEQ ID NO: 5521917 - DNA, 16 bp, Homo sapiens
tctagtgacttcctgg

SEQ ID NO: 5521918 - DNA, 21 bp, Homo sapiens
tctagtgagcctgggccagga

SEQ ID NO: 5521919 - DNA, 22 bp, Homo sapiens
tctagtgaggaagacaagcatt

SEQ ID NO: 5521920 - DNA, 12 bp, Homo sapiens
tctagtgatgat

SEQ ID NO: 5521921 - DNA, 19 bp, Homo sapiens
tctagtgcagctgaaattg

SEQ ID NO: 5521922 - DNA, 19 bp, Homo sapiens
tctagtgccattatttcta

SEQ ID NO: 5521923 - DNA, 13 bp, Homo sapiens
tctagtgctaaac

SEQ ID NO: 5521924 - DNA, 13 bp, Homo sapiens
tctagtgctgtga

SEQ ID NO: 5521925 - DNA, 14 bp, Homo sapiens
tctagtgctgtgaa

SEQ ID NO: 5521926 - DNA, 23 bp, Homo sapiens
tctagtgctgtgaaaaaaaaaat

SEQ ID NO: 5521927 - DNA, 17 bp, Homo sapiens
tctagtggctgttcatg

SEQ ID NO: 5521928 - DNA, 21 bp, Homo sapiens
tctagtgggttgacctttaaa

SEQ ID NO: 5521929 - DNA, 22 bp, Homo sapiens
tctagtgggttgacctttaaat

SEQ ID NO: 5521930 - DNA, 15 bp, Homo sapiens
tctagtggtctttgt

SEQ ID NO: 5521931 - DNA, 18 bp, Homo sapiens
tctagtggtctttgtaag

SEQ ID NO: 5521932 - DNA, 19 bp, Homo sapiens
tctagtggtctttgtaaga

SEQ ID NO: 5521933 - DNA, 22 bp, Homo sapiens
tctagtgtaccaagtgcttcct

SEQ ID NO: 5521934 - DNA, 22 bp, Homo sapiens
tctagtgtagctgccacattga

SEQ ID NO: 5521935 - DNA, 17 bp, Homo sapiens
tctagtgtccataaata

SEQ ID NO: 5521936 - DNA, 18 bp, Homo sapiens
tctagtgttttcaatttt

SEQ ID NO: 5521937 - DNA, 21 bp, Homo sapiens
tctagttagcaggaaatagtg

SEQ ID NO: 5521938 - DNA, 12 bp, Homo sapiens
tctagttcagaa

SEQ ID NO: 5521939 - DNA, 22 bp, Homo sapiens
tctagttctcaatcactgctcc

SEQ ID NO: 5521940 - DNA, 16 bp, Homo sapiens
tctagttctcttctcc

SEQ ID NO: 5521941 - DNA, 14 bp, Homo sapiens
tctagttctgccag

SEQ ID NO: 5521942 - DNA, 14 bp, Homo sapiens
tctagttctgttgt

SEQ ID NO: 5521943 - DNA, 15 bp, Homo sapiens
tctagttctttcctc

SEQ ID NO: 5521944 - DNA, 16 bp, Homo sapiens
tctagttctttcctcc

SEQ ID NO: 5521945 - DNA, 19 bp, Homo sapiens
tctagttgaaaataaagtg

SEQ ID NO: 5521946 - DNA, 21 bp, Homo sapiens
tctagttgacttcaaatgtgt

SEQ ID NO: 5521947 - DNA, 21 bp, Homo sapiens
tctagttgattgcgagaattt

SEQ ID NO: 5521948 - DNA, 22 bp, Homo sapiens
tctagttgattgcgagaatttt

SEQ ID NO: 5521949 - DNA, 13 bp, Homo sapiens
tctagttgcattt

SEQ ID NO: 5521950 - DNA, 22 bp, Homo sapiens
tctagttgccctctacctgact

SEQ ID NO: 5521951 - DNA, 13 bp, Homo sapiens
tctagttgctctt

SEQ ID NO: 5521952 - DNA, 22 bp, Homo sapiens
tctagttgggagagttggagag

SEQ ID NO: 5521953 - DNA, 13 bp, Homo sapiens
tctagttgtaatg

SEQ ID NO: 5521954 - DNA, 22 bp, Homo sapiens
tctagttgtttgattcagacag

SEQ ID NO: 5521955 - DNA, 14 bp, Homo sapiens
tctagtttacagaa

SEQ ID NO: 5521956 - DNA, 17 bp, Homo sapiens
tctagtttccctggtgc

SEQ ID NO: 5521957 - DNA, 13 bp, Homo sapiens
tctagtttcctgc

SEQ ID NO: 5521958 - DNA, 13 bp, Homo sapiens
tctagtttctagt

SEQ ID NO: 5521959 - DNA, 19 bp, Homo sapiens
tctagtttctcttagaaaa

SEQ ID NO: 5521960 - DNA, 15 bp, Homo sapiens
tctagtttctttctg

SEQ ID NO: 5521961 - DNA, 21 bp, Homo sapiens
tctagtttgattaaattcttg

SEQ ID NO: 5521962 - DNA, 20 bp, Homo sapiens
tctagtttgcatacttcctg

SEQ ID NO: 5521963 - DNA, 22 bp, Homo sapiens
tctagttttataggcagctgtc

SEQ ID NO: 5521964 - DNA, 14 bp, Homo sapiens
tctagttttcagtt

SEQ ID NO: 5521965 - DNA, 17 bp, Homo sapiens
tctagttttcagtttgt

SEQ ID NO: 5521966 - DNA, 14 bp, Homo sapiens
tctagttttctaga

SEQ ID NO: 5521967 - DNA, 15 bp, Homo sapiens
tctataaaaaatatg

SEQ ID NO: 5521968 - DNA, 18 bp, Homo sapiens
tctataaaactttctgta

SEQ ID NO: 5521969 - DNA, 13 bp, Homo sapiens
tctataaaataaa

SEQ ID NO: 5521970 - DNA, 17 bp, Homo sapiens
tctataaaataaacttc

SEQ ID NO: 5521971 - DNA, 18 bp, Homo sapiens
tctataaaataaacttct

SEQ ID NO: 5521972 - DNA, 19 bp, Homo sapiens
tctataaaataaacttctt

SEQ ID NO: 5521973 - DNA, 15 bp, Homo sapiens
tctataaacatgaag

SEQ ID NO: 5521974 - DNA, 14 bp, Homo sapiens
tctataaagaaact

SEQ ID NO: 5521975 - DNA, 18 bp, Homo sapiens
tctataaagaaacttttg

SEQ ID NO: 5521976 - DNA, 15 bp, Homo sapiens
tctataaagaaggat

SEQ ID NO: 5521977 - DNA, 14 bp, Homo sapiens
tctataaagcattt

SEQ ID NO: 5521978 - DNA, 16 bp, Homo sapiens
tctataaagcatttaa

SEQ ID NO: 5521979 - DNA, 20 bp, Homo sapiens
tctataaagcgatatacaga

SEQ ID NO: 5521980 - DNA, 22 bp, Homo sapiens
tctataaagcgatatacagatg

SEQ ID NO: 5521981 - DNA, 20 bp, Homo sapiens
tctataaagtgaacagattt

SEQ ID NO: 5521982 - DNA, 13 bp, Homo sapiens
tctataaataacc

SEQ ID NO: 5521983 - DNA, 13 bp, Homo sapiens
tctataaatcagt

SEQ ID NO: 5521984 - DNA, 16 bp, Homo sapiens
tctataaatcagtatt

SEQ ID NO: 5521985 - DNA, 13 bp, Homo sapiens
tctataaatgact

SEQ ID NO: 5521986 - DNA, 17 bp, Homo sapiens
tctataaatgactattg

SEQ ID NO: 5521987 - DNA, 20 bp, Homo sapiens
tctataaatgactattgtaa

SEQ ID NO: 5521988 - DNA, 14 bp, Homo sapiens
tctataaattgtag

SEQ ID NO: 5521989 - DNA, 15 bp, Homo sapiens
tctattttaaaataa

SEQ ID NO: 5521990 - DNA, 23 bp, Homo sapiens
tctattttaatgtatatttgctg

SEQ ID NO: 5521991 - DNA, 21 bp, Homo sapiens
tctattttacttttctgccaa

SEQ ID NO: 5521992 - DNA, 19 bp, Homo sapiens
tctattttataagggcact

SEQ ID NO: 5521993 - DNA, 18 bp, Homo sapiens
tctattttattatgaaga

SEQ ID NO: 5521994 - DNA, 19 bp, Homo sapiens
tctattttattatgagctt

SEQ ID NO: 5521995 - DNA, 14 bp, Homo sapiens
tctattttcataat

SEQ ID NO: 5521996 - DNA, 16 bp, Homo sapiens
tctattttcattttct

SEQ ID NO: 5521997 - DNA, 11 bp, Homo sapiens
tctattttcta

SEQ ID NO: 5521998 - DNA, 15 bp, Homo sapiens
tctattttctatgta

SEQ ID NO: 5521999 - DNA, 18 bp, Homo sapiens
tctattttctatgtacta

SEQ ID NO: 5522000 - DNA, 19 bp, Homo sapiens
tctattttctctgatactt

SEQ ID NO: 5522001 - DNA, 20 bp, Homo sapiens
tctattttctctgatacttt

SEQ ID NO: 5522002 - DNA, 14 bp, Homo sapiens
tctattttcttaaa

SEQ ID NO: 5522003 - DNA, 15 bp, Homo sapiens
tctattttgatgcag

SEQ ID NO: 5522004 - DNA, 20 bp, Homo sapiens
tctattttgatgcagcattt

SEQ ID NO: 5522005 - DNA, 23 bp, Homo sapiens
tctattttgatgcagcatttgat

SEQ ID NO: 5522006 - DNA, 15 bp, Homo sapiens
tctattttgcagata

SEQ ID NO: 5522007 - DNA, 18 bp, Homo sapiens
tctattttggattgtata

SEQ ID NO: 5522008 - DNA, 22 bp, Homo sapiens
tctattttggtgaccaatacta

SEQ ID NO: 5522009 - DNA, 15 bp, Homo sapiens
tctattttgtatatt

SEQ ID NO: 5522010 - DNA, 16 bp, Homo sapiens
tctattttgtctgata

SEQ ID NO: 5522011 - DNA, 17 bp, Homo sapiens
tctattttgtgatgatg

SEQ ID NO: 5522012 - DNA, 19 bp, Homo sapiens
tctatttttaaaatcataa

SEQ ID NO: 5522013 - DNA, 22 bp, Homo sapiens
tctatttttaaaatcataacat

SEQ ID NO: 5522014 - DNA, 19 bp, Homo sapiens
tctatttttgcactggaat

SEQ ID NO: 5522015 - DNA, 15 bp, Homo sapiens
tctatttttggaggt

SEQ ID NO: 5522016 - DNA, 15 bp, Homo sapiens
tctatttttgtaaaa

SEQ ID NO: 5522017 - DNA, 15 bp, Homo sapiens
tctatttttgttaat

SEQ ID NO: 5522018 - DNA, 20 bp, Homo sapiens
tctatttttgtttacaaaca

SEQ ID NO: 5522019 - DNA, 16 bp, Homo sapiens
tctattttttactaca

SEQ ID NO: 5522020 - DNA, 19 bp, Homo sapiens
tctattttttctgaggaat

SEQ ID NO: 5522021 - DNA, 20 bp, Homo sapiens
tctattttttgaaaagcaga

SEQ ID NO: 5522022 - DNA, 20 bp, Homo sapiens
tctatttttttaactgaaaa

SEQ ID NO: 5522023 - DNA, 22 bp, Homo sapiens
tctcaaaaaaaagaaaatgtct

SEQ ID NO: 5522024 - DNA, 21 bp, Homo sapiens
tctcaaaaagctgctatccaa

SEQ ID NO: 5522025 - DNA, 14 bp, Homo sapiens
tctcaaaaataaat

SEQ ID NO: 5522026 - DNA, 14 bp, Homo sapiens
tctcaaaacaaaac

SEQ ID NO: 5522027 - DNA, 12 bp, Homo sapiens
tctcaaaactga

SEQ ID NO: 5522028 - DNA, 14 bp, Homo sapiens
tctcaaaagagatt

SEQ ID NO: 5522029 - DNA, 14 bp, Homo sapiens
tctcaaaagaggtt

SEQ ID NO: 5522030 - DNA, 17 bp, Homo sapiens
tctcaaaagaggttact

SEQ ID NO: 5522031 - DNA, 22 bp, Homo sapiens
tctcaaaagaggttactttagt

SEQ ID NO: 5522032 - DNA, 21 bp, Homo sapiens
tctcaaaagcatttatcattc

SEQ ID NO: 5522033 - DNA, 22 bp, Homo sapiens
tctcaaaatacgtgttcaaaaa

SEQ ID NO: 5522034 - DNA, 14 bp, Homo sapiens
tctcaaaatgtgaa

SEQ ID NO: 5522035 - DNA, 21 bp, Homo sapiens
tctcaaaccctgtttacggta

SEQ ID NO: 5522036 - DNA, 16 bp, Homo sapiens
tctcaaacctccaaat

SEQ ID NO: 5522037 - DNA, 14 bp, Homo sapiens
tctcaaacctggca

SEQ ID NO: 5522038 - DNA, 23 bp, Homo sapiens
tctcaaacctgtttaaatatttc

SEQ ID NO: 5522039 - DNA, 21 bp, Homo sapiens
tctcaaactcctgacctcagg

SEQ ID NO: 5522040 - DNA, 19 bp, Homo sapiens
tctcaaagaaatttccact

SEQ ID NO: 5522041 - DNA, 21 bp, Homo sapiens
tctcaaagaaatttccactca

SEQ ID NO: 5522042 - DNA, 20 bp, Homo sapiens
tctcaaagatgcgtttgcct

SEQ ID NO: 5522043 - DNA, 23 bp, Homo sapiens
tctcaaagatgcgtttgcctcct

SEQ ID NO: 5522044 - DNA, 18 bp, Homo sapiens
tctcaaagcacaatgtgg

SEQ ID NO: 5522045 - DNA, 17 bp, Homo sapiens
tctcaaagcatcaaata

SEQ ID NO: 5522046 - DNA, 19 bp, Homo sapiens
tctcaaagccccattaact

SEQ ID NO: 5522047 - DNA, 22 bp, Homo sapiens
tctcaaagcctcttatttttct

SEQ ID NO: 5522048 - DNA, 13 bp, Homo sapiens
tctcaaagctggg

SEQ ID NO: 5522049 - DNA, 15 bp, Homo sapiens
tctcaaagctgggat

SEQ ID NO: 5522050 - DNA, 16 bp, Homo sapiens
tctcaaaggagcgagc

SEQ ID NO: 5522051 - DNA, 15 bp, Homo sapiens
tctcaaaggccctca

SEQ ID NO: 5522052 - DNA, 22 bp, Homo sapiens
tctcaaaggtaattctgaacca

SEQ ID NO: 5522053 - DNA, 23 bp, Homo sapiens
tctcaaagtataatctttctata

SEQ ID NO: 5522054 - DNA, 11 bp, Homo sapiens
tctcaaagtta

SEQ ID NO: 5522055 - DNA, 17 bp, Homo sapiens
tctcaaagttaattcac

SEQ ID NO: 5522056 - DNA, 19 bp, Homo sapiens
tctcaaagttttattataa

SEQ ID NO: 5522057 - DNA, 21 bp, Homo sapiens
tctcaaagtttttacagtgta

SEQ ID NO: 5522058 - DNA, 22 bp, Homo sapiens
tctcaaataggctattaaaaaa

SEQ ID NO: 5522059 - DNA, 14 bp, Homo sapiens
tctcaaatcaaata

SEQ ID NO: 5522060 - DNA, 16 bp, Homo sapiens
tctcaaatctgcttca

SEQ ID NO: 5522061 - DNA, 12 bp, Homo sapiens
tctcaaatgtgt

SEQ ID NO: 5522062 - DNA, 22 bp, Homo sapiens
tctcaaatgtgtgtggcagcca

SEQ ID NO: 5522063 - DNA, 18 bp, Homo sapiens
tctcaaatttttcatctc

SEQ ID NO: 5522064 - DNA, 23 bp, Homo sapiens
tctcaaatttttcatctcttcaa

SEQ ID NO: 5522065 - DNA, 19 bp, Homo sapiens
tctcaacaaagcacagtgt

SEQ ID NO: 5522066 - DNA, 21 bp, Homo sapiens
tctcaacaaagcacagtgtta

SEQ ID NO: 5522067 - DNA, 15 bp, Homo sapiens
tctcaacaacatgtc

SEQ ID NO: 5522068 - DNA, 13 bp, Homo sapiens
tctcaacacacag

SEQ ID NO: 5522069 - DNA, 14 bp, Homo sapiens
tctcaacacccagt

SEQ ID NO: 5522070 - DNA, 23 bp, Homo sapiens
tctcaacacccagtttccttggg

SEQ ID NO: 5522071 - DNA, 23 bp, Homo sapiens
tctcaacagaattaaaatgtcta

SEQ ID NO: 5522072 - DNA, 18 bp, Homo sapiens
tctcaacaggcctcaggg

SEQ ID NO: 5522073 - DNA, 20 bp, Homo sapiens
tctcaacaggcctcagggct

SEQ ID NO: 5522074 - DNA, 15 bp, Homo sapiens
tctcaacatactgta

SEQ ID NO: 5522075 - DNA, 20 bp, Homo sapiens
tctcaacatactgtaatcaa

SEQ ID NO: 5522076 - DNA, 18 bp, Homo sapiens
tctcaacatgtctcctac

SEQ ID NO: 5522077 - DNA, 15 bp, Homo sapiens
tctcaacatgtgttt

SEQ ID NO: 5522078 - DNA, 23 bp, Homo sapiens
tctcaaccacctaggcaatgaag

SEQ ID NO: 5522079 - DNA, 17 bp, Homo sapiens
tctcaaccacctttcag

SEQ ID NO: 5522080 - DNA, 21 bp, Homo sapiens
tctcaacccttttgtctgcct

SEQ ID NO: 5522081 - DNA, 23 bp, Homo sapiens
tctcaacccttttgtctgcctct

SEQ ID NO: 5522082 - DNA, 12 bp, Homo sapiens
tctcaaccttgt

SEQ ID NO: 5522083 - DNA, 16 bp, Homo sapiens
tctcaacgcctctcct

SEQ ID NO: 5522084 - DNA, 21 bp, Homo sapiens
tctcaactaaagaatagtgcc

SEQ ID NO: 5522085 - DNA, 19 bp, Homo sapiens
tctcaacttttttcccttg

SEQ ID NO: 5522086 - DNA, 21 bp, Homo sapiens
tctcaagaaagccctcatttt

SEQ ID NO: 5522087 - DNA, 16 bp, Homo sapiens
tctcaagaactgccat

SEQ ID NO: 5522088 - DNA, 12 bp, Homo sapiens
tctcaagaatct

SEQ ID NO: 5522089 - DNA, 15 bp, Homo sapiens
tctcaagaatctaga

SEQ ID NO: 5522090 - DNA, 19 bp, Homo sapiens
tctcaagaatctagaagat

SEQ ID NO: 5522091 - DNA, 12 bp, Homo sapiens
tctcaagacttt

SEQ ID NO: 5522092 - DNA, 22 bp, Homo sapiens
tctcaagactttagcttttcct

SEQ ID NO: 5522093 - DNA, 18 bp, Homo sapiens
tctcaagagggcactggt

SEQ ID NO: 5522094 - DNA, 15 bp, Homo sapiens
tctcaagcaagtttc

SEQ ID NO: 5522095 - DNA, 15 bp, Homo sapiens
tctcaagcactgaca

SEQ ID NO: 5522096 - DNA, 22 bp, Homo sapiens
tctcaagccagccccctccagc

SEQ ID NO: 5522097 - DNA, 13 bp, Homo sapiens
tctcaagccctgc

SEQ ID NO: 5522098 - DNA, 22 bp, Homo sapiens
tctcaagcgctatccacagaac

SEQ ID NO: 5522099 - DNA, 20 bp, Homo sapiens
tctcaagctagtgtttctag

SEQ ID NO: 5522100 - DNA, 15 bp, Homo sapiens
tctcaaggagaggca

SEQ ID NO: 5522101 - DNA, 15 bp, Homo sapiens
tctcaaggcttggag

SEQ ID NO: 5522102 - DNA, 23 bp, Homo sapiens
tctcaagggctagcatccctgag

SEQ ID NO: 5522103 - DNA, 23 bp, Homo sapiens
tctcaagggtaccaatcctggca

SEQ ID NO: 5522104 - DNA, 16 bp, Homo sapiens
tctcaaggttctcatt

SEQ ID NO: 5522105 - DNA, 15 bp, Homo sapiens
tctcaagtaaaacaa

SEQ ID NO: 5522106 - DNA, 22 bp, Homo sapiens
tctcaagtaaaacaaatgaaat

SEQ ID NO: 5522107 - DNA, 15 bp, Homo sapiens
tctcaagtagctggg

SEQ ID NO: 5522108 - DNA, 18 bp, Homo sapiens
tctcaagtgaaagacttg

SEQ ID NO: 5522109 - DNA, 17 bp, Homo sapiens
tctcaagttctaagatt

SEQ ID NO: 5522110 - DNA, 23 bp, Homo sapiens
tctcaataaaattatagctctaa

SEQ ID NO: 5522111 - DNA, 15 bp, Homo sapiens
tctcaatacagcctg

SEQ ID NO: 5522112 - DNA, 23 bp, Homo sapiens
tctcaatacttgaatatggaaca

SEQ ID NO: 5522113 - DNA, 19 bp, Homo sapiens
tctcaatagctccaagctg

SEQ ID NO: 5522114 - DNA, 21 bp, Homo sapiens
tctcaatatataataaatggg

SEQ ID NO: 5522115 - DNA, 20 bp, Homo sapiens
tctcaatattcaataaagct

SEQ ID NO: 5522116 - DNA, 14 bp, Homo sapiens
tctcaatcagtgca

SEQ ID NO: 5522117 - DNA, 19 bp, Homo sapiens
tctcaatcattgtcagaga

SEQ ID NO: 5522118 - DNA, 22 bp, Homo sapiens
tctcaatcctaatttctcctcc

SEQ ID NO: 5522119 - DNA, 23 bp, Homo sapiens
tctcaatctgcagccattcttca

SEQ ID NO: 5522120 - DNA, 16 bp, Homo sapiens
tctcaatgaagccagc

SEQ ID NO: 5522121 - DNA, 13 bp, Homo sapiens
tctcaatgctcat

SEQ ID NO: 5522122 - DNA, 22 bp, Homo sapiens
tctcaatggaaacatcactggg

SEQ ID NO: 5522123 - DNA, 23 bp, Homo sapiens
tctcaatggtgctataataaata

SEQ ID NO: 5522124 - DNA, 23 bp, Homo sapiens
tctcaatgtcttcccacaaatgg

SEQ ID NO: 5522125 - DNA, 12 bp, Homo sapiens
tctcaatgtgaa

SEQ ID NO: 5522126 - DNA, 15 bp, Homo sapiens
tctcaatgttccatt

SEQ ID NO: 5522127 - DNA, 16 bp, Homo sapiens
tctcaattccaacagt

SEQ ID NO: 5522128 - DNA, 23 bp, Homo sapiens
tctcaattctgaaggggaaaacc

SEQ ID NO: 5522129 - DNA, 12 bp, Homo sapiens
tctcaattctgt

SEQ ID NO: 5522130 - DNA, 17 bp, Homo sapiens
tctcaattgaaagcttt

SEQ ID NO: 5522131 - DNA, 14 bp, Homo sapiens
tctcaattgagtta

SEQ ID NO: 5522132 - DNA, 21 bp, Homo sapiens
tctcaattgtatagttatatt

SEQ ID NO: 5522133 - DNA, 12 bp, Homo sapiens
tctcaatttcta

SEQ ID NO: 5522134 - DNA, 15 bp, Homo sapiens
tctcaatttgaaaca

SEQ ID NO: 5522135 - DNA, 13 bp, Homo sapiens
tctcaattttgta

SEQ ID NO: 5522136 - DNA, 11 bp, Homo sapiens
tctcacaaaaa

SEQ ID NO: 5522137 - DNA, 23 bp, Homo sapiens
tctcacaaaacatattttacatc

SEQ ID NO: 5522138 - DNA, 12 bp, Homo sapiens
tctcacaaacat

SEQ ID NO: 5522139 - DNA, 14 bp, Homo sapiens
tctcacaagccagc

SEQ ID NO: 5522140 - DNA, 20 bp, Homo sapiens
tctcacaatagacagaaaca

SEQ ID NO: 5522141 - DNA, 14 bp, Homo sapiens
tctcacaattgtaa

SEQ ID NO: 5522142 - DNA, 15 bp, Homo sapiens
tctcacacacataga

SEQ ID NO: 5522143 - DNA, 18 bp, Homo sapiens
tctcacacatcacattcc

SEQ ID NO: 5522144 - DNA, 16 bp, Homo sapiens
tctcacacatgagcat

SEQ ID NO: 5522145 - DNA, 15 bp, Homo sapiens
tctcacactggagga

SEQ ID NO: 5522146 - DNA, 21 bp, Homo sapiens
tctcacactggcgtagaagtt

SEQ ID NO: 5522147 - DNA, 12 bp, Homo sapiens
tctcacagacag

SEQ ID NO: 5522148 - DNA, 23 bp, Homo sapiens
tctcacagacaggacccctgcag

SEQ ID NO: 5522149 - DNA, 12 bp, Homo sapiens
tctcacagagaa

SEQ ID NO: 5522150 - DNA, 15 bp, Homo sapiens
tctcacagagaagct

SEQ ID NO: 5522151 - DNA, 21 bp, Homo sapiens
tctcacagctccaagaatttc

SEQ ID NO: 5522152 - DNA, 13 bp, Homo sapiens
tctcacagtgtgg

SEQ ID NO: 5522153 - DNA, 17 bp, Homo sapiens
tctcacatatacaagta

SEQ ID NO: 5522154 - DNA, 21 bp, Homo sapiens
tctcacatattcatcagcagg

SEQ ID NO: 5522155 - DNA, 19 bp, Homo sapiens
tctcacatccatctacttt

SEQ ID NO: 5522156 - DNA, 19 bp, Homo sapiens
tctcacatgattccagcca

SEQ ID NO: 5522157 - DNA, 22 bp, Homo sapiens
tctcacatggaatgagggtttg

SEQ ID NO: 5522158 - DNA, 23 bp, Homo sapiens
tctcacatggtgctacgcctgca

SEQ ID NO: 5522159 - DNA, 21 bp, Homo sapiens
tctcacatgtggcaaaatatg

SEQ ID NO: 5522160 - DNA, 19 bp, Homo sapiens
tctcacatgtggctccccc

SEQ ID NO: 5522161 - DNA, 22 bp, Homo sapiens
tctcacatgtggctccccctga

SEQ ID NO: 5522162 - DNA, 16 bp, Homo sapiens
tctcacattgctgtat

SEQ ID NO: 5522163 - DNA, 16 bp, Homo sapiens
tctcaccagcccgcca

SEQ ID NO: 5522164 - DNA, 12 bp, Homo sapiens
tctcaccagcct

SEQ ID NO: 5522165 - DNA, 13 bp, Homo sapiens
tctcaccagcctt

SEQ ID NO: 5522166 - DNA, 18 bp, Homo sapiens
tctcaccagctcagcccc

SEQ ID NO: 5522167 - DNA, 23 bp, Homo sapiens
tctcaccagctcagccccggcca

SEQ ID NO: 5522168 - DNA, 14 bp, Homo sapiens
tctcaccagctgca

SEQ ID NO: 5522169 - DNA, 18 bp, Homo sapiens
tctcaccagctgcaaagt

SEQ ID NO: 5522170 - DNA, 19 bp, Homo sapiens
tctcaccagctgcaaagtg

SEQ ID NO: 5522171 - DNA, 20 bp, Homo sapiens
tctcaccagctgcaaagtgt

SEQ ID NO: 5522172 - DNA, 17 bp, Homo sapiens
tctcaccagctgctgct

SEQ ID NO: 5522173 - DNA, 16 bp, Homo sapiens
tctcaccaggcagcct

SEQ ID NO: 5522174 - DNA, 17 bp, Homo sapiens
tctcaccaggcagcctc

SEQ ID NO: 5522175 - DNA, 18 bp, Homo sapiens
tctcaccaggcagcctct

SEQ ID NO: 5522176 - DNA, 21 bp, Homo sapiens
tctcaccaggcagcctctggg

SEQ ID NO: 5522177 - DNA, 21 bp, Homo sapiens
tctcaccatttccccagggca

SEQ ID NO: 5522178 - DNA, 15 bp, Homo sapiens
tctcacccaccagct

SEQ ID NO: 5522179 - DNA, 17 bp, Homo sapiens
tctcacccaccagctcc

SEQ ID NO: 5522180 - DNA, 14 bp, Homo sapiens
tctcacccagcctg

SEQ ID NO: 5522181 - DNA, 14 bp, Homo sapiens
tctcacccaggcaa

SEQ ID NO: 5522182 - DNA, 15 bp, Homo sapiens
tctcacccaggcaat

SEQ ID NO: 5522183 - DNA, 15 bp, Homo sapiens
tctcacccataataa

SEQ ID NO: 5522184 - DNA, 13 bp, Homo sapiens
tctcaccccaagc

SEQ ID NO: 5522185 - DNA, 13 bp, Homo sapiens
tctcaccccactc

SEQ ID NO: 5522186 - DNA, 18 bp, Homo sapiens
tctcaccccactcctgtc

SEQ ID NO: 5522187 - DNA, 13 bp, Homo sapiens
tctcaccccagga

SEQ ID NO: 5522188 - DNA, 15 bp, Homo sapiens
tctcaccccatccca

SEQ ID NO: 5522189 - DNA, 19 bp, Homo sapiens
tctcaccccatcccacacc

SEQ ID NO: 5522190 - DNA, 16 bp, Homo sapiens
tctcaccccccgacct

SEQ ID NO: 5522191 - DNA, 12 bp, Homo sapiens
tctcaccctctg

SEQ ID NO: 5522192 - DNA, 13 bp, Homo sapiens
tctcaccctggag

SEQ ID NO: 5522193 - DNA, 14 bp, Homo sapiens
tctcaccctggagg

SEQ ID NO: 5522194 - DNA, 16 bp, Homo sapiens
tctcaccctggaggca

SEQ ID NO: 5522195 - DNA, 14 bp, Homo sapiens
tctcaccctgtgaa

SEQ ID NO: 5522196 - DNA, 21 bp, Homo sapiens
tctcacctaaaccctctgtga

SEQ ID NO: 5522197 - DNA, 16 bp, Homo sapiens
tctcacctagctgctc

SEQ ID NO: 5522198 - DNA, 15 bp, Homo sapiens
tctcacctcctgctg

SEQ ID NO: 5522199 - DNA, 19 bp, Homo sapiens
tctcacctcctgctgggca

SEQ ID NO: 5522200 - DNA, 18 bp, Homo sapiens
tctcacctctaggcctca

SEQ ID NO: 5522201 - DNA, 14 bp, Homo sapiens
tctcacctctgtgc

SEQ ID NO: 5522202 - DNA, 22 bp, Homo sapiens
tctcacctgaattcgagacagg

SEQ ID NO: 5522203 - DNA, 18 bp, Homo sapiens
tctcacctgccggctctg

SEQ ID NO: 5522204 - DNA, 20 bp, Homo sapiens
tctcacctgccggctctggg

SEQ ID NO: 5522205 - DNA, 21 bp, Homo sapiens
tctcacctgccggctctgggc

SEQ ID NO: 5522206 - DNA, 23 bp, Homo sapiens
tctcacctggaggcaagagggag

SEQ ID NO: 5522207 - DNA, 14 bp, Homo sapiens
tctcacctggccct

SEQ ID NO: 5522208 - DNA, 16 bp, Homo sapiens
tctcaccttccaaatc

SEQ ID NO: 5522209 - DNA, 17 bp, Homo sapiens
tctcaccttcgcctttg

SEQ ID NO: 5522210 - DNA, 20 bp, Homo sapiens
tctcaccttcgcctttgctg

SEQ ID NO: 5522211 - DNA, 17 bp, Homo sapiens
tctcaccttggttcctg

SEQ ID NO: 5522212 - DNA, 20 bp, Homo sapiens
tctcacgaaagtatttactt

SEQ ID NO: 5522213 - DNA, 14 bp, Homo sapiens
tctcacgctgccat

SEQ ID NO: 5522214 - DNA, 13 bp, Homo sapiens
tctcacgctttgt

SEQ ID NO: 5522215 - DNA, 18 bp, Homo sapiens
tctcacgctttgtttact

SEQ ID NO: 5522216 - DNA, 22 bp, Homo sapiens
tctcacggccacacagctgccg

SEQ ID NO: 5522217 - DNA, 21 bp, Homo sapiens
tctcacgggcatgggcactcc

SEQ ID NO: 5522218 - DNA, 23 bp, Homo sapiens
tctcacgggcatgggcactccct

SEQ ID NO: 5522219 - DNA, 15 bp, Homo sapiens
tctcacgggccctgc

SEQ ID NO: 5522220 - DNA, 17 bp, Homo sapiens
tctcactaaactttacc

SEQ ID NO: 5522221 - DNA, 23 bp, Homo sapiens
tctcactaaagcatgaaatgtga

SEQ ID NO: 5522222 - DNA, 19 bp, Homo sapiens
tctcactacttgaccattc

SEQ ID NO: 5522223 - DNA, 16 bp, Homo sapiens
tctcactagctgtctc

SEQ ID NO: 5522224 - DNA, 20 bp, Homo sapiens
tctcactagctgtctcagga

SEQ ID NO: 5522225 - DNA, 21 bp, Homo sapiens
tctcactaggctaaactcaag

SEQ ID NO: 5522226 - DNA, 19 bp, Homo sapiens
tctcactagttgtcagctt

SEQ ID NO: 5522227 - DNA, 20 bp, Homo sapiens
tctcactatatatatttcta

SEQ ID NO: 5522228 - DNA, 21 bp, Homo sapiens
tctcactatattgctcaggct

SEQ ID NO: 5522229 - DNA, 16 bp, Homo sapiens
tctcactatgctgcta

SEQ ID NO: 5522230 - DNA, 16 bp, Homo sapiens
tctcactatgttgccc

SEQ ID NO: 5522231 - DNA, 15 bp, Homo sapiens
tctcactatgtttct

SEQ ID NO: 5522232 - DNA, 19 bp, Homo sapiens
tctcactatgtttctcaga

SEQ ID NO: 5522233 - DNA, 21 bp, Homo sapiens
tctcactcagccgcagacaag

SEQ ID NO: 5522234 - DNA, 12 bp, Homo sapiens
tctcactccacc

SEQ ID NO: 5522235 - DNA, 18 bp, Homo sapiens
tctcactccaccacccaa

SEQ ID NO: 5522236 - DNA, 16 bp, Homo sapiens
tctcactccacccaga

SEQ ID NO: 5522237 - DNA, 21 bp, Homo sapiens
tctcactccacccagagtaga

SEQ ID NO: 5522238 - DNA, 17 bp, Homo sapiens
tctcactccagccaaag

SEQ ID NO: 5522239 - DNA, 12 bp, Homo sapiens
tctcactcccca

SEQ ID NO: 5522240 - DNA, 13 bp, Homo sapiens
tctcactccccat

SEQ ID NO: 5522241 - DNA, 12 bp, Homo sapiens
tctcactcccct

SEQ ID NO: 5522242 - DNA, 13 bp, Homo sapiens
tctcactcccctc

SEQ ID NO: 5522243 - DNA, 22 bp, Homo sapiens
tctcactcccctctcctcccct

SEQ ID NO: 5522244 - DNA, 17 bp, Homo sapiens
tctcactcctacctggt

SEQ ID NO: 5522245 - DNA, 14 bp, Homo sapiens
tctcactcctagga

SEQ ID NO: 5522246 - DNA, 15 bp, Homo sapiens
tctcactcctaggag

SEQ ID NO: 5522247 - DNA, 11 bp, Homo sapiens
tctcactcctt

SEQ ID NO: 5522248 - DNA, 23 bp, Homo sapiens
tctcactccttttggtgtgttgg

SEQ ID NO: 5522249 - DNA, 20 bp, Homo sapiens
tctcactctaggagttcagt

SEQ ID NO: 5522250 - DNA, 21 bp, Homo sapiens
tctcactctcgtcgcccaggc

SEQ ID NO: 5522251 - DNA, 14 bp, Homo sapiens
tctcactctctggg

SEQ ID NO: 5522252 - DNA, 19 bp, Homo sapiens
tctcactctcttcctttca

SEQ ID NO: 5522253 - DNA, 23 bp, Homo sapiens
tctcactctgcccccccccccca

SEQ ID NO: 5522254 - DNA, 15 bp, Homo sapiens
tctcactctgctttg

SEQ ID NO: 5522255 - DNA, 14 bp, Homo sapiens
tctcactctggcag

SEQ ID NO: 5522256 - DNA, 12 bp, Homo sapiens
tctcactctgtc

SEQ ID NO: 5522257 - DNA, 16 bp, Homo sapiens
tctcactctgtcgccc

SEQ ID NO: 5522258 - DNA, 23 bp, Homo sapiens
tctcactctgtcgcccagtctgg

SEQ ID NO: 5522259 - DNA, 12 bp, Homo sapiens
tctcactctgtt

SEQ ID NO: 5522260 - DNA, 23 bp, Homo sapiens
tctcactctgttgaccaggctgg

SEQ ID NO: 5522261 - DNA, 15 bp, Homo sapiens
tctcactctgttgcc

SEQ ID NO: 5522262 - DNA, 14 bp, Homo sapiens
tctcactgaactcc

SEQ ID NO: 5522263 - DNA, 22 bp, Homo sapiens
tctcactgagaagattgtgaat

SEQ ID NO: 5522264 - DNA, 11 bp, Homo sapiens
tctcactgagc

SEQ ID NO: 5522265 - DNA, 15 bp, Homo sapiens
tctcactgcctttgt

SEQ ID NO: 5522266 - DNA, 19 bp, Homo sapiens
tctcactgctttaggattg

SEQ ID NO: 5522267 - DNA, 15 bp, Homo sapiens
tctcactgtctgctg

SEQ ID NO: 5522268 - DNA, 21 bp, Homo sapiens
tctcactgtctgctggcaaag

SEQ ID NO: 5522269 - DNA, 20 bp, Homo sapiens
tctcactgtgggaaggccag

SEQ ID NO: 5522270 - DNA, 14 bp, Homo sapiens
tctcactgtgtccc

SEQ ID NO: 5522271 - DNA, 21 bp, Homo sapiens
tctcactgtgtccctctctct

SEQ ID NO: 5522272 - DNA, 14 bp, Homo sapiens
tctcactgttccct

SEQ ID NO: 5522273 - DNA, 16 bp, Homo sapiens
tctcactgttccctct

SEQ ID NO: 5522274 - DNA, 21 bp, Homo sapiens
tctcactgttccctctgctcc

SEQ ID NO: 5522275 - DNA, 22 bp, Homo sapiens
tctcactgttccctctgctcct

SEQ ID NO: 5522276 - DNA, 17 bp, Homo sapiens
tctcactgttctgcaaa

SEQ ID NO: 5522277 - DNA, 20 bp, Homo sapiens
tctcacttcagttgtggcct

SEQ ID NO: 5522278 - DNA, 13 bp, Homo sapiens
tctcacttgtttc

SEQ ID NO: 5522279 - DNA, 21 bp, Homo sapiens
tctcactttaataataaaaat

SEQ ID NO: 5522280 - DNA, 14 bp, Homo sapiens
tctcactttgtaaa

SEQ ID NO: 5522281 - DNA, 17 bp, Homo sapiens
tctcactttgtaaataa

SEQ ID NO: 5522282 - DNA, 15 bp, Homo sapiens
tctcacttttcatct

SEQ ID NO: 5522283 - DNA, 15 bp, Homo sapiens
tctcacttttctcca

SEQ ID NO: 5522284 - DNA, 12 bp, Homo sapiens
tctcagaaaact

SEQ ID NO: 5522285 - DNA, 17 bp, Homo sapiens
tctcagaaagtgcctga

SEQ ID NO: 5522286 - DNA, 19 bp, Homo sapiens
tctcagaaagtgcctgaca

SEQ ID NO: 5522287 - DNA, 13 bp, Homo sapiens
tctcagaaataaa

SEQ ID NO: 5522288 - DNA, 21 bp, Homo sapiens
tctcagaacaccaagtaaatc

SEQ ID NO: 5522289 - DNA, 16 bp, Homo sapiens
tctcagaacatactga

SEQ ID NO: 5522290 - DNA, 20 bp, Homo sapiens
tctcagaaccttgtcccagc

SEQ ID NO: 5522291 - DNA, 14 bp, Homo sapiens
tctcagaactcctg

SEQ ID NO: 5522292 - DNA, 21 bp, Homo sapiens
tctcagaactgttggctgctc

SEQ ID NO: 5522293 - DNA, 15 bp, Homo sapiens
tctcagaagcacaga

SEQ ID NO: 5522294 - DNA, 20 bp, Homo sapiens
tctcagaaggcaaatgactt

SEQ ID NO: 5522295 - DNA, 14 bp, Homo sapiens
tctcagaagggagg

SEQ ID NO: 5522296 - DNA, 23 bp, Homo sapiens
tctcagaaggggatggtgttgtc

SEQ ID NO: 5522297 - DNA, 20 bp, Homo sapiens
tctcagaagtgaaaaagact

SEQ ID NO: 5522298 - DNA, 16 bp, Homo sapiens
tctcagaatccaaaga

SEQ ID NO: 5522299 - DNA, 17 bp, Homo sapiens
tctcagaatctattcag

SEQ ID NO: 5522300 - DNA, 17 bp, Homo sapiens
tctcagaatctcaaata

SEQ ID NO: 5522301 - DNA, 18 bp, Homo sapiens
tctcagaatgtcattttg

SEQ ID NO: 5522302 - DNA, 16 bp, Homo sapiens
tctcagacccagatgt

SEQ ID NO: 5522303 - DNA, 15 bp, Homo sapiens
tctcagaccctgctt

SEQ ID NO: 5522304 - DNA, 21 bp, Homo sapiens
tctcagaccctgcttaggatg

SEQ ID NO: 5522305 - DNA, 17 bp, Homo sapiens
tctcagaccctttagcc

SEQ ID NO: 5522306 - DNA, 20 bp, Homo sapiens
tctcagaccttacacaccat

SEQ ID NO: 5522307 - DNA, 13 bp, Homo sapiens
tctcagaccttta

SEQ ID NO: 5522308 - DNA, 16 bp, Homo sapiens
tctcagacctttactg

SEQ ID NO: 5522309 - DNA, 21 bp, Homo sapiens
tctcagacctttactgatact

SEQ ID NO: 5522310 - DNA, 15 bp, Homo sapiens
tctcagacgacacct

SEQ ID NO: 5522311 - DNA, 14 bp, Homo sapiens
tctcagactcacca

SEQ ID NO: 5522312 - DNA, 21 bp, Homo sapiens
tctcagactctaaacacacaa

SEQ ID NO: 5522313 - DNA, 21 bp, Homo sapiens
tctcagactttggaaaatgca

SEQ ID NO: 5522314 - DNA, 22 bp, Homo sapiens
tctcagactttggaaaatgcat

SEQ ID NO: 5522315 - DNA, 11 bp, Homo sapiens
tctcagagaca

SEQ ID NO: 5522316 - DNA, 20 bp, Homo sapiens
tctcagagacaggtggccta

SEQ ID NO: 5522317 - DNA, 21 bp, Homo sapiens
tctcagagacaggtggcctag

SEQ ID NO: 5522318 - DNA, 13 bp, Homo sapiens
tctcagagattct

SEQ ID NO: 5522319 - DNA, 14 bp, Homo sapiens
tctcagagcaagcc

SEQ ID NO: 5522320 - DNA, 11 bp, Homo sapiens
tctcagagcac

SEQ ID NO: 5522321 - DNA, 12 bp, Homo sapiens
tctcagagcagc

SEQ ID NO: 5522322 - DNA, 18 bp, Homo sapiens
tctcagagcatctggctg

SEQ ID NO: 5522323 - DNA, 11 bp, Homo sapiens
tctcagagcct

SEQ ID NO: 5522324 - DNA, 14 bp, Homo sapiens
tctcagagcctcag

SEQ ID NO: 5522325 - DNA, 15 bp, Homo sapiens
tctcagagcctcagc

SEQ ID NO: 5522326 - DNA, 12 bp, Homo sapiens
tctcagagcctt

SEQ ID NO: 5522327 - DNA, 22 bp, Homo sapiens
tctcagagccttccatgacctc

SEQ ID NO: 5522328 - DNA, 17 bp, Homo sapiens
tctcagagctccacaga

SEQ ID NO: 5522329 - DNA, 18 bp, Homo sapiens
tctcagagctccacagaa

SEQ ID NO: 5522330 - DNA, 20 bp, Homo sapiens
tctcagaggcctgctgccag

SEQ ID NO: 5522331 - DNA, 14 bp, Homo sapiens
tctcagaggggcca

SEQ ID NO: 5522332 - DNA, 18 bp, Homo sapiens
tctcagagtccactgtgg

SEQ ID NO: 5522333 - DNA, 19 bp, Homo sapiens
tctcagagtccactgtggc

SEQ ID NO: 5522334 - DNA, 14 bp, Homo sapiens
tctcagatatttat

SEQ ID NO: 5522335 - DNA, 20 bp, Homo sapiens
tctcagatatttatattttt

SEQ ID NO: 5522336 - DNA, 23 bp, Homo sapiens
tctcagatatttatatttttatt

SEQ ID NO: 5522337 - DNA, 16 bp, Homo sapiens
tctcagatccctcggt

SEQ ID NO: 5522338 - DNA, 17 bp, Homo sapiens
tctcagatccttgtttc

SEQ ID NO: 5522339 - DNA, 18 bp, Homo sapiens
tctcagatccttgtttca

SEQ ID NO: 5522340 - DNA, 17 bp, Homo sapiens
tctcagatcttgacagt

SEQ ID NO: 5522341 - DNA, 15 bp, Homo sapiens
tctcagatgcagttt

SEQ ID NO: 5522342 - DNA, 23 bp, Homo sapiens
tctcagatggtgtgtccagcact

SEQ ID NO: 5522343 - DNA, 18 bp, Homo sapiens
tctcagatgttaaaataa

SEQ ID NO: 5522344 - DNA, 19 bp, Homo sapiens
tctccacccaccagtcagg

SEQ ID NO: 5522345 - DNA, 14 bp, Homo sapiens
tctccacccacctt

SEQ ID NO: 5522346 - DNA, 12 bp, Homo sapiens
tctccacccaga

SEQ ID NO: 5522347 - DNA, 16 bp, Homo sapiens
tctccacccagaggtc

SEQ ID NO: 5522348 - DNA, 18 bp, Homo sapiens
tctccaccccccacgtct

SEQ ID NO: 5522349 - DNA, 23 bp, Homo sapiens
tctccaccccccacgtctgtcct

SEQ ID NO: 5522350 - DNA, 14 bp, Homo sapiens
tctccacccctaca

SEQ ID NO: 5522351 - DNA, 13 bp, Homo sapiens
tctccacccctca

SEQ ID NO: 5522352 - DNA, 14 bp, Homo sapiens
tctccacccctcaa

SEQ ID NO: 5522353 - DNA, 16 bp, Homo sapiens
tctccacccctcaagc

SEQ ID NO: 5522354 - DNA, 17 bp, Homo sapiens
tctccacccctcaagcc

SEQ ID NO: 5522355 - DNA, 20 bp, Homo sapiens
tctccacccctcaagccagg

SEQ ID NO: 5522356 - DNA, 21 bp, Homo sapiens
tctccacccctcaagccagga

SEQ ID NO: 5522357 - DNA, 22 bp, Homo sapiens
tctccacccctcaagccaggag

SEQ ID NO: 5522358 - DNA, 19 bp, Homo sapiens
tctccacccgctctggccc

SEQ ID NO: 5522359 - DNA, 13 bp, Homo sapiens
tctccaccctcct

SEQ ID NO: 5522360 - DNA, 18 bp, Homo sapiens
tctccaccctgagcctga

SEQ ID NO: 5522361 - DNA, 16 bp, Homo sapiens
tctccaccctgctctc

SEQ ID NO: 5522362 - DNA, 15 bp, Homo sapiens
tctccacctagtggc

SEQ ID NO: 5522363 - DNA, 16 bp, Homo sapiens
tctccacctagtggct

SEQ ID NO: 5522364 - DNA, 21 bp, Homo sapiens
tctccacctagtggctgtcca

SEQ ID NO: 5522365 - DNA, 11 bp, Homo sapiens
tctccacctca

SEQ ID NO: 5522366 - DNA, 16 bp, Homo sapiens
tctccacctcagcctt

SEQ ID NO: 5522367 - DNA, 19 bp, Homo sapiens
tctccacctcagccttgga

SEQ ID NO: 5522368 - DNA, 14 bp, Homo sapiens
tctccacctcaggg

SEQ ID NO: 5522369 - DNA, 12 bp, Homo sapiens
tctccacctgca

SEQ ID NO: 5522370 - DNA, 16 bp, Homo sapiens
tctccacctgcacatt

SEQ ID NO: 5522371 - DNA, 15 bp, Homo sapiens
tctccaccttccaaa

SEQ ID NO: 5522372 - DNA, 13 bp, Homo sapiens
tctccacgtcttt

SEQ ID NO: 5522373 - DNA, 15 bp, Homo sapiens
tctccacgtctttcc

SEQ ID NO: 5522374 - DNA, 14 bp, Homo sapiens
tctccactaccccg

SEQ ID NO: 5522375 - DNA, 13 bp, Homo sapiens
tctccactcactg

SEQ ID NO: 5522376 - DNA, 16 bp, Homo sapiens
tctccactcactgcat

SEQ ID NO: 5522377 - DNA, 13 bp, Homo sapiens
tctccactccaga

SEQ ID NO: 5522378 - DNA, 12 bp, Homo sapiens
tctccactccat

SEQ ID NO: 5522379 - DNA, 13 bp, Homo sapiens
tctccactgacct

SEQ ID NO: 5522380 - DNA, 18 bp, Homo sapiens
tctccactgaggatgtga

SEQ ID NO: 5522381 - DNA, 19 bp, Homo sapiens
tctccactgctctcagcct

SEQ ID NO: 5522382 - DNA, 14 bp, Homo sapiens
tctccactggaccc

SEQ ID NO: 5522383 - DNA, 24 bp, Homo sapiens
tctccactgtcataatctctttcc

SEQ ID NO: 5522384 - DNA, 19 bp, Homo sapiens
tctccactgtgcacaccca

SEQ ID NO: 5522385 - DNA, 19 bp, Homo sapiens
tctccactgtgcctttgca

SEQ ID NO: 5522386 - DNA, 21 bp, Homo sapiens
tctccactgtttcatgagccc

SEQ ID NO: 5522387 - DNA, 22 bp, Homo sapiens
tctccactgtttcatgagccca

SEQ ID NO: 5522388 - DNA, 21 bp, Homo sapiens
tctccacttcatttttaagaa

SEQ ID NO: 5522389 - DNA, 19 bp, Homo sapiens
tctccacttctggtcccct

SEQ ID NO: 5522390 - DNA, 20 bp, Homo sapiens
tctccacttctggtcccctg

SEQ ID NO: 5522391 - DNA, 15 bp, Homo sapiens
tctccacttcttaga

SEQ ID NO: 5522392 - DNA, 13 bp, Homo sapiens
tctccacttgtat

SEQ ID NO: 5522393 - DNA, 17 bp, Homo sapiens
tctccagaaacagctgc

SEQ ID NO: 5522394 - DNA, 21 bp, Homo sapiens
tctccagaaacagctgcttct

SEQ ID NO: 5522395 - DNA, 23 bp, Homo sapiens
tctccagaaacagctgcttctcc

SEQ ID NO: 5522396 - DNA, 11 bp, Homo sapiens
tctccagacat

SEQ ID NO: 5522397 - DNA, 19 bp, Homo sapiens
tctccagacccccacccct

SEQ ID NO: 5522398 - DNA, 20 bp, Homo sapiens
tctccagacccccacccctt

SEQ ID NO: 5522399 - DNA, 12 bp, Homo sapiens
tctccagactct

SEQ ID NO: 5522400 - DNA, 23 bp, Homo sapiens
tctccagagaacctttagaatat

SEQ ID NO: 5522401 - DNA, 17 bp, Homo sapiens
tctccagagagcaaaca

SEQ ID NO: 5522402 - DNA, 15 bp, Homo sapiens
tctccagagaggctc

SEQ ID NO: 5522403 - DNA, 17 bp, Homo sapiens
tctccagaggccaagga

SEQ ID NO: 5522404 - DNA, 14 bp, Homo sapiens
tctccagatagctg

SEQ ID NO: 5522405 - DNA, 18 bp, Homo sapiens
tctccagatggagaaaca

SEQ ID NO: 5522406 - DNA, 21 bp, Homo sapiens
tctccagatttttcggaggcc

SEQ ID NO: 5522407 - DNA, 14 bp, Homo sapiens
tctccagcagttag

SEQ ID NO: 5522408 - DNA, 13 bp, Homo sapiens
tctccagcatccc

SEQ ID NO: 5522409 - DNA, 15 bp, Homo sapiens
tctccagcatcccag

SEQ ID NO: 5522410 - DNA, 16 bp, Homo sapiens
tctccagcatcccagc

SEQ ID NO: 5522411 - DNA, 19 bp, Homo sapiens
tctccagcatcccagcctc

SEQ ID NO: 5522412 - DNA, 22 bp, Homo sapiens
tctccagcatcccagcctcaga

SEQ ID NO: 5522413 - DNA, 20 bp, Homo sapiens
tctccagccaatttcaaaga

SEQ ID NO: 5522414 - DNA, 23 bp, Homo sapiens
tctccagccaccaaggctgcctg

SEQ ID NO: 5522415 - DNA, 15 bp, Homo sapiens
tctccagccagcaat

SEQ ID NO: 5522416 - DNA, 16 bp, Homo sapiens
tctccagccagcaatg

SEQ ID NO: 5522417 - DNA, 22 bp, Homo sapiens
tctccagcccatgctggctggg

SEQ ID NO: 5522418 - DNA, 15 bp, Homo sapiens
tctccagcccctgga

SEQ ID NO: 5522419 - DNA, 23 bp, Homo sapiens
tctccagccccttctcagaatct

SEQ ID NO: 5522420 - DNA, 16 bp, Homo sapiens
tctccagcctcagcct

SEQ ID NO: 5522421 - DNA, 19 bp, Homo sapiens
tctccagcctcagcctccc

SEQ ID NO: 5522422 - DNA, 21 bp, Homo sapiens
tctccagcctgggaggcacag

SEQ ID NO: 5522423 - DNA, 23 bp, Homo sapiens
tctccagcctgggaggcacagca

SEQ ID NO: 5522424 - DNA, 14 bp, Homo sapiens
tctccagccttctc

SEQ ID NO: 5522425 - DNA, 20 bp, Homo sapiens
tctccagcggccctgtcatc

SEQ ID NO: 5522426 - DNA, 22 bp, Homo sapiens
tctccagctataacagtaggga

SEQ ID NO: 5522427 - DNA, 20 bp, Homo sapiens
tctccagctcagaacccagg

SEQ ID NO: 5522428 - DNA, 14 bp, Homo sapiens
tctccagctgacta

SEQ ID NO: 5522429 - DNA, 15 bp, Homo sapiens
tctccagctgactaa

SEQ ID NO: 5522430 - DNA, 14 bp, Homo sapiens
tctccagctgcctg

SEQ ID NO: 5522431 - DNA, 19 bp, Homo sapiens
tctccagctgcctgggccc

SEQ ID NO: 5522432 - DNA, 13 bp, Homo sapiens
tctccagctgctg

SEQ ID NO: 5522433 - DNA, 19 bp, Homo sapiens
tctccagctgggctctgca

SEQ ID NO: 5522434 - DNA, 18 bp, Homo sapiens
tctccaggaaggcggggc

SEQ ID NO: 5522435 - DNA, 19 bp, Homo sapiens
tctccaggatggtgcagga

SEQ ID NO: 5522436 - DNA, 19 bp, Homo sapiens
tctccaggattgaagagca

SEQ ID NO: 5522437 - DNA, 21 bp, Homo sapiens
tctccaggattttaatttcag

SEQ ID NO: 5522438 - DNA, 17 bp, Homo sapiens
tctccaggcaccatctc

SEQ ID NO: 5522439 - DNA, 19 bp, Homo sapiens
tctccaggcaccatctccc

SEQ ID NO: 5522440 - DNA, 23 bp, Homo sapiens
tctccaggcacccttctttcctc

SEQ ID NO: 5522441 - DNA, 18 bp, Homo sapiens
tctccaggcaccgcctgc

SEQ ID NO: 5522442 - DNA, 13 bp, Homo sapiens
tctccaggccagg

SEQ ID NO: 5522443 - DNA, 12 bp, Homo sapiens
tctccaggccca

SEQ ID NO: 5522444 - DNA, 14 bp, Homo sapiens
tctccaggcccagc

SEQ ID NO: 5522445 - DNA, 15 bp, Homo sapiens
tctccaggcccagcc

SEQ ID NO: 5522446 - DNA, 17 bp, Homo sapiens
tctccaggcccagcctg

SEQ ID NO: 5522447 - DNA, 21 bp, Homo sapiens
tctccaggcgacgcggttttt

SEQ ID NO: 5522448 - DNA, 11 bp, Homo sapiens
tctccaggctg

SEQ ID NO: 5522449 - DNA, 19 bp, Homo sapiens
tctccaggctgtttctttt

SEQ ID NO: 5522450 - DNA, 11 bp, Homo sapiens
tctccagggaa

SEQ ID NO: 5522451 - DNA, 14 bp, Homo sapiens
tctccagggaagcg

SEQ ID NO: 5522452 - DNA, 17 bp, Homo sapiens
tctccagggaattctta

SEQ ID NO: 5522453 - DNA, 23 bp, Homo sapiens
tctccagggagggtatttattgg

SEQ ID NO: 5522454 - DNA, 20 bp, Homo sapiens
tctccagggagtcccctccc

SEQ ID NO: 5522455 - DNA, 17 bp, Homo sapiens
tctccagggcccccacc

SEQ ID NO: 5522456 - DNA, 16 bp, Homo sapiens
tctccagggctgcccc

SEQ ID NO: 5522457 - DNA, 19 bp, Homo sapiens
tctccaggggcctgcagaa

SEQ ID NO: 5522458 - DNA, 23 bp, Homo sapiens
tctccaggggcctgcagaaggaa

SEQ ID NO: 5522459 - DNA, 20 bp, Homo sapiens
tctccaggggctgcttcctc

SEQ ID NO: 5522460 - DNA, 22 bp, Homo sapiens
tctccaggggctgcttcctcct

SEQ ID NO: 5522461 - DNA, 15 bp, Homo sapiens
tctccaggggtgccc

SEQ ID NO: 5522462 - DNA, 14 bp, Homo sapiens
tctccaggtcagcc

SEQ ID NO: 5522463 - DNA, 16 bp, Homo sapiens
tctccaggtcagcctg

SEQ ID NO: 5522464 - DNA, 19 bp, Homo sapiens
tctccaggtgattctgatc

SEQ ID NO: 5522465 - DNA, 12 bp, Homo sapiens
tctccaggtgct

SEQ ID NO: 5522466 - DNA, 14 bp, Homo sapiens
tctccaggtgctca

SEQ ID NO: 5522467 - DNA, 19 bp, Homo sapiens
tctccagtatccactttgc

SEQ ID NO: 5522468 - DNA, 17 bp, Homo sapiens
tctccagtatcctgctg

SEQ ID NO: 5522469 - DNA, 14 bp, Homo sapiens
tctccagtgaaatg

SEQ ID NO: 5522470 - DNA, 18 bp, Homo sapiens
tctccagtggattcccag

SEQ ID NO: 5522471 - DNA, 18 bp, Homo sapiens
tctccagtggttgctgtt

SEQ ID NO: 5522472 - DNA, 14 bp, Homo sapiens
tctccagtgtgcca

SEQ ID NO: 5522473 - DNA, 23 bp, Homo sapiens
tctccagtttttgaggagccagc

SEQ ID NO: 5522474 - DNA, 21 bp, Homo sapiens
tctccataaacatgaaaacac

SEQ ID NO: 5522475 - DNA, 18 bp, Homo sapiens
tctccataaccccaccct

SEQ ID NO: 5522476 - DNA, 13 bp, Homo sapiens
tctccataatgcc

SEQ ID NO: 5522477 - DNA, 19 bp, Homo sapiens
tctccatacctgcccctgc

SEQ ID NO: 5522478 - DNA, 19 bp, Homo sapiens
tctccatacgcgttctagg

SEQ ID NO: 5522479 - DNA, 24 bp, Homo sapiens
tctccataggagggaaggagcagt

SEQ ID NO: 5522480 - DNA, 19 bp, Homo sapiens
tctccatatctccatggcc

SEQ ID NO: 5522481 - DNA, 17 bp, Homo sapiens
tctccatcagaggacac

SEQ ID NO: 5522482 - DNA, 15 bp, Homo sapiens
tctccatcataggct

SEQ ID NO: 5522483 - DNA, 18 bp, Homo sapiens
tctccatcataggctgac

SEQ ID NO: 5522484 - DNA, 12 bp, Homo sapiens
tctccatcccct

SEQ ID NO: 5522485 - DNA, 22 bp, Homo sapiens
tctccatcccctccctgcctgc

SEQ ID NO: 5522486 - DNA, 23 bp, Homo sapiens
tctccatcccctccctgcctgct

SEQ ID NO: 5522487 - DNA, 19 bp, Homo sapiens
tctccatccctctcctctg

SEQ ID NO: 5522488 - DNA, 19 bp, Homo sapiens
tctccatccttaactgtcc

SEQ ID NO: 5522489 - DNA, 14 bp, Homo sapiens
tctccatctctctg

SEQ ID NO: 5522490 - DNA, 18 bp, Homo sapiens
tctccatctctctggccc

SEQ ID NO: 5522491 - DNA, 21 bp, Homo sapiens
tctccatgctctttcaccctg

SEQ ID NO: 5522492 - DNA, 13 bp, Homo sapiens
tctccatgctgca

SEQ ID NO: 5522493 - DNA, 14 bp, Homo sapiens
tctccatgctgcaa

SEQ ID NO: 5522494 - DNA, 13 bp, Homo sapiens
tctccatgctgga

SEQ ID NO: 5522495 - DNA, 22 bp, Homo sapiens
tctccatgctggatactggaca

SEQ ID NO: 5522496 - DNA, 13 bp, Homo sapiens
tctccatggagcc

SEQ ID NO: 5522497 - DNA, 20 bp, Homo sapiens
tctccatggccaccttttca

SEQ ID NO: 5522498 - DNA, 12 bp, Homo sapiens
tctccatggccc

SEQ ID NO: 5522499 - DNA, 14 bp, Homo sapiens
tctccatggccctg

SEQ ID NO: 5522500 - DNA, 16 bp, Homo sapiens
tctccatggccctgcc

SEQ ID NO: 5522501 - DNA, 24 bp, Homo sapiens
tctccatggccctgccatgctctc

SEQ ID NO: 5522502 - DNA, 19 bp, Homo sapiens
tctccatggccctgtccca

SEQ ID NO: 5522503 - DNA, 17 bp, Homo sapiens
tctccatggcttcctcc

SEQ ID NO: 5522504 - DNA, 18 bp, Homo sapiens
tctccatgggccaccgcc

SEQ ID NO: 5522505 - DNA, 19 bp, Homo sapiens
tctccatgtgtgtgccaag

SEQ ID NO: 5522506 - DNA, 15 bp, Homo sapiens
tctccattaaacttc

SEQ ID NO: 5522507 - DNA, 16 bp, Homo sapiens
tctccattctgctcct

SEQ ID NO: 5522508 - DNA, 19 bp, Homo sapiens
tctccattgtgcctaagtc

SEQ ID NO: 5522509 - DNA, 12 bp, Homo sapiens
tctccatttaat

SEQ ID NO: 5522510 - DNA, 16 bp, Homo sapiens
tctccatttaataatt

SEQ ID NO: 5522511 - DNA, 19 bp, Homo sapiens
tctccatttaataattata

SEQ ID NO: 5522512 - DNA, 21 bp, Homo sapiens
tctccatttcacacaggtcct

SEQ ID NO: 5522513 - DNA, 13 bp, Homo sapiens
tctccatttgctc

SEQ ID NO: 5522514 - DNA, 15 bp, Homo sapiens
tctccatttggaatt

SEQ ID NO: 5522515 - DNA, 17 bp, Homo sapiens
tctccattttcttctct

SEQ ID NO: 5522516 - DNA, 21 bp, Homo sapiens
tctccattttcttctctgtga

SEQ ID NO: 5522517 - DNA, 22 bp, Homo sapiens
tctcccaaagtaccttgaactc

SEQ ID NO: 5522518 - DNA, 18 bp, Homo sapiens
tctcccaaagtgctggga

SEQ ID NO: 5522519 - DNA, 23 bp, Homo sapiens
tctcccaaagtgctgggattaca

SEQ ID NO: 5522520 - DNA, 21 bp, Homo sapiens
tctcccaaataaactccttaa

SEQ ID NO: 5522521 - DNA, 18 bp, Homo sapiens
tctcccaacatgggaggg

SEQ ID NO: 5522522 - DNA, 16 bp, Homo sapiens
tctcccaactcagcct

SEQ ID NO: 5522523 - DNA, 18 bp, Homo sapiens
tctcccaactcagcctgt

SEQ ID NO: 5522524 - DNA, 22 bp, Homo sapiens
tctcccaagctatctaaagttt

SEQ ID NO: 5522525 - DNA, 12 bp, Homo sapiens
tctcccaaggct

SEQ ID NO: 5522526 - DNA, 15 bp, Homo sapiens
tctcccaaggctgcc

SEQ ID NO: 5522527 - DNA, 18 bp, Homo sapiens
tctcccaaggctgccaga

SEQ ID NO: 5522528 - DNA, 16 bp, Homo sapiens
tctcccacacccaccc

SEQ ID NO: 5522529 - DNA, 12 bp, Homo sapiens
tctcccacactg

SEQ ID NO: 5522530 - DNA, 18 bp, Homo sapiens
tctcccacatcccactgg

SEQ ID NO: 5522531 - DNA, 22 bp, Homo sapiens
tctcccacatgaggccatctca

SEQ ID NO: 5522532 - DNA, 14 bp, Homo sapiens
tctcccacatgcca

SEQ ID NO: 5522533 - DNA, 12 bp, Homo sapiens
tctcccacccaa

SEQ ID NO: 5522534 - DNA, 23 bp, Homo sapiens
tctcccaccccagcctcaagtag

SEQ ID NO: 5522535 - DNA, 23 bp, Homo sapiens
tctcccaccccgccgttccctgc

SEQ ID NO: 5522536 - DNA, 14 bp, Homo sapiens
tctcccaccccttg

SEQ ID NO: 5522537 - DNA, 16 bp, Homo sapiens
tctcccaccctaaggg

SEQ ID NO: 5522538 - DNA, 21 bp, Homo sapiens
tctcccaccctaagggcagcc

SEQ ID NO: 5522539 - DNA, 12 bp, Homo sapiens
tctcccaccctc

SEQ ID NO: 5522540 - DNA, 17 bp, Homo sapiens
tctcccaccctcttcct

SEQ ID NO: 5522541 - DNA, 19 bp, Homo sapiens
tctcccaccctcttcctac

SEQ ID NO: 5522542 - DNA, 16 bp, Homo sapiens
tctcccaccctttctg

SEQ ID NO: 5522543 - DNA, 22 bp, Homo sapiens
tctcccaccctttctgccaggg

SEQ ID NO: 5522544 - DNA, 18 bp, Homo sapiens
tctcccacgtgcacagct

SEQ ID NO: 5522545 - DNA, 18 bp, Homo sapiens
tctcccactccagcgctg

SEQ ID NO: 5522546 - DNA, 15 bp, Homo sapiens
tctcccactctccta

SEQ ID NO: 5522547 - DNA, 21 bp, Homo sapiens
tctcccactgcaacttgtgaa

SEQ ID NO: 5522548 - DNA, 22 bp, Homo sapiens
tctcccactgcaacttgtgaac

SEQ ID NO: 5522549 - DNA, 13 bp, Homo sapiens
tctcccacttcct

SEQ ID NO: 5522550 - DNA, 14 bp, Homo sapiens
tctcccacttcctc

SEQ ID NO: 5522551 - DNA, 19 bp, Homo sapiens
tctcccacttcctcctacc

SEQ ID NO: 5522552 - DNA, 16 bp, Homo sapiens
tctcccactttctgtt

SEQ ID NO: 5522553 - DNA, 16 bp, Homo sapiens
tctcccagaaggctgg

SEQ ID NO: 5522554 - DNA, 21 bp, Homo sapiens
tctcccagacttgtttcctgt

SEQ ID NO: 5522555 - DNA, 20 bp, Homo sapiens
tctcccagaggctcctggag

SEQ ID NO: 5522556 - DNA, 22 bp, Homo sapiens
tctcccagaggctcctggagcc

SEQ ID NO: 5522557 - DNA, 18 bp, Homo sapiens
tctcccagataatgtgaa

SEQ ID NO: 5522558 - DNA, 12 bp, Homo sapiens
tctcccagctct

SEQ ID NO: 5522559 - DNA, 18 bp, Homo sapiens
tctcccagcttcaaatgc

SEQ ID NO: 5522560 - DNA, 11 bp, Homo sapiens
tctcccaggaa

SEQ ID NO: 5522561 - DNA, 18 bp, Homo sapiens
tctcccaggccaggctcc

SEQ ID NO: 5522562 - DNA, 21 bp, Homo sapiens
tctcccaggccccatgacctc

SEQ ID NO: 5522563 - DNA, 15 bp, Homo sapiens
tctcccaggctgtcc

SEQ ID NO: 5522564 - DNA, 23 bp, Homo sapiens
tctcccagggagtgagcagctac

SEQ ID NO: 5522565 - DNA, 12 bp, Homo sapiens
tctcccagggct

SEQ ID NO: 5522566 - DNA, 21 bp, Homo sapiens
tctcccaggtggattttgtgg

SEQ ID NO: 5522567 - DNA, 15 bp, Homo sapiens
tctcccagtcattta

SEQ ID NO: 5522568 - DNA, 20 bp, Homo sapiens
tctcccagtctacccagaga

SEQ ID NO: 5522569 - DNA, 13 bp, Homo sapiens
tctcccagtctct

SEQ ID NO: 5522570 - DNA, 14 bp, Homo sapiens
tctcccagtctctg

SEQ ID NO: 5522571 - DNA, 22 bp, Homo sapiens
tctcccagtgaactcctgccag

SEQ ID NO: 5522572 - DNA, 18 bp, Homo sapiens
tctcccataccatcactg

SEQ ID NO: 5522573 - DNA, 20 bp, Homo sapiens
tctcccataccatcactgag

SEQ ID NO: 5522574 - DNA, 11 bp, Homo sapiens
tctcccatccc

SEQ ID NO: 5522575 - DNA, 12 bp, Homo sapiens
tctcccatcccc

SEQ ID NO: 5522576 - DNA, 13 bp, Homo sapiens
tctcccatccccc

SEQ ID NO: 5522577 - DNA, 17 bp, Homo sapiens
tctcccatccccctgcc

SEQ ID NO: 5522578 - DNA, 18 bp, Homo sapiens
tctcccatccccctgccc

SEQ ID NO: 5522579 - DNA, 19 bp, Homo sapiens
tctcccatccccctgccct

SEQ ID NO: 5522580 - DNA, 16 bp, Homo sapiens
tctcccatcctgatcc

SEQ ID NO: 5522581 - DNA, 15 bp, Homo sapiens
tctcccatcctgggg

SEQ ID NO: 5522582 - DNA, 19 bp, Homo sapiens
tctcccatctcttccttga

SEQ ID NO: 5522583 - DNA, 21 bp, Homo sapiens
tctcccatcttaactctttgc

SEQ ID NO: 5522584 - DNA, 13 bp, Homo sapiens
tctcccatggagc

SEQ ID NO: 5522585 - DNA, 15 bp, Homo sapiens
tctcccatggagccc

SEQ ID NO: 5522586 - DNA, 22 bp, Homo sapiens
tctcccatggctttgtgctgct

SEQ ID NO: 5522587 - DNA, 23 bp, Homo sapiens
tctcccatggctttgtgctgctg

SEQ ID NO: 5522588 - DNA, 19 bp, Homo sapiens
tctcccatgggggctccag

SEQ ID NO: 5522589 - DNA, 23 bp, Homo sapiens
tctcccattctcatatgtagccc

SEQ ID NO: 5522590 - DNA, 14 bp, Homo sapiens
tctcccatttcctg

SEQ ID NO: 5522591 - DNA, 15 bp, Homo sapiens
tctcccatttcctga

SEQ ID NO: 5522592 - DNA, 19 bp, Homo sapiens
tctcccatttcctgatcta

SEQ ID NO: 5522593 - DNA, 22 bp, Homo sapiens
tctccccaacccccattctcat

SEQ ID NO: 5522594 - DNA, 11 bp, Homo sapiens
tctccccacac

SEQ ID NO: 5522595 - DNA, 12 bp, Homo sapiens
tctccccacagc

SEQ ID NO: 5522596 - DNA, 19 bp, Homo sapiens
tctccccacgagggctggc

SEQ ID NO: 5522597 - DNA, 19 bp, Homo sapiens
tctccccagagctgcctgc

SEQ ID NO: 5522598 - DNA, 11 bp, Homo sapiens
tctccccagcc

SEQ ID NO: 5522599 - DNA, 15 bp, Homo sapiens
tctccccagcccaga

SEQ ID NO: 5522600 - DNA, 13 bp, Homo sapiens
tctccccagcccc

SEQ ID NO: 5522601 - DNA, 16 bp, Homo sapiens
tctccccagcctggca

SEQ ID NO: 5522602 - DNA, 20 bp, Homo sapiens
tctccccaggcctccagcct

SEQ ID NO: 5522603 - DNA, 19 bp, Homo sapiens
tctccccaggtccagctct

SEQ ID NO: 5522604 - DNA, 14 bp, Homo sapiens
tctccccagtagag

SEQ ID NO: 5522605 - DNA, 12 bp, Homo sapiens
tctccccagtgc

SEQ ID NO: 5522606 - DNA, 21 bp, Homo sapiens
tctccccagtgcctgccactc

SEQ ID NO: 5522607 - DNA, 23 bp, Homo sapiens
tctccccagtgcctgccactctc

SEQ ID NO: 5522608 - DNA, 12 bp, Homo sapiens
tctccccagtgt

SEQ ID NO: 5522609 - DNA, 13 bp, Homo sapiens
tctccccatatat

SEQ ID NO: 5522610 - DNA, 18 bp, Homo sapiens
tctccccatatataaatt

SEQ ID NO: 5522611 - DNA, 21 bp, Homo sapiens
tctccccatatataaattatt

SEQ ID NO: 5522612 - DNA, 19 bp, Homo sapiens
tctccccatccccttccta

SEQ ID NO: 5522613 - DNA, 14 bp, Homo sapiens
tctccccatgctgg

SEQ ID NO: 5522614 - DNA, 20 bp, Homo sapiens
tctcccccaaacccacgcgt

SEQ ID NO: 5522615 - DNA, 22 bp, Homo sapiens
tctcccccaacaccccgcctgc

SEQ ID NO: 5522616 - DNA, 17 bp, Homo sapiens
tctcccccaacagctgg

SEQ ID NO: 5522617 - DNA, 21 bp, Homo sapiens
tctcccccaacagctggaccc

SEQ ID NO: 5522618 - DNA, 15 bp, Homo sapiens
tctcccccaacccac

SEQ ID NO: 5522619 - DNA, 18 bp, Homo sapiens
tctcccccaacccacctc

SEQ ID NO: 5522620 - DNA, 23 bp, Homo sapiens
tctcccccaacccacctctggcc

SEQ ID NO: 5522621 - DNA, 15 bp, Homo sapiens
tctcccccaccccct

SEQ ID NO: 5522622 - DNA, 19 bp, Homo sapiens
tctcccccaccccctcccc

SEQ ID NO: 5522623 - DNA, 23 bp, Homo sapiens
tctcccccacccttgttccagtt

SEQ ID NO: 5522624 - DNA, 13 bp, Homo sapiens
tctcccccactcc

SEQ ID NO: 5522625 - DNA, 12 bp, Homo sapiens
tctcccccagag

SEQ ID NO: 5522626 - DNA, 13 bp, Homo sapiens
tctcccccagagt

SEQ ID NO: 5522627 - DNA, 13 bp, Homo sapiens
tctcccccagccc

SEQ ID NO: 5522628 - DNA, 20 bp, Homo sapiens
tctcccccagccccatcctc

SEQ ID NO: 5522629 - DNA, 20 bp, Homo sapiens
tctcccccatcccccactgc

SEQ ID NO: 5522630 - DNA, 20 bp, Homo sapiens
tctcccccccggggctgggt

SEQ ID NO: 5522631 - DNA, 19 bp, Homo sapiens
tctcccccgacactgctgc

SEQ ID NO: 5522632 - DNA, 21 bp, Homo sapiens
tctccccctatttattgactt

SEQ ID NO: 5522633 - DNA, 15 bp, Homo sapiens
tctccccctctgtct

SEQ ID NO: 5522634 - DNA, 20 bp, Homo sapiens
tctccccctctgtcttctct

SEQ ID NO: 5522635 - DNA, 13 bp, Homo sapiens
tctccccctgggc

SEQ ID NO: 5522636 - DNA, 20 bp, Homo sapiens
tctccccctgggctctgccc

SEQ ID NO: 5522637 - DNA, 13 bp, Homo sapiens
tctcccccttcag

SEQ ID NO: 5522638 - DNA, 19 bp, Homo sapiens
tctccccgaggctgcccca

SEQ ID NO: 5522639 - DNA, 20 bp, Homo sapiens
tctccccgaggctgccccag

SEQ ID NO: 5522640 - DNA, 21 bp, Homo sapiens
tctccccgaggctgccccagg

SEQ ID NO: 5522641 - DNA, 22 bp, Homo sapiens
tctccccgaggctgccccaggc

SEQ ID NO: 5522642 - DNA, 20 bp, Homo sapiens
tctccccgcagccctctcca

SEQ ID NO: 5522643 - DNA, 22 bp, Homo sapiens
tctccccgctctggatcctgca

SEQ ID NO: 5522644 - DNA, 22 bp, Homo sapiens
tctccccggtaatgtcactgtt

SEQ ID NO: 5522645 - DNA, 17 bp, Homo sapiens
tctcccctagctcacca

SEQ ID NO: 5522646 - DNA, 18 bp, Homo sapiens
tctcccctcagagtgcaa

SEQ ID NO: 5522647 - DNA, 14 bp, Homo sapiens
tctcccctcagctc

SEQ ID NO: 5522648 - DNA, 14 bp, Homo sapiens
tctcccctccagac

SEQ ID NO: 5522649 - DNA, 15 bp, Homo sapiens
tctcccctccagacc

SEQ ID NO: 5522650 - DNA, 19 bp, Homo sapiens
tctcccctccagaccccta

SEQ ID NO: 5522651 - DNA, 13 bp, Homo sapiens
tctcccctcccag

SEQ ID NO: 5522652 - DNA, 15 bp, Homo sapiens
tctcccctccccatc

SEQ ID NO: 5522653 - DNA, 14 bp, Homo sapiens
tctcccctcctgca

SEQ ID NO: 5522654 - DNA, 17 bp, Homo sapiens
tctcccctctcccaggg

SEQ ID NO: 5522655 - DNA, 19 bp, Homo sapiens
tctcccctctcccagggat

SEQ ID NO: 5522656 - DNA, 14 bp, Homo sapiens
tctcccctctctgc

SEQ ID NO: 5522657 - DNA, 18 bp, Homo sapiens
tctcccctctgccctgta

SEQ ID NO: 5522658 - DNA, 13 bp, Homo sapiens
tctcccctctgct

SEQ ID NO: 5522659 - DNA, 13 bp, Homo sapiens
tctcccctgcccc

SEQ ID NO: 5522660 - DNA, 23 bp, Homo sapiens
tctcccctgcccccaggactggg

SEQ ID NO: 5522661 - DNA, 14 bp, Homo sapiens
tctcccctgccccg

SEQ ID NO: 5522662 - DNA, 15 bp, Homo sapiens
tctcccctgccccgt

SEQ ID NO: 5522663 - DNA, 13 bp, Homo sapiens
tctcccctgccct

SEQ ID NO: 5522664 - DNA, 17 bp, Homo sapiens
tctcccctgccctgctg

SEQ ID NO: 5522665 - DNA, 13 bp, Homo sapiens
tctcccctgggtc

SEQ ID NO: 5522666 - DNA, 22 bp, Homo sapiens
tctcccctgggtcctccaaaga

SEQ ID NO: 5522667 - DNA, 18 bp, Homo sapiens
tctccccttcctggacac

SEQ ID NO: 5522668 - DNA, 17 bp, Homo sapiens
tctccccttcctggcac

SEQ ID NO: 5522669 - DNA, 16 bp, Homo sapiens
tctccccttctctgcc

SEQ ID NO: 5522670 - DNA, 18 bp, Homo sapiens
tctccccttgcagcctgg

SEQ ID NO: 5522671 - DNA, 17 bp, Homo sapiens
tctccccttggttctgc

SEQ ID NO: 5522672 - DNA, 21 bp, Homo sapiens
tctcccgaagtcctctgtggc

SEQ ID NO: 5522673 - DNA, 21 bp, Homo sapiens
tctcccgagcaatggcgcctg

SEQ ID NO: 5522674 - DNA, 14 bp, Homo sapiens
tctcccgcaccagg

SEQ ID NO: 5522675 - DNA, 18 bp, Homo sapiens
tctcccgcaccaggccgg

SEQ ID NO: 5522676 - DNA, 18 bp, Homo sapiens
tctcccgccattggcctt

SEQ ID NO: 5522677 - DNA, 15 bp, Homo sapiens
tctcccgcgggcctg

SEQ ID NO: 5522678 - DNA, 14 bp, Homo sapiens
tctcccgcttcctg

SEQ ID NO: 5522679 - DNA, 14 bp, Homo sapiens
tctcccggctgcct

SEQ ID NO: 5522680 - DNA, 15 bp, Homo sapiens
tctcccggttcttcc

SEQ ID NO: 5522681 - DNA, 22 bp, Homo sapiens
tctcccgtcagggcccaagtcc

SEQ ID NO: 5522682 - DNA, 13 bp, Homo sapiens
tctcccgtctcgc

SEQ ID NO: 5522683 - DNA, 15 bp, Homo sapiens
tctccctaccctctt

SEQ ID NO: 5522684 - DNA, 22 bp, Homo sapiens
tctccctaccctcttctcagct

SEQ ID NO: 5522685 - DNA, 21 bp, Homo sapiens
tctccctacctccctcctcag

SEQ ID NO: 5522686 - DNA, 22 bp, Homo sapiens
tctccctacctccctcctcagg

SEQ ID NO: 5522687 - DNA, 12 bp, Homo sapiens
tctccctagccc

SEQ ID NO: 5522688 - DNA, 16 bp, Homo sapiens
tctccctagcccaccc

SEQ ID NO: 5522689 - DNA, 13 bp, Homo sapiens
tctccctagccct

SEQ ID NO: 5522690 - DNA, 15 bp, Homo sapiens
tctccctagctcctc

SEQ ID NO: 5522691 - DNA, 20 bp, Homo sapiens
tctccctagctcctcccctt

SEQ ID NO: 5522692 - DNA, 20 bp, Homo sapiens
tctccctataccgagaccca

SEQ ID NO: 5522693 - DNA, 21 bp, Homo sapiens
tctccctataccgagacccac

SEQ ID NO: 5522694 - DNA, 19 bp, Homo sapiens
tctccctcaactgaagggg

SEQ ID NO: 5522695 - DNA, 22 bp, Homo sapiens
tctccctcacaagcgctcccag

SEQ ID NO: 5522696 - DNA, 19 bp, Homo sapiens
tctccctcacccccaggtg

SEQ ID NO: 5522697 - DNA, 14 bp, Homo sapiens
tctccctccactcc

SEQ ID NO: 5522698 - DNA, 14 bp, Homo sapiens
tctccctccagctg

SEQ ID NO: 5522699 - DNA, 15 bp, Homo sapiens
tctccctccatggca

SEQ ID NO: 5522700 - DNA, 22 bp, Homo sapiens
tctccctccccaaatggctgct

SEQ ID NO: 5522701 - DNA, 22 bp, Homo sapiens
tctctaagatgaatccaaatgt

SEQ ID NO: 5522702 - DNA, 23 bp, Homo sapiens
tctctaagatgaatccaaatgtg

SEQ ID NO: 5522703 - DNA, 17 bp, Homo sapiens
tctctaagccacagctt

SEQ ID NO: 5522704 - DNA, 20 bp, Homo sapiens
tctctaagccacagcttctt

SEQ ID NO: 5522705 - DNA, 23 bp, Homo sapiens
tctctaagcctatacgtttctgt

SEQ ID NO: 5522706 - DNA, 16 bp, Homo sapiens
tctctaagcctggctt

SEQ ID NO: 5522707 - DNA, 16 bp, Homo sapiens
tctctaaggaattatt

SEQ ID NO: 5522708 - DNA, 19 bp, Homo sapiens
tctctaaggaattatttca

SEQ ID NO: 5522709 - DNA, 17 bp, Homo sapiens
tctctaaggtttacaat

SEQ ID NO: 5522710 - DNA, 15 bp, Homo sapiens
tctctaagtgggcat

SEQ ID NO: 5522711 - DNA, 20 bp, Homo sapiens
tctctaagtgggcattgcca

SEQ ID NO: 5522712 - DNA, 14 bp, Homo sapiens
tctctaagttatga

SEQ ID NO: 5522713 - DNA, 17 bp, Homo sapiens
tctctaagttatgactg

SEQ ID NO: 5522714 - DNA, 16 bp, Homo sapiens
tctctaagttccactg

SEQ ID NO: 5522715 - DNA, 12 bp, Homo sapiens
tctctaataaaa

SEQ ID NO: 5522716 - DNA, 18 bp, Homo sapiens
tctctaataaaattcaga

SEQ ID NO: 5522717 - DNA, 15 bp, Homo sapiens
tctctaataagaaaa

SEQ ID NO: 5522718 - DNA, 20 bp, Homo sapiens
tctctaatagaagtccatga

SEQ ID NO: 5522719 - DNA, 23 bp, Homo sapiens
tctctaatatccacttgtccatg

SEQ ID NO: 5522720 - DNA, 20 bp, Homo sapiens
tctctaatctgtgctgtttc

SEQ ID NO: 5522721 - DNA, 16 bp, Homo sapiens
tctctaatgtctgcag

SEQ ID NO: 5522722 - DNA, 20 bp, Homo sapiens
tctctacaaaaaataaaata

SEQ ID NO: 5522723 - DNA, 17 bp, Homo sapiens
tctctacagaggtgaaa

SEQ ID NO: 5522724 - DNA, 20 bp, Homo sapiens
tctctacagatgtcccattt

SEQ ID NO: 5522725 - DNA, 20 bp, Homo sapiens
tctctacagcaccttaaaaa

SEQ ID NO: 5522726 - DNA, 22 bp, Homo sapiens
tctctacaggtccgtttcctta

SEQ ID NO: 5522727 - DNA, 18 bp, Homo sapiens
tctctacagtctcgtctc

SEQ ID NO: 5522728 - DNA, 16 bp, Homo sapiens
tctctacattaatgtc

SEQ ID NO: 5522729 - DNA, 20 bp, Homo sapiens
tctctaccaaaaaaaggaag

SEQ ID NO: 5522730 - DNA, 18 bp, Homo sapiens
tctctacccatcttaaaa

SEQ ID NO: 5522731 - DNA, 12 bp, Homo sapiens
tctctacccccc

SEQ ID NO: 5522732 - DNA, 17 bp, Homo sapiens
tctctacccctttctgt

SEQ ID NO: 5522733 - DNA, 19 bp, Homo sapiens
tctctacccggcccagaga

SEQ ID NO: 5522734 - DNA, 16 bp, Homo sapiens
tctctacctaagaggg

SEQ ID NO: 5522735 - DNA, 15 bp, Homo sapiens
tctctacctccaccc

SEQ ID NO: 5522736 - DNA, 17 bp, Homo sapiens
tctctacctccaccctg

SEQ ID NO: 5522737 - DNA, 16 bp, Homo sapiens
tctctaccttctcccc

SEQ ID NO: 5522738 - DNA, 18 bp, Homo sapiens
tctctaccttctccccag

SEQ ID NO: 5522739 - DNA, 21 bp, Homo sapiens
tctctaccttttaaaattgaa

SEQ ID NO: 5522740 - DNA, 14 bp, Homo sapiens
tctctactaaaaat

SEQ ID NO: 5522741 - DNA, 18 bp, Homo sapiens
tctctactaaaaatacaa

SEQ ID NO: 5522742 - DNA, 19 bp, Homo sapiens
tctctactcctacctcagc

SEQ ID NO: 5522743 - DNA, 12 bp, Homo sapiens
tctctactgaaa

SEQ ID NO: 5522744 - DNA, 22 bp, Homo sapiens
tctctactgaatgtcattgaaa

SEQ ID NO: 5522745 - DNA, 12 bp, Homo sapiens
tctctactgctt

SEQ ID NO: 5522746 - DNA, 23 bp, Homo sapiens
tctctactggtaggaagaggtac

SEQ ID NO: 5522747 - DNA, 21 bp, Homo sapiens
tctctactgtctcagtttaca

SEQ ID NO: 5522748 - DNA, 16 bp, Homo sapiens
tctctactgtggcaaa

SEQ ID NO: 5522749 - DNA, 15 bp, Homo sapiens
tctctactttcctga

SEQ ID NO: 5522750 - DNA, 22 bp, Homo sapiens
tctctacttttccctgtacttt

SEQ ID NO: 5522751 - DNA, 13 bp, Homo sapiens
tctctagacaaaa

SEQ ID NO: 5522752 - DNA, 14 bp, Homo sapiens
tctctagagaacat

SEQ ID NO: 5522753 - DNA, 17 bp, Homo sapiens
tctctagaggctggcaa

SEQ ID NO: 5522754 - DNA, 18 bp, Homo sapiens
tctctagagggttgctgc

SEQ ID NO: 5522755 - DNA, 23 bp, Homo sapiens
tctctagagggttgctgcctttc

SEQ ID NO: 5522756 - DNA, 17 bp, Homo sapiens
tctctagctctccatct

SEQ ID NO: 5522757 - DNA, 19 bp, Homo sapiens
tctctagctgttctggact

SEQ ID NO: 5522758 - DNA, 24 bp, Homo sapiens
tctctagcttaagtgtaaatgaag

SEQ ID NO: 5522759 - DNA, 20 bp, Homo sapiens
tctctagctttaggggacca

SEQ ID NO: 5522760 - DNA, 19 bp, Homo sapiens
tctctaggaaatatttatt

SEQ ID NO: 5522761 - DNA, 18 bp, Homo sapiens
tctctaggcctctccagt

SEQ ID NO: 5522762 - DNA, 19 bp, Homo sapiens
tctctagggaaggccacct

SEQ ID NO: 5522763 - DNA, 22 bp, Homo sapiens
tctctagggaaggccacctgca

SEQ ID NO: 5522764 - DNA, 14 bp, Homo sapiens
tctctagggacccc

SEQ ID NO: 5522765 - DNA, 22 bp, Homo sapiens
tctctaggtgtgtccacagagt

SEQ ID NO: 5522766 - DNA, 18 bp, Homo sapiens
tctctagtagttaaaaaa

SEQ ID NO: 5522767 - DNA, 17 bp, Homo sapiens
tctctagtcatttgtta

SEQ ID NO: 5522768 - DNA, 16 bp, Homo sapiens
tctctagtgctgtgaa

SEQ ID NO: 5522769 - DNA, 20 bp, Homo sapiens
tctctagtgtagctgccaca

SEQ ID NO: 5522770 - DNA, 13 bp, Homo sapiens
tctctataaaaaa

SEQ ID NO: 5522771 - DNA, 14 bp, Homo sapiens
tctctataaagggt

SEQ ID NO: 5522772 - DNA, 16 bp, Homo sapiens
tctctatagcaccagg

SEQ ID NO: 5522773 - DNA, 22 bp, Homo sapiens
tctctatagcaccagggctcac

SEQ ID NO: 5522774 - DNA, 22 bp, Homo sapiens
tctctatataaaaaatatatgt

SEQ ID NO: 5522775 - DNA, 18 bp, Homo sapiens
tctctatattatgtcttc

SEQ ID NO: 5522776 - DNA, 16 bp, Homo sapiens
tctctatatttttatt

SEQ ID NO: 5522777 - DNA, 14 bp, Homo sapiens
tctctatcatttaa

SEQ ID NO: 5522778 - DNA, 16 bp, Homo sapiens
tctctatcatttaata

SEQ ID NO: 5522779 - DNA, 18 bp, Homo sapiens
tctctatcctctcttcct

SEQ ID NO: 5522780 - DNA, 19 bp, Homo sapiens
tctctatctctttatatat

SEQ ID NO: 5522781 - DNA, 20 bp, Homo sapiens
tctctatgcaaaatgtctgt

SEQ ID NO: 5522782 - DNA, 20 bp, Homo sapiens
tctctatgccctgttaaatg

SEQ ID NO: 5522783 - DNA, 13 bp, Homo sapiens
tctctatgcctct

SEQ ID NO: 5522784 - DNA, 16 bp, Homo sapiens
tctctatgtatcaaat

SEQ ID NO: 5522785 - DNA, 15 bp, Homo sapiens
tctctatgtatgtag

SEQ ID NO: 5522786 - DNA, 15 bp, Homo sapiens
tctctattccctcag

SEQ ID NO: 5522787 - DNA, 16 bp, Homo sapiens
tctctattcctgaccc

SEQ ID NO: 5522788 - DNA, 15 bp, Homo sapiens
tctctattctttcca

SEQ ID NO: 5522789 - DNA, 14 bp, Homo sapiens
tctctattgtaatt

SEQ ID NO: 5522790 - DNA, 17 bp, Homo sapiens
tctctattgtaattttg

SEQ ID NO: 5522791 - DNA, 22 bp, Homo sapiens
tctctattgtaattttgttcct

SEQ ID NO: 5522792 - DNA, 17 bp, Homo sapiens
tctctatttaaattctt

SEQ ID NO: 5522793 - DNA, 23 bp, Homo sapiens
tctctatttaaattcttttttaa

SEQ ID NO: 5522794 - DNA, 17 bp, Homo sapiens
tctctatttaatattta

SEQ ID NO: 5522795 - DNA, 13 bp, Homo sapiens
tctctatttatga

SEQ ID NO: 5522796 - DNA, 14 bp, Homo sapiens
tctctatttattgg

SEQ ID NO: 5522797 - DNA, 17 bp, Homo sapiens
tctctatttgagaagtt

SEQ ID NO: 5522798 - DNA, 15 bp, Homo sapiens
tctctatttgatttg

SEQ ID NO: 5522799 - DNA, 13 bp, Homo sapiens
tctctattttact

SEQ ID NO: 5522800 - DNA, 15 bp, Homo sapiens
tctctattttcataa

SEQ ID NO: 5522801 - DNA, 21 bp, Homo sapiens
tctctcaaaagagaaaaacaa

SEQ ID NO: 5522802 - DNA, 17 bp, Homo sapiens
tctctcaaacttagttt

SEQ ID NO: 5522803 - DNA, 22 bp, Homo sapiens
tctctcaaccttggccttctcc

SEQ ID NO: 5522804 - DNA, 17 bp, Homo sapiens
tctctcaatccctttgc

SEQ ID NO: 5522805 - DNA, 16 bp, Homo sapiens
tctctcaatttgaaac

SEQ ID NO: 5522806 - DNA, 23 bp, Homo sapiens
tctctcacagacaggacccctgc

SEQ ID NO: 5522807 - DNA, 14 bp, Homo sapiens
tctctcaccagcct

SEQ ID NO: 5522808 - DNA, 15 bp, Homo sapiens
tctctcaccagcctt

SEQ ID NO: 5522809 - DNA, 19 bp, Homo sapiens
tctctcacccaccagctcc

SEQ ID NO: 5522810 - DNA, 16 bp, Homo sapiens
tctctcacctacttcc

SEQ ID NO: 5522811 - DNA, 14 bp, Homo sapiens
tctctcacctgctc

SEQ ID NO: 5522812 - DNA, 18 bp, Homo sapiens
tctctcactcccctctcc

SEQ ID NO: 5522813 - DNA, 23 bp, Homo sapiens
tctctcactccctccctttctat

SEQ ID NO: 5522814 - DNA, 20 bp, Homo sapiens
tctctcactctcttcctttc

SEQ ID NO: 5522815 - DNA, 17 bp, Homo sapiens
tctctcacttgttttat

SEQ ID NO: 5522816 - DNA, 21 bp, Homo sapiens
tctctcacttgttttatttaa

SEQ ID NO: 5522817 - DNA, 22 bp, Homo sapiens
tctctcacttgttttatttaac

SEQ ID NO: 5522818 - DNA, 16 bp, Homo sapiens
tctctcagaagggagg

SEQ ID NO: 5522819 - DNA, 16 bp, Homo sapiens
tctctcagagccctca

SEQ ID NO: 5522820 - DNA, 15 bp, Homo sapiens
tctctcagccagctg

SEQ ID NO: 5522821 - DNA, 21 bp, Homo sapiens
tctctcagccagctgtttaag

SEQ ID NO: 5522822 - DNA, 13 bp, Homo sapiens
tctctcagcccag

SEQ ID NO: 5522823 - DNA, 22 bp, Homo sapiens
tctctcagccctccatggcctg

SEQ ID NO: 5522824 - DNA, 17 bp, Homo sapiens
tctctcagctcccaggc

SEQ ID NO: 5522825 - DNA, 17 bp, Homo sapiens
tctctcaggagcacagg

SEQ ID NO: 5522826 - DNA, 18 bp, Homo sapiens
tctctcaggagcacaggc

SEQ ID NO: 5522827 - DNA, 19 bp, Homo sapiens
tctctcaggagcacaggca

SEQ ID NO: 5522828 - DNA, 13 bp, Homo sapiens
tctctcagggatg

SEQ ID NO: 5522829 - DNA, 14 bp, Homo sapiens
tctctcagggttct

SEQ ID NO: 5522830 - DNA, 13 bp, Homo sapiens
tctctcatattcg

SEQ ID NO: 5522831 - DNA, 23 bp, Homo sapiens
tctctcatcctccagtaccttgc

SEQ ID NO: 5522832 - DNA, 21 bp, Homo sapiens
tctctcatcggaggcccatgc

SEQ ID NO: 5522833 - DNA, 18 bp, Homo sapiens
tctctcatcttgttcttc

SEQ ID NO: 5522834 - DNA, 15 bp, Homo sapiens
tctctcatgaacctc

SEQ ID NO: 5522835 - DNA, 16 bp, Homo sapiens
tctctcatttctttca

SEQ ID NO: 5522836 - DNA, 22 bp, Homo sapiens
tctctccaaggtgtttctagat

SEQ ID NO: 5522837 - DNA, 22 bp, Homo sapiens
tctctccaccccccacgtctgt

SEQ ID NO: 5522838 - DNA, 19 bp, Homo sapiens
tctctccaccttagtactt

SEQ ID NO: 5522839 - DNA, 14 bp, Homo sapiens
tctctccactgctc

SEQ ID NO: 5522840 - DNA, 22 bp, Homo sapiens
tctctccagagagcaaacatag

SEQ ID NO: 5522841 - DNA, 17 bp, Homo sapiens
tctctccagagctcctg

SEQ ID NO: 5522842 - DNA, 22 bp, Homo sapiens
tctctccagagctcctgagtgg

SEQ ID NO: 5522843 - DNA, 13 bp, Homo sapiens
tctctccagcccc

SEQ ID NO: 5522844 - DNA, 19 bp, Homo sapiens
tctctccagcccctggatg

SEQ ID NO: 5522845 - DNA, 17 bp, Homo sapiens
tctctccagctaattca

SEQ ID NO: 5522846 - DNA, 18 bp, Homo sapiens
tctctccagctgactaaa

SEQ ID NO: 5522847 - DNA, 21 bp, Homo sapiens
tctctccaggaaggtagccca

SEQ ID NO: 5522848 - DNA, 12 bp, Homo sapiens
tctctccagggt

SEQ ID NO: 5522849 - DNA, 16 bp, Homo sapiens
tctctccagtgaaatg

SEQ ID NO: 5522850 - DNA, 17 bp, Homo sapiens
tctctccagtgaaatga

SEQ ID NO: 5522851 - DNA, 15 bp, Homo sapiens
tctctccatcagaag

SEQ ID NO: 5522852 - DNA, 19 bp, Homo sapiens
tctctccatcagaggacac

SEQ ID NO: 5522853 - DNA, 15 bp, Homo sapiens
tctctccatccctct

SEQ ID NO: 5522854 - DNA, 11 bp, Homo sapiens
tctctccatct

SEQ ID NO: 5522855 - DNA, 18 bp, Homo sapiens
tctctcccacacaagcag

SEQ ID NO: 5522856 - DNA, 14 bp, Homo sapiens
tctctcccacttcc

SEQ ID NO: 5522857 - DNA, 15 bp, Homo sapiens
tctctcccagctctg

SEQ ID NO: 5522858 - DNA, 17 bp, Homo sapiens
tctctcccatcctgggg

SEQ ID NO: 5522859 - DNA, 17 bp, Homo sapiens
tctctcccatggagccc

SEQ ID NO: 5522860 - DNA, 20 bp, Homo sapiens
tctctcccatttcaggaatt

SEQ ID NO: 5522861 - DNA, 21 bp, Homo sapiens
tctctccccaatgctctcctt

SEQ ID NO: 5522862 - DNA, 13 bp, Homo sapiens
tctctccccagcc

SEQ ID NO: 5522863 - DNA, 15 bp, Homo sapiens
tctctccccagcccc

SEQ ID NO: 5522864 - DNA, 18 bp, Homo sapiens
tctctccccatatataaa

SEQ ID NO: 5522865 - DNA, 23 bp, Homo sapiens
tctctcccctcacatcctcctgc

SEQ ID NO: 5522866 - DNA, 21 bp, Homo sapiens
tctctccccttgcactggtca

SEQ ID NO: 5522867 - DNA, 20 bp, Homo sapiens
tctctccctacctccctcct

SEQ ID NO: 5522868 - DNA, 21 bp, Homo sapiens
tctctccctacctccctcctc

SEQ ID NO: 5522869 - DNA, 11 bp, Homo sapiens
tctctccctcc

SEQ ID NO: 5522870 - DNA, 16 bp, Homo sapiens
tctctccctccactcc

SEQ ID NO: 5522871 - DNA, 24 bp, Homo sapiens
tctctccctccctctctcatgaga

SEQ ID NO: 5522872 - DNA, 13 bp, Homo sapiens
tctctccctcctg

SEQ ID NO: 5522873 - DNA, 18 bp, Homo sapiens
tctctccctctccctgtc

SEQ ID NO: 5522874 - DNA, 15 bp, Homo sapiens
tctctccctctgccc

SEQ ID NO: 5522875 - DNA, 16 bp, Homo sapiens
tctctccctctgtctt

SEQ ID NO: 5522876 - DNA, 11 bp, Homo sapiens
tctctccctgc

SEQ ID NO: 5522877 - DNA, 13 bp, Homo sapiens
tctctccctgcct

SEQ ID NO: 5522878 - DNA, 16 bp, Homo sapiens
tctctgggcctgtgtg

SEQ ID NO: 5522879 - DNA, 20 bp, Homo sapiens
tctctgggcctgtgtgtggg

SEQ ID NO: 5522880 - DNA, 22 bp, Homo sapiens
tctctgggcctgtgtgtgggtg

SEQ ID NO: 5522881 - DNA, 17 bp, Homo sapiens
tctctgggctgagccta

SEQ ID NO: 5522882 - DNA, 12 bp, Homo sapiens
tctctgggctgg

SEQ ID NO: 5522883 - DNA, 16 bp, Homo sapiens
tctctgggctggatga

SEQ ID NO: 5522884 - DNA, 15 bp, Homo sapiens
tctctggggaccctc

SEQ ID NO: 5522885 - DNA, 18 bp, Homo sapiens
tctctggggaccctccag

SEQ ID NO: 5522886 - DNA, 19 bp, Homo sapiens
tctctggggaccctccaga

SEQ ID NO: 5522887 - DNA, 22 bp, Homo sapiens
tctctggggcagatccccactg

SEQ ID NO: 5522888 - DNA, 20 bp, Homo sapiens
tctctggggccctgggcctc

SEQ ID NO: 5522889 - DNA, 22 bp, Homo sapiens
tctctggggccctgggcctcag

SEQ ID NO: 5522890 - DNA, 19 bp, Homo sapiens
tctctgggggaggcagggc

SEQ ID NO: 5522891 - DNA, 21 bp, Homo sapiens
tctctgggggaggcagggctg

SEQ ID NO: 5522892 - DNA, 22 bp, Homo sapiens
tctctgggggaggcagggctgg

SEQ ID NO: 5522893 - DNA, 24 bp, Homo sapiens
tctctgggtaggtgttgaaaatga

SEQ ID NO: 5522894 - DNA, 15 bp, Homo sapiens
tctctgggtcccggg

SEQ ID NO: 5522895 - DNA, 22 bp, Homo sapiens
tctctgggtttacaacaaacac

SEQ ID NO: 5522896 - DNA, 17 bp, Homo sapiens
tctctggtaatattgac

SEQ ID NO: 5522897 - DNA, 18 bp, Homo sapiens
tctctggtggctgggctg

SEQ ID NO: 5522898 - DNA, 22 bp, Homo sapiens
tctctggttgacgggctgtccg

SEQ ID NO: 5522899 - DNA, 22 bp, Homo sapiens
tctctggttgccaaatactcat

SEQ ID NO: 5522900 - DNA, 18 bp, Homo sapiens
tctctggtttcaccagcg

SEQ ID NO: 5522901 - DNA, 13 bp, Homo sapiens
tctctggttttct

SEQ ID NO: 5522902 - DNA, 23 bp, Homo sapiens
tctctggttttcttgccaccctc

SEQ ID NO: 5522903 - DNA, 16 bp, Homo sapiens
tctctgtaaaatgaac

SEQ ID NO: 5522904 - DNA, 12 bp, Homo sapiens
tctctgtacaaa

SEQ ID NO: 5522905 - DNA, 21 bp, Homo sapiens
tctctgtacttttcattctct

SEQ ID NO: 5522906 - DNA, 18 bp, Homo sapiens
tctctgtagggaactctg

SEQ ID NO: 5522907 - DNA, 19 bp, Homo sapiens
tctctgtagggaactctgg

SEQ ID NO: 5522908 - DNA, 15 bp, Homo sapiens
tctctgtagttccta

SEQ ID NO: 5522909 - DNA, 16 bp, Homo sapiens
tctctgtataaacatt

SEQ ID NO: 5522910 - DNA, 21 bp, Homo sapiens
tctctgtataaacattaaatg

SEQ ID NO: 5522911 - DNA, 22 bp, Homo sapiens
tctctgtataatctatttacat

SEQ ID NO: 5522912 - DNA, 11 bp, Homo sapiens
tctctgtatat

SEQ ID NO: 5522913 - DNA, 18 bp, Homo sapiens
tctctgtatgaatgtgat

SEQ ID NO: 5522914 - DNA, 19 bp, Homo sapiens
tctctgtcacccttgtcct

SEQ ID NO: 5522915 - DNA, 13 bp, Homo sapiens
tctctgtcagtgt

SEQ ID NO: 5522916 - DNA, 16 bp, Homo sapiens
tctctgtcagtgtgaa

SEQ ID NO: 5522917 - DNA, 17 bp, Homo sapiens
tctctgtcagtgtgaaa

SEQ ID NO: 5522918 - DNA, 14 bp, Homo sapiens
tctctgtccaatct

SEQ ID NO: 5522919 - DNA, 22 bp, Homo sapiens
tctctgtccagcagtcacttcg

SEQ ID NO: 5522920 - DNA, 18 bp, Homo sapiens
tctctgtccccaggtcct

SEQ ID NO: 5522921 - DNA, 18 bp, Homo sapiens
tctctgtccctcactgcc

SEQ ID NO: 5522922 - DNA, 22 bp, Homo sapiens
tctctgtccctcactgccttcc

SEQ ID NO: 5522923 - DNA, 19 bp, Homo sapiens
tctctgtcccttgctgtat

SEQ ID NO: 5522924 - DNA, 15 bp, Homo sapiens
tctctgtcctacttc

SEQ ID NO: 5522925 - DNA, 17 bp, Homo sapiens
tctctgtcgtggagcca

SEQ ID NO: 5522926 - DNA, 17 bp, Homo sapiens
tctctgtctaccatctc

SEQ ID NO: 5522927 - DNA, 15 bp, Homo sapiens
tctctgtctcatcca

SEQ ID NO: 5522928 - DNA, 16 bp, Homo sapiens
tctctgtctcatgtgt

SEQ ID NO: 5522929 - DNA, 15 bp, Homo sapiens
tctctgtctccaggc

SEQ ID NO: 5522930 - DNA, 14 bp, Homo sapiens
tctctgtctctgct

SEQ ID NO: 5522931 - DNA, 18 bp, Homo sapiens
tctctgtctgatcctgtc

SEQ ID NO: 5522932 - DNA, 14 bp, Homo sapiens
tctctgtctggggc

SEQ ID NO: 5522933 - DNA, 15 bp, Homo sapiens
tctctgtctggggct

SEQ ID NO: 5522934 - DNA, 13 bp, Homo sapiens
tctctgtctgtct

SEQ ID NO: 5522935 - DNA, 12 bp, Homo sapiens
tctctgtgaaag

SEQ ID NO: 5522936 - DNA, 16 bp, Homo sapiens
tctctgtgaacgattt

SEQ ID NO: 5522937 - DNA, 23 bp, Homo sapiens
tctctgtgaacgatttagaaaga

SEQ ID NO: 5522938 - DNA, 22 bp, Homo sapiens
tctctgtgaatacaattaaagg

SEQ ID NO: 5522939 - DNA, 12 bp, Homo sapiens
tctctgtgaatc

SEQ ID NO: 5522940 - DNA, 13 bp, Homo sapiens
tctctgtgaatcc

SEQ ID NO: 5522941 - DNA, 18 bp, Homo sapiens
tctctgtgaccgccctcc

SEQ ID NO: 5522942 - DNA, 13 bp, Homo sapiens
tctctgtgagaag

SEQ ID NO: 5522943 - DNA, 21 bp, Homo sapiens
tctctgtgctttgactcacct

SEQ ID NO: 5522944 - DNA, 24 bp, Homo sapiens
tctctgtggaaaagccatctcagg

SEQ ID NO: 5522945 - DNA, 15 bp, Homo sapiens
tctctgtggctccaa

SEQ ID NO: 5522946 - DNA, 18 bp, Homo sapiens
tctctgtggctccaggcc

SEQ ID NO: 5522947 - DNA, 16 bp, Homo sapiens
tctctgtgtctaagat

SEQ ID NO: 5522948 - DNA, 23 bp, Homo sapiens
tctctgtgtctaagattctagat

SEQ ID NO: 5522949 - DNA, 18 bp, Homo sapiens
tctctgtgtgcacaaata

SEQ ID NO: 5522950 - DNA, 22 bp, Homo sapiens
tctctgtgtgttttctttggtt

SEQ ID NO: 5522951 - DNA, 10 bp, Homo sapiens
tctctgtgtt

SEQ ID NO: 5522952 - DNA, 13 bp, Homo sapiens
tctctgttcattt

SEQ ID NO: 5522953 - DNA, 16 bp, Homo sapiens
tctctgttcatttcct

SEQ ID NO: 5522954 - DNA, 18 bp, Homo sapiens
tctctgttcatttcctca

SEQ ID NO: 5522955 - DNA, 12 bp, Homo sapiens
tctctgttccaa

SEQ ID NO: 5522956 - DNA, 14 bp, Homo sapiens
tctctgttccaagt

SEQ ID NO: 5522957 - DNA, 18 bp, Homo sapiens
tctctgttccaagtgtgt

SEQ ID NO: 5522958 - DNA, 22 bp, Homo sapiens
tctctgttccaagtgtgtgtgc

SEQ ID NO: 5522959 - DNA, 22 bp, Homo sapiens
tctctgttccatgtctccttta

SEQ ID NO: 5522960 - DNA, 20 bp, Homo sapiens
tctctgttccttttgcaaac

SEQ ID NO: 5522961 - DNA, 22 bp, Homo sapiens
tctctgttctacccgttccaaa

SEQ ID NO: 5522962 - DNA, 17 bp, Homo sapiens
tctctgttcttcatctg

SEQ ID NO: 5522963 - DNA, 22 bp, Homo sapiens
tctctgttctttcatactacat

SEQ ID NO: 5522964 - DNA, 14 bp, Homo sapiens
tctctgttcttttc

SEQ ID NO: 5522965 - DNA, 17 bp, Homo sapiens
tctctgttggtccactg

SEQ ID NO: 5522966 - DNA, 23 bp, Homo sapiens
tctctgttggtccactgtgttta

SEQ ID NO: 5522967 - DNA, 15 bp, Homo sapiens
tctctgtttcctgaa

SEQ ID NO: 5522968 - DNA, 13 bp, Homo sapiens
tctctgtttgctt

SEQ ID NO: 5522969 - DNA, 15 bp, Homo sapiens
tctctgtttggtaag

SEQ ID NO: 5522970 - DNA, 18 bp, Homo sapiens
tctcttaaatataacact

SEQ ID NO: 5522971 - DNA, 17 bp, Homo sapiens
tctcttaagctgcccaa

SEQ ID NO: 5522972 - DNA, 21 bp, Homo sapiens
tctcttaatcactactgtatg

SEQ ID NO: 5522973 - DNA, 14 bp, Homo sapiens
tctcttacattttc

SEQ ID NO: 5522974 - DNA, 14 bp, Homo sapiens
tctcttacccagaa

SEQ ID NO: 5522975 - DNA, 15 bp, Homo sapiens
tctcttacccttctg

SEQ ID NO: 5522976 - DNA, 18 bp, Homo sapiens
tctcttacccttctgtgc

SEQ ID NO: 5522977 - DNA, 23 bp, Homo sapiens
tctcttacccttctgtgcccagc

SEQ ID NO: 5522978 - DNA, 21 bp, Homo sapiens
tctcttaccgcgagactgaga

SEQ ID NO: 5522979 - DNA, 22 bp, Homo sapiens
tctcttacgcccaacccttccc

SEQ ID NO: 5522980 - DNA, 15 bp, Homo sapiens
tctcttactgcagta

SEQ ID NO: 5522981 - DNA, 12 bp, Homo sapiens
tctcttactgcc

SEQ ID NO: 5522982 - DNA, 19 bp, Homo sapiens
tctcttacttgatagactt

SEQ ID NO: 5522983 - DNA, 22 bp, Homo sapiens
tctcttactttttgtaaatgct

SEQ ID NO: 5522984 - DNA, 12 bp, Homo sapiens
tctcttagaaaa

SEQ ID NO: 5522985 - DNA, 20 bp, Homo sapiens
tctcttagaatttgtttcat

SEQ ID NO: 5522986 - DNA, 21 bp, Homo sapiens
tctcttagagattttcatttt

SEQ ID NO: 5522987 - DNA, 16 bp, Homo sapiens
tctcttagctcccctc

SEQ ID NO: 5522988 - DNA, 19 bp, Homo sapiens
tctcttagctcccctccaa

SEQ ID NO: 5522989 - DNA, 21 bp, Homo sapiens
tctcttatagaatatttatta

SEQ ID NO: 5522990 - DNA, 21 bp, Homo sapiens
tctcttatatagtattcattt

SEQ ID NO: 5522991 - DNA, 17 bp, Homo sapiens
tctcttatatgccagaa

SEQ ID NO: 5522992 - DNA, 22 bp, Homo sapiens
tctcttatcctctctctcttct

SEQ ID NO: 5522993 - DNA, 13 bp, Homo sapiens
tctcttatctgtg

SEQ ID NO: 5522994 - DNA, 16 bp, Homo sapiens
tctcttatcttacgaa

SEQ ID NO: 5522995 - DNA, 21 bp, Homo sapiens
tctcttatcttacgaaaaaat

SEQ ID NO: 5522996 - DNA, 21 bp, Homo sapiens
tctcttattgttctttcatat

SEQ ID NO: 5522997 - DNA, 15 bp, Homo sapiens
tctcttcaataaacc

SEQ ID NO: 5522998 - DNA, 17 bp, Homo sapiens
tctcttcaataaaccac

SEQ ID NO: 5522999 - DNA, 23 bp, Homo sapiens
tctcttcaataaaccacaagcat

SEQ ID NO: 5523000 - DNA, 19 bp, Homo sapiens
tctcttcaatcactagtca

SEQ ID NO: 5523001 - DNA, 13 bp, Homo sapiens
tctcttcaatgaa

SEQ ID NO: 5523002 - DNA, 22 bp, Homo sapiens
tctcttcactaccctgattctt

SEQ ID NO: 5523003 - DNA, 13 bp, Homo sapiens
tctcttcactccc

SEQ ID NO: 5523004 - DNA, 12 bp, Homo sapiens
tctcttcactgc

SEQ ID NO: 5523005 - DNA, 23 bp, Homo sapiens
tctcttcagcccctagtgctatt

SEQ ID NO: 5523006 - DNA, 24 bp, Homo sapiens
tctcttcaggaggccctggtgtca

SEQ ID NO: 5523007 - DNA, 13 bp, Homo sapiens
tctcttcaggttc

SEQ ID NO: 5523008 - DNA, 15 bp, Homo sapiens
tctcttcaggttctt

SEQ ID NO: 5523009 - DNA, 13 bp, Homo sapiens
tctcttcagtctc

SEQ ID NO: 5523010 - DNA, 17 bp, Homo sapiens
tctcttcagtgtgttga

SEQ ID NO: 5523011 - DNA, 16 bp, Homo sapiens
tctcttcatgcttgac

SEQ ID NO: 5523012 - DNA, 15 bp, Homo sapiens
tctcttcatgtctat

SEQ ID NO: 5523013 - DNA, 16 bp, Homo sapiens
tctcttcattcaaact

SEQ ID NO: 5523014 - DNA, 18 bp, Homo sapiens
tctcttccaagtccttta

SEQ ID NO: 5523015 - DNA, 19 bp, Homo sapiens
tctcttccaagtcctttat

SEQ ID NO: 5523016 - DNA, 12 bp, Homo sapiens
tctcttccacag

SEQ ID NO: 5523017 - DNA, 13 bp, Homo sapiens
tctcttccacagt

SEQ ID NO: 5523018 - DNA, 20 bp, Homo sapiens
tctcttccacctgctggcct

SEQ ID NO: 5523019 - DNA, 15 bp, Homo sapiens
tctcttccaggcagc

SEQ ID NO: 5523020 - DNA, 16 bp, Homo sapiens
tctcttccaggcagcc

SEQ ID NO: 5523021 - DNA, 12 bp, Homo sapiens
tctcttcccagg

SEQ ID NO: 5523022 - DNA, 15 bp, Homo sapiens
tctcttccccagaga

SEQ ID NO: 5523023 - DNA, 13 bp, Homo sapiens
tctcttcccctct

SEQ ID NO: 5523024 - DNA, 16 bp, Homo sapiens
tctcttccccttccct

SEQ ID NO: 5523025 - DNA, 20 bp, Homo sapiens
tctcttccctaatcctccaa

SEQ ID NO: 5523026 - DNA, 12 bp, Homo sapiens
tctcttccctga

SEQ ID NO: 5523027 - DNA, 15 bp, Homo sapiens
tctcttcccttccca

SEQ ID NO: 5523028 - DNA, 23 bp, Homo sapiens
tctcttccctttccccagcatca

SEQ ID NO: 5523029 - DNA, 21 bp, Homo sapiens
tctcttccctttgtgtatctt

SEQ ID NO: 5523030 - DNA, 22 bp, Homo sapiens
tctcttcccttttttttctggg

SEQ ID NO: 5523031 - DNA, 12 bp, Homo sapiens
tctcttcctctg

SEQ ID NO: 5523032 - DNA, 16 bp, Homo sapiens
tctcttcctctgttct

SEQ ID NO: 5523033 - DNA, 14 bp, Homo sapiens
tctcttcctgcccc

SEQ ID NO: 5523034 - DNA, 22 bp, Homo sapiens
tctcttcctgcccctctttctc

SEQ ID NO: 5523035 - DNA, 19 bp, Homo sapiens
tctcttccttcggtctttt

SEQ ID NO: 5523036 - DNA, 22 bp, Homo sapiens
tctcttccttcggtcttttgta

SEQ ID NO: 5523037 - DNA, 12 bp, Homo sapiens
tctcttccttga

SEQ ID NO: 5523038 - DNA, 21 bp, Homo sapiens
tctcttccttgacctgcattg

SEQ ID NO: 5523039 - DNA, 11 bp, Homo sapiens
tctcttccttt

SEQ ID NO: 5523040 - DNA, 14 bp, Homo sapiens
tctcttcctttcct

SEQ ID NO: 5523041 - DNA, 18 bp, Homo sapiens
tctcttcggtggccttga

SEQ ID NO: 5523042 - DNA, 13 bp, Homo sapiens
tctcttctaacat

SEQ ID NO: 5523043 - DNA, 17 bp, Homo sapiens
tctcttctaacatgaaa

SEQ ID NO: 5523044 - DNA, 21 bp, Homo sapiens
tctcttctaacatgaaatata

SEQ ID NO: 5523045 - DNA, 21 bp, Homo sapiens
tctcttctcactttccttttc

SEQ ID NO: 5523046 - DNA, 13 bp, Homo sapiens
tctcttctcagag

SEQ ID NO: 5523047 - DNA, 14 bp, Homo sapiens
tctcttctcagagt

SEQ ID NO: 5523048 - DNA, 14 bp, Homo sapiens
tctcttctccactg

SEQ ID NO: 5523049 - DNA, 16 bp, Homo sapiens
tctcttctcccagaat

SEQ ID NO: 5523050 - DNA, 11 bp, Homo sapiens
tctcttctcct

SEQ ID NO: 5523051 - DNA, 13 bp, Homo sapiens
tctcttctcctgt

SEQ ID NO: 5523052 - DNA, 21 bp, Homo sapiens
tctcttctctattcctgaccc

SEQ ID NO: 5523053 - DNA, 14 bp, Homo sapiens
tctcttctctcttc

SEQ ID NO: 5523054 - DNA, 21 bp, Homo sapiens
tctcttctgagctatttcatc

SEQ ID NO: 5523055 - DNA, 17 bp, Homo sapiens
tctcttctgcacagctc

SEQ ID NO: 5523056 - DNA, 19 bp, Homo sapiens
tctgagacaaaagaaaaaa

SEQ ID NO: 5523057 - DNA, 22 bp, Homo sapiens
tctgagaccaaaattttgtccc

SEQ ID NO: 5523058 - DNA, 20 bp, Homo sapiens
tctgagacccttttctcagg

SEQ ID NO: 5523059 - DNA, 23 bp, Homo sapiens
tctgagacggatggaaggagaga

SEQ ID NO: 5523060 - DNA, 19 bp, Homo sapiens
tctgagactaaatgagagg

SEQ ID NO: 5523061 - DNA, 14 bp, Homo sapiens
tctgagactcacag

SEQ ID NO: 5523062 - DNA, 23 bp, Homo sapiens
tctgagactcgcgacaatgcaaa

SEQ ID NO: 5523063 - DNA, 22 bp, Homo sapiens
tctgagactctcttaggagcag

SEQ ID NO: 5523064 - DNA, 20 bp, Homo sapiens
tctgagactctttagagcag

SEQ ID NO: 5523065 - DNA, 21 bp, Homo sapiens
tctgagactctttagagcagc

SEQ ID NO: 5523066 - DNA, 20 bp, Homo sapiens
tctgagagaggccattcttt

SEQ ID NO: 5523067 - DNA, 23 bp, Homo sapiens
tctgagagaggctaaaatgtttt

SEQ ID NO: 5523068 - DNA, 15 bp, Homo sapiens
tctgagagctgtttt

SEQ ID NO: 5523069 - DNA, 13 bp, Homo sapiens
tctgagaggccct

SEQ ID NO: 5523070 - DNA, 14 bp, Homo sapiens
tctgagaggccctg

SEQ ID NO: 5523071 - DNA, 14 bp, Homo sapiens
tctgagaggctctc

SEQ ID NO: 5523072 - DNA, 20 bp, Homo sapiens
tctgagaggctctccgtgca

SEQ ID NO: 5523073 - DNA, 21 bp, Homo sapiens
tctgagagtctagattctctg

SEQ ID NO: 5523074 - DNA, 21 bp, Homo sapiens
tctgagagtgaaaccatgact

SEQ ID NO: 5523075 - DNA, 11 bp, Homo sapiens
tctgagatcag

SEQ ID NO: 5523076 - DNA, 17 bp, Homo sapiens
tctgagatccagcacaa

SEQ ID NO: 5523077 - DNA, 17 bp, Homo sapiens
tctgagatctccctcca

SEQ ID NO: 5523078 - DNA, 21 bp, Homo sapiens
tctgagatctccctccaggga

SEQ ID NO: 5523079 - DNA, 17 bp, Homo sapiens
tctgagatgctaattta

SEQ ID NO: 5523080 - DNA, 15 bp, Homo sapiens
tctgagatgctcact

SEQ ID NO: 5523081 - DNA, 19 bp, Homo sapiens
tctgagatgctcactttat

SEQ ID NO: 5523082 - DNA, 21 bp, Homo sapiens
tctgagatgctcactttatta

SEQ ID NO: 5523083 - DNA, 22 bp, Homo sapiens
tctgagatggctcccaggggct

SEQ ID NO: 5523084 - DNA, 14 bp, Homo sapiens
tctgagatgtggag

SEQ ID NO: 5523085 - DNA, 20 bp, Homo sapiens
tctgagattattttaatcta

SEQ ID NO: 5523086 - DNA, 22 bp, Homo sapiens
tctgagcaaactatttgcgact

SEQ ID NO: 5523087 - DNA, 15 bp, Homo sapiens
tctgagcaaaggccc

SEQ ID NO: 5523088 - DNA, 16 bp, Homo sapiens
tctgagcaaaggccct

SEQ ID NO: 5523089 - DNA, 15 bp, Homo sapiens
tctgagcaagagctg

SEQ ID NO: 5523090 - DNA, 16 bp, Homo sapiens
tctgagcaagagctgg

SEQ ID NO: 5523091 - DNA, 17 bp, Homo sapiens
tctgagcaagagctggc

SEQ ID NO: 5523092 - DNA, 22 bp, Homo sapiens
tctgagcaagaggattttgcgt

SEQ ID NO: 5523093 - DNA, 15 bp, Homo sapiens
tctgagcacaggtga

SEQ ID NO: 5523094 - DNA, 18 bp, Homo sapiens
tctgagcacaggtgacag

SEQ ID NO: 5523095 - DNA, 21 bp, Homo sapiens
tctgagcacatagtgtcctgc

SEQ ID NO: 5523096 - DNA, 14 bp, Homo sapiens
tctgagcaccccct

SEQ ID NO: 5523097 - DNA, 15 bp, Homo sapiens
tctgagcaccccctc

SEQ ID NO: 5523098 - DNA, 19 bp, Homo sapiens
tctgagcaccgaatattga

SEQ ID NO: 5523099 - DNA, 22 bp, Homo sapiens
tctgagcactgtttatacactg

SEQ ID NO: 5523100 - DNA, 19 bp, Homo sapiens
tctgagcagcctctgccag

SEQ ID NO: 5523101 - DNA, 18 bp, Homo sapiens
tctgagcaggggcaggcg

SEQ ID NO: 5523102 - DNA, 21 bp, Homo sapiens
tctgagcaggggcaggcgcag

SEQ ID NO: 5523103 - DNA, 22 bp, Homo sapiens
tctgagcaggtacatttctgat

SEQ ID NO: 5523104 - DNA, 22 bp, Homo sapiens
tctgagcagtcagggtgggaag

SEQ ID NO: 5523105 - DNA, 16 bp, Homo sapiens
tctgagcagtgcctct

SEQ ID NO: 5523106 - DNA, 16 bp, Homo sapiens
tctgagccaagggagg

SEQ ID NO: 5523107 - DNA, 17 bp, Homo sapiens
tctgagccaagggaggg

SEQ ID NO: 5523108 - DNA, 12 bp, Homo sapiens
tctgagccacag

SEQ ID NO: 5523109 - DNA, 15 bp, Homo sapiens
tctgagccacagcag

SEQ ID NO: 5523110 - DNA, 21 bp, Homo sapiens
tctgagccacagcagcatttt

SEQ ID NO: 5523111 - DNA, 17 bp, Homo sapiens
tctgagccagattacag

SEQ ID NO: 5523112 - DNA, 20 bp, Homo sapiens
tctgagccagtgctttaatg

SEQ ID NO: 5523113 - DNA, 22 bp, Homo sapiens
tctgagccagttcagtacctgg

SEQ ID NO: 5523114 - DNA, 13 bp, Homo sapiens
tctgagcccagct

SEQ ID NO: 5523115 - DNA, 14 bp, Homo sapiens
tctgagcccagctg

SEQ ID NO: 5523116 - DNA, 16 bp, Homo sapiens
tctgagcccagctgcc

SEQ ID NO: 5523117 - DNA, 12 bp, Homo sapiens
tctgagcccagg

SEQ ID NO: 5523118 - DNA, 15 bp, Homo sapiens
tctgagcccaggccg

SEQ ID NO: 5523119 - DNA, 12 bp, Homo sapiens
tctgagccccag

SEQ ID NO: 5523120 - DNA, 17 bp, Homo sapiens
tctgagccccagcccca

SEQ ID NO: 5523121 - DNA, 17 bp, Homo sapiens
tctgagccccctgtgcc

SEQ ID NO: 5523122 - DNA, 18 bp, Homo sapiens
tctgagccccctgtgccc

SEQ ID NO: 5523123 - DNA, 20 bp, Homo sapiens
tctgagccccctgtgcccac

SEQ ID NO: 5523124 - DNA, 22 bp, Homo sapiens
tctgagccccctgtgcccaccc

SEQ ID NO: 5523125 - DNA, 15 bp, Homo sapiens
tctgagcccctggga

SEQ ID NO: 5523126 - DNA, 13 bp, Homo sapiens
tctgagcccgggc

SEQ ID NO: 5523127 - DNA, 15 bp, Homo sapiens
tctgagcccgggctg

SEQ ID NO: 5523128 - DNA, 18 bp, Homo sapiens
tctgagcccgggctgcct

SEQ ID NO: 5523129 - DNA, 17 bp, Homo sapiens
tctgagccctcaaagtg

SEQ ID NO: 5523130 - DNA, 16 bp, Homo sapiens
tctgagccctgccctc

SEQ ID NO: 5523131 - DNA, 17 bp, Homo sapiens
tctgagccctgccctca

SEQ ID NO: 5523132 - DNA, 20 bp, Homo sapiens
tctgagccctgccctcactc

SEQ ID NO: 5523133 - DNA, 15 bp, Homo sapiens
tctgagccctggtgt

SEQ ID NO: 5523134 - DNA, 23 bp, Homo sapiens
tctgagccttagtttcagctgac

SEQ ID NO: 5523135 - DNA, 18 bp, Homo sapiens
tctgagcggccgcctgtc

SEQ ID NO: 5523136 - DNA, 22 bp, Homo sapiens
tctgagcggccgcctgtccttg

SEQ ID NO: 5523137 - DNA, 23 bp, Homo sapiens
tctgagcggcgcagagccctcca

SEQ ID NO: 5523138 - DNA, 16 bp, Homo sapiens
tctgagcgggaggcag

SEQ ID NO: 5523139 - DNA, 17 bp, Homo sapiens
tctgagcgggaggcaga

SEQ ID NO: 5523140 - DNA, 22 bp, Homo sapiens
tctgagcgggaggcagagtttg

SEQ ID NO: 5523141 - DNA, 19 bp, Homo sapiens
tctgagcgtttaaagtact

SEQ ID NO: 5523142 - DNA, 9 bp, Homo sapiens
tctgagcta

SEQ ID NO: 5523143 - DNA, 20 bp, Homo sapiens
tctgagctatttcatctatt

SEQ ID NO: 5523144 - DNA, 11 bp, Homo sapiens
tctgagctcat

SEQ ID NO: 5523145 - DNA, 18 bp, Homo sapiens
tctgagctccacctctgg

SEQ ID NO: 5523146 - DNA, 20 bp, Homo sapiens
tctgagctccacctctggtg

SEQ ID NO: 5523147 - DNA, 13 bp, Homo sapiens
tctgagctccagc

SEQ ID NO: 5523148 - DNA, 16 bp, Homo sapiens
tctgagctgagccagg

SEQ ID NO: 5523149 - DNA, 17 bp, Homo sapiens
tctgagctgcagcctgg

SEQ ID NO: 5523150 - DNA, 21 bp, Homo sapiens
tctgagctgcagcctggctgg

SEQ ID NO: 5523151 - DNA, 14 bp, Homo sapiens
tctgagctgccagt

SEQ ID NO: 5523152 - DNA, 14 bp, Homo sapiens
tctgagctgctcac

SEQ ID NO: 5523153 - DNA, 22 bp, Homo sapiens
tctgagctggcctctcactgcc

SEQ ID NO: 5523154 - DNA, 17 bp, Homo sapiens
tctgagctgtcccaagt

SEQ ID NO: 5523155 - DNA, 20 bp, Homo sapiens
tctgagctgttatcttgtgt

SEQ ID NO: 5523156 - DNA, 22 bp, Homo sapiens
tctgaggaaaatggaagaccta

SEQ ID NO: 5523157 - DNA, 21 bp, Homo sapiens
tctgaggaatcaacagggcag

SEQ ID NO: 5523158 - DNA, 16 bp, Homo sapiens
tctgaggaatccagac

SEQ ID NO: 5523159 - DNA, 16 bp, Homo sapiens
tctgaggaattctgta

SEQ ID NO: 5523160 - DNA, 23 bp, Homo sapiens
tctgaggacactaaccacgctgg

SEQ ID NO: 5523161 - DNA, 12 bp, Homo sapiens
tctgaggacaga

SEQ ID NO: 5523162 - DNA, 20 bp, Homo sapiens
tctgaggacagagcttgaag

SEQ ID NO: 5523163 - DNA, 21 bp, Homo sapiens
tctgaggacagagcttgaagc

SEQ ID NO: 5523164 - DNA, 21 bp, Homo sapiens
tctgaggacaggctctagaga

SEQ ID NO: 5523165 - DNA, 12 bp, Homo sapiens
tctgaggacatt

SEQ ID NO: 5523166 - DNA, 15 bp, Homo sapiens
tctgaggaccgctga

SEQ ID NO: 5523167 - DNA, 17 bp, Homo sapiens
tctgaggactcctgagg

SEQ ID NO: 5523168 - DNA, 14 bp, Homo sapiens
tctgaggactgtcc

SEQ ID NO: 5523169 - DNA, 15 bp, Homo sapiens
tctgaggagcccacg

SEQ ID NO: 5523170 - DNA, 16 bp, Homo sapiens
tctgaggagctgttac

SEQ ID NO: 5523171 - DNA, 17 bp, Homo sapiens
tctgaggaggaaataaa

SEQ ID NO: 5523172 - DNA, 23 bp, Homo sapiens
tctgaggagtaaaaagactactg

SEQ ID NO: 5523173 - DNA, 16 bp, Homo sapiens
tctgaggagtccaaaa

SEQ ID NO: 5523174 - DNA, 13 bp, Homo sapiens
tctgaggagtgga

SEQ ID NO: 5523175 - DNA, 22 bp, Homo sapiens
tctgaggataccttccatctca

SEQ ID NO: 5523176 - DNA, 22 bp, Homo sapiens
tctgaggatagtagttaaataa

SEQ ID NO: 5523177 - DNA, 19 bp, Homo sapiens
tctgaggcaaggcccagac

SEQ ID NO: 5523178 - DNA, 14 bp, Homo sapiens
tctgaggccagcct

SEQ ID NO: 5523179 - DNA, 17 bp, Homo sapiens
tctgaggccagcctggc

SEQ ID NO: 5523180 - DNA, 14 bp, Homo sapiens
tctgaggcccctgc

SEQ ID NO: 5523181 - DNA, 16 bp, Homo sapiens
tctgaggcccctgcct

SEQ ID NO: 5523182 - DNA, 12 bp, Homo sapiens
tctgaggcctca

SEQ ID NO: 5523183 - DNA, 21 bp, Homo sapiens
tctgaggcctcatccctcgga

SEQ ID NO: 5523184 - DNA, 13 bp, Homo sapiens
tctgaggcctgcc

SEQ ID NO: 5523185 - DNA, 13 bp, Homo sapiens
tctgaggctctcc

SEQ ID NO: 5523186 - DNA, 17 bp, Homo sapiens
tctgaggctgccccagg

SEQ ID NO: 5523187 - DNA, 14 bp, Homo sapiens
tctgaggcttccag

SEQ ID NO: 5523188 - DNA, 13 bp, Homo sapiens
tctgagggagagg

SEQ ID NO: 5523189 - DNA, 16 bp, Homo sapiens
tctgagggagaggctg

SEQ ID NO: 5523190 - DNA, 13 bp, Homo sapiens
tctgagggaggag

SEQ ID NO: 5523191 - DNA, 21 bp, Homo sapiens
tctgagggaggaggccacctc

SEQ ID NO: 5523192 - DNA, 15 bp, Homo sapiens
tctgagggcttcctt

SEQ ID NO: 5523193 - DNA, 20 bp, Homo sapiens
tctgagggcttgtagttctt

SEQ ID NO: 5523194 - DNA, 16 bp, Homo sapiens
tctgaggggagggggt

SEQ ID NO: 5523195 - DNA, 12 bp, Homo sapiens
tctgaggtcaat

SEQ ID NO: 5523196 - DNA, 17 bp, Homo sapiens
tctgaggtcaataaagc

SEQ ID NO: 5523197 - DNA, 23 bp, Homo sapiens
tctgaggtcaataaagcagagcc

SEQ ID NO: 5523198 - DNA, 14 bp, Homo sapiens
tctgaggtcctgag

SEQ ID NO: 5523199 - DNA, 16 bp, Homo sapiens
tctgaggtcctgagca

SEQ ID NO: 5523200 - DNA, 19 bp, Homo sapiens
tctgaggtgcactgggagg

SEQ ID NO: 5523201 - DNA, 21 bp, Homo sapiens
tctgaggtgcctgtcccaccc

SEQ ID NO: 5523202 - DNA, 15 bp, Homo sapiens
tctgaggttttattt

SEQ ID NO: 5523203 - DNA, 19 bp, Homo sapiens
tctgagtaagtgtgttcat

SEQ ID NO: 5523204 - DNA, 16 bp, Homo sapiens
tctgagtagctttaca

SEQ ID NO: 5523205 - DNA, 17 bp, Homo sapiens
tctgagtagctttacac

SEQ ID NO: 5523206 - DNA, 20 bp, Homo sapiens
tctgagtaggtctgggatgg

SEQ ID NO: 5523207 - DNA, 16 bp, Homo sapiens
tctgagtattctcata

SEQ ID NO: 5523208 - DNA, 13 bp, Homo sapiens
tctgagtcaaatc

SEQ ID NO: 5523209 - DNA, 18 bp, Homo sapiens
tctgagtcaaatccagtg

SEQ ID NO: 5523210 - DNA, 19 bp, Homo sapiens
tctgagtcaaatccagtgg

SEQ ID NO: 5523211 - DNA, 16 bp, Homo sapiens
tctgagtcaactcctt

SEQ ID NO: 5523212 - DNA, 20 bp, Homo sapiens
tctgagtcacaggtgtggga

SEQ ID NO: 5523213 - DNA, 21 bp, Homo sapiens
tctgagtcacaggtgtgggat

SEQ ID NO: 5523214 - DNA, 13 bp, Homo sapiens
tctgagtcagaga

SEQ ID NO: 5523215 - DNA, 15 bp, Homo sapiens
tctgagtcagagcca

SEQ ID NO: 5523216 - DNA, 23 bp, Homo sapiens
tctgagtcagctgaccccctccc

SEQ ID NO: 5523217 - DNA, 19 bp, Homo sapiens
tctgagtcatcaaaaagag

SEQ ID NO: 5523218 - DNA, 22 bp, Homo sapiens
tctgagtcatcaaaaagagtct

SEQ ID NO: 5523219 - DNA, 14 bp, Homo sapiens
tctgagtcccagga

SEQ ID NO: 5523220 - DNA, 23 bp, Homo sapiens
tctgagtcccaggagctgcccag

SEQ ID NO: 5523221 - DNA, 24 bp, Homo sapiens
tctgagtcccaggagctgcccaga

SEQ ID NO: 5523222 - DNA, 20 bp, Homo sapiens
tctgagtcccgtggggcccc

SEQ ID NO: 5523223 - DNA, 12 bp, Homo sapiens
tctgagtcctgt

SEQ ID NO: 5523224 - DNA, 14 bp, Homo sapiens
tctgagtcctgtct

SEQ ID NO: 5523225 - DNA, 18 bp, Homo sapiens
tctgagtcctgtctctgc

SEQ ID NO: 5523226 - DNA, 22 bp, Homo sapiens
tctgagtcctgtctctgcctgc

SEQ ID NO: 5523227 - DNA, 20 bp, Homo sapiens
tctgagtctatgttcaaaga

SEQ ID NO: 5523228 - DNA, 17 bp, Homo sapiens
tctgagtctgagtcctg

SEQ ID NO: 5523229 - DNA, 13 bp, Homo sapiens
tctgagtgaacct

SEQ ID NO: 5523230 - DNA, 18 bp, Homo sapiens
tctgagtgaacctgtata

SEQ ID NO: 5523231 - DNA, 12 bp, Homo sapiens
tctgagtgaatg

SEQ ID NO: 5523232 - DNA, 23 bp, Homo sapiens
tctgagtgcaaacttcagagttc

SEQ ID NO: 5523233 - DNA, 20 bp, Homo sapiens
tctgcgggggcagtgctcac

SEQ ID NO: 5523234 - DNA, 16 bp, Homo sapiens
tctgcggtgaggcagg

SEQ ID NO: 5523235 - DNA, 15 bp, Homo sapiens
tctgcgtcaggcacg

SEQ ID NO: 5523236 - DNA, 23 bp, Homo sapiens
tctgcgtcaggcacgtctcctgc

SEQ ID NO: 5523237 - DNA, 17 bp, Homo sapiens
tctgcgtcatgcttgtg

SEQ ID NO: 5523238 - DNA, 18 bp, Homo sapiens
tctgcgtccaccaggcct

SEQ ID NO: 5523239 - DNA, 19 bp, Homo sapiens
tctgcgtccaccaggcctc

SEQ ID NO: 5523240 - DNA, 20 bp, Homo sapiens
tctgcgtccaccaggcctca

SEQ ID NO: 5523241 - DNA, 13 bp, Homo sapiens
tctgcgtcccact

SEQ ID NO: 5523242 - DNA, 18 bp, Homo sapiens
tctgcgtcccccagccct

SEQ ID NO: 5523243 - DNA, 22 bp, Homo sapiens
tctgcgtcccccagccctcagg

SEQ ID NO: 5523244 - DNA, 19 bp, Homo sapiens
tctgcgtctatcctgtgta

SEQ ID NO: 5523245 - DNA, 16 bp, Homo sapiens
tctgcgtgacaataaa

SEQ ID NO: 5523246 - DNA, 16 bp, Homo sapiens
tctgcgtgcagggaca

SEQ ID NO: 5523247 - DNA, 22 bp, Homo sapiens
tctgcgtggttcctttctcagc

SEQ ID NO: 5523248 - DNA, 20 bp, Homo sapiens
tctgcgtgtcacctgtgctt

SEQ ID NO: 5523249 - DNA, 21 bp, Homo sapiens
tctgcgttggcttctccctgg

SEQ ID NO: 5523250 - DNA, 22 bp, Homo sapiens
tctgcgttggcttctccctggg

SEQ ID NO: 5523251 - DNA, 15 bp, Homo sapiens
tctgctaaataaaca

SEQ ID NO: 5523252 - DNA, 18 bp, Homo sapiens
tctgctaaatatcaccta

SEQ ID NO: 5523253 - DNA, 17 bp, Homo sapiens
tctgctaaattgatgtt

SEQ ID NO: 5523254 - DNA, 19 bp, Homo sapiens
tctgctaaattgatgttga

SEQ ID NO: 5523255 - DNA, 21 bp, Homo sapiens
tctgctaaattgatgttgatg

SEQ ID NO: 5523256 - DNA, 15 bp, Homo sapiens
tctgctaaatttcaa

SEQ ID NO: 5523257 - DNA, 23 bp, Homo sapiens
tctgctaacatggtacactgcat

SEQ ID NO: 5523258 - DNA, 21 bp, Homo sapiens
tctgctaacttggagccccag

SEQ ID NO: 5523259 - DNA, 14 bp, Homo sapiens
tctgctaataaaac

SEQ ID NO: 5523260 - DNA, 16 bp, Homo sapiens
tctgctaatgtaaact

SEQ ID NO: 5523261 - DNA, 21 bp, Homo sapiens
tctgctaccttgccccaaccc

SEQ ID NO: 5523262 - DNA, 14 bp, Homo sapiens
tctgctactgaggc

SEQ ID NO: 5523263 - DNA, 15 bp, Homo sapiens
tctgctactgaggca

SEQ ID NO: 5523264 - DNA, 13 bp, Homo sapiens
tctgctagactcc

SEQ ID NO: 5523265 - DNA, 18 bp, Homo sapiens
tctgctagactcctcagg

SEQ ID NO: 5523266 - DNA, 20 bp, Homo sapiens
tctgctaggcgctggggaga

SEQ ID NO: 5523267 - DNA, 21 bp, Homo sapiens
tctgctaggcgctggggagac

SEQ ID NO: 5523268 - DNA, 14 bp, Homo sapiens
tctgctatatttgt

SEQ ID NO: 5523269 - DNA, 17 bp, Homo sapiens
tctgctatattttcatg

SEQ ID NO: 5523270 - DNA, 17 bp, Homo sapiens
tctgctatgcattttct

SEQ ID NO: 5523271 - DNA, 13 bp, Homo sapiens
tctgctatgtctg

SEQ ID NO: 5523272 - DNA, 16 bp, Homo sapiens
tctgctatgtgacttg

SEQ ID NO: 5523273 - DNA, 19 bp, Homo sapiens
tctgctcaatgaaaccttc

SEQ ID NO: 5523274 - DNA, 12 bp, Homo sapiens
tctgctcaatgc

SEQ ID NO: 5523275 - DNA, 17 bp, Homo sapiens
tctgctcacattccctc

SEQ ID NO: 5523276 - DNA, 23 bp, Homo sapiens
tctgctcacattccctctcatcc

SEQ ID NO: 5523277 - DNA, 19 bp, Homo sapiens
tctgctcactttaaacctg

SEQ ID NO: 5523278 - DNA, 13 bp, Homo sapiens
tctgctcagaggc

SEQ ID NO: 5523279 - DNA, 18 bp, Homo sapiens
tctgctcagatagaatga

SEQ ID NO: 5523280 - DNA, 16 bp, Homo sapiens
tctgctcagcagctat

SEQ ID NO: 5523281 - DNA, 16 bp, Homo sapiens
tctgctcagcaggccc

SEQ ID NO: 5523282 - DNA, 16 bp, Homo sapiens
tctgctcagccaagct

SEQ ID NO: 5523283 - DNA, 13 bp, Homo sapiens
tctgctcagccct

SEQ ID NO: 5523284 - DNA, 15 bp, Homo sapiens
tctgctcagccctgg

SEQ ID NO: 5523285 - DNA, 16 bp, Homo sapiens
tctgctcagccctgga

SEQ ID NO: 5523286 - DNA, 19 bp, Homo sapiens
tctgctcagccctggaggt

SEQ ID NO: 5523287 - DNA, 14 bp, Homo sapiens
tctgctcagcttct

SEQ ID NO: 5523288 - DNA, 22 bp, Homo sapiens
tctgctcaggagacctggagga

SEQ ID NO: 5523289 - DNA, 14 bp, Homo sapiens
tctgctcaggcctc

SEQ ID NO: 5523290 - DNA, 18 bp, Homo sapiens
tctgctcaggtaaatctt

SEQ ID NO: 5523291 - DNA, 19 bp, Homo sapiens
tctgctcataggacctgca

SEQ ID NO: 5523292 - DNA, 23 bp, Homo sapiens
tctgctcatcattctctgtctca

SEQ ID NO: 5523293 - DNA, 18 bp, Homo sapiens
tctgctcatctacacata

SEQ ID NO: 5523294 - DNA, 16 bp, Homo sapiens
tctgctcatgggtggc

SEQ ID NO: 5523295 - DNA, 15 bp, Homo sapiens
tctgctcattctaat

SEQ ID NO: 5523296 - DNA, 21 bp, Homo sapiens
tctgctccacagaaaccctgt

SEQ ID NO: 5523297 - DNA, 12 bp, Homo sapiens
tctgctccaccc

SEQ ID NO: 5523298 - DNA, 20 bp, Homo sapiens
tctgctccacccttggcctg

SEQ ID NO: 5523299 - DNA, 21 bp, Homo sapiens
tctgctccacctttcagccca

SEQ ID NO: 5523300 - DNA, 23 bp, Homo sapiens
tctgctccacctttcagcccacg

SEQ ID NO: 5523301 - DNA, 14 bp, Homo sapiens
tctgctccagacag

SEQ ID NO: 5523302 - DNA, 21 bp, Homo sapiens
tctgctccagcaactgccctt

SEQ ID NO: 5523303 - DNA, 22 bp, Homo sapiens
tctgctccagcaactgcccttc

SEQ ID NO: 5523304 - DNA, 13 bp, Homo sapiens
tctgctccagccc

SEQ ID NO: 5523305 - DNA, 14 bp, Homo sapiens
tctgctccagcccc

SEQ ID NO: 5523306 - DNA, 23 bp, Homo sapiens
tctgctccagcccctttgcctct

SEQ ID NO: 5523307 - DNA, 19 bp, Homo sapiens
tctgctccatcggggcagg

SEQ ID NO: 5523308 - DNA, 20 bp, Homo sapiens
tctgctcccaaggggcctga

SEQ ID NO: 5523309 - DNA, 19 bp, Homo sapiens
tctgctcccaattcacctc

SEQ ID NO: 5523310 - DNA, 13 bp, Homo sapiens
tctgctcccaccc

SEQ ID NO: 5523311 - DNA, 15 bp, Homo sapiens
tctgctcccacccca

SEQ ID NO: 5523312 - DNA, 18 bp, Homo sapiens
tctgctcccaccccagaa

SEQ ID NO: 5523313 - DNA, 23 bp, Homo sapiens
tctgctcccaccccagaaatcac

SEQ ID NO: 5523314 - DNA, 20 bp, Homo sapiens
tctgctcccagcccctacct

SEQ ID NO: 5523315 - DNA, 14 bp, Homo sapiens
tctgctccccagga

SEQ ID NO: 5523316 - DNA, 16 bp, Homo sapiens
tctgctccccagggga

SEQ ID NO: 5523317 - DNA, 16 bp, Homo sapiens
tctgctcccccttttc

SEQ ID NO: 5523318 - DNA, 22 bp, Homo sapiens
tctgctcccctaaagcctcaaa

SEQ ID NO: 5523319 - DNA, 12 bp, Homo sapiens
tctgctccgtgt

SEQ ID NO: 5523320 - DNA, 20 bp, Homo sapiens
tctgctccgtgtgtctcatg

SEQ ID NO: 5523321 - DNA, 23 bp, Homo sapiens
tctgctcctacatccagctcctc

SEQ ID NO: 5523322 - DNA, 13 bp, Homo sapiens
tctgctcctcacc

SEQ ID NO: 5523323 - DNA, 20 bp, Homo sapiens
tctgctcctcccattcccct

SEQ ID NO: 5523324 - DNA, 12 bp, Homo sapiens
tctgctcctctc

SEQ ID NO: 5523325 - DNA, 17 bp, Homo sapiens
tctgctcctctccaggc

SEQ ID NO: 5523326 - DNA, 20 bp, Homo sapiens
tctgctcctctccaggcacc

SEQ ID NO: 5523327 - DNA, 14 bp, Homo sapiens
tctgctcctgcttt

SEQ ID NO: 5523328 - DNA, 22 bp, Homo sapiens
tctgctcctggagcctttgaat

SEQ ID NO: 5523329 - DNA, 13 bp, Homo sapiens
tctgctcctggga

SEQ ID NO: 5523330 - DNA, 11 bp, Homo sapiens
tctgctcctgt

SEQ ID NO: 5523331 - DNA, 13 bp, Homo sapiens
tctgctcctgtgg

SEQ ID NO: 5523332 - DNA, 12 bp, Homo sapiens
tctgctccttcc

SEQ ID NO: 5523333 - DNA, 15 bp, Homo sapiens
tctgctccttcccca

SEQ ID NO: 5523334 - DNA, 14 bp, Homo sapiens
tctgctccttcctg

SEQ ID NO: 5523335 - DNA, 18 bp, Homo sapiens
tctgctcgggcccaggcc

SEQ ID NO: 5523336 - DNA, 22 bp, Homo sapiens
tctgctcgggcccaggccatct

SEQ ID NO: 5523337 - DNA, 23 bp, Homo sapiens
tctgctctaagaagctgcaataa

SEQ ID NO: 5523338 - DNA, 20 bp, Homo sapiens
tctgctctagattcataaat

SEQ ID NO: 5523339 - DNA, 15 bp, Homo sapiens
tctgctctagccagg

SEQ ID NO: 5523340 - DNA, 16 bp, Homo sapiens
tctgctctagccagga

SEQ ID NO: 5523341 - DNA, 21 bp, Homo sapiens
tctgctctagggaatctggat

SEQ ID NO: 5523342 - DNA, 20 bp, Homo sapiens
tctgctctatactgtggcct

SEQ ID NO: 5523343 - DNA, 16 bp, Homo sapiens
tctgctctatgccagg

SEQ ID NO: 5523344 - DNA, 12 bp, Homo sapiens
tctgctctcagc

SEQ ID NO: 5523345 - DNA, 16 bp, Homo sapiens
tctgctctcagcttgt

SEQ ID NO: 5523346 - DNA, 20 bp, Homo sapiens
tctgctctcagcttgtgcct

SEQ ID NO: 5523347 - DNA, 13 bp, Homo sapiens
tctgctctccttc

SEQ ID NO: 5523348 - DNA, 19 bp, Homo sapiens
tctgctctccttcctggag

SEQ ID NO: 5523349 - DNA, 21 bp, Homo sapiens
tctgctctgccatcttcagga

SEQ ID NO: 5523350 - DNA, 18 bp, Homo sapiens
tctgctctgcctggagtg

SEQ ID NO: 5523351 - DNA, 12 bp, Homo sapiens
tctgctctggaa

SEQ ID NO: 5523352 - DNA, 22 bp, Homo sapiens
tctgctctgtgcactcacgctc

SEQ ID NO: 5523353 - DNA, 19 bp, Homo sapiens
tctgctctgtgcctgggat

SEQ ID NO: 5523354 - DNA, 13 bp, Homo sapiens
tctgctcttgcat

SEQ ID NO: 5523355 - DNA, 18 bp, Homo sapiens
tctgctctttctctgcca

SEQ ID NO: 5523356 - DNA, 20 bp, Homo sapiens
tctgctctttctctgccagt

SEQ ID NO: 5523357 - DNA, 16 bp, Homo sapiens
tctgctgaagacttgc

SEQ ID NO: 5523358 - DNA, 19 bp, Homo sapiens
tctgctgaagattcagttt

SEQ ID NO: 5523359 - DNA, 20 bp, Homo sapiens
tctgctgaatgtaaaagaaa

SEQ ID NO: 5523360 - DNA, 19 bp, Homo sapiens
tctgctgacagacacaggc

SEQ ID NO: 5523361 - DNA, 22 bp, Homo sapiens
tctgctgacagacacaggcccg

SEQ ID NO: 5523362 - DNA, 14 bp, Homo sapiens
tctgctgactgttt

SEQ ID NO: 5523363 - DNA, 18 bp, Homo sapiens
tctgctgacttctgagca

SEQ ID NO: 5523364 - DNA, 16 bp, Homo sapiens
tctgctgagcagccca

SEQ ID NO: 5523365 - DNA, 22 bp, Homo sapiens
tctgctgagctgggcccagccc

SEQ ID NO: 5523366 - DNA, 12 bp, Homo sapiens
tctgctgaggcc

SEQ ID NO: 5523367 - DNA, 17 bp, Homo sapiens
tctgctgaggccagagg

SEQ ID NO: 5523368 - DNA, 14 bp, Homo sapiens
tctgctgagtgctg

SEQ ID NO: 5523369 - DNA, 18 bp, Homo sapiens
tctgctgagtgctgggca

SEQ ID NO: 5523370 - DNA, 16 bp, Homo sapiens
tctgctgagttggcct

SEQ ID NO: 5523371 - DNA, 17 bp, Homo sapiens
tctgctgagttggcctg

SEQ ID NO: 5523372 - DNA, 18 bp, Homo sapiens
tctgctgagttggcctgg

SEQ ID NO: 5523373 - DNA, 15 bp, Homo sapiens
tctgctgatataata

SEQ ID NO: 5523374 - DNA, 16 bp, Homo sapiens
tctgctgatataatat

SEQ ID NO: 5523375 - DNA, 21 bp, Homo sapiens
tctgctgcacatagcagacta

SEQ ID NO: 5523376 - DNA, 17 bp, Homo sapiens
tctgctgcaccttgtaa

SEQ ID NO: 5523377 - DNA, 23 bp, Homo sapiens
tctgctgcagttaccacagcaac

SEQ ID NO: 5523378 - DNA, 15 bp, Homo sapiens
tctgctgcatcgctg

SEQ ID NO: 5523379 - DNA, 13 bp, Homo sapiens
tctgctgccagca

SEQ ID NO: 5523380 - DNA, 19 bp, Homo sapiens
tctgctgccagcacagtag

SEQ ID NO: 5523381 - DNA, 16 bp, Homo sapiens
tctgctgcccacggcc

SEQ ID NO: 5523382 - DNA, 17 bp, Homo sapiens
tctgctgcccacggcca

SEQ ID NO: 5523383 - DNA, 17 bp, Homo sapiens
tctgctgcccaggccac

SEQ ID NO: 5523384 - DNA, 18 bp, Homo sapiens
tctgctgcccaggccaca

SEQ ID NO: 5523385 - DNA, 21 bp, Homo sapiens
tctgctgcccaggccacagcc

SEQ ID NO: 5523386 - DNA, 11 bp, Homo sapiens
tctgctgcccc

SEQ ID NO: 5523387 - DNA, 14 bp, Homo sapiens
tctgctgccccctt

SEQ ID NO: 5523388 - DNA, 22 bp, Homo sapiens
tctgctgccccgcttccccaca

SEQ ID NO: 5523389 - DNA, 23 bp, Homo sapiens
tctgctgccccgcttccccacag

SEQ ID NO: 5523390 - DNA, 14 bp, Homo sapiens
tctgctgcccctgc

SEQ ID NO: 5523391 - DNA, 18 bp, Homo sapiens
tctgctgccctccatccc

SEQ ID NO: 5523392 - DNA, 13 bp, Homo sapiens
tctgctgccctct

SEQ ID NO: 5523393 - DNA, 16 bp, Homo sapiens
tctgctgccggctctg

SEQ ID NO: 5523394 - DNA, 22 bp, Homo sapiens
tctgctgcctccaagtcatggg

SEQ ID NO: 5523395 - DNA, 19 bp, Homo sapiens
tctgctgcctccctctgct

SEQ ID NO: 5523396 - DNA, 17 bp, Homo sapiens
tctgctgcctctgaaaa

SEQ ID NO: 5523397 - DNA, 20 bp, Homo sapiens
tctgctgcctctgaaaatat

SEQ ID NO: 5523398 - DNA, 14 bp, Homo sapiens
tctgctgcctctgt

SEQ ID NO: 5523399 - DNA, 15 bp, Homo sapiens
tctgctgcctctgtg

SEQ ID NO: 5523400 - DNA, 22 bp, Homo sapiens
tctgctgcctctgtggaagaga

SEQ ID NO: 5523401 - DNA, 22 bp, Homo sapiens
tctgctgcctgcccgcacagca

SEQ ID NO: 5523402 - DNA, 14 bp, Homo sapiens
tctgctgctcccag

SEQ ID NO: 5523403 - DNA, 12 bp, Homo sapiens
tctgctgctgat

SEQ ID NO: 5523404 - DNA, 14 bp, Homo sapiens
tctgctgctggctg

SEQ ID NO: 5523405 - DNA, 15 bp, Homo sapiens
tctgctgctggctgg

SEQ ID NO: 5523406 - DNA, 10 bp, Homo sapiens
tctgctgctt

SEQ ID NO: 5523407 - DNA, 16 bp, Homo sapiens
tctgctgcttctgggc

SEQ ID NO: 5523408 - DNA, 19 bp, Homo sapiens
tctgctgcttctgggcctg

SEQ ID NO: 5523409 - DNA, 16 bp, Homo sapiens
tctgctgctttccaac

SEQ ID NO: 5523410 - DNA, 12 bp, Homo sapiens
tctgctgctttt

SEQ ID NO: 5523411 - DNA, 15 bp, Homo sapiens
tctgggagttccctg

SEQ ID NO: 5523412 - DNA, 21 bp, Homo sapiens
tctgggatatggctgcccagg

SEQ ID NO: 5523413 - DNA, 14 bp, Homo sapiens
tctgggatctgcca

SEQ ID NO: 5523414 - DNA, 20 bp, Homo sapiens
tctgggatctgttttctgga

SEQ ID NO: 5523415 - DNA, 16 bp, Homo sapiens
tctgggatgaaggctt

SEQ ID NO: 5523416 - DNA, 15 bp, Homo sapiens
tctgggatggacagg

SEQ ID NO: 5523417 - DNA, 17 bp, Homo sapiens
tctgggatggaccctcg

SEQ ID NO: 5523418 - DNA, 23 bp, Homo sapiens
tctgggatggaccctcgcagcag

SEQ ID NO: 5523419 - DNA, 15 bp, Homo sapiens
tctgggattctactt

SEQ ID NO: 5523420 - DNA, 19 bp, Homo sapiens
tctgggattctactttaag

SEQ ID NO: 5523421 - DNA, 20 bp, Homo sapiens
tctgggcaagtagcaggact

SEQ ID NO: 5523422 - DNA, 17 bp, Homo sapiens
tctgggcacagtgctgc

SEQ ID NO: 5523423 - DNA, 18 bp, Homo sapiens
tctgggcacagtgctgcc

SEQ ID NO: 5523424 - DNA, 24 bp, Homo sapiens
tctgggcacagtgctgccccttgc

SEQ ID NO: 5523425 - DNA, 21 bp, Homo sapiens
tctgggcaccacaaaatatac

SEQ ID NO: 5523426 - DNA, 21 bp, Homo sapiens
tctgggcaccacctctgtggg

SEQ ID NO: 5523427 - DNA, 15 bp, Homo sapiens
tctgggcagagcctg

SEQ ID NO: 5523428 - DNA, 17 bp, Homo sapiens
tctgggcagagcctgtc

SEQ ID NO: 5523429 - DNA, 18 bp, Homo sapiens
tctgggcagagcctgtcc

SEQ ID NO: 5523430 - DNA, 20 bp, Homo sapiens
tctgggcagatgaaaagcta

SEQ ID NO: 5523431 - DNA, 21 bp, Homo sapiens
tctgggcagatgaaaagctac

SEQ ID NO: 5523432 - DNA, 12 bp, Homo sapiens
tctgggcagctg

SEQ ID NO: 5523433 - DNA, 14 bp, Homo sapiens
tctgggcaggacct

SEQ ID NO: 5523434 - DNA, 18 bp, Homo sapiens
tctgggcaggacctcaga

SEQ ID NO: 5523435 - DNA, 19 bp, Homo sapiens
tctgggcaggacctcagag

SEQ ID NO: 5523436 - DNA, 14 bp, Homo sapiens
tctgggcaggactc

SEQ ID NO: 5523437 - DNA, 13 bp, Homo sapiens
tctgggcagtgcc

SEQ ID NO: 5523438 - DNA, 13 bp, Homo sapiens
tctgggcagtgtg

SEQ ID NO: 5523439 - DNA, 18 bp, Homo sapiens
tctgggcatctgttctgg

SEQ ID NO: 5523440 - DNA, 20 bp, Homo sapiens
tctgggcatggcagggccag

SEQ ID NO: 5523441 - DNA, 12 bp, Homo sapiens
tctgggcatggt

SEQ ID NO: 5523442 - DNA, 17 bp, Homo sapiens
tctgggcattttcctcc

SEQ ID NO: 5523443 - DNA, 19 bp, Homo sapiens
tctgggccaagttcctcta

SEQ ID NO: 5523444 - DNA, 19 bp, Homo sapiens
tctgggccaccaggatcag

SEQ ID NO: 5523445 - DNA, 21 bp, Homo sapiens
tctgggccattctccacagca

SEQ ID NO: 5523446 - DNA, 15 bp, Homo sapiens
tctgggcccccactt

SEQ ID NO: 5523447 - DNA, 18 bp, Homo sapiens
tctgggccccctcctccc

SEQ ID NO: 5523448 - DNA, 14 bp, Homo sapiens
tctgggccctgcag

SEQ ID NO: 5523449 - DNA, 17 bp, Homo sapiens
tctgggccctgcaggag

SEQ ID NO: 5523450 - DNA, 15 bp, Homo sapiens
tctgggcctcagttt

SEQ ID NO: 5523451 - DNA, 15 bp, Homo sapiens
tctgggcctctgact

SEQ ID NO: 5523452 - DNA, 14 bp, Homo sapiens
tctgggcctgaggg

SEQ ID NO: 5523453 - DNA, 16 bp, Homo sapiens
tctgggcctgatggag

SEQ ID NO: 5523454 - DNA, 18 bp, Homo sapiens
tctgggcctgggctaggg

SEQ ID NO: 5523455 - DNA, 15 bp, Homo sapiens
tctgggcctggggtg

SEQ ID NO: 5523456 - DNA, 17 bp, Homo sapiens
tctgggcctggggtgca

SEQ ID NO: 5523457 - DNA, 12 bp, Homo sapiens
tctgggcctgtt

SEQ ID NO: 5523458 - DNA, 14 bp, Homo sapiens
tctgggccttggcc

SEQ ID NO: 5523459 - DNA, 19 bp, Homo sapiens
tctgggccttggcctggag

SEQ ID NO: 5523460 - DNA, 22 bp, Homo sapiens
tctgggccttggcctggagcac

SEQ ID NO: 5523461 - DNA, 21 bp, Homo sapiens
tctgggcgccggttccacgtg

SEQ ID NO: 5523462 - DNA, 20 bp, Homo sapiens
tctgggcggcgggcggctgg

SEQ ID NO: 5523463 - DNA, 18 bp, Homo sapiens
tctgggctaccccaccca

SEQ ID NO: 5523464 - DNA, 21 bp, Homo sapiens
tctgggctactgccactgtgt

SEQ ID NO: 5523465 - DNA, 15 bp, Homo sapiens
tctgggctatggaca

SEQ ID NO: 5523466 - DNA, 16 bp, Homo sapiens
tctgggctatggacac

SEQ ID NO: 5523467 - DNA, 17 bp, Homo sapiens
tctgggctatggacaca

SEQ ID NO: 5523468 - DNA, 18 bp, Homo sapiens
tctgggctcagggctgga

SEQ ID NO: 5523469 - DNA, 22 bp, Homo sapiens
tctgggctcctggaaccaatcc

SEQ ID NO: 5523470 - DNA, 11 bp, Homo sapiens
tctgggctctg

SEQ ID NO: 5523471 - DNA, 12 bp, Homo sapiens
tctgggctctga

SEQ ID NO: 5523472 - DNA, 13 bp, Homo sapiens
tctgggctctgga

SEQ ID NO: 5523473 - DNA, 16 bp, Homo sapiens
tctgggctctggactc

SEQ ID NO: 5523474 - DNA, 23 bp, Homo sapiens
tctgggctgattttttaaataaa

SEQ ID NO: 5523475 - DNA, 21 bp, Homo sapiens
tctgggctgcgggaggccctg

SEQ ID NO: 5523476 - DNA, 23 bp, Homo sapiens
tctgggctgcgggaggccctggc

SEQ ID NO: 5523477 - DNA, 22 bp, Homo sapiens
tctgggctgctacccagaaatc

SEQ ID NO: 5523478 - DNA, 19 bp, Homo sapiens
tctgggctggatgagctcc

SEQ ID NO: 5523479 - DNA, 12 bp, Homo sapiens
tctgggctggca

SEQ ID NO: 5523480 - DNA, 13 bp, Homo sapiens
tctgggctggcag

SEQ ID NO: 5523481 - DNA, 14 bp, Homo sapiens
tctgggctggcaga

SEQ ID NO: 5523482 - DNA, 14 bp, Homo sapiens
tctgggctgggcac

SEQ ID NO: 5523483 - DNA, 19 bp, Homo sapiens
tctgggctggggccacctt

SEQ ID NO: 5523484 - DNA, 21 bp, Homo sapiens
tctgggctgtaacgtggcact

SEQ ID NO: 5523485 - DNA, 14 bp, Homo sapiens
tctgggctgtgggc

SEQ ID NO: 5523486 - DNA, 17 bp, Homo sapiens
tctgggcttcctggagc

SEQ ID NO: 5523487 - DNA, 18 bp, Homo sapiens
tctgggctttctcctgga

SEQ ID NO: 5523488 - DNA, 16 bp, Homo sapiens
tctggggaaaaaaaag

SEQ ID NO: 5523489 - DNA, 18 bp, Homo sapiens
tctggggaaaaaaaagag

SEQ ID NO: 5523490 - DNA, 21 bp, Homo sapiens
tctggggaaagacactgcctg

SEQ ID NO: 5523491 - DNA, 22 bp, Homo sapiens
tctggggaaagacactgcctgg

SEQ ID NO: 5523492 - DNA, 13 bp, Homo sapiens
tctggggaagagg

SEQ ID NO: 5523493 - DNA, 21 bp, Homo sapiens
tctggggaagaggttttattt

SEQ ID NO: 5523494 - DNA, 22 bp, Homo sapiens
tctggggaagggaaccagccct

SEQ ID NO: 5523495 - DNA, 22 bp, Homo sapiens
tctggggaagtcaggggagaag

SEQ ID NO: 5523496 - DNA, 21 bp, Homo sapiens
tctggggaattactttcctcc

SEQ ID NO: 5523497 - DNA, 22 bp, Homo sapiens
tctggggaattactttcctcct

SEQ ID NO: 5523498 - DNA, 22 bp, Homo sapiens
tctggggacaggataataaaac

SEQ ID NO: 5523499 - DNA, 23 bp, Homo sapiens
tctggggacaggataataaaaca

SEQ ID NO: 5523500 - DNA, 13 bp, Homo sapiens
tctggggacaggc

SEQ ID NO: 5523501 - DNA, 15 bp, Homo sapiens
tctggggaccagctt

SEQ ID NO: 5523502 - DNA, 22 bp, Homo sapiens
tctggggaccccaacctcagag

SEQ ID NO: 5523503 - DNA, 20 bp, Homo sapiens
tctggggacgttgctgagcc

SEQ ID NO: 5523504 - DNA, 13 bp, Homo sapiens
tctggggagagcg

SEQ ID NO: 5523505 - DNA, 18 bp, Homo sapiens
tctggggagagcggctgg

SEQ ID NO: 5523506 - DNA, 22 bp, Homo sapiens
tctggggagagcggctggagaa

SEQ ID NO: 5523507 - DNA, 17 bp, Homo sapiens
tctggggagcaggcagc

SEQ ID NO: 5523508 - DNA, 19 bp, Homo sapiens
tctggggagcaggcagcca

SEQ ID NO: 5523509 - DNA, 22 bp, Homo sapiens
tctggggagcaggcagccagca

SEQ ID NO: 5523510 - DNA, 13 bp, Homo sapiens
tctggggagctcc

SEQ ID NO: 5523511 - DNA, 17 bp, Homo sapiens
tctggggagctcctggc

SEQ ID NO: 5523512 - DNA, 19 bp, Homo sapiens
tctggggaggaagggccag

SEQ ID NO: 5523513 - DNA, 21 bp, Homo sapiens
tctggggaggaagggccagga

SEQ ID NO: 5523514 - DNA, 22 bp, Homo sapiens
tctggggaggcaggcattcctg

SEQ ID NO: 5523515 - DNA, 14 bp, Homo sapiens
tctggggagtgtga

SEQ ID NO: 5523516 - DNA, 15 bp, Homo sapiens
tctggggatgggtgg

SEQ ID NO: 5523517 - DNA, 16 bp, Homo sapiens
tctggggatttctggg

SEQ ID NO: 5523518 - DNA, 21 bp, Homo sapiens
tctggggcaactgagagctga

SEQ ID NO: 5523519 - DNA, 23 bp, Homo sapiens
tctggggcagcaccctataaatc

SEQ ID NO: 5523520 - DNA, 17 bp, Homo sapiens
tctggggcaggctgggc

SEQ ID NO: 5523521 - DNA, 19 bp, Homo sapiens
tctggggcaggctgggcca

SEQ ID NO: 5523522 - DNA, 20 bp, Homo sapiens
tctggggcaggctgggccat

SEQ ID NO: 5523523 - DNA, 21 bp, Homo sapiens
tctggggcaggctgggccatg

SEQ ID NO: 5523524 - DNA, 12 bp, Homo sapiens
tctggggccaga

SEQ ID NO: 5523525 - DNA, 15 bp, Homo sapiens
tctggggccagcccc

SEQ ID NO: 5523526 - DNA, 20 bp, Homo sapiens
tctggggccagcccctcccc

SEQ ID NO: 5523527 - DNA, 18 bp, Homo sapiens
tctggggcccaggaagcc

SEQ ID NO: 5523528 - DNA, 22 bp, Homo sapiens
tctggggcccaggaagcccaca

SEQ ID NO: 5523529 - DNA, 13 bp, Homo sapiens
tctggggcccctt

SEQ ID NO: 5523530 - DNA, 15 bp, Homo sapiens
tctggggccctgggc

SEQ ID NO: 5523531 - DNA, 20 bp, Homo sapiens
tctggggccctgggcctcag

SEQ ID NO: 5523532 - DNA, 23 bp, Homo sapiens
tctggggcctaataaaactgatg

SEQ ID NO: 5523533 - DNA, 22 bp, Homo sapiens
tctggggctcagccctgagctg

SEQ ID NO: 5523534 - DNA, 14 bp, Homo sapiens
tctggggctgagag

SEQ ID NO: 5523535 - DNA, 22 bp, Homo sapiens
tctggggctggcaccagcaggc

SEQ ID NO: 5523536 - DNA, 16 bp, Homo sapiens
tctggggctgggcctg

SEQ ID NO: 5523537 - DNA, 11 bp, Homo sapiens
tctggggctgt

SEQ ID NO: 5523538 - DNA, 23 bp, Homo sapiens
tctggggctgtgttatgaaaata

SEQ ID NO: 5523539 - DNA, 16 bp, Homo sapiens
tctggggcttgtcctg

SEQ ID NO: 5523540 - DNA, 16 bp, Homo sapiens
tctgggggacagagaa

SEQ ID NO: 5523541 - DNA, 17 bp, Homo sapiens
tctgggggacccaggtg

SEQ ID NO: 5523542 - DNA, 20 bp, Homo sapiens
tctgggggactccttccttg

SEQ ID NO: 5523543 - DNA, 18 bp, Homo sapiens
tctgggggcacaagactg

SEQ ID NO: 5523544 - DNA, 21 bp, Homo sapiens
tctgggggcagatttgtgggg

SEQ ID NO: 5523545 - DNA, 13 bp, Homo sapiens
tctgggggcagct

SEQ ID NO: 5523546 - DNA, 14 bp, Homo sapiens
tctgggggcagctg

SEQ ID NO: 5523547 - DNA, 20 bp, Homo sapiens
tctgggggcccgacaggtgg

SEQ ID NO: 5523548 - DNA, 17 bp, Homo sapiens
tctgggggctctggcca

SEQ ID NO: 5523549 - DNA, 13 bp, Homo sapiens
tctgggggctggt

SEQ ID NO: 5523550 - DNA, 20 bp, Homo sapiens
tctggggggacccagtgcag

SEQ ID NO: 5523551 - DNA, 16 bp, Homo sapiens
tctggggggagaaaaa

SEQ ID NO: 5523552 - DNA, 17 bp, Homo sapiens
tctggggggagaaaaaa

SEQ ID NO: 5523553 - DNA, 22 bp, Homo sapiens
tctggggggtggggaggaggaa

SEQ ID NO: 5523554 - DNA, 13 bp, Homo sapiens
tctgggggtcagg

SEQ ID NO: 5523555 - DNA, 20 bp, Homo sapiens
tctgggggtggacatctgac

SEQ ID NO: 5523556 - DNA, 20 bp, Homo sapiens
tctggggtaggctgctccct

SEQ ID NO: 5523557 - DNA, 17 bp, Homo sapiens
tctggggtgggcagttt

SEQ ID NO: 5523558 - DNA, 19 bp, Homo sapiens
tctggggttcagcccctcc

SEQ ID NO: 5523559 - DNA, 21 bp, Homo sapiens
tctggggttcagcccctcctc

SEQ ID NO: 5523560 - DNA, 23 bp, Homo sapiens
tctggggttcagcccctcctctg

SEQ ID NO: 5523561 - DNA, 17 bp, Homo sapiens
tctgggtaagaagaaag

SEQ ID NO: 5523562 - DNA, 18 bp, Homo sapiens
tctgggtaagaagaaagc

SEQ ID NO: 5523563 - DNA, 18 bp, Homo sapiens
tctgggtacctgcaagca

SEQ ID NO: 5523564 - DNA, 16 bp, Homo sapiens
tctgggtagaagccac

SEQ ID NO: 5523565 - DNA, 19 bp, Homo sapiens
tctgggtagaagccaccct

SEQ ID NO: 5523566 - DNA, 20 bp, Homo sapiens
tctgggtagaagccaccctt

SEQ ID NO: 5523567 - DNA, 18 bp, Homo sapiens
tctgggtagctgtaaggc

SEQ ID NO: 5523568 - DNA, 16 bp, Homo sapiens
tctgggtatctttcca

SEQ ID NO: 5523569 - DNA, 11 bp, Homo sapiens
tctgggtcaga

SEQ ID NO: 5523570 - DNA, 15 bp, Homo sapiens
tctgggtcagaccca

SEQ ID NO: 5523571 - DNA, 17 bp, Homo sapiens
tctgggtccaggcctgg

SEQ ID NO: 5523572 - DNA, 15 bp, Homo sapiens
tctgggtccatcctg

SEQ ID NO: 5523573 - DNA, 16 bp, Homo sapiens
tctgggtccctgctcc

SEQ ID NO: 5523574 - DNA, 19 bp, Homo sapiens
tctgggtccctgctcccct

SEQ ID NO: 5523575 - DNA, 16 bp, Homo sapiens
tctgggtccttggctc

SEQ ID NO: 5523576 - DNA, 23 bp, Homo sapiens
tctgggtctacaaggactttcca

SEQ ID NO: 5523577 - DNA, 21 bp, Homo sapiens
tctgggtctcccaggacacat

SEQ ID NO: 5523578 - DNA, 13 bp, Homo sapiens
tctgggtgagaat

SEQ ID NO: 5523579 - DNA, 15 bp, Homo sapiens
tctgggtgatttcta

SEQ ID NO: 5523580 - DNA, 14 bp, Homo sapiens
tctgggtgccctga

SEQ ID NO: 5523581 - DNA, 17 bp, Homo sapiens
tctgggtgcggtggctc

SEQ ID NO: 5523582 - DNA, 15 bp, Homo sapiens
tctgggtgctgccct

SEQ ID NO: 5523583 - DNA, 18 bp, Homo sapiens
tctgggtggatgtgagca

SEQ ID NO: 5523584 - DNA, 13 bp, Homo sapiens
tctgggtggccct

SEQ ID NO: 5523585 - DNA, 22 bp, Homo sapiens
tctgggtggctcactcagcact

SEQ ID NO: 5523586 - DNA, 22 bp, Homo sapiens
tctgggtggctcctgccactga

SEQ ID NO: 5523587 - DNA, 16 bp, Homo sapiens
tctgggtggtaactgc

SEQ ID NO: 5523588 - DNA, 16 bp, Homo sapiens
tctgtccatcctcctc

SEQ ID NO: 5523589 - DNA, 17 bp, Homo sapiens
tctgtccatcctcctct

SEQ ID NO: 5523590 - DNA, 17 bp, Homo sapiens
tctgtccatctgtctgt

SEQ ID NO: 5523591 - DNA, 19 bp, Homo sapiens
tctgtccatggcctttcta

SEQ ID NO: 5523592 - DNA, 21 bp, Homo sapiens
tctgtccatggcctttctaat

SEQ ID NO: 5523593 - DNA, 22 bp, Homo sapiens
tctgtccatggcctttctaata

SEQ ID NO: 5523594 - DNA, 19 bp, Homo sapiens
tctgtccatttatccacag

SEQ ID NO: 5523595 - DNA, 20 bp, Homo sapiens
tctgtcccaagtcctgctcc

SEQ ID NO: 5523596 - DNA, 23 bp, Homo sapiens
tctgtcccactacatctgggact

SEQ ID NO: 5523597 - DNA, 23 bp, Homo sapiens
tctgtcccaggatggtcccagcg

SEQ ID NO: 5523598 - DNA, 12 bp, Homo sapiens
tctgtccccagc

SEQ ID NO: 5523599 - DNA, 22 bp, Homo sapiens
tctgtccccagccctgtcctgg

SEQ ID NO: 5523600 - DNA, 13 bp, Homo sapiens
tctgtccccaggc

SEQ ID NO: 5523601 - DNA, 23 bp, Homo sapiens
tctgtccccaggtcctgtctctg

SEQ ID NO: 5523602 - DNA, 16 bp, Homo sapiens
tctgtcccccaggctg

SEQ ID NO: 5523603 - DNA, 19 bp, Homo sapiens
tctgtccccttctctcatc

SEQ ID NO: 5523604 - DNA, 20 bp, Homo sapiens
tctgtcccggggtcctgtgg

SEQ ID NO: 5523605 - DNA, 20 bp, Homo sapiens
tctgtcccggttcaccttgc

SEQ ID NO: 5523606 - DNA, 23 bp, Homo sapiens
tctgtcccgtaaatcatatttcc

SEQ ID NO: 5523607 - DNA, 23 bp, Homo sapiens
tctgtccctaggtgttttgttca

SEQ ID NO: 5523608 - DNA, 14 bp, Homo sapiens
tctgtccctcacag

SEQ ID NO: 5523609 - DNA, 14 bp, Homo sapiens
tctgtccctcactg

SEQ ID NO: 5523610 - DNA, 22 bp, Homo sapiens
tctgtccctcactgccttccag

SEQ ID NO: 5523611 - DNA, 23 bp, Homo sapiens
tctgtccctgagagtgtctctga

SEQ ID NO: 5523612 - DNA, 12 bp, Homo sapiens
tctgtccctgtc

SEQ ID NO: 5523613 - DNA, 13 bp, Homo sapiens
tctgtccctgtcc

SEQ ID NO: 5523614 - DNA, 14 bp, Homo sapiens
tctgtccctgtccc

SEQ ID NO: 5523615 - DNA, 18 bp, Homo sapiens
tctgtccctgtccctgcc

SEQ ID NO: 5523616 - DNA, 15 bp, Homo sapiens
tctgtccctgttaga

SEQ ID NO: 5523617 - DNA, 20 bp, Homo sapiens
tctgtcccttaataaaaata

SEQ ID NO: 5523618 - DNA, 14 bp, Homo sapiens
tctgtcccttccac

SEQ ID NO: 5523619 - DNA, 18 bp, Homo sapiens
tctgtcccttccacttct

SEQ ID NO: 5523620 - DNA, 22 bp, Homo sapiens
tctgtcccttctgtccctcaca

SEQ ID NO: 5523621 - DNA, 16 bp, Homo sapiens
tctgtcccttgccccc

SEQ ID NO: 5523622 - DNA, 22 bp, Homo sapiens
tctgtcccttgcccccctggcc

SEQ ID NO: 5523623 - DNA, 16 bp, Homo sapiens
tctgtcccttgctgta

SEQ ID NO: 5523624 - DNA, 15 bp, Homo sapiens
tctgtcccttggagc

SEQ ID NO: 5523625 - DNA, 18 bp, Homo sapiens
tctgtccctttgctcccg

SEQ ID NO: 5523626 - DNA, 13 bp, Homo sapiens
tctgtcccttttc

SEQ ID NO: 5523627 - DNA, 19 bp, Homo sapiens
tctgtccgagctttgaaaa

SEQ ID NO: 5523628 - DNA, 22 bp, Homo sapiens
tctgtccgcctttacaagggag

SEQ ID NO: 5523629 - DNA, 23 bp, Homo sapiens
tctgtccgtgccccttccctggg

SEQ ID NO: 5523630 - DNA, 11 bp, Homo sapiens
tctgtcctact

SEQ ID NO: 5523631 - DNA, 17 bp, Homo sapiens
tctgtcctacttctgac

SEQ ID NO: 5523632 - DNA, 18 bp, Homo sapiens
tctgtcctacttctgact

SEQ ID NO: 5523633 - DNA, 14 bp, Homo sapiens
tctgtcctcaccct

SEQ ID NO: 5523634 - DNA, 20 bp, Homo sapiens
tctgtcctcaccctgtggga

SEQ ID NO: 5523635 - DNA, 20 bp, Homo sapiens
tctgtcctcacgccccctgt

SEQ ID NO: 5523636 - DNA, 16 bp, Homo sapiens
tctgtcctcagagcag

SEQ ID NO: 5523637 - DNA, 13 bp, Homo sapiens
tctgtcctcagcc

SEQ ID NO: 5523638 - DNA, 23 bp, Homo sapiens
tctgtcctcccatcccctcaaca

SEQ ID NO: 5523639 - DNA, 13 bp, Homo sapiens
tctgtcctctctg

SEQ ID NO: 5523640 - DNA, 12 bp, Homo sapiens
tctgtcctgcgc

SEQ ID NO: 5523641 - DNA, 14 bp, Homo sapiens
tctgtcctgcgcct

SEQ ID NO: 5523642 - DNA, 15 bp, Homo sapiens
tctgtcctgcgcctg

SEQ ID NO: 5523643 - DNA, 12 bp, Homo sapiens
tctgtcctgctg

SEQ ID NO: 5523644 - DNA, 13 bp, Homo sapiens
tctgtcctggaac

SEQ ID NO: 5523645 - DNA, 23 bp, Homo sapiens
tctgtcctggctgtgcacattct

SEQ ID NO: 5523646 - DNA, 21 bp, Homo sapiens
tctgtcctgggagtgagctgg

SEQ ID NO: 5523647 - DNA, 12 bp, Homo sapiens
tctgtcctgggg

SEQ ID NO: 5523648 - DNA, 22 bp, Homo sapiens
tctgtcctggtcagttttcaca

SEQ ID NO: 5523649 - DNA, 14 bp, Homo sapiens
tctgtcctggtgtc

SEQ ID NO: 5523650 - DNA, 17 bp, Homo sapiens
tctgtcctggtgtcact

SEQ ID NO: 5523651 - DNA, 13 bp, Homo sapiens
tctgtcctgtgac

SEQ ID NO: 5523652 - DNA, 23 bp, Homo sapiens
tctgtcctgttaggccaactgcc

SEQ ID NO: 5523653 - DNA, 20 bp, Homo sapiens
tctgtccttcagatggaaac

SEQ ID NO: 5523654 - DNA, 19 bp, Homo sapiens
tctgtccttcccccagcac

SEQ ID NO: 5523655 - DNA, 15 bp, Homo sapiens
tctgtccttgaagga

SEQ ID NO: 5523656 - DNA, 16 bp, Homo sapiens
tctgtcgcccaggctg

SEQ ID NO: 5523657 - DNA, 18 bp, Homo sapiens
tctgtcgccttagcatgt

SEQ ID NO: 5523658 - DNA, 23 bp, Homo sapiens
tctgtcgccttagcatgtttgct

SEQ ID NO: 5523659 - DNA, 15 bp, Homo sapiens
tctgtcgctcaggct

SEQ ID NO: 5523660 - DNA, 16 bp, Homo sapiens
tctgtcgctcaggctg

SEQ ID NO: 5523661 - DNA, 16 bp, Homo sapiens
tctgtcgctgggctgt

SEQ ID NO: 5523662 - DNA, 16 bp, Homo sapiens
tctgtcggtgactcct

SEQ ID NO: 5523663 - DNA, 20 bp, Homo sapiens
tctgtcggtgactcctgaag

SEQ ID NO: 5523664 - DNA, 18 bp, Homo sapiens
tctgtcgtccccagacca

SEQ ID NO: 5523665 - DNA, 19 bp, Homo sapiens
tctgtcgtccccagaccag

SEQ ID NO: 5523666 - DNA, 21 bp, Homo sapiens
tctgtcgtccccagaccagta

SEQ ID NO: 5523667 - DNA, 14 bp, Homo sapiens
tctgtctacaaata

SEQ ID NO: 5523668 - DNA, 15 bp, Homo sapiens
tctgtctacatttct

SEQ ID NO: 5523669 - DNA, 14 bp, Homo sapiens
tctgtctaccatct

SEQ ID NO: 5523670 - DNA, 18 bp, Homo sapiens
tctgtctaccatctccct

SEQ ID NO: 5523671 - DNA, 15 bp, Homo sapiens
tctgtctacttgctc

SEQ ID NO: 5523672 - DNA, 14 bp, Homo sapiens
tctgtctactttct

SEQ ID NO: 5523673 - DNA, 18 bp, Homo sapiens
tctgtctactttctcttg

SEQ ID NO: 5523674 - DNA, 22 bp, Homo sapiens
tctgtctactttctcttgttta

SEQ ID NO: 5523675 - DNA, 17 bp, Homo sapiens
tctgtctagactggcct

SEQ ID NO: 5523676 - DNA, 19 bp, Homo sapiens
tctgtctagcatgccaaca

SEQ ID NO: 5523677 - DNA, 23 bp, Homo sapiens
tctgtctagcatgccaacaagaa

SEQ ID NO: 5523678 - DNA, 14 bp, Homo sapiens
tctgtctaggactg

SEQ ID NO: 5523679 - DNA, 23 bp, Homo sapiens
tctgtctaggactgcagtgtgga

SEQ ID NO: 5523680 - DNA, 15 bp, Homo sapiens
tctgtctatctgtga

SEQ ID NO: 5523681 - DNA, 16 bp, Homo sapiens
tctgtctatctgtgaa

SEQ ID NO: 5523682 - DNA, 21 bp, Homo sapiens
tctgtctcatccatcatcatg

SEQ ID NO: 5523683 - DNA, 17 bp, Homo sapiens
tctgtctcatcctcctg

SEQ ID NO: 5523684 - DNA, 12 bp, Homo sapiens
tctgtctccaag

SEQ ID NO: 5523685 - DNA, 21 bp, Homo sapiens
tctgtctcccctaccaggctg

SEQ ID NO: 5523686 - DNA, 22 bp, Homo sapiens
tctgtctccctcccctctcaga

SEQ ID NO: 5523687 - DNA, 13 bp, Homo sapiens
tctgtctcccttc

SEQ ID NO: 5523688 - DNA, 16 bp, Homo sapiens
tctgtctcccttctct

SEQ ID NO: 5523689 - DNA, 23 bp, Homo sapiens
tctgtctcctgtcttcagagcaa

SEQ ID NO: 5523690 - DNA, 21 bp, Homo sapiens
tctgtctctaaccattcaaat

SEQ ID NO: 5523691 - DNA, 23 bp, Homo sapiens
tctgtctctaaccattcaaatga

SEQ ID NO: 5523692 - DNA, 19 bp, Homo sapiens
tctgtctctaatttaactt

SEQ ID NO: 5523693 - DNA, 20 bp, Homo sapiens
tctgtctctccccctctgtc

SEQ ID NO: 5523694 - DNA, 20 bp, Homo sapiens
tctgtctctcctagcccctc

SEQ ID NO: 5523695 - DNA, 12 bp, Homo sapiens
tctgtctctctc

SEQ ID NO: 5523696 - DNA, 12 bp, Homo sapiens
tctgtctctctt

SEQ ID NO: 5523697 - DNA, 18 bp, Homo sapiens
tctgtctctcttttgctc

SEQ ID NO: 5523698 - DNA, 21 bp, Homo sapiens
tctgtctctcttttgctctct

SEQ ID NO: 5523699 - DNA, 13 bp, Homo sapiens
tctgtctctgtgg

SEQ ID NO: 5523700 - DNA, 13 bp, Homo sapiens
tctgtctcttgca

SEQ ID NO: 5523701 - DNA, 20 bp, Homo sapiens
tctgtctgagacaggtgcct

SEQ ID NO: 5523702 - DNA, 20 bp, Homo sapiens
tctgtctgagccctgccctc

SEQ ID NO: 5523703 - DNA, 13 bp, Homo sapiens
tctgtctgctctt

SEQ ID NO: 5523704 - DNA, 14 bp, Homo sapiens
tctgtctgctctta

SEQ ID NO: 5523705 - DNA, 12 bp, Homo sapiens
tctgtctgctgg

SEQ ID NO: 5523706 - DNA, 13 bp, Homo sapiens
tctgtctgctggt

SEQ ID NO: 5523707 - DNA, 12 bp, Homo sapiens
tctgtctgcttt

SEQ ID NO: 5523708 - DNA, 12 bp, Homo sapiens
tctgtctggcac

SEQ ID NO: 5523709 - DNA, 15 bp, Homo sapiens
tctgtctggccaggg

SEQ ID NO: 5523710 - DNA, 16 bp, Homo sapiens
tctgtctggccaggga

SEQ ID NO: 5523711 - DNA, 21 bp, Homo sapiens
tctgtctgggctcagacatcc

SEQ ID NO: 5523712 - DNA, 12 bp, Homo sapiens
tctgtctggggc

SEQ ID NO: 5523713 - DNA, 13 bp, Homo sapiens
tctgtctggtcca

SEQ ID NO: 5523714 - DNA, 14 bp, Homo sapiens
tctgtctgtaagat

SEQ ID NO: 5523715 - DNA, 17 bp, Homo sapiens
tctgtctgtaagatttt

SEQ ID NO: 5523716 - DNA, 14 bp, Homo sapiens
tctgtctgtcccaa

SEQ ID NO: 5523717 - DNA, 16 bp, Homo sapiens
tctgtctgtcctaccc

SEQ ID NO: 5523718 - DNA, 16 bp, Homo sapiens
tctgtctgtccttcct

SEQ ID NO: 5523719 - DNA, 12 bp, Homo sapiens
tctgtctgtgca

SEQ ID NO: 5523720 - DNA, 13 bp, Homo sapiens
tctgtctgtgggc

SEQ ID NO: 5523721 - DNA, 19 bp, Homo sapiens
tctgtctgtgggcttcagc

SEQ ID NO: 5523722 - DNA, 16 bp, Homo sapiens
tctgtcttaaagaatt

SEQ ID NO: 5523723 - DNA, 19 bp, Homo sapiens
tctgtcttaaagaatttga

SEQ ID NO: 5523724 - DNA, 20 bp, Homo sapiens
tctgtcttaaagaatttgaa

SEQ ID NO: 5523725 - DNA, 14 bp, Homo sapiens
tctgtcttaaatga

SEQ ID NO: 5523726 - DNA, 14 bp, Homo sapiens
tctgtcttcaagga

SEQ ID NO: 5523727 - DNA, 15 bp, Homo sapiens
tctgtcttcacagct

SEQ ID NO: 5523728 - DNA, 22 bp, Homo sapiens
tctgtcttcacagctctgtgtt

SEQ ID NO: 5523729 - DNA, 12 bp, Homo sapiens
tctgtcttcagc

SEQ ID NO: 5523730 - DNA, 22 bp, Homo sapiens
tctgtcttcccaaacccagtct

SEQ ID NO: 5523731 - DNA, 12 bp, Homo sapiens
tctgtcttcctg

SEQ ID NO: 5523732 - DNA, 17 bp, Homo sapiens
tctgtcttctctatcct

SEQ ID NO: 5523733 - DNA, 15 bp, Homo sapiens
tctgtcttctctcca

SEQ ID NO: 5523734 - DNA, 17 bp, Homo sapiens
tctgtcttctctccact

SEQ ID NO: 5523735 - DNA, 14 bp, Homo sapiens
tctgtcttctggac

SEQ ID NO: 5523736 - DNA, 13 bp, Homo sapiens
tctgtcttctgta

SEQ ID NO: 5523737 - DNA, 14 bp, Homo sapiens
tctgtcttctgtat

SEQ ID NO: 5523738 - DNA, 15 bp, Homo sapiens
tctgtcttctgtata

SEQ ID NO: 5523739 - DNA, 14 bp, Homo sapiens
tctgtcttgccagc

SEQ ID NO: 5523740 - DNA, 15 bp, Homo sapiens
tctgtcttgccagcc

SEQ ID NO: 5523741 - DNA, 16 bp, Homo sapiens
tctgtcttgccagcca

SEQ ID NO: 5523742 - DNA, 21 bp, Homo sapiens
tctgtcttgccagccagaagc

SEQ ID NO: 5523743 - DNA, 14 bp, Homo sapiens
tctgtcttggcatt

SEQ ID NO: 5523744 - DNA, 20 bp, Homo sapiens
tctgtcttggggcttttggt

SEQ ID NO: 5523745 - DNA, 14 bp, Homo sapiens
tctgtcttggtcct

SEQ ID NO: 5523746 - DNA, 19 bp, Homo sapiens
tctgtcttgtaatattttg

SEQ ID NO: 5523747 - DNA, 15 bp, Homo sapiens
tctgtctttaagaac

SEQ ID NO: 5523748 - DNA, 13 bp, Homo sapiens
tctgtctttatga

SEQ ID NO: 5523749 - DNA, 14 bp, Homo sapiens
tctgtctttatgat

SEQ ID NO: 5523750 - DNA, 23 bp, Homo sapiens
tctgtctttatgtaagaagaaac

SEQ ID NO: 5523751 - DNA, 12 bp, Homo sapiens
tctgtctttcca

SEQ ID NO: 5523752 - DNA, 14 bp, Homo sapiens
tctgtctttcctga

SEQ ID NO: 5523753 - DNA, 13 bp, Homo sapiens
tctgtctttgtgg

SEQ ID NO: 5523754 - DNA, 15 bp, Homo sapiens
tctgtctttgtggga

SEQ ID NO: 5523755 - DNA, 18 bp, Homo sapiens
tctgtcttttaaactctg

SEQ ID NO: 5523756 - DNA, 18 bp, Homo sapiens
tctgtcttttctcctccg

SEQ ID NO: 5523757 - DNA, 17 bp, Homo sapiens
tctgtctttttccttcc

SEQ ID NO: 5523758 - DNA, 21 bp, Homo sapiens
tctgtctttttccttcctgag

SEQ ID NO: 5523759 - DNA, 14 bp, Homo sapiens
tctgtgaaacctgt

SEQ ID NO: 5523760 - DNA, 14 bp, Homo sapiens
tctgtgaaactaat

SEQ ID NO: 5523761 - DNA, 15 bp, Homo sapiens
tctgtgaaaggaaag

SEQ ID NO: 5523762 - DNA, 21 bp, Homo sapiens
tctgtgaaaggaaagagggag

SEQ ID NO: 5523763 - DNA, 21 bp, Homo sapiens
tctgtgaaagtctcctgtatc

SEQ ID NO: 5523764 - DNA, 22 bp, Homo sapiens
tctgtgaaagtctcctgtatca

SEQ ID NO: 5523765 - DNA, 20 bp, Homo sapiens
tctgtgaaatataattgtac

SEQ ID NO: 5523766 - DNA, 22 bp, Homo sapiens
tctgtgaaatcagaagtgcaaa

SEQ ID NO: 5523767 - DNA, 17 bp, Homo sapiens
tctgttgctggaggggc

SEQ ID NO: 5523768 - DNA, 23 bp, Homo sapiens
tctgttgctggtgtactctagga

SEQ ID NO: 5523769 - DNA, 17 bp, Homo sapiens
tctgttggagttccctc

SEQ ID NO: 5523770 - DNA, 15 bp, Homo sapiens
tctgttggcaggctg

SEQ ID NO: 5523771 - DNA, 20 bp, Homo sapiens
tctgttggcaggctggccag

SEQ ID NO: 5523772 - DNA, 12 bp, Homo sapiens
tctgttggccag

SEQ ID NO: 5523773 - DNA, 18 bp, Homo sapiens
tctgttggccagtgtgac

SEQ ID NO: 5523774 - DNA, 20 bp, Homo sapiens
tctgttggccagtgtgacaa

SEQ ID NO: 5523775 - DNA, 18 bp, Homo sapiens
tctgttggtccactgtgt

SEQ ID NO: 5523776 - DNA, 12 bp, Homo sapiens
tctgttgtaact

SEQ ID NO: 5523777 - DNA, 16 bp, Homo sapiens
tctgttgtaacttatg

SEQ ID NO: 5523778 - DNA, 21 bp, Homo sapiens
tctgttgtaacttatgtagat

SEQ ID NO: 5523779 - DNA, 15 bp, Homo sapiens
tctgttgtaagaata

SEQ ID NO: 5523780 - DNA, 22 bp, Homo sapiens
tctgttgtagaaaaactatgtg

SEQ ID NO: 5523781 - DNA, 18 bp, Homo sapiens
tctgttgtcaccttcacc

SEQ ID NO: 5523782 - DNA, 18 bp, Homo sapiens
tctgttgtgtgtcatgcc

SEQ ID NO: 5523783 - DNA, 13 bp, Homo sapiens
tctgttgtgttca

SEQ ID NO: 5523784 - DNA, 13 bp, Homo sapiens
tctgttgttcagt

SEQ ID NO: 5523785 - DNA, 15 bp, Homo sapiens
tctgttgttccaaat

SEQ ID NO: 5523786 - DNA, 14 bp, Homo sapiens
tctgttgttccatt

SEQ ID NO: 5523787 - DNA, 13 bp, Homo sapiens
tctgttgttctgt

SEQ ID NO: 5523788 - DNA, 13 bp, Homo sapiens
tctgttgtttgaa

SEQ ID NO: 5523789 - DNA, 19 bp, Homo sapiens
tctgtttaaagcatataga

SEQ ID NO: 5523790 - DNA, 20 bp, Homo sapiens
tctgtttaagaaaagtattt

SEQ ID NO: 5523791 - DNA, 23 bp, Homo sapiens
tctgtttaatactcatccttgta

SEQ ID NO: 5523792 - DNA, 18 bp, Homo sapiens
tctgtttaattttcactt

SEQ ID NO: 5523793 - DNA, 13 bp, Homo sapiens
tctgtttagataa

SEQ ID NO: 5523794 - DNA, 18 bp, Homo sapiens
tctgtttagtaaatacat

SEQ ID NO: 5523795 - DNA, 18 bp, Homo sapiens
tctgtttataaaaacaaa

SEQ ID NO: 5523796 - DNA, 18 bp, Homo sapiens
tctgtttattcttccaga

SEQ ID NO: 5523797 - DNA, 22 bp, Homo sapiens
tctgtttattcttccagaatgc

SEQ ID NO: 5523798 - DNA, 16 bp, Homo sapiens
tctgtttcccaagcta

SEQ ID NO: 5523799 - DNA, 16 bp, Homo sapiens
tctgtttcctgaaata

SEQ ID NO: 5523800 - DNA, 17 bp, Homo sapiens
tctgtttcctgaaatat

SEQ ID NO: 5523801 - DNA, 22 bp, Homo sapiens
tctgtttcctgaaatataaact

SEQ ID NO: 5523802 - DNA, 14 bp, Homo sapiens
tctgtttcctggcc

SEQ ID NO: 5523803 - DNA, 20 bp, Homo sapiens
tctgtttcctggcctcagag

SEQ ID NO: 5523804 - DNA, 23 bp, Homo sapiens
tctgtttcctggcctcagagctt

SEQ ID NO: 5523805 - DNA, 11 bp, Homo sapiens
tctgtttcctt

SEQ ID NO: 5523806 - DNA, 20 bp, Homo sapiens
tctgtttccttctctttctc

SEQ ID NO: 5523807 - DNA, 14 bp, Homo sapiens
tctgtttctatgtc

SEQ ID NO: 5523808 - DNA, 22 bp, Homo sapiens
tctgtttctggaaatgttcttt

SEQ ID NO: 5523809 - DNA, 20 bp, Homo sapiens
tctgtttcttaagggcacac

SEQ ID NO: 5523810 - DNA, 19 bp, Homo sapiens
tctgtttcttctcttggtg

SEQ ID NO: 5523811 - DNA, 16 bp, Homo sapiens
tctgtttgccacttga

SEQ ID NO: 5523812 - DNA, 18 bp, Homo sapiens
tctgtttgctcacccagg

SEQ ID NO: 5523813 - DNA, 14 bp, Homo sapiens
tctgtttgctgttg

SEQ ID NO: 5523814 - DNA, 19 bp, Homo sapiens
tctgtttggactgcagaag

SEQ ID NO: 5523815 - DNA, 13 bp, Homo sapiens
tctgtttggcact

SEQ ID NO: 5523816 - DNA, 16 bp, Homo sapiens
tctgtttggcacttgt

SEQ ID NO: 5523817 - DNA, 18 bp, Homo sapiens
tctgtttggcacttgtat

SEQ ID NO: 5523818 - DNA, 22 bp, Homo sapiens
tctgtttggtaaggaggacaat

SEQ ID NO: 5523819 - DNA, 14 bp, Homo sapiens
tctgtttgtaaatt

SEQ ID NO: 5523820 - DNA, 18 bp, Homo sapiens
tctgtttgtatatttgca

SEQ ID NO: 5523821 - DNA, 18 bp, Homo sapiens
tctgtttgtctgaacaaa

SEQ ID NO: 5523822 - DNA, 12 bp, Homo sapiens
tctgtttgttaa

SEQ ID NO: 5523823 - DNA, 14 bp, Homo sapiens
tctgtttgttactg

SEQ ID NO: 5523824 - DNA, 13 bp, Homo sapiens
tctgtttgttatt

SEQ ID NO: 5523825 - DNA, 13 bp, Homo sapiens
tctgtttgtttaa

SEQ ID NO: 5523826 - DNA, 14 bp, Homo sapiens
tctgtttgtttaag

SEQ ID NO: 5523827 - DNA, 22 bp, Homo sapiens
tctgtttgtttaagctgagcca

SEQ ID NO: 5523828 - DNA, 21 bp, Homo sapiens
tctgtttgtttcaagaacctg

SEQ ID NO: 5523829 - DNA, 18 bp, Homo sapiens
tctgttttaggttaaaaa

SEQ ID NO: 5523830 - DNA, 17 bp, Homo sapiens
tctgttttatgaaacca

SEQ ID NO: 5523831 - DNA, 16 bp, Homo sapiens
tctgttttatgacttc

SEQ ID NO: 5523832 - DNA, 17 bp, Homo sapiens
tctgttttcctttctca

SEQ ID NO: 5523833 - DNA, 17 bp, Homo sapiens
tctgttttctgtgcact

SEQ ID NO: 5523834 - DNA, 21 bp, Homo sapiens
tctgttttctgtttgtaaatt

SEQ ID NO: 5523835 - DNA, 18 bp, Homo sapiens
tctgttttcttctcagtc

SEQ ID NO: 5523836 - DNA, 23 bp, Homo sapiens
tctgttttctttctaatgagata

SEQ ID NO: 5523837 - DNA, 20 bp, Homo sapiens
tctgttttggtcccctccct

SEQ ID NO: 5523838 - DNA, 13 bp, Homo sapiens
tctgttttgtaaa

SEQ ID NO: 5523839 - DNA, 15 bp, Homo sapiens
tctgttttgtaaatg

SEQ ID NO: 5523840 - DNA, 17 bp, Homo sapiens
tctgttttgtatatgat

SEQ ID NO: 5523841 - DNA, 20 bp, Homo sapiens
tctgttttgtggtttggaat

SEQ ID NO: 5523842 - DNA, 21 bp, Homo sapiens
tctgttttgtttcgctctttg

SEQ ID NO: 5523843 - DNA, 14 bp, Homo sapiens
tctgttttgtttct

SEQ ID NO: 5523844 - DNA, 23 bp, Homo sapiens
tctgttttgtttggcaaggaaag

SEQ ID NO: 5523845 - DNA, 20 bp, Homo sapiens
tctgttttgttttgttttaa

SEQ ID NO: 5523846 - DNA, 14 bp, Homo sapiens
tctgtttttaaaaa

SEQ ID NO: 5523847 - DNA, 16 bp, Homo sapiens
tctgtttttaaaaatc

SEQ ID NO: 5523848 - DNA, 22 bp, Homo sapiens
tctgtttttcacactaaacata

SEQ ID NO: 5523849 - DNA, 13 bp, Homo sapiens
tctgtttttctca

SEQ ID NO: 5523850 - DNA, 19 bp, Homo sapiens
tctgtttttctcaaataaa

SEQ ID NO: 5523851 - DNA, 21 bp, Homo sapiens
tctgtttttctcaaataaagt

SEQ ID NO: 5523852 - DNA, 21 bp, Homo sapiens
tctgtttttcttctgaaatac

SEQ ID NO: 5523853 - DNA, 12 bp, Homo sapiens
tctgtttttgta

SEQ ID NO: 5523854 - DNA, 23 bp, Homo sapiens
tctgtttttgtatctttatgctg

SEQ ID NO: 5523855 - DNA, 19 bp, Homo sapiens
tctgttttttttttttgta

SEQ ID NO: 5523856 - DNA, 22 bp, Homo sapiens
tctgttttttttttttgtattt

SEQ ID NO: 5523857 - DNA, 23 bp, Homo sapiens
tctgttttttttttttgtatttc

SEQ ID NO: 5523858 - DNA, 18 bp, Homo sapiens
tcttaaaaaaataaaata

SEQ ID NO: 5523859 - DNA, 19 bp, Homo sapiens
tcttaaaaaaataaaatat

SEQ ID NO: 5523860 - DNA, 18 bp, Homo sapiens
tcttaaaaaataaaaact

SEQ ID NO: 5523861 - DNA, 15 bp, Homo sapiens
tcttaaaaactgtgt

SEQ ID NO: 5523862 - DNA, 13 bp, Homo sapiens
tcttaaaaagtgg

SEQ ID NO: 5523863 - DNA, 18 bp, Homo sapiens
tcttaaaaagtggaaaaa

SEQ ID NO: 5523864 - DNA, 16 bp, Homo sapiens
tcttaaaaagttgttc

SEQ ID NO: 5523865 - DNA, 13 bp, Homo sapiens
tcttaaaaatatt

SEQ ID NO: 5523866 - DNA, 17 bp, Homo sapiens
tcttaaaaatgcattta

SEQ ID NO: 5523867 - DNA, 18 bp, Homo sapiens
tcttaaaaatgcatttaa

SEQ ID NO: 5523868 - DNA, 20 bp, Homo sapiens
tcttaaaaatgcatttaagt

SEQ ID NO: 5523869 - DNA, 20 bp, Homo sapiens
tcttaaaaatgttttttcat

SEQ ID NO: 5523870 - DNA, 13 bp, Homo sapiens
tcttaaaaattaa

SEQ ID NO: 5523871 - DNA, 13 bp, Homo sapiens
tcttaaaaattat

SEQ ID NO: 5523872 - DNA, 16 bp, Homo sapiens
tcttaaaacacatgat

SEQ ID NO: 5523873 - DNA, 13 bp, Homo sapiens
tcttaaaacacta

SEQ ID NO: 5523874 - DNA, 20 bp, Homo sapiens
tcttaaaacattatgagttt

SEQ ID NO: 5523875 - DNA, 23 bp, Homo sapiens
tcttaaaacctgcttttcaatgt

SEQ ID NO: 5523876 - DNA, 13 bp, Homo sapiens
tcttaaaactcct

SEQ ID NO: 5523877 - DNA, 20 bp, Homo sapiens
tcttaaaactttattaaaag

SEQ ID NO: 5523878 - DNA, 15 bp, Homo sapiens
tcttaaaaggagctc

SEQ ID NO: 5523879 - DNA, 18 bp, Homo sapiens
tcttaaaagggaaattag

SEQ ID NO: 5523880 - DNA, 15 bp, Homo sapiens
tcttaaaagtacttt

SEQ ID NO: 5523881 - DNA, 17 bp, Homo sapiens
tcttaaaagtactttaa

SEQ ID NO: 5523882 - DNA, 16 bp, Homo sapiens
tcttaaaagtttctaa

SEQ ID NO: 5523883 - DNA, 16 bp, Homo sapiens
tcttaaaatatcttcc

SEQ ID NO: 5523884 - DNA, 19 bp, Homo sapiens
tcttaaaatatcttccttt

SEQ ID NO: 5523885 - DNA, 18 bp, Homo sapiens
tcttaaaatattgtgtaa

SEQ ID NO: 5523886 - DNA, 21 bp, Homo sapiens
tcttaaaatgcaatatttgta

SEQ ID NO: 5523887 - DNA, 13 bp, Homo sapiens
tcttaaaatgttt

SEQ ID NO: 5523888 - DNA, 20 bp, Homo sapiens
tcttaaaatgtttcaaatgg

SEQ ID NO: 5523889 - DNA, 21 bp, Homo sapiens
tcttaaaattcaagaaaataa

SEQ ID NO: 5523890 - DNA, 16 bp, Homo sapiens
tcttaaaattggttaa

SEQ ID NO: 5523891 - DNA, 16 bp, Homo sapiens
tcttaaacacttgcaa

SEQ ID NO: 5523892 - DNA, 21 bp, Homo sapiens
tcttaaaccaacctttaaaat

SEQ ID NO: 5523893 - DNA, 19 bp, Homo sapiens
tcttaaaccatttttgctg

SEQ ID NO: 5523894 - DNA, 23 bp, Homo sapiens
tcttaaaccatttttgctgaatt

SEQ ID NO: 5523895 - DNA, 17 bp, Homo sapiens
tcttaaacccacataaa

SEQ ID NO: 5523896 - DNA, 21 bp, Homo sapiens
tcttaaacccacataaacact

SEQ ID NO: 5523897 - DNA, 12 bp, Homo sapiens
tcttaaactaaa

SEQ ID NO: 5523898 - DNA, 12 bp, Homo sapiens
tcttaaactgtt

SEQ ID NO: 5523899 - DNA, 19 bp, Homo sapiens
tcttaaagaaaacccaccc

SEQ ID NO: 5523900 - DNA, 16 bp, Homo sapiens
tcttaaagaaacagct

SEQ ID NO: 5523901 - DNA, 14 bp, Homo sapiens
tcttaaagcaaata

SEQ ID NO: 5523902 - DNA, 14 bp, Homo sapiens
tcttaaagcatttc

SEQ ID NO: 5523903 - DNA, 23 bp, Homo sapiens
tcttaaagctgcctgtagttagg

SEQ ID NO: 5523904 - DNA, 13 bp, Homo sapiens
tcttaaaggacat

SEQ ID NO: 5523905 - DNA, 22 bp, Homo sapiens
tcttaaagtattcttctcttcc

SEQ ID NO: 5523906 - DNA, 18 bp, Homo sapiens
tcttaaagtgcagttctt

SEQ ID NO: 5523907 - DNA, 21 bp, Homo sapiens
tcttaaagtgccagtatttta

SEQ ID NO: 5523908 - DNA, 19 bp, Homo sapiens
tcttaaagttgaatttatt

SEQ ID NO: 5523909 - DNA, 21 bp, Homo sapiens
tcttaaagttgaatttattgg

SEQ ID NO: 5523910 - DNA, 15 bp, Homo sapiens
tcttaaataaaacta

SEQ ID NO: 5523911 - DNA, 13 bp, Homo sapiens
tcttaaataaaag

SEQ ID NO: 5523912 - DNA, 15 bp, Homo sapiens
tcttaaataaaagaa

SEQ ID NO: 5523913 - DNA, 15 bp, Homo sapiens
tcttaaataaacctt

SEQ ID NO: 5523914 - DNA, 24 bp, Homo sapiens
tcttaaatactttttcagttgttt

SEQ ID NO: 5523915 - DNA, 14 bp, Homo sapiens
tcttaaatatgaat

SEQ ID NO: 5523916 - DNA, 22 bp, Homo sapiens
tcttaaatatgtggagttcatc

SEQ ID NO: 5523917 - DNA, 13 bp, Homo sapiens
tcttaaatcagaa

SEQ ID NO: 5523918 - DNA, 14 bp, Homo sapiens
tcttaaatcagaat

SEQ ID NO: 5523919 - DNA, 22 bp, Homo sapiens
tcttaaatcagaataaattaat

SEQ ID NO: 5523920 - DNA, 16 bp, Homo sapiens
tcttaaatctaaacaa

SEQ ID NO: 5523921 - DNA, 13 bp, Homo sapiens
tcttaaatctttc

SEQ ID NO: 5523922 - DNA, 13 bp, Homo sapiens
tcttaaatgacag

SEQ ID NO: 5523923 - DNA, 14 bp, Homo sapiens
tcttaaatgctcat

SEQ ID NO: 5523924 - DNA, 16 bp, Homo sapiens
tcttaaatgctcataa

SEQ ID NO: 5523925 - DNA, 22 bp, Homo sapiens
tcttaaatgctcattttctggt

SEQ ID NO: 5523926 - DNA, 23 bp, Homo sapiens
tcttaaatggaattattttgaat

SEQ ID NO: 5523927 - DNA, 23 bp, Homo sapiens
tcttaaatgttttcattgggaaa

SEQ ID NO: 5523928 - DNA, 19 bp, Homo sapiens
tcttaaattcatttctaga

SEQ ID NO: 5523929 - DNA, 13 bp, Homo sapiens
tcttaaattttgt

SEQ ID NO: 5523930 - DNA, 14 bp, Homo sapiens
tcttaaattttgtg

SEQ ID NO: 5523931 - DNA, 17 bp, Homo sapiens
tcttaacaaaagtgaac

SEQ ID NO: 5523932 - DNA, 13 bp, Homo sapiens
tcttaacaaacca

SEQ ID NO: 5523933 - DNA, 20 bp, Homo sapiens
tcttaacaaaccaacatctt

SEQ ID NO: 5523934 - DNA, 22 bp, Homo sapiens
tcttaacaaatcagatcagatg

SEQ ID NO: 5523935 - DNA, 21 bp, Homo sapiens
tcttaacaacagcttcttgct

SEQ ID NO: 5523936 - DNA, 15 bp, Homo sapiens
tcttaacaatttctg

SEQ ID NO: 5523937 - DNA, 19 bp, Homo sapiens
tcttaacaatttctgtcct

SEQ ID NO: 5523938 - DNA, 16 bp, Homo sapiens
tcttaacacagccttc

SEQ ID NO: 5523939 - DNA, 23 bp, Homo sapiens
tcttaacacatgtccttgtgtgt

SEQ ID NO: 5523940 - DNA, 15 bp, Homo sapiens
tcttaacagtctcca

SEQ ID NO: 5523941 - DNA, 23 bp, Homo sapiens
tcttaaccagatggttgtgtatg

SEQ ID NO: 5523942 - DNA, 23 bp, Homo sapiens
tcttaacccctaagactgccttc

SEQ ID NO: 5523943 - DNA, 17 bp, Homo sapiens
tcttaaccctgaacaag

SEQ ID NO: 5523944 - DNA, 16 bp, Homo sapiens
tcttcattttttaatg

SEQ ID NO: 5523945 - DNA, 19 bp, Homo sapiens
tcttcattttttaatgtgc

SEQ ID NO: 5523946 - DNA, 21 bp, Homo sapiens
tcttcatttttttttcaatca

SEQ ID NO: 5523947 - DNA, 22 bp, Homo sapiens
tcttccaaatgcagttcattgc

SEQ ID NO: 5523948 - DNA, 13 bp, Homo sapiens
tcttccaaatttg

SEQ ID NO: 5523949 - DNA, 17 bp, Homo sapiens
tcttccaacatgtgatg

SEQ ID NO: 5523950 - DNA, 22 bp, Homo sapiens
tcttccaacatgtgatgtgttg

SEQ ID NO: 5523951 - DNA, 24 bp, Homo sapiens
tcttccaacatgtgatgtgttgct

SEQ ID NO: 5523952 - DNA, 19 bp, Homo sapiens
tcttccaaccatttatctt

SEQ ID NO: 5523953 - DNA, 21 bp, Homo sapiens
tcttccaaccatttatcttga

SEQ ID NO: 5523954 - DNA, 15 bp, Homo sapiens
tcttccaaccccagc

SEQ ID NO: 5523955 - DNA, 19 bp, Homo sapiens
tcttccaaccccagctggc

SEQ ID NO: 5523956 - DNA, 20 bp, Homo sapiens
tcttccaaccccagctggcc

SEQ ID NO: 5523957 - DNA, 22 bp, Homo sapiens
tcttccaaccccagctggcctc

SEQ ID NO: 5523958 - DNA, 23 bp, Homo sapiens
tcttccacaaagaaaattcctat

SEQ ID NO: 5523959 - DNA, 20 bp, Homo sapiens
tcttccacagcacaaacaca

SEQ ID NO: 5523960 - DNA, 13 bp, Homo sapiens
tcttccacagtgg

SEQ ID NO: 5523961 - DNA, 15 bp, Homo sapiens
tcttccacccacaaa

SEQ ID NO: 5523962 - DNA, 21 bp, Homo sapiens
tcttccacccacaaactccag

SEQ ID NO: 5523963 - DNA, 22 bp, Homo sapiens
tcttccacccacaaactccagg

SEQ ID NO: 5523964 - DNA, 15 bp, Homo sapiens
tcttccacctcagcc

SEQ ID NO: 5523965 - DNA, 14 bp, Homo sapiens
tcttccacctgtgc

SEQ ID NO: 5523966 - DNA, 14 bp, Homo sapiens
tcttccactgagtc

SEQ ID NO: 5523967 - DNA, 16 bp, Homo sapiens
tcttccactgtgtgtt

SEQ ID NO: 5523968 - DNA, 20 bp, Homo sapiens
tcttccactgtgtgttgaca

SEQ ID NO: 5523969 - DNA, 16 bp, Homo sapiens
tcttccactttttcca

SEQ ID NO: 5523970 - DNA, 17 bp, Homo sapiens
tcttccagaacctagga

SEQ ID NO: 5523971 - DNA, 16 bp, Homo sapiens
tcttccagaagtgtga

SEQ ID NO: 5523972 - DNA, 13 bp, Homo sapiens
tcttccagaatcc

SEQ ID NO: 5523973 - DNA, 17 bp, Homo sapiens
tcttccagaatgctgaa

SEQ ID NO: 5523974 - DNA, 13 bp, Homo sapiens
tcttccagacctg

SEQ ID NO: 5523975 - DNA, 23 bp, Homo sapiens
tcttccagacctgcttcctgaaa

SEQ ID NO: 5523976 - DNA, 22 bp, Homo sapiens
tcttccagagcctaagaaaatc

SEQ ID NO: 5523977 - DNA, 16 bp, Homo sapiens
tcttccagccacctag

SEQ ID NO: 5523978 - DNA, 22 bp, Homo sapiens
tcttccagcccagacatcctgt

SEQ ID NO: 5523979 - DNA, 17 bp, Homo sapiens
tcttccaggaagcacag

SEQ ID NO: 5523980 - DNA, 23 bp, Homo sapiens
tcttccaggaagcacaggccagg

SEQ ID NO: 5523981 - DNA, 18 bp, Homo sapiens
tcttccaggagccacctt

SEQ ID NO: 5523982 - DNA, 21 bp, Homo sapiens
tcttccaggcccagtccactg

SEQ ID NO: 5523983 - DNA, 15 bp, Homo sapiens
tcttccaggctggga

SEQ ID NO: 5523984 - DNA, 21 bp, Homo sapiens
tcttccaggctgggagagcct

SEQ ID NO: 5523985 - DNA, 14 bp, Homo sapiens
tcttccagggcagc

SEQ ID NO: 5523986 - DNA, 22 bp, Homo sapiens
tcttccaggtccaaacccttca

SEQ ID NO: 5523987 - DNA, 13 bp, Homo sapiens
tcttccaggtggg

SEQ ID NO: 5523988 - DNA, 18 bp, Homo sapiens
tcttccagtcttcctgac

SEQ ID NO: 5523989 - DNA, 21 bp, Homo sapiens
tcttccagtcttcctgacact

SEQ ID NO: 5523990 - DNA, 18 bp, Homo sapiens
tcttccagttactttcca

SEQ ID NO: 5523991 - DNA, 22 bp, Homo sapiens
tcttccatatggatccactggc

SEQ ID NO: 5523992 - DNA, 13 bp, Homo sapiens
tcttccatcagca

SEQ ID NO: 5523993 - DNA, 14 bp, Homo sapiens
tcttccatcagcag

SEQ ID NO: 5523994 - DNA, 15 bp, Homo sapiens
tcttccatcagcagt

SEQ ID NO: 5523995 - DNA, 19 bp, Homo sapiens
tcttccatcatcactgtaa

SEQ ID NO: 5523996 - DNA, 18 bp, Homo sapiens
tcttccatcatggattca

SEQ ID NO: 5523997 - DNA, 15 bp, Homo sapiens
tcttccatcccagga

SEQ ID NO: 5523998 - DNA, 16 bp, Homo sapiens
tcttccatcccaggac

SEQ ID NO: 5523999 - DNA, 22 bp, Homo sapiens
tcttccatctgcatcttaacat

SEQ ID NO: 5524000 - DNA, 14 bp, Homo sapiens
tcttccatgctgtg

SEQ ID NO: 5524001 - DNA, 17 bp, Homo sapiens
tcttccatgctgtgcgc

SEQ ID NO: 5524002 - DNA, 14 bp, Homo sapiens
tcttccatgtgaac

SEQ ID NO: 5524003 - DNA, 17 bp, Homo sapiens
tcttccattccttcatg

SEQ ID NO: 5524004 - DNA, 15 bp, Homo sapiens
tcttccatttattgc

SEQ ID NO: 5524005 - DNA, 13 bp, Homo sapiens
tcttccatttgca

SEQ ID NO: 5524006 - DNA, 23 bp, Homo sapiens
tcttcccaaagcaagcacctggg

SEQ ID NO: 5524007 - DNA, 15 bp, Homo sapiens
tcttcccaaatcaaa

SEQ ID NO: 5524008 - DNA, 20 bp, Homo sapiens
tcttcccaaatcaaaataaa

SEQ ID NO: 5524009 - DNA, 22 bp, Homo sapiens
tcttcccaaatcaaaataaaag

SEQ ID NO: 5524010 - DNA, 21 bp, Homo sapiens
tcttcccacgtgggcctccca

SEQ ID NO: 5524011 - DNA, 18 bp, Homo sapiens
tcttcccagaatctctga

SEQ ID NO: 5524012 - DNA, 16 bp, Homo sapiens
tcttcccaggcctttg

SEQ ID NO: 5524013 - DNA, 21 bp, Homo sapiens
tcttcccagtaagtttcccct

SEQ ID NO: 5524014 - DNA, 23 bp, Homo sapiens
tcttcccagtaagtttcccctct

SEQ ID NO: 5524015 - DNA, 16 bp, Homo sapiens
tcttcccatcactgga

SEQ ID NO: 5524016 - DNA, 17 bp, Homo sapiens
tcttcccatcactggag

SEQ ID NO: 5524017 - DNA, 15 bp, Homo sapiens
tcttcccatgactgc

SEQ ID NO: 5524018 - DNA, 22 bp, Homo sapiens
tcttcccatgactgcacccagc

SEQ ID NO: 5524019 - DNA, 14 bp, Homo sapiens
tcttcccattctcc

SEQ ID NO: 5524020 - DNA, 18 bp, Homo sapiens
tcttcccatttgtaatgt

SEQ ID NO: 5524021 - DNA, 20 bp, Homo sapiens
tcttccccaacgaaaagcac

SEQ ID NO: 5524022 - DNA, 20 bp, Homo sapiens
tcttccccaaggcactgagc

SEQ ID NO: 5524023 - DNA, 21 bp, Homo sapiens
tcttccccaaggcactgagcg

SEQ ID NO: 5524024 - DNA, 19 bp, Homo sapiens
tcttccccaagggccaaac

SEQ ID NO: 5524025 - DNA, 23 bp, Homo sapiens
tcttccccaagggccaaacccac

SEQ ID NO: 5524026 - DNA, 20 bp, Homo sapiens
tcttcccccacccctaacct

SEQ ID NO: 5524027 - DNA, 22 bp, Homo sapiens
tcttcccccacccctaacctgg

SEQ ID NO: 5524028 - DNA, 19 bp, Homo sapiens
tcttcccccctctcctccc

SEQ ID NO: 5524029 - DNA, 20 bp, Homo sapiens
tcttcccccctctcctccca

SEQ ID NO: 5524030 - DNA, 17 bp, Homo sapiens
tcttccccctctcccag

SEQ ID NO: 5524031 - DNA, 19 bp, Homo sapiens
tcttcccccttcccgcctt

SEQ ID NO: 5524032 - DNA, 15 bp, Homo sapiens
tcttcccctcctgta

SEQ ID NO: 5524033 - DNA, 13 bp, Homo sapiens
tcttcccctgaga

SEQ ID NO: 5524034 - DNA, 21 bp, Homo sapiens
tcttcccctgagagtttcctc

SEQ ID NO: 5524035 - DNA, 22 bp, Homo sapiens
tcttcccctgagagtttcctca

SEQ ID NO: 5524036 - DNA, 15 bp, Homo sapiens
tcttccccttccctt

SEQ ID NO: 5524037 - DNA, 18 bp, Homo sapiens
tcttccccttcctgtttc

SEQ ID NO: 5524038 - DNA, 22 bp, Homo sapiens
tcttccccttcctgtttcagac

SEQ ID NO: 5524039 - DNA, 23 bp, Homo sapiens
tcttccccttgcccttgccctga

SEQ ID NO: 5524040 - DNA, 18 bp, Homo sapiens
tcttcccgaaccccaagg

SEQ ID NO: 5524041 - DNA, 19 bp, Homo sapiens
tcttcccgaaccccaagga

SEQ ID NO: 5524042 - DNA, 16 bp, Homo sapiens
tcttcccgccccacct

SEQ ID NO: 5524043 - DNA, 14 bp, Homo sapiens
tcttcccgctcccc

SEQ ID NO: 5524044 - DNA, 19 bp, Homo sapiens
tcttcccgctccccaccta

SEQ ID NO: 5524045 - DNA, 14 bp, Homo sapiens
tcttcccgtaaaaa

SEQ ID NO: 5524046 - DNA, 15 bp, Homo sapiens
tcttcccgtgtgtat

SEQ ID NO: 5524047 - DNA, 21 bp, Homo sapiens
tcttcccgtgtgtatttctaa

SEQ ID NO: 5524048 - DNA, 15 bp, Homo sapiens
tcttccctacccttc

SEQ ID NO: 5524049 - DNA, 13 bp, Homo sapiens
tcttccctacctc

SEQ ID NO: 5524050 - DNA, 12 bp, Homo sapiens
tcttccctagct

SEQ ID NO: 5524051 - DNA, 12 bp, Homo sapiens
tcttccctcaga

SEQ ID NO: 5524052 - DNA, 14 bp, Homo sapiens
tcttccctccttcc

SEQ ID NO: 5524053 - DNA, 15 bp, Homo sapiens
tcttccctccttccc

SEQ ID NO: 5524054 - DNA, 16 bp, Homo sapiens
tcttccctcggggagc

SEQ ID NO: 5524055 - DNA, 12 bp, Homo sapiens
tcttccctctcc

SEQ ID NO: 5524056 - DNA, 14 bp, Homo sapiens
tcttccctctccct

SEQ ID NO: 5524057 - DNA, 19 bp, Homo sapiens
tcttccctgaagagacagg

SEQ ID NO: 5524058 - DNA, 14 bp, Homo sapiens
tcttccctgcccct

SEQ ID NO: 5524059 - DNA, 22 bp, Homo sapiens
tcttccctgcccctgtgcctct

SEQ ID NO: 5524060 - DNA, 13 bp, Homo sapiens
tcttccctgggct

SEQ ID NO: 5524061 - DNA, 13 bp, Homo sapiens
tcttccctggggg

SEQ ID NO: 5524062 - DNA, 23 bp, Homo sapiens
tcttccctgggggtcccaggatc

SEQ ID NO: 5524063 - DNA, 21 bp, Homo sapiens
tcttccctgtcttccccacct

SEQ ID NO: 5524064 - DNA, 19 bp, Homo sapiens
tcttccctgttttaaatta

SEQ ID NO: 5524065 - DNA, 19 bp, Homo sapiens
tcttcccttaactccaaga

SEQ ID NO: 5524066 - DNA, 20 bp, Homo sapiens
tcttcccttagcctctccca

SEQ ID NO: 5524067 - DNA, 18 bp, Homo sapiens
tcttcccttattcctaat

SEQ ID NO: 5524068 - DNA, 21 bp, Homo sapiens
tcttcccttattcctaatggc

SEQ ID NO: 5524069 - DNA, 19 bp, Homo sapiens
tcttcccttcctccattgc

SEQ ID NO: 5524070 - DNA, 14 bp, Homo sapiens
tcttcccttctccc

SEQ ID NO: 5524071 - DNA, 16 bp, Homo sapiens
tcttcccttctttgca

SEQ ID NO: 5524072 - DNA, 17 bp, Homo sapiens
tcttcccttgctcatga

SEQ ID NO: 5524073 - DNA, 19 bp, Homo sapiens
tcttccctttccccagcat

SEQ ID NO: 5524074 - DNA, 17 bp, Homo sapiens
tcttccctttcctccct

SEQ ID NO: 5524075 - DNA, 17 bp, Homo sapiens
tcttccgcaccctccct

SEQ ID NO: 5524076 - DNA, 21 bp, Homo sapiens
tcttccgcaccctccctagct

SEQ ID NO: 5524077 - DNA, 17 bp, Homo sapiens
tcttccgcccctgcctg

SEQ ID NO: 5524078 - DNA, 19 bp, Homo sapiens
tcttccgcccctgcctgcc

SEQ ID NO: 5524079 - DNA, 15 bp, Homo sapiens
tcttccggagatgta

SEQ ID NO: 5524080 - DNA, 21 bp, Homo sapiens
tcttccggagatgtagcaaaa

SEQ ID NO: 5524081 - DNA, 18 bp, Homo sapiens
tcttccgtgcatcccaga

SEQ ID NO: 5524082 - DNA, 21 bp, Homo sapiens
tcttccgttggaaagaacatt

SEQ ID NO: 5524083 - DNA, 18 bp, Homo sapiens
tcttcctaccaaatataa

SEQ ID NO: 5524084 - DNA, 20 bp, Homo sapiens
tcttcctaccaagtcaaact

SEQ ID NO: 5524085 - DNA, 21 bp, Homo sapiens
tcttcctaccctgcctccctt

SEQ ID NO: 5524086 - DNA, 16 bp, Homo sapiens
tcttcctactcttctc

SEQ ID NO: 5524087 - DNA, 18 bp, Homo sapiens
tcttcctagatctgcagg

SEQ ID NO: 5524088 - DNA, 20 bp, Homo sapiens
tcttcctagatctgcaggct

SEQ ID NO: 5524089 - DNA, 18 bp, Homo sapiens
tcttcctaggtccaagcc

SEQ ID NO: 5524090 - DNA, 23 bp, Homo sapiens
tcttcctagttttctcctcccag

SEQ ID NO: 5524091 - DNA, 19 bp, Homo sapiens
tcttcctatccctctccta

SEQ ID NO: 5524092 - DNA, 17 bp, Homo sapiens
tcttcctatttcagaag

SEQ ID NO: 5524093 - DNA, 18 bp, Homo sapiens
tcttcctatttctggaat

SEQ ID NO: 5524094 - DNA, 23 bp, Homo sapiens
tcttcctcaaaataaagaagtat

SEQ ID NO: 5524095 - DNA, 18 bp, Homo sapiens
tcttcctcacactgctgt

SEQ ID NO: 5524096 - DNA, 15 bp, Homo sapiens
tcttcctcagccagc

SEQ ID NO: 5524097 - DNA, 15 bp, Homo sapiens
tcttcctcatcagta

SEQ ID NO: 5524098 - DNA, 15 bp, Homo sapiens
tcttcctccacttca

SEQ ID NO: 5524099 - DNA, 17 bp, Homo sapiens
tcttcctccagctgcac

SEQ ID NO: 5524100 - DNA, 19 bp, Homo sapiens
tcttcctccagctgcacca

SEQ ID NO: 5524101 - DNA, 20 bp, Homo sapiens
tcttcctccagtctgttctc

SEQ ID NO: 5524102 - DNA, 14 bp, Homo sapiens
tcttcctcccaagt

SEQ ID NO: 5524103 - DNA, 13 bp, Homo sapiens
tcttcctcccctc

SEQ ID NO: 5524104 - DNA, 15 bp, Homo sapiens
tcttcctccctccct

SEQ ID NO: 5524105 - DNA, 21 bp, Homo sapiens
tcttcctccctccctgcaggg

SEQ ID NO: 5524106 - DNA, 17 bp, Homo sapiens
tcttcctcctcccaagg

SEQ ID NO: 5524107 - DNA, 16 bp, Homo sapiens
tcttcctcctcccctg

SEQ ID NO: 5524108 - DNA, 12 bp, Homo sapiens
tcttcctcctga

SEQ ID NO: 5524109 - DNA, 13 bp, Homo sapiens
tcttcctctcctt

SEQ ID NO: 5524110 - DNA, 16 bp, Homo sapiens
tcttcctctctctcac

SEQ ID NO: 5524111 - DNA, 13 bp, Homo sapiens
tcttcctctgagg

SEQ ID NO: 5524112 - DNA, 14 bp, Homo sapiens
tcttcctctgggca

SEQ ID NO: 5524113 - DNA, 16 bp, Homo sapiens
tcttcctcttccccca

SEQ ID NO: 5524114 - DNA, 13 bp, Homo sapiens
tcttcctgacact

SEQ ID NO: 5524115 - DNA, 15 bp, Homo sapiens
tcttcctgacacttt

SEQ ID NO: 5524116 - DNA, 22 bp, Homo sapiens
tcttcctgaccaccttgcacta

SEQ ID NO: 5524117 - DNA, 10 bp, Homo sapiens
tcttcctgca

SEQ ID NO: 5524118 - DNA, 15 bp, Homo sapiens
tcttcctgcctccca

SEQ ID NO: 5524119 - DNA, 14 bp, Homo sapiens
tcttcctgccttcg

SEQ ID NO: 5524120 - DNA, 18 bp, Homo sapiens
tcttcctgcgtagaagat

SEQ ID NO: 5524121 - DNA, 19 bp, Homo sapiens
tcttgaccatactaataaa

SEQ ID NO: 5524122 - DNA, 18 bp, Homo sapiens
tcttgaccctgcaccctc

SEQ ID NO: 5524123 - DNA, 12 bp, Homo sapiens
tcttgacctctc

SEQ ID NO: 5524124 - DNA, 15 bp, Homo sapiens
tcttgacctctccag

SEQ ID NO: 5524125 - DNA, 23 bp, Homo sapiens
tcttgaccttatgccattccata

SEQ ID NO: 5524126 - DNA, 19 bp, Homo sapiens
tcttgacgaatattgctta

SEQ ID NO: 5524127 - DNA, 20 bp, Homo sapiens
tcttgactaggtattgtcta

SEQ ID NO: 5524128 - DNA, 24 bp, Homo sapiens
tcttgactcaggtggtgtccttct

SEQ ID NO: 5524129 - DNA, 18 bp, Homo sapiens
tcttgactctaaatgcag

SEQ ID NO: 5524130 - DNA, 14 bp, Homo sapiens
tcttgactggctca

SEQ ID NO: 5524131 - DNA, 17 bp, Homo sapiens
tcttgacttagacctat

SEQ ID NO: 5524132 - DNA, 15 bp, Homo sapiens
tcttgacttcacagc

SEQ ID NO: 5524133 - DNA, 17 bp, Homo sapiens
tcttgactttgtatctt

SEQ ID NO: 5524134 - DNA, 15 bp, Homo sapiens
tcttgactttttaaa

SEQ ID NO: 5524135 - DNA, 15 bp, Homo sapiens
tcttgagaaatacta

SEQ ID NO: 5524136 - DNA, 13 bp, Homo sapiens
tcttgagagaaaa

SEQ ID NO: 5524137 - DNA, 22 bp, Homo sapiens
tcttgagagaaaagaaaaatat

SEQ ID NO: 5524138 - DNA, 20 bp, Homo sapiens
tcttgagagaaacgtgaaac

SEQ ID NO: 5524139 - DNA, 20 bp, Homo sapiens
tcttgagagcgctggcctct

SEQ ID NO: 5524140 - DNA, 13 bp, Homo sapiens
tcttgagagctgc

SEQ ID NO: 5524141 - DNA, 23 bp, Homo sapiens
tcttgagatgtattatgcaaagt

SEQ ID NO: 5524142 - DNA, 16 bp, Homo sapiens
tcttgagatgtcttct

SEQ ID NO: 5524143 - DNA, 22 bp, Homo sapiens
tcttgagcaatgtttttctcaa

SEQ ID NO: 5524144 - DNA, 12 bp, Homo sapiens
tcttgagcagac

SEQ ID NO: 5524145 - DNA, 22 bp, Homo sapiens
tcttgagcagttagcagaccta

SEQ ID NO: 5524146 - DNA, 17 bp, Homo sapiens
tcttgagcatcaatctt

SEQ ID NO: 5524147 - DNA, 18 bp, Homo sapiens
tcttgagccagtaatctt

SEQ ID NO: 5524148 - DNA, 19 bp, Homo sapiens
tcttgagccagtaatcttt

SEQ ID NO: 5524149 - DNA, 16 bp, Homo sapiens
tcttgagccctcctgg

SEQ ID NO: 5524150 - DNA, 16 bp, Homo sapiens
tcttgagcctgagcct

SEQ ID NO: 5524151 - DNA, 16 bp, Homo sapiens
tcttgagcctgggagg

SEQ ID NO: 5524152 - DNA, 19 bp, Homo sapiens
tcttgagccttgaactttg

SEQ ID NO: 5524153 - DNA, 21 bp, Homo sapiens
tcttgagctagaccaaggtca

SEQ ID NO: 5524154 - DNA, 13 bp, Homo sapiens
tcttgagctctat

SEQ ID NO: 5524155 - DNA, 14 bp, Homo sapiens
tcttgagctctatt

SEQ ID NO: 5524156 - DNA, 21 bp, Homo sapiens
tcttgagctggcctctctagc

SEQ ID NO: 5524157 - DNA, 23 bp, Homo sapiens
tcttgagctggcctctctagcac

SEQ ID NO: 5524158 - DNA, 19 bp, Homo sapiens
tcttgaggaagcccaggct

SEQ ID NO: 5524159 - DNA, 15 bp, Homo sapiens
tcttgaggagcatta

SEQ ID NO: 5524160 - DNA, 16 bp, Homo sapiens
tcttgaggccaggagt

SEQ ID NO: 5524161 - DNA, 17 bp, Homo sapiens
tcttgaggcttctgctt

SEQ ID NO: 5524162 - DNA, 22 bp, Homo sapiens
tcttgaggggaagctagtcttt

SEQ ID NO: 5524163 - DNA, 15 bp, Homo sapiens
tcttgaggggaccag

SEQ ID NO: 5524164 - DNA, 17 bp, Homo sapiens
tcttgaggtctcttttc

SEQ ID NO: 5524165 - DNA, 23 bp, Homo sapiens
tcttgaggtggtagtaaaacaca

SEQ ID NO: 5524166 - DNA, 23 bp, Homo sapiens
tcttgagtactagaatttgtatt

SEQ ID NO: 5524167 - DNA, 15 bp, Homo sapiens
tcttgagtagatctg

SEQ ID NO: 5524168 - DNA, 15 bp, Homo sapiens
tcttgagtgggcccc

SEQ ID NO: 5524169 - DNA, 13 bp, Homo sapiens
tcttgagtgttat

SEQ ID NO: 5524170 - DNA, 19 bp, Homo sapiens
tcttgatacattcaaattt

SEQ ID NO: 5524171 - DNA, 17 bp, Homo sapiens
tcttgatacccccctct

SEQ ID NO: 5524172 - DNA, 19 bp, Homo sapiens
tcttgatcaacatcttttc

SEQ ID NO: 5524173 - DNA, 23 bp, Homo sapiens
tcttgatcaacatcttttcttgc

SEQ ID NO: 5524174 - DNA, 17 bp, Homo sapiens
tcttgatcagtgtgcta

SEQ ID NO: 5524175 - DNA, 15 bp, Homo sapiens
tcttgatctcctgag

SEQ ID NO: 5524176 - DNA, 14 bp, Homo sapiens
tcttgatctctctt

SEQ ID NO: 5524177 - DNA, 22 bp, Homo sapiens
tcttgatctgctcagccctgga

SEQ ID NO: 5524178 - DNA, 17 bp, Homo sapiens
tcttgatctttgagccc

SEQ ID NO: 5524179 - DNA, 19 bp, Homo sapiens
tcttgatgatcctcaagga

SEQ ID NO: 5524180 - DNA, 13 bp, Homo sapiens
tcttgatgcatgc

SEQ ID NO: 5524181 - DNA, 20 bp, Homo sapiens
tcttgatgcctggcggggtg

SEQ ID NO: 5524182 - DNA, 22 bp, Homo sapiens
tcttgatgctcacctctatatt

SEQ ID NO: 5524183 - DNA, 16 bp, Homo sapiens
tcttgatgtaaaatct

SEQ ID NO: 5524184 - DNA, 21 bp, Homo sapiens
tcttgatgtaaggatgggcat

SEQ ID NO: 5524185 - DNA, 22 bp, Homo sapiens
tcttgatgtcatgtacttcctg

SEQ ID NO: 5524186 - DNA, 15 bp, Homo sapiens
tcttgattaatgtac

SEQ ID NO: 5524187 - DNA, 18 bp, Homo sapiens
tcttgattaatgtacttt

SEQ ID NO: 5524188 - DNA, 22 bp, Homo sapiens
tcttgattaatgtactttttat

SEQ ID NO: 5524189 - DNA, 17 bp, Homo sapiens
tcttgattataaatgtt

SEQ ID NO: 5524190 - DNA, 14 bp, Homo sapiens
tcttgattatccat

SEQ ID NO: 5524191 - DNA, 17 bp, Homo sapiens
tcttgattcagtcacat

SEQ ID NO: 5524192 - DNA, 13 bp, Homo sapiens
tcttgattcctgg

SEQ ID NO: 5524193 - DNA, 23 bp, Homo sapiens
tcttgattcgtagatttaataac

SEQ ID NO: 5524194 - DNA, 14 bp, Homo sapiens
tcttgattgatttt

SEQ ID NO: 5524195 - DNA, 15 bp, Homo sapiens
tcttgatttcccaaa

SEQ ID NO: 5524196 - DNA, 13 bp, Homo sapiens
tcttgatttcttt

SEQ ID NO: 5524197 - DNA, 13 bp, Homo sapiens
tcttgatttgagt

SEQ ID NO: 5524198 - DNA, 19 bp, Homo sapiens
tcttgattttcaagctttc

SEQ ID NO: 5524199 - DNA, 11 bp, Homo sapiens
tcttgattttt

SEQ ID NO: 5524200 - DNA, 14 bp, Homo sapiens
tcttgatttttcgg

SEQ ID NO: 5524201 - DNA, 17 bp, Homo sapiens
tcttgcaaaattcctga

SEQ ID NO: 5524202 - DNA, 19 bp, Homo sapiens
tcttgcaaagcctttaaat

SEQ ID NO: 5524203 - DNA, 13 bp, Homo sapiens
tcttgcaacagtg

SEQ ID NO: 5524204 - DNA, 16 bp, Homo sapiens
tcttgcaacttcagtt

SEQ ID NO: 5524205 - DNA, 16 bp, Homo sapiens
tcttgcaagctccagt

SEQ ID NO: 5524206 - DNA, 23 bp, Homo sapiens
tcttgcaagggaagagcctttat

SEQ ID NO: 5524207 - DNA, 17 bp, Homo sapiens
tcttgcaatggcagcct

SEQ ID NO: 5524208 - DNA, 11 bp, Homo sapiens
tcttgcaattt

SEQ ID NO: 5524209 - DNA, 17 bp, Homo sapiens
tcttgcaatttgaaggt

SEQ ID NO: 5524210 - DNA, 15 bp, Homo sapiens
tcttgcacacacttt

SEQ ID NO: 5524211 - DNA, 20 bp, Homo sapiens
tcttgcacagtcactgctct

SEQ ID NO: 5524212 - DNA, 19 bp, Homo sapiens
tcttgcacccgcctctccc

SEQ ID NO: 5524213 - DNA, 16 bp, Homo sapiens
tcttgcactccttccc

SEQ ID NO: 5524214 - DNA, 13 bp, Homo sapiens
tcttgcactgaat

SEQ ID NO: 5524215 - DNA, 12 bp, Homo sapiens
tcttgcactgta

SEQ ID NO: 5524216 - DNA, 19 bp, Homo sapiens
tcttgcactgtatccaagt

SEQ ID NO: 5524217 - DNA, 18 bp, Homo sapiens
tcttgcagagaagccttg

SEQ ID NO: 5524218 - DNA, 19 bp, Homo sapiens
tcttgcagattctatttcc

SEQ ID NO: 5524219 - DNA, 15 bp, Homo sapiens
tcttgcagcagagag

SEQ ID NO: 5524220 - DNA, 16 bp, Homo sapiens
tcttgcagcatttact

SEQ ID NO: 5524221 - DNA, 13 bp, Homo sapiens
tcttgcaggctga

SEQ ID NO: 5524222 - DNA, 21 bp, Homo sapiens
tcttgcagtatcggcactgta

SEQ ID NO: 5524223 - DNA, 19 bp, Homo sapiens
tcttgcagtggacggagag

SEQ ID NO: 5524224 - DNA, 21 bp, Homo sapiens
tcttgcagtggacggagagcc

SEQ ID NO: 5524225 - DNA, 20 bp, Homo sapiens
tcttgcagtggcttttcatg

SEQ ID NO: 5524226 - DNA, 22 bp, Homo sapiens
tcttgcagttttgtaagccctc

SEQ ID NO: 5524227 - DNA, 23 bp, Homo sapiens
tcttgcataagcctcaggcctgg

SEQ ID NO: 5524228 - DNA, 23 bp, Homo sapiens
tcttgcatccttcctataacttg

SEQ ID NO: 5524229 - DNA, 16 bp, Homo sapiens
tcttgcatctaatgaa

SEQ ID NO: 5524230 - DNA, 15 bp, Homo sapiens
tcttgcatggtttgg

SEQ ID NO: 5524231 - DNA, 12 bp, Homo sapiens
tcttgcatgtaa

SEQ ID NO: 5524232 - DNA, 15 bp, Homo sapiens
tcttgcattatgcaa

SEQ ID NO: 5524233 - DNA, 17 bp, Homo sapiens
tcttgcattatgcaatt

SEQ ID NO: 5524234 - DNA, 21 bp, Homo sapiens
tcttgcattcatggttatgaa

SEQ ID NO: 5524235 - DNA, 17 bp, Homo sapiens
tcttgcattcattttct

SEQ ID NO: 5524236 - DNA, 23 bp, Homo sapiens
tcttgcatttaaaagacagcttt

SEQ ID NO: 5524237 - DNA, 15 bp, Homo sapiens
tcttgccacatcttg

SEQ ID NO: 5524238 - DNA, 17 bp, Homo sapiens
tcttgccacatcttgaa

SEQ ID NO: 5524239 - DNA, 16 bp, Homo sapiens
tcttgccacatttctg

SEQ ID NO: 5524240 - DNA, 17 bp, Homo sapiens
tcttgccaccctctggg

SEQ ID NO: 5524241 - DNA, 21 bp, Homo sapiens
tcttgccaccctctgggagtc

SEQ ID NO: 5524242 - DNA, 14 bp, Homo sapiens
tcttgccagccaca

SEQ ID NO: 5524243 - DNA, 13 bp, Homo sapiens
tcttgccagccag

SEQ ID NO: 5524244 - DNA, 15 bp, Homo sapiens
tcttgccagcctcct

SEQ ID NO: 5524245 - DNA, 19 bp, Homo sapiens
tcttgccagcctccttgct

SEQ ID NO: 5524246 - DNA, 13 bp, Homo sapiens
tcttgccagctca

SEQ ID NO: 5524247 - DNA, 15 bp, Homo sapiens
tcttgccatcctgat

SEQ ID NO: 5524248 - DNA, 17 bp, Homo sapiens
tcttgccatcctgatgg

SEQ ID NO: 5524249 - DNA, 16 bp, Homo sapiens
tcttgccccaaatcac

SEQ ID NO: 5524250 - DNA, 21 bp, Homo sapiens
tcttgccccaaatcacaaaca

SEQ ID NO: 5524251 - DNA, 22 bp, Homo sapiens
tcttgccccaacccccagcacc

SEQ ID NO: 5524252 - DNA, 19 bp, Homo sapiens
tcttgccccagtttggggt

SEQ ID NO: 5524253 - DNA, 21 bp, Homo sapiens
tcttgccccatcactgcgcca

SEQ ID NO: 5524254 - DNA, 21 bp, Homo sapiens
tcttgccccccaccccagcct

SEQ ID NO: 5524255 - DNA, 11 bp, Homo sapiens
tcttgcccctt

SEQ ID NO: 5524256 - DNA, 14 bp, Homo sapiens
tcttgccccttggg

SEQ ID NO: 5524257 - DNA, 12 bp, Homo sapiens
tcttgccctgag

SEQ ID NO: 5524258 - DNA, 14 bp, Homo sapiens
tcttgccctgagct

SEQ ID NO: 5524259 - DNA, 14 bp, Homo sapiens
tcttgccctgggga

SEQ ID NO: 5524260 - DNA, 16 bp, Homo sapiens
tcttgcccttccctgt

SEQ ID NO: 5524261 - DNA, 21 bp, Homo sapiens
tcttgcccttccctgtccctc

SEQ ID NO: 5524262 - DNA, 22 bp, Homo sapiens
tcttgcccttcctaactaaagg

SEQ ID NO: 5524263 - DNA, 22 bp, Homo sapiens
tcttgccgtcactattcatcaa

SEQ ID NO: 5524264 - DNA, 17 bp, Homo sapiens
tcttgcctacttttctt

SEQ ID NO: 5524265 - DNA, 20 bp, Homo sapiens
tcttgcctcagcttccccag

SEQ ID NO: 5524266 - DNA, 23 bp, Homo sapiens
tcttgcctcattttgcttcccat

SEQ ID NO: 5524267 - DNA, 14 bp, Homo sapiens
tcttgcctccaggt

SEQ ID NO: 5524268 - DNA, 23 bp, Homo sapiens
tcttgcctcgaggggcccaggga

SEQ ID NO: 5524269 - DNA, 13 bp, Homo sapiens
tcttgcctctctc

SEQ ID NO: 5524270 - DNA, 16 bp, Homo sapiens
tcttgcctctctcagg

SEQ ID NO: 5524271 - DNA, 12 bp, Homo sapiens
tcttgcctctgt

SEQ ID NO: 5524272 - DNA, 14 bp, Homo sapiens
tcttgcctgaggct

SEQ ID NO: 5524273 - DNA, 16 bp, Homo sapiens
tcttgcctgaggctca

SEQ ID NO: 5524274 - DNA, 20 bp, Homo sapiens
tcttgcctgaggctcaagag

SEQ ID NO: 5524275 - DNA, 23 bp, Homo sapiens
tcttgcctgaggctcaagaggcc

SEQ ID NO: 5524276 - DNA, 23 bp, Homo sapiens
tcttgcctgaggggaaagagaga

SEQ ID NO: 5524277 - DNA, 18 bp, Homo sapiens
tcttgcctgccactgtgt

SEQ ID NO: 5524278 - DNA, 13 bp, Homo sapiens
tcttgcctgccag

SEQ ID NO: 5524279 - DNA, 21 bp, Homo sapiens
tcttgcctgcctaacaaaata

SEQ ID NO: 5524280 - DNA, 16 bp, Homo sapiens
tcttgccttacacaaa

SEQ ID NO: 5524281 - DNA, 18 bp, Homo sapiens
tcttgccttccccttgaa

SEQ ID NO: 5524282 - DNA, 18 bp, Homo sapiens
tcttgcctttccacctgc

SEQ ID NO: 5524283 - DNA, 14 bp, Homo sapiens
tcttgccttttgtt

SEQ ID NO: 5524284 - DNA, 16 bp, Homo sapiens
tcttgccttttgttaa

SEQ ID NO: 5524285 - DNA, 22 bp, Homo sapiens
tcttgccttttgttaatgcatt

SEQ ID NO: 5524286 - DNA, 19 bp, Homo sapiens
tcttgcctttttcattatt

SEQ ID NO: 5524287 - DNA, 17 bp, Homo sapiens
tcttgcgaatccaagct

SEQ ID NO: 5524288 - DNA, 21 bp, Homo sapiens
tcttgcgaatccaagctccct

SEQ ID NO: 5524289 - DNA, 21 bp, Homo sapiens
tcttgcggcaccgcccaccca

SEQ ID NO: 5524290 - DNA, 17 bp, Homo sapiens
tcttgcgggcctggaca

SEQ ID NO: 5524291 - DNA, 16 bp, Homo sapiens
tcttgcgggtctgtca

SEQ ID NO: 5524292 - DNA, 15 bp, Homo sapiens
tcttgcgtattggct

SEQ ID NO: 5524293 - DNA, 19 bp, Homo sapiens
tcttgctaagctccagccc

SEQ ID NO: 5524294 - DNA, 13 bp, Homo sapiens
tcttgctaccagt

SEQ ID NO: 5524295 - DNA, 18 bp, Homo sapiens
tcttgctactgaaaaaaa

SEQ ID NO: 5524296 - DNA, 23 bp, Homo sapiens
tcttgctagacaaggttgctgtt

SEQ ID NO: 5524297 - DNA, 13 bp, Homo sapiens
tcttgctagtatt

SEQ ID NO: 5524298 - DNA, 19 bp, Homo sapiens
tcttgctatatgatttagc

SEQ ID NO: 5524299 - DNA, 21 bp, Homo sapiens
tcttgttcatgttttgctaat

SEQ ID NO: 5524300 - DNA, 22 bp, Homo sapiens
tcttgttcattttgagtatttt

SEQ ID NO: 5524301 - DNA, 16 bp, Homo sapiens
tcttgttcctgaaatg

SEQ ID NO: 5524302 - DNA, 14 bp, Homo sapiens
tcttgttcctgtgc

SEQ ID NO: 5524303 - DNA, 15 bp, Homo sapiens
tcttgttcctgtgca

SEQ ID NO: 5524304 - DNA, 14 bp, Homo sapiens
tcttgttctctcct

SEQ ID NO: 5524305 - DNA, 13 bp, Homo sapiens
tcttgttctgtca

SEQ ID NO: 5524306 - DNA, 14 bp, Homo sapiens
tcttgttctgttcc

SEQ ID NO: 5524307 - DNA, 13 bp, Homo sapiens
tcttgttctgttt

SEQ ID NO: 5524308 - DNA, 14 bp, Homo sapiens
tcttgttcttcccc

SEQ ID NO: 5524309 - DNA, 16 bp, Homo sapiens
tcttgttgaagtgctg

SEQ ID NO: 5524310 - DNA, 16 bp, Homo sapiens
tcttgttgataaaaat

SEQ ID NO: 5524311 - DNA, 17 bp, Homo sapiens
tcttgttggtagcatgt

SEQ ID NO: 5524312 - DNA, 11 bp, Homo sapiens
tcttgttggtt

SEQ ID NO: 5524313 - DNA, 13 bp, Homo sapiens
tcttgttgttcat

SEQ ID NO: 5524314 - DNA, 20 bp, Homo sapiens
tcttgtttatacctttgcct

SEQ ID NO: 5524315 - DNA, 18 bp, Homo sapiens
tcttgtttcactccacca

SEQ ID NO: 5524316 - DNA, 13 bp, Homo sapiens
tcttgtttcattt

SEQ ID NO: 5524317 - DNA, 15 bp, Homo sapiens
tcttgtttccttgtt

SEQ ID NO: 5524318 - DNA, 21 bp, Homo sapiens
tcttgtttctccagattttta

SEQ ID NO: 5524319 - DNA, 14 bp, Homo sapiens
tcttgtttctgaaa

SEQ ID NO: 5524320 - DNA, 14 bp, Homo sapiens
tcttgtttctgagt

SEQ ID NO: 5524321 - DNA, 22 bp, Homo sapiens
tcttgtttctgcatctttttga

SEQ ID NO: 5524322 - DNA, 21 bp, Homo sapiens
tcttgtttctgggtccctgct

SEQ ID NO: 5524323 - DNA, 22 bp, Homo sapiens
tcttgtttctgggtccctgctc

SEQ ID NO: 5524324 - DNA, 14 bp, Homo sapiens
tcttgtttctgtgc

SEQ ID NO: 5524325 - DNA, 21 bp, Homo sapiens
tcttgtttggagggatcattt

SEQ ID NO: 5524326 - DNA, 15 bp, Homo sapiens
tcttgtttgtcagca

SEQ ID NO: 5524327 - DNA, 16 bp, Homo sapiens
tcttgtttgtcagcat

SEQ ID NO: 5524328 - DNA, 21 bp, Homo sapiens
tcttgtttgtcagcatctgac

SEQ ID NO: 5524329 - DNA, 16 bp, Homo sapiens
tcttgtttgttactgt

SEQ ID NO: 5524330 - DNA, 22 bp, Homo sapiens
tcttgttttaagcaaatgcatt

SEQ ID NO: 5524331 - DNA, 16 bp, Homo sapiens
tcttgttttacatttg

SEQ ID NO: 5524332 - DNA, 13 bp, Homo sapiens
tcttgttttgaaa

SEQ ID NO: 5524333 - DNA, 16 bp, Homo sapiens
tcttgttttgaaaata

SEQ ID NO: 5524334 - DNA, 13 bp, Homo sapiens
tcttgttttgtct

SEQ ID NO: 5524335 - DNA, 20 bp, Homo sapiens
tcttgttttgttgatttttc

SEQ ID NO: 5524336 - DNA, 23 bp, Homo sapiens
tcttgttttgtttgcttccatta

SEQ ID NO: 5524337 - DNA, 16 bp, Homo sapiens
tcttgttttgtttgtc

SEQ ID NO: 5524338 - DNA, 23 bp, Homo sapiens
tcttgttttgtttgtctctcctt

SEQ ID NO: 5524339 - DNA, 17 bp, Homo sapiens
tcttgtttttaagtttg

SEQ ID NO: 5524340 - DNA, 23 bp, Homo sapiens
tcttgtttttaagtttgcactca

SEQ ID NO: 5524341 - DNA, 20 bp, Homo sapiens
tcttgtttttccactactgc

SEQ ID NO: 5524342 - DNA, 21 bp, Homo sapiens
tcttgtttttccactactgct

SEQ ID NO: 5524343 - DNA, 21 bp, Homo sapiens
tctttaaaaaaaaatcttgtg

SEQ ID NO: 5524344 - DNA, 23 bp, Homo sapiens
tctttaaaaaagaaattatcttt

SEQ ID NO: 5524345 - DNA, 12 bp, Homo sapiens
tctttaaaaact

SEQ ID NO: 5524346 - DNA, 18 bp, Homo sapiens
tctttaaaaactcactta

SEQ ID NO: 5524347 - DNA, 15 bp, Homo sapiens
tctttaaaaactgtt

SEQ ID NO: 5524348 - DNA, 14 bp, Homo sapiens
tctttaaaacaaaa

SEQ ID NO: 5524349 - DNA, 12 bp, Homo sapiens
tctttaaaagaa

SEQ ID NO: 5524350 - DNA, 15 bp, Homo sapiens
tctttaaaagaaact

SEQ ID NO: 5524351 - DNA, 23 bp, Homo sapiens
tctttaaaagaaacttaactgtt

SEQ ID NO: 5524352 - DNA, 16 bp, Homo sapiens
tctttaaaagaatgac

SEQ ID NO: 5524353 - DNA, 16 bp, Homo sapiens
tctttaaaaggaaaga

SEQ ID NO: 5524354 - DNA, 14 bp, Homo sapiens
tctttaaaataaaa

SEQ ID NO: 5524355 - DNA, 21 bp, Homo sapiens
tctttaaaatttaagtatctt

SEQ ID NO: 5524356 - DNA, 21 bp, Homo sapiens
tctttaaaattttttatttta

SEQ ID NO: 5524357 - DNA, 19 bp, Homo sapiens
tctttaaacaaatatgaaa

SEQ ID NO: 5524358 - DNA, 20 bp, Homo sapiens
tctttaaacaaatatgaaaa

SEQ ID NO: 5524359 - DNA, 23 bp, Homo sapiens
tctttaaacaaatatgaaaaatg

SEQ ID NO: 5524360 - DNA, 21 bp, Homo sapiens
tctttaaaccactaaaataca

SEQ ID NO: 5524361 - DNA, 15 bp, Homo sapiens
tctttaaactactga

SEQ ID NO: 5524362 - DNA, 14 bp, Homo sapiens
tctttaaactatgt

SEQ ID NO: 5524363 - DNA, 20 bp, Homo sapiens
tctttaaagaggagcctttc

SEQ ID NO: 5524364 - DNA, 13 bp, Homo sapiens
tctttaaagatgt

SEQ ID NO: 5524365 - DNA, 14 bp, Homo sapiens
tctttaaaggccca

SEQ ID NO: 5524366 - DNA, 21 bp, Homo sapiens
tctttaaaggcccagccccta

SEQ ID NO: 5524367 - DNA, 22 bp, Homo sapiens
tctttaaaggcccagcccctag

SEQ ID NO: 5524368 - DNA, 23 bp, Homo sapiens
tctttaaaggcccagcccctaga

SEQ ID NO: 5524369 - DNA, 15 bp, Homo sapiens
tctttaaataataaa

SEQ ID NO: 5524370 - DNA, 13 bp, Homo sapiens
tctttaaatacag

SEQ ID NO: 5524371 - DNA, 14 bp, Homo sapiens
tctttaaatacagt

SEQ ID NO: 5524372 - DNA, 12 bp, Homo sapiens
tctttaaataga

SEQ ID NO: 5524373 - DNA, 15 bp, Homo sapiens
tctttaaatcaaaag

SEQ ID NO: 5524374 - DNA, 20 bp, Homo sapiens
tctttaaatcaaaagctgct

SEQ ID NO: 5524375 - DNA, 19 bp, Homo sapiens
tctttaaatcagtattcca

SEQ ID NO: 5524376 - DNA, 16 bp, Homo sapiens
tctttaaatcatttta

SEQ ID NO: 5524377 - DNA, 23 bp, Homo sapiens
tctttaaatcattttaggaaagg

SEQ ID NO: 5524378 - DNA, 11 bp, Homo sapiens
tctttaaatgt

SEQ ID NO: 5524379 - DNA, 13 bp, Homo sapiens
tctttaaattatg

SEQ ID NO: 5524380 - DNA, 15 bp, Homo sapiens
tctttaaattatgac

SEQ ID NO: 5524381 - DNA, 16 bp, Homo sapiens
tctttaaatttcaaat

SEQ ID NO: 5524382 - DNA, 13 bp, Homo sapiens
tctttaacacatt

SEQ ID NO: 5524383 - DNA, 17 bp, Homo sapiens
tctttaacagctttctc

SEQ ID NO: 5524384 - DNA, 22 bp, Homo sapiens
tctttaacatacaagaaaatgt

SEQ ID NO: 5524385 - DNA, 17 bp, Homo sapiens
tctttaacatacatcta

SEQ ID NO: 5524386 - DNA, 18 bp, Homo sapiens
tctttaacatagtcctgt

SEQ ID NO: 5524387 - DNA, 18 bp, Homo sapiens
tctttaaccaggaatatt

SEQ ID NO: 5524388 - DNA, 21 bp, Homo sapiens
tctttaaccagtctgaagttt

SEQ ID NO: 5524389 - DNA, 15 bp, Homo sapiens
tctttaaccctcact

SEQ ID NO: 5524390 - DNA, 21 bp, Homo sapiens
tctttaactcaggactccagc

SEQ ID NO: 5524391 - DNA, 11 bp, Homo sapiens
tctttaactgc

SEQ ID NO: 5524392 - DNA, 22 bp, Homo sapiens
tctttaactgccgtaatttaac

SEQ ID NO: 5524393 - DNA, 13 bp, Homo sapiens
tctttaactgtgt

SEQ ID NO: 5524394 - DNA, 17 bp, Homo sapiens
tctttaacttagtattt

SEQ ID NO: 5524395 - DNA, 12 bp, Homo sapiens
tctttaacttgt

SEQ ID NO: 5524396 - DNA, 10 bp, Homo sapiens
tctttaagag

SEQ ID NO: 5524397 - DNA, 11 bp, Homo sapiens
tctttaagaga

SEQ ID NO: 5524398 - DNA, 13 bp, Homo sapiens
tctttaagagact

SEQ ID NO: 5524399 - DNA, 23 bp, Homo sapiens
tctttaagccatagaccctgagg

SEQ ID NO: 5524400 - DNA, 18 bp, Homo sapiens
tctttaagggcatgcctt

SEQ ID NO: 5524401 - DNA, 20 bp, Homo sapiens
tctttaagggcatgccttgt

SEQ ID NO: 5524402 - DNA, 22 bp, Homo sapiens
tctttaagggcatgccttgtgc

SEQ ID NO: 5524403 - DNA, 19 bp, Homo sapiens
tctttaagtattgattctg

SEQ ID NO: 5524404 - DNA, 18 bp, Homo sapiens
tctttaagtattgtttta

SEQ ID NO: 5524405 - DNA, 15 bp, Homo sapiens
tctttaagttttatt

SEQ ID NO: 5524406 - DNA, 15 bp, Homo sapiens
tctttaataaaacaa

SEQ ID NO: 5524407 - DNA, 18 bp, Homo sapiens
tctttaataacaatatat

SEQ ID NO: 5524408 - DNA, 14 bp, Homo sapiens
tctttaatataata

SEQ ID NO: 5524409 - DNA, 15 bp, Homo sapiens
tctttaatataataa

SEQ ID NO: 5524410 - DNA, 22 bp, Homo sapiens
tctttaatataatattatactg

SEQ ID NO: 5524411 - DNA, 14 bp, Homo sapiens
tctttaatcactta

SEQ ID NO: 5524412 - DNA, 14 bp, Homo sapiens
tctttaatcccagt

SEQ ID NO: 5524413 - DNA, 13 bp, Homo sapiens
tctttaatctgtt

SEQ ID NO: 5524414 - DNA, 13 bp, Homo sapiens
tctttaatgctgt

SEQ ID NO: 5524415 - DNA, 18 bp, Homo sapiens
tctttaatgctgtctttg

SEQ ID NO: 5524416 - DNA, 19 bp, Homo sapiens
tctttaatgtcacaggcag

SEQ ID NO: 5524417 - DNA, 20 bp, Homo sapiens
tctttaatgttgtccaggaa

SEQ ID NO: 5524418 - DNA, 14 bp, Homo sapiens
tctttaattaaaac

SEQ ID NO: 5524419 - DNA, 12 bp, Homo sapiens
tctttaattcct

SEQ ID NO: 5524420 - DNA, 24 bp, Homo sapiens
tctttaattccttatcctagcctt

SEQ ID NO: 5524421 - DNA, 13 bp, Homo sapiens
tctttaattctgt

SEQ ID NO: 5524422 - DNA, 22 bp, Homo sapiens
tctttaatttctgtcagaatgc

SEQ ID NO: 5524423 - DNA, 14 bp, Homo sapiens
tctttacaaaacaa

SEQ ID NO: 5524424 - DNA, 14 bp, Homo sapiens
tctttacaaactga

SEQ ID NO: 5524425 - DNA, 21 bp, Homo sapiens
tctttacaagcaggcactgta

SEQ ID NO: 5524426 - DNA, 20 bp, Homo sapiens
tctttacatggtggtgatgt

SEQ ID NO: 5524427 - DNA, 20 bp, Homo sapiens
tctttaccaaaaaccatgtt

SEQ ID NO: 5524428 - DNA, 16 bp, Homo sapiens
tctttaccaaaggttt

SEQ ID NO: 5524429 - DNA, 18 bp, Homo sapiens
tctttaccttcatttcat

SEQ ID NO: 5524430 - DNA, 23 bp, Homo sapiens
tctttaccttctaaaagccatta

SEQ ID NO: 5524431 - DNA, 18 bp, Homo sapiens
tctttacctttattgata

SEQ ID NO: 5524432 - DNA, 22 bp, Homo sapiens
tctttacgtactgtaactgctc

SEQ ID NO: 5524433 - DNA, 16 bp, Homo sapiens
tctttactcccaagac

SEQ ID NO: 5524434 - DNA, 22 bp, Homo sapiens
tctttactcccttcctggcctc

SEQ ID NO: 5524435 - DNA, 14 bp, Homo sapiens
tctttactctgact

SEQ ID NO: 5524436 - DNA, 18 bp, Homo sapiens
tctttactggacctgaaa

SEQ ID NO: 5524437 - DNA, 21 bp, Homo sapiens
tctttactggtgatttctgag

SEQ ID NO: 5524438 - DNA, 23 bp, Homo sapiens
tctttacttaacatatctgatat

SEQ ID NO: 5524439 - DNA, 20 bp, Homo sapiens
tctttacttccatctgtttg

SEQ ID NO: 5524440 - DNA, 15 bp, Homo sapiens
tctttagaaaaggca

SEQ ID NO: 5524441 - DNA, 16 bp, Homo sapiens
tctttagaaaaggcat

SEQ ID NO: 5524442 - DNA, 15 bp, Homo sapiens
tctttagaacaacat

SEQ ID NO: 5524443 - DNA, 22 bp, Homo sapiens
tctttagaacaacataaaatta

SEQ ID NO: 5524444 - DNA, 20 bp, Homo sapiens
tctttagagaactgaaaaga

SEQ ID NO: 5524445 - DNA, 22 bp, Homo sapiens
tctttagagaactgaaaagaga

SEQ ID NO: 5524446 - DNA, 12 bp, Homo sapiens
tctttagagatt

SEQ ID NO: 5524447 - DNA, 18 bp, Homo sapiens
tctttagagattataaca

SEQ ID NO: 5524448 - DNA, 13 bp, Homo sapiens
tctttagagcatt

SEQ ID NO: 5524449 - DNA, 14 bp, Homo sapiens
tctttagagcattg

SEQ ID NO: 5524450 - DNA, 17 bp, Homo sapiens
tctttagaggctttcaa

SEQ ID NO: 5524451 - DNA, 13 bp, Homo sapiens
tctttagatattt

SEQ ID NO: 5524452 - DNA, 14 bp, Homo sapiens
tctttagatatttg

SEQ ID NO: 5524453 - DNA, 14 bp, Homo sapiens
tctttagatgcaag

SEQ ID NO: 5524454 - DNA, 15 bp, Homo sapiens
tctttagatgcaagt

SEQ ID NO: 5524455 - DNA, 18 bp, Homo sapiens
tctttagatgccaaacca

SEQ ID NO: 5524456 - DNA, 20 bp, Homo sapiens
tctttagatggtggcacatt

SEQ ID NO: 5524457 - DNA, 17 bp, Homo sapiens
tctttagcagtttcctc

SEQ ID NO: 5524458 - DNA, 15 bp, Homo sapiens
tctttagccagaatc

SEQ ID NO: 5524459 - DNA, 15 bp, Homo sapiens
tctttaggacataaa

SEQ ID NO: 5524460 - DNA, 17 bp, Homo sapiens
tctttaggattgtgatg

SEQ ID NO: 5524461 - DNA, 20 bp, Homo sapiens
tctttaggccaggcttgcct

SEQ ID NO: 5524462 - DNA, 22 bp, Homo sapiens
tctttagggaacaaggatgttt

SEQ ID NO: 5524463 - DNA, 22 bp, Homo sapiens
tctttagggagacccaataaag

SEQ ID NO: 5524464 - DNA, 23 bp, Homo sapiens
tctttagggagacccaataaaga

SEQ ID NO: 5524465 - DNA, 22 bp, Homo sapiens
tctttaggggaagtaaaacagt

SEQ ID NO: 5524466 - DNA, 16 bp, Homo sapiens
tctttaggtctttgta

SEQ ID NO: 5524467 - DNA, 16 bp, Homo sapiens
tctttaggtgcctcct

SEQ ID NO: 5524468 - DNA, 14 bp, Homo sapiens
tctttagtactcaa

SEQ ID NO: 5524469 - DNA, 20 bp, Homo sapiens
tctttagtactcaatgtttc

SEQ ID NO: 5524470 - DNA, 13 bp, Homo sapiens
tctttagtattat

SEQ ID NO: 5524471 - DNA, 18 bp, Homo sapiens
tctttagtattatattaa

SEQ ID NO: 5524472 - DNA, 18 bp, Homo sapiens
tctttagtcatttaagaa

SEQ ID NO: 5524473 - DNA, 19 bp, Homo sapiens
tctttagtcatttaagaat

SEQ ID NO: 5524474 - DNA, 21 bp, Homo sapiens
tctttagtgatgcaataaaca

SEQ ID NO: 5524475 - DNA, 15 bp, Homo sapiens
tctttagtgccggct

SEQ ID NO: 5524476 - DNA, 20 bp, Homo sapiens
tctttagtgttcaaatactt

SEQ ID NO: 5524477 - DNA, 21 bp, Homo sapiens
tcttttatctgtttaaagcat

SEQ ID NO: 5524478 - DNA, 21 bp, Homo sapiens
tcttttatgtggtggtttcta

SEQ ID NO: 5524479 - DNA, 12 bp, Homo sapiens
tcttttattatc

SEQ ID NO: 5524480 - DNA, 22 bp, Homo sapiens
tcttttattatcagttaaaatc

SEQ ID NO: 5524481 - DNA, 19 bp, Homo sapiens
tcttttattctgttatata

SEQ ID NO: 5524482 - DNA, 21 bp, Homo sapiens
tcttttattctgttatatagt

SEQ ID NO: 5524483 - DNA, 19 bp, Homo sapiens
tcttttattcttctttctt

SEQ ID NO: 5524484 - DNA, 17 bp, Homo sapiens
tcttttatttagggcct

SEQ ID NO: 5524485 - DNA, 13 bp, Homo sapiens
tcttttcaaaatt

SEQ ID NO: 5524486 - DNA, 14 bp, Homo sapiens
tcttttcaaacaca

SEQ ID NO: 5524487 - DNA, 23 bp, Homo sapiens
tcttttcaagtaattttcatatt

SEQ ID NO: 5524488 - DNA, 15 bp, Homo sapiens
tcttttcaatgggtt

SEQ ID NO: 5524489 - DNA, 16 bp, Homo sapiens
tcttttcacaaataaa

SEQ ID NO: 5524490 - DNA, 22 bp, Homo sapiens
tcttttcacatagctgtctaga

SEQ ID NO: 5524491 - DNA, 12 bp, Homo sapiens
tcttttcacatt

SEQ ID NO: 5524492 - DNA, 13 bp, Homo sapiens
tcttttcacattc

SEQ ID NO: 5524493 - DNA, 23 bp, Homo sapiens
tcttttcacctctttaaccactc

SEQ ID NO: 5524494 - DNA, 14 bp, Homo sapiens
tcttttcatacatt

SEQ ID NO: 5524495 - DNA, 18 bp, Homo sapiens
tcttttcatatctcttgc

SEQ ID NO: 5524496 - DNA, 21 bp, Homo sapiens
tcttttcatatctcttgccct

SEQ ID NO: 5524497 - DNA, 18 bp, Homo sapiens
tcttttcatctgggaaag

SEQ ID NO: 5524498 - DNA, 21 bp, Homo sapiens
tcttttcatggagtagagtca

SEQ ID NO: 5524499 - DNA, 20 bp, Homo sapiens
tcttttccactcctatggaa

SEQ ID NO: 5524500 - DNA, 15 bp, Homo sapiens
tcttttccattgtca

SEQ ID NO: 5524501 - DNA, 13 bp, Homo sapiens
tcttttcccactc

SEQ ID NO: 5524502 - DNA, 16 bp, Homo sapiens
tcttttcccatttatc

SEQ ID NO: 5524503 - DNA, 16 bp, Homo sapiens
tcttttccccgcctgc

SEQ ID NO: 5524504 - DNA, 21 bp, Homo sapiens
tcttttccccgcctgcagtct

SEQ ID NO: 5524505 - DNA, 13 bp, Homo sapiens
tcttttccctctc

SEQ ID NO: 5524506 - DNA, 11 bp, Homo sapiens
tcttttcctcg

SEQ ID NO: 5524507 - DNA, 15 bp, Homo sapiens
tcttttcctctctgt

SEQ ID NO: 5524508 - DNA, 14 bp, Homo sapiens
tcttttcctttatc

SEQ ID NO: 5524509 - DNA, 12 bp, Homo sapiens
tcttttctagag

SEQ ID NO: 5524510 - DNA, 18 bp, Homo sapiens
tcttttctagtctgagct

SEQ ID NO: 5524511 - DNA, 14 bp, Homo sapiens
tcttttctattttc

SEQ ID NO: 5524512 - DNA, 14 bp, Homo sapiens
tcttttctcatgtg

SEQ ID NO: 5524513 - DNA, 18 bp, Homo sapiens
tcttttctcccacctcct

SEQ ID NO: 5524514 - DNA, 22 bp, Homo sapiens
tcttttctccctagaaacaaag

SEQ ID NO: 5524515 - DNA, 17 bp, Homo sapiens
tcttttctcctttacca

SEQ ID NO: 5524516 - DNA, 23 bp, Homo sapiens
tcttttctctatgaaaagcaact

SEQ ID NO: 5524517 - DNA, 17 bp, Homo sapiens
tcttttctcttctacat

SEQ ID NO: 5524518 - DNA, 12 bp, Homo sapiens
tcttttctgaat

SEQ ID NO: 5524519 - DNA, 14 bp, Homo sapiens
tcttttctgaatct

SEQ ID NO: 5524520 - DNA, 15 bp, Homo sapiens
tcttttctgaatctt

SEQ ID NO: 5524521 - DNA, 19 bp, Homo sapiens
tcttttctgaatcttctga

SEQ ID NO: 5524522 - DNA, 20 bp, Homo sapiens
tcttttctgaatcttctgaa

SEQ ID NO: 5524523 - DNA, 23 bp, Homo sapiens
tcttttctgcatcatctgtagat

SEQ ID NO: 5524524 - DNA, 18 bp, Homo sapiens
tcttttctgtacttcctg

SEQ ID NO: 5524525 - DNA, 21 bp, Homo sapiens
tcttttctgtcaccaaatttg

SEQ ID NO: 5524526 - DNA, 17 bp, Homo sapiens
tcttttcttactcctcc

SEQ ID NO: 5524527 - DNA, 13 bp, Homo sapiens
tcttttcttggac

SEQ ID NO: 5524528 - DNA, 12 bp, Homo sapiens
tcttttctttac

SEQ ID NO: 5524529 - DNA, 22 bp, Homo sapiens
tcttttctttagagaactgaaa

SEQ ID NO: 5524530 - DNA, 12 bp, Homo sapiens
tcttttctttct

SEQ ID NO: 5524531 - DNA, 13 bp, Homo sapiens
tcttttctttggg

SEQ ID NO: 5524532 - DNA, 14 bp, Homo sapiens
tcttttctttgtat

SEQ ID NO: 5524533 - DNA, 15 bp, Homo sapiens
tcttttgaaaactca

SEQ ID NO: 5524534 - DNA, 14 bp, Homo sapiens
tcttttgaaacaat

SEQ ID NO: 5524535 - DNA, 22 bp, Homo sapiens
tcttttgaactgttagatgctg

SEQ ID NO: 5524536 - DNA, 13 bp, Homo sapiens
tcttttgaagaag

SEQ ID NO: 5524537 - DNA, 19 bp, Homo sapiens
tcttttgaagaagttctta

SEQ ID NO: 5524538 - DNA, 14 bp, Homo sapiens
tcttttgaagcata

SEQ ID NO: 5524539 - DNA, 23 bp, Homo sapiens
tcttttgaagggagaagacactg

SEQ ID NO: 5524540 - DNA, 16 bp, Homo sapiens
tcttttgaatcaatct

SEQ ID NO: 5524541 - DNA, 13 bp, Homo sapiens
tcttttgacatgt

SEQ ID NO: 5524542 - DNA, 14 bp, Homo sapiens
tcttttgacatgtg

SEQ ID NO: 5524543 - DNA, 22 bp, Homo sapiens
tcttttgacttaatctcatttg

SEQ ID NO: 5524544 - DNA, 18 bp, Homo sapiens
tcttttgaggtccctgta

SEQ ID NO: 5524545 - DNA, 15 bp, Homo sapiens
tcttttgagtggtaa

SEQ ID NO: 5524546 - DNA, 20 bp, Homo sapiens
tcttttgagttaggttaata

SEQ ID NO: 5524547 - DNA, 23 bp, Homo sapiens
tcttttgagttaggttaataaat

SEQ ID NO: 5524548 - DNA, 13 bp, Homo sapiens
tcttttgatacat

SEQ ID NO: 5524549 - DNA, 14 bp, Homo sapiens
tcttttgatacatt

SEQ ID NO: 5524550 - DNA, 15 bp, Homo sapiens
tcttttgatacattt

SEQ ID NO: 5524551 - DNA, 17 bp, Homo sapiens
tcttttgcatgatgatc

SEQ ID NO: 5524552 - DNA, 20 bp, Homo sapiens
tcttttgcatgtcgcacaat

SEQ ID NO: 5524553 - DNA, 21 bp, Homo sapiens
tcttttgcatgtcgcacaatg

SEQ ID NO: 5524554 - DNA, 17 bp, Homo sapiens
tcttttgccgttattaa

SEQ ID NO: 5524555 - DNA, 19 bp, Homo sapiens
tcttttgccgttattaaaa

SEQ ID NO: 5524556 - DNA, 19 bp, Homo sapiens
tcttttgctactaagttca

SEQ ID NO: 5524557 - DNA, 15 bp, Homo sapiens
tcttttgcttaggaa

SEQ ID NO: 5524558 - DNA, 15 bp, Homo sapiens
tcttttgctttcctt

SEQ ID NO: 5524559 - DNA, 17 bp, Homo sapiens
tcttttgctttcctttc

SEQ ID NO: 5524560 - DNA, 13 bp, Homo sapiens
tcttttgcttttg

SEQ ID NO: 5524561 - DNA, 19 bp, Homo sapiens
tcttttgcttttgcccatt

SEQ ID NO: 5524562 - DNA, 16 bp, Homo sapiens
tcttttggacctggct

SEQ ID NO: 5524563 - DNA, 12 bp, Homo sapiens
tcttttggcctt

SEQ ID NO: 5524564 - DNA, 13 bp, Homo sapiens
tcttttggccttg

SEQ ID NO: 5524565 - DNA, 15 bp, Homo sapiens
tcttttggccttgtg

SEQ ID NO: 5524566 - DNA, 18 bp, Homo sapiens
tcttttgggatctaactg

SEQ ID NO: 5524567 - DNA, 19 bp, Homo sapiens
tcttttgggatctaactgt

SEQ ID NO: 5524568 - DNA, 22 bp, Homo sapiens
tcttttggtaaagactggcttt

SEQ ID NO: 5524569 - DNA, 18 bp, Homo sapiens
tcttttggttattctaag

SEQ ID NO: 5524570 - DNA, 18 bp, Homo sapiens
tcttttgtaagtgctaca

SEQ ID NO: 5524571 - DNA, 13 bp, Homo sapiens
tcttttgtaattg

SEQ ID NO: 5524572 - DNA, 13 bp, Homo sapiens
tcttttgtacttt

SEQ ID NO: 5524573 - DNA, 11 bp, Homo sapiens
tcttttgtatg

SEQ ID NO: 5524574 - DNA, 20 bp, Homo sapiens
tcttttgtatgtaaatgtgc

SEQ ID NO: 5524575 - DNA, 12 bp, Homo sapiens
tcttttgtattt

SEQ ID NO: 5524576 - DNA, 13 bp, Homo sapiens
tcttttgtatttt

SEQ ID NO: 5524577 - DNA, 20 bp, Homo sapiens
tcttttgtgatgaacatatt

SEQ ID NO: 5524578 - DNA, 14 bp, Homo sapiens
tcttttgtgtcctg

SEQ ID NO: 5524579 - DNA, 12 bp, Homo sapiens
tcttttgtgttc

SEQ ID NO: 5524580 - DNA, 12 bp, Homo sapiens
tcttttgttact

SEQ ID NO: 5524581 - DNA, 13 bp, Homo sapiens
tcttttgttactg

SEQ ID NO: 5524582 - DNA, 20 bp, Homo sapiens
tcttttgttcgcatggtcac

SEQ ID NO: 5524583 - DNA, 14 bp, Homo sapiens
tcttttgttctctc

SEQ ID NO: 5524584 - DNA, 16 bp, Homo sapiens
tcttttgttctctctt

SEQ ID NO: 5524585 - DNA, 16 bp, Homo sapiens
tcttttgttgtccttg

SEQ ID NO: 5524586 - DNA, 18 bp, Homo sapiens
tcttttgtttcattaagt

SEQ ID NO: 5524587 - DNA, 15 bp, Homo sapiens
tcttttgtttccatg

SEQ ID NO: 5524588 - DNA, 21 bp, Homo sapiens
tcttttgttttttgaagtgtt

SEQ ID NO: 5524589 - DNA, 20 bp, Homo sapiens
tctttttaaaaattgttatt

SEQ ID NO: 5524590 - DNA, 18 bp, Homo sapiens
tctttttaaagtactgta

SEQ ID NO: 5524591 - DNA, 18 bp, Homo sapiens
tctttttaaagttcaaac

SEQ ID NO: 5524592 - DNA, 14 bp, Homo sapiens
tctttttaagagat

SEQ ID NO: 5524593 - DNA, 19 bp, Homo sapiens
tctttttaagcctttgaag

SEQ ID NO: 5524594 - DNA, 22 bp, Homo sapiens
tctttttaaggacactggggtc

SEQ ID NO: 5524595 - DNA, 19 bp, Homo sapiens
tctttttaagtaatgtgga

SEQ ID NO: 5524596 - DNA, 16 bp, Homo sapiens
tctttttaatcttaag

SEQ ID NO: 5524597 - DNA, 13 bp, Homo sapiens
tctttttaattat

SEQ ID NO: 5524598 - DNA, 14 bp, Homo sapiens
tctttttacagcat

SEQ ID NO: 5524599 - DNA, 20 bp, Homo sapiens
tctttttacataactgcctt

SEQ ID NO: 5524600 - DNA, 13 bp, Homo sapiens
tctttttactgtt

SEQ ID NO: 5524601 - DNA, 15 bp, Homo sapiens
tctttttatacacaa

SEQ ID NO: 5524602 - DNA, 16 bp, Homo sapiens
tctttttatcgccatt

SEQ ID NO: 5524603 - DNA, 12 bp, Homo sapiens
tctttttatctc

SEQ ID NO: 5524604 - DNA, 15 bp, Homo sapiens
tctttttattcattg

SEQ ID NO: 5524605 - DNA, 14 bp, Homo sapiens
tctttttattgaat

SEQ ID NO: 5524606 - DNA, 15 bp, Homo sapiens
tctttttattgaatc

SEQ ID NO: 5524607 - DNA, 20 bp, Homo sapiens
tctttttcaaaactagttct

SEQ ID NO: 5524608 - DNA, 11 bp, Homo sapiens
tctttttcatc

SEQ ID NO: 5524609 - DNA, 19 bp, Homo sapiens
tctttttccctttcctttc

SEQ ID NO: 5524610 - DNA, 20 bp, Homo sapiens
tctttttccctttcctttcc

SEQ ID NO: 5524611 - DNA, 17 bp, Homo sapiens
tctttttcctactccgt

SEQ ID NO: 5524612 - DNA, 12 bp, Homo sapiens
tctttttccttt

SEQ ID NO: 5524613 - DNA, 17 bp, Homo sapiens
tctttttcctttataat

SEQ ID NO: 5524614 - DNA, 20 bp, Homo sapiens
tctttttcgccaaactgtct

SEQ ID NO: 5524615 - DNA, 17 bp, Homo sapiens
tctttttctacatgtga

SEQ ID NO: 5524616 - DNA, 14 bp, Homo sapiens
tctttttctagggt

SEQ ID NO: 5524617 - DNA, 15 bp, Homo sapiens
tctttttctggactc

SEQ ID NO: 5524618 - DNA, 15 bp, Homo sapiens
tctttttctgtctct

SEQ ID NO: 5524619 - DNA, 14 bp, Homo sapiens
tctttttcttgggt

SEQ ID NO: 5524620 - DNA, 14 bp, Homo sapiens
tctttttctttctt

SEQ ID NO: 5524621 - DNA, 15 bp, Homo sapiens
tctttttctttttaa

SEQ ID NO: 5524622 - DNA, 14 bp, Homo sapiens
tctttttgaaatgt

SEQ ID NO: 5524623 - DNA, 15 bp, Homo sapiens
tctttttgactgatt

SEQ ID NO: 5524624 - DNA, 13 bp, Homo sapiens
tctttttgctgtt

SEQ ID NO: 5524625 - DNA, 15 bp, Homo sapiens
tctttttggaaactg

SEQ ID NO: 5524626 - DNA, 19 bp, Homo sapiens
tctttttgggagagacttg

SEQ ID NO: 5524627 - DNA, 22 bp, Homo sapiens
tctttttgggagagacttgttt

SEQ ID NO: 5524628 - DNA, 19 bp, Homo sapiens
tctttttggtaataacaaa

SEQ ID NO: 5524629 - DNA, 14 bp, Homo sapiens
tctttttgtacact

SEQ ID NO: 5524630 - DNA, 16 bp, Homo sapiens
tctttttgtacactta

SEQ ID NO: 5524631 - DNA, 14 bp, Homo sapiens
tctttttgtacttt

SEQ ID NO: 5524632 - DNA, 13 bp, Homo sapiens
tctttttgtgtgc

SEQ ID NO: 5524633 - DNA, 19 bp, Homo sapiens
tctttttgttaacagcaac

SEQ ID NO: 5524634 - DNA, 15 bp, Homo sapiens
tctttttgttgtaaa

SEQ ID NO: 5524635 - DNA, 13 bp, Homo sapiens
tctttttgtttgt

SEQ ID NO: 5524636 - DNA, 15 bp, Homo sapiens
tcttttttaaaaaca

SEQ ID NO: 5524637 - DNA, 18 bp, Homo sapiens
tcttttttaaaaattact

SEQ ID NO: 5524638 - DNA, 20 bp, Homo sapiens
tcttttttaaagtaaacttg

SEQ ID NO: 5524639 - DNA, 15 bp, Homo sapiens
tcttttttaaatgaa

SEQ ID NO: 5524640 - DNA, 19 bp, Homo sapiens
tcttttttaaatgaagaaa

SEQ ID NO: 5524641 - DNA, 16 bp, Homo sapiens
tcttttttaaatgaat

SEQ ID NO: 5524642 - DNA, 21 bp, Homo sapiens
tcttttttaaccggtaagagt

SEQ ID NO: 5524643 - DNA, 23 bp, Homo sapiens
tcttttttaaccggtaagagttt

SEQ ID NO: 5524644 - DNA, 13 bp, Homo sapiens
tcttttttacaaa

SEQ ID NO: 5524645 - DNA, 19 bp, Homo sapiens
tcttttttacaaaggctgt

SEQ ID NO: 5524646 - DNA, 21 bp, Homo sapiens
tcttttttactcattgaaatg

SEQ ID NO: 5524647 - DNA, 13 bp, Homo sapiens
tcttttttatgtt

SEQ ID NO: 5524648 - DNA, 18 bp, Homo sapiens
tcttttttatgttaaaaa

SEQ ID NO: 5524649 - DNA, 15 bp, Homo sapiens
tcttttttattaatc

SEQ ID NO: 5524650 - DNA, 24 bp, Homo sapiens
tcttttttattaatcactgtgtat

SEQ ID NO: 5524651 - DNA, 13 bp, Homo sapiens
tcttttttcaaaa

SEQ ID NO: 5524652 - DNA, 17 bp, Homo sapiens
tcttttttcaaaagaaa

SEQ ID NO: 5524653 - DNA, 21 bp, Homo sapiens
tcttttttcaactggctggga

SEQ ID NO: 5524654 - DNA, 14 bp, Homo sapiens
tcttttttcacaaa

SEQ ID NO: 5524655 - DNA, 19 bp, Homo sapiens
tcttttttctatctgccaa

SEQ ID NO: 5524656 - DNA, 15 bp, Homo sapiens
tcttttttctcttcc

SEQ ID NO: 5524657 - DNA, 15 bp, Homo sapiens
tcttttttctgggtc

SEQ ID NO: 5524658 - DNA, 22 bp, Homo sapiens
tgaaagattatttaaatgcttt

SEQ ID NO: 5524659 - DNA, 17 bp, Homo sapiens
tgaaagcaaaaatgcta

SEQ ID NO: 5524660 - DNA, 19 bp, Homo sapiens
tgaaagcaaaaatgctaat

SEQ ID NO: 5524661 - DNA, 23 bp, Homo sapiens
tgaaagcaaatgctttgtgacta

SEQ ID NO: 5524662 - DNA, 21 bp, Homo sapiens
tgaaagcacatgaataatttc

SEQ ID NO: 5524663 - DNA, 14 bp, Homo sapiens
tgaaagcagcagct

SEQ ID NO: 5524664 - DNA, 21 bp, Homo sapiens
tgaaagcagcagctaggactg

SEQ ID NO: 5524665 - DNA, 16 bp, Homo sapiens
tgaaagccaaaacctg

SEQ ID NO: 5524666 - DNA, 16 bp, Homo sapiens
tgaaagccaaatttat

SEQ ID NO: 5524667 - DNA, 17 bp, Homo sapiens
tgaaagccaacaactct

SEQ ID NO: 5524668 - DNA, 20 bp, Homo sapiens
tgaaagcctagtccagaaat

SEQ ID NO: 5524669 - DNA, 12 bp, Homo sapiens
tgaaagcctcac

SEQ ID NO: 5524670 - DNA, 22 bp, Homo sapiens
tgaaagccttagggaagctggc

SEQ ID NO: 5524671 - DNA, 22 bp, Homo sapiens
tgaaagcgacttcaggtcaggt

SEQ ID NO: 5524672 - DNA, 16 bp, Homo sapiens
tgaaagctacgcagac

SEQ ID NO: 5524673 - DNA, 15 bp, Homo sapiens
tgaaagctactcata

SEQ ID NO: 5524674 - DNA, 17 bp, Homo sapiens
tgaaagctatgaatgtt

SEQ ID NO: 5524675 - DNA, 16 bp, Homo sapiens
tgaaagctccatgttt

SEQ ID NO: 5524676 - DNA, 17 bp, Homo sapiens
tgaaagctctgttgcaa

SEQ ID NO: 5524677 - DNA, 20 bp, Homo sapiens
tgaaagctgagaactcctga

SEQ ID NO: 5524678 - DNA, 18 bp, Homo sapiens
tgaaagctgattactgtc

SEQ ID NO: 5524679 - DNA, 16 bp, Homo sapiens
tgaaagctgtttcatt

SEQ ID NO: 5524680 - DNA, 18 bp, Homo sapiens
tgaaagctttgaaataaa

SEQ ID NO: 5524681 - DNA, 21 bp, Homo sapiens
tgaaagctttggaaaaatctt

SEQ ID NO: 5524682 - DNA, 12 bp, Homo sapiens
tgaaaggaaaag

SEQ ID NO: 5524683 - DNA, 17 bp, Homo sapiens
tgaaaggaaagaggctc

SEQ ID NO: 5524684 - DNA, 13 bp, Homo sapiens
tgaaaggaaagta

SEQ ID NO: 5524685 - DNA, 12 bp, Homo sapiens
tgaaaggaaatt

SEQ ID NO: 5524686 - DNA, 15 bp, Homo sapiens
tgaaaggaacactgg

SEQ ID NO: 5524687 - DNA, 15 bp, Homo sapiens
tgaaaggaagtataa

SEQ ID NO: 5524688 - DNA, 20 bp, Homo sapiens
tgaaaggacagttaagtatt

SEQ ID NO: 5524689 - DNA, 15 bp, Homo sapiens
tgaaaggaccctgtg

SEQ ID NO: 5524690 - DNA, 14 bp, Homo sapiens
tgaaaggagacatt

SEQ ID NO: 5524691 - DNA, 16 bp, Homo sapiens
tgaaaggagcagtggc

SEQ ID NO: 5524692 - DNA, 14 bp, Homo sapiens
tgaaaggagccctt

SEQ ID NO: 5524693 - DNA, 20 bp, Homo sapiens
tgaaaggagggaaaagcaga

SEQ ID NO: 5524694 - DNA, 19 bp, Homo sapiens
tgaaaggagtttaaaaaca

SEQ ID NO: 5524695 - DNA, 23 bp, Homo sapiens
tgaaaggattctctaattagaaa

SEQ ID NO: 5524696 - DNA, 15 bp, Homo sapiens
tgaaaggcaattttt

SEQ ID NO: 5524697 - DNA, 20 bp, Homo sapiens
tgaaaggcaggcctatttca

SEQ ID NO: 5524698 - DNA, 23 bp, Homo sapiens
tgaaaggcaggcctatttcatca

SEQ ID NO: 5524699 - DNA, 17 bp, Homo sapiens
tgaaaggccaacagcaa

SEQ ID NO: 5524700 - DNA, 14 bp, Homo sapiens
tgaaaggccagcag

SEQ ID NO: 5524701 - DNA, 16 bp, Homo sapiens
tgaaaggcctcaagaa

SEQ ID NO: 5524702 - DNA, 16 bp, Homo sapiens
tgaaaggcttctggga

SEQ ID NO: 5524703 - DNA, 12 bp, Homo sapiens
tgaaagggaaac

SEQ ID NO: 5524704 - DNA, 16 bp, Homo sapiens
tgaaagggaaactggg

SEQ ID NO: 5524705 - DNA, 13 bp, Homo sapiens
tgaaagggacaag

SEQ ID NO: 5524706 - DNA, 15 bp, Homo sapiens
tgaaagggagcccct

SEQ ID NO: 5524707 - DNA, 23 bp, Homo sapiens
tgaaagggagtattacaaaaaca

SEQ ID NO: 5524708 - DNA, 16 bp, Homo sapiens
tgaaagggatcatcat

SEQ ID NO: 5524709 - DNA, 19 bp, Homo sapiens
tgaaagggcacttaatttg

SEQ ID NO: 5524710 - DNA, 16 bp, Homo sapiens
tgaaagggcccagaga

SEQ ID NO: 5524711 - DNA, 22 bp, Homo sapiens
tgaaagggctatggcaaggggg

SEQ ID NO: 5524712 - DNA, 22 bp, Homo sapiens
tgaaaggggaaacgtctcccag

SEQ ID NO: 5524713 - DNA, 22 bp, Homo sapiens
tgaaaggggacacctgtacatt

SEQ ID NO: 5524714 - DNA, 21 bp, Homo sapiens
tgaaagggtcaacggccctgt

SEQ ID NO: 5524715 - DNA, 21 bp, Homo sapiens
tgaaagggtttgatatggaga

SEQ ID NO: 5524716 - DNA, 17 bp, Homo sapiens
tgaaaggtaatctgaaa

SEQ ID NO: 5524717 - DNA, 13 bp, Homo sapiens
tgaaaggtactat

SEQ ID NO: 5524718 - DNA, 19 bp, Homo sapiens
tgaaaggtactatatttgc

SEQ ID NO: 5524719 - DNA, 15 bp, Homo sapiens
tgaaaggtacttcaa

SEQ ID NO: 5524720 - DNA, 23 bp, Homo sapiens
tgaaaggtgctatataattgtga

SEQ ID NO: 5524721 - DNA, 20 bp, Homo sapiens
tgaaaggtgctgatggccct

SEQ ID NO: 5524722 - DNA, 21 bp, Homo sapiens
tgaaaggtgctgatggccctc

SEQ ID NO: 5524723 - DNA, 15 bp, Homo sapiens
tgaaaggtgctttct

SEQ ID NO: 5524724 - DNA, 13 bp, Homo sapiens
tgaaagtaaaaaa

SEQ ID NO: 5524725 - DNA, 18 bp, Homo sapiens
tgaaagtaaaaaaataat

SEQ ID NO: 5524726 - DNA, 18 bp, Homo sapiens
tgaaagtaaaaaataact

SEQ ID NO: 5524727 - DNA, 14 bp, Homo sapiens
tgaaagtacatttg

SEQ ID NO: 5524728 - DNA, 21 bp, Homo sapiens
tgaaagtagattcatgaaaat

SEQ ID NO: 5524729 - DNA, 15 bp, Homo sapiens
tgaaagtataactga

SEQ ID NO: 5524730 - DNA, 14 bp, Homo sapiens
tgaaagtatgtgat

SEQ ID NO: 5524731 - DNA, 16 bp, Homo sapiens
tgaaagtattcacatc

SEQ ID NO: 5524732 - DNA, 21 bp, Homo sapiens
tgaaagtcaaatttactttaa

SEQ ID NO: 5524733 - DNA, 15 bp, Homo sapiens
tgaaagtcagatgcc

SEQ ID NO: 5524734 - DNA, 20 bp, Homo sapiens
tgaaagtcagctgaaggatg

SEQ ID NO: 5524735 - DNA, 12 bp, Homo sapiens
tgaaagtctgtc

SEQ ID NO: 5524736 - DNA, 15 bp, Homo sapiens
tgaaagtctgtcctt

SEQ ID NO: 5524737 - DNA, 16 bp, Homo sapiens
tgaaagtctgtccttg

SEQ ID NO: 5524738 - DNA, 18 bp, Homo sapiens
tgaaagtcttgtgactag

SEQ ID NO: 5524739 - DNA, 20 bp, Homo sapiens
tgaaagtcttgtgactagtg

SEQ ID NO: 5524740 - DNA, 16 bp, Homo sapiens
tgaaagtgacagagac

SEQ ID NO: 5524741 - DNA, 11 bp, Homo sapiens
tgaaagtgact

SEQ ID NO: 5524742 - DNA, 18 bp, Homo sapiens
tgaaagtgactttaaaag

SEQ ID NO: 5524743 - DNA, 16 bp, Homo sapiens
tgaaagtgatgacata

SEQ ID NO: 5524744 - DNA, 20 bp, Homo sapiens
tgaaagtgcatttttgtaaa

SEQ ID NO: 5524745 - DNA, 13 bp, Homo sapiens
tgaaagtgccttt

SEQ ID NO: 5524746 - DNA, 21 bp, Homo sapiens
tgaaagtgcctttgcagctca

SEQ ID NO: 5524747 - DNA, 19 bp, Homo sapiens
tgaaagtgggcaaaagctt

SEQ ID NO: 5524748 - DNA, 20 bp, Homo sapiens
tgaaagtgttaattttacct

SEQ ID NO: 5524749 - DNA, 23 bp, Homo sapiens
tgaaagtgttgggattggttaag

SEQ ID NO: 5524750 - DNA, 18 bp, Homo sapiens
tgaaagttaactcttcaa

SEQ ID NO: 5524751 - DNA, 15 bp, Homo sapiens
tgaaagttaatccac

SEQ ID NO: 5524752 - DNA, 14 bp, Homo sapiens
tgaaagttcttgct

SEQ ID NO: 5524753 - DNA, 12 bp, Homo sapiens
tgaaagttgctt

SEQ ID NO: 5524754 - DNA, 16 bp, Homo sapiens
tgaaagttgcttttat

SEQ ID NO: 5524755 - DNA, 17 bp, Homo sapiens
tgaaagttgcttttatt

SEQ ID NO: 5524756 - DNA, 18 bp, Homo sapiens
tgaaagttgcttttattg

SEQ ID NO: 5524757 - DNA, 14 bp, Homo sapiens
tgaaagttgtacat

SEQ ID NO: 5524758 - DNA, 15 bp, Homo sapiens
tgaaagttgtacatg

SEQ ID NO: 5524759 - DNA, 16 bp, Homo sapiens
tgaaagttgtacatga

SEQ ID NO: 5524760 - DNA, 18 bp, Homo sapiens
tgaaagttgtacatgaaa

SEQ ID NO: 5524761 - DNA, 17 bp, Homo sapiens
tgaaagttgtacatgat

SEQ ID NO: 5524762 - DNA, 18 bp, Homo sapiens
tgaaagttgtacatgata

SEQ ID NO: 5524763 - DNA, 17 bp, Homo sapiens
tgaaagttgtgatctgt

SEQ ID NO: 5524764 - DNA, 15 bp, Homo sapiens
tgaaagtttaacaaa

SEQ ID NO: 5524765 - DNA, 20 bp, Homo sapiens
tgaaagtttaacaaatgact

SEQ ID NO: 5524766 - DNA, 22 bp, Homo sapiens
tgaaagtttaacaaatgactgt

SEQ ID NO: 5524767 - DNA, 13 bp, Homo sapiens
tgaaagtttagat

SEQ ID NO: 5524768 - DNA, 20 bp, Homo sapiens
tgaaagttttcagaacctct

SEQ ID NO: 5524769 - DNA, 14 bp, Homo sapiens
tgaaagttttccag

SEQ ID NO: 5524770 - DNA, 23 bp, Homo sapiens
tgaaagttttccagtattgaaaa

SEQ ID NO: 5524771 - DNA, 22 bp, Homo sapiens
tgaaagttttgagtagatatta

SEQ ID NO: 5524772 - DNA, 14 bp, Homo sapiens
tgaaagttttgtaa

SEQ ID NO: 5524773 - DNA, 16 bp, Homo sapiens
tgaaagttttgtaaaa

SEQ ID NO: 5524774 - DNA, 16 bp, Homo sapiens
tgaaagtttttctgaa

SEQ ID NO: 5524775 - DNA, 22 bp, Homo sapiens
tgaaataaaaaaaaaaggatga

SEQ ID NO: 5524776 - DNA, 15 bp, Homo sapiens
tgaaataaaaatgga

SEQ ID NO: 5524777 - DNA, 22 bp, Homo sapiens
tgaaataaaactgtttttgaac

SEQ ID NO: 5524778 - DNA, 14 bp, Homo sapiens
tgaaataaaatata

SEQ ID NO: 5524779 - DNA, 18 bp, Homo sapiens
tgaaataaaatatcaata

SEQ ID NO: 5524780 - DNA, 15 bp, Homo sapiens
tgaaataaaatggtg

SEQ ID NO: 5524781 - DNA, 17 bp, Homo sapiens
tgaaataaactagggtt

SEQ ID NO: 5524782 - DNA, 20 bp, Homo sapiens
tgaaataaagaaattgcaat

SEQ ID NO: 5524783 - DNA, 15 bp, Homo sapiens
tgaaataaagaattt

SEQ ID NO: 5524784 - DNA, 18 bp, Homo sapiens
tgaaataaagtcaaatca

SEQ ID NO: 5524785 - DNA, 14 bp, Homo sapiens
tgaaataaatgttc

SEQ ID NO: 5524786 - DNA, 14 bp, Homo sapiens
tgaaataaatgttt

SEQ ID NO: 5524787 - DNA, 17 bp, Homo sapiens
tgaaataaatgtttcaa

SEQ ID NO: 5524788 - DNA, 18 bp, Homo sapiens
tgaaataaatgtttcaaa

SEQ ID NO: 5524789 - DNA, 17 bp, Homo sapiens
tgaaataaattctgact

SEQ ID NO: 5524790 - DNA, 21 bp, Homo sapiens
tgaaataaattggtgataagt

SEQ ID NO: 5524791 - DNA, 16 bp, Homo sapiens
tgaaataacaaaatgg

SEQ ID NO: 5524792 - DNA, 17 bp, Homo sapiens
tgaaataacaaaatgga

SEQ ID NO: 5524793 - DNA, 20 bp, Homo sapiens
tgaaataacaaaatggacat

SEQ ID NO: 5524794 - DNA, 14 bp, Homo sapiens
tgaaataactcctt

SEQ ID NO: 5524795 - DNA, 19 bp, Homo sapiens
tgaaataagatggaaaaat

SEQ ID NO: 5524796 - DNA, 13 bp, Homo sapiens
tgaaataagctat

SEQ ID NO: 5524797 - DNA, 14 bp, Homo sapiens
tgaaataagctatt

SEQ ID NO: 5524798 - DNA, 14 bp, Homo sapiens
tgaaataaggaatg

SEQ ID NO: 5524799 - DNA, 15 bp, Homo sapiens
tgaaataagttgttt

SEQ ID NO: 5524800 - DNA, 18 bp, Homo sapiens
tgaaataagttgtttcag

SEQ ID NO: 5524801 - DNA, 16 bp, Homo sapiens
tgaaataataaaatgc

SEQ ID NO: 5524802 - DNA, 19 bp, Homo sapiens
tgaaataataaaatgcaaa

SEQ ID NO: 5524803 - DNA, 20 bp, Homo sapiens
tgaaataataaaatgcaaat

SEQ ID NO: 5524804 - DNA, 22 bp, Homo sapiens
tgaaataataaaatgcaaatga

SEQ ID NO: 5524805 - DNA, 14 bp, Homo sapiens
tgaaataataatat

SEQ ID NO: 5524806 - DNA, 12 bp, Homo sapiens
tgaaataatcag

SEQ ID NO: 5524807 - DNA, 21 bp, Homo sapiens
tgaaataatcagtgactgaaa

SEQ ID NO: 5524808 - DNA, 23 bp, Homo sapiens
tgaaataatgggattagaaacaa

SEQ ID NO: 5524809 - DNA, 14 bp, Homo sapiens
tgaaataatgtgta

SEQ ID NO: 5524810 - DNA, 22 bp, Homo sapiens
tgaaataatgtgtagttcatgt

SEQ ID NO: 5524811 - DNA, 17 bp, Homo sapiens
tgaaataatgttctgtc

SEQ ID NO: 5524812 - DNA, 18 bp, Homo sapiens
tgaaataatttttaactt

SEQ ID NO: 5524813 - DNA, 11 bp, Homo sapiens
tgaaatacaac

SEQ ID NO: 5524814 - DNA, 19 bp, Homo sapiens
tgaaatacacaagtaaaca

SEQ ID NO: 5524815 - DNA, 14 bp, Homo sapiens
tgaaatacatcctt

SEQ ID NO: 5524816 - DNA, 23 bp, Homo sapiens
tgaaataccacaagcctgagaac

SEQ ID NO: 5524817 - DNA, 12 bp, Homo sapiens
tgaaatacctca

SEQ ID NO: 5524818 - DNA, 13 bp, Homo sapiens
tgaaatacctcat

SEQ ID NO: 5524819 - DNA, 17 bp, Homo sapiens
tgaaatacctgtttctt

SEQ ID NO: 5524820 - DNA, 16 bp, Homo sapiens
tgaaatacctttgcct

SEQ ID NO: 5524821 - DNA, 23 bp, Homo sapiens
tgaaatacctttgtagttactca

SEQ ID NO: 5524822 - DNA, 13 bp, Homo sapiens
tgaaatactcagg

SEQ ID NO: 5524823 - DNA, 16 bp, Homo sapiens
tgaaatactgtttgag

SEQ ID NO: 5524824 - DNA, 23 bp, Homo sapiens
tgaaatactttactttttctcat

SEQ ID NO: 5524825 - DNA, 20 bp, Homo sapiens
tgaaatactttttaacaaaa

SEQ ID NO: 5524826 - DNA, 22 bp, Homo sapiens
tgaaatagctttactgtttctc

SEQ ID NO: 5524827 - DNA, 17 bp, Homo sapiens
tgaaatagtatacattg

SEQ ID NO: 5524828 - DNA, 21 bp, Homo sapiens
tgaaatagtatacattgtctt

SEQ ID NO: 5524829 - DNA, 22 bp, Homo sapiens
tgaaatagtatacattgtcttg

SEQ ID NO: 5524830 - DNA, 20 bp, Homo sapiens
tgaaatagtcctgaagttct

SEQ ID NO: 5524831 - DNA, 13 bp, Homo sapiens
tgaaatagtgtct

SEQ ID NO: 5524832 - DNA, 20 bp, Homo sapiens
tgaaatagttattttaatac

SEQ ID NO: 5524833 - DNA, 10 bp, Homo sapiens
tgaaatataa

SEQ ID NO: 5524834 - DNA, 16 bp, Homo sapiens
tgaaatataaactgta

SEQ ID NO: 5524835 - DNA, 17 bp, Homo sapiens
tgaaatataaactgtga

SEQ ID NO: 5524836 - DNA, 18 bp, Homo sapiens
tgaactatgaacactgtc

SEQ ID NO: 5524837 - DNA, 17 bp, Homo sapiens
tgaactatgactggagt

SEQ ID NO: 5524838 - DNA, 15 bp, Homo sapiens
tgaactattgagaag

SEQ ID NO: 5524839 - DNA, 16 bp, Homo sapiens
tgaactattgagaaga

SEQ ID NO: 5524840 - DNA, 20 bp, Homo sapiens
tgaactatttctacacagtg

SEQ ID NO: 5524841 - DNA, 19 bp, Homo sapiens
tgaactattttaaataaaa

SEQ ID NO: 5524842 - DNA, 20 bp, Homo sapiens
tgaactattttaaataaaat

SEQ ID NO: 5524843 - DNA, 16 bp, Homo sapiens
tgaactcaaactgagg

SEQ ID NO: 5524844 - DNA, 16 bp, Homo sapiens
tgaactcaagaaggaa

SEQ ID NO: 5524845 - DNA, 13 bp, Homo sapiens
tgaactcaagctg

SEQ ID NO: 5524846 - DNA, 14 bp, Homo sapiens
tgaactcaagctgc

SEQ ID NO: 5524847 - DNA, 20 bp, Homo sapiens
tgaactcaatctccagggct

SEQ ID NO: 5524848 - DNA, 14 bp, Homo sapiens
tgaactcaatgata

SEQ ID NO: 5524849 - DNA, 16 bp, Homo sapiens
tgaactcaatgcatga

SEQ ID NO: 5524850 - DNA, 15 bp, Homo sapiens
tgaactcacagactg

SEQ ID NO: 5524851 - DNA, 16 bp, Homo sapiens
tgaactcacagactgc

SEQ ID NO: 5524852 - DNA, 21 bp, Homo sapiens
tgaactcaccctgggagccag

SEQ ID NO: 5524853 - DNA, 18 bp, Homo sapiens
tgaactcaccgctcaccc

SEQ ID NO: 5524854 - DNA, 21 bp, Homo sapiens
tgaactcaccgctcaccctcc

SEQ ID NO: 5524855 - DNA, 18 bp, Homo sapiens
tgaactcacgagccttgc

SEQ ID NO: 5524856 - DNA, 18 bp, Homo sapiens
tgaactcactttcctcct

SEQ ID NO: 5524857 - DNA, 17 bp, Homo sapiens
tgaactcagaccacttg

SEQ ID NO: 5524858 - DNA, 22 bp, Homo sapiens
tgaactcagatctgtctgatag

SEQ ID NO: 5524859 - DNA, 15 bp, Homo sapiens
tgaactcagccaagc

SEQ ID NO: 5524860 - DNA, 20 bp, Homo sapiens
tgaactcagccaagcacagt

SEQ ID NO: 5524861 - DNA, 22 bp, Homo sapiens
tgaactcagtagctgaacctgt

SEQ ID NO: 5524862 - DNA, 22 bp, Homo sapiens
tgaactccaccgaccaactgcc

SEQ ID NO: 5524863 - DNA, 13 bp, Homo sapiens
tgaactccaggca

SEQ ID NO: 5524864 - DNA, 14 bp, Homo sapiens
tgaactccatacag

SEQ ID NO: 5524865 - DNA, 22 bp, Homo sapiens
tgaactccatcgccatcttctt

SEQ ID NO: 5524866 - DNA, 12 bp, Homo sapiens
tgaactccattt

SEQ ID NO: 5524867 - DNA, 15 bp, Homo sapiens
tgaactccgctgcct

SEQ ID NO: 5524868 - DNA, 16 bp, Homo sapiens
tgaactcctagactca

SEQ ID NO: 5524869 - DNA, 13 bp, Homo sapiens
tgaactcctattt

SEQ ID NO: 5524870 - DNA, 11 bp, Homo sapiens
tgaactcctgg

SEQ ID NO: 5524871 - DNA, 14 bp, Homo sapiens
tgaactcctggcct

SEQ ID NO: 5524872 - DNA, 13 bp, Homo sapiens
tgaactccttgtt

SEQ ID NO: 5524873 - DNA, 12 bp, Homo sapiens
tgaactctcaaa

SEQ ID NO: 5524874 - DNA, 13 bp, Homo sapiens
tgaactctcccct

SEQ ID NO: 5524875 - DNA, 16 bp, Homo sapiens
tgaactctctctcttt

SEQ ID NO: 5524876 - DNA, 13 bp, Homo sapiens
tgaactctgacag

SEQ ID NO: 5524877 - DNA, 14 bp, Homo sapiens
tgaactctgagaga

SEQ ID NO: 5524878 - DNA, 13 bp, Homo sapiens
tgaactctggtgc

SEQ ID NO: 5524879 - DNA, 20 bp, Homo sapiens
tgaactctggtgctcctgca

SEQ ID NO: 5524880 - DNA, 14 bp, Homo sapiens
tgaactcttaatca

SEQ ID NO: 5524881 - DNA, 18 bp, Homo sapiens
tgaactcttcaatctctt

SEQ ID NO: 5524882 - DNA, 22 bp, Homo sapiens
tgaactcttcagaacacacaga

SEQ ID NO: 5524883 - DNA, 14 bp, Homo sapiens
tgaactcttctcat

SEQ ID NO: 5524884 - DNA, 19 bp, Homo sapiens
tgaactcttgataacacca

SEQ ID NO: 5524885 - DNA, 14 bp, Homo sapiens
tgaactctttcccc

SEQ ID NO: 5524886 - DNA, 15 bp, Homo sapiens
tgaactctttcccca

SEQ ID NO: 5524887 - DNA, 14 bp, Homo sapiens
tgaactctttctgg

SEQ ID NO: 5524888 - DNA, 22 bp, Homo sapiens
tgaactctttctggcctgcctt

SEQ ID NO: 5524889 - DNA, 19 bp, Homo sapiens
tgaactctttgaatgacaa

SEQ ID NO: 5524890 - DNA, 20 bp, Homo sapiens
tgaactctttgaatgacaaa

SEQ ID NO: 5524891 - DNA, 16 bp, Homo sapiens
tgaactgaaacttttc

SEQ ID NO: 5524892 - DNA, 21 bp, Homo sapiens
tgaactgaaacttttctaaag

SEQ ID NO: 5524893 - DNA, 12 bp, Homo sapiens
tgaactgaaagt

SEQ ID NO: 5524894 - DNA, 18 bp, Homo sapiens
tgaactgaaattaaaact

SEQ ID NO: 5524895 - DNA, 17 bp, Homo sapiens
tgaactgaactctgaca

SEQ ID NO: 5524896 - DNA, 15 bp, Homo sapiens
tgaactgaagcagag

SEQ ID NO: 5524897 - DNA, 12 bp, Homo sapiens
tgaactgaagtt

SEQ ID NO: 5524898 - DNA, 17 bp, Homo sapiens
tgaactgaagtttcaca

SEQ ID NO: 5524899 - DNA, 14 bp, Homo sapiens
tgaactgacaatga

SEQ ID NO: 5524900 - DNA, 15 bp, Homo sapiens
tgaactgacaatgaa

SEQ ID NO: 5524901 - DNA, 20 bp, Homo sapiens
tgaactgacaatgaagggaa

SEQ ID NO: 5524902 - DNA, 13 bp, Homo sapiens
tgaactgacaggc

SEQ ID NO: 5524903 - DNA, 21 bp, Homo sapiens
tgaactgacaggcagcctgga

SEQ ID NO: 5524904 - DNA, 14 bp, Homo sapiens
tgaactgacttcaa

SEQ ID NO: 5524905 - DNA, 23 bp, Homo sapiens
tgaactgagaaggcaggcctccg

SEQ ID NO: 5524906 - DNA, 21 bp, Homo sapiens
tgaactgagccgtgcagctgg

SEQ ID NO: 5524907 - DNA, 15 bp, Homo sapiens
tgaactgaggccctg

SEQ ID NO: 5524908 - DNA, 16 bp, Homo sapiens
tgaactgaggccctgt

SEQ ID NO: 5524909 - DNA, 18 bp, Homo sapiens
tgaactgaggccctgtga

SEQ ID NO: 5524910 - DNA, 22 bp, Homo sapiens
tgaactgaggccttgtgtgtca

SEQ ID NO: 5524911 - DNA, 21 bp, Homo sapiens
tgaactgatagttactgttgt

SEQ ID NO: 5524912 - DNA, 23 bp, Homo sapiens
tgaactgatagttactgttgtga

SEQ ID NO: 5524913 - DNA, 20 bp, Homo sapiens
tgaactgatcatgtttatga

SEQ ID NO: 5524914 - DNA, 17 bp, Homo sapiens
tgaactgattcacatct

SEQ ID NO: 5524915 - DNA, 21 bp, Homo sapiens
tgaactgattcacatctcatt

SEQ ID NO: 5524916 - DNA, 15 bp, Homo sapiens
tgaactgcaacactg

SEQ ID NO: 5524917 - DNA, 17 bp, Homo sapiens
tgaactgcaacactgga

SEQ ID NO: 5524918 - DNA, 19 bp, Homo sapiens
tgaactgcagcaatcacaa

SEQ ID NO: 5524919 - DNA, 16 bp, Homo sapiens
tgaactgcaggaagag

SEQ ID NO: 5524920 - DNA, 15 bp, Homo sapiens
tgaactgcatcaaga

SEQ ID NO: 5524921 - DNA, 17 bp, Homo sapiens
tgaactgcatcaagact

SEQ ID NO: 5524922 - DNA, 22 bp, Homo sapiens
tgaactgccaagaaaaggcatg

SEQ ID NO: 5524923 - DNA, 12 bp, Homo sapiens
tgaactgctgcc

SEQ ID NO: 5524924 - DNA, 18 bp, Homo sapiens
tgaactgctggagtctgg

SEQ ID NO: 5524925 - DNA, 20 bp, Homo sapiens
tgaactgctggagtctggct

SEQ ID NO: 5524926 - DNA, 23 bp, Homo sapiens
tgaactgcttgctaccaatctgt

SEQ ID NO: 5524927 - DNA, 14 bp, Homo sapiens
tgaactgctttcaa

SEQ ID NO: 5524928 - DNA, 15 bp, Homo sapiens
tgaactgctttcaag

SEQ ID NO: 5524929 - DNA, 12 bp, Homo sapiens
tgaactggaaga

SEQ ID NO: 5524930 - DNA, 14 bp, Homo sapiens
tgaactggaagaaa

SEQ ID NO: 5524931 - DNA, 16 bp, Homo sapiens
tgaactggaagaaagc

SEQ ID NO: 5524932 - DNA, 20 bp, Homo sapiens
tgaactggaccctgttgcta

SEQ ID NO: 5524933 - DNA, 16 bp, Homo sapiens
tgaactggagctgcta

SEQ ID NO: 5524934 - DNA, 16 bp, Homo sapiens
tgaactggaggccagg

SEQ ID NO: 5524935 - DNA, 13 bp, Homo sapiens
tgaactggccact

SEQ ID NO: 5524936 - DNA, 19 bp, Homo sapiens
tgaactggccgctgggaga

SEQ ID NO: 5524937 - DNA, 18 bp, Homo sapiens
tgaactggcttgtacatt

SEQ ID NO: 5524938 - DNA, 22 bp, Homo sapiens
tgaactgggcacagattgaaga

SEQ ID NO: 5524939 - DNA, 16 bp, Homo sapiens
tgaactggtcttcctt

SEQ ID NO: 5524940 - DNA, 17 bp, Homo sapiens
tgaactggtcttccttt

SEQ ID NO: 5524941 - DNA, 18 bp, Homo sapiens
tgaactggtcttcctttt

SEQ ID NO: 5524942 - DNA, 13 bp, Homo sapiens
tgaactggttcat

SEQ ID NO: 5524943 - DNA, 12 bp, Homo sapiens
tgaactgtaaac

SEQ ID NO: 5524944 - DNA, 14 bp, Homo sapiens
tgaactgtactact

SEQ ID NO: 5524945 - DNA, 15 bp, Homo sapiens
tgaactgtactactc

SEQ ID NO: 5524946 - DNA, 21 bp, Homo sapiens
tgaactgtattctagtggctg

SEQ ID NO: 5524947 - DNA, 11 bp, Homo sapiens
tgaactgtgac

SEQ ID NO: 5524948 - DNA, 17 bp, Homo sapiens
tgaactgtgacaggaag

SEQ ID NO: 5524949 - DNA, 16 bp, Homo sapiens
tgaactgtgagtcctg

SEQ ID NO: 5524950 - DNA, 17 bp, Homo sapiens
tgaactgtggtgccaca

SEQ ID NO: 5524951 - DNA, 19 bp, Homo sapiens
tgaactgtgtgtgaatctg

SEQ ID NO: 5524952 - DNA, 11 bp, Homo sapiens
tgaactgttac

SEQ ID NO: 5524953 - DNA, 13 bp, Homo sapiens
tgaactgttagaa

SEQ ID NO: 5524954 - DNA, 16 bp, Homo sapiens
tgaactgttagatgct

SEQ ID NO: 5524955 - DNA, 23 bp, Homo sapiens
tgaactgttgcccttctgtccaa

SEQ ID NO: 5524956 - DNA, 18 bp, Homo sapiens
tgaacttaaaatgaaagt

SEQ ID NO: 5524957 - DNA, 15 bp, Homo sapiens
tgaacttaacatgct

SEQ ID NO: 5524958 - DNA, 23 bp, Homo sapiens
tgaacttaataactgtgtactgt

SEQ ID NO: 5524959 - DNA, 23 bp, Homo sapiens
tgaacttacatactaggtgcctt

SEQ ID NO: 5524960 - DNA, 20 bp, Homo sapiens
tgaacttactgtagcctcag

SEQ ID NO: 5524961 - DNA, 15 bp, Homo sapiens
tgaacttagaactat

SEQ ID NO: 5524962 - DNA, 17 bp, Homo sapiens
tgaacttagatgttaaa

SEQ ID NO: 5524963 - DNA, 17 bp, Homo sapiens
tgaacttagattttaca

SEQ ID NO: 5524964 - DNA, 19 bp, Homo sapiens
tgaacttagattttacatg

SEQ ID NO: 5524965 - DNA, 20 bp, Homo sapiens
tgaacttagattttacatga

SEQ ID NO: 5524966 - DNA, 21 bp, Homo sapiens
tgaacttagattttacatgaa

SEQ ID NO: 5524967 - DNA, 13 bp, Homo sapiens
tgaacttgaaaaa

SEQ ID NO: 5524968 - DNA, 22 bp, Homo sapiens
tgaacttgaagctaacgttaga

SEQ ID NO: 5524969 - DNA, 17 bp, Homo sapiens
tgaacttgaggacacat

SEQ ID NO: 5524970 - DNA, 17 bp, Homo sapiens
tgaacttgcattgtgat

SEQ ID NO: 5524971 - DNA, 20 bp, Homo sapiens
tgaacttgcctcttttacct

SEQ ID NO: 5524972 - DNA, 16 bp, Homo sapiens
tgaacttgctcttttt

SEQ ID NO: 5524973 - DNA, 23 bp, Homo sapiens
tgaacttggatattcaagccttt

SEQ ID NO: 5524974 - DNA, 22 bp, Homo sapiens
tgaacttggctttcctgtttct

SEQ ID NO: 5524975 - DNA, 15 bp, Homo sapiens
tgaacttgtagctgt

SEQ ID NO: 5524976 - DNA, 17 bp, Homo sapiens
tgaacttgtagctgtaa

SEQ ID NO: 5524977 - DNA, 21 bp, Homo sapiens
tgaacttgtagctgtaaaacg

SEQ ID NO: 5524978 - DNA, 17 bp, Homo sapiens
tgaactttccaaaacct

SEQ ID NO: 5524979 - DNA, 11 bp, Homo sapiens
tgaactttctc

SEQ ID NO: 5524980 - DNA, 12 bp, Homo sapiens
tgaactttgaat

SEQ ID NO: 5524981 - DNA, 22 bp, Homo sapiens
tgaactttgaatggtttaacaa

SEQ ID NO: 5524982 - DNA, 16 bp, Homo sapiens
tgaactttgacctctg

SEQ ID NO: 5524983 - DNA, 14 bp, Homo sapiens
tgaactttgccaaa

SEQ ID NO: 5524984 - DNA, 11 bp, Homo sapiens
tgaactttgct

SEQ ID NO: 5524985 - DNA, 14 bp, Homo sapiens
tgaactttggaagc

SEQ ID NO: 5524986 - DNA, 15 bp, Homo sapiens
tgaactttgtaggac

SEQ ID NO: 5524987 - DNA, 14 bp, Homo sapiens
tgaactttgtcagt

SEQ ID NO: 5524988 - DNA, 23 bp, Homo sapiens
tgaacttttacagaatgcattaa

SEQ ID NO: 5524989 - DNA, 17 bp, Homo sapiens
tgaacttttcaaaataa

SEQ ID NO: 5524990 - DNA, 13 bp, Homo sapiens
tgaacttttgtaa

SEQ ID NO: 5524991 - DNA, 16 bp, Homo sapiens
tgaacttttgtaattt

SEQ ID NO: 5524992 - DNA, 17 bp, Homo sapiens
tgaacttttgtaatttg

SEQ ID NO: 5524993 - DNA, 18 bp, Homo sapiens
tgaacttttgtaatttga

SEQ ID NO: 5524994 - DNA, 19 bp, Homo sapiens
tgaacttttgtaatttgaa

SEQ ID NO: 5524995 - DNA, 20 bp, Homo sapiens
tgaacttttgtaatttgaat

SEQ ID NO: 5524996 - DNA, 16 bp, Homo sapiens
tgaacttttgtactga

SEQ ID NO: 5524997 - DNA, 17 bp, Homo sapiens
tgaactttttatttgag

SEQ ID NO: 5524998 - DNA, 19 bp, Homo sapiens
tgaactttttatttgagga

SEQ ID NO: 5524999 - DNA, 22 bp, Homo sapiens
tgaactttttctaggtggcagg

SEQ ID NO: 5525000 - DNA, 21 bp, Homo sapiens
tgaagaaaaaaatgtacattt

SEQ ID NO: 5525001 - DNA, 12 bp, Homo sapiens
tgaagaaaaaat

SEQ ID NO: 5525002 - DNA, 17 bp, Homo sapiens
tgaagaaaaaatacatt

SEQ ID NO: 5525003 - DNA, 13 bp, Homo sapiens
tgaagaaaaaatc

SEQ ID NO: 5525004 - DNA, 14 bp, Homo sapiens
tgaagaaaaaatca

SEQ ID NO: 5525005 - DNA, 16 bp, Homo sapiens
tgaagaaaaaatggca

SEQ ID NO: 5525006 - DNA, 17 bp, Homo sapiens
tgaagaaaaaattttaa

SEQ ID NO: 5525007 - DNA, 19 bp, Homo sapiens
tgaagaaaaaggacaaata

SEQ ID NO: 5525008 - DNA, 13 bp, Homo sapiens
tgaagaaaacaaa

SEQ ID NO: 5525009 - DNA, 17 bp, Homo sapiens
tgaagaaaactccttta

SEQ ID NO: 5525010 - DNA, 20 bp, Homo sapiens
tgaagaaaagaaaaaacaac

SEQ ID NO: 5525011 - DNA, 14 bp, Homo sapiens
tgaagaaaatactt

SEQ ID NO: 5525012 - DNA, 21 bp, Homo sapiens
tgaagaaaatcacttaggaaa

SEQ ID NO: 5525013 - DNA, 15 bp, Homo sapiens
tgaagaaaatgactt

SEQ ID NO: 5525014 - DNA, 13 bp, Homo sapiens
tgaagaaacacag

SEQ ID NO: 5525015 - DNA, 16 bp, Homo sapiens
tgaagaaacacagcat

SEQ ID NO: 5525016 - DNA, 20 bp, Homo sapiens
tgaagtaatatgcacacatt

SEQ ID NO: 5525017 - DNA, 16 bp, Homo sapiens
tgaagtacaaacatga

SEQ ID NO: 5525018 - DNA, 20 bp, Homo sapiens
tgaagtacagtatattcttg

SEQ ID NO: 5525019 - DNA, 23 bp, Homo sapiens
tgaagtacagtcccagcacattt

SEQ ID NO: 5525020 - DNA, 20 bp, Homo sapiens
tgaagtacatattaggaaaa

SEQ ID NO: 5525021 - DNA, 12 bp, Homo sapiens
tgaagtaccacc

SEQ ID NO: 5525022 - DNA, 21 bp, Homo sapiens
tgaagtactggaatttattat

SEQ ID NO: 5525023 - DNA, 13 bp, Homo sapiens
tgaagtagaagtt

SEQ ID NO: 5525024 - DNA, 23 bp, Homo sapiens
tgaagtagcaataggctgtaatc

SEQ ID NO: 5525025 - DNA, 15 bp, Homo sapiens
tgaagtagtttgtat

SEQ ID NO: 5525026 - DNA, 18 bp, Homo sapiens
tgaagtataaacccattt

SEQ ID NO: 5525027 - DNA, 15 bp, Homo sapiens
tgaagtatacattta

SEQ ID NO: 5525028 - DNA, 18 bp, Homo sapiens
tgaagtatacatttagtt

SEQ ID NO: 5525029 - DNA, 21 bp, Homo sapiens
tgaagtatattcttattggaa

SEQ ID NO: 5525030 - DNA, 17 bp, Homo sapiens
tgaagtatctgtacctg

SEQ ID NO: 5525031 - DNA, 14 bp, Homo sapiens
tgaagtatgcacta

SEQ ID NO: 5525032 - DNA, 16 bp, Homo sapiens
tgaagtatggtgtgtt

SEQ ID NO: 5525033 - DNA, 14 bp, Homo sapiens
tgaagtatgtcttc

SEQ ID NO: 5525034 - DNA, 17 bp, Homo sapiens
tgaagtattaaaatgca

SEQ ID NO: 5525035 - DNA, 21 bp, Homo sapiens
tgaagtattaaaatgcatatt

SEQ ID NO: 5525036 - DNA, 16 bp, Homo sapiens
tgaagtattacatgat

SEQ ID NO: 5525037 - DNA, 19 bp, Homo sapiens
tgaagtattagacttctaa

SEQ ID NO: 5525038 - DNA, 22 bp, Homo sapiens
tgaagtattagacttctaaata

SEQ ID NO: 5525039 - DNA, 20 bp, Homo sapiens
tgaagtcaaaccttaagata

SEQ ID NO: 5525040 - DNA, 22 bp, Homo sapiens
tgaagtcaaaccttaagataat

SEQ ID NO: 5525041 - DNA, 14 bp, Homo sapiens
tgaagtcacattag

SEQ ID NO: 5525042 - DNA, 15 bp, Homo sapiens
tgaagtcactgcaca

SEQ ID NO: 5525043 - DNA, 15 bp, Homo sapiens
tgaagtcagagagaa

SEQ ID NO: 5525044 - DNA, 14 bp, Homo sapiens
tgaagtcagatgtg

SEQ ID NO: 5525045 - DNA, 18 bp, Homo sapiens
tgaagtcagccacactgg

SEQ ID NO: 5525046 - DNA, 23 bp, Homo sapiens
tgaagtcagccacactgggcctg

SEQ ID NO: 5525047 - DNA, 18 bp, Homo sapiens
tgaagtcatcttagcttt

SEQ ID NO: 5525048 - DNA, 22 bp, Homo sapiens
tgaagtcatgctcccctgtgcc

SEQ ID NO: 5525049 - DNA, 17 bp, Homo sapiens
tgaagtccaaattgttt

SEQ ID NO: 5525050 - DNA, 23 bp, Homo sapiens
tgaagtccaaattgtttgtacag

SEQ ID NO: 5525051 - DNA, 22 bp, Homo sapiens
tgaagtccaagcatttagatgt

SEQ ID NO: 5525052 - DNA, 20 bp, Homo sapiens
tgaagtccacttatgtagac

SEQ ID NO: 5525053 - DNA, 13 bp, Homo sapiens
tgaagtccagtga

SEQ ID NO: 5525054 - DNA, 17 bp, Homo sapiens
tgaagtccagtgaccct

SEQ ID NO: 5525055 - DNA, 23 bp, Homo sapiens
tgaagtccagtgaccctggagct

SEQ ID NO: 5525056 - DNA, 20 bp, Homo sapiens
tgaagtcccaatttaagagt

SEQ ID NO: 5525057 - DNA, 13 bp, Homo sapiens
tgaagtccggaac

SEQ ID NO: 5525058 - DNA, 18 bp, Homo sapiens
tgaagtcgagcactctaa

SEQ ID NO: 5525059 - DNA, 20 bp, Homo sapiens
tgaagtcgggtcaaaaataa

SEQ ID NO: 5525060 - DNA, 16 bp, Homo sapiens
tgaagtcgttgtgagg

SEQ ID NO: 5525061 - DNA, 15 bp, Homo sapiens
tgaagtctagaatca

SEQ ID NO: 5525062 - DNA, 16 bp, Homo sapiens
tgaagtctcttccctt

SEQ ID NO: 5525063 - DNA, 11 bp, Homo sapiens
tgaagtctgaa

SEQ ID NO: 5525064 - DNA, 14 bp, Homo sapiens
tgaagtctgaaatt

SEQ ID NO: 5525065 - DNA, 17 bp, Homo sapiens
tgaagtctgagggaaac

SEQ ID NO: 5525066 - DNA, 22 bp, Homo sapiens
tgaagtctgcttaccaaaacat

SEQ ID NO: 5525067 - DNA, 16 bp, Homo sapiens
tgaagtctggaacact

SEQ ID NO: 5525068 - DNA, 17 bp, Homo sapiens
tgaagtctgtattgtaa

SEQ ID NO: 5525069 - DNA, 18 bp, Homo sapiens
tgaagtcttgcattgaat

SEQ ID NO: 5525070 - DNA, 14 bp, Homo sapiens
tgaagtcttgtata

SEQ ID NO: 5525071 - DNA, 19 bp, Homo sapiens
tgaagtctttaataaataa

SEQ ID NO: 5525072 - DNA, 17 bp, Homo sapiens
tgaagtctttgtacaga

SEQ ID NO: 5525073 - DNA, 22 bp, Homo sapiens
tgaagtctttgtacagacaaca

SEQ ID NO: 5525074 - DNA, 17 bp, Homo sapiens
tgaagtcttttctgtca

SEQ ID NO: 5525075 - DNA, 12 bp, Homo sapiens
tgaagtgaaact

SEQ ID NO: 5525076 - DNA, 20 bp, Homo sapiens
tgaagtgaacaaatttcaaa

SEQ ID NO: 5525077 - DNA, 21 bp, Homo sapiens
tgaagtgaaggagaaaggagc

SEQ ID NO: 5525078 - DNA, 13 bp, Homo sapiens
tgaagtgaataca

SEQ ID NO: 5525079 - DNA, 17 bp, Homo sapiens
tgaagtgaatacatggt

SEQ ID NO: 5525080 - DNA, 13 bp, Homo sapiens
tgaagtgaatctg

SEQ ID NO: 5525081 - DNA, 21 bp, Homo sapiens
tgaagtgaattcctgcatttg

SEQ ID NO: 5525082 - DNA, 17 bp, Homo sapiens
tgaagtgaccccagctc

SEQ ID NO: 5525083 - DNA, 17 bp, Homo sapiens
tgaagtgactgttgtac

SEQ ID NO: 5525084 - DNA, 18 bp, Homo sapiens
tgaagtgagcacagccta

SEQ ID NO: 5525085 - DNA, 23 bp, Homo sapiens
tgaagtgagctgagattgcacca

SEQ ID NO: 5525086 - DNA, 13 bp, Homo sapiens
tgaagtgaggaca

SEQ ID NO: 5525087 - DNA, 19 bp, Homo sapiens
tgaagtgatctaaaatttg

SEQ ID NO: 5525088 - DNA, 17 bp, Homo sapiens
tgaagtgcacaggagcc

SEQ ID NO: 5525089 - DNA, 13 bp, Homo sapiens
tgaagtgcagctc

SEQ ID NO: 5525090 - DNA, 14 bp, Homo sapiens
tgaagtgcagctca

SEQ ID NO: 5525091 - DNA, 13 bp, Homo sapiens
tgaagtgcatgtt

SEQ ID NO: 5525092 - DNA, 18 bp, Homo sapiens
tgaagtgcctactggggg

SEQ ID NO: 5525093 - DNA, 22 bp, Homo sapiens
tgaagtgcctctgattctatgt

SEQ ID NO: 5525094 - DNA, 16 bp, Homo sapiens
tgaagtgccttaaata

SEQ ID NO: 5525095 - DNA, 13 bp, Homo sapiens
tgaagtgcgtgaa

SEQ ID NO: 5525096 - DNA, 21 bp, Homo sapiens
tgaagtgcgtgaatgtatgta

SEQ ID NO: 5525097 - DNA, 21 bp, Homo sapiens
tgaagtgctgctccatgtttc

SEQ ID NO: 5525098 - DNA, 18 bp, Homo sapiens
tgaagtgctgtttattaa

SEQ ID NO: 5525099 - DNA, 22 bp, Homo sapiens
tgaagtgctgtttattaatctt

SEQ ID NO: 5525100 - DNA, 14 bp, Homo sapiens
tgaagtgcttgcag

SEQ ID NO: 5525101 - DNA, 18 bp, Homo sapiens
tgaagtggaaaaagaaat

SEQ ID NO: 5525102 - DNA, 13 bp, Homo sapiens
tgaagtggctggt

SEQ ID NO: 5525103 - DNA, 19 bp, Homo sapiens
tgaagtggctggtagaaaa

SEQ ID NO: 5525104 - DNA, 19 bp, Homo sapiens
tgaagtgggaaaaaataga

SEQ ID NO: 5525105 - DNA, 21 bp, Homo sapiens
tgaagtggttgcattctacta

SEQ ID NO: 5525106 - DNA, 22 bp, Homo sapiens
tgaagtgtacctgtgtacataa

SEQ ID NO: 5525107 - DNA, 16 bp, Homo sapiens
tgaagtgtaggcagac

SEQ ID NO: 5525108 - DNA, 20 bp, Homo sapiens
tgaagtgtataatataaaaa

SEQ ID NO: 5525109 - DNA, 17 bp, Homo sapiens
tgaagtgtatatgattc

SEQ ID NO: 5525110 - DNA, 19 bp, Homo sapiens
tgaagtgtcgagtccagtc

SEQ ID NO: 5525111 - DNA, 14 bp, Homo sapiens
tgaagtgtggctgg

SEQ ID NO: 5525112 - DNA, 18 bp, Homo sapiens
tgaagtgtgtccatcctg

SEQ ID NO: 5525113 - DNA, 19 bp, Homo sapiens
tgaagtgtgtggctgggcg

SEQ ID NO: 5525114 - DNA, 15 bp, Homo sapiens
tgaagtgttaataca

SEQ ID NO: 5525115 - DNA, 17 bp, Homo sapiens
tgaagtgttaatactag

SEQ ID NO: 5525116 - DNA, 23 bp, Homo sapiens
tgaagtgttagactatagcccct

SEQ ID NO: 5525117 - DNA, 20 bp, Homo sapiens
tgaagtgttgtggagaaaag

SEQ ID NO: 5525118 - DNA, 12 bp, Homo sapiens
tgaagtgtttta

SEQ ID NO: 5525119 - DNA, 21 bp, Homo sapiens
tgaagttaaaacacctttcct

SEQ ID NO: 5525120 - DNA, 22 bp, Homo sapiens
tgaagttaaaacacctttcctt

SEQ ID NO: 5525121 - DNA, 15 bp, Homo sapiens
tgaagttaagcacaa

SEQ ID NO: 5525122 - DNA, 15 bp, Homo sapiens
tgaagttacatgcat

SEQ ID NO: 5525123 - DNA, 18 bp, Homo sapiens
tgaagttacatgcataaa

SEQ ID NO: 5525124 - DNA, 15 bp, Homo sapiens
tgaagttagtggaaa

SEQ ID NO: 5525125 - DNA, 14 bp, Homo sapiens
tgaagttatctgtg

SEQ ID NO: 5525126 - DNA, 19 bp, Homo sapiens
tgaagttcatggtgatcag

SEQ ID NO: 5525127 - DNA, 14 bp, Homo sapiens
tgaagttctcctga

SEQ ID NO: 5525128 - DNA, 17 bp, Homo sapiens
tgaagttctgaaattta

SEQ ID NO: 5525129 - DNA, 21 bp, Homo sapiens
tgaagttctgcctctgatgta

SEQ ID NO: 5525130 - DNA, 18 bp, Homo sapiens
tgaagttgctctgtaccc

SEQ ID NO: 5525131 - DNA, 16 bp, Homo sapiens
tgaagttgctgtttat

SEQ ID NO: 5525132 - DNA, 18 bp, Homo sapiens
tgaagttggacagcaaaa

SEQ ID NO: 5525133 - DNA, 17 bp, Homo sapiens
tgaagttggccaccttg

SEQ ID NO: 5525134 - DNA, 20 bp, Homo sapiens
tgaagttgggtgtttccaga

SEQ ID NO: 5525135 - DNA, 23 bp, Homo sapiens
tgaagttggtttagctttggaaa

SEQ ID NO: 5525136 - DNA, 12 bp, Homo sapiens
tgaagttgtgca

SEQ ID NO: 5525137 - DNA, 15 bp, Homo sapiens
tgaagttgttactaa

SEQ ID NO: 5525138 - DNA, 16 bp, Homo sapiens
tgaagttgtttatcaa

SEQ ID NO: 5525139 - DNA, 20 bp, Homo sapiens
tgaagttgtttatcaacttc

SEQ ID NO: 5525140 - DNA, 15 bp, Homo sapiens
tgaagttgttttttt

SEQ ID NO: 5525141 - DNA, 14 bp, Homo sapiens
tgaagtttacagag

SEQ ID NO: 5525142 - DNA, 15 bp, Homo sapiens
tgaagtttacatttt

SEQ ID NO: 5525143 - DNA, 18 bp, Homo sapiens
tgaagtttattattttca

SEQ ID NO: 5525144 - DNA, 20 bp, Homo sapiens
tgaagtttattattttcaaa

SEQ ID NO: 5525145 - DNA, 23 bp, Homo sapiens
tgaagtttcaagttttaaagttc

SEQ ID NO: 5525146 - DNA, 14 bp, Homo sapiens
tgaagtttcacatg

SEQ ID NO: 5525147 - DNA, 14 bp, Homo sapiens
tgaagtttgaacca

SEQ ID NO: 5525148 - DNA, 18 bp, Homo sapiens
tgaagtttgaacttcata

SEQ ID NO: 5525149 - DNA, 13 bp, Homo sapiens
tgaagtttgaatg

SEQ ID NO: 5525150 - DNA, 14 bp, Homo sapiens
tgaagtttgaatgt

SEQ ID NO: 5525151 - DNA, 15 bp, Homo sapiens
tgaagtttgataaat

SEQ ID NO: 5525152 - DNA, 16 bp, Homo sapiens
tgaagttttacattgt

SEQ ID NO: 5525153 - DNA, 16 bp, Homo sapiens
tgaagttttactgtct

SEQ ID NO: 5525154 - DNA, 13 bp, Homo sapiens
tgaagttttatga

SEQ ID NO: 5525155 - DNA, 14 bp, Homo sapiens
tgaagttttccttg

SEQ ID NO: 5525156 - DNA, 19 bp, Homo sapiens
tgaagttttggagagggaa

SEQ ID NO: 5525157 - DNA, 16 bp, Homo sapiens
tgaagtttttaaaaat

SEQ ID NO: 5525158 - DNA, 17 bp, Homo sapiens
tgaagtttttgaaatac

SEQ ID NO: 5525159 - DNA, 18 bp, Homo sapiens
tgaataaaaaacatttgt

SEQ ID NO: 5525160 - DNA, 19 bp, Homo sapiens
tgaataaaaaacatttgta

SEQ ID NO: 5525161 - DNA, 15 bp, Homo sapiens
tgaataaaaaagatt

SEQ ID NO: 5525162 - DNA, 20 bp, Homo sapiens
tgaataaaaaagattctact

SEQ ID NO: 5525163 - DNA, 14 bp, Homo sapiens
tgaataaaaaccct

SEQ ID NO: 5525164 - DNA, 16 bp, Homo sapiens
tgaataaaaactcaag

SEQ ID NO: 5525165 - DNA, 14 bp, Homo sapiens
tgaataaaaagtga

SEQ ID NO: 5525166 - DNA, 13 bp, Homo sapiens
tgaataaaaataa

SEQ ID NO: 5525167 - DNA, 20 bp, Homo sapiens
tgaataaaaataaagttttt

SEQ ID NO: 5525168 - DNA, 12 bp, Homo sapiens
tgaataaaagaa

SEQ ID NO: 5525169 - DNA, 16 bp, Homo sapiens
tgaataaaaggctgga

SEQ ID NO: 5525170 - DNA, 14 bp, Homo sapiens
tgaataaaatgttt

SEQ ID NO: 5525171 - DNA, 19 bp, Homo sapiens
tgaataaaattattccttt

SEQ ID NO: 5525172 - DNA, 15 bp, Homo sapiens
tgaataaaattattt

SEQ ID NO: 5525173 - DNA, 17 bp, Homo sapiens
tgaataaaattgttatt

SEQ ID NO: 5525174 - DNA, 20 bp, Homo sapiens
tgaataaaattgttatttca

SEQ ID NO: 5525175 - DNA, 16 bp, Homo sapiens
tgaataaacacttttt

SEQ ID NO: 5525176 - DNA, 17 bp, Homo sapiens
tgaataaacactttttc

SEQ ID NO: 5525177 - DNA, 16 bp, Homo sapiens
tgaataaaccaagaca

SEQ ID NO: 5525178 - DNA, 12 bp, Homo sapiens
tgaataaactga

SEQ ID NO: 5525179 - DNA, 17 bp, Homo sapiens
tgaataaactgaatatt

SEQ ID NO: 5525180 - DNA, 18 bp, Homo sapiens
tgaataaacttcagcacc

SEQ ID NO: 5525181 - DNA, 19 bp, Homo sapiens
tgaataaacttcagcacca

SEQ ID NO: 5525182 - DNA, 19 bp, Homo sapiens
tgaataaagaatacttgaa

SEQ ID NO: 5525183 - DNA, 14 bp, Homo sapiens
tgaataaagaatgc

SEQ ID NO: 5525184 - DNA, 13 bp, Homo sapiens
tgaataaagagcc

SEQ ID NO: 5525185 - DNA, 14 bp, Homo sapiens
tgaataaagcaatt

SEQ ID NO: 5525186 - DNA, 13 bp, Homo sapiens
tgaataaagcctt

SEQ ID NO: 5525187 - DNA, 20 bp, Homo sapiens
tgaataaagcctttgtatct

SEQ ID NO: 5525188 - DNA, 22 bp, Homo sapiens
tgaataaagggaacatgcagct

SEQ ID NO: 5525189 - DNA, 12 bp, Homo sapiens
tgaataaagtct

SEQ ID NO: 5525190 - DNA, 19 bp, Homo sapiens
tgaataaagtctgagtggg

SEQ ID NO: 5525191 - DNA, 21 bp, Homo sapiens
tgaataaagtgcaaacagaag

SEQ ID NO: 5525192 - DNA, 13 bp, Homo sapiens
tgaataaagtgct

SEQ ID NO: 5525193 - DNA, 17 bp, Homo sapiens
tgaataaagttgaagct

SEQ ID NO: 5525194 - DNA, 14 bp, Homo sapiens
tgaataaatacctc

SEQ ID NO: 5525195 - DNA, 19 bp, Homo sapiens
tgaatgggcaaaactgaat

SEQ ID NO: 5525196 - DNA, 18 bp, Homo sapiens
tgaatgggcatgaatgga

SEQ ID NO: 5525197 - DNA, 15 bp, Homo sapiens
tgaatgggcatttct

SEQ ID NO: 5525198 - DNA, 22 bp, Homo sapiens
tgaatgggcatttctaaaatgt

SEQ ID NO: 5525199 - DNA, 13 bp, Homo sapiens
tgaatggggaggc

SEQ ID NO: 5525200 - DNA, 15 bp, Homo sapiens
tgaatgggggaggcc

SEQ ID NO: 5525201 - DNA, 18 bp, Homo sapiens
tgaatggggtctcaaagt

SEQ ID NO: 5525202 - DNA, 17 bp, Homo sapiens
tgaatgggtccattttg

SEQ ID NO: 5525203 - DNA, 13 bp, Homo sapiens
tgaatggtatgga

SEQ ID NO: 5525204 - DNA, 13 bp, Homo sapiens
tgaatggtcagcg

SEQ ID NO: 5525205 - DNA, 21 bp, Homo sapiens
tgaatggtcagcgttgcatgt

SEQ ID NO: 5525206 - DNA, 18 bp, Homo sapiens
tgaatggtctagaaacat

SEQ ID NO: 5525207 - DNA, 15 bp, Homo sapiens
tgaatggtgttgtat

SEQ ID NO: 5525208 - DNA, 14 bp, Homo sapiens
tgaatggttgcaaa

SEQ ID NO: 5525209 - DNA, 23 bp, Homo sapiens
tgaatggtttaacaaaagatttg

SEQ ID NO: 5525210 - DNA, 20 bp, Homo sapiens
tgaatggttttcaaaataaa

SEQ ID NO: 5525211 - DNA, 16 bp, Homo sapiens
tgaatgtaaatttgta

SEQ ID NO: 5525212 - DNA, 19 bp, Homo sapiens
tgaatgtaaatttgtacta

SEQ ID NO: 5525213 - DNA, 20 bp, Homo sapiens
tgaatgtaaatttgtactat

SEQ ID NO: 5525214 - DNA, 18 bp, Homo sapiens
tgaatgtaatttgtgtaa

SEQ ID NO: 5525215 - DNA, 20 bp, Homo sapiens
tgaatgtaatttgtgtaata

SEQ ID NO: 5525216 - DNA, 15 bp, Homo sapiens
tgaatgtacaaagat

SEQ ID NO: 5525217 - DNA, 12 bp, Homo sapiens
tgaatgtacctc

SEQ ID NO: 5525218 - DNA, 18 bp, Homo sapiens
tgaatgtagaataggcag

SEQ ID NO: 5525219 - DNA, 19 bp, Homo sapiens
tgaatgtagaataggcagg

SEQ ID NO: 5525220 - DNA, 19 bp, Homo sapiens
tgaatgtagcagccccggg

SEQ ID NO: 5525221 - DNA, 19 bp, Homo sapiens
tgaatgtagccagcccaca

SEQ ID NO: 5525222 - DNA, 19 bp, Homo sapiens
tgaatgtagcttccacctc

SEQ ID NO: 5525223 - DNA, 15 bp, Homo sapiens
tgaatgtatattttg

SEQ ID NO: 5525224 - DNA, 14 bp, Homo sapiens
tgaatgtatgcttc

SEQ ID NO: 5525225 - DNA, 19 bp, Homo sapiens
tgaatgtatgcttcataca

SEQ ID NO: 5525226 - DNA, 23 bp, Homo sapiens
tgaatgtatgcttcatacaggga

SEQ ID NO: 5525227 - DNA, 14 bp, Homo sapiens
tgaatgtatgtaaa

SEQ ID NO: 5525228 - DNA, 20 bp, Homo sapiens
tgaatgtatgtaatgtgtgg

SEQ ID NO: 5525229 - DNA, 19 bp, Homo sapiens
tgaatgtatgtcagtgcta

SEQ ID NO: 5525230 - DNA, 20 bp, Homo sapiens
tgaatgtattcttttatata

SEQ ID NO: 5525231 - DNA, 23 bp, Homo sapiens
tgaatgtattcttttatataact

SEQ ID NO: 5525232 - DNA, 11 bp, Homo sapiens
tgaatgtattt

SEQ ID NO: 5525233 - DNA, 14 bp, Homo sapiens
tgaatgtatttatg

SEQ ID NO: 5525234 - DNA, 17 bp, Homo sapiens
tgaatgtatttatttgg

SEQ ID NO: 5525235 - DNA, 19 bp, Homo sapiens
tgaatgtatttatttggga

SEQ ID NO: 5525236 - DNA, 12 bp, Homo sapiens
tgaatgtatttt

SEQ ID NO: 5525237 - DNA, 18 bp, Homo sapiens
tgaatgtcaatcatattt

SEQ ID NO: 5525238 - DNA, 18 bp, Homo sapiens
tgaatgtcacatttgaat

SEQ ID NO: 5525239 - DNA, 20 bp, Homo sapiens
tgaatgtcacatttgaattc

SEQ ID NO: 5525240 - DNA, 22 bp, Homo sapiens
tgaatgtcacatttgaattctt

SEQ ID NO: 5525241 - DNA, 16 bp, Homo sapiens
tgaatgtcacttctgg

SEQ ID NO: 5525242 - DNA, 19 bp, Homo sapiens
tgaatgtcagtgtgactga

SEQ ID NO: 5525243 - DNA, 14 bp, Homo sapiens
tgaatgtcattatt

SEQ ID NO: 5525244 - DNA, 16 bp, Homo sapiens
tgaatgtcccagaggc

SEQ ID NO: 5525245 - DNA, 18 bp, Homo sapiens
tgaatgtccccattctat

SEQ ID NO: 5525246 - DNA, 19 bp, Homo sapiens
tgaatgtccccattctata

SEQ ID NO: 5525247 - DNA, 16 bp, Homo sapiens
tgaatgtctaaaattg

SEQ ID NO: 5525248 - DNA, 21 bp, Homo sapiens
tgaatgtcttgttcctgtgca

SEQ ID NO: 5525249 - DNA, 22 bp, Homo sapiens
tgaatgtcttttttcaaacttt

SEQ ID NO: 5525250 - DNA, 14 bp, Homo sapiens
tgaatgtgaaacat

SEQ ID NO: 5525251 - DNA, 14 bp, Homo sapiens
tgaatgtgaagcct

SEQ ID NO: 5525252 - DNA, 17 bp, Homo sapiens
tgaatgtgaagccttcc

SEQ ID NO: 5525253 - DNA, 17 bp, Homo sapiens
tgaatgtgaatagtgtt

SEQ ID NO: 5525254 - DNA, 14 bp, Homo sapiens
tgaatgtgcatttc

SEQ ID NO: 5525255 - DNA, 15 bp, Homo sapiens
tgaatgtgcatttct

SEQ ID NO: 5525256 - DNA, 20 bp, Homo sapiens
tgaatgtgctgatcatttga

SEQ ID NO: 5525257 - DNA, 12 bp, Homo sapiens
tgaatgtgctgg

SEQ ID NO: 5525258 - DNA, 22 bp, Homo sapiens
tgaatgtggataaaactgtgta

SEQ ID NO: 5525259 - DNA, 13 bp, Homo sapiens
tgaatgtggcagt

SEQ ID NO: 5525260 - DNA, 16 bp, Homo sapiens
tgaatgtgggcactgg

SEQ ID NO: 5525261 - DNA, 17 bp, Homo sapiens
tgaatgtggttacttcc

SEQ ID NO: 5525262 - DNA, 12 bp, Homo sapiens
tgaatgtgtcag

SEQ ID NO: 5525263 - DNA, 18 bp, Homo sapiens
tgaatgtgtctggacctc

SEQ ID NO: 5525264 - DNA, 16 bp, Homo sapiens
tgaatgtgtgtatgta

SEQ ID NO: 5525265 - DNA, 17 bp, Homo sapiens
tgaatgtgtgtatgtat

SEQ ID NO: 5525266 - DNA, 20 bp, Homo sapiens
tgaatgtgtttcacagtttg

SEQ ID NO: 5525267 - DNA, 22 bp, Homo sapiens
tgaatgtgtttcacagtttgaa

SEQ ID NO: 5525268 - DNA, 23 bp, Homo sapiens
tgaatgtgtttcacagtttgaaa

SEQ ID NO: 5525269 - DNA, 15 bp, Homo sapiens
tgaatgttaaataaa

SEQ ID NO: 5525270 - DNA, 20 bp, Homo sapiens
tgaatgttaaataaattgta

SEQ ID NO: 5525271 - DNA, 20 bp, Homo sapiens
tgaatgttaacaggtatttt

SEQ ID NO: 5525272 - DNA, 17 bp, Homo sapiens
tgaatgttaagaattga

SEQ ID NO: 5525273 - DNA, 12 bp, Homo sapiens
tgaatgttacaa

SEQ ID NO: 5525274 - DNA, 12 bp, Homo sapiens
tgaatgttacta

SEQ ID NO: 5525275 - DNA, 19 bp, Homo sapiens
tgaatgttatatcatcaat

SEQ ID NO: 5525276 - DNA, 15 bp, Homo sapiens
tgaatgttatttgtt

SEQ ID NO: 5525277 - DNA, 21 bp, Homo sapiens
tgaatgttcatatagccaggg

SEQ ID NO: 5525278 - DNA, 14 bp, Homo sapiens
tgaatgttcttgaa

SEQ ID NO: 5525279 - DNA, 20 bp, Homo sapiens
tgaatgttcttgaattatat

SEQ ID NO: 5525280 - DNA, 18 bp, Homo sapiens
tgaatgttcttggttccc

SEQ ID NO: 5525281 - DNA, 20 bp, Homo sapiens
tgaatgttgcaatgtgaaaa

SEQ ID NO: 5525282 - DNA, 21 bp, Homo sapiens
tgaatgttgtcctgtgtcatc

SEQ ID NO: 5525283 - DNA, 17 bp, Homo sapiens
tgaatgtttacatgtca

SEQ ID NO: 5525284 - DNA, 19 bp, Homo sapiens
tgaatgtttgtgtctgtgg

SEQ ID NO: 5525285 - DNA, 19 bp, Homo sapiens
tgaatgttttatttatcaa

SEQ ID NO: 5525286 - DNA, 20 bp, Homo sapiens
tgaatgtttttctaaaggag

SEQ ID NO: 5525287 - DNA, 11 bp, Homo sapiens
tgaattaaaac

SEQ ID NO: 5525288 - DNA, 16 bp, Homo sapiens
tgaattaaaacttctt

SEQ ID NO: 5525289 - DNA, 18 bp, Homo sapiens
tgaattaaaacttcttaa

SEQ ID NO: 5525290 - DNA, 22 bp, Homo sapiens
tgaattaaaacttcttaaatat

SEQ ID NO: 5525291 - DNA, 19 bp, Homo sapiens
tgaattaaaataaaacaca

SEQ ID NO: 5525292 - DNA, 15 bp, Homo sapiens
tgaattaaagtaatt

SEQ ID NO: 5525293 - DNA, 14 bp, Homo sapiens
tgaattaaagtcta

SEQ ID NO: 5525294 - DNA, 20 bp, Homo sapiens
tgaattaaagtctacactgc

SEQ ID NO: 5525295 - DNA, 15 bp, Homo sapiens
tgaattaaataaata

SEQ ID NO: 5525296 - DNA, 15 bp, Homo sapiens
tgaattaaatttaat

SEQ ID NO: 5525297 - DNA, 18 bp, Homo sapiens
tgaattaagcccaattaa

SEQ ID NO: 5525298 - DNA, 20 bp, Homo sapiens
tgaattaagggccagaaaaa

SEQ ID NO: 5525299 - DNA, 22 bp, Homo sapiens
tgaattaatatccctacatgta

SEQ ID NO: 5525300 - DNA, 16 bp, Homo sapiens
tgaattaatctagaaa

SEQ ID NO: 5525301 - DNA, 21 bp, Homo sapiens
tgaattaatgacagagccagt

SEQ ID NO: 5525302 - DNA, 19 bp, Homo sapiens
tgaattacactcaaggaaa

SEQ ID NO: 5525303 - DNA, 22 bp, Homo sapiens
tgaattacagagatataaatga

SEQ ID NO: 5525304 - DNA, 23 bp, Homo sapiens
tgaattacagcagttgactcaga

SEQ ID NO: 5525305 - DNA, 20 bp, Homo sapiens
tgaattacagggaagaaatc

SEQ ID NO: 5525306 - DNA, 15 bp, Homo sapiens
tgaattacagtgaaa

SEQ ID NO: 5525307 - DNA, 18 bp, Homo sapiens
tgaattacagtgaaattt

SEQ ID NO: 5525308 - DNA, 13 bp, Homo sapiens
tgaattacatttg

SEQ ID NO: 5525309 - DNA, 15 bp, Homo sapiens
tgaattacatttgta

SEQ ID NO: 5525310 - DNA, 18 bp, Homo sapiens
tgaattaccatagagtaa

SEQ ID NO: 5525311 - DNA, 18 bp, Homo sapiens
tgaattactaacttctaa

SEQ ID NO: 5525312 - DNA, 16 bp, Homo sapiens
tgaattactgtatata

SEQ ID NO: 5525313 - DNA, 11 bp, Homo sapiens
tgaattagaaa

SEQ ID NO: 5525314 - DNA, 16 bp, Homo sapiens
tgaattagaaaattag

SEQ ID NO: 5525315 - DNA, 19 bp, Homo sapiens
tgaattagaaacataaata

SEQ ID NO: 5525316 - DNA, 21 bp, Homo sapiens
tgaattagaaacataaataaa

SEQ ID NO: 5525317 - DNA, 21 bp, Homo sapiens
tgaattagacctttatttttc

SEQ ID NO: 5525318 - DNA, 17 bp, Homo sapiens
tgaattagattatttct

SEQ ID NO: 5525319 - DNA, 18 bp, Homo sapiens
tgaattaggctaaaaggt

SEQ ID NO: 5525320 - DNA, 21 bp, Homo sapiens
tgaattagggtgggctctaaa

SEQ ID NO: 5525321 - DNA, 15 bp, Homo sapiens
tgaattagtatttca

SEQ ID NO: 5525322 - DNA, 16 bp, Homo sapiens
tgaattagtccttgct

SEQ ID NO: 5525323 - DNA, 13 bp, Homo sapiens
tgaattataacag

SEQ ID NO: 5525324 - DNA, 16 bp, Homo sapiens
tgaattatactttgtt

SEQ ID NO: 5525325 - DNA, 13 bp, Homo sapiens
tgaattatataat

SEQ ID NO: 5525326 - DNA, 15 bp, Homo sapiens
tgaattatatgttca

SEQ ID NO: 5525327 - DNA, 15 bp, Homo sapiens
tgaattatattcaat

SEQ ID NO: 5525328 - DNA, 17 bp, Homo sapiens
tgaattatcagcaaaga

SEQ ID NO: 5525329 - DNA, 21 bp, Homo sapiens
tgaattatccctgctggcttt

SEQ ID NO: 5525330 - DNA, 20 bp, Homo sapiens
tgaattatcccttttcttga

SEQ ID NO: 5525331 - DNA, 18 bp, Homo sapiens
tgaattatcttggatgag

SEQ ID NO: 5525332 - DNA, 17 bp, Homo sapiens
tgaattatgcttccaca

SEQ ID NO: 5525333 - DNA, 19 bp, Homo sapiens
tgaattatgttttgacaca

SEQ ID NO: 5525334 - DNA, 14 bp, Homo sapiens
tgaattattacagt

SEQ ID NO: 5525335 - DNA, 18 bp, Homo sapiens
tgaattattacagtgttt

SEQ ID NO: 5525336 - DNA, 18 bp, Homo sapiens
tgaattattatatacata

SEQ ID NO: 5525337 - DNA, 13 bp, Homo sapiens
tgaattattcaat

SEQ ID NO: 5525338 - DNA, 14 bp, Homo sapiens
tgaattattgacac

SEQ ID NO: 5525339 - DNA, 21 bp, Homo sapiens
tgaattattgggcttaatata

SEQ ID NO: 5525340 - DNA, 20 bp, Homo sapiens
tgaattattttgataaatta

SEQ ID NO: 5525341 - DNA, 21 bp, Homo sapiens
tgaattattttgttactgtct

SEQ ID NO: 5525342 - DNA, 19 bp, Homo sapiens
tgaattattttgttgtgat

SEQ ID NO: 5525343 - DNA, 22 bp, Homo sapiens
tgaattattttgttgtgatttt

SEQ ID NO: 5525344 - DNA, 21 bp, Homo sapiens
tgaattatttttaaagatctt

SEQ ID NO: 5525345 - DNA, 12 bp, Homo sapiens
tgaattcaaagc

SEQ ID NO: 5525346 - DNA, 15 bp, Homo sapiens
tgaattcaaagcttg

SEQ ID NO: 5525347 - DNA, 14 bp, Homo sapiens
tgaattcacaaaca

SEQ ID NO: 5525348 - DNA, 13 bp, Homo sapiens
tgaattcactcca

SEQ ID NO: 5525349 - DNA, 17 bp, Homo sapiens
tgaattcagacctggaa

SEQ ID NO: 5525350 - DNA, 22 bp, Homo sapiens
tgaattcagacctggaatgtaa

SEQ ID NO: 5525351 - DNA, 14 bp, Homo sapiens
tgaattcagttgct

SEQ ID NO: 5525352 - DNA, 16 bp, Homo sapiens
tgaattcatttcactg

SEQ ID NO: 5525353 - DNA, 14 bp, Homo sapiens
tgaattcatttgct

SEQ ID NO: 5525354 - DNA, 17 bp, Homo sapiens
tgaattcccagactctg

SEQ ID NO: 5525355 - DNA, 19 bp, Homo sapiens
tgaattcccagactctgcc

SEQ ID NO: 5525356 - DNA, 20 bp, Homo sapiens
tgaattcccagactctgcct

SEQ ID NO: 5525357 - DNA, 18 bp, Homo sapiens
tgaattcctacacatggt

SEQ ID NO: 5525358 - DNA, 16 bp, Homo sapiens
tgaattcctagaatta

SEQ ID NO: 5525359 - DNA, 16 bp, Homo sapiens
tgaattcctctcaaat

SEQ ID NO: 5525360 - DNA, 23 bp, Homo sapiens
tgaattcctctcaaattcagctc

SEQ ID NO: 5525361 - DNA, 18 bp, Homo sapiens
tgaattcctgtcttccaa

SEQ ID NO: 5525362 - DNA, 13 bp, Homo sapiens
tgaattctctcta

SEQ ID NO: 5525363 - DNA, 14 bp, Homo sapiens
tgaattctggagga

SEQ ID NO: 5525364 - DNA, 20 bp, Homo sapiens
tgaattctggaggaagaaga

SEQ ID NO: 5525365 - DNA, 17 bp, Homo sapiens
tgaattctgtgaagaat

SEQ ID NO: 5525366 - DNA, 13 bp, Homo sapiens
tgaattcttcaac

SEQ ID NO: 5525367 - DNA, 18 bp, Homo sapiens
tgaattcttgatctctaa

SEQ ID NO: 5525368 - DNA, 21 bp, Homo sapiens
tgaattcttggttgaggaaac

SEQ ID NO: 5525369 - DNA, 22 bp, Homo sapiens
tgaattcttggttgaggaaaca

SEQ ID NO: 5525370 - DNA, 17 bp, Homo sapiens
tgaattctttagatttt

SEQ ID NO: 5525371 - DNA, 23 bp, Homo sapiens
tgaattctttgtttatgcacttt

SEQ ID NO: 5525372 - DNA, 12 bp, Homo sapiens
tgaattgaaaaa

SEQ ID NO: 5525373 - DNA, 19 bp, Homo sapiens
tgacagctttctaactcac

SEQ ID NO: 5525374 - DNA, 14 bp, Homo sapiens
tgacagctttctgg

SEQ ID NO: 5525375 - DNA, 13 bp, Homo sapiens
tgacagctttgct

SEQ ID NO: 5525376 - DNA, 17 bp, Homo sapiens
tgacagctttgctgctg

SEQ ID NO: 5525377 - DNA, 21 bp, Homo sapiens
tgacagctttgctgctgaagg

SEQ ID NO: 5525378 - DNA, 19 bp, Homo sapiens
tgacaggaaagattcatgt

SEQ ID NO: 5525379 - DNA, 16 bp, Homo sapiens
tgacaggaaagccctc

SEQ ID NO: 5525380 - DNA, 18 bp, Homo sapiens
tgacaggaaagccctccc

SEQ ID NO: 5525381 - DNA, 22 bp, Homo sapiens
tgacaggaacccatcactgtgt

SEQ ID NO: 5525382 - DNA, 11 bp, Homo sapiens
tgacaggaaga

SEQ ID NO: 5525383 - DNA, 15 bp, Homo sapiens
tgacaggaagactgg

SEQ ID NO: 5525384 - DNA, 22 bp, Homo sapiens
tgacaggaattctccctggcat

SEQ ID NO: 5525385 - DNA, 16 bp, Homo sapiens
tgacaggcagacacat

SEQ ID NO: 5525386 - DNA, 19 bp, Homo sapiens
tgacaggcagacacatgct

SEQ ID NO: 5525387 - DNA, 14 bp, Homo sapiens
tgacaggcagcaga

SEQ ID NO: 5525388 - DNA, 21 bp, Homo sapiens
tgacaggcatgaatcactgtg

SEQ ID NO: 5525389 - DNA, 18 bp, Homo sapiens
tgacaggcctgaagatat

SEQ ID NO: 5525390 - DNA, 23 bp, Homo sapiens
tgacaggccttcctcctctcaaa

SEQ ID NO: 5525391 - DNA, 20 bp, Homo sapiens
tgacaggcgccgcctcgccc

SEQ ID NO: 5525392 - DNA, 18 bp, Homo sapiens
tgacaggctcgtcagcca

SEQ ID NO: 5525393 - DNA, 17 bp, Homo sapiens
tgacaggctctcctggc

SEQ ID NO: 5525394 - DNA, 15 bp, Homo sapiens
tgacaggctgaaagc

SEQ ID NO: 5525395 - DNA, 16 bp, Homo sapiens
tgacaggctgtgactc

SEQ ID NO: 5525396 - DNA, 12 bp, Homo sapiens
tgacagggaagc

SEQ ID NO: 5525397 - DNA, 14 bp, Homo sapiens
tgacagggaagcta

SEQ ID NO: 5525398 - DNA, 16 bp, Homo sapiens
tgacagggaagctaca

SEQ ID NO: 5525399 - DNA, 17 bp, Homo sapiens
tgacagggaagctacag

SEQ ID NO: 5525400 - DNA, 18 bp, Homo sapiens
tgacagggagctggggaa

SEQ ID NO: 5525401 - DNA, 22 bp, Homo sapiens
tgacagggcacaccgggcactc

SEQ ID NO: 5525402 - DNA, 12 bp, Homo sapiens
tgacagggcaga

SEQ ID NO: 5525403 - DNA, 19 bp, Homo sapiens
tgacagggccagtgcagtt

SEQ ID NO: 5525404 - DNA, 21 bp, Homo sapiens
tgacagggccagtggggcctg

SEQ ID NO: 5525405 - DNA, 16 bp, Homo sapiens
tgacaggggctcagga

SEQ ID NO: 5525406 - DNA, 14 bp, Homo sapiens
tgacaggtcagcag

SEQ ID NO: 5525407 - DNA, 15 bp, Homo sapiens
tgacaggtgcctgtc

SEQ ID NO: 5525408 - DNA, 15 bp, Homo sapiens
tgacaggtgtgagcc

SEQ ID NO: 5525409 - DNA, 19 bp, Homo sapiens
tgacaggtgtgagccactg

SEQ ID NO: 5525410 - DNA, 20 bp, Homo sapiens
tgacaggtgtgagccactgc

SEQ ID NO: 5525411 - DNA, 18 bp, Homo sapiens
tgacaggttcccagcagc

SEQ ID NO: 5525412 - DNA, 15 bp, Homo sapiens
tgacaggtttgggac

SEQ ID NO: 5525413 - DNA, 16 bp, Homo sapiens
tgacaggttttccaaa

SEQ ID NO: 5525414 - DNA, 18 bp, Homo sapiens
tgacagtaaccatttcag

SEQ ID NO: 5525415 - DNA, 22 bp, Homo sapiens
tgacagtaacttggttatacat

SEQ ID NO: 5525416 - DNA, 14 bp, Homo sapiens
tgacagtaattgtg

SEQ ID NO: 5525417 - DNA, 21 bp, Homo sapiens
tgacagtacccgactgtttat

SEQ ID NO: 5525418 - DNA, 14 bp, Homo sapiens
tgacagtagcattg

SEQ ID NO: 5525419 - DNA, 21 bp, Homo sapiens
tgacagtatatttgaaactgt

SEQ ID NO: 5525420 - DNA, 22 bp, Homo sapiens
tgacagtattatacgctggcaa

SEQ ID NO: 5525421 - DNA, 16 bp, Homo sapiens
tgacagtcaaaagatc

SEQ ID NO: 5525422 - DNA, 18 bp, Homo sapiens
tgacagtcactcagccat

SEQ ID NO: 5525423 - DNA, 13 bp, Homo sapiens
tgacagtcatcat

SEQ ID NO: 5525424 - DNA, 17 bp, Homo sapiens
tgacagtcatcatcagg

SEQ ID NO: 5525425 - DNA, 22 bp, Homo sapiens
tgacagtcatcatcagggcctg

SEQ ID NO: 5525426 - DNA, 16 bp, Homo sapiens
tgacagtcatgcagtc

SEQ ID NO: 5525427 - DNA, 16 bp, Homo sapiens
tgacagtcctctccac

SEQ ID NO: 5525428 - DNA, 17 bp, Homo sapiens
tgacagtcctctccacc

SEQ ID NO: 5525429 - DNA, 15 bp, Homo sapiens
tgacagtcttgtgct

SEQ ID NO: 5525430 - DNA, 19 bp, Homo sapiens
tgacagtgaagcagcactg

SEQ ID NO: 5525431 - DNA, 17 bp, Homo sapiens
tgacagtgcctcttcca

SEQ ID NO: 5525432 - DNA, 18 bp, Homo sapiens
tgacagtgcctcttccag

SEQ ID NO: 5525433 - DNA, 22 bp, Homo sapiens
tgacagtgcctcttccagtgaa

SEQ ID NO: 5525434 - DNA, 17 bp, Homo sapiens
tgacagtgcctgggaat

SEQ ID NO: 5525435 - DNA, 20 bp, Homo sapiens
tgacagtgcctgggaatgta

SEQ ID NO: 5525436 - DNA, 14 bp, Homo sapiens
tgacagtgccttct

SEQ ID NO: 5525437 - DNA, 21 bp, Homo sapiens
tgacagtgctctaggctgccc

SEQ ID NO: 5525438 - DNA, 22 bp, Homo sapiens
tgacagtgctctaggctgcccc

SEQ ID NO: 5525439 - DNA, 21 bp, Homo sapiens
tgacagtggccgcccaaggcc

SEQ ID NO: 5525440 - DNA, 15 bp, Homo sapiens
tgacagtggctgctc

SEQ ID NO: 5525441 - DNA, 23 bp, Homo sapiens
tgacagtggctgctctgggaagg

SEQ ID NO: 5525442 - DNA, 22 bp, Homo sapiens
tgacagtgtgggacaggctctt

SEQ ID NO: 5525443 - DNA, 24 bp, Homo sapiens
tgacagtgtgggaggcctcgtacc

SEQ ID NO: 5525444 - DNA, 19 bp, Homo sapiens
tgacagtgttgaaaatgtt

SEQ ID NO: 5525445 - DNA, 21 bp, Homo sapiens
tgacagttactcttcagtttt

SEQ ID NO: 5525446 - DNA, 15 bp, Homo sapiens
tgacagttacttaca

SEQ ID NO: 5525447 - DNA, 19 bp, Homo sapiens
tgacagttcccagagtggg

SEQ ID NO: 5525448 - DNA, 23 bp, Homo sapiens
tgacagttcttaattaagatcat

SEQ ID NO: 5525449 - DNA, 12 bp, Homo sapiens
tgacagtttaac

SEQ ID NO: 5525450 - DNA, 16 bp, Homo sapiens
tgacagtttccaaatt

SEQ ID NO: 5525451 - DNA, 23 bp, Homo sapiens
tgacagtttttgacatttatatt

SEQ ID NO: 5525452 - DNA, 17 bp, Homo sapiens
tgacataaaaacaactt

SEQ ID NO: 5525453 - DNA, 18 bp, Homo sapiens
tgacataaaaacaacttt

SEQ ID NO: 5525454 - DNA, 20 bp, Homo sapiens
tgacataaaaacaactttat

SEQ ID NO: 5525455 - DNA, 14 bp, Homo sapiens
tgacataaagttga

SEQ ID NO: 5525456 - DNA, 21 bp, Homo sapiens
tgacataacactataaaggtt

SEQ ID NO: 5525457 - DNA, 23 bp, Homo sapiens
tgacataagtatttaattcatgt

SEQ ID NO: 5525458 - DNA, 16 bp, Homo sapiens
tgacataataaagtat

SEQ ID NO: 5525459 - DNA, 22 bp, Homo sapiens
tgacataataaagtattttctt

SEQ ID NO: 5525460 - DNA, 16 bp, Homo sapiens
tgacatacaaaccatg

SEQ ID NO: 5525461 - DNA, 12 bp, Homo sapiens
tgacatacctac

SEQ ID NO: 5525462 - DNA, 18 bp, Homo sapiens
tgacatacctaccagtat

SEQ ID NO: 5525463 - DNA, 20 bp, Homo sapiens
tgacatacctaccagtatta

SEQ ID NO: 5525464 - DNA, 16 bp, Homo sapiens
tgacataccttttatt

SEQ ID NO: 5525465 - DNA, 14 bp, Homo sapiens
tgacatagcctttg

SEQ ID NO: 5525466 - DNA, 15 bp, Homo sapiens
tgacatagcctttgt

SEQ ID NO: 5525467 - DNA, 16 bp, Homo sapiens
tgacatagcctttgtg

SEQ ID NO: 5525468 - DNA, 17 bp, Homo sapiens
tgacatagcctttgtgc

SEQ ID NO: 5525469 - DNA, 21 bp, Homo sapiens
tgacataggtcataaagcatt

SEQ ID NO: 5525470 - DNA, 19 bp, Homo sapiens
tgacatagtggatggacag

SEQ ID NO: 5525471 - DNA, 13 bp, Homo sapiens
tgacatatacata

SEQ ID NO: 5525472 - DNA, 16 bp, Homo sapiens
tgacatatttaatgtt

SEQ ID NO: 5525473 - DNA, 14 bp, Homo sapiens
tgacatatttcata

SEQ ID NO: 5525474 - DNA, 15 bp, Homo sapiens
tgacatatttttgct

SEQ ID NO: 5525475 - DNA, 23 bp, Homo sapiens
tgacatcaagtgtaattagcttt

SEQ ID NO: 5525476 - DNA, 16 bp, Homo sapiens
tgacatcacagcagcc

SEQ ID NO: 5525477 - DNA, 20 bp, Homo sapiens
tgacatcacagggcctcagt

SEQ ID NO: 5525478 - DNA, 21 bp, Homo sapiens
tgacatcacagggcctcagtt

SEQ ID NO: 5525479 - DNA, 17 bp, Homo sapiens
tgacatcaccaagtgtg

SEQ ID NO: 5525480 - DNA, 14 bp, Homo sapiens
tgacatcactggca

SEQ ID NO: 5525481 - DNA, 17 bp, Homo sapiens
tgacatcacttgtacaa

SEQ ID NO: 5525482 - DNA, 20 bp, Homo sapiens
tgacatcagaagtaactccc

SEQ ID NO: 5525483 - DNA, 24 bp, Homo sapiens
tgacatcagaagtaactcccactc

SEQ ID NO: 5525484 - DNA, 21 bp, Homo sapiens
tgacatcagatttcttaatgt

SEQ ID NO: 5525485 - DNA, 16 bp, Homo sapiens
tgacatcagcactgcc

SEQ ID NO: 5525486 - DNA, 18 bp, Homo sapiens
tgacatcagccagctgcc

SEQ ID NO: 5525487 - DNA, 20 bp, Homo sapiens
tgacatcattcatgacaaca

SEQ ID NO: 5525488 - DNA, 21 bp, Homo sapiens
tgacatcattcatgacaacat

SEQ ID NO: 5525489 - DNA, 12 bp, Homo sapiens
tgacatccaaat

SEQ ID NO: 5525490 - DNA, 17 bp, Homo sapiens
tgacatccaagcttcct

SEQ ID NO: 5525491 - DNA, 13 bp, Homo sapiens
tgacatccacatg

SEQ ID NO: 5525492 - DNA, 20 bp, Homo sapiens
tgacatccacatgcacatgt

SEQ ID NO: 5525493 - DNA, 15 bp, Homo sapiens
tgacatccactgttt

SEQ ID NO: 5525494 - DNA, 15 bp, Homo sapiens
tgacatcctagaggt

SEQ ID NO: 5525495 - DNA, 23 bp, Homo sapiens
tgacatcctagaggtagagaaac

SEQ ID NO: 5525496 - DNA, 13 bp, Homo sapiens
tgacatcctgacc

SEQ ID NO: 5525497 - DNA, 17 bp, Homo sapiens
tgacatcctttctttta

SEQ ID NO: 5525498 - DNA, 17 bp, Homo sapiens
tgacatctacctcccga

SEQ ID NO: 5525499 - DNA, 24 bp, Homo sapiens
tgacatctacgaagccacaggcct

SEQ ID NO: 5525500 - DNA, 16 bp, Homo sapiens
tgacatctgtgtttca

SEQ ID NO: 5525501 - DNA, 17 bp, Homo sapiens
tgacatcttatttactt

SEQ ID NO: 5525502 - DNA, 17 bp, Homo sapiens
tgacatcttgaatcctt

SEQ ID NO: 5525503 - DNA, 15 bp, Homo sapiens
tgacatgaccctctg

SEQ ID NO: 5525504 - DNA, 15 bp, Homo sapiens
tgacatgatcgcttt

SEQ ID NO: 5525505 - DNA, 21 bp, Homo sapiens
tgacatgattagcagaagaaa

SEQ ID NO: 5525506 - DNA, 16 bp, Homo sapiens
tgacatgattccttcc

SEQ ID NO: 5525507 - DNA, 19 bp, Homo sapiens
tgacatgattccttcctgt

SEQ ID NO: 5525508 - DNA, 18 bp, Homo sapiens
tgacatgcactcagctct

SEQ ID NO: 5525509 - DNA, 14 bp, Homo sapiens
tgacatgcactgac

SEQ ID NO: 5525510 - DNA, 17 bp, Homo sapiens
tgacatgcatcatctca

SEQ ID NO: 5525511 - DNA, 19 bp, Homo sapiens
tgacatgccaccctctcca

SEQ ID NO: 5525512 - DNA, 20 bp, Homo sapiens
tgacatgcgggctgggcagc

SEQ ID NO: 5525513 - DNA, 22 bp, Homo sapiens
tgacatgcgggctgggcagctg

SEQ ID NO: 5525514 - DNA, 22 bp, Homo sapiens
tgacatgctcacacattacaac

SEQ ID NO: 5525515 - DNA, 16 bp, Homo sapiens
tgacatggaaatgaag

SEQ ID NO: 5525516 - DNA, 17 bp, Homo sapiens
tgacatggaggcactga

SEQ ID NO: 5525517 - DNA, 19 bp, Homo sapiens
tgacatggaggcactgaag

SEQ ID NO: 5525518 - DNA, 13 bp, Homo sapiens
tgacatggctttg

SEQ ID NO: 5525519 - DNA, 16 bp, Homo sapiens
tgacatgggacatttg

SEQ ID NO: 5525520 - DNA, 17 bp, Homo sapiens
tgacatgggacatttgc

SEQ ID NO: 5525521 - DNA, 18 bp, Homo sapiens
tgacatgggacatttgct

SEQ ID NO: 5525522 - DNA, 18 bp, Homo sapiens
tgacatggtgcctgagag

SEQ ID NO: 5525523 - DNA, 12 bp, Homo sapiens
tgacatggtgct

SEQ ID NO: 5525524 - DNA, 22 bp, Homo sapiens
tgacatggttaacgaggaagac

SEQ ID NO: 5525525 - DNA, 13 bp, Homo sapiens
tgacatgtaacag

SEQ ID NO: 5525526 - DNA, 20 bp, Homo sapiens
tgacatgtaagaaaatgtta

SEQ ID NO: 5525527 - DNA, 17 bp, Homo sapiens
tgacatgtccttctgag

SEQ ID NO: 5525528 - DNA, 10 bp, Homo sapiens
tgacatgtga

SEQ ID NO: 5525529 - DNA, 21 bp, Homo sapiens
tgacatgtgaaacctttttta

SEQ ID NO: 5525530 - DNA, 19 bp, Homo sapiens
tgacatgtgacatctacct

SEQ ID NO: 5525531 - DNA, 18 bp, Homo sapiens
tgacatgtggggccaggt

SEQ ID NO: 5525532 - DNA, 19 bp, Homo sapiens
tgacatgtggggccaggtc

SEQ ID NO: 5525533 - DNA, 19 bp, Homo sapiens
tgacatgtgttggcagcct

SEQ ID NO: 5525534 - DNA, 15 bp, Homo sapiens
tgacatgttccttta

SEQ ID NO: 5525535 - DNA, 13 bp, Homo sapiens
tgacattaacagt

SEQ ID NO: 5525536 - DNA, 22 bp, Homo sapiens
tgacattaggcttctaaaggac

SEQ ID NO: 5525537 - DNA, 15 bp, Homo sapiens
tgacattatgtttta

SEQ ID NO: 5525538 - DNA, 17 bp, Homo sapiens
tgacattattaaagttt

SEQ ID NO: 5525539 - DNA, 15 bp, Homo sapiens
tgacattcaaggcat

SEQ ID NO: 5525540 - DNA, 12 bp, Homo sapiens
tgacattcacct

SEQ ID NO: 5525541 - DNA, 18 bp, Homo sapiens
tgacattcacctgcccca

SEQ ID NO: 5525542 - DNA, 15 bp, Homo sapiens
tgacattcactgagt

SEQ ID NO: 5525543 - DNA, 13 bp, Homo sapiens
tgacattcactgg

SEQ ID NO: 5525544 - DNA, 13 bp, Homo sapiens
tgacattccctgc

SEQ ID NO: 5525545 - DNA, 21 bp, Homo sapiens
tgacattcctaaactatcttt

SEQ ID NO: 5525546 - DNA, 17 bp, Homo sapiens
tgacattccttgtcacc

SEQ ID NO: 5525547 - DNA, 21 bp, Homo sapiens
tgacattccttgtcaccagca

SEQ ID NO: 5525548 - DNA, 15 bp, Homo sapiens
tgacattcggggtga

SEQ ID NO: 5525549 - DNA, 12 bp, Homo sapiens
tgacattctcta

SEQ ID NO: 5525550 - DNA, 16 bp, Homo sapiens
tgaccgtgggcggggc

SEQ ID NO: 5525551 - DNA, 20 bp, Homo sapiens
tgaccgtgggcggggccttg

SEQ ID NO: 5525552 - DNA, 14 bp, Homo sapiens
tgaccgtgtacaat

SEQ ID NO: 5525553 - DNA, 15 bp, Homo sapiens
tgaccgtgtacaata

SEQ ID NO: 5525554 - DNA, 21 bp, Homo sapiens
tgaccgtgttggtctgtactg

SEQ ID NO: 5525555 - DNA, 13 bp, Homo sapiens
tgacctaaaagtt

SEQ ID NO: 5525556 - DNA, 19 bp, Homo sapiens
tgacctaaatccattttct

SEQ ID NO: 5525557 - DNA, 13 bp, Homo sapiens
tgacctaagaaca

SEQ ID NO: 5525558 - DNA, 14 bp, Homo sapiens
tgacctaagaacaa

SEQ ID NO: 5525559 - DNA, 21 bp, Homo sapiens
tgacctaagtcaggtaatata

SEQ ID NO: 5525560 - DNA, 18 bp, Homo sapiens
tgacctaatgaggtagct

SEQ ID NO: 5525561 - DNA, 17 bp, Homo sapiens
tgacctaattgttaaat

SEQ ID NO: 5525562 - DNA, 23 bp, Homo sapiens
tgacctacagggaactgggaaga

SEQ ID NO: 5525563 - DNA, 18 bp, Homo sapiens
tgacctaccccagccagg

SEQ ID NO: 5525564 - DNA, 15 bp, Homo sapiens
tgacctaccctggac

SEQ ID NO: 5525565 - DNA, 18 bp, Homo sapiens
tgacctactcgagggact

SEQ ID NO: 5525566 - DNA, 21 bp, Homo sapiens
tgacctagaccagtttgcatg

SEQ ID NO: 5525567 - DNA, 22 bp, Homo sapiens
tgacctagaccagtttgcatga

SEQ ID NO: 5525568 - DNA, 19 bp, Homo sapiens
tgacctaggcaagtttgtt

SEQ ID NO: 5525569 - DNA, 17 bp, Homo sapiens
tgacctagttttccatg

SEQ ID NO: 5525570 - DNA, 17 bp, Homo sapiens
tgacctatacctgtgtt

SEQ ID NO: 5525571 - DNA, 16 bp, Homo sapiens
tgacctatcacttcca

SEQ ID NO: 5525572 - DNA, 16 bp, Homo sapiens
tgacctatgtctgcct

SEQ ID NO: 5525573 - DNA, 13 bp, Homo sapiens
tgacctattcacc

SEQ ID NO: 5525574 - DNA, 18 bp, Homo sapiens
tgacctattcaccctcca

SEQ ID NO: 5525575 - DNA, 20 bp, Homo sapiens
tgacctattcaccctccact

SEQ ID NO: 5525576 - DNA, 21 bp, Homo sapiens
tgacctattcaccctccactt

SEQ ID NO: 5525577 - DNA, 22 bp, Homo sapiens
tgacctattcaccctccacttc

SEQ ID NO: 5525578 - DNA, 19 bp, Homo sapiens
tgacctcaaaagaaaatgt

SEQ ID NO: 5525579 - DNA, 17 bp, Homo sapiens
tgacctcaacctgtgat

SEQ ID NO: 5525580 - DNA, 21 bp, Homo sapiens
tgacctcaagatgtcctcctt

SEQ ID NO: 5525581 - DNA, 14 bp, Homo sapiens
tgacctcaaggaag

SEQ ID NO: 5525582 - DNA, 17 bp, Homo sapiens
tgacctcacacacctct

SEQ ID NO: 5525583 - DNA, 19 bp, Homo sapiens
tgacctcaccggcatgctg

SEQ ID NO: 5525584 - DNA, 22 bp, Homo sapiens
tgacctcaccggcatgctggcc

SEQ ID NO: 5525585 - DNA, 15 bp, Homo sapiens
tgacctcacctggtc

SEQ ID NO: 5525586 - DNA, 17 bp, Homo sapiens
tgacctcacctggtcct

SEQ ID NO: 5525587 - DNA, 19 bp, Homo sapiens
tgacctcacctggtcctcc

SEQ ID NO: 5525588 - DNA, 23 bp, Homo sapiens
tgacctcactggcctgccatgcc

SEQ ID NO: 5525589 - DNA, 15 bp, Homo sapiens
tgacctcactgtcct

SEQ ID NO: 5525590 - DNA, 14 bp, Homo sapiens
tgacctcactgtga

SEQ ID NO: 5525591 - DNA, 16 bp, Homo sapiens
tgacctcacttctggc

SEQ ID NO: 5525592 - DNA, 14 bp, Homo sapiens
tgacctcagcaaat

SEQ ID NO: 5525593 - DNA, 17 bp, Homo sapiens
tgacctcagcaaatcct

SEQ ID NO: 5525594 - DNA, 13 bp, Homo sapiens
tgacctcagctgc

SEQ ID NO: 5525595 - DNA, 21 bp, Homo sapiens
tgacctcagctgcacattcct

SEQ ID NO: 5525596 - DNA, 22 bp, Homo sapiens
tgacctcagctgcacattcctg

SEQ ID NO: 5525597 - DNA, 21 bp, Homo sapiens
tgacctcaggcaatctgcccg

SEQ ID NO: 5525598 - DNA, 18 bp, Homo sapiens
tgacctcaggcactagcc

SEQ ID NO: 5525599 - DNA, 21 bp, Homo sapiens
tgacctcatcattaataagtg

SEQ ID NO: 5525600 - DNA, 22 bp, Homo sapiens
tgacctcatcattaataagtga

SEQ ID NO: 5525601 - DNA, 18 bp, Homo sapiens
tgacctcatgatccaccc

SEQ ID NO: 5525602 - DNA, 14 bp, Homo sapiens
tgacctccacagct

SEQ ID NO: 5525603 - DNA, 15 bp, Homo sapiens
tgacctccacagctt

SEQ ID NO: 5525604 - DNA, 20 bp, Homo sapiens
tgacctccagagctgtcctc

SEQ ID NO: 5525605 - DNA, 23 bp, Homo sapiens
tgacctccagagctgtcctcctg

SEQ ID NO: 5525606 - DNA, 21 bp, Homo sapiens
tgacctccagggaatcagaaa

SEQ ID NO: 5525607 - DNA, 19 bp, Homo sapiens
tgacctccagtcctgctgg

SEQ ID NO: 5525608 - DNA, 22 bp, Homo sapiens
tgacctccatactgggctaagg

SEQ ID NO: 5525609 - DNA, 21 bp, Homo sapiens
tgacctcccacctatccgccc

SEQ ID NO: 5525610 - DNA, 12 bp, Homo sapiens
tgacctcccagc

SEQ ID NO: 5525611 - DNA, 16 bp, Homo sapiens
tgacctcccagcccta

SEQ ID NO: 5525612 - DNA, 16 bp, Homo sapiens
tgacctccccctcctt

SEQ ID NO: 5525613 - DNA, 18 bp, Homo sapiens
tgacctccccctccttcc

SEQ ID NO: 5525614 - DNA, 18 bp, Homo sapiens
tgacctccgcccctgccc

SEQ ID NO: 5525615 - DNA, 19 bp, Homo sapiens
tgacctccgcctcctgggt

SEQ ID NO: 5525616 - DNA, 23 bp, Homo sapiens
tgacctccgtcctctccccagcc

SEQ ID NO: 5525617 - DNA, 17 bp, Homo sapiens
tgacctcctcctgccct

SEQ ID NO: 5525618 - DNA, 14 bp, Homo sapiens
tgacctcctctggg

SEQ ID NO: 5525619 - DNA, 23 bp, Homo sapiens
tgacctcctgcagggagccttct

SEQ ID NO: 5525620 - DNA, 14 bp, Homo sapiens
tgacctcctgtcac

SEQ ID NO: 5525621 - DNA, 23 bp, Homo sapiens
tgacctcctgtcactcactgagg

SEQ ID NO: 5525622 - DNA, 17 bp, Homo sapiens
tgacctcgacgttgcct

SEQ ID NO: 5525623 - DNA, 18 bp, Homo sapiens
tgacctcgtgacccaccc

SEQ ID NO: 5525624 - DNA, 24 bp, Homo sapiens
tgacctcgtgatttgcctgcctgg

SEQ ID NO: 5525625 - DNA, 19 bp, Homo sapiens
tgacctctcacttttttat

SEQ ID NO: 5525626 - DNA, 13 bp, Homo sapiens
tgacctctcaggg

SEQ ID NO: 5525627 - DNA, 16 bp, Homo sapiens
tgacctctcagggcct

SEQ ID NO: 5525628 - DNA, 20 bp, Homo sapiens
tgacctctcagggcctggca

SEQ ID NO: 5525629 - DNA, 21 bp, Homo sapiens
tgacctctcagggcctggcag

SEQ ID NO: 5525630 - DNA, 23 bp, Homo sapiens
tgacctctcagggcctggcaggc

SEQ ID NO: 5525631 - DNA, 22 bp, Homo sapiens
tgacctctccagcatcccagcc

SEQ ID NO: 5525632 - DNA, 15 bp, Homo sapiens
tgacctctccggcct

SEQ ID NO: 5525633 - DNA, 16 bp, Homo sapiens
tgacctctccggcctg

SEQ ID NO: 5525634 - DNA, 19 bp, Homo sapiens
tgacctctccggcctggcc

SEQ ID NO: 5525635 - DNA, 21 bp, Homo sapiens
tgacctctccggcctggcctt

SEQ ID NO: 5525636 - DNA, 21 bp, Homo sapiens
tgacctctctaggtgtgtcca

SEQ ID NO: 5525637 - DNA, 18 bp, Homo sapiens
tgacctctgaagagctga

SEQ ID NO: 5525638 - DNA, 14 bp, Homo sapiens
tgacctctgcaaga

SEQ ID NO: 5525639 - DNA, 13 bp, Homo sapiens
tgacctctgcagc

SEQ ID NO: 5525640 - DNA, 18 bp, Homo sapiens
tgacctctgctgagtgct

SEQ ID NO: 5525641 - DNA, 21 bp, Homo sapiens
tgacctctgctgagtgctggg

SEQ ID NO: 5525642 - DNA, 19 bp, Homo sapiens
tgacctctgttgtcctccc

SEQ ID NO: 5525643 - DNA, 12 bp, Homo sapiens
tgacctcttgcc

SEQ ID NO: 5525644 - DNA, 12 bp, Homo sapiens
tgacctcttgct

SEQ ID NO: 5525645 - DNA, 14 bp, Homo sapiens
tgacctcttgctgt

SEQ ID NO: 5525646 - DNA, 18 bp, Homo sapiens
tgacctgaagttcaccat

SEQ ID NO: 5525647 - DNA, 14 bp, Homo sapiens
tgacctgacacctg

SEQ ID NO: 5525648 - DNA, 17 bp, Homo sapiens
tgacctgacacctgccg

SEQ ID NO: 5525649 - DNA, 19 bp, Homo sapiens
tgacctgagatgtgtgatt

SEQ ID NO: 5525650 - DNA, 17 bp, Homo sapiens
tgacctgaggagacatc

SEQ ID NO: 5525651 - DNA, 14 bp, Homo sapiens
tgacctgaggccct

SEQ ID NO: 5525652 - DNA, 20 bp, Homo sapiens
tgacctgaggccctcactga

SEQ ID NO: 5525653 - DNA, 17 bp, Homo sapiens
tgacctgaggcccttct

SEQ ID NO: 5525654 - DNA, 18 bp, Homo sapiens
tgacctgaggcccttctc

SEQ ID NO: 5525655 - DNA, 20 bp, Homo sapiens
tgacctgaggctcctgtgct

SEQ ID NO: 5525656 - DNA, 17 bp, Homo sapiens
tgacctgcaaaaatgct

SEQ ID NO: 5525657 - DNA, 11 bp, Homo sapiens
tgacctgcagg

SEQ ID NO: 5525658 - DNA, 12 bp, Homo sapiens
tgacctgcattg

SEQ ID NO: 5525659 - DNA, 16 bp, Homo sapiens
tgacctgcattgtaaa

SEQ ID NO: 5525660 - DNA, 17 bp, Homo sapiens
tgacctgcattgtaaat

SEQ ID NO: 5525661 - DNA, 13 bp, Homo sapiens
tgacctgccagcc

SEQ ID NO: 5525662 - DNA, 11 bp, Homo sapiens
tgacctgccca

SEQ ID NO: 5525663 - DNA, 13 bp, Homo sapiens
tgacctgccccgc

SEQ ID NO: 5525664 - DNA, 20 bp, Homo sapiens
tgacctgccccgcccagctg

SEQ ID NO: 5525665 - DNA, 23 bp, Homo sapiens
tgacctgcccctgccgcctgtgc

SEQ ID NO: 5525666 - DNA, 21 bp, Homo sapiens
tgacctgccctggccccagcc

SEQ ID NO: 5525667 - DNA, 17 bp, Homo sapiens
tgacctgcctcccttca

SEQ ID NO: 5525668 - DNA, 19 bp, Homo sapiens
tgacctgcctcccttcatg

SEQ ID NO: 5525669 - DNA, 21 bp, Homo sapiens
tgacctgcctcccttcatgca

SEQ ID NO: 5525670 - DNA, 15 bp, Homo sapiens
tgacctgcctctcac

SEQ ID NO: 5525671 - DNA, 23 bp, Homo sapiens
tgacctgcgggtcctcagctgct

SEQ ID NO: 5525672 - DNA, 22 bp, Homo sapiens
tgacctgctaggccagagccca

SEQ ID NO: 5525673 - DNA, 17 bp, Homo sapiens
tgacctgctccgctgct

SEQ ID NO: 5525674 - DNA, 18 bp, Homo sapiens
tgacctgctccgctgctc

SEQ ID NO: 5525675 - DNA, 16 bp, Homo sapiens
tgacctgctgagctct

SEQ ID NO: 5525676 - DNA, 19 bp, Homo sapiens
tgacctgctgagctctgag

SEQ ID NO: 5525677 - DNA, 20 bp, Homo sapiens
tgacctgctgagctctgaga

SEQ ID NO: 5525678 - DNA, 21 bp, Homo sapiens
tgacctgctgagctctgagag

SEQ ID NO: 5525679 - DNA, 22 bp, Homo sapiens
tgacctggatggggcaggccac

SEQ ID NO: 5525680 - DNA, 13 bp, Homo sapiens
tgacctgggccca

SEQ ID NO: 5525681 - DNA, 20 bp, Homo sapiens
tgacctgggcccacagagcc

SEQ ID NO: 5525682 - DNA, 17 bp, Homo sapiens
tgacctgggtatcccct

SEQ ID NO: 5525683 - DNA, 18 bp, Homo sapiens
tgacctgggtatcccctg

SEQ ID NO: 5525684 - DNA, 15 bp, Homo sapiens
tgacctggtccacag

SEQ ID NO: 5525685 - DNA, 20 bp, Homo sapiens
tgacctggtccacagggcac

SEQ ID NO: 5525686 - DNA, 22 bp, Homo sapiens
tgacctggtctggtcaggcaat

SEQ ID NO: 5525687 - DNA, 23 bp, Homo sapiens
tgacctggtctggtcaggcaatg

SEQ ID NO: 5525688 - DNA, 12 bp, Homo sapiens
tgacctggtggg

SEQ ID NO: 5525689 - DNA, 21 bp, Homo sapiens
tgacctggtgggagcacctgc

SEQ ID NO: 5525690 - DNA, 17 bp, Homo sapiens
tgacctggttgtccagg

SEQ ID NO: 5525691 - DNA, 18 bp, Homo sapiens
tgacctggttgtccaggt

SEQ ID NO: 5525692 - DNA, 19 bp, Homo sapiens
tgacctggttgtccaggtc

SEQ ID NO: 5525693 - DNA, 16 bp, Homo sapiens
tgacctgtcatgcccc

SEQ ID NO: 5525694 - DNA, 19 bp, Homo sapiens
tgacctgtcatgcccccct

SEQ ID NO: 5525695 - DNA, 20 bp, Homo sapiens
tgacctgtcatgcccccctc

SEQ ID NO: 5525696 - DNA, 13 bp, Homo sapiens
tgacctgtccagg

SEQ ID NO: 5525697 - DNA, 18 bp, Homo sapiens
tgacctgtgaccagcact

SEQ ID NO: 5525698 - DNA, 19 bp, Homo sapiens
tgacctgtggggatttctc

SEQ ID NO: 5525699 - DNA, 14 bp, Homo sapiens
tgacctgtgtcact

SEQ ID NO: 5525700 - DNA, 22 bp, Homo sapiens
tgacctgtgtttcacttaatgt

SEQ ID NO: 5525701 - DNA, 19 bp, Homo sapiens
tgacctgttagatgtgaca

SEQ ID NO: 5525702 - DNA, 15 bp, Homo sapiens
tgaccttaaggaaaa

SEQ ID NO: 5525703 - DNA, 23 bp, Homo sapiens
tgaccttaaggaaaagtaaggga

SEQ ID NO: 5525704 - DNA, 15 bp, Homo sapiens
tgaccttaatttctt

SEQ ID NO: 5525705 - DNA, 16 bp, Homo sapiens
tgaccttacagccatt

SEQ ID NO: 5525706 - DNA, 16 bp, Homo sapiens
tgaccttacatagctt

SEQ ID NO: 5525707 - DNA, 13 bp, Homo sapiens
tgaccttacattt

SEQ ID NO: 5525708 - DNA, 15 bp, Homo sapiens
tgaccttagcgttct

SEQ ID NO: 5525709 - DNA, 21 bp, Homo sapiens
tgaccttagcgttctggactc

SEQ ID NO: 5525710 - DNA, 17 bp, Homo sapiens
tgaccttcacagggaca

SEQ ID NO: 5525711 - DNA, 20 bp, Homo sapiens
tgaccttcctcgcagagagg

SEQ ID NO: 5525712 - DNA, 15 bp, Homo sapiens
tgaccttcctctggg

SEQ ID NO: 5525713 - DNA, 23 bp, Homo sapiens
tgaccttcctctggggctctagg

SEQ ID NO: 5525714 - DNA, 16 bp, Homo sapiens
tgaccttcggcagtgg

SEQ ID NO: 5525715 - DNA, 23 bp, Homo sapiens
tgaccttcggcagtggctggggg

SEQ ID NO: 5525716 - DNA, 17 bp, Homo sapiens
tgaccttctaggaagct

SEQ ID NO: 5525717 - DNA, 15 bp, Homo sapiens
tgaccttctccaggg

SEQ ID NO: 5525718 - DNA, 19 bp, Homo sapiens
tgaccttctccagggacag

SEQ ID NO: 5525719 - DNA, 13 bp, Homo sapiens
tgaccttctggga

SEQ ID NO: 5525720 - DNA, 19 bp, Homo sapiens
tgaccttctgtcgtcccca

SEQ ID NO: 5525721 - DNA, 19 bp, Homo sapiens
tgaccttgaactcctgggc

SEQ ID NO: 5525722 - DNA, 19 bp, Homo sapiens
tgaccttgacttgccatga

SEQ ID NO: 5525723 - DNA, 22 bp, Homo sapiens
tgaccttgaggagtcttgtgtg

SEQ ID NO: 5525724 - DNA, 22 bp, Homo sapiens
tgaccttgagttaacaggacag

SEQ ID NO: 5525725 - DNA, 14 bp, Homo sapiens
tgaccttgctgcca

SEQ ID NO: 5525726 - DNA, 19 bp, Homo sapiens
tgactggccccagggactc

SEQ ID NO: 5525727 - DNA, 15 bp, Homo sapiens
tgactggctaaagct

SEQ ID NO: 5525728 - DNA, 13 bp, Homo sapiens
tgactggctcctg

SEQ ID NO: 5525729 - DNA, 18 bp, Homo sapiens
tgactggctgtctgcctg

SEQ ID NO: 5525730 - DNA, 19 bp, Homo sapiens
tgactggctgtctgcctgt

SEQ ID NO: 5525731 - DNA, 22 bp, Homo sapiens
tgactggctgtctgcctgtatt

SEQ ID NO: 5525732 - DNA, 18 bp, Homo sapiens
tgactggcttgctcccgc

SEQ ID NO: 5525733 - DNA, 14 bp, Homo sapiens
tgactggctttcct

SEQ ID NO: 5525734 - DNA, 16 bp, Homo sapiens
tgactgggaccaggca

SEQ ID NO: 5525735 - DNA, 18 bp, Homo sapiens
tgactgggactcccagct

SEQ ID NO: 5525736 - DNA, 21 bp, Homo sapiens
tgactgggcaacactgcagga

SEQ ID NO: 5525737 - DNA, 13 bp, Homo sapiens
tgactgggccaca

SEQ ID NO: 5525738 - DNA, 17 bp, Homo sapiens
tgactgggccctgtcca

SEQ ID NO: 5525739 - DNA, 17 bp, Homo sapiens
tgactgggcctcccttg

SEQ ID NO: 5525740 - DNA, 20 bp, Homo sapiens
tgactgggcgtggtggctca

SEQ ID NO: 5525741 - DNA, 14 bp, Homo sapiens
tgactggggctggg

SEQ ID NO: 5525742 - DNA, 15 bp, Homo sapiens
tgactggggctgggg

SEQ ID NO: 5525743 - DNA, 21 bp, Homo sapiens
tgactgggtttctctgtatag

SEQ ID NO: 5525744 - DNA, 15 bp, Homo sapiens
tgactggtgctgcag

SEQ ID NO: 5525745 - DNA, 23 bp, Homo sapiens
tgactggtgttatcaccgtgggc

SEQ ID NO: 5525746 - DNA, 18 bp, Homo sapiens
tgactggttgtcagaatg

SEQ ID NO: 5525747 - DNA, 20 bp, Homo sapiens
tgactggttgtcagaatgga

SEQ ID NO: 5525748 - DNA, 23 bp, Homo sapiens
tgactggtttacaggccctgctc

SEQ ID NO: 5525749 - DNA, 19 bp, Homo sapiens
tgactgtaccacagacaca

SEQ ID NO: 5525750 - DNA, 17 bp, Homo sapiens
tgactgtactcctccca

SEQ ID NO: 5525751 - DNA, 20 bp, Homo sapiens
tgactgtacttgatttttca

SEQ ID NO: 5525752 - DNA, 19 bp, Homo sapiens
tgactgtagccacagctgc

SEQ ID NO: 5525753 - DNA, 21 bp, Homo sapiens
tgactgtaggcgcccctgggg

SEQ ID NO: 5525754 - DNA, 16 bp, Homo sapiens
tgactgtatctgtgta

SEQ ID NO: 5525755 - DNA, 13 bp, Homo sapiens
tgactgtcactgt

SEQ ID NO: 5525756 - DNA, 17 bp, Homo sapiens
tgactgtcactgttcct

SEQ ID NO: 5525757 - DNA, 20 bp, Homo sapiens
tgactgtcacttgctgcttt

SEQ ID NO: 5525758 - DNA, 22 bp, Homo sapiens
tgactgtcacttgctgcttttt

SEQ ID NO: 5525759 - DNA, 16 bp, Homo sapiens
tgactgtcagggaggg

SEQ ID NO: 5525760 - DNA, 20 bp, Homo sapiens
tgactgtcagggagggccag

SEQ ID NO: 5525761 - DNA, 16 bp, Homo sapiens
tgactgtccaggagct

SEQ ID NO: 5525762 - DNA, 16 bp, Homo sapiens
tgactgtcccaccggg

SEQ ID NO: 5525763 - DNA, 19 bp, Homo sapiens
tgactgtcgccacacgcct

SEQ ID NO: 5525764 - DNA, 23 bp, Homo sapiens
tgactgtcgccacacgcctctgt

SEQ ID NO: 5525765 - DNA, 15 bp, Homo sapiens
tgactgtcgtgttta

SEQ ID NO: 5525766 - DNA, 12 bp, Homo sapiens
tgactgtctggg

SEQ ID NO: 5525767 - DNA, 18 bp, Homo sapiens
tgactgtcttccctctct

SEQ ID NO: 5525768 - DNA, 17 bp, Homo sapiens
tgactgtgaccaccttc

SEQ ID NO: 5525769 - DNA, 18 bp, Homo sapiens
tgactgtgaccaccttct

SEQ ID NO: 5525770 - DNA, 19 bp, Homo sapiens
tgactgtgagcgagcctgg

SEQ ID NO: 5525771 - DNA, 16 bp, Homo sapiens
tgactgtgctggagaa

SEQ ID NO: 5525772 - DNA, 17 bp, Homo sapiens
tgactgtggagttccat

SEQ ID NO: 5525773 - DNA, 17 bp, Homo sapiens
tgactgtggccatggtc

SEQ ID NO: 5525774 - DNA, 18 bp, Homo sapiens
tgactgtggggtttttaa

SEQ ID NO: 5525775 - DNA, 21 bp, Homo sapiens
tgactgtggtagccagcatcg

SEQ ID NO: 5525776 - DNA, 21 bp, Homo sapiens
tgactgtgtaactttctctta

SEQ ID NO: 5525777 - DNA, 18 bp, Homo sapiens
tgactgtgttcagtgcct

SEQ ID NO: 5525778 - DNA, 22 bp, Homo sapiens
tgactgtgtttgcattgtctaa

SEQ ID NO: 5525779 - DNA, 24 bp, Homo sapiens
tgactgttcaagagcacacttggc

SEQ ID NO: 5525780 - DNA, 13 bp, Homo sapiens
tgactgttctctt

SEQ ID NO: 5525781 - DNA, 15 bp, Homo sapiens
tgactgttcttggta

SEQ ID NO: 5525782 - DNA, 22 bp, Homo sapiens
tgactgttgatgaagtatactt

SEQ ID NO: 5525783 - DNA, 23 bp, Homo sapiens
tgactgttgcctttgctcttata

SEQ ID NO: 5525784 - DNA, 18 bp, Homo sapiens
tgactgttggctctctga

SEQ ID NO: 5525785 - DNA, 19 bp, Homo sapiens
tgactgttgtagcattttc

SEQ ID NO: 5525786 - DNA, 18 bp, Homo sapiens
tgactgttgttcttataa

SEQ ID NO: 5525787 - DNA, 12 bp, Homo sapiens
tgactgtttatt

SEQ ID NO: 5525788 - DNA, 19 bp, Homo sapiens
tgactgtttatttaaggat

SEQ ID NO: 5525789 - DNA, 16 bp, Homo sapiens
tgactgtttcattcac

SEQ ID NO: 5525790 - DNA, 13 bp, Homo sapiens
tgactgtttcttt

SEQ ID NO: 5525791 - DNA, 17 bp, Homo sapiens
tgactgtttcttttgta

SEQ ID NO: 5525792 - DNA, 20 bp, Homo sapiens
tgactgtttcttttgtaaag

SEQ ID NO: 5525793 - DNA, 21 bp, Homo sapiens
tgactgtttcttttgtaaaga

SEQ ID NO: 5525794 - DNA, 17 bp, Homo sapiens
tgactgtttttacccat

SEQ ID NO: 5525795 - DNA, 19 bp, Homo sapiens
tgactgtttttcggacagt

SEQ ID NO: 5525796 - DNA, 17 bp, Homo sapiens
tgactgtttttgtagtg

SEQ ID NO: 5525797 - DNA, 20 bp, Homo sapiens
tgacttaacatagccaaaat

SEQ ID NO: 5525798 - DNA, 17 bp, Homo sapiens
tgacttaaggagaaata

SEQ ID NO: 5525799 - DNA, 16 bp, Homo sapiens
tgacttaatgtgatta

SEQ ID NO: 5525800 - DNA, 14 bp, Homo sapiens
tgacttaattttag

SEQ ID NO: 5525801 - DNA, 19 bp, Homo sapiens
tgacttaattttagaaaga

SEQ ID NO: 5525802 - DNA, 20 bp, Homo sapiens
tgacttaattttagaaagaa

SEQ ID NO: 5525803 - DNA, 23 bp, Homo sapiens
tgacttacaggctaaaattagtt

SEQ ID NO: 5525804 - DNA, 13 bp, Homo sapiens
tgacttagaatcc

SEQ ID NO: 5525805 - DNA, 19 bp, Homo sapiens
tgacttagaatccctgtgt

SEQ ID NO: 5525806 - DNA, 21 bp, Homo sapiens
tgacttagaatccctgtgtta

SEQ ID NO: 5525807 - DNA, 20 bp, Homo sapiens
tgacttagacctatactgaa

SEQ ID NO: 5525808 - DNA, 21 bp, Homo sapiens
tgacttagaggcaacaggatt

SEQ ID NO: 5525809 - DNA, 16 bp, Homo sapiens
tgacttagatattaaa

SEQ ID NO: 5525810 - DNA, 13 bp, Homo sapiens
tgacttagcctaa

SEQ ID NO: 5525811 - DNA, 19 bp, Homo sapiens
tgacttagcctcctcccaa

SEQ ID NO: 5525812 - DNA, 15 bp, Homo sapiens
tgacttaggaggctg

SEQ ID NO: 5525813 - DNA, 23 bp, Homo sapiens
tgacttaggtaaaataaaagact

SEQ ID NO: 5525814 - DNA, 20 bp, Homo sapiens
tgacttaggtttcaggaagt

SEQ ID NO: 5525815 - DNA, 16 bp, Homo sapiens
tgacttagtacaaagt

SEQ ID NO: 5525816 - DNA, 13 bp, Homo sapiens
tgacttatagtac

SEQ ID NO: 5525817 - DNA, 15 bp, Homo sapiens
tgacttatagtacat

SEQ ID NO: 5525818 - DNA, 14 bp, Homo sapiens
tgacttatggcatg

SEQ ID NO: 5525819 - DNA, 14 bp, Homo sapiens
tgacttatttctgc

SEQ ID NO: 5525820 - DNA, 14 bp, Homo sapiens
tgacttatttgtag

SEQ ID NO: 5525821 - DNA, 17 bp, Homo sapiens
tgacttattttgtctta

SEQ ID NO: 5525822 - DNA, 23 bp, Homo sapiens
tgacttattttgtcttattctta

SEQ ID NO: 5525823 - DNA, 15 bp, Homo sapiens
tgacttcaaatgtgt

SEQ ID NO: 5525824 - DNA, 16 bp, Homo sapiens
tgacttcaaatgtgta

SEQ ID NO: 5525825 - DNA, 17 bp, Homo sapiens
tgacttcaatgatagta

SEQ ID NO: 5525826 - DNA, 15 bp, Homo sapiens
tgacttcactgtata

SEQ ID NO: 5525827 - DNA, 23 bp, Homo sapiens
tgacttcactgtatataaacata

SEQ ID NO: 5525828 - DNA, 21 bp, Homo sapiens
tgacttcagaaactttttcta

SEQ ID NO: 5525829 - DNA, 20 bp, Homo sapiens
tgacttcagactctctcctc

SEQ ID NO: 5525830 - DNA, 15 bp, Homo sapiens
tgacttcagcagggg

SEQ ID NO: 5525831 - DNA, 22 bp, Homo sapiens
tgacttcagctgcctgaaacag

SEQ ID NO: 5525832 - DNA, 22 bp, Homo sapiens
tgacttcagggaaggtgaaaca

SEQ ID NO: 5525833 - DNA, 18 bp, Homo sapiens
tgacttcaggggctgccc

SEQ ID NO: 5525834 - DNA, 22 bp, Homo sapiens
tgacttcaggggctgcccgctc

SEQ ID NO: 5525835 - DNA, 20 bp, Homo sapiens
tgacttcaggtggagagcac

SEQ ID NO: 5525836 - DNA, 21 bp, Homo sapiens
tgacttcagtgaaattttcag

SEQ ID NO: 5525837 - DNA, 16 bp, Homo sapiens
tgacttcatctggggt

SEQ ID NO: 5525838 - DNA, 21 bp, Homo sapiens
tgacttcatgctatatatctt

SEQ ID NO: 5525839 - DNA, 19 bp, Homo sapiens
tgacttcatggaatggaca

SEQ ID NO: 5525840 - DNA, 19 bp, Homo sapiens
tgacttcatttgtgccaca

SEQ ID NO: 5525841 - DNA, 16 bp, Homo sapiens
tgacttcattttatat

SEQ ID NO: 5525842 - DNA, 20 bp, Homo sapiens
tgacttcattttatatttaa

SEQ ID NO: 5525843 - DNA, 16 bp, Homo sapiens
tgacttcccctgcctc

SEQ ID NO: 5525844 - DNA, 18 bp, Homo sapiens
tgacttcccctgcctcct

SEQ ID NO: 5525845 - DNA, 15 bp, Homo sapiens
tgacttccctccacc

SEQ ID NO: 5525846 - DNA, 18 bp, Homo sapiens
tgacttcctagggatctg

SEQ ID NO: 5525847 - DNA, 19 bp, Homo sapiens
tgacttcctagggatctga

SEQ ID NO: 5525848 - DNA, 19 bp, Homo sapiens
tgacttcctcgcctctccc

SEQ ID NO: 5525849 - DNA, 15 bp, Homo sapiens
tgacttcctgaactc

SEQ ID NO: 5525850 - DNA, 17 bp, Homo sapiens
tgacttcctggtgaggc

SEQ ID NO: 5525851 - DNA, 20 bp, Homo sapiens
tgacttctaatatcattcac

SEQ ID NO: 5525852 - DNA, 16 bp, Homo sapiens
tgacttctagcagaga

SEQ ID NO: 5525853 - DNA, 15 bp, Homo sapiens
tgacttctatcctgt

SEQ ID NO: 5525854 - DNA, 16 bp, Homo sapiens
tgacttctattttcct

SEQ ID NO: 5525855 - DNA, 17 bp, Homo sapiens
tgacttctcacttccta

SEQ ID NO: 5525856 - DNA, 16 bp, Homo sapiens
tgacttctcaggaaga

SEQ ID NO: 5525857 - DNA, 15 bp, Homo sapiens
tgacttctccaggac

SEQ ID NO: 5525858 - DNA, 20 bp, Homo sapiens
tgacttctccaggcagaggc

SEQ ID NO: 5525859 - DNA, 15 bp, Homo sapiens
tgacttctccaggtc

SEQ ID NO: 5525860 - DNA, 16 bp, Homo sapiens
tgacttctccaggtct

SEQ ID NO: 5525861 - DNA, 23 bp, Homo sapiens
tgacttctccaggtctcacgggc

SEQ ID NO: 5525862 - DNA, 14 bp, Homo sapiens
tgacttctcccccg

SEQ ID NO: 5525863 - DNA, 19 bp, Homo sapiens
tgacttctcccccgccctg

SEQ ID NO: 5525864 - DNA, 21 bp, Homo sapiens
tgacttctcccccgccctgcc

SEQ ID NO: 5525865 - DNA, 14 bp, Homo sapiens
tgacttctcccctg

SEQ ID NO: 5525866 - DNA, 11 bp, Homo sapiens
tgacttctctc

SEQ ID NO: 5525867 - DNA, 18 bp, Homo sapiens
tgacttctctgaatcaga

SEQ ID NO: 5525868 - DNA, 14 bp, Homo sapiens
tgacttctgacaaa

SEQ ID NO: 5525869 - DNA, 23 bp, Homo sapiens
tgacttctgacaaaggtggtaaa

SEQ ID NO: 5525870 - DNA, 12 bp, Homo sapiens
tgacttctgcta

SEQ ID NO: 5525871 - DNA, 15 bp, Homo sapiens
tgacttctgctgctg

SEQ ID NO: 5525872 - DNA, 18 bp, Homo sapiens
tgacttctgctgctggcc

SEQ ID NO: 5525873 - DNA, 13 bp, Homo sapiens
tgacttcttcttc

SEQ ID NO: 5525874 - DNA, 16 bp, Homo sapiens
tgacttcttgttcatg

SEQ ID NO: 5525875 - DNA, 22 bp, Homo sapiens
tgacttctttactaacactggc

SEQ ID NO: 5525876 - DNA, 22 bp, Homo sapiens
tgacttgaagacttacagcaaa

SEQ ID NO: 5525877 - DNA, 15 bp, Homo sapiens
tgacttgaatgtaca

SEQ ID NO: 5525878 - DNA, 19 bp, Homo sapiens
tgacttgaatgtacaaaga

SEQ ID NO: 5525879 - DNA, 18 bp, Homo sapiens
tgacttgagccactcctt

SEQ ID NO: 5525880 - DNA, 21 bp, Homo sapiens
tgacttgcaaagacctacctc

SEQ ID NO: 5525881 - DNA, 22 bp, Homo sapiens
tgacttgcaaagacctacctcc

SEQ ID NO: 5525882 - DNA, 16 bp, Homo sapiens
tgacttgcacatctct

SEQ ID NO: 5525883 - DNA, 17 bp, Homo sapiens
tgacttgcagatgaaaa

SEQ ID NO: 5525884 - DNA, 14 bp, Homo sapiens
tgacttgccactgc

SEQ ID NO: 5525885 - DNA, 16 bp, Homo sapiens
tgacttgccactgcca

SEQ ID NO: 5525886 - DNA, 11 bp, Homo sapiens
tgacttgcctg

SEQ ID NO: 5525887 - DNA, 15 bp, Homo sapiens
tgacttgcctggggc

SEQ ID NO: 5525888 - DNA, 18 bp, Homo sapiens
tgacttgcgcttaatcca

SEQ ID NO: 5525889 - DNA, 13 bp, Homo sapiens
tgacttgctcaag

SEQ ID NO: 5525890 - DNA, 20 bp, Homo sapiens
tgacttgctgtccaggcagc

SEQ ID NO: 5525891 - DNA, 15 bp, Homo sapiens
tgacttgctgtgtga

SEQ ID NO: 5525892 - DNA, 15 bp, Homo sapiens
tgacttggcacttaa

SEQ ID NO: 5525893 - DNA, 15 bp, Homo sapiens
tgacttggctggtgt

SEQ ID NO: 5525894 - DNA, 21 bp, Homo sapiens
tgacttgggcacccccagcct

SEQ ID NO: 5525895 - DNA, 19 bp, Homo sapiens
tgacttggggagatggagt

SEQ ID NO: 5525896 - DNA, 22 bp, Homo sapiens
tgacttgtataacatcactgtc

SEQ ID NO: 5525897 - DNA, 12 bp, Homo sapiens
tgacttgtatat

SEQ ID NO: 5525898 - DNA, 16 bp, Homo sapiens
tgacttgtctgcctcc

SEQ ID NO: 5525899 - DNA, 19 bp, Homo sapiens
tgacttgtctgcctcctgc

SEQ ID NO: 5525900 - DNA, 23 bp, Homo sapiens
tgacttgtctgcctcctgctttg

SEQ ID NO: 5525901 - DNA, 18 bp, Homo sapiens
tgacttgttctgagtaag

SEQ ID NO: 5525902 - DNA, 18 bp, Homo sapiens
tgacttgtttgtcttcca

SEQ ID NO: 5525903 - DNA, 20 bp, Homo sapiens
tgagacggagtcttgctctg

SEQ ID NO: 5525904 - DNA, 17 bp, Homo sapiens
tgagacggatggaagga

SEQ ID NO: 5525905 - DNA, 23 bp, Homo sapiens
tgagacggatggaaggagagagg

SEQ ID NO: 5525906 - DNA, 21 bp, Homo sapiens
tgagacggtgctcgcttctcc

SEQ ID NO: 5525907 - DNA, 14 bp, Homo sapiens
tgagacggtgtctc

SEQ ID NO: 5525908 - DNA, 23 bp, Homo sapiens
tgagacgtttttggaagagtagt

SEQ ID NO: 5525909 - DNA, 15 bp, Homo sapiens
tgagactaagagaaa

SEQ ID NO: 5525910 - DNA, 22 bp, Homo sapiens
tgagactaatcttattcatttt

SEQ ID NO: 5525911 - DNA, 19 bp, Homo sapiens
tgagactagattctcacct

SEQ ID NO: 5525912 - DNA, 17 bp, Homo sapiens
tgagactagcctggcca

SEQ ID NO: 5525913 - DNA, 21 bp, Homo sapiens
tgagactatgcaaaagtacaa

SEQ ID NO: 5525914 - DNA, 21 bp, Homo sapiens
tgagactcaaaggtgatgtaa

SEQ ID NO: 5525915 - DNA, 17 bp, Homo sapiens
tgagactcacaggaagg

SEQ ID NO: 5525916 - DNA, 13 bp, Homo sapiens
tgagactcaggtt

SEQ ID NO: 5525917 - DNA, 16 bp, Homo sapiens
tgagactccactcagg

SEQ ID NO: 5525918 - DNA, 13 bp, Homo sapiens
tgagactccagaa

SEQ ID NO: 5525919 - DNA, 13 bp, Homo sapiens
tgagactccatct

SEQ ID NO: 5525920 - DNA, 15 bp, Homo sapiens
tgagactcccgcctt

SEQ ID NO: 5525921 - DNA, 13 bp, Homo sapiens
tgagactcctgat

SEQ ID NO: 5525922 - DNA, 23 bp, Homo sapiens
tgagactcctgattgctctggaa

SEQ ID NO: 5525923 - DNA, 12 bp, Homo sapiens
tgagactcgaga

SEQ ID NO: 5525924 - DNA, 17 bp, Homo sapiens
tgagactcgagaacttt

SEQ ID NO: 5525925 - DNA, 22 bp, Homo sapiens
tgagactctagggtccagtgga

SEQ ID NO: 5525926 - DNA, 12 bp, Homo sapiens
tgagactctgtc

SEQ ID NO: 5525927 - DNA, 13 bp, Homo sapiens
tgagactctgtct

SEQ ID NO: 5525928 - DNA, 14 bp, Homo sapiens
tgagactctgtctc

SEQ ID NO: 5525929 - DNA, 20 bp, Homo sapiens
tgagactctgtctcagtcca

SEQ ID NO: 5525930 - DNA, 13 bp, Homo sapiens
tgagactcttaaa

SEQ ID NO: 5525931 - DNA, 16 bp, Homo sapiens
tgagactgacacctca

SEQ ID NO: 5525932 - DNA, 16 bp, Homo sapiens
tgagactgatccctgg

SEQ ID NO: 5525933 - DNA, 22 bp, Homo sapiens
tgagactgatccctggccactg

SEQ ID NO: 5525934 - DNA, 16 bp, Homo sapiens
tgagactgcagaggag

SEQ ID NO: 5525935 - DNA, 17 bp, Homo sapiens
tgagactgcagaggagc

SEQ ID NO: 5525936 - DNA, 22 bp, Homo sapiens
tgagactgccccacggagacag

SEQ ID NO: 5525937 - DNA, 13 bp, Homo sapiens
tgagactgccctg

SEQ ID NO: 5525938 - DNA, 15 bp, Homo sapiens
tgagactgccctgcc

SEQ ID NO: 5525939 - DNA, 19 bp, Homo sapiens
tgagactgccctgcccagg

SEQ ID NO: 5525940 - DNA, 22 bp, Homo sapiens
tgagactgcgggatggtcctgg

SEQ ID NO: 5525941 - DNA, 21 bp, Homo sapiens
tgagactggatactgcccggg

SEQ ID NO: 5525942 - DNA, 15 bp, Homo sapiens
tgagactgtaaaaca

SEQ ID NO: 5525943 - DNA, 16 bp, Homo sapiens
tgagactgtaaaacaa

SEQ ID NO: 5525944 - DNA, 14 bp, Homo sapiens
tgagactgtacata

SEQ ID NO: 5525945 - DNA, 23 bp, Homo sapiens
tgagactgtacataattgcatga

SEQ ID NO: 5525946 - DNA, 22 bp, Homo sapiens
tgagactgtcctgtgcctgatt

SEQ ID NO: 5525947 - DNA, 21 bp, Homo sapiens
tgagactgtgctgttgttctc

SEQ ID NO: 5525948 - DNA, 12 bp, Homo sapiens
tgagacttccaa

SEQ ID NO: 5525949 - DNA, 19 bp, Homo sapiens
tgagacttcctattaattt

SEQ ID NO: 5525950 - DNA, 17 bp, Homo sapiens
tgagacttgccttccta

SEQ ID NO: 5525951 - DNA, 17 bp, Homo sapiens
tgagactttctaaatca

SEQ ID NO: 5525952 - DNA, 15 bp, Homo sapiens
tgagactttctgctg

SEQ ID NO: 5525953 - DNA, 18 bp, Homo sapiens
tgagactttcttctagtg

SEQ ID NO: 5525954 - DNA, 17 bp, Homo sapiens
tgagagaaaaagtgccc

SEQ ID NO: 5525955 - DNA, 16 bp, Homo sapiens
tgagagaaaagaaaaa

SEQ ID NO: 5525956 - DNA, 22 bp, Homo sapiens
tgagagaaagagaaatcagaaa

SEQ ID NO: 5525957 - DNA, 22 bp, Homo sapiens
tgagagaaagagagaagccagc

SEQ ID NO: 5525958 - DNA, 16 bp, Homo sapiens
tgagagaagagagtat

SEQ ID NO: 5525959 - DNA, 22 bp, Homo sapiens
tgagagaagccacgctgtcctc

SEQ ID NO: 5525960 - DNA, 23 bp, Homo sapiens
tgagagaaggtagggtgtgtata

SEQ ID NO: 5525961 - DNA, 15 bp, Homo sapiens
tgagagaaggtgaaa

SEQ ID NO: 5525962 - DNA, 18 bp, Homo sapiens
tgagagaataagtcatgt

SEQ ID NO: 5525963 - DNA, 21 bp, Homo sapiens
tgagagaatcacacaagtttg

SEQ ID NO: 5525964 - DNA, 16 bp, Homo sapiens
tgagagaatgtggaaa

SEQ ID NO: 5525965 - DNA, 14 bp, Homo sapiens
tgagagaattggct

SEQ ID NO: 5525966 - DNA, 16 bp, Homo sapiens
tgagagacacactgaa

SEQ ID NO: 5525967 - DNA, 19 bp, Homo sapiens
tgagagacattaactcatt

SEQ ID NO: 5525968 - DNA, 14 bp, Homo sapiens
tgagagaccaggca

SEQ ID NO: 5525969 - DNA, 15 bp, Homo sapiens
tgagagacccagctg

SEQ ID NO: 5525970 - DNA, 17 bp, Homo sapiens
tgagagaccctggcctc

SEQ ID NO: 5525971 - DNA, 18 bp, Homo sapiens
tgagagaccctggcctca

SEQ ID NO: 5525972 - DNA, 17 bp, Homo sapiens
tgagagacctctgccta

SEQ ID NO: 5525973 - DNA, 15 bp, Homo sapiens
tgagagacctgccct

SEQ ID NO: 5525974 - DNA, 17 bp, Homo sapiens
tgagagacctgtgtgaa

SEQ ID NO: 5525975 - DNA, 18 bp, Homo sapiens
tgagagacgccctatttc

SEQ ID NO: 5525976 - DNA, 18 bp, Homo sapiens
tgagagacggtgtcttgt

SEQ ID NO: 5525977 - DNA, 14 bp, Homo sapiens
tgagagagaaaaga

SEQ ID NO: 5525978 - DNA, 23 bp, Homo sapiens
tgagagagaatagagctgccact

SEQ ID NO: 5525979 - DNA, 10 bp, Homo sapiens
tgagagagac

SEQ ID NO: 5525980 - DNA, 14 bp, Homo sapiens
tgagagagacaaga

SEQ ID NO: 5525981 - DNA, 18 bp, Homo sapiens
tgagagagagaacctttc

SEQ ID NO: 5525982 - DNA, 15 bp, Homo sapiens
tgagagagagagtgt

SEQ ID NO: 5525983 - DNA, 11 bp, Homo sapiens
tgagagagagg

SEQ ID NO: 5525984 - DNA, 21 bp, Homo sapiens
tgagagagatgggagctcctc

SEQ ID NO: 5525985 - DNA, 16 bp, Homo sapiens
tgagagagatgtgtaa

SEQ ID NO: 5525986 - DNA, 22 bp, Homo sapiens
tgagagagatgtgtaatttttc

SEQ ID NO: 5525987 - DNA, 13 bp, Homo sapiens
tgagagagcagga

SEQ ID NO: 5525988 - DNA, 20 bp, Homo sapiens
tgagagaggaggcctggacc

SEQ ID NO: 5525989 - DNA, 13 bp, Homo sapiens
tgagagagtgtgg

SEQ ID NO: 5525990 - DNA, 14 bp, Homo sapiens
tgagagatgctgta

SEQ ID NO: 5525991 - DNA, 14 bp, Homo sapiens
tgagagcacaaaga

SEQ ID NO: 5525992 - DNA, 16 bp, Homo sapiens
tgagagcacaaagata

SEQ ID NO: 5525993 - DNA, 14 bp, Homo sapiens
tgagagcacagcgt

SEQ ID NO: 5525994 - DNA, 15 bp, Homo sapiens
tgagagcacagcgtt

SEQ ID NO: 5525995 - DNA, 14 bp, Homo sapiens
tgagagcacccact

SEQ ID NO: 5525996 - DNA, 13 bp, Homo sapiens
tgagagcagcctc

SEQ ID NO: 5525997 - DNA, 14 bp, Homo sapiens
tgagagcagcctct

SEQ ID NO: 5525998 - DNA, 20 bp, Homo sapiens
tgagagcatcaggcctagag

SEQ ID NO: 5525999 - DNA, 20 bp, Homo sapiens
tgagagcatgtgaggggtag

SEQ ID NO: 5526000 - DNA, 17 bp, Homo sapiens
tgagagcatgtggggga

SEQ ID NO: 5526001 - DNA, 19 bp, Homo sapiens
tgagagccacgctggcctt

SEQ ID NO: 5526002 - DNA, 19 bp, Homo sapiens
tgagagccagatgcctccc

SEQ ID NO: 5526003 - DNA, 14 bp, Homo sapiens
tgagagccagcagc

SEQ ID NO: 5526004 - DNA, 15 bp, Homo sapiens
tgagagccagcagca

SEQ ID NO: 5526005 - DNA, 12 bp, Homo sapiens
tgagagccagtg

SEQ ID NO: 5526006 - DNA, 19 bp, Homo sapiens
tgagagcccgcgtgctgga

SEQ ID NO: 5526007 - DNA, 20 bp, Homo sapiens
tgagagccctgaggcctaga

SEQ ID NO: 5526008 - DNA, 11 bp, Homo sapiens
tgagagcctgt

SEQ ID NO: 5526009 - DNA, 16 bp, Homo sapiens
tgagagcctttgcctt

SEQ ID NO: 5526010 - DNA, 17 bp, Homo sapiens
tgagagcctttgccttt

SEQ ID NO: 5526011 - DNA, 21 bp, Homo sapiens
tgagagcctttggtgaataac

SEQ ID NO: 5526012 - DNA, 19 bp, Homo sapiens
tgagagcgaattgtgtgga

SEQ ID NO: 5526013 - DNA, 22 bp, Homo sapiens
tgagagcgaattgtgtggagaa

SEQ ID NO: 5526014 - DNA, 15 bp, Homo sapiens
tgagagcgcagcccg

SEQ ID NO: 5526015 - DNA, 16 bp, Homo sapiens
tgagagcgcagcccgc

SEQ ID NO: 5526016 - DNA, 14 bp, Homo sapiens
tgagagcgctggcc

SEQ ID NO: 5526017 - DNA, 15 bp, Homo sapiens
tgagagcgctggcct

SEQ ID NO: 5526018 - DNA, 16 bp, Homo sapiens
tgagagcgctggcctc

SEQ ID NO: 5526019 - DNA, 23 bp, Homo sapiens
tgagagcgtgctccagcctggct

SEQ ID NO: 5526020 - DNA, 16 bp, Homo sapiens
tgagagctcaggcagc

SEQ ID NO: 5526021 - DNA, 16 bp, Homo sapiens
tgagagctctctcttc

SEQ ID NO: 5526022 - DNA, 17 bp, Homo sapiens
tgagagctgctcctttg

SEQ ID NO: 5526023 - DNA, 13 bp, Homo sapiens
tgagagctgctga

SEQ ID NO: 5526024 - DNA, 13 bp, Homo sapiens
tgagagctggccc

SEQ ID NO: 5526025 - DNA, 20 bp, Homo sapiens
tgagagctgtttttgacagc

SEQ ID NO: 5526026 - DNA, 17 bp, Homo sapiens
tgagaggaaatcaccga

SEQ ID NO: 5526027 - DNA, 13 bp, Homo sapiens
tgagaggaagatg

SEQ ID NO: 5526028 - DNA, 22 bp, Homo sapiens
tgagaggaagatgaagagaagc

SEQ ID NO: 5526029 - DNA, 18 bp, Homo sapiens
tgagaggagcgtgtccta

SEQ ID NO: 5526030 - DNA, 17 bp, Homo sapiens
tgagaggaggggtaaat

SEQ ID NO: 5526031 - DNA, 19 bp, Homo sapiens
tgagaggaggggtaaatat

SEQ ID NO: 5526032 - DNA, 22 bp, Homo sapiens
tgagaggatgaatgtatgtgca

SEQ ID NO: 5526033 - DNA, 20 bp, Homo sapiens
tgagaggcaccagtccagca

SEQ ID NO: 5526034 - DNA, 22 bp, Homo sapiens
tgagaggcatccagtatcttga

SEQ ID NO: 5526035 - DNA, 18 bp, Homo sapiens
tgagaggcatgacagctg

SEQ ID NO: 5526036 - DNA, 16 bp, Homo sapiens
tgagaggcatttcccc

SEQ ID NO: 5526037 - DNA, 12 bp, Homo sapiens
tgagaggccccc

SEQ ID NO: 5526038 - DNA, 19 bp, Homo sapiens
tgagaggcccccacccttg

SEQ ID NO: 5526039 - DNA, 12 bp, Homo sapiens
tgagaggccctg

SEQ ID NO: 5526040 - DNA, 13 bp, Homo sapiens
tgagaggccctgg

SEQ ID NO: 5526041 - DNA, 17 bp, Homo sapiens
tgagaggccctggatca

SEQ ID NO: 5526042 - DNA, 14 bp, Homo sapiens
tgagaggcctggag

SEQ ID NO: 5526043 - DNA, 14 bp, Homo sapiens
tgagaggctctccg

SEQ ID NO: 5526044 - DNA, 13 bp, Homo sapiens
tgagaggctgagg

SEQ ID NO: 5526045 - DNA, 15 bp, Homo sapiens
tgagaggctgcctcc

SEQ ID NO: 5526046 - DNA, 16 bp, Homo sapiens
tgagaggctgtcatat

SEQ ID NO: 5526047 - DNA, 18 bp, Homo sapiens
tgagagggcaaggaagtg

SEQ ID NO: 5526048 - DNA, 19 bp, Homo sapiens
tgagaggggagagctgaac

SEQ ID NO: 5526049 - DNA, 19 bp, Homo sapiens
tgagaggggagagtccagt

SEQ ID NO: 5526050 - DNA, 20 bp, Homo sapiens
tgagaggggagggctcctgg

SEQ ID NO: 5526051 - DNA, 21 bp, Homo sapiens
tgagaggggagggctcctggg

SEQ ID NO: 5526052 - DNA, 20 bp, Homo sapiens
tgagaggggcgccttttcag

SEQ ID NO: 5526053 - DNA, 19 bp, Homo sapiens
tgagagggggatgcccctg

SEQ ID NO: 5526054 - DNA, 20 bp, Homo sapiens
tgagagggggatgcccctgg

SEQ ID NO: 5526055 - DNA, 23 bp, Homo sapiens
tgagagggtgtgggtgccctgtt

SEQ ID NO: 5526056 - DNA, 21 bp, Homo sapiens
tgagaggtgaaagcataacat

SEQ ID NO: 5526057 - DNA, 20 bp, Homo sapiens
tgagagtactcacttttcac

SEQ ID NO: 5526058 - DNA, 17 bp, Homo sapiens
tgagagtagagtcactg

SEQ ID NO: 5526059 - DNA, 18 bp, Homo sapiens
tgagagtagggccctgac

SEQ ID NO: 5526060 - DNA, 20 bp, Homo sapiens
tgagagtatagcatgaatgt

SEQ ID NO: 5526061 - DNA, 19 bp, Homo sapiens
tgagagtatattatgtatt

SEQ ID NO: 5526062 - DNA, 19 bp, Homo sapiens
tgagagtatcaggtctccc

SEQ ID NO: 5526063 - DNA, 14 bp, Homo sapiens
tgagagtcaaagct

SEQ ID NO: 5526064 - DNA, 14 bp, Homo sapiens
tgagagtcaggagt

SEQ ID NO: 5526065 - DNA, 13 bp, Homo sapiens
tgagagtctagat

SEQ ID NO: 5526066 - DNA, 19 bp, Homo sapiens
tgagagtctgaaagacaga

SEQ ID NO: 5526067 - DNA, 21 bp, Homo sapiens
tgagagtgacggctggcatgg

SEQ ID NO: 5526068 - DNA, 16 bp, Homo sapiens
tgagagtgcaaattgt

SEQ ID NO: 5526069 - DNA, 24 bp, Homo sapiens
tgagagtgtcttcacggcaggaca

SEQ ID NO: 5526070 - DNA, 13 bp, Homo sapiens
tgagagtgtgacc

SEQ ID NO: 5526071 - DNA, 21 bp, Homo sapiens
tgagagtgttcctgagacaga

SEQ ID NO: 5526072 - DNA, 16 bp, Homo sapiens
tgagagttccttctca

SEQ ID NO: 5526073 - DNA, 17 bp, Homo sapiens
tgagagttccttctcac

SEQ ID NO: 5526074 - DNA, 19 bp, Homo sapiens
tgagagttccttctcactt

SEQ ID NO: 5526075 - DNA, 22 bp, Homo sapiens
tgagagttccttctcacttaga

SEQ ID NO: 5526076 - DNA, 22 bp, Homo sapiens
tgagagttcgtgaagagggaag

SEQ ID NO: 5526077 - DNA, 16 bp, Homo sapiens
tgagagttgtctctgt

SEQ ID NO: 5526078 - DNA, 18 bp, Homo sapiens
tgagagttgtctctgttg

SEQ ID NO: 5526079 - DNA, 19 bp, Homo sapiens
tgagagttttggatgcagt

SEQ ID NO: 5526080 - DNA, 21 bp, Homo sapiens
tgagagttttgtcttgaatgt

SEQ ID NO: 5526081 - DNA, 12 bp, Homo sapiens
tgagccacagca

SEQ ID NO: 5526082 - DNA, 16 bp, Homo sapiens
tgagccacagcactcg

SEQ ID NO: 5526083 - DNA, 18 bp, Homo sapiens
tgagccacagcactcggc

SEQ ID NO: 5526084 - DNA, 18 bp, Homo sapiens
tgagccacagcagcattt

SEQ ID NO: 5526085 - DNA, 15 bp, Homo sapiens
tgagccacagtgggg

SEQ ID NO: 5526086 - DNA, 16 bp, Homo sapiens
tgagccacagtggggc

SEQ ID NO: 5526087 - DNA, 19 bp, Homo sapiens
tgagccacagtggggccca

SEQ ID NO: 5526088 - DNA, 20 bp, Homo sapiens
tgagccaccatgcctggccc

SEQ ID NO: 5526089 - DNA, 18 bp, Homo sapiens
tgagccaccgcgagggcc

SEQ ID NO: 5526090 - DNA, 23 bp, Homo sapiens
tgagccaccgcgcccagccaaga

SEQ ID NO: 5526091 - DNA, 20 bp, Homo sapiens
tgagccaccgcgcctggccc

SEQ ID NO: 5526092 - DNA, 18 bp, Homo sapiens
tgagccacctgccctttt

SEQ ID NO: 5526093 - DNA, 18 bp, Homo sapiens
tgagccacctttactctg

SEQ ID NO: 5526094 - DNA, 21 bp, Homo sapiens
tgagccacctttactctgctc

SEQ ID NO: 5526095 - DNA, 22 bp, Homo sapiens
tgagccacctttactctgctct

SEQ ID NO: 5526096 - DNA, 15 bp, Homo sapiens
tgagccactgagcct

SEQ ID NO: 5526097 - DNA, 11 bp, Homo sapiens
tgagccactgc

SEQ ID NO: 5526098 - DNA, 12 bp, Homo sapiens
tgagccactgca

SEQ ID NO: 5526099 - DNA, 13 bp, Homo sapiens
tgagccactgcac

SEQ ID NO: 5526100 - DNA, 23 bp, Homo sapiens
tgagccactgcaccgggccacag

SEQ ID NO: 5526101 - DNA, 15 bp, Homo sapiens
tgagccactgtgccc

SEQ ID NO: 5526102 - DNA, 21 bp, Homo sapiens
tgagccagatttcactctcct

SEQ ID NO: 5526103 - DNA, 16 bp, Homo sapiens
tgagccagcagacatt

SEQ ID NO: 5526104 - DNA, 17 bp, Homo sapiens
tgagccagcagacattg

SEQ ID NO: 5526105 - DNA, 18 bp, Homo sapiens
tgagccagcagacattgt

SEQ ID NO: 5526106 - DNA, 13 bp, Homo sapiens
tgagccagcaggg

SEQ ID NO: 5526107 - DNA, 22 bp, Homo sapiens
tgagccagccaggccctgccag

SEQ ID NO: 5526108 - DNA, 19 bp, Homo sapiens
tgagccagctctgtcccag

SEQ ID NO: 5526109 - DNA, 17 bp, Homo sapiens
tgagccagctgcagaag

SEQ ID NO: 5526110 - DNA, 16 bp, Homo sapiens
tgagccagcttagcaa

SEQ ID NO: 5526111 - DNA, 12 bp, Homo sapiens
tgagccaggagc

SEQ ID NO: 5526112 - DNA, 18 bp, Homo sapiens
tgagccaggagcctcctg

SEQ ID NO: 5526113 - DNA, 20 bp, Homo sapiens
tgagccaggagcctcctgac

SEQ ID NO: 5526114 - DNA, 22 bp, Homo sapiens
tgagccaggctagctggagcct

SEQ ID NO: 5526115 - DNA, 18 bp, Homo sapiens
tgagccaggcttttctca

SEQ ID NO: 5526116 - DNA, 22 bp, Homo sapiens
tgagccagggaacagccccagg

SEQ ID NO: 5526117 - DNA, 21 bp, Homo sapiens
tgagccaggtaatgagggact

SEQ ID NO: 5526118 - DNA, 21 bp, Homo sapiens
tgagccagtgctttaatggca

SEQ ID NO: 5526119 - DNA, 20 bp, Homo sapiens
tgagccagttacctttgctg

SEQ ID NO: 5526120 - DNA, 24 bp, Homo sapiens
tgagccagttacctttgctgtcac

SEQ ID NO: 5526121 - DNA, 21 bp, Homo sapiens
tgagccagttgtcctatggac

SEQ ID NO: 5526122 - DNA, 21 bp, Homo sapiens
tgagccatattaattgcctgt

SEQ ID NO: 5526123 - DNA, 15 bp, Homo sapiens
tgagccatcactaga

SEQ ID NO: 5526124 - DNA, 16 bp, Homo sapiens
tgagccatccaaagaa

SEQ ID NO: 5526125 - DNA, 23 bp, Homo sapiens
tgagccatgaggagcgtggactc

SEQ ID NO: 5526126 - DNA, 19 bp, Homo sapiens
tgagccatgagtatgccac

SEQ ID NO: 5526127 - DNA, 21 bp, Homo sapiens
tgagccatgatcgagccactg

SEQ ID NO: 5526128 - DNA, 21 bp, Homo sapiens
tgagccatgatttcccactgc

SEQ ID NO: 5526129 - DNA, 15 bp, Homo sapiens
tgagccatgcctccc

SEQ ID NO: 5526130 - DNA, 18 bp, Homo sapiens
tgagccatgcctccctgg

SEQ ID NO: 5526131 - DNA, 19 bp, Homo sapiens
tgagccattgagtgctggg

SEQ ID NO: 5526132 - DNA, 22 bp, Homo sapiens
tgagcccaaacaccctcctggc

SEQ ID NO: 5526133 - DNA, 20 bp, Homo sapiens
tgagcccaacactcacttaa

SEQ ID NO: 5526134 - DNA, 19 bp, Homo sapiens
tgagcccaaccaggccctg

SEQ ID NO: 5526135 - DNA, 22 bp, Homo sapiens
tgagcccacaggagctcccttt

SEQ ID NO: 5526136 - DNA, 18 bp, Homo sapiens
tgagcccactctactgcc

SEQ ID NO: 5526137 - DNA, 21 bp, Homo sapiens
tgagcccactctactgcccca

SEQ ID NO: 5526138 - DNA, 13 bp, Homo sapiens
tgagcccagagaa

SEQ ID NO: 5526139 - DNA, 17 bp, Homo sapiens
tgagcccagccacctcc

SEQ ID NO: 5526140 - DNA, 12 bp, Homo sapiens
tgagcccagctg

SEQ ID NO: 5526141 - DNA, 14 bp, Homo sapiens
tgagcccaggaagt

SEQ ID NO: 5526142 - DNA, 14 bp, Homo sapiens
tgagcccaggagct

SEQ ID NO: 5526143 - DNA, 22 bp, Homo sapiens
tgagcccaggagctgagtcacc

SEQ ID NO: 5526144 - DNA, 11 bp, Homo sapiens
tgagcccaggg

SEQ ID NO: 5526145 - DNA, 12 bp, Homo sapiens
tgagcccaggga

SEQ ID NO: 5526146 - DNA, 13 bp, Homo sapiens
tgagcccagggag

SEQ ID NO: 5526147 - DNA, 17 bp, Homo sapiens
tgagcccatggccctcc

SEQ ID NO: 5526148 - DNA, 18 bp, Homo sapiens
tgagcccatgttctgccc

SEQ ID NO: 5526149 - DNA, 22 bp, Homo sapiens
tgagcccatgttctgcccccag

SEQ ID NO: 5526150 - DNA, 16 bp, Homo sapiens
tgagcccattcttctg

SEQ ID NO: 5526151 - DNA, 15 bp, Homo sapiens
tgagcccatttctgg

SEQ ID NO: 5526152 - DNA, 17 bp, Homo sapiens
tgagccccacagccctg

SEQ ID NO: 5526153 - DNA, 21 bp, Homo sapiens
tgagccccagaggcagaggtt

SEQ ID NO: 5526154 - DNA, 14 bp, Homo sapiens
tgagccccagcccc

SEQ ID NO: 5526155 - DNA, 15 bp, Homo sapiens
tgagccccagcccca

SEQ ID NO: 5526156 - DNA, 12 bp, Homo sapiens
tgagccccagcg

SEQ ID NO: 5526157 - DNA, 16 bp, Homo sapiens
tgagccccaggggggc

SEQ ID NO: 5526158 - DNA, 20 bp, Homo sapiens
tgagccccaggggggcctcc

SEQ ID NO: 5526159 - DNA, 21 bp, Homo sapiens
tgagccccaggggggcctcct

SEQ ID NO: 5526160 - DNA, 20 bp, Homo sapiens
tgagccccagggtgcccaga

SEQ ID NO: 5526161 - DNA, 12 bp, Homo sapiens
tgagccccatct

SEQ ID NO: 5526162 - DNA, 17 bp, Homo sapiens
tgagcccccacctgcct

SEQ ID NO: 5526163 - DNA, 18 bp, Homo sapiens
tgagcccccacctgcctg

SEQ ID NO: 5526164 - DNA, 19 bp, Homo sapiens
tgagcccccacctgcctga

SEQ ID NO: 5526165 - DNA, 22 bp, Homo sapiens
tgagcccccagcttccagcagg

SEQ ID NO: 5526166 - DNA, 23 bp, Homo sapiens
tgagcccccccaacactgtgccc

SEQ ID NO: 5526167 - DNA, 15 bp, Homo sapiens
tgagcccccggctag

SEQ ID NO: 5526168 - DNA, 15 bp, Homo sapiens
tgagccccctctcct

SEQ ID NO: 5526169 - DNA, 23 bp, Homo sapiens
tgagccccctgcacccacccctg

SEQ ID NO: 5526170 - DNA, 17 bp, Homo sapiens
tgagccccctgtgccca

SEQ ID NO: 5526171 - DNA, 22 bp, Homo sapiens
tgagcccccttcctgtccccag

SEQ ID NO: 5526172 - DNA, 23 bp, Homo sapiens
tgagcccccttcctgtccccagg

SEQ ID NO: 5526173 - DNA, 17 bp, Homo sapiens
tgagccccgcagacctc

SEQ ID NO: 5526174 - DNA, 22 bp, Homo sapiens
tgagccccgccctcttcctgac

SEQ ID NO: 5526175 - DNA, 20 bp, Homo sapiens
tgagccccgccgtgtctgtg

SEQ ID NO: 5526176 - DNA, 23 bp, Homo sapiens
tgagccccgccgtgtctgtggcc

SEQ ID NO: 5526177 - DNA, 22 bp, Homo sapiens
tgagcccctaccccacaccagg

SEQ ID NO: 5526178 - DNA, 22 bp, Homo sapiens
tgagcccctcagacagccccct

SEQ ID NO: 5526179 - DNA, 16 bp, Homo sapiens
tgagcccctccccagc

SEQ ID NO: 5526180 - DNA, 18 bp, Homo sapiens
tgagcccctccccagcca

SEQ ID NO: 5526181 - DNA, 17 bp, Homo sapiens
tgagcccctcctctcct

SEQ ID NO: 5526182 - DNA, 15 bp, Homo sapiens
tgagcccctggtcct

SEQ ID NO: 5526183 - DNA, 14 bp, Homo sapiens
tgagcccctggtct

SEQ ID NO: 5526184 - DNA, 15 bp, Homo sapiens
tgagcccctggtctt

SEQ ID NO: 5526185 - DNA, 18 bp, Homo sapiens
tgagcccgaatttctcac

SEQ ID NO: 5526186 - DNA, 17 bp, Homo sapiens
tgagcccggatgcttct

SEQ ID NO: 5526187 - DNA, 22 bp, Homo sapiens
tgagcccggccctcccccagct

SEQ ID NO: 5526188 - DNA, 14 bp, Homo sapiens
tgagcccgggctgc

SEQ ID NO: 5526189 - DNA, 15 bp, Homo sapiens
tgagcccgggctgcc

SEQ ID NO: 5526190 - DNA, 17 bp, Homo sapiens
tgagcccgggctgcctg

SEQ ID NO: 5526191 - DNA, 18 bp, Homo sapiens
tgagcccgggctgcctgg

SEQ ID NO: 5526192 - DNA, 19 bp, Homo sapiens
tgagccctactccctgcag

SEQ ID NO: 5526193 - DNA, 16 bp, Homo sapiens
tgagccctcaaagtga

SEQ ID NO: 5526194 - DNA, 12 bp, Homo sapiens
tgagccctcaga

SEQ ID NO: 5526195 - DNA, 21 bp, Homo sapiens
tgagccctccttcttgccctg

SEQ ID NO: 5526196 - DNA, 13 bp, Homo sapiens
tgagccctctagg

SEQ ID NO: 5526197 - DNA, 14 bp, Homo sapiens
tgagccctctaggg

SEQ ID NO: 5526198 - DNA, 16 bp, Homo sapiens
tgagccctctagggca

SEQ ID NO: 5526199 - DNA, 18 bp, Homo sapiens
tgagccctctagggcagg

SEQ ID NO: 5526200 - DNA, 13 bp, Homo sapiens
tgagccctctcac

SEQ ID NO: 5526201 - DNA, 16 bp, Homo sapiens
tgagccctctcactcc

SEQ ID NO: 5526202 - DNA, 21 bp, Homo sapiens
tgagccctctcactccagcca

SEQ ID NO: 5526203 - DNA, 22 bp, Homo sapiens
tgagccctctcactccagccaa

SEQ ID NO: 5526204 - DNA, 23 bp, Homo sapiens
tgagccctctcactccagccaaa

SEQ ID NO: 5526205 - DNA, 13 bp, Homo sapiens
tgagccctgccct

SEQ ID NO: 5526206 - DNA, 15 bp, Homo sapiens
tgagccctgccctca

SEQ ID NO: 5526207 - DNA, 22 bp, Homo sapiens
tgagccctgccctcactccact

SEQ ID NO: 5526208 - DNA, 21 bp, Homo sapiens
tgagccgagatcacgccactg

SEQ ID NO: 5526209 - DNA, 23 bp, Homo sapiens
tgagccgagatcacgccactgca

SEQ ID NO: 5526210 - DNA, 17 bp, Homo sapiens
tgagccgcatcttctcc

SEQ ID NO: 5526211 - DNA, 15 bp, Homo sapiens
tgagccgcccaaggc

SEQ ID NO: 5526212 - DNA, 16 bp, Homo sapiens
tgagccgccgcgcctg

SEQ ID NO: 5526213 - DNA, 22 bp, Homo sapiens
tgagccgccgcgcctggcctag

SEQ ID NO: 5526214 - DNA, 14 bp, Homo sapiens
tgagccgcctcgga

SEQ ID NO: 5526215 - DNA, 24 bp, Homo sapiens
tgagccgcctcggagtgtggcctg

SEQ ID NO: 5526216 - DNA, 14 bp, Homo sapiens
tgagccgtgacctc

SEQ ID NO: 5526217 - DNA, 18 bp, Homo sapiens
tgagcctaaaaataaagc

SEQ ID NO: 5526218 - DNA, 20 bp, Homo sapiens
tgagcctaaatctaatcagg

SEQ ID NO: 5526219 - DNA, 15 bp, Homo sapiens
tgagcctagctacct

SEQ ID NO: 5526220 - DNA, 12 bp, Homo sapiens
tgagcctatgat

SEQ ID NO: 5526221 - DNA, 18 bp, Homo sapiens
tgagcctcaaccttctgg

SEQ ID NO: 5526222 - DNA, 22 bp, Homo sapiens
tgagcctcaatttcctcatctg

SEQ ID NO: 5526223 - DNA, 16 bp, Homo sapiens
tgagcctcacagcagt

SEQ ID NO: 5526224 - DNA, 13 bp, Homo sapiens
tgagcctcagcat

SEQ ID NO: 5526225 - DNA, 15 bp, Homo sapiens
tgagcctcagcatcc

SEQ ID NO: 5526226 - DNA, 22 bp, Homo sapiens
tgagcctcagcatcctggcacc

SEQ ID NO: 5526227 - DNA, 12 bp, Homo sapiens
tgagcctccccc

SEQ ID NO: 5526228 - DNA, 12 bp, Homo sapiens
tgagcctcctgt

SEQ ID NO: 5526229 - DNA, 16 bp, Homo sapiens
tgagcctcctgtgcct

SEQ ID NO: 5526230 - DNA, 18 bp, Homo sapiens
tgagcctcctgtgcctgg

SEQ ID NO: 5526231 - DNA, 19 bp, Homo sapiens
tgagcctcctgtgcctggc

SEQ ID NO: 5526232 - DNA, 17 bp, Homo sapiens
tgagcctcgtgtccaga

SEQ ID NO: 5526233 - DNA, 20 bp, Homo sapiens
tgagcctcgtgtccagactc

SEQ ID NO: 5526234 - DNA, 17 bp, Homo sapiens
tgagcctctgctcccca

SEQ ID NO: 5526235 - DNA, 21 bp, Homo sapiens
tgagcctgaaccttaatgtgg

SEQ ID NO: 5526236 - DNA, 17 bp, Homo sapiens
tgagcctgactgccagg

SEQ ID NO: 5526237 - DNA, 18 bp, Homo sapiens
tgagcctgaggccttcca

SEQ ID NO: 5526238 - DNA, 19 bp, Homo sapiens
tgagcctgaggccttccag

SEQ ID NO: 5526239 - DNA, 13 bp, Homo sapiens
tgagcctgcaggg

SEQ ID NO: 5526240 - DNA, 15 bp, Homo sapiens
tgagcctgcagggaa

SEQ ID NO: 5526241 - DNA, 15 bp, Homo sapiens
tgagcctgcattctg

SEQ ID NO: 5526242 - DNA, 13 bp, Homo sapiens
tgagcctgcccag

SEQ ID NO: 5526243 - DNA, 20 bp, Homo sapiens
tgagcctgcccgctgcaatg

SEQ ID NO: 5526244 - DNA, 17 bp, Homo sapiens
tgagcctgctggaagcc

SEQ ID NO: 5526245 - DNA, 16 bp, Homo sapiens
tgagcctggcaagaat

SEQ ID NO: 5526246 - DNA, 12 bp, Homo sapiens
tgagcctggcag

SEQ ID NO: 5526247 - DNA, 13 bp, Homo sapiens
tgagcctggcagg

SEQ ID NO: 5526248 - DNA, 19 bp, Homo sapiens
tgagcctggccatgtcctc

SEQ ID NO: 5526249 - DNA, 22 bp, Homo sapiens
tgagcctggcccatagaaacat

SEQ ID NO: 5526250 - DNA, 18 bp, Homo sapiens
tgagcctggctcttgtgc

SEQ ID NO: 5526251 - DNA, 13 bp, Homo sapiens
tgagcctggctgg

SEQ ID NO: 5526252 - DNA, 16 bp, Homo sapiens
tgagcctgggaaataa

SEQ ID NO: 5526253 - DNA, 14 bp, Homo sapiens
tgagcctgggcagc

SEQ ID NO: 5526254 - DNA, 14 bp, Homo sapiens
tgagcctgggctca

SEQ ID NO: 5526255 - DNA, 11 bp, Homo sapiens
tgagcctggtc

SEQ ID NO: 5526256 - DNA, 23 bp, Homo sapiens
tgagcctgtccaatttctgctgt

SEQ ID NO: 5526257 - DNA, 13 bp, Homo sapiens
tgagcctgtctct

SEQ ID NO: 5526258 - DNA, 23 bp, Homo sapiens
tgaggaggatgtccctgggccag

SEQ ID NO: 5526259 - DNA, 23 bp, Homo sapiens
tgaggaggattgcttcttgtgaa

SEQ ID NO: 5526260 - DNA, 14 bp, Homo sapiens
tgaggaggcagaga

SEQ ID NO: 5526261 - DNA, 21 bp, Homo sapiens
tgaggaggccttgggctctgc

SEQ ID NO: 5526262 - DNA, 14 bp, Homo sapiens
tgaggaggctggcc

SEQ ID NO: 5526263 - DNA, 18 bp, Homo sapiens
tgaggagggccctgagga

SEQ ID NO: 5526264 - DNA, 20 bp, Homo sapiens
tgaggagggccctgaggaat

SEQ ID NO: 5526265 - DNA, 23 bp, Homo sapiens
tgaggagggccctgaggaataaa

SEQ ID NO: 5526266 - DNA, 16 bp, Homo sapiens
tgaggaggggagcaag

SEQ ID NO: 5526267 - DNA, 21 bp, Homo sapiens
tgaggaggggagcaaggctgc

SEQ ID NO: 5526268 - DNA, 23 bp, Homo sapiens
tgaggaggggagcaaggctgcta

SEQ ID NO: 5526269 - DNA, 20 bp, Homo sapiens
tgaggaggggagcgtctggg

SEQ ID NO: 5526270 - DNA, 16 bp, Homo sapiens
tgaggaggggagggta

SEQ ID NO: 5526271 - DNA, 22 bp, Homo sapiens
tgaggaggggagggtaaataaa

SEQ ID NO: 5526272 - DNA, 21 bp, Homo sapiens
tgaggaggggcacctgccacc

SEQ ID NO: 5526273 - DNA, 11 bp, Homo sapiens
tgaggaggggg

SEQ ID NO: 5526274 - DNA, 15 bp, Homo sapiens
tgaggagggggagaa

SEQ ID NO: 5526275 - DNA, 17 bp, Homo sapiens
tgaggagggggagaagg

SEQ ID NO: 5526276 - DNA, 13 bp, Homo sapiens
tgaggagggtgga

SEQ ID NO: 5526277 - DNA, 20 bp, Homo sapiens
tgaggagggtgggggaggga

SEQ ID NO: 5526278 - DNA, 19 bp, Homo sapiens
tgaggaggttcactgagct

SEQ ID NO: 5526279 - DNA, 19 bp, Homo sapiens
tgaggagtaagtgtacaat

SEQ ID NO: 5526280 - DNA, 21 bp, Homo sapiens
tgaggagtacccccagcccaa

SEQ ID NO: 5526281 - DNA, 19 bp, Homo sapiens
tgaggagtagctgagagga

SEQ ID NO: 5526282 - DNA, 20 bp, Homo sapiens
tgaggagtagctgagaggaa

SEQ ID NO: 5526283 - DNA, 16 bp, Homo sapiens
tgaggagtcttgtgtg

SEQ ID NO: 5526284 - DNA, 18 bp, Homo sapiens
tgaggagtgatgggcaag

SEQ ID NO: 5526285 - DNA, 19 bp, Homo sapiens
tgaggagtggacgctgtcc

SEQ ID NO: 5526286 - DNA, 17 bp, Homo sapiens
tgaggagtggagggaaa

SEQ ID NO: 5526287 - DNA, 22 bp, Homo sapiens
tgaggagtggagttctctgttc

SEQ ID NO: 5526288 - DNA, 22 bp, Homo sapiens
tgaggagtggttgggctgtgcc

SEQ ID NO: 5526289 - DNA, 16 bp, Homo sapiens
tgaggagtgtgagaat

SEQ ID NO: 5526290 - DNA, 20 bp, Homo sapiens
tgaggagttgcctgactcct

SEQ ID NO: 5526291 - DNA, 20 bp, Homo sapiens
tgaggataaaaaggaaggag

SEQ ID NO: 5526292 - DNA, 15 bp, Homo sapiens
tgaggataaattgcc

SEQ ID NO: 5526293 - DNA, 17 bp, Homo sapiens
tgaggataacttccttg

SEQ ID NO: 5526294 - DNA, 21 bp, Homo sapiens
tgaggataccccaaagtccag

SEQ ID NO: 5526295 - DNA, 20 bp, Homo sapiens
tgaggatacgacagtacact

SEQ ID NO: 5526296 - DNA, 20 bp, Homo sapiens
tgaggatagtagttaaataa

SEQ ID NO: 5526297 - DNA, 18 bp, Homo sapiens
tgaggatataatgtgtgc

SEQ ID NO: 5526298 - DNA, 21 bp, Homo sapiens
tgaggatataatgtgtgcttt

SEQ ID NO: 5526299 - DNA, 15 bp, Homo sapiens
tgaggatatggcagg

SEQ ID NO: 5526300 - DNA, 13 bp, Homo sapiens
tgaggatcagagt

SEQ ID NO: 5526301 - DNA, 16 bp, Homo sapiens
tgaggatccagggcag

SEQ ID NO: 5526302 - DNA, 17 bp, Homo sapiens
tgaggatccagggcagc

SEQ ID NO: 5526303 - DNA, 18 bp, Homo sapiens
tgaggatccagggcagca

SEQ ID NO: 5526304 - DNA, 20 bp, Homo sapiens
tgaggatccagggcagcagg

SEQ ID NO: 5526305 - DNA, 17 bp, Homo sapiens
tgaggatcccctgtccc

SEQ ID NO: 5526306 - DNA, 21 bp, Homo sapiens
tgaggatcccctgtcccctgg

SEQ ID NO: 5526307 - DNA, 21 bp, Homo sapiens
tgaggatcctcacaggagcag

SEQ ID NO: 5526308 - DNA, 17 bp, Homo sapiens
tgaggatctagcttcat

SEQ ID NO: 5526309 - DNA, 23 bp, Homo sapiens
tgaggatctagcttcatgcctca

SEQ ID NO: 5526310 - DNA, 22 bp, Homo sapiens
tgaggatctattactgaccgta

SEQ ID NO: 5526311 - DNA, 21 bp, Homo sapiens
tgaggatgacccggggcagct

SEQ ID NO: 5526312 - DNA, 14 bp, Homo sapiens
tgaggatgatgtac

SEQ ID NO: 5526313 - DNA, 17 bp, Homo sapiens
tgaggatgcactggcct

SEQ ID NO: 5526314 - DNA, 23 bp, Homo sapiens
tgaggatgctgcagtgaggctgt

SEQ ID NO: 5526315 - DNA, 21 bp, Homo sapiens
tgaggatggagagcagccagc

SEQ ID NO: 5526316 - DNA, 20 bp, Homo sapiens
tgaggatgggaaggagggag

SEQ ID NO: 5526317 - DNA, 18 bp, Homo sapiens
tgaggatgggatgtattt

SEQ ID NO: 5526318 - DNA, 18 bp, Homo sapiens
tgaggatgtatgtgtata

SEQ ID NO: 5526319 - DNA, 22 bp, Homo sapiens
tgaggatgtatgtgtatatgtt

SEQ ID NO: 5526320 - DNA, 16 bp, Homo sapiens
tgaggatgtggcacaa

SEQ ID NO: 5526321 - DNA, 17 bp, Homo sapiens
tgaggattagtttagaa

SEQ ID NO: 5526322 - DNA, 20 bp, Homo sapiens
tgaggattagtttagaacag

SEQ ID NO: 5526323 - DNA, 19 bp, Homo sapiens
tgaggattatgggtcctgc

SEQ ID NO: 5526324 - DNA, 15 bp, Homo sapiens
tgaggattgtggaaa

SEQ ID NO: 5526325 - DNA, 13 bp, Homo sapiens
tgaggatttcaag

SEQ ID NO: 5526326 - DNA, 16 bp, Homo sapiens
tgaggatttcaagcct

SEQ ID NO: 5526327 - DNA, 21 bp, Homo sapiens
tgaggatttctgatctgattt

SEQ ID NO: 5526328 - DNA, 14 bp, Homo sapiens
tgaggcaaaagaag

SEQ ID NO: 5526329 - DNA, 16 bp, Homo sapiens
tgaggcaaacagcaag

SEQ ID NO: 5526330 - DNA, 20 bp, Homo sapiens
tgaggcaaattaactgtatg

SEQ ID NO: 5526331 - DNA, 16 bp, Homo sapiens
tgaggcaaccccctcg

SEQ ID NO: 5526332 - DNA, 21 bp, Homo sapiens
tgaggcaaccccctcggagcc

SEQ ID NO: 5526333 - DNA, 22 bp, Homo sapiens
tgaggcaaccccctcggagcct

SEQ ID NO: 5526334 - DNA, 20 bp, Homo sapiens
tgaggcaacctgattgtaaa

SEQ ID NO: 5526335 - DNA, 16 bp, Homo sapiens
tgaggcaactcagcag

SEQ ID NO: 5526336 - DNA, 14 bp, Homo sapiens
tgaggcaaggccca

SEQ ID NO: 5526337 - DNA, 11 bp, Homo sapiens
tgaggcaataa

SEQ ID NO: 5526338 - DNA, 20 bp, Homo sapiens
tgaggcaatgtcaggaacag

SEQ ID NO: 5526339 - DNA, 20 bp, Homo sapiens
tgaggcaccgtccaggcccc

SEQ ID NO: 5526340 - DNA, 22 bp, Homo sapiens
tgaggcacgaatgatctttctt

SEQ ID NO: 5526341 - DNA, 23 bp, Homo sapiens
tgaggcagaacctggtggctgga

SEQ ID NO: 5526342 - DNA, 16 bp, Homo sapiens
tgaggcagacagcagc

SEQ ID NO: 5526343 - DNA, 24 bp, Homo sapiens
tgaggcagacagcagctcaggcac

SEQ ID NO: 5526344 - DNA, 23 bp, Homo sapiens
tgaggcaggagaactacttgaac

SEQ ID NO: 5526345 - DNA, 19 bp, Homo sapiens
tgaggcaggagggcatgtg

SEQ ID NO: 5526346 - DNA, 22 bp, Homo sapiens
tgaggcagggaagtccccaggc

SEQ ID NO: 5526347 - DNA, 14 bp, Homo sapiens
tgaggcaggggagt

SEQ ID NO: 5526348 - DNA, 23 bp, Homo sapiens
tgaggcaggggagtagtggagag

SEQ ID NO: 5526349 - DNA, 21 bp, Homo sapiens
tgaggcaggggagtctgcttg

SEQ ID NO: 5526350 - DNA, 16 bp, Homo sapiens
tgaggcagggtctcac

SEQ ID NO: 5526351 - DNA, 15 bp, Homo sapiens
tgaggcatccagcag

SEQ ID NO: 5526352 - DNA, 18 bp, Homo sapiens
tgaggcatccgtgaggca

SEQ ID NO: 5526353 - DNA, 15 bp, Homo sapiens
tgaggcatctctctg

SEQ ID NO: 5526354 - DNA, 18 bp, Homo sapiens
tgaggcatctctctggga

SEQ ID NO: 5526355 - DNA, 22 bp, Homo sapiens
tgaggcatgagttactgtgcat

SEQ ID NO: 5526356 - DNA, 17 bp, Homo sapiens
tgaggcatgcacatctg

SEQ ID NO: 5526357 - DNA, 18 bp, Homo sapiens
tgaggcattgcacaggga

SEQ ID NO: 5526358 - DNA, 19 bp, Homo sapiens
tgaggcatttgtttgaact

SEQ ID NO: 5526359 - DNA, 20 bp, Homo sapiens
tgaggcatttgtttgaactg

SEQ ID NO: 5526360 - DNA, 14 bp, Homo sapiens
tgaggccaaatatt

SEQ ID NO: 5526361 - DNA, 21 bp, Homo sapiens
tgaggccaagaatattgcaaa

SEQ ID NO: 5526362 - DNA, 13 bp, Homo sapiens
tgaggccacccac

SEQ ID NO: 5526363 - DNA, 22 bp, Homo sapiens
tgaggccactgaagaggaggag

SEQ ID NO: 5526364 - DNA, 15 bp, Homo sapiens
tgaggccagaaaggt

SEQ ID NO: 5526365 - DNA, 13 bp, Homo sapiens
tgaggccagacca

SEQ ID NO: 5526366 - DNA, 14 bp, Homo sapiens
tgaggccagagaca

SEQ ID NO: 5526367 - DNA, 16 bp, Homo sapiens
tgaggccagaggtgct

SEQ ID NO: 5526368 - DNA, 13 bp, Homo sapiens
tgaggccagagtc

SEQ ID NO: 5526369 - DNA, 12 bp, Homo sapiens
tgaggccagcct

SEQ ID NO: 5526370 - DNA, 14 bp, Homo sapiens
tgaggccagcctgg

SEQ ID NO: 5526371 - DNA, 15 bp, Homo sapiens
tgaggccagcctggc

SEQ ID NO: 5526372 - DNA, 16 bp, Homo sapiens
tgaggccagcctggcc

SEQ ID NO: 5526373 - DNA, 18 bp, Homo sapiens
tgaggccagcctggcctc

SEQ ID NO: 5526374 - DNA, 21 bp, Homo sapiens
tgaggccagcctggcctcctg

SEQ ID NO: 5526375 - DNA, 23 bp, Homo sapiens
tgaggccagggctgatggtctta

SEQ ID NO: 5526376 - DNA, 15 bp, Homo sapiens
tgaggccagtaattc

SEQ ID NO: 5526377 - DNA, 15 bp, Homo sapiens
tgaggccagtggccc

SEQ ID NO: 5526378 - DNA, 16 bp, Homo sapiens
tgaggccagtggcccc

SEQ ID NO: 5526379 - DNA, 16 bp, Homo sapiens
tgaggccatcagggcc

SEQ ID NO: 5526380 - DNA, 19 bp, Homo sapiens
tgaggccatcagggccctg

SEQ ID NO: 5526381 - DNA, 17 bp, Homo sapiens
tgaggccatctcaggag

SEQ ID NO: 5526382 - DNA, 19 bp, Homo sapiens
tgaggccatctcaggagat

SEQ ID NO: 5526383 - DNA, 14 bp, Homo sapiens
tgaggccatggact

SEQ ID NO: 5526384 - DNA, 16 bp, Homo sapiens
tgaggccattatttca

SEQ ID NO: 5526385 - DNA, 18 bp, Homo sapiens
tgaggccattccctgtag

SEQ ID NO: 5526386 - DNA, 16 bp, Homo sapiens
tgaggcccactctgtt

SEQ ID NO: 5526387 - DNA, 11 bp, Homo sapiens
tgaggcccaga

SEQ ID NO: 5526388 - DNA, 18 bp, Homo sapiens
tgaggcccagagagctga

SEQ ID NO: 5526389 - DNA, 13 bp, Homo sapiens
tgaggcccagagg

SEQ ID NO: 5526390 - DNA, 15 bp, Homo sapiens
tgaggcccagagggc

SEQ ID NO: 5526391 - DNA, 21 bp, Homo sapiens
tgaggcccagagggcctgcaa

SEQ ID NO: 5526392 - DNA, 18 bp, Homo sapiens
tgaggcccagcagagccg

SEQ ID NO: 5526393 - DNA, 14 bp, Homo sapiens
tgaggcccagcctg

SEQ ID NO: 5526394 - DNA, 17 bp, Homo sapiens
tgaggcccagcctgtcc

SEQ ID NO: 5526395 - DNA, 13 bp, Homo sapiens
tgaggcccaggga

SEQ ID NO: 5526396 - DNA, 14 bp, Homo sapiens
tgaggcccatggcc

SEQ ID NO: 5526397 - DNA, 16 bp, Homo sapiens
tgaggcccatggccac

SEQ ID NO: 5526398 - DNA, 18 bp, Homo sapiens
tgaggcccatggccacat

SEQ ID NO: 5526399 - DNA, 14 bp, Homo sapiens
tgaggccccaactc

SEQ ID NO: 5526400 - DNA, 12 bp, Homo sapiens
tgaggcccccgg

SEQ ID NO: 5526401 - DNA, 16 bp, Homo sapiens
tgaggcccccggaggc

SEQ ID NO: 5526402 - DNA, 22 bp, Homo sapiens
tgaggcccccggaggcgcccac

SEQ ID NO: 5526403 - DNA, 23 bp, Homo sapiens
tgaggcccccgtcagggagaggt

SEQ ID NO: 5526404 - DNA, 23 bp, Homo sapiens
tgaggccccgatggactcctgac

SEQ ID NO: 5526405 - DNA, 15 bp, Homo sapiens
tgaggcccctgcctc

SEQ ID NO: 5526406 - DNA, 12 bp, Homo sapiens
tgaggccctcca

SEQ ID NO: 5526407 - DNA, 13 bp, Homo sapiens
tgaggccctccac

SEQ ID NO: 5526408 - DNA, 19 bp, Homo sapiens
tgaggccctccacacctgc

SEQ ID NO: 5526409 - DNA, 22 bp, Homo sapiens
tgaggccctccacacctgcggc

SEQ ID NO: 5526410 - DNA, 14 bp, Homo sapiens
tgaggccctgcacc

SEQ ID NO: 5526411 - DNA, 15 bp, Homo sapiens
tgaggccctgcacct

SEQ ID NO: 5526412 - DNA, 15 bp, Homo sapiens
tgaggccctgtgata

SEQ ID NO: 5526413 - DNA, 16 bp, Homo sapiens
tgaggcccttctctcc

SEQ ID NO: 5526414 - DNA, 20 bp, Homo sapiens
tgaggcccttctctccagcc

SEQ ID NO: 5526415 - DNA, 23 bp, Homo sapiens
tgaggcccttctctccagcccct

SEQ ID NO: 5526416 - DNA, 16 bp, Homo sapiens
tgaggccgcggcctcc

SEQ ID NO: 5526417 - DNA, 19 bp, Homo sapiens
tgaggccgctagaggcctg

SEQ ID NO: 5526418 - DNA, 20 bp, Homo sapiens
tgaggccgctagaggcctga

SEQ ID NO: 5526419 - DNA, 15 bp, Homo sapiens
tgaggccggacagag

SEQ ID NO: 5526420 - DNA, 16 bp, Homo sapiens
tgaggccggccctgcc

SEQ ID NO: 5526421 - DNA, 22 bp, Homo sapiens
tgaggccggccctgcccctccc

SEQ ID NO: 5526422 - DNA, 20 bp, Homo sapiens
tgaggccgttgctgacttag

SEQ ID NO: 5526423 - DNA, 17 bp, Homo sapiens
tgaggcctactctaaag

SEQ ID NO: 5526424 - DNA, 16 bp, Homo sapiens
tgaggcctagactctg

SEQ ID NO: 5526425 - DNA, 19 bp, Homo sapiens
tgaggcctcagtggacttt

SEQ ID NO: 5526426 - DNA, 14 bp, Homo sapiens
tgaggcctccaagg

SEQ ID NO: 5526427 - DNA, 15 bp, Homo sapiens
tgaggcctcttggac

SEQ ID NO: 5526428 - DNA, 23 bp, Homo sapiens
tgaggcctcttggacctctgctc

SEQ ID NO: 5526429 - DNA, 20 bp, Homo sapiens
tgaggcctgagacccaggac

SEQ ID NO: 5526430 - DNA, 21 bp, Homo sapiens
tgaggcctgagacccaggact

SEQ ID NO: 5526431 - DNA, 16 bp, Homo sapiens
tgaggcctgaggcctg

SEQ ID NO: 5526432 - DNA, 20 bp, Homo sapiens
tgaggcctgccccctgggct

SEQ ID NO: 5526433 - DNA, 13 bp, Homo sapiens
tgaggcctgcttc

SEQ ID NO: 5526434 - DNA, 17 bp, Homo sapiens
tgaggggccctggccag

SEQ ID NO: 5526435 - DNA, 19 bp, Homo sapiens
tgaggggccctggccagga

SEQ ID NO: 5526436 - DNA, 13 bp, Homo sapiens
tgaggggcctctt

SEQ ID NO: 5526437 - DNA, 15 bp, Homo sapiens
tgaggggcctgcgcc

SEQ ID NO: 5526438 - DNA, 18 bp, Homo sapiens
tgaggggcctgcgcccag

SEQ ID NO: 5526439 - DNA, 14 bp, Homo sapiens
tgaggggcctggag

SEQ ID NO: 5526440 - DNA, 17 bp, Homo sapiens
tgaggggctaccaggaa

SEQ ID NO: 5526441 - DNA, 22 bp, Homo sapiens
tgaggggctccgggtcactgct

SEQ ID NO: 5526442 - DNA, 15 bp, Homo sapiens
tgaggggctcctgga

SEQ ID NO: 5526443 - DNA, 14 bp, Homo sapiens
tgaggggctggcct

SEQ ID NO: 5526444 - DNA, 13 bp, Homo sapiens
tgaggggctgggc

SEQ ID NO: 5526445 - DNA, 19 bp, Homo sapiens
tgaggggctggggaggggg

SEQ ID NO: 5526446 - DNA, 13 bp, Homo sapiens
tgaggggctgtga

SEQ ID NO: 5526447 - DNA, 15 bp, Homo sapiens
tgaggggctttctct

SEQ ID NO: 5526448 - DNA, 22 bp, Homo sapiens
tgagggggaattcctggaacct

SEQ ID NO: 5526449 - DNA, 13 bp, Homo sapiens
tgagggggagctg

SEQ ID NO: 5526450 - DNA, 13 bp, Homo sapiens
tgagggggctcag

SEQ ID NO: 5526451 - DNA, 14 bp, Homo sapiens
tgagggggctcagt

SEQ ID NO: 5526452 - DNA, 17 bp, Homo sapiens
tgagggggctctttccc

SEQ ID NO: 5526453 - DNA, 12 bp, Homo sapiens
tgagggggtggt

SEQ ID NO: 5526454 - DNA, 22 bp, Homo sapiens
tgagggggtggttattggactc

SEQ ID NO: 5526455 - DNA, 20 bp, Homo sapiens
tgaggggtatatctgggctg

SEQ ID NO: 5526456 - DNA, 17 bp, Homo sapiens
tgaggggttcctcccct

SEQ ID NO: 5526457 - DNA, 14 bp, Homo sapiens
tgagggtaagtatt

SEQ ID NO: 5526458 - DNA, 18 bp, Homo sapiens
tgagggtaataaacttag

SEQ ID NO: 5526459 - DNA, 18 bp, Homo sapiens
tgagggtatcaaataaaa

SEQ ID NO: 5526460 - DNA, 23 bp, Homo sapiens
tgagggtatgaagagctgtcttc

SEQ ID NO: 5526461 - DNA, 22 bp, Homo sapiens
tgagggtcattctttattcttt

SEQ ID NO: 5526462 - DNA, 17 bp, Homo sapiens
tgagggtccacctggag

SEQ ID NO: 5526463 - DNA, 19 bp, Homo sapiens
tgagggtccacctggagag

SEQ ID NO: 5526464 - DNA, 19 bp, Homo sapiens
tgagggtccccacctggga

SEQ ID NO: 5526465 - DNA, 18 bp, Homo sapiens
tgagggtcctcttcctca

SEQ ID NO: 5526466 - DNA, 15 bp, Homo sapiens
tgagggtcctgcagc

SEQ ID NO: 5526467 - DNA, 22 bp, Homo sapiens
tgagggtcctgcagcctgcagg

SEQ ID NO: 5526468 - DNA, 14 bp, Homo sapiens
tgagggtcgtggga

SEQ ID NO: 5526469 - DNA, 22 bp, Homo sapiens
tgagggtcgtgggaaaggggag

SEQ ID NO: 5526470 - DNA, 21 bp, Homo sapiens
tgagggtctgaaaagggcatc

SEQ ID NO: 5526471 - DNA, 14 bp, Homo sapiens
tgagggtctgggat

SEQ ID NO: 5526472 - DNA, 23 bp, Homo sapiens
tgagggtctgtaggttgcacact

SEQ ID NO: 5526473 - DNA, 12 bp, Homo sapiens
tgagggtcttct

SEQ ID NO: 5526474 - DNA, 22 bp, Homo sapiens
tgagggtgacagagggacagtg

SEQ ID NO: 5526475 - DNA, 20 bp, Homo sapiens
tgagggtgcccttttccagc

SEQ ID NO: 5526476 - DNA, 22 bp, Homo sapiens
tgagggtgcggggcctgcaggc

SEQ ID NO: 5526477 - DNA, 20 bp, Homo sapiens
tgagggtggtttatgattaa

SEQ ID NO: 5526478 - DNA, 20 bp, Homo sapiens
tgagggtgtcggctgtgagg

SEQ ID NO: 5526479 - DNA, 20 bp, Homo sapiens
tgagggtgtttcctctaaac

SEQ ID NO: 5526480 - DNA, 14 bp, Homo sapiens
tgagggtgtttttt

SEQ ID NO: 5526481 - DNA, 14 bp, Homo sapiens
tgagggttccatgg

SEQ ID NO: 5526482 - DNA, 14 bp, Homo sapiens
tgagggtttctgat

SEQ ID NO: 5526483 - DNA, 18 bp, Homo sapiens
tgagggtttgagagcccg

SEQ ID NO: 5526484 - DNA, 20 bp, Homo sapiens
tgagggtttgtaatggtgct

SEQ ID NO: 5526485 - DNA, 23 bp, Homo sapiens
tgagggtttgtaatggtgcttat

SEQ ID NO: 5526486 - DNA, 15 bp, Homo sapiens
tgagggttttctcat

SEQ ID NO: 5526487 - DNA, 13 bp, Homo sapiens
tgaggtaaaatgt

SEQ ID NO: 5526488 - DNA, 14 bp, Homo sapiens
tgaggtaagtggaa

SEQ ID NO: 5526489 - DNA, 17 bp, Homo sapiens
tgaggtacctttccacc

SEQ ID NO: 5526490 - DNA, 21 bp, Homo sapiens
tgaggtacctttccacccaga

SEQ ID NO: 5526491 - DNA, 17 bp, Homo sapiens
tgaggtactgagagtga

SEQ ID NO: 5526492 - DNA, 23 bp, Homo sapiens
tgaggtagaaatgcaagggggac

SEQ ID NO: 5526493 - DNA, 17 bp, Homo sapiens
tgaggtagaggaaaatc

SEQ ID NO: 5526494 - DNA, 18 bp, Homo sapiens
tgaggtagaggaaaatca

SEQ ID NO: 5526495 - DNA, 16 bp, Homo sapiens
tgaggtataaagacaa

SEQ ID NO: 5526496 - DNA, 18 bp, Homo sapiens
tgaggtatggccatgccc

SEQ ID NO: 5526497 - DNA, 16 bp, Homo sapiens
tgaggtattttttcct

SEQ ID NO: 5526498 - DNA, 19 bp, Homo sapiens
tgaggtcaacacaggtagc

SEQ ID NO: 5526499 - DNA, 15 bp, Homo sapiens
tgaggtcaagaaatg

SEQ ID NO: 5526500 - DNA, 20 bp, Homo sapiens
tgaggtcaagtaagaagaca

SEQ ID NO: 5526501 - DNA, 18 bp, Homo sapiens
tgaggtcaataaagcaga

SEQ ID NO: 5526502 - DNA, 19 bp, Homo sapiens
tgaggtcaataaagcagag

SEQ ID NO: 5526503 - DNA, 22 bp, Homo sapiens
tgaggtcaataaagcagagcca

SEQ ID NO: 5526504 - DNA, 15 bp, Homo sapiens
tgaggtcactgctag

SEQ ID NO: 5526505 - DNA, 18 bp, Homo sapiens
tgaggtcactgggttcta

SEQ ID NO: 5526506 - DNA, 16 bp, Homo sapiens
tgaggtcagagcctgc

SEQ ID NO: 5526507 - DNA, 16 bp, Homo sapiens
tgaggtcaggagttcc

SEQ ID NO: 5526508 - DNA, 16 bp, Homo sapiens
tgaggtcagggagtgc

SEQ ID NO: 5526509 - DNA, 19 bp, Homo sapiens
tgaggtcatcccggggcca

SEQ ID NO: 5526510 - DNA, 22 bp, Homo sapiens
tgaggtcatcccggggccatgg

SEQ ID NO: 5526511 - DNA, 20 bp, Homo sapiens
tgaggtcatttctaaggtgt

SEQ ID NO: 5526512 - DNA, 16 bp, Homo sapiens
tgaggtccagccctgg

SEQ ID NO: 5526513 - DNA, 20 bp, Homo sapiens
tgaggtccagccctggctga

SEQ ID NO: 5526514 - DNA, 16 bp, Homo sapiens
tgaggtcccaggaagt

SEQ ID NO: 5526515 - DNA, 13 bp, Homo sapiens
tgaggtcccaggc

SEQ ID NO: 5526516 - DNA, 23 bp, Homo sapiens
tgaggtcccctcgtcccatccag

SEQ ID NO: 5526517 - DNA, 23 bp, Homo sapiens
tgaggtcccttcaaggcctcccc

SEQ ID NO: 5526518 - DNA, 17 bp, Homo sapiens
tgaggtcctcaggtcag

SEQ ID NO: 5526519 - DNA, 20 bp, Homo sapiens
tgaggtcctcaggtcagctg

SEQ ID NO: 5526520 - DNA, 14 bp, Homo sapiens
tgaggtcctgagca

SEQ ID NO: 5526521 - DNA, 17 bp, Homo sapiens
tgaggtcctgagcactg

SEQ ID NO: 5526522 - DNA, 20 bp, Homo sapiens
tgaggtcctgagcactgcca

SEQ ID NO: 5526523 - DNA, 23 bp, Homo sapiens
tgaggtcctgagcactgccagga

SEQ ID NO: 5526524 - DNA, 15 bp, Homo sapiens
tgaggtcctgggggc

SEQ ID NO: 5526525 - DNA, 18 bp, Homo sapiens
tgaggtcctgggggcctg

SEQ ID NO: 5526526 - DNA, 21 bp, Homo sapiens
tgaggtccttatgtcctgtca

SEQ ID NO: 5526527 - DNA, 15 bp, Homo sapiens
tgaggtcgggtttta

SEQ ID NO: 5526528 - DNA, 19 bp, Homo sapiens
tgaggtctagagagaacca

SEQ ID NO: 5526529 - DNA, 15 bp, Homo sapiens
tgaggtctcaccttc

SEQ ID NO: 5526530 - DNA, 13 bp, Homo sapiens
tgaggtctcagcc

SEQ ID NO: 5526531 - DNA, 16 bp, Homo sapiens
tgaggtctcagcccct

SEQ ID NO: 5526532 - DNA, 17 bp, Homo sapiens
tgaggtctcttgaggga

SEQ ID NO: 5526533 - DNA, 18 bp, Homo sapiens
tgaggtctcttgagggag

SEQ ID NO: 5526534 - DNA, 13 bp, Homo sapiens
tgaggtctgcgtc

SEQ ID NO: 5526535 - DNA, 15 bp, Homo sapiens
tgaggtctgctcggc

SEQ ID NO: 5526536 - DNA, 16 bp, Homo sapiens
tgaggtctgctcggcc

SEQ ID NO: 5526537 - DNA, 14 bp, Homo sapiens
tgaggtctgtttaa

SEQ ID NO: 5526538 - DNA, 15 bp, Homo sapiens
tgaggtctttgcatt

SEQ ID NO: 5526539 - DNA, 16 bp, Homo sapiens
tgaggtcttttacata

SEQ ID NO: 5526540 - DNA, 21 bp, Homo sapiens
tgaggtcttttgacatgtgga

SEQ ID NO: 5526541 - DNA, 18 bp, Homo sapiens
tgaggtgaacaaggtaaa

SEQ ID NO: 5526542 - DNA, 18 bp, Homo sapiens
tgaggtgaactccaggca

SEQ ID NO: 5526543 - DNA, 21 bp, Homo sapiens
tgaggtgaactccaggcatgt

SEQ ID NO: 5526544 - DNA, 16 bp, Homo sapiens
tgaggtgacttgcctg

SEQ ID NO: 5526545 - DNA, 20 bp, Homo sapiens
tgaggtgcaaggagtgtaaa

SEQ ID NO: 5526546 - DNA, 16 bp, Homo sapiens
tgaggtgcactgggag

SEQ ID NO: 5526547 - DNA, 17 bp, Homo sapiens
tgaggtgcccactccgc

SEQ ID NO: 5526548 - DNA, 20 bp, Homo sapiens
tgaggtgcccactccgccag

SEQ ID NO: 5526549 - DNA, 12 bp, Homo sapiens
tgaggtgcccag

SEQ ID NO: 5526550 - DNA, 21 bp, Homo sapiens
tgaggtgcccagctagctgca

SEQ ID NO: 5526551 - DNA, 17 bp, Homo sapiens
tgaggtgcccaggagaa

SEQ ID NO: 5526552 - DNA, 18 bp, Homo sapiens
tgaggtgcccaggagaag

SEQ ID NO: 5526553 - DNA, 22 bp, Homo sapiens
tgaggtgcctcccagtggcctg

SEQ ID NO: 5526554 - DNA, 12 bp, Homo sapiens
tgaggtgcctgc

SEQ ID NO: 5526555 - DNA, 16 bp, Homo sapiens
tgaggtgcctgctcag

SEQ ID NO: 5526556 - DNA, 22 bp, Homo sapiens
tgaggtgcctgctcaggtgcta

SEQ ID NO: 5526557 - DNA, 15 bp, Homo sapiens
tgaggtgcctgtccc

SEQ ID NO: 5526558 - DNA, 16 bp, Homo sapiens
tgaggtgcctgtccca

SEQ ID NO: 5526559 - DNA, 15 bp, Homo sapiens
tgaggtgctgatctg

SEQ ID NO: 5526560 - DNA, 14 bp, Homo sapiens
tgaggtgctgatga

SEQ ID NO: 5526561 - DNA, 15 bp, Homo sapiens
tgaggtgctgggagg

SEQ ID NO: 5526562 - DNA, 21 bp, Homo sapiens
tgaggtggaagccctccttcc

SEQ ID NO: 5526563 - DNA, 22 bp, Homo sapiens
tgaggtggaagccctccttcca

SEQ ID NO: 5526564 - DNA, 18 bp, Homo sapiens
tgaggtggcactttttca

SEQ ID NO: 5526565 - DNA, 21 bp, Homo sapiens
tgaggtggcactttttcattt

SEQ ID NO: 5526566 - DNA, 18 bp, Homo sapiens
tgaggtggcatggtccat

SEQ ID NO: 5526567 - DNA, 12 bp, Homo sapiens
tgaggtggccca

SEQ ID NO: 5526568 - DNA, 16 bp, Homo sapiens
tgaggtggcccaggcc

SEQ ID NO: 5526569 - DNA, 21 bp, Homo sapiens
tgaggtggcccaggcccccgg

SEQ ID NO: 5526570 - DNA, 20 bp, Homo sapiens
tgaggtgggcagatcacgag

SEQ ID NO: 5526571 - DNA, 16 bp, Homo sapiens
tgaggtgggcccagga

SEQ ID NO: 5526572 - DNA, 12 bp, Homo sapiens
tgaggtgggcct

SEQ ID NO: 5526573 - DNA, 13 bp, Homo sapiens
tgaggtgggctga

SEQ ID NO: 5526574 - DNA, 15 bp, Homo sapiens
tgaggtggggaagga

SEQ ID NO: 5526575 - DNA, 16 bp, Homo sapiens
tgaggtggggaaggag

SEQ ID NO: 5526576 - DNA, 20 bp, Homo sapiens
tgaggtggggaatcatttta

SEQ ID NO: 5526577 - DNA, 14 bp, Homo sapiens
tgaggtgggggcag

SEQ ID NO: 5526578 - DNA, 18 bp, Homo sapiens
tgaggtgggtgggcctga

SEQ ID NO: 5526579 - DNA, 20 bp, Homo sapiens
tgaggtgggtgggcctgact

SEQ ID NO: 5526580 - DNA, 18 bp, Homo sapiens
tgaggtggtactatgatt

SEQ ID NO: 5526581 - DNA, 21 bp, Homo sapiens
tgaggtggtagtaaaacacag

SEQ ID NO: 5526582 - DNA, 14 bp, Homo sapiens
tgaggtggtctgaa

SEQ ID NO: 5526583 - DNA, 21 bp, Homo sapiens
tgaggtgtctggcctgaggtc

SEQ ID NO: 5526584 - DNA, 22 bp, Homo sapiens
tgaggttagcccaatggagaaa

SEQ ID NO: 5526585 - DNA, 15 bp, Homo sapiens
tgaggttcagcaagg

SEQ ID NO: 5526586 - DNA, 24 bp, Homo sapiens
tgaggttcagcaaggtgagagagg

SEQ ID NO: 5526587 - DNA, 14 bp, Homo sapiens
tgaggttcctctgc

SEQ ID NO: 5526588 - DNA, 15 bp, Homo sapiens
tgaggttcctctgcc

SEQ ID NO: 5526589 - DNA, 18 bp, Homo sapiens
tgaggttcctctgcctgc

SEQ ID NO: 5526590 - DNA, 15 bp, Homo sapiens
tgaggttctcatttt

SEQ ID NO: 5526591 - DNA, 14 bp, Homo sapiens
tgaggttctttccc

SEQ ID NO: 5526592 - DNA, 14 bp, Homo sapiens
tgaggttgagctat

SEQ ID NO: 5526593 - DNA, 21 bp, Homo sapiens
tgaggttgagctatgatatgt

SEQ ID NO: 5526594 - DNA, 16 bp, Homo sapiens
tgaggttgaggaatat

SEQ ID NO: 5526595 - DNA, 16 bp, Homo sapiens
tgaggttgctagagaa

SEQ ID NO: 5526596 - DNA, 16 bp, Homo sapiens
tgaggtttcacctccg

SEQ ID NO: 5526597 - DNA, 13 bp, Homo sapiens
tgaggtttcccaa

SEQ ID NO: 5526598 - DNA, 14 bp, Homo sapiens
tgaggtttcccaat

SEQ ID NO: 5526599 - DNA, 21 bp, Homo sapiens
tgaggtttccttcagacagat

SEQ ID NO: 5526600 - DNA, 16 bp, Homo sapiens
tgaggtttgaaaagct

SEQ ID NO: 5526601 - DNA, 15 bp, Homo sapiens
tgaggtttggaagag

SEQ ID NO: 5526602 - DNA, 22 bp, Homo sapiens
tgaggttttgaataaaaagtga

SEQ ID NO: 5526603 - DNA, 15 bp, Homo sapiens
tgaggttttggaaaa

SEQ ID NO: 5526604 - DNA, 20 bp, Homo sapiens
tgagtaaaacacatattcaa

SEQ ID NO: 5526605 - DNA, 13 bp, Homo sapiens
tgagtaaaagcag

SEQ ID NO: 5526606 - DNA, 22 bp, Homo sapiens
tgagtaaaataaatattgtctt

SEQ ID NO: 5526607 - DNA, 16 bp, Homo sapiens
tgagtaaaatcacaga

SEQ ID NO: 5526608 - DNA, 14 bp, Homo sapiens
tgagtaaacataaa

SEQ ID NO: 5526609 - DNA, 19 bp, Homo sapiens
tgagtaaactgtttctcag

SEQ ID NO: 5526610 - DNA, 16 bp, Homo sapiens
tgagtaaataaactct

SEQ ID NO: 5526611 - DNA, 15 bp, Homo sapiens
tgagtaaatattgag

SEQ ID NO: 5526612 - DNA, 23 bp, Homo sapiens
tgagtctgtgtggccagcagcct

SEQ ID NO: 5526613 - DNA, 17 bp, Homo sapiens
tgagtctgtttcccaag

SEQ ID NO: 5526614 - DNA, 14 bp, Homo sapiens
tgagtcttaactgt

SEQ ID NO: 5526615 - DNA, 17 bp, Homo sapiens
tgagtcttaactgtatt

SEQ ID NO: 5526616 - DNA, 18 bp, Homo sapiens
tgagtcttaactgtattt

SEQ ID NO: 5526617 - DNA, 23 bp, Homo sapiens
tgagtcttaactgtatttcagta

SEQ ID NO: 5526618 - DNA, 15 bp, Homo sapiens
tgagtcttggcctgc

SEQ ID NO: 5526619 - DNA, 16 bp, Homo sapiens
tgagtcttggcggcag

SEQ ID NO: 5526620 - DNA, 23 bp, Homo sapiens
tgagtcttggcggcagcagccat

SEQ ID NO: 5526621 - DNA, 15 bp, Homo sapiens
tgagtcttggttcta

SEQ ID NO: 5526622 - DNA, 18 bp, Homo sapiens
tgagtcttggttctaaag

SEQ ID NO: 5526623 - DNA, 21 bp, Homo sapiens
tgagtctttgaagatagtttt

SEQ ID NO: 5526624 - DNA, 16 bp, Homo sapiens
tgagtctttggttcta

SEQ ID NO: 5526625 - DNA, 17 bp, Homo sapiens
tgagtctttggttctaa

SEQ ID NO: 5526626 - DNA, 20 bp, Homo sapiens
tgagtcttttttttttaagt

SEQ ID NO: 5526627 - DNA, 23 bp, Homo sapiens
tgagtgaaaatttttacattcat

SEQ ID NO: 5526628 - DNA, 15 bp, Homo sapiens
tgagtgaaagtactt

SEQ ID NO: 5526629 - DNA, 21 bp, Homo sapiens
tgagtgaaatactgtacaggg

SEQ ID NO: 5526630 - DNA, 15 bp, Homo sapiens
tgagtgaataaatgt

SEQ ID NO: 5526631 - DNA, 15 bp, Homo sapiens
tgagtgaatagcttt

SEQ ID NO: 5526632 - DNA, 12 bp, Homo sapiens
tgagtgaatcaa

SEQ ID NO: 5526633 - DNA, 18 bp, Homo sapiens
tgagtgaatcaggcaaag

SEQ ID NO: 5526634 - DNA, 13 bp, Homo sapiens
tgagtgaatgtta

SEQ ID NO: 5526635 - DNA, 19 bp, Homo sapiens
tgagtgacaaagcctctga

SEQ ID NO: 5526636 - DNA, 17 bp, Homo sapiens
tgagtgacagctttctg

SEQ ID NO: 5526637 - DNA, 19 bp, Homo sapiens
tgagtgacatagcctcatg

SEQ ID NO: 5526638 - DNA, 20 bp, Homo sapiens
tgagtgacatcggttcagga

SEQ ID NO: 5526639 - DNA, 16 bp, Homo sapiens
tgagtgacatgcggct

SEQ ID NO: 5526640 - DNA, 18 bp, Homo sapiens
tgagtgacctcacttctg

SEQ ID NO: 5526641 - DNA, 18 bp, Homo sapiens
tgagtgactcggtgtaaa

SEQ ID NO: 5526642 - DNA, 23 bp, Homo sapiens
tgagtgagaggcgacaggagtat

SEQ ID NO: 5526643 - DNA, 15 bp, Homo sapiens
tgagtgagccacaga

SEQ ID NO: 5526644 - DNA, 23 bp, Homo sapiens
tgagtgagccacagaccacctgc

SEQ ID NO: 5526645 - DNA, 17 bp, Homo sapiens
tgagtgagcctggctct

SEQ ID NO: 5526646 - DNA, 14 bp, Homo sapiens
tgagtgagggcata

SEQ ID NO: 5526647 - DNA, 14 bp, Homo sapiens
tgagtgataaattt

SEQ ID NO: 5526648 - DNA, 14 bp, Homo sapiens
tgagtgatcactgg

SEQ ID NO: 5526649 - DNA, 15 bp, Homo sapiens
tgagtgatcctccaa

SEQ ID NO: 5526650 - DNA, 16 bp, Homo sapiens
tgagtgatctcaaatc

SEQ ID NO: 5526651 - DNA, 15 bp, Homo sapiens
tgagtgcaacaagag

SEQ ID NO: 5526652 - DNA, 17 bp, Homo sapiens
tgagtgcaagagcctga

SEQ ID NO: 5526653 - DNA, 23 bp, Homo sapiens
tgagtgcaagagcctgagactgg

SEQ ID NO: 5526654 - DNA, 15 bp, Homo sapiens
tgagtgcaagcaaag

SEQ ID NO: 5526655 - DNA, 19 bp, Homo sapiens
tgagtgcaagcaaagcaga

SEQ ID NO: 5526656 - DNA, 16 bp, Homo sapiens
tgagtgcagccaaagg

SEQ ID NO: 5526657 - DNA, 13 bp, Homo sapiens
tgagtgcaggccc

SEQ ID NO: 5526658 - DNA, 17 bp, Homo sapiens
tgagtgccaatttctta

SEQ ID NO: 5526659 - DNA, 17 bp, Homo sapiens
tgagtgccatgcttttt

SEQ ID NO: 5526660 - DNA, 20 bp, Homo sapiens
tgagtgcccactacgtgcca

SEQ ID NO: 5526661 - DNA, 20 bp, Homo sapiens
tgagtgccccacttctggcc

SEQ ID NO: 5526662 - DNA, 15 bp, Homo sapiens
tgagtgcctgcagca

SEQ ID NO: 5526663 - DNA, 16 bp, Homo sapiens
tgagtgcctgcagcat

SEQ ID NO: 5526664 - DNA, 12 bp, Homo sapiens
tgagtgcctggc

SEQ ID NO: 5526665 - DNA, 16 bp, Homo sapiens
tgagtgccttacacaa

SEQ ID NO: 5526666 - DNA, 20 bp, Homo sapiens
tgagtgccttacacaatggt

SEQ ID NO: 5526667 - DNA, 12 bp, Homo sapiens
tgagtgccttct

SEQ ID NO: 5526668 - DNA, 19 bp, Homo sapiens
tgagtgccttttgcagaag

SEQ ID NO: 5526669 - DNA, 21 bp, Homo sapiens
tgagtgcgcagatctgtgcct

SEQ ID NO: 5526670 - DNA, 19 bp, Homo sapiens
tgagtgcgggctgaggcca

SEQ ID NO: 5526671 - DNA, 21 bp, Homo sapiens
tgagtgcgggctgaggccaga

SEQ ID NO: 5526672 - DNA, 12 bp, Homo sapiens
tgagtgctctga

SEQ ID NO: 5526673 - DNA, 13 bp, Homo sapiens
tgagtgctctgat

SEQ ID NO: 5526674 - DNA, 22 bp, Homo sapiens
tgagtgctgattcaaaccaaag

SEQ ID NO: 5526675 - DNA, 23 bp, Homo sapiens
tgagtgctgattcaaaccaaagc

SEQ ID NO: 5526676 - DNA, 23 bp, Homo sapiens
tgagtgctgggcactgctccaag

SEQ ID NO: 5526677 - DNA, 20 bp, Homo sapiens
tgagtgcttgttagagagaa

SEQ ID NO: 5526678 - DNA, 15 bp, Homo sapiens
tgagtggaaatacac

SEQ ID NO: 5526679 - DNA, 14 bp, Homo sapiens
tgagtggacagcag

SEQ ID NO: 5526680 - DNA, 17 bp, Homo sapiens
tgagtggacagcagctg

SEQ ID NO: 5526681 - DNA, 21 bp, Homo sapiens
tgagtggacgtcagaagaatc

SEQ ID NO: 5526682 - DNA, 13 bp, Homo sapiens
tgagtggactgga

SEQ ID NO: 5526683 - DNA, 20 bp, Homo sapiens
tgagtggactggagtggagc

SEQ ID NO: 5526684 - DNA, 21 bp, Homo sapiens
tgagtggatggatggacagaa

SEQ ID NO: 5526685 - DNA, 13 bp, Homo sapiens
tgagtggcagcag

SEQ ID NO: 5526686 - DNA, 15 bp, Homo sapiens
tgagtggcagccatg

SEQ ID NO: 5526687 - DNA, 16 bp, Homo sapiens
tgagtggcagccatgc

SEQ ID NO: 5526688 - DNA, 17 bp, Homo sapiens
tgagtggccagccagtg

SEQ ID NO: 5526689 - DNA, 18 bp, Homo sapiens
tgagtggccagcgccagg

SEQ ID NO: 5526690 - DNA, 14 bp, Homo sapiens
tgagtggccaggga

SEQ ID NO: 5526691 - DNA, 12 bp, Homo sapiens
tgagtggcccca

SEQ ID NO: 5526692 - DNA, 18 bp, Homo sapiens
tgagtggcggggcccctg

SEQ ID NO: 5526693 - DNA, 17 bp, Homo sapiens
tgagtggctgacagagc

SEQ ID NO: 5526694 - DNA, 23 bp, Homo sapiens
tgagtggcttcactcctgctgta

SEQ ID NO: 5526695 - DNA, 20 bp, Homo sapiens
tgagtggcttgtgattctgg

SEQ ID NO: 5526696 - DNA, 21 bp, Homo sapiens
tgagtggcttgtgattctggg

SEQ ID NO: 5526697 - DNA, 15 bp, Homo sapiens
tgagtgggagctgtc

SEQ ID NO: 5526698 - DNA, 15 bp, Homo sapiens
tgagtgggccctgcc

SEQ ID NO: 5526699 - DNA, 16 bp, Homo sapiens
tgagtgggccctgccc

SEQ ID NO: 5526700 - DNA, 22 bp, Homo sapiens
tgagtgggccctgcccggggag

SEQ ID NO: 5526701 - DNA, 19 bp, Homo sapiens
tgagtggggagacacctca

SEQ ID NO: 5526702 - DNA, 21 bp, Homo sapiens
tgagtggggagacacctcaga

SEQ ID NO: 5526703 - DNA, 17 bp, Homo sapiens
tgagtggggcttcctgg

SEQ ID NO: 5526704 - DNA, 21 bp, Homo sapiens
tgagtgggtgaataatacagt

SEQ ID NO: 5526705 - DNA, 14 bp, Homo sapiens
tgagtggtcactgg

SEQ ID NO: 5526706 - DNA, 18 bp, Homo sapiens
tgagtggtcactggtcag

SEQ ID NO: 5526707 - DNA, 19 bp, Homo sapiens
tgagtggtcactggtcagg

SEQ ID NO: 5526708 - DNA, 16 bp, Homo sapiens
tgagtggtgaggggcc

SEQ ID NO: 5526709 - DNA, 15 bp, Homo sapiens
tgagtggtggttcct

SEQ ID NO: 5526710 - DNA, 18 bp, Homo sapiens
tgagtggtggttcctttg

SEQ ID NO: 5526711 - DNA, 20 bp, Homo sapiens
tgagtggtggttcctttgca

SEQ ID NO: 5526712 - DNA, 19 bp, Homo sapiens
tgagtgtaacaagaaagga

SEQ ID NO: 5526713 - DNA, 15 bp, Homo sapiens
tgagtgtaagtgtga

SEQ ID NO: 5526714 - DNA, 21 bp, Homo sapiens
tgagtgtacagattttattta

SEQ ID NO: 5526715 - DNA, 22 bp, Homo sapiens
tgagtgtacatttatgtgtgaa

SEQ ID NO: 5526716 - DNA, 14 bp, Homo sapiens
tgagtgtatgagta

SEQ ID NO: 5526717 - DNA, 14 bp, Homo sapiens
tgagtgtatgtata

SEQ ID NO: 5526718 - DNA, 16 bp, Homo sapiens
tgagtgtatgtataca

SEQ ID NO: 5526719 - DNA, 22 bp, Homo sapiens
tgagtgtatgtatacacacaca

SEQ ID NO: 5526720 - DNA, 16 bp, Homo sapiens
tgagtgtatgtgtgtg

SEQ ID NO: 5526721 - DNA, 21 bp, Homo sapiens
tgagtgtcaaacgtgcccccc

SEQ ID NO: 5526722 - DNA, 15 bp, Homo sapiens
tgagtgtctgcgccc

SEQ ID NO: 5526723 - DNA, 18 bp, Homo sapiens
tgagtgtctgcgccccgc

SEQ ID NO: 5526724 - DNA, 15 bp, Homo sapiens
tgagtgtctgtgaga

SEQ ID NO: 5526725 - DNA, 18 bp, Homo sapiens
tgagtgtcttaattaaaa

SEQ ID NO: 5526726 - DNA, 13 bp, Homo sapiens
tgagtgtgaagct

SEQ ID NO: 5526727 - DNA, 14 bp, Homo sapiens
tgagtgtgaagctt

SEQ ID NO: 5526728 - DNA, 17 bp, Homo sapiens
tgagtgtgactttttga

SEQ ID NO: 5526729 - DNA, 11 bp, Homo sapiens
tgagtgtgaga

SEQ ID NO: 5526730 - DNA, 20 bp, Homo sapiens
tgagtgtgagggcagcactg

SEQ ID NO: 5526731 - DNA, 22 bp, Homo sapiens
tgagtgtgagggcagcactggg

SEQ ID NO: 5526732 - DNA, 21 bp, Homo sapiens
tgagtgtgatgggccaccggg

SEQ ID NO: 5526733 - DNA, 18 bp, Homo sapiens
tgagtgtgcaatatgtaa

SEQ ID NO: 5526734 - DNA, 19 bp, Homo sapiens
tgagtgtgccagagttatt

SEQ ID NO: 5526735 - DNA, 22 bp, Homo sapiens
tgagtgtgcggctgtgtgtgca

SEQ ID NO: 5526736 - DNA, 15 bp, Homo sapiens
tgagtgtgctgctgt

SEQ ID NO: 5526737 - DNA, 22 bp, Homo sapiens
tgagtgtgggagtgcagagaaa

SEQ ID NO: 5526738 - DNA, 21 bp, Homo sapiens
tgagtgtgtggtctctgcccc

SEQ ID NO: 5526739 - DNA, 11 bp, Homo sapiens
tgagtgtgtgt

SEQ ID NO: 5526740 - DNA, 13 bp, Homo sapiens
tgagtgtgtgtgc

SEQ ID NO: 5526741 - DNA, 14 bp, Homo sapiens
tgagtgtgtgtgct

SEQ ID NO: 5526742 - DNA, 16 bp, Homo sapiens
tgagtgtgtgtgtgca

SEQ ID NO: 5526743 - DNA, 23 bp, Homo sapiens
tgagtgttcaaactactgtacat

SEQ ID NO: 5526744 - DNA, 14 bp, Homo sapiens
tgagtgtttctatg

SEQ ID NO: 5526745 - DNA, 19 bp, Homo sapiens
tgagtgttttatgagaaag

SEQ ID NO: 5526746 - DNA, 21 bp, Homo sapiens
tgagtgttttatgagaaagcc

SEQ ID NO: 5526747 - DNA, 22 bp, Homo sapiens
tgagttaaagagaggccccggc

SEQ ID NO: 5526748 - DNA, 14 bp, Homo sapiens
tgagttaacaggac

SEQ ID NO: 5526749 - DNA, 16 bp, Homo sapiens
tgagttaacaggacag

SEQ ID NO: 5526750 - DNA, 13 bp, Homo sapiens
tgagttaactgtg

SEQ ID NO: 5526751 - DNA, 14 bp, Homo sapiens
tgagttaagtctat

SEQ ID NO: 5526752 - DNA, 23 bp, Homo sapiens
tgagttacattaaaataaaccaa

SEQ ID NO: 5526753 - DNA, 14 bp, Homo sapiens
tgagttagctgttt

SEQ ID NO: 5526754 - DNA, 20 bp, Homo sapiens
tgagttatatgttcactgtc

SEQ ID NO: 5526755 - DNA, 16 bp, Homo sapiens
tgagttatattggaat

SEQ ID NO: 5526756 - DNA, 12 bp, Homo sapiens
tgagttatcatg

SEQ ID NO: 5526757 - DNA, 20 bp, Homo sapiens
tgagttatcatgaattttaa

SEQ ID NO: 5526758 - DNA, 21 bp, Homo sapiens
tgagttatcatgaattttaaa

SEQ ID NO: 5526759 - DNA, 23 bp, Homo sapiens
tgagttatcatgaattttaaagt

SEQ ID NO: 5526760 - DNA, 15 bp, Homo sapiens
tgagttatctaagaa

SEQ ID NO: 5526761 - DNA, 16 bp, Homo sapiens
tgagttatctgatttt

SEQ ID NO: 5526762 - DNA, 15 bp, Homo sapiens
tgagttatgatgtaa

SEQ ID NO: 5526763 - DNA, 21 bp, Homo sapiens
tgagttattaactgtattttc

SEQ ID NO: 5526764 - DNA, 23 bp, Homo sapiens
tgagttattccttgatcattttg

SEQ ID NO: 5526765 - DNA, 15 bp, Homo sapiens
tgagttcacatgtgc

SEQ ID NO: 5526766 - DNA, 20 bp, Homo sapiens
tgagttcacatgtgccctgc

SEQ ID NO: 5526767 - DNA, 22 bp, Homo sapiens
tgagttcacatgtgccctgcct

SEQ ID NO: 5526768 - DNA, 16 bp, Homo sapiens
tgagttcaccatctct

SEQ ID NO: 5526769 - DNA, 18 bp, Homo sapiens
tgagttcataccctgtta

SEQ ID NO: 5526770 - DNA, 17 bp, Homo sapiens
tgagttccagaaagtaa

SEQ ID NO: 5526771 - DNA, 16 bp, Homo sapiens
tgagttccagttgaag

SEQ ID NO: 5526772 - DNA, 18 bp, Homo sapiens
tgagttcccaaagggagg

SEQ ID NO: 5526773 - DNA, 23 bp, Homo sapiens
tgagttcccaaagggagggtggc

SEQ ID NO: 5526774 - DNA, 13 bp, Homo sapiens
tgagttcccggga

SEQ ID NO: 5526775 - DNA, 20 bp, Homo sapiens
tgagttcccgggagctgggc

SEQ ID NO: 5526776 - DNA, 17 bp, Homo sapiens
tgagttccggcaccagt

SEQ ID NO: 5526777 - DNA, 18 bp, Homo sapiens
tgagttcctagccaccgc

SEQ ID NO: 5526778 - DNA, 19 bp, Homo sapiens
tgagttcctggaatggcac

SEQ ID NO: 5526779 - DNA, 21 bp, Homo sapiens
tgagttctcactatgtttctc

SEQ ID NO: 5526780 - DNA, 18 bp, Homo sapiens
tgagttctcagggctcct

SEQ ID NO: 5526781 - DNA, 14 bp, Homo sapiens
tgagttctcatcca

SEQ ID NO: 5526782 - DNA, 17 bp, Homo sapiens
tgagttctgcacataca

SEQ ID NO: 5526783 - DNA, 19 bp, Homo sapiens
tgagttctgcacatacaga

SEQ ID NO: 5526784 - DNA, 14 bp, Homo sapiens
tgagttctgctgaa

SEQ ID NO: 5526785 - DNA, 15 bp, Homo sapiens
tgagttctgtgtatt

SEQ ID NO: 5526786 - DNA, 17 bp, Homo sapiens
tgagttcttcctgtaat

SEQ ID NO: 5526787 - DNA, 19 bp, Homo sapiens
tgagttcttgtgtcctggt

SEQ ID NO: 5526788 - DNA, 13 bp, Homo sapiens
tgagttctttttc

SEQ ID NO: 5526789 - DNA, 19 bp, Homo sapiens
tgatatctcaatctgcagc

SEQ ID NO: 5526790 - DNA, 16 bp, Homo sapiens
tgatatctgaatgttc

SEQ ID NO: 5526791 - DNA, 19 bp, Homo sapiens
tgatatctgtttgcttcta

SEQ ID NO: 5526792 - DNA, 15 bp, Homo sapiens
tgatatgaaaaatat

SEQ ID NO: 5526793 - DNA, 19 bp, Homo sapiens
tgatatgaaaaatatgata

SEQ ID NO: 5526794 - DNA, 16 bp, Homo sapiens
tgatatgagtatacaa

SEQ ID NO: 5526795 - DNA, 17 bp, Homo sapiens
tgatatgagtatacaat

SEQ ID NO: 5526796 - DNA, 19 bp, Homo sapiens
tgatatgagtatacaatat

SEQ ID NO: 5526797 - DNA, 20 bp, Homo sapiens
tgatatgattgtaacatatt

SEQ ID NO: 5526798 - DNA, 19 bp, Homo sapiens
tgatatgatttaaaacatg

SEQ ID NO: 5526799 - DNA, 11 bp, Homo sapiens
tgatatgcatg

SEQ ID NO: 5526800 - DNA, 13 bp, Homo sapiens
tgatatgcatgta

SEQ ID NO: 5526801 - DNA, 14 bp, Homo sapiens
tgatatgctgagaa

SEQ ID NO: 5526802 - DNA, 18 bp, Homo sapiens
tgatatgctgagaaatta

SEQ ID NO: 5526803 - DNA, 20 bp, Homo sapiens
tgatatgctgagaaattatt

SEQ ID NO: 5526804 - DNA, 17 bp, Homo sapiens
tgatatggagccctgta

SEQ ID NO: 5526805 - DNA, 12 bp, Homo sapiens
tgatatggaggt

SEQ ID NO: 5526806 - DNA, 15 bp, Homo sapiens
tgatatggcagaaga

SEQ ID NO: 5526807 - DNA, 15 bp, Homo sapiens
tgatatgggctttct

SEQ ID NO: 5526808 - DNA, 15 bp, Homo sapiens
tgatatggttttatt

SEQ ID NO: 5526809 - DNA, 14 bp, Homo sapiens
tgatatgtctttaa

SEQ ID NO: 5526810 - DNA, 23 bp, Homo sapiens
tgatatgtgcttgtgtgtatgtc

SEQ ID NO: 5526811 - DNA, 16 bp, Homo sapiens
tgatatgtgtaatatc

SEQ ID NO: 5526812 - DNA, 19 bp, Homo sapiens
tgatatgtgtaatatcatt

SEQ ID NO: 5526813 - DNA, 12 bp, Homo sapiens
tgatatgttgat

SEQ ID NO: 5526814 - DNA, 16 bp, Homo sapiens
tgatatgttttatttc

SEQ ID NO: 5526815 - DNA, 23 bp, Homo sapiens
tgatatgttttatttcattggtt

SEQ ID NO: 5526816 - DNA, 17 bp, Homo sapiens
tgatattaaatttcaaa

SEQ ID NO: 5526817 - DNA, 20 bp, Homo sapiens
tgatattaaatttcaaatgc

SEQ ID NO: 5526818 - DNA, 21 bp, Homo sapiens
tgatattacaggactgcagaa

SEQ ID NO: 5526819 - DNA, 14 bp, Homo sapiens
tgatattatttctt

SEQ ID NO: 5526820 - DNA, 16 bp, Homo sapiens
tgatattatttcttct

SEQ ID NO: 5526821 - DNA, 14 bp, Homo sapiens
tgatattcagaatt

SEQ ID NO: 5526822 - DNA, 16 bp, Homo sapiens
tgatattccatgaatg

SEQ ID NO: 5526823 - DNA, 21 bp, Homo sapiens
tgatattccccccacttaaga

SEQ ID NO: 5526824 - DNA, 17 bp, Homo sapiens
tgatattctaagactta

SEQ ID NO: 5526825 - DNA, 22 bp, Homo sapiens
tgatattgacactgtccctctt

SEQ ID NO: 5526826 - DNA, 13 bp, Homo sapiens
tgatattgagaca

SEQ ID NO: 5526827 - DNA, 18 bp, Homo sapiens
tgatattgagacattaat

SEQ ID NO: 5526828 - DNA, 15 bp, Homo sapiens
tgatattgctgtgag

SEQ ID NO: 5526829 - DNA, 21 bp, Homo sapiens
tgatattggaggaatacttct

SEQ ID NO: 5526830 - DNA, 13 bp, Homo sapiens
tgatattgtgtag

SEQ ID NO: 5526831 - DNA, 15 bp, Homo sapiens
tgatattgttctcca

SEQ ID NO: 5526832 - DNA, 22 bp, Homo sapiens
tgatatttaagcagcttgaatg

SEQ ID NO: 5526833 - DNA, 15 bp, Homo sapiens
tgatatttaggtttt

SEQ ID NO: 5526834 - DNA, 14 bp, Homo sapiens
tgatatttatagaa

SEQ ID NO: 5526835 - DNA, 22 bp, Homo sapiens
tgatatttattatatttttccc

SEQ ID NO: 5526836 - DNA, 17 bp, Homo sapiens
tgatatttatttcctgc

SEQ ID NO: 5526837 - DNA, 12 bp, Homo sapiens
tgatatttcaga

SEQ ID NO: 5526838 - DNA, 14 bp, Homo sapiens
tgatatttcagaaa

SEQ ID NO: 5526839 - DNA, 17 bp, Homo sapiens
tgatatttctagcttat

SEQ ID NO: 5526840 - DNA, 15 bp, Homo sapiens
tgatatttctctagt

SEQ ID NO: 5526841 - DNA, 16 bp, Homo sapiens
tgatatttctctagta

SEQ ID NO: 5526842 - DNA, 16 bp, Homo sapiens
tgatatttcttgcttt

SEQ ID NO: 5526843 - DNA, 17 bp, Homo sapiens
tgatatttgacagacat

SEQ ID NO: 5526844 - DNA, 21 bp, Homo sapiens
tgatatttgacagacatcctt

SEQ ID NO: 5526845 - DNA, 21 bp, Homo sapiens
tgatatttgcattgaggaaat

SEQ ID NO: 5526846 - DNA, 15 bp, Homo sapiens
tgatatttgtattta

SEQ ID NO: 5526847 - DNA, 18 bp, Homo sapiens
tgatatttgtatttattc

SEQ ID NO: 5526848 - DNA, 19 bp, Homo sapiens
tgatattttcaacgcagcc

SEQ ID NO: 5526849 - DNA, 23 bp, Homo sapiens
tgatattttcaacgcagccctgc

SEQ ID NO: 5526850 - DNA, 21 bp, Homo sapiens
tgatattttccctttttaaaa

SEQ ID NO: 5526851 - DNA, 20 bp, Homo sapiens
tgatattttgtctcctacct

SEQ ID NO: 5526852 - DNA, 15 bp, Homo sapiens
tgatatttttatgtg

SEQ ID NO: 5526853 - DNA, 13 bp, Homo sapiens
tgatatttttcca

SEQ ID NO: 5526854 - DNA, 17 bp, Homo sapiens
tgatattttttatcata

SEQ ID NO: 5526855 - DNA, 15 bp, Homo sapiens
tgatatttttttaag

SEQ ID NO: 5526856 - DNA, 16 bp, Homo sapiens
tgatatttttttaagt

SEQ ID NO: 5526857 - DNA, 17 bp, Homo sapiens
tgatcaaaaataaacta

SEQ ID NO: 5526858 - DNA, 17 bp, Homo sapiens
tgatcaaaaataatgca

SEQ ID NO: 5526859 - DNA, 18 bp, Homo sapiens
tgatcaaaacctgtgcca

SEQ ID NO: 5526860 - DNA, 15 bp, Homo sapiens
tgatcaaaatcaaaa

SEQ ID NO: 5526861 - DNA, 18 bp, Homo sapiens
tgatcaaaatcaaaaggt

SEQ ID NO: 5526862 - DNA, 19 bp, Homo sapiens
tgatcaaaatcaattaaaa

SEQ ID NO: 5526863 - DNA, 13 bp, Homo sapiens
tgatcaaaatgca

SEQ ID NO: 5526864 - DNA, 14 bp, Homo sapiens
tgatcaaaatgcat

SEQ ID NO: 5526865 - DNA, 19 bp, Homo sapiens
tgatcaaaattacttttct

SEQ ID NO: 5526866 - DNA, 14 bp, Homo sapiens
tgatcaaatgttta

SEQ ID NO: 5526867 - DNA, 15 bp, Homo sapiens
tgatcaaatgtttaa

SEQ ID NO: 5526868 - DNA, 17 bp, Homo sapiens
tgatcaaatgtttaatc

SEQ ID NO: 5526869 - DNA, 18 bp, Homo sapiens
tgatcaaatgtttaatca

SEQ ID NO: 5526870 - DNA, 17 bp, Homo sapiens
tgatcaacatcttttct

SEQ ID NO: 5526871 - DNA, 18 bp, Homo sapiens
tgatcaacatcttttctt

SEQ ID NO: 5526872 - DNA, 21 bp, Homo sapiens
tgatcaacatcttttcttgcc

SEQ ID NO: 5526873 - DNA, 23 bp, Homo sapiens
tgatcaagatatatgtgtataca

SEQ ID NO: 5526874 - DNA, 24 bp, Homo sapiens
tgatcaagcatggaacaaagcatg

SEQ ID NO: 5526875 - DNA, 16 bp, Homo sapiens
tgatcaaggagggaga

SEQ ID NO: 5526876 - DNA, 15 bp, Homo sapiens
tgatcaaggtgctct

SEQ ID NO: 5526877 - DNA, 19 bp, Homo sapiens
tgatcaagtcctttgtgaa

SEQ ID NO: 5526878 - DNA, 14 bp, Homo sapiens
tgatcaagtggttt

SEQ ID NO: 5526879 - DNA, 13 bp, Homo sapiens
tgatcaataaaat

SEQ ID NO: 5526880 - DNA, 18 bp, Homo sapiens
tgatcaataaaatgtgat

SEQ ID NO: 5526881 - DNA, 12 bp, Homo sapiens
tgatcaatgaaa

SEQ ID NO: 5526882 - DNA, 14 bp, Homo sapiens
tgatcaatgaaatg

SEQ ID NO: 5526883 - DNA, 18 bp, Homo sapiens
tgatcaatgacagagcct

SEQ ID NO: 5526884 - DNA, 15 bp, Homo sapiens
tgatcaattaaatgt

SEQ ID NO: 5526885 - DNA, 20 bp, Homo sapiens
tgatcaattatagtttctga

SEQ ID NO: 5526886 - DNA, 21 bp, Homo sapiens
tgatcaattatagtttctgag

SEQ ID NO: 5526887 - DNA, 14 bp, Homo sapiens
tgatcacacagtgt

SEQ ID NO: 5526888 - DNA, 16 bp, Homo sapiens
tgatcacactatttta

SEQ ID NO: 5526889 - DNA, 18 bp, Homo sapiens
tgatcacagatgtgccca

SEQ ID NO: 5526890 - DNA, 24 bp, Homo sapiens
tgatcacagatgtgcccagagtag

SEQ ID NO: 5526891 - DNA, 14 bp, Homo sapiens
tgatcacaggagca

SEQ ID NO: 5526892 - DNA, 12 bp, Homo sapiens
tgatcacagtga

SEQ ID NO: 5526893 - DNA, 14 bp, Homo sapiens
tgatcacagtgact

SEQ ID NO: 5526894 - DNA, 16 bp, Homo sapiens
tgatcacagtgacttt

SEQ ID NO: 5526895 - DNA, 19 bp, Homo sapiens
tgatcacatctaaagcttt

SEQ ID NO: 5526896 - DNA, 20 bp, Homo sapiens
tgatcacatctaaagcttta

SEQ ID NO: 5526897 - DNA, 19 bp, Homo sapiens
tgatcaccgactgaaaata

SEQ ID NO: 5526898 - DNA, 14 bp, Homo sapiens
tgatcacctgccct

SEQ ID NO: 5526899 - DNA, 15 bp, Homo sapiens
tgatcacgcctggct

SEQ ID NO: 5526900 - DNA, 16 bp, Homo sapiens
tgatcacgcctggcta

SEQ ID NO: 5526901 - DNA, 15 bp, Homo sapiens
tgatcactagcctgt

SEQ ID NO: 5526902 - DNA, 19 bp, Homo sapiens
tgatcactcccagcactcc

SEQ ID NO: 5526903 - DNA, 14 bp, Homo sapiens
tgatcactgaaata

SEQ ID NO: 5526904 - DNA, 15 bp, Homo sapiens
tgatcactgagccat

SEQ ID NO: 5526905 - DNA, 22 bp, Homo sapiens
tgatcactgagccatcatttcc

SEQ ID NO: 5526906 - DNA, 22 bp, Homo sapiens
tgatcactttgttaaaaatatt

SEQ ID NO: 5526907 - DNA, 22 bp, Homo sapiens
tgatcagaagaacatgatttta

SEQ ID NO: 5526908 - DNA, 23 bp, Homo sapiens
tgatcagaagactttaattatat

SEQ ID NO: 5526909 - DNA, 15 bp, Homo sapiens
tgatcagacagcttg

SEQ ID NO: 5526910 - DNA, 22 bp, Homo sapiens
tgatcagacatacagctgccta

SEQ ID NO: 5526911 - DNA, 11 bp, Homo sapiens
tgatcagaggt

SEQ ID NO: 5526912 - DNA, 16 bp, Homo sapiens
tgatcagcaaatttaa

SEQ ID NO: 5526913 - DNA, 14 bp, Homo sapiens
tgatcagcattgtg

SEQ ID NO: 5526914 - DNA, 17 bp, Homo sapiens
tgatcagctgtttgtca

SEQ ID NO: 5526915 - DNA, 18 bp, Homo sapiens
tgatcagctgtttgtcat

SEQ ID NO: 5526916 - DNA, 17 bp, Homo sapiens
tgatcagcttattgtct

SEQ ID NO: 5526917 - DNA, 19 bp, Homo sapiens
tgatcagctttcaaagcat

SEQ ID NO: 5526918 - DNA, 12 bp, Homo sapiens
tgatcaggacct

SEQ ID NO: 5526919 - DNA, 22 bp, Homo sapiens
tgatcaggcttcctggtgagaa

SEQ ID NO: 5526920 - DNA, 19 bp, Homo sapiens
tgatcagtagtttgcattt

SEQ ID NO: 5526921 - DNA, 20 bp, Homo sapiens
tgatcagttaagaaatttca

SEQ ID NO: 5526922 - DNA, 21 bp, Homo sapiens
tgatcagttttttcacctgga

SEQ ID NO: 5526923 - DNA, 17 bp, Homo sapiens
tgatcataagtgaattt

SEQ ID NO: 5526924 - DNA, 17 bp, Homo sapiens
tgatcataattaaactg

SEQ ID NO: 5526925 - DNA, 14 bp, Homo sapiens
tgatcatagaattg

SEQ ID NO: 5526926 - DNA, 15 bp, Homo sapiens
tgatcatagaattgt

SEQ ID NO: 5526927 - DNA, 21 bp, Homo sapiens
tgatcatagctcactgcagcc

SEQ ID NO: 5526928 - DNA, 22 bp, Homo sapiens
tgatcataggggcatagccagt

SEQ ID NO: 5526929 - DNA, 19 bp, Homo sapiens
tgatcataggtatttcaaa

SEQ ID NO: 5526930 - DNA, 16 bp, Homo sapiens
tgatcatatatcataa

SEQ ID NO: 5526931 - DNA, 14 bp, Homo sapiens
tgatcatatttgtg

SEQ ID NO: 5526932 - DNA, 16 bp, Homo sapiens
tgatcatatttgtgtg

SEQ ID NO: 5526933 - DNA, 15 bp, Homo sapiens
tgatcatcatgtaga

SEQ ID NO: 5526934 - DNA, 23 bp, Homo sapiens
tgatcatcccatctaagctgcag

SEQ ID NO: 5526935 - DNA, 15 bp, Homo sapiens
tgatcatcgccagag

SEQ ID NO: 5526936 - DNA, 16 bp, Homo sapiens
tgatcatcgccagagg

SEQ ID NO: 5526937 - DNA, 13 bp, Homo sapiens
tgatcatctttgc

SEQ ID NO: 5526938 - DNA, 14 bp, Homo sapiens
tgatcatctttgct

SEQ ID NO: 5526939 - DNA, 15 bp, Homo sapiens
tgatcatgcattgtt

SEQ ID NO: 5526940 - DNA, 15 bp, Homo sapiens
tgatcatggtcagct

SEQ ID NO: 5526941 - DNA, 21 bp, Homo sapiens
tgatcatgtaaatgattatct

SEQ ID NO: 5526942 - DNA, 14 bp, Homo sapiens
tgatcatgtacttt

SEQ ID NO: 5526943 - DNA, 19 bp, Homo sapiens
tgatcatgtactttttagt

SEQ ID NO: 5526944 - DNA, 21 bp, Homo sapiens
tgatcattacatggctgtggt

SEQ ID NO: 5526945 - DNA, 22 bp, Homo sapiens
tgatcattacatggctgtggtt

SEQ ID NO: 5526946 - DNA, 16 bp, Homo sapiens
tgatcattgaaatact

SEQ ID NO: 5526947 - DNA, 18 bp, Homo sapiens
tgatcattgaaatacttt

SEQ ID NO: 5526948 - DNA, 21 bp, Homo sapiens
tgatcattgaaatacttttta

SEQ ID NO: 5526949 - DNA, 15 bp, Homo sapiens
tgatcattgcagtat

SEQ ID NO: 5526950 - DNA, 20 bp, Homo sapiens
tgatcatttattttaagcac

SEQ ID NO: 5526951 - DNA, 15 bp, Homo sapiens
tgatcatttttataa

SEQ ID NO: 5526952 - DNA, 18 bp, Homo sapiens
tgatccaagcaagactga

SEQ ID NO: 5526953 - DNA, 21 bp, Homo sapiens
tgatccaatactgttgccctt

SEQ ID NO: 5526954 - DNA, 12 bp, Homo sapiens
tgatccacactt

SEQ ID NO: 5526955 - DNA, 19 bp, Homo sapiens
tgatccacactttgggctt

SEQ ID NO: 5526956 - DNA, 21 bp, Homo sapiens
tgatccacccaaccctatctc

SEQ ID NO: 5526957 - DNA, 17 bp, Homo sapiens
tgatccacccacctcag

SEQ ID NO: 5526958 - DNA, 18 bp, Homo sapiens
tgatccacccacctcagc

SEQ ID NO: 5526959 - DNA, 21 bp, Homo sapiens
tgatccacccacctcagcctc

SEQ ID NO: 5526960 - DNA, 22 bp, Homo sapiens
tgatccacccaccttggcctcc

SEQ ID NO: 5526961 - DNA, 19 bp, Homo sapiens
tgatccacccagttacagg

SEQ ID NO: 5526962 - DNA, 20 bp, Homo sapiens
tgatccacctgcctcagcct

SEQ ID NO: 5526963 - DNA, 18 bp, Homo sapiens
tgatccacgatcgtacca

SEQ ID NO: 5526964 - DNA, 13 bp, Homo sapiens
tgatccagaagag

SEQ ID NO: 5526965 - DNA, 15 bp, Homo sapiens
tgatccagagcagag

SEQ ID NO: 5526966 - DNA, 19 bp, Homo sapiens
tgatccagcagattattca

SEQ ID NO: 5526967 - DNA, 21 bp, Homo sapiens
tgatgccaaaaaaaaatacat

SEQ ID NO: 5526968 - DNA, 18 bp, Homo sapiens
tgatgccaaaatgacttt

SEQ ID NO: 5526969 - DNA, 14 bp, Homo sapiens
tgatgccaaagcag

SEQ ID NO: 5526970 - DNA, 18 bp, Homo sapiens
tgatgccaaagcagacat

SEQ ID NO: 5526971 - DNA, 17 bp, Homo sapiens
tgatgccaaagctgctt

SEQ ID NO: 5526972 - DNA, 17 bp, Homo sapiens
tgatgccacaccaagct

SEQ ID NO: 5526973 - DNA, 22 bp, Homo sapiens
tgatgccacaccaagctgtgcc

SEQ ID NO: 5526974 - DNA, 12 bp, Homo sapiens
tgatgccagagg

SEQ ID NO: 5526975 - DNA, 21 bp, Homo sapiens
tgatgccagctgtactgagtt

SEQ ID NO: 5526976 - DNA, 14 bp, Homo sapiens
tgatgccaggacac

SEQ ID NO: 5526977 - DNA, 15 bp, Homo sapiens
tgatgccaggtgcaa

SEQ ID NO: 5526978 - DNA, 18 bp, Homo sapiens
tgatgccataaatacaag

SEQ ID NO: 5526979 - DNA, 15 bp, Homo sapiens
tgatgccattacaga

SEQ ID NO: 5526980 - DNA, 19 bp, Homo sapiens
tgatgccattacagaacca

SEQ ID NO: 5526981 - DNA, 22 bp, Homo sapiens
tgatgccatttgtcttttgtaa

SEQ ID NO: 5526982 - DNA, 16 bp, Homo sapiens
tgatgcccaccgagga

SEQ ID NO: 5526983 - DNA, 22 bp, Homo sapiens
tgatgcccaccgaggagcccca

SEQ ID NO: 5526984 - DNA, 18 bp, Homo sapiens
tgatgccctcttctcctt

SEQ ID NO: 5526985 - DNA, 21 bp, Homo sapiens
tgatgccctcttctccttgcc

SEQ ID NO: 5526986 - DNA, 19 bp, Homo sapiens
tgatgccctgctccaggga

SEQ ID NO: 5526987 - DNA, 21 bp, Homo sapiens
tgatgccgaacattaggaatt

SEQ ID NO: 5526988 - DNA, 22 bp, Homo sapiens
tgatgccgaacattaggaattg

SEQ ID NO: 5526989 - DNA, 16 bp, Homo sapiens
tgatgccgggcgccag

SEQ ID NO: 5526990 - DNA, 20 bp, Homo sapiens
tgatgccgggcgccaggaca

SEQ ID NO: 5526991 - DNA, 22 bp, Homo sapiens
tgatgccgggcgccaggacagc

SEQ ID NO: 5526992 - DNA, 16 bp, Homo sapiens
tgatgccgtcctgctg

SEQ ID NO: 5526993 - DNA, 18 bp, Homo sapiens
tgatgccgtcctgctgga

SEQ ID NO: 5526994 - DNA, 23 bp, Homo sapiens
tgatgcctctccccagagcattt

SEQ ID NO: 5526995 - DNA, 14 bp, Homo sapiens
tgatgcctctgtct

SEQ ID NO: 5526996 - DNA, 20 bp, Homo sapiens
tgatgcctgacacaggggac

SEQ ID NO: 5526997 - DNA, 21 bp, Homo sapiens
tgatgcctgacacaggggaca

SEQ ID NO: 5526998 - DNA, 11 bp, Homo sapiens
tgatgcctggc

SEQ ID NO: 5526999 - DNA, 20 bp, Homo sapiens
tgatgcctgtgaactgaact

SEQ ID NO: 5527000 - DNA, 12 bp, Homo sapiens
tgatgccttttt

SEQ ID NO: 5527001 - DNA, 16 bp, Homo sapiens
tgatgcgaaaacttga

SEQ ID NO: 5527002 - DNA, 23 bp, Homo sapiens
tgatgcgccttgctgatggcttg

SEQ ID NO: 5527003 - DNA, 23 bp, Homo sapiens
tgatgcgggccagtgctccagcc

SEQ ID NO: 5527004 - DNA, 15 bp, Homo sapiens
tgatgctagatagtt

SEQ ID NO: 5527005 - DNA, 16 bp, Homo sapiens
tgatgctcagagcttt

SEQ ID NO: 5527006 - DNA, 14 bp, Homo sapiens
tgatgctcaggctt

SEQ ID NO: 5527007 - DNA, 15 bp, Homo sapiens
tgatgctcaggcttg

SEQ ID NO: 5527008 - DNA, 20 bp, Homo sapiens
tgatgctccctcccctgccc

SEQ ID NO: 5527009 - DNA, 18 bp, Homo sapiens
tgatgctccgccaggaag

SEQ ID NO: 5527010 - DNA, 14 bp, Homo sapiens
tgatgctcctccgg

SEQ ID NO: 5527011 - DNA, 15 bp, Homo sapiens
tgatgctctggcttg

SEQ ID NO: 5527012 - DNA, 23 bp, Homo sapiens
tgatgctctggcttgccccagga

SEQ ID NO: 5527013 - DNA, 19 bp, Homo sapiens
tgatgctctttcccaccca

SEQ ID NO: 5527014 - DNA, 17 bp, Homo sapiens
tgatgctgagcccggaa

SEQ ID NO: 5527015 - DNA, 21 bp, Homo sapiens
tgatgctgccggcacagctgg

SEQ ID NO: 5527016 - DNA, 19 bp, Homo sapiens
tgatgctgctatatccact

SEQ ID NO: 5527017 - DNA, 13 bp, Homo sapiens
tgatgctgggctg

SEQ ID NO: 5527018 - DNA, 15 bp, Homo sapiens
tgatgctgtatttgc

SEQ ID NO: 5527019 - DNA, 20 bp, Homo sapiens
tgatgctgtgctatgaattt

SEQ ID NO: 5527020 - DNA, 13 bp, Homo sapiens
tgatgctgtgtgc

SEQ ID NO: 5527021 - DNA, 13 bp, Homo sapiens
tgatgctgttaac

SEQ ID NO: 5527022 - DNA, 17 bp, Homo sapiens
tgatgcttacatctgga

SEQ ID NO: 5527023 - DNA, 18 bp, Homo sapiens
tgatgcttataataaaga

SEQ ID NO: 5527024 - DNA, 17 bp, Homo sapiens
tgatgcttcttcagaga

SEQ ID NO: 5527025 - DNA, 19 bp, Homo sapiens
tgatgcttcttcagagact

SEQ ID NO: 5527026 - DNA, 17 bp, Homo sapiens
tgatgcttgatataata

SEQ ID NO: 5527027 - DNA, 22 bp, Homo sapiens
tgatgcttgtaacaagaaaaca

SEQ ID NO: 5527028 - DNA, 23 bp, Homo sapiens
tgatgcttgtaacaagaaaacat

SEQ ID NO: 5527029 - DNA, 15 bp, Homo sapiens
tgatgcttttctctc

SEQ ID NO: 5527030 - DNA, 17 bp, Homo sapiens
tgatgcttttctctcag

SEQ ID NO: 5527031 - DNA, 16 bp, Homo sapiens
tgatgcttttgctgct

SEQ ID NO: 5527032 - DNA, 15 bp, Homo sapiens
tgatggaaaaagaat

SEQ ID NO: 5527033 - DNA, 22 bp, Homo sapiens
tgatggaaaaagcgctgtttcc

SEQ ID NO: 5527034 - DNA, 12 bp, Homo sapiens
tgatggaaaaat

SEQ ID NO: 5527035 - DNA, 24 bp, Homo sapiens
tgatggaaaataccagtgttgggt

SEQ ID NO: 5527036 - DNA, 15 bp, Homo sapiens
tgatggaacacacac

SEQ ID NO: 5527037 - DNA, 16 bp, Homo sapiens
tgatggaacacacaca

SEQ ID NO: 5527038 - DNA, 14 bp, Homo sapiens
tgatggaaccttaa

SEQ ID NO: 5527039 - DNA, 22 bp, Homo sapiens
tgatggaagtgggccagtcctg

SEQ ID NO: 5527040 - DNA, 20 bp, Homo sapiens
tgatggaatgtgccacctgt

SEQ ID NO: 5527041 - DNA, 13 bp, Homo sapiens
tgatggaccaaag

SEQ ID NO: 5527042 - DNA, 20 bp, Homo sapiens
tgatggacccaatgcacaca

SEQ ID NO: 5527043 - DNA, 20 bp, Homo sapiens
tgatggaccgggtgggcctg

SEQ ID NO: 5527044 - DNA, 23 bp, Homo sapiens
tgatggaccgggtgggcctggcc

SEQ ID NO: 5527045 - DNA, 20 bp, Homo sapiens
tgatggactactctattttt

SEQ ID NO: 5527046 - DNA, 14 bp, Homo sapiens
tgatggactgggga

SEQ ID NO: 5527047 - DNA, 12 bp, Homo sapiens
tgatggagaagg

SEQ ID NO: 5527048 - DNA, 14 bp, Homo sapiens
tgatggagaaggaa

SEQ ID NO: 5527049 - DNA, 22 bp, Homo sapiens
tgatggagaaggaaaaggctgg

SEQ ID NO: 5527050 - DNA, 16 bp, Homo sapiens
tgatggagaaggaagg

SEQ ID NO: 5527051 - DNA, 17 bp, Homo sapiens
tgatggagaggacagag

SEQ ID NO: 5527052 - DNA, 14 bp, Homo sapiens
tgatggagaggaga

SEQ ID NO: 5527053 - DNA, 16 bp, Homo sapiens
tgatggagccccacct

SEQ ID NO: 5527054 - DNA, 14 bp, Homo sapiens
tgatggaggaaaaa

SEQ ID NO: 5527055 - DNA, 15 bp, Homo sapiens
tgatggaggaaaaag

SEQ ID NO: 5527056 - DNA, 15 bp, Homo sapiens
tgatggaggctgcag

SEQ ID NO: 5527057 - DNA, 18 bp, Homo sapiens
tgatggagggtggaaata

SEQ ID NO: 5527058 - DNA, 20 bp, Homo sapiens
tgatggagggtggaaataat

SEQ ID NO: 5527059 - DNA, 21 bp, Homo sapiens
tgatggaggtttcatactcta

SEQ ID NO: 5527060 - DNA, 16 bp, Homo sapiens
tgatggagtttctcta

SEQ ID NO: 5527061 - DNA, 19 bp, Homo sapiens
tgatggatttaacagcatg

SEQ ID NO: 5527062 - DNA, 22 bp, Homo sapiens
tgatggcaccactgcactccag

SEQ ID NO: 5527063 - DNA, 21 bp, Homo sapiens
tgatggcacttttgagctcct

SEQ ID NO: 5527064 - DNA, 18 bp, Homo sapiens
tgatggcagaactcccac

SEQ ID NO: 5527065 - DNA, 16 bp, Homo sapiens
tgatggcattactctg

SEQ ID NO: 5527066 - DNA, 18 bp, Homo sapiens
tgatggccaaagcaaagg

SEQ ID NO: 5527067 - DNA, 17 bp, Homo sapiens
tgatggccaagagcatc

SEQ ID NO: 5527068 - DNA, 14 bp, Homo sapiens
tgatggccagcccc

SEQ ID NO: 5527069 - DNA, 15 bp, Homo sapiens
tgatggccaggcctc

SEQ ID NO: 5527070 - DNA, 15 bp, Homo sapiens
tgatggccatttcta

SEQ ID NO: 5527071 - DNA, 21 bp, Homo sapiens
tgatggcccattctacttgct

SEQ ID NO: 5527072 - DNA, 16 bp, Homo sapiens
tgatggcccctccagc

SEQ ID NO: 5527073 - DNA, 20 bp, Homo sapiens
tgatggcccctccagcacac

SEQ ID NO: 5527074 - DNA, 14 bp, Homo sapiens
tgatggccctcatc

SEQ ID NO: 5527075 - DNA, 16 bp, Homo sapiens
tgatggcctttggacc

SEQ ID NO: 5527076 - DNA, 21 bp, Homo sapiens
tgatggcgcgggaggcaccag

SEQ ID NO: 5527077 - DNA, 16 bp, Homo sapiens
tgatggctagattcta

SEQ ID NO: 5527078 - DNA, 21 bp, Homo sapiens
tgatggctagattctaacata

SEQ ID NO: 5527079 - DNA, 14 bp, Homo sapiens
tgatggctatgttt

SEQ ID NO: 5527080 - DNA, 15 bp, Homo sapiens
tgatggcttctccag

SEQ ID NO: 5527081 - DNA, 12 bp, Homo sapiens
tgatggcttgac

SEQ ID NO: 5527082 - DNA, 18 bp, Homo sapiens
tgatggcttgacatgtgc

SEQ ID NO: 5527083 - DNA, 16 bp, Homo sapiens
tgatgggaaaatagta

SEQ ID NO: 5527084 - DNA, 19 bp, Homo sapiens
tgatgggaaagcattgtaa

SEQ ID NO: 5527085 - DNA, 21 bp, Homo sapiens
tgatgggaagtccggccccag

SEQ ID NO: 5527086 - DNA, 15 bp, Homo sapiens
tgatgggaataaaag

SEQ ID NO: 5527087 - DNA, 18 bp, Homo sapiens
tgatgggaggtgtgccag

SEQ ID NO: 5527088 - DNA, 21 bp, Homo sapiens
tgatgggatgattgaagaaac

SEQ ID NO: 5527089 - DNA, 16 bp, Homo sapiens
tgatgggattctggac

SEQ ID NO: 5527090 - DNA, 17 bp, Homo sapiens
tgatgggattctggaca

SEQ ID NO: 5527091 - DNA, 23 bp, Homo sapiens
tgatgggcaaggggccaggaagg

SEQ ID NO: 5527092 - DNA, 20 bp, Homo sapiens
tgatgggcactggaaaacat

SEQ ID NO: 5527093 - DNA, 18 bp, Homo sapiens
tgatgggcagatcttttc

SEQ ID NO: 5527094 - DNA, 17 bp, Homo sapiens
tgatgggcagcctgctg

SEQ ID NO: 5527095 - DNA, 22 bp, Homo sapiens
tgatgggcagcctgctggtcag

SEQ ID NO: 5527096 - DNA, 16 bp, Homo sapiens
tgatgggcctgaactc

SEQ ID NO: 5527097 - DNA, 22 bp, Homo sapiens
tgatgggcgagtcccggagccc

SEQ ID NO: 5527098 - DNA, 17 bp, Homo sapiens
tgatggggaaggaggct

SEQ ID NO: 5527099 - DNA, 20 bp, Homo sapiens
tgatggggaatccgtgtgtg

SEQ ID NO: 5527100 - DNA, 18 bp, Homo sapiens
tgatggggacatttcttc

SEQ ID NO: 5527101 - DNA, 22 bp, Homo sapiens
tgatggggccctaattcagcca

SEQ ID NO: 5527102 - DNA, 19 bp, Homo sapiens
tgatggggccctgcctcct

SEQ ID NO: 5527103 - DNA, 15 bp, Homo sapiens
tgatgggggagaggg

SEQ ID NO: 5527104 - DNA, 16 bp, Homo sapiens
tgatgggggccaggac

SEQ ID NO: 5527105 - DNA, 21 bp, Homo sapiens
tgatggggtcagcaggcccag

SEQ ID NO: 5527106 - DNA, 23 bp, Homo sapiens
tgatggggtcagcaggcccagga

SEQ ID NO: 5527107 - DNA, 17 bp, Homo sapiens
tgatggggtccagagag

SEQ ID NO: 5527108 - DNA, 23 bp, Homo sapiens
tgatggggtgggagactttccat

SEQ ID NO: 5527109 - DNA, 16 bp, Homo sapiens
tgatgggtcctgctgc

SEQ ID NO: 5527110 - DNA, 16 bp, Homo sapiens
tgatgggtgccctttc

SEQ ID NO: 5527111 - DNA, 19 bp, Homo sapiens
tgatgggtggacctgtgta

SEQ ID NO: 5527112 - DNA, 23 bp, Homo sapiens
tgatgggttagtggatggaaggg

SEQ ID NO: 5527113 - DNA, 22 bp, Homo sapiens
tgatgggttcttagagccttag

SEQ ID NO: 5527114 - DNA, 23 bp, Homo sapiens
tgatggtagaaattttatctctt

SEQ ID NO: 5527115 - DNA, 15 bp, Homo sapiens
tgatggtctggtcta

SEQ ID NO: 5527116 - DNA, 16 bp, Homo sapiens
tgatggtcttcagcct

SEQ ID NO: 5527117 - DNA, 18 bp, Homo sapiens
tgatggtgacagctgcaa

SEQ ID NO: 5527118 - DNA, 12 bp, Homo sapiens
tgatggtgagca

SEQ ID NO: 5527119 - DNA, 13 bp, Homo sapiens
tgatggtgagctg

SEQ ID NO: 5527120 - DNA, 15 bp, Homo sapiens
tgatggtgcaatgac

SEQ ID NO: 5527121 - DNA, 16 bp, Homo sapiens
tgatggtgcaatgacc

SEQ ID NO: 5527122 - DNA, 15 bp, Homo sapiens
tgatggtgctcccct

SEQ ID NO: 5527123 - DNA, 12 bp, Homo sapiens
tgatggtggccc

SEQ ID NO: 5527124 - DNA, 14 bp, Homo sapiens
tgatggtggggcca

SEQ ID NO: 5527125 - DNA, 15 bp, Homo sapiens
tgatggtggtatgtt

SEQ ID NO: 5527126 - DNA, 21 bp, Homo sapiens
tgatggtgtcattctgcctgc

SEQ ID NO: 5527127 - DNA, 21 bp, Homo sapiens
tgatggtgttaaagctgtaca

SEQ ID NO: 5527128 - DNA, 23 bp, Homo sapiens
tgatggtgttaaagctgtacacc

SEQ ID NO: 5527129 - DNA, 21 bp, Homo sapiens
tgatggttgtacatataagtg

SEQ ID NO: 5527130 - DNA, 20 bp, Homo sapiens
tgatggttttttttttcttt

SEQ ID NO: 5527131 - DNA, 18 bp, Homo sapiens
tgatgtaaaaatgcttcc

SEQ ID NO: 5527132 - DNA, 11 bp, Homo sapiens
tgatgtaaaac

SEQ ID NO: 5527133 - DNA, 15 bp, Homo sapiens
tgatgtaaaatcttg

SEQ ID NO: 5527134 - DNA, 23 bp, Homo sapiens
tgatgtaaaatcttgtcatgtgt

SEQ ID NO: 5527135 - DNA, 13 bp, Homo sapiens
tgatgtaaatagt

SEQ ID NO: 5527136 - DNA, 18 bp, Homo sapiens
tgatgtaaatagtgattt

SEQ ID NO: 5527137 - DNA, 21 bp, Homo sapiens
tgatgtaaatgaagtaacttg

SEQ ID NO: 5527138 - DNA, 22 bp, Homo sapiens
tgatgtaactgagaatttgtgt

SEQ ID NO: 5527139 - DNA, 22 bp, Homo sapiens
tgatgtaatcttgaattgtaac

SEQ ID NO: 5527140 - DNA, 14 bp, Homo sapiens
tgatgtacagaaca

SEQ ID NO: 5527141 - DNA, 18 bp, Homo sapiens
tgatgtacagaacacaaa

SEQ ID NO: 5527142 - DNA, 22 bp, Homo sapiens
tgatgtacagaacacaaatgtc

SEQ ID NO: 5527143 - DNA, 13 bp, Homo sapiens
tgattctgtgtgt

SEQ ID NO: 5527144 - DNA, 16 bp, Homo sapiens
tgattctgttgtgttc

SEQ ID NO: 5527145 - DNA, 20 bp, Homo sapiens
tgattcttaacacagccttc

SEQ ID NO: 5527146 - DNA, 21 bp, Homo sapiens
tgattcttcagcaaaaatatt

SEQ ID NO: 5527147 - DNA, 15 bp, Homo sapiens
tgattcttgaaaact

SEQ ID NO: 5527148 - DNA, 15 bp, Homo sapiens
tgattcttgagttta

SEQ ID NO: 5527149 - DNA, 20 bp, Homo sapiens
tgattcttgagtttagtgat

SEQ ID NO: 5527150 - DNA, 21 bp, Homo sapiens
tgattcttgtgtcatcaagta

SEQ ID NO: 5527151 - DNA, 22 bp, Homo sapiens
tgattctttcaatccacagtat

SEQ ID NO: 5527152 - DNA, 15 bp, Homo sapiens
tgattcttttaggac

SEQ ID NO: 5527153 - DNA, 15 bp, Homo sapiens
tgattcttttcccat

SEQ ID NO: 5527154 - DNA, 18 bp, Homo sapiens
tgattctttttaaagtgt

SEQ ID NO: 5527155 - DNA, 17 bp, Homo sapiens
tgattgaaaagaagaaa

SEQ ID NO: 5527156 - DNA, 13 bp, Homo sapiens
tgattgaaagaaa

SEQ ID NO: 5527157 - DNA, 14 bp, Homo sapiens
tgattgaaagaaaa

SEQ ID NO: 5527158 - DNA, 17 bp, Homo sapiens
tgattgaaatatcagtt

SEQ ID NO: 5527159 - DNA, 20 bp, Homo sapiens
tgattgaaccagctcatctc

SEQ ID NO: 5527160 - DNA, 20 bp, Homo sapiens
tgattgaactggaataatat

SEQ ID NO: 5527161 - DNA, 18 bp, Homo sapiens
tgattgaagaaacagcta

SEQ ID NO: 5527162 - DNA, 14 bp, Homo sapiens
tgattgaattctaa

SEQ ID NO: 5527163 - DNA, 16 bp, Homo sapiens
tgattgacacacagca

SEQ ID NO: 5527164 - DNA, 19 bp, Homo sapiens
tgattgacacacagcactc

SEQ ID NO: 5527165 - DNA, 12 bp, Homo sapiens
tgattgacagct

SEQ ID NO: 5527166 - DNA, 21 bp, Homo sapiens
tgattgacagctttgctgctg

SEQ ID NO: 5527167 - DNA, 20 bp, Homo sapiens
tgattgacattttgtagcta

SEQ ID NO: 5527168 - DNA, 15 bp, Homo sapiens
tgattgacctgctcc

SEQ ID NO: 5527169 - DNA, 23 bp, Homo sapiens
tgattgagagcagcctcttgaat

SEQ ID NO: 5527170 - DNA, 20 bp, Homo sapiens
tgattgaggagctgcactga

SEQ ID NO: 5527171 - DNA, 18 bp, Homo sapiens
tgattgatcacacagtgt

SEQ ID NO: 5527172 - DNA, 20 bp, Homo sapiens
tgattgatgtacagaacaca

SEQ ID NO: 5527173 - DNA, 17 bp, Homo sapiens
tgattgattcagtatct

SEQ ID NO: 5527174 - DNA, 12 bp, Homo sapiens
tgattgatttga

SEQ ID NO: 5527175 - DNA, 15 bp, Homo sapiens
tgattgatttgaagt

SEQ ID NO: 5527176 - DNA, 20 bp, Homo sapiens
tgattgcagaaaggagagac

SEQ ID NO: 5527177 - DNA, 19 bp, Homo sapiens
tgattgcagttatttcaaa

SEQ ID NO: 5527178 - DNA, 14 bp, Homo sapiens
tgattgccaacagt

SEQ ID NO: 5527179 - DNA, 17 bp, Homo sapiens
tgattgccatttcttcc

SEQ ID NO: 5527180 - DNA, 20 bp, Homo sapiens
tgattgccatttcttcccaa

SEQ ID NO: 5527181 - DNA, 22 bp, Homo sapiens
tgattgcctttttataactttt

SEQ ID NO: 5527182 - DNA, 17 bp, Homo sapiens
tgattgcgagaattttc

SEQ ID NO: 5527183 - DNA, 15 bp, Homo sapiens
tgattgctaaatgta

SEQ ID NO: 5527184 - DNA, 16 bp, Homo sapiens
tgattgctaaatgtaa

SEQ ID NO: 5527185 - DNA, 19 bp, Homo sapiens
tgattgctaaatgtaacag

SEQ ID NO: 5527186 - DNA, 20 bp, Homo sapiens
tgattgctaaatgtaacagt

SEQ ID NO: 5527187 - DNA, 20 bp, Homo sapiens
tgattgctgccataattcta

SEQ ID NO: 5527188 - DNA, 19 bp, Homo sapiens
tgattgctgtgtccaactc

SEQ ID NO: 5527189 - DNA, 13 bp, Homo sapiens
tgattgctttgct

SEQ ID NO: 5527190 - DNA, 12 bp, Homo sapiens
tgattgctttta

SEQ ID NO: 5527191 - DNA, 16 bp, Homo sapiens
tgattgcttttaaaat

SEQ ID NO: 5527192 - DNA, 22 bp, Homo sapiens
tgattgcttttaaaattttaag

SEQ ID NO: 5527193 - DNA, 19 bp, Homo sapiens
tgattggaagagtgacctg

SEQ ID NO: 5527194 - DNA, 20 bp, Homo sapiens
tgattggaagggcttttcaa

SEQ ID NO: 5527195 - DNA, 23 bp, Homo sapiens
tgattggaagggcttttcaaaat

SEQ ID NO: 5527196 - DNA, 22 bp, Homo sapiens
tgattggaatttctggcctcct

SEQ ID NO: 5527197 - DNA, 16 bp, Homo sapiens
tgattggaccaggcca

SEQ ID NO: 5527198 - DNA, 17 bp, Homo sapiens
tgattggataaatgctt

SEQ ID NO: 5527199 - DNA, 21 bp, Homo sapiens
tgattggatattctcctcgga

SEQ ID NO: 5527200 - DNA, 23 bp, Homo sapiens
tgattggatattctcctcggact

SEQ ID NO: 5527201 - DNA, 22 bp, Homo sapiens
tgattggcagcttcaaaacaga

SEQ ID NO: 5527202 - DNA, 20 bp, Homo sapiens
tgattggcaggagttggaag

SEQ ID NO: 5527203 - DNA, 14 bp, Homo sapiens
tgattggccagccg

SEQ ID NO: 5527204 - DNA, 13 bp, Homo sapiens
tgattggctgcag

SEQ ID NO: 5527205 - DNA, 12 bp, Homo sapiens
tgattggctgct

SEQ ID NO: 5527206 - DNA, 13 bp, Homo sapiens
tgattggctgctt

SEQ ID NO: 5527207 - DNA, 10 bp, Homo sapiens
tgattggctt

SEQ ID NO: 5527208 - DNA, 13 bp, Homo sapiens
tgattggcttaaa

SEQ ID NO: 5527209 - DNA, 17 bp, Homo sapiens
tgattggcttaaagtga

SEQ ID NO: 5527210 - DNA, 18 bp, Homo sapiens
tgattggcttaaagtgaa

SEQ ID NO: 5527211 - DNA, 17 bp, Homo sapiens
tgattgggaaaacattt

SEQ ID NO: 5527212 - DNA, 21 bp, Homo sapiens
tgattgggaaaacatttgctg

SEQ ID NO: 5527213 - DNA, 17 bp, Homo sapiens
tgattgggaataaatat

SEQ ID NO: 5527214 - DNA, 21 bp, Homo sapiens
tgattgggaataaatatgcct

SEQ ID NO: 5527215 - DNA, 17 bp, Homo sapiens
tgattgggcacatcatt

SEQ ID NO: 5527216 - DNA, 20 bp, Homo sapiens
tgattggggcctcacccaga

SEQ ID NO: 5527217 - DNA, 22 bp, Homo sapiens
tgattggggcctcacccagaag

SEQ ID NO: 5527218 - DNA, 16 bp, Homo sapiens
tgattgggtgggattt

SEQ ID NO: 5527219 - DNA, 18 bp, Homo sapiens
tgattggtgattcaaagt

SEQ ID NO: 5527220 - DNA, 17 bp, Homo sapiens
tgattggtgcaaccctt

SEQ ID NO: 5527221 - DNA, 18 bp, Homo sapiens
tgattggtttaaaagtca

SEQ ID NO: 5527222 - DNA, 16 bp, Homo sapiens
tgattggttttaattg

SEQ ID NO: 5527223 - DNA, 12 bp, Homo sapiens
tgattgtaaaat

SEQ ID NO: 5527224 - DNA, 21 bp, Homo sapiens
tgattgtaacgttgctgtggg

SEQ ID NO: 5527225 - DNA, 15 bp, Homo sapiens
tgattgtactttgaa

SEQ ID NO: 5527226 - DNA, 20 bp, Homo sapiens
tgattgtagtaatctgcatt

SEQ ID NO: 5527227 - DNA, 16 bp, Homo sapiens
tgattgtataagcatg

SEQ ID NO: 5527228 - DNA, 17 bp, Homo sapiens
tgattgtataatgtgat

SEQ ID NO: 5527229 - DNA, 17 bp, Homo sapiens
tgattgtctagtgagga

SEQ ID NO: 5527230 - DNA, 22 bp, Homo sapiens
tgattgtctgaaattttctaga

SEQ ID NO: 5527231 - DNA, 14 bp, Homo sapiens
tgattgtgcatgga

SEQ ID NO: 5527232 - DNA, 21 bp, Homo sapiens
tgattgtggaatggagattca

SEQ ID NO: 5527233 - DNA, 22 bp, Homo sapiens
tgattgtgttgaagaagggtta

SEQ ID NO: 5527234 - DNA, 13 bp, Homo sapiens
tgattgttataaa

SEQ ID NO: 5527235 - DNA, 22 bp, Homo sapiens
tgattgttatgtaaaactcgct

SEQ ID NO: 5527236 - DNA, 18 bp, Homo sapiens
tgattgttcataatacat

SEQ ID NO: 5527237 - DNA, 14 bp, Homo sapiens
tgattgttcctccc

SEQ ID NO: 5527238 - DNA, 19 bp, Homo sapiens
tgattgttcgggtgtgcaa

SEQ ID NO: 5527239 - DNA, 14 bp, Homo sapiens
tgattgttggcaca

SEQ ID NO: 5527240 - DNA, 10 bp, Homo sapiens
tgattgttta

SEQ ID NO: 5527241 - DNA, 14 bp, Homo sapiens
tgattgttttaaca

SEQ ID NO: 5527242 - DNA, 14 bp, Homo sapiens
tgattgttttagaa

SEQ ID NO: 5527243 - DNA, 22 bp, Homo sapiens
tgattgttttagaagttaaagt

SEQ ID NO: 5527244 - DNA, 17 bp, Homo sapiens
tgatttaaaaaataaat

SEQ ID NO: 5527245 - DNA, 15 bp, Homo sapiens
tgatttaaaacatgt

SEQ ID NO: 5527246 - DNA, 15 bp, Homo sapiens
tgatttaaacacaca

SEQ ID NO: 5527247 - DNA, 13 bp, Homo sapiens
tgatttaaacttc

SEQ ID NO: 5527248 - DNA, 18 bp, Homo sapiens
tgatttaaatttataatt

SEQ ID NO: 5527249 - DNA, 14 bp, Homo sapiens
tgatttaagcattt

SEQ ID NO: 5527250 - DNA, 16 bp, Homo sapiens
tgatttaagcatttta

SEQ ID NO: 5527251 - DNA, 20 bp, Homo sapiens
tgatttaagtgtctcactaa

SEQ ID NO: 5527252 - DNA, 13 bp, Homo sapiens
tgatttaatagtg

SEQ ID NO: 5527253 - DNA, 13 bp, Homo sapiens
tgatttaatatct

SEQ ID NO: 5527254 - DNA, 14 bp, Homo sapiens
tgatttaatatgga

SEQ ID NO: 5527255 - DNA, 18 bp, Homo sapiens
tgatttaatccagatctg

SEQ ID NO: 5527256 - DNA, 12 bp, Homo sapiens
tgatttaatgtt

SEQ ID NO: 5527257 - DNA, 16 bp, Homo sapiens
tgatttaatgttttca

SEQ ID NO: 5527258 - DNA, 16 bp, Homo sapiens
tgatttaatgttttct

SEQ ID NO: 5527259 - DNA, 14 bp, Homo sapiens
tgatttaattctta

SEQ ID NO: 5527260 - DNA, 14 bp, Homo sapiens
tgatttacacaggt

SEQ ID NO: 5527261 - DNA, 16 bp, Homo sapiens
tgatttacagcaagta

SEQ ID NO: 5527262 - DNA, 19 bp, Homo sapiens
tgatttacagcaagtagat

SEQ ID NO: 5527263 - DNA, 20 bp, Homo sapiens
tgatttacagcaagtagata

SEQ ID NO: 5527264 - DNA, 18 bp, Homo sapiens
tgatttacaggacttctc

SEQ ID NO: 5527265 - DNA, 16 bp, Homo sapiens
tgatttacatgctgat

SEQ ID NO: 5527266 - DNA, 17 bp, Homo sapiens
tgatttacctttggaat

SEQ ID NO: 5527267 - DNA, 22 bp, Homo sapiens
tgatttacctttggaattgtgc

SEQ ID NO: 5527268 - DNA, 16 bp, Homo sapiens
tgatttacgctcattg

SEQ ID NO: 5527269 - DNA, 20 bp, Homo sapiens
tgatttactaacagtaactg

SEQ ID NO: 5527270 - DNA, 17 bp, Homo sapiens
tgatttactctttggga

SEQ ID NO: 5527271 - DNA, 17 bp, Homo sapiens
tgatttagcaatgctgt

SEQ ID NO: 5527272 - DNA, 17 bp, Homo sapiens
tgatttagcaggaagct

SEQ ID NO: 5527273 - DNA, 20 bp, Homo sapiens
tgatttagcaggaagctgtg

SEQ ID NO: 5527274 - DNA, 18 bp, Homo sapiens
tgatttataaataacaaa

SEQ ID NO: 5527275 - DNA, 20 bp, Homo sapiens
tgatttataaatgccattta

SEQ ID NO: 5527276 - DNA, 16 bp, Homo sapiens
tgatttatagtttgta

SEQ ID NO: 5527277 - DNA, 16 bp, Homo sapiens
tgatttatatatggca

SEQ ID NO: 5527278 - DNA, 17 bp, Homo sapiens
tgatttatatatggcat

SEQ ID NO: 5527279 - DNA, 21 bp, Homo sapiens
tgatttatatatggcatattt

SEQ ID NO: 5527280 - DNA, 16 bp, Homo sapiens
tgatttatcacacaaa

SEQ ID NO: 5527281 - DNA, 16 bp, Homo sapiens
tgatttatctttcaag

SEQ ID NO: 5527282 - DNA, 15 bp, Homo sapiens
tgatttatgcattta

SEQ ID NO: 5527283 - DNA, 13 bp, Homo sapiens
tgatttatgcttt

SEQ ID NO: 5527284 - DNA, 14 bp, Homo sapiens
tgatttatgcttta

SEQ ID NO: 5527285 - DNA, 14 bp, Homo sapiens
tgatttatggctgt

SEQ ID NO: 5527286 - DNA, 15 bp, Homo sapiens
tgatttattaactta

SEQ ID NO: 5527287 - DNA, 16 bp, Homo sapiens
tgatttattaacttaa

SEQ ID NO: 5527288 - DNA, 17 bp, Homo sapiens
tgatttatttgcttctt

SEQ ID NO: 5527289 - DNA, 22 bp, Homo sapiens
tgatttatttggagtggaggca

SEQ ID NO: 5527290 - DNA, 15 bp, Homo sapiens
tgatttcaaaatcag

SEQ ID NO: 5527291 - DNA, 15 bp, Homo sapiens
tgatttcaagatgtt

SEQ ID NO: 5527292 - DNA, 22 bp, Homo sapiens
tgatttcaagatgttatattaa

SEQ ID NO: 5527293 - DNA, 20 bp, Homo sapiens
tgatttcaaggtccgagctc

SEQ ID NO: 5527294 - DNA, 20 bp, Homo sapiens
tgatttcacaaatattaaaa

SEQ ID NO: 5527295 - DNA, 19 bp, Homo sapiens
tgatttcacaacagatcaa

SEQ ID NO: 5527296 - DNA, 13 bp, Homo sapiens
tgatttcacatat

SEQ ID NO: 5527297 - DNA, 17 bp, Homo sapiens
tgatttcactttgggat

SEQ ID NO: 5527298 - DNA, 24 bp, Homo sapiens
tgatttcagcacaataaatatact

SEQ ID NO: 5527299 - DNA, 20 bp, Homo sapiens
tgatttcagcacctacagtg

SEQ ID NO: 5527300 - DNA, 18 bp, Homo sapiens
tgatttcagggaaatgga

SEQ ID NO: 5527301 - DNA, 14 bp, Homo sapiens
tgatttcagtaagt

SEQ ID NO: 5527302 - DNA, 21 bp, Homo sapiens
tgatttcagtgctgctgaact

SEQ ID NO: 5527303 - DNA, 20 bp, Homo sapiens
tgatttcagtttttcatttg

SEQ ID NO: 5527304 - DNA, 13 bp, Homo sapiens
tgatttcatattg

SEQ ID NO: 5527305 - DNA, 17 bp, Homo sapiens
tgatttcatcttctgga

SEQ ID NO: 5527306 - DNA, 18 bp, Homo sapiens
tgatttcatcttctggaa

SEQ ID NO: 5527307 - DNA, 19 bp, Homo sapiens
tgatttcatcttctggaat

SEQ ID NO: 5527308 - DNA, 18 bp, Homo sapiens
tgatttcatgtactgcat

SEQ ID NO: 5527309 - DNA, 15 bp, Homo sapiens
tgatttcattaatac

SEQ ID NO: 5527310 - DNA, 15 bp, Homo sapiens
tgatttcattcctcg

SEQ ID NO: 5527311 - DNA, 14 bp, Homo sapiens
tgatttccaaagag

SEQ ID NO: 5527312 - DNA, 16 bp, Homo sapiens
tgatttccaagtaata

SEQ ID NO: 5527313 - DNA, 19 bp, Homo sapiens
tgatttccagtgagtgtaa

SEQ ID NO: 5527314 - DNA, 18 bp, Homo sapiens
tgatttccatccaaacct

SEQ ID NO: 5527315 - DNA, 15 bp, Homo sapiens
tgatttccatctctg

SEQ ID NO: 5527316 - DNA, 15 bp, Homo sapiens
tgatttccatttctg

SEQ ID NO: 5527317 - DNA, 20 bp, Homo sapiens
tgatttcccaaaaacactaa

SEQ ID NO: 5527318 - DNA, 23 bp, Homo sapiens
tgatttcccactgcactccagcc

SEQ ID NO: 5527319 - DNA, 17 bp, Homo sapiens
tgatttcccattttaaa

SEQ ID NO: 5527320 - DNA, 19 bp, Homo sapiens
tgatttcccattttaaaga

SEQ ID NO: 5527321 - DNA, 21 bp, Homo sapiens
tgcaaattagggctacattgt

SEQ ID NO: 5527322 - DNA, 22 bp, Homo sapiens
tgcaaattagggctacattgta

SEQ ID NO: 5527323 - DNA, 15 bp, Homo sapiens
tgcaaattattctag

SEQ ID NO: 5527324 - DNA, 17 bp, Homo sapiens
tgcaaattattctagtc

SEQ ID NO: 5527325 - DNA, 19 bp, Homo sapiens
tgcaaattattctagtcaa

SEQ ID NO: 5527326 - DNA, 19 bp, Homo sapiens
tgcaaattatttattactt

SEQ ID NO: 5527327 - DNA, 24 bp, Homo sapiens
tgcaaattatttattacttgtgca

SEQ ID NO: 5527328 - DNA, 23 bp, Homo sapiens
tgcaaattcaagagcctcccctg

SEQ ID NO: 5527329 - DNA, 13 bp, Homo sapiens
tgcaaattcagaa

SEQ ID NO: 5527330 - DNA, 20 bp, Homo sapiens
tgcaaattcccagatttgaa

SEQ ID NO: 5527331 - DNA, 14 bp, Homo sapiens
tgcaaattctcagg

SEQ ID NO: 5527332 - DNA, 13 bp, Homo sapiens
tgcaaattgtgaa

SEQ ID NO: 5527333 - DNA, 14 bp, Homo sapiens
tgcaaatttagttt

SEQ ID NO: 5527334 - DNA, 15 bp, Homo sapiens
tgcaaatttagtttg

SEQ ID NO: 5527335 - DNA, 16 bp, Homo sapiens
tgcaaatttagtttgt

SEQ ID NO: 5527336 - DNA, 12 bp, Homo sapiens
tgcaaatttcat

SEQ ID NO: 5527337 - DNA, 14 bp, Homo sapiens
tgcaaatttctata

SEQ ID NO: 5527338 - DNA, 16 bp, Homo sapiens
tgcaaatttctataaa

SEQ ID NO: 5527339 - DNA, 22 bp, Homo sapiens
tgcaaatttgtaaactttgctt

SEQ ID NO: 5527340 - DNA, 20 bp, Homo sapiens
tgcaaattttgcatttagtt

SEQ ID NO: 5527341 - DNA, 15 bp, Homo sapiens
tgcaaattttttgaa

SEQ ID NO: 5527342 - DNA, 16 bp, Homo sapiens
tgcaacaaaaatgtgg

SEQ ID NO: 5527343 - DNA, 12 bp, Homo sapiens
tgcaacaaatga

SEQ ID NO: 5527344 - DNA, 20 bp, Homo sapiens
tgcaacaaatgaattttcca

SEQ ID NO: 5527345 - DNA, 22 bp, Homo sapiens
tgcaacaagacaaagcaaagcc

SEQ ID NO: 5527346 - DNA, 14 bp, Homo sapiens
tgcaacaatgcaaa

SEQ ID NO: 5527347 - DNA, 19 bp, Homo sapiens
tgcaacaatgcaaaagcca

SEQ ID NO: 5527348 - DNA, 13 bp, Homo sapiens
tgcaacacaacat

SEQ ID NO: 5527349 - DNA, 12 bp, Homo sapiens
tgcaacactcaa

SEQ ID NO: 5527350 - DNA, 17 bp, Homo sapiens
tgcaacactcaagtcta

SEQ ID NO: 5527351 - DNA, 12 bp, Homo sapiens
tgcaacactgcc

SEQ ID NO: 5527352 - DNA, 12 bp, Homo sapiens
tgcaacactgga

SEQ ID NO: 5527353 - DNA, 22 bp, Homo sapiens
tgcaacactggtctgctgttcc

SEQ ID NO: 5527354 - DNA, 24 bp, Homo sapiens
tgcaacagcaaattaatgtgtaaa

SEQ ID NO: 5527355 - DNA, 14 bp, Homo sapiens
tgcaacagcactgg

SEQ ID NO: 5527356 - DNA, 17 bp, Homo sapiens
tgcaacagcactggctc

SEQ ID NO: 5527357 - DNA, 13 bp, Homo sapiens
tgcaacagcctgt

SEQ ID NO: 5527358 - DNA, 15 bp, Homo sapiens
tgcaacaggctgggc

SEQ ID NO: 5527359 - DNA, 17 bp, Homo sapiens
tgcaacaggctgggctt

SEQ ID NO: 5527360 - DNA, 20 bp, Homo sapiens
tgcaacaggctgggcttcag

SEQ ID NO: 5527361 - DNA, 17 bp, Homo sapiens
tgcaacaggggaggaaa

SEQ ID NO: 5527362 - DNA, 22 bp, Homo sapiens
tgcaacaggggaggaaaaaaga

SEQ ID NO: 5527363 - DNA, 16 bp, Homo sapiens
tgcaacagtaatcaga

SEQ ID NO: 5527364 - DNA, 16 bp, Homo sapiens
tgcaacatacaggtgc

SEQ ID NO: 5527365 - DNA, 22 bp, Homo sapiens
tgcaacatacgggaagtttatt

SEQ ID NO: 5527366 - DNA, 15 bp, Homo sapiens
tgcaacatctcccct

SEQ ID NO: 5527367 - DNA, 15 bp, Homo sapiens
tgcaacatctctgaa

SEQ ID NO: 5527368 - DNA, 16 bp, Homo sapiens
tgcaacatctctgaat

SEQ ID NO: 5527369 - DNA, 15 bp, Homo sapiens
tgcaacatttacagt

SEQ ID NO: 5527370 - DNA, 23 bp, Homo sapiens
tgcaacatttacagtccttcaaa

SEQ ID NO: 5527371 - DNA, 21 bp, Homo sapiens
tgcaacatttctgtatactgt

SEQ ID NO: 5527372 - DNA, 16 bp, Homo sapiens
tgcaacatttgacaaa

SEQ ID NO: 5527373 - DNA, 20 bp, Homo sapiens
tgcaaccaactatccaagtg

SEQ ID NO: 5527374 - DNA, 21 bp, Homo sapiens
tgcaaccaactatccaagtgt

SEQ ID NO: 5527375 - DNA, 17 bp, Homo sapiens
tgcaaccaattgaaaag

SEQ ID NO: 5527376 - DNA, 14 bp, Homo sapiens
tgcaaccacacacc

SEQ ID NO: 5527377 - DNA, 12 bp, Homo sapiens
tgcaaccaggca

SEQ ID NO: 5527378 - DNA, 13 bp, Homo sapiens
tgcaaccaggcag

SEQ ID NO: 5527379 - DNA, 18 bp, Homo sapiens
tgcaaccaggcagctgag

SEQ ID NO: 5527380 - DNA, 18 bp, Homo sapiens
tgcaaccataagacaaac

SEQ ID NO: 5527381 - DNA, 15 bp, Homo sapiens
tgcaacccatgagcg

SEQ ID NO: 5527382 - DNA, 22 bp, Homo sapiens
tgcaacccatgagcgtccaggt

SEQ ID NO: 5527383 - DNA, 13 bp, Homo sapiens
tgcaacctcacct

SEQ ID NO: 5527384 - DNA, 19 bp, Homo sapiens
tgcaacctcacctcccggg

SEQ ID NO: 5527385 - DNA, 17 bp, Homo sapiens
tgcaacctcaccttcct

SEQ ID NO: 5527386 - DNA, 15 bp, Homo sapiens
tgcaacctccacctc

SEQ ID NO: 5527387 - DNA, 20 bp, Homo sapiens
tgcaacctccacctcccagg

SEQ ID NO: 5527388 - DNA, 21 bp, Homo sapiens
tgcaacctccacctcccgggt

SEQ ID NO: 5527389 - DNA, 21 bp, Homo sapiens
tgcaacctccacctccgggtt

SEQ ID NO: 5527390 - DNA, 19 bp, Homo sapiens
tgcaacctccacctcctga

SEQ ID NO: 5527391 - DNA, 21 bp, Homo sapiens
tgcaacctccacctcctgggt

SEQ ID NO: 5527392 - DNA, 14 bp, Homo sapiens
tgcaacctccgcct

SEQ ID NO: 5527393 - DNA, 15 bp, Homo sapiens
tgcaacctccgcctc

SEQ ID NO: 5527394 - DNA, 17 bp, Homo sapiens
tgcaacctccgcctccc

SEQ ID NO: 5527395 - DNA, 21 bp, Homo sapiens
tgcaacctccgcctcccgggt

SEQ ID NO: 5527396 - DNA, 21 bp, Homo sapiens
tgcaacctccgcctcctgggt

SEQ ID NO: 5527397 - DNA, 12 bp, Homo sapiens
tgcaacctctgc

SEQ ID NO: 5527398 - DNA, 23 bp, Homo sapiens
tgcaacctctgccccccaagttc

SEQ ID NO: 5527399 - DNA, 21 bp, Homo sapiens
tgcaacctctgcctcccgggt

SEQ ID NO: 5527400 - DNA, 23 bp, Homo sapiens
tgcaacctctgcctcctgggttc

SEQ ID NO: 5527401 - DNA, 21 bp, Homo sapiens
tgcaacctctgtctcccgggt

SEQ ID NO: 5527402 - DNA, 14 bp, Homo sapiens
tgcaacctgttgat

SEQ ID NO: 5527403 - DNA, 20 bp, Homo sapiens
tgcaaccttcacctccaggt

SEQ ID NO: 5527404 - DNA, 18 bp, Homo sapiens
tgcaaccttcgccacctg

SEQ ID NO: 5527405 - DNA, 21 bp, Homo sapiens
tgcaacgctgattcctaaggc

SEQ ID NO: 5527406 - DNA, 20 bp, Homo sapiens
tgcaacgctttttgggagaa

SEQ ID NO: 5527407 - DNA, 16 bp, Homo sapiens
tgcaacggcttagact

SEQ ID NO: 5527408 - DNA, 21 bp, Homo sapiens
tgcaacggtctcctgactggt

SEQ ID NO: 5527409 - DNA, 22 bp, Homo sapiens
tgcaacggtctcctgactggtg

SEQ ID NO: 5527410 - DNA, 15 bp, Homo sapiens
tgcaacgtgtaactt

SEQ ID NO: 5527411 - DNA, 22 bp, Homo sapiens
tgcaacgtgtaacttgtgcttt

SEQ ID NO: 5527412 - DNA, 23 bp, Homo sapiens
tgcaactaactgactctgttatt

SEQ ID NO: 5527413 - DNA, 15 bp, Homo sapiens
tgcaactaaggacaa

SEQ ID NO: 5527414 - DNA, 17 bp, Homo sapiens
tgcaactaaggacaaat

SEQ ID NO: 5527415 - DNA, 22 bp, Homo sapiens
tgcaactaaggacaaattagca

SEQ ID NO: 5527416 - DNA, 19 bp, Homo sapiens
tgcaactaattcaataaaa

SEQ ID NO: 5527417 - DNA, 13 bp, Homo sapiens
tgcaactagccaa

SEQ ID NO: 5527418 - DNA, 17 bp, Homo sapiens
tgcaactcaaggacttt

SEQ ID NO: 5527419 - DNA, 19 bp, Homo sapiens
tgcaactcatgaacaaaat

SEQ ID NO: 5527420 - DNA, 20 bp, Homo sapiens
tgcaactccagcgtcctcag

SEQ ID NO: 5527421 - DNA, 19 bp, Homo sapiens
tgcaactccatgcctattt

SEQ ID NO: 5527422 - DNA, 20 bp, Homo sapiens
tgcaactctaactctgagag

SEQ ID NO: 5527423 - DNA, 18 bp, Homo sapiens
tgcaactgacactcccac

SEQ ID NO: 5527424 - DNA, 15 bp, Homo sapiens
tgcaactggccagcc

SEQ ID NO: 5527425 - DNA, 22 bp, Homo sapiens
tgcaacttcatgtcaacttctg

SEQ ID NO: 5527426 - DNA, 19 bp, Homo sapiens
tgcaacttccgcctcctgt

SEQ ID NO: 5527427 - DNA, 20 bp, Homo sapiens
tgcaacttccgcctcctgtg

SEQ ID NO: 5527428 - DNA, 18 bp, Homo sapiens
tgcaacttccgctgaggg

SEQ ID NO: 5527429 - DNA, 19 bp, Homo sapiens
tgcaacttctatcctttct

SEQ ID NO: 5527430 - DNA, 15 bp, Homo sapiens
tgcaacttctgtccc

SEQ ID NO: 5527431 - DNA, 15 bp, Homo sapiens
tgcaacttctttctg

SEQ ID NO: 5527432 - DNA, 21 bp, Homo sapiens
tgcaacttctttctgttgaga

SEQ ID NO: 5527433 - DNA, 18 bp, Homo sapiens
tgcaacttgtaaatgtgg

SEQ ID NO: 5527434 - DNA, 20 bp, Homo sapiens
tgcaactttaagcagctctt

SEQ ID NO: 5527435 - DNA, 13 bp, Homo sapiens
tgcaactttagaa

SEQ ID NO: 5527436 - DNA, 19 bp, Homo sapiens
tgcaactttagaaagaaat

SEQ ID NO: 5527437 - DNA, 22 bp, Homo sapiens
tgcaactttagtttgtgttatt

SEQ ID NO: 5527438 - DNA, 18 bp, Homo sapiens
tgcaactttgtataaaag

SEQ ID NO: 5527439 - DNA, 16 bp, Homo sapiens
tgcaactttttaaagt

SEQ ID NO: 5527440 - DNA, 20 bp, Homo sapiens
tgcaactttttaattccata

SEQ ID NO: 5527441 - DNA, 13 bp, Homo sapiens
tgcaagaaaaaaa

SEQ ID NO: 5527442 - DNA, 17 bp, Homo sapiens
tgcaagaaaaaaactta

SEQ ID NO: 5527443 - DNA, 22 bp, Homo sapiens
tgcaagaacactggacctttgg

SEQ ID NO: 5527444 - DNA, 13 bp, Homo sapiens
tgcaagaagaata

SEQ ID NO: 5527445 - DNA, 15 bp, Homo sapiens
tgcaagaagaatata

SEQ ID NO: 5527446 - DNA, 22 bp, Homo sapiens
tgcaagaagcgccgactccctg

SEQ ID NO: 5527447 - DNA, 21 bp, Homo sapiens
tgcaagaagtctggccatttt

SEQ ID NO: 5527448 - DNA, 20 bp, Homo sapiens
tgcaagaagtcttgagaaaa

SEQ ID NO: 5527449 - DNA, 17 bp, Homo sapiens
tgcaagaatctcagaca

SEQ ID NO: 5527450 - DNA, 16 bp, Homo sapiens
tgcaagaatgaaatga

SEQ ID NO: 5527451 - DNA, 18 bp, Homo sapiens
tgcaagaattaaaactga

SEQ ID NO: 5527452 - DNA, 20 bp, Homo sapiens
tgcaagaattaaaactgagt

SEQ ID NO: 5527453 - DNA, 22 bp, Homo sapiens
tgcaagaatttctggaagaaag

SEQ ID NO: 5527454 - DNA, 19 bp, Homo sapiens
tgcaagacacaggctcagc

SEQ ID NO: 5527455 - DNA, 22 bp, Homo sapiens
tgcaagaccccaagaggaagtt

SEQ ID NO: 5527456 - DNA, 22 bp, Homo sapiens
tgcaagacctagtcccctttcc

SEQ ID NO: 5527457 - DNA, 14 bp, Homo sapiens
tgcaagagaaggag

SEQ ID NO: 5527458 - DNA, 18 bp, Homo sapiens
tgcaagagaaggagatgt

SEQ ID NO: 5527459 - DNA, 14 bp, Homo sapiens
tgcaagagaatctg

SEQ ID NO: 5527460 - DNA, 14 bp, Homo sapiens
tgcaagagacagag

SEQ ID NO: 5527461 - DNA, 18 bp, Homo sapiens
tgcaagagacagagcccc

SEQ ID NO: 5527462 - DNA, 20 bp, Homo sapiens
tgcaagagacagagccccca

SEQ ID NO: 5527463 - DNA, 19 bp, Homo sapiens
tgcaagagactctggcctc

SEQ ID NO: 5527464 - DNA, 20 bp, Homo sapiens
tgcaagagactttgtcactt

SEQ ID NO: 5527465 - DNA, 21 bp, Homo sapiens
tgcaagagcctgagactggaa

SEQ ID NO: 5527466 - DNA, 14 bp, Homo sapiens
tgcaagagccttgg

SEQ ID NO: 5527467 - DNA, 23 bp, Homo sapiens
tgcaagagccttggtgtccacct

SEQ ID NO: 5527468 - DNA, 12 bp, Homo sapiens
tgcaagaggagg

SEQ ID NO: 5527469 - DNA, 19 bp, Homo sapiens
tgcaagagtgattgcagct

SEQ ID NO: 5527470 - DNA, 19 bp, Homo sapiens
tgcaagatgcttggttgtg

SEQ ID NO: 5527471 - DNA, 18 bp, Homo sapiens
tgcaagattctgaaacat

SEQ ID NO: 5527472 - DNA, 21 bp, Homo sapiens
tgcaagattttttttttaagt

SEQ ID NO: 5527473 - DNA, 13 bp, Homo sapiens
tgcaagcaaagca

SEQ ID NO: 5527474 - DNA, 18 bp, Homo sapiens
tgcaagcaacaagctatt

SEQ ID NO: 5527475 - DNA, 19 bp, Homo sapiens
tgcaagcaacaagctattt

SEQ ID NO: 5527476 - DNA, 13 bp, Homo sapiens
tgcaagcacaaat

SEQ ID NO: 5527477 - DNA, 12 bp, Homo sapiens
tgcaagcactcg

SEQ ID NO: 5527478 - DNA, 22 bp, Homo sapiens
tgcaagcactcggggtccctgg

SEQ ID NO: 5527479 - DNA, 22 bp, Homo sapiens
tgcaagcagaggaccagggcct

SEQ ID NO: 5527480 - DNA, 14 bp, Homo sapiens
tgcaagcagcctcc

SEQ ID NO: 5527481 - DNA, 23 bp, Homo sapiens
tgcaagcagctttttattccctg

SEQ ID NO: 5527482 - DNA, 16 bp, Homo sapiens
tgcaagcagggctctg

SEQ ID NO: 5527483 - DNA, 23 bp, Homo sapiens
tgcaagcatttttccatctgtgt

SEQ ID NO: 5527484 - DNA, 21 bp, Homo sapiens
tgcaagccagggatgaagaaa

SEQ ID NO: 5527485 - DNA, 11 bp, Homo sapiens
tgcaagccata

SEQ ID NO: 5527486 - DNA, 14 bp, Homo sapiens
tgcaagccccaccc

SEQ ID NO: 5527487 - DNA, 19 bp, Homo sapiens
tgcaagctccaactcccgg

SEQ ID NO: 5527488 - DNA, 20 bp, Homo sapiens
tgcaagctccagtagctccg

SEQ ID NO: 5527489 - DNA, 20 bp, Homo sapiens
tgcaagctccgcctcccggg

SEQ ID NO: 5527490 - DNA, 17 bp, Homo sapiens
tgcaagctctggaattg

SEQ ID NO: 5527491 - DNA, 17 bp, Homo sapiens
tgcaagctgctgaagcc

SEQ ID NO: 5527492 - DNA, 20 bp, Homo sapiens
tgcaagctgctgaagccagg

SEQ ID NO: 5527493 - DNA, 19 bp, Homo sapiens
tgcaagcttggtcaaactt

SEQ ID NO: 5527494 - DNA, 12 bp, Homo sapiens
tgcaaggaagga

SEQ ID NO: 5527495 - DNA, 17 bp, Homo sapiens
tgcaaggacctaaaaca

SEQ ID NO: 5527496 - DNA, 16 bp, Homo sapiens
tgcaaggactcccgga

SEQ ID NO: 5527497 - DNA, 12 bp, Homo sapiens
tgcacaggccac

SEQ ID NO: 5527498 - DNA, 13 bp, Homo sapiens
tgcacaggcctct

SEQ ID NO: 5527499 - DNA, 15 bp, Homo sapiens
tgcacaggcctctgc

SEQ ID NO: 5527500 - DNA, 16 bp, Homo sapiens
tgcacaggcctctgcc

SEQ ID NO: 5527501 - DNA, 12 bp, Homo sapiens
tgcacaggcttg

SEQ ID NO: 5527502 - DNA, 16 bp, Homo sapiens
tgcacaggcttgctgt

SEQ ID NO: 5527503 - DNA, 18 bp, Homo sapiens
tgcacagggaagggcttg

SEQ ID NO: 5527504 - DNA, 14 bp, Homo sapiens
tgcacagggagacg

SEQ ID NO: 5527505 - DNA, 18 bp, Homo sapiens
tgcacagggattctcaca

SEQ ID NO: 5527506 - DNA, 16 bp, Homo sapiens
tgcacagggccctctg

SEQ ID NO: 5527507 - DNA, 14 bp, Homo sapiens
tgcacagggtgtgg

SEQ ID NO: 5527508 - DNA, 14 bp, Homo sapiens
tgcacaggtttgtt

SEQ ID NO: 5527509 - DNA, 21 bp, Homo sapiens
tgcacaggtttgttttttcaa

SEQ ID NO: 5527510 - DNA, 23 bp, Homo sapiens
tgcacaggtttgttttttcaaga

SEQ ID NO: 5527511 - DNA, 22 bp, Homo sapiens
tgcacagtaatatgaaagccac

SEQ ID NO: 5527512 - DNA, 17 bp, Homo sapiens
tgcacagtacaataatg

SEQ ID NO: 5527513 - DNA, 19 bp, Homo sapiens
tgcacagtacaataatgta

SEQ ID NO: 5527514 - DNA, 21 bp, Homo sapiens
tgcacagtacaataatgtact

SEQ ID NO: 5527515 - DNA, 18 bp, Homo sapiens
tgcacagtatctgctgtt

SEQ ID NO: 5527516 - DNA, 17 bp, Homo sapiens
tgcacagtatttgtaat

SEQ ID NO: 5527517 - DNA, 17 bp, Homo sapiens
tgcacagtcactgctct

SEQ ID NO: 5527518 - DNA, 22 bp, Homo sapiens
tgcacagtccacagctgaagag

SEQ ID NO: 5527519 - DNA, 16 bp, Homo sapiens
tgcacagtccctcctg

SEQ ID NO: 5527520 - DNA, 15 bp, Homo sapiens
tgcacagtgacttct

SEQ ID NO: 5527521 - DNA, 16 bp, Homo sapiens
tgcacagtgacttctg

SEQ ID NO: 5527522 - DNA, 17 bp, Homo sapiens
tgcacagtgacttctga

SEQ ID NO: 5527523 - DNA, 19 bp, Homo sapiens
tgcacagtgacttctgaga

SEQ ID NO: 5527524 - DNA, 13 bp, Homo sapiens
tgcacagtgattt

SEQ ID NO: 5527525 - DNA, 16 bp, Homo sapiens
tgcacagtgcatctca

SEQ ID NO: 5527526 - DNA, 15 bp, Homo sapiens
tgcacagtggtccag

SEQ ID NO: 5527527 - DNA, 16 bp, Homo sapiens
tgcacagtgtgtgact

SEQ ID NO: 5527528 - DNA, 22 bp, Homo sapiens
tgcacagttagcaaactttgta

SEQ ID NO: 5527529 - DNA, 23 bp, Homo sapiens
tgcacagttagttgtgaaagaaa

SEQ ID NO: 5527530 - DNA, 19 bp, Homo sapiens
tgcacagttgccacattta

SEQ ID NO: 5527531 - DNA, 20 bp, Homo sapiens
tgcacagtttagaacagagg

SEQ ID NO: 5527532 - DNA, 22 bp, Homo sapiens
tgcacagtttgcaatcttatgt

SEQ ID NO: 5527533 - DNA, 17 bp, Homo sapiens
tgcacagtttgctattt

SEQ ID NO: 5527534 - DNA, 23 bp, Homo sapiens
tgcacagttttctggctggagcc

SEQ ID NO: 5527535 - DNA, 18 bp, Homo sapiens
tgcacataaactctttta

SEQ ID NO: 5527536 - DNA, 22 bp, Homo sapiens
tgcacataagcttccattttaa

SEQ ID NO: 5527537 - DNA, 13 bp, Homo sapiens
tgcacatacagat

SEQ ID NO: 5527538 - DNA, 22 bp, Homo sapiens
tgcacatagctatcaagtgtgc

SEQ ID NO: 5527539 - DNA, 17 bp, Homo sapiens
tgcacatatcaagaagt

SEQ ID NO: 5527540 - DNA, 15 bp, Homo sapiens
tgcacatatggactc

SEQ ID NO: 5527541 - DNA, 19 bp, Homo sapiens
tgcacatatggactctgca

SEQ ID NO: 5527542 - DNA, 13 bp, Homo sapiens
tgcacatatttga

SEQ ID NO: 5527543 - DNA, 12 bp, Homo sapiens
tgcacatccctg

SEQ ID NO: 5527544 - DNA, 21 bp, Homo sapiens
tgcacatctacatgccatgcc

SEQ ID NO: 5527545 - DNA, 14 bp, Homo sapiens
tgcacatctacttg

SEQ ID NO: 5527546 - DNA, 14 bp, Homo sapiens
tgcacatctctgct

SEQ ID NO: 5527547 - DNA, 15 bp, Homo sapiens
tgcacatctctgctt

SEQ ID NO: 5527548 - DNA, 18 bp, Homo sapiens
tgcacatctgtgtcttgt

SEQ ID NO: 5527549 - DNA, 24 bp, Homo sapiens
tgcacatcttggctatgtaattct

SEQ ID NO: 5527550 - DNA, 21 bp, Homo sapiens
tgcacatgaacttagatttta

SEQ ID NO: 5527551 - DNA, 23 bp, Homo sapiens
tgcacatgaatcccacccacatg

SEQ ID NO: 5527552 - DNA, 14 bp, Homo sapiens
tgcacatgaatgca

SEQ ID NO: 5527553 - DNA, 16 bp, Homo sapiens
tgcacatgattgtata

SEQ ID NO: 5527554 - DNA, 23 bp, Homo sapiens
tgcacatgattgtataagcatgc

SEQ ID NO: 5527555 - DNA, 20 bp, Homo sapiens
tgcacatgccccttggtcct

SEQ ID NO: 5527556 - DNA, 14 bp, Homo sapiens
tgcacatgcctctg

SEQ ID NO: 5527557 - DNA, 19 bp, Homo sapiens
tgcacatgctgtctggccc

SEQ ID NO: 5527558 - DNA, 22 bp, Homo sapiens
tgcacatgctgtctggccctgg

SEQ ID NO: 5527559 - DNA, 12 bp, Homo sapiens
tgcacatggaca

SEQ ID NO: 5527560 - DNA, 12 bp, Homo sapiens
tgcacatggcct

SEQ ID NO: 5527561 - DNA, 17 bp, Homo sapiens
tgcacatggcctgagca

SEQ ID NO: 5527562 - DNA, 14 bp, Homo sapiens
tgcacatgtattct

SEQ ID NO: 5527563 - DNA, 15 bp, Homo sapiens
tgcacatgtcttgta

SEQ ID NO: 5527564 - DNA, 19 bp, Homo sapiens
tgcacatgtcttgtacatg

SEQ ID NO: 5527565 - DNA, 13 bp, Homo sapiens
tgcacatgtgtgc

SEQ ID NO: 5527566 - DNA, 17 bp, Homo sapiens
tgcacatgtttcctcta

SEQ ID NO: 5527567 - DNA, 18 bp, Homo sapiens
tgcacatgtttcctctag

SEQ ID NO: 5527568 - DNA, 21 bp, Homo sapiens
tgcacattaggaacagagtat

SEQ ID NO: 5527569 - DNA, 14 bp, Homo sapiens
tgcacattcctggc

SEQ ID NO: 5527570 - DNA, 15 bp, Homo sapiens
tgcacattcctggcc

SEQ ID NO: 5527571 - DNA, 16 bp, Homo sapiens
tgcacattcctggccc

SEQ ID NO: 5527572 - DNA, 17 bp, Homo sapiens
tgcacattcctggcccc

SEQ ID NO: 5527573 - DNA, 22 bp, Homo sapiens
tgcacattgcctgttctgcttc

SEQ ID NO: 5527574 - DNA, 14 bp, Homo sapiens
tgcacatttctgga

SEQ ID NO: 5527575 - DNA, 17 bp, Homo sapiens
tgcacatttctggattg

SEQ ID NO: 5527576 - DNA, 18 bp, Homo sapiens
tgcacatttgaattcatt

SEQ ID NO: 5527577 - DNA, 22 bp, Homo sapiens
tgcacatttgctcagaattgca

SEQ ID NO: 5527578 - DNA, 13 bp, Homo sapiens
tgcacattttcca

SEQ ID NO: 5527579 - DNA, 17 bp, Homo sapiens
tgcacattttccacgga

SEQ ID NO: 5527580 - DNA, 19 bp, Homo sapiens
tgcacattttgtacaaaga

SEQ ID NO: 5527581 - DNA, 23 bp, Homo sapiens
tgcacattttgtacaaagatatg

SEQ ID NO: 5527582 - DNA, 21 bp, Homo sapiens
tgcaccaaactgcctcaatcc

SEQ ID NO: 5527583 - DNA, 12 bp, Homo sapiens
tgcaccaaagac

SEQ ID NO: 5527584 - DNA, 13 bp, Homo sapiens
tgcaccaaagaca

SEQ ID NO: 5527585 - DNA, 16 bp, Homo sapiens
tgcaccaaagatgtcc

SEQ ID NO: 5527586 - DNA, 18 bp, Homo sapiens
tgcaccaaagatgtcctg

SEQ ID NO: 5527587 - DNA, 19 bp, Homo sapiens
tgcaccaacccagccgctg

SEQ ID NO: 5527588 - DNA, 23 bp, Homo sapiens
tgcaccaagcacccactgtgcac

SEQ ID NO: 5527589 - DNA, 22 bp, Homo sapiens
tgcaccaagcaggaaatgaaaa

SEQ ID NO: 5527590 - DNA, 20 bp, Homo sapiens
tgcaccaatcttgtttatag

SEQ ID NO: 5527591 - DNA, 14 bp, Homo sapiens
tgcaccacacctgg

SEQ ID NO: 5527592 - DNA, 19 bp, Homo sapiens
tgcaccacacctggcatgg

SEQ ID NO: 5527593 - DNA, 20 bp, Homo sapiens
tgcaccaccatgccaggcta

SEQ ID NO: 5527594 - DNA, 15 bp, Homo sapiens
tgcaccactgcactc

SEQ ID NO: 5527595 - DNA, 22 bp, Homo sapiens
tgcaccactgcactccagcctg

SEQ ID NO: 5527596 - DNA, 21 bp, Homo sapiens
tgcaccagagcaacctctcac

SEQ ID NO: 5527597 - DNA, 12 bp, Homo sapiens
tgcaccagagtg

SEQ ID NO: 5527598 - DNA, 21 bp, Homo sapiens
tgcaccagcccttccctgctt

SEQ ID NO: 5527599 - DNA, 22 bp, Homo sapiens
tgcaccagcccttccctgcttt

SEQ ID NO: 5527600 - DNA, 23 bp, Homo sapiens
tgcaccagcccttccctgctttg

SEQ ID NO: 5527601 - DNA, 16 bp, Homo sapiens
tgcaccaggggtgcac

SEQ ID NO: 5527602 - DNA, 23 bp, Homo sapiens
tgcaccagggttgaccccagagg

SEQ ID NO: 5527603 - DNA, 21 bp, Homo sapiens
tgcaccaggtagaacgccagg

SEQ ID NO: 5527604 - DNA, 13 bp, Homo sapiens
tgcaccagtttta

SEQ ID NO: 5527605 - DNA, 22 bp, Homo sapiens
tgcaccatagtatgctctgagt

SEQ ID NO: 5527606 - DNA, 23 bp, Homo sapiens
tgcaccatgctgctggggaagac

SEQ ID NO: 5527607 - DNA, 15 bp, Homo sapiens
tgcaccatggagacg

SEQ ID NO: 5527608 - DNA, 14 bp, Homo sapiens
tgcaccatgtgaag

SEQ ID NO: 5527609 - DNA, 15 bp, Homo sapiens
tgcaccattgctgct

SEQ ID NO: 5527610 - DNA, 15 bp, Homo sapiens
tgcaccattttcaat

SEQ ID NO: 5527611 - DNA, 22 bp, Homo sapiens
tgcacccacccaagacaagtga

SEQ ID NO: 5527612 - DNA, 18 bp, Homo sapiens
tgcacccacccaggagtg

SEQ ID NO: 5527613 - DNA, 13 bp, Homo sapiens
tgcacccacccct

SEQ ID NO: 5527614 - DNA, 15 bp, Homo sapiens
tgcacccacccctgc

SEQ ID NO: 5527615 - DNA, 17 bp, Homo sapiens
tgcacccacccctgccc

SEQ ID NO: 5527616 - DNA, 15 bp, Homo sapiens
tgcacccacctactt

SEQ ID NO: 5527617 - DNA, 20 bp, Homo sapiens
tgcacccactaatgtgtcat

SEQ ID NO: 5527618 - DNA, 16 bp, Homo sapiens
tgcacccactcaccag

SEQ ID NO: 5527619 - DNA, 21 bp, Homo sapiens
tgcacccactctgctttgact

SEQ ID NO: 5527620 - DNA, 13 bp, Homo sapiens
tgcacccagaaca

SEQ ID NO: 5527621 - DNA, 14 bp, Homo sapiens
tgcacccagaacag

SEQ ID NO: 5527622 - DNA, 17 bp, Homo sapiens
tgcacccagaacagtgg

SEQ ID NO: 5527623 - DNA, 20 bp, Homo sapiens
tgcacccagcatcaccagct

SEQ ID NO: 5527624 - DNA, 19 bp, Homo sapiens
tgcacccagccaaacacat

SEQ ID NO: 5527625 - DNA, 14 bp, Homo sapiens
tgcacccagccctg

SEQ ID NO: 5527626 - DNA, 16 bp, Homo sapiens
tgcacccagctccagg

SEQ ID NO: 5527627 - DNA, 22 bp, Homo sapiens
tgcacccaggaggggaacactg

SEQ ID NO: 5527628 - DNA, 15 bp, Homo sapiens
tgcacccaggggtgg

SEQ ID NO: 5527629 - DNA, 15 bp, Homo sapiens
tgcacccatgggctc

SEQ ID NO: 5527630 - DNA, 21 bp, Homo sapiens
tgcacccatgggctctgacag

SEQ ID NO: 5527631 - DNA, 22 bp, Homo sapiens
tgcacccatgggctctgacaga

SEQ ID NO: 5527632 - DNA, 16 bp, Homo sapiens
tgcacccatggtacca

SEQ ID NO: 5527633 - DNA, 23 bp, Homo sapiens
tgcaccccaaagctttcctgccc

SEQ ID NO: 5527634 - DNA, 16 bp, Homo sapiens
tgcaccccaacattga

SEQ ID NO: 5527635 - DNA, 14 bp, Homo sapiens
tgcaccccaagtcc

SEQ ID NO: 5527636 - DNA, 13 bp, Homo sapiens
tgcaccccacagg

SEQ ID NO: 5527637 - DNA, 15 bp, Homo sapiens
tgcaccccagcattc

SEQ ID NO: 5527638 - DNA, 20 bp, Homo sapiens
tgcaccccagcattccagct

SEQ ID NO: 5527639 - DNA, 23 bp, Homo sapiens
tgcaccccagcattccagctctg

SEQ ID NO: 5527640 - DNA, 23 bp, Homo sapiens
tgcaccccatgtgggtgaccagg

SEQ ID NO: 5527641 - DNA, 16 bp, Homo sapiens
tgcacccccctgggct

SEQ ID NO: 5527642 - DNA, 20 bp, Homo sapiens
tgcacccccctgtgcctgct

SEQ ID NO: 5527643 - DNA, 12 bp, Homo sapiens
tgcaccccctcc

SEQ ID NO: 5527644 - DNA, 19 bp, Homo sapiens
tgcaccccctcctgctgca

SEQ ID NO: 5527645 - DNA, 23 bp, Homo sapiens
tgcaccccgccggaggaaggtcc

SEQ ID NO: 5527646 - DNA, 13 bp, Homo sapiens
tgcacccctccca

SEQ ID NO: 5527647 - DNA, 14 bp, Homo sapiens
tgcacccctcccat

SEQ ID NO: 5527648 - DNA, 15 bp, Homo sapiens
tgcacccctccccat

SEQ ID NO: 5527649 - DNA, 22 bp, Homo sapiens
tgcacccctgagccagcagggc

SEQ ID NO: 5527650 - DNA, 14 bp, Homo sapiens
tgcacccctgggcc

SEQ ID NO: 5527651 - DNA, 15 bp, Homo sapiens
tgcacccctggtgtc

SEQ ID NO: 5527652 - DNA, 16 bp, Homo sapiens
tgcaccccttcctggg

SEQ ID NO: 5527653 - DNA, 19 bp, Homo sapiens
tgcaccccttcctgggcac

SEQ ID NO: 5527654 - DNA, 19 bp, Homo sapiens
tgcacccctttcctcccca

SEQ ID NO: 5527655 - DNA, 22 bp, Homo sapiens
tgcacccgcatgtacaaaaaca

SEQ ID NO: 5527656 - DNA, 16 bp, Homo sapiens
tgcacccgcctctccc

SEQ ID NO: 5527657 - DNA, 17 bp, Homo sapiens
tgcacccggcctggatg

SEQ ID NO: 5527658 - DNA, 18 bp, Homo sapiens
tgcacccggcctggatgc

SEQ ID NO: 5527659 - DNA, 20 bp, Homo sapiens
tgcaccctcaacctcctggg

SEQ ID NO: 5527660 - DNA, 17 bp, Homo sapiens
tgcaccctcaggcaggt

SEQ ID NO: 5527661 - DNA, 18 bp, Homo sapiens
tgcaccctcattccctcg

SEQ ID NO: 5527662 - DNA, 14 bp, Homo sapiens
tgcaccctccgcct

SEQ ID NO: 5527663 - DNA, 20 bp, Homo sapiens
tgcaccctctgctatgtctg

SEQ ID NO: 5527664 - DNA, 18 bp, Homo sapiens
tgcaccctgcgcctccag

SEQ ID NO: 5527665 - DNA, 15 bp, Homo sapiens
tgcaccctggggcct

SEQ ID NO: 5527666 - DNA, 20 bp, Homo sapiens
tgcaccctgtagatgttcta

SEQ ID NO: 5527667 - DNA, 16 bp, Homo sapiens
tgcacccttccctctt

SEQ ID NO: 5527668 - DNA, 23 bp, Homo sapiens
tgcacccttccctcttccctctc

SEQ ID NO: 5527669 - DNA, 14 bp, Homo sapiens
tgcacccttctttt

SEQ ID NO: 5527670 - DNA, 15 bp, Homo sapiens
tgcaccgaccccggg

SEQ ID NO: 5527671 - DNA, 17 bp, Homo sapiens
tgcaccgacgcctgccc

SEQ ID NO: 5527672 - DNA, 22 bp, Homo sapiens
tgcaccgccgccaccctgcccc

SEQ ID NO: 5527673 - DNA, 23 bp, Homo sapiens
tgcaccgccgccaccctgcccct

SEQ ID NO: 5527674 - DNA, 15 bp, Homo sapiens
tgcagacagaatata

SEQ ID NO: 5527675 - DNA, 14 bp, Homo sapiens
tgcagacagccatg

SEQ ID NO: 5527676 - DNA, 16 bp, Homo sapiens
tgcagacagccatgcg

SEQ ID NO: 5527677 - DNA, 22 bp, Homo sapiens
tgcagacaggcaagcacctcct

SEQ ID NO: 5527678 - DNA, 14 bp, Homo sapiens
tgcagacagtctgt

SEQ ID NO: 5527679 - DNA, 18 bp, Homo sapiens
tgcagacagtctgttatg

SEQ ID NO: 5527680 - DNA, 22 bp, Homo sapiens
tgcagacagtctgttatgcact

SEQ ID NO: 5527681 - DNA, 16 bp, Homo sapiens
tgcagacatctctgga

SEQ ID NO: 5527682 - DNA, 18 bp, Homo sapiens
tgcagacatctctggagc

SEQ ID NO: 5527683 - DNA, 15 bp, Homo sapiens
tgcagacattctcaa

SEQ ID NO: 5527684 - DNA, 13 bp, Homo sapiens
tgcagaccccagg

SEQ ID NO: 5527685 - DNA, 16 bp, Homo sapiens
tgcagaccccaggttc

SEQ ID NO: 5527686 - DNA, 17 bp, Homo sapiens
tgcagaccccttggcca

SEQ ID NO: 5527687 - DNA, 19 bp, Homo sapiens
tgcagaccccttggccagc

SEQ ID NO: 5527688 - DNA, 23 bp, Homo sapiens
tgcagaccctgaacccacacctg

SEQ ID NO: 5527689 - DNA, 15 bp, Homo sapiens
tgcagaccctgccct

SEQ ID NO: 5527690 - DNA, 15 bp, Homo sapiens
tgcagacctcaagcc

SEQ ID NO: 5527691 - DNA, 18 bp, Homo sapiens
tgcagacctcactgtcag

SEQ ID NO: 5527692 - DNA, 19 bp, Homo sapiens
tgcagacctcactgtcagg

SEQ ID NO: 5527693 - DNA, 14 bp, Homo sapiens
tgcagacctcatgc

SEQ ID NO: 5527694 - DNA, 11 bp, Homo sapiens
tgcagacctgg

SEQ ID NO: 5527695 - DNA, 16 bp, Homo sapiens
tgcagacctggctggg

SEQ ID NO: 5527696 - DNA, 18 bp, Homo sapiens
tgcagacctggctgggcc

SEQ ID NO: 5527697 - DNA, 19 bp, Homo sapiens
tgcagacctggctgggcct

SEQ ID NO: 5527698 - DNA, 21 bp, Homo sapiens
tgcagacctggctgggcctgg

SEQ ID NO: 5527699 - DNA, 15 bp, Homo sapiens
tgcagacctgggact

SEQ ID NO: 5527700 - DNA, 15 bp, Homo sapiens
tgcagacctgtcctc

SEQ ID NO: 5527701 - DNA, 16 bp, Homo sapiens
tgcagaccttactcag

SEQ ID NO: 5527702 - DNA, 19 bp, Homo sapiens
tgcagacgccacagtctcc

SEQ ID NO: 5527703 - DNA, 14 bp, Homo sapiens
tgcagacgcccaga

SEQ ID NO: 5527704 - DNA, 20 bp, Homo sapiens
tgcagacggatgcccattcc

SEQ ID NO: 5527705 - DNA, 19 bp, Homo sapiens
tgcagacgggaatgcctag

SEQ ID NO: 5527706 - DNA, 20 bp, Homo sapiens
tgcagacgggaatgcctagg

SEQ ID NO: 5527707 - DNA, 21 bp, Homo sapiens
tgcagacgtctggccctggcg

SEQ ID NO: 5527708 - DNA, 19 bp, Homo sapiens
tgcagactagaattctagt

SEQ ID NO: 5527709 - DNA, 19 bp, Homo sapiens
tgcagactcagtttgtcag

SEQ ID NO: 5527710 - DNA, 20 bp, Homo sapiens
tgcagactccaatggggcca

SEQ ID NO: 5527711 - DNA, 22 bp, Homo sapiens
tgcagactccaatggggccagc

SEQ ID NO: 5527712 - DNA, 24 bp, Homo sapiens
tgcagactcgttctcgtgacccag

SEQ ID NO: 5527713 - DNA, 22 bp, Homo sapiens
tgcagactgctagtgttctgtc

SEQ ID NO: 5527714 - DNA, 14 bp, Homo sapiens
tgcagactggaggg

SEQ ID NO: 5527715 - DNA, 18 bp, Homo sapiens
tgcagactggcagtcgca

SEQ ID NO: 5527716 - DNA, 18 bp, Homo sapiens
tgcagactgtggctgcag

SEQ ID NO: 5527717 - DNA, 23 bp, Homo sapiens
tgcagactgtggctgcagagacc

SEQ ID NO: 5527718 - DNA, 10 bp, Homo sapiens
tgcagagaaa

SEQ ID NO: 5527719 - DNA, 21 bp, Homo sapiens
tgcagagaaacttaagcaaag

SEQ ID NO: 5527720 - DNA, 15 bp, Homo sapiens
tgcagagaaagaaag

SEQ ID NO: 5527721 - DNA, 20 bp, Homo sapiens
tgcagagaaagaaagggaaa

SEQ ID NO: 5527722 - DNA, 21 bp, Homo sapiens
tgcagagaagaataagacata

SEQ ID NO: 5527723 - DNA, 18 bp, Homo sapiens
tgcagagaagattttata

SEQ ID NO: 5527724 - DNA, 18 bp, Homo sapiens
tgcagagaagcatcctcc

SEQ ID NO: 5527725 - DNA, 14 bp, Homo sapiens
tgcagagaagctgg

SEQ ID NO: 5527726 - DNA, 17 bp, Homo sapiens
tgcagagacaggacctg

SEQ ID NO: 5527727 - DNA, 18 bp, Homo sapiens
tgcagagagcacctggtg

SEQ ID NO: 5527728 - DNA, 17 bp, Homo sapiens
tgcagagagccattttg

SEQ ID NO: 5527729 - DNA, 12 bp, Homo sapiens
tgcagagatcct

SEQ ID NO: 5527730 - DNA, 18 bp, Homo sapiens
tgcagagatttcctccat

SEQ ID NO: 5527731 - DNA, 19 bp, Homo sapiens
tgcagagatttcctccatg

SEQ ID NO: 5527732 - DNA, 20 bp, Homo sapiens
tgcagagatttctcattgac

SEQ ID NO: 5527733 - DNA, 13 bp, Homo sapiens
tgcagagcaataa

SEQ ID NO: 5527734 - DNA, 19 bp, Homo sapiens
tgcagagcaataacactat

SEQ ID NO: 5527735 - DNA, 23 bp, Homo sapiens
tgcagagcaataacactatattt

SEQ ID NO: 5527736 - DNA, 11 bp, Homo sapiens
tgcagagcaga

SEQ ID NO: 5527737 - DNA, 14 bp, Homo sapiens
tgcagagcagacag

SEQ ID NO: 5527738 - DNA, 16 bp, Homo sapiens
tgcagagcagacaggc

SEQ ID NO: 5527739 - DNA, 13 bp, Homo sapiens
tgcagagcagatg

SEQ ID NO: 5527740 - DNA, 17 bp, Homo sapiens
tgcagagcagtaaggga

SEQ ID NO: 5527741 - DNA, 18 bp, Homo sapiens
tgcagagcagtaagggaa

SEQ ID NO: 5527742 - DNA, 20 bp, Homo sapiens
tgcagagcctgcagggtgac

SEQ ID NO: 5527743 - DNA, 11 bp, Homo sapiens
tgcagagcctt

SEQ ID NO: 5527744 - DNA, 16 bp, Homo sapiens
tgcagagccttctcag

SEQ ID NO: 5527745 - DNA, 19 bp, Homo sapiens
tgcagagccttctcagaag

SEQ ID NO: 5527746 - DNA, 14 bp, Homo sapiens
tgcagagctatggt

SEQ ID NO: 5527747 - DNA, 19 bp, Homo sapiens
tgcagagctatggtgaggt

SEQ ID NO: 5527748 - DNA, 13 bp, Homo sapiens
tgcagagctgaag

SEQ ID NO: 5527749 - DNA, 18 bp, Homo sapiens
tgcagagctgacccagag

SEQ ID NO: 5527750 - DNA, 14 bp, Homo sapiens
tgcagagctgcact

SEQ ID NO: 5527751 - DNA, 12 bp, Homo sapiens
tgcagagctggg

SEQ ID NO: 5527752 - DNA, 19 bp, Homo sapiens
tgcagagctttggccatta

SEQ ID NO: 5527753 - DNA, 13 bp, Homo sapiens
tgcagaggaagag

SEQ ID NO: 5527754 - DNA, 21 bp, Homo sapiens
tgcagaggaagtacaaactaa

SEQ ID NO: 5527755 - DNA, 18 bp, Homo sapiens
tgcagaggagccacctgg

SEQ ID NO: 5527756 - DNA, 21 bp, Homo sapiens
tgcagaggagccacctgggct

SEQ ID NO: 5527757 - DNA, 18 bp, Homo sapiens
tgcagaggagcccagtgg

SEQ ID NO: 5527758 - DNA, 16 bp, Homo sapiens
tgcagaggaggtaaga

SEQ ID NO: 5527759 - DNA, 18 bp, Homo sapiens
tgcagaggatttaactgt

SEQ ID NO: 5527760 - DNA, 13 bp, Homo sapiens
tgcagaggcagca

SEQ ID NO: 5527761 - DNA, 20 bp, Homo sapiens
tgcagaggcagcaggagcca

SEQ ID NO: 5527762 - DNA, 19 bp, Homo sapiens
tgcagaggcctgcagggcc

SEQ ID NO: 5527763 - DNA, 14 bp, Homo sapiens
tgcagaggcggctc

SEQ ID NO: 5527764 - DNA, 17 bp, Homo sapiens
tgcagaggcggctctgg

SEQ ID NO: 5527765 - DNA, 16 bp, Homo sapiens
tgcagaggctgagcag

SEQ ID NO: 5527766 - DNA, 13 bp, Homo sapiens
tgcagaggctgtg

SEQ ID NO: 5527767 - DNA, 21 bp, Homo sapiens
tgcagaggggcaggccctgca

SEQ ID NO: 5527768 - DNA, 21 bp, Homo sapiens
tgcagaggggctttctggaga

SEQ ID NO: 5527769 - DNA, 21 bp, Homo sapiens
tgcagagggtttgtgcccagt

SEQ ID NO: 5527770 - DNA, 15 bp, Homo sapiens
tgcagaggtaccctg

SEQ ID NO: 5527771 - DNA, 18 bp, Homo sapiens
tgcagaggtaccctgggt

SEQ ID NO: 5527772 - DNA, 15 bp, Homo sapiens
tgcagaggtcagact

SEQ ID NO: 5527773 - DNA, 16 bp, Homo sapiens
tgcagaggtctccaaa

SEQ ID NO: 5527774 - DNA, 22 bp, Homo sapiens
tgcagaggtctgtgctgaggcc

SEQ ID NO: 5527775 - DNA, 14 bp, Homo sapiens
tgcagaggtttctt

SEQ ID NO: 5527776 - DNA, 13 bp, Homo sapiens
tgcagagtaaatc

SEQ ID NO: 5527777 - DNA, 15 bp, Homo sapiens
tgcagagtaagtatt

SEQ ID NO: 5527778 - DNA, 16 bp, Homo sapiens
tgcagagtaagtatta

SEQ ID NO: 5527779 - DNA, 15 bp, Homo sapiens
tgcagagtcagcaga

SEQ ID NO: 5527780 - DNA, 23 bp, Homo sapiens
tgcagagtgaccagcacactgga

SEQ ID NO: 5527781 - DNA, 15 bp, Homo sapiens
tgcagagtgcccaga

SEQ ID NO: 5527782 - DNA, 23 bp, Homo sapiens
tgcagagtgccccatcggtcacc

SEQ ID NO: 5527783 - DNA, 23 bp, Homo sapiens
tgcagagtggtgaagttcacttc

SEQ ID NO: 5527784 - DNA, 15 bp, Homo sapiens
tgcagagttgaagtt

SEQ ID NO: 5527785 - DNA, 16 bp, Homo sapiens
tgcagataaacagtag

SEQ ID NO: 5527786 - DNA, 21 bp, Homo sapiens
tgcagataaactgatgtttga

SEQ ID NO: 5527787 - DNA, 17 bp, Homo sapiens
tgcagataacagctggt

SEQ ID NO: 5527788 - DNA, 17 bp, Homo sapiens
tgcagataactttgact

SEQ ID NO: 5527789 - DNA, 16 bp, Homo sapiens
tgcagataattctgga

SEQ ID NO: 5527790 - DNA, 22 bp, Homo sapiens
tgcagatagaatttggcccaga

SEQ ID NO: 5527791 - DNA, 18 bp, Homo sapiens
tgcagatagccagacaca

SEQ ID NO: 5527792 - DNA, 19 bp, Homo sapiens
tgcagatagcccaggagca

SEQ ID NO: 5527793 - DNA, 18 bp, Homo sapiens
tgcagatagtgcctctgc

SEQ ID NO: 5527794 - DNA, 18 bp, Homo sapiens
tgcagatatctgcatgtg

SEQ ID NO: 5527795 - DNA, 19 bp, Homo sapiens
tgcagatcatccgtctgtg

SEQ ID NO: 5527796 - DNA, 20 bp, Homo sapiens
tgcagatcccagcccaccct

SEQ ID NO: 5527797 - DNA, 17 bp, Homo sapiens
tgcagatctagccaggc

SEQ ID NO: 5527798 - DNA, 13 bp, Homo sapiens
tgcagatgaaaaa

SEQ ID NO: 5527799 - DNA, 13 bp, Homo sapiens
tgcagatgaaatg

SEQ ID NO: 5527800 - DNA, 18 bp, Homo sapiens
tgcagatgaagtaactga

SEQ ID NO: 5527801 - DNA, 17 bp, Homo sapiens
tgcagatgactggaaac

SEQ ID NO: 5527802 - DNA, 20 bp, Homo sapiens
tgcagatgactggaaacaag

SEQ ID NO: 5527803 - DNA, 14 bp, Homo sapiens
tgcagatgcctggg

SEQ ID NO: 5527804 - DNA, 17 bp, Homo sapiens
tgcagatgctgctgaag

SEQ ID NO: 5527805 - DNA, 14 bp, Homo sapiens
tgcagatgggctgt

SEQ ID NO: 5527806 - DNA, 13 bp, Homo sapiens
tgcagatgggtga

SEQ ID NO: 5527807 - DNA, 14 bp, Homo sapiens
tgcagatgttcaaa

SEQ ID NO: 5527808 - DNA, 14 bp, Homo sapiens
tgcagattcctggg

SEQ ID NO: 5527809 - DNA, 15 bp, Homo sapiens
tgcagattcctgggc

SEQ ID NO: 5527810 - DNA, 17 bp, Homo sapiens
tgcagattcctgggcct

SEQ ID NO: 5527811 - DNA, 23 bp, Homo sapiens
tgcagattcctgggcctgtcccc

SEQ ID NO: 5527812 - DNA, 19 bp, Homo sapiens
tgcagattcctttggccac

SEQ ID NO: 5527813 - DNA, 20 bp, Homo sapiens
tgcagattctgagcaaaggc

SEQ ID NO: 5527814 - DNA, 16 bp, Homo sapiens
tgcagattctgatttt

SEQ ID NO: 5527815 - DNA, 17 bp, Homo sapiens
tgcagattgcagttctg

SEQ ID NO: 5527816 - DNA, 17 bp, Homo sapiens
tgcagatttctcacctg

SEQ ID NO: 5527817 - DNA, 17 bp, Homo sapiens
tgcagatttgggctgga

SEQ ID NO: 5527818 - DNA, 13 bp, Homo sapiens
tgcagcaaaagca

SEQ ID NO: 5527819 - DNA, 22 bp, Homo sapiens
tgcagcaaacactccaccctcc

SEQ ID NO: 5527820 - DNA, 17 bp, Homo sapiens
tgcagcaaccagagcac

SEQ ID NO: 5527821 - DNA, 19 bp, Homo sapiens
tgcagcaaccagagcactg

SEQ ID NO: 5527822 - DNA, 20 bp, Homo sapiens
tgcagcaactcccacgactg

SEQ ID NO: 5527823 - DNA, 18 bp, Homo sapiens
tgcagcaagcctggcccc

SEQ ID NO: 5527824 - DNA, 20 bp, Homo sapiens
tgcagcaataaagcagcgtt

SEQ ID NO: 5527825 - DNA, 23 bp, Homo sapiens
tgcagcaataaagcagcgtttct

SEQ ID NO: 5527826 - DNA, 22 bp, Homo sapiens
tgcagcaattaaaaattgtctt

SEQ ID NO: 5527827 - DNA, 23 bp, Homo sapiens
tgcagcacagctgagaggctgtc

SEQ ID NO: 5527828 - DNA, 22 bp, Homo sapiens
tgcagcacatgcgggctcgccc

SEQ ID NO: 5527829 - DNA, 19 bp, Homo sapiens
tgcagcacattgccctgag

SEQ ID NO: 5527830 - DNA, 20 bp, Homo sapiens
tgcagcaccgaggggccttt

SEQ ID NO: 5527831 - DNA, 19 bp, Homo sapiens
tgcagcacggacaataaac

SEQ ID NO: 5527832 - DNA, 13 bp, Homo sapiens
tgcagcacgtctc

SEQ ID NO: 5527833 - DNA, 17 bp, Homo sapiens
tgcagcacgtctcagag

SEQ ID NO: 5527834 - DNA, 20 bp, Homo sapiens
tgcagcactcacacaggacc

SEQ ID NO: 5527835 - DNA, 15 bp, Homo sapiens
tgcagcactgctgcc

SEQ ID NO: 5527836 - DNA, 19 bp, Homo sapiens
tgcagcactgctgcctcag

SEQ ID NO: 5527837 - DNA, 20 bp, Homo sapiens
tgcagcactgctgcctcagc

SEQ ID NO: 5527838 - DNA, 23 bp, Homo sapiens
tgcagcagaaaggctctgaaggt

SEQ ID NO: 5527839 - DNA, 13 bp, Homo sapiens
tgcagcagaagcc

SEQ ID NO: 5527840 - DNA, 21 bp, Homo sapiens
tgcagcagagagaaataaaac

SEQ ID NO: 5527841 - DNA, 11 bp, Homo sapiens
tgcagcagagg

SEQ ID NO: 5527842 - DNA, 22 bp, Homo sapiens
tgcagcagaggacagtctggag

SEQ ID NO: 5527843 - DNA, 16 bp, Homo sapiens
tgcagcagaggcactg

SEQ ID NO: 5527844 - DNA, 12 bp, Homo sapiens
tgcagcagataa

SEQ ID NO: 5527845 - DNA, 22 bp, Homo sapiens
tgcagcagattggaaggagaca

SEQ ID NO: 5527846 - DNA, 22 bp, Homo sapiens
tgcagcagcaacacaatgttat

SEQ ID NO: 5527847 - DNA, 16 bp, Homo sapiens
tgcagcagcccagctt

SEQ ID NO: 5527848 - DNA, 13 bp, Homo sapiens
tgcagcaggcaga

SEQ ID NO: 5527849 - DNA, 14 bp, Homo sapiens
tgcagcaggcagag

SEQ ID NO: 5527850 - DNA, 16 bp, Homo sapiens
tgcagcaggcagagga

SEQ ID NO: 5527851 - DNA, 18 bp, Homo sapiens
tgcagcaggtgctgggct

SEQ ID NO: 5527852 - DNA, 23 bp, Homo sapiens
tgcagcttgtccttgctcctgga

SEQ ID NO: 5527853 - DNA, 18 bp, Homo sapiens
tgcagcttgtgctgagcc

SEQ ID NO: 5527854 - DNA, 13 bp, Homo sapiens
tgcagctttaaaa

SEQ ID NO: 5527855 - DNA, 16 bp, Homo sapiens
tgcagctttacatgca

SEQ ID NO: 5527856 - DNA, 17 bp, Homo sapiens
tgcagctttctggaaat

SEQ ID NO: 5527857 - DNA, 17 bp, Homo sapiens
tgcagctttgaggctgg

SEQ ID NO: 5527858 - DNA, 15 bp, Homo sapiens
tgcagctttgcaaac

SEQ ID NO: 5527859 - DNA, 16 bp, Homo sapiens
tgcagctttgggaaag

SEQ ID NO: 5527860 - DNA, 14 bp, Homo sapiens
tgcaggaaaaggct

SEQ ID NO: 5527861 - DNA, 21 bp, Homo sapiens
tgcaggaaaaggctaagaaaa

SEQ ID NO: 5527862 - DNA, 17 bp, Homo sapiens
tgcaggaaaaggctgca

SEQ ID NO: 5527863 - DNA, 22 bp, Homo sapiens
tgcaggaaacatttctgacacc

SEQ ID NO: 5527864 - DNA, 13 bp, Homo sapiens
tgcaggaaatata

SEQ ID NO: 5527865 - DNA, 20 bp, Homo sapiens
tgcaggaaatcagagctggc

SEQ ID NO: 5527866 - DNA, 18 bp, Homo sapiens
tgcaggaacgagcactgg

SEQ ID NO: 5527867 - DNA, 22 bp, Homo sapiens
tgcaggaacgagcactggccag

SEQ ID NO: 5527868 - DNA, 14 bp, Homo sapiens
tgcaggaagaggcc

SEQ ID NO: 5527869 - DNA, 16 bp, Homo sapiens
tgcaggaagaggccca

SEQ ID NO: 5527870 - DNA, 16 bp, Homo sapiens
tgcaggaaggaaaact

SEQ ID NO: 5527871 - DNA, 20 bp, Homo sapiens
tgcaggaaggaaaactatgt

SEQ ID NO: 5527872 - DNA, 16 bp, Homo sapiens
tgcaggaaggagctgc

SEQ ID NO: 5527873 - DNA, 17 bp, Homo sapiens
tgcaggaaggagctgcc

SEQ ID NO: 5527874 - DNA, 19 bp, Homo sapiens
tgcaggaaggagctgcctg

SEQ ID NO: 5527875 - DNA, 23 bp, Homo sapiens
tgcaggaaggagctgcctggacc

SEQ ID NO: 5527876 - DNA, 21 bp, Homo sapiens
tgcaggaatcaaaaattgaag

SEQ ID NO: 5527877 - DNA, 19 bp, Homo sapiens
tgcaggaatcacccctctg

SEQ ID NO: 5527878 - DNA, 20 bp, Homo sapiens
tgcaggaatcacccctctgc

SEQ ID NO: 5527879 - DNA, 16 bp, Homo sapiens
tgcaggaatcccggct

SEQ ID NO: 5527880 - DNA, 20 bp, Homo sapiens
tgcaggaatcccggctccag

SEQ ID NO: 5527881 - DNA, 22 bp, Homo sapiens
tgcaggaatcccggctccagag

SEQ ID NO: 5527882 - DNA, 19 bp, Homo sapiens
tgcaggaatctttaaaaga

SEQ ID NO: 5527883 - DNA, 15 bp, Homo sapiens
tgcaggaatgctgac

SEQ ID NO: 5527884 - DNA, 15 bp, Homo sapiens
tgcaggacagatcag

SEQ ID NO: 5527885 - DNA, 12 bp, Homo sapiens
tgcaggacagct

SEQ ID NO: 5527886 - DNA, 15 bp, Homo sapiens
tgcaggacagctctt

SEQ ID NO: 5527887 - DNA, 12 bp, Homo sapiens
tgcaggacagga

SEQ ID NO: 5527888 - DNA, 19 bp, Homo sapiens
tgcaggacaggaggcggcc

SEQ ID NO: 5527889 - DNA, 19 bp, Homo sapiens
tgcaggaccctgtcctgca

SEQ ID NO: 5527890 - DNA, 23 bp, Homo sapiens
tgcaggaccttgggcacatctgc

SEQ ID NO: 5527891 - DNA, 14 bp, Homo sapiens
tgcaggactcgggc

SEQ ID NO: 5527892 - DNA, 21 bp, Homo sapiens
tgcaggactctagctcatgag

SEQ ID NO: 5527893 - DNA, 20 bp, Homo sapiens
tgcaggacttgcacacaggg

SEQ ID NO: 5527894 - DNA, 14 bp, Homo sapiens
tgcaggagaaaagt

SEQ ID NO: 5527895 - DNA, 17 bp, Homo sapiens
tgcaggagacattttca

SEQ ID NO: 5527896 - DNA, 15 bp, Homo sapiens
tgcaggagagagcag

SEQ ID NO: 5527897 - DNA, 21 bp, Homo sapiens
tgcaggagcagtttgccaccc

SEQ ID NO: 5527898 - DNA, 15 bp, Homo sapiens
tgcaggagcccccct

SEQ ID NO: 5527899 - DNA, 15 bp, Homo sapiens
tgcaggagcctccct

SEQ ID NO: 5527900 - DNA, 13 bp, Homo sapiens
tgcaggaggcctg

SEQ ID NO: 5527901 - DNA, 14 bp, Homo sapiens
tgcaggaggcctgg

SEQ ID NO: 5527902 - DNA, 13 bp, Homo sapiens
tgcaggagggcac

SEQ ID NO: 5527903 - DNA, 15 bp, Homo sapiens
tgcaggagggcactg

SEQ ID NO: 5527904 - DNA, 14 bp, Homo sapiens
tgcaggaggtggag

SEQ ID NO: 5527905 - DNA, 23 bp, Homo sapiens
tgcaggagttaaaaagggcaggg

SEQ ID NO: 5527906 - DNA, 15 bp, Homo sapiens
tgcaggagttccttt

SEQ ID NO: 5527907 - DNA, 14 bp, Homo sapiens
tgcaggataataat

SEQ ID NO: 5527908 - DNA, 19 bp, Homo sapiens
tgcaggatctcaccaggca

SEQ ID NO: 5527909 - DNA, 22 bp, Homo sapiens
tgcaggatctcaccaggcagcc

SEQ ID NO: 5527910 - DNA, 20 bp, Homo sapiens
tgcaggatctgtctgtgcac

SEQ ID NO: 5527911 - DNA, 17 bp, Homo sapiens
tgcaggattcccttctg

SEQ ID NO: 5527912 - DNA, 21 bp, Homo sapiens
tgcaggattcccttctgggct

SEQ ID NO: 5527913 - DNA, 23 bp, Homo sapiens
tgcaggcaacattaccttgtctt

SEQ ID NO: 5527914 - DNA, 16 bp, Homo sapiens
tgcaggcaccgctggg

SEQ ID NO: 5527915 - DNA, 21 bp, Homo sapiens
tgcaggcaccgctgggttctg

SEQ ID NO: 5527916 - DNA, 12 bp, Homo sapiens
tgcaggcagaca

SEQ ID NO: 5527917 - DNA, 15 bp, Homo sapiens
tgcaggcagagctgg

SEQ ID NO: 5527918 - DNA, 16 bp, Homo sapiens
tgcaggcagagctgga

SEQ ID NO: 5527919 - DNA, 19 bp, Homo sapiens
tgcaggcagagctggagcc

SEQ ID NO: 5527920 - DNA, 21 bp, Homo sapiens
tgcaggcagagctggagcccc

SEQ ID NO: 5527921 - DNA, 22 bp, Homo sapiens
tgcaggcagagctggagccccc

SEQ ID NO: 5527922 - DNA, 15 bp, Homo sapiens
tgcaggcagcacagc

SEQ ID NO: 5527923 - DNA, 11 bp, Homo sapiens
tgcaggcagcc

SEQ ID NO: 5527924 - DNA, 13 bp, Homo sapiens
tgcaggcagccag

SEQ ID NO: 5527925 - DNA, 13 bp, Homo sapiens
tgcaggcagcctg

SEQ ID NO: 5527926 - DNA, 23 bp, Homo sapiens
tgcaggcagccttgcccattctc

SEQ ID NO: 5527927 - DNA, 10 bp, Homo sapiens
tgcaggcagg

SEQ ID NO: 5527928 - DNA, 20 bp, Homo sapiens
tgcaggcaggaacaaacagg

SEQ ID NO: 5527929 - DNA, 17 bp, Homo sapiens
tgcaggcaggcggctcc

SEQ ID NO: 5527930 - DNA, 21 bp, Homo sapiens
tgcaggcaggtgtgaacatgg

SEQ ID NO: 5527931 - DNA, 23 bp, Homo sapiens
tgcaggcagtgtcttaaggagac

SEQ ID NO: 5527932 - DNA, 22 bp, Homo sapiens
tgcaggcatgcttctcaccgtg

SEQ ID NO: 5527933 - DNA, 12 bp, Homo sapiens
tgcaggccacca

SEQ ID NO: 5527934 - DNA, 18 bp, Homo sapiens
tgcaggccagtggacaga

SEQ ID NO: 5527935 - DNA, 12 bp, Homo sapiens
tgcaggcccacc

SEQ ID NO: 5527936 - DNA, 17 bp, Homo sapiens
tgcaggcccaccctgct

SEQ ID NO: 5527937 - DNA, 14 bp, Homo sapiens
tgcaggcccaggca

SEQ ID NO: 5527938 - DNA, 17 bp, Homo sapiens
tgcaggcccaggcaggc

SEQ ID NO: 5527939 - DNA, 20 bp, Homo sapiens
tgcaggcccaggcaggccca

SEQ ID NO: 5527940 - DNA, 13 bp, Homo sapiens
tgcaggccccagc

SEQ ID NO: 5527941 - DNA, 12 bp, Homo sapiens
tgcaggccctgg

SEQ ID NO: 5527942 - DNA, 16 bp, Homo sapiens
tgcaggccctggcctc

SEQ ID NO: 5527943 - DNA, 22 bp, Homo sapiens
tgcaggccctttgaagcctcag

SEQ ID NO: 5527944 - DNA, 21 bp, Homo sapiens
tgcaggccgggtggccaatcc

SEQ ID NO: 5527945 - DNA, 21 bp, Homo sapiens
tgcaggcctaggtgcagctcc

SEQ ID NO: 5527946 - DNA, 14 bp, Homo sapiens
tgcaggcctgtccc

SEQ ID NO: 5527947 - DNA, 14 bp, Homo sapiens
tgcaggcggccctc

SEQ ID NO: 5527948 - DNA, 21 bp, Homo sapiens
tgcaggcggggctcctcctga

SEQ ID NO: 5527949 - DNA, 22 bp, Homo sapiens
tgcaggcggggctcctcctgaa

SEQ ID NO: 5527950 - DNA, 23 bp, Homo sapiens
tgcaggcggggctcctcctgaag

SEQ ID NO: 5527951 - DNA, 21 bp, Homo sapiens
tgcaggcggtatccagaggtg

SEQ ID NO: 5527952 - DNA, 15 bp, Homo sapiens
tgcaggctaaagtga

SEQ ID NO: 5527953 - DNA, 22 bp, Homo sapiens
tgcaggctcctcctctctggac

SEQ ID NO: 5527954 - DNA, 11 bp, Homo sapiens
tgcaggctctg

SEQ ID NO: 5527955 - DNA, 17 bp, Homo sapiens
tgcaggctctgggctca

SEQ ID NO: 5527956 - DNA, 21 bp, Homo sapiens
tgcaggctctgggctcagggc

SEQ ID NO: 5527957 - DNA, 18 bp, Homo sapiens
tgcaggctgcaggagggc

SEQ ID NO: 5527958 - DNA, 22 bp, Homo sapiens
tgcaggctgcaggagggcactg

SEQ ID NO: 5527959 - DNA, 20 bp, Homo sapiens
tgcaggctgcagtggctccc

SEQ ID NO: 5527960 - DNA, 23 bp, Homo sapiens
tgcaggctggcaccgccttctct

SEQ ID NO: 5527961 - DNA, 13 bp, Homo sapiens
tgcaggctggcca

SEQ ID NO: 5527962 - DNA, 14 bp, Homo sapiens
tgcaggctggccag

SEQ ID NO: 5527963 - DNA, 14 bp, Homo sapiens
tgcaggctggggag

SEQ ID NO: 5527964 - DNA, 13 bp, Homo sapiens
tgcaggctgtgtt

SEQ ID NO: 5527965 - DNA, 20 bp, Homo sapiens
tgcaggcttaggtcctcact

SEQ ID NO: 5527966 - DNA, 21 bp, Homo sapiens
tgcagggaaaattatttgcat

SEQ ID NO: 5527967 - DNA, 13 bp, Homo sapiens
tgcagggaagagg

SEQ ID NO: 5527968 - DNA, 15 bp, Homo sapiens
tgcagggacagcctg

SEQ ID NO: 5527969 - DNA, 21 bp, Homo sapiens
tgcagggagcaccacggccag

SEQ ID NO: 5527970 - DNA, 13 bp, Homo sapiens
tgcagggagcagc

SEQ ID NO: 5527971 - DNA, 16 bp, Homo sapiens
tgcagggagcagcacg

SEQ ID NO: 5527972 - DNA, 14 bp, Homo sapiens
tgcagggagccgag

SEQ ID NO: 5527973 - DNA, 14 bp, Homo sapiens
tgcagggagctcaa

SEQ ID NO: 5527974 - DNA, 14 bp, Homo sapiens
tgcagggaggccac

SEQ ID NO: 5527975 - DNA, 15 bp, Homo sapiens
tgcagggaggggagg

SEQ ID NO: 5527976 - DNA, 17 bp, Homo sapiens
tgcagggatattgcctt

SEQ ID NO: 5527977 - DNA, 19 bp, Homo sapiens
tgcagggatattgccttat

SEQ ID NO: 5527978 - DNA, 21 bp, Homo sapiens
tgcagggatattgccttattt

SEQ ID NO: 5527979 - DNA, 16 bp, Homo sapiens
tgcagggatgtgggtt

SEQ ID NO: 5527980 - DNA, 22 bp, Homo sapiens
tgcagggatgtgggttccacag

SEQ ID NO: 5527981 - DNA, 22 bp, Homo sapiens
tgcagggcaaaatattcactgg

SEQ ID NO: 5527982 - DNA, 12 bp, Homo sapiens
tgcagggcacgg

SEQ ID NO: 5527983 - DNA, 21 bp, Homo sapiens
tgcagggcacggggacctgga

SEQ ID NO: 5527984 - DNA, 14 bp, Homo sapiens
tgcagggcagcccc

SEQ ID NO: 5527985 - DNA, 20 bp, Homo sapiens
tgcagggcagccccacaact

SEQ ID NO: 5527986 - DNA, 21 bp, Homo sapiens
tgcagggcagcctgtgggaga

SEQ ID NO: 5527987 - DNA, 14 bp, Homo sapiens
tgcagggcagtcat

SEQ ID NO: 5527988 - DNA, 9 bp, Homo sapiens
tgcagggcc

SEQ ID NO: 5527989 - DNA, 17 bp, Homo sapiens
tgcagggccactggaag

SEQ ID NO: 5527990 - DNA, 19 bp, Homo sapiens
tgcagggccactggaagga

SEQ ID NO: 5527991 - DNA, 12 bp, Homo sapiens
tgcagggccagg

SEQ ID NO: 5527992 - DNA, 15 bp, Homo sapiens
tgcagggccaggact

SEQ ID NO: 5527993 - DNA, 23 bp, Homo sapiens
tgcagggccaggactgagccccg

SEQ ID NO: 5527994 - DNA, 17 bp, Homo sapiens
tgcagggccgggcaggg

SEQ ID NO: 5527995 - DNA, 13 bp, Homo sapiens
tgcagggcctctg

SEQ ID NO: 5527996 - DNA, 15 bp, Homo sapiens
tgcagggcctctgtc

SEQ ID NO: 5527997 - DNA, 15 bp, Homo sapiens
tgcagggcctggcat

SEQ ID NO: 5527998 - DNA, 16 bp, Homo sapiens
tgcagggcgcccctgg

SEQ ID NO: 5527999 - DNA, 19 bp, Homo sapiens
tgcagggctaaggccccca

SEQ ID NO: 5528000 - DNA, 13 bp, Homo sapiens
tgcagggctccca

SEQ ID NO: 5528001 - DNA, 15 bp, Homo sapiens
tgcagggctgctgtg

SEQ ID NO: 5528002 - DNA, 21 bp, Homo sapiens
tgcagggctgctgtggcccag

SEQ ID NO: 5528003 - DNA, 23 bp, Homo sapiens
tgcagggctgctgtggcccagtc

SEQ ID NO: 5528004 - DNA, 15 bp, Homo sapiens
tgcagggctgggtca

SEQ ID NO: 5528005 - DNA, 15 bp, Homo sapiens
tgcagggcttctcct

SEQ ID NO: 5528006 - DNA, 19 bp, Homo sapiens
tgcaggggatggggtgggg

SEQ ID NO: 5528007 - DNA, 22 bp, Homo sapiens
tgcaggggattgaagccctcca

SEQ ID NO: 5528008 - DNA, 22 bp, Homo sapiens
tgcaggggcaaacacctgctga

SEQ ID NO: 5528009 - DNA, 13 bp, Homo sapiens
tgcaggggcagga

SEQ ID NO: 5528010 - DNA, 19 bp, Homo sapiens
tgcaggggccactccaaac

SEQ ID NO: 5528011 - DNA, 21 bp, Homo sapiens
tgcaggggccactccaaactc

SEQ ID NO: 5528012 - DNA, 13 bp, Homo sapiens
tgcaggggcctgg

SEQ ID NO: 5528013 - DNA, 22 bp, Homo sapiens
tgcaggggtgacggccctcatc

SEQ ID NO: 5528014 - DNA, 19 bp, Homo sapiens
tgcagggtgacgcctgaga

SEQ ID NO: 5528015 - DNA, 23 bp, Homo sapiens
tgcagggtgacgcctgagacagc

SEQ ID NO: 5528016 - DNA, 13 bp, Homo sapiens
tgcagggtggcat

SEQ ID NO: 5528017 - DNA, 17 bp, Homo sapiens
tgcagggtggtgctggg

SEQ ID NO: 5528018 - DNA, 18 bp, Homo sapiens
tgcagggtggtgctggga

SEQ ID NO: 5528019 - DNA, 19 bp, Homo sapiens
tgcaggtacttcctcctga

SEQ ID NO: 5528020 - DNA, 22 bp, Homo sapiens
tgcaggtacttcctcctgatgg

SEQ ID NO: 5528021 - DNA, 22 bp, Homo sapiens
tgcaggtagttggtgaacagag

SEQ ID NO: 5528022 - DNA, 22 bp, Homo sapiens
tgcaggtatttcagaaggagaa

SEQ ID NO: 5528023 - DNA, 19 bp, Homo sapiens
tgcaggtattttaactgtg

SEQ ID NO: 5528024 - DNA, 15 bp, Homo sapiens
tgcaggtcagcccat

SEQ ID NO: 5528025 - DNA, 16 bp, Homo sapiens
tgcaggtcagcccatg

SEQ ID NO: 5528026 - DNA, 22 bp, Homo sapiens
tgcaggtcagcccatggaggca

SEQ ID NO: 5528027 - DNA, 11 bp, Homo sapiens
tgcaggtccct

SEQ ID NO: 5528028 - DNA, 20 bp, Homo sapiens
tgcaggtccctaataaagct

SEQ ID NO: 5528029 - DNA, 20 bp, Homo sapiens
tgcaggtcctggtgggtcag

SEQ ID NO: 5528030 - DNA, 13 bp, Homo sapiens
tgcagttgccagt

SEQ ID NO: 5528031 - DNA, 15 bp, Homo sapiens
tgcagttgccagtca

SEQ ID NO: 5528032 - DNA, 18 bp, Homo sapiens
tgcagttggactctcagg

SEQ ID NO: 5528033 - DNA, 12 bp, Homo sapiens
tgcagttgtgat

SEQ ID NO: 5528034 - DNA, 18 bp, Homo sapiens
tgcagttgtgatttctgt

SEQ ID NO: 5528035 - DNA, 18 bp, Homo sapiens
tgcagtttaagagcagaa

SEQ ID NO: 5528036 - DNA, 19 bp, Homo sapiens
tgcagtttaagagcagaac

SEQ ID NO: 5528037 - DNA, 16 bp, Homo sapiens
tgcagtttaagatgac

SEQ ID NO: 5528038 - DNA, 17 bp, Homo sapiens
tgcagtttacagtattt

SEQ ID NO: 5528039 - DNA, 12 bp, Homo sapiens
tgcagtttatca

SEQ ID NO: 5528040 - DNA, 17 bp, Homo sapiens
tgcagtttatcattcaa

SEQ ID NO: 5528041 - DNA, 12 bp, Homo sapiens
tgcagtttccaa

SEQ ID NO: 5528042 - DNA, 12 bp, Homo sapiens
tgcagtttcctg

SEQ ID NO: 5528043 - DNA, 14 bp, Homo sapiens
tgcagtttcttgtg

SEQ ID NO: 5528044 - DNA, 14 bp, Homo sapiens
tgcagtttcttttc

SEQ ID NO: 5528045 - DNA, 15 bp, Homo sapiens
tgcagtttcttttca

SEQ ID NO: 5528046 - DNA, 18 bp, Homo sapiens
tgcagtttcttttcacat

SEQ ID NO: 5528047 - DNA, 17 bp, Homo sapiens
tgcagtttgaaattctg

SEQ ID NO: 5528048 - DNA, 20 bp, Homo sapiens
tgcagtttgaaattctgaat

SEQ ID NO: 5528049 - DNA, 21 bp, Homo sapiens
tgcagtttgaaattctgaatt

SEQ ID NO: 5528050 - DNA, 19 bp, Homo sapiens
tgcagtttgagacaggaga

SEQ ID NO: 5528051 - DNA, 19 bp, Homo sapiens
tgcagtttggccctggagc

SEQ ID NO: 5528052 - DNA, 20 bp, Homo sapiens
tgcagtttggtatgaaacaa

SEQ ID NO: 5528053 - DNA, 21 bp, Homo sapiens
tgcagtttggtatgaaacaaa

SEQ ID NO: 5528054 - DNA, 13 bp, Homo sapiens
tgcagtttgtgaa

SEQ ID NO: 5528055 - DNA, 21 bp, Homo sapiens
tgcagttttaatacttgtaat

SEQ ID NO: 5528056 - DNA, 21 bp, Homo sapiens
tgcagttttcaaattataatc

SEQ ID NO: 5528057 - DNA, 14 bp, Homo sapiens
tgcagttttccagg

SEQ ID NO: 5528058 - DNA, 13 bp, Homo sapiens
tgcagttttgaca

SEQ ID NO: 5528059 - DNA, 21 bp, Homo sapiens
tgcagttttggtttgatgtaa

SEQ ID NO: 5528060 - DNA, 17 bp, Homo sapiens
tgcagtttttaaaaacc

SEQ ID NO: 5528061 - DNA, 15 bp, Homo sapiens
tgcagtttttcagag

SEQ ID NO: 5528062 - DNA, 15 bp, Homo sapiens
tgcagtttttcagga

SEQ ID NO: 5528063 - DNA, 23 bp, Homo sapiens
tgcagttttttggaagaaaatat

SEQ ID NO: 5528064 - DNA, 16 bp, Homo sapiens
tgcataaaaaaatgat

SEQ ID NO: 5528065 - DNA, 17 bp, Homo sapiens
tgcataaaaaaatgatg

SEQ ID NO: 5528066 - DNA, 13 bp, Homo sapiens
tgcataaaaactg

SEQ ID NO: 5528067 - DNA, 22 bp, Homo sapiens
tgcataaaaactggttctacaa

SEQ ID NO: 5528068 - DNA, 19 bp, Homo sapiens
tgcataaaaattaaatgga

SEQ ID NO: 5528069 - DNA, 20 bp, Homo sapiens
tgcataaaagggtcaaacct

SEQ ID NO: 5528070 - DNA, 21 bp, Homo sapiens
tgcataaaagggtcaaacctg

SEQ ID NO: 5528071 - DNA, 11 bp, Homo sapiens
tgcataaaatg

SEQ ID NO: 5528072 - DNA, 13 bp, Homo sapiens
tgcataaaattct

SEQ ID NO: 5528073 - DNA, 14 bp, Homo sapiens
tgcataaaattcta

SEQ ID NO: 5528074 - DNA, 15 bp, Homo sapiens
tgcataaaattctag

SEQ ID NO: 5528075 - DNA, 18 bp, Homo sapiens
tgcataaacaatccaaat

SEQ ID NO: 5528076 - DNA, 17 bp, Homo sapiens
tgcataaacttcatctt

SEQ ID NO: 5528077 - DNA, 11 bp, Homo sapiens
tgcataaataa

SEQ ID NO: 5528078 - DNA, 17 bp, Homo sapiens
tgcataaatgcataatt

SEQ ID NO: 5528079 - DNA, 14 bp, Homo sapiens
tgcataaatttgta

SEQ ID NO: 5528080 - DNA, 15 bp, Homo sapiens
tgcataaatttgtaa

SEQ ID NO: 5528081 - DNA, 17 bp, Homo sapiens
tgcataaatttgtaata

SEQ ID NO: 5528082 - DNA, 15 bp, Homo sapiens
tgcataagaaatgta

SEQ ID NO: 5528083 - DNA, 19 bp, Homo sapiens
tgcataagaaatgtagctg

SEQ ID NO: 5528084 - DNA, 21 bp, Homo sapiens
tgcataagaaatgtagctgaa

SEQ ID NO: 5528085 - DNA, 23 bp, Homo sapiens
tgcataagaaatgtagctgaagt

SEQ ID NO: 5528086 - DNA, 21 bp, Homo sapiens
tgcataagattaaaggaagga

SEQ ID NO: 5528087 - DNA, 18 bp, Homo sapiens
tgcataagcattgctcaa

SEQ ID NO: 5528088 - DNA, 22 bp, Homo sapiens
tgcataagcctcaggcctggcc

SEQ ID NO: 5528089 - DNA, 16 bp, Homo sapiens
tgcataagctgaacta

SEQ ID NO: 5528090 - DNA, 17 bp, Homo sapiens
tgcataagttaacttcc

SEQ ID NO: 5528091 - DNA, 19 bp, Homo sapiens
tgcataataagctaaagag

SEQ ID NO: 5528092 - DNA, 22 bp, Homo sapiens
tgcataataagctaaagaggct

SEQ ID NO: 5528093 - DNA, 15 bp, Homo sapiens
tgcataatactaatt

SEQ ID NO: 5528094 - DNA, 22 bp, Homo sapiens
tgcataatactaatttattgcc

SEQ ID NO: 5528095 - DNA, 17 bp, Homo sapiens
tgcataatagctacagt

SEQ ID NO: 5528096 - DNA, 16 bp, Homo sapiens
tgcataatatgcatat

SEQ ID NO: 5528097 - DNA, 18 bp, Homo sapiens
tgcataatatgcatatat

SEQ ID NO: 5528098 - DNA, 23 bp, Homo sapiens
tgcataatgaaccgtttacagtg

SEQ ID NO: 5528099 - DNA, 18 bp, Homo sapiens
tgcataatgataaaataa

SEQ ID NO: 5528100 - DNA, 12 bp, Homo sapiens
tgcataatgcaa

SEQ ID NO: 5528101 - DNA, 18 bp, Homo sapiens
tgcataatgtttctggat

SEQ ID NO: 5528102 - DNA, 14 bp, Homo sapiens
tgcataatttatgg

SEQ ID NO: 5528103 - DNA, 13 bp, Homo sapiens
tgcataatttcag

SEQ ID NO: 5528104 - DNA, 13 bp, Homo sapiens
tgcatacaaacaa

SEQ ID NO: 5528105 - DNA, 12 bp, Homo sapiens
tgcatacaataa

SEQ ID NO: 5528106 - DNA, 20 bp, Homo sapiens
tgcatacaataaaagagctt

SEQ ID NO: 5528107 - DNA, 21 bp, Homo sapiens
tgcatacaataaaagagcttt

SEQ ID NO: 5528108 - DNA, 16 bp, Homo sapiens
tgcatacacacacaca

SEQ ID NO: 5528109 - DNA, 21 bp, Homo sapiens
tgcatacacacacacacacag

SEQ ID NO: 5528110 - DNA, 16 bp, Homo sapiens
tgcatacaggggaggg

SEQ ID NO: 5528111 - DNA, 18 bp, Homo sapiens
tgcatacaggggaggggc

SEQ ID NO: 5528112 - DNA, 22 bp, Homo sapiens
tgcatacatgaataaaaataaa

SEQ ID NO: 5528113 - DNA, 14 bp, Homo sapiens
tgcataccaacctg

SEQ ID NO: 5528114 - DNA, 19 bp, Homo sapiens
tgcataccacaagacattt

SEQ ID NO: 5528115 - DNA, 22 bp, Homo sapiens
tgcatacggctatattggttta

SEQ ID NO: 5528116 - DNA, 12 bp, Homo sapiens
tgcatactatta

SEQ ID NO: 5528117 - DNA, 16 bp, Homo sapiens
tgcatactattaaaca

SEQ ID NO: 5528118 - DNA, 20 bp, Homo sapiens
tgcatactattaaacatgct

SEQ ID NO: 5528119 - DNA, 13 bp, Homo sapiens
tgcatactcatta

SEQ ID NO: 5528120 - DNA, 19 bp, Homo sapiens
tgcatactggactcttcaa

SEQ ID NO: 5528121 - DNA, 18 bp, Homo sapiens
tgcatactgttgatacaa

SEQ ID NO: 5528122 - DNA, 21 bp, Homo sapiens
tgcatactgttgatacaaacc

SEQ ID NO: 5528123 - DNA, 22 bp, Homo sapiens
tgcatacttacctagtgaaact

SEQ ID NO: 5528124 - DNA, 16 bp, Homo sapiens
tgcatacttcaaaagt

SEQ ID NO: 5528125 - DNA, 12 bp, Homo sapiens
tgcatactttat

SEQ ID NO: 5528126 - DNA, 20 bp, Homo sapiens
tgcatactttgtattttgat

SEQ ID NO: 5528127 - DNA, 19 bp, Homo sapiens
tgcatactttttaaatgta

SEQ ID NO: 5528128 - DNA, 22 bp, Homo sapiens
tgcatactttttaaatgtaaag

SEQ ID NO: 5528129 - DNA, 17 bp, Homo sapiens
tgcatagaactgggtaa

SEQ ID NO: 5528130 - DNA, 22 bp, Homo sapiens
tgcatagaactgggtaaatgca

SEQ ID NO: 5528131 - DNA, 17 bp, Homo sapiens
tgcatagaataaaattt

SEQ ID NO: 5528132 - DNA, 12 bp, Homo sapiens
tgcatagacaaa

SEQ ID NO: 5528133 - DNA, 11 bp, Homo sapiens
tgcatagagca

SEQ ID NO: 5528134 - DNA, 13 bp, Homo sapiens
tgcatagagcaat

SEQ ID NO: 5528135 - DNA, 21 bp, Homo sapiens
tgcatagagcaattaaactgt

SEQ ID NO: 5528136 - DNA, 22 bp, Homo sapiens
tgcatagagcaattaaactgtg

SEQ ID NO: 5528137 - DNA, 14 bp, Homo sapiens
tgcatagagccctg

SEQ ID NO: 5528138 - DNA, 15 bp, Homo sapiens
tgcatagagccctgg

SEQ ID NO: 5528139 - DNA, 18 bp, Homo sapiens
tgcatagagccctggcca

SEQ ID NO: 5528140 - DNA, 22 bp, Homo sapiens
tgcatagcagatggtttccaca

SEQ ID NO: 5528141 - DNA, 14 bp, Homo sapiens
tgcatagcagctgc

SEQ ID NO: 5528142 - DNA, 15 bp, Homo sapiens
tgcatagcagtatat

SEQ ID NO: 5528143 - DNA, 15 bp, Homo sapiens
tgcatagctctcctt

SEQ ID NO: 5528144 - DNA, 14 bp, Homo sapiens
tgcataggctcctt

SEQ ID NO: 5528145 - DNA, 19 bp, Homo sapiens
tgcataggctccttcctgt

SEQ ID NO: 5528146 - DNA, 22 bp, Homo sapiens
tgcataggctccttcctgtggg

SEQ ID NO: 5528147 - DNA, 19 bp, Homo sapiens
tgcataggctcttaagcag

SEQ ID NO: 5528148 - DNA, 22 bp, Homo sapiens
tgcatagtaccaatcattttaa

SEQ ID NO: 5528149 - DNA, 15 bp, Homo sapiens
tgcatagtcccagct

SEQ ID NO: 5528150 - DNA, 20 bp, Homo sapiens
tgcatagtcccagctaccca

SEQ ID NO: 5528151 - DNA, 21 bp, Homo sapiens
tgcatagttgtagacaaagta

SEQ ID NO: 5528152 - DNA, 13 bp, Homo sapiens
tgcatagtttgtt

SEQ ID NO: 5528153 - DNA, 23 bp, Homo sapiens
tgcatataaaggttatgaaacat

SEQ ID NO: 5528154 - DNA, 15 bp, Homo sapiens
tgcatataacttata

SEQ ID NO: 5528155 - DNA, 18 bp, Homo sapiens
tgcatataacttatattg

SEQ ID NO: 5528156 - DNA, 22 bp, Homo sapiens
tgcatataacttatattgtaag

SEQ ID NO: 5528157 - DNA, 23 bp, Homo sapiens
tgcatataagggaagtagttatc

SEQ ID NO: 5528158 - DNA, 20 bp, Homo sapiens
tgcatataatgaataaatca

SEQ ID NO: 5528159 - DNA, 14 bp, Homo sapiens
tgcatatagaaaac

SEQ ID NO: 5528160 - DNA, 17 bp, Homo sapiens
tgcatatagacacacat

SEQ ID NO: 5528161 - DNA, 21 bp, Homo sapiens
tgcatatagacacacatacat

SEQ ID NO: 5528162 - DNA, 19 bp, Homo sapiens
tgcatatagatttagtttt

SEQ ID NO: 5528163 - DNA, 16 bp, Homo sapiens
tgcatatatactacat

SEQ ID NO: 5528164 - DNA, 16 bp, Homo sapiens
tgcatatatatgtata

SEQ ID NO: 5528165 - DNA, 19 bp, Homo sapiens
tgcatatatctttcagatt

SEQ ID NO: 5528166 - DNA, 18 bp, Homo sapiens
tgcatatctgtttattct

SEQ ID NO: 5528167 - DNA, 14 bp, Homo sapiens
tgcatatgcttctg

SEQ ID NO: 5528168 - DNA, 18 bp, Homo sapiens
tgcatatgttaaagctta

SEQ ID NO: 5528169 - DNA, 23 bp, Homo sapiens
tgcatatgttaaagcttattttt

SEQ ID NO: 5528170 - DNA, 13 bp, Homo sapiens
tgcatatgttgaa

SEQ ID NO: 5528171 - DNA, 15 bp, Homo sapiens
tgcatatgttgaata

SEQ ID NO: 5528172 - DNA, 15 bp, Homo sapiens
tgcatattaaagata

SEQ ID NO: 5528173 - DNA, 15 bp, Homo sapiens
tgcatattaaataat

SEQ ID NO: 5528174 - DNA, 17 bp, Homo sapiens
tgcatattaaataataa

SEQ ID NO: 5528175 - DNA, 13 bp, Homo sapiens
tgcatattactgt

SEQ ID NO: 5528176 - DNA, 21 bp, Homo sapiens
tgcatattagcatcatgtctt

SEQ ID NO: 5528177 - DNA, 23 bp, Homo sapiens
tgcatattataaaggataaagaa

SEQ ID NO: 5528178 - DNA, 18 bp, Homo sapiens
tgcatattattttatgtt

SEQ ID NO: 5528179 - DNA, 18 bp, Homo sapiens
tgcatattcaacacactg

SEQ ID NO: 5528180 - DNA, 14 bp, Homo sapiens
tgcatattcaatgt

SEQ ID NO: 5528181 - DNA, 15 bp, Homo sapiens
tgcatattcccctct

SEQ ID NO: 5528182 - DNA, 16 bp, Homo sapiens
tgcatattcctttcta

SEQ ID NO: 5528183 - DNA, 15 bp, Homo sapiens
tgcatattgtattac

SEQ ID NO: 5528184 - DNA, 15 bp, Homo sapiens
tgcatatttataaga

SEQ ID NO: 5528185 - DNA, 23 bp, Homo sapiens
tgcatatttatagagttattata

SEQ ID NO: 5528186 - DNA, 13 bp, Homo sapiens
tgcatatttctgt

SEQ ID NO: 5528187 - DNA, 15 bp, Homo sapiens
tgcatatttctgtat

SEQ ID NO: 5528188 - DNA, 17 bp, Homo sapiens
tgcatatttctgtatat

SEQ ID NO: 5528189 - DNA, 20 bp, Homo sapiens
tgcatatttctgtatatttg

SEQ ID NO: 5528190 - DNA, 24 bp, Homo sapiens
tgcatatttctgtatatttgtcat

SEQ ID NO: 5528191 - DNA, 20 bp, Homo sapiens
tgcatatttgtgccgtaatt

SEQ ID NO: 5528192 - DNA, 17 bp, Homo sapiens
tgcatatttgttacttt

SEQ ID NO: 5528193 - DNA, 15 bp, Homo sapiens
tgcatatttgtttat

SEQ ID NO: 5528194 - DNA, 18 bp, Homo sapiens
tgcatattttgagaaact

SEQ ID NO: 5528195 - DNA, 20 bp, Homo sapiens
tgcatattttgagaaactgc

SEQ ID NO: 5528196 - DNA, 14 bp, Homo sapiens
tgcatcaaatgcat

SEQ ID NO: 5528197 - DNA, 19 bp, Homo sapiens
tgcatcaagaactattgtg

SEQ ID NO: 5528198 - DNA, 19 bp, Homo sapiens
tgcatcaagggctttatca

SEQ ID NO: 5528199 - DNA, 21 bp, Homo sapiens
tgcatcacgtaccccactggg

SEQ ID NO: 5528200 - DNA, 21 bp, Homo sapiens
tgcatcagaaagggagggctc

SEQ ID NO: 5528201 - DNA, 22 bp, Homo sapiens
tgcatcagaaagggagggctct

SEQ ID NO: 5528202 - DNA, 17 bp, Homo sapiens
tgcatcagataacaact

SEQ ID NO: 5528203 - DNA, 20 bp, Homo sapiens
tgcatcagctttttgtatta

SEQ ID NO: 5528204 - DNA, 13 bp, Homo sapiens
tgcatcaggtcct

SEQ ID NO: 5528205 - DNA, 12 bp, Homo sapiens
tgcatcagttct

SEQ ID NO: 5528206 - DNA, 19 bp, Homo sapiens
tgcatcatatatttaacaa

SEQ ID NO: 5528207 - DNA, 13 bp, Homo sapiens
tgcatcatcatca

SEQ ID NO: 5528208 - DNA, 20 bp, Homo sapiens
tgcatggacctaacattcga

SEQ ID NO: 5528209 - DNA, 17 bp, Homo sapiens
tgcatggacgcctggct

SEQ ID NO: 5528210 - DNA, 13 bp, Homo sapiens
tgcatggagaatg

SEQ ID NO: 5528211 - DNA, 14 bp, Homo sapiens
tgcatggagaatgg

SEQ ID NO: 5528212 - DNA, 16 bp, Homo sapiens
tgcatggagaatggga

SEQ ID NO: 5528213 - DNA, 13 bp, Homo sapiens
tgcatggagcagg

SEQ ID NO: 5528214 - DNA, 15 bp, Homo sapiens
tgcatggaggactct

SEQ ID NO: 5528215 - DNA, 17 bp, Homo sapiens
tgcatggaggactctcc

SEQ ID NO: 5528216 - DNA, 19 bp, Homo sapiens
tgcatggaggactctcctc

SEQ ID NO: 5528217 - DNA, 16 bp, Homo sapiens
tgcatggaggccctcc

SEQ ID NO: 5528218 - DNA, 17 bp, Homo sapiens
tgcatggagtgtttgac

SEQ ID NO: 5528219 - DNA, 17 bp, Homo sapiens
tgcatggattcagcatg

SEQ ID NO: 5528220 - DNA, 21 bp, Homo sapiens
tgcatggattcagcatgtcca

SEQ ID NO: 5528221 - DNA, 19 bp, Homo sapiens
tgcatggcacttgcatctg

SEQ ID NO: 5528222 - DNA, 20 bp, Homo sapiens
tgcatggcagggggctgctg

SEQ ID NO: 5528223 - DNA, 21 bp, Homo sapiens
tgcatggcagggggctgctgc

SEQ ID NO: 5528224 - DNA, 22 bp, Homo sapiens
tgcatggcattaattgttcctt

SEQ ID NO: 5528225 - DNA, 15 bp, Homo sapiens
tgcatggccacagcc

SEQ ID NO: 5528226 - DNA, 16 bp, Homo sapiens
tgcatggccacagcca

SEQ ID NO: 5528227 - DNA, 22 bp, Homo sapiens
tgcatggccacagccacctcca

SEQ ID NO: 5528228 - DNA, 12 bp, Homo sapiens
tgcatggcctcc

SEQ ID NO: 5528229 - DNA, 15 bp, Homo sapiens
tgcatggcctcccag

SEQ ID NO: 5528230 - DNA, 20 bp, Homo sapiens
tgcatggctccagaaatgtc

SEQ ID NO: 5528231 - DNA, 22 bp, Homo sapiens
tgcatggctccagaaatgtcta

SEQ ID NO: 5528232 - DNA, 15 bp, Homo sapiens
tgcatggctggggac

SEQ ID NO: 5528233 - DNA, 19 bp, Homo sapiens
tgcatggcttggggagcag

SEQ ID NO: 5528234 - DNA, 20 bp, Homo sapiens
tgcatggcttggggagcaga

SEQ ID NO: 5528235 - DNA, 22 bp, Homo sapiens
tgcatgggaaatagcggccctg

SEQ ID NO: 5528236 - DNA, 12 bp, Homo sapiens
tgcatgggagca

SEQ ID NO: 5528237 - DNA, 21 bp, Homo sapiens
tgcatgggccagcccctccat

SEQ ID NO: 5528238 - DNA, 17 bp, Homo sapiens
tgcatggggaaagagat

SEQ ID NO: 5528239 - DNA, 14 bp, Homo sapiens
tgcatggggcgggt

SEQ ID NO: 5528240 - DNA, 19 bp, Homo sapiens
tgcatggggctggggtcct

SEQ ID NO: 5528241 - DNA, 16 bp, Homo sapiens
tgcatgggtcagggtg

SEQ ID NO: 5528242 - DNA, 23 bp, Homo sapiens
tgcatgggtcagggtgtgaggcc

SEQ ID NO: 5528243 - DNA, 16 bp, Homo sapiens
tgcatgggtgaaggga

SEQ ID NO: 5528244 - DNA, 17 bp, Homo sapiens
tgcatgggttttgtagg

SEQ ID NO: 5528245 - DNA, 23 bp, Homo sapiens
tgcatgggttttgtaggtacttt

SEQ ID NO: 5528246 - DNA, 16 bp, Homo sapiens
tgcatggtaatttata

SEQ ID NO: 5528247 - DNA, 23 bp, Homo sapiens
tgcatggtgcagttgacagcagg

SEQ ID NO: 5528248 - DNA, 18 bp, Homo sapiens
tgcatggtgccccaggac

SEQ ID NO: 5528249 - DNA, 19 bp, Homo sapiens
tgcatggtgccccaggacc

SEQ ID NO: 5528250 - DNA, 21 bp, Homo sapiens
tgcatggtgccccaggaccag

SEQ ID NO: 5528251 - DNA, 14 bp, Homo sapiens
tgcatggtggccag

SEQ ID NO: 5528252 - DNA, 20 bp, Homo sapiens
tgcatggtgtttatgcacac

SEQ ID NO: 5528253 - DNA, 14 bp, Homo sapiens
tgcatggtttcagc

SEQ ID NO: 5528254 - DNA, 17 bp, Homo sapiens
tgcatggtttcagcact

SEQ ID NO: 5528255 - DNA, 17 bp, Homo sapiens
tgcatgtaaaatcttca

SEQ ID NO: 5528256 - DNA, 14 bp, Homo sapiens
tgcatgtaaaatgc

SEQ ID NO: 5528257 - DNA, 18 bp, Homo sapiens
tgcatgtaaaatgcagtc

SEQ ID NO: 5528258 - DNA, 23 bp, Homo sapiens
tgcatgtaacgcaagttcccagt

SEQ ID NO: 5528259 - DNA, 23 bp, Homo sapiens
tgcatgtactttatattttctat

SEQ ID NO: 5528260 - DNA, 16 bp, Homo sapiens
tgcatgtatgccatgt

SEQ ID NO: 5528261 - DNA, 15 bp, Homo sapiens
tgcatgtatgtcttg

SEQ ID NO: 5528262 - DNA, 21 bp, Homo sapiens
tgcatgtatgtgcacatgtgt

SEQ ID NO: 5528263 - DNA, 23 bp, Homo sapiens
tgcatgtatgtgcacatgtgtct

SEQ ID NO: 5528264 - DNA, 16 bp, Homo sapiens
tgcatgtatgtgtgtg

SEQ ID NO: 5528265 - DNA, 18 bp, Homo sapiens
tgcatgtatttaagaaaa

SEQ ID NO: 5528266 - DNA, 16 bp, Homo sapiens
tgcatgtcctgtaaag

SEQ ID NO: 5528267 - DNA, 21 bp, Homo sapiens
tgcatgtcgtgaccaactaga

SEQ ID NO: 5528268 - DNA, 23 bp, Homo sapiens
tgcatgtctactcagcatttgat

SEQ ID NO: 5528269 - DNA, 12 bp, Homo sapiens
tgcatgtctgca

SEQ ID NO: 5528270 - DNA, 17 bp, Homo sapiens
tgcatgtctgccaaaat

SEQ ID NO: 5528271 - DNA, 21 bp, Homo sapiens
tgcatgtctgttttaaaaaaa

SEQ ID NO: 5528272 - DNA, 20 bp, Homo sapiens
tgcatgtcttaaatgctcat

SEQ ID NO: 5528273 - DNA, 16 bp, Homo sapiens
tgcatgtgaagaaagg

SEQ ID NO: 5528274 - DNA, 17 bp, Homo sapiens
tgcatgtgaagcatgct

SEQ ID NO: 5528275 - DNA, 16 bp, Homo sapiens
tgcatgtgacttctcc

SEQ ID NO: 5528276 - DNA, 22 bp, Homo sapiens
tgcatgtgattggcagcttcaa

SEQ ID NO: 5528277 - DNA, 12 bp, Homo sapiens
tgcatgtgcatg

SEQ ID NO: 5528278 - DNA, 16 bp, Homo sapiens
tgcatgtgccgaggtg

SEQ ID NO: 5528279 - DNA, 17 bp, Homo sapiens
tgcatgtgccgaggtgc

SEQ ID NO: 5528280 - DNA, 15 bp, Homo sapiens
tgcatgtgcgtggaa

SEQ ID NO: 5528281 - DNA, 19 bp, Homo sapiens
tgcatgtgcgtggaagtgt

SEQ ID NO: 5528282 - DNA, 23 bp, Homo sapiens
tgcatgtgctgtctccatgctgg

SEQ ID NO: 5528283 - DNA, 16 bp, Homo sapiens
tgcatgtgctgtgtga

SEQ ID NO: 5528284 - DNA, 21 bp, Homo sapiens
tgcatgtggtttggttcctct

SEQ ID NO: 5528285 - DNA, 21 bp, Homo sapiens
tgcatgtgtaaatctgaaaaa

SEQ ID NO: 5528286 - DNA, 11 bp, Homo sapiens
tgcatgtgtat

SEQ ID NO: 5528287 - DNA, 17 bp, Homo sapiens
tgcatgtgtatatatgt

SEQ ID NO: 5528288 - DNA, 11 bp, Homo sapiens
tgcatgtgtgt

SEQ ID NO: 5528289 - DNA, 15 bp, Homo sapiens
tgcatgtgtgtataa

SEQ ID NO: 5528290 - DNA, 13 bp, Homo sapiens
tgcatgtgtgtgc

SEQ ID NO: 5528291 - DNA, 14 bp, Homo sapiens
tgcatgtgtgtgct

SEQ ID NO: 5528292 - DNA, 17 bp, Homo sapiens
tgcatgtgttttttccc

SEQ ID NO: 5528293 - DNA, 17 bp, Homo sapiens
tgcatgttaaaataatt

SEQ ID NO: 5528294 - DNA, 12 bp, Homo sapiens
tgcatgttacta

SEQ ID NO: 5528295 - DNA, 22 bp, Homo sapiens
tgcatgttactgccaaaaccaa

SEQ ID NO: 5528296 - DNA, 14 bp, Homo sapiens
tgcatgttatgttt

SEQ ID NO: 5528297 - DNA, 15 bp, Homo sapiens
tgcatgttatgttta

SEQ ID NO: 5528298 - DNA, 16 bp, Homo sapiens
tgcatgttatgtttaa

SEQ ID NO: 5528299 - DNA, 18 bp, Homo sapiens
tgcatgttcttttctgga

SEQ ID NO: 5528300 - DNA, 21 bp, Homo sapiens
tgcatgttgccatgaggcctt

SEQ ID NO: 5528301 - DNA, 22 bp, Homo sapiens
tgcatgttgccatgaggccttt

SEQ ID NO: 5528302 - DNA, 23 bp, Homo sapiens
tgcatgttggggtttcctttacc

SEQ ID NO: 5528303 - DNA, 18 bp, Homo sapiens
tgcatgttgtctaagaaa

SEQ ID NO: 5528304 - DNA, 23 bp, Homo sapiens
tgcatgtttaataatatgtacaa

SEQ ID NO: 5528305 - DNA, 11 bp, Homo sapiens
tgcatgtttac

SEQ ID NO: 5528306 - DNA, 13 bp, Homo sapiens
tgcatgttttcca

SEQ ID NO: 5528307 - DNA, 16 bp, Homo sapiens
tgcatgtttttgaaaa

SEQ ID NO: 5528308 - DNA, 19 bp, Homo sapiens
tgcattaaaagaaaataaa

SEQ ID NO: 5528309 - DNA, 15 bp, Homo sapiens
tgcattaaaattaaa

SEQ ID NO: 5528310 - DNA, 14 bp, Homo sapiens
tgcattaaacctgt

SEQ ID NO: 5528311 - DNA, 15 bp, Homo sapiens
tgcattaaacctgtc

SEQ ID NO: 5528312 - DNA, 15 bp, Homo sapiens
tgcattaaatgcttt

SEQ ID NO: 5528313 - DNA, 15 bp, Homo sapiens
tgcattaaattcaca

SEQ ID NO: 5528314 - DNA, 16 bp, Homo sapiens
tgcattaaattcacaa

SEQ ID NO: 5528315 - DNA, 21 bp, Homo sapiens
tgcattaaattcacaaacttt

SEQ ID NO: 5528316 - DNA, 12 bp, Homo sapiens
tgcattaataaa

SEQ ID NO: 5528317 - DNA, 16 bp, Homo sapiens
tgcattaataaaaatc

SEQ ID NO: 5528318 - DNA, 22 bp, Homo sapiens
tgcattaataatccttccaggc

SEQ ID NO: 5528319 - DNA, 17 bp, Homo sapiens
tgcattacagagaggag

SEQ ID NO: 5528320 - DNA, 22 bp, Homo sapiens
tgcattacagagaggagaaaca

SEQ ID NO: 5528321 - DNA, 23 bp, Homo sapiens
tgcattacagagaggagaaacac

SEQ ID NO: 5528322 - DNA, 19 bp, Homo sapiens
tgcattaccgcgttgtaaa

SEQ ID NO: 5528323 - DNA, 14 bp, Homo sapiens
tgcattactctggt

SEQ ID NO: 5528324 - DNA, 17 bp, Homo sapiens
tgcattactctggtgga

SEQ ID NO: 5528325 - DNA, 15 bp, Homo sapiens
tgcattacttactgt

SEQ ID NO: 5528326 - DNA, 20 bp, Homo sapiens
tgcattacttactgttaaaa

SEQ ID NO: 5528327 - DNA, 22 bp, Homo sapiens
tgcattacttactgttaaaact

SEQ ID NO: 5528328 - DNA, 19 bp, Homo sapiens
tgcattagaaatagacagt

SEQ ID NO: 5528329 - DNA, 16 bp, Homo sapiens
tgcattagacagatga

SEQ ID NO: 5528330 - DNA, 23 bp, Homo sapiens
tgcattagcacagattttaattg

SEQ ID NO: 5528331 - DNA, 15 bp, Homo sapiens
tgcattagtaacttt

SEQ ID NO: 5528332 - DNA, 14 bp, Homo sapiens
tgcattatatttat

SEQ ID NO: 5528333 - DNA, 17 bp, Homo sapiens
tgcattatctagatact

SEQ ID NO: 5528334 - DNA, 16 bp, Homo sapiens
tgcattatcttgctca

SEQ ID NO: 5528335 - DNA, 15 bp, Homo sapiens
tgcattatgtattta

SEQ ID NO: 5528336 - DNA, 15 bp, Homo sapiens
tgcattattatcatt

SEQ ID NO: 5528337 - DNA, 12 bp, Homo sapiens
tgcattatttag

SEQ ID NO: 5528338 - DNA, 15 bp, Homo sapiens
tgcattatttagtca

SEQ ID NO: 5528339 - DNA, 15 bp, Homo sapiens
tgcattatttgagaa

SEQ ID NO: 5528340 - DNA, 17 bp, Homo sapiens
tgcattattttccagat

SEQ ID NO: 5528341 - DNA, 23 bp, Homo sapiens
tgcattattttgtcataaaatgc

SEQ ID NO: 5528342 - DNA, 13 bp, Homo sapiens
tgcattcaattta

SEQ ID NO: 5528343 - DNA, 21 bp, Homo sapiens
tgcattcacaaggtcaaagtt

SEQ ID NO: 5528344 - DNA, 21 bp, Homo sapiens
tgcattcacaaggtgactggg

SEQ ID NO: 5528345 - DNA, 19 bp, Homo sapiens
tgcattcaccttagtgcaa

SEQ ID NO: 5528346 - DNA, 21 bp, Homo sapiens
tgcattcactcagcatcccca

SEQ ID NO: 5528347 - DNA, 15 bp, Homo sapiens
tgcattcatgcaaga

SEQ ID NO: 5528348 - DNA, 18 bp, Homo sapiens
tgcattcattctgagccc

SEQ ID NO: 5528349 - DNA, 18 bp, Homo sapiens
tgcattcatttttatagc

SEQ ID NO: 5528350 - DNA, 20 bp, Homo sapiens
tgcattcatttttatagcaa

SEQ ID NO: 5528351 - DNA, 20 bp, Homo sapiens
tgcattccagaacaaattgt

SEQ ID NO: 5528352 - DNA, 13 bp, Homo sapiens
tgcattccagaat

SEQ ID NO: 5528353 - DNA, 16 bp, Homo sapiens
tgcattccagaatctt

SEQ ID NO: 5528354 - DNA, 18 bp, Homo sapiens
tgcattccagaatcttga

SEQ ID NO: 5528355 - DNA, 13 bp, Homo sapiens
tgcattccagagc

SEQ ID NO: 5528356 - DNA, 19 bp, Homo sapiens
tgcattccagcgtctgctg

SEQ ID NO: 5528357 - DNA, 18 bp, Homo sapiens
tgcattccagctgtcact

SEQ ID NO: 5528358 - DNA, 23 bp, Homo sapiens
tgcattccatgattttacagaga

SEQ ID NO: 5528359 - DNA, 23 bp, Homo sapiens
tgcattccctgaatctgtgcctg

SEQ ID NO: 5528360 - DNA, 16 bp, Homo sapiens
tgcattcctgtaactt

SEQ ID NO: 5528361 - DNA, 15 bp, Homo sapiens
tgcattcctgtgccc

SEQ ID NO: 5528362 - DNA, 19 bp, Homo sapiens
tgcattcctgtgccctaga

SEQ ID NO: 5528363 - DNA, 13 bp, Homo sapiens
tgcattccttact

SEQ ID NO: 5528364 - DNA, 17 bp, Homo sapiens
tgcattccttacttgca

SEQ ID NO: 5528365 - DNA, 21 bp, Homo sapiens
tgcattccttacttgcactgt

SEQ ID NO: 5528366 - DNA, 20 bp, Homo sapiens
tgcattcctttgtcttcaaa

SEQ ID NO: 5528367 - DNA, 23 bp, Homo sapiens
tgcattcgaagaaacccttgctg

SEQ ID NO: 5528368 - DNA, 23 bp, Homo sapiens
tgcattcgcggttaagatactca

SEQ ID NO: 5528369 - DNA, 22 bp, Homo sapiens
tgcattcggtacttacccggag

SEQ ID NO: 5528370 - DNA, 21 bp, Homo sapiens
tgcattcgttgtgttttttaa

SEQ ID NO: 5528371 - DNA, 13 bp, Homo sapiens
tgcattctactag

SEQ ID NO: 5528372 - DNA, 13 bp, Homo sapiens
tgcattctatcgt

SEQ ID NO: 5528373 - DNA, 14 bp, Homo sapiens
tgcattctatcgtt

SEQ ID NO: 5528374 - DNA, 22 bp, Homo sapiens
tgcattctattgccttctttga

SEQ ID NO: 5528375 - DNA, 11 bp, Homo sapiens
tgcattctccc

SEQ ID NO: 5528376 - DNA, 20 bp, Homo sapiens
tgcattctctcccatcctgg

SEQ ID NO: 5528377 - DNA, 14 bp, Homo sapiens
tgcattctgcctct

SEQ ID NO: 5528378 - DNA, 15 bp, Homo sapiens
tgcattctgcctctc

SEQ ID NO: 5528379 - DNA, 19 bp, Homo sapiens
tgcattctgcctctctagg

SEQ ID NO: 5528380 - DNA, 12 bp, Homo sapiens
tgcattctggag

SEQ ID NO: 5528381 - DNA, 16 bp, Homo sapiens
tgcattctggatttta

SEQ ID NO: 5528382 - DNA, 18 bp, Homo sapiens
tgcattctggccaagggg

SEQ ID NO: 5528383 - DNA, 16 bp, Homo sapiens
tgcattctgtttcctc

SEQ ID NO: 5528384 - DNA, 12 bp, Homo sapiens
tgcattcttata

SEQ ID NO: 5528385 - DNA, 18 bp, Homo sapiens
tgccacaggacacagtca

SEQ ID NO: 5528386 - DNA, 22 bp, Homo sapiens
tgccacagtagaactgtctgtg

SEQ ID NO: 5528387 - DNA, 21 bp, Homo sapiens
tgccacataccaggcaacctc

SEQ ID NO: 5528388 - DNA, 21 bp, Homo sapiens
tgccacatcttgaaaatgcca

SEQ ID NO: 5528389 - DNA, 19 bp, Homo sapiens
tgccacatggccgctgccc

SEQ ID NO: 5528390 - DNA, 19 bp, Homo sapiens
tgccacatggtgtctccca

SEQ ID NO: 5528391 - DNA, 15 bp, Homo sapiens
tgccacattaaattg

SEQ ID NO: 5528392 - DNA, 18 bp, Homo sapiens
tgccacattagaacttct

SEQ ID NO: 5528393 - DNA, 21 bp, Homo sapiens
tgccacattgatttttctata

SEQ ID NO: 5528394 - DNA, 22 bp, Homo sapiens
tgccacatttatttttatatct

SEQ ID NO: 5528395 - DNA, 13 bp, Homo sapiens
tgccacatttctg

SEQ ID NO: 5528396 - DNA, 17 bp, Homo sapiens
tgccacatttctgatca

SEQ ID NO: 5528397 - DNA, 18 bp, Homo sapiens
tgccacatttctgatcag

SEQ ID NO: 5528398 - DNA, 21 bp, Homo sapiens
tgccacatttctgatcagagg

SEQ ID NO: 5528399 - DNA, 22 bp, Homo sapiens
tgccacatttctgatcagaggt

SEQ ID NO: 5528400 - DNA, 16 bp, Homo sapiens
tgccacattttcttaa

SEQ ID NO: 5528401 - DNA, 18 bp, Homo sapiens
tgccacattttgctttat

SEQ ID NO: 5528402 - DNA, 20 bp, Homo sapiens
tgccaccaaaggagacatat

SEQ ID NO: 5528403 - DNA, 18 bp, Homo sapiens
tgccaccaaaggccaggg

SEQ ID NO: 5528404 - DNA, 18 bp, Homo sapiens
tgccaccaaatctgtcta

SEQ ID NO: 5528405 - DNA, 18 bp, Homo sapiens
tgccaccaacactgctca

SEQ ID NO: 5528406 - DNA, 17 bp, Homo sapiens
tgccaccaactggccct

SEQ ID NO: 5528407 - DNA, 14 bp, Homo sapiens
tgccaccaataaaa

SEQ ID NO: 5528408 - DNA, 16 bp, Homo sapiens
tgccaccaataaaaat

SEQ ID NO: 5528409 - DNA, 19 bp, Homo sapiens
tgccaccaataaaaatcct

SEQ ID NO: 5528410 - DNA, 16 bp, Homo sapiens
tgccaccaccagatga

SEQ ID NO: 5528411 - DNA, 13 bp, Homo sapiens
tgccaccacccac

SEQ ID NO: 5528412 - DNA, 18 bp, Homo sapiens
tgccaccacccaccccaa

SEQ ID NO: 5528413 - DNA, 13 bp, Homo sapiens
tgccaccacccct

SEQ ID NO: 5528414 - DNA, 14 bp, Homo sapiens
tgccaccacccctc

SEQ ID NO: 5528415 - DNA, 19 bp, Homo sapiens
tgccaccacccctccctct

SEQ ID NO: 5528416 - DNA, 14 bp, Homo sapiens
tgccaccaccctgt

SEQ ID NO: 5528417 - DNA, 23 bp, Homo sapiens
tgccaccaccctgtcttcctctg

SEQ ID NO: 5528418 - DNA, 22 bp, Homo sapiens
tgccaccactataaaatgtctt

SEQ ID NO: 5528419 - DNA, 19 bp, Homo sapiens
tgccaccagagaccgtcct

SEQ ID NO: 5528420 - DNA, 21 bp, Homo sapiens
tgccaccagagaccgtcctca

SEQ ID NO: 5528421 - DNA, 23 bp, Homo sapiens
tgccaccagagaccgtcctcacc

SEQ ID NO: 5528422 - DNA, 21 bp, Homo sapiens
tgccaccagcaatgccctgcc

SEQ ID NO: 5528423 - DNA, 15 bp, Homo sapiens
tgccaccagcatcca

SEQ ID NO: 5528424 - DNA, 22 bp, Homo sapiens
tgccaccagcccccgccccaga

SEQ ID NO: 5528425 - DNA, 13 bp, Homo sapiens
tgccaccagcgcc

SEQ ID NO: 5528426 - DNA, 20 bp, Homo sapiens
tgccaccagcgcccccactc

SEQ ID NO: 5528427 - DNA, 21 bp, Homo sapiens
tgccaccagcgcccccactcc

SEQ ID NO: 5528428 - DNA, 22 bp, Homo sapiens
tgccaccagcgcccccactcct

SEQ ID NO: 5528429 - DNA, 24 bp, Homo sapiens
tgccaccagcgcccccactcctcc

SEQ ID NO: 5528430 - DNA, 12 bp, Homo sapiens
tgccaccaggag

SEQ ID NO: 5528431 - DNA, 13 bp, Homo sapiens
tgccaccaggaga

SEQ ID NO: 5528432 - DNA, 18 bp, Homo sapiens
tgccaccaggccacctcc

SEQ ID NO: 5528433 - DNA, 21 bp, Homo sapiens
tgccaccagggagcttcctgg

SEQ ID NO: 5528434 - DNA, 15 bp, Homo sapiens
tgccaccatcctgct

SEQ ID NO: 5528435 - DNA, 17 bp, Homo sapiens
tgccacccaccagggcg

SEQ ID NO: 5528436 - DNA, 15 bp, Homo sapiens
tgccacccaccccaa

SEQ ID NO: 5528437 - DNA, 19 bp, Homo sapiens
tgccacccacctccctgcc

SEQ ID NO: 5528438 - DNA, 20 bp, Homo sapiens
tgccacccacctccctgcct

SEQ ID NO: 5528439 - DNA, 13 bp, Homo sapiens
tgccacccacctt

SEQ ID NO: 5528440 - DNA, 12 bp, Homo sapiens
tgccacccactc

SEQ ID NO: 5528441 - DNA, 14 bp, Homo sapiens
tgccacccactcag

SEQ ID NO: 5528442 - DNA, 17 bp, Homo sapiens
tgccacccactcaggat

SEQ ID NO: 5528443 - DNA, 21 bp, Homo sapiens
tgccacccagcaacacagagc

SEQ ID NO: 5528444 - DNA, 17 bp, Homo sapiens
tgccacccagccccagc

SEQ ID NO: 5528445 - DNA, 20 bp, Homo sapiens
tgccacccagccccagccag

SEQ ID NO: 5528446 - DNA, 21 bp, Homo sapiens
tgccacccagccccagccagg

SEQ ID NO: 5528447 - DNA, 13 bp, Homo sapiens
tgccacccaggat

SEQ ID NO: 5528448 - DNA, 17 bp, Homo sapiens
tgccacccattcttccc

SEQ ID NO: 5528449 - DNA, 15 bp, Homo sapiens
tgccaccccaaccca

SEQ ID NO: 5528450 - DNA, 22 bp, Homo sapiens
tgccaccccaccctccctggag

SEQ ID NO: 5528451 - DNA, 20 bp, Homo sapiens
tgccaccccatgtgccttta

SEQ ID NO: 5528452 - DNA, 16 bp, Homo sapiens
tgccacccccagccct

SEQ ID NO: 5528453 - DNA, 21 bp, Homo sapiens
tgccacccccagccctggccc

SEQ ID NO: 5528454 - DNA, 16 bp, Homo sapiens
tgccacccccaggtct

SEQ ID NO: 5528455 - DNA, 15 bp, Homo sapiens
tgccacccccttccc

SEQ ID NO: 5528456 - DNA, 16 bp, Homo sapiens
tgccacccccttccct

SEQ ID NO: 5528457 - DNA, 17 bp, Homo sapiens
tgccacccccttccctg

SEQ ID NO: 5528458 - DNA, 20 bp, Homo sapiens
tgccacccccttccctggga

SEQ ID NO: 5528459 - DNA, 14 bp, Homo sapiens
tgccacccctcttc

SEQ ID NO: 5528460 - DNA, 16 bp, Homo sapiens
tgccacccctgtccag

SEQ ID NO: 5528461 - DNA, 21 bp, Homo sapiens
tgccaccccttcctcagcctg

SEQ ID NO: 5528462 - DNA, 16 bp, Homo sapiens
tgccacccgcccaccc

SEQ ID NO: 5528463 - DNA, 12 bp, Homo sapiens
tgccaccctacc

SEQ ID NO: 5528464 - DNA, 13 bp, Homo sapiens
tgccaccctacct

SEQ ID NO: 5528465 - DNA, 13 bp, Homo sapiens
tgccaccctcaca

SEQ ID NO: 5528466 - DNA, 15 bp, Homo sapiens
tgccaccctcacaca

SEQ ID NO: 5528467 - DNA, 21 bp, Homo sapiens
tgccaccctcacacacacagc

SEQ ID NO: 5528468 - DNA, 16 bp, Homo sapiens
tgccaccctcatgctg

SEQ ID NO: 5528469 - DNA, 21 bp, Homo sapiens
tgccaccctcctccctccaag

SEQ ID NO: 5528470 - DNA, 24 bp, Homo sapiens
tgccaccctcctccctccaagcct

SEQ ID NO: 5528471 - DNA, 13 bp, Homo sapiens
tgccaccctcctg

SEQ ID NO: 5528472 - DNA, 18 bp, Homo sapiens
tgccaccctctccatgcc

SEQ ID NO: 5528473 - DNA, 14 bp, Homo sapiens
tgccaccctctgca

SEQ ID NO: 5528474 - DNA, 20 bp, Homo sapiens
tgccaccctctgcagggcag

SEQ ID NO: 5528475 - DNA, 16 bp, Homo sapiens
tgccaccctctgctgc

SEQ ID NO: 5528476 - DNA, 17 bp, Homo sapiens
tgccaccctctgctgca

SEQ ID NO: 5528477 - DNA, 16 bp, Homo sapiens
tgccaccctctgggag

SEQ ID NO: 5528478 - DNA, 18 bp, Homo sapiens
tgccaccctctgggagtc

SEQ ID NO: 5528479 - DNA, 13 bp, Homo sapiens
tgccaccctgggc

SEQ ID NO: 5528480 - DNA, 22 bp, Homo sapiens
tgccaccctgggctctgtgggc

SEQ ID NO: 5528481 - DNA, 19 bp, Homo sapiens
tgccaccctggggagaaag

SEQ ID NO: 5528482 - DNA, 21 bp, Homo sapiens
tgccaccggaggtcactccac

SEQ ID NO: 5528483 - DNA, 15 bp, Homo sapiens
tgccaccggcctgtg

SEQ ID NO: 5528484 - DNA, 20 bp, Homo sapiens
tgccaccggggaacccagcc

SEQ ID NO: 5528485 - DNA, 17 bp, Homo sapiens
tgccaccgtcacacagt

SEQ ID NO: 5528486 - DNA, 12 bp, Homo sapiens
tgccacctagac

SEQ ID NO: 5528487 - DNA, 13 bp, Homo sapiens
tgccacctatgcc

SEQ ID NO: 5528488 - DNA, 15 bp, Homo sapiens
tgccacctatgcctg

SEQ ID NO: 5528489 - DNA, 16 bp, Homo sapiens
tgccacctatgcctgt

SEQ ID NO: 5528490 - DNA, 19 bp, Homo sapiens
tgccacctatgcctgtggt

SEQ ID NO: 5528491 - DNA, 21 bp, Homo sapiens
tgccacctatgcctgtggtga

SEQ ID NO: 5528492 - DNA, 10 bp, Homo sapiens
tgccacctcc

SEQ ID NO: 5528493 - DNA, 17 bp, Homo sapiens
tgccacctccccccaca

SEQ ID NO: 5528494 - DNA, 13 bp, Homo sapiens
tgccacctcccct

SEQ ID NO: 5528495 - DNA, 18 bp, Homo sapiens
tgccacctcccctatcca

SEQ ID NO: 5528496 - DNA, 21 bp, Homo sapiens
tgccacctcccctatccaccc

SEQ ID NO: 5528497 - DNA, 14 bp, Homo sapiens
tgccacctccctga

SEQ ID NO: 5528498 - DNA, 20 bp, Homo sapiens
tgccacctctaacagcacca

SEQ ID NO: 5528499 - DNA, 20 bp, Homo sapiens
tgccacctctggccaaatat

SEQ ID NO: 5528500 - DNA, 21 bp, Homo sapiens
tgccacctctggccaaatatg

SEQ ID NO: 5528501 - DNA, 19 bp, Homo sapiens
tgccacctgcaagtgcccg

SEQ ID NO: 5528502 - DNA, 13 bp, Homo sapiens
tgccacctgcagc

SEQ ID NO: 5528503 - DNA, 15 bp, Homo sapiens
tgccacctgcagcgt

SEQ ID NO: 5528504 - DNA, 13 bp, Homo sapiens
tgccacctggacc

SEQ ID NO: 5528505 - DNA, 18 bp, Homo sapiens
tgccacctggacccctgc

SEQ ID NO: 5528506 - DNA, 22 bp, Homo sapiens
tgccacctgtccggcccagtgc

SEQ ID NO: 5528507 - DNA, 23 bp, Homo sapiens
tgccacctgtccggcccagtgcc

SEQ ID NO: 5528508 - DNA, 13 bp, Homo sapiens
tgccacctgtctg

SEQ ID NO: 5528509 - DNA, 23 bp, Homo sapiens
tgccacctgttaaaatgtacact

SEQ ID NO: 5528510 - DNA, 19 bp, Homo sapiens
tgccaccttttgggtgtgg

SEQ ID NO: 5528511 - DNA, 15 bp, Homo sapiens
tgccacgaatttctg

SEQ ID NO: 5528512 - DNA, 21 bp, Homo sapiens
tgccacgcacaggtgctgacc

SEQ ID NO: 5528513 - DNA, 16 bp, Homo sapiens
tgccacgcacttcctc

SEQ ID NO: 5528514 - DNA, 18 bp, Homo sapiens
tgccacgcgctctgcatg

SEQ ID NO: 5528515 - DNA, 20 bp, Homo sapiens
tgccacggcagccaccctgc

SEQ ID NO: 5528516 - DNA, 22 bp, Homo sapiens
tgccacggtttatcctcttggt

SEQ ID NO: 5528517 - DNA, 14 bp, Homo sapiens
tgccacgtcatgag

SEQ ID NO: 5528518 - DNA, 21 bp, Homo sapiens
tgccacgtcccgctgcctcct

SEQ ID NO: 5528519 - DNA, 17 bp, Homo sapiens
tgccacgtgctgctgac

SEQ ID NO: 5528520 - DNA, 18 bp, Homo sapiens
tgccacgtgctgctgaca

SEQ ID NO: 5528521 - DNA, 19 bp, Homo sapiens
tgccacgtggccgctgccc

SEQ ID NO: 5528522 - DNA, 19 bp, Homo sapiens
tgccacgtggtcactgtgc

SEQ ID NO: 5528523 - DNA, 20 bp, Homo sapiens
tgccacgtggtcactgtgca

SEQ ID NO: 5528524 - DNA, 22 bp, Homo sapiens
tgccacgttggagaagcccgtg

SEQ ID NO: 5528525 - DNA, 16 bp, Homo sapiens
tgccactaaattgaca

SEQ ID NO: 5528526 - DNA, 20 bp, Homo sapiens
tgccactaaattgacactta

SEQ ID NO: 5528527 - DNA, 18 bp, Homo sapiens
tgccactaacctgtagaa

SEQ ID NO: 5528528 - DNA, 15 bp, Homo sapiens
tgccactaacttcta

SEQ ID NO: 5528529 - DNA, 21 bp, Homo sapiens
tgccactaccccttgattttc

SEQ ID NO: 5528530 - DNA, 16 bp, Homo sapiens
tgccactaggccctgg

SEQ ID NO: 5528531 - DNA, 18 bp, Homo sapiens
tgccactaggctgggtgc

SEQ ID NO: 5528532 - DNA, 21 bp, Homo sapiens
tgccactaggctgggtgccca

SEQ ID NO: 5528533 - DNA, 15 bp, Homo sapiens
tgccactcacacagc

SEQ ID NO: 5528534 - DNA, 20 bp, Homo sapiens
tgccactcacacagccaggt

SEQ ID NO: 5528535 - DNA, 22 bp, Homo sapiens
tgccactcacacagccaggtgc

SEQ ID NO: 5528536 - DNA, 14 bp, Homo sapiens
tgccactcaccctt

SEQ ID NO: 5528537 - DNA, 20 bp, Homo sapiens
tgccactcacccttcctggc

SEQ ID NO: 5528538 - DNA, 18 bp, Homo sapiens
tgccactcactaggcccc

SEQ ID NO: 5528539 - DNA, 18 bp, Homo sapiens
tgccactcaggcagcctg

SEQ ID NO: 5528540 - DNA, 12 bp, Homo sapiens
tgccactcaggg

SEQ ID NO: 5528541 - DNA, 18 bp, Homo sapiens
tgccactcattcctgtag

SEQ ID NO: 5528542 - DNA, 18 bp, Homo sapiens
tgccactccagtcctgcc

SEQ ID NO: 5528543 - DNA, 20 bp, Homo sapiens
tgccactcccctaaactcca

SEQ ID NO: 5528544 - DNA, 13 bp, Homo sapiens
tgccactccctga

SEQ ID NO: 5528545 - DNA, 14 bp, Homo sapiens
tgccactccctgag

SEQ ID NO: 5528546 - DNA, 17 bp, Homo sapiens
tgccactccctgagctt

SEQ ID NO: 5528547 - DNA, 15 bp, Homo sapiens
tgccactcctccctc

SEQ ID NO: 5528548 - DNA, 16 bp, Homo sapiens
tgccactcctccctcc

SEQ ID NO: 5528549 - DNA, 20 bp, Homo sapiens
tgccactctcctcccctccc

SEQ ID NO: 5528550 - DNA, 17 bp, Homo sapiens
tgccactctcctgagga

SEQ ID NO: 5528551 - DNA, 16 bp, Homo sapiens
tgccactctctgggac

SEQ ID NO: 5528552 - DNA, 19 bp, Homo sapiens
tgccactctctgggactct

SEQ ID NO: 5528553 - DNA, 12 bp, Homo sapiens
tgccactgaccg

SEQ ID NO: 5528554 - DNA, 16 bp, Homo sapiens
tgccactgacctcacc

SEQ ID NO: 5528555 - DNA, 18 bp, Homo sapiens
tgccactgacttgctgtg

SEQ ID NO: 5528556 - DNA, 14 bp, Homo sapiens
tgccactgaggaga

SEQ ID NO: 5528557 - DNA, 20 bp, Homo sapiens
tgccactgcactccagcctg

SEQ ID NO: 5528558 - DNA, 18 bp, Homo sapiens
tgccactgccaggcacct

SEQ ID NO: 5528559 - DNA, 18 bp, Homo sapiens
tgccactgccataacttg

SEQ ID NO: 5528560 - DNA, 14 bp, Homo sapiens
tgccactgcccccc

SEQ ID NO: 5528561 - DNA, 18 bp, Homo sapiens
tgccactgccccccgagg

SEQ ID NO: 5528562 - DNA, 23 bp, Homo sapiens
tgccactgccccccgaggctgct

SEQ ID NO: 5528563 - DNA, 18 bp, Homo sapiens
tgccactgcccgagctgg

SEQ ID NO: 5528564 - DNA, 22 bp, Homo sapiens
tgccactgcccgagctggtgca

SEQ ID NO: 5528565 - DNA, 19 bp, Homo sapiens
tgccactgcctcttcctcc

SEQ ID NO: 5528566 - DNA, 20 bp, Homo sapiens
tgccactgcctcttcctccc

SEQ ID NO: 5528567 - DNA, 19 bp, Homo sapiens
tgccactgccttcgcttct

SEQ ID NO: 5528568 - DNA, 22 bp, Homo sapiens
tgccactgcctttcagaagtga

SEQ ID NO: 5528569 - DNA, 23 bp, Homo sapiens
tgccactgcgggagctctgtatg

SEQ ID NO: 5528570 - DNA, 22 bp, Homo sapiens
tgccactgggacagctggctgg

SEQ ID NO: 5528571 - DNA, 13 bp, Homo sapiens
tgccactgggcac

SEQ ID NO: 5528572 - DNA, 12 bp, Homo sapiens
tgccactgggct

SEQ ID NO: 5528573 - DNA, 19 bp, Homo sapiens
tgccactgggctctggacc

SEQ ID NO: 5528574 - DNA, 16 bp, Homo sapiens
tgccactgtgtgcctt

SEQ ID NO: 5528575 - DNA, 19 bp, Homo sapiens
tgccactgtgtgccttctg

SEQ ID NO: 5528576 - DNA, 21 bp, Homo sapiens
tgccactgttcagcggagctg

SEQ ID NO: 5528577 - DNA, 12 bp, Homo sapiens
tgccactgttgt

SEQ ID NO: 5528578 - DNA, 21 bp, Homo sapiens
tgccactgttttgttggccca

SEQ ID NO: 5528579 - DNA, 14 bp, Homo sapiens
tgccacttaaaaag

SEQ ID NO: 5528580 - DNA, 20 bp, Homo sapiens
tgccacttaatgtatgttac

SEQ ID NO: 5528581 - DNA, 18 bp, Homo sapiens
tgccacttagtattttaa

SEQ ID NO: 5528582 - DNA, 18 bp, Homo sapiens
tgccacttcccagaggca

SEQ ID NO: 5528583 - DNA, 16 bp, Homo sapiens
tgccacttctcactca

SEQ ID NO: 5528584 - DNA, 15 bp, Homo sapiens
tgccacttctgcggg

SEQ ID NO: 5528585 - DNA, 23 bp, Homo sapiens
tgccacttctgcgggctccctcc

SEQ ID NO: 5528586 - DNA, 20 bp, Homo sapiens
tgccacttcttaaaggcctg

SEQ ID NO: 5528587 - DNA, 21 bp, Homo sapiens
tgccacttcttaaaggcctgg

SEQ ID NO: 5528588 - DNA, 23 bp, Homo sapiens
tgccacttcttaaaggcctggaa

SEQ ID NO: 5528589 - DNA, 21 bp, Homo sapiens
tgccacttgaacaaaatctgt

SEQ ID NO: 5528590 - DNA, 17 bp, Homo sapiens
tgccacttgacattcct

SEQ ID NO: 5528591 - DNA, 17 bp, Homo sapiens
tgccacttgtcaaagaa

SEQ ID NO: 5528592 - DNA, 21 bp, Homo sapiens
tgccactttacccacctagaa

SEQ ID NO: 5528593 - DNA, 14 bp, Homo sapiens
tgccactttccacc

SEQ ID NO: 5528594 - DNA, 16 bp, Homo sapiens
tgccactttccaccaa

SEQ ID NO: 5528595 - DNA, 19 bp, Homo sapiens
tgccactttgcaaaggagc

SEQ ID NO: 5528596 - DNA, 19 bp, Homo sapiens
tgccactttggcttctcct

SEQ ID NO: 5528597 - DNA, 18 bp, Homo sapiens
tgccagaaaaaaataact

SEQ ID NO: 5528598 - DNA, 24 bp, Homo sapiens
tgccagaaacagtgggagccctga

SEQ ID NO: 5528599 - DNA, 14 bp, Homo sapiens
tgccagaacagttt

SEQ ID NO: 5528600 - DNA, 21 bp, Homo sapiens
tgccagaagatcccctcagga

SEQ ID NO: 5528601 - DNA, 12 bp, Homo sapiens
tgccagaagtgt

SEQ ID NO: 5528602 - DNA, 13 bp, Homo sapiens
tgccagaagtgtg

SEQ ID NO: 5528603 - DNA, 21 bp, Homo sapiens
tgccagacaaataggagtgag

SEQ ID NO: 5528604 - DNA, 16 bp, Homo sapiens
tgccagacagagatca

SEQ ID NO: 5528605 - DNA, 19 bp, Homo sapiens
tgccagacatggacctcca

SEQ ID NO: 5528606 - DNA, 13 bp, Homo sapiens
tgccagacatgtg

SEQ ID NO: 5528607 - DNA, 22 bp, Homo sapiens
tgccagacgctcattcagcatc

SEQ ID NO: 5528608 - DNA, 23 bp, Homo sapiens
tgccagacgctcattcagcatct

SEQ ID NO: 5528609 - DNA, 17 bp, Homo sapiens
tgccagacgtgctcctg

SEQ ID NO: 5528610 - DNA, 21 bp, Homo sapiens
tgccagacgtgctcctgctga

SEQ ID NO: 5528611 - DNA, 18 bp, Homo sapiens
tgccagacttctaaaata

SEQ ID NO: 5528612 - DNA, 21 bp, Homo sapiens
tgccagacttctaaaataaat

SEQ ID NO: 5528613 - DNA, 20 bp, Homo sapiens
tgccagagaaactaacttgg

SEQ ID NO: 5528614 - DNA, 20 bp, Homo sapiens
tgccagagaagtctggtcag

SEQ ID NO: 5528615 - DNA, 21 bp, Homo sapiens
tgccagagacggaagcctttt

SEQ ID NO: 5528616 - DNA, 21 bp, Homo sapiens
tgccagagatggaggttctct

SEQ ID NO: 5528617 - DNA, 12 bp, Homo sapiens
tgccagagccaa

SEQ ID NO: 5528618 - DNA, 18 bp, Homo sapiens
tgccagagccaacctgga

SEQ ID NO: 5528619 - DNA, 20 bp, Homo sapiens
tgccagagccaacctggact

SEQ ID NO: 5528620 - DNA, 22 bp, Homo sapiens
tgccagagccaacctggacttc

SEQ ID NO: 5528621 - DNA, 22 bp, Homo sapiens
tgccagagccggccgccttctc

SEQ ID NO: 5528622 - DNA, 19 bp, Homo sapiens
tgccagagcctggggctct

SEQ ID NO: 5528623 - DNA, 14 bp, Homo sapiens
tgccagagctacac

SEQ ID NO: 5528624 - DNA, 23 bp, Homo sapiens
tgccagagctttgttttatatat

SEQ ID NO: 5528625 - DNA, 20 bp, Homo sapiens
tgccagaggaatcctggcag

SEQ ID NO: 5528626 - DNA, 22 bp, Homo sapiens
tgccagaggaatcctggcagcc

SEQ ID NO: 5528627 - DNA, 17 bp, Homo sapiens
tgccagaggatgctctt

SEQ ID NO: 5528628 - DNA, 22 bp, Homo sapiens
tgccagaggatgctctttccca

SEQ ID NO: 5528629 - DNA, 23 bp, Homo sapiens
tgccagaggatgctctttcccag

SEQ ID NO: 5528630 - DNA, 14 bp, Homo sapiens
tgccagaggccctg

SEQ ID NO: 5528631 - DNA, 15 bp, Homo sapiens
tgccagaggcctggt

SEQ ID NO: 5528632 - DNA, 22 bp, Homo sapiens
tgccagaggctgatgtcaagca

SEQ ID NO: 5528633 - DNA, 15 bp, Homo sapiens
tgccagagggccagc

SEQ ID NO: 5528634 - DNA, 19 bp, Homo sapiens
tgccagaggtgggcaggtg

SEQ ID NO: 5528635 - DNA, 22 bp, Homo sapiens
tgccagataaccaagtgagatg

SEQ ID NO: 5528636 - DNA, 21 bp, Homo sapiens
tgccagatataactgtcttgt

SEQ ID NO: 5528637 - DNA, 23 bp, Homo sapiens
tgccagatataactgtcttgttt

SEQ ID NO: 5528638 - DNA, 14 bp, Homo sapiens
tgccagatcaaaat

SEQ ID NO: 5528639 - DNA, 17 bp, Homo sapiens
tgccagatcaaaattgt

SEQ ID NO: 5528640 - DNA, 21 bp, Homo sapiens
tgccagatgaaaccaactctt

SEQ ID NO: 5528641 - DNA, 21 bp, Homo sapiens
tgccagatgctgatgttcagt

SEQ ID NO: 5528642 - DNA, 20 bp, Homo sapiens
tgccagattaaatgaatata

SEQ ID NO: 5528643 - DNA, 20 bp, Homo sapiens
tgccagattctgcctctctg

SEQ ID NO: 5528644 - DNA, 21 bp, Homo sapiens
tgccagattctgcctctctgg

SEQ ID NO: 5528645 - DNA, 13 bp, Homo sapiens
tgccagcaaagcc

SEQ ID NO: 5528646 - DNA, 16 bp, Homo sapiens
tgccagcaaataaata

SEQ ID NO: 5528647 - DNA, 11 bp, Homo sapiens
tgccagcaact

SEQ ID NO: 5528648 - DNA, 12 bp, Homo sapiens
tgccagcaactg

SEQ ID NO: 5528649 - DNA, 14 bp, Homo sapiens
tgccagcaactgaa

SEQ ID NO: 5528650 - DNA, 15 bp, Homo sapiens
tgccagcaactgaat

SEQ ID NO: 5528651 - DNA, 15 bp, Homo sapiens
tgccagcaagtcctt

SEQ ID NO: 5528652 - DNA, 23 bp, Homo sapiens
tgccagcaatgacatctcagggg

SEQ ID NO: 5528653 - DNA, 15 bp, Homo sapiens
tgccagcacaggggc

SEQ ID NO: 5528654 - DNA, 21 bp, Homo sapiens
tgccagcacaggggccccaga

SEQ ID NO: 5528655 - DNA, 22 bp, Homo sapiens
tgccagcacccagtcctctgcc

SEQ ID NO: 5528656 - DNA, 16 bp, Homo sapiens
tgccagcacccccacg

SEQ ID NO: 5528657 - DNA, 17 bp, Homo sapiens
tgccagcacccccacgc

SEQ ID NO: 5528658 - DNA, 16 bp, Homo sapiens
tgccagcacgcctggc

SEQ ID NO: 5528659 - DNA, 12 bp, Homo sapiens
tgccagcagagc

SEQ ID NO: 5528660 - DNA, 20 bp, Homo sapiens
tgccagcagagccagggcag

SEQ ID NO: 5528661 - DNA, 14 bp, Homo sapiens
tgccagcagcagca

SEQ ID NO: 5528662 - DNA, 15 bp, Homo sapiens
tgccagcagcagcag

SEQ ID NO: 5528663 - DNA, 13 bp, Homo sapiens
tgccagcagcccc

SEQ ID NO: 5528664 - DNA, 20 bp, Homo sapiens
tgccagcagccccgtctgcc

SEQ ID NO: 5528665 - DNA, 19 bp, Homo sapiens
tgccagcagcccttgttta

SEQ ID NO: 5528666 - DNA, 13 bp, Homo sapiens
tgccagcagcctc

SEQ ID NO: 5528667 - DNA, 19 bp, Homo sapiens
tgccagcagcctcgcacag

SEQ ID NO: 5528668 - DNA, 21 bp, Homo sapiens
tgccagcagcctcgcacaggc

SEQ ID NO: 5528669 - DNA, 23 bp, Homo sapiens
tgccagcagcgggggcggcccag

SEQ ID NO: 5528670 - DNA, 16 bp, Homo sapiens
tgccagcaggaataaa

SEQ ID NO: 5528671 - DNA, 17 bp, Homo sapiens
tgccagcaggaataaag

SEQ ID NO: 5528672 - DNA, 19 bp, Homo sapiens
tgccagcaggggggctgtg

SEQ ID NO: 5528673 - DNA, 19 bp, Homo sapiens
tgccagcatacattttctg

SEQ ID NO: 5528674 - DNA, 20 bp, Homo sapiens
tgccagcattccagacttca

SEQ ID NO: 5528675 - DNA, 17 bp, Homo sapiens
tgccagccactgtgata

SEQ ID NO: 5528676 - DNA, 11 bp, Homo sapiens
tgccagccagc

SEQ ID NO: 5528677 - DNA, 15 bp, Homo sapiens
tgccagccagcagcc

SEQ ID NO: 5528678 - DNA, 17 bp, Homo sapiens
tgccagccagcagccag

SEQ ID NO: 5528679 - DNA, 12 bp, Homo sapiens
tgccagccatca

SEQ ID NO: 5528680 - DNA, 13 bp, Homo sapiens
tgccagccatcac

SEQ ID NO: 5528681 - DNA, 15 bp, Homo sapiens
tgccagccatcacaa

SEQ ID NO: 5528682 - DNA, 17 bp, Homo sapiens
tgccagccatcacaagg

SEQ ID NO: 5528683 - DNA, 14 bp, Homo sapiens
tgccagcccacccc

SEQ ID NO: 5528684 - DNA, 20 bp, Homo sapiens
tgccagcccactgcctcctg

SEQ ID NO: 5528685 - DNA, 16 bp, Homo sapiens
tgccagcccagaacac

SEQ ID NO: 5528686 - DNA, 12 bp, Homo sapiens
tgccagcccagc

SEQ ID NO: 5528687 - DNA, 15 bp, Homo sapiens
tgccagcccatttgg

SEQ ID NO: 5528688 - DNA, 21 bp, Homo sapiens
tgccagccccctaaaagcact

SEQ ID NO: 5528689 - DNA, 18 bp, Homo sapiens
tgccagccccgtgccagg

SEQ ID NO: 5528690 - DNA, 24 bp, Homo sapiens
tgccagcccctgctggctggtgcc

SEQ ID NO: 5528691 - DNA, 13 bp, Homo sapiens
tgccagcccggct

SEQ ID NO: 5528692 - DNA, 12 bp, Homo sapiens
tgccagcccttc

SEQ ID NO: 5528693 - DNA, 13 bp, Homo sapiens
tgccagccgaccc

SEQ ID NO: 5528694 - DNA, 16 bp, Homo sapiens
tgccagccgaccctcc

SEQ ID NO: 5528695 - DNA, 18 bp, Homo sapiens
tgccagccgaccctcctg

SEQ ID NO: 5528696 - DNA, 22 bp, Homo sapiens
tgccagccgagatagccaaggc

SEQ ID NO: 5528697 - DNA, 21 bp, Homo sapiens
tgccagccgtgatgctcaggc

SEQ ID NO: 5528698 - DNA, 15 bp, Homo sapiens
tgccagcctccttgc

SEQ ID NO: 5528699 - DNA, 22 bp, Homo sapiens
tgccagcctccttgctgacccc

SEQ ID NO: 5528700 - DNA, 14 bp, Homo sapiens
tgccagcctgagcg

SEQ ID NO: 5528701 - DNA, 17 bp, Homo sapiens
tgccagcctgaggtgcc

SEQ ID NO: 5528702 - DNA, 17 bp, Homo sapiens
tgccagcctggcttctg

SEQ ID NO: 5528703 - DNA, 22 bp, Homo sapiens
tgccagcctggcttctggagcc

SEQ ID NO: 5528704 - DNA, 14 bp, Homo sapiens
tgccagccttcctc

SEQ ID NO: 5528705 - DNA, 23 bp, Homo sapiens
tgccagccttcctctgcagctga

SEQ ID NO: 5528706 - DNA, 17 bp, Homo sapiens
tgccagcggtttcctgg

SEQ ID NO: 5528707 - DNA, 14 bp, Homo sapiens
tgccagcgtctgtt

SEQ ID NO: 5528708 - DNA, 13 bp, Homo sapiens
tgccagcgtggca

SEQ ID NO: 5528709 - DNA, 17 bp, Homo sapiens
tgccagctactcaggag

SEQ ID NO: 5528710 - DNA, 12 bp, Homo sapiens
tgccagctccag

SEQ ID NO: 5528711 - DNA, 19 bp, Homo sapiens
tgccagctccagtgccgct

SEQ ID NO: 5528712 - DNA, 18 bp, Homo sapiens
tgccagctcttcctagct

SEQ ID NO: 5528713 - DNA, 18 bp, Homo sapiens
tgccagctgacatcttga

SEQ ID NO: 5528714 - DNA, 15 bp, Homo sapiens
tgccagctgcactga

SEQ ID NO: 5528715 - DNA, 11 bp, Homo sapiens
tgccagctgcc

SEQ ID NO: 5528716 - DNA, 15 bp, Homo sapiens
tgccagctgcccttg

SEQ ID NO: 5528717 - DNA, 15 bp, Homo sapiens
tgccagctgccttcc

SEQ ID NO: 5528718 - DNA, 17 bp, Homo sapiens
tgccagctgccttcctc

SEQ ID NO: 5528719 - DNA, 22 bp, Homo sapiens
tgccagctgctcccaatgtgcc

SEQ ID NO: 5528720 - DNA, 15 bp, Homo sapiens
tgccagctgctgagc

SEQ ID NO: 5528721 - DNA, 14 bp, Homo sapiens
tgccagctgcttct

SEQ ID NO: 5528722 - DNA, 18 bp, Homo sapiens
tgccagctgcttctgccc

SEQ ID NO: 5528723 - DNA, 18 bp, Homo sapiens
tgccagctggatcgctgc

SEQ ID NO: 5528724 - DNA, 15 bp, Homo sapiens
tgccagctggccttt

SEQ ID NO: 5528725 - DNA, 19 bp, Homo sapiens
tgccagctggcctttgtaa

SEQ ID NO: 5528726 - DNA, 18 bp, Homo sapiens
tgccagctggtgaatcca

SEQ ID NO: 5528727 - DNA, 19 bp, Homo sapiens
tgccagctgtctcccacgt

SEQ ID NO: 5528728 - DNA, 13 bp, Homo sapiens
tgccagcttcagg

SEQ ID NO: 5528729 - DNA, 14 bp, Homo sapiens
tgccagcttcaggt

SEQ ID NO: 5528730 - DNA, 23 bp, Homo sapiens
tgccagcttcccttttctcccaa

SEQ ID NO: 5528731 - DNA, 15 bp, Homo sapiens
tgccagcttctctct

SEQ ID NO: 5528732 - DNA, 19 bp, Homo sapiens
tgccagcttctctctccag

SEQ ID NO: 5528733 - DNA, 22 bp, Homo sapiens
tgccagcttctctctccagggt

SEQ ID NO: 5528734 - DNA, 22 bp, Homo sapiens
tgccagcttggacatcagtgtt

SEQ ID NO: 5528735 - DNA, 13 bp, Homo sapiens
tgccagcttgtga

SEQ ID NO: 5528736 - DNA, 21 bp, Homo sapiens
tgccaggaaacaagggaaggg

SEQ ID NO: 5528737 - DNA, 19 bp, Homo sapiens
tgccaggaaactcttgcta

SEQ ID NO: 5528738 - DNA, 18 bp, Homo sapiens
tgccattttttgtctgtg

SEQ ID NO: 5528739 - DNA, 20 bp, Homo sapiens
tgccattttttgtctgtgat

SEQ ID NO: 5528740 - DNA, 19 bp, Homo sapiens
tgccatttttttcactcag

SEQ ID NO: 5528741 - DNA, 22 bp, Homo sapiens
tgcccaaaagaggtgtcatgct

SEQ ID NO: 5528742 - DNA, 13 bp, Homo sapiens
tgcccaaaagcca

SEQ ID NO: 5528743 - DNA, 16 bp, Homo sapiens
tgcccaaaagccatgt

SEQ ID NO: 5528744 - DNA, 14 bp, Homo sapiens
tgcccaaaatgtga

SEQ ID NO: 5528745 - DNA, 15 bp, Homo sapiens
tgcccaaaatgtgaa

SEQ ID NO: 5528746 - DNA, 12 bp, Homo sapiens
tgcccaaactcc

SEQ ID NO: 5528747 - DNA, 18 bp, Homo sapiens
tgcccaaactccccttcc

SEQ ID NO: 5528748 - DNA, 19 bp, Homo sapiens
tgcccaaactccccttccc

SEQ ID NO: 5528749 - DNA, 22 bp, Homo sapiens
tgcccaaactccccttccctgg

SEQ ID NO: 5528750 - DNA, 20 bp, Homo sapiens
tgcccaaagatgcagccggt

SEQ ID NO: 5528751 - DNA, 19 bp, Homo sapiens
tgcccaaagattgatttgt

SEQ ID NO: 5528752 - DNA, 15 bp, Homo sapiens
tgcccaaagtgggga

SEQ ID NO: 5528753 - DNA, 19 bp, Homo sapiens
tgcccaaagttttattttt

SEQ ID NO: 5528754 - DNA, 20 bp, Homo sapiens
tgcccaaatccttagatctg

SEQ ID NO: 5528755 - DNA, 16 bp, Homo sapiens
tgcccaacaccagccc

SEQ ID NO: 5528756 - DNA, 18 bp, Homo sapiens
tgcccaacaccagcccct

SEQ ID NO: 5528757 - DNA, 22 bp, Homo sapiens
tgcccaacaccagcccctgccc

SEQ ID NO: 5528758 - DNA, 14 bp, Homo sapiens
tgcccaacctcagc

SEQ ID NO: 5528759 - DNA, 18 bp, Homo sapiens
tgcccaacctcagcaacc

SEQ ID NO: 5528760 - DNA, 19 bp, Homo sapiens
tgcccaacctcagcaacct

SEQ ID NO: 5528761 - DNA, 15 bp, Homo sapiens
tgcccaactcccagc

SEQ ID NO: 5528762 - DNA, 13 bp, Homo sapiens
tgcccaagccaga

SEQ ID NO: 5528763 - DNA, 22 bp, Homo sapiens
tgcccaagccagaggctgggtt

SEQ ID NO: 5528764 - DNA, 18 bp, Homo sapiens
tgcccaagccctgagagt

SEQ ID NO: 5528765 - DNA, 17 bp, Homo sapiens
tgcccaagctggagtga

SEQ ID NO: 5528766 - DNA, 13 bp, Homo sapiens
tgcccaaggccac

SEQ ID NO: 5528767 - DNA, 20 bp, Homo sapiens
tgcccaaggcctaccccagt

SEQ ID NO: 5528768 - DNA, 14 bp, Homo sapiens
tgcccaagggaaag

SEQ ID NO: 5528769 - DNA, 19 bp, Homo sapiens
tgcccaagggcctcccacc

SEQ ID NO: 5528770 - DNA, 21 bp, Homo sapiens
tgcccaagggcctcccaccag

SEQ ID NO: 5528771 - DNA, 19 bp, Homo sapiens
tgcccaagtgaccagggaa

SEQ ID NO: 5528772 - DNA, 14 bp, Homo sapiens
tgcccaagtggctc

SEQ ID NO: 5528773 - DNA, 19 bp, Homo sapiens
tgcccaagtggctcttggg

SEQ ID NO: 5528774 - DNA, 21 bp, Homo sapiens
tgcccaagtggctcttgggac

SEQ ID NO: 5528775 - DNA, 16 bp, Homo sapiens
tgcccaagtgggcagt

SEQ ID NO: 5528776 - DNA, 19 bp, Homo sapiens
tgcccaagtgggcagtcac

SEQ ID NO: 5528777 - DNA, 15 bp, Homo sapiens
tgcccaagttgctct

SEQ ID NO: 5528778 - DNA, 18 bp, Homo sapiens
tgcccaagttgctctgta

SEQ ID NO: 5528779 - DNA, 14 bp, Homo sapiens
tgcccaatccaggc

SEQ ID NO: 5528780 - DNA, 18 bp, Homo sapiens
tgcccaatcctccctgga

SEQ ID NO: 5528781 - DNA, 20 bp, Homo sapiens
tgcccaatcctccctggaga

SEQ ID NO: 5528782 - DNA, 19 bp, Homo sapiens
tgcccaatctgagcaaaca

SEQ ID NO: 5528783 - DNA, 20 bp, Homo sapiens
tgcccaatgaataatggaaa

SEQ ID NO: 5528784 - DNA, 21 bp, Homo sapiens
tgcccaatgagactctagggt

SEQ ID NO: 5528785 - DNA, 16 bp, Homo sapiens
tgcccaatttcacaga

SEQ ID NO: 5528786 - DNA, 19 bp, Homo sapiens
tgcccacaacgtcccctca

SEQ ID NO: 5528787 - DNA, 20 bp, Homo sapiens
tgcccacaactcccttgcac

SEQ ID NO: 5528788 - DNA, 17 bp, Homo sapiens
tgcccacacacactcct

SEQ ID NO: 5528789 - DNA, 19 bp, Homo sapiens
tgcccacacacactccttc

SEQ ID NO: 5528790 - DNA, 16 bp, Homo sapiens
tgcccacacaccccaa

SEQ ID NO: 5528791 - DNA, 18 bp, Homo sapiens
tgcccacacactttccat

SEQ ID NO: 5528792 - DNA, 21 bp, Homo sapiens
tgcccacacactttccatctc

SEQ ID NO: 5528793 - DNA, 11 bp, Homo sapiens
tgcccacacca

SEQ ID NO: 5528794 - DNA, 23 bp, Homo sapiens
tgcccacaccgcagggacaagcc

SEQ ID NO: 5528795 - DNA, 16 bp, Homo sapiens
tgcccacacctcctgg

SEQ ID NO: 5528796 - DNA, 19 bp, Homo sapiens
tgcccacacctgcctctga

SEQ ID NO: 5528797 - DNA, 21 bp, Homo sapiens
tgcccacagcccgcatgcagc

SEQ ID NO: 5528798 - DNA, 14 bp, Homo sapiens
tgcccacaggatca

SEQ ID NO: 5528799 - DNA, 19 bp, Homo sapiens
tgcccacaggatcagtctg

SEQ ID NO: 5528800 - DNA, 12 bp, Homo sapiens
tgcccacaggga

SEQ ID NO: 5528801 - DNA, 14 bp, Homo sapiens
tgcccacagggacc

SEQ ID NO: 5528802 - DNA, 18 bp, Homo sapiens
tgcccacagtgtcaggca

SEQ ID NO: 5528803 - DNA, 23 bp, Homo sapiens
tgcccacatgtgtccatcccagc

SEQ ID NO: 5528804 - DNA, 16 bp, Homo sapiens
tgcccacatttgggct

SEQ ID NO: 5528805 - DNA, 20 bp, Homo sapiens
tgcccacatttgggctcagg

SEQ ID NO: 5528806 - DNA, 22 bp, Homo sapiens
tgcccacatttgggctcagggt

SEQ ID NO: 5528807 - DNA, 12 bp, Homo sapiens
tgcccaccaaag

SEQ ID NO: 5528808 - DNA, 17 bp, Homo sapiens
tgcccaccagctggctc

SEQ ID NO: 5528809 - DNA, 19 bp, Homo sapiens
tgcccaccagctggctctg

SEQ ID NO: 5528810 - DNA, 23 bp, Homo sapiens
tgcccaccagctggctctgcagc

SEQ ID NO: 5528811 - DNA, 14 bp, Homo sapiens
tgcccaccattccc

SEQ ID NO: 5528812 - DNA, 19 bp, Homo sapiens
tgcccaccattcccggccg

SEQ ID NO: 5528813 - DNA, 15 bp, Homo sapiens
tgcccacccagggaa

SEQ ID NO: 5528814 - DNA, 20 bp, Homo sapiens
tgcccacccagggcccggca

SEQ ID NO: 5528815 - DNA, 13 bp, Homo sapiens
tgcccaccccacc

SEQ ID NO: 5528816 - DNA, 19 bp, Homo sapiens
tgcccaccccacccccacc

SEQ ID NO: 5528817 - DNA, 19 bp, Homo sapiens
tgcccaccccatccctggc

SEQ ID NO: 5528818 - DNA, 24 bp, Homo sapiens
tgcccaccccctcaagccaatccc

SEQ ID NO: 5528819 - DNA, 18 bp, Homo sapiens
tgcccaccccctgccctg

SEQ ID NO: 5528820 - DNA, 18 bp, Homo sapiens
tgcccaccccgcctctgg

SEQ ID NO: 5528821 - DNA, 20 bp, Homo sapiens
tgcccaccccgcctctgggc

SEQ ID NO: 5528822 - DNA, 22 bp, Homo sapiens
tgcccaccccgcctctgggctc

SEQ ID NO: 5528823 - DNA, 13 bp, Homo sapiens
tgcccacccctca

SEQ ID NO: 5528824 - DNA, 22 bp, Homo sapiens
tgcccacccctcactccccagg

SEQ ID NO: 5528825 - DNA, 23 bp, Homo sapiens
tgcccacccctcactccccaggg

SEQ ID NO: 5528826 - DNA, 13 bp, Homo sapiens
tgcccacccctgc

SEQ ID NO: 5528827 - DNA, 18 bp, Homo sapiens
tgcccacccgtcttcaat

SEQ ID NO: 5528828 - DNA, 19 bp, Homo sapiens
tgcccacccgtggagatgg

SEQ ID NO: 5528829 - DNA, 20 bp, Homo sapiens
tgcccacccgtggagatggg

SEQ ID NO: 5528830 - DNA, 17 bp, Homo sapiens
tgcccaccctaccagct

SEQ ID NO: 5528831 - DNA, 21 bp, Homo sapiens
tgcccaccctaccagctcctc

SEQ ID NO: 5528832 - DNA, 23 bp, Homo sapiens
tgcccaccctaccagctcctcca

SEQ ID NO: 5528833 - DNA, 13 bp, Homo sapiens
tgcccaccctcct

SEQ ID NO: 5528834 - DNA, 22 bp, Homo sapiens
tgcccaccctctggagaaggtg

SEQ ID NO: 5528835 - DNA, 11 bp, Homo sapiens
tgcccaccctg

SEQ ID NO: 5528836 - DNA, 12 bp, Homo sapiens
tgcccaccctgg

SEQ ID NO: 5528837 - DNA, 22 bp, Homo sapiens
tgcccaccctgggagacagacc

SEQ ID NO: 5528838 - DNA, 17 bp, Homo sapiens
tgcccaccctgggcctc

SEQ ID NO: 5528839 - DNA, 19 bp, Homo sapiens
tgcccaccgaggagcccca

SEQ ID NO: 5528840 - DNA, 20 bp, Homo sapiens
tgcccaccgaggagccccag

SEQ ID NO: 5528841 - DNA, 16 bp, Homo sapiens
tgcccaccgcccctgg

SEQ ID NO: 5528842 - DNA, 13 bp, Homo sapiens
tgcccaccgccct

SEQ ID NO: 5528843 - DNA, 22 bp, Homo sapiens
tgcccacctcagcctcccaaag

SEQ ID NO: 5528844 - DNA, 18 bp, Homo sapiens
tgcccacctcggcctccc

SEQ ID NO: 5528845 - DNA, 12 bp, Homo sapiens
tgcccacctctc

SEQ ID NO: 5528846 - DNA, 14 bp, Homo sapiens
tgcccacctctccc

SEQ ID NO: 5528847 - DNA, 18 bp, Homo sapiens
tgcccacctctccctgca

SEQ ID NO: 5528848 - DNA, 21 bp, Homo sapiens
tgcccacctctccctgcatcc

SEQ ID NO: 5528849 - DNA, 12 bp, Homo sapiens
tgcccacctgcc

SEQ ID NO: 5528850 - DNA, 15 bp, Homo sapiens
tgcccacctgcccat

SEQ ID NO: 5528851 - DNA, 22 bp, Homo sapiens
tgcccacctgcctggccggcca

SEQ ID NO: 5528852 - DNA, 18 bp, Homo sapiens
tgcccacctggcctctgc

SEQ ID NO: 5528853 - DNA, 18 bp, Homo sapiens
tgcccacctggggtctct

SEQ ID NO: 5528854 - DNA, 11 bp, Homo sapiens
tgcccacctgt

SEQ ID NO: 5528855 - DNA, 20 bp, Homo sapiens
tgcccacgatcccctccccc

SEQ ID NO: 5528856 - DNA, 23 bp, Homo sapiens
tgcccacgatcccctcccccaag

SEQ ID NO: 5528857 - DNA, 16 bp, Homo sapiens
tgcccacgcagacctg

SEQ ID NO: 5528858 - DNA, 14 bp, Homo sapiens
tgcccacgcccctc

SEQ ID NO: 5528859 - DNA, 17 bp, Homo sapiens
tgcccacgcccctcccc

SEQ ID NO: 5528860 - DNA, 22 bp, Homo sapiens
tgcccacgcccctccccagccc

SEQ ID NO: 5528861 - DNA, 23 bp, Homo sapiens
tgcccacgcccttggagccttcc

SEQ ID NO: 5528862 - DNA, 19 bp, Homo sapiens
tgcccacggagtcgtgggg

SEQ ID NO: 5528863 - DNA, 14 bp, Homo sapiens
tgcccacggccacc

SEQ ID NO: 5528864 - DNA, 21 bp, Homo sapiens
tgcccacggccacccaccctt

SEQ ID NO: 5528865 - DNA, 21 bp, Homo sapiens
tgcccacggtctgagctagct

SEQ ID NO: 5528866 - DNA, 21 bp, Homo sapiens
tgcccacgtacccaggtctgg

SEQ ID NO: 5528867 - DNA, 18 bp, Homo sapiens
tgcccacgtgcagcacct

SEQ ID NO: 5528868 - DNA, 19 bp, Homo sapiens
tgcccacgtgcagcacctg

SEQ ID NO: 5528869 - DNA, 21 bp, Homo sapiens
tgcccacgtgcagcacctgtc

SEQ ID NO: 5528870 - DNA, 22 bp, Homo sapiens
tgcccacgtgcagcacctgtca

SEQ ID NO: 5528871 - DNA, 19 bp, Homo sapiens
tgcccactcccccaggagc

SEQ ID NO: 5528872 - DNA, 20 bp, Homo sapiens
tgcccactcccccaggagca

SEQ ID NO: 5528873 - DNA, 14 bp, Homo sapiens
tgcccactccctat

SEQ ID NO: 5528874 - DNA, 16 bp, Homo sapiens
tgcccactccctatct

SEQ ID NO: 5528875 - DNA, 20 bp, Homo sapiens
tgcccactccgccagccaca

SEQ ID NO: 5528876 - DNA, 22 bp, Homo sapiens
tgcccactccgccagccacagg

SEQ ID NO: 5528877 - DNA, 23 bp, Homo sapiens
tgcccactccgccagccacagga

SEQ ID NO: 5528878 - DNA, 14 bp, Homo sapiens
tgcccactctgggg

SEQ ID NO: 5528879 - DNA, 14 bp, Homo sapiens
tgcccactgccgat

SEQ ID NO: 5528880 - DNA, 21 bp, Homo sapiens
tgcccactgcctgcctcccct

SEQ ID NO: 5528881 - DNA, 13 bp, Homo sapiens
tgcccactgctgg

SEQ ID NO: 5528882 - DNA, 14 bp, Homo sapiens
tgcccactgctggt

SEQ ID NO: 5528883 - DNA, 21 bp, Homo sapiens
tgcccactggccgctgagcgc

SEQ ID NO: 5528884 - DNA, 12 bp, Homo sapiens
tgcccactgttt

SEQ ID NO: 5528885 - DNA, 23 bp, Homo sapiens
tgcccacttagccgtccatggca

SEQ ID NO: 5528886 - DNA, 14 bp, Homo sapiens
tgcccacttctcct

SEQ ID NO: 5528887 - DNA, 12 bp, Homo sapiens
tgcccacttctg

SEQ ID NO: 5528888 - DNA, 21 bp, Homo sapiens
tgcccacttctgtgtagacat

SEQ ID NO: 5528889 - DNA, 17 bp, Homo sapiens
tgcccagaacttccctg

SEQ ID NO: 5528890 - DNA, 19 bp, Homo sapiens
tgcccagaatactgatgga

SEQ ID NO: 5528891 - DNA, 17 bp, Homo sapiens
tgcccagaatgaggctg

SEQ ID NO: 5528892 - DNA, 16 bp, Homo sapiens
tgcccagaattcccag

SEQ ID NO: 5528893 - DNA, 21 bp, Homo sapiens
tgcccagaattcccagctgtc

SEQ ID NO: 5528894 - DNA, 19 bp, Homo sapiens
tgcccagacacatgggctt

SEQ ID NO: 5528895 - DNA, 21 bp, Homo sapiens
tgcccagacatcagcctcctt

SEQ ID NO: 5528896 - DNA, 22 bp, Homo sapiens
tgcccagacatttttttccctt

SEQ ID NO: 5528897 - DNA, 15 bp, Homo sapiens
tgcccagaccacacg

SEQ ID NO: 5528898 - DNA, 16 bp, Homo sapiens
tgcccagactgatgag

SEQ ID NO: 5528899 - DNA, 15 bp, Homo sapiens
tgcccagagacccag

SEQ ID NO: 5528900 - DNA, 16 bp, Homo sapiens
tgcccagagatgcctc

SEQ ID NO: 5528901 - DNA, 14 bp, Homo sapiens
tgcccagagctgct

SEQ ID NO: 5528902 - DNA, 20 bp, Homo sapiens
tgcccagagctgctggtctc

SEQ ID NO: 5528903 - DNA, 13 bp, Homo sapiens
tgcccagagctgg

SEQ ID NO: 5528904 - DNA, 19 bp, Homo sapiens
tgcccagagggcccaggca

SEQ ID NO: 5528905 - DNA, 21 bp, Homo sapiens
tgcccagagtatgggcactca

SEQ ID NO: 5528906 - DNA, 20 bp, Homo sapiens
tgcccagatcgttctgccac

SEQ ID NO: 5528907 - DNA, 15 bp, Homo sapiens
tgcccagattcccag

SEQ ID NO: 5528908 - DNA, 13 bp, Homo sapiens
tgcccagcacctc

SEQ ID NO: 5528909 - DNA, 17 bp, Homo sapiens
tgcccagcacctggagg

SEQ ID NO: 5528910 - DNA, 13 bp, Homo sapiens
tgcccagcaggcc

SEQ ID NO: 5528911 - DNA, 15 bp, Homo sapiens
tgcccagcaggccca

SEQ ID NO: 5528912 - DNA, 16 bp, Homo sapiens
tgcccagcaggcccag

SEQ ID NO: 5528913 - DNA, 17 bp, Homo sapiens
tgcccagcaggcccagc

SEQ ID NO: 5528914 - DNA, 19 bp, Homo sapiens
tgcccccttgcccatcagc

SEQ ID NO: 5528915 - DNA, 18 bp, Homo sapiens
tgccccctttcagatgtc

SEQ ID NO: 5528916 - DNA, 22 bp, Homo sapiens
tgccccctttcagatgtcttct

SEQ ID NO: 5528917 - DNA, 21 bp, Homo sapiens
tgccccctttgaccttcccca

SEQ ID NO: 5528918 - DNA, 16 bp, Homo sapiens
tgccccgactgtggga

SEQ ID NO: 5528919 - DNA, 15 bp, Homo sapiens
tgccccgccatggtc

SEQ ID NO: 5528920 - DNA, 16 bp, Homo sapiens
tgccccgccccccaga

SEQ ID NO: 5528921 - DNA, 19 bp, Homo sapiens
tgccccgccccccagagcc

SEQ ID NO: 5528922 - DNA, 20 bp, Homo sapiens
tgccccgccccccagagcca

SEQ ID NO: 5528923 - DNA, 21 bp, Homo sapiens
tgccccgccccccagagccag

SEQ ID NO: 5528924 - DNA, 23 bp, Homo sapiens
tgccccgccccccagagccaggg

SEQ ID NO: 5528925 - DNA, 17 bp, Homo sapiens
tgccccgccctccttcc

SEQ ID NO: 5528926 - DNA, 19 bp, Homo sapiens
tgccccgcctcccggggtg

SEQ ID NO: 5528927 - DNA, 19 bp, Homo sapiens
tgccccgcttccccacaga

SEQ ID NO: 5528928 - DNA, 23 bp, Homo sapiens
tgccccgcttccccacagaactg

SEQ ID NO: 5528929 - DNA, 13 bp, Homo sapiens
tgccccggagctg

SEQ ID NO: 5528930 - DNA, 17 bp, Homo sapiens
tgccccggccacctctg

SEQ ID NO: 5528931 - DNA, 16 bp, Homo sapiens
tgccccggccactctg

SEQ ID NO: 5528932 - DNA, 18 bp, Homo sapiens
tgccccggccactctgtt

SEQ ID NO: 5528933 - DNA, 21 bp, Homo sapiens
tgccccggccccggccccagc

SEQ ID NO: 5528934 - DNA, 23 bp, Homo sapiens
tgccccggccccggccccagcca

SEQ ID NO: 5528935 - DNA, 18 bp, Homo sapiens
tgccccggcttgcctgta

SEQ ID NO: 5528936 - DNA, 20 bp, Homo sapiens
tgccccgggtccccagctcc

SEQ ID NO: 5528937 - DNA, 21 bp, Homo sapiens
tgccccgggtccccagctccc

SEQ ID NO: 5528938 - DNA, 23 bp, Homo sapiens
tgccccgggtccccagctcccca

SEQ ID NO: 5528939 - DNA, 19 bp, Homo sapiens
tgccccgtcaccatctcag

SEQ ID NO: 5528940 - DNA, 15 bp, Homo sapiens
tgccccgtcccctgg

SEQ ID NO: 5528941 - DNA, 22 bp, Homo sapiens
tgccccgtcccctgggccaccc

SEQ ID NO: 5528942 - DNA, 21 bp, Homo sapiens
tgccccgtcggactgccccca

SEQ ID NO: 5528943 - DNA, 17 bp, Homo sapiens
tgccccgtctctgttcc

SEQ ID NO: 5528944 - DNA, 19 bp, Homo sapiens
tgccccgtgacacatgctc

SEQ ID NO: 5528945 - DNA, 18 bp, Homo sapiens
tgccccgtgcagactgga

SEQ ID NO: 5528946 - DNA, 16 bp, Homo sapiens
tgccccgtgtgaatgt

SEQ ID NO: 5528947 - DNA, 15 bp, Homo sapiens
tgccccgttgcttcc

SEQ ID NO: 5528948 - DNA, 20 bp, Homo sapiens
tgccccgtttttgagactga

SEQ ID NO: 5528949 - DNA, 13 bp, Homo sapiens
tgcccctaaagag

SEQ ID NO: 5528950 - DNA, 19 bp, Homo sapiens
tgcccctaaagagcatcct

SEQ ID NO: 5528951 - DNA, 21 bp, Homo sapiens
tgcccctaaagagcatcctga

SEQ ID NO: 5528952 - DNA, 20 bp, Homo sapiens
tgcccctaaagatgggagga

SEQ ID NO: 5528953 - DNA, 17 bp, Homo sapiens
tgcccctaatctctgta

SEQ ID NO: 5528954 - DNA, 17 bp, Homo sapiens
tgcccctaccctggact

SEQ ID NO: 5528955 - DNA, 16 bp, Homo sapiens
tgcccctagcttagag

SEQ ID NO: 5528956 - DNA, 20 bp, Homo sapiens
tgcccctaggatgctgcagc

SEQ ID NO: 5528957 - DNA, 21 bp, Homo sapiens
tgcccctagtaactgctgtcg

SEQ ID NO: 5528958 - DNA, 14 bp, Homo sapiens
tgcccctcaccttg

SEQ ID NO: 5528959 - DNA, 22 bp, Homo sapiens
tgcccctcaccttgggctgggg

SEQ ID NO: 5528960 - DNA, 14 bp, Homo sapiens
tgcccctcagagac

SEQ ID NO: 5528961 - DNA, 14 bp, Homo sapiens
tgcccctcaggggg

SEQ ID NO: 5528962 - DNA, 21 bp, Homo sapiens
tgcccctcagggggccagctg

SEQ ID NO: 5528963 - DNA, 23 bp, Homo sapiens
tgcccctcagggggccagctggg

SEQ ID NO: 5528964 - DNA, 13 bp, Homo sapiens
tgcccctccaagt

SEQ ID NO: 5528965 - DNA, 14 bp, Homo sapiens
tgcccctccaagtc

SEQ ID NO: 5528966 - DNA, 22 bp, Homo sapiens
tgcccctccaagtcacaaagag

SEQ ID NO: 5528967 - DNA, 18 bp, Homo sapiens
tgcccctccagagacagg

SEQ ID NO: 5528968 - DNA, 12 bp, Homo sapiens
tgcccctcccag

SEQ ID NO: 5528969 - DNA, 13 bp, Homo sapiens
tgcccctcccaga

SEQ ID NO: 5528970 - DNA, 13 bp, Homo sapiens
tgcccctcccatg

SEQ ID NO: 5528971 - DNA, 16 bp, Homo sapiens
tgcccctcccatggcc

SEQ ID NO: 5528972 - DNA, 12 bp, Homo sapiens
tgcccctccccc

SEQ ID NO: 5528973 - DNA, 21 bp, Homo sapiens
tgcccctcccccaacccccac

SEQ ID NO: 5528974 - DNA, 15 bp, Homo sapiens
tgcccctcccccact

SEQ ID NO: 5528975 - DNA, 18 bp, Homo sapiens
tgcccctcccccagctgc

SEQ ID NO: 5528976 - DNA, 17 bp, Homo sapiens
tgcccctccctagatcc

SEQ ID NO: 5528977 - DNA, 12 bp, Homo sapiens
tgcccctccctc

SEQ ID NO: 5528978 - DNA, 13 bp, Homo sapiens
tgcccctccctca

SEQ ID NO: 5528979 - DNA, 13 bp, Homo sapiens
tgcccctccctct

SEQ ID NO: 5528980 - DNA, 18 bp, Homo sapiens
tgcccctccctgcctcca

SEQ ID NO: 5528981 - DNA, 20 bp, Homo sapiens
tgcccctccgatgctgaggc

SEQ ID NO: 5528982 - DNA, 21 bp, Homo sapiens
tgcccctccgatgctgaggcc

SEQ ID NO: 5528983 - DNA, 19 bp, Homo sapiens
tgcccctccgtccccaggg

SEQ ID NO: 5528984 - DNA, 20 bp, Homo sapiens
tgcccctccgtccccagggt

SEQ ID NO: 5528985 - DNA, 18 bp, Homo sapiens
tgcccctcctctctgccc

SEQ ID NO: 5528986 - DNA, 13 bp, Homo sapiens
tgcccctcctgga

SEQ ID NO: 5528987 - DNA, 23 bp, Homo sapiens
tgcccctcctggagcagaaagtg

SEQ ID NO: 5528988 - DNA, 12 bp, Homo sapiens
tgcccctcgcac

SEQ ID NO: 5528989 - DNA, 19 bp, Homo sapiens
tgcccctcgcacacagggc

SEQ ID NO: 5528990 - DNA, 20 bp, Homo sapiens
tgcccctcgcacacagggct

SEQ ID NO: 5528991 - DNA, 20 bp, Homo sapiens
tgcccctcgccagcttctcc

SEQ ID NO: 5528992 - DNA, 15 bp, Homo sapiens
tgcccctctcaccaa

SEQ ID NO: 5528993 - DNA, 20 bp, Homo sapiens
tgcccctctccaggcgccgg

SEQ ID NO: 5528994 - DNA, 12 bp, Homo sapiens
tgcccctctctg

SEQ ID NO: 5528995 - DNA, 16 bp, Homo sapiens
tgcccctctctgggcc

SEQ ID NO: 5528996 - DNA, 22 bp, Homo sapiens
tgcccctcttccaaaggcagcg

SEQ ID NO: 5528997 - DNA, 17 bp, Homo sapiens
tgcccctcttcccggga

SEQ ID NO: 5528998 - DNA, 15 bp, Homo sapiens
tgcccctctttctct

SEQ ID NO: 5528999 - DNA, 13 bp, Homo sapiens
tgcccctgagttc

SEQ ID NO: 5529000 - DNA, 23 bp, Homo sapiens
tgcccctgatcactcccagcact

SEQ ID NO: 5529001 - DNA, 22 bp, Homo sapiens
tgcccctgatgcagcctgtggc

SEQ ID NO: 5529002 - DNA, 23 bp, Homo sapiens
tgcccctgatgcagcctgtggct

SEQ ID NO: 5529003 - DNA, 14 bp, Homo sapiens
tgcccctgcaaaga

SEQ ID NO: 5529004 - DNA, 20 bp, Homo sapiens
tgcccctgcacctgcttctc

SEQ ID NO: 5529005 - DNA, 11 bp, Homo sapiens
tgcccctgcag

SEQ ID NO: 5529006 - DNA, 15 bp, Homo sapiens
tgcccctgcagggga

SEQ ID NO: 5529007 - DNA, 21 bp, Homo sapiens
tgcccctgcagtttggccctg

SEQ ID NO: 5529008 - DNA, 22 bp, Homo sapiens
tgcccctgcagtttggccctgg

SEQ ID NO: 5529009 - DNA, 21 bp, Homo sapiens
tgcccctgccaaggccggaga

SEQ ID NO: 5529010 - DNA, 15 bp, Homo sapiens
tgcccctgcccgaga

SEQ ID NO: 5529011 - DNA, 21 bp, Homo sapiens
tgcccctgcccgagagctctt

SEQ ID NO: 5529012 - DNA, 15 bp, Homo sapiens
tgcccctgccctgag

SEQ ID NO: 5529013 - DNA, 16 bp, Homo sapiens
tgcccctgccctgagg

SEQ ID NO: 5529014 - DNA, 17 bp, Homo sapiens
tgcccctgccctgagga

SEQ ID NO: 5529015 - DNA, 16 bp, Homo sapiens
tgcccctgcctgacag

SEQ ID NO: 5529016 - DNA, 17 bp, Homo sapiens
tgcccctgcgtggcctg

SEQ ID NO: 5529017 - DNA, 18 bp, Homo sapiens
tgcccctgctcactgggc

SEQ ID NO: 5529018 - DNA, 19 bp, Homo sapiens
tgcccctgctcactgggcc

SEQ ID NO: 5529019 - DNA, 23 bp, Homo sapiens
tgcccctgctcactgggcccgag

SEQ ID NO: 5529020 - DNA, 16 bp, Homo sapiens
tgcccctgctccctct

SEQ ID NO: 5529021 - DNA, 13 bp, Homo sapiens
tgcccctgctctg

SEQ ID NO: 5529022 - DNA, 17 bp, Homo sapiens
tgcccctgctctgtagc

SEQ ID NO: 5529023 - DNA, 20 bp, Homo sapiens
tgcccctgctctgtagccac

SEQ ID NO: 5529024 - DNA, 13 bp, Homo sapiens
tgcccctgctgcc

SEQ ID NO: 5529025 - DNA, 17 bp, Homo sapiens
tgcccctgctgcctccc

SEQ ID NO: 5529026 - DNA, 23 bp, Homo sapiens
tgcccctgctgcctccccaaccc

SEQ ID NO: 5529027 - DNA, 13 bp, Homo sapiens
tgcccctggcaaa

SEQ ID NO: 5529028 - DNA, 14 bp, Homo sapiens
tgcccctggcaaat

SEQ ID NO: 5529029 - DNA, 16 bp, Homo sapiens
tgcccctggcacctgt

SEQ ID NO: 5529030 - DNA, 16 bp, Homo sapiens
tgcccctggcagcccc

SEQ ID NO: 5529031 - DNA, 12 bp, Homo sapiens
tgcccctggccc

SEQ ID NO: 5529032 - DNA, 15 bp, Homo sapiens
tgcccctggccctgc

SEQ ID NO: 5529033 - DNA, 14 bp, Homo sapiens
tgcccctggccttg

SEQ ID NO: 5529034 - DNA, 14 bp, Homo sapiens
tgcccctggctttg

SEQ ID NO: 5529035 - DNA, 17 bp, Homo sapiens
tgcccctggctttgcct

SEQ ID NO: 5529036 - DNA, 21 bp, Homo sapiens
tgcccctggctttgcctcttc

SEQ ID NO: 5529037 - DNA, 19 bp, Homo sapiens
tgcccctggtgccctgaga

SEQ ID NO: 5529038 - DNA, 17 bp, Homo sapiens
tgcccctgtcccacctg

SEQ ID NO: 5529039 - DNA, 23 bp, Homo sapiens
tgcccctgtcccacctggctccc

SEQ ID NO: 5529040 - DNA, 16 bp, Homo sapiens
tgcccctgtctggaag

SEQ ID NO: 5529041 - DNA, 17 bp, Homo sapiens
tgcccctgtgctgcggg

SEQ ID NO: 5529042 - DNA, 22 bp, Homo sapiens
tgcccctgtgctgcggggcctt

SEQ ID NO: 5529043 - DNA, 23 bp, Homo sapiens
tgccccttaagggttgaaggcag

SEQ ID NO: 5529044 - DNA, 16 bp, Homo sapiens
tgccccttccccatct

SEQ ID NO: 5529045 - DNA, 17 bp, Homo sapiens
tgccccttccccatctc

SEQ ID NO: 5529046 - DNA, 14 bp, Homo sapiens
tgccccttccctgg

SEQ ID NO: 5529047 - DNA, 20 bp, Homo sapiens
tgccccttccgccactgggg

SEQ ID NO: 5529048 - DNA, 15 bp, Homo sapiens
tgccccttctacact

SEQ ID NO: 5529049 - DNA, 16 bp, Homo sapiens
tgccccttctacactc

SEQ ID NO: 5529050 - DNA, 20 bp, Homo sapiens
tgccccttctacactctcct

SEQ ID NO: 5529051 - DNA, 23 bp, Homo sapiens
tgccccttctacactctcctggg

SEQ ID NO: 5529052 - DNA, 15 bp, Homo sapiens
tgccccttctgagga

SEQ ID NO: 5529053 - DNA, 15 bp, Homo sapiens
tgccccttcttgggc

SEQ ID NO: 5529054 - DNA, 18 bp, Homo sapiens
tgccccttgaccccacac

SEQ ID NO: 5529055 - DNA, 15 bp, Homo sapiens
tgccccttgcttctc

SEQ ID NO: 5529056 - DNA, 12 bp, Homo sapiens
tgccccttggct

SEQ ID NO: 5529057 - DNA, 12 bp, Homo sapiens
tgccccttgggc

SEQ ID NO: 5529058 - DNA, 18 bp, Homo sapiens
tgccccttgggcatccac

SEQ ID NO: 5529059 - DNA, 18 bp, Homo sapiens
tgccccttgggcctccca

SEQ ID NO: 5529060 - DNA, 20 bp, Homo sapiens
tgccccttgggcctcccact

SEQ ID NO: 5529061 - DNA, 18 bp, Homo sapiens
tgccccttgtcctctcag

SEQ ID NO: 5529062 - DNA, 19 bp, Homo sapiens
tgccccttgtcctctcaga

SEQ ID NO: 5529063 - DNA, 19 bp, Homo sapiens
tgcccctttataaatccaa

SEQ ID NO: 5529064 - DNA, 16 bp, Homo sapiens
tgcccctttcaggcct

SEQ ID NO: 5529065 - DNA, 17 bp, Homo sapiens
tgcccctttcaggccta

SEQ ID NO: 5529066 - DNA, 17 bp, Homo sapiens
tgcccctttccttcact

SEQ ID NO: 5529067 - DNA, 21 bp, Homo sapiens
tgcccctttccttcactgccc

SEQ ID NO: 5529068 - DNA, 18 bp, Homo sapiens
tgcccctttctcttttcc

SEQ ID NO: 5529069 - DNA, 21 bp, Homo sapiens
tgcccctttcttccccaccct

SEQ ID NO: 5529070 - DNA, 18 bp, Homo sapiens
tgcccgaaactaagccag

SEQ ID NO: 5529071 - DNA, 20 bp, Homo sapiens
tgcccgaaactaagccaggc

SEQ ID NO: 5529072 - DNA, 15 bp, Homo sapiens
tgcccgagagagctc

SEQ ID NO: 5529073 - DNA, 18 bp, Homo sapiens
tgcccgagagctcttagt

SEQ ID NO: 5529074 - DNA, 21 bp, Homo sapiens
tgcccgagagctcttagtttt

SEQ ID NO: 5529075 - DNA, 13 bp, Homo sapiens
tgcccgagctggt

SEQ ID NO: 5529076 - DNA, 20 bp, Homo sapiens
tgcccgagctggtgcattac

SEQ ID NO: 5529077 - DNA, 14 bp, Homo sapiens
tgcccgagggcagc

SEQ ID NO: 5529078 - DNA, 20 bp, Homo sapiens
tgcccgaggtcgctgcagcc

SEQ ID NO: 5529079 - DNA, 20 bp, Homo sapiens
tgcccgagtccgcccatccc

SEQ ID NO: 5529080 - DNA, 23 bp, Homo sapiens
tgcccgatccagattcccaggcc

SEQ ID NO: 5529081 - DNA, 22 bp, Homo sapiens
tgcccgcacaccctcactctgc

SEQ ID NO: 5529082 - DNA, 15 bp, Homo sapiens
tgcccgcacagcagc

SEQ ID NO: 5529083 - DNA, 19 bp, Homo sapiens
tgcccgcacagcagcctgc

SEQ ID NO: 5529084 - DNA, 20 bp, Homo sapiens
tgcccgcacagcagcctgct

SEQ ID NO: 5529085 - DNA, 17 bp, Homo sapiens
tgcccgcagacctctgg

SEQ ID NO: 5529086 - DNA, 16 bp, Homo sapiens
tgcccgcagagcccac

SEQ ID NO: 5529087 - DNA, 15 bp, Homo sapiens
tgcccgcatgtgtgc

SEQ ID NO: 5529088 - DNA, 18 bp, Homo sapiens
tgcccgcatgtgtgcctg

SEQ ID NO: 5529089 - DNA, 21 bp, Homo sapiens
tgcccgcatgtgtgcctggcc

SEQ ID NO: 5529090 - DNA, 13 bp, Homo sapiens
tgcccgccagcca

SEQ ID NO: 5529091 - DNA, 13 bp, Homo sapiens
tgcccgccagcct

SEQ ID NO: 5529092 - DNA, 22 bp, Homo sapiens
tgcccgccccaagccctgcccc

SEQ ID NO: 5529093 - DNA, 16 bp, Homo sapiens
tgcccgcccggggagt

SEQ ID NO: 5529094 - DNA, 18 bp, Homo sapiens
tgcccgccctccacccac

SEQ ID NO: 5529095 - DNA, 22 bp, Homo sapiens
tgcccgccctccacccactagg

SEQ ID NO: 5529096 - DNA, 17 bp, Homo sapiens
tgcccgccctccctcct

SEQ ID NO: 5529097 - DNA, 21 bp, Homo sapiens
tgcccgccctccctcctgcct

SEQ ID NO: 5529098 - DNA, 13 bp, Homo sapiens
tgcccgccctgcc

SEQ ID NO: 5529099 - DNA, 14 bp, Homo sapiens
tgcccgccctgccc

SEQ ID NO: 5529100 - DNA, 17 bp, Homo sapiens
tgcccgccctgcccctg

SEQ ID NO: 5529101 - DNA, 18 bp, Homo sapiens
tgcccgcctaggagttga

SEQ ID NO: 5529102 - DNA, 19 bp, Homo sapiens
tgcccgcctcggcctccca

SEQ ID NO: 5529103 - DNA, 14 bp, Homo sapiens
tgcccgcctgccca

SEQ ID NO: 5529104 - DNA, 15 bp, Homo sapiens
tgcccgcctgcccac

SEQ ID NO: 5529105 - DNA, 13 bp, Homo sapiens
tgcccgcctttca

SEQ ID NO: 5529106 - DNA, 19 bp, Homo sapiens
tgcccgcgcccgccgcctc

SEQ ID NO: 5529107 - DNA, 22 bp, Homo sapiens
tgcccgcgcccgccgcctccct

SEQ ID NO: 5529108 - DNA, 16 bp, Homo sapiens
tgcccgcgctctttct

SEQ ID NO: 5529109 - DNA, 21 bp, Homo sapiens
tgcccgcgggagacagcttct

SEQ ID NO: 5529110 - DNA, 22 bp, Homo sapiens
tgcccgcgggagacagcttctc

SEQ ID NO: 5529111 - DNA, 13 bp, Homo sapiens
tgcccgctcccaa

SEQ ID NO: 5529112 - DNA, 14 bp, Homo sapiens
tgcccgctcccaac

SEQ ID NO: 5529113 - DNA, 16 bp, Homo sapiens
tgcccgctcccaaccc

SEQ ID NO: 5529114 - DNA, 22 bp, Homo sapiens
tgcccgctgcaatgcctagact

SEQ ID NO: 5529115 - DNA, 15 bp, Homo sapiens
tgcccgctgcgctgc

SEQ ID NO: 5529116 - DNA, 20 bp, Homo sapiens
tgcccgctgcgctgccctgc

SEQ ID NO: 5529117 - DNA, 22 bp, Homo sapiens
tgcccgctgcgctgccctgcaa

SEQ ID NO: 5529118 - DNA, 19 bp, Homo sapiens
tgcccggaggccgggccct

SEQ ID NO: 5529119 - DNA, 17 bp, Homo sapiens
tgcccggcccaggagcg

SEQ ID NO: 5529120 - DNA, 15 bp, Homo sapiens
tgcccggcgccctct

SEQ ID NO: 5529121 - DNA, 18 bp, Homo sapiens
tgcccggcgcctgccctg

SEQ ID NO: 5529122 - DNA, 18 bp, Homo sapiens
tgcccgggagctcaggaa

SEQ ID NO: 5529123 - DNA, 19 bp, Homo sapiens
tgcccgggcgcggccagcc

SEQ ID NO: 5529124 - DNA, 22 bp, Homo sapiens
tgcccggggagctgcagagcag

SEQ ID NO: 5529125 - DNA, 18 bp, Homo sapiens
tgcccggggcagctgcca

SEQ ID NO: 5529126 - DNA, 14 bp, Homo sapiens
tgcccgggggacgc

SEQ ID NO: 5529127 - DNA, 21 bp, Homo sapiens
tgcccgggggacgcctgccct

SEQ ID NO: 5529128 - DNA, 21 bp, Homo sapiens
tgcccggtccccttcccaggg

SEQ ID NO: 5529129 - DNA, 17 bp, Homo sapiens
tgcccggtgcagggcct

SEQ ID NO: 5529130 - DNA, 21 bp, Homo sapiens
tgcccggtggtttgccatgtc

SEQ ID NO: 5529131 - DNA, 18 bp, Homo sapiens
tgcccggttgccatggag

SEQ ID NO: 5529132 - DNA, 23 bp, Homo sapiens
tgcccgtaaacacgcctgcaaac

SEQ ID NO: 5529133 - DNA, 18 bp, Homo sapiens
tgcccgtaatcccagcta

SEQ ID NO: 5529134 - DNA, 15 bp, Homo sapiens
tgcccgtcggccctg

SEQ ID NO: 5529135 - DNA, 18 bp, Homo sapiens
tgcccgtctctctcccat

SEQ ID NO: 5529136 - DNA, 17 bp, Homo sapiens
tgcccgtcttcagccta

SEQ ID NO: 5529137 - DNA, 20 bp, Homo sapiens
tgcccgtgaagcgtgttttt

SEQ ID NO: 5529138 - DNA, 16 bp, Homo sapiens
tgcccgtgaggagggg

SEQ ID NO: 5529139 - DNA, 15 bp, Homo sapiens
tgcccgtgcccgcag

SEQ ID NO: 5529140 - DNA, 15 bp, Homo sapiens
tgcccgtgcctctgt

SEQ ID NO: 5529141 - DNA, 17 bp, Homo sapiens
tgcccgtgcctctgtgc

SEQ ID NO: 5529142 - DNA, 19 bp, Homo sapiens
tgcccgtgtagtccccaac

SEQ ID NO: 5529143 - DNA, 17 bp, Homo sapiens
tgcccgtgtggcctggg

SEQ ID NO: 5529144 - DNA, 21 bp, Homo sapiens
tgcccgtgtggcctgggtcct

SEQ ID NO: 5529145 - DNA, 19 bp, Homo sapiens
tgcccgttttaccaataaa

SEQ ID NO: 5529146 - DNA, 13 bp, Homo sapiens
tgccctaaaccct

SEQ ID NO: 5529147 - DNA, 23 bp, Homo sapiens
tgccctaactgtacatttcacag

SEQ ID NO: 5529148 - DNA, 14 bp, Homo sapiens
tgccctaagccccc

SEQ ID NO: 5529149 - DNA, 16 bp, Homo sapiens
tgccctaagcccccag

SEQ ID NO: 5529150 - DNA, 13 bp, Homo sapiens
tgccctaagggac

SEQ ID NO: 5529151 - DNA, 22 bp, Homo sapiens
tgccctaagtgatttccacagg

SEQ ID NO: 5529152 - DNA, 15 bp, Homo sapiens
tgccctaataaaaag

SEQ ID NO: 5529153 - DNA, 20 bp, Homo sapiens
tgccctaatgcgcaggctgg

SEQ ID NO: 5529154 - DNA, 16 bp, Homo sapiens
tgccctaattcatctt

SEQ ID NO: 5529155 - DNA, 23 bp, Homo sapiens
tgccctaattcatcttttaatca

SEQ ID NO: 5529156 - DNA, 18 bp, Homo sapiens
tgccctacagaggtctct

SEQ ID NO: 5529157 - DNA, 19 bp, Homo sapiens
tgccctactcattggggtt

SEQ ID NO: 5529158 - DNA, 15 bp, Homo sapiens
tgccctactgggaga

SEQ ID NO: 5529159 - DNA, 23 bp, Homo sapiens
tgccctagagacggcaggatcat

SEQ ID NO: 5529160 - DNA, 17 bp, Homo sapiens
tgccctagagcacactg

SEQ ID NO: 5529161 - DNA, 16 bp, Homo sapiens
tgccctagcccagact

SEQ ID NO: 5529162 - DNA, 21 bp, Homo sapiens
tgccctagcccagactctgag

SEQ ID NO: 5529163 - DNA, 15 bp, Homo sapiens
tgccctagctgaccc

SEQ ID NO: 5529164 - DNA, 16 bp, Homo sapiens
tgccctagctgacccc

SEQ ID NO: 5529165 - DNA, 14 bp, Homo sapiens
tgccctagggctca

SEQ ID NO: 5529166 - DNA, 16 bp, Homo sapiens
tgccctagggctcaga

SEQ ID NO: 5529167 - DNA, 18 bp, Homo sapiens
tgccctagttttctttcc

SEQ ID NO: 5529168 - DNA, 22 bp, Homo sapiens
tgccctagttttctttcctcct

SEQ ID NO: 5529169 - DNA, 23 bp, Homo sapiens
tgccctagttttctttcctcctt

SEQ ID NO: 5529170 - DNA, 16 bp, Homo sapiens
tgccctataacccctg

SEQ ID NO: 5529171 - DNA, 19 bp, Homo sapiens
tgccctatatacctcacta

SEQ ID NO: 5529172 - DNA, 21 bp, Homo sapiens
tgccctatggatttgaagttt

SEQ ID NO: 5529173 - DNA, 15 bp, Homo sapiens
tgccctattataatt

SEQ ID NO: 5529174 - DNA, 21 bp, Homo sapiens
tgccctattataattgtcatg

SEQ ID NO: 5529175 - DNA, 15 bp, Homo sapiens
tgccctcaagtaaaa

SEQ ID NO: 5529176 - DNA, 18 bp, Homo sapiens
tgccctcaagtaaaagaa

SEQ ID NO: 5529177 - DNA, 12 bp, Homo sapiens
tgccctcacccc

SEQ ID NO: 5529178 - DNA, 15 bp, Homo sapiens
tgccctcactccact

SEQ ID NO: 5529179 - DNA, 19 bp, Homo sapiens
tgccctcactccactcccc

SEQ ID NO: 5529180 - DNA, 18 bp, Homo sapiens
tgccctcactccctctgc

SEQ ID NO: 5529181 - DNA, 19 bp, Homo sapiens
tgccctcactccctctgca

SEQ ID NO: 5529182 - DNA, 20 bp, Homo sapiens
tgccctcagatgaaaataaa

SEQ ID NO: 5529183 - DNA, 23 bp, Homo sapiens
tgccctcagatgaaaataaaata

SEQ ID NO: 5529184 - DNA, 11 bp, Homo sapiens
tgccctcagct

SEQ ID NO: 5529185 - DNA, 12 bp, Homo sapiens
tgccctcaggct

SEQ ID NO: 5529186 - DNA, 22 bp, Homo sapiens
tgccctcaggctccccagtgct

SEQ ID NO: 5529187 - DNA, 16 bp, Homo sapiens
tgccctcaggcttggg

SEQ ID NO: 5529188 - DNA, 22 bp, Homo sapiens
tgccctcatacccatgcacagt

SEQ ID NO: 5529189 - DNA, 23 bp, Homo sapiens
tgccctcatggcccctctgacct

SEQ ID NO: 5529190 - DNA, 18 bp, Homo sapiens
tgccctcattactgggcc

SEQ ID NO: 5529191 - DNA, 19 bp, Homo sapiens
tgccctcattactgggcct

SEQ ID NO: 5529192 - DNA, 14 bp, Homo sapiens
tgccctcatttgtg

SEQ ID NO: 5529193 - DNA, 18 bp, Homo sapiens
tgccctccaaagagcctt

SEQ ID NO: 5529194 - DNA, 19 bp, Homo sapiens
tgccctccaagaccttctc

SEQ ID NO: 5529195 - DNA, 20 bp, Homo sapiens
tgccctccaagaccttctcc

SEQ ID NO: 5529196 - DNA, 18 bp, Homo sapiens
tgccctccacagccgcag

SEQ ID NO: 5529197 - DNA, 14 bp, Homo sapiens
tgccctccactgcc

SEQ ID NO: 5529198 - DNA, 15 bp, Homo sapiens
tgccctccactgccc

SEQ ID NO: 5529199 - DNA, 16 bp, Homo sapiens
tgccctccactgccct

SEQ ID NO: 5529200 - DNA, 18 bp, Homo sapiens
tgccctccactgccctct

SEQ ID NO: 5529201 - DNA, 19 bp, Homo sapiens
tgccctccactgccctctg

SEQ ID NO: 5529202 - DNA, 19 bp, Homo sapiens
tgccctccagctctttcct

SEQ ID NO: 5529203 - DNA, 12 bp, Homo sapiens
tgccctccaggg

SEQ ID NO: 5529204 - DNA, 15 bp, Homo sapiens
tgccctccagggcca

SEQ ID NO: 5529205 - DNA, 17 bp, Homo sapiens
tgccctccagggccagg

SEQ ID NO: 5529206 - DNA, 12 bp, Homo sapiens
tgccctcccaag

SEQ ID NO: 5529207 - DNA, 20 bp, Homo sapiens
tgccctcccaagtcccaccc

SEQ ID NO: 5529208 - DNA, 22 bp, Homo sapiens
tgccctcccaagtcccaccctc

SEQ ID NO: 5529209 - DNA, 16 bp, Homo sapiens
tgccctcccacagcct

SEQ ID NO: 5529210 - DNA, 18 bp, Homo sapiens
tgccctcccacagcctcc

SEQ ID NO: 5529211 - DNA, 19 bp, Homo sapiens
tgccctcccacagcctcct

SEQ ID NO: 5529212 - DNA, 14 bp, Homo sapiens
tgccctcccacccc

SEQ ID NO: 5529213 - DNA, 15 bp, Homo sapiens
tgccctcccaccccc

SEQ ID NO: 5529214 - DNA, 15 bp, Homo sapiens
tgccctcccagaccc

SEQ ID NO: 5529215 - DNA, 17 bp, Homo sapiens
tgccctcccagaccccc

SEQ ID NO: 5529216 - DNA, 19 bp, Homo sapiens
tgccctcccagaccccctt

SEQ ID NO: 5529217 - DNA, 22 bp, Homo sapiens
tgccctcccaggaccctccact

SEQ ID NO: 5529218 - DNA, 15 bp, Homo sapiens
tgccctcccccacgg

SEQ ID NO: 5529219 - DNA, 22 bp, Homo sapiens
tgccctccccctcctctccacc

SEQ ID NO: 5529220 - DNA, 14 bp, Homo sapiens
tgccctcccctcag

SEQ ID NO: 5529221 - DNA, 14 bp, Homo sapiens
tgccctcccctctc

SEQ ID NO: 5529222 - DNA, 16 bp, Homo sapiens
tgccctcccctgtccc

SEQ ID NO: 5529223 - DNA, 21 bp, Homo sapiens
tgccctcccgcaccttcctcc

SEQ ID NO: 5529224 - DNA, 15 bp, Homo sapiens
tgccctccctgctgc

SEQ ID NO: 5529225 - DNA, 14 bp, Homo sapiens
tgccctccctgggg

SEQ ID NO: 5529226 - DNA, 20 bp, Homo sapiens
tgccctccctttctctctcc

SEQ ID NO: 5529227 - DNA, 16 bp, Homo sapiens
tgccctccgccccgtc

SEQ ID NO: 5529228 - DNA, 19 bp, Homo sapiens
tgccctccgtcctggcagg

SEQ ID NO: 5529229 - DNA, 22 bp, Homo sapiens
tgccctcctaaatgtcagctgt

SEQ ID NO: 5529230 - DNA, 12 bp, Homo sapiens
tgccctcctctc

SEQ ID NO: 5529231 - DNA, 14 bp, Homo sapiens
tgccctcctctccc

SEQ ID NO: 5529232 - DNA, 23 bp, Homo sapiens
tgccctcctgacccattgctgtt

SEQ ID NO: 5529233 - DNA, 18 bp, Homo sapiens
tgccctcctgagcctccg

SEQ ID NO: 5529234 - DNA, 11 bp, Homo sapiens
tgccctcctgc

SEQ ID NO: 5529235 - DNA, 13 bp, Homo sapiens
tgccctcctgcca

SEQ ID NO: 5529236 - DNA, 14 bp, Homo sapiens
tgccctcctgccaa

SEQ ID NO: 5529237 - DNA, 14 bp, Homo sapiens
tgccctcctgccca

SEQ ID NO: 5529238 - DNA, 12 bp, Homo sapiens
tgccctcctggg

SEQ ID NO: 5529239 - DNA, 20 bp, Homo sapiens
tgccctcctgggccctgggc

SEQ ID NO: 5529240 - DNA, 21 bp, Homo sapiens
tgccctcctgggccctgggct

SEQ ID NO: 5529241 - DNA, 16 bp, Homo sapiens
tgccctcgcctcctcc

SEQ ID NO: 5529242 - DNA, 17 bp, Homo sapiens
tgccctcgcctcctcct

SEQ ID NO: 5529243 - DNA, 14 bp, Homo sapiens
tgccctcgctgctt

SEQ ID NO: 5529244 - DNA, 12 bp, Homo sapiens
tgccctcggcca

SEQ ID NO: 5529245 - DNA, 17 bp, Homo sapiens
tgccctcgggtggggct

SEQ ID NO: 5529246 - DNA, 15 bp, Homo sapiens
tgccctcgtggccag

SEQ ID NO: 5529247 - DNA, 18 bp, Homo sapiens
tgccctcgtggccagccc

SEQ ID NO: 5529248 - DNA, 14 bp, Homo sapiens
tgccctctcaggcc

SEQ ID NO: 5529249 - DNA, 12 bp, Homo sapiens
tgccctctccca

SEQ ID NO: 5529250 - DNA, 16 bp, Homo sapiens
tgccctctcccaccct

SEQ ID NO: 5529251 - DNA, 17 bp, Homo sapiens
tgccctctcccaccctc

SEQ ID NO: 5529252 - DNA, 16 bp, Homo sapiens
tgccctctcctgggca

SEQ ID NO: 5529253 - DNA, 17 bp, Homo sapiens
tgccctctcctgggcag

SEQ ID NO: 5529254 - DNA, 15 bp, Homo sapiens
tgccctctccttcct

SEQ ID NO: 5529255 - DNA, 17 bp, Homo sapiens
tgccctctccttcctta

SEQ ID NO: 5529256 - DNA, 14 bp, Homo sapiens
tgccctctctcggg

SEQ ID NO: 5529257 - DNA, 18 bp, Homo sapiens
tgccctctctgagtctgg

SEQ ID NO: 5529258 - DNA, 17 bp, Homo sapiens
tgccctctgctctgcct

SEQ ID NO: 5529259 - DNA, 18 bp, Homo sapiens
tgccctctgctctgcctg

SEQ ID NO: 5529260 - DNA, 19 bp, Homo sapiens
tgccctctgctgctgcccg

SEQ ID NO: 5529261 - DNA, 17 bp, Homo sapiens
tgccctctggacagctt

SEQ ID NO: 5529262 - DNA, 17 bp, Homo sapiens
tgccctctggattctct

SEQ ID NO: 5529263 - DNA, 12 bp, Homo sapiens
tgccctctgggc

SEQ ID NO: 5529264 - DNA, 13 bp, Homo sapiens
tgccctctgggct

SEQ ID NO: 5529265 - DNA, 17 bp, Homo sapiens
tgccctctgggctctga

SEQ ID NO: 5529266 - DNA, 13 bp, Homo sapiens
tgccctctgggtc

SEQ ID NO: 5529267 - DNA, 11 bp, Homo sapiens
tgccctctgtt

SEQ ID NO: 5529268 - DNA, 18 bp, Homo sapiens
tgccctcttaagatctga

SEQ ID NO: 5529269 - DNA, 16 bp, Homo sapiens
tgcctctgcctgcatt

SEQ ID NO: 5529270 - DNA, 14 bp, Homo sapiens
tgcctctgcctgtc

SEQ ID NO: 5529271 - DNA, 22 bp, Homo sapiens
tgcctctgccttagaggagccc

SEQ ID NO: 5529272 - DNA, 21 bp, Homo sapiens
tgcctctgccttgatggagaa

SEQ ID NO: 5529273 - DNA, 19 bp, Homo sapiens
tgcctctgcggggcagggc

SEQ ID NO: 5529274 - DNA, 11 bp, Homo sapiens
tgcctctgctc

SEQ ID NO: 5529275 - DNA, 16 bp, Homo sapiens
tgcctctgctccctct

SEQ ID NO: 5529276 - DNA, 17 bp, Homo sapiens
tgcctctggaggcctct

SEQ ID NO: 5529277 - DNA, 21 bp, Homo sapiens
tgcctctggaggcctctggcc

SEQ ID NO: 5529278 - DNA, 20 bp, Homo sapiens
tgcctctggctctacacata

SEQ ID NO: 5529279 - DNA, 13 bp, Homo sapiens
tgcctctgggact

SEQ ID NO: 5529280 - DNA, 17 bp, Homo sapiens
tgcctctgggcagcctg

SEQ ID NO: 5529281 - DNA, 19 bp, Homo sapiens
tgcctctgggcagcctgct

SEQ ID NO: 5529282 - DNA, 12 bp, Homo sapiens
tgcctctgggtg

SEQ ID NO: 5529283 - DNA, 22 bp, Homo sapiens
tgcctctgggtgagtggctgac

SEQ ID NO: 5529284 - DNA, 20 bp, Homo sapiens
tgcctctgtccccttctctc

SEQ ID NO: 5529285 - DNA, 19 bp, Homo sapiens
tgcctctgtcctcccatcc

SEQ ID NO: 5529286 - DNA, 18 bp, Homo sapiens
tgcctctgtcttctggac

SEQ ID NO: 5529287 - DNA, 12 bp, Homo sapiens
tgcctctgtgca

SEQ ID NO: 5529288 - DNA, 16 bp, Homo sapiens
tgcctctgtgctgtgt

SEQ ID NO: 5529289 - DNA, 17 bp, Homo sapiens
tgcctctgtgctgtgtg

SEQ ID NO: 5529290 - DNA, 13 bp, Homo sapiens
tgcctctgtggaa

SEQ ID NO: 5529291 - DNA, 22 bp, Homo sapiens
tgcctctgtgtagccgccctga

SEQ ID NO: 5529292 - DNA, 22 bp, Homo sapiens
tgcctcttatcaagtgttacag

SEQ ID NO: 5529293 - DNA, 20 bp, Homo sapiens
tgcctcttctacctcttcca

SEQ ID NO: 5529294 - DNA, 23 bp, Homo sapiens
tgcctcttctcttgacagtctga

SEQ ID NO: 5529295 - DNA, 13 bp, Homo sapiens
tgcctcttctggg

SEQ ID NO: 5529296 - DNA, 16 bp, Homo sapiens
tgcctcttctgtgggt

SEQ ID NO: 5529297 - DNA, 17 bp, Homo sapiens
tgcctcttgcagggtct

SEQ ID NO: 5529298 - DNA, 18 bp, Homo sapiens
tgcctcttggcttctcag

SEQ ID NO: 5529299 - DNA, 24 bp, Homo sapiens
tgcctcttggcttctcagcccctt

SEQ ID NO: 5529300 - DNA, 17 bp, Homo sapiens
tgcctcttgttgcagag

SEQ ID NO: 5529301 - DNA, 16 bp, Homo sapiens
tgcctcttgtttctgt

SEQ ID NO: 5529302 - DNA, 17 bp, Homo sapiens
tgcctctttaaattatg

SEQ ID NO: 5529303 - DNA, 16 bp, Homo sapiens
tgcctctttcatccac

SEQ ID NO: 5529304 - DNA, 11 bp, Homo sapiens
tgcctctttcc

SEQ ID NO: 5529305 - DNA, 18 bp, Homo sapiens
tgcctctttcctcctcat

SEQ ID NO: 5529306 - DNA, 21 bp, Homo sapiens
tgcctctttcctcctcatgaa

SEQ ID NO: 5529307 - DNA, 13 bp, Homo sapiens
tgcctctttgaag

SEQ ID NO: 5529308 - DNA, 19 bp, Homo sapiens
tgcctcttttacctgctgc

SEQ ID NO: 5529309 - DNA, 20 bp, Homo sapiens
tgcctgaaacccatttactt

SEQ ID NO: 5529310 - DNA, 18 bp, Homo sapiens
tgcctgaaagctgggagc

SEQ ID NO: 5529311 - DNA, 22 bp, Homo sapiens
tgcctgaacatccttccttccc

SEQ ID NO: 5529312 - DNA, 14 bp, Homo sapiens
tgcctgaactccag

SEQ ID NO: 5529313 - DNA, 12 bp, Homo sapiens
tgcctgaagaaa

SEQ ID NO: 5529314 - DNA, 13 bp, Homo sapiens
tgcctgaagaaca

SEQ ID NO: 5529315 - DNA, 19 bp, Homo sapiens
tgcctgaagttggagtgag

SEQ ID NO: 5529316 - DNA, 12 bp, Homo sapiens
tgcctgaataaa

SEQ ID NO: 5529317 - DNA, 20 bp, Homo sapiens
tgcctgaatccacctgcagt

SEQ ID NO: 5529318 - DNA, 14 bp, Homo sapiens
tgcctgacaaggcc

SEQ ID NO: 5529319 - DNA, 20 bp, Homo sapiens
tgcctgacaaggccagcacc

SEQ ID NO: 5529320 - DNA, 17 bp, Homo sapiens
tgcctgacacaggggac

SEQ ID NO: 5529321 - DNA, 17 bp, Homo sapiens
tgcctgacactgagccc

SEQ ID NO: 5529322 - DNA, 17 bp, Homo sapiens
tgcctgacagcatcctc

SEQ ID NO: 5529323 - DNA, 15 bp, Homo sapiens
tgcctgacagccttc

SEQ ID NO: 5529324 - DNA, 16 bp, Homo sapiens
tgcctgactaattttt

SEQ ID NO: 5529325 - DNA, 21 bp, Homo sapiens
tgcctgactagggagccatgt

SEQ ID NO: 5529326 - DNA, 14 bp, Homo sapiens
tgcctgagaagaag

SEQ ID NO: 5529327 - DNA, 23 bp, Homo sapiens
tgcctgagaagaagtggctgcca

SEQ ID NO: 5529328 - DNA, 17 bp, Homo sapiens
tgcctgagaatgcctag

SEQ ID NO: 5529329 - DNA, 21 bp, Homo sapiens
tgcctgagaatgcctaggcca

SEQ ID NO: 5529330 - DNA, 18 bp, Homo sapiens
tgcctgagaatgttacca

SEQ ID NO: 5529331 - DNA, 17 bp, Homo sapiens
tgcctgagaccagggtg

SEQ ID NO: 5529332 - DNA, 20 bp, Homo sapiens
tgcctgagaccagggtggcc

SEQ ID NO: 5529333 - DNA, 22 bp, Homo sapiens
tgcctgagaccagggtggccac

SEQ ID NO: 5529334 - DNA, 14 bp, Homo sapiens
tgcctgagaggcag

SEQ ID NO: 5529335 - DNA, 18 bp, Homo sapiens
tgcctgagcacctcccag

SEQ ID NO: 5529336 - DNA, 19 bp, Homo sapiens
tgcctgagcacctcccagc

SEQ ID NO: 5529337 - DNA, 18 bp, Homo sapiens
tgcctgagcccaggagct

SEQ ID NO: 5529338 - DNA, 15 bp, Homo sapiens
tgcctgagccccctg

SEQ ID NO: 5529339 - DNA, 16 bp, Homo sapiens
tgcctgagcccctcag

SEQ ID NO: 5529340 - DNA, 16 bp, Homo sapiens
tgcctgagctggggaa

SEQ ID NO: 5529341 - DNA, 13 bp, Homo sapiens
tgcctgaggagga

SEQ ID NO: 5529342 - DNA, 21 bp, Homo sapiens
tgcctgaggaggaggacacag

SEQ ID NO: 5529343 - DNA, 21 bp, Homo sapiens
tgcctgaggctggctgggggc

SEQ ID NO: 5529344 - DNA, 18 bp, Homo sapiens
tgcctgaggggcagcctg

SEQ ID NO: 5529345 - DNA, 22 bp, Homo sapiens
tgcctgaggggcagcctgcctt

SEQ ID NO: 5529346 - DNA, 11 bp, Homo sapiens
tgcctgagggt

SEQ ID NO: 5529347 - DNA, 19 bp, Homo sapiens
tgcctgagggtgggctttt

SEQ ID NO: 5529348 - DNA, 15 bp, Homo sapiens
tgcctgagtttccag

SEQ ID NO: 5529349 - DNA, 17 bp, Homo sapiens
tgcctgatccctgaacc

SEQ ID NO: 5529350 - DNA, 15 bp, Homo sapiens
tgcctgatggacctg

SEQ ID NO: 5529351 - DNA, 15 bp, Homo sapiens
tgcctgatgggagta

SEQ ID NO: 5529352 - DNA, 18 bp, Homo sapiens
tgcctgatgggagtaggc

SEQ ID NO: 5529353 - DNA, 21 bp, Homo sapiens
tgcctgatgggagtaggctcc

SEQ ID NO: 5529354 - DNA, 22 bp, Homo sapiens
tgcctgatgggagtaggctcca

SEQ ID NO: 5529355 - DNA, 19 bp, Homo sapiens
tgcctgattcggacggcca

SEQ ID NO: 5529356 - DNA, 20 bp, Homo sapiens
tgcctgattcggacggccaa

SEQ ID NO: 5529357 - DNA, 19 bp, Homo sapiens
tgcctgattcggctgtctc

SEQ ID NO: 5529358 - DNA, 20 bp, Homo sapiens
tgcctgattcggctgtctca

SEQ ID NO: 5529359 - DNA, 20 bp, Homo sapiens
tgcctgattgccaagctcag

SEQ ID NO: 5529360 - DNA, 16 bp, Homo sapiens
tgcctgatttcattcc

SEQ ID NO: 5529361 - DNA, 16 bp, Homo sapiens
tgcctgcaagagaatc

SEQ ID NO: 5529362 - DNA, 18 bp, Homo sapiens
tgcctgcaagagaatctg

SEQ ID NO: 5529363 - DNA, 19 bp, Homo sapiens
tgcctgcacaaactcacca

SEQ ID NO: 5529364 - DNA, 14 bp, Homo sapiens
tgcctgcacacaga

SEQ ID NO: 5529365 - DNA, 17 bp, Homo sapiens
tgcctgcaccaggagac

SEQ ID NO: 5529366 - DNA, 18 bp, Homo sapiens
tgcctgcaccaggagaca

SEQ ID NO: 5529367 - DNA, 20 bp, Homo sapiens
tgcctgcaccaggagacaga

SEQ ID NO: 5529368 - DNA, 18 bp, Homo sapiens
tgcctgcacccttccctc

SEQ ID NO: 5529369 - DNA, 21 bp, Homo sapiens
tgcctgcacccttccctcttc

SEQ ID NO: 5529370 - DNA, 13 bp, Homo sapiens
tgcctgcacctcc

SEQ ID NO: 5529371 - DNA, 16 bp, Homo sapiens
tgcctgcactccctgg

SEQ ID NO: 5529372 - DNA, 17 bp, Homo sapiens
tgcctgcactccctggc

SEQ ID NO: 5529373 - DNA, 18 bp, Homo sapiens
tgcctgcactgggaagga

SEQ ID NO: 5529374 - DNA, 20 bp, Homo sapiens
tgcctgcactgggaaggaaa

SEQ ID NO: 5529375 - DNA, 14 bp, Homo sapiens
tgcctgcagagaga

SEQ ID NO: 5529376 - DNA, 21 bp, Homo sapiens
tgcctgcagaggtctgtgctg

SEQ ID NO: 5529377 - DNA, 15 bp, Homo sapiens
tgcctgcagcacatg

SEQ ID NO: 5529378 - DNA, 14 bp, Homo sapiens
tgcctgcagcatct

SEQ ID NO: 5529379 - DNA, 18 bp, Homo sapiens
tgcctgcagcatctacta

SEQ ID NO: 5529380 - DNA, 11 bp, Homo sapiens
tgcctgcagcc

SEQ ID NO: 5529381 - DNA, 13 bp, Homo sapiens
tgcctgcagccag

SEQ ID NO: 5529382 - DNA, 16 bp, Homo sapiens
tgcctgcagccagggc

SEQ ID NO: 5529383 - DNA, 19 bp, Homo sapiens
tgcctgcagccagggctgg

SEQ ID NO: 5529384 - DNA, 20 bp, Homo sapiens
tgcctgcagccagggctggg

SEQ ID NO: 5529385 - DNA, 15 bp, Homo sapiens
tgcctgcagccccgc

SEQ ID NO: 5529386 - DNA, 22 bp, Homo sapiens
tgcctgcagccccgcgcctcct

SEQ ID NO: 5529387 - DNA, 15 bp, Homo sapiens
tgcctgcagcctccc

SEQ ID NO: 5529388 - DNA, 16 bp, Homo sapiens
tgcctgcagcctcccc

SEQ ID NO: 5529389 - DNA, 14 bp, Homo sapiens
tgcctgcagcgcct

SEQ ID NO: 5529390 - DNA, 17 bp, Homo sapiens
tgcctgcagcgcctccc

SEQ ID NO: 5529391 - DNA, 16 bp, Homo sapiens
tgcctgcagctgagat

SEQ ID NO: 5529392 - DNA, 12 bp, Homo sapiens
tgcctgcagggc

SEQ ID NO: 5529393 - DNA, 14 bp, Homo sapiens
tgcctgcagggcca

SEQ ID NO: 5529394 - DNA, 17 bp, Homo sapiens
tgcctgcagggccatgg

SEQ ID NO: 5529395 - DNA, 22 bp, Homo sapiens
tgcctgcaggtcagttgtaata

SEQ ID NO: 5529396 - DNA, 23 bp, Homo sapiens
tgcctgcaggtcagttgtaataa

SEQ ID NO: 5529397 - DNA, 12 bp, Homo sapiens
tgcctgcagttt

SEQ ID NO: 5529398 - DNA, 16 bp, Homo sapiens
tgcctgcagtttcttg

SEQ ID NO: 5529399 - DNA, 22 bp, Homo sapiens
tgcctgcagtttcttgtgtaga

SEQ ID NO: 5529400 - DNA, 18 bp, Homo sapiens
tgcctgcatgagctggca

SEQ ID NO: 5529401 - DNA, 16 bp, Homo sapiens
tgcctgcatgctgaaa

SEQ ID NO: 5529402 - DNA, 17 bp, Homo sapiens
tgcctgccaaagtagtc

SEQ ID NO: 5529403 - DNA, 22 bp, Homo sapiens
tgcctgccaaagtagtcctggc

SEQ ID NO: 5529404 - DNA, 14 bp, Homo sapiens
tgcctgccactctc

SEQ ID NO: 5529405 - DNA, 18 bp, Homo sapiens
tgcctgccactctctggg

SEQ ID NO: 5529406 - DNA, 20 bp, Homo sapiens
tgcctgccactctctgggac

SEQ ID NO: 5529407 - DNA, 21 bp, Homo sapiens
tgcctgccactctctgggact

SEQ ID NO: 5529408 - DNA, 13 bp, Homo sapiens
tgcctgccactgt

SEQ ID NO: 5529409 - DNA, 19 bp, Homo sapiens
tgcctgccagctgcactga

SEQ ID NO: 5529410 - DNA, 17 bp, Homo sapiens
tgcctgccatactgcgc

SEQ ID NO: 5529411 - DNA, 17 bp, Homo sapiens
tgcctgccatagccagg

SEQ ID NO: 5529412 - DNA, 20 bp, Homo sapiens
tgcctgccatagccaggagc

SEQ ID NO: 5529413 - DNA, 15 bp, Homo sapiens
tgcctgccatggctg

SEQ ID NO: 5529414 - DNA, 18 bp, Homo sapiens
tgcctgccatgggccagc

SEQ ID NO: 5529415 - DNA, 12 bp, Homo sapiens
tgcctgccatgt

SEQ ID NO: 5529416 - DNA, 21 bp, Homo sapiens
tgcctgccatgtacctcccct

SEQ ID NO: 5529417 - DNA, 23 bp, Homo sapiens
tgcctgccatgtacctcccctgc

SEQ ID NO: 5529418 - DNA, 16 bp, Homo sapiens
tgcctgccatgtgtga

SEQ ID NO: 5529419 - DNA, 22 bp, Homo sapiens
tgcctgccatgtgtgagtcact

SEQ ID NO: 5529420 - DNA, 14 bp, Homo sapiens
tgcctgcccacccg

SEQ ID NO: 5529421 - DNA, 18 bp, Homo sapiens
tgcctgcccaggcccctg

SEQ ID NO: 5529422 - DNA, 22 bp, Homo sapiens
tgcctgcccaggcccctgccac

SEQ ID NO: 5529423 - DNA, 15 bp, Homo sapiens
tgcctgccccacacg

SEQ ID NO: 5529424 - DNA, 12 bp, Homo sapiens
tgcctgccccca

SEQ ID NO: 5529425 - DNA, 13 bp, Homo sapiens
tgcctgcccccac

SEQ ID NO: 5529426 - DNA, 19 bp, Homo sapiens
tgcctgcccccacacccac

SEQ ID NO: 5529427 - DNA, 18 bp, Homo sapiens
tgcctgcccccctcatct

SEQ ID NO: 5529428 - DNA, 11 bp, Homo sapiens
tgcctgcccct

SEQ ID NO: 5529429 - DNA, 22 bp, Homo sapiens
tgcctgcccctaccctggactt

SEQ ID NO: 5529430 - DNA, 16 bp, Homo sapiens
tgcctgcccctgctgc

SEQ ID NO: 5529431 - DNA, 18 bp, Homo sapiens
tgcctgcccgcacagcag

SEQ ID NO: 5529432 - DNA, 20 bp, Homo sapiens
tgcctgcccgcaccctggcc

SEQ ID NO: 5529433 - DNA, 16 bp, Homo sapiens
tgcctgccctctgtct

SEQ ID NO: 5529434 - DNA, 13 bp, Homo sapiens
tgcctgccctgcc

SEQ ID NO: 5529435 - DNA, 14 bp, Homo sapiens
tgcctgccctggag

SEQ ID NO: 5529436 - DNA, 13 bp, Homo sapiens
tgcctgccctggt

SEQ ID NO: 5529437 - DNA, 16 bp, Homo sapiens
tgcctgccgcccaaag

SEQ ID NO: 5529438 - DNA, 16 bp, Homo sapiens
tgcctgccgctgcacc

SEQ ID NO: 5529439 - DNA, 20 bp, Homo sapiens
tgcctgccggccgcccagac

SEQ ID NO: 5529440 - DNA, 14 bp, Homo sapiens
tgcctgcctcccct

SEQ ID NO: 5529441 - DNA, 14 bp, Homo sapiens
tgcctgcctccggc

SEQ ID NO: 5529442 - DNA, 23 bp, Homo sapiens
tgcctgcctccggccctgcccca

SEQ ID NO: 5529443 - DNA, 12 bp, Homo sapiens
tgcctgcctcct

SEQ ID NO: 5529444 - DNA, 23 bp, Homo sapiens
tgcctgcctctgccatgcccaga

SEQ ID NO: 5529445 - DNA, 17 bp, Homo sapiens
tgcctgcctgcctgtgg

SEQ ID NO: 5529446 - DNA, 13 bp, Homo sapiens
tgcctgcctgctc

SEQ ID NO: 5529447 - DNA, 22 bp, Homo sapiens
tgcgaaacaacttgtgttctat

SEQ ID NO: 5529448 - DNA, 18 bp, Homo sapiens
tgcgaaacaggtctgttt

SEQ ID NO: 5529449 - DNA, 19 bp, Homo sapiens
tgcgaaaggatgaaagtga

SEQ ID NO: 5529450 - DNA, 22 bp, Homo sapiens
tgcgaaatgttctcatgaacta

SEQ ID NO: 5529451 - DNA, 19 bp, Homo sapiens
tgcgaactagagatgtgca

SEQ ID NO: 5529452 - DNA, 18 bp, Homo sapiens
tgcgaaggggccctggtc

SEQ ID NO: 5529453 - DNA, 21 bp, Homo sapiens
tgcgaaggggccctggtcctt

SEQ ID NO: 5529454 - DNA, 23 bp, Homo sapiens
tgcgaatggggcgatcaagtcca

SEQ ID NO: 5529455 - DNA, 14 bp, Homo sapiens
tgcgaccaccactt

SEQ ID NO: 5529456 - DNA, 16 bp, Homo sapiens
tgcgaccagaggtggg

SEQ ID NO: 5529457 - DNA, 20 bp, Homo sapiens
tgcgaccagaggtgggaggc

SEQ ID NO: 5529458 - DNA, 14 bp, Homo sapiens
tgcgaccatgtgta

SEQ ID NO: 5529459 - DNA, 16 bp, Homo sapiens
tgcgaccatgtgtaga

SEQ ID NO: 5529460 - DNA, 14 bp, Homo sapiens
tgcgaccccccacc

SEQ ID NO: 5529461 - DNA, 13 bp, Homo sapiens
tgcgaccctgggg

SEQ ID NO: 5529462 - DNA, 15 bp, Homo sapiens
tgcgactttctgcct

SEQ ID NO: 5529463 - DNA, 12 bp, Homo sapiens
tgcgagacccaa

SEQ ID NO: 5529464 - DNA, 15 bp, Homo sapiens
tgcgagactctgatg

SEQ ID NO: 5529465 - DNA, 22 bp, Homo sapiens
tgcgagagaggtgggcagcagc

SEQ ID NO: 5529466 - DNA, 24 bp, Homo sapiens
tgcgagagaggtgggcagcagctc

SEQ ID NO: 5529467 - DNA, 14 bp, Homo sapiens
tgcgagagatgtgt

SEQ ID NO: 5529468 - DNA, 23 bp, Homo sapiens
tgcgagagatgtgtgttgatact

SEQ ID NO: 5529469 - DNA, 18 bp, Homo sapiens
tgcgagatcgctggcaga

SEQ ID NO: 5529470 - DNA, 22 bp, Homo sapiens
tgcgagatcgctggcagagaag

SEQ ID NO: 5529471 - DNA, 13 bp, Homo sapiens
tgcgagcaacagt

SEQ ID NO: 5529472 - DNA, 15 bp, Homo sapiens
tgcgagcatttccct

SEQ ID NO: 5529473 - DNA, 22 bp, Homo sapiens
tgcgagcatttccctcccggga

SEQ ID NO: 5529474 - DNA, 14 bp, Homo sapiens
tgcgagcttggcct

SEQ ID NO: 5529475 - DNA, 15 bp, Homo sapiens
tgcgagcttggcctt

SEQ ID NO: 5529476 - DNA, 19 bp, Homo sapiens
tgcgagcttggccttgggc

SEQ ID NO: 5529477 - DNA, 21 bp, Homo sapiens
tgcgagcttggccttgggccg

SEQ ID NO: 5529478 - DNA, 15 bp, Homo sapiens
tgcgaggacatcaaa

SEQ ID NO: 5529479 - DNA, 23 bp, Homo sapiens
tgcgaggaccactttggagactg

SEQ ID NO: 5529480 - DNA, 21 bp, Homo sapiens
tgcgaggggccagcagagggc

SEQ ID NO: 5529481 - DNA, 19 bp, Homo sapiens
tgcgaggttgttttaaagt

SEQ ID NO: 5529482 - DNA, 22 bp, Homo sapiens
tgcgagtatgtgtttgtgtgtg

SEQ ID NO: 5529483 - DNA, 15 bp, Homo sapiens
tgcgatcatggctca

SEQ ID NO: 5529484 - DNA, 15 bp, Homo sapiens
tgcgatctgggttca

SEQ ID NO: 5529485 - DNA, 17 bp, Homo sapiens
tgcgatcttcagagcag

SEQ ID NO: 5529486 - DNA, 12 bp, Homo sapiens
tgcgatgtgttt

SEQ ID NO: 5529487 - DNA, 22 bp, Homo sapiens
tgcgatttcacagttggcactt

SEQ ID NO: 5529488 - DNA, 16 bp, Homo sapiens
tgcgattttattactg

SEQ ID NO: 5529489 - DNA, 21 bp, Homo sapiens
tgcgcaaagagtgtgctcggg

SEQ ID NO: 5529490 - DNA, 21 bp, Homo sapiens
tgcgcaaatacaaaatgattg

SEQ ID NO: 5529491 - DNA, 18 bp, Homo sapiens
tgcgcaacaacaaggacc

SEQ ID NO: 5529492 - DNA, 13 bp, Homo sapiens
tgcgcaactgatc

SEQ ID NO: 5529493 - DNA, 21 bp, Homo sapiens
tgcgcaagtgcctgggattct

SEQ ID NO: 5529494 - DNA, 19 bp, Homo sapiens
tgcgcacaccgccagcagc

SEQ ID NO: 5529495 - DNA, 20 bp, Homo sapiens
tgcgcacagagggaagccat

SEQ ID NO: 5529496 - DNA, 17 bp, Homo sapiens
tgcgcacagccccagct

SEQ ID NO: 5529497 - DNA, 18 bp, Homo sapiens
tgcgcaccaatgcccagc

SEQ ID NO: 5529498 - DNA, 20 bp, Homo sapiens
tgcgcaccccgttcccagcg

SEQ ID NO: 5529499 - DNA, 23 bp, Homo sapiens
tgcgcaccccgttcccagcgcat

SEQ ID NO: 5529500 - DNA, 21 bp, Homo sapiens
tgcgcactgagtacaaatgtg

SEQ ID NO: 5529501 - DNA, 17 bp, Homo sapiens
tgcgcacttacctgctt

SEQ ID NO: 5529502 - DNA, 19 bp, Homo sapiens
tgcgcacttacctgcttga

SEQ ID NO: 5529503 - DNA, 12 bp, Homo sapiens
tgcgcagaggcc

SEQ ID NO: 5529504 - DNA, 15 bp, Homo sapiens
tgcgcagaggccagt

SEQ ID NO: 5529505 - DNA, 16 bp, Homo sapiens
tgcgcagaggccagtt

SEQ ID NO: 5529506 - DNA, 22 bp, Homo sapiens
tgcgcagatctgtgcctgggat

SEQ ID NO: 5529507 - DNA, 20 bp, Homo sapiens
tgcgcagccccatctgtgca

SEQ ID NO: 5529508 - DNA, 21 bp, Homo sapiens
tgcgcagccccatctgtgcat

SEQ ID NO: 5529509 - DNA, 15 bp, Homo sapiens
tgcgcagctccttcc

SEQ ID NO: 5529510 - DNA, 13 bp, Homo sapiens
tgcgcaggctggc

SEQ ID NO: 5529511 - DNA, 16 bp, Homo sapiens
tgcgcaggctggccct

SEQ ID NO: 5529512 - DNA, 22 bp, Homo sapiens
tgcgcaggctggccctgccctg

SEQ ID NO: 5529513 - DNA, 18 bp, Homo sapiens
tgcgcagggccctctggg

SEQ ID NO: 5529514 - DNA, 19 bp, Homo sapiens
tgcgcaggtctcttctggg

SEQ ID NO: 5529515 - DNA, 14 bp, Homo sapiens
tgcgcagtgccttg

SEQ ID NO: 5529516 - DNA, 13 bp, Homo sapiens
tgcgcagttgctg

SEQ ID NO: 5529517 - DNA, 21 bp, Homo sapiens
tgcgcattctaacctggaggt

SEQ ID NO: 5529518 - DNA, 13 bp, Homo sapiens
tgcgcattctcat

SEQ ID NO: 5529519 - DNA, 14 bp, Homo sapiens
tgcgccaccatgcc

SEQ ID NO: 5529520 - DNA, 15 bp, Homo sapiens
tgcgccaccatgccc

SEQ ID NO: 5529521 - DNA, 20 bp, Homo sapiens
tgcgccactacactccagcc

SEQ ID NO: 5529522 - DNA, 20 bp, Homo sapiens
tgcgccactgagacggcaga

SEQ ID NO: 5529523 - DNA, 22 bp, Homo sapiens
tgcgccactgctccgtggagga

SEQ ID NO: 5529524 - DNA, 20 bp, Homo sapiens
tgcgccacttcctttgtgtt

SEQ ID NO: 5529525 - DNA, 16 bp, Homo sapiens
tgcgccaggcagagct

SEQ ID NO: 5529526 - DNA, 17 bp, Homo sapiens
tgcgccattgcactcca

SEQ ID NO: 5529527 - DNA, 17 bp, Homo sapiens
tgcgcccaccccgctct

SEQ ID NO: 5529528 - DNA, 19 bp, Homo sapiens
tgcgcccagagctggcctc

SEQ ID NO: 5529529 - DNA, 22 bp, Homo sapiens
tgcgcccagagctggcctcccc

SEQ ID NO: 5529530 - DNA, 17 bp, Homo sapiens
tgcgcccagtccttcca

SEQ ID NO: 5529531 - DNA, 22 bp, Homo sapiens
tgcgcccccagcttctctctcc

SEQ ID NO: 5529532 - DNA, 16 bp, Homo sapiens
tgcgccccccagtgga

SEQ ID NO: 5529533 - DNA, 23 bp, Homo sapiens
tgcgccccctccgccctgccact

SEQ ID NO: 5529534 - DNA, 21 bp, Homo sapiens
tgcgccccgcacgactgcggg

SEQ ID NO: 5529535 - DNA, 16 bp, Homo sapiens
tgcgcccctccccacc

SEQ ID NO: 5529536 - DNA, 11 bp, Homo sapiens
tgcgcccctgc

SEQ ID NO: 5529537 - DNA, 18 bp, Homo sapiens
tgcgcccctgcccagcac

SEQ ID NO: 5529538 - DNA, 13 bp, Homo sapiens
tgcgccctccctc

SEQ ID NO: 5529539 - DNA, 17 bp, Homo sapiens
tgcgccctccctccctc

SEQ ID NO: 5529540 - DNA, 20 bp, Homo sapiens
tgcgccctccctccctccac

SEQ ID NO: 5529541 - DNA, 17 bp, Homo sapiens
tgcgccctgacatgcta

SEQ ID NO: 5529542 - DNA, 16 bp, Homo sapiens
tgcgccctgcactccc

SEQ ID NO: 5529543 - DNA, 14 bp, Homo sapiens
tgcgccctgggctc

SEQ ID NO: 5529544 - DNA, 21 bp, Homo sapiens
tgcgcccttaactgcatccag

SEQ ID NO: 5529545 - DNA, 15 bp, Homo sapiens
tgcgcccttaccttc

SEQ ID NO: 5529546 - DNA, 20 bp, Homo sapiens
tgcgcccttgaggggcccca

SEQ ID NO: 5529547 - DNA, 18 bp, Homo sapiens
tgcgcccttgtgccctgc

SEQ ID NO: 5529548 - DNA, 20 bp, Homo sapiens
tgcgccgagaccgcagaggg

SEQ ID NO: 5529549 - DNA, 21 bp, Homo sapiens
tgcgccgagaccgcagaggga

SEQ ID NO: 5529550 - DNA, 15 bp, Homo sapiens
tgcgccgagtctgtc

SEQ ID NO: 5529551 - DNA, 17 bp, Homo sapiens
tgcgccgagtctgtctc

SEQ ID NO: 5529552 - DNA, 18 bp, Homo sapiens
tgcgccgctgtgctgttg

SEQ ID NO: 5529553 - DNA, 17 bp, Homo sapiens
tgcgcctcagccctcag

SEQ ID NO: 5529554 - DNA, 14 bp, Homo sapiens
tgcgcctccagagg

SEQ ID NO: 5529555 - DNA, 21 bp, Homo sapiens
tgcgcctccatccatctgtcc

SEQ ID NO: 5529556 - DNA, 21 bp, Homo sapiens
tgcgcctcggtatctggcttc

SEQ ID NO: 5529557 - DNA, 17 bp, Homo sapiens
tgcgcctcgtgctggcg

SEQ ID NO: 5529558 - DNA, 17 bp, Homo sapiens
tgcgcctgcccgcccgc

SEQ ID NO: 5529559 - DNA, 18 bp, Homo sapiens
tgcgcctgcccgcccgcc

SEQ ID NO: 5529560 - DNA, 11 bp, Homo sapiens
tgcgcctgctg

SEQ ID NO: 5529561 - DNA, 12 bp, Homo sapiens
tgcgcctgctgc

SEQ ID NO: 5529562 - DNA, 15 bp, Homo sapiens
tgcgcctgctgcctg

SEQ ID NO: 5529563 - DNA, 16 bp, Homo sapiens
tgcgcctgctgcctgc

SEQ ID NO: 5529564 - DNA, 17 bp, Homo sapiens
tgcgcctgctgcctgct

SEQ ID NO: 5529565 - DNA, 13 bp, Homo sapiens
tgcgcctggctct

SEQ ID NO: 5529566 - DNA, 19 bp, Homo sapiens
tgcgcctgtgatgctgggc

SEQ ID NO: 5529567 - DNA, 14 bp, Homo sapiens
tgcgccttaaacaa

SEQ ID NO: 5529568 - DNA, 16 bp, Homo sapiens
tgcgcgcagctggcgc

SEQ ID NO: 5529569 - DNA, 21 bp, Homo sapiens
tgcgcgccaccgtgcctggct

SEQ ID NO: 5529570 - DNA, 22 bp, Homo sapiens
tgcgcgtgagtgtgtgagcgct

SEQ ID NO: 5529571 - DNA, 14 bp, Homo sapiens
tgcgcgtgtgcacg

SEQ ID NO: 5529572 - DNA, 12 bp, Homo sapiens
tgcgctagagca

SEQ ID NO: 5529573 - DNA, 17 bp, Homo sapiens
tgcgctcacctgcagcc

SEQ ID NO: 5529574 - DNA, 13 bp, Homo sapiens
tgcgctcagggcc

SEQ ID NO: 5529575 - DNA, 15 bp, Homo sapiens
tgcgctcagggccat

SEQ ID NO: 5529576 - DNA, 12 bp, Homo sapiens
tgcgctcagggg

SEQ ID NO: 5529577 - DNA, 20 bp, Homo sapiens
tgcgctcaggggctccatgc

SEQ ID NO: 5529578 - DNA, 22 bp, Homo sapiens
tgcgctcaggggctccatgctg

SEQ ID NO: 5529579 - DNA, 12 bp, Homo sapiens
tgcgctcctctg

SEQ ID NO: 5529580 - DNA, 19 bp, Homo sapiens
tgcgctcggcaggaaggag

SEQ ID NO: 5529581 - DNA, 18 bp, Homo sapiens
tgcgctctcaagaccaga

SEQ ID NO: 5529582 - DNA, 14 bp, Homo sapiens
tgcgctctgggttt

SEQ ID NO: 5529583 - DNA, 17 bp, Homo sapiens
tgcgctcttcaccagga

SEQ ID NO: 5529584 - DNA, 17 bp, Homo sapiens
tgcgctgacaaccaccg

SEQ ID NO: 5529585 - DNA, 14 bp, Homo sapiens
tgcgctgccctgca

SEQ ID NO: 5529586 - DNA, 15 bp, Homo sapiens
tgcgctgccctgcaa

SEQ ID NO: 5529587 - DNA, 15 bp, Homo sapiens
tgcgctgcctggcca

SEQ ID NO: 5529588 - DNA, 17 bp, Homo sapiens
tgcgctgcctggccagg

SEQ ID NO: 5529589 - DNA, 20 bp, Homo sapiens
tgcgctgggcacttccctgc

SEQ ID NO: 5529590 - DNA, 19 bp, Homo sapiens
tgcgctggtggaccacagg

SEQ ID NO: 5529591 - DNA, 23 bp, Homo sapiens
tgcgctggtggaccacaggcatc

SEQ ID NO: 5529592 - DNA, 13 bp, Homo sapiens
tgcgctgtcccag

SEQ ID NO: 5529593 - DNA, 15 bp, Homo sapiens
tgcgctgtgctccag

SEQ ID NO: 5529594 - DNA, 16 bp, Homo sapiens
tgcgcttatttggaaa

SEQ ID NO: 5529595 - DNA, 22 bp, Homo sapiens
tgcgcttatttggaaattttag

SEQ ID NO: 5529596 - DNA, 22 bp, Homo sapiens
tgcgcttcacttgggtccaggc

SEQ ID NO: 5529597 - DNA, 14 bp, Homo sapiens
tgcgcttcctgagc

SEQ ID NO: 5529598 - DNA, 17 bp, Homo sapiens
tgcgcttctgctggagg

SEQ ID NO: 5529599 - DNA, 18 bp, Homo sapiens
tgcgctttattgcccatg

SEQ ID NO: 5529600 - DNA, 21 bp, Homo sapiens
tgcgctttgaacgtgccagca

SEQ ID NO: 5529601 - DNA, 20 bp, Homo sapiens
tgcggaagccacagggtgag

SEQ ID NO: 5529602 - DNA, 23 bp, Homo sapiens
tgcggaagccatagggggctgca

SEQ ID NO: 5529603 - DNA, 14 bp, Homo sapiens
tgcggaatcagctt

SEQ ID NO: 5529604 - DNA, 23 bp, Homo sapiens
tgcggacaccatgttcccagctc

SEQ ID NO: 5529605 - DNA, 19 bp, Homo sapiens
tgcggacaccgtggcctgg

SEQ ID NO: 5529606 - DNA, 17 bp, Homo sapiens
tgcggacagccacggcc

SEQ ID NO: 5529607 - DNA, 14 bp, Homo sapiens
tgcggaccccagct

SEQ ID NO: 5529608 - DNA, 20 bp, Homo sapiens
tgcggacccttcccagccct

SEQ ID NO: 5529609 - DNA, 16 bp, Homo sapiens
tgcggactccatggcc

SEQ ID NO: 5529610 - DNA, 17 bp, Homo sapiens
tgcggactccatggccc

SEQ ID NO: 5529611 - DNA, 18 bp, Homo sapiens
tgcggactccatggccct

SEQ ID NO: 5529612 - DNA, 19 bp, Homo sapiens
tgcggagaaccttgtgcct

SEQ ID NO: 5529613 - DNA, 14 bp, Homo sapiens
tgcggagcagcctt

SEQ ID NO: 5529614 - DNA, 13 bp, Homo sapiens
tgcggagccagcg

SEQ ID NO: 5529615 - DNA, 16 bp, Homo sapiens
tgcggagcttctccag

SEQ ID NO: 5529616 - DNA, 17 bp, Homo sapiens
tgcggaggagctgcctg

SEQ ID NO: 5529617 - DNA, 13 bp, Homo sapiens
tgcggaggctgct

SEQ ID NO: 5529618 - DNA, 23 bp, Homo sapiens
tgcggaggctgctcagatggcct

SEQ ID NO: 5529619 - DNA, 19 bp, Homo sapiens
tgcggagtcattttgtgtt

SEQ ID NO: 5529620 - DNA, 23 bp, Homo sapiens
tgcggagtcattttgtgttgaag

SEQ ID NO: 5529621 - DNA, 14 bp, Homo sapiens
tgcggagtccaggc

SEQ ID NO: 5529622 - DNA, 15 bp, Homo sapiens
tgcggatcctgctgg

SEQ ID NO: 5529623 - DNA, 13 bp, Homo sapiens
tgcggatggccgg

SEQ ID NO: 5529624 - DNA, 20 bp, Homo sapiens
tgctaccctccctgctgtcc

SEQ ID NO: 5529625 - DNA, 21 bp, Homo sapiens
tgctaccctccctgctgtccc

SEQ ID NO: 5529626 - DNA, 23 bp, Homo sapiens
tgctaccctccctgctgtcccct

SEQ ID NO: 5529627 - DNA, 21 bp, Homo sapiens
tgctacccttaataacataca

SEQ ID NO: 5529628 - DNA, 15 bp, Homo sapiens
tgctaccgccctggg

SEQ ID NO: 5529629 - DNA, 15 bp, Homo sapiens
tgctacctcagtgct

SEQ ID NO: 5529630 - DNA, 12 bp, Homo sapiens
tgctacctctga

SEQ ID NO: 5529631 - DNA, 14 bp, Homo sapiens
tgctacctctgatc

SEQ ID NO: 5529632 - DNA, 17 bp, Homo sapiens
tgctacctgatttcagc

SEQ ID NO: 5529633 - DNA, 13 bp, Homo sapiens
tgctacctgcacc

SEQ ID NO: 5529634 - DNA, 12 bp, Homo sapiens
tgctacctggtt

SEQ ID NO: 5529635 - DNA, 17 bp, Homo sapiens
tgctacctggttttcat

SEQ ID NO: 5529636 - DNA, 14 bp, Homo sapiens
tgctaccttgcccc

SEQ ID NO: 5529637 - DNA, 14 bp, Homo sapiens
tgctacgaagaaag

SEQ ID NO: 5529638 - DNA, 13 bp, Homo sapiens
tgctacgcctgca

SEQ ID NO: 5529639 - DNA, 20 bp, Homo sapiens
tgctacgcctgcatgtaaac

SEQ ID NO: 5529640 - DNA, 22 bp, Homo sapiens
tgctacggtagtgatgaaatta

SEQ ID NO: 5529641 - DNA, 14 bp, Homo sapiens
tgctacgtgcctcc

SEQ ID NO: 5529642 - DNA, 18 bp, Homo sapiens
tgctacgtgcctcccgag

SEQ ID NO: 5529643 - DNA, 15 bp, Homo sapiens
tgctacgtgtgaaat

SEQ ID NO: 5529644 - DNA, 17 bp, Homo sapiens
tgctacgtgtgaaatct

SEQ ID NO: 5529645 - DNA, 23 bp, Homo sapiens
tgctacgtgtgaaatctgtcttt

SEQ ID NO: 5529646 - DNA, 14 bp, Homo sapiens
tgctactacaaaaa

SEQ ID NO: 5529647 - DNA, 13 bp, Homo sapiens
tgctactactgca

SEQ ID NO: 5529648 - DNA, 16 bp, Homo sapiens
tgctactactgcagtc

SEQ ID NO: 5529649 - DNA, 21 bp, Homo sapiens
tgctactactgcagtctttat

SEQ ID NO: 5529650 - DNA, 19 bp, Homo sapiens
tgctactcaagtagcattt

SEQ ID NO: 5529651 - DNA, 13 bp, Homo sapiens
tgctactcagtat

SEQ ID NO: 5529652 - DNA, 12 bp, Homo sapiens
tgctactccatg

SEQ ID NO: 5529653 - DNA, 13 bp, Homo sapiens
tgctactccatgc

SEQ ID NO: 5529654 - DNA, 14 bp, Homo sapiens
tgctactgaaaaaa

SEQ ID NO: 5529655 - DNA, 17 bp, Homo sapiens
tgctactgaactgaaag

SEQ ID NO: 5529656 - DNA, 16 bp, Homo sapiens
tgctactgacccagag

SEQ ID NO: 5529657 - DNA, 16 bp, Homo sapiens
tgctactgaggcaggg

SEQ ID NO: 5529658 - DNA, 20 bp, Homo sapiens
tgctactgcactccagcctg

SEQ ID NO: 5529659 - DNA, 15 bp, Homo sapiens
tgctactgccaacct

SEQ ID NO: 5529660 - DNA, 16 bp, Homo sapiens
tgctactgcccctctc

SEQ ID NO: 5529661 - DNA, 18 bp, Homo sapiens
tgctactggggaaactgg

SEQ ID NO: 5529662 - DNA, 22 bp, Homo sapiens
tgctactggggaaactggccat

SEQ ID NO: 5529663 - DNA, 13 bp, Homo sapiens
tgctactgttgta

SEQ ID NO: 5529664 - DNA, 19 bp, Homo sapiens
tgctacttaattcctttct

SEQ ID NO: 5529665 - DNA, 16 bp, Homo sapiens
tgctacttatataatt

SEQ ID NO: 5529666 - DNA, 21 bp, Homo sapiens
tgctacttatcatttttgtat

SEQ ID NO: 5529667 - DNA, 14 bp, Homo sapiens
tgctacttccccag

SEQ ID NO: 5529668 - DNA, 17 bp, Homo sapiens
tgctacttgagggccag

SEQ ID NO: 5529669 - DNA, 19 bp, Homo sapiens
tgctacttgagggccagga

SEQ ID NO: 5529670 - DNA, 15 bp, Homo sapiens
tgctacttgctctgc

SEQ ID NO: 5529671 - DNA, 22 bp, Homo sapiens
tgctacttggggacataatttc

SEQ ID NO: 5529672 - DNA, 22 bp, Homo sapiens
tgctacttttacttgttcattt

SEQ ID NO: 5529673 - DNA, 23 bp, Homo sapiens
tgctacttttttttagttcaata

SEQ ID NO: 5529674 - DNA, 21 bp, Homo sapiens
tgctagaaaatttagcccttt

SEQ ID NO: 5529675 - DNA, 20 bp, Homo sapiens
tgctagaaacataatttttt

SEQ ID NO: 5529676 - DNA, 21 bp, Homo sapiens
tgctagaacaatgggaggctg

SEQ ID NO: 5529677 - DNA, 14 bp, Homo sapiens
tgctagaactccct

SEQ ID NO: 5529678 - DNA, 21 bp, Homo sapiens
tgctagaactccctttcaaca

SEQ ID NO: 5529679 - DNA, 11 bp, Homo sapiens
tgctagaactt

SEQ ID NO: 5529680 - DNA, 14 bp, Homo sapiens
tgctagaacttttt

SEQ ID NO: 5529681 - DNA, 20 bp, Homo sapiens
tgctagaacttttttaaata

SEQ ID NO: 5529682 - DNA, 15 bp, Homo sapiens
tgctagaagaaaaca

SEQ ID NO: 5529683 - DNA, 18 bp, Homo sapiens
tgctagaagctgtctagg

SEQ ID NO: 5529684 - DNA, 16 bp, Homo sapiens
tgctagaatagaagaa

SEQ ID NO: 5529685 - DNA, 19 bp, Homo sapiens
tgctagacaaggttgctgt

SEQ ID NO: 5529686 - DNA, 16 bp, Homo sapiens
tgctagacagaaacca

SEQ ID NO: 5529687 - DNA, 21 bp, Homo sapiens
tgctagacagaaaccaagcca

SEQ ID NO: 5529688 - DNA, 14 bp, Homo sapiens
tgctagacagccag

SEQ ID NO: 5529689 - DNA, 20 bp, Homo sapiens
tgctagactcctcaggagag

SEQ ID NO: 5529690 - DNA, 20 bp, Homo sapiens
tgctagactttctggagtga

SEQ ID NO: 5529691 - DNA, 18 bp, Homo sapiens
tgctagagacgctgatcc

SEQ ID NO: 5529692 - DNA, 22 bp, Homo sapiens
tgctagagcaacccctgtaccc

SEQ ID NO: 5529693 - DNA, 20 bp, Homo sapiens
tgctagagcagacaggcctg

SEQ ID NO: 5529694 - DNA, 20 bp, Homo sapiens
tgctagaggcttttattaga

SEQ ID NO: 5529695 - DNA, 22 bp, Homo sapiens
tgctagaggcttttattagaaa

SEQ ID NO: 5529696 - DNA, 13 bp, Homo sapiens
tgctagagttaaa

SEQ ID NO: 5529697 - DNA, 22 bp, Homo sapiens
tgctagataatagggttttcag

SEQ ID NO: 5529698 - DNA, 22 bp, Homo sapiens
tgctagatatcacttactcagt

SEQ ID NO: 5529699 - DNA, 23 bp, Homo sapiens
tgctagatccagcccaaacctgg

SEQ ID NO: 5529700 - DNA, 13 bp, Homo sapiens
tgctagattttaa

SEQ ID NO: 5529701 - DNA, 23 bp, Homo sapiens
tgctagattttaatttatttgtt

SEQ ID NO: 5529702 - DNA, 14 bp, Homo sapiens
tgctagcacaatat

SEQ ID NO: 5529703 - DNA, 14 bp, Homo sapiens
tgctagcacctccc

SEQ ID NO: 5529704 - DNA, 18 bp, Homo sapiens
tgctagcacctccccaga

SEQ ID NO: 5529705 - DNA, 14 bp, Homo sapiens
tgctagcaggcccc

SEQ ID NO: 5529706 - DNA, 19 bp, Homo sapiens
tgctagcaggccccctagg

SEQ ID NO: 5529707 - DNA, 22 bp, Homo sapiens
tgctagcagtaaaagatgaagt

SEQ ID NO: 5529708 - DNA, 14 bp, Homo sapiens
tgctagccccagag

SEQ ID NO: 5529709 - DNA, 19 bp, Homo sapiens
tgctagcctcacgaaactg

SEQ ID NO: 5529710 - DNA, 17 bp, Homo sapiens
tgctagcgagccgcctc

SEQ ID NO: 5529711 - DNA, 14 bp, Homo sapiens
tgctagctaaaaga

SEQ ID NO: 5529712 - DNA, 18 bp, Homo sapiens
tgctagctctgagccagt

SEQ ID NO: 5529713 - DNA, 21 bp, Homo sapiens
tgctagctcttaccaaaacag

SEQ ID NO: 5529714 - DNA, 15 bp, Homo sapiens
tgctagctgtagaaa

SEQ ID NO: 5529715 - DNA, 12 bp, Homo sapiens
tgctagctgtct

SEQ ID NO: 5529716 - DNA, 18 bp, Homo sapiens
tgctagctgtctctcttg

SEQ ID NO: 5529717 - DNA, 22 bp, Homo sapiens
tgctagcttgacacagtcagca

SEQ ID NO: 5529718 - DNA, 15 bp, Homo sapiens
tgctaggagccccag

SEQ ID NO: 5529719 - DNA, 18 bp, Homo sapiens
tgctaggagccccagctt

SEQ ID NO: 5529720 - DNA, 20 bp, Homo sapiens
tgctaggagccccagcttcc

SEQ ID NO: 5529721 - DNA, 21 bp, Homo sapiens
tgctaggagccccagcttcct

SEQ ID NO: 5529722 - DNA, 23 bp, Homo sapiens
tgctaggagccccagcttcctgt

SEQ ID NO: 5529723 - DNA, 17 bp, Homo sapiens
tgctaggagctgacaat

SEQ ID NO: 5529724 - DNA, 14 bp, Homo sapiens
tgctaggccagagc

SEQ ID NO: 5529725 - DNA, 21 bp, Homo sapiens
tgctaggcgagtgccaggact

SEQ ID NO: 5529726 - DNA, 22 bp, Homo sapiens
tgctagggaaacttcccgtccc

SEQ ID NO: 5529727 - DNA, 14 bp, Homo sapiens
tgctaggggaagga

SEQ ID NO: 5529728 - DNA, 20 bp, Homo sapiens
tgctaggggaaggactggcc

SEQ ID NO: 5529729 - DNA, 20 bp, Homo sapiens
tgctaggggttttaggtctc

SEQ ID NO: 5529730 - DNA, 21 bp, Homo sapiens
tgctaggtagaggcatttgtc

SEQ ID NO: 5529731 - DNA, 15 bp, Homo sapiens
tgctaggtataaaaa

SEQ ID NO: 5529732 - DNA, 23 bp, Homo sapiens
tgctaggtgggccagcccctccc

SEQ ID NO: 5529733 - DNA, 12 bp, Homo sapiens
tgctaggttcta

SEQ ID NO: 5529734 - DNA, 13 bp, Homo sapiens
tgctagtaaattt

SEQ ID NO: 5529735 - DNA, 13 bp, Homo sapiens
tgctagtacctgt

SEQ ID NO: 5529736 - DNA, 16 bp, Homo sapiens
tgctagtattcgctgt

SEQ ID NO: 5529737 - DNA, 22 bp, Homo sapiens
tgctagtattcgctgtgttcat

SEQ ID NO: 5529738 - DNA, 12 bp, Homo sapiens
tgctagtatttg

SEQ ID NO: 5529739 - DNA, 13 bp, Homo sapiens
tgctagtatttga

SEQ ID NO: 5529740 - DNA, 15 bp, Homo sapiens
tgctagtatttgaat

SEQ ID NO: 5529741 - DNA, 16 bp, Homo sapiens
tgctagtatttgaatt

SEQ ID NO: 5529742 - DNA, 17 bp, Homo sapiens
tgctagtatttgaatta

SEQ ID NO: 5529743 - DNA, 23 bp, Homo sapiens
tgctagtatttgaattaaaactt

SEQ ID NO: 5529744 - DNA, 21 bp, Homo sapiens
tgctagtcactggcagcctgc

SEQ ID NO: 5529745 - DNA, 22 bp, Homo sapiens
tgctagtcactggcagcctgca

SEQ ID NO: 5529746 - DNA, 19 bp, Homo sapiens
tgctagtcgcccctcagag

SEQ ID NO: 5529747 - DNA, 21 bp, Homo sapiens
tgctagtcgcccctcagagca

SEQ ID NO: 5529748 - DNA, 22 bp, Homo sapiens
tgctagtcgcccctcagagcat

SEQ ID NO: 5529749 - DNA, 18 bp, Homo sapiens
tgctagtgaaatggctgg

SEQ ID NO: 5529750 - DNA, 13 bp, Homo sapiens
tgctagtgagctg

SEQ ID NO: 5529751 - DNA, 16 bp, Homo sapiens
tgctagtgagctgggc

SEQ ID NO: 5529752 - DNA, 18 bp, Homo sapiens
tgctagtgagctgggcat

SEQ ID NO: 5529753 - DNA, 22 bp, Homo sapiens
tgctagtgatacactgtatcta

SEQ ID NO: 5529754 - DNA, 15 bp, Homo sapiens
tgctagtgcatttca

SEQ ID NO: 5529755 - DNA, 16 bp, Homo sapiens
tgctagtgctgtaata

SEQ ID NO: 5529756 - DNA, 19 bp, Homo sapiens
tgctagtgggccctctctc

SEQ ID NO: 5529757 - DNA, 17 bp, Homo sapiens
tgctagtggtgagcatg

SEQ ID NO: 5529758 - DNA, 18 bp, Homo sapiens
tgctagtggtgagcatgt

SEQ ID NO: 5529759 - DNA, 19 bp, Homo sapiens
tgctagtggtgagcatgta

SEQ ID NO: 5529760 - DNA, 18 bp, Homo sapiens
tgctagtgttgtatttct

SEQ ID NO: 5529761 - DNA, 16 bp, Homo sapiens
tgctagttagcgcccc

SEQ ID NO: 5529762 - DNA, 18 bp, Homo sapiens
tgctagttctgctgccct

SEQ ID NO: 5529763 - DNA, 19 bp, Homo sapiens
tgctagttctgctgccctc

SEQ ID NO: 5529764 - DNA, 12 bp, Homo sapiens
tgctagttctta

SEQ ID NO: 5529765 - DNA, 18 bp, Homo sapiens
tgctagttggagtgcttg

SEQ ID NO: 5529766 - DNA, 19 bp, Homo sapiens
tgctataaactttacatat

SEQ ID NO: 5529767 - DNA, 22 bp, Homo sapiens
tgctataaatagatttagtctg

SEQ ID NO: 5529768 - DNA, 18 bp, Homo sapiens
tgctataaatgccagagc

SEQ ID NO: 5529769 - DNA, 20 bp, Homo sapiens
tgctataaattttttgaaac

SEQ ID NO: 5529770 - DNA, 23 bp, Homo sapiens
tgctataaattttttgaaacaca

SEQ ID NO: 5529771 - DNA, 16 bp, Homo sapiens
tgctataatcattagt

SEQ ID NO: 5529772 - DNA, 18 bp, Homo sapiens
tgctataatctgttttta

SEQ ID NO: 5529773 - DNA, 22 bp, Homo sapiens
tgctatacacaagcaatgcaag

SEQ ID NO: 5529774 - DNA, 15 bp, Homo sapiens
tgctatacacacaca

SEQ ID NO: 5529775 - DNA, 19 bp, Homo sapiens
tgctatactggaaatgtaa

SEQ ID NO: 5529776 - DNA, 23 bp, Homo sapiens
tgctatagatttgtattttaaaa

SEQ ID NO: 5529777 - DNA, 14 bp, Homo sapiens
tgctatagcctggg

SEQ ID NO: 5529778 - DNA, 14 bp, Homo sapiens
tgctatagtatttg

SEQ ID NO: 5529779 - DNA, 15 bp, Homo sapiens
tgctatagtatttga

SEQ ID NO: 5529780 - DNA, 16 bp, Homo sapiens
tgctatatattaggca

SEQ ID NO: 5529781 - DNA, 21 bp, Homo sapiens
tgctatatccagttcctgctc

SEQ ID NO: 5529782 - DNA, 15 bp, Homo sapiens
tgctatatttgctaa

SEQ ID NO: 5529783 - DNA, 20 bp, Homo sapiens
tgctatcaaaataaattgaa

SEQ ID NO: 5529784 - DNA, 17 bp, Homo sapiens
tgctatcaaataactaa

SEQ ID NO: 5529785 - DNA, 22 bp, Homo sapiens
tgctatcacatagatctagtct

SEQ ID NO: 5529786 - DNA, 12 bp, Homo sapiens
tgctatcacatg

SEQ ID NO: 5529787 - DNA, 14 bp, Homo sapiens
tgctatcacatgtg

SEQ ID NO: 5529788 - DNA, 23 bp, Homo sapiens
tgctatcatgatggaatttcata

SEQ ID NO: 5529789 - DNA, 12 bp, Homo sapiens
tgctatccagcc

SEQ ID NO: 5529790 - DNA, 19 bp, Homo sapiens
tgctatccccatctccctg

SEQ ID NO: 5529791 - DNA, 22 bp, Homo sapiens
tgctatccccatctccctgcct

SEQ ID NO: 5529792 - DNA, 19 bp, Homo sapiens
tgctatcctgcaggaaata

SEQ ID NO: 5529793 - DNA, 22 bp, Homo sapiens
tgctatcctgcaggaaatataa

SEQ ID NO: 5529794 - DNA, 20 bp, Homo sapiens
tgctatcctgccaaaatcat

SEQ ID NO: 5529795 - DNA, 22 bp, Homo sapiens
tgctatcgcaccactgtgtatt

SEQ ID NO: 5529796 - DNA, 17 bp, Homo sapiens
tgctatcggcagatgat

SEQ ID NO: 5529797 - DNA, 20 bp, Homo sapiens
tgctatcggcagatgatgct

SEQ ID NO: 5529798 - DNA, 20 bp, Homo sapiens
tgctatcggggaagccagac

SEQ ID NO: 5529799 - DNA, 14 bp, Homo sapiens
tgctatctcaaagt

SEQ ID NO: 5529800 - DNA, 14 bp, Homo sapiens
tgctatctccccca

SEQ ID NO: 5529801 - DNA, 18 bp, Homo sapiens
tgctcccattcctccctc

SEQ ID NO: 5529802 - DNA, 16 bp, Homo sapiens
tgctccccaacacctg

SEQ ID NO: 5529803 - DNA, 18 bp, Homo sapiens
tgctccccaacacctgcc

SEQ ID NO: 5529804 - DNA, 14 bp, Homo sapiens
tgctccccacagcg

SEQ ID NO: 5529805 - DNA, 19 bp, Homo sapiens
tgctccccacagcgtccct

SEQ ID NO: 5529806 - DNA, 16 bp, Homo sapiens
tgctccccacccgcct

SEQ ID NO: 5529807 - DNA, 18 bp, Homo sapiens
tgctccccagccctggct

SEQ ID NO: 5529808 - DNA, 13 bp, Homo sapiens
tgctccccctttt

SEQ ID NO: 5529809 - DNA, 15 bp, Homo sapiens
tgctcccccttttcc

SEQ ID NO: 5529810 - DNA, 18 bp, Homo sapiens
tgctcccctaaagccagg

SEQ ID NO: 5529811 - DNA, 19 bp, Homo sapiens
tgctcccctaaagccaggc

SEQ ID NO: 5529812 - DNA, 21 bp, Homo sapiens
tgctcccctaaagccaggctc

SEQ ID NO: 5529813 - DNA, 16 bp, Homo sapiens
tgctcccctccctcct

SEQ ID NO: 5529814 - DNA, 17 bp, Homo sapiens
tgctcccctccctcctc

SEQ ID NO: 5529815 - DNA, 16 bp, Homo sapiens
tgctcccctgccacac

SEQ ID NO: 5529816 - DNA, 19 bp, Homo sapiens
tgctcccctgccacactga

SEQ ID NO: 5529817 - DNA, 15 bp, Homo sapiens
tgctcccctgccacg

SEQ ID NO: 5529818 - DNA, 17 bp, Homo sapiens
tgctccccttcctgcca

SEQ ID NO: 5529819 - DNA, 14 bp, Homo sapiens
tgctcccctttggg

SEQ ID NO: 5529820 - DNA, 19 bp, Homo sapiens
tgctcccgccccagggtct

SEQ ID NO: 5529821 - DNA, 20 bp, Homo sapiens
tgctcccgccccagggtctg

SEQ ID NO: 5529822 - DNA, 21 bp, Homo sapiens
tgctcccgccccagggtctga

SEQ ID NO: 5529823 - DNA, 16 bp, Homo sapiens
tgctccctaacctttc

SEQ ID NO: 5529824 - DNA, 20 bp, Homo sapiens
tgctccctaccacctcccca

SEQ ID NO: 5529825 - DNA, 19 bp, Homo sapiens
tgctccctaccccagggcc

SEQ ID NO: 5529826 - DNA, 23 bp, Homo sapiens
tgctccctaccccagggccctgg

SEQ ID NO: 5529827 - DNA, 12 bp, Homo sapiens
tgctccctcaga

SEQ ID NO: 5529828 - DNA, 12 bp, Homo sapiens
tgctccctcagc

SEQ ID NO: 5529829 - DNA, 15 bp, Homo sapiens
tgctccctcagcctc

SEQ ID NO: 5529830 - DNA, 19 bp, Homo sapiens
tgctccctcagcctcagag

SEQ ID NO: 5529831 - DNA, 21 bp, Homo sapiens
tgctccctcagcctcagagga

SEQ ID NO: 5529832 - DNA, 18 bp, Homo sapiens
tgctccctcccctgccct

SEQ ID NO: 5529833 - DNA, 22 bp, Homo sapiens
tgctccctctccaagacagcag

SEQ ID NO: 5529834 - DNA, 14 bp, Homo sapiens
tgctccctctgtca

SEQ ID NO: 5529835 - DNA, 13 bp, Homo sapiens
tgctccctctgtt

SEQ ID NO: 5529836 - DNA, 14 bp, Homo sapiens
tgctccctctgtta

SEQ ID NO: 5529837 - DNA, 13 bp, Homo sapiens
tgctccctgaagc

SEQ ID NO: 5529838 - DNA, 20 bp, Homo sapiens
tgctccctgaagccagcctt

SEQ ID NO: 5529839 - DNA, 21 bp, Homo sapiens
tgctccctgaagccagccttc

SEQ ID NO: 5529840 - DNA, 22 bp, Homo sapiens
tgctccctgaagccagccttct

SEQ ID NO: 5529841 - DNA, 21 bp, Homo sapiens
tgctccctgactgggggcaga

SEQ ID NO: 5529842 - DNA, 15 bp, Homo sapiens
tgctccctgagggcg

SEQ ID NO: 5529843 - DNA, 12 bp, Homo sapiens
tgctccctgcct

SEQ ID NO: 5529844 - DNA, 13 bp, Homo sapiens
tgctccctgcctc

SEQ ID NO: 5529845 - DNA, 16 bp, Homo sapiens
tgctccctgcctcctg

SEQ ID NO: 5529846 - DNA, 22 bp, Homo sapiens
tgctccctgcctcctgcctatg

SEQ ID NO: 5529847 - DNA, 22 bp, Homo sapiens
tgctccctggaggcacgcacca

SEQ ID NO: 5529848 - DNA, 22 bp, Homo sapiens
tgctccctgtagggtccaacca

SEQ ID NO: 5529849 - DNA, 17 bp, Homo sapiens
tgctccctgtgtccacc

SEQ ID NO: 5529850 - DNA, 20 bp, Homo sapiens
tgctccgaggacccaggaaa

SEQ ID NO: 5529851 - DNA, 19 bp, Homo sapiens
tgctccgaggactggactg

SEQ ID NO: 5529852 - DNA, 18 bp, Homo sapiens
tgctccgcctctgctggc

SEQ ID NO: 5529853 - DNA, 23 bp, Homo sapiens
tgctccgctcccaccgcccccac

SEQ ID NO: 5529854 - DNA, 13 bp, Homo sapiens
tgctccgctgcct

SEQ ID NO: 5529855 - DNA, 16 bp, Homo sapiens
tgctccgctgcctgga

SEQ ID NO: 5529856 - DNA, 18 bp, Homo sapiens
tgctccgctgcctggaac

SEQ ID NO: 5529857 - DNA, 13 bp, Homo sapiens
tgctccgtgcctc

SEQ ID NO: 5529858 - DNA, 13 bp, Homo sapiens
tgctccgtgcttg

SEQ ID NO: 5529859 - DNA, 14 bp, Homo sapiens
tgctccgtggactg

SEQ ID NO: 5529860 - DNA, 15 bp, Homo sapiens
tgctccgtggactgc

SEQ ID NO: 5529861 - DNA, 13 bp, Homo sapiens
tgctccgtggagg

SEQ ID NO: 5529862 - DNA, 15 bp, Homo sapiens
tgctccgtgtgtctc

SEQ ID NO: 5529863 - DNA, 17 bp, Homo sapiens
tgctccgtgtgtctcat

SEQ ID NO: 5529864 - DNA, 19 bp, Homo sapiens
tgctccgttggtcagcgtt

SEQ ID NO: 5529865 - DNA, 22 bp, Homo sapiens
tgctcctaaacccccgctccag

SEQ ID NO: 5529866 - DNA, 23 bp, Homo sapiens
tgctcctaaacccccgctccaga

SEQ ID NO: 5529867 - DNA, 17 bp, Homo sapiens
tgctcctaactccaccg

SEQ ID NO: 5529868 - DNA, 17 bp, Homo sapiens
tgctcctacatccagct

SEQ ID NO: 5529869 - DNA, 20 bp, Homo sapiens
tgctcctacatccagctcct

SEQ ID NO: 5529870 - DNA, 14 bp, Homo sapiens
tgctcctacccctg

SEQ ID NO: 5529871 - DNA, 21 bp, Homo sapiens
tgctcctacccctgtcctggg

SEQ ID NO: 5529872 - DNA, 23 bp, Homo sapiens
tgctcctacccctgtcctggggc

SEQ ID NO: 5529873 - DNA, 13 bp, Homo sapiens
tgctcctagaagt

SEQ ID NO: 5529874 - DNA, 14 bp, Homo sapiens
tgctcctagagagg

SEQ ID NO: 5529875 - DNA, 23 bp, Homo sapiens
tgctcctagagtatattcctctg

SEQ ID NO: 5529876 - DNA, 17 bp, Homo sapiens
tgctcctagcaccctgg

SEQ ID NO: 5529877 - DNA, 13 bp, Homo sapiens
tgctcctagcaga

SEQ ID NO: 5529878 - DNA, 18 bp, Homo sapiens
tgctcctagcagacagaa

SEQ ID NO: 5529879 - DNA, 18 bp, Homo sapiens
tgctcctagtttgacctc

SEQ ID NO: 5529880 - DNA, 19 bp, Homo sapiens
tgctcctcacccccacccc

SEQ ID NO: 5529881 - DNA, 22 bp, Homo sapiens
tgctcctcacccccacccctgt

SEQ ID NO: 5529882 - DNA, 15 bp, Homo sapiens
tgctcctcacctgtc

SEQ ID NO: 5529883 - DNA, 16 bp, Homo sapiens
tgctcctcacctgtct

SEQ ID NO: 5529884 - DNA, 19 bp, Homo sapiens
tgctcctcactgcccgcac

SEQ ID NO: 5529885 - DNA, 23 bp, Homo sapiens
tgctcctcactggaggagcagct

SEQ ID NO: 5529886 - DNA, 12 bp, Homo sapiens
tgctcctcagga

SEQ ID NO: 5529887 - DNA, 13 bp, Homo sapiens
tgctcctcatggg

SEQ ID NO: 5529888 - DNA, 11 bp, Homo sapiens
tgctcctccag

SEQ ID NO: 5529889 - DNA, 13 bp, Homo sapiens
tgctcctccagcc

SEQ ID NO: 5529890 - DNA, 16 bp, Homo sapiens
tgctcctccagccctt

SEQ ID NO: 5529891 - DNA, 13 bp, Homo sapiens
tgctcctccaggg

SEQ ID NO: 5529892 - DNA, 21 bp, Homo sapiens
tgctcctccagggccacgtgc

SEQ ID NO: 5529893 - DNA, 22 bp, Homo sapiens
tgctcctccagggccacgtgcc

SEQ ID NO: 5529894 - DNA, 13 bp, Homo sapiens
tgctcctcccatt

SEQ ID NO: 5529895 - DNA, 18 bp, Homo sapiens
tgctcctcccattcccct

SEQ ID NO: 5529896 - DNA, 16 bp, Homo sapiens
tgctcctccctctgac

SEQ ID NO: 5529897 - DNA, 12 bp, Homo sapiens
tgctcctccctg

SEQ ID NO: 5529898 - DNA, 14 bp, Homo sapiens
tgctcctccctgcc

SEQ ID NO: 5529899 - DNA, 19 bp, Homo sapiens
tgctcctccctgcccccca

SEQ ID NO: 5529900 - DNA, 14 bp, Homo sapiens
tgctcctccctggc

SEQ ID NO: 5529901 - DNA, 19 bp, Homo sapiens
tgctcctccctggctgccc

SEQ ID NO: 5529902 - DNA, 22 bp, Homo sapiens
tgctcctccctggctgccctgg

SEQ ID NO: 5529903 - DNA, 20 bp, Homo sapiens
tgctcctccgtgtggactgt

SEQ ID NO: 5529904 - DNA, 19 bp, Homo sapiens
tgctcctccttggtgcctg

SEQ ID NO: 5529905 - DNA, 21 bp, Homo sapiens
tgctcctcgctcgcacctgcc

SEQ ID NO: 5529906 - DNA, 16 bp, Homo sapiens
tgctcctcggccagag

SEQ ID NO: 5529907 - DNA, 22 bp, Homo sapiens
tgctcctcggccagagctccca

SEQ ID NO: 5529908 - DNA, 13 bp, Homo sapiens
tgctcctctccag

SEQ ID NO: 5529909 - DNA, 15 bp, Homo sapiens
tgctcctctgcccgc

SEQ ID NO: 5529910 - DNA, 17 bp, Homo sapiens
tgctcctctgcctgtgc

SEQ ID NO: 5529911 - DNA, 18 bp, Homo sapiens
tgctcctctgcctgtgcc

SEQ ID NO: 5529912 - DNA, 13 bp, Homo sapiens
tgctcctcttccc

SEQ ID NO: 5529913 - DNA, 17 bp, Homo sapiens
tgctcctcttgattcct

SEQ ID NO: 5529914 - DNA, 18 bp, Homo sapiens
tgctcctcttgattcctg

SEQ ID NO: 5529915 - DNA, 21 bp, Homo sapiens
tgctcctcttgttcctgaaat

SEQ ID NO: 5529916 - DNA, 13 bp, Homo sapiens
tgctcctgaatga

SEQ ID NO: 5529917 - DNA, 22 bp, Homo sapiens
tgctcctgaatgaggcggagct

SEQ ID NO: 5529918 - DNA, 12 bp, Homo sapiens
tgctcctgagcc

SEQ ID NO: 5529919 - DNA, 13 bp, Homo sapiens
tgctcctgagccc

SEQ ID NO: 5529920 - DNA, 21 bp, Homo sapiens
tgctcctgagcccccagcttc

SEQ ID NO: 5529921 - DNA, 15 bp, Homo sapiens
tgctcctgcagcatg

SEQ ID NO: 5529922 - DNA, 17 bp, Homo sapiens
tgctcctgcccaggagc

SEQ ID NO: 5529923 - DNA, 13 bp, Homo sapiens
tgctcctgctttt

SEQ ID NO: 5529924 - DNA, 18 bp, Homo sapiens
tgctcctggaacctggca

SEQ ID NO: 5529925 - DNA, 14 bp, Homo sapiens
tgctcctggagcct

SEQ ID NO: 5529926 - DNA, 20 bp, Homo sapiens
tgctcctggagcctttgaat

SEQ ID NO: 5529927 - DNA, 21 bp, Homo sapiens
tgctcctggagcctttgaata

SEQ ID NO: 5529928 - DNA, 21 bp, Homo sapiens
tgctcctggatctccctgaga

SEQ ID NO: 5529929 - DNA, 19 bp, Homo sapiens
tgctcctggcccactgcat

SEQ ID NO: 5529930 - DNA, 19 bp, Homo sapiens
tgctcctggccttgctgac

SEQ ID NO: 5529931 - DNA, 22 bp, Homo sapiens
tgctcctgggcattagcaaggc

SEQ ID NO: 5529932 - DNA, 13 bp, Homo sapiens
tgctcctggggag

SEQ ID NO: 5529933 - DNA, 23 bp, Homo sapiens
tgctcctggggagaaagaggggc

SEQ ID NO: 5529934 - DNA, 21 bp, Homo sapiens
tgctcctgtacgaacccctcc

SEQ ID NO: 5529935 - DNA, 12 bp, Homo sapiens
tgctcctgtgct

SEQ ID NO: 5529936 - DNA, 13 bp, Homo sapiens
tgctcctgtgctc

SEQ ID NO: 5529937 - DNA, 23 bp, Homo sapiens
tgctcctgtggcggtgcagtggc

SEQ ID NO: 5529938 - DNA, 17 bp, Homo sapiens
tgctcctgttgttactg

SEQ ID NO: 5529939 - DNA, 16 bp, Homo sapiens
tgctcctgtttaactc

SEQ ID NO: 5529940 - DNA, 18 bp, Homo sapiens
tgctccttagctgccaag

SEQ ID NO: 5529941 - DNA, 17 bp, Homo sapiens
tgctccttcagttctgc

SEQ ID NO: 5529942 - DNA, 15 bp, Homo sapiens
tgctccttccccatc

SEQ ID NO: 5529943 - DNA, 12 bp, Homo sapiens
tgctccttcctg

SEQ ID NO: 5529944 - DNA, 13 bp, Homo sapiens
tgctccttcctgt

SEQ ID NO: 5529945 - DNA, 19 bp, Homo sapiens
tgctccttcctgtggcctc

SEQ ID NO: 5529946 - DNA, 15 bp, Homo sapiens
tgctccttgcctctg

SEQ ID NO: 5529947 - DNA, 22 bp, Homo sapiens
tgctccttggcacccccatgct

SEQ ID NO: 5529948 - DNA, 23 bp, Homo sapiens
tgctccttggcacccccatgctg

SEQ ID NO: 5529949 - DNA, 21 bp, Homo sapiens
tgctccttggcctagtcagat

SEQ ID NO: 5529950 - DNA, 12 bp, Homo sapiens
tgctccttggct

SEQ ID NO: 5529951 - DNA, 15 bp, Homo sapiens
tgctccttggcttac

SEQ ID NO: 5529952 - DNA, 15 bp, Homo sapiens
tgctccttgggccct

SEQ ID NO: 5529953 - DNA, 18 bp, Homo sapiens
tgctccttgggccctttg

SEQ ID NO: 5529954 - DNA, 16 bp, Homo sapiens
tgctccttgttcctag

SEQ ID NO: 5529955 - DNA, 23 bp, Homo sapiens
tgctccttgttcctagagtagag

SEQ ID NO: 5529956 - DNA, 16 bp, Homo sapiens
tgctcctttaccctct

SEQ ID NO: 5529957 - DNA, 17 bp, Homo sapiens
tgctcctttccatcagc

SEQ ID NO: 5529958 - DNA, 18 bp, Homo sapiens
tgctcctttctgcccagc

SEQ ID NO: 5529959 - DNA, 19 bp, Homo sapiens
tgctccttttgtatcttcc

SEQ ID NO: 5529960 - DNA, 21 bp, Homo sapiens
tgctccttttgtatcttcctt

SEQ ID NO: 5529961 - DNA, 13 bp, Homo sapiens
tgctcgaccttga

SEQ ID NO: 5529962 - DNA, 18 bp, Homo sapiens
tgctcgagtcacattctg

SEQ ID NO: 5529963 - DNA, 23 bp, Homo sapiens
tgctcgattattccctgtacaat

SEQ ID NO: 5529964 - DNA, 14 bp, Homo sapiens
tgctcgcccaggaa

SEQ ID NO: 5529965 - DNA, 23 bp, Homo sapiens
tgctcgcccctgttttttgtaga

SEQ ID NO: 5529966 - DNA, 19 bp, Homo sapiens
tgctcgccctgtgccctct

SEQ ID NO: 5529967 - DNA, 24 bp, Homo sapiens
tgctcgccttcggcctctcttgga

SEQ ID NO: 5529968 - DNA, 21 bp, Homo sapiens
tgctcgcgaaggtcccacagc

SEQ ID NO: 5529969 - DNA, 16 bp, Homo sapiens
tgctcgctctgcatga

SEQ ID NO: 5529970 - DNA, 13 bp, Homo sapiens
tgctcgctgttgc

SEQ ID NO: 5529971 - DNA, 17 bp, Homo sapiens
tgctcgcttctcctcca

SEQ ID NO: 5529972 - DNA, 18 bp, Homo sapiens
tgctcgcttttcctgccc

SEQ ID NO: 5529973 - DNA, 22 bp, Homo sapiens
tgctcggacacagttttgtctt

SEQ ID NO: 5529974 - DNA, 18 bp, Homo sapiens
tgctcggcaccgccagcc

SEQ ID NO: 5529975 - DNA, 15 bp, Homo sapiens
tgctcggccgtcttc

SEQ ID NO: 5529976 - DNA, 13 bp, Homo sapiens
tgctcggctactg

SEQ ID NO: 5529977 - DNA, 22 bp, Homo sapiens
tgctcggcttgatcacagctcc

SEQ ID NO: 5529978 - DNA, 14 bp, Homo sapiens
tgctcgggcccagg

SEQ ID NO: 5529979 - DNA, 21 bp, Homo sapiens
tgctgccacttaaaaagactt

SEQ ID NO: 5529980 - DNA, 23 bp, Homo sapiens
tgctgccagacactgagcttctg

SEQ ID NO: 5529981 - DNA, 13 bp, Homo sapiens
tgctgccagagaa

SEQ ID NO: 5529982 - DNA, 24 bp, Homo sapiens
tgctgccagagaagtctggtcaga

SEQ ID NO: 5529983 - DNA, 12 bp, Homo sapiens
tgctgccagctg

SEQ ID NO: 5529984 - DNA, 12 bp, Homo sapiens
tgctgccagctt

SEQ ID NO: 5529985 - DNA, 19 bp, Homo sapiens
tgctgccagcttcaggtga

SEQ ID NO: 5529986 - DNA, 23 bp, Homo sapiens
tgctgccaggcccggcatgaggc

SEQ ID NO: 5529987 - DNA, 14 bp, Homo sapiens
tgctgccagggctt

SEQ ID NO: 5529988 - DNA, 11 bp, Homo sapiens
tgctgccatcc

SEQ ID NO: 5529989 - DNA, 13 bp, Homo sapiens
tgctgccatccag

SEQ ID NO: 5529990 - DNA, 21 bp, Homo sapiens
tgctgccatccaggttcagct

SEQ ID NO: 5529991 - DNA, 22 bp, Homo sapiens
tgctgccatccaggttcagctt

SEQ ID NO: 5529992 - DNA, 21 bp, Homo sapiens
tgctgccatgacagaggctgc

SEQ ID NO: 5529993 - DNA, 23 bp, Homo sapiens
tgctgccatgacagaggctgcac

SEQ ID NO: 5529994 - DNA, 20 bp, Homo sapiens
tgctgccatgccactgccag

SEQ ID NO: 5529995 - DNA, 23 bp, Homo sapiens
tgctgccatgccactgccaggca

SEQ ID NO: 5529996 - DNA, 13 bp, Homo sapiens
tgctgccatgccc

SEQ ID NO: 5529997 - DNA, 19 bp, Homo sapiens
tgctgccattacagaggta

SEQ ID NO: 5529998 - DNA, 22 bp, Homo sapiens
tgctgcccacaacgtcccctca

SEQ ID NO: 5529999 - DNA, 14 bp, Homo sapiens
tgctgcccaccccc

SEQ ID NO: 5530000 - DNA, 18 bp, Homo sapiens
tgctgcccaccccctgct

SEQ ID NO: 5530001 - DNA, 24 bp, Homo sapiens
tgctgcccaccccctgctggtgcc

SEQ ID NO: 5530002 - DNA, 15 bp, Homo sapiens
tgctgcccacggcca

SEQ ID NO: 5530003 - DNA, 16 bp, Homo sapiens
tgctgcccacggccac

SEQ ID NO: 5530004 - DNA, 16 bp, Homo sapiens
tgctgcccagcctcca

SEQ ID NO: 5530005 - DNA, 15 bp, Homo sapiens
tgctgcccaggccac

SEQ ID NO: 5530006 - DNA, 19 bp, Homo sapiens
tgctgcccatgagcaagcc

SEQ ID NO: 5530007 - DNA, 16 bp, Homo sapiens
tgctgcccatgccacc

SEQ ID NO: 5530008 - DNA, 16 bp, Homo sapiens
tgctgcccatgtttca

SEQ ID NO: 5530009 - DNA, 17 bp, Homo sapiens
tgctgcccatgtttcaa

SEQ ID NO: 5530010 - DNA, 17 bp, Homo sapiens
tgctgccccacaacaca

SEQ ID NO: 5530011 - DNA, 15 bp, Homo sapiens
tgctgccccagctga

SEQ ID NO: 5530012 - DNA, 18 bp, Homo sapiens
tgctgccccatcagtgct

SEQ ID NO: 5530013 - DNA, 18 bp, Homo sapiens
tgctgccccatgaagcca

SEQ ID NO: 5530014 - DNA, 15 bp, Homo sapiens
tgctgcccccacccc

SEQ ID NO: 5530015 - DNA, 22 bp, Homo sapiens
tgctgcccccaccccggggacc

SEQ ID NO: 5530016 - DNA, 18 bp, Homo sapiens
tgctgccccgcttcccca

SEQ ID NO: 5530017 - DNA, 22 bp, Homo sapiens
tgctgccccgcttccccacaga

SEQ ID NO: 5530018 - DNA, 19 bp, Homo sapiens
tgctgcccctgtctggaag

SEQ ID NO: 5530019 - DNA, 15 bp, Homo sapiens
tgctgccccttgcaa

SEQ ID NO: 5530020 - DNA, 17 bp, Homo sapiens
tgctgccccttgcaagc

SEQ ID NO: 5530021 - DNA, 20 bp, Homo sapiens
tgctgccccttgcaagccat

SEQ ID NO: 5530022 - DNA, 23 bp, Homo sapiens
tgctgccccttgcaagccataac

SEQ ID NO: 5530023 - DNA, 16 bp, Homo sapiens
tgctgcccgtgaggag

SEQ ID NO: 5530024 - DNA, 18 bp, Homo sapiens
tgctgcccgtgaggaggg

SEQ ID NO: 5530025 - DNA, 13 bp, Homo sapiens
tgctgccctgggg

SEQ ID NO: 5530026 - DNA, 15 bp, Homo sapiens
tgctgccctggggca

SEQ ID NO: 5530027 - DNA, 15 bp, Homo sapiens
tgctgccctgttgcc

SEQ ID NO: 5530028 - DNA, 17 bp, Homo sapiens
tgctgcccttggtttct

SEQ ID NO: 5530029 - DNA, 19 bp, Homo sapiens
tgctgcccttggtttctgg

SEQ ID NO: 5530030 - DNA, 13 bp, Homo sapiens
tgctgccgagggc

SEQ ID NO: 5530031 - DNA, 15 bp, Homo sapiens
tgctgccgagggctg

SEQ ID NO: 5530032 - DNA, 17 bp, Homo sapiens
tgctgccgagggctggc

SEQ ID NO: 5530033 - DNA, 14 bp, Homo sapiens
tgctgccgccgccg

SEQ ID NO: 5530034 - DNA, 21 bp, Homo sapiens
tgctgccgcctcccagcctgg

SEQ ID NO: 5530035 - DNA, 17 bp, Homo sapiens
tgctgccggcacagctg

SEQ ID NO: 5530036 - DNA, 20 bp, Homo sapiens
tgctgccggcacagctggga

SEQ ID NO: 5530037 - DNA, 13 bp, Homo sapiens
tgctgcctaataa

SEQ ID NO: 5530038 - DNA, 22 bp, Homo sapiens
tgctgcctagaaacagacctgc

SEQ ID NO: 5530039 - DNA, 20 bp, Homo sapiens
tgctgcctaggttctgttac

SEQ ID NO: 5530040 - DNA, 23 bp, Homo sapiens
tgctgcctagtgctacagatgta

SEQ ID NO: 5530041 - DNA, 24 bp, Homo sapiens
tgctgcctcaggacccatccctgc

SEQ ID NO: 5530042 - DNA, 13 bp, Homo sapiens
tgctgcctcatgc

SEQ ID NO: 5530043 - DNA, 13 bp, Homo sapiens
tgctgcctcccca

SEQ ID NO: 5530044 - DNA, 14 bp, Homo sapiens
tgctgcctccccaa

SEQ ID NO: 5530045 - DNA, 13 bp, Homo sapiens
tgctgcctctgtg

SEQ ID NO: 5530046 - DNA, 15 bp, Homo sapiens
tgctgcctctgtgga

SEQ ID NO: 5530047 - DNA, 16 bp, Homo sapiens
tgctgcctctgtggaa

SEQ ID NO: 5530048 - DNA, 20 bp, Homo sapiens
tgctgcctctgtggaagaga

SEQ ID NO: 5530049 - DNA, 14 bp, Homo sapiens
tgctgcctgccatg

SEQ ID NO: 5530050 - DNA, 15 bp, Homo sapiens
tgctgcctgccatgt

SEQ ID NO: 5530051 - DNA, 13 bp, Homo sapiens
tgctgcctgcctg

SEQ ID NO: 5530052 - DNA, 20 bp, Homo sapiens
tgctgcctgctgagatgagg

SEQ ID NO: 5530053 - DNA, 18 bp, Homo sapiens
tgctgcctggccactgct

SEQ ID NO: 5530054 - DNA, 14 bp, Homo sapiens
tgctgcctgggtag

SEQ ID NO: 5530055 - DNA, 21 bp, Homo sapiens
tgctgcctgggtaggccccac

SEQ ID NO: 5530056 - DNA, 20 bp, Homo sapiens
tgctgcctgtatttgagaga

SEQ ID NO: 5530057 - DNA, 14 bp, Homo sapiens
tgctgcctgtcccc

SEQ ID NO: 5530058 - DNA, 15 bp, Homo sapiens
tgctgccttcaccct

SEQ ID NO: 5530059 - DNA, 16 bp, Homo sapiens
tgctgccttcaccctg

SEQ ID NO: 5530060 - DNA, 22 bp, Homo sapiens
tgctgccttcagggagacaggc

SEQ ID NO: 5530061 - DNA, 21 bp, Homo sapiens
tgctgccttctgacggccctg

SEQ ID NO: 5530062 - DNA, 17 bp, Homo sapiens
tgctgccttctggattc

SEQ ID NO: 5530063 - DNA, 17 bp, Homo sapiens
tgctgccttctgtctct

SEQ ID NO: 5530064 - DNA, 20 bp, Homo sapiens
tgctgccttgctcctagcag

SEQ ID NO: 5530065 - DNA, 12 bp, Homo sapiens
tgctgccttttc

SEQ ID NO: 5530066 - DNA, 14 bp, Homo sapiens
tgctgccttttctg

SEQ ID NO: 5530067 - DNA, 16 bp, Homo sapiens
tgctgcgccccaggcc

SEQ ID NO: 5530068 - DNA, 16 bp, Homo sapiens
tgctgcgcctgcaggc

SEQ ID NO: 5530069 - DNA, 19 bp, Homo sapiens
tgctgcgcctgcaggcaga

SEQ ID NO: 5530070 - DNA, 23 bp, Homo sapiens
tgctgcgcgtgtgggtctctggg

SEQ ID NO: 5530071 - DNA, 15 bp, Homo sapiens
tgctgcgctgtgctg

SEQ ID NO: 5530072 - DNA, 15 bp, Homo sapiens
tgctgcggagcaaga

SEQ ID NO: 5530073 - DNA, 16 bp, Homo sapiens
tgctgcggctgtgggc

SEQ ID NO: 5530074 - DNA, 17 bp, Homo sapiens
tgctgcggctgtgggcg

SEQ ID NO: 5530075 - DNA, 18 bp, Homo sapiens
tgctgcgggggagccagt

SEQ ID NO: 5530076 - DNA, 22 bp, Homo sapiens
tgctgcgggggagccagttctg

SEQ ID NO: 5530077 - DNA, 23 bp, Homo sapiens
tgctgcgggtgggtatcccacct

SEQ ID NO: 5530078 - DNA, 14 bp, Homo sapiens
tgctgcgtgcctgt

SEQ ID NO: 5530079 - DNA, 17 bp, Homo sapiens
tgctgctaagtcattgg

SEQ ID NO: 5530080 - DNA, 19 bp, Homo sapiens
tgctgctaatattttcctc

SEQ ID NO: 5530081 - DNA, 17 bp, Homo sapiens
tgctgctaatcttcagg

SEQ ID NO: 5530082 - DNA, 21 bp, Homo sapiens
tgctgctaattctttgcaaaa

SEQ ID NO: 5530083 - DNA, 15 bp, Homo sapiens
tgctgctaccagcgc

SEQ ID NO: 5530084 - DNA, 16 bp, Homo sapiens
tgctgctaccagcgcc

SEQ ID NO: 5530085 - DNA, 18 bp, Homo sapiens
tgctgctaccctccctgc

SEQ ID NO: 5530086 - DNA, 19 bp, Homo sapiens
tgctgctaccctccctgct

SEQ ID NO: 5530087 - DNA, 23 bp, Homo sapiens
tgctgctaccctccctgctgtcc

SEQ ID NO: 5530088 - DNA, 15 bp, Homo sapiens
tgctgctacttaatt

SEQ ID NO: 5530089 - DNA, 12 bp, Homo sapiens
tgctgctagaac

SEQ ID NO: 5530090 - DNA, 14 bp, Homo sapiens
tgctgctagatctt

SEQ ID NO: 5530091 - DNA, 15 bp, Homo sapiens
tgctgctatgaaaat

SEQ ID NO: 5530092 - DNA, 22 bp, Homo sapiens
tgctgctatggacgacctccag

SEQ ID NO: 5530093 - DNA, 18 bp, Homo sapiens
tgctgctattgctgtctg

SEQ ID NO: 5530094 - DNA, 17 bp, Homo sapiens
tgctgctattttaactt

SEQ ID NO: 5530095 - DNA, 24 bp, Homo sapiens
tgctgctcaccctcctagcctgct

SEQ ID NO: 5530096 - DNA, 22 bp, Homo sapiens
tgctgctcactcccgctgagcc

SEQ ID NO: 5530097 - DNA, 18 bp, Homo sapiens
tgctgctcaggcccatgc

SEQ ID NO: 5530098 - DNA, 19 bp, Homo sapiens
tgctgctcatactggtctc

SEQ ID NO: 5530099 - DNA, 18 bp, Homo sapiens
tgctgctcattccacact

SEQ ID NO: 5530100 - DNA, 20 bp, Homo sapiens
tgctgctcattccacactgt

SEQ ID NO: 5530101 - DNA, 21 bp, Homo sapiens
tgctgctccaccctcccccag

SEQ ID NO: 5530102 - DNA, 15 bp, Homo sapiens
tgctgctccatgttt

SEQ ID NO: 5530103 - DNA, 13 bp, Homo sapiens
tgctgctcccagc

SEQ ID NO: 5530104 - DNA, 14 bp, Homo sapiens
tgctgctcccagcc

SEQ ID NO: 5530105 - DNA, 14 bp, Homo sapiens
tgctgctccccacc

SEQ ID NO: 5530106 - DNA, 23 bp, Homo sapiens
tgctgctcccctaaagccaggct

SEQ ID NO: 5530107 - DNA, 16 bp, Homo sapiens
tgctgctccctcagac

SEQ ID NO: 5530108 - DNA, 24 bp, Homo sapiens
tgctgctccctttatcatgtgttt

SEQ ID NO: 5530109 - DNA, 15 bp, Homo sapiens
tgctgctccgcccgc

SEQ ID NO: 5530110 - DNA, 17 bp, Homo sapiens
tgctgctccgcccgctc

SEQ ID NO: 5530111 - DNA, 23 bp, Homo sapiens
tgctgctccggtttgggctgtct

SEQ ID NO: 5530112 - DNA, 19 bp, Homo sapiens
tgctgctcctccctctgac

SEQ ID NO: 5530113 - DNA, 13 bp, Homo sapiens
tgctgctcctcgg

SEQ ID NO: 5530114 - DNA, 21 bp, Homo sapiens
tgctgctcctcggccagagct

SEQ ID NO: 5530115 - DNA, 23 bp, Homo sapiens
tgctgctcctcggccagagctcc

SEQ ID NO: 5530116 - DNA, 18 bp, Homo sapiens
tgctgctcctctcttggg

SEQ ID NO: 5530117 - DNA, 21 bp, Homo sapiens
tgctgctcctctttcccctcc

SEQ ID NO: 5530118 - DNA, 17 bp, Homo sapiens
tgctgctccttagctgc

SEQ ID NO: 5530119 - DNA, 16 bp, Homo sapiens
tgctgctcgggaaggc

SEQ ID NO: 5530120 - DNA, 19 bp, Homo sapiens
tgctgctcgggaaggcctg

SEQ ID NO: 5530121 - DNA, 20 bp, Homo sapiens
tgctgctctaggcccacaag

SEQ ID NO: 5530122 - DNA, 17 bp, Homo sapiens
tgctgctctagggcagg

SEQ ID NO: 5530123 - DNA, 12 bp, Homo sapiens
tgctgctctcag

SEQ ID NO: 5530124 - DNA, 14 bp, Homo sapiens
tgctgctctcagcc

SEQ ID NO: 5530125 - DNA, 13 bp, Homo sapiens
tgctgctctcagg

SEQ ID NO: 5530126 - DNA, 22 bp, Homo sapiens
tgctgctctcccctcccagtct

SEQ ID NO: 5530127 - DNA, 13 bp, Homo sapiens
tgctgctctgacc

SEQ ID NO: 5530128 - DNA, 12 bp, Homo sapiens
tgctgctgaaga

SEQ ID NO: 5530129 - DNA, 13 bp, Homo sapiens
tgctgctgaagag

SEQ ID NO: 5530130 - DNA, 11 bp, Homo sapiens
tgctgctgaga

SEQ ID NO: 5530131 - DNA, 17 bp, Homo sapiens
tgctgctgagaacctgg

SEQ ID NO: 5530132 - DNA, 18 bp, Homo sapiens
tgctgctgccccagcgtc

SEQ ID NO: 5530133 - DNA, 19 bp, Homo sapiens
tgctgctgcccctgcacag

SEQ ID NO: 5530134 - DNA, 14 bp, Homo sapiens
tgctgctgcccctt

SEQ ID NO: 5530135 - DNA, 16 bp, Homo sapiens
tgctgctgccgccgcc

SEQ ID NO: 5530136 - DNA, 17 bp, Homo sapiens
tgctgctgcctctttcc

SEQ ID NO: 5530137 - DNA, 14 bp, Homo sapiens
tgctgctgcctgcc

SEQ ID NO: 5530138 - DNA, 13 bp, Homo sapiens
tgctgctgcctgg

SEQ ID NO: 5530139 - DNA, 13 bp, Homo sapiens
tgctgctgctctc

SEQ ID NO: 5530140 - DNA, 14 bp, Homo sapiens
tgctgctgctgcac

SEQ ID NO: 5530141 - DNA, 17 bp, Homo sapiens
tgctgctgctgccccag

SEQ ID NO: 5530142 - DNA, 17 bp, Homo sapiens
tgctgctgctgcgccct

SEQ ID NO: 5530143 - DNA, 13 bp, Homo sapiens
tgctgctgctgct

SEQ ID NO: 5530144 - DNA, 14 bp, Homo sapiens
tgctgctgctgctc

SEQ ID NO: 5530145 - DNA, 13 bp, Homo sapiens
tgctgctggacag

SEQ ID NO: 5530146 - DNA, 23 bp, Homo sapiens
tgctgctggacagtatcactgtc

SEQ ID NO: 5530147 - DNA, 11 bp, Homo sapiens
tgctgctggcc

SEQ ID NO: 5530148 - DNA, 13 bp, Homo sapiens
tgctgctggcctc

SEQ ID NO: 5530149 - DNA, 18 bp, Homo sapiens
tgctgctggcctccctcc

SEQ ID NO: 5530150 - DNA, 13 bp, Homo sapiens
tgctgctggctcc

SEQ ID NO: 5530151 - DNA, 13 bp, Homo sapiens
tgctgctgggaat

SEQ ID NO: 5530152 - DNA, 17 bp, Homo sapiens
tgctgctgggctcagtg

SEQ ID NO: 5530153 - DNA, 20 bp, Homo sapiens
tgctgctggggaagacagtg

SEQ ID NO: 5530154 - DNA, 22 bp, Homo sapiens
tgctgctggggaagacagtggc

SEQ ID NO: 5530155 - DNA, 12 bp, Homo sapiens
tgctgctggtgc

SEQ ID NO: 5530156 - DNA, 16 bp, Homo sapiens
tgctgctggtgcacag

SEQ ID NO: 5530157 - DNA, 9 bp, Homo sapiens
tgctgctgt

SEQ ID NO: 5530158 - DNA, 22 bp, Homo sapiens
tgctgtagctaggtatcttact

SEQ ID NO: 5530159 - DNA, 18 bp, Homo sapiens
tgctgtaggatctaaggc

SEQ ID NO: 5530160 - DNA, 13 bp, Homo sapiens
tgctgtataaaat

SEQ ID NO: 5530161 - DNA, 14 bp, Homo sapiens
tgctgtataaaatc

SEQ ID NO: 5530162 - DNA, 15 bp, Homo sapiens
tgctgtataaaatca

SEQ ID NO: 5530163 - DNA, 18 bp, Homo sapiens
tgctgtataaaatcagcc

SEQ ID NO: 5530164 - DNA, 18 bp, Homo sapiens
tgctgtatacaaacaggt

SEQ ID NO: 5530165 - DNA, 22 bp, Homo sapiens
tgctgtatatggaattctttta

SEQ ID NO: 5530166 - DNA, 20 bp, Homo sapiens
tgctgtatgctgatcatcgc

SEQ ID NO: 5530167 - DNA, 22 bp, Homo sapiens
tgctgtatggcccaggcagcct

SEQ ID NO: 5530168 - DNA, 14 bp, Homo sapiens
tgctgtatgtgagc

SEQ ID NO: 5530169 - DNA, 15 bp, Homo sapiens
tgctgtattcccata

SEQ ID NO: 5530170 - DNA, 21 bp, Homo sapiens
tgctgtatttatagtaaccat

SEQ ID NO: 5530171 - DNA, 14 bp, Homo sapiens
tgctgtatttcctg

SEQ ID NO: 5530172 - DNA, 23 bp, Homo sapiens
tgctgtatttcctgcttccctgt

SEQ ID NO: 5530173 - DNA, 16 bp, Homo sapiens
tgctgtatttctttgt

SEQ ID NO: 5530174 - DNA, 21 bp, Homo sapiens
tgctgtatttgaggaaactca

SEQ ID NO: 5530175 - DNA, 23 bp, Homo sapiens
tgctgtattttaaaagaatgatt

SEQ ID NO: 5530176 - DNA, 21 bp, Homo sapiens
tgctgtattttaacactttgt

SEQ ID NO: 5530177 - DNA, 14 bp, Homo sapiens
tgctgtattttctt

SEQ ID NO: 5530178 - DNA, 15 bp, Homo sapiens
tgctgtattttgata

SEQ ID NO: 5530179 - DNA, 15 bp, Homo sapiens
tgctgtatttttaca

SEQ ID NO: 5530180 - DNA, 21 bp, Homo sapiens
tgctgtcaataaatgacaccc

SEQ ID NO: 5530181 - DNA, 23 bp, Homo sapiens
tgctgtcaataaatgacacccag

SEQ ID NO: 5530182 - DNA, 23 bp, Homo sapiens
tgctgtcaatattggtgtactgt

SEQ ID NO: 5530183 - DNA, 21 bp, Homo sapiens
tgctgtcacaaaggagtgagt

SEQ ID NO: 5530184 - DNA, 16 bp, Homo sapiens
tgctgtcacatagttt

SEQ ID NO: 5530185 - DNA, 21 bp, Homo sapiens
tgctgtcacctcgctgggctc

SEQ ID NO: 5530186 - DNA, 16 bp, Homo sapiens
tgctgtcactggcaga

SEQ ID NO: 5530187 - DNA, 20 bp, Homo sapiens
tgctgtcactggcagagcac

SEQ ID NO: 5530188 - DNA, 19 bp, Homo sapiens
tgctgtcactttctctctt

SEQ ID NO: 5530189 - DNA, 22 bp, Homo sapiens
tgctgtcatgaaatcagcaaga

SEQ ID NO: 5530190 - DNA, 14 bp, Homo sapiens
tgctgtcatgccca

SEQ ID NO: 5530191 - DNA, 15 bp, Homo sapiens
tgctgtcatggtcct

SEQ ID NO: 5530192 - DNA, 15 bp, Homo sapiens
tgctgtcatgtgaat

SEQ ID NO: 5530193 - DNA, 13 bp, Homo sapiens
tgctgtcattgct

SEQ ID NO: 5530194 - DNA, 14 bp, Homo sapiens
tgctgtcattgctt

SEQ ID NO: 5530195 - DNA, 21 bp, Homo sapiens
tgctgtcattgtccatgccta

SEQ ID NO: 5530196 - DNA, 11 bp, Homo sapiens
tgctgtcattt

SEQ ID NO: 5530197 - DNA, 23 bp, Homo sapiens
tgctgtccaatttctattaaagg

SEQ ID NO: 5530198 - DNA, 15 bp, Homo sapiens
tgctgtccagacagc

SEQ ID NO: 5530199 - DNA, 19 bp, Homo sapiens
tgctgtccagacagcctgt

SEQ ID NO: 5530200 - DNA, 13 bp, Homo sapiens
tgctgtccaggca

SEQ ID NO: 5530201 - DNA, 16 bp, Homo sapiens
tgctgtccaggcagct

SEQ ID NO: 5530202 - DNA, 15 bp, Homo sapiens
tgctgtccagtgcct

SEQ ID NO: 5530203 - DNA, 17 bp, Homo sapiens
tgctgtccagtgcctac

SEQ ID NO: 5530204 - DNA, 17 bp, Homo sapiens
tgctgtcccctcttgcc

SEQ ID NO: 5530205 - DNA, 13 bp, Homo sapiens
tgctgtccctccc

SEQ ID NO: 5530206 - DNA, 13 bp, Homo sapiens
tgctgtccctcct

SEQ ID NO: 5530207 - DNA, 18 bp, Homo sapiens
tgctgtccctgcactgtg

SEQ ID NO: 5530208 - DNA, 15 bp, Homo sapiens
tgctgtccctgtcag

SEQ ID NO: 5530209 - DNA, 17 bp, Homo sapiens
tgctgtcccttacgtga

SEQ ID NO: 5530210 - DNA, 18 bp, Homo sapiens
tgctgtccggtggagatc

SEQ ID NO: 5530211 - DNA, 14 bp, Homo sapiens
tgctgtcctcaggt

SEQ ID NO: 5530212 - DNA, 18 bp, Homo sapiens
tgctgtcctcaggtggcc

SEQ ID NO: 5530213 - DNA, 18 bp, Homo sapiens
tgctgtcctctccccctt

SEQ ID NO: 5530214 - DNA, 16 bp, Homo sapiens
tgctgtcctgatctgt

SEQ ID NO: 5530215 - DNA, 18 bp, Homo sapiens
tgctgtcctgttttactg

SEQ ID NO: 5530216 - DNA, 13 bp, Homo sapiens
tgctgtccttggg

SEQ ID NO: 5530217 - DNA, 14 bp, Homo sapiens
tgctgtcggcacca

SEQ ID NO: 5530218 - DNA, 22 bp, Homo sapiens
tgctgtcgggaccacatctgtc

SEQ ID NO: 5530219 - DNA, 23 bp, Homo sapiens
tgctgtcgggcaagatagctcct

SEQ ID NO: 5530220 - DNA, 18 bp, Homo sapiens
tgctgtctaacctgtgac

SEQ ID NO: 5530221 - DNA, 14 bp, Homo sapiens
tgctgtctatgtgg

SEQ ID NO: 5530222 - DNA, 18 bp, Homo sapiens
tgctgtctccatgctgga

SEQ ID NO: 5530223 - DNA, 13 bp, Homo sapiens
tgctgtctctctg

SEQ ID NO: 5530224 - DNA, 14 bp, Homo sapiens
tgctgtctctctgg

SEQ ID NO: 5530225 - DNA, 15 bp, Homo sapiens
tgctgtctctctggg

SEQ ID NO: 5530226 - DNA, 15 bp, Homo sapiens
tgctgtctctgctcg

SEQ ID NO: 5530227 - DNA, 19 bp, Homo sapiens
tgctgtctctgctcgccct

SEQ ID NO: 5530228 - DNA, 13 bp, Homo sapiens
tgctgtctcttaa

SEQ ID NO: 5530229 - DNA, 18 bp, Homo sapiens
tgctgtctgaaaaagtgt

SEQ ID NO: 5530230 - DNA, 21 bp, Homo sapiens
tgctgtctgagtagtggccac

SEQ ID NO: 5530231 - DNA, 17 bp, Homo sapiens
tgctgtctgcagccttg

SEQ ID NO: 5530232 - DNA, 15 bp, Homo sapiens
tgctgtctggcacag

SEQ ID NO: 5530233 - DNA, 19 bp, Homo sapiens
tgctgtctggcacagcctg

SEQ ID NO: 5530234 - DNA, 22 bp, Homo sapiens
tgctgtctggtgaggtggccca

SEQ ID NO: 5530235 - DNA, 18 bp, Homo sapiens
tgctgtctgtgtgaggct

SEQ ID NO: 5530236 - DNA, 23 bp, Homo sapiens
tgctgtcttcagtctcacagaga

SEQ ID NO: 5530237 - DNA, 15 bp, Homo sapiens
tgctgtcttctccct

SEQ ID NO: 5530238 - DNA, 17 bp, Homo sapiens
tgctgtcttgccccagt

SEQ ID NO: 5530239 - DNA, 21 bp, Homo sapiens
tgctgtcttgccccagtttgg

SEQ ID NO: 5530240 - DNA, 12 bp, Homo sapiens
tgctgtgaaaaa

SEQ ID NO: 5530241 - DNA, 14 bp, Homo sapiens
tgctgtgaaacagt

SEQ ID NO: 5530242 - DNA, 16 bp, Homo sapiens
tgctgtgaaatgactg

SEQ ID NO: 5530243 - DNA, 18 bp, Homo sapiens
tgctgtgaaccctggggc

SEQ ID NO: 5530244 - DNA, 16 bp, Homo sapiens
tgctgtgaactttcat

SEQ ID NO: 5530245 - DNA, 22 bp, Homo sapiens
tgctgtgaatagtctgtgtgca

SEQ ID NO: 5530246 - DNA, 16 bp, Homo sapiens
tgctgtgaatctgaaa

SEQ ID NO: 5530247 - DNA, 21 bp, Homo sapiens
tgctgtgaatttgtgtaagga

SEQ ID NO: 5530248 - DNA, 21 bp, Homo sapiens
tgctgtgacaccccccttctg

SEQ ID NO: 5530249 - DNA, 23 bp, Homo sapiens
tgctgtgacaccccccttctgaa

SEQ ID NO: 5530250 - DNA, 18 bp, Homo sapiens
tgctgtgaccatttataa

SEQ ID NO: 5530251 - DNA, 13 bp, Homo sapiens
tgctgtgaggctg

SEQ ID NO: 5530252 - DNA, 18 bp, Homo sapiens
tgctgtgaggctgtcctg

SEQ ID NO: 5530253 - DNA, 17 bp, Homo sapiens
tgctgtgagggagggga

SEQ ID NO: 5530254 - DNA, 20 bp, Homo sapiens
tgctgtgatacgatgcttca

SEQ ID NO: 5530255 - DNA, 22 bp, Homo sapiens
tgctgtgatacgatgcttcaag

SEQ ID NO: 5530256 - DNA, 14 bp, Homo sapiens
tgctgtgcagctct

SEQ ID NO: 5530257 - DNA, 22 bp, Homo sapiens
tgctgtgccaaagcaggtcaga

SEQ ID NO: 5530258 - DNA, 17 bp, Homo sapiens
tgctgtgccaggactgt

SEQ ID NO: 5530259 - DNA, 23 bp, Homo sapiens
tgctgtgccaggactgtgactca

SEQ ID NO: 5530260 - DNA, 23 bp, Homo sapiens
tgctgtgccatgctgggccactg

SEQ ID NO: 5530261 - DNA, 12 bp, Homo sapiens
tgctgtgcccag

SEQ ID NO: 5530262 - DNA, 13 bp, Homo sapiens
tgctgtgcccagc

SEQ ID NO: 5530263 - DNA, 16 bp, Homo sapiens
tgctgtgcccagcctc

SEQ ID NO: 5530264 - DNA, 13 bp, Homo sapiens
tgctgtgccccac

SEQ ID NO: 5530265 - DNA, 12 bp, Homo sapiens
tgctgtgcccct

SEQ ID NO: 5530266 - DNA, 15 bp, Homo sapiens
tgctgtgcctcccaa

SEQ ID NO: 5530267 - DNA, 23 bp, Homo sapiens
tgctgtgcctcgcatcctatgct

SEQ ID NO: 5530268 - DNA, 19 bp, Homo sapiens
tgctgtgcctgctagagca

SEQ ID NO: 5530269 - DNA, 16 bp, Homo sapiens
tgctgtgcgcccaggg

SEQ ID NO: 5530270 - DNA, 21 bp, Homo sapiens
tgctgtgcgtggaaaaagacg

SEQ ID NO: 5530271 - DNA, 20 bp, Homo sapiens
tgctgtgctacgtgtgaaat

SEQ ID NO: 5530272 - DNA, 18 bp, Homo sapiens
tgctgtgctctttgaaga

SEQ ID NO: 5530273 - DNA, 14 bp, Homo sapiens
tgctgtgctgctca

SEQ ID NO: 5530274 - DNA, 15 bp, Homo sapiens
tgctgtgctgctcaa

SEQ ID NO: 5530275 - DNA, 13 bp, Homo sapiens
tgctgtgctggga

SEQ ID NO: 5530276 - DNA, 22 bp, Homo sapiens
tgctgtgctttatttgtgaaac

SEQ ID NO: 5530277 - DNA, 22 bp, Homo sapiens
tgctgtggacatgtgggtggag

SEQ ID NO: 5530278 - DNA, 16 bp, Homo sapiens
tgctgtggagtgaggt

SEQ ID NO: 5530279 - DNA, 21 bp, Homo sapiens
tgctgtggattttgtggcttc

SEQ ID NO: 5530280 - DNA, 17 bp, Homo sapiens
tgctgtggccaggaggt

SEQ ID NO: 5530281 - DNA, 19 bp, Homo sapiens
tgctgtggccaggcctgca

SEQ ID NO: 5530282 - DNA, 17 bp, Homo sapiens
tgctgtggccagggtga

SEQ ID NO: 5530283 - DNA, 15 bp, Homo sapiens
tgctgtggcccagtc

SEQ ID NO: 5530284 - DNA, 16 bp, Homo sapiens
tgctgtggcctgggca

SEQ ID NO: 5530285 - DNA, 13 bp, Homo sapiens
tgctgtggctcca

SEQ ID NO: 5530286 - DNA, 22 bp, Homo sapiens
tgctgtgggaacgagaggggaa

SEQ ID NO: 5530287 - DNA, 10 bp, Homo sapiens
tgctgtgggc

SEQ ID NO: 5530288 - DNA, 13 bp, Homo sapiens
tgctgtgggcagc

SEQ ID NO: 5530289 - DNA, 13 bp, Homo sapiens
tgctgtgggcctc

SEQ ID NO: 5530290 - DNA, 22 bp, Homo sapiens
tgctgtggggcgaattcatccc

SEQ ID NO: 5530291 - DNA, 23 bp, Homo sapiens
tgctgtggggctggtagctcagg

SEQ ID NO: 5530292 - DNA, 20 bp, Homo sapiens
tgctgtggggtatacagcat

SEQ ID NO: 5530293 - DNA, 16 bp, Homo sapiens
tgctgtggtctataaa

SEQ ID NO: 5530294 - DNA, 14 bp, Homo sapiens
tgctgtggtctctt

SEQ ID NO: 5530295 - DNA, 16 bp, Homo sapiens
tgctgtggtggggaga

SEQ ID NO: 5530296 - DNA, 16 bp, Homo sapiens
tgctgtggtgtgtccc

SEQ ID NO: 5530297 - DNA, 23 bp, Homo sapiens
tgctgtggtgtgtccccctctgt

SEQ ID NO: 5530298 - DNA, 12 bp, Homo sapiens
tgctgtgtaaaa

SEQ ID NO: 5530299 - DNA, 21 bp, Homo sapiens
tgctgtgtacaacaatgcttt

SEQ ID NO: 5530300 - DNA, 16 bp, Homo sapiens
tgctgtgtagctctgt

SEQ ID NO: 5530301 - DNA, 21 bp, Homo sapiens
tgctgtgtagttccctctgcc

SEQ ID NO: 5530302 - DNA, 15 bp, Homo sapiens
tgctgtgtctgcacc

SEQ ID NO: 5530303 - DNA, 19 bp, Homo sapiens
tgctgtgtcttcattttca

SEQ ID NO: 5530304 - DNA, 10 bp, Homo sapiens
tgctgtgtga

SEQ ID NO: 5530305 - DNA, 11 bp, Homo sapiens
tgctgtgtgaa

SEQ ID NO: 5530306 - DNA, 13 bp, Homo sapiens
tgctgtgtgacat

SEQ ID NO: 5530307 - DNA, 20 bp, Homo sapiens
tgctgtgtgaccctgggcaa

SEQ ID NO: 5530308 - DNA, 16 bp, Homo sapiens
tgctgtgtgagaccag

SEQ ID NO: 5530309 - DNA, 20 bp, Homo sapiens
tgctgtgtgagaccagggga

SEQ ID NO: 5530310 - DNA, 15 bp, Homo sapiens
tgctgtgtgagtgag

SEQ ID NO: 5530311 - DNA, 20 bp, Homo sapiens
tgctgtgtgcagagtataca

SEQ ID NO: 5530312 - DNA, 11 bp, Homo sapiens
tgctgtgtgcc

SEQ ID NO: 5530313 - DNA, 14 bp, Homo sapiens
tgctgtgtgcccaa

SEQ ID NO: 5530314 - DNA, 16 bp, Homo sapiens
tgctgtgtgccccact

SEQ ID NO: 5530315 - DNA, 21 bp, Homo sapiens
tgctgtgtgccccactccagc

SEQ ID NO: 5530316 - DNA, 21 bp, Homo sapiens
tgctgtgtgctttttttgtgt

SEQ ID NO: 5530317 - DNA, 11 bp, Homo sapiens
tgctgtgtggt

SEQ ID NO: 5530318 - DNA, 18 bp, Homo sapiens
tgctgtgtgtcccaggca

SEQ ID NO: 5530319 - DNA, 18 bp, Homo sapiens
tgctgtgtgtggcttctg

SEQ ID NO: 5530320 - DNA, 11 bp, Homo sapiens
tgctgtgttaa

SEQ ID NO: 5530321 - DNA, 18 bp, Homo sapiens
tgctgtgttaaataaacc

SEQ ID NO: 5530322 - DNA, 16 bp, Homo sapiens
tgctgtgtttaatttg

SEQ ID NO: 5530323 - DNA, 13 bp, Homo sapiens
tgctgtgtttatg

SEQ ID NO: 5530324 - DNA, 21 bp, Homo sapiens
tgctgtgtttgagctctgcag

SEQ ID NO: 5530325 - DNA, 13 bp, Homo sapiens
tgctgtgtttgct

SEQ ID NO: 5530326 - DNA, 23 bp, Homo sapiens
tgctgttaactgttaactatgac

SEQ ID NO: 5530327 - DNA, 13 bp, Homo sapiens
tgctgttaatatt

SEQ ID NO: 5530328 - DNA, 15 bp, Homo sapiens
tgctgttaatctgat

SEQ ID NO: 5530329 - DNA, 17 bp, Homo sapiens
tgctgttaatgtatact

SEQ ID NO: 5530330 - DNA, 18 bp, Homo sapiens
tgctgttacagttttctt

SEQ ID NO: 5530331 - DNA, 13 bp, Homo sapiens
tgctgttacatgc

SEQ ID NO: 5530332 - DNA, 21 bp, Homo sapiens
tgctgttacgtttgaagtctg

SEQ ID NO: 5530333 - DNA, 19 bp, Homo sapiens
tgctgttactgcttctctt

SEQ ID NO: 5530334 - DNA, 22 bp, Homo sapiens
tgctgttactgcttctctttgt

SEQ ID NO: 5530335 - DNA, 17 bp, Homo sapiens
tgctgttagaatatgtt

SEQ ID NO: 5530336 - DNA, 14 bp, Homo sapiens
tgctttaaatctta

SEQ ID NO: 5530337 - DNA, 16 bp, Homo sapiens
tgctttaaatcttaag

SEQ ID NO: 5530338 - DNA, 15 bp, Homo sapiens
tgctttaaattaaaa

SEQ ID NO: 5530339 - DNA, 18 bp, Homo sapiens
tgctttaaattaaaattt

SEQ ID NO: 5530340 - DNA, 21 bp, Homo sapiens
tgctttaaccaccccatctgc

SEQ ID NO: 5530341 - DNA, 11 bp, Homo sapiens
tgctttaatat

SEQ ID NO: 5530342 - DNA, 18 bp, Homo sapiens
tgctttaatataaatgca

SEQ ID NO: 5530343 - DNA, 22 bp, Homo sapiens
tgctttaatataaatgcaaata

SEQ ID NO: 5530344 - DNA, 12 bp, Homo sapiens
tgctttaatgag

SEQ ID NO: 5530345 - DNA, 12 bp, Homo sapiens
tgctttaattac

SEQ ID NO: 5530346 - DNA, 19 bp, Homo sapiens
tgctttaattgctttaaat

SEQ ID NO: 5530347 - DNA, 15 bp, Homo sapiens
tgctttaattttagc

SEQ ID NO: 5530348 - DNA, 19 bp, Homo sapiens
tgctttacaggatcatgta

SEQ ID NO: 5530349 - DNA, 18 bp, Homo sapiens
tgctttaccaaacagcaa

SEQ ID NO: 5530350 - DNA, 21 bp, Homo sapiens
tgctttaccaattgaagtaaa

SEQ ID NO: 5530351 - DNA, 14 bp, Homo sapiens
tgctttaccacaat

SEQ ID NO: 5530352 - DNA, 15 bp, Homo sapiens
tgctttacctttaaa

SEQ ID NO: 5530353 - DNA, 18 bp, Homo sapiens
tgctttacctttattaat

SEQ ID NO: 5530354 - DNA, 14 bp, Homo sapiens
tgctttagacttga

SEQ ID NO: 5530355 - DNA, 18 bp, Homo sapiens
tgctttagacttgaaaag

SEQ ID NO: 5530356 - DNA, 18 bp, Homo sapiens
tgctttagagaatgccac

SEQ ID NO: 5530357 - DNA, 13 bp, Homo sapiens
tgctttagagaca

SEQ ID NO: 5530358 - DNA, 14 bp, Homo sapiens
tgctttagagacag

SEQ ID NO: 5530359 - DNA, 21 bp, Homo sapiens
tgctttagatgtgtatacaga

SEQ ID NO: 5530360 - DNA, 19 bp, Homo sapiens
tgctttaggattgaagtgg

SEQ ID NO: 5530361 - DNA, 17 bp, Homo sapiens
tgctttaggctcacggc

SEQ ID NO: 5530362 - DNA, 18 bp, Homo sapiens
tgctttaggttgcttcag

SEQ ID NO: 5530363 - DNA, 13 bp, Homo sapiens
tgctttagtttca

SEQ ID NO: 5530364 - DNA, 14 bp, Homo sapiens
tgctttataaaaaa

SEQ ID NO: 5530365 - DNA, 20 bp, Homo sapiens
tgctttataatgtatacatt

SEQ ID NO: 5530366 - DNA, 22 bp, Homo sapiens
tgctttataccccatttgattt

SEQ ID NO: 5530367 - DNA, 16 bp, Homo sapiens
tgctttatcagaagca

SEQ ID NO: 5530368 - DNA, 15 bp, Homo sapiens
tgctttatccagcag

SEQ ID NO: 5530369 - DNA, 16 bp, Homo sapiens
tgctttatcttttcat

SEQ ID NO: 5530370 - DNA, 14 bp, Homo sapiens
tgctttatgctgaa

SEQ ID NO: 5530371 - DNA, 20 bp, Homo sapiens
tgctttatgtgggttatcat

SEQ ID NO: 5530372 - DNA, 18 bp, Homo sapiens
tgctttattaatgttttc

SEQ ID NO: 5530373 - DNA, 15 bp, Homo sapiens
tgctttattccagaa

SEQ ID NO: 5530374 - DNA, 17 bp, Homo sapiens
tgctttattccagaatg

SEQ ID NO: 5530375 - DNA, 15 bp, Homo sapiens
tgctttatttgcaaa

SEQ ID NO: 5530376 - DNA, 15 bp, Homo sapiens
tgctttatttgtgaa

SEQ ID NO: 5530377 - DNA, 15 bp, Homo sapiens
tgctttattttccct

SEQ ID NO: 5530378 - DNA, 19 bp, Homo sapiens
tgctttcaattacaaagca

SEQ ID NO: 5530379 - DNA, 14 bp, Homo sapiens
tgctttcaattgac

SEQ ID NO: 5530380 - DNA, 19 bp, Homo sapiens
tgctttcacttcccacctc

SEQ ID NO: 5530381 - DNA, 16 bp, Homo sapiens
tgctttcagatactgg

SEQ ID NO: 5530382 - DNA, 17 bp, Homo sapiens
tgctttcagatactgga

SEQ ID NO: 5530383 - DNA, 17 bp, Homo sapiens
tgctttcagtgcctgct

SEQ ID NO: 5530384 - DNA, 18 bp, Homo sapiens
tgctttcagtgcctgctg

SEQ ID NO: 5530385 - DNA, 21 bp, Homo sapiens
tgctttcagtgcctgctgttc

SEQ ID NO: 5530386 - DNA, 14 bp, Homo sapiens
tgctttcatccagc

SEQ ID NO: 5530387 - DNA, 14 bp, Homo sapiens
tgctttccaaacct

SEQ ID NO: 5530388 - DNA, 14 bp, Homo sapiens
tgctttccaaagcc

SEQ ID NO: 5530389 - DNA, 20 bp, Homo sapiens
tgctttccacacctggcact

SEQ ID NO: 5530390 - DNA, 15 bp, Homo sapiens
tgctttccatatttt

SEQ ID NO: 5530391 - DNA, 22 bp, Homo sapiens
tgctttccatatttttttcctt

SEQ ID NO: 5530392 - DNA, 19 bp, Homo sapiens
tgctttccattcgtgaaaa

SEQ ID NO: 5530393 - DNA, 15 bp, Homo sapiens
tgctttcccagagga

SEQ ID NO: 5530394 - DNA, 14 bp, Homo sapiens
tgctttcccctgtg

SEQ ID NO: 5530395 - DNA, 15 bp, Homo sapiens
tgctttcccctgtgg

SEQ ID NO: 5530396 - DNA, 13 bp, Homo sapiens
tgctttccctctt

SEQ ID NO: 5530397 - DNA, 15 bp, Homo sapiens
tgctttccctgaagc

SEQ ID NO: 5530398 - DNA, 16 bp, Homo sapiens
tgctttccctgaggaa

SEQ ID NO: 5530399 - DNA, 12 bp, Homo sapiens
tgctttcctccc

SEQ ID NO: 5530400 - DNA, 15 bp, Homo sapiens
tgctttcctccctgg

SEQ ID NO: 5530401 - DNA, 13 bp, Homo sapiens
tgctttcctctga

SEQ ID NO: 5530402 - DNA, 14 bp, Homo sapiens
tgctttccttttct

SEQ ID NO: 5530403 - DNA, 15 bp, Homo sapiens
tgctttccttttctc

SEQ ID NO: 5530404 - DNA, 18 bp, Homo sapiens
tgctttccttttctctgc

SEQ ID NO: 5530405 - DNA, 21 bp, Homo sapiens
tgctttcgaataaagtgaata

SEQ ID NO: 5530406 - DNA, 17 bp, Homo sapiens
tgctttcggttccagtt

SEQ ID NO: 5530407 - DNA, 21 bp, Homo sapiens
tgctttcgtccatgtttctca

SEQ ID NO: 5530408 - DNA, 12 bp, Homo sapiens
tgctttctagca

SEQ ID NO: 5530409 - DNA, 18 bp, Homo sapiens
tgctttctagcaaatatg

SEQ ID NO: 5530410 - DNA, 22 bp, Homo sapiens
tgctttctagcaaatatgctgt

SEQ ID NO: 5530411 - DNA, 21 bp, Homo sapiens
tgctttctatgctgtttgtag

SEQ ID NO: 5530412 - DNA, 21 bp, Homo sapiens
tgctttctccatttatttaaa

SEQ ID NO: 5530413 - DNA, 12 bp, Homo sapiens
tgctttctcccc

SEQ ID NO: 5530414 - DNA, 12 bp, Homo sapiens
tgctttctcctg

SEQ ID NO: 5530415 - DNA, 15 bp, Homo sapiens
tgctttctccttcac

SEQ ID NO: 5530416 - DNA, 20 bp, Homo sapiens
tgctttctcctttaattgta

SEQ ID NO: 5530417 - DNA, 22 bp, Homo sapiens
tgctttctcgtgggtcctttgg

SEQ ID NO: 5530418 - DNA, 16 bp, Homo sapiens
tgctttctctctagta

SEQ ID NO: 5530419 - DNA, 13 bp, Homo sapiens
tgctttctctctc

SEQ ID NO: 5530420 - DNA, 11 bp, Homo sapiens
tgctttctctt

SEQ ID NO: 5530421 - DNA, 14 bp, Homo sapiens
tgctttctctttca

SEQ ID NO: 5530422 - DNA, 21 bp, Homo sapiens
tgctttctgaagctttaccag

SEQ ID NO: 5530423 - DNA, 23 bp, Homo sapiens
tgctttctgaagctttaccagct

SEQ ID NO: 5530424 - DNA, 18 bp, Homo sapiens
tgctttctgaatgtagac

SEQ ID NO: 5530425 - DNA, 15 bp, Homo sapiens
tgctttctgaattgg

SEQ ID NO: 5530426 - DNA, 15 bp, Homo sapiens
tgctttctgatacat

SEQ ID NO: 5530427 - DNA, 19 bp, Homo sapiens
tgctttctgatacatctgt

SEQ ID NO: 5530428 - DNA, 13 bp, Homo sapiens
tgctttctgccct

SEQ ID NO: 5530429 - DNA, 14 bp, Homo sapiens
tgctttctgctcag

SEQ ID NO: 5530430 - DNA, 15 bp, Homo sapiens
tgctttctgctcagc

SEQ ID NO: 5530431 - DNA, 15 bp, Homo sapiens
tgctttctggtataa

SEQ ID NO: 5530432 - DNA, 14 bp, Homo sapiens
tgctttctgtggct

SEQ ID NO: 5530433 - DNA, 16 bp, Homo sapiens
tgctttctgttcatct

SEQ ID NO: 5530434 - DNA, 22 bp, Homo sapiens
tgctttctgttccaaattcagt

SEQ ID NO: 5530435 - DNA, 14 bp, Homo sapiens
tgctttctgtttct

SEQ ID NO: 5530436 - DNA, 17 bp, Homo sapiens
tgctttcttctctgcct

SEQ ID NO: 5530437 - DNA, 20 bp, Homo sapiens
tgctttcttctctgcctcct

SEQ ID NO: 5530438 - DNA, 22 bp, Homo sapiens
tgctttcttctttccagacccc

SEQ ID NO: 5530439 - DNA, 23 bp, Homo sapiens
tgctttcttgccacacagtgggc

SEQ ID NO: 5530440 - DNA, 18 bp, Homo sapiens
tgctttcttgtctttaga

SEQ ID NO: 5530441 - DNA, 22 bp, Homo sapiens
tgctttctttccgtcaccctgg

SEQ ID NO: 5530442 - DNA, 22 bp, Homo sapiens
tgctttctttggcctacattct

SEQ ID NO: 5530443 - DNA, 23 bp, Homo sapiens
tgctttctttggcctacattctt

SEQ ID NO: 5530444 - DNA, 18 bp, Homo sapiens
tgctttctttgtttggct

SEQ ID NO: 5530445 - DNA, 15 bp, Homo sapiens
tgctttgaaaatatt

SEQ ID NO: 5530446 - DNA, 21 bp, Homo sapiens
tgctttgaaacagaaaaatat

SEQ ID NO: 5530447 - DNA, 23 bp, Homo sapiens
tgctttgaaagccccagaaatca

SEQ ID NO: 5530448 - DNA, 18 bp, Homo sapiens
tgctttgaactttagttt

SEQ ID NO: 5530449 - DNA, 18 bp, Homo sapiens
tgctttgaataaatgtgt

SEQ ID NO: 5530450 - DNA, 20 bp, Homo sapiens
tgctttgaatgcatgtgtga

SEQ ID NO: 5530451 - DNA, 16 bp, Homo sapiens
tgctttgacgggccag

SEQ ID NO: 5530452 - DNA, 19 bp, Homo sapiens
tgctttgacgggccaggcc

SEQ ID NO: 5530453 - DNA, 18 bp, Homo sapiens
tgctttgactcacctgtt

SEQ ID NO: 5530454 - DNA, 17 bp, Homo sapiens
tgctttgagaaaacatt

SEQ ID NO: 5530455 - DNA, 18 bp, Homo sapiens
tgctttgagtccacgccc

SEQ ID NO: 5530456 - DNA, 12 bp, Homo sapiens
tgctttgatata

SEQ ID NO: 5530457 - DNA, 17 bp, Homo sapiens
tgctttgatatttcaat

SEQ ID NO: 5530458 - DNA, 18 bp, Homo sapiens
tgctttgattgttcatat

SEQ ID NO: 5530459 - DNA, 18 bp, Homo sapiens
tgctttgatttacagcaa

SEQ ID NO: 5530460 - DNA, 12 bp, Homo sapiens
tgctttgcattt

SEQ ID NO: 5530461 - DNA, 15 bp, Homo sapiens
tgctttgcattttga

SEQ ID NO: 5530462 - DNA, 15 bp, Homo sapiens
tgctttgccagagca

SEQ ID NO: 5530463 - DNA, 15 bp, Homo sapiens
tgctttgcccaagat

SEQ ID NO: 5530464 - DNA, 15 bp, Homo sapiens
tgctttgcccaggct

SEQ ID NO: 5530465 - DNA, 14 bp, Homo sapiens
tgctttgccccact

SEQ ID NO: 5530466 - DNA, 18 bp, Homo sapiens
tgctttgcctcgaaagtg

SEQ ID NO: 5530467 - DNA, 19 bp, Homo sapiens
tgctttgcctcgaaagtgt

SEQ ID NO: 5530468 - DNA, 20 bp, Homo sapiens
tgctttgcctcgaaagtgtc

SEQ ID NO: 5530469 - DNA, 12 bp, Homo sapiens
tgctttgctaga

SEQ ID NO: 5530470 - DNA, 22 bp, Homo sapiens
tgctttgctctcaaggcttgga

SEQ ID NO: 5530471 - DNA, 14 bp, Homo sapiens
tgctttgctcttgt

SEQ ID NO: 5530472 - DNA, 13 bp, Homo sapiens
tgctttgctgcta

SEQ ID NO: 5530473 - DNA, 15 bp, Homo sapiens
tgctttgctgctatg

SEQ ID NO: 5530474 - DNA, 21 bp, Homo sapiens
tgctttgctgctatgaaaatg

SEQ ID NO: 5530475 - DNA, 23 bp, Homo sapiens
tgctttgctggagtcctgttctc

SEQ ID NO: 5530476 - DNA, 23 bp, Homo sapiens
tgctttgctgtctggtgtagctc

SEQ ID NO: 5530477 - DNA, 15 bp, Homo sapiens
tgctttgctttgtag

SEQ ID NO: 5530478 - DNA, 14 bp, Homo sapiens
tgctttgcttttta

SEQ ID NO: 5530479 - DNA, 13 bp, Homo sapiens
tgctttggaaatc

SEQ ID NO: 5530480 - DNA, 18 bp, Homo sapiens
tgctttggatacacacat

SEQ ID NO: 5530481 - DNA, 24 bp, Homo sapiens
tgctttggatgattttttaagcag

SEQ ID NO: 5530482 - DNA, 17 bp, Homo sapiens
tgctttggcttacttgt

SEQ ID NO: 5530483 - DNA, 13 bp, Homo sapiens
tgctttgggaact

SEQ ID NO: 5530484 - DNA, 17 bp, Homo sapiens
tgctttgggattttctt

SEQ ID NO: 5530485 - DNA, 14 bp, Homo sapiens
tgctttgggctgcc

SEQ ID NO: 5530486 - DNA, 18 bp, Homo sapiens
tgctttgggctgccctgg

SEQ ID NO: 5530487 - DNA, 18 bp, Homo sapiens
tgctttgggctttgcagg

SEQ ID NO: 5530488 - DNA, 22 bp, Homo sapiens
tgctttgggctttgcaggctct

SEQ ID NO: 5530489 - DNA, 18 bp, Homo sapiens
tgctttggtctgtgttca

SEQ ID NO: 5530490 - DNA, 17 bp, Homo sapiens
tgctttggtcttgcccc

SEQ ID NO: 5530491 - DNA, 18 bp, Homo sapiens
tgctttggttaatacatc

SEQ ID NO: 5530492 - DNA, 22 bp, Homo sapiens
tgctttgtagagttttgtcatt

SEQ ID NO: 5530493 - DNA, 17 bp, Homo sapiens
tgctttgtagcttaaaa

SEQ ID NO: 5530494 - DNA, 11 bp, Homo sapiens
tgctttgtagg

SEQ ID NO: 5530495 - DNA, 18 bp, Homo sapiens
tgctttgtagtttgccca

SEQ ID NO: 5530496 - DNA, 21 bp, Homo sapiens
tgctttgtagtttgctttgct

SEQ ID NO: 5530497 - DNA, 17 bp, Homo sapiens
tgctttgtatcagtcag

SEQ ID NO: 5530498 - DNA, 19 bp, Homo sapiens
tgctttgtatccatgaggg

SEQ ID NO: 5530499 - DNA, 13 bp, Homo sapiens
tgctttgtccagg

SEQ ID NO: 5530500 - DNA, 11 bp, Homo sapiens
tgctttgtcta

SEQ ID NO: 5530501 - DNA, 14 bp, Homo sapiens
tgctttgtgaacaa

SEQ ID NO: 5530502 - DNA, 14 bp, Homo sapiens
tgctttgtgatttt

SEQ ID NO: 5530503 - DNA, 17 bp, Homo sapiens
tgctttgtgatttttgt

SEQ ID NO: 5530504 - DNA, 22 bp, Homo sapiens
tgctttgtgtctagggcagagt

SEQ ID NO: 5530505 - DNA, 22 bp, Homo sapiens
tgctttgttaaaaaaaaaaaga

SEQ ID NO: 5530506 - DNA, 20 bp, Homo sapiens
tgctttgttaccttaaaact

SEQ ID NO: 5530507 - DNA, 21 bp, Homo sapiens
tgctttgttaccttaaaacta

SEQ ID NO: 5530508 - DNA, 19 bp, Homo sapiens
tgctttgttctttatttgt

SEQ ID NO: 5530509 - DNA, 18 bp, Homo sapiens
tgctttgttgatttagat

SEQ ID NO: 5530510 - DNA, 13 bp, Homo sapiens
tgctttgttgcac

SEQ ID NO: 5530511 - DNA, 18 bp, Homo sapiens
tgctttgttgtgtgcctc

SEQ ID NO: 5530512 - DNA, 21 bp, Homo sapiens
tgctttgttgtgtgcctctag

SEQ ID NO: 5530513 - DNA, 15 bp, Homo sapiens
tgctttgttttctaa

SEQ ID NO: 5530514 - DNA, 23 bp, Homo sapiens
tgctttgttttggctgctctcca

SEQ ID NO: 5530515 - DNA, 22 bp, Homo sapiens
tggaacccagactcagacattg

SEQ ID NO: 5530516 - DNA, 16 bp, Homo sapiens
tggaaccccccaggcc

SEQ ID NO: 5530517 - DNA, 18 bp, Homo sapiens
tggaaccccccaggccct

SEQ ID NO: 5530518 - DNA, 19 bp, Homo sapiens
tggaacccttttggccccc

SEQ ID NO: 5530519 - DNA, 23 bp, Homo sapiens
tggaaccgcaggaagctgctccg

SEQ ID NO: 5530520 - DNA, 16 bp, Homo sapiens
tggaacctaatgggaa

SEQ ID NO: 5530521 - DNA, 16 bp, Homo sapiens
tggaacctcagcctgg

SEQ ID NO: 5530522 - DNA, 22 bp, Homo sapiens
tggaacctcattgctaccacag

SEQ ID NO: 5530523 - DNA, 13 bp, Homo sapiens
tggaacctccttt

SEQ ID NO: 5530524 - DNA, 20 bp, Homo sapiens
tggaacctctgtctcatcct

SEQ ID NO: 5530525 - DNA, 14 bp, Homo sapiens
tggaacctggaccc

SEQ ID NO: 5530526 - DNA, 20 bp, Homo sapiens
tggaacctggaccccagcct

SEQ ID NO: 5530527 - DNA, 14 bp, Homo sapiens
tggaacctggcagg

SEQ ID NO: 5530528 - DNA, 15 bp, Homo sapiens
tggaacctggcaggc

SEQ ID NO: 5530529 - DNA, 20 bp, Homo sapiens
tggaacctggcaggccctgc

SEQ ID NO: 5530530 - DNA, 22 bp, Homo sapiens
tggaacctggcaggccctgccc

SEQ ID NO: 5530531 - DNA, 14 bp, Homo sapiens
tggaacctgtctcc

SEQ ID NO: 5530532 - DNA, 17 bp, Homo sapiens
tggaaccttccctccaa

SEQ ID NO: 5530533 - DNA, 23 bp, Homo sapiens
tggaaccttctagaacacctgcc

SEQ ID NO: 5530534 - DNA, 14 bp, Homo sapiens
tggaaccttgctgt

SEQ ID NO: 5530535 - DNA, 16 bp, Homo sapiens
tggaaccttgctgtcc

SEQ ID NO: 5530536 - DNA, 18 bp, Homo sapiens
tggaaccttgctgtcctg

SEQ ID NO: 5530537 - DNA, 22 bp, Homo sapiens
tggaaccttgctgtcctgatct

SEQ ID NO: 5530538 - DNA, 16 bp, Homo sapiens
tggaacgaactttcca

SEQ ID NO: 5530539 - DNA, 14 bp, Homo sapiens
tggaacgcagttga

SEQ ID NO: 5530540 - DNA, 19 bp, Homo sapiens
tggaacgcagttgattcct

SEQ ID NO: 5530541 - DNA, 14 bp, Homo sapiens
tggaacgcgttgaa

SEQ ID NO: 5530542 - DNA, 15 bp, Homo sapiens
tggaacgcgttgaaa

SEQ ID NO: 5530543 - DNA, 24 bp, Homo sapiens
tggaacgggcatgggcctctctgg

SEQ ID NO: 5530544 - DNA, 21 bp, Homo sapiens
tggaacgtttttcctgttctt

SEQ ID NO: 5530545 - DNA, 22 bp, Homo sapiens
tggaactaaggactccaatgtc

SEQ ID NO: 5530546 - DNA, 14 bp, Homo sapiens
tggaactaataaat

SEQ ID NO: 5530547 - DNA, 23 bp, Homo sapiens
tggaactacattagtacacagca

SEQ ID NO: 5530548 - DNA, 17 bp, Homo sapiens
tggaactactgtacttt

SEQ ID NO: 5530549 - DNA, 20 bp, Homo sapiens
tggaactaggttttaataat

SEQ ID NO: 5530550 - DNA, 16 bp, Homo sapiens
tggaactcattcctgc

SEQ ID NO: 5530551 - DNA, 19 bp, Homo sapiens
tggaactcattcctgcctg

SEQ ID NO: 5530552 - DNA, 15 bp, Homo sapiens
tggaactccccaggg

SEQ ID NO: 5530553 - DNA, 18 bp, Homo sapiens
tggaactcgtgtctggca

SEQ ID NO: 5530554 - DNA, 16 bp, Homo sapiens
tggaactctagggata

SEQ ID NO: 5530555 - DNA, 15 bp, Homo sapiens
tggaactctatctgg

SEQ ID NO: 5530556 - DNA, 20 bp, Homo sapiens
tggaactctatctgggcctg

SEQ ID NO: 5530557 - DNA, 23 bp, Homo sapiens
tggaactctatctgggcctgggc

SEQ ID NO: 5530558 - DNA, 14 bp, Homo sapiens
tggaactctcgagc

SEQ ID NO: 5530559 - DNA, 13 bp, Homo sapiens
tggaactgaaggg

SEQ ID NO: 5530560 - DNA, 15 bp, Homo sapiens
tggaactgaaggggg

SEQ ID NO: 5530561 - DNA, 20 bp, Homo sapiens
tggaactgaagggggcggcc

SEQ ID NO: 5530562 - DNA, 19 bp, Homo sapiens
tggaactgcaactccagcg

SEQ ID NO: 5530563 - DNA, 19 bp, Homo sapiens
tggaactgcaatgaaagtc

SEQ ID NO: 5530564 - DNA, 13 bp, Homo sapiens
tggaactgccacc

SEQ ID NO: 5530565 - DNA, 14 bp, Homo sapiens
tggaactgccacct

SEQ ID NO: 5530566 - DNA, 17 bp, Homo sapiens
tggaactgccaccttgg

SEQ ID NO: 5530567 - DNA, 12 bp, Homo sapiens
tggaactgctgc

SEQ ID NO: 5530568 - DNA, 15 bp, Homo sapiens
tggaactgctgccac

SEQ ID NO: 5530569 - DNA, 18 bp, Homo sapiens
tggaactgctgctgaccc

SEQ ID NO: 5530570 - DNA, 20 bp, Homo sapiens
tggaactgctgctgacccct

SEQ ID NO: 5530571 - DNA, 16 bp, Homo sapiens
tggaactgtgtattta

SEQ ID NO: 5530572 - DNA, 15 bp, Homo sapiens
tggaactgtgtttca

SEQ ID NO: 5530573 - DNA, 23 bp, Homo sapiens
tggaactgtgtttcaaatggact

SEQ ID NO: 5530574 - DNA, 15 bp, Homo sapiens
tggaactgtttcctt

SEQ ID NO: 5530575 - DNA, 16 bp, Homo sapiens
tggaacttacattgtt

SEQ ID NO: 5530576 - DNA, 14 bp, Homo sapiens
tggaacttctaata

SEQ ID NO: 5530577 - DNA, 16 bp, Homo sapiens
tggaacttctaatata

SEQ ID NO: 5530578 - DNA, 13 bp, Homo sapiens
tggaacttgaact

SEQ ID NO: 5530579 - DNA, 15 bp, Homo sapiens
tggaacttgaactga

SEQ ID NO: 5530580 - DNA, 16 bp, Homo sapiens
tggaacttgaactgat

SEQ ID NO: 5530581 - DNA, 21 bp, Homo sapiens
tggaacttgagttattaaaat

SEQ ID NO: 5530582 - DNA, 21 bp, Homo sapiens
tggaactttagtgaaacataa

SEQ ID NO: 5530583 - DNA, 13 bp, Homo sapiens
tggaactttcata

SEQ ID NO: 5530584 - DNA, 20 bp, Homo sapiens
tggaactttctgttccctat

SEQ ID NO: 5530585 - DNA, 21 bp, Homo sapiens
tggaagaaaaaaaccacacaa

SEQ ID NO: 5530586 - DNA, 22 bp, Homo sapiens
tggaagaaaatatttttaaatg

SEQ ID NO: 5530587 - DNA, 17 bp, Homo sapiens
tggaagaaaatggaatt

SEQ ID NO: 5530588 - DNA, 18 bp, Homo sapiens
tggaagaaaatggaatta

SEQ ID NO: 5530589 - DNA, 21 bp, Homo sapiens
tggaagaaaatggaattactc

SEQ ID NO: 5530590 - DNA, 22 bp, Homo sapiens
tggaagaaaatggtttattttg

SEQ ID NO: 5530591 - DNA, 12 bp, Homo sapiens
tggaagaaacac

SEQ ID NO: 5530592 - DNA, 13 bp, Homo sapiens
tggaagaaacagg

SEQ ID NO: 5530593 - DNA, 21 bp, Homo sapiens
tggaagaaactaaaaatatag

SEQ ID NO: 5530594 - DNA, 12 bp, Homo sapiens
tggaagaaagaa

SEQ ID NO: 5530595 - DNA, 14 bp, Homo sapiens
tggaagaaagaagc

SEQ ID NO: 5530596 - DNA, 15 bp, Homo sapiens
tggaagaaagccctg

SEQ ID NO: 5530597 - DNA, 19 bp, Homo sapiens
tggaagaaagccctgtgct

SEQ ID NO: 5530598 - DNA, 12 bp, Homo sapiens
tggaagaaaggc

SEQ ID NO: 5530599 - DNA, 19 bp, Homo sapiens
tggaagaaaggctgtggaa

SEQ ID NO: 5530600 - DNA, 19 bp, Homo sapiens
tggaagaaatggctatgaa

SEQ ID NO: 5530601 - DNA, 18 bp, Homo sapiens
tggaagaagaaaggactg

SEQ ID NO: 5530602 - DNA, 21 bp, Homo sapiens
tggaagaagaaccaggcatgg

SEQ ID NO: 5530603 - DNA, 22 bp, Homo sapiens
tggaagaagaaccaggcatgga

SEQ ID NO: 5530604 - DNA, 15 bp, Homo sapiens
tggaagaagagggag

SEQ ID NO: 5530605 - DNA, 13 bp, Homo sapiens
tggaagaagggag

SEQ ID NO: 5530606 - DNA, 15 bp, Homo sapiens
tggaagaagggagaa

SEQ ID NO: 5530607 - DNA, 20 bp, Homo sapiens
tggaagaagggccaccctga

SEQ ID NO: 5530608 - DNA, 18 bp, Homo sapiens
tggaagaagttttttact

SEQ ID NO: 5530609 - DNA, 22 bp, Homo sapiens
tggaagaagttttttactttgg

SEQ ID NO: 5530610 - DNA, 23 bp, Homo sapiens
tggaagaataaaattgcctctct

SEQ ID NO: 5530611 - DNA, 16 bp, Homo sapiens
tggaagaattcatgat

SEQ ID NO: 5530612 - DNA, 15 bp, Homo sapiens
tggaagacacattga

SEQ ID NO: 5530613 - DNA, 13 bp, Homo sapiens
tggaagacacttc

SEQ ID NO: 5530614 - DNA, 16 bp, Homo sapiens
tggaagacacttcaga

SEQ ID NO: 5530615 - DNA, 17 bp, Homo sapiens
tggaagacacttcagat

SEQ ID NO: 5530616 - DNA, 17 bp, Homo sapiens
tggaagacacttgctga

SEQ ID NO: 5530617 - DNA, 13 bp, Homo sapiens
tggaagacagaga

SEQ ID NO: 5530618 - DNA, 12 bp, Homo sapiens
tggaagacagct

SEQ ID NO: 5530619 - DNA, 18 bp, Homo sapiens
tggaagacatatattata

SEQ ID NO: 5530620 - DNA, 23 bp, Homo sapiens
tggaagacatatattatatatag

SEQ ID NO: 5530621 - DNA, 13 bp, Homo sapiens
tggaagaccccac

SEQ ID NO: 5530622 - DNA, 22 bp, Homo sapiens
tggaagacctaaggcagacagg

SEQ ID NO: 5530623 - DNA, 22 bp, Homo sapiens
tggaagacttagatctgagccc

SEQ ID NO: 5530624 - DNA, 14 bp, Homo sapiens
tggaagagaatcac

SEQ ID NO: 5530625 - DNA, 14 bp, Homo sapiens
tggaagagagaaag

SEQ ID NO: 5530626 - DNA, 19 bp, Homo sapiens
tggaagagagaaagcatat

SEQ ID NO: 5530627 - DNA, 20 bp, Homo sapiens
tggaagagagattgggactg

SEQ ID NO: 5530628 - DNA, 21 bp, Homo sapiens
tggaagagagattgggactga

SEQ ID NO: 5530629 - DNA, 18 bp, Homo sapiens
tggaagagaggcacctgc

SEQ ID NO: 5530630 - DNA, 19 bp, Homo sapiens
tggaagagaggcacctgct

SEQ ID NO: 5530631 - DNA, 20 bp, Homo sapiens
tggaagagaggcacctgctg

SEQ ID NO: 5530632 - DNA, 21 bp, Homo sapiens
tggaagagaggcacctgctgg

SEQ ID NO: 5530633 - DNA, 12 bp, Homo sapiens
tggaagagcagc

SEQ ID NO: 5530634 - DNA, 20 bp, Homo sapiens
tggaagagcagcacctcctc

SEQ ID NO: 5530635 - DNA, 16 bp, Homo sapiens
tggaagagcagcctga

SEQ ID NO: 5530636 - DNA, 24 bp, Homo sapiens
tggaagagcccgccgtctgcaggg

SEQ ID NO: 5530637 - DNA, 17 bp, Homo sapiens
tggaagagctgagacct

SEQ ID NO: 5530638 - DNA, 15 bp, Homo sapiens
tggaagagctgggta

SEQ ID NO: 5530639 - DNA, 15 bp, Homo sapiens
tggaagaggaaaagg

SEQ ID NO: 5530640 - DNA, 16 bp, Homo sapiens
tggaagagggaggggc

SEQ ID NO: 5530641 - DNA, 17 bp, Homo sapiens
tggaagagggaggggcc

SEQ ID NO: 5530642 - DNA, 17 bp, Homo sapiens
tggaagataattttatg

SEQ ID NO: 5530643 - DNA, 18 bp, Homo sapiens
tggaagatattcctgagt

SEQ ID NO: 5530644 - DNA, 17 bp, Homo sapiens
tggaagatcattttgaa

SEQ ID NO: 5530645 - DNA, 21 bp, Homo sapiens
tggaagatcccctctcctgcc

SEQ ID NO: 5530646 - DNA, 13 bp, Homo sapiens
tggaagatcctgc

SEQ ID NO: 5530647 - DNA, 14 bp, Homo sapiens
tggaagatcctgtg

SEQ ID NO: 5530648 - DNA, 15 bp, Homo sapiens
tggaagatcctgtga

SEQ ID NO: 5530649 - DNA, 17 bp, Homo sapiens
tggaagatcctgtgagg

SEQ ID NO: 5530650 - DNA, 22 bp, Homo sapiens
tggaagatgcagaagcaataat

SEQ ID NO: 5530651 - DNA, 23 bp, Homo sapiens
tggaagatggtccgtgcccaggc

SEQ ID NO: 5530652 - DNA, 13 bp, Homo sapiens
tggaagattagag

SEQ ID NO: 5530653 - DNA, 22 bp, Homo sapiens
tggaagatttgcccatttacac

SEQ ID NO: 5530654 - DNA, 23 bp, Homo sapiens
tggaagatttgcccatttacact

SEQ ID NO: 5530655 - DNA, 16 bp, Homo sapiens
tggaagattttcattg

SEQ ID NO: 5530656 - DNA, 22 bp, Homo sapiens
tggaagattttggtaatgatgt

SEQ ID NO: 5530657 - DNA, 14 bp, Homo sapiens
tggaagcaaagtat

SEQ ID NO: 5530658 - DNA, 16 bp, Homo sapiens
tggaagcaaagtgctg

SEQ ID NO: 5530659 - DNA, 22 bp, Homo sapiens
tggaagcacaccaatcttactt

SEQ ID NO: 5530660 - DNA, 21 bp, Homo sapiens
tggaagcacagcctcggggat

SEQ ID NO: 5530661 - DNA, 12 bp, Homo sapiens
tggaagcagagc

SEQ ID NO: 5530662 - DNA, 13 bp, Homo sapiens
tggaagcagagca

SEQ ID NO: 5530663 - DNA, 14 bp, Homo sapiens
tggaagcagagcaa

SEQ ID NO: 5530664 - DNA, 13 bp, Homo sapiens
tggaagcagaggc

SEQ ID NO: 5530665 - DNA, 14 bp, Homo sapiens
tggaagcagaggcc

SEQ ID NO: 5530666 - DNA, 13 bp, Homo sapiens
tggaagcagcaag

SEQ ID NO: 5530667 - DNA, 19 bp, Homo sapiens
tggaagcagcaaggtgggg

SEQ ID NO: 5530668 - DNA, 19 bp, Homo sapiens
tggaagcaggttaaatgtt

SEQ ID NO: 5530669 - DNA, 18 bp, Homo sapiens
tggaagcagtgcccaggt

SEQ ID NO: 5530670 - DNA, 21 bp, Homo sapiens
tggaagcatggctgtctgcac

SEQ ID NO: 5530671 - DNA, 17 bp, Homo sapiens
tggaagcatgtaggaga

SEQ ID NO: 5530672 - DNA, 23 bp, Homo sapiens
tggaagcatgtttattctgttcc

SEQ ID NO: 5530673 - DNA, 14 bp, Homo sapiens
tggaagccaggact

SEQ ID NO: 5530674 - DNA, 14 bp, Homo sapiens
tggaagccccccac

SEQ ID NO: 5530675 - DNA, 17 bp, Homo sapiens
tggaagccctccttcca

SEQ ID NO: 5530676 - DNA, 17 bp, Homo sapiens
tggaagccggcggccca

SEQ ID NO: 5530677 - DNA, 17 bp, Homo sapiens
tggaagcctccacctgc

SEQ ID NO: 5530678 - DNA, 15 bp, Homo sapiens
tggaagcctgagcag

SEQ ID NO: 5530679 - DNA, 17 bp, Homo sapiens
tggaagcctgagcaggg

SEQ ID NO: 5530680 - DNA, 18 bp, Homo sapiens
tggaagctaatttgcatt

SEQ ID NO: 5530681 - DNA, 17 bp, Homo sapiens
tggaagctaccagagct

SEQ ID NO: 5530682 - DNA, 20 bp, Homo sapiens
tggaagctagacacatgaag

SEQ ID NO: 5530683 - DNA, 23 bp, Homo sapiens
tggaagctagacacatgaaggta

SEQ ID NO: 5530684 - DNA, 18 bp, Homo sapiens
tggaagctagctcccctc

SEQ ID NO: 5530685 - DNA, 21 bp, Homo sapiens
tggaagctctccgagctctgg

SEQ ID NO: 5530686 - DNA, 17 bp, Homo sapiens
tggaagctgagcaggcc

SEQ ID NO: 5530687 - DNA, 19 bp, Homo sapiens
tggaagctgattcccagag

SEQ ID NO: 5530688 - DNA, 16 bp, Homo sapiens
tggaagctggaagact

SEQ ID NO: 5530689 - DNA, 18 bp, Homo sapiens
tggaagctggaagactgt

SEQ ID NO: 5530690 - DNA, 18 bp, Homo sapiens
tggaagctgtttggaaaa

SEQ ID NO: 5530691 - DNA, 19 bp, Homo sapiens
tggaagctgtttggaaaag

SEQ ID NO: 5530692 - DNA, 16 bp, Homo sapiens
tggaccctgttgctaa

SEQ ID NO: 5530693 - DNA, 13 bp, Homo sapiens
tggacccttccat

SEQ ID NO: 5530694 - DNA, 22 bp, Homo sapiens
tggacccttctgaagcagagac

SEQ ID NO: 5530695 - DNA, 17 bp, Homo sapiens
tggaccgagtagaggca

SEQ ID NO: 5530696 - DNA, 17 bp, Homo sapiens
tggaccgagtggaccac

SEQ ID NO: 5530697 - DNA, 16 bp, Homo sapiens
tggaccgcttcccaga

SEQ ID NO: 5530698 - DNA, 22 bp, Homo sapiens
tggaccggagagtgggggtggg

SEQ ID NO: 5530699 - DNA, 18 bp, Homo sapiens
tggaccgggtgggcctgg

SEQ ID NO: 5530700 - DNA, 19 bp, Homo sapiens
tggaccgggtgggcctggc

SEQ ID NO: 5530701 - DNA, 23 bp, Homo sapiens
tggaccgggtgggcctggcctga

SEQ ID NO: 5530702 - DNA, 14 bp, Homo sapiens
tggacctagcctgg

SEQ ID NO: 5530703 - DNA, 15 bp, Homo sapiens
tggacctagcctgga

SEQ ID NO: 5530704 - DNA, 22 bp, Homo sapiens
tggacctagcctggatggcccc

SEQ ID NO: 5530705 - DNA, 13 bp, Homo sapiens
tggacctagcttg

SEQ ID NO: 5530706 - DNA, 15 bp, Homo sapiens
tggacctatctgtaa

SEQ ID NO: 5530707 - DNA, 18 bp, Homo sapiens
tggacctatgcagggagg

SEQ ID NO: 5530708 - DNA, 22 bp, Homo sapiens
tggacctatgtcctaaggacac

SEQ ID NO: 5530709 - DNA, 14 bp, Homo sapiens
tggacctattgcca

SEQ ID NO: 5530710 - DNA, 16 bp, Homo sapiens
tggacctcaggagggc

SEQ ID NO: 5530711 - DNA, 19 bp, Homo sapiens
tggacctccaggctccagc

SEQ ID NO: 5530712 - DNA, 13 bp, Homo sapiens
tggacctccaggg

SEQ ID NO: 5530713 - DNA, 20 bp, Homo sapiens
tggacctctactttccaggc

SEQ ID NO: 5530714 - DNA, 18 bp, Homo sapiens
tggacctctcttgtgagc

SEQ ID NO: 5530715 - DNA, 15 bp, Homo sapiens
tggacctctgacagc

SEQ ID NO: 5530716 - DNA, 17 bp, Homo sapiens
tggacctctgctctgag

SEQ ID NO: 5530717 - DNA, 18 bp, Homo sapiens
tggacctgaattctactg

SEQ ID NO: 5530718 - DNA, 13 bp, Homo sapiens
tggacctgaccag

SEQ ID NO: 5530719 - DNA, 18 bp, Homo sapiens
tggacctgagtcggcccc

SEQ ID NO: 5530720 - DNA, 19 bp, Homo sapiens
tggacctgcacttggcctc

SEQ ID NO: 5530721 - DNA, 11 bp, Homo sapiens
tggacctgccc

SEQ ID NO: 5530722 - DNA, 23 bp, Homo sapiens
tggacctgccccggacctacctc

SEQ ID NO: 5530723 - DNA, 18 bp, Homo sapiens
tggacctgcctcctgcct

SEQ ID NO: 5530724 - DNA, 19 bp, Homo sapiens
tggacctgcctcctgcctg

SEQ ID NO: 5530725 - DNA, 20 bp, Homo sapiens
tggacctgcctcctgcctgc

SEQ ID NO: 5530726 - DNA, 13 bp, Homo sapiens
tggacctggcagt

SEQ ID NO: 5530727 - DNA, 16 bp, Homo sapiens
tggacctggcccagtg

SEQ ID NO: 5530728 - DNA, 21 bp, Homo sapiens
tggacctgggacaagcaggcc

SEQ ID NO: 5530729 - DNA, 23 bp, Homo sapiens
tggacctgggggtagccccgccc

SEQ ID NO: 5530730 - DNA, 23 bp, Homo sapiens
tggacctgtatatttgtaaagct

SEQ ID NO: 5530731 - DNA, 14 bp, Homo sapiens
tggaccttcctgcc

SEQ ID NO: 5530732 - DNA, 18 bp, Homo sapiens
tggaccttctctccagag

SEQ ID NO: 5530733 - DNA, 18 bp, Homo sapiens
tggaccttgacagagcag

SEQ ID NO: 5530734 - DNA, 16 bp, Homo sapiens
tggaccttgagaccac

SEQ ID NO: 5530735 - DNA, 22 bp, Homo sapiens
tggacctttcctgaggaagagg

SEQ ID NO: 5530736 - DNA, 13 bp, Homo sapiens
tggaccttttaaa

SEQ ID NO: 5530737 - DNA, 22 bp, Homo sapiens
tggaccttttcccttgctgtac

SEQ ID NO: 5530738 - DNA, 14 bp, Homo sapiens
tggaccttttcttt

SEQ ID NO: 5530739 - DNA, 23 bp, Homo sapiens
tggacgcaccggcctggctgcag

SEQ ID NO: 5530740 - DNA, 17 bp, Homo sapiens
tggacgcagccacacag

SEQ ID NO: 5530741 - DNA, 20 bp, Homo sapiens
tggacgcagccacacagtgg

SEQ ID NO: 5530742 - DNA, 14 bp, Homo sapiens
tggacgcaggccct

SEQ ID NO: 5530743 - DNA, 15 bp, Homo sapiens
tggacgcaggccctg

SEQ ID NO: 5530744 - DNA, 16 bp, Homo sapiens
tggacgcaggccctgt

SEQ ID NO: 5530745 - DNA, 18 bp, Homo sapiens
tggacgcctggctccagg

SEQ ID NO: 5530746 - DNA, 17 bp, Homo sapiens
tggacgctgcagacccc

SEQ ID NO: 5530747 - DNA, 13 bp, Homo sapiens
tggacgctgccct

SEQ ID NO: 5530748 - DNA, 16 bp, Homo sapiens
tggacggaggtccccg

SEQ ID NO: 5530749 - DNA, 22 bp, Homo sapiens
tggacggcaggctcactgccag

SEQ ID NO: 5530750 - DNA, 23 bp, Homo sapiens
tggacggcaggctcactgccagg

SEQ ID NO: 5530751 - DNA, 23 bp, Homo sapiens
tggacggcgctgcctcaggcact

SEQ ID NO: 5530752 - DNA, 17 bp, Homo sapiens
tggacgggatgacctcc

SEQ ID NO: 5530753 - DNA, 18 bp, Homo sapiens
tggacgggatgacctcca

SEQ ID NO: 5530754 - DNA, 21 bp, Homo sapiens
tggacgggatgacctccagaa

SEQ ID NO: 5530755 - DNA, 16 bp, Homo sapiens
tggacggggactgggg

SEQ ID NO: 5530756 - DNA, 18 bp, Homo sapiens
tggacggggatggttccc

SEQ ID NO: 5530757 - DNA, 12 bp, Homo sapiens
tggacggggcgg

SEQ ID NO: 5530758 - DNA, 18 bp, Homo sapiens
tggacggtgctccaggca

SEQ ID NO: 5530759 - DNA, 19 bp, Homo sapiens
tggacggtgctccaggcag

SEQ ID NO: 5530760 - DNA, 20 bp, Homo sapiens
tggacggtgctccaggcagg

SEQ ID NO: 5530761 - DNA, 19 bp, Homo sapiens
tggacggtttctagcctct

SEQ ID NO: 5530762 - DNA, 14 bp, Homo sapiens
tggacgtctttctt

SEQ ID NO: 5530763 - DNA, 18 bp, Homo sapiens
tggacgtgaaatacttcg

SEQ ID NO: 5530764 - DNA, 14 bp, Homo sapiens
tggacgtgcactga

SEQ ID NO: 5530765 - DNA, 15 bp, Homo sapiens
tggacgtgcactgac

SEQ ID NO: 5530766 - DNA, 16 bp, Homo sapiens
tggacgtgcactgaca

SEQ ID NO: 5530767 - DNA, 17 bp, Homo sapiens
tggacgttcggggcatg

SEQ ID NO: 5530768 - DNA, 13 bp, Homo sapiens
tggactaaaagat

SEQ ID NO: 5530769 - DNA, 14 bp, Homo sapiens
tggactaaaagata

SEQ ID NO: 5530770 - DNA, 15 bp, Homo sapiens
tggactaaaagatat

SEQ ID NO: 5530771 - DNA, 22 bp, Homo sapiens
tggactaaaagatataagtgct

SEQ ID NO: 5530772 - DNA, 19 bp, Homo sapiens
tggactaaatatctgtcat

SEQ ID NO: 5530773 - DNA, 19 bp, Homo sapiens
tggactaacttgtctttgg

SEQ ID NO: 5530774 - DNA, 23 bp, Homo sapiens
tggactaagatgaaatgcactgt

SEQ ID NO: 5530775 - DNA, 23 bp, Homo sapiens
tggactaagtggaacgttctcta

SEQ ID NO: 5530776 - DNA, 20 bp, Homo sapiens
tggactaattattattttaa

SEQ ID NO: 5530777 - DNA, 12 bp, Homo sapiens
tggactacacaa

SEQ ID NO: 5530778 - DNA, 13 bp, Homo sapiens
tggactacacaat

SEQ ID NO: 5530779 - DNA, 14 bp, Homo sapiens
tggactacacaata

SEQ ID NO: 5530780 - DNA, 19 bp, Homo sapiens
tggactacacccaagcctg

SEQ ID NO: 5530781 - DNA, 20 bp, Homo sapiens
tggactacacccaagcctga

SEQ ID NO: 5530782 - DNA, 17 bp, Homo sapiens
tggactacctataaatg

SEQ ID NO: 5530783 - DNA, 13 bp, Homo sapiens
tggactagccaga

SEQ ID NO: 5530784 - DNA, 18 bp, Homo sapiens
tggactagccagaattct

SEQ ID NO: 5530785 - DNA, 14 bp, Homo sapiens
tggactagggcctc

SEQ ID NO: 5530786 - DNA, 13 bp, Homo sapiens
tggactagtgtcc

SEQ ID NO: 5530787 - DNA, 18 bp, Homo sapiens
tggactatagcagggctg

SEQ ID NO: 5530788 - DNA, 14 bp, Homo sapiens
tggactatctgtct

SEQ ID NO: 5530789 - DNA, 17 bp, Homo sapiens
tggactatctgtctggt

SEQ ID NO: 5530790 - DNA, 16 bp, Homo sapiens
tggactatgcacactt

SEQ ID NO: 5530791 - DNA, 17 bp, Homo sapiens
tggactatgcacacttt

SEQ ID NO: 5530792 - DNA, 15 bp, Homo sapiens
tggactattgcaata

SEQ ID NO: 5530793 - DNA, 19 bp, Homo sapiens
tggactcaatccctagggc

SEQ ID NO: 5530794 - DNA, 20 bp, Homo sapiens
tggactcacctcccccatct

SEQ ID NO: 5530795 - DNA, 12 bp, Homo sapiens
tggactcagaaa

SEQ ID NO: 5530796 - DNA, 15 bp, Homo sapiens
tggactcagcagtga

SEQ ID NO: 5530797 - DNA, 12 bp, Homo sapiens
tggactcagccc

SEQ ID NO: 5530798 - DNA, 12 bp, Homo sapiens
tggactcagcct

SEQ ID NO: 5530799 - DNA, 14 bp, Homo sapiens
tggactcagccttg

SEQ ID NO: 5530800 - DNA, 15 bp, Homo sapiens
tggactcagctctgt

SEQ ID NO: 5530801 - DNA, 15 bp, Homo sapiens
tggactcaggaactt

SEQ ID NO: 5530802 - DNA, 16 bp, Homo sapiens
tggactcaggaacttt

SEQ ID NO: 5530803 - DNA, 16 bp, Homo sapiens
tggactcaggatccag

SEQ ID NO: 5530804 - DNA, 17 bp, Homo sapiens
tggactcaggatccagt

SEQ ID NO: 5530805 - DNA, 21 bp, Homo sapiens
tggactcaggatccagtgaca

SEQ ID NO: 5530806 - DNA, 18 bp, Homo sapiens
tggactccagactctctg

SEQ ID NO: 5530807 - DNA, 15 bp, Homo sapiens
tggactccagatctg

SEQ ID NO: 5530808 - DNA, 20 bp, Homo sapiens
tggactccagcctgcctggc

SEQ ID NO: 5530809 - DNA, 23 bp, Homo sapiens
tggactccagcctgcctggcagg

SEQ ID NO: 5530810 - DNA, 13 bp, Homo sapiens
tggactccaggcc

SEQ ID NO: 5530811 - DNA, 15 bp, Homo sapiens
tggactccaggcctg

SEQ ID NO: 5530812 - DNA, 12 bp, Homo sapiens
tggactcccctc

SEQ ID NO: 5530813 - DNA, 20 bp, Homo sapiens
tggactccctccccacccca

SEQ ID NO: 5530814 - DNA, 19 bp, Homo sapiens
tggactccgaggtggttca

SEQ ID NO: 5530815 - DNA, 21 bp, Homo sapiens
tggactccgaggtggttcaga

SEQ ID NO: 5530816 - DNA, 17 bp, Homo sapiens
tggactccggccctcct

SEQ ID NO: 5530817 - DNA, 14 bp, Homo sapiens
tggactcctctgtc

SEQ ID NO: 5530818 - DNA, 15 bp, Homo sapiens
tggactcctctgtcc

SEQ ID NO: 5530819 - DNA, 18 bp, Homo sapiens
tggactcctgccaccagc

SEQ ID NO: 5530820 - DNA, 19 bp, Homo sapiens
tggactcctgccaccagca

SEQ ID NO: 5530821 - DNA, 16 bp, Homo sapiens
tggactcgcctgtaat

SEQ ID NO: 5530822 - DNA, 16 bp, Homo sapiens
tggactctaaagacca

SEQ ID NO: 5530823 - DNA, 21 bp, Homo sapiens
tggactctaaagaccaaactt

SEQ ID NO: 5530824 - DNA, 14 bp, Homo sapiens
tggactctaaagtc

SEQ ID NO: 5530825 - DNA, 19 bp, Homo sapiens
tggactctaagctggagct

SEQ ID NO: 5530826 - DNA, 22 bp, Homo sapiens
tggactctaagctggagctctt

SEQ ID NO: 5530827 - DNA, 17 bp, Homo sapiens
tggactctacactgtga

SEQ ID NO: 5530828 - DNA, 21 bp, Homo sapiens
tggactctacactgtgaactt

SEQ ID NO: 5530829 - DNA, 13 bp, Homo sapiens
tggactctcaggg

SEQ ID NO: 5530830 - DNA, 20 bp, Homo sapiens
tggactctcagtctctgagc

SEQ ID NO: 5530831 - DNA, 21 bp, Homo sapiens
tggactctcccctcttatgta

SEQ ID NO: 5530832 - DNA, 13 bp, Homo sapiens
tggactctctgac

SEQ ID NO: 5530833 - DNA, 20 bp, Homo sapiens
tggactctctgacaaagtgg

SEQ ID NO: 5530834 - DNA, 15 bp, Homo sapiens
tggactctctgcctg

SEQ ID NO: 5530835 - DNA, 16 bp, Homo sapiens
tggactctctgcctgc

SEQ ID NO: 5530836 - DNA, 17 bp, Homo sapiens
tggactctctgcctgct

SEQ ID NO: 5530837 - DNA, 20 bp, Homo sapiens
tggactctctgcctgcttcc

SEQ ID NO: 5530838 - DNA, 16 bp, Homo sapiens
tggactctgcacatga

SEQ ID NO: 5530839 - DNA, 18 bp, Homo sapiens
tggactctgcacatgtct

SEQ ID NO: 5530840 - DNA, 19 bp, Homo sapiens
tggactctgcacatgtctt

SEQ ID NO: 5530841 - DNA, 18 bp, Homo sapiens
tggactctgcatcccagc

SEQ ID NO: 5530842 - DNA, 19 bp, Homo sapiens
tggactctgccccaatcgg

SEQ ID NO: 5530843 - DNA, 12 bp, Homo sapiens
tggactctggac

SEQ ID NO: 5530844 - DNA, 14 bp, Homo sapiens
tggactctggactg

SEQ ID NO: 5530845 - DNA, 15 bp, Homo sapiens
tggactctgtgctca

SEQ ID NO: 5530846 - DNA, 19 bp, Homo sapiens
tggactctgtggggccaca

SEQ ID NO: 5530847 - DNA, 14 bp, Homo sapiens
tggactctgtgtga

SEQ ID NO: 5530848 - DNA, 13 bp, Homo sapiens
tggactcttcaaa

SEQ ID NO: 5530849 - DNA, 21 bp, Homo sapiens
tggactcttcaaaaactgttt

SEQ ID NO: 5530850 - DNA, 18 bp, Homo sapiens
tggactcttctcggctca

SEQ ID NO: 5530851 - DNA, 20 bp, Homo sapiens
tggactcttctcggctcagg

SEQ ID NO: 5530852 - DNA, 22 bp, Homo sapiens
tggactcttctcggctcaggct

SEQ ID NO: 5530853 - DNA, 12 bp, Homo sapiens
tggactcttgct

SEQ ID NO: 5530854 - DNA, 14 bp, Homo sapiens
tggactgaagttat

SEQ ID NO: 5530855 - DNA, 23 bp, Homo sapiens
tggactgacagcatgtgccctcc

SEQ ID NO: 5530856 - DNA, 16 bp, Homo sapiens
tggactgaccctgcag

SEQ ID NO: 5530857 - DNA, 19 bp, Homo sapiens
tggactgacctggtccaca

SEQ ID NO: 5530858 - DNA, 21 bp, Homo sapiens
tggactgactaccagctaact

SEQ ID NO: 5530859 - DNA, 14 bp, Homo sapiens
tggactgagcggcc

SEQ ID NO: 5530860 - DNA, 17 bp, Homo sapiens
tggactgagctggggga

SEQ ID NO: 5530861 - DNA, 14 bp, Homo sapiens
tggactgaggcctg

SEQ ID NO: 5530862 - DNA, 15 bp, Homo sapiens
tggactgaggcctga

SEQ ID NO: 5530863 - DNA, 23 bp, Homo sapiens
tggactgagggggcctggatgcc

SEQ ID NO: 5530864 - DNA, 19 bp, Homo sapiens
tggactgagtgggaagccc

SEQ ID NO: 5530865 - DNA, 15 bp, Homo sapiens
tggactgatgctttt

SEQ ID NO: 5530866 - DNA, 17 bp, Homo sapiens
tggactgatggttgctt

SEQ ID NO: 5530867 - DNA, 14 bp, Homo sapiens
tggactgcacaggc

SEQ ID NO: 5530868 - DNA, 13 bp, Homo sapiens
tggactgcagaag

SEQ ID NO: 5530869 - DNA, 20 bp, Homo sapiens
tggactgcagtcggcatgcc

SEQ ID NO: 5530870 - DNA, 13 bp, Homo sapiens
tggactgcatggg

SEQ ID NO: 5530871 - DNA, 18 bp, Homo sapiens
tggaggagagagccttgg

SEQ ID NO: 5530872 - DNA, 22 bp, Homo sapiens
tggaggagagagccttgggagc

SEQ ID NO: 5530873 - DNA, 16 bp, Homo sapiens
tggaggagagcctggt

SEQ ID NO: 5530874 - DNA, 20 bp, Homo sapiens
tggaggagcaaaggctgaga

SEQ ID NO: 5530875 - DNA, 22 bp, Homo sapiens
tggaggagcagcttccttctgg

SEQ ID NO: 5530876 - DNA, 20 bp, Homo sapiens
tggaggagcagtgcaggcac

SEQ ID NO: 5530877 - DNA, 12 bp, Homo sapiens
tggaggagccca

SEQ ID NO: 5530878 - DNA, 19 bp, Homo sapiens
tggaggagcccaggccagg

SEQ ID NO: 5530879 - DNA, 22 bp, Homo sapiens
tggaggagcccaggccaggact

SEQ ID NO: 5530880 - DNA, 23 bp, Homo sapiens
tggaggagcccaggccaggactc

SEQ ID NO: 5530881 - DNA, 14 bp, Homo sapiens
tggaggagctgagg

SEQ ID NO: 5530882 - DNA, 16 bp, Homo sapiens
tggaggagctgaggga

SEQ ID NO: 5530883 - DNA, 17 bp, Homo sapiens
tggaggagctggcctgt

SEQ ID NO: 5530884 - DNA, 18 bp, Homo sapiens
tggaggagctggcctgtg

SEQ ID NO: 5530885 - DNA, 14 bp, Homo sapiens
tggaggaggaaggc

SEQ ID NO: 5530886 - DNA, 21 bp, Homo sapiens
tggaggaggaaggcaagaggg

SEQ ID NO: 5530887 - DNA, 12 bp, Homo sapiens
tggaggaggagg

SEQ ID NO: 5530888 - DNA, 17 bp, Homo sapiens
tggaggaggaggaggag

SEQ ID NO: 5530889 - DNA, 23 bp, Homo sapiens
tggaggaggaggaggaggaggaa

SEQ ID NO: 5530890 - DNA, 14 bp, Homo sapiens
tggaggaggaggca

SEQ ID NO: 5530891 - DNA, 12 bp, Homo sapiens
tggaggaggcct

SEQ ID NO: 5530892 - DNA, 15 bp, Homo sapiens
tggaggaggcctggg

SEQ ID NO: 5530893 - DNA, 23 bp, Homo sapiens
tggaggaggcctgggggcaggga

SEQ ID NO: 5530894 - DNA, 16 bp, Homo sapiens
tggaggaggggaagct

SEQ ID NO: 5530895 - DNA, 19 bp, Homo sapiens
tggaggaggggaagctggg

SEQ ID NO: 5530896 - DNA, 20 bp, Homo sapiens
tggaggaggtgtcccaagct

SEQ ID NO: 5530897 - DNA, 14 bp, Homo sapiens
tggaggatggacga

SEQ ID NO: 5530898 - DNA, 17 bp, Homo sapiens
tggaggatggacgagtg

SEQ ID NO: 5530899 - DNA, 18 bp, Homo sapiens
tggaggatggtgtcctga

SEQ ID NO: 5530900 - DNA, 21 bp, Homo sapiens
tggaggatggtgtcctgaggc

SEQ ID NO: 5530901 - DNA, 13 bp, Homo sapiens
tggaggattgcta

SEQ ID NO: 5530902 - DNA, 15 bp, Homo sapiens
tggaggattgctgcc

SEQ ID NO: 5530903 - DNA, 18 bp, Homo sapiens
tggaggattgctgccaga

SEQ ID NO: 5530904 - DNA, 19 bp, Homo sapiens
tggaggattgctgccagag

SEQ ID NO: 5530905 - DNA, 20 bp, Homo sapiens
tggaggattgctgccagaga

SEQ ID NO: 5530906 - DNA, 22 bp, Homo sapiens
tggaggattgctgccagagaag

SEQ ID NO: 5530907 - DNA, 23 bp, Homo sapiens
tggaggatttcctacccccgtcc

SEQ ID NO: 5530908 - DNA, 17 bp, Homo sapiens
tggaggcaaaggcctgg

SEQ ID NO: 5530909 - DNA, 16 bp, Homo sapiens
tggaggcacgcaccac

SEQ ID NO: 5530910 - DNA, 14 bp, Homo sapiens
tggaggcagactcg

SEQ ID NO: 5530911 - DNA, 14 bp, Homo sapiens
tggaggcagagacc

SEQ ID NO: 5530912 - DNA, 21 bp, Homo sapiens
tggaggcagagacctccaata

SEQ ID NO: 5530913 - DNA, 14 bp, Homo sapiens
tggaggcagatgcc

SEQ ID NO: 5530914 - DNA, 23 bp, Homo sapiens
tggaggcagatgcccttgctggg

SEQ ID NO: 5530915 - DNA, 21 bp, Homo sapiens
tggaggcagatgtggggctga

SEQ ID NO: 5530916 - DNA, 23 bp, Homo sapiens
tggaggcaggctccccctgcctt

SEQ ID NO: 5530917 - DNA, 21 bp, Homo sapiens
tggaggcaggggacaagggag

SEQ ID NO: 5530918 - DNA, 14 bp, Homo sapiens
tggaggcattgttt

SEQ ID NO: 5530919 - DNA, 21 bp, Homo sapiens
tggaggccaagcctgcagctt

SEQ ID NO: 5530920 - DNA, 21 bp, Homo sapiens
tggaggccaccaagctgctct

SEQ ID NO: 5530921 - DNA, 17 bp, Homo sapiens
tggaggccaccgggaca

SEQ ID NO: 5530922 - DNA, 18 bp, Homo sapiens
tggaggccagagtctccc

SEQ ID NO: 5530923 - DNA, 21 bp, Homo sapiens
tggaggccagagtctcccagt

SEQ ID NO: 5530924 - DNA, 15 bp, Homo sapiens
tggaggcccagttca

SEQ ID NO: 5530925 - DNA, 18 bp, Homo sapiens
tggaggccccaaccctgt

SEQ ID NO: 5530926 - DNA, 17 bp, Homo sapiens
tggaggcccctggagcc

SEQ ID NO: 5530927 - DNA, 16 bp, Homo sapiens
tggaggcccctgggct

SEQ ID NO: 5530928 - DNA, 15 bp, Homo sapiens
tggaggcccttttct

SEQ ID NO: 5530929 - DNA, 22 bp, Homo sapiens
tggaggcccttttctggctcct

SEQ ID NO: 5530930 - DNA, 21 bp, Homo sapiens
tggaggccgaggaccaccagc

SEQ ID NO: 5530931 - DNA, 11 bp, Homo sapiens
tggaggcctct

SEQ ID NO: 5530932 - DNA, 18 bp, Homo sapiens
tggaggcctgatgctgcc

SEQ ID NO: 5530933 - DNA, 19 bp, Homo sapiens
tggaggcctgatgctgccc

SEQ ID NO: 5530934 - DNA, 20 bp, Homo sapiens
tggaggcctgatgctgcccc

SEQ ID NO: 5530935 - DNA, 20 bp, Homo sapiens
tggaggcctggtctggagcc

SEQ ID NO: 5530936 - DNA, 21 bp, Homo sapiens
tggaggcctggtctggagccc

SEQ ID NO: 5530937 - DNA, 18 bp, Homo sapiens
tggaggccttccagctgc

SEQ ID NO: 5530938 - DNA, 21 bp, Homo sapiens
tggaggccttccagctgctgt

SEQ ID NO: 5530939 - DNA, 14 bp, Homo sapiens
tggaggcgagccag

SEQ ID NO: 5530940 - DNA, 16 bp, Homo sapiens
tggaggcgccttcctg

SEQ ID NO: 5530941 - DNA, 16 bp, Homo sapiens
tggaggctcctgtggt

SEQ ID NO: 5530942 - DNA, 11 bp, Homo sapiens
tggaggctctc

SEQ ID NO: 5530943 - DNA, 12 bp, Homo sapiens
tggaggctgccc

SEQ ID NO: 5530944 - DNA, 21 bp, Homo sapiens
tggaggctgccccattgagat

SEQ ID NO: 5530945 - DNA, 12 bp, Homo sapiens
tggaggctgctc

SEQ ID NO: 5530946 - DNA, 22 bp, Homo sapiens
tggaggctgctgccccctggct

SEQ ID NO: 5530947 - DNA, 23 bp, Homo sapiens
tggaggctgctgccccctggctt

SEQ ID NO: 5530948 - DNA, 17 bp, Homo sapiens
tggaggctgctgtgaaa

SEQ ID NO: 5530949 - DNA, 13 bp, Homo sapiens
tggaggctggacc

SEQ ID NO: 5530950 - DNA, 12 bp, Homo sapiens
tggaggctggca

SEQ ID NO: 5530951 - DNA, 22 bp, Homo sapiens
tggaggctgggtggccggccct

SEQ ID NO: 5530952 - DNA, 13 bp, Homo sapiens
tggaggctgtctt

SEQ ID NO: 5530953 - DNA, 17 bp, Homo sapiens
tggaggcttcctgcgtc

SEQ ID NO: 5530954 - DNA, 12 bp, Homo sapiens
tggagggaaagc

SEQ ID NO: 5530955 - DNA, 15 bp, Homo sapiens
tggagggaaagccag

SEQ ID NO: 5530956 - DNA, 19 bp, Homo sapiens
tggagggaaagccagcctg

SEQ ID NO: 5530957 - DNA, 22 bp, Homo sapiens
tggagggaaccaccagcgttcc

SEQ ID NO: 5530958 - DNA, 19 bp, Homo sapiens
tggagggaagacctgaaag

SEQ ID NO: 5530959 - DNA, 11 bp, Homo sapiens
tggagggaagc

SEQ ID NO: 5530960 - DNA, 16 bp, Homo sapiens
tggagggaaggacagt

SEQ ID NO: 5530961 - DNA, 21 bp, Homo sapiens
tggagggaatgaacctggagg

SEQ ID NO: 5530962 - DNA, 23 bp, Homo sapiens
tggagggacttttaatcagtgaa

SEQ ID NO: 5530963 - DNA, 24 bp, Homo sapiens
tggagggacttttaatcagtgaag

SEQ ID NO: 5530964 - DNA, 14 bp, Homo sapiens
tggagggagactga

SEQ ID NO: 5530965 - DNA, 11 bp, Homo sapiens
tggagggagag

SEQ ID NO: 5530966 - DNA, 11 bp, Homo sapiens
tggagggaggc

SEQ ID NO: 5530967 - DNA, 19 bp, Homo sapiens
tggagggaggccccagggg

SEQ ID NO: 5530968 - DNA, 17 bp, Homo sapiens
tggagggagggaagggt

SEQ ID NO: 5530969 - DNA, 18 bp, Homo sapiens
tggagggatcattttctg

SEQ ID NO: 5530970 - DNA, 20 bp, Homo sapiens
tggagggatgccacccagca

SEQ ID NO: 5530971 - DNA, 18 bp, Homo sapiens
tggagggattgaacacag

SEQ ID NO: 5530972 - DNA, 19 bp, Homo sapiens
tggagggattgaacacagg

SEQ ID NO: 5530973 - DNA, 21 bp, Homo sapiens
tggagggattgaacacaggca

SEQ ID NO: 5530974 - DNA, 22 bp, Homo sapiens
tggagggattgaacacaggcaa

SEQ ID NO: 5530975 - DNA, 16 bp, Homo sapiens
tggagggcaagccctg

SEQ ID NO: 5530976 - DNA, 12 bp, Homo sapiens
tggagggcacag

SEQ ID NO: 5530977 - DNA, 16 bp, Homo sapiens
tggagggcacagccct

SEQ ID NO: 5530978 - DNA, 12 bp, Homo sapiens
tggagggcactt

SEQ ID NO: 5530979 - DNA, 13 bp, Homo sapiens
tggagggcacttc

SEQ ID NO: 5530980 - DNA, 18 bp, Homo sapiens
tggagggcacttggccag

SEQ ID NO: 5530981 - DNA, 13 bp, Homo sapiens
tggagggcctggg

SEQ ID NO: 5530982 - DNA, 21 bp, Homo sapiens
tggagggcgtgggagcgtggg

SEQ ID NO: 5530983 - DNA, 21 bp, Homo sapiens
tggagggctagaacctggaga

SEQ ID NO: 5530984 - DNA, 20 bp, Homo sapiens
tggagggctagaactggaga

SEQ ID NO: 5530985 - DNA, 21 bp, Homo sapiens
tggagggctagaactggagag

SEQ ID NO: 5530986 - DNA, 21 bp, Homo sapiens
tggagggctagaatctggaga

SEQ ID NO: 5530987 - DNA, 13 bp, Homo sapiens
tggagggctcagg

SEQ ID NO: 5530988 - DNA, 19 bp, Homo sapiens
tggagggctgcagagcctg

SEQ ID NO: 5530989 - DNA, 21 bp, Homo sapiens
tggagggctggaatctggaga

SEQ ID NO: 5530990 - DNA, 12 bp, Homo sapiens
tggagggctggg

SEQ ID NO: 5530991 - DNA, 21 bp, Homo sapiens
tggagggctgggcagggccct

SEQ ID NO: 5530992 - DNA, 15 bp, Homo sapiens
tggaggggagctctg

SEQ ID NO: 5530993 - DNA, 19 bp, Homo sapiens
tggaggggagctgctggcc

SEQ ID NO: 5530994 - DNA, 18 bp, Homo sapiens
tggaggggcagagccagg

SEQ ID NO: 5530995 - DNA, 18 bp, Homo sapiens
tggaggggcgcccagggt

SEQ ID NO: 5530996 - DNA, 16 bp, Homo sapiens
tggaggggctggggac

SEQ ID NO: 5530997 - DNA, 18 bp, Homo sapiens
tggaggggcttgggcctg

SEQ ID NO: 5530998 - DNA, 12 bp, Homo sapiens
tggagggggaag

SEQ ID NO: 5530999 - DNA, 20 bp, Homo sapiens
tggagggggaggggagaagc

SEQ ID NO: 5531000 - DNA, 19 bp, Homo sapiens
tggaggggggtgctggccc

SEQ ID NO: 5531001 - DNA, 21 bp, Homo sapiens
tggaggggtaggggctgggaa

SEQ ID NO: 5531002 - DNA, 21 bp, Homo sapiens
tggaggggtgacagtggagga

SEQ ID NO: 5531003 - DNA, 13 bp, Homo sapiens
tggaggggtggcc

SEQ ID NO: 5531004 - DNA, 19 bp, Homo sapiens
tggaggggtggcccagagc

SEQ ID NO: 5531005 - DNA, 20 bp, Homo sapiens
tggaggggtggcccagagcc

SEQ ID NO: 5531006 - DNA, 17 bp, Homo sapiens
tggaggggtggggagct

SEQ ID NO: 5531007 - DNA, 20 bp, Homo sapiens
tggaggggtggtcctgactc

SEQ ID NO: 5531008 - DNA, 11 bp, Homo sapiens
tggaggggtgt

SEQ ID NO: 5531009 - DNA, 13 bp, Homo sapiens
tggaggggtgtgg

SEQ ID NO: 5531010 - DNA, 17 bp, Homo sapiens
tggaggggtgtggcagt

SEQ ID NO: 5531011 - DNA, 19 bp, Homo sapiens
tggaggggtgtggcagtgg

SEQ ID NO: 5531012 - DNA, 23 bp, Homo sapiens
tggaggggtgtggctccttccca

SEQ ID NO: 5531013 - DNA, 19 bp, Homo sapiens
tggagggtaactggggggc

SEQ ID NO: 5531014 - DNA, 23 bp, Homo sapiens
tggagggtaggggagtgtgggtg

SEQ ID NO: 5531015 - DNA, 19 bp, Homo sapiens
tggagggtctgggggcagc

SEQ ID NO: 5531016 - DNA, 20 bp, Homo sapiens
tggagggtctgggggcagct

SEQ ID NO: 5531017 - DNA, 15 bp, Homo sapiens
tggagggtgaccaca

SEQ ID NO: 5531018 - DNA, 19 bp, Homo sapiens
tggagggtggcgccctgcg

SEQ ID NO: 5531019 - DNA, 13 bp, Homo sapiens
tggagggtggggc

SEQ ID NO: 5531020 - DNA, 17 bp, Homo sapiens
tggaggtactgagacag

SEQ ID NO: 5531021 - DNA, 18 bp, Homo sapiens
tggaggtactgagacagg

SEQ ID NO: 5531022 - DNA, 23 bp, Homo sapiens
tggaggtactgagacagggtgct

SEQ ID NO: 5531023 - DNA, 14 bp, Homo sapiens
tggaggtagggctg

SEQ ID NO: 5531024 - DNA, 21 bp, Homo sapiens
tggaggtagggctggctggag

SEQ ID NO: 5531025 - DNA, 16 bp, Homo sapiens
tggaggtcccagccct

SEQ ID NO: 5531026 - DNA, 18 bp, Homo sapiens
tggaggtctctccctccc

SEQ ID NO: 5531027 - DNA, 22 bp, Homo sapiens
tggaggtctctccctcccccag

SEQ ID NO: 5531028 - DNA, 15 bp, Homo sapiens
tggaggtctggctga

SEQ ID NO: 5531029 - DNA, 17 bp, Homo sapiens
tggaggtctggctgagc

SEQ ID NO: 5531030 - DNA, 16 bp, Homo sapiens
tggaggtgctgctcta

SEQ ID NO: 5531031 - DNA, 23 bp, Homo sapiens
tggaggtggaaaagcaacattca

SEQ ID NO: 5531032 - DNA, 13 bp, Homo sapiens
tggaggtgggagc

SEQ ID NO: 5531033 - DNA, 13 bp, Homo sapiens
tggaggtgggcat

SEQ ID NO: 5531034 - DNA, 14 bp, Homo sapiens
tggaggtgggctga

SEQ ID NO: 5531035 - DNA, 23 bp, Homo sapiens
tggaggtgggctgatggcctggc

SEQ ID NO: 5531036 - DNA, 14 bp, Homo sapiens
tggaggtggggcct

SEQ ID NO: 5531037 - DNA, 21 bp, Homo sapiens
tggaggtggggcgaggcaggc

SEQ ID NO: 5531038 - DNA, 17 bp, Homo sapiens
tggaggtggggttggga

SEQ ID NO: 5531039 - DNA, 13 bp, Homo sapiens
tggaggtgggtgt

SEQ ID NO: 5531040 - DNA, 22 bp, Homo sapiens
tggaggtgtcaggctgctggcg

SEQ ID NO: 5531041 - DNA, 14 bp, Homo sapiens
tggaggtgtgggag

SEQ ID NO: 5531042 - DNA, 20 bp, Homo sapiens
tggaggtgttgtggggatgg

SEQ ID NO: 5531043 - DNA, 16 bp, Homo sapiens
tggaggttaaggcata

SEQ ID NO: 5531044 - DNA, 21 bp, Homo sapiens
tggaggttaaggctgaggaaa

SEQ ID NO: 5531045 - DNA, 15 bp, Homo sapiens
tggaggttctcagag

SEQ ID NO: 5531046 - DNA, 16 bp, Homo sapiens
tggaggttctcagagc

SEQ ID NO: 5531047 - DNA, 19 bp, Homo sapiens
tggaggttctcagagccaa

SEQ ID NO: 5531048 - DNA, 21 bp, Homo sapiens
tggcgcaacaggagtcagtct

SEQ ID NO: 5531049 - DNA, 14 bp, Homo sapiens
tggcgcaagcctgt

SEQ ID NO: 5531050 - DNA, 15 bp, Homo sapiens
tggcgcaatctcagc

SEQ ID NO: 5531051 - DNA, 23 bp, Homo sapiens
tggcgcaatctcggctcactgca

SEQ ID NO: 5531052 - DNA, 13 bp, Homo sapiens
tggcgcaccctcc

SEQ ID NO: 5531053 - DNA, 15 bp, Homo sapiens
tggcgcaccctcccc

SEQ ID NO: 5531054 - DNA, 17 bp, Homo sapiens
tggcgcagtgcctctgg

SEQ ID NO: 5531055 - DNA, 21 bp, Homo sapiens
tggcgccctgcctcctggagg

SEQ ID NO: 5531056 - DNA, 22 bp, Homo sapiens
tggcgccctgcctcctggagga

SEQ ID NO: 5531057 - DNA, 18 bp, Homo sapiens
tggcgccgcgtggacagc

SEQ ID NO: 5531058 - DNA, 17 bp, Homo sapiens
tggcgccgtctccaggg

SEQ ID NO: 5531059 - DNA, 12 bp, Homo sapiens
tggcgccttctc

SEQ ID NO: 5531060 - DNA, 15 bp, Homo sapiens
tggcgcgcagcccgg

SEQ ID NO: 5531061 - DNA, 13 bp, Homo sapiens
tggcgcgcctgcc

SEQ ID NO: 5531062 - DNA, 15 bp, Homo sapiens
tggcgcgggagctgg

SEQ ID NO: 5531063 - DNA, 15 bp, Homo sapiens
tggcgcgggaggcac

SEQ ID NO: 5531064 - DNA, 18 bp, Homo sapiens
tggcgcgtgtgtggccta

SEQ ID NO: 5531065 - DNA, 19 bp, Homo sapiens
tggcgctatattgtggctg

SEQ ID NO: 5531066 - DNA, 19 bp, Homo sapiens
tggcgctcagcagccctag

SEQ ID NO: 5531067 - DNA, 20 bp, Homo sapiens
tggcgctcagcagccctagc

SEQ ID NO: 5531068 - DNA, 20 bp, Homo sapiens
tggcgctgagggtttttcta

SEQ ID NO: 5531069 - DNA, 15 bp, Homo sapiens
tggcgctgcccctgg

SEQ ID NO: 5531070 - DNA, 23 bp, Homo sapiens
tggcgctgcccctggcagcccct

SEQ ID NO: 5531071 - DNA, 13 bp, Homo sapiens
tggcgctgccgag

SEQ ID NO: 5531072 - DNA, 13 bp, Homo sapiens
tggcgctgtgcta

SEQ ID NO: 5531073 - DNA, 17 bp, Homo sapiens
tggcgctttctcctgtg

SEQ ID NO: 5531074 - DNA, 22 bp, Homo sapiens
tggcggacactgggggaggaga

SEQ ID NO: 5531075 - DNA, 14 bp, Homo sapiens
tggcggagagtttt

SEQ ID NO: 5531076 - DNA, 15 bp, Homo sapiens
tggcggaggccatgg

SEQ ID NO: 5531077 - DNA, 16 bp, Homo sapiens
tggcggaggccatggg

SEQ ID NO: 5531078 - DNA, 14 bp, Homo sapiens
tggcggaggctgct

SEQ ID NO: 5531079 - DNA, 23 bp, Homo sapiens
tggcggagggagcggcatgggcg

SEQ ID NO: 5531080 - DNA, 13 bp, Homo sapiens
tggcggaggtctc

SEQ ID NO: 5531081 - DNA, 16 bp, Homo sapiens
tggcggaggtctctgg

SEQ ID NO: 5531082 - DNA, 19 bp, Homo sapiens
tggcggaggtctctgggag

SEQ ID NO: 5531083 - DNA, 19 bp, Homo sapiens
tggcggcaggaagccaaag

SEQ ID NO: 5531084 - DNA, 18 bp, Homo sapiens
tggcggcagggccaggct

SEQ ID NO: 5531085 - DNA, 18 bp, Homo sapiens
tggcggcccctcagcctg

SEQ ID NO: 5531086 - DNA, 19 bp, Homo sapiens
tggcggcccttctgactgt

SEQ ID NO: 5531087 - DNA, 13 bp, Homo sapiens
tggcggcctgtgg

SEQ ID NO: 5531088 - DNA, 13 bp, Homo sapiens
tggcggccttccg

SEQ ID NO: 5531089 - DNA, 19 bp, Homo sapiens
tggcggcggcacttcaagc

SEQ ID NO: 5531090 - DNA, 22 bp, Homo sapiens
tggcggctgcacaacagccctg

SEQ ID NO: 5531091 - DNA, 18 bp, Homo sapiens
tggcggcttcctgtccac

SEQ ID NO: 5531092 - DNA, 19 bp, Homo sapiens
tggcggcttcctgtccact

SEQ ID NO: 5531093 - DNA, 15 bp, Homo sapiens
tggcgggcagcccag

SEQ ID NO: 5531094 - DNA, 15 bp, Homo sapiens
tggcgggcagcccct

SEQ ID NO: 5531095 - DNA, 18 bp, Homo sapiens
tggcgggcagcccctgct

SEQ ID NO: 5531096 - DNA, 13 bp, Homo sapiens
tggcgggcccact

SEQ ID NO: 5531097 - DNA, 14 bp, Homo sapiens
tggcggggtggggt

SEQ ID NO: 5531098 - DNA, 20 bp, Homo sapiens
tggcgggtccacttgccagg

SEQ ID NO: 5531099 - DNA, 13 bp, Homo sapiens
tggcgggtggctg

SEQ ID NO: 5531100 - DNA, 14 bp, Homo sapiens
tggcggtggctgcc

SEQ ID NO: 5531101 - DNA, 16 bp, Homo sapiens
tggcggtggctgcccc

SEQ ID NO: 5531102 - DNA, 18 bp, Homo sapiens
tggcgtaagtacagagaa

SEQ ID NO: 5531103 - DNA, 19 bp, Homo sapiens
tggcgtaagtacagagaag

SEQ ID NO: 5531104 - DNA, 19 bp, Homo sapiens
tggcgtagagggtgctgcc

SEQ ID NO: 5531105 - DNA, 20 bp, Homo sapiens
tggcgtagagggtgctgccc

SEQ ID NO: 5531106 - DNA, 23 bp, Homo sapiens
tggcgtaggctacagagaagcct

SEQ ID NO: 5531107 - DNA, 17 bp, Homo sapiens
tggcgtatcaggaaagc

SEQ ID NO: 5531108 - DNA, 12 bp, Homo sapiens
tggcgtcctctc

SEQ ID NO: 5531109 - DNA, 23 bp, Homo sapiens
tggcgtcctctccctcctggcca

SEQ ID NO: 5531110 - DNA, 22 bp, Homo sapiens
tggcgtcggccagaggggctgc

SEQ ID NO: 5531111 - DNA, 13 bp, Homo sapiens
tggcgtctccctc

SEQ ID NO: 5531112 - DNA, 19 bp, Homo sapiens
tggcgtctgcctaggagct

SEQ ID NO: 5531113 - DNA, 23 bp, Homo sapiens
tggcgtctgcctaggagctggct

SEQ ID NO: 5531114 - DNA, 13 bp, Homo sapiens
tggcgtctgtctt

SEQ ID NO: 5531115 - DNA, 17 bp, Homo sapiens
tggcgtctgtcttcaag

SEQ ID NO: 5531116 - DNA, 16 bp, Homo sapiens
tggcgtgatctcggct

SEQ ID NO: 5531117 - DNA, 15 bp, Homo sapiens
tggcgtgccctggag

SEQ ID NO: 5531118 - DNA, 16 bp, Homo sapiens
tggcgtggattaaact

SEQ ID NO: 5531119 - DNA, 16 bp, Homo sapiens
tggcgtgtgtccctgt

SEQ ID NO: 5531120 - DNA, 19 bp, Homo sapiens
tggcgtgtgtccctgtggt

SEQ ID NO: 5531121 - DNA, 15 bp, Homo sapiens
tggcgttatggcagc

SEQ ID NO: 5531122 - DNA, 18 bp, Homo sapiens
tggcgttcctgccaggct

SEQ ID NO: 5531123 - DNA, 14 bp, Homo sapiens
tggcgttgttcata

SEQ ID NO: 5531124 - DNA, 14 bp, Homo sapiens
tggcgttgttgcat

SEQ ID NO: 5531125 - DNA, 18 bp, Homo sapiens
tggcgttttgtctgtgtt

SEQ ID NO: 5531126 - DNA, 19 bp, Homo sapiens
tggcgttttgtctgtgttg

SEQ ID NO: 5531127 - DNA, 21 bp, Homo sapiens
tggcgtttttctcgtccccct

SEQ ID NO: 5531128 - DNA, 14 bp, Homo sapiens
tggctaaaggtccc

SEQ ID NO: 5531129 - DNA, 20 bp, Homo sapiens
tggctaaatgcctaataaac

SEQ ID NO: 5531130 - DNA, 14 bp, Homo sapiens
tggctaaattcatg

SEQ ID NO: 5531131 - DNA, 14 bp, Homo sapiens
tggctaacagtcta

SEQ ID NO: 5531132 - DNA, 17 bp, Homo sapiens
tggctaacttacaaaga

SEQ ID NO: 5531133 - DNA, 12 bp, Homo sapiens
tggctaagaccc

SEQ ID NO: 5531134 - DNA, 17 bp, Homo sapiens
tggctaagcttaaaaaa

SEQ ID NO: 5531135 - DNA, 20 bp, Homo sapiens
tggctaagcttaaaaaaaac

SEQ ID NO: 5531136 - DNA, 23 bp, Homo sapiens
tggctaaggcatcattttcacct

SEQ ID NO: 5531137 - DNA, 22 bp, Homo sapiens
tggctaagggggaccatgggga

SEQ ID NO: 5531138 - DNA, 11 bp, Homo sapiens
tggctaataaa

SEQ ID NO: 5531139 - DNA, 14 bp, Homo sapiens
tggctaataaactg

SEQ ID NO: 5531140 - DNA, 15 bp, Homo sapiens
tggctaataaactgt

SEQ ID NO: 5531141 - DNA, 17 bp, Homo sapiens
tggctaatgtactgcat

SEQ ID NO: 5531142 - DNA, 19 bp, Homo sapiens
tggctaatgtactgcatat

SEQ ID NO: 5531143 - DNA, 19 bp, Homo sapiens
tggctaattttttgtactt

SEQ ID NO: 5531144 - DNA, 17 bp, Homo sapiens
tggctacaattactttg

SEQ ID NO: 5531145 - DNA, 22 bp, Homo sapiens
tggctacatcccagcctgtggt

SEQ ID NO: 5531146 - DNA, 17 bp, Homo sapiens
tggctaccattgtcact

SEQ ID NO: 5531147 - DNA, 17 bp, Homo sapiens
tggctaccgttttacaa

SEQ ID NO: 5531148 - DNA, 15 bp, Homo sapiens
tggctacgcctcttc

SEQ ID NO: 5531149 - DNA, 17 bp, Homo sapiens
tggctacgttttggttc

SEQ ID NO: 5531150 - DNA, 21 bp, Homo sapiens
tggctacgttttggttctatg

SEQ ID NO: 5531151 - DNA, 14 bp, Homo sapiens
tggctactccctgg

SEQ ID NO: 5531152 - DNA, 19 bp, Homo sapiens
tggctactccctggaccac

SEQ ID NO: 5531153 - DNA, 23 bp, Homo sapiens
tggctactctgtgccagagcctg

SEQ ID NO: 5531154 - DNA, 14 bp, Homo sapiens
tggctacttccctt

SEQ ID NO: 5531155 - DNA, 15 bp, Homo sapiens
tggctagaagaaagt

SEQ ID NO: 5531156 - DNA, 20 bp, Homo sapiens
tggctagaatcagggtggag

SEQ ID NO: 5531157 - DNA, 21 bp, Homo sapiens
tggctagaatcagggtggaga

SEQ ID NO: 5531158 - DNA, 21 bp, Homo sapiens
tggctagagtcctcactccca

SEQ ID NO: 5531159 - DNA, 16 bp, Homo sapiens
tggctagcctttcttg

SEQ ID NO: 5531160 - DNA, 17 bp, Homo sapiens
tggctaggaaagggaag

SEQ ID NO: 5531161 - DNA, 11 bp, Homo sapiens
tggctaggact

SEQ ID NO: 5531162 - DNA, 22 bp, Homo sapiens
tggctagtcacatatcaagtcc

SEQ ID NO: 5531163 - DNA, 16 bp, Homo sapiens
tggctagtcctttctg

SEQ ID NO: 5531164 - DNA, 23 bp, Homo sapiens
tggctataacagtgtctttctag

SEQ ID NO: 5531165 - DNA, 15 bp, Homo sapiens
tggctatattaatct

SEQ ID NO: 5531166 - DNA, 22 bp, Homo sapiens
tggctatcaaagaataagaaaa

SEQ ID NO: 5531167 - DNA, 13 bp, Homo sapiens
tggctatcctaga

SEQ ID NO: 5531168 - DNA, 13 bp, Homo sapiens
tggctatcctgat

SEQ ID NO: 5531169 - DNA, 23 bp, Homo sapiens
tggctatctactaccagaagggc

SEQ ID NO: 5531170 - DNA, 18 bp, Homo sapiens
tggctatgaaaatgagcc

SEQ ID NO: 5531171 - DNA, 15 bp, Homo sapiens
tggctatgaacagaa

SEQ ID NO: 5531172 - DNA, 16 bp, Homo sapiens
tggctatgagggcctt

SEQ ID NO: 5531173 - DNA, 17 bp, Homo sapiens
tggctatgcatttgaaa

SEQ ID NO: 5531174 - DNA, 19 bp, Homo sapiens
tggctatgcatttgaaaat

SEQ ID NO: 5531175 - DNA, 15 bp, Homo sapiens
tggctatgccttgca

SEQ ID NO: 5531176 - DNA, 22 bp, Homo sapiens
tggctatgttttggagagagca

SEQ ID NO: 5531177 - DNA, 13 bp, Homo sapiens
tggctattgtcct

SEQ ID NO: 5531178 - DNA, 21 bp, Homo sapiens
tggctattgtccttgtgtatc

SEQ ID NO: 5531179 - DNA, 23 bp, Homo sapiens
tggctattgtccttgtgtatcct

SEQ ID NO: 5531180 - DNA, 15 bp, Homo sapiens
tggctatttaaaact

SEQ ID NO: 5531181 - DNA, 14 bp, Homo sapiens
tggctatttctgtg

SEQ ID NO: 5531182 - DNA, 19 bp, Homo sapiens
tggctatttctgtgtccag

SEQ ID NO: 5531183 - DNA, 12 bp, Homo sapiens
tggctatttgaa

SEQ ID NO: 5531184 - DNA, 22 bp, Homo sapiens
tggctatttgaaatactaaaag

SEQ ID NO: 5531185 - DNA, 14 bp, Homo sapiens
tggctcaaagcagc

SEQ ID NO: 5531186 - DNA, 17 bp, Homo sapiens
tggctcaagtagaaaag

SEQ ID NO: 5531187 - DNA, 16 bp, Homo sapiens
tggctcaatcctctaa

SEQ ID NO: 5531188 - DNA, 16 bp, Homo sapiens
tggctcacaaggccca

SEQ ID NO: 5531189 - DNA, 14 bp, Homo sapiens
tggctcacacctgt

SEQ ID NO: 5531190 - DNA, 16 bp, Homo sapiens
tggctcacacctgtaa

SEQ ID NO: 5531191 - DNA, 21 bp, Homo sapiens
tggctcacacctgtaatccca

SEQ ID NO: 5531192 - DNA, 21 bp, Homo sapiens
tggctcacactcgacatgaaa

SEQ ID NO: 5531193 - DNA, 14 bp, Homo sapiens
tggctcacactgag

SEQ ID NO: 5531194 - DNA, 16 bp, Homo sapiens
tggctcacactgagaa

SEQ ID NO: 5531195 - DNA, 14 bp, Homo sapiens
tggctcacagactg

SEQ ID NO: 5531196 - DNA, 12 bp, Homo sapiens
tggctcacagcc

SEQ ID NO: 5531197 - DNA, 14 bp, Homo sapiens
tggctcacagtaca

SEQ ID NO: 5531198 - DNA, 17 bp, Homo sapiens
tggctcacatcatgtaa

SEQ ID NO: 5531199 - DNA, 15 bp, Homo sapiens
tggctcacatttcat

SEQ ID NO: 5531200 - DNA, 13 bp, Homo sapiens
tggctcacccagt

SEQ ID NO: 5531201 - DNA, 21 bp, Homo sapiens
tggctcacgccccgctgtgtc

SEQ ID NO: 5531202 - DNA, 14 bp, Homo sapiens
tggctcacgcctgt

SEQ ID NO: 5531203 - DNA, 18 bp, Homo sapiens
tggctcacgcctgtaatc

SEQ ID NO: 5531204 - DNA, 16 bp, Homo sapiens
tggctcacgtgtgtga

SEQ ID NO: 5531205 - DNA, 12 bp, Homo sapiens
tggctcactact

SEQ ID NO: 5531206 - DNA, 20 bp, Homo sapiens
tggctcactatgaatctatt

SEQ ID NO: 5531207 - DNA, 22 bp, Homo sapiens
tggctcactcagcacttggccc

SEQ ID NO: 5531208 - DNA, 14 bp, Homo sapiens
tggctcactggctg

SEQ ID NO: 5531209 - DNA, 16 bp, Homo sapiens
tggctcactggctggg

SEQ ID NO: 5531210 - DNA, 19 bp, Homo sapiens
tggctcactggctgggagt

SEQ ID NO: 5531211 - DNA, 20 bp, Homo sapiens
tggctcactggctgggagtc

SEQ ID NO: 5531212 - DNA, 23 bp, Homo sapiens
tggctcagaaaataccttagctt

SEQ ID NO: 5531213 - DNA, 21 bp, Homo sapiens
tggctcagacccctcagcccc

SEQ ID NO: 5531214 - DNA, 13 bp, Homo sapiens
tggctcagagtcc

SEQ ID NO: 5531215 - DNA, 14 bp, Homo sapiens
tggctcagagtcca

SEQ ID NO: 5531216 - DNA, 22 bp, Homo sapiens
tggctcagatcggccacagggc

SEQ ID NO: 5531217 - DNA, 18 bp, Homo sapiens
tggctcagcatcctccac

SEQ ID NO: 5531218 - DNA, 14 bp, Homo sapiens
tggctcagcccggg

SEQ ID NO: 5531219 - DNA, 15 bp, Homo sapiens
tggctcagcctgtct

SEQ ID NO: 5531220 - DNA, 17 bp, Homo sapiens
tggctcagcctgtctcg

SEQ ID NO: 5531221 - DNA, 16 bp, Homo sapiens
tggctcagctgtggtc

SEQ ID NO: 5531222 - DNA, 13 bp, Homo sapiens
tggctcaggcaag

SEQ ID NO: 5531223 - DNA, 19 bp, Homo sapiens
tggctcaggcaagcccctc

SEQ ID NO: 5531224 - DNA, 21 bp, Homo sapiens
tggctcaggcaagcccctcag

SEQ ID NO: 5531225 - DNA, 13 bp, Homo sapiens
tggctcaggccca

SEQ ID NO: 5531226 - DNA, 15 bp, Homo sapiens
tggctcaggcccagc

SEQ ID NO: 5531227 - DNA, 17 bp, Homo sapiens
tggcttgtaactccacc

SEQ ID NO: 5531228 - DNA, 12 bp, Homo sapiens
tggcttgtacat

SEQ ID NO: 5531229 - DNA, 16 bp, Homo sapiens
tggcttgtacatagta

SEQ ID NO: 5531230 - DNA, 13 bp, Homo sapiens
tggcttgtagaat

SEQ ID NO: 5531231 - DNA, 16 bp, Homo sapiens
tggcttgtagaattgt

SEQ ID NO: 5531232 - DNA, 17 bp, Homo sapiens
tggcttgtagaattttt

SEQ ID NO: 5531233 - DNA, 12 bp, Homo sapiens
tggcttgtaggg

SEQ ID NO: 5531234 - DNA, 15 bp, Homo sapiens
tggcttgtcggagca

SEQ ID NO: 5531235 - DNA, 21 bp, Homo sapiens
tggcttgtctcacgcagccag

SEQ ID NO: 5531236 - DNA, 18 bp, Homo sapiens
tggcttgtgatctgggaa

SEQ ID NO: 5531237 - DNA, 22 bp, Homo sapiens
tggcttgtgattctgggatgga

SEQ ID NO: 5531238 - DNA, 12 bp, Homo sapiens
tggcttgttcat

SEQ ID NO: 5531239 - DNA, 22 bp, Homo sapiens
tggcttgttcatcatccagatg

SEQ ID NO: 5531240 - DNA, 16 bp, Homo sapiens
tggcttgttctctgga

SEQ ID NO: 5531241 - DNA, 20 bp, Homo sapiens
tggcttgttctctggaacct

SEQ ID NO: 5531242 - DNA, 13 bp, Homo sapiens
tggctttaaataa

SEQ ID NO: 5531243 - DNA, 21 bp, Homo sapiens
tggctttaaataaattaagat

SEQ ID NO: 5531244 - DNA, 14 bp, Homo sapiens
tggctttaatgaat

SEQ ID NO: 5531245 - DNA, 14 bp, Homo sapiens
tggctttacctttt

SEQ ID NO: 5531246 - DNA, 19 bp, Homo sapiens
tggctttacctttttgtat

SEQ ID NO: 5531247 - DNA, 20 bp, Homo sapiens
tggctttatcctctttagag

SEQ ID NO: 5531248 - DNA, 21 bp, Homo sapiens
tggctttatcctctttagagt

SEQ ID NO: 5531249 - DNA, 19 bp, Homo sapiens
tggctttatgcaaatacaa

SEQ ID NO: 5531250 - DNA, 17 bp, Homo sapiens
tggctttatttgttttt

SEQ ID NO: 5531251 - DNA, 19 bp, Homo sapiens
tggctttcaaagctaaaat

SEQ ID NO: 5531252 - DNA, 18 bp, Homo sapiens
tggctttcacatttaaat

SEQ ID NO: 5531253 - DNA, 22 bp, Homo sapiens
tggctttcagagccagcctggc

SEQ ID NO: 5531254 - DNA, 11 bp, Homo sapiens
tggctttcagg

SEQ ID NO: 5531255 - DNA, 14 bp, Homo sapiens
tggctttcagggag

SEQ ID NO: 5531256 - DNA, 13 bp, Homo sapiens
tggctttcatcct

SEQ ID NO: 5531257 - DNA, 18 bp, Homo sapiens
tggctttcatcctgtgtc

SEQ ID NO: 5531258 - DNA, 12 bp, Homo sapiens
tggctttcattt

SEQ ID NO: 5531259 - DNA, 12 bp, Homo sapiens
tggctttccagg

SEQ ID NO: 5531260 - DNA, 15 bp, Homo sapiens
tggctttccaggcac

SEQ ID NO: 5531261 - DNA, 21 bp, Homo sapiens
tggctttccaggcaccctcag

SEQ ID NO: 5531262 - DNA, 14 bp, Homo sapiens
tggctttcccagga

SEQ ID NO: 5531263 - DNA, 17 bp, Homo sapiens
tggctttccttgtggca

SEQ ID NO: 5531264 - DNA, 21 bp, Homo sapiens
tggctttccttgtggcagagg

SEQ ID NO: 5531265 - DNA, 15 bp, Homo sapiens
tggctttctaccaca

SEQ ID NO: 5531266 - DNA, 22 bp, Homo sapiens
tggctttctccgactgctaggg

SEQ ID NO: 5531267 - DNA, 21 bp, Homo sapiens
tggctttctctccttggcctt

SEQ ID NO: 5531268 - DNA, 14 bp, Homo sapiens
tggctttctctctg

SEQ ID NO: 5531269 - DNA, 15 bp, Homo sapiens
tggctttctctctgg

SEQ ID NO: 5531270 - DNA, 23 bp, Homo sapiens
tggctttctctctggcttctctc

SEQ ID NO: 5531271 - DNA, 17 bp, Homo sapiens
tggctttgaaacctcag

SEQ ID NO: 5531272 - DNA, 18 bp, Homo sapiens
tggctttgaaacctcagg

SEQ ID NO: 5531273 - DNA, 18 bp, Homo sapiens
tggctttgaggccgaagc

SEQ ID NO: 5531274 - DNA, 16 bp, Homo sapiens
tggctttgcagctgct

SEQ ID NO: 5531275 - DNA, 21 bp, Homo sapiens
tggctttgcagctgctgtctg

SEQ ID NO: 5531276 - DNA, 20 bp, Homo sapiens
tggctttgcccaacctcagc

SEQ ID NO: 5531277 - DNA, 17 bp, Homo sapiens
tggctttgcccacccct

SEQ ID NO: 5531278 - DNA, 11 bp, Homo sapiens
tggctttgcct

SEQ ID NO: 5531279 - DNA, 13 bp, Homo sapiens
tggctttgcctct

SEQ ID NO: 5531280 - DNA, 14 bp, Homo sapiens
tggctttgcctctt

SEQ ID NO: 5531281 - DNA, 17 bp, Homo sapiens
tggctttgcctcttctt

SEQ ID NO: 5531282 - DNA, 14 bp, Homo sapiens
tggctttgccttta

SEQ ID NO: 5531283 - DNA, 19 bp, Homo sapiens
tggctttgcggaggctgct

SEQ ID NO: 5531284 - DNA, 18 bp, Homo sapiens
tggctttggcactctctg

SEQ ID NO: 5531285 - DNA, 15 bp, Homo sapiens
tggctttggcagtgt

SEQ ID NO: 5531286 - DNA, 19 bp, Homo sapiens
tggctttgggaaagcccag

SEQ ID NO: 5531287 - DNA, 22 bp, Homo sapiens
tggctttgggaaagcccagact

SEQ ID NO: 5531288 - DNA, 12 bp, Homo sapiens
tggctttgtctt

SEQ ID NO: 5531289 - DNA, 16 bp, Homo sapiens
tggctttgtcttgaaa

SEQ ID NO: 5531290 - DNA, 19 bp, Homo sapiens
tggctttgtcttgaaaaaa

SEQ ID NO: 5531291 - DNA, 15 bp, Homo sapiens
tggctttgtgctgct

SEQ ID NO: 5531292 - DNA, 17 bp, Homo sapiens
tggctttgtgctgctga

SEQ ID NO: 5531293 - DNA, 16 bp, Homo sapiens
tggctttgttcttgtc

SEQ ID NO: 5531294 - DNA, 21 bp, Homo sapiens
tggcttttaaacctgttcctg

SEQ ID NO: 5531295 - DNA, 17 bp, Homo sapiens
tggcttttattaatgca

SEQ ID NO: 5531296 - DNA, 21 bp, Homo sapiens
tggcttttattaatgcacttt

SEQ ID NO: 5531297 - DNA, 15 bp, Homo sapiens
tggcttttcactgct

SEQ ID NO: 5531298 - DNA, 18 bp, Homo sapiens
tggcttttcactgctggc

SEQ ID NO: 5531299 - DNA, 19 bp, Homo sapiens
tggcttttcactgctggct

SEQ ID NO: 5531300 - DNA, 21 bp, Homo sapiens
tggcttttcactgctggctgc

SEQ ID NO: 5531301 - DNA, 17 bp, Homo sapiens
tggcttttctggctggg

SEQ ID NO: 5531302 - DNA, 23 bp, Homo sapiens
tggcttttcttacccagattgtg

SEQ ID NO: 5531303 - DNA, 17 bp, Homo sapiens
tggcttttgctttccct

SEQ ID NO: 5531304 - DNA, 21 bp, Homo sapiens
tggcttttgtgcattatctag

SEQ ID NO: 5531305 - DNA, 17 bp, Homo sapiens
tggctttttactattaa

SEQ ID NO: 5531306 - DNA, 15 bp, Homo sapiens
tggctttttcccagc

SEQ ID NO: 5531307 - DNA, 17 bp, Homo sapiens
tggctttttcctctgag

SEQ ID NO: 5531308 - DNA, 21 bp, Homo sapiens
tggctttttcctctgagccca

SEQ ID NO: 5531309 - DNA, 21 bp, Homo sapiens
tggctttttgtgcttggcaaa

SEQ ID NO: 5531310 - DNA, 17 bp, Homo sapiens
tggctttttgttcagaa

SEQ ID NO: 5531311 - DNA, 22 bp, Homo sapiens
tggcttttttaaaaaagcaaca

SEQ ID NO: 5531312 - DNA, 17 bp, Homo sapiens
tggcttttttgtggggt

SEQ ID NO: 5531313 - DNA, 20 bp, Homo sapiens
tgggaaaaaaacttggcact

SEQ ID NO: 5531314 - DNA, 13 bp, Homo sapiens
tgggaaaaaaaga

SEQ ID NO: 5531315 - DNA, 21 bp, Homo sapiens
tgggaaaaaagttttgatgaa

SEQ ID NO: 5531316 - DNA, 20 bp, Homo sapiens
tgggaaaaatctaaaatgtg

SEQ ID NO: 5531317 - DNA, 19 bp, Homo sapiens
tgggaaaaatgttggaatg

SEQ ID NO: 5531318 - DNA, 14 bp, Homo sapiens
tgggaaaacatttg

SEQ ID NO: 5531319 - DNA, 15 bp, Homo sapiens
tgggaaaacttcact

SEQ ID NO: 5531320 - DNA, 20 bp, Homo sapiens
tgggaaaacttcactccaaa

SEQ ID NO: 5531321 - DNA, 21 bp, Homo sapiens
tgggaaaacttcactccaaag

SEQ ID NO: 5531322 - DNA, 17 bp, Homo sapiens
tgggaaaagtgttatta

SEQ ID NO: 5531323 - DNA, 23 bp, Homo sapiens
tgggaaaataccccatcattcat

SEQ ID NO: 5531324 - DNA, 23 bp, Homo sapiens
tgggaaaatgtcccccacctctt

SEQ ID NO: 5531325 - DNA, 23 bp, Homo sapiens
tgggaaacaaataatttgaactt

SEQ ID NO: 5531326 - DNA, 11 bp, Homo sapiens
tgggaaacacc

SEQ ID NO: 5531327 - DNA, 14 bp, Homo sapiens
tgggaaacagggag

SEQ ID NO: 5531328 - DNA, 15 bp, Homo sapiens
tgggaaacagggagc

SEQ ID NO: 5531329 - DNA, 17 bp, Homo sapiens
tgggaaaccatgtagca

SEQ ID NO: 5531330 - DNA, 21 bp, Homo sapiens
tgggaaacccttttgcgtggt

SEQ ID NO: 5531331 - DNA, 14 bp, Homo sapiens
tgggaaactgcttt

SEQ ID NO: 5531332 - DNA, 20 bp, Homo sapiens
tgggaaactgggtttctcat

SEQ ID NO: 5531333 - DNA, 19 bp, Homo sapiens
tgggaaactgttgtgggcg

SEQ ID NO: 5531334 - DNA, 22 bp, Homo sapiens
tgggaaacttgtcacttgcatg

SEQ ID NO: 5531335 - DNA, 16 bp, Homo sapiens
tgggaaactttccctt

SEQ ID NO: 5531336 - DNA, 16 bp, Homo sapiens
tgggaaagatggataa

SEQ ID NO: 5531337 - DNA, 15 bp, Homo sapiens
tgggaaagcataaag

SEQ ID NO: 5531338 - DNA, 21 bp, Homo sapiens
tgggaaagccacctctccctc

SEQ ID NO: 5531339 - DNA, 14 bp, Homo sapiens
tgggaaagcccaga

SEQ ID NO: 5531340 - DNA, 19 bp, Homo sapiens
tgggaaagctctgtagagc

SEQ ID NO: 5531341 - DNA, 23 bp, Homo sapiens
tgggaaaggaaaaccagggatag

SEQ ID NO: 5531342 - DNA, 19 bp, Homo sapiens
tgggaaaggacccacccat

SEQ ID NO: 5531343 - DNA, 21 bp, Homo sapiens
tgggaaaggaggcatgcctct

SEQ ID NO: 5531344 - DNA, 16 bp, Homo sapiens
tgggaaaggagtagaa

SEQ ID NO: 5531345 - DNA, 17 bp, Homo sapiens
tgggaaaggcagggccc

SEQ ID NO: 5531346 - DNA, 16 bp, Homo sapiens
tgggaaaggggaagtt

SEQ ID NO: 5531347 - DNA, 16 bp, Homo sapiens
tgggaaagtattctgt

SEQ ID NO: 5531348 - DNA, 16 bp, Homo sapiens
tgggaaatagcggccc

SEQ ID NO: 5531349 - DNA, 17 bp, Homo sapiens
tgggaaatagcggccct

SEQ ID NO: 5531350 - DNA, 22 bp, Homo sapiens
tgggaaatagggcaagaattct

SEQ ID NO: 5531351 - DNA, 18 bp, Homo sapiens
tgggaaatatgccactga

SEQ ID NO: 5531352 - DNA, 19 bp, Homo sapiens
tgggaaatatttagcaaat

SEQ ID NO: 5531353 - DNA, 15 bp, Homo sapiens
tgggaaatgagcagg

SEQ ID NO: 5531354 - DNA, 16 bp, Homo sapiens
tgggaaatgagcaggg

SEQ ID NO: 5531355 - DNA, 16 bp, Homo sapiens
tgggaaatgagccagc

SEQ ID NO: 5531356 - DNA, 13 bp, Homo sapiens
tgggaaatgcaga

SEQ ID NO: 5531357 - DNA, 22 bp, Homo sapiens
tgggaaatggtatgagctgagg

SEQ ID NO: 5531358 - DNA, 23 bp, Homo sapiens
tgggaaatggtatgagctgaggg

SEQ ID NO: 5531359 - DNA, 11 bp, Homo sapiens
tgggaaatgtc

SEQ ID NO: 5531360 - DNA, 22 bp, Homo sapiens
tgggaaattaaatccaataaaa

SEQ ID NO: 5531361 - DNA, 19 bp, Homo sapiens
tgggaaattatctgcctta

SEQ ID NO: 5531362 - DNA, 23 bp, Homo sapiens
tgggaaattgctccattcctgag

SEQ ID NO: 5531363 - DNA, 16 bp, Homo sapiens
tgggaaatttttaatg

SEQ ID NO: 5531364 - DNA, 19 bp, Homo sapiens
tgggaacaagtgtacagaa

SEQ ID NO: 5531365 - DNA, 20 bp, Homo sapiens
tgggaacaagtgtacagaag

SEQ ID NO: 5531366 - DNA, 21 bp, Homo sapiens
tgggaacaagtgtacagaaga

SEQ ID NO: 5531367 - DNA, 14 bp, Homo sapiens
tgggaacacagttc

SEQ ID NO: 5531368 - DNA, 20 bp, Homo sapiens
tgggaacaccataggtcacc

SEQ ID NO: 5531369 - DNA, 13 bp, Homo sapiens
tgggaacactggc

SEQ ID NO: 5531370 - DNA, 17 bp, Homo sapiens
tgggaacactggcagac

SEQ ID NO: 5531371 - DNA, 16 bp, Homo sapiens
tgggaacactggcctg

SEQ ID NO: 5531372 - DNA, 17 bp, Homo sapiens
tgggaacactggcctgg

SEQ ID NO: 5531373 - DNA, 15 bp, Homo sapiens
tgggaacaggcccca

SEQ ID NO: 5531374 - DNA, 18 bp, Homo sapiens
tgggaacatgacccagcc

SEQ ID NO: 5531375 - DNA, 17 bp, Homo sapiens
tgggaacattatcacaa

SEQ ID NO: 5531376 - DNA, 14 bp, Homo sapiens
tgggaacattattt

SEQ ID NO: 5531377 - DNA, 22 bp, Homo sapiens
tgggaacatttattttatgaga

SEQ ID NO: 5531378 - DNA, 18 bp, Homo sapiens
tgggaaccactcccacca

SEQ ID NO: 5531379 - DNA, 16 bp, Homo sapiens
tgggaaccatgaagct

SEQ ID NO: 5531380 - DNA, 21 bp, Homo sapiens
tgggaaccatttcaagacaga

SEQ ID NO: 5531381 - DNA, 13 bp, Homo sapiens
tgggaaccctccc

SEQ ID NO: 5531382 - DNA, 17 bp, Homo sapiens
tgggaaccgccctcctg

SEQ ID NO: 5531383 - DNA, 18 bp, Homo sapiens
tgggaaccgccctcctga

SEQ ID NO: 5531384 - DNA, 14 bp, Homo sapiens
tgggaacctcccag

SEQ ID NO: 5531385 - DNA, 17 bp, Homo sapiens
tgggaacctcccagagg

SEQ ID NO: 5531386 - DNA, 22 bp, Homo sapiens
tgggaacctcccagaggtccag

SEQ ID NO: 5531387 - DNA, 14 bp, Homo sapiens
tgggaacctcctta

SEQ ID NO: 5531388 - DNA, 16 bp, Homo sapiens
tgggaacgagagggga

SEQ ID NO: 5531389 - DNA, 18 bp, Homo sapiens
tgggaacgtgactgcccc

SEQ ID NO: 5531390 - DNA, 19 bp, Homo sapiens
tgggaacgtgtgtccaggc

SEQ ID NO: 5531391 - DNA, 21 bp, Homo sapiens
tgggaacgtgtgtccaggctc

SEQ ID NO: 5531392 - DNA, 17 bp, Homo sapiens
tgggaactatgaggagc

SEQ ID NO: 5531393 - DNA, 18 bp, Homo sapiens
tgggaactcacctggggc

SEQ ID NO: 5531394 - DNA, 22 bp, Homo sapiens
tgggaactcccaagaacagcag

SEQ ID NO: 5531395 - DNA, 13 bp, Homo sapiens
tgggaactctgac

SEQ ID NO: 5531396 - DNA, 18 bp, Homo sapiens
tgggaactgcagacctgt

SEQ ID NO: 5531397 - DNA, 17 bp, Homo sapiens
tgggaactggttcaaga

SEQ ID NO: 5531398 - DNA, 16 bp, Homo sapiens
tgggaagaaaaaggaa

SEQ ID NO: 5531399 - DNA, 23 bp, Homo sapiens
tgggaagaaagaatgcaagagtg

SEQ ID NO: 5531400 - DNA, 16 bp, Homo sapiens
tgggaagaacatgcta

SEQ ID NO: 5531401 - DNA, 12 bp, Homo sapiens
tgggaagaagta

SEQ ID NO: 5531402 - DNA, 21 bp, Homo sapiens
tgggaagacatggggaggaag

SEQ ID NO: 5531403 - DNA, 13 bp, Homo sapiens
tgggaagactcag

SEQ ID NO: 5531404 - DNA, 14 bp, Homo sapiens
tgggatggacagga

SEQ ID NO: 5531405 - DNA, 19 bp, Homo sapiens
tgggatggacgctgccggg

SEQ ID NO: 5531406 - DNA, 22 bp, Homo sapiens
tgggatggacgctgccgggaga

SEQ ID NO: 5531407 - DNA, 21 bp, Homo sapiens
tgggatgggacagggaggcca

SEQ ID NO: 5531408 - DNA, 22 bp, Homo sapiens
tgggatgggacagggaggccac

SEQ ID NO: 5531409 - DNA, 15 bp, Homo sapiens
tgggatgggaccagg

SEQ ID NO: 5531410 - DNA, 15 bp, Homo sapiens
tgggatgggcacagg

SEQ ID NO: 5531411 - DNA, 19 bp, Homo sapiens
tgggatgggcacaggctgc

SEQ ID NO: 5531412 - DNA, 13 bp, Homo sapiens
tgggatgggctct

SEQ ID NO: 5531413 - DNA, 20 bp, Homo sapiens
tgggatgggctctacctctc

SEQ ID NO: 5531414 - DNA, 22 bp, Homo sapiens
tgggatgggctctacctctctt

SEQ ID NO: 5531415 - DNA, 17 bp, Homo sapiens
tgggatgggttccagag

SEQ ID NO: 5531416 - DNA, 17 bp, Homo sapiens
tgggatggtgactcctg

SEQ ID NO: 5531417 - DNA, 18 bp, Homo sapiens
tgggatgtcacagtccaa

SEQ ID NO: 5531418 - DNA, 19 bp, Homo sapiens
tgggatgtccacagatgcc

SEQ ID NO: 5531419 - DNA, 13 bp, Homo sapiens
tgggatgtcctct

SEQ ID NO: 5531420 - DNA, 16 bp, Homo sapiens
tgggatgtcttatttt

SEQ ID NO: 5531421 - DNA, 17 bp, Homo sapiens
tgggatgtgagccccag

SEQ ID NO: 5531422 - DNA, 18 bp, Homo sapiens
tgggatgtgagccccagg

SEQ ID NO: 5531423 - DNA, 20 bp, Homo sapiens
tgggatgttcagcactgtcc

SEQ ID NO: 5531424 - DNA, 21 bp, Homo sapiens
tgggatgttcagcactgtccc

SEQ ID NO: 5531425 - DNA, 22 bp, Homo sapiens
tgggatgttcagcactgtccct

SEQ ID NO: 5531426 - DNA, 17 bp, Homo sapiens
tgggattaaagagattg

SEQ ID NO: 5531427 - DNA, 17 bp, Homo sapiens
tgggattaagaaacctt

SEQ ID NO: 5531428 - DNA, 22 bp, Homo sapiens
tgggattacaagcgtgagccac

SEQ ID NO: 5531429 - DNA, 12 bp, Homo sapiens
tgggattacagg

SEQ ID NO: 5531430 - DNA, 21 bp, Homo sapiens
tgggattacaggcatgagcca

SEQ ID NO: 5531431 - DNA, 21 bp, Homo sapiens
tgggattacaggcgtgagcca

SEQ ID NO: 5531432 - DNA, 19 bp, Homo sapiens
tgggattacaggcttgagc

SEQ ID NO: 5531433 - DNA, 13 bp, Homo sapiens
tgggattacaggt

SEQ ID NO: 5531434 - DNA, 21 bp, Homo sapiens
tgggattacaggtgtaagcca

SEQ ID NO: 5531435 - DNA, 17 bp, Homo sapiens
tgggattacaggtgtga

SEQ ID NO: 5531436 - DNA, 21 bp, Homo sapiens
tgggattacaggtgtgagcca

SEQ ID NO: 5531437 - DNA, 15 bp, Homo sapiens
tgggattactggcat

SEQ ID NO: 5531438 - DNA, 23 bp, Homo sapiens
tgggattagattcatctatggag

SEQ ID NO: 5531439 - DNA, 20 bp, Homo sapiens
tgggattataggcatgagcc

SEQ ID NO: 5531440 - DNA, 15 bp, Homo sapiens
tgggattatgggtca

SEQ ID NO: 5531441 - DNA, 19 bp, Homo sapiens
tgggattatgggtcacagg

SEQ ID NO: 5531442 - DNA, 12 bp, Homo sapiens
tgggattattct

SEQ ID NO: 5531443 - DNA, 13 bp, Homo sapiens
tgggattattctt

SEQ ID NO: 5531444 - DNA, 18 bp, Homo sapiens
tgggattattctttgaaa

SEQ ID NO: 5531445 - DNA, 23 bp, Homo sapiens
tgggattcaaacctgcatattgt

SEQ ID NO: 5531446 - DNA, 21 bp, Homo sapiens
tgggattcaggaaaaggcctg

SEQ ID NO: 5531447 - DNA, 16 bp, Homo sapiens
tgggattcctcccctg

SEQ ID NO: 5531448 - DNA, 17 bp, Homo sapiens
tgggattctactttaag

SEQ ID NO: 5531449 - DNA, 22 bp, Homo sapiens
tgggattctactttaagcacta

SEQ ID NO: 5531450 - DNA, 10 bp, Homo sapiens
tgggattgct

SEQ ID NO: 5531451 - DNA, 18 bp, Homo sapiens
tgggattgggggctggtg

SEQ ID NO: 5531452 - DNA, 14 bp, Homo sapiens
tgggattgggggga

SEQ ID NO: 5531453 - DNA, 18 bp, Homo sapiens
tgggatttcttcgctgct

SEQ ID NO: 5531454 - DNA, 13 bp, Homo sapiens
tgggatttgcaaa

SEQ ID NO: 5531455 - DNA, 16 bp, Homo sapiens
tgggattttaaaaaca

SEQ ID NO: 5531456 - DNA, 18 bp, Homo sapiens
tgggattttaaactagat

SEQ ID NO: 5531457 - DNA, 16 bp, Homo sapiens
tgggattttcaattat

SEQ ID NO: 5531458 - DNA, 16 bp, Homo sapiens
tgggattttttccctt

SEQ ID NO: 5531459 - DNA, 17 bp, Homo sapiens
tgggatttttttattaa

SEQ ID NO: 5531460 - DNA, 21 bp, Homo sapiens
tgggattttttttttttggtc

SEQ ID NO: 5531461 - DNA, 15 bp, Homo sapiens
tgggcaaaaaactcg

SEQ ID NO: 5531462 - DNA, 17 bp, Homo sapiens
tgggcaaaacccaggac

SEQ ID NO: 5531463 - DNA, 19 bp, Homo sapiens
tgggcaaaacccaggacat

SEQ ID NO: 5531464 - DNA, 22 bp, Homo sapiens
tgggcaaaacccaggacatctc

SEQ ID NO: 5531465 - DNA, 15 bp, Homo sapiens
tgggcaaaagagtgt

SEQ ID NO: 5531466 - DNA, 18 bp, Homo sapiens
tgggcaaacccttctctt

SEQ ID NO: 5531467 - DNA, 15 bp, Homo sapiens
tgggcaaagagtgta

SEQ ID NO: 5531468 - DNA, 21 bp, Homo sapiens
tgggcaaagcccctcacactg

SEQ ID NO: 5531469 - DNA, 15 bp, Homo sapiens
tgggcaaagcctagt

SEQ ID NO: 5531470 - DNA, 13 bp, Homo sapiens
tgggcaaagcttg

SEQ ID NO: 5531471 - DNA, 14 bp, Homo sapiens
tgggcaaagcttgt

SEQ ID NO: 5531472 - DNA, 18 bp, Homo sapiens
tgggcaaaggccccctct

SEQ ID NO: 5531473 - DNA, 11 bp, Homo sapiens
tgggcaacata

SEQ ID NO: 5531474 - DNA, 21 bp, Homo sapiens
tgggcaacccccagcctgcta

SEQ ID NO: 5531475 - DNA, 18 bp, Homo sapiens
tgggcaagacctcttccc

SEQ ID NO: 5531476 - DNA, 14 bp, Homo sapiens
tgggcaaggaggcc

SEQ ID NO: 5531477 - DNA, 16 bp, Homo sapiens
tgggcaaggtgggtga

SEQ ID NO: 5531478 - DNA, 13 bp, Homo sapiens
tgggcaagtccct

SEQ ID NO: 5531479 - DNA, 16 bp, Homo sapiens
tgggcaagtcccttga

SEQ ID NO: 5531480 - DNA, 17 bp, Homo sapiens
tgggcaagtgaggcaag

SEQ ID NO: 5531481 - DNA, 21 bp, Homo sapiens
tgggcaagtgaggcaagagaa

SEQ ID NO: 5531482 - DNA, 15 bp, Homo sapiens
tgggcaagtgattga

SEQ ID NO: 5531483 - DNA, 18 bp, Homo sapiens
tgggcaagtggatggccc

SEQ ID NO: 5531484 - DNA, 12 bp, Homo sapiens
tgggcaataaaa

SEQ ID NO: 5531485 - DNA, 16 bp, Homo sapiens
tgggcaatatagcaag

SEQ ID NO: 5531486 - DNA, 13 bp, Homo sapiens
tgggcaatattct

SEQ ID NO: 5531487 - DNA, 17 bp, Homo sapiens
tgggcaatattctctgt

SEQ ID NO: 5531488 - DNA, 17 bp, Homo sapiens
tgggcaatcctgggctg

SEQ ID NO: 5531489 - DNA, 18 bp, Homo sapiens
tgggcaatgaaaccaaag

SEQ ID NO: 5531490 - DNA, 18 bp, Homo sapiens
tgggcaatggccaggggc

SEQ ID NO: 5531491 - DNA, 17 bp, Homo sapiens
tgggcaattgttacaag

SEQ ID NO: 5531492 - DNA, 20 bp, Homo sapiens
tgggcaattgttacaagtgt

SEQ ID NO: 5531493 - DNA, 16 bp, Homo sapiens
tgggcaatttagaaaa

SEQ ID NO: 5531494 - DNA, 20 bp, Homo sapiens
tgggcacaaagggcccagat

SEQ ID NO: 5531495 - DNA, 21 bp, Homo sapiens
tgggcacaatcttggtcatgt

SEQ ID NO: 5531496 - DNA, 16 bp, Homo sapiens
tgggcacacgcacaaa

SEQ ID NO: 5531497 - DNA, 22 bp, Homo sapiens
tgggcacacgcctcccactggg

SEQ ID NO: 5531498 - DNA, 15 bp, Homo sapiens
tgggcacacgctgct

SEQ ID NO: 5531499 - DNA, 12 bp, Homo sapiens
tgggcacaggct

SEQ ID NO: 5531500 - DNA, 13 bp, Homo sapiens
tgggcacaggctg

SEQ ID NO: 5531501 - DNA, 17 bp, Homo sapiens
tgggcacagtgctgccc

SEQ ID NO: 5531502 - DNA, 23 bp, Homo sapiens
tgggcacagtgctgccccttgca

SEQ ID NO: 5531503 - DNA, 19 bp, Homo sapiens
tgggcacatagcataggct

SEQ ID NO: 5531504 - DNA, 21 bp, Homo sapiens
tgggcacatagcataggctgg

SEQ ID NO: 5531505 - DNA, 22 bp, Homo sapiens
tgggcacatagcataggctggg

SEQ ID NO: 5531506 - DNA, 20 bp, Homo sapiens
tgggcacatcatttcaagaa

SEQ ID NO: 5531507 - DNA, 18 bp, Homo sapiens
tgggcacatgaggagggt

SEQ ID NO: 5531508 - DNA, 16 bp, Homo sapiens
tgggcacatgctcagg

SEQ ID NO: 5531509 - DNA, 19 bp, Homo sapiens
tgggcaccagcttctttct

SEQ ID NO: 5531510 - DNA, 16 bp, Homo sapiens
tgggcacccaccctgg

SEQ ID NO: 5531511 - DNA, 19 bp, Homo sapiens
tgggcacccacctccaccc

SEQ ID NO: 5531512 - DNA, 16 bp, Homo sapiens
tgggcaccccactgca

SEQ ID NO: 5531513 - DNA, 21 bp, Homo sapiens
tgggcaccccaggcagctcct

SEQ ID NO: 5531514 - DNA, 16 bp, Homo sapiens
tgggcacccccagcct

SEQ ID NO: 5531515 - DNA, 18 bp, Homo sapiens
tgggcacccccagcctgg

SEQ ID NO: 5531516 - DNA, 19 bp, Homo sapiens
tgggcacccctgcctcctg

SEQ ID NO: 5531517 - DNA, 12 bp, Homo sapiens
tgggcaccctgc

SEQ ID NO: 5531518 - DNA, 14 bp, Homo sapiens
tgggcaccctgcag

SEQ ID NO: 5531519 - DNA, 15 bp, Homo sapiens
tgggcaccctgcagg

SEQ ID NO: 5531520 - DNA, 20 bp, Homo sapiens
tgggcaccctgcaggcaggc

SEQ ID NO: 5531521 - DNA, 21 bp, Homo sapiens
tgggcaccgggaccccctcac

SEQ ID NO: 5531522 - DNA, 21 bp, Homo sapiens
tgggcaccgtgtcctcctctg

SEQ ID NO: 5531523 - DNA, 15 bp, Homo sapiens
tgggcacctcagaaa

SEQ ID NO: 5531524 - DNA, 19 bp, Homo sapiens
tgggcacctggggagtggg

SEQ ID NO: 5531525 - DNA, 19 bp, Homo sapiens
tgggcacgctgtgggcagg

SEQ ID NO: 5531526 - DNA, 21 bp, Homo sapiens
tgggcacgggagagcgccacc

SEQ ID NO: 5531527 - DNA, 23 bp, Homo sapiens
tgggcactccgcgccgatgccac

SEQ ID NO: 5531528 - DNA, 13 bp, Homo sapiens
tgggcactgctcc

SEQ ID NO: 5531529 - DNA, 16 bp, Homo sapiens
tgggcactgctccaag

SEQ ID NO: 5531530 - DNA, 17 bp, Homo sapiens
tgggcactgctccaagg

SEQ ID NO: 5531531 - DNA, 19 bp, Homo sapiens
tgggcactgctccaaggga

SEQ ID NO: 5531532 - DNA, 20 bp, Homo sapiens
tgggcactgctccaagggac

SEQ ID NO: 5531533 - DNA, 15 bp, Homo sapiens
tgggcactgctgagg

SEQ ID NO: 5531534 - DNA, 14 bp, Homo sapiens
tgggcactgctggg

SEQ ID NO: 5531535 - DNA, 16 bp, Homo sapiens
tgggcactgctgggtg

SEQ ID NO: 5531536 - DNA, 21 bp, Homo sapiens
tgggcactgctgggtggccca

SEQ ID NO: 5531537 - DNA, 13 bp, Homo sapiens
tgggcactggaaa

SEQ ID NO: 5531538 - DNA, 17 bp, Homo sapiens
tgggcactgggcactag

SEQ ID NO: 5531539 - DNA, 13 bp, Homo sapiens
tgggcactggggc

SEQ ID NO: 5531540 - DNA, 20 bp, Homo sapiens
tgggcacttccctgctgcct

SEQ ID NO: 5531541 - DNA, 13 bp, Homo sapiens
tgggcacttgaga

SEQ ID NO: 5531542 - DNA, 15 bp, Homo sapiens
tgggcagaagataga

SEQ ID NO: 5531543 - DNA, 16 bp, Homo sapiens
tgggcagaaggaagac

SEQ ID NO: 5531544 - DNA, 15 bp, Homo sapiens
tgggcagaaggccaa

SEQ ID NO: 5531545 - DNA, 18 bp, Homo sapiens
tgggcagaaggccaagag

SEQ ID NO: 5531546 - DNA, 13 bp, Homo sapiens
tgggcagacaggt

SEQ ID NO: 5531547 - DNA, 12 bp, Homo sapiens
tgggcagagcag

SEQ ID NO: 5531548 - DNA, 17 bp, Homo sapiens
tgggcagagcagagacc

SEQ ID NO: 5531549 - DNA, 22 bp, Homo sapiens
tgggcagagcagagaccatccc

SEQ ID NO: 5531550 - DNA, 18 bp, Homo sapiens
tgggcagagcccccagga

SEQ ID NO: 5531551 - DNA, 16 bp, Homo sapiens
tgggcagagctgcatc

SEQ ID NO: 5531552 - DNA, 22 bp, Homo sapiens
tgggcagaggaatgtgggctat

SEQ ID NO: 5531553 - DNA, 23 bp, Homo sapiens
tgggcagaggaccaggctgtagg

SEQ ID NO: 5531554 - DNA, 17 bp, Homo sapiens
tgggcagaggggagagg

SEQ ID NO: 5531555 - DNA, 16 bp, Homo sapiens
tgggcagagtcctgcc

SEQ ID NO: 5531556 - DNA, 18 bp, Homo sapiens
tgggcagagtcctgcctt

SEQ ID NO: 5531557 - DNA, 19 bp, Homo sapiens
tgggcagagtcctgccttc

SEQ ID NO: 5531558 - DNA, 22 bp, Homo sapiens
tgggcagatctcccacatgcca

SEQ ID NO: 5531559 - DNA, 17 bp, Homo sapiens
tgggcagatcttttctt

SEQ ID NO: 5531560 - DNA, 13 bp, Homo sapiens
tgggcagcaaggc

SEQ ID NO: 5531561 - DNA, 17 bp, Homo sapiens
tgggcagcaatttaaat

SEQ ID NO: 5531562 - DNA, 18 bp, Homo sapiens
tgggcagcaatttaaatg

SEQ ID NO: 5531563 - DNA, 21 bp, Homo sapiens
tgggcagcaatttaaatgtta

SEQ ID NO: 5531564 - DNA, 17 bp, Homo sapiens
tgggcagcacaaggcct

SEQ ID NO: 5531565 - DNA, 12 bp, Homo sapiens
tgggcagcaccc

SEQ ID NO: 5531566 - DNA, 13 bp, Homo sapiens
tgggcagcaccct

SEQ ID NO: 5531567 - DNA, 17 bp, Homo sapiens
tgggcagcaccctcccc

SEQ ID NO: 5531568 - DNA, 18 bp, Homo sapiens
tgggcagcaccctccccc

SEQ ID NO: 5531569 - DNA, 17 bp, Homo sapiens
tgggcagcacctttcta

SEQ ID NO: 5531570 - DNA, 12 bp, Homo sapiens
tgggcagcagca

SEQ ID NO: 5531571 - DNA, 13 bp, Homo sapiens
tgggcagcagcat

SEQ ID NO: 5531572 - DNA, 18 bp, Homo sapiens
tgggcagcagcatcccag

SEQ ID NO: 5531573 - DNA, 23 bp, Homo sapiens
tgggcagcagcatcccagccttg

SEQ ID NO: 5531574 - DNA, 18 bp, Homo sapiens
tgggcagcagctcagcct

SEQ ID NO: 5531575 - DNA, 16 bp, Homo sapiens
tgggcagcatagcaag

SEQ ID NO: 5531576 - DNA, 18 bp, Homo sapiens
tgggcagcatagcaagac

SEQ ID NO: 5531577 - DNA, 18 bp, Homo sapiens
tgggcagcatgcccagat

SEQ ID NO: 5531578 - DNA, 14 bp, Homo sapiens
tgggcagccaggct

SEQ ID NO: 5531579 - DNA, 15 bp, Homo sapiens
tgggcagccaggctg

SEQ ID NO: 5531580 - DNA, 18 bp, Homo sapiens
tgggcagccatcttgaat

SEQ ID NO: 5531581 - DNA, 12 bp, Homo sapiens
tgggcagcccag

SEQ ID NO: 5531582 - DNA, 17 bp, Homo sapiens
tgggctgctggccatga

SEQ ID NO: 5531583 - DNA, 15 bp, Homo sapiens
tgggctgctggggca

SEQ ID NO: 5531584 - DNA, 18 bp, Homo sapiens
tgggctggaacagattca

SEQ ID NO: 5531585 - DNA, 18 bp, Homo sapiens
tgggctggaatcaggaat

SEQ ID NO: 5531586 - DNA, 22 bp, Homo sapiens
tgggctggagcagtttggggca

SEQ ID NO: 5531587 - DNA, 20 bp, Homo sapiens
tgggctggagtcctctccag

SEQ ID NO: 5531588 - DNA, 14 bp, Homo sapiens
tgggctggagtggg

SEQ ID NO: 5531589 - DNA, 16 bp, Homo sapiens
tgggctggatgagctc

SEQ ID NO: 5531590 - DNA, 18 bp, Homo sapiens
tgggctggcacagcccct

SEQ ID NO: 5531591 - DNA, 22 bp, Homo sapiens
tgggctggcacagcccctggag

SEQ ID NO: 5531592 - DNA, 19 bp, Homo sapiens
tgggctggcacccactgga

SEQ ID NO: 5531593 - DNA, 20 bp, Homo sapiens
tgggctggcggccatccccg

SEQ ID NO: 5531594 - DNA, 13 bp, Homo sapiens
tgggctggctctg

SEQ ID NO: 5531595 - DNA, 21 bp, Homo sapiens
tgggctggctctgaagccaag

SEQ ID NO: 5531596 - DNA, 16 bp, Homo sapiens
tgggctgggacttctt

SEQ ID NO: 5531597 - DNA, 19 bp, Homo sapiens
tgggctgggacttcttacc

SEQ ID NO: 5531598 - DNA, 12 bp, Homo sapiens
tgggctgggcac

SEQ ID NO: 5531599 - DNA, 13 bp, Homo sapiens
tgggctgggcagc

SEQ ID NO: 5531600 - DNA, 14 bp, Homo sapiens
tgggctgggcagcc

SEQ ID NO: 5531601 - DNA, 21 bp, Homo sapiens
tgggctgggcccacccaggga

SEQ ID NO: 5531602 - DNA, 21 bp, Homo sapiens
tgggctgggccctctcttctc

SEQ ID NO: 5531603 - DNA, 16 bp, Homo sapiens
tgggctgggccctctt

SEQ ID NO: 5531604 - DNA, 23 bp, Homo sapiens
tgggctgggcccttcctggctag

SEQ ID NO: 5531605 - DNA, 18 bp, Homo sapiens
tgggctggggactctggc

SEQ ID NO: 5531606 - DNA, 18 bp, Homo sapiens
tgggctggggaggaggag

SEQ ID NO: 5531607 - DNA, 11 bp, Homo sapiens
tgggctggggc

SEQ ID NO: 5531608 - DNA, 12 bp, Homo sapiens
tgggctggggca

SEQ ID NO: 5531609 - DNA, 15 bp, Homo sapiens
tgggctggggcaggg

SEQ ID NO: 5531610 - DNA, 19 bp, Homo sapiens
tgggctggggcaggggcct

SEQ ID NO: 5531611 - DNA, 23 bp, Homo sapiens
tgggctggggcaggggcctgggc

SEQ ID NO: 5531612 - DNA, 13 bp, Homo sapiens
tgggctggggcca

SEQ ID NO: 5531613 - DNA, 17 bp, Homo sapiens
tgggctggggcctcaga

SEQ ID NO: 5531614 - DNA, 19 bp, Homo sapiens
tgggctggggctgctcccc

SEQ ID NO: 5531615 - DNA, 12 bp, Homo sapiens
tgggctggggga

SEQ ID NO: 5531616 - DNA, 23 bp, Homo sapiens
tgggctggtatctcagaaagtgc

SEQ ID NO: 5531617 - DNA, 15 bp, Homo sapiens
tgggctggtattctc

SEQ ID NO: 5531618 - DNA, 16 bp, Homo sapiens
tgggctggtattctct

SEQ ID NO: 5531619 - DNA, 18 bp, Homo sapiens
tgggctggtgccccacag

SEQ ID NO: 5531620 - DNA, 19 bp, Homo sapiens
tgggctggtggctcccgga

SEQ ID NO: 5531621 - DNA, 21 bp, Homo sapiens
tgggctggtttggtggccagg

SEQ ID NO: 5531622 - DNA, 22 bp, Homo sapiens
tgggctggtttggtggccaggc

SEQ ID NO: 5531623 - DNA, 20 bp, Homo sapiens
tgggctgtaacgtggcactg

SEQ ID NO: 5531624 - DNA, 19 bp, Homo sapiens
tgggctgtagtttggagac

SEQ ID NO: 5531625 - DNA, 19 bp, Homo sapiens
tgggctgtcaacattcaaa

SEQ ID NO: 5531626 - DNA, 11 bp, Homo sapiens
tgggctgtcca

SEQ ID NO: 5531627 - DNA, 17 bp, Homo sapiens
tgggctgtccagcctta

SEQ ID NO: 5531628 - DNA, 15 bp, Homo sapiens
tgggctgtctgtcac

SEQ ID NO: 5531629 - DNA, 13 bp, Homo sapiens
tgggctgtgagga

SEQ ID NO: 5531630 - DNA, 14 bp, Homo sapiens
tgggctgtgaggac

SEQ ID NO: 5531631 - DNA, 15 bp, Homo sapiens
tgggctgtgaggaca

SEQ ID NO: 5531632 - DNA, 17 bp, Homo sapiens
tgggctgtgaggacagg

SEQ ID NO: 5531633 - DNA, 12 bp, Homo sapiens
tgggctgtgagt

SEQ ID NO: 5531634 - DNA, 21 bp, Homo sapiens
tgggctgtgattactgcaatc

SEQ ID NO: 5531635 - DNA, 22 bp, Homo sapiens
tgggctgtgtcctaaggcccat

SEQ ID NO: 5531636 - DNA, 22 bp, Homo sapiens
tgggctgttctgtttcctgtgt

SEQ ID NO: 5531637 - DNA, 21 bp, Homo sapiens
tgggctgttgtgtctggagcc

SEQ ID NO: 5531638 - DNA, 22 bp, Homo sapiens
tgggctgttgtgtctggagcct

SEQ ID NO: 5531639 - DNA, 14 bp, Homo sapiens
tgggcttagagcag

SEQ ID NO: 5531640 - DNA, 23 bp, Homo sapiens
tgggcttagtatttctcaggaag

SEQ ID NO: 5531641 - DNA, 19 bp, Homo sapiens
tgggcttatttagaaaaaa

SEQ ID NO: 5531642 - DNA, 18 bp, Homo sapiens
tgggcttcaacagccaag

SEQ ID NO: 5531643 - DNA, 23 bp, Homo sapiens
tgggcttcactgtataaatagga

SEQ ID NO: 5531644 - DNA, 14 bp, Homo sapiens
tgggcttcagcact

SEQ ID NO: 5531645 - DNA, 18 bp, Homo sapiens
tgggcttcagctgccagt

SEQ ID NO: 5531646 - DNA, 21 bp, Homo sapiens
tgggcttcagtggcagctgct

SEQ ID NO: 5531647 - DNA, 22 bp, Homo sapiens
tgggcttcatcctcctcagatc

SEQ ID NO: 5531648 - DNA, 13 bp, Homo sapiens
tgggcttcatctg

SEQ ID NO: 5531649 - DNA, 16 bp, Homo sapiens
tgggcttcattccgga

SEQ ID NO: 5531650 - DNA, 18 bp, Homo sapiens
tgggcttcattctggaaa

SEQ ID NO: 5531651 - DNA, 13 bp, Homo sapiens
tgggcttcccaag

SEQ ID NO: 5531652 - DNA, 12 bp, Homo sapiens
tgggcttcccag

SEQ ID NO: 5531653 - DNA, 22 bp, Homo sapiens
tgggcttcccagtggctgctgc

SEQ ID NO: 5531654 - DNA, 23 bp, Homo sapiens
tgggcttcccagtggctgctgcc

SEQ ID NO: 5531655 - DNA, 22 bp, Homo sapiens
tgggcttccccaggtggcctgg

SEQ ID NO: 5531656 - DNA, 14 bp, Homo sapiens
tgggcttcctgccc

SEQ ID NO: 5531657 - DNA, 19 bp, Homo sapiens
tgggcttcctgcccttccc

SEQ ID NO: 5531658 - DNA, 21 bp, Homo sapiens
tgggcttcctgcccttccctc

SEQ ID NO: 5531659 - DNA, 15 bp, Homo sapiens
tgggcttcctgctgg

SEQ ID NO: 5531660 - DNA, 19 bp, Homo sapiens
tgggcttcctgctgggact

SEQ ID NO: 5531661 - DNA, 16 bp, Homo sapiens
tgggcttcctggagca

SEQ ID NO: 5531662 - DNA, 22 bp, Homo sapiens
tgggcttcggagtgaatgtggc

SEQ ID NO: 5531663 - DNA, 22 bp, Homo sapiens
tgggcttctgcggtgaggcagg

SEQ ID NO: 5531664 - DNA, 16 bp, Homo sapiens
tgggcttctgtgccca

SEQ ID NO: 5531665 - DNA, 13 bp, Homo sapiens
tgggcttcttcct

SEQ ID NO: 5531666 - DNA, 11 bp, Homo sapiens
tgggcttgaca

SEQ ID NO: 5531667 - DNA, 18 bp, Homo sapiens
tgggcttgacacctgtct

SEQ ID NO: 5531668 - DNA, 21 bp, Homo sapiens
tgggcttgacacctgtcttga

SEQ ID NO: 5531669 - DNA, 22 bp, Homo sapiens
tgggcttgaccaggcttggcct

SEQ ID NO: 5531670 - DNA, 17 bp, Homo sapiens
tgggcttgctattctgt

SEQ ID NO: 5531671 - DNA, 13 bp, Homo sapiens
tgggcttggcctg

SEQ ID NO: 5531672 - DNA, 14 bp, Homo sapiens
tgggcttggcctgc

SEQ ID NO: 5531673 - DNA, 15 bp, Homo sapiens
tgggcttggcctgct

SEQ ID NO: 5531674 - DNA, 19 bp, Homo sapiens
tgggcttggcctgctgtga

SEQ ID NO: 5531675 - DNA, 17 bp, Homo sapiens
tgggcttggcctggaga

SEQ ID NO: 5531676 - DNA, 18 bp, Homo sapiens
tgggcttggcctggagag

SEQ ID NO: 5531677 - DNA, 20 bp, Homo sapiens
tgggcttggcctggagagga

SEQ ID NO: 5531678 - DNA, 16 bp, Homo sapiens
tgggcttggctcttgg

SEQ ID NO: 5531679 - DNA, 15 bp, Homo sapiens
tgggcttgggcctag

SEQ ID NO: 5531680 - DNA, 18 bp, Homo sapiens
tgggcttgggcctaggct

SEQ ID NO: 5531681 - DNA, 19 bp, Homo sapiens
tgggcttgggcctaggctg

SEQ ID NO: 5531682 - DNA, 18 bp, Homo sapiens
tgggcttgtggggcctgg

SEQ ID NO: 5531683 - DNA, 18 bp, Homo sapiens
tgggctttaaaagaaaaa

SEQ ID NO: 5531684 - DNA, 15 bp, Homo sapiens
tgggctttaacaaaa

SEQ ID NO: 5531685 - DNA, 20 bp, Homo sapiens
tgggctttaacatccttatt

SEQ ID NO: 5531686 - DNA, 20 bp, Homo sapiens
tgggctttctcagtgtcagc

SEQ ID NO: 5531687 - DNA, 15 bp, Homo sapiens
tgggctttctcctgg

SEQ ID NO: 5531688 - DNA, 11 bp, Homo sapiens
tgggctttctg

SEQ ID NO: 5531689 - DNA, 20 bp, Homo sapiens
tgggctttgattccatctcc

SEQ ID NO: 5531690 - DNA, 16 bp, Homo sapiens
tgggctttgatttcca

SEQ ID NO: 5531691 - DNA, 15 bp, Homo sapiens
tgggctttgcaggct

SEQ ID NO: 5531692 - DNA, 22 bp, Homo sapiens
tgggcttttatttttttggaac

SEQ ID NO: 5531693 - DNA, 22 bp, Homo sapiens
tgggcttttggggagccagaag

SEQ ID NO: 5531694 - DNA, 19 bp, Homo sapiens
tgggcttttgttctgaggg

SEQ ID NO: 5531695 - DNA, 20 bp, Homo sapiens
tgggcttttgttctgagggg

SEQ ID NO: 5531696 - DNA, 17 bp, Homo sapiens
tggggaaaaaaatcatc

SEQ ID NO: 5531697 - DNA, 17 bp, Homo sapiens
tggggaaaaaagcacat

SEQ ID NO: 5531698 - DNA, 19 bp, Homo sapiens
tggggaaaaagaatgatgc

SEQ ID NO: 5531699 - DNA, 23 bp, Homo sapiens
tggggaaaaggatgatggaaaaa

SEQ ID NO: 5531700 - DNA, 22 bp, Homo sapiens
tggggaaaatggccatgcagga

SEQ ID NO: 5531701 - DNA, 16 bp, Homo sapiens
tggggaaacagcatct

SEQ ID NO: 5531702 - DNA, 15 bp, Homo sapiens
tggggaaactaacaa

SEQ ID NO: 5531703 - DNA, 20 bp, Homo sapiens
tggggaaactgagggcagag

SEQ ID NO: 5531704 - DNA, 18 bp, Homo sapiens
tggggaaactggccatgg

SEQ ID NO: 5531705 - DNA, 17 bp, Homo sapiens
tggggaaacttgggaat

SEQ ID NO: 5531706 - DNA, 20 bp, Homo sapiens
tggggaaagacactgcctgg

SEQ ID NO: 5531707 - DNA, 17 bp, Homo sapiens
tggggaaaggaggtggg

SEQ ID NO: 5531708 - DNA, 11 bp, Homo sapiens
tggggaaaggg

SEQ ID NO: 5531709 - DNA, 21 bp, Homo sapiens
tggggaaaggggacaaggaag

SEQ ID NO: 5531710 - DNA, 15 bp, Homo sapiens
tggggaacaagggtg

SEQ ID NO: 5531711 - DNA, 14 bp, Homo sapiens
tggggaacaggtcc

SEQ ID NO: 5531712 - DNA, 20 bp, Homo sapiens
tggggaacatggctggcctg

SEQ ID NO: 5531713 - DNA, 22 bp, Homo sapiens
tggggaacatggctggcctggt

SEQ ID NO: 5531714 - DNA, 17 bp, Homo sapiens
tggggaactcccccaga

SEQ ID NO: 5531715 - DNA, 15 bp, Homo sapiens
tggggaactgagggc

SEQ ID NO: 5531716 - DNA, 18 bp, Homo sapiens
tggggaagaacagccccg

SEQ ID NO: 5531717 - DNA, 17 bp, Homo sapiens
tggggaagacagtggcc

SEQ ID NO: 5531718 - DNA, 18 bp, Homo sapiens
tggggaagacagtggccc

SEQ ID NO: 5531719 - DNA, 16 bp, Homo sapiens
tggggaagagagcctg

SEQ ID NO: 5531720 - DNA, 22 bp, Homo sapiens
tggggaagaggactgtgtgaga

SEQ ID NO: 5531721 - DNA, 21 bp, Homo sapiens
tggggaagaggatgagcagag

SEQ ID NO: 5531722 - DNA, 15 bp, Homo sapiens
tggggaagaggcctt

SEQ ID NO: 5531723 - DNA, 11 bp, Homo sapiens
tggggaagagt

SEQ ID NO: 5531724 - DNA, 14 bp, Homo sapiens
tggggaagattaga

SEQ ID NO: 5531725 - DNA, 21 bp, Homo sapiens
tggggaagcaagacgtcctgg

SEQ ID NO: 5531726 - DNA, 18 bp, Homo sapiens
tggggaagcttcttaaat

SEQ ID NO: 5531727 - DNA, 11 bp, Homo sapiens
tggggaaggag

SEQ ID NO: 5531728 - DNA, 16 bp, Homo sapiens
tggggaaggagccagt

SEQ ID NO: 5531729 - DNA, 21 bp, Homo sapiens
tggggaaggaggaggctccca

SEQ ID NO: 5531730 - DNA, 13 bp, Homo sapiens
tggggaaggcaga

SEQ ID NO: 5531731 - DNA, 19 bp, Homo sapiens
tggggaaggcagaggctgg

SEQ ID NO: 5531732 - DNA, 22 bp, Homo sapiens
tggggaaggcagaggctggcac

SEQ ID NO: 5531733 - DNA, 19 bp, Homo sapiens
tggggaagggaaccagccc

SEQ ID NO: 5531734 - DNA, 13 bp, Homo sapiens
tggggaaggggcc

SEQ ID NO: 5531735 - DNA, 23 bp, Homo sapiens
tggggaaggggcctgggctgtga

SEQ ID NO: 5531736 - DNA, 15 bp, Homo sapiens
tggggaagggtgggg

SEQ ID NO: 5531737 - DNA, 16 bp, Homo sapiens
tggggaagggtgggga

SEQ ID NO: 5531738 - DNA, 22 bp, Homo sapiens
tggggaagggtggggagaaata

SEQ ID NO: 5531739 - DNA, 22 bp, Homo sapiens
tggggaagggttttcttttctt

SEQ ID NO: 5531740 - DNA, 20 bp, Homo sapiens
tggggaaggttatcagtgct

SEQ ID NO: 5531741 - DNA, 19 bp, Homo sapiens
tggggaagtcaggggagaa

SEQ ID NO: 5531742 - DNA, 19 bp, Homo sapiens
tggggaagtgctccccaca

SEQ ID NO: 5531743 - DNA, 17 bp, Homo sapiens
tggggaagtttatttga

SEQ ID NO: 5531744 - DNA, 16 bp, Homo sapiens
tggggaatgctcccag

SEQ ID NO: 5531745 - DNA, 17 bp, Homo sapiens
tggggaatgctcccagc

SEQ ID NO: 5531746 - DNA, 17 bp, Homo sapiens
tggggaattaaatagtg

SEQ ID NO: 5531747 - DNA, 14 bp, Homo sapiens
tggggacacagcag

SEQ ID NO: 5531748 - DNA, 18 bp, Homo sapiens
tggggacacagcagtgag

SEQ ID NO: 5531749 - DNA, 23 bp, Homo sapiens
tggggacacaggatcctggcctg

SEQ ID NO: 5531750 - DNA, 14 bp, Homo sapiens
tggggacagaccag

SEQ ID NO: 5531751 - DNA, 17 bp, Homo sapiens
tggggacagaccagccc

SEQ ID NO: 5531752 - DNA, 14 bp, Homo sapiens
tggggacagagcca

SEQ ID NO: 5531753 - DNA, 17 bp, Homo sapiens
tggggacagagccaccc

SEQ ID NO: 5531754 - DNA, 12 bp, Homo sapiens
tggggacagatt

SEQ ID NO: 5531755 - DNA, 21 bp, Homo sapiens
tggggacagattcagtcttgc

SEQ ID NO: 5531756 - DNA, 19 bp, Homo sapiens
tggggacagctttcctggg

SEQ ID NO: 5531757 - DNA, 21 bp, Homo sapiens
tggggacagctttcctgggtg

SEQ ID NO: 5531758 - DNA, 22 bp, Homo sapiens
tggggacataaagcctctgact

SEQ ID NO: 5531759 - DNA, 15 bp, Homo sapiens
tgggggtgggtcaga

SEQ ID NO: 5531760 - DNA, 16 bp, Homo sapiens
tgggggttctggcagg

SEQ ID NO: 5531761 - DNA, 15 bp, Homo sapiens
tgggggttctttctt

SEQ ID NO: 5531762 - DNA, 22 bp, Homo sapiens
tgggggttctttcttcctctgc

SEQ ID NO: 5531763 - DNA, 19 bp, Homo sapiens
tgggggttttcaatgtgaa

SEQ ID NO: 5531764 - DNA, 15 bp, Homo sapiens
tggggtaagccagag

SEQ ID NO: 5531765 - DNA, 19 bp, Homo sapiens
tggggtaagccagagcctg

SEQ ID NO: 5531766 - DNA, 17 bp, Homo sapiens
tggggtaagcggaataa

SEQ ID NO: 5531767 - DNA, 15 bp, Homo sapiens
tggggtacaggcagt

SEQ ID NO: 5531768 - DNA, 20 bp, Homo sapiens
tggggtacaggtttggggag

SEQ ID NO: 5531769 - DNA, 14 bp, Homo sapiens
tggggtacagtaaa

SEQ ID NO: 5531770 - DNA, 16 bp, Homo sapiens
tggggtacatttctct

SEQ ID NO: 5531771 - DNA, 22 bp, Homo sapiens
tggggtaccagccactggaggg

SEQ ID NO: 5531772 - DNA, 18 bp, Homo sapiens
tggggtaccatgtggcca

SEQ ID NO: 5531773 - DNA, 17 bp, Homo sapiens
tggggtacccactgctc

SEQ ID NO: 5531774 - DNA, 14 bp, Homo sapiens
tggggtagactgag

SEQ ID NO: 5531775 - DNA, 18 bp, Homo sapiens
tggggtagctagaggaac

SEQ ID NO: 5531776 - DNA, 16 bp, Homo sapiens
tggggtaggctgctcc

SEQ ID NO: 5531777 - DNA, 20 bp, Homo sapiens
tggggtaggctgctccctga

SEQ ID NO: 5531778 - DNA, 16 bp, Homo sapiens
tggggtagggctgact

SEQ ID NO: 5531779 - DNA, 22 bp, Homo sapiens
tggggtagggtgagaagggcag

SEQ ID NO: 5531780 - DNA, 15 bp, Homo sapiens
tggggtaggttggga

SEQ ID NO: 5531781 - DNA, 21 bp, Homo sapiens
tggggtaggttgggagaatgt

SEQ ID NO: 5531782 - DNA, 19 bp, Homo sapiens
tggggtataggtctcatct

SEQ ID NO: 5531783 - DNA, 19 bp, Homo sapiens
tggggtatggattctaaaa

SEQ ID NO: 5531784 - DNA, 20 bp, Homo sapiens
tggggtatggattctaaaat

SEQ ID NO: 5531785 - DNA, 15 bp, Homo sapiens
tggggtatgggagag

SEQ ID NO: 5531786 - DNA, 20 bp, Homo sapiens
tggggtatttaccacagcag

SEQ ID NO: 5531787 - DNA, 12 bp, Homo sapiens
tggggtattttt

SEQ ID NO: 5531788 - DNA, 20 bp, Homo sapiens
tggggtcaagaaacagccag

SEQ ID NO: 5531789 - DNA, 22 bp, Homo sapiens
tggggtcaagaaacagccagca

SEQ ID NO: 5531790 - DNA, 16 bp, Homo sapiens
tggggtcaagctgagc

SEQ ID NO: 5531791 - DNA, 15 bp, Homo sapiens
tggggtcacagaggc

SEQ ID NO: 5531792 - DNA, 13 bp, Homo sapiens
tggggtcactctg

SEQ ID NO: 5531793 - DNA, 14 bp, Homo sapiens
tggggtcactctgg

SEQ ID NO: 5531794 - DNA, 17 bp, Homo sapiens
tggggtcactctggcag

SEQ ID NO: 5531795 - DNA, 18 bp, Homo sapiens
tggggtcactctggcagc

SEQ ID NO: 5531796 - DNA, 20 bp, Homo sapiens
tggggtcactctggcagctc

SEQ ID NO: 5531797 - DNA, 18 bp, Homo sapiens
tggggtcagcaggcccag

SEQ ID NO: 5531798 - DNA, 20 bp, Homo sapiens
tggggtcagccccaagggct

SEQ ID NO: 5531799 - DNA, 20 bp, Homo sapiens
tggggtcaggccgggcagag

SEQ ID NO: 5531800 - DNA, 21 bp, Homo sapiens
tggggtcaggtgccactgacc

SEQ ID NO: 5531801 - DNA, 20 bp, Homo sapiens
tggggtcatgccctcctctc

SEQ ID NO: 5531802 - DNA, 23 bp, Homo sapiens
tggggtccacttccccctcttca

SEQ ID NO: 5531803 - DNA, 14 bp, Homo sapiens
tggggtccagggct

SEQ ID NO: 5531804 - DNA, 15 bp, Homo sapiens
tggggtcccagcagc

SEQ ID NO: 5531805 - DNA, 15 bp, Homo sapiens
tggggtcccagggaa

SEQ ID NO: 5531806 - DNA, 15 bp, Homo sapiens
tggggtccccactcc

SEQ ID NO: 5531807 - DNA, 16 bp, Homo sapiens
tggggtccccactccc

SEQ ID NO: 5531808 - DNA, 21 bp, Homo sapiens
tggggtcccccctgagtgggc

SEQ ID NO: 5531809 - DNA, 21 bp, Homo sapiens
tggggtcctcctgtgctattt

SEQ ID NO: 5531810 - DNA, 20 bp, Homo sapiens
tggggtcctggagcagacca

SEQ ID NO: 5531811 - DNA, 19 bp, Homo sapiens
tggggtcctgggctggggc

SEQ ID NO: 5531812 - DNA, 15 bp, Homo sapiens
tggggtcggctcctg

SEQ ID NO: 5531813 - DNA, 17 bp, Homo sapiens
tggggtctcaggtccag

SEQ ID NO: 5531814 - DNA, 21 bp, Homo sapiens
tggggtctccctctcctgcct

SEQ ID NO: 5531815 - DNA, 10 bp, Homo sapiens
tggggtctct

SEQ ID NO: 5531816 - DNA, 17 bp, Homo sapiens
tggggtctctcacagac

SEQ ID NO: 5531817 - DNA, 22 bp, Homo sapiens
tggggtctctctccctacctcc

SEQ ID NO: 5531818 - DNA, 15 bp, Homo sapiens
tggggtctctgagca

SEQ ID NO: 5531819 - DNA, 18 bp, Homo sapiens
tggggtctggcagcctcc

SEQ ID NO: 5531820 - DNA, 13 bp, Homo sapiens
tggggtctgtaaa

SEQ ID NO: 5531821 - DNA, 16 bp, Homo sapiens
tggggtctgtaaaatc

SEQ ID NO: 5531822 - DNA, 17 bp, Homo sapiens
tggggtctgtgactgga

SEQ ID NO: 5531823 - DNA, 21 bp, Homo sapiens
tggggtcttagggtacagccc

SEQ ID NO: 5531824 - DNA, 22 bp, Homo sapiens
tggggtcttgctatgttgccca

SEQ ID NO: 5531825 - DNA, 14 bp, Homo sapiens
tggggtgacagtca

SEQ ID NO: 5531826 - DNA, 16 bp, Homo sapiens
tggggtgacagtcatc

SEQ ID NO: 5531827 - DNA, 23 bp, Homo sapiens
tggggtgacagtcatcatcaggg

SEQ ID NO: 5531828 - DNA, 19 bp, Homo sapiens
tggggtgagaattgggcgg

SEQ ID NO: 5531829 - DNA, 15 bp, Homo sapiens
tggggtgagcctgac

SEQ ID NO: 5531830 - DNA, 13 bp, Homo sapiens
tggggtgagggag

SEQ ID NO: 5531831 - DNA, 17 bp, Homo sapiens
tggggtgataaggggcc

SEQ ID NO: 5531832 - DNA, 23 bp, Homo sapiens
tggggtgatgaccccatagacct

SEQ ID NO: 5531833 - DNA, 18 bp, Homo sapiens
tggggtgatggccagagg

SEQ ID NO: 5531834 - DNA, 19 bp, Homo sapiens
tggggtgatggccagagga

SEQ ID NO: 5531835 - DNA, 16 bp, Homo sapiens
tggggtgcactcgcca

SEQ ID NO: 5531836 - DNA, 22 bp, Homo sapiens
tggggtgcagctgggtggggca

SEQ ID NO: 5531837 - DNA, 15 bp, Homo sapiens
tggggtgcagcttca

SEQ ID NO: 5531838 - DNA, 18 bp, Homo sapiens
tggggtgcagggatgtgg

SEQ ID NO: 5531839 - DNA, 19 bp, Homo sapiens
tggggtgccctccactgcc

SEQ ID NO: 5531840 - DNA, 15 bp, Homo sapiens
tggggtgccgcctgc

SEQ ID NO: 5531841 - DNA, 12 bp, Homo sapiens
tggggtgcctga

SEQ ID NO: 5531842 - DNA, 21 bp, Homo sapiens
tggggtgccttcactgggcca

SEQ ID NO: 5531843 - DNA, 22 bp, Homo sapiens
tggggtgccttcactgggccag

SEQ ID NO: 5531844 - DNA, 14 bp, Homo sapiens
tggggtgctgccct

SEQ ID NO: 5531845 - DNA, 21 bp, Homo sapiens
tggggtgctgcctctcacaca

SEQ ID NO: 5531846 - DNA, 17 bp, Homo sapiens
tggggtgctggggctgc

SEQ ID NO: 5531847 - DNA, 18 bp, Homo sapiens
tggggtgctggggctgca

SEQ ID NO: 5531848 - DNA, 22 bp, Homo sapiens
tggggtgcttcctttcaggcca

SEQ ID NO: 5531849 - DNA, 14 bp, Homo sapiens
tggggtgcttgctg

SEQ ID NO: 5531850 - DNA, 19 bp, Homo sapiens
tggggtggagcactggact

SEQ ID NO: 5531851 - DNA, 13 bp, Homo sapiens
tggggtggaggct

SEQ ID NO: 5531852 - DNA, 22 bp, Homo sapiens
tggggtggaggctaagcctgga

SEQ ID NO: 5531853 - DNA, 15 bp, Homo sapiens
tggggtggagtccca

SEQ ID NO: 5531854 - DNA, 14 bp, Homo sapiens
tggggtggcctcaa

SEQ ID NO: 5531855 - DNA, 16 bp, Homo sapiens
tggggtggcctggccc

SEQ ID NO: 5531856 - DNA, 15 bp, Homo sapiens
tggggtggcgtctgc

SEQ ID NO: 5531857 - DNA, 16 bp, Homo sapiens
tggggtggcgtctgcc

SEQ ID NO: 5531858 - DNA, 13 bp, Homo sapiens
tggggtggctgca

SEQ ID NO: 5531859 - DNA, 21 bp, Homo sapiens
tggggtgggagctcctccgca

SEQ ID NO: 5531860 - DNA, 13 bp, Homo sapiens
tggggtgggaggg

SEQ ID NO: 5531861 - DNA, 14 bp, Homo sapiens
tggggtgggagggt

SEQ ID NO: 5531862 - DNA, 23 bp, Homo sapiens
tggggtgggagtaacagggcaga

SEQ ID NO: 5531863 - DNA, 13 bp, Homo sapiens
tggggtgggcagg

SEQ ID NO: 5531864 - DNA, 15 bp, Homo sapiens
tggggtggggagaaa

SEQ ID NO: 5531865 - DNA, 14 bp, Homo sapiens
tggggtggggcagg

SEQ ID NO: 5531866 - DNA, 11 bp, Homo sapiens
tggggtggggg

SEQ ID NO: 5531867 - DNA, 19 bp, Homo sapiens
tggggtgggggccaggcct

SEQ ID NO: 5531868 - DNA, 19 bp, Homo sapiens
tggggtgggggtggggaga

SEQ ID NO: 5531869 - DNA, 14 bp, Homo sapiens
tggggtggggtggg

SEQ ID NO: 5531870 - DNA, 19 bp, Homo sapiens
tggggtgggtataaaagat

SEQ ID NO: 5531871 - DNA, 15 bp, Homo sapiens
tggggtgtgcatgcc

SEQ ID NO: 5531872 - DNA, 18 bp, Homo sapiens
tggggtgtggggtggggt

SEQ ID NO: 5531873 - DNA, 21 bp, Homo sapiens
tggggtgttaatggtagcatt

SEQ ID NO: 5531874 - DNA, 22 bp, Homo sapiens
tggggttatagaaggtcagcaa

SEQ ID NO: 5531875 - DNA, 20 bp, Homo sapiens
tggggttcaagcccaggctt

SEQ ID NO: 5531876 - DNA, 19 bp, Homo sapiens
tggggttcataggggcagg

SEQ ID NO: 5531877 - DNA, 14 bp, Homo sapiens
tggggttcccccag

SEQ ID NO: 5531878 - DNA, 22 bp, Homo sapiens
tggggttcctctgtacagcaag

SEQ ID NO: 5531879 - DNA, 11 bp, Homo sapiens
tggggttcctg

SEQ ID NO: 5531880 - DNA, 12 bp, Homo sapiens
tggggttcctgc

SEQ ID NO: 5531881 - DNA, 13 bp, Homo sapiens
tggggttcctgct

SEQ ID NO: 5531882 - DNA, 14 bp, Homo sapiens
tggggttcctgctg

SEQ ID NO: 5531883 - DNA, 20 bp, Homo sapiens
tggggttcctgctgtggggc

SEQ ID NO: 5531884 - DNA, 15 bp, Homo sapiens
tggggttcggcctgt

SEQ ID NO: 5531885 - DNA, 14 bp, Homo sapiens
tggggttcgtggaa

SEQ ID NO: 5531886 - DNA, 22 bp, Homo sapiens
tggggttctggaaatccagata

SEQ ID NO: 5531887 - DNA, 19 bp, Homo sapiens
tggggttgcatcagaaatg

SEQ ID NO: 5531888 - DNA, 22 bp, Homo sapiens
tggggttgccagaggccctgga

SEQ ID NO: 5531889 - DNA, 14 bp, Homo sapiens
tggggttgcccagc

SEQ ID NO: 5531890 - DNA, 19 bp, Homo sapiens
tggggttgcccagcctgga

SEQ ID NO: 5531891 - DNA, 21 bp, Homo sapiens
tggggttgccctgggggatac

SEQ ID NO: 5531892 - DNA, 21 bp, Homo sapiens
tggggttggctgggcccagaa

SEQ ID NO: 5531893 - DNA, 14 bp, Homo sapiens
tggggttgtccccg

SEQ ID NO: 5531894 - DNA, 14 bp, Homo sapiens
tggggttgtgttgt

SEQ ID NO: 5531895 - DNA, 16 bp, Homo sapiens
tggggtttcaccatgt

SEQ ID NO: 5531896 - DNA, 14 bp, Homo sapiens
tggggttttcactt

SEQ ID NO: 5531897 - DNA, 17 bp, Homo sapiens
tggggttttcacttcct

SEQ ID NO: 5531898 - DNA, 23 bp, Homo sapiens
tggggttttgacttgccactgcc

SEQ ID NO: 5531899 - DNA, 12 bp, Homo sapiens
tggggttttgta

SEQ ID NO: 5531900 - DNA, 15 bp, Homo sapiens
tggggtttttattat

SEQ ID NO: 5531901 - DNA, 21 bp, Homo sapiens
tggggtttttgccctggagcc

SEQ ID NO: 5531902 - DNA, 21 bp, Homo sapiens
tgggtaaaagcagggcagcag

SEQ ID NO: 5531903 - DNA, 15 bp, Homo sapiens
tgggtaaaatacttt

SEQ ID NO: 5531904 - DNA, 16 bp, Homo sapiens
tgggtaaaatactttt

SEQ ID NO: 5531905 - DNA, 15 bp, Homo sapiens
tgggtaaaattagat

SEQ ID NO: 5531906 - DNA, 24 bp, Homo sapiens
tgggtaaaattagatgcatgttga

SEQ ID NO: 5531907 - DNA, 15 bp, Homo sapiens
tgggtaaagggacag

SEQ ID NO: 5531908 - DNA, 16 bp, Homo sapiens
tgggtaaagggacagt

SEQ ID NO: 5531909 - DNA, 13 bp, Homo sapiens
tgggtaaataaat

SEQ ID NO: 5531910 - DNA, 15 bp, Homo sapiens
tgggtaaataaatgc

SEQ ID NO: 5531911 - DNA, 16 bp, Homo sapiens
tgggtaaataaatgct

SEQ ID NO: 5531912 - DNA, 19 bp, Homo sapiens
tgggtaaataaatgctgct

SEQ ID NO: 5531913 - DNA, 20 bp, Homo sapiens
tgggtaaatgcaaagttctg

SEQ ID NO: 5531914 - DNA, 17 bp, Homo sapiens
tgggtaaatgtggtgag

SEQ ID NO: 5531915 - DNA, 20 bp, Homo sapiens
tgggtaacctgaagttttat

SEQ ID NO: 5531916 - DNA, 14 bp, Homo sapiens
tgggtaacgtgaga

SEQ ID NO: 5531917 - DNA, 16 bp, Homo sapiens
tgggtaagaggagcag

SEQ ID NO: 5531918 - DNA, 22 bp, Homo sapiens
tgggtaatccaggcacagctga

SEQ ID NO: 5531919 - DNA, 23 bp, Homo sapiens
tgggtaatccaggcacagctgag

SEQ ID NO: 5531920 - DNA, 18 bp, Homo sapiens
tgggtaatgaaacaaaga

SEQ ID NO: 5531921 - DNA, 20 bp, Homo sapiens
tgggtaattaaaaacagaaa

SEQ ID NO: 5531922 - DNA, 15 bp, Homo sapiens
tgggtaattgtacaa

SEQ ID NO: 5531923 - DNA, 19 bp, Homo sapiens
tgggtaattgtacaataaa

SEQ ID NO: 5531924 - DNA, 20 bp, Homo sapiens
tgggtaattgtacaataaat

SEQ ID NO: 5531925 - DNA, 20 bp, Homo sapiens
tgggtaatttagattgtaaa

SEQ ID NO: 5531926 - DNA, 14 bp, Homo sapiens
tgggtaattttctt

SEQ ID NO: 5531927 - DNA, 23 bp, Homo sapiens
tgggtacaggtttttttggattt

SEQ ID NO: 5531928 - DNA, 13 bp, Homo sapiens
tgggtacatcaag

SEQ ID NO: 5531929 - DNA, 15 bp, Homo sapiens
tgggtacatgtgagg

SEQ ID NO: 5531930 - DNA, 16 bp, Homo sapiens
tgggtacccaggctgg

SEQ ID NO: 5531931 - DNA, 19 bp, Homo sapiens
tgggtacctggtccccact

SEQ ID NO: 5531932 - DNA, 22 bp, Homo sapiens
tgggtacctgtaattagtttaa

SEQ ID NO: 5531933 - DNA, 16 bp, Homo sapiens
tgggtactgactgaga

SEQ ID NO: 5531934 - DNA, 21 bp, Homo sapiens
tgggtactgtctcggcagagg

SEQ ID NO: 5531935 - DNA, 17 bp, Homo sapiens
tgggtacttatactaaa

SEQ ID NO: 5531936 - DNA, 19 bp, Homo sapiens
tgggtacttcttgaaggtg

SEQ ID NO: 5531937 - DNA, 13 bp, Homo sapiens
tggtccagctctt

SEQ ID NO: 5531938 - DNA, 16 bp, Homo sapiens
tggtccaggccctgtg

SEQ ID NO: 5531939 - DNA, 17 bp, Homo sapiens
tggtccagggaagctgg

SEQ ID NO: 5531940 - DNA, 21 bp, Homo sapiens
tggtccagggctagtgacttg

SEQ ID NO: 5531941 - DNA, 20 bp, Homo sapiens
tggtccagggtccagccctc

SEQ ID NO: 5531942 - DNA, 12 bp, Homo sapiens
tggtccagtgtc

SEQ ID NO: 5531943 - DNA, 15 bp, Homo sapiens
tggtccatagagagc

SEQ ID NO: 5531944 - DNA, 12 bp, Homo sapiens
tggtccatcccc

SEQ ID NO: 5531945 - DNA, 16 bp, Homo sapiens
tggtccatcccctgag

SEQ ID NO: 5531946 - DNA, 14 bp, Homo sapiens
tggtccatctctga

SEQ ID NO: 5531947 - DNA, 17 bp, Homo sapiens
tggtccatctctgaaaa

SEQ ID NO: 5531948 - DNA, 20 bp, Homo sapiens
tggtccatctggttttctct

SEQ ID NO: 5531949 - DNA, 14 bp, Homo sapiens
tggtccatgcaggg

SEQ ID NO: 5531950 - DNA, 18 bp, Homo sapiens
tggtccatgcagggggct

SEQ ID NO: 5531951 - DNA, 17 bp, Homo sapiens
tggtccatttcatgtga

SEQ ID NO: 5531952 - DNA, 20 bp, Homo sapiens
tggtccatttcatgtgatct

SEQ ID NO: 5531953 - DNA, 17 bp, Homo sapiens
tggtccatttgttcctg

SEQ ID NO: 5531954 - DNA, 15 bp, Homo sapiens
tggtcccacatccct

SEQ ID NO: 5531955 - DNA, 16 bp, Homo sapiens
tggtcccacatccctg

SEQ ID NO: 5531956 - DNA, 22 bp, Homo sapiens
tggtcccacatccctgggcctg

SEQ ID NO: 5531957 - DNA, 14 bp, Homo sapiens
tggtcccaccccac

SEQ ID NO: 5531958 - DNA, 21 bp, Homo sapiens
tggtcccagacagctggaccc

SEQ ID NO: 5531959 - DNA, 16 bp, Homo sapiens
tggtcccagccagcag

SEQ ID NO: 5531960 - DNA, 16 bp, Homo sapiens
tggtcccatccaggca

SEQ ID NO: 5531961 - DNA, 17 bp, Homo sapiens
tggtcccatcctctaaa

SEQ ID NO: 5531962 - DNA, 17 bp, Homo sapiens
tggtccccagcattgca

SEQ ID NO: 5531963 - DNA, 17 bp, Homo sapiens
tggtcccccatgggctg

SEQ ID NO: 5531964 - DNA, 15 bp, Homo sapiens
tggtcccccttccat

SEQ ID NO: 5531965 - DNA, 17 bp, Homo sapiens
tggtccccgttccaccc

SEQ ID NO: 5531966 - DNA, 11 bp, Homo sapiens
tggtcccctcc

SEQ ID NO: 5531967 - DNA, 22 bp, Homo sapiens
tggtcccctccctcgtgggctt

SEQ ID NO: 5531968 - DNA, 14 bp, Homo sapiens
tggtcccctcctca

SEQ ID NO: 5531969 - DNA, 21 bp, Homo sapiens
tggtcccgtggatgctctttc

SEQ ID NO: 5531970 - DNA, 22 bp, Homo sapiens
tggtccctccagaaccaccccg

SEQ ID NO: 5531971 - DNA, 14 bp, Homo sapiens
tggtccctctcaga

SEQ ID NO: 5531972 - DNA, 14 bp, Homo sapiens
tggtccctctgagg

SEQ ID NO: 5531973 - DNA, 19 bp, Homo sapiens
tggtccctcttctctcctc

SEQ ID NO: 5531974 - DNA, 20 bp, Homo sapiens
tggtccctcttctctcctca

SEQ ID NO: 5531975 - DNA, 21 bp, Homo sapiens
tggtccctcttctctcctcag

SEQ ID NO: 5531976 - DNA, 13 bp, Homo sapiens
tggtccctgccct

SEQ ID NO: 5531977 - DNA, 17 bp, Homo sapiens
tggtccctgccctcatc

SEQ ID NO: 5531978 - DNA, 19 bp, Homo sapiens
tggtccctgccctcccctg

SEQ ID NO: 5531979 - DNA, 22 bp, Homo sapiens
tggtccctgccctcccctgctc

SEQ ID NO: 5531980 - DNA, 13 bp, Homo sapiens
tggtccctgcctt

SEQ ID NO: 5531981 - DNA, 14 bp, Homo sapiens
tggtccctggaagc

SEQ ID NO: 5531982 - DNA, 15 bp, Homo sapiens
tggtccctggaagct

SEQ ID NO: 5531983 - DNA, 23 bp, Homo sapiens
tggtccctggaagcttaaagtat

SEQ ID NO: 5531984 - DNA, 15 bp, Homo sapiens
tggtccctggtcctt

SEQ ID NO: 5531985 - DNA, 16 bp, Homo sapiens
tggtcccttaaggcac

SEQ ID NO: 5531986 - DNA, 22 bp, Homo sapiens
tggtcccttccaatgctgtggg

SEQ ID NO: 5531987 - DNA, 15 bp, Homo sapiens
tggtcccttcttccc

SEQ ID NO: 5531988 - DNA, 18 bp, Homo sapiens
tggtccgagctgaggact

SEQ ID NO: 5531989 - DNA, 16 bp, Homo sapiens
tggtccgctttcctgg

SEQ ID NO: 5531990 - DNA, 19 bp, Homo sapiens
tggtccggacactcctaga

SEQ ID NO: 5531991 - DNA, 19 bp, Homo sapiens
tggtccgtgcccaggccct

SEQ ID NO: 5531992 - DNA, 23 bp, Homo sapiens
tggtcctaatatatatgtagaga

SEQ ID NO: 5531993 - DNA, 17 bp, Homo sapiens
tggtcctaatcttctga

SEQ ID NO: 5531994 - DNA, 19 bp, Homo sapiens
tggtcctaatcttctgaac

SEQ ID NO: 5531995 - DNA, 16 bp, Homo sapiens
tggtcctaggctggaa

SEQ ID NO: 5531996 - DNA, 18 bp, Homo sapiens
tggtcctaggctggaagg

SEQ ID NO: 5531997 - DNA, 19 bp, Homo sapiens
tggtcctaggctggaagga

SEQ ID NO: 5531998 - DNA, 19 bp, Homo sapiens
tggtcctatggcctcatgt

SEQ ID NO: 5531999 - DNA, 16 bp, Homo sapiens
tggtcctccatttcaa

SEQ ID NO: 5532000 - DNA, 15 bp, Homo sapiens
tggtcctccctccca

SEQ ID NO: 5532001 - DNA, 21 bp, Homo sapiens
tggtcctcctatctccctggc

SEQ ID NO: 5532002 - DNA, 16 bp, Homo sapiens
tggtcctctctctgtg

SEQ ID NO: 5532003 - DNA, 22 bp, Homo sapiens
tggtcctctgatttcacatatt

SEQ ID NO: 5532004 - DNA, 14 bp, Homo sapiens
tggtcctgaatgta

SEQ ID NO: 5532005 - DNA, 13 bp, Homo sapiens
tggtcctgaccag

SEQ ID NO: 5532006 - DNA, 12 bp, Homo sapiens
tggtcctgactc

SEQ ID NO: 5532007 - DNA, 22 bp, Homo sapiens
tggtcctgactcaacatgttac

SEQ ID NO: 5532008 - DNA, 12 bp, Homo sapiens
tggtcctgactt

SEQ ID NO: 5532009 - DNA, 14 bp, Homo sapiens
tggtcctgagacct

SEQ ID NO: 5532010 - DNA, 20 bp, Homo sapiens
tggtcctgagggtccccacc

SEQ ID NO: 5532011 - DNA, 14 bp, Homo sapiens
tggtcctgcacatg

SEQ ID NO: 5532012 - DNA, 13 bp, Homo sapiens
tggtcctgcactg

SEQ ID NO: 5532013 - DNA, 18 bp, Homo sapiens
tggtcctgcctaaatttc

SEQ ID NO: 5532014 - DNA, 16 bp, Homo sapiens
tggtcctggctgcact

SEQ ID NO: 5532015 - DNA, 13 bp, Homo sapiens
tggtcctggctgg

SEQ ID NO: 5532016 - DNA, 11 bp, Homo sapiens
tggtcctgggg

SEQ ID NO: 5532017 - DNA, 16 bp, Homo sapiens
tggtcctggggctctg

SEQ ID NO: 5532018 - DNA, 19 bp, Homo sapiens
tggtcctggggctctgtgc

SEQ ID NO: 5532019 - DNA, 11 bp, Homo sapiens
tggtcctggtg

SEQ ID NO: 5532020 - DNA, 12 bp, Homo sapiens
tggtcctggtgc

SEQ ID NO: 5532021 - DNA, 13 bp, Homo sapiens
tggtcctggtgct

SEQ ID NO: 5532022 - DNA, 13 bp, Homo sapiens
tggtcctgtagga

SEQ ID NO: 5532023 - DNA, 20 bp, Homo sapiens
tggtcctgtaggagttctat

SEQ ID NO: 5532024 - DNA, 20 bp, Homo sapiens
tggtcctgtcaccctggccc

SEQ ID NO: 5532025 - DNA, 16 bp, Homo sapiens
tggtcctgtccccgca

SEQ ID NO: 5532026 - DNA, 21 bp, Homo sapiens
tggtcctgttttctaaaaaaa

SEQ ID NO: 5532027 - DNA, 15 bp, Homo sapiens
tggtccttaatccca

SEQ ID NO: 5532028 - DNA, 17 bp, Homo sapiens
tggtccttcactggcgc

SEQ ID NO: 5532029 - DNA, 19 bp, Homo sapiens
tggtccttcactggcgcct

SEQ ID NO: 5532030 - DNA, 21 bp, Homo sapiens
tggtccttcactggcgccttc

SEQ ID NO: 5532031 - DNA, 19 bp, Homo sapiens
tggtccttccctgatggcc

SEQ ID NO: 5532032 - DNA, 20 bp, Homo sapiens
tggtcctttacactcaggct

SEQ ID NO: 5532033 - DNA, 21 bp, Homo sapiens
tggtcctttacactcaggctt

SEQ ID NO: 5532034 - DNA, 11 bp, Homo sapiens
tggtcctttct

SEQ ID NO: 5532035 - DNA, 13 bp, Homo sapiens
tggtcctttctcc

SEQ ID NO: 5532036 - DNA, 16 bp, Homo sapiens
tggtcctttctccaca

SEQ ID NO: 5532037 - DNA, 17 bp, Homo sapiens
tggtcctttctggaagt

SEQ ID NO: 5532038 - DNA, 15 bp, Homo sapiens
tggtcctttcttccg

SEQ ID NO: 5532039 - DNA, 23 bp, Homo sapiens
tggtcgagaaagaggcaccagga

SEQ ID NO: 5532040 - DNA, 16 bp, Homo sapiens
tggtcgaggagtaaca

SEQ ID NO: 5532041 - DNA, 17 bp, Homo sapiens
tggtcgagtctttgtgt

SEQ ID NO: 5532042 - DNA, 21 bp, Homo sapiens
tggtcgagtctttgtgtgtta

SEQ ID NO: 5532043 - DNA, 14 bp, Homo sapiens
tggtcgcccaggag

SEQ ID NO: 5532044 - DNA, 14 bp, Homo sapiens
tggtcggaaaacat

SEQ ID NO: 5532045 - DNA, 20 bp, Homo sapiens
tggtcggatctcacaggctg

SEQ ID NO: 5532046 - DNA, 17 bp, Homo sapiens
tggtcgggggagagggc

SEQ ID NO: 5532047 - DNA, 19 bp, Homo sapiens
tggtcgtaaacatctcaga

SEQ ID NO: 5532048 - DNA, 20 bp, Homo sapiens
tggtcgtcaactttcctcaa

SEQ ID NO: 5532049 - DNA, 18 bp, Homo sapiens
tggtctaaaaataaacca

SEQ ID NO: 5532050 - DNA, 18 bp, Homo sapiens
tggtctaaagtgtttagc

SEQ ID NO: 5532051 - DNA, 21 bp, Homo sapiens
tggtctaaagtgtttagctgt

SEQ ID NO: 5532052 - DNA, 17 bp, Homo sapiens
tggtctaacactggcat

SEQ ID NO: 5532053 - DNA, 23 bp, Homo sapiens
tggtctaacactggcatgttcaa

SEQ ID NO: 5532054 - DNA, 18 bp, Homo sapiens
tggtctaaggttcagcct

SEQ ID NO: 5532055 - DNA, 21 bp, Homo sapiens
tggtctaatgattcaaatgtt

SEQ ID NO: 5532056 - DNA, 13 bp, Homo sapiens
tggtctacactgg

SEQ ID NO: 5532057 - DNA, 16 bp, Homo sapiens
tggtctacactgtgct

SEQ ID NO: 5532058 - DNA, 16 bp, Homo sapiens
tggtctactctagaag

SEQ ID NO: 5532059 - DNA, 19 bp, Homo sapiens
tggtctagaatggattttt

SEQ ID NO: 5532060 - DNA, 11 bp, Homo sapiens
tggtctagacc

SEQ ID NO: 5532061 - DNA, 23 bp, Homo sapiens
tggtctagaccagggctgctctt

SEQ ID NO: 5532062 - DNA, 23 bp, Homo sapiens
tggtctaggagctgtctccagga

SEQ ID NO: 5532063 - DNA, 14 bp, Homo sapiens
tggtctatgttccg

SEQ ID NO: 5532064 - DNA, 15 bp, Homo sapiens
tggtctattgtctgt

SEQ ID NO: 5532065 - DNA, 17 bp, Homo sapiens
tggtctcaaactcctga

SEQ ID NO: 5532066 - DNA, 22 bp, Homo sapiens
tggtctcaaactcctgacctca

SEQ ID NO: 5532067 - DNA, 19 bp, Homo sapiens
tggtctcaaactcctgact

SEQ ID NO: 5532068 - DNA, 17 bp, Homo sapiens
tggtctcaaactcttga

SEQ ID NO: 5532069 - DNA, 21 bp, Homo sapiens
tggtctcaaacttgtggcctc

SEQ ID NO: 5532070 - DNA, 17 bp, Homo sapiens
tggtctcaccctggagg

SEQ ID NO: 5532071 - DNA, 18 bp, Homo sapiens
tggtctcacctggaggca

SEQ ID NO: 5532072 - DNA, 12 bp, Homo sapiens
tggtctcagaaa

SEQ ID NO: 5532073 - DNA, 22 bp, Homo sapiens
tggtctcagcagcgaccacccc

SEQ ID NO: 5532074 - DNA, 20 bp, Homo sapiens
tggtctcagcgggagccagt

SEQ ID NO: 5532075 - DNA, 13 bp, Homo sapiens
tggtctcagcttc

SEQ ID NO: 5532076 - DNA, 12 bp, Homo sapiens
tggtctcaggat

SEQ ID NO: 5532077 - DNA, 14 bp, Homo sapiens
tggtctcaggcagc

SEQ ID NO: 5532078 - DNA, 16 bp, Homo sapiens
tggtctcagtgttaat

SEQ ID NO: 5532079 - DNA, 18 bp, Homo sapiens
tggtctcatttgggggcg

SEQ ID NO: 5532080 - DNA, 15 bp, Homo sapiens
tggtctccacctgtg

SEQ ID NO: 5532081 - DNA, 16 bp, Homo sapiens
tggtctccatttttcc

SEQ ID NO: 5532082 - DNA, 22 bp, Homo sapiens
tggtctccatttttcccaggac

SEQ ID NO: 5532083 - DNA, 23 bp, Homo sapiens
tggtctccccaattctcccctcc

SEQ ID NO: 5532084 - DNA, 16 bp, Homo sapiens
tggtctccctggcctc

SEQ ID NO: 5532085 - DNA, 15 bp, Homo sapiens
tggtctcccttctct

SEQ ID NO: 5532086 - DNA, 17 bp, Homo sapiens
tggtctcctctcagctt

SEQ ID NO: 5532087 - DNA, 12 bp, Homo sapiens
tggtctcctctg

SEQ ID NO: 5532088 - DNA, 20 bp, Homo sapiens
tggtctcctctttgttttgt

SEQ ID NO: 5532089 - DNA, 14 bp, Homo sapiens
tggtctcctgcccc

SEQ ID NO: 5532090 - DNA, 22 bp, Homo sapiens
tggtctccttggaaatccgtct

SEQ ID NO: 5532091 - DNA, 15 bp, Homo sapiens
tggtctcgaactcct

SEQ ID NO: 5532092 - DNA, 17 bp, Homo sapiens
tggtctcgaactcctga

SEQ ID NO: 5532093 - DNA, 19 bp, Homo sapiens
tggtctcgaactcctgacc

SEQ ID NO: 5532094 - DNA, 22 bp, Homo sapiens
tggtctcgaactcctggcctcg

SEQ ID NO: 5532095 - DNA, 16 bp, Homo sapiens
tggtctcgatgctgct

SEQ ID NO: 5532096 - DNA, 19 bp, Homo sapiens
tggtctcgatgctgctggc

SEQ ID NO: 5532097 - DNA, 16 bp, Homo sapiens
tggtctctaggcctga

SEQ ID NO: 5532098 - DNA, 18 bp, Homo sapiens
tggtctctaggcctgaac

SEQ ID NO: 5532099 - DNA, 19 bp, Homo sapiens
tggtctctaggctggggaa

SEQ ID NO: 5532100 - DNA, 18 bp, Homo sapiens
tggtctctcccagctctg

SEQ ID NO: 5532101 - DNA, 19 bp, Homo sapiens
tggtctctcccagctctgg

SEQ ID NO: 5532102 - DNA, 21 bp, Homo sapiens
tggtctctctatgcctctcta

SEQ ID NO: 5532103 - DNA, 15 bp, Homo sapiens
tggtctctctccctc

SEQ ID NO: 5532104 - DNA, 19 bp, Homo sapiens
tggtctctctccctctgtc

SEQ ID NO: 5532105 - DNA, 20 bp, Homo sapiens
tggtctctctccctctgtct

SEQ ID NO: 5532106 - DNA, 19 bp, Homo sapiens
tggtctctgcatttttctg

SEQ ID NO: 5532107 - DNA, 15 bp, Homo sapiens
tggtctctgccccag

SEQ ID NO: 5532108 - DNA, 22 bp, Homo sapiens
tggtctctgctgaaggttgtaa

SEQ ID NO: 5532109 - DNA, 13 bp, Homo sapiens
tggtctctggctc

SEQ ID NO: 5532110 - DNA, 18 bp, Homo sapiens
tggtctctggttcttgaa

SEQ ID NO: 5532111 - DNA, 17 bp, Homo sapiens
tggtctcttccagccca

SEQ ID NO: 5532112 - DNA, 13 bp, Homo sapiens
tggtctcttgctt

SEQ ID NO: 5532113 - DNA, 17 bp, Homo sapiens
tggtctctttctttcca

SEQ ID NO: 5532114 - DNA, 20 bp, Homo sapiens
tggtctctttctttccaaag

SEQ ID NO: 5532115 - DNA, 15 bp, Homo sapiens
tggtctgaactgctt

SEQ ID NO: 5532116 - DNA, 18 bp, Homo sapiens
tggtggcatcacagaccc

SEQ ID NO: 5532117 - DNA, 12 bp, Homo sapiens
tggtggcatttt

SEQ ID NO: 5532118 - DNA, 18 bp, Homo sapiens
tggtggcatttttgcttc

SEQ ID NO: 5532119 - DNA, 13 bp, Homo sapiens
tggtggccaagcc

SEQ ID NO: 5532120 - DNA, 15 bp, Homo sapiens
tggtggccaagcctg

SEQ ID NO: 5532121 - DNA, 19 bp, Homo sapiens
tggtggccaagcctgcccc

SEQ ID NO: 5532122 - DNA, 16 bp, Homo sapiens
tggtggccaagcctgg

SEQ ID NO: 5532123 - DNA, 16 bp, Homo sapiens
tggtggccactgagct

SEQ ID NO: 5532124 - DNA, 20 bp, Homo sapiens
tggtggccactgagctggct

SEQ ID NO: 5532125 - DNA, 22 bp, Homo sapiens
tggtggccacttcattccagca

SEQ ID NO: 5532126 - DNA, 21 bp, Homo sapiens
tggtggccatgctcctcttcc

SEQ ID NO: 5532127 - DNA, 16 bp, Homo sapiens
tggtggcccctcccca

SEQ ID NO: 5532128 - DNA, 16 bp, Homo sapiens
tggtggccctctcccc

SEQ ID NO: 5532129 - DNA, 14 bp, Homo sapiens
tggtggccctgcgg

SEQ ID NO: 5532130 - DNA, 16 bp, Homo sapiens
tggtggccctgtgcct

SEQ ID NO: 5532131 - DNA, 19 bp, Homo sapiens
tggtggccctgtgcctggg

SEQ ID NO: 5532132 - DNA, 11 bp, Homo sapiens
tggtggcctat

SEQ ID NO: 5532133 - DNA, 11 bp, Homo sapiens
tggtggcctca

SEQ ID NO: 5532134 - DNA, 18 bp, Homo sapiens
tggtggcctcaagaaagg

SEQ ID NO: 5532135 - DNA, 12 bp, Homo sapiens
tggtggcctcag

SEQ ID NO: 5532136 - DNA, 13 bp, Homo sapiens
tggtggccttctg

SEQ ID NO: 5532137 - DNA, 19 bp, Homo sapiens
tggtggccttctgctgccc

SEQ ID NO: 5532138 - DNA, 21 bp, Homo sapiens
tggtggccttctgctgcccag

SEQ ID NO: 5532139 - DNA, 17 bp, Homo sapiens
tggtggcgcaagcctgt

SEQ ID NO: 5532140 - DNA, 22 bp, Homo sapiens
tggtggcgctttctcctgtgcc

SEQ ID NO: 5532141 - DNA, 23 bp, Homo sapiens
tggtggcggcgaagaagagaaag

SEQ ID NO: 5532142 - DNA, 17 bp, Homo sapiens
tggtggcgggcacctgt

SEQ ID NO: 5532143 - DNA, 16 bp, Homo sapiens
tggtggctcatgcctg

SEQ ID NO: 5532144 - DNA, 19 bp, Homo sapiens
tggtggctgggcccagcag

SEQ ID NO: 5532145 - DNA, 21 bp, Homo sapiens
tggtggctgggctgctcctga

SEQ ID NO: 5532146 - DNA, 15 bp, Homo sapiens
tggtggctgtctctg

SEQ ID NO: 5532147 - DNA, 16 bp, Homo sapiens
tggtggctgttcctga

SEQ ID NO: 5532148 - DNA, 22 bp, Homo sapiens
tggtggcttaagtgagcagaac

SEQ ID NO: 5532149 - DNA, 21 bp, Homo sapiens
tggtggcttcagctccagccc

SEQ ID NO: 5532150 - DNA, 21 bp, Homo sapiens
tggtgggagcacagctttcct

SEQ ID NO: 5532151 - DNA, 17 bp, Homo sapiens
tggtgggagcacctgcc

SEQ ID NO: 5532152 - DNA, 21 bp, Homo sapiens
tggtgggaggcccggggccct

SEQ ID NO: 5532153 - DNA, 13 bp, Homo sapiens
tggtgggatccac

SEQ ID NO: 5532154 - DNA, 19 bp, Homo sapiens
tggtgggatgtggttttct

SEQ ID NO: 5532155 - DNA, 17 bp, Homo sapiens
tggtgggcaccaagagc

SEQ ID NO: 5532156 - DNA, 20 bp, Homo sapiens
tggtgggcagctgaggacac

SEQ ID NO: 5532157 - DNA, 17 bp, Homo sapiens
tggtgggcattctctct

SEQ ID NO: 5532158 - DNA, 20 bp, Homo sapiens
tggtgggccaacaaagaaca

SEQ ID NO: 5532159 - DNA, 22 bp, Homo sapiens
tggtgggcccagaccactgtct

SEQ ID NO: 5532160 - DNA, 14 bp, Homo sapiens
tggtgggctccaga

SEQ ID NO: 5532161 - DNA, 12 bp, Homo sapiens
tggtgggctggc

SEQ ID NO: 5532162 - DNA, 15 bp, Homo sapiens
tggtgggctggccca

SEQ ID NO: 5532163 - DNA, 18 bp, Homo sapiens
tggtgggcttctgcgtcc

SEQ ID NO: 5532164 - DNA, 22 bp, Homo sapiens
tggtggggaggggcgctggccc

SEQ ID NO: 5532165 - DNA, 13 bp, Homo sapiens
tggtggggcagaa

SEQ ID NO: 5532166 - DNA, 13 bp, Homo sapiens
tggtggggccagg

SEQ ID NO: 5532167 - DNA, 22 bp, Homo sapiens
tggtggggccaggccaggacca

SEQ ID NO: 5532168 - DNA, 21 bp, Homo sapiens
tggtggggccatacccatgtg

SEQ ID NO: 5532169 - DNA, 17 bp, Homo sapiens
tggtggggcccccagca

SEQ ID NO: 5532170 - DNA, 16 bp, Homo sapiens
tggtggggctgagcct

SEQ ID NO: 5532171 - DNA, 16 bp, Homo sapiens
tggtgggggcctcggt

SEQ ID NO: 5532172 - DNA, 18 bp, Homo sapiens
tggtgggggtagagctga

SEQ ID NO: 5532173 - DNA, 21 bp, Homo sapiens
tggtgggggtagagctgatcc

SEQ ID NO: 5532174 - DNA, 19 bp, Homo sapiens
tggtgggggttctggcagg

SEQ ID NO: 5532175 - DNA, 17 bp, Homo sapiens
tggtggggtctcctcag

SEQ ID NO: 5532176 - DNA, 20 bp, Homo sapiens
tggtgggtaattgtacaata

SEQ ID NO: 5532177 - DNA, 17 bp, Homo sapiens
tggtgggtccatgggca

SEQ ID NO: 5532178 - DNA, 22 bp, Homo sapiens
tggtgggtctttaataaaacaa

SEQ ID NO: 5532179 - DNA, 19 bp, Homo sapiens
tggtgggttcaggggactc

SEQ ID NO: 5532180 - DNA, 17 bp, Homo sapiens
tggtggtaaccctggtg

SEQ ID NO: 5532181 - DNA, 20 bp, Homo sapiens
tggtggtacatgcctgtaat

SEQ ID NO: 5532182 - DNA, 14 bp, Homo sapiens
tggtggtagagaag

SEQ ID NO: 5532183 - DNA, 15 bp, Homo sapiens
tggtggtatctgagt

SEQ ID NO: 5532184 - DNA, 14 bp, Homo sapiens
tggtggtattttat

SEQ ID NO: 5532185 - DNA, 16 bp, Homo sapiens
tggtggtattttattt

SEQ ID NO: 5532186 - DNA, 16 bp, Homo sapiens
tggtggtcacaggctg

SEQ ID NO: 5532187 - DNA, 23 bp, Homo sapiens
tggtggtcttctccaccagcccc

SEQ ID NO: 5532188 - DNA, 18 bp, Homo sapiens
tggtggtgaaggggctgg

SEQ ID NO: 5532189 - DNA, 16 bp, Homo sapiens
tggtggtgcacacctg

SEQ ID NO: 5532190 - DNA, 11 bp, Homo sapiens
tggtggtgcta

SEQ ID NO: 5532191 - DNA, 20 bp, Homo sapiens
tggtggttaaggccagggcc

SEQ ID NO: 5532192 - DNA, 15 bp, Homo sapiens
tggtggttattttaa

SEQ ID NO: 5532193 - DNA, 16 bp, Homo sapiens
tggtggttcattccac

SEQ ID NO: 5532194 - DNA, 14 bp, Homo sapiens
tggtggttgtgcct

SEQ ID NO: 5532195 - DNA, 17 bp, Homo sapiens
tggtggtttcacggtgc

SEQ ID NO: 5532196 - DNA, 18 bp, Homo sapiens
tggtggtttcagaaaggg

SEQ ID NO: 5532197 - DNA, 16 bp, Homo sapiens
tggtggtttgattgtt

SEQ ID NO: 5532198 - DNA, 20 bp, Homo sapiens
tggtggttttcagagcagga

SEQ ID NO: 5532199 - DNA, 16 bp, Homo sapiens
tggtggtttttgctct

SEQ ID NO: 5532200 - DNA, 20 bp, Homo sapiens
tggtgtaaagctggccctgc

SEQ ID NO: 5532201 - DNA, 23 bp, Homo sapiens
tggtgtaacctgagatggccctc

SEQ ID NO: 5532202 - DNA, 18 bp, Homo sapiens
tggtgtaaggtactttca

SEQ ID NO: 5532203 - DNA, 13 bp, Homo sapiens
tggtgtaatcatt

SEQ ID NO: 5532204 - DNA, 18 bp, Homo sapiens
tggtgtaatctcaatgca

SEQ ID NO: 5532205 - DNA, 21 bp, Homo sapiens
tggtgtaatctcaatgcaagc

SEQ ID NO: 5532206 - DNA, 20 bp, Homo sapiens
tggtgtaatctctcatggtg

SEQ ID NO: 5532207 - DNA, 18 bp, Homo sapiens
tggtgtaatgcacaattt

SEQ ID NO: 5532208 - DNA, 13 bp, Homo sapiens
tggtgtaatttat

SEQ ID NO: 5532209 - DNA, 17 bp, Homo sapiens
tggtgtaatttgaagat

SEQ ID NO: 5532210 - DNA, 14 bp, Homo sapiens
tggtgtacaaaatg

SEQ ID NO: 5532211 - DNA, 20 bp, Homo sapiens
tggtgtacctgctggaagaa

SEQ ID NO: 5532212 - DNA, 14 bp, Homo sapiens
tggtgtactctagg

SEQ ID NO: 5532213 - DNA, 20 bp, Homo sapiens
tggtgtactgggttaatggc

SEQ ID NO: 5532214 - DNA, 18 bp, Homo sapiens
tggtgtagccctcccact

SEQ ID NO: 5532215 - DNA, 15 bp, Homo sapiens
tggtgtagctacaga

SEQ ID NO: 5532216 - DNA, 18 bp, Homo sapiens
tggtgtagctacagagaa

SEQ ID NO: 5532217 - DNA, 20 bp, Homo sapiens
tggtgtagctacagagaaac

SEQ ID NO: 5532218 - DNA, 22 bp, Homo sapiens
tggtgtagctacagagaaacca

SEQ ID NO: 5532219 - DNA, 13 bp, Homo sapiens
tggtgtagctgtc

SEQ ID NO: 5532220 - DNA, 15 bp, Homo sapiens
tggtgtagctgtcct

SEQ ID NO: 5532221 - DNA, 17 bp, Homo sapiens
tggtgtagctgtcctct

SEQ ID NO: 5532222 - DNA, 15 bp, Homo sapiens
tggtgtatatcatga

SEQ ID NO: 5532223 - DNA, 16 bp, Homo sapiens
tggtgtatatcatgaa

SEQ ID NO: 5532224 - DNA, 22 bp, Homo sapiens
tggtgtatatcatgaagccttg

SEQ ID NO: 5532225 - DNA, 23 bp, Homo sapiens
tggtgtatgtttatcaaagagca

SEQ ID NO: 5532226 - DNA, 17 bp, Homo sapiens
tggtgtattatcatttt

SEQ ID NO: 5532227 - DNA, 21 bp, Homo sapiens
tggtgtatttttcaggtaggc

SEQ ID NO: 5532228 - DNA, 18 bp, Homo sapiens
tggtgtcacatggggcct

SEQ ID NO: 5532229 - DNA, 16 bp, Homo sapiens
tggtgtcaccagcctg

SEQ ID NO: 5532230 - DNA, 15 bp, Homo sapiens
tggtgtcactgtccc

SEQ ID NO: 5532231 - DNA, 19 bp, Homo sapiens
tggtgtcactgtccctcct

SEQ ID NO: 5532232 - DNA, 17 bp, Homo sapiens
tggtgtcacttactgtt

SEQ ID NO: 5532233 - DNA, 19 bp, Homo sapiens
tggtgtcagccccacagga

SEQ ID NO: 5532234 - DNA, 20 bp, Homo sapiens
tggtgtcagcccctcttccc

SEQ ID NO: 5532235 - DNA, 23 bp, Homo sapiens
tggtgtcagcccctcttcccttc

SEQ ID NO: 5532236 - DNA, 13 bp, Homo sapiens
tggtgtcaggcag

SEQ ID NO: 5532237 - DNA, 16 bp, Homo sapiens
tggtgtcataactaga

SEQ ID NO: 5532238 - DNA, 16 bp, Homo sapiens
tggtgtcatttttgaa

SEQ ID NO: 5532239 - DNA, 13 bp, Homo sapiens
tggtgtccacctg

SEQ ID NO: 5532240 - DNA, 14 bp, Homo sapiens
tggtgtccacctgg

SEQ ID NO: 5532241 - DNA, 15 bp, Homo sapiens
tggtgtccacctggc

SEQ ID NO: 5532242 - DNA, 17 bp, Homo sapiens
tggtgtccacctggccc

SEQ ID NO: 5532243 - DNA, 17 bp, Homo sapiens
tggtgtccctgcctggc

SEQ ID NO: 5532244 - DNA, 16 bp, Homo sapiens
tggtgtcctgaagctg

SEQ ID NO: 5532245 - DNA, 15 bp, Homo sapiens
tggtgtcctgaccac

SEQ ID NO: 5532246 - DNA, 13 bp, Homo sapiens
tggtgtcctgagg

SEQ ID NO: 5532247 - DNA, 14 bp, Homo sapiens
tggtgtcctgaggc

SEQ ID NO: 5532248 - DNA, 15 bp, Homo sapiens
tggtgtcctgcatgt

SEQ ID NO: 5532249 - DNA, 15 bp, Homo sapiens
tggtgtccttccctg

SEQ ID NO: 5532250 - DNA, 23 bp, Homo sapiens
tggtgtccttctcctcttgtagc

SEQ ID NO: 5532251 - DNA, 16 bp, Homo sapiens
tggtgtccttcttcct

SEQ ID NO: 5532252 - DNA, 18 bp, Homo sapiens
tggtgtccttcttcctca

SEQ ID NO: 5532253 - DNA, 15 bp, Homo sapiens
tggtgtcgggccctt

SEQ ID NO: 5532254 - DNA, 21 bp, Homo sapiens
tggtgtctaataaacacagat

SEQ ID NO: 5532255 - DNA, 20 bp, Homo sapiens
tggtgtctccaaccccccag

SEQ ID NO: 5532256 - DNA, 14 bp, Homo sapiens
tggtgtctgatgtg

SEQ ID NO: 5532257 - DNA, 13 bp, Homo sapiens
tggtgtctgcggg

SEQ ID NO: 5532258 - DNA, 19 bp, Homo sapiens
tggtgtctggattcccagg

SEQ ID NO: 5532259 - DNA, 17 bp, Homo sapiens
tggtgtcttcattttac

SEQ ID NO: 5532260 - DNA, 11 bp, Homo sapiens
tggtgtcttcc

SEQ ID NO: 5532261 - DNA, 15 bp, Homo sapiens
tggtgtctttgatca

SEQ ID NO: 5532262 - DNA, 22 bp, Homo sapiens
tggtgtgaacccgggaggcaga

SEQ ID NO: 5532263 - DNA, 22 bp, Homo sapiens
tggtgtgaactaaactttcaca

SEQ ID NO: 5532264 - DNA, 23 bp, Homo sapiens
tggtgtgaactaaactttcacac

SEQ ID NO: 5532265 - DNA, 13 bp, Homo sapiens
tggtgtgaccatg

SEQ ID NO: 5532266 - DNA, 18 bp, Homo sapiens
tggtgtgaccctctgaat

SEQ ID NO: 5532267 - DNA, 22 bp, Homo sapiens
tggtgtgagaagatcattgcca

SEQ ID NO: 5532268 - DNA, 14 bp, Homo sapiens
tggtgtgaggcccc

SEQ ID NO: 5532269 - DNA, 20 bp, Homo sapiens
tggtgtgaggcccccggagg

SEQ ID NO: 5532270 - DNA, 18 bp, Homo sapiens
tggtgtgatcccagctca

SEQ ID NO: 5532271 - DNA, 18 bp, Homo sapiens
tggtgtgatcgtctgact

SEQ ID NO: 5532272 - DNA, 22 bp, Homo sapiens
tggtgtgatcttaatatatttg

SEQ ID NO: 5532273 - DNA, 16 bp, Homo sapiens
tggtgtggagttttca

SEQ ID NO: 5532274 - DNA, 23 bp, Homo sapiens
tggtgtggagttttcatgacaga

SEQ ID NO: 5532275 - DNA, 17 bp, Homo sapiens
tggtgtggcccgtggcc

SEQ ID NO: 5532276 - DNA, 16 bp, Homo sapiens
tggtgtggctgctccc

SEQ ID NO: 5532277 - DNA, 16 bp, Homo sapiens
tggtgtgggtgtcctg

SEQ ID NO: 5532278 - DNA, 17 bp, Homo sapiens
tggtgtgggtgtcctgc

SEQ ID NO: 5532279 - DNA, 23 bp, Homo sapiens
tggtgtggtacagagaagccagc

SEQ ID NO: 5532280 - DNA, 16 bp, Homo sapiens
tggtgtggtgaatgtg

SEQ ID NO: 5532281 - DNA, 16 bp, Homo sapiens
tggtgtgtcatgctca

SEQ ID NO: 5532282 - DNA, 15 bp, Homo sapiens
tggtgtgtgtatgcg

SEQ ID NO: 5532283 - DNA, 14 bp, Homo sapiens
tggtgtgtgtctct

SEQ ID NO: 5532284 - DNA, 13 bp, Homo sapiens
tggtgtgtttccc

SEQ ID NO: 5532285 - DNA, 15 bp, Homo sapiens
tggtgtgtttcccta

SEQ ID NO: 5532286 - DNA, 18 bp, Homo sapiens
tggtgttaaagctgtaca

SEQ ID NO: 5532287 - DNA, 12 bp, Homo sapiens
tggtgttaatga

SEQ ID NO: 5532288 - DNA, 16 bp, Homo sapiens
tggtgttactaaagtc

SEQ ID NO: 5532289 - DNA, 18 bp, Homo sapiens
tggtgttactgcagttga

SEQ ID NO: 5532290 - DNA, 17 bp, Homo sapiens
tggtgttcctggaagca

SEQ ID NO: 5532291 - DNA, 21 bp, Homo sapiens
tggtgttctaagactctgtgt

SEQ ID NO: 5532292 - DNA, 23 bp, Homo sapiens
tggtgttctcctgctgctccctc

SEQ ID NO: 5532293 - DNA, 19 bp, Homo sapiens
tggtgttctgaagtgggaa

SEQ ID NO: 5532294 - DNA, 18 bp, Homo sapiens
tgtaaaggtaggtgcatg

SEQ ID NO: 5532295 - DNA, 19 bp, Homo sapiens
tgtaaaggtatattgtgaa

SEQ ID NO: 5532296 - DNA, 16 bp, Homo sapiens
tgtaaaggtcactttt

SEQ ID NO: 5532297 - DNA, 14 bp, Homo sapiens
tgtaaaggtcagag

SEQ ID NO: 5532298 - DNA, 19 bp, Homo sapiens
tgtaaaggtcagagtcaaa

SEQ ID NO: 5532299 - DNA, 19 bp, Homo sapiens
tgtaaaggtgatgaattta

SEQ ID NO: 5532300 - DNA, 18 bp, Homo sapiens
tgtaaagtatgtaaacag

SEQ ID NO: 5532301 - DNA, 17 bp, Homo sapiens
tgtaaagtatgtgagta

SEQ ID NO: 5532302 - DNA, 21 bp, Homo sapiens
tgtaaagtatgtttttacatt

SEQ ID NO: 5532303 - DNA, 20 bp, Homo sapiens
tgtaaagtatttgatgtaca

SEQ ID NO: 5532304 - DNA, 22 bp, Homo sapiens
tgtaaagtatttgatgtacatt

SEQ ID NO: 5532305 - DNA, 17 bp, Homo sapiens
tgtaaagtgtaaatcct

SEQ ID NO: 5532306 - DNA, 17 bp, Homo sapiens
tgtaaagttaaaaatag

SEQ ID NO: 5532307 - DNA, 12 bp, Homo sapiens
tgtaaagttagt

SEQ ID NO: 5532308 - DNA, 17 bp, Homo sapiens
tgtaaagttagtctact

SEQ ID NO: 5532309 - DNA, 21 bp, Homo sapiens
tgtaaagttattcttgaagtc

SEQ ID NO: 5532310 - DNA, 19 bp, Homo sapiens
tgtaaagttggttggataa

SEQ ID NO: 5532311 - DNA, 20 bp, Homo sapiens
tgtaaagttggttggataag

SEQ ID NO: 5532312 - DNA, 13 bp, Homo sapiens
tgtaaagtttcta

SEQ ID NO: 5532313 - DNA, 14 bp, Homo sapiens
tgtaaagtttctag

SEQ ID NO: 5532314 - DNA, 10 bp, Homo sapiens
tgtaaataaa

SEQ ID NO: 5532315 - DNA, 15 bp, Homo sapiens
tgtaaataaaaatag

SEQ ID NO: 5532316 - DNA, 17 bp, Homo sapiens
tgtaaataaaatgtgta

SEQ ID NO: 5532317 - DNA, 19 bp, Homo sapiens
tgtaaataaaatgtgtaca

SEQ ID NO: 5532318 - DNA, 14 bp, Homo sapiens
tgtaaataaactat

SEQ ID NO: 5532319 - DNA, 18 bp, Homo sapiens
tgtaaataaagccctggg

SEQ ID NO: 5532320 - DNA, 15 bp, Homo sapiens
tgtaaataaattttg

SEQ ID NO: 5532321 - DNA, 18 bp, Homo sapiens
tgtaaataaattttgtgc

SEQ ID NO: 5532322 - DNA, 23 bp, Homo sapiens
tgtaaataaccacactgaaacct

SEQ ID NO: 5532323 - DNA, 19 bp, Homo sapiens
tgtaaataaccccattctt

SEQ ID NO: 5532324 - DNA, 12 bp, Homo sapiens
tgtaaataagag

SEQ ID NO: 5532325 - DNA, 14 bp, Homo sapiens
tgtaaataatctgt

SEQ ID NO: 5532326 - DNA, 15 bp, Homo sapiens
tgtaaataattcttt

SEQ ID NO: 5532327 - DNA, 15 bp, Homo sapiens
tgtaaataatttatt

SEQ ID NO: 5532328 - DNA, 19 bp, Homo sapiens
tgtaaataattttctaaga

SEQ ID NO: 5532329 - DNA, 22 bp, Homo sapiens
tgtaaataattttctaagacag

SEQ ID NO: 5532330 - DNA, 21 bp, Homo sapiens
tgtaaatacaaaataaaatta

SEQ ID NO: 5532331 - DNA, 19 bp, Homo sapiens
tgtaaatacaattcaaaca

SEQ ID NO: 5532332 - DNA, 21 bp, Homo sapiens
tgtaaatacaattcaaacaat

SEQ ID NO: 5532333 - DNA, 21 bp, Homo sapiens
tgtaaatacacatagcatgta

SEQ ID NO: 5532334 - DNA, 12 bp, Homo sapiens
tgtaaatacacc

SEQ ID NO: 5532335 - DNA, 21 bp, Homo sapiens
tgtaaatacatcctttttctg

SEQ ID NO: 5532336 - DNA, 23 bp, Homo sapiens
tgtaaatacatcctttttctgct

SEQ ID NO: 5532337 - DNA, 15 bp, Homo sapiens
tgtaaatacatgtgt

SEQ ID NO: 5532338 - DNA, 17 bp, Homo sapiens
tgtaaataccaagagca

SEQ ID NO: 5532339 - DNA, 14 bp, Homo sapiens
tgtaaataccagga

SEQ ID NO: 5532340 - DNA, 15 bp, Homo sapiens
tgtaaatacccatat

SEQ ID NO: 5532341 - DNA, 18 bp, Homo sapiens
tgtaaatactggactcag

SEQ ID NO: 5532342 - DNA, 15 bp, Homo sapiens
tgtaaatactgttgg

SEQ ID NO: 5532343 - DNA, 17 bp, Homo sapiens
tgtaaatactgttggtg

SEQ ID NO: 5532344 - DNA, 17 bp, Homo sapiens
tgtaaatagtttaacac

SEQ ID NO: 5532345 - DNA, 21 bp, Homo sapiens
tgtaaatagttttaaatatga

SEQ ID NO: 5532346 - DNA, 23 bp, Homo sapiens
tgtaaatagttttaaatatgaac

SEQ ID NO: 5532347 - DNA, 14 bp, Homo sapiens
tgtaaatataaaga

SEQ ID NO: 5532348 - DNA, 23 bp, Homo sapiens
tgtaaatatacagcatgagattg

SEQ ID NO: 5532349 - DNA, 12 bp, Homo sapiens
tgtaaatatata

SEQ ID NO: 5532350 - DNA, 15 bp, Homo sapiens
tgtaaatatataaat

SEQ ID NO: 5532351 - DNA, 21 bp, Homo sapiens
tgtaaatatataaatatatat

SEQ ID NO: 5532352 - DNA, 14 bp, Homo sapiens
tgtaaatatcccag

SEQ ID NO: 5532353 - DNA, 13 bp, Homo sapiens
tgtaaatatccct

SEQ ID NO: 5532354 - DNA, 17 bp, Homo sapiens
tgtaaatatgaagagtt

SEQ ID NO: 5532355 - DNA, 19 bp, Homo sapiens
tgtaaatatgtacatttct

SEQ ID NO: 5532356 - DNA, 23 bp, Homo sapiens
tgtaaatatgtacatttctcagg

SEQ ID NO: 5532357 - DNA, 13 bp, Homo sapiens
tgtaaatatgttt

SEQ ID NO: 5532358 - DNA, 22 bp, Homo sapiens
tgtaaatatgttttttagatca

SEQ ID NO: 5532359 - DNA, 20 bp, Homo sapiens
tgtaaatattagtgcagtta

SEQ ID NO: 5532360 - DNA, 20 bp, Homo sapiens
tgtaaatattccttatttaa

SEQ ID NO: 5532361 - DNA, 14 bp, Homo sapiens
tgtaaatattctat

SEQ ID NO: 5532362 - DNA, 13 bp, Homo sapiens
tgtaaatattctt

SEQ ID NO: 5532363 - DNA, 18 bp, Homo sapiens
tgtaaatattcttgtcca

SEQ ID NO: 5532364 - DNA, 18 bp, Homo sapiens
tgtaaatatttactcttt

SEQ ID NO: 5532365 - DNA, 14 bp, Homo sapiens
tgtaaatatttcat

SEQ ID NO: 5532366 - DNA, 17 bp, Homo sapiens
tgtaaatatttcataaa

SEQ ID NO: 5532367 - DNA, 20 bp, Homo sapiens
tgtaaatatttcataaatta

SEQ ID NO: 5532368 - DNA, 14 bp, Homo sapiens
tgtaaatattttaa

SEQ ID NO: 5532369 - DNA, 22 bp, Homo sapiens
tgtaaatattttaaagaattgt

SEQ ID NO: 5532370 - DNA, 11 bp, Homo sapiens
tgtaaatcact

SEQ ID NO: 5532371 - DNA, 18 bp, Homo sapiens
tgtaaatcacttcattgt

SEQ ID NO: 5532372 - DNA, 17 bp, Homo sapiens
tgtaaatcacttgtaaa

SEQ ID NO: 5532373 - DNA, 15 bp, Homo sapiens
tgtaaatccaacaca

SEQ ID NO: 5532374 - DNA, 18 bp, Homo sapiens
tgtaaatcccattattca

SEQ ID NO: 5532375 - DNA, 18 bp, Homo sapiens
tgtaaatcctagacttga

SEQ ID NO: 5532376 - DNA, 12 bp, Homo sapiens
tgtaaatccttt

SEQ ID NO: 5532377 - DNA, 20 bp, Homo sapiens
tgtaaatcctttttctttat

SEQ ID NO: 5532378 - DNA, 22 bp, Homo sapiens
tgtaaatcctttttctttataa

SEQ ID NO: 5532379 - DNA, 17 bp, Homo sapiens
tgtaaatcgggaaggat

SEQ ID NO: 5532380 - DNA, 16 bp, Homo sapiens
tgtaaatctaacatta

SEQ ID NO: 5532381 - DNA, 16 bp, Homo sapiens
tgtaaatctgccacaa

SEQ ID NO: 5532382 - DNA, 16 bp, Homo sapiens
tgtaaatcttgccttt

SEQ ID NO: 5532383 - DNA, 22 bp, Homo sapiens
tgtaaatctttgtgaacattct

SEQ ID NO: 5532384 - DNA, 18 bp, Homo sapiens
tgtaaatgaaacttaaga

SEQ ID NO: 5532385 - DNA, 21 bp, Homo sapiens
tgtaaatgaagggtcatttct

SEQ ID NO: 5532386 - DNA, 21 bp, Homo sapiens
tgtaaatgaagtaacttgtct

SEQ ID NO: 5532387 - DNA, 21 bp, Homo sapiens
tgtaaatgaccaagaaaaaga

SEQ ID NO: 5532388 - DNA, 16 bp, Homo sapiens
tgtaaatgactttcat

SEQ ID NO: 5532389 - DNA, 17 bp, Homo sapiens
tgtaaatgagacacata

SEQ ID NO: 5532390 - DNA, 22 bp, Homo sapiens
tgtaaatgagggcagaaacctt

SEQ ID NO: 5532391 - DNA, 21 bp, Homo sapiens
tgtaaatgatatgtctttaaa

SEQ ID NO: 5532392 - DNA, 11 bp, Homo sapiens
tgtaaatgcct

SEQ ID NO: 5532393 - DNA, 16 bp, Homo sapiens
tgtaaatgccttgctt

SEQ ID NO: 5532394 - DNA, 22 bp, Homo sapiens
tgtaaatgctattatactgtta

SEQ ID NO: 5532395 - DNA, 16 bp, Homo sapiens
tgtaaatgctccagca

SEQ ID NO: 5532396 - DNA, 15 bp, Homo sapiens
tgtaaatgctgtaaa

SEQ ID NO: 5532397 - DNA, 18 bp, Homo sapiens
tgtaaatgctgtaaatat

SEQ ID NO: 5532398 - DNA, 22 bp, Homo sapiens
tgtaaatgctgtaaatatttca

SEQ ID NO: 5532399 - DNA, 15 bp, Homo sapiens
tgtaaatggtgtaca

SEQ ID NO: 5532400 - DNA, 15 bp, Homo sapiens
tgtaaatgtaaactc

SEQ ID NO: 5532401 - DNA, 16 bp, Homo sapiens
tgtaaatgtctcactg

SEQ ID NO: 5532402 - DNA, 15 bp, Homo sapiens
tgtaaatgtgtacat

SEQ ID NO: 5532403 - DNA, 22 bp, Homo sapiens
tgtaaatgtgttggacaaatgt

SEQ ID NO: 5532404 - DNA, 14 bp, Homo sapiens
tgtaaatgttaaca

SEQ ID NO: 5532405 - DNA, 21 bp, Homo sapiens
tgtaaatgtttcttttccctt

SEQ ID NO: 5532406 - DNA, 15 bp, Homo sapiens
tgtaaattaaatgaa

SEQ ID NO: 5532407 - DNA, 14 bp, Homo sapiens
tgtaaattaacttt

SEQ ID NO: 5532408 - DNA, 17 bp, Homo sapiens
tgtaaattaacttttat

SEQ ID NO: 5532409 - DNA, 20 bp, Homo sapiens
tgtaaattagtttgacactg

SEQ ID NO: 5532410 - DNA, 16 bp, Homo sapiens
tgtaaattatgtaatg

SEQ ID NO: 5532411 - DNA, 13 bp, Homo sapiens
tgtaaattattgt

SEQ ID NO: 5532412 - DNA, 16 bp, Homo sapiens
tgtaaattattgtaaa

SEQ ID NO: 5532413 - DNA, 18 bp, Homo sapiens
tgtaaattattgtaaact

SEQ ID NO: 5532414 - DNA, 19 bp, Homo sapiens
tgtaaattatttcatacaa

SEQ ID NO: 5532415 - DNA, 17 bp, Homo sapiens
tgtaaattattttatgt

SEQ ID NO: 5532416 - DNA, 20 bp, Homo sapiens
tgtaaattattttatgtcat

SEQ ID NO: 5532417 - DNA, 12 bp, Homo sapiens
tgtaaattcagt

SEQ ID NO: 5532418 - DNA, 15 bp, Homo sapiens
tgtaaattcatattt

SEQ ID NO: 5532419 - DNA, 16 bp, Homo sapiens
tgtaaattccccttcc

SEQ ID NO: 5532420 - DNA, 22 bp, Homo sapiens
tgtaaattctgatttcttttca

SEQ ID NO: 5532421 - DNA, 16 bp, Homo sapiens
tgtaaattgaagaagc

SEQ ID NO: 5532422 - DNA, 18 bp, Homo sapiens
tgtaaattgaagaagcct

SEQ ID NO: 5532423 - DNA, 18 bp, Homo sapiens
tgtaaattgcacagagca

SEQ ID NO: 5532424 - DNA, 18 bp, Homo sapiens
tgtaaattgcagaattca

SEQ ID NO: 5532425 - DNA, 21 bp, Homo sapiens
tgtaaattgcagaattcaaaa

SEQ ID NO: 5532426 - DNA, 15 bp, Homo sapiens
tgtaaatttggattt

SEQ ID NO: 5532427 - DNA, 12 bp, Homo sapiens
tgtaaatttgta

SEQ ID NO: 5532428 - DNA, 20 bp, Homo sapiens
tgtaaattttgtatgaaaaa

SEQ ID NO: 5532429 - DNA, 16 bp, Homo sapiens
tgtaacaacaattatt

SEQ ID NO: 5532430 - DNA, 13 bp, Homo sapiens
tgtaacaacttcc

SEQ ID NO: 5532431 - DNA, 14 bp, Homo sapiens
tgtaacaagccacc

SEQ ID NO: 5532432 - DNA, 14 bp, Homo sapiens
tgtaacaagccaga

SEQ ID NO: 5532433 - DNA, 21 bp, Homo sapiens
tgtaacaattgtgtagccttt

SEQ ID NO: 5532434 - DNA, 22 bp, Homo sapiens
tgtaacaattgtgtagcctttt

SEQ ID NO: 5532435 - DNA, 15 bp, Homo sapiens
tgtaacacaagccac

SEQ ID NO: 5532436 - DNA, 16 bp, Homo sapiens
tgtaacacaagccaca

SEQ ID NO: 5532437 - DNA, 20 bp, Homo sapiens
tgtaacacagtcattctagg

SEQ ID NO: 5532438 - DNA, 21 bp, Homo sapiens
tgtaacacagtcattctagga

SEQ ID NO: 5532439 - DNA, 14 bp, Homo sapiens
tgtaacacataaac

SEQ ID NO: 5532440 - DNA, 15 bp, Homo sapiens
tgtaacacataaaca

SEQ ID NO: 5532441 - DNA, 20 bp, Homo sapiens
tgtaacacataaacaattca

SEQ ID NO: 5532442 - DNA, 15 bp, Homo sapiens
tgtaacactattaca

SEQ ID NO: 5532443 - DNA, 19 bp, Homo sapiens
tgtaacactattacagtat

SEQ ID NO: 5532444 - DNA, 23 bp, Homo sapiens
tgtaacactattacagtattgct

SEQ ID NO: 5532445 - DNA, 17 bp, Homo sapiens
tgtaacactgcaagaag

SEQ ID NO: 5532446 - DNA, 20 bp, Homo sapiens
tgtaacactgcaagaagtct

SEQ ID NO: 5532447 - DNA, 11 bp, Homo sapiens
tgtaacactgg

SEQ ID NO: 5532448 - DNA, 18 bp, Homo sapiens
tgtaacactttacaatgt

SEQ ID NO: 5532449 - DNA, 18 bp, Homo sapiens
tgtaacagagttgaggtt

SEQ ID NO: 5532450 - DNA, 11 bp, Homo sapiens
tgtaacagctg

SEQ ID NO: 5532451 - DNA, 14 bp, Homo sapiens
tgtaacagctgagg

SEQ ID NO: 5532452 - DNA, 15 bp, Homo sapiens
tgtaacagctgaggt

SEQ ID NO: 5532453 - DNA, 19 bp, Homo sapiens
tgtaacaggatacaggtga

SEQ ID NO: 5532454 - DNA, 21 bp, Homo sapiens
tgtaacaggatacaggtgaca

SEQ ID NO: 5532455 - DNA, 14 bp, Homo sapiens
tgtaacaggctttt

SEQ ID NO: 5532456 - DNA, 21 bp, Homo sapiens
tgtaacaggtctcctcttaaa

SEQ ID NO: 5532457 - DNA, 22 bp, Homo sapiens
tgtaacagttggtgattttaga

SEQ ID NO: 5532458 - DNA, 16 bp, Homo sapiens
tgtaacatcataatta

SEQ ID NO: 5532459 - DNA, 13 bp, Homo sapiens
tgtaacatgaagc

SEQ ID NO: 5532460 - DNA, 19 bp, Homo sapiens
tgtaacattaattctacta

SEQ ID NO: 5532461 - DNA, 13 bp, Homo sapiens
tgtaacattgtaa

SEQ ID NO: 5532462 - DNA, 15 bp, Homo sapiens
tgtaacattgtaaag

SEQ ID NO: 5532463 - DNA, 16 bp, Homo sapiens
tgtaacattgtaaagt

SEQ ID NO: 5532464 - DNA, 17 bp, Homo sapiens
tgtaacattgtaaagta

SEQ ID NO: 5532465 - DNA, 14 bp, Homo sapiens
tgtaacatttcaca

SEQ ID NO: 5532466 - DNA, 16 bp, Homo sapiens
tgtaaccaatcctact

SEQ ID NO: 5532467 - DNA, 13 bp, Homo sapiens
tgtaaccagcagt

SEQ ID NO: 5532468 - DNA, 16 bp, Homo sapiens
tgtaaccagctcagtg

SEQ ID NO: 5532469 - DNA, 18 bp, Homo sapiens
tgtaaccagctcagtgtt

SEQ ID NO: 5532470 - DNA, 18 bp, Homo sapiens
tgtaaccagttataaata

SEQ ID NO: 5532471 - DNA, 20 bp, Homo sapiens
tgtaaccagttataaataca

SEQ ID NO: 5532472 - DNA, 19 bp, Homo sapiens
tgtacaggaagtagttcta

SEQ ID NO: 5532473 - DNA, 17 bp, Homo sapiens
tgtacaggactgtaaag

SEQ ID NO: 5532474 - DNA, 20 bp, Homo sapiens
tgtacaggactgtaaagatt

SEQ ID NO: 5532475 - DNA, 22 bp, Homo sapiens
tgtacaggctaggaagaacttg

SEQ ID NO: 5532476 - DNA, 21 bp, Homo sapiens
tgtacaggggccatgccccac

SEQ ID NO: 5532477 - DNA, 23 bp, Homo sapiens
tgtacagggtggctgtggtccta

SEQ ID NO: 5532478 - DNA, 18 bp, Homo sapiens
tgtacagtaatatgttta

SEQ ID NO: 5532479 - DNA, 23 bp, Homo sapiens
tgtacagtaatatgtttaatgtt

SEQ ID NO: 5532480 - DNA, 16 bp, Homo sapiens
tgtacagtatgtgtct

SEQ ID NO: 5532481 - DNA, 16 bp, Homo sapiens
tgtacagtatttacct

SEQ ID NO: 5532482 - DNA, 19 bp, Homo sapiens
tgtacagtatttttcagat

SEQ ID NO: 5532483 - DNA, 17 bp, Homo sapiens
tgtacagtctcaatttt

SEQ ID NO: 5532484 - DNA, 18 bp, Homo sapiens
tgtacagtctcaattttg

SEQ ID NO: 5532485 - DNA, 16 bp, Homo sapiens
tgtacagtctgctcct

SEQ ID NO: 5532486 - DNA, 12 bp, Homo sapiens
tgtacagtctgt

SEQ ID NO: 5532487 - DNA, 13 bp, Homo sapiens
tgtacagtctgtc

SEQ ID NO: 5532488 - DNA, 14 bp, Homo sapiens
tgtacagtctgtca

SEQ ID NO: 5532489 - DNA, 19 bp, Homo sapiens
tgtacagtctgtcttctgt

SEQ ID NO: 5532490 - DNA, 14 bp, Homo sapiens
tgtacagtcttgta

SEQ ID NO: 5532491 - DNA, 18 bp, Homo sapiens
tgtacagtgaattgtctt

SEQ ID NO: 5532492 - DNA, 17 bp, Homo sapiens
tgtacagtgtctgtgcc

SEQ ID NO: 5532493 - DNA, 19 bp, Homo sapiens
tgtacagtgtgtaaagtgt

SEQ ID NO: 5532494 - DNA, 13 bp, Homo sapiens
tgtacagtgttac

SEQ ID NO: 5532495 - DNA, 15 bp, Homo sapiens
tgtacagttatacat

SEQ ID NO: 5532496 - DNA, 22 bp, Homo sapiens
tgtacagttatctaagttaatt

SEQ ID NO: 5532497 - DNA, 17 bp, Homo sapiens
tgtacagttatttatgc

SEQ ID NO: 5532498 - DNA, 18 bp, Homo sapiens
tgtacagttgactggctt

SEQ ID NO: 5532499 - DNA, 18 bp, Homo sapiens
tgtacagttgagctcagg

SEQ ID NO: 5532500 - DNA, 20 bp, Homo sapiens
tgtacagtttaacagagttt

SEQ ID NO: 5532501 - DNA, 16 bp, Homo sapiens
tgtacagttttgtgga

SEQ ID NO: 5532502 - DNA, 20 bp, Homo sapiens
tgtacagttttgtggactga

SEQ ID NO: 5532503 - DNA, 17 bp, Homo sapiens
tgtacataaaattttct

SEQ ID NO: 5532504 - DNA, 22 bp, Homo sapiens
tgtacataaaattttctagaaa

SEQ ID NO: 5532505 - DNA, 14 bp, Homo sapiens
tgtacataaacaat

SEQ ID NO: 5532506 - DNA, 16 bp, Homo sapiens
tgtacataaagtcatc

SEQ ID NO: 5532507 - DNA, 21 bp, Homo sapiens
tgtacataaagtcatcaaagt

SEQ ID NO: 5532508 - DNA, 17 bp, Homo sapiens
tgtacataactcctgtc

SEQ ID NO: 5532509 - DNA, 23 bp, Homo sapiens
tgtacataactctgtaaaaacac

SEQ ID NO: 5532510 - DNA, 18 bp, Homo sapiens
tgtacataactgaaaatg

SEQ ID NO: 5532511 - DNA, 17 bp, Homo sapiens
tgtacataacttcagat

SEQ ID NO: 5532512 - DNA, 22 bp, Homo sapiens
tgtacataatgcttaatttcta

SEQ ID NO: 5532513 - DNA, 23 bp, Homo sapiens
tgtacataatgcttaatttctaa

SEQ ID NO: 5532514 - DNA, 14 bp, Homo sapiens
tgtacataattgca

SEQ ID NO: 5532515 - DNA, 19 bp, Homo sapiens
tgtacataattgcatgaaa

SEQ ID NO: 5532516 - DNA, 13 bp, Homo sapiens
tgtacatacattg

SEQ ID NO: 5532517 - DNA, 22 bp, Homo sapiens
tgtacatacgctctcgtctctc

SEQ ID NO: 5532518 - DNA, 14 bp, Homo sapiens
tgtacatactggcc

SEQ ID NO: 5532519 - DNA, 15 bp, Homo sapiens
tgtacatactggcct

SEQ ID NO: 5532520 - DNA, 19 bp, Homo sapiens
tgtacatactggcctctgt

SEQ ID NO: 5532521 - DNA, 19 bp, Homo sapiens
tgtacatactttttcaaga

SEQ ID NO: 5532522 - DNA, 20 bp, Homo sapiens
tgtacatactttttgggttt

SEQ ID NO: 5532523 - DNA, 20 bp, Homo sapiens
tgtacatagagcaatgttgg

SEQ ID NO: 5532524 - DNA, 18 bp, Homo sapiens
tgtacatagagtgagaag

SEQ ID NO: 5532525 - DNA, 14 bp, Homo sapiens
tgtacatagtgcta

SEQ ID NO: 5532526 - DNA, 21 bp, Homo sapiens
tgtacatagtgctaacatgaa

SEQ ID NO: 5532527 - DNA, 16 bp, Homo sapiens
tgtacatatatgtata

SEQ ID NO: 5532528 - DNA, 17 bp, Homo sapiens
tgtacatatggaaatcc

SEQ ID NO: 5532529 - DNA, 19 bp, Homo sapiens
tgtacatatgtaaaataaa

SEQ ID NO: 5532530 - DNA, 18 bp, Homo sapiens
tgtacatatgtaaaatat

SEQ ID NO: 5532531 - DNA, 15 bp, Homo sapiens
tgtacatatgtgctg

SEQ ID NO: 5532532 - DNA, 20 bp, Homo sapiens
tgtacatatttgagactagt

SEQ ID NO: 5532533 - DNA, 17 bp, Homo sapiens
tgtacatcatgttattt

SEQ ID NO: 5532534 - DNA, 18 bp, Homo sapiens
tgtacatcccatgtaaca

SEQ ID NO: 5532535 - DNA, 20 bp, Homo sapiens
tgtacatcccatgtaacaga

SEQ ID NO: 5532536 - DNA, 23 bp, Homo sapiens
tgtacatcccatgtaacagaaag

SEQ ID NO: 5532537 - DNA, 23 bp, Homo sapiens
tgtacatctattttggattgtat

SEQ ID NO: 5532538 - DNA, 16 bp, Homo sapiens
tgtacatctggcttat

SEQ ID NO: 5532539 - DNA, 18 bp, Homo sapiens
tgtacatgaaatttttgt

SEQ ID NO: 5532540 - DNA, 15 bp, Homo sapiens
tgtacatgaagaatg

SEQ ID NO: 5532541 - DNA, 18 bp, Homo sapiens
tgtacatgataagacatt

SEQ ID NO: 5532542 - DNA, 19 bp, Homo sapiens
tgtacatgataagacattt

SEQ ID NO: 5532543 - DNA, 22 bp, Homo sapiens
tgtacatggaattttttgaata

SEQ ID NO: 5532544 - DNA, 20 bp, Homo sapiens
tgtacatgggactatgcttt

SEQ ID NO: 5532545 - DNA, 15 bp, Homo sapiens
tgtacatgtacatag

SEQ ID NO: 5532546 - DNA, 11 bp, Homo sapiens
tgtacatgtgt

SEQ ID NO: 5532547 - DNA, 17 bp, Homo sapiens
tgtacatgtgtagcctg

SEQ ID NO: 5532548 - DNA, 14 bp, Homo sapiens
tgtacatgttcctg

SEQ ID NO: 5532549 - DNA, 14 bp, Homo sapiens
tgtacatgttcttg

SEQ ID NO: 5532550 - DNA, 22 bp, Homo sapiens
tgtacattaaataccagccagc

SEQ ID NO: 5532551 - DNA, 13 bp, Homo sapiens
tgtacattactgt

SEQ ID NO: 5532552 - DNA, 17 bp, Homo sapiens
tgtacattatgaagaat

SEQ ID NO: 5532553 - DNA, 12 bp, Homo sapiens
tgtacattatgt

SEQ ID NO: 5532554 - DNA, 19 bp, Homo sapiens
tgtacattccctgcatcca

SEQ ID NO: 5532555 - DNA, 12 bp, Homo sapiens
tgtacattcctg

SEQ ID NO: 5532556 - DNA, 15 bp, Homo sapiens
tgtacattcctgata

SEQ ID NO: 5532557 - DNA, 16 bp, Homo sapiens
tgtacattctgcctag

SEQ ID NO: 5532558 - DNA, 18 bp, Homo sapiens
tgtacattcttccatcat

SEQ ID NO: 5532559 - DNA, 17 bp, Homo sapiens
tgtacattgtgagctct

SEQ ID NO: 5532560 - DNA, 19 bp, Homo sapiens
tgtacattgtgagctctgg

SEQ ID NO: 5532561 - DNA, 17 bp, Homo sapiens
tgtacatttattcatag

SEQ ID NO: 5532562 - DNA, 22 bp, Homo sapiens
tgtacatttatttattactgtc

SEQ ID NO: 5532563 - DNA, 12 bp, Homo sapiens
tgtacatttcta

SEQ ID NO: 5532564 - DNA, 15 bp, Homo sapiens
tgtacatttctaagt

SEQ ID NO: 5532565 - DNA, 19 bp, Homo sapiens
tgtacatttctaagtcaaa

SEQ ID NO: 5532566 - DNA, 16 bp, Homo sapiens
tgtacatttctataaa

SEQ ID NO: 5532567 - DNA, 21 bp, Homo sapiens
tgtacatttctataaatagat

SEQ ID NO: 5532568 - DNA, 15 bp, Homo sapiens
tgtacatttctcagg

SEQ ID NO: 5532569 - DNA, 14 bp, Homo sapiens
tgtacatttgaaaa

SEQ ID NO: 5532570 - DNA, 24 bp, Homo sapiens
tgtacatttgatttgatatacaga

SEQ ID NO: 5532571 - DNA, 20 bp, Homo sapiens
tgtacattttaaaggataat

SEQ ID NO: 5532572 - DNA, 13 bp, Homo sapiens
tgtacattttata

SEQ ID NO: 5532573 - DNA, 17 bp, Homo sapiens
tgtacattttataaagt

SEQ ID NO: 5532574 - DNA, 14 bp, Homo sapiens
tgtacattttggat

SEQ ID NO: 5532575 - DNA, 20 bp, Homo sapiens
tgtacattttggatttcttt

SEQ ID NO: 5532576 - DNA, 22 bp, Homo sapiens
tgtacattttggatttctttat

SEQ ID NO: 5532577 - DNA, 20 bp, Homo sapiens
tgtacattttgtaaaatatt

SEQ ID NO: 5532578 - DNA, 23 bp, Homo sapiens
tgtacattttgttgtaaaaagaa

SEQ ID NO: 5532579 - DNA, 20 bp, Homo sapiens
tgtacatttttaaattctta

SEQ ID NO: 5532580 - DNA, 20 bp, Homo sapiens
tgtacatttttcagcagcaa

SEQ ID NO: 5532581 - DNA, 18 bp, Homo sapiens
tgtacatttttgatcaaa

SEQ ID NO: 5532582 - DNA, 23 bp, Homo sapiens
tgtacatttttgatcaaatgtac

SEQ ID NO: 5532583 - DNA, 24 bp, Homo sapiens
tgtacatttttgatcaaatgtaca

SEQ ID NO: 5532584 - DNA, 18 bp, Homo sapiens
tgtacatttttgggggga

SEQ ID NO: 5532585 - DNA, 21 bp, Homo sapiens
tgtacatttttggggggagag

SEQ ID NO: 5532586 - DNA, 14 bp, Homo sapiens
tgtaccaaaacatc

SEQ ID NO: 5532587 - DNA, 14 bp, Homo sapiens
tgtaccaaaattca

SEQ ID NO: 5532588 - DNA, 16 bp, Homo sapiens
tgtaccaaatctgaca

SEQ ID NO: 5532589 - DNA, 21 bp, Homo sapiens
tgtaccaaatctgacatatta

SEQ ID NO: 5532590 - DNA, 14 bp, Homo sapiens
tgtaccaagtgaaa

SEQ ID NO: 5532591 - DNA, 21 bp, Homo sapiens
tgtaccaagtgcttcctacaa

SEQ ID NO: 5532592 - DNA, 12 bp, Homo sapiens
tgtaccacaccc

SEQ ID NO: 5532593 - DNA, 20 bp, Homo sapiens
tgtaccacaccctgcctgct

SEQ ID NO: 5532594 - DNA, 18 bp, Homo sapiens
tgtaccacatctgctcta

SEQ ID NO: 5532595 - DNA, 15 bp, Homo sapiens
tgtaccactgctaat

SEQ ID NO: 5532596 - DNA, 18 bp, Homo sapiens
tgtaccacttcctgaggc

SEQ ID NO: 5532597 - DNA, 20 bp, Homo sapiens
tgtaccacttcctgaggcct

SEQ ID NO: 5532598 - DNA, 22 bp, Homo sapiens
tgtaccacttcctgaggcctca

SEQ ID NO: 5532599 - DNA, 17 bp, Homo sapiens
tgtaccaggtcattctt

SEQ ID NO: 5532600 - DNA, 15 bp, Homo sapiens
tgtaccagtgtactg

SEQ ID NO: 5532601 - DNA, 18 bp, Homo sapiens
tgtaccagtgtactgctt

SEQ ID NO: 5532602 - DNA, 20 bp, Homo sapiens
tgtaccagtgtactgctttc

SEQ ID NO: 5532603 - DNA, 13 bp, Homo sapiens
tgtaccagtgtga

SEQ ID NO: 5532604 - DNA, 12 bp, Homo sapiens
tgtaccagttaa

SEQ ID NO: 5532605 - DNA, 21 bp, Homo sapiens
tgtaccagttaatttttccaa

SEQ ID NO: 5532606 - DNA, 23 bp, Homo sapiens
tgtaccagttaatttttccaact

SEQ ID NO: 5532607 - DNA, 14 bp, Homo sapiens
tgtaccatagaaaa

SEQ ID NO: 5532608 - DNA, 18 bp, Homo sapiens
tgtaccatagaaaaatgt

SEQ ID NO: 5532609 - DNA, 17 bp, Homo sapiens
tgtaccatatagcaaaa

SEQ ID NO: 5532610 - DNA, 14 bp, Homo sapiens
tgtaccatatgtag

SEQ ID NO: 5532611 - DNA, 12 bp, Homo sapiens
tgtaccatcaat

SEQ ID NO: 5532612 - DNA, 16 bp, Homo sapiens
tgtaccatgaatattt

SEQ ID NO: 5532613 - DNA, 12 bp, Homo sapiens
tgtaccatgtac

SEQ ID NO: 5532614 - DNA, 14 bp, Homo sapiens
tgtaccattaaaat

SEQ ID NO: 5532615 - DNA, 19 bp, Homo sapiens
tgtaccattaaaatatgca

SEQ ID NO: 5532616 - DNA, 20 bp, Homo sapiens
tgtaccattccttcaaataa

SEQ ID NO: 5532617 - DNA, 21 bp, Homo sapiens
tgtaccattccttcaaataaa

SEQ ID NO: 5532618 - DNA, 14 bp, Homo sapiens
tgtaccatttgcct

SEQ ID NO: 5532619 - DNA, 18 bp, Homo sapiens
tgtaccattttaaagtta

SEQ ID NO: 5532620 - DNA, 16 bp, Homo sapiens
tgtacccaccccagca

SEQ ID NO: 5532621 - DNA, 12 bp, Homo sapiens
tgtacccaccgg

SEQ ID NO: 5532622 - DNA, 21 bp, Homo sapiens
tgtacccaccgggccactcct

SEQ ID NO: 5532623 - DNA, 20 bp, Homo sapiens
tgtacccacgctgggtatta

SEQ ID NO: 5532624 - DNA, 23 bp, Homo sapiens
tgtacccacgctgggtattacca

SEQ ID NO: 5532625 - DNA, 14 bp, Homo sapiens
tgtacccagatgcc

SEQ ID NO: 5532626 - DNA, 16 bp, Homo sapiens
tgtacccagatgccta

SEQ ID NO: 5532627 - DNA, 14 bp, Homo sapiens
tgtacccagccacc

SEQ ID NO: 5532628 - DNA, 20 bp, Homo sapiens
tgtacccagccaccttcctg

SEQ ID NO: 5532629 - DNA, 14 bp, Homo sapiens
tgtacccagctcct

SEQ ID NO: 5532630 - DNA, 12 bp, Homo sapiens
tgtacccagttt

SEQ ID NO: 5532631 - DNA, 14 bp, Homo sapiens
tgtacccagtttct

SEQ ID NO: 5532632 - DNA, 19 bp, Homo sapiens
tgtacccatctttaattta

SEQ ID NO: 5532633 - DNA, 12 bp, Homo sapiens
tgtaccccatcc

SEQ ID NO: 5532634 - DNA, 14 bp, Homo sapiens
tgtaccccccaacc

SEQ ID NO: 5532635 - DNA, 20 bp, Homo sapiens
tgtaccccccaacccctgag

SEQ ID NO: 5532636 - DNA, 19 bp, Homo sapiens
tgtacccccgcccaggctg

SEQ ID NO: 5532637 - DNA, 18 bp, Homo sapiens
tgtaccctccatgtacct

SEQ ID NO: 5532638 - DNA, 22 bp, Homo sapiens
tgtacccttaagtcaccctagc

SEQ ID NO: 5532639 - DNA, 22 bp, Homo sapiens
tgtacccttccacctcctagag

SEQ ID NO: 5532640 - DNA, 23 bp, Homo sapiens
tgtaccctttaagatatccatct

SEQ ID NO: 5532641 - DNA, 17 bp, Homo sapiens
tgtaccgaaacaccccg

SEQ ID NO: 5532642 - DNA, 20 bp, Homo sapiens
tgtaccgaaacaccccgctc

SEQ ID NO: 5532643 - DNA, 20 bp, Homo sapiens
tgtaccgatgcagctctctt

SEQ ID NO: 5532644 - DNA, 17 bp, Homo sapiens
tgtaccgcccggcagcc

SEQ ID NO: 5532645 - DNA, 18 bp, Homo sapiens
tgtaccgcgtctaccctg

SEQ ID NO: 5532646 - DNA, 16 bp, Homo sapiens
tgtaccggccactgca

SEQ ID NO: 5532647 - DNA, 21 bp, Homo sapiens
tgtaccgggctggcctgtgcc

SEQ ID NO: 5532648 - DNA, 22 bp, Homo sapiens
tgtaccgtaggctttgtattca

SEQ ID NO: 5532649 - DNA, 20 bp, Homo sapiens
tgtagcctgtgcatgtatgt

SEQ ID NO: 5532650 - DNA, 13 bp, Homo sapiens
tgtagcctttttg

SEQ ID NO: 5532651 - DNA, 14 bp, Homo sapiens
tgtagcgaccccag

SEQ ID NO: 5532652 - DNA, 16 bp, Homo sapiens
tgtagcgaccccagac

SEQ ID NO: 5532653 - DNA, 23 bp, Homo sapiens
tgtagcgaccccagactgtagag

SEQ ID NO: 5532654 - DNA, 14 bp, Homo sapiens
tgtagcgggaggaa

SEQ ID NO: 5532655 - DNA, 19 bp, Homo sapiens
tgtagcgtcctgaggaata

SEQ ID NO: 5532656 - DNA, 16 bp, Homo sapiens
tgtagcgtctttcttt

SEQ ID NO: 5532657 - DNA, 17 bp, Homo sapiens
tgtagcgtgtttacatg

SEQ ID NO: 5532658 - DNA, 24 bp, Homo sapiens
tgtagcgtttcctttcttccctca

SEQ ID NO: 5532659 - DNA, 19 bp, Homo sapiens
tgtagctaattaggaagct

SEQ ID NO: 5532660 - DNA, 13 bp, Homo sapiens
tgtagctacagag

SEQ ID NO: 5532661 - DNA, 17 bp, Homo sapiens
tgtagctacagagaaac

SEQ ID NO: 5532662 - DNA, 18 bp, Homo sapiens
tgtagctacagagaaacc

SEQ ID NO: 5532663 - DNA, 18 bp, Homo sapiens
tgtagctatagaatgagt

SEQ ID NO: 5532664 - DNA, 22 bp, Homo sapiens
tgtagctcaaataggtcatcat

SEQ ID NO: 5532665 - DNA, 14 bp, Homo sapiens
tgtagctcaagttt

SEQ ID NO: 5532666 - DNA, 11 bp, Homo sapiens
tgtagctcagt

SEQ ID NO: 5532667 - DNA, 13 bp, Homo sapiens
tgtagctcagtca

SEQ ID NO: 5532668 - DNA, 15 bp, Homo sapiens
tgtagctccctcctc

SEQ ID NO: 5532669 - DNA, 20 bp, Homo sapiens
tgtagctccctcctcccatc

SEQ ID NO: 5532670 - DNA, 17 bp, Homo sapiens
tgtagctcctctgctgc

SEQ ID NO: 5532671 - DNA, 23 bp, Homo sapiens
tgtagctctgaatgctatttgtg

SEQ ID NO: 5532672 - DNA, 20 bp, Homo sapiens
tgtagctctgcatctcctgt

SEQ ID NO: 5532673 - DNA, 20 bp, Homo sapiens
tgtagctctttgtcagggag

SEQ ID NO: 5532674 - DNA, 15 bp, Homo sapiens
tgtagctgaagtaga

SEQ ID NO: 5532675 - DNA, 20 bp, Homo sapiens
tgtagctgctagctattggc

SEQ ID NO: 5532676 - DNA, 13 bp, Homo sapiens
tgtagctgctata

SEQ ID NO: 5532677 - DNA, 14 bp, Homo sapiens
tgtagctggcaagc

SEQ ID NO: 5532678 - DNA, 22 bp, Homo sapiens
tgtagctggcaagctgcaaaag

SEQ ID NO: 5532679 - DNA, 22 bp, Homo sapiens
tgtagctgtaagggcagtgccc

SEQ ID NO: 5532680 - DNA, 13 bp, Homo sapiens
tgtagctgtcatg

SEQ ID NO: 5532681 - DNA, 12 bp, Homo sapiens
tgtagctgtcct

SEQ ID NO: 5532682 - DNA, 14 bp, Homo sapiens
tgtagctgtgacct

SEQ ID NO: 5532683 - DNA, 16 bp, Homo sapiens
tgtagctgtgacctgc

SEQ ID NO: 5532684 - DNA, 23 bp, Homo sapiens
tgtagctgtgacctgctgagctc

SEQ ID NO: 5532685 - DNA, 21 bp, Homo sapiens
tgtagctgttttaagaaatct

SEQ ID NO: 5532686 - DNA, 20 bp, Homo sapiens
tgtagcttatctgcccctcc

SEQ ID NO: 5532687 - DNA, 20 bp, Homo sapiens
tgtagcttctaatgttcccc

SEQ ID NO: 5532688 - DNA, 14 bp, Homo sapiens
tgtagcttctgaaa

SEQ ID NO: 5532689 - DNA, 17 bp, Homo sapiens
tgtagcttcttctgaaa

SEQ ID NO: 5532690 - DNA, 16 bp, Homo sapiens
tgtagctttaaaacca

SEQ ID NO: 5532691 - DNA, 15 bp, Homo sapiens
tgtagctttcctgga

SEQ ID NO: 5532692 - DNA, 17 bp, Homo sapiens
tgtagctttcctggaag

SEQ ID NO: 5532693 - DNA, 15 bp, Homo sapiens
tgtagctttgctctt

SEQ ID NO: 5532694 - DNA, 23 bp, Homo sapiens
tgtagctttggaagtttagctct

SEQ ID NO: 5532695 - DNA, 20 bp, Homo sapiens
tgtaggaaaagctgttccca

SEQ ID NO: 5532696 - DNA, 22 bp, Homo sapiens
tgtaggaaaattttcttcttta

SEQ ID NO: 5532697 - DNA, 15 bp, Homo sapiens
tgtaggaacaagcat

SEQ ID NO: 5532698 - DNA, 22 bp, Homo sapiens
tgtaggaaccgtggtatgtctg

SEQ ID NO: 5532699 - DNA, 19 bp, Homo sapiens
tgtaggaagagtagcattt

SEQ ID NO: 5532700 - DNA, 19 bp, Homo sapiens
tgtaggaaggtactgtatg

SEQ ID NO: 5532701 - DNA, 20 bp, Homo sapiens
tgtaggaaggtactgtatga

SEQ ID NO: 5532702 - DNA, 19 bp, Homo sapiens
tgtaggaaggtctcattct

SEQ ID NO: 5532703 - DNA, 20 bp, Homo sapiens
tgtaggaaggtctcattctt

SEQ ID NO: 5532704 - DNA, 21 bp, Homo sapiens
tgtaggaattcttttggggaa

SEQ ID NO: 5532705 - DNA, 16 bp, Homo sapiens
tgtaggactatataaa

SEQ ID NO: 5532706 - DNA, 14 bp, Homo sapiens
tgtaggactgtata

SEQ ID NO: 5532707 - DNA, 18 bp, Homo sapiens
tgtaggagaaactcccat

SEQ ID NO: 5532708 - DNA, 20 bp, Homo sapiens
tgtaggagctacccttttcc

SEQ ID NO: 5532709 - DNA, 19 bp, Homo sapiens
tgtaggagctgcagttctt

SEQ ID NO: 5532710 - DNA, 20 bp, Homo sapiens
tgtaggatgacaggctctcc

SEQ ID NO: 5532711 - DNA, 14 bp, Homo sapiens
tgtaggcagacaca

SEQ ID NO: 5532712 - DNA, 17 bp, Homo sapiens
tgtaggcataaagtcag

SEQ ID NO: 5532713 - DNA, 20 bp, Homo sapiens
tgtaggccaaatttgtagtg

SEQ ID NO: 5532714 - DNA, 16 bp, Homo sapiens
tgtaggcgcccctggg

SEQ ID NO: 5532715 - DNA, 20 bp, Homo sapiens
tgtaggctaaaaggcttcca

SEQ ID NO: 5532716 - DNA, 23 bp, Homo sapiens
tgtaggctggtccctatgtcatg

SEQ ID NO: 5532717 - DNA, 20 bp, Homo sapiens
tgtagggaaaaaaatgcttc

SEQ ID NO: 5532718 - DNA, 16 bp, Homo sapiens
tgtagggaaaccttgg

SEQ ID NO: 5532719 - DNA, 21 bp, Homo sapiens
tgtagggaacggcctgagagg

SEQ ID NO: 5532720 - DNA, 12 bp, Homo sapiens
tgtagggaactt

SEQ ID NO: 5532721 - DNA, 21 bp, Homo sapiens
tgtagggaccagtgggatggg

SEQ ID NO: 5532722 - DNA, 20 bp, Homo sapiens
tgtagggagatggagaaaat

SEQ ID NO: 5532723 - DNA, 20 bp, Homo sapiens
tgtagggagtgaagccacag

SEQ ID NO: 5532724 - DNA, 19 bp, Homo sapiens
tgtagggcctgcatggaga

SEQ ID NO: 5532725 - DNA, 12 bp, Homo sapiens
tgtagggctgga

SEQ ID NO: 5532726 - DNA, 19 bp, Homo sapiens
tgtaggggacgagaaagat

SEQ ID NO: 5532727 - DNA, 23 bp, Homo sapiens
tgtaggggaggggctcctttcca

SEQ ID NO: 5532728 - DNA, 13 bp, Homo sapiens
tgtaggggcaggg

SEQ ID NO: 5532729 - DNA, 16 bp, Homo sapiens
tgtaggggccacctcc

SEQ ID NO: 5532730 - DNA, 18 bp, Homo sapiens
tgtagggtaaggtgcctt

SEQ ID NO: 5532731 - DNA, 20 bp, Homo sapiens
tgtagggtccaaccagacct

SEQ ID NO: 5532732 - DNA, 21 bp, Homo sapiens
tgtagggttctgcttttaagt

SEQ ID NO: 5532733 - DNA, 15 bp, Homo sapiens
tgtaggtaaaatgta

SEQ ID NO: 5532734 - DNA, 14 bp, Homo sapiens
tgtaggtaagactg

SEQ ID NO: 5532735 - DNA, 18 bp, Homo sapiens
tgtaggtaagttggctca

SEQ ID NO: 5532736 - DNA, 16 bp, Homo sapiens
tgtaggtatagaagat

SEQ ID NO: 5532737 - DNA, 17 bp, Homo sapiens
tgtaggtatgaataagt

SEQ ID NO: 5532738 - DNA, 13 bp, Homo sapiens
tgtaggtatgtct

SEQ ID NO: 5532739 - DNA, 21 bp, Homo sapiens
tgtaggtcaatgaaatatttg

SEQ ID NO: 5532740 - DNA, 13 bp, Homo sapiens
tgtaggtcactct

SEQ ID NO: 5532741 - DNA, 14 bp, Homo sapiens
tgtaggtgaacagt

SEQ ID NO: 5532742 - DNA, 23 bp, Homo sapiens
tgtaggtgaacagtcacgcctga

SEQ ID NO: 5532743 - DNA, 17 bp, Homo sapiens
tgtaggtgagcctgggc

SEQ ID NO: 5532744 - DNA, 19 bp, Homo sapiens
tgtaggtgagcctgggcag

SEQ ID NO: 5532745 - DNA, 23 bp, Homo sapiens
tgtaggtgatgtttccagctgcc

SEQ ID NO: 5532746 - DNA, 20 bp, Homo sapiens
tgtaggtgcaagatggaaag

SEQ ID NO: 5532747 - DNA, 19 bp, Homo sapiens
tgtaggtggagaggtggaa

SEQ ID NO: 5532748 - DNA, 15 bp, Homo sapiens
tgtaggtgtctctgg

SEQ ID NO: 5532749 - DNA, 19 bp, Homo sapiens
tgtaggtgtctctgggcct

SEQ ID NO: 5532750 - DNA, 20 bp, Homo sapiens
tgtaggtgtctctgggcctg

SEQ ID NO: 5532751 - DNA, 16 bp, Homo sapiens
tgtaggtgttatgtat

SEQ ID NO: 5532752 - DNA, 19 bp, Homo sapiens
tgtaggtgttatgtattcc

SEQ ID NO: 5532753 - DNA, 22 bp, Homo sapiens
tgtaggttattatgattagctt

SEQ ID NO: 5532754 - DNA, 21 bp, Homo sapiens
tgtaggttattttatatttga

SEQ ID NO: 5532755 - DNA, 17 bp, Homo sapiens
tgtagtaaaagtggtct

SEQ ID NO: 5532756 - DNA, 18 bp, Homo sapiens
tgtagtaaaatgttttca

SEQ ID NO: 5532757 - DNA, 21 bp, Homo sapiens
tgtagtaaactattcttaata

SEQ ID NO: 5532758 - DNA, 19 bp, Homo sapiens
tgtagtaaactatttatct

SEQ ID NO: 5532759 - DNA, 13 bp, Homo sapiens
tgtagtaaagaaa

SEQ ID NO: 5532760 - DNA, 17 bp, Homo sapiens
tgtagtaaataatgctt

SEQ ID NO: 5532761 - DNA, 15 bp, Homo sapiens
tgtagtaacactaat

SEQ ID NO: 5532762 - DNA, 20 bp, Homo sapiens
tgtagtaacactaatatatt

SEQ ID NO: 5532763 - DNA, 20 bp, Homo sapiens
tgtagtaactgcctcagtgt

SEQ ID NO: 5532764 - DNA, 14 bp, Homo sapiens
tgtagtaagagctt

SEQ ID NO: 5532765 - DNA, 19 bp, Homo sapiens
tgtagtaatgttttttaga

SEQ ID NO: 5532766 - DNA, 14 bp, Homo sapiens
tgtagtaattgaca

SEQ ID NO: 5532767 - DNA, 19 bp, Homo sapiens
tgtagtaattgacatgtgc

SEQ ID NO: 5532768 - DNA, 14 bp, Homo sapiens
tgtagtaattgtta

SEQ ID NO: 5532769 - DNA, 18 bp, Homo sapiens
tgtagtaattgttacaat

SEQ ID NO: 5532770 - DNA, 13 bp, Homo sapiens
tgtagtaatttat

SEQ ID NO: 5532771 - DNA, 15 bp, Homo sapiens
tgtagtagttgatga

SEQ ID NO: 5532772 - DNA, 15 bp, Homo sapiens
tgtagtatggtatat

SEQ ID NO: 5532773 - DNA, 15 bp, Homo sapiens
tgtagtatttatatt

SEQ ID NO: 5532774 - DNA, 15 bp, Homo sapiens
tgtagtcaataaaac

SEQ ID NO: 5532775 - DNA, 16 bp, Homo sapiens
tgtagtcaggtgctca

SEQ ID NO: 5532776 - DNA, 14 bp, Homo sapiens
tgtagtcatttact

SEQ ID NO: 5532777 - DNA, 15 bp, Homo sapiens
tgtagtcatttacta

SEQ ID NO: 5532778 - DNA, 24 bp, Homo sapiens
tgtagtcatttactaaacatatga

SEQ ID NO: 5532779 - DNA, 19 bp, Homo sapiens
tgtagtcccacttacttgg

SEQ ID NO: 5532780 - DNA, 16 bp, Homo sapiens
tgtagtcccagcactt

SEQ ID NO: 5532781 - DNA, 19 bp, Homo sapiens
tgtagtcccggaggccttc

SEQ ID NO: 5532782 - DNA, 22 bp, Homo sapiens
tgtagtccgtgctgacagctgc

SEQ ID NO: 5532783 - DNA, 23 bp, Homo sapiens
tgtagtcctagccactcaggagg

SEQ ID NO: 5532784 - DNA, 17 bp, Homo sapiens
tgtagtcctcataaaaa

SEQ ID NO: 5532785 - DNA, 16 bp, Homo sapiens
tgtagtcttatgaata

SEQ ID NO: 5532786 - DNA, 21 bp, Homo sapiens
tgtagtcttggctaaggaaat

SEQ ID NO: 5532787 - DNA, 21 bp, Homo sapiens
tgtagtcttgtcttagctctg

SEQ ID NO: 5532788 - DNA, 14 bp, Homo sapiens
tgtagtctttttat

SEQ ID NO: 5532789 - DNA, 16 bp, Homo sapiens
tgtagtgaagctctca

SEQ ID NO: 5532790 - DNA, 16 bp, Homo sapiens
tgtagtgagaaactga

SEQ ID NO: 5532791 - DNA, 17 bp, Homo sapiens
tgtagtgagaaactgat

SEQ ID NO: 5532792 - DNA, 21 bp, Homo sapiens
tgtagtgagcgagtggatgct

SEQ ID NO: 5532793 - DNA, 17 bp, Homo sapiens
tgtagtgagtgtagact

SEQ ID NO: 5532794 - DNA, 23 bp, Homo sapiens
tgtagtgatgttgtttgggagag

SEQ ID NO: 5532795 - DNA, 20 bp, Homo sapiens
tgtagtgatttttatgccac

SEQ ID NO: 5532796 - DNA, 15 bp, Homo sapiens
tgtagtgctacaggg

SEQ ID NO: 5532797 - DNA, 13 bp, Homo sapiens
tgtagtggaagag

SEQ ID NO: 5532798 - DNA, 15 bp, Homo sapiens
tgtagtggaagagca

SEQ ID NO: 5532799 - DNA, 20 bp, Homo sapiens
tgtagtggaagagcagcctg

SEQ ID NO: 5532800 - DNA, 18 bp, Homo sapiens
tgtagtggccccctcctc

SEQ ID NO: 5532801 - DNA, 23 bp, Homo sapiens
tgtagtggctcatgcctgtaatc

SEQ ID NO: 5532802 - DNA, 23 bp, Homo sapiens
tgtagtggcttcttttgaactgt

SEQ ID NO: 5532803 - DNA, 13 bp, Homo sapiens
tgtagtgggaagt

SEQ ID NO: 5532804 - DNA, 13 bp, Homo sapiens
tgtagtggtttta

SEQ ID NO: 5532805 - DNA, 22 bp, Homo sapiens
tgtagtgtattaatctctgtgt

SEQ ID NO: 5532806 - DNA, 21 bp, Homo sapiens
tgtagtgtccattttgtgaag

SEQ ID NO: 5532807 - DNA, 20 bp, Homo sapiens
tgtagtgtgtttgtgagtat

SEQ ID NO: 5532808 - DNA, 23 bp, Homo sapiens
tgtagtgtgtttgtgagtatgtg

SEQ ID NO: 5532809 - DNA, 14 bp, Homo sapiens
tgtagtgttggaga

SEQ ID NO: 5532810 - DNA, 20 bp, Homo sapiens
tgtagtgttggagaagaact

SEQ ID NO: 5532811 - DNA, 18 bp, Homo sapiens
tgtagttaatataaatgt

SEQ ID NO: 5532812 - DNA, 18 bp, Homo sapiens
tgtagttaatttatctaa

SEQ ID NO: 5532813 - DNA, 23 bp, Homo sapiens
tgtagttacagtaaatacactgt

SEQ ID NO: 5532814 - DNA, 14 bp, Homo sapiens
tgtagttaggaaat

SEQ ID NO: 5532815 - DNA, 23 bp, Homo sapiens
tgtagttaggaaataaaaccttt

SEQ ID NO: 5532816 - DNA, 18 bp, Homo sapiens
tgtagttaggcctggctc

SEQ ID NO: 5532817 - DNA, 16 bp, Homo sapiens
tgtagttataaaccaa

SEQ ID NO: 5532818 - DNA, 18 bp, Homo sapiens
tgtagttctgtgtacttt

SEQ ID NO: 5532819 - DNA, 19 bp, Homo sapiens
tgtagttgacaattctgca

SEQ ID NO: 5532820 - DNA, 22 bp, Homo sapiens
tgtagttgcaatagaacagaga

SEQ ID NO: 5532821 - DNA, 22 bp, Homo sapiens
tgtagttgtcacactaaaattt

SEQ ID NO: 5532822 - DNA, 11 bp, Homo sapiens
tgtagtttaat

SEQ ID NO: 5532823 - DNA, 22 bp, Homo sapiens
tgtagtttgaaagttgtacatg

SEQ ID NO: 5532824 - DNA, 15 bp, Homo sapiens
tgtagtttgcccaga

SEQ ID NO: 5532825 - DNA, 16 bp, Homo sapiens
tgtattcagataatta

SEQ ID NO: 5532826 - DNA, 17 bp, Homo sapiens
tgtattcatactgacat

SEQ ID NO: 5532827 - DNA, 20 bp, Homo sapiens
tgtattcatatattgcattt

SEQ ID NO: 5532828 - DNA, 17 bp, Homo sapiens
tgtattcatatttgtac

SEQ ID NO: 5532829 - DNA, 13 bp, Homo sapiens
tgtattcatccag

SEQ ID NO: 5532830 - DNA, 14 bp, Homo sapiens
tgtattcatccaga

SEQ ID NO: 5532831 - DNA, 16 bp, Homo sapiens
tgtattcatccagagt

SEQ ID NO: 5532832 - DNA, 20 bp, Homo sapiens
tgtattcatccagagttctt

SEQ ID NO: 5532833 - DNA, 17 bp, Homo sapiens
tgtattcatcttttgta

SEQ ID NO: 5532834 - DNA, 21 bp, Homo sapiens
tgtattcatgttcatgtgatt

SEQ ID NO: 5532835 - DNA, 13 bp, Homo sapiens
tgtattcattctt

SEQ ID NO: 5532836 - DNA, 18 bp, Homo sapiens
tgtattcccacccctgga

SEQ ID NO: 5532837 - DNA, 20 bp, Homo sapiens
tgtattcccgttttacagat

SEQ ID NO: 5532838 - DNA, 23 bp, Homo sapiens
tgtattcccgttttacagataag

SEQ ID NO: 5532839 - DNA, 18 bp, Homo sapiens
tgtattcccttgtatttt

SEQ ID NO: 5532840 - DNA, 20 bp, Homo sapiens
tgtattcccttgtattttgt

SEQ ID NO: 5532841 - DNA, 23 bp, Homo sapiens
tgtattcccttttatttccaaaa

SEQ ID NO: 5532842 - DNA, 21 bp, Homo sapiens
tgtattctacctttgtaaaac

SEQ ID NO: 5532843 - DNA, 16 bp, Homo sapiens
tgtattctatttgtgt

SEQ ID NO: 5532844 - DNA, 18 bp, Homo sapiens
tgtattctcataatactg

SEQ ID NO: 5532845 - DNA, 13 bp, Homo sapiens
tgtattctctgag

SEQ ID NO: 5532846 - DNA, 19 bp, Homo sapiens
tgtattctctgagctgtgc

SEQ ID NO: 5532847 - DNA, 21 bp, Homo sapiens
tgtattctctgcaattttact

SEQ ID NO: 5532848 - DNA, 12 bp, Homo sapiens
tgtattctctgt

SEQ ID NO: 5532849 - DNA, 14 bp, Homo sapiens
tgtattctgaggat

SEQ ID NO: 5532850 - DNA, 18 bp, Homo sapiens
tgtattctgtatccgtga

SEQ ID NO: 5532851 - DNA, 13 bp, Homo sapiens
tgtattctgtctt

SEQ ID NO: 5532852 - DNA, 17 bp, Homo sapiens
tgtattctgtcttcatc

SEQ ID NO: 5532853 - DNA, 18 bp, Homo sapiens
tgtattctgtggattcta

SEQ ID NO: 5532854 - DNA, 14 bp, Homo sapiens
tgtattcttaaaat

SEQ ID NO: 5532855 - DNA, 20 bp, Homo sapiens
tgtattcttaaaatgcaata

SEQ ID NO: 5532856 - DNA, 15 bp, Homo sapiens
tgtattcttctgtat

SEQ ID NO: 5532857 - DNA, 18 bp, Homo sapiens
tgtattcttgttttacat

SEQ ID NO: 5532858 - DNA, 14 bp, Homo sapiens
tgtattctttataa

SEQ ID NO: 5532859 - DNA, 21 bp, Homo sapiens
tgtattctttgatgttaacac

SEQ ID NO: 5532860 - DNA, 16 bp, Homo sapiens
tgtattcttttctcag

SEQ ID NO: 5532861 - DNA, 19 bp, Homo sapiens
tgtattcttttctcagtgt

SEQ ID NO: 5532862 - DNA, 16 bp, Homo sapiens
tgtattgaaaacactt

SEQ ID NO: 5532863 - DNA, 13 bp, Homo sapiens
tgtattgacttta

SEQ ID NO: 5532864 - DNA, 19 bp, Homo sapiens
tgtattgagggccagtgat

SEQ ID NO: 5532865 - DNA, 20 bp, Homo sapiens
tgtattgagtcttaactgta

SEQ ID NO: 5532866 - DNA, 21 bp, Homo sapiens
tgtattgatgcaatataagca

SEQ ID NO: 5532867 - DNA, 21 bp, Homo sapiens
tgtattgattacaaataaaca

SEQ ID NO: 5532868 - DNA, 18 bp, Homo sapiens
tgtattgcagctaagctc

SEQ ID NO: 5532869 - DNA, 22 bp, Homo sapiens
tgtattgctccattttcttgtc

SEQ ID NO: 5532870 - DNA, 16 bp, Homo sapiens
tgtattgctcctccca

SEQ ID NO: 5532871 - DNA, 16 bp, Homo sapiens
tgtattgctgctgtgc

SEQ ID NO: 5532872 - DNA, 12 bp, Homo sapiens
tgtattgcttta

SEQ ID NO: 5532873 - DNA, 15 bp, Homo sapiens
tgtattggcagcaca

SEQ ID NO: 5532874 - DNA, 17 bp, Homo sapiens
tgtattggcagcacagc

SEQ ID NO: 5532875 - DNA, 17 bp, Homo sapiens
tgtattggctctgtgaa

SEQ ID NO: 5532876 - DNA, 18 bp, Homo sapiens
tgtattggtgttgcagcc

SEQ ID NO: 5532877 - DNA, 16 bp, Homo sapiens
tgtattggttaaaact

SEQ ID NO: 5532878 - DNA, 18 bp, Homo sapiens
tgtattggttaaaactgt

SEQ ID NO: 5532879 - DNA, 20 bp, Homo sapiens
tgtattggtttctgtttgaa

SEQ ID NO: 5532880 - DNA, 17 bp, Homo sapiens
tgtattgtaactatgtt

SEQ ID NO: 5532881 - DNA, 11 bp, Homo sapiens
tgtattgtacc

SEQ ID NO: 5532882 - DNA, 15 bp, Homo sapiens
tgtattgtgcaatgt

SEQ ID NO: 5532883 - DNA, 13 bp, Homo sapiens
tgtattgtggtat

SEQ ID NO: 5532884 - DNA, 19 bp, Homo sapiens
tgtattgtgtcttttgcat

SEQ ID NO: 5532885 - DNA, 19 bp, Homo sapiens
tgtattgttagatgtttgt

SEQ ID NO: 5532886 - DNA, 15 bp, Homo sapiens
tgtattgttcccagt

SEQ ID NO: 5532887 - DNA, 18 bp, Homo sapiens
tgtattgttctcatgtaa

SEQ ID NO: 5532888 - DNA, 15 bp, Homo sapiens
tgtattgttctgttt

SEQ ID NO: 5532889 - DNA, 20 bp, Homo sapiens
tgtattgttgaaaaagtttg

SEQ ID NO: 5532890 - DNA, 23 bp, Homo sapiens
tgtattgttgaaaaagtttgttt

SEQ ID NO: 5532891 - DNA, 19 bp, Homo sapiens
tgtattgtttctacaataa

SEQ ID NO: 5532892 - DNA, 20 bp, Homo sapiens
tgtattgttttcccaagtgt

SEQ ID NO: 5532893 - DNA, 14 bp, Homo sapiens
tgtatttaaaaaca

SEQ ID NO: 5532894 - DNA, 19 bp, Homo sapiens
tgtatttaaaacatttcat

SEQ ID NO: 5532895 - DNA, 20 bp, Homo sapiens
tgtatttaaaacatttcatg

SEQ ID NO: 5532896 - DNA, 12 bp, Homo sapiens
tgtatttaaaga

SEQ ID NO: 5532897 - DNA, 14 bp, Homo sapiens
tgtatttaaagttg

SEQ ID NO: 5532898 - DNA, 15 bp, Homo sapiens
tgtatttaaatgaaa

SEQ ID NO: 5532899 - DNA, 21 bp, Homo sapiens
tgtatttaacaaaaagtgctt

SEQ ID NO: 5532900 - DNA, 16 bp, Homo sapiens
tgtatttaacagaaat

SEQ ID NO: 5532901 - DNA, 14 bp, Homo sapiens
tgtatttaagaaaa

SEQ ID NO: 5532902 - DNA, 21 bp, Homo sapiens
tgtatttaagaaagggaaagc

SEQ ID NO: 5532903 - DNA, 13 bp, Homo sapiens
tgtatttaagaca

SEQ ID NO: 5532904 - DNA, 21 bp, Homo sapiens
tgtatttaagatttttgtaaa

SEQ ID NO: 5532905 - DNA, 20 bp, Homo sapiens
tgtatttaagcaaatactta

SEQ ID NO: 5532906 - DNA, 22 bp, Homo sapiens
tgtatttaaggaatcaaatctt

SEQ ID NO: 5532907 - DNA, 22 bp, Homo sapiens
tgtatttacttgttatgttgta

SEQ ID NO: 5532908 - DNA, 23 bp, Homo sapiens
tgtatttacttgttatgttgtaa

SEQ ID NO: 5532909 - DNA, 19 bp, Homo sapiens
tgtatttagctacagcttg

SEQ ID NO: 5532910 - DNA, 20 bp, Homo sapiens
tgtatttaggccatttgtta

SEQ ID NO: 5532911 - DNA, 20 bp, Homo sapiens
tgtatttataatttaaatga

SEQ ID NO: 5532912 - DNA, 19 bp, Homo sapiens
tgtatttatataagtctgt

SEQ ID NO: 5532913 - DNA, 13 bp, Homo sapiens
tgtatttatatat

SEQ ID NO: 5532914 - DNA, 15 bp, Homo sapiens
tgtatttatatgtta

SEQ ID NO: 5532915 - DNA, 12 bp, Homo sapiens
tgtatttatgta

SEQ ID NO: 5532916 - DNA, 16 bp, Homo sapiens
tgtatttatgtgtgag

SEQ ID NO: 5532917 - DNA, 14 bp, Homo sapiens
tgtatttattaatt

SEQ ID NO: 5532918 - DNA, 17 bp, Homo sapiens
tgtatttattcctctgt

SEQ ID NO: 5532919 - DNA, 21 bp, Homo sapiens
tgtatttattcctctgtccta

SEQ ID NO: 5532920 - DNA, 14 bp, Homo sapiens
tgtatttcaaatat

SEQ ID NO: 5532921 - DNA, 16 bp, Homo sapiens
tgtatttcagggacct

SEQ ID NO: 5532922 - DNA, 23 bp, Homo sapiens
tgtatttcagggacctcaggggc

SEQ ID NO: 5532923 - DNA, 19 bp, Homo sapiens
tgtatttcagtattttcca

SEQ ID NO: 5532924 - DNA, 20 bp, Homo sapiens
tgtatttcagtattttccag

SEQ ID NO: 5532925 - DNA, 20 bp, Homo sapiens
tgtatttcctgcttccctgt

SEQ ID NO: 5532926 - DNA, 11 bp, Homo sapiens
tgtatttcctt

SEQ ID NO: 5532927 - DNA, 15 bp, Homo sapiens
tgtatttctaagaaa

SEQ ID NO: 5532928 - DNA, 19 bp, Homo sapiens
tgtatttctaagaaataga

SEQ ID NO: 5532929 - DNA, 15 bp, Homo sapiens
tgtatttctcttgtc

SEQ ID NO: 5532930 - DNA, 15 bp, Homo sapiens
tgtatttctgtagaa

SEQ ID NO: 5532931 - DNA, 16 bp, Homo sapiens
tgtatttctgtagaat

SEQ ID NO: 5532932 - DNA, 14 bp, Homo sapiens
tgtatttctgtgga

SEQ ID NO: 5532933 - DNA, 18 bp, Homo sapiens
tgtatttcttatacgctt

SEQ ID NO: 5532934 - DNA, 11 bp, Homo sapiens
tgtatttcttt

SEQ ID NO: 5532935 - DNA, 18 bp, Homo sapiens
tgtatttcttttatatat

SEQ ID NO: 5532936 - DNA, 17 bp, Homo sapiens
tgtatttgaaataagaa

SEQ ID NO: 5532937 - DNA, 13 bp, Homo sapiens
tgtatttgagaag

SEQ ID NO: 5532938 - DNA, 14 bp, Homo sapiens
tgtatttgagaaga

SEQ ID NO: 5532939 - DNA, 14 bp, Homo sapiens
tgtatttgaggaaa

SEQ ID NO: 5532940 - DNA, 21 bp, Homo sapiens
tgtatttgagttggctttgct

SEQ ID NO: 5532941 - DNA, 12 bp, Homo sapiens
tgtatttgctaa

SEQ ID NO: 5532942 - DNA, 22 bp, Homo sapiens
tgtatttggctgggctacaatt

SEQ ID NO: 5532943 - DNA, 13 bp, Homo sapiens
tgtatttgtatta

SEQ ID NO: 5532944 - DNA, 13 bp, Homo sapiens
tgtatttgtgact

SEQ ID NO: 5532945 - DNA, 18 bp, Homo sapiens
tgtatttgtgactaattg

SEQ ID NO: 5532946 - DNA, 22 bp, Homo sapiens
tgtatttgtgactaattgtata

SEQ ID NO: 5532947 - DNA, 12 bp, Homo sapiens
tgtatttgtgta

SEQ ID NO: 5532948 - DNA, 18 bp, Homo sapiens
tgtatttgttaatttctt

SEQ ID NO: 5532949 - DNA, 17 bp, Homo sapiens
tgtatttgttatatata

SEQ ID NO: 5532950 - DNA, 16 bp, Homo sapiens
tgtatttgttcatgtt

SEQ ID NO: 5532951 - DNA, 19 bp, Homo sapiens
tgtatttgttcatgtttgg

SEQ ID NO: 5532952 - DNA, 20 bp, Homo sapiens
tgtatttgttgaaattaaaa

SEQ ID NO: 5532953 - DNA, 14 bp, Homo sapiens
tgtattttaaaata

SEQ ID NO: 5532954 - DNA, 23 bp, Homo sapiens
tgtattttaaagggacagtttgt

SEQ ID NO: 5532955 - DNA, 20 bp, Homo sapiens
tgtattttaaatgttttaca

SEQ ID NO: 5532956 - DNA, 15 bp, Homo sapiens
tgtattttaacactt

SEQ ID NO: 5532957 - DNA, 13 bp, Homo sapiens
tgtattttaacta

SEQ ID NO: 5532958 - DNA, 18 bp, Homo sapiens
tgtattttaactattttt

SEQ ID NO: 5532959 - DNA, 14 bp, Homo sapiens
tgtattttaactca

SEQ ID NO: 5532960 - DNA, 22 bp, Homo sapiens
tgtattttaagatccagaaata

SEQ ID NO: 5532961 - DNA, 16 bp, Homo sapiens
tgtattttaataaaga

SEQ ID NO: 5532962 - DNA, 18 bp, Homo sapiens
tgtattttaataaagatt

SEQ ID NO: 5532963 - DNA, 16 bp, Homo sapiens
tgtattttaataacat

SEQ ID NO: 5532964 - DNA, 13 bp, Homo sapiens
tgtattttacatg

SEQ ID NO: 5532965 - DNA, 18 bp, Homo sapiens
tgtattttactttgtgca

SEQ ID NO: 5532966 - DNA, 17 bp, Homo sapiens
tgtattttatcttattt

SEQ ID NO: 5532967 - DNA, 14 bp, Homo sapiens
tgtattttatgtat

SEQ ID NO: 5532968 - DNA, 14 bp, Homo sapiens
tgtattttatgtta

SEQ ID NO: 5532969 - DNA, 15 bp, Homo sapiens
tgtattttatgttat

SEQ ID NO: 5532970 - DNA, 18 bp, Homo sapiens
tgtattttattattttct

SEQ ID NO: 5532971 - DNA, 21 bp, Homo sapiens
tgtattttatttttttctctc

SEQ ID NO: 5532972 - DNA, 16 bp, Homo sapiens
tgtattttcaaagact

SEQ ID NO: 5532973 - DNA, 13 bp, Homo sapiens
tgtattttcaact

SEQ ID NO: 5532974 - DNA, 16 bp, Homo sapiens
tgtattttcaataaag

SEQ ID NO: 5532975 - DNA, 19 bp, Homo sapiens
tgtattttcatagatgtgt

SEQ ID NO: 5532976 - DNA, 12 bp, Homo sapiens
tgtattttccaa

SEQ ID NO: 5532977 - DNA, 17 bp, Homo sapiens
tgtattttccaagtgtg

SEQ ID NO: 5532978 - DNA, 22 bp, Homo sapiens
tgtattttccaagtgtgcatat

SEQ ID NO: 5532979 - DNA, 12 bp, Homo sapiens
tgtattttccta

SEQ ID NO: 5532980 - DNA, 20 bp, Homo sapiens
tgtattttctgtcactgtag

SEQ ID NO: 5532981 - DNA, 22 bp, Homo sapiens
tgtattttcttcacctctgcta

SEQ ID NO: 5532982 - DNA, 16 bp, Homo sapiens
tgtattttgagataat

SEQ ID NO: 5532983 - DNA, 14 bp, Homo sapiens
tgtattttgagttt

SEQ ID NO: 5532984 - DNA, 13 bp, Homo sapiens
tgtattttgatat

SEQ ID NO: 5532985 - DNA, 23 bp, Homo sapiens
tgtattttgatataattgtactg

SEQ ID NO: 5532986 - DNA, 15 bp, Homo sapiens
tgtattttgcatact

SEQ ID NO: 5532987 - DNA, 22 bp, Homo sapiens
tgtattttgcatactcaaggtg

SEQ ID NO: 5532988 - DNA, 19 bp, Homo sapiens
tgtattttggaagacatat

SEQ ID NO: 5532989 - DNA, 21 bp, Homo sapiens
tgtattttgtaaactgatgtt

SEQ ID NO: 5532990 - DNA, 22 bp, Homo sapiens
tgtattttgtaaactgatgttt

SEQ ID NO: 5532991 - DNA, 22 bp, Homo sapiens
tgtattttgtaaataataaaat

SEQ ID NO: 5532992 - DNA, 22 bp, Homo sapiens
tgtattttgtgagtttgtttct

SEQ ID NO: 5532993 - DNA, 15 bp, Homo sapiens
tgtattttgtgtgac

SEQ ID NO: 5532994 - DNA, 19 bp, Homo sapiens
tgtattttgtgtgaccaac

SEQ ID NO: 5532995 - DNA, 17 bp, Homo sapiens
tgtattttgttaaagct

SEQ ID NO: 5532996 - DNA, 17 bp, Homo sapiens
tgtatttttaaattctg

SEQ ID NO: 5532997 - DNA, 17 bp, Homo sapiens
tgtatttttaataaaga

SEQ ID NO: 5532998 - DNA, 13 bp, Homo sapiens
tgtatttttagta

SEQ ID NO: 5532999 - DNA, 19 bp, Homo sapiens
tgtatttttagtagagatg

SEQ ID NO: 5533000 - DNA, 16 bp, Homo sapiens
tgtatttttatataat

SEQ ID NO: 5533001 - DNA, 18 bp, Homo sapiens
tgtatttttattttcctg

SEQ ID NO: 5533002 - DNA, 18 bp, Homo sapiens
tgtatttttcaataataa

SEQ ID NO: 5533003 - DNA, 22 bp, Homo sapiens
tgtcagccatgggaaatgagcc

SEQ ID NO: 5533004 - DNA, 15 bp, Homo sapiens
tgtcagcccacagca

SEQ ID NO: 5533005 - DNA, 17 bp, Homo sapiens
tgtcagcccacagcagc

SEQ ID NO: 5533006 - DNA, 23 bp, Homo sapiens
tgtcagcccctcatcagcctttt

SEQ ID NO: 5533007 - DNA, 13 bp, Homo sapiens
tgtcagcccctct

SEQ ID NO: 5533008 - DNA, 18 bp, Homo sapiens
tgtcagcccctcttccct

SEQ ID NO: 5533009 - DNA, 22 bp, Homo sapiens
tgtcagccgagccgggcctggg

SEQ ID NO: 5533010 - DNA, 17 bp, Homo sapiens
tgtcagccgggccctga

SEQ ID NO: 5533011 - DNA, 21 bp, Homo sapiens
tgtcagccgggccctgagtaa

SEQ ID NO: 5533012 - DNA, 13 bp, Homo sapiens
tgtcagcctgtgc

SEQ ID NO: 5533013 - DNA, 17 bp, Homo sapiens
tgtcagcctgtgctgtg

SEQ ID NO: 5533014 - DNA, 12 bp, Homo sapiens
tgtcagcctttg

SEQ ID NO: 5533015 - DNA, 13 bp, Homo sapiens
tgtcagcgtttct

SEQ ID NO: 5533016 - DNA, 20 bp, Homo sapiens
tgtcagctaaagaagtttga

SEQ ID NO: 5533017 - DNA, 19 bp, Homo sapiens
tgtcagctactaatgatgt

SEQ ID NO: 5533018 - DNA, 21 bp, Homo sapiens
tgtcagctactaatgatgttt

SEQ ID NO: 5533019 - DNA, 23 bp, Homo sapiens
tgtcagctgagcttgagctcccc

SEQ ID NO: 5533020 - DNA, 19 bp, Homo sapiens
tgtcagctgaggctggggg

SEQ ID NO: 5533021 - DNA, 23 bp, Homo sapiens
tgtcagctgcaaggtactctggt

SEQ ID NO: 5533022 - DNA, 17 bp, Homo sapiens
tgtcagctgctgttgaa

SEQ ID NO: 5533023 - DNA, 18 bp, Homo sapiens
tgtcagctgctgttgaac

SEQ ID NO: 5533024 - DNA, 18 bp, Homo sapiens
tgtcagctggtagctggg

SEQ ID NO: 5533025 - DNA, 18 bp, Homo sapiens
tgtcagctgtagaaaggt

SEQ ID NO: 5533026 - DNA, 17 bp, Homo sapiens
tgtcagcttcccagcca

SEQ ID NO: 5533027 - DNA, 20 bp, Homo sapiens
tgtcagcttcccagccatgc

SEQ ID NO: 5533028 - DNA, 21 bp, Homo sapiens
tgtcagcttcccagccatgcc

SEQ ID NO: 5533029 - DNA, 19 bp, Homo sapiens
tgtcagcttggctgtagga

SEQ ID NO: 5533030 - DNA, 14 bp, Homo sapiens
tgtcagctttgact

SEQ ID NO: 5533031 - DNA, 21 bp, Homo sapiens
tgtcagctttggattgctggg

SEQ ID NO: 5533032 - DNA, 21 bp, Homo sapiens
tgtcaggaaacatatttaaga

SEQ ID NO: 5533033 - DNA, 17 bp, Homo sapiens
tgtcaggaacagaagga

SEQ ID NO: 5533034 - DNA, 12 bp, Homo sapiens
tgtcaggaatgg

SEQ ID NO: 5533035 - DNA, 17 bp, Homo sapiens
tgtcaggacccaggccg

SEQ ID NO: 5533036 - DNA, 14 bp, Homo sapiens
tgtcaggagagcag

SEQ ID NO: 5533037 - DNA, 16 bp, Homo sapiens
tgtcaggagtgtgtgt

SEQ ID NO: 5533038 - DNA, 13 bp, Homo sapiens
tgtcaggattgcg

SEQ ID NO: 5533039 - DNA, 21 bp, Homo sapiens
tgtcaggattgcgagagatgt

SEQ ID NO: 5533040 - DNA, 14 bp, Homo sapiens
tgtcaggcactggg

SEQ ID NO: 5533041 - DNA, 22 bp, Homo sapiens
tgtcaggcatggctcagagctt

SEQ ID NO: 5533042 - DNA, 21 bp, Homo sapiens
tgtcaggcccgtcggagctgc

SEQ ID NO: 5533043 - DNA, 19 bp, Homo sapiens
tgtcaggccttcagggttc

SEQ ID NO: 5533044 - DNA, 12 bp, Homo sapiens
tgtcaggctctg

SEQ ID NO: 5533045 - DNA, 14 bp, Homo sapiens
tgtcaggctctgaa

SEQ ID NO: 5533046 - DNA, 19 bp, Homo sapiens
tgtcaggctgctggcgcct

SEQ ID NO: 5533047 - DNA, 23 bp, Homo sapiens
tgtcaggctgctggcgcctctgc

SEQ ID NO: 5533048 - DNA, 13 bp, Homo sapiens
tgtcaggctggga

SEQ ID NO: 5533049 - DNA, 15 bp, Homo sapiens
tgtcagggagggcca

SEQ ID NO: 5533050 - DNA, 19 bp, Homo sapiens
tgtcagggagggccaggga

SEQ ID NO: 5533051 - DNA, 16 bp, Homo sapiens
tgtcagggatgagttg

SEQ ID NO: 5533052 - DNA, 19 bp, Homo sapiens
tgtcagggatgagttgagg

SEQ ID NO: 5533053 - DNA, 15 bp, Homo sapiens
tgtcagggtctcctt

SEQ ID NO: 5533054 - DNA, 21 bp, Homo sapiens
tgtcagggtctccttccttcc

SEQ ID NO: 5533055 - DNA, 16 bp, Homo sapiens
tgtcaggtcccagcga

SEQ ID NO: 5533056 - DNA, 15 bp, Homo sapiens
tgtcaggtgggagat

SEQ ID NO: 5533057 - DNA, 20 bp, Homo sapiens
tgtcaggtggggcagcttga

SEQ ID NO: 5533058 - DNA, 24 bp, Homo sapiens
tgtcagtactaaggtgactttctg

SEQ ID NO: 5533059 - DNA, 18 bp, Homo sapiens
tgtcagtatgtggaagtg

SEQ ID NO: 5533060 - DNA, 22 bp, Homo sapiens
tgtcagtatgtggaagtgtggg

SEQ ID NO: 5533061 - DNA, 17 bp, Homo sapiens
tgtcagtatttcaactg

SEQ ID NO: 5533062 - DNA, 18 bp, Homo sapiens
tgtcagtatttcaactgc

SEQ ID NO: 5533063 - DNA, 18 bp, Homo sapiens
tgtcagtatttcagtgta

SEQ ID NO: 5533064 - DNA, 17 bp, Homo sapiens
tgtcagtatttttgccg

SEQ ID NO: 5533065 - DNA, 16 bp, Homo sapiens
tgtcagtcacagccac

SEQ ID NO: 5533066 - DNA, 17 bp, Homo sapiens
tgtcagtcccactgcac

SEQ ID NO: 5533067 - DNA, 17 bp, Homo sapiens
tgtcagtctacaggcct

SEQ ID NO: 5533068 - DNA, 15 bp, Homo sapiens
tgtcagtctgagtca

SEQ ID NO: 5533069 - DNA, 17 bp, Homo sapiens
tgtcagtctgcttagaa

SEQ ID NO: 5533070 - DNA, 16 bp, Homo sapiens
tgtcagtgattttgta

SEQ ID NO: 5533071 - DNA, 16 bp, Homo sapiens
tgtcagtgcagcccgt

SEQ ID NO: 5533072 - DNA, 23 bp, Homo sapiens
tgtcagtgccgccgcctcgccca

SEQ ID NO: 5533073 - DNA, 18 bp, Homo sapiens
tgtcagtggggctctctg

SEQ ID NO: 5533074 - DNA, 20 bp, Homo sapiens
tgtcagtggggctctctgag

SEQ ID NO: 5533075 - DNA, 15 bp, Homo sapiens
tgtcagtggtttcta

SEQ ID NO: 5533076 - DNA, 15 bp, Homo sapiens
tgtcagtgtagacac

SEQ ID NO: 5533077 - DNA, 20 bp, Homo sapiens
tgtcagtgtagacacaggtc

SEQ ID NO: 5533078 - DNA, 16 bp, Homo sapiens
tgtcagtgtcctcagg

SEQ ID NO: 5533079 - DNA, 15 bp, Homo sapiens
tgtcagtgtgaaaat

SEQ ID NO: 5533080 - DNA, 15 bp, Homo sapiens
tgtcagtgtgactga

SEQ ID NO: 5533081 - DNA, 17 bp, Homo sapiens
tgtcagtgtgtcagttt

SEQ ID NO: 5533082 - DNA, 11 bp, Homo sapiens
tgtcagtgttg

SEQ ID NO: 5533083 - DNA, 18 bp, Homo sapiens
tgtcagtgtttgtatttg

SEQ ID NO: 5533084 - DNA, 16 bp, Homo sapiens
tgtcagtgtttttgaa

SEQ ID NO: 5533085 - DNA, 16 bp, Homo sapiens
tgtcagttcagaaaaa

SEQ ID NO: 5533086 - DNA, 19 bp, Homo sapiens
tgtcagttcataatatatg

SEQ ID NO: 5533087 - DNA, 21 bp, Homo sapiens
tgtcagttcttggtgctctgt

SEQ ID NO: 5533088 - DNA, 14 bp, Homo sapiens
tgtcagttgaaaat

SEQ ID NO: 5533089 - DNA, 20 bp, Homo sapiens
tgtcagttgttatttattga

SEQ ID NO: 5533090 - DNA, 14 bp, Homo sapiens
tgtcagtttatgtt

SEQ ID NO: 5533091 - DNA, 17 bp, Homo sapiens
tgtcagtttcccctctc

SEQ ID NO: 5533092 - DNA, 14 bp, Homo sapiens
tgtcagtttgtgaa

SEQ ID NO: 5533093 - DNA, 18 bp, Homo sapiens
tgtcagtttgtgaagtga

SEQ ID NO: 5533094 - DNA, 16 bp, Homo sapiens
tgtcagtttttcctcc

SEQ ID NO: 5533095 - DNA, 15 bp, Homo sapiens
tgtcataaaatgcat

SEQ ID NO: 5533096 - DNA, 20 bp, Homo sapiens
tgtcataaaatgcatactgt

SEQ ID NO: 5533097 - DNA, 17 bp, Homo sapiens
tgtcataaaatgctatt

SEQ ID NO: 5533098 - DNA, 21 bp, Homo sapiens
tgtcataaacagatgaataaa

SEQ ID NO: 5533099 - DNA, 18 bp, Homo sapiens
tgtcataaactttctcca

SEQ ID NO: 5533100 - DNA, 17 bp, Homo sapiens
tgtcataaagaagagcc

SEQ ID NO: 5533101 - DNA, 22 bp, Homo sapiens
tgtcataaagtgagaaaactgt

SEQ ID NO: 5533102 - DNA, 18 bp, Homo sapiens
tgtcataaatgtcacaat

SEQ ID NO: 5533103 - DNA, 21 bp, Homo sapiens
tgtcataacatccagagcttt

SEQ ID NO: 5533104 - DNA, 12 bp, Homo sapiens
tgtcataacatt

SEQ ID NO: 5533105 - DNA, 21 bp, Homo sapiens
tgtcataacatttaaagagat

SEQ ID NO: 5533106 - DNA, 17 bp, Homo sapiens
tgtcataactagagcac

SEQ ID NO: 5533107 - DNA, 14 bp, Homo sapiens
tgtcataagaatga

SEQ ID NO: 5533108 - DNA, 16 bp, Homo sapiens
tgtcataagaatgaat

SEQ ID NO: 5533109 - DNA, 17 bp, Homo sapiens
tgtcataagaatgaata

SEQ ID NO: 5533110 - DNA, 13 bp, Homo sapiens
tgtcataagcatt

SEQ ID NO: 5533111 - DNA, 16 bp, Homo sapiens
tgtcataagcattact

SEQ ID NO: 5533112 - DNA, 20 bp, Homo sapiens
tgtcataagcattactttat

SEQ ID NO: 5533113 - DNA, 21 bp, Homo sapiens
tgtcataaggcggcgtgggcg

SEQ ID NO: 5533114 - DNA, 16 bp, Homo sapiens
tgtcataataaagttg

SEQ ID NO: 5533115 - DNA, 18 bp, Homo sapiens
tgtcataatggtgaatgt

SEQ ID NO: 5533116 - DNA, 14 bp, Homo sapiens
tgtcatactctgtg

SEQ ID NO: 5533117 - DNA, 17 bp, Homo sapiens
tgtcatactctgtgtaa

SEQ ID NO: 5533118 - DNA, 18 bp, Homo sapiens
tgtcatactctgtgtaat

SEQ ID NO: 5533119 - DNA, 22 bp, Homo sapiens
tgtcatagaaagtgccagaaag

SEQ ID NO: 5533120 - DNA, 22 bp, Homo sapiens
tgtcatagggattgtccctgtg

SEQ ID NO: 5533121 - DNA, 23 bp, Homo sapiens
tgtcatagttctgagctgccagt

SEQ ID NO: 5533122 - DNA, 16 bp, Homo sapiens
tgtcatagtttaattg

SEQ ID NO: 5533123 - DNA, 20 bp, Homo sapiens
tgtcatatatggggggccaa

SEQ ID NO: 5533124 - DNA, 23 bp, Homo sapiens
tgtcatatattcatgtaataaat

SEQ ID NO: 5533125 - DNA, 17 bp, Homo sapiens
tgtcatatcagcacata

SEQ ID NO: 5533126 - DNA, 23 bp, Homo sapiens
tgtcatatgctcctagagaggag

SEQ ID NO: 5533127 - DNA, 21 bp, Homo sapiens
tgtcatatgtaggtgtctgca

SEQ ID NO: 5533128 - DNA, 21 bp, Homo sapiens
tgtcatcaagtagtagtactt

SEQ ID NO: 5533129 - DNA, 14 bp, Homo sapiens
tgtcatcaattaaa

SEQ ID NO: 5533130 - DNA, 22 bp, Homo sapiens
tgtcatcaattgaatggtcagc

SEQ ID NO: 5533131 - DNA, 13 bp, Homo sapiens
tgtcatcactccc

SEQ ID NO: 5533132 - DNA, 15 bp, Homo sapiens
tgtcatcactccctg

SEQ ID NO: 5533133 - DNA, 18 bp, Homo sapiens
tgtcatcagagctcctct

SEQ ID NO: 5533134 - DNA, 20 bp, Homo sapiens
tgtcatcagagctcctctgt

SEQ ID NO: 5533135 - DNA, 13 bp, Homo sapiens
tgtcatcagaggg

SEQ ID NO: 5533136 - DNA, 14 bp, Homo sapiens
tgtcatcagatgga

SEQ ID NO: 5533137 - DNA, 13 bp, Homo sapiens
tgtcatccacctg

SEQ ID NO: 5533138 - DNA, 16 bp, Homo sapiens
tgtcatcccattgtct

SEQ ID NO: 5533139 - DNA, 17 bp, Homo sapiens
tgtcatcccattgtctt

SEQ ID NO: 5533140 - DNA, 18 bp, Homo sapiens
tgtcatcccgctcctgct

SEQ ID NO: 5533141 - DNA, 23 bp, Homo sapiens
tgtcatcccgctcctgctgaaac

SEQ ID NO: 5533142 - DNA, 23 bp, Homo sapiens
tgtcatcctcaaagaaagtgtat

SEQ ID NO: 5533143 - DNA, 14 bp, Homo sapiens
tgtcatcctcacag

SEQ ID NO: 5533144 - DNA, 17 bp, Homo sapiens
tgtcatcgttccccacc

SEQ ID NO: 5533145 - DNA, 14 bp, Homo sapiens
tgtcatctctctgc

SEQ ID NO: 5533146 - DNA, 23 bp, Homo sapiens
tgtcatctctctggggccctggg

SEQ ID NO: 5533147 - DNA, 16 bp, Homo sapiens
tgtcatctgagaatga

SEQ ID NO: 5533148 - DNA, 19 bp, Homo sapiens
tgtcatctgagaatgaaca

SEQ ID NO: 5533149 - DNA, 17 bp, Homo sapiens
tgtcatctgctccttcc

SEQ ID NO: 5533150 - DNA, 15 bp, Homo sapiens
tgtcatctgctgcga

SEQ ID NO: 5533151 - DNA, 20 bp, Homo sapiens
tgtcatctgggccaccagct

SEQ ID NO: 5533152 - DNA, 14 bp, Homo sapiens
tgtcatgaaagcac

SEQ ID NO: 5533153 - DNA, 20 bp, Homo sapiens
tgtcatgaagaatgtttctg

SEQ ID NO: 5533154 - DNA, 19 bp, Homo sapiens
tgtcatgaattcttatgct

SEQ ID NO: 5533155 - DNA, 15 bp, Homo sapiens
tgtcatgactttcag

SEQ ID NO: 5533156 - DNA, 15 bp, Homo sapiens
tgtcatgaggaaact

SEQ ID NO: 5533157 - DNA, 13 bp, Homo sapiens
tgtcatgattggc

SEQ ID NO: 5533158 - DNA, 20 bp, Homo sapiens
tgtcatgatttcaatgattg

SEQ ID NO: 5533159 - DNA, 13 bp, Homo sapiens
tgtcatgcccagc

SEQ ID NO: 5533160 - DNA, 18 bp, Homo sapiens
tgtcatgcccagcttgga

SEQ ID NO: 5533161 - DNA, 19 bp, Homo sapiens
tgtcatgcccagcttggag

SEQ ID NO: 5533162 - DNA, 14 bp, Homo sapiens
tgtcatgcccccct

SEQ ID NO: 5533163 - DNA, 15 bp, Homo sapiens
tgtcatgcccccctc

SEQ ID NO: 5533164 - DNA, 22 bp, Homo sapiens
tgtcatgctcacttttgtgaaa

SEQ ID NO: 5533165 - DNA, 22 bp, Homo sapiens
tgtcatgcttcatcattccctc

SEQ ID NO: 5533166 - DNA, 15 bp, Homo sapiens
tgtcatggaaaagcc

SEQ ID NO: 5533167 - DNA, 18 bp, Homo sapiens
tgtcatggaaaagcccag

SEQ ID NO: 5533168 - DNA, 22 bp, Homo sapiens
tgtcatggaaaatgtcctgtgg

SEQ ID NO: 5533169 - DNA, 21 bp, Homo sapiens
tgtcatggactgttgccacca

SEQ ID NO: 5533170 - DNA, 20 bp, Homo sapiens
tgtcatggccttgaaacagt

SEQ ID NO: 5533171 - DNA, 12 bp, Homo sapiens
tgtcatggctga

SEQ ID NO: 5533172 - DNA, 14 bp, Homo sapiens
tgtcatggctgaag

SEQ ID NO: 5533173 - DNA, 12 bp, Homo sapiens
tgtcatggtgaa

SEQ ID NO: 5533174 - DNA, 13 bp, Homo sapiens
tgtcatggtgaaa

SEQ ID NO: 5533175 - DNA, 16 bp, Homo sapiens
tgtcatggtgaaatta

SEQ ID NO: 5533176 - DNA, 17 bp, Homo sapiens
tgtcatggtgaaattat

SEQ ID NO: 5533177 - DNA, 22 bp, Homo sapiens
tgtcatggtgaaattataacta

SEQ ID NO: 5533178 - DNA, 14 bp, Homo sapiens
tgtcatggtgatgc

SEQ ID NO: 5533179 - DNA, 18 bp, Homo sapiens
tgtcatggtgatgcaagt

SEQ ID NO: 5533180 - DNA, 14 bp, Homo sapiens
tgtcctcaccacat

SEQ ID NO: 5533181 - DNA, 23 bp, Homo sapiens
tgtcctcacgccccctgtgactt

SEQ ID NO: 5533182 - DNA, 20 bp, Homo sapiens
tgtcctcacggtgccttttt

SEQ ID NO: 5533183 - DNA, 19 bp, Homo sapiens
tgtcctcagagcaggggcc

SEQ ID NO: 5533184 - DNA, 19 bp, Homo sapiens
tgtcctcagaggcgtgctg

SEQ ID NO: 5533185 - DNA, 21 bp, Homo sapiens
tgtcctcagaggcgtgctggt

SEQ ID NO: 5533186 - DNA, 14 bp, Homo sapiens
tgtcctcagcagct

SEQ ID NO: 5533187 - DNA, 15 bp, Homo sapiens
tgtcctcagcatttc

SEQ ID NO: 5533188 - DNA, 14 bp, Homo sapiens
tgtcctcagccagt

SEQ ID NO: 5533189 - DNA, 13 bp, Homo sapiens
tgtcctcagcctt

SEQ ID NO: 5533190 - DNA, 17 bp, Homo sapiens
tgtcctcagccttgcca

SEQ ID NO: 5533191 - DNA, 21 bp, Homo sapiens
tgtcctcagccttgccagaga

SEQ ID NO: 5533192 - DNA, 23 bp, Homo sapiens
tgtcctcagcttgggcttcttcc

SEQ ID NO: 5533193 - DNA, 22 bp, Homo sapiens
tgtcctcagggctctaccaaga

SEQ ID NO: 5533194 - DNA, 18 bp, Homo sapiens
tgtcctcaggtgaataac

SEQ ID NO: 5533195 - DNA, 14 bp, Homo sapiens
tgtcctcaggtggc

SEQ ID NO: 5533196 - DNA, 20 bp, Homo sapiens
tgtcctcatctataaaatga

SEQ ID NO: 5533197 - DNA, 21 bp, Homo sapiens
tgtcctcatgtgagaaagcag

SEQ ID NO: 5533198 - DNA, 17 bp, Homo sapiens
tgtcctcatttctccag

SEQ ID NO: 5533199 - DNA, 18 bp, Homo sapiens
tgtcctcatttctccaga

SEQ ID NO: 5533200 - DNA, 22 bp, Homo sapiens
tgtcctccaacaataaagagct

SEQ ID NO: 5533201 - DNA, 23 bp, Homo sapiens
tgtcctccaacaataaagagctc

SEQ ID NO: 5533202 - DNA, 14 bp, Homo sapiens
tgtcctccaagtgc

SEQ ID NO: 5533203 - DNA, 21 bp, Homo sapiens
tgtcctccaccacaagagctc

SEQ ID NO: 5533204 - DNA, 21 bp, Homo sapiens
tgtcctccaggagcttcttgt

SEQ ID NO: 5533205 - DNA, 14 bp, Homo sapiens
tgtcctccagggcg

SEQ ID NO: 5533206 - DNA, 17 bp, Homo sapiens
tgtcctcccacagacct

SEQ ID NO: 5533207 - DNA, 19 bp, Homo sapiens
tgtcctcccacagacctgc

SEQ ID NO: 5533208 - DNA, 20 bp, Homo sapiens
tgtcctcccacagacctgca

SEQ ID NO: 5533209 - DNA, 18 bp, Homo sapiens
tgtcctcccagctcctca

SEQ ID NO: 5533210 - DNA, 14 bp, Homo sapiens
tgtcctcccaggaa

SEQ ID NO: 5533211 - DNA, 16 bp, Homo sapiens
tgtcctcccaggaacc

SEQ ID NO: 5533212 - DNA, 14 bp, Homo sapiens
tgtcctcccatccc

SEQ ID NO: 5533213 - DNA, 15 bp, Homo sapiens
tgtcctcccatcccc

SEQ ID NO: 5533214 - DNA, 22 bp, Homo sapiens
tgtcctcccatcccctggactg

SEQ ID NO: 5533215 - DNA, 23 bp, Homo sapiens
tgtcctcccatcccctggactgg

SEQ ID NO: 5533216 - DNA, 19 bp, Homo sapiens
tgtcctccccaccccgata

SEQ ID NO: 5533217 - DNA, 17 bp, Homo sapiens
tgtcctcccgagctcct

SEQ ID NO: 5533218 - DNA, 12 bp, Homo sapiens
tgtcctccctcc

SEQ ID NO: 5533219 - DNA, 13 bp, Homo sapiens
tgtcctccctcca

SEQ ID NO: 5533220 - DNA, 14 bp, Homo sapiens
tgtcctcctaaggg

SEQ ID NO: 5533221 - DNA, 21 bp, Homo sapiens
tgtcctcctcggatcaccgag

SEQ ID NO: 5533222 - DNA, 13 bp, Homo sapiens
tgtcctcctctga

SEQ ID NO: 5533223 - DNA, 14 bp, Homo sapiens
tgtcctcctctgag

SEQ ID NO: 5533224 - DNA, 16 bp, Homo sapiens
tgtcctcctctgagga

SEQ ID NO: 5533225 - DNA, 18 bp, Homo sapiens
tgtcctcctctgaggaag

SEQ ID NO: 5533226 - DNA, 16 bp, Homo sapiens
tgtcctcctgctctgc

SEQ ID NO: 5533227 - DNA, 19 bp, Homo sapiens
tgtcctcctgctctgcttc

SEQ ID NO: 5533228 - DNA, 16 bp, Homo sapiens
tgtcctcctggcacct

SEQ ID NO: 5533229 - DNA, 16 bp, Homo sapiens
tgtcctccttcctggg

SEQ ID NO: 5533230 - DNA, 17 bp, Homo sapiens
tgtcctccttcctggga

SEQ ID NO: 5533231 - DNA, 18 bp, Homo sapiens
tgtcctccttcctgggac

SEQ ID NO: 5533232 - DNA, 14 bp, Homo sapiens
tgtcctccttttca

SEQ ID NO: 5533233 - DNA, 18 bp, Homo sapiens
tgtcctccttttcacttt

SEQ ID NO: 5533234 - DNA, 13 bp, Homo sapiens
tgtcctcgcactg

SEQ ID NO: 5533235 - DNA, 14 bp, Homo sapiens
tgtcctcgcactgc

SEQ ID NO: 5533236 - DNA, 20 bp, Homo sapiens
tgtcctcggtttcccatttg

SEQ ID NO: 5533237 - DNA, 16 bp, Homo sapiens
tgtcctctccagcttt

SEQ ID NO: 5533238 - DNA, 12 bp, Homo sapiens
tgtcctctcccc

SEQ ID NO: 5533239 - DNA, 24 bp, Homo sapiens
tgtcctctcccccttcagctcctg

SEQ ID NO: 5533240 - DNA, 13 bp, Homo sapiens
tgtcctctcccct

SEQ ID NO: 5533241 - DNA, 22 bp, Homo sapiens
tgtcctctcccctccagccttt

SEQ ID NO: 5533242 - DNA, 16 bp, Homo sapiens
tgtcctctcccctctg

SEQ ID NO: 5533243 - DNA, 17 bp, Homo sapiens
tgtcctctccctgccaa

SEQ ID NO: 5533244 - DNA, 13 bp, Homo sapiens
tgtcctctcgagc

SEQ ID NO: 5533245 - DNA, 16 bp, Homo sapiens
tgtcctctcgagccca

SEQ ID NO: 5533246 - DNA, 16 bp, Homo sapiens
tgtcctctgctttgct

SEQ ID NO: 5533247 - DNA, 13 bp, Homo sapiens
tgtcctcttctgc

SEQ ID NO: 5533248 - DNA, 19 bp, Homo sapiens
tgtcctcttctgcatcttg

SEQ ID NO: 5533249 - DNA, 17 bp, Homo sapiens
tgtcctcttctgctctt

SEQ ID NO: 5533250 - DNA, 20 bp, Homo sapiens
tgtcctcttctgctcttttc

SEQ ID NO: 5533251 - DNA, 13 bp, Homo sapiens
tgtcctcttgcca

SEQ ID NO: 5533252 - DNA, 15 bp, Homo sapiens
tgtcctcttgctcaa

SEQ ID NO: 5533253 - DNA, 18 bp, Homo sapiens
tgtcctcttggccatcct

SEQ ID NO: 5533254 - DNA, 23 bp, Homo sapiens
tgtcctctttactcccttcctgg

SEQ ID NO: 5533255 - DNA, 23 bp, Homo sapiens
tgtcctctttcagaaaacagaaa

SEQ ID NO: 5533256 - DNA, 14 bp, Homo sapiens
tgtcctgaaacatg

SEQ ID NO: 5533257 - DNA, 21 bp, Homo sapiens
tgtcctgaaagcggctgcctc

SEQ ID NO: 5533258 - DNA, 23 bp, Homo sapiens
tgtcctgaaccgactgaccctga

SEQ ID NO: 5533259 - DNA, 24 bp, Homo sapiens
tgtcctgaaccgactgaccctgag

SEQ ID NO: 5533260 - DNA, 16 bp, Homo sapiens
tgtcctgaactgtgag

SEQ ID NO: 5533261 - DNA, 12 bp, Homo sapiens
tgtcctgaagcc

SEQ ID NO: 5533262 - DNA, 15 bp, Homo sapiens
tgtcctgaagcccag

SEQ ID NO: 5533263 - DNA, 12 bp, Homo sapiens
tgtcctgaaggc

SEQ ID NO: 5533264 - DNA, 21 bp, Homo sapiens
tgtcctgaatccagcattgtt

SEQ ID NO: 5533265 - DNA, 19 bp, Homo sapiens
tgtcctgacagcactcctc

SEQ ID NO: 5533266 - DNA, 16 bp, Homo sapiens
tgtcctgaccaccctc

SEQ ID NO: 5533267 - DNA, 20 bp, Homo sapiens
tgtcctgaccaccctcccct

SEQ ID NO: 5533268 - DNA, 22 bp, Homo sapiens
tgtcctgacttcaggggctgcc

SEQ ID NO: 5533269 - DNA, 19 bp, Homo sapiens
tgtcctgactttgccccct

SEQ ID NO: 5533270 - DNA, 17 bp, Homo sapiens
tgtcctgagccccaggg

SEQ ID NO: 5533271 - DNA, 19 bp, Homo sapiens
tgtcctgagccccagggag

SEQ ID NO: 5533272 - DNA, 18 bp, Homo sapiens
tgtcctgagccccctgca

SEQ ID NO: 5533273 - DNA, 20 bp, Homo sapiens
tgtcctgagccccctgcacc

SEQ ID NO: 5533274 - DNA, 12 bp, Homo sapiens
tgtcctgagctc

SEQ ID NO: 5533275 - DNA, 17 bp, Homo sapiens
tgtcctgagctcagcgt

SEQ ID NO: 5533276 - DNA, 18 bp, Homo sapiens
tgtcctgaggagccctga

SEQ ID NO: 5533277 - DNA, 15 bp, Homo sapiens
tgtcctgatgctttt

SEQ ID NO: 5533278 - DNA, 18 bp, Homo sapiens
tgtcctgatggtcagctc

SEQ ID NO: 5533279 - DNA, 19 bp, Homo sapiens
tgtcctgatgtttttctgt

SEQ ID NO: 5533280 - DNA, 21 bp, Homo sapiens
tgtcctgatgtttttctgtgt

SEQ ID NO: 5533281 - DNA, 15 bp, Homo sapiens
tgtcctgatttctta

SEQ ID NO: 5533282 - DNA, 18 bp, Homo sapiens
tgtcctgcacaccctggg

SEQ ID NO: 5533283 - DNA, 19 bp, Homo sapiens
tgtcctgcacaccctgggc

SEQ ID NO: 5533284 - DNA, 24 bp, Homo sapiens
tgtcctgccacccagccccagcca

SEQ ID NO: 5533285 - DNA, 16 bp, Homo sapiens
tgtcctgccagctgcc

SEQ ID NO: 5533286 - DNA, 17 bp, Homo sapiens
tgtcctgccagctgcct

SEQ ID NO: 5533287 - DNA, 12 bp, Homo sapiens
tgtcctgcccac

SEQ ID NO: 5533288 - DNA, 16 bp, Homo sapiens
tgtcctgcccacccta

SEQ ID NO: 5533289 - DNA, 13 bp, Homo sapiens
tgtcctgcccgtg

SEQ ID NO: 5533290 - DNA, 10 bp, Homo sapiens
tgtcctgcct

SEQ ID NO: 5533291 - DNA, 11 bp, Homo sapiens
tgtcctgcctc

SEQ ID NO: 5533292 - DNA, 14 bp, Homo sapiens
tgtcctgcctcctc

SEQ ID NO: 5533293 - DNA, 15 bp, Homo sapiens
tgtcctgcctcctca

SEQ ID NO: 5533294 - DNA, 23 bp, Homo sapiens
tgtcctgcctctctgctccagag

SEQ ID NO: 5533295 - DNA, 17 bp, Homo sapiens
tgtcctgcctgtctgcc

SEQ ID NO: 5533296 - DNA, 21 bp, Homo sapiens
tgtcctgcctgtctgccccag

SEQ ID NO: 5533297 - DNA, 15 bp, Homo sapiens
tgtcctgcgcctgcg

SEQ ID NO: 5533298 - DNA, 18 bp, Homo sapiens
tgtcctgcgttcagcccc

SEQ ID NO: 5533299 - DNA, 20 bp, Homo sapiens
tgtcctgcgttcagcccctg

SEQ ID NO: 5533300 - DNA, 11 bp, Homo sapiens
tgtcctgctca

SEQ ID NO: 5533301 - DNA, 18 bp, Homo sapiens
tgtcctgctcacgtctgt

SEQ ID NO: 5533302 - DNA, 21 bp, Homo sapiens
tgtcctgctcacgtctgtgag

SEQ ID NO: 5533303 - DNA, 12 bp, Homo sapiens
tgtcctgctcag

SEQ ID NO: 5533304 - DNA, 14 bp, Homo sapiens
tgtcctgctcagat

SEQ ID NO: 5533305 - DNA, 18 bp, Homo sapiens
tgtcctgctcagatgctg

SEQ ID NO: 5533306 - DNA, 16 bp, Homo sapiens
tgtcctgctccacagt

SEQ ID NO: 5533307 - DNA, 10 bp, Homo sapiens
tgtcctgctg

SEQ ID NO: 5533308 - DNA, 18 bp, Homo sapiens
tgtcctgctgccctccca

SEQ ID NO: 5533309 - DNA, 20 bp, Homo sapiens
tgtcctgctgccctcccaca

SEQ ID NO: 5533310 - DNA, 12 bp, Homo sapiens
tgtcctgctggt

SEQ ID NO: 5533311 - DNA, 16 bp, Homo sapiens
tgtcctggaccctggc

SEQ ID NO: 5533312 - DNA, 11 bp, Homo sapiens
tgtcctggccc

SEQ ID NO: 5533313 - DNA, 13 bp, Homo sapiens
tgtcctggccctt

SEQ ID NO: 5533314 - DNA, 19 bp, Homo sapiens
tgtcctggcccttcagtct

SEQ ID NO: 5533315 - DNA, 20 bp, Homo sapiens
tgtcctggcccttcagtctg

SEQ ID NO: 5533316 - DNA, 14 bp, Homo sapiens
tgtcctggctccca

SEQ ID NO: 5533317 - DNA, 15 bp, Homo sapiens
tgtcctggctgctct

SEQ ID NO: 5533318 - DNA, 12 bp, Homo sapiens
tgtcctgggagt

SEQ ID NO: 5533319 - DNA, 15 bp, Homo sapiens
tgtcctgggcctgca

SEQ ID NO: 5533320 - DNA, 17 bp, Homo sapiens
tgtcctgggcctgcaga

SEQ ID NO: 5533321 - DNA, 19 bp, Homo sapiens
tgtcctgggttctggggca

SEQ ID NO: 5533322 - DNA, 18 bp, Homo sapiens
tgtcctggtaattcctct

SEQ ID NO: 5533323 - DNA, 20 bp, Homo sapiens
tgtcctggtaattcctctcc

SEQ ID NO: 5533324 - DNA, 15 bp, Homo sapiens
tgtcctggtacagca

SEQ ID NO: 5533325 - DNA, 19 bp, Homo sapiens
tgtcctggtacagcagggt

SEQ ID NO: 5533326 - DNA, 20 bp, Homo sapiens
tgtcctggtcagttttcaca

SEQ ID NO: 5533327 - DNA, 16 bp, Homo sapiens
tgtcctggtgagaaaa

SEQ ID NO: 5533328 - DNA, 13 bp, Homo sapiens
tgtcctggtgctc

SEQ ID NO: 5533329 - DNA, 19 bp, Homo sapiens
tgtcctggtgctctctgcc

SEQ ID NO: 5533330 - DNA, 20 bp, Homo sapiens
tgtcctggtgctctctgcca

SEQ ID NO: 5533331 - DNA, 13 bp, Homo sapiens
tgtcctggtggta

SEQ ID NO: 5533332 - DNA, 21 bp, Homo sapiens
tgtcctggtgtcacttactgt

SEQ ID NO: 5533333 - DNA, 17 bp, Homo sapiens
tgtcctggttagcagag

SEQ ID NO: 5533334 - DNA, 16 bp, Homo sapiens
tgtcctgtaactgtta

SEQ ID NO: 5533335 - DNA, 16 bp, Homo sapiens
tgtcctgtacattgtg

SEQ ID NO: 5533336 - DNA, 21 bp, Homo sapiens
tgtcctgtagagagagaccta

SEQ ID NO: 5533337 - DNA, 20 bp, Homo sapiens
tgtcctgtagaggttttgtt

SEQ ID NO: 5533338 - DNA, 24 bp, Homo sapiens
tgtcctgtagttgcgtggactctg

SEQ ID NO: 5533339 - DNA, 15 bp, Homo sapiens
tgtcctgtcatcatc

SEQ ID NO: 5533340 - DNA, 19 bp, Homo sapiens
tgtcctgtcatcatcatgg

SEQ ID NO: 5533341 - DNA, 12 bp, Homo sapiens
tgtcctgtcctg

SEQ ID NO: 5533342 - DNA, 13 bp, Homo sapiens
tgtcctgtcctgg

SEQ ID NO: 5533343 - DNA, 18 bp, Homo sapiens
tgtcctgtcctttcttgc

SEQ ID NO: 5533344 - DNA, 13 bp, Homo sapiens
tgtcctgtctgct

SEQ ID NO: 5533345 - DNA, 15 bp, Homo sapiens
tgtcctgtctgctgg

SEQ ID NO: 5533346 - DNA, 16 bp, Homo sapiens
tgtcctgtctgctggg

SEQ ID NO: 5533347 - DNA, 17 bp, Homo sapiens
tgtcctgtctgctgggc

SEQ ID NO: 5533348 - DNA, 15 bp, Homo sapiens
tgtcctgtctttgat

SEQ ID NO: 5533349 - DNA, 17 bp, Homo sapiens
tgtcctgtgaatggaag

SEQ ID NO: 5533350 - DNA, 20 bp, Homo sapiens
tgtcctgtgagatgtgtatc

SEQ ID NO: 5533351 - DNA, 19 bp, Homo sapiens
tgtcctgtgaggtttccca

SEQ ID NO: 5533352 - DNA, 12 bp, Homo sapiens
tgtcctgtgatg

SEQ ID NO: 5533353 - DNA, 14 bp, Homo sapiens
tgtcctgtgctttc

SEQ ID NO: 5533354 - DNA, 15 bp, Homo sapiens
tgtcctgtgctttct

SEQ ID NO: 5533355 - DNA, 17 bp, Homo sapiens
tgtcctgtgtcatctgt

SEQ ID NO: 5533356 - DNA, 19 bp, Homo sapiens
tgtcctgtgtcatctgtca

SEQ ID NO: 5533357 - DNA, 16 bp, Homo sapiens
tgtcctgtgtctatgt

SEQ ID NO: 5533358 - DNA, 23 bp, Homo sapiens
tgtcctgttaggccaactgcctc

SEQ ID NO: 5533359 - DNA, 21 bp, Homo sapiens
tgtcttcatttcattgtatga

SEQ ID NO: 5533360 - DNA, 15 bp, Homo sapiens
tgtcttcatttttta

SEQ ID NO: 5533361 - DNA, 20 bp, Homo sapiens
tgtcttcattttttaatgtg

SEQ ID NO: 5533362 - DNA, 22 bp, Homo sapiens
tgtcttcattttttaatgtgct

SEQ ID NO: 5533363 - DNA, 17 bp, Homo sapiens
tgtcttccaaccccagc

SEQ ID NO: 5533364 - DNA, 18 bp, Homo sapiens
tgtcttccaaccccagct

SEQ ID NO: 5533365 - DNA, 21 bp, Homo sapiens
tgtcttccaaccccagctggc

SEQ ID NO: 5533366 - DNA, 14 bp, Homo sapiens
tgtcttccataatg

SEQ ID NO: 5533367 - DNA, 23 bp, Homo sapiens
tgtcttccattaagaacactaaa

SEQ ID NO: 5533368 - DNA, 18 bp, Homo sapiens
tgtcttccattccattgt

SEQ ID NO: 5533369 - DNA, 13 bp, Homo sapiens
tgtcttcccaggg

SEQ ID NO: 5533370 - DNA, 22 bp, Homo sapiens
tgtcttcccagggtagcccgcc

SEQ ID NO: 5533371 - DNA, 13 bp, Homo sapiens
tgtcttcccccct

SEQ ID NO: 5533372 - DNA, 14 bp, Homo sapiens
tgtcttcccccctc

SEQ ID NO: 5533373 - DNA, 15 bp, Homo sapiens
tgtcttcccccctct

SEQ ID NO: 5533374 - DNA, 19 bp, Homo sapiens
tgtcttcccccctctcctc

SEQ ID NO: 5533375 - DNA, 13 bp, Homo sapiens
tgtcttcccctga

SEQ ID NO: 5533376 - DNA, 20 bp, Homo sapiens
tgtcttcccgatgagggaag

SEQ ID NO: 5533377 - DNA, 12 bp, Homo sapiens
tgtcttccctgg

SEQ ID NO: 5533378 - DNA, 16 bp, Homo sapiens
tgtcttccctgggctg

SEQ ID NO: 5533379 - DNA, 13 bp, Homo sapiens
tgtcttcccttct

SEQ ID NO: 5533380 - DNA, 21 bp, Homo sapiens
tgtcttccgatcaacatttat

SEQ ID NO: 5533381 - DNA, 15 bp, Homo sapiens
tgtcttcctagaatt

SEQ ID NO: 5533382 - DNA, 20 bp, Homo sapiens
tgtcttcctagtatattagt

SEQ ID NO: 5533383 - DNA, 22 bp, Homo sapiens
tgtcttcctatcaaaaagatat

SEQ ID NO: 5533384 - DNA, 22 bp, Homo sapiens
tgtcttcctcaaaataaagaag

SEQ ID NO: 5533385 - DNA, 17 bp, Homo sapiens
tgtcttcctctgcaagt

SEQ ID NO: 5533386 - DNA, 13 bp, Homo sapiens
tgtcttcctgcat

SEQ ID NO: 5533387 - DNA, 17 bp, Homo sapiens
tgtcttcctgcattcac

SEQ ID NO: 5533388 - DNA, 18 bp, Homo sapiens
tgtcttcctgcattcacc

SEQ ID NO: 5533389 - DNA, 14 bp, Homo sapiens
tgtcttccttggag

SEQ ID NO: 5533390 - DNA, 15 bp, Homo sapiens
tgtcttccttggcct

SEQ ID NO: 5533391 - DNA, 17 bp, Homo sapiens
tgtcttcgctggctcct

SEQ ID NO: 5533392 - DNA, 21 bp, Homo sapiens
tgtcttcggaaaccttggtgt

SEQ ID NO: 5533393 - DNA, 18 bp, Homo sapiens
tgtcttcgtacagttctt

SEQ ID NO: 5533394 - DNA, 16 bp, Homo sapiens
tgtcttctaactttat

SEQ ID NO: 5533395 - DNA, 16 bp, Homo sapiens
tgtcttctcaggctct

SEQ ID NO: 5533396 - DNA, 10 bp, Homo sapiens
tgtcttctcc

SEQ ID NO: 5533397 - DNA, 15 bp, Homo sapiens
tgtcttctcccagag

SEQ ID NO: 5533398 - DNA, 19 bp, Homo sapiens
tgtcttctcccagagcaca

SEQ ID NO: 5533399 - DNA, 14 bp, Homo sapiens
tgtcttctccccag

SEQ ID NO: 5533400 - DNA, 12 bp, Homo sapiens
tgtcttctccct

SEQ ID NO: 5533401 - DNA, 17 bp, Homo sapiens
tgtcttctccctgcaca

SEQ ID NO: 5533402 - DNA, 12 bp, Homo sapiens
tgtcttctcctt

SEQ ID NO: 5533403 - DNA, 19 bp, Homo sapiens
tgtcttctctatcctctct

SEQ ID NO: 5533404 - DNA, 21 bp, Homo sapiens
tgtcttctctatcctctctct

SEQ ID NO: 5533405 - DNA, 11 bp, Homo sapiens
tgtcttctctc

SEQ ID NO: 5533406 - DNA, 18 bp, Homo sapiens
tgtcttctgcctgttata

SEQ ID NO: 5533407 - DNA, 11 bp, Homo sapiens
tgtcttctgct

SEQ ID NO: 5533408 - DNA, 13 bp, Homo sapiens
tgtcttctgctgt

SEQ ID NO: 5533409 - DNA, 13 bp, Homo sapiens
tgtcttctgcttt

SEQ ID NO: 5533410 - DNA, 15 bp, Homo sapiens
tgtcttctgctttgt

SEQ ID NO: 5533411 - DNA, 11 bp, Homo sapiens
tgtcttctgga

SEQ ID NO: 5533412 - DNA, 12 bp, Homo sapiens
tgtcttctggac

SEQ ID NO: 5533413 - DNA, 16 bp, Homo sapiens
tgtcttctggtctgtg

SEQ ID NO: 5533414 - DNA, 18 bp, Homo sapiens
tgtcttctggtctgtgtg

SEQ ID NO: 5533415 - DNA, 21 bp, Homo sapiens
tgtcttctggtctgtgtgtgt

SEQ ID NO: 5533416 - DNA, 12 bp, Homo sapiens
tgtcttctgtat

SEQ ID NO: 5533417 - DNA, 13 bp, Homo sapiens
tgtcttctttctc

SEQ ID NO: 5533418 - DNA, 15 bp, Homo sapiens
tgtcttctttctcca

SEQ ID NO: 5533419 - DNA, 22 bp, Homo sapiens
tgtcttctttctccatggagcc

SEQ ID NO: 5533420 - DNA, 16 bp, Homo sapiens
tgtcttctttctcctg

SEQ ID NO: 5533421 - DNA, 13 bp, Homo sapiens
tgtcttctttgct

SEQ ID NO: 5533422 - DNA, 16 bp, Homo sapiens
tgtcttctttgctaga

SEQ ID NO: 5533423 - DNA, 14 bp, Homo sapiens
tgtcttcttttgtg

SEQ ID NO: 5533424 - DNA, 21 bp, Homo sapiens
tgtcttcttttgtggtgtctt

SEQ ID NO: 5533425 - DNA, 23 bp, Homo sapiens
tgtcttcttttgtggtgtcttcc

SEQ ID NO: 5533426 - DNA, 23 bp, Homo sapiens
tgtcttgaaacatgttcatctgg

SEQ ID NO: 5533427 - DNA, 14 bp, Homo sapiens
tgtcttgaaacctt

SEQ ID NO: 5533428 - DNA, 20 bp, Homo sapiens
tgtcttgaaacctttctact

SEQ ID NO: 5533429 - DNA, 19 bp, Homo sapiens
tgtcttgaataagagtgat

SEQ ID NO: 5533430 - DNA, 17 bp, Homo sapiens
tgtcttgagagaaaaga

SEQ ID NO: 5533431 - DNA, 20 bp, Homo sapiens
tgtcttgagagaaaagaaaa

SEQ ID NO: 5533432 - DNA, 14 bp, Homo sapiens
tgtcttgagatgta

SEQ ID NO: 5533433 - DNA, 19 bp, Homo sapiens
tgtcttgagctctattatg

SEQ ID NO: 5533434 - DNA, 19 bp, Homo sapiens
tgtcttgcaacttcagttt

SEQ ID NO: 5533435 - DNA, 20 bp, Homo sapiens
tgtcttgcaatggcagcctt

SEQ ID NO: 5533436 - DNA, 22 bp, Homo sapiens
tgtcttgcagtggacggagagc

SEQ ID NO: 5533437 - DNA, 14 bp, Homo sapiens
tgtcttgccagcca

SEQ ID NO: 5533438 - DNA, 16 bp, Homo sapiens
tgtcttgccagccaga

SEQ ID NO: 5533439 - DNA, 17 bp, Homo sapiens
tgtcttgccccagtttg

SEQ ID NO: 5533440 - DNA, 16 bp, Homo sapiens
tgtcttgcctttttca

SEQ ID NO: 5533441 - DNA, 17 bp, Homo sapiens
tgtcttgcctttttcat

SEQ ID NO: 5533442 - DNA, 17 bp, Homo sapiens
tgtcttgctaacaggat

SEQ ID NO: 5533443 - DNA, 23 bp, Homo sapiens
tgtcttgctatggggagaaaaga

SEQ ID NO: 5533444 - DNA, 13 bp, Homo sapiens
tgtcttgctcctg

SEQ ID NO: 5533445 - DNA, 13 bp, Homo sapiens
tgtcttggaacat

SEQ ID NO: 5533446 - DNA, 23 bp, Homo sapiens
tgtcttggaagacttaattctga

SEQ ID NO: 5533447 - DNA, 20 bp, Homo sapiens
tgtcttggaagtctgtctca

SEQ ID NO: 5533448 - DNA, 15 bp, Homo sapiens
tgtcttggacactgt

SEQ ID NO: 5533449 - DNA, 17 bp, Homo sapiens
tgtcttggagtgcattt

SEQ ID NO: 5533450 - DNA, 20 bp, Homo sapiens
tgtcttggagtgcatttgac

SEQ ID NO: 5533451 - DNA, 12 bp, Homo sapiens
tgtcttggcatt

SEQ ID NO: 5533452 - DNA, 14 bp, Homo sapiens
tgtcttggcctccc

SEQ ID NO: 5533453 - DNA, 16 bp, Homo sapiens
tgtcttggcctcccaa

SEQ ID NO: 5533454 - DNA, 17 bp, Homo sapiens
tgtcttggctgtggggc

SEQ ID NO: 5533455 - DNA, 12 bp, Homo sapiens
tgtcttgggcag

SEQ ID NO: 5533456 - DNA, 22 bp, Homo sapiens
tgtcttgggcagagctggctct

SEQ ID NO: 5533457 - DNA, 16 bp, Homo sapiens
tgtcttggttgccagt

SEQ ID NO: 5533458 - DNA, 12 bp, Homo sapiens
tgtcttgtactt

SEQ ID NO: 5533459 - DNA, 15 bp, Homo sapiens
tgtcttgtcaggtgg

SEQ ID NO: 5533460 - DNA, 15 bp, Homo sapiens
tgtcttgtctcactt

SEQ ID NO: 5533461 - DNA, 23 bp, Homo sapiens
tgtcttgtgtatttctctgtgaa

SEQ ID NO: 5533462 - DNA, 16 bp, Homo sapiens
tgtcttgtgtttttgt

SEQ ID NO: 5533463 - DNA, 21 bp, Homo sapiens
tgtcttgtgtttttgtcttat

SEQ ID NO: 5533464 - DNA, 19 bp, Homo sapiens
tgtcttgttaatattcttt

SEQ ID NO: 5533465 - DNA, 20 bp, Homo sapiens
tgtcttgttatgtacaaact

SEQ ID NO: 5533466 - DNA, 18 bp, Homo sapiens
tgtcttgttcattttgag

SEQ ID NO: 5533467 - DNA, 22 bp, Homo sapiens
tgtcttgttcattttgagtatt

SEQ ID NO: 5533468 - DNA, 13 bp, Homo sapiens
tgtcttgttctgt

SEQ ID NO: 5533469 - DNA, 19 bp, Homo sapiens
tgtcttgttctgtcactca

SEQ ID NO: 5533470 - DNA, 15 bp, Homo sapiens
tgtcttgttctgtcc

SEQ ID NO: 5533471 - DNA, 12 bp, Homo sapiens
tgtcttgttctt

SEQ ID NO: 5533472 - DNA, 18 bp, Homo sapiens
tgtctttaaatacttcat

SEQ ID NO: 5533473 - DNA, 15 bp, Homo sapiens
tgtctttaagaacta

SEQ ID NO: 5533474 - DNA, 15 bp, Homo sapiens
tgtctttactcctca

SEQ ID NO: 5533475 - DNA, 22 bp, Homo sapiens
tgtctttagaatcgctttcctt

SEQ ID NO: 5533476 - DNA, 19 bp, Homo sapiens
tgtctttaggcagcagctt

SEQ ID NO: 5533477 - DNA, 16 bp, Homo sapiens
tgtctttatagatgta

SEQ ID NO: 5533478 - DNA, 20 bp, Homo sapiens
tgtctttattagtaacatca

SEQ ID NO: 5533479 - DNA, 13 bp, Homo sapiens
tgtctttattctt

SEQ ID NO: 5533480 - DNA, 12 bp, Homo sapiens
tgtctttcaaaa

SEQ ID NO: 5533481 - DNA, 16 bp, Homo sapiens
tgtctttcaaaaggta

SEQ ID NO: 5533482 - DNA, 15 bp, Homo sapiens
tgtctttcagataca

SEQ ID NO: 5533483 - DNA, 22 bp, Homo sapiens
tgtctttcctaagacctggggt

SEQ ID NO: 5533484 - DNA, 14 bp, Homo sapiens
tgtctttcctccct

SEQ ID NO: 5533485 - DNA, 18 bp, Homo sapiens
tgtctttcggaattttta

SEQ ID NO: 5533486 - DNA, 16 bp, Homo sapiens
tgtctttctaagaaat

SEQ ID NO: 5533487 - DNA, 17 bp, Homo sapiens
tgtctttctaagaaatc

SEQ ID NO: 5533488 - DNA, 13 bp, Homo sapiens
tgtctttctagcc

SEQ ID NO: 5533489 - DNA, 22 bp, Homo sapiens
tgtctttctggaaaggaaacat

SEQ ID NO: 5533490 - DNA, 13 bp, Homo sapiens
tgtctttctttgg

SEQ ID NO: 5533491 - DNA, 14 bp, Homo sapiens
tgtctttctttggt

SEQ ID NO: 5533492 - DNA, 15 bp, Homo sapiens
tgtctttctttggtg

SEQ ID NO: 5533493 - DNA, 12 bp, Homo sapiens
tgtctttgctgt

SEQ ID NO: 5533494 - DNA, 19 bp, Homo sapiens
tgtctttggaccctgaggc

SEQ ID NO: 5533495 - DNA, 22 bp, Homo sapiens
tgtctttggaccctgaggccca

SEQ ID NO: 5533496 - DNA, 23 bp, Homo sapiens
tgtctttggataataggaattca

SEQ ID NO: 5533497 - DNA, 13 bp, Homo sapiens
tgtctttgtccct

SEQ ID NO: 5533498 - DNA, 13 bp, Homo sapiens
tgtctttgtggac

SEQ ID NO: 5533499 - DNA, 19 bp, Homo sapiens
tgtctttgttgtctccctc

SEQ ID NO: 5533500 - DNA, 20 bp, Homo sapiens
tgtcttttaaaatgcaatgt

SEQ ID NO: 5533501 - DNA, 16 bp, Homo sapiens
tgtcttttaaactgga

SEQ ID NO: 5533502 - DNA, 15 bp, Homo sapiens
tgtcttttaataaaa

SEQ ID NO: 5533503 - DNA, 21 bp, Homo sapiens
tgtcttttaataaaaaggaaa

SEQ ID NO: 5533504 - DNA, 22 bp, Homo sapiens
tgtcttttaataaaaaggaaat

SEQ ID NO: 5533505 - DNA, 14 bp, Homo sapiens
tgtcttttaatgat

SEQ ID NO: 5533506 - DNA, 14 bp, Homo sapiens
tgtcttttaatgct

SEQ ID NO: 5533507 - DNA, 13 bp, Homo sapiens
tgtcttttagaca

SEQ ID NO: 5533508 - DNA, 14 bp, Homo sapiens
tgtcttttagacaa

SEQ ID NO: 5533509 - DNA, 15 bp, Homo sapiens
tgtcttttatatttg

SEQ ID NO: 5533510 - DNA, 20 bp, Homo sapiens
tgtcttttatgcagatagaa

SEQ ID NO: 5533511 - DNA, 19 bp, Homo sapiens
tgtcttttatttaacaaaa

SEQ ID NO: 5533512 - DNA, 19 bp, Homo sapiens
tgtcttttcaagtaatttt

SEQ ID NO: 5533513 - DNA, 16 bp, Homo sapiens
tgtcttttcagaagca

SEQ ID NO: 5533514 - DNA, 21 bp, Homo sapiens
tgtcttttcagaagcaagcca

SEQ ID NO: 5533515 - DNA, 20 bp, Homo sapiens
tgtcttttctttgccatctc

SEQ ID NO: 5533516 - DNA, 18 bp, Homo sapiens
tgtcttttgacatccagc

SEQ ID NO: 5533517 - DNA, 14 bp, Homo sapiens
tgtcttttgacatt

SEQ ID NO: 5533518 - DNA, 17 bp, Homo sapiens
tgtcttttgacatttta

SEQ ID NO: 5533519 - DNA, 17 bp, Homo sapiens
tgtcttttgttctctct

SEQ ID NO: 5533520 - DNA, 16 bp, Homo sapiens
tgtctttttcctatga

SEQ ID NO: 5533521 - DNA, 19 bp, Homo sapiens
tgtctttttccttcctgag

SEQ ID NO: 5533522 - DNA, 14 bp, Homo sapiens
tgtctttttcgcca

SEQ ID NO: 5533523 - DNA, 20 bp, Homo sapiens
tgtctttttctggactgaag

SEQ ID NO: 5533524 - DNA, 20 bp, Homo sapiens
tgtctttttgttatgcaaat

SEQ ID NO: 5533525 - DNA, 16 bp, Homo sapiens
tgtcttttttcactac

SEQ ID NO: 5533526 - DNA, 23 bp, Homo sapiens
tgtctttttttgtatagttaaca

SEQ ID NO: 5533527 - DNA, 17 bp, Homo sapiens
tgtcttttttttcatcc

SEQ ID NO: 5533528 - DNA, 17 bp, Homo sapiens
tgtgaaaaaaaaaatgc

SEQ ID NO: 5533529 - DNA, 20 bp, Homo sapiens
tgtgaaaaaaaaaatgctga

SEQ ID NO: 5533530 - DNA, 20 bp, Homo sapiens
tgtgaaaaaaatgaaataaa

SEQ ID NO: 5533531 - DNA, 18 bp, Homo sapiens
tgtgaaaaaagaaaatgg

SEQ ID NO: 5533532 - DNA, 23 bp, Homo sapiens
tgtgaaaaaatttactttaaact

SEQ ID NO: 5533533 - DNA, 22 bp, Homo sapiens
tgtgaaaaagatgccaattatt

SEQ ID NO: 5533534 - DNA, 12 bp, Homo sapiens
tgtgaaaaagga

SEQ ID NO: 5533535 - DNA, 15 bp, Homo sapiens
tgtgaaaaattaact

SEQ ID NO: 5533536 - DNA, 15 bp, Homo sapiens
tgtgaaaagaaaaat

SEQ ID NO: 5533537 - DNA, 23 bp, Homo sapiens
tgtgaaaagcacagctgtatata

SEQ ID NO: 5533538 - DNA, 14 bp, Homo sapiens
tgtgagatactgtg

SEQ ID NO: 5533539 - DNA, 21 bp, Homo sapiens
tgtgagatagttttcatttta

SEQ ID NO: 5533540 - DNA, 16 bp, Homo sapiens
tgtgagatgatttgta

SEQ ID NO: 5533541 - DNA, 22 bp, Homo sapiens
tgtgagatgctagaactccctt

SEQ ID NO: 5533542 - DNA, 14 bp, Homo sapiens
tgtgagatgtaatt

SEQ ID NO: 5533543 - DNA, 21 bp, Homo sapiens
tgtgagattactttgtcccgc

SEQ ID NO: 5533544 - DNA, 18 bp, Homo sapiens
tgtgagattttttattgc

SEQ ID NO: 5533545 - DNA, 20 bp, Homo sapiens
tgtgagcaaaaatgccaggc

SEQ ID NO: 5533546 - DNA, 17 bp, Homo sapiens
tgtgagcaaacagagga

SEQ ID NO: 5533547 - DNA, 19 bp, Homo sapiens
tgtgagcacaaaggtagct

SEQ ID NO: 5533548 - DNA, 14 bp, Homo sapiens
tgtgagcacatgcg

SEQ ID NO: 5533549 - DNA, 20 bp, Homo sapiens
tgtgagcacctttcctgaaa

SEQ ID NO: 5533550 - DNA, 21 bp, Homo sapiens
tgtgagcactatctttcagga

SEQ ID NO: 5533551 - DNA, 14 bp, Homo sapiens
tgtgagcagcctcc

SEQ ID NO: 5533552 - DNA, 14 bp, Homo sapiens
tgtgagcagggctg

SEQ ID NO: 5533553 - DNA, 12 bp, Homo sapiens
tgtgagcagtgg

SEQ ID NO: 5533554 - DNA, 18 bp, Homo sapiens
tgtgagcatcagagggct

SEQ ID NO: 5533555 - DNA, 17 bp, Homo sapiens
tgtgagcatcctgcaag

SEQ ID NO: 5533556 - DNA, 18 bp, Homo sapiens
tgtgagcatccttcccag

SEQ ID NO: 5533557 - DNA, 16 bp, Homo sapiens
tgtgagcatctctgtg

SEQ ID NO: 5533558 - DNA, 18 bp, Homo sapiens
tgtgagcatctctgtgta

SEQ ID NO: 5533559 - DNA, 19 bp, Homo sapiens
tgtgagcatctctgtgtac

SEQ ID NO: 5533560 - DNA, 20 bp, Homo sapiens
tgtgagcatggggccaggaa

SEQ ID NO: 5533561 - DNA, 14 bp, Homo sapiens
tgtgagccacagca

SEQ ID NO: 5533562 - DNA, 14 bp, Homo sapiens
tgtgagccactgca

SEQ ID NO: 5533563 - DNA, 19 bp, Homo sapiens
tgtgagccactgcgcccag

SEQ ID NO: 5533564 - DNA, 20 bp, Homo sapiens
tgtgagccactgtgcccagc

SEQ ID NO: 5533565 - DNA, 14 bp, Homo sapiens
tgtgagccagtcta

SEQ ID NO: 5533566 - DNA, 13 bp, Homo sapiens
tgtgagccccagg

SEQ ID NO: 5533567 - DNA, 15 bp, Homo sapiens
tgtgagccccagggg

SEQ ID NO: 5533568 - DNA, 23 bp, Homo sapiens
tgtgagccccaggggggcctcct

SEQ ID NO: 5533569 - DNA, 14 bp, Homo sapiens
tgtgagcccctggt

SEQ ID NO: 5533570 - DNA, 22 bp, Homo sapiens
tgtgagcccctggtcctgaggg

SEQ ID NO: 5533571 - DNA, 15 bp, Homo sapiens
tgtgagcctctttgt

SEQ ID NO: 5533572 - DNA, 19 bp, Homo sapiens
tgtgagcgagcctggcagg

SEQ ID NO: 5533573 - DNA, 15 bp, Homo sapiens
tgtgagcgccttggt

SEQ ID NO: 5533574 - DNA, 16 bp, Homo sapiens
tgtgagcgccttggta

SEQ ID NO: 5533575 - DNA, 15 bp, Homo sapiens
tgtgagcgtggcctt

SEQ ID NO: 5533576 - DNA, 17 bp, Homo sapiens
tgtgagcgtggccttgg

SEQ ID NO: 5533577 - DNA, 18 bp, Homo sapiens
tgtgagcgtggccttggg

SEQ ID NO: 5533578 - DNA, 22 bp, Homo sapiens
tgtgagcgtggccttgggagga

SEQ ID NO: 5533579 - DNA, 22 bp, Homo sapiens
tgtgagctaggagaagggctga

SEQ ID NO: 5533580 - DNA, 19 bp, Homo sapiens
tgtgagctcccaggtgcag

SEQ ID NO: 5533581 - DNA, 14 bp, Homo sapiens
tgtgagctctggtt

SEQ ID NO: 5533582 - DNA, 17 bp, Homo sapiens
tgtgagctcttccctta

SEQ ID NO: 5533583 - DNA, 15 bp, Homo sapiens
tgtgagctgcaccag

SEQ ID NO: 5533584 - DNA, 20 bp, Homo sapiens
tgtgagctgcaccaggtaga

SEQ ID NO: 5533585 - DNA, 11 bp, Homo sapiens
tgtgagctgga

SEQ ID NO: 5533586 - DNA, 16 bp, Homo sapiens
tgtgagctttgaagta

SEQ ID NO: 5533587 - DNA, 14 bp, Homo sapiens
tgtgagctttttgt

SEQ ID NO: 5533588 - DNA, 23 bp, Homo sapiens
tgtgaggaaagtcattggcttta

SEQ ID NO: 5533589 - DNA, 23 bp, Homo sapiens
tgtgaggaactcacatactgact

SEQ ID NO: 5533590 - DNA, 17 bp, Homo sapiens
tgtgaggaagaggttgc

SEQ ID NO: 5533591 - DNA, 11 bp, Homo sapiens
tgtgaggaagc

SEQ ID NO: 5533592 - DNA, 18 bp, Homo sapiens
tgtgaggaagccgctggg

SEQ ID NO: 5533593 - DNA, 20 bp, Homo sapiens
tgtgaggaagccgctggggc

SEQ ID NO: 5533594 - DNA, 19 bp, Homo sapiens
tgtgaggaagtgtggaaaa

SEQ ID NO: 5533595 - DNA, 15 bp, Homo sapiens
tgtgaggacagggcc

SEQ ID NO: 5533596 - DNA, 22 bp, Homo sapiens
tgtgaggacagggcccccacag

SEQ ID NO: 5533597 - DNA, 18 bp, Homo sapiens
tgtgaggagagaggagga

SEQ ID NO: 5533598 - DNA, 13 bp, Homo sapiens
tgtgaggagctgc

SEQ ID NO: 5533599 - DNA, 17 bp, Homo sapiens
tgtgaggagctgctggc

SEQ ID NO: 5533600 - DNA, 14 bp, Homo sapiens
tgtgaggaggaaaa

SEQ ID NO: 5533601 - DNA, 17 bp, Homo sapiens
tgtgaggaggaaaagga

SEQ ID NO: 5533602 - DNA, 20 bp, Homo sapiens
tgtgaggatagagacttgca

SEQ ID NO: 5533603 - DNA, 12 bp, Homo sapiens
tgtgaggcagga

SEQ ID NO: 5533604 - DNA, 13 bp, Homo sapiens
tgtgaggcagggg

SEQ ID NO: 5533605 - DNA, 13 bp, Homo sapiens
tgtgaggccacac

SEQ ID NO: 5533606 - DNA, 17 bp, Homo sapiens
tgtgaggccagggcaga

SEQ ID NO: 5533607 - DNA, 13 bp, Homo sapiens
tgtgaggcccctg

SEQ ID NO: 5533608 - DNA, 18 bp, Homo sapiens
tgtgaggcctggccaggc

SEQ ID NO: 5533609 - DNA, 17 bp, Homo sapiens
tgtgaggcggcagctgg

SEQ ID NO: 5533610 - DNA, 14 bp, Homo sapiens
tgtgaggctgggcc

SEQ ID NO: 5533611 - DNA, 17 bp, Homo sapiens
tgtgaggctgggccagc

SEQ ID NO: 5533612 - DNA, 19 bp, Homo sapiens
tgtgaggctgggccagcct

SEQ ID NO: 5533613 - DNA, 15 bp, Homo sapiens
tgtgaggctgtgtct

SEQ ID NO: 5533614 - DNA, 18 bp, Homo sapiens
tgtgaggcttgcccagga

SEQ ID NO: 5533615 - DNA, 22 bp, Homo sapiens
tgtgagggaaagagctttccta

SEQ ID NO: 5533616 - DNA, 21 bp, Homo sapiens
tgtgagggaataaacctggca

SEQ ID NO: 5533617 - DNA, 17 bp, Homo sapiens
tgtgagggacatgctca

SEQ ID NO: 5533618 - DNA, 13 bp, Homo sapiens
tgtgagggagaga

SEQ ID NO: 5533619 - DNA, 22 bp, Homo sapiens
tgtgagggcaaaccaggctgca

SEQ ID NO: 5533620 - DNA, 14 bp, Homo sapiens
tgtgagggcagcac

SEQ ID NO: 5533621 - DNA, 12 bp, Homo sapiens
tgtgagggcagt

SEQ ID NO: 5533622 - DNA, 23 bp, Homo sapiens
tgtgagggccaccggtgggcagt

SEQ ID NO: 5533623 - DNA, 15 bp, Homo sapiens
tgtgaggggaatctg

SEQ ID NO: 5533624 - DNA, 15 bp, Homo sapiens
tgtgaggggcccctg

SEQ ID NO: 5533625 - DNA, 20 bp, Homo sapiens
tgtgaggggcccctggccca

SEQ ID NO: 5533626 - DNA, 22 bp, Homo sapiens
tgtgaggggtttcttttggaaa

SEQ ID NO: 5533627 - DNA, 14 bp, Homo sapiens
tgtgagggtgcagg

SEQ ID NO: 5533628 - DNA, 17 bp, Homo sapiens
tgtgagggtttgtaatg

SEQ ID NO: 5533629 - DNA, 21 bp, Homo sapiens
tgtgaggtgcagagtgcccag

SEQ ID NO: 5533630 - DNA, 21 bp, Homo sapiens
tgtgaggtttcccaatggtgt

SEQ ID NO: 5533631 - DNA, 22 bp, Homo sapiens
tgtgaggtttcccaatggtgtt

SEQ ID NO: 5533632 - DNA, 19 bp, Homo sapiens
tgtgagtagagcatgactt

SEQ ID NO: 5533633 - DNA, 17 bp, Homo sapiens
tgtgagtatgtgtggtt

SEQ ID NO: 5533634 - DNA, 17 bp, Homo sapiens
tgtgagtattctatgta

SEQ ID NO: 5533635 - DNA, 13 bp, Homo sapiens
tgtgagtattctc

SEQ ID NO: 5533636 - DNA, 16 bp, Homo sapiens
tgtgagtatttctgtt

SEQ ID NO: 5533637 - DNA, 15 bp, Homo sapiens
tgtgagtcaccaagc

SEQ ID NO: 5533638 - DNA, 21 bp, Homo sapiens
tgtgagtcaccaagcccagtt

SEQ ID NO: 5533639 - DNA, 15 bp, Homo sapiens
tgtgagtcacttcta

SEQ ID NO: 5533640 - DNA, 16 bp, Homo sapiens
tgtgagtcattatgta

SEQ ID NO: 5533641 - DNA, 17 bp, Homo sapiens
tgtgagtcccagagccc

SEQ ID NO: 5533642 - DNA, 15 bp, Homo sapiens
tgtgagtccctgtga

SEQ ID NO: 5533643 - DNA, 23 bp, Homo sapiens
tgtgagtctccccttgcagcctg

SEQ ID NO: 5533644 - DNA, 15 bp, Homo sapiens
tgtgagtctgggata

SEQ ID NO: 5533645 - DNA, 14 bp, Homo sapiens
tgtgagtctgtcct

SEQ ID NO: 5533646 - DNA, 20 bp, Homo sapiens
tgtgagtctgtcctttccca

SEQ ID NO: 5533647 - DNA, 20 bp, Homo sapiens
tgtgagtctttggttctaag

SEQ ID NO: 5533648 - DNA, 22 bp, Homo sapiens
tgtgagtctttggttctaagga

SEQ ID NO: 5533649 - DNA, 17 bp, Homo sapiens
tgtgagtgaaagtactt

SEQ ID NO: 5533650 - DNA, 15 bp, Homo sapiens
tgtgagtgaaagttg

SEQ ID NO: 5533651 - DNA, 16 bp, Homo sapiens
tgtgagtgagactgag

SEQ ID NO: 5533652 - DNA, 19 bp, Homo sapiens
tgtgagtgagggagacagg

SEQ ID NO: 5533653 - DNA, 16 bp, Homo sapiens
tgtgagtgccttttgc

SEQ ID NO: 5533654 - DNA, 17 bp, Homo sapiens
tgtgagtgcgtctgagg

SEQ ID NO: 5533655 - DNA, 18 bp, Homo sapiens
tgtgagtgcgtgtgtgtg

SEQ ID NO: 5533656 - DNA, 17 bp, Homo sapiens
tgtgagtggataatcag

SEQ ID NO: 5533657 - DNA, 14 bp, Homo sapiens
tgtgagtggcagcc

SEQ ID NO: 5533658 - DNA, 15 bp, Homo sapiens
tgtgagtggcagcca

SEQ ID NO: 5533659 - DNA, 16 bp, Homo sapiens
tgtgagtggcagccat

SEQ ID NO: 5533660 - DNA, 18 bp, Homo sapiens
tgtgagtggcagccatgc

SEQ ID NO: 5533661 - DNA, 22 bp, Homo sapiens
tgtgagtgggaggagagggcag

SEQ ID NO: 5533662 - DNA, 23 bp, Homo sapiens
tgtgagtgggaggagagggcaga

SEQ ID NO: 5533663 - DNA, 16 bp, Homo sapiens
tgtgagtgtaagtgtg

SEQ ID NO: 5533664 - DNA, 18 bp, Homo sapiens
tgtgagtgtatgtataca

SEQ ID NO: 5533665 - DNA, 21 bp, Homo sapiens
tgtgagtgtatgtatacacac

SEQ ID NO: 5533666 - DNA, 11 bp, Homo sapiens
tgtgagtgtga

SEQ ID NO: 5533667 - DNA, 13 bp, Homo sapiens
tgtgagtgtgaca

SEQ ID NO: 5533668 - DNA, 18 bp, Homo sapiens
tgtgagtgtgacagggcc

SEQ ID NO: 5533669 - DNA, 18 bp, Homo sapiens
tgtgagtgtgagagatgg

SEQ ID NO: 5533670 - DNA, 19 bp, Homo sapiens
tgtgagtgtgagtgtgaga

SEQ ID NO: 5533671 - DNA, 14 bp, Homo sapiens
tgtgagtgtgtgca

SEQ ID NO: 5533672 - DNA, 15 bp, Homo sapiens
tgtgagtgtgtgtgc

SEQ ID NO: 5533673 - DNA, 17 bp, Homo sapiens
tgtgagtgtttggggga

SEQ ID NO: 5533674 - DNA, 16 bp, Homo sapiens
tgtgagttctccctgt

SEQ ID NO: 5533675 - DNA, 22 bp, Homo sapiens
tgtgagttgagccttcaggcca

SEQ ID NO: 5533676 - DNA, 19 bp, Homo sapiens
tgtgagtttaccttgtata

SEQ ID NO: 5533677 - DNA, 22 bp, Homo sapiens
tgtgagtttaccttgtatactg

SEQ ID NO: 5533678 - DNA, 23 bp, Homo sapiens
tgtgagtttaccttgtatactgt

SEQ ID NO: 5533679 - DNA, 21 bp, Homo sapiens
tgtgagtttagtaaggctgtg

SEQ ID NO: 5533680 - DNA, 19 bp, Homo sapiens
tgtgagtttgtttctttga

SEQ ID NO: 5533681 - DNA, 18 bp, Homo sapiens
tgtgataaaatgttgaac

SEQ ID NO: 5533682 - DNA, 16 bp, Homo sapiens
tgtgataaatcagtca

SEQ ID NO: 5533683 - DNA, 23 bp, Homo sapiens
tgtgataacaaagagtcttggtt

SEQ ID NO: 5533684 - DNA, 16 bp, Homo sapiens
tgtgataactctgcaa

SEQ ID NO: 5533685 - DNA, 18 bp, Homo sapiens
tgtgataaggatcagaac

SEQ ID NO: 5533686 - DNA, 17 bp, Homo sapiens
tgtgataatagcatttt

SEQ ID NO: 5533687 - DNA, 21 bp, Homo sapiens
tgtgatacactgaatggaaat

SEQ ID NO: 5533688 - DNA, 17 bp, Homo sapiens
tgtgatacatttctgaa

SEQ ID NO: 5533689 - DNA, 21 bp, Homo sapiens
tgtgatacattttttaagctt

SEQ ID NO: 5533690 - DNA, 22 bp, Homo sapiens
tgtgatacattttttaagcttc

SEQ ID NO: 5533691 - DNA, 19 bp, Homo sapiens
tgtgatactattaccacca

SEQ ID NO: 5533692 - DNA, 14 bp, Homo sapiens
tgtgatagcacttt

SEQ ID NO: 5533693 - DNA, 15 bp, Homo sapiens
tgtgatagcactttc

SEQ ID NO: 5533694 - DNA, 16 bp, Homo sapiens
tgtgatataaaatatt

SEQ ID NO: 5533695 - DNA, 14 bp, Homo sapiens
tgtgatatataagt

SEQ ID NO: 5533696 - DNA, 15 bp, Homo sapiens
tgtgatatataagtg

SEQ ID NO: 5533697 - DNA, 13 bp, Homo sapiens
tgtgatatctgaa

SEQ ID NO: 5533698 - DNA, 17 bp, Homo sapiens
tgtgatatgtctgctga

SEQ ID NO: 5533699 - DNA, 14 bp, Homo sapiens
tgtgatatgtgtaa

SEQ ID NO: 5533700 - DNA, 15 bp, Homo sapiens
tgtgatatgtgtaat

SEQ ID NO: 5533701 - DNA, 13 bp, Homo sapiens
tgtgatatgtttt

SEQ ID NO: 5533702 - DNA, 20 bp, Homo sapiens
tgtgatatgttttaaagtta

SEQ ID NO: 5533703 - DNA, 15 bp, Homo sapiens
tgtgatattcccctt

SEQ ID NO: 5533704 - DNA, 16 bp, Homo sapiens
tgtgatattctgttgc

SEQ ID NO: 5533705 - DNA, 19 bp, Homo sapiens
tgtgatattgaccatgtga

SEQ ID NO: 5533706 - DNA, 22 bp, Homo sapiens
tgtgatatttcagaaatacaga

SEQ ID NO: 5533707 - DNA, 12 bp, Homo sapiens
tgtgatcaactg

SEQ ID NO: 5533708 - DNA, 18 bp, Homo sapiens
tgtgatcacgcctggcta

SEQ ID NO: 5533709 - DNA, 18 bp, Homo sapiens
tgtgatcaggccccaccc

SEQ ID NO: 5533710 - DNA, 19 bp, Homo sapiens
tgtgatcaggccccacccc

SEQ ID NO: 5533711 - DNA, 20 bp, Homo sapiens
tgtgatcaggctatgtatgg

SEQ ID NO: 5533712 - DNA, 19 bp, Homo sapiens
tgtgatcatagctcactgt

SEQ ID NO: 5533713 - DNA, 17 bp, Homo sapiens
tgtgatcatatatcata

SEQ ID NO: 5533714 - DNA, 17 bp, Homo sapiens
tgtgatccaggaaagat

SEQ ID NO: 5533715 - DNA, 15 bp, Homo sapiens
tgtgatcccagctca

SEQ ID NO: 5533716 - DNA, 17 bp, Homo sapiens
tgtgctactaacagatt

SEQ ID NO: 5533717 - DNA, 14 bp, Homo sapiens
tgtgctactttgcc

SEQ ID NO: 5533718 - DNA, 18 bp, Homo sapiens
tgtgctagagttaaaagt

SEQ ID NO: 5533719 - DNA, 20 bp, Homo sapiens
tgtgctagagttaaaagtta

SEQ ID NO: 5533720 - DNA, 19 bp, Homo sapiens
tgtgctagtaattggaaag

SEQ ID NO: 5533721 - DNA, 18 bp, Homo sapiens
tgtgctagtcactggcag

SEQ ID NO: 5533722 - DNA, 19 bp, Homo sapiens
tgtgctagtcactggcagc

SEQ ID NO: 5533723 - DNA, 18 bp, Homo sapiens
tgtgctatacacacacac

SEQ ID NO: 5533724 - DNA, 21 bp, Homo sapiens
tgtgctatactgcatactttt

SEQ ID NO: 5533725 - DNA, 17 bp, Homo sapiens
tgtgctatagtatttga

SEQ ID NO: 5533726 - DNA, 22 bp, Homo sapiens
tgtgctatataaatatgtcaga

SEQ ID NO: 5533727 - DNA, 22 bp, Homo sapiens
tgtgctatgaaacaatcttcca

SEQ ID NO: 5533728 - DNA, 14 bp, Homo sapiens
tgtgctatgcaaaa

SEQ ID NO: 5533729 - DNA, 18 bp, Homo sapiens
tgtgctatggtgctctgt

SEQ ID NO: 5533730 - DNA, 15 bp, Homo sapiens
tgtgctattgaactg

SEQ ID NO: 5533731 - DNA, 16 bp, Homo sapiens
tgtgctattgaactga

SEQ ID NO: 5533732 - DNA, 17 bp, Homo sapiens
tgtgctatttgtacaaa

SEQ ID NO: 5533733 - DNA, 21 bp, Homo sapiens
tgtgctatttgtacaaataaa

SEQ ID NO: 5533734 - DNA, 20 bp, Homo sapiens
tgtgctcaaaatttgaagaa

SEQ ID NO: 5533735 - DNA, 20 bp, Homo sapiens
tgtgctcaccctctcttggt

SEQ ID NO: 5533736 - DNA, 21 bp, Homo sapiens
tgtgctcacgctcccccgcag

SEQ ID NO: 5533737 - DNA, 17 bp, Homo sapiens
tgtgctcagcagcccca

SEQ ID NO: 5533738 - DNA, 15 bp, Homo sapiens
tgtgctcaggagccc

SEQ ID NO: 5533739 - DNA, 18 bp, Homo sapiens
tgtgctcagtcgccctgt

SEQ ID NO: 5533740 - DNA, 16 bp, Homo sapiens
tgtgctcatgtttgga

SEQ ID NO: 5533741 - DNA, 21 bp, Homo sapiens
tgtgctcatgtttggaaagct

SEQ ID NO: 5533742 - DNA, 12 bp, Homo sapiens
tgtgctcatttt

SEQ ID NO: 5533743 - DNA, 19 bp, Homo sapiens
tgtgctcattttgcaattt

SEQ ID NO: 5533744 - DNA, 18 bp, Homo sapiens
tgtgctccaaatgtctac

SEQ ID NO: 5533745 - DNA, 19 bp, Homo sapiens
tgtgctccagcagtgctgg

SEQ ID NO: 5533746 - DNA, 19 bp, Homo sapiens
tgtgctccaggcttcctgc

SEQ ID NO: 5533747 - DNA, 21 bp, Homo sapiens
tgtgctccaggcttcctgccc

SEQ ID NO: 5533748 - DNA, 23 bp, Homo sapiens
tgtgctccaggcttcctgcccta

SEQ ID NO: 5533749 - DNA, 21 bp, Homo sapiens
tgtgctccagtgttttcttgt

SEQ ID NO: 5533750 - DNA, 22 bp, Homo sapiens
tgtgctccagtgttttcttgtg

SEQ ID NO: 5533751 - DNA, 11 bp, Homo sapiens
tgtgctcccac

SEQ ID NO: 5533752 - DNA, 17 bp, Homo sapiens
tgtgctcccaccaggca

SEQ ID NO: 5533753 - DNA, 13 bp, Homo sapiens
tgtgctcccacgg

SEQ ID NO: 5533754 - DNA, 20 bp, Homo sapiens
tgtgctcccctgccacactg

SEQ ID NO: 5533755 - DNA, 21 bp, Homo sapiens
tgtgctccctggttctgatga

SEQ ID NO: 5533756 - DNA, 15 bp, Homo sapiens
tgtgctccgtagctt

SEQ ID NO: 5533757 - DNA, 14 bp, Homo sapiens
tgtgctccgtgcct

SEQ ID NO: 5533758 - DNA, 23 bp, Homo sapiens
tgtgctcctcttgattcctggtt

SEQ ID NO: 5533759 - DNA, 12 bp, Homo sapiens
tgtgctcctgcc

SEQ ID NO: 5533760 - DNA, 23 bp, Homo sapiens
tgtgctcgggatcaaacctttct

SEQ ID NO: 5533761 - DNA, 23 bp, Homo sapiens
tgtgctctacatctcgtatggat

SEQ ID NO: 5533762 - DNA, 17 bp, Homo sapiens
tgtgctctccccggcag

SEQ ID NO: 5533763 - DNA, 17 bp, Homo sapiens
tgtgctctcctagagct

SEQ ID NO: 5533764 - DNA, 23 bp, Homo sapiens
tgtgctctcctagagctctgtct

SEQ ID NO: 5533765 - DNA, 13 bp, Homo sapiens
tgtgctctcggct

SEQ ID NO: 5533766 - DNA, 20 bp, Homo sapiens
tgtgctctcggcttcaccag

SEQ ID NO: 5533767 - DNA, 23 bp, Homo sapiens
tgtgctctgatcatccactgtgc

SEQ ID NO: 5533768 - DNA, 15 bp, Homo sapiens
tgtgctctggacagg

SEQ ID NO: 5533769 - DNA, 13 bp, Homo sapiens
tgtgctctggagg

SEQ ID NO: 5533770 - DNA, 16 bp, Homo sapiens
tgtgctctggaggctg

SEQ ID NO: 5533771 - DNA, 19 bp, Homo sapiens
tgtgctcttatccccagct

SEQ ID NO: 5533772 - DNA, 16 bp, Homo sapiens
tgtgctcttcctctgg

SEQ ID NO: 5533773 - DNA, 18 bp, Homo sapiens
tgtgctcttcctctggtt

SEQ ID NO: 5533774 - DNA, 20 bp, Homo sapiens
tgtgctcttcctctggtttc

SEQ ID NO: 5533775 - DNA, 19 bp, Homo sapiens
tgtgctgaacataacttct

SEQ ID NO: 5533776 - DNA, 21 bp, Homo sapiens
tgtgctgaacataacttctca

SEQ ID NO: 5533777 - DNA, 13 bp, Homo sapiens
tgtgctgaagaca

SEQ ID NO: 5533778 - DNA, 15 bp, Homo sapiens
tgtgctgaagacatg

SEQ ID NO: 5533779 - DNA, 13 bp, Homo sapiens
tgtgctgaatgtg

SEQ ID NO: 5533780 - DNA, 19 bp, Homo sapiens
tgtgctgacaacttagctc

SEQ ID NO: 5533781 - DNA, 21 bp, Homo sapiens
tgtgctgacaacttagctcag

SEQ ID NO: 5533782 - DNA, 23 bp, Homo sapiens
tgtgctgacaacttagctcaggt

SEQ ID NO: 5533783 - DNA, 14 bp, Homo sapiens
tgtgctgaccctcc

SEQ ID NO: 5533784 - DNA, 17 bp, Homo sapiens
tgtgctgaccctcctgt

SEQ ID NO: 5533785 - DNA, 21 bp, Homo sapiens
tgtgctgacggaagccaactt

SEQ ID NO: 5533786 - DNA, 17 bp, Homo sapiens
tgtgctgaggactccct

SEQ ID NO: 5533787 - DNA, 11 bp, Homo sapiens
tgtgctgaggt

SEQ ID NO: 5533788 - DNA, 20 bp, Homo sapiens
tgtgctgatcctgctgacct

SEQ ID NO: 5533789 - DNA, 22 bp, Homo sapiens
tgtgctgcatgcgacagcgtcc

SEQ ID NO: 5533790 - DNA, 12 bp, Homo sapiens
tgtgctgccctg

SEQ ID NO: 5533791 - DNA, 14 bp, Homo sapiens
tgtgctgccctgcc

SEQ ID NO: 5533792 - DNA, 18 bp, Homo sapiens
tgtgctgccctgcccacc

SEQ ID NO: 5533793 - DNA, 19 bp, Homo sapiens
tgtgctgccctgcccacct

SEQ ID NO: 5533794 - DNA, 19 bp, Homo sapiens
tgtgctgcggtcactcagg

SEQ ID NO: 5533795 - DNA, 23 bp, Homo sapiens
tgtgctgcggtcactcaggcctc

SEQ ID NO: 5533796 - DNA, 14 bp, Homo sapiens
tgtgctgctgctgc

SEQ ID NO: 5533797 - DNA, 15 bp, Homo sapiens
tgtgctgctgctgct

SEQ ID NO: 5533798 - DNA, 15 bp, Homo sapiens
tgtgctgctgggaat

SEQ ID NO: 5533799 - DNA, 18 bp, Homo sapiens
tgtgctgctgggaatgga

SEQ ID NO: 5533800 - DNA, 17 bp, Homo sapiens
tgtgctgctgtaagaaa

SEQ ID NO: 5533801 - DNA, 15 bp, Homo sapiens
tgtgctgctgtggca

SEQ ID NO: 5533802 - DNA, 16 bp, Homo sapiens
tgtgctgctgttctgt

SEQ ID NO: 5533803 - DNA, 18 bp, Homo sapiens
tgtgctgctttgatatat

SEQ ID NO: 5533804 - DNA, 23 bp, Homo sapiens
tgtgctggactttaaaaaaacaa

SEQ ID NO: 5533805 - DNA, 13 bp, Homo sapiens
tgtgctggagcca

SEQ ID NO: 5533806 - DNA, 15 bp, Homo sapiens
tgtgctggagccact

SEQ ID NO: 5533807 - DNA, 20 bp, Homo sapiens
tgtgctggagccactaacta

SEQ ID NO: 5533808 - DNA, 16 bp, Homo sapiens
tgtgctggagctggct

SEQ ID NO: 5533809 - DNA, 17 bp, Homo sapiens
tgtgctggagctggctt

SEQ ID NO: 5533810 - DNA, 14 bp, Homo sapiens
tgtgctggaggggt

SEQ ID NO: 5533811 - DNA, 15 bp, Homo sapiens
tgtgctggaggggtg

SEQ ID NO: 5533812 - DNA, 20 bp, Homo sapiens
tgtgctggaggggtggccca

SEQ ID NO: 5533813 - DNA, 19 bp, Homo sapiens
tgtgctgggaaatgcagaa

SEQ ID NO: 5533814 - DNA, 18 bp, Homo sapiens
tgtgctgggaagcccgga

SEQ ID NO: 5533815 - DNA, 21 bp, Homo sapiens
tgtgctgggaagcccggactg

SEQ ID NO: 5533816 - DNA, 19 bp, Homo sapiens
tgtgctgggagcaggactg

SEQ ID NO: 5533817 - DNA, 17 bp, Homo sapiens
tgtgctgggagctccac

SEQ ID NO: 5533818 - DNA, 18 bp, Homo sapiens
tgtgctgggaggtcccag

SEQ ID NO: 5533819 - DNA, 21 bp, Homo sapiens
tgtgctgggccagtggctggg

SEQ ID NO: 5533820 - DNA, 11 bp, Homo sapiens
tgtgctggggg

SEQ ID NO: 5533821 - DNA, 16 bp, Homo sapiens
tgtgctgggggaatga

SEQ ID NO: 5533822 - DNA, 23 bp, Homo sapiens
tgtgctgggggaatgagcccaga

SEQ ID NO: 5533823 - DNA, 18 bp, Homo sapiens
tgtgctggggttatctga

SEQ ID NO: 5533824 - DNA, 17 bp, Homo sapiens
tgtgctgggtcccagcc

SEQ ID NO: 5533825 - DNA, 18 bp, Homo sapiens
tgtgctgggtcccagcct

SEQ ID NO: 5533826 - DNA, 20 bp, Homo sapiens
tgtgctgggtcccagcctgg

SEQ ID NO: 5533827 - DNA, 14 bp, Homo sapiens
tgtgctggtaaatg

SEQ ID NO: 5533828 - DNA, 22 bp, Homo sapiens
tgtgctggtctctaggcctgaa

SEQ ID NO: 5533829 - DNA, 16 bp, Homo sapiens
tgtgctggtgaacact

SEQ ID NO: 5533830 - DNA, 23 bp, Homo sapiens
tgtgctggtgtcctgaccaccct

SEQ ID NO: 5533831 - DNA, 17 bp, Homo sapiens
tgtgctgtgcccaagtt

SEQ ID NO: 5533832 - DNA, 15 bp, Homo sapiens
tgtgctgtgcctgct

SEQ ID NO: 5533833 - DNA, 19 bp, Homo sapiens
tgtgctgtgctatggtgct

SEQ ID NO: 5533834 - DNA, 16 bp, Homo sapiens
tgtgctgtggaagcaa

SEQ ID NO: 5533835 - DNA, 13 bp, Homo sapiens
tgtgctgtggcat

SEQ ID NO: 5533836 - DNA, 18 bp, Homo sapiens
tgtgctgtggccaggcct

SEQ ID NO: 5533837 - DNA, 19 bp, Homo sapiens
tgtgctgtggccaggcctg

SEQ ID NO: 5533838 - DNA, 22 bp, Homo sapiens
tgtgctgtgggcagcaccctcc

SEQ ID NO: 5533839 - DNA, 17 bp, Homo sapiens
tgtgctgtggttcctgg

SEQ ID NO: 5533840 - DNA, 12 bp, Homo sapiens
tgtgctgtgtaa

SEQ ID NO: 5533841 - DNA, 23 bp, Homo sapiens
tgtgctgtgtaaagttagtctac

SEQ ID NO: 5533842 - DNA, 21 bp, Homo sapiens
tgtgctgtgtttgctcccctt

SEQ ID NO: 5533843 - DNA, 22 bp, Homo sapiens
tgtgctgttagaatatgttgat

SEQ ID NO: 5533844 - DNA, 23 bp, Homo sapiens
tgtgctgttgttatgatgtgctt

SEQ ID NO: 5533845 - DNA, 15 bp, Homo sapiens
tgtgctgtttcaaag

SEQ ID NO: 5533846 - DNA, 15 bp, Homo sapiens
tgtgctgttttctgt

SEQ ID NO: 5533847 - DNA, 15 bp, Homo sapiens
tgtgcttaataatac

SEQ ID NO: 5533848 - DNA, 15 bp, Homo sapiens
tgtgcttacagtgac

SEQ ID NO: 5533849 - DNA, 16 bp, Homo sapiens
tgtgcttacagtgact

SEQ ID NO: 5533850 - DNA, 19 bp, Homo sapiens
tgtgcttatggtaccagat

SEQ ID NO: 5533851 - DNA, 13 bp, Homo sapiens
tgtgcttattttt

SEQ ID NO: 5533852 - DNA, 23 bp, Homo sapiens
tgtgcttcaaatgatccttccta

SEQ ID NO: 5533853 - DNA, 23 bp, Homo sapiens
tgtgcttcacagtagagccagct

SEQ ID NO: 5533854 - DNA, 18 bp, Homo sapiens
tgtgcttcatctgtggga

SEQ ID NO: 5533855 - DNA, 16 bp, Homo sapiens
tgtgcttctaatatta

SEQ ID NO: 5533856 - DNA, 23 bp, Homo sapiens
tgtgcttctaatatttattgctt

SEQ ID NO: 5533857 - DNA, 12 bp, Homo sapiens
tgtgcttctccc

SEQ ID NO: 5533858 - DNA, 16 bp, Homo sapiens
tgtgcttctccccaga

SEQ ID NO: 5533859 - DNA, 18 bp, Homo sapiens
tgtgcttctccccagaat

SEQ ID NO: 5533860 - DNA, 24 bp, Homo sapiens
tgtgcttctcttctttattgcact

SEQ ID NO: 5533861 - DNA, 13 bp, Homo sapiens
tgtgcttctgctc

SEQ ID NO: 5533862 - DNA, 16 bp, Homo sapiens
tgtgcttgaagattca

SEQ ID NO: 5533863 - DNA, 19 bp, Homo sapiens
tgtgcttgagccaggaggc

SEQ ID NO: 5533864 - DNA, 21 bp, Homo sapiens
tgtgcttgcttagagtgccca

SEQ ID NO: 5533865 - DNA, 16 bp, Homo sapiens
tgtgcttggaaccagt

SEQ ID NO: 5533866 - DNA, 15 bp, Homo sapiens
tgtgcttggaggcct

SEQ ID NO: 5533867 - DNA, 18 bp, Homo sapiens
tgtgcttgtcattccaga

SEQ ID NO: 5533868 - DNA, 14 bp, Homo sapiens
tgtgcttgtttaca

SEQ ID NO: 5533869 - DNA, 14 bp, Homo sapiens
tgtgcttgttttat

SEQ ID NO: 5533870 - DNA, 16 bp, Homo sapiens
tgtgctttataaaaaa

SEQ ID NO: 5533871 - DNA, 19 bp, Homo sapiens
tgtgctttattgaattaga

SEQ ID NO: 5533872 - DNA, 22 bp, Homo sapiens
tgtgctttattgaattagaaaa

SEQ ID NO: 5533873 - DNA, 12 bp, Homo sapiens
tgtgctttcatg

SEQ ID NO: 5533874 - DNA, 16 bp, Homo sapiens
tgtgctttccagctca

SEQ ID NO: 5533875 - DNA, 20 bp, Homo sapiens
tgtgctttccagctcacccc

SEQ ID NO: 5533876 - DNA, 16 bp, Homo sapiens
tgtgctttccctgaac

SEQ ID NO: 5533877 - DNA, 13 bp, Homo sapiens
tgtgctttcctga

SEQ ID NO: 5533878 - DNA, 22 bp, Homo sapiens
tgtgctttctatctaattttta

SEQ ID NO: 5533879 - DNA, 15 bp, Homo sapiens
tgtgctttctattgt

SEQ ID NO: 5533880 - DNA, 13 bp, Homo sapiens
tgtgctttctgca

SEQ ID NO: 5533881 - DNA, 19 bp, Homo sapiens
tgtgctttctgcatgctta

SEQ ID NO: 5533882 - DNA, 20 bp, Homo sapiens
tgtgctttctttagaaacac

SEQ ID NO: 5533883 - DNA, 23 bp, Homo sapiens
tgtgctttgagatttttttttct

SEQ ID NO: 5533884 - DNA, 17 bp, Homo sapiens
tgtgctttgcattttct

SEQ ID NO: 5533885 - DNA, 17 bp, Homo sapiens
tgtgctttgctcttgtc

SEQ ID NO: 5533886 - DNA, 22 bp, Homo sapiens
tgtgctttgctcttgtcccacg

SEQ ID NO: 5533887 - DNA, 21 bp, Homo sapiens
tgtgctttggaacaatcacag

SEQ ID NO: 5533888 - DNA, 14 bp, Homo sapiens
tgtgctttggttaa

SEQ ID NO: 5533889 - DNA, 12 bp, Homo sapiens
tgtgctttgtag

SEQ ID NO: 5533890 - DNA, 22 bp, Homo sapiens
tgtgctttgtatcagtcagtgc

SEQ ID NO: 5533891 - DNA, 17 bp, Homo sapiens
tgtgctttgtggcttct

SEQ ID NO: 5533892 - DNA, 21 bp, Homo sapiens
tgtgggccaagtccactgtcc

SEQ ID NO: 5533893 - DNA, 21 bp, Homo sapiens
tgtgggccaccgtgcctggct

SEQ ID NO: 5533894 - DNA, 23 bp, Homo sapiens
tgtgggccagccgattcctccag

SEQ ID NO: 5533895 - DNA, 15 bp, Homo sapiens
tgtgggcccctcaac

SEQ ID NO: 5533896 - DNA, 17 bp, Homo sapiens
tgtgggcccctcaacag

SEQ ID NO: 5533897 - DNA, 19 bp, Homo sapiens
tgtgggcctcacctgcccc

SEQ ID NO: 5533898 - DNA, 22 bp, Homo sapiens
tgtgggcgcccaccctgggctc

SEQ ID NO: 5533899 - DNA, 23 bp, Homo sapiens
tgtgggcgcccaccctgggctcc

SEQ ID NO: 5533900 - DNA, 16 bp, Homo sapiens
tgtgggcgctgcttcc

SEQ ID NO: 5533901 - DNA, 17 bp, Homo sapiens
tgtgggcgggcccagca

SEQ ID NO: 5533902 - DNA, 22 bp, Homo sapiens
tgtgggcgtgagacctgcccct

SEQ ID NO: 5533903 - DNA, 22 bp, Homo sapiens
tgtgggctatgtagtcataata

SEQ ID NO: 5533904 - DNA, 13 bp, Homo sapiens
tgtgggctgcact

SEQ ID NO: 5533905 - DNA, 21 bp, Homo sapiens
tgtgggctgcactctgtgccc

SEQ ID NO: 5533906 - DNA, 20 bp, Homo sapiens
tgtgggctggtgccccacag

SEQ ID NO: 5533907 - DNA, 22 bp, Homo sapiens
tgtgggcttatgtctctgcctt

SEQ ID NO: 5533908 - DNA, 22 bp, Homo sapiens
tgtgggcttcctgctgggactg

SEQ ID NO: 5533909 - DNA, 23 bp, Homo sapiens
tgtggggaaccaattgctttgtc

SEQ ID NO: 5533910 - DNA, 23 bp, Homo sapiens
tgtggggaagcaagacgtcctgg

SEQ ID NO: 5533911 - DNA, 21 bp, Homo sapiens
tgtggggacacagcagtgagt

SEQ ID NO: 5533912 - DNA, 14 bp, Homo sapiens
tgtggggagctggt

SEQ ID NO: 5533913 - DNA, 14 bp, Homo sapiens
tgtggggaggcagc

SEQ ID NO: 5533914 - DNA, 15 bp, Homo sapiens
tgtggggaggctgca

SEQ ID NO: 5533915 - DNA, 17 bp, Homo sapiens
tgtggggaggggaaggg

SEQ ID NO: 5533916 - DNA, 19 bp, Homo sapiens
tgtggggagggtgtctggg

SEQ ID NO: 5533917 - DNA, 16 bp, Homo sapiens
tgtggggattttcact

SEQ ID NO: 5533918 - DNA, 12 bp, Homo sapiens
tgtggggccaca

SEQ ID NO: 5533919 - DNA, 12 bp, Homo sapiens
tgtggggccagg

SEQ ID NO: 5533920 - DNA, 15 bp, Homo sapiens
tgtggggccaggtca

SEQ ID NO: 5533921 - DNA, 23 bp, Homo sapiens
tgtggggcccaagcatgccccac

SEQ ID NO: 5533922 - DNA, 14 bp, Homo sapiens
tgtggggcctggga

SEQ ID NO: 5533923 - DNA, 15 bp, Homo sapiens
tgtggggctgggcac

SEQ ID NO: 5533924 - DNA, 13 bp, Homo sapiens
tgtgggggagatt

SEQ ID NO: 5533925 - DNA, 13 bp, Homo sapiens
tgtgggggcttca

SEQ ID NO: 5533926 - DNA, 16 bp, Homo sapiens
tgtgggggcttcatct

SEQ ID NO: 5533927 - DNA, 19 bp, Homo sapiens
tgtgggggcttcatctctt

SEQ ID NO: 5533928 - DNA, 17 bp, Homo sapiens
tgtggggggacagacag

SEQ ID NO: 5533929 - DNA, 18 bp, Homo sapiens
tgtggggggctgggggag

SEQ ID NO: 5533930 - DNA, 14 bp, Homo sapiens
tgtggggggtcctt

SEQ ID NO: 5533931 - DNA, 13 bp, Homo sapiens
tgtggggggtgcc

SEQ ID NO: 5533932 - DNA, 17 bp, Homo sapiens
tgtgggggtctgggagg

SEQ ID NO: 5533933 - DNA, 22 bp, Homo sapiens
tgtgggggtctgggaggcaggt

SEQ ID NO: 5533934 - DNA, 14 bp, Homo sapiens
tgtgggggtggcca

SEQ ID NO: 5533935 - DNA, 16 bp, Homo sapiens
tgtgggggtggccatc

SEQ ID NO: 5533936 - DNA, 20 bp, Homo sapiens
tgtgggggtggccatccctg

SEQ ID NO: 5533937 - DNA, 14 bp, Homo sapiens
tgtggggtaagttg

SEQ ID NO: 5533938 - DNA, 18 bp, Homo sapiens
tgtggggtggacctggga

SEQ ID NO: 5533939 - DNA, 22 bp, Homo sapiens
tgtggggtgtgcacatctctgc

SEQ ID NO: 5533940 - DNA, 21 bp, Homo sapiens
tgtggggtttttggagaaggt

SEQ ID NO: 5533941 - DNA, 19 bp, Homo sapiens
tgtgggtaagaggagcaga

SEQ ID NO: 5533942 - DNA, 21 bp, Homo sapiens
tgtgggtacagagaggtcaag

SEQ ID NO: 5533943 - DNA, 16 bp, Homo sapiens
tgtgggtatttcttgg

SEQ ID NO: 5533944 - DNA, 13 bp, Homo sapiens
tgtgggtccctgc

SEQ ID NO: 5533945 - DNA, 15 bp, Homo sapiens
tgtgggtcttccagg

SEQ ID NO: 5533946 - DNA, 18 bp, Homo sapiens
tgtgggtgaaatggagat

SEQ ID NO: 5533947 - DNA, 20 bp, Homo sapiens
tgtgggtgaagtgcctgctg

SEQ ID NO: 5533948 - DNA, 17 bp, Homo sapiens
tgtgggtgaccaggtcc

SEQ ID NO: 5533949 - DNA, 16 bp, Homo sapiens
tgtgggtgccttccat

SEQ ID NO: 5533950 - DNA, 22 bp, Homo sapiens
tgtgggtggaagggctgggtgt

SEQ ID NO: 5533951 - DNA, 15 bp, Homo sapiens
tgtgggtggagaagg

SEQ ID NO: 5533952 - DNA, 17 bp, Homo sapiens
tgtgggtggatataaat

SEQ ID NO: 5533953 - DNA, 20 bp, Homo sapiens
tgtgggtggatataaatata

SEQ ID NO: 5533954 - DNA, 19 bp, Homo sapiens
tgtgggtgggagtgtgtct

SEQ ID NO: 5533955 - DNA, 14 bp, Homo sapiens
tgtgggtggggagg

SEQ ID NO: 5533956 - DNA, 15 bp, Homo sapiens
tgtgggtggggaggc

SEQ ID NO: 5533957 - DNA, 19 bp, Homo sapiens
tgtgggtggggaggccctg

SEQ ID NO: 5533958 - DNA, 12 bp, Homo sapiens
tgtgggtggggc

SEQ ID NO: 5533959 - DNA, 21 bp, Homo sapiens
tgtgggtggggcttctctggg

SEQ ID NO: 5533960 - DNA, 22 bp, Homo sapiens
tgtgggtggggttatgtgaggg

SEQ ID NO: 5533961 - DNA, 14 bp, Homo sapiens
tgtgggtgttaatt

SEQ ID NO: 5533962 - DNA, 21 bp, Homo sapiens
tgtgggtgttctttcctgccc

SEQ ID NO: 5533963 - DNA, 22 bp, Homo sapiens
tgtgggtgttctttcctgccct

SEQ ID NO: 5533964 - DNA, 15 bp, Homo sapiens
tgtgggttccacaga

SEQ ID NO: 5533965 - DNA, 14 bp, Homo sapiens
tgtgggttctacag

SEQ ID NO: 5533966 - DNA, 15 bp, Homo sapiens
tgtgggttggccagg

SEQ ID NO: 5533967 - DNA, 16 bp, Homo sapiens
tgtgggtttctctgtg

SEQ ID NO: 5533968 - DNA, 18 bp, Homo sapiens
tgtgggtttttcatcttt

SEQ ID NO: 5533969 - DNA, 21 bp, Homo sapiens
tgtggtacaagcattctgtct

SEQ ID NO: 5533970 - DNA, 16 bp, Homo sapiens
tgtggtacaatctcaa

SEQ ID NO: 5533971 - DNA, 12 bp, Homo sapiens
tgtggtacagag

SEQ ID NO: 5533972 - DNA, 15 bp, Homo sapiens
tgtggtacagagaag

SEQ ID NO: 5533973 - DNA, 20 bp, Homo sapiens
tgtggtacagagaagccagc

SEQ ID NO: 5533974 - DNA, 18 bp, Homo sapiens
tgtggtaccctggcagag

SEQ ID NO: 5533975 - DNA, 21 bp, Homo sapiens
tgtggtaccttcagccctggc

SEQ ID NO: 5533976 - DNA, 14 bp, Homo sapiens
tgtggtagaaacaa

SEQ ID NO: 5533977 - DNA, 22 bp, Homo sapiens
tgtggtagggacttaaaaaact

SEQ ID NO: 5533978 - DNA, 18 bp, Homo sapiens
tgtggtagggggtgtctc

SEQ ID NO: 5533979 - DNA, 14 bp, Homo sapiens
tgtggtagtcctcc

SEQ ID NO: 5533980 - DNA, 17 bp, Homo sapiens
tgtggtataaaaaggaa

SEQ ID NO: 5533981 - DNA, 24 bp, Homo sapiens
tgtggtatagtagaaaggccagct

SEQ ID NO: 5533982 - DNA, 16 bp, Homo sapiens
tgtggtatatttgtgt

SEQ ID NO: 5533983 - DNA, 21 bp, Homo sapiens
tgtggtattcaactaatacat

SEQ ID NO: 5533984 - DNA, 19 bp, Homo sapiens
tgtggtattgaatattgtg

SEQ ID NO: 5533985 - DNA, 23 bp, Homo sapiens
tgtggtcaacatttctcatgttg

SEQ ID NO: 5533986 - DNA, 15 bp, Homo sapiens
tgtggtcacagctgt

SEQ ID NO: 5533987 - DNA, 13 bp, Homo sapiens
tgtggtcagagag

SEQ ID NO: 5533988 - DNA, 14 bp, Homo sapiens
tgtggtcagagagg

SEQ ID NO: 5533989 - DNA, 15 bp, Homo sapiens
tgtggtcagcagatg

SEQ ID NO: 5533990 - DNA, 15 bp, Homo sapiens
tgtggtcatgtgagt

SEQ ID NO: 5533991 - DNA, 14 bp, Homo sapiens
tgtggtccaaatag

SEQ ID NO: 5533992 - DNA, 16 bp, Homo sapiens
tgtggtccatctctga

SEQ ID NO: 5533993 - DNA, 18 bp, Homo sapiens
tgtggtccatctctgaaa

SEQ ID NO: 5533994 - DNA, 19 bp, Homo sapiens
tgtggtccatctctgaaaa

SEQ ID NO: 5533995 - DNA, 20 bp, Homo sapiens
tgtggtccatctctgaaaac

SEQ ID NO: 5533996 - DNA, 23 bp, Homo sapiens
tgtggtccatgcccactgctggt

SEQ ID NO: 5533997 - DNA, 16 bp, Homo sapiens
tgtggtcccaacagga

SEQ ID NO: 5533998 - DNA, 13 bp, Homo sapiens
tgtggtcccaccc

SEQ ID NO: 5533999 - DNA, 21 bp, Homo sapiens
tgtggtcccataggagcagcc

SEQ ID NO: 5534000 - DNA, 23 bp, Homo sapiens
tgtggtctataaaataaacttct

SEQ ID NO: 5534001 - DNA, 17 bp, Homo sapiens
tgtggtctattgtcgct

SEQ ID NO: 5534002 - DNA, 15 bp, Homo sapiens
tgtggtctcaggata

SEQ ID NO: 5534003 - DNA, 15 bp, Homo sapiens
tgtggtctccagctc

SEQ ID NO: 5534004 - DNA, 18 bp, Homo sapiens
tgtggtctccagctcctc

SEQ ID NO: 5534005 - DNA, 16 bp, Homo sapiens
tgtggtctctttgggg

SEQ ID NO: 5534006 - DNA, 16 bp, Homo sapiens
tgtggtctgactcctt

SEQ ID NO: 5534007 - DNA, 14 bp, Homo sapiens
tgtggtctgtgtgt

SEQ ID NO: 5534008 - DNA, 19 bp, Homo sapiens
tgtggtcttatgattttat

SEQ ID NO: 5534009 - DNA, 22 bp, Homo sapiens
tgtggtctttgctgctgctctc

SEQ ID NO: 5534010 - DNA, 17 bp, Homo sapiens
tgtggtctttttcctga

SEQ ID NO: 5534011 - DNA, 15 bp, Homo sapiens
tgtggtgaatatgca

SEQ ID NO: 5534012 - DNA, 15 bp, Homo sapiens
tgtggtgacaggccc

SEQ ID NO: 5534013 - DNA, 16 bp, Homo sapiens
tgtggtgactttggat

SEQ ID NO: 5534014 - DNA, 13 bp, Homo sapiens
tgtggtgagggag

SEQ ID NO: 5534015 - DNA, 18 bp, Homo sapiens
tgtggtgaggggctttct

SEQ ID NO: 5534016 - DNA, 19 bp, Homo sapiens
tgtggtgaggggctttctc

SEQ ID NO: 5534017 - DNA, 23 bp, Homo sapiens
tgtggtgaggtcctgtcctggct

SEQ ID NO: 5534018 - DNA, 23 bp, Homo sapiens
tgtggtgatacctataaagagga

SEQ ID NO: 5534019 - DNA, 19 bp, Homo sapiens
tgtggtgatgatgtgtata

SEQ ID NO: 5534020 - DNA, 21 bp, Homo sapiens
tgtggtgatgtacgctgcgtg

SEQ ID NO: 5534021 - DNA, 17 bp, Homo sapiens
tgtggtgcagtgtgaaa

SEQ ID NO: 5534022 - DNA, 17 bp, Homo sapiens
tgtggtgcattcctgaa

SEQ ID NO: 5534023 - DNA, 18 bp, Homo sapiens
tgtggtgcctctcttggc

SEQ ID NO: 5534024 - DNA, 14 bp, Homo sapiens
tgtggtggagccag

SEQ ID NO: 5534025 - DNA, 18 bp, Homo sapiens
tgtggtggattctccctg

SEQ ID NO: 5534026 - DNA, 15 bp, Homo sapiens
tgtggtggcctcagc

SEQ ID NO: 5534027 - DNA, 12 bp, Homo sapiens
tgtggtgtaaag

SEQ ID NO: 5534028 - DNA, 16 bp, Homo sapiens
tgtggtgtaaagctgg

SEQ ID NO: 5534029 - DNA, 18 bp, Homo sapiens
tgtggtgtaaagctggcc

SEQ ID NO: 5534030 - DNA, 23 bp, Homo sapiens
tgtggtgtcgtctgtgaatgcta

SEQ ID NO: 5534031 - DNA, 12 bp, Homo sapiens
tgtggtgtgacc

SEQ ID NO: 5534032 - DNA, 15 bp, Homo sapiens
tgtggtgtgtttgct

SEQ ID NO: 5534033 - DNA, 16 bp, Homo sapiens
tgtggtgttgaggctt

SEQ ID NO: 5534034 - DNA, 21 bp, Homo sapiens
tgtggtgtttcctgcaggcca

SEQ ID NO: 5534035 - DNA, 22 bp, Homo sapiens
tgtggttaccgagtatctgtaa

SEQ ID NO: 5534036 - DNA, 23 bp, Homo sapiens
tgtggttataacttaatgaaaac

SEQ ID NO: 5534037 - DNA, 19 bp, Homo sapiens
tgtggttatcactttaagt

SEQ ID NO: 5534038 - DNA, 17 bp, Homo sapiens
tgtggttatttctctga

SEQ ID NO: 5534039 - DNA, 16 bp, Homo sapiens
tgtggttccatgcagc

SEQ ID NO: 5534040 - DNA, 15 bp, Homo sapiens
tgtggttctatttta

SEQ ID NO: 5534041 - DNA, 18 bp, Homo sapiens
tgtggttctattttactt

SEQ ID NO: 5534042 - DNA, 18 bp, Homo sapiens
tgtggttgaaaaccacag

SEQ ID NO: 5534043 - DNA, 14 bp, Homo sapiens
tgtggttgcagtct

SEQ ID NO: 5534044 - DNA, 18 bp, Homo sapiens
tgtggttgggggtgggag

SEQ ID NO: 5534045 - DNA, 16 bp, Homo sapiens
tgtggttgtagaagga

SEQ ID NO: 5534046 - DNA, 18 bp, Homo sapiens
tgtggttgtgtgtgttct

SEQ ID NO: 5534047 - DNA, 18 bp, Homo sapiens
tgtggtttactagcagga

SEQ ID NO: 5534048 - DNA, 15 bp, Homo sapiens
tgtggtttcagatgt

SEQ ID NO: 5534049 - DNA, 20 bp, Homo sapiens
tgtggtttcagatgtgcaat

SEQ ID NO: 5534050 - DNA, 22 bp, Homo sapiens
tgtggtttcagatgtgcaataa

SEQ ID NO: 5534051 - DNA, 18 bp, Homo sapiens
tgtggtttcccctttctt

SEQ ID NO: 5534052 - DNA, 13 bp, Homo sapiens
tgtggtttggaat

SEQ ID NO: 5534053 - DNA, 12 bp, Homo sapiens
tgtggtttgttg

SEQ ID NO: 5534054 - DNA, 14 bp, Homo sapiens
tgtggttttatgga

SEQ ID NO: 5534055 - DNA, 18 bp, Homo sapiens
tgtggttttcccctccct

SEQ ID NO: 5534056 - DNA, 19 bp, Homo sapiens
tgtggttttcttttgccat

SEQ ID NO: 5534057 - DNA, 21 bp, Homo sapiens
tgtgtaaaaaaaccaccaaaa

SEQ ID NO: 5534058 - DNA, 15 bp, Homo sapiens
tgtgtaaaaaatgga

SEQ ID NO: 5534059 - DNA, 15 bp, Homo sapiens
tgtgtaaaatgagta

SEQ ID NO: 5534060 - DNA, 16 bp, Homo sapiens
tgtgtaaaattaatgt

SEQ ID NO: 5534061 - DNA, 21 bp, Homo sapiens
tgtgtaaaattaatgtaataa

SEQ ID NO: 5534062 - DNA, 21 bp, Homo sapiens
tgtgtaaaattggattattac

SEQ ID NO: 5534063 - DNA, 14 bp, Homo sapiens
tgtgtaaacaaaat

SEQ ID NO: 5534064 - DNA, 22 bp, Homo sapiens
tgtgtaaacaaaatgaagctgc

SEQ ID NO: 5534065 - DNA, 21 bp, Homo sapiens
tgtgtaaacacagtcaaaata

SEQ ID NO: 5534066 - DNA, 14 bp, Homo sapiens
tgtgtaaagattta

SEQ ID NO: 5534067 - DNA, 20 bp, Homo sapiens
tgtgtaaaggaacaactgat

SEQ ID NO: 5534068 - DNA, 9 bp, Homo sapiens
tgtgtaaat

SEQ ID NO: 5534069 - DNA, 19 bp, Homo sapiens
tgtgtgagtgtatgtatac

SEQ ID NO: 5534070 - DNA, 20 bp, Homo sapiens
tgtgtgagtgtatgtataca

SEQ ID NO: 5534071 - DNA, 14 bp, Homo sapiens
tgtgtgagtgtgag

SEQ ID NO: 5534072 - DNA, 16 bp, Homo sapiens
tgtgtgatgaactttc

SEQ ID NO: 5534073 - DNA, 14 bp, Homo sapiens
tgtgtgatgcatgt

SEQ ID NO: 5534074 - DNA, 15 bp, Homo sapiens
tgtgtgatgcgcctt

SEQ ID NO: 5534075 - DNA, 14 bp, Homo sapiens
tgtgtgatgtgaca

SEQ ID NO: 5534076 - DNA, 19 bp, Homo sapiens
tgtgtgatgtgacatttgt

SEQ ID NO: 5534077 - DNA, 14 bp, Homo sapiens
tgtgtgattacagc

SEQ ID NO: 5534078 - DNA, 15 bp, Homo sapiens
tgtgtgattgacagc

SEQ ID NO: 5534079 - DNA, 18 bp, Homo sapiens
tgtgtgattgacagcttt

SEQ ID NO: 5534080 - DNA, 19 bp, Homo sapiens
tgtgtgattgacagctttg

SEQ ID NO: 5534081 - DNA, 21 bp, Homo sapiens
tgtgtgattgacagctttgct

SEQ ID NO: 5534082 - DNA, 13 bp, Homo sapiens
tgtgtgatttcct

SEQ ID NO: 5534083 - DNA, 23 bp, Homo sapiens
tgtgtgatttcctaaacataatt

SEQ ID NO: 5534084 - DNA, 22 bp, Homo sapiens
tgtgtgcaacagggtatggact

SEQ ID NO: 5534085 - DNA, 23 bp, Homo sapiens
tgtgtgcaccttaccaactttct

SEQ ID NO: 5534086 - DNA, 23 bp, Homo sapiens
tgtgtgcagaattctaggcagca

SEQ ID NO: 5534087 - DNA, 15 bp, Homo sapiens
tgtgtgcagagcaga

SEQ ID NO: 5534088 - DNA, 21 bp, Homo sapiens
tgtgtgcagagcagacaggct

SEQ ID NO: 5534089 - DNA, 17 bp, Homo sapiens
tgtgtgcagagctgaag

SEQ ID NO: 5534090 - DNA, 18 bp, Homo sapiens
tgtgtgcagagtccattt

SEQ ID NO: 5534091 - DNA, 21 bp, Homo sapiens
tgtgtgcagtctctcttaccc

SEQ ID NO: 5534092 - DNA, 19 bp, Homo sapiens
tgtgtgcatatgcatgtgt

SEQ ID NO: 5534093 - DNA, 17 bp, Homo sapiens
tgtgtgcatatttgtta

SEQ ID NO: 5534094 - DNA, 22 bp, Homo sapiens
tgtgtgcatcaggctttctttt

SEQ ID NO: 5534095 - DNA, 19 bp, Homo sapiens
tgtgtgcatgtatgtgtgt

SEQ ID NO: 5534096 - DNA, 12 bp, Homo sapiens
tgtgtgcatgtg

SEQ ID NO: 5534097 - DNA, 17 bp, Homo sapiens
tgtgtgcatgtgccgag

SEQ ID NO: 5534098 - DNA, 18 bp, Homo sapiens
tgtgtgcatgtgccgagg

SEQ ID NO: 5534099 - DNA, 16 bp, Homo sapiens
tgtgtgccaagagcta

SEQ ID NO: 5534100 - DNA, 21 bp, Homo sapiens
tgtgtgccatagagtttaaca

SEQ ID NO: 5534101 - DNA, 17 bp, Homo sapiens
tgtgtgcccagcacctg

SEQ ID NO: 5534102 - DNA, 21 bp, Homo sapiens
tgtgtgccccactccagcctg

SEQ ID NO: 5534103 - DNA, 20 bp, Homo sapiens
tgtgtgccctctgggctctg

SEQ ID NO: 5534104 - DNA, 22 bp, Homo sapiens
tgtgtgccctgggccaggcagg

SEQ ID NO: 5534105 - DNA, 21 bp, Homo sapiens
tgtgtgccgagcccttgccca

SEQ ID NO: 5534106 - DNA, 20 bp, Homo sapiens
tgtgtgcctctagctgaatt

SEQ ID NO: 5534107 - DNA, 20 bp, Homo sapiens
tgtgtgcctggccgcagggc

SEQ ID NO: 5534108 - DNA, 18 bp, Homo sapiens
tgtgtgcgagtgtgtgca

SEQ ID NO: 5534109 - DNA, 17 bp, Homo sapiens
tgtgtgcgctgcctggc

SEQ ID NO: 5534110 - DNA, 19 bp, Homo sapiens
tgtgtgcgtcctgtcggag

SEQ ID NO: 5534111 - DNA, 20 bp, Homo sapiens
tgtgtgcgtgtatatgtgct

SEQ ID NO: 5534112 - DNA, 17 bp, Homo sapiens
tgtgtgctaaacgtgta

SEQ ID NO: 5534113 - DNA, 14 bp, Homo sapiens
tgtgtgctactaac

SEQ ID NO: 5534114 - DNA, 17 bp, Homo sapiens
tgtgtgctactaacaga

SEQ ID NO: 5534115 - DNA, 17 bp, Homo sapiens
tgtgtgctcatgtatgt

SEQ ID NO: 5534116 - DNA, 13 bp, Homo sapiens
tgtgtgctctcca

SEQ ID NO: 5534117 - DNA, 16 bp, Homo sapiens
tgtgtgctcttatccc

SEQ ID NO: 5534118 - DNA, 18 bp, Homo sapiens
tgtgtgctcttcttcttt

SEQ ID NO: 5534119 - DNA, 15 bp, Homo sapiens
tgtgtgctgactgaa

SEQ ID NO: 5534120 - DNA, 12 bp, Homo sapiens
tgtgtgctgttt

SEQ ID NO: 5534121 - DNA, 14 bp, Homo sapiens
tgtgtgctttccca

SEQ ID NO: 5534122 - DNA, 22 bp, Homo sapiens
tgtgtggaaaaaaaaaaaaact

SEQ ID NO: 5534123 - DNA, 16 bp, Homo sapiens
tgtgtggaaatgggac

SEQ ID NO: 5534124 - DNA, 22 bp, Homo sapiens
tgtgtggaaggcagggacagag

SEQ ID NO: 5534125 - DNA, 12 bp, Homo sapiens
tgtgtggacagc

SEQ ID NO: 5534126 - DNA, 13 bp, Homo sapiens
tgtgtggacagcc

SEQ ID NO: 5534127 - DNA, 12 bp, Homo sapiens
tgtgtggaccat

SEQ ID NO: 5534128 - DNA, 23 bp, Homo sapiens
tgtgtggactgtggcacttgcct

SEQ ID NO: 5534129 - DNA, 22 bp, Homo sapiens
tgtgtggagagggaatgtgaaa

SEQ ID NO: 5534130 - DNA, 23 bp, Homo sapiens
tgtgtggagggattgaacacagg

SEQ ID NO: 5534131 - DNA, 17 bp, Homo sapiens
tgtgtggagtcatttct

SEQ ID NO: 5534132 - DNA, 20 bp, Homo sapiens
tgtgtggagtcatttctgat

SEQ ID NO: 5534133 - DNA, 17 bp, Homo sapiens
tgtgtggatgctgagct

SEQ ID NO: 5534134 - DNA, 14 bp, Homo sapiens
tgtgtggcaaacat

SEQ ID NO: 5534135 - DNA, 15 bp, Homo sapiens
tgtgtggcaaacatt

SEQ ID NO: 5534136 - DNA, 17 bp, Homo sapiens
tgtgtggcaaacattta

SEQ ID NO: 5534137 - DNA, 21 bp, Homo sapiens
tgtgtggcaaacatttaaaaa

SEQ ID NO: 5534138 - DNA, 20 bp, Homo sapiens
tgtgtggcaaattaaacaat

SEQ ID NO: 5534139 - DNA, 22 bp, Homo sapiens
tgtgtggcagccaggatgacta

SEQ ID NO: 5534140 - DNA, 16 bp, Homo sapiens
tgtgtggccacttctg

SEQ ID NO: 5534141 - DNA, 18 bp, Homo sapiens
tgtgtggcccagttctga

SEQ ID NO: 5534142 - DNA, 13 bp, Homo sapiens
tgtgtggcctccc

SEQ ID NO: 5534143 - DNA, 20 bp, Homo sapiens
tgtgtggcctggtgggtcag

SEQ ID NO: 5534144 - DNA, 15 bp, Homo sapiens
tgtgtggctcctggg

SEQ ID NO: 5534145 - DNA, 15 bp, Homo sapiens
tgtgtggctcctggt

SEQ ID NO: 5534146 - DNA, 14 bp, Homo sapiens
tgtgtggctgtgca

SEQ ID NO: 5534147 - DNA, 15 bp, Homo sapiens
tgtgtggctgtgggt

SEQ ID NO: 5534148 - DNA, 17 bp, Homo sapiens
tgtgtggctttcagagc

SEQ ID NO: 5534149 - DNA, 20 bp, Homo sapiens
tgtgtggctttcagagcctc

SEQ ID NO: 5534150 - DNA, 14 bp, Homo sapiens
tgtgtgggagggcg

SEQ ID NO: 5534151 - DNA, 15 bp, Homo sapiens
tgtgtgggatactta

SEQ ID NO: 5534152 - DNA, 20 bp, Homo sapiens
tgtgtgggatcattgcattt

SEQ ID NO: 5534153 - DNA, 23 bp, Homo sapiens
tgtgtgggccaccgtgcctggct

SEQ ID NO: 5534154 - DNA, 15 bp, Homo sapiens
tgtgtggggaggcag

SEQ ID NO: 5534155 - DNA, 16 bp, Homo sapiens
tgtgtggggaggcagc

SEQ ID NO: 5534156 - DNA, 16 bp, Homo sapiens
tgtgtggggcccaagc

SEQ ID NO: 5534157 - DNA, 19 bp, Homo sapiens
tgtgtgggggtctgggagg

SEQ ID NO: 5534158 - DNA, 22 bp, Homo sapiens
tgtgtgggggtctgggaggcag

SEQ ID NO: 5534159 - DNA, 22 bp, Homo sapiens
tgtgtggggttcagcgtagaaa

SEQ ID NO: 5534160 - DNA, 16 bp, Homo sapiens
tgtgtgggtctgggga

SEQ ID NO: 5534161 - DNA, 20 bp, Homo sapiens
tgtgtgggtggatataaata

SEQ ID NO: 5534162 - DNA, 16 bp, Homo sapiens
tgtgtggtatatttgt

SEQ ID NO: 5534163 - DNA, 20 bp, Homo sapiens
tgtgtggtccatgcccactg

SEQ ID NO: 5534164 - DNA, 20 bp, Homo sapiens
tgtgtggtctctgccccagc

SEQ ID NO: 5534165 - DNA, 23 bp, Homo sapiens
tgtgtggtctctgccccagcctg

SEQ ID NO: 5534166 - DNA, 21 bp, Homo sapiens
tgtgtggtgcacgtttgtaat

SEQ ID NO: 5534167 - DNA, 21 bp, Homo sapiens
tgtgtggtggattctccctgg

SEQ ID NO: 5534168 - DNA, 19 bp, Homo sapiens
tgtgtggtgtcgtctgtga

SEQ ID NO: 5534169 - DNA, 20 bp, Homo sapiens
tgtgtggtgtcgtctgtgaa

SEQ ID NO: 5534170 - DNA, 17 bp, Homo sapiens
tgtgtggttcagctact

SEQ ID NO: 5534171 - DNA, 21 bp, Homo sapiens
tgtgtggttggaaaacttttg

SEQ ID NO: 5534172 - DNA, 23 bp, Homo sapiens
tgtgtggtttagtgtaaaaatga

SEQ ID NO: 5534173 - DNA, 16 bp, Homo sapiens
tgtgtgtaagctgact

SEQ ID NO: 5534174 - DNA, 14 bp, Homo sapiens
tgtgtgtaatttct

SEQ ID NO: 5534175 - DNA, 20 bp, Homo sapiens
tgtgtgtacaaatacatgtg

SEQ ID NO: 5534176 - DNA, 23 bp, Homo sapiens
tgtgtgtaggtattaaagatgtg

SEQ ID NO: 5534177 - DNA, 21 bp, Homo sapiens
tgtgtgtatatatttaaaaaa

SEQ ID NO: 5534178 - DNA, 14 bp, Homo sapiens
tgtgtgtatatgta

SEQ ID NO: 5534179 - DNA, 18 bp, Homo sapiens
tgtgtgtatctgtgggtc

SEQ ID NO: 5534180 - DNA, 14 bp, Homo sapiens
tgtgtgtatgctga

SEQ ID NO: 5534181 - DNA, 13 bp, Homo sapiens
tgtgtgtatgtgt

SEQ ID NO: 5534182 - DNA, 14 bp, Homo sapiens
tgtgtgtatgtgta

SEQ ID NO: 5534183 - DNA, 15 bp, Homo sapiens
tgtgtgtatgtgtga

SEQ ID NO: 5534184 - DNA, 14 bp, Homo sapiens
tgtgtgtatttgct

SEQ ID NO: 5534185 - DNA, 20 bp, Homo sapiens
tgtgtgtatttgctaatttt

SEQ ID NO: 5534186 - DNA, 15 bp, Homo sapiens
tgtgtgtatttgtgt

SEQ ID NO: 5534187 - DNA, 16 bp, Homo sapiens
tgtgtgtattttttca

SEQ ID NO: 5534188 - DNA, 23 bp, Homo sapiens
tgtgtgtcagcccatgtcaatca

SEQ ID NO: 5534189 - DNA, 16 bp, Homo sapiens
tgtgtgtccaaaactg

SEQ ID NO: 5534190 - DNA, 19 bp, Homo sapiens
tgtgtgtccaaaactgcct

SEQ ID NO: 5534191 - DNA, 15 bp, Homo sapiens
tgtgtgtcccaggca

SEQ ID NO: 5534192 - DNA, 14 bp, Homo sapiens
tgtgtgtcccccta

SEQ ID NO: 5534193 - DNA, 13 bp, Homo sapiens
tgtgtgtctccag

SEQ ID NO: 5534194 - DNA, 23 bp, Homo sapiens
tgtgtgtctccatgcacatgcac

SEQ ID NO: 5534195 - DNA, 16 bp, Homo sapiens
tgtgtgtctctatctt

SEQ ID NO: 5534196 - DNA, 16 bp, Homo sapiens
tgtgtgtctgcagaca

SEQ ID NO: 5534197 - DNA, 14 bp, Homo sapiens
tgtgtgtctgtcct

SEQ ID NO: 5534198 - DNA, 16 bp, Homo sapiens
tgtgtgtcttaattat

SEQ ID NO: 5534199 - DNA, 18 bp, Homo sapiens
tgtgtgtcttttataaaa

SEQ ID NO: 5534200 - DNA, 16 bp, Homo sapiens
tgtgtgtgaatgaaca

SEQ ID NO: 5534201 - DNA, 16 bp, Homo sapiens
tgtgtgtgagctaccg

SEQ ID NO: 5534202 - DNA, 13 bp, Homo sapiens
tgtgtgtgagttt

SEQ ID NO: 5534203 - DNA, 14 bp, Homo sapiens
tgtgtgtgatgtga

SEQ ID NO: 5534204 - DNA, 15 bp, Homo sapiens
tgtgtgtgatgtgac

SEQ ID NO: 5534205 - DNA, 18 bp, Homo sapiens
tgtgtgtgatgtgacatt

SEQ ID NO: 5534206 - DNA, 14 bp, Homo sapiens
tgtgtgtgattttt

SEQ ID NO: 5534207 - DNA, 18 bp, Homo sapiens
tgtgtgtgcagacttcag

SEQ ID NO: 5534208 - DNA, 18 bp, Homo sapiens
tgtgtgtgcatgtatgtg

SEQ ID NO: 5534209 - DNA, 15 bp, Homo sapiens
tgtgtgtgccctggg

SEQ ID NO: 5534210 - DNA, 13 bp, Homo sapiens
tgtgtgtgcgtgt

SEQ ID NO: 5534211 - DNA, 11 bp, Homo sapiens
tgtgtgtgctg

SEQ ID NO: 5534212 - DNA, 12 bp, Homo sapiens
tgtgtgtgctga

SEQ ID NO: 5534213 - DNA, 19 bp, Homo sapiens
tgtgtgtgcttatgtatga

SEQ ID NO: 5534214 - DNA, 12 bp, Homo sapiens
tgtgtgtggaag

SEQ ID NO: 5534215 - DNA, 13 bp, Homo sapiens
tgtgtgtggcagg

SEQ ID NO: 5534216 - DNA, 12 bp, Homo sapiens
tgtgtgtgggag

SEQ ID NO: 5534217 - DNA, 20 bp, Homo sapiens
tgtgtgtgggagtgtgtaat

SEQ ID NO: 5534218 - DNA, 19 bp, Homo sapiens
tgtgtgtgggctgtgagtg

SEQ ID NO: 5534219 - DNA, 12 bp, Homo sapiens
tgtgtgtgggtg

SEQ ID NO: 5534220 - DNA, 21 bp, Homo sapiens
tgtgtgtggtccatgcccact

SEQ ID NO: 5534221 - DNA, 11 bp, Homo sapiens
tgtgtgtgtac

SEQ ID NO: 5534222 - DNA, 11 bp, Homo sapiens
tgtgtgtgtat

SEQ ID NO: 5534223 - DNA, 14 bp, Homo sapiens
tgtgtgtgtatgct

SEQ ID NO: 5534224 - DNA, 14 bp, Homo sapiens
tgtgtgtgtatgtt

SEQ ID NO: 5534225 - DNA, 12 bp, Homo sapiens
tgtgtgtgtctc

SEQ ID NO: 5534226 - DNA, 14 bp, Homo sapiens
tgtgtgtgtctcta

SEQ ID NO: 5534227 - DNA, 12 bp, Homo sapiens
tgtgtgtgtctt

SEQ ID NO: 5534228 - DNA, 11 bp, Homo sapiens
tgtgtgtgtga

SEQ ID NO: 5534229 - DNA, 13 bp, Homo sapiens
tgtgtgtgtgaga

SEQ ID NO: 5534230 - DNA, 11 bp, Homo sapiens
tgtgtgtgtgc

SEQ ID NO: 5534231 - DNA, 14 bp, Homo sapiens
tgtgtgtgtgcgtg

SEQ ID NO: 5534232 - DNA, 15 bp, Homo sapiens
tgtgtgtgtggacag

SEQ ID NO: 5534233 - DNA, 14 bp, Homo sapiens
tgtgtgtgtgtact

SEQ ID NO: 5534234 - DNA, 14 bp, Homo sapiens
tgtgtgtgtgtatg

SEQ ID NO: 5534235 - DNA, 13 bp, Homo sapiens
tgtgtgtgtgtgc

SEQ ID NO: 5534236 - DNA, 16 bp, Homo sapiens
tgtgtgtgtgtgcatg

SEQ ID NO: 5534237 - DNA, 14 bp, Homo sapiens
tgtgtgtgtgtgtc

SEQ ID NO: 5534238 - DNA, 15 bp, Homo sapiens
tgtgtgtgtgtgtcc

SEQ ID NO: 5534239 - DNA, 16 bp, Homo sapiens
tgtgtgtgtgtgtctg

SEQ ID NO: 5534240 - DNA, 22 bp, Homo sapiens
tgtgtgttcaccttcaaaatgt

SEQ ID NO: 5534241 - DNA, 17 bp, Homo sapiens
tgtgtgttcctgctttt

SEQ ID NO: 5534242 - DNA, 10 bp, Homo sapiens
tgtgtgttct

SEQ ID NO: 5534243 - DNA, 16 bp, Homo sapiens
tgtgtgttctgtagct

SEQ ID NO: 5534244 - DNA, 16 bp, Homo sapiens
tgtgtgttcttcaagc

SEQ ID NO: 5534245 - DNA, 20 bp, Homo sapiens
tgtgtgttcttttgatacat

SEQ ID NO: 5534246 - DNA, 17 bp, Homo sapiens
tgtgtgttgatactgtt

SEQ ID NO: 5534247 - DNA, 12 bp, Homo sapiens
tgtgtgttgcac

SEQ ID NO: 5534248 - DNA, 12 bp, Homo sapiens
tgtgtgttgctt

SEQ ID NO: 5534249 - DNA, 14 bp, Homo sapiens
tgttaattaaatat

SEQ ID NO: 5534250 - DNA, 15 bp, Homo sapiens
tgttaattacaccat

SEQ ID NO: 5534251 - DNA, 21 bp, Homo sapiens
tgttaattactatattttaga

SEQ ID NO: 5534252 - DNA, 18 bp, Homo sapiens
tgttaattataaacagca

SEQ ID NO: 5534253 - DNA, 20 bp, Homo sapiens
tgttaattataaacagcagg

SEQ ID NO: 5534254 - DNA, 14 bp, Homo sapiens
tgttaattgattaa

SEQ ID NO: 5534255 - DNA, 19 bp, Homo sapiens
tgttaattgattaaactgt

SEQ ID NO: 5534256 - DNA, 18 bp, Homo sapiens
tgttaatttagaaaactt

SEQ ID NO: 5534257 - DNA, 18 bp, Homo sapiens
tgttaatttataatgtat

SEQ ID NO: 5534258 - DNA, 23 bp, Homo sapiens
tgttaatttataggcgttttttg

SEQ ID NO: 5534259 - DNA, 14 bp, Homo sapiens
tgttaatttatttt

SEQ ID NO: 5534260 - DNA, 22 bp, Homo sapiens
tgttaatttattttgctccctc

SEQ ID NO: 5534261 - DNA, 14 bp, Homo sapiens
tgttaatttgttat

SEQ ID NO: 5534262 - DNA, 13 bp, Homo sapiens
tgttaattttgct

SEQ ID NO: 5534263 - DNA, 17 bp, Homo sapiens
tgttaattttgctaact

SEQ ID NO: 5534264 - DNA, 13 bp, Homo sapiens
tgttaatttttga

SEQ ID NO: 5534265 - DNA, 15 bp, Homo sapiens
tgttaatttttgata

SEQ ID NO: 5534266 - DNA, 14 bp, Homo sapiens
tgttacaaaatgta

SEQ ID NO: 5534267 - DNA, 15 bp, Homo sapiens
tgttacaaaatgtaa

SEQ ID NO: 5534268 - DNA, 17 bp, Homo sapiens
tgttacaaaatgtaact

SEQ ID NO: 5534269 - DNA, 18 bp, Homo sapiens
tgttacaaaatgtaactg

SEQ ID NO: 5534270 - DNA, 18 bp, Homo sapiens
tgttacaaagttgtatgt

SEQ ID NO: 5534271 - DNA, 14 bp, Homo sapiens
tgttacaaattgta

SEQ ID NO: 5534272 - DNA, 17 bp, Homo sapiens
tgttacaaattgtagaa

SEQ ID NO: 5534273 - DNA, 20 bp, Homo sapiens
tgttacaaattttttaattt

SEQ ID NO: 5534274 - DNA, 16 bp, Homo sapiens
tgttacaacaactatt

SEQ ID NO: 5534275 - DNA, 15 bp, Homo sapiens
tgttacaagaggcca

SEQ ID NO: 5534276 - DNA, 15 bp, Homo sapiens
tgttacaagtttgct

SEQ ID NO: 5534277 - DNA, 22 bp, Homo sapiens
tgttacaagtttgctaaaagaa

SEQ ID NO: 5534278 - DNA, 23 bp, Homo sapiens
tgttacaagtttgctaaaagaag

SEQ ID NO: 5534279 - DNA, 13 bp, Homo sapiens
tgttacaataaaa

SEQ ID NO: 5534280 - DNA, 17 bp, Homo sapiens
tgttacacagcccaaga

SEQ ID NO: 5534281 - DNA, 15 bp, Homo sapiens
tgttacacatacaca

SEQ ID NO: 5534282 - DNA, 17 bp, Homo sapiens
tgttacacattaaacag

SEQ ID NO: 5534283 - DNA, 18 bp, Homo sapiens
tgttacactttttggaag

SEQ ID NO: 5534284 - DNA, 13 bp, Homo sapiens
tgttacagaggac

SEQ ID NO: 5534285 - DNA, 14 bp, Homo sapiens
tgttacagcatcta

SEQ ID NO: 5534286 - DNA, 23 bp, Homo sapiens
tgttacagccaagtgccaaatgc

SEQ ID NO: 5534287 - DNA, 18 bp, Homo sapiens
tgttacaggtgtactatg

SEQ ID NO: 5534288 - DNA, 22 bp, Homo sapiens
tgttacagtttatattgtggaa

SEQ ID NO: 5534289 - DNA, 14 bp, Homo sapiens
tgttacatagtgta

SEQ ID NO: 5534290 - DNA, 15 bp, Homo sapiens
tgttacatagtgtag

SEQ ID NO: 5534291 - DNA, 12 bp, Homo sapiens
tgttacatcaca

SEQ ID NO: 5534292 - DNA, 19 bp, Homo sapiens
tgttacattaggaagatat

SEQ ID NO: 5534293 - DNA, 20 bp, Homo sapiens
tgttaccaaatacacatttc

SEQ ID NO: 5534294 - DNA, 19 bp, Homo sapiens
tgttaccagacttcaagat

SEQ ID NO: 5534295 - DNA, 24 bp, Homo sapiens
tgttaccatactgtctctggagtg

SEQ ID NO: 5534296 - DNA, 14 bp, Homo sapiens
tgttacccagcctg

SEQ ID NO: 5534297 - DNA, 19 bp, Homo sapiens
tgttacccaggctggtctc

SEQ ID NO: 5534298 - DNA, 13 bp, Homo sapiens
tgttacccagggc

SEQ ID NO: 5534299 - DNA, 15 bp, Homo sapiens
tgttacccatttgaa

SEQ ID NO: 5534300 - DNA, 22 bp, Homo sapiens
tgttacccgcagatcctgtccc

SEQ ID NO: 5534301 - DNA, 23 bp, Homo sapiens
tgttacccgcagatcctgtccca

SEQ ID NO: 5534302 - DNA, 15 bp, Homo sapiens
tgttaccgcctgtct

SEQ ID NO: 5534303 - DNA, 16 bp, Homo sapiens
tgttacctactttgac

SEQ ID NO: 5534304 - DNA, 15 bp, Homo sapiens
tgttacctaggttaa

SEQ ID NO: 5534305 - DNA, 19 bp, Homo sapiens
tgttacctccaacagaact

SEQ ID NO: 5534306 - DNA, 15 bp, Homo sapiens
tgttacctgaaaaca

SEQ ID NO: 5534307 - DNA, 22 bp, Homo sapiens
tgttacctgaaaacactgtgca

SEQ ID NO: 5534308 - DNA, 13 bp, Homo sapiens
tgttaccttaaaa

SEQ ID NO: 5534309 - DNA, 13 bp, Homo sapiens
tgttaccttttat

SEQ ID NO: 5534310 - DNA, 21 bp, Homo sapiens
tgttacggcagtcacactgct

SEQ ID NO: 5534311 - DNA, 22 bp, Homo sapiens
tgttacggcagtcacactgctg

SEQ ID NO: 5534312 - DNA, 16 bp, Homo sapiens
tgttacgtagcctaag

SEQ ID NO: 5534313 - DNA, 22 bp, Homo sapiens
tgttacgtgaagaaataaatga

SEQ ID NO: 5534314 - DNA, 20 bp, Homo sapiens
tgttactaaaaaaaagatga

SEQ ID NO: 5534315 - DNA, 22 bp, Homo sapiens
tgttactaaagtcacatataaa

SEQ ID NO: 5534316 - DNA, 23 bp, Homo sapiens
tgttactaaatggtgttacatta

SEQ ID NO: 5534317 - DNA, 21 bp, Homo sapiens
tgttactaccttattttcccc

SEQ ID NO: 5534318 - DNA, 16 bp, Homo sapiens
tgttactatctgcttt

SEQ ID NO: 5534319 - DNA, 15 bp, Homo sapiens
tgttactattttcta

SEQ ID NO: 5534320 - DNA, 20 bp, Homo sapiens
tgttactccaaaaagaaata

SEQ ID NO: 5534321 - DNA, 13 bp, Homo sapiens
tgttactctggtt

SEQ ID NO: 5534322 - DNA, 17 bp, Homo sapiens
tgttactctggttcttt

SEQ ID NO: 5534323 - DNA, 14 bp, Homo sapiens
tgttactcttacga

SEQ ID NO: 5534324 - DNA, 17 bp, Homo sapiens
tgttactcttgggacat

SEQ ID NO: 5534325 - DNA, 14 bp, Homo sapiens
tgttactgaagtta

SEQ ID NO: 5534326 - DNA, 16 bp, Homo sapiens
tgttactgagatgttt

SEQ ID NO: 5534327 - DNA, 19 bp, Homo sapiens
tgttactgattcaattata

SEQ ID NO: 5534328 - DNA, 18 bp, Homo sapiens
tgttactgattctcctgt

SEQ ID NO: 5534329 - DNA, 14 bp, Homo sapiens
tgttactgcagtga

SEQ ID NO: 5534330 - DNA, 15 bp, Homo sapiens
tgttactgcagtgac

SEQ ID NO: 5534331 - DNA, 16 bp, Homo sapiens
tgttactgcagtgacc

SEQ ID NO: 5534332 - DNA, 12 bp, Homo sapiens
tgttactgcctt

SEQ ID NO: 5534333 - DNA, 17 bp, Homo sapiens
tgttactgctttgcaaa

SEQ ID NO: 5534334 - DNA, 13 bp, Homo sapiens
tgttactgtattt

SEQ ID NO: 5534335 - DNA, 20 bp, Homo sapiens
tgttactgtatttttcagaa

SEQ ID NO: 5534336 - DNA, 22 bp, Homo sapiens
tgttactgtcctgttttctaat

SEQ ID NO: 5534337 - DNA, 13 bp, Homo sapiens
tgttactgtctgt

SEQ ID NO: 5534338 - DNA, 15 bp, Homo sapiens
tgttactgtgtgaag

SEQ ID NO: 5534339 - DNA, 17 bp, Homo sapiens
tgttactgttaaccatt

SEQ ID NO: 5534340 - DNA, 11 bp, Homo sapiens
tgttactgttc

SEQ ID NO: 5534341 - DNA, 15 bp, Homo sapiens
tgttactgttcttgc

SEQ ID NO: 5534342 - DNA, 17 bp, Homo sapiens
tgttactgttcttgctg

SEQ ID NO: 5534343 - DNA, 20 bp, Homo sapiens
tgttactgttcttgctgcta

SEQ ID NO: 5534344 - DNA, 21 bp, Homo sapiens
tgttactgttcttgctgctag

SEQ ID NO: 5534345 - DNA, 12 bp, Homo sapiens
tgttacttacct

SEQ ID NO: 5534346 - DNA, 16 bp, Homo sapiens
tgttacttccctccaa

SEQ ID NO: 5534347 - DNA, 20 bp, Homo sapiens
tgttacttccctccaagagg

SEQ ID NO: 5534348 - DNA, 13 bp, Homo sapiens
tgttacttctctg

SEQ ID NO: 5534349 - DNA, 14 bp, Homo sapiens
tgttacttctgata

SEQ ID NO: 5534350 - DNA, 15 bp, Homo sapiens
tgttacttgaagtaa

SEQ ID NO: 5534351 - DNA, 14 bp, Homo sapiens
tgttacttgcagca

SEQ ID NO: 5534352 - DNA, 19 bp, Homo sapiens
tgttacttgcagcattcat

SEQ ID NO: 5534353 - DNA, 17 bp, Homo sapiens
tgttacttgctttgagt

SEQ ID NO: 5534354 - DNA, 12 bp, Homo sapiens
tgttactttctt

SEQ ID NO: 5534355 - DNA, 19 bp, Homo sapiens
tgttactttggcaatttcc

SEQ ID NO: 5534356 - DNA, 20 bp, Homo sapiens
tgttactttttagtctttta

SEQ ID NO: 5534357 - DNA, 14 bp, Homo sapiens
tgttagaaaaaact

SEQ ID NO: 5534358 - DNA, 22 bp, Homo sapiens
tgttagaaaatgacttatttct

SEQ ID NO: 5534359 - DNA, 23 bp, Homo sapiens
tgttagaaaatgacttatttctg

SEQ ID NO: 5534360 - DNA, 22 bp, Homo sapiens
tgttagaacactattttcagaa

SEQ ID NO: 5534361 - DNA, 19 bp, Homo sapiens
tgttagaagaggtggcccc

SEQ ID NO: 5534362 - DNA, 20 bp, Homo sapiens
tgttagaagaggtggcccca

SEQ ID NO: 5534363 - DNA, 19 bp, Homo sapiens
tgttagaatgtaaggtata

SEQ ID NO: 5534364 - DNA, 11 bp, Homo sapiens
tgttagaatta

SEQ ID NO: 5534365 - DNA, 17 bp, Homo sapiens
tgttagaattgatttcc

SEQ ID NO: 5534366 - DNA, 18 bp, Homo sapiens
tgttagaattgatttcca

SEQ ID NO: 5534367 - DNA, 18 bp, Homo sapiens
tgttagactatagcccct

SEQ ID NO: 5534368 - DNA, 20 bp, Homo sapiens
tgttagactatagcccctgg

SEQ ID NO: 5534369 - DNA, 19 bp, Homo sapiens
tgttagacttgctccctct

SEQ ID NO: 5534370 - DNA, 23 bp, Homo sapiens
tgttagacttgctccctctccaa

SEQ ID NO: 5534371 - DNA, 14 bp, Homo sapiens
tgttagacttgtgt

SEQ ID NO: 5534372 - DNA, 19 bp, Homo sapiens
tgttagacttgtgtgcatg

SEQ ID NO: 5534373 - DNA, 16 bp, Homo sapiens
tgttagagagaaagag

SEQ ID NO: 5534374 - DNA, 17 bp, Homo sapiens
tgttagagagaaagaga

SEQ ID NO: 5534375 - DNA, 21 bp, Homo sapiens
tgttagagaggtagcgagctg

SEQ ID NO: 5534376 - DNA, 23 bp, Homo sapiens
tgttagagaggtagcgagctgct

SEQ ID NO: 5534377 - DNA, 20 bp, Homo sapiens
tgttagaggttttaaagtga

SEQ ID NO: 5534378 - DNA, 22 bp, Homo sapiens
tgttagaggttttaaagtgatt

SEQ ID NO: 5534379 - DNA, 21 bp, Homo sapiens
tgttagatagaatttccaata

SEQ ID NO: 5534380 - DNA, 19 bp, Homo sapiens
tgttagatagctgcatgtg

SEQ ID NO: 5534381 - DNA, 13 bp, Homo sapiens
tgttagatattgc

SEQ ID NO: 5534382 - DNA, 14 bp, Homo sapiens
tgttagatattgct

SEQ ID NO: 5534383 - DNA, 19 bp, Homo sapiens
tgttagatatttttcataa

SEQ ID NO: 5534384 - DNA, 23 bp, Homo sapiens
tgttagatgcttagtgtgaagtt

SEQ ID NO: 5534385 - DNA, 17 bp, Homo sapiens
tgttagattaagaaata

SEQ ID NO: 5534386 - DNA, 20 bp, Homo sapiens
tgttagattaagaaatagac

SEQ ID NO: 5534387 - DNA, 12 bp, Homo sapiens
tgttagcaaaga

SEQ ID NO: 5534388 - DNA, 17 bp, Homo sapiens
tgttagcactgttgatg

SEQ ID NO: 5534389 - DNA, 19 bp, Homo sapiens
tgttagcattaaagttcta

SEQ ID NO: 5534390 - DNA, 20 bp, Homo sapiens
tgttagccacggaaacatag

SEQ ID NO: 5534391 - DNA, 15 bp, Homo sapiens
tgttagcccttcaga

SEQ ID NO: 5534392 - DNA, 19 bp, Homo sapiens
tgttagcccttcagattgt

SEQ ID NO: 5534393 - DNA, 20 bp, Homo sapiens
tgttagcccttcagattgtt

SEQ ID NO: 5534394 - DNA, 19 bp, Homo sapiens
tgttagcctcaatttctga

SEQ ID NO: 5534395 - DNA, 13 bp, Homo sapiens
tgttagctgctca

SEQ ID NO: 5534396 - DNA, 18 bp, Homo sapiens
tgttagctgctcacttaa

SEQ ID NO: 5534397 - DNA, 14 bp, Homo sapiens
tgttagctgggaag

SEQ ID NO: 5534398 - DNA, 14 bp, Homo sapiens
tgttagcttcctta

SEQ ID NO: 5534399 - DNA, 22 bp, Homo sapiens
tgttagctttccaaggaagcag

SEQ ID NO: 5534400 - DNA, 19 bp, Homo sapiens
tgttaggagatgtcatcaa

SEQ ID NO: 5534401 - DNA, 21 bp, Homo sapiens
tgttaggattttcacattctt

SEQ ID NO: 5534402 - DNA, 19 bp, Homo sapiens
tgttaggccaaagacaaat

SEQ ID NO: 5534403 - DNA, 21 bp, Homo sapiens
tgttaggccaaagacaaatag

SEQ ID NO: 5534404 - DNA, 14 bp, Homo sapiens
tgttaggctgggcc

SEQ ID NO: 5534405 - DNA, 16 bp, Homo sapiens
tgttaggctgggccca

SEQ ID NO: 5534406 - DNA, 18 bp, Homo sapiens
tgttaggctgggcccaga

SEQ ID NO: 5534407 - DNA, 21 bp, Homo sapiens
tgttaggctttataggtgaag

SEQ ID NO: 5534408 - DNA, 23 bp, Homo sapiens
tgttagggagatgagttgcagtt

SEQ ID NO: 5534409 - DNA, 16 bp, Homo sapiens
tgttagggctgctttt

SEQ ID NO: 5534410 - DNA, 16 bp, Homo sapiens
tgttaggggaaaatag

SEQ ID NO: 5534411 - DNA, 13 bp, Homo sapiens
tgttagggtcagc

SEQ ID NO: 5534412 - DNA, 15 bp, Homo sapiens
tgttagggtcagcca

SEQ ID NO: 5534413 - DNA, 15 bp, Homo sapiens
tgttagggttatgtt

SEQ ID NO: 5534414 - DNA, 23 bp, Homo sapiens
tgttaggtcaagctatttctctg

SEQ ID NO: 5534415 - DNA, 21 bp, Homo sapiens
tgttaggttggggataggttt

SEQ ID NO: 5534416 - DNA, 14 bp, Homo sapiens
tgttagtaaaggaa

SEQ ID NO: 5534417 - DNA, 15 bp, Homo sapiens
tgttagtaaaggggc

SEQ ID NO: 5534418 - DNA, 15 bp, Homo sapiens
tgttagtactttgga

SEQ ID NO: 5534419 - DNA, 14 bp, Homo sapiens
tgttagtagaaatt

SEQ ID NO: 5534420 - DNA, 17 bp, Homo sapiens
tgttagtataagctttt

SEQ ID NO: 5534421 - DNA, 14 bp, Homo sapiens
tgttagtcaaggac

SEQ ID NO: 5534422 - DNA, 17 bp, Homo sapiens
tgttagtgatttgctat

SEQ ID NO: 5534423 - DNA, 17 bp, Homo sapiens
tgttagtggacttgttt

SEQ ID NO: 5534424 - DNA, 13 bp, Homo sapiens
tgttagtgggaag

SEQ ID NO: 5534425 - DNA, 15 bp, Homo sapiens
tgttagtgggaagag

SEQ ID NO: 5534426 - DNA, 21 bp, Homo sapiens
tgttagtgggaagagctgggt

SEQ ID NO: 5534427 - DNA, 24 bp, Homo sapiens
tgttcccgatggtctctctccctc

SEQ ID NO: 5534428 - DNA, 23 bp, Homo sapiens
tgttcccgattcacgtttttctg

SEQ ID NO: 5534429 - DNA, 15 bp, Homo sapiens
tgttcccgtgcctgg

SEQ ID NO: 5534430 - DNA, 11 bp, Homo sapiens
tgttccctaga

SEQ ID NO: 5534431 - DNA, 14 bp, Homo sapiens
tgttccctagagag

SEQ ID NO: 5534432 - DNA, 18 bp, Homo sapiens
tgttccctagagagaata

SEQ ID NO: 5534433 - DNA, 21 bp, Homo sapiens
tgttccctagagagaataaat

SEQ ID NO: 5534434 - DNA, 23 bp, Homo sapiens
tgttccctagagagaataaattg

SEQ ID NO: 5534435 - DNA, 21 bp, Homo sapiens
tgttccctatttttctctcct

SEQ ID NO: 5534436 - DNA, 23 bp, Homo sapiens
tgttccctatttttctctcctgt

SEQ ID NO: 5534437 - DNA, 21 bp, Homo sapiens
tgttccctcattctgcattaa

SEQ ID NO: 5534438 - DNA, 15 bp, Homo sapiens
tgttccctccaggca

SEQ ID NO: 5534439 - DNA, 14 bp, Homo sapiens
tgttccctcctggt

SEQ ID NO: 5534440 - DNA, 16 bp, Homo sapiens
tgttccctctgctcct

SEQ ID NO: 5534441 - DNA, 15 bp, Homo sapiens
tgttccctctggctt

SEQ ID NO: 5534442 - DNA, 12 bp, Homo sapiens
tgttccctgcac

SEQ ID NO: 5534443 - DNA, 14 bp, Homo sapiens
tgttccctgcaccc

SEQ ID NO: 5534444 - DNA, 12 bp, Homo sapiens
tgttccctgctg

SEQ ID NO: 5534445 - DNA, 14 bp, Homo sapiens
tgttccctgctggg

SEQ ID NO: 5534446 - DNA, 14 bp, Homo sapiens
tgttcccttcctct

SEQ ID NO: 5534447 - DNA, 20 bp, Homo sapiens
tgttcccttcctcttcctgc

SEQ ID NO: 5534448 - DNA, 15 bp, Homo sapiens
tgttccctttgagtc

SEQ ID NO: 5534449 - DNA, 13 bp, Homo sapiens
tgttccctttgcc

SEQ ID NO: 5534450 - DNA, 15 bp, Homo sapiens
tgttccctttgcctt

SEQ ID NO: 5534451 - DNA, 22 bp, Homo sapiens
tgttccctttgccttaaacctg

SEQ ID NO: 5534452 - DNA, 20 bp, Homo sapiens
tgttccctttgtctttcaaa

SEQ ID NO: 5534453 - DNA, 15 bp, Homo sapiens
tgttccgtgccaggc

SEQ ID NO: 5534454 - DNA, 16 bp, Homo sapiens
tgttccgtgccaggca

SEQ ID NO: 5534455 - DNA, 16 bp, Homo sapiens
tgttccgttcatctga

SEQ ID NO: 5534456 - DNA, 20 bp, Homo sapiens
tgttccgttcatctgaggag

SEQ ID NO: 5534457 - DNA, 24 bp, Homo sapiens
tgttccgttcatctgaggagtcca

SEQ ID NO: 5534458 - DNA, 15 bp, Homo sapiens
tgttcctaagttctt

SEQ ID NO: 5534459 - DNA, 15 bp, Homo sapiens
tgttcctacagcccc

SEQ ID NO: 5534460 - DNA, 19 bp, Homo sapiens
tgttcctatggaaacattt

SEQ ID NO: 5534461 - DNA, 22 bp, Homo sapiens
tgttcctcaaagcttggattaa

SEQ ID NO: 5534462 - DNA, 23 bp, Homo sapiens
tgttcctcaccaataacttcaga

SEQ ID NO: 5534463 - DNA, 16 bp, Homo sapiens
tgttcctcccctgtag

SEQ ID NO: 5534464 - DNA, 13 bp, Homo sapiens
tgttcctcctgct

SEQ ID NO: 5534465 - DNA, 19 bp, Homo sapiens
tgttcctcgggatgaaaag

SEQ ID NO: 5534466 - DNA, 23 bp, Homo sapiens
tgttcctcgggatgaaaagccat

SEQ ID NO: 5534467 - DNA, 19 bp, Homo sapiens
tgttcctcggtgggccaga

SEQ ID NO: 5534468 - DNA, 21 bp, Homo sapiens
tgttcctcggtgggccagagc

SEQ ID NO: 5534469 - DNA, 23 bp, Homo sapiens
tgttcctcggtgggccagagctg

SEQ ID NO: 5534470 - DNA, 16 bp, Homo sapiens
tgttcctctatacttt

SEQ ID NO: 5534471 - DNA, 23 bp, Homo sapiens
tgttcctctatactttgttctgt

SEQ ID NO: 5534472 - DNA, 19 bp, Homo sapiens
tgttcctgaaatgtgtttc

SEQ ID NO: 5534473 - DNA, 18 bp, Homo sapiens
tgttcctgaagctgctgt

SEQ ID NO: 5534474 - DNA, 21 bp, Homo sapiens
tgttcctgaagctgctgtgtc

SEQ ID NO: 5534475 - DNA, 22 bp, Homo sapiens
tgttcctgacactcaataaaca

SEQ ID NO: 5534476 - DNA, 22 bp, Homo sapiens
tgttcctgactgttctcttact

SEQ ID NO: 5534477 - DNA, 22 bp, Homo sapiens
tgttcctgatttttcatatgtg

SEQ ID NO: 5534478 - DNA, 21 bp, Homo sapiens
tgttcctgcctccttgatatt

SEQ ID NO: 5534479 - DNA, 13 bp, Homo sapiens
tgttcctgctctt

SEQ ID NO: 5534480 - DNA, 11 bp, Homo sapiens
tgttcctgctg

SEQ ID NO: 5534481 - DNA, 12 bp, Homo sapiens
tgttcctgctgc

SEQ ID NO: 5534482 - DNA, 12 bp, Homo sapiens
tgttcctgctgt

SEQ ID NO: 5534483 - DNA, 18 bp, Homo sapiens
tgttcctgctgtatttcc

SEQ ID NO: 5534484 - DNA, 16 bp, Homo sapiens
tgttcctgctttctct

SEQ ID NO: 5534485 - DNA, 11 bp, Homo sapiens
tgttcctggaa

SEQ ID NO: 5534486 - DNA, 23 bp, Homo sapiens
tgttcctggacaccacccagagc

SEQ ID NO: 5534487 - DNA, 21 bp, Homo sapiens
tgttcctggcaatagtgtgtt

SEQ ID NO: 5534488 - DNA, 14 bp, Homo sapiens
tgttcctggctgat

SEQ ID NO: 5534489 - DNA, 17 bp, Homo sapiens
tgttcctggctttgaca

SEQ ID NO: 5534490 - DNA, 12 bp, Homo sapiens
tgttcctgtctc

SEQ ID NO: 5534491 - DNA, 17 bp, Homo sapiens
tgttcctgtctcaatag

SEQ ID NO: 5534492 - DNA, 12 bp, Homo sapiens
tgttcctgtgtt

SEQ ID NO: 5534493 - DNA, 18 bp, Homo sapiens
tgttccttcacatcctgt

SEQ ID NO: 5534494 - DNA, 18 bp, Homo sapiens
tgttccttccctgtgcct

SEQ ID NO: 5534495 - DNA, 17 bp, Homo sapiens
tgttccttcctgcagac

SEQ ID NO: 5534496 - DNA, 19 bp, Homo sapiens
tgttccttcctgcagacct

SEQ ID NO: 5534497 - DNA, 20 bp, Homo sapiens
tgttccttcctgcagacctg

SEQ ID NO: 5534498 - DNA, 22 bp, Homo sapiens
tgttccttcctgcagacctggc

SEQ ID NO: 5534499 - DNA, 14 bp, Homo sapiens
tgttccttctgtga

SEQ ID NO: 5534500 - DNA, 15 bp, Homo sapiens
tgttccttctgtgaa

SEQ ID NO: 5534501 - DNA, 19 bp, Homo sapiens
tgttccttctgtgaagaag

SEQ ID NO: 5534502 - DNA, 23 bp, Homo sapiens
tgttccttgcttttatagttgta

SEQ ID NO: 5534503 - DNA, 17 bp, Homo sapiens
tgttccttggcagtgga

SEQ ID NO: 5534504 - DNA, 12 bp, Homo sapiens
tgttccttttga

SEQ ID NO: 5534505 - DNA, 14 bp, Homo sapiens
tgttccttttgaaa

SEQ ID NO: 5534506 - DNA, 21 bp, Homo sapiens
tgttcgattacgtcatcaaaa

SEQ ID NO: 5534507 - DNA, 14 bp, Homo sapiens
tgttcgctggctga

SEQ ID NO: 5534508 - DNA, 14 bp, Homo sapiens
tgttcgcttggctc

SEQ ID NO: 5534509 - DNA, 21 bp, Homo sapiens
tgttcggaaggggttcctcaa

SEQ ID NO: 5534510 - DNA, 13 bp, Homo sapiens
tgttcggagctct

SEQ ID NO: 5534511 - DNA, 22 bp, Homo sapiens
tgttcgggccaaggacctgaga

SEQ ID NO: 5534512 - DNA, 21 bp, Homo sapiens
tgttcgggggagcagagagag

SEQ ID NO: 5534513 - DNA, 18 bp, Homo sapiens
tgttcggttttgttgttc

SEQ ID NO: 5534514 - DNA, 17 bp, Homo sapiens
tgttcggtttttttcct

SEQ ID NO: 5534515 - DNA, 20 bp, Homo sapiens
tgttcgtattctattcaaaa

SEQ ID NO: 5534516 - DNA, 19 bp, Homo sapiens
tgttcgtggagccacaggc

SEQ ID NO: 5534517 - DNA, 14 bp, Homo sapiens
tgttcgttctgata

SEQ ID NO: 5534518 - DNA, 21 bp, Homo sapiens
tgttcgtttcatcaggctctg

SEQ ID NO: 5534519 - DNA, 22 bp, Homo sapiens
tgttcgtttccatcatgtctgt

SEQ ID NO: 5534520 - DNA, 14 bp, Homo sapiens
tgttctaaagctct

SEQ ID NO: 5534521 - DNA, 16 bp, Homo sapiens
tgttctaacatgtaat

SEQ ID NO: 5534522 - DNA, 16 bp, Homo sapiens
tgttctaacctttaca

SEQ ID NO: 5534523 - DNA, 17 bp, Homo sapiens
tgttctaactcttagaa

SEQ ID NO: 5534524 - DNA, 16 bp, Homo sapiens
tgttctaagatgtgat

SEQ ID NO: 5534525 - DNA, 12 bp, Homo sapiens
tgttctaaggct

SEQ ID NO: 5534526 - DNA, 11 bp, Homo sapiens
tgttctaaggg

SEQ ID NO: 5534527 - DNA, 16 bp, Homo sapiens
tgttctaagtttctaa

SEQ ID NO: 5534528 - DNA, 18 bp, Homo sapiens
tgttctaagtttctaaga

SEQ ID NO: 5534529 - DNA, 19 bp, Homo sapiens
tgttctaatactttgttta

SEQ ID NO: 5534530 - DNA, 16 bp, Homo sapiens
tgttctacatgaggac

SEQ ID NO: 5534531 - DNA, 17 bp, Homo sapiens
tgttctacatggctttg

SEQ ID NO: 5534532 - DNA, 18 bp, Homo sapiens
tgttctacccgttccaaa

SEQ ID NO: 5534533 - DNA, 22 bp, Homo sapiens
tgttctaccgtggatttgtact

SEQ ID NO: 5534534 - DNA, 13 bp, Homo sapiens
tgttctacttgat

SEQ ID NO: 5534535 - DNA, 14 bp, Homo sapiens
tgttctagaatcat

SEQ ID NO: 5534536 - DNA, 20 bp, Homo sapiens
tgttctagaatcatgtattt

SEQ ID NO: 5534537 - DNA, 17 bp, Homo sapiens
tgttctagacttcccca

SEQ ID NO: 5534538 - DNA, 19 bp, Homo sapiens
tgttctagacttccccatc

SEQ ID NO: 5534539 - DNA, 19 bp, Homo sapiens
tgttctagagtgacaggca

SEQ ID NO: 5534540 - DNA, 17 bp, Homo sapiens
tgttctagtactgtatt

SEQ ID NO: 5534541 - DNA, 16 bp, Homo sapiens
tgttctagttttcagt

SEQ ID NO: 5534542 - DNA, 23 bp, Homo sapiens
tgttctatatgcatttaattctg

SEQ ID NO: 5534543 - DNA, 13 bp, Homo sapiens
tgttctatccaaa

SEQ ID NO: 5534544 - DNA, 19 bp, Homo sapiens
tgttctatccaaacatgta

SEQ ID NO: 5534545 - DNA, 14 bp, Homo sapiens
tgttctatgaacaa

SEQ ID NO: 5534546 - DNA, 20 bp, Homo sapiens
tgttctatggaccaaatgta

SEQ ID NO: 5534547 - DNA, 21 bp, Homo sapiens
tgttctatggaccaaatgtaa

SEQ ID NO: 5534548 - DNA, 22 bp, Homo sapiens
tgttctatggaccaaatgtaaa

SEQ ID NO: 5534549 - DNA, 18 bp, Homo sapiens
tgttctatggttatgaaa

SEQ ID NO: 5534550 - DNA, 19 bp, Homo sapiens
tgttctatttaacaactgg

SEQ ID NO: 5534551 - DNA, 21 bp, Homo sapiens
tgttctatttcagtgccaata

SEQ ID NO: 5534552 - DNA, 12 bp, Homo sapiens
tgttctcaacac

SEQ ID NO: 5534553 - DNA, 16 bp, Homo sapiens
tgttctcaacacacag

SEQ ID NO: 5534554 - DNA, 19 bp, Homo sapiens
tgttctcaacacacagtat

SEQ ID NO: 5534555 - DNA, 18 bp, Homo sapiens
tgttctcaatgcttttct

SEQ ID NO: 5534556 - DNA, 13 bp, Homo sapiens
tgttctcacacca

SEQ ID NO: 5534557 - DNA, 22 bp, Homo sapiens
tgttctcacactggtctgctgt

SEQ ID NO: 5534558 - DNA, 20 bp, Homo sapiens
tgttctcacataacagagta

SEQ ID NO: 5534559 - DNA, 22 bp, Homo sapiens
tgttctcagagcactgtgttca

SEQ ID NO: 5534560 - DNA, 13 bp, Homo sapiens
tgttctcagagct

SEQ ID NO: 5534561 - DNA, 22 bp, Homo sapiens
tgttctcagagctccacagaag

SEQ ID NO: 5534562 - DNA, 11 bp, Homo sapiens
tgttctcagca

SEQ ID NO: 5534563 - DNA, 14 bp, Homo sapiens
tgttctcagctccc

SEQ ID NO: 5534564 - DNA, 18 bp, Homo sapiens
tgttctcagctccccctg

SEQ ID NO: 5534565 - DNA, 20 bp, Homo sapiens
tgttctcagctccccctgtc

SEQ ID NO: 5534566 - DNA, 12 bp, Homo sapiens
tgttctcagggg

SEQ ID NO: 5534567 - DNA, 22 bp, Homo sapiens
tgttctcaggggtgctggggca

SEQ ID NO: 5534568 - DNA, 17 bp, Homo sapiens
tgttctcatagaggaaa

SEQ ID NO: 5534569 - DNA, 15 bp, Homo sapiens
tgttctcatgaagca

SEQ ID NO: 5534570 - DNA, 21 bp, Homo sapiens
tgttctcatgaagcaggaggc

SEQ ID NO: 5534571 - DNA, 16 bp, Homo sapiens
tgttctcatgtaagaa

SEQ ID NO: 5534572 - DNA, 22 bp, Homo sapiens
tgttctccactgacacaaaaga

SEQ ID NO: 5534573 - DNA, 21 bp, Homo sapiens
tgttctccagtcattatgtta

SEQ ID NO: 5534574 - DNA, 16 bp, Homo sapiens
tgttctccattttcaa

SEQ ID NO: 5534575 - DNA, 17 bp, Homo sapiens
tgttctcccttcggtgg

SEQ ID NO: 5534576 - DNA, 22 bp, Homo sapiens
tgttctccctttctctctcctc

SEQ ID NO: 5534577 - DNA, 20 bp, Homo sapiens
tgttctccgggtgtggcctc

SEQ ID NO: 5534578 - DNA, 22 bp, Homo sapiens
tgttctccgggtgtggcctcag

SEQ ID NO: 5534579 - DNA, 23 bp, Homo sapiens
tgttctccgggtgtggcctcagc

SEQ ID NO: 5534580 - DNA, 16 bp, Homo sapiens
tgttctccgtccctgc

SEQ ID NO: 5534581 - DNA, 19 bp, Homo sapiens
tgttctcctaatgctctga

SEQ ID NO: 5534582 - DNA, 20 bp, Homo sapiens
tgttctcctatatcctcctt

SEQ ID NO: 5534583 - DNA, 11 bp, Homo sapiens
tgttctcctcc

SEQ ID NO: 5534584 - DNA, 20 bp, Homo sapiens
tgttctcctccaaatgctgt

SEQ ID NO: 5534585 - DNA, 18 bp, Homo sapiens
tgttctcctcgtccatca

SEQ ID NO: 5534586 - DNA, 13 bp, Homo sapiens
tgttctcctgctg

SEQ ID NO: 5534587 - DNA, 21 bp, Homo sapiens
tgttctcctgctgctccctca

SEQ ID NO: 5534588 - DNA, 18 bp, Homo sapiens
tgttctcctgtccctcca

SEQ ID NO: 5534589 - DNA, 17 bp, Homo sapiens
tgttctcggagtgtgta

SEQ ID NO: 5534590 - DNA, 18 bp, Homo sapiens
tgttctcgttttgaaact

SEQ ID NO: 5534591 - DNA, 20 bp, Homo sapiens
tgttctctatcatttaataa

SEQ ID NO: 5534592 - DNA, 12 bp, Homo sapiens
tgttctctcccc

SEQ ID NO: 5534593 - DNA, 15 bp, Homo sapiens
tgttctctcttctcc

SEQ ID NO: 5534594 - DNA, 16 bp, Homo sapiens
tgttctctcttctcca

SEQ ID NO: 5534595 - DNA, 12 bp, Homo sapiens
tgttctctgaat

SEQ ID NO: 5534596 - DNA, 22 bp, Homo sapiens
tgttctctgaatgagcctttgt

SEQ ID NO: 5534597 - DNA, 18 bp, Homo sapiens
tgttctctgaggacacta

SEQ ID NO: 5534598 - DNA, 13 bp, Homo sapiens
tgttctctgccct

SEQ ID NO: 5534599 - DNA, 16 bp, Homo sapiens
tgttctctgccctcca

SEQ ID NO: 5534600 - DNA, 19 bp, Homo sapiens
tgttctctgccctccaaga

SEQ ID NO: 5534601 - DNA, 22 bp, Homo sapiens
tgttctctgcttgacagactca

SEQ ID NO: 5534602 - DNA, 16 bp, Homo sapiens
tgttctctggaacctg

SEQ ID NO: 5534603 - DNA, 13 bp, Homo sapiens
tgttctctgggag

SEQ ID NO: 5534604 - DNA, 13 bp, Homo sapiens
tgttgtcctccca

SEQ ID NO: 5534605 - DNA, 14 bp, Homo sapiens
tgttgtcctcccag

SEQ ID NO: 5534606 - DNA, 16 bp, Homo sapiens
tgttgtcctcccagga

SEQ ID NO: 5534607 - DNA, 21 bp, Homo sapiens
tgttgtcctgtgtcatctgtc

SEQ ID NO: 5534608 - DNA, 17 bp, Homo sapiens
tgttgtccttttcatag

SEQ ID NO: 5534609 - DNA, 20 bp, Homo sapiens
tgttgtcgtaaagatttggg

SEQ ID NO: 5534610 - DNA, 14 bp, Homo sapiens
tgttgtctaagaaa

SEQ ID NO: 5534611 - DNA, 21 bp, Homo sapiens
tgttgtctcatagaactgcct

SEQ ID NO: 5534612 - DNA, 17 bp, Homo sapiens
tgttgtctcttctcctt

SEQ ID NO: 5534613 - DNA, 23 bp, Homo sapiens
tgttgtctctttcctacaagtta

SEQ ID NO: 5534614 - DNA, 13 bp, Homo sapiens
tgttgtctgcaac

SEQ ID NO: 5534615 - DNA, 20 bp, Homo sapiens
tgttgtctgcgcctgaaaag

SEQ ID NO: 5534616 - DNA, 13 bp, Homo sapiens
tgttgtctgtgca

SEQ ID NO: 5534617 - DNA, 14 bp, Homo sapiens
tgttgtcttagcat

SEQ ID NO: 5534618 - DNA, 16 bp, Homo sapiens
tgttgtcttgaaagat

SEQ ID NO: 5534619 - DNA, 20 bp, Homo sapiens
tgttgtgaataattacagtg

SEQ ID NO: 5534620 - DNA, 13 bp, Homo sapiens
tgttgtgaatgtc

SEQ ID NO: 5534621 - DNA, 21 bp, Homo sapiens
tgttgtgacacatcaagcttt

SEQ ID NO: 5534622 - DNA, 22 bp, Homo sapiens
tgttgtgacacatcaagctttt

SEQ ID NO: 5534623 - DNA, 17 bp, Homo sapiens
tgttgtgactggcaccc

SEQ ID NO: 5534624 - DNA, 22 bp, Homo sapiens
tgttgtgctgggagcaggactg

SEQ ID NO: 5534625 - DNA, 14 bp, Homo sapiens
tgttgtggaagcat

SEQ ID NO: 5534626 - DNA, 20 bp, Homo sapiens
tgttgtggtactggcaataa

SEQ ID NO: 5534627 - DNA, 23 bp, Homo sapiens
tgttgtggtactggcaataagat

SEQ ID NO: 5534628 - DNA, 16 bp, Homo sapiens
tgttgtggtttgttgc

SEQ ID NO: 5534629 - DNA, 17 bp, Homo sapiens
tgttgtgtaataacaga

SEQ ID NO: 5534630 - DNA, 16 bp, Homo sapiens
tgttgtgtacagactt

SEQ ID NO: 5534631 - DNA, 19 bp, Homo sapiens
tgttgtgtataatttacct

SEQ ID NO: 5534632 - DNA, 18 bp, Homo sapiens
tgttgtgtgtatatgtat

SEQ ID NO: 5534633 - DNA, 14 bp, Homo sapiens
tgttgtgtgtggga

SEQ ID NO: 5534634 - DNA, 16 bp, Homo sapiens
tgttgtgtgtgggagt

SEQ ID NO: 5534635 - DNA, 21 bp, Homo sapiens
tgttgtgttcctggctgatga

SEQ ID NO: 5534636 - DNA, 16 bp, Homo sapiens
tgttgtgttctttata

SEQ ID NO: 5534637 - DNA, 12 bp, Homo sapiens
tgttgttactgg

SEQ ID NO: 5534638 - DNA, 21 bp, Homo sapiens
tgttgttactgggtaggttct

SEQ ID NO: 5534639 - DNA, 21 bp, Homo sapiens
tgttgttatcatttaagattt

SEQ ID NO: 5534640 - DNA, 19 bp, Homo sapiens
tgttgttatgatgtgctta

SEQ ID NO: 5534641 - DNA, 22 bp, Homo sapiens
tgttgttccaaatgtgtataat

SEQ ID NO: 5534642 - DNA, 14 bp, Homo sapiens
tgttgttccatttt

SEQ ID NO: 5534643 - DNA, 22 bp, Homo sapiens
tgttgttccattttatgcagaa

SEQ ID NO: 5534644 - DNA, 15 bp, Homo sapiens
tgttgttcccacaca

SEQ ID NO: 5534645 - DNA, 14 bp, Homo sapiens
tgttgttcctggct

SEQ ID NO: 5534646 - DNA, 16 bp, Homo sapiens
tgttgttcttacaaac

SEQ ID NO: 5534647 - DNA, 23 bp, Homo sapiens
tgttgttcttggcaataaatttt

SEQ ID NO: 5534648 - DNA, 18 bp, Homo sapiens
tgttgttctttcagaaag

SEQ ID NO: 5534649 - DNA, 16 bp, Homo sapiens
tgttgttgctgctgtt

SEQ ID NO: 5534650 - DNA, 19 bp, Homo sapiens
tgttgttggcaagctgcag

SEQ ID NO: 5534651 - DNA, 16 bp, Homo sapiens
tgttgttgttgctgct

SEQ ID NO: 5534652 - DNA, 14 bp, Homo sapiens
tgttgttgttttat

SEQ ID NO: 5534653 - DNA, 18 bp, Homo sapiens
tgttgtttaatctgaact

SEQ ID NO: 5534654 - DNA, 13 bp, Homo sapiens
tgttgtttaatgt

SEQ ID NO: 5534655 - DNA, 13 bp, Homo sapiens
tgttgtttacaat

SEQ ID NO: 5534656 - DNA, 21 bp, Homo sapiens
tgttgtttataataaaaatat

SEQ ID NO: 5534657 - DNA, 13 bp, Homo sapiens
tgttgtttcagtg

SEQ ID NO: 5534658 - DNA, 14 bp, Homo sapiens
tgttgtttcagtga

SEQ ID NO: 5534659 - DNA, 21 bp, Homo sapiens
tgttgtttcagtgaatatgcc

SEQ ID NO: 5534660 - DNA, 21 bp, Homo sapiens
tgttgtttctataaatgacta

SEQ ID NO: 5534661 - DNA, 15 bp, Homo sapiens
tgttgtttcttaaat

SEQ ID NO: 5534662 - DNA, 13 bp, Homo sapiens
tgttgtttctttc

SEQ ID NO: 5534663 - DNA, 15 bp, Homo sapiens
tgttgtttctttcta

SEQ ID NO: 5534664 - DNA, 11 bp, Homo sapiens
tgttgtttgcc

SEQ ID NO: 5534665 - DNA, 13 bp, Homo sapiens
tgttgtttgcttt

SEQ ID NO: 5534666 - DNA, 12 bp, Homo sapiens
tgttgtttgtaa

SEQ ID NO: 5534667 - DNA, 12 bp, Homo sapiens
tgttgtttgtat

SEQ ID NO: 5534668 - DNA, 12 bp, Homo sapiens
tgttgtttgttt

SEQ ID NO: 5534669 - DNA, 22 bp, Homo sapiens
tgttgttttaacctcccctctc

SEQ ID NO: 5534670 - DNA, 13 bp, Homo sapiens
tgttgttttctct

SEQ ID NO: 5534671 - DNA, 16 bp, Homo sapiens
tgttgttttgtatgag

SEQ ID NO: 5534672 - DNA, 21 bp, Homo sapiens
tgttgtttttaaaaagaaaat

SEQ ID NO: 5534673 - DNA, 18 bp, Homo sapiens
tgttgtttttaagtcctg

SEQ ID NO: 5534674 - DNA, 22 bp, Homo sapiens
tgtttaaaaaccgaataaatgt

SEQ ID NO: 5534675 - DNA, 20 bp, Homo sapiens
tgtttaaaaatacacatgga

SEQ ID NO: 5534676 - DNA, 20 bp, Homo sapiens
tgtttaaaaattgaaaaaag

SEQ ID NO: 5534677 - DNA, 16 bp, Homo sapiens
tgtttaaaaatttata

SEQ ID NO: 5534678 - DNA, 17 bp, Homo sapiens
tgtttaaaaatttataa

SEQ ID NO: 5534679 - DNA, 18 bp, Homo sapiens
tgtttaaaaatttataac

SEQ ID NO: 5534680 - DNA, 20 bp, Homo sapiens
tgtttaaaacaccttctata

SEQ ID NO: 5534681 - DNA, 21 bp, Homo sapiens
tgtttaaaactcagaatataa

SEQ ID NO: 5534682 - DNA, 18 bp, Homo sapiens
tgtttaaaacttcagttt

SEQ ID NO: 5534683 - DNA, 18 bp, Homo sapiens
tgtttaaaagaaatatat

SEQ ID NO: 5534684 - DNA, 14 bp, Homo sapiens
tgtttaaaaggatt

SEQ ID NO: 5534685 - DNA, 12 bp, Homo sapiens
tgtttaaaataa

SEQ ID NO: 5534686 - DNA, 15 bp, Homo sapiens
tgtttaaaataaaat

SEQ ID NO: 5534687 - DNA, 21 bp, Homo sapiens
tgtttaaaatggcatttagca

SEQ ID NO: 5534688 - DNA, 13 bp, Homo sapiens
tgtttaaaatgta

SEQ ID NO: 5534689 - DNA, 14 bp, Homo sapiens
tgtttaaaatgtaa

SEQ ID NO: 5534690 - DNA, 22 bp, Homo sapiens
tgtttaaaatgtaatttaaatg

SEQ ID NO: 5534691 - DNA, 19 bp, Homo sapiens
tgtttaaacaatctttcat

SEQ ID NO: 5534692 - DNA, 23 bp, Homo sapiens
tgtttaaacacttatcttctgga

SEQ ID NO: 5534693 - DNA, 21 bp, Homo sapiens
tgtttaaacccaagtgctgca

SEQ ID NO: 5534694 - DNA, 19 bp, Homo sapiens
tgtttaaactttgacaaaa

SEQ ID NO: 5534695 - DNA, 20 bp, Homo sapiens
tgtttaaagaaatatttgga

SEQ ID NO: 5534696 - DNA, 16 bp, Homo sapiens
tgtttaaagaataaag

SEQ ID NO: 5534697 - DNA, 21 bp, Homo sapiens
tgtttaaagagaggttataga

SEQ ID NO: 5534698 - DNA, 13 bp, Homo sapiens
tgtttaaagtggc

SEQ ID NO: 5534699 - DNA, 22 bp, Homo sapiens
tgtttaaagtgtacttataaac

SEQ ID NO: 5534700 - DNA, 12 bp, Homo sapiens
tgtttaaagttc

SEQ ID NO: 5534701 - DNA, 13 bp, Homo sapiens
tgtttaaagttca

SEQ ID NO: 5534702 - DNA, 14 bp, Homo sapiens
tgtttaaataaagt

SEQ ID NO: 5534703 - DNA, 17 bp, Homo sapiens
tgtttaaataaagtatc

SEQ ID NO: 5534704 - DNA, 22 bp, Homo sapiens
tgtttaaataaagtatcatgca

SEQ ID NO: 5534705 - DNA, 17 bp, Homo sapiens
tgtttaaatagcctaaa

SEQ ID NO: 5534706 - DNA, 18 bp, Homo sapiens
tgtttaaatagcctaaat

SEQ ID NO: 5534707 - DNA, 11 bp, Homo sapiens
tgtttaaatat

SEQ ID NO: 5534708 - DNA, 13 bp, Homo sapiens
tgtttaaatataa

SEQ ID NO: 5534709 - DNA, 22 bp, Homo sapiens
tgtttaaatataaatctgatca

SEQ ID NO: 5534710 - DNA, 16 bp, Homo sapiens
tgtttaaattatttta

SEQ ID NO: 5534711 - DNA, 13 bp, Homo sapiens
tgtttaacaaatc

SEQ ID NO: 5534712 - DNA, 13 bp, Homo sapiens
tgtttaactggca

SEQ ID NO: 5534713 - DNA, 16 bp, Homo sapiens
tgtttaactggcatgg

SEQ ID NO: 5534714 - DNA, 15 bp, Homo sapiens
tgtttaactgtgcat

SEQ ID NO: 5534715 - DNA, 20 bp, Homo sapiens
tgtttaacttaatcaattaa

SEQ ID NO: 5534716 - DNA, 18 bp, Homo sapiens
tgtttaagaaaagtattt

SEQ ID NO: 5534717 - DNA, 12 bp, Homo sapiens
tgtttaagagac

SEQ ID NO: 5534718 - DNA, 17 bp, Homo sapiens
tgtttaagatatatttc

SEQ ID NO: 5534719 - DNA, 16 bp, Homo sapiens
tgtttaagatctgttt

SEQ ID NO: 5534720 - DNA, 14 bp, Homo sapiens
tgtttaagatttaa

SEQ ID NO: 5534721 - DNA, 22 bp, Homo sapiens
tgtttaagatttaatttgccaa

SEQ ID NO: 5534722 - DNA, 19 bp, Homo sapiens
tgtttaagcagaattggaa

SEQ ID NO: 5534723 - DNA, 21 bp, Homo sapiens
tgtttaagtattaacttacaa

SEQ ID NO: 5534724 - DNA, 21 bp, Homo sapiens
tgtttaagtgaattgacttat

SEQ ID NO: 5534725 - DNA, 15 bp, Homo sapiens
tgtttaagtggcttt

SEQ ID NO: 5534726 - DNA, 16 bp, Homo sapiens
tgtttaagtgtttaga

SEQ ID NO: 5534727 - DNA, 14 bp, Homo sapiens
tgtttaataaagct

SEQ ID NO: 5534728 - DNA, 16 bp, Homo sapiens
tgtttaataaagcttt

SEQ ID NO: 5534729 - DNA, 17 bp, Homo sapiens
tgtttaataaagcttta

SEQ ID NO: 5534730 - DNA, 18 bp, Homo sapiens
tgtttaataaagctttat

SEQ ID NO: 5534731 - DNA, 19 bp, Homo sapiens
tgtttaataaagctttata

SEQ ID NO: 5534732 - DNA, 14 bp, Homo sapiens
tgtttaataagtat

SEQ ID NO: 5534733 - DNA, 18 bp, Homo sapiens
tgtttaatagtatatcta

SEQ ID NO: 5534734 - DNA, 19 bp, Homo sapiens
tgtttaatatctgactgaa

SEQ ID NO: 5534735 - DNA, 16 bp, Homo sapiens
tgtttaatattgagaa

SEQ ID NO: 5534736 - DNA, 20 bp, Homo sapiens
tgtttaatattgagaaagaa

SEQ ID NO: 5534737 - DNA, 24 bp, Homo sapiens
tgtttaatcatataaatagaatgt

SEQ ID NO: 5534738 - DNA, 14 bp, Homo sapiens
tgtttaatctgtta

SEQ ID NO: 5534739 - DNA, 14 bp, Homo sapiens
tgtttaatcttttt

SEQ ID NO: 5534740 - DNA, 14 bp, Homo sapiens
tgtttaatgtgaac

SEQ ID NO: 5534741 - DNA, 15 bp, Homo sapiens
tgtttaatgtgaact

SEQ ID NO: 5534742 - DNA, 23 bp, Homo sapiens
tgtttaatgtgaactctcccctc

SEQ ID NO: 5534743 - DNA, 19 bp, Homo sapiens
tgtttaatgtgaacttgta

SEQ ID NO: 5534744 - DNA, 22 bp, Homo sapiens
tgtttaatgtgaacttgtagct

SEQ ID NO: 5534745 - DNA, 23 bp, Homo sapiens
tgtttaatgtgaacttgtagctg

SEQ ID NO: 5534746 - DNA, 13 bp, Homo sapiens
tgtttaatgttat

SEQ ID NO: 5534747 - DNA, 15 bp, Homo sapiens
tgtttaatgttcatt

SEQ ID NO: 5534748 - DNA, 15 bp, Homo sapiens
tgtttaatttcttca

SEQ ID NO: 5534749 - DNA, 23 bp, Homo sapiens
tgtttaatttcttcaaaatgtat

SEQ ID NO: 5534750 - DNA, 14 bp, Homo sapiens
tgtttaatttgctt

SEQ ID NO: 5534751 - DNA, 17 bp, Homo sapiens
tgtttaatttgcttcct

SEQ ID NO: 5534752 - DNA, 18 bp, Homo sapiens
tgtttaatttttatttct

SEQ ID NO: 5534753 - DNA, 19 bp, Homo sapiens
tgtttacaaaatcaggtaa

SEQ ID NO: 5534754 - DNA, 12 bp, Homo sapiens
tgtttacaaaca

SEQ ID NO: 5534755 - DNA, 19 bp, Homo sapiens
tgtttacaacacagtagtg

SEQ ID NO: 5534756 - DNA, 23 bp, Homo sapiens
tgtttacaacacagtagtgttct

SEQ ID NO: 5534757 - DNA, 17 bp, Homo sapiens
tgtttacaacatcacca

SEQ ID NO: 5534758 - DNA, 16 bp, Homo sapiens
tgtttacacacgtgca

SEQ ID NO: 5534759 - DNA, 16 bp, Homo sapiens
tgtttacactgtcaaa

SEQ ID NO: 5534760 - DNA, 13 bp, Homo sapiens
tgtttacagaact

SEQ ID NO: 5534761 - DNA, 14 bp, Homo sapiens
tgtttacagaactg

SEQ ID NO: 5534762 - DNA, 23 bp, Homo sapiens
tgtttacagacaaggcaggcctg

SEQ ID NO: 5534763 - DNA, 22 bp, Homo sapiens
tgtttacagataattacctact

SEQ ID NO: 5534764 - DNA, 17 bp, Homo sapiens
tgtttacagatccccaa

SEQ ID NO: 5534765 - DNA, 20 bp, Homo sapiens
tgtttacagggagcctcctg

SEQ ID NO: 5534766 - DNA, 23 bp, Homo sapiens
tgtttacatatctgtcccctgct

SEQ ID NO: 5534767 - DNA, 15 bp, Homo sapiens
tgtttacatgtgtag

SEQ ID NO: 5534768 - DNA, 17 bp, Homo sapiens
tgtttacatttactgaa

SEQ ID NO: 5534769 - DNA, 20 bp, Homo sapiens
tgtttacatttactgaaatg

SEQ ID NO: 5534770 - DNA, 17 bp, Homo sapiens
tgtttacatttgatgca

SEQ ID NO: 5534771 - DNA, 18 bp, Homo sapiens
tgtttacattttctttca

SEQ ID NO: 5534772 - DNA, 20 bp, Homo sapiens
tgtttacattttctttcata

SEQ ID NO: 5534773 - DNA, 16 bp, Homo sapiens
tgtttaccctccctgt

SEQ ID NO: 5534774 - DNA, 19 bp, Homo sapiens
tgtttaccctccctgtccc

SEQ ID NO: 5534775 - DNA, 22 bp, Homo sapiens
tgtttacctcactggtgcattt

SEQ ID NO: 5534776 - DNA, 22 bp, Homo sapiens
tgtttacgatttcactaggact

SEQ ID NO: 5534777 - DNA, 17 bp, Homo sapiens
tgtttactatagaccaa

SEQ ID NO: 5534778 - DNA, 17 bp, Homo sapiens
tgtttactatgtgccag

SEQ ID NO: 5534779 - DNA, 23 bp, Homo sapiens
tgtttactcaaagtctaacatat

SEQ ID NO: 5534780 - DNA, 13 bp, Homo sapiens
tgtttactcacat

SEQ ID NO: 5534781 - DNA, 14 bp, Homo sapiens
tgtttactcacatt

SEQ ID NO: 5534782 - DNA, 23 bp, Homo sapiens
tgttttaaggatgcttgtacata

SEQ ID NO: 5534783 - DNA, 15 bp, Homo sapiens
tgttttaatctgaaa

SEQ ID NO: 5534784 - DNA, 20 bp, Homo sapiens
tgttttaatctgaaattcta

SEQ ID NO: 5534785 - DNA, 13 bp, Homo sapiens
tgttttaattgta

SEQ ID NO: 5534786 - DNA, 23 bp, Homo sapiens
tgttttaatttaaacacctcctc

SEQ ID NO: 5534787 - DNA, 17 bp, Homo sapiens
tgttttacaaatttttc

SEQ ID NO: 5534788 - DNA, 20 bp, Homo sapiens
tgttttacaagaattgtcca

SEQ ID NO: 5534789 - DNA, 21 bp, Homo sapiens
tgttttacaagaattgtccat

SEQ ID NO: 5534790 - DNA, 19 bp, Homo sapiens
tgttttacaatgatttgta

SEQ ID NO: 5534791 - DNA, 20 bp, Homo sapiens
tgttttacaatgatttgtaa

SEQ ID NO: 5534792 - DNA, 21 bp, Homo sapiens
tgttttacaatgatttgtaaa

SEQ ID NO: 5534793 - DNA, 22 bp, Homo sapiens
tgttttacaatgatttgtaaag

SEQ ID NO: 5534794 - DNA, 23 bp, Homo sapiens
tgttttacagctgcctttcgtga

SEQ ID NO: 5534795 - DNA, 15 bp, Homo sapiens
tgttttaccagctcc

SEQ ID NO: 5534796 - DNA, 22 bp, Homo sapiens
tgttttacgcaaggaaggactt

SEQ ID NO: 5534797 - DNA, 19 bp, Homo sapiens
tgttttacgtctgggagaa

SEQ ID NO: 5534798 - DNA, 14 bp, Homo sapiens
tgttttactgcttt

SEQ ID NO: 5534799 - DNA, 15 bp, Homo sapiens
tgttttactttgttt

SEQ ID NO: 5534800 - DNA, 16 bp, Homo sapiens
tgttttagaaccagcc

SEQ ID NO: 5534801 - DNA, 22 bp, Homo sapiens
tgttttagacaaatactcatgt

SEQ ID NO: 5534802 - DNA, 13 bp, Homo sapiens
tgttttagcatta

SEQ ID NO: 5534803 - DNA, 16 bp, Homo sapiens
tgttttagcatttgta

SEQ ID NO: 5534804 - DNA, 20 bp, Homo sapiens
tgttttagtaaaaaagagaa

SEQ ID NO: 5534805 - DNA, 22 bp, Homo sapiens
tgttttagtaaccagaaatctt

SEQ ID NO: 5534806 - DNA, 14 bp, Homo sapiens
tgttttagtttctg

SEQ ID NO: 5534807 - DNA, 13 bp, Homo sapiens
tgttttataaatg

SEQ ID NO: 5534808 - DNA, 15 bp, Homo sapiens
tgttttataagttca

SEQ ID NO: 5534809 - DNA, 16 bp, Homo sapiens
tgttttatagaggttc

SEQ ID NO: 5534810 - DNA, 12 bp, Homo sapiens
tgttttatatat

SEQ ID NO: 5534811 - DNA, 13 bp, Homo sapiens
tgttttatatatt

SEQ ID NO: 5534812 - DNA, 23 bp, Homo sapiens
tgttttatatattatgtgaagaa

SEQ ID NO: 5534813 - DNA, 14 bp, Homo sapiens
tgttttatatcaaa

SEQ ID NO: 5534814 - DNA, 23 bp, Homo sapiens
tgttttatccttacaatgtgaat

SEQ ID NO: 5534815 - DNA, 16 bp, Homo sapiens
tgttttatcttctata

SEQ ID NO: 5534816 - DNA, 14 bp, Homo sapiens
tgttttatgacatt

SEQ ID NO: 5534817 - DNA, 14 bp, Homo sapiens
tgttttatgactaa

SEQ ID NO: 5534818 - DNA, 19 bp, Homo sapiens
tgttttatgactaatcctt

SEQ ID NO: 5534819 - DNA, 18 bp, Homo sapiens
tgttttatgacttcatta

SEQ ID NO: 5534820 - DNA, 14 bp, Homo sapiens
tgttttatgagaaa

SEQ ID NO: 5534821 - DNA, 15 bp, Homo sapiens
tgttttatgagaaag

SEQ ID NO: 5534822 - DNA, 19 bp, Homo sapiens
tgttttatgagaaagcctt

SEQ ID NO: 5534823 - DNA, 14 bp, Homo sapiens
tgttttatgctact

SEQ ID NO: 5534824 - DNA, 12 bp, Homo sapiens
tgttttatgtca

SEQ ID NO: 5534825 - DNA, 14 bp, Homo sapiens
tgttttatgtcata

SEQ ID NO: 5534826 - DNA, 20 bp, Homo sapiens
tgttttatgtcatactctgt

SEQ ID NO: 5534827 - DNA, 14 bp, Homo sapiens
tgttttatgtgcac

SEQ ID NO: 5534828 - DNA, 14 bp, Homo sapiens
tgttttatgttcta

SEQ ID NO: 5534829 - DNA, 21 bp, Homo sapiens
tgttttatgttgatctgcata

SEQ ID NO: 5534830 - DNA, 17 bp, Homo sapiens
tgttttattactgtttc

SEQ ID NO: 5534831 - DNA, 18 bp, Homo sapiens
tgttttattactgtttct

SEQ ID NO: 5534832 - DNA, 20 bp, Homo sapiens
tgttttattcaccatcatgt

SEQ ID NO: 5534833 - DNA, 14 bp, Homo sapiens
tgttttattcctgt

SEQ ID NO: 5534834 - DNA, 22 bp, Homo sapiens
tgttttattggggaattaaata

SEQ ID NO: 5534835 - DNA, 21 bp, Homo sapiens
tgttttattttaattcagttg

SEQ ID NO: 5534836 - DNA, 23 bp, Homo sapiens
tgttttattttttattgttttca

SEQ ID NO: 5534837 - DNA, 20 bp, Homo sapiens
tgttttatttttttaccaat

SEQ ID NO: 5534838 - DNA, 16 bp, Homo sapiens
tgttttcaaaaaaaca

SEQ ID NO: 5534839 - DNA, 13 bp, Homo sapiens
tgttttcaaatgg

SEQ ID NO: 5534840 - DNA, 20 bp, Homo sapiens
tgttttcaacctagaaacct

SEQ ID NO: 5534841 - DNA, 16 bp, Homo sapiens
tgttttcaagtgtaaa

SEQ ID NO: 5534842 - DNA, 21 bp, Homo sapiens
tgttttcaataacaaagcaca

SEQ ID NO: 5534843 - DNA, 21 bp, Homo sapiens
tgttttcaattttaaacatat

SEQ ID NO: 5534844 - DNA, 22 bp, Homo sapiens
tgttttcacagttcctctttgt

SEQ ID NO: 5534845 - DNA, 13 bp, Homo sapiens
tgttttcagcact

SEQ ID NO: 5534846 - DNA, 20 bp, Homo sapiens
tgttttcagccttcagattt

SEQ ID NO: 5534847 - DNA, 12 bp, Homo sapiens
tgttttcagtct

SEQ ID NO: 5534848 - DNA, 15 bp, Homo sapiens
tgttttcagtgtaca

SEQ ID NO: 5534849 - DNA, 15 bp, Homo sapiens
tgttttcataataaa

SEQ ID NO: 5534850 - DNA, 22 bp, Homo sapiens
tgttttcatcatttcagccaaa

SEQ ID NO: 5534851 - DNA, 20 bp, Homo sapiens
tgttttcatggtgaaaatgt

SEQ ID NO: 5534852 - DNA, 15 bp, Homo sapiens
tgttttcattaaatt

SEQ ID NO: 5534853 - DNA, 21 bp, Homo sapiens
tgttttcattcccccttccta

SEQ ID NO: 5534854 - DNA, 12 bp, Homo sapiens
tgttttcattct

SEQ ID NO: 5534855 - DNA, 20 bp, Homo sapiens
tgttttccatgagtcccctg

SEQ ID NO: 5534856 - DNA, 22 bp, Homo sapiens
tgttttccatgatttagcaagc

SEQ ID NO: 5534857 - DNA, 19 bp, Homo sapiens
tgttttcccacacatattc

SEQ ID NO: 5534858 - DNA, 18 bp, Homo sapiens
tgttttccctttaaagcc

SEQ ID NO: 5534859 - DNA, 16 bp, Homo sapiens
tgttttcctaaacaca

SEQ ID NO: 5534860 - DNA, 21 bp, Homo sapiens
tgttttcctcccttctgctac

SEQ ID NO: 5534861 - DNA, 16 bp, Homo sapiens
tgttttcgcaaatgtt

SEQ ID NO: 5534862 - DNA, 15 bp, Homo sapiens
tgttttctagtgtat

SEQ ID NO: 5534863 - DNA, 16 bp, Homo sapiens
tgttttctagtgtatc

SEQ ID NO: 5534864 - DNA, 19 bp, Homo sapiens
tgttttctagtgtatcaaa

SEQ ID NO: 5534865 - DNA, 21 bp, Homo sapiens
tgttttctagtgtatcaaaat

SEQ ID NO: 5534866 - DNA, 15 bp, Homo sapiens
tgttttctccctctc

SEQ ID NO: 5534867 - DNA, 12 bp, Homo sapiens
tgttttctctga

SEQ ID NO: 5534868 - DNA, 13 bp, Homo sapiens
tgttttctctgtg

SEQ ID NO: 5534869 - DNA, 22 bp, Homo sapiens
tgttttctgaaacacacgagca

SEQ ID NO: 5534870 - DNA, 12 bp, Homo sapiens
tgttttctgggg

SEQ ID NO: 5534871 - DNA, 20 bp, Homo sapiens
tgttttctggggaaagggga

SEQ ID NO: 5534872 - DNA, 14 bp, Homo sapiens
tgttttctgtaaat

SEQ ID NO: 5534873 - DNA, 13 bp, Homo sapiens
tgttttctgtaga

SEQ ID NO: 5534874 - DNA, 21 bp, Homo sapiens
tgttttctgtagactctaaga

SEQ ID NO: 5534875 - DNA, 13 bp, Homo sapiens
tgttttctgtgta

SEQ ID NO: 5534876 - DNA, 15 bp, Homo sapiens
tgttttctgtgtaac

SEQ ID NO: 5534877 - DNA, 12 bp, Homo sapiens
tgttttcttaaa

SEQ ID NO: 5534878 - DNA, 13 bp, Homo sapiens
tgttttcttcaac

SEQ ID NO: 5534879 - DNA, 13 bp, Homo sapiens
tgttttcttcatt

SEQ ID NO: 5534880 - DNA, 19 bp, Homo sapiens
tgttttcttgtctgtgtga

SEQ ID NO: 5534881 - DNA, 22 bp, Homo sapiens
tgttttctttctttaaatgttt

SEQ ID NO: 5534882 - DNA, 15 bp, Homo sapiens
tgttttctttgagga

SEQ ID NO: 5534883 - DNA, 13 bp, Homo sapiens
tgttttgaaacta

SEQ ID NO: 5534884 - DNA, 23 bp, Homo sapiens
tgttttgaaagtttaacaaatga

SEQ ID NO: 5534885 - DNA, 17 bp, Homo sapiens
tgttttgaaatcaatgc

SEQ ID NO: 5534886 - DNA, 16 bp, Homo sapiens
tgttttgaaatgatat

SEQ ID NO: 5534887 - DNA, 17 bp, Homo sapiens
tgttttgaaggcaaaat

SEQ ID NO: 5534888 - DNA, 21 bp, Homo sapiens
tgttttgaatattactcctat

SEQ ID NO: 5534889 - DNA, 19 bp, Homo sapiens
tgttttgaatggtgttgta

SEQ ID NO: 5534890 - DNA, 16 bp, Homo sapiens
tgttttgaatgtggat

SEQ ID NO: 5534891 - DNA, 14 bp, Homo sapiens
tgttttgaattttg

SEQ ID NO: 5534892 - DNA, 15 bp, Homo sapiens
tgttttgaattttgt

SEQ ID NO: 5534893 - DNA, 17 bp, Homo sapiens
tgttttgacggatgatt

SEQ ID NO: 5534894 - DNA, 18 bp, Homo sapiens
tgttttgagctttccatg

SEQ ID NO: 5534895 - DNA, 21 bp, Homo sapiens
tgttttgagggctattagaag

SEQ ID NO: 5534896 - DNA, 20 bp, Homo sapiens
tgttttgatatttatttcct

SEQ ID NO: 5534897 - DNA, 21 bp, Homo sapiens
tgttttgatatttatttcctg

SEQ ID NO: 5534898 - DNA, 15 bp, Homo sapiens
tgttttgatctctgt

SEQ ID NO: 5534899 - DNA, 20 bp, Homo sapiens
tgttttgatgagaaaaaact

SEQ ID NO: 5534900 - DNA, 11 bp, Homo sapiens
tgttttgcaag

SEQ ID NO: 5534901 - DNA, 23 bp, Homo sapiens
tgttttgcaagggaatgaatcca

SEQ ID NO: 5534902 - DNA, 15 bp, Homo sapiens
tgttttgcactgaca

SEQ ID NO: 5534903 - DNA, 13 bp, Homo sapiens
tgttttgcacttt

SEQ ID NO: 5534904 - DNA, 13 bp, Homo sapiens
tgttttgcatgta

SEQ ID NO: 5534905 - DNA, 20 bp, Homo sapiens
tgttttgccaaagactgtaa

SEQ ID NO: 5534906 - DNA, 21 bp, Homo sapiens
tgttttgccaatttgcacatt

SEQ ID NO: 5534907 - DNA, 23 bp, Homo sapiens
tgttttgccaatttgcacattaa

SEQ ID NO: 5534908 - DNA, 12 bp, Homo sapiens
tgttttgccagt

SEQ ID NO: 5534909 - DNA, 19 bp, Homo sapiens
tgttttgccatgtagcaga

SEQ ID NO: 5534910 - DNA, 11 bp, Homo sapiens
tgttttgctaa

SEQ ID NO: 5534911 - DNA, 20 bp, Homo sapiens
tgttttgctttttaaactga

SEQ ID NO: 5534912 - DNA, 19 bp, Homo sapiens
tgttttggacagtttacca

SEQ ID NO: 5534913 - DNA, 15 bp, Homo sapiens
tgttttggagaaaaa

SEQ ID NO: 5534914 - DNA, 15 bp, Homo sapiens
tgttttggatgaatg

SEQ ID NO: 5534915 - DNA, 23 bp, Homo sapiens
tgttttggattctttaaatatat

SEQ ID NO: 5534916 - DNA, 22 bp, Homo sapiens
tgttttggatttggagagaaat

SEQ ID NO: 5534917 - DNA, 18 bp, Homo sapiens
tgttttggctgaaattct

SEQ ID NO: 5534918 - DNA, 17 bp, Homo sapiens
tgttttgggactttttt

SEQ ID NO: 5534919 - DNA, 17 bp, Homo sapiens
tgttttgggcctccatg

SEQ ID NO: 5534920 - DNA, 19 bp, Homo sapiens
tgttttgggtagctgccac

SEQ ID NO: 5534921 - DNA, 14 bp, Homo sapiens
tgttttgggtgaat

SEQ ID NO: 5534922 - DNA, 23 bp, Homo sapiens
tgttttgggtgaatcttgaggaa

SEQ ID NO: 5534923 - DNA, 20 bp, Homo sapiens
tgttttgggtggtaaagtgt

SEQ ID NO: 5534924 - DNA, 12 bp, Homo sapiens
tgttttgggttt

SEQ ID NO: 5534925 - DNA, 23 bp, Homo sapiens
tgttttggtatgcactggttcct

SEQ ID NO: 5534926 - DNA, 16 bp, Homo sapiens
tgttttggtcccctcc

SEQ ID NO: 5534927 - DNA, 18 bp, Homo sapiens
tgttttgtaaacatttat

SEQ ID NO: 5534928 - DNA, 13 bp, Homo sapiens
tgttttgtaaact

SEQ ID NO: 5534929 - DNA, 18 bp, Homo sapiens
tgttttgtaaactttgaa

SEQ ID NO: 5534930 - DNA, 20 bp, Homo sapiens
tgttttgtaaactttgaaat

SEQ ID NO: 5534931 - DNA, 12 bp, Homo sapiens
tgttttgtaaag

SEQ ID NO: 5534932 - DNA, 19 bp, Homo sapiens
tgttttgtaaagtccccag

SEQ ID NO: 5534933 - DNA, 13 bp, Homo sapiens
tgttttgtacaat

SEQ ID NO: 5534934 - DNA, 15 bp, Homo sapiens
tgttttgtacagatg

SEQ ID NO: 5534935 - DNA, 18 bp, Homo sapiens
tgttttgtacatagattt

SEQ ID NO: 5534936 - DNA, 14 bp, Homo sapiens
tgttttgtaccagt

SEQ ID NO: 5534937 - DNA, 15 bp, Homo sapiens
tgttttgtaccagtg

SEQ ID NO: 5534938 - DNA, 20 bp, Homo sapiens
tgttttgtaccagtgaattt

SEQ ID NO: 5534939 - DNA, 13 bp, Homo sapiens
tgttttgtagatg

SEQ ID NO: 5534940 - DNA, 12 bp, Homo sapiens
tgttttgtataa

SEQ ID NO: 5534941 - DNA, 14 bp, Homo sapiens
tgttttgtatacaa

SEQ ID NO: 5534942 - DNA, 17 bp, Homo sapiens
tgttttgtcctgcctct

SEQ ID NO: 5534943 - DNA, 20 bp, Homo sapiens
tgttttgtcctttgagaaag

SEQ ID NO: 5534944 - DNA, 17 bp, Homo sapiens
tgttttgtcttacaaag

SEQ ID NO: 5534945 - DNA, 15 bp, Homo sapiens
tgttttgtgcatttg

SEQ ID NO: 5534946 - DNA, 22 bp, Homo sapiens
tgttttgtgcggtgtgtctcca

SEQ ID NO: 5534947 - DNA, 16 bp, Homo sapiens
tgttttgtgtctggtg

SEQ ID NO: 5534948 - DNA, 15 bp, Homo sapiens
tgttttgtgttgtgt

SEQ ID NO: 5534949 - DNA, 17 bp, Homo sapiens
tgttttgtgtttttcca

SEQ ID NO: 5534950 - DNA, 19 bp, Homo sapiens
tgttttgtgtttttccaaa

SEQ ID NO: 5534951 - DNA, 20 bp, Homo sapiens
tgttttgtgtttttccaaaa

SEQ ID NO: 5534952 - DNA, 16 bp, Homo sapiens
tgttttgttaatatac

SEQ ID NO: 5534953 - DNA, 22 bp, Homo sapiens
tgttttgttcaccattataatg

SEQ ID NO: 5534954 - DNA, 16 bp, Homo sapiens
tgttttgttctgtggt

SEQ ID NO: 5534955 - DNA, 12 bp, Homo sapiens
tgttttgttgac

SEQ ID NO: 5534956 - DNA, 15 bp, Homo sapiens
tgttttgttgacatt

SEQ ID NO: 5534957 - DNA, 20 bp, Homo sapiens
tgttttgttgacattctgaa

SEQ ID NO: 5534958 - DNA, 22 bp, Homo sapiens
tgttttgttgcactgaagtttg

SEQ ID NO: 5534959 - DNA, 13 bp, Homo sapiens
tgttttgtttctg

SEQ ID NO: 5534960 - DNA, 20 bp, Homo sapiens
ttaaagcttattaaaactca

SEQ ID NO: 5534961 - DNA, 13 bp, Homo sapiens
ttaaagcttattt

SEQ ID NO: 5534962 - DNA, 19 bp, Homo sapiens
ttaaagcttgatttgatct

SEQ ID NO: 5534963 - DNA, 11 bp, Homo sapiens
ttaaaggaaaa

SEQ ID NO: 5534964 - DNA, 16 bp, Homo sapiens
ttaaaggaaaaaatgt

SEQ ID NO: 5534965 - DNA, 17 bp, Homo sapiens
ttaaaggaaaagcacaa

SEQ ID NO: 5534966 - DNA, 20 bp, Homo sapiens
ttaaaggaaggttctggtgt

SEQ ID NO: 5534967 - DNA, 15 bp, Homo sapiens
ttaaaggaagtcagt

SEQ ID NO: 5534968 - DNA, 18 bp, Homo sapiens
ttaaaggaattaaactaa

SEQ ID NO: 5534969 - DNA, 15 bp, Homo sapiens
ttaaaggacaaacag

SEQ ID NO: 5534970 - DNA, 16 bp, Homo sapiens
ttaaaggacaaacagt

SEQ ID NO: 5534971 - DNA, 21 bp, Homo sapiens
ttaaaggacaggaggaggaga

SEQ ID NO: 5534972 - DNA, 14 bp, Homo sapiens
ttaaaggacataaa

SEQ ID NO: 5534973 - DNA, 23 bp, Homo sapiens
ttaaaggagcagctagctgcttt

SEQ ID NO: 5534974 - DNA, 13 bp, Homo sapiens
ttaaaggataatg

SEQ ID NO: 5534975 - DNA, 20 bp, Homo sapiens
ttaaaggataattatccaat

SEQ ID NO: 5534976 - DNA, 16 bp, Homo sapiens
ttaaaggcagacagtt

SEQ ID NO: 5534977 - DNA, 19 bp, Homo sapiens
ttaaaggcagtccagagct

SEQ ID NO: 5534978 - DNA, 18 bp, Homo sapiens
ttaaaggcccagccccta

SEQ ID NO: 5534979 - DNA, 21 bp, Homo sapiens
ttaaagggaatgactttgaag

SEQ ID NO: 5534980 - DNA, 23 bp, Homo sapiens
ttaaaggggagacctcagaagta

SEQ ID NO: 5534981 - DNA, 21 bp, Homo sapiens
ttaaaggggcagaaaaactct

SEQ ID NO: 5534982 - DNA, 21 bp, Homo sapiens
ttaaagggggagaattctaga

SEQ ID NO: 5534983 - DNA, 15 bp, Homo sapiens
ttaaaggtagagatg

SEQ ID NO: 5534984 - DNA, 15 bp, Homo sapiens
ttaaaggtatacaaa

SEQ ID NO: 5534985 - DNA, 15 bp, Homo sapiens
ttaaaggtgtcttcc

SEQ ID NO: 5534986 - DNA, 17 bp, Homo sapiens
ttaaaggtgtgctattt

SEQ ID NO: 5534987 - DNA, 18 bp, Homo sapiens
ttaaaggttaaattgctt

SEQ ID NO: 5534988 - DNA, 20 bp, Homo sapiens
ttaaaggttcctttgttccc

SEQ ID NO: 5534989 - DNA, 19 bp, Homo sapiens
ttaaaggttgagtatgtga

SEQ ID NO: 5534990 - DNA, 20 bp, Homo sapiens
ttaaaggttggaatctttta

SEQ ID NO: 5534991 - DNA, 19 bp, Homo sapiens
ttaaaggtttttgaaatcc

SEQ ID NO: 5534992 - DNA, 22 bp, Homo sapiens
ttaaagtaaaaggcactgcaca

SEQ ID NO: 5534993 - DNA, 13 bp, Homo sapiens
ttaaagtaaactt

SEQ ID NO: 5534994 - DNA, 16 bp, Homo sapiens
ttaaagtaattgttcc

SEQ ID NO: 5534995 - DNA, 20 bp, Homo sapiens
ttaaagtaattgttccagag

SEQ ID NO: 5534996 - DNA, 15 bp, Homo sapiens
ttaaagtacctgtag

SEQ ID NO: 5534997 - DNA, 22 bp, Homo sapiens
ttaaagtacctgtagtgagaaa

SEQ ID NO: 5534998 - DNA, 13 bp, Homo sapiens
ttaaagtatgcaa

SEQ ID NO: 5534999 - DNA, 20 bp, Homo sapiens
ttaaagtatgcattattaaa

SEQ ID NO: 5535000 - DNA, 18 bp, Homo sapiens
ttaaagtatgttattgca

SEQ ID NO: 5535001 - DNA, 13 bp, Homo sapiens
ttaaagtatttct

SEQ ID NO: 5535002 - DNA, 18 bp, Homo sapiens
ttaaagtattttaatttt

SEQ ID NO: 5535003 - DNA, 12 bp, Homo sapiens
ttaaagtctaca

SEQ ID NO: 5535004 - DNA, 17 bp, Homo sapiens
ttaaagtctacactgcc

SEQ ID NO: 5535005 - DNA, 19 bp, Homo sapiens
ttaaagtctacactgcctt

SEQ ID NO: 5535006 - DNA, 12 bp, Homo sapiens
ttaaagtctgaa

SEQ ID NO: 5535007 - DNA, 17 bp, Homo sapiens
ttaaagtctgagaaatt

SEQ ID NO: 5535008 - DNA, 20 bp, Homo sapiens
ttaaagtcttctttcatgta

SEQ ID NO: 5535009 - DNA, 17 bp, Homo sapiens
ttaaagtgaaggaaata

SEQ ID NO: 5535010 - DNA, 21 bp, Homo sapiens
ttaaagtgactaatggcatga

SEQ ID NO: 5535011 - DNA, 17 bp, Homo sapiens
ttaaagtgatactgaaa

SEQ ID NO: 5535012 - DNA, 12 bp, Homo sapiens
ttaaagtgccat

SEQ ID NO: 5535013 - DNA, 22 bp, Homo sapiens
ttaaagtgctaaggttctaagg

SEQ ID NO: 5535014 - DNA, 13 bp, Homo sapiens
ttaaagtgctgtt

SEQ ID NO: 5535015 - DNA, 17 bp, Homo sapiens
ttaaagtgctgtttaga

SEQ ID NO: 5535016 - DNA, 21 bp, Homo sapiens
ttaaagtgctgtttagattta

SEQ ID NO: 5535017 - DNA, 14 bp, Homo sapiens
ttaaagtggactta

SEQ ID NO: 5535018 - DNA, 17 bp, Homo sapiens
ttaaagtgtaataatat

SEQ ID NO: 5535019 - DNA, 14 bp, Homo sapiens
ttaaagtgtacatt

SEQ ID NO: 5535020 - DNA, 20 bp, Homo sapiens
ttaaagtgtattataacagt

SEQ ID NO: 5535021 - DNA, 16 bp, Homo sapiens
ttaaagttaaaactgg

SEQ ID NO: 5535022 - DNA, 23 bp, Homo sapiens
ttaaagttagtatcttttgatat

SEQ ID NO: 5535023 - DNA, 15 bp, Homo sapiens
ttaaagttcaaactc

SEQ ID NO: 5535024 - DNA, 12 bp, Homo sapiens
ttaaagttctag

SEQ ID NO: 5535025 - DNA, 13 bp, Homo sapiens
ttaaagttctgtg

SEQ ID NO: 5535026 - DNA, 18 bp, Homo sapiens
ttaaagttctgtgtattt

SEQ ID NO: 5535027 - DNA, 15 bp, Homo sapiens
ttaaagttcttattt

SEQ ID NO: 5535028 - DNA, 17 bp, Homo sapiens
ttaaagttgaatttatt

SEQ ID NO: 5535029 - DNA, 12 bp, Homo sapiens
ttaaagttgcac

SEQ ID NO: 5535030 - DNA, 15 bp, Homo sapiens
ttaaagttggagaca

SEQ ID NO: 5535031 - DNA, 15 bp, Homo sapiens
ttaaagtttaaatac

SEQ ID NO: 5535032 - DNA, 13 bp, Homo sapiens
ttaaagtttcaaa

SEQ ID NO: 5535033 - DNA, 20 bp, Homo sapiens
ttaaagttttgtacaaagtt

SEQ ID NO: 5535034 - DNA, 20 bp, Homo sapiens
ttaaagttttttatatatga

SEQ ID NO: 5535035 - DNA, 21 bp, Homo sapiens
ttaaagttttttatatatgaa

SEQ ID NO: 5535036 - DNA, 14 bp, Homo sapiens
ttaaataaaaataa

SEQ ID NO: 5535037 - DNA, 14 bp, Homo sapiens
ttaaataaaacatt

SEQ ID NO: 5535038 - DNA, 19 bp, Homo sapiens
ttaaataaaactttccaaa

SEQ ID NO: 5535039 - DNA, 11 bp, Homo sapiens
ttaaataaaag

SEQ ID NO: 5535040 - DNA, 21 bp, Homo sapiens
ttaaataaaagaaatgcacaa

SEQ ID NO: 5535041 - DNA, 12 bp, Homo sapiens
ttaaataaaata

SEQ ID NO: 5535042 - DNA, 15 bp, Homo sapiens
ttaaataaaataacc

SEQ ID NO: 5535043 - DNA, 13 bp, Homo sapiens
ttaaataaaatca

SEQ ID NO: 5535044 - DNA, 15 bp, Homo sapiens
ttaaataaaatcaat

SEQ ID NO: 5535045 - DNA, 14 bp, Homo sapiens
ttaaataaaattta

SEQ ID NO: 5535046 - DNA, 17 bp, Homo sapiens
ttaaataaaatttaatt

SEQ ID NO: 5535047 - DNA, 21 bp, Homo sapiens
ttaaataaactgttttcaagt

SEQ ID NO: 5535048 - DNA, 13 bp, Homo sapiens
ttaaataaacttt

SEQ ID NO: 5535049 - DNA, 14 bp, Homo sapiens
ttaaataaactttt

SEQ ID NO: 5535050 - DNA, 19 bp, Homo sapiens
ttaaataaagacctatgta

SEQ ID NO: 5535051 - DNA, 19 bp, Homo sapiens
ttaaataaaggtacacatg

SEQ ID NO: 5535052 - DNA, 20 bp, Homo sapiens
ttaaataaataaataagaat

SEQ ID NO: 5535053 - DNA, 21 bp, Homo sapiens
ttaaataaatcaagaatcatt

SEQ ID NO: 5535054 - DNA, 23 bp, Homo sapiens
ttaaataaatctttcagcctgct

SEQ ID NO: 5535055 - DNA, 20 bp, Homo sapiens
ttaaataaattaagatccta

SEQ ID NO: 5535056 - DNA, 14 bp, Homo sapiens
ttaaataaattcaa

SEQ ID NO: 5535057 - DNA, 15 bp, Homo sapiens
ttaaataaattcaaa

SEQ ID NO: 5535058 - DNA, 23 bp, Homo sapiens
ttaaataaattcaaaccatttaa

SEQ ID NO: 5535059 - DNA, 15 bp, Homo sapiens
ttaaataaattgtat

SEQ ID NO: 5535060 - DNA, 17 bp, Homo sapiens
ttaaataaattgtatat

SEQ ID NO: 5535061 - DNA, 18 bp, Homo sapiens
ttaaataaattgtatatt

SEQ ID NO: 5535062 - DNA, 15 bp, Homo sapiens
ttaaataaattttaa

SEQ ID NO: 5535063 - DNA, 11 bp, Homo sapiens
ttaaataacaa

SEQ ID NO: 5535064 - DNA, 19 bp, Homo sapiens
ttaaataacctctggccct

SEQ ID NO: 5535065 - DNA, 20 bp, Homo sapiens
ttaaataacctctggccctt

SEQ ID NO: 5535066 - DNA, 23 bp, Homo sapiens
ttaaataacctctggcccttgga

SEQ ID NO: 5535067 - DNA, 14 bp, Homo sapiens
ttaaataactgtgt

SEQ ID NO: 5535068 - DNA, 15 bp, Homo sapiens
ttaaataagaaactt

SEQ ID NO: 5535069 - DNA, 13 bp, Homo sapiens
ttaaataagattc

SEQ ID NO: 5535070 - DNA, 15 bp, Homo sapiens
ttaaataagattcta

SEQ ID NO: 5535071 - DNA, 16 bp, Homo sapiens
ttaaataagcaaataa

SEQ ID NO: 5535072 - DNA, 22 bp, Homo sapiens
ttaaataataatagttaatgaa

SEQ ID NO: 5535073 - DNA, 16 bp, Homo sapiens
ttaaataatacaactc

SEQ ID NO: 5535074 - DNA, 15 bp, Homo sapiens
ttaaataatagacat

SEQ ID NO: 5535075 - DNA, 18 bp, Homo sapiens
ttaaataatgcttcagat

SEQ ID NO: 5535076 - DNA, 13 bp, Homo sapiens
ttaaataatgtga

SEQ ID NO: 5535077 - DNA, 18 bp, Homo sapiens
ttaaataatgtgaaactg

SEQ ID NO: 5535078 - DNA, 22 bp, Homo sapiens
ttaaataatgtgaaactggatt

SEQ ID NO: 5535079 - DNA, 14 bp, Homo sapiens
ttaaataatttaac

SEQ ID NO: 5535080 - DNA, 15 bp, Homo sapiens
ttaaataatttaact

SEQ ID NO: 5535081 - DNA, 16 bp, Homo sapiens
ttaaataatttaacta

SEQ ID NO: 5535082 - DNA, 18 bp, Homo sapiens
ttaaataattttacatgt

SEQ ID NO: 5535083 - DNA, 15 bp, Homo sapiens
ttaaatacaaaactt

SEQ ID NO: 5535084 - DNA, 12 bp, Homo sapiens
ttaaatacacat

SEQ ID NO: 5535085 - DNA, 14 bp, Homo sapiens
ttaaatacacatta

SEQ ID NO: 5535086 - DNA, 15 bp, Homo sapiens
ttaaatacactgaat

SEQ ID NO: 5535087 - DNA, 19 bp, Homo sapiens
ttaaatacagataattcat

SEQ ID NO: 5535088 - DNA, 19 bp, Homo sapiens
ttaaatacaggaaacagtt

SEQ ID NO: 5535089 - DNA, 18 bp, Homo sapiens
ttaaatacatatggatgt

SEQ ID NO: 5535090 - DNA, 23 bp, Homo sapiens
ttaaatacatatggatgttactc

SEQ ID NO: 5535091 - DNA, 19 bp, Homo sapiens
ttaaataccagccagcagg

SEQ ID NO: 5535092 - DNA, 16 bp, Homo sapiens
ttaaataccagtactt

SEQ ID NO: 5535093 - DNA, 18 bp, Homo sapiens
ttaaatactgtgcagaat

SEQ ID NO: 5535094 - DNA, 22 bp, Homo sapiens
ttaaatactttttcagttgttt

SEQ ID NO: 5535095 - DNA, 18 bp, Homo sapiens
ttaaatagagtttgctat

SEQ ID NO: 5535096 - DNA, 17 bp, Homo sapiens
ttaaatagatacaaatg

SEQ ID NO: 5535097 - DNA, 13 bp, Homo sapiens
ttaaatagatgac

SEQ ID NO: 5535098 - DNA, 19 bp, Homo sapiens
ttaaatagcctaaatgatg

SEQ ID NO: 5535099 - DNA, 19 bp, Homo sapiens
ttaaatagcttttttctct

SEQ ID NO: 5535100 - DNA, 18 bp, Homo sapiens
ttaaataggatattaaca

SEQ ID NO: 5535101 - DNA, 12 bp, Homo sapiens
ttaaatagtgtg

SEQ ID NO: 5535102 - DNA, 13 bp, Homo sapiens
ttaaatataaaat

SEQ ID NO: 5535103 - DNA, 16 bp, Homo sapiens
ttaaatataaaataca

SEQ ID NO: 5535104 - DNA, 16 bp, Homo sapiens
ttaaatataaagcaag

SEQ ID NO: 5535105 - DNA, 14 bp, Homo sapiens
ttaaatataattct

SEQ ID NO: 5535106 - DNA, 19 bp, Homo sapiens
ttaaatataattctgtaaa

SEQ ID NO: 5535107 - DNA, 12 bp, Homo sapiens
ttaaatatacaa

SEQ ID NO: 5535108 - DNA, 19 bp, Homo sapiens
ttaaatatagatgtaattt

SEQ ID NO: 5535109 - DNA, 15 bp, Homo sapiens
ttaaatatataaaca

SEQ ID NO: 5535110 - DNA, 19 bp, Homo sapiens
ttaaatatataaacaaaca

SEQ ID NO: 5535111 - DNA, 14 bp, Homo sapiens
ttaaatatatatta

SEQ ID NO: 5535112 - DNA, 20 bp, Homo sapiens
ttaaatatatattattctca

SEQ ID NO: 5535113 - DNA, 16 bp, Homo sapiens
ttaaatatatctagaa

SEQ ID NO: 5535114 - DNA, 19 bp, Homo sapiens
ttaaatatatctttgtaaa

SEQ ID NO: 5535115 - DNA, 17 bp, Homo sapiens
ttaaatatatgtatgta

SEQ ID NO: 5535116 - DNA, 16 bp, Homo sapiens
ttaaatatcaatcatt

SEQ ID NO: 5535117 - DNA, 12 bp, Homo sapiens
ttaaatatcatt

SEQ ID NO: 5535118 - DNA, 19 bp, Homo sapiens
ttaaatatcattctttgta

SEQ ID NO: 5535119 - DNA, 18 bp, Homo sapiens
ttaaatatccacagtact

SEQ ID NO: 5535120 - DNA, 21 bp, Homo sapiens
ttaaatatctgaacatttact

SEQ ID NO: 5535121 - DNA, 16 bp, Homo sapiens
ttaaatatcttttatg

SEQ ID NO: 5535122 - DNA, 19 bp, Homo sapiens
ttaaatatcttttatgttt

SEQ ID NO: 5535123 - DNA, 14 bp, Homo sapiens
ttaaatatgaacaa

SEQ ID NO: 5535124 - DNA, 14 bp, Homo sapiens
ttaaatatgaatga

SEQ ID NO: 5535125 - DNA, 15 bp, Homo sapiens
ttaaatatgaatgaa

SEQ ID NO: 5535126 - DNA, 13 bp, Homo sapiens
ttaaatatgattt

SEQ ID NO: 5535127 - DNA, 21 bp, Homo sapiens
ttaaatatgttagcaaagagt

SEQ ID NO: 5535128 - DNA, 20 bp, Homo sapiens
ttaaatattagttaatggat

SEQ ID NO: 5535129 - DNA, 18 bp, Homo sapiens
ttaaatattatgctgctt

SEQ ID NO: 5535130 - DNA, 16 bp, Homo sapiens
ttaaatattctgtaca

SEQ ID NO: 5535131 - DNA, 14 bp, Homo sapiens
ttaaatattgtaat

SEQ ID NO: 5535132 - DNA, 19 bp, Homo sapiens
ttaaatattgtaatatgac

SEQ ID NO: 5535133 - DNA, 19 bp, Homo sapiens
ttaaatattgtcattacaa

SEQ ID NO: 5535134 - DNA, 14 bp, Homo sapiens
ttaaatatttaatg

SEQ ID NO: 5535135 - DNA, 18 bp, Homo sapiens
ttaaatatttcaagacat

SEQ ID NO: 5535136 - DNA, 22 bp, Homo sapiens
ttaaatatttcaagacattaaa

SEQ ID NO: 5535137 - DNA, 13 bp, Homo sapiens
ttaaatatttgaa

SEQ ID NO: 5535138 - DNA, 15 bp, Homo sapiens
ttaaatattttgcta

SEQ ID NO: 5535139 - DNA, 18 bp, Homo sapiens
ttaaatattttgctaact

SEQ ID NO: 5535140 - DNA, 20 bp, Homo sapiens
ttaagacctactgttctaaa

SEQ ID NO: 5535141 - DNA, 21 bp, Homo sapiens
ttaagacctactgttctaaag

SEQ ID NO: 5535142 - DNA, 18 bp, Homo sapiens
ttaagacctggcagctct

SEQ ID NO: 5535143 - DNA, 15 bp, Homo sapiens
ttaagacgtgaatgt

SEQ ID NO: 5535144 - DNA, 16 bp, Homo sapiens
ttaagacgtgaatgtc

SEQ ID NO: 5535145 - DNA, 19 bp, Homo sapiens
ttaagacgtgaatgtctca

SEQ ID NO: 5535146 - DNA, 22 bp, Homo sapiens
ttaagactgataattttacaat

SEQ ID NO: 5535147 - DNA, 13 bp, Homo sapiens
ttaagactgtaat

SEQ ID NO: 5535148 - DNA, 18 bp, Homo sapiens
ttaagactgtgtctgtat

SEQ ID NO: 5535149 - DNA, 17 bp, Homo sapiens
ttaagacttaatctttg

SEQ ID NO: 5535150 - DNA, 19 bp, Homo sapiens
ttaagacttaatctttgct

SEQ ID NO: 5535151 - DNA, 12 bp, Homo sapiens
ttaagagaaact

SEQ ID NO: 5535152 - DNA, 14 bp, Homo sapiens
ttaagagaaacttt

SEQ ID NO: 5535153 - DNA, 16 bp, Homo sapiens
ttaagagaaactttat

SEQ ID NO: 5535154 - DNA, 23 bp, Homo sapiens
ttaagagaaactttatacattag

SEQ ID NO: 5535155 - DNA, 15 bp, Homo sapiens
ttaagagaaatggca

SEQ ID NO: 5535156 - DNA, 22 bp, Homo sapiens
ttaagagaagacctagctatgt

SEQ ID NO: 5535157 - DNA, 17 bp, Homo sapiens
ttaagagaatccacata

SEQ ID NO: 5535158 - DNA, 14 bp, Homo sapiens
ttaagagactcact

SEQ ID NO: 5535159 - DNA, 14 bp, Homo sapiens
ttaagagagaaatc

SEQ ID NO: 5535160 - DNA, 15 bp, Homo sapiens
ttaagagagaaatct

SEQ ID NO: 5535161 - DNA, 22 bp, Homo sapiens
ttaagagagtctatttacggaa

SEQ ID NO: 5535162 - DNA, 18 bp, Homo sapiens
ttaagagataattcttaa

SEQ ID NO: 5535163 - DNA, 13 bp, Homo sapiens
ttaagagatacat

SEQ ID NO: 5535164 - DNA, 20 bp, Homo sapiens
ttaagagatacttacatttc

SEQ ID NO: 5535165 - DNA, 16 bp, Homo sapiens
ttaagagcagtccatt

SEQ ID NO: 5535166 - DNA, 16 bp, Homo sapiens
ttaagagcataaacaa

SEQ ID NO: 5535167 - DNA, 22 bp, Homo sapiens
ttaagagccatataagtttgaa

SEQ ID NO: 5535168 - DNA, 17 bp, Homo sapiens
ttaagagctaaccagtt

SEQ ID NO: 5535169 - DNA, 23 bp, Homo sapiens
ttaagagctattttagaaagcta

SEQ ID NO: 5535170 - DNA, 21 bp, Homo sapiens
ttaagagcttgatctgtgatt

SEQ ID NO: 5535171 - DNA, 13 bp, Homo sapiens
ttaagaggcaggg

SEQ ID NO: 5535172 - DNA, 15 bp, Homo sapiens
ttaagaggcagggtc

SEQ ID NO: 5535173 - DNA, 19 bp, Homo sapiens
ttaagaggctttggcccaa

SEQ ID NO: 5535174 - DNA, 12 bp, Homo sapiens
ttaagagtaaaa

SEQ ID NO: 5535175 - DNA, 18 bp, Homo sapiens
ttaagagtccaactcact

SEQ ID NO: 5535176 - DNA, 22 bp, Homo sapiens
ttaagagtccaactcacttcca

SEQ ID NO: 5535177 - DNA, 13 bp, Homo sapiens
ttaagagtccaag

SEQ ID NO: 5535178 - DNA, 23 bp, Homo sapiens
ttaagagtcctgaggcagaacct

SEQ ID NO: 5535179 - DNA, 12 bp, Homo sapiens
ttaagagtgaaa

SEQ ID NO: 5535180 - DNA, 22 bp, Homo sapiens
ttaagagtggcatataattttc

SEQ ID NO: 5535181 - DNA, 21 bp, Homo sapiens
ttaagagtgggggagagcagg

SEQ ID NO: 5535182 - DNA, 20 bp, Homo sapiens
ttaagataacttactgtata

SEQ ID NO: 5535183 - DNA, 19 bp, Homo sapiens
ttaagataataatatatgt

SEQ ID NO: 5535184 - DNA, 21 bp, Homo sapiens
ttaagataatagtttacatgt

SEQ ID NO: 5535185 - DNA, 14 bp, Homo sapiens
ttaagataattata

SEQ ID NO: 5535186 - DNA, 22 bp, Homo sapiens
ttaagataattgtactttgaaa

SEQ ID NO: 5535187 - DNA, 16 bp, Homo sapiens
ttaagatacactcctg

SEQ ID NO: 5535188 - DNA, 19 bp, Homo sapiens
ttaagatacttagattaga

SEQ ID NO: 5535189 - DNA, 14 bp, Homo sapiens
ttaagatagaacac

SEQ ID NO: 5535190 - DNA, 16 bp, Homo sapiens
ttaagatagaacaggc

SEQ ID NO: 5535191 - DNA, 17 bp, Homo sapiens
ttaagatatattttgag

SEQ ID NO: 5535192 - DNA, 22 bp, Homo sapiens
ttaagatcccagtgtgaagtat

SEQ ID NO: 5535193 - DNA, 19 bp, Homo sapiens
ttaagatcctaaactctct

SEQ ID NO: 5535194 - DNA, 15 bp, Homo sapiens
ttaagatctgactgc

SEQ ID NO: 5535195 - DNA, 19 bp, Homo sapiens
ttaagatcttggcttaatt

SEQ ID NO: 5535196 - DNA, 21 bp, Homo sapiens
ttaagatgccttgaattgtct

SEQ ID NO: 5535197 - DNA, 14 bp, Homo sapiens
ttaagatggattct

SEQ ID NO: 5535198 - DNA, 16 bp, Homo sapiens
ttaagatgtccagggc

SEQ ID NO: 5535199 - DNA, 17 bp, Homo sapiens
ttaagatgtctgagaga

SEQ ID NO: 5535200 - DNA, 11 bp, Homo sapiens
ttaagatgtga

SEQ ID NO: 5535201 - DNA, 14 bp, Homo sapiens
ttaagatgtgaaaa

SEQ ID NO: 5535202 - DNA, 18 bp, Homo sapiens
ttaagatgttgtcttgcg

SEQ ID NO: 5535203 - DNA, 16 bp, Homo sapiens
ttaagattataattgt

SEQ ID NO: 5535204 - DNA, 15 bp, Homo sapiens
ttaagattccatttt

SEQ ID NO: 5535205 - DNA, 12 bp, Homo sapiens
ttaagattcttg

SEQ ID NO: 5535206 - DNA, 17 bp, Homo sapiens
ttaagatttctttatgt

SEQ ID NO: 5535207 - DNA, 17 bp, Homo sapiens
ttaagattttactttaa

SEQ ID NO: 5535208 - DNA, 20 bp, Homo sapiens
ttaagatttttctcaaagtt

SEQ ID NO: 5535209 - DNA, 23 bp, Homo sapiens
ttaagcaaaggggacagctgtgt

SEQ ID NO: 5535210 - DNA, 23 bp, Homo sapiens
ttaagcaacaaaactatggaaat

SEQ ID NO: 5535211 - DNA, 17 bp, Homo sapiens
ttaagcaacacttggaa

SEQ ID NO: 5535212 - DNA, 16 bp, Homo sapiens
ttaagcaactggaaaa

SEQ ID NO: 5535213 - DNA, 15 bp, Homo sapiens
ttaagcaagttaagt

SEQ ID NO: 5535214 - DNA, 13 bp, Homo sapiens
ttaagcaataaaa

SEQ ID NO: 5535215 - DNA, 14 bp, Homo sapiens
ttaagcaataaaac

SEQ ID NO: 5535216 - DNA, 20 bp, Homo sapiens
ttaagcaataaaactgctag

SEQ ID NO: 5535217 - DNA, 19 bp, Homo sapiens
ttaagcaataaggaaatgt

SEQ ID NO: 5535218 - DNA, 22 bp, Homo sapiens
ttaagcacaaccatgttcttga

SEQ ID NO: 5535219 - DNA, 14 bp, Homo sapiens
ttaagcacacacat

SEQ ID NO: 5535220 - DNA, 15 bp, Homo sapiens
ttaagcagaagcatt

SEQ ID NO: 5535221 - DNA, 17 bp, Homo sapiens
ttaagcagaattggaaa

SEQ ID NO: 5535222 - DNA, 21 bp, Homo sapiens
ttaagcagactggaaaagtga

SEQ ID NO: 5535223 - DNA, 22 bp, Homo sapiens
ttaagcagcatggaaaaatggt

SEQ ID NO: 5535224 - DNA, 21 bp, Homo sapiens
ttaagcagcctttctgtggag

SEQ ID NO: 5535225 - DNA, 22 bp, Homo sapiens
ttaagcagctaaattttctgaa

SEQ ID NO: 5535226 - DNA, 20 bp, Homo sapiens
ttaagcagctcttgctaatc

SEQ ID NO: 5535227 - DNA, 22 bp, Homo sapiens
ttaagcaggaatcctagaagca

SEQ ID NO: 5535228 - DNA, 16 bp, Homo sapiens
ttaagcaggtttgttt

SEQ ID NO: 5535229 - DNA, 15 bp, Homo sapiens
ttaagcagtaatctg

SEQ ID NO: 5535230 - DNA, 18 bp, Homo sapiens
ttaagcatatatttttat

SEQ ID NO: 5535231 - DNA, 15 bp, Homo sapiens
ttaagcatcacaaat

SEQ ID NO: 5535232 - DNA, 15 bp, Homo sapiens
ttaagcatgacagaa

SEQ ID NO: 5535233 - DNA, 23 bp, Homo sapiens
ttaagcattactcttgtaagatt

SEQ ID NO: 5535234 - DNA, 22 bp, Homo sapiens
ttaagcattgtttgcttattgt

SEQ ID NO: 5535235 - DNA, 17 bp, Homo sapiens
ttaagcatttgtatatt

SEQ ID NO: 5535236 - DNA, 18 bp, Homo sapiens
ttaagcattttactgtct

SEQ ID NO: 5535237 - DNA, 21 bp, Homo sapiens
ttaagcattttactgtctgta

SEQ ID NO: 5535238 - DNA, 16 bp, Homo sapiens
ttaagccaaaacaatg

SEQ ID NO: 5535239 - DNA, 17 bp, Homo sapiens
ttaagccaaagaaacaa

SEQ ID NO: 5535240 - DNA, 18 bp, Homo sapiens
ttaagccacaaagtttgt

SEQ ID NO: 5535241 - DNA, 19 bp, Homo sapiens
ttaagccactgcctctccc

SEQ ID NO: 5535242 - DNA, 15 bp, Homo sapiens
ttaagccaggaaaca

SEQ ID NO: 5535243 - DNA, 13 bp, Homo sapiens
ttaagccctgctc

SEQ ID NO: 5535244 - DNA, 18 bp, Homo sapiens
ttaagccctgctctttct

SEQ ID NO: 5535245 - DNA, 20 bp, Homo sapiens
ttaagccctttgctctggag

SEQ ID NO: 5535246 - DNA, 19 bp, Homo sapiens
ttaagcctaccgtatttca

SEQ ID NO: 5535247 - DNA, 14 bp, Homo sapiens
ttaagccttacaaa

SEQ ID NO: 5535248 - DNA, 16 bp, Homo sapiens
ttaagccttcaaaact

SEQ ID NO: 5535249 - DNA, 13 bp, Homo sapiens
ttaagccttcatt

SEQ ID NO: 5535250 - DNA, 15 bp, Homo sapiens
ttaagccttcatttg

SEQ ID NO: 5535251 - DNA, 15 bp, Homo sapiens
ttaagccttgacaca

SEQ ID NO: 5535252 - DNA, 16 bp, Homo sapiens
ttaagccttgacacac

SEQ ID NO: 5535253 - DNA, 15 bp, Homo sapiens
ttaagcctttgaagt

SEQ ID NO: 5535254 - DNA, 16 bp, Homo sapiens
ttaagcctttgaagtg

SEQ ID NO: 5535255 - DNA, 16 bp, Homo sapiens
ttaagcctttggaaac

SEQ ID NO: 5535256 - DNA, 16 bp, Homo sapiens
ttaagctatcagcaat

SEQ ID NO: 5535257 - DNA, 14 bp, Homo sapiens
ttaagctcagtggc

SEQ ID NO: 5535258 - DNA, 17 bp, Homo sapiens
ttaagctcccctgcctt

SEQ ID NO: 5535259 - DNA, 16 bp, Homo sapiens
ttaagctctcatagct

SEQ ID NO: 5535260 - DNA, 14 bp, Homo sapiens
ttaagctctgagct

SEQ ID NO: 5535261 - DNA, 17 bp, Homo sapiens
ttaagctctgagctgtc

SEQ ID NO: 5535262 - DNA, 19 bp, Homo sapiens
ttaagctgcagagatttct

SEQ ID NO: 5535263 - DNA, 23 bp, Homo sapiens
ttaagctgcagagatttctcatt

SEQ ID NO: 5535264 - DNA, 21 bp, Homo sapiens
ttaagctgtaaattacataag

SEQ ID NO: 5535265 - DNA, 16 bp, Homo sapiens
ttaagctgtagagagt

SEQ ID NO: 5535266 - DNA, 16 bp, Homo sapiens
ttaagcttctagacac

SEQ ID NO: 5535267 - DNA, 13 bp, Homo sapiens
ttaagcttttatt

SEQ ID NO: 5535268 - DNA, 14 bp, Homo sapiens
ttaagcttttattt

SEQ ID NO: 5535269 - DNA, 16 bp, Homo sapiens
ttaagcttttcatttt

SEQ ID NO: 5535270 - DNA, 14 bp, Homo sapiens
ttaagctttttgga

SEQ ID NO: 5535271 - DNA, 19 bp, Homo sapiens
ttaagctttttttttttga

SEQ ID NO: 5535272 - DNA, 13 bp, Homo sapiens
ttaaggaaaagta

SEQ ID NO: 5535273 - DNA, 14 bp, Homo sapiens
ttaaggaaaagtaa

SEQ ID NO: 5535274 - DNA, 12 bp, Homo sapiens
ttaaggaaacaa

SEQ ID NO: 5535275 - DNA, 14 bp, Homo sapiens
ttaaggaaacaata

SEQ ID NO: 5535276 - DNA, 16 bp, Homo sapiens
ttaaggaaactcttat

SEQ ID NO: 5535277 - DNA, 23 bp, Homo sapiens
ttaaggaaatttgtaccatttca

SEQ ID NO: 5535278 - DNA, 11 bp, Homo sapiens
ttaaggaacat

SEQ ID NO: 5535279 - DNA, 13 bp, Homo sapiens
ttaaggaagaaaa

SEQ ID NO: 5535280 - DNA, 18 bp, Homo sapiens
ttaaggaagaaaaatcag

SEQ ID NO: 5535281 - DNA, 21 bp, Homo sapiens
ttaaggaagatcctgaagcag

SEQ ID NO: 5535282 - DNA, 23 bp, Homo sapiens
ttaaggaatcaaatcttacaaaa

SEQ ID NO: 5535283 - DNA, 14 bp, Homo sapiens
ttaaggaattttgt

SEQ ID NO: 5535284 - DNA, 17 bp, Homo sapiens
ttaaggacactggggtc

SEQ ID NO: 5535285 - DNA, 18 bp, Homo sapiens
ttaaggacactggggtct

SEQ ID NO: 5535286 - DNA, 17 bp, Homo sapiens
ttaaggacagtgttcaa

SEQ ID NO: 5535287 - DNA, 21 bp, Homo sapiens
ttaaggacagtgttcaaattc

SEQ ID NO: 5535288 - DNA, 17 bp, Homo sapiens
ttaaggacccttttaag

SEQ ID NO: 5535289 - DNA, 19 bp, Homo sapiens
ttaaggacccttttaagca

SEQ ID NO: 5535290 - DNA, 23 bp, Homo sapiens
ttaaggacccttttaagcatgtg

SEQ ID NO: 5535291 - DNA, 17 bp, Homo sapiens
ttaaggactacagaatt

SEQ ID NO: 5535292 - DNA, 19 bp, Homo sapiens
ttaaggactacagaattgg

SEQ ID NO: 5535293 - DNA, 15 bp, Homo sapiens
ttaaggactgactga

SEQ ID NO: 5535294 - DNA, 17 bp, Homo sapiens
ttaaggacttctgcagc

SEQ ID NO: 5535295 - DNA, 20 bp, Homo sapiens
ttaaggagaatcatgtttct

SEQ ID NO: 5535296 - DNA, 21 bp, Homo sapiens
ttaaggagactggtaggagga

SEQ ID NO: 5535297 - DNA, 17 bp, Homo sapiens
ttaaggagcaaaaatct

SEQ ID NO: 5535298 - DNA, 19 bp, Homo sapiens
ttaaggaggtagctcccag

SEQ ID NO: 5535299 - DNA, 16 bp, Homo sapiens
ttaaggatagtgtgaa

SEQ ID NO: 5535300 - DNA, 15 bp, Homo sapiens
ttaaggatggatggc

SEQ ID NO: 5535301 - DNA, 21 bp, Homo sapiens
ttaaggatggatggcaccctg

SEQ ID NO: 5535302 - DNA, 22 bp, Homo sapiens
ttaaggatggatggcaccctgg

SEQ ID NO: 5535303 - DNA, 14 bp, Homo sapiens
ttaaggattctgca

SEQ ID NO: 5535304 - DNA, 15 bp, Homo sapiens
ttaaggattctgcag

SEQ ID NO: 5535305 - DNA, 20 bp, Homo sapiens
ttaaggattgtgatattttt

SEQ ID NO: 5535306 - DNA, 13 bp, Homo sapiens
ttaaggattttat

SEQ ID NO: 5535307 - DNA, 15 bp, Homo sapiens
ttaaggcaactgaac

SEQ ID NO: 5535308 - DNA, 14 bp, Homo sapiens
ttaaggcagtagtt

SEQ ID NO: 5535309 - DNA, 18 bp, Homo sapiens
ttaaggcccaacattaaa

SEQ ID NO: 5535310 - DNA, 21 bp, Homo sapiens
ttaaggcctaaggaagccagt

SEQ ID NO: 5535311 - DNA, 16 bp, Homo sapiens
ttaaggctctgtgcct

SEQ ID NO: 5535312 - DNA, 19 bp, Homo sapiens
ttaaggctctgtgccttgg

SEQ ID NO: 5535313 - DNA, 14 bp, Homo sapiens
ttaaggctgtgtga

SEQ ID NO: 5535314 - DNA, 14 bp, Homo sapiens
ttaagggaagctga

SEQ ID NO: 5535315 - DNA, 21 bp, Homo sapiens
ttaagggatggaaaaggaaga

SEQ ID NO: 5535316 - DNA, 10 bp, Homo sapiens
ttaagggcat

SEQ ID NO: 5535317 - DNA, 19 bp, Homo sapiens
ttaagggcatgccttgtgc

SEQ ID NO: 5535318 - DNA, 23 bp, Homo sapiens
ttaatcggttgaccctactgtgg

SEQ ID NO: 5535319 - DNA, 14 bp, Homo sapiens
ttaatcgtttttgt

SEQ ID NO: 5535320 - DNA, 18 bp, Homo sapiens
ttaatctaaaatgattgt

SEQ ID NO: 5535321 - DNA, 15 bp, Homo sapiens
ttaatctactgcatt

SEQ ID NO: 5535322 - DNA, 16 bp, Homo sapiens
ttaatctactgcattt

SEQ ID NO: 5535323 - DNA, 21 bp, Homo sapiens
ttaatctactgcatttaggga

SEQ ID NO: 5535324 - DNA, 15 bp, Homo sapiens
ttaatctactgtatc

SEQ ID NO: 5535325 - DNA, 20 bp, Homo sapiens
ttaatctactttttgtattt

SEQ ID NO: 5535326 - DNA, 21 bp, Homo sapiens
ttaatctcctgagttgtataa

SEQ ID NO: 5535327 - DNA, 18 bp, Homo sapiens
ttaatctctaaaattcta

SEQ ID NO: 5535328 - DNA, 12 bp, Homo sapiens
ttaatctctgtg

SEQ ID NO: 5535329 - DNA, 23 bp, Homo sapiens
ttaatctctgtgtgttttctttg

SEQ ID NO: 5535330 - DNA, 15 bp, Homo sapiens
ttaatctctgttatg

SEQ ID NO: 5535331 - DNA, 20 bp, Homo sapiens
ttaatctctgttatgtactg

SEQ ID NO: 5535332 - DNA, 15 bp, Homo sapiens
ttaatctgaaaattt

SEQ ID NO: 5535333 - DNA, 15 bp, Homo sapiens
ttaatctgaaattct

SEQ ID NO: 5535334 - DNA, 16 bp, Homo sapiens
ttaatctgaaattcta

SEQ ID NO: 5535335 - DNA, 20 bp, Homo sapiens
ttaatctgtaacccccaagg

SEQ ID NO: 5535336 - DNA, 16 bp, Homo sapiens
ttaatctgtatttccc

SEQ ID NO: 5535337 - DNA, 13 bp, Homo sapiens
ttaatctgtgtgt

SEQ ID NO: 5535338 - DNA, 15 bp, Homo sapiens
ttaatctgttgtttg

SEQ ID NO: 5535339 - DNA, 13 bp, Homo sapiens
ttaatcttaatgt

SEQ ID NO: 5535340 - DNA, 16 bp, Homo sapiens
ttaatcttaatgtata

SEQ ID NO: 5535341 - DNA, 13 bp, Homo sapiens
ttaatcttagctt

SEQ ID NO: 5535342 - DNA, 16 bp, Homo sapiens
ttaatcttagtgtatg

SEQ ID NO: 5535343 - DNA, 15 bp, Homo sapiens
ttaatcttatcaaga

SEQ ID NO: 5535344 - DNA, 15 bp, Homo sapiens
ttaatcttcagtttt

SEQ ID NO: 5535345 - DNA, 17 bp, Homo sapiens
ttaatcttcagttttat

SEQ ID NO: 5535346 - DNA, 21 bp, Homo sapiens
ttaatcttctctcttgattga

SEQ ID NO: 5535347 - DNA, 15 bp, Homo sapiens
ttaatcttgatcatt

SEQ ID NO: 5535348 - DNA, 19 bp, Homo sapiens
ttaatcttggatagctaat

SEQ ID NO: 5535349 - DNA, 14 bp, Homo sapiens
ttaatcttgtgtag

SEQ ID NO: 5535350 - DNA, 17 bp, Homo sapiens
ttaatctttaattttac

SEQ ID NO: 5535351 - DNA, 13 bp, Homo sapiens
ttaatctttattt

SEQ ID NO: 5535352 - DNA, 14 bp, Homo sapiens
ttaatctttcctga

SEQ ID NO: 5535353 - DNA, 17 bp, Homo sapiens
ttaatcttttcacaaat

SEQ ID NO: 5535354 - DNA, 23 bp, Homo sapiens
ttaatcttttcagccttgtaaat

SEQ ID NO: 5535355 - DNA, 20 bp, Homo sapiens
ttaatcttttcttatttttg

SEQ ID NO: 5535356 - DNA, 19 bp, Homo sapiens
ttaatgaaaaatctgaatt

SEQ ID NO: 5535357 - DNA, 21 bp, Homo sapiens
ttaatgaaaatgataaaacag

SEQ ID NO: 5535358 - DNA, 14 bp, Homo sapiens
ttaatgaaaatgtc

SEQ ID NO: 5535359 - DNA, 12 bp, Homo sapiens
ttaatgaaataa

SEQ ID NO: 5535360 - DNA, 22 bp, Homo sapiens
ttaatgaaatatctgtatttaa

SEQ ID NO: 5535361 - DNA, 14 bp, Homo sapiens
ttaatgaacaaatg

SEQ ID NO: 5535362 - DNA, 13 bp, Homo sapiens
ttaatgaactgtg

SEQ ID NO: 5535363 - DNA, 16 bp, Homo sapiens
ttaatgaactgtgaca

SEQ ID NO: 5535364 - DNA, 23 bp, Homo sapiens
ttaatgaagacccagtgtaaaga

SEQ ID NO: 5535365 - DNA, 15 bp, Homo sapiens
ttaatgaagatctaa

SEQ ID NO: 5535366 - DNA, 15 bp, Homo sapiens
ttaatgaagtttgaa

SEQ ID NO: 5535367 - DNA, 19 bp, Homo sapiens
ttaatgaatagaataaata

SEQ ID NO: 5535368 - DNA, 22 bp, Homo sapiens
ttaatgaatattgatgttaaca

SEQ ID NO: 5535369 - DNA, 21 bp, Homo sapiens
ttaatgaatttaaggcaaaaa

SEQ ID NO: 5535370 - DNA, 12 bp, Homo sapiens
ttaatgacaaca

SEQ ID NO: 5535371 - DNA, 19 bp, Homo sapiens
ttaatgacaacacttaata

SEQ ID NO: 5535372 - DNA, 20 bp, Homo sapiens
ttaatgacaacacttaatag

SEQ ID NO: 5535373 - DNA, 19 bp, Homo sapiens
ttaatgacagagccagtgg

SEQ ID NO: 5535374 - DNA, 15 bp, Homo sapiens
ttaatgacattcccc

SEQ ID NO: 5535375 - DNA, 20 bp, Homo sapiens
ttaatgaccatgttatattg

SEQ ID NO: 5535376 - DNA, 22 bp, Homo sapiens
ttaatgaccatgttatattgct

SEQ ID NO: 5535377 - DNA, 16 bp, Homo sapiens
ttaatgactctttctg

SEQ ID NO: 5535378 - DNA, 21 bp, Homo sapiens
ttaatgactggctacagagta

SEQ ID NO: 5535379 - DNA, 11 bp, Homo sapiens
ttaatgactta

SEQ ID NO: 5535380 - DNA, 12 bp, Homo sapiens
ttaatgactttt

SEQ ID NO: 5535381 - DNA, 14 bp, Homo sapiens
ttaatgacttttta

SEQ ID NO: 5535382 - DNA, 17 bp, Homo sapiens
ttaatgagaacatttac

SEQ ID NO: 5535383 - DNA, 22 bp, Homo sapiens
ttaatgagaacatttacacatt

SEQ ID NO: 5535384 - DNA, 23 bp, Homo sapiens
ttaatgagactttaaaagcattt

SEQ ID NO: 5535385 - DNA, 24 bp, Homo sapiens
ttaatgagccatcactagaagaaa

SEQ ID NO: 5535386 - DNA, 19 bp, Homo sapiens
ttaatgagtatatgtaaca

SEQ ID NO: 5535387 - DNA, 18 bp, Homo sapiens
ttaatgagtgcacctgcc

SEQ ID NO: 5535388 - DNA, 20 bp, Homo sapiens
ttaatgagtgcacctgcctc

SEQ ID NO: 5535389 - DNA, 22 bp, Homo sapiens
ttaatgagtgcacctgcctcca

SEQ ID NO: 5535390 - DNA, 14 bp, Homo sapiens
ttaatgataaaatc

SEQ ID NO: 5535391 - DNA, 23 bp, Homo sapiens
ttaatgataaactcagatctgat

SEQ ID NO: 5535392 - DNA, 21 bp, Homo sapiens
ttaatgataagtaaatgctag

SEQ ID NO: 5535393 - DNA, 21 bp, Homo sapiens
ttaatgatatgcttgtaacta

SEQ ID NO: 5535394 - DNA, 22 bp, Homo sapiens
ttaatgatctcggatgaccaaa

SEQ ID NO: 5535395 - DNA, 14 bp, Homo sapiens
ttaatgatggtgtt

SEQ ID NO: 5535396 - DNA, 20 bp, Homo sapiens
ttaatgatggtgttaaagct

SEQ ID NO: 5535397 - DNA, 22 bp, Homo sapiens
ttaatgatggtgttaaagctgt

SEQ ID NO: 5535398 - DNA, 14 bp, Homo sapiens
ttaatgattcctat

SEQ ID NO: 5535399 - DNA, 14 bp, Homo sapiens
ttaatgattctgaa

SEQ ID NO: 5535400 - DNA, 18 bp, Homo sapiens
ttaatgattcttgtgtca

SEQ ID NO: 5535401 - DNA, 19 bp, Homo sapiens
ttaatgattcttgtgtcat

SEQ ID NO: 5535402 - DNA, 23 bp, Homo sapiens
ttaatgcaaatgaaggaatgcaa

SEQ ID NO: 5535403 - DNA, 20 bp, Homo sapiens
ttaatgcaagagaacatttt

SEQ ID NO: 5535404 - DNA, 11 bp, Homo sapiens
ttaatgcactt

SEQ ID NO: 5535405 - DNA, 13 bp, Homo sapiens
ttaatgcactttc

SEQ ID NO: 5535406 - DNA, 20 bp, Homo sapiens
ttaatgcattaaacctgtct

SEQ ID NO: 5535407 - DNA, 18 bp, Homo sapiens
ttaatgcattgttgtaaa

SEQ ID NO: 5535408 - DNA, 22 bp, Homo sapiens
ttaatgcatttatcaataaaag

SEQ ID NO: 5535409 - DNA, 16 bp, Homo sapiens
ttaatgcattttgctg

SEQ ID NO: 5535410 - DNA, 13 bp, Homo sapiens
ttaatgcccagac

SEQ ID NO: 5535411 - DNA, 23 bp, Homo sapiens
ttaatgccgatatactctagatg

SEQ ID NO: 5535412 - DNA, 23 bp, Homo sapiens
ttaatgcctgcccattagagaag

SEQ ID NO: 5535413 - DNA, 19 bp, Homo sapiens
ttaatgcctgctttttgga

SEQ ID NO: 5535414 - DNA, 12 bp, Homo sapiens
ttaatgccttcc

SEQ ID NO: 5535415 - DNA, 16 bp, Homo sapiens
ttaatgccttccacat

SEQ ID NO: 5535416 - DNA, 15 bp, Homo sapiens
ttaatgcgatttctt

SEQ ID NO: 5535417 - DNA, 17 bp, Homo sapiens
ttaatgctaatcttgtg

SEQ ID NO: 5535418 - DNA, 14 bp, Homo sapiens
ttaatgctacatgt

SEQ ID NO: 5535419 - DNA, 16 bp, Homo sapiens
ttaatgctatttgaac

SEQ ID NO: 5535420 - DNA, 16 bp, Homo sapiens
ttaatgctgccttttc

SEQ ID NO: 5535421 - DNA, 13 bp, Homo sapiens
ttaatgctgtctt

SEQ ID NO: 5535422 - DNA, 24 bp, Homo sapiens
ttaatgctgtttctaagaaaatgt

SEQ ID NO: 5535423 - DNA, 22 bp, Homo sapiens
ttaatgcttaaaaatgtatccc

SEQ ID NO: 5535424 - DNA, 13 bp, Homo sapiens
ttaatgcttcatt

SEQ ID NO: 5535425 - DNA, 15 bp, Homo sapiens
ttaatgcttctttca

SEQ ID NO: 5535426 - DNA, 19 bp, Homo sapiens
ttaatgcttgaatattact

SEQ ID NO: 5535427 - DNA, 13 bp, Homo sapiens
ttaatggaaagtt

SEQ ID NO: 5535428 - DNA, 14 bp, Homo sapiens
ttaatggaaagttg

SEQ ID NO: 5535429 - DNA, 19 bp, Homo sapiens
ttaatggaaagtttgtagc

SEQ ID NO: 5535430 - DNA, 22 bp, Homo sapiens
ttaatggacaaataagtttttg

SEQ ID NO: 5535431 - DNA, 22 bp, Homo sapiens
ttaatggactgtgaatttcaaa

SEQ ID NO: 5535432 - DNA, 21 bp, Homo sapiens
ttaatggacttatttcttcaa

SEQ ID NO: 5535433 - DNA, 16 bp, Homo sapiens
ttaatggattgttaat

SEQ ID NO: 5535434 - DNA, 16 bp, Homo sapiens
ttaatggcctggaggg

SEQ ID NO: 5535435 - DNA, 20 bp, Homo sapiens
ttaatggggaccctccaaag

SEQ ID NO: 5535436 - DNA, 16 bp, Homo sapiens
ttaatggggtctgtaa

SEQ ID NO: 5535437 - DNA, 19 bp, Homo sapiens
ttaatggggtctgtaaata

SEQ ID NO: 5535438 - DNA, 23 bp, Homo sapiens
ttaatgggtttcccttgcccttt

SEQ ID NO: 5535439 - DNA, 19 bp, Homo sapiens
ttaatggtagcattcttct

SEQ ID NO: 5535440 - DNA, 16 bp, Homo sapiens
ttaatggtatctgtta

SEQ ID NO: 5535441 - DNA, 17 bp, Homo sapiens
ttaatggtgccttcatt

SEQ ID NO: 5535442 - DNA, 20 bp, Homo sapiens
ttaatggttaagaactgtga

SEQ ID NO: 5535443 - DNA, 18 bp, Homo sapiens
ttaatggtttattctttg

SEQ ID NO: 5535444 - DNA, 13 bp, Homo sapiens
ttaatgtaaaatt

SEQ ID NO: 5535445 - DNA, 18 bp, Homo sapiens
ttaatgtaaaattcatag

SEQ ID NO: 5535446 - DNA, 20 bp, Homo sapiens
ttaatgtaaagaacttaaat

SEQ ID NO: 5535447 - DNA, 15 bp, Homo sapiens
ttaatgtaataaagt

SEQ ID NO: 5535448 - DNA, 16 bp, Homo sapiens
ttaatgtaataaagtg

SEQ ID NO: 5535449 - DNA, 17 bp, Homo sapiens
ttaatgtaataaagtga

SEQ ID NO: 5535450 - DNA, 18 bp, Homo sapiens
ttaatgtacatagtgcta

SEQ ID NO: 5535451 - DNA, 12 bp, Homo sapiens
ttaatgtacttt

SEQ ID NO: 5535452 - DNA, 21 bp, Homo sapiens
ttaatgtactttttattgcat

SEQ ID NO: 5535453 - DNA, 14 bp, Homo sapiens
ttaatgtagataaa

SEQ ID NO: 5535454 - DNA, 22 bp, Homo sapiens
ttaatgtaggatgacaggctct

SEQ ID NO: 5535455 - DNA, 19 bp, Homo sapiens
ttaatgtatagtaaatcac

SEQ ID NO: 5535456 - DNA, 21 bp, Homo sapiens
ttaatgtatataaaaatggct

SEQ ID NO: 5535457 - DNA, 21 bp, Homo sapiens
ttaatgtatatttgctgcaaa

SEQ ID NO: 5535458 - DNA, 15 bp, Homo sapiens
ttaatgtatctattt

SEQ ID NO: 5535459 - DNA, 23 bp, Homo sapiens
ttaatgtatctatttgtacaatt

SEQ ID NO: 5535460 - DNA, 20 bp, Homo sapiens
ttaatgtatcttaaaggaca

SEQ ID NO: 5535461 - DNA, 17 bp, Homo sapiens
ttaatgtatgttaccaa

SEQ ID NO: 5535462 - DNA, 22 bp, Homo sapiens
ttaatgtattgttctcatgtaa

SEQ ID NO: 5535463 - DNA, 21 bp, Homo sapiens
ttaatgtatttgttcatgttt

SEQ ID NO: 5535464 - DNA, 23 bp, Homo sapiens
ttaatgtatttgttcatgtttgg

SEQ ID NO: 5535465 - DNA, 20 bp, Homo sapiens
ttaatgtatttttgtaaata

SEQ ID NO: 5535466 - DNA, 18 bp, Homo sapiens
ttaatgtcaaggaaagga

SEQ ID NO: 5535467 - DNA, 17 bp, Homo sapiens
ttaatgtcacaggcagg

SEQ ID NO: 5535468 - DNA, 18 bp, Homo sapiens
ttaatgtcacaggcaggt

SEQ ID NO: 5535469 - DNA, 14 bp, Homo sapiens
ttaatgtcagtgac

SEQ ID NO: 5535470 - DNA, 22 bp, Homo sapiens
ttaatgtcatggccttgaaaca

SEQ ID NO: 5535471 - DNA, 20 bp, Homo sapiens
ttaatgtcattgctaaaaaa

SEQ ID NO: 5535472 - DNA, 23 bp, Homo sapiens
ttaatgtctcactttactttcaa

SEQ ID NO: 5535473 - DNA, 22 bp, Homo sapiens
ttaatgtctggtgtttgtcatg

SEQ ID NO: 5535474 - DNA, 22 bp, Homo sapiens
ttaatgtctgtcagaagacact

SEQ ID NO: 5535475 - DNA, 23 bp, Homo sapiens
ttaatgtctgtcagaagacacta

SEQ ID NO: 5535476 - DNA, 16 bp, Homo sapiens
ttaatgtctttgtgtt

SEQ ID NO: 5535477 - DNA, 18 bp, Homo sapiens
ttaatgtgaactctcccc

SEQ ID NO: 5535478 - DNA, 20 bp, Homo sapiens
ttaatgtgaactctcccctc

SEQ ID NO: 5535479 - DNA, 21 bp, Homo sapiens
ttaatgtgaactctcccctcc

SEQ ID NO: 5535480 - DNA, 13 bp, Homo sapiens
ttaatgtgaactt

SEQ ID NO: 5535481 - DNA, 21 bp, Homo sapiens
ttaatgtgagggtttgtaatg

SEQ ID NO: 5535482 - DNA, 22 bp, Homo sapiens
ttaatgtgatcctaaaattgtt

SEQ ID NO: 5535483 - DNA, 20 bp, Homo sapiens
ttaatgtgatgatgtaattg

SEQ ID NO: 5535484 - DNA, 22 bp, Homo sapiens
ttaatgtgatggatggcacaat

SEQ ID NO: 5535485 - DNA, 11 bp, Homo sapiens
ttaatgtgcca

SEQ ID NO: 5535486 - DNA, 14 bp, Homo sapiens
ttaatgtgctctgt

SEQ ID NO: 5535487 - DNA, 13 bp, Homo sapiens
ttaatgtgtaaaa

SEQ ID NO: 5535488 - DNA, 22 bp, Homo sapiens
ttaatgtgtaaaattggattat

SEQ ID NO: 5535489 - DNA, 14 bp, Homo sapiens
ttaatgtgtaaaga

SEQ ID NO: 5535490 - DNA, 22 bp, Homo sapiens
ttaatgttcattttctctgtat

SEQ ID NO: 5535491 - DNA, 23 bp, Homo sapiens
ttaatgttctgaataatttctta

SEQ ID NO: 5535492 - DNA, 22 bp, Homo sapiens
ttaatgttctgaatttcctttt

SEQ ID NO: 5535493 - DNA, 17 bp, Homo sapiens
ttaatgttgaacaaaat

SEQ ID NO: 5535494 - DNA, 19 bp, Homo sapiens
ttacattaatgcccagcca

SEQ ID NO: 5535495 - DNA, 16 bp, Homo sapiens
ttacattacagaatat

SEQ ID NO: 5535496 - DNA, 14 bp, Homo sapiens
ttacattatgcaaa

SEQ ID NO: 5535497 - DNA, 15 bp, Homo sapiens
ttacattattaaacg

SEQ ID NO: 5535498 - DNA, 12 bp, Homo sapiens
ttacattattcc

SEQ ID NO: 5535499 - DNA, 13 bp, Homo sapiens
ttacattcagttg

SEQ ID NO: 5535500 - DNA, 16 bp, Homo sapiens
ttacattcatatctta

SEQ ID NO: 5535501 - DNA, 16 bp, Homo sapiens
ttacattcctaactag

SEQ ID NO: 5535502 - DNA, 13 bp, Homo sapiens
ttacattcctaga

SEQ ID NO: 5535503 - DNA, 18 bp, Homo sapiens
ttacattccttgataatg

SEQ ID NO: 5535504 - DNA, 21 bp, Homo sapiens
ttacattccttgataatgttg

SEQ ID NO: 5535505 - DNA, 14 bp, Homo sapiens
ttacattgccattt

SEQ ID NO: 5535506 - DNA, 22 bp, Homo sapiens
ttacattgctggtcttgtaaga

SEQ ID NO: 5535507 - DNA, 12 bp, Homo sapiens
ttacattgtaaa

SEQ ID NO: 5535508 - DNA, 17 bp, Homo sapiens
ttacattgtcctgtagc

SEQ ID NO: 5535509 - DNA, 16 bp, Homo sapiens
ttacattgttcaatta

SEQ ID NO: 5535510 - DNA, 17 bp, Homo sapiens
ttacattgtttgtctgt

SEQ ID NO: 5535511 - DNA, 16 bp, Homo sapiens
ttacatttaatacaga

SEQ ID NO: 5535512 - DNA, 19 bp, Homo sapiens
ttacatttaatacagataa

SEQ ID NO: 5535513 - DNA, 18 bp, Homo sapiens
ttacatttacaaactgaa

SEQ ID NO: 5535514 - DNA, 18 bp, Homo sapiens
ttacatttactgaaatgc

SEQ ID NO: 5535515 - DNA, 14 bp, Homo sapiens
ttacatttatacat

SEQ ID NO: 5535516 - DNA, 15 bp, Homo sapiens
ttacatttatacatc

SEQ ID NO: 5535517 - DNA, 11 bp, Homo sapiens
ttacatttcac

SEQ ID NO: 5535518 - DNA, 23 bp, Homo sapiens
ttacatttcacctactaatgtct

SEQ ID NO: 5535519 - DNA, 12 bp, Homo sapiens
ttacatttcatt

SEQ ID NO: 5535520 - DNA, 15 bp, Homo sapiens
ttacatttcatttat

SEQ ID NO: 5535521 - DNA, 17 bp, Homo sapiens
ttacatttcatttatac

SEQ ID NO: 5535522 - DNA, 13 bp, Homo sapiens
ttacatttgtaat

SEQ ID NO: 5535523 - DNA, 20 bp, Homo sapiens
ttacatttgtataaaataat

SEQ ID NO: 5535524 - DNA, 15 bp, Homo sapiens
ttacattttacacac

SEQ ID NO: 5535525 - DNA, 14 bp, Homo sapiens
ttacattttatggt

SEQ ID NO: 5535526 - DNA, 23 bp, Homo sapiens
ttacattttatggtgcctagtat

SEQ ID NO: 5535527 - DNA, 19 bp, Homo sapiens
ttacattttatttattagc

SEQ ID NO: 5535528 - DNA, 13 bp, Homo sapiens
ttacattttcttg

SEQ ID NO: 5535529 - DNA, 17 bp, Homo sapiens
ttacattttctttcata

SEQ ID NO: 5535530 - DNA, 20 bp, Homo sapiens
ttacatttttaagtgctgca

SEQ ID NO: 5535531 - DNA, 14 bp, Homo sapiens
ttacatttttacaa

SEQ ID NO: 5535532 - DNA, 15 bp, Homo sapiens
ttacatttttacaat

SEQ ID NO: 5535533 - DNA, 13 bp, Homo sapiens
ttacatttttatt

SEQ ID NO: 5535534 - DNA, 15 bp, Homo sapiens
ttacatttttctgat

SEQ ID NO: 5535535 - DNA, 16 bp, Homo sapiens
ttaccaaaaaagtatt

SEQ ID NO: 5535536 - DNA, 17 bp, Homo sapiens
ttaccaaaaaccatgtt

SEQ ID NO: 5535537 - DNA, 13 bp, Homo sapiens
ttaccaaaacata

SEQ ID NO: 5535538 - DNA, 20 bp, Homo sapiens
ttaccaaaaccatccatccc

SEQ ID NO: 5535539 - DNA, 16 bp, Homo sapiens
ttaccaaacagcaaac

SEQ ID NO: 5535540 - DNA, 20 bp, Homo sapiens
ttaccaaagagatattgata

SEQ ID NO: 5535541 - DNA, 16 bp, Homo sapiens
ttaccaaagatgaatg

SEQ ID NO: 5535542 - DNA, 20 bp, Homo sapiens
ttaccaaagcatcaatacaa

SEQ ID NO: 5535543 - DNA, 16 bp, Homo sapiens
ttaccaaagtgtcttt

SEQ ID NO: 5535544 - DNA, 15 bp, Homo sapiens
ttaccaaataaagta

SEQ ID NO: 5535545 - DNA, 16 bp, Homo sapiens
ttaccaaatacacatt

SEQ ID NO: 5535546 - DNA, 13 bp, Homo sapiens
ttaccaaattgct

SEQ ID NO: 5535547 - DNA, 20 bp, Homo sapiens
ttaccaacatgtatctgtct

SEQ ID NO: 5535548 - DNA, 21 bp, Homo sapiens
ttaccaacatgtatctgtcta

SEQ ID NO: 5535549 - DNA, 11 bp, Homo sapiens
ttaccaacttc

SEQ ID NO: 5535550 - DNA, 15 bp, Homo sapiens
ttaccaactttctgt

SEQ ID NO: 5535551 - DNA, 14 bp, Homo sapiens
ttaccaagagaagg

SEQ ID NO: 5535552 - DNA, 14 bp, Homo sapiens
ttaccaagagtaac

SEQ ID NO: 5535553 - DNA, 16 bp, Homo sapiens
ttaccaagagtaactt

SEQ ID NO: 5535554 - DNA, 20 bp, Homo sapiens
ttaccaaggatgaattcttt

SEQ ID NO: 5535555 - DNA, 19 bp, Homo sapiens
ttaccaagttggtcttact

SEQ ID NO: 5535556 - DNA, 11 bp, Homo sapiens
ttaccaataaa

SEQ ID NO: 5535557 - DNA, 16 bp, Homo sapiens
ttaccaataaactgag

SEQ ID NO: 5535558 - DNA, 17 bp, Homo sapiens
ttaccaataaactgagc

SEQ ID NO: 5535559 - DNA, 18 bp, Homo sapiens
ttaccaatagcctgaatt

SEQ ID NO: 5535560 - DNA, 19 bp, Homo sapiens
ttaccaataggcaaattaa

SEQ ID NO: 5535561 - DNA, 19 bp, Homo sapiens
ttaccaattccaatttcaa

SEQ ID NO: 5535562 - DNA, 23 bp, Homo sapiens
ttaccaattgaagtaaaatgtgg

SEQ ID NO: 5535563 - DNA, 21 bp, Homo sapiens
ttaccaatttaactagtcctg

SEQ ID NO: 5535564 - DNA, 11 bp, Homo sapiens
ttaccacactt

SEQ ID NO: 5535565 - DNA, 19 bp, Homo sapiens
ttaccacagagttttttaa

SEQ ID NO: 5535566 - DNA, 17 bp, Homo sapiens
ttaccacaggatgcata

SEQ ID NO: 5535567 - DNA, 15 bp, Homo sapiens
ttaccacccccacac

SEQ ID NO: 5535568 - DNA, 17 bp, Homo sapiens
ttaccaccctttcacaa

SEQ ID NO: 5535569 - DNA, 17 bp, Homo sapiens
ttaccacgccttgacct

SEQ ID NO: 5535570 - DNA, 23 bp, Homo sapiens
ttaccactctaccaaataatttc

SEQ ID NO: 5535571 - DNA, 22 bp, Homo sapiens
ttaccactgaagatagaagaaa

SEQ ID NO: 5535572 - DNA, 19 bp, Homo sapiens
ttaccactggtaacatgtg

SEQ ID NO: 5535573 - DNA, 23 bp, Homo sapiens
ttaccactgtggaagtccctcag

SEQ ID NO: 5535574 - DNA, 15 bp, Homo sapiens
ttaccacttagaaga

SEQ ID NO: 5535575 - DNA, 13 bp, Homo sapiens
ttaccagaaatat

SEQ ID NO: 5535576 - DNA, 17 bp, Homo sapiens
ttaccagaagcttccat

SEQ ID NO: 5535577 - DNA, 16 bp, Homo sapiens
ttaccagaagtttaaa

SEQ ID NO: 5535578 - DNA, 22 bp, Homo sapiens
ttaccagaagtttaaatctttg

SEQ ID NO: 5535579 - DNA, 16 bp, Homo sapiens
ttaccagacttcaaga

SEQ ID NO: 5535580 - DNA, 20 bp, Homo sapiens
ttaccagagacgcccagccc

SEQ ID NO: 5535581 - DNA, 20 bp, Homo sapiens
ttaccagagcctctttgctg

SEQ ID NO: 5535582 - DNA, 22 bp, Homo sapiens
ttaccagagcctctttgctgga

SEQ ID NO: 5535583 - DNA, 19 bp, Homo sapiens
ttaccagataatgctactt

SEQ ID NO: 5535584 - DNA, 24 bp, Homo sapiens
ttaccagatttttacacatgtatc

SEQ ID NO: 5535585 - DNA, 22 bp, Homo sapiens
ttaccagcaagaataaaaaaga

SEQ ID NO: 5535586 - DNA, 14 bp, Homo sapiens
ttaccagcagagca

SEQ ID NO: 5535587 - DNA, 20 bp, Homo sapiens
ttaccagcatatatagtatt

SEQ ID NO: 5535588 - DNA, 14 bp, Homo sapiens
ttaccagcatttgt

SEQ ID NO: 5535589 - DNA, 18 bp, Homo sapiens
ttaccagcatttgtcctt

SEQ ID NO: 5535590 - DNA, 21 bp, Homo sapiens
ttaccagcctccgtatttcag

SEQ ID NO: 5535591 - DNA, 19 bp, Homo sapiens
ttaccagcttaaaacactt

SEQ ID NO: 5535592 - DNA, 16 bp, Homo sapiens
ttaccagcttttaacc

SEQ ID NO: 5535593 - DNA, 21 bp, Homo sapiens
ttaccagggactatctttgct

SEQ ID NO: 5535594 - DNA, 17 bp, Homo sapiens
ttaccagggtctttgca

SEQ ID NO: 5535595 - DNA, 18 bp, Homo sapiens
ttaccaggttgtcctcaa

SEQ ID NO: 5535596 - DNA, 22 bp, Homo sapiens
ttaccagtaaagtgtaacatat

SEQ ID NO: 5535597 - DNA, 21 bp, Homo sapiens
ttaccagtatttaacttctga

SEQ ID NO: 5535598 - DNA, 21 bp, Homo sapiens
ttaccagtctttaaaggccca

SEQ ID NO: 5535599 - DNA, 18 bp, Homo sapiens
ttaccagtgccttaaact

SEQ ID NO: 5535600 - DNA, 16 bp, Homo sapiens
ttaccatactgtctct

SEQ ID NO: 5535601 - DNA, 17 bp, Homo sapiens
ttaccatactgtctctg

SEQ ID NO: 5535602 - DNA, 19 bp, Homo sapiens
ttaccatactgtctctgga

SEQ ID NO: 5535603 - DNA, 17 bp, Homo sapiens
ttaccatagttttctca

SEQ ID NO: 5535604 - DNA, 20 bp, Homo sapiens
ttaccatgagaagagggcct

SEQ ID NO: 5535605 - DNA, 17 bp, Homo sapiens
ttaccatgcatttctcg

SEQ ID NO: 5535606 - DNA, 19 bp, Homo sapiens
ttaccatggagttaacatc

SEQ ID NO: 5535607 - DNA, 22 bp, Homo sapiens
ttaccatgggtgtggatggcag

SEQ ID NO: 5535608 - DNA, 23 bp, Homo sapiens
ttaccatgggtgtggatggcagt

SEQ ID NO: 5535609 - DNA, 14 bp, Homo sapiens
ttaccatgtaaata

SEQ ID NO: 5535610 - DNA, 21 bp, Homo sapiens
ttaccatgtaaataatctgtg

SEQ ID NO: 5535611 - DNA, 23 bp, Homo sapiens
ttaccattaaaccatctccctgg

SEQ ID NO: 5535612 - DNA, 12 bp, Homo sapiens
ttaccattagca

SEQ ID NO: 5535613 - DNA, 17 bp, Homo sapiens
ttaccattagcataatt

SEQ ID NO: 5535614 - DNA, 19 bp, Homo sapiens
ttaccattattttacagtc

SEQ ID NO: 5535615 - DNA, 17 bp, Homo sapiens
ttaccattcacaataaa

SEQ ID NO: 5535616 - DNA, 19 bp, Homo sapiens
ttaccatttgttaatatca

SEQ ID NO: 5535617 - DNA, 16 bp, Homo sapiens
ttaccattttaacgct

SEQ ID NO: 5535618 - DNA, 16 bp, Homo sapiens
ttaccatttttctgga

SEQ ID NO: 5535619 - DNA, 11 bp, Homo sapiens
ttacccaaagc

SEQ ID NO: 5535620 - DNA, 13 bp, Homo sapiens
ttacccaaatatg

SEQ ID NO: 5535621 - DNA, 20 bp, Homo sapiens
ttacccaaggatttttaaaa

SEQ ID NO: 5535622 - DNA, 18 bp, Homo sapiens
ttacccactcggtcccag

SEQ ID NO: 5535623 - DNA, 19 bp, Homo sapiens
ttacccactgtcaggcctc

SEQ ID NO: 5535624 - DNA, 16 bp, Homo sapiens
ttacccagaatgtcag

SEQ ID NO: 5535625 - DNA, 16 bp, Homo sapiens
ttacccagattgtgta

SEQ ID NO: 5535626 - DNA, 18 bp, Homo sapiens
ttacccagattgtgtaca

SEQ ID NO: 5535627 - DNA, 23 bp, Homo sapiens
ttacccataaacagcacacctgt

SEQ ID NO: 5535628 - DNA, 17 bp, Homo sapiens
ttacccatatcccctct

SEQ ID NO: 5535629 - DNA, 21 bp, Homo sapiens
ttacccatcttgcttccaaga

SEQ ID NO: 5535630 - DNA, 23 bp, Homo sapiens
ttacccatttgggtgggagtgtt

SEQ ID NO: 5535631 - DNA, 13 bp, Homo sapiens
ttaccccagctcc

SEQ ID NO: 5535632 - DNA, 23 bp, Homo sapiens
ttaccccagctccatccttgcat

SEQ ID NO: 5535633 - DNA, 21 bp, Homo sapiens
ttaccccataccccttattgc

SEQ ID NO: 5535634 - DNA, 20 bp, Homo sapiens
ttacccccagctttgaggaa

SEQ ID NO: 5535635 - DNA, 17 bp, Homo sapiens
ttacccccattcgcgct

SEQ ID NO: 5535636 - DNA, 17 bp, Homo sapiens
ttacccctgcacagttt

SEQ ID NO: 5535637 - DNA, 21 bp, Homo sapiens
ttacccgaaagcatcactgcc

SEQ ID NO: 5535638 - DNA, 22 bp, Homo sapiens
ttacccgcagatcctgtcccat

SEQ ID NO: 5535639 - DNA, 13 bp, Homo sapiens
ttaccctacagac

SEQ ID NO: 5535640 - DNA, 16 bp, Homo sapiens
ttaccctacagacagc

SEQ ID NO: 5535641 - DNA, 16 bp, Homo sapiens
ttaccctactggctgt

SEQ ID NO: 5535642 - DNA, 22 bp, Homo sapiens
ttaccctagttctcttatcttt

SEQ ID NO: 5535643 - DNA, 16 bp, Homo sapiens
ttaccctccacacact

SEQ ID NO: 5535644 - DNA, 15 bp, Homo sapiens
ttaccctccctgtcc

SEQ ID NO: 5535645 - DNA, 19 bp, Homo sapiens
ttaccctccctgtcccctg

SEQ ID NO: 5535646 - DNA, 18 bp, Homo sapiens
ttaccctcctagctttcc

SEQ ID NO: 5535647 - DNA, 18 bp, Homo sapiens
ttaccctcctctgctggg

SEQ ID NO: 5535648 - DNA, 12 bp, Homo sapiens
ttaccctgggaa

SEQ ID NO: 5535649 - DNA, 15 bp, Homo sapiens
ttaccctgggctgga

SEQ ID NO: 5535650 - DNA, 16 bp, Homo sapiens
ttaccctggtggaggc

SEQ ID NO: 5535651 - DNA, 18 bp, Homo sapiens
ttacccttcaatgttaaa

SEQ ID NO: 5535652 - DNA, 17 bp, Homo sapiens
ttacccttccctgcact

SEQ ID NO: 5535653 - DNA, 22 bp, Homo sapiens
ttacccttcctcatctgtgcct

SEQ ID NO: 5535654 - DNA, 20 bp, Homo sapiens
ttacccttctgtgcccagct

SEQ ID NO: 5535655 - DNA, 22 bp, Homo sapiens
ttacccttctgtgcccagctca

SEQ ID NO: 5535656 - DNA, 16 bp, Homo sapiens
ttaccctttagactgt

SEQ ID NO: 5535657 - DNA, 18 bp, Homo sapiens
ttaccgcccacccagcag

SEQ ID NO: 5535658 - DNA, 21 bp, Homo sapiens
ttaccgcgtaatgcgccaata

SEQ ID NO: 5535659 - DNA, 16 bp, Homo sapiens
ttaccgcgttgtaaaa

SEQ ID NO: 5535660 - DNA, 18 bp, Homo sapiens
ttaccgcgttgtaaaata

SEQ ID NO: 5535661 - DNA, 18 bp, Homo sapiens
ttaccggttgattgaaat

SEQ ID NO: 5535662 - DNA, 20 bp, Homo sapiens
ttaccgtgtgttatataact

SEQ ID NO: 5535663 - DNA, 17 bp, Homo sapiens
ttacctaaacagatata

SEQ ID NO: 5535664 - DNA, 13 bp, Homo sapiens
ttacctaaactga

SEQ ID NO: 5535665 - DNA, 15 bp, Homo sapiens
ttacctaaagtattt

SEQ ID NO: 5535666 - DNA, 20 bp, Homo sapiens
ttacctaagtgacatttgta

SEQ ID NO: 5535667 - DNA, 18 bp, Homo sapiens
ttacctaccaccttccct

SEQ ID NO: 5535668 - DNA, 21 bp, Homo sapiens
ttacctaccaccttccctctt

SEQ ID NO: 5535669 - DNA, 17 bp, Homo sapiens
ttacctactattggccc

SEQ ID NO: 5535670 - DNA, 21 bp, Homo sapiens
ttacctactgtgtcttggaat

SEQ ID NO: 5535671 - DNA, 19 bp, Homo sapiens
ttacttagtattgcaaagt

SEQ ID NO: 5535672 - DNA, 17 bp, Homo sapiens
ttacttatcatccacat

SEQ ID NO: 5535673 - DNA, 14 bp, Homo sapiens
ttacttatgtagaa

SEQ ID NO: 5535674 - DNA, 19 bp, Homo sapiens
ttacttcaaagtgcctggg

SEQ ID NO: 5535675 - DNA, 22 bp, Homo sapiens
ttacttcaaagtgcctgggctc

SEQ ID NO: 5535676 - DNA, 21 bp, Homo sapiens
ttacttcactatacaaacaaa

SEQ ID NO: 5535677 - DNA, 19 bp, Homo sapiens
ttacttcactttaattctc

SEQ ID NO: 5535678 - DNA, 17 bp, Homo sapiens
ttacttcactttcatct

SEQ ID NO: 5535679 - DNA, 18 bp, Homo sapiens
ttacttcactttcatctg

SEQ ID NO: 5535680 - DNA, 22 bp, Homo sapiens
ttacttccacagaatacaagcc

SEQ ID NO: 5535681 - DNA, 19 bp, Homo sapiens
ttacttccagcaaaatcca

SEQ ID NO: 5535682 - DNA, 19 bp, Homo sapiens
ttacttccagcaagcaaag

SEQ ID NO: 5535683 - DNA, 12 bp, Homo sapiens
ttacttccccca

SEQ ID NO: 5535684 - DNA, 14 bp, Homo sapiens
ttacttcctggcct

SEQ ID NO: 5535685 - DNA, 15 bp, Homo sapiens
ttacttcctggcctc

SEQ ID NO: 5535686 - DNA, 18 bp, Homo sapiens
ttacttcgtgcgcaacaa

SEQ ID NO: 5535687 - DNA, 18 bp, Homo sapiens
ttacttctaatcttaaat

SEQ ID NO: 5535688 - DNA, 18 bp, Homo sapiens
ttacttctagtcagtcat

SEQ ID NO: 5535689 - DNA, 18 bp, Homo sapiens
ttacttctctataaaaaa

SEQ ID NO: 5535690 - DNA, 12 bp, Homo sapiens
ttacttctgcta

SEQ ID NO: 5535691 - DNA, 23 bp, Homo sapiens
ttacttcttatacatttgataaa

SEQ ID NO: 5535692 - DNA, 13 bp, Homo sapiens
ttacttcttctct

SEQ ID NO: 5535693 - DNA, 13 bp, Homo sapiens
ttacttgaaagat

SEQ ID NO: 5535694 - DNA, 12 bp, Homo sapiens
ttacttgaaata

SEQ ID NO: 5535695 - DNA, 14 bp, Homo sapiens
ttacttgaaataag

SEQ ID NO: 5535696 - DNA, 17 bp, Homo sapiens
ttacttgaactttccaa

SEQ ID NO: 5535697 - DNA, 12 bp, Homo sapiens
ttacttgaagta

SEQ ID NO: 5535698 - DNA, 16 bp, Homo sapiens
ttacttgaatttcaaa

SEQ ID NO: 5535699 - DNA, 13 bp, Homo sapiens
ttacttgagaagt

SEQ ID NO: 5535700 - DNA, 13 bp, Homo sapiens
ttacttgagcaaa

SEQ ID NO: 5535701 - DNA, 22 bp, Homo sapiens
ttacttgagtatcataatatat

SEQ ID NO: 5535702 - DNA, 15 bp, Homo sapiens
ttacttgataaggga

SEQ ID NO: 5535703 - DNA, 20 bp, Homo sapiens
ttacttgatagacttactaa

SEQ ID NO: 5535704 - DNA, 12 bp, Homo sapiens
ttacttgatcat

SEQ ID NO: 5535705 - DNA, 23 bp, Homo sapiens
ttacttgcaaaatggagaccaaa

SEQ ID NO: 5535706 - DNA, 12 bp, Homo sapiens
ttacttgcacaa

SEQ ID NO: 5535707 - DNA, 18 bp, Homo sapiens
ttacttgcattgctggac

SEQ ID NO: 5535708 - DNA, 14 bp, Homo sapiens
ttacttgctataaa

SEQ ID NO: 5535709 - DNA, 13 bp, Homo sapiens
ttacttgcttcag

SEQ ID NO: 5535710 - DNA, 14 bp, Homo sapiens
ttacttgcttcagt

SEQ ID NO: 5535711 - DNA, 16 bp, Homo sapiens
ttacttgctttcaatt

SEQ ID NO: 5535712 - DNA, 22 bp, Homo sapiens
ttacttgctttcaattgacaaa

SEQ ID NO: 5535713 - DNA, 23 bp, Homo sapiens
ttacttgctttcaattgacaaat

SEQ ID NO: 5535714 - DNA, 21 bp, Homo sapiens
ttacttggaaatattaaaaga

SEQ ID NO: 5535715 - DNA, 14 bp, Homo sapiens
ttacttggcttttt

SEQ ID NO: 5535716 - DNA, 14 bp, Homo sapiens
ttacttgggaaatt

SEQ ID NO: 5535717 - DNA, 13 bp, Homo sapiens
ttacttgtaaata

SEQ ID NO: 5535718 - DNA, 16 bp, Homo sapiens
ttacttgtaaatataa

SEQ ID NO: 5535719 - DNA, 19 bp, Homo sapiens
ttacttgtaaatataaaga

SEQ ID NO: 5535720 - DNA, 22 bp, Homo sapiens
ttacttgtagaaatctgtaatt

SEQ ID NO: 5535721 - DNA, 13 bp, Homo sapiens
ttacttgtctgta

SEQ ID NO: 5535722 - DNA, 16 bp, Homo sapiens
ttacttgtctttgatt

SEQ ID NO: 5535723 - DNA, 15 bp, Homo sapiens
ttacttgtgcactta

SEQ ID NO: 5535724 - DNA, 14 bp, Homo sapiens
ttacttgtggtgtg

SEQ ID NO: 5535725 - DNA, 15 bp, Homo sapiens
ttacttgtggtgtga

SEQ ID NO: 5535726 - DNA, 16 bp, Homo sapiens
ttacttgttcatttct

SEQ ID NO: 5535727 - DNA, 16 bp, Homo sapiens
ttacttgtttaattct

SEQ ID NO: 5535728 - DNA, 23 bp, Homo sapiens
ttacttgttttcggggagaaata

SEQ ID NO: 5535729 - DNA, 18 bp, Homo sapiens
ttactttaaaaggagcca

SEQ ID NO: 5535730 - DNA, 16 bp, Homo sapiens
ttactttaaacttgtc

SEQ ID NO: 5535731 - DNA, 13 bp, Homo sapiens
ttactttaaagta

SEQ ID NO: 5535732 - DNA, 15 bp, Homo sapiens
ttactttaaattata

SEQ ID NO: 5535733 - DNA, 13 bp, Homo sapiens
ttactttaacatt

SEQ ID NO: 5535734 - DNA, 20 bp, Homo sapiens
ttactttaacattttggaaa

SEQ ID NO: 5535735 - DNA, 21 bp, Homo sapiens
ttactttaacattttggaaat

SEQ ID NO: 5535736 - DNA, 23 bp, Homo sapiens
ttactttaacctccctcaacaag

SEQ ID NO: 5535737 - DNA, 22 bp, Homo sapiens
ttactttaacttagttttgcat

SEQ ID NO: 5535738 - DNA, 21 bp, Homo sapiens
ttactttaatactcacctcct

SEQ ID NO: 5535739 - DNA, 15 bp, Homo sapiens
ttactttaccacccc

SEQ ID NO: 5535740 - DNA, 20 bp, Homo sapiens
ttactttaccacccccacac

SEQ ID NO: 5535741 - DNA, 13 bp, Homo sapiens
ttactttagaaaa

SEQ ID NO: 5535742 - DNA, 18 bp, Homo sapiens
ttactttagaagcctgca

SEQ ID NO: 5535743 - DNA, 24 bp, Homo sapiens
ttactttagttagcatgcgcgctg

SEQ ID NO: 5535744 - DNA, 17 bp, Homo sapiens
ttactttcaagtaatat

SEQ ID NO: 5535745 - DNA, 14 bp, Homo sapiens
ttactttcagtttt

SEQ ID NO: 5535746 - DNA, 15 bp, Homo sapiens
ttactttccattgct

SEQ ID NO: 5535747 - DNA, 17 bp, Homo sapiens
ttactttcccttgcttt

SEQ ID NO: 5535748 - DNA, 21 bp, Homo sapiens
ttactttcctttccccagccc

SEQ ID NO: 5535749 - DNA, 16 bp, Homo sapiens
ttactttctctctcct

SEQ ID NO: 5535750 - DNA, 15 bp, Homo sapiens
ttactttctctgtag

SEQ ID NO: 5535751 - DNA, 13 bp, Homo sapiens
ttactttcttaat

SEQ ID NO: 5535752 - DNA, 19 bp, Homo sapiens
ttactttctttcagatgtt

SEQ ID NO: 5535753 - DNA, 11 bp, Homo sapiens
ttactttgaac

SEQ ID NO: 5535754 - DNA, 11 bp, Homo sapiens
ttactttgaat

SEQ ID NO: 5535755 - DNA, 20 bp, Homo sapiens
ttactttgcattttgtttca

SEQ ID NO: 5535756 - DNA, 13 bp, Homo sapiens
ttactttgctgag

SEQ ID NO: 5535757 - DNA, 20 bp, Homo sapiens
ttactttgcttgagaatcct

SEQ ID NO: 5535758 - DNA, 20 bp, Homo sapiens
ttactttggcaatttcctgg

SEQ ID NO: 5535759 - DNA, 21 bp, Homo sapiens
ttactttggggctaatttaac

SEQ ID NO: 5535760 - DNA, 19 bp, Homo sapiens
ttactttgtaaattctgat

SEQ ID NO: 5535761 - DNA, 13 bp, Homo sapiens
ttactttgtaatt

SEQ ID NO: 5535762 - DNA, 12 bp, Homo sapiens
ttactttgtatg

SEQ ID NO: 5535763 - DNA, 13 bp, Homo sapiens
ttactttgtatga

SEQ ID NO: 5535764 - DNA, 14 bp, Homo sapiens
ttactttgtgcaaa

SEQ ID NO: 5535765 - DNA, 18 bp, Homo sapiens
ttactttgtgcaatatga

SEQ ID NO: 5535766 - DNA, 11 bp, Homo sapiens
ttactttgtgt

SEQ ID NO: 5535767 - DNA, 20 bp, Homo sapiens
ttacttttaaatattaactc

SEQ ID NO: 5535768 - DNA, 23 bp, Homo sapiens
ttacttttaccactatttaagtt

SEQ ID NO: 5535769 - DNA, 21 bp, Homo sapiens
ttacttttatttgcaacattt

SEQ ID NO: 5535770 - DNA, 21 bp, Homo sapiens
ttacttttcacactgtcttcc

SEQ ID NO: 5535771 - DNA, 20 bp, Homo sapiens
ttacttttccttgcatacaa

SEQ ID NO: 5535772 - DNA, 17 bp, Homo sapiens
ttacttttctgccaaaa

SEQ ID NO: 5535773 - DNA, 14 bp, Homo sapiens
ttacttttgggagg

SEQ ID NO: 5535774 - DNA, 13 bp, Homo sapiens
ttacttttgtaaa

SEQ ID NO: 5535775 - DNA, 15 bp, Homo sapiens
ttacttttgtaaata

SEQ ID NO: 5535776 - DNA, 18 bp, Homo sapiens
ttacttttgtcttcctca

SEQ ID NO: 5535777 - DNA, 20 bp, Homo sapiens
ttacttttgttctgtatttt

SEQ ID NO: 5535778 - DNA, 17 bp, Homo sapiens
ttactttttaaaaataa

SEQ ID NO: 5535779 - DNA, 18 bp, Homo sapiens
ttactttttaaacagtgt

SEQ ID NO: 5535780 - DNA, 21 bp, Homo sapiens
ttactttttatatagcaaaat

SEQ ID NO: 5535781 - DNA, 13 bp, Homo sapiens
ttactttttatgg

SEQ ID NO: 5535782 - DNA, 14 bp, Homo sapiens
ttactttttcccat

SEQ ID NO: 5535783 - DNA, 18 bp, Homo sapiens
ttactttttgtaaatgct

SEQ ID NO: 5535784 - DNA, 15 bp, Homo sapiens
ttacttttttaaaat

SEQ ID NO: 5535785 - DNA, 13 bp, Homo sapiens
ttacttttttaca

SEQ ID NO: 5535786 - DNA, 15 bp, Homo sapiens
ttacttttttacact

SEQ ID NO: 5535787 - DNA, 15 bp, Homo sapiens
ttacttttttatagc

SEQ ID NO: 5535788 - DNA, 16 bp, Homo sapiens
ttacttttttatagct

SEQ ID NO: 5535789 - DNA, 22 bp, Homo sapiens
ttactttttttctgtgacattt

SEQ ID NO: 5535790 - DNA, 19 bp, Homo sapiens
ttactttttttttttggtg

SEQ ID NO: 5535791 - DNA, 23 bp, Homo sapiens
ttagaaaaaaaactgaagatgaa

SEQ ID NO: 5535792 - DNA, 15 bp, Homo sapiens
ttagaaaaaaattac

SEQ ID NO: 5535793 - DNA, 14 bp, Homo sapiens
ttagaaaaaacaat

SEQ ID NO: 5535794 - DNA, 19 bp, Homo sapiens
ttagaaaaaacaatttttg

SEQ ID NO: 5535795 - DNA, 17 bp, Homo sapiens
ttagaaaaaactggaaa

SEQ ID NO: 5535796 - DNA, 20 bp, Homo sapiens
ttagaaaaaactggaaacat

SEQ ID NO: 5535797 - DNA, 21 bp, Homo sapiens
ttagaaaaacatttaaacttt

SEQ ID NO: 5535798 - DNA, 14 bp, Homo sapiens
ttagaaaaagaaca

SEQ ID NO: 5535799 - DNA, 21 bp, Homo sapiens
ttagaaaaagaacatgcagtt

SEQ ID NO: 5535800 - DNA, 14 bp, Homo sapiens
ttagaaaacattca

SEQ ID NO: 5535801 - DNA, 23 bp, Homo sapiens
ttagaaaaccagctcagcactgc

SEQ ID NO: 5535802 - DNA, 15 bp, Homo sapiens
ttagaaaactttgtt

SEQ ID NO: 5535803 - DNA, 21 bp, Homo sapiens
ttagaaaaggtgataaaatca

SEQ ID NO: 5535804 - DNA, 22 bp, Homo sapiens
ttagaaaagtggtgtaaacttg

SEQ ID NO: 5535805 - DNA, 17 bp, Homo sapiens
ttagaaaagttaacatt

SEQ ID NO: 5535806 - DNA, 22 bp, Homo sapiens
ttagaaaataggggttaagact

SEQ ID NO: 5535807 - DNA, 15 bp, Homo sapiens
ttagaaaatatagtt

SEQ ID NO: 5535808 - DNA, 16 bp, Homo sapiens
ttagaaaatcagattt

SEQ ID NO: 5535809 - DNA, 22 bp, Homo sapiens
ttagaaaatgacttatttctgc

SEQ ID NO: 5535810 - DNA, 13 bp, Homo sapiens
ttagaaaatgtgt

SEQ ID NO: 5535811 - DNA, 19 bp, Homo sapiens
ttagaaaatgttatttaac

SEQ ID NO: 5535812 - DNA, 20 bp, Homo sapiens
ttagaaaatgtttggaattt

SEQ ID NO: 5535813 - DNA, 18 bp, Homo sapiens
ttagaaaattcagctcct

SEQ ID NO: 5535814 - DNA, 19 bp, Homo sapiens
ttagaaaattcagctcctt

SEQ ID NO: 5535815 - DNA, 16 bp, Homo sapiens
ttagaaaattttgtaa

SEQ ID NO: 5535816 - DNA, 21 bp, Homo sapiens
ttagaaaattttgtaaaacaa

SEQ ID NO: 5535817 - DNA, 22 bp, Homo sapiens
ttagaaaattttgtaaaacaat

SEQ ID NO: 5535818 - DNA, 21 bp, Homo sapiens
ttagaaacacacttttgcaca

SEQ ID NO: 5535819 - DNA, 15 bp, Homo sapiens
ttagaaacacataaa

SEQ ID NO: 5535820 - DNA, 16 bp, Homo sapiens
ttagaaacaccattca

SEQ ID NO: 5535821 - DNA, 13 bp, Homo sapiens
ttagaaacataaa

SEQ ID NO: 5535822 - DNA, 12 bp, Homo sapiens
ttagaaacatgt

SEQ ID NO: 5535823 - DNA, 20 bp, Homo sapiens
ttagaaacctcattggccag

SEQ ID NO: 5535824 - DNA, 18 bp, Homo sapiens
ttagaaaccttaatatgt

SEQ ID NO: 5535825 - DNA, 10 bp, Homo sapiens
ttagaaacta

SEQ ID NO: 5535826 - DNA, 18 bp, Homo sapiens
ttagaaagaaaattatat

SEQ ID NO: 5535827 - DNA, 21 bp, Homo sapiens
ttagaaagaaaattatattct

SEQ ID NO: 5535828 - DNA, 21 bp, Homo sapiens
ttagaaagggaaggaaatccc

SEQ ID NO: 5535829 - DNA, 13 bp, Homo sapiens
ttagaaaggttaa

SEQ ID NO: 5535830 - DNA, 21 bp, Homo sapiens
ttagaaagtagccacgtatgg

SEQ ID NO: 5535831 - DNA, 19 bp, Homo sapiens
ttagaaataaaagatgata

SEQ ID NO: 5535832 - DNA, 15 bp, Homo sapiens
ttagaaatagacagt

SEQ ID NO: 5535833 - DNA, 11 bp, Homo sapiens
ttagaaatata

SEQ ID NO: 5535834 - DNA, 15 bp, Homo sapiens
ttagaaatattaaag

SEQ ID NO: 5535835 - DNA, 13 bp, Homo sapiens
ttagaaatattca

SEQ ID NO: 5535836 - DNA, 19 bp, Homo sapiens
ttagaaatattcacatctt

SEQ ID NO: 5535837 - DNA, 13 bp, Homo sapiens
ttagaaatatttt

SEQ ID NO: 5535838 - DNA, 16 bp, Homo sapiens
ttagaaatcaagcata

SEQ ID NO: 5535839 - DNA, 17 bp, Homo sapiens
ttagaaatcaagcataa

SEQ ID NO: 5535840 - DNA, 18 bp, Homo sapiens
ttagaaatcaagcataaa

SEQ ID NO: 5535841 - DNA, 19 bp, Homo sapiens
ttagaaatcattgtagaaa

SEQ ID NO: 5535842 - DNA, 13 bp, Homo sapiens
ttagaaatcattt

SEQ ID NO: 5535843 - DNA, 17 bp, Homo sapiens
ttagaaatgaccaatat

SEQ ID NO: 5535844 - DNA, 16 bp, Homo sapiens
ttagaaatgcagaatc

SEQ ID NO: 5535845 - DNA, 22 bp, Homo sapiens
ttagaaatgtgaagaggtctga

SEQ ID NO: 5535846 - DNA, 15 bp, Homo sapiens
ttagaaattacaagt

SEQ ID NO: 5535847 - DNA, 20 bp, Homo sapiens
ttagaaattacaagtttcag

SEQ ID NO: 5535848 - DNA, 23 bp, Homo sapiens
ttagaaattacctgtggatattt

SEQ ID NO: 5535849 - DNA, 17 bp, Homo sapiens
ttagaaattataatttt

SEQ ID NO: 5535850 - DNA, 17 bp, Homo sapiens
ttagggagtattctaat

SEQ ID NO: 5535851 - DNA, 19 bp, Homo sapiens
ttagggagtggttcctgtg

SEQ ID NO: 5535852 - DNA, 21 bp, Homo sapiens
ttagggatagtactaagcatt

SEQ ID NO: 5535853 - DNA, 15 bp, Homo sapiens
ttagggcatttttct

SEQ ID NO: 5535854 - DNA, 20 bp, Homo sapiens
ttagggcggggagaagagca

SEQ ID NO: 5535855 - DNA, 15 bp, Homo sapiens
ttagggctctaattt

SEQ ID NO: 5535856 - DNA, 11 bp, Homo sapiens
ttagggctgct

SEQ ID NO: 5535857 - DNA, 13 bp, Homo sapiens
ttagggctgcttt

SEQ ID NO: 5535858 - DNA, 14 bp, Homo sapiens
ttaggggaaaatag

SEQ ID NO: 5535859 - DNA, 20 bp, Homo sapiens
ttaggggaagtaaaacagtc

SEQ ID NO: 5535860 - DNA, 19 bp, Homo sapiens
ttaggggaagtatgtgtgg

SEQ ID NO: 5535861 - DNA, 17 bp, Homo sapiens
ttaggggatggggagga

SEQ ID NO: 5535862 - DNA, 22 bp, Homo sapiens
ttaggggatttttttttagaca

SEQ ID NO: 5535863 - DNA, 16 bp, Homo sapiens
ttagggggtgggaggg

SEQ ID NO: 5535864 - DNA, 11 bp, Homo sapiens
ttagggtacag

SEQ ID NO: 5535865 - DNA, 14 bp, Homo sapiens
ttagggtacattta

SEQ ID NO: 5535866 - DNA, 21 bp, Homo sapiens
ttagggtcctgtcgaagggga

SEQ ID NO: 5535867 - DNA, 15 bp, Homo sapiens
ttagggtgcagccac

SEQ ID NO: 5535868 - DNA, 16 bp, Homo sapiens
ttagggttatgattaa

SEQ ID NO: 5535869 - DNA, 16 bp, Homo sapiens
ttagggttctatattt

SEQ ID NO: 5535870 - DNA, 13 bp, Homo sapiens
ttaggtaaataaa

SEQ ID NO: 5535871 - DNA, 23 bp, Homo sapiens
ttaggtaagaagttttaaaaagc

SEQ ID NO: 5535872 - DNA, 23 bp, Homo sapiens
ttaggtagatgagaaaacaggct

SEQ ID NO: 5535873 - DNA, 14 bp, Homo sapiens
ttaggtagcacagc

SEQ ID NO: 5535874 - DNA, 19 bp, Homo sapiens
ttaggtatgtttgtaactt

SEQ ID NO: 5535875 - DNA, 22 bp, Homo sapiens
ttaggtcaataacactgtattt

SEQ ID NO: 5535876 - DNA, 22 bp, Homo sapiens
ttaggtcacattacattaacat

SEQ ID NO: 5535877 - DNA, 22 bp, Homo sapiens
ttaggtcatccaacctctttcc

SEQ ID NO: 5535878 - DNA, 14 bp, Homo sapiens
ttaggtcccgggag

SEQ ID NO: 5535879 - DNA, 21 bp, Homo sapiens
ttaggtctgttgaagtgcatg

SEQ ID NO: 5535880 - DNA, 16 bp, Homo sapiens
ttaggtgaggaagcaa

SEQ ID NO: 5535881 - DNA, 18 bp, Homo sapiens
ttaggtgcaatttcaagg

SEQ ID NO: 5535882 - DNA, 22 bp, Homo sapiens
ttaggtgcctggatattttttg

SEQ ID NO: 5535883 - DNA, 22 bp, Homo sapiens
ttaggtggccgctcctccctgc

SEQ ID NO: 5535884 - DNA, 21 bp, Homo sapiens
ttaggtgtgactgaatttctt

SEQ ID NO: 5535885 - DNA, 19 bp, Homo sapiens
ttaggtgtgggggaagcac

SEQ ID NO: 5535886 - DNA, 12 bp, Homo sapiens
ttaggttaacat

SEQ ID NO: 5535887 - DNA, 14 bp, Homo sapiens
ttaggttaggactt

SEQ ID NO: 5535888 - DNA, 22 bp, Homo sapiens
ttaggttatggtttaatgttac

SEQ ID NO: 5535889 - DNA, 14 bp, Homo sapiens
ttaggttattttgc

SEQ ID NO: 5535890 - DNA, 14 bp, Homo sapiens
ttaggttctaaagt

SEQ ID NO: 5535891 - DNA, 22 bp, Homo sapiens
ttaggttctaaagttctaagat

SEQ ID NO: 5535892 - DNA, 18 bp, Homo sapiens
ttaggttggcaaaaaggc

SEQ ID NO: 5535893 - DNA, 13 bp, Homo sapiens
ttaggttgttacc

SEQ ID NO: 5535894 - DNA, 15 bp, Homo sapiens
ttaggtttactgtga

SEQ ID NO: 5535895 - DNA, 16 bp, Homo sapiens
ttaggttttgtacaat

SEQ ID NO: 5535896 - DNA, 16 bp, Homo sapiens
ttaggtttttccttat

SEQ ID NO: 5535897 - DNA, 13 bp, Homo sapiens
ttaggtttttggc

SEQ ID NO: 5535898 - DNA, 22 bp, Homo sapiens
ttagtaaaaaatcaattaacca

SEQ ID NO: 5535899 - DNA, 13 bp, Homo sapiens
ttagtaaaaacat

SEQ ID NO: 5535900 - DNA, 14 bp, Homo sapiens
ttagtaaaaacatt

SEQ ID NO: 5535901 - DNA, 21 bp, Homo sapiens
ttagtaaaattatctgttcta

SEQ ID NO: 5535902 - DNA, 12 bp, Homo sapiens
ttagtaaaccaa

SEQ ID NO: 5535903 - DNA, 13 bp, Homo sapiens
ttagtaaatacat

SEQ ID NO: 5535904 - DNA, 20 bp, Homo sapiens
ttagtaaatatgtgaagaaa

SEQ ID NO: 5535905 - DNA, 13 bp, Homo sapiens
ttagtaaatgtct

SEQ ID NO: 5535906 - DNA, 16 bp, Homo sapiens
ttagtaaatgtctttg

SEQ ID NO: 5535907 - DNA, 20 bp, Homo sapiens
ttagtaaatgtctttgtaag

SEQ ID NO: 5535908 - DNA, 13 bp, Homo sapiens
ttagtaaatgtta

SEQ ID NO: 5535909 - DNA, 14 bp, Homo sapiens
ttagtaaattccta

SEQ ID NO: 5535910 - DNA, 23 bp, Homo sapiens
ttagtaacatgtgttaagtattt

SEQ ID NO: 5535911 - DNA, 18 bp, Homo sapiens
ttagtaacctttaaaaat

SEQ ID NO: 5535912 - DNA, 16 bp, Homo sapiens
ttagtaacttttagtg

SEQ ID NO: 5535913 - DNA, 22 bp, Homo sapiens
ttagtaataaaacccagcatgt

SEQ ID NO: 5535914 - DNA, 16 bp, Homo sapiens
ttagtaatacctctaa

SEQ ID NO: 5535915 - DNA, 17 bp, Homo sapiens
ttagtaatacctctaat

SEQ ID NO: 5535916 - DNA, 21 bp, Homo sapiens
ttagtaatagtccaatatttg

SEQ ID NO: 5535917 - DNA, 17 bp, Homo sapiens
ttagtacaaagtttcaa

SEQ ID NO: 5535918 - DNA, 21 bp, Homo sapiens
ttagtacaatagtatacattt

SEQ ID NO: 5535919 - DNA, 22 bp, Homo sapiens
ttagtacagtagcttaaataaa

SEQ ID NO: 5535920 - DNA, 23 bp, Homo sapiens
ttagtacagtagcttaaataaat

SEQ ID NO: 5535921 - DNA, 19 bp, Homo sapiens
ttagtaccagagctagttt

SEQ ID NO: 5535922 - DNA, 14 bp, Homo sapiens
ttagtacccacctg

SEQ ID NO: 5535923 - DNA, 15 bp, Homo sapiens
ttagtacccacctga

SEQ ID NO: 5535924 - DNA, 14 bp, Homo sapiens
ttagtaccttcaaa

SEQ ID NO: 5535925 - DNA, 18 bp, Homo sapiens
ttagtacctttttaacag

SEQ ID NO: 5535926 - DNA, 16 bp, Homo sapiens
ttagtacggctgctgc

SEQ ID NO: 5535927 - DNA, 20 bp, Homo sapiens
ttagtactatatctgtttta

SEQ ID NO: 5535928 - DNA, 20 bp, Homo sapiens
ttagtactcttctagcattt

SEQ ID NO: 5535929 - DNA, 21 bp, Homo sapiens
ttagtactgaagccaaatgaa

SEQ ID NO: 5535930 - DNA, 22 bp, Homo sapiens
ttagtactgaagccaaatgaaa

SEQ ID NO: 5535931 - DNA, 23 bp, Homo sapiens
ttagtactgaagccaaatgaaac

SEQ ID NO: 5535932 - DNA, 23 bp, Homo sapiens
ttagtactttagactaattgtgt

SEQ ID NO: 5535933 - DNA, 13 bp, Homo sapiens
ttagtagaaaata

SEQ ID NO: 5535934 - DNA, 16 bp, Homo sapiens
ttagtagagacagtgt

SEQ ID NO: 5535935 - DNA, 23 bp, Homo sapiens
ttagtagaggtacacttgtgaat

SEQ ID NO: 5535936 - DNA, 15 bp, Homo sapiens
ttagtagctgataaa

SEQ ID NO: 5535937 - DNA, 16 bp, Homo sapiens
ttagtagctgataaag

SEQ ID NO: 5535938 - DNA, 17 bp, Homo sapiens
ttagtaggtcctcaata

SEQ ID NO: 5535939 - DNA, 22 bp, Homo sapiens
ttagtagttactaaaattatgt

SEQ ID NO: 5535940 - DNA, 18 bp, Homo sapiens
ttagtataaatgtacatc

SEQ ID NO: 5535941 - DNA, 19 bp, Homo sapiens
ttagtataatatttcttaa

SEQ ID NO: 5535942 - DNA, 24 bp, Homo sapiens
ttagtatattattattaattacaa

SEQ ID NO: 5535943 - DNA, 19 bp, Homo sapiens
ttagtatatttatataatt

SEQ ID NO: 5535944 - DNA, 15 bp, Homo sapiens
ttagtatcagtgttt

SEQ ID NO: 5535945 - DNA, 15 bp, Homo sapiens
ttagtatcctgttag

SEQ ID NO: 5535946 - DNA, 23 bp, Homo sapiens
ttagtatctaacatgtatcccaa

SEQ ID NO: 5535947 - DNA, 18 bp, Homo sapiens
ttagtatgaggcatttgt

SEQ ID NO: 5535948 - DNA, 12 bp, Homo sapiens
ttagtatgcagt

SEQ ID NO: 5535949 - DNA, 16 bp, Homo sapiens
ttagtatgcagttgat

SEQ ID NO: 5535950 - DNA, 20 bp, Homo sapiens
ttagtatggttcaagattgt

SEQ ID NO: 5535951 - DNA, 13 bp, Homo sapiens
ttagtatgtgcat

SEQ ID NO: 5535952 - DNA, 13 bp, Homo sapiens
ttagtattaacta

SEQ ID NO: 5535953 - DNA, 20 bp, Homo sapiens
ttagtattcaggcactgaga

SEQ ID NO: 5535954 - DNA, 17 bp, Homo sapiens
ttagtattcattctgca

SEQ ID NO: 5535955 - DNA, 15 bp, Homo sapiens
ttagtattctaataa

SEQ ID NO: 5535956 - DNA, 17 bp, Homo sapiens
ttagtattgcaaagtca

SEQ ID NO: 5535957 - DNA, 23 bp, Homo sapiens
ttagtattgttgtccttttcata

SEQ ID NO: 5535958 - DNA, 22 bp, Homo sapiens
ttagtatttatttaatgttatg

SEQ ID NO: 5535959 - DNA, 20 bp, Homo sapiens
ttagtatttatttatgtact

SEQ ID NO: 5535960 - DNA, 15 bp, Homo sapiens
ttagtatttcagtgt

SEQ ID NO: 5535961 - DNA, 14 bp, Homo sapiens
ttagtatttctcag

SEQ ID NO: 5535962 - DNA, 15 bp, Homo sapiens
ttagtatttctcagg

SEQ ID NO: 5535963 - DNA, 15 bp, Homo sapiens
ttagtattttaatcc

SEQ ID NO: 5535964 - DNA, 17 bp, Homo sapiens
ttagtattttaatcctg

SEQ ID NO: 5535965 - DNA, 18 bp, Homo sapiens
ttagtattttaatcctgt

SEQ ID NO: 5535966 - DNA, 20 bp, Homo sapiens
ttagtcaaatatttattgga

SEQ ID NO: 5535967 - DNA, 22 bp, Homo sapiens
ttagtcacctaaccctctgtca

SEQ ID NO: 5535968 - DNA, 23 bp, Homo sapiens
ttagtcacctaaccctctgtcac

SEQ ID NO: 5535969 - DNA, 16 bp, Homo sapiens
ttagtcactaagactt

SEQ ID NO: 5535970 - DNA, 23 bp, Homo sapiens
ttagtcactgcctgcagaggtct

SEQ ID NO: 5535971 - DNA, 14 bp, Homo sapiens
ttagtcagaaatga

SEQ ID NO: 5535972 - DNA, 18 bp, Homo sapiens
ttagtcatccaacaagaa

SEQ ID NO: 5535973 - DNA, 13 bp, Homo sapiens
ttagtcatgtgac

SEQ ID NO: 5535974 - DNA, 19 bp, Homo sapiens
ttagtcatgtttatctgct

SEQ ID NO: 5535975 - DNA, 13 bp, Homo sapiens
ttagtcattatta

SEQ ID NO: 5535976 - DNA, 20 bp, Homo sapiens
ttagtcattattattacttt

SEQ ID NO: 5535977 - DNA, 16 bp, Homo sapiens
ttagtcattgatagaa

SEQ ID NO: 5535978 - DNA, 13 bp, Homo sapiens
ttagtcatttaag

SEQ ID NO: 5535979 - DNA, 16 bp, Homo sapiens
ttagtcatttaagaat

SEQ ID NO: 5535980 - DNA, 19 bp, Homo sapiens
ttagtcatttaagaattta

SEQ ID NO: 5535981 - DNA, 23 bp, Homo sapiens
ttagtcccacagggaaatgtgta

SEQ ID NO: 5535982 - DNA, 14 bp, Homo sapiens
ttagtcctgtactg

SEQ ID NO: 5535983 - DNA, 13 bp, Homo sapiens
ttagtccttgctt

SEQ ID NO: 5535984 - DNA, 19 bp, Homo sapiens
ttagtcgggcatgagtctg

SEQ ID NO: 5535985 - DNA, 20 bp, Homo sapiens
ttagtcgggcatgagtctgt

SEQ ID NO: 5535986 - DNA, 21 bp, Homo sapiens
ttagtcgtgagctcttgtgag

SEQ ID NO: 5535987 - DNA, 18 bp, Homo sapiens
ttagtctatcaaatgaaa

SEQ ID NO: 5535988 - DNA, 21 bp, Homo sapiens
ttagtctcgctaaagttatat

SEQ ID NO: 5535989 - DNA, 17 bp, Homo sapiens
ttagtcttctttcccaa

SEQ ID NO: 5535990 - DNA, 18 bp, Homo sapiens
ttagtgaaaattctgttg

SEQ ID NO: 5535991 - DNA, 15 bp, Homo sapiens
ttagtgaacaggttc

SEQ ID NO: 5535992 - DNA, 13 bp, Homo sapiens
ttagtgaatggga

SEQ ID NO: 5535993 - DNA, 23 bp, Homo sapiens
ttagtgaattacactcaaggaaa

SEQ ID NO: 5535994 - DNA, 17 bp, Homo sapiens
ttagtgaccattattca

SEQ ID NO: 5535995 - DNA, 17 bp, Homo sapiens
ttagtgagattaaaaat

SEQ ID NO: 5535996 - DNA, 20 bp, Homo sapiens
ttagtgagcagtgagcactg

SEQ ID NO: 5535997 - DNA, 21 bp, Homo sapiens
ttagtgagcagtgagcactga

SEQ ID NO: 5535998 - DNA, 14 bp, Homo sapiens
ttagtgagttattc

SEQ ID NO: 5535999 - DNA, 14 bp, Homo sapiens
ttagtgatagatgt

SEQ ID NO: 5536000 - DNA, 17 bp, Homo sapiens
ttagtgatatttctcta

SEQ ID NO: 5536001 - DNA, 14 bp, Homo sapiens
ttagtgatgtaatt

SEQ ID NO: 5536002 - DNA, 12 bp, Homo sapiens
ttagtgatgtcc

SEQ ID NO: 5536003 - DNA, 23 bp, Homo sapiens
ttagtgatgtccttaaaatgtgg

SEQ ID NO: 5536004 - DNA, 18 bp, Homo sapiens
ttagtgattctgatttca

SEQ ID NO: 5536005 - DNA, 16 bp, Homo sapiens
ttagtgattgtgtctg

SEQ ID NO: 5536006 - DNA, 15 bp, Homo sapiens
ttagtgcaatttctt

SEQ ID NO: 5536007 - DNA, 20 bp, Homo sapiens
ttagtgcaatttcttctgta

SEQ ID NO: 5536008 - DNA, 14 bp, Homo sapiens
ttagtgcatctttg

SEQ ID NO: 5536009 - DNA, 23 bp, Homo sapiens
ttagtgccaatgttgtgtgttgc

SEQ ID NO: 5536010 - DNA, 14 bp, Homo sapiens
ttagtgccagaatt

SEQ ID NO: 5536011 - DNA, 19 bp, Homo sapiens
ttagtgccctctttagcca

SEQ ID NO: 5536012 - DNA, 14 bp, Homo sapiens
ttagtgccctgccc

SEQ ID NO: 5536013 - DNA, 19 bp, Homo sapiens
ttagtgccctgccccctgg

SEQ ID NO: 5536014 - DNA, 17 bp, Homo sapiens
ttagtgcggacaagttt

SEQ ID NO: 5536015 - DNA, 17 bp, Homo sapiens
ttagtgctaagtgtgaa

SEQ ID NO: 5536016 - DNA, 20 bp, Homo sapiens
ttagtgctaagtgtgaactg

SEQ ID NO: 5536017 - DNA, 11 bp, Homo sapiens
ttagtgctagt

SEQ ID NO: 5536018 - DNA, 14 bp, Homo sapiens
ttagtgctggtcct

SEQ ID NO: 5536019 - DNA, 15 bp, Homo sapiens
ttagtgcttaacatt

SEQ ID NO: 5536020 - DNA, 15 bp, Homo sapiens
ttagtgcttggctca

SEQ ID NO: 5536021 - DNA, 14 bp, Homo sapiens
ttagtgctttacat

SEQ ID NO: 5536022 - DNA, 16 bp, Homo sapiens
ttagtggaccctgaaa

SEQ ID NO: 5536023 - DNA, 19 bp, Homo sapiens
ttagtggaccctgaaatgt

SEQ ID NO: 5536024 - DNA, 11 bp, Homo sapiens
ttagtggagcc

SEQ ID NO: 5536025 - DNA, 15 bp, Homo sapiens
ttagtggatggaata

SEQ ID NO: 5536026 - DNA, 16 bp, Homo sapiens
ttagtggcatatttgc

SEQ ID NO: 5536027 - DNA, 20 bp, Homo sapiens
ttagtggctcaacattgtgt

SEQ ID NO: 5536028 - DNA, 12 bp, Homo sapiens
ttatacttcaaa

SEQ ID NO: 5536029 - DNA, 23 bp, Homo sapiens
ttatactttccctaccctctaga

SEQ ID NO: 5536030 - DNA, 14 bp, Homo sapiens
ttatacttttgctt

SEQ ID NO: 5536031 - DNA, 15 bp, Homo sapiens
ttatagaaattctga

SEQ ID NO: 5536032 - DNA, 17 bp, Homo sapiens
ttatagaaggaatttgt

SEQ ID NO: 5536033 - DNA, 16 bp, Homo sapiens
ttatagaagtttagat

SEQ ID NO: 5536034 - DNA, 18 bp, Homo sapiens
ttatagaataaaagctat

SEQ ID NO: 5536035 - DNA, 15 bp, Homo sapiens
ttatagaatactttt

SEQ ID NO: 5536036 - DNA, 13 bp, Homo sapiens
ttatagacaaaag

SEQ ID NO: 5536037 - DNA, 20 bp, Homo sapiens
ttatagaggtaaaatttgca

SEQ ID NO: 5536038 - DNA, 22 bp, Homo sapiens
ttatagaggtaaaatttgcaca

SEQ ID NO: 5536039 - DNA, 19 bp, Homo sapiens
ttatagatatataaataat

SEQ ID NO: 5536040 - DNA, 21 bp, Homo sapiens
ttatagatcccccagacttta

SEQ ID NO: 5536041 - DNA, 19 bp, Homo sapiens
ttatagatgtgagccagca

SEQ ID NO: 5536042 - DNA, 13 bp, Homo sapiens
ttatagattctaa

SEQ ID NO: 5536043 - DNA, 15 bp, Homo sapiens
ttatagattctaaag

SEQ ID NO: 5536044 - DNA, 18 bp, Homo sapiens
ttatagattttttaaaaa

SEQ ID NO: 5536045 - DNA, 19 bp, Homo sapiens
ttatagattttttaaaaaa

SEQ ID NO: 5536046 - DNA, 17 bp, Homo sapiens
ttatagcaaacttggaa

SEQ ID NO: 5536047 - DNA, 17 bp, Homo sapiens
ttatagcaactaatgtt

SEQ ID NO: 5536048 - DNA, 21 bp, Homo sapiens
ttatagcacaaactttaaatt

SEQ ID NO: 5536049 - DNA, 22 bp, Homo sapiens
ttatagcactttgaaatacctc

SEQ ID NO: 5536050 - DNA, 23 bp, Homo sapiens
ttatagcactttgaaatacctca

SEQ ID NO: 5536051 - DNA, 15 bp, Homo sapiens
ttatagcctctgtct

SEQ ID NO: 5536052 - DNA, 16 bp, Homo sapiens
ttatagcctctgtctg

SEQ ID NO: 5536053 - DNA, 15 bp, Homo sapiens
ttatagcgcctgtat

SEQ ID NO: 5536054 - DNA, 17 bp, Homo sapiens
ttatagctcccaaaaga

SEQ ID NO: 5536055 - DNA, 18 bp, Homo sapiens
ttatagctctaataagtt

SEQ ID NO: 5536056 - DNA, 16 bp, Homo sapiens
ttatagctctaatgtt

SEQ ID NO: 5536057 - DNA, 17 bp, Homo sapiens
ttatagctctaatgttt

SEQ ID NO: 5536058 - DNA, 14 bp, Homo sapiens
ttatagcttcagga

SEQ ID NO: 5536059 - DNA, 17 bp, Homo sapiens
ttataggaaataaatct

SEQ ID NO: 5536060 - DNA, 22 bp, Homo sapiens
ttataggcagctgtcctgtgat

SEQ ID NO: 5536061 - DNA, 15 bp, Homo sapiens
ttataggcgtttttt

SEQ ID NO: 5536062 - DNA, 22 bp, Homo sapiens
ttataggtaatcaatgaatatt

SEQ ID NO: 5536063 - DNA, 17 bp, Homo sapiens
ttataggtcacatatgt

SEQ ID NO: 5536064 - DNA, 18 bp, Homo sapiens
ttataggtcactcctggg

SEQ ID NO: 5536065 - DNA, 18 bp, Homo sapiens
ttataggtcctttagaaa

SEQ ID NO: 5536066 - DNA, 14 bp, Homo sapiens
ttatagtaactata

SEQ ID NO: 5536067 - DNA, 18 bp, Homo sapiens
ttatagtactgctttact

SEQ ID NO: 5536068 - DNA, 19 bp, Homo sapiens
ttatagtactgctttactg

SEQ ID NO: 5536069 - DNA, 22 bp, Homo sapiens
ttatagtactgctttactgtgt

SEQ ID NO: 5536070 - DNA, 14 bp, Homo sapiens
ttatagtagaacaa

SEQ ID NO: 5536071 - DNA, 15 bp, Homo sapiens
ttatagtatgtgact

SEQ ID NO: 5536072 - DNA, 14 bp, Homo sapiens
ttatagtctgtact

SEQ ID NO: 5536073 - DNA, 16 bp, Homo sapiens
ttatagtctgtacttc

SEQ ID NO: 5536074 - DNA, 19 bp, Homo sapiens
ttatagtgaagtgttaata

SEQ ID NO: 5536075 - DNA, 15 bp, Homo sapiens
ttatagtgaatactg

SEQ ID NO: 5536076 - DNA, 21 bp, Homo sapiens
ttatagtgaattatccctttt

SEQ ID NO: 5536077 - DNA, 14 bp, Homo sapiens
ttatagtgcaatat

SEQ ID NO: 5536078 - DNA, 17 bp, Homo sapiens
ttatagtggaaaaacac

SEQ ID NO: 5536079 - DNA, 16 bp, Homo sapiens
ttatagtgtttaactg

SEQ ID NO: 5536080 - DNA, 22 bp, Homo sapiens
ttatagttaagcaaatttcatt

SEQ ID NO: 5536081 - DNA, 19 bp, Homo sapiens
ttatagttactgtgtaatt

SEQ ID NO: 5536082 - DNA, 18 bp, Homo sapiens
ttatagttcatagttgga

SEQ ID NO: 5536083 - DNA, 14 bp, Homo sapiens
ttatagtttataca

SEQ ID NO: 5536084 - DNA, 16 bp, Homo sapiens
ttatagtttgtacatg

SEQ ID NO: 5536085 - DNA, 21 bp, Homo sapiens
ttatataaaacttaaaaacaa

SEQ ID NO: 5536086 - DNA, 13 bp, Homo sapiens
ttatataaagaaa

SEQ ID NO: 5536087 - DNA, 14 bp, Homo sapiens
ttatataaagaaaa

SEQ ID NO: 5536088 - DNA, 15 bp, Homo sapiens
ttatataaagaaaat

SEQ ID NO: 5536089 - DNA, 18 bp, Homo sapiens
ttatataaaggcaaggaa

SEQ ID NO: 5536090 - DNA, 20 bp, Homo sapiens
ttatataaaggcaaggaaat

SEQ ID NO: 5536091 - DNA, 16 bp, Homo sapiens
ttatataaagtattct

SEQ ID NO: 5536092 - DNA, 19 bp, Homo sapiens
ttatataaataaagttttt

SEQ ID NO: 5536093 - DNA, 22 bp, Homo sapiens
ttatataaatatatatttttca

SEQ ID NO: 5536094 - DNA, 23 bp, Homo sapiens
ttatataaatatatatttttcaa

SEQ ID NO: 5536095 - DNA, 14 bp, Homo sapiens
ttatataaatgctt

SEQ ID NO: 5536096 - DNA, 13 bp, Homo sapiens
ttatataaatgta

SEQ ID NO: 5536097 - DNA, 23 bp, Homo sapiens
ttatataaatgtaaaaataataa

SEQ ID NO: 5536098 - DNA, 22 bp, Homo sapiens
ttatataactacattaaaagct

SEQ ID NO: 5536099 - DNA, 16 bp, Homo sapiens
ttatataactgtattt

SEQ ID NO: 5536100 - DNA, 19 bp, Homo sapiens
ttatataagcaaaatgaaa

SEQ ID NO: 5536101 - DNA, 19 bp, Homo sapiens
ttatataagcccttaataa

SEQ ID NO: 5536102 - DNA, 18 bp, Homo sapiens
ttatataagcttgtattc

SEQ ID NO: 5536103 - DNA, 16 bp, Homo sapiens
ttatataagtattcta

SEQ ID NO: 5536104 - DNA, 21 bp, Homo sapiens
ttatataatatctaaagttat

SEQ ID NO: 5536105 - DNA, 20 bp, Homo sapiens
ttatataatcattattactt

SEQ ID NO: 5536106 - DNA, 21 bp, Homo sapiens
ttatataattctgaaatgttt

SEQ ID NO: 5536107 - DNA, 20 bp, Homo sapiens
ttatataattgccaaaaagt

SEQ ID NO: 5536108 - DNA, 12 bp, Homo sapiens
ttatataattgt

SEQ ID NO: 5536109 - DNA, 19 bp, Homo sapiens
ttatatacaaagctgtcac

SEQ ID NO: 5536110 - DNA, 14 bp, Homo sapiens
ttatatacaataat

SEQ ID NO: 5536111 - DNA, 17 bp, Homo sapiens
ttatatacaataatgga

SEQ ID NO: 5536112 - DNA, 19 bp, Homo sapiens
ttatatacaataatggaaa

SEQ ID NO: 5536113 - DNA, 22 bp, Homo sapiens
ttatatacaataatggaaaaaa

SEQ ID NO: 5536114 - DNA, 20 bp, Homo sapiens
ttatatacaatttctattat

SEQ ID NO: 5536115 - DNA, 14 bp, Homo sapiens
ttatatacagagga

SEQ ID NO: 5536116 - DNA, 23 bp, Homo sapiens
ttatatacctggcttttacttta

SEQ ID NO: 5536117 - DNA, 23 bp, Homo sapiens
ttatatactgggttcttgtttta

SEQ ID NO: 5536118 - DNA, 17 bp, Homo sapiens
ttatatacttagctata

SEQ ID NO: 5536119 - DNA, 16 bp, Homo sapiens
ttatatacttgttgtt

SEQ ID NO: 5536120 - DNA, 16 bp, Homo sapiens
ttatatagactgttga

SEQ ID NO: 5536121 - DNA, 22 bp, Homo sapiens
ttatatagattataacttgtct

SEQ ID NO: 5536122 - DNA, 17 bp, Homo sapiens
ttatatagcaaaatgat

SEQ ID NO: 5536123 - DNA, 16 bp, Homo sapiens
ttatatagcaaagata

SEQ ID NO: 5536124 - DNA, 21 bp, Homo sapiens
ttatataggttttgtttgcta

SEQ ID NO: 5536125 - DNA, 21 bp, Homo sapiens
ttatatagtctacagttgtcc

SEQ ID NO: 5536126 - DNA, 18 bp, Homo sapiens
ttatatagtggatgatat

SEQ ID NO: 5536127 - DNA, 18 bp, Homo sapiens
ttatatagtttactattt

SEQ ID NO: 5536128 - DNA, 13 bp, Homo sapiens
ttatatataaaat

SEQ ID NO: 5536129 - DNA, 15 bp, Homo sapiens
ttatatataaaataa

SEQ ID NO: 5536130 - DNA, 18 bp, Homo sapiens
ttatatataaaataaata

SEQ ID NO: 5536131 - DNA, 20 bp, Homo sapiens
ttatatataaaataaatata

SEQ ID NO: 5536132 - DNA, 18 bp, Homo sapiens
ttatatataaatatatta

SEQ ID NO: 5536133 - DNA, 12 bp, Homo sapiens
ttatatatacat

SEQ ID NO: 5536134 - DNA, 23 bp, Homo sapiens
ttatatatacattagacacacat

SEQ ID NO: 5536135 - DNA, 14 bp, Homo sapiens
ttatatatatatct

SEQ ID NO: 5536136 - DNA, 16 bp, Homo sapiens
ttatatatatatgtat

SEQ ID NO: 5536137 - DNA, 21 bp, Homo sapiens
ttatatatattgttaaatcct

SEQ ID NO: 5536138 - DNA, 12 bp, Homo sapiens
ttatatatcata

SEQ ID NO: 5536139 - DNA, 14 bp, Homo sapiens
ttatatatcataaa

SEQ ID NO: 5536140 - DNA, 16 bp, Homo sapiens
ttatatatcataaagt

SEQ ID NO: 5536141 - DNA, 19 bp, Homo sapiens
ttatatatccctgataaat

SEQ ID NO: 5536142 - DNA, 16 bp, Homo sapiens
ttatatatgaaaacta

SEQ ID NO: 5536143 - DNA, 12 bp, Homo sapiens
ttatatatgaag

SEQ ID NO: 5536144 - DNA, 13 bp, Homo sapiens
ttatatattataa

SEQ ID NO: 5536145 - DNA, 13 bp, Homo sapiens
ttatatattatat

SEQ ID NO: 5536146 - DNA, 15 bp, Homo sapiens
ttatatattatgtct

SEQ ID NO: 5536147 - DNA, 14 bp, Homo sapiens
ttatatattatgtg

SEQ ID NO: 5536148 - DNA, 19 bp, Homo sapiens
ttatatattatgtgaagaa

SEQ ID NO: 5536149 - DNA, 20 bp, Homo sapiens
ttatatattatgtgaagaat

SEQ ID NO: 5536150 - DNA, 15 bp, Homo sapiens
ttatatattgaaagt

SEQ ID NO: 5536151 - DNA, 23 bp, Homo sapiens
ttatatattgaaagttgctttta

SEQ ID NO: 5536152 - DNA, 19 bp, Homo sapiens
ttatatattgtctgtaaaa

SEQ ID NO: 5536153 - DNA, 14 bp, Homo sapiens
ttatatatttctaa

SEQ ID NO: 5536154 - DNA, 15 bp, Homo sapiens
ttatatatttgaaag

SEQ ID NO: 5536155 - DNA, 14 bp, Homo sapiens
ttatatattttgtt

SEQ ID NO: 5536156 - DNA, 18 bp, Homo sapiens
ttatatatttttctgaga

SEQ ID NO: 5536157 - DNA, 13 bp, Homo sapiens
ttatatcaaagta

SEQ ID NO: 5536158 - DNA, 15 bp, Homo sapiens
ttatatcacacaata

SEQ ID NO: 5536159 - DNA, 16 bp, Homo sapiens
ttatatcatacagttt

SEQ ID NO: 5536160 - DNA, 18 bp, Homo sapiens
ttatatcatattgctttt

SEQ ID NO: 5536161 - DNA, 20 bp, Homo sapiens
ttatatcatgcaaaatatgt

SEQ ID NO: 5536162 - DNA, 18 bp, Homo sapiens
ttatatcattctgggtgt

SEQ ID NO: 5536163 - DNA, 18 bp, Homo sapiens
ttatatccccctaaacta

SEQ ID NO: 5536164 - DNA, 14 bp, Homo sapiens
ttatatctaattta

SEQ ID NO: 5536165 - DNA, 23 bp, Homo sapiens
ttatatctaatttatacaaaata

SEQ ID NO: 5536166 - DNA, 23 bp, Homo sapiens
ttatatctatattttacataaat

SEQ ID NO: 5536167 - DNA, 16 bp, Homo sapiens
ttatatctcccccact

SEQ ID NO: 5536168 - DNA, 20 bp, Homo sapiens
ttatatctgtaatgatactg

SEQ ID NO: 5536169 - DNA, 22 bp, Homo sapiens
ttatatctgtggtcttcaaatt

SEQ ID NO: 5536170 - DNA, 22 bp, Homo sapiens
ttatatctgttttgtttcttga

SEQ ID NO: 5536171 - DNA, 15 bp, Homo sapiens
ttatatcttgtagct

SEQ ID NO: 5536172 - DNA, 21 bp, Homo sapiens
ttatatcttgtttacaataaa

SEQ ID NO: 5536173 - DNA, 13 bp, Homo sapiens
ttatatctttatg

SEQ ID NO: 5536174 - DNA, 12 bp, Homo sapiens
ttatatcttttg

SEQ ID NO: 5536175 - DNA, 14 bp, Homo sapiens
ttatatcttttggt

SEQ ID NO: 5536176 - DNA, 20 bp, Homo sapiens
ttatatcttttggttattct

SEQ ID NO: 5536177 - DNA, 13 bp, Homo sapiens
ttatatgaaaaca

SEQ ID NO: 5536178 - DNA, 15 bp, Homo sapiens
ttatatgaacataca

SEQ ID NO: 5536179 - DNA, 18 bp, Homo sapiens
ttatatgaagcaagctgt

SEQ ID NO: 5536180 - DNA, 20 bp, Homo sapiens
ttatatgacttcttgttcat

SEQ ID NO: 5536181 - DNA, 17 bp, Homo sapiens
ttatatgccctcaagta

SEQ ID NO: 5536182 - DNA, 22 bp, Homo sapiens
ttatatgctaattaaataatac

SEQ ID NO: 5536183 - DNA, 18 bp, Homo sapiens
ttatatgctatttctata

SEQ ID NO: 5536184 - DNA, 13 bp, Homo sapiens
ttatatgcttact

SEQ ID NO: 5536185 - DNA, 19 bp, Homo sapiens
ttatatgcttactgatata

SEQ ID NO: 5536186 - DNA, 20 bp, Homo sapiens
ttatatgctttattaatgtt

SEQ ID NO: 5536187 - DNA, 10 bp, Homo sapiens
ttatatggaa

SEQ ID NO: 5536188 - DNA, 18 bp, Homo sapiens
ttatatggaaatatatat

SEQ ID NO: 5536189 - DNA, 14 bp, Homo sapiens
ttatatggaaattc

SEQ ID NO: 5536190 - DNA, 18 bp, Homo sapiens
ttatatggaagaaagtaa

SEQ ID NO: 5536191 - DNA, 17 bp, Homo sapiens
ttatatggataatctga

SEQ ID NO: 5536192 - DNA, 20 bp, Homo sapiens
ttatatggataatctgagca

SEQ ID NO: 5536193 - DNA, 22 bp, Homo sapiens
ttatatggatgattcagaaatt

SEQ ID NO: 5536194 - DNA, 19 bp, Homo sapiens
ttatatgggtatatattca

SEQ ID NO: 5536195 - DNA, 13 bp, Homo sapiens
ttatatgtaaatg

SEQ ID NO: 5536196 - DNA, 17 bp, Homo sapiens
ttatatgtacagtttat

SEQ ID NO: 5536197 - DNA, 16 bp, Homo sapiens
ttatatgtacatgaga

SEQ ID NO: 5536198 - DNA, 16 bp, Homo sapiens
ttatatgtaccgtagg

SEQ ID NO: 5536199 - DNA, 22 bp, Homo sapiens
ttatatgtatccagtacattta

SEQ ID NO: 5536200 - DNA, 12 bp, Homo sapiens
ttatatgtatgt

SEQ ID NO: 5536201 - DNA, 17 bp, Homo sapiens
ttatatgtatgtgttta

SEQ ID NO: 5536202 - DNA, 16 bp, Homo sapiens
ttatatgtcaaagcag

SEQ ID NO: 5536203 - DNA, 12 bp, Homo sapiens
ttatatgtcctt

SEQ ID NO: 5536204 - DNA, 12 bp, Homo sapiens
ttatatgtcttg

SEQ ID NO: 5536205 - DNA, 21 bp, Homo sapiens
ttatatgttaatttgttatgt

SEQ ID NO: 5536206 - DNA, 13 bp, Homo sapiens
ttatgtttgtaat

SEQ ID NO: 5536207 - DNA, 15 bp, Homo sapiens
ttatgtttgtacaca

SEQ ID NO: 5536208 - DNA, 21 bp, Homo sapiens
ttatgttttatttaaatgctt

SEQ ID NO: 5536209 - DNA, 22 bp, Homo sapiens
ttatgttttatttaaatgcttt

SEQ ID NO: 5536210 - DNA, 22 bp, Homo sapiens
ttatgttttcgaaaatcaaatg

SEQ ID NO: 5536211 - DNA, 16 bp, Homo sapiens
ttatgttttctttctc

SEQ ID NO: 5536212 - DNA, 23 bp, Homo sapiens
ttatgttttggtccacttttcca

SEQ ID NO: 5536213 - DNA, 22 bp, Homo sapiens
ttatgttttttaaaatatttat

SEQ ID NO: 5536214 - DNA, 22 bp, Homo sapiens
ttattaaaacagaaattaatct

SEQ ID NO: 5536215 - DNA, 12 bp, Homo sapiens
ttattaaaacat

SEQ ID NO: 5536216 - DNA, 16 bp, Homo sapiens
ttattaaaatcttaaa

SEQ ID NO: 5536217 - DNA, 20 bp, Homo sapiens
ttattaaaatgattgtaaaa

SEQ ID NO: 5536218 - DNA, 21 bp, Homo sapiens
ttattaaaatgattgtaaaat

SEQ ID NO: 5536219 - DNA, 15 bp, Homo sapiens
ttattaaaattctga

SEQ ID NO: 5536220 - DNA, 13 bp, Homo sapiens
ttattaaaattgt

SEQ ID NO: 5536221 - DNA, 17 bp, Homo sapiens
ttattaaacaattttgt

SEQ ID NO: 5536222 - DNA, 15 bp, Homo sapiens
ttattaaacttaaaa

SEQ ID NO: 5536223 - DNA, 12 bp, Homo sapiens
ttattaaagaaa

SEQ ID NO: 5536224 - DNA, 10 bp, Homo sapiens
ttattaaagg

SEQ ID NO: 5536225 - DNA, 17 bp, Homo sapiens
ttattaaagttctgtaa

SEQ ID NO: 5536226 - DNA, 12 bp, Homo sapiens
ttattaaataaa

SEQ ID NO: 5536227 - DNA, 16 bp, Homo sapiens
ttattaaataaaatca

SEQ ID NO: 5536228 - DNA, 19 bp, Homo sapiens
ttattaaataaaatcaatt

SEQ ID NO: 5536229 - DNA, 21 bp, Homo sapiens
ttattaaataaaatcaatttt

SEQ ID NO: 5536230 - DNA, 18 bp, Homo sapiens
ttattaaatacaaaactt

SEQ ID NO: 5536231 - DNA, 15 bp, Homo sapiens
ttattaaatcgttta

SEQ ID NO: 5536232 - DNA, 20 bp, Homo sapiens
ttattaaatcgtttaatgtt

SEQ ID NO: 5536233 - DNA, 19 bp, Homo sapiens
ttattaaatgcccagcccc

SEQ ID NO: 5536234 - DNA, 12 bp, Homo sapiens
ttattaaatgta

SEQ ID NO: 5536235 - DNA, 15 bp, Homo sapiens
ttattaaatgtagct

SEQ ID NO: 5536236 - DNA, 24 bp, Homo sapiens
ttattaaatgtagcttcagtcatt

SEQ ID NO: 5536237 - DNA, 13 bp, Homo sapiens
ttattaaatgtat

SEQ ID NO: 5536238 - DNA, 19 bp, Homo sapiens
ttattaaatgtttcaaaat

SEQ ID NO: 5536239 - DNA, 17 bp, Homo sapiens
ttattaaattgtaaaac

SEQ ID NO: 5536240 - DNA, 14 bp, Homo sapiens
ttattaaattgtgt

SEQ ID NO: 5536241 - DNA, 18 bp, Homo sapiens
ttattaaatttattaaat

SEQ ID NO: 5536242 - DNA, 20 bp, Homo sapiens
ttattaaatttattaaatgt

SEQ ID NO: 5536243 - DNA, 21 bp, Homo sapiens
ttattaaatttattaaatgtt

SEQ ID NO: 5536244 - DNA, 16 bp, Homo sapiens
ttattaacaaacagga

SEQ ID NO: 5536245 - DNA, 19 bp, Homo sapiens
ttattaacaattaggcaga

SEQ ID NO: 5536246 - DNA, 17 bp, Homo sapiens
ttattaacatatattgt

SEQ ID NO: 5536247 - DNA, 20 bp, Homo sapiens
ttattaacgggcatgtatta

SEQ ID NO: 5536248 - DNA, 23 bp, Homo sapiens
ttattaactactgaataatgcta

SEQ ID NO: 5536249 - DNA, 17 bp, Homo sapiens
ttattaacttaataatc

SEQ ID NO: 5536250 - DNA, 18 bp, Homo sapiens
ttattaagaactatattt

SEQ ID NO: 5536251 - DNA, 18 bp, Homo sapiens
ttattaagaggtaagact

SEQ ID NO: 5536252 - DNA, 19 bp, Homo sapiens
ttattaagaggtaagactt

SEQ ID NO: 5536253 - DNA, 19 bp, Homo sapiens
ttattaagatggattctca

SEQ ID NO: 5536254 - DNA, 13 bp, Homo sapiens
ttattaagtatat

SEQ ID NO: 5536255 - DNA, 18 bp, Homo sapiens
ttattaagtatatttgta

SEQ ID NO: 5536256 - DNA, 19 bp, Homo sapiens
ttattaagtatatttgtaa

SEQ ID NO: 5536257 - DNA, 24 bp, Homo sapiens
ttattaagtctgggatgtagaact

SEQ ID NO: 5536258 - DNA, 16 bp, Homo sapiens
ttattaataccaaata

SEQ ID NO: 5536259 - DNA, 18 bp, Homo sapiens
ttattaataccaaatatt

SEQ ID NO: 5536260 - DNA, 20 bp, Homo sapiens
ttattaatatatattatctt

SEQ ID NO: 5536261 - DNA, 20 bp, Homo sapiens
ttattaatatggtgactttt

SEQ ID NO: 5536262 - DNA, 15 bp, Homo sapiens
ttattaatattgtgc

SEQ ID NO: 5536263 - DNA, 18 bp, Homo sapiens
ttattaatatttaacatt

SEQ ID NO: 5536264 - DNA, 14 bp, Homo sapiens
ttattaatatttgc

SEQ ID NO: 5536265 - DNA, 22 bp, Homo sapiens
ttattaatatttgcacatggga

SEQ ID NO: 5536266 - DNA, 14 bp, Homo sapiens
ttattaatatttgt

SEQ ID NO: 5536267 - DNA, 13 bp, Homo sapiens
ttattaatcacta

SEQ ID NO: 5536268 - DNA, 18 bp, Homo sapiens
ttattaatcactgtgtat

SEQ ID NO: 5536269 - DNA, 15 bp, Homo sapiens
ttattaatcattcca

SEQ ID NO: 5536270 - DNA, 20 bp, Homo sapiens
ttattaatctactgtatcaa

SEQ ID NO: 5536271 - DNA, 15 bp, Homo sapiens
ttattaatgaactgt

SEQ ID NO: 5536272 - DNA, 11 bp, Homo sapiens
ttattaatgca

SEQ ID NO: 5536273 - DNA, 12 bp, Homo sapiens
ttattaatgttt

SEQ ID NO: 5536274 - DNA, 15 bp, Homo sapiens
ttattaattcattaa

SEQ ID NO: 5536275 - DNA, 13 bp, Homo sapiens
ttattaattttta

SEQ ID NO: 5536276 - DNA, 19 bp, Homo sapiens
ttattacaaattttcactg

SEQ ID NO: 5536277 - DNA, 22 bp, Homo sapiens
ttattacaagtggctccccacc

SEQ ID NO: 5536278 - DNA, 15 bp, Homo sapiens
ttattacagagggaa

SEQ ID NO: 5536279 - DNA, 23 bp, Homo sapiens
ttattacagggcattcaaatggg

SEQ ID NO: 5536280 - DNA, 12 bp, Homo sapiens
ttattacagtgt

SEQ ID NO: 5536281 - DNA, 15 bp, Homo sapiens
ttattacataactga

SEQ ID NO: 5536282 - DNA, 20 bp, Homo sapiens
ttattacataactgatctat

SEQ ID NO: 5536283 - DNA, 15 bp, Homo sapiens
ttattacatgtaatt

SEQ ID NO: 5536284 - DNA, 19 bp, Homo sapiens
ttattacatttaaatcctt

SEQ ID NO: 5536285 - DNA, 17 bp, Homo sapiens
ttattaccagcatttgt

SEQ ID NO: 5536286 - DNA, 19 bp, Homo sapiens
ttattaccccctccttcag

SEQ ID NO: 5536287 - DNA, 22 bp, Homo sapiens
ttattaccccctccttcagaca

SEQ ID NO: 5536288 - DNA, 18 bp, Homo sapiens
ttattacccttctttcca

SEQ ID NO: 5536289 - DNA, 17 bp, Homo sapiens
ttattaccgataaatga

SEQ ID NO: 5536290 - DNA, 21 bp, Homo sapiens
ttattacctcaggtgccaacc

SEQ ID NO: 5536291 - DNA, 15 bp, Homo sapiens
ttattacctctgata

SEQ ID NO: 5536292 - DNA, 19 bp, Homo sapiens
ttattaccttctttctaat

SEQ ID NO: 5536293 - DNA, 22 bp, Homo sapiens
ttattaccttctttctaataca

SEQ ID NO: 5536294 - DNA, 18 bp, Homo sapiens
ttattacgtatgtctggt

SEQ ID NO: 5536295 - DNA, 14 bp, Homo sapiens
ttattactgctaag

SEQ ID NO: 5536296 - DNA, 13 bp, Homo sapiens
ttattactgtaat

SEQ ID NO: 5536297 - DNA, 12 bp, Homo sapiens
ttattactgtcc

SEQ ID NO: 5536298 - DNA, 19 bp, Homo sapiens
ttattactgtttctaaact

SEQ ID NO: 5536299 - DNA, 17 bp, Homo sapiens
ttattacttatttgtgc

SEQ ID NO: 5536300 - DNA, 22 bp, Homo sapiens
ttattacttctgtttgggagac

SEQ ID NO: 5536301 - DNA, 16 bp, Homo sapiens
ttattacttgtaaata

SEQ ID NO: 5536302 - DNA, 12 bp, Homo sapiens
ttattactttaa

SEQ ID NO: 5536303 - DNA, 18 bp, Homo sapiens
ttattactttaaattata

SEQ ID NO: 5536304 - DNA, 21 bp, Homo sapiens
ttattactttaaattatatga

SEQ ID NO: 5536305 - DNA, 12 bp, Homo sapiens
ttattagaaacc

SEQ ID NO: 5536306 - DNA, 12 bp, Homo sapiens
ttattagaaagc

SEQ ID NO: 5536307 - DNA, 10 bp, Homo sapiens
ttattagaac

SEQ ID NO: 5536308 - DNA, 18 bp, Homo sapiens
ttattagaatcaaacatt

SEQ ID NO: 5536309 - DNA, 21 bp, Homo sapiens
ttattagaatcaaacattttg

SEQ ID NO: 5536310 - DNA, 21 bp, Homo sapiens
ttattagagattacctcctga

SEQ ID NO: 5536311 - DNA, 12 bp, Homo sapiens
ttattagatgaa

SEQ ID NO: 5536312 - DNA, 15 bp, Homo sapiens
ttattagcaccagct

SEQ ID NO: 5536313 - DNA, 16 bp, Homo sapiens
ttattagcaccagctt

SEQ ID NO: 5536314 - DNA, 18 bp, Homo sapiens
ttattagcaccagcttgc

SEQ ID NO: 5536315 - DNA, 21 bp, Homo sapiens
ttattagcagctgactttcaa

SEQ ID NO: 5536316 - DNA, 18 bp, Homo sapiens
ttattagcatttgtttta

SEQ ID NO: 5536317 - DNA, 23 bp, Homo sapiens
ttattagcatttgttttagcatt

SEQ ID NO: 5536318 - DNA, 22 bp, Homo sapiens
ttattagcattttcaagaagac

SEQ ID NO: 5536319 - DNA, 22 bp, Homo sapiens
ttattagccagtgaaacacttg

SEQ ID NO: 5536320 - DNA, 18 bp, Homo sapiens
ttattagccctgcatttt

SEQ ID NO: 5536321 - DNA, 12 bp, Homo sapiens
ttattagctgta

SEQ ID NO: 5536322 - DNA, 19 bp, Homo sapiens
ttattagggagaaaattca

SEQ ID NO: 5536323 - DNA, 15 bp, Homo sapiens
ttattaggtcttaaa

SEQ ID NO: 5536324 - DNA, 16 bp, Homo sapiens
ttattagtattgttgt

SEQ ID NO: 5536325 - DNA, 18 bp, Homo sapiens
ttattagtattgttgtcc

SEQ ID NO: 5536326 - DNA, 15 bp, Homo sapiens
ttattagttaatata

SEQ ID NO: 5536327 - DNA, 22 bp, Homo sapiens
ttattagttccccaaatacaaa

SEQ ID NO: 5536328 - DNA, 14 bp, Homo sapiens
ttattagtttacat

SEQ ID NO: 5536329 - DNA, 13 bp, Homo sapiens
ttattataaaaat

SEQ ID NO: 5536330 - DNA, 14 bp, Homo sapiens
ttattataaagctt

SEQ ID NO: 5536331 - DNA, 17 bp, Homo sapiens
ttattataaagcttaaa

SEQ ID NO: 5536332 - DNA, 14 bp, Homo sapiens
ttattataaatgtt

SEQ ID NO: 5536333 - DNA, 14 bp, Homo sapiens
ttattataacataa

SEQ ID NO: 5536334 - DNA, 18 bp, Homo sapiens
ttattataattgtatcag

SEQ ID NO: 5536335 - DNA, 20 bp, Homo sapiens
ttattataattgtatcagag

SEQ ID NO: 5536336 - DNA, 17 bp, Homo sapiens
ttattataccacttata

SEQ ID NO: 5536337 - DNA, 14 bp, Homo sapiens
ttattatagtctgt

SEQ ID NO: 5536338 - DNA, 13 bp, Homo sapiens
ttattatataaat

SEQ ID NO: 5536339 - DNA, 12 bp, Homo sapiens
ttattatatatt

SEQ ID NO: 5536340 - DNA, 19 bp, Homo sapiens
ttattatcctcctgttctg

SEQ ID NO: 5536341 - DNA, 14 bp, Homo sapiens
ttattatcctgcat

SEQ ID NO: 5536342 - DNA, 11 bp, Homo sapiens
ttattatctac

SEQ ID NO: 5536343 - DNA, 20 bp, Homo sapiens
ttattatgaaacttgtgtaa

SEQ ID NO: 5536344 - DNA, 19 bp, Homo sapiens
ttattatgaaggaatttga

SEQ ID NO: 5536345 - DNA, 17 bp, Homo sapiens
ttattatggaaaacatt

SEQ ID NO: 5536346 - DNA, 18 bp, Homo sapiens
ttattatggcttgtgaac

SEQ ID NO: 5536347 - DNA, 21 bp, Homo sapiens
ttattatggtcatatttcaca

SEQ ID NO: 5536348 - DNA, 13 bp, Homo sapiens
ttattatgtagct

SEQ ID NO: 5536349 - DNA, 21 bp, Homo sapiens
ttattatgtttattacaattt

SEQ ID NO: 5536350 - DNA, 15 bp, Homo sapiens
ttattattaattaca

SEQ ID NO: 5536351 - DNA, 14 bp, Homo sapiens
ttattattaattta

SEQ ID NO: 5536352 - DNA, 14 bp, Homo sapiens
ttattattactgtt

SEQ ID NO: 5536353 - DNA, 16 bp, Homo sapiens
ttattattatattgtt

SEQ ID NO: 5536354 - DNA, 16 bp, Homo sapiens
ttattattattgtgac

SEQ ID NO: 5536355 - DNA, 15 bp, Homo sapiens
ttattattatttgct

SEQ ID NO: 5536356 - DNA, 16 bp, Homo sapiens
ttattattatttttta

SEQ ID NO: 5536357 - DNA, 12 bp, Homo sapiens
ttattattcaga

SEQ ID NO: 5536358 - DNA, 13 bp, Homo sapiens
ttattattcttga

SEQ ID NO: 5536359 - DNA, 18 bp, Homo sapiens
ttattattgtactttatt

SEQ ID NO: 5536360 - DNA, 14 bp, Homo sapiens
ttattattgtggta

SEQ ID NO: 5536361 - DNA, 15 bp, Homo sapiens
ttattatttatttga

SEQ ID NO: 5536362 - DNA, 14 bp, Homo sapiens
ttattatttctgtt

SEQ ID NO: 5536363 - DNA, 12 bp, Homo sapiens
ttattatttgaa

SEQ ID NO: 5536364 - DNA, 20 bp, Homo sapiens
ttattatttgcagtcatgga

SEQ ID NO: 5536365 - DNA, 12 bp, Homo sapiens
ttattattttca

SEQ ID NO: 5536366 - DNA, 13 bp, Homo sapiens
ttattattttcaa

SEQ ID NO: 5536367 - DNA, 16 bp, Homo sapiens
ttattattttcacctg

SEQ ID NO: 5536368 - DNA, 18 bp, Homo sapiens
ttattattttcatataat

SEQ ID NO: 5536369 - DNA, 22 bp, Homo sapiens
ttattattttcatataatttgc

SEQ ID NO: 5536370 - DNA, 15 bp, Homo sapiens
ttattattttggggt

SEQ ID NO: 5536371 - DNA, 14 bp, Homo sapiens
ttattcaaagagaa

SEQ ID NO: 5536372 - DNA, 13 bp, Homo sapiens
ttattcaaagttg

SEQ ID NO: 5536373 - DNA, 19 bp, Homo sapiens
ttattcaaagttgcctaaa

SEQ ID NO: 5536374 - DNA, 16 bp, Homo sapiens
ttattcaaatttgtac

SEQ ID NO: 5536375 - DNA, 13 bp, Homo sapiens
ttattcaacagca

SEQ ID NO: 5536376 - DNA, 22 bp, Homo sapiens
ttattcaacagcaagtgtgaat

SEQ ID NO: 5536377 - DNA, 19 bp, Homo sapiens
ttattcaagaatgaaaaat

SEQ ID NO: 5536378 - DNA, 17 bp, Homo sapiens
ttattcaagtattgaga

SEQ ID NO: 5536379 - DNA, 14 bp, Homo sapiens
ttattcaataaagt

SEQ ID NO: 5536380 - DNA, 17 bp, Homo sapiens
ttattcaataaagtatt

SEQ ID NO: 5536381 - DNA, 21 bp, Homo sapiens
ttattcaataaagtatttaat

SEQ ID NO: 5536382 - DNA, 16 bp, Homo sapiens
ttattcaatatggtta

SEQ ID NO: 5536383 - DNA, 18 bp, Homo sapiens
ttattcaattcctctggg

SEQ ID NO: 5536384 - DNA, 19 bp, Homo sapiens
ttattcaattcctctggga

SEQ ID NO: 5536385 - DNA, 19 bp, Homo sapiens
ttattcaattctgtataga

SEQ ID NO: 5536386 - DNA, 14 bp, Homo sapiens
ttattgtccttcta

SEQ ID NO: 5536387 - DNA, 16 bp, Homo sapiens
ttattgtctgtctaca

SEQ ID NO: 5536388 - DNA, 20 bp, Homo sapiens
ttattgtgacttcactgtat

SEQ ID NO: 5536389 - DNA, 19 bp, Homo sapiens
ttattgtggataacaaaga

SEQ ID NO: 5536390 - DNA, 23 bp, Homo sapiens
ttattgtggataacaaagatatc

SEQ ID NO: 5536391 - DNA, 24 bp, Homo sapiens
ttattgtggcccagataaggcttt

SEQ ID NO: 5536392 - DNA, 22 bp, Homo sapiens
ttattgtgtatagatatttcct

SEQ ID NO: 5536393 - DNA, 17 bp, Homo sapiens
ttattgtgtgcgctgcc

SEQ ID NO: 5536394 - DNA, 21 bp, Homo sapiens
ttattgtgtgcgctgcctggc

SEQ ID NO: 5536395 - DNA, 16 bp, Homo sapiens
ttattgttaaattaca

SEQ ID NO: 5536396 - DNA, 17 bp, Homo sapiens
ttattgttaaattacat

SEQ ID NO: 5536397 - DNA, 14 bp, Homo sapiens
ttattgttaataca

SEQ ID NO: 5536398 - DNA, 13 bp, Homo sapiens
ttattgttccaag

SEQ ID NO: 5536399 - DNA, 17 bp, Homo sapiens
ttattgttccaagacat

SEQ ID NO: 5536400 - DNA, 17 bp, Homo sapiens
ttattgtttaaaatcat

SEQ ID NO: 5536401 - DNA, 15 bp, Homo sapiens
ttattgtttgaaaga

SEQ ID NO: 5536402 - DNA, 13 bp, Homo sapiens
ttattgttttgtt

SEQ ID NO: 5536403 - DNA, 14 bp, Homo sapiens
ttattgttttgtta

SEQ ID NO: 5536404 - DNA, 17 bp, Homo sapiens
ttatttaaaaaactaaa

SEQ ID NO: 5536405 - DNA, 14 bp, Homo sapiens
ttatttaaaaatat

SEQ ID NO: 5536406 - DNA, 12 bp, Homo sapiens
ttatttaaaaga

SEQ ID NO: 5536407 - DNA, 13 bp, Homo sapiens
ttatttaaaagat

SEQ ID NO: 5536408 - DNA, 16 bp, Homo sapiens
ttatttaaaagattca

SEQ ID NO: 5536409 - DNA, 16 bp, Homo sapiens
ttatttaaaagatttt

SEQ ID NO: 5536410 - DNA, 18 bp, Homo sapiens
ttatttaaaatgattttt

SEQ ID NO: 5536411 - DNA, 23 bp, Homo sapiens
ttatttaaaccgctaaaagaaac

SEQ ID NO: 5536412 - DNA, 18 bp, Homo sapiens
ttatttaaataaaatcac

SEQ ID NO: 5536413 - DNA, 13 bp, Homo sapiens
ttatttaaataga

SEQ ID NO: 5536414 - DNA, 14 bp, Homo sapiens
ttatttaaatctgt

SEQ ID NO: 5536415 - DNA, 11 bp, Homo sapiens
ttatttaaatg

SEQ ID NO: 5536416 - DNA, 14 bp, Homo sapiens
ttatttaaatgcat

SEQ ID NO: 5536417 - DNA, 21 bp, Homo sapiens
ttatttaaatgcatgtcttaa

SEQ ID NO: 5536418 - DNA, 14 bp, Homo sapiens
ttatttaaatgctt

SEQ ID NO: 5536419 - DNA, 14 bp, Homo sapiens
ttatttaaatgtac

SEQ ID NO: 5536420 - DNA, 15 bp, Homo sapiens
ttatttaaatgtact

SEQ ID NO: 5536421 - DNA, 13 bp, Homo sapiens
ttatttaaatgtt

SEQ ID NO: 5536422 - DNA, 11 bp, Homo sapiens
ttatttaactc

SEQ ID NO: 5536423 - DNA, 13 bp, Homo sapiens
ttatttaagaaat

SEQ ID NO: 5536424 - DNA, 13 bp, Homo sapiens
ttatttaaggatg

SEQ ID NO: 5536425 - DNA, 15 bp, Homo sapiens
ttatttaaggatgga

SEQ ID NO: 5536426 - DNA, 19 bp, Homo sapiens
ttatttaaggatggatggc

SEQ ID NO: 5536427 - DNA, 20 bp, Homo sapiens
ttatttaaggatggatggca

SEQ ID NO: 5536428 - DNA, 22 bp, Homo sapiens
ttatttaaggatggatggcacc

SEQ ID NO: 5536429 - DNA, 15 bp, Homo sapiens
ttatttaataacatt

SEQ ID NO: 5536430 - DNA, 12 bp, Homo sapiens
ttatttaataag

SEQ ID NO: 5536431 - DNA, 13 bp, Homo sapiens
ttatttaatagct

SEQ ID NO: 5536432 - DNA, 21 bp, Homo sapiens
ttatttaatcacagtcatctt

SEQ ID NO: 5536433 - DNA, 22 bp, Homo sapiens
ttatttaatgaaagactgtaca

SEQ ID NO: 5536434 - DNA, 17 bp, Homo sapiens
ttatttaattaaatgta

SEQ ID NO: 5536435 - DNA, 20 bp, Homo sapiens
ttatttaatttcataaattg

SEQ ID NO: 5536436 - DNA, 13 bp, Homo sapiens
ttatttaatttgt

SEQ ID NO: 5536437 - DNA, 18 bp, Homo sapiens
ttatttaatttgtatgct

SEQ ID NO: 5536438 - DNA, 12 bp, Homo sapiens
ttatttacaaaa

SEQ ID NO: 5536439 - DNA, 17 bp, Homo sapiens
ttatttacaagaagaac

SEQ ID NO: 5536440 - DNA, 15 bp, Homo sapiens
ttatttacagatgaa

SEQ ID NO: 5536441 - DNA, 20 bp, Homo sapiens
ttatttacagatgaatgtat

SEQ ID NO: 5536442 - DNA, 21 bp, Homo sapiens
ttatttacatcactttgtgaa

SEQ ID NO: 5536443 - DNA, 22 bp, Homo sapiens
ttatttacatcactttgtgaat

SEQ ID NO: 5536444 - DNA, 13 bp, Homo sapiens
ttatttacattta

SEQ ID NO: 5536445 - DNA, 15 bp, Homo sapiens
ttatttaccttttaa

SEQ ID NO: 5536446 - DNA, 19 bp, Homo sapiens
ttatttacttgtagaaatc

SEQ ID NO: 5536447 - DNA, 18 bp, Homo sapiens
ttatttagacaagagatg

SEQ ID NO: 5536448 - DNA, 15 bp, Homo sapiens
ttatttagattcact

SEQ ID NO: 5536449 - DNA, 11 bp, Homo sapiens
ttatttagcat

SEQ ID NO: 5536450 - DNA, 15 bp, Homo sapiens
ttatttaggaaacac

SEQ ID NO: 5536451 - DNA, 16 bp, Homo sapiens
ttatttaggctttgta

SEQ ID NO: 5536452 - DNA, 18 bp, Homo sapiens
ttatttagggaactgctt

SEQ ID NO: 5536453 - DNA, 13 bp, Homo sapiens
ttatttagtaaaa

SEQ ID NO: 5536454 - DNA, 22 bp, Homo sapiens
ttatttagtaaaattatctgtt

SEQ ID NO: 5536455 - DNA, 20 bp, Homo sapiens
ttatttagtcaattgtttaa

SEQ ID NO: 5536456 - DNA, 21 bp, Homo sapiens
ttatttagtcaattgtttaat

SEQ ID NO: 5536457 - DNA, 23 bp, Homo sapiens
ttatttagtcaattgtttaatgt

SEQ ID NO: 5536458 - DNA, 20 bp, Homo sapiens
ttatttagttgaaaaatcta

SEQ ID NO: 5536459 - DNA, 17 bp, Homo sapiens
ttatttataatcacttt

SEQ ID NO: 5536460 - DNA, 15 bp, Homo sapiens
ttatttatacactgt

SEQ ID NO: 5536461 - DNA, 14 bp, Homo sapiens
ttatttatagtcat

SEQ ID NO: 5536462 - DNA, 14 bp, Homo sapiens
ttatttatatatga

SEQ ID NO: 5536463 - DNA, 18 bp, Homo sapiens
ttatttatatgtactgtt

SEQ ID NO: 5536464 - DNA, 12 bp, Homo sapiens
ttatttatattc

SEQ ID NO: 5536465 - DNA, 16 bp, Homo sapiens
ttatttatatttattg

SEQ ID NO: 5536466 - DNA, 20 bp, Homo sapiens
ttatttatcaaaatgtagct

SEQ ID NO: 5536467 - DNA, 21 bp, Homo sapiens
ttatttatcaatttttcccag

SEQ ID NO: 5536468 - DNA, 19 bp, Homo sapiens
ttatttatgacctgaaata

SEQ ID NO: 5536469 - DNA, 14 bp, Homo sapiens
ttatttatgcctct

SEQ ID NO: 5536470 - DNA, 20 bp, Homo sapiens
ttatttatgcctctgtattt

SEQ ID NO: 5536471 - DNA, 23 bp, Homo sapiens
ttatttatgcgtaatttaatggg

SEQ ID NO: 5536472 - DNA, 11 bp, Homo sapiens
ttatttatgga

SEQ ID NO: 5536473 - DNA, 23 bp, Homo sapiens
ttatttatggcttataaatgtgt

SEQ ID NO: 5536474 - DNA, 15 bp, Homo sapiens
ttatttatgtatggt

SEQ ID NO: 5536475 - DNA, 21 bp, Homo sapiens
ttatttattaaaaatgttctc

SEQ ID NO: 5536476 - DNA, 16 bp, Homo sapiens
ttatttattaaacttc

SEQ ID NO: 5536477 - DNA, 13 bp, Homo sapiens
ttatttattatta

SEQ ID NO: 5536478 - DNA, 13 bp, Homo sapiens
ttatttattcact

SEQ ID NO: 5536479 - DNA, 17 bp, Homo sapiens
ttatttattcagcttca

SEQ ID NO: 5536480 - DNA, 11 bp, Homo sapiens
ttatttattga

SEQ ID NO: 5536481 - DNA, 15 bp, Homo sapiens
ttatttattggagat

SEQ ID NO: 5536482 - DNA, 15 bp, Homo sapiens
ttatttatttaaatg

SEQ ID NO: 5536483 - DNA, 15 bp, Homo sapiens
ttatttatttatgga

SEQ ID NO: 5536484 - DNA, 13 bp, Homo sapiens
ttatttatttcct

SEQ ID NO: 5536485 - DNA, 23 bp, Homo sapiens
ttatttatttctgtaaaatttgt

SEQ ID NO: 5536486 - DNA, 18 bp, Homo sapiens
ttatttatttgattaggt

SEQ ID NO: 5536487 - DNA, 20 bp, Homo sapiens
ttatttatttttgtactgtg

SEQ ID NO: 5536488 - DNA, 14 bp, Homo sapiens
ttatttcaataaat

SEQ ID NO: 5536489 - DNA, 15 bp, Homo sapiens
ttatttcaatgtaat

SEQ ID NO: 5536490 - DNA, 18 bp, Homo sapiens
ttatttcaatgtaattaa

SEQ ID NO: 5536491 - DNA, 18 bp, Homo sapiens
ttatttcaattgtttata

SEQ ID NO: 5536492 - DNA, 22 bp, Homo sapiens
ttatttcactatcttcttcaaa

SEQ ID NO: 5536493 - DNA, 14 bp, Homo sapiens
ttatttcacttgat

SEQ ID NO: 5536494 - DNA, 20 bp, Homo sapiens
ttatttcagatgattcaaat

SEQ ID NO: 5536495 - DNA, 19 bp, Homo sapiens
ttatttcagattttgataa

SEQ ID NO: 5536496 - DNA, 18 bp, Homo sapiens
ttatttcataattgccta

SEQ ID NO: 5536497 - DNA, 23 bp, Homo sapiens
ttatttcatatactataattgta

SEQ ID NO: 5536498 - DNA, 16 bp, Homo sapiens
ttatttcattcacatt

SEQ ID NO: 5536499 - DNA, 12 bp, Homo sapiens
ttatttccaaaa

SEQ ID NO: 5536500 - DNA, 18 bp, Homo sapiens
ttatttccactaaaaata

SEQ ID NO: 5536501 - DNA, 19 bp, Homo sapiens
ttatttccactattttcaa

SEQ ID NO: 5536502 - DNA, 22 bp, Homo sapiens
ttatttccaggtaatatgtctt

SEQ ID NO: 5536503 - DNA, 14 bp, Homo sapiens
ttatttccagtggt

SEQ ID NO: 5536504 - DNA, 15 bp, Homo sapiens
ttatttccagttttt

SEQ ID NO: 5536505 - DNA, 22 bp, Homo sapiens
ttatttccatattaaaatcaca

SEQ ID NO: 5536506 - DNA, 21 bp, Homo sapiens
ttatttccatcatgtcagagc

SEQ ID NO: 5536507 - DNA, 14 bp, Homo sapiens
ttatttccccagcc

SEQ ID NO: 5536508 - DNA, 18 bp, Homo sapiens
ttatttccccagccacag

SEQ ID NO: 5536509 - DNA, 19 bp, Homo sapiens
ttatttcccccatttttcc

SEQ ID NO: 5536510 - DNA, 22 bp, Homo sapiens
ttatttccctacattaaacatg

SEQ ID NO: 5536511 - DNA, 10 bp, Homo sapiens
ttatttccta

SEQ ID NO: 5536512 - DNA, 21 bp, Homo sapiens
ttatttcctagttctgtagaa

SEQ ID NO: 5536513 - DNA, 17 bp, Homo sapiens
ttatttcctatcataaa

SEQ ID NO: 5536514 - DNA, 17 bp, Homo sapiens
ttatttcctatgatgta

SEQ ID NO: 5536515 - DNA, 23 bp, Homo sapiens
ttatttcggagcgcaatgccatc

SEQ ID NO: 5536516 - DNA, 15 bp, Homo sapiens
ttatttctaaaacat

SEQ ID NO: 5536517 - DNA, 21 bp, Homo sapiens
ttatttctaaatgagacgaaa

SEQ ID NO: 5536518 - DNA, 22 bp, Homo sapiens
ttatttctaatccttttcctta

SEQ ID NO: 5536519 - DNA, 18 bp, Homo sapiens
ttatttctacctttctga

SEQ ID NO: 5536520 - DNA, 22 bp, Homo sapiens
ttatttctagtccaaaattaca

SEQ ID NO: 5536521 - DNA, 19 bp, Homo sapiens
ttatttctagttctttcct

SEQ ID NO: 5536522 - DNA, 12 bp, Homo sapiens
ttatttctatga

SEQ ID NO: 5536523 - DNA, 22 bp, Homo sapiens
ttatttctcagactttggaaaa

SEQ ID NO: 5536524 - DNA, 12 bp, Homo sapiens
ttatttctcctt

SEQ ID NO: 5536525 - DNA, 21 bp, Homo sapiens
ttatttctctcatctgttaca

SEQ ID NO: 5536526 - DNA, 18 bp, Homo sapiens
ttatttctctctcctggt

SEQ ID NO: 5536527 - DNA, 19 bp, Homo sapiens
ttatttctctggcaaactt

SEQ ID NO: 5536528 - DNA, 11 bp, Homo sapiens
ttatttctgaa

SEQ ID NO: 5536529 - DNA, 12 bp, Homo sapiens
ttatttctgatg

SEQ ID NO: 5536530 - DNA, 22 bp, Homo sapiens
ttatttctgatttcataattca

SEQ ID NO: 5536531 - DNA, 13 bp, Homo sapiens
ttatttctgcata

SEQ ID NO: 5536532 - DNA, 15 bp, Homo sapiens
ttatttctgcatatg

SEQ ID NO: 5536533 - DNA, 19 bp, Homo sapiens
ttatttctgctctggaata

SEQ ID NO: 5536534 - DNA, 14 bp, Homo sapiens
ttatttctgtaaaa

SEQ ID NO: 5536535 - DNA, 17 bp, Homo sapiens
ttatttctgtatataga

SEQ ID NO: 5536536 - DNA, 16 bp, Homo sapiens
ttatttctgtcattca

SEQ ID NO: 5536537 - DNA, 14 bp, Homo sapiens
ttatttctgtgaaa

SEQ ID NO: 5536538 - DNA, 20 bp, Homo sapiens
ttatttctgtgaaagaagta

SEQ ID NO: 5536539 - DNA, 12 bp, Homo sapiens
ttatttcttccc

SEQ ID NO: 5536540 - DNA, 23 bp, Homo sapiens
ttatttcttcccagaatctctga

SEQ ID NO: 5536541 - DNA, 13 bp, Homo sapiens
ttatttcttccct

SEQ ID NO: 5536542 - DNA, 12 bp, Homo sapiens
ttatttcttctc

SEQ ID NO: 5536543 - DNA, 14 bp, Homo sapiens
ttatttgaaaaaag

SEQ ID NO: 5536544 - DNA, 22 bp, Homo sapiens
ttatttgaaaacatataaagca

SEQ ID NO: 5536545 - DNA, 11 bp, Homo sapiens
ttatttgaaag

SEQ ID NO: 5536546 - DNA, 19 bp, Homo sapiens
ttatttgactatgaatgtt

SEQ ID NO: 5536547 - DNA, 15 bp, Homo sapiens
ttatttgactttaat

SEQ ID NO: 5536548 - DNA, 16 bp, Homo sapiens
ttatttgagaaaatat

SEQ ID NO: 5536549 - DNA, 20 bp, Homo sapiens
ttatttgagaagctgctcaa

SEQ ID NO: 5536550 - DNA, 17 bp, Homo sapiens
ttatttgaggtcagtgt

SEQ ID NO: 5536551 - DNA, 14 bp, Homo sapiens
ttatttgagtttga

SEQ ID NO: 5536552 - DNA, 20 bp, Homo sapiens
ttatttgatgagttctgtcc

SEQ ID NO: 5536553 - DNA, 19 bp, Homo sapiens
ttatttgattatttaagac

SEQ ID NO: 5536554 - DNA, 11 bp, Homo sapiens
ttatttgcaat

SEQ ID NO: 5536555 - DNA, 22 bp, Homo sapiens
ttatttgcaatttgagccattt

SEQ ID NO: 5536556 - DNA, 13 bp, Homo sapiens
ttatttgcatgtg

SEQ ID NO: 5536557 - DNA, 20 bp, Homo sapiens
ttatttgctcataagtaaat

SEQ ID NO: 5536558 - DNA, 20 bp, Homo sapiens
ttatttggaataataatttt

SEQ ID NO: 5536559 - DNA, 22 bp, Homo sapiens
ttatttggcagtttggtatttg

SEQ ID NO: 5536560 - DNA, 13 bp, Homo sapiens
ttatttggcataa

SEQ ID NO: 5536561 - DNA, 23 bp, Homo sapiens
ttatttgggccagttatagctta

SEQ ID NO: 5536562 - DNA, 21 bp, Homo sapiens
ttatttggggttgcatcagaa

SEQ ID NO: 5536563 - DNA, 18 bp, Homo sapiens
ttatttggttcccttcct

SEQ ID NO: 5536564 - DNA, 15 bp, Homo sapiens
ttatttgtaaattta

SEQ ID NO: 5536565 - DNA, 19 bp, Homo sapiens
ttcacacttccaccagcct

SEQ ID NO: 5536566 - DNA, 12 bp, Homo sapiens
ttcacagagcac

SEQ ID NO: 5536567 - DNA, 19 bp, Homo sapiens
ttcacagagcacgcctgcc

SEQ ID NO: 5536568 - DNA, 20 bp, Homo sapiens
ttcacagagcacgcctgcca

SEQ ID NO: 5536569 - DNA, 23 bp, Homo sapiens
ttcacagagtgtgctgctatttt

SEQ ID NO: 5536570 - DNA, 19 bp, Homo sapiens
ttcacagatgcctactttt

SEQ ID NO: 5536571 - DNA, 19 bp, Homo sapiens
ttcacagatggaagaagtt

SEQ ID NO: 5536572 - DNA, 20 bp, Homo sapiens
ttcacagatgggtgcttgga

SEQ ID NO: 5536573 - DNA, 15 bp, Homo sapiens
ttcacagcaacactc

SEQ ID NO: 5536574 - DNA, 13 bp, Homo sapiens
ttcacagcagctt

SEQ ID NO: 5536575 - DNA, 13 bp, Homo sapiens
ttcacagcccaga

SEQ ID NO: 5536576 - DNA, 19 bp, Homo sapiens
ttcacagcctataaccaga

SEQ ID NO: 5536577 - DNA, 14 bp, Homo sapiens
ttcacagctccttg

SEQ ID NO: 5536578 - DNA, 15 bp, Homo sapiens
ttcacagctctgtgt

SEQ ID NO: 5536579 - DNA, 14 bp, Homo sapiens
ttcacagctggaga

SEQ ID NO: 5536580 - DNA, 17 bp, Homo sapiens
ttcacagcttcaccact

SEQ ID NO: 5536581 - DNA, 13 bp, Homo sapiens
ttcacagctttta

SEQ ID NO: 5536582 - DNA, 12 bp, Homo sapiens
ttcacaggaggc

SEQ ID NO: 5536583 - DNA, 13 bp, Homo sapiens
ttcacaggcactc

SEQ ID NO: 5536584 - DNA, 12 bp, Homo sapiens
ttcacaggcagc

SEQ ID NO: 5536585 - DNA, 13 bp, Homo sapiens
ttcacaggcagcc

SEQ ID NO: 5536586 - DNA, 10 bp, Homo sapiens
ttcacaggcg

SEQ ID NO: 5536587 - DNA, 22 bp, Homo sapiens
ttcacaggctgtaaattgaact

SEQ ID NO: 5536588 - DNA, 23 bp, Homo sapiens
ttcacaggggttcccttctctca

SEQ ID NO: 5536589 - DNA, 18 bp, Homo sapiens
ttcacaggtgtggtgtaa

SEQ ID NO: 5536590 - DNA, 23 bp, Homo sapiens
ttcacaggttctgcgttacaaca

SEQ ID NO: 5536591 - DNA, 19 bp, Homo sapiens
ttcacagtacccaaactgc

SEQ ID NO: 5536592 - DNA, 23 bp, Homo sapiens
ttcacagtacccaaactgctttt

SEQ ID NO: 5536593 - DNA, 21 bp, Homo sapiens
ttcacagtcaccaagtgtatt

SEQ ID NO: 5536594 - DNA, 16 bp, Homo sapiens
ttcacagtcactgatg

SEQ ID NO: 5536595 - DNA, 20 bp, Homo sapiens
ttcacagtgacactggacca

SEQ ID NO: 5536596 - DNA, 16 bp, Homo sapiens
ttcacagtgtctgtaa

SEQ ID NO: 5536597 - DNA, 17 bp, Homo sapiens
ttcacagtgtctgtaaa

SEQ ID NO: 5536598 - DNA, 18 bp, Homo sapiens
ttcacagtgtctgtaaat

SEQ ID NO: 5536599 - DNA, 16 bp, Homo sapiens
ttcacagtgtttctta

SEQ ID NO: 5536600 - DNA, 22 bp, Homo sapiens
ttcacagttcctctttgttgga

SEQ ID NO: 5536601 - DNA, 15 bp, Homo sapiens
ttcacagttctctcc

SEQ ID NO: 5536602 - DNA, 20 bp, Homo sapiens
ttcacagttctctccttctt

SEQ ID NO: 5536603 - DNA, 16 bp, Homo sapiens
ttcacagttctgtaat

SEQ ID NO: 5536604 - DNA, 20 bp, Homo sapiens
ttcacagttctttgggccag

SEQ ID NO: 5536605 - DNA, 21 bp, Homo sapiens
ttcacagttctttgggccaga

SEQ ID NO: 5536606 - DNA, 20 bp, Homo sapiens
ttcacagttggcacttctgc

SEQ ID NO: 5536607 - DNA, 18 bp, Homo sapiens
ttcacagtttcttccatt

SEQ ID NO: 5536608 - DNA, 19 bp, Homo sapiens
ttcacataaatgcagccca

SEQ ID NO: 5536609 - DNA, 20 bp, Homo sapiens
ttcacataaatgcagcccat

SEQ ID NO: 5536610 - DNA, 15 bp, Homo sapiens
ttcacataccctccc

SEQ ID NO: 5536611 - DNA, 19 bp, Homo sapiens
ttcacatatgattctctta

SEQ ID NO: 5536612 - DNA, 17 bp, Homo sapiens
ttcacatatttgtagct

SEQ ID NO: 5536613 - DNA, 22 bp, Homo sapiens
ttcacatcctcagaaagtgcag

SEQ ID NO: 5536614 - DNA, 14 bp, Homo sapiens
ttcacatgaacata

SEQ ID NO: 5536615 - DNA, 15 bp, Homo sapiens
ttcacatgctggctc

SEQ ID NO: 5536616 - DNA, 16 bp, Homo sapiens
ttcacatgtgccctgc

SEQ ID NO: 5536617 - DNA, 17 bp, Homo sapiens
ttcacatgtgccctgcc

SEQ ID NO: 5536618 - DNA, 18 bp, Homo sapiens
ttcacatgtgccctgcct

SEQ ID NO: 5536619 - DNA, 20 bp, Homo sapiens
ttcacatgtgccctgccttg

SEQ ID NO: 5536620 - DNA, 16 bp, Homo sapiens
ttcacatgttctaata

SEQ ID NO: 5536621 - DNA, 16 bp, Homo sapiens
ttcacatgtttaactt

SEQ ID NO: 5536622 - DNA, 15 bp, Homo sapiens
ttcacatgttttcaa

SEQ ID NO: 5536623 - DNA, 17 bp, Homo sapiens
ttcacattaaaaaatga

SEQ ID NO: 5536624 - DNA, 20 bp, Homo sapiens
ttcacattaatggtctaaaa

SEQ ID NO: 5536625 - DNA, 15 bp, Homo sapiens
ttcacattcctgacc

SEQ ID NO: 5536626 - DNA, 12 bp, Homo sapiens
ttcacattctta

SEQ ID NO: 5536627 - DNA, 20 bp, Homo sapiens
ttcacattgtttgctgctat

SEQ ID NO: 5536628 - DNA, 19 bp, Homo sapiens
ttcacatttaaatggttct

SEQ ID NO: 5536629 - DNA, 19 bp, Homo sapiens
ttcacattttccttttcaa

SEQ ID NO: 5536630 - DNA, 11 bp, Homo sapiens
ttcacattttt

SEQ ID NO: 5536631 - DNA, 23 bp, Homo sapiens
ttcacatttttacaaataggtag

SEQ ID NO: 5536632 - DNA, 16 bp, Homo sapiens
ttcacatttttgtaat

SEQ ID NO: 5536633 - DNA, 14 bp, Homo sapiens
ttcaccacagactt

SEQ ID NO: 5536634 - DNA, 22 bp, Homo sapiens
ttcaccaccccctgtcccattc

SEQ ID NO: 5536635 - DNA, 11 bp, Homo sapiens
ttcaccaccct

SEQ ID NO: 5536636 - DNA, 15 bp, Homo sapiens
ttcaccactcctctc

SEQ ID NO: 5536637 - DNA, 12 bp, Homo sapiens
ttcaccagcagc

SEQ ID NO: 5536638 - DNA, 13 bp, Homo sapiens
ttcaccagcagca

SEQ ID NO: 5536639 - DNA, 18 bp, Homo sapiens
ttcaccagccctgagcca

SEQ ID NO: 5536640 - DNA, 18 bp, Homo sapiens
ttcaccaggaagaaggcc

SEQ ID NO: 5536641 - DNA, 17 bp, Homo sapiens
ttcaccaggggtgctca

SEQ ID NO: 5536642 - DNA, 17 bp, Homo sapiens
ttcaccaggttaaaatt

SEQ ID NO: 5536643 - DNA, 13 bp, Homo sapiens
ttcaccagtctgt

SEQ ID NO: 5536644 - DNA, 20 bp, Homo sapiens
ttcaccagtctgtctactgt

SEQ ID NO: 5536645 - DNA, 21 bp, Homo sapiens
ttcaccagtctgtctactgtg

SEQ ID NO: 5536646 - DNA, 16 bp, Homo sapiens
ttcaccagtgttcctg

SEQ ID NO: 5536647 - DNA, 22 bp, Homo sapiens
ttcaccagtgttcctgaagctg

SEQ ID NO: 5536648 - DNA, 22 bp, Homo sapiens
ttcaccatccagagaccaaata

SEQ ID NO: 5536649 - DNA, 15 bp, Homo sapiens
ttcaccatctttcta

SEQ ID NO: 5536650 - DNA, 13 bp, Homo sapiens
ttcaccatgcagg

SEQ ID NO: 5536651 - DNA, 17 bp, Homo sapiens
ttcaccatgcaggcaac

SEQ ID NO: 5536652 - DNA, 20 bp, Homo sapiens
ttcaccatgcaggcaacatt

SEQ ID NO: 5536653 - DNA, 16 bp, Homo sapiens
ttcaccatggcaaacc

SEQ ID NO: 5536654 - DNA, 12 bp, Homo sapiens
ttcaccatggcc

SEQ ID NO: 5536655 - DNA, 17 bp, Homo sapiens
ttcaccatgtaaaacaa

SEQ ID NO: 5536656 - DNA, 22 bp, Homo sapiens
ttcaccatgtaaaacaaaaaac

SEQ ID NO: 5536657 - DNA, 17 bp, Homo sapiens
ttcaccatgttgccaat

SEQ ID NO: 5536658 - DNA, 21 bp, Homo sapiens
ttcaccatgttggccaggctg

SEQ ID NO: 5536659 - DNA, 18 bp, Homo sapiens
ttcaccattataatgaat

SEQ ID NO: 5536660 - DNA, 24 bp, Homo sapiens
ttcaccatttggcaatgccatcat

SEQ ID NO: 5536661 - DNA, 22 bp, Homo sapiens
ttcacccaccaggccagctcag

SEQ ID NO: 5536662 - DNA, 23 bp, Homo sapiens
ttcacccaccaggccagctcagg

SEQ ID NO: 5536663 - DNA, 12 bp, Homo sapiens
ttcacccactcc

SEQ ID NO: 5536664 - DNA, 15 bp, Homo sapiens
ttcacccagacagct

SEQ ID NO: 5536665 - DNA, 19 bp, Homo sapiens
ttcacccagcacccatgcc

SEQ ID NO: 5536666 - DNA, 18 bp, Homo sapiens
ttcacccaggcctatgtt

SEQ ID NO: 5536667 - DNA, 20 bp, Homo sapiens
ttcacccatcctaggaacca

SEQ ID NO: 5536668 - DNA, 17 bp, Homo sapiens
ttcaccccaatcccagc

SEQ ID NO: 5536669 - DNA, 14 bp, Homo sapiens
ttcaccccaccctt

SEQ ID NO: 5536670 - DNA, 13 bp, Homo sapiens
ttcacccccaact

SEQ ID NO: 5536671 - DNA, 13 bp, Homo sapiens
ttcacccccatcc

SEQ ID NO: 5536672 - DNA, 22 bp, Homo sapiens
ttcaccccccactcaccagtgt

SEQ ID NO: 5536673 - DNA, 22 bp, Homo sapiens
ttcaccccggcaggccctgcag

SEQ ID NO: 5536674 - DNA, 18 bp, Homo sapiens
ttcacccctacactgtga

SEQ ID NO: 5536675 - DNA, 21 bp, Homo sapiens
ttcacccctacactgtgaagg

SEQ ID NO: 5536676 - DNA, 10 bp, Homo sapiens
ttcacccctc

SEQ ID NO: 5536677 - DNA, 17 bp, Homo sapiens
ttcacccctcccacctc

SEQ ID NO: 5536678 - DNA, 19 bp, Homo sapiens
ttcacccctcttcccacca

SEQ ID NO: 5536679 - DNA, 17 bp, Homo sapiens
ttcaccccttatcctga

SEQ ID NO: 5536680 - DNA, 16 bp, Homo sapiens
ttcaccctcatgaaaa

SEQ ID NO: 5536681 - DNA, 14 bp, Homo sapiens
ttcaccctcctcat

SEQ ID NO: 5536682 - DNA, 21 bp, Homo sapiens
ttcaccctgcattacatgtgt

SEQ ID NO: 5536683 - DNA, 14 bp, Homo sapiens
ttcaccctgccacc

SEQ ID NO: 5536684 - DNA, 18 bp, Homo sapiens
ttcacccttaacccaagg

SEQ ID NO: 5536685 - DNA, 22 bp, Homo sapiens
ttcacccttaacccaaggagca

SEQ ID NO: 5536686 - DNA, 13 bp, Homo sapiens
ttcacccttttct

SEQ ID NO: 5536687 - DNA, 13 bp, Homo sapiens
ttcaccgcattcc

SEQ ID NO: 5536688 - DNA, 15 bp, Homo sapiens
ttcaccgtggctacc

SEQ ID NO: 5536689 - DNA, 16 bp, Homo sapiens
ttcacctaagagattc

SEQ ID NO: 5536690 - DNA, 15 bp, Homo sapiens
ttcacctccatgtca

SEQ ID NO: 5536691 - DNA, 18 bp, Homo sapiens
ttcacctccatgtcatcc

SEQ ID NO: 5536692 - DNA, 23 bp, Homo sapiens
ttcacctctgggaccccagctgc

SEQ ID NO: 5536693 - DNA, 18 bp, Homo sapiens
ttcacctctgtacagacc

SEQ ID NO: 5536694 - DNA, 13 bp, Homo sapiens
ttcacctcttcca

SEQ ID NO: 5536695 - DNA, 15 bp, Homo sapiens
ttcacctcttcctct

SEQ ID NO: 5536696 - DNA, 16 bp, Homo sapiens
ttcacctcttcctctg

SEQ ID NO: 5536697 - DNA, 18 bp, Homo sapiens
ttcacctcttcctctggt

SEQ ID NO: 5536698 - DNA, 17 bp, Homo sapiens
ttcacctgaaacacttt

SEQ ID NO: 5536699 - DNA, 16 bp, Homo sapiens
ttcacctgattcaact

SEQ ID NO: 5536700 - DNA, 21 bp, Homo sapiens
ttcacctgggcgccaactgct

SEQ ID NO: 5536701 - DNA, 17 bp, Homo sapiens
ttcacctgtaaaacttt

SEQ ID NO: 5536702 - DNA, 19 bp, Homo sapiens
ttcacctgtgacaaaggat

SEQ ID NO: 5536703 - DNA, 18 bp, Homo sapiens
ttcacctgttatgtatga

SEQ ID NO: 5536704 - DNA, 23 bp, Homo sapiens
ttcaccttatgtattattttcta

SEQ ID NO: 5536705 - DNA, 12 bp, Homo sapiens
ttcaccttccct

SEQ ID NO: 5536706 - DNA, 12 bp, Homo sapiens
ttcaccttggaa

SEQ ID NO: 5536707 - DNA, 17 bp, Homo sapiens
ttcacctttcctctccc

SEQ ID NO: 5536708 - DNA, 16 bp, Homo sapiens
ttcacctttggtgcag

SEQ ID NO: 5536709 - DNA, 14 bp, Homo sapiens
ttcacctttgtagc

SEQ ID NO: 5536710 - DNA, 22 bp, Homo sapiens
ttcaccttttcttcaaaatcga

SEQ ID NO: 5536711 - DNA, 18 bp, Homo sapiens
ttcacgaacagcgttttt

SEQ ID NO: 5536712 - DNA, 13 bp, Homo sapiens
ttcacgaactgtt

SEQ ID NO: 5536713 - DNA, 17 bp, Homo sapiens
ttcacgaagtgttgcat

SEQ ID NO: 5536714 - DNA, 14 bp, Homo sapiens
ttcacgagtgttcc

SEQ ID NO: 5536715 - DNA, 14 bp, Homo sapiens
ttcacgcaacttga

SEQ ID NO: 5536716 - DNA, 15 bp, Homo sapiens
ttcacgccattctcc

SEQ ID NO: 5536717 - DNA, 19 bp, Homo sapiens
ttcacgccattctcctgcc

SEQ ID NO: 5536718 - DNA, 19 bp, Homo sapiens
ttcacgccgtaattctttc

SEQ ID NO: 5536719 - DNA, 21 bp, Homo sapiens
ttcacgccgtaattctttctg

SEQ ID NO: 5536720 - DNA, 17 bp, Homo sapiens
ttcacggaagagccttg

SEQ ID NO: 5536721 - DNA, 20 bp, Homo sapiens
ttcacggacaggaagcacag

SEQ ID NO: 5536722 - DNA, 15 bp, Homo sapiens
ttcacggactctttg

SEQ ID NO: 5536723 - DNA, 23 bp, Homo sapiens
ttcacgggcaacactcactgcct

SEQ ID NO: 5536724 - DNA, 18 bp, Homo sapiens
ttcacggtgacacaggtc

SEQ ID NO: 5536725 - DNA, 20 bp, Homo sapiens
ttcacggtgacacaggtcag

SEQ ID NO: 5536726 - DNA, 20 bp, Homo sapiens
ttcacgtaatcctcctgagt

SEQ ID NO: 5536727 - DNA, 20 bp, Homo sapiens
ttcacgtcactgccagagct

SEQ ID NO: 5536728 - DNA, 19 bp, Homo sapiens
ttcacgtcataggaagtta

SEQ ID NO: 5536729 - DNA, 22 bp, Homo sapiens
ttcacgtgcagcagcaacacaa

SEQ ID NO: 5536730 - DNA, 21 bp, Homo sapiens
ttcacgtgctttgtgttcagt

SEQ ID NO: 5536731 - DNA, 14 bp, Homo sapiens
ttcactaaagcagt

SEQ ID NO: 5536732 - DNA, 14 bp, Homo sapiens
ttcactaatcatga

SEQ ID NO: 5536733 - DNA, 15 bp, Homo sapiens
ttcactagaaaatga

SEQ ID NO: 5536734 - DNA, 22 bp, Homo sapiens
ttcactagaagccgtgggaaga

SEQ ID NO: 5536735 - DNA, 23 bp, Homo sapiens
ttcactagtgaccccttccctgt

SEQ ID NO: 5536736 - DNA, 17 bp, Homo sapiens
ttcactattcctatgct

SEQ ID NO: 5536737 - DNA, 23 bp, Homo sapiens
ttcactcaagagttcagtgctca

SEQ ID NO: 5536738 - DNA, 18 bp, Homo sapiens
ttcactcagaattattca

SEQ ID NO: 5536739 - DNA, 17 bp, Homo sapiens
ttcactcagccacaccc

SEQ ID NO: 5536740 - DNA, 17 bp, Homo sapiens
ttcactccagtcaacag

SEQ ID NO: 5536741 - DNA, 19 bp, Homo sapiens
ttcactccagtcaacagat

SEQ ID NO: 5536742 - DNA, 22 bp, Homo sapiens
ttcactcccaggtgagaattca

SEQ ID NO: 5536743 - DNA, 15 bp, Homo sapiens
ttcagtctcacagag

SEQ ID NO: 5536744 - DNA, 18 bp, Homo sapiens
ttcagtctcacagagaag

SEQ ID NO: 5536745 - DNA, 22 bp, Homo sapiens
ttcagtctcagctgctgaaatt

SEQ ID NO: 5536746 - DNA, 23 bp, Homo sapiens
ttcagtctctataccaataaagt

SEQ ID NO: 5536747 - DNA, 24 bp, Homo sapiens
ttcagtctctataccaataaagtg

SEQ ID NO: 5536748 - DNA, 14 bp, Homo sapiens
ttcagtctgcagct

SEQ ID NO: 5536749 - DNA, 12 bp, Homo sapiens
ttcagtctgtgt

SEQ ID NO: 5536750 - DNA, 13 bp, Homo sapiens
ttcagtctttcat

SEQ ID NO: 5536751 - DNA, 13 bp, Homo sapiens
ttcagtgaagatg

SEQ ID NO: 5536752 - DNA, 13 bp, Homo sapiens
ttcagtgaagcag

SEQ ID NO: 5536753 - DNA, 12 bp, Homo sapiens
ttcagtgaatat

SEQ ID NO: 5536754 - DNA, 22 bp, Homo sapiens
ttcagtgaatatttttgtattt

SEQ ID NO: 5536755 - DNA, 18 bp, Homo sapiens
ttcagtgactcctgctgg

SEQ ID NO: 5536756 - DNA, 20 bp, Homo sapiens
ttcagtgacttcttccctaa

SEQ ID NO: 5536757 - DNA, 17 bp, Homo sapiens
ttcagtgagcccctccc

SEQ ID NO: 5536758 - DNA, 18 bp, Homo sapiens
ttcagtgatggcaacact

SEQ ID NO: 5536759 - DNA, 16 bp, Homo sapiens
ttcagtgcaagagact

SEQ ID NO: 5536760 - DNA, 18 bp, Homo sapiens
ttcagtgcaagagacttt

SEQ ID NO: 5536761 - DNA, 23 bp, Homo sapiens
ttcagtgcatcattactgttcca

SEQ ID NO: 5536762 - DNA, 23 bp, Homo sapiens
ttcagtgcattatctacttgtgt

SEQ ID NO: 5536763 - DNA, 13 bp, Homo sapiens
ttcagtgccaata

SEQ ID NO: 5536764 - DNA, 14 bp, Homo sapiens
ttcagtgcccacca

SEQ ID NO: 5536765 - DNA, 14 bp, Homo sapiens
ttcagtgcctgctg

SEQ ID NO: 5536766 - DNA, 13 bp, Homo sapiens
ttcagtgccttat

SEQ ID NO: 5536767 - DNA, 20 bp, Homo sapiens
ttcagtgccttcctctctct

SEQ ID NO: 5536768 - DNA, 16 bp, Homo sapiens
ttcagtgctacatttt

SEQ ID NO: 5536769 - DNA, 18 bp, Homo sapiens
ttcagtggaacacaaatg

SEQ ID NO: 5536770 - DNA, 21 bp, Homo sapiens
ttcagtggacatttgttctgg

SEQ ID NO: 5536771 - DNA, 13 bp, Homo sapiens
ttcagtggaccct

SEQ ID NO: 5536772 - DNA, 23 bp, Homo sapiens
ttcagtggaccgaaatctgtatt

SEQ ID NO: 5536773 - DNA, 23 bp, Homo sapiens
ttcagtggctggaattaaaacaa

SEQ ID NO: 5536774 - DNA, 13 bp, Homo sapiens
ttcagtgggaaat

SEQ ID NO: 5536775 - DNA, 22 bp, Homo sapiens
ttcagtggtgaaatcttgtttg

SEQ ID NO: 5536776 - DNA, 13 bp, Homo sapiens
ttcagtgtaaata

SEQ ID NO: 5536777 - DNA, 20 bp, Homo sapiens
ttcagtgtaaattaattaca

SEQ ID NO: 5536778 - DNA, 13 bp, Homo sapiens
ttcagtgtaattt

SEQ ID NO: 5536779 - DNA, 13 bp, Homo sapiens
ttcagtgtacatg

SEQ ID NO: 5536780 - DNA, 22 bp, Homo sapiens
ttcagtgtcaaataaacactgt

SEQ ID NO: 5536781 - DNA, 23 bp, Homo sapiens
ttcagtgtcaaataaacactgtg

SEQ ID NO: 5536782 - DNA, 20 bp, Homo sapiens
ttcagtgtcccaccttgacc

SEQ ID NO: 5536783 - DNA, 12 bp, Homo sapiens
ttcagtgtcctt

SEQ ID NO: 5536784 - DNA, 18 bp, Homo sapiens
ttcagtgtccttcacggc

SEQ ID NO: 5536785 - DNA, 18 bp, Homo sapiens
ttcagtgttacctgtgtg

SEQ ID NO: 5536786 - DNA, 23 bp, Homo sapiens
ttcagtgttcccaaagtgaactc

SEQ ID NO: 5536787 - DNA, 13 bp, Homo sapiens
ttcagtgttgaca

SEQ ID NO: 5536788 - DNA, 15 bp, Homo sapiens
ttcagtgttgacata

SEQ ID NO: 5536789 - DNA, 17 bp, Homo sapiens
ttcagtgttgacatagc

SEQ ID NO: 5536790 - DNA, 22 bp, Homo sapiens
ttcagtgttgacatagcctttg

SEQ ID NO: 5536791 - DNA, 13 bp, Homo sapiens
ttcagtgtttctg

SEQ ID NO: 5536792 - DNA, 16 bp, Homo sapiens
ttcagtgttttcattt

SEQ ID NO: 5536793 - DNA, 16 bp, Homo sapiens
ttcagttaagaaaaaa

SEQ ID NO: 5536794 - DNA, 21 bp, Homo sapiens
ttcagttaagaaaaaaataat

SEQ ID NO: 5536795 - DNA, 19 bp, Homo sapiens
ttcagttaattcttagata

SEQ ID NO: 5536796 - DNA, 19 bp, Homo sapiens
ttcagttacaagattgtaa

SEQ ID NO: 5536797 - DNA, 17 bp, Homo sapiens
ttcagttattaaatgat

SEQ ID NO: 5536798 - DNA, 11 bp, Homo sapiens
ttcagttattt

SEQ ID NO: 5536799 - DNA, 16 bp, Homo sapiens
ttcagttattttgctt

SEQ ID NO: 5536800 - DNA, 16 bp, Homo sapiens
ttcagttcaaagtcat

SEQ ID NO: 5536801 - DNA, 17 bp, Homo sapiens
ttcagttcaaagtcatg

SEQ ID NO: 5536802 - DNA, 14 bp, Homo sapiens
ttcagttccagctt

SEQ ID NO: 5536803 - DNA, 19 bp, Homo sapiens
ttcagttcccagaatcaaa

SEQ ID NO: 5536804 - DNA, 22 bp, Homo sapiens
ttcagttccctcctgcccagga

SEQ ID NO: 5536805 - DNA, 14 bp, Homo sapiens
ttcagttctaggcc

SEQ ID NO: 5536806 - DNA, 17 bp, Homo sapiens
ttcagttctaggccttt

SEQ ID NO: 5536807 - DNA, 20 bp, Homo sapiens
ttcagttctaggcctttcct

SEQ ID NO: 5536808 - DNA, 13 bp, Homo sapiens
ttcagttctattt

SEQ ID NO: 5536809 - DNA, 13 bp, Homo sapiens
ttcagttctcatc

SEQ ID NO: 5536810 - DNA, 19 bp, Homo sapiens
ttcagttctcatcttgtaa

SEQ ID NO: 5536811 - DNA, 17 bp, Homo sapiens
ttcagttgcttgtcttc

SEQ ID NO: 5536812 - DNA, 15 bp, Homo sapiens
ttcagttgtctctga

SEQ ID NO: 5536813 - DNA, 20 bp, Homo sapiens
ttcagttgtgtttgttgctg

SEQ ID NO: 5536814 - DNA, 17 bp, Homo sapiens
ttcagttgttcttttta

SEQ ID NO: 5536815 - DNA, 16 bp, Homo sapiens
ttcagtttaattctgt

SEQ ID NO: 5536816 - DNA, 16 bp, Homo sapiens
ttcagtttagaaccta

SEQ ID NO: 5536817 - DNA, 18 bp, Homo sapiens
ttcagtttatctgttcat

SEQ ID NO: 5536818 - DNA, 20 bp, Homo sapiens
ttcagtttctatcaaccttc

SEQ ID NO: 5536819 - DNA, 21 bp, Homo sapiens
ttcagtttgaaaatattttgt

SEQ ID NO: 5536820 - DNA, 14 bp, Homo sapiens
ttcagtttgtctct

SEQ ID NO: 5536821 - DNA, 20 bp, Homo sapiens
ttcagttttaaaaatgaaga

SEQ ID NO: 5536822 - DNA, 17 bp, Homo sapiens
ttcagttttatctttaa

SEQ ID NO: 5536823 - DNA, 19 bp, Homo sapiens
ttcagttttatttttgcca

SEQ ID NO: 5536824 - DNA, 21 bp, Homo sapiens
ttcagttttcatttggttcat

SEQ ID NO: 5536825 - DNA, 17 bp, Homo sapiens
ttcagttttcccacttt

SEQ ID NO: 5536826 - DNA, 24 bp, Homo sapiens
ttcagttttggtgataatcgtctt

SEQ ID NO: 5536827 - DNA, 16 bp, Homo sapiens
ttcagtttttcacttc

SEQ ID NO: 5536828 - DNA, 14 bp, Homo sapiens
ttcagtttttcatt

SEQ ID NO: 5536829 - DNA, 21 bp, Homo sapiens
ttcagtttttcatttgttttg

SEQ ID NO: 5536830 - DNA, 20 bp, Homo sapiens
ttcataaaagtttgcatgtg

SEQ ID NO: 5536831 - DNA, 15 bp, Homo sapiens
ttcataaacaagttc

SEQ ID NO: 5536832 - DNA, 18 bp, Homo sapiens
ttcataaagagaaaatga

SEQ ID NO: 5536833 - DNA, 22 bp, Homo sapiens
ttcataaagattcacctaagag

SEQ ID NO: 5536834 - DNA, 11 bp, Homo sapiens
ttcataaagca

SEQ ID NO: 5536835 - DNA, 20 bp, Homo sapiens
ttcataaataaagtttgttg

SEQ ID NO: 5536836 - DNA, 14 bp, Homo sapiens
ttcataaatcatgt

SEQ ID NO: 5536837 - DNA, 16 bp, Homo sapiens
ttcataaatgaatttt

SEQ ID NO: 5536838 - DNA, 18 bp, Homo sapiens
ttcataaattaacaaagt

SEQ ID NO: 5536839 - DNA, 20 bp, Homo sapiens
ttcataaattaacaaagtgt

SEQ ID NO: 5536840 - DNA, 13 bp, Homo sapiens
ttcataaattggc

SEQ ID NO: 5536841 - DNA, 19 bp, Homo sapiens
ttcataaattggctccttt

SEQ ID NO: 5536842 - DNA, 22 bp, Homo sapiens
ttcataaattggctcctttccc

SEQ ID NO: 5536843 - DNA, 19 bp, Homo sapiens
ttcataaatttgttgtcat

SEQ ID NO: 5536844 - DNA, 23 bp, Homo sapiens
ttcataaatttgttgtcatgtgt

SEQ ID NO: 5536845 - DNA, 23 bp, Homo sapiens
ttcataacaaaccatctggtgcc

SEQ ID NO: 5536846 - DNA, 12 bp, Homo sapiens
ttcataaccaac

SEQ ID NO: 5536847 - DNA, 16 bp, Homo sapiens
ttcataaccaacaata

SEQ ID NO: 5536848 - DNA, 18 bp, Homo sapiens
ttcataaccaacaatata

SEQ ID NO: 5536849 - DNA, 18 bp, Homo sapiens
ttcataacttattgctga

SEQ ID NO: 5536850 - DNA, 22 bp, Homo sapiens
ttcataacttattgctgatttt

SEQ ID NO: 5536851 - DNA, 16 bp, Homo sapiens
ttcataacttcctgta

SEQ ID NO: 5536852 - DNA, 23 bp, Homo sapiens
ttcataacttgctgaatttcagg

SEQ ID NO: 5536853 - DNA, 14 bp, Homo sapiens
ttcataactttcat

SEQ ID NO: 5536854 - DNA, 17 bp, Homo sapiens
ttcataactttcattaa

SEQ ID NO: 5536855 - DNA, 20 bp, Homo sapiens
ttcataagaggttctaactt

SEQ ID NO: 5536856 - DNA, 15 bp, Homo sapiens
ttcataagatattct

SEQ ID NO: 5536857 - DNA, 18 bp, Homo sapiens
ttcataagctttgtaatt

SEQ ID NO: 5536858 - DNA, 17 bp, Homo sapiens
ttcataaggcctgccct

SEQ ID NO: 5536859 - DNA, 18 bp, Homo sapiens
ttcataaggcctgccctc

SEQ ID NO: 5536860 - DNA, 19 bp, Homo sapiens
ttcataagtattatgtctc

SEQ ID NO: 5536861 - DNA, 14 bp, Homo sapiens
ttcataataaaagg

SEQ ID NO: 5536862 - DNA, 18 bp, Homo sapiens
ttcataataaatagacac

SEQ ID NO: 5536863 - DNA, 13 bp, Homo sapiens
ttcataataaatt

SEQ ID NO: 5536864 - DNA, 15 bp, Homo sapiens
ttcataatcactcta

SEQ ID NO: 5536865 - DNA, 13 bp, Homo sapiens
ttcataatcagta

SEQ ID NO: 5536866 - DNA, 14 bp, Homo sapiens
ttcataatcagtaa

SEQ ID NO: 5536867 - DNA, 21 bp, Homo sapiens
ttcataatcagtaaatagtgt

SEQ ID NO: 5536868 - DNA, 14 bp, Homo sapiens
ttcataatctttgc

SEQ ID NO: 5536869 - DNA, 14 bp, Homo sapiens
ttcataatgaatta

SEQ ID NO: 5536870 - DNA, 19 bp, Homo sapiens
ttcataatgaattataaca

SEQ ID NO: 5536871 - DNA, 18 bp, Homo sapiens
ttcataattcatttaaga

SEQ ID NO: 5536872 - DNA, 23 bp, Homo sapiens
ttcataattcatttaagaacaag

SEQ ID NO: 5536873 - DNA, 16 bp, Homo sapiens
ttcataattctgaaac

SEQ ID NO: 5536874 - DNA, 23 bp, Homo sapiens
ttcataattttagtaatttccta

SEQ ID NO: 5536875 - DNA, 13 bp, Homo sapiens
ttcataattttca

SEQ ID NO: 5536876 - DNA, 22 bp, Homo sapiens
ttcatacaaaactgttcacgtt

SEQ ID NO: 5536877 - DNA, 18 bp, Homo sapiens
ttcatacactaaccaaat

SEQ ID NO: 5536878 - DNA, 22 bp, Homo sapiens
ttcatacatatatatatttgta

SEQ ID NO: 5536879 - DNA, 23 bp, Homo sapiens
ttcatacatatttttgtagcact

SEQ ID NO: 5536880 - DNA, 13 bp, Homo sapiens
ttcatacatttga

SEQ ID NO: 5536881 - DNA, 18 bp, Homo sapiens
ttcatacatttgacttct

SEQ ID NO: 5536882 - DNA, 17 bp, Homo sapiens
ttcataccccagaaatt

SEQ ID NO: 5536883 - DNA, 19 bp, Homo sapiens
ttcatacctaagtactgta

SEQ ID NO: 5536884 - DNA, 15 bp, Homo sapiens
ttcatacctcagaat

SEQ ID NO: 5536885 - DNA, 16 bp, Homo sapiens
ttcatacctgtgaata

SEQ ID NO: 5536886 - DNA, 20 bp, Homo sapiens
ttcatacgcatcccatctct

SEQ ID NO: 5536887 - DNA, 19 bp, Homo sapiens
ttcatactatttagatttt

SEQ ID NO: 5536888 - DNA, 16 bp, Homo sapiens
ttcatactccttttgg

SEQ ID NO: 5536889 - DNA, 17 bp, Homo sapiens
ttcatactccttttggc

SEQ ID NO: 5536890 - DNA, 17 bp, Homo sapiens
ttcatactctagatttt

SEQ ID NO: 5536891 - DNA, 19 bp, Homo sapiens
ttcatactctgttgcctcc

SEQ ID NO: 5536892 - DNA, 20 bp, Homo sapiens
ttcatactctgttgcctcct

SEQ ID NO: 5536893 - DNA, 22 bp, Homo sapiens
ttcatactgtaacattcaggaa

SEQ ID NO: 5536894 - DNA, 14 bp, Homo sapiens
ttcatactgtagaa

SEQ ID NO: 5536895 - DNA, 20 bp, Homo sapiens
ttcatacttttgatatgatt

SEQ ID NO: 5536896 - DNA, 15 bp, Homo sapiens
ttcatagaagtgttg

SEQ ID NO: 5536897 - DNA, 16 bp, Homo sapiens
ttcatagaagtgttga

SEQ ID NO: 5536898 - DNA, 18 bp, Homo sapiens
ttcatagagacttgggaa

SEQ ID NO: 5536899 - DNA, 19 bp, Homo sapiens
ttcatagagatttgtctaa

SEQ ID NO: 5536900 - DNA, 20 bp, Homo sapiens
ttcatagagttcccatgaac

SEQ ID NO: 5536901 - DNA, 19 bp, Homo sapiens
ttcatagatattttatatg

SEQ ID NO: 5536902 - DNA, 14 bp, Homo sapiens
ttcatagatttcct

SEQ ID NO: 5536903 - DNA, 17 bp, Homo sapiens
ttcatagccaaacagga

SEQ ID NO: 5536904 - DNA, 13 bp, Homo sapiens
ttcatagcccagt

SEQ ID NO: 5536905 - DNA, 20 bp, Homo sapiens
ttcatagctggttcctgcta

SEQ ID NO: 5536906 - DNA, 18 bp, Homo sapiens
ttcatagctgtacttctt

SEQ ID NO: 5536907 - DNA, 12 bp, Homo sapiens
ttcataggcaga

SEQ ID NO: 5536908 - DNA, 21 bp, Homo sapiens
ttcataggcggtcatgtgtgc

SEQ ID NO: 5536909 - DNA, 22 bp, Homo sapiens
ttcataggcggtcatgtgtgca

SEQ ID NO: 5536910 - DNA, 20 bp, Homo sapiens
ttcatagggaaaggttttgt

SEQ ID NO: 5536911 - DNA, 13 bp, Homo sapiens
ttcataggtctga

SEQ ID NO: 5536912 - DNA, 17 bp, Homo sapiens
ttcatagtaagattgat

SEQ ID NO: 5536913 - DNA, 19 bp, Homo sapiens
ttcatagtataactttaaa

SEQ ID NO: 5536914 - DNA, 13 bp, Homo sapiens
ttcatagttctgt

SEQ ID NO: 5536915 - DNA, 18 bp, Homo sapiens
ttcatagtttctgtaatt

SEQ ID NO: 5536916 - DNA, 15 bp, Homo sapiens
ttcatagttttctaa

SEQ ID NO: 5536917 - DNA, 14 bp, Homo sapiens
ttcatataaatgga

SEQ ID NO: 5536918 - DNA, 21 bp, Homo sapiens
ttcatataataaattaatttt

SEQ ID NO: 5536919 - DNA, 14 bp, Homo sapiens
ttcatataatttaa

SEQ ID NO: 5536920 - DNA, 14 bp, Homo sapiens
ttccaacttcctgt

SEQ ID NO: 5536921 - DNA, 16 bp, Homo sapiens
ttccaacttgaaggat

SEQ ID NO: 5536922 - DNA, 20 bp, Homo sapiens
ttccaacttgaaggattgca

SEQ ID NO: 5536923 - DNA, 22 bp, Homo sapiens
ttccaacttggctgcaggaatc

SEQ ID NO: 5536924 - DNA, 15 bp, Homo sapiens
ttccaagaaaatatc

SEQ ID NO: 5536925 - DNA, 21 bp, Homo sapiens
ttccaagaaagatccaccctc

SEQ ID NO: 5536926 - DNA, 16 bp, Homo sapiens
ttccaagacagagtct

SEQ ID NO: 5536927 - DNA, 21 bp, Homo sapiens
ttccaagacatgtctgttcta

SEQ ID NO: 5536928 - DNA, 22 bp, Homo sapiens
ttccaagaccatttgtagtgag

SEQ ID NO: 5536929 - DNA, 18 bp, Homo sapiens
ttccaagactccagccct

SEQ ID NO: 5536930 - DNA, 16 bp, Homo sapiens
ttccaagactctagag

SEQ ID NO: 5536931 - DNA, 19 bp, Homo sapiens
ttccaagactgaagactgc

SEQ ID NO: 5536932 - DNA, 12 bp, Homo sapiens
ttccaagagctg

SEQ ID NO: 5536933 - DNA, 12 bp, Homo sapiens
ttccaagagtct

SEQ ID NO: 5536934 - DNA, 13 bp, Homo sapiens
ttccaagagtcta

SEQ ID NO: 5536935 - DNA, 14 bp, Homo sapiens
ttccaagagtctaa

SEQ ID NO: 5536936 - DNA, 16 bp, Homo sapiens
ttccaagcaaatgtta

SEQ ID NO: 5536937 - DNA, 16 bp, Homo sapiens
ttccaagccctcagct

SEQ ID NO: 5536938 - DNA, 17 bp, Homo sapiens
ttccaagcccttttaca

SEQ ID NO: 5536939 - DNA, 14 bp, Homo sapiens
ttccaagcctgggc

SEQ ID NO: 5536940 - DNA, 15 bp, Homo sapiens
ttccaagcctgggcc

SEQ ID NO: 5536941 - DNA, 16 bp, Homo sapiens
ttccaagcctgggcca

SEQ ID NO: 5536942 - DNA, 20 bp, Homo sapiens
ttccaagcctgggccactgg

SEQ ID NO: 5536943 - DNA, 21 bp, Homo sapiens
ttccaagcctgggccactggc

SEQ ID NO: 5536944 - DNA, 19 bp, Homo sapiens
ttccaagctccaaatccaa

SEQ ID NO: 5536945 - DNA, 17 bp, Homo sapiens
ttccaaggaaatacata

SEQ ID NO: 5536946 - DNA, 14 bp, Homo sapiens
ttccaaggaagcag

SEQ ID NO: 5536947 - DNA, 19 bp, Homo sapiens
ttccaaggaagcagaagac

SEQ ID NO: 5536948 - DNA, 19 bp, Homo sapiens
ttccaaggagcagagaggt

SEQ ID NO: 5536949 - DNA, 13 bp, Homo sapiens
ttccaaggagctg

SEQ ID NO: 5536950 - DNA, 13 bp, Homo sapiens
ttccaaggccctg

SEQ ID NO: 5536951 - DNA, 20 bp, Homo sapiens
ttccaaggctactacagaga

SEQ ID NO: 5536952 - DNA, 13 bp, Homo sapiens
ttccaagggccca

SEQ ID NO: 5536953 - DNA, 21 bp, Homo sapiens
ttccaagggtatgggaagcca

SEQ ID NO: 5536954 - DNA, 22 bp, Homo sapiens
ttccaagggttgaattctggag

SEQ ID NO: 5536955 - DNA, 23 bp, Homo sapiens
ttccaaggtcactcttggtccct

SEQ ID NO: 5536956 - DNA, 22 bp, Homo sapiens
ttccaagtagaattgatttccc

SEQ ID NO: 5536957 - DNA, 19 bp, Homo sapiens
ttccaagtcaacactcttc

SEQ ID NO: 5536958 - DNA, 22 bp, Homo sapiens
ttccaagtcctttatctgcacc

SEQ ID NO: 5536959 - DNA, 15 bp, Homo sapiens
ttccaagtctccacc

SEQ ID NO: 5536960 - DNA, 16 bp, Homo sapiens
ttccaagtctttgcta

SEQ ID NO: 5536961 - DNA, 16 bp, Homo sapiens
ttccaagtgtatattt

SEQ ID NO: 5536962 - DNA, 18 bp, Homo sapiens
ttccaagtgtattttaaa

SEQ ID NO: 5536963 - DNA, 12 bp, Homo sapiens
ttccaagtgtgc

SEQ ID NO: 5536964 - DNA, 12 bp, Homo sapiens
ttccaagtgtgt

SEQ ID NO: 5536965 - DNA, 16 bp, Homo sapiens
ttccaagtgtgtgtgc

SEQ ID NO: 5536966 - DNA, 21 bp, Homo sapiens
ttccaagtgtgtgtgcaatgt

SEQ ID NO: 5536967 - DNA, 16 bp, Homo sapiens
ttccaagttgctaata

SEQ ID NO: 5536968 - DNA, 13 bp, Homo sapiens
ttccaataaacca

SEQ ID NO: 5536969 - DNA, 17 bp, Homo sapiens
ttccaataaagcagagt

SEQ ID NO: 5536970 - DNA, 20 bp, Homo sapiens
ttccaataccctagaagaaa

SEQ ID NO: 5536971 - DNA, 23 bp, Homo sapiens
ttccaataccctagaagaaaacc

SEQ ID NO: 5536972 - DNA, 18 bp, Homo sapiens
ttccaatagaaagaaact

SEQ ID NO: 5536973 - DNA, 21 bp, Homo sapiens
ttccaatagaacagtttactt

SEQ ID NO: 5536974 - DNA, 19 bp, Homo sapiens
ttccaatatttataattaa

SEQ ID NO: 5536975 - DNA, 16 bp, Homo sapiens
ttccaatcacagtgtt

SEQ ID NO: 5536976 - DNA, 15 bp, Homo sapiens
ttccaatcctggctc

SEQ ID NO: 5536977 - DNA, 23 bp, Homo sapiens
ttccaatcctggctctgtggctt

SEQ ID NO: 5536978 - DNA, 20 bp, Homo sapiens
ttccaatctctgttctgttt

SEQ ID NO: 5536979 - DNA, 16 bp, Homo sapiens
ttccaatcttgctttg

SEQ ID NO: 5536980 - DNA, 15 bp, Homo sapiens
ttccaatgctgtggg

SEQ ID NO: 5536981 - DNA, 15 bp, Homo sapiens
ttccaatgcttctgt

SEQ ID NO: 5536982 - DNA, 16 bp, Homo sapiens
ttccaatgtctggaga

SEQ ID NO: 5536983 - DNA, 13 bp, Homo sapiens
ttccaatgtgaaa

SEQ ID NO: 5536984 - DNA, 16 bp, Homo sapiens
ttccaatgtgcccagt

SEQ ID NO: 5536985 - DNA, 23 bp, Homo sapiens
ttccaatgtggtggcaataaatg

SEQ ID NO: 5536986 - DNA, 13 bp, Homo sapiens
ttccaatgtttta

SEQ ID NO: 5536987 - DNA, 21 bp, Homo sapiens
ttccaatgttttattggggaa

SEQ ID NO: 5536988 - DNA, 15 bp, Homo sapiens
ttccaattaaattta

SEQ ID NO: 5536989 - DNA, 19 bp, Homo sapiens
ttccaattctatcttttgt

SEQ ID NO: 5536990 - DNA, 18 bp, Homo sapiens
ttccaatttataatgaat

SEQ ID NO: 5536991 - DNA, 13 bp, Homo sapiens
ttccaatttcaaa

SEQ ID NO: 5536992 - DNA, 15 bp, Homo sapiens
ttccaatttcaaaat

SEQ ID NO: 5536993 - DNA, 14 bp, Homo sapiens
ttccaattttcctt

SEQ ID NO: 5536994 - DNA, 15 bp, Homo sapiens
ttccacaaaattaga

SEQ ID NO: 5536995 - DNA, 17 bp, Homo sapiens
ttccacaaaattagaaa

SEQ ID NO: 5536996 - DNA, 21 bp, Homo sapiens
ttccacaaaattatgctgcat

SEQ ID NO: 5536997 - DNA, 11 bp, Homo sapiens
ttccacaaacc

SEQ ID NO: 5536998 - DNA, 16 bp, Homo sapiens
ttccacaaagaaaatt

SEQ ID NO: 5536999 - DNA, 22 bp, Homo sapiens
ttccacaagagcccaggcctcc

SEQ ID NO: 5537000 - DNA, 14 bp, Homo sapiens
ttccacaattttgt

SEQ ID NO: 5537001 - DNA, 19 bp, Homo sapiens
ttccacaattttgtctcta

SEQ ID NO: 5537002 - DNA, 17 bp, Homo sapiens
ttccacacagaatgcaa

SEQ ID NO: 5537003 - DNA, 13 bp, Homo sapiens
ttccacacaggcc

SEQ ID NO: 5537004 - DNA, 16 bp, Homo sapiens
ttccacacaggcccat

SEQ ID NO: 5537005 - DNA, 13 bp, Homo sapiens
ttccacacatgca

SEQ ID NO: 5537006 - DNA, 14 bp, Homo sapiens
ttccacacatttaa

SEQ ID NO: 5537007 - DNA, 16 bp, Homo sapiens
ttccacacatttccct

SEQ ID NO: 5537008 - DNA, 21 bp, Homo sapiens
ttccacacatttccctatttt

SEQ ID NO: 5537009 - DNA, 20 bp, Homo sapiens
ttccacacccaatgctgctc

SEQ ID NO: 5537010 - DNA, 13 bp, Homo sapiens
ttccacaccccca

SEQ ID NO: 5537011 - DNA, 15 bp, Homo sapiens
ttccacaccttttat

SEQ ID NO: 5537012 - DNA, 22 bp, Homo sapiens
ttccacaccttttattgacaca

SEQ ID NO: 5537013 - DNA, 16 bp, Homo sapiens
ttccacacgcattaat

SEQ ID NO: 5537014 - DNA, 17 bp, Homo sapiens
ttccacactatgtgtgt

SEQ ID NO: 5537015 - DNA, 19 bp, Homo sapiens
ttccacactgcagggagga

SEQ ID NO: 5537016 - DNA, 19 bp, Homo sapiens
ttccacactgtcagagctg

SEQ ID NO: 5537017 - DNA, 14 bp, Homo sapiens
ttccacactgttga

SEQ ID NO: 5537018 - DNA, 12 bp, Homo sapiens
ttccacacttct

SEQ ID NO: 5537019 - DNA, 16 bp, Homo sapiens
ttccacacttctgggc

SEQ ID NO: 5537020 - DNA, 22 bp, Homo sapiens
ttccacagagggaagtttaaaa

SEQ ID NO: 5537021 - DNA, 23 bp, Homo sapiens
ttccacagcacaaacacacctct

SEQ ID NO: 5537022 - DNA, 13 bp, Homo sapiens
ttccacagcagtg

SEQ ID NO: 5537023 - DNA, 21 bp, Homo sapiens
ttccacagcctgcaagtcagt

SEQ ID NO: 5537024 - DNA, 14 bp, Homo sapiens
ttccacagctgccc

SEQ ID NO: 5537025 - DNA, 13 bp, Homo sapiens
ttccacagctggc

SEQ ID NO: 5537026 - DNA, 21 bp, Homo sapiens
ttccacaggacacgaaggctg

SEQ ID NO: 5537027 - DNA, 22 bp, Homo sapiens
ttccacaggacgaatgcatatt

SEQ ID NO: 5537028 - DNA, 14 bp, Homo sapiens
ttccacagggacca

SEQ ID NO: 5537029 - DNA, 17 bp, Homo sapiens
ttccacagggtcccaca

SEQ ID NO: 5537030 - DNA, 20 bp, Homo sapiens
ttccacagtgactgggccct

SEQ ID NO: 5537031 - DNA, 21 bp, Homo sapiens
ttccacagttgccaccacctc

SEQ ID NO: 5537032 - DNA, 22 bp, Homo sapiens
ttccacataaattttaattcaa

SEQ ID NO: 5537033 - DNA, 15 bp, Homo sapiens
ttccacatcatgtta

SEQ ID NO: 5537034 - DNA, 13 bp, Homo sapiens
ttccacatcccca

SEQ ID NO: 5537035 - DNA, 15 bp, Homo sapiens
ttccacatgctctga

SEQ ID NO: 5537036 - DNA, 13 bp, Homo sapiens
ttccacatgtgcc

SEQ ID NO: 5537037 - DNA, 13 bp, Homo sapiens
ttccacatttgtc

SEQ ID NO: 5537038 - DNA, 13 bp, Homo sapiens
ttccaccaaattc

SEQ ID NO: 5537039 - DNA, 22 bp, Homo sapiens
ttccaccagagcaggggctgct

SEQ ID NO: 5537040 - DNA, 11 bp, Homo sapiens
ttccaccagcc

SEQ ID NO: 5537041 - DNA, 14 bp, Homo sapiens
ttccaccaggccgt

SEQ ID NO: 5537042 - DNA, 15 bp, Homo sapiens
ttccaccaggccgtg

SEQ ID NO: 5537043 - DNA, 14 bp, Homo sapiens
ttccaccagggcca

SEQ ID NO: 5537044 - DNA, 15 bp, Homo sapiens
ttccaccagggccag

SEQ ID NO: 5537045 - DNA, 17 bp, Homo sapiens
ttccaccagggccagag

SEQ ID NO: 5537046 - DNA, 21 bp, Homo sapiens
ttccaccagggccagagcagc

SEQ ID NO: 5537047 - DNA, 19 bp, Homo sapiens
ttccaccataccttagaga

SEQ ID NO: 5537048 - DNA, 18 bp, Homo sapiens
ttccaccatcaagccacc

SEQ ID NO: 5537049 - DNA, 17 bp, Homo sapiens
ttccaccattgctggaa

SEQ ID NO: 5537050 - DNA, 20 bp, Homo sapiens
ttccacccacaaactccagg

SEQ ID NO: 5537051 - DNA, 14 bp, Homo sapiens
ttccacccattccc

SEQ ID NO: 5537052 - DNA, 18 bp, Homo sapiens
ttccaccccaagagaact

SEQ ID NO: 5537053 - DNA, 19 bp, Homo sapiens
ttccaccccaagagaactc

SEQ ID NO: 5537054 - DNA, 14 bp, Homo sapiens
ttccaccccctccc

SEQ ID NO: 5537055 - DNA, 18 bp, Homo sapiens
ttccaccccctccctggc

SEQ ID NO: 5537056 - DNA, 23 bp, Homo sapiens
ttccaccccctggtgcctgcagg

SEQ ID NO: 5537057 - DNA, 16 bp, Homo sapiens
ttccacccctcctcga

SEQ ID NO: 5537058 - DNA, 18 bp, Homo sapiens
ttccacccctccttccct

SEQ ID NO: 5537059 - DNA, 20 bp, Homo sapiens
ttccaccctgccctggccta

SEQ ID NO: 5537060 - DNA, 21 bp, Homo sapiens
ttccaccctgccctggcctac

SEQ ID NO: 5537061 - DNA, 18 bp, Homo sapiens
ttccacctcacaactcct

SEQ ID NO: 5537062 - DNA, 13 bp, Homo sapiens
ttccacctcaccc

SEQ ID NO: 5537063 - DNA, 15 bp, Homo sapiens
ttccacctcacccca

SEQ ID NO: 5537064 - DNA, 14 bp, Homo sapiens
ttccacctcagcct

SEQ ID NO: 5537065 - DNA, 12 bp, Homo sapiens
ttccacctccct

SEQ ID NO: 5537066 - DNA, 14 bp, Homo sapiens
ttccacctccctcc

SEQ ID NO: 5537067 - DNA, 14 bp, Homo sapiens
ttccacctgccaca

SEQ ID NO: 5537068 - DNA, 15 bp, Homo sapiens
ttccacctgctctgc

SEQ ID NO: 5537069 - DNA, 20 bp, Homo sapiens
ttccacctgctttctcctgg

SEQ ID NO: 5537070 - DNA, 17 bp, Homo sapiens
ttccacctggaaactgc

SEQ ID NO: 5537071 - DNA, 14 bp, Homo sapiens
ttccacctggaaag

SEQ ID NO: 5537072 - DNA, 19 bp, Homo sapiens
ttccacctggaaagccagg

SEQ ID NO: 5537073 - DNA, 20 bp, Homo sapiens
ttccacctggaaagccaggt

SEQ ID NO: 5537074 - DNA, 13 bp, Homo sapiens
ttccacctggaag

SEQ ID NO: 5537075 - DNA, 21 bp, Homo sapiens
ttccacctgtgccctcaccac

SEQ ID NO: 5537076 - DNA, 12 bp, Homo sapiens
ttccaccttggc

SEQ ID NO: 5537077 - DNA, 19 bp, Homo sapiens
ttccacgctgtctccagac

SEQ ID NO: 5537078 - DNA, 24 bp, Homo sapiens
ttccacggcatcgcatccgtcctg

SEQ ID NO: 5537079 - DNA, 23 bp, Homo sapiens
ttccacgggtctcacttatacca

SEQ ID NO: 5537080 - DNA, 17 bp, Homo sapiens
ttccacgtaagtcactg

SEQ ID NO: 5537081 - DNA, 22 bp, Homo sapiens
ttccacgtgccccttgtcgcgc

SEQ ID NO: 5537082 - DNA, 12 bp, Homo sapiens
ttccactaaccc

SEQ ID NO: 5537083 - DNA, 19 bp, Homo sapiens
ttccactacacctggctga

SEQ ID NO: 5537084 - DNA, 18 bp, Homo sapiens
ttccactaccaaaagaca

SEQ ID NO: 5537085 - DNA, 21 bp, Homo sapiens
ttccactaccaaaagacatta

SEQ ID NO: 5537086 - DNA, 15 bp, Homo sapiens
ttccactactgtgta

SEQ ID NO: 5537087 - DNA, 16 bp, Homo sapiens
ttccactactgtgtag

SEQ ID NO: 5537088 - DNA, 22 bp, Homo sapiens
ttccactataattttacaaagt

SEQ ID NO: 5537089 - DNA, 21 bp, Homo sapiens
ttccactatcccaatcaaaga

SEQ ID NO: 5537090 - DNA, 16 bp, Homo sapiens
ttccactcaaaatatg

SEQ ID NO: 5537091 - DNA, 17 bp, Homo sapiens
ttccactcaaatgtcct

SEQ ID NO: 5537092 - DNA, 12 bp, Homo sapiens
ttccactccact

SEQ ID NO: 5537093 - DNA, 15 bp, Homo sapiens
ttccactcccactgc

SEQ ID NO: 5537094 - DNA, 20 bp, Homo sapiens
ttccactcctatggaaaagg

SEQ ID NO: 5537095 - DNA, 16 bp, Homo sapiens
ttccactccttccaga

SEQ ID NO: 5537096 - DNA, 20 bp, Homo sapiens
ttccactcgatgatgcttct

SEQ ID NO: 5537097 - DNA, 18 bp, Homo sapiens
ttccactctgatagaatt

SEQ ID NO: 5537098 - DNA, 19 bp, Homo sapiens
ttccactctggattcagcc

SEQ ID NO: 5537099 - DNA, 21 bp, Homo sapiens
ttcccaggcctttggagggga

SEQ ID NO: 5537100 - DNA, 14 bp, Homo sapiens
ttcccaggctgccc

SEQ ID NO: 5537101 - DNA, 14 bp, Homo sapiens
ttcccagggaagtg

SEQ ID NO: 5537102 - DNA, 10 bp, Homo sapiens
ttcccagggt

SEQ ID NO: 5537103 - DNA, 19 bp, Homo sapiens
ttcccaggtaatttaaatt

SEQ ID NO: 5537104 - DNA, 12 bp, Homo sapiens
ttcccagtattt

SEQ ID NO: 5537105 - DNA, 14 bp, Homo sapiens
ttcccagtggctgc

SEQ ID NO: 5537106 - DNA, 15 bp, Homo sapiens
ttcccagtggctgct

SEQ ID NO: 5537107 - DNA, 18 bp, Homo sapiens
ttcccagtggctgctgcc

SEQ ID NO: 5537108 - DNA, 21 bp, Homo sapiens
ttcccagtggctgctgcccag

SEQ ID NO: 5537109 - DNA, 15 bp, Homo sapiens
ttcccagtgggctgt

SEQ ID NO: 5537110 - DNA, 16 bp, Homo sapiens
ttcccagttaaagatt

SEQ ID NO: 5537111 - DNA, 15 bp, Homo sapiens
ttcccagttggagct

SEQ ID NO: 5537112 - DNA, 16 bp, Homo sapiens
ttcccagttggagctc

SEQ ID NO: 5537113 - DNA, 23 bp, Homo sapiens
ttcccataacataaaagtgctac

SEQ ID NO: 5537114 - DNA, 15 bp, Homo sapiens
ttcccataattttct

SEQ ID NO: 5537115 - DNA, 18 bp, Homo sapiens
ttcccataattttcttca

SEQ ID NO: 5537116 - DNA, 14 bp, Homo sapiens
ttcccatcacccct

SEQ ID NO: 5537117 - DNA, 18 bp, Homo sapiens
ttcccatcaccccttccc

SEQ ID NO: 5537118 - DNA, 17 bp, Homo sapiens
ttcccatcaccggagga

SEQ ID NO: 5537119 - DNA, 17 bp, Homo sapiens
ttcccatcactgctgtc

SEQ ID NO: 5537120 - DNA, 13 bp, Homo sapiens
ttcccatccccag

SEQ ID NO: 5537121 - DNA, 15 bp, Homo sapiens
ttcccatccccagcg

SEQ ID NO: 5537122 - DNA, 17 bp, Homo sapiens
ttcccatccccagcgat

SEQ ID NO: 5537123 - DNA, 13 bp, Homo sapiens
ttcccatccctga

SEQ ID NO: 5537124 - DNA, 22 bp, Homo sapiens
ttcccatccctgaaacattgca

SEQ ID NO: 5537125 - DNA, 13 bp, Homo sapiens
ttcccatcctacc

SEQ ID NO: 5537126 - DNA, 14 bp, Homo sapiens
ttcccatcgctgtc

SEQ ID NO: 5537127 - DNA, 15 bp, Homo sapiens
ttcccatcgctgtca

SEQ ID NO: 5537128 - DNA, 11 bp, Homo sapiens
ttcccatctgc

SEQ ID NO: 5537129 - DNA, 14 bp, Homo sapiens
ttcccatctgcacc

SEQ ID NO: 5537130 - DNA, 20 bp, Homo sapiens
ttcccatctgctttattgcc

SEQ ID NO: 5537131 - DNA, 18 bp, Homo sapiens
ttcccatgacccaggctg

SEQ ID NO: 5537132 - DNA, 16 bp, Homo sapiens
ttcccatgactcttgg

SEQ ID NO: 5537133 - DNA, 22 bp, Homo sapiens
ttcccatgccggtacacagcca

SEQ ID NO: 5537134 - DNA, 19 bp, Homo sapiens
ttcccatgcctgtctctgt

SEQ ID NO: 5537135 - DNA, 17 bp, Homo sapiens
ttcccatggtggcctca

SEQ ID NO: 5537136 - DNA, 19 bp, Homo sapiens
ttcccatggtggcctcaag

SEQ ID NO: 5537137 - DNA, 20 bp, Homo sapiens
ttcccatggtgtatgtggtt

SEQ ID NO: 5537138 - DNA, 22 bp, Homo sapiens
ttcccatgtgtgactccagcct

SEQ ID NO: 5537139 - DNA, 23 bp, Homo sapiens
ttcccattactttaatactcacc

SEQ ID NO: 5537140 - DNA, 17 bp, Homo sapiens
ttcccattggtctgcat

SEQ ID NO: 5537141 - DNA, 15 bp, Homo sapiens
ttcccatttatctaa

SEQ ID NO: 5537142 - DNA, 15 bp, Homo sapiens
ttcccatttcagctg

SEQ ID NO: 5537143 - DNA, 22 bp, Homo sapiens
ttcccatttcgtgtaatattct

SEQ ID NO: 5537144 - DNA, 15 bp, Homo sapiens
ttcccatttcttccc

SEQ ID NO: 5537145 - DNA, 14 bp, Homo sapiens
ttcccatttgtaat

SEQ ID NO: 5537146 - DNA, 20 bp, Homo sapiens
ttcccatttgtaatgtatct

SEQ ID NO: 5537147 - DNA, 22 bp, Homo sapiens
ttcccatttgttgctgctgctg

SEQ ID NO: 5537148 - DNA, 14 bp, Homo sapiens
ttcccattttaaat

SEQ ID NO: 5537149 - DNA, 15 bp, Homo sapiens
ttccccaaaaattga

SEQ ID NO: 5537150 - DNA, 21 bp, Homo sapiens
ttccccaaaggatggtcacac

SEQ ID NO: 5537151 - DNA, 13 bp, Homo sapiens
ttccccaacagtg

SEQ ID NO: 5537152 - DNA, 19 bp, Homo sapiens
ttccccaacagtgtgaagt

SEQ ID NO: 5537153 - DNA, 20 bp, Homo sapiens
ttccccaacagtgtgaagtt

SEQ ID NO: 5537154 - DNA, 19 bp, Homo sapiens
ttccccaacggggtgggga

SEQ ID NO: 5537155 - DNA, 22 bp, Homo sapiens
ttccccaacggggtggggaggg

SEQ ID NO: 5537156 - DNA, 14 bp, Homo sapiens
ttccccaagagaaa

SEQ ID NO: 5537157 - DNA, 19 bp, Homo sapiens
ttccccaagatctgccaga

SEQ ID NO: 5537158 - DNA, 19 bp, Homo sapiens
ttccccaagcctggcaggg

SEQ ID NO: 5537159 - DNA, 16 bp, Homo sapiens
ttccccaaggacccag

SEQ ID NO: 5537160 - DNA, 18 bp, Homo sapiens
ttccccaaggcactgagc

SEQ ID NO: 5537161 - DNA, 15 bp, Homo sapiens
ttccccaataaagcc

SEQ ID NO: 5537162 - DNA, 16 bp, Homo sapiens
ttccccaataaagcct

SEQ ID NO: 5537163 - DNA, 23 bp, Homo sapiens
ttccccaattacagggtgactca

SEQ ID NO: 5537164 - DNA, 15 bp, Homo sapiens
ttccccacacagggc

SEQ ID NO: 5537165 - DNA, 13 bp, Homo sapiens
ttccccacagaac

SEQ ID NO: 5537166 - DNA, 23 bp, Homo sapiens
ttccccacaggtcctccatcacc

SEQ ID NO: 5537167 - DNA, 21 bp, Homo sapiens
ttccccaccagtgaatgaaag

SEQ ID NO: 5537168 - DNA, 22 bp, Homo sapiens
ttccccaccccagctcatgccc

SEQ ID NO: 5537169 - DNA, 14 bp, Homo sapiens
ttccccaccccttc

SEQ ID NO: 5537170 - DNA, 19 bp, Homo sapiens
ttccccacctcttccttcc

SEQ ID NO: 5537171 - DNA, 17 bp, Homo sapiens
ttccccactcagccttt

SEQ ID NO: 5537172 - DNA, 15 bp, Homo sapiens
ttccccactctgctc

SEQ ID NO: 5537173 - DNA, 17 bp, Homo sapiens
ttccccactgacagcct

SEQ ID NO: 5537174 - DNA, 22 bp, Homo sapiens
ttccccacttctgtgccacccc

SEQ ID NO: 5537175 - DNA, 15 bp, Homo sapiens
ttccccagacccaga

SEQ ID NO: 5537176 - DNA, 20 bp, Homo sapiens
ttccccagacccagaggtcc

SEQ ID NO: 5537177 - DNA, 22 bp, Homo sapiens
ttccccagacttctctttctta

SEQ ID NO: 5537178 - DNA, 13 bp, Homo sapiens
ttccccagacttg

SEQ ID NO: 5537179 - DNA, 11 bp, Homo sapiens
ttccccagaga

SEQ ID NO: 5537180 - DNA, 12 bp, Homo sapiens
ttccccagagag

SEQ ID NO: 5537181 - DNA, 20 bp, Homo sapiens
ttccccagaggctcccaatc

SEQ ID NO: 5537182 - DNA, 24 bp, Homo sapiens
ttccccagaggctcccaatcagct

SEQ ID NO: 5537183 - DNA, 22 bp, Homo sapiens
ttccccagcagggtcttttcat

SEQ ID NO: 5537184 - DNA, 20 bp, Homo sapiens
ttccccagcatcactcccca

SEQ ID NO: 5537185 - DNA, 22 bp, Homo sapiens
ttccccagcatgcaccacgggc

SEQ ID NO: 5537186 - DNA, 12 bp, Homo sapiens
ttccccagccac

SEQ ID NO: 5537187 - DNA, 14 bp, Homo sapiens
ttccccagcccagg

SEQ ID NO: 5537188 - DNA, 23 bp, Homo sapiens
ttccccagccctccccacctgct

SEQ ID NO: 5537189 - DNA, 19 bp, Homo sapiens
ttccccagcctctcctcct

SEQ ID NO: 5537190 - DNA, 14 bp, Homo sapiens
ttccccagctcccc

SEQ ID NO: 5537191 - DNA, 15 bp, Homo sapiens
ttccccaggaggcca

SEQ ID NO: 5537192 - DNA, 16 bp, Homo sapiens
ttccccaggaggccag

SEQ ID NO: 5537193 - DNA, 20 bp, Homo sapiens
ttccccaggaggccagcctt

SEQ ID NO: 5537194 - DNA, 15 bp, Homo sapiens
ttccccaggcccacc

SEQ ID NO: 5537195 - DNA, 17 bp, Homo sapiens
ttccccagggaaggaaa

SEQ ID NO: 5537196 - DNA, 18 bp, Homo sapiens
ttccccaggggaaaatga

SEQ ID NO: 5537197 - DNA, 17 bp, Homo sapiens
ttccccagtgactccag

SEQ ID NO: 5537198 - DNA, 21 bp, Homo sapiens
ttccccataatacccttttcc

SEQ ID NO: 5537199 - DNA, 20 bp, Homo sapiens
ttccccatatttgtgttcag

SEQ ID NO: 5537200 - DNA, 21 bp, Homo sapiens
ttccccatcgccttctgggga

SEQ ID NO: 5537201 - DNA, 18 bp, Homo sapiens
ttccccatctccatttca

SEQ ID NO: 5537202 - DNA, 22 bp, Homo sapiens
ttccccatctctgtctggggct

SEQ ID NO: 5537203 - DNA, 17 bp, Homo sapiens
ttccccatctttgatcc

SEQ ID NO: 5537204 - DNA, 23 bp, Homo sapiens
ttccccatctttgatccttctga

SEQ ID NO: 5537205 - DNA, 20 bp, Homo sapiens
ttccccatgaaccctgccct

SEQ ID NO: 5537206 - DNA, 17 bp, Homo sapiens
ttccccatggggctgcg

SEQ ID NO: 5537207 - DNA, 17 bp, Homo sapiens
ttccccattcagtgaca

SEQ ID NO: 5537208 - DNA, 19 bp, Homo sapiens
ttccccattgccttctggg

SEQ ID NO: 5537209 - DNA, 20 bp, Homo sapiens
ttccccatttgtttgtgctt

SEQ ID NO: 5537210 - DNA, 19 bp, Homo sapiens
ttcccccaaaggcatccca

SEQ ID NO: 5537211 - DNA, 23 bp, Homo sapiens
ttcccccaagcagaagaccagat

SEQ ID NO: 5537212 - DNA, 21 bp, Homo sapiens
ttcccccaaggctgatgcatt

SEQ ID NO: 5537213 - DNA, 15 bp, Homo sapiens
ttcccccaccagctg

SEQ ID NO: 5537214 - DNA, 19 bp, Homo sapiens
ttcccccaccagctgcagc

SEQ ID NO: 5537215 - DNA, 11 bp, Homo sapiens
ttcccccaccc

SEQ ID NO: 5537216 - DNA, 21 bp, Homo sapiens
ttcccccacccctaacctggc

SEQ ID NO: 5537217 - DNA, 15 bp, Homo sapiens
ttcccccacctgcag

SEQ ID NO: 5537218 - DNA, 18 bp, Homo sapiens
ttcccccactactgcagc

SEQ ID NO: 5537219 - DNA, 15 bp, Homo sapiens
ttcccccactgatca

SEQ ID NO: 5537220 - DNA, 12 bp, Homo sapiens
ttcccccagccc

SEQ ID NO: 5537221 - DNA, 16 bp, Homo sapiens
ttcccccaggcgcctg

SEQ ID NO: 5537222 - DNA, 14 bp, Homo sapiens
ttcccccatagcca

SEQ ID NO: 5537223 - DNA, 18 bp, Homo sapiens
ttcccccatagccacccc

SEQ ID NO: 5537224 - DNA, 21 bp, Homo sapiens
ttcccccatcccctttcctcc

SEQ ID NO: 5537225 - DNA, 15 bp, Homo sapiens
ttcccccatccctac

SEQ ID NO: 5537226 - DNA, 17 bp, Homo sapiens
ttcccccatccctacca

SEQ ID NO: 5537227 - DNA, 13 bp, Homo sapiens
ttccccccaaggg

SEQ ID NO: 5537228 - DNA, 21 bp, Homo sapiens
ttccccccactctccccacac

SEQ ID NO: 5537229 - DNA, 20 bp, Homo sapiens
ttccccccattttgcctctg

SEQ ID NO: 5537230 - DNA, 21 bp, Homo sapiens
ttccccccattttgcctctgt

SEQ ID NO: 5537231 - DNA, 16 bp, Homo sapiens
ttcccccccctttcct

SEQ ID NO: 5537232 - DNA, 18 bp, Homo sapiens
ttcccccccctttcctaa

SEQ ID NO: 5537233 - DNA, 19 bp, Homo sapiens
ttcccccctctcctcccag

SEQ ID NO: 5537234 - DNA, 21 bp, Homo sapiens
ttcccccctctcctcccagct

SEQ ID NO: 5537235 - DNA, 19 bp, Homo sapiens
ttcccccgagctcttggcc

SEQ ID NO: 5537236 - DNA, 21 bp, Homo sapiens
ttcccccgagctcttggcctt

SEQ ID NO: 5537237 - DNA, 13 bp, Homo sapiens
ttcccccgccgct

SEQ ID NO: 5537238 - DNA, 23 bp, Homo sapiens
ttcccccgccgcttttctcctct

SEQ ID NO: 5537239 - DNA, 14 bp, Homo sapiens
ttccccctccatgt

SEQ ID NO: 5537240 - DNA, 17 bp, Homo sapiens
ttccccctctcccagtt

SEQ ID NO: 5537241 - DNA, 15 bp, Homo sapiens
ttccccctgccctgt

SEQ ID NO: 5537242 - DNA, 17 bp, Homo sapiens
ttcccccttcccctgcg

SEQ ID NO: 5537243 - DNA, 13 bp, Homo sapiens
ttcccccttcccg

SEQ ID NO: 5537244 - DNA, 18 bp, Homo sapiens
ttccccctttctctgcct

SEQ ID NO: 5537245 - DNA, 19 bp, Homo sapiens
ttccccctttctctgcctg

SEQ ID NO: 5537246 - DNA, 16 bp, Homo sapiens
ttccccctttcttcct

SEQ ID NO: 5537247 - DNA, 18 bp, Homo sapiens
ttccccgcaacccacagc

SEQ ID NO: 5537248 - DNA, 22 bp, Homo sapiens
ttccccgcctgcagtcttctgg

SEQ ID NO: 5537249 - DNA, 16 bp, Homo sapiens
ttccccgctgcccaat

SEQ ID NO: 5537250 - DNA, 20 bp, Homo sapiens
ttccccggagctgggaaggt

SEQ ID NO: 5537251 - DNA, 16 bp, Homo sapiens
ttccccgggggaggaa

SEQ ID NO: 5537252 - DNA, 22 bp, Homo sapiens
ttccccgtcccctgcagcctgg

SEQ ID NO: 5537253 - DNA, 20 bp, Homo sapiens
ttcccctaatcttttctgaa

SEQ ID NO: 5537254 - DNA, 13 bp, Homo sapiens
ttcccctacagaa

SEQ ID NO: 5537255 - DNA, 22 bp, Homo sapiens
ttcccctagtaagtgccttcca

SEQ ID NO: 5537256 - DNA, 22 bp, Homo sapiens
ttcccctcagaaaaaaattcat

SEQ ID NO: 5537257 - DNA, 20 bp, Homo sapiens
ttcccctcagaacaccctgt

SEQ ID NO: 5537258 - DNA, 16 bp, Homo sapiens
ttcccctcagagctct

SEQ ID NO: 5537259 - DNA, 14 bp, Homo sapiens
ttcccctcccacct

SEQ ID NO: 5537260 - DNA, 21 bp, Homo sapiens
ttcccctcccagccctgaggg

SEQ ID NO: 5537261 - DNA, 12 bp, Homo sapiens
ttcccctcccct

SEQ ID NO: 5537262 - DNA, 21 bp, Homo sapiens
ttcccctcccgacagcccatc

SEQ ID NO: 5537263 - DNA, 14 bp, Homo sapiens
ttcccctccctacc

SEQ ID NO: 5537264 - DNA, 16 bp, Homo sapiens
ttcccctccctggctc

SEQ ID NO: 5537265 - DNA, 14 bp, Homo sapiens
ttcccctccctggg

SEQ ID NO: 5537266 - DNA, 13 bp, Homo sapiens
ttcccctcctacc

SEQ ID NO: 5537267 - DNA, 17 bp, Homo sapiens
ttcccctcctacccctc

SEQ ID NO: 5537268 - DNA, 22 bp, Homo sapiens
ttcccctcctacccctcccagc

SEQ ID NO: 5537269 - DNA, 17 bp, Homo sapiens
ttcccctcctttgtctt

SEQ ID NO: 5537270 - DNA, 12 bp, Homo sapiens
ttcccctctccc

SEQ ID NO: 5537271 - DNA, 13 bp, Homo sapiens
ttcccctctctgc

SEQ ID NO: 5537272 - DNA, 18 bp, Homo sapiens
ttcccctctctgcccctg

SEQ ID NO: 5537273 - DNA, 15 bp, Homo sapiens
ttcccctctggaggg

SEQ ID NO: 5537274 - DNA, 19 bp, Homo sapiens
ttcccctcttcccttcaac

SEQ ID NO: 5537275 - DNA, 12 bp, Homo sapiens
ttcccctgcctc

SEQ ID NO: 5537276 - DNA, 16 bp, Homo sapiens
ttcccctgcgccctcc

SEQ ID NO: 5537277 - DNA, 20 bp, Homo sapiens
ttccgtctccctaaaataaa

SEQ ID NO: 5537278 - DNA, 23 bp, Homo sapiens
ttccgtctccctaaaataaaaac

SEQ ID NO: 5537279 - DNA, 16 bp, Homo sapiens
ttccgtgaactctggt

SEQ ID NO: 5537280 - DNA, 18 bp, Homo sapiens
ttccgtgacgtcactgga

SEQ ID NO: 5537281 - DNA, 19 bp, Homo sapiens
ttccgtgggtcatcccagc

SEQ ID NO: 5537282 - DNA, 20 bp, Homo sapiens
ttccgtggtcagagtgccac

SEQ ID NO: 5537283 - DNA, 17 bp, Homo sapiens
ttccgtgtccaccccca

SEQ ID NO: 5537284 - DNA, 21 bp, Homo sapiens
ttccgtgtgattgtctttgaa

SEQ ID NO: 5537285 - DNA, 14 bp, Homo sapiens
ttccgttaaaatac

SEQ ID NO: 5537286 - DNA, 18 bp, Homo sapiens
ttccgttcatctgaggag

SEQ ID NO: 5537287 - DNA, 19 bp, Homo sapiens
ttccgttcatctgaggagt

SEQ ID NO: 5537288 - DNA, 16 bp, Homo sapiens
ttccgttggaaagaac

SEQ ID NO: 5537289 - DNA, 19 bp, Homo sapiens
ttccgttggaaagaacatt

SEQ ID NO: 5537290 - DNA, 21 bp, Homo sapiens
ttccgttggaaagaacattta

SEQ ID NO: 5537291 - DNA, 17 bp, Homo sapiens
ttccgttgtacatgttc

SEQ ID NO: 5537292 - DNA, 17 bp, Homo sapiens
ttccgtttgcttttgtt

SEQ ID NO: 5537293 - DNA, 23 bp, Homo sapiens
ttccgtttttttttttttattgt

SEQ ID NO: 5537294 - DNA, 18 bp, Homo sapiens
ttcctaaatataaatgaa

SEQ ID NO: 5537295 - DNA, 20 bp, Homo sapiens
ttcctaaatatattttaaga

SEQ ID NO: 5537296 - DNA, 21 bp, Homo sapiens
ttcctaaatatattttaagac

SEQ ID NO: 5537297 - DNA, 23 bp, Homo sapiens
ttcctaaatatccaaagactgta

SEQ ID NO: 5537298 - DNA, 20 bp, Homo sapiens
ttcctaaattttcctgtcct

SEQ ID NO: 5537299 - DNA, 18 bp, Homo sapiens
ttcctaacacagcatgtg

SEQ ID NO: 5537300 - DNA, 15 bp, Homo sapiens
ttcctaacaggatga

SEQ ID NO: 5537301 - DNA, 20 bp, Homo sapiens
ttcctaacatgcaccttgct

SEQ ID NO: 5537302 - DNA, 16 bp, Homo sapiens
ttcctaacctgtcaga

SEQ ID NO: 5537303 - DNA, 13 bp, Homo sapiens
ttcctaactagaa

SEQ ID NO: 5537304 - DNA, 21 bp, Homo sapiens
ttcctaactagaattagtatg

SEQ ID NO: 5537305 - DNA, 22 bp, Homo sapiens
ttcctaacttttcaatgacatt

SEQ ID NO: 5537306 - DNA, 18 bp, Homo sapiens
ttcctaagaagcttctaa

SEQ ID NO: 5537307 - DNA, 21 bp, Homo sapiens
ttcctaagacatttttcattc

SEQ ID NO: 5537308 - DNA, 19 bp, Homo sapiens
ttcctaagagtggaggagg

SEQ ID NO: 5537309 - DNA, 12 bp, Homo sapiens
ttcctaaggcat

SEQ ID NO: 5537310 - DNA, 15 bp, Homo sapiens
ttcctaaggcatgtg

SEQ ID NO: 5537311 - DNA, 16 bp, Homo sapiens
ttcctaaggcccagct

SEQ ID NO: 5537312 - DNA, 18 bp, Homo sapiens
ttcctaaggcccagctgc

SEQ ID NO: 5537313 - DNA, 18 bp, Homo sapiens
ttcctaagttcttagata

SEQ ID NO: 5537314 - DNA, 14 bp, Homo sapiens
ttcctaagtttctt

SEQ ID NO: 5537315 - DNA, 21 bp, Homo sapiens
ttcctaagtttttttcatttt

SEQ ID NO: 5537316 - DNA, 15 bp, Homo sapiens
ttcctaataaagttc

SEQ ID NO: 5537317 - DNA, 16 bp, Homo sapiens
ttcctaataaagttct

SEQ ID NO: 5537318 - DNA, 19 bp, Homo sapiens
ttcctaatatcaaatgcag

SEQ ID NO: 5537319 - DNA, 23 bp, Homo sapiens
ttcctaatcaaattctgtctggg

SEQ ID NO: 5537320 - DNA, 23 bp, Homo sapiens
ttcctaatcagaaatttttatca

SEQ ID NO: 5537321 - DNA, 15 bp, Homo sapiens
ttcctaatgcattag

SEQ ID NO: 5537322 - DNA, 13 bp, Homo sapiens
ttcctaatggatt

SEQ ID NO: 5537323 - DNA, 19 bp, Homo sapiens
ttcctaatggtctcatctc

SEQ ID NO: 5537324 - DNA, 22 bp, Homo sapiens
ttcctaatggtctcatctcctt

SEQ ID NO: 5537325 - DNA, 17 bp, Homo sapiens
ttcctaattaaaataag

SEQ ID NO: 5537326 - DNA, 21 bp, Homo sapiens
ttcctaattaaaataagaatt

SEQ ID NO: 5537327 - DNA, 18 bp, Homo sapiens
ttcctaattccacagctg

SEQ ID NO: 5537328 - DNA, 15 bp, Homo sapiens
ttcctaattcctgta

SEQ ID NO: 5537329 - DNA, 18 bp, Homo sapiens
ttcctaatttcccttctt

SEQ ID NO: 5537330 - DNA, 23 bp, Homo sapiens
ttcctaattttagtgacagctct

SEQ ID NO: 5537331 - DNA, 14 bp, Homo sapiens
ttcctacaaagacg

SEQ ID NO: 5537332 - DNA, 15 bp, Homo sapiens
ttcctacaacgaaat

SEQ ID NO: 5537333 - DNA, 23 bp, Homo sapiens
ttcctacaactaaaaataaatta

SEQ ID NO: 5537334 - DNA, 13 bp, Homo sapiens
ttcctacaactta

SEQ ID NO: 5537335 - DNA, 22 bp, Homo sapiens
ttcctacaagagcagcctgtgg

SEQ ID NO: 5537336 - DNA, 23 bp, Homo sapiens
ttcctacaagagcagcctgtggc

SEQ ID NO: 5537337 - DNA, 14 bp, Homo sapiens
ttcctacaatatat

SEQ ID NO: 5537338 - DNA, 21 bp, Homo sapiens
ttcctacacccttggacttga

SEQ ID NO: 5537339 - DNA, 23 bp, Homo sapiens
ttcctacagaaatactgctctga

SEQ ID NO: 5537340 - DNA, 17 bp, Homo sapiens
ttcctacagatagtcaa

SEQ ID NO: 5537341 - DNA, 20 bp, Homo sapiens
ttcctacagcactactgggt

SEQ ID NO: 5537342 - DNA, 12 bp, Homo sapiens
ttcctacatctt

SEQ ID NO: 5537343 - DNA, 19 bp, Homo sapiens
ttcctacatgccccctccc

SEQ ID NO: 5537344 - DNA, 21 bp, Homo sapiens
ttcctaccacccggtccccac

SEQ ID NO: 5537345 - DNA, 23 bp, Homo sapiens
ttcctacccacacctctgccaga

SEQ ID NO: 5537346 - DNA, 14 bp, Homo sapiens
ttcctacccccgtc

SEQ ID NO: 5537347 - DNA, 18 bp, Homo sapiens
ttcctacccctcttccag

SEQ ID NO: 5537348 - DNA, 18 bp, Homo sapiens
ttcctaccctccttccac

SEQ ID NO: 5537349 - DNA, 22 bp, Homo sapiens
ttcctaccctccttccacatgt

SEQ ID NO: 5537350 - DNA, 13 bp, Homo sapiens
ttcctaccctctc

SEQ ID NO: 5537351 - DNA, 15 bp, Homo sapiens
ttcctaccctgcctc

SEQ ID NO: 5537352 - DNA, 15 bp, Homo sapiens
ttcctacctccctgc

SEQ ID NO: 5537353 - DNA, 17 bp, Homo sapiens
ttcctactcacacttca

SEQ ID NO: 5537354 - DNA, 20 bp, Homo sapiens
ttcctactcacacttcagct

SEQ ID NO: 5537355 - DNA, 21 bp, Homo sapiens
ttcctactctgggaagaatgt

SEQ ID NO: 5537356 - DNA, 17 bp, Homo sapiens
ttcctactcttctctct

SEQ ID NO: 5537357 - DNA, 22 bp, Homo sapiens
ttcctactcttctctctgctct

SEQ ID NO: 5537358 - DNA, 21 bp, Homo sapiens
ttcctactgcgcctcgtgctg

SEQ ID NO: 5537359 - DNA, 14 bp, Homo sapiens
ttcctactgtcctg

SEQ ID NO: 5537360 - DNA, 14 bp, Homo sapiens
ttcctactttctat

SEQ ID NO: 5537361 - DNA, 20 bp, Homo sapiens
ttcctactttgcttctctcc

SEQ ID NO: 5537362 - DNA, 19 bp, Homo sapiens
ttcctagaagttactgaat

SEQ ID NO: 5537363 - DNA, 19 bp, Homo sapiens
ttcctagagaagacaggct

SEQ ID NO: 5537364 - DNA, 19 bp, Homo sapiens
ttcctagagagcagaaata

SEQ ID NO: 5537365 - DNA, 21 bp, Homo sapiens
ttcctagagagcagaaataaa

SEQ ID NO: 5537366 - DNA, 17 bp, Homo sapiens
ttcctagagcatctgtc

SEQ ID NO: 5537367 - DNA, 18 bp, Homo sapiens
ttcctagagcatctgtcc

SEQ ID NO: 5537368 - DNA, 19 bp, Homo sapiens
ttcctagaggcagaggttg

SEQ ID NO: 5537369 - DNA, 22 bp, Homo sapiens
ttcctagatctgcaggctgcac

SEQ ID NO: 5537370 - DNA, 13 bp, Homo sapiens
ttcctagatgtgt

SEQ ID NO: 5537371 - DNA, 17 bp, Homo sapiens
ttcctagattacatctg

SEQ ID NO: 5537372 - DNA, 17 bp, Homo sapiens
ttcctagcacacacttt

SEQ ID NO: 5537373 - DNA, 23 bp, Homo sapiens
ttcctagcactgccccacatgca

SEQ ID NO: 5537374 - DNA, 14 bp, Homo sapiens
ttcctagctagaga

SEQ ID NO: 5537375 - DNA, 21 bp, Homo sapiens
ttcctagctgtaaatataaat

SEQ ID NO: 5537376 - DNA, 16 bp, Homo sapiens
ttcctagctgttctaa

SEQ ID NO: 5537377 - DNA, 19 bp, Homo sapiens
ttcctagcttatctccctg

SEQ ID NO: 5537378 - DNA, 23 bp, Homo sapiens
ttcctaggaaatcacaggcttct

SEQ ID NO: 5537379 - DNA, 17 bp, Homo sapiens
ttcctaggcccaggcct

SEQ ID NO: 5537380 - DNA, 17 bp, Homo sapiens
ttcctaggccccagagc

SEQ ID NO: 5537381 - DNA, 14 bp, Homo sapiens
ttcctaggggtttg

SEQ ID NO: 5537382 - DNA, 20 bp, Homo sapiens
ttcctagtaagtcaggacag

SEQ ID NO: 5537383 - DNA, 19 bp, Homo sapiens
ttcctagtatacccactgc

SEQ ID NO: 5537384 - DNA, 21 bp, Homo sapiens
ttcctagtatacccactgcat

SEQ ID NO: 5537385 - DNA, 14 bp, Homo sapiens
ttcctagtctttcc

SEQ ID NO: 5537386 - DNA, 18 bp, Homo sapiens
ttcctagtgaaccacagg

SEQ ID NO: 5537387 - DNA, 22 bp, Homo sapiens
ttcctagtgaaccacaggtttt

SEQ ID NO: 5537388 - DNA, 22 bp, Homo sapiens
ttcctagtgcctacaatgggaa

SEQ ID NO: 5537389 - DNA, 17 bp, Homo sapiens
ttcctagtggatgactg

SEQ ID NO: 5537390 - DNA, 20 bp, Homo sapiens
ttcctagtggtgtcattttt

SEQ ID NO: 5537391 - DNA, 14 bp, Homo sapiens
ttcctagtgtcttt

SEQ ID NO: 5537392 - DNA, 18 bp, Homo sapiens
ttcctagttcatcccttc

SEQ ID NO: 5537393 - DNA, 16 bp, Homo sapiens
ttcctagttctgtaga

SEQ ID NO: 5537394 - DNA, 13 bp, Homo sapiens
ttcctagttggtg

SEQ ID NO: 5537395 - DNA, 21 bp, Homo sapiens
ttcctagttttatgtttcttg

SEQ ID NO: 5537396 - DNA, 18 bp, Homo sapiens
ttcctagttttctcctcc

SEQ ID NO: 5537397 - DNA, 13 bp, Homo sapiens
ttcctataaaatc

SEQ ID NO: 5537398 - DNA, 23 bp, Homo sapiens
ttcctataacttcttcctgctgg

SEQ ID NO: 5537399 - DNA, 17 bp, Homo sapiens
ttcctataacttgatgc

SEQ ID NO: 5537400 - DNA, 21 bp, Homo sapiens
ttcctataacttgatgcatgt

SEQ ID NO: 5537401 - DNA, 18 bp, Homo sapiens
ttcctataccatttccgt

SEQ ID NO: 5537402 - DNA, 21 bp, Homo sapiens
ttcctataccggagctccagt

SEQ ID NO: 5537403 - DNA, 13 bp, Homo sapiens
ttcctatacgcag

SEQ ID NO: 5537404 - DNA, 19 bp, Homo sapiens
ttcctatatagtttattga

SEQ ID NO: 5537405 - DNA, 21 bp, Homo sapiens
ttcctatatagtttattgaca

SEQ ID NO: 5537406 - DNA, 22 bp, Homo sapiens
ttcctatatagtttattgacaa

SEQ ID NO: 5537407 - DNA, 17 bp, Homo sapiens
ttcctatcataaaaata

SEQ ID NO: 5537408 - DNA, 18 bp, Homo sapiens
ttcctatgacacagttat

SEQ ID NO: 5537409 - DNA, 19 bp, Homo sapiens
ttcctatgactcaaagatg

SEQ ID NO: 5537410 - DNA, 21 bp, Homo sapiens
ttcctatgactcaaagatgaa

SEQ ID NO: 5537411 - DNA, 18 bp, Homo sapiens
ttcctatgatgtatactg

SEQ ID NO: 5537412 - DNA, 23 bp, Homo sapiens
ttcctatgcccaggtaccaccct

SEQ ID NO: 5537413 - DNA, 14 bp, Homo sapiens
ttcctatgtaactg

SEQ ID NO: 5537414 - DNA, 21 bp, Homo sapiens
ttcctattccaagcttccata

SEQ ID NO: 5537415 - DNA, 14 bp, Homo sapiens
ttcctattctcctg

SEQ ID NO: 5537416 - DNA, 15 bp, Homo sapiens
ttcctattctcctgc

SEQ ID NO: 5537417 - DNA, 17 bp, Homo sapiens
ttcctattctcctgcca

SEQ ID NO: 5537418 - DNA, 14 bp, Homo sapiens
ttcctattctgttg

SEQ ID NO: 5537419 - DNA, 22 bp, Homo sapiens
ttcctattctgttgccaatttt

SEQ ID NO: 5537420 - DNA, 13 bp, Homo sapiens
ttcctattgtaat

SEQ ID NO: 5537421 - DNA, 20 bp, Homo sapiens
ttcctattgtcattaaaggt

SEQ ID NO: 5537422 - DNA, 20 bp, Homo sapiens
ttcctattgtgatttgactg

SEQ ID NO: 5537423 - DNA, 22 bp, Homo sapiens
ttcctattgtgatttgactgtt

SEQ ID NO: 5537424 - DNA, 15 bp, Homo sapiens
ttcctatttatttga

SEQ ID NO: 5537425 - DNA, 13 bp, Homo sapiens
ttcctatttcaga

SEQ ID NO: 5537426 - DNA, 23 bp, Homo sapiens
ttcctatttcagaagtttaaata

SEQ ID NO: 5537427 - DNA, 16 bp, Homo sapiens
ttcctatttctttcag

SEQ ID NO: 5537428 - DNA, 23 bp, Homo sapiens
ttcctatttgccatgggcttcac

SEQ ID NO: 5537429 - DNA, 12 bp, Homo sapiens
ttcctattttaa

SEQ ID NO: 5537430 - DNA, 16 bp, Homo sapiens
ttcctattttaaaacc

SEQ ID NO: 5537431 - DNA, 20 bp, Homo sapiens
ttcctattttaaaaccatgc

SEQ ID NO: 5537432 - DNA, 22 bp, Homo sapiens
ttcctattttcttttccattgc

SEQ ID NO: 5537433 - DNA, 22 bp, Homo sapiens
ttcctatttttaaataatttcc

SEQ ID NO: 5537434 - DNA, 17 bp, Homo sapiens
ttcctcaaatacatgca

SEQ ID NO: 5537435 - DNA, 18 bp, Homo sapiens
ttcctcaaatacatgcac

SEQ ID NO: 5537436 - DNA, 20 bp, Homo sapiens
ttcctcaaatcaaaaacagg

SEQ ID NO: 5537437 - DNA, 20 bp, Homo sapiens
ttcctcaaattttttgactt

SEQ ID NO: 5537438 - DNA, 22 bp, Homo sapiens
ttcctcaaattttttgactttt

SEQ ID NO: 5537439 - DNA, 23 bp, Homo sapiens
ttcctcaagtatcttctattttt

SEQ ID NO: 5537440 - DNA, 18 bp, Homo sapiens
ttcctcacacccacctgc

SEQ ID NO: 5537441 - DNA, 21 bp, Homo sapiens
ttcctcacacccacctgctgc

SEQ ID NO: 5537442 - DNA, 15 bp, Homo sapiens
ttcctcacacccctg

SEQ ID NO: 5537443 - DNA, 22 bp, Homo sapiens
ttcctcacacccctgtcccacc

SEQ ID NO: 5537444 - DNA, 14 bp, Homo sapiens
ttcctcacactgct

SEQ ID NO: 5537445 - DNA, 22 bp, Homo sapiens
ttcctcacactgctgtcctctc

SEQ ID NO: 5537446 - DNA, 20 bp, Homo sapiens
ttcctcaccaataacttcag

SEQ ID NO: 5537447 - DNA, 21 bp, Homo sapiens
ttcctcaccaataacttcaga

SEQ ID NO: 5537448 - DNA, 22 bp, Homo sapiens
ttcctcacgcccttcaatgctg

SEQ ID NO: 5537449 - DNA, 23 bp, Homo sapiens
ttcctcacgtgcaggacagctct

SEQ ID NO: 5537450 - DNA, 19 bp, Homo sapiens
ttcctcactgcctggtaaa

SEQ ID NO: 5537451 - DNA, 16 bp, Homo sapiens
ttcctggccctccact

SEQ ID NO: 5537452 - DNA, 11 bp, Homo sapiens
ttcctggcctc

SEQ ID NO: 5537453 - DNA, 22 bp, Homo sapiens
ttcctggcctcactggctgggg

SEQ ID NO: 5537454 - DNA, 20 bp, Homo sapiens
ttcctggcctcagagcttcc

SEQ ID NO: 5537455 - DNA, 21 bp, Homo sapiens
ttcctggcctcagagcttcct

SEQ ID NO: 5537456 - DNA, 22 bp, Homo sapiens
ttcctggcctcagccagctgcc

SEQ ID NO: 5537457 - DNA, 13 bp, Homo sapiens
ttcctggcctccc

SEQ ID NO: 5537458 - DNA, 13 bp, Homo sapiens
ttcctggcgcccc

SEQ ID NO: 5537459 - DNA, 18 bp, Homo sapiens
ttcctggctccttcactg

SEQ ID NO: 5537460 - DNA, 12 bp, Homo sapiens
ttcctggctcta

SEQ ID NO: 5537461 - DNA, 18 bp, Homo sapiens
ttcctggctctaccctgt

SEQ ID NO: 5537462 - DNA, 13 bp, Homo sapiens
ttcctggctctgg

SEQ ID NO: 5537463 - DNA, 15 bp, Homo sapiens
ttcctggctctgggg

SEQ ID NO: 5537464 - DNA, 16 bp, Homo sapiens
ttcctggctctggggg

SEQ ID NO: 5537465 - DNA, 11 bp, Homo sapiens
ttcctggctga

SEQ ID NO: 5537466 - DNA, 23 bp, Homo sapiens
ttcctggctgctgccatgtctca

SEQ ID NO: 5537467 - DNA, 14 bp, Homo sapiens
ttcctggctgtaaa

SEQ ID NO: 5537468 - DNA, 13 bp, Homo sapiens
ttcctggctttgg

SEQ ID NO: 5537469 - DNA, 17 bp, Homo sapiens
ttcctgggaaatattcc

SEQ ID NO: 5537470 - DNA, 21 bp, Homo sapiens
ttcctgggaatggaataacta

SEQ ID NO: 5537471 - DNA, 22 bp, Homo sapiens
ttcctgggaatggaataactat

SEQ ID NO: 5537472 - DNA, 23 bp, Homo sapiens
ttcctgggaccccctcgccagct

SEQ ID NO: 5537473 - DNA, 17 bp, Homo sapiens
ttcctgggaggacaggc

SEQ ID NO: 5537474 - DNA, 20 bp, Homo sapiens
ttcctgggaggacaggcagg

SEQ ID NO: 5537475 - DNA, 20 bp, Homo sapiens
ttcctgggcagcctttccag

SEQ ID NO: 5537476 - DNA, 17 bp, Homo sapiens
ttcctgggccagaagta

SEQ ID NO: 5537477 - DNA, 12 bp, Homo sapiens
ttcctgggcctg

SEQ ID NO: 5537478 - DNA, 16 bp, Homo sapiens
ttcctgggcctgtccc

SEQ ID NO: 5537479 - DNA, 16 bp, Homo sapiens
ttcctgggccttctca

SEQ ID NO: 5537480 - DNA, 19 bp, Homo sapiens
ttcctgggccttctcagct

SEQ ID NO: 5537481 - DNA, 22 bp, Homo sapiens
ttcctgggccttctcagctctc

SEQ ID NO: 5537482 - DNA, 16 bp, Homo sapiens
ttcctggggatgtcat

SEQ ID NO: 5537483 - DNA, 16 bp, Homo sapiens
ttcctggggccccgct

SEQ ID NO: 5537484 - DNA, 17 bp, Homo sapiens
ttcctggggccgcctgc

SEQ ID NO: 5537485 - DNA, 23 bp, Homo sapiens
ttcctggggccgcctgccctgcc

SEQ ID NO: 5537486 - DNA, 14 bp, Homo sapiens
ttcctggggctgga

SEQ ID NO: 5537487 - DNA, 22 bp, Homo sapiens
ttcctggggtgccctccactgc

SEQ ID NO: 5537488 - DNA, 17 bp, Homo sapiens
ttcctgggtcctgcctg

SEQ ID NO: 5537489 - DNA, 17 bp, Homo sapiens
ttcctgggtgccctggc

SEQ ID NO: 5537490 - DNA, 17 bp, Homo sapiens
ttcctgggtggctactc

SEQ ID NO: 5537491 - DNA, 19 bp, Homo sapiens
ttcctgggtgttagaacct

SEQ ID NO: 5537492 - DNA, 23 bp, Homo sapiens
ttcctggtattatttacaatgca

SEQ ID NO: 5537493 - DNA, 20 bp, Homo sapiens
ttcctggtcaaagctcctta

SEQ ID NO: 5537494 - DNA, 14 bp, Homo sapiens
ttcctggtctgtag

SEQ ID NO: 5537495 - DNA, 19 bp, Homo sapiens
ttcctggtgaggcccagcc

SEQ ID NO: 5537496 - DNA, 23 bp, Homo sapiens
ttcctggttaagcaggcattgct

SEQ ID NO: 5537497 - DNA, 23 bp, Homo sapiens
ttcctggttctgtctagactggc

SEQ ID NO: 5537498 - DNA, 18 bp, Homo sapiens
ttcctggttgttcctgca

SEQ ID NO: 5537499 - DNA, 17 bp, Homo sapiens
ttcctggtttgactcag

SEQ ID NO: 5537500 - DNA, 23 bp, Homo sapiens
ttcctggttttgtacactgctgt

SEQ ID NO: 5537501 - DNA, 20 bp, Homo sapiens
ttcctgtaaataagagttgc

SEQ ID NO: 5537502 - DNA, 16 bp, Homo sapiens
ttcctgtaaatgtgac

SEQ ID NO: 5537503 - DNA, 22 bp, Homo sapiens
ttcctgtaacacaagccacaga

SEQ ID NO: 5537504 - DNA, 15 bp, Homo sapiens
ttcctgtaactttta

SEQ ID NO: 5537505 - DNA, 17 bp, Homo sapiens
ttcctgtaacttttaat

SEQ ID NO: 5537506 - DNA, 12 bp, Homo sapiens
ttcctgtactgt

SEQ ID NO: 5537507 - DNA, 24 bp, Homo sapiens
ttcctgtagtgcccctcccatggc

SEQ ID NO: 5537508 - DNA, 18 bp, Homo sapiens
ttcctgtcagtgtttttg

SEQ ID NO: 5537509 - DNA, 19 bp, Homo sapiens
ttcctgtcagtgtttttga

SEQ ID NO: 5537510 - DNA, 21 bp, Homo sapiens
ttcctgtcagtgtttttgaaa

SEQ ID NO: 5537511 - DNA, 16 bp, Homo sapiens
ttcctgtccagctcca

SEQ ID NO: 5537512 - DNA, 17 bp, Homo sapiens
ttcctgtccagctccaa

SEQ ID NO: 5537513 - DNA, 15 bp, Homo sapiens
ttcctgtcccacctc

SEQ ID NO: 5537514 - DNA, 18 bp, Homo sapiens
ttcctgtccccatctgtc

SEQ ID NO: 5537515 - DNA, 13 bp, Homo sapiens
ttcctgtccctga

SEQ ID NO: 5537516 - DNA, 14 bp, Homo sapiens
ttcctgtccctgag

SEQ ID NO: 5537517 - DNA, 12 bp, Homo sapiens
ttcctgtccctt

SEQ ID NO: 5537518 - DNA, 11 bp, Homo sapiens
ttcctgtccta

SEQ ID NO: 5537519 - DNA, 14 bp, Homo sapiens
ttcctgtcctccca

SEQ ID NO: 5537520 - DNA, 19 bp, Homo sapiens
ttcctgtcctctttcagct

SEQ ID NO: 5537521 - DNA, 12 bp, Homo sapiens
ttcctgtcctgc

SEQ ID NO: 5537522 - DNA, 15 bp, Homo sapiens
ttcctgtcctgcctc

SEQ ID NO: 5537523 - DNA, 20 bp, Homo sapiens
ttcctgtcctgcctcctcat

SEQ ID NO: 5537524 - DNA, 15 bp, Homo sapiens
ttcctgtcctgctca

SEQ ID NO: 5537525 - DNA, 13 bp, Homo sapiens
ttcctgtccttgt

SEQ ID NO: 5537526 - DNA, 13 bp, Homo sapiens
ttcctgtctattt

SEQ ID NO: 5537527 - DNA, 21 bp, Homo sapiens
ttcctgtctcccagggacatg

SEQ ID NO: 5537528 - DNA, 13 bp, Homo sapiens
ttcctgtctgttt

SEQ ID NO: 5537529 - DNA, 19 bp, Homo sapiens
ttcctgtcttatcctccac

SEQ ID NO: 5537530 - DNA, 14 bp, Homo sapiens
ttcctgtcttccaa

SEQ ID NO: 5537531 - DNA, 22 bp, Homo sapiens
ttcctgtgacagtgaaatacat

SEQ ID NO: 5537532 - DNA, 11 bp, Homo sapiens
ttcctgtgagg

SEQ ID NO: 5537533 - DNA, 17 bp, Homo sapiens
ttcctgtgatccaccca

SEQ ID NO: 5537534 - DNA, 22 bp, Homo sapiens
ttcctgtgatccacccaaccct

SEQ ID NO: 5537535 - DNA, 12 bp, Homo sapiens
ttcctgtgcaga

SEQ ID NO: 5537536 - DNA, 17 bp, Homo sapiens
ttcctgtgccaacctga

SEQ ID NO: 5537537 - DNA, 18 bp, Homo sapiens
ttcctgtgccatgttatt

SEQ ID NO: 5537538 - DNA, 23 bp, Homo sapiens
ttcctgtgccatgttattcagct

SEQ ID NO: 5537539 - DNA, 20 bp, Homo sapiens
ttcctgtgcccatcatctct

SEQ ID NO: 5537540 - DNA, 22 bp, Homo sapiens
ttcctgtgcccatcatctctgc

SEQ ID NO: 5537541 - DNA, 16 bp, Homo sapiens
ttcctgtgccctcacc

SEQ ID NO: 5537542 - DNA, 19 bp, Homo sapiens
ttcctgtgccctcacccca

SEQ ID NO: 5537543 - DNA, 21 bp, Homo sapiens
ttcctgtggaataaagatggt

SEQ ID NO: 5537544 - DNA, 17 bp, Homo sapiens
ttcctgtggagacactg

SEQ ID NO: 5537545 - DNA, 14 bp, Homo sapiens
ttcctgtggccagg

SEQ ID NO: 5537546 - DNA, 18 bp, Homo sapiens
ttcctgtggccaggaggt

SEQ ID NO: 5537547 - DNA, 13 bp, Homo sapiens
ttcctgtggcctc

SEQ ID NO: 5537548 - DNA, 16 bp, Homo sapiens
ttcctgtggctccctc

SEQ ID NO: 5537549 - DNA, 19 bp, Homo sapiens
ttcctgtggctccctctct

SEQ ID NO: 5537550 - DNA, 23 bp, Homo sapiens
ttcctgtggctccctctctcctg

SEQ ID NO: 5537551 - DNA, 22 bp, Homo sapiens
ttcctgtgggccaggagctcag

SEQ ID NO: 5537552 - DNA, 14 bp, Homo sapiens
ttcctgtgggtggg

SEQ ID NO: 5537553 - DNA, 15 bp, Homo sapiens
ttcctgtgggtgggg

SEQ ID NO: 5537554 - DNA, 21 bp, Homo sapiens
ttcctgtgggtgttctttcct

SEQ ID NO: 5537555 - DNA, 21 bp, Homo sapiens
ttcctgtggttttattacaaa

SEQ ID NO: 5537556 - DNA, 17 bp, Homo sapiens
ttcctgtgtaacatctg

SEQ ID NO: 5537557 - DNA, 11 bp, Homo sapiens
ttcctgtgtat

SEQ ID NO: 5537558 - DNA, 18 bp, Homo sapiens
ttcctgtgtgaagaaagc

SEQ ID NO: 5537559 - DNA, 17 bp, Homo sapiens
ttcctgtgtgtactctg

SEQ ID NO: 5537560 - DNA, 22 bp, Homo sapiens
ttcctgtgtgtccaaaactgcc

SEQ ID NO: 5537561 - DNA, 21 bp, Homo sapiens
ttcctgtgtttgtcctgggtt

SEQ ID NO: 5537562 - DNA, 14 bp, Homo sapiens
ttcctgttaatgta

SEQ ID NO: 5537563 - DNA, 15 bp, Homo sapiens
ttcctgttacaatat

SEQ ID NO: 5537564 - DNA, 14 bp, Homo sapiens
ttcctgttcacctt

SEQ ID NO: 5537565 - DNA, 20 bp, Homo sapiens
ttcctgttcaccttatgtat

SEQ ID NO: 5537566 - DNA, 16 bp, Homo sapiens
ttcctgttcagtgaga

SEQ ID NO: 5537567 - DNA, 15 bp, Homo sapiens
ttcctgttccctcct

SEQ ID NO: 5537568 - DNA, 17 bp, Homo sapiens
ttcctgttccctcctgg

SEQ ID NO: 5537569 - DNA, 21 bp, Homo sapiens
ttcctgttccctcctggtcct

SEQ ID NO: 5537570 - DNA, 21 bp, Homo sapiens
ttcctgttcggttccagacac

SEQ ID NO: 5537571 - DNA, 17 bp, Homo sapiens
ttcctgttctcttgtat

SEQ ID NO: 5537572 - DNA, 23 bp, Homo sapiens
ttcctgttctcttgtatagctga

SEQ ID NO: 5537573 - DNA, 20 bp, Homo sapiens
ttcctgttgatgggaaaagc

SEQ ID NO: 5537574 - DNA, 18 bp, Homo sapiens
ttcctgtttatgcattca

SEQ ID NO: 5537575 - DNA, 20 bp, Homo sapiens
ttcctgtttatttttaaatt

SEQ ID NO: 5537576 - DNA, 21 bp, Homo sapiens
ttcctgtttatttttaaattt

SEQ ID NO: 5537577 - DNA, 19 bp, Homo sapiens
ttcctgtttcagacccccc

SEQ ID NO: 5537578 - DNA, 15 bp, Homo sapiens
ttcctgtttctaagt

SEQ ID NO: 5537579 - DNA, 15 bp, Homo sapiens
ttcctgtttctgaaa

SEQ ID NO: 5537580 - DNA, 20 bp, Homo sapiens
ttcctgtttctgaaaagaaa

SEQ ID NO: 5537581 - DNA, 15 bp, Homo sapiens
ttcctgtttgaaact

SEQ ID NO: 5537582 - DNA, 18 bp, Homo sapiens
ttcctgtttgaacccagg

SEQ ID NO: 5537583 - DNA, 13 bp, Homo sapiens
ttcctgtttgttt

SEQ ID NO: 5537584 - DNA, 15 bp, Homo sapiens
ttcctgttttaagca

SEQ ID NO: 5537585 - DNA, 20 bp, Homo sapiens
ttccttaaaattaagttgaa

SEQ ID NO: 5537586 - DNA, 15 bp, Homo sapiens
ttccttaaacatgaa

SEQ ID NO: 5537587 - DNA, 15 bp, Homo sapiens
ttccttaaactgtgt

SEQ ID NO: 5537588 - DNA, 12 bp, Homo sapiens
ttccttaaatga

SEQ ID NO: 5537589 - DNA, 19 bp, Homo sapiens
ttccttaaatttttagcca

SEQ ID NO: 5537590 - DNA, 22 bp, Homo sapiens
ttccttaaatttttagccattt

SEQ ID NO: 5537591 - DNA, 19 bp, Homo sapiens
ttccttaacagctgtatta

SEQ ID NO: 5537592 - DNA, 17 bp, Homo sapiens
ttccttaagagctattt

SEQ ID NO: 5537593 - DNA, 19 bp, Homo sapiens
ttccttaagtatatcatgt

SEQ ID NO: 5537594 - DNA, 15 bp, Homo sapiens
ttccttacaggtgtg

SEQ ID NO: 5537595 - DNA, 16 bp, Homo sapiens
ttccttacataaacat

SEQ ID NO: 5537596 - DNA, 16 bp, Homo sapiens
ttccttaccccagctg

SEQ ID NO: 5537597 - DNA, 20 bp, Homo sapiens
ttccttacctatttcctcag

SEQ ID NO: 5537598 - DNA, 13 bp, Homo sapiens
ttccttacctgga

SEQ ID NO: 5537599 - DNA, 23 bp, Homo sapiens
ttccttacctttaccccatccct

SEQ ID NO: 5537600 - DNA, 16 bp, Homo sapiens
ttccttactgcagaat

SEQ ID NO: 5537601 - DNA, 20 bp, Homo sapiens
ttccttactttttatatata

SEQ ID NO: 5537602 - DNA, 17 bp, Homo sapiens
ttccttagcagctcagg

SEQ ID NO: 5537603 - DNA, 17 bp, Homo sapiens
ttccttagctaaatgca

SEQ ID NO: 5537604 - DNA, 23 bp, Homo sapiens
ttccttagctatttatccctttc

SEQ ID NO: 5537605 - DNA, 20 bp, Homo sapiens
ttccttagcttagacctcag

SEQ ID NO: 5537606 - DNA, 21 bp, Homo sapiens
ttccttagcttagacctcagc

SEQ ID NO: 5537607 - DNA, 22 bp, Homo sapiens
ttccttagcttagacctcagcc

SEQ ID NO: 5537608 - DNA, 23 bp, Homo sapiens
ttccttaggtttttttccttctg

SEQ ID NO: 5537609 - DNA, 19 bp, Homo sapiens
ttccttagtataatattaa

SEQ ID NO: 5537610 - DNA, 12 bp, Homo sapiens
ttccttagtcat

SEQ ID NO: 5537611 - DNA, 19 bp, Homo sapiens
ttccttagtttttaccttg

SEQ ID NO: 5537612 - DNA, 14 bp, Homo sapiens
ttccttataaaaat

SEQ ID NO: 5537613 - DNA, 17 bp, Homo sapiens
ttccttataaaaattct

SEQ ID NO: 5537614 - DNA, 15 bp, Homo sapiens
ttccttataagaatt

SEQ ID NO: 5537615 - DNA, 15 bp, Homo sapiens
ttccttatactgtat

SEQ ID NO: 5537616 - DNA, 22 bp, Homo sapiens
ttccttatgtatcagtgtcctt

SEQ ID NO: 5537617 - DNA, 14 bp, Homo sapiens
ttccttattgaaaa

SEQ ID NO: 5537618 - DNA, 17 bp, Homo sapiens
ttccttattgaaaaatc

SEQ ID NO: 5537619 - DNA, 19 bp, Homo sapiens
ttccttattgaaaaatcag

SEQ ID NO: 5537620 - DNA, 21 bp, Homo sapiens
ttccttattttaagcattgtg

SEQ ID NO: 5537621 - DNA, 23 bp, Homo sapiens
ttccttatttttacttgtatgta

SEQ ID NO: 5537622 - DNA, 19 bp, Homo sapiens
ttccttcaatgtgcataat

SEQ ID NO: 5537623 - DNA, 16 bp, Homo sapiens
ttccttcacccaccac

SEQ ID NO: 5537624 - DNA, 19 bp, Homo sapiens
ttccttcagaatatcttaa

SEQ ID NO: 5537625 - DNA, 22 bp, Homo sapiens
ttccttcagagagcagtgcttt

SEQ ID NO: 5537626 - DNA, 12 bp, Homo sapiens
ttccttcagatt

SEQ ID NO: 5537627 - DNA, 15 bp, Homo sapiens
ttccttcagcttcca

SEQ ID NO: 5537628 - DNA, 11 bp, Homo sapiens
ttcgtggagct

SEQ ID NO: 5537629 - DNA, 18 bp, Homo sapiens
ttcgtgtaatattctctg

SEQ ID NO: 5537630 - DNA, 16 bp, Homo sapiens
ttcgtgtactgcaaag

SEQ ID NO: 5537631 - DNA, 23 bp, Homo sapiens
ttcgtgtagtggaagagcagcct

SEQ ID NO: 5537632 - DNA, 17 bp, Homo sapiens
ttcgtgtctctcccacc

SEQ ID NO: 5537633 - DNA, 12 bp, Homo sapiens
ttcgtgtggctc

SEQ ID NO: 5537634 - DNA, 23 bp, Homo sapiens
ttcgtgtttttggttttctcctt

SEQ ID NO: 5537635 - DNA, 19 bp, Homo sapiens
ttcgttaactgtgtatgta

SEQ ID NO: 5537636 - DNA, 23 bp, Homo sapiens
ttcgttaagaatttggggcagga

SEQ ID NO: 5537637 - DNA, 16 bp, Homo sapiens
ttcgttagaccgctct

SEQ ID NO: 5537638 - DNA, 16 bp, Homo sapiens
ttcgttcaaaagtgga

SEQ ID NO: 5537639 - DNA, 12 bp, Homo sapiens
ttcgttccctga

SEQ ID NO: 5537640 - DNA, 17 bp, Homo sapiens
ttcgttcgcagagcttt

SEQ ID NO: 5537641 - DNA, 13 bp, Homo sapiens
ttcgttctgttta

SEQ ID NO: 5537642 - DNA, 17 bp, Homo sapiens
ttcgttcttgttagtac

SEQ ID NO: 5537643 - DNA, 17 bp, Homo sapiens
ttcgttgcacagctgtt

SEQ ID NO: 5537644 - DNA, 18 bp, Homo sapiens
ttcgttggggacatgaga

SEQ ID NO: 5537645 - DNA, 17 bp, Homo sapiens
ttcgttggtgaccagtt

SEQ ID NO: 5537646 - DNA, 22 bp, Homo sapiens
ttcgttggtgaccagtttctta

SEQ ID NO: 5537647 - DNA, 20 bp, Homo sapiens
ttcgttgtgttttttaagat

SEQ ID NO: 5537648 - DNA, 20 bp, Homo sapiens
ttcgtttagaatcagaataa

SEQ ID NO: 5537649 - DNA, 13 bp, Homo sapiens
ttcgtttatattt

SEQ ID NO: 5537650 - DNA, 14 bp, Homo sapiens
ttcgtttccatcat

SEQ ID NO: 5537651 - DNA, 14 bp, Homo sapiens
ttcgtttctgacat

SEQ ID NO: 5537652 - DNA, 15 bp, Homo sapiens
ttcgtttctgacata

SEQ ID NO: 5537653 - DNA, 14 bp, Homo sapiens
ttcgtttctggggc

SEQ ID NO: 5537654 - DNA, 16 bp, Homo sapiens
ttcgtttgcctccaga

SEQ ID NO: 5537655 - DNA, 22 bp, Homo sapiens
ttcgtttggtcttaggtcttcc

SEQ ID NO: 5537656 - DNA, 18 bp, Homo sapiens
ttcgtttgtttgttttgt

SEQ ID NO: 5537657 - DNA, 17 bp, Homo sapiens
ttcgtttttcttggggt

SEQ ID NO: 5537658 - DNA, 18 bp, Homo sapiens
ttctaaaaaaaaaaactg

SEQ ID NO: 5537659 - DNA, 18 bp, Homo sapiens
ttctaaaaagatgtaata

SEQ ID NO: 5537660 - DNA, 14 bp, Homo sapiens
ttctaaaaagatta

SEQ ID NO: 5537661 - DNA, 14 bp, Homo sapiens
ttctaaaaagtcaa

SEQ ID NO: 5537662 - DNA, 18 bp, Homo sapiens
ttctaaaaattgtgatca

SEQ ID NO: 5537663 - DNA, 19 bp, Homo sapiens
ttctaaaacaataaagatt

SEQ ID NO: 5537664 - DNA, 13 bp, Homo sapiens
ttctaaaacacat

SEQ ID NO: 5537665 - DNA, 22 bp, Homo sapiens
ttctaaaacccttggtctgtgt

SEQ ID NO: 5537666 - DNA, 22 bp, Homo sapiens
ttctaaaactaaatagcatgta

SEQ ID NO: 5537667 - DNA, 15 bp, Homo sapiens
ttctaaaactactgc

SEQ ID NO: 5537668 - DNA, 15 bp, Homo sapiens
ttctaaaactgtact

SEQ ID NO: 5537669 - DNA, 16 bp, Homo sapiens
ttctaaaactgtactt

SEQ ID NO: 5537670 - DNA, 19 bp, Homo sapiens
ttctaaaactgtactttga

SEQ ID NO: 5537671 - DNA, 13 bp, Homo sapiens
ttctaaaagaata

SEQ ID NO: 5537672 - DNA, 13 bp, Homo sapiens
ttctaaaagccat

SEQ ID NO: 5537673 - DNA, 17 bp, Homo sapiens
ttctaaaagctttcatg

SEQ ID NO: 5537674 - DNA, 15 bp, Homo sapiens
ttctaaaagtttcta

SEQ ID NO: 5537675 - DNA, 22 bp, Homo sapiens
ttctaaaagtttgaggaatatt

SEQ ID NO: 5537676 - DNA, 16 bp, Homo sapiens
ttctaaaagttttcta

SEQ ID NO: 5537677 - DNA, 14 bp, Homo sapiens
ttctaaaatagcaa

SEQ ID NO: 5537678 - DNA, 16 bp, Homo sapiens
ttctaaaatagcaata

SEQ ID NO: 5537679 - DNA, 23 bp, Homo sapiens
ttctaaaatagcaataactgaaa

SEQ ID NO: 5537680 - DNA, 18 bp, Homo sapiens
ttctaaaatcatgaaact

SEQ ID NO: 5537681 - DNA, 15 bp, Homo sapiens
ttctaaaatctaaaa

SEQ ID NO: 5537682 - DNA, 14 bp, Homo sapiens
ttctaaaatgcctt

SEQ ID NO: 5537683 - DNA, 15 bp, Homo sapiens
ttctaaaatgtgatg

SEQ ID NO: 5537684 - DNA, 19 bp, Homo sapiens
ttctaaaatgtgatgttct

SEQ ID NO: 5537685 - DNA, 13 bp, Homo sapiens
ttctaaaattgaa

SEQ ID NO: 5537686 - DNA, 16 bp, Homo sapiens
ttctaaaattgaagag

SEQ ID NO: 5537687 - DNA, 19 bp, Homo sapiens
ttctaaacacttcattctt

SEQ ID NO: 5537688 - DNA, 23 bp, Homo sapiens
ttctaaacacttcattctttata

SEQ ID NO: 5537689 - DNA, 14 bp, Homo sapiens
ttctaaacagagat

SEQ ID NO: 5537690 - DNA, 13 bp, Homo sapiens
ttctaaaccaaaa

SEQ ID NO: 5537691 - DNA, 22 bp, Homo sapiens
ttctaaaccatgaaaagttttc

SEQ ID NO: 5537692 - DNA, 21 bp, Homo sapiens
ttctaaacgtaagcactgttt

SEQ ID NO: 5537693 - DNA, 19 bp, Homo sapiens
ttctaaacgtgaactaaga

SEQ ID NO: 5537694 - DNA, 22 bp, Homo sapiens
ttctaaacgtgaactaagattt

SEQ ID NO: 5537695 - DNA, 23 bp, Homo sapiens
ttctaaactccctggctgttctg

SEQ ID NO: 5537696 - DNA, 15 bp, Homo sapiens
ttctaaactgttttc

SEQ ID NO: 5537697 - DNA, 16 bp, Homo sapiens
ttctaaagaagttcaa

SEQ ID NO: 5537698 - DNA, 13 bp, Homo sapiens
ttctaaagacagg

SEQ ID NO: 5537699 - DNA, 13 bp, Homo sapiens
ttctaaagataat

SEQ ID NO: 5537700 - DNA, 23 bp, Homo sapiens
ttctaaagataatattactgttt

SEQ ID NO: 5537701 - DNA, 20 bp, Homo sapiens
ttctaaagccaagaagaatt

SEQ ID NO: 5537702 - DNA, 16 bp, Homo sapiens
ttctaaagctctgaca

SEQ ID NO: 5537703 - DNA, 19 bp, Homo sapiens
ttctaaagctgaatgtcaa

SEQ ID NO: 5537704 - DNA, 14 bp, Homo sapiens
ttctaaaggagcag

SEQ ID NO: 5537705 - DNA, 20 bp, Homo sapiens
ttctaaaggctacctttgta

SEQ ID NO: 5537706 - DNA, 17 bp, Homo sapiens
ttctaaagtactgagca

SEQ ID NO: 5537707 - DNA, 14 bp, Homo sapiens
ttctaaagttctaa

SEQ ID NO: 5537708 - DNA, 16 bp, Homo sapiens
ttctaaagttctaaga

SEQ ID NO: 5537709 - DNA, 12 bp, Homo sapiens
ttctaaagttgt

SEQ ID NO: 5537710 - DNA, 18 bp, Homo sapiens
ttctaaataaaaatatgt

SEQ ID NO: 5537711 - DNA, 22 bp, Homo sapiens
ttctaaataaaatataattgtt

SEQ ID NO: 5537712 - DNA, 21 bp, Homo sapiens
ttctaaataaggaatttcctc

SEQ ID NO: 5537713 - DNA, 22 bp, Homo sapiens
ttctaaatagcgattataatct

SEQ ID NO: 5537714 - DNA, 23 bp, Homo sapiens
ttctaaatagcgattataatctc

SEQ ID NO: 5537715 - DNA, 17 bp, Homo sapiens
ttctaaatatgaatgaa

SEQ ID NO: 5537716 - DNA, 23 bp, Homo sapiens
ttctaaatattgacacttagcag

SEQ ID NO: 5537717 - DNA, 20 bp, Homo sapiens
ttctaaatattgcttcaatt

SEQ ID NO: 5537718 - DNA, 23 bp, Homo sapiens
ttctaaatattgcttcaatttca

SEQ ID NO: 5537719 - DNA, 16 bp, Homo sapiens
ttctaaatcagaaata

SEQ ID NO: 5537720 - DNA, 15 bp, Homo sapiens
ttctaaatgaatgtt

SEQ ID NO: 5537721 - DNA, 12 bp, Homo sapiens
ttctaaatgcaa

SEQ ID NO: 5537722 - DNA, 13 bp, Homo sapiens
ttctaaatgcaat

SEQ ID NO: 5537723 - DNA, 15 bp, Homo sapiens
ttctaaatgcaataa

SEQ ID NO: 5537724 - DNA, 18 bp, Homo sapiens
ttctaaatgcaataagat

SEQ ID NO: 5537725 - DNA, 23 bp, Homo sapiens
ttctaaatgcatatcctgagcca

SEQ ID NO: 5537726 - DNA, 18 bp, Homo sapiens
ttctaaatgctggtctag

SEQ ID NO: 5537727 - DNA, 23 bp, Homo sapiens
ttctaaatgtacaaattcttata

SEQ ID NO: 5537728 - DNA, 23 bp, Homo sapiens
ttctaaatgttattacttgtaaa

SEQ ID NO: 5537729 - DNA, 21 bp, Homo sapiens
ttctaaatgtttctttttctt

SEQ ID NO: 5537730 - DNA, 16 bp, Homo sapiens
ttctaaattacaaagg

SEQ ID NO: 5537731 - DNA, 13 bp, Homo sapiens
ttctaaattctat

SEQ ID NO: 5537732 - DNA, 22 bp, Homo sapiens
ttctaacagatcagaacatgaa

SEQ ID NO: 5537733 - DNA, 23 bp, Homo sapiens
ttctaacagatcagaacatgaaa

SEQ ID NO: 5537734 - DNA, 22 bp, Homo sapiens
ttctaaccaaagagtctctggc

SEQ ID NO: 5537735 - DNA, 18 bp, Homo sapiens
ttctaaccaagaggctgg

SEQ ID NO: 5537736 - DNA, 19 bp, Homo sapiens
ttctaaccaagaggctggt

SEQ ID NO: 5537737 - DNA, 23 bp, Homo sapiens
ttctaacccagtcttatttttct

SEQ ID NO: 5537738 - DNA, 23 bp, Homo sapiens
ttctaaccttcacgattaactgt

SEQ ID NO: 5537739 - DNA, 22 bp, Homo sapiens
ttctaaccttgaatgctgccag

SEQ ID NO: 5537740 - DNA, 23 bp, Homo sapiens
ttctaaccttgaatgctgccagt

SEQ ID NO: 5537741 - DNA, 16 bp, Homo sapiens
ttctaactctgatgta

SEQ ID NO: 5537742 - DNA, 16 bp, Homo sapiens
ttctaactgtaaatca

SEQ ID NO: 5537743 - DNA, 17 bp, Homo sapiens
ttctaactgtaaatcac

SEQ ID NO: 5537744 - DNA, 20 bp, Homo sapiens
ttctaactgtaaatcacttg

SEQ ID NO: 5537745 - DNA, 21 bp, Homo sapiens
ttctaactgtaaatcacttgt

SEQ ID NO: 5537746 - DNA, 22 bp, Homo sapiens
ttctaactgtaaatcacttgta

SEQ ID NO: 5537747 - DNA, 23 bp, Homo sapiens
ttctaactgtaaatcacttgtaa

SEQ ID NO: 5537748 - DNA, 17 bp, Homo sapiens
ttctaacttaatgtagt

SEQ ID NO: 5537749 - DNA, 14 bp, Homo sapiens
ttctaacttcataa

SEQ ID NO: 5537750 - DNA, 16 bp, Homo sapiens
ttctaagaaaagccta

SEQ ID NO: 5537751 - DNA, 22 bp, Homo sapiens
ttctaagaaaatgtagttagct

SEQ ID NO: 5537752 - DNA, 23 bp, Homo sapiens
ttctaagaaacatttatattgat

SEQ ID NO: 5537753 - DNA, 14 bp, Homo sapiens
ttctaagaaataga

SEQ ID NO: 5537754 - DNA, 18 bp, Homo sapiens
ttctaagaaatcaagtaa

SEQ ID NO: 5537755 - DNA, 13 bp, Homo sapiens
ttctaagaagaca

SEQ ID NO: 5537756 - DNA, 16 bp, Homo sapiens
ttctaagaagacattt

SEQ ID NO: 5537757 - DNA, 17 bp, Homo sapiens
ttctaagacagttttta

SEQ ID NO: 5537758 - DNA, 20 bp, Homo sapiens
ttctaagacattctgttgga

SEQ ID NO: 5537759 - DNA, 16 bp, Homo sapiens
ttctaagactctgtgt

SEQ ID NO: 5537760 - DNA, 21 bp, Homo sapiens
ttctaagacttactctaagat

SEQ ID NO: 5537761 - DNA, 19 bp, Homo sapiens
ttctaagatgtgatattct

SEQ ID NO: 5537762 - DNA, 22 bp, Homo sapiens
ttctaagatgtgatattctaag

SEQ ID NO: 5537763 - DNA, 23 bp, Homo sapiens
ttctaagatgtgatattctaaga

SEQ ID NO: 5537764 - DNA, 13 bp, Homo sapiens
ttctaagatgttc

SEQ ID NO: 5537765 - DNA, 12 bp, Homo sapiens
ttctaagattct

SEQ ID NO: 5537766 - DNA, 14 bp, Homo sapiens
ttctaagattctaa

SEQ ID NO: 5537767 - DNA, 16 bp, Homo sapiens
ttctaagattctaaag

SEQ ID NO: 5537768 - DNA, 16 bp, Homo sapiens
ttctaagattctaatg

SEQ ID NO: 5537769 - DNA, 17 bp, Homo sapiens
ttctaagattctaatga

SEQ ID NO: 5537770 - DNA, 19 bp, Homo sapiens
ttctaagattctaatgatg

SEQ ID NO: 5537771 - DNA, 13 bp, Homo sapiens
ttctaagattctg

SEQ ID NO: 5537772 - DNA, 22 bp, Homo sapiens
ttctaagattgtacatatggaa

SEQ ID NO: 5537773 - DNA, 20 bp, Homo sapiens
ttctaagcaaccacactgct

SEQ ID NO: 5537774 - DNA, 18 bp, Homo sapiens
ttctaagcaatgcaaatg

SEQ ID NO: 5537775 - DNA, 17 bp, Homo sapiens
ttctaagcataaaagat

SEQ ID NO: 5537776 - DNA, 13 bp, Homo sapiens
ttctaagcatgta

SEQ ID NO: 5537777 - DNA, 17 bp, Homo sapiens
ttctaagccctgttctc

SEQ ID NO: 5537778 - DNA, 14 bp, Homo sapiens
ttctaagcttattt

SEQ ID NO: 5537779 - DNA, 17 bp, Homo sapiens
ttctaagcttatttcta

SEQ ID NO: 5537780 - DNA, 22 bp, Homo sapiens
ttctaaggaaatggagaagctc

SEQ ID NO: 5537781 - DNA, 13 bp, Homo sapiens
ttctaaggaagac

SEQ ID NO: 5537782 - DNA, 18 bp, Homo sapiens
ttctaaggaatatgagct

SEQ ID NO: 5537783 - DNA, 17 bp, Homo sapiens
ttctaaggatagccttt

SEQ ID NO: 5537784 - DNA, 18 bp, Homo sapiens
ttctaaggatagcctttg

SEQ ID NO: 5537785 - DNA, 20 bp, Homo sapiens
ttctaaggccctttttccta

SEQ ID NO: 5537786 - DNA, 19 bp, Homo sapiens
ttctaaggcctaggattct

SEQ ID NO: 5537787 - DNA, 22 bp, Homo sapiens
ttctaaggcctaggattctaaa

SEQ ID NO: 5537788 - DNA, 16 bp, Homo sapiens
ttctaagggaaaaagt

SEQ ID NO: 5537789 - DNA, 20 bp, Homo sapiens
ttctaagggatccagagacc

SEQ ID NO: 5537790 - DNA, 21 bp, Homo sapiens
ttctaaggggacctacagaca

SEQ ID NO: 5537791 - DNA, 23 bp, Homo sapiens
ttctaaggtccggtgttctaaga

SEQ ID NO: 5537792 - DNA, 17 bp, Homo sapiens
ttctaagtaaaaccaca

SEQ ID NO: 5537793 - DNA, 15 bp, Homo sapiens
ttctaagtaaataca

SEQ ID NO: 5537794 - DNA, 20 bp, Homo sapiens
ttctaagtcgtgcactttct

SEQ ID NO: 5537795 - DNA, 22 bp, Homo sapiens
ttctaagtgaaatttctagcct

SEQ ID NO: 5537796 - DNA, 19 bp, Homo sapiens
ttctaagtgagatgtttgg

SEQ ID NO: 5537797 - DNA, 15 bp, Homo sapiens
ttctaagtggcctgc

SEQ ID NO: 5537798 - DNA, 19 bp, Homo sapiens
ttctaagtgtaacctcagt

SEQ ID NO: 5537799 - DNA, 20 bp, Homo sapiens
ttctaagtgtaacctcagta

SEQ ID NO: 5537800 - DNA, 14 bp, Homo sapiens
ttctaagttagact

SEQ ID NO: 5537801 - DNA, 18 bp, Homo sapiens
ttctaagttatttacttt

SEQ ID NO: 5537802 - DNA, 13 bp, Homo sapiens
ttctaagtttcta

SEQ ID NO: 5537803 - DNA, 17 bp, Homo sapiens
ttctaagtttctaagat

SEQ ID NO: 5537804 - DNA, 12 bp, Homo sapiens
ttctatgttgta

SEQ ID NO: 5537805 - DNA, 14 bp, Homo sapiens
ttctattaaaagac

SEQ ID NO: 5537806 - DNA, 15 bp, Homo sapiens
ttctattaaaagact

SEQ ID NO: 5537807 - DNA, 17 bp, Homo sapiens
ttctattaaaagactca

SEQ ID NO: 5537808 - DNA, 18 bp, Homo sapiens
ttctattaaaagtgggaa

SEQ ID NO: 5537809 - DNA, 23 bp, Homo sapiens
ttctattaaaagtgggaattagg

SEQ ID NO: 5537810 - DNA, 21 bp, Homo sapiens
ttctattaaagtgctaaggtt

SEQ ID NO: 5537811 - DNA, 20 bp, Homo sapiens
ttctattacattttcagtga

SEQ ID NO: 5537812 - DNA, 23 bp, Homo sapiens
ttctattagtcacctaaccctct

SEQ ID NO: 5537813 - DNA, 11 bp, Homo sapiens
ttctattatat

SEQ ID NO: 5537814 - DNA, 13 bp, Homo sapiens
ttctattatctgg

SEQ ID NO: 5537815 - DNA, 19 bp, Homo sapiens
ttctattatttttataatt

SEQ ID NO: 5537816 - DNA, 23 bp, Homo sapiens
ttctattatttttcaagtaataa

SEQ ID NO: 5537817 - DNA, 16 bp, Homo sapiens
ttctattcataataaa

SEQ ID NO: 5537818 - DNA, 22 bp, Homo sapiens
ttctattcattcattttgaaat

SEQ ID NO: 5537819 - DNA, 13 bp, Homo sapiens
ttctattctccag

SEQ ID NO: 5537820 - DNA, 17 bp, Homo sapiens
ttctattctccagacat

SEQ ID NO: 5537821 - DNA, 20 bp, Homo sapiens
ttctattctctcctcagact

SEQ ID NO: 5537822 - DNA, 12 bp, Homo sapiens
ttctattgaaaa

SEQ ID NO: 5537823 - DNA, 14 bp, Homo sapiens
ttctattgaattcg

SEQ ID NO: 5537824 - DNA, 17 bp, Homo sapiens
ttctattgacttcaatg

SEQ ID NO: 5537825 - DNA, 17 bp, Homo sapiens
ttctattgactttctta

SEQ ID NO: 5537826 - DNA, 15 bp, Homo sapiens
ttctattgcctctga

SEQ ID NO: 5537827 - DNA, 18 bp, Homo sapiens
ttctattgccttctttga

SEQ ID NO: 5537828 - DNA, 15 bp, Homo sapiens
ttctattgtacagaa

SEQ ID NO: 5537829 - DNA, 16 bp, Homo sapiens
ttctattgtgtggatg

SEQ ID NO: 5537830 - DNA, 21 bp, Homo sapiens
ttctattgtgtttcacaaaat

SEQ ID NO: 5537831 - DNA, 20 bp, Homo sapiens
ttctattgttaaacaaatga

SEQ ID NO: 5537832 - DNA, 14 bp, Homo sapiens
ttctattgtttact

SEQ ID NO: 5537833 - DNA, 18 bp, Homo sapiens
ttctatttaaaaaataaa

SEQ ID NO: 5537834 - DNA, 20 bp, Homo sapiens
ttctatttaaaaaataaaaa

SEQ ID NO: 5537835 - DNA, 19 bp, Homo sapiens
ttctatttatatgtacatg

SEQ ID NO: 5537836 - DNA, 18 bp, Homo sapiens
ttctatttattcctgtta

SEQ ID NO: 5537837 - DNA, 17 bp, Homo sapiens
ttctatttatttgactg

SEQ ID NO: 5537838 - DNA, 13 bp, Homo sapiens
ttctatttcataa

SEQ ID NO: 5537839 - DNA, 13 bp, Homo sapiens
ttctatttctatc

SEQ ID NO: 5537840 - DNA, 14 bp, Homo sapiens
ttctatttctatct

SEQ ID NO: 5537841 - DNA, 12 bp, Homo sapiens
ttctatttctct

SEQ ID NO: 5537842 - DNA, 13 bp, Homo sapiens
ttctatttctcta

SEQ ID NO: 5537843 - DNA, 17 bp, Homo sapiens
ttctatttctctgtgta

SEQ ID NO: 5537844 - DNA, 16 bp, Homo sapiens
ttctatttcttgaaga

SEQ ID NO: 5537845 - DNA, 12 bp, Homo sapiens
ttctatttcttt

SEQ ID NO: 5537846 - DNA, 12 bp, Homo sapiens
ttctatttgcta

SEQ ID NO: 5537847 - DNA, 16 bp, Homo sapiens
ttctatttggggcttg

SEQ ID NO: 5537848 - DNA, 18 bp, Homo sapiens
ttctatttggttagaagg

SEQ ID NO: 5537849 - DNA, 13 bp, Homo sapiens
ttctatttgtctt

SEQ ID NO: 5537850 - DNA, 21 bp, Homo sapiens
ttctatttgtgtaaggacttt

SEQ ID NO: 5537851 - DNA, 17 bp, Homo sapiens
ttctattttactgtctt

SEQ ID NO: 5537852 - DNA, 15 bp, Homo sapiens
ttctattttattatg

SEQ ID NO: 5537853 - DNA, 15 bp, Homo sapiens
ttctattttcacaat

SEQ ID NO: 5537854 - DNA, 22 bp, Homo sapiens
ttctattttctctgatactttt

SEQ ID NO: 5537855 - DNA, 15 bp, Homo sapiens
ttctattttgctgga

SEQ ID NO: 5537856 - DNA, 16 bp, Homo sapiens
ttctattttgtaaact

SEQ ID NO: 5537857 - DNA, 17 bp, Homo sapiens
ttctatttttatcatga

SEQ ID NO: 5537858 - DNA, 20 bp, Homo sapiens
ttctatttttatcatgaatt

SEQ ID NO: 5537859 - DNA, 16 bp, Homo sapiens
ttctatttttatctga

SEQ ID NO: 5537860 - DNA, 15 bp, Homo sapiens
ttctatttttgtaga

SEQ ID NO: 5537861 - DNA, 17 bp, Homo sapiens
ttctatttttgtccttg

SEQ ID NO: 5537862 - DNA, 22 bp, Homo sapiens
ttctcaaaaaccacagtcctca

SEQ ID NO: 5537863 - DNA, 13 bp, Homo sapiens
ttctcaaaaagct

SEQ ID NO: 5537864 - DNA, 22 bp, Homo sapiens
ttctcaaaaagctgctatccaa

SEQ ID NO: 5537865 - DNA, 21 bp, Homo sapiens
ttctcaaaagcatttatcatt

SEQ ID NO: 5537866 - DNA, 22 bp, Homo sapiens
ttctcaaaccctgtttacggta

SEQ ID NO: 5537867 - DNA, 22 bp, Homo sapiens
ttctcaaagagaattgtatgta

SEQ ID NO: 5537868 - DNA, 15 bp, Homo sapiens
ttctcaaagcaggaa

SEQ ID NO: 5537869 - DNA, 23 bp, Homo sapiens
ttctcaaagcctcttatttttct

SEQ ID NO: 5537870 - DNA, 15 bp, Homo sapiens
ttctcaaagctggga

SEQ ID NO: 5537871 - DNA, 19 bp, Homo sapiens
ttctcaaagggtacttcca

SEQ ID NO: 5537872 - DNA, 13 bp, Homo sapiens
ttctcaaagtttt

SEQ ID NO: 5537873 - DNA, 19 bp, Homo sapiens
ttctcaaagtttttacagt

SEQ ID NO: 5537874 - DNA, 20 bp, Homo sapiens
ttctcaaagtttttacagtg

SEQ ID NO: 5537875 - DNA, 21 bp, Homo sapiens
ttctcaaagtttttacagtgt

SEQ ID NO: 5537876 - DNA, 15 bp, Homo sapiens
ttctcaaatgtgtgt

SEQ ID NO: 5537877 - DNA, 22 bp, Homo sapiens
ttctcaacaaagcacagtgtta

SEQ ID NO: 5537878 - DNA, 13 bp, Homo sapiens
ttctcaacacaca

SEQ ID NO: 5537879 - DNA, 20 bp, Homo sapiens
ttctcaacatactgtaatca

SEQ ID NO: 5537880 - DNA, 15 bp, Homo sapiens
ttctcaacctaccac

SEQ ID NO: 5537881 - DNA, 20 bp, Homo sapiens
ttctcaactccagagcccct

SEQ ID NO: 5537882 - DNA, 16 bp, Homo sapiens
ttctcaagaatctaga

SEQ ID NO: 5537883 - DNA, 13 bp, Homo sapiens
ttctcaagacttt

SEQ ID NO: 5537884 - DNA, 14 bp, Homo sapiens
ttctcaagccctgc

SEQ ID NO: 5537885 - DNA, 23 bp, Homo sapiens
ttctcaagccgcatcccagactt

SEQ ID NO: 5537886 - DNA, 18 bp, Homo sapiens
ttctcaagcgctatccac

SEQ ID NO: 5537887 - DNA, 21 bp, Homo sapiens
ttctcaagcgctatccacaga

SEQ ID NO: 5537888 - DNA, 21 bp, Homo sapiens
ttctcaagggacgtcctccaa

SEQ ID NO: 5537889 - DNA, 14 bp, Homo sapiens
ttctcaagtaacat

SEQ ID NO: 5537890 - DNA, 21 bp, Homo sapiens
ttctcaagtgttttggagaaa

SEQ ID NO: 5537891 - DNA, 22 bp, Homo sapiens
ttctcaagttctaagattctaa

SEQ ID NO: 5537892 - DNA, 19 bp, Homo sapiens
ttctcaagtttaaagtcat

SEQ ID NO: 5537893 - DNA, 12 bp, Homo sapiens
ttctcaatgaaa

SEQ ID NO: 5537894 - DNA, 12 bp, Homo sapiens
ttctcaatttca

SEQ ID NO: 5537895 - DNA, 19 bp, Homo sapiens
ttctcacaatagacagaaa

SEQ ID NO: 5537896 - DNA, 23 bp, Homo sapiens
ttctcacaatagccgatatcaga

SEQ ID NO: 5537897 - DNA, 14 bp, Homo sapiens
ttctcacacccacc

SEQ ID NO: 5537898 - DNA, 18 bp, Homo sapiens
ttctcacacccaccgtcc

SEQ ID NO: 5537899 - DNA, 20 bp, Homo sapiens
ttctcacactctaactgtat

SEQ ID NO: 5537900 - DNA, 21 bp, Homo sapiens
ttctcacagcacatgctggcc

SEQ ID NO: 5537901 - DNA, 20 bp, Homo sapiens
ttctcacagctccaagaatt

SEQ ID NO: 5537902 - DNA, 19 bp, Homo sapiens
ttctcacagtgggagccag

SEQ ID NO: 5537903 - DNA, 14 bp, Homo sapiens
ttctcacagtgtgg

SEQ ID NO: 5537904 - DNA, 20 bp, Homo sapiens
ttctcacatggaatgagggt

SEQ ID NO: 5537905 - DNA, 13 bp, Homo sapiens
ttctcaccagctg

SEQ ID NO: 5537906 - DNA, 15 bp, Homo sapiens
ttctcaccagctgca

SEQ ID NO: 5537907 - DNA, 16 bp, Homo sapiens
ttctcaccagctgcaa

SEQ ID NO: 5537908 - DNA, 21 bp, Homo sapiens
ttctcaccagctgcaaagtgt

SEQ ID NO: 5537909 - DNA, 22 bp, Homo sapiens
ttctcaccagctgcaaagtgtt

SEQ ID NO: 5537910 - DNA, 23 bp, Homo sapiens
ttctcaccagctgcaaagtgttt

SEQ ID NO: 5537911 - DNA, 12 bp, Homo sapiens
ttctcaccagga

SEQ ID NO: 5537912 - DNA, 13 bp, Homo sapiens
ttctcaccaggaa

SEQ ID NO: 5537913 - DNA, 16 bp, Homo sapiens
ttctcaccattcctgt

SEQ ID NO: 5537914 - DNA, 20 bp, Homo sapiens
ttctcaccctactctggatg

SEQ ID NO: 5537915 - DNA, 21 bp, Homo sapiens
ttctcacctaaaccctctgtg

SEQ ID NO: 5537916 - DNA, 18 bp, Homo sapiens
ttctcacctgctccagga

SEQ ID NO: 5537917 - DNA, 20 bp, Homo sapiens
ttctcaccttaactcagcca

SEQ ID NO: 5537918 - DNA, 21 bp, Homo sapiens
ttctcacctttcccacctctc

SEQ ID NO: 5537919 - DNA, 16 bp, Homo sapiens
ttctcacgctttgttt

SEQ ID NO: 5537920 - DNA, 15 bp, Homo sapiens
ttctcactaaatctt

SEQ ID NO: 5537921 - DNA, 14 bp, Homo sapiens
ttctcactagtgtc

SEQ ID NO: 5537922 - DNA, 21 bp, Homo sapiens
ttctcactagtgtcaggcccc

SEQ ID NO: 5537923 - DNA, 18 bp, Homo sapiens
ttctcactatgtttctca

SEQ ID NO: 5537924 - DNA, 23 bp, Homo sapiens
ttctcactccctttgtggacttt

SEQ ID NO: 5537925 - DNA, 18 bp, Homo sapiens
ttctcactgaactccacc

SEQ ID NO: 5537926 - DNA, 19 bp, Homo sapiens
ttctcactgaactccaccg

SEQ ID NO: 5537927 - DNA, 16 bp, Homo sapiens
ttctcactgcctttgt

SEQ ID NO: 5537928 - DNA, 13 bp, Homo sapiens
ttctcactgctgt

SEQ ID NO: 5537929 - DNA, 18 bp, Homo sapiens
ttctcacttcaattaatg

SEQ ID NO: 5537930 - DNA, 22 bp, Homo sapiens
ttctcagaaatgtcatgattgc

SEQ ID NO: 5537931 - DNA, 16 bp, Homo sapiens
ttctcagaacagctga

SEQ ID NO: 5537932 - DNA, 17 bp, Homo sapiens
ttctcagaacagctgaa

SEQ ID NO: 5537933 - DNA, 13 bp, Homo sapiens
ttctcagaagcac

SEQ ID NO: 5537934 - DNA, 21 bp, Homo sapiens
ttctcagaagcacagaatatt

SEQ ID NO: 5537935 - DNA, 16 bp, Homo sapiens
ttctcagaagtgaaaa

SEQ ID NO: 5537936 - DNA, 18 bp, Homo sapiens
ttctcagaatccaaagat

SEQ ID NO: 5537937 - DNA, 23 bp, Homo sapiens
ttctcagaatctcaaataactaa

SEQ ID NO: 5537938 - DNA, 15 bp, Homo sapiens
ttctcagaattcggt

SEQ ID NO: 5537939 - DNA, 16 bp, Homo sapiens
ttctcagactgccaaa

SEQ ID NO: 5537940 - DNA, 15 bp, Homo sapiens
ttctcagagccaagt

SEQ ID NO: 5537941 - DNA, 14 bp, Homo sapiens
ttctcagatcttga

SEQ ID NO: 5537942 - DNA, 12 bp, Homo sapiens
ttctcagcaagt

SEQ ID NO: 5537943 - DNA, 21 bp, Homo sapiens
ttctcagcgggagtctcctca

SEQ ID NO: 5537944 - DNA, 14 bp, Homo sapiens
ttctcagctccact

SEQ ID NO: 5537945 - DNA, 16 bp, Homo sapiens
ttctcagctccactct

SEQ ID NO: 5537946 - DNA, 21 bp, Homo sapiens
ttctcagctccactctgaagt

SEQ ID NO: 5537947 - DNA, 12 bp, Homo sapiens
ttctcagctccc

SEQ ID NO: 5537948 - DNA, 14 bp, Homo sapiens
ttctcagctcccat

SEQ ID NO: 5537949 - DNA, 18 bp, Homo sapiens
ttctcagctcccatttct

SEQ ID NO: 5537950 - DNA, 17 bp, Homo sapiens
ttctcagctccccctgt

SEQ ID NO: 5537951 - DNA, 18 bp, Homo sapiens
ttctcagctccccctgtc

SEQ ID NO: 5537952 - DNA, 19 bp, Homo sapiens
ttctcagctgaaattatat

SEQ ID NO: 5537953 - DNA, 15 bp, Homo sapiens
ttctcagctgtgcct

SEQ ID NO: 5537954 - DNA, 18 bp, Homo sapiens
ttctcagcttgcagctgg

SEQ ID NO: 5537955 - DNA, 18 bp, Homo sapiens
ttctcaggaagagctatg

SEQ ID NO: 5537956 - DNA, 16 bp, Homo sapiens
ttctcaggacacaggc

SEQ ID NO: 5537957 - DNA, 19 bp, Homo sapiens
ttctcaggacacaggcctg

SEQ ID NO: 5537958 - DNA, 21 bp, Homo sapiens
ttctcaggaggtgtctcctac

SEQ ID NO: 5537959 - DNA, 15 bp, Homo sapiens
ttctcaggccccggg

SEQ ID NO: 5537960 - DNA, 20 bp, Homo sapiens
ttctcaggctctgccctgcc

SEQ ID NO: 5537961 - DNA, 13 bp, Homo sapiens
ttctcaggctggc

SEQ ID NO: 5537962 - DNA, 16 bp, Homo sapiens
ttctcagggctcctgc

SEQ ID NO: 5537963 - DNA, 16 bp, Homo sapiens
ttctcagggctggagc

SEQ ID NO: 5537964 - DNA, 22 bp, Homo sapiens
ttctcagggctggagcctgggg

SEQ ID NO: 5537965 - DNA, 16 bp, Homo sapiens
ttctcagggtctctgc

SEQ ID NO: 5537966 - DNA, 19 bp, Homo sapiens
ttctcagggtctctgctgc

SEQ ID NO: 5537967 - DNA, 17 bp, Homo sapiens
ttctcaggtgttgccaa

SEQ ID NO: 5537968 - DNA, 21 bp, Homo sapiens
ttctcagtcctaatttgaaca

SEQ ID NO: 5537969 - DNA, 19 bp, Homo sapiens
ttctcagtcggtgtgtaat

SEQ ID NO: 5537970 - DNA, 20 bp, Homo sapiens
ttctcagtggcttctccatc

SEQ ID NO: 5537971 - DNA, 15 bp, Homo sapiens
ttctcagtgtctgaa

SEQ ID NO: 5537972 - DNA, 22 bp, Homo sapiens
ttctcagttgcagaaaatgaac

SEQ ID NO: 5537973 - DNA, 17 bp, Homo sapiens
ttctcagtttctgcctg

SEQ ID NO: 5537974 - DNA, 18 bp, Homo sapiens
ttctcagtttttcttaat

SEQ ID NO: 5537975 - DNA, 19 bp, Homo sapiens
ttctcagtttttcttaata

SEQ ID NO: 5537976 - DNA, 17 bp, Homo sapiens
ttctcataattcctaca

SEQ ID NO: 5537977 - DNA, 23 bp, Homo sapiens
ttctcataattcctacagcacta

SEQ ID NO: 5537978 - DNA, 17 bp, Homo sapiens
ttctcatactatttaag

SEQ ID NO: 5537979 - DNA, 16 bp, Homo sapiens
ttctcatagccccggt

SEQ ID NO: 5537980 - DNA, 20 bp, Homo sapiens
ttctcatatccataaaattg

SEQ ID NO: 5537981 - DNA, 16 bp, Homo sapiens
ttctcatcatattgta

SEQ ID NO: 5537982 - DNA, 17 bp, Homo sapiens
ttctgaagttttatttt

SEQ ID NO: 5537983 - DNA, 23 bp, Homo sapiens
ttctgaagttttattttaaatta

SEQ ID NO: 5537984 - DNA, 11 bp, Homo sapiens
ttctgaataaa

SEQ ID NO: 5537985 - DNA, 19 bp, Homo sapiens
ttctgaataaaaaagattc

SEQ ID NO: 5537986 - DNA, 14 bp, Homo sapiens
ttctgaataaagca

SEQ ID NO: 5537987 - DNA, 17 bp, Homo sapiens
ttctgaataatttctta

SEQ ID NO: 5537988 - DNA, 22 bp, Homo sapiens
ttctgaatattttatctttcct

SEQ ID NO: 5537989 - DNA, 22 bp, Homo sapiens
ttctgaatcaccaattaaaaac

SEQ ID NO: 5537990 - DNA, 14 bp, Homo sapiens
ttctgaatcactgt

SEQ ID NO: 5537991 - DNA, 14 bp, Homo sapiens
ttctgaatgctgct

SEQ ID NO: 5537992 - DNA, 23 bp, Homo sapiens
ttctgaatgcttctaagtaaata

SEQ ID NO: 5537993 - DNA, 13 bp, Homo sapiens
ttctgaatggaaa

SEQ ID NO: 5537994 - DNA, 15 bp, Homo sapiens
ttctgaatggctgca

SEQ ID NO: 5537995 - DNA, 11 bp, Homo sapiens
ttctgaatgta

SEQ ID NO: 5537996 - DNA, 22 bp, Homo sapiens
ttctgaatgtgaaaatatttaa

SEQ ID NO: 5537997 - DNA, 19 bp, Homo sapiens
ttctgaatgtgctgatcat

SEQ ID NO: 5537998 - DNA, 20 bp, Homo sapiens
ttctgaatgtttgtgtctgt

SEQ ID NO: 5537999 - DNA, 13 bp, Homo sapiens
ttctgaattaaaa

SEQ ID NO: 5538000 - DNA, 17 bp, Homo sapiens
ttctgaattcataaaaa

SEQ ID NO: 5538001 - DNA, 23 bp, Homo sapiens
ttctgaattggctaaaagacatg

SEQ ID NO: 5538002 - DNA, 13 bp, Homo sapiens
ttctgaatttgca

SEQ ID NO: 5538003 - DNA, 15 bp, Homo sapiens
ttctgaatttgcaaa

SEQ ID NO: 5538004 - DNA, 17 bp, Homo sapiens
ttctgaatttgcaaagt

SEQ ID NO: 5538005 - DNA, 18 bp, Homo sapiens
ttctgaatttgcaaagta

SEQ ID NO: 5538006 - DNA, 19 bp, Homo sapiens
ttctgaatttgcaaagtac

SEQ ID NO: 5538007 - DNA, 22 bp, Homo sapiens
ttctgaatttgcaaagtactgt

SEQ ID NO: 5538008 - DNA, 18 bp, Homo sapiens
ttctgaattttttttctg

SEQ ID NO: 5538009 - DNA, 15 bp, Homo sapiens
ttctgacaaactgtg

SEQ ID NO: 5538010 - DNA, 16 bp, Homo sapiens
ttctgacacttgtggt

SEQ ID NO: 5538011 - DNA, 14 bp, Homo sapiens
ttctgacagagcca

SEQ ID NO: 5538012 - DNA, 20 bp, Homo sapiens
ttctgacagcccatgggaat

SEQ ID NO: 5538013 - DNA, 14 bp, Homo sapiens
ttctgacagtgttt

SEQ ID NO: 5538014 - DNA, 21 bp, Homo sapiens
ttctgacagtttttctgtttt

SEQ ID NO: 5538015 - DNA, 21 bp, Homo sapiens
ttctgacatccacatgctctg

SEQ ID NO: 5538016 - DNA, 13 bp, Homo sapiens
ttctgacatgcat

SEQ ID NO: 5538017 - DNA, 21 bp, Homo sapiens
ttctgacatgcattgttggct

SEQ ID NO: 5538018 - DNA, 18 bp, Homo sapiens
ttctgacatgtaagaaaa

SEQ ID NO: 5538019 - DNA, 23 bp, Homo sapiens
ttctgacatgtaagaaaatgtta

SEQ ID NO: 5538020 - DNA, 22 bp, Homo sapiens
ttctgacattaacagttttcca

SEQ ID NO: 5538021 - DNA, 11 bp, Homo sapiens
ttctgaccaaa

SEQ ID NO: 5538022 - DNA, 20 bp, Homo sapiens
ttctgaccaaaatgtgtttc

SEQ ID NO: 5538023 - DNA, 22 bp, Homo sapiens
ttctgaccaaaatgtgtttcat

SEQ ID NO: 5538024 - DNA, 14 bp, Homo sapiens
ttctgaccacactt

SEQ ID NO: 5538025 - DNA, 17 bp, Homo sapiens
ttctgaccacagcatca

SEQ ID NO: 5538026 - DNA, 15 bp, Homo sapiens
ttctgacccaaagca

SEQ ID NO: 5538027 - DNA, 16 bp, Homo sapiens
ttctgacccagggcct

SEQ ID NO: 5538028 - DNA, 16 bp, Homo sapiens
ttctgacccatgctgc

SEQ ID NO: 5538029 - DNA, 23 bp, Homo sapiens
ttctgaccccacttatgctgctg

SEQ ID NO: 5538030 - DNA, 20 bp, Homo sapiens
ttctgacctcatgagtgtca

SEQ ID NO: 5538031 - DNA, 21 bp, Homo sapiens
ttctgacctgttgccagcaga

SEQ ID NO: 5538032 - DNA, 16 bp, Homo sapiens
ttctgaccttgtgaac

SEQ ID NO: 5538033 - DNA, 18 bp, Homo sapiens
ttctgacgcagcctgaga

SEQ ID NO: 5538034 - DNA, 22 bp, Homo sapiens
ttctgacgcagcctgagaatga

SEQ ID NO: 5538035 - DNA, 13 bp, Homo sapiens
ttctgacggccct

SEQ ID NO: 5538036 - DNA, 14 bp, Homo sapiens
ttctgacggccctg

SEQ ID NO: 5538037 - DNA, 21 bp, Homo sapiens
ttctgacgtcagcgcaccaaa

SEQ ID NO: 5538038 - DNA, 20 bp, Homo sapiens
ttctgacgtgccttttgcac

SEQ ID NO: 5538039 - DNA, 15 bp, Homo sapiens
ttctgactccagtgg

SEQ ID NO: 5538040 - DNA, 16 bp, Homo sapiens
ttctgactctggacca

SEQ ID NO: 5538041 - DNA, 23 bp, Homo sapiens
ttctgactgcaacttctgtccct

SEQ ID NO: 5538042 - DNA, 15 bp, Homo sapiens
ttctgactgtccctg

SEQ ID NO: 5538043 - DNA, 13 bp, Homo sapiens
ttctgactgttta

SEQ ID NO: 5538044 - DNA, 19 bp, Homo sapiens
ttctgactgtttatttaag

SEQ ID NO: 5538045 - DNA, 20 bp, Homo sapiens
ttctgacttacttaaccagg

SEQ ID NO: 5538046 - DNA, 20 bp, Homo sapiens
ttctgacttctagctgtctg

SEQ ID NO: 5538047 - DNA, 21 bp, Homo sapiens
ttctgacttctagctgtctgt

SEQ ID NO: 5538048 - DNA, 20 bp, Homo sapiens
ttctgacttctcccatctag

SEQ ID NO: 5538049 - DNA, 19 bp, Homo sapiens
ttctgactttacttgtggt

SEQ ID NO: 5538050 - DNA, 14 bp, Homo sapiens
ttctgactttgaat

SEQ ID NO: 5538051 - DNA, 18 bp, Homo sapiens
ttctgactttgaatttat

SEQ ID NO: 5538052 - DNA, 18 bp, Homo sapiens
ttctgactttttgtttct

SEQ ID NO: 5538053 - DNA, 12 bp, Homo sapiens
ttctgagaaaac

SEQ ID NO: 5538054 - DNA, 13 bp, Homo sapiens
ttctgagaaaaca

SEQ ID NO: 5538055 - DNA, 18 bp, Homo sapiens
ttctgagaaggtccttaa

SEQ ID NO: 5538056 - DNA, 20 bp, Homo sapiens
ttctgagacatgtgtcaaca

SEQ ID NO: 5538057 - DNA, 13 bp, Homo sapiens
ttctgagaccagt

SEQ ID NO: 5538058 - DNA, 19 bp, Homo sapiens
ttctgagacgtcatgagga

SEQ ID NO: 5538059 - DNA, 16 bp, Homo sapiens
ttctgagacttggatt

SEQ ID NO: 5538060 - DNA, 19 bp, Homo sapiens
ttctgagagctgtgcatca

SEQ ID NO: 5538061 - DNA, 19 bp, Homo sapiens
ttctgagatggctcccagg

SEQ ID NO: 5538062 - DNA, 19 bp, Homo sapiens
ttctgagatgggagagcaa

SEQ ID NO: 5538063 - DNA, 15 bp, Homo sapiens
ttctgagcaaaggcc

SEQ ID NO: 5538064 - DNA, 21 bp, Homo sapiens
ttctgagcaccgaatattgag

SEQ ID NO: 5538065 - DNA, 22 bp, Homo sapiens
ttctgagcacgggcaaagaaaa

SEQ ID NO: 5538066 - DNA, 22 bp, Homo sapiens
ttctgagcagcgagcctgctag

SEQ ID NO: 5538067 - DNA, 23 bp, Homo sapiens
ttctgagcaggggcccctgggga

SEQ ID NO: 5538068 - DNA, 21 bp, Homo sapiens
ttctgagcagtgcctcttgtc

SEQ ID NO: 5538069 - DNA, 10 bp, Homo sapiens
ttctgagccc

SEQ ID NO: 5538070 - DNA, 11 bp, Homo sapiens
ttctgagcccc

SEQ ID NO: 5538071 - DNA, 16 bp, Homo sapiens
ttctgagccccagccc

SEQ ID NO: 5538072 - DNA, 22 bp, Homo sapiens
ttctgagcctctttaacagctt

SEQ ID NO: 5538073 - DNA, 14 bp, Homo sapiens
ttctgagcctgcct

SEQ ID NO: 5538074 - DNA, 18 bp, Homo sapiens
ttctgagccttctactta

SEQ ID NO: 5538075 - DNA, 16 bp, Homo sapiens
ttctgagctatttcat

SEQ ID NO: 5538076 - DNA, 12 bp, Homo sapiens
ttctgagctcca

SEQ ID NO: 5538077 - DNA, 14 bp, Homo sapiens
ttctgagctccacc

SEQ ID NO: 5538078 - DNA, 18 bp, Homo sapiens
ttctgagctccccatcac

SEQ ID NO: 5538079 - DNA, 20 bp, Homo sapiens
ttctgagcttttcatggaag

SEQ ID NO: 5538080 - DNA, 23 bp, Homo sapiens
ttctgaggaccgctgataagcat

SEQ ID NO: 5538081 - DNA, 13 bp, Homo sapiens
ttctgaggccaga

SEQ ID NO: 5538082 - DNA, 20 bp, Homo sapiens
ttctgagggtccactactca

SEQ ID NO: 5538083 - DNA, 17 bp, Homo sapiens
ttctgaggtgcactggg

SEQ ID NO: 5538084 - DNA, 17 bp, Homo sapiens
ttctgagtaattaataa

SEQ ID NO: 5538085 - DNA, 14 bp, Homo sapiens
ttctgagtattctc

SEQ ID NO: 5538086 - DNA, 23 bp, Homo sapiens
ttctgagtgaatgttaacatgcg

SEQ ID NO: 5538087 - DNA, 15 bp, Homo sapiens
ttctgagtgccttct

SEQ ID NO: 5538088 - DNA, 22 bp, Homo sapiens
ttctgagtgccttctgtgggga

SEQ ID NO: 5538089 - DNA, 14 bp, Homo sapiens
ttctgagttcttga

SEQ ID NO: 5538090 - DNA, 15 bp, Homo sapiens
ttctgagttttgtgt

SEQ ID NO: 5538091 - DNA, 16 bp, Homo sapiens
ttctgagttttgtgtt

SEQ ID NO: 5538092 - DNA, 22 bp, Homo sapiens
ttctgagttttgtgtttgttgt

SEQ ID NO: 5538093 - DNA, 15 bp, Homo sapiens
ttctgataaacctgt

SEQ ID NO: 5538094 - DNA, 18 bp, Homo sapiens
ttctgataaccatagcat

SEQ ID NO: 5538095 - DNA, 17 bp, Homo sapiens
ttctgataatttattgt

SEQ ID NO: 5538096 - DNA, 21 bp, Homo sapiens
ttctgataatttattgtcttt

SEQ ID NO: 5538097 - DNA, 14 bp, Homo sapiens
ttctgatactttag

SEQ ID NO: 5538098 - DNA, 21 bp, Homo sapiens
ttctgataggagggggcggca

SEQ ID NO: 5538099 - DNA, 14 bp, Homo sapiens
ttctgatatagaat

SEQ ID NO: 5538100 - DNA, 17 bp, Homo sapiens
ttctgatatgtgaattt

SEQ ID NO: 5538101 - DNA, 15 bp, Homo sapiens
ttctgatcaaggcct

SEQ ID NO: 5538102 - DNA, 23 bp, Homo sapiens
ttctgatcagaggtgtacactaa

SEQ ID NO: 5538103 - DNA, 19 bp, Homo sapiens
ttctgatcctagttccacc

SEQ ID NO: 5538104 - DNA, 15 bp, Homo sapiens
ttctgatcctctctt

SEQ ID NO: 5538105 - DNA, 16 bp, Homo sapiens
ttctgatcctctcttc

SEQ ID NO: 5538106 - DNA, 14 bp, Homo sapiens
ttctgatcttcact

SEQ ID NO: 5538107 - DNA, 18 bp, Homo sapiens
ttctgatgacataataaa

SEQ ID NO: 5538108 - DNA, 15 bp, Homo sapiens
ttctgatgacgcctg

SEQ ID NO: 5538109 - DNA, 18 bp, Homo sapiens
ttctgatgaggcatttta

SEQ ID NO: 5538110 - DNA, 14 bp, Homo sapiens
ttctgatgatgtcg

SEQ ID NO: 5538111 - DNA, 19 bp, Homo sapiens
ttctgatggccaaaatacc

SEQ ID NO: 5538112 - DNA, 13 bp, Homo sapiens
ttctgatgtatta

SEQ ID NO: 5538113 - DNA, 23 bp, Homo sapiens
ttctgatgtattacatgactgtt

SEQ ID NO: 5538114 - DNA, 17 bp, Homo sapiens
ttctgatgttactgaga

SEQ ID NO: 5538115 - DNA, 16 bp, Homo sapiens
ttctgatgtttctgtg

SEQ ID NO: 5538116 - DNA, 19 bp, Homo sapiens
ttctgatgtttctgtgaaa

SEQ ID NO: 5538117 - DNA, 14 bp, Homo sapiens
ttctgattagaaat

SEQ ID NO: 5538118 - DNA, 15 bp, Homo sapiens
ttctgattagaaatg

SEQ ID NO: 5538119 - DNA, 20 bp, Homo sapiens
ttctgattagctttgtgttt

SEQ ID NO: 5538120 - DNA, 15 bp, Homo sapiens
ttctgattattacaa

SEQ ID NO: 5538121 - DNA, 18 bp, Homo sapiens
ttctgattcactattaga

SEQ ID NO: 5538122 - DNA, 17 bp, Homo sapiens
ttctgattctagtgtgt

SEQ ID NO: 5538123 - DNA, 12 bp, Homo sapiens
ttctgattctga

SEQ ID NO: 5538124 - DNA, 13 bp, Homo sapiens
ttctgattctgat

SEQ ID NO: 5538125 - DNA, 23 bp, Homo sapiens
ttctgattctggctttaagcctt

SEQ ID NO: 5538126 - DNA, 15 bp, Homo sapiens
ttctgattcttcaaa

SEQ ID NO: 5538127 - DNA, 22 bp, Homo sapiens
ttctgattgattttttttcttg

SEQ ID NO: 5538128 - DNA, 19 bp, Homo sapiens
ttctgattgctatcagcaa

SEQ ID NO: 5538129 - DNA, 17 bp, Homo sapiens
ttctgattggtgattca

SEQ ID NO: 5538130 - DNA, 22 bp, Homo sapiens
ttctgattgtaacgttgctgtg

SEQ ID NO: 5538131 - DNA, 17 bp, Homo sapiens
ttctgatttcagttttt

SEQ ID NO: 5538132 - DNA, 20 bp, Homo sapiens
ttctgatttcagtttttcat

SEQ ID NO: 5538133 - DNA, 13 bp, Homo sapiens
ttctgatttcata

SEQ ID NO: 5538134 - DNA, 11 bp, Homo sapiens
ttctgatttct

SEQ ID NO: 5538135 - DNA, 23 bp, Homo sapiens
ttctgatttgccactgatattca

SEQ ID NO: 5538136 - DNA, 15 bp, Homo sapiens
ttctgatttttctct

SEQ ID NO: 5538137 - DNA, 18 bp, Homo sapiens
ttctgatttttttgttgt

SEQ ID NO: 5538138 - DNA, 17 bp, Homo sapiens
ttctgcaacaagcatgc

SEQ ID NO: 5538139 - DNA, 16 bp, Homo sapiens
ttctgcaacagcctgt

SEQ ID NO: 5538140 - DNA, 15 bp, Homo sapiens
ttctgcaagaattaa

SEQ ID NO: 5538141 - DNA, 18 bp, Homo sapiens
ttctgcaagaattaaaac

SEQ ID NO: 5538142 - DNA, 19 bp, Homo sapiens
ttctgcaagaattaaaact

SEQ ID NO: 5538143 - DNA, 15 bp, Homo sapiens
ttctgcaagcctgcg

SEQ ID NO: 5538144 - DNA, 18 bp, Homo sapiens
ttctgcaataacagtttt

SEQ ID NO: 5538145 - DNA, 22 bp, Homo sapiens
ttctgcaatgttattattggct

SEQ ID NO: 5538146 - DNA, 11 bp, Homo sapiens
ttctgcacagc

SEQ ID NO: 5538147 - DNA, 13 bp, Homo sapiens
ttctgcacagctt

SEQ ID NO: 5538148 - DNA, 15 bp, Homo sapiens
ttctgcacagctttt

SEQ ID NO: 5538149 - DNA, 21 bp, Homo sapiens
ttctgcacagcttttccaaaa

SEQ ID NO: 5538150 - DNA, 19 bp, Homo sapiens
ttctgcacaggtctctgtt

SEQ ID NO: 5538151 - DNA, 22 bp, Homo sapiens
ttctgcacaggtctctgtttag

SEQ ID NO: 5538152 - DNA, 18 bp, Homo sapiens
ttctgcaccacacctggc

SEQ ID NO: 5538153 - DNA, 22 bp, Homo sapiens
ttctgcaccctccaccctgtcc

SEQ ID NO: 5538154 - DNA, 16 bp, Homo sapiens
ttctgcaccttatctt

SEQ ID NO: 5538155 - DNA, 19 bp, Homo sapiens
ttctgcaccttgccaggga

SEQ ID NO: 5538156 - DNA, 16 bp, Homo sapiens
ttctgcactatatgca

SEQ ID NO: 5538157 - DNA, 13 bp, Homo sapiens
ttctgcactgaaa

SEQ ID NO: 5538158 - DNA, 15 bp, Homo sapiens
ttctgcactgaaaag

SEQ ID NO: 5538159 - DNA, 12 bp, Homo sapiens
ttctgcagaaaa

SEQ ID NO: 5538160 - DNA, 19 bp, Homo sapiens
ttctgtatttgaaagtgcc

SEQ ID NO: 5538161 - DNA, 15 bp, Homo sapiens
ttctgtattttcaaa

SEQ ID NO: 5538162 - DNA, 18 bp, Homo sapiens
ttctgtattttgtttttg

SEQ ID NO: 5538163 - DNA, 21 bp, Homo sapiens
ttctgtattttttgtttgtat

SEQ ID NO: 5538164 - DNA, 14 bp, Homo sapiens
ttctgtcaagaaga

SEQ ID NO: 5538165 - DNA, 16 bp, Homo sapiens
ttctgtcactcaggct

SEQ ID NO: 5538166 - DNA, 14 bp, Homo sapiens
ttctgtcactgtag

SEQ ID NO: 5538167 - DNA, 18 bp, Homo sapiens
ttctgtcagatgagaaca

SEQ ID NO: 5538168 - DNA, 23 bp, Homo sapiens
ttctgtcagatgagaacaaagct

SEQ ID NO: 5538169 - DNA, 16 bp, Homo sapiens
ttctgtcagtaaaact

SEQ ID NO: 5538170 - DNA, 14 bp, Homo sapiens
ttctgtcagtctga

SEQ ID NO: 5538171 - DNA, 16 bp, Homo sapiens
ttctgtcagtgttaaa

SEQ ID NO: 5538172 - DNA, 19 bp, Homo sapiens
ttctgtcatcccgctcctg

SEQ ID NO: 5538173 - DNA, 22 bp, Homo sapiens
ttctgtcatcccgctcctgctg

SEQ ID NO: 5538174 - DNA, 22 bp, Homo sapiens
ttctgtcattcccctcttttgt

SEQ ID NO: 5538175 - DNA, 16 bp, Homo sapiens
ttctgtcatttacaca

SEQ ID NO: 5538176 - DNA, 12 bp, Homo sapiens
ttctgtccagga

SEQ ID NO: 5538177 - DNA, 18 bp, Homo sapiens
ttctgtccagtttccaaa

SEQ ID NO: 5538178 - DNA, 14 bp, Homo sapiens
ttctgtccatcagt

SEQ ID NO: 5538179 - DNA, 17 bp, Homo sapiens
ttctgtcccaagtctcc

SEQ ID NO: 5538180 - DNA, 14 bp, Homo sapiens
ttctgtccccagcc

SEQ ID NO: 5538181 - DNA, 22 bp, Homo sapiens
ttctgtccccagccctgtcctg

SEQ ID NO: 5538182 - DNA, 23 bp, Homo sapiens
ttctgtccccatctaggtcctgg

SEQ ID NO: 5538183 - DNA, 13 bp, Homo sapiens
ttctgtccctagg

SEQ ID NO: 5538184 - DNA, 16 bp, Homo sapiens
ttctgtccctgtccct

SEQ ID NO: 5538185 - DNA, 21 bp, Homo sapiens
ttctgtccgagctttgaaaat

SEQ ID NO: 5538186 - DNA, 19 bp, Homo sapiens
ttctgtcctcttctgtgag

SEQ ID NO: 5538187 - DNA, 13 bp, Homo sapiens
ttctgtcctgctg

SEQ ID NO: 5538188 - DNA, 18 bp, Homo sapiens
ttctgtcctggtgtcact

SEQ ID NO: 5538189 - DNA, 15 bp, Homo sapiens
ttctgtcctgtaact

SEQ ID NO: 5538190 - DNA, 15 bp, Homo sapiens
ttctgtcctgtgagg

SEQ ID NO: 5538191 - DNA, 23 bp, Homo sapiens
ttctgtcctgtgaggtttcccaa

SEQ ID NO: 5538192 - DNA, 14 bp, Homo sapiens
ttctgtccttcaga

SEQ ID NO: 5538193 - DNA, 23 bp, Homo sapiens
ttctgtccttttggcactgagat

SEQ ID NO: 5538194 - DNA, 18 bp, Homo sapiens
ttctgtcgccttagcatg

SEQ ID NO: 5538195 - DNA, 22 bp, Homo sapiens
ttctgtcgtccccagaccagta

SEQ ID NO: 5538196 - DNA, 21 bp, Homo sapiens
ttctgtctaggttaaagctaa

SEQ ID NO: 5538197 - DNA, 22 bp, Homo sapiens
ttctgtctaggttaaagctaaa

SEQ ID NO: 5538198 - DNA, 19 bp, Homo sapiens
ttctgtctcataattgtca

SEQ ID NO: 5538199 - DNA, 16 bp, Homo sapiens
ttctgtctcatatgat

SEQ ID NO: 5538200 - DNA, 19 bp, Homo sapiens
ttctgtctcccctaccagg

SEQ ID NO: 5538201 - DNA, 14 bp, Homo sapiens
ttctgtctcccttc

SEQ ID NO: 5538202 - DNA, 22 bp, Homo sapiens
ttctgtctctaaccattcaaat

SEQ ID NO: 5538203 - DNA, 13 bp, Homo sapiens
ttctgtctgggga

SEQ ID NO: 5538204 - DNA, 20 bp, Homo sapiens
ttctgtctggtttatttagg

SEQ ID NO: 5538205 - DNA, 14 bp, Homo sapiens
ttctgtcttcccaa

SEQ ID NO: 5538206 - DNA, 20 bp, Homo sapiens
ttctgtcttggggcttttgg

SEQ ID NO: 5538207 - DNA, 14 bp, Homo sapiens
ttctgtctttatgt

SEQ ID NO: 5538208 - DNA, 13 bp, Homo sapiens
ttctgtgaaagaa

SEQ ID NO: 5538209 - DNA, 16 bp, Homo sapiens
ttctgtgaaatataat

SEQ ID NO: 5538210 - DNA, 20 bp, Homo sapiens
ttctgtgaaatataattgta

SEQ ID NO: 5538211 - DNA, 18 bp, Homo sapiens
ttctgtgaaattctcaga

SEQ ID NO: 5538212 - DNA, 11 bp, Homo sapiens
ttctgtgaaga

SEQ ID NO: 5538213 - DNA, 13 bp, Homo sapiens
ttctgtgaagaag

SEQ ID NO: 5538214 - DNA, 23 bp, Homo sapiens
ttctgtgaagaagccctgttctc

SEQ ID NO: 5538215 - DNA, 18 bp, Homo sapiens
ttctgtgaagctaataca

SEQ ID NO: 5538216 - DNA, 15 bp, Homo sapiens
ttctgtgaatagcag

SEQ ID NO: 5538217 - DNA, 17 bp, Homo sapiens
ttctgtgacatttatgt

SEQ ID NO: 5538218 - DNA, 20 bp, Homo sapiens
ttctgtgaccaaaatacctt

SEQ ID NO: 5538219 - DNA, 16 bp, Homo sapiens
ttctgtgacccatctg

SEQ ID NO: 5538220 - DNA, 18 bp, Homo sapiens
ttctgtgatgagctgatc

SEQ ID NO: 5538221 - DNA, 19 bp, Homo sapiens
ttctgtgcaataaaaccaa

SEQ ID NO: 5538222 - DNA, 20 bp, Homo sapiens
ttctgtgcactagcctgtga

SEQ ID NO: 5538223 - DNA, 17 bp, Homo sapiens
ttctgtgcatctggcct

SEQ ID NO: 5538224 - DNA, 19 bp, Homo sapiens
ttctgtgccattttctgta

SEQ ID NO: 5538225 - DNA, 24 bp, Homo sapiens
ttctgtgcccagaatactgatgga

SEQ ID NO: 5538226 - DNA, 16 bp, Homo sapiens
ttctgtgccctactca

SEQ ID NO: 5538227 - DNA, 21 bp, Homo sapiens
ttctgtgcctccccccagacc

SEQ ID NO: 5538228 - DNA, 22 bp, Homo sapiens
ttctgtgcctccccccagaccc

SEQ ID NO: 5538229 - DNA, 13 bp, Homo sapiens
ttctgtgcctgaa

SEQ ID NO: 5538230 - DNA, 17 bp, Homo sapiens
ttctgtgcctgaatatt

SEQ ID NO: 5538231 - DNA, 22 bp, Homo sapiens
ttctgtgcctgactctgtgctg

SEQ ID NO: 5538232 - DNA, 20 bp, Homo sapiens
ttctgtgctaatcaaaactt

SEQ ID NO: 5538233 - DNA, 23 bp, Homo sapiens
ttctgtggaaaaataaaggaaat

SEQ ID NO: 5538234 - DNA, 17 bp, Homo sapiens
ttctgtggaaaacaatt

SEQ ID NO: 5538235 - DNA, 16 bp, Homo sapiens
ttctgtggaaagtgta

SEQ ID NO: 5538236 - DNA, 20 bp, Homo sapiens
ttctgtggaaagtgtaaagc

SEQ ID NO: 5538237 - DNA, 22 bp, Homo sapiens
ttctgtggacaccactgagctc

SEQ ID NO: 5538238 - DNA, 14 bp, Homo sapiens
ttctgtggattcta

SEQ ID NO: 5538239 - DNA, 19 bp, Homo sapiens
ttctgtggccgccatctgc

SEQ ID NO: 5538240 - DNA, 20 bp, Homo sapiens
ttctgtggccgccatctgcg

SEQ ID NO: 5538241 - DNA, 22 bp, Homo sapiens
ttctgtggcgaggcatgctatc

SEQ ID NO: 5538242 - DNA, 12 bp, Homo sapiens
ttctgtggctca

SEQ ID NO: 5538243 - DNA, 23 bp, Homo sapiens
ttctgtggctggctctaccttcc

SEQ ID NO: 5538244 - DNA, 22 bp, Homo sapiens
ttctgtgggagaattcttacat

SEQ ID NO: 5538245 - DNA, 19 bp, Homo sapiens
ttctgtgggcatggccgct

SEQ ID NO: 5538246 - DNA, 19 bp, Homo sapiens
ttctgtgggcttggccttg

SEQ ID NO: 5538247 - DNA, 19 bp, Homo sapiens
ttctgtggggcccctcacc

SEQ ID NO: 5538248 - DNA, 15 bp, Homo sapiens
ttctgtggggctggg

SEQ ID NO: 5538249 - DNA, 17 bp, Homo sapiens
ttctgtggggctgggca

SEQ ID NO: 5538250 - DNA, 20 bp, Homo sapiens
ttctgtggtccctctgtgtc

SEQ ID NO: 5538251 - DNA, 10 bp, Homo sapiens
ttctgtggtt

SEQ ID NO: 5538252 - DNA, 21 bp, Homo sapiens
ttctgtggttctataataagt

SEQ ID NO: 5538253 - DNA, 18 bp, Homo sapiens
ttctgtggtttcatgtta

SEQ ID NO: 5538254 - DNA, 20 bp, Homo sapiens
ttctgtggttttcccctccc

SEQ ID NO: 5538255 - DNA, 21 bp, Homo sapiens
ttctgtgtaaacagaagcctg

SEQ ID NO: 5538256 - DNA, 18 bp, Homo sapiens
ttctgtgtaagcttttaa

SEQ ID NO: 5538257 - DNA, 15 bp, Homo sapiens
ttctgtgtacataaa

SEQ ID NO: 5538258 - DNA, 14 bp, Homo sapiens
ttctgtgtacattt

SEQ ID NO: 5538259 - DNA, 15 bp, Homo sapiens
ttctgtgtacttttt

SEQ ID NO: 5538260 - DNA, 16 bp, Homo sapiens
ttctgtgtagaaactg

SEQ ID NO: 5538261 - DNA, 22 bp, Homo sapiens
ttctgtgtagtatttatattta

SEQ ID NO: 5538262 - DNA, 21 bp, Homo sapiens
ttctgtgtatctctttcacat

SEQ ID NO: 5538263 - DNA, 12 bp, Homo sapiens
ttctgtgtattt

SEQ ID NO: 5538264 - DNA, 13 bp, Homo sapiens
ttctgtgtattta

SEQ ID NO: 5538265 - DNA, 18 bp, Homo sapiens
ttctgtgtattttgagat

SEQ ID NO: 5538266 - DNA, 21 bp, Homo sapiens
ttctgtgtcacgtgaccctgt

SEQ ID NO: 5538267 - DNA, 11 bp, Homo sapiens
ttctgtgtcct

SEQ ID NO: 5538268 - DNA, 16 bp, Homo sapiens
ttctgtgtctgctgta

SEQ ID NO: 5538269 - DNA, 22 bp, Homo sapiens
ttctgtgtctttcacagctcct

SEQ ID NO: 5538270 - DNA, 19 bp, Homo sapiens
ttctgtgtgccctgaaaat

SEQ ID NO: 5538271 - DNA, 19 bp, Homo sapiens
ttctgtgtggcaccttgat

SEQ ID NO: 5538272 - DNA, 20 bp, Homo sapiens
ttctgtgtgggtctggggag

SEQ ID NO: 5538273 - DNA, 18 bp, Homo sapiens
ttctgtgtggtatattgt

SEQ ID NO: 5538274 - DNA, 22 bp, Homo sapiens
ttctgtgtggtctccagctcct

SEQ ID NO: 5538275 - DNA, 21 bp, Homo sapiens
ttctgtgtgtatctaaaggat

SEQ ID NO: 5538276 - DNA, 17 bp, Homo sapiens
ttctgtgtgtcagtttt

SEQ ID NO: 5538277 - DNA, 21 bp, Homo sapiens
ttctgtgtgtcagttttcata

SEQ ID NO: 5538278 - DNA, 13 bp, Homo sapiens
ttctgtgtgttcc

SEQ ID NO: 5538279 - DNA, 14 bp, Homo sapiens
ttctgtgtgttcct

SEQ ID NO: 5538280 - DNA, 17 bp, Homo sapiens
ttctgtgtgttcctggc

SEQ ID NO: 5538281 - DNA, 20 bp, Homo sapiens
ttctgtgtgttttcataata

SEQ ID NO: 5538282 - DNA, 14 bp, Homo sapiens
ttctgtgttcattt

SEQ ID NO: 5538283 - DNA, 17 bp, Homo sapiens
ttctgtgttgaaatata

SEQ ID NO: 5538284 - DNA, 19 bp, Homo sapiens
ttctgtgttgaaatatagt

SEQ ID NO: 5538285 - DNA, 14 bp, Homo sapiens
ttctgtgtttacag

SEQ ID NO: 5538286 - DNA, 18 bp, Homo sapiens
ttctgtgtttagctattt

SEQ ID NO: 5538287 - DNA, 20 bp, Homo sapiens
ttctgtgtttagctatttaa

SEQ ID NO: 5538288 - DNA, 16 bp, Homo sapiens
ttctgtgtttctggag

SEQ ID NO: 5538289 - DNA, 18 bp, Homo sapiens
ttctgttaaaaaaataaa

SEQ ID NO: 5538290 - DNA, 15 bp, Homo sapiens
ttctgttaaaatcta

SEQ ID NO: 5538291 - DNA, 21 bp, Homo sapiens
ttctgttaaaatctattctgt

SEQ ID NO: 5538292 - DNA, 13 bp, Homo sapiens
ttctgttaaaatg

SEQ ID NO: 5538293 - DNA, 13 bp, Homo sapiens
ttctgttaactga

SEQ ID NO: 5538294 - DNA, 17 bp, Homo sapiens
ttctgttaactgaatac

SEQ ID NO: 5538295 - DNA, 20 bp, Homo sapiens
ttctgttacaaaatgtaact

SEQ ID NO: 5538296 - DNA, 22 bp, Homo sapiens
ttctgttacaaaatgtaactgt

SEQ ID NO: 5538297 - DNA, 17 bp, Homo sapiens
ttctgttacccagggct

SEQ ID NO: 5538298 - DNA, 19 bp, Homo sapiens
ttctgttagctgctcactt

SEQ ID NO: 5538299 - DNA, 14 bp, Homo sapiens
ttctgttatacaca

SEQ ID NO: 5538300 - DNA, 21 bp, Homo sapiens
ttctgttatatcccctgctac

SEQ ID NO: 5538301 - DNA, 15 bp, Homo sapiens
ttctgttattgtatt

SEQ ID NO: 5538302 - DNA, 13 bp, Homo sapiens
ttctgttcacttt

SEQ ID NO: 5538303 - DNA, 22 bp, Homo sapiens
ttctgttcatctctttgtcctg

SEQ ID NO: 5538304 - DNA, 15 bp, Homo sapiens
ttctgttcatttgtt

SEQ ID NO: 5538305 - DNA, 17 bp, Homo sapiens
ttctgttccagtcacat

SEQ ID NO: 5538306 - DNA, 13 bp, Homo sapiens
ttctgttctagtt

SEQ ID NO: 5538307 - DNA, 16 bp, Homo sapiens
ttctgttctccctggg

SEQ ID NO: 5538308 - DNA, 13 bp, Homo sapiens
ttctgttctgggg

SEQ ID NO: 5538309 - DNA, 20 bp, Homo sapiens
ttctgttctgtggaaagtgt

SEQ ID NO: 5538310 - DNA, 14 bp, Homo sapiens
ttctgttctgttga

SEQ ID NO: 5538311 - DNA, 15 bp, Homo sapiens
ttctgttcttacaaa

SEQ ID NO: 5538312 - DNA, 18 bp, Homo sapiens
ttctgttctttctggcta

SEQ ID NO: 5538313 - DNA, 19 bp, Homo sapiens
ttctgttgaaaagcacaca

SEQ ID NO: 5538314 - DNA, 17 bp, Homo sapiens
ttctgttgatcccactt

SEQ ID NO: 5538315 - DNA, 15 bp, Homo sapiens
ttctgttgctgcctc

SEQ ID NO: 5538316 - DNA, 18 bp, Homo sapiens
ttctgttgctggaggggc

SEQ ID NO: 5538317 - DNA, 21 bp, Homo sapiens
ttctgttggccagtgtgacaa

SEQ ID NO: 5538318 - DNA, 15 bp, Homo sapiens
ttctgttggtcttaa

SEQ ID NO: 5538319 - DNA, 17 bp, Homo sapiens
ttctgttgtaaagagtg

SEQ ID NO: 5538320 - DNA, 14 bp, Homo sapiens
ttctgttgtaactt

SEQ ID NO: 5538321 - DNA, 20 bp, Homo sapiens
ttctgttgtcattgctgttg

SEQ ID NO: 5538322 - DNA, 13 bp, Homo sapiens
ttctgttgtctgc

SEQ ID NO: 5538323 - DNA, 19 bp, Homo sapiens
ttctgttgtgtttgtcaaa

SEQ ID NO: 5538324 - DNA, 18 bp, Homo sapiens
ttctgttgttccatttta

SEQ ID NO: 5538325 - DNA, 13 bp, Homo sapiens
ttctgttgtttct

SEQ ID NO: 5538326 - DNA, 17 bp, Homo sapiens
ttctgtttataattgtt

SEQ ID NO: 5538327 - DNA, 18 bp, Homo sapiens
ttctgtttatggccacat

SEQ ID NO: 5538328 - DNA, 20 bp, Homo sapiens
ttctgtttattcttccagaa

SEQ ID NO: 5538329 - DNA, 17 bp, Homo sapiens
ttctgtttcaaagcaca

SEQ ID NO: 5538330 - DNA, 18 bp, Homo sapiens
ttctgtttcctcttgatc

SEQ ID NO: 5538331 - DNA, 13 bp, Homo sapiens
ttctgtttcctgg

SEQ ID NO: 5538332 - DNA, 20 bp, Homo sapiens
ttctgtttcctggcctcaga

SEQ ID NO: 5538333 - DNA, 21 bp, Homo sapiens
ttctgtttcctggcctcagag

SEQ ID NO: 5538334 - DNA, 15 bp, Homo sapiens
ttctgtttccttttt

SEQ ID NO: 5538335 - DNA, 21 bp, Homo sapiens
ttctgtttctaatttgctgct

SEQ ID NO: 5538336 - DNA, 14 bp, Homo sapiens
ttctgtttctagtt

SEQ ID NO: 5538337 - DNA, 15 bp, Homo sapiens
ttctttgccatctct

SEQ ID NO: 5538338 - DNA, 18 bp, Homo sapiens
ttctttgccatctctgct

SEQ ID NO: 5538339 - DNA, 18 bp, Homo sapiens
ttctttgcctgttcagtt

SEQ ID NO: 5538340 - DNA, 14 bp, Homo sapiens
ttctttgctagttg

SEQ ID NO: 5538341 - DNA, 23 bp, Homo sapiens
ttctttgctgcagtcatctactt

SEQ ID NO: 5538342 - DNA, 13 bp, Homo sapiens
ttctttgctgccc

SEQ ID NO: 5538343 - DNA, 16 bp, Homo sapiens
ttctttgctgtgccaa

SEQ ID NO: 5538344 - DNA, 16 bp, Homo sapiens
ttctttgcttgaacac

SEQ ID NO: 5538345 - DNA, 17 bp, Homo sapiens
ttctttggacaacagga

SEQ ID NO: 5538346 - DNA, 18 bp, Homo sapiens
ttctttggtgcctttcct

SEQ ID NO: 5538347 - DNA, 22 bp, Homo sapiens
ttctttggtgcctttcctgttc

SEQ ID NO: 5538348 - DNA, 22 bp, Homo sapiens
ttctttgtacacccatgaaaga

SEQ ID NO: 5538349 - DNA, 13 bp, Homo sapiens
ttctttgtatctt

SEQ ID NO: 5538350 - DNA, 14 bp, Homo sapiens
ttctttgtatctta

SEQ ID NO: 5538351 - DNA, 19 bp, Homo sapiens
ttctttgtcattcagttct

SEQ ID NO: 5538352 - DNA, 12 bp, Homo sapiens
ttctttgtgcct

SEQ ID NO: 5538353 - DNA, 16 bp, Homo sapiens
ttctttgtgcctttgg

SEQ ID NO: 5538354 - DNA, 14 bp, Homo sapiens
ttctttgttcctgc

SEQ ID NO: 5538355 - DNA, 15 bp, Homo sapiens
ttctttgttgcttaa

SEQ ID NO: 5538356 - DNA, 15 bp, Homo sapiens
ttctttgtttcctgg

SEQ ID NO: 5538357 - DNA, 13 bp, Homo sapiens
ttctttgtttctt

SEQ ID NO: 5538358 - DNA, 18 bp, Homo sapiens
ttctttgtttttagagac

SEQ ID NO: 5538359 - DNA, 20 bp, Homo sapiens
ttcttttaaaaatacaatta

SEQ ID NO: 5538360 - DNA, 14 bp, Homo sapiens
ttcttttaaagaag

SEQ ID NO: 5538361 - DNA, 14 bp, Homo sapiens
ttcttttaaagacc

SEQ ID NO: 5538362 - DNA, 14 bp, Homo sapiens
ttcttttaaagatt

SEQ ID NO: 5538363 - DNA, 14 bp, Homo sapiens
ttcttttaagaatc

SEQ ID NO: 5538364 - DNA, 22 bp, Homo sapiens
ttcttttaatgatgccatggca

SEQ ID NO: 5538365 - DNA, 19 bp, Homo sapiens
ttcttttactcatgatctt

SEQ ID NO: 5538366 - DNA, 13 bp, Homo sapiens
ttcttttactctg

SEQ ID NO: 5538367 - DNA, 15 bp, Homo sapiens
ttcttttactgtaat

SEQ ID NO: 5538368 - DNA, 19 bp, Homo sapiens
ttcttttagtcagaaatga

SEQ ID NO: 5538369 - DNA, 19 bp, Homo sapiens
ttcttttatatataaaata

SEQ ID NO: 5538370 - DNA, 23 bp, Homo sapiens
ttcttttatatataaaataaata

SEQ ID NO: 5538371 - DNA, 13 bp, Homo sapiens
ttcttttattaat

SEQ ID NO: 5538372 - DNA, 15 bp, Homo sapiens
ttcttttcaatgcaa

SEQ ID NO: 5538373 - DNA, 19 bp, Homo sapiens
ttcttttcacattcttata

SEQ ID NO: 5538374 - DNA, 20 bp, Homo sapiens
ttcttttcacattcttataa

SEQ ID NO: 5538375 - DNA, 17 bp, Homo sapiens
ttcttttccagaaagaa

SEQ ID NO: 5538376 - DNA, 16 bp, Homo sapiens
ttcttttccattgtca

SEQ ID NO: 5538377 - DNA, 13 bp, Homo sapiens
ttcttttcccatt

SEQ ID NO: 5538378 - DNA, 14 bp, Homo sapiens
ttcttttcccattt

SEQ ID NO: 5538379 - DNA, 22 bp, Homo sapiens
ttcttttcccttaaatacagat

SEQ ID NO: 5538380 - DNA, 14 bp, Homo sapiens
ttcttttcctgggt

SEQ ID NO: 5538381 - DNA, 14 bp, Homo sapiens
ttcttttctcagtg

SEQ ID NO: 5538382 - DNA, 12 bp, Homo sapiens
ttcttttctcat

SEQ ID NO: 5538383 - DNA, 12 bp, Homo sapiens
ttcttttctcct

SEQ ID NO: 5538384 - DNA, 13 bp, Homo sapiens
ttcttttctggaa

SEQ ID NO: 5538385 - DNA, 22 bp, Homo sapiens
ttcttttctggtgattctccag

SEQ ID NO: 5538386 - DNA, 16 bp, Homo sapiens
ttcttttgaaatgcca

SEQ ID NO: 5538387 - DNA, 23 bp, Homo sapiens
ttcttttgaatcaatctggcttc

SEQ ID NO: 5538388 - DNA, 23 bp, Homo sapiens
ttcttttgagcaactttcttaca

SEQ ID NO: 5538389 - DNA, 15 bp, Homo sapiens
ttcttttgattttgt

SEQ ID NO: 5538390 - DNA, 14 bp, Homo sapiens
ttcttttgcaattg

SEQ ID NO: 5538391 - DNA, 13 bp, Homo sapiens
ttcttttgcattt

SEQ ID NO: 5538392 - DNA, 21 bp, Homo sapiens
ttcttttgcccttcacagtgt

SEQ ID NO: 5538393 - DNA, 13 bp, Homo sapiens
ttcttttggaaag

SEQ ID NO: 5538394 - DNA, 14 bp, Homo sapiens
ttcttttgtatgta

SEQ ID NO: 5538395 - DNA, 12 bp, Homo sapiens
ttcttttgtatt

SEQ ID NO: 5538396 - DNA, 13 bp, Homo sapiens
ttcttttgtctcc

SEQ ID NO: 5538397 - DNA, 11 bp, Homo sapiens
ttcttttgtgc

SEQ ID NO: 5538398 - DNA, 18 bp, Homo sapiens
ttcttttgtgcccctgct

SEQ ID NO: 5538399 - DNA, 16 bp, Homo sapiens
ttcttttgtgtcctgc

SEQ ID NO: 5538400 - DNA, 19 bp, Homo sapiens
ttcttttgtgttggatttg

SEQ ID NO: 5538401 - DNA, 14 bp, Homo sapiens
ttcttttgttatta

SEQ ID NO: 5538402 - DNA, 13 bp, Homo sapiens
ttcttttgtttgg

SEQ ID NO: 5538403 - DNA, 14 bp, Homo sapiens
ttctttttaaatgt

SEQ ID NO: 5538404 - DNA, 15 bp, Homo sapiens
ttctttttaaatgtg

SEQ ID NO: 5538405 - DNA, 16 bp, Homo sapiens
ttctttttaagagata

SEQ ID NO: 5538406 - DNA, 21 bp, Homo sapiens
ttctttttaagtaatgtggaa

SEQ ID NO: 5538407 - DNA, 15 bp, Homo sapiens
ttctttttacagcat

SEQ ID NO: 5538408 - DNA, 16 bp, Homo sapiens
ttctttttacataact

SEQ ID NO: 5538409 - DNA, 22 bp, Homo sapiens
ttctttttacccatttgttcat

SEQ ID NO: 5538410 - DNA, 17 bp, Homo sapiens
ttctttttactgttgaa

SEQ ID NO: 5538411 - DNA, 15 bp, Homo sapiens
ttctttttcaaaaat

SEQ ID NO: 5538412 - DNA, 16 bp, Homo sapiens
ttctttttctggaaat

SEQ ID NO: 5538413 - DNA, 14 bp, Homo sapiens
ttctttttctggac

SEQ ID NO: 5538414 - DNA, 14 bp, Homo sapiens
ttctttttgaaatg

SEQ ID NO: 5538415 - DNA, 12 bp, Homo sapiens
ttctttttgaat

SEQ ID NO: 5538416 - DNA, 20 bp, Homo sapiens
ttctttttgctctaaaatat

SEQ ID NO: 5538417 - DNA, 14 bp, Homo sapiens
ttctttttgctgtt

SEQ ID NO: 5538418 - DNA, 17 bp, Homo sapiens
ttctttttggtttgcct

SEQ ID NO: 5538419 - DNA, 20 bp, Homo sapiens
ttcttttttaaatgtttctt

SEQ ID NO: 5538420 - DNA, 22 bp, Homo sapiens
ttcttttttaaatgtttcttgg

SEQ ID NO: 5538421 - DNA, 14 bp, Homo sapiens
ttcttttttatgtg

SEQ ID NO: 5538422 - DNA, 14 bp, Homo sapiens
ttcttttttattaa

SEQ ID NO: 5538423 - DNA, 17 bp, Homo sapiens
ttcttttttcagttatt

SEQ ID NO: 5538424 - DNA, 14 bp, Homo sapiens
ttcttttttcccct

SEQ ID NO: 5538425 - DNA, 16 bp, Homo sapiens
ttcttttttcctctga

SEQ ID NO: 5538426 - DNA, 21 bp, Homo sapiens
ttcttttttcggctaaaaaga

SEQ ID NO: 5538427 - DNA, 23 bp, Homo sapiens
ttcttttttgatatagaagtata

SEQ ID NO: 5538428 - DNA, 16 bp, Homo sapiens
ttctttttttagagaa

SEQ ID NO: 5538429 - DNA, 18 bp, Homo sapiens
ttctttttttccttttta

SEQ ID NO: 5538430 - DNA, 16 bp, Homo sapiens
ttctttttttgcatat

SEQ ID NO: 5538431 - DNA, 18 bp, Homo sapiens
ttctttttttgcatatta

SEQ ID NO: 5538432 - DNA, 18 bp, Homo sapiens
ttctttttttgctttgtt

SEQ ID NO: 5538433 - DNA, 14 bp, Homo sapiens
ttctttttttgtga

SEQ ID NO: 5538434 - DNA, 16 bp, Homo sapiens
ttcttttttttaatgt

SEQ ID NO: 5538435 - DNA, 17 bp, Homo sapiens
ttcttttttttaatgtt

SEQ ID NO: 5538436 - DNA, 18 bp, Homo sapiens
ttcttttttttttctgtt

SEQ ID NO: 5538437 - DNA, 22 bp, Homo sapiens
ttcttttttttttttttacagt

SEQ ID NO: 5538438 - DNA, 16 bp, Homo sapiens
ttgaaaaaaaatagat

SEQ ID NO: 5538439 - DNA, 15 bp, Homo sapiens
ttgaaaaaaacttca

SEQ ID NO: 5538440 - DNA, 17 bp, Homo sapiens
ttgaaaaaaagtttcta

SEQ ID NO: 5538441 - DNA, 12 bp, Homo sapiens
ttgaaaaaaata

SEQ ID NO: 5538442 - DNA, 20 bp, Homo sapiens
ttgaaaaaactttctctttg

SEQ ID NO: 5538443 - DNA, 12 bp, Homo sapiens
ttgaaaaaagaa

SEQ ID NO: 5538444 - DNA, 13 bp, Homo sapiens
ttgaaaaaagtta

SEQ ID NO: 5538445 - DNA, 19 bp, Homo sapiens
ttgaaaaaatagacttaaa

SEQ ID NO: 5538446 - DNA, 22 bp, Homo sapiens
ttgaaaaaatagagcctgaggg

SEQ ID NO: 5538447 - DNA, 14 bp, Homo sapiens
ttgaaaaaatattg

SEQ ID NO: 5538448 - DNA, 19 bp, Homo sapiens
ttgaaaaaatattgtttaa

SEQ ID NO: 5538449 - DNA, 15 bp, Homo sapiens
ttgaaaaaatgttct

SEQ ID NO: 5538450 - DNA, 13 bp, Homo sapiens
ttgaaaaaattaa

SEQ ID NO: 5538451 - DNA, 19 bp, Homo sapiens
ttgaaaaaatttaaaagta

SEQ ID NO: 5538452 - DNA, 11 bp, Homo sapiens
ttgaaaaacaa

SEQ ID NO: 5538453 - DNA, 14 bp, Homo sapiens
ttgaaaaactcttt

SEQ ID NO: 5538454 - DNA, 21 bp, Homo sapiens
ttgaaaaactctttattttcc

SEQ ID NO: 5538455 - DNA, 14 bp, Homo sapiens
ttgaaaaagacatt

SEQ ID NO: 5538456 - DNA, 11 bp, Homo sapiens
ttgaaaaagat

SEQ ID NO: 5538457 - DNA, 13 bp, Homo sapiens
ttgaaaaagcgaa

SEQ ID NO: 5538458 - DNA, 14 bp, Homo sapiens
ttgaaaaaggaaaa

SEQ ID NO: 5538459 - DNA, 20 bp, Homo sapiens
ttgaaaaaggaaatattctt

SEQ ID NO: 5538460 - DNA, 12 bp, Homo sapiens
ttgaaaaaggat

SEQ ID NO: 5538461 - DNA, 18 bp, Homo sapiens
ttgaaaaagttaatgctt

SEQ ID NO: 5538462 - DNA, 12 bp, Homo sapiens
ttgaaaaataaa

SEQ ID NO: 5538463 - DNA, 17 bp, Homo sapiens
ttgaaaaataaaaacca

SEQ ID NO: 5538464 - DNA, 21 bp, Homo sapiens
ttgaaaaataaaaaccataaa

SEQ ID NO: 5538465 - DNA, 20 bp, Homo sapiens
ttgaaaaatagcatatgcct

SEQ ID NO: 5538466 - DNA, 13 bp, Homo sapiens
ttgaaaaatataa

SEQ ID NO: 5538467 - DNA, 20 bp, Homo sapiens
ttgaaaaatataaaattatg

SEQ ID NO: 5538468 - DNA, 23 bp, Homo sapiens
ttgaaaaatattcatgtagatca

SEQ ID NO: 5538469 - DNA, 20 bp, Homo sapiens
ttgaaaaatctcattatttc

SEQ ID NO: 5538470 - DNA, 13 bp, Homo sapiens
ttgaaaaatgaca

SEQ ID NO: 5538471 - DNA, 15 bp, Homo sapiens
ttgaaaaatgacaat

SEQ ID NO: 5538472 - DNA, 21 bp, Homo sapiens
ttgaaaaatgtgcaaaacagc

SEQ ID NO: 5538473 - DNA, 18 bp, Homo sapiens
ttgaaaacaaacttctcg

SEQ ID NO: 5538474 - DNA, 20 bp, Homo sapiens
ttgaaaacaattcagtggtc

SEQ ID NO: 5538475 - DNA, 12 bp, Homo sapiens
ttgaaaacacac

SEQ ID NO: 5538476 - DNA, 12 bp, Homo sapiens
ttgaaaacacta

SEQ ID NO: 5538477 - DNA, 21 bp, Homo sapiens
ttgaaaacactaacaaaattt

SEQ ID NO: 5538478 - DNA, 21 bp, Homo sapiens
ttgaaaacactgttctctgcc

SEQ ID NO: 5538479 - DNA, 14 bp, Homo sapiens
ttgaaaacacttat

SEQ ID NO: 5538480 - DNA, 18 bp, Homo sapiens
ttgaaaaccaaaatgaca

SEQ ID NO: 5538481 - DNA, 22 bp, Homo sapiens
ttgaaaaccaaaatgacatctt

SEQ ID NO: 5538482 - DNA, 14 bp, Homo sapiens
ttgaaaactacatt

SEQ ID NO: 5538483 - DNA, 15 bp, Homo sapiens
ttgaaaactacattt

SEQ ID NO: 5538484 - DNA, 14 bp, Homo sapiens
ttgaaaactgacat

SEQ ID NO: 5538485 - DNA, 15 bp, Homo sapiens
ttgaaaactgacatc

SEQ ID NO: 5538486 - DNA, 14 bp, Homo sapiens
ttgaaaacttcaaa

SEQ ID NO: 5538487 - DNA, 16 bp, Homo sapiens
ttgaaaacttcaaagc

SEQ ID NO: 5538488 - DNA, 13 bp, Homo sapiens
ttgaaaagaaaga

SEQ ID NO: 5538489 - DNA, 15 bp, Homo sapiens
ttgaaaagaaagaaa

SEQ ID NO: 5538490 - DNA, 21 bp, Homo sapiens
ttgaaaagaaagtgttttatt

SEQ ID NO: 5538491 - DNA, 18 bp, Homo sapiens
ttgaaaagaacagaagga

SEQ ID NO: 5538492 - DNA, 14 bp, Homo sapiens
ttgaaaagaagaaa

SEQ ID NO: 5538493 - DNA, 20 bp, Homo sapiens
ttgaaaagaagaaagtctat

SEQ ID NO: 5538494 - DNA, 23 bp, Homo sapiens
ttgaaaagaagaaagtctatgct

SEQ ID NO: 5538495 - DNA, 22 bp, Homo sapiens
ttgaaaagactccaaagaaatg

SEQ ID NO: 5538496 - DNA, 23 bp, Homo sapiens
ttgaaaagactccaaagaaatgt

SEQ ID NO: 5538497 - DNA, 16 bp, Homo sapiens
ttgaaaagattgcaaa

SEQ ID NO: 5538498 - DNA, 17 bp, Homo sapiens
ttgaaaagattgcaaag

SEQ ID NO: 5538499 - DNA, 19 bp, Homo sapiens
ttgaaaagattgcaaaggg

SEQ ID NO: 5538500 - DNA, 15 bp, Homo sapiens
ttgaaaagcagacat

SEQ ID NO: 5538501 - DNA, 21 bp, Homo sapiens
ttgaaaagccatgtttaagat

SEQ ID NO: 5538502 - DNA, 21 bp, Homo sapiens
ttgaaaagcttcttaattaat

SEQ ID NO: 5538503 - DNA, 22 bp, Homo sapiens
ttgaaaagcttcttaattaatt

SEQ ID NO: 5538504 - DNA, 16 bp, Homo sapiens
ttgaaaaggtgacctt

SEQ ID NO: 5538505 - DNA, 16 bp, Homo sapiens
ttgaaaagtaaaaaat

SEQ ID NO: 5538506 - DNA, 15 bp, Homo sapiens
ttgaaaagtgtcctc

SEQ ID NO: 5538507 - DNA, 14 bp, Homo sapiens
ttgaaaagttgaaa

SEQ ID NO: 5538508 - DNA, 13 bp, Homo sapiens
ttgaaaatacatt

SEQ ID NO: 5538509 - DNA, 20 bp, Homo sapiens
ttgaaaatatgtactgtata

SEQ ID NO: 5538510 - DNA, 14 bp, Homo sapiens
ttgaaaatatttct

SEQ ID NO: 5538511 - DNA, 22 bp, Homo sapiens
ttgaaaatatttctatgtaaat

SEQ ID NO: 5538512 - DNA, 14 bp, Homo sapiens
ttgaaaatgccacc

SEQ ID NO: 5538513 - DNA, 15 bp, Homo sapiens
ttgaaaatgctctta

SEQ ID NO: 5538514 - DNA, 19 bp, Homo sapiens
ttgaaaatggtattaaaga

SEQ ID NO: 5538515 - DNA, 20 bp, Homo sapiens
ttgaaaatgtaagtaaatgt

SEQ ID NO: 5538516 - DNA, 23 bp, Homo sapiens
ttgaaaatgtacatgttcctttg

SEQ ID NO: 5538517 - DNA, 17 bp, Homo sapiens
ttgaaaatgtgtttgct

SEQ ID NO: 5538518 - DNA, 13 bp, Homo sapiens
ttgacattctaca

SEQ ID NO: 5538519 - DNA, 14 bp, Homo sapiens
ttgacattctctat

SEQ ID NO: 5538520 - DNA, 13 bp, Homo sapiens
ttgacattctgaa

SEQ ID NO: 5538521 - DNA, 18 bp, Homo sapiens
ttgacattctgaatgctt

SEQ ID NO: 5538522 - DNA, 13 bp, Homo sapiens
ttgacattcttca

SEQ ID NO: 5538523 - DNA, 19 bp, Homo sapiens
ttgacattgtcagaatgtt

SEQ ID NO: 5538524 - DNA, 17 bp, Homo sapiens
ttgacatttacaggagg

SEQ ID NO: 5538525 - DNA, 17 bp, Homo sapiens
ttgacatttatattaaa

SEQ ID NO: 5538526 - DNA, 15 bp, Homo sapiens
ttgacatttgtagtt

SEQ ID NO: 5538527 - DNA, 15 bp, Homo sapiens
ttgaccaagaactgc

SEQ ID NO: 5538528 - DNA, 21 bp, Homo sapiens
ttgaccaagaactgcatggac

SEQ ID NO: 5538529 - DNA, 18 bp, Homo sapiens
ttgaccaagcaggaagct

SEQ ID NO: 5538530 - DNA, 14 bp, Homo sapiens
ttgaccactgacag

SEQ ID NO: 5538531 - DNA, 23 bp, Homo sapiens
ttgaccactgacagcctccacct

SEQ ID NO: 5538532 - DNA, 15 bp, Homo sapiens
ttgaccactggccct

SEQ ID NO: 5538533 - DNA, 16 bp, Homo sapiens
ttgaccactgtctttt

SEQ ID NO: 5538534 - DNA, 21 bp, Homo sapiens
ttgaccagaactttttcctct

SEQ ID NO: 5538535 - DNA, 12 bp, Homo sapiens
ttgaccagacct

SEQ ID NO: 5538536 - DNA, 21 bp, Homo sapiens
ttgaccagacctagacctggg

SEQ ID NO: 5538537 - DNA, 12 bp, Homo sapiens
ttgaccagctct

SEQ ID NO: 5538538 - DNA, 13 bp, Homo sapiens
ttgaccaggaaag

SEQ ID NO: 5538539 - DNA, 11 bp, Homo sapiens
ttgaccaggcc

SEQ ID NO: 5538540 - DNA, 11 bp, Homo sapiens
ttgaccaggct

SEQ ID NO: 5538541 - DNA, 18 bp, Homo sapiens
ttgaccagtataaaatta

SEQ ID NO: 5538542 - DNA, 20 bp, Homo sapiens
ttgaccagtttaagccgcag

SEQ ID NO: 5538543 - DNA, 17 bp, Homo sapiens
ttgaccatctgctttta

SEQ ID NO: 5538544 - DNA, 15 bp, Homo sapiens
ttgaccattaataaa

SEQ ID NO: 5538545 - DNA, 15 bp, Homo sapiens
ttgaccattctcacc

SEQ ID NO: 5538546 - DNA, 17 bp, Homo sapiens
ttgaccattctccacct

SEQ ID NO: 5538547 - DNA, 24 bp, Homo sapiens
ttgaccattctccacctgccaggg

SEQ ID NO: 5538548 - DNA, 15 bp, Homo sapiens
ttgaccattggctgc

SEQ ID NO: 5538549 - DNA, 14 bp, Homo sapiens
ttgacccacaagaa

SEQ ID NO: 5538550 - DNA, 12 bp, Homo sapiens
ttgacccactca

SEQ ID NO: 5538551 - DNA, 15 bp, Homo sapiens
ttgaccccagtttct

SEQ ID NO: 5538552 - DNA, 17 bp, Homo sapiens
ttgaccccgatatattt

SEQ ID NO: 5538553 - DNA, 14 bp, Homo sapiens
ttgacccctcctga

SEQ ID NO: 5538554 - DNA, 13 bp, Homo sapiens
ttgaccccttcct

SEQ ID NO: 5538555 - DNA, 14 bp, Homo sapiens
ttgaccccttcctg

SEQ ID NO: 5538556 - DNA, 13 bp, Homo sapiens
ttgacccctttcc

SEQ ID NO: 5538557 - DNA, 15 bp, Homo sapiens
ttgaccctgcaccct

SEQ ID NO: 5538558 - DNA, 17 bp, Homo sapiens
ttgaccctttcctcccc

SEQ ID NO: 5538559 - DNA, 15 bp, Homo sapiens
ttgaccgacagcttt

SEQ ID NO: 5538560 - DNA, 20 bp, Homo sapiens
ttgaccgcgactaatttcaa

SEQ ID NO: 5538561 - DNA, 20 bp, Homo sapiens
ttgaccgtgaggccagagac

SEQ ID NO: 5538562 - DNA, 21 bp, Homo sapiens
ttgaccgtgaggccagagaca

SEQ ID NO: 5538563 - DNA, 22 bp, Homo sapiens
ttgaccgtttttatattacttt

SEQ ID NO: 5538564 - DNA, 19 bp, Homo sapiens
ttgacctcaaaagaaaatg

SEQ ID NO: 5538565 - DNA, 20 bp, Homo sapiens
ttgacctcaatggaggtttg

SEQ ID NO: 5538566 - DNA, 21 bp, Homo sapiens
ttgacctcctccctgttattt

SEQ ID NO: 5538567 - DNA, 13 bp, Homo sapiens
ttgacctctcagg

SEQ ID NO: 5538568 - DNA, 15 bp, Homo sapiens
ttgacctctcagggc

SEQ ID NO: 5538569 - DNA, 19 bp, Homo sapiens
ttgacctctcagggcctgg

SEQ ID NO: 5538570 - DNA, 14 bp, Homo sapiens
ttgacctctgcagc

SEQ ID NO: 5538571 - DNA, 19 bp, Homo sapiens
ttgacctgacgatcttccc

SEQ ID NO: 5538572 - DNA, 23 bp, Homo sapiens
ttgacctgacgatcttccccctt

SEQ ID NO: 5538573 - DNA, 18 bp, Homo sapiens
ttgacctgaggagacatc

SEQ ID NO: 5538574 - DNA, 19 bp, Homo sapiens
ttgacctgaggctgtggtc

SEQ ID NO: 5538575 - DNA, 19 bp, Homo sapiens
ttgacctgcattgtaaata

SEQ ID NO: 5538576 - DNA, 16 bp, Homo sapiens
ttgacctgctccgctg

SEQ ID NO: 5538577 - DNA, 21 bp, Homo sapiens
ttgacctgctccgctgctcct

SEQ ID NO: 5538578 - DNA, 23 bp, Homo sapiens
ttgacctggaggggagaggtcag

SEQ ID NO: 5538579 - DNA, 15 bp, Homo sapiens
ttgacctgtcctctt

SEQ ID NO: 5538580 - DNA, 19 bp, Homo sapiens
ttgacctgtttctctttgt

SEQ ID NO: 5538581 - DNA, 23 bp, Homo sapiens
ttgaccttctccctcactcctgc

SEQ ID NO: 5538582 - DNA, 12 bp, Homo sapiens
ttgaccttgtat

SEQ ID NO: 5538583 - DNA, 13 bp, Homo sapiens
ttgacctttattt

SEQ ID NO: 5538584 - DNA, 21 bp, Homo sapiens
ttgacctttgaggtctaaaca

SEQ ID NO: 5538585 - DNA, 14 bp, Homo sapiens
ttgacctttgtaca

SEQ ID NO: 5538586 - DNA, 21 bp, Homo sapiens
ttgacgaagaaacaaaaaaca

SEQ ID NO: 5538587 - DNA, 16 bp, Homo sapiens
ttgacgaagtctcttt

SEQ ID NO: 5538588 - DNA, 19 bp, Homo sapiens
ttgacgaatattgcttact

SEQ ID NO: 5538589 - DNA, 17 bp, Homo sapiens
ttgacgccatcccagcc

SEQ ID NO: 5538590 - DNA, 20 bp, Homo sapiens
ttgacgccatcccagcccca

SEQ ID NO: 5538591 - DNA, 20 bp, Homo sapiens
ttgacgcgagaggctctgag

SEQ ID NO: 5538592 - DNA, 14 bp, Homo sapiens
ttgacgggccaggc

SEQ ID NO: 5538593 - DNA, 15 bp, Homo sapiens
ttgacgggctgtccg

SEQ ID NO: 5538594 - DNA, 22 bp, Homo sapiens
ttgacgtcactttttggccatg

SEQ ID NO: 5538595 - DNA, 17 bp, Homo sapiens
ttgacgttgttgtcatt

SEQ ID NO: 5538596 - DNA, 15 bp, Homo sapiens
ttgacgtttcttctt

SEQ ID NO: 5538597 - DNA, 19 bp, Homo sapiens
ttgacgtttcttctttcta

SEQ ID NO: 5538598 - DNA, 20 bp, Homo sapiens
ttgacgtttcttctttctag

SEQ ID NO: 5538599 - DNA, 16 bp, Homo sapiens
ttgactaatttcacat

SEQ ID NO: 5538600 - DNA, 22 bp, Homo sapiens
ttgactagaaaatttaaaacat

SEQ ID NO: 5538601 - DNA, 16 bp, Homo sapiens
ttgactataaaaactg

SEQ ID NO: 5538602 - DNA, 18 bp, Homo sapiens
ttgactataaaaactgcc

SEQ ID NO: 5538603 - DNA, 17 bp, Homo sapiens
ttgactatcaaactgaa

SEQ ID NO: 5538604 - DNA, 20 bp, Homo sapiens
ttgactattacactgcctgg

SEQ ID NO: 5538605 - DNA, 20 bp, Homo sapiens
ttgactcaagtttttacaaa

SEQ ID NO: 5538606 - DNA, 19 bp, Homo sapiens
ttgactcacctgttacttg

SEQ ID NO: 5538607 - DNA, 17 bp, Homo sapiens
ttgactcagaggctggg

SEQ ID NO: 5538608 - DNA, 15 bp, Homo sapiens
ttgactcaggattta

SEQ ID NO: 5538609 - DNA, 23 bp, Homo sapiens
ttgactcaggatttaaaaactgg

SEQ ID NO: 5538610 - DNA, 16 bp, Homo sapiens
ttgactcatggcagct

SEQ ID NO: 5538611 - DNA, 21 bp, Homo sapiens
ttgactcctttccaatagaaa

SEQ ID NO: 5538612 - DNA, 22 bp, Homo sapiens
ttgactctcacactgaatcagc

SEQ ID NO: 5538613 - DNA, 13 bp, Homo sapiens
ttgactctgggga

SEQ ID NO: 5538614 - DNA, 18 bp, Homo sapiens
ttgactctggggtgcagc

SEQ ID NO: 5538615 - DNA, 19 bp, Homo sapiens
ttgactcttatttatagaa

SEQ ID NO: 5538616 - DNA, 16 bp, Homo sapiens
ttgactcttccgtgca

SEQ ID NO: 5538617 - DNA, 17 bp, Homo sapiens
ttgactcttccgtgcat

SEQ ID NO: 5538618 - DNA, 15 bp, Homo sapiens
ttgactctttcaaag

SEQ ID NO: 5538619 - DNA, 20 bp, Homo sapiens
ttgactgaaaaaaaaaaaga

SEQ ID NO: 5538620 - DNA, 20 bp, Homo sapiens
ttgactgaagccgtgcctgt

SEQ ID NO: 5538621 - DNA, 23 bp, Homo sapiens
ttgactgaagcgaacatcttcat

SEQ ID NO: 5538622 - DNA, 18 bp, Homo sapiens
ttgactgccctcttactg

SEQ ID NO: 5538623 - DNA, 21 bp, Homo sapiens
ttgactgccctcttactgttt

SEQ ID NO: 5538624 - DNA, 22 bp, Homo sapiens
ttgactgccctcttactgtttt

SEQ ID NO: 5538625 - DNA, 11 bp, Homo sapiens
ttgactggctt

SEQ ID NO: 5538626 - DNA, 22 bp, Homo sapiens
ttgactgggcaacactgcagga

SEQ ID NO: 5538627 - DNA, 17 bp, Homo sapiens
ttgactgggtttctctg

SEQ ID NO: 5538628 - DNA, 23 bp, Homo sapiens
ttgactgggtttctctgtatagt

SEQ ID NO: 5538629 - DNA, 21 bp, Homo sapiens
ttgactggtttacaggccctg

SEQ ID NO: 5538630 - DNA, 12 bp, Homo sapiens
ttgactgtaatg

SEQ ID NO: 5538631 - DNA, 17 bp, Homo sapiens
ttgactgtacagagact

SEQ ID NO: 5538632 - DNA, 22 bp, Homo sapiens
ttgactgtaggcgcccctgggg

SEQ ID NO: 5538633 - DNA, 15 bp, Homo sapiens
ttgactgtgattaga

SEQ ID NO: 5538634 - DNA, 21 bp, Homo sapiens
ttgactgtgattagatcacat

SEQ ID NO: 5538635 - DNA, 20 bp, Homo sapiens
ttgactgtgatttatttgga

SEQ ID NO: 5538636 - DNA, 18 bp, Homo sapiens
ttgactgtgctagctaaa

SEQ ID NO: 5538637 - DNA, 18 bp, Homo sapiens
ttgacttatagtacatga

SEQ ID NO: 5538638 - DNA, 16 bp, Homo sapiens
ttgacttattttctct

SEQ ID NO: 5538639 - DNA, 18 bp, Homo sapiens
ttgacttcattttatatt

SEQ ID NO: 5538640 - DNA, 23 bp, Homo sapiens
ttgacttcattttatatttaaaa

SEQ ID NO: 5538641 - DNA, 19 bp, Homo sapiens
ttgacttgaaaagaaagaa

SEQ ID NO: 5538642 - DNA, 15 bp, Homo sapiens
ttgacttgccactgc

SEQ ID NO: 5538643 - DNA, 20 bp, Homo sapiens
ttgacttgtataacatcact

SEQ ID NO: 5538644 - DNA, 21 bp, Homo sapiens
ttgacttgtttgtgcatcctg

SEQ ID NO: 5538645 - DNA, 14 bp, Homo sapiens
ttgactttaaagat

SEQ ID NO: 5538646 - DNA, 17 bp, Homo sapiens
ttgactttatctcctgc

SEQ ID NO: 5538647 - DNA, 13 bp, Homo sapiens
ttgactttcaggt

SEQ ID NO: 5538648 - DNA, 13 bp, Homo sapiens
ttgactttccaga

SEQ ID NO: 5538649 - DNA, 16 bp, Homo sapiens
ttgactttccagaatg

SEQ ID NO: 5538650 - DNA, 13 bp, Homo sapiens
ttgactttcccca

SEQ ID NO: 5538651 - DNA, 22 bp, Homo sapiens
ttgactttccccaccagatgct

SEQ ID NO: 5538652 - DNA, 23 bp, Homo sapiens
ttgactttccccaccagatgctg

SEQ ID NO: 5538653 - DNA, 18 bp, Homo sapiens
ttgactttcttaaaaata

SEQ ID NO: 5538654 - DNA, 14 bp, Homo sapiens
ttgactttgctcct

SEQ ID NO: 5538655 - DNA, 19 bp, Homo sapiens
ttgactttgttcacagcat

SEQ ID NO: 5538656 - DNA, 18 bp, Homo sapiens
ttgacttttctgtaattc

SEQ ID NO: 5538657 - DNA, 19 bp, Homo sapiens
ttgactttttaaaaaagtt

SEQ ID NO: 5538658 - DNA, 17 bp, Homo sapiens
ttgactttttaaaattc

SEQ ID NO: 5538659 - DNA, 17 bp, Homo sapiens
ttgactttttgcattta

SEQ ID NO: 5538660 - DNA, 13 bp, Homo sapiens
ttgactttttgga

SEQ ID NO: 5538661 - DNA, 21 bp, Homo sapiens
ttgagaaaaaaagaatagttg

SEQ ID NO: 5538662 - DNA, 14 bp, Homo sapiens
ttgagaaaagagtg

SEQ ID NO: 5538663 - DNA, 15 bp, Homo sapiens
ttgagaaaaggtttg

SEQ ID NO: 5538664 - DNA, 12 bp, Homo sapiens
ttgagaaagaaa

SEQ ID NO: 5538665 - DNA, 23 bp, Homo sapiens
ttgagaaatactatatatacaat

SEQ ID NO: 5538666 - DNA, 21 bp, Homo sapiens
ttgagaaatatggacacttaa

SEQ ID NO: 5538667 - DNA, 16 bp, Homo sapiens
ttgagaaatgaataat

SEQ ID NO: 5538668 - DNA, 22 bp, Homo sapiens
ttgagaacattccctggaattg

SEQ ID NO: 5538669 - DNA, 17 bp, Homo sapiens
ttgagaaccagtctcct

SEQ ID NO: 5538670 - DNA, 22 bp, Homo sapiens
ttgagaaccttggaccactcct

SEQ ID NO: 5538671 - DNA, 13 bp, Homo sapiens
ttgagaactgaca

SEQ ID NO: 5538672 - DNA, 19 bp, Homo sapiens
ttgagaactgcatatgttt

SEQ ID NO: 5538673 - DNA, 18 bp, Homo sapiens
ttgagaactttatttcca

SEQ ID NO: 5538674 - DNA, 18 bp, Homo sapiens
ttgagaagaaaacatcta

SEQ ID NO: 5538675 - DNA, 22 bp, Homo sapiens
ttgagaagacctcacctagaaa

SEQ ID NO: 5538676 - DNA, 18 bp, Homo sapiens
ttgagaagcacaactgaa

SEQ ID NO: 5538677 - DNA, 19 bp, Homo sapiens
ttgagaagccttcagctcc

SEQ ID NO: 5538678 - DNA, 17 bp, Homo sapiens
ttgagaagcgtatgttt

SEQ ID NO: 5538679 - DNA, 20 bp, Homo sapiens
ttgagaaggaaaattttagc

SEQ ID NO: 5538680 - DNA, 16 bp, Homo sapiens
ttgagaaggaaataaa

SEQ ID NO: 5538681 - DNA, 17 bp, Homo sapiens
ttgagaaggagagaaag

SEQ ID NO: 5538682 - DNA, 16 bp, Homo sapiens
ttgagaaggtgcctgc

SEQ ID NO: 5538683 - DNA, 17 bp, Homo sapiens
ttgagaataaatgagca

SEQ ID NO: 5538684 - DNA, 17 bp, Homo sapiens
ttgagaatagaaatttg

SEQ ID NO: 5538685 - DNA, 20 bp, Homo sapiens
ttgagaatattataaaaata

SEQ ID NO: 5538686 - DNA, 23 bp, Homo sapiens
ttgagaatgagggcgtgaaacac

SEQ ID NO: 5538687 - DNA, 18 bp, Homo sapiens
ttgagaatggttacaaag

SEQ ID NO: 5538688 - DNA, 18 bp, Homo sapiens
ttgagaattttgtttcaa

SEQ ID NO: 5538689 - DNA, 16 bp, Homo sapiens
ttgagacaaaaattat

SEQ ID NO: 5538690 - DNA, 23 bp, Homo sapiens
ttgagacaaaaattatctatttg

SEQ ID NO: 5538691 - DNA, 20 bp, Homo sapiens
ttgagacaagccctggcaac

SEQ ID NO: 5538692 - DNA, 15 bp, Homo sapiens
ttgagacactgtcaa

SEQ ID NO: 5538693 - DNA, 16 bp, Homo sapiens
ttgagacactgtcaag

SEQ ID NO: 5538694 - DNA, 11 bp, Homo sapiens
ttgagacagag

SEQ ID NO: 5538695 - DNA, 16 bp, Homo sapiens
ttgattaacaaatatg

SEQ ID NO: 5538696 - DNA, 14 bp, Homo sapiens
ttgattaacaatgt

SEQ ID NO: 5538697 - DNA, 15 bp, Homo sapiens
ttgattaacaatgta

SEQ ID NO: 5538698 - DNA, 18 bp, Homo sapiens
ttgattaagaaaggaagt

SEQ ID NO: 5538699 - DNA, 17 bp, Homo sapiens
ttgattaagattttaca

SEQ ID NO: 5538700 - DNA, 20 bp, Homo sapiens
ttgattaagattttacaaaa

SEQ ID NO: 5538701 - DNA, 17 bp, Homo sapiens
ttgattaatgtactttt

SEQ ID NO: 5538702 - DNA, 22 bp, Homo sapiens
ttgattaatgtactttttattg

SEQ ID NO: 5538703 - DNA, 14 bp, Homo sapiens
ttgattaatttgag

SEQ ID NO: 5538704 - DNA, 18 bp, Homo sapiens
ttgattacaaataaacag

SEQ ID NO: 5538705 - DNA, 11 bp, Homo sapiens
ttgattacata

SEQ ID NO: 5538706 - DNA, 23 bp, Homo sapiens
ttgattacttcttatttttctta

SEQ ID NO: 5538707 - DNA, 22 bp, Homo sapiens
ttgattagtataatatttctta

SEQ ID NO: 5538708 - DNA, 17 bp, Homo sapiens
ttgattataccactgca

SEQ ID NO: 5538709 - DNA, 18 bp, Homo sapiens
ttgattatataagcaaaa

SEQ ID NO: 5538710 - DNA, 19 bp, Homo sapiens
ttgattatcttcagcccag

SEQ ID NO: 5538711 - DNA, 13 bp, Homo sapiens
ttgattatgcaga

SEQ ID NO: 5538712 - DNA, 13 bp, Homo sapiens
ttgattatgcata

SEQ ID NO: 5538713 - DNA, 14 bp, Homo sapiens
ttgattattatgtt

SEQ ID NO: 5538714 - DNA, 23 bp, Homo sapiens
ttgattatttgcatgttatgttt

SEQ ID NO: 5538715 - DNA, 12 bp, Homo sapiens
ttgattcaaaat

SEQ ID NO: 5538716 - DNA, 13 bp, Homo sapiens
ttgattcaaataa

SEQ ID NO: 5538717 - DNA, 17 bp, Homo sapiens
ttgattcaaggctcaga

SEQ ID NO: 5538718 - DNA, 13 bp, Homo sapiens
ttgattcacatgt

SEQ ID NO: 5538719 - DNA, 14 bp, Homo sapiens
ttgattcacatgtt

SEQ ID NO: 5538720 - DNA, 22 bp, Homo sapiens
ttgattcacctcctaaaacaac

SEQ ID NO: 5538721 - DNA, 13 bp, Homo sapiens
ttgattcacttca

SEQ ID NO: 5538722 - DNA, 16 bp, Homo sapiens
ttgattcagacagctg

SEQ ID NO: 5538723 - DNA, 17 bp, Homo sapiens
ttgattcagacagctgc

SEQ ID NO: 5538724 - DNA, 23 bp, Homo sapiens
ttgattcagacagctgcctggga

SEQ ID NO: 5538725 - DNA, 14 bp, Homo sapiens
ttgattcagcaaaa

SEQ ID NO: 5538726 - DNA, 17 bp, Homo sapiens
ttgattcagcaaaaatc

SEQ ID NO: 5538727 - DNA, 16 bp, Homo sapiens
ttgattcagctctgca

SEQ ID NO: 5538728 - DNA, 14 bp, Homo sapiens
ttgattcagtatct

SEQ ID NO: 5538729 - DNA, 17 bp, Homo sapiens
ttgattcagtcttctgg

SEQ ID NO: 5538730 - DNA, 13 bp, Homo sapiens
ttgattcatctct

SEQ ID NO: 5538731 - DNA, 16 bp, Homo sapiens
ttgattcatctctggt

SEQ ID NO: 5538732 - DNA, 15 bp, Homo sapiens
ttgattcattttcct

SEQ ID NO: 5538733 - DNA, 13 bp, Homo sapiens
ttgattccactga

SEQ ID NO: 5538734 - DNA, 22 bp, Homo sapiens
ttgattccattccatggaaata

SEQ ID NO: 5538735 - DNA, 17 bp, Homo sapiens
ttgattccattttaagt

SEQ ID NO: 5538736 - DNA, 17 bp, Homo sapiens
ttgattcccataacata

SEQ ID NO: 5538737 - DNA, 18 bp, Homo sapiens
ttgattcctcgcgacatc

SEQ ID NO: 5538738 - DNA, 13 bp, Homo sapiens
ttgattcctggtt

SEQ ID NO: 5538739 - DNA, 23 bp, Homo sapiens
ttgattctccttttatgtgtagt

SEQ ID NO: 5538740 - DNA, 13 bp, Homo sapiens
ttgattctctcca

SEQ ID NO: 5538741 - DNA, 12 bp, Homo sapiens
ttgattctgcag

SEQ ID NO: 5538742 - DNA, 13 bp, Homo sapiens
ttgattctgtccc

SEQ ID NO: 5538743 - DNA, 19 bp, Homo sapiens
ttgattcttgaaaactggg

SEQ ID NO: 5538744 - DNA, 12 bp, Homo sapiens
ttgattctttca

SEQ ID NO: 5538745 - DNA, 18 bp, Homo sapiens
ttgattgaaaaaagagaa

SEQ ID NO: 5538746 - DNA, 19 bp, Homo sapiens
ttgattgaaaaaagagaaa

SEQ ID NO: 5538747 - DNA, 22 bp, Homo sapiens
ttgattgagaaagatgttccag

SEQ ID NO: 5538748 - DNA, 13 bp, Homo sapiens
ttgattgaggagc

SEQ ID NO: 5538749 - DNA, 13 bp, Homo sapiens
ttgattgatttga

SEQ ID NO: 5538750 - DNA, 12 bp, Homo sapiens
ttgattgcatat

SEQ ID NO: 5538751 - DNA, 13 bp, Homo sapiens
ttgattgctgtgt

SEQ ID NO: 5538752 - DNA, 18 bp, Homo sapiens
ttgattggataaatgctt

SEQ ID NO: 5538753 - DNA, 21 bp, Homo sapiens
ttgattggggaattaaaagtc

SEQ ID NO: 5538754 - DNA, 21 bp, Homo sapiens
ttgattggtgattaggtggtg

SEQ ID NO: 5538755 - DNA, 16 bp, Homo sapiens
ttgattgtcaaataca

SEQ ID NO: 5538756 - DNA, 20 bp, Homo sapiens
ttgattgtcagccacctccc

SEQ ID NO: 5538757 - DNA, 21 bp, Homo sapiens
ttgattgtcagccacctccct

SEQ ID NO: 5538758 - DNA, 15 bp, Homo sapiens
ttgattgtctttccc

SEQ ID NO: 5538759 - DNA, 12 bp, Homo sapiens
ttgattgtgcat

SEQ ID NO: 5538760 - DNA, 14 bp, Homo sapiens
ttgattgtgttttc

SEQ ID NO: 5538761 - DNA, 21 bp, Homo sapiens
ttgattgttataaaataacat

SEQ ID NO: 5538762 - DNA, 22 bp, Homo sapiens
ttgattgttttattttggaatt

SEQ ID NO: 5538763 - DNA, 20 bp, Homo sapiens
ttgatttaactgacttaaca

SEQ ID NO: 5538764 - DNA, 14 bp, Homo sapiens
ttgatttaatatct

SEQ ID NO: 5538765 - DNA, 11 bp, Homo sapiens
ttgatttacag

SEQ ID NO: 5538766 - DNA, 17 bp, Homo sapiens
ttgatttacctttggaa

SEQ ID NO: 5538767 - DNA, 19 bp, Homo sapiens
ttgatttacctttggaatt

SEQ ID NO: 5538768 - DNA, 13 bp, Homo sapiens
ttgatttattaac

SEQ ID NO: 5538769 - DNA, 12 bp, Homo sapiens
ttgatttcaaca

SEQ ID NO: 5538770 - DNA, 11 bp, Homo sapiens
ttgatttcctc

SEQ ID NO: 5538771 - DNA, 12 bp, Homo sapiens
ttgatttctaag

SEQ ID NO: 5538772 - DNA, 22 bp, Homo sapiens
ttgatttctacgttatgaaaac

SEQ ID NO: 5538773 - DNA, 20 bp, Homo sapiens
ttgatttctagtatctattg

SEQ ID NO: 5538774 - DNA, 23 bp, Homo sapiens
ttgatttgaacaaattttctggt

SEQ ID NO: 5538775 - DNA, 16 bp, Homo sapiens
ttgatttgaagtggaa

SEQ ID NO: 5538776 - DNA, 15 bp, Homo sapiens
ttgatttgagaaatt

SEQ ID NO: 5538777 - DNA, 13 bp, Homo sapiens
ttgatttgagatt

SEQ ID NO: 5538778 - DNA, 18 bp, Homo sapiens
ttgatttgtaccattcct

SEQ ID NO: 5538779 - DNA, 19 bp, Homo sapiens
ttgatttgtcactgcttca

SEQ ID NO: 5538780 - DNA, 15 bp, Homo sapiens
ttgattttaaaatgt

SEQ ID NO: 5538781 - DNA, 20 bp, Homo sapiens
ttgattttagccttctctgt

SEQ ID NO: 5538782 - DNA, 14 bp, Homo sapiens
ttgattttcatatc

SEQ ID NO: 5538783 - DNA, 20 bp, Homo sapiens
ttgattttccccctaattct

SEQ ID NO: 5538784 - DNA, 16 bp, Homo sapiens
ttgattttctgttgta

SEQ ID NO: 5538785 - DNA, 15 bp, Homo sapiens
ttgattttgctgact

SEQ ID NO: 5538786 - DNA, 21 bp, Homo sapiens
ttgattttgctgactttaaaa

SEQ ID NO: 5538787 - DNA, 21 bp, Homo sapiens
ttgatttttaagaaagtaatt

SEQ ID NO: 5538788 - DNA, 14 bp, Homo sapiens
ttgatttttatctc

SEQ ID NO: 5538789 - DNA, 15 bp, Homo sapiens
ttgatttttatttta

SEQ ID NO: 5538790 - DNA, 20 bp, Homo sapiens
ttgatttttcaaagacttca

SEQ ID NO: 5538791 - DNA, 15 bp, Homo sapiens
ttgatttttgtctca

SEQ ID NO: 5538792 - DNA, 18 bp, Homo sapiens
ttgatttttttaaacata

SEQ ID NO: 5538793 - DNA, 17 bp, Homo sapiens
ttgcaaaaatattttat

SEQ ID NO: 5538794 - DNA, 15 bp, Homo sapiens
ttgcaaaagaagttg

SEQ ID NO: 5538795 - DNA, 15 bp, Homo sapiens
ttgcaaaagtgtatg

SEQ ID NO: 5538796 - DNA, 17 bp, Homo sapiens
ttgcaaaatacatgaag

SEQ ID NO: 5538797 - DNA, 17 bp, Homo sapiens
ttgcaaaatagaagaag

SEQ ID NO: 5538798 - DNA, 21 bp, Homo sapiens
ttgcaaaatcacttagcagca

SEQ ID NO: 5538799 - DNA, 15 bp, Homo sapiens
ttgcaaaatcagttt

SEQ ID NO: 5538800 - DNA, 13 bp, Homo sapiens
ttgcaaacccttt

SEQ ID NO: 5538801 - DNA, 19 bp, Homo sapiens
ttgcaaacctcagagggat

SEQ ID NO: 5538802 - DNA, 18 bp, Homo sapiens
ttgcaaactctataaaga

SEQ ID NO: 5538803 - DNA, 20 bp, Homo sapiens
ttgcaaactctataaagaaa

SEQ ID NO: 5538804 - DNA, 13 bp, Homo sapiens
ttgcaaagaaaga

SEQ ID NO: 5538805 - DNA, 15 bp, Homo sapiens
ttgcaaagaaagaaa

SEQ ID NO: 5538806 - DNA, 15 bp, Homo sapiens
ttgcaaagaccacct

SEQ ID NO: 5538807 - DNA, 15 bp, Homo sapiens
ttgcaaagcctttaa

SEQ ID NO: 5538808 - DNA, 13 bp, Homo sapiens
ttgcaaagtgtat

SEQ ID NO: 5538809 - DNA, 16 bp, Homo sapiens
ttgcaaatcagagcat

SEQ ID NO: 5538810 - DNA, 12 bp, Homo sapiens
ttgcaaatcttg

SEQ ID NO: 5538811 - DNA, 22 bp, Homo sapiens
ttgcaaatgaatgcctttcaaa

SEQ ID NO: 5538812 - DNA, 20 bp, Homo sapiens
ttgcaaatgcacatttgtca

SEQ ID NO: 5538813 - DNA, 19 bp, Homo sapiens
ttgcaaattatttattact

SEQ ID NO: 5538814 - DNA, 12 bp, Homo sapiens
ttgcaacaaaat

SEQ ID NO: 5538815 - DNA, 19 bp, Homo sapiens
ttgcaacaataataaatgt

SEQ ID NO: 5538816 - DNA, 12 bp, Homo sapiens
ttgcaacaatgc

SEQ ID NO: 5538817 - DNA, 15 bp, Homo sapiens
ttgcaacaatgcaaa

SEQ ID NO: 5538818 - DNA, 13 bp, Homo sapiens
ttgcaacacacag

SEQ ID NO: 5538819 - DNA, 15 bp, Homo sapiens
ttgcaacacacagac

SEQ ID NO: 5538820 - DNA, 16 bp, Homo sapiens
ttgcaacactgccaaa

SEQ ID NO: 5538821 - DNA, 17 bp, Homo sapiens
ttgcaacagcaaattaa

SEQ ID NO: 5538822 - DNA, 18 bp, Homo sapiens
ttgcaacagcaaattaat

SEQ ID NO: 5538823 - DNA, 14 bp, Homo sapiens
ttgcaacagcagtg

SEQ ID NO: 5538824 - DNA, 14 bp, Homo sapiens
ttgcaacaggctgg

SEQ ID NO: 5538825 - DNA, 22 bp, Homo sapiens
ttgcaacaggggaggaaaaaag

SEQ ID NO: 5538826 - DNA, 16 bp, Homo sapiens
ttgcaacatggtccag

SEQ ID NO: 5538827 - DNA, 18 bp, Homo sapiens
ttgcaaccaggaacagca

SEQ ID NO: 5538828 - DNA, 15 bp, Homo sapiens
ttgcaaccaggcagc

SEQ ID NO: 5538829 - DNA, 16 bp, Homo sapiens
ttgcaaccaggcagct

SEQ ID NO: 5538830 - DNA, 14 bp, Homo sapiens
ttgcaaccgtctgt

SEQ ID NO: 5538831 - DNA, 14 bp, Homo sapiens
ttgcaacctttata

SEQ ID NO: 5538832 - DNA, 16 bp, Homo sapiens
ttgcaacctttatagg

SEQ ID NO: 5538833 - DNA, 19 bp, Homo sapiens
ttgcaactaaggacaaatt

SEQ ID NO: 5538834 - DNA, 20 bp, Homo sapiens
ttgcaactcgaactgctttc

SEQ ID NO: 5538835 - DNA, 20 bp, Homo sapiens
ttgcaactggtatatattta

SEQ ID NO: 5538836 - DNA, 15 bp, Homo sapiens
ttgcaacttcagttt

SEQ ID NO: 5538837 - DNA, 15 bp, Homo sapiens
ttgcaactttagaaa

SEQ ID NO: 5538838 - DNA, 18 bp, Homo sapiens
ttgcaactttagaaagaa

SEQ ID NO: 5538839 - DNA, 21 bp, Homo sapiens
ttgcaactttagaaagaaatt

SEQ ID NO: 5538840 - DNA, 17 bp, Homo sapiens
ttgcaactttgtataaa

SEQ ID NO: 5538841 - DNA, 19 bp, Homo sapiens
ttgcaagcaacaagctatt

SEQ ID NO: 5538842 - DNA, 20 bp, Homo sapiens
ttgcaagcaacaagctattt

SEQ ID NO: 5538843 - DNA, 19 bp, Homo sapiens
ttgcaagcagcctcctggg

SEQ ID NO: 5538844 - DNA, 13 bp, Homo sapiens
ttgcaagccataa

SEQ ID NO: 5538845 - DNA, 14 bp, Homo sapiens
ttgcaagccataac

SEQ ID NO: 5538846 - DNA, 22 bp, Homo sapiens
ttgcaagccataacgtgccccc

SEQ ID NO: 5538847 - DNA, 14 bp, Homo sapiens
ttgcaagcccctct

SEQ ID NO: 5538848 - DNA, 12 bp, Homo sapiens
ttgcaaggaagc

SEQ ID NO: 5538849 - DNA, 14 bp, Homo sapiens
ttgcaaggccgctg

SEQ ID NO: 5538850 - DNA, 22 bp, Homo sapiens
ttgcaagggaaaagtctcttgt

SEQ ID NO: 5538851 - DNA, 13 bp, Homo sapiens
ttgcaagggaatg

SEQ ID NO: 5538852 - DNA, 21 bp, Homo sapiens
ttgcaagggcggcctttccca

SEQ ID NO: 5538853 - DNA, 15 bp, Homo sapiens
ttgcaagtcatggct

SEQ ID NO: 5538854 - DNA, 17 bp, Homo sapiens
ttgcaagtgaaataata

SEQ ID NO: 5538855 - DNA, 22 bp, Homo sapiens
ttgcaagtgaaataatattgat

SEQ ID NO: 5538856 - DNA, 15 bp, Homo sapiens
ttgcaataaaatagt

SEQ ID NO: 5538857 - DNA, 23 bp, Homo sapiens
ttgcaataaactcagtcaaatgt

SEQ ID NO: 5538858 - DNA, 16 bp, Homo sapiens
ttgcaataacagctgc

SEQ ID NO: 5538859 - DNA, 15 bp, Homo sapiens
ttgcaataacttcta

SEQ ID NO: 5538860 - DNA, 12 bp, Homo sapiens
ttgcaataagat

SEQ ID NO: 5538861 - DNA, 22 bp, Homo sapiens
ttgcaataaggatttattctca

SEQ ID NO: 5538862 - DNA, 23 bp, Homo sapiens
ttgcaataaggatttattctcag

SEQ ID NO: 5538863 - DNA, 15 bp, Homo sapiens
ttgcaataatgcagt

SEQ ID NO: 5538864 - DNA, 16 bp, Homo sapiens
ttgcaataatgcagta

SEQ ID NO: 5538865 - DNA, 17 bp, Homo sapiens
ttgcaatagcagttata

SEQ ID NO: 5538866 - DNA, 20 bp, Homo sapiens
ttgcaatagcagttataaca

SEQ ID NO: 5538867 - DNA, 15 bp, Homo sapiens
ttgcaatatctgaag

SEQ ID NO: 5538868 - DNA, 18 bp, Homo sapiens
ttgcaatccaggctgttc

SEQ ID NO: 5538869 - DNA, 21 bp, Homo sapiens
ttgcaatccaggctgttctca

SEQ ID NO: 5538870 - DNA, 23 bp, Homo sapiens
ttgcaatccaggctgttctcagc

SEQ ID NO: 5538871 - DNA, 18 bp, Homo sapiens
ttgcaatctaatctgaac

SEQ ID NO: 5538872 - DNA, 19 bp, Homo sapiens
ttgcaatctaatctgaact

SEQ ID NO: 5538873 - DNA, 16 bp, Homo sapiens
ttgcaatcttatgttg

SEQ ID NO: 5538874 - DNA, 11 bp, Homo sapiens
ttgcaatgcag

SEQ ID NO: 5538875 - DNA, 20 bp, Homo sapiens
ttgcaatgcagaggttgaga

SEQ ID NO: 5538876 - DNA, 15 bp, Homo sapiens
ttgcccccctggcct

SEQ ID NO: 5538877 - DNA, 16 bp, Homo sapiens
ttgcccccctggcctc

SEQ ID NO: 5538878 - DNA, 19 bp, Homo sapiens
ttgcccccgtggggctccc

SEQ ID NO: 5538879 - DNA, 22 bp, Homo sapiens
ttgcccccgtggggctcccggc

SEQ ID NO: 5538880 - DNA, 15 bp, Homo sapiens
ttgcccccttgccca

SEQ ID NO: 5538881 - DNA, 21 bp, Homo sapiens
ttgcccctccgatgctgaggc

SEQ ID NO: 5538882 - DNA, 22 bp, Homo sapiens
ttgcccctccgatgctgaggcc

SEQ ID NO: 5538883 - DNA, 13 bp, Homo sapiens
ttgcccctctgcc

SEQ ID NO: 5538884 - DNA, 15 bp, Homo sapiens
ttgcccctctgcctt

SEQ ID NO: 5538885 - DNA, 12 bp, Homo sapiens
ttgcccctggct

SEQ ID NO: 5538886 - DNA, 17 bp, Homo sapiens
ttgcccctggctttgcc

SEQ ID NO: 5538887 - DNA, 13 bp, Homo sapiens
ttgccccttcccc

SEQ ID NO: 5538888 - DNA, 19 bp, Homo sapiens
ttgccccttccccatctcc

SEQ ID NO: 5538889 - DNA, 12 bp, Homo sapiens
ttgccccttggg

SEQ ID NO: 5538890 - DNA, 13 bp, Homo sapiens
ttgccccttgggc

SEQ ID NO: 5538891 - DNA, 16 bp, Homo sapiens
ttgccccttgggcctc

SEQ ID NO: 5538892 - DNA, 17 bp, Homo sapiens
ttgccccttgggcctcc

SEQ ID NO: 5538893 - DNA, 21 bp, Homo sapiens
ttgccccttgggcctcccccc

SEQ ID NO: 5538894 - DNA, 22 bp, Homo sapiens
ttgccccttgggcctcccccca

SEQ ID NO: 5538895 - DNA, 21 bp, Homo sapiens
ttgcccgaaactaagccaggc

SEQ ID NO: 5538896 - DNA, 23 bp, Homo sapiens
ttgcccgccagcctcagtgccac

SEQ ID NO: 5538897 - DNA, 16 bp, Homo sapiens
ttgcccgccctccacc

SEQ ID NO: 5538898 - DNA, 18 bp, Homo sapiens
ttgcccgccctccaccca

SEQ ID NO: 5538899 - DNA, 21 bp, Homo sapiens
ttgcccgctcccacagcttcc

SEQ ID NO: 5538900 - DNA, 22 bp, Homo sapiens
ttgcccgctcccacagcttcct

SEQ ID NO: 5538901 - DNA, 19 bp, Homo sapiens
ttgcccggctgtgattgct

SEQ ID NO: 5538902 - DNA, 14 bp, Homo sapiens
ttgccctaagcaga

SEQ ID NO: 5538903 - DNA, 18 bp, Homo sapiens
ttgccctaagcagaaagt

SEQ ID NO: 5538904 - DNA, 20 bp, Homo sapiens
ttgccctaattaaaaactgt

SEQ ID NO: 5538905 - DNA, 20 bp, Homo sapiens
ttgccctaattcatctttta

SEQ ID NO: 5538906 - DNA, 19 bp, Homo sapiens
ttgccctcccctgcccctc

SEQ ID NO: 5538907 - DNA, 22 bp, Homo sapiens
ttgccctccctttctctctcca

SEQ ID NO: 5538908 - DNA, 17 bp, Homo sapiens
ttgccctccgcctggga

SEQ ID NO: 5538909 - DNA, 12 bp, Homo sapiens
ttgccctcctgg

SEQ ID NO: 5538910 - DNA, 18 bp, Homo sapiens
ttgccctgacctcccagc

SEQ ID NO: 5538911 - DNA, 12 bp, Homo sapiens
ttgccctgagct

SEQ ID NO: 5538912 - DNA, 21 bp, Homo sapiens
ttgccctgagctttccgggga

SEQ ID NO: 5538913 - DNA, 14 bp, Homo sapiens
ttgccctgccaggc

SEQ ID NO: 5538914 - DNA, 14 bp, Homo sapiens
ttgccctgcctgca

SEQ ID NO: 5538915 - DNA, 13 bp, Homo sapiens
ttgccctgggaaa

SEQ ID NO: 5538916 - DNA, 12 bp, Homo sapiens
ttgccctgggcc

SEQ ID NO: 5538917 - DNA, 17 bp, Homo sapiens
ttgccctgggctgcctc

SEQ ID NO: 5538918 - DNA, 10 bp, Homo sapiens
ttgccctggt

SEQ ID NO: 5538919 - DNA, 13 bp, Homo sapiens
ttgccctgttaaa

SEQ ID NO: 5538920 - DNA, 17 bp, Homo sapiens
ttgcccttacctgtctc

SEQ ID NO: 5538921 - DNA, 21 bp, Homo sapiens
ttgcccttcaggacccttcta

SEQ ID NO: 5538922 - DNA, 22 bp, Homo sapiens
ttgcccttcaggacccttctac

SEQ ID NO: 5538923 - DNA, 13 bp, Homo sapiens
ttgcccttccctg

SEQ ID NO: 5538924 - DNA, 14 bp, Homo sapiens
ttgcccttccctgt

SEQ ID NO: 5538925 - DNA, 19 bp, Homo sapiens
ttgcccttccctgtccctc

SEQ ID NO: 5538926 - DNA, 13 bp, Homo sapiens
ttgcccttcctga

SEQ ID NO: 5538927 - DNA, 16 bp, Homo sapiens
ttgcccttctgtccaa

SEQ ID NO: 5538928 - DNA, 16 bp, Homo sapiens
ttgcccttgccctgac

SEQ ID NO: 5538929 - DNA, 14 bp, Homo sapiens
ttgcccttggagct

SEQ ID NO: 5538930 - DNA, 15 bp, Homo sapiens
ttgccgaaactggaa

SEQ ID NO: 5538931 - DNA, 16 bp, Homo sapiens
ttgccgaaactggaag

SEQ ID NO: 5538932 - DNA, 17 bp, Homo sapiens
ttgccgaaactggaagt

SEQ ID NO: 5538933 - DNA, 18 bp, Homo sapiens
ttgccgaaactggaagtt

SEQ ID NO: 5538934 - DNA, 14 bp, Homo sapiens
ttgccgagagaggc

SEQ ID NO: 5538935 - DNA, 17 bp, Homo sapiens
ttgccgaggagccaggc

SEQ ID NO: 5538936 - DNA, 21 bp, Homo sapiens
ttgccgcgtcgccctcccagg

SEQ ID NO: 5538937 - DNA, 13 bp, Homo sapiens
ttgccgggcctgg

SEQ ID NO: 5538938 - DNA, 16 bp, Homo sapiens
ttgccggtggtgcagg

SEQ ID NO: 5538939 - DNA, 18 bp, Homo sapiens
ttgccgtctacctgaggg

SEQ ID NO: 5538940 - DNA, 22 bp, Homo sapiens
ttgccgtctaggattgggcctc

SEQ ID NO: 5538941 - DNA, 16 bp, Homo sapiens
ttgccgtgagcatgca

SEQ ID NO: 5538942 - DNA, 14 bp, Homo sapiens
ttgccgttattaaa

SEQ ID NO: 5538943 - DNA, 12 bp, Homo sapiens
ttgcctaaaatt

SEQ ID NO: 5538944 - DNA, 22 bp, Homo sapiens
ttgcctaaaattcggaatggtt

SEQ ID NO: 5538945 - DNA, 21 bp, Homo sapiens
ttgcctaaatacttttttcta

SEQ ID NO: 5538946 - DNA, 15 bp, Homo sapiens
ttgcctaaatccatt

SEQ ID NO: 5538947 - DNA, 14 bp, Homo sapiens
ttgcctaagtatta

SEQ ID NO: 5538948 - DNA, 18 bp, Homo sapiens
ttgcctaagtattccttt

SEQ ID NO: 5538949 - DNA, 23 bp, Homo sapiens
ttgcctaatacattaaagcagtc

SEQ ID NO: 5538950 - DNA, 16 bp, Homo sapiens
ttgcctaattggaaag

SEQ ID NO: 5538951 - DNA, 20 bp, Homo sapiens
ttgcctacaataaaaagaaa

SEQ ID NO: 5538952 - DNA, 13 bp, Homo sapiens
ttgcctaccattt

SEQ ID NO: 5538953 - DNA, 23 bp, Homo sapiens
ttgcctagaaatatctttctctt

SEQ ID NO: 5538954 - DNA, 23 bp, Homo sapiens
ttgcctaggcgattttgtctacc

SEQ ID NO: 5538955 - DNA, 23 bp, Homo sapiens
ttgcctataatacttgcaactaa

SEQ ID NO: 5538956 - DNA, 15 bp, Homo sapiens
ttgcctatctttaaa

SEQ ID NO: 5538957 - DNA, 24 bp, Homo sapiens
ttgcctattcccacacctccacag

SEQ ID NO: 5538958 - DNA, 20 bp, Homo sapiens
ttgcctcaaaattgtgtcca

SEQ ID NO: 5538959 - DNA, 13 bp, Homo sapiens
ttgcctcaccttg

SEQ ID NO: 5538960 - DNA, 22 bp, Homo sapiens
ttgcctcagggccaagccggcc

SEQ ID NO: 5538961 - DNA, 17 bp, Homo sapiens
ttgcctcatattgtcct

SEQ ID NO: 5538962 - DNA, 17 bp, Homo sapiens
ttgcctcatgaacactg

SEQ ID NO: 5538963 - DNA, 16 bp, Homo sapiens
ttgcctcatttcccta

SEQ ID NO: 5538964 - DNA, 21 bp, Homo sapiens
ttgcctcatttccctatcttc

SEQ ID NO: 5538965 - DNA, 21 bp, Homo sapiens
ttgcctcatttcttcctctgc

SEQ ID NO: 5538966 - DNA, 21 bp, Homo sapiens
ttgcctcattttgcttcccat

SEQ ID NO: 5538967 - DNA, 22 bp, Homo sapiens
ttgcctccacctctccttggaa

SEQ ID NO: 5538968 - DNA, 12 bp, Homo sapiens
ttgcctccaggt

SEQ ID NO: 5538969 - DNA, 22 bp, Homo sapiens
ttgcctccccatttcccatctg

SEQ ID NO: 5538970 - DNA, 15 bp, Homo sapiens
ttgcctccctgcact

SEQ ID NO: 5538971 - DNA, 13 bp, Homo sapiens
ttgcctcccttcc

SEQ ID NO: 5538972 - DNA, 14 bp, Homo sapiens
ttgcctcccttcct

SEQ ID NO: 5538973 - DNA, 15 bp, Homo sapiens
ttgcctcctctctcc

SEQ ID NO: 5538974 - DNA, 16 bp, Homo sapiens
ttgcctcctctctccc

SEQ ID NO: 5538975 - DNA, 23 bp, Homo sapiens
ttgcctcctctctccctgcctca

SEQ ID NO: 5538976 - DNA, 19 bp, Homo sapiens
ttgcctccttatttatcaa

SEQ ID NO: 5538977 - DNA, 15 bp, Homo sapiens
ttgcctcggctcctg

SEQ ID NO: 5538978 - DNA, 16 bp, Homo sapiens
ttgcctcggctcctgc

SEQ ID NO: 5538979 - DNA, 15 bp, Homo sapiens
ttgcctctctgtttg

SEQ ID NO: 5538980 - DNA, 17 bp, Homo sapiens
ttgcctctcttgcccct

SEQ ID NO: 5538981 - DNA, 22 bp, Homo sapiens
ttgcctctgcacgtgcacacac

SEQ ID NO: 5538982 - DNA, 19 bp, Homo sapiens
ttgcctctgccctggattg

SEQ ID NO: 5538983 - DNA, 14 bp, Homo sapiens
ttgcctctgcctct

SEQ ID NO: 5538984 - DNA, 18 bp, Homo sapiens
ttgcctctgcctctgaca

SEQ ID NO: 5538985 - DNA, 12 bp, Homo sapiens
ttgcctctgtcc

SEQ ID NO: 5538986 - DNA, 20 bp, Homo sapiens
ttgcctctgtccccttctct

SEQ ID NO: 5538987 - DNA, 19 bp, Homo sapiens
ttgcctctgtgctgtgtgt

SEQ ID NO: 5538988 - DNA, 17 bp, Homo sapiens
ttgcctcttcagcagca

SEQ ID NO: 5538989 - DNA, 18 bp, Homo sapiens
ttgcctcttcagcagcat

SEQ ID NO: 5538990 - DNA, 12 bp, Homo sapiens
ttgcctcttctt

SEQ ID NO: 5538991 - DNA, 15 bp, Homo sapiens
ttgcctcttctttgt

SEQ ID NO: 5538992 - DNA, 14 bp, Homo sapiens
ttgcctctttaaat

SEQ ID NO: 5538993 - DNA, 19 bp, Homo sapiens
ttgcctctttaaattatga

SEQ ID NO: 5538994 - DNA, 13 bp, Homo sapiens
ttgcctctttctc

SEQ ID NO: 5538995 - DNA, 23 bp, Homo sapiens
ttgcctgaatccatcaggacttg

SEQ ID NO: 5538996 - DNA, 18 bp, Homo sapiens
ttgcctgactaaaatgtt

SEQ ID NO: 5538997 - DNA, 21 bp, Homo sapiens
ttgcctgagaagaagtggctg

SEQ ID NO: 5538998 - DNA, 18 bp, Homo sapiens
ttgcctgagaaggggcag

SEQ ID NO: 5538999 - DNA, 13 bp, Homo sapiens
ttgcctgaggctc

SEQ ID NO: 5539000 - DNA, 23 bp, Homo sapiens
ttgcctgaggctcaagaggccca

SEQ ID NO: 5539001 - DNA, 20 bp, Homo sapiens
ttgcctgaggggaaagagag

SEQ ID NO: 5539002 - DNA, 23 bp, Homo sapiens
ttgcctgatttgttttcattata

SEQ ID NO: 5539003 - DNA, 23 bp, Homo sapiens
ttgcctgcaacagagagaaaaag

SEQ ID NO: 5539004 - DNA, 12 bp, Homo sapiens
ttgcctgcaaga

SEQ ID NO: 5539005 - DNA, 17 bp, Homo sapiens
ttgcctgcacccttccc

SEQ ID NO: 5539006 - DNA, 19 bp, Homo sapiens
ttgcctgcagagagaagcc

SEQ ID NO: 5539007 - DNA, 15 bp, Homo sapiens
ttgcctgcagggcca

SEQ ID NO: 5539008 - DNA, 20 bp, Homo sapiens
ttgcctgcagtttcttgtgt

SEQ ID NO: 5539009 - DNA, 16 bp, Homo sapiens
ttgcctgccagggccc

SEQ ID NO: 5539010 - DNA, 14 bp, Homo sapiens
ttgcctgccctcct

SEQ ID NO: 5539011 - DNA, 15 bp, Homo sapiens
ttgcctgcctcctag

SEQ ID NO: 5539012 - DNA, 18 bp, Homo sapiens
ttgcctgcctcctaggct

SEQ ID NO: 5539013 - DNA, 11 bp, Homo sapiens
ttgcctgcctg

SEQ ID NO: 5539014 - DNA, 13 bp, Homo sapiens
ttgcctgctgggc

SEQ ID NO: 5539015 - DNA, 13 bp, Homo sapiens
ttgcctgctgtat

SEQ ID NO: 5539016 - DNA, 19 bp, Homo sapiens
ttgcctgcttctttccaga

SEQ ID NO: 5539017 - DNA, 14 bp, Homo sapiens
ttgcctgctttctc

SEQ ID NO: 5539018 - DNA, 22 bp, Homo sapiens
ttgcctggactgaccacaccaa

SEQ ID NO: 5539019 - DNA, 12 bp, Homo sapiens
ttgcctggctgt

SEQ ID NO: 5539020 - DNA, 15 bp, Homo sapiens
ttgcctggctgtgga

SEQ ID NO: 5539021 - DNA, 18 bp, Homo sapiens
ttgcctgggcagtgccca

SEQ ID NO: 5539022 - DNA, 17 bp, Homo sapiens
ttgcctgggctgggcag

SEQ ID NO: 5539023 - DNA, 19 bp, Homo sapiens
ttgcctgggctgggcagcc

SEQ ID NO: 5539024 - DNA, 12 bp, Homo sapiens
ttgcctggggcc

SEQ ID NO: 5539025 - DNA, 15 bp, Homo sapiens
ttgcctggtacagta

SEQ ID NO: 5539026 - DNA, 16 bp, Homo sapiens
ttgcctggttttgtct

SEQ ID NO: 5539027 - DNA, 15 bp, Homo sapiens
ttgcctgtaagaaaa

SEQ ID NO: 5539028 - DNA, 19 bp, Homo sapiens
ttgcctgtagagccagcct

SEQ ID NO: 5539029 - DNA, 18 bp, Homo sapiens
ttgcctgtgactgtaaag

SEQ ID NO: 5539030 - DNA, 13 bp, Homo sapiens
ttgcctgttcagt

SEQ ID NO: 5539031 - DNA, 22 bp, Homo sapiens
ttgcctgttcagttacagaaag

SEQ ID NO: 5539032 - DNA, 11 bp, Homo sapiens
ttgcctgttct

SEQ ID NO: 5539033 - DNA, 13 bp, Homo sapiens
ttgccttaaaata

SEQ ID NO: 5539034 - DNA, 16 bp, Homo sapiens
ttgccttaaacctgaa

SEQ ID NO: 5539035 - DNA, 16 bp, Homo sapiens
ttgccttaactggagc

SEQ ID NO: 5539036 - DNA, 17 bp, Homo sapiens
ttgccttaataaatatg

SEQ ID NO: 5539037 - DNA, 20 bp, Homo sapiens
ttgccttaataaatatgtaa

SEQ ID NO: 5539038 - DNA, 15 bp, Homo sapiens
ttgccttaattctta

SEQ ID NO: 5539039 - DNA, 14 bp, Homo sapiens
ttgccttagcactt

SEQ ID NO: 5539040 - DNA, 14 bp, Homo sapiens
ttgccttaggaagt

SEQ ID NO: 5539041 - DNA, 12 bp, Homo sapiens
ttgccttatttg

SEQ ID NO: 5539042 - DNA, 22 bp, Homo sapiens
ttgccttatttgtctgtaaaaa

SEQ ID NO: 5539043 - DNA, 11 bp, Homo sapiens
ttgccttcagc

SEQ ID NO: 5539044 - DNA, 21 bp, Homo sapiens
ttgccttccacgctgtctcca

SEQ ID NO: 5539045 - DNA, 14 bp, Homo sapiens
ttgccttcccctgt

SEQ ID NO: 5539046 - DNA, 20 bp, Homo sapiens
ttgccttcctcgtgcagagc

SEQ ID NO: 5539047 - DNA, 21 bp, Homo sapiens
ttgccttcctcgtgcagagct

SEQ ID NO: 5539048 - DNA, 22 bp, Homo sapiens
ttgccttcctcgtgcagagctg

SEQ ID NO: 5539049 - DNA, 23 bp, Homo sapiens
ttgccttctcaccagctgcaaag

SEQ ID NO: 5539050 - DNA, 19 bp, Homo sapiens
ttgccttctctgcccacag

SEQ ID NO: 5539051 - DNA, 14 bp, Homo sapiens
ttgccttctttgaa

SEQ ID NO: 5539052 - DNA, 19 bp, Homo sapiens
ttgccttgaaatttacaca

SEQ ID NO: 5539053 - DNA, 23 bp, Homo sapiens
ttgccttgcaattagcattctgt

SEQ ID NO: 5539054 - DNA, 20 bp, Homo sapiens
ttgccttgcagccacatggc

SEQ ID NO: 5539055 - DNA, 13 bp, Homo sapiens
ttgctggccccag

SEQ ID NO: 5539056 - DNA, 17 bp, Homo sapiens
ttgctggccccagccct

SEQ ID NO: 5539057 - DNA, 12 bp, Homo sapiens
ttgctggctgcc

SEQ ID NO: 5539058 - DNA, 15 bp, Homo sapiens
ttgctggctgtgaaa

SEQ ID NO: 5539059 - DNA, 16 bp, Homo sapiens
ttgctggctgtgaaac

SEQ ID NO: 5539060 - DNA, 20 bp, Homo sapiens
ttgctgggcagtttttctgt

SEQ ID NO: 5539061 - DNA, 23 bp, Homo sapiens
ttgctgggcatactttctctcta

SEQ ID NO: 5539062 - DNA, 12 bp, Homo sapiens
ttgctgggccag

SEQ ID NO: 5539063 - DNA, 15 bp, Homo sapiens
ttgctgggccaggga

SEQ ID NO: 5539064 - DNA, 12 bp, Homo sapiens
ttgctgggcttt

SEQ ID NO: 5539065 - DNA, 16 bp, Homo sapiens
ttgctgggctttggga

SEQ ID NO: 5539066 - DNA, 16 bp, Homo sapiens
ttgctggggccaggcc

SEQ ID NO: 5539067 - DNA, 21 bp, Homo sapiens
ttgctggggctcacggggcct

SEQ ID NO: 5539068 - DNA, 20 bp, Homo sapiens
ttgctggggtccagggctgt

SEQ ID NO: 5539069 - DNA, 14 bp, Homo sapiens
ttgctgggtccagg

SEQ ID NO: 5539070 - DNA, 20 bp, Homo sapiens
ttgctgggtggttctctggg

SEQ ID NO: 5539071 - DNA, 16 bp, Homo sapiens
ttgctggtaaaatgaa

SEQ ID NO: 5539072 - DNA, 23 bp, Homo sapiens
ttgctggtaaaatgaagaattta

SEQ ID NO: 5539073 - DNA, 14 bp, Homo sapiens
ttgctggtacacac

SEQ ID NO: 5539074 - DNA, 15 bp, Homo sapiens
ttgctggtcctgcac

SEQ ID NO: 5539075 - DNA, 18 bp, Homo sapiens
ttgctggtcctgcacatg

SEQ ID NO: 5539076 - DNA, 19 bp, Homo sapiens
ttgctggtgcctcttttca

SEQ ID NO: 5539077 - DNA, 14 bp, Homo sapiens
ttgctggtggtttt

SEQ ID NO: 5539078 - DNA, 19 bp, Homo sapiens
ttgctggtgtactctagga

SEQ ID NO: 5539079 - DNA, 22 bp, Homo sapiens
ttgctggtgtactctaggactt

SEQ ID NO: 5539080 - DNA, 16 bp, Homo sapiens
ttgctggtgtagtctt

SEQ ID NO: 5539081 - DNA, 22 bp, Homo sapiens
ttgctggttcagccttcgtgtg

SEQ ID NO: 5539082 - DNA, 22 bp, Homo sapiens
ttgctggttgctgtgtggtttg

SEQ ID NO: 5539083 - DNA, 15 bp, Homo sapiens
ttgctgtaaaatttg

SEQ ID NO: 5539084 - DNA, 15 bp, Homo sapiens
ttgctgtaaataaaa

SEQ ID NO: 5539085 - DNA, 13 bp, Homo sapiens
ttgctgtacaaaa

SEQ ID NO: 5539086 - DNA, 21 bp, Homo sapiens
ttgctgtaccagcccagatgt

SEQ ID NO: 5539087 - DNA, 14 bp, Homo sapiens
ttgctgtactagag

SEQ ID NO: 5539088 - DNA, 12 bp, Homo sapiens
ttgctgtagaga

SEQ ID NO: 5539089 - DNA, 19 bp, Homo sapiens
ttgctgtaggatctaaggc

SEQ ID NO: 5539090 - DNA, 18 bp, Homo sapiens
ttgctgtatgacccctgg

SEQ ID NO: 5539091 - DNA, 12 bp, Homo sapiens
ttgctgtcacaa

SEQ ID NO: 5539092 - DNA, 14 bp, Homo sapiens
ttgctgtcacaaag

SEQ ID NO: 5539093 - DNA, 14 bp, Homo sapiens
ttgctgtcacttct

SEQ ID NO: 5539094 - DNA, 19 bp, Homo sapiens
ttgctgtcactttctctct

SEQ ID NO: 5539095 - DNA, 21 bp, Homo sapiens
ttgctgtcataagaatgaata

SEQ ID NO: 5539096 - DNA, 15 bp, Homo sapiens
ttgctgtccaggcag

SEQ ID NO: 5539097 - DNA, 16 bp, Homo sapiens
ttgctgtccaggcagc

SEQ ID NO: 5539098 - DNA, 14 bp, Homo sapiens
ttgctgtcctccag

SEQ ID NO: 5539099 - DNA, 19 bp, Homo sapiens
ttgctgtctacagtagctg

SEQ ID NO: 5539100 - DNA, 19 bp, Homo sapiens
ttgctgtctggctttcccg

SEQ ID NO: 5539101 - DNA, 16 bp, Homo sapiens
ttgctgtctggtgagg

SEQ ID NO: 5539102 - DNA, 20 bp, Homo sapiens
ttgctgtcttcagtctcaca

SEQ ID NO: 5539103 - DNA, 16 bp, Homo sapiens
ttgctgtcttgcccca

SEQ ID NO: 5539104 - DNA, 17 bp, Homo sapiens
ttgctgtcttgccccag

SEQ ID NO: 5539105 - DNA, 18 bp, Homo sapiens
ttgctgtgaacaattgtc

SEQ ID NO: 5539106 - DNA, 14 bp, Homo sapiens
ttgctgtgaggctg

SEQ ID NO: 5539107 - DNA, 12 bp, Homo sapiens
ttgctgtgccaa

SEQ ID NO: 5539108 - DNA, 19 bp, Homo sapiens
ttgctgtgcctcccaaaat

SEQ ID NO: 5539109 - DNA, 11 bp, Homo sapiens
ttgctgtggac

SEQ ID NO: 5539110 - DNA, 14 bp, Homo sapiens
ttgctgtggctcca

SEQ ID NO: 5539111 - DNA, 20 bp, Homo sapiens
ttgctgtgtccaactccagt

SEQ ID NO: 5539112 - DNA, 17 bp, Homo sapiens
ttgctgtgtgaaatctt

SEQ ID NO: 5539113 - DNA, 18 bp, Homo sapiens
ttgctgtgtgaaatcttt

SEQ ID NO: 5539114 - DNA, 21 bp, Homo sapiens
ttgctgtgtgaaatctttcaa

SEQ ID NO: 5539115 - DNA, 15 bp, Homo sapiens
ttgctgtgtttaatt

SEQ ID NO: 5539116 - DNA, 21 bp, Homo sapiens
ttgctgtgtttaatttgactt

SEQ ID NO: 5539117 - DNA, 15 bp, Homo sapiens
ttgctgttaaaaata

SEQ ID NO: 5539118 - DNA, 14 bp, Homo sapiens
ttgctgttaccaaa

SEQ ID NO: 5539119 - DNA, 22 bp, Homo sapiens
ttgctgttatgtctgtttaaga

SEQ ID NO: 5539120 - DNA, 17 bp, Homo sapiens
ttgctgttcacagcttt

SEQ ID NO: 5539121 - DNA, 18 bp, Homo sapiens
ttgctgttcacagctttt

SEQ ID NO: 5539122 - DNA, 12 bp, Homo sapiens
ttgctgttcagt

SEQ ID NO: 5539123 - DNA, 14 bp, Homo sapiens
ttgctgttcttgaa

SEQ ID NO: 5539124 - DNA, 17 bp, Homo sapiens
ttgctgttgaaagcaaa

SEQ ID NO: 5539125 - DNA, 12 bp, Homo sapiens
ttgctgttgaca

SEQ ID NO: 5539126 - DNA, 18 bp, Homo sapiens
ttgctgttgctgttggca

SEQ ID NO: 5539127 - DNA, 15 bp, Homo sapiens
ttgctgttgcttgaa

SEQ ID NO: 5539128 - DNA, 14 bp, Homo sapiens
ttgctgttgtccaa

SEQ ID NO: 5539129 - DNA, 22 bp, Homo sapiens
ttgctgttgttcagaagttgtt

SEQ ID NO: 5539130 - DNA, 16 bp, Homo sapiens
ttgctgttgttgcagg

SEQ ID NO: 5539131 - DNA, 23 bp, Homo sapiens
ttgctgttgtttctataaatgac

SEQ ID NO: 5539132 - DNA, 19 bp, Homo sapiens
ttgctgtttagagtaaata

SEQ ID NO: 5539133 - DNA, 22 bp, Homo sapiens
ttgctgtttagcttcctccaga

SEQ ID NO: 5539134 - DNA, 21 bp, Homo sapiens
ttgctgtttatgatctatttg

SEQ ID NO: 5539135 - DNA, 16 bp, Homo sapiens
ttgctgttttaaattg

SEQ ID NO: 5539136 - DNA, 16 bp, Homo sapiens
ttgctgttttgttctg

SEQ ID NO: 5539137 - DNA, 16 bp, Homo sapiens
ttgctgttttttggag

SEQ ID NO: 5539138 - DNA, 14 bp, Homo sapiens
ttgcttaaaatatg

SEQ ID NO: 5539139 - DNA, 16 bp, Homo sapiens
ttgcttaaaatatgtg

SEQ ID NO: 5539140 - DNA, 18 bp, Homo sapiens
ttgcttaaaatatgtgaa

SEQ ID NO: 5539141 - DNA, 22 bp, Homo sapiens
ttgcttaaaatatgtgaagttt

SEQ ID NO: 5539142 - DNA, 15 bp, Homo sapiens
ttgcttaaatgtgaa

SEQ ID NO: 5539143 - DNA, 17 bp, Homo sapiens
ttgcttaaatgtgaatt

SEQ ID NO: 5539144 - DNA, 14 bp, Homo sapiens
ttgcttaaatttct

SEQ ID NO: 5539145 - DNA, 23 bp, Homo sapiens
ttgcttaaatttcttatgtgaca

SEQ ID NO: 5539146 - DNA, 16 bp, Homo sapiens
ttgcttaacattagat

SEQ ID NO: 5539147 - DNA, 23 bp, Homo sapiens
ttgcttaagatgctaatagaaaa

SEQ ID NO: 5539148 - DNA, 12 bp, Homo sapiens
ttgcttaaggca

SEQ ID NO: 5539149 - DNA, 21 bp, Homo sapiens
ttgcttaattacaatatttct

SEQ ID NO: 5539150 - DNA, 22 bp, Homo sapiens
ttgcttaatttccttctgttaa

SEQ ID NO: 5539151 - DNA, 23 bp, Homo sapiens
ttgcttaatttccttctgttaag

SEQ ID NO: 5539152 - DNA, 17 bp, Homo sapiens
ttgcttaattttgattt

SEQ ID NO: 5539153 - DNA, 23 bp, Homo sapiens
ttgcttacaatttttttaatttt

SEQ ID NO: 5539154 - DNA, 13 bp, Homo sapiens
ttgcttaccttgt

SEQ ID NO: 5539155 - DNA, 19 bp, Homo sapiens
ttgcttagagtgcccagca

SEQ ID NO: 5539156 - DNA, 22 bp, Homo sapiens
ttgcttagagtgcccagcagag

SEQ ID NO: 5539157 - DNA, 12 bp, Homo sapiens
ttgcttagtaaa

SEQ ID NO: 5539158 - DNA, 13 bp, Homo sapiens
ttgcttagtaagt

SEQ ID NO: 5539159 - DNA, 13 bp, Homo sapiens
ttgcttatattga

SEQ ID NO: 5539160 - DNA, 16 bp, Homo sapiens
ttgcttattgtgtgtt

SEQ ID NO: 5539161 - DNA, 14 bp, Homo sapiens
ttgcttatttatat

SEQ ID NO: 5539162 - DNA, 20 bp, Homo sapiens
ttgcttcaatttcaaacttt

SEQ ID NO: 5539163 - DNA, 21 bp, Homo sapiens
ttgcttcaatttcaaactttt

SEQ ID NO: 5539164 - DNA, 12 bp, Homo sapiens
ttgcttcactca

SEQ ID NO: 5539165 - DNA, 17 bp, Homo sapiens
ttgcttcagtaaaagga

SEQ ID NO: 5539166 - DNA, 21 bp, Homo sapiens
ttgcttcagtcatcagccagc

SEQ ID NO: 5539167 - DNA, 15 bp, Homo sapiens
ttgcttcataaatga

SEQ ID NO: 5539168 - DNA, 17 bp, Homo sapiens
ttgcttcataaatgaag

SEQ ID NO: 5539169 - DNA, 20 bp, Homo sapiens
ttgcttcataaatgaagcag

SEQ ID NO: 5539170 - DNA, 14 bp, Homo sapiens
ttgcttcatctgga

SEQ ID NO: 5539171 - DNA, 13 bp, Homo sapiens
ttgcttcatgtgt

SEQ ID NO: 5539172 - DNA, 16 bp, Homo sapiens
ttgcttcattaaaaca

SEQ ID NO: 5539173 - DNA, 14 bp, Homo sapiens
ttgcttcattgtta

SEQ ID NO: 5539174 - DNA, 21 bp, Homo sapiens
ttgcttccaagaccatttgta

SEQ ID NO: 5539175 - DNA, 17 bp, Homo sapiens
ttgcttcccctccagga

SEQ ID NO: 5539176 - DNA, 18 bp, Homo sapiens
ttgcttcccctccaggag

SEQ ID NO: 5539177 - DNA, 16 bp, Homo sapiens
ttgcttccccttttgc

SEQ ID NO: 5539178 - DNA, 20 bp, Homo sapiens
ttgcttccccttttgccaat

SEQ ID NO: 5539179 - DNA, 23 bp, Homo sapiens
ttgcttcccttttttcctttcca

SEQ ID NO: 5539180 - DNA, 12 bp, Homo sapiens
ttgcttccgcca

SEQ ID NO: 5539181 - DNA, 13 bp, Homo sapiens
ttgcttcctagta

SEQ ID NO: 5539182 - DNA, 16 bp, Homo sapiens
ttgcttcctagtaagt

SEQ ID NO: 5539183 - DNA, 17 bp, Homo sapiens
ttgcttcctcctcccca

SEQ ID NO: 5539184 - DNA, 15 bp, Homo sapiens
ttgcttcctgtgtaa

SEQ ID NO: 5539185 - DNA, 19 bp, Homo sapiens
ttgcttctaaatgcccagt

SEQ ID NO: 5539186 - DNA, 23 bp, Homo sapiens
ttgcttctaagggatccagagac

SEQ ID NO: 5539187 - DNA, 17 bp, Homo sapiens
ttgcttctacatgatgc

SEQ ID NO: 5539188 - DNA, 15 bp, Homo sapiens
ttgcttctccaaata

SEQ ID NO: 5539189 - DNA, 13 bp, Homo sapiens
ttgcttctcttct

SEQ ID NO: 5539190 - DNA, 17 bp, Homo sapiens
ttgcttctgaatcactg

SEQ ID NO: 5539191 - DNA, 23 bp, Homo sapiens
ttgcttctggctttgttcttgtc

SEQ ID NO: 5539192 - DNA, 21 bp, Homo sapiens
ttgcttctgtagtactcctta

SEQ ID NO: 5539193 - DNA, 17 bp, Homo sapiens
ttgcttctgtatttcct

SEQ ID NO: 5539194 - DNA, 12 bp, Homo sapiens
ttgcttctgtgt

SEQ ID NO: 5539195 - DNA, 22 bp, Homo sapiens
ttgcttcttctcctatgtgtaa

SEQ ID NO: 5539196 - DNA, 13 bp, Homo sapiens
ttgcttcttctga

SEQ ID NO: 5539197 - DNA, 15 bp, Homo sapiens
ttgcttcttgtgaag

SEQ ID NO: 5539198 - DNA, 12 bp, Homo sapiens
ttgcttctttct

SEQ ID NO: 5539199 - DNA, 13 bp, Homo sapiens
ttgcttgaaacca

SEQ ID NO: 5539200 - DNA, 14 bp, Homo sapiens
ttgcttgaaagaaa

SEQ ID NO: 5539201 - DNA, 17 bp, Homo sapiens
ttgcttgaacacagtat

SEQ ID NO: 5539202 - DNA, 18 bp, Homo sapiens
ttgcttgaacacagtatt

SEQ ID NO: 5539203 - DNA, 19 bp, Homo sapiens
ttgcttgaacctgtgagga

SEQ ID NO: 5539204 - DNA, 17 bp, Homo sapiens
ttgcttgacttcagtta

SEQ ID NO: 5539205 - DNA, 15 bp, Homo sapiens
ttgcttgagcatgcc

SEQ ID NO: 5539206 - DNA, 18 bp, Homo sapiens
ttgcttgagcccaggagt

SEQ ID NO: 5539207 - DNA, 17 bp, Homo sapiens
ttgcttgatccagaaga

SEQ ID NO: 5539208 - DNA, 15 bp, Homo sapiens
ttgcttgccgagcct

SEQ ID NO: 5539209 - DNA, 15 bp, Homo sapiens
ttgcttgcctctctg

SEQ ID NO: 5539210 - DNA, 18 bp, Homo sapiens
ttgcttgcctgatataaa

SEQ ID NO: 5539211 - DNA, 22 bp, Homo sapiens
ttgcttgcgtgctgggacagct

SEQ ID NO: 5539212 - DNA, 18 bp, Homo sapiens
ttgcttggaaattccttg

SEQ ID NO: 5539213 - DNA, 16 bp, Homo sapiens
ttgcttggactattat

SEQ ID NO: 5539214 - DNA, 15 bp, Homo sapiens
ttgcttggctgcttg

SEQ ID NO: 5539215 - DNA, 14 bp, Homo sapiens
ttgcttgggaaggg

SEQ ID NO: 5539216 - DNA, 15 bp, Homo sapiens
ttgcttgggaagggg

SEQ ID NO: 5539217 - DNA, 16 bp, Homo sapiens
ttgcttgggccactgc

SEQ ID NO: 5539218 - DNA, 23 bp, Homo sapiens
ttgcttgggccactgccctctcc

SEQ ID NO: 5539219 - DNA, 17 bp, Homo sapiens
ttgcttgtaaaaatatg

SEQ ID NO: 5539220 - DNA, 17 bp, Homo sapiens
ttgcttgtactgggaca

SEQ ID NO: 5539221 - DNA, 21 bp, Homo sapiens
ttgcttgtattgtaaatgtgg

SEQ ID NO: 5539222 - DNA, 13 bp, Homo sapiens
ttgcttgttacat

SEQ ID NO: 5539223 - DNA, 23 bp, Homo sapiens
ttgcttgttgggattcctgaccc

SEQ ID NO: 5539224 - DNA, 14 bp, Homo sapiens
ttgctttaaaacaa

SEQ ID NO: 5539225 - DNA, 15 bp, Homo sapiens
ttgctttaaaacaaa

SEQ ID NO: 5539226 - DNA, 14 bp, Homo sapiens
ttgctttaaatctt

SEQ ID NO: 5539227 - DNA, 23 bp, Homo sapiens
ttgctttaagaaactgttactgt

SEQ ID NO: 5539228 - DNA, 18 bp, Homo sapiens
ttgctttaatataaatgc

SEQ ID NO: 5539229 - DNA, 16 bp, Homo sapiens
ttgctttaatatgagc

SEQ ID NO: 5539230 - DNA, 16 bp, Homo sapiens
ttgctttaattaatta

SEQ ID NO: 5539231 - DNA, 23 bp, Homo sapiens
ttgctttaattgctttaaatctt

SEQ ID NO: 5539232 - DNA, 18 bp, Homo sapiens
ttgctttaattgttaaga

SEQ ID NO: 5539233 - DNA, 12 bp, Homo sapiens
ttgctttactgg

SEQ ID NO: 5539234 - DNA, 18 bp, Homo sapiens
ttggatcctcagaactct

SEQ ID NO: 5539235 - DNA, 19 bp, Homo sapiens
ttggatctatcacctgtca

SEQ ID NO: 5539236 - DNA, 21 bp, Homo sapiens
ttggatctattgatttgaaaa

SEQ ID NO: 5539237 - DNA, 19 bp, Homo sapiens
ttggatctccaattgcctc

SEQ ID NO: 5539238 - DNA, 17 bp, Homo sapiens
ttggatctgtgacacat

SEQ ID NO: 5539239 - DNA, 16 bp, Homo sapiens
ttggatcttgaatgtg

SEQ ID NO: 5539240 - DNA, 17 bp, Homo sapiens
ttggatcttgaatgtgg

SEQ ID NO: 5539241 - DNA, 20 bp, Homo sapiens
ttggatgattgttcataata

SEQ ID NO: 5539242 - DNA, 23 bp, Homo sapiens
ttggatgcagtgctcgctgttgc

SEQ ID NO: 5539243 - DNA, 24 bp, Homo sapiens
ttggatgcagtgctcgctgttgct

SEQ ID NO: 5539244 - DNA, 21 bp, Homo sapiens
ttggatggcttaagcctgtgt

SEQ ID NO: 5539245 - DNA, 17 bp, Homo sapiens
ttggatgggacattttt

SEQ ID NO: 5539246 - DNA, 22 bp, Homo sapiens
ttggatgggactagagctttct

SEQ ID NO: 5539247 - DNA, 18 bp, Homo sapiens
ttggatgggagtgggcac

SEQ ID NO: 5539248 - DNA, 23 bp, Homo sapiens
ttggatggggctggcatgttttc

SEQ ID NO: 5539249 - DNA, 20 bp, Homo sapiens
ttggatggtgaagtcacatt

SEQ ID NO: 5539250 - DNA, 14 bp, Homo sapiens
ttggatgtggagct

SEQ ID NO: 5539251 - DNA, 20 bp, Homo sapiens
ttggatgtgggtctttttct

SEQ ID NO: 5539252 - DNA, 15 bp, Homo sapiens
ttggatgttgctata

SEQ ID NO: 5539253 - DNA, 20 bp, Homo sapiens
ttggatgttgctatagtgac

SEQ ID NO: 5539254 - DNA, 23 bp, Homo sapiens
ttggatgttgctatagtgacatg

SEQ ID NO: 5539255 - DNA, 23 bp, Homo sapiens
ttggatgtttttagttctgactt

SEQ ID NO: 5539256 - DNA, 15 bp, Homo sapiens
ttggattaaatacat

SEQ ID NO: 5539257 - DNA, 19 bp, Homo sapiens
ttggattactttgttttaa

SEQ ID NO: 5539258 - DNA, 23 bp, Homo sapiens
ttggattattcatttaaaatgat

SEQ ID NO: 5539259 - DNA, 15 bp, Homo sapiens
ttggattatttaata

SEQ ID NO: 5539260 - DNA, 19 bp, Homo sapiens
ttggattatttaataacat

SEQ ID NO: 5539261 - DNA, 14 bp, Homo sapiens
ttggattattttct

SEQ ID NO: 5539262 - DNA, 12 bp, Homo sapiens
ttggattcacag

SEQ ID NO: 5539263 - DNA, 15 bp, Homo sapiens
ttggattctgagagc

SEQ ID NO: 5539264 - DNA, 15 bp, Homo sapiens
ttggattcttatgta

SEQ ID NO: 5539265 - DNA, 14 bp, Homo sapiens
ttggattctttaaa

SEQ ID NO: 5539266 - DNA, 15 bp, Homo sapiens
ttggattgacagtaa

SEQ ID NO: 5539267 - DNA, 17 bp, Homo sapiens
ttggattgacagtaact

SEQ ID NO: 5539268 - DNA, 18 bp, Homo sapiens
ttggattgacagtaactt

SEQ ID NO: 5539269 - DNA, 14 bp, Homo sapiens
ttggattgtatatt

SEQ ID NO: 5539270 - DNA, 18 bp, Homo sapiens
ttggattgtatattgtgt

SEQ ID NO: 5539271 - DNA, 15 bp, Homo sapiens
ttggattgtccccga

SEQ ID NO: 5539272 - DNA, 14 bp, Homo sapiens
ttggatttcgtgtg

SEQ ID NO: 5539273 - DNA, 16 bp, Homo sapiens
ttggatttctgtgaag

SEQ ID NO: 5539274 - DNA, 15 bp, Homo sapiens
ttggatttctttata

SEQ ID NO: 5539275 - DNA, 14 bp, Homo sapiens
ttggatttgctgtg

SEQ ID NO: 5539276 - DNA, 14 bp, Homo sapiens
ttggatttggagag

SEQ ID NO: 5539277 - DNA, 15 bp, Homo sapiens
ttggatttgtccaaa

SEQ ID NO: 5539278 - DNA, 21 bp, Homo sapiens
ttggatttgtccaaacaggtg

SEQ ID NO: 5539279 - DNA, 18 bp, Homo sapiens
ttggatttgtttaaaagg

SEQ ID NO: 5539280 - DNA, 17 bp, Homo sapiens
ttggattttatgttgac

SEQ ID NO: 5539281 - DNA, 24 bp, Homo sapiens
ttggattttatgttgacatttgtt

SEQ ID NO: 5539282 - DNA, 20 bp, Homo sapiens
ttggattttgcaaggtgcat

SEQ ID NO: 5539283 - DNA, 23 bp, Homo sapiens
ttggatttttaattaaaaactag

SEQ ID NO: 5539284 - DNA, 16 bp, Homo sapiens
ttggatttttgactct

SEQ ID NO: 5539285 - DNA, 15 bp, Homo sapiens
ttggcaaaagccttg

SEQ ID NO: 5539286 - DNA, 17 bp, Homo sapiens
ttggcaaaagccttgtg

SEQ ID NO: 5539287 - DNA, 16 bp, Homo sapiens
ttggcaaacgggcttg

SEQ ID NO: 5539288 - DNA, 16 bp, Homo sapiens
ttggcaaactaaagga

SEQ ID NO: 5539289 - DNA, 23 bp, Homo sapiens
ttggcaaactctccaccacacgt

SEQ ID NO: 5539290 - DNA, 22 bp, Homo sapiens
ttggcaaagtttaaatgtattt

SEQ ID NO: 5539291 - DNA, 14 bp, Homo sapiens
ttggcaaattctga

SEQ ID NO: 5539292 - DNA, 20 bp, Homo sapiens
ttggcaaatttgtgaactgt

SEQ ID NO: 5539293 - DNA, 15 bp, Homo sapiens
ttggcaacagaagca

SEQ ID NO: 5539294 - DNA, 13 bp, Homo sapiens
ttggcaacatctt

SEQ ID NO: 5539295 - DNA, 16 bp, Homo sapiens
ttggcaagaagactgt

SEQ ID NO: 5539296 - DNA, 18 bp, Homo sapiens
ttggcaagaagactgtat

SEQ ID NO: 5539297 - DNA, 20 bp, Homo sapiens
ttggcaagatgaaataattt

SEQ ID NO: 5539298 - DNA, 16 bp, Homo sapiens
ttggcaagatgtttct

SEQ ID NO: 5539299 - DNA, 20 bp, Homo sapiens
ttggcaagatgtttcttata

SEQ ID NO: 5539300 - DNA, 13 bp, Homo sapiens
ttggcaagctgca

SEQ ID NO: 5539301 - DNA, 20 bp, Homo sapiens
ttggcaagtaacttctgact

SEQ ID NO: 5539302 - DNA, 16 bp, Homo sapiens
ttggcaagtcacgttg

SEQ ID NO: 5539303 - DNA, 22 bp, Homo sapiens
ttggcaataaattttgaaaagt

SEQ ID NO: 5539304 - DNA, 18 bp, Homo sapiens
ttggcaatacatttgatt

SEQ ID NO: 5539305 - DNA, 16 bp, Homo sapiens
ttggcaatagtttgca

SEQ ID NO: 5539306 - DNA, 20 bp, Homo sapiens
ttggcaatatcatattctaa

SEQ ID NO: 5539307 - DNA, 19 bp, Homo sapiens
ttggcaatgggccgtcccc

SEQ ID NO: 5539308 - DNA, 16 bp, Homo sapiens
ttggcaatttcctggc

SEQ ID NO: 5539309 - DNA, 12 bp, Homo sapiens
ttggcaattttg

SEQ ID NO: 5539310 - DNA, 13 bp, Homo sapiens
ttggcaattttgt

SEQ ID NO: 5539311 - DNA, 16 bp, Homo sapiens
ttggcacaccctctct

SEQ ID NO: 5539312 - DNA, 16 bp, Homo sapiens
ttggcacagaaacaca

SEQ ID NO: 5539313 - DNA, 15 bp, Homo sapiens
ttggcacatgcaggt

SEQ ID NO: 5539314 - DNA, 18 bp, Homo sapiens
ttggcaccaaagatgcag

SEQ ID NO: 5539315 - DNA, 14 bp, Homo sapiens
ttggcaccaccagg

SEQ ID NO: 5539316 - DNA, 21 bp, Homo sapiens
ttggcaccagacacccaggac

SEQ ID NO: 5539317 - DNA, 23 bp, Homo sapiens
ttggcaccagacacccaggactt

SEQ ID NO: 5539318 - DNA, 20 bp, Homo sapiens
ttggcaccatggtatcatat

SEQ ID NO: 5539319 - DNA, 12 bp, Homo sapiens
ttggcaccccca

SEQ ID NO: 5539320 - DNA, 19 bp, Homo sapiens
ttggcacccccatgctgcc

SEQ ID NO: 5539321 - DNA, 20 bp, Homo sapiens
ttggcacccccatgctgcct

SEQ ID NO: 5539322 - DNA, 18 bp, Homo sapiens
ttggcaccgaagcccaga

SEQ ID NO: 5539323 - DNA, 21 bp, Homo sapiens
ttggcacctaatccaggcaga

SEQ ID NO: 5539324 - DNA, 23 bp, Homo sapiens
ttggcaccttccccctcccccag

SEQ ID NO: 5539325 - DNA, 22 bp, Homo sapiens
ttggcactgagatatttattgt

SEQ ID NO: 5539326 - DNA, 14 bp, Homo sapiens
ttggcactggatgg

SEQ ID NO: 5539327 - DNA, 21 bp, Homo sapiens
ttggcactgtggaactgccac

SEQ ID NO: 5539328 - DNA, 14 bp, Homo sapiens
ttggcacttgtatt

SEQ ID NO: 5539329 - DNA, 20 bp, Homo sapiens
ttggcactttgttttcaaga

SEQ ID NO: 5539330 - DNA, 16 bp, Homo sapiens
ttggcagaactgctgg

SEQ ID NO: 5539331 - DNA, 13 bp, Homo sapiens
ttggcagagaaaa

SEQ ID NO: 5539332 - DNA, 17 bp, Homo sapiens
ttggcagagaaggcctc

SEQ ID NO: 5539333 - DNA, 19 bp, Homo sapiens
ttggcagagacactttgtc

SEQ ID NO: 5539334 - DNA, 13 bp, Homo sapiens
ttggcagagagga

SEQ ID NO: 5539335 - DNA, 14 bp, Homo sapiens
ttggcagagaggac

SEQ ID NO: 5539336 - DNA, 21 bp, Homo sapiens
ttggcagatgcagctcttcct

SEQ ID NO: 5539337 - DNA, 12 bp, Homo sapiens
ttggcagcacag

SEQ ID NO: 5539338 - DNA, 12 bp, Homo sapiens
ttggcagcaggt

SEQ ID NO: 5539339 - DNA, 21 bp, Homo sapiens
ttggcagcaggtgctgctacc

SEQ ID NO: 5539340 - DNA, 22 bp, Homo sapiens
ttggcagcaggtgctgctaccc

SEQ ID NO: 5539341 - DNA, 16 bp, Homo sapiens
ttggcagccaaggaat

SEQ ID NO: 5539342 - DNA, 15 bp, Homo sapiens
ttggcagccatgata

SEQ ID NO: 5539343 - DNA, 17 bp, Homo sapiens
ttggcagccatgataat

SEQ ID NO: 5539344 - DNA, 20 bp, Homo sapiens
ttggcagcctactagggacc

SEQ ID NO: 5539345 - DNA, 16 bp, Homo sapiens
ttggcagcgcctcgcc

SEQ ID NO: 5539346 - DNA, 11 bp, Homo sapiens
ttggcagctct

SEQ ID NO: 5539347 - DNA, 15 bp, Homo sapiens
ttggcagctttttct

SEQ ID NO: 5539348 - DNA, 15 bp, Homo sapiens
ttggcaggaggcagg

SEQ ID NO: 5539349 - DNA, 22 bp, Homo sapiens
ttggcaggagtgggctctgagc

SEQ ID NO: 5539350 - DNA, 13 bp, Homo sapiens
ttggcaggctgag

SEQ ID NO: 5539351 - DNA, 13 bp, Homo sapiens
ttggcaggctggc

SEQ ID NO: 5539352 - DNA, 16 bp, Homo sapiens
ttggcagggatcccca

SEQ ID NO: 5539353 - DNA, 19 bp, Homo sapiens
ttggcaggtaggaatatta

SEQ ID NO: 5539354 - DNA, 16 bp, Homo sapiens
ttggcaggtcctggcc

SEQ ID NO: 5539355 - DNA, 14 bp, Homo sapiens
ttggcagtctgaat

SEQ ID NO: 5539356 - DNA, 14 bp, Homo sapiens
ttggcagtgacttt

SEQ ID NO: 5539357 - DNA, 23 bp, Homo sapiens
ttggcagtgggaatgttctttct

SEQ ID NO: 5539358 - DNA, 11 bp, Homo sapiens
ttggcagtgtt

SEQ ID NO: 5539359 - DNA, 18 bp, Homo sapiens
ttggcataacataaatct

SEQ ID NO: 5539360 - DNA, 19 bp, Homo sapiens
ttggcataacataaatctg

SEQ ID NO: 5539361 - DNA, 20 bp, Homo sapiens
ttggcataatagtcaatttc

SEQ ID NO: 5539362 - DNA, 14 bp, Homo sapiens
ttggcatcacctgc

SEQ ID NO: 5539363 - DNA, 13 bp, Homo sapiens
ttggcatccctgg

SEQ ID NO: 5539364 - DNA, 17 bp, Homo sapiens
ttggcatctctgtccca

SEQ ID NO: 5539365 - DNA, 14 bp, Homo sapiens
ttggcatctgcttt

SEQ ID NO: 5539366 - DNA, 14 bp, Homo sapiens
ttggcatctgtgtg

SEQ ID NO: 5539367 - DNA, 19 bp, Homo sapiens
ttggcatgcatctttaatt

SEQ ID NO: 5539368 - DNA, 16 bp, Homo sapiens
ttggcatggaaattta

SEQ ID NO: 5539369 - DNA, 14 bp, Homo sapiens
ttggcattaaaact

SEQ ID NO: 5539370 - DNA, 18 bp, Homo sapiens
ttggcattatctctttct

SEQ ID NO: 5539371 - DNA, 12 bp, Homo sapiens
ttggcattcctc

SEQ ID NO: 5539372 - DNA, 14 bp, Homo sapiens
ttggcattcttctt

SEQ ID NO: 5539373 - DNA, 15 bp, Homo sapiens
ttggcattctttgca

SEQ ID NO: 5539374 - DNA, 20 bp, Homo sapiens
ttggcattctttgcaatact

SEQ ID NO: 5539375 - DNA, 17 bp, Homo sapiens
ttggcattggaattcta

SEQ ID NO: 5539376 - DNA, 13 bp, Homo sapiens
ttggcatttctat

SEQ ID NO: 5539377 - DNA, 12 bp, Homo sapiens
ttggcatttgca

SEQ ID NO: 5539378 - DNA, 14 bp, Homo sapiens
ttggcatttgctgg

SEQ ID NO: 5539379 - DNA, 15 bp, Homo sapiens
ttggcatttgtgtta

SEQ ID NO: 5539380 - DNA, 16 bp, Homo sapiens
ttggccaaacatcaga

SEQ ID NO: 5539381 - DNA, 15 bp, Homo sapiens
ttggccaaagtgtta

SEQ ID NO: 5539382 - DNA, 15 bp, Homo sapiens
ttggccaagagaagg

SEQ ID NO: 5539383 - DNA, 16 bp, Homo sapiens
ttggccaagagaaggg

SEQ ID NO: 5539384 - DNA, 18 bp, Homo sapiens
ttggccaagagaagggct

SEQ ID NO: 5539385 - DNA, 16 bp, Homo sapiens
ttggccaagcagggag

SEQ ID NO: 5539386 - DNA, 23 bp, Homo sapiens
ttggccaatgcacctaaagaaaa

SEQ ID NO: 5539387 - DNA, 21 bp, Homo sapiens
ttggccacaacctgaaagaca

SEQ ID NO: 5539388 - DNA, 15 bp, Homo sapiens
ttggccacagccagg

SEQ ID NO: 5539389 - DNA, 17 bp, Homo sapiens
ttggccaccccttgctc

SEQ ID NO: 5539390 - DNA, 22 bp, Homo sapiens
ttggccaccccttgctctctgt

SEQ ID NO: 5539391 - DNA, 13 bp, Homo sapiens
ttggccacctgta

SEQ ID NO: 5539392 - DNA, 21 bp, Homo sapiens
ttggccacctgtagccatctg

SEQ ID NO: 5539393 - DNA, 15 bp, Homo sapiens
ttggccactggatcc

SEQ ID NO: 5539394 - DNA, 16 bp, Homo sapiens
ttggccactggatcct

SEQ ID NO: 5539395 - DNA, 20 bp, Homo sapiens
ttggccactggatcctgctg

SEQ ID NO: 5539396 - DNA, 21 bp, Homo sapiens
ttggccactggatcctgctgc

SEQ ID NO: 5539397 - DNA, 22 bp, Homo sapiens
ttggccactgggtctcactcct

SEQ ID NO: 5539398 - DNA, 21 bp, Homo sapiens
ttggccactttgcagacctgg

SEQ ID NO: 5539399 - DNA, 14 bp, Homo sapiens
ttggccagagctga

SEQ ID NO: 5539400 - DNA, 21 bp, Homo sapiens
ttggccagggaggcgcaggga

SEQ ID NO: 5539401 - DNA, 21 bp, Homo sapiens
ttggccatatttacctcagcc

SEQ ID NO: 5539402 - DNA, 17 bp, Homo sapiens
ttggccatcatttcatt

SEQ ID NO: 5539403 - DNA, 18 bp, Homo sapiens
ttggccatccttctgtgt

SEQ ID NO: 5539404 - DNA, 14 bp, Homo sapiens
ttggccatgggagg

SEQ ID NO: 5539405 - DNA, 16 bp, Homo sapiens
ttggcccaagctcttg

SEQ ID NO: 5539406 - DNA, 19 bp, Homo sapiens
ttggcccaagtcattgttt

SEQ ID NO: 5539407 - DNA, 13 bp, Homo sapiens
ttggcccaatgcc

SEQ ID NO: 5539408 - DNA, 22 bp, Homo sapiens
ttggcccaggaaaaacctgtgg

SEQ ID NO: 5539409 - DNA, 23 bp, Homo sapiens
ttggcccatcccgccttctccag

SEQ ID NO: 5539410 - DNA, 21 bp, Homo sapiens
ttggccccccgaccttgtaga

SEQ ID NO: 5539411 - DNA, 18 bp, Homo sapiens
ttggcccccttcaggagc

SEQ ID NO: 5539412 - DNA, 14 bp, Homo sapiens
ttggtgaataacct

SEQ ID NO: 5539413 - DNA, 15 bp, Homo sapiens
ttggtgaattttcaa

SEQ ID NO: 5539414 - DNA, 16 bp, Homo sapiens
ttggtgaccttttgta

SEQ ID NO: 5539415 - DNA, 13 bp, Homo sapiens
ttggtgactcact

SEQ ID NO: 5539416 - DNA, 15 bp, Homo sapiens
ttggtgactgggaaa

SEQ ID NO: 5539417 - DNA, 22 bp, Homo sapiens
ttggtgacttgtctgcctcctg

SEQ ID NO: 5539418 - DNA, 18 bp, Homo sapiens
ttggtgagttgtgccttt

SEQ ID NO: 5539419 - DNA, 15 bp, Homo sapiens
ttggtgataagtgga

SEQ ID NO: 5539420 - DNA, 18 bp, Homo sapiens
ttggtgataagtggaaaa

SEQ ID NO: 5539421 - DNA, 20 bp, Homo sapiens
ttggtgataagtggaaaaaa

SEQ ID NO: 5539422 - DNA, 15 bp, Homo sapiens
ttggtgattcaaatg

SEQ ID NO: 5539423 - DNA, 16 bp, Homo sapiens
ttggtgattcaaatgg

SEQ ID NO: 5539424 - DNA, 16 bp, Homo sapiens
ttggtgattccgcagt

SEQ ID NO: 5539425 - DNA, 20 bp, Homo sapiens
ttggtgcaattaactctgga

SEQ ID NO: 5539426 - DNA, 22 bp, Homo sapiens
ttggtgcacagattgctgaaac

SEQ ID NO: 5539427 - DNA, 22 bp, Homo sapiens
ttggtgcacagcacaaattagt

SEQ ID NO: 5539428 - DNA, 20 bp, Homo sapiens
ttggtgcagaggtttcttga

SEQ ID NO: 5539429 - DNA, 16 bp, Homo sapiens
ttggtgcatagaactg

SEQ ID NO: 5539430 - DNA, 12 bp, Homo sapiens
ttggtgccacca

SEQ ID NO: 5539431 - DNA, 19 bp, Homo sapiens
ttggtgccctcgcctcctc

SEQ ID NO: 5539432 - DNA, 14 bp, Homo sapiens
ttggtgcctcactg

SEQ ID NO: 5539433 - DNA, 17 bp, Homo sapiens
ttggtgcctgcctctgc

SEQ ID NO: 5539434 - DNA, 12 bp, Homo sapiens
ttggtgcctggc

SEQ ID NO: 5539435 - DNA, 20 bp, Homo sapiens
ttggtgcctggcctggcaca

SEQ ID NO: 5539436 - DNA, 22 bp, Homo sapiens
ttggtgcctggcctggcacaca

SEQ ID NO: 5539437 - DNA, 15 bp, Homo sapiens
ttggtgctgatggag

SEQ ID NO: 5539438 - DNA, 18 bp, Homo sapiens
ttggtgctgctcatactg

SEQ ID NO: 5539439 - DNA, 12 bp, Homo sapiens
ttggtgctgctt

SEQ ID NO: 5539440 - DNA, 13 bp, Homo sapiens
ttggtgctgcttt

SEQ ID NO: 5539441 - DNA, 17 bp, Homo sapiens
ttggtgctgttgaaaat

SEQ ID NO: 5539442 - DNA, 14 bp, Homo sapiens
ttggtgcttcagcc

SEQ ID NO: 5539443 - DNA, 21 bp, Homo sapiens
ttggtgctttttataaaaaga

SEQ ID NO: 5539444 - DNA, 16 bp, Homo sapiens
ttggtggagataaaga

SEQ ID NO: 5539445 - DNA, 18 bp, Homo sapiens
ttggtggagcagccagag

SEQ ID NO: 5539446 - DNA, 19 bp, Homo sapiens
ttggtggccggtggttttg

SEQ ID NO: 5539447 - DNA, 19 bp, Homo sapiens
ttggtggcctaatttacaa

SEQ ID NO: 5539448 - DNA, 13 bp, Homo sapiens
ttggtggctgagc

SEQ ID NO: 5539449 - DNA, 14 bp, Homo sapiens
ttggtgggaagcaa

SEQ ID NO: 5539450 - DNA, 21 bp, Homo sapiens
ttggtgggaagcaagcagggg

SEQ ID NO: 5539451 - DNA, 14 bp, Homo sapiens
ttggtggggccagg

SEQ ID NO: 5539452 - DNA, 19 bp, Homo sapiens
ttggtggggggtccagtct

SEQ ID NO: 5539453 - DNA, 21 bp, Homo sapiens
ttggtggggtggcacctgttt

SEQ ID NO: 5539454 - DNA, 20 bp, Homo sapiens
ttggtggtagccatcaagca

SEQ ID NO: 5539455 - DNA, 21 bp, Homo sapiens
ttggtggtctgagctgtccca

SEQ ID NO: 5539456 - DNA, 12 bp, Homo sapiens
ttggtggttttt

SEQ ID NO: 5539457 - DNA, 23 bp, Homo sapiens
ttggtgtaacatcttcaacatgt

SEQ ID NO: 5539458 - DNA, 17 bp, Homo sapiens
ttggtgtaattaataaa

SEQ ID NO: 5539459 - DNA, 22 bp, Homo sapiens
ttggtgtacagaccacctttca

SEQ ID NO: 5539460 - DNA, 15 bp, Homo sapiens
ttggtgtatattata

SEQ ID NO: 5539461 - DNA, 21 bp, Homo sapiens
ttggtgtcaacatgaaacacc

SEQ ID NO: 5539462 - DNA, 17 bp, Homo sapiens
ttggtgtcgggcatgac

SEQ ID NO: 5539463 - DNA, 19 bp, Homo sapiens
ttggtgtcgggcatgacac

SEQ ID NO: 5539464 - DNA, 14 bp, Homo sapiens
ttggtgtctgcggg

SEQ ID NO: 5539465 - DNA, 20 bp, Homo sapiens
ttggtgtgaatttgccagag

SEQ ID NO: 5539466 - DNA, 14 bp, Homo sapiens
ttggtgtgccctgt

SEQ ID NO: 5539467 - DNA, 13 bp, Homo sapiens
ttggtgtgcctta

SEQ ID NO: 5539468 - DNA, 23 bp, Homo sapiens
ttggtgtgttcgttgcacagctg

SEQ ID NO: 5539469 - DNA, 23 bp, Homo sapiens
ttggtgtgtttttgggatgtctt

SEQ ID NO: 5539470 - DNA, 21 bp, Homo sapiens
ttggtgttctaagactctgtg

SEQ ID NO: 5539471 - DNA, 16 bp, Homo sapiens
ttggtgttctggcctc

SEQ ID NO: 5539472 - DNA, 13 bp, Homo sapiens
ttggtgttgacat

SEQ ID NO: 5539473 - DNA, 15 bp, Homo sapiens
ttggtgttgtcattg

SEQ ID NO: 5539474 - DNA, 18 bp, Homo sapiens
ttggtgttgtcattgtaa

SEQ ID NO: 5539475 - DNA, 17 bp, Homo sapiens
ttggtgtttgtctgtgt

SEQ ID NO: 5539476 - DNA, 22 bp, Homo sapiens
ttggttaaaactgtacatttaa

SEQ ID NO: 5539477 - DNA, 22 bp, Homo sapiens
ttggttaagctttgacactgga

SEQ ID NO: 5539478 - DNA, 17 bp, Homo sapiens
ttggttaatcacttaac

SEQ ID NO: 5539479 - DNA, 18 bp, Homo sapiens
ttggttaatttttacatg

SEQ ID NO: 5539480 - DNA, 22 bp, Homo sapiens
ttggttagaagggttacatggt

SEQ ID NO: 5539481 - DNA, 14 bp, Homo sapiens
ttggttagaagtaa

SEQ ID NO: 5539482 - DNA, 17 bp, Homo sapiens
ttggttagagaagtaag

SEQ ID NO: 5539483 - DNA, 16 bp, Homo sapiens
ttggttatacatgaca

SEQ ID NO: 5539484 - DNA, 18 bp, Homo sapiens
ttggttatacatgacact

SEQ ID NO: 5539485 - DNA, 21 bp, Homo sapiens
ttggttatacatgacactgaa

SEQ ID NO: 5539486 - DNA, 20 bp, Homo sapiens
ttggttatagtgcaatatat

SEQ ID NO: 5539487 - DNA, 12 bp, Homo sapiens
ttggttatgaaa

SEQ ID NO: 5539488 - DNA, 23 bp, Homo sapiens
ttggttatgatggaaaggaagaa

SEQ ID NO: 5539489 - DNA, 23 bp, Homo sapiens
ttggttattatatatttaacatg

SEQ ID NO: 5539490 - DNA, 15 bp, Homo sapiens
ttggttcaaatgtgt

SEQ ID NO: 5539491 - DNA, 21 bp, Homo sapiens
ttggttcaataaagcactgag

SEQ ID NO: 5539492 - DNA, 15 bp, Homo sapiens
ttggttcacctgtga

SEQ ID NO: 5539493 - DNA, 20 bp, Homo sapiens
ttggttcagacacctgttca

SEQ ID NO: 5539494 - DNA, 15 bp, Homo sapiens
ttggttcagtttttt

SEQ ID NO: 5539495 - DNA, 14 bp, Homo sapiens
ttggttcccttgtg

SEQ ID NO: 5539496 - DNA, 15 bp, Homo sapiens
ttggttcctcacata

SEQ ID NO: 5539497 - DNA, 13 bp, Homo sapiens
ttggttcctgggg

SEQ ID NO: 5539498 - DNA, 15 bp, Homo sapiens
ttggttccttctctg

SEQ ID NO: 5539499 - DNA, 16 bp, Homo sapiens
ttggttccttgggggg

SEQ ID NO: 5539500 - DNA, 13 bp, Homo sapiens
ttggttctaagga

SEQ ID NO: 5539501 - DNA, 18 bp, Homo sapiens
ttggttctgattaggtaa

SEQ ID NO: 5539502 - DNA, 19 bp, Homo sapiens
ttggttctgcttcaataaa

SEQ ID NO: 5539503 - DNA, 18 bp, Homo sapiens
ttggttctggactaaaac

SEQ ID NO: 5539504 - DNA, 19 bp, Homo sapiens
ttggttcttgacagtgaga

SEQ ID NO: 5539505 - DNA, 22 bp, Homo sapiens
ttggttcttgaggggaccagga

SEQ ID NO: 5539506 - DNA, 22 bp, Homo sapiens
ttggttcttggtagagattcat

SEQ ID NO: 5539507 - DNA, 22 bp, Homo sapiens
ttggttgaaagttagagatttt

SEQ ID NO: 5539508 - DNA, 16 bp, Homo sapiens
ttggttgaataaacta

SEQ ID NO: 5539509 - DNA, 20 bp, Homo sapiens
ttggttgcaattgtttaaga

SEQ ID NO: 5539510 - DNA, 20 bp, Homo sapiens
ttggttgcattattatcatt

SEQ ID NO: 5539511 - DNA, 14 bp, Homo sapiens
ttggttggaagcta

SEQ ID NO: 5539512 - DNA, 15 bp, Homo sapiens
ttggttggctggcct

SEQ ID NO: 5539513 - DNA, 17 bp, Homo sapiens
ttggttggctggttgtt

SEQ ID NO: 5539514 - DNA, 14 bp, Homo sapiens
ttggttggggtggg

SEQ ID NO: 5539515 - DNA, 21 bp, Homo sapiens
ttggttggtaactctgtaatt

SEQ ID NO: 5539516 - DNA, 13 bp, Homo sapiens
ttggttggtgtga

SEQ ID NO: 5539517 - DNA, 13 bp, Homo sapiens
ttggttggttttt

SEQ ID NO: 5539518 - DNA, 14 bp, Homo sapiens
ttggttgtatataa

SEQ ID NO: 5539519 - DNA, 19 bp, Homo sapiens
ttggttgtatataaagttt

SEQ ID NO: 5539520 - DNA, 20 bp, Homo sapiens
ttggttgtctttttctagac

SEQ ID NO: 5539521 - DNA, 15 bp, Homo sapiens
ttggttgtgccttcc

SEQ ID NO: 5539522 - DNA, 14 bp, Homo sapiens
ttggttgtgctgat

SEQ ID NO: 5539523 - DNA, 13 bp, Homo sapiens
ttggttgtttctc

SEQ ID NO: 5539524 - DNA, 18 bp, Homo sapiens
ttggttgttttttccttt

SEQ ID NO: 5539525 - DNA, 18 bp, Homo sapiens
ttggtttaaagaaagtgt

SEQ ID NO: 5539526 - DNA, 22 bp, Homo sapiens
ttggtttaaagaaagtgtattt

SEQ ID NO: 5539527 - DNA, 13 bp, Homo sapiens
ttggtttaagcag

SEQ ID NO: 5539528 - DNA, 14 bp, Homo sapiens
ttggtttacattta

SEQ ID NO: 5539529 - DNA, 13 bp, Homo sapiens
ttggtttactttc

SEQ ID NO: 5539530 - DNA, 17 bp, Homo sapiens
ttggtttagctttggaa

SEQ ID NO: 5539531 - DNA, 13 bp, Homo sapiens
ttggtttatgaga

SEQ ID NO: 5539532 - DNA, 15 bp, Homo sapiens
ttggtttattttcac

SEQ ID NO: 5539533 - DNA, 17 bp, Homo sapiens
ttggtttattttcacag

SEQ ID NO: 5539534 - DNA, 14 bp, Homo sapiens
ttggtttatttttg

SEQ ID NO: 5539535 - DNA, 15 bp, Homo sapiens
ttggtttcccctgca

SEQ ID NO: 5539536 - DNA, 16 bp, Homo sapiens
ttggtttcctatttcc

SEQ ID NO: 5539537 - DNA, 16 bp, Homo sapiens
ttggtttctgcttctc

SEQ ID NO: 5539538 - DNA, 13 bp, Homo sapiens
ttggtttgagaaa

SEQ ID NO: 5539539 - DNA, 19 bp, Homo sapiens
ttggtttggacacagtgtt

SEQ ID NO: 5539540 - DNA, 13 bp, Homo sapiens
ttggtttggtaca

SEQ ID NO: 5539541 - DNA, 17 bp, Homo sapiens
ttggtttggtacagttc

SEQ ID NO: 5539542 - DNA, 21 bp, Homo sapiens
ttggtttgtggcgtctccctc

SEQ ID NO: 5539543 - DNA, 16 bp, Homo sapiens
ttggtttgtgggtcca

SEQ ID NO: 5539544 - DNA, 14 bp, Homo sapiens
ttggtttgtttata

SEQ ID NO: 5539545 - DNA, 15 bp, Homo sapiens
ttggttttaaaagca

SEQ ID NO: 5539546 - DNA, 13 bp, Homo sapiens
ttggttttaaaat

SEQ ID NO: 5539547 - DNA, 20 bp, Homo sapiens
ttggttttaattgaaggaaa

SEQ ID NO: 5539548 - DNA, 23 bp, Homo sapiens
ttggttttatggttacttcttct

SEQ ID NO: 5539549 - DNA, 14 bp, Homo sapiens
ttggttttccatga

SEQ ID NO: 5539550 - DNA, 13 bp, Homo sapiens
ttggttttcctgt

SEQ ID NO: 5539551 - DNA, 15 bp, Homo sapiens
ttggttttctccttc

SEQ ID NO: 5539552 - DNA, 16 bp, Homo sapiens
ttggttttctctctgg

SEQ ID NO: 5539553 - DNA, 21 bp, Homo sapiens
ttggttttgctacataattat

SEQ ID NO: 5539554 - DNA, 14 bp, Homo sapiens
ttggttttgttccc

SEQ ID NO: 5539555 - DNA, 17 bp, Homo sapiens
ttggtttttaaagattt

SEQ ID NO: 5539556 - DNA, 22 bp, Homo sapiens
ttggtttttactgctctgagaa

SEQ ID NO: 5539557 - DNA, 16 bp, Homo sapiens
ttggtttttttgtaca

SEQ ID NO: 5539558 - DNA, 16 bp, Homo sapiens
ttgtaaaaaaaaatgc

SEQ ID NO: 5539559 - DNA, 21 bp, Homo sapiens
ttgtaaaaaaaaatgcctttg

SEQ ID NO: 5539560 - DNA, 16 bp, Homo sapiens
ttgtaaaaaagatttg

SEQ ID NO: 5539561 - DNA, 14 bp, Homo sapiens
ttgtaaaaaattca

SEQ ID NO: 5539562 - DNA, 17 bp, Homo sapiens
ttgtaaaaaattcacat

SEQ ID NO: 5539563 - DNA, 18 bp, Homo sapiens
ttgtaaaaacaaaaagac

SEQ ID NO: 5539564 - DNA, 19 bp, Homo sapiens
ttgtaaaaacagcattgct

SEQ ID NO: 5539565 - DNA, 23 bp, Homo sapiens
ttgtaaaaacagcattgctttct

SEQ ID NO: 5539566 - DNA, 15 bp, Homo sapiens
ttgtaaaaactgaag

SEQ ID NO: 5539567 - DNA, 22 bp, Homo sapiens
ttgtaaaaacttttttctttga

SEQ ID NO: 5539568 - DNA, 12 bp, Homo sapiens
ttgtaaaaagaa

SEQ ID NO: 5539569 - DNA, 14 bp, Homo sapiens
ttgtaaaaagaaat

SEQ ID NO: 5539570 - DNA, 12 bp, Homo sapiens
ttgtaaaaaggg

SEQ ID NO: 5539571 - DNA, 13 bp, Homo sapiens
ttgtaaaaatatg

SEQ ID NO: 5539572 - DNA, 22 bp, Homo sapiens
ttgtaaaaatcttttgaagcat

SEQ ID NO: 5539573 - DNA, 19 bp, Homo sapiens
ttgtaaaaatgagactttt

SEQ ID NO: 5539574 - DNA, 16 bp, Homo sapiens
ttgtaaaaatgagtca

SEQ ID NO: 5539575 - DNA, 15 bp, Homo sapiens
ttgtaaaacaatgcc

SEQ ID NO: 5539576 - DNA, 20 bp, Homo sapiens
ttgtaaaacagctaaatttg

SEQ ID NO: 5539577 - DNA, 18 bp, Homo sapiens
ttgtaaaacattcacacc

SEQ ID NO: 5539578 - DNA, 20 bp, Homo sapiens
ttgtaaaacctgtcaatgat

SEQ ID NO: 5539579 - DNA, 23 bp, Homo sapiens
ttgtaaaactgtgacattccaca

SEQ ID NO: 5539580 - DNA, 13 bp, Homo sapiens
ttgtaaaacttct

SEQ ID NO: 5539581 - DNA, 20 bp, Homo sapiens
ttgtaaaagaacagtaaaca

SEQ ID NO: 5539582 - DNA, 18 bp, Homo sapiens
ttgtaaaatagaaaaagt

SEQ ID NO: 5539583 - DNA, 18 bp, Homo sapiens
ttgtaaaatattatgttt

SEQ ID NO: 5539584 - DNA, 13 bp, Homo sapiens
ttgtaaaatgaca

SEQ ID NO: 5539585 - DNA, 19 bp, Homo sapiens
ttgtaaaatgacaatcatg

SEQ ID NO: 5539586 - DNA, 13 bp, Homo sapiens
ttgtaaaatggtg

SEQ ID NO: 5539587 - DNA, 17 bp, Homo sapiens
ttgtaaaattatttcat

SEQ ID NO: 5539588 - DNA, 22 bp, Homo sapiens
ttgtaaacattagttctatttc

SEQ ID NO: 5539589 - DNA, 13 bp, Homo sapiens
ttgtaaacattta

SEQ ID NO: 5539590 - DNA, 14 bp, Homo sapiens
ttgtaaacatttat

SEQ ID NO: 5539591 - DNA, 19 bp, Homo sapiens
ttgtagctggggctttgat

SEQ ID NO: 5539592 - DNA, 22 bp, Homo sapiens
ttgtagcttaaaaaaaggaaaa

SEQ ID NO: 5539593 - DNA, 16 bp, Homo sapiens
ttgtagctttatcaaa

SEQ ID NO: 5539594 - DNA, 17 bp, Homo sapiens
ttgtagctttatcaaag

SEQ ID NO: 5539595 - DNA, 15 bp, Homo sapiens
ttgtagctttcctgg

SEQ ID NO: 5539596 - DNA, 18 bp, Homo sapiens
ttgtagctttcctggaag

SEQ ID NO: 5539597 - DNA, 23 bp, Homo sapiens
ttgtaggaagataaaaaaactgt

SEQ ID NO: 5539598 - DNA, 16 bp, Homo sapiens
ttgtaggaagcatttt

SEQ ID NO: 5539599 - DNA, 19 bp, Homo sapiens
ttgtaggaatctgccttcc

SEQ ID NO: 5539600 - DNA, 18 bp, Homo sapiens
ttgtaggactaaataatg

SEQ ID NO: 5539601 - DNA, 17 bp, Homo sapiens
ttgtaggataagtgaaa

SEQ ID NO: 5539602 - DNA, 19 bp, Homo sapiens
ttgtaggggtcaaagaaat

SEQ ID NO: 5539603 - DNA, 17 bp, Homo sapiens
ttgtaggtatactatgt

SEQ ID NO: 5539604 - DNA, 19 bp, Homo sapiens
ttgtaggtatactatgtaa

SEQ ID NO: 5539605 - DNA, 22 bp, Homo sapiens
ttgtaggtatgtctgtgccatt

SEQ ID NO: 5539606 - DNA, 19 bp, Homo sapiens
ttgtaggtttctctgcctc

SEQ ID NO: 5539607 - DNA, 16 bp, Homo sapiens
ttgtagtaaaagtggt

SEQ ID NO: 5539608 - DNA, 18 bp, Homo sapiens
ttgtagtaaagaaattta

SEQ ID NO: 5539609 - DNA, 14 bp, Homo sapiens
ttgtagtaaatatt

SEQ ID NO: 5539610 - DNA, 15 bp, Homo sapiens
ttgtagtagtctcat

SEQ ID NO: 5539611 - DNA, 20 bp, Homo sapiens
ttgtagtagtctcattactt

SEQ ID NO: 5539612 - DNA, 20 bp, Homo sapiens
ttgtagtataatttcaagga

SEQ ID NO: 5539613 - DNA, 15 bp, Homo sapiens
ttgtagtcagttttg

SEQ ID NO: 5539614 - DNA, 21 bp, Homo sapiens
ttgtagtgaagctctcaccca

SEQ ID NO: 5539615 - DNA, 19 bp, Homo sapiens
ttgtagtgttcagaaaaaa

SEQ ID NO: 5539616 - DNA, 23 bp, Homo sapiens
ttgtagttaatttattaagtctg

SEQ ID NO: 5539617 - DNA, 17 bp, Homo sapiens
ttgtagttactcaagca

SEQ ID NO: 5539618 - DNA, 19 bp, Homo sapiens
ttgtagttccacttatagc

SEQ ID NO: 5539619 - DNA, 15 bp, Homo sapiens
ttgtagttcttagtc

SEQ ID NO: 5539620 - DNA, 18 bp, Homo sapiens
ttgtagttcttgtgcatg

SEQ ID NO: 5539621 - DNA, 17 bp, Homo sapiens
ttgtagttctttaaact

SEQ ID NO: 5539622 - DNA, 13 bp, Homo sapiens
ttgtagttgaata

SEQ ID NO: 5539623 - DNA, 16 bp, Homo sapiens
ttgtagttgaatattg

SEQ ID NO: 5539624 - DNA, 17 bp, Homo sapiens
ttgtagtttacctcttt

SEQ ID NO: 5539625 - DNA, 18 bp, Homo sapiens
ttgtagtttgaaagttgt

SEQ ID NO: 5539626 - DNA, 23 bp, Homo sapiens
ttgtagtttgaaagttgtacatg

SEQ ID NO: 5539627 - DNA, 15 bp, Homo sapiens
ttgtagtttgcccag

SEQ ID NO: 5539628 - DNA, 16 bp, Homo sapiens
ttgtataaaaaaaata

SEQ ID NO: 5539629 - DNA, 13 bp, Homo sapiens
ttgtataaaaaca

SEQ ID NO: 5539630 - DNA, 19 bp, Homo sapiens
ttgtataaaaaggaaatta

SEQ ID NO: 5539631 - DNA, 23 bp, Homo sapiens
ttgtataaaaaggaaattagtct

SEQ ID NO: 5539632 - DNA, 13 bp, Homo sapiens
ttgtataaaacag

SEQ ID NO: 5539633 - DNA, 18 bp, Homo sapiens
ttgtataaaagttgtact

SEQ ID NO: 5539634 - DNA, 12 bp, Homo sapiens
ttgtataaaata

SEQ ID NO: 5539635 - DNA, 19 bp, Homo sapiens
ttgtataaaatccaaaatg

SEQ ID NO: 5539636 - DNA, 15 bp, Homo sapiens
ttgtataaactgtat

SEQ ID NO: 5539637 - DNA, 23 bp, Homo sapiens
ttgtataaactgtcaaattttca

SEQ ID NO: 5539638 - DNA, 15 bp, Homo sapiens
ttgtataaagaaact

SEQ ID NO: 5539639 - DNA, 19 bp, Homo sapiens
ttgtataaataataaagaa

SEQ ID NO: 5539640 - DNA, 17 bp, Homo sapiens
ttgtataaatgtatata

SEQ ID NO: 5539641 - DNA, 22 bp, Homo sapiens
ttgtataaatgtatatacacat

SEQ ID NO: 5539642 - DNA, 22 bp, Homo sapiens
ttgtataaattaaataaactgt

SEQ ID NO: 5539643 - DNA, 20 bp, Homo sapiens
ttgtataaatttttaagtgt

SEQ ID NO: 5539644 - DNA, 22 bp, Homo sapiens
ttgtataaatttttaagtgtca

SEQ ID NO: 5539645 - DNA, 15 bp, Homo sapiens
ttgtataacaggtta

SEQ ID NO: 5539646 - DNA, 16 bp, Homo sapiens
ttgtataacatcactg

SEQ ID NO: 5539647 - DNA, 16 bp, Homo sapiens
ttgtataactaacagc

SEQ ID NO: 5539648 - DNA, 14 bp, Homo sapiens
ttgtataacttctt

SEQ ID NO: 5539649 - DNA, 18 bp, Homo sapiens
ttgtataagatgctgctg

SEQ ID NO: 5539650 - DNA, 22 bp, Homo sapiens
ttgtataagtaattcagtggga

SEQ ID NO: 5539651 - DNA, 15 bp, Homo sapiens
ttgtataattgtatc

SEQ ID NO: 5539652 - DNA, 16 bp, Homo sapiens
ttgtataattgtatcg

SEQ ID NO: 5539653 - DNA, 12 bp, Homo sapiens
ttgtataatttc

SEQ ID NO: 5539654 - DNA, 22 bp, Homo sapiens
ttgtatacaaatatattgttaa

SEQ ID NO: 5539655 - DNA, 13 bp, Homo sapiens
ttgtatacaagta

SEQ ID NO: 5539656 - DNA, 16 bp, Homo sapiens
ttgtataccaatgtgt

SEQ ID NO: 5539657 - DNA, 17 bp, Homo sapiens
ttgtatacttattttct

SEQ ID NO: 5539658 - DNA, 15 bp, Homo sapiens
ttgtatacttttggt

SEQ ID NO: 5539659 - DNA, 17 bp, Homo sapiens
ttgtatagaccaaagca

SEQ ID NO: 5539660 - DNA, 15 bp, Homo sapiens
ttgtatagtaaagtg

SEQ ID NO: 5539661 - DNA, 15 bp, Homo sapiens
ttgtatagtgtaaaa

SEQ ID NO: 5539662 - DNA, 16 bp, Homo sapiens
ttgtatagttaacaca

SEQ ID NO: 5539663 - DNA, 18 bp, Homo sapiens
ttgtatagttaacacact

SEQ ID NO: 5539664 - DNA, 14 bp, Homo sapiens
ttgtatagttatgt

SEQ ID NO: 5539665 - DNA, 18 bp, Homo sapiens
ttgtatagttatgtaaat

SEQ ID NO: 5539666 - DNA, 19 bp, Homo sapiens
ttgtatagttgcttgcctg

SEQ ID NO: 5539667 - DNA, 15 bp, Homo sapiens
ttgtatataaagttt

SEQ ID NO: 5539668 - DNA, 16 bp, Homo sapiens
ttgtatataaatggtg

SEQ ID NO: 5539669 - DNA, 13 bp, Homo sapiens
ttgtatatacagt

SEQ ID NO: 5539670 - DNA, 20 bp, Homo sapiens
ttgtatatacagttattttg

SEQ ID NO: 5539671 - DNA, 21 bp, Homo sapiens
ttgtatatacagttattttgg

SEQ ID NO: 5539672 - DNA, 20 bp, Homo sapiens
ttgtatatacttcactcact

SEQ ID NO: 5539673 - DNA, 22 bp, Homo sapiens
ttgtatatagagattgtacatt

SEQ ID NO: 5539674 - DNA, 17 bp, Homo sapiens
ttgtatatatatgtgaa

SEQ ID NO: 5539675 - DNA, 21 bp, Homo sapiens
ttgtatatcactaaaagcatg

SEQ ID NO: 5539676 - DNA, 14 bp, Homo sapiens
ttgtatatgactgc

SEQ ID NO: 5539677 - DNA, 18 bp, Homo sapiens
ttgtatatgactgcattt

SEQ ID NO: 5539678 - DNA, 16 bp, Homo sapiens
ttgtatatgatctaat

SEQ ID NO: 5539679 - DNA, 16 bp, Homo sapiens
ttgtatatgctgcatt

SEQ ID NO: 5539680 - DNA, 13 bp, Homo sapiens
ttgtatattacaa

SEQ ID NO: 5539681 - DNA, 22 bp, Homo sapiens
ttgtatattacaacatttatgt

SEQ ID NO: 5539682 - DNA, 14 bp, Homo sapiens
ttgtatattacaat

SEQ ID NO: 5539683 - DNA, 14 bp, Homo sapiens
ttgtatattcactt

SEQ ID NO: 5539684 - DNA, 14 bp, Homo sapiens
ttgtatattctatt

SEQ ID NO: 5539685 - DNA, 17 bp, Homo sapiens
ttgtatattctggaaaa

SEQ ID NO: 5539686 - DNA, 16 bp, Homo sapiens
ttgtatattgattata

SEQ ID NO: 5539687 - DNA, 13 bp, Homo sapiens
ttgtatattggtt

SEQ ID NO: 5539688 - DNA, 14 bp, Homo sapiens
ttgtatattggttt

SEQ ID NO: 5539689 - DNA, 16 bp, Homo sapiens
ttgtatattgtcagat

SEQ ID NO: 5539690 - DNA, 15 bp, Homo sapiens
ttgtatattgtgttt

SEQ ID NO: 5539691 - DNA, 14 bp, Homo sapiens
ttgtatatttgcaa

SEQ ID NO: 5539692 - DNA, 15 bp, Homo sapiens
ttgtatatttgtaca

SEQ ID NO: 5539693 - DNA, 16 bp, Homo sapiens
ttgtatatttgtacaa

SEQ ID NO: 5539694 - DNA, 17 bp, Homo sapiens
ttgtatatttgtacaaa

SEQ ID NO: 5539695 - DNA, 13 bp, Homo sapiens
ttgtatcaaatgt

SEQ ID NO: 5539696 - DNA, 19 bp, Homo sapiens
ttgtatcacaaatcttaac

SEQ ID NO: 5539697 - DNA, 14 bp, Homo sapiens
ttgtatcctggcaa

SEQ ID NO: 5539698 - DNA, 15 bp, Homo sapiens
ttgtatcctggcaaa

SEQ ID NO: 5539699 - DNA, 20 bp, Homo sapiens
ttgtatcctggcaaataata

SEQ ID NO: 5539700 - DNA, 21 bp, Homo sapiens
ttgtatcctggcaaataatac

SEQ ID NO: 5539701 - DNA, 22 bp, Homo sapiens
ttgtatcctggcaaataatact

SEQ ID NO: 5539702 - DNA, 18 bp, Homo sapiens
ttgtatcgatgttatgta

SEQ ID NO: 5539703 - DNA, 17 bp, Homo sapiens
ttgtatcgtatagctgt

SEQ ID NO: 5539704 - DNA, 20 bp, Homo sapiens
ttgtatctagtgcagctgat

SEQ ID NO: 5539705 - DNA, 20 bp, Homo sapiens
ttgtatctcagtctaaggtc

SEQ ID NO: 5539706 - DNA, 15 bp, Homo sapiens
ttgtatctcctttaa

SEQ ID NO: 5539707 - DNA, 15 bp, Homo sapiens
ttgtatctgatatca

SEQ ID NO: 5539708 - DNA, 18 bp, Homo sapiens
ttgtatctgtctttccac

SEQ ID NO: 5539709 - DNA, 15 bp, Homo sapiens
ttgtatctttatgct

SEQ ID NO: 5539710 - DNA, 18 bp, Homo sapiens
ttgtatctttctttctct

SEQ ID NO: 5539711 - DNA, 17 bp, Homo sapiens
ttgtatgaaatatatgt

SEQ ID NO: 5539712 - DNA, 22 bp, Homo sapiens
ttgtatgacttctgctgaagga

SEQ ID NO: 5539713 - DNA, 16 bp, Homo sapiens
ttgtatgagatggtta

SEQ ID NO: 5539714 - DNA, 22 bp, Homo sapiens
ttgtatgagatggttaaaaagg

SEQ ID NO: 5539715 - DNA, 20 bp, Homo sapiens
ttgtatgaggtcctcaggtc

SEQ ID NO: 5539716 - DNA, 22 bp, Homo sapiens
ttgtatgaggtcctcaggtcag

SEQ ID NO: 5539717 - DNA, 20 bp, Homo sapiens
ttgtatgatcctaatgaatg

SEQ ID NO: 5539718 - DNA, 20 bp, Homo sapiens
ttgtatgatgtgttgtgata

SEQ ID NO: 5539719 - DNA, 17 bp, Homo sapiens
ttgtatgcagggagcac

SEQ ID NO: 5539720 - DNA, 20 bp, Homo sapiens
ttgtatgcctttaaatctgt

SEQ ID NO: 5539721 - DNA, 18 bp, Homo sapiens
ttgtatgctgaatttcta

SEQ ID NO: 5539722 - DNA, 13 bp, Homo sapiens
ttgtatgctgccc

SEQ ID NO: 5539723 - DNA, 20 bp, Homo sapiens
ttgtatggggaggcaagtgt

SEQ ID NO: 5539724 - DNA, 15 bp, Homo sapiens
ttgtatgtaaatctg

SEQ ID NO: 5539725 - DNA, 13 bp, Homo sapiens
ttgtatgtaaatg

SEQ ID NO: 5539726 - DNA, 16 bp, Homo sapiens
ttgtatgtaaatgtgc

SEQ ID NO: 5539727 - DNA, 16 bp, Homo sapiens
ttgtatgtcaaagctt

SEQ ID NO: 5539728 - DNA, 14 bp, Homo sapiens
ttgtatgtctgtgt

SEQ ID NO: 5539729 - DNA, 14 bp, Homo sapiens
ttgtatgtggaagt

SEQ ID NO: 5539730 - DNA, 15 bp, Homo sapiens
ttgtatgtggaagta

SEQ ID NO: 5539731 - DNA, 19 bp, Homo sapiens
ttgtatgttagaataattt

SEQ ID NO: 5539732 - DNA, 14 bp, Homo sapiens
ttgtatgttgagga

SEQ ID NO: 5539733 - DNA, 18 bp, Homo sapiens
ttgtatgttgaggatcta

SEQ ID NO: 5539734 - DNA, 12 bp, Homo sapiens
ttgtatgtttgc

SEQ ID NO: 5539735 - DNA, 17 bp, Homo sapiens
ttgtattaaaaatagat

SEQ ID NO: 5539736 - DNA, 16 bp, Homo sapiens
ttgtattaaagacaga

SEQ ID NO: 5539737 - DNA, 19 bp, Homo sapiens
ttgtattaacaaagttact

SEQ ID NO: 5539738 - DNA, 13 bp, Homo sapiens
ttgtattaagaat

SEQ ID NO: 5539739 - DNA, 16 bp, Homo sapiens
ttgtattaataaagca

SEQ ID NO: 5539740 - DNA, 14 bp, Homo sapiens
ttgtattacatcta

SEQ ID NO: 5539741 - DNA, 16 bp, Homo sapiens
ttgtattacatctaat

SEQ ID NO: 5539742 - DNA, 18 bp, Homo sapiens
ttgtattactgcttccca

SEQ ID NO: 5539743 - DNA, 15 bp, Homo sapiens
ttgtattagatgttc

SEQ ID NO: 5539744 - DNA, 16 bp, Homo sapiens
ttgtattataattgtt

SEQ ID NO: 5539745 - DNA, 20 bp, Homo sapiens
ttgtattatcagtgaatata

SEQ ID NO: 5539746 - DNA, 22 bp, Homo sapiens
ttgtattatcagtgaatataaa

SEQ ID NO: 5539747 - DNA, 14 bp, Homo sapiens
ttgtattatcatat

SEQ ID NO: 5539748 - DNA, 19 bp, Homo sapiens
ttgtattatcatatatgct

SEQ ID NO: 5539749 - DNA, 15 bp, Homo sapiens
ttgtattattacaaa

SEQ ID NO: 5539750 - DNA, 19 bp, Homo sapiens
ttgtattatttcaccagca

SEQ ID NO: 5539751 - DNA, 13 bp, Homo sapiens
ttgtattatttgg

SEQ ID NO: 5539752 - DNA, 14 bp, Homo sapiens
ttgtattatttgga

SEQ ID NO: 5539753 - DNA, 18 bp, Homo sapiens
ttgtattatttggagtta

SEQ ID NO: 5539754 - DNA, 21 bp, Homo sapiens
ttgtattcagagttgatggtt

SEQ ID NO: 5539755 - DNA, 17 bp, Homo sapiens
ttgtattccaagcatat

SEQ ID NO: 5539756 - DNA, 21 bp, Homo sapiens
ttgtattctctcctgtacctc

SEQ ID NO: 5539757 - DNA, 14 bp, Homo sapiens
ttgtattctctgag

SEQ ID NO: 5539758 - DNA, 15 bp, Homo sapiens
ttgtattctctgcaa

SEQ ID NO: 5539759 - DNA, 15 bp, Homo sapiens
ttgtattctctgtcc

SEQ ID NO: 5539760 - DNA, 21 bp, Homo sapiens
ttgtattgcatgcaatttgaa

SEQ ID NO: 5539761 - DNA, 15 bp, Homo sapiens
ttgtattgctgctgt

SEQ ID NO: 5539762 - DNA, 16 bp, Homo sapiens
ttgtattggtgaaaga

SEQ ID NO: 5539763 - DNA, 17 bp, Homo sapiens
ttgtattgtaaatgtgg

SEQ ID NO: 5539764 - DNA, 13 bp, Homo sapiens
ttgtattgtacat

SEQ ID NO: 5539765 - DNA, 18 bp, Homo sapiens
ttgtattgtatattacaa

SEQ ID NO: 5539766 - DNA, 19 bp, Homo sapiens
ttgtattgtggtattgaat

SEQ ID NO: 5539767 - DNA, 20 bp, Homo sapiens
ttgtattgttagatgtttgt

SEQ ID NO: 5539768 - DNA, 13 bp, Homo sapiens
ttgtattgttgaa

SEQ ID NO: 5539769 - DNA, 16 bp, Homo sapiens
ttgtattgtttcaatt

SEQ ID NO: 5539770 - DNA, 14 bp, Homo sapiens
ttgtgctgatgaga

SEQ ID NO: 5539771 - DNA, 12 bp, Homo sapiens
ttgtgctgccat

SEQ ID NO: 5539772 - DNA, 11 bp, Homo sapiens
ttgtgctgctg

SEQ ID NO: 5539773 - DNA, 15 bp, Homo sapiens
ttgtgctgctgagtc

SEQ ID NO: 5539774 - DNA, 18 bp, Homo sapiens
ttgtgctggatggagccc

SEQ ID NO: 5539775 - DNA, 20 bp, Homo sapiens
ttgtgctgggagcaggactg

SEQ ID NO: 5539776 - DNA, 21 bp, Homo sapiens
ttgtgctgggtcccagcctgg

SEQ ID NO: 5539777 - DNA, 14 bp, Homo sapiens
ttgtgcttaataat

SEQ ID NO: 5539778 - DNA, 15 bp, Homo sapiens
ttgtgcttagaattg

SEQ ID NO: 5539779 - DNA, 11 bp, Homo sapiens
ttgtgcttcta

SEQ ID NO: 5539780 - DNA, 11 bp, Homo sapiens
ttgtgcttctc

SEQ ID NO: 5539781 - DNA, 13 bp, Homo sapiens
ttgtgcttcttca

SEQ ID NO: 5539782 - DNA, 15 bp, Homo sapiens
ttgtgcttgttcttc

SEQ ID NO: 5539783 - DNA, 13 bp, Homo sapiens
ttgtgctttcctg

SEQ ID NO: 5539784 - DNA, 15 bp, Homo sapiens
ttgtgcttttcctga

SEQ ID NO: 5539785 - DNA, 16 bp, Homo sapiens
ttgtgctttttgtcat

SEQ ID NO: 5539786 - DNA, 23 bp, Homo sapiens
ttgtggaaacagctggtactgat

SEQ ID NO: 5539787 - DNA, 21 bp, Homo sapiens
ttgtggaagacacttgctgag

SEQ ID NO: 5539788 - DNA, 22 bp, Homo sapiens
ttgtggaagcaaaaatctgaaa

SEQ ID NO: 5539789 - DNA, 17 bp, Homo sapiens
ttgtggaatactagcta

SEQ ID NO: 5539790 - DNA, 16 bp, Homo sapiens
ttgtggacacagctct

SEQ ID NO: 5539791 - DNA, 17 bp, Homo sapiens
ttgtggacactacacgt

SEQ ID NO: 5539792 - DNA, 18 bp, Homo sapiens
ttgtggaccaattattga

SEQ ID NO: 5539793 - DNA, 16 bp, Homo sapiens
ttgtggactgagcgag

SEQ ID NO: 5539794 - DNA, 13 bp, Homo sapiens
ttgtggactttat

SEQ ID NO: 5539795 - DNA, 14 bp, Homo sapiens
ttgtggagagaatg

SEQ ID NO: 5539796 - DNA, 20 bp, Homo sapiens
ttgtggagatcacagcccca

SEQ ID NO: 5539797 - DNA, 14 bp, Homo sapiens
ttgtggagtttgta

SEQ ID NO: 5539798 - DNA, 13 bp, Homo sapiens
ttgtggatactat

SEQ ID NO: 5539799 - DNA, 18 bp, Homo sapiens
ttgtggatataaaatgtg

SEQ ID NO: 5539800 - DNA, 15 bp, Homo sapiens
ttgtggatgggaggc

SEQ ID NO: 5539801 - DNA, 14 bp, Homo sapiens
ttgtggatgtcttc

SEQ ID NO: 5539802 - DNA, 21 bp, Homo sapiens
ttgtggatgttttaattccat

SEQ ID NO: 5539803 - DNA, 17 bp, Homo sapiens
ttgtggattaaaccttt

SEQ ID NO: 5539804 - DNA, 22 bp, Homo sapiens
ttgtggatttaacagaaatgta

SEQ ID NO: 5539805 - DNA, 15 bp, Homo sapiens
ttgtggatttcagtt

SEQ ID NO: 5539806 - DNA, 16 bp, Homo sapiens
ttgtggatttcagttt

SEQ ID NO: 5539807 - DNA, 18 bp, Homo sapiens
ttgtggcaagtgaatttg

SEQ ID NO: 5539808 - DNA, 19 bp, Homo sapiens
ttgtggcagaagtgtttca

SEQ ID NO: 5539809 - DNA, 15 bp, Homo sapiens
ttgtggcagcctgat

SEQ ID NO: 5539810 - DNA, 18 bp, Homo sapiens
ttgtggccaaggagctgc

SEQ ID NO: 5539811 - DNA, 17 bp, Homo sapiens
ttgtggcctaagaggct

SEQ ID NO: 5539812 - DNA, 21 bp, Homo sapiens
ttgtggcctgggcctcctcac

SEQ ID NO: 5539813 - DNA, 18 bp, Homo sapiens
ttgtggcctttgcgctcc

SEQ ID NO: 5539814 - DNA, 17 bp, Homo sapiens
ttgtggctatcctgatt

SEQ ID NO: 5539815 - DNA, 17 bp, Homo sapiens
ttgtggctattaaaact

SEQ ID NO: 5539816 - DNA, 15 bp, Homo sapiens
ttgtggctcttattt

SEQ ID NO: 5539817 - DNA, 21 bp, Homo sapiens
ttgtggctgatttcaaatgca

SEQ ID NO: 5539818 - DNA, 20 bp, Homo sapiens
ttgtggctgtcagcaggaag

SEQ ID NO: 5539819 - DNA, 22 bp, Homo sapiens
ttgtggctgttgagatgtgctt

SEQ ID NO: 5539820 - DNA, 16 bp, Homo sapiens
ttgtgggcaaaggcag

SEQ ID NO: 5539821 - DNA, 19 bp, Homo sapiens
ttgtgggccccccttgcct

SEQ ID NO: 5539822 - DNA, 13 bp, Homo sapiens
ttgtgggcctggg

SEQ ID NO: 5539823 - DNA, 19 bp, Homo sapiens
ttgtgggcctgggctcctg

SEQ ID NO: 5539824 - DNA, 23 bp, Homo sapiens
ttgtgggcctgggctcctggacc

SEQ ID NO: 5539825 - DNA, 11 bp, Homo sapiens
ttgtgggctgg

SEQ ID NO: 5539826 - DNA, 23 bp, Homo sapiens
ttgtgggcttcctgctgggactg

SEQ ID NO: 5539827 - DNA, 14 bp, Homo sapiens
ttgtggggccagga

SEQ ID NO: 5539828 - DNA, 17 bp, Homo sapiens
ttgtggggcctgggagg

SEQ ID NO: 5539829 - DNA, 20 bp, Homo sapiens
ttgtggggctggaaggacct

SEQ ID NO: 5539830 - DNA, 16 bp, Homo sapiens
ttgtgggggactgtaa

SEQ ID NO: 5539831 - DNA, 23 bp, Homo sapiens
ttgtgggggtgtcacagaggcag

SEQ ID NO: 5539832 - DNA, 21 bp, Homo sapiens
ttgtggggtgcagctgggtgg

SEQ ID NO: 5539833 - DNA, 18 bp, Homo sapiens
ttgtgggtatttcttggc

SEQ ID NO: 5539834 - DNA, 18 bp, Homo sapiens
ttgtgggtttctctgtgc

SEQ ID NO: 5539835 - DNA, 19 bp, Homo sapiens
ttgtgggtttttcatcttt

SEQ ID NO: 5539836 - DNA, 14 bp, Homo sapiens
ttgtggtaaaaaga

SEQ ID NO: 5539837 - DNA, 22 bp, Homo sapiens
ttgtggtaggccttttaacatt

SEQ ID NO: 5539838 - DNA, 14 bp, Homo sapiens
ttgtggtccaaata

SEQ ID NO: 5539839 - DNA, 19 bp, Homo sapiens
ttgtggtgtaaagctggcc

SEQ ID NO: 5539840 - DNA, 11 bp, Homo sapiens
ttgtggtgtga

SEQ ID NO: 5539841 - DNA, 22 bp, Homo sapiens
ttgtggtgtgaccatgttcatt

SEQ ID NO: 5539842 - DNA, 13 bp, Homo sapiens
ttgtggttaatct

SEQ ID NO: 5539843 - DNA, 17 bp, Homo sapiens
ttgtggttattattttt

SEQ ID NO: 5539844 - DNA, 15 bp, Homo sapiens
ttgtggttctatttt

SEQ ID NO: 5539845 - DNA, 16 bp, Homo sapiens
ttgtggttctatttta

SEQ ID NO: 5539846 - DNA, 16 bp, Homo sapiens
ttgtggttgaaatctg

SEQ ID NO: 5539847 - DNA, 13 bp, Homo sapiens
ttgtggtttgttg

SEQ ID NO: 5539848 - DNA, 15 bp, Homo sapiens
ttgtgtaaaaaatgg

SEQ ID NO: 5539849 - DNA, 16 bp, Homo sapiens
ttgtgtaaatttgtat

SEQ ID NO: 5539850 - DNA, 23 bp, Homo sapiens
ttgtgtaactaatttgtggtaaa

SEQ ID NO: 5539851 - DNA, 18 bp, Homo sapiens
ttgtgtaagaaatacaga

SEQ ID NO: 5539852 - DNA, 15 bp, Homo sapiens
ttgtgtaaggaaaaa

SEQ ID NO: 5539853 - DNA, 17 bp, Homo sapiens
ttgtgtaataaagtgtt

SEQ ID NO: 5539854 - DNA, 21 bp, Homo sapiens
ttgtgtaataaagtgttttca

SEQ ID NO: 5539855 - DNA, 22 bp, Homo sapiens
ttgtgtaataaagtgttttcag

SEQ ID NO: 5539856 - DNA, 23 bp, Homo sapiens
ttgtgtaatattactttaacatg

SEQ ID NO: 5539857 - DNA, 18 bp, Homo sapiens
ttgtgtaatttaagtgac

SEQ ID NO: 5539858 - DNA, 20 bp, Homo sapiens
ttgtgtacaaagtagagaag

SEQ ID NO: 5539859 - DNA, 19 bp, Homo sapiens
ttgtgtacagtatgtgtct

SEQ ID NO: 5539860 - DNA, 20 bp, Homo sapiens
ttgtgtacagtatgtgtcta

SEQ ID NO: 5539861 - DNA, 19 bp, Homo sapiens
ttgtgtacatagagcaatg

SEQ ID NO: 5539862 - DNA, 21 bp, Homo sapiens
ttgtgtacatagagcaatgtt

SEQ ID NO: 5539863 - DNA, 15 bp, Homo sapiens
ttgtgtactctggcc

SEQ ID NO: 5539864 - DNA, 20 bp, Homo sapiens
ttgtgtactgataaaatact

SEQ ID NO: 5539865 - DNA, 21 bp, Homo sapiens
ttgtgtagaagtccacagaca

SEQ ID NO: 5539866 - DNA, 13 bp, Homo sapiens
ttgtgtagatttg

SEQ ID NO: 5539867 - DNA, 14 bp, Homo sapiens
ttgtgtagatttga

SEQ ID NO: 5539868 - DNA, 14 bp, Homo sapiens
ttgtgtagcctttt

SEQ ID NO: 5539869 - DNA, 21 bp, Homo sapiens
ttgtgtaggaaatctgaagcc

SEQ ID NO: 5539870 - DNA, 22 bp, Homo sapiens
ttgtgtaggaaatctgaagcct

SEQ ID NO: 5539871 - DNA, 22 bp, Homo sapiens
ttgtgtagtcttcaactggtta

SEQ ID NO: 5539872 - DNA, 19 bp, Homo sapiens
ttgtgtataatgtgcttta

SEQ ID NO: 5539873 - DNA, 16 bp, Homo sapiens
ttgtgtatagaactgg

SEQ ID NO: 5539874 - DNA, 15 bp, Homo sapiens
ttgtgtatatatctt

SEQ ID NO: 5539875 - DNA, 21 bp, Homo sapiens
ttgtgtatatatcttataact

SEQ ID NO: 5539876 - DNA, 15 bp, Homo sapiens
ttgtgtatatttaag

SEQ ID NO: 5539877 - DNA, 17 bp, Homo sapiens
ttgtgtatatttgcttc

SEQ ID NO: 5539878 - DNA, 14 bp, Homo sapiens
ttgtgtatatttgt

SEQ ID NO: 5539879 - DNA, 21 bp, Homo sapiens
ttgtgtatccattatcatgtg

SEQ ID NO: 5539880 - DNA, 10 bp, Homo sapiens
ttgtgtatgg

SEQ ID NO: 5539881 - DNA, 13 bp, Homo sapiens
ttgtgtatgtact

SEQ ID NO: 5539882 - DNA, 16 bp, Homo sapiens
ttgtgtattagatatc

SEQ ID NO: 5539883 - DNA, 11 bp, Homo sapiens
ttgtgtattga

SEQ ID NO: 5539884 - DNA, 16 bp, Homo sapiens
ttgtgtattgatgcaa

SEQ ID NO: 5539885 - DNA, 13 bp, Homo sapiens
ttgtgtatttaac

SEQ ID NO: 5539886 - DNA, 14 bp, Homo sapiens
ttgtgtatttaaca

SEQ ID NO: 5539887 - DNA, 21 bp, Homo sapiens
ttgtgtatttaacagggaggg

SEQ ID NO: 5539888 - DNA, 20 bp, Homo sapiens
ttgtgtatttctctgtgaat

SEQ ID NO: 5539889 - DNA, 18 bp, Homo sapiens
ttgtgtcaagacatttct

SEQ ID NO: 5539890 - DNA, 19 bp, Homo sapiens
ttgtgtcactgtacagttt

SEQ ID NO: 5539891 - DNA, 20 bp, Homo sapiens
ttgtgtcactgtacagtttt

SEQ ID NO: 5539892 - DNA, 19 bp, Homo sapiens
ttgtgtcataccagaaagc

SEQ ID NO: 5539893 - DNA, 21 bp, Homo sapiens
ttgtgtcatttattcaagtat

SEQ ID NO: 5539894 - DNA, 23 bp, Homo sapiens
ttgtgtccctggaaccttctaga

SEQ ID NO: 5539895 - DNA, 18 bp, Homo sapiens
ttgtgtctagggcagagt

SEQ ID NO: 5539896 - DNA, 20 bp, Homo sapiens
ttgtgtctatgatgttgctg

SEQ ID NO: 5539897 - DNA, 22 bp, Homo sapiens
ttgtgtctcatttagaaacaat

SEQ ID NO: 5539898 - DNA, 22 bp, Homo sapiens
ttgtgtctgaaaatatctcttg

SEQ ID NO: 5539899 - DNA, 18 bp, Homo sapiens
ttgtgtctgcctgcctca

SEQ ID NO: 5539900 - DNA, 18 bp, Homo sapiens
ttgtgtctggagcctgca

SEQ ID NO: 5539901 - DNA, 19 bp, Homo sapiens
ttgtgtctggcagtttata

SEQ ID NO: 5539902 - DNA, 15 bp, Homo sapiens
ttgtgtctgtacacg

SEQ ID NO: 5539903 - DNA, 13 bp, Homo sapiens
ttgtgtctgtgtt

SEQ ID NO: 5539904 - DNA, 16 bp, Homo sapiens
ttgtgtctttgtctgg

SEQ ID NO: 5539905 - DNA, 19 bp, Homo sapiens
ttgtgtctttgtctggcca

SEQ ID NO: 5539906 - DNA, 18 bp, Homo sapiens
ttgtgtcttttaaactgg

SEQ ID NO: 5539907 - DNA, 23 bp, Homo sapiens
ttgtgtgaaaaaagaaaatggct

SEQ ID NO: 5539908 - DNA, 14 bp, Homo sapiens
ttgtgtgaaattgc

SEQ ID NO: 5539909 - DNA, 16 bp, Homo sapiens
ttgtgtgaaattgcat

SEQ ID NO: 5539910 - DNA, 23 bp, Homo sapiens
ttgtgtgaccaactgtgttgtat

SEQ ID NO: 5539911 - DNA, 18 bp, Homo sapiens
ttgtgtgatatttcagaa

SEQ ID NO: 5539912 - DNA, 21 bp, Homo sapiens
ttgtgtgatatttcagaaata

SEQ ID NO: 5539913 - DNA, 14 bp, Homo sapiens
ttgtgtgatttaag

SEQ ID NO: 5539914 - DNA, 17 bp, Homo sapiens
ttgtgtgcctctagctg

SEQ ID NO: 5539915 - DNA, 13 bp, Homo sapiens
ttgtgtgctctcc

SEQ ID NO: 5539916 - DNA, 14 bp, Homo sapiens
ttgtgtgctctcca

SEQ ID NO: 5539917 - DNA, 16 bp, Homo sapiens
ttgtgtgcttctgctc

SEQ ID NO: 5539918 - DNA, 19 bp, Homo sapiens
ttgtgtggaaatcatacca

SEQ ID NO: 5539919 - DNA, 17 bp, Homo sapiens
ttgtgtggatatttatt

SEQ ID NO: 5539920 - DNA, 21 bp, Homo sapiens
ttgtgtggcccagcacgagcc

SEQ ID NO: 5539921 - DNA, 20 bp, Homo sapiens
ttgtgtgggtttactctgtg

SEQ ID NO: 5539922 - DNA, 23 bp, Homo sapiens
ttgtgtgggtttactctgtgcta

SEQ ID NO: 5539923 - DNA, 17 bp, Homo sapiens
ttgtgtggtattcaact

SEQ ID NO: 5539924 - DNA, 19 bp, Homo sapiens
ttgtgtggtttcccctttc

SEQ ID NO: 5539925 - DNA, 20 bp, Homo sapiens
ttgtgtgtatgctgcttttc

SEQ ID NO: 5539926 - DNA, 19 bp, Homo sapiens
ttgtgtgtatgtctatgtg

SEQ ID NO: 5539927 - DNA, 14 bp, Homo sapiens
ttgtgtgtatttgt

SEQ ID NO: 5539928 - DNA, 18 bp, Homo sapiens
ttgtgtgtatttgtatta

SEQ ID NO: 5539929 - DNA, 21 bp, Homo sapiens
ttgtgtgtatttgtattaata

SEQ ID NO: 5539930 - DNA, 15 bp, Homo sapiens
ttgtgtgttatattc

SEQ ID NO: 5539931 - DNA, 17 bp, Homo sapiens
ttgtgtgtttattgtca

SEQ ID NO: 5539932 - DNA, 18 bp, Homo sapiens
ttgtgtgttttgtacact

SEQ ID NO: 5539933 - DNA, 20 bp, Homo sapiens
ttgtgtgttttgtacactta

SEQ ID NO: 5539934 - DNA, 13 bp, Homo sapiens
ttgtgttactaag

SEQ ID NO: 5539935 - DNA, 20 bp, Homo sapiens
ttgtgttactaagtttttat

SEQ ID NO: 5539936 - DNA, 15 bp, Homo sapiens
ttgtgttattcgtga

SEQ ID NO: 5539937 - DNA, 22 bp, Homo sapiens
ttgtgttcagaagaatcttcct

SEQ ID NO: 5539938 - DNA, 21 bp, Homo sapiens
ttgtgttcagctctttccaaa

SEQ ID NO: 5539939 - DNA, 14 bp, Homo sapiens
ttgtgttcctatgg

SEQ ID NO: 5539940 - DNA, 11 bp, Homo sapiens
ttgtgttcctg

SEQ ID NO: 5539941 - DNA, 12 bp, Homo sapiens
ttgtgttcctgg

SEQ ID NO: 5539942 - DNA, 17 bp, Homo sapiens
ttgtgttcctggctgat

SEQ ID NO: 5539943 - DNA, 14 bp, Homo sapiens
ttgtgttccttctg

SEQ ID NO: 5539944 - DNA, 17 bp, Homo sapiens
ttgtgttccttctgtga

SEQ ID NO: 5539945 - DNA, 14 bp, Homo sapiens
ttgtgttccttttt

SEQ ID NO: 5539946 - DNA, 13 bp, Homo sapiens
ttgtgttctaata

SEQ ID NO: 5539947 - DNA, 15 bp, Homo sapiens
ttgtgttctctttaa

SEQ ID NO: 5539948 - DNA, 22 bp, Homo sapiens
ttgtttctatactgtttgtaat

SEQ ID NO: 5539949 - DNA, 17 bp, Homo sapiens
ttgtttctctgttgtaa

SEQ ID NO: 5539950 - DNA, 12 bp, Homo sapiens
ttgtttctgaaa

SEQ ID NO: 5539951 - DNA, 18 bp, Homo sapiens
ttgtttctgagaaaagaa

SEQ ID NO: 5539952 - DNA, 14 bp, Homo sapiens
ttgtttctgatcta

SEQ ID NO: 5539953 - DNA, 20 bp, Homo sapiens
ttgtttctgggtccctgctc

SEQ ID NO: 5539954 - DNA, 12 bp, Homo sapiens
ttgtttctgtac

SEQ ID NO: 5539955 - DNA, 14 bp, Homo sapiens
ttgtttctgtactt

SEQ ID NO: 5539956 - DNA, 17 bp, Homo sapiens
ttgtttctgtcaagcat

SEQ ID NO: 5539957 - DNA, 16 bp, Homo sapiens
ttgtttctgttccaaa

SEQ ID NO: 5539958 - DNA, 14 bp, Homo sapiens
ttgtttctgtttct

SEQ ID NO: 5539959 - DNA, 23 bp, Homo sapiens
ttgtttcttaaataagaaacttt

SEQ ID NO: 5539960 - DNA, 18 bp, Homo sapiens
ttgtttcttatagatttt

SEQ ID NO: 5539961 - DNA, 13 bp, Homo sapiens
ttgtttcttccaa

SEQ ID NO: 5539962 - DNA, 12 bp, Homo sapiens
ttgtttcttctt

SEQ ID NO: 5539963 - DNA, 17 bp, Homo sapiens
ttgtttcttgacaagct

SEQ ID NO: 5539964 - DNA, 15 bp, Homo sapiens
ttgtttcttgactct

SEQ ID NO: 5539965 - DNA, 13 bp, Homo sapiens
ttgtttcttgttt

SEQ ID NO: 5539966 - DNA, 17 bp, Homo sapiens
ttgtttcttgtttattg

SEQ ID NO: 5539967 - DNA, 12 bp, Homo sapiens
ttgtttctttct

SEQ ID NO: 5539968 - DNA, 16 bp, Homo sapiens
ttgtttctttctctga

SEQ ID NO: 5539969 - DNA, 14 bp, Homo sapiens
ttgtttctttgaat

SEQ ID NO: 5539970 - DNA, 13 bp, Homo sapiens
ttgtttctttgtg

SEQ ID NO: 5539971 - DNA, 21 bp, Homo sapiens
ttgtttgaaacaaagaaggtt

SEQ ID NO: 5539972 - DNA, 16 bp, Homo sapiens
ttgtttgaatatttgt

SEQ ID NO: 5539973 - DNA, 20 bp, Homo sapiens
ttgtttgagacagggtctca

SEQ ID NO: 5539974 - DNA, 23 bp, Homo sapiens
ttgtttgaggcaaatctaaaatt

SEQ ID NO: 5539975 - DNA, 22 bp, Homo sapiens
ttgtttgagtttttcctcccag

SEQ ID NO: 5539976 - DNA, 16 bp, Homo sapiens
ttgtttgatgtgtatg

SEQ ID NO: 5539977 - DNA, 15 bp, Homo sapiens
ttgtttgcacagagg

SEQ ID NO: 5539978 - DNA, 12 bp, Homo sapiens
ttgtttgctatc

SEQ ID NO: 5539979 - DNA, 19 bp, Homo sapiens
ttgtttgctcacctggggt

SEQ ID NO: 5539980 - DNA, 12 bp, Homo sapiens
ttgtttgctgct

SEQ ID NO: 5539981 - DNA, 15 bp, Homo sapiens
ttgtttgcttattgt

SEQ ID NO: 5539982 - DNA, 15 bp, Homo sapiens
ttgtttgcttccatt

SEQ ID NO: 5539983 - DNA, 19 bp, Homo sapiens
ttgtttggacctgcatatt

SEQ ID NO: 5539984 - DNA, 18 bp, Homo sapiens
ttgtttggatgtaattta

SEQ ID NO: 5539985 - DNA, 11 bp, Homo sapiens
ttgtttggatt

SEQ ID NO: 5539986 - DNA, 16 bp, Homo sapiens
ttgtttggcaaggaaa

SEQ ID NO: 5539987 - DNA, 18 bp, Homo sapiens
ttgtttggcaaggaaagg

SEQ ID NO: 5539988 - DNA, 14 bp, Homo sapiens
ttgtttggcttcct

SEQ ID NO: 5539989 - DNA, 19 bp, Homo sapiens
ttgtttgggatcagcttct

SEQ ID NO: 5539990 - DNA, 22 bp, Homo sapiens
ttgtttgggctttaacatcctt

SEQ ID NO: 5539991 - DNA, 17 bp, Homo sapiens
ttgtttggggcaggagt

SEQ ID NO: 5539992 - DNA, 14 bp, Homo sapiens
ttgtttggtacttt

SEQ ID NO: 5539993 - DNA, 15 bp, Homo sapiens
ttgtttggtattgta

SEQ ID NO: 5539994 - DNA, 13 bp, Homo sapiens
ttgtttggttata

SEQ ID NO: 5539995 - DNA, 18 bp, Homo sapiens
ttgtttggttatagtgca

SEQ ID NO: 5539996 - DNA, 21 bp, Homo sapiens
ttgtttggttatagtgcaata

SEQ ID NO: 5539997 - DNA, 18 bp, Homo sapiens
ttgtttgtactggttcat

SEQ ID NO: 5539998 - DNA, 19 bp, Homo sapiens
ttgtttgtagctttcctgg

SEQ ID NO: 5539999 - DNA, 11 bp, Homo sapiens
ttgtttgtatt

SEQ ID NO: 5540000 - DNA, 22 bp, Homo sapiens
ttgtttgtattcatgttcatgt

SEQ ID NO: 5540001 - DNA, 13 bp, Homo sapiens
ttgtttgtcagca

SEQ ID NO: 5540002 - DNA, 17 bp, Homo sapiens
ttgtttgtcagcatctg

SEQ ID NO: 5540003 - DNA, 16 bp, Homo sapiens
ttgtttgtctctcctt

SEQ ID NO: 5540004 - DNA, 20 bp, Homo sapiens
ttgtttgtctctccttttct

SEQ ID NO: 5540005 - DNA, 15 bp, Homo sapiens
ttgtttgtctgtttg

SEQ ID NO: 5540006 - DNA, 13 bp, Homo sapiens
ttgtttgtcttta

SEQ ID NO: 5540007 - DNA, 11 bp, Homo sapiens
ttgtttgtgct

SEQ ID NO: 5540008 - DNA, 12 bp, Homo sapiens
ttgtttgtgctt

SEQ ID NO: 5540009 - DNA, 23 bp, Homo sapiens
ttgtttgtgtgaaaggaaagtag

SEQ ID NO: 5540010 - DNA, 13 bp, Homo sapiens
ttgtttgtttcaa

SEQ ID NO: 5540011 - DNA, 20 bp, Homo sapiens
ttgtttgtttcttcttttcc

SEQ ID NO: 5540012 - DNA, 14 bp, Homo sapiens
ttgtttgtttcttt

SEQ ID NO: 5540013 - DNA, 13 bp, Homo sapiens
ttgtttgttttcc

SEQ ID NO: 5540014 - DNA, 23 bp, Homo sapiens
ttgtttgttttgttttttagttc

SEQ ID NO: 5540015 - DNA, 13 bp, Homo sapiens
ttgtttgtttttg

SEQ ID NO: 5540016 - DNA, 23 bp, Homo sapiens
ttgttttaaaataagttaaaggc

SEQ ID NO: 5540017 - DNA, 18 bp, Homo sapiens
ttgttttaagattgtaat

SEQ ID NO: 5540018 - DNA, 15 bp, Homo sapiens
ttgttttaagcaaat

SEQ ID NO: 5540019 - DNA, 13 bp, Homo sapiens
ttgttttaatcta

SEQ ID NO: 5540020 - DNA, 14 bp, Homo sapiens
ttgttttaatctta

SEQ ID NO: 5540021 - DNA, 15 bp, Homo sapiens
ttgttttaattttag

SEQ ID NO: 5540022 - DNA, 20 bp, Homo sapiens
ttgttttaccagctcccagg

SEQ ID NO: 5540023 - DNA, 21 bp, Homo sapiens
ttgttttagaagattctatgt

SEQ ID NO: 5540024 - DNA, 21 bp, Homo sapiens
ttgttttagatccaaatgtaa

SEQ ID NO: 5540025 - DNA, 14 bp, Homo sapiens
ttgttttattttaa

SEQ ID NO: 5540026 - DNA, 17 bp, Homo sapiens
ttgttttattttaatag

SEQ ID NO: 5540027 - DNA, 17 bp, Homo sapiens
ttgttttcaacaattgg

SEQ ID NO: 5540028 - DNA, 17 bp, Homo sapiens
ttgttttcaatgaatta

SEQ ID NO: 5540029 - DNA, 18 bp, Homo sapiens
ttgttttcacttgtattg

SEQ ID NO: 5540030 - DNA, 16 bp, Homo sapiens
ttgttttccaaagaaa

SEQ ID NO: 5540031 - DNA, 23 bp, Homo sapiens
ttgttttccctttaaagcctttt

SEQ ID NO: 5540032 - DNA, 17 bp, Homo sapiens
ttgttttctaagatgtt

SEQ ID NO: 5540033 - DNA, 11 bp, Homo sapiens
ttgttttctct

SEQ ID NO: 5540034 - DNA, 14 bp, Homo sapiens
ttgttttctctgtg

SEQ ID NO: 5540035 - DNA, 22 bp, Homo sapiens
ttgttttctctgtgtggttcag

SEQ ID NO: 5540036 - DNA, 17 bp, Homo sapiens
ttgttttctgactaatt

SEQ ID NO: 5540037 - DNA, 18 bp, Homo sapiens
ttgttttctgactaatta

SEQ ID NO: 5540038 - DNA, 11 bp, Homo sapiens
ttgttttctgt

SEQ ID NO: 5540039 - DNA, 14 bp, Homo sapiens
ttgttttcttcatt

SEQ ID NO: 5540040 - DNA, 20 bp, Homo sapiens
ttgttttcttctgtatgtta

SEQ ID NO: 5540041 - DNA, 14 bp, Homo sapiens
ttgttttctttttc

SEQ ID NO: 5540042 - DNA, 13 bp, Homo sapiens
ttgttttgaaagt

SEQ ID NO: 5540043 - DNA, 14 bp, Homo sapiens
ttgttttgaaagtt

SEQ ID NO: 5540044 - DNA, 19 bp, Homo sapiens
ttgttttgacggatgattg

SEQ ID NO: 5540045 - DNA, 17 bp, Homo sapiens
ttgttttgagctttcca

SEQ ID NO: 5540046 - DNA, 23 bp, Homo sapiens
ttgttttgatgtttgtggcctca

SEQ ID NO: 5540047 - DNA, 20 bp, Homo sapiens
ttgttttgatttatggctgt

SEQ ID NO: 5540048 - DNA, 14 bp, Homo sapiens
ttgttttgcaaaag

SEQ ID NO: 5540049 - DNA, 18 bp, Homo sapiens
ttgttttgccaatttgca

SEQ ID NO: 5540050 - DNA, 13 bp, Homo sapiens
ttgttttgcttcc

SEQ ID NO: 5540051 - DNA, 14 bp, Homo sapiens
ttgttttgcttccc

SEQ ID NO: 5540052 - DNA, 16 bp, Homo sapiens
ttgttttgcttcccct

SEQ ID NO: 5540053 - DNA, 12 bp, Homo sapiens
ttgttttgcttt

SEQ ID NO: 5540054 - DNA, 18 bp, Homo sapiens
ttgttttgctttttctga

SEQ ID NO: 5540055 - DNA, 13 bp, Homo sapiens
ttgttttggaata

SEQ ID NO: 5540056 - DNA, 22 bp, Homo sapiens
ttgttttggctgaaattctcct

SEQ ID NO: 5540057 - DNA, 19 bp, Homo sapiens
ttgttttgggtgaatcttg

SEQ ID NO: 5540058 - DNA, 13 bp, Homo sapiens
ttgttttgtcttg

SEQ ID NO: 5540059 - DNA, 12 bp, Homo sapiens
ttgttttgtgtt

SEQ ID NO: 5540060 - DNA, 14 bp, Homo sapiens
ttgttttgtgtttt

SEQ ID NO: 5540061 - DNA, 21 bp, Homo sapiens
ttgttttgttgcactgaagtt

SEQ ID NO: 5540062 - DNA, 14 bp, Homo sapiens
ttgttttgtttgtc

SEQ ID NO: 5540063 - DNA, 16 bp, Homo sapiens
ttgttttgttttttgg

SEQ ID NO: 5540064 - DNA, 17 bp, Homo sapiens
ttgtttttaaaaagcaa

SEQ ID NO: 5540065 - DNA, 19 bp, Homo sapiens
ttgtttttaatctcctgtt

SEQ ID NO: 5540066 - DNA, 14 bp, Homo sapiens
ttgtttttactgta

SEQ ID NO: 5540067 - DNA, 17 bp, Homo sapiens
ttgtttttagaatcatt

SEQ ID NO: 5540068 - DNA, 19 bp, Homo sapiens
ttgtttttataaaaacatt

SEQ ID NO: 5540069 - DNA, 16 bp, Homo sapiens
ttgtttttatatatta

SEQ ID NO: 5540070 - DNA, 12 bp, Homo sapiens
ttgtttttatga

SEQ ID NO: 5540071 - DNA, 15 bp, Homo sapiens
ttgtttttatttctt

SEQ ID NO: 5540072 - DNA, 11 bp, Homo sapiens
ttgtttttccc

SEQ ID NO: 5540073 - DNA, 13 bp, Homo sapiens
ttgtttttctgat

SEQ ID NO: 5540074 - DNA, 21 bp, Homo sapiens
ttgtttttgagtactgtacta

SEQ ID NO: 5540075 - DNA, 12 bp, Homo sapiens
ttgtttttgatg

SEQ ID NO: 5540076 - DNA, 20 bp, Homo sapiens
ttgtttttgatgtgcgtgct

SEQ ID NO: 5540077 - DNA, 16 bp, Homo sapiens
ttgtttttgcatgaaa

SEQ ID NO: 5540078 - DNA, 18 bp, Homo sapiens
ttgtttttggaaagaaat

SEQ ID NO: 5540079 - DNA, 23 bp, Homo sapiens
ttgttttttaaaatccagacttt

SEQ ID NO: 5540080 - DNA, 16 bp, Homo sapiens
ttgttttttaaagcaa

SEQ ID NO: 5540081 - DNA, 18 bp, Homo sapiens
ttgttttttaaagcaagt

SEQ ID NO: 5540082 - DNA, 23 bp, Homo sapiens
ttgttttttaaagcaagtcacct

SEQ ID NO: 5540083 - DNA, 13 bp, Homo sapiens
ttgttttttaagt

SEQ ID NO: 5540084 - DNA, 21 bp, Homo sapiens
ttgttttttaattctctgttc

SEQ ID NO: 5540085 - DNA, 12 bp, Homo sapiens
ttgttttttatc

SEQ ID NO: 5540086 - DNA, 14 bp, Homo sapiens
ttgttttttatctt

SEQ ID NO: 5540087 - DNA, 17 bp, Homo sapiens
ttgttttttcaaaatag

SEQ ID NO: 5540088 - DNA, 12 bp, Homo sapiens
ttgttttttcat

SEQ ID NO: 5540089 - DNA, 18 bp, Homo sapiens
ttgttttttcctttataa

SEQ ID NO: 5540090 - DNA, 18 bp, Homo sapiens
ttgttttttcttgccagg

SEQ ID NO: 5540091 - DNA, 20 bp, Homo sapiens
ttgttttttctttaaagaag

SEQ ID NO: 5540092 - DNA, 16 bp, Homo sapiens
ttgttttttctttata

SEQ ID NO: 5540093 - DNA, 17 bp, Homo sapiens
ttgttttttctttataa

SEQ ID NO: 5540094 - DNA, 16 bp, Homo sapiens
ttgttttttgtaacta

SEQ ID NO: 5540095 - DNA, 23 bp, Homo sapiens
tttaaaaaaaaaaaatcatttag

SEQ ID NO: 5540096 - DNA, 19 bp, Homo sapiens
tttaaaaaaaaatcttgtg

SEQ ID NO: 5540097 - DNA, 19 bp, Homo sapiens
tttaaaaaaaatattctgt

SEQ ID NO: 5540098 - DNA, 16 bp, Homo sapiens
tttaaaaaaaatgtga

SEQ ID NO: 5540099 - DNA, 17 bp, Homo sapiens
tttaaaaaaaatgtgaa

SEQ ID NO: 5540100 - DNA, 20 bp, Homo sapiens
tttaaaaaaaatgtgaaatt

SEQ ID NO: 5540101 - DNA, 20 bp, Homo sapiens
tttaaaaaaacaaatgttag

SEQ ID NO: 5540102 - DNA, 19 bp, Homo sapiens
tttaaaaaaactgaaggtt

SEQ ID NO: 5540103 - DNA, 12 bp, Homo sapiens
tttaaaaaaaga

SEQ ID NO: 5540104 - DNA, 13 bp, Homo sapiens
tttaaaaaaagaa

SEQ ID NO: 5540105 - DNA, 15 bp, Homo sapiens
tttaaaaaaagaaat

SEQ ID NO: 5540106 - DNA, 22 bp, Homo sapiens
tttaaaaaaagctaaattacat

SEQ ID NO: 5540107 - DNA, 18 bp, Homo sapiens
tttaaaaaaagtatatat

SEQ ID NO: 5540108 - DNA, 17 bp, Homo sapiens
tttaaaaaaataaaaca

SEQ ID NO: 5540109 - DNA, 20 bp, Homo sapiens
tttaaaaaaataaaacagta

SEQ ID NO: 5540110 - DNA, 19 bp, Homo sapiens
tttaaaaaaataaaacatt

SEQ ID NO: 5540111 - DNA, 20 bp, Homo sapiens
tttaaaaaaataaaacattt

SEQ ID NO: 5540112 - DNA, 21 bp, Homo sapiens
tttaaaaaaataacatctctt

SEQ ID NO: 5540113 - DNA, 14 bp, Homo sapiens
tttaaaaaaataat

SEQ ID NO: 5540114 - DNA, 22 bp, Homo sapiens
tttaaaaaaataatataaatga

SEQ ID NO: 5540115 - DNA, 21 bp, Homo sapiens
tttaaaaaaatctccccagta

SEQ ID NO: 5540116 - DNA, 13 bp, Homo sapiens
tttaaaaaacaaa

SEQ ID NO: 5540117 - DNA, 19 bp, Homo sapiens
tttaaaaaactctttggtg

SEQ ID NO: 5540118 - DNA, 20 bp, Homo sapiens
tttaaaaaagaaacatttgg

SEQ ID NO: 5540119 - DNA, 22 bp, Homo sapiens
tttaaaaaagaaattatcttta

SEQ ID NO: 5540120 - DNA, 18 bp, Homo sapiens
tttaaaaaagactgaaca

SEQ ID NO: 5540121 - DNA, 18 bp, Homo sapiens
tttaaaaaagatggattt

SEQ ID NO: 5540122 - DNA, 13 bp, Homo sapiens
tttaaaaaagctt

SEQ ID NO: 5540123 - DNA, 21 bp, Homo sapiens
tttaaaaaagtttaaaatgta

SEQ ID NO: 5540124 - DNA, 22 bp, Homo sapiens
tttaaaaaataaataaaaacta

SEQ ID NO: 5540125 - DNA, 16 bp, Homo sapiens
tttaaaaaataaatat

SEQ ID NO: 5540126 - DNA, 19 bp, Homo sapiens
tttaaaaaataaatataat

SEQ ID NO: 5540127 - DNA, 21 bp, Homo sapiens
tttaaaaaataacttcattgt

SEQ ID NO: 5540128 - DNA, 20 bp, Homo sapiens
tttaagcccatcaattatag

SEQ ID NO: 5540129 - DNA, 20 bp, Homo sapiens
tttaagccctgctctttctc

SEQ ID NO: 5540130 - DNA, 17 bp, Homo sapiens
tttaagccttacaaagg

SEQ ID NO: 5540131 - DNA, 12 bp, Homo sapiens
tttaagccttat

SEQ ID NO: 5540132 - DNA, 16 bp, Homo sapiens
tttaagccttgacaca

SEQ ID NO: 5540133 - DNA, 19 bp, Homo sapiens
tttaagccttgacacactg

SEQ ID NO: 5540134 - DNA, 13 bp, Homo sapiens
tttaagcctttga

SEQ ID NO: 5540135 - DNA, 18 bp, Homo sapiens
tttaagcctttgaagtgc

SEQ ID NO: 5540136 - DNA, 21 bp, Homo sapiens
tttaagcctttgttgaactgt

SEQ ID NO: 5540137 - DNA, 15 bp, Homo sapiens
tttaagccttttgtg

SEQ ID NO: 5540138 - DNA, 15 bp, Homo sapiens
tttaagctccagctt

SEQ ID NO: 5540139 - DNA, 22 bp, Homo sapiens
tttaagctccatgtgcatataa

SEQ ID NO: 5540140 - DNA, 14 bp, Homo sapiens
tttaagctgtaaaa

SEQ ID NO: 5540141 - DNA, 12 bp, Homo sapiens
tttaagctgttt

SEQ ID NO: 5540142 - DNA, 17 bp, Homo sapiens
tttaagcttaacatttc

SEQ ID NO: 5540143 - DNA, 21 bp, Homo sapiens
tttaagcttcagttgcttgtc

SEQ ID NO: 5540144 - DNA, 15 bp, Homo sapiens
tttaagcttgaagat

SEQ ID NO: 5540145 - DNA, 20 bp, Homo sapiens
tttaagctttaaatgacagt

SEQ ID NO: 5540146 - DNA, 11 bp, Homo sapiens
tttaaggaaaa

SEQ ID NO: 5540147 - DNA, 23 bp, Homo sapiens
tttaaggaacaagaattgctaaa

SEQ ID NO: 5540148 - DNA, 19 bp, Homo sapiens
tttaaggaacttctgaaga

SEQ ID NO: 5540149 - DNA, 19 bp, Homo sapiens
tttaaggaatcaaatctta

SEQ ID NO: 5540150 - DNA, 19 bp, Homo sapiens
tttaaggataaatcataaa

SEQ ID NO: 5540151 - DNA, 23 bp, Homo sapiens
tttaaggatgactttttttctga

SEQ ID NO: 5540152 - DNA, 20 bp, Homo sapiens
tttaaggatgcttgtacata

SEQ ID NO: 5540153 - DNA, 21 bp, Homo sapiens
tttaaggatgcttgtacataa

SEQ ID NO: 5540154 - DNA, 14 bp, Homo sapiens
tttaaggatggatg

SEQ ID NO: 5540155 - DNA, 15 bp, Homo sapiens
tttaaggatggatgg

SEQ ID NO: 5540156 - DNA, 21 bp, Homo sapiens
tttaaggatggatggcaccct

SEQ ID NO: 5540157 - DNA, 19 bp, Homo sapiens
tttaaggcatatttaacaa

SEQ ID NO: 5540158 - DNA, 17 bp, Homo sapiens
tttaagggaaagaaaat

SEQ ID NO: 5540159 - DNA, 22 bp, Homo sapiens
tttaagggagtgtactcccagg

SEQ ID NO: 5540160 - DNA, 18 bp, Homo sapiens
tttaagggcatgccttgt

SEQ ID NO: 5540161 - DNA, 20 bp, Homo sapiens
tttaagggcatgccttgtgc

SEQ ID NO: 5540162 - DNA, 16 bp, Homo sapiens
tttaaggggagaaaat

SEQ ID NO: 5540163 - DNA, 19 bp, Homo sapiens
tttaaggggatctaaaaaa

SEQ ID NO: 5540164 - DNA, 14 bp, Homo sapiens
tttaagggggaaaa

SEQ ID NO: 5540165 - DNA, 17 bp, Homo sapiens
tttaagggtttgtggaa

SEQ ID NO: 5540166 - DNA, 19 bp, Homo sapiens
tttaaggtagcttcagcta

SEQ ID NO: 5540167 - DNA, 20 bp, Homo sapiens
tttaaggtctaatcagtgat

SEQ ID NO: 5540168 - DNA, 15 bp, Homo sapiens
tttaaggtctgtttg

SEQ ID NO: 5540169 - DNA, 18 bp, Homo sapiens
tttaaggttgcacacagt

SEQ ID NO: 5540170 - DNA, 12 bp, Homo sapiens
tttaaggtttca

SEQ ID NO: 5540171 - DNA, 16 bp, Homo sapiens
tttaaggtttttactg

SEQ ID NO: 5540172 - DNA, 20 bp, Homo sapiens
tttaagtaacgtgctcactg

SEQ ID NO: 5540173 - DNA, 21 bp, Homo sapiens
tttaagtaacgtgctcactgt

SEQ ID NO: 5540174 - DNA, 21 bp, Homo sapiens
tttaagtaagacttttattaa

SEQ ID NO: 5540175 - DNA, 20 bp, Homo sapiens
tttaagtaagtaagtttcat

SEQ ID NO: 5540176 - DNA, 14 bp, Homo sapiens
tttaagtaatgtgg

SEQ ID NO: 5540177 - DNA, 20 bp, Homo sapiens
tttaagtaattgccagcttt

SEQ ID NO: 5540178 - DNA, 17 bp, Homo sapiens
tttaagtacaaaaaagt

SEQ ID NO: 5540179 - DNA, 20 bp, Homo sapiens
tttaagtactacacattttt

SEQ ID NO: 5540180 - DNA, 21 bp, Homo sapiens
tttaagtactacacattttta

SEQ ID NO: 5540181 - DNA, 23 bp, Homo sapiens
tttaagtactatctttgtctaaa

SEQ ID NO: 5540182 - DNA, 15 bp, Homo sapiens
tttaagtagaaaaat

SEQ ID NO: 5540183 - DNA, 21 bp, Homo sapiens
tttaagtagaaaagttgcaga

SEQ ID NO: 5540184 - DNA, 14 bp, Homo sapiens
tttaagtagatttc

SEQ ID NO: 5540185 - DNA, 22 bp, Homo sapiens
tttaagtatggaatattcattt

SEQ ID NO: 5540186 - DNA, 21 bp, Homo sapiens
tttaagtattgcatctgtata

SEQ ID NO: 5540187 - DNA, 14 bp, Homo sapiens
tttaagtatttata

SEQ ID NO: 5540188 - DNA, 20 bp, Homo sapiens
tttaagtcagtatggtctaa

SEQ ID NO: 5540189 - DNA, 12 bp, Homo sapiens
tttaagtcattt

SEQ ID NO: 5540190 - DNA, 21 bp, Homo sapiens
tttaagtcgggaaattctgct

SEQ ID NO: 5540191 - DNA, 14 bp, Homo sapiens
tttaagtctacaaa

SEQ ID NO: 5540192 - DNA, 20 bp, Homo sapiens
tttaagtctacaaaaaggta

SEQ ID NO: 5540193 - DNA, 17 bp, Homo sapiens
tttaagtgaaaatggtc

SEQ ID NO: 5540194 - DNA, 13 bp, Homo sapiens
tttaagtgaaatt

SEQ ID NO: 5540195 - DNA, 21 bp, Homo sapiens
tttaagtgacacagacatttt

SEQ ID NO: 5540196 - DNA, 22 bp, Homo sapiens
tttaagtgacacagacattttg

SEQ ID NO: 5540197 - DNA, 21 bp, Homo sapiens
tttaagtgacataattgtcca

SEQ ID NO: 5540198 - DNA, 23 bp, Homo sapiens
tttaagtgacataattgtccagt

SEQ ID NO: 5540199 - DNA, 14 bp, Homo sapiens
tttaagtgcaacat

SEQ ID NO: 5540200 - DNA, 19 bp, Homo sapiens
tttaagtgcaacatttctg

SEQ ID NO: 5540201 - DNA, 20 bp, Homo sapiens
tttaagtgcaacatttctgt

SEQ ID NO: 5540202 - DNA, 21 bp, Homo sapiens
tttaagtgcaacatttctgta

SEQ ID NO: 5540203 - DNA, 23 bp, Homo sapiens
tttaagtgcaacatttctgtata

SEQ ID NO: 5540204 - DNA, 18 bp, Homo sapiens
tttaagtgcgtgtgtaga

SEQ ID NO: 5540205 - DNA, 21 bp, Homo sapiens
tttaagtgcgtgtgtagagtt

SEQ ID NO: 5540206 - DNA, 15 bp, Homo sapiens
tttaagtgctgcatt

SEQ ID NO: 5540207 - DNA, 17 bp, Homo sapiens
tttaagtgctgcattta

SEQ ID NO: 5540208 - DNA, 14 bp, Homo sapiens
tttaagtgcttaca

SEQ ID NO: 5540209 - DNA, 18 bp, Homo sapiens
tttaagtggactctctga

SEQ ID NO: 5540210 - DNA, 22 bp, Homo sapiens
tttaagtggactgtatttcggc

SEQ ID NO: 5540211 - DNA, 17 bp, Homo sapiens
tttaagtgggctcctga

SEQ ID NO: 5540212 - DNA, 17 bp, Homo sapiens
tttaagtgtctcactaa

SEQ ID NO: 5540213 - DNA, 13 bp, Homo sapiens
tttaagtgtgcag

SEQ ID NO: 5540214 - DNA, 17 bp, Homo sapiens
tttaagtgttggaaaaa

SEQ ID NO: 5540215 - DNA, 18 bp, Homo sapiens
tttaagttaaatatgtag

SEQ ID NO: 5540216 - DNA, 17 bp, Homo sapiens
tttaagttaatgaaata

SEQ ID NO: 5540217 - DNA, 16 bp, Homo sapiens
tttaagttattaagag

SEQ ID NO: 5540218 - DNA, 23 bp, Homo sapiens
tttaagttcactttttttgttct

SEQ ID NO: 5540219 - DNA, 14 bp, Homo sapiens
tttaagttcccaga

SEQ ID NO: 5540220 - DNA, 15 bp, Homo sapiens
tttaagttcctgctg

SEQ ID NO: 5540221 - DNA, 19 bp, Homo sapiens
tttaagttcttatgaggag

SEQ ID NO: 5540222 - DNA, 16 bp, Homo sapiens
tttaagttgaaaagta

SEQ ID NO: 5540223 - DNA, 13 bp, Homo sapiens
tttaagttgatta

SEQ ID NO: 5540224 - DNA, 16 bp, Homo sapiens
tttaagttgtattaaa

SEQ ID NO: 5540225 - DNA, 14 bp, Homo sapiens
tttaagttgtcaaa

SEQ ID NO: 5540226 - DNA, 20 bp, Homo sapiens
tttaagttgtcaaagaagct

SEQ ID NO: 5540227 - DNA, 15 bp, Homo sapiens
tttaagttgtttgca

SEQ ID NO: 5540228 - DNA, 13 bp, Homo sapiens
tttaagtttgaag

SEQ ID NO: 5540229 - DNA, 14 bp, Homo sapiens
tttaagtttgaaga

SEQ ID NO: 5540230 - DNA, 12 bp, Homo sapiens
tttaagtttgca

SEQ ID NO: 5540231 - DNA, 11 bp, Homo sapiens
tttaagtttgt

SEQ ID NO: 5540232 - DNA, 20 bp, Homo sapiens
tttaagtttgttgctgtcaa

SEQ ID NO: 5540233 - DNA, 14 bp, Homo sapiens
tttaagttttattt

SEQ ID NO: 5540234 - DNA, 18 bp, Homo sapiens
tttaagttttatttaact

SEQ ID NO: 5540235 - DNA, 18 bp, Homo sapiens
tttaataaaaatacacat

SEQ ID NO: 5540236 - DNA, 14 bp, Homo sapiens
tttaataaacactc

SEQ ID NO: 5540237 - DNA, 19 bp, Homo sapiens
tttaataaactactctttg

SEQ ID NO: 5540238 - DNA, 21 bp, Homo sapiens
tttaataaactactctttgat

SEQ ID NO: 5540239 - DNA, 13 bp, Homo sapiens
tttaataaactgc

SEQ ID NO: 5540240 - DNA, 16 bp, Homo sapiens
tttaataaactgcaag

SEQ ID NO: 5540241 - DNA, 15 bp, Homo sapiens
tttaataaagaaata

SEQ ID NO: 5540242 - DNA, 18 bp, Homo sapiens
tttaataaagaaatattt

SEQ ID NO: 5540243 - DNA, 15 bp, Homo sapiens
tttaataaagatgag

SEQ ID NO: 5540244 - DNA, 16 bp, Homo sapiens
tttaataaagatgagt

SEQ ID NO: 5540245 - DNA, 16 bp, Homo sapiens
tttaataaagtagtta

SEQ ID NO: 5540246 - DNA, 16 bp, Homo sapiens
tttaataaatattgag

SEQ ID NO: 5540247 - DNA, 21 bp, Homo sapiens
tttaataaatgacaaatgtat

SEQ ID NO: 5540248 - DNA, 20 bp, Homo sapiens
tttaataacaaggagatttc

SEQ ID NO: 5540249 - DNA, 23 bp, Homo sapiens
tttaataacatatctaaagtcat

SEQ ID NO: 5540250 - DNA, 20 bp, Homo sapiens
tttaataacattaccttact

SEQ ID NO: 5540251 - DNA, 22 bp, Homo sapiens
tttaataacattaccttactgt

SEQ ID NO: 5540252 - DNA, 13 bp, Homo sapiens
tttaataactttg

SEQ ID NO: 5540253 - DNA, 23 bp, Homo sapiens
tttaataactttgctggaaaatc

SEQ ID NO: 5540254 - DNA, 20 bp, Homo sapiens
tttaataagctactagcaaa

SEQ ID NO: 5540255 - DNA, 17 bp, Homo sapiens
tttaataatatacttgt

SEQ ID NO: 5540256 - DNA, 19 bp, Homo sapiens
tttaataatgtatgtacag

SEQ ID NO: 5540257 - DNA, 19 bp, Homo sapiens
tttaataatgttgccttgg

SEQ ID NO: 5540258 - DNA, 21 bp, Homo sapiens
tttaataattatatgctattt

SEQ ID NO: 5540259 - DNA, 22 bp, Homo sapiens
tttaataattatgtgccatttt

SEQ ID NO: 5540260 - DNA, 11 bp, Homo sapiens
tttaataattt

SEQ ID NO: 5540261 - DNA, 15 bp, Homo sapiens
tttaatacaggaaat

SEQ ID NO: 5540262 - DNA, 19 bp, Homo sapiens
tttaatactcacctcctcc

SEQ ID NO: 5540263 - DNA, 19 bp, Homo sapiens
tttaatagaaaattaaaat

SEQ ID NO: 5540264 - DNA, 20 bp, Homo sapiens
tttaatagaaaattaaaata

SEQ ID NO: 5540265 - DNA, 15 bp, Homo sapiens
tttaatagaaataaa

SEQ ID NO: 5540266 - DNA, 23 bp, Homo sapiens
tttaatagaaataaattcctaaa

SEQ ID NO: 5540267 - DNA, 21 bp, Homo sapiens
tttaatagaatatactgtctt

SEQ ID NO: 5540268 - DNA, 18 bp, Homo sapiens
tttaatagcaaagaattg

SEQ ID NO: 5540269 - DNA, 13 bp, Homo sapiens
tttaatagcacta

SEQ ID NO: 5540270 - DNA, 22 bp, Homo sapiens
tttaatagcgtcataactagaa

SEQ ID NO: 5540271 - DNA, 22 bp, Homo sapiens
tttaataggtagcattgaaaaa

SEQ ID NO: 5540272 - DNA, 18 bp, Homo sapiens
tttaatagtcaccttcat

SEQ ID NO: 5540273 - DNA, 16 bp, Homo sapiens
tttaatagtgcttttt

SEQ ID NO: 5540274 - DNA, 19 bp, Homo sapiens
tttaatagtggcaaatgaa

SEQ ID NO: 5540275 - DNA, 14 bp, Homo sapiens
tttaatagtgttaa

SEQ ID NO: 5540276 - DNA, 22 bp, Homo sapiens
tttaatagtgttaatcaattta

SEQ ID NO: 5540277 - DNA, 13 bp, Homo sapiens
tttaatataaagt

SEQ ID NO: 5540278 - DNA, 18 bp, Homo sapiens
tttaatataaagttttat

SEQ ID NO: 5540279 - DNA, 13 bp, Homo sapiens
tttaatataaatg

SEQ ID NO: 5540280 - DNA, 18 bp, Homo sapiens
tttaatataaatgcaaat

SEQ ID NO: 5540281 - DNA, 20 bp, Homo sapiens
tttaatataaatgcaaataa

SEQ ID NO: 5540282 - DNA, 21 bp, Homo sapiens
tttaatatctgagaagtgtat

SEQ ID NO: 5540283 - DNA, 17 bp, Homo sapiens
tttaatatctggcactg

SEQ ID NO: 5540284 - DNA, 19 bp, Homo sapiens
tttaatatctggcactgtt

SEQ ID NO: 5540285 - DNA, 13 bp, Homo sapiens
tttaatatcttca

SEQ ID NO: 5540286 - DNA, 15 bp, Homo sapiens
tttaatatgaaattt

SEQ ID NO: 5540287 - DNA, 14 bp, Homo sapiens
tttaatatgagctt

SEQ ID NO: 5540288 - DNA, 18 bp, Homo sapiens
tttaatatgagcttcaat

SEQ ID NO: 5540289 - DNA, 21 bp, Homo sapiens
tttaatatgagcttcaatata

SEQ ID NO: 5540290 - DNA, 14 bp, Homo sapiens
tttaatatgcatct

SEQ ID NO: 5540291 - DNA, 16 bp, Homo sapiens
tttaatatgcatcttt

SEQ ID NO: 5540292 - DNA, 18 bp, Homo sapiens
tttaatatgggttctttt

SEQ ID NO: 5540293 - DNA, 14 bp, Homo sapiens
tttaatatgtattt

SEQ ID NO: 5540294 - DNA, 15 bp, Homo sapiens
tttaatatgttgact

SEQ ID NO: 5540295 - DNA, 19 bp, Homo sapiens
tttaatatgttgactttat

SEQ ID NO: 5540296 - DNA, 20 bp, Homo sapiens
tttaatatgttgactttatt

SEQ ID NO: 5540297 - DNA, 20 bp, Homo sapiens
tttaatattaaagccatgtt

SEQ ID NO: 5540298 - DNA, 15 bp, Homo sapiens
tttaatattacctaa

SEQ ID NO: 5540299 - DNA, 17 bp, Homo sapiens
tttaatattattactgt

SEQ ID NO: 5540300 - DNA, 23 bp, Homo sapiens
tttaatattccagaagaacaact

SEQ ID NO: 5540301 - DNA, 21 bp, Homo sapiens
tttaatattcttttgtttcca

SEQ ID NO: 5540302 - DNA, 12 bp, Homo sapiens
tttaatatttaa

SEQ ID NO: 5540303 - DNA, 15 bp, Homo sapiens
tttaatatttaaaca

SEQ ID NO: 5540304 - DNA, 20 bp, Homo sapiens
tttaatatttaataagattt

SEQ ID NO: 5540305 - DNA, 22 bp, Homo sapiens
tttagaaaagggagtttaaaaa

SEQ ID NO: 5540306 - DNA, 11 bp, Homo sapiens
tttagaaaata

SEQ ID NO: 5540307 - DNA, 14 bp, Homo sapiens
tttagaaaatcaga

SEQ ID NO: 5540308 - DNA, 17 bp, Homo sapiens
tttagaaactgaaaaat

SEQ ID NO: 5540309 - DNA, 11 bp, Homo sapiens
tttagaaactt

SEQ ID NO: 5540310 - DNA, 16 bp, Homo sapiens
tttagaaacttatctt

SEQ ID NO: 5540311 - DNA, 22 bp, Homo sapiens
tttagaaagaaattgtttttct

SEQ ID NO: 5540312 - DNA, 23 bp, Homo sapiens
tttagaaagaagcccaatattat

SEQ ID NO: 5540313 - DNA, 13 bp, Homo sapiens
tttagaaagcatt

SEQ ID NO: 5540314 - DNA, 14 bp, Homo sapiens
tttagaaagctaaa

SEQ ID NO: 5540315 - DNA, 16 bp, Homo sapiens
tttagaaagctgacat

SEQ ID NO: 5540316 - DNA, 18 bp, Homo sapiens
tttagaaataaaagatga

SEQ ID NO: 5540317 - DNA, 17 bp, Homo sapiens
tttagaaataaacctta

SEQ ID NO: 5540318 - DNA, 15 bp, Homo sapiens
tttagaaataataaa

SEQ ID NO: 5540319 - DNA, 14 bp, Homo sapiens
tttagaaatataat

SEQ ID NO: 5540320 - DNA, 16 bp, Homo sapiens
tttagaaatattcaaa

SEQ ID NO: 5540321 - DNA, 13 bp, Homo sapiens
tttagaaatcatt

SEQ ID NO: 5540322 - DNA, 18 bp, Homo sapiens
tttagaaatcattttgca

SEQ ID NO: 5540323 - DNA, 15 bp, Homo sapiens
tttagaaatgcatat

SEQ ID NO: 5540324 - DNA, 17 bp, Homo sapiens
tttagaaattacaagtt

SEQ ID NO: 5540325 - DNA, 14 bp, Homo sapiens
tttagaaattataa

SEQ ID NO: 5540326 - DNA, 15 bp, Homo sapiens
tttagaaattctata

SEQ ID NO: 5540327 - DNA, 16 bp, Homo sapiens
tttagaacagaaaaca

SEQ ID NO: 5540328 - DNA, 23 bp, Homo sapiens
tttagaacagaaaacaacaaaaa

SEQ ID NO: 5540329 - DNA, 13 bp, Homo sapiens
tttagaacaggag

SEQ ID NO: 5540330 - DNA, 18 bp, Homo sapiens
tttagaacatgtaaaatg

SEQ ID NO: 5540331 - DNA, 15 bp, Homo sapiens
tttagaacctacaaa

SEQ ID NO: 5540332 - DNA, 16 bp, Homo sapiens
tttagaacctgcattt

SEQ ID NO: 5540333 - DNA, 12 bp, Homo sapiens
tttagaactcta

SEQ ID NO: 5540334 - DNA, 11 bp, Homo sapiens
tttagaacttg

SEQ ID NO: 5540335 - DNA, 17 bp, Homo sapiens
tttagaagagttacctt

SEQ ID NO: 5540336 - DNA, 20 bp, Homo sapiens
tttagaagcaaagatttcag

SEQ ID NO: 5540337 - DNA, 11 bp, Homo sapiens
tttagaagcct

SEQ ID NO: 5540338 - DNA, 17 bp, Homo sapiens
tttagaagtgagagaaa

SEQ ID NO: 5540339 - DNA, 19 bp, Homo sapiens
tttagaagtgcatttctga

SEQ ID NO: 5540340 - DNA, 18 bp, Homo sapiens
tttagaagtgtcatgttt

SEQ ID NO: 5540341 - DNA, 22 bp, Homo sapiens
tttagaagttaaagtcaatatt

SEQ ID NO: 5540342 - DNA, 15 bp, Homo sapiens
tttagaataagaatt

SEQ ID NO: 5540343 - DNA, 19 bp, Homo sapiens
tttagaataagaatttgca

SEQ ID NO: 5540344 - DNA, 19 bp, Homo sapiens
tttagaatatatttgtgta

SEQ ID NO: 5540345 - DNA, 21 bp, Homo sapiens
tttagaatattaaaaattaat

SEQ ID NO: 5540346 - DNA, 11 bp, Homo sapiens
tttagaatcta

SEQ ID NO: 5540347 - DNA, 14 bp, Homo sapiens
tttagaatctagaa

SEQ ID NO: 5540348 - DNA, 15 bp, Homo sapiens
tttagaatctagaaa

SEQ ID NO: 5540349 - DNA, 18 bp, Homo sapiens
tttagaatcttttaaata

SEQ ID NO: 5540350 - DNA, 15 bp, Homo sapiens
tttagaatgacagga

SEQ ID NO: 5540351 - DNA, 18 bp, Homo sapiens
tttagaatggtgatttta

SEQ ID NO: 5540352 - DNA, 21 bp, Homo sapiens
tttagaatggtgattttaaat

SEQ ID NO: 5540353 - DNA, 13 bp, Homo sapiens
tttagaattctaa

SEQ ID NO: 5540354 - DNA, 20 bp, Homo sapiens
tttagaatttgaaaggaaaa

SEQ ID NO: 5540355 - DNA, 16 bp, Homo sapiens
tttagacaaatactca

SEQ ID NO: 5540356 - DNA, 19 bp, Homo sapiens
tttagacaaatactcatgt

SEQ ID NO: 5540357 - DNA, 21 bp, Homo sapiens
tttagacaaatactcatgtgt

SEQ ID NO: 5540358 - DNA, 22 bp, Homo sapiens
tttagacaagagatgggaatga

SEQ ID NO: 5540359 - DNA, 14 bp, Homo sapiens
tttagacaccttca

SEQ ID NO: 5540360 - DNA, 12 bp, Homo sapiens
tttagacagagt

SEQ ID NO: 5540361 - DNA, 11 bp, Homo sapiens
tttagacagta

SEQ ID NO: 5540362 - DNA, 15 bp, Homo sapiens
tttagaccaaggaac

SEQ ID NO: 5540363 - DNA, 19 bp, Homo sapiens
tttagaccctattgctgct

SEQ ID NO: 5540364 - DNA, 22 bp, Homo sapiens
tttagactcatcaatcaaataa

SEQ ID NO: 5540365 - DNA, 15 bp, Homo sapiens
tttagactgtagcct

SEQ ID NO: 5540366 - DNA, 13 bp, Homo sapiens
tttagacttgaaa

SEQ ID NO: 5540367 - DNA, 19 bp, Homo sapiens
tttagacttgaaaagagac

SEQ ID NO: 5540368 - DNA, 15 bp, Homo sapiens
tttagagaaactttg

SEQ ID NO: 5540369 - DNA, 15 bp, Homo sapiens
tttagagaagccata

SEQ ID NO: 5540370 - DNA, 17 bp, Homo sapiens
tttagagaatgtgtttc

SEQ ID NO: 5540371 - DNA, 14 bp, Homo sapiens
tttagagacatcct

SEQ ID NO: 5540372 - DNA, 13 bp, Homo sapiens
tttagagagcctg

SEQ ID NO: 5540373 - DNA, 14 bp, Homo sapiens
tttagagagcctgt

SEQ ID NO: 5540374 - DNA, 23 bp, Homo sapiens
tttagagagcctgtcaccagagc

SEQ ID NO: 5540375 - DNA, 22 bp, Homo sapiens
tttagagataagagttggctgg

SEQ ID NO: 5540376 - DNA, 17 bp, Homo sapiens
tttagagataattgctt

SEQ ID NO: 5540377 - DNA, 19 bp, Homo sapiens
tttagagataggaaactga

SEQ ID NO: 5540378 - DNA, 17 bp, Homo sapiens
tttagagatattttcca

SEQ ID NO: 5540379 - DNA, 21 bp, Homo sapiens
tttagagatgaattaaattta

SEQ ID NO: 5540380 - DNA, 22 bp, Homo sapiens
tttagagattaatttgtgtaga

SEQ ID NO: 5540381 - DNA, 20 bp, Homo sapiens
tttagagcagttaacatctg

SEQ ID NO: 5540382 - DNA, 15 bp, Homo sapiens
tttagagcattaaaa

SEQ ID NO: 5540383 - DNA, 22 bp, Homo sapiens
tttagagcattaaaataactat

SEQ ID NO: 5540384 - DNA, 21 bp, Homo sapiens
tttagagccattagagcacag

SEQ ID NO: 5540385 - DNA, 17 bp, Homo sapiens
tttagagggtgaaggag

SEQ ID NO: 5540386 - DNA, 17 bp, Homo sapiens
tttagagtaaataaact

SEQ ID NO: 5540387 - DNA, 18 bp, Homo sapiens
tttagagtaaataaactg

SEQ ID NO: 5540388 - DNA, 21 bp, Homo sapiens
tttagagtaaataaactgttt

SEQ ID NO: 5540389 - DNA, 22 bp, Homo sapiens
tttagagtatgcaagaagaata

SEQ ID NO: 5540390 - DNA, 12 bp, Homo sapiens
tttagagtattt

SEQ ID NO: 5540391 - DNA, 17 bp, Homo sapiens
tttagagtatttacact

SEQ ID NO: 5540392 - DNA, 19 bp, Homo sapiens
tttagagtcaatttgctga

SEQ ID NO: 5540393 - DNA, 17 bp, Homo sapiens
tttagagttagactgtt

SEQ ID NO: 5540394 - DNA, 13 bp, Homo sapiens
tttagataataca

SEQ ID NO: 5540395 - DNA, 15 bp, Homo sapiens
tttagataatttgaa

SEQ ID NO: 5540396 - DNA, 13 bp, Homo sapiens
tttagatagccct

SEQ ID NO: 5540397 - DNA, 18 bp, Homo sapiens
tttagatagccctgtcct

SEQ ID NO: 5540398 - DNA, 23 bp, Homo sapiens
tttagatagccctgtcctggtgg

SEQ ID NO: 5540399 - DNA, 17 bp, Homo sapiens
tttagatatattctcta

SEQ ID NO: 5540400 - DNA, 17 bp, Homo sapiens
tttagatattcattaat

SEQ ID NO: 5540401 - DNA, 17 bp, Homo sapiens
tttagatattttccata

SEQ ID NO: 5540402 - DNA, 17 bp, Homo sapiens
tttagatgaatgtcagt

SEQ ID NO: 5540403 - DNA, 22 bp, Homo sapiens
tttagatgaatgtcagttgtta

SEQ ID NO: 5540404 - DNA, 20 bp, Homo sapiens
tttagatgcaagtggctgag

SEQ ID NO: 5540405 - DNA, 11 bp, Homo sapiens
tttagatgctg

SEQ ID NO: 5540406 - DNA, 13 bp, Homo sapiens
tttagatgctgat

SEQ ID NO: 5540407 - DNA, 14 bp, Homo sapiens
tttagatggtggca

SEQ ID NO: 5540408 - DNA, 18 bp, Homo sapiens
tttagatggttacactgt

SEQ ID NO: 5540409 - DNA, 21 bp, Homo sapiens
tttagatgtagatatttgaaa

SEQ ID NO: 5540410 - DNA, 22 bp, Homo sapiens
tttagatgtgtatacagaaaat

SEQ ID NO: 5540411 - DNA, 16 bp, Homo sapiens
tttagattattttatc

SEQ ID NO: 5540412 - DNA, 21 bp, Homo sapiens
tttagattattttatctggta

SEQ ID NO: 5540413 - DNA, 19 bp, Homo sapiens
tttagattgaaaacttttc

SEQ ID NO: 5540414 - DNA, 13 bp, Homo sapiens
tttagatttaatg

SEQ ID NO: 5540415 - DNA, 15 bp, Homo sapiens
tttagatttaattta

SEQ ID NO: 5540416 - DNA, 16 bp, Homo sapiens
tttagatttcaagaaa

SEQ ID NO: 5540417 - DNA, 22 bp, Homo sapiens
tttagattttgtgtttattctt

SEQ ID NO: 5540418 - DNA, 18 bp, Homo sapiens
tttagatttttaaattgg

SEQ ID NO: 5540419 - DNA, 23 bp, Homo sapiens
tttagcaaagcgggttataatga

SEQ ID NO: 5540420 - DNA, 11 bp, Homo sapiens
tttagcaagca

SEQ ID NO: 5540421 - DNA, 20 bp, Homo sapiens
tttagcaataaataacactt

SEQ ID NO: 5540422 - DNA, 15 bp, Homo sapiens
tttagcaatgctgtg

SEQ ID NO: 5540423 - DNA, 14 bp, Homo sapiens
tttagcacaatttg

SEQ ID NO: 5540424 - DNA, 23 bp, Homo sapiens
tttagcacaatttgagactgaaa

SEQ ID NO: 5540425 - DNA, 13 bp, Homo sapiens
tttagcacagtat

SEQ ID NO: 5540426 - DNA, 15 bp, Homo sapiens
tttagcacagtattt

SEQ ID NO: 5540427 - DNA, 17 bp, Homo sapiens
tttagcacagtatttaa

SEQ ID NO: 5540428 - DNA, 20 bp, Homo sapiens
tttagcacagtatttaacat

SEQ ID NO: 5540429 - DNA, 13 bp, Homo sapiens
tttagcaccccca

SEQ ID NO: 5540430 - DNA, 18 bp, Homo sapiens
tttagcacgtttaaagtt

SEQ ID NO: 5540431 - DNA, 21 bp, Homo sapiens
tttagcacgtttaaagttctg

SEQ ID NO: 5540432 - DNA, 22 bp, Homo sapiens
tttagcacgtttaaagttctgt

SEQ ID NO: 5540433 - DNA, 18 bp, Homo sapiens
tttagcagaatcaaaatg

SEQ ID NO: 5540434 - DNA, 17 bp, Homo sapiens
tttagcagatttaagat

SEQ ID NO: 5540435 - DNA, 18 bp, Homo sapiens
tttagcagcacttttgat

SEQ ID NO: 5540436 - DNA, 19 bp, Homo sapiens
tttagcagtaaaatagctg

SEQ ID NO: 5540437 - DNA, 14 bp, Homo sapiens
tttagcagttctgc

SEQ ID NO: 5540438 - DNA, 20 bp, Homo sapiens
tttagcataaatttaatgta

SEQ ID NO: 5540439 - DNA, 22 bp, Homo sapiens
tttagcatgttcctccttttct

SEQ ID NO: 5540440 - DNA, 17 bp, Homo sapiens
tttagcatttttatgca

SEQ ID NO: 5540441 - DNA, 15 bp, Homo sapiens
tttagccaccatctt

SEQ ID NO: 5540442 - DNA, 20 bp, Homo sapiens
tttagccagcgtttattgta

SEQ ID NO: 5540443 - DNA, 19 bp, Homo sapiens
tttagccataattttgcat

SEQ ID NO: 5540444 - DNA, 13 bp, Homo sapiens
tttagccattacc

SEQ ID NO: 5540445 - DNA, 22 bp, Homo sapiens
tttagcccagtgttttctttga

SEQ ID NO: 5540446 - DNA, 15 bp, Homo sapiens
tttagcctagttcat

SEQ ID NO: 5540447 - DNA, 15 bp, Homo sapiens
tttagcctcttccct

SEQ ID NO: 5540448 - DNA, 19 bp, Homo sapiens
tttagcctcttccctctga

SEQ ID NO: 5540449 - DNA, 16 bp, Homo sapiens
tttagccttctctgtt

SEQ ID NO: 5540450 - DNA, 16 bp, Homo sapiens
tttagcgggactcagt

SEQ ID NO: 5540451 - DNA, 17 bp, Homo sapiens
tttagctaacaaaagat

SEQ ID NO: 5540452 - DNA, 18 bp, Homo sapiens
tttagctaacaaaagata

SEQ ID NO: 5540453 - DNA, 23 bp, Homo sapiens
tttagctaacaaaagatatgaag

SEQ ID NO: 5540454 - DNA, 12 bp, Homo sapiens
tttagctacctt

SEQ ID NO: 5540455 - DNA, 20 bp, Homo sapiens
tttagctacctttttatatt

SEQ ID NO: 5540456 - DNA, 20 bp, Homo sapiens
tttagctaggatttgaacac

SEQ ID NO: 5540457 - DNA, 21 bp, Homo sapiens
tttagctatttaatactaatt

SEQ ID NO: 5540458 - DNA, 13 bp, Homo sapiens
tttagctatttat

SEQ ID NO: 5540459 - DNA, 13 bp, Homo sapiens
tttagctctgaga

SEQ ID NO: 5540460 - DNA, 13 bp, Homo sapiens
tttagctgaggga

SEQ ID NO: 5540461 - DNA, 21 bp, Homo sapiens
tttagctgatgaacttattct

SEQ ID NO: 5540462 - DNA, 22 bp, Homo sapiens
tttagctggaaaagtatgttag

SEQ ID NO: 5540463 - DNA, 16 bp, Homo sapiens
tttagctgtatcaaac

SEQ ID NO: 5540464 - DNA, 13 bp, Homo sapiens
tttagctgtgcag

SEQ ID NO: 5540465 - DNA, 23 bp, Homo sapiens
tttagcttacctgggcacaaaca

SEQ ID NO: 5540466 - DNA, 14 bp, Homo sapiens
tttagcttcagttg

SEQ ID NO: 5540467 - DNA, 16 bp, Homo sapiens
tttagcttcagttgtt

SEQ ID NO: 5540468 - DNA, 19 bp, Homo sapiens
tttagcttcagttgttctt

SEQ ID NO: 5540469 - DNA, 16 bp, Homo sapiens
tttagcttctctgcca

SEQ ID NO: 5540470 - DNA, 18 bp, Homo sapiens
tttagcttctttccctta

SEQ ID NO: 5540471 - DNA, 15 bp, Homo sapiens
tttagctttggaaag

SEQ ID NO: 5540472 - DNA, 14 bp, Homo sapiens
tttaggaaaagcat

SEQ ID NO: 5540473 - DNA, 22 bp, Homo sapiens
tttaggaaaatcactttgtcta

SEQ ID NO: 5540474 - DNA, 13 bp, Homo sapiens
tttaggaaaatga

SEQ ID NO: 5540475 - DNA, 17 bp, Homo sapiens
tttaggaacttcagaga

SEQ ID NO: 5540476 - DNA, 24 bp, Homo sapiens
tttaggaagaagtggtactagtgt

SEQ ID NO: 5540477 - DNA, 18 bp, Homo sapiens
tttaggaagcaagcttaa

SEQ ID NO: 5540478 - DNA, 14 bp, Homo sapiens
tttaggaataataa

SEQ ID NO: 5540479 - DNA, 15 bp, Homo sapiens
tttaggaataataaa

SEQ ID NO: 5540480 - DNA, 21 bp, Homo sapiens
tttaggacacatttagatgca

SEQ ID NO: 5540481 - DNA, 15 bp, Homo sapiens
tttaggactgaaaat

SEQ ID NO: 5540482 - DNA, 18 bp, Homo sapiens
tttaggactgaaaatact

SEQ ID NO: 5540483 - DNA, 11 bp, Homo sapiens
tttaggagaaa

SEQ ID NO: 5540484 - DNA, 21 bp, Homo sapiens
tttatgtaaaatcaataaaag

SEQ ID NO: 5540485 - DNA, 19 bp, Homo sapiens
tttatgtaagaagaaactg

SEQ ID NO: 5540486 - DNA, 13 bp, Homo sapiens
tttatgtaatgaa

SEQ ID NO: 5540487 - DNA, 12 bp, Homo sapiens
tttatgtaatta

SEQ ID NO: 5540488 - DNA, 15 bp, Homo sapiens
tttatgtaattatat

SEQ ID NO: 5540489 - DNA, 19 bp, Homo sapiens
tttatgtaatttgtacagg

SEQ ID NO: 5540490 - DNA, 14 bp, Homo sapiens
tttatgtacaggat

SEQ ID NO: 5540491 - DNA, 12 bp, Homo sapiens
tttatgtacata

SEQ ID NO: 5540492 - DNA, 13 bp, Homo sapiens
tttatgtactgta

SEQ ID NO: 5540493 - DNA, 11 bp, Homo sapiens
tttatgtagac

SEQ ID NO: 5540494 - DNA, 20 bp, Homo sapiens
tttatgtagaggctttatgt

SEQ ID NO: 5540495 - DNA, 24 bp, Homo sapiens
tttatgtagaggctttatgttgca

SEQ ID NO: 5540496 - DNA, 14 bp, Homo sapiens
tttatgtagcacat

SEQ ID NO: 5540497 - DNA, 19 bp, Homo sapiens
tttatgtagtaattgacat

SEQ ID NO: 5540498 - DNA, 20 bp, Homo sapiens
tttatgtatgtttacactgt

SEQ ID NO: 5540499 - DNA, 12 bp, Homo sapiens
tttatgtattct

SEQ ID NO: 5540500 - DNA, 17 bp, Homo sapiens
tttatgtcatagaaata

SEQ ID NO: 5540501 - DNA, 15 bp, Homo sapiens
tttatgtcattttca

SEQ ID NO: 5540502 - DNA, 22 bp, Homo sapiens
tttatgtcccttcacatagttt

SEQ ID NO: 5540503 - DNA, 17 bp, Homo sapiens
tttatgtctttcttgta

SEQ ID NO: 5540504 - DNA, 14 bp, Homo sapiens
tttatgtgaaacat

SEQ ID NO: 5540505 - DNA, 18 bp, Homo sapiens
tttatgtgaacattccta

SEQ ID NO: 5540506 - DNA, 16 bp, Homo sapiens
tttatgtgatatgttt

SEQ ID NO: 5540507 - DNA, 16 bp, Homo sapiens
tttatgtgatgtaact

SEQ ID NO: 5540508 - DNA, 16 bp, Homo sapiens
tttatgtgtagaattt

SEQ ID NO: 5540509 - DNA, 17 bp, Homo sapiens
tttatgtgtagttgtct

SEQ ID NO: 5540510 - DNA, 18 bp, Homo sapiens
tttatgtgtgaggagctg

SEQ ID NO: 5540511 - DNA, 12 bp, Homo sapiens
tttatgtgttct

SEQ ID NO: 5540512 - DNA, 22 bp, Homo sapiens
tttatgtgtttggatacatctg

SEQ ID NO: 5540513 - DNA, 20 bp, Homo sapiens
tttatgttaagggaagaatt

SEQ ID NO: 5540514 - DNA, 17 bp, Homo sapiens
tttatgttagattttgc

SEQ ID NO: 5540515 - DNA, 15 bp, Homo sapiens
tttatgttatgagga

SEQ ID NO: 5540516 - DNA, 17 bp, Homo sapiens
tttatgttcatttgttt

SEQ ID NO: 5540517 - DNA, 14 bp, Homo sapiens
tttatgttcttata

SEQ ID NO: 5540518 - DNA, 18 bp, Homo sapiens
tttatgttcttatagaat

SEQ ID NO: 5540519 - DNA, 14 bp, Homo sapiens
tttatgttctttca

SEQ ID NO: 5540520 - DNA, 19 bp, Homo sapiens
tttatgttctttcacccat

SEQ ID NO: 5540521 - DNA, 13 bp, Homo sapiens
tttatgttgacat

SEQ ID NO: 5540522 - DNA, 18 bp, Homo sapiens
tttatgttgacatttgtt

SEQ ID NO: 5540523 - DNA, 14 bp, Homo sapiens
tttatgttgatctg

SEQ ID NO: 5540524 - DNA, 10 bp, Homo sapiens
tttatgttta

SEQ ID NO: 5540525 - DNA, 16 bp, Homo sapiens
tttatgtttaaaaagt

SEQ ID NO: 5540526 - DNA, 18 bp, Homo sapiens
tttatgtttaaaagaaat

SEQ ID NO: 5540527 - DNA, 17 bp, Homo sapiens
tttatgtttaagtgctt

SEQ ID NO: 5540528 - DNA, 14 bp, Homo sapiens
tttatgtttagata

SEQ ID NO: 5540529 - DNA, 14 bp, Homo sapiens
tttatgtttgaata

SEQ ID NO: 5540530 - DNA, 21 bp, Homo sapiens
tttatgtttgtggttttggga

SEQ ID NO: 5540531 - DNA, 15 bp, Homo sapiens
tttatgttttcacag

SEQ ID NO: 5540532 - DNA, 20 bp, Homo sapiens
tttatgttttggtccacttt

SEQ ID NO: 5540533 - DNA, 12 bp, Homo sapiens
tttatgttttgt

SEQ ID NO: 5540534 - DNA, 17 bp, Homo sapiens
tttatgttttgtttctg

SEQ ID NO: 5540535 - DNA, 20 bp, Homo sapiens
tttatgttttgtttctgaaa

SEQ ID NO: 5540536 - DNA, 13 bp, Homo sapiens
tttattaaaaact

SEQ ID NO: 5540537 - DNA, 15 bp, Homo sapiens
tttattaaaaatgtt

SEQ ID NO: 5540538 - DNA, 12 bp, Homo sapiens
tttattaaaaca

SEQ ID NO: 5540539 - DNA, 12 bp, Homo sapiens
tttattaaaaga

SEQ ID NO: 5540540 - DNA, 18 bp, Homo sapiens
tttattaaaagagtagaa

SEQ ID NO: 5540541 - DNA, 19 bp, Homo sapiens
tttattaaaatactgtttt

SEQ ID NO: 5540542 - DNA, 22 bp, Homo sapiens
tttattaaaatactgttttgga

SEQ ID NO: 5540543 - DNA, 14 bp, Homo sapiens
tttattaaaatatt

SEQ ID NO: 5540544 - DNA, 18 bp, Homo sapiens
tttattaaaatatttcag

SEQ ID NO: 5540545 - DNA, 19 bp, Homo sapiens
tttattaaaatatttcagg

SEQ ID NO: 5540546 - DNA, 21 bp, Homo sapiens
tttattaaaatatttcaggtt

SEQ ID NO: 5540547 - DNA, 13 bp, Homo sapiens
tttattaaaatct

SEQ ID NO: 5540548 - DNA, 16 bp, Homo sapiens
tttattaaaatcttaa

SEQ ID NO: 5540549 - DNA, 14 bp, Homo sapiens
tttattaaaatgat

SEQ ID NO: 5540550 - DNA, 20 bp, Homo sapiens
tttattaaacaattttgtta

SEQ ID NO: 5540551 - DNA, 17 bp, Homo sapiens
tttattaaacagatttt

SEQ ID NO: 5540552 - DNA, 22 bp, Homo sapiens
tttattaaacagatttttacaa

SEQ ID NO: 5540553 - DNA, 23 bp, Homo sapiens
tttattaaacagatttttacaaa

SEQ ID NO: 5540554 - DNA, 13 bp, Homo sapiens
tttattaaagatg

SEQ ID NO: 5540555 - DNA, 13 bp, Homo sapiens
tttattaaagcaa

SEQ ID NO: 5540556 - DNA, 19 bp, Homo sapiens
tttattaaagcaacatttt

SEQ ID NO: 5540557 - DNA, 19 bp, Homo sapiens
tttattaaagcatttccta

SEQ ID NO: 5540558 - DNA, 12 bp, Homo sapiens
tttattaaatag

SEQ ID NO: 5540559 - DNA, 12 bp, Homo sapiens
tttattaaatct

SEQ ID NO: 5540560 - DNA, 19 bp, Homo sapiens
tttattaaatgcccagccc

SEQ ID NO: 5540561 - DNA, 12 bp, Homo sapiens
tttattaaattt

SEQ ID NO: 5540562 - DNA, 13 bp, Homo sapiens
tttattaaatttg

SEQ ID NO: 5540563 - DNA, 18 bp, Homo sapiens
tttattaacatatattgt

SEQ ID NO: 5540564 - DNA, 21 bp, Homo sapiens
tttattaactaggtatgaagt

SEQ ID NO: 5540565 - DNA, 22 bp, Homo sapiens
tttattaagatggattctcaga

SEQ ID NO: 5540566 - DNA, 23 bp, Homo sapiens
tttattaagccaggaaacatgaa

SEQ ID NO: 5540567 - DNA, 20 bp, Homo sapiens
tttattaagctttttggaat

SEQ ID NO: 5540568 - DNA, 13 bp, Homo sapiens
tttattaagtaga

SEQ ID NO: 5540569 - DNA, 21 bp, Homo sapiens
tttattaagtatatttgtaaa

SEQ ID NO: 5540570 - DNA, 20 bp, Homo sapiens
tttattaatagaatgataaa

SEQ ID NO: 5540571 - DNA, 17 bp, Homo sapiens
tttattaatatatatta

SEQ ID NO: 5540572 - DNA, 19 bp, Homo sapiens
tttattaatcttagtgtat

SEQ ID NO: 5540573 - DNA, 15 bp, Homo sapiens
tttattaatgaactg

SEQ ID NO: 5540574 - DNA, 20 bp, Homo sapiens
tttattaatgaactgtgaca

SEQ ID NO: 5540575 - DNA, 12 bp, Homo sapiens
tttattaatgca

SEQ ID NO: 5540576 - DNA, 21 bp, Homo sapiens
tttattaatgcctctcccgca

SEQ ID NO: 5540577 - DNA, 18 bp, Homo sapiens
tttattaattcattaaat

SEQ ID NO: 5540578 - DNA, 16 bp, Homo sapiens
tttattaatttatatg

SEQ ID NO: 5540579 - DNA, 14 bp, Homo sapiens
tttattaatttgaa

SEQ ID NO: 5540580 - DNA, 17 bp, Homo sapiens
tttattaattttctatg

SEQ ID NO: 5540581 - DNA, 23 bp, Homo sapiens
tttattacaaattttcactgctg

SEQ ID NO: 5540582 - DNA, 18 bp, Homo sapiens
tttattacaatgtatctt

SEQ ID NO: 5540583 - DNA, 17 bp, Homo sapiens
tttattacaatttgtat

SEQ ID NO: 5540584 - DNA, 14 bp, Homo sapiens
tttattacagaaat

SEQ ID NO: 5540585 - DNA, 16 bp, Homo sapiens
tttattacatatgatt

SEQ ID NO: 5540586 - DNA, 16 bp, Homo sapiens
tttattacatctttca

SEQ ID NO: 5540587 - DNA, 18 bp, Homo sapiens
tttattaccagattcact

SEQ ID NO: 5540588 - DNA, 22 bp, Homo sapiens
tttattaccagattcacttctg

SEQ ID NO: 5540589 - DNA, 14 bp, Homo sapiens
tttattaccagtgg

SEQ ID NO: 5540590 - DNA, 16 bp, Homo sapiens
tttattacgtatgtct

SEQ ID NO: 5540591 - DNA, 19 bp, Homo sapiens
tttattactgtaagaaaat

SEQ ID NO: 5540592 - DNA, 16 bp, Homo sapiens
tttattacttccatga

SEQ ID NO: 5540593 - DNA, 20 bp, Homo sapiens
tttattacttccatgaattt

SEQ ID NO: 5540594 - DNA, 15 bp, Homo sapiens
tttattagacattct

SEQ ID NO: 5540595 - DNA, 20 bp, Homo sapiens
tttattagctgtaaatacat

SEQ ID NO: 5540596 - DNA, 24 bp, Homo sapiens
tttattagctgtaaatacatgtgt

SEQ ID NO: 5540597 - DNA, 16 bp, Homo sapiens
tttattaggaaaagat

SEQ ID NO: 5540598 - DNA, 18 bp, Homo sapiens
tttattaggaaaagatat

SEQ ID NO: 5540599 - DNA, 14 bp, Homo sapiens
tttattaggttaag

SEQ ID NO: 5540600 - DNA, 21 bp, Homo sapiens
tttattagtaacatcataaga

SEQ ID NO: 5540601 - DNA, 22 bp, Homo sapiens
tttattagtcagagtttcagct

SEQ ID NO: 5540602 - DNA, 14 bp, Homo sapiens
tttattagtgaagt

SEQ ID NO: 5540603 - DNA, 14 bp, Homo sapiens
tttattataaactg

SEQ ID NO: 5540604 - DNA, 14 bp, Homo sapiens
tttattataaattc

SEQ ID NO: 5540605 - DNA, 20 bp, Homo sapiens
tttattatatatttacagaa

SEQ ID NO: 5540606 - DNA, 24 bp, Homo sapiens
tttattatatatttacagaagaaa

SEQ ID NO: 5540607 - DNA, 22 bp, Homo sapiens
tttattatatttgaattgacag

SEQ ID NO: 5540608 - DNA, 15 bp, Homo sapiens
tttattatgagctac

SEQ ID NO: 5540609 - DNA, 16 bp, Homo sapiens
tttattatgagctttc

SEQ ID NO: 5540610 - DNA, 13 bp, Homo sapiens
tttattatggcac

SEQ ID NO: 5540611 - DNA, 20 bp, Homo sapiens
tttattatggcttgtgaact

SEQ ID NO: 5540612 - DNA, 14 bp, Homo sapiens
tttattattcctag

SEQ ID NO: 5540613 - DNA, 13 bp, Homo sapiens
tttattatttcta

SEQ ID NO: 5540614 - DNA, 15 bp, Homo sapiens
tttattattttcaaa

SEQ ID NO: 5540615 - DNA, 13 bp, Homo sapiens
tttattcaaaata

SEQ ID NO: 5540616 - DNA, 19 bp, Homo sapiens
tttattcaaggtaaaattc

SEQ ID NO: 5540617 - DNA, 13 bp, Homo sapiens
tttattcaataaa

SEQ ID NO: 5540618 - DNA, 16 bp, Homo sapiens
tttattcacaaaacat

SEQ ID NO: 5540619 - DNA, 18 bp, Homo sapiens
tttattcacatatgtctt

SEQ ID NO: 5540620 - DNA, 19 bp, Homo sapiens
tttattcacatatgtctta

SEQ ID NO: 5540621 - DNA, 14 bp, Homo sapiens
tttattcagaactt

SEQ ID NO: 5540622 - DNA, 15 bp, Homo sapiens
tttattcagaacttt

SEQ ID NO: 5540623 - DNA, 20 bp, Homo sapiens
tttattcagaactttagtat

SEQ ID NO: 5540624 - DNA, 20 bp, Homo sapiens
tttattcagctagaatttct

SEQ ID NO: 5540625 - DNA, 17 bp, Homo sapiens
tttattcagcttcattt

SEQ ID NO: 5540626 - DNA, 17 bp, Homo sapiens
tttattcagtaaacaac

SEQ ID NO: 5540627 - DNA, 22 bp, Homo sapiens
tttattcatgtgtacagaaaca

SEQ ID NO: 5540628 - DNA, 22 bp, Homo sapiens
tttattcattcagtgagacaca

SEQ ID NO: 5540629 - DNA, 13 bp, Homo sapiens
tttattccagagc

SEQ ID NO: 5540630 - DNA, 12 bp, Homo sapiens
tttattcccaag

SEQ ID NO: 5540631 - DNA, 21 bp, Homo sapiens
tttattcccaagtatgcctta

SEQ ID NO: 5540632 - DNA, 22 bp, Homo sapiens
tttattcccaagtatgccttaa

SEQ ID NO: 5540633 - DNA, 21 bp, Homo sapiens
tttattccctgcccaaaccct

SEQ ID NO: 5540634 - DNA, 18 bp, Homo sapiens
tttattcctttccttttt

SEQ ID NO: 5540635 - DNA, 16 bp, Homo sapiens
tttattctatctgttt

SEQ ID NO: 5540636 - DNA, 18 bp, Homo sapiens
tttattctcagtaacttt

SEQ ID NO: 5540637 - DNA, 14 bp, Homo sapiens
tttattctcatttg

SEQ ID NO: 5540638 - DNA, 13 bp, Homo sapiens
tttattctgtggt

SEQ ID NO: 5540639 - DNA, 12 bp, Homo sapiens
tttattctgtta

SEQ ID NO: 5540640 - DNA, 12 bp, Homo sapiens
tttattcttcca

SEQ ID NO: 5540641 - DNA, 13 bp, Homo sapiens
tttattcttgtga

SEQ ID NO: 5540642 - DNA, 17 bp, Homo sapiens
tttattcttgtgaatat

SEQ ID NO: 5540643 - DNA, 17 bp, Homo sapiens
tttattctttactatta

SEQ ID NO: 5540644 - DNA, 17 bp, Homo sapiens
tttattctttgcaaata

SEQ ID NO: 5540645 - DNA, 18 bp, Homo sapiens
tttattctttgcaaataa

SEQ ID NO: 5540646 - DNA, 20 bp, Homo sapiens
tttattgaaatgatttcaca

SEQ ID NO: 5540647 - DNA, 14 bp, Homo sapiens
tttattgaaatgta

SEQ ID NO: 5540648 - DNA, 17 bp, Homo sapiens
tttattgaatactgtct

SEQ ID NO: 5540649 - DNA, 18 bp, Homo sapiens
tttattgaatactgtctg

SEQ ID NO: 5540650 - DNA, 22 bp, Homo sapiens
tttattgaatactgtctgtatc

SEQ ID NO: 5540651 - DNA, 23 bp, Homo sapiens
tttattgaatactgtctgtatct

SEQ ID NO: 5540652 - DNA, 15 bp, Homo sapiens
tttattgacacagaa

SEQ ID NO: 5540653 - DNA, 22 bp, Homo sapiens
tttattgacaggtcttttcaaa

SEQ ID NO: 5540654 - DNA, 16 bp, Homo sapiens
tttattgactcttgag

SEQ ID NO: 5540655 - DNA, 20 bp, Homo sapiens
tttattgaggaaaaatatgt

SEQ ID NO: 5540656 - DNA, 24 bp, Homo sapiens
tttattgagtaatattacatttca

SEQ ID NO: 5540657 - DNA, 15 bp, Homo sapiens
tttattgatgtgcaa

SEQ ID NO: 5540658 - DNA, 18 bp, Homo sapiens
tttattgatgttttcaca

SEQ ID NO: 5540659 - DNA, 16 bp, Homo sapiens
tttattgatttcaagt

SEQ ID NO: 5540660 - DNA, 13 bp, Homo sapiens
tttattgcaaagt

SEQ ID NO: 5540661 - DNA, 13 bp, Homo sapiens
tttattgcacaaa

SEQ ID NO: 5540662 - DNA, 19 bp, Homo sapiens
tttattgcactaggaattc

SEQ ID NO: 5540663 - DNA, 14 bp, Homo sapiens
tttattgcagaatg

SEQ ID NO: 5540664 - DNA, 14 bp, Homo sapiens
tttcacatgaacat

SEQ ID NO: 5540665 - DNA, 11 bp, Homo sapiens
tttcacatgga

SEQ ID NO: 5540666 - DNA, 22 bp, Homo sapiens
tttcacatgtttatatttggct

SEQ ID NO: 5540667 - DNA, 23 bp, Homo sapiens
tttcacatgtttatatttggctc

SEQ ID NO: 5540668 - DNA, 17 bp, Homo sapiens
tttcacattagaagaca

SEQ ID NO: 5540669 - DNA, 18 bp, Homo sapiens
tttcacattcctgaccct

SEQ ID NO: 5540670 - DNA, 13 bp, Homo sapiens
tttcacattctta

SEQ ID NO: 5540671 - DNA, 16 bp, Homo sapiens
tttcacattgaatcat

SEQ ID NO: 5540672 - DNA, 14 bp, Homo sapiens
tttcacattggaaa

SEQ ID NO: 5540673 - DNA, 15 bp, Homo sapiens
tttcacatttctact

SEQ ID NO: 5540674 - DNA, 14 bp, Homo sapiens
tttcacatttttaa

SEQ ID NO: 5540675 - DNA, 16 bp, Homo sapiens
tttcacatttttgtaa

SEQ ID NO: 5540676 - DNA, 19 bp, Homo sapiens
tttcaccaaaatttctaca

SEQ ID NO: 5540677 - DNA, 15 bp, Homo sapiens
tttcaccacattcgt

SEQ ID NO: 5540678 - DNA, 17 bp, Homo sapiens
tttcaccagatttgcta

SEQ ID NO: 5540679 - DNA, 23 bp, Homo sapiens
tttcaccatctcttgtaaaagtt

SEQ ID NO: 5540680 - DNA, 21 bp, Homo sapiens
tttcaccatgatggccaggct

SEQ ID NO: 5540681 - DNA, 21 bp, Homo sapiens
tttcaccatgttggccaggct

SEQ ID NO: 5540682 - DNA, 17 bp, Homo sapiens
tttcacccatcctagga

SEQ ID NO: 5540683 - DNA, 19 bp, Homo sapiens
tttcacccatcctaggaac

SEQ ID NO: 5540684 - DNA, 23 bp, Homo sapiens
tttcacccatcctaggaaccagc

SEQ ID NO: 5540685 - DNA, 20 bp, Homo sapiens
tttcacccatctctcaggaa

SEQ ID NO: 5540686 - DNA, 21 bp, Homo sapiens
tttcaccccatccctccttaa

SEQ ID NO: 5540687 - DNA, 14 bp, Homo sapiens
tttcacccctcttc

SEQ ID NO: 5540688 - DNA, 15 bp, Homo sapiens
tttcacccctcttcc

SEQ ID NO: 5540689 - DNA, 15 bp, Homo sapiens
tttcaccctattttc

SEQ ID NO: 5540690 - DNA, 17 bp, Homo sapiens
tttcaccctattttcag

SEQ ID NO: 5540691 - DNA, 20 bp, Homo sapiens
tttcacctactaatgtctct

SEQ ID NO: 5540692 - DNA, 17 bp, Homo sapiens
tttcacctactttgtaa

SEQ ID NO: 5540693 - DNA, 16 bp, Homo sapiens
tttcacctagattttt

SEQ ID NO: 5540694 - DNA, 13 bp, Homo sapiens
tttcacctccatg

SEQ ID NO: 5540695 - DNA, 13 bp, Homo sapiens
tttcacctcttta

SEQ ID NO: 5540696 - DNA, 18 bp, Homo sapiens
tttcacctgaaacacttt

SEQ ID NO: 5540697 - DNA, 18 bp, Homo sapiens
tttcacctggaagcattt

SEQ ID NO: 5540698 - DNA, 13 bp, Homo sapiens
tttcacctgggat

SEQ ID NO: 5540699 - DNA, 14 bp, Homo sapiens
tttcacctgtaaac

SEQ ID NO: 5540700 - DNA, 17 bp, Homo sapiens
tttcacctgtaaacctg

SEQ ID NO: 5540701 - DNA, 16 bp, Homo sapiens
tttcacctgtgacaaa

SEQ ID NO: 5540702 - DNA, 15 bp, Homo sapiens
tttcacgaactgttc

SEQ ID NO: 5540703 - DNA, 23 bp, Homo sapiens
tttcacgaactgttcacactgca

SEQ ID NO: 5540704 - DNA, 15 bp, Homo sapiens
tttcacgagtgttcc

SEQ ID NO: 5540705 - DNA, 20 bp, Homo sapiens
tttcacgcctgaggcaatta

SEQ ID NO: 5540706 - DNA, 23 bp, Homo sapiens
tttcacggaagttttcaatgatg

SEQ ID NO: 5540707 - DNA, 18 bp, Homo sapiens
tttcacgggaactctcca

SEQ ID NO: 5540708 - DNA, 15 bp, Homo sapiens
tttcacgggagattt

SEQ ID NO: 5540709 - DNA, 18 bp, Homo sapiens
tttcacgtaaatattcat

SEQ ID NO: 5540710 - DNA, 21 bp, Homo sapiens
tttcacgtcataggaagttag

SEQ ID NO: 5540711 - DNA, 20 bp, Homo sapiens
tttcacgtcttggtgccttt

SEQ ID NO: 5540712 - DNA, 16 bp, Homo sapiens
tttcactacttagcat

SEQ ID NO: 5540713 - DNA, 12 bp, Homo sapiens
tttcactacttt

SEQ ID NO: 5540714 - DNA, 16 bp, Homo sapiens
tttcactataatgtga

SEQ ID NO: 5540715 - DNA, 18 bp, Homo sapiens
tttcactatcttcttcaa

SEQ ID NO: 5540716 - DNA, 13 bp, Homo sapiens
tttcactcctgct

SEQ ID NO: 5540717 - DNA, 18 bp, Homo sapiens
tttcactctaagtcatgt

SEQ ID NO: 5540718 - DNA, 20 bp, Homo sapiens
tttcactctcctatgccttt

SEQ ID NO: 5540719 - DNA, 15 bp, Homo sapiens
tttcactctccttgg

SEQ ID NO: 5540720 - DNA, 24 bp, Homo sapiens
tttcactcttattgcccacgctgg

SEQ ID NO: 5540721 - DNA, 19 bp, Homo sapiens
tttcactgaagtgaataca

SEQ ID NO: 5540722 - DNA, 23 bp, Homo sapiens
tttcactgactttttttgtgggg

SEQ ID NO: 5540723 - DNA, 20 bp, Homo sapiens
tttcactgctgcaaggcctt

SEQ ID NO: 5540724 - DNA, 16 bp, Homo sapiens
tttcactggagcacaa

SEQ ID NO: 5540725 - DNA, 22 bp, Homo sapiens
tttcactggcataaatctgaag

SEQ ID NO: 5540726 - DNA, 13 bp, Homo sapiens
tttcactggggat

SEQ ID NO: 5540727 - DNA, 13 bp, Homo sapiens
tttcactgtctgt

SEQ ID NO: 5540728 - DNA, 13 bp, Homo sapiens
tttcactgtcttt

SEQ ID NO: 5540729 - DNA, 21 bp, Homo sapiens
tttcactgtctttaattctgt

SEQ ID NO: 5540730 - DNA, 22 bp, Homo sapiens
tttcactgtcttttaaaaaaca

SEQ ID NO: 5540731 - DNA, 15 bp, Homo sapiens
tttcacttaaggaga

SEQ ID NO: 5540732 - DNA, 16 bp, Homo sapiens
tttcacttacctgaaa

SEQ ID NO: 5540733 - DNA, 20 bp, Homo sapiens
tttcacttacctgaaaagta

SEQ ID NO: 5540734 - DNA, 14 bp, Homo sapiens
tttcacttatacct

SEQ ID NO: 5540735 - DNA, 22 bp, Homo sapiens
tttcacttcaggagaaactgct

SEQ ID NO: 5540736 - DNA, 22 bp, Homo sapiens
tttcacttcccgagcgctggtc

SEQ ID NO: 5540737 - DNA, 11 bp, Homo sapiens
tttcacttcct

SEQ ID NO: 5540738 - DNA, 22 bp, Homo sapiens
tttcacttcctctccacaggag

SEQ ID NO: 5540739 - DNA, 22 bp, Homo sapiens
tttcacttctacctacatattt

SEQ ID NO: 5540740 - DNA, 18 bp, Homo sapiens
tttcacttcttaaggaca

SEQ ID NO: 5540741 - DNA, 13 bp, Homo sapiens
tttcacttcttcc

SEQ ID NO: 5540742 - DNA, 15 bp, Homo sapiens
tttcacttcttccta

SEQ ID NO: 5540743 - DNA, 20 bp, Homo sapiens
tttcacttgagcaagatgat

SEQ ID NO: 5540744 - DNA, 16 bp, Homo sapiens
tttcacttgctctttg

SEQ ID NO: 5540745 - DNA, 16 bp, Homo sapiens
tttcacttgtattgac

SEQ ID NO: 5540746 - DNA, 15 bp, Homo sapiens
tttcactttattgct

SEQ ID NO: 5540747 - DNA, 17 bp, Homo sapiens
tttcactttgtgattat

SEQ ID NO: 5540748 - DNA, 17 bp, Homo sapiens
tttcacttttctgtaaa

SEQ ID NO: 5540749 - DNA, 16 bp, Homo sapiens
tttcacttttgttctg

SEQ ID NO: 5540750 - DNA, 19 bp, Homo sapiens
tttcagaaaacagaaaaaa

SEQ ID NO: 5540751 - DNA, 22 bp, Homo sapiens
tttcagaaaatattatgtgttt

SEQ ID NO: 5540752 - DNA, 15 bp, Homo sapiens
tttcagaaacagggc

SEQ ID NO: 5540753 - DNA, 15 bp, Homo sapiens
tttcagaaagatgaa

SEQ ID NO: 5540754 - DNA, 19 bp, Homo sapiens
tttcagaaagtttgaagca

SEQ ID NO: 5540755 - DNA, 22 bp, Homo sapiens
tttcagaaataaaagtatgaat

SEQ ID NO: 5540756 - DNA, 13 bp, Homo sapiens
tttcagaaataca

SEQ ID NO: 5540757 - DNA, 13 bp, Homo sapiens
tttcagaaatata

SEQ ID NO: 5540758 - DNA, 16 bp, Homo sapiens
tttcagaaatatgtgg

SEQ ID NO: 5540759 - DNA, 12 bp, Homo sapiens
tttcagaaatca

SEQ ID NO: 5540760 - DNA, 12 bp, Homo sapiens
tttcagaaatct

SEQ ID NO: 5540761 - DNA, 12 bp, Homo sapiens
tttcagaaattc

SEQ ID NO: 5540762 - DNA, 20 bp, Homo sapiens
tttcagaacctcttccccag

SEQ ID NO: 5540763 - DNA, 13 bp, Homo sapiens
tttcagaagaaat

SEQ ID NO: 5540764 - DNA, 16 bp, Homo sapiens
tttcagaagcaagcca

SEQ ID NO: 5540765 - DNA, 18 bp, Homo sapiens
tttcagaagcaggcaggg

SEQ ID NO: 5540766 - DNA, 17 bp, Homo sapiens
tttcagaagttaacatc

SEQ ID NO: 5540767 - DNA, 20 bp, Homo sapiens
tttcagaagttagtttgtat

SEQ ID NO: 5540768 - DNA, 21 bp, Homo sapiens
tttcagaagtttaaatattaa

SEQ ID NO: 5540769 - DNA, 12 bp, Homo sapiens
tttcagaataaa

SEQ ID NO: 5540770 - DNA, 15 bp, Homo sapiens
tttcagaataaaatt

SEQ ID NO: 5540771 - DNA, 16 bp, Homo sapiens
tttcagaatattttca

SEQ ID NO: 5540772 - DNA, 15 bp, Homo sapiens
tttcagaatcatctt

SEQ ID NO: 5540773 - DNA, 20 bp, Homo sapiens
tttcagaatctgaatgtaat

SEQ ID NO: 5540774 - DNA, 15 bp, Homo sapiens
tttcagaattttgta

SEQ ID NO: 5540775 - DNA, 16 bp, Homo sapiens
tttcagacaaattact

SEQ ID NO: 5540776 - DNA, 11 bp, Homo sapiens
tttcagacagg

SEQ ID NO: 5540777 - DNA, 21 bp, Homo sapiens
tttcagactcccattcctgaa

SEQ ID NO: 5540778 - DNA, 15 bp, Homo sapiens
tttcagactgcagag

SEQ ID NO: 5540779 - DNA, 18 bp, Homo sapiens
tttcagactgcctgtctg

SEQ ID NO: 5540780 - DNA, 23 bp, Homo sapiens
tttcagactgcctgtctgcttgc

SEQ ID NO: 5540781 - DNA, 24 bp, Homo sapiens
tttcagactgcctgtctgcttgca

SEQ ID NO: 5540782 - DNA, 21 bp, Homo sapiens
tttcagactttaaaattctaa

SEQ ID NO: 5540783 - DNA, 16 bp, Homo sapiens
tttcagagatggacag

SEQ ID NO: 5540784 - DNA, 17 bp, Homo sapiens
tttcagagatggacaga

SEQ ID NO: 5540785 - DNA, 17 bp, Homo sapiens
tttcagagcaggaggcc

SEQ ID NO: 5540786 - DNA, 17 bp, Homo sapiens
tttcagagcccccagcc

SEQ ID NO: 5540787 - DNA, 17 bp, Homo sapiens
tttcagaggctgcagga

SEQ ID NO: 5540788 - DNA, 18 bp, Homo sapiens
tttcagataactgttatt

SEQ ID NO: 5540789 - DNA, 21 bp, Homo sapiens
tttcagataatcacaatacat

SEQ ID NO: 5540790 - DNA, 17 bp, Homo sapiens
tttcagataatgatgga

SEQ ID NO: 5540791 - DNA, 19 bp, Homo sapiens
tttcagatataaatactga

SEQ ID NO: 5540792 - DNA, 16 bp, Homo sapiens
tttcagatatatatca

SEQ ID NO: 5540793 - DNA, 23 bp, Homo sapiens
tttcagatatcttggacaaatca

SEQ ID NO: 5540794 - DNA, 12 bp, Homo sapiens
tttcagatgagg

SEQ ID NO: 5540795 - DNA, 13 bp, Homo sapiens
tttcagatgaggt

SEQ ID NO: 5540796 - DNA, 18 bp, Homo sapiens
tttcagatgtaatgtttt

SEQ ID NO: 5540797 - DNA, 12 bp, Homo sapiens
tttcagatgtct

SEQ ID NO: 5540798 - DNA, 15 bp, Homo sapiens
tttcagatgtcttct

SEQ ID NO: 5540799 - DNA, 19 bp, Homo sapiens
tttcagatgtcttctgcct

SEQ ID NO: 5540800 - DNA, 21 bp, Homo sapiens
tttcagatgtcttctgcctgt

SEQ ID NO: 5540801 - DNA, 22 bp, Homo sapiens
tttcagatgtcttctgcctgtt

SEQ ID NO: 5540802 - DNA, 16 bp, Homo sapiens
tttcagatgtgcaata

SEQ ID NO: 5540803 - DNA, 22 bp, Homo sapiens
tttcagatgtgcaataatttgt

SEQ ID NO: 5540804 - DNA, 20 bp, Homo sapiens
tttcagattccaagtgtatt

SEQ ID NO: 5540805 - DNA, 21 bp, Homo sapiens
tttcagattccacacaaaatg

SEQ ID NO: 5540806 - DNA, 18 bp, Homo sapiens
tttcagattgtatctgaa

SEQ ID NO: 5540807 - DNA, 17 bp, Homo sapiens
tttcagatttgcacaaa

SEQ ID NO: 5540808 - DNA, 19 bp, Homo sapiens
tttcagatttgcacaaaaa

SEQ ID NO: 5540809 - DNA, 15 bp, Homo sapiens
tttcagattttgata

SEQ ID NO: 5540810 - DNA, 18 bp, Homo sapiens
tttcagattttgataact

SEQ ID NO: 5540811 - DNA, 18 bp, Homo sapiens
tttcagattttttaaaat

SEQ ID NO: 5540812 - DNA, 22 bp, Homo sapiens
tttcagcaacaagactgccagg

SEQ ID NO: 5540813 - DNA, 15 bp, Homo sapiens
tttcagcaatccatg

SEQ ID NO: 5540814 - DNA, 23 bp, Homo sapiens
tttcagcacctacagtgtacagt

SEQ ID NO: 5540815 - DNA, 12 bp, Homo sapiens
tttcagcactag

SEQ ID NO: 5540816 - DNA, 16 bp, Homo sapiens
tttcagcactcagaaa

SEQ ID NO: 5540817 - DNA, 19 bp, Homo sapiens
tttcagcacttaactactt

SEQ ID NO: 5540818 - DNA, 19 bp, Homo sapiens
tttcagcagcaaaaccaaa

SEQ ID NO: 5540819 - DNA, 15 bp, Homo sapiens
tttcagcagtctaaa

SEQ ID NO: 5540820 - DNA, 17 bp, Homo sapiens
tttcagcagtctaaatt

SEQ ID NO: 5540821 - DNA, 20 bp, Homo sapiens
tttcagcatggtttgcatga

SEQ ID NO: 5540822 - DNA, 18 bp, Homo sapiens
tttcagcattaagctgtt

SEQ ID NO: 5540823 - DNA, 18 bp, Homo sapiens
tttcagcattcccaatta

SEQ ID NO: 5540824 - DNA, 14 bp, Homo sapiens
tttcagcattgata

SEQ ID NO: 5540825 - DNA, 23 bp, Homo sapiens
tttcagccaaactgtagatgaag

SEQ ID NO: 5540826 - DNA, 16 bp, Homo sapiens
tttcagccaaagtcct

SEQ ID NO: 5540827 - DNA, 17 bp, Homo sapiens
tttcagccaaagtccta

SEQ ID NO: 5540828 - DNA, 21 bp, Homo sapiens
tttcagccaaggggctgcgct

SEQ ID NO: 5540829 - DNA, 21 bp, Homo sapiens
tttcagccaatctggacactt

SEQ ID NO: 5540830 - DNA, 23 bp, Homo sapiens
tttcagcctcctgtttggtgggg

SEQ ID NO: 5540831 - DNA, 18 bp, Homo sapiens
tttcagcgactccgttgg

SEQ ID NO: 5540832 - DNA, 22 bp, Homo sapiens
tttcagcgatgtatgcagctat

SEQ ID NO: 5540833 - DNA, 19 bp, Homo sapiens
tttcagcgcccccaggcct

SEQ ID NO: 5540834 - DNA, 21 bp, Homo sapiens
tttcagctaagggaagacatt

SEQ ID NO: 5540835 - DNA, 22 bp, Homo sapiens
tttcagctaggaacaaatcttc

SEQ ID NO: 5540836 - DNA, 21 bp, Homo sapiens
tttcagctatacctgcacgtt

SEQ ID NO: 5540837 - DNA, 15 bp, Homo sapiens
tttcagctatgctag

SEQ ID NO: 5540838 - DNA, 13 bp, Homo sapiens
tttcagctccctt

SEQ ID NO: 5540839 - DNA, 16 bp, Homo sapiens
tttcagctcctgacca

SEQ ID NO: 5540840 - DNA, 20 bp, Homo sapiens
tttcagctcctgaccagttg

SEQ ID NO: 5540841 - DNA, 22 bp, Homo sapiens
tttccaccaagtgtctagagtc

SEQ ID NO: 5540842 - DNA, 19 bp, Homo sapiens
tttccaccacagccagcac

SEQ ID NO: 5540843 - DNA, 18 bp, Homo sapiens
tttccaccatcaaatgct

SEQ ID NO: 5540844 - DNA, 16 bp, Homo sapiens
tttccacccagaccct

SEQ ID NO: 5540845 - DNA, 15 bp, Homo sapiens
tttccaccccctccc

SEQ ID NO: 5540846 - DNA, 22 bp, Homo sapiens
tttccaccccctccctggcctg

SEQ ID NO: 5540847 - DNA, 16 bp, Homo sapiens
tttccaccctgtctag

SEQ ID NO: 5540848 - DNA, 19 bp, Homo sapiens
tttccacctgctttctcct

SEQ ID NO: 5540849 - DNA, 14 bp, Homo sapiens
tttccaccttctca

SEQ ID NO: 5540850 - DNA, 22 bp, Homo sapiens
tttccacctttatgttttaata

SEQ ID NO: 5540851 - DNA, 17 bp, Homo sapiens
tttccacctttctctgt

SEQ ID NO: 5540852 - DNA, 15 bp, Homo sapiens
tttccacgaaatcct

SEQ ID NO: 5540853 - DNA, 17 bp, Homo sapiens
tttccactattatagaa

SEQ ID NO: 5540854 - DNA, 14 bp, Homo sapiens
tttccactattttc

SEQ ID NO: 5540855 - DNA, 17 bp, Homo sapiens
tttccactcaggtctgt

SEQ ID NO: 5540856 - DNA, 16 bp, Homo sapiens
tttccactcccactgc

SEQ ID NO: 5540857 - DNA, 12 bp, Homo sapiens
tttccactgaac

SEQ ID NO: 5540858 - DNA, 18 bp, Homo sapiens
tttccactgaacaaaacc

SEQ ID NO: 5540859 - DNA, 17 bp, Homo sapiens
tttccactgtaattaaa

SEQ ID NO: 5540860 - DNA, 16 bp, Homo sapiens
tttccacttcttcatt

SEQ ID NO: 5540861 - DNA, 16 bp, Homo sapiens
tttccacttgttctca

SEQ ID NO: 5540862 - DNA, 18 bp, Homo sapiens
tttccacttgttctcagg

SEQ ID NO: 5540863 - DNA, 12 bp, Homo sapiens
tttccactttgt

SEQ ID NO: 5540864 - DNA, 15 bp, Homo sapiens
tttccagaaaatata

SEQ ID NO: 5540865 - DNA, 19 bp, Homo sapiens
tttccagaaaatataaatg

SEQ ID NO: 5540866 - DNA, 22 bp, Homo sapiens
tttccagaaaatataaatgcat

SEQ ID NO: 5540867 - DNA, 24 bp, Homo sapiens
tttccagaaaatataaatgcatga

SEQ ID NO: 5540868 - DNA, 19 bp, Homo sapiens
tttccagaaatacctgtct

SEQ ID NO: 5540869 - DNA, 21 bp, Homo sapiens
tttccagaactaccaaaatga

SEQ ID NO: 5540870 - DNA, 18 bp, Homo sapiens
tttccagaactgcacaat

SEQ ID NO: 5540871 - DNA, 18 bp, Homo sapiens
tttccagaaggatttctt

SEQ ID NO: 5540872 - DNA, 21 bp, Homo sapiens
tttccagaaggccacaggcca

SEQ ID NO: 5540873 - DNA, 12 bp, Homo sapiens
tttccagaatga

SEQ ID NO: 5540874 - DNA, 17 bp, Homo sapiens
tttccagagcattccag

SEQ ID NO: 5540875 - DNA, 13 bp, Homo sapiens
tttccagcaaaat

SEQ ID NO: 5540876 - DNA, 20 bp, Homo sapiens
tttccagcattcccaggtag

SEQ ID NO: 5540877 - DNA, 11 bp, Homo sapiens
tttccagcctc

SEQ ID NO: 5540878 - DNA, 15 bp, Homo sapiens
tttccagcttgcatt

SEQ ID NO: 5540879 - DNA, 16 bp, Homo sapiens
tttccagctttctccc

SEQ ID NO: 5540880 - DNA, 13 bp, Homo sapiens
tttccaggaaggc

SEQ ID NO: 5540881 - DNA, 14 bp, Homo sapiens
tttccaggactctt

SEQ ID NO: 5540882 - DNA, 20 bp, Homo sapiens
tttccaggactgtttcaaac

SEQ ID NO: 5540883 - DNA, 17 bp, Homo sapiens
tttccaggagacatata

SEQ ID NO: 5540884 - DNA, 19 bp, Homo sapiens
tttccaggcttctgctggg

SEQ ID NO: 5540885 - DNA, 13 bp, Homo sapiens
tttccagggaggg

SEQ ID NO: 5540886 - DNA, 12 bp, Homo sapiens
tttccagtattt

SEQ ID NO: 5540887 - DNA, 16 bp, Homo sapiens
tttccagtattttagt

SEQ ID NO: 5540888 - DNA, 20 bp, Homo sapiens
tttccagtctccaccaggaa

SEQ ID NO: 5540889 - DNA, 21 bp, Homo sapiens
tttccagtctccaccaggaac

SEQ ID NO: 5540890 - DNA, 18 bp, Homo sapiens
tttccagtgacttgcaat

SEQ ID NO: 5540891 - DNA, 16 bp, Homo sapiens
tttccagttaaggacc

SEQ ID NO: 5540892 - DNA, 17 bp, Homo sapiens
tttccagttcctctttt

SEQ ID NO: 5540893 - DNA, 15 bp, Homo sapiens
tttccagttctgaca

SEQ ID NO: 5540894 - DNA, 17 bp, Homo sapiens
tttccagttgctgtgga

SEQ ID NO: 5540895 - DNA, 15 bp, Homo sapiens
tttccataaatttgg

SEQ ID NO: 5540896 - DNA, 22 bp, Homo sapiens
tttccataaatttggactgtct

SEQ ID NO: 5540897 - DNA, 14 bp, Homo sapiens
tttccataaggatt

SEQ ID NO: 5540898 - DNA, 22 bp, Homo sapiens
tttccatacagggtctcttcct

SEQ ID NO: 5540899 - DNA, 14 bp, Homo sapiens
tttccatatagtct

SEQ ID NO: 5540900 - DNA, 18 bp, Homo sapiens
tttccatatattggcact

SEQ ID NO: 5540901 - DNA, 21 bp, Homo sapiens
tttccatatccatagtgactt

SEQ ID NO: 5540902 - DNA, 18 bp, Homo sapiens
tttccatatggattttct

SEQ ID NO: 5540903 - DNA, 12 bp, Homo sapiens
tttccatatgtt

SEQ ID NO: 5540904 - DNA, 13 bp, Homo sapiens
tttccatatttgg

SEQ ID NO: 5540905 - DNA, 15 bp, Homo sapiens
tttccatatttggat

SEQ ID NO: 5540906 - DNA, 19 bp, Homo sapiens
tttccatatttttttcctt

SEQ ID NO: 5540907 - DNA, 14 bp, Homo sapiens
tttccatcataatt

SEQ ID NO: 5540908 - DNA, 14 bp, Homo sapiens
tttccatcatgtct

SEQ ID NO: 5540909 - DNA, 20 bp, Homo sapiens
tttccatcatgtctgtatac

SEQ ID NO: 5540910 - DNA, 21 bp, Homo sapiens
tttccatcccctagaaatcct

SEQ ID NO: 5540911 - DNA, 16 bp, Homo sapiens
tttccatcctttgcat

SEQ ID NO: 5540912 - DNA, 19 bp, Homo sapiens
tttccatcctttgcatttc

SEQ ID NO: 5540913 - DNA, 16 bp, Homo sapiens
tttccatctaaaaata

SEQ ID NO: 5540914 - DNA, 14 bp, Homo sapiens
tttccatctaaaat

SEQ ID NO: 5540915 - DNA, 23 bp, Homo sapiens
tttccatctgcttgtattttcca

SEQ ID NO: 5540916 - DNA, 11 bp, Homo sapiens
tttccatctta

SEQ ID NO: 5540917 - DNA, 17 bp, Homo sapiens
tttccatgaaaatgcaa

SEQ ID NO: 5540918 - DNA, 17 bp, Homo sapiens
tttccatgaagtttgaa

SEQ ID NO: 5540919 - DNA, 15 bp, Homo sapiens
tttccatgacatttt

SEQ ID NO: 5540920 - DNA, 22 bp, Homo sapiens
tttccatgcagttattagaact

SEQ ID NO: 5540921 - DNA, 19 bp, Homo sapiens
tttccatgcgtgtttctga

SEQ ID NO: 5540922 - DNA, 18 bp, Homo sapiens
tttccatggcaaatgggc

SEQ ID NO: 5540923 - DNA, 20 bp, Homo sapiens
tttccatggcaaatgggcag

SEQ ID NO: 5540924 - DNA, 21 bp, Homo sapiens
tttccatggcaggaaggcttg

SEQ ID NO: 5540925 - DNA, 13 bp, Homo sapiens
tttccatggctct

SEQ ID NO: 5540926 - DNA, 14 bp, Homo sapiens
tttccatgtatgca

SEQ ID NO: 5540927 - DNA, 15 bp, Homo sapiens
tttccatgtggcctt

SEQ ID NO: 5540928 - DNA, 17 bp, Homo sapiens
tttccatgttatgtttc

SEQ ID NO: 5540929 - DNA, 21 bp, Homo sapiens
tttccattatttatattagtt

SEQ ID NO: 5540930 - DNA, 21 bp, Homo sapiens
tttccattcatggatatttgt

SEQ ID NO: 5540931 - DNA, 16 bp, Homo sapiens
tttccattctgggtgt

SEQ ID NO: 5540932 - DNA, 18 bp, Homo sapiens
tttccattcttcttgcta

SEQ ID NO: 5540933 - DNA, 19 bp, Homo sapiens
tttccattcttcttgctac

SEQ ID NO: 5540934 - DNA, 21 bp, Homo sapiens
tttccattggtttacctgtga

SEQ ID NO: 5540935 - DNA, 16 bp, Homo sapiens
tttccattgtgtggcc

SEQ ID NO: 5540936 - DNA, 13 bp, Homo sapiens
tttccatttacta

SEQ ID NO: 5540937 - DNA, 13 bp, Homo sapiens
tttccatttattg

SEQ ID NO: 5540938 - DNA, 19 bp, Homo sapiens
tttccatttggattttaaa

SEQ ID NO: 5540939 - DNA, 18 bp, Homo sapiens
tttccatttggtattaca

SEQ ID NO: 5540940 - DNA, 18 bp, Homo sapiens
tttcccaaaacaatctat

SEQ ID NO: 5540941 - DNA, 14 bp, Homo sapiens
tttcccaaagcact

SEQ ID NO: 5540942 - DNA, 10 bp, Homo sapiens
tttcccaagc

SEQ ID NO: 5540943 - DNA, 18 bp, Homo sapiens
tttcccaagtcagacaga

SEQ ID NO: 5540944 - DNA, 18 bp, Homo sapiens
tttcccaatattgagcag

SEQ ID NO: 5540945 - DNA, 23 bp, Homo sapiens
tttcccacaccgtgtaaaccaaa

SEQ ID NO: 5540946 - DNA, 20 bp, Homo sapiens
tttcccacactgtgaactaa

SEQ ID NO: 5540947 - DNA, 23 bp, Homo sapiens
tttcccaccccaacctgctctcc

SEQ ID NO: 5540948 - DNA, 13 bp, Homo sapiens
tttcccaccctcc

SEQ ID NO: 5540949 - DNA, 15 bp, Homo sapiens
tttcccactgcaccc

SEQ ID NO: 5540950 - DNA, 23 bp, Homo sapiens
tttcccacttcccaccctgcccc

SEQ ID NO: 5540951 - DNA, 12 bp, Homo sapiens
tttcccagaagg

SEQ ID NO: 5540952 - DNA, 12 bp, Homo sapiens
tttcccagccct

SEQ ID NO: 5540953 - DNA, 12 bp, Homo sapiens
tttcccaggacg

SEQ ID NO: 5540954 - DNA, 21 bp, Homo sapiens
tttcccaggactagagcacaa

SEQ ID NO: 5540955 - DNA, 22 bp, Homo sapiens
tttcccaggcccactgtgcctc

SEQ ID NO: 5540956 - DNA, 13 bp, Homo sapiens
tttcccagtattt

SEQ ID NO: 5540957 - DNA, 16 bp, Homo sapiens
tttcccagtgagcctc

SEQ ID NO: 5540958 - DNA, 18 bp, Homo sapiens
tttcccagtgagcctctg

SEQ ID NO: 5540959 - DNA, 16 bp, Homo sapiens
tttcccatcacccctt

SEQ ID NO: 5540960 - DNA, 12 bp, Homo sapiens
tttcccatctgc

SEQ ID NO: 5540961 - DNA, 13 bp, Homo sapiens
tttcccatctgca

SEQ ID NO: 5540962 - DNA, 23 bp, Homo sapiens
tttcccatctggctttttctgcc

SEQ ID NO: 5540963 - DNA, 21 bp, Homo sapiens
tttcccatgatttcatgtact

SEQ ID NO: 5540964 - DNA, 13 bp, Homo sapiens
tttcccatgctga

SEQ ID NO: 5540965 - DNA, 14 bp, Homo sapiens
tttcccatgtattt

SEQ ID NO: 5540966 - DNA, 20 bp, Homo sapiens
tttcccattggttcacctgt

SEQ ID NO: 5540967 - DNA, 17 bp, Homo sapiens
tttcccatttcgtgtaa

SEQ ID NO: 5540968 - DNA, 21 bp, Homo sapiens
tttccccaaagtcttaaaata

SEQ ID NO: 5540969 - DNA, 21 bp, Homo sapiens
tttccccaaggacccagccct

SEQ ID NO: 5540970 - DNA, 19 bp, Homo sapiens
tttccccaattatcctcct

SEQ ID NO: 5540971 - DNA, 21 bp, Homo sapiens
tttccccacattctatagcca

SEQ ID NO: 5540972 - DNA, 18 bp, Homo sapiens
tttccccaccagatgctg

SEQ ID NO: 5540973 - DNA, 17 bp, Homo sapiens
tttccccacctcttcct

SEQ ID NO: 5540974 - DNA, 20 bp, Homo sapiens
tttccccactaataaagtgc

SEQ ID NO: 5540975 - DNA, 22 bp, Homo sapiens
tttccccagaggctcccaatca

SEQ ID NO: 5540976 - DNA, 19 bp, Homo sapiens
tttccccagcatcactccc

SEQ ID NO: 5540977 - DNA, 19 bp, Homo sapiens
tttccccaggggaaaatga

SEQ ID NO: 5540978 - DNA, 15 bp, Homo sapiens
tttccccataactca

SEQ ID NO: 5540979 - DNA, 21 bp, Homo sapiens
tttccccatctctgtctgggg

SEQ ID NO: 5540980 - DNA, 21 bp, Homo sapiens
tttccccattcattcctgatg

SEQ ID NO: 5540981 - DNA, 13 bp, Homo sapiens
tttccccattgtg

SEQ ID NO: 5540982 - DNA, 18 bp, Homo sapiens
tttcccccaccccagagt

SEQ ID NO: 5540983 - DNA, 22 bp, Homo sapiens
tttcccccaccccatttctctc

SEQ ID NO: 5540984 - DNA, 17 bp, Homo sapiens
tttcccccaccctccca

SEQ ID NO: 5540985 - DNA, 13 bp, Homo sapiens
tttcccccactcc

SEQ ID NO: 5540986 - DNA, 23 bp, Homo sapiens
tttcccccagcaacgcccctcca

SEQ ID NO: 5540987 - DNA, 15 bp, Homo sapiens
tttcccccaggaaaa

SEQ ID NO: 5540988 - DNA, 17 bp, Homo sapiens
tttccccccactctccc

SEQ ID NO: 5540989 - DNA, 19 bp, Homo sapiens
tttccccccactctcccca

SEQ ID NO: 5540990 - DNA, 19 bp, Homo sapiens
tttcccccctttttttcct

SEQ ID NO: 5540991 - DNA, 23 bp, Homo sapiens
tttcccccgagctcttggccttt

SEQ ID NO: 5540992 - DNA, 18 bp, Homo sapiens
tttccccctagcctgcct

SEQ ID NO: 5540993 - DNA, 12 bp, Homo sapiens
tttccccctcct

SEQ ID NO: 5540994 - DNA, 13 bp, Homo sapiens
tttccccctcctc

SEQ ID NO: 5540995 - DNA, 22 bp, Homo sapiens
tttcccccttcccatttcttcc

SEQ ID NO: 5540996 - DNA, 23 bp, Homo sapiens
tttcccccttcccatttcttccc

SEQ ID NO: 5540997 - DNA, 23 bp, Homo sapiens
tttcccccttgaggattgtggaa

SEQ ID NO: 5540998 - DNA, 17 bp, Homo sapiens
tttcccccttggctctc

SEQ ID NO: 5540999 - DNA, 18 bp, Homo sapiens
tttccccctttcttcctc

SEQ ID NO: 5541000 - DNA, 20 bp, Homo sapiens
tttccccgaagagtcagccc

SEQ ID NO: 5541001 - DNA, 23 bp, Homo sapiens
tttcccctaattttccagagaag

SEQ ID NO: 5541002 - DNA, 18 bp, Homo sapiens
tttcccctatcatttatt

SEQ ID NO: 5541003 - DNA, 13 bp, Homo sapiens
tttcccctatcct

SEQ ID NO: 5541004 - DNA, 16 bp, Homo sapiens
tttcccctcagagctc

SEQ ID NO: 5541005 - DNA, 14 bp, Homo sapiens
tttcccctcccaat

SEQ ID NO: 5541006 - DNA, 21 bp, Homo sapiens
tttcccctcccaatcctctct

SEQ ID NO: 5541007 - DNA, 23 bp, Homo sapiens
tttcccctcccaatcctctctcc

SEQ ID NO: 5541008 - DNA, 22 bp, Homo sapiens
tttcccctcccgcttcctccgg

SEQ ID NO: 5541009 - DNA, 21 bp, Homo sapiens
tttcccctcccgtcttcctcc

SEQ ID NO: 5541010 - DNA, 16 bp, Homo sapiens
tttcccctccctgggt

SEQ ID NO: 5541011 - DNA, 17 bp, Homo sapiens
tttcccctcctttgtct

SEQ ID NO: 5541012 - DNA, 13 bp, Homo sapiens
tttcccctctctg

SEQ ID NO: 5541013 - DNA, 20 bp, Homo sapiens
tttcccctctgtgtcctctc

SEQ ID NO: 5541014 - DNA, 14 bp, Homo sapiens
tttcccctcttccc

SEQ ID NO: 5541015 - DNA, 13 bp, Homo sapiens
tttcccctgcaat

SEQ ID NO: 5541016 - DNA, 16 bp, Homo sapiens
tttcccctgcaatgcg

SEQ ID NO: 5541017 - DNA, 16 bp, Homo sapiens
tttcccctgctcccct

SEQ ID NO: 5541018 - DNA, 14 bp, Homo sapiens
tttcccctggcctc

SEQ ID NO: 5541019 - DNA, 16 bp, Homo sapiens
tttctattgtacagaa

SEQ ID NO: 5541020 - DNA, 20 bp, Homo sapiens
tttctattgttaaacaaatg

SEQ ID NO: 5541021 - DNA, 14 bp, Homo sapiens
tttctattgttact

SEQ ID NO: 5541022 - DNA, 16 bp, Homo sapiens
tttctatttataagtg

SEQ ID NO: 5541023 - DNA, 17 bp, Homo sapiens
tttctatttataagtga

SEQ ID NO: 5541024 - DNA, 17 bp, Homo sapiens
tttctatttcactggag

SEQ ID NO: 5541025 - DNA, 12 bp, Homo sapiens
tttctatttcca

SEQ ID NO: 5541026 - DNA, 17 bp, Homo sapiens
tttctatttctcctcca

SEQ ID NO: 5541027 - DNA, 16 bp, Homo sapiens
tttctatttgacttgt

SEQ ID NO: 5541028 - DNA, 21 bp, Homo sapiens
tttctattttccctcgctggg

SEQ ID NO: 5541029 - DNA, 15 bp, Homo sapiens
tttctatttttgatt

SEQ ID NO: 5541030 - DNA, 18 bp, Homo sapiens
tttctcaaaacccttaaa

SEQ ID NO: 5541031 - DNA, 22 bp, Homo sapiens
tttctcaaaacccttaaaagaa

SEQ ID NO: 5541032 - DNA, 20 bp, Homo sapiens
tttctcaaaagaggttactt

SEQ ID NO: 5541033 - DNA, 16 bp, Homo sapiens
tttctcaaagaaattt

SEQ ID NO: 5541034 - DNA, 13 bp, Homo sapiens
tttctcaaagttt

SEQ ID NO: 5541035 - DNA, 18 bp, Homo sapiens
tttctcaaagttttgaaa

SEQ ID NO: 5541036 - DNA, 22 bp, Homo sapiens
tttctcaaagttttgaaaagct

SEQ ID NO: 5541037 - DNA, 21 bp, Homo sapiens
tttctcaaagtttttacagtg

SEQ ID NO: 5541038 - DNA, 16 bp, Homo sapiens
tttctcaactgtccca

SEQ ID NO: 5541039 - DNA, 18 bp, Homo sapiens
tttctcaagtgttttgga

SEQ ID NO: 5541040 - DNA, 16 bp, Homo sapiens
tttctcaatagttctt

SEQ ID NO: 5541041 - DNA, 17 bp, Homo sapiens
tttctcaatcagtgcag

SEQ ID NO: 5541042 - DNA, 13 bp, Homo sapiens
tttctcaatgtct

SEQ ID NO: 5541043 - DNA, 22 bp, Homo sapiens
tttctcacactctaactgtata

SEQ ID NO: 5541044 - DNA, 18 bp, Homo sapiens
tttctcacattgctgtat

SEQ ID NO: 5541045 - DNA, 14 bp, Homo sapiens
tttctcactatata

SEQ ID NO: 5541046 - DNA, 14 bp, Homo sapiens
tttctcactccctt

SEQ ID NO: 5541047 - DNA, 15 bp, Homo sapiens
tttctcactgaactc

SEQ ID NO: 5541048 - DNA, 15 bp, Homo sapiens
tttctcactgaagct

SEQ ID NO: 5541049 - DNA, 14 bp, Homo sapiens
tttctcactgctgt

SEQ ID NO: 5541050 - DNA, 15 bp, Homo sapiens
tttctcacttttgga

SEQ ID NO: 5541051 - DNA, 20 bp, Homo sapiens
tttctcagaagtccctgttt

SEQ ID NO: 5541052 - DNA, 22 bp, Homo sapiens
tttctcagactcaccaactttt

SEQ ID NO: 5541053 - DNA, 19 bp, Homo sapiens
tttctcagactggtctcga

SEQ ID NO: 5541054 - DNA, 19 bp, Homo sapiens
tttctcagactttggaaaa

SEQ ID NO: 5541055 - DNA, 20 bp, Homo sapiens
tttctcagattcctttgtat

SEQ ID NO: 5541056 - DNA, 15 bp, Homo sapiens
tttctcagcatatat

SEQ ID NO: 5541057 - DNA, 20 bp, Homo sapiens
tttctcagcctggttcagaa

SEQ ID NO: 5541058 - DNA, 14 bp, Homo sapiens
tttctcagctccca

SEQ ID NO: 5541059 - DNA, 13 bp, Homo sapiens
tttctcaggagct

SEQ ID NO: 5541060 - DNA, 21 bp, Homo sapiens
tttctcaggctaggccagcag

SEQ ID NO: 5541061 - DNA, 16 bp, Homo sapiens
tttctcaggcttctca

SEQ ID NO: 5541062 - DNA, 21 bp, Homo sapiens
tttctcagggaagtaagatgt

SEQ ID NO: 5541063 - DNA, 21 bp, Homo sapiens
tttctcagggtcactgtcctt

SEQ ID NO: 5541064 - DNA, 23 bp, Homo sapiens
tttctcagggtcactgtccttga

SEQ ID NO: 5541065 - DNA, 17 bp, Homo sapiens
tttctcagtgatttcct

SEQ ID NO: 5541066 - DNA, 16 bp, Homo sapiens
tttctcagtttgtata

SEQ ID NO: 5541067 - DNA, 17 bp, Homo sapiens
tttctcataaaactgtg

SEQ ID NO: 5541068 - DNA, 12 bp, Homo sapiens
tttctcatactt

SEQ ID NO: 5541069 - DNA, 20 bp, Homo sapiens
tttctcataggctatgccat

SEQ ID NO: 5541070 - DNA, 20 bp, Homo sapiens
tttctcatccacataccctg

SEQ ID NO: 5541071 - DNA, 11 bp, Homo sapiens
tttctcatgtg

SEQ ID NO: 5541072 - DNA, 19 bp, Homo sapiens
tttctcatgtgtttgcata

SEQ ID NO: 5541073 - DNA, 12 bp, Homo sapiens
tttctcatgttg

SEQ ID NO: 5541074 - DNA, 15 bp, Homo sapiens
tttctcatgttgaag

SEQ ID NO: 5541075 - DNA, 14 bp, Homo sapiens
tttctcattaacaa

SEQ ID NO: 5541076 - DNA, 21 bp, Homo sapiens
tttctcattagagatctgaaa

SEQ ID NO: 5541077 - DNA, 14 bp, Homo sapiens
tttctcattcttgc

SEQ ID NO: 5541078 - DNA, 14 bp, Homo sapiens
tttctcattcttgt

SEQ ID NO: 5541079 - DNA, 22 bp, Homo sapiens
tttctcatttgccaataataat

SEQ ID NO: 5541080 - DNA, 19 bp, Homo sapiens
tttctcatttggggagggg

SEQ ID NO: 5541081 - DNA, 14 bp, Homo sapiens
tttctccaaataaa

SEQ ID NO: 5541082 - DNA, 21 bp, Homo sapiens
tttctccaagagctacataat

SEQ ID NO: 5541083 - DNA, 15 bp, Homo sapiens
tttctccaagtactt

SEQ ID NO: 5541084 - DNA, 20 bp, Homo sapiens
tttctccaatatcagtgctc

SEQ ID NO: 5541085 - DNA, 23 bp, Homo sapiens
tttctccacttcatttttaagaa

SEQ ID NO: 5541086 - DNA, 14 bp, Homo sapiens
tttctccagaaatt

SEQ ID NO: 5541087 - DNA, 13 bp, Homo sapiens
tttctccagaacc

SEQ ID NO: 5541088 - DNA, 14 bp, Homo sapiens
tttctccagaccca

SEQ ID NO: 5541089 - DNA, 11 bp, Homo sapiens
tttctccagct

SEQ ID NO: 5541090 - DNA, 15 bp, Homo sapiens
tttctccagtgctgt

SEQ ID NO: 5541091 - DNA, 23 bp, Homo sapiens
tttctccatattagatttaccca

SEQ ID NO: 5541092 - DNA, 17 bp, Homo sapiens
tttctccatcccctccc

SEQ ID NO: 5541093 - DNA, 20 bp, Homo sapiens
tttctccatcccctccctgc

SEQ ID NO: 5541094 - DNA, 14 bp, Homo sapiens
tttctccatcttta

SEQ ID NO: 5541095 - DNA, 21 bp, Homo sapiens
tttctccattaaacttctact

SEQ ID NO: 5541096 - DNA, 14 bp, Homo sapiens
tttctccatttatt

SEQ ID NO: 5541097 - DNA, 13 bp, Homo sapiens
tttctcccaagaa

SEQ ID NO: 5541098 - DNA, 15 bp, Homo sapiens
tttctcccaagctga

SEQ ID NO: 5541099 - DNA, 15 bp, Homo sapiens
tttctcccaaggcca

SEQ ID NO: 5541100 - DNA, 19 bp, Homo sapiens
tttctcccacctccttcct

SEQ ID NO: 5541101 - DNA, 22 bp, Homo sapiens
tttctcccacctccttcctcct

SEQ ID NO: 5541102 - DNA, 17 bp, Homo sapiens
tttctcccagcttcaaa

SEQ ID NO: 5541103 - DNA, 21 bp, Homo sapiens
tttctcccagcttcaaatgca

SEQ ID NO: 5541104 - DNA, 17 bp, Homo sapiens
tttctcccagtcattta

SEQ ID NO: 5541105 - DNA, 10 bp, Homo sapiens
tttctccccc

SEQ ID NO: 5541106 - DNA, 21 bp, Homo sapiens
tttctcccccatgttctgtcc

SEQ ID NO: 5541107 - DNA, 20 bp, Homo sapiens
tttctcccctgcccccagga

SEQ ID NO: 5541108 - DNA, 19 bp, Homo sapiens
tttctcccgaatcctgagg

SEQ ID NO: 5541109 - DNA, 13 bp, Homo sapiens
tttctccctcacc

SEQ ID NO: 5541110 - DNA, 13 bp, Homo sapiens
tttctccctctca

SEQ ID NO: 5541111 - DNA, 22 bp, Homo sapiens
tttctccctctcatgtccctcc

SEQ ID NO: 5541112 - DNA, 21 bp, Homo sapiens
tttctccctggatttttacca

SEQ ID NO: 5541113 - DNA, 23 bp, Homo sapiens
tttctccctggatttttaccagt

SEQ ID NO: 5541114 - DNA, 21 bp, Homo sapiens
tttctccctgtcccttccttt

SEQ ID NO: 5541115 - DNA, 21 bp, Homo sapiens
tttctccctgttcctttgagt

SEQ ID NO: 5541116 - DNA, 15 bp, Homo sapiens
tttctcccttctgct

SEQ ID NO: 5541117 - DNA, 18 bp, Homo sapiens
tttctccggggtctgtgc

SEQ ID NO: 5541118 - DNA, 20 bp, Homo sapiens
tttctccgggtcctcctaag

SEQ ID NO: 5541119 - DNA, 16 bp, Homo sapiens
tttctccgtatttatt

SEQ ID NO: 5541120 - DNA, 18 bp, Homo sapiens
tttctcctactttacact

SEQ ID NO: 5541121 - DNA, 20 bp, Homo sapiens
tttctcctccccacctgtag

SEQ ID NO: 5541122 - DNA, 23 bp, Homo sapiens
tttctcctccgcctgtgtccatc

SEQ ID NO: 5541123 - DNA, 18 bp, Homo sapiens
tttctcctctttgaacat

SEQ ID NO: 5541124 - DNA, 16 bp, Homo sapiens
tttctcctctttgaga

SEQ ID NO: 5541125 - DNA, 19 bp, Homo sapiens
tttctcctggcccctgcct

SEQ ID NO: 5541126 - DNA, 22 bp, Homo sapiens
tttctcctggtgactcaaataa

SEQ ID NO: 5541127 - DNA, 14 bp, Homo sapiens
tttctcctgtgccc

SEQ ID NO: 5541128 - DNA, 17 bp, Homo sapiens
tttctccttaccgtctt

SEQ ID NO: 5541129 - DNA, 13 bp, Homo sapiens
tttctccttgaaa

SEQ ID NO: 5541130 - DNA, 14 bp, Homo sapiens
tttctccttgaaat

SEQ ID NO: 5541131 - DNA, 12 bp, Homo sapiens
tttctccttggt

SEQ ID NO: 5541132 - DNA, 14 bp, Homo sapiens
tttctcctttgcaa

SEQ ID NO: 5541133 - DNA, 21 bp, Homo sapiens
tttctcgagtccaaaatcatt

SEQ ID NO: 5541134 - DNA, 23 bp, Homo sapiens
tttctcgggtgcatttgagagaa

SEQ ID NO: 5541135 - DNA, 17 bp, Homo sapiens
tttctcgtactttcaca

SEQ ID NO: 5541136 - DNA, 23 bp, Homo sapiens
tttctcgtactttcacatctctg

SEQ ID NO: 5541137 - DNA, 14 bp, Homo sapiens
tttctctaaactgt

SEQ ID NO: 5541138 - DNA, 22 bp, Homo sapiens
tttctctaacttcaaggcccat

SEQ ID NO: 5541139 - DNA, 17 bp, Homo sapiens
tttctctaataataaat

SEQ ID NO: 5541140 - DNA, 22 bp, Homo sapiens
tttctctacagatgtcccattt

SEQ ID NO: 5541141 - DNA, 21 bp, Homo sapiens
tttctctagaggctggcaaga

SEQ ID NO: 5541142 - DNA, 15 bp, Homo sapiens
tttctctataaagta

SEQ ID NO: 5541143 - DNA, 16 bp, Homo sapiens
tttctctattaaaatg

SEQ ID NO: 5541144 - DNA, 16 bp, Homo sapiens
tttctctcaacaccat

SEQ ID NO: 5541145 - DNA, 21 bp, Homo sapiens
tttctctcccaacgctgaagc

SEQ ID NO: 5541146 - DNA, 22 bp, Homo sapiens
tttctctcccaacgctgaagcg

SEQ ID NO: 5541147 - DNA, 12 bp, Homo sapiens
tttctctcctct

SEQ ID NO: 5541148 - DNA, 15 bp, Homo sapiens
tttctctcctgtcct

SEQ ID NO: 5541149 - DNA, 21 bp, Homo sapiens
tttctctccttcttccctgtt

SEQ ID NO: 5541150 - DNA, 22 bp, Homo sapiens
tttctctctatttgtattgtta

SEQ ID NO: 5541151 - DNA, 18 bp, Homo sapiens
tttctctctcctctctgc

SEQ ID NO: 5541152 - DNA, 12 bp, Homo sapiens
tttctctctcta

SEQ ID NO: 5541153 - DNA, 14 bp, Homo sapiens
tttctctctctcta

SEQ ID NO: 5541154 - DNA, 17 bp, Homo sapiens
tttctctctctctacct

SEQ ID NO: 5541155 - DNA, 11 bp, Homo sapiens
tttctctctgg

SEQ ID NO: 5541156 - DNA, 13 bp, Homo sapiens
tttctctctggat

SEQ ID NO: 5541157 - DNA, 13 bp, Homo sapiens
tttctctctgtgt

SEQ ID NO: 5541158 - DNA, 13 bp, Homo sapiens
tttctctcttccc

SEQ ID NO: 5541159 - DNA, 21 bp, Homo sapiens
tttctctctttcttttgtgca

SEQ ID NO: 5541160 - DNA, 15 bp, Homo sapiens
tttctctgaacacat

SEQ ID NO: 5541161 - DNA, 11 bp, Homo sapiens
tttctctgaga

SEQ ID NO: 5541162 - DNA, 18 bp, Homo sapiens
tttctctgagaaccaaaa

SEQ ID NO: 5541163 - DNA, 15 bp, Homo sapiens
tttctctgatacaga

SEQ ID NO: 5541164 - DNA, 11 bp, Homo sapiens
tttctctgcca

SEQ ID NO: 5541165 - DNA, 21 bp, Homo sapiens
tttctctgctcttgtttcact

SEQ ID NO: 5541166 - DNA, 14 bp, Homo sapiens
tttctctgcttcag

SEQ ID NO: 5541167 - DNA, 18 bp, Homo sapiens
tttctctgcttcagcttg

SEQ ID NO: 5541168 - DNA, 13 bp, Homo sapiens
tttctctgggctt

SEQ ID NO: 5541169 - DNA, 20 bp, Homo sapiens
tttctctggggtatttgggg

SEQ ID NO: 5541170 - DNA, 19 bp, Homo sapiens
tttctctggtggtcttcct

SEQ ID NO: 5541171 - DNA, 18 bp, Homo sapiens
tttctctgtagttcctaa

SEQ ID NO: 5541172 - DNA, 22 bp, Homo sapiens
tttctctgtagttcctaatgga

SEQ ID NO: 5541173 - DNA, 13 bp, Homo sapiens
tttctctgtatat

SEQ ID NO: 5541174 - DNA, 11 bp, Homo sapiens
tttctctgtgc

SEQ ID NO: 5541175 - DNA, 16 bp, Homo sapiens
tttctctgtgctctga

SEQ ID NO: 5541176 - DNA, 16 bp, Homo sapiens
tttctctgtggctcca

SEQ ID NO: 5541177 - DNA, 19 bp, Homo sapiens
tttctcttaagctgcccaa

SEQ ID NO: 5541178 - DNA, 14 bp, Homo sapiens
tttctcttacctgt

SEQ ID NO: 5541179 - DNA, 17 bp, Homo sapiens
tttctcttactgcaaat

SEQ ID NO: 5541180 - DNA, 19 bp, Homo sapiens
tttctcttcagtgtgttga

SEQ ID NO: 5541181 - DNA, 18 bp, Homo sapiens
tttctcttccccttagaa

SEQ ID NO: 5541182 - DNA, 15 bp, Homo sapiens
tttctcttccccttc

SEQ ID NO: 5541183 - DNA, 14 bp, Homo sapiens
tttctcttccctga

SEQ ID NO: 5541184 - DNA, 23 bp, Homo sapiens
tttctcttctacccttttccttt

SEQ ID NO: 5541185 - DNA, 16 bp, Homo sapiens
tttctcttctcccctt

SEQ ID NO: 5541186 - DNA, 14 bp, Homo sapiens
tttctcttctgtcc

SEQ ID NO: 5541187 - DNA, 15 bp, Homo sapiens
tttctcttctgtcca

SEQ ID NO: 5541188 - DNA, 22 bp, Homo sapiens
tttctcttctgtccatcagtgc

SEQ ID NO: 5541189 - DNA, 15 bp, Homo sapiens
tttctcttctgttct

SEQ ID NO: 5541190 - DNA, 15 bp, Homo sapiens
tttctctttaaaaga

SEQ ID NO: 5541191 - DNA, 14 bp, Homo sapiens
tttctctttaaact

SEQ ID NO: 5541192 - DNA, 14 bp, Homo sapiens
tttctctttaggag

SEQ ID NO: 5541193 - DNA, 17 bp, Homo sapiens
tttctctttccatgaca

SEQ ID NO: 5541194 - DNA, 22 bp, Homo sapiens
tttctctttcctcatttcctag

SEQ ID NO: 5541195 - DNA, 14 bp, Homo sapiens
tttctctttcgtta

SEQ ID NO: 5541196 - DNA, 14 bp, Homo sapiens
tttctctttctcct

SEQ ID NO: 5541197 - DNA, 12 bp, Homo sapiens
tttctctttctt

SEQ ID NO: 5541198 - DNA, 22 bp, Homo sapiens
tttcttgcaagcaacaagctat

SEQ ID NO: 5541199 - DNA, 16 bp, Homo sapiens
tttcttgcaatttgaa

SEQ ID NO: 5541200 - DNA, 17 bp, Homo sapiens
tttcttgcaatttgaag

SEQ ID NO: 5541201 - DNA, 13 bp, Homo sapiens
tttcttgcactga

SEQ ID NO: 5541202 - DNA, 17 bp, Homo sapiens
tttcttgcactgaatat

SEQ ID NO: 5541203 - DNA, 17 bp, Homo sapiens
tttcttgcactgtccag

SEQ ID NO: 5541204 - DNA, 15 bp, Homo sapiens
tttcttgcagattct

SEQ ID NO: 5541205 - DNA, 13 bp, Homo sapiens
tttcttgcattga

SEQ ID NO: 5541206 - DNA, 12 bp, Homo sapiens
tttcttgcctca

SEQ ID NO: 5541207 - DNA, 13 bp, Homo sapiens
tttcttgcctcat

SEQ ID NO: 5541208 - DNA, 18 bp, Homo sapiens
tttcttgcctctgtcccc

SEQ ID NO: 5541209 - DNA, 22 bp, Homo sapiens
tttcttgccttaaccagtctct

SEQ ID NO: 5541210 - DNA, 20 bp, Homo sapiens
tttcttgctctctctccctg

SEQ ID NO: 5541211 - DNA, 16 bp, Homo sapiens
tttcttgctgcttcta

SEQ ID NO: 5541212 - DNA, 12 bp, Homo sapiens
tttcttgcttgt

SEQ ID NO: 5541213 - DNA, 19 bp, Homo sapiens
tttcttggcaaaagccttg

SEQ ID NO: 5541214 - DNA, 19 bp, Homo sapiens
tttcttggcctcaagttca

SEQ ID NO: 5541215 - DNA, 18 bp, Homo sapiens
tttcttgggaaacttcta

SEQ ID NO: 5541216 - DNA, 23 bp, Homo sapiens
tttcttgggaattgaaaaaaatt

SEQ ID NO: 5541217 - DNA, 17 bp, Homo sapiens
tttcttggtatgatcat

SEQ ID NO: 5541218 - DNA, 20 bp, Homo sapiens
tttcttggtttctggataaa

SEQ ID NO: 5541219 - DNA, 15 bp, Homo sapiens
tttcttgtaaatgtt

SEQ ID NO: 5541220 - DNA, 19 bp, Homo sapiens
tttcttgtaatttaaacag

SEQ ID NO: 5541221 - DNA, 13 bp, Homo sapiens
tttcttgtctata

SEQ ID NO: 5541222 - DNA, 19 bp, Homo sapiens
tttcttgtgcactggcacc

SEQ ID NO: 5541223 - DNA, 15 bp, Homo sapiens
tttcttgtggtgtaa

SEQ ID NO: 5541224 - DNA, 18 bp, Homo sapiens
tttcttgtgttctgtaga

SEQ ID NO: 5541225 - DNA, 17 bp, Homo sapiens
tttcttgttattaccaa

SEQ ID NO: 5541226 - DNA, 20 bp, Homo sapiens
tttcttgttcatccaaggaa

SEQ ID NO: 5541227 - DNA, 17 bp, Homo sapiens
tttcttgttgcatcttt

SEQ ID NO: 5541228 - DNA, 13 bp, Homo sapiens
tttcttgtttaac

SEQ ID NO: 5541229 - DNA, 12 bp, Homo sapiens
tttcttgtttat

SEQ ID NO: 5541230 - DNA, 13 bp, Homo sapiens
tttcttgtttatt

SEQ ID NO: 5541231 - DNA, 13 bp, Homo sapiens
tttcttgtttctg

SEQ ID NO: 5541232 - DNA, 14 bp, Homo sapiens
tttcttgtttctta

SEQ ID NO: 5541233 - DNA, 19 bp, Homo sapiens
tttctttaaaataaaaaag

SEQ ID NO: 5541234 - DNA, 14 bp, Homo sapiens
tttctttaaactat

SEQ ID NO: 5541235 - DNA, 13 bp, Homo sapiens
tttctttaaagat

SEQ ID NO: 5541236 - DNA, 16 bp, Homo sapiens
tttctttaaagccagt

SEQ ID NO: 5541237 - DNA, 19 bp, Homo sapiens
tttctttaaatgtgtattt

SEQ ID NO: 5541238 - DNA, 12 bp, Homo sapiens
tttctttaaatt

SEQ ID NO: 5541239 - DNA, 23 bp, Homo sapiens
tttctttaaccttgtataaatta

SEQ ID NO: 5541240 - DNA, 17 bp, Homo sapiens
tttctttaatcaaaagt

SEQ ID NO: 5541241 - DNA, 13 bp, Homo sapiens
tttctttaatgct

SEQ ID NO: 5541242 - DNA, 18 bp, Homo sapiens
tttctttaatgcttttat

SEQ ID NO: 5541243 - DNA, 21 bp, Homo sapiens
tttctttagaacaacataaaa

SEQ ID NO: 5541244 - DNA, 24 bp, Homo sapiens
tttctttagaacaacataaaatta

SEQ ID NO: 5541245 - DNA, 18 bp, Homo sapiens
tttctttagagaactgaa

SEQ ID NO: 5541246 - DNA, 19 bp, Homo sapiens
tttctttagagaactgaaa

SEQ ID NO: 5541247 - DNA, 16 bp, Homo sapiens
tttctttatataaggt

SEQ ID NO: 5541248 - DNA, 15 bp, Homo sapiens
tttctttatttctgt

SEQ ID NO: 5541249 - DNA, 16 bp, Homo sapiens
tttctttcacaaaaaa

SEQ ID NO: 5541250 - DNA, 15 bp, Homo sapiens
tttctttcagatttt

SEQ ID NO: 5541251 - DNA, 16 bp, Homo sapiens
tttctttcatacatta

SEQ ID NO: 5541252 - DNA, 13 bp, Homo sapiens
tttctttccagag

SEQ ID NO: 5541253 - DNA, 19 bp, Homo sapiens
tttctttccatttacagtc

SEQ ID NO: 5541254 - DNA, 15 bp, Homo sapiens
tttctttcccttctt

SEQ ID NO: 5541255 - DNA, 21 bp, Homo sapiens
tttctttcctttccccttttt

SEQ ID NO: 5541256 - DNA, 13 bp, Homo sapiens
tttctttctaact

SEQ ID NO: 5541257 - DNA, 13 bp, Homo sapiens
tttctttctagtt

SEQ ID NO: 5541258 - DNA, 14 bp, Homo sapiens
tttctttctgtctt

SEQ ID NO: 5541259 - DNA, 10 bp, Homo sapiens
tttctttctt

SEQ ID NO: 5541260 - DNA, 15 bp, Homo sapiens
tttctttcttccatt

SEQ ID NO: 5541261 - DNA, 23 bp, Homo sapiens
tttctttcttcccgtgtgtattt

SEQ ID NO: 5541262 - DNA, 13 bp, Homo sapiens
tttctttcttcct

SEQ ID NO: 5541263 - DNA, 15 bp, Homo sapiens
tttctttctttctgt

SEQ ID NO: 5541264 - DNA, 11 bp, Homo sapiens
tttctttgaaa

SEQ ID NO: 5541265 - DNA, 21 bp, Homo sapiens
tttctttgaaaaaaaataaat

SEQ ID NO: 5541266 - DNA, 16 bp, Homo sapiens
tttctttgaagaagga

SEQ ID NO: 5541267 - DNA, 11 bp, Homo sapiens
tttctttgaat

SEQ ID NO: 5541268 - DNA, 13 bp, Homo sapiens
tttctttgaataa

SEQ ID NO: 5541269 - DNA, 14 bp, Homo sapiens
tttctttgaataaa

SEQ ID NO: 5541270 - DNA, 15 bp, Homo sapiens
tttctttgaataaat

SEQ ID NO: 5541271 - DNA, 16 bp, Homo sapiens
tttctttgagttttaa

SEQ ID NO: 5541272 - DNA, 14 bp, Homo sapiens
tttctttgattttc

SEQ ID NO: 5541273 - DNA, 12 bp, Homo sapiens
tttctttggaaa

SEQ ID NO: 5541274 - DNA, 23 bp, Homo sapiens
tttctttgggaatatttgaatct

SEQ ID NO: 5541275 - DNA, 22 bp, Homo sapiens
tttctttgggggtggaaaagga

SEQ ID NO: 5541276 - DNA, 17 bp, Homo sapiens
tttctttggtgcctttc

SEQ ID NO: 5541277 - DNA, 13 bp, Homo sapiens
tttctttgtaaag

SEQ ID NO: 5541278 - DNA, 15 bp, Homo sapiens
tttctttgtaaaggt

SEQ ID NO: 5541279 - DNA, 17 bp, Homo sapiens
tttctttgtgataacaa

SEQ ID NO: 5541280 - DNA, 16 bp, Homo sapiens
tttctttgttatcaaa

SEQ ID NO: 5541281 - DNA, 13 bp, Homo sapiens
tttctttgtttct

SEQ ID NO: 5541282 - DNA, 19 bp, Homo sapiens
tttctttgtttctttcttt

SEQ ID NO: 5541283 - DNA, 13 bp, Homo sapiens
tttcttttaagca

SEQ ID NO: 5541284 - DNA, 17 bp, Homo sapiens
tttcttttacagactag

SEQ ID NO: 5541285 - DNA, 14 bp, Homo sapiens
tttcttttatacct

SEQ ID NO: 5541286 - DNA, 13 bp, Homo sapiens
tttcttttatata

SEQ ID NO: 5541287 - DNA, 18 bp, Homo sapiens
tttcttttatatataaaa

SEQ ID NO: 5541288 - DNA, 16 bp, Homo sapiens
tttcttttctctggta

SEQ ID NO: 5541289 - DNA, 22 bp, Homo sapiens
tttcttttctggaatgtaatca

SEQ ID NO: 5541290 - DNA, 15 bp, Homo sapiens
tttcttttcttttta

SEQ ID NO: 5541291 - DNA, 20 bp, Homo sapiens
tttcttttgaataatgtagt

SEQ ID NO: 5541292 - DNA, 20 bp, Homo sapiens
tttcttttgcaggagtttgt

SEQ ID NO: 5541293 - DNA, 14 bp, Homo sapiens
tttcttttgctgat

SEQ ID NO: 5541294 - DNA, 18 bp, Homo sapiens
tttcttttgctttccttt

SEQ ID NO: 5541295 - DNA, 23 bp, Homo sapiens
tttcttttggtaaagactggctt

SEQ ID NO: 5541296 - DNA, 16 bp, Homo sapiens
tttcttttgtaaatgt

SEQ ID NO: 5541297 - DNA, 19 bp, Homo sapiens
tttcttttgtaataaacta

SEQ ID NO: 5541298 - DNA, 15 bp, Homo sapiens
tttcttttgtattaa

SEQ ID NO: 5541299 - DNA, 17 bp, Homo sapiens
tttcttttgttactgtt

SEQ ID NO: 5541300 - DNA, 20 bp, Homo sapiens
tttcttttgttactgttctt

SEQ ID NO: 5541301 - DNA, 16 bp, Homo sapiens
tttcttttgttcttga

SEQ ID NO: 5541302 - DNA, 17 bp, Homo sapiens
tttctttttaagaaatt

SEQ ID NO: 5541303 - DNA, 13 bp, Homo sapiens
tttctttttaatt

SEQ ID NO: 5541304 - DNA, 20 bp, Homo sapiens
tttctttttaattattttaa

SEQ ID NO: 5541305 - DNA, 12 bp, Homo sapiens
tttctttttaca

SEQ ID NO: 5541306 - DNA, 15 bp, Homo sapiens
tttctttttactgtt

SEQ ID NO: 5541307 - DNA, 18 bp, Homo sapiens
tttctttttactgttgaa

SEQ ID NO: 5541308 - DNA, 18 bp, Homo sapiens
tttctttttattttaaat

SEQ ID NO: 5541309 - DNA, 17 bp, Homo sapiens
tttctttttatttttta

SEQ ID NO: 5541310 - DNA, 20 bp, Homo sapiens
tttctttttccttcataatt

SEQ ID NO: 5541311 - DNA, 15 bp, Homo sapiens
tttctttttctggaa

SEQ ID NO: 5541312 - DNA, 16 bp, Homo sapiens
tttctttttctggaaa

SEQ ID NO: 5541313 - DNA, 18 bp, Homo sapiens
tttctttttctgtctctc

SEQ ID NO: 5541314 - DNA, 14 bp, Homo sapiens
tttctttttcttct

SEQ ID NO: 5541315 - DNA, 13 bp, Homo sapiens
tttctttttgaat

SEQ ID NO: 5541316 - DNA, 16 bp, Homo sapiens
tttctttttgaatctt

SEQ ID NO: 5541317 - DNA, 18 bp, Homo sapiens
tttcttttttaaagtaaa

SEQ ID NO: 5541318 - DNA, 16 bp, Homo sapiens
tttcttttttaaatta

SEQ ID NO: 5541319 - DNA, 18 bp, Homo sapiens
tttcttttttaaattaat

SEQ ID NO: 5541320 - DNA, 19 bp, Homo sapiens
tttcttttttgagtgtgca

SEQ ID NO: 5541321 - DNA, 21 bp, Homo sapiens
tttctttttttaactggtgaa

SEQ ID NO: 5541322 - DNA, 18 bp, Homo sapiens
tttctttttttctttaat

SEQ ID NO: 5541323 - DNA, 15 bp, Homo sapiens
tttctttttttgcat

SEQ ID NO: 5541324 - DNA, 18 bp, Homo sapiens
tttcttttttttaataag

SEQ ID NO: 5541325 - DNA, 18 bp, Homo sapiens
tttctttttttttaagtt

SEQ ID NO: 5541326 - DNA, 22 bp, Homo sapiens
tttcttttttttttctgttgaa

SEQ ID NO: 5541327 - DNA, 21 bp, Homo sapiens
tttgaaaaaaaagtttttaat

SEQ ID NO: 5541328 - DNA, 21 bp, Homo sapiens
tttgaaaaaagctcatttcat

SEQ ID NO: 5541329 - DNA, 16 bp, Homo sapiens
tttgaaaaaattaaaa

SEQ ID NO: 5541330 - DNA, 22 bp, Homo sapiens
tttgaaaaagagaacagaaaac

SEQ ID NO: 5541331 - DNA, 23 bp, Homo sapiens
tttgaaaaagcgaaaaaatcagg

SEQ ID NO: 5541332 - DNA, 19 bp, Homo sapiens
tttgaaaaagctggtcttt

SEQ ID NO: 5541333 - DNA, 23 bp, Homo sapiens
tttgaaaaagtaggctgccgcca

SEQ ID NO: 5541334 - DNA, 23 bp, Homo sapiens
tttgaaaaagtgtacatgaagaa

SEQ ID NO: 5541335 - DNA, 13 bp, Homo sapiens
tttgaaaaatata

SEQ ID NO: 5541336 - DNA, 22 bp, Homo sapiens
tttgaaaaatattgctaaaagt

SEQ ID NO: 5541337 - DNA, 23 bp, Homo sapiens
tttgaaaaatattgctaaaagtg

SEQ ID NO: 5541338 - DNA, 22 bp, Homo sapiens
tttgaaaaattacctgtataat

SEQ ID NO: 5541339 - DNA, 16 bp, Homo sapiens
tttgaaaaattcctat

SEQ ID NO: 5541340 - DNA, 12 bp, Homo sapiens
tttgaaaacaaa

SEQ ID NO: 5541341 - DNA, 19 bp, Homo sapiens
tttgaaaacaattcagtgg

SEQ ID NO: 5541342 - DNA, 23 bp, Homo sapiens
tttgaaaacaccaagagtacagg

SEQ ID NO: 5541343 - DNA, 23 bp, Homo sapiens
tttgaaaacaccagctgtatata

SEQ ID NO: 5541344 - DNA, 19 bp, Homo sapiens
tttgaaaacatgtttattt

SEQ ID NO: 5541345 - DNA, 14 bp, Homo sapiens
tttgaaaactacat

SEQ ID NO: 5541346 - DNA, 14 bp, Homo sapiens
tttgaaaactcatc

SEQ ID NO: 5541347 - DNA, 13 bp, Homo sapiens
tttgaaaactgac

SEQ ID NO: 5541348 - DNA, 15 bp, Homo sapiens
tttgaaaactgacat

SEQ ID NO: 5541349 - DNA, 13 bp, Homo sapiens
tttgaaaagaaca

SEQ ID NO: 5541350 - DNA, 13 bp, Homo sapiens
tttgaaaagcaga

SEQ ID NO: 5541351 - DNA, 22 bp, Homo sapiens
tttgaaaagcccacataagttt

SEQ ID NO: 5541352 - DNA, 14 bp, Homo sapiens
tttgaaaagctatt

SEQ ID NO: 5541353 - DNA, 15 bp, Homo sapiens
tttgaaaagctatta

SEQ ID NO: 5541354 - DNA, 18 bp, Homo sapiens
tttgaaaagctattagcc

SEQ ID NO: 5541355 - DNA, 13 bp, Homo sapiens
tttgaaaagctga

SEQ ID NO: 5541356 - DNA, 20 bp, Homo sapiens
tttgaaaagctgactgtttt

SEQ ID NO: 5541357 - DNA, 22 bp, Homo sapiens
tttgaaaagcttcttaattaat

SEQ ID NO: 5541358 - DNA, 22 bp, Homo sapiens
tttgaaaagtaatatttattaa

SEQ ID NO: 5541359 - DNA, 16 bp, Homo sapiens
tttgaaaagtatcagg

SEQ ID NO: 5541360 - DNA, 15 bp, Homo sapiens
tttgaaaagttgaaa

SEQ ID NO: 5541361 - DNA, 17 bp, Homo sapiens
tttgaaaagttggaagg

SEQ ID NO: 5541362 - DNA, 14 bp, Homo sapiens
tttgaaaatagttt

SEQ ID NO: 5541363 - DNA, 15 bp, Homo sapiens
tttgaaaatagttta

SEQ ID NO: 5541364 - DNA, 18 bp, Homo sapiens
tttgaaaatatgtactgt

SEQ ID NO: 5541365 - DNA, 13 bp, Homo sapiens
tttgaaaatgtcc

SEQ ID NO: 5541366 - DNA, 22 bp, Homo sapiens
tttgaaaattacatgttttttc

SEQ ID NO: 5541367 - DNA, 16 bp, Homo sapiens
tttgaaaattgtatac

SEQ ID NO: 5541368 - DNA, 20 bp, Homo sapiens
tttgaaaattgtataccaat

SEQ ID NO: 5541369 - DNA, 15 bp, Homo sapiens
tttgaaacaaagaag

SEQ ID NO: 5541370 - DNA, 15 bp, Homo sapiens
tttgaaacaaagtac

SEQ ID NO: 5541371 - DNA, 20 bp, Homo sapiens
tttgaaacaaagtactcttt

SEQ ID NO: 5541372 - DNA, 17 bp, Homo sapiens
tttgaaacacaatacct

SEQ ID NO: 5541373 - DNA, 18 bp, Homo sapiens
tttgaaacacaataccta

SEQ ID NO: 5541374 - DNA, 22 bp, Homo sapiens
tttgaaacacacagtgaccaag

SEQ ID NO: 5541375 - DNA, 17 bp, Homo sapiens
tttgaaacactttgcat

SEQ ID NO: 5541376 - DNA, 18 bp, Homo sapiens
tttgaaacattgctttta

SEQ ID NO: 5541377 - DNA, 16 bp, Homo sapiens
tttgaaacccacagtt

SEQ ID NO: 5541378 - DNA, 14 bp, Homo sapiens
tttgcagacaggca

SEQ ID NO: 5541379 - DNA, 19 bp, Homo sapiens
tttgcagacctgggacttt

SEQ ID NO: 5541380 - DNA, 21 bp, Homo sapiens
tttgcagaggctatgggaaga

SEQ ID NO: 5541381 - DNA, 11 bp, Homo sapiens
tttgcagagta

SEQ ID NO: 5541382 - DNA, 14 bp, Homo sapiens
tttgcagatgaagt

SEQ ID NO: 5541383 - DNA, 21 bp, Homo sapiens
tttgcagatgttcaaatattg

SEQ ID NO: 5541384 - DNA, 18 bp, Homo sapiens
tttgcagatttatttagt

SEQ ID NO: 5541385 - DNA, 13 bp, Homo sapiens
tttgcagcagagg

SEQ ID NO: 5541386 - DNA, 16 bp, Homo sapiens
tttgcagcataccaat

SEQ ID NO: 5541387 - DNA, 14 bp, Homo sapiens
tttgcagctcagaa

SEQ ID NO: 5541388 - DNA, 22 bp, Homo sapiens
tttgcagctgcccagcccctcc

SEQ ID NO: 5541389 - DNA, 13 bp, Homo sapiens
tttgcagctgctg

SEQ ID NO: 5541390 - DNA, 18 bp, Homo sapiens
tttgcagctgctggtttt

SEQ ID NO: 5541391 - DNA, 14 bp, Homo sapiens
tttgcagctgcttt

SEQ ID NO: 5541392 - DNA, 15 bp, Homo sapiens
tttgcagcttccaat

SEQ ID NO: 5541393 - DNA, 11 bp, Homo sapiens
tttgcagcttt

SEQ ID NO: 5541394 - DNA, 12 bp, Homo sapiens
tttgcaggaaaa

SEQ ID NO: 5541395 - DNA, 22 bp, Homo sapiens
tttgcaggatctgtctgtgcac

SEQ ID NO: 5541396 - DNA, 20 bp, Homo sapiens
tttgcaggattcccttctgg

SEQ ID NO: 5541397 - DNA, 21 bp, Homo sapiens
tttgcaggatttttagagcat

SEQ ID NO: 5541398 - DNA, 13 bp, Homo sapiens
tttgcaggctctg

SEQ ID NO: 5541399 - DNA, 14 bp, Homo sapiens
tttgcaggctctgg

SEQ ID NO: 5541400 - DNA, 9 bp, Homo sapiens
tttgcagta

SEQ ID NO: 5541401 - DNA, 14 bp, Homo sapiens
tttgcagtaactgt

SEQ ID NO: 5541402 - DNA, 21 bp, Homo sapiens
tttgcagtagagtcatctcca

SEQ ID NO: 5541403 - DNA, 19 bp, Homo sapiens
tttgcagtgcagtatagaa

SEQ ID NO: 5541404 - DNA, 22 bp, Homo sapiens
tttgcagttggactctcaggga

SEQ ID NO: 5541405 - DNA, 22 bp, Homo sapiens
tttgcataacaattcctctact

SEQ ID NO: 5541406 - DNA, 18 bp, Homo sapiens
tttgcataacgtataaaa

SEQ ID NO: 5541407 - DNA, 19 bp, Homo sapiens
tttgcataacgtataaaag

SEQ ID NO: 5541408 - DNA, 23 bp, Homo sapiens
tttgcataacgtataaaagcctg

SEQ ID NO: 5541409 - DNA, 16 bp, Homo sapiens
tttgcataatactaat

SEQ ID NO: 5541410 - DNA, 16 bp, Homo sapiens
tttgcataatgcaatc

SEQ ID NO: 5541411 - DNA, 18 bp, Homo sapiens
tttgcatacattcttcaa

SEQ ID NO: 5541412 - DNA, 14 bp, Homo sapiens
tttgcatagaataa

SEQ ID NO: 5541413 - DNA, 16 bp, Homo sapiens
tttgcatagaataatg

SEQ ID NO: 5541414 - DNA, 23 bp, Homo sapiens
tttgcatagctctccttccccct

SEQ ID NO: 5541415 - DNA, 22 bp, Homo sapiens
tttgcataggtgatctcattta

SEQ ID NO: 5541416 - DNA, 11 bp, Homo sapiens
tttgcatatcc

SEQ ID NO: 5541417 - DNA, 21 bp, Homo sapiens
tttgcatattctctattttac

SEQ ID NO: 5541418 - DNA, 13 bp, Homo sapiens
tttgcatatttat

SEQ ID NO: 5541419 - DNA, 13 bp, Homo sapiens
tttgcatattttg

SEQ ID NO: 5541420 - DNA, 20 bp, Homo sapiens
tttgcatattttgagaaact

SEQ ID NO: 5541421 - DNA, 21 bp, Homo sapiens
tttgcatattttgagaaactg

SEQ ID NO: 5541422 - DNA, 20 bp, Homo sapiens
tttgcatcatttaactgaac

SEQ ID NO: 5541423 - DNA, 14 bp, Homo sapiens
tttgcatctgaccc

SEQ ID NO: 5541424 - DNA, 12 bp, Homo sapiens
tttgcatgaaat

SEQ ID NO: 5541425 - DNA, 17 bp, Homo sapiens
tttgcatgatatcttca

SEQ ID NO: 5541426 - DNA, 17 bp, Homo sapiens
tttgcatgcgcccgagg

SEQ ID NO: 5541427 - DNA, 18 bp, Homo sapiens
tttgcatggcacttgcat

SEQ ID NO: 5541428 - DNA, 20 bp, Homo sapiens
tttgcatggcacttgcatct

SEQ ID NO: 5541429 - DNA, 22 bp, Homo sapiens
tttgcatggcacttgcatctgt

SEQ ID NO: 5541430 - DNA, 23 bp, Homo sapiens
tttgcatggcacttgcatctgtg

SEQ ID NO: 5541431 - DNA, 18 bp, Homo sapiens
tttgcatgtcgcacaatg

SEQ ID NO: 5541432 - DNA, 21 bp, Homo sapiens
tttgcatgtctaattcattta

SEQ ID NO: 5541433 - DNA, 15 bp, Homo sapiens
tttgcatgttatgtt

SEQ ID NO: 5541434 - DNA, 13 bp, Homo sapiens
tttgcatgtttaa

SEQ ID NO: 5541435 - DNA, 17 bp, Homo sapiens
tttgcattaaattcaca

SEQ ID NO: 5541436 - DNA, 18 bp, Homo sapiens
tttgcattaatctaagaa

SEQ ID NO: 5541437 - DNA, 16 bp, Homo sapiens
tttgcattactctggt

SEQ ID NO: 5541438 - DNA, 18 bp, Homo sapiens
tttgcattatgtatttat

SEQ ID NO: 5541439 - DNA, 21 bp, Homo sapiens
tttgcattatgtatttataat

SEQ ID NO: 5541440 - DNA, 17 bp, Homo sapiens
tttgcattcaaattaag

SEQ ID NO: 5541441 - DNA, 14 bp, Homo sapiens
tttgcattccagaa

SEQ ID NO: 5541442 - DNA, 20 bp, Homo sapiens
tttgcattccagcgtctgct

SEQ ID NO: 5541443 - DNA, 18 bp, Homo sapiens
tttgcattcttattcatc

SEQ ID NO: 5541444 - DNA, 12 bp, Homo sapiens
tttgcattgcca

SEQ ID NO: 5541445 - DNA, 21 bp, Homo sapiens
tttgcatttacgcctgtaaat

SEQ ID NO: 5541446 - DNA, 17 bp, Homo sapiens
tttgcatttagttttat

SEQ ID NO: 5541447 - DNA, 21 bp, Homo sapiens
tttgcatttcagaaagccttt

SEQ ID NO: 5541448 - DNA, 14 bp, Homo sapiens
tttgcatttcatgc

SEQ ID NO: 5541449 - DNA, 14 bp, Homo sapiens
tttgcatttctttc

SEQ ID NO: 5541450 - DNA, 14 bp, Homo sapiens
tttgcatttggaat

SEQ ID NO: 5541451 - DNA, 15 bp, Homo sapiens
tttgcattttcacaa

SEQ ID NO: 5541452 - DNA, 18 bp, Homo sapiens
tttgcattttttaaattt

SEQ ID NO: 5541453 - DNA, 20 bp, Homo sapiens
tttgccaagccctttgctgt

SEQ ID NO: 5541454 - DNA, 22 bp, Homo sapiens
tttgccaagcttgtgagagctg

SEQ ID NO: 5541455 - DNA, 17 bp, Homo sapiens
tttgccaaggcaaaaaa

SEQ ID NO: 5541456 - DNA, 15 bp, Homo sapiens
tttgccaataaagct

SEQ ID NO: 5541457 - DNA, 14 bp, Homo sapiens
tttgccacaaagaa

SEQ ID NO: 5541458 - DNA, 18 bp, Homo sapiens
tttgccacaaagaagatt

SEQ ID NO: 5541459 - DNA, 20 bp, Homo sapiens
tttgccacctttcctgttca

SEQ ID NO: 5541460 - DNA, 18 bp, Homo sapiens
tttgccactaattttagt

SEQ ID NO: 5541461 - DNA, 15 bp, Homo sapiens
tttgccactgcaaac

SEQ ID NO: 5541462 - DNA, 14 bp, Homo sapiens
tttgccactgctgt

SEQ ID NO: 5541463 - DNA, 21 bp, Homo sapiens
tttgccagaacagtttgtaca

SEQ ID NO: 5541464 - DNA, 12 bp, Homo sapiens
tttgccagcaga

SEQ ID NO: 5541465 - DNA, 19 bp, Homo sapiens
tttgccagcagagccaggg

SEQ ID NO: 5541466 - DNA, 14 bp, Homo sapiens
tttgccagctgctg

SEQ ID NO: 5541467 - DNA, 16 bp, Homo sapiens
tttgccagtgaagact

SEQ ID NO: 5541468 - DNA, 18 bp, Homo sapiens
tttgccatctctgctcca

SEQ ID NO: 5541469 - DNA, 21 bp, Homo sapiens
tttgccatgacatttcatctg

SEQ ID NO: 5541470 - DNA, 22 bp, Homo sapiens
tttgccatgacatttcatctgg

SEQ ID NO: 5541471 - DNA, 14 bp, Homo sapiens
tttgccatgctgct

SEQ ID NO: 5541472 - DNA, 20 bp, Homo sapiens
tttgccatgtgcttctgcca

SEQ ID NO: 5541473 - DNA, 18 bp, Homo sapiens
tttgccatgttggccagg

SEQ ID NO: 5541474 - DNA, 11 bp, Homo sapiens
tttgccatttg

SEQ ID NO: 5541475 - DNA, 12 bp, Homo sapiens
tttgccatttga

SEQ ID NO: 5541476 - DNA, 23 bp, Homo sapiens
tttgccatttttattagaaattt

SEQ ID NO: 5541477 - DNA, 16 bp, Homo sapiens
tttgcccaacctcagc

SEQ ID NO: 5541478 - DNA, 21 bp, Homo sapiens
tttgcccagggtcctgtgcct

SEQ ID NO: 5541479 - DNA, 16 bp, Homo sapiens
tttgcccagtcctggg

SEQ ID NO: 5541480 - DNA, 17 bp, Homo sapiens
tttgccccaagtcctca

SEQ ID NO: 5541481 - DNA, 16 bp, Homo sapiens
tttgccccctcccttc

SEQ ID NO: 5541482 - DNA, 23 bp, Homo sapiens
tttgccccgggatattatagaaa

SEQ ID NO: 5541483 - DNA, 16 bp, Homo sapiens
tttgcccctggcaaat

SEQ ID NO: 5541484 - DNA, 18 bp, Homo sapiens
tttgcccgttgaccagat

SEQ ID NO: 5541485 - DNA, 13 bp, Homo sapiens
tttgccctcccat

SEQ ID NO: 5541486 - DNA, 13 bp, Homo sapiens
tttgccctgaggc

SEQ ID NO: 5541487 - DNA, 19 bp, Homo sapiens
tttgccctgcgtcccttct

SEQ ID NO: 5541488 - DNA, 21 bp, Homo sapiens
tttgccctgctgccctccccc

SEQ ID NO: 5541489 - DNA, 19 bp, Homo sapiens
tttgccctggtttcactgg

SEQ ID NO: 5541490 - DNA, 21 bp, Homo sapiens
tttgccctgtggattccagca

SEQ ID NO: 5541491 - DNA, 21 bp, Homo sapiens
tttgcccttcaggacccttct

SEQ ID NO: 5541492 - DNA, 23 bp, Homo sapiens
tttgcccttcaggacccttctac

SEQ ID NO: 5541493 - DNA, 13 bp, Homo sapiens
tttgcccttctgg

SEQ ID NO: 5541494 - DNA, 13 bp, Homo sapiens
tttgccctttact

SEQ ID NO: 5541495 - DNA, 23 bp, Homo sapiens
tttgccctttacttgtctttctg

SEQ ID NO: 5541496 - DNA, 22 bp, Homo sapiens
tttgcctaatacattaaagcag

SEQ ID NO: 5541497 - DNA, 18 bp, Homo sapiens
tttgcctatctttaaaca

SEQ ID NO: 5541498 - DNA, 10 bp, Homo sapiens
tttgcctcaa

SEQ ID NO: 5541499 - DNA, 23 bp, Homo sapiens
tttgcctcaactccaggatttag

SEQ ID NO: 5541500 - DNA, 17 bp, Homo sapiens
tttgcctcaccttgggg

SEQ ID NO: 5541501 - DNA, 13 bp, Homo sapiens
tttgcctcctgga

SEQ ID NO: 5541502 - DNA, 18 bp, Homo sapiens
tttgcctcgaaagtgtca

SEQ ID NO: 5541503 - DNA, 18 bp, Homo sapiens
tttgcctctgcccttggg

SEQ ID NO: 5541504 - DNA, 21 bp, Homo sapiens
tttgcctctgctactgaggca

SEQ ID NO: 5541505 - DNA, 13 bp, Homo sapiens
tttgcctctgtcc

SEQ ID NO: 5541506 - DNA, 14 bp, Homo sapiens
tttgcctgagggcg

SEQ ID NO: 5541507 - DNA, 20 bp, Homo sapiens
tttgcctgcaagagaatctg

SEQ ID NO: 5541508 - DNA, 20 bp, Homo sapiens
tttgcctgcctgggcctccc

SEQ ID NO: 5541509 - DNA, 19 bp, Homo sapiens
tttgcctgcctggtgtgcc

SEQ ID NO: 5541510 - DNA, 12 bp, Homo sapiens
tttgcctggctg

SEQ ID NO: 5541511 - DNA, 18 bp, Homo sapiens
tttgcctggttttgtctt

SEQ ID NO: 5541512 - DNA, 12 bp, Homo sapiens
tttgcctgtaac

SEQ ID NO: 5541513 - DNA, 14 bp, Homo sapiens
tttgcctgtaacaa

SEQ ID NO: 5541514 - DNA, 22 bp, Homo sapiens
tttgcctgtgtgagcatctctg

SEQ ID NO: 5541515 - DNA, 14 bp, Homo sapiens
tttgcctgttcagt

SEQ ID NO: 5541516 - DNA, 19 bp, Homo sapiens
tttgcctgttcagttacag

SEQ ID NO: 5541517 - DNA, 23 bp, Homo sapiens
tttgcctgttcagttacagaaag

SEQ ID NO: 5541518 - DNA, 16 bp, Homo sapiens
tttgccttaattctta

SEQ ID NO: 5541519 - DNA, 19 bp, Homo sapiens
tttgccttaggaagtgact

SEQ ID NO: 5541520 - DNA, 20 bp, Homo sapiens
tttgccttaggaagtgactt

SEQ ID NO: 5541521 - DNA, 15 bp, Homo sapiens
tttgccttctactcc

SEQ ID NO: 5541522 - DNA, 15 bp, Homo sapiens
tttgccttctggtta

SEQ ID NO: 5541523 - DNA, 22 bp, Homo sapiens
tttgccttctggttatttatgg

SEQ ID NO: 5541524 - DNA, 19 bp, Homo sapiens
tttgccttgcagaactgcc

SEQ ID NO: 5541525 - DNA, 14 bp, Homo sapiens
tttgcctttaacag

SEQ ID NO: 5541526 - DNA, 19 bp, Homo sapiens
tttgcctttaggcaggaag

SEQ ID NO: 5541527 - DNA, 11 bp, Homo sapiens
tttgcctttct

SEQ ID NO: 5541528 - DNA, 22 bp, Homo sapiens
tttgcctttctgggagcagaaa

SEQ ID NO: 5541529 - DNA, 17 bp, Homo sapiens
tttgccttttcaaatca

SEQ ID NO: 5541530 - DNA, 16 bp, Homo sapiens
tttgcgaaaagataaa

SEQ ID NO: 5541531 - DNA, 22 bp, Homo sapiens
tttgcgaatattttgtaaatta

SEQ ID NO: 5541532 - DNA, 15 bp, Homo sapiens
tttgcgcaaacttta

SEQ ID NO: 5541533 - DNA, 15 bp, Homo sapiens
tttgcgcctcggtat

SEQ ID NO: 5541534 - DNA, 13 bp, Homo sapiens
tttgcgctgctaa

SEQ ID NO: 5541535 - DNA, 20 bp, Homo sapiens
tttgcgcttatttggaaatt

SEQ ID NO: 5541536 - DNA, 20 bp, Homo sapiens
tttgcggggcctgtctcagt

SEQ ID NO: 5541537 - DNA, 22 bp, Homo sapiens
tttgcggggcctgtctcagtga

SEQ ID NO: 5541538 - DNA, 16 bp, Homo sapiens
tttgcggggcttttaa

SEQ ID NO: 5541539 - DNA, 23 bp, Homo sapiens
tttgcggggcttttaaaaggaaa

SEQ ID NO: 5541540 - DNA, 23 bp, Homo sapiens
tttgcgtaaatggttttcaacaa

SEQ ID NO: 5541541 - DNA, 17 bp, Homo sapiens
tttgcgtgcccggggca

SEQ ID NO: 5541542 - DNA, 19 bp, Homo sapiens
tttgcgtggaaatctcaga

SEQ ID NO: 5541543 - DNA, 23 bp, Homo sapiens
tttgcgtggatcaagcttgtgta

SEQ ID NO: 5541544 - DNA, 19 bp, Homo sapiens
tttgcgtgggagtgtgtgc

SEQ ID NO: 5541545 - DNA, 17 bp, Homo sapiens
tttgctaaaagaagaga

SEQ ID NO: 5541546 - DNA, 13 bp, Homo sapiens
tttgctaaataca

SEQ ID NO: 5541547 - DNA, 22 bp, Homo sapiens
tttgctaactagcttggaaact

SEQ ID NO: 5541548 - DNA, 19 bp, Homo sapiens
tttgctaagcattccaact

SEQ ID NO: 5541549 - DNA, 21 bp, Homo sapiens
tttgctaagtaaatctcttct

SEQ ID NO: 5541550 - DNA, 23 bp, Homo sapiens
tttgctaataccaactatttcaa

SEQ ID NO: 5541551 - DNA, 13 bp, Homo sapiens
tttgctaatgaat

SEQ ID NO: 5541552 - DNA, 18 bp, Homo sapiens
tttgctaatgtataatgt

SEQ ID NO: 5541553 - DNA, 13 bp, Homo sapiens
tttgctaattaaa

SEQ ID NO: 5541554 - DNA, 14 bp, Homo sapiens
tttgctaattaaaa

SEQ ID NO: 5541555 - DNA, 14 bp, Homo sapiens
tttgctaattttta

SEQ ID NO: 5541556 - DNA, 13 bp, Homo sapiens
tttgtaagtgtaa

SEQ ID NO: 5541557 - DNA, 15 bp, Homo sapiens
tttgtaataaactct

SEQ ID NO: 5541558 - DNA, 15 bp, Homo sapiens
tttgtaataacattt

SEQ ID NO: 5541559 - DNA, 16 bp, Homo sapiens
tttgtaataacattta

SEQ ID NO: 5541560 - DNA, 18 bp, Homo sapiens
tttgtaataacatttaat

SEQ ID NO: 5541561 - DNA, 19 bp, Homo sapiens
tttgtaataacatttaatt

SEQ ID NO: 5541562 - DNA, 20 bp, Homo sapiens
tttgtaataacatttaattt

SEQ ID NO: 5541563 - DNA, 23 bp, Homo sapiens
tttgtaataagcaatcaaggtta

SEQ ID NO: 5541564 - DNA, 21 bp, Homo sapiens
tttgtaataataaagaatagc

SEQ ID NO: 5541565 - DNA, 13 bp, Homo sapiens
tttgtaatacttt

SEQ ID NO: 5541566 - DNA, 16 bp, Homo sapiens
tttgtaatatgagaat

SEQ ID NO: 5541567 - DNA, 15 bp, Homo sapiens
tttgtaatattttcc

SEQ ID NO: 5541568 - DNA, 16 bp, Homo sapiens
tttgtaatattttcca

SEQ ID NO: 5541569 - DNA, 21 bp, Homo sapiens
tttgtaatcactcccattttt

SEQ ID NO: 5541570 - DNA, 11 bp, Homo sapiens
tttgtaatcat

SEQ ID NO: 5541571 - DNA, 22 bp, Homo sapiens
tttgtaatctagttgtcaataa

SEQ ID NO: 5541572 - DNA, 14 bp, Homo sapiens
tttgtaatgaaaac

SEQ ID NO: 5541573 - DNA, 17 bp, Homo sapiens
tttgtaatgcactgttt

SEQ ID NO: 5541574 - DNA, 13 bp, Homo sapiens
tttgtaatggtgc

SEQ ID NO: 5541575 - DNA, 18 bp, Homo sapiens
tttgtaatgtatcttatt

SEQ ID NO: 5541576 - DNA, 18 bp, Homo sapiens
tttgtaatgtgtgaaaaa

SEQ ID NO: 5541577 - DNA, 22 bp, Homo sapiens
tttgtaattaaaagcaaatcat

SEQ ID NO: 5541578 - DNA, 23 bp, Homo sapiens
tttgtaattaaaagcaaatcatt

SEQ ID NO: 5541579 - DNA, 13 bp, Homo sapiens
tttgtaattctta

SEQ ID NO: 5541580 - DNA, 14 bp, Homo sapiens
tttgtaattgtgta

SEQ ID NO: 5541581 - DNA, 14 bp, Homo sapiens
tttgtaatttgaat

SEQ ID NO: 5541582 - DNA, 15 bp, Homo sapiens
tttgtaatttgaatt

SEQ ID NO: 5541583 - DNA, 17 bp, Homo sapiens
tttgtaatttgaattgg

SEQ ID NO: 5541584 - DNA, 20 bp, Homo sapiens
tttgtaatttttggggaaaa

SEQ ID NO: 5541585 - DNA, 16 bp, Homo sapiens
tttgtaatttttttat

SEQ ID NO: 5541586 - DNA, 19 bp, Homo sapiens
tttgtaatttttttctagt

SEQ ID NO: 5541587 - DNA, 23 bp, Homo sapiens
tttgtacaaaaaaaaagttttat

SEQ ID NO: 5541588 - DNA, 21 bp, Homo sapiens
tttgtacaaactatttcagaa

SEQ ID NO: 5541589 - DNA, 13 bp, Homo sapiens
tttgtacaaataa

SEQ ID NO: 5541590 - DNA, 19 bp, Homo sapiens
tttgtacaattttaaagtt

SEQ ID NO: 5541591 - DNA, 24 bp, Homo sapiens
tttgtacacaacacctaaaaccag

SEQ ID NO: 5541592 - DNA, 14 bp, Homo sapiens
tttgtacactgctg

SEQ ID NO: 5541593 - DNA, 12 bp, Homo sapiens
tttgtacactta

SEQ ID NO: 5541594 - DNA, 10 bp, Homo sapiens
tttgtacaga

SEQ ID NO: 5541595 - DNA, 14 bp, Homo sapiens
tttgtacagacaac

SEQ ID NO: 5541596 - DNA, 19 bp, Homo sapiens
tttgtacagacgtatgctt

SEQ ID NO: 5541597 - DNA, 22 bp, Homo sapiens
tttgtacaggggccatgcccca

SEQ ID NO: 5541598 - DNA, 13 bp, Homo sapiens
tttgtacataaat

SEQ ID NO: 5541599 - DNA, 20 bp, Homo sapiens
tttgtacatatcaaatagat

SEQ ID NO: 5541600 - DNA, 20 bp, Homo sapiens
tttgtacatgccattgaaaa

SEQ ID NO: 5541601 - DNA, 11 bp, Homo sapiens
tttgtacatgt

SEQ ID NO: 5541602 - DNA, 16 bp, Homo sapiens
tttgtacattacacta

SEQ ID NO: 5541603 - DNA, 19 bp, Homo sapiens
tttgtacattacactaaat

SEQ ID NO: 5541604 - DNA, 21 bp, Homo sapiens
tttgtacattacactaaatta

SEQ ID NO: 5541605 - DNA, 13 bp, Homo sapiens
tttgtacattatg

SEQ ID NO: 5541606 - DNA, 14 bp, Homo sapiens
tttgtacattgtgc

SEQ ID NO: 5541607 - DNA, 12 bp, Homo sapiens
tttgtacatttg

SEQ ID NO: 5541608 - DNA, 17 bp, Homo sapiens
tttgtaccagtgaattt

SEQ ID NO: 5541609 - DNA, 23 bp, Homo sapiens
tttgtaccagtgaatttttgcaa

SEQ ID NO: 5541610 - DNA, 14 bp, Homo sapiens
tttgtaccatattg

SEQ ID NO: 5541611 - DNA, 23 bp, Homo sapiens
tttgtaccattccttcaaataaa

SEQ ID NO: 5541612 - DNA, 19 bp, Homo sapiens
tttgtaccattttaaagtt

SEQ ID NO: 5541613 - DNA, 19 bp, Homo sapiens
tttgtaccccccaacccct

SEQ ID NO: 5541614 - DNA, 21 bp, Homo sapiens
tttgtaccctgaagtgttttt

SEQ ID NO: 5541615 - DNA, 20 bp, Homo sapiens
tttgtacgacgtcagatgtt

SEQ ID NO: 5541616 - DNA, 20 bp, Homo sapiens
tttgtacgttaattaaacaa

SEQ ID NO: 5541617 - DNA, 15 bp, Homo sapiens
tttgtactgaatttt

SEQ ID NO: 5541618 - DNA, 17 bp, Homo sapiens
tttgtactggttcattg

SEQ ID NO: 5541619 - DNA, 13 bp, Homo sapiens
tttgtactgtaaa

SEQ ID NO: 5541620 - DNA, 23 bp, Homo sapiens
tttgtactgtatctattcttctg

SEQ ID NO: 5541621 - DNA, 14 bp, Homo sapiens
tttgtactgtgctg

SEQ ID NO: 5541622 - DNA, 23 bp, Homo sapiens
tttgtacttgctccttttgctct

SEQ ID NO: 5541623 - DNA, 20 bp, Homo sapiens
tttgtactttatcatgaatg

SEQ ID NO: 5541624 - DNA, 13 bp, Homo sapiens
tttgtacttttag

SEQ ID NO: 5541625 - DNA, 14 bp, Homo sapiens
tttgtacttttagt

SEQ ID NO: 5541626 - DNA, 18 bp, Homo sapiens
tttgtacttttctggttc

SEQ ID NO: 5541627 - DNA, 17 bp, Homo sapiens
tttgtagaataaatggt

SEQ ID NO: 5541628 - DNA, 11 bp, Homo sapiens
tttgtagacat

SEQ ID NO: 5541629 - DNA, 16 bp, Homo sapiens
tttgtagacattttga

SEQ ID NO: 5541630 - DNA, 15 bp, Homo sapiens
tttgtagagacaggg

SEQ ID NO: 5541631 - DNA, 20 bp, Homo sapiens
tttgtagatatatatttcca

SEQ ID NO: 5541632 - DNA, 16 bp, Homo sapiens
tttgtagatgaacttg

SEQ ID NO: 5541633 - DNA, 18 bp, Homo sapiens
tttgtagatgtattttca

SEQ ID NO: 5541634 - DNA, 19 bp, Homo sapiens
tttgtagattaggattaaa

SEQ ID NO: 5541635 - DNA, 15 bp, Homo sapiens
tttgtagcaaccatt

SEQ ID NO: 5541636 - DNA, 18 bp, Homo sapiens
tttgtagcaaccatttgt

SEQ ID NO: 5541637 - DNA, 17 bp, Homo sapiens
tttgtagcactgacaga

SEQ ID NO: 5541638 - DNA, 10 bp, Homo sapiens
tttgtagcat

SEQ ID NO: 5541639 - DNA, 18 bp, Homo sapiens
tttgtagcatttttctaa

SEQ ID NO: 5541640 - DNA, 20 bp, Homo sapiens
tttgtagccatcctgttaaa

SEQ ID NO: 5541641 - DNA, 19 bp, Homo sapiens
tttgtagcctctctttgtt

SEQ ID NO: 5541642 - DNA, 23 bp, Homo sapiens
tttgtagctagtttaaaattatt

SEQ ID NO: 5541643 - DNA, 20 bp, Homo sapiens
tttgtagctggggctttgat

SEQ ID NO: 5541644 - DNA, 16 bp, Homo sapiens
tttgtagctgtcatgg

SEQ ID NO: 5541645 - DNA, 22 bp, Homo sapiens
tttgtagcttaaaaaaaggaaa

SEQ ID NO: 5541646 - DNA, 18 bp, Homo sapiens
tttgtaggaagcattttt

SEQ ID NO: 5541647 - DNA, 16 bp, Homo sapiens
tttgtaggctgttccc

SEQ ID NO: 5541648 - DNA, 20 bp, Homo sapiens
tttgtaggctgttccctttg

SEQ ID NO: 5541649 - DNA, 15 bp, Homo sapiens
tttgtagggtttcta

SEQ ID NO: 5541650 - DNA, 14 bp, Homo sapiens
tttgtaggtaaaat

SEQ ID NO: 5541651 - DNA, 14 bp, Homo sapiens
tttgtaggtacttt

SEQ ID NO: 5541652 - DNA, 16 bp, Homo sapiens
tttgtaggtatactat

SEQ ID NO: 5541653 - DNA, 15 bp, Homo sapiens
tttgtaggttatttt

SEQ ID NO: 5541654 - DNA, 16 bp, Homo sapiens
tttgtagtaaaagtgg

SEQ ID NO: 5541655 - DNA, 23 bp, Homo sapiens
tttgtagtaaaagtggtctctgc

SEQ ID NO: 5541656 - DNA, 15 bp, Homo sapiens
tttgtagtagcgttt

SEQ ID NO: 5541657 - DNA, 19 bp, Homo sapiens
tttgtagtagcgtttttta

SEQ ID NO: 5541658 - DNA, 17 bp, Homo sapiens
tttgtagtagttgatga

SEQ ID NO: 5541659 - DNA, 16 bp, Homo sapiens
tttgtagtcttaactt

SEQ ID NO: 5541660 - DNA, 16 bp, Homo sapiens
tttgtagtgaaataat

SEQ ID NO: 5541661 - DNA, 18 bp, Homo sapiens
tttgtagtgaaataatag

SEQ ID NO: 5541662 - DNA, 15 bp, Homo sapiens
tttgtagtgattttt

SEQ ID NO: 5541663 - DNA, 17 bp, Homo sapiens
tttgtagtgttggagaa

SEQ ID NO: 5541664 - DNA, 17 bp, Homo sapiens
tttgtagtttgcccaga

SEQ ID NO: 5541665 - DNA, 12 bp, Homo sapiens
tttgtagttttt

SEQ ID NO: 5541666 - DNA, 18 bp, Homo sapiens
tttgtataaaaaggaaat

SEQ ID NO: 5541667 - DNA, 12 bp, Homo sapiens
tttgtataaaag

SEQ ID NO: 5541668 - DNA, 16 bp, Homo sapiens
tttgtataaaatctga

SEQ ID NO: 5541669 - DNA, 17 bp, Homo sapiens
tttgtataaaatctgaa

SEQ ID NO: 5541670 - DNA, 17 bp, Homo sapiens
tttgtataaagaaactg

SEQ ID NO: 5541671 - DNA, 23 bp, Homo sapiens
tttgtataaatgacaaagtgttg

SEQ ID NO: 5541672 - DNA, 16 bp, Homo sapiens
tttgtataaattttta

SEQ ID NO: 5541673 - DNA, 12 bp, Homo sapiens
tttgtataactt

SEQ ID NO: 5541674 - DNA, 19 bp, Homo sapiens
tttgtataacttcttaaaa

SEQ ID NO: 5541675 - DNA, 19 bp, Homo sapiens
tttgtataacttttgatga

SEQ ID NO: 5541676 - DNA, 21 bp, Homo sapiens
tttgtataattggatttccta

SEQ ID NO: 5541677 - DNA, 14 bp, Homo sapiens
tttgtatacaaata

SEQ ID NO: 5541678 - DNA, 14 bp, Homo sapiens
tttgtatacaagta

SEQ ID NO: 5541679 - DNA, 19 bp, Homo sapiens
tttgtatacatcctgggta

SEQ ID NO: 5541680 - DNA, 21 bp, Homo sapiens
tttgtataggagccccaggca

SEQ ID NO: 5541681 - DNA, 19 bp, Homo sapiens
tttgtatagtgtaaactga

SEQ ID NO: 5541682 - DNA, 16 bp, Homo sapiens
tttgtatagttatgta

SEQ ID NO: 5541683 - DNA, 19 bp, Homo sapiens
tttgtatagttatgtaaat

SEQ ID NO: 5541684 - DNA, 21 bp, Homo sapiens
tttgtatagttgcttgcctga

SEQ ID NO: 5541685 - DNA, 15 bp, Homo sapiens
tttgtatatacagtt

SEQ ID NO: 5541686 - DNA, 19 bp, Homo sapiens
tttgtatatatacataaca

SEQ ID NO: 5541687 - DNA, 20 bp, Homo sapiens
tttgtatatattttatatgt

SEQ ID NO: 5541688 - DNA, 14 bp, Homo sapiens
tttgtatatcatga

SEQ ID NO: 5541689 - DNA, 16 bp, Homo sapiens
tttgtatatgctgcat

SEQ ID NO: 5541690 - DNA, 21 bp, Homo sapiens
tttgtatattaaaatagcata

SEQ ID NO: 5541691 - DNA, 18 bp, Homo sapiens
tttgtatattggttttat

SEQ ID NO: 5541692 - DNA, 20 bp, Homo sapiens
tttgtatattggttttatga

SEQ ID NO: 5541693 - DNA, 16 bp, Homo sapiens
tttgtatattgtagga

SEQ ID NO: 5541694 - DNA, 17 bp, Homo sapiens
tttgtatatttgcaaac

SEQ ID NO: 5541695 - DNA, 23 bp, Homo sapiens
tttgtatcggagggaaacagaag

SEQ ID NO: 5541696 - DNA, 21 bp, Homo sapiens
tttgtatctctgaagcatgtt

SEQ ID NO: 5541697 - DNA, 15 bp, Homo sapiens
tttgtatcttaaatc

SEQ ID NO: 5541698 - DNA, 12 bp, Homo sapiens
tttgtatctttc

SEQ ID NO: 5541699 - DNA, 12 bp, Homo sapiens
tttgtatgaaat

SEQ ID NO: 5541700 - DNA, 19 bp, Homo sapiens
tttgtatgaaatatatgtg

SEQ ID NO: 5541701 - DNA, 18 bp, Homo sapiens
tttgtatgaaattataat

SEQ ID NO: 5541702 - DNA, 16 bp, Homo sapiens
tttgtatgaagtactt

SEQ ID NO: 5541703 - DNA, 14 bp, Homo sapiens
tttgtatgagatgg

SEQ ID NO: 5541704 - DNA, 13 bp, Homo sapiens
tttgtatgatatt

SEQ ID NO: 5541705 - DNA, 13 bp, Homo sapiens
tttgtatgatgta

SEQ ID NO: 5541706 - DNA, 21 bp, Homo sapiens
tttgtatgcaagcagtttcaa

SEQ ID NO: 5541707 - DNA, 23 bp, Homo sapiens
tttgtatgcaagcagtttcaata

SEQ ID NO: 5541708 - DNA, 16 bp, Homo sapiens
tttgtatgcactttgt

SEQ ID NO: 5541709 - DNA, 15 bp, Homo sapiens
tttgtatgtatgtgt

SEQ ID NO: 5541710 - DNA, 13 bp, Homo sapiens
tttgtatgtatta

SEQ ID NO: 5541711 - DNA, 18 bp, Homo sapiens
tttgtatgtcaataactt

SEQ ID NO: 5541712 - DNA, 14 bp, Homo sapiens
tttgtatgtctgtg

SEQ ID NO: 5541713 - DNA, 17 bp, Homo sapiens
tttgtatgtctgtgtat

SEQ ID NO: 5541714 - DNA, 14 bp, Homo sapiens
tttgtatgtgaaca

SEQ ID NO: 5541715 - DNA, 15 bp, Homo sapiens
tttgtatgtgtgggt

SEQ ID NO: 5541716 - DNA, 16 bp, Homo sapiens
tttgtattaaacttga

SEQ ID NO: 5541717 - DNA, 17 bp, Homo sapiens
tttgtattactttctct

SEQ ID NO: 5541718 - DNA, 14 bp, Homo sapiens
tttgtattataaaa

SEQ ID NO: 5541719 - DNA, 15 bp, Homo sapiens
tttgtattataattg

SEQ ID NO: 5541720 - DNA, 16 bp, Homo sapiens
tttgtattataattgt

SEQ ID NO: 5541721 - DNA, 23 bp, Homo sapiens
tttgtattataattgttgatatt

SEQ ID NO: 5541722 - DNA, 16 bp, Homo sapiens
tttgtattattacaaa

SEQ ID NO: 5541723 - DNA, 18 bp, Homo sapiens
tttgtattattacaaata

SEQ ID NO: 5541724 - DNA, 15 bp, Homo sapiens
tttgtattattgctg

SEQ ID NO: 5541725 - DNA, 22 bp, Homo sapiens
tttgtattcccttttatttcca

SEQ ID NO: 5541726 - DNA, 12 bp, Homo sapiens
tttgtattctgt

SEQ ID NO: 5541727 - DNA, 13 bp, Homo sapiens
tttgtattcttca

SEQ ID NO: 5541728 - DNA, 12 bp, Homo sapiens
tttgtattgctt

SEQ ID NO: 5541729 - DNA, 16 bp, Homo sapiens
tttgtattgcttcctg

SEQ ID NO: 5541730 - DNA, 22 bp, Homo sapiens
tttgtattgcttcctgattacc

SEQ ID NO: 5541731 - DNA, 17 bp, Homo sapiens
tttgtatttaaaacctt

SEQ ID NO: 5541732 - DNA, 23 bp, Homo sapiens
tttgtatttaatgatttttgtgt

SEQ ID NO: 5541733 - DNA, 10 bp, Homo sapiens
tttgtatttt

SEQ ID NO: 5541734 - DNA, 23 bp, Homo sapiens
tttgtattttatttttttctctc

SEQ ID NO: 5541735 - DNA, 14 bp, Homo sapiens
tttgttgttttctg

SEQ ID NO: 5541736 - DNA, 18 bp, Homo sapiens
tttgttgttttctggggg

SEQ ID NO: 5541737 - DNA, 14 bp, Homo sapiens
tttgtttaaaaagg

SEQ ID NO: 5541738 - DNA, 18 bp, Homo sapiens
tttgtttaaaattctctt

SEQ ID NO: 5541739 - DNA, 13 bp, Homo sapiens
tttgtttaaagaa

SEQ ID NO: 5541740 - DNA, 17 bp, Homo sapiens
tttgtttaaagaataaa

SEQ ID NO: 5541741 - DNA, 14 bp, Homo sapiens
tttgtttaactttt

SEQ ID NO: 5541742 - DNA, 15 bp, Homo sapiens
tttgtttaaggttaa

SEQ ID NO: 5541743 - DNA, 21 bp, Homo sapiens
tttgtttaataccctgtacat

SEQ ID NO: 5541744 - DNA, 12 bp, Homo sapiens
tttgtttacaca

SEQ ID NO: 5541745 - DNA, 19 bp, Homo sapiens
tttgtttagaaaaaaaact

SEQ ID NO: 5541746 - DNA, 13 bp, Homo sapiens
tttgtttatgcac

SEQ ID NO: 5541747 - DNA, 13 bp, Homo sapiens
tttgtttatgcat

SEQ ID NO: 5541748 - DNA, 14 bp, Homo sapiens
tttgtttatgcata

SEQ ID NO: 5541749 - DNA, 21 bp, Homo sapiens
tttgtttatggtaaaaaattt

SEQ ID NO: 5541750 - DNA, 21 bp, Homo sapiens
tttgtttatgttacttaaaca

SEQ ID NO: 5541751 - DNA, 17 bp, Homo sapiens
tttgtttattaaatagt

SEQ ID NO: 5541752 - DNA, 18 bp, Homo sapiens
tttgtttcaacccaactg

SEQ ID NO: 5541753 - DNA, 17 bp, Homo sapiens
tttgtttcaatgaggtg

SEQ ID NO: 5541754 - DNA, 19 bp, Homo sapiens
tttgtttcactctttccag

SEQ ID NO: 5541755 - DNA, 13 bp, Homo sapiens
tttgtttcacttt

SEQ ID NO: 5541756 - DNA, 11 bp, Homo sapiens
tttgtttcctg

SEQ ID NO: 5541757 - DNA, 15 bp, Homo sapiens
tttgtttcctttgtt

SEQ ID NO: 5541758 - DNA, 15 bp, Homo sapiens
tttgtttctacctcc

SEQ ID NO: 5541759 - DNA, 16 bp, Homo sapiens
tttgtttctgaaaatt

SEQ ID NO: 5541760 - DNA, 13 bp, Homo sapiens
tttgtttctgtac

SEQ ID NO: 5541761 - DNA, 18 bp, Homo sapiens
tttgtttctgtacttttt

SEQ ID NO: 5541762 - DNA, 12 bp, Homo sapiens
tttgtttcttaa

SEQ ID NO: 5541763 - DNA, 13 bp, Homo sapiens
tttgtttcttaag

SEQ ID NO: 5541764 - DNA, 17 bp, Homo sapiens
tttgtttcttacgcttg

SEQ ID NO: 5541765 - DNA, 14 bp, Homo sapiens
tttgtttcttcctt

SEQ ID NO: 5541766 - DNA, 13 bp, Homo sapiens
tttgtttcttctt

SEQ ID NO: 5541767 - DNA, 18 bp, Homo sapiens
tttgtttcttgatagtta

SEQ ID NO: 5541768 - DNA, 12 bp, Homo sapiens
tttgtttgaact

SEQ ID NO: 5541769 - DNA, 13 bp, Homo sapiens
tttgtttgaactg

SEQ ID NO: 5541770 - DNA, 14 bp, Homo sapiens
tttgtttgaatgtt

SEQ ID NO: 5541771 - DNA, 12 bp, Homo sapiens
tttgtttgtatt

SEQ ID NO: 5541772 - DNA, 15 bp, Homo sapiens
tttgtttgtattgta

SEQ ID NO: 5541773 - DNA, 22 bp, Homo sapiens
tttgttttaatcttagctttta

SEQ ID NO: 5541774 - DNA, 12 bp, Homo sapiens
tttgttttaatt

SEQ ID NO: 5541775 - DNA, 21 bp, Homo sapiens
tttgttttagaagattctatg

SEQ ID NO: 5541776 - DNA, 21 bp, Homo sapiens
tttgttttatttttttaccaa

SEQ ID NO: 5541777 - DNA, 18 bp, Homo sapiens
tttgttttcaatgaatta

SEQ ID NO: 5541778 - DNA, 20 bp, Homo sapiens
tttgttttcacactgataca

SEQ ID NO: 5541779 - DNA, 11 bp, Homo sapiens
tttgttttctt

SEQ ID NO: 5541780 - DNA, 13 bp, Homo sapiens
tttgttttctttg

SEQ ID NO: 5541781 - DNA, 18 bp, Homo sapiens
tttgttttgctttttctg

SEQ ID NO: 5541782 - DNA, 13 bp, Homo sapiens
tttgtttttaatt

SEQ ID NO: 5541783 - DNA, 13 bp, Homo sapiens
tttgtttttactg

SEQ ID NO: 5541784 - DNA, 14 bp, Homo sapiens
tttgtttttatgaa

SEQ ID NO: 5541785 - DNA, 18 bp, Homo sapiens
tttgtttttatttaaatt

SEQ ID NO: 5541786 - DNA, 18 bp, Homo sapiens
tttgtttttccagttcca

SEQ ID NO: 5541787 - DNA, 20 bp, Homo sapiens
tttgtttttcgtcattttat

SEQ ID NO: 5541788 - DNA, 13 bp, Homo sapiens
tttgtttttctca

SEQ ID NO: 5541789 - DNA, 20 bp, Homo sapiens
tttgtttttgctttctgaaa

SEQ ID NO: 5541790 - DNA, 14 bp, Homo sapiens
tttgtttttgtctt

SEQ ID NO: 5541791 - DNA, 15 bp, Homo sapiens
tttgttttttcaatg

SEQ ID NO: 5541792 - DNA, 16 bp, Homo sapiens
tttgttttttgaagtg

SEQ ID NO: 5541793 - DNA, 16 bp, Homo sapiens
tttgttttttgagtct

SEQ ID NO: 5541794 - DNA, 13 bp, Homo sapiens
tttgttttttgta

SEQ ID NO: 5541795 - DNA, 16 bp, Homo sapiens
tttgttttttgtaact

SEQ ID NO: 5541796 - DNA, 22 bp, Homo sapiens
tttgtttttttccaactgtgtt

SEQ ID NO: 5541797 - DNA, 20 bp, Homo sapiens
ttttaaaaaaaactatttaa

SEQ ID NO: 5541798 - DNA, 19 bp, Homo sapiens
ttttaaaaaaaatgtgaaa

SEQ ID NO: 5541799 - DNA, 20 bp, Homo sapiens
ttttaaaaaaaatgtgaaat

SEQ ID NO: 5541800 - DNA, 21 bp, Homo sapiens
ttttaaaaaaaatgtgaaatt

SEQ ID NO: 5541801 - DNA, 17 bp, Homo sapiens
ttttaaaaaaaatttgt

SEQ ID NO: 5541802 - DNA, 21 bp, Homo sapiens
ttttaaaaaaaatttgtgtgc

SEQ ID NO: 5541803 - DNA, 19 bp, Homo sapiens
ttttaaaaaaacaaatgtt

SEQ ID NO: 5541804 - DNA, 18 bp, Homo sapiens
ttttaaaaaaataaaaca

SEQ ID NO: 5541805 - DNA, 20 bp, Homo sapiens
ttttaaaaaaataaaacatt

SEQ ID NO: 5541806 - DNA, 19 bp, Homo sapiens
ttttaaaaaacaaaaagta

SEQ ID NO: 5541807 - DNA, 14 bp, Homo sapiens
ttttaaaaaacttt

SEQ ID NO: 5541808 - DNA, 13 bp, Homo sapiens
ttttaaaaaagaa

SEQ ID NO: 5541809 - DNA, 23 bp, Homo sapiens
ttttaaaaaagcaacagaaacct

SEQ ID NO: 5541810 - DNA, 14 bp, Homo sapiens
ttttaaaaaataac

SEQ ID NO: 5541811 - DNA, 18 bp, Homo sapiens
ttttaaaaaatattttct

SEQ ID NO: 5541812 - DNA, 15 bp, Homo sapiens
ttttaaaaaatcaaa

SEQ ID NO: 5541813 - DNA, 20 bp, Homo sapiens
ttttaaaaaatcaatcaatg

SEQ ID NO: 5541814 - DNA, 14 bp, Homo sapiens
ttttaaaaaatgaa

SEQ ID NO: 5541815 - DNA, 16 bp, Homo sapiens
ttttaaaaaatggtca

SEQ ID NO: 5541816 - DNA, 17 bp, Homo sapiens
ttttaaaaaatggtcac

SEQ ID NO: 5541817 - DNA, 16 bp, Homo sapiens
ttttaaaaacaactta

SEQ ID NO: 5541818 - DNA, 22 bp, Homo sapiens
ttttaaaaacactacttttgct

SEQ ID NO: 5541819 - DNA, 18 bp, Homo sapiens
ttttaaaaacatgagaaa

SEQ ID NO: 5541820 - DNA, 19 bp, Homo sapiens
ttttaaaaacatgagaaat

SEQ ID NO: 5541821 - DNA, 20 bp, Homo sapiens
ttttaaaaacctattttgaa

SEQ ID NO: 5541822 - DNA, 18 bp, Homo sapiens
ttttaaaaacctgtatct

SEQ ID NO: 5541823 - DNA, 19 bp, Homo sapiens
ttttaaaaactcttcagtg

SEQ ID NO: 5541824 - DNA, 20 bp, Homo sapiens
ttttaaaaactcttcagtgc

SEQ ID NO: 5541825 - DNA, 13 bp, Homo sapiens
ttttaaaaagaaa

SEQ ID NO: 5541826 - DNA, 23 bp, Homo sapiens
ttttaaaaagaaactatttttgt

SEQ ID NO: 5541827 - DNA, 18 bp, Homo sapiens
ttttaaaaagagtaattt

SEQ ID NO: 5541828 - DNA, 21 bp, Homo sapiens
ttttaaaaaggaactgcagca

SEQ ID NO: 5541829 - DNA, 12 bp, Homo sapiens
ttttaaaaaggc

SEQ ID NO: 5541830 - DNA, 20 bp, Homo sapiens
ttttaaaaagggtaacttgt

SEQ ID NO: 5541831 - DNA, 11 bp, Homo sapiens
ttttaaaaagt

SEQ ID NO: 5541832 - DNA, 20 bp, Homo sapiens
ttttaaaaagtattgccaaa

SEQ ID NO: 5541833 - DNA, 21 bp, Homo sapiens
ttttaaaaagttatataaagg

SEQ ID NO: 5541834 - DNA, 16 bp, Homo sapiens
ttttaaaaagttgata

SEQ ID NO: 5541835 - DNA, 16 bp, Homo sapiens
ttttaaaaatacatat

SEQ ID NO: 5541836 - DNA, 17 bp, Homo sapiens
ttttaaaaatagacact

SEQ ID NO: 5541837 - DNA, 23 bp, Homo sapiens
ttttaaaaatcataaactgtgtg

SEQ ID NO: 5541838 - DNA, 12 bp, Homo sapiens
ttttaaaaatga

SEQ ID NO: 5541839 - DNA, 16 bp, Homo sapiens
ttttaaaaatgaaatt

SEQ ID NO: 5541840 - DNA, 14 bp, Homo sapiens
ttttaaaaatgaat

SEQ ID NO: 5541841 - DNA, 13 bp, Homo sapiens
ttttaaaaatggt

SEQ ID NO: 5541842 - DNA, 13 bp, Homo sapiens
ttttaaaaatgta

SEQ ID NO: 5541843 - DNA, 11 bp, Homo sapiens
ttttaaaacac

SEQ ID NO: 5541844 - DNA, 13 bp, Homo sapiens
ttttaaaacacat

SEQ ID NO: 5541845 - DNA, 20 bp, Homo sapiens
ttttaaaacacatgttttta

SEQ ID NO: 5541846 - DNA, 14 bp, Homo sapiens
ttttaaaacactaa

SEQ ID NO: 5541847 - DNA, 16 bp, Homo sapiens
ttttaaaacacttcca

SEQ ID NO: 5541848 - DNA, 22 bp, Homo sapiens
ttttaaaacacttccataatct

SEQ ID NO: 5541849 - DNA, 15 bp, Homo sapiens
ttttaaaacatggca

SEQ ID NO: 5541850 - DNA, 12 bp, Homo sapiens
ttttaaaaccat

SEQ ID NO: 5541851 - DNA, 19 bp, Homo sapiens
ttttaaaacgtgtaaatga

SEQ ID NO: 5541852 - DNA, 20 bp, Homo sapiens
ttttaaaacgtgtaaatgaa

SEQ ID NO: 5541853 - DNA, 14 bp, Homo sapiens
ttttaaaactactt

SEQ ID NO: 5541854 - DNA, 16 bp, Homo sapiens
ttttaaaactgcattt

SEQ ID NO: 5541855 - DNA, 17 bp, Homo sapiens
ttttaaaactggacctg

SEQ ID NO: 5541856 - DNA, 13 bp, Homo sapiens
ttttaaaagaaat

SEQ ID NO: 5541857 - DNA, 14 bp, Homo sapiens
ttttaaaagaatga

SEQ ID NO: 5541858 - DNA, 14 bp, Homo sapiens
ttttaaaagacaag

SEQ ID NO: 5541859 - DNA, 16 bp, Homo sapiens
ttttaaaagactttga

SEQ ID NO: 5541860 - DNA, 20 bp, Homo sapiens
ttttaaaagactttgatgtg

SEQ ID NO: 5541861 - DNA, 11 bp, Homo sapiens
ttttaaaagca

SEQ ID NO: 5541862 - DNA, 18 bp, Homo sapiens
ttttaaaagcaattatat

SEQ ID NO: 5541863 - DNA, 13 bp, Homo sapiens
ttttaaaagcaca

SEQ ID NO: 5541864 - DNA, 22 bp, Homo sapiens
ttttaaaagcacaatcactaaa

SEQ ID NO: 5541865 - DNA, 13 bp, Homo sapiens
ttttaaaagcata

SEQ ID NO: 5541866 - DNA, 23 bp, Homo sapiens
ttttaaaagcatatataaaacaa

SEQ ID NO: 5541867 - DNA, 13 bp, Homo sapiens
ttttaaaaggaaa

SEQ ID NO: 5541868 - DNA, 23 bp, Homo sapiens
ttttaaaaggttgactcaagttt

SEQ ID NO: 5541869 - DNA, 18 bp, Homo sapiens
ttttaaaagtctatttta

SEQ ID NO: 5541870 - DNA, 16 bp, Homo sapiens
ttttaaaagtgcacat

SEQ ID NO: 5541871 - DNA, 22 bp, Homo sapiens
ttttaaaagttactccttttag

SEQ ID NO: 5541872 - DNA, 16 bp, Homo sapiens
ttttaaaagttattaa

SEQ ID NO: 5541873 - DNA, 22 bp, Homo sapiens
ttttaaaagttgttaccaaata

SEQ ID NO: 5541874 - DNA, 12 bp, Homo sapiens
ttttaaaagttt

SEQ ID NO: 5541875 - DNA, 23 bp, Homo sapiens
ttttaaaagttttgaaggaaacc

SEQ ID NO: 5541876 - DNA, 13 bp, Homo sapiens
ttttaaaataaaa

SEQ ID NO: 5541877 - DNA, 17 bp, Homo sapiens
ttttaaaataaaatttt

SEQ ID NO: 5541878 - DNA, 19 bp, Homo sapiens
ttttaaaataaactgtaaa

SEQ ID NO: 5541879 - DNA, 23 bp, Homo sapiens
ttttaaaataagctttctcagaa

SEQ ID NO: 5541880 - DNA, 17 bp, Homo sapiens
ttttaaaatacttgttt

SEQ ID NO: 5541881 - DNA, 21 bp, Homo sapiens
ttttaaaatagaaattttgta

SEQ ID NO: 5541882 - DNA, 23 bp, Homo sapiens
ttttaaaatagaaattttgtaag

SEQ ID NO: 5541883 - DNA, 21 bp, Homo sapiens
ttttaaaatagcgttcttgta

SEQ ID NO: 5541884 - DNA, 15 bp, Homo sapiens
ttttaaaatatatgt

SEQ ID NO: 5541885 - DNA, 21 bp, Homo sapiens
ttttaaaatatcctgtaacta

SEQ ID NO: 5541886 - DNA, 17 bp, Homo sapiens
ttttaaaatatttaact

SEQ ID NO: 5541887 - DNA, 20 bp, Homo sapiens
ttttaaaatatttaactttt

SEQ ID NO: 5541888 - DNA, 11 bp, Homo sapiens
ttttaaaatca

SEQ ID NO: 5541889 - DNA, 15 bp, Homo sapiens
ttttaaaatcaactt

SEQ ID NO: 5541890 - DNA, 19 bp, Homo sapiens
ttttaaaatcactaacatt

SEQ ID NO: 5541891 - DNA, 22 bp, Homo sapiens
ttttaaaatcagctattttgtg

SEQ ID NO: 5541892 - DNA, 23 bp, Homo sapiens
ttttaaaatccactttatcttga

SEQ ID NO: 5541893 - DNA, 21 bp, Homo sapiens
ttttaaaatccagactttctt

SEQ ID NO: 5541894 - DNA, 22 bp, Homo sapiens
ttttaaaatccagactttcttt

SEQ ID NO: 5541895 - DNA, 23 bp, Homo sapiens
ttttaaaatctgagggaaatgtt

SEQ ID NO: 5541896 - DNA, 15 bp, Homo sapiens
ttttaaaatctgatt

SEQ ID NO: 5541897 - DNA, 13 bp, Homo sapiens
ttttaaaatctta

SEQ ID NO: 5541898 - DNA, 22 bp, Homo sapiens
ttttaaaatcttattaaagttt

SEQ ID NO: 5541899 - DNA, 13 bp, Homo sapiens
ttttaaaatgaaa

SEQ ID NO: 5541900 - DNA, 16 bp, Homo sapiens
ttttaaaatgaataat

SEQ ID NO: 5541901 - DNA, 22 bp, Homo sapiens
ttttaaaatgagaaatctaaaa

SEQ ID NO: 5541902 - DNA, 21 bp, Homo sapiens
ttttaaaatgtacatgtatta

SEQ ID NO: 5541903 - DNA, 14 bp, Homo sapiens
ttttaaaattatat

SEQ ID NO: 5541904 - DNA, 18 bp, Homo sapiens
ttttaaaattcaccccca

SEQ ID NO: 5541905 - DNA, 15 bp, Homo sapiens
ttttaaaattgattt

SEQ ID NO: 5541906 - DNA, 23 bp, Homo sapiens
ttttaaaattgtacatgaacatg

SEQ ID NO: 5541907 - DNA, 20 bp, Homo sapiens
ttttaaaatttgttcttgta

SEQ ID NO: 5541908 - DNA, 21 bp, Homo sapiens
ttttaaacaaaatttcacagt

SEQ ID NO: 5541909 - DNA, 23 bp, Homo sapiens
ttttaaacaaaatttcacagttc

SEQ ID NO: 5541910 - DNA, 15 bp, Homo sapiens
ttttaaacagatatt

SEQ ID NO: 5541911 - DNA, 13 bp, Homo sapiens
ttttaaacagtga

SEQ ID NO: 5541912 - DNA, 13 bp, Homo sapiens
ttttaaacagtgt

SEQ ID NO: 5541913 - DNA, 19 bp, Homo sapiens
ttttaaacatgagaataaa

SEQ ID NO: 5541914 - DNA, 13 bp, Homo sapiens
ttttaaacatttt

SEQ ID NO: 5541915 - DNA, 15 bp, Homo sapiens
ttttactagaacaca

SEQ ID NO: 5541916 - DNA, 23 bp, Homo sapiens
ttttactatgcctgttgatctat

SEQ ID NO: 5541917 - DNA, 19 bp, Homo sapiens
ttttactccccctcttaag

SEQ ID NO: 5541918 - DNA, 13 bp, Homo sapiens
ttttactcccctt

SEQ ID NO: 5541919 - DNA, 21 bp, Homo sapiens
ttttactccctgatcccagtt

SEQ ID NO: 5541920 - DNA, 20 bp, Homo sapiens
ttttactcctcagttcctca

SEQ ID NO: 5541921 - DNA, 13 bp, Homo sapiens
ttttactcctttg

SEQ ID NO: 5541922 - DNA, 22 bp, Homo sapiens
ttttactcctttgcattccatg

SEQ ID NO: 5541923 - DNA, 12 bp, Homo sapiens
ttttactctgcc

SEQ ID NO: 5541924 - DNA, 20 bp, Homo sapiens
ttttactctgggagtaatac

SEQ ID NO: 5541925 - DNA, 16 bp, Homo sapiens
ttttactctgtgtaaa

SEQ ID NO: 5541926 - DNA, 15 bp, Homo sapiens
ttttactgaagcctt

SEQ ID NO: 5541927 - DNA, 18 bp, Homo sapiens
ttttactgaatgatctat

SEQ ID NO: 5541928 - DNA, 18 bp, Homo sapiens
ttttactgacagaaatgc

SEQ ID NO: 5541929 - DNA, 17 bp, Homo sapiens
ttttactgattaacaaa

SEQ ID NO: 5541930 - DNA, 14 bp, Homo sapiens
ttttactgcatttt

SEQ ID NO: 5541931 - DNA, 19 bp, Homo sapiens
ttttactgcattttcacaa

SEQ ID NO: 5541932 - DNA, 23 bp, Homo sapiens
ttttactgccctttcaaagcact

SEQ ID NO: 5541933 - DNA, 16 bp, Homo sapiens
ttttactgctttctga

SEQ ID NO: 5541934 - DNA, 17 bp, Homo sapiens
ttttactgctttctgaa

SEQ ID NO: 5541935 - DNA, 20 bp, Homo sapiens
ttttactgctttctgaatgt

SEQ ID NO: 5541936 - DNA, 15 bp, Homo sapiens
ttttactgcttttaa

SEQ ID NO: 5541937 - DNA, 23 bp, Homo sapiens
ttttactgcttttaacttctgat

SEQ ID NO: 5541938 - DNA, 15 bp, Homo sapiens
ttttactggttgcat

SEQ ID NO: 5541939 - DNA, 13 bp, Homo sapiens
ttttactgtcaga

SEQ ID NO: 5541940 - DNA, 17 bp, Homo sapiens
ttttactgtctatatat

SEQ ID NO: 5541941 - DNA, 15 bp, Homo sapiens
ttttactgtctgtaa

SEQ ID NO: 5541942 - DNA, 13 bp, Homo sapiens
ttttactgtgcat

SEQ ID NO: 5541943 - DNA, 14 bp, Homo sapiens
ttttacttagcaat

SEQ ID NO: 5541944 - DNA, 20 bp, Homo sapiens
ttttacttctggcctttcct

SEQ ID NO: 5541945 - DNA, 14 bp, Homo sapiens
ttttacttgaagta

SEQ ID NO: 5541946 - DNA, 17 bp, Homo sapiens
ttttacttgattaagga

SEQ ID NO: 5541947 - DNA, 13 bp, Homo sapiens
ttttacttggaaa

SEQ ID NO: 5541948 - DNA, 16 bp, Homo sapiens
ttttactttaaagtag

SEQ ID NO: 5541949 - DNA, 15 bp, Homo sapiens
ttttactttgtgcaa

SEQ ID NO: 5541950 - DNA, 19 bp, Homo sapiens
ttttacttttataataaaa

SEQ ID NO: 5541951 - DNA, 17 bp, Homo sapiens
ttttacttttcacactg

SEQ ID NO: 5541952 - DNA, 17 bp, Homo sapiens
ttttacttttctgccaa

SEQ ID NO: 5541953 - DNA, 23 bp, Homo sapiens
ttttagaaaaggccaatatacct

SEQ ID NO: 5541954 - DNA, 15 bp, Homo sapiens
ttttagaaaatgttt

SEQ ID NO: 5541955 - DNA, 19 bp, Homo sapiens
ttttagaaactacaaatat

SEQ ID NO: 5541956 - DNA, 12 bp, Homo sapiens
ttttagaaactt

SEQ ID NO: 5541957 - DNA, 13 bp, Homo sapiens
ttttagaaagaaa

SEQ ID NO: 5541958 - DNA, 12 bp, Homo sapiens
ttttagaaattc

SEQ ID NO: 5541959 - DNA, 14 bp, Homo sapiens
ttttagaaattggt

SEQ ID NO: 5541960 - DNA, 22 bp, Homo sapiens
ttttagaagcagcgagtgcatg

SEQ ID NO: 5541961 - DNA, 13 bp, Homo sapiens
ttttagaataaaa

SEQ ID NO: 5541962 - DNA, 13 bp, Homo sapiens
ttttagaataaga

SEQ ID NO: 5541963 - DNA, 20 bp, Homo sapiens
ttttagaataagaatttgca

SEQ ID NO: 5541964 - DNA, 18 bp, Homo sapiens
ttttagaataaggaggag

SEQ ID NO: 5541965 - DNA, 20 bp, Homo sapiens
ttttagaatacattgtactt

SEQ ID NO: 5541966 - DNA, 17 bp, Homo sapiens
ttttagaatgtcaataa

SEQ ID NO: 5541967 - DNA, 19 bp, Homo sapiens
ttttagaatgtcaataaat

SEQ ID NO: 5541968 - DNA, 23 bp, Homo sapiens
ttttagaattacaccacaagtat

SEQ ID NO: 5541969 - DNA, 23 bp, Homo sapiens
ttttagacaaatactcatgtgta

SEQ ID NO: 5541970 - DNA, 21 bp, Homo sapiens
ttttagaccctattgctgctt

SEQ ID NO: 5541971 - DNA, 20 bp, Homo sapiens
ttttagacctcatctccaag

SEQ ID NO: 5541972 - DNA, 19 bp, Homo sapiens
ttttagacgatcacagaaa

SEQ ID NO: 5541973 - DNA, 20 bp, Homo sapiens
ttttagagaatgtgtttcaa

SEQ ID NO: 5541974 - DNA, 16 bp, Homo sapiens
ttttagagataaatat

SEQ ID NO: 5541975 - DNA, 22 bp, Homo sapiens
ttttagagcattaaaataacta

SEQ ID NO: 5541976 - DNA, 18 bp, Homo sapiens
ttttagagcttccaaatg

SEQ ID NO: 5541977 - DNA, 15 bp, Homo sapiens
ttttagagtaaacta

SEQ ID NO: 5541978 - DNA, 17 bp, Homo sapiens
ttttagagtaagaaatt

SEQ ID NO: 5541979 - DNA, 18 bp, Homo sapiens
ttttagatactttgctag

SEQ ID NO: 5541980 - DNA, 16 bp, Homo sapiens
ttttagatcaaatact

SEQ ID NO: 5541981 - DNA, 17 bp, Homo sapiens
ttttagatgaccaaaac

SEQ ID NO: 5541982 - DNA, 19 bp, Homo sapiens
ttttagatggttacactgt

SEQ ID NO: 5541983 - DNA, 19 bp, Homo sapiens
ttttagatgtgctgctttg

SEQ ID NO: 5541984 - DNA, 12 bp, Homo sapiens
ttttagatgtta

SEQ ID NO: 5541985 - DNA, 18 bp, Homo sapiens
ttttagattcctacttaa

SEQ ID NO: 5541986 - DNA, 23 bp, Homo sapiens
ttttagattcctacttaaacaaa

SEQ ID NO: 5541987 - DNA, 20 bp, Homo sapiens
ttttagattgagaaatgtgt

SEQ ID NO: 5541988 - DNA, 23 bp, Homo sapiens
ttttagcaaagcgggttataatg

SEQ ID NO: 5541989 - DNA, 18 bp, Homo sapiens
ttttagcaaatcagtata

SEQ ID NO: 5541990 - DNA, 15 bp, Homo sapiens
ttttagcattaccta

SEQ ID NO: 5541991 - DNA, 21 bp, Homo sapiens
ttttagccataattttgcata

SEQ ID NO: 5541992 - DNA, 21 bp, Homo sapiens
ttttagccatttctccatggg

SEQ ID NO: 5541993 - DNA, 19 bp, Homo sapiens
ttttagcctagttcatcca

SEQ ID NO: 5541994 - DNA, 23 bp, Homo sapiens
ttttagccttctctgttcatttc

SEQ ID NO: 5541995 - DNA, 18 bp, Homo sapiens
ttttagctccataagcaa

SEQ ID NO: 5541996 - DNA, 19 bp, Homo sapiens
ttttagctccttgactcct

SEQ ID NO: 5541997 - DNA, 23 bp, Homo sapiens
ttttagctggtgtcagcccctct

SEQ ID NO: 5541998 - DNA, 20 bp, Homo sapiens
ttttagcttcagttgttctt

SEQ ID NO: 5541999 - DNA, 23 bp, Homo sapiens
ttttaggaaaagcatctgccaca

SEQ ID NO: 5542000 - DNA, 12 bp, Homo sapiens
ttttaggaaagg

SEQ ID NO: 5542001 - DNA, 12 bp, Homo sapiens
ttttaggaaatg

SEQ ID NO: 5542002 - DNA, 20 bp, Homo sapiens
ttttaggaataataaattca

SEQ ID NO: 5542003 - DNA, 23 bp, Homo sapiens
ttttaggagctaaggctctatga

SEQ ID NO: 5542004 - DNA, 17 bp, Homo sapiens
ttttaggatacttaaca

SEQ ID NO: 5542005 - DNA, 18 bp, Homo sapiens
ttttaggatacttaacaa

SEQ ID NO: 5542006 - DNA, 21 bp, Homo sapiens
ttttaggatacttaacaaata

SEQ ID NO: 5542007 - DNA, 23 bp, Homo sapiens
ttttaggattcccctcaatgcag

SEQ ID NO: 5542008 - DNA, 15 bp, Homo sapiens
ttttaggattctgtc

SEQ ID NO: 5542009 - DNA, 14 bp, Homo sapiens
ttttaggctacagt

SEQ ID NO: 5542010 - DNA, 19 bp, Homo sapiens
ttttaggctgttccttgta

SEQ ID NO: 5542011 - DNA, 23 bp, Homo sapiens
ttttaggctgttccttgtactct

SEQ ID NO: 5542012 - DNA, 22 bp, Homo sapiens
ttttagggaataatattcaata

SEQ ID NO: 5542013 - DNA, 21 bp, Homo sapiens
ttttagggagtggttcctgtg

SEQ ID NO: 5542014 - DNA, 15 bp, Homo sapiens
ttttagggcagattt

SEQ ID NO: 5542015 - DNA, 22 bp, Homo sapiens
ttttagggtaagaagtttgtgt

SEQ ID NO: 5542016 - DNA, 23 bp, Homo sapiens
ttttagggttctaaatgcaataa

SEQ ID NO: 5542017 - DNA, 23 bp, Homo sapiens
ttttaggtcaagggcttactatt

SEQ ID NO: 5542018 - DNA, 20 bp, Homo sapiens
ttttaggtcatccaacctct

SEQ ID NO: 5542019 - DNA, 21 bp, Homo sapiens
ttttaggtcatccaacctctt

SEQ ID NO: 5542020 - DNA, 22 bp, Homo sapiens
ttttaggtggcatagtggctta

SEQ ID NO: 5542021 - DNA, 16 bp, Homo sapiens
ttttaggtgttgattt

SEQ ID NO: 5542022 - DNA, 19 bp, Homo sapiens
ttttaggtgttgattttct

SEQ ID NO: 5542023 - DNA, 13 bp, Homo sapiens
ttttaggttctaa

SEQ ID NO: 5542024 - DNA, 14 bp, Homo sapiens
ttttaggttctaaa

SEQ ID NO: 5542025 - DNA, 15 bp, Homo sapiens
ttttaggttctaaag

SEQ ID NO: 5542026 - DNA, 23 bp, Homo sapiens
ttttaggttctaaagttctaaga

SEQ ID NO: 5542027 - DNA, 14 bp, Homo sapiens
ttttagtaagttaa

SEQ ID NO: 5542028 - DNA, 19 bp, Homo sapiens
ttttagtaatctgtacatt

SEQ ID NO: 5542029 - DNA, 15 bp, Homo sapiens
ttttagtacccacct

SEQ ID NO: 5542030 - DNA, 21 bp, Homo sapiens
ttttagtacccacctgagctt

SEQ ID NO: 5542031 - DNA, 22 bp, Homo sapiens
ttttagtagagatggggtttca

SEQ ID NO: 5542032 - DNA, 21 bp, Homo sapiens
ttttagtcagaaatgattcag

SEQ ID NO: 5542033 - DNA, 15 bp, Homo sapiens
ttttagtcttttact

SEQ ID NO: 5542034 - DNA, 19 bp, Homo sapiens
ttttagtgaacttgaaata

SEQ ID NO: 5542035 - DNA, 19 bp, Homo sapiens
ttttagtggttctgtgcct

SEQ ID NO: 5542036 - DNA, 19 bp, Homo sapiens
ttttagtgtaaaattgtta

SEQ ID NO: 5542037 - DNA, 20 bp, Homo sapiens
ttttagtgtaaaattgttaa

SEQ ID NO: 5542038 - DNA, 19 bp, Homo sapiens
ttttagtgtattaatcata

SEQ ID NO: 5542039 - DNA, 16 bp, Homo sapiens
ttttagtgtctgacct

SEQ ID NO: 5542040 - DNA, 16 bp, Homo sapiens
ttttagtgtgtaaaat

SEQ ID NO: 5542041 - DNA, 18 bp, Homo sapiens
ttttagtgtgtaaaatta

SEQ ID NO: 5542042 - DNA, 24 bp, Homo sapiens
ttttagttaagcatgactttagat

SEQ ID NO: 5542043 - DNA, 19 bp, Homo sapiens
ttttagttccttctataca

SEQ ID NO: 5542044 - DNA, 13 bp, Homo sapiens
ttttagttctgac

SEQ ID NO: 5542045 - DNA, 17 bp, Homo sapiens
ttttagttggtgctgat

SEQ ID NO: 5542046 - DNA, 14 bp, Homo sapiens
ttttagtttcaaaa

SEQ ID NO: 5542047 - DNA, 19 bp, Homo sapiens
ttttagtttctaaagccaa

SEQ ID NO: 5542048 - DNA, 19 bp, Homo sapiens
ttttagtttctgttctgtg

SEQ ID NO: 5542049 - DNA, 16 bp, Homo sapiens
ttttagtttttcatta

SEQ ID NO: 5542050 - DNA, 20 bp, Homo sapiens
ttttataaaaaaaatgaaat

SEQ ID NO: 5542051 - DNA, 23 bp, Homo sapiens
ttttataaaaacattgaaatatt

SEQ ID NO: 5542052 - DNA, 14 bp, Homo sapiens
ttttataaaaagat

SEQ ID NO: 5542053 - DNA, 20 bp, Homo sapiens
ttttataaaagcaaaagaga

SEQ ID NO: 5542054 - DNA, 13 bp, Homo sapiens
ttttataaacagt

SEQ ID NO: 5542055 - DNA, 22 bp, Homo sapiens
ttttataaagtctaagcaagat

SEQ ID NO: 5542056 - DNA, 18 bp, Homo sapiens
ttttataaataaactgtt

SEQ ID NO: 5542057 - DNA, 20 bp, Homo sapiens
ttttataaatataagccttt

SEQ ID NO: 5542058 - DNA, 22 bp, Homo sapiens
ttttataaatatgtgaaaatga

SEQ ID NO: 5542059 - DNA, 12 bp, Homo sapiens
ttttataaatcg

SEQ ID NO: 5542060 - DNA, 17 bp, Homo sapiens
ttttataaccttgttct

SEQ ID NO: 5542061 - DNA, 17 bp, Homo sapiens
ttttataagaaaaactt

SEQ ID NO: 5542062 - DNA, 14 bp, Homo sapiens
ttttataagaattt

SEQ ID NO: 5542063 - DNA, 16 bp, Homo sapiens
ttttataagatttaat

SEQ ID NO: 5542064 - DNA, 22 bp, Homo sapiens
ttttataagcacagacaattct

SEQ ID NO: 5542065 - DNA, 19 bp, Homo sapiens
ttttataaggacttcctga

SEQ ID NO: 5542066 - DNA, 14 bp, Homo sapiens
ttttataatattca

SEQ ID NO: 5542067 - DNA, 19 bp, Homo sapiens
ttttataatcaatgaattt

SEQ ID NO: 5542068 - DNA, 14 bp, Homo sapiens
ttttataatgactg

SEQ ID NO: 5542069 - DNA, 19 bp, Homo sapiens
ttttataattctcattaaa

SEQ ID NO: 5542070 - DNA, 23 bp, Homo sapiens
ttttataattggtgctatttgaa

SEQ ID NO: 5542071 - DNA, 17 bp, Homo sapiens
ttttataattttctaag

SEQ ID NO: 5542072 - DNA, 14 bp, Homo sapiens
ttttataattttgt

SEQ ID NO: 5542073 - DNA, 14 bp, Homo sapiens
ttttatacagtagt

SEQ ID NO: 5542074 - DNA, 17 bp, Homo sapiens
ttttatacagtagtgag

SEQ ID NO: 5542075 - DNA, 18 bp, Homo sapiens
ttttatacataaacagtt

SEQ ID NO: 5542076 - DNA, 14 bp, Homo sapiens
ttttatacatagtc

SEQ ID NO: 5542077 - DNA, 12 bp, Homo sapiens
ttttatacatat

SEQ ID NO: 5542078 - DNA, 13 bp, Homo sapiens
ttttatacatatc

SEQ ID NO: 5542079 - DNA, 17 bp, Homo sapiens
ttttatacatatcagaa

SEQ ID NO: 5542080 - DNA, 17 bp, Homo sapiens
ttttatactccatacat

SEQ ID NO: 5542081 - DNA, 16 bp, Homo sapiens
ttttatactgcacttt

SEQ ID NO: 5542082 - DNA, 21 bp, Homo sapiens
ttttatactgctctataaata

SEQ ID NO: 5542083 - DNA, 16 bp, Homo sapiens
ttttatactgtacatg

SEQ ID NO: 5542084 - DNA, 15 bp, Homo sapiens
ttttatactgtactt

SEQ ID NO: 5542085 - DNA, 15 bp, Homo sapiens
ttttatacttcaaat

SEQ ID NO: 5542086 - DNA, 18 bp, Homo sapiens
ttttatactttccctacc

SEQ ID NO: 5542087 - DNA, 19 bp, Homo sapiens
ttttatagaaaatgcatta

SEQ ID NO: 5542088 - DNA, 17 bp, Homo sapiens
ttttatagcctggactg

SEQ ID NO: 5542089 - DNA, 20 bp, Homo sapiens
ttttataggggctttgctga

SEQ ID NO: 5542090 - DNA, 15 bp, Homo sapiens
ttttatagtggaaaa

SEQ ID NO: 5542091 - DNA, 14 bp, Homo sapiens
ttttctggctgggg

SEQ ID NO: 5542092 - DNA, 10 bp, Homo sapiens
ttttctgggt

SEQ ID NO: 5542093 - DNA, 21 bp, Homo sapiens
ttttctgggtaggactttggt

SEQ ID NO: 5542094 - DNA, 13 bp, Homo sapiens
ttttctgggtctt

SEQ ID NO: 5542095 - DNA, 22 bp, Homo sapiens
ttttctgggtgtccaaaggaag

SEQ ID NO: 5542096 - DNA, 16 bp, Homo sapiens
ttttctggtagataga

SEQ ID NO: 5542097 - DNA, 19 bp, Homo sapiens
ttttctggtagatagaaat

SEQ ID NO: 5542098 - DNA, 22 bp, Homo sapiens
ttttctggtaggttctgtctgt

SEQ ID NO: 5542099 - DNA, 21 bp, Homo sapiens
ttttctggtggggctgtcctg

SEQ ID NO: 5542100 - DNA, 16 bp, Homo sapiens
ttttctggttccaaac

SEQ ID NO: 5542101 - DNA, 17 bp, Homo sapiens
ttttctggttctaacat

SEQ ID NO: 5542102 - DNA, 21 bp, Homo sapiens
ttttctgtaagagaaaatatt

SEQ ID NO: 5542103 - DNA, 22 bp, Homo sapiens
ttttctgtaatcttttatttaa

SEQ ID NO: 5542104 - DNA, 12 bp, Homo sapiens
ttttctgtactt

SEQ ID NO: 5542105 - DNA, 17 bp, Homo sapiens
ttttctgtataaatgtc

SEQ ID NO: 5542106 - DNA, 12 bp, Homo sapiens
ttttctgtattt

SEQ ID NO: 5542107 - DNA, 13 bp, Homo sapiens
ttttctgtcctgg

SEQ ID NO: 5542108 - DNA, 15 bp, Homo sapiens
ttttctgtctctctt

SEQ ID NO: 5542109 - DNA, 17 bp, Homo sapiens
ttttctgtctctgcctc

SEQ ID NO: 5542110 - DNA, 18 bp, Homo sapiens
ttttctgtgcctgaatat

SEQ ID NO: 5542111 - DNA, 21 bp, Homo sapiens
ttttctgtgtaaccattttat

SEQ ID NO: 5542112 - DNA, 22 bp, Homo sapiens
ttttctgtgtaaccattttata

SEQ ID NO: 5542113 - DNA, 11 bp, Homo sapiens
ttttctgtgtg

SEQ ID NO: 5542114 - DNA, 16 bp, Homo sapiens
ttttctgtgtgttcct

SEQ ID NO: 5542115 - DNA, 23 bp, Homo sapiens
ttttctgtgtttagctatttaat

SEQ ID NO: 5542116 - DNA, 23 bp, Homo sapiens
ttttctgttactttgttttttaa

SEQ ID NO: 5542117 - DNA, 13 bp, Homo sapiens
ttttctgttcttt

SEQ ID NO: 5542118 - DNA, 15 bp, Homo sapiens
ttttctgttgtaact

SEQ ID NO: 5542119 - DNA, 15 bp, Homo sapiens
ttttctgtttaggaa

SEQ ID NO: 5542120 - DNA, 15 bp, Homo sapiens
ttttctgtttgtaaa

SEQ ID NO: 5542121 - DNA, 11 bp, Homo sapiens
ttttcttaaaa

SEQ ID NO: 5542122 - DNA, 13 bp, Homo sapiens
ttttcttaaagca

SEQ ID NO: 5542123 - DNA, 16 bp, Homo sapiens
ttttcttaaatgtttt

SEQ ID NO: 5542124 - DNA, 17 bp, Homo sapiens
ttttcttaacttctgaa

SEQ ID NO: 5542125 - DNA, 13 bp, Homo sapiens
ttttcttaagaca

SEQ ID NO: 5542126 - DNA, 23 bp, Homo sapiens
ttttcttacccagattgtgtaca

SEQ ID NO: 5542127 - DNA, 14 bp, Homo sapiens
ttttcttactttta

SEQ ID NO: 5542128 - DNA, 14 bp, Homo sapiens
ttttcttagttact

SEQ ID NO: 5542129 - DNA, 15 bp, Homo sapiens
ttttcttagttactt

SEQ ID NO: 5542130 - DNA, 16 bp, Homo sapiens
ttttcttatataagac

SEQ ID NO: 5542131 - DNA, 13 bp, Homo sapiens
ttttcttatccaa

SEQ ID NO: 5542132 - DNA, 13 bp, Homo sapiens
ttttcttatttag

SEQ ID NO: 5542133 - DNA, 13 bp, Homo sapiens
ttttcttatttat

SEQ ID NO: 5542134 - DNA, 11 bp, Homo sapiens
ttttcttcagc

SEQ ID NO: 5542135 - DNA, 13 bp, Homo sapiens
ttttcttcaggaa

SEQ ID NO: 5542136 - DNA, 16 bp, Homo sapiens
ttttcttcatgtgcaa

SEQ ID NO: 5542137 - DNA, 13 bp, Homo sapiens
ttttcttcccaaa

SEQ ID NO: 5542138 - DNA, 15 bp, Homo sapiens
ttttcttcccatttg

SEQ ID NO: 5542139 - DNA, 16 bp, Homo sapiens
ttttcttccccttcct

SEQ ID NO: 5542140 - DNA, 14 bp, Homo sapiens
ttttcttcctttga

SEQ ID NO: 5542141 - DNA, 15 bp, Homo sapiens
ttttcttctctgtga

SEQ ID NO: 5542142 - DNA, 15 bp, Homo sapiens
ttttcttcttcctgg

SEQ ID NO: 5542143 - DNA, 23 bp, Homo sapiens
ttttcttctttaatttttctgtt

SEQ ID NO: 5542144 - DNA, 13 bp, Homo sapiens
ttttcttctttta

SEQ ID NO: 5542145 - DNA, 17 bp, Homo sapiens
ttttcttgaaaggggaa

SEQ ID NO: 5542146 - DNA, 20 bp, Homo sapiens
ttttcttgactttgtatctt

SEQ ID NO: 5542147 - DNA, 12 bp, Homo sapiens
ttttcttgataa

SEQ ID NO: 5542148 - DNA, 16 bp, Homo sapiens
ttttcttgataatttt

SEQ ID NO: 5542149 - DNA, 16 bp, Homo sapiens
ttttcttgatcttaaa

SEQ ID NO: 5542150 - DNA, 14 bp, Homo sapiens
ttttcttgatttga

SEQ ID NO: 5542151 - DNA, 13 bp, Homo sapiens
ttttcttgcagtt

SEQ ID NO: 5542152 - DNA, 14 bp, Homo sapiens
ttttcttgcagttt

SEQ ID NO: 5542153 - DNA, 21 bp, Homo sapiens
ttttcttgccaatgaggtctg

SEQ ID NO: 5542154 - DNA, 20 bp, Homo sapiens
ttttcttgccaccctctggg

SEQ ID NO: 5542155 - DNA, 13 bp, Homo sapiens
ttttcttgccagc

SEQ ID NO: 5542156 - DNA, 19 bp, Homo sapiens
ttttcttgcctctgtcccc

SEQ ID NO: 5542157 - DNA, 23 bp, Homo sapiens
ttttcttgggaattgaaaaaaat

SEQ ID NO: 5542158 - DNA, 19 bp, Homo sapiens
ttttcttgtatctggattc

SEQ ID NO: 5542159 - DNA, 18 bp, Homo sapiens
ttttcttgtttatcagca

SEQ ID NO: 5542160 - DNA, 14 bp, Homo sapiens
ttttcttgtttctg

SEQ ID NO: 5542161 - DNA, 18 bp, Homo sapiens
ttttctttaaagaagttg

SEQ ID NO: 5542162 - DNA, 15 bp, Homo sapiens
ttttctttaaagatg

SEQ ID NO: 5542163 - DNA, 16 bp, Homo sapiens
ttttctttaatgcttt

SEQ ID NO: 5542164 - DNA, 22 bp, Homo sapiens
ttttctttacaaacaaaagcat

SEQ ID NO: 5542165 - DNA, 13 bp, Homo sapiens
ttttctttacaca

SEQ ID NO: 5542166 - DNA, 14 bp, Homo sapiens
ttttctttagtata

SEQ ID NO: 5542167 - DNA, 13 bp, Homo sapiens
ttttctttatgga

SEQ ID NO: 5542168 - DNA, 11 bp, Homo sapiens
ttttctttcac

SEQ ID NO: 5542169 - DNA, 13 bp, Homo sapiens
ttttctttcactt

SEQ ID NO: 5542170 - DNA, 16 bp, Homo sapiens
ttttctttcagccaag

SEQ ID NO: 5542171 - DNA, 15 bp, Homo sapiens
ttttctttctatgta

SEQ ID NO: 5542172 - DNA, 22 bp, Homo sapiens
ttttctttctatgtagaactgt

SEQ ID NO: 5542173 - DNA, 17 bp, Homo sapiens
ttttctttctttttctg

SEQ ID NO: 5542174 - DNA, 18 bp, Homo sapiens
ttttctttgaaatgctaa

SEQ ID NO: 5542175 - DNA, 20 bp, Homo sapiens
ttttctttgaataaatgtca

SEQ ID NO: 5542176 - DNA, 15 bp, Homo sapiens
ttttctttgaccaga

SEQ ID NO: 5542177 - DNA, 21 bp, Homo sapiens
ttttctttgctgtgccaaagc

SEQ ID NO: 5542178 - DNA, 15 bp, Homo sapiens
ttttctttgtaaagg

SEQ ID NO: 5542179 - DNA, 18 bp, Homo sapiens
ttttctttgtatcattca

SEQ ID NO: 5542180 - DNA, 12 bp, Homo sapiens
ttttctttgtgt

SEQ ID NO: 5542181 - DNA, 13 bp, Homo sapiens
ttttctttgtgta

SEQ ID NO: 5542182 - DNA, 16 bp, Homo sapiens
ttttcttttctatgga

SEQ ID NO: 5542183 - DNA, 22 bp, Homo sapiens
ttttcttttgctttatgggttt

SEQ ID NO: 5542184 - DNA, 16 bp, Homo sapiens
ttttcttttgctttcc

SEQ ID NO: 5542185 - DNA, 18 bp, Homo sapiens
ttttcttttgttactgtt

SEQ ID NO: 5542186 - DNA, 19 bp, Homo sapiens
ttttcttttgttactgttc

SEQ ID NO: 5542187 - DNA, 21 bp, Homo sapiens
ttttcttttgttttcttcatt

SEQ ID NO: 5542188 - DNA, 15 bp, Homo sapiens
ttttctttttacata

SEQ ID NO: 5542189 - DNA, 18 bp, Homo sapiens
ttttctttttactgttga

SEQ ID NO: 5542190 - DNA, 20 bp, Homo sapiens
ttttctttttataactcatg

SEQ ID NO: 5542191 - DNA, 15 bp, Homo sapiens
ttttctttttctgtc

SEQ ID NO: 5542192 - DNA, 17 bp, Homo sapiens
ttttctttttcttaaga

SEQ ID NO: 5542193 - DNA, 21 bp, Homo sapiens
ttttctttttgaaacagtctt

SEQ ID NO: 5542194 - DNA, 22 bp, Homo sapiens
ttttcttttttaaatgtttctt

SEQ ID NO: 5542195 - DNA, 20 bp, Homo sapiens
ttttcttttttcttttggtc

SEQ ID NO: 5542196 - DNA, 18 bp, Homo sapiens
ttttcttttttgagtgtg

SEQ ID NO: 5542197 - DNA, 18 bp, Homo sapiens
ttttctttttttaactgg

SEQ ID NO: 5542198 - DNA, 21 bp, Homo sapiens
ttttctttttttaactggtga

SEQ ID NO: 5542199 - DNA, 16 bp, Homo sapiens
ttttgaaaaaagctca

SEQ ID NO: 5542200 - DNA, 19 bp, Homo sapiens
ttttgaaaaaagtatagga

SEQ ID NO: 5542201 - DNA, 21 bp, Homo sapiens
ttttgaaaaagtaggctgccg

SEQ ID NO: 5542202 - DNA, 13 bp, Homo sapiens
ttttgaaaaatat

SEQ ID NO: 5542203 - DNA, 23 bp, Homo sapiens
ttttgaaaaatattgctaaaagt

SEQ ID NO: 5542204 - DNA, 22 bp, Homo sapiens
ttttgaaaaattcctattgtga

SEQ ID NO: 5542205 - DNA, 21 bp, Homo sapiens
ttttgaaaaattgtctttcct

SEQ ID NO: 5542206 - DNA, 15 bp, Homo sapiens
ttttgaaaacactta

SEQ ID NO: 5542207 - DNA, 18 bp, Homo sapiens
ttttgaaaacccctggct

SEQ ID NO: 5542208 - DNA, 18 bp, Homo sapiens
ttttgaaaactacatttt

SEQ ID NO: 5542209 - DNA, 23 bp, Homo sapiens
ttttgaaaactacattttaacat

SEQ ID NO: 5542210 - DNA, 11 bp, Homo sapiens
ttttgaaaagt

SEQ ID NO: 5542211 - DNA, 20 bp, Homo sapiens
ttttgaaaatattttaccca

SEQ ID NO: 5542212 - DNA, 15 bp, Homo sapiens
ttttgaaaatcaaga

SEQ ID NO: 5542213 - DNA, 14 bp, Homo sapiens
ttttgaaaattatg

SEQ ID NO: 5542214 - DNA, 22 bp, Homo sapiens
ttttgaaaattatgcaaaagca

SEQ ID NO: 5542215 - DNA, 16 bp, Homo sapiens
ttttgaaacccacagt

SEQ ID NO: 5542216 - DNA, 20 bp, Homo sapiens
ttttgaaagaattctatttt

SEQ ID NO: 5542217 - DNA, 21 bp, Homo sapiens
ttttgaaagaattctattttg

SEQ ID NO: 5542218 - DNA, 18 bp, Homo sapiens
ttttgaaagacaaaattt

SEQ ID NO: 5542219 - DNA, 17 bp, Homo sapiens
ttttgaaagatgtatgg

SEQ ID NO: 5542220 - DNA, 17 bp, Homo sapiens
ttttgaaagtctgtcct

SEQ ID NO: 5542221 - DNA, 19 bp, Homo sapiens
ttttgaaatacctttgtag

SEQ ID NO: 5542222 - DNA, 22 bp, Homo sapiens
ttttgaaatacctttgtagtta

SEQ ID NO: 5542223 - DNA, 22 bp, Homo sapiens
ttttgaaatattaaaccctgga

SEQ ID NO: 5542224 - DNA, 23 bp, Homo sapiens
ttttgaaatcaatgcaagagtga

SEQ ID NO: 5542225 - DNA, 13 bp, Homo sapiens
ttttgaaatcacc

SEQ ID NO: 5542226 - DNA, 22 bp, Homo sapiens
ttttgaaatcagtaaacactgt

SEQ ID NO: 5542227 - DNA, 21 bp, Homo sapiens
ttttgaaatcccatcaggtca

SEQ ID NO: 5542228 - DNA, 11 bp, Homo sapiens
ttttgaaatga

SEQ ID NO: 5542229 - DNA, 17 bp, Homo sapiens
ttttgaaatgaaattta

SEQ ID NO: 5542230 - DNA, 17 bp, Homo sapiens
ttttgaaatgaactttg

SEQ ID NO: 5542231 - DNA, 16 bp, Homo sapiens
ttttgaaatgctgaaa

SEQ ID NO: 5542232 - DNA, 18 bp, Homo sapiens
ttttgaaatgctgaaaat

SEQ ID NO: 5542233 - DNA, 13 bp, Homo sapiens
ttttgaaatgtca

SEQ ID NO: 5542234 - DNA, 17 bp, Homo sapiens
ttttgaaatgtgaacgt

SEQ ID NO: 5542235 - DNA, 14 bp, Homo sapiens
ttttgaacttgtca

SEQ ID NO: 5542236 - DNA, 14 bp, Homo sapiens
ttttgaagaaaaca

SEQ ID NO: 5542237 - DNA, 12 bp, Homo sapiens
ttttgaagctgt

SEQ ID NO: 5542238 - DNA, 14 bp, Homo sapiens
ttttgaagctgttg

SEQ ID NO: 5542239 - DNA, 14 bp, Homo sapiens
ttttgaaggcaaaa

SEQ ID NO: 5542240 - DNA, 19 bp, Homo sapiens
ttttgaagtagtttgtata

SEQ ID NO: 5542241 - DNA, 12 bp, Homo sapiens
ttttgaagtgat

SEQ ID NO: 5542242 - DNA, 11 bp, Homo sapiens
ttttgaagttt

SEQ ID NO: 5542243 - DNA, 20 bp, Homo sapiens
ttttgaataaaaagtgaact

SEQ ID NO: 5542244 - DNA, 21 bp, Homo sapiens
ttttgaataccattaaaactg

SEQ ID NO: 5542245 - DNA, 15 bp, Homo sapiens
ttttgaatatgcctt

SEQ ID NO: 5542246 - DNA, 18 bp, Homo sapiens
ttttgaatattaagctaa

SEQ ID NO: 5542247 - DNA, 13 bp, Homo sapiens
ttttgaatcaata

SEQ ID NO: 5542248 - DNA, 20 bp, Homo sapiens
ttttgaatcaatctggcttc

SEQ ID NO: 5542249 - DNA, 14 bp, Homo sapiens
ttttgaatctataa

SEQ ID NO: 5542250 - DNA, 16 bp, Homo sapiens
ttttgaatctataaaa

SEQ ID NO: 5542251 - DNA, 14 bp, Homo sapiens
ttttgaatctttaa

SEQ ID NO: 5542252 - DNA, 22 bp, Homo sapiens
ttttgaatgcttcctgacaatc

SEQ ID NO: 5542253 - DNA, 21 bp, Homo sapiens
ttttgaattagattatttctg

SEQ ID NO: 5542254 - DNA, 16 bp, Homo sapiens
ttttgacacatgtgtg

SEQ ID NO: 5542255 - DNA, 18 bp, Homo sapiens
ttttgacactatatctgt

SEQ ID NO: 5542256 - DNA, 18 bp, Homo sapiens
ttttgacactgaaagttt

SEQ ID NO: 5542257 - DNA, 19 bp, Homo sapiens
ttttgacacttccattgtt

SEQ ID NO: 5542258 - DNA, 19 bp, Homo sapiens
ttttgacagactatttgct

SEQ ID NO: 5542259 - DNA, 19 bp, Homo sapiens
ttttgacagtgttgaaaat

SEQ ID NO: 5542260 - DNA, 23 bp, Homo sapiens
ttttgacagtgttgaaaatgttc

SEQ ID NO: 5542261 - DNA, 15 bp, Homo sapiens
ttttgacatggaaat

SEQ ID NO: 5542262 - DNA, 19 bp, Homo sapiens
ttttgacatttacaggagg

SEQ ID NO: 5542263 - DNA, 18 bp, Homo sapiens
ttttgaccctcattcttt

SEQ ID NO: 5542264 - DNA, 18 bp, Homo sapiens
ttttgacctgtggtgcaa

SEQ ID NO: 5542265 - DNA, 20 bp, Homo sapiens
ttttgaccttcatttcatgt

SEQ ID NO: 5542266 - DNA, 20 bp, Homo sapiens
ttttgacggatgattggatt

SEQ ID NO: 5542267 - DNA, 21 bp, Homo sapiens
ttttgactctggcaaagcttt

SEQ ID NO: 5542268 - DNA, 17 bp, Homo sapiens
ttttgacttaaagcaga

SEQ ID NO: 5542269 - DNA, 18 bp, Homo sapiens
ttttgacttaatgtgatt

SEQ ID NO: 5542270 - DNA, 13 bp, Homo sapiens
ttttgtcttcaac

SEQ ID NO: 5542271 - DNA, 17 bp, Homo sapiens
ttttgtctttcaaattt

SEQ ID NO: 5542272 - DNA, 22 bp, Homo sapiens
ttttgtcttttaatccatttca

SEQ ID NO: 5542273 - DNA, 13 bp, Homo sapiens
ttttgtgaaagct

SEQ ID NO: 5542274 - DNA, 22 bp, Homo sapiens
ttttgtgaaatgaaaacatgta

SEQ ID NO: 5542275 - DNA, 24 bp, Homo sapiens
ttttgtgaaatgaaaacatgtaat

SEQ ID NO: 5542276 - DNA, 12 bp, Homo sapiens
ttttgtgaaatt

SEQ ID NO: 5542277 - DNA, 22 bp, Homo sapiens
ttttgtgaaatttttcatattt

SEQ ID NO: 5542278 - DNA, 21 bp, Homo sapiens
ttttgtgaagaaacatttatc

SEQ ID NO: 5542279 - DNA, 19 bp, Homo sapiens
ttttgtgaatggattggat

SEQ ID NO: 5542280 - DNA, 24 bp, Homo sapiens
ttttgtgaatggttgcaaagtgtt

SEQ ID NO: 5542281 - DNA, 13 bp, Homo sapiens
ttttgtgagatgt

SEQ ID NO: 5542282 - DNA, 20 bp, Homo sapiens
ttttgtgatgcaaataaata

SEQ ID NO: 5542283 - DNA, 19 bp, Homo sapiens
ttttgtgatttagaactgt

SEQ ID NO: 5542284 - DNA, 12 bp, Homo sapiens
ttttgtgcacag

SEQ ID NO: 5542285 - DNA, 19 bp, Homo sapiens
ttttgtgcattctttggta

SEQ ID NO: 5542286 - DNA, 21 bp, Homo sapiens
ttttgtgccattatatttgca

SEQ ID NO: 5542287 - DNA, 16 bp, Homo sapiens
ttttgtgctctttcct

SEQ ID NO: 5542288 - DNA, 11 bp, Homo sapiens
ttttgtgcttt

SEQ ID NO: 5542289 - DNA, 19 bp, Homo sapiens
ttttgtggctgatttcaaa

SEQ ID NO: 5542290 - DNA, 17 bp, Homo sapiens
ttttgtgggcttaattg

SEQ ID NO: 5542291 - DNA, 21 bp, Homo sapiens
ttttgtggtcattaagcattg

SEQ ID NO: 5542292 - DNA, 22 bp, Homo sapiens
ttttgtggttctattttacttt

SEQ ID NO: 5542293 - DNA, 13 bp, Homo sapiens
ttttgtgtacagt

SEQ ID NO: 5542294 - DNA, 11 bp, Homo sapiens
ttttgtgtata

SEQ ID NO: 5542295 - DNA, 21 bp, Homo sapiens
ttttgtgtataatgtgcttta

SEQ ID NO: 5542296 - DNA, 12 bp, Homo sapiens
ttttgtgtatgt

SEQ ID NO: 5542297 - DNA, 16 bp, Homo sapiens
ttttgtgtatgtactt

SEQ ID NO: 5542298 - DNA, 11 bp, Homo sapiens
ttttgtgtcct

SEQ ID NO: 5542299 - DNA, 13 bp, Homo sapiens
ttttgtgtcctcc

SEQ ID NO: 5542300 - DNA, 22 bp, Homo sapiens
ttttgtgtcctgctctgtttgg

SEQ ID NO: 5542301 - DNA, 18 bp, Homo sapiens
ttttgtgtgaccaactgt

SEQ ID NO: 5542302 - DNA, 13 bp, Homo sapiens
ttttgtgtgatgc

SEQ ID NO: 5542303 - DNA, 17 bp, Homo sapiens
ttttgtgtgtatttgct

SEQ ID NO: 5542304 - DNA, 20 bp, Homo sapiens
ttttgtgtgtatttgctaat

SEQ ID NO: 5542305 - DNA, 16 bp, Homo sapiens
ttttgtgtgtgctgga

SEQ ID NO: 5542306 - DNA, 17 bp, Homo sapiens
ttttgtgttactgcagt

SEQ ID NO: 5542307 - DNA, 18 bp, Homo sapiens
ttttgtgttcctatggaa

SEQ ID NO: 5542308 - DNA, 19 bp, Homo sapiens
ttttgtgttcctatggaaa

SEQ ID NO: 5542309 - DNA, 17 bp, Homo sapiens
ttttgtgttcctctttg

SEQ ID NO: 5542310 - DNA, 16 bp, Homo sapiens
ttttgtgttgtacaat

SEQ ID NO: 5542311 - DNA, 12 bp, Homo sapiens
ttttgtgtttat

SEQ ID NO: 5542312 - DNA, 13 bp, Homo sapiens
ttttgtgtttcta

SEQ ID NO: 5542313 - DNA, 20 bp, Homo sapiens
ttttgtgttttcttgtaaat

SEQ ID NO: 5542314 - DNA, 13 bp, Homo sapiens
ttttgttaacatg

SEQ ID NO: 5542315 - DNA, 15 bp, Homo sapiens
ttttgttaactgatt

SEQ ID NO: 5542316 - DNA, 16 bp, Homo sapiens
ttttgttaactgattt

SEQ ID NO: 5542317 - DNA, 22 bp, Homo sapiens
ttttgttaataataagataatg

SEQ ID NO: 5542318 - DNA, 13 bp, Homo sapiens
ttttgttacatag

SEQ ID NO: 5542319 - DNA, 13 bp, Homo sapiens
ttttgttactgtt

SEQ ID NO: 5542320 - DNA, 21 bp, Homo sapiens
ttttgttactgttcttgctgc

SEQ ID NO: 5542321 - DNA, 22 bp, Homo sapiens
ttttgttactgttcttgctgct

SEQ ID NO: 5542322 - DNA, 23 bp, Homo sapiens
ttttgttactgttcttgctgcta

SEQ ID NO: 5542323 - DNA, 17 bp, Homo sapiens
ttttgttagtttacaat

SEQ ID NO: 5542324 - DNA, 14 bp, Homo sapiens
ttttgttatagaat

SEQ ID NO: 5542325 - DNA, 16 bp, Homo sapiens
ttttgttatagaatac

SEQ ID NO: 5542326 - DNA, 11 bp, Homo sapiens
ttttgttattc

SEQ ID NO: 5542327 - DNA, 20 bp, Homo sapiens
ttttgttattccatcaataa

SEQ ID NO: 5542328 - DNA, 23 bp, Homo sapiens
ttttgttattccatcaataaatg

SEQ ID NO: 5542329 - DNA, 21 bp, Homo sapiens
ttttgttcaccttctgtgcat

SEQ ID NO: 5542330 - DNA, 17 bp, Homo sapiens
ttttgttcatacatatt

SEQ ID NO: 5542331 - DNA, 13 bp, Homo sapiens
ttttgttccaaaa

SEQ ID NO: 5542332 - DNA, 21 bp, Homo sapiens
ttttgttccacaagttaaata

SEQ ID NO: 5542333 - DNA, 21 bp, Homo sapiens
ttttgttccacattctctctc

SEQ ID NO: 5542334 - DNA, 15 bp, Homo sapiens
ttttgttcccctcct

SEQ ID NO: 5542335 - DNA, 13 bp, Homo sapiens
ttttgttccctat

SEQ ID NO: 5542336 - DNA, 13 bp, Homo sapiens
ttttgttcctgtg

SEQ ID NO: 5542337 - DNA, 14 bp, Homo sapiens
ttttgttcctgttt

SEQ ID NO: 5542338 - DNA, 15 bp, Homo sapiens
ttttgttctacatga

SEQ ID NO: 5542339 - DNA, 17 bp, Homo sapiens
ttttgttcttaaaaatg

SEQ ID NO: 5542340 - DNA, 13 bp, Homo sapiens
ttttgttgacatt

SEQ ID NO: 5542341 - DNA, 13 bp, Homo sapiens
ttttgttgcactg

SEQ ID NO: 5542342 - DNA, 16 bp, Homo sapiens
ttttgttgccccagaa

SEQ ID NO: 5542343 - DNA, 13 bp, Homo sapiens
ttttgttggcata

SEQ ID NO: 5542344 - DNA, 21 bp, Homo sapiens
ttttgttgtgcactagtgcaa

SEQ ID NO: 5542345 - DNA, 13 bp, Homo sapiens
ttttgttgttcct

SEQ ID NO: 5542346 - DNA, 16 bp, Homo sapiens
ttttgttgttcctcta

SEQ ID NO: 5542347 - DNA, 21 bp, Homo sapiens
ttttgttgttcctctatactt

SEQ ID NO: 5542348 - DNA, 22 bp, Homo sapiens
ttttgttgttgttgtttgtaaa

SEQ ID NO: 5542349 - DNA, 18 bp, Homo sapiens
ttttgttgtttgtttagt

SEQ ID NO: 5542350 - DNA, 16 bp, Homo sapiens
ttttgtttatttcatt

SEQ ID NO: 5542351 - DNA, 18 bp, Homo sapiens
ttttgtttcaatgaggtg

SEQ ID NO: 5542352 - DNA, 12 bp, Homo sapiens
ttttgtttcact

SEQ ID NO: 5542353 - DNA, 22 bp, Homo sapiens
ttttgtttcactctttccagat

SEQ ID NO: 5542354 - DNA, 13 bp, Homo sapiens
ttttgtttcactg

SEQ ID NO: 5542355 - DNA, 14 bp, Homo sapiens
ttttgtttcactgg

SEQ ID NO: 5542356 - DNA, 19 bp, Homo sapiens
ttttgtttcatattgatgt

SEQ ID NO: 5542357 - DNA, 22 bp, Homo sapiens
ttttgtttggaccaaaaaccag

SEQ ID NO: 5542358 - DNA, 22 bp, Homo sapiens
ttttgtttggtattgtatttat

SEQ ID NO: 5542359 - DNA, 16 bp, Homo sapiens
ttttgtttgtaatcct

SEQ ID NO: 5542360 - DNA, 16 bp, Homo sapiens
ttttgttttaaaatta

SEQ ID NO: 5542361 - DNA, 13 bp, Homo sapiens
ttttgttttacaa

SEQ ID NO: 5542362 - DNA, 14 bp, Homo sapiens
ttttgttttacttt

SEQ ID NO: 5542363 - DNA, 15 bp, Homo sapiens
ttttgttttcattat

SEQ ID NO: 5542364 - DNA, 15 bp, Homo sapiens
ttttgttttgttgga

SEQ ID NO: 5542365 - DNA, 17 bp, Homo sapiens
ttttgtttttacttttg

SEQ ID NO: 5542366 - DNA, 20 bp, Homo sapiens
ttttgtttttccagttccag

SEQ ID NO: 5542367 - DNA, 19 bp, Homo sapiens
ttttgtttttgtaaaaaag

SEQ ID NO: 5542368 - DNA, 16 bp, Homo sapiens
ttttgttttttgagtc

SEQ ID NO: 5542369 - DNA, 22 bp, Homo sapiens
tttttaaaaaaaatgtgaaatt

SEQ ID NO: 5542370 - DNA, 14 bp, Homo sapiens
tttttaaaaaaact

SEQ ID NO: 5542371 - DNA, 14 bp, Homo sapiens
tttttaaaaaaaga

SEQ ID NO: 5542372 - DNA, 15 bp, Homo sapiens
tttttaaaaaaagaa

SEQ ID NO: 5542373 - DNA, 23 bp, Homo sapiens
tttttaaaaaaataaaacagtat

SEQ ID NO: 5542374 - DNA, 22 bp, Homo sapiens
tttttaaaaaaatttttgcaaa

SEQ ID NO: 5542375 - DNA, 23 bp, Homo sapiens
tttttaaaaaaatttttgcaaat

SEQ ID NO: 5542376 - DNA, 13 bp, Homo sapiens
tttttaaaaaaga

SEQ ID NO: 5542377 - DNA, 23 bp, Homo sapiens
tttttaaaaaagaaaaagacaat

SEQ ID NO: 5542378 - DNA, 22 bp, Homo sapiens
tttttaaaaaagacatttaaag

SEQ ID NO: 5542379 - DNA, 15 bp, Homo sapiens
tttttaaaaaagctt

SEQ ID NO: 5542380 - DNA, 23 bp, Homo sapiens
tttttaaaaaataccattgaaat

SEQ ID NO: 5542381 - DNA, 18 bp, Homo sapiens
tttttaaaaaatattttc

SEQ ID NO: 5542382 - DNA, 17 bp, Homo sapiens
tttttaaaaacaaacaa

SEQ ID NO: 5542383 - DNA, 13 bp, Homo sapiens
tttttaaaaacct

SEQ ID NO: 5542384 - DNA, 18 bp, Homo sapiens
tttttaaaaactaaaaaa

SEQ ID NO: 5542385 - DNA, 21 bp, Homo sapiens
tttttaaaaagaaaatcagtt

SEQ ID NO: 5542386 - DNA, 22 bp, Homo sapiens
tttttaaaaaggcctttgggat

SEQ ID NO: 5542387 - DNA, 19 bp, Homo sapiens
tttttaaaaaggtaaatgg

SEQ ID NO: 5542388 - DNA, 14 bp, Homo sapiens
tttttaaaaagtgt

SEQ ID NO: 5542389 - DNA, 15 bp, Homo sapiens
tttttaaaaataaag

SEQ ID NO: 5542390 - DNA, 22 bp, Homo sapiens
tttttaaaaataaatctaaatg

SEQ ID NO: 5542391 - DNA, 18 bp, Homo sapiens
tttttaaaacacatgttt

SEQ ID NO: 5542392 - DNA, 23 bp, Homo sapiens
tttttaaaacacatgtttttata

SEQ ID NO: 5542393 - DNA, 13 bp, Homo sapiens
tttttaaaacact

SEQ ID NO: 5542394 - DNA, 20 bp, Homo sapiens
tttttaaaactaatgagtat

SEQ ID NO: 5542395 - DNA, 12 bp, Homo sapiens
tttttaaaagaa

SEQ ID NO: 5542396 - DNA, 14 bp, Homo sapiens
tttttaaaagactt

SEQ ID NO: 5542397 - DNA, 20 bp, Homo sapiens
tttttaaaagagacaaactg

SEQ ID NO: 5542398 - DNA, 22 bp, Homo sapiens
tttttaaaagccttccagtttt

SEQ ID NO: 5542399 - DNA, 22 bp, Homo sapiens
tttttaaaagtttcaatgtgat

SEQ ID NO: 5542400 - DNA, 14 bp, Homo sapiens
tttttaaaataaaa

SEQ ID NO: 5542401 - DNA, 16 bp, Homo sapiens
tttttaaaataaaaat

SEQ ID NO: 5542402 - DNA, 14 bp, Homo sapiens
tttttaaaataaac

SEQ ID NO: 5542403 - DNA, 13 bp, Homo sapiens
tttttaaaatact

SEQ ID NO: 5542404 - DNA, 14 bp, Homo sapiens
tttttaaaatagaa

SEQ ID NO: 5542405 - DNA, 12 bp, Homo sapiens
tttttaaaatat

SEQ ID NO: 5542406 - DNA, 13 bp, Homo sapiens
tttttaaaatata

SEQ ID NO: 5542407 - DNA, 17 bp, Homo sapiens
tttttaaaatatctttt

SEQ ID NO: 5542408 - DNA, 13 bp, Homo sapiens
tttttaaaatatt

SEQ ID NO: 5542409 - DNA, 16 bp, Homo sapiens
tttttaaaatatttat

SEQ ID NO: 5542410 - DNA, 17 bp, Homo sapiens
tttttaaaatatttatt

SEQ ID NO: 5542411 - DNA, 13 bp, Homo sapiens
tttttaaaatcca

SEQ ID NO: 5542412 - DNA, 14 bp, Homo sapiens
tttttaaaatccag

SEQ ID NO: 5542413 - DNA, 14 bp, Homo sapiens
tttttaaaatctta

SEQ ID NO: 5542414 - DNA, 19 bp, Homo sapiens
tttttaaaatcttattaaa

SEQ ID NO: 5542415 - DNA, 22 bp, Homo sapiens
tttttaaaatgctgctttgtcc

SEQ ID NO: 5542416 - DNA, 19 bp, Homo sapiens
tttttaaaatggtgcttaa

SEQ ID NO: 5542417 - DNA, 12 bp, Homo sapiens
tttttaaaattt

SEQ ID NO: 5542418 - DNA, 16 bp, Homo sapiens
tttttaaactgtacag

SEQ ID NO: 5542419 - DNA, 17 bp, Homo sapiens
tttttaaacttgtaaag

SEQ ID NO: 5542420 - DNA, 12 bp, Homo sapiens
tttttaaagaaa

SEQ ID NO: 5542421 - DNA, 13 bp, Homo sapiens
tttttaaagaaaa

SEQ ID NO: 5542422 - DNA, 16 bp, Homo sapiens
tttttaaagaatccaa

SEQ ID NO: 5542423 - DNA, 24 bp, Homo sapiens
tttttaaagaatccaagacaaact

SEQ ID NO: 5542424 - DNA, 15 bp, Homo sapiens
tttttaaagaatgtt

SEQ ID NO: 5542425 - DNA, 12 bp, Homo sapiens
tttttaaagaca

SEQ ID NO: 5542426 - DNA, 17 bp, Homo sapiens
tttttaaagacagggtc

SEQ ID NO: 5542427 - DNA, 14 bp, Homo sapiens
tttttaaagactgt

SEQ ID NO: 5542428 - DNA, 14 bp, Homo sapiens
tttttaaagcctgg

SEQ ID NO: 5542429 - DNA, 19 bp, Homo sapiens
tttttaaagcctggcttct

SEQ ID NO: 5542430 - DNA, 12 bp, Homo sapiens
tttttaaagctt

SEQ ID NO: 5542431 - DNA, 16 bp, Homo sapiens
tttttaaagcttttga

SEQ ID NO: 5542432 - DNA, 18 bp, Homo sapiens
tttttaaaggacaaacag

SEQ ID NO: 5542433 - DNA, 19 bp, Homo sapiens
tttttaaagtaaacttgtg

SEQ ID NO: 5542434 - DNA, 20 bp, Homo sapiens
tttttaaagtgtttctgtta

SEQ ID NO: 5542435 - DNA, 19 bp, Homo sapiens
tttttaaagtttgttcact

SEQ ID NO: 5542436 - DNA, 20 bp, Homo sapiens
tttttaaagtttgttcactt

SEQ ID NO: 5542437 - DNA, 15 bp, Homo sapiens
tttttaaagttttgt

SEQ ID NO: 5542438 - DNA, 16 bp, Homo sapiens
tttttaaataaaagca

SEQ ID NO: 5542439 - DNA, 18 bp, Homo sapiens
tttttaaataaaagcaca

SEQ ID NO: 5542440 - DNA, 14 bp, Homo sapiens
tttttaaataaaat

SEQ ID NO: 5542441 - DNA, 14 bp, Homo sapiens
tttttaaataaact

SEQ ID NO: 5542442 - DNA, 15 bp, Homo sapiens
tttttaaataaactt

SEQ ID NO: 5542443 - DNA, 17 bp, Homo sapiens
tttttaaataaactttt

SEQ ID NO: 5542444 - DNA, 23 bp, Homo sapiens
tttttaaataaactttttttcaa

SEQ ID NO: 5542445 - DNA, 14 bp, Homo sapiens
tttttaaatatatt

SEQ ID NO: 5542446 - DNA, 20 bp, Homo sapiens
tttttaaatcaaaaactttt

SEQ ID NO: 5542447 - DNA, 16 bp, Homo sapiens
tttttaaatcaaggaa

SEQ ID NO: 5542448 - DNA, 13 bp, Homo sapiens
tttttaaatcatt

SEQ ID NO: 5542449 - DNA, 15 bp, Homo sapiens
tttttaaatcattca

SEQ ID NO: 5542450 - DNA, 19 bp, Homo sapiens
tttttgaagtcttgtataa

SEQ ID NO: 5542451 - DNA, 14 bp, Homo sapiens
tttttgaagtgtag

SEQ ID NO: 5542452 - DNA, 24 bp, Homo sapiens
tttttgaagtgtaggcagacacag

SEQ ID NO: 5542453 - DNA, 14 bp, Homo sapiens
tttttgaagtgttg

SEQ ID NO: 5542454 - DNA, 18 bp, Homo sapiens
tttttgaagttctggcaa

SEQ ID NO: 5542455 - DNA, 12 bp, Homo sapiens
tttttgaataaa

SEQ ID NO: 5542456 - DNA, 22 bp, Homo sapiens
tttttgaatgcctcataaatta

SEQ ID NO: 5542457 - DNA, 21 bp, Homo sapiens
tttttgaatttaaataaagtt

SEQ ID NO: 5542458 - DNA, 17 bp, Homo sapiens
tttttgacacttccatt

SEQ ID NO: 5542459 - DNA, 13 bp, Homo sapiens
tttttgaccagtt

SEQ ID NO: 5542460 - DNA, 16 bp, Homo sapiens
tttttgagacagggtc

SEQ ID NO: 5542461 - DNA, 21 bp, Homo sapiens
tttttgagatactattttcat

SEQ ID NO: 5542462 - DNA, 16 bp, Homo sapiens
tttttgagtaaaactt

SEQ ID NO: 5542463 - DNA, 13 bp, Homo sapiens
tttttgagtgtat

SEQ ID NO: 5542464 - DNA, 13 bp, Homo sapiens
tttttgatactaa

SEQ ID NO: 5542465 - DNA, 16 bp, Homo sapiens
tttttgatcaaaaact

SEQ ID NO: 5542466 - DNA, 20 bp, Homo sapiens
tttttgatcctctactgtgc

SEQ ID NO: 5542467 - DNA, 18 bp, Homo sapiens
tttttgatgactacctca

SEQ ID NO: 5542468 - DNA, 20 bp, Homo sapiens
tttttgatgactacctcaga

SEQ ID NO: 5542469 - DNA, 21 bp, Homo sapiens
tttttgatgactacctcagaa

SEQ ID NO: 5542470 - DNA, 17 bp, Homo sapiens
tttttgatgtataaaac

SEQ ID NO: 5542471 - DNA, 14 bp, Homo sapiens
tttttgatgtatat

SEQ ID NO: 5542472 - DNA, 13 bp, Homo sapiens
tttttgatgtcag

SEQ ID NO: 5542473 - DNA, 15 bp, Homo sapiens
tttttgcaagtgaag

SEQ ID NO: 5542474 - DNA, 18 bp, Homo sapiens
tttttgcaagtgaaggtt

SEQ ID NO: 5542475 - DNA, 22 bp, Homo sapiens
tttttgcaataatgcagtatgg

SEQ ID NO: 5542476 - DNA, 18 bp, Homo sapiens
tttttgcaggagcagtat

SEQ ID NO: 5542477 - DNA, 14 bp, Homo sapiens
tttttgcagtaact

SEQ ID NO: 5542478 - DNA, 16 bp, Homo sapiens
tttttgcagtaactgt

SEQ ID NO: 5542479 - DNA, 13 bp, Homo sapiens
tttttgcatgaaa

SEQ ID NO: 5542480 - DNA, 19 bp, Homo sapiens
tttttgcatgcatgcaaat

SEQ ID NO: 5542481 - DNA, 12 bp, Homo sapiens
tttttgcatttt

SEQ ID NO: 5542482 - DNA, 12 bp, Homo sapiens
tttttgccaaaa

SEQ ID NO: 5542483 - DNA, 21 bp, Homo sapiens
tttttgccagttttccctgga

SEQ ID NO: 5542484 - DNA, 23 bp, Homo sapiens
tttttgccctgcgtcccttctct

SEQ ID NO: 5542485 - DNA, 24 bp, Homo sapiens
tttttgccctggagcctcagcagc

SEQ ID NO: 5542486 - DNA, 22 bp, Homo sapiens
tttttgcctaaatccaaagaaa

SEQ ID NO: 5542487 - DNA, 12 bp, Homo sapiens
tttttgctaatt

SEQ ID NO: 5542488 - DNA, 16 bp, Homo sapiens
tttttgctataatcat

SEQ ID NO: 5542489 - DNA, 20 bp, Homo sapiens
tttttgctataatcattagt

SEQ ID NO: 5542490 - DNA, 14 bp, Homo sapiens
tttttgctctaaaa

SEQ ID NO: 5542491 - DNA, 14 bp, Homo sapiens
tttttgctctccct

SEQ ID NO: 5542492 - DNA, 19 bp, Homo sapiens
tttttgctcttctgtatgt

SEQ ID NO: 5542493 - DNA, 12 bp, Homo sapiens
tttttgctgatt

SEQ ID NO: 5542494 - DNA, 23 bp, Homo sapiens
tttttgctgctgcctctttccct

SEQ ID NO: 5542495 - DNA, 21 bp, Homo sapiens
tttttgcttattttacaaata

SEQ ID NO: 5542496 - DNA, 17 bp, Homo sapiens
tttttgctttctgaaat

SEQ ID NO: 5542497 - DNA, 9 bp, Homo sapiens
tttttggaa

SEQ ID NO: 5542498 - DNA, 18 bp, Homo sapiens
tttttggaaaagaataaa

SEQ ID NO: 5542499 - DNA, 15 bp, Homo sapiens
tttttggaaactgtt

SEQ ID NO: 5542500 - DNA, 15 bp, Homo sapiens
tttttggaaagtcag

SEQ ID NO: 5542501 - DNA, 19 bp, Homo sapiens
tttttggagaaatgtcata

SEQ ID NO: 5542502 - DNA, 21 bp, Homo sapiens
tttttggagaaggttatcaaa

SEQ ID NO: 5542503 - DNA, 17 bp, Homo sapiens
tttttggattgacagta

SEQ ID NO: 5542504 - DNA, 17 bp, Homo sapiens
tttttggcaaagccaga

SEQ ID NO: 5542505 - DNA, 20 bp, Homo sapiens
tttttggcaacctggctctg

SEQ ID NO: 5542506 - DNA, 24 bp, Homo sapiens
tttttggcataacataaatctgtg

SEQ ID NO: 5542507 - DNA, 22 bp, Homo sapiens
tttttggcattcctctaatgtt

SEQ ID NO: 5542508 - DNA, 17 bp, Homo sapiens
tttttggcctgtttgat

SEQ ID NO: 5542509 - DNA, 20 bp, Homo sapiens
tttttggcgtggctgactta

SEQ ID NO: 5542510 - DNA, 22 bp, Homo sapiens
tttttgggaaaagaaaagtcaa

SEQ ID NO: 5542511 - DNA, 22 bp, Homo sapiens
tttttggggaaaaaagcacata

SEQ ID NO: 5542512 - DNA, 12 bp, Homo sapiens
tttttggggata

SEQ ID NO: 5542513 - DNA, 21 bp, Homo sapiens
tttttggggggaatgacatgt

SEQ ID NO: 5542514 - DNA, 23 bp, Homo sapiens
tttttggtaaatttttgaaaaat

SEQ ID NO: 5542515 - DNA, 20 bp, Homo sapiens
tttttggtaatatatatatt

SEQ ID NO: 5542516 - DNA, 16 bp, Homo sapiens
tttttggtagtttctg

SEQ ID NO: 5542517 - DNA, 18 bp, Homo sapiens
tttttggtatggtaaaga

SEQ ID NO: 5542518 - DNA, 12 bp, Homo sapiens
tttttggtattt

SEQ ID NO: 5542519 - DNA, 16 bp, Homo sapiens
tttttggtatttatgt

SEQ ID NO: 5542520 - DNA, 19 bp, Homo sapiens
tttttggtgattcaaatgg

SEQ ID NO: 5542521 - DNA, 18 bp, Homo sapiens
tttttggtggatgtaaat

SEQ ID NO: 5542522 - DNA, 19 bp, Homo sapiens
tttttggtggatgtaaata

SEQ ID NO: 5542523 - DNA, 22 bp, Homo sapiens
tttttggtgtatagaagtttgt

SEQ ID NO: 5542524 - DNA, 15 bp, Homo sapiens
tttttggttgtttgc

SEQ ID NO: 5542525 - DNA, 20 bp, Homo sapiens
tttttggtttcttattcaaa

SEQ ID NO: 5542526 - DNA, 17 bp, Homo sapiens
tttttggttttctcctt

SEQ ID NO: 5542527 - DNA, 14 bp, Homo sapiens
tttttgtaaaaact

SEQ ID NO: 5542528 - DNA, 15 bp, Homo sapiens
tttttgtaaaaactt

SEQ ID NO: 5542529 - DNA, 23 bp, Homo sapiens
tttttgtaaactggaattaaaag

SEQ ID NO: 5542530 - DNA, 14 bp, Homo sapiens
tttttgtaaagatt

SEQ ID NO: 5542531 - DNA, 19 bp, Homo sapiens
tttttgtaaagatttctgt

SEQ ID NO: 5542532 - DNA, 22 bp, Homo sapiens
tttttgtaaagcccttgcacag

SEQ ID NO: 5542533 - DNA, 14 bp, Homo sapiens
tttttgtaaagtgt

SEQ ID NO: 5542534 - DNA, 23 bp, Homo sapiens
tttttgtaaatgctgtaaatatt

SEQ ID NO: 5542535 - DNA, 16 bp, Homo sapiens
tttttgtaaatgtgta

SEQ ID NO: 5542536 - DNA, 20 bp, Homo sapiens
tttttgtaaatgtgtacata

SEQ ID NO: 5542537 - DNA, 21 bp, Homo sapiens
tttttgtaaccatatgattga

SEQ ID NO: 5542538 - DNA, 19 bp, Homo sapiens
tttttgtaactacaaagct

SEQ ID NO: 5542539 - DNA, 18 bp, Homo sapiens
tttttgtaacttcaaata

SEQ ID NO: 5542540 - DNA, 17 bp, Homo sapiens
tttttgtaataacattt

SEQ ID NO: 5542541 - DNA, 19 bp, Homo sapiens
tttttgtaataacatttaa

SEQ ID NO: 5542542 - DNA, 22 bp, Homo sapiens
tttttgtaataagcaatcaagg

SEQ ID NO: 5542543 - DNA, 16 bp, Homo sapiens
tttttgtaatataaga

SEQ ID NO: 5542544 - DNA, 18 bp, Homo sapiens
tttttgtaatataagaca

SEQ ID NO: 5542545 - DNA, 19 bp, Homo sapiens
tttttgtaatgcactgttt

SEQ ID NO: 5542546 - DNA, 12 bp, Homo sapiens
tttttgtacact

SEQ ID NO: 5542547 - DNA, 18 bp, Homo sapiens
tttttgtacagtttgctg

SEQ ID NO: 5542548 - DNA, 12 bp, Homo sapiens
tttttgtacatc

SEQ ID NO: 5542549 - DNA, 13 bp, Homo sapiens
tttttgtacatta

SEQ ID NO: 5542550 - DNA, 14 bp, Homo sapiens
tttttgtacattat

SEQ ID NO: 5542551 - DNA, 21 bp, Homo sapiens
tttttgtacatttggaacagt

SEQ ID NO: 5542552 - DNA, 20 bp, Homo sapiens
tttttgtaccatattgctct

SEQ ID NO: 5542553 - DNA, 21 bp, Homo sapiens
tttttgtacgttatatattgt

SEQ ID NO: 5542554 - DNA, 23 bp, Homo sapiens
tttttgtacgttatatattgtat

SEQ ID NO: 5542555 - DNA, 12 bp, Homo sapiens
tttttgtactgt

SEQ ID NO: 5542556 - DNA, 14 bp, Homo sapiens
tttttgtactgtgc

SEQ ID NO: 5542557 - DNA, 19 bp, Homo sapiens
tttttgtagagacagggtt

SEQ ID NO: 5542558 - DNA, 19 bp, Homo sapiens
tttttgtagagccagggtc

SEQ ID NO: 5542559 - DNA, 21 bp, Homo sapiens
tttttgtagcactgacagatt

SEQ ID NO: 5542560 - DNA, 16 bp, Homo sapiens
tttttgtagccttcct

SEQ ID NO: 5542561 - DNA, 21 bp, Homo sapiens
tttttgtagctgctatatatt

SEQ ID NO: 5542562 - DNA, 12 bp, Homo sapiens
tttttgtataaa

SEQ ID NO: 5542563 - DNA, 20 bp, Homo sapiens
tttttgtataaaaaggaaat

SEQ ID NO: 5542564 - DNA, 12 bp, Homo sapiens
tttttgtatctt

SEQ ID NO: 5542565 - DNA, 16 bp, Homo sapiens
tttttgtatgcttaaa

SEQ ID NO: 5542566 - DNA, 11 bp, Homo sapiens
tttttgtattc

SEQ ID NO: 5542567 - DNA, 11 bp, Homo sapiens
tttttgtattt

SEQ ID NO: 5542568 - DNA, 13 bp, Homo sapiens
tttttgtatttct

SEQ ID NO: 5542569 - DNA, 17 bp, Homo sapiens
tttttgtcaacattgtg

SEQ ID NO: 5542570 - DNA, 17 bp, Homo sapiens
tttttgtccatcttgtt

SEQ ID NO: 5542571 - DNA, 20 bp, Homo sapiens
tttttgtctatgaagttgct

SEQ ID NO: 5542572 - DNA, 17 bp, Homo sapiens
tttttgtcttattgaaa

SEQ ID NO: 5542573 - DNA, 14 bp, Homo sapiens
tttttgtcttgcat

SEQ ID NO: 5542574 - DNA, 21 bp, Homo sapiens
tttttgtgaagacggcacggt

SEQ ID NO: 5542575 - DNA, 23 bp, Homo sapiens
tttttgtgccattatatttgcat

SEQ ID NO: 5542576 - DNA, 17 bp, Homo sapiens
tttttgtgggagataaa

SEQ ID NO: 5542577 - DNA, 11 bp, Homo sapiens
tttttgtgggg

SEQ ID NO: 5542578 - DNA, 13 bp, Homo sapiens
tttttgtgtatgt

SEQ ID NO: 5542579 - DNA, 14 bp, Homo sapiens
tttttgtgtatgta

SEQ ID NO: 5542580 - DNA, 15 bp, Homo sapiens
tttttgtgtatttgt

SEQ ID NO: 5542581 - DNA, 21 bp, Homo sapiens
tttttgtgtgttctttaaata

SEQ ID NO: 5542582 - DNA, 14 bp, Homo sapiens
tttttgtgttttct

SEQ ID NO: 5542583 - DNA, 13 bp, Homo sapiens
tttttgttaatca

SEQ ID NO: 5542584 - DNA, 12 bp, Homo sapiens
tttttgttacat

SEQ ID NO: 5542585 - DNA, 19 bp, Homo sapiens
tttttgttaggctgtaaag

SEQ ID NO: 5542586 - DNA, 22 bp, Homo sapiens
tttttgttcaccttctgtgcat

SEQ ID NO: 5542587 - DNA, 11 bp, Homo sapiens
tttttgttcat

SEQ ID NO: 5542588 - DNA, 22 bp, Homo sapiens
tttttgttccacaagttaaata

SEQ ID NO: 5542589 - DNA, 12 bp, Homo sapiens
tttttgttccct

SEQ ID NO: 5542590 - DNA, 14 bp, Homo sapiens
tttttgttcctgtg

SEQ ID NO: 5542591 - DNA, 13 bp, Homo sapiens
tttttgttgacat

SEQ ID NO: 5542592 - DNA, 20 bp, Homo sapiens
tttttgttgcagtgtagttt

SEQ ID NO: 5542593 - DNA, 19 bp, Homo sapiens
tttttgttggagtgtttct

SEQ ID NO: 5542594 - DNA, 14 bp, Homo sapiens
tttttgtttctaac

SEQ ID NO: 5542595 - DNA, 20 bp, Homo sapiens
tttttgtttctgagaaaaga

SEQ ID NO: 5542596 - DNA, 22 bp, Homo sapiens
tttttgtttctttgtgtttgct

SEQ ID NO: 5542597 - DNA, 13 bp, Homo sapiens
tttttgtttgcag

SEQ ID NO: 5542598 - DNA, 12 bp, Homo sapiens
tttttgtttgcc

SEQ ID NO: 5542599 - DNA, 16 bp, Homo sapiens
tttttgtttggtataa

SEQ ID NO: 5542600 - DNA, 15 bp, Homo sapiens
tttttgtttgtactg

SEQ ID NO: 5542601 - DNA, 18 bp, Homo sapiens
tttttgtttgtttttgct

SEQ ID NO: 5542602 - DNA, 15 bp, Homo sapiens
tttttgttttctgat

SEQ ID NO: 5542603 - DNA, 14 bp, Homo sapiens
tttttgttttgaaa

SEQ ID NO: 5542604 - DNA, 9 bp, Homo sapiens
ttttttaaa

SEQ ID NO: 5542605 - DNA, 13 bp, Homo sapiens
ttttttaaaaaag

SEQ ID NO: 5542606 - DNA, 23 bp, Homo sapiens
ttttttaaaaaagaaacatttgg

SEQ ID NO: 5542607 - DNA, 21 bp, Homo sapiens
ttttttaaaactgaatcttaa

SEQ ID NO: 5542608 - DNA, 18 bp, Homo sapiens
ttttttaaaataagtctg

SEQ ID NO: 5542609 - DNA, 16 bp, Homo sapiens
ttttttaaaatccaga

SEQ ID NO: 5542610 - DNA, 23 bp, Homo sapiens
ttttttaaacaaaatttcacagt

SEQ ID NO: 5542611 - DNA, 16 bp, Homo sapiens
ttttttaaacaaacat

SEQ ID NO: 5542612 - DNA, 23 bp, Homo sapiens
ttttttaaaggggtctgttctgc

SEQ ID NO: 5542613 - DNA, 12 bp, Homo sapiens
ttttttaaatca

SEQ ID NO: 5542614 - DNA, 19 bp, Homo sapiens
ttttttaaatcttgaccaa

SEQ ID NO: 5542615 - DNA, 20 bp, Homo sapiens
ttttttaaatttacagaata

SEQ ID NO: 5542616 - DNA, 19 bp, Homo sapiens
ttttttaaccaaaggtgaa

SEQ ID NO: 5542617 - DNA, 12 bp, Homo sapiens
ttttttaagatt

SEQ ID NO: 5542618 - DNA, 19 bp, Homo sapiens
ttttttaagcaactggaaa

SEQ ID NO: 5542619 - DNA, 23 bp, Homo sapiens
ttttttaagcttcagttgcttgt

SEQ ID NO: 5542620 - DNA, 14 bp, Homo sapiens
ttttttaatatact

SEQ ID NO: 5542621 - DNA, 19 bp, Homo sapiens
ttttttaatccgccaatat

SEQ ID NO: 5542622 - DNA, 12 bp, Homo sapiens
ttttttaatcta

SEQ ID NO: 5542623 - DNA, 18 bp, Homo sapiens
ttttttaatctactgcat

SEQ ID NO: 5542624 - DNA, 16 bp, Homo sapiens
ttttttaatgtatctt

SEQ ID NO: 5542625 - DNA, 18 bp, Homo sapiens
ttttttaatgtgctctgt

SEQ ID NO: 5542626 - DNA, 12 bp, Homo sapiens
ttttttaatttt

SEQ ID NO: 5542627 - DNA, 12 bp, Homo sapiens
ttttttacaaat

SEQ ID NO: 5542628 - DNA, 23 bp, Homo sapiens
ttttttacaaattggagcaggga

SEQ ID NO: 5542629 - DNA, 16 bp, Homo sapiens
aaaactttggaaccag

SEQ ID NO: 5542630 - DNA, 23 bp, Homo sapiens
aaaactttggagaactcatttca

SEQ ID NO: 5542631 - DNA, 17 bp, Homo sapiens
aaaactttgttaggcca

SEQ ID NO: 5542632 - DNA, 16 bp, Homo sapiens
aaaacttttacatttt

SEQ ID NO: 5542633 - DNA, 15 bp, Homo sapiens
aaaacttttctcaga

SEQ ID NO: 5542634 - DNA, 11 bp, Homo sapiens
aaaacttttgt

SEQ ID NO: 5542635 - DNA, 14 bp, Homo sapiens
aaaacttttgtaaa

SEQ ID NO: 5542636 - DNA, 20 bp, Homo sapiens
aaaactttttatattttata

SEQ ID NO: 5542637 - DNA, 22 bp, Homo sapiens
aaaacttttttctttgaaatgc

SEQ ID NO: 5542638 - DNA, 9 bp, Homo sapiens
aaaagaaaa

SEQ ID NO: 5542639 - DNA, 12 bp, Homo sapiens
aaaagaaaaaaa

SEQ ID NO: 5542640 - DNA, 17 bp, Homo sapiens
aaaagaaaaaaaaagaa

SEQ ID NO: 5542641 - DNA, 22 bp, Homo sapiens
aaaagaaaaaaaaagaaaaaag

SEQ ID NO: 5542642 - DNA, 15 bp, Homo sapiens
aaaagaaaaaaagaa

SEQ ID NO: 5542643 - DNA, 18 bp, Homo sapiens
aaaagaaaaaaatggaaa

SEQ ID NO: 5542644 - DNA, 16 bp, Homo sapiens
aaaagaaaaaagcaat

SEQ ID NO: 5542645 - DNA, 16 bp, Homo sapiens
aaaagaaaaaagtcct

SEQ ID NO: 5542646 - DNA, 17 bp, Homo sapiens
aaaagaaaaaagtcctt

SEQ ID NO: 5542647 - DNA, 11 bp, Homo sapiens
aaaagaaaaag

SEQ ID NO: 5542648 - DNA, 12 bp, Homo sapiens
aaaagaaaaaga

SEQ ID NO: 5542649 - DNA, 15 bp, Homo sapiens
aaaagaaaaataata

SEQ ID NO: 5542650 - DNA, 21 bp, Homo sapiens
aaaagaaaaatctcattattt

SEQ ID NO: 5542651 - DNA, 16 bp, Homo sapiens
aaaagaaaaatgaaga

SEQ ID NO: 5542652 - DNA, 21 bp, Homo sapiens
aaaagaaaaatttctggcaaa

SEQ ID NO: 5542653 - DNA, 13 bp, Homo sapiens
aaaagaaaacatt

SEQ ID NO: 5542654 - DNA, 22 bp, Homo sapiens
aaaagaaaacatttaacataat

SEQ ID NO: 5542655 - DNA, 11 bp, Homo sapiens
aaaagaaaacc

SEQ ID NO: 5542656 - DNA, 14 bp, Homo sapiens
aaaagaaaaccatt

SEQ ID NO: 5542657 - DNA, 17 bp, Homo sapiens
aaaagaaaaccatttta

SEQ ID NO: 5542658 - DNA, 14 bp, Homo sapiens
aaaagaaaagagaa

SEQ ID NO: 5542659 - DNA, 13 bp, Homo sapiens
aaaagaaaagttt

SEQ ID NO: 5542660 - DNA, 10 bp, Homo sapiens
aaaagaaaat

SEQ ID NO: 5542661 - DNA, 12 bp, Homo sapiens
aaaagaaaataa

SEQ ID NO: 5542662 - DNA, 15 bp, Homo sapiens
aaaagaaaataaaaa

SEQ ID NO: 5542663 - DNA, 19 bp, Homo sapiens
aaaagaaaatatacatttg

SEQ ID NO: 5542664 - DNA, 11 bp, Homo sapiens
aaaagaaaatg

SEQ ID NO: 5542665 - DNA, 19 bp, Homo sapiens
aaaagaaaatgaaaaacaa

SEQ ID NO: 5542666 - DNA, 22 bp, Homo sapiens
aaaagaaaatgaaaaacaacca

SEQ ID NO: 5542667 - DNA, 11 bp, Homo sapiens
aaaagaaaatt

SEQ ID NO: 5542668 - DNA, 14 bp, Homo sapiens
aaaagaaaattgat

SEQ ID NO: 5542669 - DNA, 12 bp, Homo sapiens
aaaagaaaattt

SEQ ID NO: 5542670 - DNA, 19 bp, Homo sapiens
aaaagaaacaccagtgtta

SEQ ID NO: 5542671 - DNA, 12 bp, Homo sapiens
aaaagaaactta

SEQ ID NO: 5542672 - DNA, 13 bp, Homo sapiens
aaaagaaagaaaa

SEQ ID NO: 5542673 - DNA, 12 bp, Homo sapiens
aaaagaaagaac

SEQ ID NO: 5542674 - DNA, 18 bp, Homo sapiens
aaaagaaaggctgttaaa

SEQ ID NO: 5542675 - DNA, 14 bp, Homo sapiens
aaaagaaatatatc

SEQ ID NO: 5542676 - DNA, 21 bp, Homo sapiens
aaaagaaatcaatagttgaat

SEQ ID NO: 5542677 - DNA, 15 bp, Homo sapiens
aaaagaaatcaattt

SEQ ID NO: 5542678 - DNA, 14 bp, Homo sapiens
aaaagaaatctcta

SEQ ID NO: 5542679 - DNA, 12 bp, Homo sapiens
aaaagaaatctt

SEQ ID NO: 5542680 - DNA, 17 bp, Homo sapiens
aaaagaaatcttgtctt

SEQ ID NO: 5542681 - DNA, 13 bp, Homo sapiens
aaaagaaatgaaa

SEQ ID NO: 5542682 - DNA, 14 bp, Homo sapiens
aaaagaaatgaaca

SEQ ID NO: 5542683 - DNA, 14 bp, Homo sapiens
aaaagaaatgacta

SEQ ID NO: 5542684 - DNA, 16 bp, Homo sapiens
aaaagaaatgtcaatt

SEQ ID NO: 5542685 - DNA, 23 bp, Homo sapiens
aaaagaaattatctttagttgaa

SEQ ID NO: 5542686 - DNA, 19 bp, Homo sapiens
aaaagaaattcgcatgttt

SEQ ID NO: 5542687 - DNA, 20 bp, Homo sapiens
aaaagaaattcgcatgttta

SEQ ID NO: 5542688 - DNA, 15 bp, Homo sapiens
aaaagaaatttgatg

SEQ ID NO: 5542689 - DNA, 11 bp, Homo sapiens
aaaagaacaat

SEQ ID NO: 5542690 - DNA, 17 bp, Homo sapiens
aaaagaacaatattgac

SEQ ID NO: 5542691 - DNA, 21 bp, Homo sapiens
aaaagaacataggaattttgt

SEQ ID NO: 5542692 - DNA, 16 bp, Homo sapiens
aaaagaacatgcagtt

SEQ ID NO: 5542693 - DNA, 17 bp, Homo sapiens
aaaagaacatgcagttt

SEQ ID NO: 5542694 - DNA, 18 bp, Homo sapiens
aaaagaacatgcagtttg

SEQ ID NO: 5542695 - DNA, 13 bp, Homo sapiens
aaaagaagaagga

SEQ ID NO: 5542696 - DNA, 16 bp, Homo sapiens
aaaagaagagccttgt

SEQ ID NO: 5542697 - DNA, 19 bp, Homo sapiens
aaaagaagcactttgattg

SEQ ID NO: 5542698 - DNA, 13 bp, Homo sapiens
aaaagaaggaaaa

SEQ ID NO: 5542699 - DNA, 14 bp, Homo sapiens
aaaagaaggaatat

SEQ ID NO: 5542700 - DNA, 12 bp, Homo sapiens
aaaagaagtgtg

SEQ ID NO: 5542701 - DNA, 13 bp, Homo sapiens
aaaagaagtgtgc

SEQ ID NO: 5542702 - DNA, 19 bp, Homo sapiens
aaaagaagttgcaagactc

SEQ ID NO: 5542703 - DNA, 11 bp, Homo sapiens
aaaagaagttt

SEQ ID NO: 5542704 - DNA, 16 bp, Homo sapiens
aaaagaataaaaactt

SEQ ID NO: 5542705 - DNA, 13 bp, Homo sapiens
aaaagaatatatt

SEQ ID NO: 5542706 - DNA, 19 bp, Homo sapiens
aaaagaatatttagaaaaa

SEQ ID NO: 5542707 - DNA, 23 bp, Homo sapiens
aaaagaatctagataggtgcttt

SEQ ID NO: 5542708 - DNA, 21 bp, Homo sapiens
aaaagaatctgcatttagcac

SEQ ID NO: 5542709 - DNA, 11 bp, Homo sapiens
aaaagaatgat

SEQ ID NO: 5542710 - DNA, 21 bp, Homo sapiens
aaaagaatggaccaaccactt

SEQ ID NO: 5542711 - DNA, 14 bp, Homo sapiens
aaaagaatgtacat

SEQ ID NO: 5542712 - DNA, 15 bp, Homo sapiens
aaaagacaagtgctc

SEQ ID NO: 5542713 - DNA, 21 bp, Homo sapiens
aaaagacaattttttttcaaa

SEQ ID NO: 5542714 - DNA, 20 bp, Homo sapiens
aaaagacacacttgtccaca

SEQ ID NO: 5542715 - DNA, 19 bp, Homo sapiens
aaaagacactggtgtatct

SEQ ID NO: 5542716 - DNA, 16 bp, Homo sapiens
aaaagacacttttacc

SEQ ID NO: 5542717 - DNA, 20 bp, Homo sapiens
aaaagacagacccagtgagt

SEQ ID NO: 5542718 - DNA, 13 bp, Homo sapiens
aaaagacagggct

SEQ ID NO: 5542719 - DNA, 21 bp, Homo sapiens
aaaagacagtggatcatgaaa

SEQ ID NO: 5542720 - DNA, 19 bp, Homo sapiens
aaaagacagtgtatgtaga

SEQ ID NO: 5542721 - DNA, 13 bp, Homo sapiens
aaaagacataaaa

SEQ ID NO: 5542722 - DNA, 13 bp, Homo sapiens
aaaagacatgcat

SEQ ID NO: 5542723 - DNA, 18 bp, Homo sapiens
aaaagacatgttgtaaat

SEQ ID NO: 5542724 - DNA, 21 bp, Homo sapiens
aaaagacattgaaagctctat

SEQ ID NO: 5542725 - DNA, 13 bp, Homo sapiens
aaaagacatttaa

SEQ ID NO: 5542726 - DNA, 13 bp, Homo sapiens
aaaagacattttt

SEQ ID NO: 5542727 - DNA, 17 bp, Homo sapiens
aaaagaccaaattttga

SEQ ID NO: 5542728 - DNA, 14 bp, Homo sapiens
aaaagaccaagact

SEQ ID NO: 5542729 - DNA, 16 bp, Homo sapiens
aaaagaccaagacttt

SEQ ID NO: 5542730 - DNA, 13 bp, Homo sapiens
aaaagaccaatag

SEQ ID NO: 5542731 - DNA, 13 bp, Homo sapiens
aaaagaccagact

SEQ ID NO: 5542732 - DNA, 22 bp, Homo sapiens
aaaagaccaggtctacagtgat

SEQ ID NO: 5542733 - DNA, 16 bp, Homo sapiens
aaaagaccatgcattc

SEQ ID NO: 5542734 - DNA, 24 bp, Homo sapiens
aaaagacccactgaatctgagaaa

SEQ ID NO: 5542735 - DNA, 19 bp, Homo sapiens
aaaagaccctgagactcca

SEQ ID NO: 5542736 - DNA, 14 bp, Homo sapiens
aaaagacctggcct

SEQ ID NO: 5542737 - DNA, 15 bp, Homo sapiens
aaaagacctggcctt

SEQ ID NO: 5542738 - DNA, 20 bp, Homo sapiens
aaaagacgatgtttatgttc

SEQ ID NO: 5542739 - DNA, 19 bp, Homo sapiens
aaaagacgcaccagcccag

SEQ ID NO: 5542740 - DNA, 13 bp, Homo sapiens
aaaagactcatcc

SEQ ID NO: 5542741 - DNA, 13 bp, Homo sapiens
aaaagactccaaa

SEQ ID NO: 5542742 - DNA, 16 bp, Homo sapiens
aaaagactgaacatgt

SEQ ID NO: 5542743 - DNA, 14 bp, Homo sapiens
aaaagactgtcaaa

SEQ ID NO: 5542744 - DNA, 13 bp, Homo sapiens
aaaagacttcaaa

SEQ ID NO: 5542745 - DNA, 18 bp, Homo sapiens
aaaagacttgagaaattt

SEQ ID NO: 5542746 - DNA, 15 bp, Homo sapiens
aaaagacttgtttct

SEQ ID NO: 5542747 - DNA, 15 bp, Homo sapiens
aaaagacttttgttg

SEQ ID NO: 5542748 - DNA, 18 bp, Homo sapiens
aaaagagaagaagaaaaa

SEQ ID NO: 5542749 - DNA, 12 bp, Homo sapiens
aaaagagaaggg

SEQ ID NO: 5542750 - DNA, 13 bp, Homo sapiens
aaaagagaaggga

SEQ ID NO: 5542751 - DNA, 21 bp, Homo sapiens
aaaagagaccacccatatcat

SEQ ID NO: 5542752 - DNA, 22 bp, Homo sapiens
aaaagagaccacccatatcatg

SEQ ID NO: 5542753 - DNA, 11 bp, Homo sapiens
aaaagagactc

SEQ ID NO: 5542754 - DNA, 17 bp, Homo sapiens
aaaagagacttctctgt

SEQ ID NO: 5542755 - DNA, 19 bp, Homo sapiens
aaaagagagaaaacttatt

SEQ ID NO: 5542756 - DNA, 22 bp, Homo sapiens
aaaagagagaagagtccaggaa

SEQ ID NO: 5542757 - DNA, 12 bp, Homo sapiens
aaaagagaggat

SEQ ID NO: 5542758 - DNA, 15 bp, Homo sapiens
aaaagagataataag

SEQ ID NO: 5542759 - DNA, 19 bp, Homo sapiens
aaaagagatgatgaaaata

SEQ ID NO: 5542760 - DNA, 14 bp, Homo sapiens
aaaagagatttcaa

SEQ ID NO: 5542761 - DNA, 22 bp, Homo sapiens
aaaagagcatggatgcatttca

SEQ ID NO: 5542762 - DNA, 21 bp, Homo sapiens
aaaagagccaagttcaaagaa

SEQ ID NO: 5542763 - DNA, 14 bp, Homo sapiens
aaaagagccctggc

SEQ ID NO: 5542764 - DNA, 15 bp, Homo sapiens
aaaagagccctggct

SEQ ID NO: 5542765 - DNA, 13 bp, Homo sapiens
aaaagagctactc

SEQ ID NO: 5542766 - DNA, 22 bp, Homo sapiens
aaaagaggaaagaatgaaagag

SEQ ID NO: 5542767 - DNA, 18 bp, Homo sapiens
aaaagaggaaattaaata

SEQ ID NO: 5542768 - DNA, 20 bp, Homo sapiens
aaaagaggaaattaaataat

SEQ ID NO: 5542769 - DNA, 15 bp, Homo sapiens
aaaagaggagcactt

SEQ ID NO: 5542770 - DNA, 15 bp, Homo sapiens
aaaagaggggctggg

SEQ ID NO: 5542771 - DNA, 16 bp, Homo sapiens
aaaagaggttacttta

SEQ ID NO: 5542772 - DNA, 19 bp, Homo sapiens
aaaagaggttactttagtt

SEQ ID NO: 5542773 - DNA, 20 bp, Homo sapiens
aaaagaggtttaagtttgtt

SEQ ID NO: 5542774 - DNA, 17 bp, Homo sapiens
aaaagaggtttttctta

SEQ ID NO: 5542775 - DNA, 21 bp, Homo sapiens
aaaagaggtttttcttaaata

SEQ ID NO: 5542776 - DNA, 12 bp, Homo sapiens
aaaagagtatgt

SEQ ID NO: 5542777 - DNA, 19 bp, Homo sapiens
aaaagagtgtaaaatattt

SEQ ID NO: 5542778 - DNA, 12 bp, Homo sapiens
aaaagataagaa

SEQ ID NO: 5542779 - DNA, 22 bp, Homo sapiens
aaaagataatattttacataca

SEQ ID NO: 5542780 - DNA, 17 bp, Homo sapiens
aaaagataccttaaaat

SEQ ID NO: 5542781 - DNA, 21 bp, Homo sapiens
aaaagataccttaaaatttga

SEQ ID NO: 5542782 - DNA, 22 bp, Homo sapiens
aaaagatactgtatatgtcaaa

SEQ ID NO: 5542783 - DNA, 12 bp, Homo sapiens
aaaagatataag

SEQ ID NO: 5542784 - DNA, 13 bp, Homo sapiens
aaaagatataagt

SEQ ID NO: 5542785 - DNA, 14 bp, Homo sapiens
aaaagatataagtg

SEQ ID NO: 5542786 - DNA, 18 bp, Homo sapiens
aaaagatataagtgctgt

SEQ ID NO: 5542787 - DNA, 21 bp, Homo sapiens
aaaagatatattaaaaatata

SEQ ID NO: 5542788 - DNA, 14 bp, Homo sapiens
aaaagatatgtatt

SEQ ID NO: 5542789 - DNA, 22 bp, Homo sapiens
aaaagatccatttaaaacaagc

SEQ ID NO: 5542790 - DNA, 16 bp, Homo sapiens
aaaagatccttcattt

SEQ ID NO: 5542791 - DNA, 18 bp, Homo sapiens
aaaagatctttcattttg

SEQ ID NO: 5542792 - DNA, 18 bp, Homo sapiens
aaaagatgaaaaagaata

SEQ ID NO: 5542793 - DNA, 15 bp, Homo sapiens
aaaagatgcaatgta

SEQ ID NO: 5542794 - DNA, 13 bp, Homo sapiens
aaaagatgcttta

SEQ ID NO: 5542795 - DNA, 19 bp, Homo sapiens
aaaagatgggaaactgctt

SEQ ID NO: 5542796 - DNA, 13 bp, Homo sapiens
aaaagatgtagat

SEQ ID NO: 5542797 - DNA, 17 bp, Homo sapiens
aaaagatgtatgttgct

SEQ ID NO: 5542798 - DNA, 18 bp, Homo sapiens
aaaagattaaaattagtg

SEQ ID NO: 5542799 - DNA, 16 bp, Homo sapiens
aaaagattaacaacac

SEQ ID NO: 5542800 - DNA, 21 bp, Homo sapiens
aaaagattataggaactgagg

SEQ ID NO: 5542801 - DNA, 15 bp, Homo sapiens
aaaagattatatatc

SEQ ID NO: 5542802 - DNA, 11 bp, Homo sapiens
aaaagattcta

SEQ ID NO: 5542803 - DNA, 15 bp, Homo sapiens
aaaagattctactaa

SEQ ID NO: 5542804 - DNA, 13 bp, Homo sapiens
aaaagattctgaa

SEQ ID NO: 5542805 - DNA, 22 bp, Homo sapiens
aaaagattcttcttaaaagttt

SEQ ID NO: 5542806 - DNA, 21 bp, Homo sapiens
aaaagattgaagtattttgct

SEQ ID NO: 5542807 - DNA, 14 bp, Homo sapiens
aaaagattgcaaag

SEQ ID NO: 5542808 - DNA, 18 bp, Homo sapiens
aaaagattgctgaaattt

SEQ ID NO: 5542809 - DNA, 16 bp, Homo sapiens
aaaagattggagctga

SEQ ID NO: 5542810 - DNA, 23 bp, Homo sapiens
aaaagattgtattactttaatga

SEQ ID NO: 5542811 - DNA, 15 bp, Homo sapiens
aaaataccttagctt

SEQ ID NO: 5542812 - DNA, 22 bp, Homo sapiens
aaaatactaagagatttgcttt

SEQ ID NO: 5542813 - DNA, 13 bp, Homo sapiens
aaaatactaccta

SEQ ID NO: 5542814 - DNA, 22 bp, Homo sapiens
aaaatactacctataggaaagt

SEQ ID NO: 5542815 - DNA, 19 bp, Homo sapiens
aaaatactatgaaatgaaa

SEQ ID NO: 5542816 - DNA, 14 bp, Homo sapiens
aaaatactattgcc

SEQ ID NO: 5542817 - DNA, 15 bp, Homo sapiens
aaaatactattggac

SEQ ID NO: 5542818 - DNA, 18 bp, Homo sapiens
aaaatactattggacaga

SEQ ID NO: 5542819 - DNA, 20 bp, Homo sapiens
aaaatactattggacagaca

SEQ ID NO: 5542820 - DNA, 21 bp, Homo sapiens
aaaatactatttaagatgtga

SEQ ID NO: 5542821 - DNA, 23 bp, Homo sapiens
aaaatactatttaagatgtgaaa

SEQ ID NO: 5542822 - DNA, 16 bp, Homo sapiens
aaaatactccaaagat

SEQ ID NO: 5542823 - DNA, 14 bp, Homo sapiens
aaaatactctaatt

SEQ ID NO: 5542824 - DNA, 16 bp, Homo sapiens
aaaatactctaattct

SEQ ID NO: 5542825 - DNA, 20 bp, Homo sapiens
aaaatactctaattctaacc

SEQ ID NO: 5542826 - DNA, 15 bp, Homo sapiens
aaaatactctagcct

SEQ ID NO: 5542827 - DNA, 14 bp, Homo sapiens
aaaatactctgcta

SEQ ID NO: 5542828 - DNA, 22 bp, Homo sapiens
aaaatactgactccaaccattc

SEQ ID NO: 5542829 - DNA, 15 bp, Homo sapiens
aaaatactgccagat

SEQ ID NO: 5542830 - DNA, 20 bp, Homo sapiens
aaaatactgccagatgctga

SEQ ID NO: 5542831 - DNA, 22 bp, Homo sapiens
aaaatactgcttttgcaaacag

SEQ ID NO: 5542832 - DNA, 23 bp, Homo sapiens
aaaatactgcttttgcaaacaga

SEQ ID NO: 5542833 - DNA, 22 bp, Homo sapiens
aaaatactggaattcaaagata

SEQ ID NO: 5542834 - DNA, 19 bp, Homo sapiens
aaaatacttaaatatttgt

SEQ ID NO: 5542835 - DNA, 14 bp, Homo sapiens
aaaatacttaaatg

SEQ ID NO: 5542836 - DNA, 13 bp, Homo sapiens
aaaatacttctat

SEQ ID NO: 5542837 - DNA, 19 bp, Homo sapiens
aaaatacttctttttcatt

SEQ ID NO: 5542838 - DNA, 21 bp, Homo sapiens
aaaatacttctttttcattat

SEQ ID NO: 5542839 - DNA, 12 bp, Homo sapiens
aaaatactttga

SEQ ID NO: 5542840 - DNA, 16 bp, Homo sapiens
aaaatacttttactct

SEQ ID NO: 5542841 - DNA, 22 bp, Homo sapiens
aaaatacttttactctgcctac

SEQ ID NO: 5542842 - DNA, 22 bp, Homo sapiens
aaaatacttttgcatttttcct

SEQ ID NO: 5542843 - DNA, 15 bp, Homo sapiens
aaaatagaaaagtta

SEQ ID NO: 5542844 - DNA, 16 bp, Homo sapiens
aaaatagaaaagttat

SEQ ID NO: 5542845 - DNA, 12 bp, Homo sapiens
aaaatagaaaca

SEQ ID NO: 5542846 - DNA, 13 bp, Homo sapiens
aaaatagaaagtt

SEQ ID NO: 5542847 - DNA, 20 bp, Homo sapiens
aaaatagaaattttgtaaga

SEQ ID NO: 5542848 - DNA, 13 bp, Homo sapiens
aaaatagaagaag

SEQ ID NO: 5542849 - DNA, 18 bp, Homo sapiens
aaaatagaataattcttt

SEQ ID NO: 5542850 - DNA, 17 bp, Homo sapiens
aaaatagaatacatttt

SEQ ID NO: 5542851 - DNA, 16 bp, Homo sapiens
aaaatagaatatagca

SEQ ID NO: 5542852 - DNA, 16 bp, Homo sapiens
aaaatagaatatataa

SEQ ID NO: 5542853 - DNA, 10 bp, Homo sapiens
aaaatagaca

SEQ ID NO: 5542854 - DNA, 15 bp, Homo sapiens
aaaatagacaaatag

SEQ ID NO: 5542855 - DNA, 19 bp, Homo sapiens
aaaatagacatctttaaca

SEQ ID NO: 5542856 - DNA, 18 bp, Homo sapiens
aaaatagacatgtagttg

SEQ ID NO: 5542857 - DNA, 20 bp, Homo sapiens
aaaatagacctaactgaata

SEQ ID NO: 5542858 - DNA, 16 bp, Homo sapiens
aaaatagactaacttc

SEQ ID NO: 5542859 - DNA, 21 bp, Homo sapiens
aaaatagactaacttcagtag

SEQ ID NO: 5542860 - DNA, 16 bp, Homo sapiens
aaaatagagcttttaa

SEQ ID NO: 5542861 - DNA, 17 bp, Homo sapiens
aaaatagaggctttgag

SEQ ID NO: 5542862 - DNA, 22 bp, Homo sapiens
aaaatagataagagtagaaact

SEQ ID NO: 5542863 - DNA, 23 bp, Homo sapiens
aaaatagatataaatttttaaga

SEQ ID NO: 5542864 - DNA, 18 bp, Homo sapiens
aaaatagattttataaga

SEQ ID NO: 5542865 - DNA, 21 bp, Homo sapiens
aaaatagcaacactctatatt

SEQ ID NO: 5542866 - DNA, 23 bp, Homo sapiens
aaaatagcaacctttttatctcc

SEQ ID NO: 5542867 - DNA, 15 bp, Homo sapiens
aaaatagcaatgcct

SEQ ID NO: 5542868 - DNA, 16 bp, Homo sapiens
aaaatagcacatgatt

SEQ ID NO: 5542869 - DNA, 13 bp, Homo sapiens
aaaatagcatact

SEQ ID NO: 5542870 - DNA, 18 bp, Homo sapiens
aaaatagcatactgtgta

SEQ ID NO: 5542871 - DNA, 21 bp, Homo sapiens
aaaatagcatactgtgtatgt

SEQ ID NO: 5542872 - DNA, 13 bp, Homo sapiens
aaaatagccctgc

SEQ ID NO: 5542873 - DNA, 15 bp, Homo sapiens
aaaatagcgttcttg

SEQ ID NO: 5542874 - DNA, 17 bp, Homo sapiens
aaaatagcgttcttgta

SEQ ID NO: 5542875 - DNA, 15 bp, Homo sapiens
aaaatagctataaat

SEQ ID NO: 5542876 - DNA, 16 bp, Homo sapiens
aaaatagctctgtgtg

SEQ ID NO: 5542877 - DNA, 18 bp, Homo sapiens
aaaatagcttattataga

SEQ ID NO: 5542878 - DNA, 15 bp, Homo sapiens
aaaataggagagaga

SEQ ID NO: 5542879 - DNA, 13 bp, Homo sapiens
aaaataggcagga

SEQ ID NO: 5542880 - DNA, 21 bp, Homo sapiens
aaaatagggtggacagaagct

SEQ ID NO: 5542881 - DNA, 18 bp, Homo sapiens
aaaatagtaagcctccct

SEQ ID NO: 5542882 - DNA, 18 bp, Homo sapiens
aaaatagtaattttttac

SEQ ID NO: 5542883 - DNA, 19 bp, Homo sapiens
aaaatagtagaacaagcaa

SEQ ID NO: 5542884 - DNA, 13 bp, Homo sapiens
aaaatagtctcat

SEQ ID NO: 5542885 - DNA, 17 bp, Homo sapiens
aaaatagtctcattgcc

SEQ ID NO: 5542886 - DNA, 20 bp, Homo sapiens
aaaatagtgtaagaactgta

SEQ ID NO: 5542887 - DNA, 23 bp, Homo sapiens
aaaatagttaagacatgatttcc

SEQ ID NO: 5542888 - DNA, 12 bp, Homo sapiens
aaaatagttacc

SEQ ID NO: 5542889 - DNA, 15 bp, Homo sapiens
aaaatagttctattt

SEQ ID NO: 5542890 - DNA, 21 bp, Homo sapiens
aaaatagttgagccagcagac

SEQ ID NO: 5542891 - DNA, 16 bp, Homo sapiens
aaaatagttgtccata

SEQ ID NO: 5542892 - DNA, 17 bp, Homo sapiens
aaaatagtttaggaaaa

SEQ ID NO: 5542893 - DNA, 19 bp, Homo sapiens
aaaatagtttggatatgta

SEQ ID NO: 5542894 - DNA, 20 bp, Homo sapiens
aaaatagtttggatatgtaa

SEQ ID NO: 5542895 - DNA, 17 bp, Homo sapiens
aaaatagtttgtttaat

SEQ ID NO: 5542896 - DNA, 13 bp, Homo sapiens
aaaatagttttct

SEQ ID NO: 5542897 - DNA, 15 bp, Homo sapiens
aaaatagttttctaa

SEQ ID NO: 5542898 - DNA, 17 bp, Homo sapiens
aaaatagttttctaaat

SEQ ID NO: 5542899 - DNA, 10 bp, Homo sapiens
aaaatataaa

SEQ ID NO: 5542900 - DNA, 22 bp, Homo sapiens
aaaatataaaatagttgtccat

SEQ ID NO: 5542901 - DNA, 13 bp, Homo sapiens
aaaatataaatta

SEQ ID NO: 5542902 - DNA, 21 bp, Homo sapiens
aaaatataaattgtacatttt

SEQ ID NO: 5542903 - DNA, 12 bp, Homo sapiens
aaaatataagta

SEQ ID NO: 5542904 - DNA, 12 bp, Homo sapiens
aaaatataattg

SEQ ID NO: 5542905 - DNA, 19 bp, Homo sapiens
aaaatataattgtttttta

SEQ ID NO: 5542906 - DNA, 14 bp, Homo sapiens
aaaatatacaagta

SEQ ID NO: 5542907 - DNA, 20 bp, Homo sapiens
aaaatatacaagtaaattct

SEQ ID NO: 5542908 - DNA, 22 bp, Homo sapiens
aaaatatacaagtaaattctgt

SEQ ID NO: 5542909 - DNA, 14 bp, Homo sapiens
aaaatatacatgtt

SEQ ID NO: 5542910 - DNA, 11 bp, Homo sapiens
aaaatatactg

SEQ ID NO: 5542911 - DNA, 14 bp, Homo sapiens
aaaatatactgtaa

SEQ ID NO: 5542912 - DNA, 20 bp, Homo sapiens
aaaatatactgtaaagaaag

SEQ ID NO: 5542913 - DNA, 15 bp, Homo sapiens
aaaatatagagacag

SEQ ID NO: 5542914 - DNA, 18 bp, Homo sapiens
aaaatatagcctttaaat

SEQ ID NO: 5542915 - DNA, 16 bp, Homo sapiens
aaaatatagctgtaca

SEQ ID NO: 5542916 - DNA, 18 bp, Homo sapiens
aaaatatataccccccca

SEQ ID NO: 5542917 - DNA, 13 bp, Homo sapiens
aaaatatatacta

SEQ ID NO: 5542918 - DNA, 14 bp, Homo sapiens
aaaatatatataaa

SEQ ID NO: 5542919 - DNA, 20 bp, Homo sapiens
aaaatatatatagtgctata

SEQ ID NO: 5542920 - DNA, 18 bp, Homo sapiens
aaaatatatatcaaatat

SEQ ID NO: 5542921 - DNA, 22 bp, Homo sapiens
aaaatatatatgtgcagtattt

SEQ ID NO: 5542922 - DNA, 13 bp, Homo sapiens
aaaatatatattt

SEQ ID NO: 5542923 - DNA, 17 bp, Homo sapiens
aaaatatatctggaact

SEQ ID NO: 5542924 - DNA, 12 bp, Homo sapiens
aaaatatatctt

SEQ ID NO: 5542925 - DNA, 16 bp, Homo sapiens
aaaatatatgttctgc

SEQ ID NO: 5542926 - DNA, 13 bp, Homo sapiens
aaaatatatgttg

SEQ ID NO: 5542927 - DNA, 16 bp, Homo sapiens
aaaatatatgtttggc

SEQ ID NO: 5542928 - DNA, 20 bp, Homo sapiens
aaaatatattttatgattta

SEQ ID NO: 5542929 - DNA, 13 bp, Homo sapiens
aaaatatattttg

SEQ ID NO: 5542930 - DNA, 13 bp, Homo sapiens
aaaatatcaagta

SEQ ID NO: 5542931 - DNA, 22 bp, Homo sapiens
aaaatatccaattcatttcttc

SEQ ID NO: 5542932 - DNA, 13 bp, Homo sapiens
aaaatatctacat

SEQ ID NO: 5542933 - DNA, 17 bp, Homo sapiens
aaaatatctatattcta

SEQ ID NO: 5542934 - DNA, 18 bp, Homo sapiens
aaaatatctatattctat

SEQ ID NO: 5542935 - DNA, 12 bp, Homo sapiens
aaaatatctcct

SEQ ID NO: 5542936 - DNA, 12 bp, Homo sapiens
aaaatatctctt

SEQ ID NO: 5542937 - DNA, 13 bp, Homo sapiens
aaaatatctgaat

SEQ ID NO: 5542938 - DNA, 22 bp, Homo sapiens
aaaatatctgacatcttattta

SEQ ID NO: 5542939 - DNA, 14 bp, Homo sapiens
aaaatatcttcctt

SEQ ID NO: 5542940 - DNA, 15 bp, Homo sapiens
aaaatatcttccttt

SEQ ID NO: 5542941 - DNA, 24 bp, Homo sapiens
aaaatatgaaattataatgcaata

SEQ ID NO: 5542942 - DNA, 16 bp, Homo sapiens
aaaatatgaacctatt

SEQ ID NO: 5542943 - DNA, 19 bp, Homo sapiens
aaaatatgagattggaaaa

SEQ ID NO: 5542944 - DNA, 18 bp, Homo sapiens
aaaatatgatatatatgt

SEQ ID NO: 5542945 - DNA, 13 bp, Homo sapiens
aaaatatgatatt

SEQ ID NO: 5542946 - DNA, 16 bp, Homo sapiens
aaaatatggaacttct

SEQ ID NO: 5542947 - DNA, 21 bp, Homo sapiens
aaaatatggaacttctaatat

SEQ ID NO: 5542948 - DNA, 20 bp, Homo sapiens
aaaatatgtaagaacacatt

SEQ ID NO: 5542949 - DNA, 16 bp, Homo sapiens
aaaatatgtactgtat

SEQ ID NO: 5542950 - DNA, 11 bp, Homo sapiens
aaaatatgtat

SEQ ID NO: 5542951 - DNA, 14 bp, Homo sapiens
aaaatatgtatgtc

SEQ ID NO: 5542952 - DNA, 22 bp, Homo sapiens
aaaatatgtatgtctaattgag

SEQ ID NO: 5542953 - DNA, 23 bp, Homo sapiens
aaaatatgtctcgctagtgatgt

SEQ ID NO: 5542954 - DNA, 18 bp, Homo sapiens
aaaatatgtgaaggacct

SEQ ID NO: 5542955 - DNA, 18 bp, Homo sapiens
aaaatatgtgagcatgaa

SEQ ID NO: 5542956 - DNA, 12 bp, Homo sapiens
aaaatatgtgta

SEQ ID NO: 5542957 - DNA, 21 bp, Homo sapiens
aaaatattaaatcaagagtga

SEQ ID NO: 5542958 - DNA, 23 bp, Homo sapiens
aaaatattaacatattatttcat

SEQ ID NO: 5542959 - DNA, 15 bp, Homo sapiens
aaaatattaatacag

SEQ ID NO: 5542960 - DNA, 16 bp, Homo sapiens
aaaatattataactta

SEQ ID NO: 5542961 - DNA, 19 bp, Homo sapiens
aaaatattataacttaaaa

SEQ ID NO: 5542962 - DNA, 17 bp, Homo sapiens
aaaatattatctttgta

SEQ ID NO: 5542963 - DNA, 14 bp, Homo sapiens
aaaatattatgtgt

SEQ ID NO: 5542964 - DNA, 15 bp, Homo sapiens
aaaatattatgtgtt

SEQ ID NO: 5542965 - DNA, 21 bp, Homo sapiens
aaaatattatgtgtttccata

SEQ ID NO: 5542966 - DNA, 14 bp, Homo sapiens
aaaatattatttga

SEQ ID NO: 5542967 - DNA, 16 bp, Homo sapiens
aaaatattatttgata

SEQ ID NO: 5542968 - DNA, 17 bp, Homo sapiens
aaaatattcactctcca

SEQ ID NO: 5542969 - DNA, 22 bp, Homo sapiens
aaaatattcactctccattaga

SEQ ID NO: 5542970 - DNA, 23 bp, Homo sapiens
aaaatattcactctccattagaa

SEQ ID NO: 5542971 - DNA, 19 bp, Homo sapiens
aaaatattctaacatttga

SEQ ID NO: 5542972 - DNA, 21 bp, Homo sapiens
aaaatattctaacatttgata

SEQ ID NO: 5542973 - DNA, 17 bp, Homo sapiens
aaaatattctgtaagaa

SEQ ID NO: 5542974 - DNA, 15 bp, Homo sapiens
aaaatattctgtcat

SEQ ID NO: 5542975 - DNA, 22 bp, Homo sapiens
aaaatattgctaaaagtgcatt

SEQ ID NO: 5542976 - DNA, 12 bp, Homo sapiens
aaaatattgtgt

SEQ ID NO: 5542977 - DNA, 16 bp, Homo sapiens
aaaatattgtgtaaga

SEQ ID NO: 5542978 - DNA, 19 bp, Homo sapiens
aaaatattgtgtaagaatc

SEQ ID NO: 5542979 - DNA, 11 bp, Homo sapiens
aaaatattgtt

SEQ ID NO: 5542980 - DNA, 12 bp, Homo sapiens
aaaatattgtta

SEQ ID NO: 5542981 - DNA, 21 bp, Homo sapiens
aaaatattgtttaatgcaaat

SEQ ID NO: 5542982 - DNA, 14 bp, Homo sapiens
aaaatattgtttct

SEQ ID NO: 5542983 - DNA, 16 bp, Homo sapiens
aaaatattgtttctgc

SEQ ID NO: 5542984 - DNA, 20 bp, Homo sapiens
aaaatattgttttacaatag

SEQ ID NO: 5542985 - DNA, 19 bp, Homo sapiens
aaaatatttaaaaatgtct

SEQ ID NO: 5542986 - DNA, 14 bp, Homo sapiens
aaaatatttaaagg

SEQ ID NO: 5542987 - DNA, 11 bp, Homo sapiens
aaaatatttat

SEQ ID NO: 5542988 - DNA, 16 bp, Homo sapiens
aaaatatttataaatg

SEQ ID NO: 5542989 - DNA, 17 bp, Homo sapiens
aaaatatttatgaagaa

SEQ ID NO: 5542990 - DNA, 11 bp, Homo sapiens
aaaatgtatat

SEQ ID NO: 5542991 - DNA, 16 bp, Homo sapiens
aaaatgtatatattta

SEQ ID NO: 5542992 - DNA, 18 bp, Homo sapiens
aaaatgtatattttgatg

SEQ ID NO: 5542993 - DNA, 21 bp, Homo sapiens
aaaatgtatccaaggaaacat

SEQ ID NO: 5542994 - DNA, 18 bp, Homo sapiens
aaaatgtatccagaggaa

SEQ ID NO: 5542995 - DNA, 21 bp, Homo sapiens
aaaatgtatctgcatatgttt

SEQ ID NO: 5542996 - DNA, 16 bp, Homo sapiens
aaaatgtatgcatgtt

SEQ ID NO: 5542997 - DNA, 15 bp, Homo sapiens
aaaatgtatgtctgg

SEQ ID NO: 5542998 - DNA, 21 bp, Homo sapiens
aaaatgtattcaagcaaacat

SEQ ID NO: 5542999 - DNA, 15 bp, Homo sapiens
aaaatgtattccttt

SEQ ID NO: 5543000 - DNA, 11 bp, Homo sapiens
aaaatgtattt

SEQ ID NO: 5543001 - DNA, 13 bp, Homo sapiens
aaaatgtatttta

SEQ ID NO: 5543002 - DNA, 18 bp, Homo sapiens
aaaatgtattttatgtta

SEQ ID NO: 5543003 - DNA, 15 bp, Homo sapiens
aaaatgtattttgcc

SEQ ID NO: 5543004 - DNA, 23 bp, Homo sapiens
aaaatgtcaaaagtagaactttg

SEQ ID NO: 5543005 - DNA, 17 bp, Homo sapiens
aaaatgtcacacttgtt

SEQ ID NO: 5543006 - DNA, 20 bp, Homo sapiens
aaaatgtccagccaccccca

SEQ ID NO: 5543007 - DNA, 22 bp, Homo sapiens
aaaatgtctcaatggtgctata

SEQ ID NO: 5543008 - DNA, 15 bp, Homo sapiens
aaaatgtcttgtgta

SEQ ID NO: 5543009 - DNA, 21 bp, Homo sapiens
aaaatgtctttccaaattatt

SEQ ID NO: 5543010 - DNA, 20 bp, Homo sapiens
aaaatgtgaaatctcagaat

SEQ ID NO: 5543011 - DNA, 16 bp, Homo sapiens
aaaatgtgaaattttt

SEQ ID NO: 5543012 - DNA, 23 bp, Homo sapiens
aaaatgtgaaatttttccacact

SEQ ID NO: 5543013 - DNA, 20 bp, Homo sapiens
aaaatgtgatgttctaaggc

SEQ ID NO: 5543014 - DNA, 13 bp, Homo sapiens
aaaatgtgatttt

SEQ ID NO: 5543015 - DNA, 18 bp, Homo sapiens
aaaatgtgatttttctga

SEQ ID NO: 5543016 - DNA, 19 bp, Homo sapiens
aaaatgtgcaaaacagcgt

SEQ ID NO: 5543017 - DNA, 12 bp, Homo sapiens
aaaatgtgcagt

SEQ ID NO: 5543018 - DNA, 18 bp, Homo sapiens
aaaatgtgccattttgca

SEQ ID NO: 5543019 - DNA, 18 bp, Homo sapiens
aaaatgtgccgtctttgg

SEQ ID NO: 5543020 - DNA, 19 bp, Homo sapiens
aaaatgtgctatactgcat

SEQ ID NO: 5543021 - DNA, 22 bp, Homo sapiens
aaaatgtggtctgccaatctgt

SEQ ID NO: 5543022 - DNA, 12 bp, Homo sapiens
aaaatgtgtaca

SEQ ID NO: 5543023 - DNA, 18 bp, Homo sapiens
aaaatgtgtctgcaacat

SEQ ID NO: 5543024 - DNA, 21 bp, Homo sapiens
aaaatgtgtctgcaacatgga

SEQ ID NO: 5543025 - DNA, 16 bp, Homo sapiens
aaaatgtgtgtattct

SEQ ID NO: 5543026 - DNA, 16 bp, Homo sapiens
aaaatgtgttgaaact

SEQ ID NO: 5543027 - DNA, 18 bp, Homo sapiens
aaaatgttaaaacataaa

SEQ ID NO: 5543028 - DNA, 16 bp, Homo sapiens
aaaatgttaacaactt

SEQ ID NO: 5543029 - DNA, 20 bp, Homo sapiens
aaaatgttacgtgaagaaat

SEQ ID NO: 5543030 - DNA, 21 bp, Homo sapiens
aaaatgttactccctgtttta

SEQ ID NO: 5543031 - DNA, 18 bp, Homo sapiens
aaaatgttatcttctcaa

SEQ ID NO: 5543032 - DNA, 16 bp, Homo sapiens
aaaatgttatttaaca

SEQ ID NO: 5543033 - DNA, 12 bp, Homo sapiens
aaaatgttcatc

SEQ ID NO: 5543034 - DNA, 22 bp, Homo sapiens
aaaatgttcatcaattcccatt

SEQ ID NO: 5543035 - DNA, 15 bp, Homo sapiens
aaaatgttctatatg

SEQ ID NO: 5543036 - DNA, 23 bp, Homo sapiens
aaaatgttctatttaacaactgg

SEQ ID NO: 5543037 - DNA, 16 bp, Homo sapiens
aaaatgttctcaaata

SEQ ID NO: 5543038 - DNA, 14 bp, Homo sapiens
aaaatgttctgaca

SEQ ID NO: 5543039 - DNA, 12 bp, Homo sapiens
aaaatgttcttt

SEQ ID NO: 5543040 - DNA, 13 bp, Homo sapiens
aaaatgttgaaaa

SEQ ID NO: 5543041 - DNA, 22 bp, Homo sapiens
aaaatgttgagaagcgttttta

SEQ ID NO: 5543042 - DNA, 17 bp, Homo sapiens
aaaatgttgctgaaaaa

SEQ ID NO: 5543043 - DNA, 19 bp, Homo sapiens
aaaatgttggatttataaa

SEQ ID NO: 5543044 - DNA, 20 bp, Homo sapiens
aaaatgttggatttataaat

SEQ ID NO: 5543045 - DNA, 13 bp, Homo sapiens
aaaatgttggctg

SEQ ID NO: 5543046 - DNA, 23 bp, Homo sapiens
aaaatgtttaattcattaatctg

SEQ ID NO: 5543047 - DNA, 15 bp, Homo sapiens
aaaatgtttacattt

SEQ ID NO: 5543048 - DNA, 22 bp, Homo sapiens
aaaatgtttacattttctttca

SEQ ID NO: 5543049 - DNA, 22 bp, Homo sapiens
aaaatgtttcattatgcacttt

SEQ ID NO: 5543050 - DNA, 16 bp, Homo sapiens
aaaatgtttccactgg

SEQ ID NO: 5543051 - DNA, 12 bp, Homo sapiens
aaaatgtttcct

SEQ ID NO: 5543052 - DNA, 23 bp, Homo sapiens
aaaatgtttgccctgttcaaagt

SEQ ID NO: 5543053 - DNA, 16 bp, Homo sapiens
aaaatgtttggtttca

SEQ ID NO: 5543054 - DNA, 22 bp, Homo sapiens
aaaatgttttatggtagctttt

SEQ ID NO: 5543055 - DNA, 14 bp, Homo sapiens
aaaatgttttcagc

SEQ ID NO: 5543056 - DNA, 12 bp, Homo sapiens
aaaatgttttta

SEQ ID NO: 5543057 - DNA, 15 bp, Homo sapiens
aaaatgttttttgat

SEQ ID NO: 5543058 - DNA, 13 bp, Homo sapiens
aaaattaaaataa

SEQ ID NO: 5543059 - DNA, 12 bp, Homo sapiens
aaaattaaaatg

SEQ ID NO: 5543060 - DNA, 17 bp, Homo sapiens
aaaattaaaatttaaca

SEQ ID NO: 5543061 - DNA, 20 bp, Homo sapiens
aaaattaaaccaatgaagaa

SEQ ID NO: 5543062 - DNA, 15 bp, Homo sapiens
aaaattaaagaaaat

SEQ ID NO: 5543063 - DNA, 11 bp, Homo sapiens
aaaattaaagc

SEQ ID NO: 5543064 - DNA, 13 bp, Homo sapiens
aaaattaaagccc

SEQ ID NO: 5543065 - DNA, 13 bp, Homo sapiens
aaaattaaatatt

SEQ ID NO: 5543066 - DNA, 17 bp, Homo sapiens
aaaattaaatcaacctt

SEQ ID NO: 5543067 - DNA, 15 bp, Homo sapiens
aaaattaaatctaga

SEQ ID NO: 5543068 - DNA, 22 bp, Homo sapiens
aaaattaaatgccttgtataaa

SEQ ID NO: 5543069 - DNA, 16 bp, Homo sapiens
aaaattaaatttgatg

SEQ ID NO: 5543070 - DNA, 23 bp, Homo sapiens
aaaattaactgctaacttctatt

SEQ ID NO: 5543071 - DNA, 13 bp, Homo sapiens
aaaattaactggt

SEQ ID NO: 5543072 - DNA, 17 bp, Homo sapiens
aaaattaacttagtttt

SEQ ID NO: 5543073 - DNA, 12 bp, Homo sapiens
aaaattaacttt

SEQ ID NO: 5543074 - DNA, 12 bp, Homo sapiens
aaaattaagaaa

SEQ ID NO: 5543075 - DNA, 18 bp, Homo sapiens
aaaattaagctgtaatca

SEQ ID NO: 5543076 - DNA, 16 bp, Homo sapiens
aaaattaaggaaatgt

SEQ ID NO: 5543077 - DNA, 16 bp, Homo sapiens
aaaattaagtagaaca

SEQ ID NO: 5543078 - DNA, 14 bp, Homo sapiens
aaaattaagttgaa

SEQ ID NO: 5543079 - DNA, 21 bp, Homo sapiens
aaaattaatatgattattaat

SEQ ID NO: 5543080 - DNA, 21 bp, Homo sapiens
aaaattaatgcagatttctct

SEQ ID NO: 5543081 - DNA, 21 bp, Homo sapiens
aaaattaatgtaataaagtga

SEQ ID NO: 5543082 - DNA, 14 bp, Homo sapiens
aaaattaattagga

SEQ ID NO: 5543083 - DNA, 17 bp, Homo sapiens
aaaattaattaggaatt

SEQ ID NO: 5543084 - DNA, 23 bp, Homo sapiens
aaaattaattaggaattacttta

SEQ ID NO: 5543085 - DNA, 17 bp, Homo sapiens
aaaattaattctaaact

SEQ ID NO: 5543086 - DNA, 14 bp, Homo sapiens
aaaattacaaagaa

SEQ ID NO: 5543087 - DNA, 22 bp, Homo sapiens
aaaattacagatgtgaaaataa

SEQ ID NO: 5543088 - DNA, 16 bp, Homo sapiens
aaaattacataattca

SEQ ID NO: 5543089 - DNA, 13 bp, Homo sapiens
aaaattacattat

SEQ ID NO: 5543090 - DNA, 13 bp, Homo sapiens
aaaattaccttta

SEQ ID NO: 5543091 - DNA, 16 bp, Homo sapiens
aaaattacctttaatg

SEQ ID NO: 5543092 - DNA, 18 bp, Homo sapiens
aaaattacctttaatgca

SEQ ID NO: 5543093 - DNA, 17 bp, Homo sapiens
aaaattactaattttac

SEQ ID NO: 5543094 - DNA, 18 bp, Homo sapiens
aaaattactattcttggt

SEQ ID NO: 5543095 - DNA, 18 bp, Homo sapiens
aaaattactgtgaattgt

SEQ ID NO: 5543096 - DNA, 18 bp, Homo sapiens
aaaattagaaaaaaacaa

SEQ ID NO: 5543097 - DNA, 13 bp, Homo sapiens
aaaattagaactt

SEQ ID NO: 5543098 - DNA, 18 bp, Homo sapiens
aaaattagaacttgaata

SEQ ID NO: 5543099 - DNA, 13 bp, Homo sapiens
aaaattagaagca

SEQ ID NO: 5543100 - DNA, 18 bp, Homo sapiens
aaaattagatgcatgttg

SEQ ID NO: 5543101 - DNA, 14 bp, Homo sapiens
aaaattagcatctg

SEQ ID NO: 5543102 - DNA, 19 bp, Homo sapiens
aaaattagccagtaatcct

SEQ ID NO: 5543103 - DNA, 21 bp, Homo sapiens
aaaattagccagtaatcctgt

SEQ ID NO: 5543104 - DNA, 15 bp, Homo sapiens
aaaattagccgggca

SEQ ID NO: 5543105 - DNA, 19 bp, Homo sapiens
aaaattaggatttcatgat

SEQ ID NO: 5543106 - DNA, 13 bp, Homo sapiens
aaaattagtcttt

SEQ ID NO: 5543107 - DNA, 23 bp, Homo sapiens
aaaattagtgagatttgtattta

SEQ ID NO: 5543108 - DNA, 20 bp, Homo sapiens
aaaattagttttaaaatact

SEQ ID NO: 5543109 - DNA, 16 bp, Homo sapiens
aaaattataaactcta

SEQ ID NO: 5543110 - DNA, 14 bp, Homo sapiens
aaaattataaactt

SEQ ID NO: 5543111 - DNA, 16 bp, Homo sapiens
aaaattataaactttt

SEQ ID NO: 5543112 - DNA, 13 bp, Homo sapiens
aaaattatactgt

SEQ ID NO: 5543113 - DNA, 15 bp, Homo sapiens
aaaattatactgtgt

SEQ ID NO: 5543114 - DNA, 15 bp, Homo sapiens
aaaattatatagcaa

SEQ ID NO: 5543115 - DNA, 18 bp, Homo sapiens
aaaattatatagcaaaga

SEQ ID NO: 5543116 - DNA, 14 bp, Homo sapiens
aaaattatattctg

SEQ ID NO: 5543117 - DNA, 14 bp, Homo sapiens
aaaattatatttgg

SEQ ID NO: 5543118 - DNA, 17 bp, Homo sapiens
aaaattatctatttgta

SEQ ID NO: 5543119 - DNA, 18 bp, Homo sapiens
aaaattatctatttgtat

SEQ ID NO: 5543120 - DNA, 13 bp, Homo sapiens
aaaattatctgtt

SEQ ID NO: 5543121 - DNA, 14 bp, Homo sapiens
aaaattatctttaa

SEQ ID NO: 5543122 - DNA, 23 bp, Homo sapiens
aaaattatgataaaatgctttaa

SEQ ID NO: 5543123 - DNA, 15 bp, Homo sapiens
aaaattatggaatat

SEQ ID NO: 5543124 - DNA, 19 bp, Homo sapiens
aaaattatgtttttcagtt

SEQ ID NO: 5543125 - DNA, 21 bp, Homo sapiens
aaaattattaaaaattataga

SEQ ID NO: 5543126 - DNA, 14 bp, Homo sapiens
aaaattattagaac

SEQ ID NO: 5543127 - DNA, 13 bp, Homo sapiens
aaaattattccca

SEQ ID NO: 5543128 - DNA, 19 bp, Homo sapiens
aaaattattgattgctttt

SEQ ID NO: 5543129 - DNA, 15 bp, Homo sapiens
aaaattatttgcctt

SEQ ID NO: 5543130 - DNA, 20 bp, Homo sapiens
aaaattatttgccttttaaa

SEQ ID NO: 5543131 - DNA, 15 bp, Homo sapiens
aaaattatttgctat

SEQ ID NO: 5543132 - DNA, 17 bp, Homo sapiens
aaaattatttgctatgg

SEQ ID NO: 5543133 - DNA, 17 bp, Homo sapiens
aaaattattttaaacaa

SEQ ID NO: 5543134 - DNA, 18 bp, Homo sapiens
aaaattattttaaacaaa

SEQ ID NO: 5543135 - DNA, 15 bp, Homo sapiens
aaaattattttgaca

SEQ ID NO: 5543136 - DNA, 21 bp, Homo sapiens
aaaattattttgttcatacat

SEQ ID NO: 5543137 - DNA, 17 bp, Homo sapiens
aaaattatttttattaa

SEQ ID NO: 5543138 - DNA, 20 bp, Homo sapiens
aaaattatttttttttttgt

SEQ ID NO: 5543139 - DNA, 16 bp, Homo sapiens
aaaattcaaaaagtgt

SEQ ID NO: 5543140 - DNA, 17 bp, Homo sapiens
aaaattcaaaaagtgtt

SEQ ID NO: 5543141 - DNA, 21 bp, Homo sapiens
aaaattcaaagcatggacatt

SEQ ID NO: 5543142 - DNA, 14 bp, Homo sapiens
aaaattcaattgta

SEQ ID NO: 5543143 - DNA, 17 bp, Homo sapiens
aaaattcaattgtaaat

SEQ ID NO: 5543144 - DNA, 17 bp, Homo sapiens
aaaattcacttctatat

SEQ ID NO: 5543145 - DNA, 16 bp, Homo sapiens
aaaattcagagtcctt

SEQ ID NO: 5543146 - DNA, 16 bp, Homo sapiens
aaaattcagcaaacca

SEQ ID NO: 5543147 - DNA, 18 bp, Homo sapiens
aaaattcagcaaaccatt

SEQ ID NO: 5543148 - DNA, 14 bp, Homo sapiens
aaaattcagcaaag

SEQ ID NO: 5543149 - DNA, 19 bp, Homo sapiens
aaaattcagggctttaaac

SEQ ID NO: 5543150 - DNA, 18 bp, Homo sapiens
aaaattcatagtaagatt

SEQ ID NO: 5543151 - DNA, 14 bp, Homo sapiens
aaaattcatataaa

SEQ ID NO: 5543152 - DNA, 16 bp, Homo sapiens
aaaattcatgccccag

SEQ ID NO: 5543153 - DNA, 21 bp, Homo sapiens
aaaattcatgccccagtatta

SEQ ID NO: 5543154 - DNA, 16 bp, Homo sapiens
aaaattcattccattt

SEQ ID NO: 5543155 - DNA, 16 bp, Homo sapiens
aaaattcatttcacat

SEQ ID NO: 5543156 - DNA, 12 bp, Homo sapiens
aaaattcatttg

SEQ ID NO: 5543157 - DNA, 13 bp, Homo sapiens
aaaattcattttt

SEQ ID NO: 5543158 - DNA, 23 bp, Homo sapiens
aaaattccaaatttttttcttag

SEQ ID NO: 5543159 - DNA, 20 bp, Homo sapiens
aaaattccagaaaggatatt

SEQ ID NO: 5543160 - DNA, 17 bp, Homo sapiens
aaaattccagaatgaag

SEQ ID NO: 5543161 - DNA, 17 bp, Homo sapiens
aaaattccatgcactct

SEQ ID NO: 5543162 - DNA, 18 bp, Homo sapiens
aaaattccattatcttat

SEQ ID NO: 5543163 - DNA, 19 bp, Homo sapiens
aaaattccattatcttatg

SEQ ID NO: 5543164 - DNA, 14 bp, Homo sapiens
aaaattcccttcct

SEQ ID NO: 5543165 - DNA, 21 bp, Homo sapiens
aaaattcgacctgatttacag

SEQ ID NO: 5543166 - DNA, 20 bp, Homo sapiens
aaaattcgcccgagctgttt

SEQ ID NO: 5543167 - DNA, 22 bp, Homo sapiens
aaaattcgcccgagctgtttat

SEQ ID NO: 5543168 - DNA, 16 bp, Homo sapiens
aaaattctagctgtat

SEQ ID NO: 5543169 - DNA, 18 bp, Homo sapiens
aaacagtgcctgctgaat

SEQ ID NO: 5543170 - DNA, 18 bp, Homo sapiens
aaacagtgctattctgag

SEQ ID NO: 5543171 - DNA, 14 bp, Homo sapiens
aaacagtgctgttt

SEQ ID NO: 5543172 - DNA, 23 bp, Homo sapiens
aaacagtggatcacaaagtggaa

SEQ ID NO: 5543173 - DNA, 20 bp, Homo sapiens
aaacagtgggagccctgacc

SEQ ID NO: 5543174 - DNA, 19 bp, Homo sapiens
aaacagtgtggcttaaaca

SEQ ID NO: 5543175 - DNA, 22 bp, Homo sapiens
aaacagtgtggcttaaacattt

SEQ ID NO: 5543176 - DNA, 17 bp, Homo sapiens
aaacagtgtgtaaacaa

SEQ ID NO: 5543177 - DNA, 12 bp, Homo sapiens
aaacagtgtttg

SEQ ID NO: 5543178 - DNA, 16 bp, Homo sapiens
aaacagttctcactgg

SEQ ID NO: 5543179 - DNA, 14 bp, Homo sapiens
aaacagttgaataa

SEQ ID NO: 5543180 - DNA, 16 bp, Homo sapiens
aaacagttgcacagca

SEQ ID NO: 5543181 - DNA, 22 bp, Homo sapiens
aaacagttgctgtgaactttca

SEQ ID NO: 5543182 - DNA, 23 bp, Homo sapiens
aaacagttgtaccactgctaata

SEQ ID NO: 5543183 - DNA, 17 bp, Homo sapiens
aaacagttgtctgctgt

SEQ ID NO: 5543184 - DNA, 13 bp, Homo sapiens
aaacagtttaaca

SEQ ID NO: 5543185 - DNA, 21 bp, Homo sapiens
aaacagtttcatctaaatgaa

SEQ ID NO: 5543186 - DNA, 13 bp, Homo sapiens
aaacataaaaact

SEQ ID NO: 5543187 - DNA, 13 bp, Homo sapiens
aaacataaaaagt

SEQ ID NO: 5543188 - DNA, 14 bp, Homo sapiens
aaacataaaaatca

SEQ ID NO: 5543189 - DNA, 16 bp, Homo sapiens
aaacataagagagcct

SEQ ID NO: 5543190 - DNA, 15 bp, Homo sapiens
aaacataagagcttt

SEQ ID NO: 5543191 - DNA, 14 bp, Homo sapiens
aaacataagtgcaa

SEQ ID NO: 5543192 - DNA, 10 bp, Homo sapiens
aaacataatt

SEQ ID NO: 5543193 - DNA, 13 bp, Homo sapiens
aaacataattctt

SEQ ID NO: 5543194 - DNA, 12 bp, Homo sapiens
aaacataattgt

SEQ ID NO: 5543195 - DNA, 16 bp, Homo sapiens
aaacatacataataca

SEQ ID NO: 5543196 - DNA, 16 bp, Homo sapiens
aaacatacttacattt

SEQ ID NO: 5543197 - DNA, 21 bp, Homo sapiens
aaacatagaaatggaaatttt

SEQ ID NO: 5543198 - DNA, 21 bp, Homo sapiens
aaacatagacagatgtggaca

SEQ ID NO: 5543199 - DNA, 18 bp, Homo sapiens
aaacatagactgaagatt

SEQ ID NO: 5543200 - DNA, 19 bp, Homo sapiens
aaacatagactgaagattt

SEQ ID NO: 5543201 - DNA, 16 bp, Homo sapiens
aaacatagcttgtaac

SEQ ID NO: 5543202 - DNA, 14 bp, Homo sapiens
aaacataggaatat

SEQ ID NO: 5543203 - DNA, 17 bp, Homo sapiens
aaacataggtataatta

SEQ ID NO: 5543204 - DNA, 17 bp, Homo sapiens
aaacatatacagaaaaa

SEQ ID NO: 5543205 - DNA, 21 bp, Homo sapiens
aaacatatataacaatgctgt

SEQ ID NO: 5543206 - DNA, 17 bp, Homo sapiens
aaacatatcatggtaat

SEQ ID NO: 5543207 - DNA, 23 bp, Homo sapiens
aaacatatcatggtaatgacaga

SEQ ID NO: 5543208 - DNA, 19 bp, Homo sapiens
aaacatatccaagtttgaa

SEQ ID NO: 5543209 - DNA, 14 bp, Homo sapiens
aaacatatctctta

SEQ ID NO: 5543210 - DNA, 23 bp, Homo sapiens
aaacatatctcttatcttacgaa

SEQ ID NO: 5543211 - DNA, 15 bp, Homo sapiens
aaacatatgatttca

SEQ ID NO: 5543212 - DNA, 14 bp, Homo sapiens
aaacatatgcacat

SEQ ID NO: 5543213 - DNA, 17 bp, Homo sapiens
aaacatatgtatctttg

SEQ ID NO: 5543214 - DNA, 22 bp, Homo sapiens
aaacatatgtctgtctttgcaa

SEQ ID NO: 5543215 - DNA, 23 bp, Homo sapiens
aaacatatgtctgtctttgcaaa

SEQ ID NO: 5543216 - DNA, 15 bp, Homo sapiens
aaacatattcaagga

SEQ ID NO: 5543217 - DNA, 13 bp, Homo sapiens
aaacatatttata

SEQ ID NO: 5543218 - DNA, 15 bp, Homo sapiens
aaacatatttcattt

SEQ ID NO: 5543219 - DNA, 19 bp, Homo sapiens
aaacatatttttatacttt

SEQ ID NO: 5543220 - DNA, 19 bp, Homo sapiens
aaacatcaaataaatttct

SEQ ID NO: 5543221 - DNA, 20 bp, Homo sapiens
aaacatcaacctggcaaaaa

SEQ ID NO: 5543222 - DNA, 22 bp, Homo sapiens
aaacatcacacacacagacaga

SEQ ID NO: 5543223 - DNA, 13 bp, Homo sapiens
aaacatcacattc

SEQ ID NO: 5543224 - DNA, 18 bp, Homo sapiens
aaacatcagctgaattca

SEQ ID NO: 5543225 - DNA, 20 bp, Homo sapiens
aaacatcagttactctgaag

SEQ ID NO: 5543226 - DNA, 23 bp, Homo sapiens
aaacatcagttactctgaagggc

SEQ ID NO: 5543227 - DNA, 16 bp, Homo sapiens
aaacatcataaatctt

SEQ ID NO: 5543228 - DNA, 19 bp, Homo sapiens
aaacatcattcatttttgt

SEQ ID NO: 5543229 - DNA, 16 bp, Homo sapiens
aaacatcattcctttt

SEQ ID NO: 5543230 - DNA, 19 bp, Homo sapiens
aaacatcattcctttttat

SEQ ID NO: 5543231 - DNA, 21 bp, Homo sapiens
aaacatcattcctttttattt

SEQ ID NO: 5543232 - DNA, 20 bp, Homo sapiens
aaacatccacttaagttctt

SEQ ID NO: 5543233 - DNA, 18 bp, Homo sapiens
aaacatcccaaactttaa

SEQ ID NO: 5543234 - DNA, 19 bp, Homo sapiens
aaacatcccaaactttaaa

SEQ ID NO: 5543235 - DNA, 23 bp, Homo sapiens
aaacatcccaaactttaaaatgc

SEQ ID NO: 5543236 - DNA, 16 bp, Homo sapiens
aaacatcccactgact

SEQ ID NO: 5543237 - DNA, 18 bp, Homo sapiens
aaacatcctacaagacac

SEQ ID NO: 5543238 - DNA, 20 bp, Homo sapiens
aaacatcctatgaaatactt

SEQ ID NO: 5543239 - DNA, 14 bp, Homo sapiens
aaacatcctgactt

SEQ ID NO: 5543240 - DNA, 13 bp, Homo sapiens
aaacatctcagag

SEQ ID NO: 5543241 - DNA, 13 bp, Homo sapiens
aaacatctcctta

SEQ ID NO: 5543242 - DNA, 11 bp, Homo sapiens
aaacatctgga

SEQ ID NO: 5543243 - DNA, 14 bp, Homo sapiens
aaacatctgtgtct

SEQ ID NO: 5543244 - DNA, 16 bp, Homo sapiens
aaacatctttgaaatt

SEQ ID NO: 5543245 - DNA, 13 bp, Homo sapiens
aaacatgaaaaca

SEQ ID NO: 5543246 - DNA, 20 bp, Homo sapiens
aaacatgaagcataatttgt

SEQ ID NO: 5543247 - DNA, 23 bp, Homo sapiens
aaacatgaagggaaaattagctt

SEQ ID NO: 5543248 - DNA, 13 bp, Homo sapiens
aaacatgaattat

SEQ ID NO: 5543249 - DNA, 16 bp, Homo sapiens
aaacatgaatttagaa

SEQ ID NO: 5543250 - DNA, 13 bp, Homo sapiens
aaacatgacactg

SEQ ID NO: 5543251 - DNA, 21 bp, Homo sapiens
aaacatgaccctaaatcttga

SEQ ID NO: 5543252 - DNA, 13 bp, Homo sapiens
aaacatgagaaat

SEQ ID NO: 5543253 - DNA, 14 bp, Homo sapiens
aaacatgagaaatg

SEQ ID NO: 5543254 - DNA, 17 bp, Homo sapiens
aaacatgagaaatgtga

SEQ ID NO: 5543255 - DNA, 23 bp, Homo sapiens
aaacatgaggttctctctactgg

SEQ ID NO: 5543256 - DNA, 19 bp, Homo sapiens
aaacatgagtgaatagctt

SEQ ID NO: 5543257 - DNA, 16 bp, Homo sapiens
aaacatgagttattca

SEQ ID NO: 5543258 - DNA, 16 bp, Homo sapiens
aaacatgatgtcaact

SEQ ID NO: 5543259 - DNA, 16 bp, Homo sapiens
aaacatgcagaacaaa

SEQ ID NO: 5543260 - DNA, 24 bp, Homo sapiens
aaacatgctaaatagttctatcag

SEQ ID NO: 5543261 - DNA, 16 bp, Homo sapiens
aaacatgctagtgata

SEQ ID NO: 5543262 - DNA, 15 bp, Homo sapiens
aaacatgctgtacat

SEQ ID NO: 5543263 - DNA, 16 bp, Homo sapiens
aaacatgctgtacata

SEQ ID NO: 5543264 - DNA, 20 bp, Homo sapiens
aaacatgctgtacatacttt

SEQ ID NO: 5543265 - DNA, 18 bp, Homo sapiens
aaacatgcttataacatt

SEQ ID NO: 5543266 - DNA, 20 bp, Homo sapiens
aaacatgcttataacattaa

SEQ ID NO: 5543267 - DNA, 23 bp, Homo sapiens
aaacatgcttgaataactgagct

SEQ ID NO: 5543268 - DNA, 18 bp, Homo sapiens
aaacatgcttttccaaac

SEQ ID NO: 5543269 - DNA, 23 bp, Homo sapiens
aaacatggccacatccaacattt

SEQ ID NO: 5543270 - DNA, 15 bp, Homo sapiens
aaacatgggctgtga

SEQ ID NO: 5543271 - DNA, 17 bp, Homo sapiens
aaacatgggctgtgatt

SEQ ID NO: 5543272 - DNA, 16 bp, Homo sapiens
aaacatgggtttagtt

SEQ ID NO: 5543273 - DNA, 15 bp, Homo sapiens
aaacatggttacaat

SEQ ID NO: 5543274 - DNA, 17 bp, Homo sapiens
aaacatggttgtaatat

SEQ ID NO: 5543275 - DNA, 17 bp, Homo sapiens
aaacatggtttgactct

SEQ ID NO: 5543276 - DNA, 17 bp, Homo sapiens
aaacatgtatgtaaata

SEQ ID NO: 5543277 - DNA, 13 bp, Homo sapiens
aaacatgtatgtg

SEQ ID NO: 5543278 - DNA, 15 bp, Homo sapiens
aaacatgtatttatg

SEQ ID NO: 5543279 - DNA, 12 bp, Homo sapiens
aaacatgtcatg

SEQ ID NO: 5543280 - DNA, 22 bp, Homo sapiens
aaacatgtctcctatcctggtt

SEQ ID NO: 5543281 - DNA, 16 bp, Homo sapiens
aaacatgtgcccctgc

SEQ ID NO: 5543282 - DNA, 17 bp, Homo sapiens
aaacatgtggagtgtat

SEQ ID NO: 5543283 - DNA, 15 bp, Homo sapiens
aaacatgttagtcaa

SEQ ID NO: 5543284 - DNA, 20 bp, Homo sapiens
aaacatgttgccaaaatggt

SEQ ID NO: 5543285 - DNA, 21 bp, Homo sapiens
aaacatgtttaaatagcctaa

SEQ ID NO: 5543286 - DNA, 19 bp, Homo sapiens
aaacatgtttccactattg

SEQ ID NO: 5543287 - DNA, 19 bp, Homo sapiens
aaacatgtttctttgtaat

SEQ ID NO: 5543288 - DNA, 14 bp, Homo sapiens
aaacattaaaatat

SEQ ID NO: 5543289 - DNA, 18 bp, Homo sapiens
aaacattaaacactgtaa

SEQ ID NO: 5543290 - DNA, 21 bp, Homo sapiens
aaacattaaacactgtaatct

SEQ ID NO: 5543291 - DNA, 16 bp, Homo sapiens
aaacattaaatgtctt

SEQ ID NO: 5543292 - DNA, 12 bp, Homo sapiens
aaacattaagaa

SEQ ID NO: 5543293 - DNA, 14 bp, Homo sapiens
aaacattaagaaaa

SEQ ID NO: 5543294 - DNA, 19 bp, Homo sapiens
aaacattaagaaaatcata

SEQ ID NO: 5543295 - DNA, 15 bp, Homo sapiens
aaacattaagattga

SEQ ID NO: 5543296 - DNA, 20 bp, Homo sapiens
aaacattaagattgaggcct

SEQ ID NO: 5543297 - DNA, 14 bp, Homo sapiens
aaacattaatgttg

SEQ ID NO: 5543298 - DNA, 16 bp, Homo sapiens
aaacattaattttgtg

SEQ ID NO: 5543299 - DNA, 17 bp, Homo sapiens
aaacattaattttgtgc

SEQ ID NO: 5543300 - DNA, 22 bp, Homo sapiens
aaacattaattttgtgcattct

SEQ ID NO: 5543301 - DNA, 23 bp, Homo sapiens
aaacattaattttgtgcattctt

SEQ ID NO: 5543302 - DNA, 16 bp, Homo sapiens
aaacattagaagaaaa

SEQ ID NO: 5543303 - DNA, 21 bp, Homo sapiens
aaacattagaagaaaacatat

SEQ ID NO: 5543304 - DNA, 17 bp, Homo sapiens
aaacattagtactttat

SEQ ID NO: 5543305 - DNA, 24 bp, Homo sapiens
aaacattagtactttatagaagaa

SEQ ID NO: 5543306 - DNA, 20 bp, Homo sapiens
aaacattagtgaaaattctg

SEQ ID NO: 5543307 - DNA, 19 bp, Homo sapiens
aaacattatatgtatacat

SEQ ID NO: 5543308 - DNA, 15 bp, Homo sapiens
aaacattatgatgtg

SEQ ID NO: 5543309 - DNA, 17 bp, Homo sapiens
aaacattattttaattg

SEQ ID NO: 5543310 - DNA, 23 bp, Homo sapiens
aaacattcaaaaacatggccaca

SEQ ID NO: 5543311 - DNA, 21 bp, Homo sapiens
aaacattcaattccagagaac

SEQ ID NO: 5543312 - DNA, 19 bp, Homo sapiens
aaacattcagaggaagaca

SEQ ID NO: 5543313 - DNA, 14 bp, Homo sapiens
aaacattcatcacc

SEQ ID NO: 5543314 - DNA, 22 bp, Homo sapiens
aaacattcatgtaactctccag

SEQ ID NO: 5543315 - DNA, 10 bp, Homo sapiens
aaacattcca

SEQ ID NO: 5543316 - DNA, 13 bp, Homo sapiens
aaacattccagat

SEQ ID NO: 5543317 - DNA, 14 bp, Homo sapiens
aaacattccagatg

SEQ ID NO: 5543318 - DNA, 13 bp, Homo sapiens
aaacattcccctc

SEQ ID NO: 5543319 - DNA, 23 bp, Homo sapiens
aaacattctgatttggaaaaaga

SEQ ID NO: 5543320 - DNA, 17 bp, Homo sapiens
aaacattctttcctaaa

SEQ ID NO: 5543321 - DNA, 14 bp, Homo sapiens
aaacattgaaatat

SEQ ID NO: 5543322 - DNA, 13 bp, Homo sapiens
aaacattgagact

SEQ ID NO: 5543323 - DNA, 18 bp, Homo sapiens
aaacattgagactgctag

SEQ ID NO: 5543324 - DNA, 18 bp, Homo sapiens
aaacattgcctttgaatg

SEQ ID NO: 5543325 - DNA, 17 bp, Homo sapiens
aaacattgctgcctttg

SEQ ID NO: 5543326 - DNA, 13 bp, Homo sapiens
aaacattggaagc

SEQ ID NO: 5543327 - DNA, 17 bp, Homo sapiens
aaacattggaagcaggt

SEQ ID NO: 5543328 - DNA, 20 bp, Homo sapiens
aaacattggttcttgtatta

SEQ ID NO: 5543329 - DNA, 11 bp, Homo sapiens
aaacattgtaa

SEQ ID NO: 5543330 - DNA, 17 bp, Homo sapiens
aaacattgtaaatattt

SEQ ID NO: 5543331 - DNA, 14 bp, Homo sapiens
aaacatttaaactt

SEQ ID NO: 5543332 - DNA, 13 bp, Homo sapiens
aaacatttaaaga

SEQ ID NO: 5543333 - DNA, 18 bp, Homo sapiens
aaacatttacaataaata

SEQ ID NO: 5543334 - DNA, 20 bp, Homo sapiens
aaacatttaccaatcatatt

SEQ ID NO: 5543335 - DNA, 11 bp, Homo sapiens
aaacatttata

SEQ ID NO: 5543336 - DNA, 15 bp, Homo sapiens
aaacatttataaact

SEQ ID NO: 5543337 - DNA, 14 bp, Homo sapiens
aaacatttatgaca

SEQ ID NO: 5543338 - DNA, 16 bp, Homo sapiens
aaacatttatgacaag

SEQ ID NO: 5543339 - DNA, 23 bp, Homo sapiens
aaacatttattttttttaaagaa

SEQ ID NO: 5543340 - DNA, 19 bp, Homo sapiens
aaacatttcaagtttactc

SEQ ID NO: 5543341 - DNA, 22 bp, Homo sapiens
aaacatttcaatgtcagccttt

SEQ ID NO: 5543342 - DNA, 16 bp, Homo sapiens
aaacatttcataattt

SEQ ID NO: 5543343 - DNA, 18 bp, Homo sapiens
aaacatttcataatttgt

SEQ ID NO: 5543344 - DNA, 13 bp, Homo sapiens
aaacatttcatcc

SEQ ID NO: 5543345 - DNA, 16 bp, Homo sapiens
aaacatttccctgctg

SEQ ID NO: 5543346 - DNA, 20 bp, Homo sapiens
aaacatttccctgctgagtg

SEQ ID NO: 5543347 - DNA, 20 bp, Homo sapiens
aaactatccttctctttcaa

SEQ ID NO: 5543348 - DNA, 18 bp, Homo sapiens
aaactatcgccatggctt

SEQ ID NO: 5543349 - DNA, 16 bp, Homo sapiens
aaactatctgtattta

SEQ ID NO: 5543350 - DNA, 17 bp, Homo sapiens
aaactatgatttatttt

SEQ ID NO: 5543351 - DNA, 21 bp, Homo sapiens
aaactatggtgtgcttatgtt

SEQ ID NO: 5543352 - DNA, 18 bp, Homo sapiens
aaactatggttcccaata

SEQ ID NO: 5543353 - DNA, 21 bp, Homo sapiens
aaactatggttcccaataaaa

SEQ ID NO: 5543354 - DNA, 22 bp, Homo sapiens
aaactatgtgttcaatgaaata

SEQ ID NO: 5543355 - DNA, 19 bp, Homo sapiens
aaactatgtgtttttctca

SEQ ID NO: 5543356 - DNA, 18 bp, Homo sapiens
aaactattagagtatttc

SEQ ID NO: 5543357 - DNA, 22 bp, Homo sapiens
aaactattccatgttttaaaat

SEQ ID NO: 5543358 - DNA, 17 bp, Homo sapiens
aaactattgagccttgc

SEQ ID NO: 5543359 - DNA, 19 bp, Homo sapiens
aaactatttaaaattggca

SEQ ID NO: 5543360 - DNA, 13 bp, Homo sapiens
aaactatttaaca

SEQ ID NO: 5543361 - DNA, 19 bp, Homo sapiens
aaactatttacaatgtgta

SEQ ID NO: 5543362 - DNA, 22 bp, Homo sapiens
aaactatttatctgtgtttttg

SEQ ID NO: 5543363 - DNA, 17 bp, Homo sapiens
aaactatttattgtgct

SEQ ID NO: 5543364 - DNA, 19 bp, Homo sapiens
aaactatttattgtgctgg

SEQ ID NO: 5543365 - DNA, 12 bp, Homo sapiens
aaactatttcag

SEQ ID NO: 5543366 - DNA, 17 bp, Homo sapiens
aaactatttcagaatat

SEQ ID NO: 5543367 - DNA, 15 bp, Homo sapiens
aaactatttgcgact

SEQ ID NO: 5543368 - DNA, 14 bp, Homo sapiens
aaactatttttgta

SEQ ID NO: 5543369 - DNA, 22 bp, Homo sapiens
aaactatttttgtaaaagacat

SEQ ID NO: 5543370 - DNA, 19 bp, Homo sapiens
aaactcaaaacttaacata

SEQ ID NO: 5543371 - DNA, 20 bp, Homo sapiens
aaactcaaccaaatggtaca

SEQ ID NO: 5543372 - DNA, 22 bp, Homo sapiens
aaactcaaccatgtcatctttt

SEQ ID NO: 5543373 - DNA, 14 bp, Homo sapiens
aaactcaagacaat

SEQ ID NO: 5543374 - DNA, 16 bp, Homo sapiens
aaactcaccatttcat

SEQ ID NO: 5543375 - DNA, 17 bp, Homo sapiens
aaactcaccatttcatc

SEQ ID NO: 5543376 - DNA, 22 bp, Homo sapiens
aaactcacggaccactcgaggc

SEQ ID NO: 5543377 - DNA, 13 bp, Homo sapiens
aaactcactgtga

SEQ ID NO: 5543378 - DNA, 14 bp, Homo sapiens
aaactcagatcctt

SEQ ID NO: 5543379 - DNA, 16 bp, Homo sapiens
aaactcagatttaaaa

SEQ ID NO: 5543380 - DNA, 13 bp, Homo sapiens
aaactcaggcaga

SEQ ID NO: 5543381 - DNA, 13 bp, Homo sapiens
aaactcagggaca

SEQ ID NO: 5543382 - DNA, 19 bp, Homo sapiens
aaactcagggacagagcca

SEQ ID NO: 5543383 - DNA, 16 bp, Homo sapiens
aaactcagggcttcta

SEQ ID NO: 5543384 - DNA, 14 bp, Homo sapiens
aaactcagttaaaa

SEQ ID NO: 5543385 - DNA, 15 bp, Homo sapiens
aaactcagttaaaat

SEQ ID NO: 5543386 - DNA, 17 bp, Homo sapiens
aaactcagttaaaatgt

SEQ ID NO: 5543387 - DNA, 20 bp, Homo sapiens
aaactcagttcaaaccattt

SEQ ID NO: 5543388 - DNA, 18 bp, Homo sapiens
aaactcatacagtggtat

SEQ ID NO: 5543389 - DNA, 17 bp, Homo sapiens
aaactcatattacaaaa

SEQ ID NO: 5543390 - DNA, 19 bp, Homo sapiens
aaactcatcacataaagaa

SEQ ID NO: 5543391 - DNA, 22 bp, Homo sapiens
aaactcatcacataaagaaatt

SEQ ID NO: 5543392 - DNA, 13 bp, Homo sapiens
aaactcatctcat

SEQ ID NO: 5543393 - DNA, 16 bp, Homo sapiens
aaactcatctgaaatg

SEQ ID NO: 5543394 - DNA, 13 bp, Homo sapiens
aaactcatctgga

SEQ ID NO: 5543395 - DNA, 17 bp, Homo sapiens
aaactcatgatcaagat

SEQ ID NO: 5543396 - DNA, 21 bp, Homo sapiens
aaactcatgatcaagatatat

SEQ ID NO: 5543397 - DNA, 21 bp, Homo sapiens
aaactcattcattagtcatgt

SEQ ID NO: 5543398 - DNA, 14 bp, Homo sapiens
aaactcatttatct

SEQ ID NO: 5543399 - DNA, 12 bp, Homo sapiens
aaactccaaagt

SEQ ID NO: 5543400 - DNA, 15 bp, Homo sapiens
aaactccaaagtcca

SEQ ID NO: 5543401 - DNA, 16 bp, Homo sapiens
aaactccacatctgcc

SEQ ID NO: 5543402 - DNA, 18 bp, Homo sapiens
aaactccacatctgcctt

SEQ ID NO: 5543403 - DNA, 22 bp, Homo sapiens
aaactccagatgccacaatgga

SEQ ID NO: 5543404 - DNA, 19 bp, Homo sapiens
aaactccaggatttataaa

SEQ ID NO: 5543405 - DNA, 15 bp, Homo sapiens
aaactccaggctgga

SEQ ID NO: 5543406 - DNA, 23 bp, Homo sapiens
aaactccagggtcccctgccacc

SEQ ID NO: 5543407 - DNA, 21 bp, Homo sapiens
aaactccatctcaaaacaaaa

SEQ ID NO: 5543408 - DNA, 16 bp, Homo sapiens
aaactccatgatattt

SEQ ID NO: 5543409 - DNA, 18 bp, Homo sapiens
aaactccatgatatttaa

SEQ ID NO: 5543410 - DNA, 17 bp, Homo sapiens
aaactcccaatacaaag

SEQ ID NO: 5543411 - DNA, 23 bp, Homo sapiens
aaactcccatttacgtgtctgaa

SEQ ID NO: 5543412 - DNA, 20 bp, Homo sapiens
aaactccccttccctgggga

SEQ ID NO: 5543413 - DNA, 16 bp, Homo sapiens
aaactccctggctgtt

SEQ ID NO: 5543414 - DNA, 17 bp, Homo sapiens
aaactcccttgtgttcc

SEQ ID NO: 5543415 - DNA, 19 bp, Homo sapiens
aaactcccttgtgttcctt

SEQ ID NO: 5543416 - DNA, 22 bp, Homo sapiens
aaactccgagtgaactggtctt

SEQ ID NO: 5543417 - DNA, 16 bp, Homo sapiens
aaactccgcccccagc

SEQ ID NO: 5543418 - DNA, 16 bp, Homo sapiens
aaactcctactgcttc

SEQ ID NO: 5543419 - DNA, 14 bp, Homo sapiens
aaactcctgaaaaa

SEQ ID NO: 5543420 - DNA, 11 bp, Homo sapiens
aaactcctgac

SEQ ID NO: 5543421 - DNA, 12 bp, Homo sapiens
aaactcctgacc

SEQ ID NO: 5543422 - DNA, 15 bp, Homo sapiens
aaactcctgacctca

SEQ ID NO: 5543423 - DNA, 16 bp, Homo sapiens
aaactcctgacttcag

SEQ ID NO: 5543424 - DNA, 17 bp, Homo sapiens
aaactcctgattttgta

SEQ ID NO: 5543425 - DNA, 14 bp, Homo sapiens
aaactcctgtgacc

SEQ ID NO: 5543426 - DNA, 20 bp, Homo sapiens
aaactcctgttttcacacct

SEQ ID NO: 5543427 - DNA, 14 bp, Homo sapiens
aaactccttttgct

SEQ ID NO: 5543428 - DNA, 19 bp, Homo sapiens
aaactccttttgctgtctt

SEQ ID NO: 5543429 - DNA, 21 bp, Homo sapiens
aaactcgcgagtgtaactttc

SEQ ID NO: 5543430 - DNA, 21 bp, Homo sapiens
aaactcgcttaggtagaaact

SEQ ID NO: 5543431 - DNA, 18 bp, Homo sapiens
aaactcgtctgatgtttt

SEQ ID NO: 5543432 - DNA, 22 bp, Homo sapiens
aaactcgtctgatgttttgatg

SEQ ID NO: 5543433 - DNA, 15 bp, Homo sapiens
aaactcgttaatttg

SEQ ID NO: 5543434 - DNA, 21 bp, Homo sapiens
aaactctaaacattaatcaat

SEQ ID NO: 5543435 - DNA, 15 bp, Homo sapiens
aaactctactaattt

SEQ ID NO: 5543436 - DNA, 15 bp, Homo sapiens
aaactctagactgca

SEQ ID NO: 5543437 - DNA, 16 bp, Homo sapiens
aaactctataaagaaa

SEQ ID NO: 5543438 - DNA, 17 bp, Homo sapiens
aaactctatggtcttat

SEQ ID NO: 5543439 - DNA, 18 bp, Homo sapiens
aaactctcctctgctgct

SEQ ID NO: 5543440 - DNA, 20 bp, Homo sapiens
aaactctcgagacttctctg

SEQ ID NO: 5543441 - DNA, 13 bp, Homo sapiens
aaactctctagct

SEQ ID NO: 5543442 - DNA, 17 bp, Homo sapiens
aaactctctagcttaag

SEQ ID NO: 5543443 - DNA, 15 bp, Homo sapiens
aaactctctcccagg

SEQ ID NO: 5543444 - DNA, 16 bp, Homo sapiens
aaactctctcccagga

SEQ ID NO: 5543445 - DNA, 17 bp, Homo sapiens
aaactctctcccaggac

SEQ ID NO: 5543446 - DNA, 22 bp, Homo sapiens
aaactctctttgggaatgtttg

SEQ ID NO: 5543447 - DNA, 16 bp, Homo sapiens
aaactctgaaggagag

SEQ ID NO: 5543448 - DNA, 23 bp, Homo sapiens
aaactctgcatccagagattcat

SEQ ID NO: 5543449 - DNA, 11 bp, Homo sapiens
aaactctgcca

SEQ ID NO: 5543450 - DNA, 12 bp, Homo sapiens
aaactctgctgt

SEQ ID NO: 5543451 - DNA, 13 bp, Homo sapiens
aaactctggagag

SEQ ID NO: 5543452 - DNA, 18 bp, Homo sapiens
aaactctggctcagcctg

SEQ ID NO: 5543453 - DNA, 22 bp, Homo sapiens
aaactctgggaaataagagaga

SEQ ID NO: 5543454 - DNA, 16 bp, Homo sapiens
aaactctgggtcttgg

SEQ ID NO: 5543455 - DNA, 18 bp, Homo sapiens
aaactctgttacactttt

SEQ ID NO: 5543456 - DNA, 12 bp, Homo sapiens
aaactcttaaaa

SEQ ID NO: 5543457 - DNA, 18 bp, Homo sapiens
aaactcttaatctgtgtg

SEQ ID NO: 5543458 - DNA, 21 bp, Homo sapiens
aaactcttcagttaattctta

SEQ ID NO: 5543459 - DNA, 16 bp, Homo sapiens
aaactcttgaatatgt

SEQ ID NO: 5543460 - DNA, 17 bp, Homo sapiens
aaactcttggcctctgc

SEQ ID NO: 5543461 - DNA, 13 bp, Homo sapiens
aaactcttgtgta

SEQ ID NO: 5543462 - DNA, 17 bp, Homo sapiens
aaactctttcattcttc

SEQ ID NO: 5543463 - DNA, 21 bp, Homo sapiens
aaactctttggtcgttttttt

SEQ ID NO: 5543464 - DNA, 13 bp, Homo sapiens
aaactcttttccc

SEQ ID NO: 5543465 - DNA, 13 bp, Homo sapiens
aaactgaaaaatc

SEQ ID NO: 5543466 - DNA, 17 bp, Homo sapiens
aaactgaaaatctaata

SEQ ID NO: 5543467 - DNA, 16 bp, Homo sapiens
aaactgaaataaacct

SEQ ID NO: 5543468 - DNA, 16 bp, Homo sapiens
aaactgaaatttgcta

SEQ ID NO: 5543469 - DNA, 17 bp, Homo sapiens
aaactgaaccaacagaa

SEQ ID NO: 5543470 - DNA, 17 bp, Homo sapiens
aaactgaacttgaagct

SEQ ID NO: 5543471 - DNA, 21 bp, Homo sapiens
aaactgaagatgaaatatata

SEQ ID NO: 5543472 - DNA, 14 bp, Homo sapiens
aaactgaagcaact

SEQ ID NO: 5543473 - DNA, 12 bp, Homo sapiens
aaactgaaggtt

SEQ ID NO: 5543474 - DNA, 19 bp, Homo sapiens
aaactgaagtctgaaattt

SEQ ID NO: 5543475 - DNA, 23 bp, Homo sapiens
aaactgaatacctaagatttctg

SEQ ID NO: 5543476 - DNA, 20 bp, Homo sapiens
aaactgaatctatggcttta

SEQ ID NO: 5543477 - DNA, 15 bp, Homo sapiens
aaactgaatttgttc

SEQ ID NO: 5543478 - DNA, 22 bp, Homo sapiens
aaactgacaacctgtgcagtcc

SEQ ID NO: 5543479 - DNA, 13 bp, Homo sapiens
aaactgacaattt

SEQ ID NO: 5543480 - DNA, 13 bp, Homo sapiens
aaactgacagtat

SEQ ID NO: 5543481 - DNA, 14 bp, Homo sapiens
aaactgacagtatt

SEQ ID NO: 5543482 - DNA, 20 bp, Homo sapiens
aaactgacagtattaagggt

SEQ ID NO: 5543483 - DNA, 14 bp, Homo sapiens
aaactgacatcaga

SEQ ID NO: 5543484 - DNA, 22 bp, Homo sapiens
aaactgacatcagatttcttaa

SEQ ID NO: 5543485 - DNA, 23 bp, Homo sapiens
aaactgacatcagatttcttaat

SEQ ID NO: 5543486 - DNA, 19 bp, Homo sapiens
aaactgacatgccctccct

SEQ ID NO: 5543487 - DNA, 20 bp, Homo sapiens
aaactgacatgccctccctt

SEQ ID NO: 5543488 - DNA, 16 bp, Homo sapiens
aaactgactcttaaga

SEQ ID NO: 5543489 - DNA, 12 bp, Homo sapiens
aaactgacttta

SEQ ID NO: 5543490 - DNA, 20 bp, Homo sapiens
aaactgactttttcccccca

SEQ ID NO: 5543491 - DNA, 15 bp, Homo sapiens
aaactgagacaggca

SEQ ID NO: 5543492 - DNA, 13 bp, Homo sapiens
aaactgagaccaa

SEQ ID NO: 5543493 - DNA, 16 bp, Homo sapiens
aaactgagaccaagtc

SEQ ID NO: 5543494 - DNA, 22 bp, Homo sapiens
aaactgagatccttccttttga

SEQ ID NO: 5543495 - DNA, 14 bp, Homo sapiens
aaactgagcgaccc

SEQ ID NO: 5543496 - DNA, 19 bp, Homo sapiens
aaactgaggaattttcttt

SEQ ID NO: 5543497 - DNA, 20 bp, Homo sapiens
aaactgaggccattatttca

SEQ ID NO: 5543498 - DNA, 13 bp, Homo sapiens
aaactgaggccca

SEQ ID NO: 5543499 - DNA, 16 bp, Homo sapiens
aaactgagtccatgaa

SEQ ID NO: 5543500 - DNA, 21 bp, Homo sapiens
aaactgatgcgaaaacttgaa

SEQ ID NO: 5543501 - DNA, 22 bp, Homo sapiens
aaactgatgcgaaaacttgaat

SEQ ID NO: 5543502 - DNA, 17 bp, Homo sapiens
aaactgatgctgaggat

SEQ ID NO: 5543503 - DNA, 22 bp, Homo sapiens
aaactgatgctgaggatgattg

SEQ ID NO: 5543504 - DNA, 12 bp, Homo sapiens
aaactgatgtac

SEQ ID NO: 5543505 - DNA, 14 bp, Homo sapiens
aaactgatttccca

SEQ ID NO: 5543506 - DNA, 13 bp, Homo sapiens
aaactgatttctt

SEQ ID NO: 5543507 - DNA, 17 bp, Homo sapiens
aaactgatttcttcaga

SEQ ID NO: 5543508 - DNA, 19 bp, Homo sapiens
aaactgatttttttttcct

SEQ ID NO: 5543509 - DNA, 22 bp, Homo sapiens
aaactgatttttttttccttca

SEQ ID NO: 5543510 - DNA, 22 bp, Homo sapiens
aaactgcaaatgtccccttgat

SEQ ID NO: 5543511 - DNA, 17 bp, Homo sapiens
aaactgcaaatgtgcag

SEQ ID NO: 5543512 - DNA, 12 bp, Homo sapiens
aaactgcaatag

SEQ ID NO: 5543513 - DNA, 18 bp, Homo sapiens
aaactgcaatagagactg

SEQ ID NO: 5543514 - DNA, 17 bp, Homo sapiens
aaactgcacaataaaac

SEQ ID NO: 5543515 - DNA, 17 bp, Homo sapiens
aaactgcacagtgctgt

SEQ ID NO: 5543516 - DNA, 14 bp, Homo sapiens
aaactgcacatcta

SEQ ID NO: 5543517 - DNA, 15 bp, Homo sapiens
aaactgcacatctac

SEQ ID NO: 5543518 - DNA, 17 bp, Homo sapiens
aaactgcacatgatttc

SEQ ID NO: 5543519 - DNA, 18 bp, Homo sapiens
aaactgcacatgatttca

SEQ ID NO: 5543520 - DNA, 15 bp, Homo sapiens
aaactgcacttttag

SEQ ID NO: 5543521 - DNA, 13 bp, Homo sapiens
aaactgcagtcct

SEQ ID NO: 5543522 - DNA, 12 bp, Homo sapiens
aaactgcagttt

SEQ ID NO: 5543523 - DNA, 16 bp, Homo sapiens
aaactgcagttttaac

SEQ ID NO: 5543524 - DNA, 23 bp, Homo sapiens
aaactgcataagtgaaaatctta

SEQ ID NO: 5543525 - DNA, 22 bp, Homo sapiens
aaactgcatcccacgttctgtt

SEQ ID NO: 5543526 - DNA, 22 bp, Homo sapiens
aaagacacacaggagtcctttc

SEQ ID NO: 5543527 - DNA, 21 bp, Homo sapiens
aaagacacagatttcggtcat

SEQ ID NO: 5543528 - DNA, 13 bp, Homo sapiens
aaagacacctact

SEQ ID NO: 5543529 - DNA, 19 bp, Homo sapiens
aaagacacctactgagtgg

SEQ ID NO: 5543530 - DNA, 12 bp, Homo sapiens
aaagacactgcc

SEQ ID NO: 5543531 - DNA, 13 bp, Homo sapiens
aaagacactgcct

SEQ ID NO: 5543532 - DNA, 16 bp, Homo sapiens
aaagacactgcctggg

SEQ ID NO: 5543533 - DNA, 9 bp, Homo sapiens
aaagacaga

SEQ ID NO: 5543534 - DNA, 12 bp, Homo sapiens
aaagacagaaaa

SEQ ID NO: 5543535 - DNA, 13 bp, Homo sapiens
aaagacagaatgg

SEQ ID NO: 5543536 - DNA, 19 bp, Homo sapiens
aaagacagaatggtggagt

SEQ ID NO: 5543537 - DNA, 21 bp, Homo sapiens
aaagacagagcggaactatga

SEQ ID NO: 5543538 - DNA, 15 bp, Homo sapiens
aaagacagagtgaat

SEQ ID NO: 5543539 - DNA, 16 bp, Homo sapiens
aaagacaggagtttat

SEQ ID NO: 5543540 - DNA, 22 bp, Homo sapiens
aaagacagggtgggagggagga

SEQ ID NO: 5543541 - DNA, 13 bp, Homo sapiens
aaagacagtgaaa

SEQ ID NO: 5543542 - DNA, 16 bp, Homo sapiens
aaagacagtgtatgta

SEQ ID NO: 5543543 - DNA, 22 bp, Homo sapiens
aaagacagtgtatgtagaagca

SEQ ID NO: 5543544 - DNA, 17 bp, Homo sapiens
aaagacagtttcttgca

SEQ ID NO: 5543545 - DNA, 14 bp, Homo sapiens
aaagacatacctga

SEQ ID NO: 5543546 - DNA, 14 bp, Homo sapiens
aaagacatcaatga

SEQ ID NO: 5543547 - DNA, 21 bp, Homo sapiens
aaagacatcagtctccaacat

SEQ ID NO: 5543548 - DNA, 15 bp, Homo sapiens
aaagacatgaatatg

SEQ ID NO: 5543549 - DNA, 16 bp, Homo sapiens
aaagacatgctttcca

SEQ ID NO: 5543550 - DNA, 17 bp, Homo sapiens
aaagacattgacagcaa

SEQ ID NO: 5543551 - DNA, 19 bp, Homo sapiens
aaagacattgacagcaatt

SEQ ID NO: 5543552 - DNA, 20 bp, Homo sapiens
aaagacattgattcagcctg

SEQ ID NO: 5543553 - DNA, 13 bp, Homo sapiens
aaagacatttcaa

SEQ ID NO: 5543554 - DNA, 15 bp, Homo sapiens
aaagacatttcatcc

SEQ ID NO: 5543555 - DNA, 23 bp, Homo sapiens
aaagacatttcatccaccaatat

SEQ ID NO: 5543556 - DNA, 17 bp, Homo sapiens
aaagacattttttaaaa

SEQ ID NO: 5543557 - DNA, 14 bp, Homo sapiens
aaagaccaaacttc

SEQ ID NO: 5543558 - DNA, 13 bp, Homo sapiens
aaagaccagacta

SEQ ID NO: 5543559 - DNA, 18 bp, Homo sapiens
aaagaccatgcattcaga

SEQ ID NO: 5543560 - DNA, 14 bp, Homo sapiens
aaagaccatttaat

SEQ ID NO: 5543561 - DNA, 15 bp, Homo sapiens
aaagacccaggggga

SEQ ID NO: 5543562 - DNA, 19 bp, Homo sapiens
aaagaccctaaatctgagg

SEQ ID NO: 5543563 - DNA, 21 bp, Homo sapiens
aaagaccctgatgcaggtcag

SEQ ID NO: 5543564 - DNA, 22 bp, Homo sapiens
aaagaccctgatgcaggtcagc

SEQ ID NO: 5543565 - DNA, 14 bp, Homo sapiens
aaagaccctggctt

SEQ ID NO: 5543566 - DNA, 18 bp, Homo sapiens
aaagaccctggctttcat

SEQ ID NO: 5543567 - DNA, 17 bp, Homo sapiens
aaagacctcgtggagaa

SEQ ID NO: 5543568 - DNA, 17 bp, Homo sapiens
aaagaccttgtgtgtat

SEQ ID NO: 5543569 - DNA, 20 bp, Homo sapiens
aaagaccttgtgtgtatgtg

SEQ ID NO: 5543570 - DNA, 23 bp, Homo sapiens
aaagaccttgtgtgtatgtgtac

SEQ ID NO: 5543571 - DNA, 22 bp, Homo sapiens
aaagacctttggagcaaagctg

SEQ ID NO: 5543572 - DNA, 16 bp, Homo sapiens
aaagacgatgtttatg

SEQ ID NO: 5543573 - DNA, 18 bp, Homo sapiens
aaagacgcaaggtgtgct

SEQ ID NO: 5543574 - DNA, 19 bp, Homo sapiens
aaagacgcaaggtgtgctc

SEQ ID NO: 5543575 - DNA, 21 bp, Homo sapiens
aaagacgctcaagaatcctct

SEQ ID NO: 5543576 - DNA, 22 bp, Homo sapiens
aaagacgtctctttttggtaat

SEQ ID NO: 5543577 - DNA, 13 bp, Homo sapiens
aaagactaagatc

SEQ ID NO: 5543578 - DNA, 23 bp, Homo sapiens
aaagactaatttaaaaaataact

SEQ ID NO: 5543579 - DNA, 14 bp, Homo sapiens
aaagactattcaaa

SEQ ID NO: 5543580 - DNA, 19 bp, Homo sapiens
aaagactattcaaacagtc

SEQ ID NO: 5543581 - DNA, 18 bp, Homo sapiens
aaagactatttcaaaatg

SEQ ID NO: 5543582 - DNA, 14 bp, Homo sapiens
aaagactattttct

SEQ ID NO: 5543583 - DNA, 14 bp, Homo sapiens
aaagactcaaattt

SEQ ID NO: 5543584 - DNA, 20 bp, Homo sapiens
aaagactcaaattttgtacc

SEQ ID NO: 5543585 - DNA, 15 bp, Homo sapiens
aaagactcagtgttc

SEQ ID NO: 5543586 - DNA, 10 bp, Homo sapiens
aaagactcat

SEQ ID NO: 5543587 - DNA, 14 bp, Homo sapiens
aaagactcatccgt

SEQ ID NO: 5543588 - DNA, 15 bp, Homo sapiens
aaagactcatccgtc

SEQ ID NO: 5543589 - DNA, 15 bp, Homo sapiens
aaagactccaaagaa

SEQ ID NO: 5543590 - DNA, 14 bp, Homo sapiens
aaagactcctctgg

SEQ ID NO: 5543591 - DNA, 16 bp, Homo sapiens
aaagactcctctgggc

SEQ ID NO: 5543592 - DNA, 17 bp, Homo sapiens
aaagactcgagaaccaa

SEQ ID NO: 5543593 - DNA, 18 bp, Homo sapiens
aaagactctgagccaagg

SEQ ID NO: 5543594 - DNA, 15 bp, Homo sapiens
aaagactctggaggt

SEQ ID NO: 5543595 - DNA, 13 bp, Homo sapiens
aaagactgcagaa

SEQ ID NO: 5543596 - DNA, 17 bp, Homo sapiens
aaagactgcagctgctg

SEQ ID NO: 5543597 - DNA, 11 bp, Homo sapiens
aaagactggca

SEQ ID NO: 5543598 - DNA, 23 bp, Homo sapiens
aaagactggcttttattaatgca

SEQ ID NO: 5543599 - DNA, 16 bp, Homo sapiens
aaagactggttttctg

SEQ ID NO: 5543600 - DNA, 15 bp, Homo sapiens
aaagactgtacaaag

SEQ ID NO: 5543601 - DNA, 13 bp, Homo sapiens
aaagactgtactg

SEQ ID NO: 5543602 - DNA, 14 bp, Homo sapiens
aaagactgtactgg

SEQ ID NO: 5543603 - DNA, 22 bp, Homo sapiens
aaagactgtcaaatgaactttt

SEQ ID NO: 5543604 - DNA, 13 bp, Homo sapiens
aaagactgttatt

SEQ ID NO: 5543605 - DNA, 18 bp, Homo sapiens
aaagacttagtatatttt

SEQ ID NO: 5543606 - DNA, 14 bp, Homo sapiens
aaagacttccctaa

SEQ ID NO: 5543607 - DNA, 20 bp, Homo sapiens
aaagacttctcaaagagaat

SEQ ID NO: 5543608 - DNA, 17 bp, Homo sapiens
aaagacttgagacaatg

SEQ ID NO: 5543609 - DNA, 18 bp, Homo sapiens
aaagacttggttggtagg

SEQ ID NO: 5543610 - DNA, 15 bp, Homo sapiens
aaagacttgtgcatc

SEQ ID NO: 5543611 - DNA, 20 bp, Homo sapiens
aaagacttgttaaatgtata

SEQ ID NO: 5543612 - DNA, 22 bp, Homo sapiens
aaagacttgttagccaacttca

SEQ ID NO: 5543613 - DNA, 22 bp, Homo sapiens
aaagacttttatgtgagatttc

SEQ ID NO: 5543614 - DNA, 13 bp, Homo sapiens
aaagagaaaagaa

SEQ ID NO: 5543615 - DNA, 14 bp, Homo sapiens
aaagagaaaagaaa

SEQ ID NO: 5543616 - DNA, 12 bp, Homo sapiens
aaagagaaacac

SEQ ID NO: 5543617 - DNA, 22 bp, Homo sapiens
aaagagaaacagttggtaactt

SEQ ID NO: 5543618 - DNA, 20 bp, Homo sapiens
aaagagaaaccgaggtgcaa

SEQ ID NO: 5543619 - DNA, 13 bp, Homo sapiens
aaagagaaacttt

SEQ ID NO: 5543620 - DNA, 23 bp, Homo sapiens
aaagagaaactttgtgctacatg

SEQ ID NO: 5543621 - DNA, 19 bp, Homo sapiens
aaagagaaagagacagaga

SEQ ID NO: 5543622 - DNA, 15 bp, Homo sapiens
aaagagaaagagttt

SEQ ID NO: 5543623 - DNA, 12 bp, Homo sapiens
aaagagaaatga

SEQ ID NO: 5543624 - DNA, 10 bp, Homo sapiens
aaagagaagg

SEQ ID NO: 5543625 - DNA, 15 bp, Homo sapiens
aaagagaaggcctgg

SEQ ID NO: 5543626 - DNA, 14 bp, Homo sapiens
aaagagaatgaact

SEQ ID NO: 5543627 - DNA, 15 bp, Homo sapiens
aaagagaatgaactg

SEQ ID NO: 5543628 - DNA, 12 bp, Homo sapiens
aaagagaatgag

SEQ ID NO: 5543629 - DNA, 19 bp, Homo sapiens
aaagagaattacttatatt

SEQ ID NO: 5543630 - DNA, 19 bp, Homo sapiens
aaagagaattagattatat

SEQ ID NO: 5543631 - DNA, 14 bp, Homo sapiens
aaagagacaggcag

SEQ ID NO: 5543632 - DNA, 13 bp, Homo sapiens
aaagagacagtga

SEQ ID NO: 5543633 - DNA, 14 bp, Homo sapiens
aaagagacatttca

SEQ ID NO: 5543634 - DNA, 10 bp, Homo sapiens
aaagagacca

SEQ ID NO: 5543635 - DNA, 11 bp, Homo sapiens
aaagagactct

SEQ ID NO: 5543636 - DNA, 15 bp, Homo sapiens
aaagagactggagca

SEQ ID NO: 5543637 - DNA, 14 bp, Homo sapiens
aaagagactgggcc

SEQ ID NO: 5543638 - DNA, 20 bp, Homo sapiens
aaagagactgtggggagggt

SEQ ID NO: 5543639 - DNA, 13 bp, Homo sapiens
aaagagagaaaat

SEQ ID NO: 5543640 - DNA, 21 bp, Homo sapiens
aaagagagaaaataaaaagtt

SEQ ID NO: 5543641 - DNA, 16 bp, Homo sapiens
aaagagagaagggaga

SEQ ID NO: 5543642 - DNA, 10 bp, Homo sapiens
aaagagagag

SEQ ID NO: 5543643 - DNA, 13 bp, Homo sapiens
aaagagagagaga

SEQ ID NO: 5543644 - DNA, 23 bp, Homo sapiens
aaagagagagagagagagagaag

SEQ ID NO: 5543645 - DNA, 13 bp, Homo sapiens
aaagagagagcag

SEQ ID NO: 5543646 - DNA, 15 bp, Homo sapiens
aaagagagatttttt

SEQ ID NO: 5543647 - DNA, 15 bp, Homo sapiens
aaagagagcagagaa

SEQ ID NO: 5543648 - DNA, 19 bp, Homo sapiens
aaagagagttaaaagcagc

SEQ ID NO: 5543649 - DNA, 18 bp, Homo sapiens
aaagagataataagatta

SEQ ID NO: 5543650 - DNA, 21 bp, Homo sapiens
aaagagataccaagatgccat

SEQ ID NO: 5543651 - DNA, 17 bp, Homo sapiens
aaagagatatgggaaca

SEQ ID NO: 5543652 - DNA, 13 bp, Homo sapiens
aaagagatatttt

SEQ ID NO: 5543653 - DNA, 16 bp, Homo sapiens
aaagagatattttaaa

SEQ ID NO: 5543654 - DNA, 24 bp, Homo sapiens
aaagagatccaggaagcatgagtg

SEQ ID NO: 5543655 - DNA, 19 bp, Homo sapiens
aaagagatgggccttttct

SEQ ID NO: 5543656 - DNA, 23 bp, Homo sapiens
aaagagatttcccttcatttaaa

SEQ ID NO: 5543657 - DNA, 12 bp, Homo sapiens
aaagagcacaaa

SEQ ID NO: 5543658 - DNA, 18 bp, Homo sapiens
aaagagcacaaacatttt

SEQ ID NO: 5543659 - DNA, 21 bp, Homo sapiens
aaagagcacttaagagaatat

SEQ ID NO: 5543660 - DNA, 14 bp, Homo sapiens
aaagagcagcattt

SEQ ID NO: 5543661 - DNA, 12 bp, Homo sapiens
aaagagcaggat

SEQ ID NO: 5543662 - DNA, 15 bp, Homo sapiens
aaagagcatggatgc

SEQ ID NO: 5543663 - DNA, 21 bp, Homo sapiens
aaagagcatggatgcatttca

SEQ ID NO: 5543664 - DNA, 15 bp, Homo sapiens
aaagagccaagttca

SEQ ID NO: 5543665 - DNA, 19 bp, Homo sapiens
aaagagccaagttcaaaga

SEQ ID NO: 5543666 - DNA, 21 bp, Homo sapiens
aaagagccatgtgtcatgtaa

SEQ ID NO: 5543667 - DNA, 22 bp, Homo sapiens
aaagagccctggctctgcccct

SEQ ID NO: 5543668 - DNA, 23 bp, Homo sapiens
aaagagccctggctctgcccctc

SEQ ID NO: 5543669 - DNA, 15 bp, Homo sapiens
aaagagcccttgcct

SEQ ID NO: 5543670 - DNA, 18 bp, Homo sapiens
aaagagcccttgcctccc

SEQ ID NO: 5543671 - DNA, 17 bp, Homo sapiens
aaagagctactcagaaa

SEQ ID NO: 5543672 - DNA, 16 bp, Homo sapiens
aaagagctgtctgact

SEQ ID NO: 5543673 - DNA, 19 bp, Homo sapiens
aaagagctgtggctggggg

SEQ ID NO: 5543674 - DNA, 16 bp, Homo sapiens
aaagagctgttttgga

SEQ ID NO: 5543675 - DNA, 18 bp, Homo sapiens
aaagagctgttttggatg

SEQ ID NO: 5543676 - DNA, 12 bp, Homo sapiens
aaagaggaaaga

SEQ ID NO: 5543677 - DNA, 20 bp, Homo sapiens
aaagaggaatggccctcatt

SEQ ID NO: 5543678 - DNA, 13 bp, Homo sapiens
aaagaggagaagg

SEQ ID NO: 5543679 - DNA, 17 bp, Homo sapiens
aaagaggagaaggagag

SEQ ID NO: 5543680 - DNA, 15 bp, Homo sapiens
aaagaggaggcagaa

SEQ ID NO: 5543681 - DNA, 14 bp, Homo sapiens
aaagaggagtgctt

SEQ ID NO: 5543682 - DNA, 14 bp, Homo sapiens
aaagaggatgattt

SEQ ID NO: 5543683 - DNA, 15 bp, Homo sapiens
aaagaggattagaca

SEQ ID NO: 5543684 - DNA, 17 bp, Homo sapiens
aaagaggattagtagaa

SEQ ID NO: 5543685 - DNA, 15 bp, Homo sapiens
aaagaggcacagagc

SEQ ID NO: 5543686 - DNA, 19 bp, Homo sapiens
aaagaggcaccaggaagcc

SEQ ID NO: 5543687 - DNA, 12 bp, Homo sapiens
aaagaggcatct

SEQ ID NO: 5543688 - DNA, 17 bp, Homo sapiens
aaagaggcctgttcata

SEQ ID NO: 5543689 - DNA, 18 bp, Homo sapiens
aaagaggcgtctgtatat

SEQ ID NO: 5543690 - DNA, 21 bp, Homo sapiens
aaagaggcgtcttgtattttc

SEQ ID NO: 5543691 - DNA, 19 bp, Homo sapiens
aaagaggcgttgctttcac

SEQ ID NO: 5543692 - DNA, 13 bp, Homo sapiens
aaagaggctatgt

SEQ ID NO: 5543693 - DNA, 20 bp, Homo sapiens
aaagaggctgaaagaggcca

SEQ ID NO: 5543694 - DNA, 19 bp, Homo sapiens
aaagaggctgaggctggca

SEQ ID NO: 5543695 - DNA, 14 bp, Homo sapiens
aaagaggctgcccc

SEQ ID NO: 5543696 - DNA, 13 bp, Homo sapiens
aaagaggctgtgt

SEQ ID NO: 5543697 - DNA, 15 bp, Homo sapiens
aaagaggctgtgtgg

SEQ ID NO: 5543698 - DNA, 15 bp, Homo sapiens
aaagagggagagatg

SEQ ID NO: 5543699 - DNA, 22 bp, Homo sapiens
aaagagggagttggctggatct

SEQ ID NO: 5543700 - DNA, 16 bp, Homo sapiens
aaagagggtgagggcc

SEQ ID NO: 5543701 - DNA, 22 bp, Homo sapiens
aaagaggtccattaatacttcc

SEQ ID NO: 5543702 - DNA, 15 bp, Homo sapiens
aaagaggtctcccca

SEQ ID NO: 5543703 - DNA, 16 bp, Homo sapiens
aaagaggtctccccat

SEQ ID NO: 5543704 - DNA, 19 bp, Homo sapiens
aaagaggtctccccatccc

SEQ ID NO: 5543705 - DNA, 15 bp, Homo sapiens
aaagaggtgaaaatg

SEQ ID NO: 5543706 - DNA, 16 bp, Homo sapiens
aaagaggtgaaaatga

SEQ ID NO: 5543707 - DNA, 14 bp, Homo sapiens
aaagcatttaggag

SEQ ID NO: 5543708 - DNA, 16 bp, Homo sapiens
aaagcatttaggagaa

SEQ ID NO: 5543709 - DNA, 15 bp, Homo sapiens
aaagcatttataaat

SEQ ID NO: 5543710 - DNA, 17 bp, Homo sapiens
aaagcatttcaggccag

SEQ ID NO: 5543711 - DNA, 20 bp, Homo sapiens
aaagcatttgaatgcatttt

SEQ ID NO: 5543712 - DNA, 22 bp, Homo sapiens
aaagcatttgaatgcattttgt

SEQ ID NO: 5543713 - DNA, 23 bp, Homo sapiens
aaagcatttgaatgcattttgtt

SEQ ID NO: 5543714 - DNA, 22 bp, Homo sapiens
aaagcattttaatgatattgga

SEQ ID NO: 5543715 - DNA, 16 bp, Homo sapiens
aaagcatttttcaata

SEQ ID NO: 5543716 - DNA, 19 bp, Homo sapiens
aaagccaaaaaatgggaga

SEQ ID NO: 5543717 - DNA, 19 bp, Homo sapiens
aaagccaaacaaaactgaa

SEQ ID NO: 5543718 - DNA, 16 bp, Homo sapiens
aaagccaaacaagcct

SEQ ID NO: 5543719 - DNA, 15 bp, Homo sapiens
aaagccaaacatata

SEQ ID NO: 5543720 - DNA, 15 bp, Homo sapiens
aaagccaaagctagg

SEQ ID NO: 5543721 - DNA, 16 bp, Homo sapiens
aaagccaaatgtaaat

SEQ ID NO: 5543722 - DNA, 19 bp, Homo sapiens
aaagccaaccttcaaagaa

SEQ ID NO: 5543723 - DNA, 16 bp, Homo sapiens
aaagccaagaagaatt

SEQ ID NO: 5543724 - DNA, 12 bp, Homo sapiens
aaagccaagaat

SEQ ID NO: 5543725 - DNA, 14 bp, Homo sapiens
aaagccaagaattg

SEQ ID NO: 5543726 - DNA, 19 bp, Homo sapiens
aaagccaagtgttttgtat

SEQ ID NO: 5543727 - DNA, 17 bp, Homo sapiens
aaagccaatgtgaacag

SEQ ID NO: 5543728 - DNA, 15 bp, Homo sapiens
aaagccacaaggctg

SEQ ID NO: 5543729 - DNA, 17 bp, Homo sapiens
aaagccacaaggctggc

SEQ ID NO: 5543730 - DNA, 19 bp, Homo sapiens
aaagccacaaggctggcca

SEQ ID NO: 5543731 - DNA, 15 bp, Homo sapiens
aaagccacacggaga

SEQ ID NO: 5543732 - DNA, 16 bp, Homo sapiens
aaagccacactttgaa

SEQ ID NO: 5543733 - DNA, 11 bp, Homo sapiens
aaagccacagc

SEQ ID NO: 5543734 - DNA, 18 bp, Homo sapiens
aaagccacataaccagcg

SEQ ID NO: 5543735 - DNA, 15 bp, Homo sapiens
aaagccacattttgc

SEQ ID NO: 5543736 - DNA, 12 bp, Homo sapiens
aaagccacctct

SEQ ID NO: 5543737 - DNA, 14 bp, Homo sapiens
aaagccacctgctg

SEQ ID NO: 5543738 - DNA, 18 bp, Homo sapiens
aaagccaccttgttacaa

SEQ ID NO: 5543739 - DNA, 14 bp, Homo sapiens
aaagccacttctgg

SEQ ID NO: 5543740 - DNA, 20 bp, Homo sapiens
aaagccagaaccagatgagt

SEQ ID NO: 5543741 - DNA, 21 bp, Homo sapiens
aaagccagaaggaaaagagta

SEQ ID NO: 5543742 - DNA, 13 bp, Homo sapiens
aaagccagacaac

SEQ ID NO: 5543743 - DNA, 23 bp, Homo sapiens
aaagccagacaacttctgtttct

SEQ ID NO: 5543744 - DNA, 21 bp, Homo sapiens
aaagccagagtggccacggcc

SEQ ID NO: 5543745 - DNA, 13 bp, Homo sapiens
aaagccagcaaag

SEQ ID NO: 5543746 - DNA, 19 bp, Homo sapiens
aaagccagctgccgaccag

SEQ ID NO: 5543747 - DNA, 11 bp, Homo sapiens
aaagccaggaa

SEQ ID NO: 5543748 - DNA, 13 bp, Homo sapiens
aaagccaggaaca

SEQ ID NO: 5543749 - DNA, 16 bp, Homo sapiens
aaagccaggagcagcc

SEQ ID NO: 5543750 - DNA, 14 bp, Homo sapiens
aaagccagggtctc

SEQ ID NO: 5543751 - DNA, 19 bp, Homo sapiens
aaagccagtcatcatctct

SEQ ID NO: 5543752 - DNA, 23 bp, Homo sapiens
aaagccagttggcttctgtgcct

SEQ ID NO: 5543753 - DNA, 14 bp, Homo sapiens
aaagccatattcca

SEQ ID NO: 5543754 - DNA, 15 bp, Homo sapiens
aaagccatattctaa

SEQ ID NO: 5543755 - DNA, 13 bp, Homo sapiens
aaagccatatttt

SEQ ID NO: 5543756 - DNA, 17 bp, Homo sapiens
aaagccatcatgtaaat

SEQ ID NO: 5543757 - DNA, 19 bp, Homo sapiens
aaagccatgttaaatgact

SEQ ID NO: 5543758 - DNA, 17 bp, Homo sapiens
aaagccattctgattat

SEQ ID NO: 5543759 - DNA, 14 bp, Homo sapiens
aaagccattctttt

SEQ ID NO: 5543760 - DNA, 14 bp, Homo sapiens
aaagccatttctta

SEQ ID NO: 5543761 - DNA, 16 bp, Homo sapiens
aaagccatttgtctgt

SEQ ID NO: 5543762 - DNA, 16 bp, Homo sapiens
aaagccattttaggct

SEQ ID NO: 5543763 - DNA, 16 bp, Homo sapiens
aaagcccaacctcctg

SEQ ID NO: 5543764 - DNA, 13 bp, Homo sapiens
aaagcccacctgg

SEQ ID NO: 5543765 - DNA, 15 bp, Homo sapiens
aaagcccagagacag

SEQ ID NO: 5543766 - DNA, 21 bp, Homo sapiens
aaagcccagctctttgttcag

SEQ ID NO: 5543767 - DNA, 22 bp, Homo sapiens
aaagcccataaggccagaaact

SEQ ID NO: 5543768 - DNA, 22 bp, Homo sapiens
aaagcccatatgctaccaccag

SEQ ID NO: 5543769 - DNA, 17 bp, Homo sapiens
aaagcccattcattcca

SEQ ID NO: 5543770 - DNA, 14 bp, Homo sapiens
aaagccccagaaat

SEQ ID NO: 5543771 - DNA, 17 bp, Homo sapiens
aaagccccatgctggag

SEQ ID NO: 5543772 - DNA, 18 bp, Homo sapiens
aaagccccatgctggagc

SEQ ID NO: 5543773 - DNA, 19 bp, Homo sapiens
aaagcccccacttctctcc

SEQ ID NO: 5543774 - DNA, 22 bp, Homo sapiens
aaagcccccagagcccaggctc

SEQ ID NO: 5543775 - DNA, 20 bp, Homo sapiens
aaagccccccagctcccaca

SEQ ID NO: 5543776 - DNA, 10 bp, Homo sapiens
aaagccccct

SEQ ID NO: 5543777 - DNA, 20 bp, Homo sapiens
aaagcccctcacctcaggac

SEQ ID NO: 5543778 - DNA, 20 bp, Homo sapiens
aaagccctatgtgaaaagat

SEQ ID NO: 5543779 - DNA, 23 bp, Homo sapiens
aaagccctcagatcccagggtac

SEQ ID NO: 5543780 - DNA, 17 bp, Homo sapiens
aaagccctcccccttcc

SEQ ID NO: 5543781 - DNA, 12 bp, Homo sapiens
aaagccctccct

SEQ ID NO: 5543782 - DNA, 18 bp, Homo sapiens
aaagccctccctgtctgt

SEQ ID NO: 5543783 - DNA, 14 bp, Homo sapiens
aaagccctgagatc

SEQ ID NO: 5543784 - DNA, 13 bp, Homo sapiens
aaagccctgcctc

SEQ ID NO: 5543785 - DNA, 15 bp, Homo sapiens
aaagccctgcctctg

SEQ ID NO: 5543786 - DNA, 14 bp, Homo sapiens
aaagccctgtgctc

SEQ ID NO: 5543787 - DNA, 13 bp, Homo sapiens
aaagccctgtgtt

SEQ ID NO: 5543788 - DNA, 17 bp, Homo sapiens
aaagccctgtgttaagt

SEQ ID NO: 5543789 - DNA, 16 bp, Homo sapiens
aaagcccttctcaaga

SEQ ID NO: 5543790 - DNA, 17 bp, Homo sapiens
aaagccgaaagggttaa

SEQ ID NO: 5543791 - DNA, 21 bp, Homo sapiens
aaagccgcccagtgggaccca

SEQ ID NO: 5543792 - DNA, 23 bp, Homo sapiens
aaagccgttgtttacttaaagat

SEQ ID NO: 5543793 - DNA, 13 bp, Homo sapiens
aaagcctaagaaa

SEQ ID NO: 5543794 - DNA, 14 bp, Homo sapiens
aaagcctaagaaaa

SEQ ID NO: 5543795 - DNA, 22 bp, Homo sapiens
aaagcctagacaacctttctgt

SEQ ID NO: 5543796 - DNA, 13 bp, Homo sapiens
aaagcctcaacca

SEQ ID NO: 5543797 - DNA, 16 bp, Homo sapiens
aaagcctcagaaaggg

SEQ ID NO: 5543798 - DNA, 22 bp, Homo sapiens
aaagcctcatttgaatgtgtga

SEQ ID NO: 5543799 - DNA, 16 bp, Homo sapiens
aaagcctcctccagcc

SEQ ID NO: 5543800 - DNA, 20 bp, Homo sapiens
aaagcctcctgccccctgcc

SEQ ID NO: 5543801 - DNA, 22 bp, Homo sapiens
aaagcctcctgccccctgccag

SEQ ID NO: 5543802 - DNA, 14 bp, Homo sapiens
aaagcctctctctc

SEQ ID NO: 5543803 - DNA, 22 bp, Homo sapiens
aaagcctctggtggaacctgca

SEQ ID NO: 5543804 - DNA, 14 bp, Homo sapiens
aaagcctcttcaaa

SEQ ID NO: 5543805 - DNA, 22 bp, Homo sapiens
aaagcctgaactatttattaaa

SEQ ID NO: 5543806 - DNA, 13 bp, Homo sapiens
aaagcctgcaatt

SEQ ID NO: 5543807 - DNA, 14 bp, Homo sapiens
aaagcctggcttct

SEQ ID NO: 5543808 - DNA, 18 bp, Homo sapiens
aaagcctgggtgacattt

SEQ ID NO: 5543809 - DNA, 23 bp, Homo sapiens
aaagcctgggtttggtgtatggt

SEQ ID NO: 5543810 - DNA, 18 bp, Homo sapiens
aaagcctgtcccaggact

SEQ ID NO: 5543811 - DNA, 19 bp, Homo sapiens
aaagcctgtcccaggactc

SEQ ID NO: 5543812 - DNA, 20 bp, Homo sapiens
aaagcctgtcccaggactca

SEQ ID NO: 5543813 - DNA, 13 bp, Homo sapiens
aaagcctgtctct

SEQ ID NO: 5543814 - DNA, 17 bp, Homo sapiens
aaagcctgttcatggca

SEQ ID NO: 5543815 - DNA, 18 bp, Homo sapiens
aaagcctgttcatggcag

SEQ ID NO: 5543816 - DNA, 12 bp, Homo sapiens
aaagccttacag

SEQ ID NO: 5543817 - DNA, 15 bp, Homo sapiens
aaagccttctggatc

SEQ ID NO: 5543818 - DNA, 18 bp, Homo sapiens
aaagcctttgatgcacaa

SEQ ID NO: 5543819 - DNA, 20 bp, Homo sapiens
aaagccttttgctttatgct

SEQ ID NO: 5543820 - DNA, 12 bp, Homo sapiens
aaagcgaaaaaa

SEQ ID NO: 5543821 - DNA, 16 bp, Homo sapiens
aaagcgaaaaaatcag

SEQ ID NO: 5543822 - DNA, 20 bp, Homo sapiens
aaagcgaaccgtgaggaggg

SEQ ID NO: 5543823 - DNA, 15 bp, Homo sapiens
aaagcgaatggacca

SEQ ID NO: 5543824 - DNA, 22 bp, Homo sapiens
aaagcgctaagtaaaaatatta

SEQ ID NO: 5543825 - DNA, 18 bp, Homo sapiens
aaagcggccgatgggagt

SEQ ID NO: 5543826 - DNA, 13 bp, Homo sapiens
aaagcggctgcct

SEQ ID NO: 5543827 - DNA, 16 bp, Homo sapiens
aaagcgggaaccctgg

SEQ ID NO: 5543828 - DNA, 17 bp, Homo sapiens
aaagcgggaaggacatt

SEQ ID NO: 5543829 - DNA, 15 bp, Homo sapiens
aaagcgggcagcccc

SEQ ID NO: 5543830 - DNA, 21 bp, Homo sapiens
aaagcggggcttcatctgcaa

SEQ ID NO: 5543831 - DNA, 14 bp, Homo sapiens
aaagcggggggagg

SEQ ID NO: 5543832 - DNA, 14 bp, Homo sapiens
aaagcgtctttaag

SEQ ID NO: 5543833 - DNA, 17 bp, Homo sapiens
aaagcgtctttaagaga

SEQ ID NO: 5543834 - DNA, 22 bp, Homo sapiens
aaagcgtgagcttaaaatacaa

SEQ ID NO: 5543835 - DNA, 12 bp, Homo sapiens
aaagctaaaata

SEQ ID NO: 5543836 - DNA, 18 bp, Homo sapiens
aaagctaaaatatataat

SEQ ID NO: 5543837 - DNA, 18 bp, Homo sapiens
aaagctaaagtatctgta

SEQ ID NO: 5543838 - DNA, 19 bp, Homo sapiens
aaagctaaattttgttact

SEQ ID NO: 5543839 - DNA, 14 bp, Homo sapiens
aaagctaatgtgca

SEQ ID NO: 5543840 - DNA, 15 bp, Homo sapiens
aaagctacaggactg

SEQ ID NO: 5543841 - DNA, 21 bp, Homo sapiens
aaagctaccatttatcaagca

SEQ ID NO: 5543842 - DNA, 17 bp, Homo sapiens
aaagctactgaatttat

SEQ ID NO: 5543843 - DNA, 13 bp, Homo sapiens
aaagctaggaaag

SEQ ID NO: 5543844 - DNA, 19 bp, Homo sapiens
aaagctaggaaaggcagaa

SEQ ID NO: 5543845 - DNA, 20 bp, Homo sapiens
aaagctagtgtacctcctct

SEQ ID NO: 5543846 - DNA, 12 bp, Homo sapiens
aaagctataaag

SEQ ID NO: 5543847 - DNA, 19 bp, Homo sapiens
aaagctatcttaaaatata

SEQ ID NO: 5543848 - DNA, 15 bp, Homo sapiens
aaagctatgaatgtt

SEQ ID NO: 5543849 - DNA, 22 bp, Homo sapiens
aaagctatggtgagatgcagct

SEQ ID NO: 5543850 - DNA, 14 bp, Homo sapiens
aaagctatgttaca

SEQ ID NO: 5543851 - DNA, 23 bp, Homo sapiens
aaagctattagccaggatcatgg

SEQ ID NO: 5543852 - DNA, 18 bp, Homo sapiens
aaagctatttatgggccc

SEQ ID NO: 5543853 - DNA, 13 bp, Homo sapiens
aaagctcaagatg

SEQ ID NO: 5543854 - DNA, 21 bp, Homo sapiens
aaagctcaagatgacagctct

SEQ ID NO: 5543855 - DNA, 14 bp, Homo sapiens
aaagctcaatagga

SEQ ID NO: 5543856 - DNA, 16 bp, Homo sapiens
aaagctcactgctgat

SEQ ID NO: 5543857 - DNA, 14 bp, Homo sapiens
aaagctcagatgac

SEQ ID NO: 5543858 - DNA, 15 bp, Homo sapiens
aaagctcagatgaca

SEQ ID NO: 5543859 - DNA, 14 bp, Homo sapiens
aaagctcaggaggg

SEQ ID NO: 5543860 - DNA, 15 bp, Homo sapiens
aaagctcaggagggt

SEQ ID NO: 5543861 - DNA, 20 bp, Homo sapiens
aaagctcatgcatttcaagc

SEQ ID NO: 5543862 - DNA, 19 bp, Homo sapiens
aaagctcatttcatgctct

SEQ ID NO: 5543863 - DNA, 14 bp, Homo sapiens
aaagctcccttgaa

SEQ ID NO: 5543864 - DNA, 15 bp, Homo sapiens
aaagctcccttgaag

SEQ ID NO: 5543865 - DNA, 14 bp, Homo sapiens
aaagctcctctgct

SEQ ID NO: 5543866 - DNA, 13 bp, Homo sapiens
aaagctcctgtcc

SEQ ID NO: 5543867 - DNA, 20 bp, Homo sapiens
aaagctcgtagaaacaagac

SEQ ID NO: 5543868 - DNA, 22 bp, Homo sapiens
aaagctcgtccccattgcttaa

SEQ ID NO: 5543869 - DNA, 15 bp, Homo sapiens
aaagctctaaggtaa

SEQ ID NO: 5543870 - DNA, 17 bp, Homo sapiens
aaagctctacatttgca

SEQ ID NO: 5543871 - DNA, 14 bp, Homo sapiens
aaagctctagaatc

SEQ ID NO: 5543872 - DNA, 18 bp, Homo sapiens
aaagctctgaacaaaagc

SEQ ID NO: 5543873 - DNA, 14 bp, Homo sapiens
aaagctctgaccac

SEQ ID NO: 5543874 - DNA, 17 bp, Homo sapiens
aaagctctgcatgtgtg

SEQ ID NO: 5543875 - DNA, 21 bp, Homo sapiens
aaagctctgttccatgcaact

SEQ ID NO: 5543876 - DNA, 22 bp, Homo sapiens
aaagctctgttgcaattaggat

SEQ ID NO: 5543877 - DNA, 17 bp, Homo sapiens
aaagctcttctttttta

SEQ ID NO: 5543878 - DNA, 12 bp, Homo sapiens
aaagctgaaaac

SEQ ID NO: 5543879 - DNA, 13 bp, Homo sapiens
aaagctgaaaatg

SEQ ID NO: 5543880 - DNA, 22 bp, Homo sapiens
aaagctgaaaattaaattttag

SEQ ID NO: 5543881 - DNA, 22 bp, Homo sapiens
aaagctgaaattctcagaatta

SEQ ID NO: 5543882 - DNA, 13 bp, Homo sapiens
aaagctgaagatc

SEQ ID NO: 5543883 - DNA, 15 bp, Homo sapiens
aaagctgaagccgcc

SEQ ID NO: 5543884 - DNA, 23 bp, Homo sapiens
aaagctgactgttttttttgcag

SEQ ID NO: 5543885 - DNA, 20 bp, Homo sapiens
aaagctgatctggtttgact

SEQ ID NO: 5543886 - DNA, 23 bp, Homo sapiens
aaagctgatgatgtctcttgtag

SEQ ID NO: 5543887 - DNA, 13 bp, Homo sapiens
aaatatgattgat

SEQ ID NO: 5543888 - DNA, 17 bp, Homo sapiens
aaatatgcaaagcactg

SEQ ID NO: 5543889 - DNA, 15 bp, Homo sapiens
aaatatgcaacctgt

SEQ ID NO: 5543890 - DNA, 21 bp, Homo sapiens
aaatatgcactaagtctcttt

SEQ ID NO: 5543891 - DNA, 13 bp, Homo sapiens
aaatatgcactgc

SEQ ID NO: 5543892 - DNA, 17 bp, Homo sapiens
aaatatgcatgtacttt

SEQ ID NO: 5543893 - DNA, 16 bp, Homo sapiens
aaatatgccactgacc

SEQ ID NO: 5543894 - DNA, 23 bp, Homo sapiens
aaatatgccccttcttgggcccc

SEQ ID NO: 5543895 - DNA, 20 bp, Homo sapiens
aaatatgctaaatgttagca

SEQ ID NO: 5543896 - DNA, 19 bp, Homo sapiens
aaatatggaactgtaataa

SEQ ID NO: 5543897 - DNA, 17 bp, Homo sapiens
aaatatggaacttacat

SEQ ID NO: 5543898 - DNA, 20 bp, Homo sapiens
aaatatggaacttctaatat

SEQ ID NO: 5543899 - DNA, 19 bp, Homo sapiens
aaatatggtcttttggtta

SEQ ID NO: 5543900 - DNA, 14 bp, Homo sapiens
aaatatgtaaaact

SEQ ID NO: 5543901 - DNA, 15 bp, Homo sapiens
aaatatgtaatataa

SEQ ID NO: 5543902 - DNA, 23 bp, Homo sapiens
aaatatgtaatataaatttaagc

SEQ ID NO: 5543903 - DNA, 18 bp, Homo sapiens
aaatatgtacatttctca

SEQ ID NO: 5543904 - DNA, 12 bp, Homo sapiens
aaatatgtagat

SEQ ID NO: 5543905 - DNA, 16 bp, Homo sapiens
aaatatgtatcctcta

SEQ ID NO: 5543906 - DNA, 12 bp, Homo sapiens
aaatatgtatta

SEQ ID NO: 5543907 - DNA, 13 bp, Homo sapiens
aaatatgtattaa

SEQ ID NO: 5543908 - DNA, 19 bp, Homo sapiens
aaatatgtattatacatct

SEQ ID NO: 5543909 - DNA, 21 bp, Homo sapiens
aaatatgtcatcatgcttatg

SEQ ID NO: 5543910 - DNA, 16 bp, Homo sapiens
aaatatgtcctggggt

SEQ ID NO: 5543911 - DNA, 18 bp, Homo sapiens
aaatatgtctcgctagtg

SEQ ID NO: 5543912 - DNA, 14 bp, Homo sapiens
aaatatgtgaaaat

SEQ ID NO: 5543913 - DNA, 12 bp, Homo sapiens
aaatatgtgaag

SEQ ID NO: 5543914 - DNA, 15 bp, Homo sapiens
aaatatgtgaagaaa

SEQ ID NO: 5543915 - DNA, 16 bp, Homo sapiens
aaatatgtgaagtttt

SEQ ID NO: 5543916 - DNA, 22 bp, Homo sapiens
aaatatgtgaagttttccttgc

SEQ ID NO: 5543917 - DNA, 12 bp, Homo sapiens
aaatatgtgtat

SEQ ID NO: 5543918 - DNA, 16 bp, Homo sapiens
aaatatgttgatgaaa

SEQ ID NO: 5543919 - DNA, 14 bp, Homo sapiens
aaatatgtttcaca

SEQ ID NO: 5543920 - DNA, 14 bp, Homo sapiens
aaatatgtttgtgc

SEQ ID NO: 5543921 - DNA, 12 bp, Homo sapiens
aaatattaaaat

SEQ ID NO: 5543922 - DNA, 15 bp, Homo sapiens
aaatattaaaatcac

SEQ ID NO: 5543923 - DNA, 17 bp, Homo sapiens
aaatattaaaatttatt

SEQ ID NO: 5543924 - DNA, 17 bp, Homo sapiens
aaatattaacatattat

SEQ ID NO: 5543925 - DNA, 15 bp, Homo sapiens
aaatattaagagcta

SEQ ID NO: 5543926 - DNA, 20 bp, Homo sapiens
aaatattaatatgtactttt

SEQ ID NO: 5543927 - DNA, 14 bp, Homo sapiens
aaatattacagtga

SEQ ID NO: 5543928 - DNA, 21 bp, Homo sapiens
aaatattactgatcttacctt

SEQ ID NO: 5543929 - DNA, 21 bp, Homo sapiens
aaatattagatgtgatttaat

SEQ ID NO: 5543930 - DNA, 22 bp, Homo sapiens
aaatattagatgtgatttaata

SEQ ID NO: 5543931 - DNA, 19 bp, Homo sapiens
aaatattataatgtgccca

SEQ ID NO: 5543932 - DNA, 23 bp, Homo sapiens
aaatattatccagcaagcagtct

SEQ ID NO: 5543933 - DNA, 14 bp, Homo sapiens
aaatattatctgaa

SEQ ID NO: 5543934 - DNA, 15 bp, Homo sapiens
aaatattatgatttt

SEQ ID NO: 5543935 - DNA, 12 bp, Homo sapiens
aaatattatgca

SEQ ID NO: 5543936 - DNA, 19 bp, Homo sapiens
aaatattatgcaaattccc

SEQ ID NO: 5543937 - DNA, 12 bp, Homo sapiens
aaatattatgcc

SEQ ID NO: 5543938 - DNA, 14 bp, Homo sapiens
aaatattatgttat

SEQ ID NO: 5543939 - DNA, 16 bp, Homo sapiens
aaatattatgttatga

SEQ ID NO: 5543940 - DNA, 23 bp, Homo sapiens
aaatattattgtggaaatgaata

SEQ ID NO: 5543941 - DNA, 13 bp, Homo sapiens
aaatattatttgt

SEQ ID NO: 5543942 - DNA, 20 bp, Homo sapiens
aaatattattttatgaaagg

SEQ ID NO: 5543943 - DNA, 15 bp, Homo sapiens
aaatattcaataaga

SEQ ID NO: 5543944 - DNA, 16 bp, Homo sapiens
aaatattcacatcttc

SEQ ID NO: 5543945 - DNA, 19 bp, Homo sapiens
aaatattcactctccatta

SEQ ID NO: 5543946 - DNA, 22 bp, Homo sapiens
aaatattcactctccattagaa

SEQ ID NO: 5543947 - DNA, 12 bp, Homo sapiens
aaatattcagaa

SEQ ID NO: 5543948 - DNA, 17 bp, Homo sapiens
aaatattcagaatcttt

SEQ ID NO: 5543949 - DNA, 20 bp, Homo sapiens
aaatattcatgcttgccatc

SEQ ID NO: 5543950 - DNA, 19 bp, Homo sapiens
aaatattcctccaaatctc

SEQ ID NO: 5543951 - DNA, 17 bp, Homo sapiens
aaatattctaacatttg

SEQ ID NO: 5543952 - DNA, 13 bp, Homo sapiens
aaatattctgaat

SEQ ID NO: 5543953 - DNA, 20 bp, Homo sapiens
aaatattctgaatcaccaat

SEQ ID NO: 5543954 - DNA, 21 bp, Homo sapiens
aaatattctgaatcaccaatt

SEQ ID NO: 5543955 - DNA, 12 bp, Homo sapiens
aaatattctgtc

SEQ ID NO: 5543956 - DNA, 15 bp, Homo sapiens
aaatattctgtcatt

SEQ ID NO: 5543957 - DNA, 13 bp, Homo sapiens
aaatattcttagg

SEQ ID NO: 5543958 - DNA, 23 bp, Homo sapiens
aaatattcttctataaatgaatc

SEQ ID NO: 5543959 - DNA, 11 bp, Homo sapiens
aaatattcttg

SEQ ID NO: 5543960 - DNA, 17 bp, Homo sapiens
aaatattcttgtccaca

SEQ ID NO: 5543961 - DNA, 22 bp, Homo sapiens
aaatattctttctcataaaact

SEQ ID NO: 5543962 - DNA, 22 bp, Homo sapiens
aaatattgacttctcttgaatt

SEQ ID NO: 5543963 - DNA, 15 bp, Homo sapiens
aaatattgaggcttt

SEQ ID NO: 5543964 - DNA, 21 bp, Homo sapiens
aaatattgaggctttgtgttg

SEQ ID NO: 5543965 - DNA, 15 bp, Homo sapiens
aaatattgatgaaaa

SEQ ID NO: 5543966 - DNA, 22 bp, Homo sapiens
aaatattgctaaaagcatgtat

SEQ ID NO: 5543967 - DNA, 21 bp, Homo sapiens
aaatattgctaaaagtgcatt

SEQ ID NO: 5543968 - DNA, 16 bp, Homo sapiens
aaatattgctctatgt

SEQ ID NO: 5543969 - DNA, 15 bp, Homo sapiens
aaatattgctgtata

SEQ ID NO: 5543970 - DNA, 21 bp, Homo sapiens
aaatattgctgtctgaaaaag

SEQ ID NO: 5543971 - DNA, 22 bp, Homo sapiens
aaatattgctgtctgaaaaagt

SEQ ID NO: 5543972 - DNA, 14 bp, Homo sapiens
aaatattgcttcaa

SEQ ID NO: 5543973 - DNA, 22 bp, Homo sapiens
aaatattgcttggactacctat

SEQ ID NO: 5543974 - DNA, 18 bp, Homo sapiens
aaatattggtattaaaga

SEQ ID NO: 5543975 - DNA, 19 bp, Homo sapiens
aaatattggtattaaagaa

SEQ ID NO: 5543976 - DNA, 23 bp, Homo sapiens
aaatattggtattaaagaatgct

SEQ ID NO: 5543977 - DNA, 12 bp, Homo sapiens
aaatattggtta

SEQ ID NO: 5543978 - DNA, 13 bp, Homo sapiens
aaatattgtaaat

SEQ ID NO: 5543979 - DNA, 14 bp, Homo sapiens
aaatattgtaaatg

SEQ ID NO: 5543980 - DNA, 18 bp, Homo sapiens
aaatattgtaaatgctat

SEQ ID NO: 5543981 - DNA, 12 bp, Homo sapiens
aaatattgtaat

SEQ ID NO: 5543982 - DNA, 12 bp, Homo sapiens
aaatattgtagt

SEQ ID NO: 5543983 - DNA, 15 bp, Homo sapiens
aaatattgtatttta

SEQ ID NO: 5543984 - DNA, 21 bp, Homo sapiens
aaatattgtcatgtttattct

SEQ ID NO: 5543985 - DNA, 12 bp, Homo sapiens
aaatattgttaa

SEQ ID NO: 5543986 - DNA, 20 bp, Homo sapiens
aaatattgttaccatgaaga

SEQ ID NO: 5543987 - DNA, 16 bp, Homo sapiens
aaatattgtttctgca

SEQ ID NO: 5543988 - DNA, 22 bp, Homo sapiens
aaatattgtttctgcattcatt

SEQ ID NO: 5543989 - DNA, 19 bp, Homo sapiens
aaatatttaaaaaaaaaca

SEQ ID NO: 5543990 - DNA, 14 bp, Homo sapiens
aaatatttaaaaat

SEQ ID NO: 5543991 - DNA, 15 bp, Homo sapiens
aaatatttaacatag

SEQ ID NO: 5543992 - DNA, 20 bp, Homo sapiens
aaatatttaagtgaaggaga

SEQ ID NO: 5543993 - DNA, 15 bp, Homo sapiens
aaatatttaatatca

SEQ ID NO: 5543994 - DNA, 21 bp, Homo sapiens
aaatatttaatgttgaacaaa

SEQ ID NO: 5543995 - DNA, 17 bp, Homo sapiens
aaatatttacatatgaa

SEQ ID NO: 5543996 - DNA, 21 bp, Homo sapiens
aaatatttacatatgaaattt

SEQ ID NO: 5543997 - DNA, 19 bp, Homo sapiens
aaatatttactctttgcaa

SEQ ID NO: 5543998 - DNA, 14 bp, Homo sapiens
aaatatttagtcta

SEQ ID NO: 5543999 - DNA, 17 bp, Homo sapiens
aaatatttataaatgaa

SEQ ID NO: 5544000 - DNA, 13 bp, Homo sapiens
aaatatttatgaa

SEQ ID NO: 5544001 - DNA, 22 bp, Homo sapiens
aaatatttatgacctcaacaaa

SEQ ID NO: 5544002 - DNA, 12 bp, Homo sapiens
aaatatttatgc

SEQ ID NO: 5544003 - DNA, 13 bp, Homo sapiens
aaatatttatgct

SEQ ID NO: 5544004 - DNA, 22 bp, Homo sapiens
aaatatttattaaataaaatca

SEQ ID NO: 5544005 - DNA, 15 bp, Homo sapiens
aaatatttattcatt

SEQ ID NO: 5544006 - DNA, 15 bp, Homo sapiens
aaatatttatttatt

SEQ ID NO: 5544007 - DNA, 13 bp, Homo sapiens
aaatatttatttt

SEQ ID NO: 5544008 - DNA, 15 bp, Homo sapiens
aaatatttattttaa

SEQ ID NO: 5544009 - DNA, 14 bp, Homo sapiens
aaatatttcaagac

SEQ ID NO: 5544010 - DNA, 20 bp, Homo sapiens
aaatatttcaataacttaga

SEQ ID NO: 5544011 - DNA, 13 bp, Homo sapiens
aaatatttcactt

SEQ ID NO: 5544012 - DNA, 15 bp, Homo sapiens
aaatatttcagatat

SEQ ID NO: 5544013 - DNA, 13 bp, Homo sapiens
aaatatttcataa

SEQ ID NO: 5544014 - DNA, 20 bp, Homo sapiens
aaatatttcctgacttgagt

SEQ ID NO: 5544015 - DNA, 14 bp, Homo sapiens
aaatatttccttaa

SEQ ID NO: 5544016 - DNA, 19 bp, Homo sapiens
aaatatttctatgtaaatt

SEQ ID NO: 5544017 - DNA, 21 bp, Homo sapiens
aaatatttctatgtaaattat

SEQ ID NO: 5544018 - DNA, 14 bp, Homo sapiens
aaatatttctcaac

SEQ ID NO: 5544019 - DNA, 12 bp, Homo sapiens
aaatatttctta

SEQ ID NO: 5544020 - DNA, 20 bp, Homo sapiens
aaatatttcttaagtataaa

SEQ ID NO: 5544021 - DNA, 14 bp, Homo sapiens
aaatatttgaaaat

SEQ ID NO: 5544022 - DNA, 23 bp, Homo sapiens
aaatatttgaatgaaaacatttt

SEQ ID NO: 5544023 - DNA, 17 bp, Homo sapiens
aaatatttgactattct

SEQ ID NO: 5544024 - DNA, 15 bp, Homo sapiens
aaatatttgcctcca

SEQ ID NO: 5544025 - DNA, 15 bp, Homo sapiens
aaatatttgtacata

SEQ ID NO: 5544026 - DNA, 18 bp, Homo sapiens
aaatatttgttcttataa

SEQ ID NO: 5544027 - DNA, 15 bp, Homo sapiens
aaatattttaaagaa

SEQ ID NO: 5544028 - DNA, 18 bp, Homo sapiens
aaatattttaaagaattg

SEQ ID NO: 5544029 - DNA, 23 bp, Homo sapiens
aaatattttaaagaattgtgtca

SEQ ID NO: 5544030 - DNA, 14 bp, Homo sapiens
aaatattttaagta

SEQ ID NO: 5544031 - DNA, 19 bp, Homo sapiens
aaatattttagatgttatt

SEQ ID NO: 5544032 - DNA, 14 bp, Homo sapiens
aaatattttatctt

SEQ ID NO: 5544033 - DNA, 12 bp, Homo sapiens
aaatattttcca

SEQ ID NO: 5544034 - DNA, 17 bp, Homo sapiens
aaatattttcctgccac

SEQ ID NO: 5544035 - DNA, 12 bp, Homo sapiens
aaatattttcta

SEQ ID NO: 5544036 - DNA, 13 bp, Homo sapiens
aaatattttctac

SEQ ID NO: 5544037 - DNA, 14 bp, Homo sapiens
aaatattttctatt

SEQ ID NO: 5544038 - DNA, 17 bp, Homo sapiens
aaatattttctatttta

SEQ ID NO: 5544039 - DNA, 16 bp, Homo sapiens
aaatattttctgggtt

SEQ ID NO: 5544040 - DNA, 15 bp, Homo sapiens
aaatattttctgtgt

SEQ ID NO: 5544041 - DNA, 16 bp, Homo sapiens
aaatattttctgtgtg

SEQ ID NO: 5544042 - DNA, 13 bp, Homo sapiens
aaatattttgaat

SEQ ID NO: 5544043 - DNA, 22 bp, Homo sapiens
aaatattttgaatcaataatat

SEQ ID NO: 5544044 - DNA, 20 bp, Homo sapiens
aaatattttgataataaatt

SEQ ID NO: 5544045 - DNA, 11 bp, Homo sapiens
aaatattttgc

SEQ ID NO: 5544046 - DNA, 16 bp, Homo sapiens
aaatattttgctaact

SEQ ID NO: 5544047 - DNA, 14 bp, Homo sapiens
aaatattttggatg

SEQ ID NO: 5544048 - DNA, 17 bp, Homo sapiens
aaatattttgtcactgc

SEQ ID NO: 5544049 - DNA, 15 bp, Homo sapiens
aaatattttgttctt

SEQ ID NO: 5544050 - DNA, 23 bp, Homo sapiens
aaatatttttatgtgaaggtgtt

SEQ ID NO: 5544051 - DNA, 14 bp, Homo sapiens
aaatatttttcaac

SEQ ID NO: 5544052 - DNA, 15 bp, Homo sapiens
aaatatttttcaact

SEQ ID NO: 5544053 - DNA, 16 bp, Homo sapiens
aaatatttttcaactt

SEQ ID NO: 5544054 - DNA, 12 bp, Homo sapiens
aaatatttttgg

SEQ ID NO: 5544055 - DNA, 21 bp, Homo sapiens
aaatattttttaaaaccataa

SEQ ID NO: 5544056 - DNA, 17 bp, Homo sapiens
aaatattttttaaagtc

SEQ ID NO: 5544057 - DNA, 19 bp, Homo sapiens
aaatattttttccttttgt

SEQ ID NO: 5544058 - DNA, 21 bp, Homo sapiens
aaatattttttcttttctatt

SEQ ID NO: 5544059 - DNA, 15 bp, Homo sapiens
aaatatttttttcct

SEQ ID NO: 5544060 - DNA, 19 bp, Homo sapiens
aaatatttttttctagcta

SEQ ID NO: 5544061 - DNA, 23 bp, Homo sapiens
aaatatttttttctttttaaaat

SEQ ID NO: 5544062 - DNA, 20 bp, Homo sapiens
aaatatttttttgtagatga

SEQ ID NO: 5544063 - DNA, 21 bp, Homo sapiens
aaatatttttttttctttcag

SEQ ID NO: 5544064 - DNA, 17 bp, Homo sapiens
aaatcaaaaacttttca

SEQ ID NO: 5544065 - DNA, 21 bp, Homo sapiens
aaatcaaaaacttttcatttc

SEQ ID NO: 5544066 - DNA, 22 bp, Homo sapiens
aaatcaaaaacttttcatttca

SEQ ID NO: 5544067 - DNA, 22 bp, Homo sapiens
aaatcttattaaagtttcaaaa

SEQ ID NO: 5544068 - DNA, 20 bp, Homo sapiens
aaatcttcaaggtgtaaaat

SEQ ID NO: 5544069 - DNA, 15 bp, Homo sapiens
aaatcttcactttct

SEQ ID NO: 5544070 - DNA, 16 bp, Homo sapiens
aaatcttcagctggtg

SEQ ID NO: 5544071 - DNA, 22 bp, Homo sapiens
aaatcttcatggaattcacaaa

SEQ ID NO: 5544072 - DNA, 11 bp, Homo sapiens
aaatcttcctc

SEQ ID NO: 5544073 - DNA, 17 bp, Homo sapiens
aaatcttcctctggagc

SEQ ID NO: 5544074 - DNA, 18 bp, Homo sapiens
aaatcttgcagttttgta

SEQ ID NO: 5544075 - DNA, 13 bp, Homo sapiens
aaatcttgcttca

SEQ ID NO: 5544076 - DNA, 13 bp, Homo sapiens
aaatcttggaagt

SEQ ID NO: 5544077 - DNA, 20 bp, Homo sapiens
aaatcttggaagtacatgaa

SEQ ID NO: 5544078 - DNA, 22 bp, Homo sapiens
aaatcttggtgtaacttaaata

SEQ ID NO: 5544079 - DNA, 13 bp, Homo sapiens
aaatcttggtttg

SEQ ID NO: 5544080 - DNA, 13 bp, Homo sapiens
aaatcttgtaagt

SEQ ID NO: 5544081 - DNA, 24 bp, Homo sapiens
aaatcttgtttgttactgtcattc

SEQ ID NO: 5544082 - DNA, 14 bp, Homo sapiens
aaatctttaagaat

SEQ ID NO: 5544083 - DNA, 19 bp, Homo sapiens
aaatctttagggaatgaga

SEQ ID NO: 5544084 - DNA, 13 bp, Homo sapiens
aaatctttcaaaa

SEQ ID NO: 5544085 - DNA, 14 bp, Homo sapiens
aaatctttcaagtt

SEQ ID NO: 5544086 - DNA, 15 bp, Homo sapiens
aaatctttccatctc

SEQ ID NO: 5544087 - DNA, 22 bp, Homo sapiens
aaatctttccatctcattacag

SEQ ID NO: 5544088 - DNA, 17 bp, Homo sapiens
aaatctttctgtaaaca

SEQ ID NO: 5544089 - DNA, 18 bp, Homo sapiens
aaatctttctgtaaacag

SEQ ID NO: 5544090 - DNA, 20 bp, Homo sapiens
aaatctttctgtaaacagaa

SEQ ID NO: 5544091 - DNA, 20 bp, Homo sapiens
aaatctttcttcaaatctcc

SEQ ID NO: 5544092 - DNA, 23 bp, Homo sapiens
aaatctttctttcttagaaattt

SEQ ID NO: 5544093 - DNA, 22 bp, Homo sapiens
aaatctttctttggggaaaaat

SEQ ID NO: 5544094 - DNA, 21 bp, Homo sapiens
aaatctttgtgaacattctgt

SEQ ID NO: 5544095 - DNA, 16 bp, Homo sapiens
aaatctttgttaaaat

SEQ ID NO: 5544096 - DNA, 18 bp, Homo sapiens
aaatctttgttaaaatat

SEQ ID NO: 5544097 - DNA, 20 bp, Homo sapiens
aaatctttgttaaaatatag

SEQ ID NO: 5544098 - DNA, 21 bp, Homo sapiens
aaatctttgttaaaatatagt

SEQ ID NO: 5544099 - DNA, 18 bp, Homo sapiens
aaatctttgttgaagttt

SEQ ID NO: 5544100 - DNA, 18 bp, Homo sapiens
aaatcttttagtcattat

SEQ ID NO: 5544101 - DNA, 13 bp, Homo sapiens
aaatctttttgct

SEQ ID NO: 5544102 - DNA, 16 bp, Homo sapiens
aaatctttttgcttct

SEQ ID NO: 5544103 - DNA, 21 bp, Homo sapiens
aaatctttttgcttctacttt

SEQ ID NO: 5544104 - DNA, 20 bp, Homo sapiens
aaatgaaaaaaatgatctat

SEQ ID NO: 5544105 - DNA, 23 bp, Homo sapiens
aaatgaaaaacacaattctttat

SEQ ID NO: 5544106 - DNA, 14 bp, Homo sapiens
aaatgaaaactttt

SEQ ID NO: 5544107 - DNA, 19 bp, Homo sapiens
aaatgaaaacttttgtaaa

SEQ ID NO: 5544108 - DNA, 21 bp, Homo sapiens
aaatgaaaacttttgtaaatt

SEQ ID NO: 5544109 - DNA, 13 bp, Homo sapiens
aaatgaaaagaga

SEQ ID NO: 5544110 - DNA, 14 bp, Homo sapiens
aaatgaaaagagaa

SEQ ID NO: 5544111 - DNA, 14 bp, Homo sapiens
aaatgaaaatggct

SEQ ID NO: 5544112 - DNA, 16 bp, Homo sapiens
aaatgaaaatgtaact

SEQ ID NO: 5544113 - DNA, 17 bp, Homo sapiens
aaatgaaaatgtaactt

SEQ ID NO: 5544114 - DNA, 17 bp, Homo sapiens
aaatgaaaatgtcttgt

SEQ ID NO: 5544115 - DNA, 21 bp, Homo sapiens
aaatgaaacaaataatcacat

SEQ ID NO: 5544116 - DNA, 16 bp, Homo sapiens
aaatgaaacaatgaaa

SEQ ID NO: 5544117 - DNA, 16 bp, Homo sapiens
aaatgaaactttcttt

SEQ ID NO: 5544118 - DNA, 13 bp, Homo sapiens
aaatgaaagattt

SEQ ID NO: 5544119 - DNA, 21 bp, Homo sapiens
aaatgaaagcagggacttgaa

SEQ ID NO: 5544120 - DNA, 12 bp, Homo sapiens
aaatgaaaggag

SEQ ID NO: 5544121 - DNA, 15 bp, Homo sapiens
aaatgaaagggaaac

SEQ ID NO: 5544122 - DNA, 23 bp, Homo sapiens
aaatgaaagtgactttaaaagaa

SEQ ID NO: 5544123 - DNA, 14 bp, Homo sapiens
aaatgaaagtgaga

SEQ ID NO: 5544124 - DNA, 17 bp, Homo sapiens
aaatgaaatacttgaca

SEQ ID NO: 5544125 - DNA, 14 bp, Homo sapiens
aaatgaaatgcata

SEQ ID NO: 5544126 - DNA, 15 bp, Homo sapiens
aaatgaaatgcattt

SEQ ID NO: 5544127 - DNA, 21 bp, Homo sapiens
aaatgaaatgttttaaggctt

SEQ ID NO: 5544128 - DNA, 11 bp, Homo sapiens
aaatgaaattt

SEQ ID NO: 5544129 - DNA, 18 bp, Homo sapiens
aaatgaaatttaagcaca

SEQ ID NO: 5544130 - DNA, 22 bp, Homo sapiens
aaatgaaatttaattacaaaca

SEQ ID NO: 5544131 - DNA, 14 bp, Homo sapiens
aaatgaaattttac

SEQ ID NO: 5544132 - DNA, 18 bp, Homo sapiens
aaatgaaattttaccaag

SEQ ID NO: 5544133 - DNA, 12 bp, Homo sapiens
aaatgaacaaaa

SEQ ID NO: 5544134 - DNA, 13 bp, Homo sapiens
aaatgaacacaaa

SEQ ID NO: 5544135 - DNA, 15 bp, Homo sapiens
aaatgaacacaaatt

SEQ ID NO: 5544136 - DNA, 16 bp, Homo sapiens
aaatgaacacaaatta

SEQ ID NO: 5544137 - DNA, 18 bp, Homo sapiens
aaatgaacacaaattatg

SEQ ID NO: 5544138 - DNA, 18 bp, Homo sapiens
aaatgaacacagctcttt

SEQ ID NO: 5544139 - DNA, 16 bp, Homo sapiens
aaatgaactaactgcc

SEQ ID NO: 5544140 - DNA, 19 bp, Homo sapiens
aaatgaactaactgccatg

SEQ ID NO: 5544141 - DNA, 20 bp, Homo sapiens
aaatgaactactgctatttt

SEQ ID NO: 5544142 - DNA, 14 bp, Homo sapiens
aaatgaactgattt

SEQ ID NO: 5544143 - DNA, 15 bp, Homo sapiens
aaatgaactgcccac

SEQ ID NO: 5544144 - DNA, 19 bp, Homo sapiens
aaatgaactgtatattatt

SEQ ID NO: 5544145 - DNA, 15 bp, Homo sapiens
aaatgaactgtatta

SEQ ID NO: 5544146 - DNA, 12 bp, Homo sapiens
aaatgaactttg

SEQ ID NO: 5544147 - DNA, 17 bp, Homo sapiens
aaatgaacttttacaga

SEQ ID NO: 5544148 - DNA, 20 bp, Homo sapiens
aaatgaacttttacagaatg

SEQ ID NO: 5544149 - DNA, 22 bp, Homo sapiens
aaatgaacttttacagaatgca

SEQ ID NO: 5544150 - DNA, 13 bp, Homo sapiens
aaatgaagaattt

SEQ ID NO: 5544151 - DNA, 17 bp, Homo sapiens
aaatgaagatacagtgg

SEQ ID NO: 5544152 - DNA, 23 bp, Homo sapiens
aaatgaagattattttttatgag

SEQ ID NO: 5544153 - DNA, 12 bp, Homo sapiens
aaatgaagcaat

SEQ ID NO: 5544154 - DNA, 19 bp, Homo sapiens
aaatgaagcaatttatatc

SEQ ID NO: 5544155 - DNA, 15 bp, Homo sapiens
aaatgaagcagaagc

SEQ ID NO: 5544156 - DNA, 16 bp, Homo sapiens
aaatgaagcagaggaa

SEQ ID NO: 5544157 - DNA, 19 bp, Homo sapiens
aaatgaaggttaggattta

SEQ ID NO: 5544158 - DNA, 13 bp, Homo sapiens
aaatgaagtattt

SEQ ID NO: 5544159 - DNA, 16 bp, Homo sapiens
aaatgaataaaagtga

SEQ ID NO: 5544160 - DNA, 14 bp, Homo sapiens
aaatgaataaatcc

SEQ ID NO: 5544161 - DNA, 17 bp, Homo sapiens
aaatgaataagctttct

SEQ ID NO: 5544162 - DNA, 18 bp, Homo sapiens
aaatgaataatttattat

SEQ ID NO: 5544163 - DNA, 18 bp, Homo sapiens
aaatgaataatttcccaa

SEQ ID NO: 5544164 - DNA, 15 bp, Homo sapiens
aaatgaatactgaat

SEQ ID NO: 5544165 - DNA, 14 bp, Homo sapiens
aaatgaatagagag

SEQ ID NO: 5544166 - DNA, 23 bp, Homo sapiens
aaatgaatagcttgtttctgtca

SEQ ID NO: 5544167 - DNA, 15 bp, Homo sapiens
aaatgaatattttga

SEQ ID NO: 5544168 - DNA, 16 bp, Homo sapiens
aaatgaatcattgtta

SEQ ID NO: 5544169 - DNA, 23 bp, Homo sapiens
aaatgaatctcgttcccaaagaa

SEQ ID NO: 5544170 - DNA, 17 bp, Homo sapiens
aaatgaatgaaatataa

SEQ ID NO: 5544171 - DNA, 11 bp, Homo sapiens
aaatgaatgag

SEQ ID NO: 5544172 - DNA, 15 bp, Homo sapiens
aaatgaatgagccaa

SEQ ID NO: 5544173 - DNA, 19 bp, Homo sapiens
aaatgaatgagctctctaa

SEQ ID NO: 5544174 - DNA, 13 bp, Homo sapiens
aaatgaatgcatt

SEQ ID NO: 5544175 - DNA, 16 bp, Homo sapiens
aaatgaatggctcact

SEQ ID NO: 5544176 - DNA, 21 bp, Homo sapiens
aaatgaatgtgcaaaaaaaga

SEQ ID NO: 5544177 - DNA, 12 bp, Homo sapiens
aaatgaatgtgt

SEQ ID NO: 5544178 - DNA, 13 bp, Homo sapiens
aaatgaattcttt

SEQ ID NO: 5544179 - DNA, 14 bp, Homo sapiens
aaatgaattgcctt

SEQ ID NO: 5544180 - DNA, 12 bp, Homo sapiens
aaatgaattgta

SEQ ID NO: 5544181 - DNA, 14 bp, Homo sapiens
aaatgaattgtatt

SEQ ID NO: 5544182 - DNA, 19 bp, Homo sapiens
aaatgaattgtattttttg

SEQ ID NO: 5544183 - DNA, 22 bp, Homo sapiens
aaatgacaaagccattctttta

SEQ ID NO: 5544184 - DNA, 16 bp, Homo sapiens
aaatgacaacagaaaa

SEQ ID NO: 5544185 - DNA, 23 bp, Homo sapiens
aaatgacaacagaaaaacaatct

SEQ ID NO: 5544186 - DNA, 19 bp, Homo sapiens
aaatgacaatcatgtgtgt

SEQ ID NO: 5544187 - DNA, 21 bp, Homo sapiens
aaatgacaatcatgtgtgtta

SEQ ID NO: 5544188 - DNA, 22 bp, Homo sapiens
aaatgacaccatcttttattct

SEQ ID NO: 5544189 - DNA, 14 bp, Homo sapiens
aaatgacacccaga

SEQ ID NO: 5544190 - DNA, 17 bp, Homo sapiens
aaatgacacccagacct

SEQ ID NO: 5544191 - DNA, 20 bp, Homo sapiens
aaatgacactcatataatta

SEQ ID NO: 5544192 - DNA, 16 bp, Homo sapiens
aaatgacagatttctg

SEQ ID NO: 5544193 - DNA, 15 bp, Homo sapiens
aaatgacagcgggga

SEQ ID NO: 5544194 - DNA, 14 bp, Homo sapiens
aaatgacagtaata

SEQ ID NO: 5544195 - DNA, 17 bp, Homo sapiens
aaatgacagtcaaaaga

SEQ ID NO: 5544196 - DNA, 16 bp, Homo sapiens
aaatgacatcttttta

SEQ ID NO: 5544197 - DNA, 19 bp, Homo sapiens
aaatgacatttcactaaaa

SEQ ID NO: 5544198 - DNA, 14 bp, Homo sapiens
aaatgacatttttg

SEQ ID NO: 5544199 - DNA, 15 bp, Homo sapiens
aaatgacatttttga

SEQ ID NO: 5544200 - DNA, 14 bp, Homo sapiens
aaatgaccaaagat

SEQ ID NO: 5544201 - DNA, 15 bp, Homo sapiens
aaatgaccaaagatg

SEQ ID NO: 5544202 - DNA, 13 bp, Homo sapiens
aaatgacccaaac

SEQ ID NO: 5544203 - DNA, 15 bp, Homo sapiens
aaatgacctcaagga

SEQ ID NO: 5544204 - DNA, 21 bp, Homo sapiens
aaatgacctcagcaaatcctc

SEQ ID NO: 5544205 - DNA, 22 bp, Homo sapiens
aaatgacctcagcaaatcctct

SEQ ID NO: 5544206 - DNA, 20 bp, Homo sapiens
aaatgacctctgtcctccct

SEQ ID NO: 5544207 - DNA, 17 bp, Homo sapiens
aaatgacggctaccaca

SEQ ID NO: 5544208 - DNA, 12 bp, Homo sapiens
aaatgacggtgt

SEQ ID NO: 5544209 - DNA, 22 bp, Homo sapiens
aaatgactaaaaaacaaagaag

SEQ ID NO: 5544210 - DNA, 17 bp, Homo sapiens
aaatgactacttagcat

SEQ ID NO: 5544211 - DNA, 16 bp, Homo sapiens
aaatgactattgtaat

SEQ ID NO: 5544212 - DNA, 20 bp, Homo sapiens
aaatgactattgtaatgcca

SEQ ID NO: 5544213 - DNA, 14 bp, Homo sapiens
aaatgactggctcc

SEQ ID NO: 5544214 - DNA, 16 bp, Homo sapiens
aaatgacttattgatt

SEQ ID NO: 5544215 - DNA, 17 bp, Homo sapiens
aaatgacttatttctgc

SEQ ID NO: 5544216 - DNA, 18 bp, Homo sapiens
aaatgacttgcagatgaa

SEQ ID NO: 5544217 - DNA, 17 bp, Homo sapiens
aaatgactttatacaac

SEQ ID NO: 5544218 - DNA, 20 bp, Homo sapiens
aaatgactttattatttatt

SEQ ID NO: 5544219 - DNA, 21 bp, Homo sapiens
aaatgactttattatttattt

SEQ ID NO: 5544220 - DNA, 19 bp, Homo sapiens
aaatgactttcataataaa

SEQ ID NO: 5544221 - DNA, 14 bp, Homo sapiens
aaatgactttgaac

SEQ ID NO: 5544222 - DNA, 15 bp, Homo sapiens
aaatgactttgaact

SEQ ID NO: 5544223 - DNA, 18 bp, Homo sapiens
aaatgactttgaactgaa

SEQ ID NO: 5544224 - DNA, 22 bp, Homo sapiens
aaatgagaaaggatttcctttc

SEQ ID NO: 5544225 - DNA, 11 bp, Homo sapiens
aaatgagaaat

SEQ ID NO: 5544226 - DNA, 21 bp, Homo sapiens
aaatgagaaattgtgccaaag

SEQ ID NO: 5544227 - DNA, 14 bp, Homo sapiens
aaatgagaacatgt

SEQ ID NO: 5544228 - DNA, 22 bp, Homo sapiens
aaatgagaacatgttggtattt

SEQ ID NO: 5544229 - DNA, 23 bp, Homo sapiens
aaatgagaacatgttggtattta

SEQ ID NO: 5544230 - DNA, 13 bp, Homo sapiens
aaatgagaaggaa

SEQ ID NO: 5544231 - DNA, 15 bp, Homo sapiens
aaatgagaagtactt

SEQ ID NO: 5544232 - DNA, 19 bp, Homo sapiens
aaatgagaatgacagcctt

SEQ ID NO: 5544233 - DNA, 18 bp, Homo sapiens
aaatgagaattttatatt

SEQ ID NO: 5544234 - DNA, 20 bp, Homo sapiens
aaatgagaattttatattct

SEQ ID NO: 5544235 - DNA, 21 bp, Homo sapiens
aaatgagaattttatattcta

SEQ ID NO: 5544236 - DNA, 12 bp, Homo sapiens
aaatgagacttt

SEQ ID NO: 5544237 - DNA, 17 bp, Homo sapiens
aaatgagactttttcag

SEQ ID NO: 5544238 - DNA, 17 bp, Homo sapiens
aaatgagaggagaacag

SEQ ID NO: 5544239 - DNA, 17 bp, Homo sapiens
aaatgagatcaggctct

SEQ ID NO: 5544240 - DNA, 22 bp, Homo sapiens
aaatgagatcaggctctgcctc

SEQ ID NO: 5544241 - DNA, 19 bp, Homo sapiens
aaatgagcctggcaagaat

SEQ ID NO: 5544242 - DNA, 23 bp, Homo sapiens
aaatgagctcgcatttgtcaatg

SEQ ID NO: 5544243 - DNA, 18 bp, Homo sapiens
aaatgagcttgattaaat

SEQ ID NO: 5544244 - DNA, 19 bp, Homo sapiens
aaatgagcttgtaaatact

SEQ ID NO: 5544245 - DNA, 20 bp, Homo sapiens
aaatgagctttcaggaagtt

SEQ ID NO: 5544246 - DNA, 17 bp, Homo sapiens
aaatgtgatttttctga

SEQ ID NO: 5544247 - DNA, 22 bp, Homo sapiens
aaatgtgcattcttttaaaaga

SEQ ID NO: 5544248 - DNA, 22 bp, Homo sapiens
aaatgtgccatactaatgatga

SEQ ID NO: 5544249 - DNA, 16 bp, Homo sapiens
aaatgtgctgcaaaga

SEQ ID NO: 5544250 - DNA, 12 bp, Homo sapiens
aaatgtgcttca

SEQ ID NO: 5544251 - DNA, 17 bp, Homo sapiens
aaatgtgcttcattgtt

SEQ ID NO: 5544252 - DNA, 16 bp, Homo sapiens
aaatgtggatgctctt

SEQ ID NO: 5544253 - DNA, 13 bp, Homo sapiens
aaatgtggatgtg

SEQ ID NO: 5544254 - DNA, 16 bp, Homo sapiens
aaatgtggattttgta

SEQ ID NO: 5544255 - DNA, 18 bp, Homo sapiens
aaatgtggcatttgtgat

SEQ ID NO: 5544256 - DNA, 14 bp, Homo sapiens
aaatgtggccaagc

SEQ ID NO: 5544257 - DNA, 19 bp, Homo sapiens
aaatgtgggattatgggtc

SEQ ID NO: 5544258 - DNA, 20 bp, Homo sapiens
aaatgtgggattatgggtca

SEQ ID NO: 5544259 - DNA, 17 bp, Homo sapiens
aaatgtggtcctattta

SEQ ID NO: 5544260 - DNA, 14 bp, Homo sapiens
aaatgtggtctgcc

SEQ ID NO: 5544261 - DNA, 22 bp, Homo sapiens
aaatgtggtctgccaatctgta

SEQ ID NO: 5544262 - DNA, 15 bp, Homo sapiens
aaatgtggtgagaat

SEQ ID NO: 5544263 - DNA, 10 bp, Homo sapiens
aaatgtgtaa

SEQ ID NO: 5544264 - DNA, 16 bp, Homo sapiens
aaatgtgtaataatgt

SEQ ID NO: 5544265 - DNA, 16 bp, Homo sapiens
aaatgtgtacagtgaa

SEQ ID NO: 5544266 - DNA, 12 bp, Homo sapiens
aaatgtgtacat

SEQ ID NO: 5544267 - DNA, 21 bp, Homo sapiens
aaatgtgtatatttttgtatg

SEQ ID NO: 5544268 - DNA, 13 bp, Homo sapiens
aaatgtgtatttt

SEQ ID NO: 5544269 - DNA, 19 bp, Homo sapiens
aaatgtgtatttttcaagg

SEQ ID NO: 5544270 - DNA, 20 bp, Homo sapiens
aaatgtgtatttttgttgca

SEQ ID NO: 5544271 - DNA, 15 bp, Homo sapiens
aaatgtgtcagcatg

SEQ ID NO: 5544272 - DNA, 21 bp, Homo sapiens
aaatgtgtcctatctatcttc

SEQ ID NO: 5544273 - DNA, 19 bp, Homo sapiens
aaatgtgtgagtgcatgta

SEQ ID NO: 5544274 - DNA, 17 bp, Homo sapiens
aaatgtgtgcttggaaa

SEQ ID NO: 5544275 - DNA, 15 bp, Homo sapiens
aaatgtgtggtgcta

SEQ ID NO: 5544276 - DNA, 14 bp, Homo sapiens
aaatgtgtgtcacc

SEQ ID NO: 5544277 - DNA, 15 bp, Homo sapiens
aaatgtgtgtgatgt

SEQ ID NO: 5544278 - DNA, 18 bp, Homo sapiens
aaatgtgtgtgatgtgac

SEQ ID NO: 5544279 - DNA, 21 bp, Homo sapiens
aaatgtgttggacaaatgtga

SEQ ID NO: 5544280 - DNA, 14 bp, Homo sapiens
aaatgtgtttctgt

SEQ ID NO: 5544281 - DNA, 23 bp, Homo sapiens
aaatgtgttttgtttattaaata

SEQ ID NO: 5544282 - DNA, 13 bp, Homo sapiens
aaatgtgtttttc

SEQ ID NO: 5544283 - DNA, 18 bp, Homo sapiens
aaatgttaaaagttttat

SEQ ID NO: 5544284 - DNA, 15 bp, Homo sapiens
aaatgttaaagatgt

SEQ ID NO: 5544285 - DNA, 21 bp, Homo sapiens
aaatgttaaagatgtagcaaa

SEQ ID NO: 5544286 - DNA, 13 bp, Homo sapiens
aaatgttaacaat

SEQ ID NO: 5544287 - DNA, 23 bp, Homo sapiens
aaatgttaacaatgcctattgta

SEQ ID NO: 5544288 - DNA, 21 bp, Homo sapiens
aaatgttaacagagtttgata

SEQ ID NO: 5544289 - DNA, 18 bp, Homo sapiens
aaatgttaactacatatt

SEQ ID NO: 5544290 - DNA, 12 bp, Homo sapiens
aaatgttaagaa

SEQ ID NO: 5544291 - DNA, 16 bp, Homo sapiens
aaatgttaataaaggt

SEQ ID NO: 5544292 - DNA, 16 bp, Homo sapiens
aaatgttacaaaaaaa

SEQ ID NO: 5544293 - DNA, 13 bp, Homo sapiens
aaatgttacagtt

SEQ ID NO: 5544294 - DNA, 23 bp, Homo sapiens
aaatgttacctaattattacagc

SEQ ID NO: 5544295 - DNA, 13 bp, Homo sapiens
aaatgttacgtga

SEQ ID NO: 5544296 - DNA, 22 bp, Homo sapiens
aaatgttactccctgttttagt

SEQ ID NO: 5544297 - DNA, 17 bp, Homo sapiens
aaatgttagacttgtgt

SEQ ID NO: 5544298 - DNA, 17 bp, Homo sapiens
aaatgttagatattgct

SEQ ID NO: 5544299 - DNA, 20 bp, Homo sapiens
aaatgttagcaagatgattt

SEQ ID NO: 5544300 - DNA, 15 bp, Homo sapiens
aaatgttagtttctt

SEQ ID NO: 5544301 - DNA, 17 bp, Homo sapiens
aaatgttatcttctcaa

SEQ ID NO: 5544302 - DNA, 23 bp, Homo sapiens
aaatgttatcttctcaagttcta

SEQ ID NO: 5544303 - DNA, 21 bp, Homo sapiens
aaatgttattactgaggaaag

SEQ ID NO: 5544304 - DNA, 13 bp, Homo sapiens
aaatgttattatt

SEQ ID NO: 5544305 - DNA, 12 bp, Homo sapiens
aaatgttatttc

SEQ ID NO: 5544306 - DNA, 17 bp, Homo sapiens
aaatgttatttctgcaa

SEQ ID NO: 5544307 - DNA, 17 bp, Homo sapiens
aaatgttcaaattcacg

SEQ ID NO: 5544308 - DNA, 16 bp, Homo sapiens
aaatgttcacaaggta

SEQ ID NO: 5544309 - DNA, 13 bp, Homo sapiens
aaatgttcacttt

SEQ ID NO: 5544310 - DNA, 15 bp, Homo sapiens
aaatgttcagaaggt

SEQ ID NO: 5544311 - DNA, 21 bp, Homo sapiens
aaatgttcagaaggttgctct

SEQ ID NO: 5544312 - DNA, 17 bp, Homo sapiens
aaatgttcatcaatgaa

SEQ ID NO: 5544313 - DNA, 14 bp, Homo sapiens
aaatgttctaagtt

SEQ ID NO: 5544314 - DNA, 17 bp, Homo sapiens
aaatgttctatatgcat

SEQ ID NO: 5544315 - DNA, 22 bp, Homo sapiens
aaatgttctatttaacaactgg

SEQ ID NO: 5544316 - DNA, 10 bp, Homo sapiens
aaatgttctt

SEQ ID NO: 5544317 - DNA, 23 bp, Homo sapiens
aaatgttgaaatatgatgttaaa

SEQ ID NO: 5544318 - DNA, 22 bp, Homo sapiens
aaatgttgaaccaaacctccct

SEQ ID NO: 5544319 - DNA, 17 bp, Homo sapiens
aaatgttgaaggaactt

SEQ ID NO: 5544320 - DNA, 12 bp, Homo sapiens
aaatgttgaata

SEQ ID NO: 5544321 - DNA, 12 bp, Homo sapiens
aaatgttgagaa

SEQ ID NO: 5544322 - DNA, 19 bp, Homo sapiens
aaatgttgagaatcccaaa

SEQ ID NO: 5544323 - DNA, 21 bp, Homo sapiens
aaatgttgataaatggatatt

SEQ ID NO: 5544324 - DNA, 19 bp, Homo sapiens
aaatgttgctgaaaaatgg

SEQ ID NO: 5544325 - DNA, 18 bp, Homo sapiens
aaatgttgctttaacctg

SEQ ID NO: 5544326 - DNA, 18 bp, Homo sapiens
aaatgttggaatgttatg

SEQ ID NO: 5544327 - DNA, 19 bp, Homo sapiens
aaatgttggatttataaat

SEQ ID NO: 5544328 - DNA, 23 bp, Homo sapiens
aaatgttgttcattattggaggg

SEQ ID NO: 5544329 - DNA, 22 bp, Homo sapiens
aaatgttgttctcttctttaaa

SEQ ID NO: 5544330 - DNA, 17 bp, Homo sapiens
aaatgtttaataaagct

SEQ ID NO: 5544331 - DNA, 22 bp, Homo sapiens
aaatgtttaataaagctttata

SEQ ID NO: 5544332 - DNA, 15 bp, Homo sapiens
aaatgtttaatcata

SEQ ID NO: 5544333 - DNA, 19 bp, Homo sapiens
aaatgtttaatcatataaa

SEQ ID NO: 5544334 - DNA, 18 bp, Homo sapiens
aaatgtttaatggtgaaa

SEQ ID NO: 5544335 - DNA, 15 bp, Homo sapiens
aaatgtttaattcat

SEQ ID NO: 5544336 - DNA, 23 bp, Homo sapiens
aaatgtttaattcattaatctgt

SEQ ID NO: 5544337 - DNA, 15 bp, Homo sapiens
aaatgtttacatttt

SEQ ID NO: 5544338 - DNA, 23 bp, Homo sapiens
aaatgtttacattttctttcata

SEQ ID NO: 5544339 - DNA, 13 bp, Homo sapiens
aaatgtttactgt

SEQ ID NO: 5544340 - DNA, 21 bp, Homo sapiens
aaatgtttatacaataattta

SEQ ID NO: 5544341 - DNA, 14 bp, Homo sapiens
aaatgtttatatta

SEQ ID NO: 5544342 - DNA, 21 bp, Homo sapiens
aaatgtttatattgtttttat

SEQ ID NO: 5544343 - DNA, 18 bp, Homo sapiens
aaatgtttatttaaaaga

SEQ ID NO: 5544344 - DNA, 18 bp, Homo sapiens
aaatgtttcactatgatt

SEQ ID NO: 5544345 - DNA, 16 bp, Homo sapiens
aaatgtttcccccact

SEQ ID NO: 5544346 - DNA, 13 bp, Homo sapiens
aaatgtttcctta

SEQ ID NO: 5544347 - DNA, 14 bp, Homo sapiens
aaatgtttccttaa

SEQ ID NO: 5544348 - DNA, 20 bp, Homo sapiens
aaatgtttccttaaacatga

SEQ ID NO: 5544349 - DNA, 21 bp, Homo sapiens
aaatgtttccttaaacatgaa

SEQ ID NO: 5544350 - DNA, 13 bp, Homo sapiens
aaatgtttctgca

SEQ ID NO: 5544351 - DNA, 23 bp, Homo sapiens
aaatgtttctgcagtagtctctg

SEQ ID NO: 5544352 - DNA, 16 bp, Homo sapiens
aaatgtttctttttct

SEQ ID NO: 5544353 - DNA, 17 bp, Homo sapiens
aaatgtttctttttctt

SEQ ID NO: 5544354 - DNA, 15 bp, Homo sapiens
aaatgtttggaattt

SEQ ID NO: 5544355 - DNA, 19 bp, Homo sapiens
aaatgtttggaatttaaga

SEQ ID NO: 5544356 - DNA, 22 bp, Homo sapiens
aaatgtttggcatgtaaatgta

SEQ ID NO: 5544357 - DNA, 20 bp, Homo sapiens
aaatgtttgtactttttaat

SEQ ID NO: 5544358 - DNA, 17 bp, Homo sapiens
aaatgttttaaagaagt

SEQ ID NO: 5544359 - DNA, 20 bp, Homo sapiens
aaatgttttaaagtttaatg

SEQ ID NO: 5544360 - DNA, 23 bp, Homo sapiens
aaatgttttaaggcttcaattta

SEQ ID NO: 5544361 - DNA, 12 bp, Homo sapiens
aaatgttttaat

SEQ ID NO: 5544362 - DNA, 13 bp, Homo sapiens
aaatgttttacaa

SEQ ID NO: 5544363 - DNA, 22 bp, Homo sapiens
aaatgttttataagttcacaaa

SEQ ID NO: 5544364 - DNA, 15 bp, Homo sapiens
aaatgttttatgaca

SEQ ID NO: 5544365 - DNA, 18 bp, Homo sapiens
aaatgttttcagctagga

SEQ ID NO: 5544366 - DNA, 22 bp, Homo sapiens
aaatgttttcatatttttcaaa

SEQ ID NO: 5544367 - DNA, 19 bp, Homo sapiens
aaatgttttcattgggaaa

SEQ ID NO: 5544368 - DNA, 11 bp, Homo sapiens
aaatgttttcc

SEQ ID NO: 5544369 - DNA, 16 bp, Homo sapiens
aaatgttttccaatat

SEQ ID NO: 5544370 - DNA, 22 bp, Homo sapiens
aaatgttttcccctaattttcc

SEQ ID NO: 5544371 - DNA, 21 bp, Homo sapiens
aaatgttttctggggaaaggg

SEQ ID NO: 5544372 - DNA, 22 bp, Homo sapiens
aaatgttttgctcaatagattg

SEQ ID NO: 5544373 - DNA, 18 bp, Homo sapiens
aaatgttttgtaaacatt

SEQ ID NO: 5544374 - DNA, 20 bp, Homo sapiens
aaatgttttgtaaactttga

SEQ ID NO: 5544375 - DNA, 16 bp, Homo sapiens
aaatgtttttaaaaac

SEQ ID NO: 5544376 - DNA, 21 bp, Homo sapiens
aaatgtttttaacactatact

SEQ ID NO: 5544377 - DNA, 22 bp, Homo sapiens
aaatgtttttaataaaagaaaa

SEQ ID NO: 5544378 - DNA, 12 bp, Homo sapiens
aaatgtttttag

SEQ ID NO: 5544379 - DNA, 22 bp, Homo sapiens
aaatgtttttagaacatgtaaa

SEQ ID NO: 5544380 - DNA, 18 bp, Homo sapiens
aaatgtttttattaacaa

SEQ ID NO: 5544381 - DNA, 16 bp, Homo sapiens
aaatgtttttctgcca

SEQ ID NO: 5544382 - DNA, 21 bp, Homo sapiens
aaatgtttttctgccagggag

SEQ ID NO: 5544383 - DNA, 18 bp, Homo sapiens
aaatgttttttaaaatgg

SEQ ID NO: 5544384 - DNA, 21 bp, Homo sapiens
aaatgttttttaaaatggtta

SEQ ID NO: 5544385 - DNA, 18 bp, Homo sapiens
aaatgtttttttttaaag

SEQ ID NO: 5544386 - DNA, 21 bp, Homo sapiens
aaatgtttttttttaaagact

SEQ ID NO: 5544387 - DNA, 15 bp, Homo sapiens
aaattaaaaaaaaat

SEQ ID NO: 5544388 - DNA, 17 bp, Homo sapiens
aaattaaaaaaaaattg

SEQ ID NO: 5544389 - DNA, 18 bp, Homo sapiens
aaattaaaaagattcttt

SEQ ID NO: 5544390 - DNA, 20 bp, Homo sapiens
aaattaaaacatatttcatt

SEQ ID NO: 5544391 - DNA, 22 bp, Homo sapiens
aaattaaaacatatttcatttt

SEQ ID NO: 5544392 - DNA, 21 bp, Homo sapiens
aaattaaaacgaaaataaagt

SEQ ID NO: 5544393 - DNA, 15 bp, Homo sapiens
aaattaaaactcatt

SEQ ID NO: 5544394 - DNA, 15 bp, Homo sapiens
aaattaaaataggca

SEQ ID NO: 5544395 - DNA, 14 bp, Homo sapiens
aaattaaaatatta

SEQ ID NO: 5544396 - DNA, 17 bp, Homo sapiens
aaattaaaatattattt

SEQ ID NO: 5544397 - DNA, 20 bp, Homo sapiens
aaattaaaatattatttgat

SEQ ID NO: 5544398 - DNA, 22 bp, Homo sapiens
aaattaaaatccagcatcccaa

SEQ ID NO: 5544399 - DNA, 11 bp, Homo sapiens
aaattaaaatt

SEQ ID NO: 5544400 - DNA, 17 bp, Homo sapiens
aaattaaaatttaacat

SEQ ID NO: 5544401 - DNA, 13 bp, Homo sapiens
aaattaaaatttt

SEQ ID NO: 5544402 - DNA, 19 bp, Homo sapiens
aaattaaaattttccttta

SEQ ID NO: 5544403 - DNA, 13 bp, Homo sapiens
aaattaaacaatt

SEQ ID NO: 5544404 - DNA, 15 bp, Homo sapiens
aaattaaacaattta

SEQ ID NO: 5544405 - DNA, 17 bp, Homo sapiens
aaattaaacatattcaa

SEQ ID NO: 5544406 - DNA, 18 bp, Homo sapiens
aaattaaacatgctgtta

SEQ ID NO: 5544407 - DNA, 20 bp, Homo sapiens
aaattaaacatgctgttacc

SEQ ID NO: 5544408 - DNA, 19 bp, Homo sapiens
aaattaaaccaatgaagaa

SEQ ID NO: 5544409 - DNA, 19 bp, Homo sapiens
aaattaaaccggaccatct

SEQ ID NO: 5544410 - DNA, 18 bp, Homo sapiens
aaattaaacgtaaatgtt

SEQ ID NO: 5544411 - DNA, 20 bp, Homo sapiens
aaattaaacgtaaatgtttt

SEQ ID NO: 5544412 - DNA, 13 bp, Homo sapiens
aaattaaagaaaa

SEQ ID NO: 5544413 - DNA, 14 bp, Homo sapiens
aaattaaagaaatg

SEQ ID NO: 5544414 - DNA, 13 bp, Homo sapiens
aaattaaagcatt

SEQ ID NO: 5544415 - DNA, 22 bp, Homo sapiens
aaattaaagcctttagtatcag

SEQ ID NO: 5544416 - DNA, 23 bp, Homo sapiens
aaattaaagcctttagtatcagt

SEQ ID NO: 5544417 - DNA, 17 bp, Homo sapiens
aaattaaagctgaaaac

SEQ ID NO: 5544418 - DNA, 15 bp, Homo sapiens
aaattaaagctgcct

SEQ ID NO: 5544419 - DNA, 13 bp, Homo sapiens
aaattaaataaat

SEQ ID NO: 5544420 - DNA, 13 bp, Homo sapiens
aaattaaataatt

SEQ ID NO: 5544421 - DNA, 17 bp, Homo sapiens
aaattaaataattttac

SEQ ID NO: 5544422 - DNA, 18 bp, Homo sapiens
aaattaaataattttaca

SEQ ID NO: 5544423 - DNA, 12 bp, Homo sapiens
aaattctgctgc

SEQ ID NO: 5544424 - DNA, 15 bp, Homo sapiens
aaattctgctgcttg

SEQ ID NO: 5544425 - DNA, 18 bp, Homo sapiens
aaattctgctgcttgaaa

SEQ ID NO: 5544426 - DNA, 17 bp, Homo sapiens
aaattctggaaatgtct

SEQ ID NO: 5544427 - DNA, 9 bp, Homo sapiens
aaattctgt

SEQ ID NO: 5544428 - DNA, 18 bp, Homo sapiens
aaattctgtctctggatt

SEQ ID NO: 5544429 - DNA, 17 bp, Homo sapiens
aaattctgtctggggac

SEQ ID NO: 5544430 - DNA, 22 bp, Homo sapiens
aaattctgtttttaaaaattag

SEQ ID NO: 5544431 - DNA, 23 bp, Homo sapiens
aaattcttaatttggatctattt

SEQ ID NO: 5544432 - DNA, 19 bp, Homo sapiens
aaattcttatgttgaatat

SEQ ID NO: 5544433 - DNA, 19 bp, Homo sapiens
aaattcttcaagaaagaat

SEQ ID NO: 5544434 - DNA, 21 bp, Homo sapiens
aaattcttctaattgctgtgt

SEQ ID NO: 5544435 - DNA, 23 bp, Homo sapiens
aaattcttctccactttctagcc

SEQ ID NO: 5544436 - DNA, 12 bp, Homo sapiens
aaattcttgaaa

SEQ ID NO: 5544437 - DNA, 13 bp, Homo sapiens
aaattcttgagaa

SEQ ID NO: 5544438 - DNA, 14 bp, Homo sapiens
aaattcttgagaag

SEQ ID NO: 5544439 - DNA, 18 bp, Homo sapiens
aaattcttggttattctg

SEQ ID NO: 5544440 - DNA, 15 bp, Homo sapiens
aaattctttatttct

SEQ ID NO: 5544441 - DNA, 14 bp, Homo sapiens
aaattctttcactt

SEQ ID NO: 5544442 - DNA, 20 bp, Homo sapiens
aaattctttcagctatcagt

SEQ ID NO: 5544443 - DNA, 11 bp, Homo sapiens
aaattcttttg

SEQ ID NO: 5544444 - DNA, 19 bp, Homo sapiens
aaattctttttttattatt

SEQ ID NO: 5544445 - DNA, 18 bp, Homo sapiens
aaattgaaaaataaaaac

SEQ ID NO: 5544446 - DNA, 11 bp, Homo sapiens
aaattgaaaac

SEQ ID NO: 5544447 - DNA, 17 bp, Homo sapiens
aaattgaaaactttgga

SEQ ID NO: 5544448 - DNA, 22 bp, Homo sapiens
aaattgaaaggcattctctgaa

SEQ ID NO: 5544449 - DNA, 18 bp, Homo sapiens
aaattgaaagtattcaga

SEQ ID NO: 5544450 - DNA, 20 bp, Homo sapiens
aaattgaaagtattcagaaa

SEQ ID NO: 5544451 - DNA, 20 bp, Homo sapiens
aaattgaaatgggaacaata

SEQ ID NO: 5544452 - DNA, 12 bp, Homo sapiens
aaattgaacctt

SEQ ID NO: 5544453 - DNA, 16 bp, Homo sapiens
aaattgaactgtaaac

SEQ ID NO: 5544454 - DNA, 17 bp, Homo sapiens
aaattgaagagagatat

SEQ ID NO: 5544455 - DNA, 21 bp, Homo sapiens
aaattgaagagagatatatct

SEQ ID NO: 5544456 - DNA, 20 bp, Homo sapiens
aaattgaagtgtcttctgtt

SEQ ID NO: 5544457 - DNA, 22 bp, Homo sapiens
aaattgaagtgtcttctgttcc

SEQ ID NO: 5544458 - DNA, 18 bp, Homo sapiens
aaattgaatactttgaat

SEQ ID NO: 5544459 - DNA, 23 bp, Homo sapiens
aaattgaatagtttatttctgtg

SEQ ID NO: 5544460 - DNA, 15 bp, Homo sapiens
aaattgaatttaaca

SEQ ID NO: 5544461 - DNA, 17 bp, Homo sapiens
aaattgaatttaacaat

SEQ ID NO: 5544462 - DNA, 21 bp, Homo sapiens
aaattgacaagctaggaaaga

SEQ ID NO: 5544463 - DNA, 22 bp, Homo sapiens
aaattgacaagctaggaaagag

SEQ ID NO: 5544464 - DNA, 20 bp, Homo sapiens
aaattgacacaagtggacct

SEQ ID NO: 5544465 - DNA, 19 bp, Homo sapiens
aaattgacacttaaaaatg

SEQ ID NO: 5544466 - DNA, 22 bp, Homo sapiens
aaattgacagatcaagctgtga

SEQ ID NO: 5544467 - DNA, 16 bp, Homo sapiens
aaattgacagctttct

SEQ ID NO: 5544468 - DNA, 18 bp, Homo sapiens
aaattgacctagttcaga

SEQ ID NO: 5544469 - DNA, 16 bp, Homo sapiens
aaattgacctcaaaag

SEQ ID NO: 5544470 - DNA, 21 bp, Homo sapiens
aaattgacctcaaaagaaaat

SEQ ID NO: 5544471 - DNA, 22 bp, Homo sapiens
aaattgacctcaaaagaaaatg

SEQ ID NO: 5544472 - DNA, 13 bp, Homo sapiens
aaattgacttctt

SEQ ID NO: 5544473 - DNA, 13 bp, Homo sapiens
aaattgagagaat

SEQ ID NO: 5544474 - DNA, 17 bp, Homo sapiens
aaattgagagaatggaa

SEQ ID NO: 5544475 - DNA, 16 bp, Homo sapiens
aaattgagagctttat

SEQ ID NO: 5544476 - DNA, 16 bp, Homo sapiens
aaattgagctgctttt

SEQ ID NO: 5544477 - DNA, 23 bp, Homo sapiens
aaattgaggttgttcaaagttta

SEQ ID NO: 5544478 - DNA, 22 bp, Homo sapiens
aaattgagtttcagaataaaat

SEQ ID NO: 5544479 - DNA, 19 bp, Homo sapiens
aaattgataacatggaaat

SEQ ID NO: 5544480 - DNA, 14 bp, Homo sapiens
aaattgatattata

SEQ ID NO: 5544481 - DNA, 19 bp, Homo sapiens
aaattgatcattcataatt

SEQ ID NO: 5544482 - DNA, 15 bp, Homo sapiens
aaattgatcctttga

SEQ ID NO: 5544483 - DNA, 15 bp, Homo sapiens
aaattgatgcactac

SEQ ID NO: 5544484 - DNA, 18 bp, Homo sapiens
aaattgatgggatttggt

SEQ ID NO: 5544485 - DNA, 14 bp, Homo sapiens
aaattgatgtgttt

SEQ ID NO: 5544486 - DNA, 21 bp, Homo sapiens
aaattgatgtgtttatttata

SEQ ID NO: 5544487 - DNA, 19 bp, Homo sapiens
aaattgattaaggctttct

SEQ ID NO: 5544488 - DNA, 21 bp, Homo sapiens
aaattgattcaaatgttacaa

SEQ ID NO: 5544489 - DNA, 13 bp, Homo sapiens
aaattgatttgtt

SEQ ID NO: 5544490 - DNA, 14 bp, Homo sapiens
aaattgattttgaa

SEQ ID NO: 5544491 - DNA, 15 bp, Homo sapiens
aaattgattttgaac

SEQ ID NO: 5544492 - DNA, 19 bp, Homo sapiens
aaattgatttttctcttca

SEQ ID NO: 5544493 - DNA, 20 bp, Homo sapiens
aaattgatttttctcttcat

SEQ ID NO: 5544494 - DNA, 12 bp, Homo sapiens
aaattgcaaaga

SEQ ID NO: 5544495 - DNA, 19 bp, Homo sapiens
aaattgcaaatcttgaaat

SEQ ID NO: 5544496 - DNA, 16 bp, Homo sapiens
aaattgcaacatatta

SEQ ID NO: 5544497 - DNA, 20 bp, Homo sapiens
aaattgcacacactcagtgc

SEQ ID NO: 5544498 - DNA, 16 bp, Homo sapiens
aaattgcactattgca

SEQ ID NO: 5544499 - DNA, 17 bp, Homo sapiens
aaattgcactgaagttt

SEQ ID NO: 5544500 - DNA, 21 bp, Homo sapiens
aaattgcactgaagtttttga

SEQ ID NO: 5544501 - DNA, 22 bp, Homo sapiens
aaattgcactgaagtttttgaa

SEQ ID NO: 5544502 - DNA, 18 bp, Homo sapiens
aaattgcagaagaaactc

SEQ ID NO: 5544503 - DNA, 20 bp, Homo sapiens
aaattgcagaagaaactcct

SEQ ID NO: 5544504 - DNA, 18 bp, Homo sapiens
aaattgcagacagtgttt

SEQ ID NO: 5544505 - DNA, 21 bp, Homo sapiens
aaattgcagtttacagtattt

SEQ ID NO: 5544506 - DNA, 19 bp, Homo sapiens
aaattgcagtttcatgtat

SEQ ID NO: 5544507 - DNA, 21 bp, Homo sapiens
aaattgcagtttcatgtatgt

SEQ ID NO: 5544508 - DNA, 16 bp, Homo sapiens
aaattgcataaagcat

SEQ ID NO: 5544509 - DNA, 12 bp, Homo sapiens
aaattgcatact

SEQ ID NO: 5544510 - DNA, 15 bp, Homo sapiens
aaattgcatgaaact

SEQ ID NO: 5544511 - DNA, 18 bp, Homo sapiens
aaattgcatttcctgaca

SEQ ID NO: 5544512 - DNA, 21 bp, Homo sapiens
aaattgccatattgcacatgt

SEQ ID NO: 5544513 - DNA, 23 bp, Homo sapiens
aaattgccatattgcacatgtct

SEQ ID NO: 5544514 - DNA, 15 bp, Homo sapiens
aaattgccattttat

SEQ ID NO: 5544515 - DNA, 22 bp, Homo sapiens
aaattgcctataatacttgcaa

SEQ ID NO: 5544516 - DNA, 20 bp, Homo sapiens
aaattgcctatcctgctgtt

SEQ ID NO: 5544517 - DNA, 14 bp, Homo sapiens
aaattgcctccctt

SEQ ID NO: 5544518 - DNA, 17 bp, Homo sapiens
aaattgcctcccttcct

SEQ ID NO: 5544519 - DNA, 18 bp, Homo sapiens
aaattgcctcccttcctc

SEQ ID NO: 5544520 - DNA, 20 bp, Homo sapiens
aaattgcctgaaacccattt

SEQ ID NO: 5544521 - DNA, 13 bp, Homo sapiens
aaattgccttcag

SEQ ID NO: 5544522 - DNA, 15 bp, Homo sapiens
aaattgccttcagcc

SEQ ID NO: 5544523 - DNA, 16 bp, Homo sapiens
aaattgcctttctgtg

SEQ ID NO: 5544524 - DNA, 19 bp, Homo sapiens
aaattgcctttctgtgttt

SEQ ID NO: 5544525 - DNA, 16 bp, Homo sapiens
aaattgcctttgtaat

SEQ ID NO: 5544526 - DNA, 23 bp, Homo sapiens
aaattgcctttgtaatatgagaa

SEQ ID NO: 5544527 - DNA, 20 bp, Homo sapiens
aaattgctagtgatttcatt

SEQ ID NO: 5544528 - DNA, 13 bp, Homo sapiens
aaattgctatgtt

SEQ ID NO: 5544529 - DNA, 21 bp, Homo sapiens
aaattgctatgttactatttt

SEQ ID NO: 5544530 - DNA, 19 bp, Homo sapiens
aaattgctattttatttgt

SEQ ID NO: 5544531 - DNA, 18 bp, Homo sapiens
aaattgctcacagttatt

SEQ ID NO: 5544532 - DNA, 23 bp, Homo sapiens
aaattgctcacagttattacata

SEQ ID NO: 5544533 - DNA, 13 bp, Homo sapiens
aaattgctccttg

SEQ ID NO: 5544534 - DNA, 23 bp, Homo sapiens
aaattgctgactgtagctttgga

SEQ ID NO: 5544535 - DNA, 15 bp, Homo sapiens
aaattgctgagatgt

SEQ ID NO: 5544536 - DNA, 16 bp, Homo sapiens
aaattgctgagatgtt

SEQ ID NO: 5544537 - DNA, 19 bp, Homo sapiens
aaattgctggcagatgctt

SEQ ID NO: 5544538 - DNA, 22 bp, Homo sapiens
aaattgctgtgcctcccaaaat

SEQ ID NO: 5544539 - DNA, 13 bp, Homo sapiens
aaattgcttctag

SEQ ID NO: 5544540 - DNA, 18 bp, Homo sapiens
aaattgctttgtattgta

SEQ ID NO: 5544541 - DNA, 13 bp, Homo sapiens
aaattgcttttgt

SEQ ID NO: 5544542 - DNA, 19 bp, Homo sapiens
aaattgcttttgttgtgac

SEQ ID NO: 5544543 - DNA, 16 bp, Homo sapiens
aaattggaacagaatg

SEQ ID NO: 5544544 - DNA, 19 bp, Homo sapiens
aaattggaacagaatgttt

SEQ ID NO: 5544545 - DNA, 23 bp, Homo sapiens
aaattggactttcaaaattaaat

SEQ ID NO: 5544546 - DNA, 22 bp, Homo sapiens
aaattggagaaaagcacttaaa

SEQ ID NO: 5544547 - DNA, 15 bp, Homo sapiens
aaattggattatttt

SEQ ID NO: 5544548 - DNA, 12 bp, Homo sapiens
aaattggatttg

SEQ ID NO: 5544549 - DNA, 16 bp, Homo sapiens
aaattggcatggaaat

SEQ ID NO: 5544550 - DNA, 21 bp, Homo sapiens
aaattggcattttaagtgttt

SEQ ID NO: 5544551 - DNA, 21 bp, Homo sapiens
aaattggcctggtatggctgc

SEQ ID NO: 5544552 - DNA, 18 bp, Homo sapiens
aaattggctcctttccca

SEQ ID NO: 5544553 - DNA, 19 bp, Homo sapiens
aaattggctcctttcccac

SEQ ID NO: 5544554 - DNA, 15 bp, Homo sapiens
aaattgggaaaggag

SEQ ID NO: 5544555 - DNA, 17 bp, Homo sapiens
aaattgggacaacagtg

SEQ ID NO: 5544556 - DNA, 22 bp, Homo sapiens
aaattgggacaacagtgctttg

SEQ ID NO: 5544557 - DNA, 19 bp, Homo sapiens
aaattgggactagtttata

SEQ ID NO: 5544558 - DNA, 16 bp, Homo sapiens
aaattgggatctgtct

SEQ ID NO: 5544559 - DNA, 21 bp, Homo sapiens
aaattgggcttgtgatttcca

SEQ ID NO: 5544560 - DNA, 19 bp, Homo sapiens
aaattggggaggagggggc

SEQ ID NO: 5544561 - DNA, 18 bp, Homo sapiens
aaattgggtgtgccctgg

SEQ ID NO: 5544562 - DNA, 19 bp, Homo sapiens
aaattgggttcatgatgca

SEQ ID NO: 5544563 - DNA, 17 bp, Homo sapiens
aaattggtaaaaataaa

SEQ ID NO: 5544564 - DNA, 22 bp, Homo sapiens
aaattggtaattgaatggaagc

SEQ ID NO: 5544565 - DNA, 15 bp, Homo sapiens
aaattggtacatagg

SEQ ID NO: 5544566 - DNA, 20 bp, Homo sapiens
aaattggtatcaagaaagtc

SEQ ID NO: 5544567 - DNA, 16 bp, Homo sapiens
aaattggtgataagtg

SEQ ID NO: 5544568 - DNA, 18 bp, Homo sapiens
aaattggtgataagtgga

SEQ ID NO: 5544569 - DNA, 20 bp, Homo sapiens
aaattggtgataagtggaaa

SEQ ID NO: 5544570 - DNA, 22 bp, Homo sapiens
aaattggttcagggtgataact

SEQ ID NO: 5544571 - DNA, 22 bp, Homo sapiens
aaattggttggagaatttaggt

SEQ ID NO: 5544572 - DNA, 20 bp, Homo sapiens
aaattgtaagcatgcacaaa

SEQ ID NO: 5544573 - DNA, 12 bp, Homo sapiens
aaattgtacata

SEQ ID NO: 5544574 - DNA, 22 bp, Homo sapiens
aaattgtacatatttgtggaat

SEQ ID NO: 5544575 - DNA, 18 bp, Homo sapiens
aaattgtacattttgtaa

SEQ ID NO: 5544576 - DNA, 16 bp, Homo sapiens
aaattgtagtgcaaaa

SEQ ID NO: 5544577 - DNA, 20 bp, Homo sapiens
aaattgtagtgcaaaatggt

SEQ ID NO: 5544578 - DNA, 21 bp, Homo sapiens
aaattgtataccaatgtgttt

SEQ ID NO: 5544579 - DNA, 15 bp, Homo sapiens
aaattgtatctcagt

SEQ ID NO: 5544580 - DNA, 18 bp, Homo sapiens
aaattgtatctcattact

SEQ ID NO: 5544581 - DNA, 19 bp, Homo sapiens
aaattgtatgaaaatcctt

SEQ ID NO: 5544582 - DNA, 17 bp, Homo sapiens
aaattgtattacaaatc

SEQ ID NO: 5544583 - DNA, 13 bp, Homo sapiens
aaattgtattttt

SEQ ID NO: 5544584 - DNA, 16 bp, Homo sapiens
aaattgtatttttgta

SEQ ID NO: 5544585 - DNA, 13 bp, Homo sapiens
aaattgtcagcaa

SEQ ID NO: 5544586 - DNA, 15 bp, Homo sapiens
aaattgtcattattt

SEQ ID NO: 5544587 - DNA, 18 bp, Homo sapiens
aaattgtcgtttttattc

SEQ ID NO: 5544588 - DNA, 23 bp, Homo sapiens
aaattgtctgccattacaccaga

SEQ ID NO: 5544589 - DNA, 20 bp, Homo sapiens
aaattgtctgtctgctctta

SEQ ID NO: 5544590 - DNA, 14 bp, Homo sapiens
aaattgtcttcatg

SEQ ID NO: 5544591 - DNA, 22 bp, Homo sapiens
aaattgtctttaaaaactgttt

SEQ ID NO: 5544592 - DNA, 21 bp, Homo sapiens
aaattgtcttttgtcatgtgg

SEQ ID NO: 5544593 - DNA, 13 bp, Homo sapiens
aaattgtgaaaaa

SEQ ID NO: 5544594 - DNA, 15 bp, Homo sapiens
aaattgtgaaaaaaa

SEQ ID NO: 5544595 - DNA, 16 bp, Homo sapiens
aaattgtgaaaaatga

SEQ ID NO: 5544596 - DNA, 11 bp, Homo sapiens
aaattgtgaag

SEQ ID NO: 5544597 - DNA, 18 bp, Homo sapiens
aaattgtgatgttttgtt

SEQ ID NO: 5544598 - DNA, 23 bp, Homo sapiens
aaattgtgcagtactttgtgcat

SEQ ID NO: 5544599 - DNA, 13 bp, Homo sapiens
aacaaaatctgaa

SEQ ID NO: 5544600 - DNA, 15 bp, Homo sapiens
aacaaaatgaaacaa

SEQ ID NO: 5544601 - DNA, 14 bp, Homo sapiens
aacaaaatgtagaa

SEQ ID NO: 5544602 - DNA, 18 bp, Homo sapiens
aacaaaattagccgggca

SEQ ID NO: 5544603 - DNA, 15 bp, Homo sapiens
aacaaaattatttgt

SEQ ID NO: 5544604 - DNA, 22 bp, Homo sapiens
aacaaaattgacagctttctaa

SEQ ID NO: 5544605 - DNA, 15 bp, Homo sapiens
aacaaaatttgaata

SEQ ID NO: 5544606 - DNA, 19 bp, Homo sapiens
aacaaaatttgtttgaaat

SEQ ID NO: 5544607 - DNA, 12 bp, Homo sapiens
aacaaacaaaaa

SEQ ID NO: 5544608 - DNA, 16 bp, Homo sapiens
aacaaacaaaactctt

SEQ ID NO: 5544609 - DNA, 14 bp, Homo sapiens
aacaaacaaacaaa

SEQ ID NO: 5544610 - DNA, 16 bp, Homo sapiens
aacaaacaaacaaaaa

SEQ ID NO: 5544611 - DNA, 15 bp, Homo sapiens
aacaaacaatacctg

SEQ ID NO: 5544612 - DNA, 14 bp, Homo sapiens
aacaaacacacaca

SEQ ID NO: 5544613 - DNA, 18 bp, Homo sapiens
aacaaacacatgggggag

SEQ ID NO: 5544614 - DNA, 12 bp, Homo sapiens
aacaaacaggat

SEQ ID NO: 5544615 - DNA, 18 bp, Homo sapiens
aacaaacattgatgctga

SEQ ID NO: 5544616 - DNA, 14 bp, Homo sapiens
aacaaacatttgaa

SEQ ID NO: 5544617 - DNA, 15 bp, Homo sapiens
aacaaaccaacatct

SEQ ID NO: 5544618 - DNA, 17 bp, Homo sapiens
aacaaaccacagcagga

SEQ ID NO: 5544619 - DNA, 16 bp, Homo sapiens
aacaaaccagaatccc

SEQ ID NO: 5544620 - DNA, 17 bp, Homo sapiens
aacaaaccagcaacttt

SEQ ID NO: 5544621 - DNA, 18 bp, Homo sapiens
aacaaaccagcaactttt

SEQ ID NO: 5544622 - DNA, 11 bp, Homo sapiens
aacaaaccatc

SEQ ID NO: 5544623 - DNA, 13 bp, Homo sapiens
aacaaaccatctg

SEQ ID NO: 5544624 - DNA, 17 bp, Homo sapiens
aacaaacgagcaggcat

SEQ ID NO: 5544625 - DNA, 13 bp, Homo sapiens
aacaaactaaaaa

SEQ ID NO: 5544626 - DNA, 15 bp, Homo sapiens
aacaaactaaaaata

SEQ ID NO: 5544627 - DNA, 14 bp, Homo sapiens
aacaaactatttct

SEQ ID NO: 5544628 - DNA, 15 bp, Homo sapiens
aacaaactcaaaatg

SEQ ID NO: 5544629 - DNA, 16 bp, Homo sapiens
aacaaactcgtttttt

SEQ ID NO: 5544630 - DNA, 15 bp, Homo sapiens
aacaaactgaaaaat

SEQ ID NO: 5544631 - DNA, 17 bp, Homo sapiens
aacaaactgaaaaatct

SEQ ID NO: 5544632 - DNA, 13 bp, Homo sapiens
aacaaagaaatat

SEQ ID NO: 5544633 - DNA, 15 bp, Homo sapiens
aacaaagaaattatg

SEQ ID NO: 5544634 - DNA, 11 bp, Homo sapiens
aacaaagaaga

SEQ ID NO: 5544635 - DNA, 13 bp, Homo sapiens
aacaaagaaggtt

SEQ ID NO: 5544636 - DNA, 12 bp, Homo sapiens
aacaaagacatg

SEQ ID NO: 5544637 - DNA, 15 bp, Homo sapiens
aacaaagacattctt

SEQ ID NO: 5544638 - DNA, 14 bp, Homo sapiens
aacaaagacattga

SEQ ID NO: 5544639 - DNA, 17 bp, Homo sapiens
aacaaagacatttatat

SEQ ID NO: 5544640 - DNA, 20 bp, Homo sapiens
aacaaagaccaatgtgaaga

SEQ ID NO: 5544641 - DNA, 14 bp, Homo sapiens
aacaaagaccaatt

SEQ ID NO: 5544642 - DNA, 16 bp, Homo sapiens
aacaaagaccaatttt

SEQ ID NO: 5544643 - DNA, 16 bp, Homo sapiens
aacaaagagtgaaata

SEQ ID NO: 5544644 - DNA, 17 bp, Homo sapiens
aacaaagagtgaaatat

SEQ ID NO: 5544645 - DNA, 17 bp, Homo sapiens
aacaaagagttcaagaa

SEQ ID NO: 5544646 - DNA, 19 bp, Homo sapiens
aacaaagagttcaagaaat

SEQ ID NO: 5544647 - DNA, 15 bp, Homo sapiens
aacaaagcacagtgt

SEQ ID NO: 5544648 - DNA, 17 bp, Homo sapiens
aacaaagcacagtgtta

SEQ ID NO: 5544649 - DNA, 18 bp, Homo sapiens
aacaaagcagctttaaaa

SEQ ID NO: 5544650 - DNA, 19 bp, Homo sapiens
aacaaagcagtatataata

SEQ ID NO: 5544651 - DNA, 23 bp, Homo sapiens
aacaaagccaaacaaaactgaac

SEQ ID NO: 5544652 - DNA, 16 bp, Homo sapiens
aacaaagccactttca

SEQ ID NO: 5544653 - DNA, 12 bp, Homo sapiens
aacaaagccaga

SEQ ID NO: 5544654 - DNA, 14 bp, Homo sapiens
aacaaagccagaag

SEQ ID NO: 5544655 - DNA, 17 bp, Homo sapiens
aacaaagctgttaaact

SEQ ID NO: 5544656 - DNA, 18 bp, Homo sapiens
aacaaagctgttaaactg

SEQ ID NO: 5544657 - DNA, 16 bp, Homo sapiens
aacaaagcttagcagg

SEQ ID NO: 5544658 - DNA, 17 bp, Homo sapiens
aacaaagcttagcagga

SEQ ID NO: 5544659 - DNA, 14 bp, Homo sapiens
aacaaaggaactaa

SEQ ID NO: 5544660 - DNA, 17 bp, Homo sapiens
aacaaaggatttgaaaa

SEQ ID NO: 5544661 - DNA, 17 bp, Homo sapiens
aacaaaggcaagttaag

SEQ ID NO: 5544662 - DNA, 13 bp, Homo sapiens
aacaaaggcagct

SEQ ID NO: 5544663 - DNA, 18 bp, Homo sapiens
aacaaaggcagctgtgtc

SEQ ID NO: 5544664 - DNA, 16 bp, Homo sapiens
aacaaagggttttctt

SEQ ID NO: 5544665 - DNA, 16 bp, Homo sapiens
aacaaaggttgagatg

SEQ ID NO: 5544666 - DNA, 17 bp, Homo sapiens
aacaaagtcacagtcgt

SEQ ID NO: 5544667 - DNA, 20 bp, Homo sapiens
aacaaagtctgggaaattct

SEQ ID NO: 5544668 - DNA, 12 bp, Homo sapiens
aacaaagtcttt

SEQ ID NO: 5544669 - DNA, 20 bp, Homo sapiens
aacaaagtgactgtttggct

SEQ ID NO: 5544670 - DNA, 15 bp, Homo sapiens
aacaaagtgcaaagc

SEQ ID NO: 5544671 - DNA, 17 bp, Homo sapiens
aacaaagtgcaaagctg

SEQ ID NO: 5544672 - DNA, 17 bp, Homo sapiens
aacaaagtgctttttca

SEQ ID NO: 5544673 - DNA, 18 bp, Homo sapiens
aacaaagtggaaggaaag

SEQ ID NO: 5544674 - DNA, 23 bp, Homo sapiens
aacaaagttactaggtaacttca

SEQ ID NO: 5544675 - DNA, 17 bp, Homo sapiens
aacaaagtttgctgaaa

SEQ ID NO: 5544676 - DNA, 15 bp, Homo sapiens
aacaaataaactagt

SEQ ID NO: 5544677 - DNA, 15 bp, Homo sapiens
aacaaataacctata

SEQ ID NO: 5544678 - DNA, 22 bp, Homo sapiens
aacaaatacattcataaggaaa

SEQ ID NO: 5544679 - DNA, 14 bp, Homo sapiens
aacaaatatactca

SEQ ID NO: 5544680 - DNA, 19 bp, Homo sapiens
aacaaatatgaaaaatgta

SEQ ID NO: 5544681 - DNA, 23 bp, Homo sapiens
aacaaatatgaaaaatgtaaata

SEQ ID NO: 5544682 - DNA, 16 bp, Homo sapiens
aacaaatatgttctct

SEQ ID NO: 5544683 - DNA, 21 bp, Homo sapiens
aacaaatcaaacacaacacaa

SEQ ID NO: 5544684 - DNA, 15 bp, Homo sapiens
aacaaatcactgtat

SEQ ID NO: 5544685 - DNA, 18 bp, Homo sapiens
aacaaatcagatcagatg

SEQ ID NO: 5544686 - DNA, 18 bp, Homo sapiens
aacaaatcctgcatttag

SEQ ID NO: 5544687 - DNA, 13 bp, Homo sapiens
aacaaatcttcaa

SEQ ID NO: 5544688 - DNA, 22 bp, Homo sapiens
aacaaatcttcaaggtgtaaaa

SEQ ID NO: 5544689 - DNA, 22 bp, Homo sapiens
aacaaatgaaatttaattacaa

SEQ ID NO: 5544690 - DNA, 19 bp, Homo sapiens
aacaaatgaacgatatgta

SEQ ID NO: 5544691 - DNA, 12 bp, Homo sapiens
aacaaatgcttt

SEQ ID NO: 5544692 - DNA, 14 bp, Homo sapiens
aacaaatggcttgt

SEQ ID NO: 5544693 - DNA, 22 bp, Homo sapiens
aacaaatgtggccaagcctatc

SEQ ID NO: 5544694 - DNA, 22 bp, Homo sapiens
aacaaatgtgtttttctatata

SEQ ID NO: 5544695 - DNA, 15 bp, Homo sapiens
aacaaattaaataaa

SEQ ID NO: 5544696 - DNA, 18 bp, Homo sapiens
aacaaattcatattctgt

SEQ ID NO: 5544697 - DNA, 20 bp, Homo sapiens
aacaaattctttagtactca

SEQ ID NO: 5544698 - DNA, 21 bp, Homo sapiens
aacaaattctttagtactcaa

SEQ ID NO: 5544699 - DNA, 14 bp, Homo sapiens
aacaaattgcattt

SEQ ID NO: 5544700 - DNA, 13 bp, Homo sapiens
aacaaatttacat

SEQ ID NO: 5544701 - DNA, 15 bp, Homo sapiens
aacaaatttcattgc

SEQ ID NO: 5544702 - DNA, 16 bp, Homo sapiens
aacaaatttcattgca

SEQ ID NO: 5544703 - DNA, 19 bp, Homo sapiens
aacaaatttcattgcactt

SEQ ID NO: 5544704 - DNA, 15 bp, Homo sapiens
aacaacaaaccaaaa

SEQ ID NO: 5544705 - DNA, 13 bp, Homo sapiens
aacaacaaacttg

SEQ ID NO: 5544706 - DNA, 13 bp, Homo sapiens
aacaacaaagcat

SEQ ID NO: 5544707 - DNA, 17 bp, Homo sapiens
aacaacaaagcatgctc

SEQ ID NO: 5544708 - DNA, 12 bp, Homo sapiens
aacaacaaataa

SEQ ID NO: 5544709 - DNA, 14 bp, Homo sapiens
aacaacaacaacaa

SEQ ID NO: 5544710 - DNA, 12 bp, Homo sapiens
aacaacaacaat

SEQ ID NO: 5544711 - DNA, 16 bp, Homo sapiens
aacaacaacaatacaa

SEQ ID NO: 5544712 - DNA, 16 bp, Homo sapiens
aacaacaataataaag

SEQ ID NO: 5544713 - DNA, 14 bp, Homo sapiens
aacaacaattggta

SEQ ID NO: 5544714 - DNA, 19 bp, Homo sapiens
aacaacaattggtaaaact

SEQ ID NO: 5544715 - DNA, 20 bp, Homo sapiens
aacaacaattttaaataaga

SEQ ID NO: 5544716 - DNA, 16 bp, Homo sapiens
aacaacaccagaactg

SEQ ID NO: 5544717 - DNA, 15 bp, Homo sapiens
aacaacacctcctcc

SEQ ID NO: 5544718 - DNA, 18 bp, Homo sapiens
aacaacactaatacacta

SEQ ID NO: 5544719 - DNA, 14 bp, Homo sapiens
aacaacactgtagt

SEQ ID NO: 5544720 - DNA, 15 bp, Homo sapiens
aacaacactgtgtta

SEQ ID NO: 5544721 - DNA, 12 bp, Homo sapiens
aacaacagaaac

SEQ ID NO: 5544722 - DNA, 23 bp, Homo sapiens
aacaacagtacctgaaggattat

SEQ ID NO: 5544723 - DNA, 14 bp, Homo sapiens
aacaacagtagttt

SEQ ID NO: 5544724 - DNA, 20 bp, Homo sapiens
aacaacagtcttcatttttt

SEQ ID NO: 5544725 - DNA, 16 bp, Homo sapiens
aacaacataaaattaa

SEQ ID NO: 5544726 - DNA, 14 bp, Homo sapiens
aacaacatgttcta

SEQ ID NO: 5544727 - DNA, 16 bp, Homo sapiens
aacaacattttcttga

SEQ ID NO: 5544728 - DNA, 21 bp, Homo sapiens
aacaacattttgagaacaaag

SEQ ID NO: 5544729 - DNA, 15 bp, Homo sapiens
aacaaccaaagaaaa

SEQ ID NO: 5544730 - DNA, 15 bp, Homo sapiens
aacaaccacaggaat

SEQ ID NO: 5544731 - DNA, 14 bp, Homo sapiens
aacaaccatcctgc

SEQ ID NO: 5544732 - DNA, 23 bp, Homo sapiens
aacaacccaaggcaatgatatgg

SEQ ID NO: 5544733 - DNA, 19 bp, Homo sapiens
aacaaccccccatcacaaa

SEQ ID NO: 5544734 - DNA, 15 bp, Homo sapiens
aacaaccctgttgag

SEQ ID NO: 5544735 - DNA, 21 bp, Homo sapiens
aacaaccctgttgagtatttg

SEQ ID NO: 5544736 - DNA, 18 bp, Homo sapiens
aacaaccgtcctgctgtc

SEQ ID NO: 5544737 - DNA, 12 bp, Homo sapiens
aacaacctgcca

SEQ ID NO: 5544738 - DNA, 14 bp, Homo sapiens
aacaacctgccaca

SEQ ID NO: 5544739 - DNA, 13 bp, Homo sapiens
aacaacctggaga

SEQ ID NO: 5544740 - DNA, 22 bp, Homo sapiens
aacaacctggccgcgtttagac

SEQ ID NO: 5544741 - DNA, 18 bp, Homo sapiens
aacaaccttcagctttat

SEQ ID NO: 5544742 - DNA, 21 bp, Homo sapiens
aacaaccttcagctttatttt

SEQ ID NO: 5544743 - DNA, 22 bp, Homo sapiens
aacaacgcttgtgaatgtattt

SEQ ID NO: 5544744 - DNA, 22 bp, Homo sapiens
aacaacgtctttttgtttgttt

SEQ ID NO: 5544745 - DNA, 17 bp, Homo sapiens
aacaactaatcaagagt

SEQ ID NO: 5544746 - DNA, 14 bp, Homo sapiens
aacaactactactt

SEQ ID NO: 5544747 - DNA, 16 bp, Homo sapiens
aacaactaggcttcag

SEQ ID NO: 5544748 - DNA, 23 bp, Homo sapiens
aacaactccctgaacctcagttt

SEQ ID NO: 5544749 - DNA, 18 bp, Homo sapiens
aacaactgaaatgtggat

SEQ ID NO: 5544750 - DNA, 18 bp, Homo sapiens
aacaactgagatgttaaa

SEQ ID NO: 5544751 - DNA, 13 bp, Homo sapiens
aacaactgccaaa

SEQ ID NO: 5544752 - DNA, 23 bp, Homo sapiens
aacaactgctgggaatatccgtg

SEQ ID NO: 5544753 - DNA, 16 bp, Homo sapiens
aacaactggaaataaa

SEQ ID NO: 5544754 - DNA, 18 bp, Homo sapiens
aacaactggatgcatcaa

SEQ ID NO: 5544755 - DNA, 13 bp, Homo sapiens
aacaacttaatgt

SEQ ID NO: 5544756 - DNA, 15 bp, Homo sapiens
aacaacttactaaat

SEQ ID NO: 5544757 - DNA, 19 bp, Homo sapiens
aacaacttccgttgctgcc

SEQ ID NO: 5544758 - DNA, 21 bp, Homo sapiens
aacaacttgtacttgtttcat

SEQ ID NO: 5544759 - DNA, 14 bp, Homo sapiens
aacaacttgtagca

SEQ ID NO: 5544760 - DNA, 17 bp, Homo sapiens
aacaacttgtagcagct

SEQ ID NO: 5544761 - DNA, 22 bp, Homo sapiens
aacaactttcactttgcaaaga

SEQ ID NO: 5544762 - DNA, 15 bp, Homo sapiens
aacaactttgtgctt

SEQ ID NO: 5544763 - DNA, 13 bp, Homo sapiens
aacaactttgttt

SEQ ID NO: 5544764 - DNA, 13 bp, Homo sapiens
aacaagaaaacat

SEQ ID NO: 5544765 - DNA, 14 bp, Homo sapiens
aacaagaaactgtc

SEQ ID NO: 5544766 - DNA, 19 bp, Homo sapiens
aacaagaaatggatgtaag

SEQ ID NO: 5544767 - DNA, 15 bp, Homo sapiens
aacaagaagaaatat

SEQ ID NO: 5544768 - DNA, 13 bp, Homo sapiens
aacaagaagccca

SEQ ID NO: 5544769 - DNA, 12 bp, Homo sapiens
aacaagaatgca

SEQ ID NO: 5544770 - DNA, 13 bp, Homo sapiens
aacaagaatgcat

SEQ ID NO: 5544771 - DNA, 16 bp, Homo sapiens
aacaagaccacgtttc

SEQ ID NO: 5544772 - DNA, 20 bp, Homo sapiens
aacaagaccacgtttctaaa

SEQ ID NO: 5544773 - DNA, 20 bp, Homo sapiens
aacaagacccccaggaagga

SEQ ID NO: 5544774 - DNA, 14 bp, Homo sapiens
aacaagaccctgtc

SEQ ID NO: 5544775 - DNA, 22 bp, Homo sapiens
aacaagacctcagtgccttcct

SEQ ID NO: 5544776 - DNA, 17 bp, Homo sapiens
aacaagacttcagattc

SEQ ID NO: 5544777 - DNA, 11 bp, Homo sapiens
aacaagaggag

SEQ ID NO: 5544778 - DNA, 20 bp, Homo sapiens
aacaagaggagcaggaagca

SEQ ID NO: 5544779 - DNA, 17 bp, Homo sapiens
aacaagaggggaaaaca

SEQ ID NO: 5544780 - DNA, 21 bp, Homo sapiens
aacaagaggtgctagctctta

SEQ ID NO: 5544781 - DNA, 13 bp, Homo sapiens
aacagaacagggt

SEQ ID NO: 5544782 - DNA, 20 bp, Homo sapiens
aacagaacatcattagaaca

SEQ ID NO: 5544783 - DNA, 18 bp, Homo sapiens
aacagaacatttctcatg

SEQ ID NO: 5544784 - DNA, 16 bp, Homo sapiens
aacagaacccacagta

SEQ ID NO: 5544785 - DNA, 13 bp, Homo sapiens
aacagaactaaat

SEQ ID NO: 5544786 - DNA, 18 bp, Homo sapiens
aacagaactaaatgttct

SEQ ID NO: 5544787 - DNA, 21 bp, Homo sapiens
aacagaactaaatgttctatg

SEQ ID NO: 5544788 - DNA, 21 bp, Homo sapiens
aacagaactcgatgcactgac

SEQ ID NO: 5544789 - DNA, 22 bp, Homo sapiens
aacagaactgctaaatactgta

SEQ ID NO: 5544790 - DNA, 23 bp, Homo sapiens
aacagaactgctaaatactgtac

SEQ ID NO: 5544791 - DNA, 13 bp, Homo sapiens
aacagaagcaaat

SEQ ID NO: 5544792 - DNA, 14 bp, Homo sapiens
aacagaagcagagg

SEQ ID NO: 5544793 - DNA, 16 bp, Homo sapiens
aacagaagcatttgta

SEQ ID NO: 5544794 - DNA, 21 bp, Homo sapiens
aacagaagcatttgtattttg

SEQ ID NO: 5544795 - DNA, 22 bp, Homo sapiens
aacagaagctttttgtttgcat

SEQ ID NO: 5544796 - DNA, 19 bp, Homo sapiens
aacagaaggtatacctggg

SEQ ID NO: 5544797 - DNA, 14 bp, Homo sapiens
aacagaagtgagga

SEQ ID NO: 5544798 - DNA, 13 bp, Homo sapiens
aacagaagtggtt

SEQ ID NO: 5544799 - DNA, 20 bp, Homo sapiens
aacagaagttgtgaaactaa

SEQ ID NO: 5544800 - DNA, 14 bp, Homo sapiens
aacagaataaagca

SEQ ID NO: 5544801 - DNA, 20 bp, Homo sapiens
aacagaataaagcagcctga

SEQ ID NO: 5544802 - DNA, 17 bp, Homo sapiens
aacagaataatgcatga

SEQ ID NO: 5544803 - DNA, 12 bp, Homo sapiens
aacagaatgaaa

SEQ ID NO: 5544804 - DNA, 14 bp, Homo sapiens
aacagaatgaaaaa

SEQ ID NO: 5544805 - DNA, 17 bp, Homo sapiens
aacagaatgaaaaatga

SEQ ID NO: 5544806 - DNA, 21 bp, Homo sapiens
aacagaatgaaaaatgaaaga

SEQ ID NO: 5544807 - DNA, 13 bp, Homo sapiens
aacagaatggatt

SEQ ID NO: 5544808 - DNA, 14 bp, Homo sapiens
aacagaatttgaga

SEQ ID NO: 5544809 - DNA, 15 bp, Homo sapiens
aacagaatttgagaa

SEQ ID NO: 5544810 - DNA, 14 bp, Homo sapiens
aacagaatttttcc

SEQ ID NO: 5544811 - DNA, 16 bp, Homo sapiens
aacagacaacagaagt

SEQ ID NO: 5544812 - DNA, 19 bp, Homo sapiens
aacagacaagcaacccaaa

SEQ ID NO: 5544813 - DNA, 23 bp, Homo sapiens
aacagacaagcaacccaaactga

SEQ ID NO: 5544814 - DNA, 17 bp, Homo sapiens
aacagacacaatttata

SEQ ID NO: 5544815 - DNA, 17 bp, Homo sapiens
aacagacaccctccact

SEQ ID NO: 5544816 - DNA, 15 bp, Homo sapiens
aacagacactacatt

SEQ ID NO: 5544817 - DNA, 15 bp, Homo sapiens
aacagacaggtggaa

SEQ ID NO: 5544818 - DNA, 11 bp, Homo sapiens
aacagacattg

SEQ ID NO: 5544819 - DNA, 13 bp, Homo sapiens
aacagacattgtt

SEQ ID NO: 5544820 - DNA, 15 bp, Homo sapiens
aacagacattgtttt

SEQ ID NO: 5544821 - DNA, 18 bp, Homo sapiens
aacagacattgttttgcc

SEQ ID NO: 5544822 - DNA, 22 bp, Homo sapiens
aacagacattgttttgccaaca

SEQ ID NO: 5544823 - DNA, 13 bp, Homo sapiens
aacagaccagcat

SEQ ID NO: 5544824 - DNA, 19 bp, Homo sapiens
aacagaccccctctagaaa

SEQ ID NO: 5544825 - DNA, 14 bp, Homo sapiens
aacagacctaagaa

SEQ ID NO: 5544826 - DNA, 18 bp, Homo sapiens
aacagacctaatgctcct

SEQ ID NO: 5544827 - DNA, 22 bp, Homo sapiens
aacagacctcactgctttgtag

SEQ ID NO: 5544828 - DNA, 17 bp, Homo sapiens
aacagactatttaactt

SEQ ID NO: 5544829 - DNA, 15 bp, Homo sapiens
aacagactgccttat

SEQ ID NO: 5544830 - DNA, 19 bp, Homo sapiens
aacagactggaagcacagc

SEQ ID NO: 5544831 - DNA, 20 bp, Homo sapiens
aacagactggaagcacagct

SEQ ID NO: 5544832 - DNA, 18 bp, Homo sapiens
aacagactggcctgagga

SEQ ID NO: 5544833 - DNA, 12 bp, Homo sapiens
aacagagaaaga

SEQ ID NO: 5544834 - DNA, 13 bp, Homo sapiens
aacagagaaagaa

SEQ ID NO: 5544835 - DNA, 14 bp, Homo sapiens
aacagagaaagggt

SEQ ID NO: 5544836 - DNA, 13 bp, Homo sapiens
aacagagaaggca

SEQ ID NO: 5544837 - DNA, 15 bp, Homo sapiens
aacagagaaggcagg

SEQ ID NO: 5544838 - DNA, 10 bp, Homo sapiens
aacagagact

SEQ ID NO: 5544839 - DNA, 11 bp, Homo sapiens
aacagagactc

SEQ ID NO: 5544840 - DNA, 19 bp, Homo sapiens
aacagagactgaatagata

SEQ ID NO: 5544841 - DNA, 12 bp, Homo sapiens
aacagagagaac

SEQ ID NO: 5544842 - DNA, 14 bp, Homo sapiens
aacagagagaatga

SEQ ID NO: 5544843 - DNA, 13 bp, Homo sapiens
aacagagatgtga

SEQ ID NO: 5544844 - DNA, 14 bp, Homo sapiens
aacagagcccaggg

SEQ ID NO: 5544845 - DNA, 15 bp, Homo sapiens
aacagagcctgccta

SEQ ID NO: 5544846 - DNA, 16 bp, Homo sapiens
aacagagccttcacaa

SEQ ID NO: 5544847 - DNA, 20 bp, Homo sapiens
aacagagcgggcctcttccc

SEQ ID NO: 5544848 - DNA, 20 bp, Homo sapiens
aacagagctactgagacttg

SEQ ID NO: 5544849 - DNA, 16 bp, Homo sapiens
aacagagctagaggcc

SEQ ID NO: 5544850 - DNA, 12 bp, Homo sapiens
aacagaggacca

SEQ ID NO: 5544851 - DNA, 15 bp, Homo sapiens
aacagaggagaaagg

SEQ ID NO: 5544852 - DNA, 12 bp, Homo sapiens
aacagaggatat

SEQ ID NO: 5544853 - DNA, 17 bp, Homo sapiens
aacagaggccatggcag

SEQ ID NO: 5544854 - DNA, 20 bp, Homo sapiens
aacagagggaccaaattgct

SEQ ID NO: 5544855 - DNA, 22 bp, Homo sapiens
aacagagggaggaatgtgtgcc

SEQ ID NO: 5544856 - DNA, 18 bp, Homo sapiens
aacagagggccagagcta

SEQ ID NO: 5544857 - DNA, 21 bp, Homo sapiens
aacagagggccagagctaggg

SEQ ID NO: 5544858 - DNA, 15 bp, Homo sapiens
aacagaggtaaaaaa

SEQ ID NO: 5544859 - DNA, 20 bp, Homo sapiens
aacagaggtaaaaaaaagaa

SEQ ID NO: 5544860 - DNA, 20 bp, Homo sapiens
aacagagtagttttggtttt

SEQ ID NO: 5544861 - DNA, 14 bp, Homo sapiens
aacagagtatatat

SEQ ID NO: 5544862 - DNA, 15 bp, Homo sapiens
aacagagtatatatg

SEQ ID NO: 5544863 - DNA, 17 bp, Homo sapiens
aacagagtatatatgta

SEQ ID NO: 5544864 - DNA, 18 bp, Homo sapiens
aacagagtggattgggct

SEQ ID NO: 5544865 - DNA, 21 bp, Homo sapiens
aacagagtggcctccctgctg

SEQ ID NO: 5544866 - DNA, 15 bp, Homo sapiens
aacagagttatagaa

SEQ ID NO: 5544867 - DNA, 13 bp, Homo sapiens
aacagataaagtt

SEQ ID NO: 5544868 - DNA, 17 bp, Homo sapiens
aacagatatcagtgtct

SEQ ID NO: 5544869 - DNA, 16 bp, Homo sapiens
aacagatatcttcagt

SEQ ID NO: 5544870 - DNA, 19 bp, Homo sapiens
aacagatatcttcagttta

SEQ ID NO: 5544871 - DNA, 21 bp, Homo sapiens
aacagatatcttcagtttaat

SEQ ID NO: 5544872 - DNA, 21 bp, Homo sapiens
aacagatcacatgcccctctt

SEQ ID NO: 5544873 - DNA, 14 bp, Homo sapiens
aacagatcagtaaa

SEQ ID NO: 5544874 - DNA, 17 bp, Homo sapiens
aacagatcctttcaaaa

SEQ ID NO: 5544875 - DNA, 21 bp, Homo sapiens
aacagatctggaacctcagcc

SEQ ID NO: 5544876 - DNA, 16 bp, Homo sapiens
aacagatcttgttctt

SEQ ID NO: 5544877 - DNA, 18 bp, Homo sapiens
aacagatgacccctgccc

SEQ ID NO: 5544878 - DNA, 21 bp, Homo sapiens
aacagatgagaagactagcag

SEQ ID NO: 5544879 - DNA, 21 bp, Homo sapiens
aacagatgagcgaaaatgtat

SEQ ID NO: 5544880 - DNA, 17 bp, Homo sapiens
aacagatgctctgagag

SEQ ID NO: 5544881 - DNA, 16 bp, Homo sapiens
aacagatggctgtgaa

SEQ ID NO: 5544882 - DNA, 21 bp, Homo sapiens
aacagatggggtctgtgactg

SEQ ID NO: 5544883 - DNA, 23 bp, Homo sapiens
aacagatggggtctgtgactgga

SEQ ID NO: 5544884 - DNA, 16 bp, Homo sapiens
aacagatgtttgtttt

SEQ ID NO: 5544885 - DNA, 22 bp, Homo sapiens
aacagattattttggaaagttt

SEQ ID NO: 5544886 - DNA, 14 bp, Homo sapiens
aacagattcaaagc

SEQ ID NO: 5544887 - DNA, 20 bp, Homo sapiens
aacagattcagaatgagaat

SEQ ID NO: 5544888 - DNA, 21 bp, Homo sapiens
aacagattcaggccagcccag

SEQ ID NO: 5544889 - DNA, 14 bp, Homo sapiens
aacagattctttta

SEQ ID NO: 5544890 - DNA, 17 bp, Homo sapiens
aacagattcttttatgt

SEQ ID NO: 5544891 - DNA, 16 bp, Homo sapiens
aacagattggatttta

SEQ ID NO: 5544892 - DNA, 18 bp, Homo sapiens
aacagattggattttatg

SEQ ID NO: 5544893 - DNA, 21 bp, Homo sapiens
aacagatttaagcaagaccat

SEQ ID NO: 5544894 - DNA, 14 bp, Homo sapiens
aacagatttctaag

SEQ ID NO: 5544895 - DNA, 13 bp, Homo sapiens
aacagatttggaa

SEQ ID NO: 5544896 - DNA, 13 bp, Homo sapiens
aacagatttgtga

SEQ ID NO: 5544897 - DNA, 23 bp, Homo sapiens
aacagatttgtgaactcagccaa

SEQ ID NO: 5544898 - DNA, 16 bp, Homo sapiens
aacagatttgttcatt

SEQ ID NO: 5544899 - DNA, 13 bp, Homo sapiens
aacagattttatt

SEQ ID NO: 5544900 - DNA, 14 bp, Homo sapiens
aacagatttttaca

SEQ ID NO: 5544901 - DNA, 17 bp, Homo sapiens
aacagcaacaacaacag

SEQ ID NO: 5544902 - DNA, 18 bp, Homo sapiens
aacagcaacacaaagctt

SEQ ID NO: 5544903 - DNA, 13 bp, Homo sapiens
aacagcaaggaaa

SEQ ID NO: 5544904 - DNA, 17 bp, Homo sapiens
aacagcaagtgtttgtg

SEQ ID NO: 5544905 - DNA, 17 bp, Homo sapiens
aacagcaattttcataa

SEQ ID NO: 5544906 - DNA, 13 bp, Homo sapiens
aacagcacacagg

SEQ ID NO: 5544907 - DNA, 20 bp, Homo sapiens
aacagcacacctgtgtccaa

SEQ ID NO: 5544908 - DNA, 20 bp, Homo sapiens
aacagcaccaaatcaaaatc

SEQ ID NO: 5544909 - DNA, 23 bp, Homo sapiens
aacagcaccaccatttaatttca

SEQ ID NO: 5544910 - DNA, 18 bp, Homo sapiens
aacagcactggctctctc

SEQ ID NO: 5544911 - DNA, 20 bp, Homo sapiens
aacagcagactcagctctga

SEQ ID NO: 5544912 - DNA, 16 bp, Homo sapiens
aacagcagaggttctt

SEQ ID NO: 5544913 - DNA, 23 bp, Homo sapiens
aacagcagagtaaaattacagaa

SEQ ID NO: 5544914 - DNA, 13 bp, Homo sapiens
aacagcagctcat

SEQ ID NO: 5544915 - DNA, 14 bp, Homo sapiens
aacagcagctcata

SEQ ID NO: 5544916 - DNA, 22 bp, Homo sapiens
aacagcaggggcattagtttca

SEQ ID NO: 5544917 - DNA, 21 bp, Homo sapiens
aacagcagggtacctgaaaga

SEQ ID NO: 5544918 - DNA, 21 bp, Homo sapiens
aacagcagggtagtctggttt

SEQ ID NO: 5544919 - DNA, 20 bp, Homo sapiens
aacagcagggtttgagcaca

SEQ ID NO: 5544920 - DNA, 15 bp, Homo sapiens
aacagcaggtgtgac

SEQ ID NO: 5544921 - DNA, 15 bp, Homo sapiens
aacagcaggttgtgt

SEQ ID NO: 5544922 - DNA, 23 bp, Homo sapiens
aacagcagtctccttcagcacgg

SEQ ID NO: 5544923 - DNA, 12 bp, Homo sapiens
aacagcagtgat

SEQ ID NO: 5544924 - DNA, 23 bp, Homo sapiens
aacagcagtgatctcagggcaga

SEQ ID NO: 5544925 - DNA, 24 bp, Homo sapiens
aacagcagtgttctcacagtgtgg

SEQ ID NO: 5544926 - DNA, 15 bp, Homo sapiens
aacagcagtttgtga

SEQ ID NO: 5544927 - DNA, 10 bp, Homo sapiens
aacagcatct

SEQ ID NO: 5544928 - DNA, 19 bp, Homo sapiens
aacagcatctccaagcagc

SEQ ID NO: 5544929 - DNA, 22 bp, Homo sapiens
aacagcatgaataaaacactca

SEQ ID NO: 5544930 - DNA, 15 bp, Homo sapiens
aacagcatgacaaaa

SEQ ID NO: 5544931 - DNA, 23 bp, Homo sapiens
aacagcatgacaaaaattatttt

SEQ ID NO: 5544932 - DNA, 17 bp, Homo sapiens
aacagcatgctgctttg

SEQ ID NO: 5544933 - DNA, 19 bp, Homo sapiens
aacagcatgctgctttgcc

SEQ ID NO: 5544934 - DNA, 14 bp, Homo sapiens
aacagcatggcccg

SEQ ID NO: 5544935 - DNA, 14 bp, Homo sapiens
aacagcattgcttt

SEQ ID NO: 5544936 - DNA, 18 bp, Homo sapiens
aacagcattggcctggcc

SEQ ID NO: 5544937 - DNA, 16 bp, Homo sapiens
aacagccaaagaaact

SEQ ID NO: 5544938 - DNA, 18 bp, Homo sapiens
aacagccaagacccaaca

SEQ ID NO: 5544939 - DNA, 23 bp, Homo sapiens
aacagccaagtgtgaccccactg

SEQ ID NO: 5544940 - DNA, 19 bp, Homo sapiens
aacagccattgcggcccca

SEQ ID NO: 5544941 - DNA, 23 bp, Homo sapiens
aacagccattgcggccccaggag

SEQ ID NO: 5544942 - DNA, 13 bp, Homo sapiens
aacagcccaggca

SEQ ID NO: 5544943 - DNA, 15 bp, Homo sapiens
aacagccccggggcc

SEQ ID NO: 5544944 - DNA, 17 bp, Homo sapiens
aacagccctcctctgca

SEQ ID NO: 5544945 - DNA, 14 bp, Homo sapiens
aacagccctctctc

SEQ ID NO: 5544946 - DNA, 19 bp, Homo sapiens
aacagccctctctctcact

SEQ ID NO: 5544947 - DNA, 22 bp, Homo sapiens
aacagccgagtggatagatgcc

SEQ ID NO: 5544948 - DNA, 17 bp, Homo sapiens
aacagcctattcctgaa

SEQ ID NO: 5544949 - DNA, 13 bp, Homo sapiens
aacagcctcacag

SEQ ID NO: 5544950 - DNA, 16 bp, Homo sapiens
aacagcctctttttga

SEQ ID NO: 5544951 - DNA, 14 bp, Homo sapiens
aacagcctgagaaa

SEQ ID NO: 5544952 - DNA, 15 bp, Homo sapiens
aacagcctgagaaat

SEQ ID NO: 5544953 - DNA, 19 bp, Homo sapiens
aacagcctgggtaggaaaa

SEQ ID NO: 5544954 - DNA, 20 bp, Homo sapiens
aacagcctgggtaggaaaat

SEQ ID NO: 5544955 - DNA, 23 bp, Homo sapiens
aacagcctgtttgggaggctgga

SEQ ID NO: 5544956 - DNA, 17 bp, Homo sapiens
aacagccttagagctct

SEQ ID NO: 5544957 - DNA, 20 bp, Homo sapiens
aacagccttagagctcttgt

SEQ ID NO: 5544958 - DNA, 12 bp, Homo sapiens
aacagccttagc

SEQ ID NO: 5544959 - DNA, 17 bp, Homo sapiens
aacagccttagctgcca

SEQ ID NO: 5544960 - DNA, 21 bp, Homo sapiens
aacatcataattacattccta

SEQ ID NO: 5544961 - DNA, 16 bp, Homo sapiens
aacatcatatacctct

SEQ ID NO: 5544962 - DNA, 18 bp, Homo sapiens
aacatcatatacctcttg

SEQ ID NO: 5544963 - DNA, 21 bp, Homo sapiens
aacatcatcaaggcactgcct

SEQ ID NO: 5544964 - DNA, 23 bp, Homo sapiens
aacatcatcaggcttggaatgaa

SEQ ID NO: 5544965 - DNA, 19 bp, Homo sapiens
aacatcattactataagaa

SEQ ID NO: 5544966 - DNA, 13 bp, Homo sapiens
aacatcattcctt

SEQ ID NO: 5544967 - DNA, 17 bp, Homo sapiens
aacatcattccttttta

SEQ ID NO: 5544968 - DNA, 13 bp, Homo sapiens
aacatcatttcaa

SEQ ID NO: 5544969 - DNA, 15 bp, Homo sapiens
aacatcatttcaatc

SEQ ID NO: 5544970 - DNA, 21 bp, Homo sapiens
aacatcattttactcttatga

SEQ ID NO: 5544971 - DNA, 15 bp, Homo sapiens
aacatccaaaatctt

SEQ ID NO: 5544972 - DNA, 16 bp, Homo sapiens
aacatccaagtggcct

SEQ ID NO: 5544973 - DNA, 24 bp, Homo sapiens
aacatccaagtggcctccgtcact

SEQ ID NO: 5544974 - DNA, 22 bp, Homo sapiens
aacatccaataggaatgctaac

SEQ ID NO: 5544975 - DNA, 15 bp, Homo sapiens
aacatccaatatttt

SEQ ID NO: 5544976 - DNA, 15 bp, Homo sapiens
aacatccactctctc

SEQ ID NO: 5544977 - DNA, 18 bp, Homo sapiens
aacatccacttaagttct

SEQ ID NO: 5544978 - DNA, 11 bp, Homo sapiens
aacatccagaa

SEQ ID NO: 5544979 - DNA, 12 bp, Homo sapiens
aacatccagaag

SEQ ID NO: 5544980 - DNA, 14 bp, Homo sapiens
aacatcccaaactt

SEQ ID NO: 5544981 - DNA, 16 bp, Homo sapiens
aacatcccaaacttta

SEQ ID NO: 5544982 - DNA, 23 bp, Homo sapiens
aacatcccaaactttaaaatgcg

SEQ ID NO: 5544983 - DNA, 19 bp, Homo sapiens
aacatcccaataaagtcct

SEQ ID NO: 5544984 - DNA, 19 bp, Homo sapiens
aacatcccattgccctggt

SEQ ID NO: 5544985 - DNA, 19 bp, Homo sapiens
aacatccctgtcttaactg

SEQ ID NO: 5544986 - DNA, 20 bp, Homo sapiens
aacatccggaacagccaaag

SEQ ID NO: 5544987 - DNA, 22 bp, Homo sapiens
aacatcctatcaacaacaaggt

SEQ ID NO: 5544988 - DNA, 16 bp, Homo sapiens
aacatcctgaaaattc

SEQ ID NO: 5544989 - DNA, 12 bp, Homo sapiens
aacatcctgcca

SEQ ID NO: 5544990 - DNA, 14 bp, Homo sapiens
aacatcctgccagc

SEQ ID NO: 5544991 - DNA, 13 bp, Homo sapiens
aacatcctgctgc

SEQ ID NO: 5544992 - DNA, 19 bp, Homo sapiens
aacatccttcaagaactct

SEQ ID NO: 5544993 - DNA, 21 bp, Homo sapiens
aacatcctttgcagggcagcc

SEQ ID NO: 5544994 - DNA, 22 bp, Homo sapiens
aacatcgaaaagttattttgta

SEQ ID NO: 5544995 - DNA, 14 bp, Homo sapiens
aacatcgatatgta

SEQ ID NO: 5544996 - DNA, 15 bp, Homo sapiens
aacatcgcacagttt

SEQ ID NO: 5544997 - DNA, 17 bp, Homo sapiens
aacatcgcacagtttac

SEQ ID NO: 5544998 - DNA, 18 bp, Homo sapiens
aacatcgtggatgtagtg

SEQ ID NO: 5544999 - DNA, 12 bp, Homo sapiens
aacatctagaaa

SEQ ID NO: 5545000 - DNA, 14 bp, Homo sapiens
aacatctagcagta

SEQ ID NO: 5545001 - DNA, 21 bp, Homo sapiens
aacatctagcagtaaatactt

SEQ ID NO: 5545002 - DNA, 21 bp, Homo sapiens
aacatctattataaaaccatg

SEQ ID NO: 5545003 - DNA, 22 bp, Homo sapiens
aacatctattataaaaccatgt

SEQ ID NO: 5545004 - DNA, 23 bp, Homo sapiens
aacatctccatggggaggcctca

SEQ ID NO: 5545005 - DNA, 21 bp, Homo sapiens
aacatctcgagccccctggat

SEQ ID NO: 5545006 - DNA, 14 bp, Homo sapiens
aacatctctgcagt

SEQ ID NO: 5545007 - DNA, 23 bp, Homo sapiens
aacatctctgcagtttttcccaa

SEQ ID NO: 5545008 - DNA, 12 bp, Homo sapiens
aacatctctggc

SEQ ID NO: 5545009 - DNA, 15 bp, Homo sapiens
aacatctcttgaaac

SEQ ID NO: 5545010 - DNA, 14 bp, Homo sapiens
aacatctctttctc

SEQ ID NO: 5545011 - DNA, 16 bp, Homo sapiens
aacatctgaaaagaaa

SEQ ID NO: 5545012 - DNA, 12 bp, Homo sapiens
aacatctgattt

SEQ ID NO: 5545013 - DNA, 14 bp, Homo sapiens
aacatctgatttct

SEQ ID NO: 5545014 - DNA, 15 bp, Homo sapiens
aacatctgccattta

SEQ ID NO: 5545015 - DNA, 13 bp, Homo sapiens
aacatctggatat

SEQ ID NO: 5545016 - DNA, 22 bp, Homo sapiens
aacatctgtcctgtgaaagact

SEQ ID NO: 5545017 - DNA, 11 bp, Homo sapiens
aacatctgtgt

SEQ ID NO: 5545018 - DNA, 17 bp, Homo sapiens
aacatctgtgtctgtgt

SEQ ID NO: 5545019 - DNA, 20 bp, Homo sapiens
aacatcttacttgtcctttg

SEQ ID NO: 5545020 - DNA, 17 bp, Homo sapiens
aacatcttaggcacttt

SEQ ID NO: 5545021 - DNA, 20 bp, Homo sapiens
aacatcttaggcacttttta

SEQ ID NO: 5545022 - DNA, 22 bp, Homo sapiens
aacatcttaggcactttttaac

SEQ ID NO: 5545023 - DNA, 12 bp, Homo sapiens
aacatcttcata

SEQ ID NO: 5545024 - DNA, 15 bp, Homo sapiens
aacatcttcatataa

SEQ ID NO: 5545025 - DNA, 18 bp, Homo sapiens
aacatctttaaggggagg

SEQ ID NO: 5545026 - DNA, 21 bp, Homo sapiens
aacatctttacgtactgtaac

SEQ ID NO: 5545027 - DNA, 22 bp, Homo sapiens
aacatctttacgtactgtaact

SEQ ID NO: 5545028 - DNA, 19 bp, Homo sapiens
aacatctttattgaaattc

SEQ ID NO: 5545029 - DNA, 18 bp, Homo sapiens
aacatctttccagtcctt

SEQ ID NO: 5545030 - DNA, 16 bp, Homo sapiens
aacatctttgaaaaga

SEQ ID NO: 5545031 - DNA, 19 bp, Homo sapiens
aacatctttgcgaaaagat

SEQ ID NO: 5545032 - DNA, 11 bp, Homo sapiens
aacatctttgt

SEQ ID NO: 5545033 - DNA, 21 bp, Homo sapiens
aacatgaaaaacacggcagct

SEQ ID NO: 5545034 - DNA, 21 bp, Homo sapiens
aacatgaaaacattgatgaat

SEQ ID NO: 5545035 - DNA, 22 bp, Homo sapiens
aacatgaaacaactcatgtctt

SEQ ID NO: 5545036 - DNA, 13 bp, Homo sapiens
aacatgaaacacc

SEQ ID NO: 5545037 - DNA, 16 bp, Homo sapiens
aacatgaaactgccta

SEQ ID NO: 5545038 - DNA, 19 bp, Homo sapiens
aacatgaaagctgatgcca

SEQ ID NO: 5545039 - DNA, 14 bp, Homo sapiens
aacatgaaatatat

SEQ ID NO: 5545040 - DNA, 12 bp, Homo sapiens
aacatgaaatga

SEQ ID NO: 5545041 - DNA, 23 bp, Homo sapiens
aacatgaagacctttttctgcac

SEQ ID NO: 5545042 - DNA, 20 bp, Homo sapiens
aacatgaaggatcaaaaaat

SEQ ID NO: 5545043 - DNA, 14 bp, Homo sapiens
aacatgaattaaga

SEQ ID NO: 5545044 - DNA, 15 bp, Homo sapiens
aacatgaatttaatg

SEQ ID NO: 5545045 - DNA, 20 bp, Homo sapiens
aacatgaatttaatgtctag

SEQ ID NO: 5545046 - DNA, 20 bp, Homo sapiens
aacatgaatttttatgattt

SEQ ID NO: 5545047 - DNA, 14 bp, Homo sapiens
aacatgaccaaaaa

SEQ ID NO: 5545048 - DNA, 16 bp, Homo sapiens
aacatgaccctgggct

SEQ ID NO: 5545049 - DNA, 20 bp, Homo sapiens
aacatgactccatagacctt

SEQ ID NO: 5545050 - DNA, 16 bp, Homo sapiens
aacatgagaaatgtga

SEQ ID NO: 5545051 - DNA, 18 bp, Homo sapiens
aacatgagactgtaaaac

SEQ ID NO: 5545052 - DNA, 21 bp, Homo sapiens
aacatgaggacagaaggactg

SEQ ID NO: 5545053 - DNA, 18 bp, Homo sapiens
aacatgaggccactggag

SEQ ID NO: 5545054 - DNA, 17 bp, Homo sapiens
aacatgagtcaagagca

SEQ ID NO: 5545055 - DNA, 12 bp, Homo sapiens
aacatgagtgtc

SEQ ID NO: 5545056 - DNA, 20 bp, Homo sapiens
aacatgagttattcataaag

SEQ ID NO: 5545057 - DNA, 19 bp, Homo sapiens
aacatgatagttaaactac

SEQ ID NO: 5545058 - DNA, 21 bp, Homo sapiens
aacatgatgaggtagtacctt

SEQ ID NO: 5545059 - DNA, 14 bp, Homo sapiens
aacatgatgtacta

SEQ ID NO: 5545060 - DNA, 22 bp, Homo sapiens
aacatgattttacaagtataac

SEQ ID NO: 5545061 - DNA, 19 bp, Homo sapiens
aacatgcaacaaaaatgtg

SEQ ID NO: 5545062 - DNA, 14 bp, Homo sapiens
aacatgcaagaatt

SEQ ID NO: 5545063 - DNA, 18 bp, Homo sapiens
aacatgcaattggggaag

SEQ ID NO: 5545064 - DNA, 20 bp, Homo sapiens
aacatgcaattggggaagaa

SEQ ID NO: 5545065 - DNA, 21 bp, Homo sapiens
aacatgcaattggggaagaaa

SEQ ID NO: 5545066 - DNA, 19 bp, Homo sapiens
aacatgcaattttgcattt

SEQ ID NO: 5545067 - DNA, 14 bp, Homo sapiens
aacatgcacattta

SEQ ID NO: 5545068 - DNA, 17 bp, Homo sapiens
aacatgcacattttgta

SEQ ID NO: 5545069 - DNA, 13 bp, Homo sapiens
aacatgcaccctg

SEQ ID NO: 5545070 - DNA, 14 bp, Homo sapiens
aacatgcactgatg

SEQ ID NO: 5545071 - DNA, 19 bp, Homo sapiens
aacatgcactgatgttgtg

SEQ ID NO: 5545072 - DNA, 19 bp, Homo sapiens
aacatgcagaacaaatgaa

SEQ ID NO: 5545073 - DNA, 20 bp, Homo sapiens
aacatgcagaacaaatgaag

SEQ ID NO: 5545074 - DNA, 12 bp, Homo sapiens
aacatgcagaag

SEQ ID NO: 5545075 - DNA, 13 bp, Homo sapiens
aacatgcagctct

SEQ ID NO: 5545076 - DNA, 14 bp, Homo sapiens
aacatgcagtactt

SEQ ID NO: 5545077 - DNA, 17 bp, Homo sapiens
aacatgcagtttgaaat

SEQ ID NO: 5545078 - DNA, 18 bp, Homo sapiens
aacatgcagtttgaaatt

SEQ ID NO: 5545079 - DNA, 21 bp, Homo sapiens
aacatgcagtttgaaattctg

SEQ ID NO: 5545080 - DNA, 22 bp, Homo sapiens
aacatgcataagaaatgtagct

SEQ ID NO: 5545081 - DNA, 14 bp, Homo sapiens
aacatgcatacttt

SEQ ID NO: 5545082 - DNA, 17 bp, Homo sapiens
aacatgcatactttatt

SEQ ID NO: 5545083 - DNA, 14 bp, Homo sapiens
aacatgccctgttc

SEQ ID NO: 5545084 - DNA, 12 bp, Homo sapiens
aacatgcctcct

SEQ ID NO: 5545085 - DNA, 13 bp, Homo sapiens
aacatgcctcctc

SEQ ID NO: 5545086 - DNA, 19 bp, Homo sapiens
aacatgcctcctcctgccc

SEQ ID NO: 5545087 - DNA, 22 bp, Homo sapiens
aacatgcctcctcctgccctcc

SEQ ID NO: 5545088 - DNA, 15 bp, Homo sapiens
aacatgcctgccaaa

SEQ ID NO: 5545089 - DNA, 17 bp, Homo sapiens
aacatgctacctgatcc

SEQ ID NO: 5545090 - DNA, 14 bp, Homo sapiens
aacatgctgtgtaa

SEQ ID NO: 5545091 - DNA, 17 bp, Homo sapiens
aacatgctgtgtaagct

SEQ ID NO: 5545092 - DNA, 23 bp, Homo sapiens
aacatgcttatgacaatgactgt

SEQ ID NO: 5545093 - DNA, 16 bp, Homo sapiens
aacatgcttcatgaaa

SEQ ID NO: 5545094 - DNA, 14 bp, Homo sapiens
aacatggaagatat

SEQ ID NO: 5545095 - DNA, 19 bp, Homo sapiens
aacatggaagatattcctt

SEQ ID NO: 5545096 - DNA, 18 bp, Homo sapiens
aacatggaatttaattta

SEQ ID NO: 5545097 - DNA, 21 bp, Homo sapiens
aacatggaatttaatttatgt

SEQ ID NO: 5545098 - DNA, 22 bp, Homo sapiens
aacatggaatttaatttatgtg

SEQ ID NO: 5545099 - DNA, 18 bp, Homo sapiens
aacatggacttgtatatt

SEQ ID NO: 5545100 - DNA, 20 bp, Homo sapiens
aacatggagaaaccctgtct

SEQ ID NO: 5545101 - DNA, 16 bp, Homo sapiens
aacatggagctgtcat

SEQ ID NO: 5545102 - DNA, 17 bp, Homo sapiens
aacatggagctgtcatc

SEQ ID NO: 5545103 - DNA, 15 bp, Homo sapiens
aacatggcatgtgaa

SEQ ID NO: 5545104 - DNA, 22 bp, Homo sapiens
aacatggccaatagtcatatgt

SEQ ID NO: 5545105 - DNA, 23 bp, Homo sapiens
aacatggccacatccaacatttc

SEQ ID NO: 5545106 - DNA, 17 bp, Homo sapiens
aacatggccagactccc

SEQ ID NO: 5545107 - DNA, 18 bp, Homo sapiens
aacatggccagactccct

SEQ ID NO: 5545108 - DNA, 15 bp, Homo sapiens
aacatggctggcctg

SEQ ID NO: 5545109 - DNA, 17 bp, Homo sapiens
aacatggcttctccttt

SEQ ID NO: 5545110 - DNA, 22 bp, Homo sapiens
aacatggcttctcctttggcat

SEQ ID NO: 5545111 - DNA, 13 bp, Homo sapiens
aacatggctttga

SEQ ID NO: 5545112 - DNA, 12 bp, Homo sapiens
aacatgggaggg

SEQ ID NO: 5545113 - DNA, 16 bp, Homo sapiens
aacatgggagggatca

SEQ ID NO: 5545114 - DNA, 22 bp, Homo sapiens
aacatgggcattgggttctaaa

SEQ ID NO: 5545115 - DNA, 21 bp, Homo sapiens
aacatgggctcttcactagtg

SEQ ID NO: 5545116 - DNA, 15 bp, Homo sapiens
aacatgggctgtgat

SEQ ID NO: 5545117 - DNA, 19 bp, Homo sapiens
aacatgggctgtgattact

SEQ ID NO: 5545118 - DNA, 15 bp, Homo sapiens
aacatggggcccctc

SEQ ID NO: 5545119 - DNA, 15 bp, Homo sapiens
aacatgggtttcctt

SEQ ID NO: 5545120 - DNA, 14 bp, Homo sapiens
aacatggtgcctat

SEQ ID NO: 5545121 - DNA, 21 bp, Homo sapiens
aacatggtgcctatatctgag

SEQ ID NO: 5545122 - DNA, 17 bp, Homo sapiens
aacatggtgtgtgtctc

SEQ ID NO: 5545123 - DNA, 21 bp, Homo sapiens
aacatggttcaggtacacata

SEQ ID NO: 5545124 - DNA, 20 bp, Homo sapiens
aacatggttttgaaatgctt

SEQ ID NO: 5545125 - DNA, 13 bp, Homo sapiens
aacatgtaaaatc

SEQ ID NO: 5545126 - DNA, 24 bp, Homo sapiens
aacatgtaaaatgtttaatggtga

SEQ ID NO: 5545127 - DNA, 17 bp, Homo sapiens
aacatgtaaatacaaat

SEQ ID NO: 5545128 - DNA, 18 bp, Homo sapiens
aacatgtaatataaagat

SEQ ID NO: 5545129 - DNA, 16 bp, Homo sapiens
aacatgtacacaaagt

SEQ ID NO: 5545130 - DNA, 15 bp, Homo sapiens
aacatgtactgttct

SEQ ID NO: 5545131 - DNA, 17 bp, Homo sapiens
aacatgtatctgtctac

SEQ ID NO: 5545132 - DNA, 12 bp, Homo sapiens
aacatgtatgtg

SEQ ID NO: 5545133 - DNA, 16 bp, Homo sapiens
aacatgtatgtgcatt

SEQ ID NO: 5545134 - DNA, 19 bp, Homo sapiens
aacatgtcacaatacagta

SEQ ID NO: 5545135 - DNA, 15 bp, Homo sapiens
aacatgtccccttcc

SEQ ID NO: 5545136 - DNA, 20 bp, Homo sapiens
aacatgtcggagtagaaatt

SEQ ID NO: 5545137 - DNA, 13 bp, Homo sapiens
aacatgtctaaag

SEQ ID NO: 5545138 - DNA, 12 bp, Homo sapiens
aaccatagttac

SEQ ID NO: 5545139 - DNA, 23 bp, Homo sapiens
aaccatatgattgaaaagaagaa

SEQ ID NO: 5545140 - DNA, 14 bp, Homo sapiens
aaccatatttagca

SEQ ID NO: 5545141 - DNA, 22 bp, Homo sapiens
aaccatattttattgtattttg

SEQ ID NO: 5545142 - DNA, 17 bp, Homo sapiens
aaccatcagaattcaga

SEQ ID NO: 5545143 - DNA, 18 bp, Homo sapiens
aaccatcagatatttctt

SEQ ID NO: 5545144 - DNA, 17 bp, Homo sapiens
aaccatcagttactggt

SEQ ID NO: 5545145 - DNA, 16 bp, Homo sapiens
aaccatcattataaac

SEQ ID NO: 5545146 - DNA, 17 bp, Homo sapiens
aaccatcattgaaatct

SEQ ID NO: 5545147 - DNA, 18 bp, Homo sapiens
aaccatcattgaaatctt

SEQ ID NO: 5545148 - DNA, 20 bp, Homo sapiens
aaccatccagtgacaaacca

SEQ ID NO: 5545149 - DNA, 20 bp, Homo sapiens
aaccatccatctgtggaaat

SEQ ID NO: 5545150 - DNA, 15 bp, Homo sapiens
aaccatcctctccct

SEQ ID NO: 5545151 - DNA, 15 bp, Homo sapiens
aaccatcctgtttga

SEQ ID NO: 5545152 - DNA, 16 bp, Homo sapiens
aaccatcctgtttgaa

SEQ ID NO: 5545153 - DNA, 12 bp, Homo sapiens
aaccatctccct

SEQ ID NO: 5545154 - DNA, 15 bp, Homo sapiens
aaccatctctgtgat

SEQ ID NO: 5545155 - DNA, 15 bp, Homo sapiens
aaccatctggtgcct

SEQ ID NO: 5545156 - DNA, 14 bp, Homo sapiens
aaccatgaaaagtt

SEQ ID NO: 5545157 - DNA, 14 bp, Homo sapiens
aaccatgaactcag

SEQ ID NO: 5545158 - DNA, 15 bp, Homo sapiens
aaccatgaagacagg

SEQ ID NO: 5545159 - DNA, 23 bp, Homo sapiens
aaccatgaagagatttttcatga

SEQ ID NO: 5545160 - DNA, 23 bp, Homo sapiens
aaccatgaatgaacccctggctc

SEQ ID NO: 5545161 - DNA, 12 bp, Homo sapiens
aaccatgactgt

SEQ ID NO: 5545162 - DNA, 18 bp, Homo sapiens
aaccatgaggtaaaagag

SEQ ID NO: 5545163 - DNA, 19 bp, Homo sapiens
aaccatgcaaatgctatga

SEQ ID NO: 5545164 - DNA, 20 bp, Homo sapiens
aaccatgcagaggaatatta

SEQ ID NO: 5545165 - DNA, 16 bp, Homo sapiens
aaccatgcagcttcat

SEQ ID NO: 5545166 - DNA, 21 bp, Homo sapiens
aaccatgcagcttcatcaatt

SEQ ID NO: 5545167 - DNA, 16 bp, Homo sapiens
aaccatgcaggaagga

SEQ ID NO: 5545168 - DNA, 19 bp, Homo sapiens
aaccatggacctgcacttg

SEQ ID NO: 5545169 - DNA, 13 bp, Homo sapiens
aaccatggacttt

SEQ ID NO: 5545170 - DNA, 15 bp, Homo sapiens
aaccatggactttat

SEQ ID NO: 5545171 - DNA, 16 bp, Homo sapiens
aaccatggactttata

SEQ ID NO: 5545172 - DNA, 11 bp, Homo sapiens
aaccatggcac

SEQ ID NO: 5545173 - DNA, 22 bp, Homo sapiens
aaccatggctgaaggaaaccag

SEQ ID NO: 5545174 - DNA, 18 bp, Homo sapiens
aaccatgggataaatgcc

SEQ ID NO: 5545175 - DNA, 20 bp, Homo sapiens
aaccatgggctcagggccag

SEQ ID NO: 5545176 - DNA, 21 bp, Homo sapiens
aaccatgggctcagggccagg

SEQ ID NO: 5545177 - DNA, 20 bp, Homo sapiens
aaccatgtagttttaacaga

SEQ ID NO: 5545178 - DNA, 21 bp, Homo sapiens
aaccatgtagttttaacagaa

SEQ ID NO: 5545179 - DNA, 22 bp, Homo sapiens
aaccatgttcttgagcagctga

SEQ ID NO: 5545180 - DNA, 23 bp, Homo sapiens
aaccattaaaactgaagtctgaa

SEQ ID NO: 5545181 - DNA, 13 bp, Homo sapiens
aaccattaagaaa

SEQ ID NO: 5545182 - DNA, 23 bp, Homo sapiens
aaccattaagtcatgtgtgaaca

SEQ ID NO: 5545183 - DNA, 15 bp, Homo sapiens
aaccattacatgttt

SEQ ID NO: 5545184 - DNA, 16 bp, Homo sapiens
aaccattaccttaaaa

SEQ ID NO: 5545185 - DNA, 18 bp, Homo sapiens
aaccattaccttaaaatt

SEQ ID NO: 5545186 - DNA, 14 bp, Homo sapiens
aaccattatacctt

SEQ ID NO: 5545187 - DNA, 13 bp, Homo sapiens
aaccattatactt

SEQ ID NO: 5545188 - DNA, 17 bp, Homo sapiens
aaccattatactttata

SEQ ID NO: 5545189 - DNA, 22 bp, Homo sapiens
aaccattatttaataagagtaa

SEQ ID NO: 5545190 - DNA, 19 bp, Homo sapiens
aaccattcaaaaatttcac

SEQ ID NO: 5545191 - DNA, 23 bp, Homo sapiens
aaccattccatttccaagcactt

SEQ ID NO: 5545192 - DNA, 23 bp, Homo sapiens
aaccattgatgagcactcctgat

SEQ ID NO: 5545193 - DNA, 15 bp, Homo sapiens
aaccattgcttcact

SEQ ID NO: 5545194 - DNA, 23 bp, Homo sapiens
aaccattgcttcactacccatcg

SEQ ID NO: 5545195 - DNA, 14 bp, Homo sapiens
aaccattggacaga

SEQ ID NO: 5545196 - DNA, 19 bp, Homo sapiens
aaccattggacagatttca

SEQ ID NO: 5545197 - DNA, 21 bp, Homo sapiens
aaccattgtaactattaacct

SEQ ID NO: 5545198 - DNA, 14 bp, Homo sapiens
aaccattgtcttgt

SEQ ID NO: 5545199 - DNA, 18 bp, Homo sapiens
aaccattgtcttgttctg

SEQ ID NO: 5545200 - DNA, 17 bp, Homo sapiens
aaccattgttcagaaga

SEQ ID NO: 5545201 - DNA, 14 bp, Homo sapiens
aaccattgttctga

SEQ ID NO: 5545202 - DNA, 23 bp, Homo sapiens
aaccattgttctgacacgacttc

SEQ ID NO: 5545203 - DNA, 17 bp, Homo sapiens
aaccatttaaagaaaga

SEQ ID NO: 5545204 - DNA, 21 bp, Homo sapiens
aaccatttaataaagaaatat

SEQ ID NO: 5545205 - DNA, 14 bp, Homo sapiens
aaccatttaattca

SEQ ID NO: 5545206 - DNA, 19 bp, Homo sapiens
aaccatttaattcataatt

SEQ ID NO: 5545207 - DNA, 14 bp, Homo sapiens
aaccatttctagag

SEQ ID NO: 5545208 - DNA, 22 bp, Homo sapiens
aaccatttctcactagtgtcag

SEQ ID NO: 5545209 - DNA, 19 bp, Homo sapiens
aaccatttgaaacccctgt

SEQ ID NO: 5545210 - DNA, 23 bp, Homo sapiens
aaccatttgaagtgtacctgtgt

SEQ ID NO: 5545211 - DNA, 22 bp, Homo sapiens
aaccattttataaagtgcttgt

SEQ ID NO: 5545212 - DNA, 15 bp, Homo sapiens
aaccattttattttt

SEQ ID NO: 5545213 - DNA, 13 bp, Homo sapiens
aaccattttcctt

SEQ ID NO: 5545214 - DNA, 23 bp, Homo sapiens
aaccattttgctgtcccttttcc

SEQ ID NO: 5545215 - DNA, 21 bp, Homo sapiens
aaccatttttagaaggaaaaa

SEQ ID NO: 5545216 - DNA, 15 bp, Homo sapiens
aaccatttttgaacc

SEQ ID NO: 5545217 - DNA, 22 bp, Homo sapiens
aaccatttttgctgaattcatc

SEQ ID NO: 5545218 - DNA, 14 bp, Homo sapiens
aacccaaaacctca

SEQ ID NO: 5545219 - DNA, 13 bp, Homo sapiens
aacccaaaccatg

SEQ ID NO: 5545220 - DNA, 14 bp, Homo sapiens
aacccaaactctcc

SEQ ID NO: 5545221 - DNA, 12 bp, Homo sapiens
aacccaaacttc

SEQ ID NO: 5545222 - DNA, 21 bp, Homo sapiens
aacccaaagagacagctcttc

SEQ ID NO: 5545223 - DNA, 11 bp, Homo sapiens
aacccaaagat

SEQ ID NO: 5545224 - DNA, 14 bp, Homo sapiens
aacccaaaggaccc

SEQ ID NO: 5545225 - DNA, 17 bp, Homo sapiens
aacccaaaggacccaag

SEQ ID NO: 5545226 - DNA, 20 bp, Homo sapiens
aacccaaatatatcaaaacg

SEQ ID NO: 5545227 - DNA, 13 bp, Homo sapiens
aacccaaatgttc

SEQ ID NO: 5545228 - DNA, 18 bp, Homo sapiens
aacccaaatgttcatcaa

SEQ ID NO: 5545229 - DNA, 11 bp, Homo sapiens
aacccaacagt

SEQ ID NO: 5545230 - DNA, 19 bp, Homo sapiens
aacccaagcaacatttgta

SEQ ID NO: 5545231 - DNA, 16 bp, Homo sapiens
aacccaagctcctcct

SEQ ID NO: 5545232 - DNA, 16 bp, Homo sapiens
aacccaagcttagaac

SEQ ID NO: 5545233 - DNA, 18 bp, Homo sapiens
aacccaaggactgaggga

SEQ ID NO: 5545234 - DNA, 21 bp, Homo sapiens
aacccaaggagcacaggtccc

SEQ ID NO: 5545235 - DNA, 22 bp, Homo sapiens
aacccaaggtgggtagatcacg

SEQ ID NO: 5545236 - DNA, 14 bp, Homo sapiens
aacccaagtgcctc

SEQ ID NO: 5545237 - DNA, 17 bp, Homo sapiens
aacccaagtggaatcat

SEQ ID NO: 5545238 - DNA, 13 bp, Homo sapiens
aacccaatagttg

SEQ ID NO: 5545239 - DNA, 14 bp, Homo sapiens
aacccaatccaaat

SEQ ID NO: 5545240 - DNA, 17 bp, Homo sapiens
aacccaatccctctcca

SEQ ID NO: 5545241 - DNA, 19 bp, Homo sapiens
aacccaatctgcacactcc

SEQ ID NO: 5545242 - DNA, 18 bp, Homo sapiens
aacccacaagctgcctct

SEQ ID NO: 5545243 - DNA, 14 bp, Homo sapiens
aacccacaattgaa

SEQ ID NO: 5545244 - DNA, 21 bp, Homo sapiens
aacccacagatgtctctgggg

SEQ ID NO: 5545245 - DNA, 16 bp, Homo sapiens
aacccacagttttagt

SEQ ID NO: 5545246 - DNA, 15 bp, Homo sapiens
aacccacataaacac

SEQ ID NO: 5545247 - DNA, 22 bp, Homo sapiens
aacccacatggggttcctggtt

SEQ ID NO: 5545248 - DNA, 20 bp, Homo sapiens
aacccacctctcctgccctg

SEQ ID NO: 5545249 - DNA, 21 bp, Homo sapiens
aacccacctctggccctgtgt

SEQ ID NO: 5545250 - DNA, 16 bp, Homo sapiens
aacccactcatgactg

SEQ ID NO: 5545251 - DNA, 20 bp, Homo sapiens
aacccactgctgaaaaagaa

SEQ ID NO: 5545252 - DNA, 21 bp, Homo sapiens
aacccactgtgcttacagtga

SEQ ID NO: 5545253 - DNA, 23 bp, Homo sapiens
aacccactgtgcttacagtgact

SEQ ID NO: 5545254 - DNA, 16 bp, Homo sapiens
aacccacttctggcct

SEQ ID NO: 5545255 - DNA, 21 bp, Homo sapiens
aacccacttgtcactgacaca

SEQ ID NO: 5545256 - DNA, 19 bp, Homo sapiens
aacccactttaaaatatct

SEQ ID NO: 5545257 - DNA, 23 bp, Homo sapiens
aacccagacctgttagcagacag

SEQ ID NO: 5545258 - DNA, 12 bp, Homo sapiens
aacccagactca

SEQ ID NO: 5545259 - DNA, 22 bp, Homo sapiens
aacccagaggtggatgttatga

SEQ ID NO: 5545260 - DNA, 17 bp, Homo sapiens
aacccagagtcaggaag

SEQ ID NO: 5545261 - DNA, 14 bp, Homo sapiens
aacccagattttat

SEQ ID NO: 5545262 - DNA, 21 bp, Homo sapiens
aacccagattttgctgtatat

SEQ ID NO: 5545263 - DNA, 14 bp, Homo sapiens
aacccagcaaaaca

SEQ ID NO: 5545264 - DNA, 16 bp, Homo sapiens
aacccagcaacagaaa

SEQ ID NO: 5545265 - DNA, 23 bp, Homo sapiens
aacccagcaacagaaaaatggag

SEQ ID NO: 5545266 - DNA, 16 bp, Homo sapiens
aacccagcatgtacaa

SEQ ID NO: 5545267 - DNA, 21 bp, Homo sapiens
aacccagcggcttagccaagc

SEQ ID NO: 5545268 - DNA, 24 bp, Homo sapiens
aacccagcgttcttcaggagatga

SEQ ID NO: 5545269 - DNA, 17 bp, Homo sapiens
aacccagctctggtcca

SEQ ID NO: 5545270 - DNA, 16 bp, Homo sapiens
aacccaggacatctcc

SEQ ID NO: 5545271 - DNA, 17 bp, Homo sapiens
aacccaggacgcttctg

SEQ ID NO: 5545272 - DNA, 19 bp, Homo sapiens
aacccaggacgcttctgaa

SEQ ID NO: 5545273 - DNA, 11 bp, Homo sapiens
aacccaggaga

SEQ ID NO: 5545274 - DNA, 20 bp, Homo sapiens
aacccaggagcatccacctc

SEQ ID NO: 5545275 - DNA, 19 bp, Homo sapiens
aacccaggaggtggaggtt

SEQ ID NO: 5545276 - DNA, 15 bp, Homo sapiens
aacccaggcagctgg

SEQ ID NO: 5545277 - DNA, 20 bp, Homo sapiens
aacccagggctctgccccag

SEQ ID NO: 5545278 - DNA, 15 bp, Homo sapiens
aacccaggtgttgtc

SEQ ID NO: 5545279 - DNA, 23 bp, Homo sapiens
aacccagtcgcccttacttcttg

SEQ ID NO: 5545280 - DNA, 19 bp, Homo sapiens
aacccagtctcctctccat

SEQ ID NO: 5545281 - DNA, 11 bp, Homo sapiens
aacccagtctt

SEQ ID NO: 5545282 - DNA, 21 bp, Homo sapiens
aacccagtcttgtggatggaa

SEQ ID NO: 5545283 - DNA, 15 bp, Homo sapiens
aacccagtctttctt

SEQ ID NO: 5545284 - DNA, 13 bp, Homo sapiens
aacccagtgttca

SEQ ID NO: 5545285 - DNA, 21 bp, Homo sapiens
aacccataactaccaggaata

SEQ ID NO: 5545286 - DNA, 15 bp, Homo sapiens
aacccatacaatgta

SEQ ID NO: 5545287 - DNA, 16 bp, Homo sapiens
aacccatacaatgtat

SEQ ID NO: 5545288 - DNA, 23 bp, Homo sapiens
aacccatacaatgtatgtacaat

SEQ ID NO: 5545289 - DNA, 21 bp, Homo sapiens
aacccataggcccacacacag

SEQ ID NO: 5545290 - DNA, 13 bp, Homo sapiens
aacccatatttta

SEQ ID NO: 5545291 - DNA, 16 bp, Homo sapiens
aacccatcactgtgtc

SEQ ID NO: 5545292 - DNA, 17 bp, Homo sapiens
aacccatcagaaggaga

SEQ ID NO: 5545293 - DNA, 21 bp, Homo sapiens
aacccatcggtaggcaaagga

SEQ ID NO: 5545294 - DNA, 13 bp, Homo sapiens
aacccatctgtaa

SEQ ID NO: 5545295 - DNA, 22 bp, Homo sapiens
aacccatgaagctggccctcag

SEQ ID NO: 5545296 - DNA, 21 bp, Homo sapiens
aacccatgagcgtccaggtga

SEQ ID NO: 5545297 - DNA, 21 bp, Homo sapiens
aacccatgcatggcctcccag

SEQ ID NO: 5545298 - DNA, 19 bp, Homo sapiens
aacccatgcccctgacaga

SEQ ID NO: 5545299 - DNA, 19 bp, Homo sapiens
aacccattaatcttttgta

SEQ ID NO: 5545300 - DNA, 17 bp, Homo sapiens
aacccattcactacagg

SEQ ID NO: 5545301 - DNA, 17 bp, Homo sapiens
aacccatttacttagga

SEQ ID NO: 5545302 - DNA, 21 bp, Homo sapiens
aacccatttgccatgctgcta

SEQ ID NO: 5545303 - DNA, 20 bp, Homo sapiens
aacccatttgtctctacttt

SEQ ID NO: 5545304 - DNA, 18 bp, Homo sapiens
aaccccaacgcacaggaa

SEQ ID NO: 5545305 - DNA, 15 bp, Homo sapiens
aaccccaactcccag

SEQ ID NO: 5545306 - DNA, 19 bp, Homo sapiens
aaccccaactcccagccta

SEQ ID NO: 5545307 - DNA, 16 bp, Homo sapiens
aaccccaagttagttc

SEQ ID NO: 5545308 - DNA, 12 bp, Homo sapiens
aaccccacccag

SEQ ID NO: 5545309 - DNA, 17 bp, Homo sapiens
aaccccacccagctcca

SEQ ID NO: 5545310 - DNA, 13 bp, Homo sapiens
aaccccacctccc

SEQ ID NO: 5545311 - DNA, 23 bp, Homo sapiens
aaccccactgtagacaggaaagc

SEQ ID NO: 5545312 - DNA, 14 bp, Homo sapiens
aaccccacttccat

SEQ ID NO: 5545313 - DNA, 18 bp, Homo sapiens
aaccccagcagtcctggg

SEQ ID NO: 5545314 - DNA, 11 bp, Homo sapiens
aaccccagccg

SEQ ID NO: 5545315 - DNA, 16 bp, Homo sapiens
aaccttcttttcaatg

SEQ ID NO: 5545316 - DNA, 20 bp, Homo sapiens
aaccttcttttcaatgcaat

SEQ ID NO: 5545317 - DNA, 22 bp, Homo sapiens
aaccttcttttcaatgcaatgc

SEQ ID NO: 5545318 - DNA, 13 bp, Homo sapiens
aaccttgaaatgg

SEQ ID NO: 5545319 - DNA, 18 bp, Homo sapiens
aaccttgaagttctgaaa

SEQ ID NO: 5545320 - DNA, 23 bp, Homo sapiens
aaccttgaagttctgaaatttaa

SEQ ID NO: 5545321 - DNA, 14 bp, Homo sapiens
aaccttgaatgctg

SEQ ID NO: 5545322 - DNA, 15 bp, Homo sapiens
aaccttgagacagct

SEQ ID NO: 5545323 - DNA, 20 bp, Homo sapiens
aaccttgcaaactctataaa

SEQ ID NO: 5545324 - DNA, 18 bp, Homo sapiens
aaccttgcctggtacagt

SEQ ID NO: 5545325 - DNA, 15 bp, Homo sapiens
aaccttgctactgtt

SEQ ID NO: 5545326 - DNA, 15 bp, Homo sapiens
aaccttggaccactc

SEQ ID NO: 5545327 - DNA, 13 bp, Homo sapiens
aaccttggccttc

SEQ ID NO: 5545328 - DNA, 16 bp, Homo sapiens
aaccttggccttctcc

SEQ ID NO: 5545329 - DNA, 21 bp, Homo sapiens
aaccttgtaaattccccttcc

SEQ ID NO: 5545330 - DNA, 14 bp, Homo sapiens
aaccttgtataaat

SEQ ID NO: 5545331 - DNA, 19 bp, Homo sapiens
aaccttgtataaattattc

SEQ ID NO: 5545332 - DNA, 13 bp, Homo sapiens
aaccttgtcccag

SEQ ID NO: 5545333 - DNA, 16 bp, Homo sapiens
aaccttgtcccagcca

SEQ ID NO: 5545334 - DNA, 19 bp, Homo sapiens
aaccttgtctctatgccag

SEQ ID NO: 5545335 - DNA, 18 bp, Homo sapiens
aaccttgttatttctcag

SEQ ID NO: 5545336 - DNA, 20 bp, Homo sapiens
aaccttgttctatttttcaa

SEQ ID NO: 5545337 - DNA, 22 bp, Homo sapiens
aaccttgtttaatagatttggg

SEQ ID NO: 5545338 - DNA, 20 bp, Homo sapiens
aaccttgtttattaaattgc

SEQ ID NO: 5545339 - DNA, 12 bp, Homo sapiens
aacctttaaaaa

SEQ ID NO: 5545340 - DNA, 20 bp, Homo sapiens
aacctttaaaaatgtataat

SEQ ID NO: 5545341 - DNA, 23 bp, Homo sapiens
aacctttaaaattgtcacctctg

SEQ ID NO: 5545342 - DNA, 23 bp, Homo sapiens
aacctttaagaaaagccctgaga

SEQ ID NO: 5545343 - DNA, 12 bp, Homo sapiens
aacctttaatga

SEQ ID NO: 5545344 - DNA, 20 bp, Homo sapiens
aacctttagaatatcttttc

SEQ ID NO: 5545345 - DNA, 21 bp, Homo sapiens
aacctttataggataactgat

SEQ ID NO: 5545346 - DNA, 14 bp, Homo sapiens
aacctttattcttt

SEQ ID NO: 5545347 - DNA, 22 bp, Homo sapiens
aacctttcaggaaagtatctct

SEQ ID NO: 5545348 - DNA, 15 bp, Homo sapiens
aacctttccatttta

SEQ ID NO: 5545349 - DNA, 14 bp, Homo sapiens
aacctttcccattt

SEQ ID NO: 5545350 - DNA, 19 bp, Homo sapiens
aacctttccccagacacat

SEQ ID NO: 5545351 - DNA, 20 bp, Homo sapiens
aacctttccccagacacatt

SEQ ID NO: 5545352 - DNA, 11 bp, Homo sapiens
aacctttccct

SEQ ID NO: 5545353 - DNA, 18 bp, Homo sapiens
aacctttccctcaccccc

SEQ ID NO: 5545354 - DNA, 20 bp, Homo sapiens
aacctttctactttttctgt

SEQ ID NO: 5545355 - DNA, 12 bp, Homo sapiens
aacctttctgac

SEQ ID NO: 5545356 - DNA, 19 bp, Homo sapiens
aacctttggacaagaggaa

SEQ ID NO: 5545357 - DNA, 18 bp, Homo sapiens
aacctttgtaagaaaacc

SEQ ID NO: 5545358 - DNA, 19 bp, Homo sapiens
aacctttgtaagaaaacca

SEQ ID NO: 5545359 - DNA, 22 bp, Homo sapiens
aacctttgtaagaaaaccaaaa

SEQ ID NO: 5545360 - DNA, 14 bp, Homo sapiens
aacctttgtgccct

SEQ ID NO: 5545361 - DNA, 20 bp, Homo sapiens
aacctttgtgtggctcctgg

SEQ ID NO: 5545362 - DNA, 16 bp, Homo sapiens
aacctttgtttcaact

SEQ ID NO: 5545363 - DNA, 22 bp, Homo sapiens
aaccttttaaaaaaataatata

SEQ ID NO: 5545364 - DNA, 19 bp, Homo sapiens
aaccttttactggttgcat

SEQ ID NO: 5545365 - DNA, 22 bp, Homo sapiens
aaccttttatcaataaagcact

SEQ ID NO: 5545366 - DNA, 23 bp, Homo sapiens
aaccttttatcaataaagcacta

SEQ ID NO: 5545367 - DNA, 23 bp, Homo sapiens
aaccttttgagtgccttacacaa

SEQ ID NO: 5545368 - DNA, 18 bp, Homo sapiens
aacctttttatttcaaac

SEQ ID NO: 5545369 - DNA, 11 bp, Homo sapiens
aacctttttct

SEQ ID NO: 5545370 - DNA, 16 bp, Homo sapiens
aacctttttgtaaata

SEQ ID NO: 5545371 - DNA, 12 bp, Homo sapiens
aaccttttttgt

SEQ ID NO: 5545372 - DNA, 19 bp, Homo sapiens
aaccttttttgtcttattg

SEQ ID NO: 5545373 - DNA, 17 bp, Homo sapiens
aacctttttttttgaaa

SEQ ID NO: 5545374 - DNA, 17 bp, Homo sapiens
aacgaaaacctgactag

SEQ ID NO: 5545375 - DNA, 16 bp, Homo sapiens
aacgaaacacagaact

SEQ ID NO: 5545376 - DNA, 14 bp, Homo sapiens
aacgaaacccactc

SEQ ID NO: 5545377 - DNA, 23 bp, Homo sapiens
aacgaaactccatctcaaaacaa

SEQ ID NO: 5545378 - DNA, 21 bp, Homo sapiens
aacgaaagctgggcaacatgc

SEQ ID NO: 5545379 - DNA, 21 bp, Homo sapiens
aacgaacccactgtgcttaca

SEQ ID NO: 5545380 - DNA, 14 bp, Homo sapiens
aacgaacccctaga

SEQ ID NO: 5545381 - DNA, 19 bp, Homo sapiens
aacgaacccctagaaagga

SEQ ID NO: 5545382 - DNA, 18 bp, Homo sapiens
aacgaaccttggcctggg

SEQ ID NO: 5545383 - DNA, 14 bp, Homo sapiens
aacgaagaaaaaaa

SEQ ID NO: 5545384 - DNA, 15 bp, Homo sapiens
aacgaagataaatca

SEQ ID NO: 5545385 - DNA, 23 bp, Homo sapiens
aacgaaggggccccggggctggc

SEQ ID NO: 5545386 - DNA, 12 bp, Homo sapiens
aacgaagttggg

SEQ ID NO: 5545387 - DNA, 22 bp, Homo sapiens
aacgaatataagcttaaaataa

SEQ ID NO: 5545388 - DNA, 11 bp, Homo sapiens
aacgaatgaag

SEQ ID NO: 5545389 - DNA, 18 bp, Homo sapiens
aacgaatggtctttgctc

SEQ ID NO: 5545390 - DNA, 14 bp, Homo sapiens
aacgacaaaatgaa

SEQ ID NO: 5545391 - DNA, 18 bp, Homo sapiens
aacgacaaatctgtctgc

SEQ ID NO: 5545392 - DNA, 19 bp, Homo sapiens
aacgaccaaactcagttcg

SEQ ID NO: 5545393 - DNA, 19 bp, Homo sapiens
aacgaccgacgcccctccg

SEQ ID NO: 5545394 - DNA, 17 bp, Homo sapiens
aacgactccgagaacaa

SEQ ID NO: 5545395 - DNA, 15 bp, Homo sapiens
aacgagacacattgc

SEQ ID NO: 5545396 - DNA, 14 bp, Homo sapiens
aacgagcactggcc

SEQ ID NO: 5545397 - DNA, 19 bp, Homo sapiens
aacgagcactggccagaga

SEQ ID NO: 5545398 - DNA, 24 bp, Homo sapiens
aacgagcagcccagggcctagagg

SEQ ID NO: 5545399 - DNA, 14 bp, Homo sapiens
aacgagcctcctca

SEQ ID NO: 5545400 - DNA, 20 bp, Homo sapiens
aacgagcctcctcagggggt

SEQ ID NO: 5545401 - DNA, 18 bp, Homo sapiens
aacgagcctggaagcact

SEQ ID NO: 5545402 - DNA, 12 bp, Homo sapiens
aacgaggaagcc

SEQ ID NO: 5545403 - DNA, 20 bp, Homo sapiens
aacgaggatttccctgaagc

SEQ ID NO: 5545404 - DNA, 22 bp, Homo sapiens
aacgaggatttccctgaagcta

SEQ ID NO: 5545405 - DNA, 23 bp, Homo sapiens
aacgagggctgatggaggaaaaa

SEQ ID NO: 5545406 - DNA, 16 bp, Homo sapiens
aacgataaaattacaa

SEQ ID NO: 5545407 - DNA, 23 bp, Homo sapiens
aacgatacaaatttggccttaag

SEQ ID NO: 5545408 - DNA, 21 bp, Homo sapiens
aacgatagcctagctttctaa

SEQ ID NO: 5545409 - DNA, 21 bp, Homo sapiens
aacgatgtgcaatacattttt

SEQ ID NO: 5545410 - DNA, 13 bp, Homo sapiens
aacgatgtgtctg

SEQ ID NO: 5545411 - DNA, 20 bp, Homo sapiens
aacgatgtgtctgtatttca

SEQ ID NO: 5545412 - DNA, 14 bp, Homo sapiens
aacgatgttgtgat

SEQ ID NO: 5545413 - DNA, 17 bp, Homo sapiens
aacgattcacagcctcc

SEQ ID NO: 5545414 - DNA, 17 bp, Homo sapiens
aacgatttaattctctt

SEQ ID NO: 5545415 - DNA, 15 bp, Homo sapiens
aacgatttaatttat

SEQ ID NO: 5545416 - DNA, 12 bp, Homo sapiens
aacgatttagaa

SEQ ID NO: 5545417 - DNA, 15 bp, Homo sapiens
aacgatttttaaaat

SEQ ID NO: 5545418 - DNA, 19 bp, Homo sapiens
aacgcaagttcccagttgg

SEQ ID NO: 5545419 - DNA, 22 bp, Homo sapiens
aacgcaagttcccagttggagc

SEQ ID NO: 5545420 - DNA, 17 bp, Homo sapiens
aacgcacaacatgcaca

SEQ ID NO: 5545421 - DNA, 14 bp, Homo sapiens
aacgcacttacaag

SEQ ID NO: 5545422 - DNA, 13 bp, Homo sapiens
aacgcagaagagg

SEQ ID NO: 5545423 - DNA, 11 bp, Homo sapiens
aacgcagccct

SEQ ID NO: 5545424 - DNA, 21 bp, Homo sapiens
aacgcagccctagagcctgcc

SEQ ID NO: 5545425 - DNA, 16 bp, Homo sapiens
aacgcagccctgcttt

SEQ ID NO: 5545426 - DNA, 20 bp, Homo sapiens
aacgcaggagaatcactgca

SEQ ID NO: 5545427 - DNA, 22 bp, Homo sapiens
aacgcaggagaatcactgcagc

SEQ ID NO: 5545428 - DNA, 15 bp, Homo sapiens
aacgcaggagagaga

SEQ ID NO: 5545429 - DNA, 20 bp, Homo sapiens
aacgcaggcccccaggtgcc

SEQ ID NO: 5545430 - DNA, 12 bp, Homo sapiens
aacgcagttgat

SEQ ID NO: 5545431 - DNA, 22 bp, Homo sapiens
aacgcagttgtgtggcccagca

SEQ ID NO: 5545432 - DNA, 23 bp, Homo sapiens
aacgcatctagttcccctgttta

SEQ ID NO: 5545433 - DNA, 21 bp, Homo sapiens
aacgcatggagtgtgtattgt

SEQ ID NO: 5545434 - DNA, 20 bp, Homo sapiens
aacgcattgccacggaaaca

SEQ ID NO: 5545435 - DNA, 11 bp, Homo sapiens
aacgcattttg

SEQ ID NO: 5545436 - DNA, 21 bp, Homo sapiens
aacgcattttgggttgtttaa

SEQ ID NO: 5545437 - DNA, 15 bp, Homo sapiens
aacgccagtctccca

SEQ ID NO: 5545438 - DNA, 20 bp, Homo sapiens
aacgccagtctcccaggccc

SEQ ID NO: 5545439 - DNA, 19 bp, Homo sapiens
aacgccccgggcaaagggt

SEQ ID NO: 5545440 - DNA, 13 bp, Homo sapiens
aacgcccctccaa

SEQ ID NO: 5545441 - DNA, 16 bp, Homo sapiens
aacgcccctccaaacc

SEQ ID NO: 5545442 - DNA, 21 bp, Homo sapiens
aacgcccctccaaacctccag

SEQ ID NO: 5545443 - DNA, 13 bp, Homo sapiens
aacgccctgtgtc

SEQ ID NO: 5545444 - DNA, 16 bp, Homo sapiens
aacgccgagtgcactg

SEQ ID NO: 5545445 - DNA, 13 bp, Homo sapiens
aacgcctccccct

SEQ ID NO: 5545446 - DNA, 20 bp, Homo sapiens
aacgcctgccttctgggcaa

SEQ ID NO: 5545447 - DNA, 22 bp, Homo sapiens
aacgccttgaaaacaagcctcc

SEQ ID NO: 5545448 - DNA, 23 bp, Homo sapiens
aacgccttttcttggttcttttt

SEQ ID NO: 5545449 - DNA, 13 bp, Homo sapiens
aacgcgcagatgt

SEQ ID NO: 5545450 - DNA, 14 bp, Homo sapiens
aacgcgtctgcctg

SEQ ID NO: 5545451 - DNA, 15 bp, Homo sapiens
aacgcgtctgcctgg

SEQ ID NO: 5545452 - DNA, 16 bp, Homo sapiens
aacgcgtgtgtacacg

SEQ ID NO: 5545453 - DNA, 17 bp, Homo sapiens
aacgctaaagagccctt

SEQ ID NO: 5545454 - DNA, 15 bp, Homo sapiens
aacgctcagcgctgg

SEQ ID NO: 5545455 - DNA, 16 bp, Homo sapiens
aacgctccaaagtcat

SEQ ID NO: 5545456 - DNA, 16 bp, Homo sapiens
aacgctcctttgtgtg

SEQ ID NO: 5545457 - DNA, 14 bp, Homo sapiens
aacgctctaccctg

SEQ ID NO: 5545458 - DNA, 18 bp, Homo sapiens
aacgctctaccctgcagc

SEQ ID NO: 5545459 - DNA, 18 bp, Homo sapiens
aacgctgaactgacaatg

SEQ ID NO: 5545460 - DNA, 17 bp, Homo sapiens
aacgctgagccacctgc

SEQ ID NO: 5545461 - DNA, 23 bp, Homo sapiens
aacgctgattcctaaggcccagc

SEQ ID NO: 5545462 - DNA, 12 bp, Homo sapiens
aacgctgcctgc

SEQ ID NO: 5545463 - DNA, 16 bp, Homo sapiens
aacgctgtgatgctgt

SEQ ID NO: 5545464 - DNA, 17 bp, Homo sapiens
aacggaaatgtgtggtc

SEQ ID NO: 5545465 - DNA, 17 bp, Homo sapiens
aacggaacgttggactt

SEQ ID NO: 5545466 - DNA, 14 bp, Homo sapiens
aacggaccaaagca

SEQ ID NO: 5545467 - DNA, 21 bp, Homo sapiens
aacggaccaaagcaagaccct

SEQ ID NO: 5545468 - DNA, 14 bp, Homo sapiens
aacggagaaaggtg

SEQ ID NO: 5545469 - DNA, 19 bp, Homo sapiens
aacggagagcgcctgcccc

SEQ ID NO: 5545470 - DNA, 19 bp, Homo sapiens
aacggaggcctgcgaccct

SEQ ID NO: 5545471 - DNA, 16 bp, Homo sapiens
aacggattattttttc

SEQ ID NO: 5545472 - DNA, 18 bp, Homo sapiens
aacggattattttttcag

SEQ ID NO: 5545473 - DNA, 20 bp, Homo sapiens
aacggattattttttcagac

SEQ ID NO: 5545474 - DNA, 22 bp, Homo sapiens
aacggattattttttcagaccg

SEQ ID NO: 5545475 - DNA, 18 bp, Homo sapiens
aacggcaaaaaaaaattt

SEQ ID NO: 5545476 - DNA, 13 bp, Homo sapiens
aacggccagggtt

SEQ ID NO: 5545477 - DNA, 17 bp, Homo sapiens
aacggcccaggccaggt

SEQ ID NO: 5545478 - DNA, 13 bp, Homo sapiens
aacggccccagcg

SEQ ID NO: 5545479 - DNA, 19 bp, Homo sapiens
aacggccctgcagccagct

SEQ ID NO: 5545480 - DNA, 23 bp, Homo sapiens
aacggctaacctggacctggaac

SEQ ID NO: 5545481 - DNA, 12 bp, Homo sapiens
aacggctctcca

SEQ ID NO: 5545482 - DNA, 18 bp, Homo sapiens
aacgggaaagaatataaa

SEQ ID NO: 5545483 - DNA, 21 bp, Homo sapiens
aacgggaccccctggccctgc

SEQ ID NO: 5545484 - DNA, 16 bp, Homo sapiens
aacgggaggctgggca

SEQ ID NO: 5545485 - DNA, 18 bp, Homo sapiens
aacgggaggctgggcaca

SEQ ID NO: 5545486 - DNA, 13 bp, Homo sapiens
aacgggcagccac

SEQ ID NO: 5545487 - DNA, 14 bp, Homo sapiens
aacgggcagccaca

SEQ ID NO: 5545488 - DNA, 16 bp, Homo sapiens
aacgggcagccacagg

SEQ ID NO: 5545489 - DNA, 19 bp, Homo sapiens
aacgggcagccacaggact

SEQ ID NO: 5545490 - DNA, 16 bp, Homo sapiens
aacgggctccttcccc

SEQ ID NO: 5545491 - DNA, 21 bp, Homo sapiens
aacgggcttgactttggctga

SEQ ID NO: 5545492 - DNA, 14 bp, Homo sapiens
aactatttcagaat

SEQ ID NO: 5545493 - DNA, 13 bp, Homo sapiens
aactatttcagtg

SEQ ID NO: 5545494 - DNA, 18 bp, Homo sapiens
aactatttcttatatatg

SEQ ID NO: 5545495 - DNA, 15 bp, Homo sapiens
aactatttctttcat

SEQ ID NO: 5545496 - DNA, 17 bp, Homo sapiens
aactatttctttcatca

SEQ ID NO: 5545497 - DNA, 15 bp, Homo sapiens
aactatttgtataaa

SEQ ID NO: 5545498 - DNA, 19 bp, Homo sapiens
aactatttgtctttcagga

SEQ ID NO: 5545499 - DNA, 18 bp, Homo sapiens
aactattttaaataaaat

SEQ ID NO: 5545500 - DNA, 18 bp, Homo sapiens
aactattttcaaagactt

SEQ ID NO: 5545501 - DNA, 13 bp, Homo sapiens
aactattttcaga

SEQ ID NO: 5545502 - DNA, 14 bp, Homo sapiens
aactattttcagat

SEQ ID NO: 5545503 - DNA, 13 bp, Homo sapiens
aactatttttgta

SEQ ID NO: 5545504 - DNA, 22 bp, Homo sapiens
aactattttttaaaaattcact

SEQ ID NO: 5545505 - DNA, 15 bp, Homo sapiens
aactatttttttcaa

SEQ ID NO: 5545506 - DNA, 17 bp, Homo sapiens
aactatttttttcaaag

SEQ ID NO: 5545507 - DNA, 17 bp, Homo sapiens
aactcaaaacacccaaa

SEQ ID NO: 5545508 - DNA, 19 bp, Homo sapiens
aactcaaaacttaacatat

SEQ ID NO: 5545509 - DNA, 23 bp, Homo sapiens
aactcaaaaggagaactgtgctc

SEQ ID NO: 5545510 - DNA, 16 bp, Homo sapiens
aactcaaaatatttgt

SEQ ID NO: 5545511 - DNA, 14 bp, Homo sapiens
aactcaaacacaga

SEQ ID NO: 5545512 - DNA, 17 bp, Homo sapiens
aactcaaactcttaaaa

SEQ ID NO: 5545513 - DNA, 19 bp, Homo sapiens
aactcaaagatgatggaaa

SEQ ID NO: 5545514 - DNA, 22 bp, Homo sapiens
aactcaaagatgatggaaacgc

SEQ ID NO: 5545515 - DNA, 13 bp, Homo sapiens
aactcaaatacac

SEQ ID NO: 5545516 - DNA, 11 bp, Homo sapiens
aactcaaatgc

SEQ ID NO: 5545517 - DNA, 23 bp, Homo sapiens
aactcaaatggggccagatccag

SEQ ID NO: 5545518 - DNA, 17 bp, Homo sapiens
aactcaaccaaatggta

SEQ ID NO: 5545519 - DNA, 23 bp, Homo sapiens
aactcaaccaaatggtacaaaac

SEQ ID NO: 5545520 - DNA, 21 bp, Homo sapiens
aactcaactgggctctgtccc

SEQ ID NO: 5545521 - DNA, 21 bp, Homo sapiens
aactcaagatttgaccaaatc

SEQ ID NO: 5545522 - DNA, 22 bp, Homo sapiens
aactcaaggataccttcttatt

SEQ ID NO: 5545523 - DNA, 18 bp, Homo sapiens
aactcaagggttttccag

SEQ ID NO: 5545524 - DNA, 13 bp, Homo sapiens
aactcaatataaa

SEQ ID NO: 5545525 - DNA, 21 bp, Homo sapiens
aactcaatctaaattaaaaaa

SEQ ID NO: 5545526 - DNA, 22 bp, Homo sapiens
aactcaatgcatgatgactctt

SEQ ID NO: 5545527 - DNA, 13 bp, Homo sapiens
aactcaatgcttt

SEQ ID NO: 5545528 - DNA, 16 bp, Homo sapiens
aactcaatgctttatt

SEQ ID NO: 5545529 - DNA, 19 bp, Homo sapiens
aactcaatgctttatttgt

SEQ ID NO: 5545530 - DNA, 22 bp, Homo sapiens
aactcacacattcccccaccag

SEQ ID NO: 5545531 - DNA, 17 bp, Homo sapiens
aactcacacccctgccc

SEQ ID NO: 5545532 - DNA, 16 bp, Homo sapiens
aactcacatgccttct

SEQ ID NO: 5545533 - DNA, 15 bp, Homo sapiens
aactcaccatgtaaa

SEQ ID NO: 5545534 - DNA, 15 bp, Homo sapiens
aactcaccccagccc

SEQ ID NO: 5545535 - DNA, 12 bp, Homo sapiens
aactcacccttg

SEQ ID NO: 5545536 - DNA, 12 bp, Homo sapiens
aactcacctccc

SEQ ID NO: 5545537 - DNA, 15 bp, Homo sapiens
aactcacctgcccct

SEQ ID NO: 5545538 - DNA, 21 bp, Homo sapiens
aactcacctgctggcccctca

SEQ ID NO: 5545539 - DNA, 17 bp, Homo sapiens
aactcactatggttttt

SEQ ID NO: 5545540 - DNA, 17 bp, Homo sapiens
aactcactccttttaaa

SEQ ID NO: 5545541 - DNA, 20 bp, Homo sapiens
aactcactccttttaaagaa

SEQ ID NO: 5545542 - DNA, 16 bp, Homo sapiens
aactcactctgggctg

SEQ ID NO: 5545543 - DNA, 16 bp, Homo sapiens
aactcactgattctct

SEQ ID NO: 5545544 - DNA, 15 bp, Homo sapiens
aactcactgcctagg

SEQ ID NO: 5545545 - DNA, 21 bp, Homo sapiens
aactcactgctcaagaagaca

SEQ ID NO: 5545546 - DNA, 22 bp, Homo sapiens
aactcactggaatgtacagtat

SEQ ID NO: 5545547 - DNA, 17 bp, Homo sapiens
aactcacttcaatgaac

SEQ ID NO: 5545548 - DNA, 13 bp, Homo sapiens
aactcagaaggct

SEQ ID NO: 5545549 - DNA, 17 bp, Homo sapiens
aactcagagcacagcca

SEQ ID NO: 5545550 - DNA, 15 bp, Homo sapiens
aactcagatatccta

SEQ ID NO: 5545551 - DNA, 14 bp, Homo sapiens
aactcagatcacta

SEQ ID NO: 5545552 - DNA, 20 bp, Homo sapiens
aactcagatcactactgcag

SEQ ID NO: 5545553 - DNA, 12 bp, Homo sapiens
aactcagatcca

SEQ ID NO: 5545554 - DNA, 21 bp, Homo sapiens
aactcagatctgatcaagagt

SEQ ID NO: 5545555 - DNA, 16 bp, Homo sapiens
aactcagatgtccaaa

SEQ ID NO: 5545556 - DNA, 13 bp, Homo sapiens
aactcagatttaa

SEQ ID NO: 5545557 - DNA, 10 bp, Homo sapiens
aactcagccg

SEQ ID NO: 5545558 - DNA, 22 bp, Homo sapiens
aactcagcctcaataagccttg

SEQ ID NO: 5545559 - DNA, 16 bp, Homo sapiens
aactcagcctgggaca

SEQ ID NO: 5545560 - DNA, 21 bp, Homo sapiens
aactcagccttaagaaagcta

SEQ ID NO: 5545561 - DNA, 16 bp, Homo sapiens
aactcaggactccagc

SEQ ID NO: 5545562 - DNA, 17 bp, Homo sapiens
aactcaggcaaagaaaa

SEQ ID NO: 5545563 - DNA, 13 bp, Homo sapiens
aactcagggacag

SEQ ID NO: 5545564 - DNA, 22 bp, Homo sapiens
aactcagtcattagactcctcc

SEQ ID NO: 5545565 - DNA, 23 bp, Homo sapiens
aactcagtcattagactcctcct

SEQ ID NO: 5545566 - DNA, 17 bp, Homo sapiens
aactcagtgaaggccca

SEQ ID NO: 5545567 - DNA, 15 bp, Homo sapiens
aactcagttcaaacc

SEQ ID NO: 5545568 - DNA, 16 bp, Homo sapiens
aactcagttcaaacca

SEQ ID NO: 5545569 - DNA, 17 bp, Homo sapiens
aactcagttccaaagtc

SEQ ID NO: 5545570 - DNA, 18 bp, Homo sapiens
aactcagttttaactaga

SEQ ID NO: 5545571 - DNA, 21 bp, Homo sapiens
aactcataatctataaacaat

SEQ ID NO: 5545572 - DNA, 12 bp, Homo sapiens
aactcatacagt

SEQ ID NO: 5545573 - DNA, 16 bp, Homo sapiens
aactcatactgtgctg

SEQ ID NO: 5545574 - DNA, 22 bp, Homo sapiens
aactcatactgtgctggagcca

SEQ ID NO: 5545575 - DNA, 16 bp, Homo sapiens
aactcatattttcatg

SEQ ID NO: 5545576 - DNA, 15 bp, Homo sapiens
aactcatattttgaa

SEQ ID NO: 5545577 - DNA, 11 bp, Homo sapiens
aactcatcaaa

SEQ ID NO: 5545578 - DNA, 15 bp, Homo sapiens
aactcatcacataaa

SEQ ID NO: 5545579 - DNA, 18 bp, Homo sapiens
aactcatcacataaagaa

SEQ ID NO: 5545580 - DNA, 14 bp, Homo sapiens
aactcatcataaaa

SEQ ID NO: 5545581 - DNA, 18 bp, Homo sapiens
aactcatcataaaataaa

SEQ ID NO: 5545582 - DNA, 17 bp, Homo sapiens
aactcatcattttctac

SEQ ID NO: 5545583 - DNA, 22 bp, Homo sapiens
aactcatcctgtgtggggaggc

SEQ ID NO: 5545584 - DNA, 22 bp, Homo sapiens
aactcatctaggtaaattacag

SEQ ID NO: 5545585 - DNA, 20 bp, Homo sapiens
aactcatctgaaatgttaca

SEQ ID NO: 5545586 - DNA, 17 bp, Homo sapiens
aactcatctgttatcct

SEQ ID NO: 5545587 - DNA, 21 bp, Homo sapiens
aactcatctttagagcaacag

SEQ ID NO: 5545588 - DNA, 19 bp, Homo sapiens
aactcatgaacaaaatgaa

SEQ ID NO: 5545589 - DNA, 19 bp, Homo sapiens
aactcatgactgagtctgg

SEQ ID NO: 5545590 - DNA, 15 bp, Homo sapiens
aactcatgatcaaga

SEQ ID NO: 5545591 - DNA, 21 bp, Homo sapiens
aactcattcctgcctgtctcc

SEQ ID NO: 5545592 - DNA, 23 bp, Homo sapiens
aactcattcctgcctgtctcctt

SEQ ID NO: 5545593 - DNA, 16 bp, Homo sapiens
aactcattgcagcaga

SEQ ID NO: 5545594 - DNA, 23 bp, Homo sapiens
aactcattgcagcagataacttt

SEQ ID NO: 5545595 - DNA, 20 bp, Homo sapiens
aactcattgcatcatttaca

SEQ ID NO: 5545596 - DNA, 16 bp, Homo sapiens
aactcatttgaatgct

SEQ ID NO: 5545597 - DNA, 22 bp, Homo sapiens
aactcatttgggtattttgtca

SEQ ID NO: 5545598 - DNA, 18 bp, Homo sapiens
aactcattttcatattgt

SEQ ID NO: 5545599 - DNA, 17 bp, Homo sapiens
aactcattttgcttgtg

SEQ ID NO: 5545600 - DNA, 20 bp, Homo sapiens
aactcatttttgccatacat

SEQ ID NO: 5545601 - DNA, 21 bp, Homo sapiens
aactcatttttgttttcatta

SEQ ID NO: 5545602 - DNA, 20 bp, Homo sapiens
aactccaaacaattctgatg

SEQ ID NO: 5545603 - DNA, 15 bp, Homo sapiens
aactccaacctctcg

SEQ ID NO: 5545604 - DNA, 21 bp, Homo sapiens
aactccaacctctcggcccca

SEQ ID NO: 5545605 - DNA, 21 bp, Homo sapiens
aactccaacttagtgtctcta

SEQ ID NO: 5545606 - DNA, 10 bp, Homo sapiens
aactccaaga

SEQ ID NO: 5545607 - DNA, 13 bp, Homo sapiens
aactccaagcaga

SEQ ID NO: 5545608 - DNA, 12 bp, Homo sapiens
aactccaaggca

SEQ ID NO: 5545609 - DNA, 18 bp, Homo sapiens
aactccaaggcaaatgtc

SEQ ID NO: 5545610 - DNA, 18 bp, Homo sapiens
aactccaaggttcccttg

SEQ ID NO: 5545611 - DNA, 11 bp, Homo sapiens
aactccacagg

SEQ ID NO: 5545612 - DNA, 18 bp, Homo sapiens
aactccacatctgcctta

SEQ ID NO: 5545613 - DNA, 18 bp, Homo sapiens
aactccacccccagagga

SEQ ID NO: 5545614 - DNA, 17 bp, Homo sapiens
aactccaccctctgcga

SEQ ID NO: 5545615 - DNA, 13 bp, Homo sapiens
aactccaccgcct

SEQ ID NO: 5545616 - DNA, 12 bp, Homo sapiens
aactccagcatt

SEQ ID NO: 5545617 - DNA, 21 bp, Homo sapiens
aactccagcgtcctcagcacc

SEQ ID NO: 5545618 - DNA, 17 bp, Homo sapiens
aactccagctgagtcct

SEQ ID NO: 5545619 - DNA, 22 bp, Homo sapiens
aactccaggatttataaagcaa

SEQ ID NO: 5545620 - DNA, 12 bp, Homo sapiens
aactccaggcat

SEQ ID NO: 5545621 - DNA, 14 bp, Homo sapiens
aactccaggctgga

SEQ ID NO: 5545622 - DNA, 15 bp, Homo sapiens
aactccaggggcacc

SEQ ID NO: 5545623 - DNA, 13 bp, Homo sapiens
aactccagtagct

SEQ ID NO: 5545624 - DNA, 21 bp, Homo sapiens
aactccagtgttcccttctgg

SEQ ID NO: 5545625 - DNA, 17 bp, Homo sapiens
aactccatatgtgttcc

SEQ ID NO: 5545626 - DNA, 13 bp, Homo sapiens
aactccatcattc

SEQ ID NO: 5545627 - DNA, 22 bp, Homo sapiens
aactccatcgccatcttcttcc

SEQ ID NO: 5545628 - DNA, 11 bp, Homo sapiens
aactccatgac

SEQ ID NO: 5545629 - DNA, 18 bp, Homo sapiens
aactccatgaccaggcca

SEQ ID NO: 5545630 - DNA, 12 bp, Homo sapiens
aactccatgatg

SEQ ID NO: 5545631 - DNA, 12 bp, Homo sapiens
aactccatgcct

SEQ ID NO: 5545632 - DNA, 17 bp, Homo sapiens
aactcccagccaccacc

SEQ ID NO: 5545633 - DNA, 21 bp, Homo sapiens
aactcccagccaccaccactg

SEQ ID NO: 5545634 - DNA, 16 bp, Homo sapiens
aactcccatcacctct

SEQ ID NO: 5545635 - DNA, 16 bp, Homo sapiens
aactccccagggcctc

SEQ ID NO: 5545636 - DNA, 10 bp, Homo sapiens
aactccccca

SEQ ID NO: 5545637 - DNA, 13 bp, Homo sapiens
aactcccccaccg

SEQ ID NO: 5545638 - DNA, 20 bp, Homo sapiens
aactcccccaccgcccactc

SEQ ID NO: 5545639 - DNA, 16 bp, Homo sapiens
aactcccctgtttcaa

SEQ ID NO: 5545640 - DNA, 20 bp, Homo sapiens
aactccccttccctggggag

SEQ ID NO: 5545641 - DNA, 23 bp, Homo sapiens
aactccccttcctcactgcccaa

SEQ ID NO: 5545642 - DNA, 11 bp, Homo sapiens
aactccctcca

SEQ ID NO: 5545643 - DNA, 20 bp, Homo sapiens
aactccctccaccagcctgc

SEQ ID NO: 5545644 - DNA, 21 bp, Homo sapiens
aactccctccaccagcctgct

SEQ ID NO: 5545645 - DNA, 11 bp, Homo sapiens
aactccctcct

SEQ ID NO: 5545646 - DNA, 13 bp, Homo sapiens
aactccctcctca

SEQ ID NO: 5545647 - DNA, 14 bp, Homo sapiens
aactccctcctcac

SEQ ID NO: 5545648 - DNA, 14 bp, Homo sapiens
aactccctcctccc

SEQ ID NO: 5545649 - DNA, 17 bp, Homo sapiens
aactccctctctgtgca

SEQ ID NO: 5545650 - DNA, 13 bp, Homo sapiens
aactccctgcccc

SEQ ID NO: 5545651 - DNA, 13 bp, Homo sapiens
aactcccttcctt

SEQ ID NO: 5545652 - DNA, 19 bp, Homo sapiens
aactcccttctcccctcag

SEQ ID NO: 5545653 - DNA, 15 bp, Homo sapiens
aactcccttctgctt

SEQ ID NO: 5545654 - DNA, 14 bp, Homo sapiens
aactccctttcaac

SEQ ID NO: 5545655 - DNA, 18 bp, Homo sapiens
aactccctttttacactt

SEQ ID NO: 5545656 - DNA, 19 bp, Homo sapiens
aactccctttttacacttt

SEQ ID NO: 5545657 - DNA, 20 bp, Homo sapiens
aactccctttttacacttta

SEQ ID NO: 5545658 - DNA, 21 bp, Homo sapiens
aactccctttttacactttat

SEQ ID NO: 5545659 - DNA, 23 bp, Homo sapiens
aactccgaaagtctgaatctccc

SEQ ID NO: 5545660 - DNA, 16 bp, Homo sapiens
aactccgcccagcctc

SEQ ID NO: 5545661 - DNA, 19 bp, Homo sapiens
aactccgcccagcctctcc

SEQ ID NO: 5545662 - DNA, 18 bp, Homo sapiens
aactccgcccccagccta

SEQ ID NO: 5545663 - DNA, 21 bp, Homo sapiens
aactccggattgcgttcctcc

SEQ ID NO: 5545664 - DNA, 17 bp, Homo sapiens
aactccgtgtgcctggg

SEQ ID NO: 5545665 - DNA, 15 bp, Homo sapiens
aactccgtttccaaa

SEQ ID NO: 5545666 - DNA, 11 bp, Homo sapiens
aactcctacct

SEQ ID NO: 5545667 - DNA, 15 bp, Homo sapiens
aactcctagttctag

SEQ ID NO: 5545668 - DNA, 15 bp, Homo sapiens
aactcctatttcaat

SEQ ID NO: 5545669 - DNA, 15 bp, Homo sapiens
aactcctcaagggca

SEQ ID NO: 5545670 - DNA, 13 bp, Homo sapiens
aactcctcccacc

SEQ ID NO: 5545671 - DNA, 14 bp, Homo sapiens
aactcctcccaccc

SEQ ID NO: 5545672 - DNA, 15 bp, Homo sapiens
aactggtcttccttt

SEQ ID NO: 5545673 - DNA, 21 bp, Homo sapiens
aactggtgatataaagaatga

SEQ ID NO: 5545674 - DNA, 20 bp, Homo sapiens
aactggtgcactttgtaaat

SEQ ID NO: 5545675 - DNA, 21 bp, Homo sapiens
aactggtgcactttgtaaatt

SEQ ID NO: 5545676 - DNA, 22 bp, Homo sapiens
aactggtgggtctttaataaaa

SEQ ID NO: 5545677 - DNA, 21 bp, Homo sapiens
aactggttaaacattaatatt

SEQ ID NO: 5545678 - DNA, 20 bp, Homo sapiens
aactggttatttaaaatgta

SEQ ID NO: 5545679 - DNA, 14 bp, Homo sapiens
aactggttcctaca

SEQ ID NO: 5545680 - DNA, 22 bp, Homo sapiens
aactggttctacaaatttttac

SEQ ID NO: 5545681 - DNA, 23 bp, Homo sapiens
aactggttctgtgttgaaatata

SEQ ID NO: 5545682 - DNA, 14 bp, Homo sapiens
aactggttcttgcc

SEQ ID NO: 5545683 - DNA, 16 bp, Homo sapiens
aactggttcttgcctt

SEQ ID NO: 5545684 - DNA, 13 bp, Homo sapiens
aactggtttagca

SEQ ID NO: 5545685 - DNA, 23 bp, Homo sapiens
aactggtttagcacaatttatat

SEQ ID NO: 5545686 - DNA, 19 bp, Homo sapiens
aactggtttataataaact

SEQ ID NO: 5545687 - DNA, 23 bp, Homo sapiens
aactgtaaaagtgtacagactct

SEQ ID NO: 5545688 - DNA, 19 bp, Homo sapiens
aactgtaaaatgatactgt

SEQ ID NO: 5545689 - DNA, 14 bp, Homo sapiens
aactgtaaataaaa

SEQ ID NO: 5545690 - DNA, 16 bp, Homo sapiens
aactgtaaataaaatg

SEQ ID NO: 5545691 - DNA, 22 bp, Homo sapiens
aactgtaaataaaatgtgtaca

SEQ ID NO: 5545692 - DNA, 13 bp, Homo sapiens
aactgtaaatatt

SEQ ID NO: 5545693 - DNA, 17 bp, Homo sapiens
aactgtaaatcacttgt

SEQ ID NO: 5545694 - DNA, 18 bp, Homo sapiens
aactgtaaatcacttgta

SEQ ID NO: 5545695 - DNA, 19 bp, Homo sapiens
aactgtaaatcacttgtaa

SEQ ID NO: 5545696 - DNA, 16 bp, Homo sapiens
aactgtaaatcataat

SEQ ID NO: 5545697 - DNA, 11 bp, Homo sapiens
aactgtacagt

SEQ ID NO: 5545698 - DNA, 16 bp, Homo sapiens
aactgtacagtgtctt

SEQ ID NO: 5545699 - DNA, 17 bp, Homo sapiens
aactgtacagtgtcttt

SEQ ID NO: 5545700 - DNA, 14 bp, Homo sapiens
aactgtacattgtg

SEQ ID NO: 5545701 - DNA, 23 bp, Homo sapiens
aactgtacatttcacaggctaat

SEQ ID NO: 5545702 - DNA, 22 bp, Homo sapiens
aactgtaccatgtgctacaggg

SEQ ID NO: 5545703 - DNA, 13 bp, Homo sapiens
aactgtacctttt

SEQ ID NO: 5545704 - DNA, 13 bp, Homo sapiens
aactgtactgaat

SEQ ID NO: 5545705 - DNA, 13 bp, Homo sapiens
aactgtactgtct

SEQ ID NO: 5545706 - DNA, 13 bp, Homo sapiens
aactgtacttcac

SEQ ID NO: 5545707 - DNA, 15 bp, Homo sapiens
aactgtacttcactg

SEQ ID NO: 5545708 - DNA, 20 bp, Homo sapiens
aactgtagataaagtggttt

SEQ ID NO: 5545709 - DNA, 14 bp, Homo sapiens
aactgtagatgaag

SEQ ID NO: 5545710 - DNA, 20 bp, Homo sapiens
aactgtagatgatgtatttt

SEQ ID NO: 5545711 - DNA, 19 bp, Homo sapiens
aactgtagcgaccccagac

SEQ ID NO: 5545712 - DNA, 18 bp, Homo sapiens
aactgtagctcaagttta

SEQ ID NO: 5545713 - DNA, 15 bp, Homo sapiens
aactgtagtctctga

SEQ ID NO: 5545714 - DNA, 22 bp, Homo sapiens
aactgtagtgtagtcaggtgct

SEQ ID NO: 5545715 - DNA, 14 bp, Homo sapiens
aactgtatattatt

SEQ ID NO: 5545716 - DNA, 22 bp, Homo sapiens
aactgtatgaagtcatagataa

SEQ ID NO: 5545717 - DNA, 14 bp, Homo sapiens
aactgtatgtctta

SEQ ID NO: 5545718 - DNA, 23 bp, Homo sapiens
aactgtatgtcttataagaaaac

SEQ ID NO: 5545719 - DNA, 15 bp, Homo sapiens
aactgtattaaagaa

SEQ ID NO: 5545720 - DNA, 17 bp, Homo sapiens
aactgtattaaagaaaa

SEQ ID NO: 5545721 - DNA, 19 bp, Homo sapiens
aactgtattctagtggctg

SEQ ID NO: 5545722 - DNA, 15 bp, Homo sapiens
aactgtatttaagga

SEQ ID NO: 5545723 - DNA, 16 bp, Homo sapiens
aactgtatttacttgt

SEQ ID NO: 5545724 - DNA, 12 bp, Homo sapiens
aactgtatttca

SEQ ID NO: 5545725 - DNA, 17 bp, Homo sapiens
aactgtattttctttca

SEQ ID NO: 5545726 - DNA, 18 bp, Homo sapiens
aactgtattttctttcac

SEQ ID NO: 5545727 - DNA, 20 bp, Homo sapiens
aactgtattttctttcactt

SEQ ID NO: 5545728 - DNA, 14 bp, Homo sapiens
aactgtattttgaa

SEQ ID NO: 5545729 - DNA, 17 bp, Homo sapiens
aactgtcaccctgaggt

SEQ ID NO: 5545730 - DNA, 20 bp, Homo sapiens
aactgtcactctaggaagaa

SEQ ID NO: 5545731 - DNA, 13 bp, Homo sapiens
aactgtcagttca

SEQ ID NO: 5545732 - DNA, 15 bp, Homo sapiens
aactgtcattacaga

SEQ ID NO: 5545733 - DNA, 21 bp, Homo sapiens
aactgtcattgtgtgtggaat

SEQ ID NO: 5545734 - DNA, 19 bp, Homo sapiens
aactgtccacatctgcctc

SEQ ID NO: 5545735 - DNA, 16 bp, Homo sapiens
aactgtccagagagca

SEQ ID NO: 5545736 - DNA, 17 bp, Homo sapiens
aactgtcccacaaaata

SEQ ID NO: 5545737 - DNA, 12 bp, Homo sapiens
aactgtcccagc

SEQ ID NO: 5545738 - DNA, 17 bp, Homo sapiens
aactgtcccatccccag

SEQ ID NO: 5545739 - DNA, 17 bp, Homo sapiens
aactgtccctgctttct

SEQ ID NO: 5545740 - DNA, 19 bp, Homo sapiens
aactgtccgtaagcagtat

SEQ ID NO: 5545741 - DNA, 21 bp, Homo sapiens
aactgtcctctttcagaaaac

SEQ ID NO: 5545742 - DNA, 11 bp, Homo sapiens
aactgtcctgt

SEQ ID NO: 5545743 - DNA, 14 bp, Homo sapiens
aactgtcctgtcct

SEQ ID NO: 5545744 - DNA, 14 bp, Homo sapiens
aactgtcctttcct

SEQ ID NO: 5545745 - DNA, 16 bp, Homo sapiens
aactgtcggaggaaag

SEQ ID NO: 5545746 - DNA, 19 bp, Homo sapiens
aactgtcggaggaaagaca

SEQ ID NO: 5545747 - DNA, 20 bp, Homo sapiens
aactgtcgtgtcatactcga

SEQ ID NO: 5545748 - DNA, 21 bp, Homo sapiens
aactgtctgaatattctagaa

SEQ ID NO: 5545749 - DNA, 22 bp, Homo sapiens
aactgtcttgagagaaaagaaa

SEQ ID NO: 5545750 - DNA, 13 bp, Homo sapiens
aactgtcttgttt

SEQ ID NO: 5545751 - DNA, 15 bp, Homo sapiens
aactgtcttgtttca

SEQ ID NO: 5545752 - DNA, 13 bp, Homo sapiens
aactgtctttcat

SEQ ID NO: 5545753 - DNA, 17 bp, Homo sapiens
aactgtgaaaaatcaga

SEQ ID NO: 5545754 - DNA, 16 bp, Homo sapiens
aactgtgaacctggag

SEQ ID NO: 5545755 - DNA, 17 bp, Homo sapiens
aactgtgaagtttacat

SEQ ID NO: 5545756 - DNA, 16 bp, Homo sapiens
aactgtgaatatgaga

SEQ ID NO: 5545757 - DNA, 18 bp, Homo sapiens
aactgtgaatatgagaaa

SEQ ID NO: 5545758 - DNA, 15 bp, Homo sapiens
aactgtgaatatgtg

SEQ ID NO: 5545759 - DNA, 21 bp, Homo sapiens
aactgtgaatgcttctgattt

SEQ ID NO: 5545760 - DNA, 15 bp, Homo sapiens
aactgtgacaggaag

SEQ ID NO: 5545761 - DNA, 16 bp, Homo sapiens
aactgtgacaggaagc

SEQ ID NO: 5545762 - DNA, 17 bp, Homo sapiens
aactgtgacattccaca

SEQ ID NO: 5545763 - DNA, 18 bp, Homo sapiens
aactgtgacattccacag

SEQ ID NO: 5545764 - DNA, 13 bp, Homo sapiens
aactgtgagataa

SEQ ID NO: 5545765 - DNA, 17 bp, Homo sapiens
aactgtgagataaatat

SEQ ID NO: 5545766 - DNA, 20 bp, Homo sapiens
aactgtgagataaatatcat

SEQ ID NO: 5545767 - DNA, 21 bp, Homo sapiens
aactgtgatggggtgggcagg

SEQ ID NO: 5545768 - DNA, 22 bp, Homo sapiens
aactgtgatggggtgggcaggg

SEQ ID NO: 5545769 - DNA, 16 bp, Homo sapiens
aactgtgatttcagga

SEQ ID NO: 5545770 - DNA, 19 bp, Homo sapiens
aactgtgatttttatcaca

SEQ ID NO: 5545771 - DNA, 18 bp, Homo sapiens
aactgtgcaactttttaa

SEQ ID NO: 5545772 - DNA, 22 bp, Homo sapiens
aactgtgcagagtctagaagtt

SEQ ID NO: 5545773 - DNA, 16 bp, Homo sapiens
aactgtgcattacaaa

SEQ ID NO: 5545774 - DNA, 18 bp, Homo sapiens
aactgtgccctgccttca

SEQ ID NO: 5545775 - DNA, 14 bp, Homo sapiens
aactgtgctcccac

SEQ ID NO: 5545776 - DNA, 13 bp, Homo sapiens
aactgtgcttctc

SEQ ID NO: 5545777 - DNA, 15 bp, Homo sapiens
aactgtgcttctcta

SEQ ID NO: 5545778 - DNA, 20 bp, Homo sapiens
aactgtgcttctctatgata

SEQ ID NO: 5545779 - DNA, 19 bp, Homo sapiens
aactgtggaatataaatag

SEQ ID NO: 5545780 - DNA, 13 bp, Homo sapiens
aactgtggaattt

SEQ ID NO: 5545781 - DNA, 15 bp, Homo sapiens
aactgtggaatttat

SEQ ID NO: 5545782 - DNA, 23 bp, Homo sapiens
aactgtggaatttattggcagcc

SEQ ID NO: 5545783 - DNA, 19 bp, Homo sapiens
aactgtggataaattttgg

SEQ ID NO: 5545784 - DNA, 13 bp, Homo sapiens
aactgtggatatt

SEQ ID NO: 5545785 - DNA, 12 bp, Homo sapiens
aactgtgggaag

SEQ ID NO: 5545786 - DNA, 19 bp, Homo sapiens
aactgtgggattctgattt

SEQ ID NO: 5545787 - DNA, 21 bp, Homo sapiens
aactgtgggattctgatttgt

SEQ ID NO: 5545788 - DNA, 20 bp, Homo sapiens
aactgtgtaaaccacataat

SEQ ID NO: 5545789 - DNA, 22 bp, Homo sapiens
aactgtgtaaaccacataattt

SEQ ID NO: 5545790 - DNA, 23 bp, Homo sapiens
aactgtgtacataactgaaaatg

SEQ ID NO: 5545791 - DNA, 15 bp, Homo sapiens
aactgtgtagcatct

SEQ ID NO: 5545792 - DNA, 20 bp, Homo sapiens
aactgtgtatcattaaaata

SEQ ID NO: 5545793 - DNA, 22 bp, Homo sapiens
aactgtgtatcattaaaatata

SEQ ID NO: 5545794 - DNA, 18 bp, Homo sapiens
aactgtgtatttatttaa

SEQ ID NO: 5545795 - DNA, 23 bp, Homo sapiens
aactgtgtatttatttaaaactc

SEQ ID NO: 5545796 - DNA, 15 bp, Homo sapiens
aactgtgtcacgcag

SEQ ID NO: 5545797 - DNA, 22 bp, Homo sapiens
aactgtgtgtaattgttccttt

SEQ ID NO: 5545798 - DNA, 14 bp, Homo sapiens
aactgtgtgtgaat

SEQ ID NO: 5545799 - DNA, 15 bp, Homo sapiens
aactgtgttgtatta

SEQ ID NO: 5545800 - DNA, 16 bp, Homo sapiens
aactgtgttgtattaa

SEQ ID NO: 5545801 - DNA, 18 bp, Homo sapiens
aactgtgttgtattaaca

SEQ ID NO: 5545802 - DNA, 16 bp, Homo sapiens
aactgtgtttcaaatg

SEQ ID NO: 5545803 - DNA, 19 bp, Homo sapiens
aactgtgtttcaagttcaa

SEQ ID NO: 5545804 - DNA, 19 bp, Homo sapiens
aactgttaaatgtggtttc

SEQ ID NO: 5545805 - DNA, 20 bp, Homo sapiens
aactgttacaacttgtattt

SEQ ID NO: 5545806 - DNA, 18 bp, Homo sapiens
aactgttaccattggaaa

SEQ ID NO: 5545807 - DNA, 19 bp, Homo sapiens
aactgttaccattggaaat

SEQ ID NO: 5545808 - DNA, 16 bp, Homo sapiens
aactgttagatgctga

SEQ ID NO: 5545809 - DNA, 15 bp, Homo sapiens
aactgttagcactgt

SEQ ID NO: 5545810 - DNA, 17 bp, Homo sapiens
aactgttagcactgttg

SEQ ID NO: 5545811 - DNA, 20 bp, Homo sapiens
aactgttagcactgttgatg

SEQ ID NO: 5545812 - DNA, 22 bp, Homo sapiens
aactgttagcactgttgatgta

SEQ ID NO: 5545813 - DNA, 14 bp, Homo sapiens
aactgttatgaaat

SEQ ID NO: 5545814 - DNA, 16 bp, Homo sapiens
aactgttatgaaataa

SEQ ID NO: 5545815 - DNA, 20 bp, Homo sapiens
aactgttatttataatcact

SEQ ID NO: 5545816 - DNA, 22 bp, Homo sapiens
aactgttatttataatcacttt

SEQ ID NO: 5545817 - DNA, 19 bp, Homo sapiens
aactgttcaagtgtcccca

SEQ ID NO: 5545818 - DNA, 17 bp, Homo sapiens
aactgttccccttggta

SEQ ID NO: 5545819 - DNA, 21 bp, Homo sapiens
aactgttctctattagacttt

SEQ ID NO: 5545820 - DNA, 21 bp, Homo sapiens
aactgttctggcctcagacca

SEQ ID NO: 5545821 - DNA, 14 bp, Homo sapiens
aactgttctgtgtg

SEQ ID NO: 5545822 - DNA, 13 bp, Homo sapiens
aactgttctttgc

SEQ ID NO: 5545823 - DNA, 17 bp, Homo sapiens
aactgttctttgcagtg

SEQ ID NO: 5545824 - DNA, 19 bp, Homo sapiens
aactgttgcacttttgaat

SEQ ID NO: 5545825 - DNA, 22 bp, Homo sapiens
aactgttgcacttttgaatgtc

SEQ ID NO: 5545826 - DNA, 19 bp, Homo sapiens
aactgttgcctaattggaa

SEQ ID NO: 5545827 - DNA, 20 bp, Homo sapiens
aactgttgcctaattggaaa

SEQ ID NO: 5545828 - DNA, 13 bp, Homo sapiens
aactgttgctcga

SEQ ID NO: 5545829 - DNA, 19 bp, Homo sapiens
aactgttggaagttcactg

SEQ ID NO: 5545830 - DNA, 15 bp, Homo sapiens
aactgttggagcccg

SEQ ID NO: 5545831 - DNA, 14 bp, Homo sapiens
aactgttgtataaa

SEQ ID NO: 5545832 - DNA, 19 bp, Homo sapiens
aactgttgtataaatttat

SEQ ID NO: 5545833 - DNA, 19 bp, Homo sapiens
aactgttgttactggaaga

SEQ ID NO: 5545834 - DNA, 13 bp, Homo sapiens
aactgttgttgaa

SEQ ID NO: 5545835 - DNA, 18 bp, Homo sapiens
aactgttgttgataagga

SEQ ID NO: 5545836 - DNA, 13 bp, Homo sapiens
aactgttgtttga

SEQ ID NO: 5545837 - DNA, 18 bp, Homo sapiens
aactgttgtttgatgtgt

SEQ ID NO: 5545838 - DNA, 19 bp, Homo sapiens
aactgttgtttgatgtgta

SEQ ID NO: 5545839 - DNA, 22 bp, Homo sapiens
aactgttgtttgatgtgtatgt

SEQ ID NO: 5545840 - DNA, 13 bp, Homo sapiens
aactgtttagatg

SEQ ID NO: 5545841 - DNA, 11 bp, Homo sapiens
aactgtttata

SEQ ID NO: 5545842 - DNA, 13 bp, Homo sapiens
aactgtttatata

SEQ ID NO: 5545843 - DNA, 16 bp, Homo sapiens
aactgtttatatgtgt

SEQ ID NO: 5545844 - DNA, 16 bp, Homo sapiens
aactgtttcaaagcca

SEQ ID NO: 5545845 - DNA, 21 bp, Homo sapiens
aactgtttcaagccctcctcc

SEQ ID NO: 5545846 - DNA, 18 bp, Homo sapiens
aactgtttccctgctgaa

SEQ ID NO: 5545847 - DNA, 14 bp, Homo sapiens
aactgtttccttca

SEQ ID NO: 5545848 - DNA, 13 bp, Homo sapiens
aactgtttctcag

SEQ ID NO: 5545849 - DNA, 22 bp, Homo sapiens
aactgtttgaaaacttcagaag

SEQ ID NO: 5545850 - DNA, 19 bp, Homo sapiens
aagaaaaataataaagtca

SEQ ID NO: 5545851 - DNA, 11 bp, Homo sapiens
aagaaaaatat

SEQ ID NO: 5545852 - DNA, 12 bp, Homo sapiens
aagaaaaatata

SEQ ID NO: 5545853 - DNA, 13 bp, Homo sapiens
aagaaaaatcaaa

SEQ ID NO: 5545854 - DNA, 12 bp, Homo sapiens
aagaaaaatcag

SEQ ID NO: 5545855 - DNA, 19 bp, Homo sapiens
aagaaaaatcatgtttgct

SEQ ID NO: 5545856 - DNA, 21 bp, Homo sapiens
aagaaaaatctcattatttca

SEQ ID NO: 5545857 - DNA, 21 bp, Homo sapiens
aagaaaaatgcctgtctctag

SEQ ID NO: 5545858 - DNA, 12 bp, Homo sapiens
aagaaaaattaa

SEQ ID NO: 5545859 - DNA, 18 bp, Homo sapiens
aagaaaaattaattagga

SEQ ID NO: 5545860 - DNA, 16 bp, Homo sapiens
aagaaaacaaactaaa

SEQ ID NO: 5545861 - DNA, 15 bp, Homo sapiens
aagaaaacaaagttc

SEQ ID NO: 5545862 - DNA, 22 bp, Homo sapiens
aagaaaacacaacattttaata

SEQ ID NO: 5545863 - DNA, 22 bp, Homo sapiens
aagaaaacacacaaaagattat

SEQ ID NO: 5545864 - DNA, 15 bp, Homo sapiens
aagaaaacagtacag

SEQ ID NO: 5545865 - DNA, 22 bp, Homo sapiens
aagaaaacagtacagaaggcaa

SEQ ID NO: 5545866 - DNA, 14 bp, Homo sapiens
aagaaaacatatat

SEQ ID NO: 5545867 - DNA, 13 bp, Homo sapiens
aagaaaacatcta

SEQ ID NO: 5545868 - DNA, 19 bp, Homo sapiens
aagaaaacatgtctgtgaa

SEQ ID NO: 5545869 - DNA, 18 bp, Homo sapiens
aagaaaacatttaacata

SEQ ID NO: 5545870 - DNA, 14 bp, Homo sapiens
aagaaaacattttg

SEQ ID NO: 5545871 - DNA, 11 bp, Homo sapiens
aagaaaaccaa

SEQ ID NO: 5545872 - DNA, 20 bp, Homo sapiens
aagaaaaccaccccttagat

SEQ ID NO: 5545873 - DNA, 21 bp, Homo sapiens
aagaaaacccaaagctctaag

SEQ ID NO: 5545874 - DNA, 16 bp, Homo sapiens
aagaaaacggaaatgt

SEQ ID NO: 5545875 - DNA, 14 bp, Homo sapiens
aagaaaactaacaa

SEQ ID NO: 5545876 - DNA, 20 bp, Homo sapiens
aagaaaactaacaaccaacc

SEQ ID NO: 5545877 - DNA, 12 bp, Homo sapiens
aagaaaactgcg

SEQ ID NO: 5545878 - DNA, 14 bp, Homo sapiens
aagaaaactggaaa

SEQ ID NO: 5545879 - DNA, 18 bp, Homo sapiens
aagaaaacttacagaaga

SEQ ID NO: 5545880 - DNA, 20 bp, Homo sapiens
aagaaaacttgaacaagaaa

SEQ ID NO: 5545881 - DNA, 17 bp, Homo sapiens
aagaaaagaattacaga

SEQ ID NO: 5545882 - DNA, 23 bp, Homo sapiens
aagaaaagagatattttaaaatg

SEQ ID NO: 5545883 - DNA, 11 bp, Homo sapiens
aagaaaagata

SEQ ID NO: 5545884 - DNA, 15 bp, Homo sapiens
aagaaaagataaaga

SEQ ID NO: 5545885 - DNA, 12 bp, Homo sapiens
aagaaaagattt

SEQ ID NO: 5545886 - DNA, 22 bp, Homo sapiens
aagaaaagattttaatcaagtt

SEQ ID NO: 5545887 - DNA, 11 bp, Homo sapiens
aagaaaagcac

SEQ ID NO: 5545888 - DNA, 16 bp, Homo sapiens
aagaaaagcactggga

SEQ ID NO: 5545889 - DNA, 15 bp, Homo sapiens
aagaaaagcactttt

SEQ ID NO: 5545890 - DNA, 18 bp, Homo sapiens
aagaaaagcacttttgtt

SEQ ID NO: 5545891 - DNA, 19 bp, Homo sapiens
aagaaaagcacttttgtta

SEQ ID NO: 5545892 - DNA, 19 bp, Homo sapiens
aagaaaagcactttttaaa

SEQ ID NO: 5545893 - DNA, 21 bp, Homo sapiens
aagaaaagcctgaactattta

SEQ ID NO: 5545894 - DNA, 23 bp, Homo sapiens
aagaaaagcgcgttgtgtatatt

SEQ ID NO: 5545895 - DNA, 17 bp, Homo sapiens
aagaaaaggaatgcaag

SEQ ID NO: 5545896 - DNA, 16 bp, Homo sapiens
aagaaaaggcaaaaga

SEQ ID NO: 5545897 - DNA, 17 bp, Homo sapiens
aagaaaaggcaaaagac

SEQ ID NO: 5545898 - DNA, 18 bp, Homo sapiens
aagaaaaggcaaaagact

SEQ ID NO: 5545899 - DNA, 23 bp, Homo sapiens
aagaaaaggttcttcttgggagt

SEQ ID NO: 5545900 - DNA, 15 bp, Homo sapiens
aagaaaagtattttg

SEQ ID NO: 5545901 - DNA, 17 bp, Homo sapiens
aagaaaagtattttgaa

SEQ ID NO: 5545902 - DNA, 22 bp, Homo sapiens
aagaaaagtattttgaagttta

SEQ ID NO: 5545903 - DNA, 16 bp, Homo sapiens
aagaaaagtggttgtt

SEQ ID NO: 5545904 - DNA, 14 bp, Homo sapiens
aagaaaagtgtgta

SEQ ID NO: 5545905 - DNA, 21 bp, Homo sapiens
aagaaaagttcttaaaacact

SEQ ID NO: 5545906 - DNA, 16 bp, Homo sapiens
aagaaaagtttaccat

SEQ ID NO: 5545907 - DNA, 14 bp, Homo sapiens
aagaaaataaaatt

SEQ ID NO: 5545908 - DNA, 12 bp, Homo sapiens
aagaaaataacc

SEQ ID NO: 5545909 - DNA, 13 bp, Homo sapiens
aagaaaatactta

SEQ ID NO: 5545910 - DNA, 20 bp, Homo sapiens
aagaaaatacttaaatgtta

SEQ ID NO: 5545911 - DNA, 12 bp, Homo sapiens
aagaaaatagat

SEQ ID NO: 5545912 - DNA, 13 bp, Homo sapiens
aagaaaatatttt

SEQ ID NO: 5545913 - DNA, 14 bp, Homo sapiens
aagaaaatattttg

SEQ ID NO: 5545914 - DNA, 13 bp, Homo sapiens
aagaaaatcaatg

SEQ ID NO: 5545915 - DNA, 13 bp, Homo sapiens
aagaaaatcactt

SEQ ID NO: 5545916 - DNA, 20 bp, Homo sapiens
aagaaaatcatattgcttct

SEQ ID NO: 5545917 - DNA, 15 bp, Homo sapiens
aagaaaatccttcag

SEQ ID NO: 5545918 - DNA, 22 bp, Homo sapiens
aagaaaatctattttgtaactt

SEQ ID NO: 5545919 - DNA, 12 bp, Homo sapiens
aagaaaatcttt

SEQ ID NO: 5545920 - DNA, 16 bp, Homo sapiens
aagaaaatgaaatgca

SEQ ID NO: 5545921 - DNA, 14 bp, Homo sapiens
aagaaaatgacttt

SEQ ID NO: 5545922 - DNA, 17 bp, Homo sapiens
aagaaaatgactttatt

SEQ ID NO: 5545923 - DNA, 17 bp, Homo sapiens
aagaaaatggaaagaag

SEQ ID NO: 5545924 - DNA, 12 bp, Homo sapiens
aagaaaatggtt

SEQ ID NO: 5545925 - DNA, 13 bp, Homo sapiens
aagaaaatgtctt

SEQ ID NO: 5545926 - DNA, 12 bp, Homo sapiens
aagaaaatgtgg

SEQ ID NO: 5545927 - DNA, 13 bp, Homo sapiens
aagaaaatgtggc

SEQ ID NO: 5545928 - DNA, 14 bp, Homo sapiens
aagaaaatgtgtaa

SEQ ID NO: 5545929 - DNA, 16 bp, Homo sapiens
aagaaaattacaaaaa

SEQ ID NO: 5545930 - DNA, 19 bp, Homo sapiens
aagaaaattagtaattgta

SEQ ID NO: 5545931 - DNA, 23 bp, Homo sapiens
aagaaaattctctcaagacttct

SEQ ID NO: 5545932 - DNA, 18 bp, Homo sapiens
aagaaaattgccaaaata

SEQ ID NO: 5545933 - DNA, 20 bp, Homo sapiens
aagaaaattgccaaaatata

SEQ ID NO: 5545934 - DNA, 13 bp, Homo sapiens
aagaaaattgcct

SEQ ID NO: 5545935 - DNA, 15 bp, Homo sapiens
aagaaaatttaaaaa

SEQ ID NO: 5545936 - DNA, 13 bp, Homo sapiens
aagaaaatttaat

SEQ ID NO: 5545937 - DNA, 16 bp, Homo sapiens
aagaaacaaagcaaat

SEQ ID NO: 5545938 - DNA, 14 bp, Homo sapiens
aagaaacaacagaa

SEQ ID NO: 5545939 - DNA, 13 bp, Homo sapiens
aagaaacaagctg

SEQ ID NO: 5545940 - DNA, 13 bp, Homo sapiens
aagaaacaataaa

SEQ ID NO: 5545941 - DNA, 22 bp, Homo sapiens
aagaaacacactgaggcaggga

SEQ ID NO: 5545942 - DNA, 14 bp, Homo sapiens
aagaaacacagcat

SEQ ID NO: 5545943 - DNA, 17 bp, Homo sapiens
aagaaacacagcatgca

SEQ ID NO: 5545944 - DNA, 15 bp, Homo sapiens
aagaaacaccagtgt

SEQ ID NO: 5545945 - DNA, 13 bp, Homo sapiens
aagaaacactaaa

SEQ ID NO: 5545946 - DNA, 16 bp, Homo sapiens
aagaaacactaaatta

SEQ ID NO: 5545947 - DNA, 14 bp, Homo sapiens
aagaaacactcaac

SEQ ID NO: 5545948 - DNA, 13 bp, Homo sapiens
aagaaacagaaga

SEQ ID NO: 5545949 - DNA, 22 bp, Homo sapiens
aagaaacagtgcgttgagtgta

SEQ ID NO: 5545950 - DNA, 11 bp, Homo sapiens
aagaaacattg

SEQ ID NO: 5545951 - DNA, 15 bp, Homo sapiens
aagaaacattgttaa

SEQ ID NO: 5545952 - DNA, 11 bp, Homo sapiens
aagaaacattt

SEQ ID NO: 5545953 - DNA, 13 bp, Homo sapiens
aagaaacatttcc

SEQ ID NO: 5545954 - DNA, 19 bp, Homo sapiens
aagaaaccaagtgggctgg

SEQ ID NO: 5545955 - DNA, 20 bp, Homo sapiens
aagaaaccacaggttccata

SEQ ID NO: 5545956 - DNA, 20 bp, Homo sapiens
aagaaaccatgcaaagcaac

SEQ ID NO: 5545957 - DNA, 19 bp, Homo sapiens
aagaaaccatttttaatga

SEQ ID NO: 5545958 - DNA, 21 bp, Homo sapiens
aagaaaccatttttaatgaga

SEQ ID NO: 5545959 - DNA, 11 bp, Homo sapiens
aagaaacccaa

SEQ ID NO: 5545960 - DNA, 23 bp, Homo sapiens
aagaaaccccaagcagcattcag

SEQ ID NO: 5545961 - DNA, 18 bp, Homo sapiens
aagaaacccgacagaggg

SEQ ID NO: 5545962 - DNA, 15 bp, Homo sapiens
aagaaacctactgcc

SEQ ID NO: 5545963 - DNA, 16 bp, Homo sapiens
aagaaacctactgccc

SEQ ID NO: 5545964 - DNA, 17 bp, Homo sapiens
aagaaaccttgctctcc

SEQ ID NO: 5545965 - DNA, 13 bp, Homo sapiens
aagaaacctttta

SEQ ID NO: 5545966 - DNA, 21 bp, Homo sapiens
aagaaacgtctatgtgtacag

SEQ ID NO: 5545967 - DNA, 17 bp, Homo sapiens
aagaaactaaaaatata

SEQ ID NO: 5545968 - DNA, 21 bp, Homo sapiens
aagaaactagtaagaaacaat

SEQ ID NO: 5545969 - DNA, 17 bp, Homo sapiens
aagaaactatacatcat

SEQ ID NO: 5545970 - DNA, 21 bp, Homo sapiens
aagaaactattttttaaaaat

SEQ ID NO: 5545971 - DNA, 19 bp, Homo sapiens
aagaaactctatggtctta

SEQ ID NO: 5545972 - DNA, 13 bp, Homo sapiens
aagaaactgaatg

SEQ ID NO: 5545973 - DNA, 14 bp, Homo sapiens
aagaaactgaatga

SEQ ID NO: 5545974 - DNA, 20 bp, Homo sapiens
aagaaactgaggaattttct

SEQ ID NO: 5545975 - DNA, 19 bp, Homo sapiens
aagaaactgcttacagttt

SEQ ID NO: 5545976 - DNA, 21 bp, Homo sapiens
aagaaactggggctcctccag

SEQ ID NO: 5545977 - DNA, 13 bp, Homo sapiens
aagaaacttgaag

SEQ ID NO: 5545978 - DNA, 17 bp, Homo sapiens
aagaaacttgaagcttt

SEQ ID NO: 5545979 - DNA, 20 bp, Homo sapiens
aagaaacttgatattgaggt

SEQ ID NO: 5545980 - DNA, 10 bp, Homo sapiens
aagaaacttt

SEQ ID NO: 5545981 - DNA, 15 bp, Homo sapiens
aagaaactttggaag

SEQ ID NO: 5545982 - DNA, 14 bp, Homo sapiens
aagaaactttgttt

SEQ ID NO: 5545983 - DNA, 11 bp, Homo sapiens
aagaaactttt

SEQ ID NO: 5545984 - DNA, 13 bp, Homo sapiens
aagaaacttttct

SEQ ID NO: 5545985 - DNA, 17 bp, Homo sapiens
aagaaacttttgaaaaa

SEQ ID NO: 5545986 - DNA, 18 bp, Homo sapiens
aagaaacttttgtaaaga

SEQ ID NO: 5545987 - DNA, 21 bp, Homo sapiens
aagaaactttttaataaagta

SEQ ID NO: 5545988 - DNA, 13 bp, Homo sapiens
aagaaagaaaatc

SEQ ID NO: 5545989 - DNA, 14 bp, Homo sapiens
aagaaagaaaatca

SEQ ID NO: 5545990 - DNA, 16 bp, Homo sapiens
aagaaagaaaatcagg

SEQ ID NO: 5545991 - DNA, 13 bp, Homo sapiens
aagaaagaaagga

SEQ ID NO: 5545992 - DNA, 13 bp, Homo sapiens
aagaaagaaatgc

SEQ ID NO: 5545993 - DNA, 15 bp, Homo sapiens
aagaaagaacatttt

SEQ ID NO: 5545994 - DNA, 14 bp, Homo sapiens
aagaaagaacggaa

SEQ ID NO: 5545995 - DNA, 16 bp, Homo sapiens
aagaaagaactatctt

SEQ ID NO: 5545996 - DNA, 15 bp, Homo sapiens
aagaaagaagactgt

SEQ ID NO: 5545997 - DNA, 12 bp, Homo sapiens
aagaaagaagca

SEQ ID NO: 5545998 - DNA, 13 bp, Homo sapiens
aagaaagaagcat

SEQ ID NO: 5545999 - DNA, 20 bp, Homo sapiens
aagaaagaatgttactgcct

SEQ ID NO: 5546000 - DNA, 12 bp, Homo sapiens
aagaaagacatc

SEQ ID NO: 5546001 - DNA, 20 bp, Homo sapiens
aagaaagacgcactttggct

SEQ ID NO: 5546002 - DNA, 22 bp, Homo sapiens
aagaaagactatctaaatgttg

SEQ ID NO: 5546003 - DNA, 17 bp, Homo sapiens
aagaaagagaaagtact

SEQ ID NO: 5546004 - DNA, 14 bp, Homo sapiens
aagaaagagaatga

SEQ ID NO: 5546005 - DNA, 17 bp, Homo sapiens
aagaaagagaatgaact

SEQ ID NO: 5546006 - DNA, 18 bp, Homo sapiens
aagaaagagaatgaactg

SEQ ID NO: 5546007 - DNA, 21 bp, Homo sapiens
aagaaagagaatgaactgtgg

SEQ ID NO: 5546008 - DNA, 12 bp, Homo sapiens
aagaaagagaga

SEQ ID NO: 5546009 - DNA, 13 bp, Homo sapiens
aagaaagagagaa

SEQ ID NO: 5546010 - DNA, 14 bp, Homo sapiens
aagaaagagagaaa

SEQ ID NO: 5546011 - DNA, 23 bp, Homo sapiens
aagaaagagcaacaatccatctc

SEQ ID NO: 5546012 - DNA, 18 bp, Homo sapiens
aagaaagagggaaaaaga

SEQ ID NO: 5546013 - DNA, 14 bp, Homo sapiens
aagaaagatgctga

SEQ ID NO: 5546014 - DNA, 16 bp, Homo sapiens
aagaaagatgctgatg

SEQ ID NO: 5546015 - DNA, 17 bp, Homo sapiens
aagaaagatgtatatag

SEQ ID NO: 5546016 - DNA, 21 bp, Homo sapiens
aagaaagatttgttactgtat

SEQ ID NO: 5546017 - DNA, 15 bp, Homo sapiens
aagaaagcaaaaaat

SEQ ID NO: 5546018 - DNA, 15 bp, Homo sapiens
aagaaagcaaataag

SEQ ID NO: 5546019 - DNA, 18 bp, Homo sapiens
aagaaagcacctgttttt

SEQ ID NO: 5546020 - DNA, 12 bp, Homo sapiens
aagaaagcactt

SEQ ID NO: 5546021 - DNA, 17 bp, Homo sapiens
aagaaagccagacaact

SEQ ID NO: 5546022 - DNA, 15 bp, Homo sapiens
aagaaagccctgtgc

SEQ ID NO: 5546023 - DNA, 17 bp, Homo sapiens
aagaaagccctgtgctt

SEQ ID NO: 5546024 - DNA, 13 bp, Homo sapiens
aagaaagcctgag

SEQ ID NO: 5546025 - DNA, 22 bp, Homo sapiens
aagaaagcctgagtactccaca

SEQ ID NO: 5546026 - DNA, 12 bp, Homo sapiens
aagaaagcttcc

SEQ ID NO: 5546027 - DNA, 13 bp, Homo sapiens
aagaaaggaaaga

SEQ ID NO: 5546028 - DNA, 16 bp, Homo sapiens
aagaaaggaaagaagg

SEQ ID NO: 5546029 - DNA, 12 bp, Homo sapiens
aagaaaggaggg

SEQ ID NO: 5546030 - DNA, 16 bp, Homo sapiens
aagaaaggaggggaga

SEQ ID NO: 5546031 - DNA, 10 bp, Homo sapiens
aagaaaggat

SEQ ID NO: 5546032 - DNA, 17 bp, Homo sapiens
aagaaaggatataaaag

SEQ ID NO: 5546033 - DNA, 22 bp, Homo sapiens
aagacacgtggcctcgtgaggg

SEQ ID NO: 5546034 - DNA, 17 bp, Homo sapiens
aagacacgtgtttttgt

SEQ ID NO: 5546035 - DNA, 22 bp, Homo sapiens
aagacactaattccttaaatga

SEQ ID NO: 5546036 - DNA, 14 bp, Homo sapiens
aagacactgaaata

SEQ ID NO: 5546037 - DNA, 21 bp, Homo sapiens
aagacactgaaatatacacac

SEQ ID NO: 5546038 - DNA, 14 bp, Homo sapiens
aagacactgcctgg

SEQ ID NO: 5546039 - DNA, 14 bp, Homo sapiens
aagacactgtgaga

SEQ ID NO: 5546040 - DNA, 20 bp, Homo sapiens
aagacactgtgcaggcccag

SEQ ID NO: 5546041 - DNA, 18 bp, Homo sapiens
aagacacttatattttga

SEQ ID NO: 5546042 - DNA, 22 bp, Homo sapiens
aagacacttcaatgggagtgaa

SEQ ID NO: 5546043 - DNA, 15 bp, Homo sapiens
aagacacttgctgag

SEQ ID NO: 5546044 - DNA, 14 bp, Homo sapiens
aagacagaaaagtg

SEQ ID NO: 5546045 - DNA, 19 bp, Homo sapiens
aagacagaaaagtgcctga

SEQ ID NO: 5546046 - DNA, 12 bp, Homo sapiens
aagacagaagcc

SEQ ID NO: 5546047 - DNA, 13 bp, Homo sapiens
aagacagaagcct

SEQ ID NO: 5546048 - DNA, 18 bp, Homo sapiens
aagacagagaaaacttgc

SEQ ID NO: 5546049 - DNA, 20 bp, Homo sapiens
aagacagagaaaacttgcct

SEQ ID NO: 5546050 - DNA, 20 bp, Homo sapiens
aagacagagaaacagacaga

SEQ ID NO: 5546051 - DNA, 16 bp, Homo sapiens
aagacagagacgcagg

SEQ ID NO: 5546052 - DNA, 13 bp, Homo sapiens
aagacagagcagg

SEQ ID NO: 5546053 - DNA, 23 bp, Homo sapiens
aagacagagcaggctttgtgaga

SEQ ID NO: 5546054 - DNA, 22 bp, Homo sapiens
aagacagagccccaccctcaga

SEQ ID NO: 5546055 - DNA, 16 bp, Homo sapiens
aagacagagctgggat

SEQ ID NO: 5546056 - DNA, 13 bp, Homo sapiens
aagacagagggga

SEQ ID NO: 5546057 - DNA, 12 bp, Homo sapiens
aagacagagtct

SEQ ID NO: 5546058 - DNA, 22 bp, Homo sapiens
aagacagagtcttgctctgtct

SEQ ID NO: 5546059 - DNA, 17 bp, Homo sapiens
aagacagatgccccaga

SEQ ID NO: 5546060 - DNA, 20 bp, Homo sapiens
aagacagatgccccagagct

SEQ ID NO: 5546061 - DNA, 21 bp, Homo sapiens
aagacagattttcggaacaca

SEQ ID NO: 5546062 - DNA, 14 bp, Homo sapiens
aagacagcagagcc

SEQ ID NO: 5546063 - DNA, 15 bp, Homo sapiens
aagacagcagcagcc

SEQ ID NO: 5546064 - DNA, 16 bp, Homo sapiens
aagacagcagcagcct

SEQ ID NO: 5546065 - DNA, 18 bp, Homo sapiens
aagacagcagcagcctgc

SEQ ID NO: 5546066 - DNA, 21 bp, Homo sapiens
aagacagcagcagcctgcacc

SEQ ID NO: 5546067 - DNA, 16 bp, Homo sapiens
aagacagcatttgtgt

SEQ ID NO: 5546068 - DNA, 19 bp, Homo sapiens
aagacagccacttttagct

SEQ ID NO: 5546069 - DNA, 19 bp, Homo sapiens
aagacagctcttcttgaaa

SEQ ID NO: 5546070 - DNA, 22 bp, Homo sapiens
aagacagctggcggaggctgct

SEQ ID NO: 5546071 - DNA, 12 bp, Homo sapiens
aagacagcttcc

SEQ ID NO: 5546072 - DNA, 14 bp, Homo sapiens
aagacagcttccca

SEQ ID NO: 5546073 - DNA, 21 bp, Homo sapiens
aagacaggaaagttcagagtt

SEQ ID NO: 5546074 - DNA, 22 bp, Homo sapiens
aagacaggagagattatttaca

SEQ ID NO: 5546075 - DNA, 17 bp, Homo sapiens
aagacaggcacaaaatg

SEQ ID NO: 5546076 - DNA, 19 bp, Homo sapiens
aagacagggaatagtggga

SEQ ID NO: 5546077 - DNA, 19 bp, Homo sapiens
aagacagggtgggagggag

SEQ ID NO: 5546078 - DNA, 21 bp, Homo sapiens
aagacagggtgggagggagga

SEQ ID NO: 5546079 - DNA, 15 bp, Homo sapiens
aagacagtatttatt

SEQ ID NO: 5546080 - DNA, 17 bp, Homo sapiens
aagacagtgccctgaga

SEQ ID NO: 5546081 - DNA, 20 bp, Homo sapiens
aagacagtggcagcaaagga

SEQ ID NO: 5546082 - DNA, 19 bp, Homo sapiens
aagacagtgtacaaaactg

SEQ ID NO: 5546083 - DNA, 21 bp, Homo sapiens
aagacagtgtatgtagaagca

SEQ ID NO: 5546084 - DNA, 18 bp, Homo sapiens
aagacagttgggatccaa

SEQ ID NO: 5546085 - DNA, 14 bp, Homo sapiens
aagacataaaactt

SEQ ID NO: 5546086 - DNA, 18 bp, Homo sapiens
aagacataaaactttaaa

SEQ ID NO: 5546087 - DNA, 22 bp, Homo sapiens
aagacataaacaaagacattga

SEQ ID NO: 5546088 - DNA, 14 bp, Homo sapiens
aagacataacgttt

SEQ ID NO: 5546089 - DNA, 21 bp, Homo sapiens
aagacataacgtttttccttt

SEQ ID NO: 5546090 - DNA, 23 bp, Homo sapiens
aagacatactccttccatcaaat

SEQ ID NO: 5546091 - DNA, 13 bp, Homo sapiens
aagacatatatta

SEQ ID NO: 5546092 - DNA, 17 bp, Homo sapiens
aagacatatattatata

SEQ ID NO: 5546093 - DNA, 14 bp, Homo sapiens
aagacatatcatgt

SEQ ID NO: 5546094 - DNA, 18 bp, Homo sapiens
aagacatatcatgtgtga

SEQ ID NO: 5546095 - DNA, 15 bp, Homo sapiens
aagacatcaatgaaa

SEQ ID NO: 5546096 - DNA, 20 bp, Homo sapiens
aagacatcacatccctctcc

SEQ ID NO: 5546097 - DNA, 17 bp, Homo sapiens
aagacatccataaagaa

SEQ ID NO: 5546098 - DNA, 21 bp, Homo sapiens
aagacatctgaggaaaatgga

SEQ ID NO: 5546099 - DNA, 19 bp, Homo sapiens
aagacatgcatttttaaaa

SEQ ID NO: 5546100 - DNA, 18 bp, Homo sapiens
aagacatgcttacttttt

SEQ ID NO: 5546101 - DNA, 14 bp, Homo sapiens
aagacatgcttggg

SEQ ID NO: 5546102 - DNA, 16 bp, Homo sapiens
aagacatgctttccat

SEQ ID NO: 5546103 - DNA, 13 bp, Homo sapiens
aagacatggaaga

SEQ ID NO: 5546104 - DNA, 20 bp, Homo sapiens
aagacatggaagattagagg

SEQ ID NO: 5546105 - DNA, 22 bp, Homo sapiens
aagacatggaaggttagaggtt

SEQ ID NO: 5546106 - DNA, 20 bp, Homo sapiens
aagacatggaaggttaggtt

SEQ ID NO: 5546107 - DNA, 19 bp, Homo sapiens
aagacatggggaggaagga

SEQ ID NO: 5546108 - DNA, 16 bp, Homo sapiens
aagacatgtaggtgtt

SEQ ID NO: 5546109 - DNA, 23 bp, Homo sapiens
aagacatgtgaggaggaaaagga

SEQ ID NO: 5546110 - DNA, 19 bp, Homo sapiens
aagacatgttgtaaattag

SEQ ID NO: 5546111 - DNA, 21 bp, Homo sapiens
aagacattaagagaacaaaga

SEQ ID NO: 5546112 - DNA, 18 bp, Homo sapiens
aagacattagagaaaacc

SEQ ID NO: 5546113 - DNA, 20 bp, Homo sapiens
aagacattagagaaaacctt

SEQ ID NO: 5546114 - DNA, 22 bp, Homo sapiens
aagacattagagaaaaccttaa

SEQ ID NO: 5546115 - DNA, 23 bp, Homo sapiens
aagacattagagaaaaccttaaa

SEQ ID NO: 5546116 - DNA, 18 bp, Homo sapiens
aagacattgggtctattc

SEQ ID NO: 5546117 - DNA, 14 bp, Homo sapiens
aagacattgtcaat

SEQ ID NO: 5546118 - DNA, 21 bp, Homo sapiens
aagacattgtttttaaaaaaa

SEQ ID NO: 5546119 - DNA, 14 bp, Homo sapiens
aagacatttaaaat

SEQ ID NO: 5546120 - DNA, 20 bp, Homo sapiens
aagacatttcaaataactgc

SEQ ID NO: 5546121 - DNA, 12 bp, Homo sapiens
aagacatttctt

SEQ ID NO: 5546122 - DNA, 16 bp, Homo sapiens
aagacatttgatagaa

SEQ ID NO: 5546123 - DNA, 17 bp, Homo sapiens
aagacatttgatagaaa

SEQ ID NO: 5546124 - DNA, 18 bp, Homo sapiens
aagacatttgatagaaag

SEQ ID NO: 5546125 - DNA, 15 bp, Homo sapiens
aagacatttgctgaa

SEQ ID NO: 5546126 - DNA, 13 bp, Homo sapiens
aagacatttgtat

SEQ ID NO: 5546127 - DNA, 17 bp, Homo sapiens
aagacatttgtatattg

SEQ ID NO: 5546128 - DNA, 18 bp, Homo sapiens
aagacattttgtttttac

SEQ ID NO: 5546129 - DNA, 14 bp, Homo sapiens
aagacatttttcat

SEQ ID NO: 5546130 - DNA, 15 bp, Homo sapiens
aagacatttttcatt

SEQ ID NO: 5546131 - DNA, 16 bp, Homo sapiens
aagacatttttcattc

SEQ ID NO: 5546132 - DNA, 21 bp, Homo sapiens
aagacatttttcattcatgaa

SEQ ID NO: 5546133 - DNA, 22 bp, Homo sapiens
aagacatttttcattcatgaat

SEQ ID NO: 5546134 - DNA, 20 bp, Homo sapiens
aagacattttttaaaagcct

SEQ ID NO: 5546135 - DNA, 15 bp, Homo sapiens
aagacattttttgct

SEQ ID NO: 5546136 - DNA, 14 bp, Homo sapiens
aagaccaaaatgaa

SEQ ID NO: 5546137 - DNA, 12 bp, Homo sapiens
aagaccaaagag

SEQ ID NO: 5546138 - DNA, 21 bp, Homo sapiens
aagaccaagacttttgtctga

SEQ ID NO: 5546139 - DNA, 17 bp, Homo sapiens
aagaccaagtcctcaaa

SEQ ID NO: 5546140 - DNA, 14 bp, Homo sapiens
aagaccaataaact

SEQ ID NO: 5546141 - DNA, 18 bp, Homo sapiens
aagaccaccacttcgaaa

SEQ ID NO: 5546142 - DNA, 18 bp, Homo sapiens
aagaccaccttcccttcc

SEQ ID NO: 5546143 - DNA, 21 bp, Homo sapiens
aagaccagaattcccttgaat

SEQ ID NO: 5546144 - DNA, 17 bp, Homo sapiens
aagaccagcctgtccaa

SEQ ID NO: 5546145 - DNA, 17 bp, Homo sapiens
aagaccaggctgcagcc

SEQ ID NO: 5546146 - DNA, 12 bp, Homo sapiens
aagaccagggct

SEQ ID NO: 5546147 - DNA, 16 bp, Homo sapiens
aagaccagtcacagcc

SEQ ID NO: 5546148 - DNA, 17 bp, Homo sapiens
aagaccatgcattcaga

SEQ ID NO: 5546149 - DNA, 13 bp, Homo sapiens
aagaccatttaat

SEQ ID NO: 5546150 - DNA, 13 bp, Homo sapiens
aagaccatttttc

SEQ ID NO: 5546151 - DNA, 15 bp, Homo sapiens
aagacccaaaacagc

SEQ ID NO: 5546152 - DNA, 21 bp, Homo sapiens
aagacccaaaacagctttgtc

SEQ ID NO: 5546153 - DNA, 18 bp, Homo sapiens
aagacccaacttgccaaa

SEQ ID NO: 5546154 - DNA, 23 bp, Homo sapiens
aagacccaactttctcactgctg

SEQ ID NO: 5546155 - DNA, 23 bp, Homo sapiens
aagacccactgaatctgagaaag

SEQ ID NO: 5546156 - DNA, 21 bp, Homo sapiens
aagacccagacaggactgcag

SEQ ID NO: 5546157 - DNA, 14 bp, Homo sapiens
aagacccagcagat

SEQ ID NO: 5546158 - DNA, 17 bp, Homo sapiens
aagacccagcaggaagc

SEQ ID NO: 5546159 - DNA, 17 bp, Homo sapiens
aagacccagtgtaaaga

SEQ ID NO: 5546160 - DNA, 17 bp, Homo sapiens
aagaccccactggagtc

SEQ ID NO: 5546161 - DNA, 18 bp, Homo sapiens
aagaccccaggaagtcat

SEQ ID NO: 5546162 - DNA, 17 bp, Homo sapiens
aagacccccatctctgc

SEQ ID NO: 5546163 - DNA, 20 bp, Homo sapiens
aagacccccatttgtcccag

SEQ ID NO: 5546164 - DNA, 16 bp, Homo sapiens
aagaccctaggtgctc

SEQ ID NO: 5546165 - DNA, 19 bp, Homo sapiens
aagaccctatctcccacaa

SEQ ID NO: 5546166 - DNA, 15 bp, Homo sapiens
aagaccctcagttat

SEQ ID NO: 5546167 - DNA, 21 bp, Homo sapiens
aagaccctcttgcccatcctg

SEQ ID NO: 5546168 - DNA, 15 bp, Homo sapiens
aagaccctgagactc

SEQ ID NO: 5546169 - DNA, 15 bp, Homo sapiens
aagaccctggtctga

SEQ ID NO: 5546170 - DNA, 16 bp, Homo sapiens
aagaccctgtctcaaa

SEQ ID NO: 5546171 - DNA, 13 bp, Homo sapiens
aagaccctgtgtc

SEQ ID NO: 5546172 - DNA, 18 bp, Homo sapiens
aagacccttgtggtccca

SEQ ID NO: 5546173 - DNA, 21 bp, Homo sapiens
aagacccttgtggtcccaccc

SEQ ID NO: 5546174 - DNA, 22 bp, Homo sapiens
aagacccttgtggtcccacccc

SEQ ID NO: 5546175 - DNA, 14 bp, Homo sapiens
aagaccctttcaga

SEQ ID NO: 5546176 - DNA, 14 bp, Homo sapiens
aagaccctttgttg

SEQ ID NO: 5546177 - DNA, 14 bp, Homo sapiens
aagaccgccccagg

SEQ ID NO: 5546178 - DNA, 17 bp, Homo sapiens
aagaccgccccagggct

SEQ ID NO: 5546179 - DNA, 15 bp, Homo sapiens
aagaccgccccccgc

SEQ ID NO: 5546180 - DNA, 17 bp, Homo sapiens
aagacctaaatgacctc

SEQ ID NO: 5546181 - DNA, 20 bp, Homo sapiens
aagacctaaatgacctcagc

SEQ ID NO: 5546182 - DNA, 20 bp, Homo sapiens
aagacctactgttctaaagc

SEQ ID NO: 5546183 - DNA, 16 bp, Homo sapiens
aagacctcacctagaa

SEQ ID NO: 5546184 - DNA, 13 bp, Homo sapiens
aagacctcatctc

SEQ ID NO: 5546185 - DNA, 17 bp, Homo sapiens
aagacctccctgtgaga

SEQ ID NO: 5546186 - DNA, 17 bp, Homo sapiens
aagacctcgtctttgct

SEQ ID NO: 5546187 - DNA, 24 bp, Homo sapiens
aagacctcgtctttgcttgtcctg

SEQ ID NO: 5546188 - DNA, 13 bp, Homo sapiens
aagacctctgtga

SEQ ID NO: 5546189 - DNA, 22 bp, Homo sapiens
aagacctgaaagagaggactgg

SEQ ID NO: 5546190 - DNA, 12 bp, Homo sapiens
aagacctgagta

SEQ ID NO: 5546191 - DNA, 15 bp, Homo sapiens
aagacctgagtattt

SEQ ID NO: 5546192 - DNA, 16 bp, Homo sapiens
aagacctgagtatttt

SEQ ID NO: 5546193 - DNA, 11 bp, Homo sapiens
aagacctgcct

SEQ ID NO: 5546194 - DNA, 12 bp, Homo sapiens
aagacctggcaa

SEQ ID NO: 5546195 - DNA, 21 bp, Homo sapiens
aagacctggcaaggacacaga

SEQ ID NO: 5546196 - DNA, 23 bp, Homo sapiens
aagacctggggctgctgtgaagc

SEQ ID NO: 5546197 - DNA, 19 bp, Homo sapiens
aagacctgttggttccaag

SEQ ID NO: 5546198 - DNA, 15 bp, Homo sapiens
aagaccttctcccta

SEQ ID NO: 5546199 - DNA, 22 bp, Homo sapiens
aagaccttctccctagcccttc

SEQ ID NO: 5546200 - DNA, 15 bp, Homo sapiens
aagaccttctccttc

SEQ ID NO: 5546201 - DNA, 18 bp, Homo sapiens
aagaccttctccttcacc

SEQ ID NO: 5546202 - DNA, 19 bp, Homo sapiens
aagaccttctccttcacct

SEQ ID NO: 5546203 - DNA, 18 bp, Homo sapiens
aagaccttgtgtgtatgt

SEQ ID NO: 5546204 - DNA, 22 bp, Homo sapiens
aagaccttgtgtgtatgtgtac

SEQ ID NO: 5546205 - DNA, 19 bp, Homo sapiens
aagacctttattcacccct

SEQ ID NO: 5546206 - DNA, 20 bp, Homo sapiens
aagacctttattcacccctg

SEQ ID NO: 5546207 - DNA, 14 bp, Homo sapiens
aagacgactacaga

SEQ ID NO: 5546208 - DNA, 23 bp, Homo sapiens
aagacgaggggcagggaaggaca

SEQ ID NO: 5546209 - DNA, 17 bp, Homo sapiens
aagacgatacagcttgg

SEQ ID NO: 5546210 - DNA, 18 bp, Homo sapiens
aagagccttccacccagg

SEQ ID NO: 5546211 - DNA, 20 bp, Homo sapiens
aagagccttggtgtccacct

SEQ ID NO: 5546212 - DNA, 21 bp, Homo sapiens
aagagcgatacacaaagcttt

SEQ ID NO: 5546213 - DNA, 20 bp, Homo sapiens
aagagcgctcctctgccttg

SEQ ID NO: 5546214 - DNA, 15 bp, Homo sapiens
aagagctaataaatc

SEQ ID NO: 5546215 - DNA, 15 bp, Homo sapiens
aagagctaggaaaga

SEQ ID NO: 5546216 - DNA, 13 bp, Homo sapiens
aagagctattgcc

SEQ ID NO: 5546217 - DNA, 14 bp, Homo sapiens
aagagctattttag

SEQ ID NO: 5546218 - DNA, 19 bp, Homo sapiens
aagagctattttagaaagc

SEQ ID NO: 5546219 - DNA, 14 bp, Homo sapiens
aagagctcaggaga

SEQ ID NO: 5546220 - DNA, 19 bp, Homo sapiens
aagagctcaggagaaggcc

SEQ ID NO: 5546221 - DNA, 13 bp, Homo sapiens
aagagctctccag

SEQ ID NO: 5546222 - DNA, 21 bp, Homo sapiens
aagagctcttcggtttctgag

SEQ ID NO: 5546223 - DNA, 15 bp, Homo sapiens
aagagctcttggccc

SEQ ID NO: 5546224 - DNA, 20 bp, Homo sapiens
aagagctctttgtctcacca

SEQ ID NO: 5546225 - DNA, 11 bp, Homo sapiens
aagagctgagg

SEQ ID NO: 5546226 - DNA, 13 bp, Homo sapiens
aagagctgccctc

SEQ ID NO: 5546227 - DNA, 14 bp, Homo sapiens
aagagctgcctgga

SEQ ID NO: 5546228 - DNA, 15 bp, Homo sapiens
aagagctgcctggat

SEQ ID NO: 5546229 - DNA, 12 bp, Homo sapiens
aagagctgctgt

SEQ ID NO: 5546230 - DNA, 15 bp, Homo sapiens
aagagctgctgtatt

SEQ ID NO: 5546231 - DNA, 14 bp, Homo sapiens
aagagctgggatcc

SEQ ID NO: 5546232 - DNA, 21 bp, Homo sapiens
aagagctgggtaccaggccac

SEQ ID NO: 5546233 - DNA, 16 bp, Homo sapiens
aagagctgtcctggta

SEQ ID NO: 5546234 - DNA, 11 bp, Homo sapiens
aagagctgtct

SEQ ID NO: 5546235 - DNA, 22 bp, Homo sapiens
aagagctgtctatgcagcctgc

SEQ ID NO: 5546236 - DNA, 23 bp, Homo sapiens
aagagctgtctatgcagcctgct

SEQ ID NO: 5546237 - DNA, 12 bp, Homo sapiens
aagagctgtctg

SEQ ID NO: 5546238 - DNA, 13 bp, Homo sapiens
aagagctgtcttc

SEQ ID NO: 5546239 - DNA, 21 bp, Homo sapiens
aagagctgttatgctgtttcc

SEQ ID NO: 5546240 - DNA, 13 bp, Homo sapiens
aagagctgttctt

SEQ ID NO: 5546241 - DNA, 17 bp, Homo sapiens
aagagctgttttggatg

SEQ ID NO: 5546242 - DNA, 14 bp, Homo sapiens
aagagcttaagaac

SEQ ID NO: 5546243 - DNA, 13 bp, Homo sapiens
aagagcttagaaa

SEQ ID NO: 5546244 - DNA, 21 bp, Homo sapiens
aagagcttagaaactggaaat

SEQ ID NO: 5546245 - DNA, 17 bp, Homo sapiens
aagagcttccagaaatg

SEQ ID NO: 5546246 - DNA, 14 bp, Homo sapiens
aagagcttccagag

SEQ ID NO: 5546247 - DNA, 23 bp, Homo sapiens
aagagcttgctccagattctgat

SEQ ID NO: 5546248 - DNA, 16 bp, Homo sapiens
aagagcttgctttgat

SEQ ID NO: 5546249 - DNA, 21 bp, Homo sapiens
aagagcttgtgtcctgtcctt

SEQ ID NO: 5546250 - DNA, 17 bp, Homo sapiens
aagagctttacaaaaag

SEQ ID NO: 5546251 - DNA, 22 bp, Homo sapiens
aagaggaaaagctgtaagaaaa

SEQ ID NO: 5546252 - DNA, 19 bp, Homo sapiens
aagaggaaaagtgcaatgc

SEQ ID NO: 5546253 - DNA, 14 bp, Homo sapiens
aagaggaaaatgaa

SEQ ID NO: 5546254 - DNA, 17 bp, Homo sapiens
aagaggaaaggcgcccc

SEQ ID NO: 5546255 - DNA, 18 bp, Homo sapiens
aagaggaaaggcgccccc

SEQ ID NO: 5546256 - DNA, 20 bp, Homo sapiens
aagaggaaattaaataattt

SEQ ID NO: 5546257 - DNA, 22 bp, Homo sapiens
aagaggaacagcactggggagt

SEQ ID NO: 5546258 - DNA, 18 bp, Homo sapiens
aagaggaacagtgtggtt

SEQ ID NO: 5546259 - DNA, 16 bp, Homo sapiens
aagaggaagaaattca

SEQ ID NO: 5546260 - DNA, 18 bp, Homo sapiens
aagaggaagaaattcagg

SEQ ID NO: 5546261 - DNA, 19 bp, Homo sapiens
aagaggaagaaattcaggt

SEQ ID NO: 5546262 - DNA, 14 bp, Homo sapiens
aagaggaagcaaat

SEQ ID NO: 5546263 - DNA, 15 bp, Homo sapiens
aagaggaagcaagaa

SEQ ID NO: 5546264 - DNA, 17 bp, Homo sapiens
aagaggaagttcagatc

SEQ ID NO: 5546265 - DNA, 14 bp, Homo sapiens
aagaggaatctgtt

SEQ ID NO: 5546266 - DNA, 22 bp, Homo sapiens
aagaggaatctgtttctctgct

SEQ ID NO: 5546267 - DNA, 20 bp, Homo sapiens
aagaggaatgaaaaaagctt

SEQ ID NO: 5546268 - DNA, 21 bp, Homo sapiens
aagaggaatggccctcattca

SEQ ID NO: 5546269 - DNA, 18 bp, Homo sapiens
aagaggaatttcttttcc

SEQ ID NO: 5546270 - DNA, 19 bp, Homo sapiens
aagaggactcgcttgtaaa

SEQ ID NO: 5546271 - DNA, 22 bp, Homo sapiens
aagaggactcgcttgtaaatac

SEQ ID NO: 5546272 - DNA, 17 bp, Homo sapiens
aagaggactgagactgg

SEQ ID NO: 5546273 - DNA, 16 bp, Homo sapiens
aagaggactgtgtgag

SEQ ID NO: 5546274 - DNA, 19 bp, Homo sapiens
aagaggactgtgtgagagg

SEQ ID NO: 5546275 - DNA, 18 bp, Homo sapiens
aagaggagaaaagctcaa

SEQ ID NO: 5546276 - DNA, 16 bp, Homo sapiens
aagaggagaccctgga

SEQ ID NO: 5546277 - DNA, 16 bp, Homo sapiens
aagaggagaggaaaac

SEQ ID NO: 5546278 - DNA, 21 bp, Homo sapiens
aagaggagaggaaaactattc

SEQ ID NO: 5546279 - DNA, 19 bp, Homo sapiens
aagaggagataaggtggct

SEQ ID NO: 5546280 - DNA, 23 bp, Homo sapiens
aagaggagatgtgatcaggcccc

SEQ ID NO: 5546281 - DNA, 19 bp, Homo sapiens
aagaggagcagagggcagg

SEQ ID NO: 5546282 - DNA, 13 bp, Homo sapiens
aagaggagcctca

SEQ ID NO: 5546283 - DNA, 13 bp, Homo sapiens
aagaggagccttt

SEQ ID NO: 5546284 - DNA, 22 bp, Homo sapiens
aagaggaggacccctgccttcc

SEQ ID NO: 5546285 - DNA, 13 bp, Homo sapiens
aagaggaggagga

SEQ ID NO: 5546286 - DNA, 16 bp, Homo sapiens
aagaggaggaggaggg

SEQ ID NO: 5546287 - DNA, 15 bp, Homo sapiens
aagaggaggagggat

SEQ ID NO: 5546288 - DNA, 18 bp, Homo sapiens
aagaggaggcagaaagat

SEQ ID NO: 5546289 - DNA, 17 bp, Homo sapiens
aagaggaggcaggagga

SEQ ID NO: 5546290 - DNA, 13 bp, Homo sapiens
aagaggagggacc

SEQ ID NO: 5546291 - DNA, 22 bp, Homo sapiens
aagaggaggggaagaggcctgt

SEQ ID NO: 5546292 - DNA, 19 bp, Homo sapiens
aagaggatctcctgtccat

SEQ ID NO: 5546293 - DNA, 17 bp, Homo sapiens
aagaggatgagcagagg

SEQ ID NO: 5546294 - DNA, 22 bp, Homo sapiens
aagaggatgagcagagggagga

SEQ ID NO: 5546295 - DNA, 15 bp, Homo sapiens
aagaggcaagagaca

SEQ ID NO: 5546296 - DNA, 21 bp, Homo sapiens
aagaggcaagagacagaatga

SEQ ID NO: 5546297 - DNA, 17 bp, Homo sapiens
aagaggcaagtggtagg

SEQ ID NO: 5546298 - DNA, 19 bp, Homo sapiens
aagaggcagaaaattgcac

SEQ ID NO: 5546299 - DNA, 13 bp, Homo sapiens
aagaggcagagtt

SEQ ID NO: 5546300 - DNA, 22 bp, Homo sapiens
aagaggcagagttctgtgaaga

SEQ ID NO: 5546301 - DNA, 15 bp, Homo sapiens
aagaggcagggacct

SEQ ID NO: 5546302 - DNA, 14 bp, Homo sapiens
aagaggcagggtct

SEQ ID NO: 5546303 - DNA, 17 bp, Homo sapiens
aagaggcatcctgcctg

SEQ ID NO: 5546304 - DNA, 18 bp, Homo sapiens
aagaggcatcctgcctgg

SEQ ID NO: 5546305 - DNA, 19 bp, Homo sapiens
aagaggcatcctgcctggg

SEQ ID NO: 5546306 - DNA, 16 bp, Homo sapiens
aagaggcattcagcaa

SEQ ID NO: 5546307 - DNA, 23 bp, Homo sapiens
aagaggccacttagggaaagatg

SEQ ID NO: 5546308 - DNA, 23 bp, Homo sapiens
aagaggccagacatggtgtctca

SEQ ID NO: 5546309 - DNA, 20 bp, Homo sapiens
aagaggccagtaggagacac

SEQ ID NO: 5546310 - DNA, 23 bp, Homo sapiens
aagaggcccactagagggcccat

SEQ ID NO: 5546311 - DNA, 13 bp, Homo sapiens
aagaggcccaggg

SEQ ID NO: 5546312 - DNA, 18 bp, Homo sapiens
aagaggccgtggctgctg

SEQ ID NO: 5546313 - DNA, 13 bp, Homo sapiens
aagaggccttggg

SEQ ID NO: 5546314 - DNA, 17 bp, Homo sapiens
aagaggcgggccagcca

SEQ ID NO: 5546315 - DNA, 21 bp, Homo sapiens
aagaggctccccctaaacaca

SEQ ID NO: 5546316 - DNA, 16 bp, Homo sapiens
aagaggctctggacag

SEQ ID NO: 5546317 - DNA, 16 bp, Homo sapiens
aagaggctgagacagg

SEQ ID NO: 5546318 - DNA, 14 bp, Homo sapiens
aagaggctgcagcc

SEQ ID NO: 5546319 - DNA, 17 bp, Homo sapiens
aagaggctgcccctctc

SEQ ID NO: 5546320 - DNA, 21 bp, Homo sapiens
aagaggctgcccctctcacca

SEQ ID NO: 5546321 - DNA, 23 bp, Homo sapiens
aagaggctgcccctctcaccaaa

SEQ ID NO: 5546322 - DNA, 11 bp, Homo sapiens
aagaggctggt

SEQ ID NO: 5546323 - DNA, 12 bp, Homo sapiens
aagaggctggtt

SEQ ID NO: 5546324 - DNA, 21 bp, Homo sapiens
aagaggctggttttggcatct

SEQ ID NO: 5546325 - DNA, 17 bp, Homo sapiens
aagaggctgtgtggcca

SEQ ID NO: 5546326 - DNA, 11 bp, Homo sapiens
aagaggcttct

SEQ ID NO: 5546327 - DNA, 20 bp, Homo sapiens
aagaggcttctcctgtttta

SEQ ID NO: 5546328 - DNA, 15 bp, Homo sapiens
aagagggaaaaagag

SEQ ID NO: 5546329 - DNA, 18 bp, Homo sapiens
aagagggaaaacagaaaa

SEQ ID NO: 5546330 - DNA, 22 bp, Homo sapiens
aagagggaatccccgaaggtgc

SEQ ID NO: 5546331 - DNA, 16 bp, Homo sapiens
aagagggacagagccc

SEQ ID NO: 5546332 - DNA, 17 bp, Homo sapiens
aagagggacgcctgggg

SEQ ID NO: 5546333 - DNA, 23 bp, Homo sapiens
aagagggactccaagccctgggg

SEQ ID NO: 5546334 - DNA, 13 bp, Homo sapiens
aagagggactgta

SEQ ID NO: 5546335 - DNA, 17 bp, Homo sapiens
aagagggagaagcatga

SEQ ID NO: 5546336 - DNA, 19 bp, Homo sapiens
aagagggagaggtggagca

SEQ ID NO: 5546337 - DNA, 21 bp, Homo sapiens
aagagggagccggtttgggag

SEQ ID NO: 5546338 - DNA, 23 bp, Homo sapiens
aagagggaggggacagaggccct

SEQ ID NO: 5546339 - DNA, 13 bp, Homo sapiens
aagagggcaaagc

SEQ ID NO: 5546340 - DNA, 16 bp, Homo sapiens
aagagggcaaagctga

SEQ ID NO: 5546341 - DNA, 16 bp, Homo sapiens
aagagggcccagccca

SEQ ID NO: 5546342 - DNA, 12 bp, Homo sapiens
aagagggcctgt

SEQ ID NO: 5546343 - DNA, 14 bp, Homo sapiens
aagagggctgagct

SEQ ID NO: 5546344 - DNA, 15 bp, Homo sapiens
aagagggctgagctg

SEQ ID NO: 5546345 - DNA, 16 bp, Homo sapiens
aagagggctgagctga

SEQ ID NO: 5546346 - DNA, 13 bp, Homo sapiens
aagaggggacagg

SEQ ID NO: 5546347 - DNA, 11 bp, Homo sapiens
aagaggggcag

SEQ ID NO: 5546348 - DNA, 15 bp, Homo sapiens
aagaggggcgctgcc

SEQ ID NO: 5546349 - DNA, 14 bp, Homo sapiens
aagagggggctctg

SEQ ID NO: 5546350 - DNA, 15 bp, Homo sapiens
aagagggggctctgc

SEQ ID NO: 5546351 - DNA, 16 bp, Homo sapiens
aagagggggtggaggg

SEQ ID NO: 5546352 - DNA, 18 bp, Homo sapiens
aagaggggtcaagagtta

SEQ ID NO: 5546353 - DNA, 14 bp, Homo sapiens
aagaggggtggaga

SEQ ID NO: 5546354 - DNA, 15 bp, Homo sapiens
aagaggggtggagac

SEQ ID NO: 5546355 - DNA, 15 bp, Homo sapiens
aagagggtcccaggg

SEQ ID NO: 5546356 - DNA, 17 bp, Homo sapiens
aagagggtcccagggct

SEQ ID NO: 5546357 - DNA, 13 bp, Homo sapiens
aagagggtctctt

SEQ ID NO: 5546358 - DNA, 19 bp, Homo sapiens
aagagggtgaacaaagaaa

SEQ ID NO: 5546359 - DNA, 16 bp, Homo sapiens
aagagggtgagggcct

SEQ ID NO: 5546360 - DNA, 14 bp, Homo sapiens
aagaggtaagagca

SEQ ID NO: 5546361 - DNA, 15 bp, Homo sapiens
aagaggtacagggtt

SEQ ID NO: 5546362 - DNA, 16 bp, Homo sapiens
aagaggtacagggttt

SEQ ID NO: 5546363 - DNA, 19 bp, Homo sapiens
aagaggtaccaaaaaagaa

SEQ ID NO: 5546364 - DNA, 15 bp, Homo sapiens
aagaggtactaaaaa

SEQ ID NO: 5546365 - DNA, 18 bp, Homo sapiens
aagaggtactaaaaacac

SEQ ID NO: 5546366 - DNA, 19 bp, Homo sapiens
aagaggtactaaaaacact

SEQ ID NO: 5546367 - DNA, 23 bp, Homo sapiens
aagaggtactgtaatgggtaatt

SEQ ID NO: 5546368 - DNA, 13 bp, Homo sapiens
aagaggtctgagc

SEQ ID NO: 5546369 - DNA, 18 bp, Homo sapiens
aagaggtctgagccctgg

SEQ ID NO: 5546370 - DNA, 22 bp, Homo sapiens
aagaggtctgagccctggtgtg

SEQ ID NO: 5546371 - DNA, 15 bp, Homo sapiens
aagaggtctgattgg

SEQ ID NO: 5546372 - DNA, 16 bp, Homo sapiens
aagaggtctgattggc

SEQ ID NO: 5546373 - DNA, 17 bp, Homo sapiens
aagaggtctgattggct

SEQ ID NO: 5546374 - DNA, 19 bp, Homo sapiens
aagaggtgaaaatgaagaa

SEQ ID NO: 5546375 - DNA, 17 bp, Homo sapiens
aagaggtgaacattaaa

SEQ ID NO: 5546376 - DNA, 20 bp, Homo sapiens
aagaggtgaccccagggcac

SEQ ID NO: 5546377 - DNA, 21 bp, Homo sapiens
aagaggtgaccccagggcaca

SEQ ID NO: 5546378 - DNA, 21 bp, Homo sapiens
aagaggtgcctgggaggagtg

SEQ ID NO: 5546379 - DNA, 23 bp, Homo sapiens
aagaggtgcctgggaggagtggc

SEQ ID NO: 5546380 - DNA, 11 bp, Homo sapiens
aagaggtgctg

SEQ ID NO: 5546381 - DNA, 18 bp, Homo sapiens
aagaggtgctgctttgct

SEQ ID NO: 5546382 - DNA, 14 bp, Homo sapiens
aagaggtggattca

SEQ ID NO: 5546383 - DNA, 14 bp, Homo sapiens
aagaggtggcccca

SEQ ID NO: 5546384 - DNA, 20 bp, Homo sapiens
aagaggtggccccatattaa

SEQ ID NO: 5546385 - DNA, 17 bp, Homo sapiens
aagaggtgggagggccc

SEQ ID NO: 5546386 - DNA, 13 bp, Homo sapiens
aagaggtggggac

SEQ ID NO: 5546387 - DNA, 16 bp, Homo sapiens
aagaggtgtcatgctt

SEQ ID NO: 5546388 - DNA, 18 bp, Homo sapiens
aagaggtgtgcaagagag

SEQ ID NO: 5546389 - DNA, 20 bp, Homo sapiens
aagattctagatcagatgct

SEQ ID NO: 5546390 - DNA, 15 bp, Homo sapiens
aagattctagatgat

SEQ ID NO: 5546391 - DNA, 12 bp, Homo sapiens
aagattctatgt

SEQ ID NO: 5546392 - DNA, 21 bp, Homo sapiens
aagattctatgttaatatttt

SEQ ID NO: 5546393 - DNA, 22 bp, Homo sapiens
aagattctatgttaatatttta

SEQ ID NO: 5546394 - DNA, 21 bp, Homo sapiens
aagattctatttaattgaaac

SEQ ID NO: 5546395 - DNA, 19 bp, Homo sapiens
aagattctctatgtatcaa

SEQ ID NO: 5546396 - DNA, 12 bp, Homo sapiens
aagattctctgc

SEQ ID NO: 5546397 - DNA, 12 bp, Homo sapiens
aagattctgctg

SEQ ID NO: 5546398 - DNA, 23 bp, Homo sapiens
aagattctgtgggcagctggctc

SEQ ID NO: 5546399 - DNA, 10 bp, Homo sapiens
aagattcttc

SEQ ID NO: 5546400 - DNA, 20 bp, Homo sapiens
aagattcttctgtgtttata

SEQ ID NO: 5546401 - DNA, 12 bp, Homo sapiens
aagattcttctt

SEQ ID NO: 5546402 - DNA, 12 bp, Homo sapiens
aagattctttaa

SEQ ID NO: 5546403 - DNA, 18 bp, Homo sapiens
aagattctttaaactact

SEQ ID NO: 5546404 - DNA, 16 bp, Homo sapiens
aagattctttttctga

SEQ ID NO: 5546405 - DNA, 12 bp, Homo sapiens
aagattgaaatt

SEQ ID NO: 5546406 - DNA, 20 bp, Homo sapiens
aagattgaagctaaaacact

SEQ ID NO: 5546407 - DNA, 22 bp, Homo sapiens
aagattgagaagttactttcca

SEQ ID NO: 5546408 - DNA, 18 bp, Homo sapiens
aagattgatagaaaatcc

SEQ ID NO: 5546409 - DNA, 14 bp, Homo sapiens
aagattgatatcta

SEQ ID NO: 5546410 - DNA, 16 bp, Homo sapiens
aagattgatatctata

SEQ ID NO: 5546411 - DNA, 20 bp, Homo sapiens
aagattgatatctataaaat

SEQ ID NO: 5546412 - DNA, 17 bp, Homo sapiens
aagattgatgtttcctt

SEQ ID NO: 5546413 - DNA, 11 bp, Homo sapiens
aagattgcaaa

SEQ ID NO: 5546414 - DNA, 15 bp, Homo sapiens
aagattgcaaaggga

SEQ ID NO: 5546415 - DNA, 16 bp, Homo sapiens
aagattgcaaagggac

SEQ ID NO: 5546416 - DNA, 15 bp, Homo sapiens
aagattgcaaggaag

SEQ ID NO: 5546417 - DNA, 19 bp, Homo sapiens
aagattgcaaggaaggaaa

SEQ ID NO: 5546418 - DNA, 18 bp, Homo sapiens
aagattgccccatctaga

SEQ ID NO: 5546419 - DNA, 12 bp, Homo sapiens
aagattgctgaa

SEQ ID NO: 5546420 - DNA, 15 bp, Homo sapiens
aagattgctgaaatt

SEQ ID NO: 5546421 - DNA, 16 bp, Homo sapiens
aagattggaaagacag

SEQ ID NO: 5546422 - DNA, 20 bp, Homo sapiens
aagattggacatggtctcct

SEQ ID NO: 5546423 - DNA, 22 bp, Homo sapiens
aagattggacatggtctcctct

SEQ ID NO: 5546424 - DNA, 22 bp, Homo sapiens
aagattggggacactcatattg

SEQ ID NO: 5546425 - DNA, 23 bp, Homo sapiens
aagattggtctcccatatgcaga

SEQ ID NO: 5546426 - DNA, 21 bp, Homo sapiens
aagattggtgggattttttgt

SEQ ID NO: 5546427 - DNA, 17 bp, Homo sapiens
aagattggttataatag

SEQ ID NO: 5546428 - DNA, 15 bp, Homo sapiens
aagattggtttaaaa

SEQ ID NO: 5546429 - DNA, 17 bp, Homo sapiens
aagattgtaaactaaag

SEQ ID NO: 5546430 - DNA, 13 bp, Homo sapiens
aagattgtactta

SEQ ID NO: 5546431 - DNA, 21 bp, Homo sapiens
aagattgtacttttatcttaa

SEQ ID NO: 5546432 - DNA, 23 bp, Homo sapiens
aagattgtattactttaatgatt

SEQ ID NO: 5546433 - DNA, 14 bp, Homo sapiens
aagattgtattgct

SEQ ID NO: 5546434 - DNA, 13 bp, Homo sapiens
aagattgtgtctg

SEQ ID NO: 5546435 - DNA, 17 bp, Homo sapiens
aagattgtgtggtgttt

SEQ ID NO: 5546436 - DNA, 16 bp, Homo sapiens
aagattgttaaattca

SEQ ID NO: 5546437 - DNA, 20 bp, Homo sapiens
aagattgttattaaatgtag

SEQ ID NO: 5546438 - DNA, 22 bp, Homo sapiens
aagattgttggtgaattttcaa

SEQ ID NO: 5546439 - DNA, 15 bp, Homo sapiens
aagattgtttatcta

SEQ ID NO: 5546440 - DNA, 23 bp, Homo sapiens
aagatttaaagtgccttatcaaa

SEQ ID NO: 5546441 - DNA, 14 bp, Homo sapiens
aagatttaacaaat

SEQ ID NO: 5546442 - DNA, 14 bp, Homo sapiens
aagatttaattgta

SEQ ID NO: 5546443 - DNA, 17 bp, Homo sapiens
aagatttaatttgccaa

SEQ ID NO: 5546444 - DNA, 21 bp, Homo sapiens
aagatttacctcgttctgctc

SEQ ID NO: 5546445 - DNA, 23 bp, Homo sapiens
aagatttacctcgttctgctcag

SEQ ID NO: 5546446 - DNA, 17 bp, Homo sapiens
aagatttatcaaatcag

SEQ ID NO: 5546447 - DNA, 22 bp, Homo sapiens
aagatttatctgcaaggatttt

SEQ ID NO: 5546448 - DNA, 21 bp, Homo sapiens
aagatttatgaacagaaatat

SEQ ID NO: 5546449 - DNA, 12 bp, Homo sapiens
aagatttatgtt

SEQ ID NO: 5546450 - DNA, 12 bp, Homo sapiens
aagatttattgt

SEQ ID NO: 5546451 - DNA, 23 bp, Homo sapiens
aagatttattttgttaaaatctc

SEQ ID NO: 5546452 - DNA, 12 bp, Homo sapiens
aagatttcagta

SEQ ID NO: 5546453 - DNA, 16 bp, Homo sapiens
aagatttcatatctaa

SEQ ID NO: 5546454 - DNA, 20 bp, Homo sapiens
aagatttcatatctaacttt

SEQ ID NO: 5546455 - DNA, 17 bp, Homo sapiens
aagatttccttgtgcaa

SEQ ID NO: 5546456 - DNA, 22 bp, Homo sapiens
aagatttcctttggcaatatca

SEQ ID NO: 5546457 - DNA, 17 bp, Homo sapiens
aagatttctaaataaaa

SEQ ID NO: 5546458 - DNA, 22 bp, Homo sapiens
aagatttctgtctactaagtga

SEQ ID NO: 5546459 - DNA, 20 bp, Homo sapiens
aagatttcttttcattattc

SEQ ID NO: 5546460 - DNA, 21 bp, Homo sapiens
aagatttgcccatttacactt

SEQ ID NO: 5546461 - DNA, 17 bp, Homo sapiens
aagatttggaaaattca

SEQ ID NO: 5546462 - DNA, 17 bp, Homo sapiens
aagatttggaaagatat

SEQ ID NO: 5546463 - DNA, 20 bp, Homo sapiens
aagatttggaagctcttctt

SEQ ID NO: 5546464 - DNA, 17 bp, Homo sapiens
aagatttggaataaagt

SEQ ID NO: 5546465 - DNA, 14 bp, Homo sapiens
aagatttggcagga

SEQ ID NO: 5546466 - DNA, 14 bp, Homo sapiens
aagatttggttttt

SEQ ID NO: 5546467 - DNA, 19 bp, Homo sapiens
aagatttggtttttgtctt

SEQ ID NO: 5546468 - DNA, 19 bp, Homo sapiens
aagatttgtacatattatc

SEQ ID NO: 5546469 - DNA, 19 bp, Homo sapiens
aagatttgttactgtattt

SEQ ID NO: 5546470 - DNA, 14 bp, Homo sapiens
aagatttgttttta

SEQ ID NO: 5546471 - DNA, 19 bp, Homo sapiens
aagatttgtttttaaactg

SEQ ID NO: 5546472 - DNA, 22 bp, Homo sapiens
aagatttgtttttaaactgtac

SEQ ID NO: 5546473 - DNA, 17 bp, Homo sapiens
aagatttgtttttgtag

SEQ ID NO: 5546474 - DNA, 23 bp, Homo sapiens
aagattttaaaagttttgttctt

SEQ ID NO: 5546475 - DNA, 14 bp, Homo sapiens
aagattttagggct

SEQ ID NO: 5546476 - DNA, 21 bp, Homo sapiens
aagattttatggttttataac

SEQ ID NO: 5546477 - DNA, 22 bp, Homo sapiens
aagattttatgtgcttgaagat

SEQ ID NO: 5546478 - DNA, 23 bp, Homo sapiens
aagattttattcttatttcattt

SEQ ID NO: 5546479 - DNA, 20 bp, Homo sapiens
aagattttattgtataaaaa

SEQ ID NO: 5546480 - DNA, 22 bp, Homo sapiens
aagattttatttatggaattaa

SEQ ID NO: 5546481 - DNA, 19 bp, Homo sapiens
aagattttcattgaggata

SEQ ID NO: 5546482 - DNA, 19 bp, Homo sapiens
aagattttcctcttgtgat

SEQ ID NO: 5546483 - DNA, 20 bp, Homo sapiens
aagattttcctcttgtgatt

SEQ ID NO: 5546484 - DNA, 12 bp, Homo sapiens
aagattttcctt

SEQ ID NO: 5546485 - DNA, 13 bp, Homo sapiens
aagattttctttc

SEQ ID NO: 5546486 - DNA, 11 bp, Homo sapiens
aagattttgaa

SEQ ID NO: 5546487 - DNA, 14 bp, Homo sapiens
aagattttgaaaac

SEQ ID NO: 5546488 - DNA, 15 bp, Homo sapiens
aagattttgaaaact

SEQ ID NO: 5546489 - DNA, 23 bp, Homo sapiens
aagattttgaaaactacatttta

SEQ ID NO: 5546490 - DNA, 15 bp, Homo sapiens
aagattttgaaggaa

SEQ ID NO: 5546491 - DNA, 15 bp, Homo sapiens
aagattttgaatgct

SEQ ID NO: 5546492 - DNA, 17 bp, Homo sapiens
aagattttgaatgcttc

SEQ ID NO: 5546493 - DNA, 21 bp, Homo sapiens
aagattttgaatgcttcctga

SEQ ID NO: 5546494 - DNA, 20 bp, Homo sapiens
aagattttgatctcacattt

SEQ ID NO: 5546495 - DNA, 17 bp, Homo sapiens
aagattttggtaatgat

SEQ ID NO: 5546496 - DNA, 14 bp, Homo sapiens
aagattttgtgaaa

SEQ ID NO: 5546497 - DNA, 12 bp, Homo sapiens
aagatttttaaa

SEQ ID NO: 5546498 - DNA, 17 bp, Homo sapiens
aagatttttaaaatgaa

SEQ ID NO: 5546499 - DNA, 18 bp, Homo sapiens
aagatttttaaaatgaat

SEQ ID NO: 5546500 - DNA, 17 bp, Homo sapiens
aagatttttcaaaatcg

SEQ ID NO: 5546501 - DNA, 13 bp, Homo sapiens
aagatttttctca

SEQ ID NO: 5546502 - DNA, 15 bp, Homo sapiens
aagatttttgttaag

SEQ ID NO: 5546503 - DNA, 18 bp, Homo sapiens
aagatttttgtttgttta

SEQ ID NO: 5546504 - DNA, 23 bp, Homo sapiens
aagattttttttttaagtgacat

SEQ ID NO: 5546505 - DNA, 14 bp, Homo sapiens
aagcaaaaaaggta

SEQ ID NO: 5546506 - DNA, 13 bp, Homo sapiens
aagcaaaaaatga

SEQ ID NO: 5546507 - DNA, 14 bp, Homo sapiens
aagcaaaaatgcta

SEQ ID NO: 5546508 - DNA, 19 bp, Homo sapiens
aagcaaaacatcacattcc

SEQ ID NO: 5546509 - DNA, 20 bp, Homo sapiens
aagcaaaacatctctgcagt

SEQ ID NO: 5546510 - DNA, 15 bp, Homo sapiens
aagcaaaagaaaaag

SEQ ID NO: 5546511 - DNA, 15 bp, Homo sapiens
aagcaaaagaagtaa

SEQ ID NO: 5546512 - DNA, 21 bp, Homo sapiens
aagcaaaagtaatcacttaaa

SEQ ID NO: 5546513 - DNA, 18 bp, Homo sapiens
aagcaaaataaaaactat

SEQ ID NO: 5546514 - DNA, 22 bp, Homo sapiens
aagcaaaataacaaaaaagaga

SEQ ID NO: 5546515 - DNA, 11 bp, Homo sapiens
aagcaaaatat

SEQ ID NO: 5546516 - DNA, 13 bp, Homo sapiens
aagcaaaatatta

SEQ ID NO: 5546517 - DNA, 14 bp, Homo sapiens
aagcaaaatatttg

SEQ ID NO: 5546518 - DNA, 17 bp, Homo sapiens
aagcaaaatcttttttc

SEQ ID NO: 5546519 - DNA, 19 bp, Homo sapiens
aagcaaaatttttaaaact

SEQ ID NO: 5546520 - DNA, 19 bp, Homo sapiens
aagcaaaattttttctcta

SEQ ID NO: 5546521 - DNA, 19 bp, Homo sapiens
aagcaaacaagcttgattt

SEQ ID NO: 5546522 - DNA, 17 bp, Homo sapiens
aagcaaacagggtggcc

SEQ ID NO: 5546523 - DNA, 17 bp, Homo sapiens
aagcaaacatcaaataa

SEQ ID NO: 5546524 - DNA, 12 bp, Homo sapiens
aagcaaaccagc

SEQ ID NO: 5546525 - DNA, 13 bp, Homo sapiens
aagcaaacccaga

SEQ ID NO: 5546526 - DNA, 16 bp, Homo sapiens
aagcaaacccagacgg

SEQ ID NO: 5546527 - DNA, 18 bp, Homo sapiens
aagcaaaccttaatttga

SEQ ID NO: 5546528 - DNA, 14 bp, Homo sapiens
aagcaaactgaaat

SEQ ID NO: 5546529 - DNA, 18 bp, Homo sapiens
aagcaaactgaaattagt

SEQ ID NO: 5546530 - DNA, 20 bp, Homo sapiens
aagcaaactgaaattagtgt

SEQ ID NO: 5546531 - DNA, 13 bp, Homo sapiens
aagcaaagacaaa

SEQ ID NO: 5546532 - DNA, 14 bp, Homo sapiens
aagcaaagacaaaa

SEQ ID NO: 5546533 - DNA, 15 bp, Homo sapiens
aagcaaagacaaaag

SEQ ID NO: 5546534 - DNA, 21 bp, Homo sapiens
aagcaaagacagtttcttgca

SEQ ID NO: 5546535 - DNA, 21 bp, Homo sapiens
aagcaaagatttcagtagaat

SEQ ID NO: 5546536 - DNA, 10 bp, Homo sapiens
aagcaaagca

SEQ ID NO: 5546537 - DNA, 16 bp, Homo sapiens
aagcaaagcacagaga

SEQ ID NO: 5546538 - DNA, 17 bp, Homo sapiens
aagcaaagcacagagag

SEQ ID NO: 5546539 - DNA, 12 bp, Homo sapiens
aagcaaaggaga

SEQ ID NO: 5546540 - DNA, 20 bp, Homo sapiens
aagcaaaggcagtcccggga

SEQ ID NO: 5546541 - DNA, 21 bp, Homo sapiens
aagcaaaggggacagctgtgt

SEQ ID NO: 5546542 - DNA, 19 bp, Homo sapiens
aagcaaaggtgcactccag

SEQ ID NO: 5546543 - DNA, 21 bp, Homo sapiens
aagcaaaggtgcactccagac

SEQ ID NO: 5546544 - DNA, 22 bp, Homo sapiens
aagcaaaggtgcactccagact

SEQ ID NO: 5546545 - DNA, 23 bp, Homo sapiens
aagcaaaggtgcactccagactc

SEQ ID NO: 5546546 - DNA, 17 bp, Homo sapiens
aagcaaagtattgtgaa

SEQ ID NO: 5546547 - DNA, 23 bp, Homo sapiens
aagcaaagtgctggattgtcctt

SEQ ID NO: 5546548 - DNA, 22 bp, Homo sapiens
aagcaaagttcaacttatttca

SEQ ID NO: 5546549 - DNA, 13 bp, Homo sapiens
aagcaaataaata

SEQ ID NO: 5546550 - DNA, 13 bp, Homo sapiens
aagcaaatacaat

SEQ ID NO: 5546551 - DNA, 16 bp, Homo sapiens
aagcaaataccaaagc

SEQ ID NO: 5546552 - DNA, 18 bp, Homo sapiens
aagcaaataccaaagcag

SEQ ID NO: 5546553 - DNA, 12 bp, Homo sapiens
aagcaaatactt

SEQ ID NO: 5546554 - DNA, 18 bp, Homo sapiens
aagcaaatatttatgacc

SEQ ID NO: 5546555 - DNA, 16 bp, Homo sapiens
aagcaaatcatttgtt

SEQ ID NO: 5546556 - DNA, 15 bp, Homo sapiens
aagcaaatgctttgt

SEQ ID NO: 5546557 - DNA, 19 bp, Homo sapiens
aagcaaatgtcatgctgcc

SEQ ID NO: 5546558 - DNA, 20 bp, Homo sapiens
aagcaaatgtcatgctgcct

SEQ ID NO: 5546559 - DNA, 22 bp, Homo sapiens
aagcaaatgtcatgctgcctta

SEQ ID NO: 5546560 - DNA, 20 bp, Homo sapiens
aagcaaatgtgaatcatttt

SEQ ID NO: 5546561 - DNA, 18 bp, Homo sapiens
aagcaaatgtgacctgtg

SEQ ID NO: 5546562 - DNA, 12 bp, Homo sapiens
aagcaaatgtgt

SEQ ID NO: 5546563 - DNA, 15 bp, Homo sapiens
aagcaaattaagaca

SEQ ID NO: 5546564 - DNA, 20 bp, Homo sapiens
aagcaaatttcaaaagacat

SEQ ID NO: 5546565 - DNA, 19 bp, Homo sapiens
aagcaaatttcattatcta

SEQ ID NO: 5546566 - DNA, 20 bp, Homo sapiens
aagcaaatttctagatatga

SEQ ID NO: 5546567 - DNA, 15 bp, Homo sapiens
aagcatatttgagaa

SEQ ID NO: 5546568 - DNA, 16 bp, Homo sapiens
aagcatattttgctgg

SEQ ID NO: 5546569 - DNA, 14 bp, Homo sapiens
aagcatcaaactct

SEQ ID NO: 5546570 - DNA, 15 bp, Homo sapiens
aagcatcaaataata

SEQ ID NO: 5546571 - DNA, 15 bp, Homo sapiens
aagcatcacaaatga

SEQ ID NO: 5546572 - DNA, 21 bp, Homo sapiens
aagcatcacaaatgatattaa

SEQ ID NO: 5546573 - DNA, 15 bp, Homo sapiens
aagcatcacctcagg

SEQ ID NO: 5546574 - DNA, 16 bp, Homo sapiens
aagcatcacctcaggc

SEQ ID NO: 5546575 - DNA, 23 bp, Homo sapiens
aagcatcacctcaggccaggtgc

SEQ ID NO: 5546576 - DNA, 19 bp, Homo sapiens
aagcatcactgccttggcc

SEQ ID NO: 5546577 - DNA, 13 bp, Homo sapiens
aagcatcagaaag

SEQ ID NO: 5546578 - DNA, 16 bp, Homo sapiens
aagcatcagcaagaca

SEQ ID NO: 5546579 - DNA, 23 bp, Homo sapiens
aagcatcagggggaagaagcaga

SEQ ID NO: 5546580 - DNA, 19 bp, Homo sapiens
aagcatcattatttatgta

SEQ ID NO: 5546581 - DNA, 23 bp, Homo sapiens
aagcatcattatttatgtattgt

SEQ ID NO: 5546582 - DNA, 22 bp, Homo sapiens
aagcatcattgtccccatgcaa

SEQ ID NO: 5546583 - DNA, 15 bp, Homo sapiens
aagcatccaaagatt

SEQ ID NO: 5546584 - DNA, 12 bp, Homo sapiens
aagcatccatgt

SEQ ID NO: 5546585 - DNA, 20 bp, Homo sapiens
aagcatccatgtgtggactc

SEQ ID NO: 5546586 - DNA, 21 bp, Homo sapiens
aagcatccatgtgtggactca

SEQ ID NO: 5546587 - DNA, 20 bp, Homo sapiens
aagcatccattaattaatga

SEQ ID NO: 5546588 - DNA, 16 bp, Homo sapiens
aagcatcctcagaagc

SEQ ID NO: 5546589 - DNA, 18 bp, Homo sapiens
aagcatcctcagaagcct

SEQ ID NO: 5546590 - DNA, 12 bp, Homo sapiens
aagcatcctccc

SEQ ID NO: 5546591 - DNA, 14 bp, Homo sapiens
aagcatcctcccca

SEQ ID NO: 5546592 - DNA, 15 bp, Homo sapiens
aagcatcctccccac

SEQ ID NO: 5546593 - DNA, 19 bp, Homo sapiens
aagcatcggtcatgtgtgt

SEQ ID NO: 5546594 - DNA, 20 bp, Homo sapiens
aagcatcggtcatgtgtgta

SEQ ID NO: 5546595 - DNA, 17 bp, Homo sapiens
aagcatctaaactttaa

SEQ ID NO: 5546596 - DNA, 17 bp, Homo sapiens
aagcatctaaggacaag

SEQ ID NO: 5546597 - DNA, 16 bp, Homo sapiens
aagcatctcctgagga

SEQ ID NO: 5546598 - DNA, 17 bp, Homo sapiens
aagcatctcctgaggat

SEQ ID NO: 5546599 - DNA, 20 bp, Homo sapiens
aagcatctgccacaaaaatg

SEQ ID NO: 5546600 - DNA, 22 bp, Homo sapiens
aagcatctgccacaaaaatgtt

SEQ ID NO: 5546601 - DNA, 22 bp, Homo sapiens
aagcatctgtgtaacctccaca

SEQ ID NO: 5546602 - DNA, 21 bp, Homo sapiens
aagcatcttccagaagtgtga

SEQ ID NO: 5546603 - DNA, 20 bp, Homo sapiens
aagcatcttgggggggtggc

SEQ ID NO: 5546604 - DNA, 19 bp, Homo sapiens
aagcatcttgtcaagaaat

SEQ ID NO: 5546605 - DNA, 20 bp, Homo sapiens
aagcatgaacgtggattgta

SEQ ID NO: 5546606 - DNA, 15 bp, Homo sapiens
aagcatgaagataaa

SEQ ID NO: 5546607 - DNA, 20 bp, Homo sapiens
aagcatgaataacatttaaa

SEQ ID NO: 5546608 - DNA, 14 bp, Homo sapiens
aagcatgaatattt

SEQ ID NO: 5546609 - DNA, 15 bp, Homo sapiens
aagcatgatgggaaa

SEQ ID NO: 5546610 - DNA, 19 bp, Homo sapiens
aagcatgatgggaaaatat

SEQ ID NO: 5546611 - DNA, 20 bp, Homo sapiens
aagcatgatgggaaaatatt

SEQ ID NO: 5546612 - DNA, 21 bp, Homo sapiens
aagcatgatgggaaaatattt

SEQ ID NO: 5546613 - DNA, 23 bp, Homo sapiens
aagcatgcacaaattctgtctct

SEQ ID NO: 5546614 - DNA, 17 bp, Homo sapiens
aagcatgcataaatcaa

SEQ ID NO: 5546615 - DNA, 19 bp, Homo sapiens
aagcatgcataaatcaatg

SEQ ID NO: 5546616 - DNA, 23 bp, Homo sapiens
aagcatgcataaatcaatggttc

SEQ ID NO: 5546617 - DNA, 19 bp, Homo sapiens
aagcatgccaatttctctt

SEQ ID NO: 5546618 - DNA, 15 bp, Homo sapiens
aagcatgctcagtat

SEQ ID NO: 5546619 - DNA, 20 bp, Homo sapiens
aagcatgctcagtattgaga

SEQ ID NO: 5546620 - DNA, 21 bp, Homo sapiens
aagcatgcttgtgaaaatgtg

SEQ ID NO: 5546621 - DNA, 15 bp, Homo sapiens
aagcatgctttcttt

SEQ ID NO: 5546622 - DNA, 17 bp, Homo sapiens
aagcatgctttgctgct

SEQ ID NO: 5546623 - DNA, 14 bp, Homo sapiens
aagcatggacattt

SEQ ID NO: 5546624 - DNA, 19 bp, Homo sapiens
aagcatggacatttagaag

SEQ ID NO: 5546625 - DNA, 11 bp, Homo sapiens
aagcatggact

SEQ ID NO: 5546626 - DNA, 18 bp, Homo sapiens
aagcatggagagtggcat

SEQ ID NO: 5546627 - DNA, 16 bp, Homo sapiens
aagcatggattttccc

SEQ ID NO: 5546628 - DNA, 17 bp, Homo sapiens
aagcatggccctgctgc

SEQ ID NO: 5546629 - DNA, 15 bp, Homo sapiens
aagcatggctatttt

SEQ ID NO: 5546630 - DNA, 16 bp, Homo sapiens
aagcatggctgtctgc

SEQ ID NO: 5546631 - DNA, 15 bp, Homo sapiens
aagcatgggaaaaag

SEQ ID NO: 5546632 - DNA, 21 bp, Homo sapiens
aagcatgggaaaaagagactc

SEQ ID NO: 5546633 - DNA, 17 bp, Homo sapiens
aagcatgggattattag

SEQ ID NO: 5546634 - DNA, 17 bp, Homo sapiens
aagcatggtataattga

SEQ ID NO: 5546635 - DNA, 21 bp, Homo sapiens
aagcatggtataattgaaact

SEQ ID NO: 5546636 - DNA, 17 bp, Homo sapiens
aagcatggtcccacatc

SEQ ID NO: 5546637 - DNA, 23 bp, Homo sapiens
aagcatggtcccacatccctggg

SEQ ID NO: 5546638 - DNA, 17 bp, Homo sapiens
aagcatggtcccttgtc

SEQ ID NO: 5546639 - DNA, 18 bp, Homo sapiens
aagcatggtgtcagtttt

SEQ ID NO: 5546640 - DNA, 15 bp, Homo sapiens
aagcatgtacagtgt

SEQ ID NO: 5546641 - DNA, 17 bp, Homo sapiens
aagcatgtacagtgttc

SEQ ID NO: 5546642 - DNA, 23 bp, Homo sapiens
aagcatgtagccagttaaggaaa

SEQ ID NO: 5546643 - DNA, 13 bp, Homo sapiens
aagcatgtcaatt

SEQ ID NO: 5546644 - DNA, 14 bp, Homo sapiens
aagcatgtctctct

SEQ ID NO: 5546645 - DNA, 15 bp, Homo sapiens
aagcatgtctctgct

SEQ ID NO: 5546646 - DNA, 20 bp, Homo sapiens
aagcatgtgatgttgtctta

SEQ ID NO: 5546647 - DNA, 13 bp, Homo sapiens
aagcatgtggcat

SEQ ID NO: 5546648 - DNA, 16 bp, Homo sapiens
aagcatgttgaatgta

SEQ ID NO: 5546649 - DNA, 18 bp, Homo sapiens
aagcatgtttaaaacaaa

SEQ ID NO: 5546650 - DNA, 20 bp, Homo sapiens
aagcatgtttcatgttttgt

SEQ ID NO: 5546651 - DNA, 13 bp, Homo sapiens
aagcatgttttgc

SEQ ID NO: 5546652 - DNA, 16 bp, Homo sapiens
aagcattaaaaataag

SEQ ID NO: 5546653 - DNA, 21 bp, Homo sapiens
aagcattaaaaataagccaaa

SEQ ID NO: 5546654 - DNA, 18 bp, Homo sapiens
aagcattaacttctctgg

SEQ ID NO: 5546655 - DNA, 18 bp, Homo sapiens
aagcattaagaacacttt

SEQ ID NO: 5546656 - DNA, 18 bp, Homo sapiens
aagcattaccactcaggc

SEQ ID NO: 5546657 - DNA, 19 bp, Homo sapiens
aagcattaccactcaggca

SEQ ID NO: 5546658 - DNA, 18 bp, Homo sapiens
aagcattactcttgtaag

SEQ ID NO: 5546659 - DNA, 21 bp, Homo sapiens
aagcattactcttgtaagatt

SEQ ID NO: 5546660 - DNA, 13 bp, Homo sapiens
aagcattacttta

SEQ ID NO: 5546661 - DNA, 23 bp, Homo sapiens
aagcattcaatttattcaagaaa

SEQ ID NO: 5546662 - DNA, 17 bp, Homo sapiens
aagcattcagagagcag

SEQ ID NO: 5546663 - DNA, 13 bp, Homo sapiens
aagcattccaaca

SEQ ID NO: 5546664 - DNA, 14 bp, Homo sapiens
aagcattccaacaa

SEQ ID NO: 5546665 - DNA, 17 bp, Homo sapiens
aagcattccaacaaagg

SEQ ID NO: 5546666 - DNA, 20 bp, Homo sapiens
aagcattccttagcagctca

SEQ ID NO: 5546667 - DNA, 16 bp, Homo sapiens
aagcattccttctttg

SEQ ID NO: 5546668 - DNA, 17 bp, Homo sapiens
aagcattccttctttga

SEQ ID NO: 5546669 - DNA, 22 bp, Homo sapiens
aagcattctcattggaaattta

SEQ ID NO: 5546670 - DNA, 23 bp, Homo sapiens
aagcattctccccagtgtatgtc

SEQ ID NO: 5546671 - DNA, 21 bp, Homo sapiens
aagcattctgtgcataaaagt

SEQ ID NO: 5546672 - DNA, 22 bp, Homo sapiens
aagcattcttagactagttgaa

SEQ ID NO: 5546673 - DNA, 17 bp, Homo sapiens
aagcattgaaattatag

SEQ ID NO: 5546674 - DNA, 14 bp, Homo sapiens
aagcattgagatct

SEQ ID NO: 5546675 - DNA, 18 bp, Homo sapiens
aagcattgcagaacatga

SEQ ID NO: 5546676 - DNA, 16 bp, Homo sapiens
aagcattgccattgaa

SEQ ID NO: 5546677 - DNA, 14 bp, Homo sapiens
aagcattgcctgga

SEQ ID NO: 5546678 - DNA, 21 bp, Homo sapiens
aagcattgcctggactgacca

SEQ ID NO: 5546679 - DNA, 21 bp, Homo sapiens
aagcattgcctggccttcctg

SEQ ID NO: 5546680 - DNA, 14 bp, Homo sapiens
aagcattgctaaag

SEQ ID NO: 5546681 - DNA, 22 bp, Homo sapiens
aagcattgcttttattttgaaa

SEQ ID NO: 5546682 - DNA, 15 bp, Homo sapiens
aagcattggagtttc

SEQ ID NO: 5546683 - DNA, 20 bp, Homo sapiens
aagcattggagtttcaaatc

SEQ ID NO: 5546684 - DNA, 14 bp, Homo sapiens
aagcattgtaaaat

SEQ ID NO: 5546685 - DNA, 13 bp, Homo sapiens
aagcattgtaaat

SEQ ID NO: 5546686 - DNA, 19 bp, Homo sapiens
aagcattgtaaatgtgctt

SEQ ID NO: 5546687 - DNA, 14 bp, Homo sapiens
aagcattgtttgct

SEQ ID NO: 5546688 - DNA, 20 bp, Homo sapiens
aagcattgtttgcttattgt

SEQ ID NO: 5546689 - DNA, 21 bp, Homo sapiens
aagcattgtttgcttattgtt

SEQ ID NO: 5546690 - DNA, 14 bp, Homo sapiens
aagcatttaaaaga

SEQ ID NO: 5546691 - DNA, 18 bp, Homo sapiens
aagcatttacaagtgctg

SEQ ID NO: 5546692 - DNA, 20 bp, Homo sapiens
aagcatttcaaagccctgcc

SEQ ID NO: 5546693 - DNA, 24 bp, Homo sapiens
aagcatttcaaagccctgcctctg

SEQ ID NO: 5546694 - DNA, 12 bp, Homo sapiens
aagcatttcacc

SEQ ID NO: 5546695 - DNA, 12 bp, Homo sapiens
aagcatttcatg

SEQ ID NO: 5546696 - DNA, 12 bp, Homo sapiens
aagcatttccta

SEQ ID NO: 5546697 - DNA, 17 bp, Homo sapiens
aagcatttgaatgcatt

SEQ ID NO: 5546698 - DNA, 15 bp, Homo sapiens
aagcatttgtatatt

SEQ ID NO: 5546699 - DNA, 18 bp, Homo sapiens
aagcatttgtattttgtg

SEQ ID NO: 5546700 - DNA, 19 bp, Homo sapiens
aagcatttgtattttgtgt

SEQ ID NO: 5546701 - DNA, 19 bp, Homo sapiens
aagcatttgtttctacttt

SEQ ID NO: 5546702 - DNA, 12 bp, Homo sapiens
aagcattttata

SEQ ID NO: 5546703 - DNA, 15 bp, Homo sapiens
aagcattttataaat

SEQ ID NO: 5546704 - DNA, 16 bp, Homo sapiens
aagcattttataaatg

SEQ ID NO: 5546705 - DNA, 23 bp, Homo sapiens
aagcattttcagtcttgtagtgt

SEQ ID NO: 5546706 - DNA, 19 bp, Homo sapiens
aagcattttctacacagcg

SEQ ID NO: 5546707 - DNA, 22 bp, Homo sapiens
aagcattttctttctgtttttt

SEQ ID NO: 5546708 - DNA, 22 bp, Homo sapiens
aagcattttgggatccttcagc

SEQ ID NO: 5546709 - DNA, 14 bp, Homo sapiens
aagcattttgtaat

SEQ ID NO: 5546710 - DNA, 15 bp, Homo sapiens
aagcattttttaaaa

SEQ ID NO: 5546711 - DNA, 16 bp, Homo sapiens
aagcattttttaaaag

SEQ ID NO: 5546712 - DNA, 20 bp, Homo sapiens
aagcattttttaaaagcatg

SEQ ID NO: 5546713 - DNA, 21 bp, Homo sapiens
aagccaaaaaccttagctccc

SEQ ID NO: 5546714 - DNA, 12 bp, Homo sapiens
aagccaaaacaa

SEQ ID NO: 5546715 - DNA, 18 bp, Homo sapiens
aagccaaaacaatgttta

SEQ ID NO: 5546716 - DNA, 16 bp, Homo sapiens
aagccaaaactgagca

SEQ ID NO: 5546717 - DNA, 19 bp, Homo sapiens
aagccaaaactgagcataa

SEQ ID NO: 5546718 - DNA, 19 bp, Homo sapiens
aagccaaaatagagagtat

SEQ ID NO: 5546719 - DNA, 21 bp, Homo sapiens
aagccaaaatagagagtatac

SEQ ID NO: 5546720 - DNA, 14 bp, Homo sapiens
aagccaaaatggga

SEQ ID NO: 5546721 - DNA, 17 bp, Homo sapiens
aagccaaactcaggccc

SEQ ID NO: 5546722 - DNA, 18 bp, Homo sapiens
aagccaaactcaggccca

SEQ ID NO: 5546723 - DNA, 16 bp, Homo sapiens
aagccaaactctgcca

SEQ ID NO: 5546724 - DNA, 18 bp, Homo sapiens
aagccaaagaaacaagct

SEQ ID NO: 5546725 - DNA, 22 bp, Homo sapiens
aagccaaagaaacaagctgtgc

SEQ ID NO: 5546726 - DNA, 23 bp, Homo sapiens
aagccaaagaaacaagctgtgca

SEQ ID NO: 5546727 - DNA, 19 bp, Homo sapiens
aagccaaagaaatgaacat

SEQ ID NO: 5546728 - DNA, 20 bp, Homo sapiens
aagccaaagaaatgaacatt

SEQ ID NO: 5546729 - DNA, 23 bp, Homo sapiens
aagccaaagaaatgaacattcca

SEQ ID NO: 5546730 - DNA, 16 bp, Homo sapiens
aagccaaagacttagt

SEQ ID NO: 5546731 - DNA, 17 bp, Homo sapiens
aagccaaagctaggcct

SEQ ID NO: 5546732 - DNA, 14 bp, Homo sapiens
aagccaaaggcagc

SEQ ID NO: 5546733 - DNA, 19 bp, Homo sapiens
aagccaaaggcagctaaga

SEQ ID NO: 5546734 - DNA, 23 bp, Homo sapiens
aagccaaaggttcagaaaattaa

SEQ ID NO: 5546735 - DNA, 15 bp, Homo sapiens
aagccaaagtttctg

SEQ ID NO: 5546736 - DNA, 14 bp, Homo sapiens
aagccaaatttatc

SEQ ID NO: 5546737 - DNA, 16 bp, Homo sapiens
aagccaacaactctgc

SEQ ID NO: 5546738 - DNA, 20 bp, Homo sapiens
aagccaacaactctgccttt

SEQ ID NO: 5546739 - DNA, 23 bp, Homo sapiens
aagccaacaactctgcctttatg

SEQ ID NO: 5546740 - DNA, 16 bp, Homo sapiens
aagccaacaccctgtc

SEQ ID NO: 5546741 - DNA, 20 bp, Homo sapiens
aagccaacaggtaaacacat

SEQ ID NO: 5546742 - DNA, 14 bp, Homo sapiens
aagccaaccagcct

SEQ ID NO: 5546743 - DNA, 22 bp, Homo sapiens
aagcctcttattccaggagaag

SEQ ID NO: 5546744 - DNA, 16 bp, Homo sapiens
aagcctgaaaattcca

SEQ ID NO: 5546745 - DNA, 22 bp, Homo sapiens
aagcctgaactatttattaaaa

SEQ ID NO: 5546746 - DNA, 17 bp, Homo sapiens
aagcctgaactgaggcc

SEQ ID NO: 5546747 - DNA, 21 bp, Homo sapiens
aagcctgaagggcctcccagc

SEQ ID NO: 5546748 - DNA, 19 bp, Homo sapiens
aagcctgacttcacatctg

SEQ ID NO: 5546749 - DNA, 14 bp, Homo sapiens
aagcctgagcaggc

SEQ ID NO: 5546750 - DNA, 19 bp, Homo sapiens
aagcctgaggacagaaaga

SEQ ID NO: 5546751 - DNA, 16 bp, Homo sapiens
aagcctgagggaaagg

SEQ ID NO: 5546752 - DNA, 12 bp, Homo sapiens
aagcctgagtgg

SEQ ID NO: 5546753 - DNA, 17 bp, Homo sapiens
aagcctgcaatttcata

SEQ ID NO: 5546754 - DNA, 12 bp, Homo sapiens
aagcctgcagct

SEQ ID NO: 5546755 - DNA, 16 bp, Homo sapiens
aagcctgcaggagaaa

SEQ ID NO: 5546756 - DNA, 14 bp, Homo sapiens
aagcctgcaggagt

SEQ ID NO: 5546757 - DNA, 18 bp, Homo sapiens
aagcctgcccttgtctga

SEQ ID NO: 5546758 - DNA, 23 bp, Homo sapiens
aagcctgcctaggaattcccagc

SEQ ID NO: 5546759 - DNA, 13 bp, Homo sapiens
aagcctgcctcaa

SEQ ID NO: 5546760 - DNA, 18 bp, Homo sapiens
aagcctgcctcgccttgt

SEQ ID NO: 5546761 - DNA, 16 bp, Homo sapiens
aagcctgcgttctcat

SEQ ID NO: 5546762 - DNA, 21 bp, Homo sapiens
aagcctgcgttggtccagagc

SEQ ID NO: 5546763 - DNA, 16 bp, Homo sapiens
aagcctgctccttccc

SEQ ID NO: 5546764 - DNA, 17 bp, Homo sapiens
aagcctgctccttccct

SEQ ID NO: 5546765 - DNA, 20 bp, Homo sapiens
aagcctgctgattgattttt

SEQ ID NO: 5546766 - DNA, 14 bp, Homo sapiens
aagcctgctgattt

SEQ ID NO: 5546767 - DNA, 22 bp, Homo sapiens
aagcctgctggctgcggccccc

SEQ ID NO: 5546768 - DNA, 15 bp, Homo sapiens
aagcctgctgtcttg

SEQ ID NO: 5546769 - DNA, 21 bp, Homo sapiens
aagcctgctgtgtccttcctc

SEQ ID NO: 5546770 - DNA, 14 bp, Homo sapiens
aagcctggaaaaaa

SEQ ID NO: 5546771 - DNA, 14 bp, Homo sapiens
aagcctggactctg

SEQ ID NO: 5546772 - DNA, 18 bp, Homo sapiens
aagcctggactctgcccc

SEQ ID NO: 5546773 - DNA, 17 bp, Homo sapiens
aagcctggcacccaccg

SEQ ID NO: 5546774 - DNA, 12 bp, Homo sapiens
aagcctggcagg

SEQ ID NO: 5546775 - DNA, 12 bp, Homo sapiens
aagcctggccca

SEQ ID NO: 5546776 - DNA, 21 bp, Homo sapiens
aagcctggcctacatggttga

SEQ ID NO: 5546777 - DNA, 20 bp, Homo sapiens
aagcctggcttagaaggcac

SEQ ID NO: 5546778 - DNA, 16 bp, Homo sapiens
aagcctgggccactgg

SEQ ID NO: 5546779 - DNA, 18 bp, Homo sapiens
aagcctgggggcctggct

SEQ ID NO: 5546780 - DNA, 15 bp, Homo sapiens
aagcctggtcagccc

SEQ ID NO: 5546781 - DNA, 18 bp, Homo sapiens
aagcctggtcagcccaaa

SEQ ID NO: 5546782 - DNA, 18 bp, Homo sapiens
aagcctggtctcctccca

SEQ ID NO: 5546783 - DNA, 19 bp, Homo sapiens
aagcctggtttttctcaat

SEQ ID NO: 5546784 - DNA, 21 bp, Homo sapiens
aagcctgtaacactcctctgc

SEQ ID NO: 5546785 - DNA, 15 bp, Homo sapiens
aagcctgtaattatg

SEQ ID NO: 5546786 - DNA, 21 bp, Homo sapiens
aagcctgtattctcaaacaca

SEQ ID NO: 5546787 - DNA, 15 bp, Homo sapiens
aagcctgtcccagga

SEQ ID NO: 5546788 - DNA, 16 bp, Homo sapiens
aagcctgtcccaggac

SEQ ID NO: 5546789 - DNA, 14 bp, Homo sapiens
aagcctgtccccag

SEQ ID NO: 5546790 - DNA, 11 bp, Homo sapiens
aagcctgtcct

SEQ ID NO: 5546791 - DNA, 17 bp, Homo sapiens
aagcctgtctctttcca

SEQ ID NO: 5546792 - DNA, 12 bp, Homo sapiens
aagcctgtgaat

SEQ ID NO: 5546793 - DNA, 16 bp, Homo sapiens
aagcctgtgcaaaaaa

SEQ ID NO: 5546794 - DNA, 15 bp, Homo sapiens
aagcctgtgccacct

SEQ ID NO: 5546795 - DNA, 17 bp, Homo sapiens
aagcctgtgccacctgc

SEQ ID NO: 5546796 - DNA, 17 bp, Homo sapiens
aagcctgtgcctcccag

SEQ ID NO: 5546797 - DNA, 12 bp, Homo sapiens
aagcctgtggct

SEQ ID NO: 5546798 - DNA, 13 bp, Homo sapiens
aagcctgtggctg

SEQ ID NO: 5546799 - DNA, 12 bp, Homo sapiens
aagcctgtgggc

SEQ ID NO: 5546800 - DNA, 22 bp, Homo sapiens
aagcctgtgtatcgtggagaaa

SEQ ID NO: 5546801 - DNA, 18 bp, Homo sapiens
aagcctgttcatggcaga

SEQ ID NO: 5546802 - DNA, 22 bp, Homo sapiens
aagcctgttccataggaaggct

SEQ ID NO: 5546803 - DNA, 20 bp, Homo sapiens
aagcctgttcccctcactgg

SEQ ID NO: 5546804 - DNA, 15 bp, Homo sapiens
aagcctgttgtttaa

SEQ ID NO: 5546805 - DNA, 15 bp, Homo sapiens
aagcctgtttaagag

SEQ ID NO: 5546806 - DNA, 13 bp, Homo sapiens
aagccttaaaaat

SEQ ID NO: 5546807 - DNA, 14 bp, Homo sapiens
aagccttaaaatgc

SEQ ID NO: 5546808 - DNA, 17 bp, Homo sapiens
aagccttaactaagact

SEQ ID NO: 5546809 - DNA, 18 bp, Homo sapiens
aagccttaactaagactc

SEQ ID NO: 5546810 - DNA, 18 bp, Homo sapiens
aagccttaatttgcacag

SEQ ID NO: 5546811 - DNA, 19 bp, Homo sapiens
aagccttaatttgcacagt

SEQ ID NO: 5546812 - DNA, 18 bp, Homo sapiens
aagccttacagttatcct

SEQ ID NO: 5546813 - DNA, 23 bp, Homo sapiens
aagccttatcaagtgtcttccat

SEQ ID NO: 5546814 - DNA, 18 bp, Homo sapiens
aagccttatgaaaattat

SEQ ID NO: 5546815 - DNA, 22 bp, Homo sapiens
aagccttatgaggtcaagaaat

SEQ ID NO: 5546816 - DNA, 13 bp, Homo sapiens
aagccttcaaaac

SEQ ID NO: 5546817 - DNA, 22 bp, Homo sapiens
aagccttcaaaactatagcttg

SEQ ID NO: 5546818 - DNA, 21 bp, Homo sapiens
aagccttcaagctctgaggga

SEQ ID NO: 5546819 - DNA, 15 bp, Homo sapiens
aagccttcagctcca

SEQ ID NO: 5546820 - DNA, 17 bp, Homo sapiens
aagccttcagctccagg

SEQ ID NO: 5546821 - DNA, 19 bp, Homo sapiens
aagccttcagctccaggga

SEQ ID NO: 5546822 - DNA, 12 bp, Homo sapiens
aagccttcattt

SEQ ID NO: 5546823 - DNA, 13 bp, Homo sapiens
aagccttcatttg

SEQ ID NO: 5546824 - DNA, 16 bp, Homo sapiens
aagccttccacactca

SEQ ID NO: 5546825 - DNA, 20 bp, Homo sapiens
aagccttcccccagcaaggc

SEQ ID NO: 5546826 - DNA, 12 bp, Homo sapiens
aagccttcccct

SEQ ID NO: 5546827 - DNA, 22 bp, Homo sapiens
aagccttccccttatcctccct

SEQ ID NO: 5546828 - DNA, 18 bp, Homo sapiens
aagccttcgaaaagaaat

SEQ ID NO: 5546829 - DNA, 20 bp, Homo sapiens
aagccttcgaaaagaaattg

SEQ ID NO: 5546830 - DNA, 21 bp, Homo sapiens
aagccttcgaaaagaaattgt

SEQ ID NO: 5546831 - DNA, 12 bp, Homo sapiens
aagccttctgac

SEQ ID NO: 5546832 - DNA, 13 bp, Homo sapiens
aagccttctgcag

SEQ ID NO: 5546833 - DNA, 14 bp, Homo sapiens
aagccttctgcagc

SEQ ID NO: 5546834 - DNA, 21 bp, Homo sapiens
aagccttctgcagcaggaact

SEQ ID NO: 5546835 - DNA, 13 bp, Homo sapiens
aagccttctggat

SEQ ID NO: 5546836 - DNA, 21 bp, Homo sapiens
aagccttctggatccatgggg

SEQ ID NO: 5546837 - DNA, 22 bp, Homo sapiens
aagccttcttatatctgaagat

SEQ ID NO: 5546838 - DNA, 20 bp, Homo sapiens
aagccttgattggtgttgcc

SEQ ID NO: 5546839 - DNA, 18 bp, Homo sapiens
aagccttggaaccagccc

SEQ ID NO: 5546840 - DNA, 23 bp, Homo sapiens
aagccttgggttccaaccaggca

SEQ ID NO: 5546841 - DNA, 17 bp, Homo sapiens
aagcctttaaattgttc

SEQ ID NO: 5546842 - DNA, 22 bp, Homo sapiens
aagcctttaaattgttcctctt

SEQ ID NO: 5546843 - DNA, 23 bp, Homo sapiens
aagcctttactgaccctggggct

SEQ ID NO: 5546844 - DNA, 19 bp, Homo sapiens
aagcctttagtatcagtgt

SEQ ID NO: 5546845 - DNA, 15 bp, Homo sapiens
aagcctttcattttg

SEQ ID NO: 5546846 - DNA, 14 bp, Homo sapiens
aagcctttccataa

SEQ ID NO: 5546847 - DNA, 21 bp, Homo sapiens
aagcctttgccgtgagcatgc

SEQ ID NO: 5546848 - DNA, 22 bp, Homo sapiens
aagcctttgccgtgagcatgca

SEQ ID NO: 5546849 - DNA, 21 bp, Homo sapiens
aagcctttggtgaattccttc

SEQ ID NO: 5546850 - DNA, 10 bp, Homo sapiens
aagcctttgt

SEQ ID NO: 5546851 - DNA, 15 bp, Homo sapiens
aagccttttaaatca

SEQ ID NO: 5546852 - DNA, 17 bp, Homo sapiens
aagccttttaaatcatc

SEQ ID NO: 5546853 - DNA, 22 bp, Homo sapiens
aagccttttccataaagtgtaa

SEQ ID NO: 5546854 - DNA, 17 bp, Homo sapiens
aagccttttgcaaatag

SEQ ID NO: 5546855 - DNA, 16 bp, Homo sapiens
aagcgaagatgatttc

SEQ ID NO: 5546856 - DNA, 22 bp, Homo sapiens
aagcgaagtctttgccttctct

SEQ ID NO: 5546857 - DNA, 15 bp, Homo sapiens
aagcgaattatactc

SEQ ID NO: 5546858 - DNA, 12 bp, Homo sapiens
aagcgacagatt

SEQ ID NO: 5546859 - DNA, 15 bp, Homo sapiens
aagcgactctcctgt

SEQ ID NO: 5546860 - DNA, 15 bp, Homo sapiens
aagcgacttcaggtc

SEQ ID NO: 5546861 - DNA, 18 bp, Homo sapiens
aagcgatcctccttcctc

SEQ ID NO: 5546862 - DNA, 15 bp, Homo sapiens
aagcgattctcctgc

SEQ ID NO: 5546863 - DNA, 19 bp, Homo sapiens
aagcgattctcttgcctca

SEQ ID NO: 5546864 - DNA, 15 bp, Homo sapiens
aagcgattcttctgc

SEQ ID NO: 5546865 - DNA, 21 bp, Homo sapiens
aagcgattcttgtgcctcagc

SEQ ID NO: 5546866 - DNA, 14 bp, Homo sapiens
aagcgcagagaaat

SEQ ID NO: 5546867 - DNA, 23 bp, Homo sapiens
aagcgcagggaggatgccacagc

SEQ ID NO: 5546868 - DNA, 23 bp, Homo sapiens
aagcgcatccaatctcaaggaat

SEQ ID NO: 5546869 - DNA, 15 bp, Homo sapiens
aagcgccaggctgga

SEQ ID NO: 5546870 - DNA, 12 bp, Homo sapiens
aagcgccctcac

SEQ ID NO: 5546871 - DNA, 13 bp, Homo sapiens
aagcgccctggcc

SEQ ID NO: 5546872 - DNA, 15 bp, Homo sapiens
aagcgccctggcccc

SEQ ID NO: 5546873 - DNA, 19 bp, Homo sapiens
aagcgccctggcccccaca

SEQ ID NO: 5546874 - DNA, 15 bp, Homo sapiens
aagcgcctattgttt

SEQ ID NO: 5546875 - DNA, 15 bp, Homo sapiens
aagcgcgttgtgtat

SEQ ID NO: 5546876 - DNA, 13 bp, Homo sapiens
aagcgctcatctg

SEQ ID NO: 5546877 - DNA, 15 bp, Homo sapiens
aagcgctccagggcc

SEQ ID NO: 5546878 - DNA, 22 bp, Homo sapiens
aagcgctccagggccgtgaggg

SEQ ID NO: 5546879 - DNA, 16 bp, Homo sapiens
aagcgctcccagcctg

SEQ ID NO: 5546880 - DNA, 18 bp, Homo sapiens
aagcgctcccagcctgcc

SEQ ID NO: 5546881 - DNA, 15 bp, Homo sapiens
aagcgctgtttcctt

SEQ ID NO: 5546882 - DNA, 18 bp, Homo sapiens
aagcggagagagccaaga

SEQ ID NO: 5546883 - DNA, 15 bp, Homo sapiens
aagcggcatagcacc

SEQ ID NO: 5546884 - DNA, 24 bp, Homo sapiens
aagcggctcaagaataaaatatga

SEQ ID NO: 5546885 - DNA, 22 bp, Homo sapiens
aagcggctcaagcccaggaggg

SEQ ID NO: 5546886 - DNA, 14 bp, Homo sapiens
aagcggctggcagc

SEQ ID NO: 5546887 - DNA, 22 bp, Homo sapiens
aagcggggcttcatctgcaaag

SEQ ID NO: 5546888 - DNA, 13 bp, Homo sapiens
aagcggtggagga

SEQ ID NO: 5546889 - DNA, 20 bp, Homo sapiens
aagcggtttccaggccaccg

SEQ ID NO: 5546890 - DNA, 17 bp, Homo sapiens
aagcgtcgccccagtgg

SEQ ID NO: 5546891 - DNA, 20 bp, Homo sapiens
aagcgtcgccccagtggcac

SEQ ID NO: 5546892 - DNA, 21 bp, Homo sapiens
aagcgtctgggcaagaggaaa

SEQ ID NO: 5546893 - DNA, 15 bp, Homo sapiens
aagcgtctttaagag

SEQ ID NO: 5546894 - DNA, 19 bp, Homo sapiens
aagcgtctttaagagactc

SEQ ID NO: 5546895 - DNA, 23 bp, Homo sapiens
aagcgtgcacaaggattgaaaat

SEQ ID NO: 5546896 - DNA, 17 bp, Homo sapiens
aagcgtgctgacatcag

SEQ ID NO: 5546897 - DNA, 16 bp, Homo sapiens
aagcgtgttctcagca

SEQ ID NO: 5546898 - DNA, 18 bp, Homo sapiens
aagcgtgttctcagcaca

SEQ ID NO: 5546899 - DNA, 22 bp, Homo sapiens
aagcgttcatatgctctgcttt

SEQ ID NO: 5546900 - DNA, 20 bp, Homo sapiens
aagcgttcctggccttctga

SEQ ID NO: 5546901 - DNA, 15 bp, Homo sapiens
aagcgtttctgtgta

SEQ ID NO: 5546902 - DNA, 15 bp, Homo sapiens
aagcgtttttaacct

SEQ ID NO: 5546903 - DNA, 21 bp, Homo sapiens
aagcgtttttaacctgttttg

SEQ ID NO: 5546904 - DNA, 14 bp, Homo sapiens
aagctaaaacactt

SEQ ID NO: 5546905 - DNA, 23 bp, Homo sapiens
aagctaaaacctgagctagaagc

SEQ ID NO: 5546906 - DNA, 12 bp, Homo sapiens
aagctaaaagga

SEQ ID NO: 5546907 - DNA, 15 bp, Homo sapiens
aagctaaaaggaaaa

SEQ ID NO: 5546908 - DNA, 15 bp, Homo sapiens
aagctaaaaggtttc

SEQ ID NO: 5546909 - DNA, 15 bp, Homo sapiens
aagctaaaataaaga

SEQ ID NO: 5546910 - DNA, 21 bp, Homo sapiens
aagctaaaatatataatatac

SEQ ID NO: 5546911 - DNA, 12 bp, Homo sapiens
aagctaaagaaa

SEQ ID NO: 5546912 - DNA, 21 bp, Homo sapiens
aagctaaatcctttactgtta

SEQ ID NO: 5546913 - DNA, 23 bp, Homo sapiens
aagctaacagggaaggcaggcag

SEQ ID NO: 5546914 - DNA, 15 bp, Homo sapiens
aagctaacatcttta

SEQ ID NO: 5546915 - DNA, 18 bp, Homo sapiens
aagctaagtaaaaatatg

SEQ ID NO: 5546916 - DNA, 17 bp, Homo sapiens
aagctaataaaatatca

SEQ ID NO: 5546917 - DNA, 15 bp, Homo sapiens
aagctaatactaata

SEQ ID NO: 5546918 - DNA, 13 bp, Homo sapiens
aagctaatgaact

SEQ ID NO: 5546919 - DNA, 15 bp, Homo sapiens
aagctaatgaccaac

SEQ ID NO: 5546920 - DNA, 23 bp, Homo sapiens
aagctaatgaccaacctgtttct

SEQ ID NO: 5546921 - DNA, 19 bp, Homo sapiens
aaggaaagtttgccaggag

SEQ ID NO: 5546922 - DNA, 21 bp, Homo sapiens
aaggaaagtttgccaggagga

SEQ ID NO: 5546923 - DNA, 14 bp, Homo sapiens
aaggaaataaagcg

SEQ ID NO: 5546924 - DNA, 19 bp, Homo sapiens
aaggaaataaaggtaaaat

SEQ ID NO: 5546925 - DNA, 16 bp, Homo sapiens
aaggaaataacattgc

SEQ ID NO: 5546926 - DNA, 22 bp, Homo sapiens
aaggaaataccagttctgggca

SEQ ID NO: 5546927 - DNA, 19 bp, Homo sapiens
aaggaaataggttttaggt

SEQ ID NO: 5546928 - DNA, 13 bp, Homo sapiens
aaggaaatatatt

SEQ ID NO: 5546929 - DNA, 18 bp, Homo sapiens
aaggaaatatcataatgt

SEQ ID NO: 5546930 - DNA, 14 bp, Homo sapiens
aaggaaatccaaaa

SEQ ID NO: 5546931 - DNA, 16 bp, Homo sapiens
aaggaaatctcacccc

SEQ ID NO: 5546932 - DNA, 22 bp, Homo sapiens
aaggaaatctcaccccatccca

SEQ ID NO: 5546933 - DNA, 18 bp, Homo sapiens
aaggaaatgagtggccag

SEQ ID NO: 5546934 - DNA, 24 bp, Homo sapiens
aaggaaatgagtggccagcgccag

SEQ ID NO: 5546935 - DNA, 13 bp, Homo sapiens
aaggaaatgatgg

SEQ ID NO: 5546936 - DNA, 14 bp, Homo sapiens
aaggaaatgatgga

SEQ ID NO: 5546937 - DNA, 14 bp, Homo sapiens
aaggaaatgattga

SEQ ID NO: 5546938 - DNA, 21 bp, Homo sapiens
aaggaaatgattgaggagtga

SEQ ID NO: 5546939 - DNA, 14 bp, Homo sapiens
aaggaaatgtcatg

SEQ ID NO: 5546940 - DNA, 18 bp, Homo sapiens
aaggaaatgtcctgcatg

SEQ ID NO: 5546941 - DNA, 12 bp, Homo sapiens
aaggaaatgtta

SEQ ID NO: 5546942 - DNA, 20 bp, Homo sapiens
aaggaaatgttgagggcaag

SEQ ID NO: 5546943 - DNA, 20 bp, Homo sapiens
aaggaaattcagattgttta

SEQ ID NO: 5546944 - DNA, 14 bp, Homo sapiens
aaggaaatttgttt

SEQ ID NO: 5546945 - DNA, 15 bp, Homo sapiens
aaggaaatttgtttg

SEQ ID NO: 5546946 - DNA, 13 bp, Homo sapiens
aaggaaattttac

SEQ ID NO: 5546947 - DNA, 23 bp, Homo sapiens
aaggaacaaaaaaaccacaaagg

SEQ ID NO: 5546948 - DNA, 15 bp, Homo sapiens
aaggaacacccggaa

SEQ ID NO: 5546949 - DNA, 18 bp, Homo sapiens
aaggaacacgtttttaca

SEQ ID NO: 5546950 - DNA, 21 bp, Homo sapiens
aaggaacactggaaaataaat

SEQ ID NO: 5546951 - DNA, 17 bp, Homo sapiens
aaggaacagcaatggtg

SEQ ID NO: 5546952 - DNA, 19 bp, Homo sapiens
aaggaacagtgctgttctg

SEQ ID NO: 5546953 - DNA, 21 bp, Homo sapiens
aaggaacagttgcatttagct

SEQ ID NO: 5546954 - DNA, 21 bp, Homo sapiens
aaggaacatggagctgtcatc

SEQ ID NO: 5546955 - DNA, 14 bp, Homo sapiens
aaggaacatttatc

SEQ ID NO: 5546956 - DNA, 22 bp, Homo sapiens
aaggaaccaaagcgaattttaa

SEQ ID NO: 5546957 - DNA, 18 bp, Homo sapiens
aaggaacctaattgaaat

SEQ ID NO: 5546958 - DNA, 18 bp, Homo sapiens
aaggaacgtatatcacat

SEQ ID NO: 5546959 - DNA, 23 bp, Homo sapiens
aaggaactaggtcaaaaatctgt

SEQ ID NO: 5546960 - DNA, 18 bp, Homo sapiens
aaggaactcaaggtggct

SEQ ID NO: 5546961 - DNA, 22 bp, Homo sapiens
aaggaactctggcttccaggta

SEQ ID NO: 5546962 - DNA, 14 bp, Homo sapiens
aaggaactggaaca

SEQ ID NO: 5546963 - DNA, 17 bp, Homo sapiens
aaggaacttgaaaaata

SEQ ID NO: 5546964 - DNA, 12 bp, Homo sapiens
aaggaagaaaac

SEQ ID NO: 5546965 - DNA, 15 bp, Homo sapiens
aaggaagaaaacgga

SEQ ID NO: 5546966 - DNA, 14 bp, Homo sapiens
aaggaagaagaaat

SEQ ID NO: 5546967 - DNA, 15 bp, Homo sapiens
aaggaagaataattt

SEQ ID NO: 5546968 - DNA, 15 bp, Homo sapiens
aaggaagagaagaca

SEQ ID NO: 5546969 - DNA, 21 bp, Homo sapiens
aaggaagagccaatgttttcc

SEQ ID NO: 5546970 - DNA, 21 bp, Homo sapiens
aaggaagatcctgaagcagtt

SEQ ID NO: 5546971 - DNA, 23 bp, Homo sapiens
aaggaagatcttgagagctgctg

SEQ ID NO: 5546972 - DNA, 22 bp, Homo sapiens
aaggaagccacagctggtggta

SEQ ID NO: 5546973 - DNA, 17 bp, Homo sapiens
aaggaagccctctcaga

SEQ ID NO: 5546974 - DNA, 23 bp, Homo sapiens
aaggaagccttgctcattcttga

SEQ ID NO: 5546975 - DNA, 23 bp, Homo sapiens
aaggaagcgaaggatatattatg

SEQ ID NO: 5546976 - DNA, 16 bp, Homo sapiens
aaggaagctccactgt

SEQ ID NO: 5546977 - DNA, 12 bp, Homo sapiens
aaggaaggaaag

SEQ ID NO: 5546978 - DNA, 16 bp, Homo sapiens
aaggaaggaaagaaag

SEQ ID NO: 5546979 - DNA, 20 bp, Homo sapiens
aaggaaggacacattgtttt

SEQ ID NO: 5546980 - DNA, 12 bp, Homo sapiens
aaggaaggacca

SEQ ID NO: 5546981 - DNA, 13 bp, Homo sapiens
aaggaaggagccc

SEQ ID NO: 5546982 - DNA, 13 bp, Homo sapiens
aaggaaggaggca

SEQ ID NO: 5546983 - DNA, 17 bp, Homo sapiens
aaggaaggcagggagga

SEQ ID NO: 5546984 - DNA, 13 bp, Homo sapiens
aaggaaggctctc

SEQ ID NO: 5546985 - DNA, 17 bp, Homo sapiens
aaggaaggctgaaggct

SEQ ID NO: 5546986 - DNA, 13 bp, Homo sapiens
aaggaagggacac

SEQ ID NO: 5546987 - DNA, 15 bp, Homo sapiens
aaggaagggacacac

SEQ ID NO: 5546988 - DNA, 17 bp, Homo sapiens
aaggaagggacacacac

SEQ ID NO: 5546989 - DNA, 23 bp, Homo sapiens
aaggaagggcagagaatggctgg

SEQ ID NO: 5546990 - DNA, 21 bp, Homo sapiens
aaggaaggggctatcctggga

SEQ ID NO: 5546991 - DNA, 22 bp, Homo sapiens
aaggaagggtggctttgcattt

SEQ ID NO: 5546992 - DNA, 12 bp, Homo sapiens
aaggaaggtgga

SEQ ID NO: 5546993 - DNA, 17 bp, Homo sapiens
aaggaagtcttcaaatt

SEQ ID NO: 5546994 - DNA, 23 bp, Homo sapiens
aaggaagtcttcaaatttgattc

SEQ ID NO: 5546995 - DNA, 14 bp, Homo sapiens
aaggaagtgaggta

SEQ ID NO: 5546996 - DNA, 16 bp, Homo sapiens
aaggaagtgccccctc

SEQ ID NO: 5546997 - DNA, 19 bp, Homo sapiens
aaggaagtggggtgttctt

SEQ ID NO: 5546998 - DNA, 23 bp, Homo sapiens
aaggaagttattaacgggcatgt

SEQ ID NO: 5546999 - DNA, 15 bp, Homo sapiens
aaggaagtttgattt

SEQ ID NO: 5547000 - DNA, 21 bp, Homo sapiens
aaggaagttttaactttaata

SEQ ID NO: 5547001 - DNA, 14 bp, Homo sapiens
aaggaataagcatt

SEQ ID NO: 5547002 - DNA, 18 bp, Homo sapiens
aaggaatacctgtccccc

SEQ ID NO: 5547003 - DNA, 20 bp, Homo sapiens
aaggaatagatctatgattg

SEQ ID NO: 5547004 - DNA, 16 bp, Homo sapiens
aaggaatatatggcag

SEQ ID NO: 5547005 - DNA, 16 bp, Homo sapiens
aaggaatcaaatctta

SEQ ID NO: 5547006 - DNA, 19 bp, Homo sapiens
aaggaatcacgttagagga

SEQ ID NO: 5547007 - DNA, 20 bp, Homo sapiens
aaggaatccactcccaggca

SEQ ID NO: 5547008 - DNA, 22 bp, Homo sapiens
aaggaatccactcccaggcagc

SEQ ID NO: 5547009 - DNA, 16 bp, Homo sapiens
aaggaatcctctggga

SEQ ID NO: 5547010 - DNA, 17 bp, Homo sapiens
aaggaatctccagtttt

SEQ ID NO: 5547011 - DNA, 17 bp, Homo sapiens
aaggaatctggcattct

SEQ ID NO: 5547012 - DNA, 13 bp, Homo sapiens
aaggaatcttctc

SEQ ID NO: 5547013 - DNA, 21 bp, Homo sapiens
aaggaatctttaagcagagaa

SEQ ID NO: 5547014 - DNA, 15 bp, Homo sapiens
aaggaatgcaaagat

SEQ ID NO: 5547015 - DNA, 16 bp, Homo sapiens
aaggaatgcaaagatg

SEQ ID NO: 5547016 - DNA, 18 bp, Homo sapiens
aaggaatgcaagagaagg

SEQ ID NO: 5547017 - DNA, 17 bp, Homo sapiens
aaggaatgcctgtgcca

SEQ ID NO: 5547018 - DNA, 17 bp, Homo sapiens
aaggaatgcttggaata

SEQ ID NO: 5547019 - DNA, 13 bp, Homo sapiens
aaggaatgttatc

SEQ ID NO: 5547020 - DNA, 19 bp, Homo sapiens
aaggaatgttatcagtatt

SEQ ID NO: 5547021 - DNA, 20 bp, Homo sapiens
aaggaattctaggcatccca

SEQ ID NO: 5547022 - DNA, 17 bp, Homo sapiens
aaggaatttcttaactt

SEQ ID NO: 5547023 - DNA, 20 bp, Homo sapiens
aaggaatttcttaacttctt

SEQ ID NO: 5547024 - DNA, 14 bp, Homo sapiens
aaggaattttgtaa

SEQ ID NO: 5547025 - DNA, 16 bp, Homo sapiens
aaggacaaagtctcca

SEQ ID NO: 5547026 - DNA, 21 bp, Homo sapiens
aaggacaaagtctccagccca

SEQ ID NO: 5547027 - DNA, 19 bp, Homo sapiens
aaggacaaagtgccaaaga

SEQ ID NO: 5547028 - DNA, 20 bp, Homo sapiens
aaggacaaagtgccaaagaa

SEQ ID NO: 5547029 - DNA, 21 bp, Homo sapiens
aaggacaaatctaaaatgcaa

SEQ ID NO: 5547030 - DNA, 15 bp, Homo sapiens
aaggacaaattagca

SEQ ID NO: 5547031 - DNA, 21 bp, Homo sapiens
aaggacaaattagcatgcaag

SEQ ID NO: 5547032 - DNA, 13 bp, Homo sapiens
aaggacaacagtt

SEQ ID NO: 5547033 - DNA, 18 bp, Homo sapiens
aaggacaatcccaggaag

SEQ ID NO: 5547034 - DNA, 13 bp, Homo sapiens
aaggacaatgcct

SEQ ID NO: 5547035 - DNA, 13 bp, Homo sapiens
aaggacacagcag

SEQ ID NO: 5547036 - DNA, 12 bp, Homo sapiens
aaggacactggg

SEQ ID NO: 5547037 - DNA, 13 bp, Homo sapiens
aaggacagaacat

SEQ ID NO: 5547038 - DNA, 17 bp, Homo sapiens
aaggacagacagcaggc

SEQ ID NO: 5547039 - DNA, 21 bp, Homo sapiens
aaggacagactggccgggcag

SEQ ID NO: 5547040 - DNA, 15 bp, Homo sapiens
aaggacagagccagc

SEQ ID NO: 5547041 - DNA, 13 bp, Homo sapiens
aaggacagcagct

SEQ ID NO: 5547042 - DNA, 18 bp, Homo sapiens
aaggacagcagctggtgc

SEQ ID NO: 5547043 - DNA, 15 bp, Homo sapiens
aaggacagcatcaaa

SEQ ID NO: 5547044 - DNA, 13 bp, Homo sapiens
aaggacagcccct

SEQ ID NO: 5547045 - DNA, 15 bp, Homo sapiens
aaggacagctcagaa

SEQ ID NO: 5547046 - DNA, 13 bp, Homo sapiens
aaggacagctgtg

SEQ ID NO: 5547047 - DNA, 13 bp, Homo sapiens
aaggacaggagcc

SEQ ID NO: 5547048 - DNA, 20 bp, Homo sapiens
aaggacaggaggaggagatg

SEQ ID NO: 5547049 - DNA, 13 bp, Homo sapiens
aaggacaggcagg

SEQ ID NO: 5547050 - DNA, 23 bp, Homo sapiens
aaggacagggctggctcctctgc

SEQ ID NO: 5547051 - DNA, 18 bp, Homo sapiens
aaggacaggtctctgaga

SEQ ID NO: 5547052 - DNA, 22 bp, Homo sapiens
aaggacaggtctctgagacagg

SEQ ID NO: 5547053 - DNA, 15 bp, Homo sapiens
aaggacagtccctgc

SEQ ID NO: 5547054 - DNA, 17 bp, Homo sapiens
aaggacagtccctgctg

SEQ ID NO: 5547055 - DNA, 18 bp, Homo sapiens
aaggacagtgttcaaatt

SEQ ID NO: 5547056 - DNA, 16 bp, Homo sapiens
aaggacagttcagaga

SEQ ID NO: 5547057 - DNA, 21 bp, Homo sapiens
aaggacatgagactaagagaa

SEQ ID NO: 5547058 - DNA, 22 bp, Homo sapiens
aaggacatgagatcagggcctg

SEQ ID NO: 5547059 - DNA, 19 bp, Homo sapiens
aaggacatggtgagtctat

SEQ ID NO: 5547060 - DNA, 17 bp, Homo sapiens
aaggacattcactgctg

SEQ ID NO: 5547061 - DNA, 15 bp, Homo sapiens
aaggacattcttgta

SEQ ID NO: 5547062 - DNA, 18 bp, Homo sapiens
aaggacattgcggacagc

SEQ ID NO: 5547063 - DNA, 21 bp, Homo sapiens
aaggacattgtatgcagggag

SEQ ID NO: 5547064 - DNA, 15 bp, Homo sapiens
aaggacatttgggac

SEQ ID NO: 5547065 - DNA, 22 bp, Homo sapiens
aaggacatttgggactgtcttg

SEQ ID NO: 5547066 - DNA, 19 bp, Homo sapiens
aaggaccaactggcttctg

SEQ ID NO: 5547067 - DNA, 20 bp, Homo sapiens
aaggaccaactggcttctgt

SEQ ID NO: 5547068 - DNA, 20 bp, Homo sapiens
aaggacccaaatttccctgg

SEQ ID NO: 5547069 - DNA, 13 bp, Homo sapiens
aaggacccaccca

SEQ ID NO: 5547070 - DNA, 24 bp, Homo sapiens
aaggacccacccatcttcctgctg

SEQ ID NO: 5547071 - DNA, 12 bp, Homo sapiens
aaggacccaggc

SEQ ID NO: 5547072 - DNA, 13 bp, Homo sapiens
aaggacccaggcg

SEQ ID NO: 5547073 - DNA, 15 bp, Homo sapiens
aaggacccaggcgct

SEQ ID NO: 5547074 - DNA, 16 bp, Homo sapiens
aaggacccaggcgctg

SEQ ID NO: 5547075 - DNA, 21 bp, Homo sapiens
aaggacccaggcgctgcatac

SEQ ID NO: 5547076 - DNA, 13 bp, Homo sapiens
aaggaccccaggt

SEQ ID NO: 5547077 - DNA, 18 bp, Homo sapiens
aaggacccggaggggcct

SEQ ID NO: 5547078 - DNA, 19 bp, Homo sapiens
aaggaccctgtttctgtag

SEQ ID NO: 5547079 - DNA, 20 bp, Homo sapiens
aaggaccctgttttccacac

SEQ ID NO: 5547080 - DNA, 15 bp, Homo sapiens
aaggacctaaattcg

SEQ ID NO: 5547081 - DNA, 13 bp, Homo sapiens
aaggacctcctga

SEQ ID NO: 5547082 - DNA, 16 bp, Homo sapiens
aaggacctgaaataag

SEQ ID NO: 5547083 - DNA, 18 bp, Homo sapiens
aaggacctgagctggcca

SEQ ID NO: 5547084 - DNA, 17 bp, Homo sapiens
aaggacctgctcccaca

SEQ ID NO: 5547085 - DNA, 12 bp, Homo sapiens
aaggaccttaag

SEQ ID NO: 5547086 - DNA, 18 bp, Homo sapiens
aaggaccttaagacagag

SEQ ID NO: 5547087 - DNA, 21 bp, Homo sapiens
aaggaccttcactctaagatg

SEQ ID NO: 5547088 - DNA, 19 bp, Homo sapiens
aaggacgcctgcaggagag

SEQ ID NO: 5547089 - DNA, 16 bp, Homo sapiens
aaggacgctggctact

SEQ ID NO: 5547090 - DNA, 16 bp, Homo sapiens
aaggacggcaggagtg

SEQ ID NO: 5547091 - DNA, 20 bp, Homo sapiens
aaggacggtccccacccctc

SEQ ID NO: 5547092 - DNA, 16 bp, Homo sapiens
aaggacgtaaaattta

SEQ ID NO: 5547093 - DNA, 22 bp, Homo sapiens
aaggactaatccaatacctctt

SEQ ID NO: 5547094 - DNA, 22 bp, Homo sapiens
aaggactagatactactttctc

SEQ ID NO: 5547095 - DNA, 23 bp, Homo sapiens
aaggactagatactactttctct

SEQ ID NO: 5547096 - DNA, 13 bp, Homo sapiens
aaggactagggtc

SEQ ID NO: 5547097 - DNA, 19 bp, Homo sapiens
aaggactatattaatcacc

SEQ ID NO: 5547098 - DNA, 22 bp, Homo sapiens
aaggactatttataactaatat

SEQ ID NO: 5547099 - DNA, 22 bp, Homo sapiens
aaggctccaggagcagccacat

SEQ ID NO: 5547100 - DNA, 15 bp, Homo sapiens
aaggctccatatata

SEQ ID NO: 5547101 - DNA, 15 bp, Homo sapiens
aaggctccccacccc

SEQ ID NO: 5547102 - DNA, 21 bp, Homo sapiens
aaggctccctcgccctgtgag

SEQ ID NO: 5547103 - DNA, 22 bp, Homo sapiens
aaggctcgattttgtatctgca

SEQ ID NO: 5547104 - DNA, 23 bp, Homo sapiens
aaggctcgattttgtatctgcag

SEQ ID NO: 5547105 - DNA, 20 bp, Homo sapiens
aaggctctatgagtctagat

SEQ ID NO: 5547106 - DNA, 12 bp, Homo sapiens
aaggctctcccc

SEQ ID NO: 5547107 - DNA, 17 bp, Homo sapiens
aaggctctcccctctcg

SEQ ID NO: 5547108 - DNA, 23 bp, Homo sapiens
aaggctctcccctctcgccccat

SEQ ID NO: 5547109 - DNA, 23 bp, Homo sapiens
aaggctctcgggtgggggagcca

SEQ ID NO: 5547110 - DNA, 15 bp, Homo sapiens
aaggctctctctgtc

SEQ ID NO: 5547111 - DNA, 17 bp, Homo sapiens
aaggctctctctgtccc

SEQ ID NO: 5547112 - DNA, 14 bp, Homo sapiens
aaggctctgagagt

SEQ ID NO: 5547113 - DNA, 20 bp, Homo sapiens
aaggctctgagagtctagat

SEQ ID NO: 5547114 - DNA, 21 bp, Homo sapiens
aaggctctgagagtctagatt

SEQ ID NO: 5547115 - DNA, 12 bp, Homo sapiens
aaggctctgtca

SEQ ID NO: 5547116 - DNA, 20 bp, Homo sapiens
aaggctctgtcactccaggc

SEQ ID NO: 5547117 - DNA, 16 bp, Homo sapiens
aaggctctgtgccttg

SEQ ID NO: 5547118 - DNA, 17 bp, Homo sapiens
aaggctctgtgccttgg

SEQ ID NO: 5547119 - DNA, 23 bp, Homo sapiens
aaggctctgttccacatatattt

SEQ ID NO: 5547120 - DNA, 17 bp, Homo sapiens
aaggctcttctccccag

SEQ ID NO: 5547121 - DNA, 21 bp, Homo sapiens
aaggctcttctccttggagga

SEQ ID NO: 5547122 - DNA, 15 bp, Homo sapiens
aaggctgaaaagtgc

SEQ ID NO: 5547123 - DNA, 18 bp, Homo sapiens
aaggctgaaaagtgcttt

SEQ ID NO: 5547124 - DNA, 18 bp, Homo sapiens
aaggctgaactcttcaga

SEQ ID NO: 5547125 - DNA, 16 bp, Homo sapiens
aaggctgaccaagaga

SEQ ID NO: 5547126 - DNA, 18 bp, Homo sapiens
aaggctgactacattttt

SEQ ID NO: 5547127 - DNA, 12 bp, Homo sapiens
aaggctgagaag

SEQ ID NO: 5547128 - DNA, 22 bp, Homo sapiens
aaggctgagacagtgaatttgg

SEQ ID NO: 5547129 - DNA, 11 bp, Homo sapiens
aaggctgagag

SEQ ID NO: 5547130 - DNA, 22 bp, Homo sapiens
aaggctgaggcaggaggatcac

SEQ ID NO: 5547131 - DNA, 15 bp, Homo sapiens
aaggctgaggctgcc

SEQ ID NO: 5547132 - DNA, 15 bp, Homo sapiens
aaggctgcaacgctg

SEQ ID NO: 5547133 - DNA, 20 bp, Homo sapiens
aaggctgcagctaatttgtg

SEQ ID NO: 5547134 - DNA, 20 bp, Homo sapiens
aaggctgccaacggggagcg

SEQ ID NO: 5547135 - DNA, 13 bp, Homo sapiens
aaggctgccaggg

SEQ ID NO: 5547136 - DNA, 23 bp, Homo sapiens
aaggctgcccactggagacgcct

SEQ ID NO: 5547137 - DNA, 16 bp, Homo sapiens
aaggctgcccctgtaa

SEQ ID NO: 5547138 - DNA, 21 bp, Homo sapiens
aaggctgcccctgtaaggttt

SEQ ID NO: 5547139 - DNA, 13 bp, Homo sapiens
aaggctgccctgg

SEQ ID NO: 5547140 - DNA, 14 bp, Homo sapiens
aaggctgccctggg

SEQ ID NO: 5547141 - DNA, 14 bp, Homo sapiens
aaggctgccctgtc

SEQ ID NO: 5547142 - DNA, 14 bp, Homo sapiens
aaggctgccggctg

SEQ ID NO: 5547143 - DNA, 12 bp, Homo sapiens
aaggctgcctgc

SEQ ID NO: 5547144 - DNA, 13 bp, Homo sapiens
aaggctgcctgga

SEQ ID NO: 5547145 - DNA, 18 bp, Homo sapiens
aaggctgcctggagaaag

SEQ ID NO: 5547146 - DNA, 19 bp, Homo sapiens
aaggctgcctggagaaagg

SEQ ID NO: 5547147 - DNA, 22 bp, Homo sapiens
aaggctgcctggagaaaggatg

SEQ ID NO: 5547148 - DNA, 19 bp, Homo sapiens
aaggctgcgtctggagggg

SEQ ID NO: 5547149 - DNA, 12 bp, Homo sapiens
aaggctgctggc

SEQ ID NO: 5547150 - DNA, 13 bp, Homo sapiens
aaggctgctggct

SEQ ID NO: 5547151 - DNA, 21 bp, Homo sapiens
aaggctgctggcttcagggag

SEQ ID NO: 5547152 - DNA, 17 bp, Homo sapiens
aaggctgctgtgtagct

SEQ ID NO: 5547153 - DNA, 12 bp, Homo sapiens
aaggctggctga

SEQ ID NO: 5547154 - DNA, 16 bp, Homo sapiens
aaggctggctgggcat

SEQ ID NO: 5547155 - DNA, 14 bp, Homo sapiens
aaggctggggctat

SEQ ID NO: 5547156 - DNA, 19 bp, Homo sapiens
aaggctgggggaagaagct

SEQ ID NO: 5547157 - DNA, 16 bp, Homo sapiens
aaggctggggtcttgg

SEQ ID NO: 5547158 - DNA, 21 bp, Homo sapiens
aaggctgggtaatgtgaaggc

SEQ ID NO: 5547159 - DNA, 17 bp, Homo sapiens
aaggctgggtccagggg

SEQ ID NO: 5547160 - DNA, 20 bp, Homo sapiens
aaggctggtaagagaagtga

SEQ ID NO: 5547161 - DNA, 21 bp, Homo sapiens
aaggctggtgaggtcctggtg

SEQ ID NO: 5547162 - DNA, 22 bp, Homo sapiens
aaggctggtggacagacccagg

SEQ ID NO: 5547163 - DNA, 19 bp, Homo sapiens
aaggctgtacatagtcctt

SEQ ID NO: 5547164 - DNA, 16 bp, Homo sapiens
aaggctgtattcagca

SEQ ID NO: 5547165 - DNA, 17 bp, Homo sapiens
aaggctgtattcagcaa

SEQ ID NO: 5547166 - DNA, 20 bp, Homo sapiens
aaggctgtcaattacaggaa

SEQ ID NO: 5547167 - DNA, 23 bp, Homo sapiens
aaggctgtcggggtcaagctgga

SEQ ID NO: 5547168 - DNA, 21 bp, Homo sapiens
aaggctgtcttctcccagagc

SEQ ID NO: 5547169 - DNA, 12 bp, Homo sapiens
aaggctgtgata

SEQ ID NO: 5547170 - DNA, 17 bp, Homo sapiens
aaggctgtgataaccag

SEQ ID NO: 5547171 - DNA, 17 bp, Homo sapiens
aaggctgtgccaggctg

SEQ ID NO: 5547172 - DNA, 22 bp, Homo sapiens
aaggctgtgccaggctgggagg

SEQ ID NO: 5547173 - DNA, 16 bp, Homo sapiens
aaggctgtgtaagatt

SEQ ID NO: 5547174 - DNA, 21 bp, Homo sapiens
aaggctgtgtaagatttgttt

SEQ ID NO: 5547175 - DNA, 20 bp, Homo sapiens
aaggctgtgtgaatttttct

SEQ ID NO: 5547176 - DNA, 22 bp, Homo sapiens
aaggctgtgtgtcttctgcccc

SEQ ID NO: 5547177 - DNA, 13 bp, Homo sapiens
aaggctgttgcat

SEQ ID NO: 5547178 - DNA, 21 bp, Homo sapiens
aaggctgttttaacggcctgc

SEQ ID NO: 5547179 - DNA, 15 bp, Homo sapiens
aaggcttaaacccat

SEQ ID NO: 5547180 - DNA, 12 bp, Homo sapiens
aaggcttaattg

SEQ ID NO: 5547181 - DNA, 14 bp, Homo sapiens
aaggcttaattgac

SEQ ID NO: 5547182 - DNA, 20 bp, Homo sapiens
aaggcttaggcctatagatt

SEQ ID NO: 5547183 - DNA, 22 bp, Homo sapiens
aaggcttccaatgtggtggcaa

SEQ ID NO: 5547184 - DNA, 19 bp, Homo sapiens
aaggcttccggctgagctg

SEQ ID NO: 5547185 - DNA, 23 bp, Homo sapiens
aaggcttccggctgagctgtgcc

SEQ ID NO: 5547186 - DNA, 12 bp, Homo sapiens
aaggcttctctc

SEQ ID NO: 5547187 - DNA, 15 bp, Homo sapiens
aaggcttctctccac

SEQ ID NO: 5547188 - DNA, 14 bp, Homo sapiens
aaggcttctctctc

SEQ ID NO: 5547189 - DNA, 23 bp, Homo sapiens
aaggcttctgggacttgaaatca

SEQ ID NO: 5547190 - DNA, 13 bp, Homo sapiens
aaggcttgaagct

SEQ ID NO: 5547191 - DNA, 13 bp, Homo sapiens
aaggcttggctgg

SEQ ID NO: 5547192 - DNA, 16 bp, Homo sapiens
aaggcttggctggtgt

SEQ ID NO: 5547193 - DNA, 18 bp, Homo sapiens
aaggctttaaagctgaga

SEQ ID NO: 5547194 - DNA, 17 bp, Homo sapiens
aaggctttcagggcctc

SEQ ID NO: 5547195 - DNA, 22 bp, Homo sapiens
aaggctttcagggcctccagcc

SEQ ID NO: 5547196 - DNA, 14 bp, Homo sapiens
aaggctttctctac

SEQ ID NO: 5547197 - DNA, 21 bp, Homo sapiens
aaggctttgccatgggcctgc

SEQ ID NO: 5547198 - DNA, 21 bp, Homo sapiens
aaggcttttgatccttttgag

SEQ ID NO: 5547199 - DNA, 16 bp, Homo sapiens
aaggctttttataaac

SEQ ID NO: 5547200 - DNA, 15 bp, Homo sapiens
aagggaaaaaaaatg

SEQ ID NO: 5547201 - DNA, 14 bp, Homo sapiens
aagggaaaaaagaa

SEQ ID NO: 5547202 - DNA, 16 bp, Homo sapiens
aagggaaaaaagaaag

SEQ ID NO: 5547203 - DNA, 18 bp, Homo sapiens
aagggaaaaaagaaagaa

SEQ ID NO: 5547204 - DNA, 20 bp, Homo sapiens
aagggaaaaaagaaagaaaa

SEQ ID NO: 5547205 - DNA, 15 bp, Homo sapiens
aagggaaaaagttgt

SEQ ID NO: 5547206 - DNA, 20 bp, Homo sapiens
aagggaaaaatcaagtatta

SEQ ID NO: 5547207 - DNA, 15 bp, Homo sapiens
aagggaaaagggaga

SEQ ID NO: 5547208 - DNA, 18 bp, Homo sapiens
aagggaaacagtcatttg

SEQ ID NO: 5547209 - DNA, 16 bp, Homo sapiens
aagggaaagcctctgg

SEQ ID NO: 5547210 - DNA, 18 bp, Homo sapiens
aagggaaagcctctggcc

SEQ ID NO: 5547211 - DNA, 22 bp, Homo sapiens
aagggaaagcttcattctcctt

SEQ ID NO: 5547212 - DNA, 14 bp, Homo sapiens
aagggaaatcaatt

SEQ ID NO: 5547213 - DNA, 17 bp, Homo sapiens
aagggaaatcaatttaa

SEQ ID NO: 5547214 - DNA, 13 bp, Homo sapiens
aagggaacacaaa

SEQ ID NO: 5547215 - DNA, 17 bp, Homo sapiens
aagggaacagaaactac

SEQ ID NO: 5547216 - DNA, 17 bp, Homo sapiens
aagggaacagcctgagc

SEQ ID NO: 5547217 - DNA, 20 bp, Homo sapiens
aagggaaccagccctccaga

SEQ ID NO: 5547218 - DNA, 18 bp, Homo sapiens
aagggaagacatttcttt

SEQ ID NO: 5547219 - DNA, 17 bp, Homo sapiens
aagggaagcagagcctg

SEQ ID NO: 5547220 - DNA, 19 bp, Homo sapiens
aagggaagcagagcctggg

SEQ ID NO: 5547221 - DNA, 15 bp, Homo sapiens
aagggaagcctgact

SEQ ID NO: 5547222 - DNA, 16 bp, Homo sapiens
aagggaagcctgactg

SEQ ID NO: 5547223 - DNA, 14 bp, Homo sapiens
aagggaaggacaga

SEQ ID NO: 5547224 - DNA, 18 bp, Homo sapiens
aagggaaggggcctccct

SEQ ID NO: 5547225 - DNA, 16 bp, Homo sapiens
aagggaagtgaggccc

SEQ ID NO: 5547226 - DNA, 14 bp, Homo sapiens
aagggaagtgggga

SEQ ID NO: 5547227 - DNA, 17 bp, Homo sapiens
aagggaagttgtgcctt

SEQ ID NO: 5547228 - DNA, 17 bp, Homo sapiens
aagggaatactcacatt

SEQ ID NO: 5547229 - DNA, 21 bp, Homo sapiens
aagggaatagaaatgtttgct

SEQ ID NO: 5547230 - DNA, 18 bp, Homo sapiens
aagggaatgaatccatta

SEQ ID NO: 5547231 - DNA, 21 bp, Homo sapiens
aagggaattcgatgcccccct

SEQ ID NO: 5547232 - DNA, 13 bp, Homo sapiens
aagggacacagga

SEQ ID NO: 5547233 - DNA, 21 bp, Homo sapiens
aagggacacaggagaccaccc

SEQ ID NO: 5547234 - DNA, 22 bp, Homo sapiens
aagggacacaggagaccacccc

SEQ ID NO: 5547235 - DNA, 23 bp, Homo sapiens
aagggacactggatccagaagct

SEQ ID NO: 5547236 - DNA, 21 bp, Homo sapiens
aagggacacttttatgttttt

SEQ ID NO: 5547237 - DNA, 15 bp, Homo sapiens
aagggacagaaaaga

SEQ ID NO: 5547238 - DNA, 19 bp, Homo sapiens
aagggacagaaaagaaagc

SEQ ID NO: 5547239 - DNA, 12 bp, Homo sapiens
aagggacagcaa

SEQ ID NO: 5547240 - DNA, 13 bp, Homo sapiens
aagggacagccca

SEQ ID NO: 5547241 - DNA, 16 bp, Homo sapiens
aagggacagctgctgg

SEQ ID NO: 5547242 - DNA, 13 bp, Homo sapiens
aagggacaggaga

SEQ ID NO: 5547243 - DNA, 20 bp, Homo sapiens
aagggacaggagaagagagg

SEQ ID NO: 5547244 - DNA, 19 bp, Homo sapiens
aagggacagtattctcagt

SEQ ID NO: 5547245 - DNA, 20 bp, Homo sapiens
aagggacatgttttgataaa

SEQ ID NO: 5547246 - DNA, 21 bp, Homo sapiens
aagggaccaagcgaccaagga

SEQ ID NO: 5547247 - DNA, 14 bp, Homo sapiens
aagggacccacctg

SEQ ID NO: 5547248 - DNA, 13 bp, Homo sapiens
aagggaccccaga

SEQ ID NO: 5547249 - DNA, 14 bp, Homo sapiens
aagggaccccagat

SEQ ID NO: 5547250 - DNA, 23 bp, Homo sapiens
aagggaccccagatacctgtgag

SEQ ID NO: 5547251 - DNA, 19 bp, Homo sapiens
aagggacccgaagcccagg

SEQ ID NO: 5547252 - DNA, 15 bp, Homo sapiens
aagggaccctttgcc

SEQ ID NO: 5547253 - DNA, 19 bp, Homo sapiens
aagggaccctttgggggtt

SEQ ID NO: 5547254 - DNA, 14 bp, Homo sapiens
aagggaccttcagg

SEQ ID NO: 5547255 - DNA, 18 bp, Homo sapiens
aagggaccttcagggaga

SEQ ID NO: 5547256 - DNA, 23 bp, Homo sapiens
aagggaccttcagggagagctgg

SEQ ID NO: 5547257 - DNA, 23 bp, Homo sapiens
aagggacggggcccgccccaggc

SEQ ID NO: 5547258 - DNA, 22 bp, Homo sapiens
aagggacggttgtggtgaagtt

SEQ ID NO: 5547259 - DNA, 19 bp, Homo sapiens
aagggactacctctgtgcc

SEQ ID NO: 5547260 - DNA, 18 bp, Homo sapiens
aagggactccagaagcag

SEQ ID NO: 5547261 - DNA, 22 bp, Homo sapiens
aagggactccagaagcagcagc

SEQ ID NO: 5547262 - DNA, 18 bp, Homo sapiens
aagggactctgggctgtg

SEQ ID NO: 5547263 - DNA, 15 bp, Homo sapiens
aagggactgagaaat

SEQ ID NO: 5547264 - DNA, 21 bp, Homo sapiens
aagggactgagagatgcagaa

SEQ ID NO: 5547265 - DNA, 13 bp, Homo sapiens
aagggactggtcc

SEQ ID NO: 5547266 - DNA, 14 bp, Homo sapiens
aagggactggtcca

SEQ ID NO: 5547267 - DNA, 18 bp, Homo sapiens
aagggacttaacttgttt

SEQ ID NO: 5547268 - DNA, 13 bp, Homo sapiens
aagggagaaaaga

SEQ ID NO: 5547269 - DNA, 18 bp, Homo sapiens
aagggagaaaagagaaac

SEQ ID NO: 5547270 - DNA, 17 bp, Homo sapiens
aagggagaaagaaaact

SEQ ID NO: 5547271 - DNA, 15 bp, Homo sapiens
aagggagaaatgcca

SEQ ID NO: 5547272 - DNA, 12 bp, Homo sapiens
aagggagaagaa

SEQ ID NO: 5547273 - DNA, 14 bp, Homo sapiens
aagggagaagaaat

SEQ ID NO: 5547274 - DNA, 17 bp, Homo sapiens
aagggagaagaaatcca

SEQ ID NO: 5547275 - DNA, 20 bp, Homo sapiens
aagggagagaaaagctggac

SEQ ID NO: 5547276 - DNA, 13 bp, Homo sapiens
aaggtgtttgaaa

SEQ ID NO: 5547277 - DNA, 15 bp, Homo sapiens
aaggtgtttgaaaat

SEQ ID NO: 5547278 - DNA, 17 bp, Homo sapiens
aaggtgttttctgtgta

SEQ ID NO: 5547279 - DNA, 18 bp, Homo sapiens
aaggttaaaggaaaagca

SEQ ID NO: 5547280 - DNA, 14 bp, Homo sapiens
aaggttaagccata

SEQ ID NO: 5547281 - DNA, 20 bp, Homo sapiens
aaggttaatgttcatcatcc

SEQ ID NO: 5547282 - DNA, 22 bp, Homo sapiens
aaggttaattctctagggctag

SEQ ID NO: 5547283 - DNA, 22 bp, Homo sapiens
aaggttaatttttccttcctct

SEQ ID NO: 5547284 - DNA, 22 bp, Homo sapiens
aaggttactcagcagcagagag

SEQ ID NO: 5547285 - DNA, 18 bp, Homo sapiens
aaggttactgggagtgtg

SEQ ID NO: 5547286 - DNA, 17 bp, Homo sapiens
aaggttagaggtttgtc

SEQ ID NO: 5547287 - DNA, 18 bp, Homo sapiens
aaggttagaggtttgtca

SEQ ID NO: 5547288 - DNA, 17 bp, Homo sapiens
aaggttaggatttaaca

SEQ ID NO: 5547289 - DNA, 19 bp, Homo sapiens
aaggttaggtttgtcaaca

SEQ ID NO: 5547290 - DNA, 15 bp, Homo sapiens
aaggttataattttt

SEQ ID NO: 5547291 - DNA, 18 bp, Homo sapiens
aaggttatcagtgcttcc

SEQ ID NO: 5547292 - DNA, 14 bp, Homo sapiens
aaggttatgaaaca

SEQ ID NO: 5547293 - DNA, 20 bp, Homo sapiens
aaggttatgaaacatatcat

SEQ ID NO: 5547294 - DNA, 13 bp, Homo sapiens
aaggttatgtaga

SEQ ID NO: 5547295 - DNA, 17 bp, Homo sapiens
aaggttatttatttaaa

SEQ ID NO: 5547296 - DNA, 22 bp, Homo sapiens
aaggttatttatttaaatgtct

SEQ ID NO: 5547297 - DNA, 16 bp, Homo sapiens
aaggttcagaaaatta

SEQ ID NO: 5547298 - DNA, 22 bp, Homo sapiens
aaggttccaatcagatctttat

SEQ ID NO: 5547299 - DNA, 15 bp, Homo sapiens
aaggttccacagagt

SEQ ID NO: 5547300 - DNA, 17 bp, Homo sapiens
aaggttcccgttgcatt

SEQ ID NO: 5547301 - DNA, 23 bp, Homo sapiens
aaggttccgcttggagcagaggg

SEQ ID NO: 5547302 - DNA, 11 bp, Homo sapiens
aaggttctaag

SEQ ID NO: 5547303 - DNA, 13 bp, Homo sapiens
aaggttctaaggc

SEQ ID NO: 5547304 - DNA, 14 bp, Homo sapiens
aaggttctaaggcc

SEQ ID NO: 5547305 - DNA, 12 bp, Homo sapiens
aaggttctaggt

SEQ ID NO: 5547306 - DNA, 21 bp, Homo sapiens
aaggttctcaggtgttgccaa

SEQ ID NO: 5547307 - DNA, 16 bp, Homo sapiens
aaggttctcatttctc

SEQ ID NO: 5547308 - DNA, 17 bp, Homo sapiens
aaggttctcatttctca

SEQ ID NO: 5547309 - DNA, 18 bp, Homo sapiens
aaggttctggtgtgaact

SEQ ID NO: 5547310 - DNA, 19 bp, Homo sapiens
aaggttcttcatccctttc

SEQ ID NO: 5547311 - DNA, 18 bp, Homo sapiens
aaggttcttgctttctct

SEQ ID NO: 5547312 - DNA, 13 bp, Homo sapiens
aaggttgaataat

SEQ ID NO: 5547313 - DNA, 17 bp, Homo sapiens
aaggttgaataatatat

SEQ ID NO: 5547314 - DNA, 15 bp, Homo sapiens
aaggttgaattaatt

SEQ ID NO: 5547315 - DNA, 22 bp, Homo sapiens
aaggttgacaataaatgtgctt

SEQ ID NO: 5547316 - DNA, 19 bp, Homo sapiens
aaggttgagtatgtgaaga

SEQ ID NO: 5547317 - DNA, 15 bp, Homo sapiens
aaggttgcacagcaa

SEQ ID NO: 5547318 - DNA, 20 bp, Homo sapiens
aaggttgccaaattgctgca

SEQ ID NO: 5547319 - DNA, 14 bp, Homo sapiens
aaggttgctgttgt

SEQ ID NO: 5547320 - DNA, 17 bp, Homo sapiens
aaggttggaactgctgc

SEQ ID NO: 5547321 - DNA, 23 bp, Homo sapiens
aaggttggaactgctgccatgat

SEQ ID NO: 5547322 - DNA, 14 bp, Homo sapiens
aaggttggatggat

SEQ ID NO: 5547323 - DNA, 15 bp, Homo sapiens
aaggttggccttact

SEQ ID NO: 5547324 - DNA, 19 bp, Homo sapiens
aaggttggcgtgccctgga

SEQ ID NO: 5547325 - DNA, 16 bp, Homo sapiens
aaggttgggcagggtg

SEQ ID NO: 5547326 - DNA, 16 bp, Homo sapiens
aaggttggttgctaag

SEQ ID NO: 5547327 - DNA, 13 bp, Homo sapiens
aaggttgtattac

SEQ ID NO: 5547328 - DNA, 13 bp, Homo sapiens
aaggttgtgtaca

SEQ ID NO: 5547329 - DNA, 18 bp, Homo sapiens
aaggttgttttgaaactg

SEQ ID NO: 5547330 - DNA, 22 bp, Homo sapiens
aaggtttaaacttctctgaagg

SEQ ID NO: 5547331 - DNA, 23 bp, Homo sapiens
aaggtttaaacttctctgaaggg

SEQ ID NO: 5547332 - DNA, 20 bp, Homo sapiens
aaggtttaaagagtctagat

SEQ ID NO: 5547333 - DNA, 21 bp, Homo sapiens
aaggtttaaatgaacaagaga

SEQ ID NO: 5547334 - DNA, 19 bp, Homo sapiens
aaggtttaggctggtggcc

SEQ ID NO: 5547335 - DNA, 22 bp, Homo sapiens
aaggtttaggctggtggcccag

SEQ ID NO: 5547336 - DNA, 16 bp, Homo sapiens
aaggtttataaagcag

SEQ ID NO: 5547337 - DNA, 14 bp, Homo sapiens
aaggtttcaacaaa

SEQ ID NO: 5547338 - DNA, 22 bp, Homo sapiens
aaggtttccactattatagaaa

SEQ ID NO: 5547339 - DNA, 19 bp, Homo sapiens
aaggtttcccagtgagcct

SEQ ID NO: 5547340 - DNA, 16 bp, Homo sapiens
aaggtttctgaaaatt

SEQ ID NO: 5547341 - DNA, 20 bp, Homo sapiens
aaggtttctggagcagtgga

SEQ ID NO: 5547342 - DNA, 23 bp, Homo sapiens
aaggtttgatgccaaagcagaca

SEQ ID NO: 5547343 - DNA, 14 bp, Homo sapiens
aaggtttgttttca

SEQ ID NO: 5547344 - DNA, 15 bp, Homo sapiens
aaggttttaggttct

SEQ ID NO: 5547345 - DNA, 17 bp, Homo sapiens
aaggttttaggttctaa

SEQ ID NO: 5547346 - DNA, 20 bp, Homo sapiens
aaggttttataaggctgatg

SEQ ID NO: 5547347 - DNA, 20 bp, Homo sapiens
aaggttttcctcttctattt

SEQ ID NO: 5547348 - DNA, 23 bp, Homo sapiens
aaggttttggttatggagtcttg

SEQ ID NO: 5547349 - DNA, 19 bp, Homo sapiens
aaggttttggttgcattat

SEQ ID NO: 5547350 - DNA, 23 bp, Homo sapiens
aaggttttgttgtgttctgttga

SEQ ID NO: 5547351 - DNA, 19 bp, Homo sapiens
aaggtttttgatagcattg

SEQ ID NO: 5547352 - DNA, 18 bp, Homo sapiens
aaggttttttttttaagt

SEQ ID NO: 5547353 - DNA, 19 bp, Homo sapiens
aaggttttttttttaagtg

SEQ ID NO: 5547354 - DNA, 17 bp, Homo sapiens
aagtaaaaaaaatcaga

SEQ ID NO: 5547355 - DNA, 21 bp, Homo sapiens
aagtaaaaaagttaaatgtgt

SEQ ID NO: 5547356 - DNA, 13 bp, Homo sapiens
aagtaaaaacaaa

SEQ ID NO: 5547357 - DNA, 22 bp, Homo sapiens
aagtaaaaacaaagaaattatg

SEQ ID NO: 5547358 - DNA, 18 bp, Homo sapiens
aagtaaaaattaaaaaat

SEQ ID NO: 5547359 - DNA, 16 bp, Homo sapiens
aagtaaaacaaatgaa

SEQ ID NO: 5547360 - DNA, 15 bp, Homo sapiens
aagtaaaacagtcat

SEQ ID NO: 5547361 - DNA, 16 bp, Homo sapiens
aagtaaaaccacagca

SEQ ID NO: 5547362 - DNA, 15 bp, Homo sapiens
aagtaaaagaaaagc

SEQ ID NO: 5547363 - DNA, 19 bp, Homo sapiens
aagtaaaagatcaggttat

SEQ ID NO: 5547364 - DNA, 13 bp, Homo sapiens
aagtaaaagcaaa

SEQ ID NO: 5547365 - DNA, 18 bp, Homo sapiens
aagtaaaagcaaaaaaga

SEQ ID NO: 5547366 - DNA, 21 bp, Homo sapiens
aagtaaaagcaaaaaagaaaa

SEQ ID NO: 5547367 - DNA, 16 bp, Homo sapiens
aagtaaaagtagtgtt

SEQ ID NO: 5547368 - DNA, 20 bp, Homo sapiens
aagtaaaagtctacctgtgt

SEQ ID NO: 5547369 - DNA, 14 bp, Homo sapiens
aagtaaaatgaaca

SEQ ID NO: 5547370 - DNA, 14 bp, Homo sapiens
aagtaaaatgtctt

SEQ ID NO: 5547371 - DNA, 17 bp, Homo sapiens
aagtaaaattagagcaa

SEQ ID NO: 5547372 - DNA, 21 bp, Homo sapiens
aagtaaaattagagcaagaac

SEQ ID NO: 5547373 - DNA, 22 bp, Homo sapiens
aagtaaaattatcctctttgta

SEQ ID NO: 5547374 - DNA, 16 bp, Homo sapiens
aagtaaaattgtttca

SEQ ID NO: 5547375 - DNA, 12 bp, Homo sapiens
aagtaaactttt

SEQ ID NO: 5547376 - DNA, 16 bp, Homo sapiens
aagtaaagaactgcac

SEQ ID NO: 5547377 - DNA, 12 bp, Homo sapiens
aagtaaagctaa

SEQ ID NO: 5547378 - DNA, 23 bp, Homo sapiens
aagtaaaggcctcctcccccacc

SEQ ID NO: 5547379 - DNA, 13 bp, Homo sapiens
aagtaaagtaaag

SEQ ID NO: 5547380 - DNA, 21 bp, Homo sapiens
aagtaaagtattggatttttt

SEQ ID NO: 5547381 - DNA, 16 bp, Homo sapiens
aagtaaagtgaagaat

SEQ ID NO: 5547382 - DNA, 16 bp, Homo sapiens
aagtaaagtgatgttt

SEQ ID NO: 5547383 - DNA, 19 bp, Homo sapiens
aagtaaagtgatgtttgtg

SEQ ID NO: 5547384 - DNA, 21 bp, Homo sapiens
aagtaaatacaagactgttgt

SEQ ID NO: 5547385 - DNA, 13 bp, Homo sapiens
aagtaaatacaat

SEQ ID NO: 5547386 - DNA, 17 bp, Homo sapiens
aagtaaatacaattttt

SEQ ID NO: 5547387 - DNA, 18 bp, Homo sapiens
aagtaaatgctacctctg

SEQ ID NO: 5547388 - DNA, 15 bp, Homo sapiens
aagtaaatgtagctc

SEQ ID NO: 5547389 - DNA, 18 bp, Homo sapiens
aagtaaattacattaaaa

SEQ ID NO: 5547390 - DNA, 14 bp, Homo sapiens
aagtaaattgaaat

SEQ ID NO: 5547391 - DNA, 21 bp, Homo sapiens
aagtaaattttctttaagtca

SEQ ID NO: 5547392 - DNA, 14 bp, Homo sapiens
aagtaacagtatgt

SEQ ID NO: 5547393 - DNA, 12 bp, Homo sapiens
aagtaacatata

SEQ ID NO: 5547394 - DNA, 16 bp, Homo sapiens
aagtaacatataaatt

SEQ ID NO: 5547395 - DNA, 21 bp, Homo sapiens
aagtaacatgacttccttatt

SEQ ID NO: 5547396 - DNA, 22 bp, Homo sapiens
aagtaacatgcatactttattg

SEQ ID NO: 5547397 - DNA, 22 bp, Homo sapiens
aagtaaccaggccccagcctcc

SEQ ID NO: 5547398 - DNA, 19 bp, Homo sapiens
aagtaacctgggcttaagt

SEQ ID NO: 5547399 - DNA, 15 bp, Homo sapiens
aagtaacgtgctcac

SEQ ID NO: 5547400 - DNA, 14 bp, Homo sapiens
aagtaactataaca

SEQ ID NO: 5547401 - DNA, 22 bp, Homo sapiens
aagtaactataacaaaaaaaga

SEQ ID NO: 5547402 - DNA, 12 bp, Homo sapiens
aagtaactcatt

SEQ ID NO: 5547403 - DNA, 15 bp, Homo sapiens
aagtaactcattgct

SEQ ID NO: 5547404 - DNA, 15 bp, Homo sapiens
aagtaacttatttga

SEQ ID NO: 5547405 - DNA, 15 bp, Homo sapiens
aagtaacttattttg

SEQ ID NO: 5547406 - DNA, 18 bp, Homo sapiens
aagtaacttgtcttaaat

SEQ ID NO: 5547407 - DNA, 22 bp, Homo sapiens
aagtaacttgtcttaaataaaa

SEQ ID NO: 5547408 - DNA, 13 bp, Homo sapiens
aagtaactttaaa

SEQ ID NO: 5547409 - DNA, 18 bp, Homo sapiens
aagtaactttaaattatg

SEQ ID NO: 5547410 - DNA, 21 bp, Homo sapiens
aagtaactttattcttgaaag

SEQ ID NO: 5547411 - DNA, 19 bp, Homo sapiens
aagtaacttttaaaatttg

SEQ ID NO: 5547412 - DNA, 15 bp, Homo sapiens
aagtaacttttacaa

SEQ ID NO: 5547413 - DNA, 15 bp, Homo sapiens
aagtaagaaaatatt

SEQ ID NO: 5547414 - DNA, 18 bp, Homo sapiens
aagtaagaaaatattttg

SEQ ID NO: 5547415 - DNA, 19 bp, Homo sapiens
aagtaagaaaatattttgt

SEQ ID NO: 5547416 - DNA, 13 bp, Homo sapiens
aagtaagaaagaa

SEQ ID NO: 5547417 - DNA, 18 bp, Homo sapiens
aagtaagaaagtgaagca

SEQ ID NO: 5547418 - DNA, 20 bp, Homo sapiens
aagtaagaaagtgaagcaaa

SEQ ID NO: 5547419 - DNA, 20 bp, Homo sapiens
aagtaagaagacatgaacca

SEQ ID NO: 5547420 - DNA, 16 bp, Homo sapiens
aagtaagaatggccaa

SEQ ID NO: 5547421 - DNA, 15 bp, Homo sapiens
aagtaagagactcag

SEQ ID NO: 5547422 - DNA, 15 bp, Homo sapiens
aagtaagagctctaa

SEQ ID NO: 5547423 - DNA, 20 bp, Homo sapiens
aagtaagagtggtggcctat

SEQ ID NO: 5547424 - DNA, 20 bp, Homo sapiens
aagtaagatgtaaattgaag

SEQ ID NO: 5547425 - DNA, 13 bp, Homo sapiens
aagtaagcaaaga

SEQ ID NO: 5547426 - DNA, 17 bp, Homo sapiens
aagtaagcaacagcata

SEQ ID NO: 5547427 - DNA, 15 bp, Homo sapiens
aagtaaggtgcagtt

SEQ ID NO: 5547428 - DNA, 14 bp, Homo sapiens
aagtaagtctcaag

SEQ ID NO: 5547429 - DNA, 16 bp, Homo sapiens
aagtaagtctcaaggt

SEQ ID NO: 5547430 - DNA, 22 bp, Homo sapiens
aagtaagtcttttttttttcca

SEQ ID NO: 5547431 - DNA, 21 bp, Homo sapiens
aagtaagtggagcatttggaa

SEQ ID NO: 5547432 - DNA, 15 bp, Homo sapiens
aagtaagtgtctgtg

SEQ ID NO: 5547433 - DNA, 12 bp, Homo sapiens
aagtaagttaat

SEQ ID NO: 5547434 - DNA, 19 bp, Homo sapiens
aagtaagttaataatgtat

SEQ ID NO: 5547435 - DNA, 21 bp, Homo sapiens
aagtaataaattccaatacaa

SEQ ID NO: 5547436 - DNA, 16 bp, Homo sapiens
aagtaataatgtgcaa

SEQ ID NO: 5547437 - DNA, 17 bp, Homo sapiens
aagtaatacgttttgac

SEQ ID NO: 5547438 - DNA, 18 bp, Homo sapiens
aagtaatacgttttgaca

SEQ ID NO: 5547439 - DNA, 19 bp, Homo sapiens
aagtaatacgttttgacat

SEQ ID NO: 5547440 - DNA, 13 bp, Homo sapiens
aagtaatataatg

SEQ ID NO: 5547441 - DNA, 21 bp, Homo sapiens
aagtaatataatggaagagaa

SEQ ID NO: 5547442 - DNA, 14 bp, Homo sapiens
aagtaatatatcaa

SEQ ID NO: 5547443 - DNA, 16 bp, Homo sapiens
aagtaatatgcacaca

SEQ ID NO: 5547444 - DNA, 18 bp, Homo sapiens
aagtaatatgcacacatt

SEQ ID NO: 5547445 - DNA, 16 bp, Homo sapiens
aagtaatatttaaaga

SEQ ID NO: 5547446 - DNA, 16 bp, Homo sapiens
aagtaatcactaaccc

SEQ ID NO: 5547447 - DNA, 14 bp, Homo sapiens
aagtaatcacttaa

SEQ ID NO: 5547448 - DNA, 16 bp, Homo sapiens
aagtaatcacttaaag

SEQ ID NO: 5547449 - DNA, 21 bp, Homo sapiens
aagtaatccacctgcctcggc

SEQ ID NO: 5547450 - DNA, 18 bp, Homo sapiens
aagtaatctcacagcatt

SEQ ID NO: 5547451 - DNA, 21 bp, Homo sapiens
aagtaatctcacagcatttgc

SEQ ID NO: 5547452 - DNA, 21 bp, Homo sapiens
aagtaatctttaactgaactc

SEQ ID NO: 5547453 - DNA, 18 bp, Homo sapiens
aagtaatctttttacagt

SEQ ID NO: 5547454 - DNA, 17 bp, Homo sapiens
aagtcactcccaagccc

SEQ ID NO: 5547455 - DNA, 19 bp, Homo sapiens
aagtcactgcaaaaccagg

SEQ ID NO: 5547456 - DNA, 22 bp, Homo sapiens
aagtcactgcaaaaccaggttt

SEQ ID NO: 5547457 - DNA, 12 bp, Homo sapiens
aagtcactgcac

SEQ ID NO: 5547458 - DNA, 17 bp, Homo sapiens
aagtcacttaactataa

SEQ ID NO: 5547459 - DNA, 20 bp, Homo sapiens
aagtcacttactattgttgc

SEQ ID NO: 5547460 - DNA, 14 bp, Homo sapiens
aagtcacttccagt

SEQ ID NO: 5547461 - DNA, 14 bp, Homo sapiens
aagtcacttctcca

SEQ ID NO: 5547462 - DNA, 16 bp, Homo sapiens
aagtcagaatcagaag

SEQ ID NO: 5547463 - DNA, 23 bp, Homo sapiens
aagtcagaatcagaagatagtct

SEQ ID NO: 5547464 - DNA, 16 bp, Homo sapiens
aagtcagactgctggg

SEQ ID NO: 5547465 - DNA, 20 bp, Homo sapiens
aagtcagactgctgggactg

SEQ ID NO: 5547466 - DNA, 17 bp, Homo sapiens
aagtcagagaaaacact

SEQ ID NO: 5547467 - DNA, 14 bp, Homo sapiens
aagtcagagacaga

SEQ ID NO: 5547468 - DNA, 15 bp, Homo sapiens
aagtcagaggatggc

SEQ ID NO: 5547469 - DNA, 18 bp, Homo sapiens
aagtcagagttaaaatat

SEQ ID NO: 5547470 - DNA, 19 bp, Homo sapiens
aagtcagagttaaaatata

SEQ ID NO: 5547471 - DNA, 18 bp, Homo sapiens
aagtcagatctgcctaag

SEQ ID NO: 5547472 - DNA, 12 bp, Homo sapiens
aagtcagatgac

SEQ ID NO: 5547473 - DNA, 20 bp, Homo sapiens
aagtcagatggaaaattcat

SEQ ID NO: 5547474 - DNA, 23 bp, Homo sapiens
aagtcagatggaaaattcatttt

SEQ ID NO: 5547475 - DNA, 13 bp, Homo sapiens
aagtcagatgttt

SEQ ID NO: 5547476 - DNA, 14 bp, Homo sapiens
aagtcagatgtttg

SEQ ID NO: 5547477 - DNA, 20 bp, Homo sapiens
aagtcagatttttatttatg

SEQ ID NO: 5547478 - DNA, 16 bp, Homo sapiens
aagtcagccacactgg

SEQ ID NO: 5547479 - DNA, 19 bp, Homo sapiens
aagtcagcccaacaggcag

SEQ ID NO: 5547480 - DNA, 14 bp, Homo sapiens
aagtcagctacaaa

SEQ ID NO: 5547481 - DNA, 20 bp, Homo sapiens
aagtcagctacaaaagttaa

SEQ ID NO: 5547482 - DNA, 21 bp, Homo sapiens
aagtcagctactctagttctg

SEQ ID NO: 5547483 - DNA, 20 bp, Homo sapiens
aagtcagctccagctttctg

SEQ ID NO: 5547484 - DNA, 16 bp, Homo sapiens
aagtcagctgaaggat

SEQ ID NO: 5547485 - DNA, 16 bp, Homo sapiens
aagtcaggacctggct

SEQ ID NO: 5547486 - DNA, 17 bp, Homo sapiens
aagtcaggacctggctt

SEQ ID NO: 5547487 - DNA, 16 bp, Homo sapiens
aagtcaggccaggtgg

SEQ ID NO: 5547488 - DNA, 17 bp, Homo sapiens
aagtcaggctagctgtg

SEQ ID NO: 5547489 - DNA, 15 bp, Homo sapiens
aagtcaggctgttgg

SEQ ID NO: 5547490 - DNA, 15 bp, Homo sapiens
aagtcaggtccaatt

SEQ ID NO: 5547491 - DNA, 20 bp, Homo sapiens
aagtcagtcacgtttccttt

SEQ ID NO: 5547492 - DNA, 20 bp, Homo sapiens
aagtcagttgctcaaaaaga

SEQ ID NO: 5547493 - DNA, 17 bp, Homo sapiens
aagtcagttggagaaaa

SEQ ID NO: 5547494 - DNA, 15 bp, Homo sapiens
aagtcataattgcat

SEQ ID NO: 5547495 - DNA, 17 bp, Homo sapiens
aagtcatccagtgaaac

SEQ ID NO: 5547496 - DNA, 21 bp, Homo sapiens
aagtcatcccctctcaggaga

SEQ ID NO: 5547497 - DNA, 15 bp, Homo sapiens
aagtcatcctcctgg

SEQ ID NO: 5547498 - DNA, 19 bp, Homo sapiens
aagtcatctacttaataaa

SEQ ID NO: 5547499 - DNA, 15 bp, Homo sapiens
aagtcatgaagccca

SEQ ID NO: 5547500 - DNA, 14 bp, Homo sapiens
aagtcatgaagctc

SEQ ID NO: 5547501 - DNA, 17 bp, Homo sapiens
aagtcatgcaaaggctg

SEQ ID NO: 5547502 - DNA, 14 bp, Homo sapiens
aagtcatgggagaa

SEQ ID NO: 5547503 - DNA, 18 bp, Homo sapiens
aagtcatgggagaagagg

SEQ ID NO: 5547504 - DNA, 14 bp, Homo sapiens
aagtcatggtcaca

SEQ ID NO: 5547505 - DNA, 19 bp, Homo sapiens
aagtcatgtatgtttctct

SEQ ID NO: 5547506 - DNA, 13 bp, Homo sapiens
aagtcattaaact

SEQ ID NO: 5547507 - DNA, 18 bp, Homo sapiens
aagtcattagaatgtcct

SEQ ID NO: 5547508 - DNA, 16 bp, Homo sapiens
aagtcattggcaaagt

SEQ ID NO: 5547509 - DNA, 19 bp, Homo sapiens
aagtcatttcaaaatatgt

SEQ ID NO: 5547510 - DNA, 20 bp, Homo sapiens
aagtcatttccgtccccccc

SEQ ID NO: 5547511 - DNA, 22 bp, Homo sapiens
aagtcatttccgtcccccccca

SEQ ID NO: 5547512 - DNA, 15 bp, Homo sapiens
aagtcatttgtgaaa

SEQ ID NO: 5547513 - DNA, 16 bp, Homo sapiens
aagtcattttaacttt

SEQ ID NO: 5547514 - DNA, 14 bp, Homo sapiens
aagtcattttgtaa

SEQ ID NO: 5547515 - DNA, 12 bp, Homo sapiens
aagtcatttttg

SEQ ID NO: 5547516 - DNA, 20 bp, Homo sapiens
aagtcattttttacttgaat

SEQ ID NO: 5547517 - DNA, 12 bp, Homo sapiens
aagtccaatgtg

SEQ ID NO: 5547518 - DNA, 19 bp, Homo sapiens
aagtccacagtggaaccag

SEQ ID NO: 5547519 - DNA, 22 bp, Homo sapiens
aagtccaccccaattaactgaa

SEQ ID NO: 5547520 - DNA, 17 bp, Homo sapiens
aagtccacctgcctatc

SEQ ID NO: 5547521 - DNA, 12 bp, Homo sapiens
aagtccactgtc

SEQ ID NO: 5547522 - DNA, 20 bp, Homo sapiens
aagtccagaagcctcctgtt

SEQ ID NO: 5547523 - DNA, 21 bp, Homo sapiens
aagtccagaagcctcctgttg

SEQ ID NO: 5547524 - DNA, 12 bp, Homo sapiens
aagtccagagcc

SEQ ID NO: 5547525 - DNA, 22 bp, Homo sapiens
aagtccagatttacactgggag

SEQ ID NO: 5547526 - DNA, 23 bp, Homo sapiens
aagtccagatttacactgggaga

SEQ ID NO: 5547527 - DNA, 19 bp, Homo sapiens
aagtccagctttctgcaga

SEQ ID NO: 5547528 - DNA, 22 bp, Homo sapiens
aagtccagctttctgcagactg

SEQ ID NO: 5547529 - DNA, 20 bp, Homo sapiens
aagtccaggcagagacaata

SEQ ID NO: 5547530 - DNA, 21 bp, Homo sapiens
aagtccaggtcctggtggggc

SEQ ID NO: 5547531 - DNA, 20 bp, Homo sapiens
aagtccagtgtttctttttt

SEQ ID NO: 5547532 - DNA, 19 bp, Homo sapiens
aagtccatagctgagctgg

SEQ ID NO: 5547533 - DNA, 15 bp, Homo sapiens
aagtccatctgtcac

SEQ ID NO: 5547534 - DNA, 21 bp, Homo sapiens
aagtccatgtgataattgtaa

SEQ ID NO: 5547535 - DNA, 23 bp, Homo sapiens
aagtcccaccggttgcttctggg

SEQ ID NO: 5547536 - DNA, 22 bp, Homo sapiens
aagtcccagggagctctgcata

SEQ ID NO: 5547537 - DNA, 18 bp, Homo sapiens
aagtcccagtatacctca

SEQ ID NO: 5547538 - DNA, 22 bp, Homo sapiens
aagtccccaggccccaggaagc

SEQ ID NO: 5547539 - DNA, 23 bp, Homo sapiens
aagtccccgagggcgaaggccat

SEQ ID NO: 5547540 - DNA, 16 bp, Homo sapiens
aagtccccgtccccca

SEQ ID NO: 5547541 - DNA, 18 bp, Homo sapiens
aagtccccttctgtgttt

SEQ ID NO: 5547542 - DNA, 20 bp, Homo sapiens
aagtcccgtgccctgtttcc

SEQ ID NO: 5547543 - DNA, 17 bp, Homo sapiens
aagtccctaggagggaa

SEQ ID NO: 5547544 - DNA, 13 bp, Homo sapiens
aagtccctccctg

SEQ ID NO: 5547545 - DNA, 19 bp, Homo sapiens
aagtccctgactctctgtg

SEQ ID NO: 5547546 - DNA, 17 bp, Homo sapiens
aagtccctggaaaagga

SEQ ID NO: 5547547 - DNA, 13 bp, Homo sapiens
aagtccctgttct

SEQ ID NO: 5547548 - DNA, 21 bp, Homo sapiens
aagtccctgttttctgagccc

SEQ ID NO: 5547549 - DNA, 22 bp, Homo sapiens
aagtccctgttttctgagcccg

SEQ ID NO: 5547550 - DNA, 21 bp, Homo sapiens
aagtcccttcctattctcctg

SEQ ID NO: 5547551 - DNA, 13 bp, Homo sapiens
aagtcccttcctg

SEQ ID NO: 5547552 - DNA, 23 bp, Homo sapiens
aagtccgaggcctggctctggag

SEQ ID NO: 5547553 - DNA, 18 bp, Homo sapiens
aagtcctatcgactttat

SEQ ID NO: 5547554 - DNA, 13 bp, Homo sapiens
aagtcctatctca

SEQ ID NO: 5547555 - DNA, 14 bp, Homo sapiens
aagtcctccctgac

SEQ ID NO: 5547556 - DNA, 11 bp, Homo sapiens
aagtcctctgc

SEQ ID NO: 5547557 - DNA, 22 bp, Homo sapiens
aagtcctctgtggccagctgca

SEQ ID NO: 5547558 - DNA, 22 bp, Homo sapiens
aagtcctcttttctgagaggac

SEQ ID NO: 5547559 - DNA, 16 bp, Homo sapiens
aagtcctgaacctttc

SEQ ID NO: 5547560 - DNA, 22 bp, Homo sapiens
aagtcctgctcctttctgccca

SEQ ID NO: 5547561 - DNA, 23 bp, Homo sapiens
aagtcctggcacagtttttgtaa

SEQ ID NO: 5547562 - DNA, 12 bp, Homo sapiens
aagtcctgtcac

SEQ ID NO: 5547563 - DNA, 20 bp, Homo sapiens
aagtccttagaatgagggaa

SEQ ID NO: 5547564 - DNA, 21 bp, Homo sapiens
aagtccttcagtgagcccctc

SEQ ID NO: 5547565 - DNA, 19 bp, Homo sapiens
aagtccttggactgttttg

SEQ ID NO: 5547566 - DNA, 20 bp, Homo sapiens
aagtcctttgagctcctggg

SEQ ID NO: 5547567 - DNA, 15 bp, Homo sapiens
aagtccttttgtaaa

SEQ ID NO: 5547568 - DNA, 15 bp, Homo sapiens
aagtcgaaggatgct

SEQ ID NO: 5547569 - DNA, 16 bp, Homo sapiens
aagtcgagcactctaa

SEQ ID NO: 5547570 - DNA, 12 bp, Homo sapiens
aagtcgccagtc

SEQ ID NO: 5547571 - DNA, 18 bp, Homo sapiens
aagtcgccagtcactgct

SEQ ID NO: 5547572 - DNA, 14 bp, Homo sapiens
aagtcgctgaacaa

SEQ ID NO: 5547573 - DNA, 19 bp, Homo sapiens
aagtcgcttttggtgcctg

SEQ ID NO: 5547574 - DNA, 19 bp, Homo sapiens
aagtcggatgtcagagcct

SEQ ID NO: 5547575 - DNA, 18 bp, Homo sapiens
aagtcgggtcaaaaataa

SEQ ID NO: 5547576 - DNA, 19 bp, Homo sapiens
aagtcgtccttactcctgt

SEQ ID NO: 5547577 - DNA, 19 bp, Homo sapiens
aagtcgtttcaggacatgg

SEQ ID NO: 5547578 - DNA, 17 bp, Homo sapiens
aagtcgttttccaaact

SEQ ID NO: 5547579 - DNA, 19 bp, Homo sapiens
aagtcgttttccaaactga

SEQ ID NO: 5547580 - DNA, 20 bp, Homo sapiens
aagtctaaaaagacctggcc

SEQ ID NO: 5547581 - DNA, 21 bp, Homo sapiens
aagtctaaaaagacctggcct

SEQ ID NO: 5547582 - DNA, 22 bp, Homo sapiens
aagtctaaaaagacctggcctt

SEQ ID NO: 5547583 - DNA, 21 bp, Homo sapiens
aagtctaaacaaaattgcaat

SEQ ID NO: 5547584 - DNA, 14 bp, Homo sapiens
aagtctaaacaatg

SEQ ID NO: 5547585 - DNA, 15 bp, Homo sapiens
aagtctaaacaatga

SEQ ID NO: 5547586 - DNA, 11 bp, Homo sapiens
aagtctaaagt

SEQ ID NO: 5547587 - DNA, 15 bp, Homo sapiens
aagtctaaagtttac

SEQ ID NO: 5547588 - DNA, 20 bp, Homo sapiens
aagtctaaagtttacagtaa

SEQ ID NO: 5547589 - DNA, 21 bp, Homo sapiens
aagtctaactttggttttctt

SEQ ID NO: 5547590 - DNA, 17 bp, Homo sapiens
aagtctaatgaagagaa

SEQ ID NO: 5547591 - DNA, 18 bp, Homo sapiens
aagtctaatgaagagaaa

SEQ ID NO: 5547592 - DNA, 16 bp, Homo sapiens
aagtctacactgcctt

SEQ ID NO: 5547593 - DNA, 20 bp, Homo sapiens
aagtctaccaacctgttcaa

SEQ ID NO: 5547594 - DNA, 21 bp, Homo sapiens
aagtctacctgccttgcctgt

SEQ ID NO: 5547595 - DNA, 16 bp, Homo sapiens
aagtctactttagtat

SEQ ID NO: 5547596 - DNA, 12 bp, Homo sapiens
aagtctagaaaa

SEQ ID NO: 5547597 - DNA, 21 bp, Homo sapiens
aagtctagaaaataatgcaaa

SEQ ID NO: 5547598 - DNA, 15 bp, Homo sapiens
aagtctagaaaccag

SEQ ID NO: 5547599 - DNA, 22 bp, Homo sapiens
aagtctaggagctgggaggaaa

SEQ ID NO: 5547600 - DNA, 11 bp, Homo sapiens
aagtctatgct

SEQ ID NO: 5547601 - DNA, 13 bp, Homo sapiens
aagtctatgctta

SEQ ID NO: 5547602 - DNA, 20 bp, Homo sapiens
aagtctattgaataatgtag

SEQ ID NO: 5547603 - DNA, 16 bp, Homo sapiens
aagtctattgtttgtt

SEQ ID NO: 5547604 - DNA, 15 bp, Homo sapiens
aagtctcaaagatct

SEQ ID NO: 5547605 - DNA, 17 bp, Homo sapiens
aagtctcaatgaaatag

SEQ ID NO: 5547606 - DNA, 21 bp, Homo sapiens
aagtctcacccattatctgga

SEQ ID NO: 5547607 - DNA, 15 bp, Homo sapiens
aagtctcagaagagg

SEQ ID NO: 5547608 - DNA, 12 bp, Homo sapiens
aagtctcagcct

SEQ ID NO: 5547609 - DNA, 14 bp, Homo sapiens
aagtctcagcctgg

SEQ ID NO: 5547610 - DNA, 19 bp, Homo sapiens
aagtctcagctaagctcac

SEQ ID NO: 5547611 - DNA, 14 bp, Homo sapiens
aagtctccaaagtc

SEQ ID NO: 5547612 - DNA, 14 bp, Homo sapiens
aagtctccacccct

SEQ ID NO: 5547613 - DNA, 19 bp, Homo sapiens
aagtctccacccctacaca

SEQ ID NO: 5547614 - DNA, 17 bp, Homo sapiens
aagtctccagaagaaaa

SEQ ID NO: 5547615 - DNA, 18 bp, Homo sapiens
aagtctccagaagaaaat

SEQ ID NO: 5547616 - DNA, 15 bp, Homo sapiens
aagtctccagcccac

SEQ ID NO: 5547617 - DNA, 19 bp, Homo sapiens
aagtctcccttctgtttct

SEQ ID NO: 5547618 - DNA, 12 bp, Homo sapiens
aagtctcctgtc

SEQ ID NO: 5547619 - DNA, 14 bp, Homo sapiens
aagtctccttcccc

SEQ ID NO: 5547620 - DNA, 18 bp, Homo sapiens
aagtctcctttactgaat

SEQ ID NO: 5547621 - DNA, 18 bp, Homo sapiens
aagtctctaattctatta

SEQ ID NO: 5547622 - DNA, 15 bp, Homo sapiens
aagtctctatttaaa

SEQ ID NO: 5547623 - DNA, 14 bp, Homo sapiens
aagtctctctaaga

SEQ ID NO: 5547624 - DNA, 14 bp, Homo sapiens
aagtctctctgtga

SEQ ID NO: 5547625 - DNA, 17 bp, Homo sapiens
aagtctctctgtgaata

SEQ ID NO: 5547626 - DNA, 20 bp, Homo sapiens
aagtctctgactcttgcctt

SEQ ID NO: 5547627 - DNA, 14 bp, Homo sapiens
aagtctctgctgct

SEQ ID NO: 5547628 - DNA, 15 bp, Homo sapiens
aagtctctgctggcc

SEQ ID NO: 5547629 - DNA, 21 bp, Homo sapiens
aagtctctgctggcccagcca

SEQ ID NO: 5547630 - DNA, 19 bp, Homo sapiens
aagtctctgggtcacgttt

SEQ ID NO: 5547631 - DNA, 12 bp, Homo sapiens
aagtctctgtga

SEQ ID NO: 5547632 - DNA, 17 bp, Homo sapiens
aagtgttcctgtctcaa

SEQ ID NO: 5547633 - DNA, 14 bp, Homo sapiens
aagtgttccttgct

SEQ ID NO: 5547634 - DNA, 20 bp, Homo sapiens
aagtgttctgttacaaaatg

SEQ ID NO: 5547635 - DNA, 22 bp, Homo sapiens
aagtgttctgttacaaaatgta

SEQ ID NO: 5547636 - DNA, 23 bp, Homo sapiens
aagtgttctgttacaaaatgtaa

SEQ ID NO: 5547637 - DNA, 19 bp, Homo sapiens
aagtgttcttaggtttact

SEQ ID NO: 5547638 - DNA, 19 bp, Homo sapiens
aagtgttcttcagtgtaat

SEQ ID NO: 5547639 - DNA, 16 bp, Homo sapiens
aagtgttgaaaaatat

SEQ ID NO: 5547640 - DNA, 16 bp, Homo sapiens
aagtgttgaaaatgta

SEQ ID NO: 5547641 - DNA, 22 bp, Homo sapiens
aagtgttgaaaatgtatttcct

SEQ ID NO: 5547642 - DNA, 22 bp, Homo sapiens
aagtgttgaagaagagtttgca

SEQ ID NO: 5547643 - DNA, 18 bp, Homo sapiens
aagtgttgctcttggaaa

SEQ ID NO: 5547644 - DNA, 21 bp, Homo sapiens
aagtgttggccatcatttcat

SEQ ID NO: 5547645 - DNA, 22 bp, Homo sapiens
aagtgttgtaaatatttatgta

SEQ ID NO: 5547646 - DNA, 23 bp, Homo sapiens
aagtgttgtaccatatgtagcat

SEQ ID NO: 5547647 - DNA, 22 bp, Homo sapiens
aagtgttgtatcaaagtgtgat

SEQ ID NO: 5547648 - DNA, 16 bp, Homo sapiens
aagtgttgtgttcctg

SEQ ID NO: 5547649 - DNA, 17 bp, Homo sapiens
aagtgttgtgttcctgg

SEQ ID NO: 5547650 - DNA, 17 bp, Homo sapiens
aagtgtttaaaagagcc

SEQ ID NO: 5547651 - DNA, 18 bp, Homo sapiens
aagtgtttaaaagcaaat

SEQ ID NO: 5547652 - DNA, 23 bp, Homo sapiens
aagtgtttaacttgtcaaaaaac

SEQ ID NO: 5547653 - DNA, 19 bp, Homo sapiens
aagtgtttaattgtataaa

SEQ ID NO: 5547654 - DNA, 16 bp, Homo sapiens
aagtgtttatttttca

SEQ ID NO: 5547655 - DNA, 14 bp, Homo sapiens
aagtgtttctcaaa

SEQ ID NO: 5547656 - DNA, 18 bp, Homo sapiens
aagtgtttctcaaaagag

SEQ ID NO: 5547657 - DNA, 14 bp, Homo sapiens
aagtgtttctgtta

SEQ ID NO: 5547658 - DNA, 19 bp, Homo sapiens
aagtgtttgaagtctgctc

SEQ ID NO: 5547659 - DNA, 23 bp, Homo sapiens
aagtgttttacaatgatttgtaa

SEQ ID NO: 5547660 - DNA, 18 bp, Homo sapiens
aagtgttttactcttttt

SEQ ID NO: 5547661 - DNA, 19 bp, Homo sapiens
aagtgttttattttcaaat

SEQ ID NO: 5547662 - DNA, 14 bp, Homo sapiens
aagtgttttcagag

SEQ ID NO: 5547663 - DNA, 23 bp, Homo sapiens
aagtgttttgtattttatagtga

SEQ ID NO: 5547664 - DNA, 15 bp, Homo sapiens
aagtgtttttacata

SEQ ID NO: 5547665 - DNA, 14 bp, Homo sapiens
aagttaaaaaaaag

SEQ ID NO: 5547666 - DNA, 12 bp, Homo sapiens
aagttaaaacaa

SEQ ID NO: 5547667 - DNA, 13 bp, Homo sapiens
aagttaaaattgt

SEQ ID NO: 5547668 - DNA, 23 bp, Homo sapiens
aagttaaactacctaaaataaat

SEQ ID NO: 5547669 - DNA, 14 bp, Homo sapiens
aagttaaactgatt

SEQ ID NO: 5547670 - DNA, 16 bp, Homo sapiens
aagttaaagagacaaa

SEQ ID NO: 5547671 - DNA, 18 bp, Homo sapiens
aagttaaagagacaaata

SEQ ID NO: 5547672 - DNA, 14 bp, Homo sapiens
aagttaaaggcagt

SEQ ID NO: 5547673 - DNA, 11 bp, Homo sapiens
aagttaaaggg

SEQ ID NO: 5547674 - DNA, 14 bp, Homo sapiens
aagttaaagggaag

SEQ ID NO: 5547675 - DNA, 22 bp, Homo sapiens
aagttaaagtcacacatttcta

SEQ ID NO: 5547676 - DNA, 12 bp, Homo sapiens
aagttaaataaa

SEQ ID NO: 5547677 - DNA, 14 bp, Homo sapiens
aagttaaataaatc

SEQ ID NO: 5547678 - DNA, 16 bp, Homo sapiens
aagttaaatatgtaga

SEQ ID NO: 5547679 - DNA, 21 bp, Homo sapiens
aagttaaatcattttcattaa

SEQ ID NO: 5547680 - DNA, 17 bp, Homo sapiens
aagttaaatgtagagtt

SEQ ID NO: 5547681 - DNA, 13 bp, Homo sapiens
aagttaaatgtat

SEQ ID NO: 5547682 - DNA, 14 bp, Homo sapiens
aagttaaatgtatc

SEQ ID NO: 5547683 - DNA, 13 bp, Homo sapiens
aagttaaatgtgt

SEQ ID NO: 5547684 - DNA, 13 bp, Homo sapiens
aagttaacagaga

SEQ ID NO: 5547685 - DNA, 22 bp, Homo sapiens
aagttaactgttccccttggta

SEQ ID NO: 5547686 - DNA, 11 bp, Homo sapiens
aagttaagaat

SEQ ID NO: 5547687 - DNA, 23 bp, Homo sapiens
aagttaagaatgttcttatgttg

SEQ ID NO: 5547688 - DNA, 16 bp, Homo sapiens
aagttaagattcttgg

SEQ ID NO: 5547689 - DNA, 20 bp, Homo sapiens
aagttaagctgctatagtaa

SEQ ID NO: 5547690 - DNA, 11 bp, Homo sapiens
aagttaataag

SEQ ID NO: 5547691 - DNA, 14 bp, Homo sapiens
aagttaataagcaa

SEQ ID NO: 5547692 - DNA, 13 bp, Homo sapiens
aagttaataatgt

SEQ ID NO: 5547693 - DNA, 16 bp, Homo sapiens
aagttaataatgtatt

SEQ ID NO: 5547694 - DNA, 18 bp, Homo sapiens
aagttaataatgtattgt

SEQ ID NO: 5547695 - DNA, 12 bp, Homo sapiens
aagttaatagat

SEQ ID NO: 5547696 - DNA, 20 bp, Homo sapiens
aagttaatattggaagtgaa

SEQ ID NO: 5547697 - DNA, 19 bp, Homo sapiens
aagttaatccactgtgact

SEQ ID NO: 5547698 - DNA, 18 bp, Homo sapiens
aagttaattcttaaaact

SEQ ID NO: 5547699 - DNA, 18 bp, Homo sapiens
aagttaattgtatttatg

SEQ ID NO: 5547700 - DNA, 12 bp, Homo sapiens
aagttaatttaa

SEQ ID NO: 5547701 - DNA, 20 bp, Homo sapiens
aagttacaaattgcttgaaa

SEQ ID NO: 5547702 - DNA, 17 bp, Homo sapiens
aagttacaattacatct

SEQ ID NO: 5547703 - DNA, 16 bp, Homo sapiens
aagttacacaattaat

SEQ ID NO: 5547704 - DNA, 14 bp, Homo sapiens
aagttacacatttt

SEQ ID NO: 5547705 - DNA, 23 bp, Homo sapiens
aagttacacggggttacactgtt

SEQ ID NO: 5547706 - DNA, 14 bp, Homo sapiens
aagttacactttta

SEQ ID NO: 5547707 - DNA, 21 bp, Homo sapiens
aagttacacttttatttcctg

SEQ ID NO: 5547708 - DNA, 19 bp, Homo sapiens
aagttacagaaatactata

SEQ ID NO: 5547709 - DNA, 16 bp, Homo sapiens
aagttacagtttgcac

SEQ ID NO: 5547710 - DNA, 16 bp, Homo sapiens
aagttacatacattta

SEQ ID NO: 5547711 - DNA, 16 bp, Homo sapiens
aagttacatgcataaa

SEQ ID NO: 5547712 - DNA, 18 bp, Homo sapiens
aagttacatgcataaaag

SEQ ID NO: 5547713 - DNA, 20 bp, Homo sapiens
aagttacatgtttgcacctt

SEQ ID NO: 5547714 - DNA, 17 bp, Homo sapiens
aagttaccttactgaaa

SEQ ID NO: 5547715 - DNA, 17 bp, Homo sapiens
aagttactaatatatct

SEQ ID NO: 5547716 - DNA, 21 bp, Homo sapiens
aagttactaatatatctgtaa

SEQ ID NO: 5547717 - DNA, 15 bp, Homo sapiens
aagttactactgatt

SEQ ID NO: 5547718 - DNA, 19 bp, Homo sapiens
aagttactaggtaacttca

SEQ ID NO: 5547719 - DNA, 20 bp, Homo sapiens
aagttactaggtaacttcat

SEQ ID NO: 5547720 - DNA, 18 bp, Homo sapiens
aagttactggctctttgt

SEQ ID NO: 5547721 - DNA, 22 bp, Homo sapiens
aagttacttcactttaattctc

SEQ ID NO: 5547722 - DNA, 11 bp, Homo sapiens
aagttactttg

SEQ ID NO: 5547723 - DNA, 14 bp, Homo sapiens
aagttactttgtaa

SEQ ID NO: 5547724 - DNA, 17 bp, Homo sapiens
aagttactttttgtaga

SEQ ID NO: 5547725 - DNA, 20 bp, Homo sapiens
aagttagaaaattcagctcc

SEQ ID NO: 5547726 - DNA, 14 bp, Homo sapiens
aagttagaatctat

SEQ ID NO: 5547727 - DNA, 15 bp, Homo sapiens
aagttagaatctatt

SEQ ID NO: 5547728 - DNA, 15 bp, Homo sapiens
aagttagaattcctt

SEQ ID NO: 5547729 - DNA, 17 bp, Homo sapiens
aagttagaattccttca

SEQ ID NO: 5547730 - DNA, 21 bp, Homo sapiens
aagttagaattccttcagggt

SEQ ID NO: 5547731 - DNA, 18 bp, Homo sapiens
aagttagagaatatattt

SEQ ID NO: 5547732 - DNA, 17 bp, Homo sapiens
aagttagagataattct

SEQ ID NO: 5547733 - DNA, 18 bp, Homo sapiens
aagttagagattttacaa

SEQ ID NO: 5547734 - DNA, 18 bp, Homo sapiens
aagttagatgttttagtt

SEQ ID NO: 5547735 - DNA, 16 bp, Homo sapiens
aagttagcattgtttc

SEQ ID NO: 5547736 - DNA, 17 bp, Homo sapiens
aagttagcattgtttct

SEQ ID NO: 5547737 - DNA, 17 bp, Homo sapiens
aagttagcctttatcta

SEQ ID NO: 5547738 - DNA, 15 bp, Homo sapiens
aagttagctcaggag

SEQ ID NO: 5547739 - DNA, 14 bp, Homo sapiens
aagttagctgagcg

SEQ ID NO: 5547740 - DNA, 16 bp, Homo sapiens
aagttagctttaactt

SEQ ID NO: 5547741 - DNA, 16 bp, Homo sapiens
aagttagggcattttt

SEQ ID NO: 5547742 - DNA, 17 bp, Homo sapiens
aagttagggggttctta

SEQ ID NO: 5547743 - DNA, 20 bp, Homo sapiens
aagttaggttataagaaaca

SEQ ID NO: 5547744 - DNA, 18 bp, Homo sapiens
aagttagtattaaaatct

SEQ ID NO: 5547745 - DNA, 19 bp, Homo sapiens
aagttagtggaaatctgaa

SEQ ID NO: 5547746 - DNA, 22 bp, Homo sapiens
aagttagtgtgttgtctgtgca

SEQ ID NO: 5547747 - DNA, 22 bp, Homo sapiens
aagttagtttgtatatattatt

SEQ ID NO: 5547748 - DNA, 17 bp, Homo sapiens
aagttagtttttaatct

SEQ ID NO: 5547749 - DNA, 11 bp, Homo sapiens
aagttataata

SEQ ID NO: 5547750 - DNA, 18 bp, Homo sapiens
aagttataataactgaac

SEQ ID NO: 5547751 - DNA, 15 bp, Homo sapiens
aagttataccagcaa

SEQ ID NO: 5547752 - DNA, 13 bp, Homo sapiens
aagttatagagca

SEQ ID NO: 5547753 - DNA, 13 bp, Homo sapiens
aagttatagtact

SEQ ID NO: 5547754 - DNA, 22 bp, Homo sapiens
aagttatataaagagaaaattg

SEQ ID NO: 5547755 - DNA, 23 bp, Homo sapiens
aagttatataaagagaaaattga

SEQ ID NO: 5547756 - DNA, 23 bp, Homo sapiens
aagttatataaaggcaaggaaat

SEQ ID NO: 5547757 - DNA, 18 bp, Homo sapiens
aagttatattagtgaaga

SEQ ID NO: 5547758 - DNA, 22 bp, Homo sapiens
aagttatattgaatatatcaga

SEQ ID NO: 5547759 - DNA, 12 bp, Homo sapiens
aagttatattta

SEQ ID NO: 5547760 - DNA, 22 bp, Homo sapiens
aagttatatttcctataccatt

SEQ ID NO: 5547761 - DNA, 23 bp, Homo sapiens
aagttatatttcctataccattt

SEQ ID NO: 5547762 - DNA, 19 bp, Homo sapiens
aagttatctgtgttatttg

SEQ ID NO: 5547763 - DNA, 20 bp, Homo sapiens
aagttatcttaaatatgaat

SEQ ID NO: 5547764 - DNA, 21 bp, Homo sapiens
aagttatcttaaatatgaatt

SEQ ID NO: 5547765 - DNA, 14 bp, Homo sapiens
aagttatgagggtc

SEQ ID NO: 5547766 - DNA, 22 bp, Homo sapiens
aagttatggtttcctcatttta

SEQ ID NO: 5547767 - DNA, 24 bp, Homo sapiens
aagttatggtttcctcattttact

SEQ ID NO: 5547768 - DNA, 14 bp, Homo sapiens
aagttatgtattta

SEQ ID NO: 5547769 - DNA, 14 bp, Homo sapiens
aagttattaaaatt

SEQ ID NO: 5547770 - DNA, 17 bp, Homo sapiens
aagttattaactttaat

SEQ ID NO: 5547771 - DNA, 17 bp, Homo sapiens
aagttattacctctcca

SEQ ID NO: 5547772 - DNA, 18 bp, Homo sapiens
aagttattcaaatttgta

SEQ ID NO: 5547773 - DNA, 19 bp, Homo sapiens
aagttattcaaatttgtac

SEQ ID NO: 5547774 - DNA, 20 bp, Homo sapiens
aagttattgataagttcata

SEQ ID NO: 5547775 - DNA, 22 bp, Homo sapiens
aagttattgataagttcataca

SEQ ID NO: 5547776 - DNA, 13 bp, Homo sapiens
aagttattgctgc

SEQ ID NO: 5547777 - DNA, 20 bp, Homo sapiens
aagttattgctgcataaatt

SEQ ID NO: 5547778 - DNA, 18 bp, Homo sapiens
aagttattgtgttgcctt

SEQ ID NO: 5547779 - DNA, 13 bp, Homo sapiens
aagttatttataa

SEQ ID NO: 5547780 - DNA, 18 bp, Homo sapiens
aagttatttatattttgt

SEQ ID NO: 5547781 - DNA, 19 bp, Homo sapiens
aagttatttcttgtttgtt

SEQ ID NO: 5547782 - DNA, 19 bp, Homo sapiens
aagttatttgatctggtgc

SEQ ID NO: 5547783 - DNA, 20 bp, Homo sapiens
aagttatttgttcattattt

SEQ ID NO: 5547784 - DNA, 18 bp, Homo sapiens
aagttattttctacagtg

SEQ ID NO: 5547785 - DNA, 19 bp, Homo sapiens
aagttatttttaatttggt

SEQ ID NO: 5547786 - DNA, 18 bp, Homo sapiens
aagttatttttcttttta

SEQ ID NO: 5547787 - DNA, 17 bp, Homo sapiens
aagttatttttgtacat

SEQ ID NO: 5547788 - DNA, 19 bp, Homo sapiens
aagttatttttgtacatgt

SEQ ID NO: 5547789 - DNA, 17 bp, Homo sapiens
aagttcaacttatttca

SEQ ID NO: 5547790 - DNA, 18 bp, Homo sapiens
aagttcaagaagactatg

SEQ ID NO: 5547791 - DNA, 18 bp, Homo sapiens
aagttcaagactgaaatg

SEQ ID NO: 5547792 - DNA, 12 bp, Homo sapiens
aagttcaagtga

SEQ ID NO: 5547793 - DNA, 20 bp, Homo sapiens
aagttcaagtgatctttcaa

SEQ ID NO: 5547794 - DNA, 17 bp, Homo sapiens
aagttcacaaaatggtg

SEQ ID NO: 5547795 - DNA, 22 bp, Homo sapiens
aagttcaccgtagtaacacata

SEQ ID NO: 5547796 - DNA, 19 bp, Homo sapiens
aagttcacttccccaactc

SEQ ID NO: 5547797 - DNA, 23 bp, Homo sapiens
aagttcagaaatttaaaagcaga

SEQ ID NO: 5547798 - DNA, 14 bp, Homo sapiens
aagttcagagtttt

SEQ ID NO: 5547799 - DNA, 16 bp, Homo sapiens
aagttcagagttttct

SEQ ID NO: 5547800 - DNA, 20 bp, Homo sapiens
aagttcagcaagtagagcag

SEQ ID NO: 5547801 - DNA, 16 bp, Homo sapiens
aagttcaggctctgag

SEQ ID NO: 5547802 - DNA, 21 bp, Homo sapiens
aagttcagggaagcaggcaga

SEQ ID NO: 5547803 - DNA, 13 bp, Homo sapiens
aagttcagggacc

SEQ ID NO: 5547804 - DNA, 20 bp, Homo sapiens
aagttcagtcttgtctttga

SEQ ID NO: 5547805 - DNA, 13 bp, Homo sapiens
aagttcatacatt

SEQ ID NO: 5547806 - DNA, 15 bp, Homo sapiens
aagttcatacattgt

SEQ ID NO: 5547807 - DNA, 17 bp, Homo sapiens
aagttcatataatttaa

SEQ ID NO: 5547808 - DNA, 13 bp, Homo sapiens
aagttcatatctg

SEQ ID NO: 5547809 - DNA, 20 bp, Homo sapiens
aataaaaacttcagaaaaac

SEQ ID NO: 5547810 - DNA, 18 bp, Homo sapiens
aataaaaacttttgagga

SEQ ID NO: 5547811 - DNA, 22 bp, Homo sapiens
aataaaaagactattaagagca

SEQ ID NO: 5547812 - DNA, 19 bp, Homo sapiens
aataaaaagatcactttct

SEQ ID NO: 5547813 - DNA, 23 bp, Homo sapiens
aataaaaagatcactttctcagt

SEQ ID NO: 5547814 - DNA, 14 bp, Homo sapiens
aataaaaagattct

SEQ ID NO: 5547815 - DNA, 15 bp, Homo sapiens
aataaaaagattcta

SEQ ID NO: 5547816 - DNA, 12 bp, Homo sapiens
aataaaaagcca

SEQ ID NO: 5547817 - DNA, 15 bp, Homo sapiens
aataaaaagcctctt

SEQ ID NO: 5547818 - DNA, 12 bp, Homo sapiens
aataaaaaggaa

SEQ ID NO: 5547819 - DNA, 18 bp, Homo sapiens
aataaaaaggatctcctt

SEQ ID NO: 5547820 - DNA, 16 bp, Homo sapiens
aataaaaaggtgacca

SEQ ID NO: 5547821 - DNA, 19 bp, Homo sapiens
aataaaaagtgaacttttg

SEQ ID NO: 5547822 - DNA, 13 bp, Homo sapiens
aataaaaagttaa

SEQ ID NO: 5547823 - DNA, 14 bp, Homo sapiens
aataaaaagttaaa

SEQ ID NO: 5547824 - DNA, 16 bp, Homo sapiens
aataaaaataaatttg

SEQ ID NO: 5547825 - DNA, 17 bp, Homo sapiens
aataaaaataagtcatt

SEQ ID NO: 5547826 - DNA, 12 bp, Homo sapiens
aataaaaataca

SEQ ID NO: 5547827 - DNA, 11 bp, Homo sapiens
aataaaaatag

SEQ ID NO: 5547828 - DNA, 24 bp, Homo sapiens
aataaaaatagctataaatagtga

SEQ ID NO: 5547829 - DNA, 17 bp, Homo sapiens
aataaaaatatatatta

SEQ ID NO: 5547830 - DNA, 14 bp, Homo sapiens
aataaaaatatatt

SEQ ID NO: 5547831 - DNA, 15 bp, Homo sapiens
aataaaaatatattt

SEQ ID NO: 5547832 - DNA, 21 bp, Homo sapiens
aataaaaatcaacttgtgtac

SEQ ID NO: 5547833 - DNA, 13 bp, Homo sapiens
aataaaaatggca

SEQ ID NO: 5547834 - DNA, 19 bp, Homo sapiens
aataaaaattaaggcaact

SEQ ID NO: 5547835 - DNA, 16 bp, Homo sapiens
aataaaaattctagat

SEQ ID NO: 5547836 - DNA, 15 bp, Homo sapiens
aataaaaattgaaaa

SEQ ID NO: 5547837 - DNA, 17 bp, Homo sapiens
aataaaaatttgtttaa

SEQ ID NO: 5547838 - DNA, 21 bp, Homo sapiens
aataaaaatttgtttaaagtt

SEQ ID NO: 5547839 - DNA, 14 bp, Homo sapiens
aataaaacaaaggg

SEQ ID NO: 5547840 - DNA, 12 bp, Homo sapiens
aataaaacaaat

SEQ ID NO: 5547841 - DNA, 16 bp, Homo sapiens
aataaaacaactctga

SEQ ID NO: 5547842 - DNA, 12 bp, Homo sapiens
aataaaacaagc

SEQ ID NO: 5547843 - DNA, 16 bp, Homo sapiens
aataaaacaagcctta

SEQ ID NO: 5547844 - DNA, 17 bp, Homo sapiens
aataaaacaagccttaa

SEQ ID NO: 5547845 - DNA, 14 bp, Homo sapiens
aataaaacacacct

SEQ ID NO: 5547846 - DNA, 11 bp, Homo sapiens
aataaaacatt

SEQ ID NO: 5547847 - DNA, 14 bp, Homo sapiens
aataaaacattagt

SEQ ID NO: 5547848 - DNA, 11 bp, Homo sapiens
aataaaaccaa

SEQ ID NO: 5547849 - DNA, 13 bp, Homo sapiens
aataaaaccagaa

SEQ ID NO: 5547850 - DNA, 20 bp, Homo sapiens
aataaaacccaatacttttg

SEQ ID NO: 5547851 - DNA, 12 bp, Homo sapiens
aataaaaccttt

SEQ ID NO: 5547852 - DNA, 23 bp, Homo sapiens
aataaaactatttaaaattggca

SEQ ID NO: 5547853 - DNA, 17 bp, Homo sapiens
aataaaactatttgtat

SEQ ID NO: 5547854 - DNA, 15 bp, Homo sapiens
aataaaactggcttt

SEQ ID NO: 5547855 - DNA, 20 bp, Homo sapiens
aataaaactgtttgacttct

SEQ ID NO: 5547856 - DNA, 16 bp, Homo sapiens
aataaaactttatgga

SEQ ID NO: 5547857 - DNA, 14 bp, Homo sapiens
aataaaactttcca

SEQ ID NO: 5547858 - DNA, 16 bp, Homo sapiens
aataaaactttccaaa

SEQ ID NO: 5547859 - DNA, 16 bp, Homo sapiens
aataaaagaaaattac

SEQ ID NO: 5547860 - DNA, 12 bp, Homo sapiens
aataaaagaaca

SEQ ID NO: 5547861 - DNA, 14 bp, Homo sapiens
aataaaagagctgt

SEQ ID NO: 5547862 - DNA, 16 bp, Homo sapiens
aataaaagagctgtct

SEQ ID NO: 5547863 - DNA, 18 bp, Homo sapiens
aataaaagagctttatcc

SEQ ID NO: 5547864 - DNA, 19 bp, Homo sapiens
aataaaagcccaggagccc

SEQ ID NO: 5547865 - DNA, 17 bp, Homo sapiens
aataaaagcctttgaaa

SEQ ID NO: 5547866 - DNA, 16 bp, Homo sapiens
aataaaagctataaag

SEQ ID NO: 5547867 - DNA, 14 bp, Homo sapiens
aataaaaggaaaag

SEQ ID NO: 5547868 - DNA, 21 bp, Homo sapiens
aataaaaggaagccaaagagt

SEQ ID NO: 5547869 - DNA, 15 bp, Homo sapiens
aataaaaggactctg

SEQ ID NO: 5547870 - DNA, 13 bp, Homo sapiens
aataaaaggtcta

SEQ ID NO: 5547871 - DNA, 17 bp, Homo sapiens
aataaaagtattcttgt

SEQ ID NO: 5547872 - DNA, 22 bp, Homo sapiens
aataaaagtattcttgttagaa

SEQ ID NO: 5547873 - DNA, 13 bp, Homo sapiens
aataaaagtgact

SEQ ID NO: 5547874 - DNA, 19 bp, Homo sapiens
aataaaagtgcacacctta

SEQ ID NO: 5547875 - DNA, 16 bp, Homo sapiens
aataaaagtggtaatt

SEQ ID NO: 5547876 - DNA, 20 bp, Homo sapiens
aataaaagttcctctccctt

SEQ ID NO: 5547877 - DNA, 17 bp, Homo sapiens
aataaaagtttacaact

SEQ ID NO: 5547878 - DNA, 13 bp, Homo sapiens
aataaaataaaaa

SEQ ID NO: 5547879 - DNA, 15 bp, Homo sapiens
aataaaataaattat

SEQ ID NO: 5547880 - DNA, 18 bp, Homo sapiens
aataaaataacagactgt

SEQ ID NO: 5547881 - DNA, 15 bp, Homo sapiens
aataaaataattcta

SEQ ID NO: 5547882 - DNA, 17 bp, Homo sapiens
aataaaataattctaaa

SEQ ID NO: 5547883 - DNA, 13 bp, Homo sapiens
aataaaatacttt

SEQ ID NO: 5547884 - DNA, 12 bp, Homo sapiens
aataaaatagag

SEQ ID NO: 5547885 - DNA, 18 bp, Homo sapiens
aataaaatagtattgaaa

SEQ ID NO: 5547886 - DNA, 12 bp, Homo sapiens
aataaaatataa

SEQ ID NO: 5547887 - DNA, 15 bp, Homo sapiens
aataaaatataattg

SEQ ID NO: 5547888 - DNA, 15 bp, Homo sapiens
aataaaatatatctt

SEQ ID NO: 5547889 - DNA, 16 bp, Homo sapiens
aataaaatatcattca

SEQ ID NO: 5547890 - DNA, 18 bp, Homo sapiens
aataaaatatcattcagc

SEQ ID NO: 5547891 - DNA, 19 bp, Homo sapiens
aataaaatatcattcagca

SEQ ID NO: 5547892 - DNA, 20 bp, Homo sapiens
aataaaatatcattcagcaa

SEQ ID NO: 5547893 - DNA, 11 bp, Homo sapiens
aataaaatatt

SEQ ID NO: 5547894 - DNA, 16 bp, Homo sapiens
aataaaatattcactc

SEQ ID NO: 5547895 - DNA, 20 bp, Homo sapiens
aataaaatattcactctcca

SEQ ID NO: 5547896 - DNA, 21 bp, Homo sapiens
aataaaatattcactctccat

SEQ ID NO: 5547897 - DNA, 13 bp, Homo sapiens
aataaaatattta

SEQ ID NO: 5547898 - DNA, 14 bp, Homo sapiens
aataaaatattttc

SEQ ID NO: 5547899 - DNA, 16 bp, Homo sapiens
aataaaatattttctg

SEQ ID NO: 5547900 - DNA, 17 bp, Homo sapiens
aataaaatattttctgt

SEQ ID NO: 5547901 - DNA, 18 bp, Homo sapiens
aataaaatattttctgtg

SEQ ID NO: 5547902 - DNA, 22 bp, Homo sapiens
aataaaatccatacatttgtgt

SEQ ID NO: 5547903 - DNA, 14 bp, Homo sapiens
aataaaatcctgct

SEQ ID NO: 5547904 - DNA, 14 bp, Homo sapiens
aataaaatgaaaat

SEQ ID NO: 5547905 - DNA, 19 bp, Homo sapiens
aataaaatgaggacatgtt

SEQ ID NO: 5547906 - DNA, 13 bp, Homo sapiens
aataaaatgatgt

SEQ ID NO: 5547907 - DNA, 14 bp, Homo sapiens
aataaaatgcaaat

SEQ ID NO: 5547908 - DNA, 16 bp, Homo sapiens
aataaaatgcaaatga

SEQ ID NO: 5547909 - DNA, 13 bp, Homo sapiens
aataaaatgcatt

SEQ ID NO: 5547910 - DNA, 18 bp, Homo sapiens
aataaaatggatagaaaa

SEQ ID NO: 5547911 - DNA, 19 bp, Homo sapiens
aataaaatgggttttactg

SEQ ID NO: 5547912 - DNA, 14 bp, Homo sapiens
aataaaatgtgtac

SEQ ID NO: 5547913 - DNA, 19 bp, Homo sapiens
aataaaatgtgtacagtga

SEQ ID NO: 5547914 - DNA, 17 bp, Homo sapiens
aataaaatgttgaaaag

SEQ ID NO: 5547915 - DNA, 14 bp, Homo sapiens
aataaaattaatga

SEQ ID NO: 5547916 - DNA, 16 bp, Homo sapiens
aataaaattacacagt

SEQ ID NO: 5547917 - DNA, 16 bp, Homo sapiens
aataaaattatttgca

SEQ ID NO: 5547918 - DNA, 17 bp, Homo sapiens
aataaaattatttgcag

SEQ ID NO: 5547919 - DNA, 18 bp, Homo sapiens
aataaaattcaacaaaca

SEQ ID NO: 5547920 - DNA, 19 bp, Homo sapiens
aataaaattcaacaaacat

SEQ ID NO: 5547921 - DNA, 16 bp, Homo sapiens
aataaaattcatttct

SEQ ID NO: 5547922 - DNA, 13 bp, Homo sapiens
aataaaattccta

SEQ ID NO: 5547923 - DNA, 18 bp, Homo sapiens
aataaaattcctatctca

SEQ ID NO: 5547924 - DNA, 16 bp, Homo sapiens
aataaaattgcctctc

SEQ ID NO: 5547925 - DNA, 15 bp, Homo sapiens
aataaaattggcacc

SEQ ID NO: 5547926 - DNA, 12 bp, Homo sapiens
aataaaatttcc

SEQ ID NO: 5547927 - DNA, 13 bp, Homo sapiens
aataaaattttat

SEQ ID NO: 5547928 - DNA, 12 bp, Homo sapiens
aataaaattttc

SEQ ID NO: 5547929 - DNA, 14 bp, Homo sapiens
aataaaattttcaa

SEQ ID NO: 5547930 - DNA, 15 bp, Homo sapiens
aataaaattttcaaa

SEQ ID NO: 5547931 - DNA, 18 bp, Homo sapiens
aataaaattttcaaactt

SEQ ID NO: 5547932 - DNA, 19 bp, Homo sapiens
aataaaattttttttcatg

SEQ ID NO: 5547933 - DNA, 22 bp, Homo sapiens
aataaacacagtgtttcctgag

SEQ ID NO: 5547934 - DNA, 11 bp, Homo sapiens
aataaacactg

SEQ ID NO: 5547935 - DNA, 12 bp, Homo sapiens
aataaacactgg

SEQ ID NO: 5547936 - DNA, 21 bp, Homo sapiens
aataaacactggttgtagtca

SEQ ID NO: 5547937 - DNA, 13 bp, Homo sapiens
aataaacactgtg

SEQ ID NO: 5547938 - DNA, 16 bp, Homo sapiens
aataaacaggaatttt

SEQ ID NO: 5547939 - DNA, 18 bp, Homo sapiens
aataaacaggaattttat

SEQ ID NO: 5547940 - DNA, 15 bp, Homo sapiens
aataaacagtatatt

SEQ ID NO: 5547941 - DNA, 12 bp, Homo sapiens
aataaacagtca

SEQ ID NO: 5547942 - DNA, 17 bp, Homo sapiens
aataaacagtgagcata

SEQ ID NO: 5547943 - DNA, 20 bp, Homo sapiens
aataaacatcatagtttctt

SEQ ID NO: 5547944 - DNA, 13 bp, Homo sapiens
aataaacatcctt

SEQ ID NO: 5547945 - DNA, 21 bp, Homo sapiens
aataaacattaattttgtgca

SEQ ID NO: 5547946 - DNA, 19 bp, Homo sapiens
aataaaccaaacccagcca

SEQ ID NO: 5547947 - DNA, 14 bp, Homo sapiens
aataaaccaagaca

SEQ ID NO: 5547948 - DNA, 16 bp, Homo sapiens
aataaaccacaagcat

SEQ ID NO: 5547949 - DNA, 19 bp, Homo sapiens
aataaaccacaagcatctc

SEQ ID NO: 5547950 - DNA, 12 bp, Homo sapiens
aataaaccagac

SEQ ID NO: 5547951 - DNA, 12 bp, Homo sapiens
aataaaccagtg

SEQ ID NO: 5547952 - DNA, 15 bp, Homo sapiens
aataaaccagtgtga

SEQ ID NO: 5547953 - DNA, 20 bp, Homo sapiens
aataaaccggatcctgttgc

SEQ ID NO: 5547954 - DNA, 17 bp, Homo sapiens
aataaacctcaaaatgt

SEQ ID NO: 5547955 - DNA, 20 bp, Homo sapiens
aataaacctcaaaatgtcta

SEQ ID NO: 5547956 - DNA, 20 bp, Homo sapiens
aataaacctgcactgaaacc

SEQ ID NO: 5547957 - DNA, 14 bp, Homo sapiens
aataaacctggaga

SEQ ID NO: 5547958 - DNA, 15 bp, Homo sapiens
aataaacctggagat

SEQ ID NO: 5547959 - DNA, 17 bp, Homo sapiens
aataaacctggagatga

SEQ ID NO: 5547960 - DNA, 19 bp, Homo sapiens
aataaacctggagatgatg

SEQ ID NO: 5547961 - DNA, 20 bp, Homo sapiens
aataaacctggagatgatga

SEQ ID NO: 5547962 - DNA, 18 bp, Homo sapiens
aataaacctgggctcagc

SEQ ID NO: 5547963 - DNA, 16 bp, Homo sapiens
aataaacctgttcttc

SEQ ID NO: 5547964 - DNA, 15 bp, Homo sapiens
aataaaccttgtttc

SEQ ID NO: 5547965 - DNA, 22 bp, Homo sapiens
aataaaccttgtttctttctga

SEQ ID NO: 5547966 - DNA, 15 bp, Homo sapiens
aataaacgaaacatt

SEQ ID NO: 5547967 - DNA, 18 bp, Homo sapiens
aataaacgaaacatttag

SEQ ID NO: 5547968 - DNA, 13 bp, Homo sapiens
aataaacgaagat

SEQ ID NO: 5547969 - DNA, 13 bp, Homo sapiens
aataaacgtggat

SEQ ID NO: 5547970 - DNA, 17 bp, Homo sapiens
aataaactactctttga

SEQ ID NO: 5547971 - DNA, 16 bp, Homo sapiens
aataaactagagaagg

SEQ ID NO: 5547972 - DNA, 20 bp, Homo sapiens
aataaactagagaagggaga

SEQ ID NO: 5547973 - DNA, 14 bp, Homo sapiens
aataaactagggtt

SEQ ID NO: 5547974 - DNA, 19 bp, Homo sapiens
aataaactatttatatcac

SEQ ID NO: 5547975 - DNA, 18 bp, Homo sapiens
aataaactcaatgagctc

SEQ ID NO: 5547976 - DNA, 21 bp, Homo sapiens
aataaactcctactaaatccc

SEQ ID NO: 5547977 - DNA, 22 bp, Homo sapiens
aataaactcctactaaatccct

SEQ ID NO: 5547978 - DNA, 15 bp, Homo sapiens
aataaactctctagg

SEQ ID NO: 5547979 - DNA, 17 bp, Homo sapiens
aataaactcttcaaggc

SEQ ID NO: 5547980 - DNA, 19 bp, Homo sapiens
aataaactcttcaaggcca

SEQ ID NO: 5547981 - DNA, 10 bp, Homo sapiens
aataaactga

SEQ ID NO: 5547982 - DNA, 14 bp, Homo sapiens
aataaactgcaaat

SEQ ID NO: 5547983 - DNA, 15 bp, Homo sapiens
aataaactgcaaatg

SEQ ID NO: 5547984 - DNA, 17 bp, Homo sapiens
aataaactgtattaaat

SEQ ID NO: 5547985 - DNA, 22 bp, Homo sapiens
aataaactgtcctctttcagaa

SEQ ID NO: 5547986 - DNA, 12 bp, Homo sapiens
aataaactgttt

SEQ ID NO: 5547987 - DNA, 16 bp, Homo sapiens
aataaactgtttatat

SEQ ID NO: 5547988 - DNA, 22 bp, Homo sapiens
aataaacttagaataaaattgt

SEQ ID NO: 5547989 - DNA, 19 bp, Homo sapiens
aataaacttagaggaaaat

SEQ ID NO: 5547990 - DNA, 14 bp, Homo sapiens
aataaacttcagca

SEQ ID NO: 5547991 - DNA, 17 bp, Homo sapiens
aataaacttcttaacat

SEQ ID NO: 5547992 - DNA, 14 bp, Homo sapiens
aataattggttctt

SEQ ID NO: 5547993 - DNA, 21 bp, Homo sapiens
aataattgtatctacattaaa

SEQ ID NO: 5547994 - DNA, 20 bp, Homo sapiens
aataattgtggagaggagag

SEQ ID NO: 5547995 - DNA, 14 bp, Homo sapiens
aataattgtgtaca

SEQ ID NO: 5547996 - DNA, 16 bp, Homo sapiens
aataattgtgtacaaa

SEQ ID NO: 5547997 - DNA, 17 bp, Homo sapiens
aataattgttgtgtgta

SEQ ID NO: 5547998 - DNA, 17 bp, Homo sapiens
aataattgttgttctgt

SEQ ID NO: 5547999 - DNA, 18 bp, Homo sapiens
aataattgtttccaactt

SEQ ID NO: 5548000 - DNA, 21 bp, Homo sapiens
aataattgtttccaacttgtc

SEQ ID NO: 5548001 - DNA, 10 bp, Homo sapiens
aataatttaa

SEQ ID NO: 5548002 - DNA, 17 bp, Homo sapiens
aataatttaactaattt

SEQ ID NO: 5548003 - DNA, 20 bp, Homo sapiens
aataatttaactaatttaaa

SEQ ID NO: 5548004 - DNA, 21 bp, Homo sapiens
aataatttaactaatttaaac

SEQ ID NO: 5548005 - DNA, 21 bp, Homo sapiens
aataatttaagccaataaata

SEQ ID NO: 5548006 - DNA, 13 bp, Homo sapiens
aataatttagaaa

SEQ ID NO: 5548007 - DNA, 19 bp, Homo sapiens
aataatttagaaataaaag

SEQ ID NO: 5548008 - DNA, 15 bp, Homo sapiens
aataatttatagtaa

SEQ ID NO: 5548009 - DNA, 14 bp, Homo sapiens
aataatttattaca

SEQ ID NO: 5548010 - DNA, 22 bp, Homo sapiens
aataatttattattaaggtaac

SEQ ID NO: 5548011 - DNA, 12 bp, Homo sapiens
aataatttcatc

SEQ ID NO: 5548012 - DNA, 20 bp, Homo sapiens
aataatttcctggtgtgaag

SEQ ID NO: 5548013 - DNA, 20 bp, Homo sapiens
aataatttccttcaggcagc

SEQ ID NO: 5548014 - DNA, 15 bp, Homo sapiens
aataatttctaatgt

SEQ ID NO: 5548015 - DNA, 16 bp, Homo sapiens
aataatttctaatgtt

SEQ ID NO: 5548016 - DNA, 12 bp, Homo sapiens
aataatttctat

SEQ ID NO: 5548017 - DNA, 16 bp, Homo sapiens
aataatttgaactttg

SEQ ID NO: 5548018 - DNA, 12 bp, Homo sapiens
aataatttgtaa

SEQ ID NO: 5548019 - DNA, 13 bp, Homo sapiens
aataatttgtaaa

SEQ ID NO: 5548020 - DNA, 22 bp, Homo sapiens
aataatttgtaaatgattttaa

SEQ ID NO: 5548021 - DNA, 15 bp, Homo sapiens
aataatttgtaaatt

SEQ ID NO: 5548022 - DNA, 13 bp, Homo sapiens
aataatttgtaca

SEQ ID NO: 5548023 - DNA, 16 bp, Homo sapiens
aataatttgttgtact

SEQ ID NO: 5548024 - DNA, 17 bp, Homo sapiens
aataatttgttttcatt

SEQ ID NO: 5548025 - DNA, 14 bp, Homo sapiens
aataattttaaaaa

SEQ ID NO: 5548026 - DNA, 17 bp, Homo sapiens
aataattttaaaaatgg

SEQ ID NO: 5548027 - DNA, 14 bp, Homo sapiens
aataattttaacag

SEQ ID NO: 5548028 - DNA, 22 bp, Homo sapiens
aataattttaacagacatgtat

SEQ ID NO: 5548029 - DNA, 23 bp, Homo sapiens
aataattttaatattcttttgtt

SEQ ID NO: 5548030 - DNA, 23 bp, Homo sapiens
aataattttatgaactgcatgta

SEQ ID NO: 5548031 - DNA, 15 bp, Homo sapiens
aataattttcctcct

SEQ ID NO: 5548032 - DNA, 16 bp, Homo sapiens
aataattttcctgtga

SEQ ID NO: 5548033 - DNA, 18 bp, Homo sapiens
aataattttctagtatgt

SEQ ID NO: 5548034 - DNA, 22 bp, Homo sapiens
aataattttggaataatttcta

SEQ ID NO: 5548035 - DNA, 13 bp, Homo sapiens
aataatttttaac

SEQ ID NO: 5548036 - DNA, 17 bp, Homo sapiens
aataatttttatattta

SEQ ID NO: 5548037 - DNA, 19 bp, Homo sapiens
aataatttttatatttaat

SEQ ID NO: 5548038 - DNA, 19 bp, Homo sapiens
aataatttttgctgaattc

SEQ ID NO: 5548039 - DNA, 16 bp, Homo sapiens
aatacaaaaatgaata

SEQ ID NO: 5548040 - DNA, 20 bp, Homo sapiens
aatacaaaaattagccgagc

SEQ ID NO: 5548041 - DNA, 20 bp, Homo sapiens
aatacaaaaattagccgggc

SEQ ID NO: 5548042 - DNA, 13 bp, Homo sapiens
aatacaaaacttc

SEQ ID NO: 5548043 - DNA, 11 bp, Homo sapiens
aatacaaaagg

SEQ ID NO: 5548044 - DNA, 17 bp, Homo sapiens
aatacaaaattataaag

SEQ ID NO: 5548045 - DNA, 11 bp, Homo sapiens
aatacaaacaa

SEQ ID NO: 5548046 - DNA, 17 bp, Homo sapiens
aatacaaacatatttgt

SEQ ID NO: 5548047 - DNA, 14 bp, Homo sapiens
aatacaaacatttc

SEQ ID NO: 5548048 - DNA, 21 bp, Homo sapiens
aatacaaagaaccaagaaaaa

SEQ ID NO: 5548049 - DNA, 18 bp, Homo sapiens
aatacaaaggttccattc

SEQ ID NO: 5548050 - DNA, 15 bp, Homo sapiens
aatacaaagtaaata

SEQ ID NO: 5548051 - DNA, 19 bp, Homo sapiens
aatacaaagtaaatacaag

SEQ ID NO: 5548052 - DNA, 17 bp, Homo sapiens
aatacaaagttagagaa

SEQ ID NO: 5548053 - DNA, 18 bp, Homo sapiens
aatacaaatctgtataaa

SEQ ID NO: 5548054 - DNA, 19 bp, Homo sapiens
aatacaaatctgtataaat

SEQ ID NO: 5548055 - DNA, 22 bp, Homo sapiens
aatacaaatctgtataaatgtc

SEQ ID NO: 5548056 - DNA, 12 bp, Homo sapiens
aatacaaatgga

SEQ ID NO: 5548057 - DNA, 15 bp, Homo sapiens
aatacaaattgagga

SEQ ID NO: 5548058 - DNA, 14 bp, Homo sapiens
aatacaaattttgt

SEQ ID NO: 5548059 - DNA, 17 bp, Homo sapiens
aatacaacaacaacaaa

SEQ ID NO: 5548060 - DNA, 16 bp, Homo sapiens
aatacaacaagaacaa

SEQ ID NO: 5548061 - DNA, 22 bp, Homo sapiens
aatacaacacattgaaactgta

SEQ ID NO: 5548062 - DNA, 22 bp, Homo sapiens
aatacaagccaagctagaagga

SEQ ID NO: 5548063 - DNA, 23 bp, Homo sapiens
aatacaagccaagctagaaggaa

SEQ ID NO: 5548064 - DNA, 22 bp, Homo sapiens
aatacaagccactaccttctga

SEQ ID NO: 5548065 - DNA, 12 bp, Homo sapiens
aatacaaggtat

SEQ ID NO: 5548066 - DNA, 13 bp, Homo sapiens
aatacaaggtata

SEQ ID NO: 5548067 - DNA, 20 bp, Homo sapiens
aatacaaggtataataaaat

SEQ ID NO: 5548068 - DNA, 17 bp, Homo sapiens
aatacaagtaaagctag

SEQ ID NO: 5548069 - DNA, 19 bp, Homo sapiens
aatacaagtaatattatta

SEQ ID NO: 5548070 - DNA, 20 bp, Homo sapiens
aatacaagttacatacattt

SEQ ID NO: 5548071 - DNA, 23 bp, Homo sapiens
aatacaatagtatgcagctaaaa

SEQ ID NO: 5548072 - DNA, 13 bp, Homo sapiens
aatacaatcagaa

SEQ ID NO: 5548073 - DNA, 22 bp, Homo sapiens
aatacaattcaaacaattcaat

SEQ ID NO: 5548074 - DNA, 14 bp, Homo sapiens
aatacaattcaaat

SEQ ID NO: 5548075 - DNA, 17 bp, Homo sapiens
aatacaattcagtttta

SEQ ID NO: 5548076 - DNA, 13 bp, Homo sapiens
aatacaattttgt

SEQ ID NO: 5548077 - DNA, 22 bp, Homo sapiens
aatacaatttttatttctttta

SEQ ID NO: 5548078 - DNA, 20 bp, Homo sapiens
aatacaattttttttattag

SEQ ID NO: 5548079 - DNA, 15 bp, Homo sapiens
aatacacaacacaaa

SEQ ID NO: 5548080 - DNA, 16 bp, Homo sapiens
aatacacacagttact

SEQ ID NO: 5548081 - DNA, 14 bp, Homo sapiens
aatacacagtactt

SEQ ID NO: 5548082 - DNA, 19 bp, Homo sapiens
aatacacagtactttattg

SEQ ID NO: 5548083 - DNA, 17 bp, Homo sapiens
aatacacatacatatat

SEQ ID NO: 5548084 - DNA, 14 bp, Homo sapiens
aatacacatggaaa

SEQ ID NO: 5548085 - DNA, 18 bp, Homo sapiens
aatacacatggaaaaaaa

SEQ ID NO: 5548086 - DNA, 16 bp, Homo sapiens
aatacacatttcacat

SEQ ID NO: 5548087 - DNA, 21 bp, Homo sapiens
aatacaccacctcactcctgt

SEQ ID NO: 5548088 - DNA, 17 bp, Homo sapiens
aatacaccacgaatttg

SEQ ID NO: 5548089 - DNA, 15 bp, Homo sapiens
aatacaccactacat

SEQ ID NO: 5548090 - DNA, 18 bp, Homo sapiens
aatacaccgtttagaaaa

SEQ ID NO: 5548091 - DNA, 16 bp, Homo sapiens
aatacaccttccccac

SEQ ID NO: 5548092 - DNA, 20 bp, Homo sapiens
aatacactaattcctttcta

SEQ ID NO: 5548093 - DNA, 16 bp, Homo sapiens
aatacactacaaatgt

SEQ ID NO: 5548094 - DNA, 17 bp, Homo sapiens
aatacactagttgtttc

SEQ ID NO: 5548095 - DNA, 13 bp, Homo sapiens
aatacactgtgaa

SEQ ID NO: 5548096 - DNA, 14 bp, Homo sapiens
aatacactgtgaag

SEQ ID NO: 5548097 - DNA, 15 bp, Homo sapiens
aatacacttcttttg

SEQ ID NO: 5548098 - DNA, 17 bp, Homo sapiens
aatacacttcttttgaa

SEQ ID NO: 5548099 - DNA, 19 bp, Homo sapiens
aatacagaaattagccggg

SEQ ID NO: 5548100 - DNA, 15 bp, Homo sapiens
aatacagaatcttgt

SEQ ID NO: 5548101 - DNA, 19 bp, Homo sapiens
aatacagaatttatagaat

SEQ ID NO: 5548102 - DNA, 13 bp, Homo sapiens
aatacagacacta

SEQ ID NO: 5548103 - DNA, 13 bp, Homo sapiens
aatacagataaat

SEQ ID NO: 5548104 - DNA, 13 bp, Homo sapiens
aatacagatatat

SEQ ID NO: 5548105 - DNA, 14 bp, Homo sapiens
aatacagatatatt

SEQ ID NO: 5548106 - DNA, 19 bp, Homo sapiens
aatacagatatattttctt

SEQ ID NO: 5548107 - DNA, 16 bp, Homo sapiens
aatacagatcatcttg

SEQ ID NO: 5548108 - DNA, 20 bp, Homo sapiens
aatacagattttgatagcaa

SEQ ID NO: 5548109 - DNA, 21 bp, Homo sapiens
aatacagattttgatagcaaa

SEQ ID NO: 5548110 - DNA, 13 bp, Homo sapiens
aatacagctggct

SEQ ID NO: 5548111 - DNA, 23 bp, Homo sapiens
aatacaggagacccaacaatgag

SEQ ID NO: 5548112 - DNA, 12 bp, Homo sapiens
aatacagggagg

SEQ ID NO: 5548113 - DNA, 20 bp, Homo sapiens
aatacaggtaacattataaa

SEQ ID NO: 5548114 - DNA, 14 bp, Homo sapiens
aatacagtaaagtt

SEQ ID NO: 5548115 - DNA, 22 bp, Homo sapiens
aatacagtaaagtttaaaaaat

SEQ ID NO: 5548116 - DNA, 15 bp, Homo sapiens
aatacagtaagtaaa

SEQ ID NO: 5548117 - DNA, 21 bp, Homo sapiens
aatacagtacaggcagcacag

SEQ ID NO: 5548118 - DNA, 18 bp, Homo sapiens
aatacagtagtataatgt

SEQ ID NO: 5548119 - DNA, 16 bp, Homo sapiens
aatacagtattataga

SEQ ID NO: 5548120 - DNA, 14 bp, Homo sapiens
aatacagtattatt

SEQ ID NO: 5548121 - DNA, 15 bp, Homo sapiens
aatacagtattattt

SEQ ID NO: 5548122 - DNA, 23 bp, Homo sapiens
aatacagtattatttagtaaaat

SEQ ID NO: 5548123 - DNA, 18 bp, Homo sapiens
aatacagtcattccaaga

SEQ ID NO: 5548124 - DNA, 18 bp, Homo sapiens
aatacagtctagtttcct

SEQ ID NO: 5548125 - DNA, 18 bp, Homo sapiens
aatacagtcttccacaaa

SEQ ID NO: 5548126 - DNA, 21 bp, Homo sapiens
aatacagtcttccatttgcaa

SEQ ID NO: 5548127 - DNA, 15 bp, Homo sapiens
aatacagtgctttat

SEQ ID NO: 5548128 - DNA, 21 bp, Homo sapiens
aatacagtgctttatggctct

SEQ ID NO: 5548129 - DNA, 20 bp, Homo sapiens
aatacagtttataaagccaa

SEQ ID NO: 5548130 - DNA, 22 bp, Homo sapiens
aatacagtttcattaactcctt

SEQ ID NO: 5548131 - DNA, 13 bp, Homo sapiens
aatacataaatag

SEQ ID NO: 5548132 - DNA, 17 bp, Homo sapiens
aatacataacattcaat

SEQ ID NO: 5548133 - DNA, 21 bp, Homo sapiens
aatacataactagtttaatta

SEQ ID NO: 5548134 - DNA, 19 bp, Homo sapiens
aatacataagttaatattg

SEQ ID NO: 5548135 - DNA, 22 bp, Homo sapiens
aatacataccacgctagggctg

SEQ ID NO: 5548136 - DNA, 14 bp, Homo sapiens
aatacatactaatg

SEQ ID NO: 5548137 - DNA, 20 bp, Homo sapiens
aatacatactaatgaagtat

SEQ ID NO: 5548138 - DNA, 19 bp, Homo sapiens
aatacataggcttatatac

SEQ ID NO: 5548139 - DNA, 17 bp, Homo sapiens
aatacatataaagatta

SEQ ID NO: 5548140 - DNA, 14 bp, Homo sapiens
aatacatatatcta

SEQ ID NO: 5548141 - DNA, 15 bp, Homo sapiens
aatacatattacaag

SEQ ID NO: 5548142 - DNA, 18 bp, Homo sapiens
aatacatattacaagaaa

SEQ ID NO: 5548143 - DNA, 21 bp, Homo sapiens
aatacatattccatgggactt

SEQ ID NO: 5548144 - DNA, 17 bp, Homo sapiens
aatacatattttgtatt

SEQ ID NO: 5548145 - DNA, 14 bp, Homo sapiens
aatacatcacatct

SEQ ID NO: 5548146 - DNA, 13 bp, Homo sapiens
aatacatcagaaa

SEQ ID NO: 5548147 - DNA, 16 bp, Homo sapiens
aatacatcagaaaata

SEQ ID NO: 5548148 - DNA, 18 bp, Homo sapiens
aatacatcctttttctgc

SEQ ID NO: 5548149 - DNA, 19 bp, Homo sapiens
aatacatcctttttctgct

SEQ ID NO: 5548150 - DNA, 22 bp, Homo sapiens
aatacatctccagtacattccg

SEQ ID NO: 5548151 - DNA, 17 bp, Homo sapiens
aatacatgacatttatt

SEQ ID NO: 5548152 - DNA, 17 bp, Homo sapiens
aatacatgagaaagatg

SEQ ID NO: 5548153 - DNA, 14 bp, Homo sapiens
aatacatgcacagt

SEQ ID NO: 5548154 - DNA, 16 bp, Homo sapiens
aatacatgcacagtca

SEQ ID NO: 5548155 - DNA, 18 bp, Homo sapiens
aatacatgccacatcaaa

SEQ ID NO: 5548156 - DNA, 12 bp, Homo sapiens
aatacatgcctt

SEQ ID NO: 5548157 - DNA, 22 bp, Homo sapiens
aatacatgctaagagaagtaga

SEQ ID NO: 5548158 - DNA, 19 bp, Homo sapiens
aatacatgtacctatagaa

SEQ ID NO: 5548159 - DNA, 19 bp, Homo sapiens
aatacatgtgtggatgtgt

SEQ ID NO: 5548160 - DNA, 18 bp, Homo sapiens
aatacatgttgtaaatgg

SEQ ID NO: 5548161 - DNA, 15 bp, Homo sapiens
aatacattaaagcag

SEQ ID NO: 5548162 - DNA, 17 bp, Homo sapiens
aatacattaaagcagtc

SEQ ID NO: 5548163 - DNA, 16 bp, Homo sapiens
aatacattaacaagct

SEQ ID NO: 5548164 - DNA, 19 bp, Homo sapiens
aatacattatatttctatt

SEQ ID NO: 5548165 - DNA, 15 bp, Homo sapiens
aatacattattagaa

SEQ ID NO: 5548166 - DNA, 17 bp, Homo sapiens
aatacattattgaaaag

SEQ ID NO: 5548167 - DNA, 21 bp, Homo sapiens
aatacattattggacttccat

SEQ ID NO: 5548168 - DNA, 17 bp, Homo sapiens
aatacattcgaaggaac

SEQ ID NO: 5548169 - DNA, 21 bp, Homo sapiens
aatacattctatgacattttt

SEQ ID NO: 5548170 - DNA, 14 bp, Homo sapiens
aataggagtatttt

SEQ ID NO: 5548171 - DNA, 17 bp, Homo sapiens
aataggagtatttttgg

SEQ ID NO: 5548172 - DNA, 11 bp, Homo sapiens
aataggagtct

SEQ ID NO: 5548173 - DNA, 17 bp, Homo sapiens
aataggagtgagtgtat

SEQ ID NO: 5548174 - DNA, 15 bp, Homo sapiens
aataggatcctggag

SEQ ID NO: 5548175 - DNA, 16 bp, Homo sapiens
aataggatcctggagg

SEQ ID NO: 5548176 - DNA, 23 bp, Homo sapiens
aataggatgaatgggaaagtatt

SEQ ID NO: 5548177 - DNA, 14 bp, Homo sapiens
aataggatgggctt

SEQ ID NO: 5548178 - DNA, 20 bp, Homo sapiens
aataggatgggcttctgtgc

SEQ ID NO: 5548179 - DNA, 13 bp, Homo sapiens
aataggattaatg

SEQ ID NO: 5548180 - DNA, 13 bp, Homo sapiens
aataggatttgca

SEQ ID NO: 5548181 - DNA, 16 bp, Homo sapiens
aataggatttttagaa

SEQ ID NO: 5548182 - DNA, 17 bp, Homo sapiens
aataggcactttaaaac

SEQ ID NO: 5548183 - DNA, 18 bp, Homo sapiens
aataggcactttaaaaca

SEQ ID NO: 5548184 - DNA, 21 bp, Homo sapiens
aataggcagggggccctgccc

SEQ ID NO: 5548185 - DNA, 16 bp, Homo sapiens
aataggcattaaatgc

SEQ ID NO: 5548186 - DNA, 16 bp, Homo sapiens
aataggcattttaagt

SEQ ID NO: 5548187 - DNA, 22 bp, Homo sapiens
aataggccatgttaattaaact

SEQ ID NO: 5548188 - DNA, 18 bp, Homo sapiens
aataggcgtaactaattt

SEQ ID NO: 5548189 - DNA, 22 bp, Homo sapiens
aataggctgatgggcaaaaaac

SEQ ID NO: 5548190 - DNA, 19 bp, Homo sapiens
aataggcttagagaggaaa

SEQ ID NO: 5548191 - DNA, 20 bp, Homo sapiens
aataggcttagagaggaaaa

SEQ ID NO: 5548192 - DNA, 21 bp, Homo sapiens
aataggcttagagaggaaaag

SEQ ID NO: 5548193 - DNA, 13 bp, Homo sapiens
aataggcttgtgt

SEQ ID NO: 5548194 - DNA, 21 bp, Homo sapiens
aatagggctgagctctctgtg

SEQ ID NO: 5548195 - DNA, 23 bp, Homo sapiens
aatagggtagaatgattaatcaa

SEQ ID NO: 5548196 - DNA, 15 bp, Homo sapiens
aataggtactgccat

SEQ ID NO: 5548197 - DNA, 23 bp, Homo sapiens
aataggtagagtcattcatattt

SEQ ID NO: 5548198 - DNA, 20 bp, Homo sapiens
aataggtagcctgctgtggg

SEQ ID NO: 5548199 - DNA, 22 bp, Homo sapiens
aataggtagcctgctgtggggt

SEQ ID NO: 5548200 - DNA, 21 bp, Homo sapiens
aataggtagtttggatatttt

SEQ ID NO: 5548201 - DNA, 14 bp, Homo sapiens
aataggtcagataa

SEQ ID NO: 5548202 - DNA, 15 bp, Homo sapiens
aataggtcatatgtt

SEQ ID NO: 5548203 - DNA, 20 bp, Homo sapiens
aataggtcatatgttgtgtt

SEQ ID NO: 5548204 - DNA, 17 bp, Homo sapiens
aataggtctttctctca

SEQ ID NO: 5548205 - DNA, 22 bp, Homo sapiens
aataggttactttggactgagt

SEQ ID NO: 5548206 - DNA, 16 bp, Homo sapiens
aataggttataggtaa

SEQ ID NO: 5548207 - DNA, 16 bp, Homo sapiens
aataggttcagatttt

SEQ ID NO: 5548208 - DNA, 14 bp, Homo sapiens
aataggttcttctt

SEQ ID NO: 5548209 - DNA, 16 bp, Homo sapiens
aataggtttgtaaaat

SEQ ID NO: 5548210 - DNA, 17 bp, Homo sapiens
aataggttttccctgtt

SEQ ID NO: 5548211 - DNA, 16 bp, Homo sapiens
aatagtaaactaaagt

SEQ ID NO: 5548212 - DNA, 19 bp, Homo sapiens
aatagtaaataatgattca

SEQ ID NO: 5548213 - DNA, 12 bp, Homo sapiens
aatagtaactct

SEQ ID NO: 5548214 - DNA, 12 bp, Homo sapiens
aatagtaatata

SEQ ID NO: 5548215 - DNA, 21 bp, Homo sapiens
aatagtaatggttctagaagg

SEQ ID NO: 5548216 - DNA, 17 bp, Homo sapiens
aatagtacatgcagaaa

SEQ ID NO: 5548217 - DNA, 14 bp, Homo sapiens
aatagtacttacaa

SEQ ID NO: 5548218 - DNA, 14 bp, Homo sapiens
aatagtagacattt

SEQ ID NO: 5548219 - DNA, 22 bp, Homo sapiens
aatagtagagtatcagttgcag

SEQ ID NO: 5548220 - DNA, 13 bp, Homo sapiens
aatagtaggcaag

SEQ ID NO: 5548221 - DNA, 21 bp, Homo sapiens
aatagtaggcaagatggcaca

SEQ ID NO: 5548222 - DNA, 19 bp, Homo sapiens
aatagtatacattttataa

SEQ ID NO: 5548223 - DNA, 13 bp, Homo sapiens
aatagtatatcta

SEQ ID NO: 5548224 - DNA, 14 bp, Homo sapiens
aatagtatatctaa

SEQ ID NO: 5548225 - DNA, 14 bp, Homo sapiens
aatagtatatgcat

SEQ ID NO: 5548226 - DNA, 23 bp, Homo sapiens
aatagtatccagcacagatttgc

SEQ ID NO: 5548227 - DNA, 18 bp, Homo sapiens
aatagtatcctccaggtt

SEQ ID NO: 5548228 - DNA, 20 bp, Homo sapiens
aatagtatcctccaggtttt

SEQ ID NO: 5548229 - DNA, 21 bp, Homo sapiens
aatagtatcctccaggttttt

SEQ ID NO: 5548230 - DNA, 17 bp, Homo sapiens
aatagtatgaaaatgga

SEQ ID NO: 5548231 - DNA, 21 bp, Homo sapiens
aatagtatgggaaaaaaactg

SEQ ID NO: 5548232 - DNA, 21 bp, Homo sapiens
aatagtattctgatcagttgc

SEQ ID NO: 5548233 - DNA, 13 bp, Homo sapiens
aatagtcaagaaa

SEQ ID NO: 5548234 - DNA, 19 bp, Homo sapiens
aatagtcaccttcatgatt

SEQ ID NO: 5548235 - DNA, 21 bp, Homo sapiens
aatagtcaccttcatgattat

SEQ ID NO: 5548236 - DNA, 13 bp, Homo sapiens
aatagtcatgatt

SEQ ID NO: 5548237 - DNA, 24 bp, Homo sapiens
aatagtcatgattctatgtaatgt

SEQ ID NO: 5548238 - DNA, 16 bp, Homo sapiens
aatagtcatgtttctg

SEQ ID NO: 5548239 - DNA, 19 bp, Homo sapiens
aatagtcattaaaaacata

SEQ ID NO: 5548240 - DNA, 16 bp, Homo sapiens
aatagtcattccaaat

SEQ ID NO: 5548241 - DNA, 18 bp, Homo sapiens
aatagtcattccaaatat

SEQ ID NO: 5548242 - DNA, 16 bp, Homo sapiens
aatagtccaatatttg

SEQ ID NO: 5548243 - DNA, 17 bp, Homo sapiens
aatagtccaatatttgg

SEQ ID NO: 5548244 - DNA, 19 bp, Homo sapiens
aatagtcgggggaaaaaat

SEQ ID NO: 5548245 - DNA, 22 bp, Homo sapiens
aatagtctctctgcaagacaga

SEQ ID NO: 5548246 - DNA, 13 bp, Homo sapiens
aatagtctgtgtg

SEQ ID NO: 5548247 - DNA, 20 bp, Homo sapiens
aatagtctgtgtgcacaatg

SEQ ID NO: 5548248 - DNA, 23 bp, Homo sapiens
aatagtgataagttgaggaaaga

SEQ ID NO: 5548249 - DNA, 13 bp, Homo sapiens
aatagtgattttt

SEQ ID NO: 5548250 - DNA, 21 bp, Homo sapiens
aatagtgcaacatctctgaat

SEQ ID NO: 5548251 - DNA, 21 bp, Homo sapiens
aatagtgccgcaataaacata

SEQ ID NO: 5548252 - DNA, 22 bp, Homo sapiens
aatagtgcctcagcgctgccca

SEQ ID NO: 5548253 - DNA, 22 bp, Homo sapiens
aatagtgctcgctttctatgta

SEQ ID NO: 5548254 - DNA, 20 bp, Homo sapiens
aatagtggttaacagagcta

SEQ ID NO: 5548255 - DNA, 21 bp, Homo sapiens
aatagtggttcttggaaaaat

SEQ ID NO: 5548256 - DNA, 18 bp, Homo sapiens
aatagtgtaagaactgta

SEQ ID NO: 5548257 - DNA, 18 bp, Homo sapiens
aatagtgtcatataaact

SEQ ID NO: 5548258 - DNA, 20 bp, Homo sapiens
aatagtgtcctatgcaataa

SEQ ID NO: 5548259 - DNA, 21 bp, Homo sapiens
aatagtgtcctatgcaataaa

SEQ ID NO: 5548260 - DNA, 23 bp, Homo sapiens
aatagtgtcctatgcaataaaat

SEQ ID NO: 5548261 - DNA, 19 bp, Homo sapiens
aatagtgtggaaattaaga

SEQ ID NO: 5548262 - DNA, 20 bp, Homo sapiens
aatagtgtggaaattaagaa

SEQ ID NO: 5548263 - DNA, 22 bp, Homo sapiens
aatagtgtgtcaagattgcaaa

SEQ ID NO: 5548264 - DNA, 14 bp, Homo sapiens
aatagtgtgttctg

SEQ ID NO: 5548265 - DNA, 17 bp, Homo sapiens
aatagtgtgttctgatt

SEQ ID NO: 5548266 - DNA, 22 bp, Homo sapiens
aatagtgtgttctgattagaaa

SEQ ID NO: 5548267 - DNA, 16 bp, Homo sapiens
aatagtgttcttttta

SEQ ID NO: 5548268 - DNA, 18 bp, Homo sapiens
aatagttaaaaattaaat

SEQ ID NO: 5548269 - DNA, 22 bp, Homo sapiens
aatagttaaaaattaaatattt

SEQ ID NO: 5548270 - DNA, 23 bp, Homo sapiens
aatagttaaaaattaaatattta

SEQ ID NO: 5548271 - DNA, 13 bp, Homo sapiens
aatagttaacaca

SEQ ID NO: 5548272 - DNA, 21 bp, Homo sapiens
aatagttaagacatgatttcc

SEQ ID NO: 5548273 - DNA, 15 bp, Homo sapiens
aatagttactccagt

SEQ ID NO: 5548274 - DNA, 20 bp, Homo sapiens
aatagttactccagtgccaa

SEQ ID NO: 5548275 - DNA, 19 bp, Homo sapiens
aatagttattatttaattg

SEQ ID NO: 5548276 - DNA, 18 bp, Homo sapiens
aatagttcaggagacttt

SEQ ID NO: 5548277 - DNA, 18 bp, Homo sapiens
aatagttcaggatttggt

SEQ ID NO: 5548278 - DNA, 21 bp, Homo sapiens
aatagttcaggtaacaggcag

SEQ ID NO: 5548279 - DNA, 18 bp, Homo sapiens
aatagttcagtagaatta

SEQ ID NO: 5548280 - DNA, 16 bp, Homo sapiens
aatagttccattctat

SEQ ID NO: 5548281 - DNA, 13 bp, Homo sapiens
aatagttctattt

SEQ ID NO: 5548282 - DNA, 17 bp, Homo sapiens
aatagttctatttctat

SEQ ID NO: 5548283 - DNA, 17 bp, Homo sapiens
aatagttcttaaaatta

SEQ ID NO: 5548284 - DNA, 22 bp, Homo sapiens
aatagttgaacctatttctctt

SEQ ID NO: 5548285 - DNA, 16 bp, Homo sapiens
aatagttgagccagca

SEQ ID NO: 5548286 - DNA, 23 bp, Homo sapiens
aatagttgagccagcagacattg

SEQ ID NO: 5548287 - DNA, 21 bp, Homo sapiens
aatagttgtccatattttcac

SEQ ID NO: 5548288 - DNA, 14 bp, Homo sapiens
aatagttgtctgtg

SEQ ID NO: 5548289 - DNA, 20 bp, Homo sapiens
aatagttgtctgtgcttcct

SEQ ID NO: 5548290 - DNA, 18 bp, Homo sapiens
aatagtttaaaaatattc

SEQ ID NO: 5548291 - DNA, 14 bp, Homo sapiens
aatagtttacacac

SEQ ID NO: 5548292 - DNA, 14 bp, Homo sapiens
aatagtttatctta

SEQ ID NO: 5548293 - DNA, 20 bp, Homo sapiens
aatagtttatttctgtgaaa

SEQ ID NO: 5548294 - DNA, 17 bp, Homo sapiens
aatagtttattttaaaa

SEQ ID NO: 5548295 - DNA, 20 bp, Homo sapiens
aatagtttattttaaaacaa

SEQ ID NO: 5548296 - DNA, 12 bp, Homo sapiens
aatagtttccaa

SEQ ID NO: 5548297 - DNA, 18 bp, Homo sapiens
aatagtttccaagaaatt

SEQ ID NO: 5548298 - DNA, 22 bp, Homo sapiens
aatagtttctaaaccatgaaaa

SEQ ID NO: 5548299 - DNA, 18 bp, Homo sapiens
aatagtttgtctatttta

SEQ ID NO: 5548300 - DNA, 11 bp, Homo sapiens
aatagttttac

SEQ ID NO: 5548301 - DNA, 17 bp, Homo sapiens
aatagttttagattatt

SEQ ID NO: 5548302 - DNA, 20 bp, Homo sapiens
aatagttttattaataaaca

SEQ ID NO: 5548303 - DNA, 20 bp, Homo sapiens
aatagttttctaaatgtttc

SEQ ID NO: 5548304 - DNA, 14 bp, Homo sapiens
aatagttttgcttt

SEQ ID NO: 5548305 - DNA, 14 bp, Homo sapiens
aatagttttttact

SEQ ID NO: 5548306 - DNA, 20 bp, Homo sapiens
aatataaaaaatcatgccag

SEQ ID NO: 5548307 - DNA, 12 bp, Homo sapiens
aatataaaaaca

SEQ ID NO: 5548308 - DNA, 14 bp, Homo sapiens
aatataaaaacaac

SEQ ID NO: 5548309 - DNA, 13 bp, Homo sapiens
aatataaaaacat

SEQ ID NO: 5548310 - DNA, 15 bp, Homo sapiens
aatataaaaagcaga

SEQ ID NO: 5548311 - DNA, 17 bp, Homo sapiens
aatataaaaataattaa

SEQ ID NO: 5548312 - DNA, 18 bp, Homo sapiens
aatataaaaatgtgaatc

SEQ ID NO: 5548313 - DNA, 15 bp, Homo sapiens
aatataaaacagtca

SEQ ID NO: 5548314 - DNA, 14 bp, Homo sapiens
aatataaaactgcg

SEQ ID NO: 5548315 - DNA, 18 bp, Homo sapiens
aatataaaactgcgttaa

SEQ ID NO: 5548316 - DNA, 17 bp, Homo sapiens
aatataaaactgtactt

SEQ ID NO: 5548317 - DNA, 14 bp, Homo sapiens
aatataaaaggcaa

SEQ ID NO: 5548318 - DNA, 23 bp, Homo sapiens
aatataaaaggcaaatgtgtaca

SEQ ID NO: 5548319 - DNA, 14 bp, Homo sapiens
aatataaaatacat

SEQ ID NO: 5548320 - DNA, 22 bp, Homo sapiens
aatataaaatagttgtccatat

SEQ ID NO: 5548321 - DNA, 12 bp, Homo sapiens
aatataaaatta

SEQ ID NO: 5548322 - DNA, 14 bp, Homo sapiens
aatataaacaaaga

SEQ ID NO: 5548323 - DNA, 22 bp, Homo sapiens
aatataaacaaagattcatgat

SEQ ID NO: 5548324 - DNA, 14 bp, Homo sapiens
aatataaacaatgt

SEQ ID NO: 5548325 - DNA, 19 bp, Homo sapiens
aatataaacacattaaaag

SEQ ID NO: 5548326 - DNA, 13 bp, Homo sapiens
aatataaacacta

SEQ ID NO: 5548327 - DNA, 21 bp, Homo sapiens
aatataaactgaaaaatgtca

SEQ ID NO: 5548328 - DNA, 23 bp, Homo sapiens
aatataaactgaaaaatgtcagt

SEQ ID NO: 5548329 - DNA, 15 bp, Homo sapiens
aatataaactgtgag

SEQ ID NO: 5548330 - DNA, 16 bp, Homo sapiens
aatataaactgtgaga

SEQ ID NO: 5548331 - DNA, 12 bp, Homo sapiens
aatataaagctt

SEQ ID NO: 5548332 - DNA, 18 bp, Homo sapiens
aatataaagttaaaaaaa

SEQ ID NO: 5548333 - DNA, 18 bp, Homo sapiens
aatataaagttctacagt

SEQ ID NO: 5548334 - DNA, 17 bp, Homo sapiens
aatataaatatcacaaa

SEQ ID NO: 5548335 - DNA, 14 bp, Homo sapiens
aatataaatcacag

SEQ ID NO: 5548336 - DNA, 22 bp, Homo sapiens
aatataaatcacagatttccaa

SEQ ID NO: 5548337 - DNA, 22 bp, Homo sapiens
aatataaatgaatgaaatataa

SEQ ID NO: 5548338 - DNA, 13 bp, Homo sapiens
aatataaatgcaa

SEQ ID NO: 5548339 - DNA, 22 bp, Homo sapiens
aatataaatgcaaataacaaat

SEQ ID NO: 5548340 - DNA, 11 bp, Homo sapiens
aatataaatgt

SEQ ID NO: 5548341 - DNA, 20 bp, Homo sapiens
aatataaatgtgtgtatgtg

SEQ ID NO: 5548342 - DNA, 12 bp, Homo sapiens
aatataaatgtt

SEQ ID NO: 5548343 - DNA, 15 bp, Homo sapiens
aatataaatgtttaa

SEQ ID NO: 5548344 - DNA, 18 bp, Homo sapiens
aatataaattaagacttt

SEQ ID NO: 5548345 - DNA, 18 bp, Homo sapiens
aatataacataatcacaa

SEQ ID NO: 5548346 - DNA, 18 bp, Homo sapiens
aatataacatgaaatgat

SEQ ID NO: 5548347 - DNA, 15 bp, Homo sapiens
aatatgaatgtcaca

SEQ ID NO: 5548348 - DNA, 16 bp, Homo sapiens
aatatgaatgtcacat

SEQ ID NO: 5548349 - DNA, 22 bp, Homo sapiens
aatatgaattcaagaaaggaaa

SEQ ID NO: 5548350 - DNA, 14 bp, Homo sapiens
aatatgacacagct

SEQ ID NO: 5548351 - DNA, 20 bp, Homo sapiens
aatatgacacagcttgtgaa

SEQ ID NO: 5548352 - DNA, 22 bp, Homo sapiens
aatatgacacagcttgtgaatg

SEQ ID NO: 5548353 - DNA, 13 bp, Homo sapiens
aatatgacagaat

SEQ ID NO: 5548354 - DNA, 13 bp, Homo sapiens
aatatgacagata

SEQ ID NO: 5548355 - DNA, 14 bp, Homo sapiens
aatatgacagataa

SEQ ID NO: 5548356 - DNA, 16 bp, Homo sapiens
aatatgacagctgtcc

SEQ ID NO: 5548357 - DNA, 21 bp, Homo sapiens
aatatgacggaagaacataga

SEQ ID NO: 5548358 - DNA, 16 bp, Homo sapiens
aatatgagaatcagat

SEQ ID NO: 5548359 - DNA, 17 bp, Homo sapiens
aatatgaggggactgca

SEQ ID NO: 5548360 - DNA, 18 bp, Homo sapiens
aatatgaggggactgcat

SEQ ID NO: 5548361 - DNA, 21 bp, Homo sapiens
aatatgaggggactgcatgca

SEQ ID NO: 5548362 - DNA, 17 bp, Homo sapiens
aatatgagtacaaatgc

SEQ ID NO: 5548363 - DNA, 17 bp, Homo sapiens
aatatgagtctcaataa

SEQ ID NO: 5548364 - DNA, 17 bp, Homo sapiens
aatatgatatatatgta

SEQ ID NO: 5548365 - DNA, 20 bp, Homo sapiens
aatatgatccctaatgtgtt

SEQ ID NO: 5548366 - DNA, 16 bp, Homo sapiens
aatatgatgactgttt

SEQ ID NO: 5548367 - DNA, 17 bp, Homo sapiens
aatatgattgcactaaa

SEQ ID NO: 5548368 - DNA, 18 bp, Homo sapiens
aatatgattgcactaaat

SEQ ID NO: 5548369 - DNA, 23 bp, Homo sapiens
aatatgattgcactaaataaact

SEQ ID NO: 5548370 - DNA, 21 bp, Homo sapiens
aatatgattttttaaaagaaa

SEQ ID NO: 5548371 - DNA, 23 bp, Homo sapiens
aatatgattttttaagtctatgt

SEQ ID NO: 5548372 - DNA, 15 bp, Homo sapiens
aatatgcaaagcact

SEQ ID NO: 5548373 - DNA, 19 bp, Homo sapiens
aatatgcaacctgtgcaaa

SEQ ID NO: 5548374 - DNA, 21 bp, Homo sapiens
aatatgcaagcagctttttat

SEQ ID NO: 5548375 - DNA, 17 bp, Homo sapiens
aatatgcaatgtgaagc

SEQ ID NO: 5548376 - DNA, 15 bp, Homo sapiens
aatatgcacacattt

SEQ ID NO: 5548377 - DNA, 17 bp, Homo sapiens
aatatgcacacattttt

SEQ ID NO: 5548378 - DNA, 20 bp, Homo sapiens
aatatgcactaagtctcttt

SEQ ID NO: 5548379 - DNA, 12 bp, Homo sapiens
aatatgcacttt

SEQ ID NO: 5548380 - DNA, 17 bp, Homo sapiens
aatatgcagaatctctg

SEQ ID NO: 5548381 - DNA, 15 bp, Homo sapiens
aatatgcagttctgc

SEQ ID NO: 5548382 - DNA, 17 bp, Homo sapiens
aatatgcattgtctgca

SEQ ID NO: 5548383 - DNA, 18 bp, Homo sapiens
aatatgcattgtctgcaa

SEQ ID NO: 5548384 - DNA, 19 bp, Homo sapiens
aatatgcattgtctgcaat

SEQ ID NO: 5548385 - DNA, 23 bp, Homo sapiens
aatatgccagtgactgctgcgct

SEQ ID NO: 5548386 - DNA, 21 bp, Homo sapiens
aatatgccccattcaacatct

SEQ ID NO: 5548387 - DNA, 20 bp, Homo sapiens
aatatgcccctccccagtag

SEQ ID NO: 5548388 - DNA, 14 bp, Homo sapiens
aatatgccccttct

SEQ ID NO: 5548389 - DNA, 19 bp, Homo sapiens
aatatgcctctcctttgta

SEQ ID NO: 5548390 - DNA, 21 bp, Homo sapiens
aatatgcctctcctttgtata

SEQ ID NO: 5548391 - DNA, 16 bp, Homo sapiens
aatatgcctgcaggag

SEQ ID NO: 5548392 - DNA, 21 bp, Homo sapiens
aatatgcctgtaattcagtgt

SEQ ID NO: 5548393 - DNA, 19 bp, Homo sapiens
aatatgccttaatttagaa

SEQ ID NO: 5548394 - DNA, 13 bp, Homo sapiens
aatatgctaattt

SEQ ID NO: 5548395 - DNA, 15 bp, Homo sapiens
aatatgctaatttgg

SEQ ID NO: 5548396 - DNA, 21 bp, Homo sapiens
aatatgctacagtactatgta

SEQ ID NO: 5548397 - DNA, 22 bp, Homo sapiens
aatatgctacagtactatgtaa

SEQ ID NO: 5548398 - DNA, 18 bp, Homo sapiens
aatatgctgcaacaaaat

SEQ ID NO: 5548399 - DNA, 22 bp, Homo sapiens
aatatgctgccaaattttggcc

SEQ ID NO: 5548400 - DNA, 16 bp, Homo sapiens
aatatgctgttatgtc

SEQ ID NO: 5548401 - DNA, 16 bp, Homo sapiens
aatatgcttaaaataa

SEQ ID NO: 5548402 - DNA, 17 bp, Homo sapiens
aatatgcttataaccta

SEQ ID NO: 5548403 - DNA, 21 bp, Homo sapiens
aatatgcttatattgttcact

SEQ ID NO: 5548404 - DNA, 23 bp, Homo sapiens
aatatggaaatcttttacatttt

SEQ ID NO: 5548405 - DNA, 16 bp, Homo sapiens
aatatggaactgtaat

SEQ ID NO: 5548406 - DNA, 20 bp, Homo sapiens
aatatggaacttacattgtt

SEQ ID NO: 5548407 - DNA, 24 bp, Homo sapiens
aatatggaacttacattgttcaat

SEQ ID NO: 5548408 - DNA, 18 bp, Homo sapiens
aatatggaacttctaata

SEQ ID NO: 5548409 - DNA, 20 bp, Homo sapiens
aatatggaacttctaatata

SEQ ID NO: 5548410 - DNA, 23 bp, Homo sapiens
aatatggaagtaaaggcattcca

SEQ ID NO: 5548411 - DNA, 21 bp, Homo sapiens
aatatggacacttaatactac

SEQ ID NO: 5548412 - DNA, 20 bp, Homo sapiens
aatatggacatgtaaaaaga

SEQ ID NO: 5548413 - DNA, 17 bp, Homo sapiens
aatatggactcagcctt

SEQ ID NO: 5548414 - DNA, 14 bp, Homo sapiens
aatatggatttgtt

SEQ ID NO: 5548415 - DNA, 18 bp, Homo sapiens
aatatggcaatagcattg

SEQ ID NO: 5548416 - DNA, 19 bp, Homo sapiens
aatatgggcattgtagtta

SEQ ID NO: 5548417 - DNA, 17 bp, Homo sapiens
aatatggggatagtctg

SEQ ID NO: 5548418 - DNA, 23 bp, Homo sapiens
aatatggggatagtctgggtcag

SEQ ID NO: 5548419 - DNA, 18 bp, Homo sapiens
aatatggtggccctgggg

SEQ ID NO: 5548420 - DNA, 15 bp, Homo sapiens
aatatggtgtatttt

SEQ ID NO: 5548421 - DNA, 16 bp, Homo sapiens
aatatggttgatagtt

SEQ ID NO: 5548422 - DNA, 15 bp, Homo sapiens
aatatgtaaacttta

SEQ ID NO: 5548423 - DNA, 17 bp, Homo sapiens
aatatgtaaactttaac

SEQ ID NO: 5548424 - DNA, 16 bp, Homo sapiens
aatatgtaacatgtct

SEQ ID NO: 5548425 - DNA, 18 bp, Homo sapiens
aatatgtaagtcaggagt

SEQ ID NO: 5548426 - DNA, 16 bp, Homo sapiens
aatatgtaatacttaa

SEQ ID NO: 5548427 - DNA, 23 bp, Homo sapiens
aatatgtaatacttaaataaaca

SEQ ID NO: 5548428 - DNA, 19 bp, Homo sapiens
aatatgtaatttcaaaata

SEQ ID NO: 5548429 - DNA, 14 bp, Homo sapiens
aatatgtacaaata

SEQ ID NO: 5548430 - DNA, 19 bp, Homo sapiens
aatatgtacaaataatatt

SEQ ID NO: 5548431 - DNA, 19 bp, Homo sapiens
aatatgtacacaacttaga

SEQ ID NO: 5548432 - DNA, 15 bp, Homo sapiens
aatatgtacatttct

SEQ ID NO: 5548433 - DNA, 20 bp, Homo sapiens
aatatgtacatttctcaggc

SEQ ID NO: 5548434 - DNA, 22 bp, Homo sapiens
aatatgtacatttgtcttttta

SEQ ID NO: 5548435 - DNA, 12 bp, Homo sapiens
aatatgtaccaa

SEQ ID NO: 5548436 - DNA, 14 bp, Homo sapiens
aatatgtactgtat

SEQ ID NO: 5548437 - DNA, 19 bp, Homo sapiens
aatatgtactgtataacat

SEQ ID NO: 5548438 - DNA, 15 bp, Homo sapiens
aatatgtacttttcc

SEQ ID NO: 5548439 - DNA, 16 bp, Homo sapiens
aatatgtagaatgtaa

SEQ ID NO: 5548440 - DNA, 14 bp, Homo sapiens
aatatgtagccttt

SEQ ID NO: 5548441 - DNA, 23 bp, Homo sapiens
aatatgtataactttaacttctg

SEQ ID NO: 5548442 - DNA, 19 bp, Homo sapiens
aatatgtatatgacattta

SEQ ID NO: 5548443 - DNA, 13 bp, Homo sapiens
aatatgtatgtct

SEQ ID NO: 5548444 - DNA, 16 bp, Homo sapiens
aatatgtattaacact

SEQ ID NO: 5548445 - DNA, 21 bp, Homo sapiens
aatatgtattctgtaaaagaa

SEQ ID NO: 5548446 - DNA, 21 bp, Homo sapiens
aatatgtatttaccaaaaatt

SEQ ID NO: 5548447 - DNA, 22 bp, Homo sapiens
aatatgtctcgctagtgatgtt

SEQ ID NO: 5548448 - DNA, 12 bp, Homo sapiens
aatatgtgaaga

SEQ ID NO: 5548449 - DNA, 22 bp, Homo sapiens
aatatgtgaagcccagcatctc

SEQ ID NO: 5548450 - DNA, 19 bp, Homo sapiens
aatatgtgaaggaccttca

SEQ ID NO: 5548451 - DNA, 21 bp, Homo sapiens
aatatgtgagattttttattg

SEQ ID NO: 5548452 - DNA, 22 bp, Homo sapiens
aatatgtgagattttttattgc

SEQ ID NO: 5548453 - DNA, 18 bp, Homo sapiens
aatatgtgattatcattt

SEQ ID NO: 5548454 - DNA, 19 bp, Homo sapiens
aatatgtggaagcaaccaa

SEQ ID NO: 5548455 - DNA, 23 bp, Homo sapiens
aatatgtggagttcatcttgaat

SEQ ID NO: 5548456 - DNA, 20 bp, Homo sapiens
aatatgtggtccatctctga

SEQ ID NO: 5548457 - DNA, 22 bp, Homo sapiens
aatatgtggtccatctctgaaa

SEQ ID NO: 5548458 - DNA, 12 bp, Homo sapiens
aatatgtgtaac

SEQ ID NO: 5548459 - DNA, 16 bp, Homo sapiens
aatatgtgtaactttt

SEQ ID NO: 5548460 - DNA, 15 bp, Homo sapiens
aatatgttaaagttt

SEQ ID NO: 5548461 - DNA, 16 bp, Homo sapiens
aatatgttaaagttta

SEQ ID NO: 5548462 - DNA, 22 bp, Homo sapiens
aatatgttaacctcagtgtcat

SEQ ID NO: 5548463 - DNA, 11 bp, Homo sapiens
aatatgttacc

SEQ ID NO: 5548464 - DNA, 16 bp, Homo sapiens
aatatgttagcaaaga

SEQ ID NO: 5548465 - DNA, 12 bp, Homo sapiens
aatatgttgact

SEQ ID NO: 5548466 - DNA, 14 bp, Homo sapiens
aatatgttgacttt

SEQ ID NO: 5548467 - DNA, 22 bp, Homo sapiens
aatatgttgagtgttcatttta

SEQ ID NO: 5548468 - DNA, 16 bp, Homo sapiens
aatatgttgattttta

SEQ ID NO: 5548469 - DNA, 18 bp, Homo sapiens
aatatgtttaatgttcat

SEQ ID NO: 5548470 - DNA, 15 bp, Homo sapiens
aatatgtttagtttt

SEQ ID NO: 5548471 - DNA, 22 bp, Homo sapiens
aatatgtttagttttacatttt

SEQ ID NO: 5548472 - DNA, 17 bp, Homo sapiens
aatatgtttcaaacttt

SEQ ID NO: 5548473 - DNA, 13 bp, Homo sapiens
aatatgtttcaca

SEQ ID NO: 5548474 - DNA, 13 bp, Homo sapiens
aatatgtttcctt

SEQ ID NO: 5548475 - DNA, 19 bp, Homo sapiens
aatatgtttccttgtttat

SEQ ID NO: 5548476 - DNA, 20 bp, Homo sapiens
aatatgtttggaatattcca

SEQ ID NO: 5548477 - DNA, 23 bp, Homo sapiens
aatatgttttgcctttgtggccc

SEQ ID NO: 5548478 - DNA, 16 bp, Homo sapiens
aatattaaaaaaatgc

SEQ ID NO: 5548479 - DNA, 20 bp, Homo sapiens
aatattaaaaagaagtttct

SEQ ID NO: 5548480 - DNA, 20 bp, Homo sapiens
aatattaaaaagtctgtatg

SEQ ID NO: 5548481 - DNA, 16 bp, Homo sapiens
aatattaaaaagtctt

SEQ ID NO: 5548482 - DNA, 13 bp, Homo sapiens
aatattaaaagaa

SEQ ID NO: 5548483 - DNA, 16 bp, Homo sapiens
aatattaaaatcactg

SEQ ID NO: 5548484 - DNA, 22 bp, Homo sapiens
aatattaaaatcactgtcaata

SEQ ID NO: 5548485 - DNA, 13 bp, Homo sapiens
aatattaaaattg

SEQ ID NO: 5548486 - DNA, 17 bp, Homo sapiens
aatattaaaattgttaa

SEQ ID NO: 5548487 - DNA, 17 bp, Homo sapiens
aatattaaaccctggat

SEQ ID NO: 5548488 - DNA, 23 bp, Homo sapiens
aatattaaagatttatttagcta

SEQ ID NO: 5548489 - DNA, 15 bp, Homo sapiens
aatattaaagccatg

SEQ ID NO: 5548490 - DNA, 19 bp, Homo sapiens
aatattaaagccatgttta

SEQ ID NO: 5548491 - DNA, 19 bp, Homo sapiens
aatattaaagctcttcatt

SEQ ID NO: 5548492 - DNA, 23 bp, Homo sapiens
aatattaaagctcttcatttctg

SEQ ID NO: 5548493 - DNA, 13 bp, Homo sapiens
aatattaaataca

SEQ ID NO: 5548494 - DNA, 16 bp, Homo sapiens
aatattaaatacagac

SEQ ID NO: 5548495 - DNA, 19 bp, Homo sapiens
aatattaaatattataatg

SEQ ID NO: 5548496 - DNA, 13 bp, Homo sapiens
aatattaaatctg

SEQ ID NO: 5548497 - DNA, 18 bp, Homo sapiens
aatattaactacagaaaa

SEQ ID NO: 5548498 - DNA, 15 bp, Homo sapiens
aatattaactactgt

SEQ ID NO: 5548499 - DNA, 22 bp, Homo sapiens
aatattaactgacgaagaagca

SEQ ID NO: 5548500 - DNA, 18 bp, Homo sapiens
aatattaacttttaatgg

SEQ ID NO: 5548501 - DNA, 14 bp, Homo sapiens
aatattaagaaaca

SEQ ID NO: 5548502 - DNA, 17 bp, Homo sapiens
aatattaagaacatttt

SEQ ID NO: 5548503 - DNA, 20 bp, Homo sapiens
aatattaagtgttgtacaat

SEQ ID NO: 5548504 - DNA, 15 bp, Homo sapiens
aatattaatacagat

SEQ ID NO: 5548505 - DNA, 15 bp, Homo sapiens
aatattaatatgtac

SEQ ID NO: 5548506 - DNA, 12 bp, Homo sapiens
aatattaatccc

SEQ ID NO: 5548507 - DNA, 17 bp, Homo sapiens
aatattaatggaaacat

SEQ ID NO: 5548508 - DNA, 18 bp, Homo sapiens
aatattaatggaaacatg

SEQ ID NO: 5548509 - DNA, 13 bp, Homo sapiens
aatattaatttat

SEQ ID NO: 5548510 - DNA, 18 bp, Homo sapiens
aatattaatttatatttg

SEQ ID NO: 5548511 - DNA, 20 bp, Homo sapiens
aatattacagataaaatgta

SEQ ID NO: 5548512 - DNA, 13 bp, Homo sapiens
aatattacatgta

SEQ ID NO: 5548513 - DNA, 15 bp, Homo sapiens
aatattacatgtaaa

SEQ ID NO: 5548514 - DNA, 19 bp, Homo sapiens
aatattacatgtaaagctg

SEQ ID NO: 5548515 - DNA, 21 bp, Homo sapiens
aatattacatgtaaagctgtt

SEQ ID NO: 5548516 - DNA, 22 bp, Homo sapiens
aatattacatgtaaagctgtta

SEQ ID NO: 5548517 - DNA, 15 bp, Homo sapiens
aatattacattgcat

SEQ ID NO: 5548518 - DNA, 21 bp, Homo sapiens
aatattacattgcattcaaaa

SEQ ID NO: 5548519 - DNA, 13 bp, Homo sapiens
aatattacatttc

SEQ ID NO: 5548520 - DNA, 17 bp, Homo sapiens
aatattacatttcattt

SEQ ID NO: 5548521 - DNA, 19 bp, Homo sapiens
aatattacatttcatttat

SEQ ID NO: 5548522 - DNA, 22 bp, Homo sapiens
aatattaccaaaaaagtatttt

SEQ ID NO: 5548523 - DNA, 17 bp, Homo sapiens
aatcaagaatattcaaa

SEQ ID NO: 5548524 - DNA, 16 bp, Homo sapiens
aatcaagaatcattga

SEQ ID NO: 5548525 - DNA, 13 bp, Homo sapiens
aatcaagagaaac

SEQ ID NO: 5548526 - DNA, 19 bp, Homo sapiens
aatcaagagcattgctttt

SEQ ID NO: 5548527 - DNA, 17 bp, Homo sapiens
aatcaagagctgccctc

SEQ ID NO: 5548528 - DNA, 10 bp, Homo sapiens
aatcaagagt

SEQ ID NO: 5548529 - DNA, 17 bp, Homo sapiens
aatcaagagtctctcca

SEQ ID NO: 5548530 - DNA, 18 bp, Homo sapiens
aatcaagagtctctccag

SEQ ID NO: 5548531 - DNA, 20 bp, Homo sapiens
aatcaagagtctctccagcc

SEQ ID NO: 5548532 - DNA, 21 bp, Homo sapiens
aatcaagagtctctccagcct

SEQ ID NO: 5548533 - DNA, 18 bp, Homo sapiens
aatcaagatgagatatat

SEQ ID NO: 5548534 - DNA, 13 bp, Homo sapiens
aatcaagatttta

SEQ ID NO: 5548535 - DNA, 18 bp, Homo sapiens
aatcaagattttagggct

SEQ ID NO: 5548536 - DNA, 16 bp, Homo sapiens
aatcaagcaggttaga

SEQ ID NO: 5548537 - DNA, 18 bp, Homo sapiens
aatcaagcaggttagaga

SEQ ID NO: 5548538 - DNA, 23 bp, Homo sapiens
aatcaagcctctggtcacatggc

SEQ ID NO: 5548539 - DNA, 19 bp, Homo sapiens
aatcaaggagtcttctaat

SEQ ID NO: 5548540 - DNA, 21 bp, Homo sapiens
aatcaaggagtcttctaatgt

SEQ ID NO: 5548541 - DNA, 18 bp, Homo sapiens
aatcaaggcaaaaggaat

SEQ ID NO: 5548542 - DNA, 14 bp, Homo sapiens
aatcaagggtcagg

SEQ ID NO: 5548543 - DNA, 18 bp, Homo sapiens
aatcaagtctgtgaaagt

SEQ ID NO: 5548544 - DNA, 20 bp, Homo sapiens
aatcaagtctgtgaaagtct

SEQ ID NO: 5548545 - DNA, 17 bp, Homo sapiens
aatcaagtctgtttact

SEQ ID NO: 5548546 - DNA, 22 bp, Homo sapiens
aatcaagttaatgtactttcat

SEQ ID NO: 5548547 - DNA, 19 bp, Homo sapiens
aatcaagtttccaagcaaa

SEQ ID NO: 5548548 - DNA, 20 bp, Homo sapiens
aatcaagtttgaccagtgca

SEQ ID NO: 5548549 - DNA, 16 bp, Homo sapiens
aatcaataagctagat

SEQ ID NO: 5548550 - DNA, 15 bp, Homo sapiens
aatcaatacagacaa

SEQ ID NO: 5548551 - DNA, 16 bp, Homo sapiens
aatcaatacccttggc

SEQ ID NO: 5548552 - DNA, 21 bp, Homo sapiens
aatcaatacccttggcactga

SEQ ID NO: 5548553 - DNA, 14 bp, Homo sapiens
aatcaatactttga

SEQ ID NO: 5548554 - DNA, 21 bp, Homo sapiens
aatcaatatcccaacattctg

SEQ ID NO: 5548555 - DNA, 13 bp, Homo sapiens
aatcaatcagaag

SEQ ID NO: 5548556 - DNA, 14 bp, Homo sapiens
aatcaatcttgcat

SEQ ID NO: 5548557 - DNA, 18 bp, Homo sapiens
aatcaatcttgcatgtaa

SEQ ID NO: 5548558 - DNA, 13 bp, Homo sapiens
aatcaatgaaaaa

SEQ ID NO: 5548559 - DNA, 14 bp, Homo sapiens
aatcaatgaatatt

SEQ ID NO: 5548560 - DNA, 19 bp, Homo sapiens
aatcaatgaatattgaagt

SEQ ID NO: 5548561 - DNA, 14 bp, Homo sapiens
aatcaatgtgagtt

SEQ ID NO: 5548562 - DNA, 22 bp, Homo sapiens
aatcaattaatttttttattgt

SEQ ID NO: 5548563 - DNA, 18 bp, Homo sapiens
aatcaattattacattta

SEQ ID NO: 5548564 - DNA, 22 bp, Homo sapiens
aatcaatttaaacccattttag

SEQ ID NO: 5548565 - DNA, 16 bp, Homo sapiens
aatcaatttaaaggaa

SEQ ID NO: 5548566 - DNA, 16 bp, Homo sapiens
aatcaatttaaatgtt

SEQ ID NO: 5548567 - DNA, 18 bp, Homo sapiens
aatcaatttaaatgttta

SEQ ID NO: 5548568 - DNA, 12 bp, Homo sapiens
aatcaatttaag

SEQ ID NO: 5548569 - DNA, 14 bp, Homo sapiens
aatcaatttcccag

SEQ ID NO: 5548570 - DNA, 15 bp, Homo sapiens
aatcaatttcccaga

SEQ ID NO: 5548571 - DNA, 16 bp, Homo sapiens
aatcaatttcccagaa

SEQ ID NO: 5548572 - DNA, 17 bp, Homo sapiens
aatcacaaaagtatatt

SEQ ID NO: 5548573 - DNA, 17 bp, Homo sapiens
aatcacaaaggctgaca

SEQ ID NO: 5548574 - DNA, 18 bp, Homo sapiens
aatcacaacaaactgaat

SEQ ID NO: 5548575 - DNA, 23 bp, Homo sapiens
aatcacaagaacaaatacacttt

SEQ ID NO: 5548576 - DNA, 15 bp, Homo sapiens
aatcacaagcaataa

SEQ ID NO: 5548577 - DNA, 18 bp, Homo sapiens
aatcacaagcaataatta

SEQ ID NO: 5548578 - DNA, 19 bp, Homo sapiens
aatcacaagcaataattag

SEQ ID NO: 5548579 - DNA, 21 bp, Homo sapiens
aatcacaatgagaaaaataaa

SEQ ID NO: 5548580 - DNA, 21 bp, Homo sapiens
aatcacaattttcctgtggaa

SEQ ID NO: 5548581 - DNA, 15 bp, Homo sapiens
aatcacacctctggg

SEQ ID NO: 5548582 - DNA, 19 bp, Homo sapiens
aatcacactgtcttctgat

SEQ ID NO: 5548583 - DNA, 14 bp, Homo sapiens
aatcacagaaaaaa

SEQ ID NO: 5548584 - DNA, 17 bp, Homo sapiens
aatcacagaaaatttaa

SEQ ID NO: 5548585 - DNA, 23 bp, Homo sapiens
aatcacagatgggtattaaactt

SEQ ID NO: 5548586 - DNA, 14 bp, Homo sapiens
aatcacagattttt

SEQ ID NO: 5548587 - DNA, 14 bp, Homo sapiens
aatcacagccaata

SEQ ID NO: 5548588 - DNA, 22 bp, Homo sapiens
aatcacagcccaaaatttgatg

SEQ ID NO: 5548589 - DNA, 19 bp, Homo sapiens
aatcacagcttgtattttg

SEQ ID NO: 5548590 - DNA, 12 bp, Homo sapiens
aatcacagtgtt

SEQ ID NO: 5548591 - DNA, 22 bp, Homo sapiens
aatcacatattttaaaatttgt

SEQ ID NO: 5548592 - DNA, 11 bp, Homo sapiens
aatcacattca

SEQ ID NO: 5548593 - DNA, 17 bp, Homo sapiens
aatcacattcaggcatg

SEQ ID NO: 5548594 - DNA, 15 bp, Homo sapiens
aatcacattttgtat

SEQ ID NO: 5548595 - DNA, 21 bp, Homo sapiens
aatcacattttgtatggagtt

SEQ ID NO: 5548596 - DNA, 22 bp, Homo sapiens
aatcacatttttttatgctctt

SEQ ID NO: 5548597 - DNA, 16 bp, Homo sapiens
aatcaccaaaggagct

SEQ ID NO: 5548598 - DNA, 15 bp, Homo sapiens
aatcaccaaaggctc

SEQ ID NO: 5548599 - DNA, 12 bp, Homo sapiens
aatcaccaaagt

SEQ ID NO: 5548600 - DNA, 13 bp, Homo sapiens
aatcaccaaagta

SEQ ID NO: 5548601 - DNA, 15 bp, Homo sapiens
aatcaccaattaaaa

SEQ ID NO: 5548602 - DNA, 18 bp, Homo sapiens
aatcaccacaaactgtaa

SEQ ID NO: 5548603 - DNA, 20 bp, Homo sapiens
aatcaccacaccaaacctct

SEQ ID NO: 5548604 - DNA, 20 bp, Homo sapiens
aatcaccagggccaaaagct

SEQ ID NO: 5548605 - DNA, 17 bp, Homo sapiens
aatcaccatctttgtca

SEQ ID NO: 5548606 - DNA, 14 bp, Homo sapiens
aatcaccatgtaag

SEQ ID NO: 5548607 - DNA, 23 bp, Homo sapiens
aatcaccatgtaagcactctgga

SEQ ID NO: 5548608 - DNA, 13 bp, Homo sapiens
aatcacccaatcc

SEQ ID NO: 5548609 - DNA, 22 bp, Homo sapiens
aatcacccacaaccctctggaa

SEQ ID NO: 5548610 - DNA, 14 bp, Homo sapiens
aatcacccccagga

SEQ ID NO: 5548611 - DNA, 18 bp, Homo sapiens
aatcacccctctgcccct

SEQ ID NO: 5548612 - DNA, 19 bp, Homo sapiens
aatcaccctgactgtgggg

SEQ ID NO: 5548613 - DNA, 21 bp, Homo sapiens
aatcaccgaaaacgtggctgc

SEQ ID NO: 5548614 - DNA, 19 bp, Homo sapiens
aatcaccgatgcaaacatt

SEQ ID NO: 5548615 - DNA, 19 bp, Homo sapiens
aatcacctaattaatttca

SEQ ID NO: 5548616 - DNA, 20 bp, Homo sapiens
aatcacctaattaatttcag

SEQ ID NO: 5548617 - DNA, 17 bp, Homo sapiens
aatcacctcctgtgttg

SEQ ID NO: 5548618 - DNA, 14 bp, Homo sapiens
aatcacctggctga

SEQ ID NO: 5548619 - DNA, 15 bp, Homo sapiens
aatcaccttctttgt

SEQ ID NO: 5548620 - DNA, 16 bp, Homo sapiens
aatcaccttctttgta

SEQ ID NO: 5548621 - DNA, 17 bp, Homo sapiens
aatcaccttctttgtaa

SEQ ID NO: 5548622 - DNA, 15 bp, Homo sapiens
aatcaccttttctaa

SEQ ID NO: 5548623 - DNA, 19 bp, Homo sapiens
aatcacgagatcttccttc

SEQ ID NO: 5548624 - DNA, 16 bp, Homo sapiens
aatcacgctttttgaa

SEQ ID NO: 5548625 - DNA, 18 bp, Homo sapiens
aatcacgctttttgaaaa

SEQ ID NO: 5548626 - DNA, 17 bp, Homo sapiens
aatcactaaaaatgatc

SEQ ID NO: 5548627 - DNA, 18 bp, Homo sapiens
aatcactaaactttattt

SEQ ID NO: 5548628 - DNA, 21 bp, Homo sapiens
aatcactataaccatcagtta

SEQ ID NO: 5548629 - DNA, 17 bp, Homo sapiens
aatcactatctttctga

SEQ ID NO: 5548630 - DNA, 18 bp, Homo sapiens
aatcactatctttctgat

SEQ ID NO: 5548631 - DNA, 22 bp, Homo sapiens
aatcactattcttaagcacttt

SEQ ID NO: 5548632 - DNA, 23 bp, Homo sapiens
aatcactattcttaagcactttg

SEQ ID NO: 5548633 - DNA, 15 bp, Homo sapiens
aatcactcagagcag

SEQ ID NO: 5548634 - DNA, 21 bp, Homo sapiens
aatcactctaattaattgtaa

SEQ ID NO: 5548635 - DNA, 21 bp, Homo sapiens
aatcactctgcaatggaaact

SEQ ID NO: 5548636 - DNA, 22 bp, Homo sapiens
aatcactcttgtggatgtttta

SEQ ID NO: 5548637 - DNA, 13 bp, Homo sapiens
aatcactgaggca

SEQ ID NO: 5548638 - DNA, 13 bp, Homo sapiens
aatcactgcactt

SEQ ID NO: 5548639 - DNA, 17 bp, Homo sapiens
aatcactgcagcccagg

SEQ ID NO: 5548640 - DNA, 12 bp, Homo sapiens
aatcactgccta

SEQ ID NO: 5548641 - DNA, 16 bp, Homo sapiens
aatcactggattataa

SEQ ID NO: 5548642 - DNA, 10 bp, Homo sapiens
aatcactgtg

SEQ ID NO: 5548643 - DNA, 12 bp, Homo sapiens
aatcactgtgaa

SEQ ID NO: 5548644 - DNA, 15 bp, Homo sapiens
aatcactgtgaaatt

SEQ ID NO: 5548645 - DNA, 18 bp, Homo sapiens
aatcactgtgctcagcca

SEQ ID NO: 5548646 - DNA, 13 bp, Homo sapiens
aatcactgtgtat

SEQ ID NO: 5548647 - DNA, 14 bp, Homo sapiens
aatcactgtgtata

SEQ ID NO: 5548648 - DNA, 15 bp, Homo sapiens
aatcactgtgtatat

SEQ ID NO: 5548649 - DNA, 21 bp, Homo sapiens
aatcactgttgagttctgatt

SEQ ID NO: 5548650 - DNA, 18 bp, Homo sapiens
aatcactgttgctttgaa

SEQ ID NO: 5548651 - DNA, 22 bp, Homo sapiens
aatcactgttgctttgaaaaat

SEQ ID NO: 5548652 - DNA, 14 bp, Homo sapiens
aatcactgttttta

SEQ ID NO: 5548653 - DNA, 22 bp, Homo sapiens
aatcactgtttttagacacctt

SEQ ID NO: 5548654 - DNA, 17 bp, Homo sapiens
aatcacttaacattcct

SEQ ID NO: 5548655 - DNA, 18 bp, Homo sapiens
aatcacttaacattccta

SEQ ID NO: 5548656 - DNA, 19 bp, Homo sapiens
aatcacttaacattcctaa

SEQ ID NO: 5548657 - DNA, 16 bp, Homo sapiens
aatcacttaggaaatg

SEQ ID NO: 5548658 - DNA, 12 bp, Homo sapiens
aatcacttcaga

SEQ ID NO: 5548659 - DNA, 15 bp, Homo sapiens
aatcacttcagatct

SEQ ID NO: 5548660 - DNA, 20 bp, Homo sapiens
aatcacttcagatctctaat

SEQ ID NO: 5548661 - DNA, 14 bp, Homo sapiens
aatcacttccatag

SEQ ID NO: 5548662 - DNA, 14 bp, Homo sapiens
aatcacttgaaccc

SEQ ID NO: 5548663 - DNA, 23 bp, Homo sapiens
aatcacttgaccgggagacagag

SEQ ID NO: 5548664 - DNA, 12 bp, Homo sapiens
aatcacttgtaa

SEQ ID NO: 5548665 - DNA, 14 bp, Homo sapiens
aatcacttgtaaat

SEQ ID NO: 5548666 - DNA, 19 bp, Homo sapiens
aatcacttgtaaataaata

SEQ ID NO: 5548667 - DNA, 22 bp, Homo sapiens
aatcacttgttttattgactgt

SEQ ID NO: 5548668 - DNA, 20 bp, Homo sapiens
aatcactttaatttagaaga

SEQ ID NO: 5548669 - DNA, 18 bp, Homo sapiens
aatcactttacctgcagg

SEQ ID NO: 5548670 - DNA, 23 bp, Homo sapiens
aatcactttgtctaactcagaat

SEQ ID NO: 5548671 - DNA, 14 bp, Homo sapiens
aatcactttttgga

SEQ ID NO: 5548672 - DNA, 12 bp, Homo sapiens
aatcagaaaaat

SEQ ID NO: 5548673 - DNA, 15 bp, Homo sapiens
aatcagaaaacccac

SEQ ID NO: 5548674 - DNA, 14 bp, Homo sapiens
aatcagaaaagcta

SEQ ID NO: 5548675 - DNA, 15 bp, Homo sapiens
aatcagaaaagctat

SEQ ID NO: 5548676 - DNA, 21 bp, Homo sapiens
aatcagaaaagctattaaagt

SEQ ID NO: 5548677 - DNA, 22 bp, Homo sapiens
aatcagaaaccccacttccatt

SEQ ID NO: 5548678 - DNA, 14 bp, Homo sapiens
aatcagaaagacat

SEQ ID NO: 5548679 - DNA, 17 bp, Homo sapiens
aatcagaaataggaaga

SEQ ID NO: 5548680 - DNA, 13 bp, Homo sapiens
aatcagaaatttt

SEQ ID NO: 5548681 - DNA, 18 bp, Homo sapiens
aatcagaacaaaacttct

SEQ ID NO: 5548682 - DNA, 11 bp, Homo sapiens
aatcagaactc

SEQ ID NO: 5548683 - DNA, 14 bp, Homo sapiens
aatcagaagaaagg

SEQ ID NO: 5548684 - DNA, 24 bp, Homo sapiens
aatcagaagtcatcttgctaccag

SEQ ID NO: 5548685 - DNA, 14 bp, Homo sapiens
aatcagaagtgcaa

SEQ ID NO: 5548686 - DNA, 11 bp, Homo sapiens
aatcagaataa

SEQ ID NO: 5548687 - DNA, 18 bp, Homo sapiens
aatcagaatctttaaaga

SEQ ID NO: 5548688 - DNA, 13 bp, Homo sapiens
aatcagacaaagt

SEQ ID NO: 5548689 - DNA, 17 bp, Homo sapiens
aatcagacatgagtcca

SEQ ID NO: 5548690 - DNA, 12 bp, Homo sapiens
aatcagactctt

SEQ ID NO: 5548691 - DNA, 21 bp, Homo sapiens
aatcagactcttggggaagcg

SEQ ID NO: 5548692 - DNA, 12 bp, Homo sapiens
aatcagactgac

SEQ ID NO: 5548693 - DNA, 16 bp, Homo sapiens
aatcagagaaggaaca

SEQ ID NO: 5548694 - DNA, 13 bp, Homo sapiens
aatcagagacaaa

SEQ ID NO: 5548695 - DNA, 18 bp, Homo sapiens
aatcagagagcaaggcat

SEQ ID NO: 5548696 - DNA, 14 bp, Homo sapiens
aatcagagagccta

SEQ ID NO: 5548697 - DNA, 23 bp, Homo sapiens
aatcagagataaagcttaggtca

SEQ ID NO: 5548698 - DNA, 15 bp, Homo sapiens
aatcagagatttttg

SEQ ID NO: 5548699 - DNA, 16 bp, Homo sapiens
aatcagagctccagtt

SEQ ID NO: 5548700 - DNA, 23 bp, Homo sapiens
aatcagagctccagtttgcattt

SEQ ID NO: 5548701 - DNA, 19 bp, Homo sapiens
aatcagaggagagacggtg

SEQ ID NO: 5548702 - DNA, 14 bp, Homo sapiens
aatcccagttcatg

SEQ ID NO: 5548703 - DNA, 16 bp, Homo sapiens
aatcccatcaggctgt

SEQ ID NO: 5548704 - DNA, 23 bp, Homo sapiens
aatcccatgagataaataaaaat

SEQ ID NO: 5548705 - DNA, 18 bp, Homo sapiens
aatcccattgtatttaaa

SEQ ID NO: 5548706 - DNA, 15 bp, Homo sapiens
aatcccatttcccaa

SEQ ID NO: 5548707 - DNA, 15 bp, Homo sapiens
aatcccatttcttga

SEQ ID NO: 5548708 - DNA, 13 bp, Homo sapiens
aatccccaagaac

SEQ ID NO: 5548709 - DNA, 12 bp, Homo sapiens
aatccccactcc

SEQ ID NO: 5548710 - DNA, 15 bp, Homo sapiens
aatccccactcctcc

SEQ ID NO: 5548711 - DNA, 20 bp, Homo sapiens
aatccccagatatttatgta

SEQ ID NO: 5548712 - DNA, 13 bp, Homo sapiens
aatccccagccta

SEQ ID NO: 5548713 - DNA, 21 bp, Homo sapiens
aatcccccagcgcttagaaac

SEQ ID NO: 5548714 - DNA, 18 bp, Homo sapiens
aatcccccttgccacccc

SEQ ID NO: 5548715 - DNA, 22 bp, Homo sapiens
aatccccgacccccctacccca

SEQ ID NO: 5548716 - DNA, 17 bp, Homo sapiens
aatcccctaaaataaca

SEQ ID NO: 5548717 - DNA, 17 bp, Homo sapiens
aatcccctaaacaaaaa

SEQ ID NO: 5548718 - DNA, 17 bp, Homo sapiens
aatcccctaactgattt

SEQ ID NO: 5548719 - DNA, 20 bp, Homo sapiens
aatcccctatcccattctgc

SEQ ID NO: 5548720 - DNA, 20 bp, Homo sapiens
aatcccctcagcctcttctc

SEQ ID NO: 5548721 - DNA, 17 bp, Homo sapiens
aatcccctccttgggca

SEQ ID NO: 5548722 - DNA, 23 bp, Homo sapiens
aatccccttctcccctgcactgt

SEQ ID NO: 5548723 - DNA, 23 bp, Homo sapiens
aatccctctccactcttctctcc

SEQ ID NO: 5548724 - DNA, 14 bp, Homo sapiens
aatccctgccactg

SEQ ID NO: 5548725 - DNA, 16 bp, Homo sapiens
aatccctgccactggg

SEQ ID NO: 5548726 - DNA, 22 bp, Homo sapiens
aatccctgccactgggctctgg

SEQ ID NO: 5548727 - DNA, 17 bp, Homo sapiens
aatccctgggcattgct

SEQ ID NO: 5548728 - DNA, 17 bp, Homo sapiens
aatccctggggctgtgc

SEQ ID NO: 5548729 - DNA, 22 bp, Homo sapiens
aatccctgtaatatttagctgt

SEQ ID NO: 5548730 - DNA, 17 bp, Homo sapiens
aatccctgtttaatatt

SEQ ID NO: 5548731 - DNA, 18 bp, Homo sapiens
aatcccttaacagttgta

SEQ ID NO: 5548732 - DNA, 16 bp, Homo sapiens
aatcccttcacagtcc

SEQ ID NO: 5548733 - DNA, 13 bp, Homo sapiens
aatcccttcctct

SEQ ID NO: 5548734 - DNA, 17 bp, Homo sapiens
aatcccttttatctatt

SEQ ID NO: 5548735 - DNA, 13 bp, Homo sapiens
aatccgaacctcc

SEQ ID NO: 5548736 - DNA, 13 bp, Homo sapiens
aatccgacttgaa

SEQ ID NO: 5548737 - DNA, 16 bp, Homo sapiens
aatccgagtgtttgcc

SEQ ID NO: 5548738 - DNA, 19 bp, Homo sapiens
aatccgccagtgtttctga

SEQ ID NO: 5548739 - DNA, 17 bp, Homo sapiens
aatccgcctgcagagga

SEQ ID NO: 5548740 - DNA, 23 bp, Homo sapiens
aatccgctctcttcctgcccctc

SEQ ID NO: 5548741 - DNA, 20 bp, Homo sapiens
aatccgttcatagaaattgt

SEQ ID NO: 5548742 - DNA, 23 bp, Homo sapiens
aatccgttcccttctgccacctg

SEQ ID NO: 5548743 - DNA, 15 bp, Homo sapiens
aatcctaaaagaagc

SEQ ID NO: 5548744 - DNA, 17 bp, Homo sapiens
aatcctaagttaccttt

SEQ ID NO: 5548745 - DNA, 21 bp, Homo sapiens
aatcctaatttctcctccctt

SEQ ID NO: 5548746 - DNA, 13 bp, Homo sapiens
aatcctacagtga

SEQ ID NO: 5548747 - DNA, 14 bp, Homo sapiens
aatcctacagtgaa

SEQ ID NO: 5548748 - DNA, 14 bp, Homo sapiens
aatcctaccaaagt

SEQ ID NO: 5548749 - DNA, 16 bp, Homo sapiens
aatcctaccaacctct

SEQ ID NO: 5548750 - DNA, 15 bp, Homo sapiens
aatcctaccccctct

SEQ ID NO: 5548751 - DNA, 15 bp, Homo sapiens
aatcctacctcaaaa

SEQ ID NO: 5548752 - DNA, 17 bp, Homo sapiens
aatcctacctgttttgt

SEQ ID NO: 5548753 - DNA, 20 bp, Homo sapiens
aatcctaccttgcttttgct

SEQ ID NO: 5548754 - DNA, 20 bp, Homo sapiens
aatcctacgctatgtagaat

SEQ ID NO: 5548755 - DNA, 22 bp, Homo sapiens
aatcctagaaccaagcttcaga

SEQ ID NO: 5548756 - DNA, 17 bp, Homo sapiens
aatcctagactgctcct

SEQ ID NO: 5548757 - DNA, 16 bp, Homo sapiens
aatcctagacttgaaa

SEQ ID NO: 5548758 - DNA, 19 bp, Homo sapiens
aatcctagcagacactgcc

SEQ ID NO: 5548759 - DNA, 16 bp, Homo sapiens
aatcctagccccgaga

SEQ ID NO: 5548760 - DNA, 21 bp, Homo sapiens
aatcctagtttgctgtggcct

SEQ ID NO: 5548761 - DNA, 17 bp, Homo sapiens
aatcctatatagaatgc

SEQ ID NO: 5548762 - DNA, 21 bp, Homo sapiens
aatcctatatctgtttgtata

SEQ ID NO: 5548763 - DNA, 16 bp, Homo sapiens
aatcctatctggggag

SEQ ID NO: 5548764 - DNA, 21 bp, Homo sapiens
aatcctatgtgattttaactc

SEQ ID NO: 5548765 - DNA, 18 bp, Homo sapiens
aatcctattaaaacacag

SEQ ID NO: 5548766 - DNA, 20 bp, Homo sapiens
aatcctattctcgggctgag

SEQ ID NO: 5548767 - DNA, 21 bp, Homo sapiens
aatcctattctgatgaatctc

SEQ ID NO: 5548768 - DNA, 15 bp, Homo sapiens
aatcctcactgggtg

SEQ ID NO: 5548769 - DNA, 16 bp, Homo sapiens
aatcctcactgggtgg

SEQ ID NO: 5548770 - DNA, 21 bp, Homo sapiens
aatcctcagagagttgtctgt

SEQ ID NO: 5548771 - DNA, 21 bp, Homo sapiens
aatcctcagccgagaaattgg

SEQ ID NO: 5548772 - DNA, 22 bp, Homo sapiens
aatcctcagccgagaaattggg

SEQ ID NO: 5548773 - DNA, 16 bp, Homo sapiens
aatcctcaggaaatta

SEQ ID NO: 5548774 - DNA, 20 bp, Homo sapiens
aatcctcaggatttcattga

SEQ ID NO: 5548775 - DNA, 21 bp, Homo sapiens
aatcctcatgttactcagtgt

SEQ ID NO: 5548776 - DNA, 20 bp, Homo sapiens
aatcctccaaccaggctcct

SEQ ID NO: 5548777 - DNA, 14 bp, Homo sapiens
aatcctcccagaaa

SEQ ID NO: 5548778 - DNA, 12 bp, Homo sapiens
aatcctccccac

SEQ ID NO: 5548779 - DNA, 13 bp, Homo sapiens
aatcctccccgct

SEQ ID NO: 5548780 - DNA, 17 bp, Homo sapiens
aatcctcccttcccagg

SEQ ID NO: 5548781 - DNA, 22 bp, Homo sapiens
aatcctcctgagtagctgggat

SEQ ID NO: 5548782 - DNA, 15 bp, Homo sapiens
aatcctcctgagtga

SEQ ID NO: 5548783 - DNA, 14 bp, Homo sapiens
aatcctcctgcctc

SEQ ID NO: 5548784 - DNA, 20 bp, Homo sapiens
aatcctcctgcctcagcctt

SEQ ID NO: 5548785 - DNA, 21 bp, Homo sapiens
aatcctctcaaccacctttca

SEQ ID NO: 5548786 - DNA, 15 bp, Homo sapiens
aatcctctcctttct

SEQ ID NO: 5548787 - DNA, 14 bp, Homo sapiens
aatcctctctcccc

SEQ ID NO: 5548788 - DNA, 15 bp, Homo sapiens
aatcctctctcccct

SEQ ID NO: 5548789 - DNA, 18 bp, Homo sapiens
aatcctctctcccctctg

SEQ ID NO: 5548790 - DNA, 19 bp, Homo sapiens
aatcctctgggagcttctt

SEQ ID NO: 5548791 - DNA, 17 bp, Homo sapiens
aatcctctgtaaaaaga

SEQ ID NO: 5548792 - DNA, 18 bp, Homo sapiens
aatcctcttcctctgagg

SEQ ID NO: 5548793 - DNA, 23 bp, Homo sapiens
aatcctcttctaaaatagcaata

SEQ ID NO: 5548794 - DNA, 18 bp, Homo sapiens
aatcctcttgagagaaac

SEQ ID NO: 5548795 - DNA, 23 bp, Homo sapiens
aatcctcttgagagaaacgtgaa

SEQ ID NO: 5548796 - DNA, 15 bp, Homo sapiens
aatcctgagctcaaa

SEQ ID NO: 5548797 - DNA, 18 bp, Homo sapiens
aatcctgagtctgggcaa

SEQ ID NO: 5548798 - DNA, 18 bp, Homo sapiens
aatcctgattcatattta

SEQ ID NO: 5548799 - DNA, 19 bp, Homo sapiens
aatcctgattcctctctaa

SEQ ID NO: 5548800 - DNA, 10 bp, Homo sapiens
aatcctgccc

SEQ ID NO: 5548801 - DNA, 19 bp, Homo sapiens
aatcctgcccaaaatgtga

SEQ ID NO: 5548802 - DNA, 21 bp, Homo sapiens
aatcctgcccaaaatgtgaag

SEQ ID NO: 5548803 - DNA, 17 bp, Homo sapiens
aatcctgctgccagaga

SEQ ID NO: 5548804 - DNA, 18 bp, Homo sapiens
aatcctggaaggacacag

SEQ ID NO: 5548805 - DNA, 19 bp, Homo sapiens
aatcctgggcccccagaga

SEQ ID NO: 5548806 - DNA, 17 bp, Homo sapiens
aatcctggtttgtaatg

SEQ ID NO: 5548807 - DNA, 17 bp, Homo sapiens
aatcctgtaccaaatct

SEQ ID NO: 5548808 - DNA, 18 bp, Homo sapiens
aatcctgtaccaaatctg

SEQ ID NO: 5548809 - DNA, 22 bp, Homo sapiens
aatcctgtatattatggtgtaa

SEQ ID NO: 5548810 - DNA, 13 bp, Homo sapiens
aatcctgtccctc

SEQ ID NO: 5548811 - DNA, 21 bp, Homo sapiens
aatcctgtcctcagcttctta

SEQ ID NO: 5548812 - DNA, 20 bp, Homo sapiens
aatcctgtcgattagactgg

SEQ ID NO: 5548813 - DNA, 12 bp, Homo sapiens
aatcctgtcttt

SEQ ID NO: 5548814 - DNA, 14 bp, Homo sapiens
aatcctgtgtggtt

SEQ ID NO: 5548815 - DNA, 11 bp, Homo sapiens
aatcctgtgtt

SEQ ID NO: 5548816 - DNA, 16 bp, Homo sapiens
aatcctgttacttaaa

SEQ ID NO: 5548817 - DNA, 20 bp, Homo sapiens
aatcctgttacttaaatagc

SEQ ID NO: 5548818 - DNA, 16 bp, Homo sapiens
aatcctgttgaaaagc

SEQ ID NO: 5548819 - DNA, 20 bp, Homo sapiens
aatcctgttgaaaagccatg

SEQ ID NO: 5548820 - DNA, 16 bp, Homo sapiens
aatcctgtttttccta

SEQ ID NO: 5548821 - DNA, 23 bp, Homo sapiens
aatcctgtttttcctatgctctg

SEQ ID NO: 5548822 - DNA, 21 bp, Homo sapiens
aatccttaaactagctaaaac

SEQ ID NO: 5548823 - DNA, 15 bp, Homo sapiens
aatccttcagcaatc

SEQ ID NO: 5548824 - DNA, 20 bp, Homo sapiens
aatccttccaaaaattatta

SEQ ID NO: 5548825 - DNA, 21 bp, Homo sapiens
aatccttccaaaaattattat

SEQ ID NO: 5548826 - DNA, 14 bp, Homo sapiens
aatccttccatttc

SEQ ID NO: 5548827 - DNA, 16 bp, Homo sapiens
aatccttccatttctt

SEQ ID NO: 5548828 - DNA, 13 bp, Homo sapiens
aatccttccctgc

SEQ ID NO: 5548829 - DNA, 16 bp, Homo sapiens
aatccttccctgctct

SEQ ID NO: 5548830 - DNA, 16 bp, Homo sapiens
aatccttctagtttcc

SEQ ID NO: 5548831 - DNA, 19 bp, Homo sapiens
aatccttctattctagcct

SEQ ID NO: 5548832 - DNA, 15 bp, Homo sapiens
aatccttctgcaact

SEQ ID NO: 5548833 - DNA, 13 bp, Homo sapiens
aatccttctttgt

SEQ ID NO: 5548834 - DNA, 17 bp, Homo sapiens
aatccttgatgattgac

SEQ ID NO: 5548835 - DNA, 13 bp, Homo sapiens
aatccttgcttat

SEQ ID NO: 5548836 - DNA, 18 bp, Homo sapiens
aatccttgcttatgacat

SEQ ID NO: 5548837 - DNA, 18 bp, Homo sapiens
aatccttggagtcccagg

SEQ ID NO: 5548838 - DNA, 20 bp, Homo sapiens
aatccttggctgaattaaaa

SEQ ID NO: 5548839 - DNA, 17 bp, Homo sapiens
aatccttgggagtcatt

SEQ ID NO: 5548840 - DNA, 14 bp, Homo sapiens
aatcctttaatgat

SEQ ID NO: 5548841 - DNA, 13 bp, Homo sapiens
aatcctttactgt

SEQ ID NO: 5548842 - DNA, 18 bp, Homo sapiens
aatcctttattattattt

SEQ ID NO: 5548843 - DNA, 16 bp, Homo sapiens
aatcctttctgcccac

SEQ ID NO: 5548844 - DNA, 14 bp, Homo sapiens
aatcctttgcctgc

SEQ ID NO: 5548845 - DNA, 14 bp, Homo sapiens
aatcctttggaaaa

SEQ ID NO: 5548846 - DNA, 23 bp, Homo sapiens
aatcctttgttttctgactaatt

SEQ ID NO: 5548847 - DNA, 18 bp, Homo sapiens
aatccttttcctgttcat

SEQ ID NO: 5548848 - DNA, 13 bp, Homo sapiens
aatccttttcctt

SEQ ID NO: 5548849 - DNA, 19 bp, Homo sapiens
aatccttttgataaattta

SEQ ID NO: 5548850 - DNA, 16 bp, Homo sapiens
aatcgaagcaaaagta

SEQ ID NO: 5548851 - DNA, 15 bp, Homo sapiens
aatcgacctgcctcg

SEQ ID NO: 5548852 - DNA, 17 bp, Homo sapiens
aatcgactcaaaaataa

SEQ ID NO: 5548853 - DNA, 18 bp, Homo sapiens
aatcgaggcagaaagata

SEQ ID NO: 5548854 - DNA, 20 bp, Homo sapiens
aatcgatctgtactgtaatt

SEQ ID NO: 5548855 - DNA, 15 bp, Homo sapiens
aatcgatgaatgtaa

SEQ ID NO: 5548856 - DNA, 22 bp, Homo sapiens
aatcgatgaatgtaaactcggg

SEQ ID NO: 5548857 - DNA, 15 bp, Homo sapiens
aatcgatttcctccc

SEQ ID NO: 5548858 - DNA, 14 bp, Homo sapiens
aatcgcattaatga

SEQ ID NO: 5548859 - DNA, 14 bp, Homo sapiens
aatcgccccagact

SEQ ID NO: 5548860 - DNA, 18 bp, Homo sapiens
aatcgccttatgagaaca

SEQ ID NO: 5548861 - DNA, 19 bp, Homo sapiens
aatcgctaatcagtcattt

SEQ ID NO: 5548862 - DNA, 21 bp, Homo sapiens
aatcgcttaaagatgttccta

SEQ ID NO: 5548863 - DNA, 23 bp, Homo sapiens
aatcgcttctcttttgaaacaat

SEQ ID NO: 5548864 - DNA, 22 bp, Homo sapiens
aatcgctttccttcctcccctt

SEQ ID NO: 5548865 - DNA, 14 bp, Homo sapiens
aatcggactgccaa

SEQ ID NO: 5548866 - DNA, 15 bp, Homo sapiens
aatcggactgccaaa

SEQ ID NO: 5548867 - DNA, 23 bp, Homo sapiens
aatcggatctggggctctgggat

SEQ ID NO: 5548868 - DNA, 21 bp, Homo sapiens
aatcggcagtattttctgttt

SEQ ID NO: 5548869 - DNA, 15 bp, Homo sapiens
aatcgggagtagcaa

SEQ ID NO: 5548870 - DNA, 22 bp, Homo sapiens
aatcgggataaaacagcattag

SEQ ID NO: 5548871 - DNA, 15 bp, Homo sapiens
aatcggttgacccta

SEQ ID NO: 5548872 - DNA, 15 bp, Homo sapiens
aatcggtttaaacat

SEQ ID NO: 5548873 - DNA, 19 bp, Homo sapiens
aatcgtacattgtgccctg

SEQ ID NO: 5548874 - DNA, 19 bp, Homo sapiens
aatcgtacattttgcttgc

SEQ ID NO: 5548875 - DNA, 16 bp, Homo sapiens
aatcgtcaaccacttt

SEQ ID NO: 5548876 - DNA, 23 bp, Homo sapiens
aatcgtccctatatcagggcctg

SEQ ID NO: 5548877 - DNA, 15 bp, Homo sapiens
aatcgtgtgccatgg

SEQ ID NO: 5548878 - DNA, 14 bp, Homo sapiens
aatcgtttaatgtt

SEQ ID NO: 5548879 - DNA, 16 bp, Homo sapiens
aatgaaaacagaatgt

SEQ ID NO: 5548880 - DNA, 18 bp, Homo sapiens
aatgaaaacagaatgtct

SEQ ID NO: 5548881 - DNA, 22 bp, Homo sapiens
aatgaaaacagtgtgtaaacaa

SEQ ID NO: 5548882 - DNA, 17 bp, Homo sapiens
aatgaaaacatgtacta

SEQ ID NO: 5548883 - DNA, 19 bp, Homo sapiens
aatgaaaacatgtactaca

SEQ ID NO: 5548884 - DNA, 13 bp, Homo sapiens
aatgaaaacattt

SEQ ID NO: 5548885 - DNA, 16 bp, Homo sapiens
aatgaaaactgtaaat

SEQ ID NO: 5548886 - DNA, 20 bp, Homo sapiens
aatgaaaacttttgtaaatt

SEQ ID NO: 5548887 - DNA, 22 bp, Homo sapiens
aatgaaaagatggagttgtatt

SEQ ID NO: 5548888 - DNA, 23 bp, Homo sapiens
aatgaaaagatggagttgtattt

SEQ ID NO: 5548889 - DNA, 17 bp, Homo sapiens
aatgaaaagctgaatcc

SEQ ID NO: 5548890 - DNA, 15 bp, Homo sapiens
aatgaaaaggaagtt

SEQ ID NO: 5548891 - DNA, 19 bp, Homo sapiens
aatgaaaagtcgttttcca

SEQ ID NO: 5548892 - DNA, 20 bp, Homo sapiens
aatgaaaagtcgttttccaa

SEQ ID NO: 5548893 - DNA, 21 bp, Homo sapiens
aatgaaaagtcgttttccaaa

SEQ ID NO: 5548894 - DNA, 11 bp, Homo sapiens
aatgaaaataa

SEQ ID NO: 5548895 - DNA, 17 bp, Homo sapiens
aatgaaaataaaacaca

SEQ ID NO: 5548896 - DNA, 22 bp, Homo sapiens
aatgaaaataaaacacacctcg

SEQ ID NO: 5548897 - DNA, 13 bp, Homo sapiens
aatgaaaataact

SEQ ID NO: 5548898 - DNA, 16 bp, Homo sapiens
aatgaaaataactgaa

SEQ ID NO: 5548899 - DNA, 13 bp, Homo sapiens
aatgaaaatatct

SEQ ID NO: 5548900 - DNA, 16 bp, Homo sapiens
aatgaaaatgaatatc

SEQ ID NO: 5548901 - DNA, 19 bp, Homo sapiens
aatgaaaatggctgaagaa

SEQ ID NO: 5548902 - DNA, 14 bp, Homo sapiens
aatgaaaatgtcag

SEQ ID NO: 5548903 - DNA, 20 bp, Homo sapiens
aatgaaaatgtcagaaacca

SEQ ID NO: 5548904 - DNA, 23 bp, Homo sapiens
aatgaaaatgtcagaaaccagtt

SEQ ID NO: 5548905 - DNA, 13 bp, Homo sapiens
aatgaaaattgta

SEQ ID NO: 5548906 - DNA, 20 bp, Homo sapiens
aatgaaaattgtatgttaag

SEQ ID NO: 5548907 - DNA, 19 bp, Homo sapiens
aatgaaacaaataatcaca

SEQ ID NO: 5548908 - DNA, 20 bp, Homo sapiens
aatgaaacaaataatcacat

SEQ ID NO: 5548909 - DNA, 17 bp, Homo sapiens
aatgaaacaccttctct

SEQ ID NO: 5548910 - DNA, 17 bp, Homo sapiens
aatgaaacagaacttga

SEQ ID NO: 5548911 - DNA, 21 bp, Homo sapiens
aatgaaacagggaaaatgaag

SEQ ID NO: 5548912 - DNA, 14 bp, Homo sapiens
aatgaaacccccac

SEQ ID NO: 5548913 - DNA, 20 bp, Homo sapiens
aatgaaacccccacacacac

SEQ ID NO: 5548914 - DNA, 17 bp, Homo sapiens
aatgaaacctgtgtctc

SEQ ID NO: 5548915 - DNA, 20 bp, Homo sapiens
aatgaaactagaaagcagag

SEQ ID NO: 5548916 - DNA, 23 bp, Homo sapiens
aatgaaactttctttctaaagaa

SEQ ID NO: 5548917 - DNA, 13 bp, Homo sapiens
aatgaaagaaaat

SEQ ID NO: 5548918 - DNA, 13 bp, Homo sapiens
aatgaaagaaacc

SEQ ID NO: 5548919 - DNA, 16 bp, Homo sapiens
aatgaaagaaacccac

SEQ ID NO: 5548920 - DNA, 20 bp, Homo sapiens
aatgaaagactgtacaaagt

SEQ ID NO: 5548921 - DNA, 21 bp, Homo sapiens
aatgaaagactgtacaaagta

SEQ ID NO: 5548922 - DNA, 17 bp, Homo sapiens
aatgaaagagaaaatat

SEQ ID NO: 5548923 - DNA, 21 bp, Homo sapiens
aatgaaagagagctctaacca

SEQ ID NO: 5548924 - DNA, 23 bp, Homo sapiens
aatgaaaggaagtataaagtaac

SEQ ID NO: 5548925 - DNA, 22 bp, Homo sapiens
aatgaaagggaaactgggaaac

SEQ ID NO: 5548926 - DNA, 19 bp, Homo sapiens
aatgaaagtataactgagt

SEQ ID NO: 5548927 - DNA, 15 bp, Homo sapiens
aatgaaagtattggc

SEQ ID NO: 5548928 - DNA, 20 bp, Homo sapiens
aatgaaagtcaaatttactt

SEQ ID NO: 5548929 - DNA, 21 bp, Homo sapiens
aatgaaagtcttgtgactagt

SEQ ID NO: 5548930 - DNA, 17 bp, Homo sapiens
aatgaaagtgatgacat

SEQ ID NO: 5548931 - DNA, 16 bp, Homo sapiens
aatgaaagtgttaatt

SEQ ID NO: 5548932 - DNA, 19 bp, Homo sapiens
aatgaaataaaatttgaaa

SEQ ID NO: 5548933 - DNA, 12 bp, Homo sapiens
aatgaaatactg

SEQ ID NO: 5548934 - DNA, 13 bp, Homo sapiens
aatgaaatactgt

SEQ ID NO: 5548935 - DNA, 20 bp, Homo sapiens
aatgaaatataaactgtgag

SEQ ID NO: 5548936 - DNA, 22 bp, Homo sapiens
aatgaaatataaactgtgagat

SEQ ID NO: 5548937 - DNA, 12 bp, Homo sapiens
aatgaaatatct

SEQ ID NO: 5548938 - DNA, 18 bp, Homo sapiens
aatgaaatatgtgaagcc

SEQ ID NO: 5548939 - DNA, 20 bp, Homo sapiens
aatgaaatatgtgaagccca

SEQ ID NO: 5548940 - DNA, 21 bp, Homo sapiens
aatgaaatatttgcttattta

SEQ ID NO: 5548941 - DNA, 12 bp, Homo sapiens
aatgaaatcttc

SEQ ID NO: 5548942 - DNA, 17 bp, Homo sapiens
aatgaaatgataaagac

SEQ ID NO: 5548943 - DNA, 12 bp, Homo sapiens
aatgaaatgcat

SEQ ID NO: 5548944 - DNA, 15 bp, Homo sapiens
aatgaaatgcatttt

SEQ ID NO: 5548945 - DNA, 16 bp, Homo sapiens
aatgaaatgccaaagg

SEQ ID NO: 5548946 - DNA, 18 bp, Homo sapiens
aatgaaatgctctccttt

SEQ ID NO: 5548947 - DNA, 14 bp, Homo sapiens
aatgaaatgtatgc

SEQ ID NO: 5548948 - DNA, 15 bp, Homo sapiens
aatgaaatgtttact

SEQ ID NO: 5548949 - DNA, 21 bp, Homo sapiens
aatgaaattaaaaataaaatt

SEQ ID NO: 5548950 - DNA, 15 bp, Homo sapiens
aatgaaattaacaca

SEQ ID NO: 5548951 - DNA, 14 bp, Homo sapiens
aatgaaattaactg

SEQ ID NO: 5548952 - DNA, 22 bp, Homo sapiens
aatgaaattcttttataaatat

SEQ ID NO: 5548953 - DNA, 14 bp, Homo sapiens
aatgaaattgtaaa

SEQ ID NO: 5548954 - DNA, 17 bp, Homo sapiens
aatgaaatttaagcaca

SEQ ID NO: 5548955 - DNA, 14 bp, Homo sapiens
aatgaaatttgcaa

SEQ ID NO: 5548956 - DNA, 16 bp, Homo sapiens
aatgaacaaaattatt

SEQ ID NO: 5548957 - DNA, 17 bp, Homo sapiens
aatgaacaaaattattt

SEQ ID NO: 5548958 - DNA, 15 bp, Homo sapiens
aatgaacaaacctgt

SEQ ID NO: 5548959 - DNA, 14 bp, Homo sapiens
aatgaacaaattga

SEQ ID NO: 5548960 - DNA, 17 bp, Homo sapiens
aatgaacaagagaagca

SEQ ID NO: 5548961 - DNA, 19 bp, Homo sapiens
aatgaacacagctctttaa

SEQ ID NO: 5548962 - DNA, 21 bp, Homo sapiens
aatgaacactcttttgcttta

SEQ ID NO: 5548963 - DNA, 15 bp, Homo sapiens
aatgaacagaacata

SEQ ID NO: 5548964 - DNA, 22 bp, Homo sapiens
aatgaacagaacatagacagaa

SEQ ID NO: 5548965 - DNA, 13 bp, Homo sapiens
aatgaacagaatt

SEQ ID NO: 5548966 - DNA, 18 bp, Homo sapiens
aatgaacatctcttgaaa

SEQ ID NO: 5548967 - DNA, 15 bp, Homo sapiens
aatgaacatttaact

SEQ ID NO: 5548968 - DNA, 12 bp, Homo sapiens
aatgaacatttt

SEQ ID NO: 5548969 - DNA, 23 bp, Homo sapiens
aatgaacattttgtggagtttgt

SEQ ID NO: 5548970 - DNA, 16 bp, Homo sapiens
aatgaaccacatcttg

SEQ ID NO: 5548971 - DNA, 17 bp, Homo sapiens
aatgaaccacatcttgc

SEQ ID NO: 5548972 - DNA, 23 bp, Homo sapiens
aatgaaccacatcttgctctgct

SEQ ID NO: 5548973 - DNA, 17 bp, Homo sapiens
aatgaaccccactgggt

SEQ ID NO: 5548974 - DNA, 21 bp, Homo sapiens
aatgaacccccatgatgtaag

SEQ ID NO: 5548975 - DNA, 22 bp, Homo sapiens
aatgaacccccatgatgtaagt

SEQ ID NO: 5548976 - DNA, 18 bp, Homo sapiens
aatgaacccctggctcct

SEQ ID NO: 5548977 - DNA, 23 bp, Homo sapiens
aatgaacccctggctccttcacc

SEQ ID NO: 5548978 - DNA, 22 bp, Homo sapiens
aatgaaccgtttacagtgtatt

SEQ ID NO: 5548979 - DNA, 16 bp, Homo sapiens
aatgaacctgatcact

SEQ ID NO: 5548980 - DNA, 13 bp, Homo sapiens
aatgaactactgc

SEQ ID NO: 5548981 - DNA, 20 bp, Homo sapiens
aatgaactcaagaaggaatt

SEQ ID NO: 5548982 - DNA, 11 bp, Homo sapiens
aatgaactgaa

SEQ ID NO: 5548983 - DNA, 14 bp, Homo sapiens
aatgaactgatttt

SEQ ID NO: 5548984 - DNA, 13 bp, Homo sapiens
aatgaactgccca

SEQ ID NO: 5548985 - DNA, 15 bp, Homo sapiens
aatgaactgtatatt

SEQ ID NO: 5548986 - DNA, 16 bp, Homo sapiens
aatgaactgtatatta

SEQ ID NO: 5548987 - DNA, 20 bp, Homo sapiens
aatgaactgtattattgcaa

SEQ ID NO: 5548988 - DNA, 19 bp, Homo sapiens
aatgaactgtgacaggaag

SEQ ID NO: 5548989 - DNA, 18 bp, Homo sapiens
aatgaacttccatttgta

SEQ ID NO: 5548990 - DNA, 15 bp, Homo sapiens
aatgaacttgttact

SEQ ID NO: 5548991 - DNA, 14 bp, Homo sapiens
aatgaacttttaca

SEQ ID NO: 5548992 - DNA, 17 bp, Homo sapiens
aatgaacttttacagaa

SEQ ID NO: 5548993 - DNA, 18 bp, Homo sapiens
aatgaacttttacagaat

SEQ ID NO: 5548994 - DNA, 20 bp, Homo sapiens
aatgaacttttacagaatgc

SEQ ID NO: 5548995 - DNA, 13 bp, Homo sapiens
aatgaagaaagta

SEQ ID NO: 5548996 - DNA, 20 bp, Homo sapiens
aatgaagaaagtaaaaccat

SEQ ID NO: 5548997 - DNA, 13 bp, Homo sapiens
aatgaagaaggaa

SEQ ID NO: 5548998 - DNA, 14 bp, Homo sapiens
aatgaagaaggaag

SEQ ID NO: 5548999 - DNA, 14 bp, Homo sapiens
aatgaagaagtttc

SEQ ID NO: 5549000 - DNA, 19 bp, Homo sapiens
aatgaagaattatgtaata

SEQ ID NO: 5549001 - DNA, 14 bp, Homo sapiens
aatgaagaatttaa

SEQ ID NO: 5549002 - DNA, 15 bp, Homo sapiens
aatgaagaatttaaa

SEQ ID NO: 5549003 - DNA, 13 bp, Homo sapiens
aatgaagacaatg

SEQ ID NO: 5549004 - DNA, 23 bp, Homo sapiens
aatgaagacctaaatgacctcag

SEQ ID NO: 5549005 - DNA, 18 bp, Homo sapiens
aatgaagataaatgcttt

SEQ ID NO: 5549006 - DNA, 19 bp, Homo sapiens
aatgaagataaatgcttta

SEQ ID NO: 5549007 - DNA, 20 bp, Homo sapiens
aatgaagataaatgctttaa

SEQ ID NO: 5549008 - DNA, 22 bp, Homo sapiens
aatgaagataaatgctttaaat

SEQ ID NO: 5549009 - DNA, 12 bp, Homo sapiens
aatgaagatact

SEQ ID NO: 5549010 - DNA, 16 bp, Homo sapiens
aatgaagatctttata

SEQ ID NO: 5549011 - DNA, 22 bp, Homo sapiens
aatgaagattattttttatgag

SEQ ID NO: 5549012 - DNA, 21 bp, Homo sapiens
aatgaagattcagcagtgtct

SEQ ID NO: 5549013 - DNA, 14 bp, Homo sapiens
aatgaagcaaacac

SEQ ID NO: 5549014 - DNA, 18 bp, Homo sapiens
aatgaagcaaacacacag

SEQ ID NO: 5549015 - DNA, 14 bp, Homo sapiens
aatgaagcaatgct

SEQ ID NO: 5549016 - DNA, 17 bp, Homo sapiens
aatgaagcaatttatat

SEQ ID NO: 5549017 - DNA, 16 bp, Homo sapiens
aatgaagcagaggaag

SEQ ID NO: 5549018 - DNA, 17 bp, Homo sapiens
aatgaagcagctttaaa

SEQ ID NO: 5549019 - DNA, 13 bp, Homo sapiens
aatgaagccagct

SEQ ID NO: 5549020 - DNA, 18 bp, Homo sapiens
aatgaaggatttcttatt

SEQ ID NO: 5549021 - DNA, 22 bp, Homo sapiens
aatgaaggatttcttattttct

SEQ ID NO: 5549022 - DNA, 20 bp, Homo sapiens
aatgaaggcatatttccaat

SEQ ID NO: 5549023 - DNA, 12 bp, Homo sapiens
aatgaagggaaa

SEQ ID NO: 5549024 - DNA, 18 bp, Homo sapiens
aatgaagggaaattgttt

SEQ ID NO: 5549025 - DNA, 16 bp, Homo sapiens
aatgaagggtcatttc

SEQ ID NO: 5549026 - DNA, 22 bp, Homo sapiens
aatgaaggtcataagtttctga

SEQ ID NO: 5549027 - DNA, 17 bp, Homo sapiens
aatgaaggtgtgctaca

SEQ ID NO: 5549028 - DNA, 19 bp, Homo sapiens
aatgaaggtttttgtaaag

SEQ ID NO: 5549029 - DNA, 23 bp, Homo sapiens
aatgaagtattacatgatttaaa

SEQ ID NO: 5549030 - DNA, 20 bp, Homo sapiens
aatgaagtattatctgtaaa

SEQ ID NO: 5549031 - DNA, 22 bp, Homo sapiens
aatgaagtattatctgtaaaaa

SEQ ID NO: 5549032 - DNA, 22 bp, Homo sapiens
aatgaagtatttcatgtaatat

SEQ ID NO: 5549033 - DNA, 14 bp, Homo sapiens
aatgaagtctctga

SEQ ID NO: 5549034 - DNA, 15 bp, Homo sapiens
aatgaagtgattcta

SEQ ID NO: 5549035 - DNA, 14 bp, Homo sapiens
aatgaagttgaaaa

SEQ ID NO: 5549036 - DNA, 13 bp, Homo sapiens
aatgaagtttgaa

SEQ ID NO: 5549037 - DNA, 17 bp, Homo sapiens
aatgaagtttgaatgtt

SEQ ID NO: 5549038 - DNA, 18 bp, Homo sapiens
aatgaagtttgaatgtta

SEQ ID NO: 5549039 - DNA, 22 bp, Homo sapiens
aatgaagtttgaatgttaaata

SEQ ID NO: 5549040 - DNA, 15 bp, Homo sapiens
aatgaataaactgaa

SEQ ID NO: 5549041 - DNA, 20 bp, Homo sapiens
aatgaataaagtgcaaacag

SEQ ID NO: 5549042 - DNA, 21 bp, Homo sapiens
aatgaataaagtgcaaacaga

SEQ ID NO: 5549043 - DNA, 22 bp, Homo sapiens
aatgaatatcaggctattattt

SEQ ID NO: 5549044 - DNA, 18 bp, Homo sapiens
aatgaatatctattaata

SEQ ID NO: 5549045 - DNA, 16 bp, Homo sapiens
aatgaatatctgcttt

SEQ ID NO: 5549046 - DNA, 12 bp, Homo sapiens
aatgaatatgcc

SEQ ID NO: 5549047 - DNA, 23 bp, Homo sapiens
aatgaatattaaagtctgagaaa

SEQ ID NO: 5549048 - DNA, 17 bp, Homo sapiens
aatgaatattttgataa

SEQ ID NO: 5549049 - DNA, 18 bp, Homo sapiens
aatgaatattttgataat

SEQ ID NO: 5549050 - DNA, 17 bp, Homo sapiens
aatgaatctcgttccca

SEQ ID NO: 5549051 - DNA, 17 bp, Homo sapiens
aatgaatctttgactga

SEQ ID NO: 5549052 - DNA, 14 bp, Homo sapiens
aatgaatgaaacat

SEQ ID NO: 5549053 - DNA, 16 bp, Homo sapiens
aatgaatgaggtctgg

SEQ ID NO: 5549054 - DNA, 19 bp, Homo sapiens
aatgaatgattaaattatg

SEQ ID NO: 5549055 - DNA, 20 bp, Homo sapiens
aatgaatgcaaaattgtttt

SEQ ID NO: 5549056 - DNA, 17 bp, Homo sapiens
aatgcaaaaaaaattag

SEQ ID NO: 5549057 - DNA, 21 bp, Homo sapiens
aatgcaaaaaagaaacaataa

SEQ ID NO: 5549058 - DNA, 17 bp, Homo sapiens
aatgcaaaaactctttg

SEQ ID NO: 5549059 - DNA, 22 bp, Homo sapiens
aatgcaaaattgttttcacttg

SEQ ID NO: 5549060 - DNA, 20 bp, Homo sapiens
aatgcaaaatttttttaatc

SEQ ID NO: 5549061 - DNA, 18 bp, Homo sapiens
aatgcaaacactgtgtat

SEQ ID NO: 5549062 - DNA, 22 bp, Homo sapiens
aatgcaaaccatcattgaaatc

SEQ ID NO: 5549063 - DNA, 13 bp, Homo sapiens
aatgcaaactggg

SEQ ID NO: 5549064 - DNA, 12 bp, Homo sapiens
aatgcaaagatg

SEQ ID NO: 5549065 - DNA, 17 bp, Homo sapiens
aatgcaaagttacatga

SEQ ID NO: 5549066 - DNA, 16 bp, Homo sapiens
aatgcaaagttctgtg

SEQ ID NO: 5549067 - DNA, 22 bp, Homo sapiens
aatgcaaatagtagacatttgt

SEQ ID NO: 5549068 - DNA, 22 bp, Homo sapiens
aatgcaaatgaaggaatgcaat

SEQ ID NO: 5549069 - DNA, 16 bp, Homo sapiens
aatgcaaatgaatcat

SEQ ID NO: 5549070 - DNA, 19 bp, Homo sapiens
aatgcaaatgtctaattgt

SEQ ID NO: 5549071 - DNA, 16 bp, Homo sapiens
aatgcaaattctcaag

SEQ ID NO: 5549072 - DNA, 17 bp, Homo sapiens
aatgcaaccatttgaaa

SEQ ID NO: 5549073 - DNA, 16 bp, Homo sapiens
aatgcaacctctgccc

SEQ ID NO: 5549074 - DNA, 13 bp, Homo sapiens
aatgcaactttta

SEQ ID NO: 5549075 - DNA, 20 bp, Homo sapiens
aatgcaacttttaattactg

SEQ ID NO: 5549076 - DNA, 9 bp, Homo sapiens
aatgcaaga

SEQ ID NO: 5549077 - DNA, 21 bp, Homo sapiens
aatgcaagagaacattttact

SEQ ID NO: 5549078 - DNA, 21 bp, Homo sapiens
aatgcaagagtgattgcagct

SEQ ID NO: 5549079 - DNA, 22 bp, Homo sapiens
aatgcaagcaaagtatcaaaga

SEQ ID NO: 5549080 - DNA, 21 bp, Homo sapiens
aatgcaagtaagactttctga

SEQ ID NO: 5549081 - DNA, 22 bp, Homo sapiens
aatgcaagtgaacttgggaggg

SEQ ID NO: 5549082 - DNA, 12 bp, Homo sapiens
aatgcaataaga

SEQ ID NO: 5549083 - DNA, 13 bp, Homo sapiens
aatgcaataagaa

SEQ ID NO: 5549084 - DNA, 14 bp, Homo sapiens
aatgcaataagatt

SEQ ID NO: 5549085 - DNA, 22 bp, Homo sapiens
aatgcaatagaagtgctcccct

SEQ ID NO: 5549086 - DNA, 18 bp, Homo sapiens
aatgcaatataaaaatgt

SEQ ID NO: 5549087 - DNA, 14 bp, Homo sapiens
aatgcaatatgtat

SEQ ID NO: 5549088 - DNA, 15 bp, Homo sapiens
aatgcaatatgtgaa

SEQ ID NO: 5549089 - DNA, 15 bp, Homo sapiens
aatgcaatcaggatt

SEQ ID NO: 5549090 - DNA, 21 bp, Homo sapiens
aatgcaatgtaagcatacttt

SEQ ID NO: 5549091 - DNA, 12 bp, Homo sapiens
aatgcaattaga

SEQ ID NO: 5549092 - DNA, 18 bp, Homo sapiens
aatgcaattagatagaaa

SEQ ID NO: 5549093 - DNA, 17 bp, Homo sapiens
aatgcaattcaatgcaa

SEQ ID NO: 5549094 - DNA, 18 bp, Homo sapiens
aatgcaattcaatgcaat

SEQ ID NO: 5549095 - DNA, 14 bp, Homo sapiens
aatgcaatttaaaa

SEQ ID NO: 5549096 - DNA, 17 bp, Homo sapiens
aatgcaatttaaaatta

SEQ ID NO: 5549097 - DNA, 16 bp, Homo sapiens
aatgcaatttgattga

SEQ ID NO: 5549098 - DNA, 12 bp, Homo sapiens
aatgcacaaaca

SEQ ID NO: 5549099 - DNA, 22 bp, Homo sapiens
aatgcacaaattgaaaacacac

SEQ ID NO: 5549100 - DNA, 17 bp, Homo sapiens
aatgcacaagaatggat

SEQ ID NO: 5549101 - DNA, 16 bp, Homo sapiens
aatgcacaagctcaga

SEQ ID NO: 5549102 - DNA, 16 bp, Homo sapiens
aatgcacaatgtcttg

SEQ ID NO: 5549103 - DNA, 19 bp, Homo sapiens
aatgcacaatgtcttggta

SEQ ID NO: 5549104 - DNA, 12 bp, Homo sapiens
aatgcacaattt

SEQ ID NO: 5549105 - DNA, 21 bp, Homo sapiens
aatgcacaatttagaaaacat

SEQ ID NO: 5549106 - DNA, 14 bp, Homo sapiens
aatgcacacaaaac

SEQ ID NO: 5549107 - DNA, 16 bp, Homo sapiens
aatgcacacagcggct

SEQ ID NO: 5549108 - DNA, 18 bp, Homo sapiens
aatgcacacagcggctgc

SEQ ID NO: 5549109 - DNA, 21 bp, Homo sapiens
aatgcacacagcggctgcctc

SEQ ID NO: 5549110 - DNA, 17 bp, Homo sapiens
aatgcacagatatactt

SEQ ID NO: 5549111 - DNA, 18 bp, Homo sapiens
aatgcacagatatacttt

SEQ ID NO: 5549112 - DNA, 22 bp, Homo sapiens
aatgcacagttctatttgctat

SEQ ID NO: 5549113 - DNA, 15 bp, Homo sapiens
aatgcacatcctcat

SEQ ID NO: 5549114 - DNA, 24 bp, Homo sapiens
aatgcacatttgtcactgaataat

SEQ ID NO: 5549115 - DNA, 14 bp, Homo sapiens
aatgcaccaagaaa

SEQ ID NO: 5549116 - DNA, 21 bp, Homo sapiens
aatgcaccaatcttgtttata

SEQ ID NO: 5549117 - DNA, 19 bp, Homo sapiens
aatgcacctagctgtgcaa

SEQ ID NO: 5549118 - DNA, 22 bp, Homo sapiens
aatgcactaagacaagaacatt

SEQ ID NO: 5549119 - DNA, 16 bp, Homo sapiens
aatgcactcctgcccc

SEQ ID NO: 5549120 - DNA, 21 bp, Homo sapiens
aatgcactctgggtctggcca

SEQ ID NO: 5549121 - DNA, 22 bp, Homo sapiens
aatgcactgatgtgtgaagtga

SEQ ID NO: 5549122 - DNA, 14 bp, Homo sapiens
aatgcactgtattg

SEQ ID NO: 5549123 - DNA, 21 bp, Homo sapiens
aatgcactgtattgctcctcc

SEQ ID NO: 5549124 - DNA, 22 bp, Homo sapiens
aatgcactgtattgctcctccc

SEQ ID NO: 5549125 - DNA, 13 bp, Homo sapiens
aatgcactgtttt

SEQ ID NO: 5549126 - DNA, 16 bp, Homo sapiens
aatgcactgtttttaa

SEQ ID NO: 5549127 - DNA, 19 bp, Homo sapiens
aatgcactgtttttaatct

SEQ ID NO: 5549128 - DNA, 22 bp, Homo sapiens
aatgcactttctatcctctgta

SEQ ID NO: 5549129 - DNA, 13 bp, Homo sapiens
aatgcactttgtt

SEQ ID NO: 5549130 - DNA, 20 bp, Homo sapiens
aatgcagaaaacagggtctg

SEQ ID NO: 5549131 - DNA, 18 bp, Homo sapiens
aatgcagaagtattcttt

SEQ ID NO: 5549132 - DNA, 22 bp, Homo sapiens
aatgcagaattttttgagtaat

SEQ ID NO: 5549133 - DNA, 20 bp, Homo sapiens
aatgcagacaacaccttcct

SEQ ID NO: 5549134 - DNA, 15 bp, Homo sapiens
aatgcagacacacaa

SEQ ID NO: 5549135 - DNA, 22 bp, Homo sapiens
aatgcagacacacaacatcaag

SEQ ID NO: 5549136 - DNA, 14 bp, Homo sapiens
aatgcagaggtctc

SEQ ID NO: 5549137 - DNA, 18 bp, Homo sapiens
aatgcagattcctgggcc

SEQ ID NO: 5549138 - DNA, 19 bp, Homo sapiens
aatgcagattcctgggcct

SEQ ID NO: 5549139 - DNA, 21 bp, Homo sapiens
aatgcagattcctgggcctgt

SEQ ID NO: 5549140 - DNA, 20 bp, Homo sapiens
aatgcagcaaggccctgctg

SEQ ID NO: 5549141 - DNA, 15 bp, Homo sapiens
aatgcagcaatccca

SEQ ID NO: 5549142 - DNA, 22 bp, Homo sapiens
aatgcagccacgattggagaat

SEQ ID NO: 5549143 - DNA, 22 bp, Homo sapiens
aatgcagcccaccaggagcacc

SEQ ID NO: 5549144 - DNA, 17 bp, Homo sapiens
aatgcagcccatttctc

SEQ ID NO: 5549145 - DNA, 22 bp, Homo sapiens
aatgcagcgaaccaatatttgt

SEQ ID NO: 5549146 - DNA, 21 bp, Homo sapiens
aatgcagcttcaggtgagcca

SEQ ID NO: 5549147 - DNA, 23 bp, Homo sapiens
aatgcaggcaggtgtgaacatgg

SEQ ID NO: 5549148 - DNA, 23 bp, Homo sapiens
aatgcagggattgctgccacttt

SEQ ID NO: 5549149 - DNA, 17 bp, Homo sapiens
aatgcagggcacatgat

SEQ ID NO: 5549150 - DNA, 18 bp, Homo sapiens
aatgcaggtgaacttttt

SEQ ID NO: 5549151 - DNA, 17 bp, Homo sapiens
aatgcagtataaaatgt

SEQ ID NO: 5549152 - DNA, 15 bp, Homo sapiens
aatgcagtatatttc

SEQ ID NO: 5549153 - DNA, 14 bp, Homo sapiens
aatgcagtatggta

SEQ ID NO: 5549154 - DNA, 22 bp, Homo sapiens
aatgcagtccagaataagtgct

SEQ ID NO: 5549155 - DNA, 23 bp, Homo sapiens
aatgcagtccagaataagtgctg

SEQ ID NO: 5549156 - DNA, 20 bp, Homo sapiens
aatgcagtggcgccatctca

SEQ ID NO: 5549157 - DNA, 16 bp, Homo sapiens
aatgcagttgtctctg

SEQ ID NO: 5549158 - DNA, 16 bp, Homo sapiens
aatgcataaaatgtta

SEQ ID NO: 5549159 - DNA, 18 bp, Homo sapiens
aatgcataagctttttaa

SEQ ID NO: 5549160 - DNA, 21 bp, Homo sapiens
aatgcatacaataaaagagct

SEQ ID NO: 5549161 - DNA, 22 bp, Homo sapiens
aatgcatacaataaaagagctt

SEQ ID NO: 5549162 - DNA, 15 bp, Homo sapiens
aatgcatactgttga

SEQ ID NO: 5549163 - DNA, 21 bp, Homo sapiens
aatgcatactgttgatacaaa

SEQ ID NO: 5549164 - DNA, 12 bp, Homo sapiens
aatgcatagagc

SEQ ID NO: 5549165 - DNA, 15 bp, Homo sapiens
aatgcatagagcaat

SEQ ID NO: 5549166 - DNA, 17 bp, Homo sapiens
aatgcatagagcaatta

SEQ ID NO: 5549167 - DNA, 20 bp, Homo sapiens
aatgcatagagccctggcca

SEQ ID NO: 5549168 - DNA, 22 bp, Homo sapiens
aatgcatagagccctggccagc

SEQ ID NO: 5549169 - DNA, 13 bp, Homo sapiens
aatgcatattgta

SEQ ID NO: 5549170 - DNA, 19 bp, Homo sapiens
aatgcatatttataagaga

SEQ ID NO: 5549171 - DNA, 23 bp, Homo sapiens
aatgcatatttgcaaagtgtatt

SEQ ID NO: 5549172 - DNA, 16 bp, Homo sapiens
aatgcatatttttgca

SEQ ID NO: 5549173 - DNA, 17 bp, Homo sapiens
aatgcatatttttgcac

SEQ ID NO: 5549174 - DNA, 21 bp, Homo sapiens
aatgcatcatcatagaaaaac

SEQ ID NO: 5549175 - DNA, 19 bp, Homo sapiens
aatgcatccaaataggagt

SEQ ID NO: 5549176 - DNA, 20 bp, Homo sapiens
aatgcatctcatcaacttaa

SEQ ID NO: 5549177 - DNA, 17 bp, Homo sapiens
aatgcatctgaaagttt

SEQ ID NO: 5549178 - DNA, 22 bp, Homo sapiens
aatgcatctgaaagttttgata

SEQ ID NO: 5549179 - DNA, 19 bp, Homo sapiens
aatgcatctttgatgtgtt

SEQ ID NO: 5549180 - DNA, 14 bp, Homo sapiens
aatgcatgaagcaa

SEQ ID NO: 5549181 - DNA, 19 bp, Homo sapiens
aatgcatgaagcaacgata

SEQ ID NO: 5549182 - DNA, 13 bp, Homo sapiens
aatgcatgagtaa

SEQ ID NO: 5549183 - DNA, 18 bp, Homo sapiens
aatgcatgagtaaaaaaa

SEQ ID NO: 5549184 - DNA, 14 bp, Homo sapiens
aatgcatgatgact

SEQ ID NO: 5549185 - DNA, 17 bp, Homo sapiens
aatgcatgatgactctt

SEQ ID NO: 5549186 - DNA, 23 bp, Homo sapiens
aatgcatgatgactcttcttatc

SEQ ID NO: 5549187 - DNA, 18 bp, Homo sapiens
aatgcatgattttataca

SEQ ID NO: 5549188 - DNA, 19 bp, Homo sapiens
aatgcatgattttatacat

SEQ ID NO: 5549189 - DNA, 20 bp, Homo sapiens
aatgcatgattttatacata

SEQ ID NO: 5549190 - DNA, 16 bp, Homo sapiens
aatgcatgattttgta

SEQ ID NO: 5549191 - DNA, 17 bp, Homo sapiens
aatgcatgattttgtaa

SEQ ID NO: 5549192 - DNA, 19 bp, Homo sapiens
aatgcatgcagccactgtg

SEQ ID NO: 5549193 - DNA, 20 bp, Homo sapiens
aatgcatgctttccatattt

SEQ ID NO: 5549194 - DNA, 16 bp, Homo sapiens
aatgcatgtcttaaat

SEQ ID NO: 5549195 - DNA, 18 bp, Homo sapiens
aatgcatgtcttaaatgc

SEQ ID NO: 5549196 - DNA, 21 bp, Homo sapiens
aatgcatgtcttaaatgctca

SEQ ID NO: 5549197 - DNA, 13 bp, Homo sapiens
aatgcatgtgctg

SEQ ID NO: 5549198 - DNA, 22 bp, Homo sapiens
aatgcatgttctgtgtgccctg

SEQ ID NO: 5549199 - DNA, 14 bp, Homo sapiens
aatgcattaaaaaa

SEQ ID NO: 5549200 - DNA, 15 bp, Homo sapiens
aatgcattaaacctg

SEQ ID NO: 5549201 - DNA, 18 bp, Homo sapiens
aatgcattaaacctgtct

SEQ ID NO: 5549202 - DNA, 14 bp, Homo sapiens
aatgcattaataaa

SEQ ID NO: 5549203 - DNA, 22 bp, Homo sapiens
aatgcattattttgtcataaaa

SEQ ID NO: 5549204 - DNA, 15 bp, Homo sapiens
aatgcattctggaga

SEQ ID NO: 5549205 - DNA, 14 bp, Homo sapiens
aatgcattcttctc

SEQ ID NO: 5549206 - DNA, 13 bp, Homo sapiens
aatgcattctttc

SEQ ID NO: 5549207 - DNA, 13 bp, Homo sapiens
aatgcattggcct

SEQ ID NO: 5549208 - DNA, 15 bp, Homo sapiens
aatgcattggcctct

SEQ ID NO: 5549209 - DNA, 17 bp, Homo sapiens
aatgcattggcctctgt

SEQ ID NO: 5549210 - DNA, 18 bp, Homo sapiens
aatgcattgtatcgatgt

SEQ ID NO: 5549211 - DNA, 22 bp, Homo sapiens
aatgcattgtatcgatgttatg

SEQ ID NO: 5549212 - DNA, 18 bp, Homo sapiens
aatgcattgttgtaaagt

SEQ ID NO: 5549213 - DNA, 15 bp, Homo sapiens
aatgcatttaaaata

SEQ ID NO: 5549214 - DNA, 12 bp, Homo sapiens
aatgcatttaag

SEQ ID NO: 5549215 - DNA, 21 bp, Homo sapiens
aatgcatttggaaccaaagtc

SEQ ID NO: 5549216 - DNA, 16 bp, Homo sapiens
aatgcattttcaagat

SEQ ID NO: 5549217 - DNA, 17 bp, Homo sapiens
aatgcattttcaagata

SEQ ID NO: 5549218 - DNA, 12 bp, Homo sapiens
aatgcattttgt

SEQ ID NO: 5549219 - DNA, 18 bp, Homo sapiens
aatgccaaaatgtactta

SEQ ID NO: 5549220 - DNA, 14 bp, Homo sapiens
aatgccaaaggaag

SEQ ID NO: 5549221 - DNA, 18 bp, Homo sapiens
aatgccaaaggaagtttt

SEQ ID NO: 5549222 - DNA, 21 bp, Homo sapiens
aatgccaaattaaaaaagata

SEQ ID NO: 5549223 - DNA, 22 bp, Homo sapiens
aatgccaacatacccttcttta

SEQ ID NO: 5549224 - DNA, 19 bp, Homo sapiens
aatgccaactgttggaatt

SEQ ID NO: 5549225 - DNA, 14 bp, Homo sapiens
aatgccaagactct

SEQ ID NO: 5549226 - DNA, 20 bp, Homo sapiens
aatgccaagactctatgctc

SEQ ID NO: 5549227 - DNA, 21 bp, Homo sapiens
aatgccaagactctatgctct

SEQ ID NO: 5549228 - DNA, 17 bp, Homo sapiens
aatgccaagataattca

SEQ ID NO: 5549229 - DNA, 12 bp, Homo sapiens
aatgccaagatt

SEQ ID NO: 5549230 - DNA, 19 bp, Homo sapiens
aatgccaagcacttctttt

SEQ ID NO: 5549231 - DNA, 21 bp, Homo sapiens
aatgccaagggggtgactgga

SEQ ID NO: 5549232 - DNA, 18 bp, Homo sapiens
aatgctgctccaccctcc

SEQ ID NO: 5549233 - DNA, 13 bp, Homo sapiens
aatgctgcttctc

SEQ ID NO: 5549234 - DNA, 13 bp, Homo sapiens
aatgctgctttgg

SEQ ID NO: 5549235 - DNA, 17 bp, Homo sapiens
aatgctgctttgtccag

SEQ ID NO: 5549236 - DNA, 19 bp, Homo sapiens
aatgctgcttttaaaacat

SEQ ID NO: 5549237 - DNA, 23 bp, Homo sapiens
aatgctggactggaggcccctgg

SEQ ID NO: 5549238 - DNA, 12 bp, Homo sapiens
aatgctggagcg

SEQ ID NO: 5549239 - DNA, 22 bp, Homo sapiens
aatgctggcaaaggctggctgt

SEQ ID NO: 5549240 - DNA, 16 bp, Homo sapiens
aatgctggcaaatcca

SEQ ID NO: 5549241 - DNA, 14 bp, Homo sapiens
aatgctggcctgac

SEQ ID NO: 5549242 - DNA, 21 bp, Homo sapiens
aatgctggcctgactggttgt

SEQ ID NO: 5549243 - DNA, 16 bp, Homo sapiens
aatgctgggcccccag

SEQ ID NO: 5549244 - DNA, 12 bp, Homo sapiens
aatgctgggctg

SEQ ID NO: 5549245 - DNA, 21 bp, Homo sapiens
aatgctggggtcatataaaat

SEQ ID NO: 5549246 - DNA, 18 bp, Homo sapiens
aatgctggtgaaatgctg

SEQ ID NO: 5549247 - DNA, 18 bp, Homo sapiens
aatgctggttttcctaaa

SEQ ID NO: 5549248 - DNA, 22 bp, Homo sapiens
aatgctggttttcctaaatgca

SEQ ID NO: 5549249 - DNA, 17 bp, Homo sapiens
aatgctgtacatctatt

SEQ ID NO: 5549250 - DNA, 12 bp, Homo sapiens
aatgctgtacct

SEQ ID NO: 5549251 - DNA, 16 bp, Homo sapiens
aatgctgtatgtcatt

SEQ ID NO: 5549252 - DNA, 16 bp, Homo sapiens
aatgctgtattttaaa

SEQ ID NO: 5549253 - DNA, 22 bp, Homo sapiens
aatgctgtattttaaaagaatg

SEQ ID NO: 5549254 - DNA, 19 bp, Homo sapiens
aatgctgtatttttacagc

SEQ ID NO: 5549255 - DNA, 21 bp, Homo sapiens
aatgctgtatttttacagcta

SEQ ID NO: 5549256 - DNA, 17 bp, Homo sapiens
aatgctgtcaactatga

SEQ ID NO: 5549257 - DNA, 21 bp, Homo sapiens
aatgctgtctttcttgctccc

SEQ ID NO: 5549258 - DNA, 22 bp, Homo sapiens
aatgctgtctttcttgctccct

SEQ ID NO: 5549259 - DNA, 17 bp, Homo sapiens
aatgctgtctttgtgga

SEQ ID NO: 5549260 - DNA, 22 bp, Homo sapiens
aatgctgttaatatttctaaaa

SEQ ID NO: 5549261 - DNA, 10 bp, Homo sapiens
aatgctgttc

SEQ ID NO: 5549262 - DNA, 23 bp, Homo sapiens
aatgctgttcgttcaaaagtgga

SEQ ID NO: 5549263 - DNA, 13 bp, Homo sapiens
aatgctgttctca

SEQ ID NO: 5549264 - DNA, 16 bp, Homo sapiens
aatgctgttctcaatc

SEQ ID NO: 5549265 - DNA, 16 bp, Homo sapiens
aatgctgttgcctcat

SEQ ID NO: 5549266 - DNA, 19 bp, Homo sapiens
aatgctgttggtgagaatc

SEQ ID NO: 5549267 - DNA, 13 bp, Homo sapiens
aatgctgtttcta

SEQ ID NO: 5549268 - DNA, 18 bp, Homo sapiens
aatgctgtttctaagaaa

SEQ ID NO: 5549269 - DNA, 22 bp, Homo sapiens
aatgctgtttctaagaaaatgt

SEQ ID NO: 5549270 - DNA, 24 bp, Homo sapiens
aatgctgtttctaagaaaatgtag

SEQ ID NO: 5549271 - DNA, 12 bp, Homo sapiens
aatgcttaaaaa

SEQ ID NO: 5549272 - DNA, 22 bp, Homo sapiens
aatgcttaaagaattcaaattt

SEQ ID NO: 5549273 - DNA, 14 bp, Homo sapiens
aatgcttaaatgat

SEQ ID NO: 5549274 - DNA, 14 bp, Homo sapiens
aatgcttaaatttc

SEQ ID NO: 5549275 - DNA, 15 bp, Homo sapiens
aatgcttagaaattc

SEQ ID NO: 5549276 - DNA, 17 bp, Homo sapiens
aatgcttataggctggg

SEQ ID NO: 5549277 - DNA, 20 bp, Homo sapiens
aatgcttatgtgttgcataa

SEQ ID NO: 5549278 - DNA, 18 bp, Homo sapiens
aatgcttcagatattatt

SEQ ID NO: 5549279 - DNA, 16 bp, Homo sapiens
aatgcttccaagcatg

SEQ ID NO: 5549280 - DNA, 23 bp, Homo sapiens
aatgcttcctagaagttactgaa

SEQ ID NO: 5549281 - DNA, 20 bp, Homo sapiens
aatgcttctaagtaaataca

SEQ ID NO: 5549282 - DNA, 14 bp, Homo sapiens
aatgcttctatcag

SEQ ID NO: 5549283 - DNA, 14 bp, Homo sapiens
aatgcttctgattt

SEQ ID NO: 5549284 - DNA, 15 bp, Homo sapiens
aatgcttctgattta

SEQ ID NO: 5549285 - DNA, 11 bp, Homo sapiens
aatgcttctgc

SEQ ID NO: 5549286 - DNA, 18 bp, Homo sapiens
aatgcttctgcctcagct

SEQ ID NO: 5549287 - DNA, 15 bp, Homo sapiens
aatgcttctgtagct

SEQ ID NO: 5549288 - DNA, 18 bp, Homo sapiens
aatgcttctgtagcttct

SEQ ID NO: 5549289 - DNA, 12 bp, Homo sapiens
aatgcttctttt

SEQ ID NO: 5549290 - DNA, 21 bp, Homo sapiens
aatgcttcttttagtcagaaa

SEQ ID NO: 5549291 - DNA, 22 bp, Homo sapiens
aatgcttcttttagtcagaaat

SEQ ID NO: 5549292 - DNA, 16 bp, Homo sapiens
aatgcttgaaaaatgt

SEQ ID NO: 5549293 - DNA, 19 bp, Homo sapiens
aatgcttgccaagaaatcg

SEQ ID NO: 5549294 - DNA, 18 bp, Homo sapiens
aatgcttgctgctgattt

SEQ ID NO: 5549295 - DNA, 13 bp, Homo sapiens
aatgcttgctttt

SEQ ID NO: 5549296 - DNA, 14 bp, Homo sapiens
aatgcttggcactc

SEQ ID NO: 5549297 - DNA, 17 bp, Homo sapiens
aatgcttggcttctcat

SEQ ID NO: 5549298 - DNA, 18 bp, Homo sapiens
aatgctttaaaaactatt

SEQ ID NO: 5549299 - DNA, 16 bp, Homo sapiens
aatgctttaaatagtt

SEQ ID NO: 5549300 - DNA, 22 bp, Homo sapiens
aatgctttatttgtaaatttag

SEQ ID NO: 5549301 - DNA, 13 bp, Homo sapiens
aatgctttcagta

SEQ ID NO: 5549302 - DNA, 14 bp, Homo sapiens
aatgctttcctccc

SEQ ID NO: 5549303 - DNA, 18 bp, Homo sapiens
aatgctttctcatgcata

SEQ ID NO: 5549304 - DNA, 15 bp, Homo sapiens
aatgctttctgtatg

SEQ ID NO: 5549305 - DNA, 14 bp, Homo sapiens
aatgctttgaaatt

SEQ ID NO: 5549306 - DNA, 14 bp, Homo sapiens
aatgctttgtgact

SEQ ID NO: 5549307 - DNA, 17 bp, Homo sapiens
aatgctttgtgactatt

SEQ ID NO: 5549308 - DNA, 13 bp, Homo sapiens
aatgcttttaaaa

SEQ ID NO: 5549309 - DNA, 14 bp, Homo sapiens
aatgcttttaaatc

SEQ ID NO: 5549310 - DNA, 14 bp, Homo sapiens
aatgcttttagtgt

SEQ ID NO: 5549311 - DNA, 17 bp, Homo sapiens
aatgcttttatattcta

SEQ ID NO: 5549312 - DNA, 22 bp, Homo sapiens
aatgctttttgttttatttttt

SEQ ID NO: 5549313 - DNA, 11 bp, Homo sapiens
aatggaaaaaa

SEQ ID NO: 5549314 - DNA, 19 bp, Homo sapiens
aatggaaaaaaacataaaa

SEQ ID NO: 5549315 - DNA, 19 bp, Homo sapiens
aatggaaaacagactcagg

SEQ ID NO: 5549316 - DNA, 14 bp, Homo sapiens
aatggaaaatgatt

SEQ ID NO: 5549317 - DNA, 20 bp, Homo sapiens
aatggaaaatgccatgaatt

SEQ ID NO: 5549318 - DNA, 15 bp, Homo sapiens
aatggaaaatgtata

SEQ ID NO: 5549319 - DNA, 17 bp, Homo sapiens
aatggaaaattttctcc

SEQ ID NO: 5549320 - DNA, 16 bp, Homo sapiens
aatggaaacacacaca

SEQ ID NO: 5549321 - DNA, 17 bp, Homo sapiens
aatggaaacattacagt

SEQ ID NO: 5549322 - DNA, 14 bp, Homo sapiens
aatggaaactgaaa

SEQ ID NO: 5549323 - DNA, 13 bp, Homo sapiens
aatggaaacttta

SEQ ID NO: 5549324 - DNA, 20 bp, Homo sapiens
aatggaaagaaggaaaaaag

SEQ ID NO: 5549325 - DNA, 14 bp, Homo sapiens
aatggaaataaata

SEQ ID NO: 5549326 - DNA, 22 bp, Homo sapiens
aatggaaatcatcgaaaattca

SEQ ID NO: 5549327 - DNA, 13 bp, Homo sapiens
aatggaaatgtaa

SEQ ID NO: 5549328 - DNA, 16 bp, Homo sapiens
aatggaaattttgcta

SEQ ID NO: 5549329 - DNA, 21 bp, Homo sapiens
aatggaacagatttcaaaaaa

SEQ ID NO: 5549330 - DNA, 16 bp, Homo sapiens
aatggaaccaggcttg

SEQ ID NO: 5549331 - DNA, 16 bp, Homo sapiens
aatggaacctcctttc

SEQ ID NO: 5549332 - DNA, 18 bp, Homo sapiens
aatggaactactgtactt

SEQ ID NO: 5549333 - DNA, 20 bp, Homo sapiens
aatggaactccccagggcct

SEQ ID NO: 5549334 - DNA, 21 bp, Homo sapiens
aatggaactcctaaataaact

SEQ ID NO: 5549335 - DNA, 12 bp, Homo sapiens
aatggaagaaaa

SEQ ID NO: 5549336 - DNA, 13 bp, Homo sapiens
aatggaagacaca

SEQ ID NO: 5549337 - DNA, 18 bp, Homo sapiens
aatggaagacctaaggca

SEQ ID NO: 5549338 - DNA, 19 bp, Homo sapiens
aatggaagagaagagaaag

SEQ ID NO: 5549339 - DNA, 22 bp, Homo sapiens
aatggaagagaagagaaaggac

SEQ ID NO: 5549340 - DNA, 16 bp, Homo sapiens
aatggaagagagaaag

SEQ ID NO: 5549341 - DNA, 23 bp, Homo sapiens
aatggaagatttgcccatttaca

SEQ ID NO: 5549342 - DNA, 21 bp, Homo sapiens
aatggaagcaaaattataaga

SEQ ID NO: 5549343 - DNA, 13 bp, Homo sapiens
aatggaagcaaag

SEQ ID NO: 5549344 - DNA, 16 bp, Homo sapiens
aatggaagcaaagtgc

SEQ ID NO: 5549345 - DNA, 18 bp, Homo sapiens
aatggaagcaaagtgctg

SEQ ID NO: 5549346 - DNA, 19 bp, Homo sapiens
aatggaagcaaagtgctgg

SEQ ID NO: 5549347 - DNA, 17 bp, Homo sapiens
aatggaagcactgccat

SEQ ID NO: 5549348 - DNA, 21 bp, Homo sapiens
aatggaagcctccacctgcag

SEQ ID NO: 5549349 - DNA, 22 bp, Homo sapiens
aatggaagcctccacctgcagc

SEQ ID NO: 5549350 - DNA, 22 bp, Homo sapiens
aatggaagcctgaactgaggcc

SEQ ID NO: 5549351 - DNA, 20 bp, Homo sapiens
aatggaaggtttgtatattg

SEQ ID NO: 5549352 - DNA, 10 bp, Homo sapiens
aatggaataa

SEQ ID NO: 5549353 - DNA, 14 bp, Homo sapiens
aatggaataactat

SEQ ID NO: 5549354 - DNA, 15 bp, Homo sapiens
aatggaataactatc

SEQ ID NO: 5549355 - DNA, 21 bp, Homo sapiens
aatggaatataaatatcacaa

SEQ ID NO: 5549356 - DNA, 19 bp, Homo sapiens
aatggaatcagcttttaat

SEQ ID NO: 5549357 - DNA, 21 bp, Homo sapiens
aatggaatcagcttttaataa

SEQ ID NO: 5549358 - DNA, 18 bp, Homo sapiens
aatggacaaaatccatga

SEQ ID NO: 5549359 - DNA, 14 bp, Homo sapiens
aatggacatttcta

SEQ ID NO: 5549360 - DNA, 14 bp, Homo sapiens
aatggacattttct

SEQ ID NO: 5549361 - DNA, 21 bp, Homo sapiens
aatggaccggagagtgggggt

SEQ ID NO: 5549362 - DNA, 20 bp, Homo sapiens
aatggactaacttgtctttg

SEQ ID NO: 5549363 - DNA, 22 bp, Homo sapiens
aatggactcagctctgtctgct

SEQ ID NO: 5549364 - DNA, 17 bp, Homo sapiens
aatggactggtttgaga

SEQ ID NO: 5549365 - DNA, 14 bp, Homo sapiens
aatggactgtgaat

SEQ ID NO: 5549366 - DNA, 23 bp, Homo sapiens
aatggactgttacagactgaaag

SEQ ID NO: 5549367 - DNA, 19 bp, Homo sapiens
aatggacttgcttcttgtg

SEQ ID NO: 5549368 - DNA, 23 bp, Homo sapiens
aatggactttgcacactttggcc

SEQ ID NO: 5549369 - DNA, 12 bp, Homo sapiens
aatggagaaaat

SEQ ID NO: 5549370 - DNA, 15 bp, Homo sapiens
aatggagaaaatgaa

SEQ ID NO: 5549371 - DNA, 16 bp, Homo sapiens
aatggagaaaatgaat

SEQ ID NO: 5549372 - DNA, 14 bp, Homo sapiens
aatggagaaatgaa

SEQ ID NO: 5549373 - DNA, 20 bp, Homo sapiens
aatggagaacagtttcatca

SEQ ID NO: 5549374 - DNA, 15 bp, Homo sapiens
aatggagaagctctg

SEQ ID NO: 5549375 - DNA, 15 bp, Homo sapiens
aatggagaagctgca

SEQ ID NO: 5549376 - DNA, 16 bp, Homo sapiens
aatggagaagctgcag

SEQ ID NO: 5549377 - DNA, 18 bp, Homo sapiens
aatggagaattaaaactt

SEQ ID NO: 5549378 - DNA, 20 bp, Homo sapiens
aatggagattcagttttcat

SEQ ID NO: 5549379 - DNA, 22 bp, Homo sapiens
aatggagctcagtaacataact

SEQ ID NO: 5549380 - DNA, 13 bp, Homo sapiens
aatggagcttgta

SEQ ID NO: 5549381 - DNA, 21 bp, Homo sapiens
aatggaggaactttccaaaca

SEQ ID NO: 5549382 - DNA, 15 bp, Homo sapiens
aatggaggagccagg

SEQ ID NO: 5549383 - DNA, 18 bp, Homo sapiens
aatggaggagccaggccc

SEQ ID NO: 5549384 - DNA, 19 bp, Homo sapiens
aatggaggggcagagccag

SEQ ID NO: 5549385 - DNA, 20 bp, Homo sapiens
aatggaggggcagagccagg

SEQ ID NO: 5549386 - DNA, 14 bp, Homo sapiens
aatggagtcttttc

SEQ ID NO: 5549387 - DNA, 18 bp, Homo sapiens
aatggagtgtttgaaaac

SEQ ID NO: 5549388 - DNA, 20 bp, Homo sapiens
aatggagtgtttgaaaactg

SEQ ID NO: 5549389 - DNA, 13 bp, Homo sapiens
aatggagttggag

SEQ ID NO: 5549390 - DNA, 16 bp, Homo sapiens
aatggatacataaaga

SEQ ID NO: 5549391 - DNA, 15 bp, Homo sapiens
aatggatagaaaaaa

SEQ ID NO: 5549392 - DNA, 14 bp, Homo sapiens
aatggatagctcat

SEQ ID NO: 5549393 - DNA, 17 bp, Homo sapiens
aatggatatgaaagaga

SEQ ID NO: 5549394 - DNA, 19 bp, Homo sapiens
aatggatatgaaagagaaa

SEQ ID NO: 5549395 - DNA, 14 bp, Homo sapiens
aatggatatttctc

SEQ ID NO: 5549396 - DNA, 20 bp, Homo sapiens
aatggatcaatacacacaca

SEQ ID NO: 5549397 - DNA, 13 bp, Homo sapiens
aatggatcacaag

SEQ ID NO: 5549398 - DNA, 21 bp, Homo sapiens
aatggatcccaatctgagaaa

SEQ ID NO: 5549399 - DNA, 13 bp, Homo sapiens
aatggatgaaatc

SEQ ID NO: 5549400 - DNA, 22 bp, Homo sapiens
aatggattcatggagtagcctg

SEQ ID NO: 5549401 - DNA, 23 bp, Homo sapiens
aatggattcatggagtagcctgg

SEQ ID NO: 5549402 - DNA, 21 bp, Homo sapiens
aatggattggattatttaata

SEQ ID NO: 5549403 - DNA, 14 bp, Homo sapiens
aatggattgttaat

SEQ ID NO: 5549404 - DNA, 15 bp, Homo sapiens
aatggatttcagaag

SEQ ID NO: 5549405 - DNA, 15 bp, Homo sapiens
aatggattttcctga

SEQ ID NO: 5549406 - DNA, 19 bp, Homo sapiens
aatggatttttaaattata

SEQ ID NO: 5549407 - DNA, 18 bp, Homo sapiens
aatggatttttctttaac

SEQ ID NO: 5549408 - DNA, 21 bp, Homo sapiens
aatggattttttttttcaggt

SEQ ID NO: 5549409 - DNA, 14 bp, Homo sapiens
aatggcaacaaaca

SEQ ID NO: 5549410 - DNA, 19 bp, Homo sapiens
aatgtacagttgagctcag

SEQ ID NO: 5549411 - DNA, 16 bp, Homo sapiens
aatgtacatactatgt

SEQ ID NO: 5549412 - DNA, 16 bp, Homo sapiens
aatgtacatgaagcaa

SEQ ID NO: 5549413 - DNA, 20 bp, Homo sapiens
aatgtacatgtattaaatta

SEQ ID NO: 5549414 - DNA, 22 bp, Homo sapiens
aatgtacccaccgggccactcc

SEQ ID NO: 5549415 - DNA, 18 bp, Homo sapiens
aatgtacccctctcagtc

SEQ ID NO: 5549416 - DNA, 14 bp, Homo sapiens
aatgtacctatgtg

SEQ ID NO: 5549417 - DNA, 13 bp, Homo sapiens
aatgtacgtcatt

SEQ ID NO: 5549418 - DNA, 18 bp, Homo sapiens
aatgtacgtccagcctgc

SEQ ID NO: 5549419 - DNA, 18 bp, Homo sapiens
aatgtactacatttgcat

SEQ ID NO: 5549420 - DNA, 17 bp, Homo sapiens
aatgtactatatgtata

SEQ ID NO: 5549421 - DNA, 16 bp, Homo sapiens
aatgtactatgtctga

SEQ ID NO: 5549422 - DNA, 19 bp, Homo sapiens
aatgtactgatttcagtaa

SEQ ID NO: 5549423 - DNA, 12 bp, Homo sapiens
aatgtactgtac

SEQ ID NO: 5549424 - DNA, 20 bp, Homo sapiens
aatgtactgtacataaattc

SEQ ID NO: 5549425 - DNA, 22 bp, Homo sapiens
aatgtactgtacataaattcca

SEQ ID NO: 5549426 - DNA, 15 bp, Homo sapiens
aatgtacttaaatga

SEQ ID NO: 5549427 - DNA, 19 bp, Homo sapiens
aatgtacttgtttctctgt

SEQ ID NO: 5549428 - DNA, 10 bp, Homo sapiens
aatgtacttt

SEQ ID NO: 5549429 - DNA, 15 bp, Homo sapiens
aatgtagaaattctt

SEQ ID NO: 5549430 - DNA, 17 bp, Homo sapiens
aatgtagaatgattttt

SEQ ID NO: 5549431 - DNA, 17 bp, Homo sapiens
aatgtagaattgaaaat

SEQ ID NO: 5549432 - DNA, 17 bp, Homo sapiens
aatgtagacaaagtgaa

SEQ ID NO: 5549433 - DNA, 21 bp, Homo sapiens
aatgtagagtttttaaacatc

SEQ ID NO: 5549434 - DNA, 16 bp, Homo sapiens
aatgtagataagtgtt

SEQ ID NO: 5549435 - DNA, 18 bp, Homo sapiens
aatgtagcagcttcttag

SEQ ID NO: 5549436 - DNA, 23 bp, Homo sapiens
aatgtagcgactgtcaacagcgt

SEQ ID NO: 5549437 - DNA, 18 bp, Homo sapiens
aatgtagcgtgtaagctt

SEQ ID NO: 5549438 - DNA, 20 bp, Homo sapiens
aatgtagcgtgtaagcttgt

SEQ ID NO: 5549439 - DNA, 21 bp, Homo sapiens
aatgtagcgtgtttacatgtg

SEQ ID NO: 5549440 - DNA, 22 bp, Homo sapiens
aatgtagctatttttcttgttg

SEQ ID NO: 5549441 - DNA, 22 bp, Homo sapiens
aatgtagcttcagtcattaaat

SEQ ID NO: 5549442 - DNA, 18 bp, Homo sapiens
aatgtagcttccacctca

SEQ ID NO: 5549443 - DNA, 22 bp, Homo sapiens
aatgtagcttccacctcatgga

SEQ ID NO: 5549444 - DNA, 18 bp, Homo sapiens
aatgtaggcacttttatt

SEQ ID NO: 5549445 - DNA, 23 bp, Homo sapiens
aatgtaggcacttttattttcat

SEQ ID NO: 5549446 - DNA, 19 bp, Homo sapiens
aatgtaggcttagtttgtg

SEQ ID NO: 5549447 - DNA, 21 bp, Homo sapiens
aatgtagggcctgcatggaga

SEQ ID NO: 5549448 - DNA, 19 bp, Homo sapiens
aatgtagggttatatttgg

SEQ ID NO: 5549449 - DNA, 16 bp, Homo sapiens
aatgtagtctccctgt

SEQ ID NO: 5549450 - DNA, 22 bp, Homo sapiens
aatgtagttagctccataaagt

SEQ ID NO: 5549451 - DNA, 23 bp, Homo sapiens
aatgtagtttgaggaaatttgca

SEQ ID NO: 5549452 - DNA, 14 bp, Homo sapiens
aatgtagttttaaa

SEQ ID NO: 5549453 - DNA, 20 bp, Homo sapiens
aatgtagttttaaataaagt

SEQ ID NO: 5549454 - DNA, 23 bp, Homo sapiens
aatgtagttttgtgatgcatttt

SEQ ID NO: 5549455 - DNA, 18 bp, Homo sapiens
aatgtagttttgtttatg

SEQ ID NO: 5549456 - DNA, 13 bp, Homo sapiens
aatgtataaaaat

SEQ ID NO: 5549457 - DNA, 20 bp, Homo sapiens
aatgtataaaaattatcaaa

SEQ ID NO: 5549458 - DNA, 17 bp, Homo sapiens
aatgtataaagattgta

SEQ ID NO: 5549459 - DNA, 16 bp, Homo sapiens
aatgtataatgtgcag

SEQ ID NO: 5549460 - DNA, 20 bp, Homo sapiens
aatgtatacctgtaactgca

SEQ ID NO: 5549461 - DNA, 14 bp, Homo sapiens
aatgtatacttgaa

SEQ ID NO: 5549462 - DNA, 15 bp, Homo sapiens
aatgtatagtatttg

SEQ ID NO: 5549463 - DNA, 12 bp, Homo sapiens
aatgtatataaa

SEQ ID NO: 5549464 - DNA, 13 bp, Homo sapiens
aatgtatataaaa

SEQ ID NO: 5549465 - DNA, 15 bp, Homo sapiens
aatgtatataaaaat

SEQ ID NO: 5549466 - DNA, 16 bp, Homo sapiens
aatgtatatacacata

SEQ ID NO: 5549467 - DNA, 17 bp, Homo sapiens
aatgtatatacacatat

SEQ ID NO: 5549468 - DNA, 21 bp, Homo sapiens
aatgtatatacacatatacct

SEQ ID NO: 5549469 - DNA, 19 bp, Homo sapiens
aatgtatatagtctttgca

SEQ ID NO: 5549470 - DNA, 13 bp, Homo sapiens
aatgtatatattt

SEQ ID NO: 5549471 - DNA, 20 bp, Homo sapiens
aatgtatatgaacttaacat

SEQ ID NO: 5549472 - DNA, 17 bp, Homo sapiens
aatgtatatgtcattta

SEQ ID NO: 5549473 - DNA, 17 bp, Homo sapiens
aatgtatattgatgtaa

SEQ ID NO: 5549474 - DNA, 18 bp, Homo sapiens
aatgtatatttaacttct

SEQ ID NO: 5549475 - DNA, 16 bp, Homo sapiens
aatgtatatttgctgc

SEQ ID NO: 5549476 - DNA, 18 bp, Homo sapiens
aatgtatatttgctgcaa

SEQ ID NO: 5549477 - DNA, 20 bp, Homo sapiens
aatgtatatttgctgcaaag

SEQ ID NO: 5549478 - DNA, 17 bp, Homo sapiens
aatgtatattttgatga

SEQ ID NO: 5549479 - DNA, 13 bp, Homo sapiens
aatgtatcaggaa

SEQ ID NO: 5549480 - DNA, 15 bp, Homo sapiens
aatgtatcaggaaat

SEQ ID NO: 5549481 - DNA, 18 bp, Homo sapiens
aatgtatcaggaaatata

SEQ ID NO: 5549482 - DNA, 20 bp, Homo sapiens
aatgtatcattcagtgtaaa

SEQ ID NO: 5549483 - DNA, 23 bp, Homo sapiens
aatgtatccaaggaaacatttta

SEQ ID NO: 5549484 - DNA, 13 bp, Homo sapiens
aatgtatcccatt

SEQ ID NO: 5549485 - DNA, 15 bp, Homo sapiens
aatgtatctatttgt

SEQ ID NO: 5549486 - DNA, 17 bp, Homo sapiens
aatgtatctgtgaagta

SEQ ID NO: 5549487 - DNA, 11 bp, Homo sapiens
aatgtatctta

SEQ ID NO: 5549488 - DNA, 18 bp, Homo sapiens
aatgtatcttattcacat

SEQ ID NO: 5549489 - DNA, 21 bp, Homo sapiens
aatgtatcttatttatatatg

SEQ ID NO: 5549490 - DNA, 22 bp, Homo sapiens
aatgtatcttatttatatatga

SEQ ID NO: 5549491 - DNA, 13 bp, Homo sapiens
aatgtatctttat

SEQ ID NO: 5549492 - DNA, 17 bp, Homo sapiens
aatgtatctttattaaa

SEQ ID NO: 5549493 - DNA, 17 bp, Homo sapiens
aatgtatgaattttgta

SEQ ID NO: 5549494 - DNA, 21 bp, Homo sapiens
aatgtatgcttcatacaggga

SEQ ID NO: 5549495 - DNA, 14 bp, Homo sapiens
aatgtatggcatgt

SEQ ID NO: 5549496 - DNA, 20 bp, Homo sapiens
aatgtatggctcatttgctt

SEQ ID NO: 5549497 - DNA, 19 bp, Homo sapiens
aatgtatgtaatgtgtggt

SEQ ID NO: 5549498 - DNA, 19 bp, Homo sapiens
aatgtatgtgtaagtattc

SEQ ID NO: 5549499 - DNA, 20 bp, Homo sapiens
aatgtatgtgtaagtattct

SEQ ID NO: 5549500 - DNA, 21 bp, Homo sapiens
aatgtatgtgtggctgtgggt

SEQ ID NO: 5549501 - DNA, 17 bp, Homo sapiens
aatgtatgttaccaaaa

SEQ ID NO: 5549502 - DNA, 15 bp, Homo sapiens
aatgtattaatctgt

SEQ ID NO: 5549503 - DNA, 19 bp, Homo sapiens
aatgtattagtatggttca

SEQ ID NO: 5549504 - DNA, 17 bp, Homo sapiens
aatgtattattctgcag

SEQ ID NO: 5549505 - DNA, 18 bp, Homo sapiens
aatgtattattctgcagc

SEQ ID NO: 5549506 - DNA, 22 bp, Homo sapiens
aatgtattattctgcagcatga

SEQ ID NO: 5549507 - DNA, 13 bp, Homo sapiens
aatgtattcaaat

SEQ ID NO: 5549508 - DNA, 13 bp, Homo sapiens
aatgtattcaagc

SEQ ID NO: 5549509 - DNA, 17 bp, Homo sapiens
aatgtattcatatttgt

SEQ ID NO: 5549510 - DNA, 14 bp, Homo sapiens
aatgtattcattct

SEQ ID NO: 5549511 - DNA, 16 bp, Homo sapiens
aatgtattcccttcag

SEQ ID NO: 5549512 - DNA, 18 bp, Homo sapiens
aatgtattcctttaaaat

SEQ ID NO: 5549513 - DNA, 21 bp, Homo sapiens
aatgtattctatctctcttta

SEQ ID NO: 5549514 - DNA, 13 bp, Homo sapiens
aatgtattctgta

SEQ ID NO: 5549515 - DNA, 18 bp, Homo sapiens
aatgtattcttttatata

SEQ ID NO: 5549516 - DNA, 20 bp, Homo sapiens
aatgtattcttttatataac

SEQ ID NO: 5549517 - DNA, 22 bp, Homo sapiens
aatgtattcttttatataacta

SEQ ID NO: 5549518 - DNA, 18 bp, Homo sapiens
aatgtattgaacttggaa

SEQ ID NO: 5549519 - DNA, 15 bp, Homo sapiens
aatgtattgattcaa

SEQ ID NO: 5549520 - DNA, 15 bp, Homo sapiens
aatgtattgtacctt

SEQ ID NO: 5549521 - DNA, 16 bp, Homo sapiens
aatgtattgtaccttt

SEQ ID NO: 5549522 - DNA, 22 bp, Homo sapiens
aatgtattgttctcatgtaaga

SEQ ID NO: 5549523 - DNA, 23 bp, Homo sapiens
aatgtattgttctgtttgtgtta

SEQ ID NO: 5549524 - DNA, 19 bp, Homo sapiens
aatgtatttagctacagct

SEQ ID NO: 5549525 - DNA, 21 bp, Homo sapiens
aatgtatttatttaaaagatt

SEQ ID NO: 5549526 - DNA, 18 bp, Homo sapiens
aatgtatttcctgaaata

SEQ ID NO: 5549527 - DNA, 19 bp, Homo sapiens
aatgtatttgaaaattaca

SEQ ID NO: 5549528 - DNA, 15 bp, Homo sapiens
aatgtatttgttcat

SEQ ID NO: 5549529 - DNA, 18 bp, Homo sapiens
aatgtatttgttcatgtt

SEQ ID NO: 5549530 - DNA, 20 bp, Homo sapiens
aatgtatttgttcatgtttg

SEQ ID NO: 5549531 - DNA, 21 bp, Homo sapiens
aatgtatttgttcatgtttgg

SEQ ID NO: 5549532 - DNA, 17 bp, Homo sapiens
aatgtattttaaaataa

SEQ ID NO: 5549533 - DNA, 13 bp, Homo sapiens
aatgtattttaat

SEQ ID NO: 5549534 - DNA, 19 bp, Homo sapiens
aatgtattttatgttatat

SEQ ID NO: 5549535 - DNA, 20 bp, Homo sapiens
aatgtattttatgttatata

SEQ ID NO: 5549536 - DNA, 15 bp, Homo sapiens
aatgtattttattgt

SEQ ID NO: 5549537 - DNA, 20 bp, Homo sapiens
aatgtattttcagctcaatt

SEQ ID NO: 5549538 - DNA, 23 bp, Homo sapiens
aatgtattttcttcacctctgct

SEQ ID NO: 5549539 - DNA, 20 bp, Homo sapiens
aatgtattttgaaaacactt

SEQ ID NO: 5549540 - DNA, 21 bp, Homo sapiens
aatgtattttgaagaatattt

SEQ ID NO: 5549541 - DNA, 16 bp, Homo sapiens
aatgtattttgcctct

SEQ ID NO: 5549542 - DNA, 20 bp, Homo sapiens
aatgtattttggaagacata

SEQ ID NO: 5549543 - DNA, 22 bp, Homo sapiens
aatgtattttggaagacatata

SEQ ID NO: 5549544 - DNA, 17 bp, Homo sapiens
aatgtatttttgtaaat

SEQ ID NO: 5549545 - DNA, 15 bp, Homo sapiens
aatgtcaaaagtaga

SEQ ID NO: 5549546 - DNA, 15 bp, Homo sapiens
aatgtcaaaattgtt

SEQ ID NO: 5549547 - DNA, 23 bp, Homo sapiens
aatgtcaaacagtgccaaatgct

SEQ ID NO: 5549548 - DNA, 20 bp, Homo sapiens
aatgtcaaatgaaacctaca

SEQ ID NO: 5549549 - DNA, 18 bp, Homo sapiens
aatgtcaacaccagaaag

SEQ ID NO: 5549550 - DNA, 14 bp, Homo sapiens
aatgtcaaggtgct

SEQ ID NO: 5549551 - DNA, 16 bp, Homo sapiens
aatgtcaaggtgctgt

SEQ ID NO: 5549552 - DNA, 16 bp, Homo sapiens
aatgtcaagtggcagc

SEQ ID NO: 5549553 - DNA, 16 bp, Homo sapiens
aatgtcacaacatggt

SEQ ID NO: 5549554 - DNA, 21 bp, Homo sapiens
aatgtcacaatcctgtccctc

SEQ ID NO: 5549555 - DNA, 17 bp, Homo sapiens
aatgtcacacttgtttc

SEQ ID NO: 5549556 - DNA, 19 bp, Homo sapiens
aatgtcacacttgtttctt

SEQ ID NO: 5549557 - DNA, 22 bp, Homo sapiens
aatgtcacacttgtttcttgtt

SEQ ID NO: 5549558 - DNA, 14 bp, Homo sapiens
aatgtcacaggcag

SEQ ID NO: 5549559 - DNA, 16 bp, Homo sapiens
aatgtcacaggcaggt

SEQ ID NO: 5549560 - DNA, 17 bp, Homo sapiens
aatgtcacatttgaatt

SEQ ID NO: 5549561 - DNA, 19 bp, Homo sapiens
aatgtcaccaccttcccag

SEQ ID NO: 5549562 - DNA, 22 bp, Homo sapiens
aatgtcacgttttgttttgtgc

SEQ ID NO: 5549563 - DNA, 17 bp, Homo sapiens
aatgtcactatatcttc

SEQ ID NO: 5549564 - DNA, 21 bp, Homo sapiens
aatgtcactgaagtgattgaa

SEQ ID NO: 5549565 - DNA, 15 bp, Homo sapiens
aatgtcactgccaac

SEQ ID NO: 5549566 - DNA, 17 bp, Homo sapiens
aatgtcactgttataaa

SEQ ID NO: 5549567 - DNA, 17 bp, Homo sapiens
aatgtcacttcatattt

SEQ ID NO: 5549568 - DNA, 18 bp, Homo sapiens
aatgtcacttcatatttt

SEQ ID NO: 5549569 - DNA, 20 bp, Homo sapiens
aatgtcacttcatattttat

SEQ ID NO: 5549570 - DNA, 21 bp, Homo sapiens
aatgtcacttcatattttata

SEQ ID NO: 5549571 - DNA, 13 bp, Homo sapiens
aatgtcagaaaaa

SEQ ID NO: 5549572 - DNA, 17 bp, Homo sapiens
aatgtcagaaaaacaat

SEQ ID NO: 5549573 - DNA, 22 bp, Homo sapiens
aatgtcagaaaaacaataagag

SEQ ID NO: 5549574 - DNA, 21 bp, Homo sapiens
aatgtcagaaaataacagatg

SEQ ID NO: 5549575 - DNA, 14 bp, Homo sapiens
aatgtcagaaactc

SEQ ID NO: 5549576 - DNA, 21 bp, Homo sapiens
aatgtcagatacaatgtattt

SEQ ID NO: 5549577 - DNA, 20 bp, Homo sapiens
aatgtcagattcctttccct

SEQ ID NO: 5549578 - DNA, 16 bp, Homo sapiens
aatgtcagatttctgg

SEQ ID NO: 5549579 - DNA, 18 bp, Homo sapiens
aatgtcagcctttgttaa

SEQ ID NO: 5549580 - DNA, 20 bp, Homo sapiens
aatgtcaggaacagaaggat

SEQ ID NO: 5549581 - DNA, 16 bp, Homo sapiens
aatgtcagggccaggt

SEQ ID NO: 5549582 - DNA, 15 bp, Homo sapiens
aatgtcagtatgtgg

SEQ ID NO: 5549583 - DNA, 16 bp, Homo sapiens
aatgtcagtatgtgga

SEQ ID NO: 5549584 - DNA, 22 bp, Homo sapiens
aatgtcagtatgtggaagtgtg

SEQ ID NO: 5549585 - DNA, 15 bp, Homo sapiens
aatgtcagtgtgact

SEQ ID NO: 5549586 - DNA, 13 bp, Homo sapiens
aatgttgctgaaa

SEQ ID NO: 5549587 - DNA, 14 bp, Homo sapiens
aatgttgctgaaaa

SEQ ID NO: 5549588 - DNA, 20 bp, Homo sapiens
aatgttgcttaggatgtgtg

SEQ ID NO: 5549589 - DNA, 12 bp, Homo sapiens
aatgttgcttta

SEQ ID NO: 5549590 - DNA, 14 bp, Homo sapiens
aatgttggaatgtt

SEQ ID NO: 5549591 - DNA, 16 bp, Homo sapiens
aatgttggaattttca

SEQ ID NO: 5549592 - DNA, 18 bp, Homo sapiens
aatgttggaattttcaaa

SEQ ID NO: 5549593 - DNA, 20 bp, Homo sapiens
aatgttggacacctttaggt

SEQ ID NO: 5549594 - DNA, 22 bp, Homo sapiens
aatgttggacagacactgttgc

SEQ ID NO: 5549595 - DNA, 17 bp, Homo sapiens
aatgttggataaggaat

SEQ ID NO: 5549596 - DNA, 18 bp, Homo sapiens
aatgttggataaggaatt

SEQ ID NO: 5549597 - DNA, 18 bp, Homo sapiens
aatgttggcaaatcactt

SEQ ID NO: 5549598 - DNA, 20 bp, Homo sapiens
aatgttggcagatgcagctc

SEQ ID NO: 5549599 - DNA, 17 bp, Homo sapiens
aatgttggcctgtcaga

SEQ ID NO: 5549600 - DNA, 15 bp, Homo sapiens
aatgttggctgtaat

SEQ ID NO: 5549601 - DNA, 17 bp, Homo sapiens
aatgttggtgcaattaa

SEQ ID NO: 5549602 - DNA, 23 bp, Homo sapiens
aatgttggtgtggagttttcatg

SEQ ID NO: 5549603 - DNA, 23 bp, Homo sapiens
aatgttggttacatgaatgaatg

SEQ ID NO: 5549604 - DNA, 13 bp, Homo sapiens
aatgttggtttac

SEQ ID NO: 5549605 - DNA, 21 bp, Homo sapiens
aatgttggtttactttcaaat

SEQ ID NO: 5549606 - DNA, 14 bp, Homo sapiens
aatgttggtttttt

SEQ ID NO: 5549607 - DNA, 20 bp, Homo sapiens
aatgttggttttttataaag

SEQ ID NO: 5549608 - DNA, 17 bp, Homo sapiens
aatgttgtatttaattt

SEQ ID NO: 5549609 - DNA, 15 bp, Homo sapiens
aatgttgtatttcaa

SEQ ID NO: 5549610 - DNA, 12 bp, Homo sapiens
aatgttgtcctg

SEQ ID NO: 5549611 - DNA, 18 bp, Homo sapiens
aatgttgtcctgtgtcat

SEQ ID NO: 5549612 - DNA, 12 bp, Homo sapiens
aatgttgtgaat

SEQ ID NO: 5549613 - DNA, 17 bp, Homo sapiens
aatgttgtgaataatta

SEQ ID NO: 5549614 - DNA, 20 bp, Homo sapiens
aatgttgtgaataattacag

SEQ ID NO: 5549615 - DNA, 16 bp, Homo sapiens
aatgttgtggtttgtt

SEQ ID NO: 5549616 - DNA, 22 bp, Homo sapiens
aatgttgtgttggtatttactg

SEQ ID NO: 5549617 - DNA, 13 bp, Homo sapiens
aatgttgttaaat

SEQ ID NO: 5549618 - DNA, 19 bp, Homo sapiens
aatgttgttaaatgctatg

SEQ ID NO: 5549619 - DNA, 15 bp, Homo sapiens
aatgttgttatttaa

SEQ ID NO: 5549620 - DNA, 21 bp, Homo sapiens
aatgttgtttacaatatagat

SEQ ID NO: 5549621 - DNA, 19 bp, Homo sapiens
aatgtttaaaaaagtttaa

SEQ ID NO: 5549622 - DNA, 12 bp, Homo sapiens
aatgtttaaaga

SEQ ID NO: 5549623 - DNA, 11 bp, Homo sapiens
aatgtttaaat

SEQ ID NO: 5549624 - DNA, 16 bp, Homo sapiens
aatgtttaaatataaa

SEQ ID NO: 5549625 - DNA, 12 bp, Homo sapiens
aatgtttaaatc

SEQ ID NO: 5549626 - DNA, 16 bp, Homo sapiens
aatgtttaaatcatgt

SEQ ID NO: 5549627 - DNA, 22 bp, Homo sapiens
aatgtttaaatcatgtatgtta

SEQ ID NO: 5549628 - DNA, 20 bp, Homo sapiens
aatgtttaagcagaattgga

SEQ ID NO: 5549629 - DNA, 20 bp, Homo sapiens
aatgtttaatagaaaattaa

SEQ ID NO: 5549630 - DNA, 18 bp, Homo sapiens
aatgtttaatcatataaa

SEQ ID NO: 5549631 - DNA, 22 bp, Homo sapiens
aatgtttacagggagcctcctg

SEQ ID NO: 5549632 - DNA, 21 bp, Homo sapiens
aatgtttacatcatcagatga

SEQ ID NO: 5549633 - DNA, 15 bp, Homo sapiens
aatgtttacattttc

SEQ ID NO: 5549634 - DNA, 20 bp, Homo sapiens
aatgtttacattttctttca

SEQ ID NO: 5549635 - DNA, 22 bp, Homo sapiens
aatgtttacattttctttcata

SEQ ID NO: 5549636 - DNA, 13 bp, Homo sapiens
aatgtttactata

SEQ ID NO: 5549637 - DNA, 13 bp, Homo sapiens
aatgtttactgta

SEQ ID NO: 5549638 - DNA, 15 bp, Homo sapiens
aatgtttactgtaaa

SEQ ID NO: 5549639 - DNA, 17 bp, Homo sapiens
aatgtttactgtaaatt

SEQ ID NO: 5549640 - DNA, 14 bp, Homo sapiens
aatgtttactgtat

SEQ ID NO: 5549641 - DNA, 16 bp, Homo sapiens
aatgtttatacagagt

SEQ ID NO: 5549642 - DNA, 14 bp, Homo sapiens
aatgtttatactgt

SEQ ID NO: 5549643 - DNA, 23 bp, Homo sapiens
aatgtttatactgtatttctaag

SEQ ID NO: 5549644 - DNA, 18 bp, Homo sapiens
aatgtttatgagccagac

SEQ ID NO: 5549645 - DNA, 22 bp, Homo sapiens
aatgtttatgagccagacaaat

SEQ ID NO: 5549646 - DNA, 20 bp, Homo sapiens
aatgtttatggaaatattaa

SEQ ID NO: 5549647 - DNA, 20 bp, Homo sapiens
aatgtttattatttacatca

SEQ ID NO: 5549648 - DNA, 23 bp, Homo sapiens
aatgtttattatttacatcactt

SEQ ID NO: 5549649 - DNA, 20 bp, Homo sapiens
aatgtttattgggcaataaa

SEQ ID NO: 5549650 - DNA, 21 bp, Homo sapiens
aatgtttattgggcaataaaa

SEQ ID NO: 5549651 - DNA, 22 bp, Homo sapiens
aatgtttatttagctctgaagc

SEQ ID NO: 5549652 - DNA, 18 bp, Homo sapiens
aatgtttatttttgctct

SEQ ID NO: 5549653 - DNA, 10 bp, Homo sapiens
aatgtttcaa

SEQ ID NO: 5549654 - DNA, 23 bp, Homo sapiens
aatgtttcaaacatatataacaa

SEQ ID NO: 5549655 - DNA, 15 bp, Homo sapiens
aatgtttcaaatgca

SEQ ID NO: 5549656 - DNA, 15 bp, Homo sapiens
aatgtttcatttgca

SEQ ID NO: 5549657 - DNA, 15 bp, Homo sapiens
aatgtttcattttca

SEQ ID NO: 5549658 - DNA, 13 bp, Homo sapiens
aatgtttccaggc

SEQ ID NO: 5549659 - DNA, 21 bp, Homo sapiens
aatgtttccaggcatgaccct

SEQ ID NO: 5549660 - DNA, 23 bp, Homo sapiens
aatgtttccaggcatgaccctgg

SEQ ID NO: 5549661 - DNA, 10 bp, Homo sapiens
aatgtttcct

SEQ ID NO: 5549662 - DNA, 23 bp, Homo sapiens
aatgtttcctccaaatctgattt

SEQ ID NO: 5549663 - DNA, 20 bp, Homo sapiens
aatgtttcctgtggaaatat

SEQ ID NO: 5549664 - DNA, 23 bp, Homo sapiens
aatgtttcctgtggaaatatgca

SEQ ID NO: 5549665 - DNA, 12 bp, Homo sapiens
aatgtttccttt

SEQ ID NO: 5549666 - DNA, 13 bp, Homo sapiens
aatgtttccttta

SEQ ID NO: 5549667 - DNA, 13 bp, Homo sapiens
aatgtttctattt

SEQ ID NO: 5549668 - DNA, 18 bp, Homo sapiens
aatgtttctatttccata

SEQ ID NO: 5549669 - DNA, 19 bp, Homo sapiens
aatgtttctatttccataa

SEQ ID NO: 5549670 - DNA, 15 bp, Homo sapiens
aatgtttctgcagta

SEQ ID NO: 5549671 - DNA, 13 bp, Homo sapiens
aatgtttctggac

SEQ ID NO: 5549672 - DNA, 19 bp, Homo sapiens
aatgtttctggacattctc

SEQ ID NO: 5549673 - DNA, 23 bp, Homo sapiens
aatgtttcttctaggttctaaaa

SEQ ID NO: 5549674 - DNA, 13 bp, Homo sapiens
aatgtttcttttc

SEQ ID NO: 5549675 - DNA, 17 bp, Homo sapiens
aatgtttcttttccctt

SEQ ID NO: 5549676 - DNA, 18 bp, Homo sapiens
aatgtttcttttccctta

SEQ ID NO: 5549677 - DNA, 18 bp, Homo sapiens
aatgtttgaaaacaaaaa

SEQ ID NO: 5549678 - DNA, 12 bp, Homo sapiens
aatgtttgagca

SEQ ID NO: 5549679 - DNA, 13 bp, Homo sapiens
aatgtttgcatat

SEQ ID NO: 5549680 - DNA, 22 bp, Homo sapiens
aatgtttgccctgttcaaagta

SEQ ID NO: 5549681 - DNA, 16 bp, Homo sapiens
aatgtttgcctctgcc

SEQ ID NO: 5549682 - DNA, 15 bp, Homo sapiens
aatgtttggaattta

SEQ ID NO: 5549683 - DNA, 21 bp, Homo sapiens
aatgtttggattctcttagct

SEQ ID NO: 5549684 - DNA, 18 bp, Homo sapiens
aatgtttgggcagaaggg

SEQ ID NO: 5549685 - DNA, 14 bp, Homo sapiens
aatgtttggtttca

SEQ ID NO: 5549686 - DNA, 20 bp, Homo sapiens
aatgtttgtcagtaaatact

SEQ ID NO: 5549687 - DNA, 13 bp, Homo sapiens
aatgtttgtcatt

SEQ ID NO: 5549688 - DNA, 18 bp, Homo sapiens
aatgtttgtctcatccca

SEQ ID NO: 5549689 - DNA, 13 bp, Homo sapiens
aatgtttgtgaga

SEQ ID NO: 5549690 - DNA, 22 bp, Homo sapiens
aatgtttgtgatattaaatttc

SEQ ID NO: 5549691 - DNA, 15 bp, Homo sapiens
aatgtttgtgtctgt

SEQ ID NO: 5549692 - DNA, 21 bp, Homo sapiens
aatgtttgttatttacactgg

SEQ ID NO: 5549693 - DNA, 23 bp, Homo sapiens
aatgttttaaagaagtccatgtg

SEQ ID NO: 5549694 - DNA, 13 bp, Homo sapiens
aatgttttaaagt

SEQ ID NO: 5549695 - DNA, 15 bp, Homo sapiens
aatgttttaaatgta

SEQ ID NO: 5549696 - DNA, 16 bp, Homo sapiens
aatgttttaaatgtac

SEQ ID NO: 5549697 - DNA, 19 bp, Homo sapiens
aatgttttaaatgtacaga

SEQ ID NO: 5549698 - DNA, 13 bp, Homo sapiens
aatgttttaaatt

SEQ ID NO: 5549699 - DNA, 15 bp, Homo sapiens
aatgttttaaattct

SEQ ID NO: 5549700 - DNA, 20 bp, Homo sapiens
aatgttttactgtgaaactg

SEQ ID NO: 5549701 - DNA, 17 bp, Homo sapiens
aatgttttccaatattt

SEQ ID NO: 5549702 - DNA, 10 bp, Homo sapiens
aatgttttcg

SEQ ID NO: 5549703 - DNA, 10 bp, Homo sapiens
aatgttttct

SEQ ID NO: 5549704 - DNA, 16 bp, Homo sapiens
aatgttttctttgcaa

SEQ ID NO: 5549705 - DNA, 22 bp, Homo sapiens
aatgttttgccagccacttacc

SEQ ID NO: 5549706 - DNA, 15 bp, Homo sapiens
aatgttttgtaaact

SEQ ID NO: 5549707 - DNA, 21 bp, Homo sapiens
aatgttttgtaaactttgaaa

SEQ ID NO: 5549708 - DNA, 12 bp, Homo sapiens
aatgttttgtac

SEQ ID NO: 5549709 - DNA, 13 bp, Homo sapiens
aatgttttgtaca

SEQ ID NO: 5549710 - DNA, 18 bp, Homo sapiens
aatgttttgtatatacag

SEQ ID NO: 5549711 - DNA, 19 bp, Homo sapiens
aatgttttgtatatacagt

SEQ ID NO: 5549712 - DNA, 20 bp, Homo sapiens
aatgttttgtatatacagtt

SEQ ID NO: 5549713 - DNA, 21 bp, Homo sapiens
aatgttttgtatatacagtta

SEQ ID NO: 5549714 - DNA, 22 bp, Homo sapiens
aatgttttgtatatacagttat

SEQ ID NO: 5549715 - DNA, 11 bp, Homo sapiens
aatgtttttaa

SEQ ID NO: 5549716 - DNA, 22 bp, Homo sapiens
aatgtttttaaaaagagtaatt

SEQ ID NO: 5549717 - DNA, 16 bp, Homo sapiens
aatgtttttaaatata

SEQ ID NO: 5549718 - DNA, 22 bp, Homo sapiens
aatgtttttaagatgatcatct

SEQ ID NO: 5549719 - DNA, 14 bp, Homo sapiens
aatgtttttatttc

SEQ ID NO: 5549720 - DNA, 17 bp, Homo sapiens
aatgtttttatttcaat

SEQ ID NO: 5549721 - DNA, 15 bp, Homo sapiens
aatgtttttctaaag

SEQ ID NO: 5549722 - DNA, 13 bp, Homo sapiens
aatgtttttctat

SEQ ID NO: 5549723 - DNA, 18 bp, Homo sapiens
aatgtttttgatttatca

SEQ ID NO: 5549724 - DNA, 19 bp, Homo sapiens
aatgttttttatacttcaa

SEQ ID NO: 5549725 - DNA, 22 bp, Homo sapiens
aatgttttttatacttcaaatg

SEQ ID NO: 5549726 - DNA, 14 bp, Homo sapiens
aatgtttttttccc

SEQ ID NO: 5549727 - DNA, 16 bp, Homo sapiens
aattaaaaaaaaattg

SEQ ID NO: 5549728 - DNA, 17 bp, Homo sapiens
aattaaaaaaaaattgt

SEQ ID NO: 5549729 - DNA, 18 bp, Homo sapiens
aattaaaaaaaaattgta

SEQ ID NO: 5549730 - DNA, 15 bp, Homo sapiens
aattaaaaaagataa

SEQ ID NO: 5549731 - DNA, 17 bp, Homo sapiens
aattaaaaaagataaac

SEQ ID NO: 5549732 - DNA, 17 bp, Homo sapiens
aattaaaaaatgaaatt

SEQ ID NO: 5549733 - DNA, 22 bp, Homo sapiens
aattaaaaaatgaaattaaaaa

SEQ ID NO: 5549734 - DNA, 18 bp, Homo sapiens
aattaaaaacgaaaacct

SEQ ID NO: 5549735 - DNA, 14 bp, Homo sapiens
aattaaaaactgtg

SEQ ID NO: 5549736 - DNA, 21 bp, Homo sapiens
aattaaaaagattctttttct

SEQ ID NO: 5549737 - DNA, 20 bp, Homo sapiens
aattaaaaaggaaagaaaac

SEQ ID NO: 5549738 - DNA, 22 bp, Homo sapiens
aattaaaaagggccagaaaaat

SEQ ID NO: 5549739 - DNA, 14 bp, Homo sapiens
aattaaaaatgaaa

SEQ ID NO: 5549740 - DNA, 11 bp, Homo sapiens
aattaaaacaa

SEQ ID NO: 5549741 - DNA, 17 bp, Homo sapiens
aattaaaacaaaatcct

SEQ ID NO: 5549742 - DNA, 21 bp, Homo sapiens
aattaaaacaaatatacattt

SEQ ID NO: 5549743 - DNA, 20 bp, Homo sapiens
aattaaaacaatgtcaaggt

SEQ ID NO: 5549744 - DNA, 13 bp, Homo sapiens
aattaaaacactt

SEQ ID NO: 5549745 - DNA, 14 bp, Homo sapiens
aattaaaacacttt

SEQ ID NO: 5549746 - DNA, 16 bp, Homo sapiens
aattaaaacagctgca

SEQ ID NO: 5549747 - DNA, 21 bp, Homo sapiens
aattaaaacatatttcatttt

SEQ ID NO: 5549748 - DNA, 21 bp, Homo sapiens
aattaaaacgaaaataaagta

SEQ ID NO: 5549749 - DNA, 16 bp, Homo sapiens
aattaaaactcaacat

SEQ ID NO: 5549750 - DNA, 12 bp, Homo sapiens
aattaaaactga

SEQ ID NO: 5549751 - DNA, 21 bp, Homo sapiens
aattaaaactgagtccatgaa

SEQ ID NO: 5549752 - DNA, 22 bp, Homo sapiens
aattaaaactgagtccatgaaa

SEQ ID NO: 5549753 - DNA, 20 bp, Homo sapiens
aattaaaacttcttaaatat

SEQ ID NO: 5549754 - DNA, 16 bp, Homo sapiens
aattaaaagcaaatca

SEQ ID NO: 5549755 - DNA, 18 bp, Homo sapiens
aattaaaagcaaatcatt

SEQ ID NO: 5549756 - DNA, 11 bp, Homo sapiens
aattaaaatat

SEQ ID NO: 5549757 - DNA, 15 bp, Homo sapiens
aattaaaatatatat

SEQ ID NO: 5549758 - DNA, 16 bp, Homo sapiens
aattaaaatatatata

SEQ ID NO: 5549759 - DNA, 21 bp, Homo sapiens
aattaaaatattatttgatat

SEQ ID NO: 5549760 - DNA, 17 bp, Homo sapiens
aattaaaatctggaaat

SEQ ID NO: 5549761 - DNA, 16 bp, Homo sapiens
aattaaaatgtgcagt

SEQ ID NO: 5549762 - DNA, 15 bp, Homo sapiens
aattaaaattgtgca

SEQ ID NO: 5549763 - DNA, 17 bp, Homo sapiens
aattaaaattgtgcata

SEQ ID NO: 5549764 - DNA, 18 bp, Homo sapiens
aattaaaattgtgcataa

SEQ ID NO: 5549765 - DNA, 14 bp, Homo sapiens
aattataaggactg

SEQ ID NO: 5549766 - DNA, 17 bp, Homo sapiens
aattataagggccctgc

SEQ ID NO: 5549767 - DNA, 22 bp, Homo sapiens
aattataagggccctgccctgt

SEQ ID NO: 5549768 - DNA, 12 bp, Homo sapiens
aattataataaa

SEQ ID NO: 5549769 - DNA, 16 bp, Homo sapiens
aattataatctcattt

SEQ ID NO: 5549770 - DNA, 15 bp, Homo sapiens
aattataatgcaaat

SEQ ID NO: 5549771 - DNA, 12 bp, Homo sapiens
aattataatgta

SEQ ID NO: 5549772 - DNA, 16 bp, Homo sapiens
aattataatgtattca

SEQ ID NO: 5549773 - DNA, 18 bp, Homo sapiens
aattataatgtattcata

SEQ ID NO: 5549774 - DNA, 19 bp, Homo sapiens
aattataccccctgcaaag

SEQ ID NO: 5549775 - DNA, 20 bp, Homo sapiens
aattatagaaacaatactgt

SEQ ID NO: 5549776 - DNA, 21 bp, Homo sapiens
aattatagaaacaatactgtt

SEQ ID NO: 5549777 - DNA, 18 bp, Homo sapiens
aattatagacctctagta

SEQ ID NO: 5549778 - DNA, 20 bp, Homo sapiens
aattatagctctaatgtttg

SEQ ID NO: 5549779 - DNA, 13 bp, Homo sapiens
aattatagctttt

SEQ ID NO: 5549780 - DNA, 17 bp, Homo sapiens
aattataggaagttctt

SEQ ID NO: 5549781 - DNA, 18 bp, Homo sapiens
aattataggagacttgta

SEQ ID NO: 5549782 - DNA, 16 bp, Homo sapiens
aattatataaatcatt

SEQ ID NO: 5549783 - DNA, 21 bp, Homo sapiens
aattatataactgtatttgaa

SEQ ID NO: 5549784 - DNA, 13 bp, Homo sapiens
aattatatagcaa

SEQ ID NO: 5549785 - DNA, 17 bp, Homo sapiens
aattatatagcaaagat

SEQ ID NO: 5549786 - DNA, 21 bp, Homo sapiens
aattatataggttgtgcaaat

SEQ ID NO: 5549787 - DNA, 19 bp, Homo sapiens
aattatatattgcaaggtg

SEQ ID NO: 5549788 - DNA, 16 bp, Homo sapiens
aattatatctaattta

SEQ ID NO: 5549789 - DNA, 21 bp, Homo sapiens
aattatatctaatttatacaa

SEQ ID NO: 5549790 - DNA, 12 bp, Homo sapiens
aattatatctgt

SEQ ID NO: 5549791 - DNA, 18 bp, Homo sapiens
aattatatgaagcagaat

SEQ ID NO: 5549792 - DNA, 19 bp, Homo sapiens
aattatatgctatttctat

SEQ ID NO: 5549793 - DNA, 20 bp, Homo sapiens
aattatatgctatttctata

SEQ ID NO: 5549794 - DNA, 20 bp, Homo sapiens
aattatatgtatattgtcta

SEQ ID NO: 5549795 - DNA, 16 bp, Homo sapiens
aattatattcaatgca

SEQ ID NO: 5549796 - DNA, 11 bp, Homo sapiens
aattatattcc

SEQ ID NO: 5549797 - DNA, 23 bp, Homo sapiens
aattatattcctcttgcatttca

SEQ ID NO: 5549798 - DNA, 13 bp, Homo sapiens
aattatattgtta

SEQ ID NO: 5549799 - DNA, 23 bp, Homo sapiens
aattatattttgttgctttctta

SEQ ID NO: 5549800 - DNA, 22 bp, Homo sapiens
aattatcaaaaaacagaaaaac

SEQ ID NO: 5549801 - DNA, 16 bp, Homo sapiens
aattatcaagctaata

SEQ ID NO: 5549802 - DNA, 17 bp, Homo sapiens
aattatcagtcatgagg

SEQ ID NO: 5549803 - DNA, 21 bp, Homo sapiens
aattatcatcaatctttatgt

SEQ ID NO: 5549804 - DNA, 20 bp, Homo sapiens
aattatccatggtaaaaact

SEQ ID NO: 5549805 - DNA, 12 bp, Homo sapiens
aattatccatta

SEQ ID NO: 5549806 - DNA, 20 bp, Homo sapiens
aattatccattacgtgcatt

SEQ ID NO: 5549807 - DNA, 14 bp, Homo sapiens
aattatcctatttc

SEQ ID NO: 5549808 - DNA, 16 bp, Homo sapiens
aattatcctatttcag

SEQ ID NO: 5549809 - DNA, 17 bp, Homo sapiens
aattatcctatttcagt

SEQ ID NO: 5549810 - DNA, 22 bp, Homo sapiens
aattatcctcaagttgtgtgct

SEQ ID NO: 5549811 - DNA, 15 bp, Homo sapiens
aattatcggaagcag

SEQ ID NO: 5549812 - DNA, 20 bp, Homo sapiens
aattatcggaagcagtgcct

SEQ ID NO: 5549813 - DNA, 20 bp, Homo sapiens
aattatcgggaacagtgttt

SEQ ID NO: 5549814 - DNA, 14 bp, Homo sapiens
aattatctaattta

SEQ ID NO: 5549815 - DNA, 15 bp, Homo sapiens
aattatctaatttat

SEQ ID NO: 5549816 - DNA, 21 bp, Homo sapiens
aattatctagtagttgtagaa

SEQ ID NO: 5549817 - DNA, 22 bp, Homo sapiens
aattatctatagctaagtacac

SEQ ID NO: 5549818 - DNA, 19 bp, Homo sapiens
aattatctatccttgatga

SEQ ID NO: 5549819 - DNA, 13 bp, Homo sapiens
aattatctatttg

SEQ ID NO: 5549820 - DNA, 22 bp, Homo sapiens
aattatctcaagtaaaacaaat

SEQ ID NO: 5549821 - DNA, 15 bp, Homo sapiens
aattatctcctaatt

SEQ ID NO: 5549822 - DNA, 19 bp, Homo sapiens
aattatctgaatattagat

SEQ ID NO: 5549823 - DNA, 19 bp, Homo sapiens
aattatctgattaagcatt

SEQ ID NO: 5549824 - DNA, 19 bp, Homo sapiens
aattatctgccttatacat

SEQ ID NO: 5549825 - DNA, 15 bp, Homo sapiens
aattatctgttctat

SEQ ID NO: 5549826 - DNA, 16 bp, Homo sapiens
aattatctgttctatg

SEQ ID NO: 5549827 - DNA, 19 bp, Homo sapiens
aattatctgttctatggac

SEQ ID NO: 5549828 - DNA, 23 bp, Homo sapiens
aattatcttagtctatagaaatg

SEQ ID NO: 5549829 - DNA, 17 bp, Homo sapiens
aattatcttatgaaaac

SEQ ID NO: 5549830 - DNA, 17 bp, Homo sapiens
aattatcttgatacatt

SEQ ID NO: 5549831 - DNA, 21 bp, Homo sapiens
aattatcttgatacattcaaa

SEQ ID NO: 5549832 - DNA, 19 bp, Homo sapiens
aattatctttagttgaatt

SEQ ID NO: 5549833 - DNA, 16 bp, Homo sapiens
aattatcttttcaaag

SEQ ID NO: 5549834 - DNA, 17 bp, Homo sapiens
aattatcttttcaaagg

SEQ ID NO: 5549835 - DNA, 18 bp, Homo sapiens
aattatcttttcaaaggt

SEQ ID NO: 5549836 - DNA, 13 bp, Homo sapiens
aattatgaaaata

SEQ ID NO: 5549837 - DNA, 12 bp, Homo sapiens
aattatgacagt

SEQ ID NO: 5549838 - DNA, 15 bp, Homo sapiens
aattatgacagttat

SEQ ID NO: 5549839 - DNA, 22 bp, Homo sapiens
aattatgagatgatgaaaataa

SEQ ID NO: 5549840 - DNA, 14 bp, Homo sapiens
aattatgagatttt

SEQ ID NO: 5549841 - DNA, 22 bp, Homo sapiens
aattatgagctatcctttcaaa

SEQ ID NO: 5549842 - DNA, 20 bp, Homo sapiens
aattatgagtttttcaatta

SEQ ID NO: 5549843 - DNA, 19 bp, Homo sapiens
aattatgcactaaatatga

SEQ ID NO: 5549844 - DNA, 13 bp, Homo sapiens
aattatgcactgg

SEQ ID NO: 5549845 - DNA, 14 bp, Homo sapiens
aattatgcactggc

SEQ ID NO: 5549846 - DNA, 19 bp, Homo sapiens
aattatgctaacaaactga

SEQ ID NO: 5549847 - DNA, 16 bp, Homo sapiens
aattatgctaagaatt

SEQ ID NO: 5549848 - DNA, 18 bp, Homo sapiens
aattatggaaatatagtt

SEQ ID NO: 5549849 - DNA, 13 bp, Homo sapiens
aattatggaatat

SEQ ID NO: 5549850 - DNA, 15 bp, Homo sapiens
aattatggaatatca

SEQ ID NO: 5549851 - DNA, 16 bp, Homo sapiens
aattatggcatttcta

SEQ ID NO: 5549852 - DNA, 17 bp, Homo sapiens
aattatggcatttctat

SEQ ID NO: 5549853 - DNA, 17 bp, Homo sapiens
aattatgggaacaagtg

SEQ ID NO: 5549854 - DNA, 18 bp, Homo sapiens
aattatggtaaaattttg

SEQ ID NO: 5549855 - DNA, 22 bp, Homo sapiens
aattatggtctggggtaaaatt

SEQ ID NO: 5549856 - DNA, 16 bp, Homo sapiens
aattatgtaaataact

SEQ ID NO: 5549857 - DNA, 15 bp, Homo sapiens
aattatgtaatgcaa

SEQ ID NO: 5549858 - DNA, 22 bp, Homo sapiens
aattatgtagctctttgtcagg

SEQ ID NO: 5549859 - DNA, 12 bp, Homo sapiens
aattatgtataa

SEQ ID NO: 5549860 - DNA, 13 bp, Homo sapiens
aattatgtataaa

SEQ ID NO: 5549861 - DNA, 15 bp, Homo sapiens
aattatgtataaaca

SEQ ID NO: 5549862 - DNA, 15 bp, Homo sapiens
aattatgtctcttga

SEQ ID NO: 5549863 - DNA, 20 bp, Homo sapiens
aattatgtctcttgagcatc

SEQ ID NO: 5549864 - DNA, 22 bp, Homo sapiens
aattatgtctgctgaataataa

SEQ ID NO: 5549865 - DNA, 13 bp, Homo sapiens
aattatgtgacaa

SEQ ID NO: 5549866 - DNA, 21 bp, Homo sapiens
aattatgtgacaacctttgtg

SEQ ID NO: 5549867 - DNA, 22 bp, Homo sapiens
aattatgtgacaacctttgtgt

SEQ ID NO: 5549868 - DNA, 23 bp, Homo sapiens
aattatgtgacaacctttgtgta

SEQ ID NO: 5549869 - DNA, 15 bp, Homo sapiens
aattatgtgacattt

SEQ ID NO: 5549870 - DNA, 17 bp, Homo sapiens
aattatgtgacatttta

SEQ ID NO: 5549871 - DNA, 12 bp, Homo sapiens
aattatgtgcaa

SEQ ID NO: 5549872 - DNA, 23 bp, Homo sapiens
aattatgtgtagttataaaccaa

SEQ ID NO: 5549873 - DNA, 13 bp, Homo sapiens
aattatgttaaac

SEQ ID NO: 5549874 - DNA, 23 bp, Homo sapiens
aattatgttactgtatttttcag

SEQ ID NO: 5549875 - DNA, 14 bp, Homo sapiens
aattatgttattga

SEQ ID NO: 5549876 - DNA, 18 bp, Homo sapiens
aattatgttattgaaaaa

SEQ ID NO: 5549877 - DNA, 20 bp, Homo sapiens
aattatgttggtactttcca

SEQ ID NO: 5549878 - DNA, 18 bp, Homo sapiens
aattatgttggtgtgaat

SEQ ID NO: 5549879 - DNA, 21 bp, Homo sapiens
aattatgtttatataaatgct

SEQ ID NO: 5549880 - DNA, 22 bp, Homo sapiens
aattatgtttgccactttgcaa

SEQ ID NO: 5549881 - DNA, 23 bp, Homo sapiens
aattatgtttttcagtttaattc

SEQ ID NO: 5549882 - DNA, 18 bp, Homo sapiens
aattattaaaaattatag

SEQ ID NO: 5549883 - DNA, 18 bp, Homo sapiens
aattattaactacattta

SEQ ID NO: 5549884 - DNA, 17 bp, Homo sapiens
aattattaagctgtttg

SEQ ID NO: 5549885 - DNA, 22 bp, Homo sapiens
aattattaatgaaaataagaat

SEQ ID NO: 5549886 - DNA, 15 bp, Homo sapiens
aattattaatgaatg

SEQ ID NO: 5549887 - DNA, 16 bp, Homo sapiens
aattattaatgaatgc

SEQ ID NO: 5549888 - DNA, 14 bp, Homo sapiens
aattattaattgtc

SEQ ID NO: 5549889 - DNA, 17 bp, Homo sapiens
aattattaattgtcctg

SEQ ID NO: 5549890 - DNA, 19 bp, Homo sapiens
aattattaattgtcctgtg

SEQ ID NO: 5549891 - DNA, 21 bp, Homo sapiens
aattattacactgtaagaaat

SEQ ID NO: 5549892 - DNA, 16 bp, Homo sapiens
aattattacatcttta

SEQ ID NO: 5549893 - DNA, 15 bp, Homo sapiens
aattattactttaaa

SEQ ID NO: 5549894 - DNA, 16 bp, Homo sapiens
aattattactttaaat

SEQ ID NO: 5549895 - DNA, 21 bp, Homo sapiens
aattattagcatttgttttag

SEQ ID NO: 5549896 - DNA, 22 bp, Homo sapiens
aattattataaaaatattaaga

SEQ ID NO: 5549897 - DNA, 12 bp, Homo sapiens
aattattatata

SEQ ID NO: 5549898 - DNA, 16 bp, Homo sapiens
aattattatatattta

SEQ ID NO: 5549899 - DNA, 11 bp, Homo sapiens
aattattattt

SEQ ID NO: 5549900 - DNA, 17 bp, Homo sapiens
aattattatttaactct

SEQ ID NO: 5549901 - DNA, 18 bp, Homo sapiens
aattattatttatatatg

SEQ ID NO: 5549902 - DNA, 15 bp, Homo sapiens
aattattattttaaa

SEQ ID NO: 5549903 - DNA, 18 bp, Homo sapiens
aattattattttaaaata

SEQ ID NO: 5549904 - DNA, 23 bp, Homo sapiens
aattattattttaaaatatatga

SEQ ID NO: 5549905 - DNA, 13 bp, Homo sapiens
aattattcaaaga

SEQ ID NO: 5549906 - DNA, 13 bp, Homo sapiens
aattattcatgct

SEQ ID NO: 5549907 - DNA, 20 bp, Homo sapiens
aattattccctgaattgttt

SEQ ID NO: 5549908 - DNA, 23 bp, Homo sapiens
aattattcctttcctagactaat

SEQ ID NO: 5549909 - DNA, 22 bp, Homo sapiens
aattattctagtcaactgctgt

SEQ ID NO: 5549910 - DNA, 13 bp, Homo sapiens
aattattgacact

SEQ ID NO: 5549911 - DNA, 16 bp, Homo sapiens
aattattgacactgaa

SEQ ID NO: 5549912 - DNA, 17 bp, Homo sapiens
aattattgacactgaac

SEQ ID NO: 5549913 - DNA, 14 bp, Homo sapiens
aattattgatatat

SEQ ID NO: 5549914 - DNA, 15 bp, Homo sapiens
aattattgatatata

SEQ ID NO: 5549915 - DNA, 16 bp, Homo sapiens
aattattgatatatat

SEQ ID NO: 5549916 - DNA, 18 bp, Homo sapiens
aattattgatatatatta

SEQ ID NO: 5549917 - DNA, 16 bp, Homo sapiens
aattattgatgaaaat

SEQ ID NO: 5549918 - DNA, 19 bp, Homo sapiens
aattattgatgattttgta

SEQ ID NO: 5549919 - DNA, 12 bp, Homo sapiens
aattattggtaa

SEQ ID NO: 5549920 - DNA, 16 bp, Homo sapiens
aattattggtatattt

SEQ ID NO: 5549921 - DNA, 22 bp, Homo sapiens
aattattggtatatttgtagat

SEQ ID NO: 5549922 - DNA, 21 bp, Homo sapiens
aattattggttggtgtgaaga

SEQ ID NO: 5549923 - DNA, 13 bp, Homo sapiens
aattattgtaaac

SEQ ID NO: 5549924 - DNA, 14 bp, Homo sapiens
aattattgtaaact

SEQ ID NO: 5549925 - DNA, 13 bp, Homo sapiens
aattattgtaatg

SEQ ID NO: 5549926 - DNA, 13 bp, Homo sapiens
aattattgtgatt

SEQ ID NO: 5549927 - DNA, 22 bp, Homo sapiens
aattattgtttatattttcaat

SEQ ID NO: 5549928 - DNA, 17 bp, Homo sapiens
aattatttaaagaaagt

SEQ ID NO: 5549929 - DNA, 19 bp, Homo sapiens
aattatttaaataaaatca

SEQ ID NO: 5549930 - DNA, 14 bp, Homo sapiens
aattatttaaatgt

SEQ ID NO: 5549931 - DNA, 14 bp, Homo sapiens
aattatttaataaa

SEQ ID NO: 5549932 - DNA, 16 bp, Homo sapiens
aattatttaattgtcc

SEQ ID NO: 5549933 - DNA, 21 bp, Homo sapiens
aattatttattaaatgcccag

SEQ ID NO: 5549934 - DNA, 15 bp, Homo sapiens
aattatttattactt

SEQ ID NO: 5549935 - DNA, 19 bp, Homo sapiens
aattatttgaagatttaat

SEQ ID NO: 5549936 - DNA, 12 bp, Homo sapiens
aattatttgcat

SEQ ID NO: 5549937 - DNA, 21 bp, Homo sapiens
aattatttgcatattttgaga

SEQ ID NO: 5549938 - DNA, 16 bp, Homo sapiens
aattatttgcctttta

SEQ ID NO: 5549939 - DNA, 14 bp, Homo sapiens
aattatttgtgtaa

SEQ ID NO: 5549940 - DNA, 15 bp, Homo sapiens
aattatttgtgtaat

SEQ ID NO: 5549941 - DNA, 12 bp, Homo sapiens
aattattttaaa

SEQ ID NO: 5549942 - DNA, 21 bp, Homo sapiens
aattattttaaaatatttaaa

SEQ ID NO: 5549943 - DNA, 12 bp, Homo sapiens
aattctgtttta

SEQ ID NO: 5549944 - DNA, 21 bp, Homo sapiens
aattctgttttaggttaaaaa

SEQ ID NO: 5549945 - DNA, 21 bp, Homo sapiens
aattctgtttttaatgctatt

SEQ ID NO: 5549946 - DNA, 14 bp, Homo sapiens
aattctgtttttct

SEQ ID NO: 5549947 - DNA, 19 bp, Homo sapiens
aattcttaagtcttttgtc

SEQ ID NO: 5549948 - DNA, 22 bp, Homo sapiens
aattcttacactgcctgtatac

SEQ ID NO: 5549949 - DNA, 15 bp, Homo sapiens
aattcttacatgttt

SEQ ID NO: 5549950 - DNA, 18 bp, Homo sapiens
aattcttaccgaaatgaa

SEQ ID NO: 5549951 - DNA, 20 bp, Homo sapiens
aattcttaccgaaatgaaaa

SEQ ID NO: 5549952 - DNA, 15 bp, Homo sapiens
aattcttacctcatt

SEQ ID NO: 5549953 - DNA, 21 bp, Homo sapiens
aattcttacctcatttgcatc

SEQ ID NO: 5549954 - DNA, 15 bp, Homo sapiens
aattcttactctgga

SEQ ID NO: 5549955 - DNA, 15 bp, Homo sapiens
aattcttactgttct

SEQ ID NO: 5549956 - DNA, 19 bp, Homo sapiens
aattcttactgttctgaaa

SEQ ID NO: 5549957 - DNA, 23 bp, Homo sapiens
aattcttagatctggtgtccagc

SEQ ID NO: 5549958 - DNA, 22 bp, Homo sapiens
aattcttagcatacattcagac

SEQ ID NO: 5549959 - DNA, 19 bp, Homo sapiens
aattcttatgccatataat

SEQ ID NO: 5549960 - DNA, 18 bp, Homo sapiens
aattcttattccatatta

SEQ ID NO: 5549961 - DNA, 17 bp, Homo sapiens
aattcttatttcccctt

SEQ ID NO: 5549962 - DNA, 14 bp, Homo sapiens
aattcttatttctg

SEQ ID NO: 5549963 - DNA, 18 bp, Homo sapiens
aattcttatttctgtgtt

SEQ ID NO: 5549964 - DNA, 19 bp, Homo sapiens
aattcttattttagaaatt

SEQ ID NO: 5549965 - DNA, 22 bp, Homo sapiens
aattcttattttataattttaa

SEQ ID NO: 5549966 - DNA, 23 bp, Homo sapiens
aattcttattttataattttaaa

SEQ ID NO: 5549967 - DNA, 17 bp, Homo sapiens
aattcttattttgtgga

SEQ ID NO: 5549968 - DNA, 21 bp, Homo sapiens
aattcttatttttaatttttc

SEQ ID NO: 5549969 - DNA, 19 bp, Homo sapiens
aattcttattttttaaaaa

SEQ ID NO: 5549970 - DNA, 12 bp, Homo sapiens
aattcttcaaca

SEQ ID NO: 5549971 - DNA, 21 bp, Homo sapiens
aattcttcaacagggaaaaca

SEQ ID NO: 5549972 - DNA, 17 bp, Homo sapiens
aattcttcacatgttta

SEQ ID NO: 5549973 - DNA, 22 bp, Homo sapiens
aattcttcacctaagtctctgt

SEQ ID NO: 5549974 - DNA, 17 bp, Homo sapiens
aattcttcacctttgta

SEQ ID NO: 5549975 - DNA, 11 bp, Homo sapiens
aattcttcagt

SEQ ID NO: 5549976 - DNA, 13 bp, Homo sapiens
aattcttcattat

SEQ ID NO: 5549977 - DNA, 15 bp, Homo sapiens
aattcttccctgggg

SEQ ID NO: 5549978 - DNA, 16 bp, Homo sapiens
aattcttccctggggg

SEQ ID NO: 5549979 - DNA, 15 bp, Homo sapiens
aattcttcctcctct

SEQ ID NO: 5549980 - DNA, 16 bp, Homo sapiens
aattcttcctcctctg

SEQ ID NO: 5549981 - DNA, 15 bp, Homo sapiens
aattcttccttccct

SEQ ID NO: 5549982 - DNA, 13 bp, Homo sapiens
aattcttctgaac

SEQ ID NO: 5549983 - DNA, 15 bp, Homo sapiens
aattcttctgaactc

SEQ ID NO: 5549984 - DNA, 22 bp, Homo sapiens
aattcttctgcaacatttgaca

SEQ ID NO: 5549985 - DNA, 20 bp, Homo sapiens
aattcttctgttctctggtt

SEQ ID NO: 5549986 - DNA, 21 bp, Homo sapiens
aattcttctgttctctggttt

SEQ ID NO: 5549987 - DNA, 13 bp, Homo sapiens
aattcttgaagtt

SEQ ID NO: 5549988 - DNA, 13 bp, Homo sapiens
aattcttgcactg

SEQ ID NO: 5549989 - DNA, 14 bp, Homo sapiens
aattcttgcactgt

SEQ ID NO: 5549990 - DNA, 15 bp, Homo sapiens
aattcttgcactgta

SEQ ID NO: 5549991 - DNA, 13 bp, Homo sapiens
aattcttgcatat

SEQ ID NO: 5549992 - DNA, 17 bp, Homo sapiens
aattcttgcatattttg

SEQ ID NO: 5549993 - DNA, 14 bp, Homo sapiens
aattcttgcttgag

SEQ ID NO: 5549994 - DNA, 19 bp, Homo sapiens
aattcttggttgaggaaac

SEQ ID NO: 5549995 - DNA, 15 bp, Homo sapiens
aattcttgtaacttt

SEQ ID NO: 5549996 - DNA, 15 bp, Homo sapiens
aattcttgtatatta

SEQ ID NO: 5549997 - DNA, 22 bp, Homo sapiens
aattctttaaaattacaactaa

SEQ ID NO: 5549998 - DNA, 16 bp, Homo sapiens
aattctttagattttt

SEQ ID NO: 5549999 - DNA, 17 bp, Homo sapiens
aattctttagattttta

SEQ ID NO: 5550000 - DNA, 15 bp, Homo sapiens
aattctttagtactc

SEQ ID NO: 5550001 - DNA, 14 bp, Homo sapiens
aattctttatacaa

SEQ ID NO: 5550002 - DNA, 21 bp, Homo sapiens
aattctttatacaacagtgct

SEQ ID NO: 5550003 - DNA, 17 bp, Homo sapiens
aattctttatcacatgt

SEQ ID NO: 5550004 - DNA, 20 bp, Homo sapiens
aattctttatttctgtcatt

SEQ ID NO: 5550005 - DNA, 12 bp, Homo sapiens
aattctttcaac

SEQ ID NO: 5550006 - DNA, 22 bp, Homo sapiens
aattctttcacttgatgtttgt

SEQ ID NO: 5550007 - DNA, 20 bp, Homo sapiens
aattctttctattttcacaa

SEQ ID NO: 5550008 - DNA, 12 bp, Homo sapiens
aattctttctgt

SEQ ID NO: 5550009 - DNA, 16 bp, Homo sapiens
aattctttctgtctcc

SEQ ID NO: 5550010 - DNA, 23 bp, Homo sapiens
aattctttctgtctcccttctct

SEQ ID NO: 5550011 - DNA, 12 bp, Homo sapiens
aattctttcttt

SEQ ID NO: 5550012 - DNA, 19 bp, Homo sapiens
aattctttctttttccttc

SEQ ID NO: 5550013 - DNA, 18 bp, Homo sapiens
aattctttgacctgttgg

SEQ ID NO: 5550014 - DNA, 18 bp, Homo sapiens
aattctttgcaaaaatcc

SEQ ID NO: 5550015 - DNA, 17 bp, Homo sapiens
aattctttgtttatgca

SEQ ID NO: 5550016 - DNA, 14 bp, Homo sapiens
aattctttgtttcc

SEQ ID NO: 5550017 - DNA, 16 bp, Homo sapiens
aattcttttataaata

SEQ ID NO: 5550018 - DNA, 13 bp, Homo sapiens
aattcttttcaaa

SEQ ID NO: 5550019 - DNA, 16 bp, Homo sapiens
aattcttttgaaagat

SEQ ID NO: 5550020 - DNA, 13 bp, Homo sapiens
aattcttttgcca

SEQ ID NO: 5550021 - DNA, 18 bp, Homo sapiens
aattcttttttattaatc

SEQ ID NO: 5550022 - DNA, 23 bp, Homo sapiens
aattcttttttattaatcactgt

SEQ ID NO: 5550023 - DNA, 23 bp, Homo sapiens
aattctttttttattattattta

SEQ ID NO: 5550024 - DNA, 13 bp, Homo sapiens
aattgaaaaaaat

SEQ ID NO: 5550025 - DNA, 14 bp, Homo sapiens
aattgaaaacacac

SEQ ID NO: 5550026 - DNA, 14 bp, Homo sapiens
aattgaaaacacta

SEQ ID NO: 5550027 - DNA, 18 bp, Homo sapiens
aattgaaaaggaacttgc

SEQ ID NO: 5550028 - DNA, 14 bp, Homo sapiens
aattgaaaaggact

SEQ ID NO: 5550029 - DNA, 15 bp, Homo sapiens
aattgaaactagtta

SEQ ID NO: 5550030 - DNA, 18 bp, Homo sapiens
aattgaaactctctgttc

SEQ ID NO: 5550031 - DNA, 16 bp, Homo sapiens
aattgaaactgagtat

SEQ ID NO: 5550032 - DNA, 22 bp, Homo sapiens
aattgaaaggaaatgtttgagt

SEQ ID NO: 5550033 - DNA, 21 bp, Homo sapiens
aattgaaaggcattctctgaa

SEQ ID NO: 5550034 - DNA, 17 bp, Homo sapiens
aattgaaagtattcaga

SEQ ID NO: 5550035 - DNA, 22 bp, Homo sapiens
aattgaaagtgggcaaaagctt

SEQ ID NO: 5550036 - DNA, 14 bp, Homo sapiens
aattgaaataaata

SEQ ID NO: 5550037 - DNA, 22 bp, Homo sapiens
aattgaaataaataaaaatgca

SEQ ID NO: 5550038 - DNA, 16 bp, Homo sapiens
aattgaaatacctatt

SEQ ID NO: 5550039 - DNA, 20 bp, Homo sapiens
aattgaaatgggaacaatat

SEQ ID NO: 5550040 - DNA, 13 bp, Homo sapiens
aattgaaatgtaa

SEQ ID NO: 5550041 - DNA, 16 bp, Homo sapiens
aattgaaatgtaaggc

SEQ ID NO: 5550042 - DNA, 23 bp, Homo sapiens
aattgaaatttaaaaataaagct

SEQ ID NO: 5550043 - DNA, 20 bp, Homo sapiens
aattgaaatttttaaatcat

SEQ ID NO: 5550044 - DNA, 21 bp, Homo sapiens
aattgaacaataaagtttgct

SEQ ID NO: 5550045 - DNA, 22 bp, Homo sapiens
aattgaacaataaagtttgctt

SEQ ID NO: 5550046 - DNA, 16 bp, Homo sapiens
aattgaacatgcaatt

SEQ ID NO: 5550047 - DNA, 19 bp, Homo sapiens
aattgaaccgtcaatgtga

SEQ ID NO: 5550048 - DNA, 20 bp, Homo sapiens
aattgaaccgtcaatgtgaa

SEQ ID NO: 5550049 - DNA, 12 bp, Homo sapiens
aattgaaccttt

SEQ ID NO: 5550050 - DNA, 23 bp, Homo sapiens
aattgaacctttgtgccctatca

SEQ ID NO: 5550051 - DNA, 14 bp, Homo sapiens
aattgaagaaaatc

SEQ ID NO: 5550052 - DNA, 19 bp, Homo sapiens
aattgaagaactgcacttt

SEQ ID NO: 5550053 - DNA, 21 bp, Homo sapiens
aattgaagaagcctcacacgt

SEQ ID NO: 5550054 - DNA, 17 bp, Homo sapiens
aattgaagagagatata

SEQ ID NO: 5550055 - DNA, 16 bp, Homo sapiens
aattgaagataggaga

SEQ ID NO: 5550056 - DNA, 23 bp, Homo sapiens
aattgaagatgtaaggaattgaa

SEQ ID NO: 5550057 - DNA, 13 bp, Homo sapiens
aattgaagctttt

SEQ ID NO: 5550058 - DNA, 12 bp, Homo sapiens
aattgaaggaaa

SEQ ID NO: 5550059 - DNA, 13 bp, Homo sapiens
aattgaaggaaag

SEQ ID NO: 5550060 - DNA, 14 bp, Homo sapiens
aattgaaggaaaga

SEQ ID NO: 5550061 - DNA, 16 bp, Homo sapiens
aattgaaggaaagatt

SEQ ID NO: 5550062 - DNA, 17 bp, Homo sapiens
aattgaaggagaaaatg

SEQ ID NO: 5550063 - DNA, 20 bp, Homo sapiens
aattgaagtcatcataaaag

SEQ ID NO: 5550064 - DNA, 17 bp, Homo sapiens
aattgaagtgtataata

SEQ ID NO: 5550065 - DNA, 22 bp, Homo sapiens
aattgaagtgtataatataaaa

SEQ ID NO: 5550066 - DNA, 19 bp, Homo sapiens
aattgaatactttgaatgt

SEQ ID NO: 5550067 - DNA, 21 bp, Homo sapiens
aattgaatactttgaatgtgt

SEQ ID NO: 5550068 - DNA, 15 bp, Homo sapiens
aattgaatcactgct

SEQ ID NO: 5550069 - DNA, 22 bp, Homo sapiens
aattgaatgtaccttatttaaa

SEQ ID NO: 5550070 - DNA, 14 bp, Homo sapiens
aattgaattaataa

SEQ ID NO: 5550071 - DNA, 13 bp, Homo sapiens
aattgaatttaac

SEQ ID NO: 5550072 - DNA, 12 bp, Homo sapiens
aattgacaaaaa

SEQ ID NO: 5550073 - DNA, 15 bp, Homo sapiens
aattgacaacccaaa

SEQ ID NO: 5550074 - DNA, 22 bp, Homo sapiens
aattgacaagctaggaaagagg

SEQ ID NO: 5550075 - DNA, 23 bp, Homo sapiens
aattgacagatcaagctgtgaga

SEQ ID NO: 5550076 - DNA, 17 bp, Homo sapiens
aattgacagggaaaata

SEQ ID NO: 5550077 - DNA, 22 bp, Homo sapiens
aattgacaggggaacttggttt

SEQ ID NO: 5550078 - DNA, 18 bp, Homo sapiens
aattgacattctctattg

SEQ ID NO: 5550079 - DNA, 14 bp, Homo sapiens
aattgacattgctt

SEQ ID NO: 5550080 - DNA, 13 bp, Homo sapiens
aattgacccacaa

SEQ ID NO: 5550081 - DNA, 21 bp, Homo sapiens
aattgaccctagccagagaat

SEQ ID NO: 5550082 - DNA, 17 bp, Homo sapiens
aattgacctcaaaagaa

SEQ ID NO: 5550083 - DNA, 20 bp, Homo sapiens
aattgacctgatttccattt

SEQ ID NO: 5550084 - DNA, 17 bp, Homo sapiens
aattgaccttgaccatt

SEQ ID NO: 5550085 - DNA, 20 bp, Homo sapiens
aattgactcttatttataga

SEQ ID NO: 5550086 - DNA, 21 bp, Homo sapiens
aattgactcttatttatagaa

SEQ ID NO: 5550087 - DNA, 21 bp, Homo sapiens
aattgactgaaattactttaa

SEQ ID NO: 5550088 - DNA, 17 bp, Homo sapiens
aattgactgaagcacag

SEQ ID NO: 5550089 - DNA, 15 bp, Homo sapiens
aattgactgcagttg

SEQ ID NO: 5550090 - DNA, 22 bp, Homo sapiens
aattgacttcagcaggggtggg

SEQ ID NO: 5550091 - DNA, 13 bp, Homo sapiens
aattgacttcctc

SEQ ID NO: 5550092 - DNA, 14 bp, Homo sapiens
aattgacttcctcc

SEQ ID NO: 5550093 - DNA, 12 bp, Homo sapiens
aattgagaaaag

SEQ ID NO: 5550094 - DNA, 15 bp, Homo sapiens
aattgagaagggaaa

SEQ ID NO: 5550095 - DNA, 15 bp, Homo sapiens
aattgagagatgttt

SEQ ID NO: 5550096 - DNA, 15 bp, Homo sapiens
aattgagcagttcat

SEQ ID NO: 5550097 - DNA, 24 bp, Homo sapiens
aattgagcctgtgcctggctagaa

SEQ ID NO: 5550098 - DNA, 24 bp, Homo sapiens
aattgagctaggggggtcagccag

SEQ ID NO: 5550099 - DNA, 21 bp, Homo sapiens
aattgagcttacaattaggaa

SEQ ID NO: 5550100 - DNA, 21 bp, Homo sapiens
aattgaggagagggactgaat

SEQ ID NO: 5550101 - DNA, 22 bp, Homo sapiens
aattgaggagagggactgaata

SEQ ID NO: 5550102 - DNA, 18 bp, Homo sapiens
aattgagggcccgggacg

SEQ ID NO: 5550103 - DNA, 22 bp, Homo sapiens
aattgaggtttggaagagtgaa

SEQ ID NO: 5550104 - DNA, 16 bp, Homo sapiens
aattgagtatcacttt

SEQ ID NO: 5550105 - DNA, 23 bp, Homo sapiens
aattgagtctcttttttattctg

SEQ ID NO: 5550106 - DNA, 20 bp, Homo sapiens
aattgagttaaatcagtaat

SEQ ID NO: 5550107 - DNA, 21 bp, Homo sapiens
aattgagtttaacaataataa

SEQ ID NO: 5550108 - DNA, 22 bp, Homo sapiens
aattgagtttaacaataataaa

SEQ ID NO: 5550109 - DNA, 14 bp, Homo sapiens
aattgagtttcaga

SEQ ID NO: 5550110 - DNA, 22 bp, Homo sapiens
aattgataataaactgtcctct

SEQ ID NO: 5550111 - DNA, 18 bp, Homo sapiens
aattgatacctgttcctt

SEQ ID NO: 5550112 - DNA, 23 bp, Homo sapiens
aattgatagcaggtgtaataaga

SEQ ID NO: 5550113 - DNA, 14 bp, Homo sapiens
aattgatattatat

SEQ ID NO: 5550114 - DNA, 15 bp, Homo sapiens
aattgatattatatt

SEQ ID NO: 5550115 - DNA, 21 bp, Homo sapiens
aattgatattatattaaacat

SEQ ID NO: 5550116 - DNA, 14 bp, Homo sapiens
aattgatattttta

SEQ ID NO: 5550117 - DNA, 13 bp, Homo sapiens
aattgatcattca

SEQ ID NO: 5550118 - DNA, 15 bp, Homo sapiens
aattgatcctttgat

SEQ ID NO: 5550119 - DNA, 17 bp, Homo sapiens
aattgatcgacttgcca

SEQ ID NO: 5550120 - DNA, 15 bp, Homo sapiens
aattggggattctta

SEQ ID NO: 5550121 - DNA, 13 bp, Homo sapiens
aattggggcactt

SEQ ID NO: 5550122 - DNA, 17 bp, Homo sapiens
aattgggtgaagagctt

SEQ ID NO: 5550123 - DNA, 17 bp, Homo sapiens
aattgggtgtgccctgg

SEQ ID NO: 5550124 - DNA, 18 bp, Homo sapiens
aattgggtgtgccctggc

SEQ ID NO: 5550125 - DNA, 16 bp, Homo sapiens
aattgggttcatgatg

SEQ ID NO: 5550126 - DNA, 19 bp, Homo sapiens
aattgggttcatgatgcag

SEQ ID NO: 5550127 - DNA, 14 bp, Homo sapiens
aattgggttttgat

SEQ ID NO: 5550128 - DNA, 23 bp, Homo sapiens
aattggtaaaaacagcagctcat

SEQ ID NO: 5550129 - DNA, 23 bp, Homo sapiens
aattggtaaggcctctggactgg

SEQ ID NO: 5550130 - DNA, 16 bp, Homo sapiens
aattggtaattgaatg

SEQ ID NO: 5550131 - DNA, 23 bp, Homo sapiens
aattggtgggaagcaagcagggg

SEQ ID NO: 5550132 - DNA, 12 bp, Homo sapiens
aattggtgtata

SEQ ID NO: 5550133 - DNA, 16 bp, Homo sapiens
aattggtgtatatcat

SEQ ID NO: 5550134 - DNA, 16 bp, Homo sapiens
aattggtgtcattttc

SEQ ID NO: 5550135 - DNA, 21 bp, Homo sapiens
aattggtgtcattttcttgat

SEQ ID NO: 5550136 - DNA, 16 bp, Homo sapiens
aattggttaatcactt

SEQ ID NO: 5550137 - DNA, 20 bp, Homo sapiens
aattggttatcatgggaaag

SEQ ID NO: 5550138 - DNA, 18 bp, Homo sapiens
aattggttgtatataaag

SEQ ID NO: 5550139 - DNA, 14 bp, Homo sapiens
aattggttgtttaa

SEQ ID NO: 5550140 - DNA, 23 bp, Homo sapiens
aattggttgtttaacacttctgt

SEQ ID NO: 5550141 - DNA, 13 bp, Homo sapiens
aattggtttaaac

SEQ ID NO: 5550142 - DNA, 22 bp, Homo sapiens
aattggtttaaacttttatgcg

SEQ ID NO: 5550143 - DNA, 11 bp, Homo sapiens
aattgtaaaag

SEQ ID NO: 5550144 - DNA, 20 bp, Homo sapiens
aattgtaaacagaaattgca

SEQ ID NO: 5550145 - DNA, 13 bp, Homo sapiens
aattgtaaactgt

SEQ ID NO: 5550146 - DNA, 17 bp, Homo sapiens
aattgtaaactgtacta

SEQ ID NO: 5550147 - DNA, 20 bp, Homo sapiens
aattgtaaatcctgtgtttc

SEQ ID NO: 5550148 - DNA, 17 bp, Homo sapiens
aattgtaaattgaatca

SEQ ID NO: 5550149 - DNA, 13 bp, Homo sapiens
aattgtaacctgc

SEQ ID NO: 5550150 - DNA, 14 bp, Homo sapiens
aattgtaagccaga

SEQ ID NO: 5550151 - DNA, 15 bp, Homo sapiens
aattgtaagccagag

SEQ ID NO: 5550152 - DNA, 20 bp, Homo sapiens
aattgtaagccagagtcaac

SEQ ID NO: 5550153 - DNA, 16 bp, Homo sapiens
aattgtaaggaatgat

SEQ ID NO: 5550154 - DNA, 19 bp, Homo sapiens
aattgtaagtgaaattaag

SEQ ID NO: 5550155 - DNA, 14 bp, Homo sapiens
aattgtaatggatt

SEQ ID NO: 5550156 - DNA, 15 bp, Homo sapiens
aattgtaattatatc

SEQ ID NO: 5550157 - DNA, 16 bp, Homo sapiens
aattgtaattatatct

SEQ ID NO: 5550158 - DNA, 17 bp, Homo sapiens
aattgtaattatatctg

SEQ ID NO: 5550159 - DNA, 18 bp, Homo sapiens
aattgtacaaaaaagtta

SEQ ID NO: 5550160 - DNA, 18 bp, Homo sapiens
aattgtacaaaattaagc

SEQ ID NO: 5550161 - DNA, 15 bp, Homo sapiens
aattgtacatatttg

SEQ ID NO: 5550162 - DNA, 17 bp, Homo sapiens
aattgtacctatttctg

SEQ ID NO: 5550163 - DNA, 18 bp, Homo sapiens
aattgtacctatttctga

SEQ ID NO: 5550164 - DNA, 22 bp, Homo sapiens
aattgtaccttttttgtttttt

SEQ ID NO: 5550165 - DNA, 16 bp, Homo sapiens
aattgtactaaagcca

SEQ ID NO: 5550166 - DNA, 13 bp, Homo sapiens
aattgtactttga

SEQ ID NO: 5550167 - DNA, 16 bp, Homo sapiens
aattgtagatggaaat

SEQ ID NO: 5550168 - DNA, 18 bp, Homo sapiens
aattgtagatggaaatca

SEQ ID NO: 5550169 - DNA, 18 bp, Homo sapiens
aattgtaggggtgtgtgt

SEQ ID NO: 5550170 - DNA, 13 bp, Homo sapiens
aattgtataacag

SEQ ID NO: 5550171 - DNA, 12 bp, Homo sapiens
aattgtataagt

SEQ ID NO: 5550172 - DNA, 14 bp, Homo sapiens
aattgtataagtca

SEQ ID NO: 5550173 - DNA, 16 bp, Homo sapiens
aattgtataagtcaag

SEQ ID NO: 5550174 - DNA, 18 bp, Homo sapiens
aattgtataagtcaagca

SEQ ID NO: 5550175 - DNA, 19 bp, Homo sapiens
aattgtataccaatgtgtt

SEQ ID NO: 5550176 - DNA, 12 bp, Homo sapiens
aattgtatatat

SEQ ID NO: 5550177 - DNA, 21 bp, Homo sapiens
aattgtatatatatgtgaact

SEQ ID NO: 5550178 - DNA, 13 bp, Homo sapiens
aattgtatattca

SEQ ID NO: 5550179 - DNA, 16 bp, Homo sapiens
aattgtatattcactt

SEQ ID NO: 5550180 - DNA, 17 bp, Homo sapiens
aattgtatattcacttt

SEQ ID NO: 5550181 - DNA, 17 bp, Homo sapiens
aattgtatcaatttgtt

SEQ ID NO: 5550182 - DNA, 22 bp, Homo sapiens
aattgtatcagaggcctataat

SEQ ID NO: 5550183 - DNA, 18 bp, Homo sapiens
aattgtatcatttgaaca

SEQ ID NO: 5550184 - DNA, 19 bp, Homo sapiens
aattgtatcgtatagctgt

SEQ ID NO: 5550185 - DNA, 19 bp, Homo sapiens
aattgtatctacattaaaa

SEQ ID NO: 5550186 - DNA, 22 bp, Homo sapiens
aattgtatctacattaaaatga

SEQ ID NO: 5550187 - DNA, 20 bp, Homo sapiens
aattgtatctagtgcagctg

SEQ ID NO: 5550188 - DNA, 23 bp, Homo sapiens
aattgtatctagtgcagctgatt

SEQ ID NO: 5550189 - DNA, 22 bp, Homo sapiens
aattgtatctcatactgtctgg

SEQ ID NO: 5550190 - DNA, 15 bp, Homo sapiens
aattgtattctcata

SEQ ID NO: 5550191 - DNA, 16 bp, Homo sapiens
aattgtattgaaaaca

SEQ ID NO: 5550192 - DNA, 15 bp, Homo sapiens
aattgtatttagtga

SEQ ID NO: 5550193 - DNA, 15 bp, Homo sapiens
aattgtatttatgta

SEQ ID NO: 5550194 - DNA, 13 bp, Homo sapiens
aattgtattttat

SEQ ID NO: 5550195 - DNA, 18 bp, Homo sapiens
aattgtattttatatgag

SEQ ID NO: 5550196 - DNA, 12 bp, Homo sapiens
aattgtattttt

SEQ ID NO: 5550197 - DNA, 17 bp, Homo sapiens
aattgtatttttgtatg

SEQ ID NO: 5550198 - DNA, 23 bp, Homo sapiens
aattgtattttttgttgaaagta

SEQ ID NO: 5550199 - DNA, 23 bp, Homo sapiens
aattgtcacctctgttaaggttg

SEQ ID NO: 5550200 - DNA, 20 bp, Homo sapiens
aattgtcagatcgttcattg

SEQ ID NO: 5550201 - DNA, 17 bp, Homo sapiens
aattgtcagcatgacaa

SEQ ID NO: 5550202 - DNA, 13 bp, Homo sapiens
aattgtcatgact

SEQ ID NO: 5550203 - DNA, 14 bp, Homo sapiens
aattgtcatgactt

SEQ ID NO: 5550204 - DNA, 23 bp, Homo sapiens
aattgtcatggttacaaactaca

SEQ ID NO: 5550205 - DNA, 17 bp, Homo sapiens
aattgtccctgtttcaa

SEQ ID NO: 5550206 - DNA, 18 bp, Homo sapiens
aattgtccctgtttcaaa

SEQ ID NO: 5550207 - DNA, 16 bp, Homo sapiens
aattgtcccttaaaca

SEQ ID NO: 5550208 - DNA, 13 bp, Homo sapiens
aattgtcctgtgt

SEQ ID NO: 5550209 - DNA, 18 bp, Homo sapiens
aattgtcgaaaagagtct

SEQ ID NO: 5550210 - DNA, 13 bp, Homo sapiens
aattgtctattta

SEQ ID NO: 5550211 - DNA, 15 bp, Homo sapiens
aattgtctttaaaaa

SEQ ID NO: 5550212 - DNA, 18 bp, Homo sapiens
aattgtctttaatttctg

SEQ ID NO: 5550213 - DNA, 23 bp, Homo sapiens
aattgtctttattaacaaacagg

SEQ ID NO: 5550214 - DNA, 19 bp, Homo sapiens
aattgtctttggtgctttt

SEQ ID NO: 5550215 - DNA, 19 bp, Homo sapiens
aattgtcttttagacaact

SEQ ID NO: 5550216 - DNA, 18 bp, Homo sapiens
aattgtcttttttttcct

SEQ ID NO: 5550217 - DNA, 19 bp, Homo sapiens
aattgtcttttttttcctt

SEQ ID NO: 5550218 - DNA, 23 bp, Homo sapiens
aattgtgaaagctccatgtttag

SEQ ID NO: 5550219 - DNA, 22 bp, Homo sapiens
aattgtgaagctaatgaccaac

SEQ ID NO: 5550220 - DNA, 21 bp, Homo sapiens
aattgtgaatgttggtgtgaa

SEQ ID NO: 5550221 - DNA, 18 bp, Homo sapiens
aattgtgaattgataata

SEQ ID NO: 5550222 - DNA, 20 bp, Homo sapiens
aattgtgaattgataataaa

SEQ ID NO: 5550223 - DNA, 18 bp, Homo sapiens
aattgtgaccaatacatt

SEQ ID NO: 5550224 - DNA, 20 bp, Homo sapiens
aattgtgaccaatacatttg

SEQ ID NO: 5550225 - DNA, 21 bp, Homo sapiens
aattgtgaccaatacatttgt

SEQ ID NO: 5550226 - DNA, 14 bp, Homo sapiens
aattgtgagggaca

SEQ ID NO: 5550227 - DNA, 15 bp, Homo sapiens
aattgtgatgttttg

SEQ ID NO: 5550228 - DNA, 21 bp, Homo sapiens
aattgtgattagacagaacac

SEQ ID NO: 5550229 - DNA, 15 bp, Homo sapiens
aattgtgcaaaatat

SEQ ID NO: 5550230 - DNA, 17 bp, Homo sapiens
aattgtgcaaaatattg

SEQ ID NO: 5550231 - DNA, 16 bp, Homo sapiens
aattgtgctccaaatg

SEQ ID NO: 5550232 - DNA, 18 bp, Homo sapiens
aattgtgctccaaatgtc

SEQ ID NO: 5550233 - DNA, 12 bp, Homo sapiens
aattgtgctgcc

SEQ ID NO: 5550234 - DNA, 15 bp, Homo sapiens
aattgtgctgccatt

SEQ ID NO: 5550235 - DNA, 13 bp, Homo sapiens
aattgtgcttctc

SEQ ID NO: 5550236 - DNA, 20 bp, Homo sapiens
aattgtgcttctccccagaa

SEQ ID NO: 5550237 - DNA, 21 bp, Homo sapiens
aattgtgcttctccccagaat

SEQ ID NO: 5550238 - DNA, 18 bp, Homo sapiens
aattgtgctttcaccaga

SEQ ID NO: 5550239 - DNA, 22 bp, Homo sapiens
aattgtggaaggattgtaacat

SEQ ID NO: 5550240 - DNA, 11 bp, Homo sapiens
aattgtggatg

SEQ ID NO: 5550241 - DNA, 23 bp, Homo sapiens
aattgtgggcataaactgtttca

SEQ ID NO: 5550242 - DNA, 21 bp, Homo sapiens
aattgtgggtctatttctagt

SEQ ID NO: 5550243 - DNA, 21 bp, Homo sapiens
aattgtggttccctaaagaca

SEQ ID NO: 5550244 - DNA, 15 bp, Homo sapiens
aattgtgtaaaaaat

SEQ ID NO: 5550245 - DNA, 21 bp, Homo sapiens
aattgtgtaaaaaatggaaaa

SEQ ID NO: 5550246 - DNA, 18 bp, Homo sapiens
aattgtgtaactgttctt

SEQ ID NO: 5550247 - DNA, 12 bp, Homo sapiens
aattgtgtacaa

SEQ ID NO: 5550248 - DNA, 13 bp, Homo sapiens
aattgtgtacaaa

SEQ ID NO: 5550249 - DNA, 21 bp, Homo sapiens
aattgtgtacaaagtagagaa

SEQ ID NO: 5550250 - DNA, 22 bp, Homo sapiens
aattgtgtacaaagtagagaag

SEQ ID NO: 5550251 - DNA, 22 bp, Homo sapiens
aattgtgtactcggaaattaaa

SEQ ID NO: 5550252 - DNA, 23 bp, Homo sapiens
aattgtgtagagtgtttgtgagc

SEQ ID NO: 5550253 - DNA, 16 bp, Homo sapiens
aattgtgtagcctttt

SEQ ID NO: 5550254 - DNA, 16 bp, Homo sapiens
aattgtgtatatatct

SEQ ID NO: 5550255 - DNA, 18 bp, Homo sapiens
aattgtgtattgatgcaa

SEQ ID NO: 5550256 - DNA, 16 bp, Homo sapiens
aattgtgtatttaaaa

SEQ ID NO: 5550257 - DNA, 19 bp, Homo sapiens
aattgtgtattttctttgg

SEQ ID NO: 5550258 - DNA, 14 bp, Homo sapiens
aattgtgtctgtgg

SEQ ID NO: 5550259 - DNA, 15 bp, Homo sapiens
aattgtgtgatattt

SEQ ID NO: 5550260 - DNA, 15 bp, Homo sapiens
aattgtgtggattct

SEQ ID NO: 5550261 - DNA, 13 bp, Homo sapiens
aattgtgtggtca

SEQ ID NO: 5550262 - DNA, 23 bp, Homo sapiens
aattgtgtgtctggtaactggaa

SEQ ID NO: 5550263 - DNA, 23 bp, Homo sapiens
aattgtgtgtgatgtgaagccaa

SEQ ID NO: 5550264 - DNA, 17 bp, Homo sapiens
aattgtgtgttaatgtc

SEQ ID NO: 5550265 - DNA, 15 bp, Homo sapiens
aattgtgttcttaaa

SEQ ID NO: 5550266 - DNA, 14 bp, Homo sapiens
aattgtgtttacat

SEQ ID NO: 5550267 - DNA, 17 bp, Homo sapiens
aattgtgtttagatttt

SEQ ID NO: 5550268 - DNA, 20 bp, Homo sapiens
aattgtgtttataattttaa

SEQ ID NO: 5550269 - DNA, 22 bp, Homo sapiens
aattgtgtttattttttaaaaa

SEQ ID NO: 5550270 - DNA, 16 bp, Homo sapiens
aattgttacaagtgtt

SEQ ID NO: 5550271 - DNA, 24 bp, Homo sapiens
aattgttaccactggtaacatgtg

SEQ ID NO: 5550272 - DNA, 15 bp, Homo sapiens
aattgttatacattt

SEQ ID NO: 5550273 - DNA, 16 bp, Homo sapiens
aattgttcaaaaataa

SEQ ID NO: 5550274 - DNA, 13 bp, Homo sapiens
aattgttcctctt

SEQ ID NO: 5550275 - DNA, 19 bp, Homo sapiens
aattgttcctgatgtgcca

SEQ ID NO: 5550276 - DNA, 16 bp, Homo sapiens
aattgttccttgcttt

SEQ ID NO: 5550277 - DNA, 23 bp, Homo sapiens
aattgttccttggagaaatgaaa

SEQ ID NO: 5550278 - DNA, 23 bp, Homo sapiens
aattgttcgtttcatcaggctct

SEQ ID NO: 5550279 - DNA, 13 bp, Homo sapiens
aattgttctcaga

SEQ ID NO: 5550280 - DNA, 20 bp, Homo sapiens
aattgttgaacaggtgtttt

SEQ ID NO: 5550281 - DNA, 20 bp, Homo sapiens
aattgttgacagttctgaag

SEQ ID NO: 5550282 - DNA, 13 bp, Homo sapiens
aattgttgatatt

SEQ ID NO: 5550283 - DNA, 22 bp, Homo sapiens
aattgttgtccggtttacttta

SEQ ID NO: 5550284 - DNA, 16 bp, Homo sapiens
aattgttgttctgtta

SEQ ID NO: 5550285 - DNA, 22 bp, Homo sapiens
aattgttgttctgttaactgaa

SEQ ID NO: 5550286 - DNA, 13 bp, Homo sapiens
aattgttgtttct

SEQ ID NO: 5550287 - DNA, 20 bp, Homo sapiens
aattgttgtttctttctagt

SEQ ID NO: 5550288 - DNA, 19 bp, Homo sapiens
aattgttgtttgtatgtat

SEQ ID NO: 5550289 - DNA, 15 bp, Homo sapiens
aattgtttaagtgtt

SEQ ID NO: 5550290 - DNA, 22 bp, Homo sapiens
aattgtttagattttgtgttta

SEQ ID NO: 5550291 - DNA, 22 bp, Homo sapiens
aattgtttatgtgttatgaaca

SEQ ID NO: 5550292 - DNA, 14 bp, Homo sapiens
aattgtttcagttt

SEQ ID NO: 5550293 - DNA, 16 bp, Homo sapiens
aattgtttccaacttg

SEQ ID NO: 5550294 - DNA, 21 bp, Homo sapiens
aattgtttccaacttgtctgg

SEQ ID NO: 5550295 - DNA, 14 bp, Homo sapiens
aattgtttcttgac

SEQ ID NO: 5550296 - DNA, 17 bp, Homo sapiens
aattgtttggcttcctc

SEQ ID NO: 5550297 - DNA, 15 bp, Homo sapiens
aatttataaaaatta

SEQ ID NO: 5550298 - DNA, 18 bp, Homo sapiens
aatttataaaattagaaa

SEQ ID NO: 5550299 - DNA, 22 bp, Homo sapiens
aatttataaacttttttcttac

SEQ ID NO: 5550300 - DNA, 15 bp, Homo sapiens
aatttataaaggtct

SEQ ID NO: 5550301 - DNA, 15 bp, Homo sapiens
aatttataaagtacc

SEQ ID NO: 5550302 - DNA, 14 bp, Homo sapiens
aatttataacaaat

SEQ ID NO: 5550303 - DNA, 19 bp, Homo sapiens
aatttataacaattgattt

SEQ ID NO: 5550304 - DNA, 22 bp, Homo sapiens
aatttataacagttataaagaa

SEQ ID NO: 5550305 - DNA, 14 bp, Homo sapiens
aatttataagcatt

SEQ ID NO: 5550306 - DNA, 14 bp, Homo sapiens
aatttataatgtat

SEQ ID NO: 5550307 - DNA, 15 bp, Homo sapiens
aatttataatgtatt

SEQ ID NO: 5550308 - DNA, 13 bp, Homo sapiens
aatttataattca

SEQ ID NO: 5550309 - DNA, 12 bp, Homo sapiens
aatttataattt

SEQ ID NO: 5550310 - DNA, 15 bp, Homo sapiens
aatttataattttaa

SEQ ID NO: 5550311 - DNA, 16 bp, Homo sapiens
aatttataattttaag

SEQ ID NO: 5550312 - DNA, 12 bp, Homo sapiens
aatttatacaaa

SEQ ID NO: 5550313 - DNA, 17 bp, Homo sapiens
aatttatacaaagaaac

SEQ ID NO: 5550314 - DNA, 17 bp, Homo sapiens
aatttatacaatatcat

SEQ ID NO: 5550315 - DNA, 19 bp, Homo sapiens
aatttatacaccagcaatt

SEQ ID NO: 5550316 - DNA, 21 bp, Homo sapiens
aatttatacctacctgtgtgg

SEQ ID NO: 5550317 - DNA, 16 bp, Homo sapiens
aatttatagaataatt

SEQ ID NO: 5550318 - DNA, 16 bp, Homo sapiens
aatttatagtttatac

SEQ ID NO: 5550319 - DNA, 17 bp, Homo sapiens
aatttatataaagtatt

SEQ ID NO: 5550320 - DNA, 19 bp, Homo sapiens
aatttatataaagtatttt

SEQ ID NO: 5550321 - DNA, 20 bp, Homo sapiens
aatttatatcaggtgtataa

SEQ ID NO: 5550322 - DNA, 12 bp, Homo sapiens
aatttatatctt

SEQ ID NO: 5550323 - DNA, 13 bp, Homo sapiens
aatttatatcttt

SEQ ID NO: 5550324 - DNA, 13 bp, Homo sapiens
aatttatatgcat

SEQ ID NO: 5550325 - DNA, 18 bp, Homo sapiens
aatttatatgcatgcaca

SEQ ID NO: 5550326 - DNA, 21 bp, Homo sapiens
aatttatattccatttacata

SEQ ID NO: 5550327 - DNA, 23 bp, Homo sapiens
aatttatatttgtctcattttgt

SEQ ID NO: 5550328 - DNA, 23 bp, Homo sapiens
aatttatattttagaaataataa

SEQ ID NO: 5550329 - DNA, 14 bp, Homo sapiens
aatttatcaaagca

SEQ ID NO: 5550330 - DNA, 16 bp, Homo sapiens
aatttatcaaagcata

SEQ ID NO: 5550331 - DNA, 17 bp, Homo sapiens
aatttatccctttacaa

SEQ ID NO: 5550332 - DNA, 22 bp, Homo sapiens
aatttatccctttacaatgtga

SEQ ID NO: 5550333 - DNA, 18 bp, Homo sapiens
aatttatcctataagatg

SEQ ID NO: 5550334 - DNA, 21 bp, Homo sapiens
aatttatcctataagatgaca

SEQ ID NO: 5550335 - DNA, 18 bp, Homo sapiens
aatttatcctgaaatttc

SEQ ID NO: 5550336 - DNA, 24 bp, Homo sapiens
aatttatctctttagttagtgatt

SEQ ID NO: 5550337 - DNA, 14 bp, Homo sapiens
aatttatctgaata

SEQ ID NO: 5550338 - DNA, 15 bp, Homo sapiens
aatttatctgttgtc

SEQ ID NO: 5550339 - DNA, 19 bp, Homo sapiens
aatttatcttgttcaatga

SEQ ID NO: 5550340 - DNA, 16 bp, Homo sapiens
aatttatctttaccaa

SEQ ID NO: 5550341 - DNA, 13 bp, Homo sapiens
aatttatctttga

SEQ ID NO: 5550342 - DNA, 15 bp, Homo sapiens
aatttatgaagcaga

SEQ ID NO: 5550343 - DNA, 21 bp, Homo sapiens
aatttatgaattgaattatct

SEQ ID NO: 5550344 - DNA, 23 bp, Homo sapiens
aatttatgaattgaattatcttg

SEQ ID NO: 5550345 - DNA, 16 bp, Homo sapiens
aatttatgagtttttg

SEQ ID NO: 5550346 - DNA, 19 bp, Homo sapiens
aatttatgagtttttgata

SEQ ID NO: 5550347 - DNA, 19 bp, Homo sapiens
aatttatgcacttataagg

SEQ ID NO: 5550348 - DNA, 22 bp, Homo sapiens
aatttatgccaagaacagaaaa

SEQ ID NO: 5550349 - DNA, 14 bp, Homo sapiens
aatttatgggagaa

SEQ ID NO: 5550350 - DNA, 14 bp, Homo sapiens
aatttatgtaaggt

SEQ ID NO: 5550351 - DNA, 23 bp, Homo sapiens
aatttatgtcattttcagatcct

SEQ ID NO: 5550352 - DNA, 15 bp, Homo sapiens
aatttatgtgaaatg

SEQ ID NO: 5550353 - DNA, 14 bp, Homo sapiens
aatttattaaatgt

SEQ ID NO: 5550354 - DNA, 15 bp, Homo sapiens
aatttattaaattta

SEQ ID NO: 5550355 - DNA, 13 bp, Homo sapiens
aatttattacaaa

SEQ ID NO: 5550356 - DNA, 20 bp, Homo sapiens
aatttattagccctgcattt

SEQ ID NO: 5550357 - DNA, 12 bp, Homo sapiens
aatttattatag

SEQ ID NO: 5550358 - DNA, 13 bp, Homo sapiens
aatttattattaa

SEQ ID NO: 5550359 - DNA, 16 bp, Homo sapiens
aatttattattgaaat

SEQ ID NO: 5550360 - DNA, 18 bp, Homo sapiens
aatttattattgaaattg

SEQ ID NO: 5550361 - DNA, 21 bp, Homo sapiens
aatttattgaggaaaaatatg

SEQ ID NO: 5550362 - DNA, 22 bp, Homo sapiens
aatttattgaggaaaaatatgt

SEQ ID NO: 5550363 - DNA, 22 bp, Homo sapiens
aatttattggcagccaaggaat

SEQ ID NO: 5550364 - DNA, 17 bp, Homo sapiens
aatttattggcttttct

SEQ ID NO: 5550365 - DNA, 20 bp, Homo sapiens
aatttattggcttttctgat

SEQ ID NO: 5550366 - DNA, 23 bp, Homo sapiens
aatttattggcttttctgatcca

SEQ ID NO: 5550367 - DNA, 15 bp, Homo sapiens
aatttattgtctgtc

SEQ ID NO: 5550368 - DNA, 21 bp, Homo sapiens
aatttattgtctttattttta

SEQ ID NO: 5550369 - DNA, 16 bp, Homo sapiens
aatttatttatattcc

SEQ ID NO: 5550370 - DNA, 17 bp, Homo sapiens
aatttatttatgttctc

SEQ ID NO: 5550371 - DNA, 20 bp, Homo sapiens
aatttatttatgttctcaac

SEQ ID NO: 5550372 - DNA, 22 bp, Homo sapiens
aatttatttattaagatggatt

SEQ ID NO: 5550373 - DNA, 23 bp, Homo sapiens
aatttatttcaataaatctttca

SEQ ID NO: 5550374 - DNA, 23 bp, Homo sapiens
aatttatttccaatgtttcaagc

SEQ ID NO: 5550375 - DNA, 22 bp, Homo sapiens
aatttatttccccgagtcctca

SEQ ID NO: 5550376 - DNA, 20 bp, Homo sapiens
aatttatttcttaacctttg

SEQ ID NO: 5550377 - DNA, 13 bp, Homo sapiens
aatttatttgttt

SEQ ID NO: 5550378 - DNA, 19 bp, Homo sapiens
aatttattttaatgtaaat

SEQ ID NO: 5550379 - DNA, 15 bp, Homo sapiens
aatttattttctcaa

SEQ ID NO: 5550380 - DNA, 22 bp, Homo sapiens
aatttattttctcaatctttta

SEQ ID NO: 5550381 - DNA, 13 bp, Homo sapiens
aatttattttctt

SEQ ID NO: 5550382 - DNA, 21 bp, Homo sapiens
aatttattttgctccctctgt

SEQ ID NO: 5550383 - DNA, 22 bp, Homo sapiens
aatttattttgctccctctgtt

SEQ ID NO: 5550384 - DNA, 15 bp, Homo sapiens
aatttattttgctct

SEQ ID NO: 5550385 - DNA, 17 bp, Homo sapiens
aatttattttgtcgaat

SEQ ID NO: 5550386 - DNA, 20 bp, Homo sapiens
aatttatttttaagaaagaa

SEQ ID NO: 5550387 - DNA, 15 bp, Homo sapiens
aatttcaaaaatata

SEQ ID NO: 5550388 - DNA, 17 bp, Homo sapiens
aatttcaaaaatataac

SEQ ID NO: 5550389 - DNA, 19 bp, Homo sapiens
aatttcaaaaatataactt

SEQ ID NO: 5550390 - DNA, 15 bp, Homo sapiens
aatttcaaaagacat

SEQ ID NO: 5550391 - DNA, 16 bp, Homo sapiens
aatttcaaaatacatt

SEQ ID NO: 5550392 - DNA, 22 bp, Homo sapiens
aatttcaaaatacatttgtaag

SEQ ID NO: 5550393 - DNA, 14 bp, Homo sapiens
aatttcaaaatgca

SEQ ID NO: 5550394 - DNA, 16 bp, Homo sapiens
aatttcaaaatgcatg

SEQ ID NO: 5550395 - DNA, 16 bp, Homo sapiens
aatttcaaaatgcttt

SEQ ID NO: 5550396 - DNA, 15 bp, Homo sapiens
aatttcaaaatgtct

SEQ ID NO: 5550397 - DNA, 16 bp, Homo sapiens
aatttcaaaatttaaa

SEQ ID NO: 5550398 - DNA, 18 bp, Homo sapiens
aatttcaaacatttgtca

SEQ ID NO: 5550399 - DNA, 17 bp, Homo sapiens
aatttcaaacttttgaa

SEQ ID NO: 5550400 - DNA, 19 bp, Homo sapiens
aatttcaaacttttgaaag

SEQ ID NO: 5550401 - DNA, 20 bp, Homo sapiens
aatttcaaacttttgaaaga

SEQ ID NO: 5550402 - DNA, 16 bp, Homo sapiens
aatttcaaagtatgtt

SEQ ID NO: 5550403 - DNA, 14 bp, Homo sapiens
aatttcaaatctgt

SEQ ID NO: 5550404 - DNA, 14 bp, Homo sapiens
aatttcaagaatgt

SEQ ID NO: 5550405 - DNA, 11 bp, Homo sapiens
aatttcaaggt

SEQ ID NO: 5550406 - DNA, 14 bp, Homo sapiens
aatttcaaggttct

SEQ ID NO: 5550407 - DNA, 18 bp, Homo sapiens
aatttcaaggttctaacc

SEQ ID NO: 5550408 - DNA, 15 bp, Homo sapiens
aatttcaatttgttc

SEQ ID NO: 5550409 - DNA, 20 bp, Homo sapiens
aatttcaatttttaaatttc

SEQ ID NO: 5550410 - DNA, 17 bp, Homo sapiens
aatttcacaatataaag

SEQ ID NO: 5550411 - DNA, 15 bp, Homo sapiens
aatttcacagataat

SEQ ID NO: 5550412 - DNA, 21 bp, Homo sapiens
aatttcacagataatttactt

SEQ ID NO: 5550413 - DNA, 17 bp, Homo sapiens
aatttcacagatgctgt

SEQ ID NO: 5550414 - DNA, 12 bp, Homo sapiens
aatttcacagtt

SEQ ID NO: 5550415 - DNA, 20 bp, Homo sapiens
aatttcacctgtaaacctga

SEQ ID NO: 5550416 - DNA, 22 bp, Homo sapiens
aatttcacgtcataggaagtta

SEQ ID NO: 5550417 - DNA, 14 bp, Homo sapiens
aatttcactgtctt

SEQ ID NO: 5550418 - DNA, 18 bp, Homo sapiens
aatttcactgtcttttaa

SEQ ID NO: 5550419 - DNA, 21 bp, Homo sapiens
aatttcacttcaggagaaact

SEQ ID NO: 5550420 - DNA, 19 bp, Homo sapiens
aatttcagaaactaagaat

SEQ ID NO: 5550421 - DNA, 21 bp, Homo sapiens
aatttcagcttctatatattg

SEQ ID NO: 5550422 - DNA, 16 bp, Homo sapiens
aatttcaggcattttg

SEQ ID NO: 5550423 - DNA, 16 bp, Homo sapiens
aatttcagggtgcagc

SEQ ID NO: 5550424 - DNA, 19 bp, Homo sapiens
aatttcagtataaagatca

SEQ ID NO: 5550425 - DNA, 14 bp, Homo sapiens
aatttcagtccaga

SEQ ID NO: 5550426 - DNA, 19 bp, Homo sapiens
aatttcagtgtaaagtgtg

SEQ ID NO: 5550427 - DNA, 17 bp, Homo sapiens
aatttcagttctagttg

SEQ ID NO: 5550428 - DNA, 13 bp, Homo sapiens
aatttcataaatt

SEQ ID NO: 5550429 - DNA, 15 bp, Homo sapiens
aatttcataaattgg

SEQ ID NO: 5550430 - DNA, 16 bp, Homo sapiens
aatttcataaattggc

SEQ ID NO: 5550431 - DNA, 19 bp, Homo sapiens
aatttcataaattggctcc

SEQ ID NO: 5550432 - DNA, 20 bp, Homo sapiens
aatttcataaattggctcct

SEQ ID NO: 5550433 - DNA, 18 bp, Homo sapiens
aatttcataattctgaaa

SEQ ID NO: 5550434 - DNA, 20 bp, Homo sapiens
aatttcatagctgtacttct

SEQ ID NO: 5550435 - DNA, 18 bp, Homo sapiens
aatttcatatgctgtata

SEQ ID NO: 5550436 - DNA, 18 bp, Homo sapiens
aatttcatctttccaaat

SEQ ID NO: 5550437 - DNA, 11 bp, Homo sapiens
aatttcatgaa

SEQ ID NO: 5550438 - DNA, 21 bp, Homo sapiens
aatttcattctcttgaaggtg

SEQ ID NO: 5550439 - DNA, 14 bp, Homo sapiens
aatttcattgcact

SEQ ID NO: 5550440 - DNA, 16 bp, Homo sapiens
aatttcattgcacttt

SEQ ID NO: 5550441 - DNA, 22 bp, Homo sapiens
aatttcattgcactttcctttc

SEQ ID NO: 5550442 - DNA, 15 bp, Homo sapiens
aatttcattgtgttg

SEQ ID NO: 5550443 - DNA, 15 bp, Homo sapiens
aatttcatttaaata

SEQ ID NO: 5550444 - DNA, 15 bp, Homo sapiens
aatttcatttatttt

SEQ ID NO: 5550445 - DNA, 20 bp, Homo sapiens
aatttcattttagtatttta

SEQ ID NO: 5550446 - DNA, 21 bp, Homo sapiens
aatttcattttagtattttag

SEQ ID NO: 5550447 - DNA, 18 bp, Homo sapiens
aatttcattttccttcag

SEQ ID NO: 5550448 - DNA, 14 bp, Homo sapiens
aatttccaaaataa

SEQ ID NO: 5550449 - DNA, 22 bp, Homo sapiens
aatttccaaaataatctatatt

SEQ ID NO: 5550450 - DNA, 14 bp, Homo sapiens
aatttccactgtaa

SEQ ID NO: 5550451 - DNA, 15 bp, Homo sapiens
aatttccagtacctt

SEQ ID NO: 5550452 - DNA, 17 bp, Homo sapiens
aatttccagtacctttg

SEQ ID NO: 5550453 - DNA, 23 bp, Homo sapiens
aatttccagtttaagtaattgcc

SEQ ID NO: 5550454 - DNA, 17 bp, Homo sapiens
aatttccatatccttct

SEQ ID NO: 5550455 - DNA, 16 bp, Homo sapiens
aatttccattaaaggt

SEQ ID NO: 5550456 - DNA, 18 bp, Homo sapiens
aatttcccacccccaccc

SEQ ID NO: 5550457 - DNA, 19 bp, Homo sapiens
aatttcccagactagattt

SEQ ID NO: 5550458 - DNA, 15 bp, Homo sapiens
aatttcccaggaccc

SEQ ID NO: 5550459 - DNA, 16 bp, Homo sapiens
aatttcccaggaccct

SEQ ID NO: 5550460 - DNA, 21 bp, Homo sapiens
aatttccccaacagtgtgaag

SEQ ID NO: 5550461 - DNA, 16 bp, Homo sapiens
aatttccctctgatat

SEQ ID NO: 5550462 - DNA, 20 bp, Homo sapiens
aatttccctgggggcatcct

SEQ ID NO: 5550463 - DNA, 20 bp, Homo sapiens
aatttcctcccaattcatgg

SEQ ID NO: 5550464 - DNA, 13 bp, Homo sapiens
aatttcctctatt

SEQ ID NO: 5550465 - DNA, 11 bp, Homo sapiens
aatttcctggc

SEQ ID NO: 5550466 - DNA, 21 bp, Homo sapiens
aatttcctggccctccactcc

SEQ ID NO: 5550467 - DNA, 17 bp, Homo sapiens
aatttcctgggagcttt

SEQ ID NO: 5550468 - DNA, 18 bp, Homo sapiens
aatttcctggtgtgaagg

SEQ ID NO: 5550469 - DNA, 22 bp, Homo sapiens
aatttcctggtgtgaaggtcct

SEQ ID NO: 5550470 - DNA, 11 bp, Homo sapiens
aatttcctgtg

SEQ ID NO: 5550471 - DNA, 13 bp, Homo sapiens
aatttcctgtgag

SEQ ID NO: 5550472 - DNA, 16 bp, Homo sapiens
aatttcctgtgaggat

SEQ ID NO: 5550473 - DNA, 15 bp, Homo sapiens
aatttcctgtttgaa

SEQ ID NO: 5550474 - DNA, 16 bp, Homo sapiens
aatttccttctgttaa

SEQ ID NO: 5550475 - DNA, 19 bp, Homo sapiens
aattttatgaactgcatgt

SEQ ID NO: 5550476 - DNA, 11 bp, Homo sapiens
aattttatgta

SEQ ID NO: 5550477 - DNA, 18 bp, Homo sapiens
aattttatgtcatagaaa

SEQ ID NO: 5550478 - DNA, 22 bp, Homo sapiens
aattttatgtcatagaaatatt

SEQ ID NO: 5550479 - DNA, 11 bp, Homo sapiens
aattttattat

SEQ ID NO: 5550480 - DNA, 15 bp, Homo sapiens
aattttattgaaagc

SEQ ID NO: 5550481 - DNA, 15 bp, Homo sapiens
aattttattgcaaag

SEQ ID NO: 5550482 - DNA, 16 bp, Homo sapiens
aattttattgcaaagt

SEQ ID NO: 5550483 - DNA, 13 bp, Homo sapiens
aattttattgctg

SEQ ID NO: 5550484 - DNA, 17 bp, Homo sapiens
aattttatttagttctt

SEQ ID NO: 5550485 - DNA, 17 bp, Homo sapiens
aattttatttataaact

SEQ ID NO: 5550486 - DNA, 22 bp, Homo sapiens
aattttatttgttctttttctg

SEQ ID NO: 5550487 - DNA, 17 bp, Homo sapiens
aattttattttaaattt

SEQ ID NO: 5550488 - DNA, 20 bp, Homo sapiens
aattttattttgtgctcatt

SEQ ID NO: 5550489 - DNA, 17 bp, Homo sapiens
aattttatttttctgtg

SEQ ID NO: 5550490 - DNA, 18 bp, Homo sapiens
aattttattttttttctg

SEQ ID NO: 5550491 - DNA, 15 bp, Homo sapiens
aattttcaaaagaaa

SEQ ID NO: 5550492 - DNA, 18 bp, Homo sapiens
aattttcaaggccttcag

SEQ ID NO: 5550493 - DNA, 19 bp, Homo sapiens
aattttcaagtaattgtga

SEQ ID NO: 5550494 - DNA, 21 bp, Homo sapiens
aattttcacaaaatgtctcag

SEQ ID NO: 5550495 - DNA, 16 bp, Homo sapiens
aattttcacatgaaca

SEQ ID NO: 5550496 - DNA, 14 bp, Homo sapiens
aattttcacttctg

SEQ ID NO: 5550497 - DNA, 18 bp, Homo sapiens
aattttcacttgcttaaa

SEQ ID NO: 5550498 - DNA, 21 bp, Homo sapiens
aattttcacttttggcaatga

SEQ ID NO: 5550499 - DNA, 18 bp, Homo sapiens
aattttcagatttgcaca

SEQ ID NO: 5550500 - DNA, 20 bp, Homo sapiens
aattttcagatttgcacaaa

SEQ ID NO: 5550501 - DNA, 14 bp, Homo sapiens
aattttcagttcta

SEQ ID NO: 5550502 - DNA, 17 bp, Homo sapiens
aattttcagttctattt

SEQ ID NO: 5550503 - DNA, 21 bp, Homo sapiens
aattttcataataaaaggcat

SEQ ID NO: 5550504 - DNA, 13 bp, Homo sapiens
aattttcatttta

SEQ ID NO: 5550505 - DNA, 16 bp, Homo sapiens
aattttcattttacag

SEQ ID NO: 5550506 - DNA, 19 bp, Homo sapiens
aattttcattttacagtta

SEQ ID NO: 5550507 - DNA, 15 bp, Homo sapiens
aattttccaaccttt

SEQ ID NO: 5550508 - DNA, 16 bp, Homo sapiens
aattttccaacctttg

SEQ ID NO: 5550509 - DNA, 17 bp, Homo sapiens
aattttccaagaacata

SEQ ID NO: 5550510 - DNA, 17 bp, Homo sapiens
aattttccagtataaaa

SEQ ID NO: 5550511 - DNA, 18 bp, Homo sapiens
aattttccattacatgat

SEQ ID NO: 5550512 - DNA, 21 bp, Homo sapiens
aattttcccagtgaataaata

SEQ ID NO: 5550513 - DNA, 19 bp, Homo sapiens
aattttcctctaattaaaa

SEQ ID NO: 5550514 - DNA, 22 bp, Homo sapiens
aattttcctctaattaaaatgt

SEQ ID NO: 5550515 - DNA, 22 bp, Homo sapiens
aattttcctgtcctctttcagc

SEQ ID NO: 5550516 - DNA, 13 bp, Homo sapiens
aattttcctgtgg

SEQ ID NO: 5550517 - DNA, 15 bp, Homo sapiens
aattttccttgaagc

SEQ ID NO: 5550518 - DNA, 16 bp, Homo sapiens
aattttccttgaagcc

SEQ ID NO: 5550519 - DNA, 16 bp, Homo sapiens
aattttcctttgtcat

SEQ ID NO: 5550520 - DNA, 21 bp, Homo sapiens
aattttcctttttcatgtaag

SEQ ID NO: 5550521 - DNA, 17 bp, Homo sapiens
aattttctagaatacta

SEQ ID NO: 5550522 - DNA, 17 bp, Homo sapiens
aattttctagactttct

SEQ ID NO: 5550523 - DNA, 19 bp, Homo sapiens
aattttctatgtgttgtgt

SEQ ID NO: 5550524 - DNA, 23 bp, Homo sapiens
aattttctcaaaagcatttatca

SEQ ID NO: 5550525 - DNA, 14 bp, Homo sapiens
aattttctccagtc

SEQ ID NO: 5550526 - DNA, 18 bp, Homo sapiens
aattttctccctttatgt

SEQ ID NO: 5550527 - DNA, 13 bp, Homo sapiens
aattttctccttg

SEQ ID NO: 5550528 - DNA, 18 bp, Homo sapiens
aattttctctttaggaga

SEQ ID NO: 5550529 - DNA, 18 bp, Homo sapiens
aattttctgcagctgttt

SEQ ID NO: 5550530 - DNA, 18 bp, Homo sapiens
aattttctggcctttcat

SEQ ID NO: 5550531 - DNA, 12 bp, Homo sapiens
aattttctgtaa

SEQ ID NO: 5550532 - DNA, 20 bp, Homo sapiens
aattttctgtggatcatttc

SEQ ID NO: 5550533 - DNA, 20 bp, Homo sapiens
aattttcttacccatatatc

SEQ ID NO: 5550534 - DNA, 14 bp, Homo sapiens
aattttcttcttta

SEQ ID NO: 5550535 - DNA, 13 bp, Homo sapiens
aattttcttgttt

SEQ ID NO: 5550536 - DNA, 20 bp, Homo sapiens
aattttctttcatacattat

SEQ ID NO: 5550537 - DNA, 23 bp, Homo sapiens
aattttctttcatacattatatt

SEQ ID NO: 5550538 - DNA, 22 bp, Homo sapiens
aattttctttttctgaagcctc

SEQ ID NO: 5550539 - DNA, 23 bp, Homo sapiens
aattttctttttgtttcactgga

SEQ ID NO: 5550540 - DNA, 18 bp, Homo sapiens
aattttgaaaactctaat

SEQ ID NO: 5550541 - DNA, 20 bp, Homo sapiens
aattttgaactgtttaacac

SEQ ID NO: 5550542 - DNA, 19 bp, Homo sapiens
aattttgaagtgctgttta

SEQ ID NO: 5550543 - DNA, 14 bp, Homo sapiens
aattttgaatgtac

SEQ ID NO: 5550544 - DNA, 18 bp, Homo sapiens
aattttgaatgtttatgt

SEQ ID NO: 5550545 - DNA, 19 bp, Homo sapiens
aattttgacactatatctg

SEQ ID NO: 5550546 - DNA, 23 bp, Homo sapiens
aattttgacttgaaaaatattca

SEQ ID NO: 5550547 - DNA, 13 bp, Homo sapiens
aattttgagaaaa

SEQ ID NO: 5550548 - DNA, 21 bp, Homo sapiens
aattttgagtacagaattcaa

SEQ ID NO: 5550549 - DNA, 23 bp, Homo sapiens
aattttgagtacagaattcaaca

SEQ ID NO: 5550550 - DNA, 20 bp, Homo sapiens
aattttgatataatctttca

SEQ ID NO: 5550551 - DNA, 13 bp, Homo sapiens
aattttgatatac

SEQ ID NO: 5550552 - DNA, 19 bp, Homo sapiens
aattttgatatacattgtg

SEQ ID NO: 5550553 - DNA, 15 bp, Homo sapiens
aattttgcaaatata

SEQ ID NO: 5550554 - DNA, 16 bp, Homo sapiens
aattttgcaaatataa

SEQ ID NO: 5550555 - DNA, 14 bp, Homo sapiens
aattttgcaaatta

SEQ ID NO: 5550556 - DNA, 16 bp, Homo sapiens
aattttgcaatgtatt

SEQ ID NO: 5550557 - DNA, 12 bp, Homo sapiens
aattttgcattt

SEQ ID NO: 5550558 - DNA, 19 bp, Homo sapiens
aattttgctaccaaagaat

SEQ ID NO: 5550559 - DNA, 17 bp, Homo sapiens
aattttggaaaaatgtc

SEQ ID NO: 5550560 - DNA, 19 bp, Homo sapiens
aattttggaaaaatgtcac

SEQ ID NO: 5550561 - DNA, 20 bp, Homo sapiens
aattttggaaaaatgtcact

SEQ ID NO: 5550562 - DNA, 19 bp, Homo sapiens
aattttggaagaattcatg

SEQ ID NO: 5550563 - DNA, 13 bp, Homo sapiens
aattttggaataa

SEQ ID NO: 5550564 - DNA, 20 bp, Homo sapiens
aattttggaataatttctat

SEQ ID NO: 5550565 - DNA, 18 bp, Homo sapiens
aattttggaatatttgct

SEQ ID NO: 5550566 - DNA, 19 bp, Homo sapiens
aattttggacctaaacatt

SEQ ID NO: 5550567 - DNA, 23 bp, Homo sapiens
aattttgggtattgtaatctgaa

SEQ ID NO: 5550568 - DNA, 20 bp, Homo sapiens
aattttggtcatagcattca

SEQ ID NO: 5550569 - DNA, 19 bp, Homo sapiens
aattttggtccaaattctt

SEQ ID NO: 5550570 - DNA, 19 bp, Homo sapiens
aattttggtgatgtaaaac

SEQ ID NO: 5550571 - DNA, 20 bp, Homo sapiens
aattttggttgtattctttg

SEQ ID NO: 5550572 - DNA, 14 bp, Homo sapiens
aattttggttttct

SEQ ID NO: 5550573 - DNA, 20 bp, Homo sapiens
aattttggttttctactgtt

SEQ ID NO: 5550574 - DNA, 17 bp, Homo sapiens
aattttgtaaaacaatg

SEQ ID NO: 5550575 - DNA, 18 bp, Homo sapiens
aattttgtaaagtttcta

SEQ ID NO: 5550576 - DNA, 15 bp, Homo sapiens
aattttgtaacgaag

SEQ ID NO: 5550577 - DNA, 17 bp, Homo sapiens
aattttgtaagtataag

SEQ ID NO: 5550578 - DNA, 19 bp, Homo sapiens
aattttgtaagtataagaa

SEQ ID NO: 5550579 - DNA, 18 bp, Homo sapiens
aattttgtaatgtatcaa

SEQ ID NO: 5550580 - DNA, 13 bp, Homo sapiens
aattttgtacaaa

SEQ ID NO: 5550581 - DNA, 13 bp, Homo sapiens
aattttgtacata

SEQ ID NO: 5550582 - DNA, 16 bp, Homo sapiens
aattttgtacatactg

SEQ ID NO: 5550583 - DNA, 14 bp, Homo sapiens
aattttgtacattt

SEQ ID NO: 5550584 - DNA, 13 bp, Homo sapiens
aattttgtacgta

SEQ ID NO: 5550585 - DNA, 18 bp, Homo sapiens
aattttgtatccatttaa

SEQ ID NO: 5550586 - DNA, 23 bp, Homo sapiens
aattttgtatccatttaaactaa

SEQ ID NO: 5550587 - DNA, 16 bp, Homo sapiens
aattttgtatgttaaa

SEQ ID NO: 5550588 - DNA, 17 bp, Homo sapiens
aattttgtattttccaa

SEQ ID NO: 5550589 - DNA, 21 bp, Homo sapiens
aattttgtattttccaagtgt

SEQ ID NO: 5550590 - DNA, 17 bp, Homo sapiens
aattttgtctattaaag

SEQ ID NO: 5550591 - DNA, 12 bp, Homo sapiens
aattttgtctca

SEQ ID NO: 5550592 - DNA, 16 bp, Homo sapiens
aattttgtctcacttt

SEQ ID NO: 5550593 - DNA, 22 bp, Homo sapiens
aattttgtctgccccaagtttt

SEQ ID NO: 5550594 - DNA, 12 bp, Homo sapiens
aattttgtctta

SEQ ID NO: 5550595 - DNA, 15 bp, Homo sapiens
aattttgtcttaagt

SEQ ID NO: 5550596 - DNA, 12 bp, Homo sapiens
aattttgtcttt

SEQ ID NO: 5550597 - DNA, 13 bp, Homo sapiens
aattttgtctttc

SEQ ID NO: 5550598 - DNA, 23 bp, Homo sapiens
aattttgtgatgaataaaataat

SEQ ID NO: 5550599 - DNA, 18 bp, Homo sapiens
aattttgtggttttcgag

SEQ ID NO: 5550600 - DNA, 21 bp, Homo sapiens
aattttgttaagaatttcaat

SEQ ID NO: 5550601 - DNA, 14 bp, Homo sapiens
aattttgttctctg

SEQ ID NO: 5550602 - DNA, 13 bp, Homo sapiens
aattttgttgctg

SEQ ID NO: 5550603 - DNA, 13 bp, Homo sapiens
aattttgtttctg

SEQ ID NO: 5550604 - DNA, 18 bp, Homo sapiens
aattttgtttgtaatcct

SEQ ID NO: 5550605 - DNA, 15 bp, Homo sapiens
aattttgttttaaac

SEQ ID NO: 5550606 - DNA, 13 bp, Homo sapiens
aattttgttttac

SEQ ID NO: 5550607 - DNA, 14 bp, Homo sapiens
aattttgttttact

SEQ ID NO: 5550608 - DNA, 16 bp, Homo sapiens
aattttgttttacttt

SEQ ID NO: 5550609 - DNA, 14 bp, Homo sapiens
aattttgtttttat

SEQ ID NO: 5550610 - DNA, 12 bp, Homo sapiens
aatttttaaaaa

SEQ ID NO: 5550611 - DNA, 15 bp, Homo sapiens
aatttttaaaacttt

SEQ ID NO: 5550612 - DNA, 21 bp, Homo sapiens
aatttttaaaataaactgtaa

SEQ ID NO: 5550613 - DNA, 17 bp, Homo sapiens
aatttttaaactagtaa

SEQ ID NO: 5550614 - DNA, 18 bp, Homo sapiens
aatttttaaactagtaat

SEQ ID NO: 5550615 - DNA, 15 bp, Homo sapiens
aatttttaaatttct

SEQ ID NO: 5550616 - DNA, 12 bp, Homo sapiens
aatttttaactg

SEQ ID NO: 5550617 - DNA, 13 bp, Homo sapiens
aatttttaacttt

SEQ ID NO: 5550618 - DNA, 19 bp, Homo sapiens
aatttttaatgacttttta

SEQ ID NO: 5550619 - DNA, 14 bp, Homo sapiens
aatttttacagaat

SEQ ID NO: 5550620 - DNA, 15 bp, Homo sapiens
aatttttacatgacc

SEQ ID NO: 5550621 - DNA, 20 bp, Homo sapiens
aatttttacattcatcaata

SEQ ID NO: 5550622 - DNA, 18 bp, Homo sapiens
aatttttaccacttctgt

SEQ ID NO: 5550623 - DNA, 22 bp, Homo sapiens
aatttttaccatagttttctca

SEQ ID NO: 5550624 - DNA, 13 bp, Homo sapiens
aatttttagaaag

SEQ ID NO: 5550625 - DNA, 18 bp, Homo sapiens
aatttttagccatttctc

SEQ ID NO: 5550626 - DNA, 18 bp, Homo sapiens
aatttttataaatatgtg

SEQ ID NO: 5550627 - DNA, 19 bp, Homo sapiens
aatttttataaatatgtga

SEQ ID NO: 5550628 - DNA, 19 bp, Homo sapiens
aatttttataaattactat

SEQ ID NO: 5550629 - DNA, 16 bp, Homo sapiens
aatttttatacatatc

SEQ ID NO: 5550630 - DNA, 19 bp, Homo sapiens
aatttttatacatatcaga

SEQ ID NO: 5550631 - DNA, 20 bp, Homo sapiens
aatttttatacatatcagaa

SEQ ID NO: 5550632 - DNA, 22 bp, Homo sapiens
aatttttatacatatcagaaaa

SEQ ID NO: 5550633 - DNA, 14 bp, Homo sapiens
aatttttatgtgtg

SEQ ID NO: 5550634 - DNA, 19 bp, Homo sapiens
aatttttattatgcataac

SEQ ID NO: 5550635 - DNA, 15 bp, Homo sapiens
aatttttattcataa

SEQ ID NO: 5550636 - DNA, 14 bp, Homo sapiens
aatttttatttctt

SEQ ID NO: 5550637 - DNA, 16 bp, Homo sapiens
aatttttatttttcta

SEQ ID NO: 5550638 - DNA, 22 bp, Homo sapiens
aatttttatttttgctgagact

SEQ ID NO: 5550639 - DNA, 19 bp, Homo sapiens
aatttttcagcacttaact

SEQ ID NO: 5550640 - DNA, 14 bp, Homo sapiens
aatttttcatattt

SEQ ID NO: 5550641 - DNA, 16 bp, Homo sapiens
aatttttcattctcag

SEQ ID NO: 5550642 - DNA, 14 bp, Homo sapiens
aatttttccaacta

SEQ ID NO: 5550643 - DNA, 13 bp, Homo sapiens
aatttttcctgca

SEQ ID NO: 5550644 - DNA, 17 bp, Homo sapiens
aatttttcctgcatgtt

SEQ ID NO: 5550645 - DNA, 11 bp, Homo sapiens
aatttttcctt

SEQ ID NO: 5550646 - DNA, 14 bp, Homo sapiens
aatttttccttcct

SEQ ID NO: 5550647 - DNA, 20 bp, Homo sapiens
aatttttctcagtttgtata

SEQ ID NO: 5550648 - DNA, 20 bp, Homo sapiens
aatttttctctaactcagaa

SEQ ID NO: 5550649 - DNA, 12 bp, Homo sapiens
aatttttctgca

SEQ ID NO: 5550650 - DNA, 23 bp, Homo sapiens
aatttttctgcactgagcagagt

SEQ ID NO: 5550651 - DNA, 15 bp, Homo sapiens
aatttttcttgcgaa

SEQ ID NO: 5550652 - DNA, 22 bp, Homo sapiens
aatttttcttttcttgattttt

SEQ ID NO: 5550653 - DNA, 15 bp, Homo sapiens
aatttttgaaaaata

SEQ ID NO: 5550654 - DNA, 16 bp, Homo sapiens
acaaaaggcatctgaa

SEQ ID NO: 5550655 - DNA, 17 bp, Homo sapiens
acaaaaggcatctgaac

SEQ ID NO: 5550656 - DNA, 22 bp, Homo sapiens
acaaaaggctttggcaacagaa

SEQ ID NO: 5550657 - DNA, 15 bp, Homo sapiens
acaaaagggagaaca

SEQ ID NO: 5550658 - DNA, 20 bp, Homo sapiens
acaaaagggtgtatagtgtt

SEQ ID NO: 5550659 - DNA, 13 bp, Homo sapiens
acaaaaggtttga

SEQ ID NO: 5550660 - DNA, 19 bp, Homo sapiens
acaaaagtacattgcttaa

SEQ ID NO: 5550661 - DNA, 16 bp, Homo sapiens
acaaaagtaccataga

SEQ ID NO: 5550662 - DNA, 23 bp, Homo sapiens
acaaaagtatattcaaaaattat

SEQ ID NO: 5550663 - DNA, 21 bp, Homo sapiens
acaaaagtctcaatgttccat

SEQ ID NO: 5550664 - DNA, 21 bp, Homo sapiens
acaaaagtctgtctttcctga

SEQ ID NO: 5550665 - DNA, 12 bp, Homo sapiens
acaaaagtgaac

SEQ ID NO: 5550666 - DNA, 20 bp, Homo sapiens
acaaaagtgacagatgttat

SEQ ID NO: 5550667 - DNA, 16 bp, Homo sapiens
acaaaagtgctttgga

SEQ ID NO: 5550668 - DNA, 13 bp, Homo sapiens
acaaaagttacta

SEQ ID NO: 5550669 - DNA, 14 bp, Homo sapiens
acaaaagtttttta

SEQ ID NO: 5550670 - DNA, 10 bp, Homo sapiens
acaaaataaa

SEQ ID NO: 5550671 - DNA, 13 bp, Homo sapiens
acaaaataaagtg

SEQ ID NO: 5550672 - DNA, 19 bp, Homo sapiens
acaaaataaagtgtgtgtg

SEQ ID NO: 5550673 - DNA, 15 bp, Homo sapiens
acaaaataatttaac

SEQ ID NO: 5550674 - DNA, 17 bp, Homo sapiens
acaaaataatttaacta

SEQ ID NO: 5550675 - DNA, 22 bp, Homo sapiens
acaaaataatttaactaattta

SEQ ID NO: 5550676 - DNA, 23 bp, Homo sapiens
acaaaatacacattcttgcttgt

SEQ ID NO: 5550677 - DNA, 12 bp, Homo sapiens
acaaaatagaag

SEQ ID NO: 5550678 - DNA, 23 bp, Homo sapiens
acaaaatataaagcatctaaact

SEQ ID NO: 5550679 - DNA, 23 bp, Homo sapiens
acaaaatataaatcacagatttc

SEQ ID NO: 5550680 - DNA, 12 bp, Homo sapiens
acaaaatataca

SEQ ID NO: 5550681 - DNA, 12 bp, Homo sapiens
acaaaatattta

SEQ ID NO: 5550682 - DNA, 13 bp, Homo sapiens
acaaaatatttaa

SEQ ID NO: 5550683 - DNA, 15 bp, Homo sapiens
acaaaatatttaagt

SEQ ID NO: 5550684 - DNA, 15 bp, Homo sapiens
acaaaatatttctaa

SEQ ID NO: 5550685 - DNA, 13 bp, Homo sapiens
acaaaatcaaata

SEQ ID NO: 5550686 - DNA, 13 bp, Homo sapiens
acaaaatcacaag

SEQ ID NO: 5550687 - DNA, 22 bp, Homo sapiens
acaaaatcacaagcaataatta

SEQ ID NO: 5550688 - DNA, 18 bp, Homo sapiens
acaaaatcacattctgca

SEQ ID NO: 5550689 - DNA, 17 bp, Homo sapiens
acaaaatcacttccata

SEQ ID NO: 5550690 - DNA, 20 bp, Homo sapiens
acaaaatcaggtaactaact

SEQ ID NO: 5550691 - DNA, 17 bp, Homo sapiens
acaaaatccattccagg

SEQ ID NO: 5550692 - DNA, 20 bp, Homo sapiens
acaaaatccttgccttcaaa

SEQ ID NO: 5550693 - DNA, 15 bp, Homo sapiens
acaaaatctgaactc

SEQ ID NO: 5550694 - DNA, 19 bp, Homo sapiens
acaaaatctgaactctcaa

SEQ ID NO: 5550695 - DNA, 14 bp, Homo sapiens
acaaaatctgttta

SEQ ID NO: 5550696 - DNA, 13 bp, Homo sapiens
acaaaatgaaacg

SEQ ID NO: 5550697 - DNA, 13 bp, Homo sapiens
acaaaatgaagct

SEQ ID NO: 5550698 - DNA, 16 bp, Homo sapiens
acaaaatgaatgcatt

SEQ ID NO: 5550699 - DNA, 15 bp, Homo sapiens
acaaaatgataatca

SEQ ID NO: 5550700 - DNA, 12 bp, Homo sapiens
acaaaatgccaa

SEQ ID NO: 5550701 - DNA, 13 bp, Homo sapiens
acaaaatggaagg

SEQ ID NO: 5550702 - DNA, 20 bp, Homo sapiens
acaaaatggaatactcttat

SEQ ID NO: 5550703 - DNA, 14 bp, Homo sapiens
acaaaatgggagga

SEQ ID NO: 5550704 - DNA, 17 bp, Homo sapiens
acaaaatgggaggagga

SEQ ID NO: 5550705 - DNA, 17 bp, Homo sapiens
acaaaatgtaactgtta

SEQ ID NO: 5550706 - DNA, 17 bp, Homo sapiens
acaaaatgtagaatatt

SEQ ID NO: 5550707 - DNA, 23 bp, Homo sapiens
acaaaatgtagaatattcagaca

SEQ ID NO: 5550708 - DNA, 17 bp, Homo sapiens
acaaaatgtagacaaag

SEQ ID NO: 5550709 - DNA, 16 bp, Homo sapiens
acaaaatgtatgtctg

SEQ ID NO: 5550710 - DNA, 15 bp, Homo sapiens
acaaaatgtcacact

SEQ ID NO: 5550711 - DNA, 12 bp, Homo sapiens
acaaaatgttat

SEQ ID NO: 5550712 - DNA, 17 bp, Homo sapiens
acaaaatgttttttgat

SEQ ID NO: 5550713 - DNA, 20 bp, Homo sapiens
acaaaattaagcaaatgtta

SEQ ID NO: 5550714 - DNA, 15 bp, Homo sapiens
acaaaattaatacat

SEQ ID NO: 5550715 - DNA, 14 bp, Homo sapiens
acaaaattatttgt

SEQ ID NO: 5550716 - DNA, 13 bp, Homo sapiens
acaaaattcaaag

SEQ ID NO: 5550717 - DNA, 16 bp, Homo sapiens
acaaaattgacagctt

SEQ ID NO: 5550718 - DNA, 16 bp, Homo sapiens
acaaaattgcaatttc

SEQ ID NO: 5550719 - DNA, 16 bp, Homo sapiens
acaaaattgtaagcca

SEQ ID NO: 5550720 - DNA, 20 bp, Homo sapiens
acaaaattgtaagccagagt

SEQ ID NO: 5550721 - DNA, 20 bp, Homo sapiens
acaaaatttagtttttgttc

SEQ ID NO: 5550722 - DNA, 23 bp, Homo sapiens
acaaaatttatgtcattttcaga

SEQ ID NO: 5550723 - DNA, 22 bp, Homo sapiens
acaaaatttcacagttctgtaa

SEQ ID NO: 5550724 - DNA, 22 bp, Homo sapiens
acaaaatttgaataataaatcg

SEQ ID NO: 5550725 - DNA, 13 bp, Homo sapiens
acaaaatttgact

SEQ ID NO: 5550726 - DNA, 20 bp, Homo sapiens
acaaaatttgactaatttta

SEQ ID NO: 5550727 - DNA, 21 bp, Homo sapiens
acaaaatttgagaatacataa

SEQ ID NO: 5550728 - DNA, 12 bp, Homo sapiens
acaaaattttaa

SEQ ID NO: 5550729 - DNA, 15 bp, Homo sapiens
acaaaattttgttta

SEQ ID NO: 5550730 - DNA, 11 bp, Homo sapiens
acaaacaaaaa

SEQ ID NO: 5550731 - DNA, 11 bp, Homo sapiens
acaaacaaaac

SEQ ID NO: 5550732 - DNA, 15 bp, Homo sapiens
acaaacaaaacttaa

SEQ ID NO: 5550733 - DNA, 16 bp, Homo sapiens
acaaacaaaatttcta

SEQ ID NO: 5550734 - DNA, 18 bp, Homo sapiens
acaaacaaaatttctatt

SEQ ID NO: 5550735 - DNA, 16 bp, Homo sapiens
acaaacaaacaaaact

SEQ ID NO: 5550736 - DNA, 18 bp, Homo sapiens
acaaacaaacaatgcata

SEQ ID NO: 5550737 - DNA, 15 bp, Homo sapiens
acaaacaaataaata

SEQ ID NO: 5550738 - DNA, 18 bp, Homo sapiens
acaaacaaatcaaacaca

SEQ ID NO: 5550739 - DNA, 13 bp, Homo sapiens
acaaacaaatttt

SEQ ID NO: 5550740 - DNA, 16 bp, Homo sapiens
acaaacaacaaagcag

SEQ ID NO: 5550741 - DNA, 21 bp, Homo sapiens
acaaacaagatacgtatattt

SEQ ID NO: 5550742 - DNA, 14 bp, Homo sapiens
acaaacaagcatat

SEQ ID NO: 5550743 - DNA, 18 bp, Homo sapiens
acaaacaagccccctgcc

SEQ ID NO: 5550744 - DNA, 18 bp, Homo sapiens
acaaacaagctaggtgct

SEQ ID NO: 5550745 - DNA, 21 bp, Homo sapiens
acaaacaaggcctgtcagcta

SEQ ID NO: 5550746 - DNA, 16 bp, Homo sapiens
acaaacaatctcttaa

SEQ ID NO: 5550747 - DNA, 20 bp, Homo sapiens
acaaacaatggaaactgaat

SEQ ID NO: 5550748 - DNA, 18 bp, Homo sapiens
acaaacacaattctagga

SEQ ID NO: 5550749 - DNA, 16 bp, Homo sapiens
acaaacacattataaa

SEQ ID NO: 5550750 - DNA, 15 bp, Homo sapiens
acaaacacctcccag

SEQ ID NO: 5550751 - DNA, 14 bp, Homo sapiens
acaaacacctccta

SEQ ID NO: 5550752 - DNA, 15 bp, Homo sapiens
acaaacactgaatca

SEQ ID NO: 5550753 - DNA, 23 bp, Homo sapiens
acaaacactgaatcatgttaata

SEQ ID NO: 5550754 - DNA, 21 bp, Homo sapiens
acaaacactgcagtttcctgg

SEQ ID NO: 5550755 - DNA, 22 bp, Homo sapiens
acaaacactgcagtttcctgga

SEQ ID NO: 5550756 - DNA, 23 bp, Homo sapiens
acaaacactgccatattgtgtaa

SEQ ID NO: 5550757 - DNA, 18 bp, Homo sapiens
acaaacagaaacgagatt

SEQ ID NO: 5550758 - DNA, 15 bp, Homo sapiens
acaaacagcccttcc

SEQ ID NO: 5550759 - DNA, 10 bp, Homo sapiens
acaaacagga

SEQ ID NO: 5550760 - DNA, 13 bp, Homo sapiens
acaaacagtgaat

SEQ ID NO: 5550761 - DNA, 14 bp, Homo sapiens
acaaacataagtgc

SEQ ID NO: 5550762 - DNA, 17 bp, Homo sapiens
acaaacatagacagatg

SEQ ID NO: 5550763 - DNA, 18 bp, Homo sapiens
acaaacatagacagatgt

SEQ ID NO: 5550764 - DNA, 14 bp, Homo sapiens
acaaacatgaatcc

SEQ ID NO: 5550765 - DNA, 19 bp, Homo sapiens
acaaacatggaaaacagag

SEQ ID NO: 5550766 - DNA, 13 bp, Homo sapiens
acaaaccaacatc

SEQ ID NO: 5550767 - DNA, 16 bp, Homo sapiens
acaaaccaacatcttt

SEQ ID NO: 5550768 - DNA, 17 bp, Homo sapiens
acaaaccaacatctttg

SEQ ID NO: 5550769 - DNA, 22 bp, Homo sapiens
acaaaccaacatctttgcgaaa

SEQ ID NO: 5550770 - DNA, 18 bp, Homo sapiens
acaaaccaaccatttcta

SEQ ID NO: 5550771 - DNA, 16 bp, Homo sapiens
acaaaccacaactgac

SEQ ID NO: 5550772 - DNA, 23 bp, Homo sapiens
acaaaccacaactgacacaggaa

SEQ ID NO: 5550773 - DNA, 20 bp, Homo sapiens
acaaaccaccaggactgaaa

SEQ ID NO: 5550774 - DNA, 13 bp, Homo sapiens
acaaaccactgta

SEQ ID NO: 5550775 - DNA, 15 bp, Homo sapiens
acaaaccactgtaca

SEQ ID NO: 5550776 - DNA, 14 bp, Homo sapiens
acaaaccagaagca

SEQ ID NO: 5550777 - DNA, 15 bp, Homo sapiens
acaaaccagcctggg

SEQ ID NO: 5550778 - DNA, 13 bp, Homo sapiens
acaaaccaggagc

SEQ ID NO: 5550779 - DNA, 14 bp, Homo sapiens
acaaaccaggagca

SEQ ID NO: 5550780 - DNA, 21 bp, Homo sapiens
acaaaccaggtcaccatcctc

SEQ ID NO: 5550781 - DNA, 18 bp, Homo sapiens
acaaaccataactgacaa

SEQ ID NO: 5550782 - DNA, 17 bp, Homo sapiens
acaaaccatctggtgcc

SEQ ID NO: 5550783 - DNA, 22 bp, Homo sapiens
acaaaccatctggtgcctttcc

SEQ ID NO: 5550784 - DNA, 17 bp, Homo sapiens
acaaaccattttatttt

SEQ ID NO: 5550785 - DNA, 23 bp, Homo sapiens
acaaacccaggagtttgtgtgtc

SEQ ID NO: 5550786 - DNA, 14 bp, Homo sapiens
acaaaccctgggga

SEQ ID NO: 5550787 - DNA, 15 bp, Homo sapiens
acaaaccctttaaat

SEQ ID NO: 5550788 - DNA, 23 bp, Homo sapiens
acaaacctactgcccacatttgg

SEQ ID NO: 5550789 - DNA, 16 bp, Homo sapiens
acaaacctcactgaga

SEQ ID NO: 5550790 - DNA, 18 bp, Homo sapiens
acaaacctgcctgggttt

SEQ ID NO: 5550791 - DNA, 19 bp, Homo sapiens
acaaaccttaaaacagctg

SEQ ID NO: 5550792 - DNA, 16 bp, Homo sapiens
acaaaccttgccttga

SEQ ID NO: 5550793 - DNA, 18 bp, Homo sapiens
acaaaccttgccttgaaa

SEQ ID NO: 5550794 - DNA, 19 bp, Homo sapiens
acaaacgtaatttgttata

SEQ ID NO: 5550795 - DNA, 18 bp, Homo sapiens
acaaacgtatgtaaatgt

SEQ ID NO: 5550796 - DNA, 22 bp, Homo sapiens
acaaacgtttgacaaacacaat

SEQ ID NO: 5550797 - DNA, 15 bp, Homo sapiens
acaaactacctctgg

SEQ ID NO: 5550798 - DNA, 20 bp, Homo sapiens
acaaactatgatcacagtga

SEQ ID NO: 5550799 - DNA, 20 bp, Homo sapiens
acaaactattacttacaaac

SEQ ID NO: 5550800 - DNA, 22 bp, Homo sapiens
acaaactattacttacaaactg

SEQ ID NO: 5550801 - DNA, 23 bp, Homo sapiens
acaaactattacttacaaactgc

SEQ ID NO: 5550802 - DNA, 14 bp, Homo sapiens
acaaactcagatcc

SEQ ID NO: 5550803 - DNA, 13 bp, Homo sapiens
acaaactcatcca

SEQ ID NO: 5550804 - DNA, 22 bp, Homo sapiens
acaaactcatcctcttttaatg

SEQ ID NO: 5550805 - DNA, 13 bp, Homo sapiens
acaaactccaggc

SEQ ID NO: 5550806 - DNA, 16 bp, Homo sapiens
acaaactccaggctgg

SEQ ID NO: 5550807 - DNA, 18 bp, Homo sapiens
acaaactccttaatatga

SEQ ID NO: 5550808 - DNA, 20 bp, Homo sapiens
acaaactcttcagttaattc

SEQ ID NO: 5550809 - DNA, 11 bp, Homo sapiens
acaaactgaag

SEQ ID NO: 5550810 - DNA, 20 bp, Homo sapiens
acaaactgatgcgaaaactt

SEQ ID NO: 5550811 - DNA, 21 bp, Homo sapiens
acaaactgatgcgaaaacttg

SEQ ID NO: 5550812 - DNA, 19 bp, Homo sapiens
acaaactgcacatgatttc

SEQ ID NO: 5550813 - DNA, 21 bp, Homo sapiens
acaaactgcacatgatttcac

SEQ ID NO: 5550814 - DNA, 15 bp, Homo sapiens
acaaactgcagctgt

SEQ ID NO: 5550815 - DNA, 18 bp, Homo sapiens
acaaactgcagctgtgag

SEQ ID NO: 5550816 - DNA, 20 bp, Homo sapiens
acaaactgccattggctata

SEQ ID NO: 5550817 - DNA, 22 bp, Homo sapiens
acaaactgcttcccttactttg

SEQ ID NO: 5550818 - DNA, 19 bp, Homo sapiens
acaaactggcttaataata

SEQ ID NO: 5550819 - DNA, 18 bp, Homo sapiens
acaaactgtaaaaaatgt

SEQ ID NO: 5550820 - DNA, 15 bp, Homo sapiens
acaaactgtgaaaat

SEQ ID NO: 5550821 - DNA, 18 bp, Homo sapiens
acaaactgtgaaaatagt

SEQ ID NO: 5550822 - DNA, 22 bp, Homo sapiens
acaaactgtgaaaatagtgtaa

SEQ ID NO: 5550823 - DNA, 15 bp, Homo sapiens
acaaacttactgtca

SEQ ID NO: 5550824 - DNA, 21 bp, Homo sapiens
acaaacttggacaacacggag

SEQ ID NO: 5550825 - DNA, 13 bp, Homo sapiens
acaaactttaaat

SEQ ID NO: 5550826 - DNA, 22 bp, Homo sapiens
acaaactttagggtaaaaattg

SEQ ID NO: 5550827 - DNA, 13 bp, Homo sapiens
acaaactttgcat

SEQ ID NO: 5550828 - DNA, 15 bp, Homo sapiens
acaaactttgcatct

SEQ ID NO: 5550829 - DNA, 19 bp, Homo sapiens
acaaactttgcatctcagt

SEQ ID NO: 5550830 - DNA, 21 bp, Homo sapiens
acaaactttgtaattctaata

SEQ ID NO: 5550831 - DNA, 23 bp, Homo sapiens
acaaactttgtttgctaatgcac

SEQ ID NO: 5550832 - DNA, 15 bp, Homo sapiens
acaaacttttaagat

SEQ ID NO: 5550833 - DNA, 23 bp, Homo sapiens
acaacaaagcatgctcagtattg

SEQ ID NO: 5550834 - DNA, 13 bp, Homo sapiens
acaacaaaggaag

SEQ ID NO: 5550835 - DNA, 14 bp, Homo sapiens
acaacaaataattt

SEQ ID NO: 5550836 - DNA, 16 bp, Homo sapiens
acaacaacaataataa

SEQ ID NO: 5550837 - DNA, 13 bp, Homo sapiens
acaacaacaatac

SEQ ID NO: 5550838 - DNA, 16 bp, Homo sapiens
acaacaacaatacaac

SEQ ID NO: 5550839 - DNA, 14 bp, Homo sapiens
acaacaacagaaca

SEQ ID NO: 5550840 - DNA, 21 bp, Homo sapiens
acaacaactattttttaagaa

SEQ ID NO: 5550841 - DNA, 15 bp, Homo sapiens
acaacaacttaatgt

SEQ ID NO: 5550842 - DNA, 13 bp, Homo sapiens
acaacaagagttt

SEQ ID NO: 5550843 - DNA, 20 bp, Homo sapiens
acaacaagcaaactgaaatt

SEQ ID NO: 5550844 - DNA, 23 bp, Homo sapiens
acaacaaggccctttaacttgtc

SEQ ID NO: 5550845 - DNA, 19 bp, Homo sapiens
acaacaagttgtttcaaac

SEQ ID NO: 5550846 - DNA, 21 bp, Homo sapiens
acaacaagttgtttcaaacag

SEQ ID NO: 5550847 - DNA, 23 bp, Homo sapiens
acaacaagttgtttcaaacagca

SEQ ID NO: 5550848 - DNA, 13 bp, Homo sapiens
acaacaataataa

SEQ ID NO: 5550849 - DNA, 14 bp, Homo sapiens
acaacaataataaa

SEQ ID NO: 5550850 - DNA, 14 bp, Homo sapiens
acaacaatccttct

SEQ ID NO: 5550851 - DNA, 13 bp, Homo sapiens
acaacaatgcttt

SEQ ID NO: 5550852 - DNA, 23 bp, Homo sapiens
acaacaatggtttacatgaacac

SEQ ID NO: 5550853 - DNA, 17 bp, Homo sapiens
acaacaattttaaataa

SEQ ID NO: 5550854 - DNA, 15 bp, Homo sapiens
acaacacaaccaacg

SEQ ID NO: 5550855 - DNA, 13 bp, Homo sapiens
acaacacaagaaa

SEQ ID NO: 5550856 - DNA, 15 bp, Homo sapiens
acaacacaagaaaac

SEQ ID NO: 5550857 - DNA, 13 bp, Homo sapiens
acaacacatgtgg

SEQ ID NO: 5550858 - DNA, 19 bp, Homo sapiens
acaacaccagcaacattat

SEQ ID NO: 5550859 - DNA, 16 bp, Homo sapiens
acaacaccccacagga

SEQ ID NO: 5550860 - DNA, 21 bp, Homo sapiens
acaacacctcctcctgctgct

SEQ ID NO: 5550861 - DNA, 15 bp, Homo sapiens
acaacaccttcctcc

SEQ ID NO: 5550862 - DNA, 17 bp, Homo sapiens
acaacaccttcctcctg

SEQ ID NO: 5550863 - DNA, 18 bp, Homo sapiens
acaacaccttcctcctgc

SEQ ID NO: 5550864 - DNA, 23 bp, Homo sapiens
acaacacggagcagggagagctc

SEQ ID NO: 5550865 - DNA, 15 bp, Homo sapiens
acaacactacttccc

SEQ ID NO: 5550866 - DNA, 14 bp, Homo sapiens
acaacactgtagta

SEQ ID NO: 5550867 - DNA, 16 bp, Homo sapiens
acaacacttaatagca

SEQ ID NO: 5550868 - DNA, 16 bp, Homo sapiens
acaacacttcattttc

SEQ ID NO: 5550869 - DNA, 15 bp, Homo sapiens
acaacagaaaaacaa

SEQ ID NO: 5550870 - DNA, 13 bp, Homo sapiens
acaacagaataaa

SEQ ID NO: 5550871 - DNA, 12 bp, Homo sapiens
acaacagactga

SEQ ID NO: 5550872 - DNA, 13 bp, Homo sapiens
acaacagatttct

SEQ ID NO: 5550873 - DNA, 18 bp, Homo sapiens
acaacagcaaaccctgat

SEQ ID NO: 5550874 - DNA, 12 bp, Homo sapiens
acaacagcaaca

SEQ ID NO: 5550875 - DNA, 16 bp, Homo sapiens
acaacagcagtctcct

SEQ ID NO: 5550876 - DNA, 23 bp, Homo sapiens
acaacagcagtctccttcagcac

SEQ ID NO: 5550877 - DNA, 17 bp, Homo sapiens
acaacagccaacagcta

SEQ ID NO: 5550878 - DNA, 12 bp, Homo sapiens
acaacagcccag

SEQ ID NO: 5550879 - DNA, 13 bp, Homo sapiens
acaacagcctgag

SEQ ID NO: 5550880 - DNA, 15 bp, Homo sapiens
acaacagcctggggt

SEQ ID NO: 5550881 - DNA, 14 bp, Homo sapiens
acaacaggagagag

SEQ ID NO: 5550882 - DNA, 15 bp, Homo sapiens
acaacaggattttca

SEQ ID NO: 5550883 - DNA, 16 bp, Homo sapiens
acaacaggattttcaa

SEQ ID NO: 5550884 - DNA, 17 bp, Homo sapiens
acaacaggattttcaag

SEQ ID NO: 5550885 - DNA, 19 bp, Homo sapiens
acaacaggattttcaagtt

SEQ ID NO: 5550886 - DNA, 18 bp, Homo sapiens
acaacaggcaggggccca

SEQ ID NO: 5550887 - DNA, 16 bp, Homo sapiens
acaacaggcccttggg

SEQ ID NO: 5550888 - DNA, 22 bp, Homo sapiens
acaacaggcccttgggtgaaag

SEQ ID NO: 5550889 - DNA, 16 bp, Homo sapiens
acaacaggctgtgtgt

SEQ ID NO: 5550890 - DNA, 22 bp, Homo sapiens
acaacaggctgtgtgtggaaat

SEQ ID NO: 5550891 - DNA, 14 bp, Homo sapiens
acaacagtaacaca

SEQ ID NO: 5550892 - DNA, 14 bp, Homo sapiens
acaacagtcagcca

SEQ ID NO: 5550893 - DNA, 17 bp, Homo sapiens
acaacagtcagccagct

SEQ ID NO: 5550894 - DNA, 22 bp, Homo sapiens
acaacagttgggctgtcaacat

SEQ ID NO: 5550895 - DNA, 13 bp, Homo sapiens
acaacatatcaga

SEQ ID NO: 5550896 - DNA, 20 bp, Homo sapiens
acaacatcagaaagaattga

SEQ ID NO: 5550897 - DNA, 16 bp, Homo sapiens
acaacatcattccaaa

SEQ ID NO: 5550898 - DNA, 15 bp, Homo sapiens
acaacatccactgtt

SEQ ID NO: 5550899 - DNA, 22 bp, Homo sapiens
acaacatccatgtcctatgtgt

SEQ ID NO: 5550900 - DNA, 12 bp, Homo sapiens
acaacatctgag

SEQ ID NO: 5550901 - DNA, 13 bp, Homo sapiens
acaacatgcacat

SEQ ID NO: 5550902 - DNA, 14 bp, Homo sapiens
acaacatgcacatt

SEQ ID NO: 5550903 - DNA, 19 bp, Homo sapiens
acaacatggcttctccttt

SEQ ID NO: 5550904 - DNA, 15 bp, Homo sapiens
acaacatggtgctac

SEQ ID NO: 5550905 - DNA, 14 bp, Homo sapiens
acaacatgtataat

SEQ ID NO: 5550906 - DNA, 13 bp, Homo sapiens
acaacatgttcta

SEQ ID NO: 5550907 - DNA, 17 bp, Homo sapiens
acaacattaattttatg

SEQ ID NO: 5550908 - DNA, 15 bp, Homo sapiens
acaacattagaatat

SEQ ID NO: 5550909 - DNA, 14 bp, Homo sapiens
acaacattatgatc

SEQ ID NO: 5550910 - DNA, 16 bp, Homo sapiens
acaacattatgatcta

SEQ ID NO: 5550911 - DNA, 23 bp, Homo sapiens
acaacattatgatctaataaact

SEQ ID NO: 5550912 - DNA, 22 bp, Homo sapiens
acaacattattttaaaatcaaa

SEQ ID NO: 5550913 - DNA, 17 bp, Homo sapiens
acaacatttacaactca

SEQ ID NO: 5550914 - DNA, 22 bp, Homo sapiens
acaacatttatatattgtctgt

SEQ ID NO: 5550915 - DNA, 22 bp, Homo sapiens
acaacatttctatagccaaaaa

SEQ ID NO: 5550916 - DNA, 13 bp, Homo sapiens
acaacattttaat

SEQ ID NO: 5550917 - DNA, 20 bp, Homo sapiens
acaacatttttgtacattat

SEQ ID NO: 5550918 - DNA, 23 bp, Homo sapiens
acaacatttttgtacattatgtt

SEQ ID NO: 5550919 - DNA, 13 bp, Homo sapiens
acaaccaaaacat

SEQ ID NO: 5550920 - DNA, 22 bp, Homo sapiens
acaaccaacagaaaacatccca

SEQ ID NO: 5550921 - DNA, 22 bp, Homo sapiens
acaaccaacttgttgtggctct

SEQ ID NO: 5550922 - DNA, 18 bp, Homo sapiens
acaaccacatacaacaca

SEQ ID NO: 5550923 - DNA, 20 bp, Homo sapiens
acaaccaccaccttatacat

SEQ ID NO: 5550924 - DNA, 16 bp, Homo sapiens
acaaccactaatttgt

SEQ ID NO: 5550925 - DNA, 18 bp, Homo sapiens
acaaccactgggatcagc

SEQ ID NO: 5550926 - DNA, 20 bp, Homo sapiens
acaaccactgggatcagctg

SEQ ID NO: 5550927 - DNA, 15 bp, Homo sapiens
acaaccagaaggccc

SEQ ID NO: 5550928 - DNA, 13 bp, Homo sapiens
acaaccagagccc

SEQ ID NO: 5550929 - DNA, 15 bp, Homo sapiens
acaaccatccctgcc

SEQ ID NO: 5550930 - DNA, 17 bp, Homo sapiens
acaaccatccctgccac

SEQ ID NO: 5550931 - DNA, 14 bp, Homo sapiens
acaaccatgtcatt

SEQ ID NO: 5550932 - DNA, 16 bp, Homo sapiens
acaaccatgttcttga

SEQ ID NO: 5550933 - DNA, 23 bp, Homo sapiens
acaaccatgttcttgagcagctg

SEQ ID NO: 5550934 - DNA, 22 bp, Homo sapiens
acaacccaggcagtaccattca

SEQ ID NO: 5550935 - DNA, 14 bp, Homo sapiens
acaaccccagcctc

SEQ ID NO: 5550936 - DNA, 16 bp, Homo sapiens
acaacccccagctccc

SEQ ID NO: 5550937 - DNA, 23 bp, Homo sapiens
acaacccctgatgtttgaagagt

SEQ ID NO: 5550938 - DNA, 14 bp, Homo sapiens
acaaccctctggaa

SEQ ID NO: 5550939 - DNA, 22 bp, Homo sapiens
acaaccctgaagcagaggcctt

SEQ ID NO: 5550940 - DNA, 11 bp, Homo sapiens
acaaccctgac

SEQ ID NO: 5550941 - DNA, 22 bp, Homo sapiens
acaaccctgttgagtatttgct

SEQ ID NO: 5550942 - DNA, 17 bp, Homo sapiens
acaacccttctctgttg

SEQ ID NO: 5550943 - DNA, 19 bp, Homo sapiens
acaacccttctctgttggt

SEQ ID NO: 5550944 - DNA, 22 bp, Homo sapiens
acaaccgatgctccagccaacc

SEQ ID NO: 5550945 - DNA, 21 bp, Homo sapiens
acaaccgtcctgctgtccctg

SEQ ID NO: 5550946 - DNA, 14 bp, Homo sapiens
acaacctaaatgga

SEQ ID NO: 5550947 - DNA, 15 bp, Homo sapiens
acaacctaaatggag

SEQ ID NO: 5550948 - DNA, 17 bp, Homo sapiens
acaacctactctgcaaa

SEQ ID NO: 5550949 - DNA, 15 bp, Homo sapiens
acaacctagaatgtc

SEQ ID NO: 5550950 - DNA, 16 bp, Homo sapiens
acaacctcaactgcct

SEQ ID NO: 5550951 - DNA, 16 bp, Homo sapiens
acaacctcaccaaact

SEQ ID NO: 5550952 - DNA, 22 bp, Homo sapiens
acaacctccctcttgttttgtt

SEQ ID NO: 5550953 - DNA, 23 bp, Homo sapiens
acaacctccctcttgttttgttt

SEQ ID NO: 5550954 - DNA, 14 bp, Homo sapiens
acaacctgaaagac

SEQ ID NO: 5550955 - DNA, 15 bp, Homo sapiens
acaacctgaaagaca

SEQ ID NO: 5550956 - DNA, 18 bp, Homo sapiens
acaacctgaacctaggag

SEQ ID NO: 5550957 - DNA, 13 bp, Homo sapiens
acaacctgaatct

SEQ ID NO: 5550958 - DNA, 14 bp, Homo sapiens
acaacctgaatctt

SEQ ID NO: 5550959 - DNA, 16 bp, Homo sapiens
acaacctgaatctttt

SEQ ID NO: 5550960 - DNA, 18 bp, Homo sapiens
acaacctgaatctttttt

SEQ ID NO: 5550961 - DNA, 20 bp, Homo sapiens
acaacctgagttcaagtcaa

SEQ ID NO: 5550962 - DNA, 23 bp, Homo sapiens
acaacctgcttgggtggagaagc

SEQ ID NO: 5550963 - DNA, 12 bp, Homo sapiens
acaacctggaga

SEQ ID NO: 5550964 - DNA, 19 bp, Homo sapiens
acaacctgtgtgagagaat

SEQ ID NO: 5550965 - DNA, 18 bp, Homo sapiens
acaaccttcggctccggg

SEQ ID NO: 5550966 - DNA, 23 bp, Homo sapiens
acaaccttggcttggccctggca

SEQ ID NO: 5550967 - DNA, 16 bp, Homo sapiens
acaacctttcccattt

SEQ ID NO: 5550968 - DNA, 16 bp, Homo sapiens
acaacctttgtgtaat

SEQ ID NO: 5550969 - DNA, 15 bp, Homo sapiens
acaaccttttacatt

SEQ ID NO: 5550970 - DNA, 18 bp, Homo sapiens
acaaccttttacattgtg

SEQ ID NO: 5550971 - DNA, 19 bp, Homo sapiens
acaacgatttctccattaa

SEQ ID NO: 5550972 - DNA, 23 bp, Homo sapiens
acaacgcattgccacggaaacat

SEQ ID NO: 5550973 - DNA, 21 bp, Homo sapiens
acaacgctctaccctgcagct

SEQ ID NO: 5550974 - DNA, 22 bp, Homo sapiens
acaacggagtcaaaaattaaac

SEQ ID NO: 5550975 - DNA, 18 bp, Homo sapiens
acaacgggcagaaatcga

SEQ ID NO: 5550976 - DNA, 17 bp, Homo sapiens
acaacgtcccctcaagc

SEQ ID NO: 5550977 - DNA, 14 bp, Homo sapiens
acaacgtctcttca

SEQ ID NO: 5550978 - DNA, 14 bp, Homo sapiens
acaacgtgcattgt

SEQ ID NO: 5550979 - DNA, 17 bp, Homo sapiens
acaacgtgcattgtgct

SEQ ID NO: 5550980 - DNA, 22 bp, Homo sapiens
acaacgtgctctttgttttgtg

SEQ ID NO: 5550981 - DNA, 18 bp, Homo sapiens
acaactaacaatgccttg

SEQ ID NO: 5550982 - DNA, 10 bp, Homo sapiens
acaactaagt

SEQ ID NO: 5550983 - DNA, 15 bp, Homo sapiens
acaactatggctgtt

SEQ ID NO: 5550984 - DNA, 18 bp, Homo sapiens
acaactatgtaatttata

SEQ ID NO: 5550985 - DNA, 19 bp, Homo sapiens
acaactatttcggcctttt

SEQ ID NO: 5550986 - DNA, 15 bp, Homo sapiens
acaactattttcaga

SEQ ID NO: 5550987 - DNA, 19 bp, Homo sapiens
acaactcactccttttaaa

SEQ ID NO: 5550988 - DNA, 17 bp, Homo sapiens
acaactcagtttcatat

SEQ ID NO: 5550989 - DNA, 23 bp, Homo sapiens
acaactcatccagaactgtctta

SEQ ID NO: 5550990 - DNA, 14 bp, Homo sapiens
acaactcattctga

SEQ ID NO: 5550991 - DNA, 12 bp, Homo sapiens
acaactccagcc

SEQ ID NO: 5550992 - DNA, 22 bp, Homo sapiens
acaactccagccacccagccag

SEQ ID NO: 5550993 - DNA, 15 bp, Homo sapiens
acaactcccccaccg

SEQ ID NO: 5550994 - DNA, 22 bp, Homo sapiens
acaactcccttaaggtctccaa

SEQ ID NO: 5550995 - DNA, 15 bp, Homo sapiens
acaactccttccatc

SEQ ID NO: 5550996 - DNA, 24 bp, Homo sapiens
acaactctactgttgcaaagcttc

SEQ ID NO: 5550997 - DNA, 13 bp, Homo sapiens
acaactctatttt

SEQ ID NO: 5550998 - DNA, 18 bp, Homo sapiens
acaactctgcctttatga

SEQ ID NO: 5550999 - DNA, 18 bp, Homo sapiens
acaactcttccatttatt

SEQ ID NO: 5551000 - DNA, 11 bp, Homo sapiens
acaactgaaac

SEQ ID NO: 5551001 - DNA, 17 bp, Homo sapiens
acaactgaaagaaaaag

SEQ ID NO: 5551002 - DNA, 14 bp, Homo sapiens
acaactgacacagg

SEQ ID NO: 5551003 - DNA, 17 bp, Homo sapiens
acaactgactgacttag

SEQ ID NO: 5551004 - DNA, 18 bp, Homo sapiens
acaactgatcatttgcag

SEQ ID NO: 5551005 - DNA, 15 bp, Homo sapiens
acaactgcaaagaaa

SEQ ID NO: 5551006 - DNA, 22 bp, Homo sapiens
acaactgccaaataaaatgttt

SEQ ID NO: 5551007 - DNA, 22 bp, Homo sapiens
acaactgcctcgaaacacagaa

SEQ ID NO: 5551008 - DNA, 17 bp, Homo sapiens
acaactgctcccacctc

SEQ ID NO: 5551009 - DNA, 20 bp, Homo sapiens
acaactgctgtggccccctg

SEQ ID NO: 5551010 - DNA, 13 bp, Homo sapiens
acaactggaaata

SEQ ID NO: 5551011 - DNA, 14 bp, Homo sapiens
acaactggaaataa

SEQ ID NO: 5551012 - DNA, 16 bp, Homo sapiens
acaagcctcttctgaa

SEQ ID NO: 5551013 - DNA, 22 bp, Homo sapiens
acaagcctgaaagtaatttcaa

SEQ ID NO: 5551014 - DNA, 13 bp, Homo sapiens
acaagcctgagaa

SEQ ID NO: 5551015 - DNA, 15 bp, Homo sapiens
acaagccttaatctg

SEQ ID NO: 5551016 - DNA, 24 bp, Homo sapiens
acaagccttactcacctctctcta

SEQ ID NO: 5551017 - DNA, 15 bp, Homo sapiens
acaagccttcagcca

SEQ ID NO: 5551018 - DNA, 15 bp, Homo sapiens
acaagcgctcccagc

SEQ ID NO: 5551019 - DNA, 21 bp, Homo sapiens
acaagcgctcccagcctgccc

SEQ ID NO: 5551020 - DNA, 17 bp, Homo sapiens
acaagcgtgagccactg

SEQ ID NO: 5551021 - DNA, 21 bp, Homo sapiens
acaagcgtgagccactgcacc

SEQ ID NO: 5551022 - DNA, 23 bp, Homo sapiens
acaagctaattgggagtccaggc

SEQ ID NO: 5551023 - DNA, 17 bp, Homo sapiens
acaagctacatatgtag

SEQ ID NO: 5551024 - DNA, 13 bp, Homo sapiens
acaagctaggaaa

SEQ ID NO: 5551025 - DNA, 15 bp, Homo sapiens
acaagctcatccctg

SEQ ID NO: 5551026 - DNA, 17 bp, Homo sapiens
acaagctcatccctgga

SEQ ID NO: 5551027 - DNA, 13 bp, Homo sapiens
acaagctccaagc

SEQ ID NO: 5551028 - DNA, 15 bp, Homo sapiens
acaagctcccaggcc

SEQ ID NO: 5551029 - DNA, 16 bp, Homo sapiens
acaagctccctggtga

SEQ ID NO: 5551030 - DNA, 16 bp, Homo sapiens
acaagctcctggtctt

SEQ ID NO: 5551031 - DNA, 19 bp, Homo sapiens
acaagctgacttggcactt

SEQ ID NO: 5551032 - DNA, 22 bp, Homo sapiens
acaagctgcaaatcagccatgt

SEQ ID NO: 5551033 - DNA, 13 bp, Homo sapiens
acaagctgcaccc

SEQ ID NO: 5551034 - DNA, 19 bp, Homo sapiens
acaagctgcaccctcaggc

SEQ ID NO: 5551035 - DNA, 14 bp, Homo sapiens
acaagctgcactgt

SEQ ID NO: 5551036 - DNA, 17 bp, Homo sapiens
acaagctgcactgtgaa

SEQ ID NO: 5551037 - DNA, 18 bp, Homo sapiens
acaagctgcactgtgaac

SEQ ID NO: 5551038 - DNA, 11 bp, Homo sapiens
acaagctgcct

SEQ ID NO: 5551039 - DNA, 14 bp, Homo sapiens
acaagctgcctctg

SEQ ID NO: 5551040 - DNA, 15 bp, Homo sapiens
acaagctgcctctga

SEQ ID NO: 5551041 - DNA, 16 bp, Homo sapiens
acaagctggaagcaca

SEQ ID NO: 5551042 - DNA, 19 bp, Homo sapiens
acaagctggcttacactgg

SEQ ID NO: 5551043 - DNA, 20 bp, Homo sapiens
acaagctgtataaacagaac

SEQ ID NO: 5551044 - DNA, 16 bp, Homo sapiens
acaagctgtccctgca

SEQ ID NO: 5551045 - DNA, 18 bp, Homo sapiens
acaagctgtgcaggcatg

SEQ ID NO: 5551046 - DNA, 22 bp, Homo sapiens
acaagctgttgaccaggcacct

SEQ ID NO: 5551047 - DNA, 19 bp, Homo sapiens
acaagcttcagtaagttat

SEQ ID NO: 5551048 - DNA, 15 bp, Homo sapiens
acaagcttctgagac

SEQ ID NO: 5551049 - DNA, 16 bp, Homo sapiens
acaagcttctgtcctg

SEQ ID NO: 5551050 - DNA, 18 bp, Homo sapiens
acaagcttctgtcctgcc

SEQ ID NO: 5551051 - DNA, 20 bp, Homo sapiens
acaagcttgtatatacatat

SEQ ID NO: 5551052 - DNA, 22 bp, Homo sapiens
acaaggaaatacccttctttta

SEQ ID NO: 5551053 - DNA, 12 bp, Homo sapiens
acaaggaaccac

SEQ ID NO: 5551054 - DNA, 24 bp, Homo sapiens
acaaggaaccaccgaagaggaagc

SEQ ID NO: 5551055 - DNA, 15 bp, Homo sapiens
acaaggaagccaaag

SEQ ID NO: 5551056 - DNA, 17 bp, Homo sapiens
acaaggaaggaaaagaa

SEQ ID NO: 5551057 - DNA, 21 bp, Homo sapiens
acaaggaagtcaaagcaagga

SEQ ID NO: 5551058 - DNA, 21 bp, Homo sapiens
acaaggaagtgggggccgctg

SEQ ID NO: 5551059 - DNA, 16 bp, Homo sapiens
acaaggaatgcctgtg

SEQ ID NO: 5551060 - DNA, 19 bp, Homo sapiens
acaaggaatgcctgtgcca

SEQ ID NO: 5551061 - DNA, 20 bp, Homo sapiens
acaaggaatttccctgtgtg

SEQ ID NO: 5551062 - DNA, 18 bp, Homo sapiens
acaaggacaatgccttgg

SEQ ID NO: 5551063 - DNA, 22 bp, Homo sapiens
acaaggacacgcgcccccctcc

SEQ ID NO: 5551064 - DNA, 19 bp, Homo sapiens
acaaggacattcactgctg

SEQ ID NO: 5551065 - DNA, 17 bp, Homo sapiens
acaaggacgctggctac

SEQ ID NO: 5551066 - DNA, 9 bp, Homo sapiens
acaaggact

SEQ ID NO: 5551067 - DNA, 19 bp, Homo sapiens
acaaggactagggtcctgg

SEQ ID NO: 5551068 - DNA, 16 bp, Homo sapiens
acaaggagataagaaa

SEQ ID NO: 5551069 - DNA, 14 bp, Homo sapiens
acaaggagggcaca

SEQ ID NO: 5551070 - DNA, 15 bp, Homo sapiens
acaaggatcagattc

SEQ ID NO: 5551071 - DNA, 21 bp, Homo sapiens
acaaggatgaattaagttttt

SEQ ID NO: 5551072 - DNA, 20 bp, Homo sapiens
acaaggatgatctaggaaga

SEQ ID NO: 5551073 - DNA, 15 bp, Homo sapiens
acaaggattgaaaat

SEQ ID NO: 5551074 - DNA, 16 bp, Homo sapiens
acaaggattgaaaatt

SEQ ID NO: 5551075 - DNA, 16 bp, Homo sapiens
acaaggattgctactg

SEQ ID NO: 5551076 - DNA, 15 bp, Homo sapiens
acaaggcaaggctgt

SEQ ID NO: 5551077 - DNA, 20 bp, Homo sapiens
acaaggcaaggctgtcaatt

SEQ ID NO: 5551078 - DNA, 17 bp, Homo sapiens
acaaggcacttgtcact

SEQ ID NO: 5551079 - DNA, 18 bp, Homo sapiens
acaaggcaggaggagctg

SEQ ID NO: 5551080 - DNA, 17 bp, Homo sapiens
acaaggcaggcctttcc

SEQ ID NO: 5551081 - DNA, 19 bp, Homo sapiens
acaaggcaggcctttccta

SEQ ID NO: 5551082 - DNA, 17 bp, Homo sapiens
acaaggcattcaagtgt

SEQ ID NO: 5551083 - DNA, 15 bp, Homo sapiens
acaaggccagaaaaa

SEQ ID NO: 5551084 - DNA, 21 bp, Homo sapiens
acaaggccagaaaaagaagaa

SEQ ID NO: 5551085 - DNA, 16 bp, Homo sapiens
acaaggccccagagac

SEQ ID NO: 5551086 - DNA, 16 bp, Homo sapiens
acaaggcccctctgca

SEQ ID NO: 5551087 - DNA, 14 bp, Homo sapiens
acaaggcctgcttg

SEQ ID NO: 5551088 - DNA, 11 bp, Homo sapiens
acaaggcctgg

SEQ ID NO: 5551089 - DNA, 13 bp, Homo sapiens
acaaggcctggtc

SEQ ID NO: 5551090 - DNA, 14 bp, Homo sapiens
acaaggcctggtct

SEQ ID NO: 5551091 - DNA, 19 bp, Homo sapiens
acaaggccttgcctggcct

SEQ ID NO: 5551092 - DNA, 14 bp, Homo sapiens
acaaggccttgctc

SEQ ID NO: 5551093 - DNA, 17 bp, Homo sapiens
acaaggctagatcatga

SEQ ID NO: 5551094 - DNA, 18 bp, Homo sapiens
acaaggctgaaaagtgct

SEQ ID NO: 5551095 - DNA, 13 bp, Homo sapiens
acaaggctgacca

SEQ ID NO: 5551096 - DNA, 15 bp, Homo sapiens
acaaggctggccagc

SEQ ID NO: 5551097 - DNA, 18 bp, Homo sapiens
acaaggctgtgccaggct

SEQ ID NO: 5551098 - DNA, 15 bp, Homo sapiens
acaaggctgttgcat

SEQ ID NO: 5551099 - DNA, 23 bp, Homo sapiens
acaagggaaaataaaaaaagaaa

SEQ ID NO: 5551100 - DNA, 16 bp, Homo sapiens
acaagggaaggacaga

SEQ ID NO: 5551101 - DNA, 19 bp, Homo sapiens
acaagggagcttgcttgca

SEQ ID NO: 5551102 - DNA, 13 bp, Homo sapiens
acaagggattctg

SEQ ID NO: 5551103 - DNA, 14 bp, Homo sapiens
acaagggattctgg

SEQ ID NO: 5551104 - DNA, 21 bp, Homo sapiens
acaagggctgacctgcctctc

SEQ ID NO: 5551105 - DNA, 18 bp, Homo sapiens
acaagggctgcaatgccc

SEQ ID NO: 5551106 - DNA, 18 bp, Homo sapiens
acaaggggagggccagga

SEQ ID NO: 5551107 - DNA, 13 bp, Homo sapiens
acaaggggcctcc

SEQ ID NO: 5551108 - DNA, 21 bp, Homo sapiens
acaaggggcgtgcctggcgcc

SEQ ID NO: 5551109 - DNA, 15 bp, Homo sapiens
acaaggggtcaatgt

SEQ ID NO: 5551110 - DNA, 23 bp, Homo sapiens
acaaggggtggaagggcaggagc

SEQ ID NO: 5551111 - DNA, 16 bp, Homo sapiens
acaaggggtgtgactt

SEQ ID NO: 5551112 - DNA, 17 bp, Homo sapiens
acaagggtctagggaga

SEQ ID NO: 5551113 - DNA, 19 bp, Homo sapiens
acaagggtctagggagaga

SEQ ID NO: 5551114 - DNA, 20 bp, Homo sapiens
acaagggtctagggagagac

SEQ ID NO: 5551115 - DNA, 10 bp, Homo sapiens
acaaggtaaa

SEQ ID NO: 5551116 - DNA, 19 bp, Homo sapiens
acaaggtaaacttcattgg

SEQ ID NO: 5551117 - DNA, 21 bp, Homo sapiens
acaaggtacccctttctggct

SEQ ID NO: 5551118 - DNA, 13 bp, Homo sapiens
acaaggtagacat

SEQ ID NO: 5551119 - DNA, 22 bp, Homo sapiens
acaaggtagccctggccagagg

SEQ ID NO: 5551120 - DNA, 22 bp, Homo sapiens
acaaggtatacctcagttccac

SEQ ID NO: 5551121 - DNA, 20 bp, Homo sapiens
acaaggtcaggagttcgaga

SEQ ID NO: 5551122 - DNA, 24 bp, Homo sapiens
acaaggtcatggccacactgtgac

SEQ ID NO: 5551123 - DNA, 15 bp, Homo sapiens
acaaggtgcaggcag

SEQ ID NO: 5551124 - DNA, 16 bp, Homo sapiens
acaaggtgcaggcagg

SEQ ID NO: 5551125 - DNA, 21 bp, Homo sapiens
acaaggtgccctttagccaga

SEQ ID NO: 5551126 - DNA, 15 bp, Homo sapiens
acaaggtgctcagac

SEQ ID NO: 5551127 - DNA, 20 bp, Homo sapiens
acaaggtgctcagacatgaa

SEQ ID NO: 5551128 - DNA, 15 bp, Homo sapiens
acaaggtgggcaggg

SEQ ID NO: 5551129 - DNA, 15 bp, Homo sapiens
acaaggtgttcattt

SEQ ID NO: 5551130 - DNA, 18 bp, Homo sapiens
acaaggttatcagaaaga

SEQ ID NO: 5551131 - DNA, 19 bp, Homo sapiens
acaaggttccctctgagaa

SEQ ID NO: 5551132 - DNA, 15 bp, Homo sapiens
acaagtaaaactgtg

SEQ ID NO: 5551133 - DNA, 16 bp, Homo sapiens
acaagtaaatatatat

SEQ ID NO: 5551134 - DNA, 13 bp, Homo sapiens
acaagtaaattct

SEQ ID NO: 5551135 - DNA, 15 bp, Homo sapiens
acaagtaaattctgt

SEQ ID NO: 5551136 - DNA, 14 bp, Homo sapiens
acaagtaacaaaaa

SEQ ID NO: 5551137 - DNA, 19 bp, Homo sapiens
acaagtaacagttgaagaa

SEQ ID NO: 5551138 - DNA, 13 bp, Homo sapiens
acaagtaagaaaa

SEQ ID NO: 5551139 - DNA, 14 bp, Homo sapiens
acaagtaatattat

SEQ ID NO: 5551140 - DNA, 15 bp, Homo sapiens
acaagtaatattatt

SEQ ID NO: 5551141 - DNA, 13 bp, Homo sapiens
acaagtaatgtaa

SEQ ID NO: 5551142 - DNA, 15 bp, Homo sapiens
acaagtaatttcagt

SEQ ID NO: 5551143 - DNA, 20 bp, Homo sapiens
acaagtactatctgttcccc

SEQ ID NO: 5551144 - DNA, 11 bp, Homo sapiens
acaagtactgg

SEQ ID NO: 5551145 - DNA, 13 bp, Homo sapiens
acaagtacttttg

SEQ ID NO: 5551146 - DNA, 21 bp, Homo sapiens
acaagtagaatggcagctgga

SEQ ID NO: 5551147 - DNA, 16 bp, Homo sapiens
acaagtagcctctggg

SEQ ID NO: 5551148 - DNA, 13 bp, Homo sapiens
acaagtaggagac

SEQ ID NO: 5551149 - DNA, 15 bp, Homo sapiens
acaagtaggagacac

SEQ ID NO: 5551150 - DNA, 18 bp, Homo sapiens
acaagtagttctgtattt

SEQ ID NO: 5551151 - DNA, 19 bp, Homo sapiens
acaagtagttctgtatttg

SEQ ID NO: 5551152 - DNA, 21 bp, Homo sapiens
acaagtagttctgtatttgaa

SEQ ID NO: 5551153 - DNA, 16 bp, Homo sapiens
acaagtatacttatat

SEQ ID NO: 5551154 - DNA, 22 bp, Homo sapiens
acaagtatttgttaatttagaa

SEQ ID NO: 5551155 - DNA, 15 bp, Homo sapiens
acaagtattttgcta

SEQ ID NO: 5551156 - DNA, 19 bp, Homo sapiens
acaagtcaattctgtgtgg

SEQ ID NO: 5551157 - DNA, 16 bp, Homo sapiens
acaagtcacagctgca

SEQ ID NO: 5551158 - DNA, 17 bp, Homo sapiens
acaagtcacagctgcag

SEQ ID NO: 5551159 - DNA, 19 bp, Homo sapiens
acaagtcacagctgcagct

SEQ ID NO: 5551160 - DNA, 20 bp, Homo sapiens
acaagtcagtcattcagata

SEQ ID NO: 5551161 - DNA, 23 bp, Homo sapiens
acaagtcataggttaatatttaa

SEQ ID NO: 5551162 - DNA, 17 bp, Homo sapiens
acaagtcatggacattc

SEQ ID NO: 5551163 - DNA, 15 bp, Homo sapiens
acaagtcatttcaaa

SEQ ID NO: 5551164 - DNA, 18 bp, Homo sapiens
acaagtcatttttgtatt

SEQ ID NO: 5551165 - DNA, 19 bp, Homo sapiens
acaagtcctgtgaatttct

SEQ ID NO: 5551166 - DNA, 17 bp, Homo sapiens
acaagtctagtcttctg

SEQ ID NO: 5551167 - DNA, 22 bp, Homo sapiens
acaagtctcaggggaccattcc

SEQ ID NO: 5551168 - DNA, 21 bp, Homo sapiens
acaagtctgagtagttatgaa

SEQ ID NO: 5551169 - DNA, 19 bp, Homo sapiens
acaagtctgcatttcatat

SEQ ID NO: 5551170 - DNA, 22 bp, Homo sapiens
acaagtctgcatttcatattat

SEQ ID NO: 5551171 - DNA, 13 bp, Homo sapiens
acaagtcttccag

SEQ ID NO: 5551172 - DNA, 18 bp, Homo sapiens
acaagtcttgctgtgctt

SEQ ID NO: 5551173 - DNA, 20 bp, Homo sapiens
acaagtcttgctgtgcttta

SEQ ID NO: 5551174 - DNA, 18 bp, Homo sapiens
acaagtgaaaaacatcca

SEQ ID NO: 5551175 - DNA, 15 bp, Homo sapiens
acaagtgaacaaaat

SEQ ID NO: 5551176 - DNA, 16 bp, Homo sapiens
acaagtgaagaacact

SEQ ID NO: 5551177 - DNA, 13 bp, Homo sapiens
acaagtgaagttg

SEQ ID NO: 5551178 - DNA, 22 bp, Homo sapiens
acaagtgaatctttctcctggt

SEQ ID NO: 5551179 - DNA, 18 bp, Homo sapiens
acaagtgaccccagggcc

SEQ ID NO: 5551180 - DNA, 19 bp, Homo sapiens
acaagtgaccccagggcct

SEQ ID NO: 5551181 - DNA, 20 bp, Homo sapiens
acaagtgaccccagggcctg

SEQ ID NO: 5551182 - DNA, 18 bp, Homo sapiens
acaagtgacttatttgct

SEQ ID NO: 5551183 - DNA, 21 bp, Homo sapiens
acaagtgagacaaaaagcact

SEQ ID NO: 5551184 - DNA, 22 bp, Homo sapiens
acaagtgagttgttgccctggg

SEQ ID NO: 5551185 - DNA, 12 bp, Homo sapiens
acaagtgccact

SEQ ID NO: 5551186 - DNA, 17 bp, Homo sapiens
acaagtgccgcaaattg

SEQ ID NO: 5551187 - DNA, 15 bp, Homo sapiens
acaagtgctctttcc

SEQ ID NO: 5551188 - DNA, 12 bp, Homo sapiens
acaagtgctggc

SEQ ID NO: 5551189 - DNA, 13 bp, Homo sapiens
acaagtgctggca

SEQ ID NO: 5551190 - DNA, 18 bp, Homo sapiens
acaagtggcaacctgctt

SEQ ID NO: 5551191 - DNA, 13 bp, Homo sapiens
acacaaaggaagt

SEQ ID NO: 5551192 - DNA, 22 bp, Homo sapiens
acacaaaggatttgatgctttt

SEQ ID NO: 5551193 - DNA, 14 bp, Homo sapiens
acacaaaggcatgc

SEQ ID NO: 5551194 - DNA, 18 bp, Homo sapiens
acacaaagtgaaattagt

SEQ ID NO: 5551195 - DNA, 17 bp, Homo sapiens
acacaaataccagagca

SEQ ID NO: 5551196 - DNA, 13 bp, Homo sapiens
acacaaatacgga

SEQ ID NO: 5551197 - DNA, 18 bp, Homo sapiens
acacaaatacttattcat

SEQ ID NO: 5551198 - DNA, 23 bp, Homo sapiens
acacaaatattgcttggactacc

SEQ ID NO: 5551199 - DNA, 21 bp, Homo sapiens
acacaaatccctatgttgcta

SEQ ID NO: 5551200 - DNA, 12 bp, Homo sapiens
acacaaatgata

SEQ ID NO: 5551201 - DNA, 12 bp, Homo sapiens
acacaaatgcag

SEQ ID NO: 5551202 - DNA, 15 bp, Homo sapiens
acacaaatgtctagt

SEQ ID NO: 5551203 - DNA, 18 bp, Homo sapiens
acacaaattatcttaaaa

SEQ ID NO: 5551204 - DNA, 13 bp, Homo sapiens
acacaaattttca

SEQ ID NO: 5551205 - DNA, 18 bp, Homo sapiens
acacaaattttcaagttt

SEQ ID NO: 5551206 - DNA, 21 bp, Homo sapiens
acacaaattttcaagtttaca

SEQ ID NO: 5551207 - DNA, 23 bp, Homo sapiens
acacaaattttcaagtttacact

SEQ ID NO: 5551208 - DNA, 15 bp, Homo sapiens
acacaacaaaaattt

SEQ ID NO: 5551209 - DNA, 17 bp, Homo sapiens
acacaacaagaaactgt

SEQ ID NO: 5551210 - DNA, 14 bp, Homo sapiens
acacaacacaagaa

SEQ ID NO: 5551211 - DNA, 13 bp, Homo sapiens
acacaacacacac

SEQ ID NO: 5551212 - DNA, 12 bp, Homo sapiens
acacaacaccag

SEQ ID NO: 5551213 - DNA, 16 bp, Homo sapiens
acacaacaccaggact

SEQ ID NO: 5551214 - DNA, 19 bp, Homo sapiens
acacaacactgatgtgact

SEQ ID NO: 5551215 - DNA, 17 bp, Homo sapiens
acacaacagcagtctcc

SEQ ID NO: 5551216 - DNA, 13 bp, Homo sapiens
acacaacagccaa

SEQ ID NO: 5551217 - DNA, 23 bp, Homo sapiens
acacaacgattatagtaactata

SEQ ID NO: 5551218 - DNA, 17 bp, Homo sapiens
acacaacgctgctgcct

SEQ ID NO: 5551219 - DNA, 17 bp, Homo sapiens
acacaacggcagtgaag

SEQ ID NO: 5551220 - DNA, 13 bp, Homo sapiens
acacaactatatt

SEQ ID NO: 5551221 - DNA, 16 bp, Homo sapiens
acacaactatcaaaat

SEQ ID NO: 5551222 - DNA, 17 bp, Homo sapiens
acacaactatcaaaatt

SEQ ID NO: 5551223 - DNA, 19 bp, Homo sapiens
acacaactgtggataaatt

SEQ ID NO: 5551224 - DNA, 13 bp, Homo sapiens
acacaagaaaaag

SEQ ID NO: 5551225 - DNA, 14 bp, Homo sapiens
acacaagaaaaaga

SEQ ID NO: 5551226 - DNA, 13 bp, Homo sapiens
acacaagaaaact

SEQ ID NO: 5551227 - DNA, 15 bp, Homo sapiens
acacaagaaaactca

SEQ ID NO: 5551228 - DNA, 23 bp, Homo sapiens
acacaagagggactgtatttctg

SEQ ID NO: 5551229 - DNA, 20 bp, Homo sapiens
acacaagattggtgtttttt

SEQ ID NO: 5551230 - DNA, 17 bp, Homo sapiens
acacaagcagacacaca

SEQ ID NO: 5551231 - DNA, 19 bp, Homo sapiens
acacaagcagacacacaca

SEQ ID NO: 5551232 - DNA, 20 bp, Homo sapiens
acacaagcagacacacacat

SEQ ID NO: 5551233 - DNA, 17 bp, Homo sapiens
acacaaggagctttctt

SEQ ID NO: 5551234 - DNA, 21 bp, Homo sapiens
acacaaggagctttcttgttt

SEQ ID NO: 5551235 - DNA, 23 bp, Homo sapiens
acacaaggagctttcttgtttct

SEQ ID NO: 5551236 - DNA, 20 bp, Homo sapiens
acacaagggatataaaatga

SEQ ID NO: 5551237 - DNA, 22 bp, Homo sapiens
acacaagggatataaaatgaaa

SEQ ID NO: 5551238 - DNA, 20 bp, Homo sapiens
acacaaggggcaaatgaatt

SEQ ID NO: 5551239 - DNA, 14 bp, Homo sapiens
acacaaggggccct

SEQ ID NO: 5551240 - DNA, 20 bp, Homo sapiens
acacaaggggcccttggagc

SEQ ID NO: 5551241 - DNA, 16 bp, Homo sapiens
acacaaggtcatggcc

SEQ ID NO: 5551242 - DNA, 23 bp, Homo sapiens
acacaaggtcatggccacactgt

SEQ ID NO: 5551243 - DNA, 17 bp, Homo sapiens
acacaaggtgatttcag

SEQ ID NO: 5551244 - DNA, 14 bp, Homo sapiens
acacaagtaaaact

SEQ ID NO: 5551245 - DNA, 23 bp, Homo sapiens
acacaagtaagagactcagcctg

SEQ ID NO: 5551246 - DNA, 19 bp, Homo sapiens
acacaagtagattgatcta

SEQ ID NO: 5551247 - DNA, 15 bp, Homo sapiens
acacaagtcctgtga

SEQ ID NO: 5551248 - DNA, 16 bp, Homo sapiens
acacaagtgtattatt

SEQ ID NO: 5551249 - DNA, 14 bp, Homo sapiens
acacaataagcaaa

SEQ ID NO: 5551250 - DNA, 12 bp, Homo sapiens
acacaatacaat

SEQ ID NO: 5551251 - DNA, 16 bp, Homo sapiens
acacaatacagtatta

SEQ ID NO: 5551252 - DNA, 18 bp, Homo sapiens
acacaatacatgttttca

SEQ ID NO: 5551253 - DNA, 12 bp, Homo sapiens
acacaataccta

SEQ ID NO: 5551254 - DNA, 15 bp, Homo sapiens
acacaataggtcttt

SEQ ID NO: 5551255 - DNA, 16 bp, Homo sapiens
acacaatatgtatgct

SEQ ID NO: 5551256 - DNA, 22 bp, Homo sapiens
acacaatatgtatgctttttac

SEQ ID NO: 5551257 - DNA, 18 bp, Homo sapiens
acacaatcagaccaagga

SEQ ID NO: 5551258 - DNA, 22 bp, Homo sapiens
acacaatccctggggctgtgca

SEQ ID NO: 5551259 - DNA, 19 bp, Homo sapiens
acacaatcgtattacataa

SEQ ID NO: 5551260 - DNA, 20 bp, Homo sapiens
acacaatgacacatttgttg

SEQ ID NO: 5551261 - DNA, 17 bp, Homo sapiens
acacaatggcacctctg

SEQ ID NO: 5551262 - DNA, 18 bp, Homo sapiens
acacaatggcacctctgc

SEQ ID NO: 5551263 - DNA, 23 bp, Homo sapiens
acacaatggtttttaaattttgt

SEQ ID NO: 5551264 - DNA, 11 bp, Homo sapiens
acacaatgtgg

SEQ ID NO: 5551265 - DNA, 23 bp, Homo sapiens
acacaatgtgtctttctttttgg

SEQ ID NO: 5551266 - DNA, 12 bp, Homo sapiens
acacaatgttat

SEQ ID NO: 5551267 - DNA, 20 bp, Homo sapiens
acacaattaattcatccctt

SEQ ID NO: 5551268 - DNA, 15 bp, Homo sapiens
acacaattaattgtc

SEQ ID NO: 5551269 - DNA, 15 bp, Homo sapiens
acacaattagatttc

SEQ ID NO: 5551270 - DNA, 19 bp, Homo sapiens
acacaattcattggctcct

SEQ ID NO: 5551271 - DNA, 18 bp, Homo sapiens
acacacaaaatgtcacaa

SEQ ID NO: 5551272 - DNA, 14 bp, Homo sapiens
acacacaaagagag

SEQ ID NO: 5551273 - DNA, 20 bp, Homo sapiens
acacacaaatattgcttgga

SEQ ID NO: 5551274 - DNA, 13 bp, Homo sapiens
acacacaaatgca

SEQ ID NO: 5551275 - DNA, 17 bp, Homo sapiens
acacacaaatgcagaca

SEQ ID NO: 5551276 - DNA, 19 bp, Homo sapiens
acacacaaatgcagacaca

SEQ ID NO: 5551277 - DNA, 14 bp, Homo sapiens
acacacaacaaaaa

SEQ ID NO: 5551278 - DNA, 17 bp, Homo sapiens
acacacaacagccaaca

SEQ ID NO: 5551279 - DNA, 16 bp, Homo sapiens
acacacaacatcaaga

SEQ ID NO: 5551280 - DNA, 18 bp, Homo sapiens
acacacaacgtaaaaata

SEQ ID NO: 5551281 - DNA, 14 bp, Homo sapiens
acacacaagtaaga

SEQ ID NO: 5551282 - DNA, 13 bp, Homo sapiens
acacacacaaaac

SEQ ID NO: 5551283 - DNA, 14 bp, Homo sapiens
acacacacaaaaca

SEQ ID NO: 5551284 - DNA, 14 bp, Homo sapiens
acacacacaaatat

SEQ ID NO: 5551285 - DNA, 15 bp, Homo sapiens
acacacacaaatgca

SEQ ID NO: 5551286 - DNA, 13 bp, Homo sapiens
acacacacacaca

SEQ ID NO: 5551287 - DNA, 15 bp, Homo sapiens
acacacacacacagc

SEQ ID NO: 5551288 - DNA, 16 bp, Homo sapiens
acacacacacacatac

SEQ ID NO: 5551289 - DNA, 15 bp, Homo sapiens
acacacacacacatg

SEQ ID NO: 5551290 - DNA, 14 bp, Homo sapiens
acacacacacactt

SEQ ID NO: 5551291 - DNA, 12 bp, Homo sapiens
acacacacacag

SEQ ID NO: 5551292 - DNA, 14 bp, Homo sapiens
acacacacacatac

SEQ ID NO: 5551293 - DNA, 13 bp, Homo sapiens
acacacacacatt

SEQ ID NO: 5551294 - DNA, 16 bp, Homo sapiens
acacacacacgatgca

SEQ ID NO: 5551295 - DNA, 16 bp, Homo sapiens
acacacacacgcacgc

SEQ ID NO: 5551296 - DNA, 14 bp, Homo sapiens
acacacacacgcag

SEQ ID NO: 5551297 - DNA, 11 bp, Homo sapiens
acacacacact

SEQ ID NO: 5551298 - DNA, 12 bp, Homo sapiens
acacacacagaa

SEQ ID NO: 5551299 - DNA, 13 bp, Homo sapiens
acacacacagaaa

SEQ ID NO: 5551300 - DNA, 12 bp, Homo sapiens
acacacacagac

SEQ ID NO: 5551301 - DNA, 15 bp, Homo sapiens
acacacacagacaca

SEQ ID NO: 5551302 - DNA, 15 bp, Homo sapiens
acacacacagacata

SEQ ID NO: 5551303 - DNA, 13 bp, Homo sapiens
acacacacagaga

SEQ ID NO: 5551304 - DNA, 16 bp, Homo sapiens
acacacacagccacac

SEQ ID NO: 5551305 - DNA, 15 bp, Homo sapiens
acacacacagccagg

SEQ ID NO: 5551306 - DNA, 14 bp, Homo sapiens
acacacacagccat

SEQ ID NO: 5551307 - DNA, 13 bp, Homo sapiens
acacacacagctg

SEQ ID NO: 5551308 - DNA, 14 bp, Homo sapiens
acacacacaggagg

SEQ ID NO: 5551309 - DNA, 13 bp, Homo sapiens
acacacacatata

SEQ ID NO: 5551310 - DNA, 14 bp, Homo sapiens
acacacacatccac

SEQ ID NO: 5551311 - DNA, 15 bp, Homo sapiens
acacacacatgcata

SEQ ID NO: 5551312 - DNA, 14 bp, Homo sapiens
acacacacccaggc

SEQ ID NO: 5551313 - DNA, 14 bp, Homo sapiens
acacacacccttcc

SEQ ID NO: 5551314 - DNA, 22 bp, Homo sapiens
acacacacccttccccactccc

SEQ ID NO: 5551315 - DNA, 15 bp, Homo sapiens
acacacaccttgcaa

SEQ ID NO: 5551316 - DNA, 14 bp, Homo sapiens
acacacacgatgca

SEQ ID NO: 5551317 - DNA, 15 bp, Homo sapiens
acacacacgatgcat

SEQ ID NO: 5551318 - DNA, 12 bp, Homo sapiens
acacacacgcac

SEQ ID NO: 5551319 - DNA, 15 bp, Homo sapiens
acacacacgcacata

SEQ ID NO: 5551320 - DNA, 14 bp, Homo sapiens
acacacacgcacgc

SEQ ID NO: 5551321 - DNA, 18 bp, Homo sapiens
acacacacgcagacacac

SEQ ID NO: 5551322 - DNA, 19 bp, Homo sapiens
acacacacgcagacacaca

SEQ ID NO: 5551323 - DNA, 21 bp, Homo sapiens
acacacacgcagacacacaca

SEQ ID NO: 5551324 - DNA, 11 bp, Homo sapiens
acacacactct

SEQ ID NO: 5551325 - DNA, 14 bp, Homo sapiens
acacacactgtctg

SEQ ID NO: 5551326 - DNA, 18 bp, Homo sapiens
acacacactgtctggggc

SEQ ID NO: 5551327 - DNA, 22 bp, Homo sapiens
acacacagaaaatatactgtaa

SEQ ID NO: 5551328 - DNA, 20 bp, Homo sapiens
acacacagaaatgtgtcaat

SEQ ID NO: 5551329 - DNA, 19 bp, Homo sapiens
acacacagatatacacatg

SEQ ID NO: 5551330 - DNA, 14 bp, Homo sapiens
acacacagatgcac

SEQ ID NO: 5551331 - DNA, 13 bp, Homo sapiens
acacacagcagct

SEQ ID NO: 5551332 - DNA, 12 bp, Homo sapiens
acacacagccac

SEQ ID NO: 5551333 - DNA, 13 bp, Homo sapiens
acacacagccaca

SEQ ID NO: 5551334 - DNA, 14 bp, Homo sapiens
acacacagccacac

SEQ ID NO: 5551335 - DNA, 18 bp, Homo sapiens
acacacagccacacacac

SEQ ID NO: 5551336 - DNA, 21 bp, Homo sapiens
acacacagccacacacacaga

SEQ ID NO: 5551337 - DNA, 13 bp, Homo sapiens
acacacagcctgt

SEQ ID NO: 5551338 - DNA, 14 bp, Homo sapiens
acacacagcctttc

SEQ ID NO: 5551339 - DNA, 18 bp, Homo sapiens
acacacagcctttctgta

SEQ ID NO: 5551340 - DNA, 20 bp, Homo sapiens
acacacagctaacacacagc

SEQ ID NO: 5551341 - DNA, 12 bp, Homo sapiens
acacacagctct

SEQ ID NO: 5551342 - DNA, 14 bp, Homo sapiens
acacacagctctgt

SEQ ID NO: 5551343 - DNA, 11 bp, Homo sapiens
acacacagctg

SEQ ID NO: 5551344 - DNA, 19 bp, Homo sapiens
acacacaggaactctgtgt

SEQ ID NO: 5551345 - DNA, 17 bp, Homo sapiens
acacacaggcaactgag

SEQ ID NO: 5551346 - DNA, 12 bp, Homo sapiens
acacacaggcct

SEQ ID NO: 5551347 - DNA, 21 bp, Homo sapiens
acacacaggtggtgtcactgt

SEQ ID NO: 5551348 - DNA, 15 bp, Homo sapiens
acacacagtgacaaa

SEQ ID NO: 5551349 - DNA, 17 bp, Homo sapiens
acacacagttgttgaat

SEQ ID NO: 5551350 - DNA, 18 bp, Homo sapiens
acacacataaaggataaa

SEQ ID NO: 5551351 - DNA, 12 bp, Homo sapiens
acacacatacag

SEQ ID NO: 5551352 - DNA, 13 bp, Homo sapiens
acacacatacaga

SEQ ID NO: 5551353 - DNA, 21 bp, Homo sapiens
acacacatataaacatcacac

SEQ ID NO: 5551354 - DNA, 15 bp, Homo sapiens
acacacatatataca

SEQ ID NO: 5551355 - DNA, 18 bp, Homo sapiens
acacacatatatacatac

SEQ ID NO: 5551356 - DNA, 18 bp, Homo sapiens
acacacatatattatttg

SEQ ID NO: 5551357 - DNA, 14 bp, Homo sapiens
acacacatgcatac

SEQ ID NO: 5551358 - DNA, 16 bp, Homo sapiens
acacacatgcatacac

SEQ ID NO: 5551359 - DNA, 19 bp, Homo sapiens
acacacatgcatacacaca

SEQ ID NO: 5551360 - DNA, 20 bp, Homo sapiens
acacacatgcatacacacac

SEQ ID NO: 5551361 - DNA, 16 bp, Homo sapiens
acacacatgccctcct

SEQ ID NO: 5551362 - DNA, 18 bp, Homo sapiens
acacacatgccctcctgg

SEQ ID NO: 5551363 - DNA, 18 bp, Homo sapiens
acacacatggatgagcac

SEQ ID NO: 5551364 - DNA, 14 bp, Homo sapiens
acacaccaatcagc

SEQ ID NO: 5551365 - DNA, 21 bp, Homo sapiens
acacaccaatcagcgctctgt

SEQ ID NO: 5551366 - DNA, 15 bp, Homo sapiens
acacaccacacatac

SEQ ID NO: 5551367 - DNA, 18 bp, Homo sapiens
acacaccaggctgtgggc

SEQ ID NO: 5551368 - DNA, 22 bp, Homo sapiens
acacaccaggctgtgggcctca

SEQ ID NO: 5551369 - DNA, 14 bp, Homo sapiens
acacaccagtttac

SEQ ID NO: 5551370 - DNA, 13 bp, Homo sapiens
acacaccattttg

SEQ ID NO: 5551371 - DNA, 18 bp, Homo sapiens
acacaccattttgtaagt

SEQ ID NO: 5551372 - DNA, 16 bp, Homo sapiens
acacacccctcaaaaa

SEQ ID NO: 5551373 - DNA, 15 bp, Homo sapiens
acacaggcaactgag

SEQ ID NO: 5551374 - DNA, 16 bp, Homo sapiens
acacaggcaactgagg

SEQ ID NO: 5551375 - DNA, 13 bp, Homo sapiens
acacaggcaggaa

SEQ ID NO: 5551376 - DNA, 13 bp, Homo sapiens
acacaggcagggc

SEQ ID NO: 5551377 - DNA, 20 bp, Homo sapiens
acacaggcagggcctggctc

SEQ ID NO: 5551378 - DNA, 13 bp, Homo sapiens
acacaggcaggta

SEQ ID NO: 5551379 - DNA, 23 bp, Homo sapiens
acacaggcatttcctgggtggct

SEQ ID NO: 5551380 - DNA, 19 bp, Homo sapiens
acacaggccaccctgtgca

SEQ ID NO: 5551381 - DNA, 22 bp, Homo sapiens
acacaggcccggctccaggctc

SEQ ID NO: 5551382 - DNA, 24 bp, Homo sapiens
acacaggcccggctccaggctcct

SEQ ID NO: 5551383 - DNA, 13 bp, Homo sapiens
acacaggccctcc

SEQ ID NO: 5551384 - DNA, 23 bp, Homo sapiens
acacaggcctggcccagccagca

SEQ ID NO: 5551385 - DNA, 12 bp, Homo sapiens
acacaggcctgt

SEQ ID NO: 5551386 - DNA, 15 bp, Homo sapiens
acacaggctcagcat

SEQ ID NO: 5551387 - DNA, 18 bp, Homo sapiens
acacaggctccaaactgg

SEQ ID NO: 5551388 - DNA, 16 bp, Homo sapiens
acacagggaaagcatt

SEQ ID NO: 5551389 - DNA, 17 bp, Homo sapiens
acacagggaaagcattt

SEQ ID NO: 5551390 - DNA, 14 bp, Homo sapiens
acacagggacttga

SEQ ID NO: 5551391 - DNA, 18 bp, Homo sapiens
acacagggacttgaagtt

SEQ ID NO: 5551392 - DNA, 11 bp, Homo sapiens
acacagggcag

SEQ ID NO: 5551393 - DNA, 14 bp, Homo sapiens
acacagggcctgct

SEQ ID NO: 5551394 - DNA, 22 bp, Homo sapiens
acacaggggcttgactttttca

SEQ ID NO: 5551395 - DNA, 21 bp, Homo sapiens
acacaggggtggagtttctga

SEQ ID NO: 5551396 - DNA, 23 bp, Homo sapiens
acacagggtgacggtgacaaaga

SEQ ID NO: 5551397 - DNA, 17 bp, Homo sapiens
acacaggtacagcaaca

SEQ ID NO: 5551398 - DNA, 16 bp, Homo sapiens
acacaggtcagggctc

SEQ ID NO: 5551399 - DNA, 20 bp, Homo sapiens
acacaggtcagggctcagag

SEQ ID NO: 5551400 - DNA, 21 bp, Homo sapiens
acacaggtcagggctcagagt

SEQ ID NO: 5551401 - DNA, 17 bp, Homo sapiens
acacaggtcctgaaagt

SEQ ID NO: 5551402 - DNA, 14 bp, Homo sapiens
acacaggtgagaaa

SEQ ID NO: 5551403 - DNA, 15 bp, Homo sapiens
acacaggtggccatc

SEQ ID NO: 5551404 - DNA, 22 bp, Homo sapiens
acacaggtggggactgggcaca

SEQ ID NO: 5551405 - DNA, 21 bp, Homo sapiens
acacaggtggtgtcactgtcc

SEQ ID NO: 5551406 - DNA, 19 bp, Homo sapiens
acacaggtgttggaagcca

SEQ ID NO: 5551407 - DNA, 18 bp, Homo sapiens
acacaggtttagttgact

SEQ ID NO: 5551408 - DNA, 14 bp, Homo sapiens
acacaggtttgtaa

SEQ ID NO: 5551409 - DNA, 18 bp, Homo sapiens
acacagtactttattgta

SEQ ID NO: 5551410 - DNA, 18 bp, Homo sapiens
acacagtagtgttctgtt

SEQ ID NO: 5551411 - DNA, 16 bp, Homo sapiens
acacagtattacttct

SEQ ID NO: 5551412 - DNA, 18 bp, Homo sapiens
acacagtattacttctgc

SEQ ID NO: 5551413 - DNA, 22 bp, Homo sapiens
acacagtattacttctgctaca

SEQ ID NO: 5551414 - DNA, 21 bp, Homo sapiens
acacagtattcagagtctctg

SEQ ID NO: 5551415 - DNA, 20 bp, Homo sapiens
acacagtattgtagaaagct

SEQ ID NO: 5551416 - DNA, 16 bp, Homo sapiens
acacagtcacccctcc

SEQ ID NO: 5551417 - DNA, 15 bp, Homo sapiens
acacagtcagcatgc

SEQ ID NO: 5551418 - DNA, 14 bp, Homo sapiens
acacagtccccaga

SEQ ID NO: 5551419 - DNA, 17 bp, Homo sapiens
acacagtccccagactc

SEQ ID NO: 5551420 - DNA, 19 bp, Homo sapiens
acacagtcttggctcactg

SEQ ID NO: 5551421 - DNA, 20 bp, Homo sapiens
acacagtgacttcctgggga

SEQ ID NO: 5551422 - DNA, 15 bp, Homo sapiens
acacagtgagactgt

SEQ ID NO: 5551423 - DNA, 23 bp, Homo sapiens
acacagtgagactgtacataatt

SEQ ID NO: 5551424 - DNA, 13 bp, Homo sapiens
acacagtgggccg

SEQ ID NO: 5551425 - DNA, 23 bp, Homo sapiens
acacagtgggccggccccaggct

SEQ ID NO: 5551426 - DNA, 22 bp, Homo sapiens
acacagtgttccagctgcctgg

SEQ ID NO: 5551427 - DNA, 16 bp, Homo sapiens
acacagtgtttcaatt

SEQ ID NO: 5551428 - DNA, 14 bp, Homo sapiens
acacagtgtttcct

SEQ ID NO: 5551429 - DNA, 17 bp, Homo sapiens
acacagttactgactta

SEQ ID NO: 5551430 - DNA, 19 bp, Homo sapiens
acacagttcaacataaaga

SEQ ID NO: 5551431 - DNA, 23 bp, Homo sapiens
acacagttcacaaacagtaaagg

SEQ ID NO: 5551432 - DNA, 15 bp, Homo sapiens
acacagttccacaat

SEQ ID NO: 5551433 - DNA, 15 bp, Homo sapiens
acacagttcctggga

SEQ ID NO: 5551434 - DNA, 16 bp, Homo sapiens
acacagttcctgggaa

SEQ ID NO: 5551435 - DNA, 19 bp, Homo sapiens
acacagttgaccctatttt

SEQ ID NO: 5551436 - DNA, 16 bp, Homo sapiens
acacagttggaagcag

SEQ ID NO: 5551437 - DNA, 18 bp, Homo sapiens
acacagtttaaaaaatca

SEQ ID NO: 5551438 - DNA, 14 bp, Homo sapiens
acacagttttgaaa

SEQ ID NO: 5551439 - DNA, 13 bp, Homo sapiens
acacataaacaat

SEQ ID NO: 5551440 - DNA, 14 bp, Homo sapiens
acacataaacaatt

SEQ ID NO: 5551441 - DNA, 19 bp, Homo sapiens
acacataaaccaaaaccaa

SEQ ID NO: 5551442 - DNA, 12 bp, Homo sapiens
acacataaagga

SEQ ID NO: 5551443 - DNA, 18 bp, Homo sapiens
acacataaaggataaact

SEQ ID NO: 5551444 - DNA, 12 bp, Homo sapiens
acacataaatat

SEQ ID NO: 5551445 - DNA, 21 bp, Homo sapiens
acacataaatctgtctgattc

SEQ ID NO: 5551446 - DNA, 13 bp, Homo sapiens
acacataaatgaa

SEQ ID NO: 5551447 - DNA, 14 bp, Homo sapiens
acacataaatgaaa

SEQ ID NO: 5551448 - DNA, 15 bp, Homo sapiens
acacataaatgaaag

SEQ ID NO: 5551449 - DNA, 16 bp, Homo sapiens
acacataaatgaaaga

SEQ ID NO: 5551450 - DNA, 18 bp, Homo sapiens
acacataaatgaaagaaa

SEQ ID NO: 5551451 - DNA, 14 bp, Homo sapiens
acacataacacaca

SEQ ID NO: 5551452 - DNA, 13 bp, Homo sapiens
acacataattaaa

SEQ ID NO: 5551453 - DNA, 16 bp, Homo sapiens
acacataattaaagtg

SEQ ID NO: 5551454 - DNA, 17 bp, Homo sapiens
acacataattaaagtgt

SEQ ID NO: 5551455 - DNA, 15 bp, Homo sapiens
acacataattaacac

SEQ ID NO: 5551456 - DNA, 11 bp, Homo sapiens
acacatacata

SEQ ID NO: 5551457 - DNA, 16 bp, Homo sapiens
acacatacatacacat

SEQ ID NO: 5551458 - DNA, 14 bp, Homo sapiens
acacatacatcctg

SEQ ID NO: 5551459 - DNA, 18 bp, Homo sapiens
acacatacgtgcacaggg

SEQ ID NO: 5551460 - DNA, 20 bp, Homo sapiens
acacatagattaatggcact

SEQ ID NO: 5551461 - DNA, 13 bp, Homo sapiens
acacatagattca

SEQ ID NO: 5551462 - DNA, 17 bp, Homo sapiens
acacatagattcacctg

SEQ ID NO: 5551463 - DNA, 16 bp, Homo sapiens
acacatagcgccgtgc

SEQ ID NO: 5551464 - DNA, 20 bp, Homo sapiens
acacatagcgccgtgctgta

SEQ ID NO: 5551465 - DNA, 20 bp, Homo sapiens
acacatagttctgtaataaa

SEQ ID NO: 5551466 - DNA, 21 bp, Homo sapiens
acacatagttctgtaataaaa

SEQ ID NO: 5551467 - DNA, 17 bp, Homo sapiens
acacatagtttcttttt

SEQ ID NO: 5551468 - DNA, 15 bp, Homo sapiens
acacatataaacaca

SEQ ID NO: 5551469 - DNA, 21 bp, Homo sapiens
acacatataaacacagtaaga

SEQ ID NO: 5551470 - DNA, 23 bp, Homo sapiens
acacatataaattgtcttaatgg

SEQ ID NO: 5551471 - DNA, 14 bp, Homo sapiens
acacatatacatat

SEQ ID NO: 5551472 - DNA, 15 bp, Homo sapiens
acacatatacatata

SEQ ID NO: 5551473 - DNA, 19 bp, Homo sapiens
acacatatatacatacgca

SEQ ID NO: 5551474 - DNA, 15 bp, Homo sapiens
acacatatataggca

SEQ ID NO: 5551475 - DNA, 21 bp, Homo sapiens
acacatatatataacaaataa

SEQ ID NO: 5551476 - DNA, 16 bp, Homo sapiens
acacatatatattaca

SEQ ID NO: 5551477 - DNA, 16 bp, Homo sapiens
acacatatatgtatac

SEQ ID NO: 5551478 - DNA, 19 bp, Homo sapiens
acacatatgaacacagaca

SEQ ID NO: 5551479 - DNA, 17 bp, Homo sapiens
acacatatgagggggaa

SEQ ID NO: 5551480 - DNA, 20 bp, Homo sapiens
acacatattgttttaaaata

SEQ ID NO: 5551481 - DNA, 20 bp, Homo sapiens
acacatcaagactatctaca

SEQ ID NO: 5551482 - DNA, 18 bp, Homo sapiens
acacatcaccaggtgcat

SEQ ID NO: 5551483 - DNA, 13 bp, Homo sapiens
acacatcagcatg

SEQ ID NO: 5551484 - DNA, 15 bp, Homo sapiens
acacatcatctgtaa

SEQ ID NO: 5551485 - DNA, 18 bp, Homo sapiens
acacatccagctgcccct

SEQ ID NO: 5551486 - DNA, 22 bp, Homo sapiens
acacatcccggcctcttccacc

SEQ ID NO: 5551487 - DNA, 18 bp, Homo sapiens
acacatccgccttttgta

SEQ ID NO: 5551488 - DNA, 16 bp, Homo sapiens
acacatcgcactgtgg

SEQ ID NO: 5551489 - DNA, 12 bp, Homo sapiens
acacatctattg

SEQ ID NO: 5551490 - DNA, 12 bp, Homo sapiens
acacatctcctc

SEQ ID NO: 5551491 - DNA, 16 bp, Homo sapiens
acacatctggccctga

SEQ ID NO: 5551492 - DNA, 14 bp, Homo sapiens
acacatctggctgc

SEQ ID NO: 5551493 - DNA, 22 bp, Homo sapiens
acacatctgggtgccctgaaag

SEQ ID NO: 5551494 - DNA, 13 bp, Homo sapiens
acacatcttaaaa

SEQ ID NO: 5551495 - DNA, 15 bp, Homo sapiens
acacatcttcaacag

SEQ ID NO: 5551496 - DNA, 13 bp, Homo sapiens
acacatctttcct

SEQ ID NO: 5551497 - DNA, 22 bp, Homo sapiens
acacatgaaaggcatcagtccc

SEQ ID NO: 5551498 - DNA, 21 bp, Homo sapiens
acacatgagcatcaggccagg

SEQ ID NO: 5551499 - DNA, 21 bp, Homo sapiens
acacatgcaaggtcatttttt

SEQ ID NO: 5551500 - DNA, 14 bp, Homo sapiens
acacatgcacacac

SEQ ID NO: 5551501 - DNA, 15 bp, Homo sapiens
acacatgcacacaca

SEQ ID NO: 5551502 - DNA, 16 bp, Homo sapiens
acacatgcagaataat

SEQ ID NO: 5551503 - DNA, 14 bp, Homo sapiens
acacatgcatacac

SEQ ID NO: 5551504 - DNA, 15 bp, Homo sapiens
acacatgcatacaca

SEQ ID NO: 5551505 - DNA, 16 bp, Homo sapiens
acacatgcatacacac

SEQ ID NO: 5551506 - DNA, 17 bp, Homo sapiens
acacatgccaacactta

SEQ ID NO: 5551507 - DNA, 18 bp, Homo sapiens
acacatgcccctccccca

SEQ ID NO: 5551508 - DNA, 20 bp, Homo sapiens
acacatgcccctcccccagc

SEQ ID NO: 5551509 - DNA, 15 bp, Homo sapiens
acacatgccctcctg

SEQ ID NO: 5551510 - DNA, 21 bp, Homo sapiens
acacatgcctatattatcata

SEQ ID NO: 5551511 - DNA, 18 bp, Homo sapiens
acacatgccttaaatttg

SEQ ID NO: 5551512 - DNA, 16 bp, Homo sapiens
acacatgctaggatgc

SEQ ID NO: 5551513 - DNA, 22 bp, Homo sapiens
acacatgctctcaatatataat

SEQ ID NO: 5551514 - DNA, 22 bp, Homo sapiens
acacatgctgaggttttgaata

SEQ ID NO: 5551515 - DNA, 18 bp, Homo sapiens
acacatgctgccttcttg

SEQ ID NO: 5551516 - DNA, 23 bp, Homo sapiens
acacatgcttccctttcctgagt

SEQ ID NO: 5551517 - DNA, 15 bp, Homo sapiens
acacatggacacaga

SEQ ID NO: 5551518 - DNA, 13 bp, Homo sapiens
acacatggcagaa

SEQ ID NO: 5551519 - DNA, 14 bp, Homo sapiens
acacatgtaaaata

SEQ ID NO: 5551520 - DNA, 15 bp, Homo sapiens
acacatgtatttggt

SEQ ID NO: 5551521 - DNA, 13 bp, Homo sapiens
acacatgtccaag

SEQ ID NO: 5551522 - DNA, 18 bp, Homo sapiens
acacatgtcctatccaaa

SEQ ID NO: 5551523 - DNA, 20 bp, Homo sapiens
acacatgtcctatccaaagg

SEQ ID NO: 5551524 - DNA, 20 bp, Homo sapiens
acacatgtgctgatgtttac

SEQ ID NO: 5551525 - DNA, 15 bp, Homo sapiens
acacatgtggagaag

SEQ ID NO: 5551526 - DNA, 14 bp, Homo sapiens
acacatgtgttatc

SEQ ID NO: 5551527 - DNA, 15 bp, Homo sapiens
acacatgtgttatct

SEQ ID NO: 5551528 - DNA, 15 bp, Homo sapiens
acacatgttgccttg

SEQ ID NO: 5551529 - DNA, 18 bp, Homo sapiens
acacattaaacaggattt

SEQ ID NO: 5551530 - DNA, 13 bp, Homo sapiens
acacattaaagta

SEQ ID NO: 5551531 - DNA, 15 bp, Homo sapiens
acacattaataaaca

SEQ ID NO: 5551532 - DNA, 16 bp, Homo sapiens
acacattacttgcaca

SEQ ID NO: 5551533 - DNA, 21 bp, Homo sapiens
acacattataaagttcagatg

SEQ ID NO: 5551534 - DNA, 16 bp, Homo sapiens
acacattatagaaatt

SEQ ID NO: 5551535 - DNA, 14 bp, Homo sapiens
acacattatcttct

SEQ ID NO: 5551536 - DNA, 15 bp, Homo sapiens
acacattatcttctg

SEQ ID NO: 5551537 - DNA, 19 bp, Homo sapiens
acacattatgttagagagg

SEQ ID NO: 5551538 - DNA, 16 bp, Homo sapiens
acacattattaagcac

SEQ ID NO: 5551539 - DNA, 13 bp, Homo sapiens
acacattccagcc

SEQ ID NO: 5551540 - DNA, 16 bp, Homo sapiens
acacattccagccagg

SEQ ID NO: 5551541 - DNA, 23 bp, Homo sapiens
acacattccagccaggcccaggc

SEQ ID NO: 5551542 - DNA, 15 bp, Homo sapiens
acacattccagggct

SEQ ID NO: 5551543 - DNA, 16 bp, Homo sapiens
acacattccagggctg

SEQ ID NO: 5551544 - DNA, 11 bp, Homo sapiens
acacattcctt

SEQ ID NO: 5551545 - DNA, 12 bp, Homo sapiens
acacattccttt

SEQ ID NO: 5551546 - DNA, 19 bp, Homo sapiens
acacattctcacaattgta

SEQ ID NO: 5551547 - DNA, 12 bp, Homo sapiens
acacattctcct

SEQ ID NO: 5551548 - DNA, 15 bp, Homo sapiens
acacattctgccttg

SEQ ID NO: 5551549 - DNA, 21 bp, Homo sapiens
acacattctttataaaatgta

SEQ ID NO: 5551550 - DNA, 22 bp, Homo sapiens
acacattgaaactgtatttact

SEQ ID NO: 5551551 - DNA, 18 bp, Homo sapiens
acacattgccccatgaga

SEQ ID NO: 5551552 - DNA, 23 bp, Homo sapiens
acacctggcatggtgcagggaga

SEQ ID NO: 5551553 - DNA, 12 bp, Homo sapiens
acacctggccct

SEQ ID NO: 5551554 - DNA, 20 bp, Homo sapiens
acacctggccgggtcaccct

SEQ ID NO: 5551555 - DNA, 17 bp, Homo sapiens
acacctgggcttaagaa

SEQ ID NO: 5551556 - DNA, 19 bp, Homo sapiens
acacctgggggacagaggc

SEQ ID NO: 5551557 - DNA, 18 bp, Homo sapiens
acacctggtgcgggcctg

SEQ ID NO: 5551558 - DNA, 21 bp, Homo sapiens
acacctggtgcgggcctggcc

SEQ ID NO: 5551559 - DNA, 23 bp, Homo sapiens
acacctggtgcgggcctggccct

SEQ ID NO: 5551560 - DNA, 13 bp, Homo sapiens
acacctgtaatcc

SEQ ID NO: 5551561 - DNA, 13 bp, Homo sapiens
acacctgtacatt

SEQ ID NO: 5551562 - DNA, 20 bp, Homo sapiens
acacctgtagcacttactgg

SEQ ID NO: 5551563 - DNA, 16 bp, Homo sapiens
acacctgtagtcccag

SEQ ID NO: 5551564 - DNA, 17 bp, Homo sapiens
acacctgtctgtgcaga

SEQ ID NO: 5551565 - DNA, 21 bp, Homo sapiens
acacctgtctgtgcagatgct

SEQ ID NO: 5551566 - DNA, 13 bp, Homo sapiens
acacctgtcttga

SEQ ID NO: 5551567 - DNA, 16 bp, Homo sapiens
acacctgtcttgaata

SEQ ID NO: 5551568 - DNA, 16 bp, Homo sapiens
acacctgttcacagaa

SEQ ID NO: 5551569 - DNA, 22 bp, Homo sapiens
acaccttagacggaggtgcctg

SEQ ID NO: 5551570 - DNA, 15 bp, Homo sapiens
acaccttatatttac

SEQ ID NO: 5551571 - DNA, 20 bp, Homo sapiens
acaccttccagctcctgtaa

SEQ ID NO: 5551572 - DNA, 14 bp, Homo sapiens
acaccttccagggc

SEQ ID NO: 5551573 - DNA, 14 bp, Homo sapiens
acaccttcccagct

SEQ ID NO: 5551574 - DNA, 17 bp, Homo sapiens
acaccttcctcctgcag

SEQ ID NO: 5551575 - DNA, 12 bp, Homo sapiens
acaccttctata

SEQ ID NO: 5551576 - DNA, 21 bp, Homo sapiens
acaccttcttattatatatat

SEQ ID NO: 5551577 - DNA, 17 bp, Homo sapiens
acaccttcttggcttct

SEQ ID NO: 5551578 - DNA, 16 bp, Homo sapiens
acaccttgacagggca

SEQ ID NO: 5551579 - DNA, 23 bp, Homo sapiens
acaccttggacatcctcctccca

SEQ ID NO: 5551580 - DNA, 22 bp, Homo sapiens
acaccttggcttgttattgcct

SEQ ID NO: 5551581 - DNA, 23 bp, Homo sapiens
acaccttgtgaccttctctatat

SEQ ID NO: 5551582 - DNA, 15 bp, Homo sapiens
acacctttatctcaa

SEQ ID NO: 5551583 - DNA, 19 bp, Homo sapiens
acacctttatctcaagata

SEQ ID NO: 5551584 - DNA, 22 bp, Homo sapiens
acacctttattcagaactttag

SEQ ID NO: 5551585 - DNA, 21 bp, Homo sapiens
acacctttgttttgcactgac

SEQ ID NO: 5551586 - DNA, 22 bp, Homo sapiens
acaccttttgtatttaaaacct

SEQ ID NO: 5551587 - DNA, 13 bp, Homo sapiens
acacgaaacttgt

SEQ ID NO: 5551588 - DNA, 23 bp, Homo sapiens
acacgaaacttgttattgtgaat

SEQ ID NO: 5551589 - DNA, 15 bp, Homo sapiens
acacgaaagaaatgt

SEQ ID NO: 5551590 - DNA, 13 bp, Homo sapiens
acacgaaagagag

SEQ ID NO: 5551591 - DNA, 14 bp, Homo sapiens
acacgaaagagaga

SEQ ID NO: 5551592 - DNA, 18 bp, Homo sapiens
acacgaagaaatagaata

SEQ ID NO: 5551593 - DNA, 15 bp, Homo sapiens
acacgaatattgctg

SEQ ID NO: 5551594 - DNA, 21 bp, Homo sapiens
acacgaatattgctgatggtg

SEQ ID NO: 5551595 - DNA, 19 bp, Homo sapiens
acacgacagcacacacagt

SEQ ID NO: 5551596 - DNA, 18 bp, Homo sapiens
acacgagcaaacccagag

SEQ ID NO: 5551597 - DNA, 18 bp, Homo sapiens
acacgagccacaagctgc

SEQ ID NO: 5551598 - DNA, 14 bp, Homo sapiens
acacgatgcattta

SEQ ID NO: 5551599 - DNA, 19 bp, Homo sapiens
acacgatgcatttaataaa

SEQ ID NO: 5551600 - DNA, 24 bp, Homo sapiens
acacgatgcatttaataaagatga

SEQ ID NO: 5551601 - DNA, 20 bp, Homo sapiens
acacgattagctttattatg

SEQ ID NO: 5551602 - DNA, 17 bp, Homo sapiens
acacgattttattgctg

SEQ ID NO: 5551603 - DNA, 23 bp, Homo sapiens
acacgattttcaagattctaaag

SEQ ID NO: 5551604 - DNA, 13 bp, Homo sapiens
acacgcacaaaca

SEQ ID NO: 5551605 - DNA, 15 bp, Homo sapiens
acacgcacaaacaca

SEQ ID NO: 5551606 - DNA, 20 bp, Homo sapiens
acacgcacacacacacacag

SEQ ID NO: 5551607 - DNA, 21 bp, Homo sapiens
acacgcacatatacacacaca

SEQ ID NO: 5551608 - DNA, 14 bp, Homo sapiens
acacgcacgcacac

SEQ ID NO: 5551609 - DNA, 13 bp, Homo sapiens
acacgcagacaca

SEQ ID NO: 5551610 - DNA, 17 bp, Homo sapiens
acacgcagcctgctctg

SEQ ID NO: 5551611 - DNA, 18 bp, Homo sapiens
acacgcagcctgctctgg

SEQ ID NO: 5551612 - DNA, 13 bp, Homo sapiens
acacgcaggagca

SEQ ID NO: 5551613 - DNA, 14 bp, Homo sapiens
acacgcaggagcac

SEQ ID NO: 5551614 - DNA, 15 bp, Homo sapiens
acacgcaggagcaca

SEQ ID NO: 5551615 - DNA, 12 bp, Homo sapiens
acacgcaggcgg

SEQ ID NO: 5551616 - DNA, 23 bp, Homo sapiens
acacgcaggcggccagggcggcc

SEQ ID NO: 5551617 - DNA, 13 bp, Homo sapiens
acacgcagttgct

SEQ ID NO: 5551618 - DNA, 21 bp, Homo sapiens
acacgcatgcctcagccagcc

SEQ ID NO: 5551619 - DNA, 13 bp, Homo sapiens
acacgcatgggca

SEQ ID NO: 5551620 - DNA, 16 bp, Homo sapiens
acacgcatgggcattg

SEQ ID NO: 5551621 - DNA, 17 bp, Homo sapiens
acacgcatgggcattgc

SEQ ID NO: 5551622 - DNA, 21 bp, Homo sapiens
acacgcatgggcattgcagcc

SEQ ID NO: 5551623 - DNA, 22 bp, Homo sapiens
acacgcatgggcattgcagcct

SEQ ID NO: 5551624 - DNA, 14 bp, Homo sapiens
acacgccagctcct

SEQ ID NO: 5551625 - DNA, 21 bp, Homo sapiens
acacgccccaattttcaggta

SEQ ID NO: 5551626 - DNA, 14 bp, Homo sapiens
acacgccctcttag

SEQ ID NO: 5551627 - DNA, 19 bp, Homo sapiens
acacgccggggctggccct

SEQ ID NO: 5551628 - DNA, 21 bp, Homo sapiens
acacgcctgagagtggcactg

SEQ ID NO: 5551629 - DNA, 14 bp, Homo sapiens
acacgccttcatgc

SEQ ID NO: 5551630 - DNA, 20 bp, Homo sapiens
acacgcgcccccctcccaga

SEQ ID NO: 5551631 - DNA, 22 bp, Homo sapiens
acacgcgcccccctcccagagg

SEQ ID NO: 5551632 - DNA, 13 bp, Homo sapiens
acacgcgcgcaca

SEQ ID NO: 5551633 - DNA, 21 bp, Homo sapiens
acacgcgggcgcgatcccaca

SEQ ID NO: 5551634 - DNA, 18 bp, Homo sapiens
acacgcgtccacatacac

SEQ ID NO: 5551635 - DNA, 19 bp, Homo sapiens
acacgcgtccacatacact

SEQ ID NO: 5551636 - DNA, 14 bp, Homo sapiens
acacgcgtgattga

SEQ ID NO: 5551637 - DNA, 16 bp, Homo sapiens
acacgcgtgattgacc

SEQ ID NO: 5551638 - DNA, 14 bp, Homo sapiens
acacgctcctccct

SEQ ID NO: 5551639 - DNA, 16 bp, Homo sapiens
acacgctccttcctct

SEQ ID NO: 5551640 - DNA, 12 bp, Homo sapiens
acacgcttctga

SEQ ID NO: 5551641 - DNA, 16 bp, Homo sapiens
acacgcttctgagcag

SEQ ID NO: 5551642 - DNA, 14 bp, Homo sapiens
acacgcttttgtga

SEQ ID NO: 5551643 - DNA, 15 bp, Homo sapiens
acacggaccatgtgg

SEQ ID NO: 5551644 - DNA, 15 bp, Homo sapiens
acacggaccctgtgt

SEQ ID NO: 5551645 - DNA, 16 bp, Homo sapiens
acacggagctcctggc

SEQ ID NO: 5551646 - DNA, 18 bp, Homo sapiens
acacggaggcatctgcac

SEQ ID NO: 5551647 - DNA, 14 bp, Homo sapiens
acacggaggccaga

SEQ ID NO: 5551648 - DNA, 23 bp, Homo sapiens
acacggatgcacagagatatgca

SEQ ID NO: 5551649 - DNA, 13 bp, Homo sapiens
acacggcagcccc

SEQ ID NO: 5551650 - DNA, 20 bp, Homo sapiens
acacggccacatcaaagagg

SEQ ID NO: 5551651 - DNA, 13 bp, Homo sapiens
acacggccacccg

SEQ ID NO: 5551652 - DNA, 16 bp, Homo sapiens
acacggccctcctggg

SEQ ID NO: 5551653 - DNA, 18 bp, Homo sapiens
acacggccctcctgggaa

SEQ ID NO: 5551654 - DNA, 12 bp, Homo sapiens
acacggccctgc

SEQ ID NO: 5551655 - DNA, 13 bp, Homo sapiens
acacggccctgcc

SEQ ID NO: 5551656 - DNA, 17 bp, Homo sapiens
acacggccctgccccat

SEQ ID NO: 5551657 - DNA, 21 bp, Homo sapiens
acacggccctgccccatcctg

SEQ ID NO: 5551658 - DNA, 22 bp, Homo sapiens
acacggccctgccccatcctgg

SEQ ID NO: 5551659 - DNA, 23 bp, Homo sapiens
acacggccctgccccatcctggg

SEQ ID NO: 5551660 - DNA, 15 bp, Homo sapiens
acacggctcccccag

SEQ ID NO: 5551661 - DNA, 18 bp, Homo sapiens
acacggctcccccaggcc

SEQ ID NO: 5551662 - DNA, 22 bp, Homo sapiens
acacggctggtcactctgccct

SEQ ID NO: 5551663 - DNA, 23 bp, Homo sapiens
acacggctggtcactctgccctc

SEQ ID NO: 5551664 - DNA, 14 bp, Homo sapiens
acacggcttctcat

SEQ ID NO: 5551665 - DNA, 20 bp, Homo sapiens
acacgggagccgctggcaga

SEQ ID NO: 5551666 - DNA, 21 bp, Homo sapiens
acacgggagggtttggggaca

SEQ ID NO: 5551667 - DNA, 19 bp, Homo sapiens
acacgggcagcctggctcc

SEQ ID NO: 5551668 - DNA, 13 bp, Homo sapiens
acacggggcagga

SEQ ID NO: 5551669 - DNA, 16 bp, Homo sapiens
acacggggtattttag

SEQ ID NO: 5551670 - DNA, 15 bp, Homo sapiens
acacggtaggccaag

SEQ ID NO: 5551671 - DNA, 18 bp, Homo sapiens
acacggtttaactgtccc

SEQ ID NO: 5551672 - DNA, 22 bp, Homo sapiens
acacggtttgaagcctggaaca

SEQ ID NO: 5551673 - DNA, 23 bp, Homo sapiens
acacgtacttaaatgaaagcatg

SEQ ID NO: 5551674 - DNA, 19 bp, Homo sapiens
acacgtatttgaatggcct

SEQ ID NO: 5551675 - DNA, 13 bp, Homo sapiens
acacgtcattgtg

SEQ ID NO: 5551676 - DNA, 20 bp, Homo sapiens
acacgtccactcccaagcca

SEQ ID NO: 5551677 - DNA, 23 bp, Homo sapiens
acacgtctatgcaattgtacaaa

SEQ ID NO: 5551678 - DNA, 17 bp, Homo sapiens
acacgtctgaccctctc

SEQ ID NO: 5551679 - DNA, 16 bp, Homo sapiens
acacgtgatggaccaa

SEQ ID NO: 5551680 - DNA, 24 bp, Homo sapiens
acacgtggaggaatgctcccccat

SEQ ID NO: 5551681 - DNA, 16 bp, Homo sapiens
acacgtgggctcccct

SEQ ID NO: 5551682 - DNA, 19 bp, Homo sapiens
acacgtgggctcccctctt

SEQ ID NO: 5551683 - DNA, 14 bp, Homo sapiens
acacgtgtctataa

SEQ ID NO: 5551684 - DNA, 17 bp, Homo sapiens
acacgtgtgatgtatgt

SEQ ID NO: 5551685 - DNA, 13 bp, Homo sapiens
acacgtgtgtatg

SEQ ID NO: 5551686 - DNA, 14 bp, Homo sapiens
acacgtgtgtatga

SEQ ID NO: 5551687 - DNA, 13 bp, Homo sapiens
acacgttgccagg

SEQ ID NO: 5551688 - DNA, 18 bp, Homo sapiens
acacgtttaatcccagca

SEQ ID NO: 5551689 - DNA, 21 bp, Homo sapiens
acacgtttaatcccagcactt

SEQ ID NO: 5551690 - DNA, 18 bp, Homo sapiens
acacgtttgatttcttcc

SEQ ID NO: 5551691 - DNA, 14 bp, Homo sapiens
acactaaaaataaa

SEQ ID NO: 5551692 - DNA, 15 bp, Homo sapiens
acactaaacagacta

SEQ ID NO: 5551693 - DNA, 21 bp, Homo sapiens
acactaaacagactatttaac

SEQ ID NO: 5551694 - DNA, 17 bp, Homo sapiens
acactaaaccaagttat

SEQ ID NO: 5551695 - DNA, 16 bp, Homo sapiens
acactaaactctgggg

SEQ ID NO: 5551696 - DNA, 13 bp, Homo sapiens
acactaaagactg

SEQ ID NO: 5551697 - DNA, 20 bp, Homo sapiens
acactaaaggaggaggagcc

SEQ ID NO: 5551698 - DNA, 18 bp, Homo sapiens
acactaaaggtggaaata

SEQ ID NO: 5551699 - DNA, 16 bp, Homo sapiens
acactaaagtgcatta

SEQ ID NO: 5551700 - DNA, 19 bp, Homo sapiens
acactaaatgttaaagatg

SEQ ID NO: 5551701 - DNA, 20 bp, Homo sapiens
acactaaatgttaaagatgt

SEQ ID NO: 5551702 - DNA, 21 bp, Homo sapiens
acactaaatgttaaagatgta

SEQ ID NO: 5551703 - DNA, 15 bp, Homo sapiens
acactaaattagttt

SEQ ID NO: 5551704 - DNA, 15 bp, Homo sapiens
acactaaattattag

SEQ ID NO: 5551705 - DNA, 18 bp, Homo sapiens
acactaaattgcagttta

SEQ ID NO: 5551706 - DNA, 20 bp, Homo sapiens
acactaacaaaatttgaata

SEQ ID NO: 5551707 - DNA, 20 bp, Homo sapiens
acactaaccaaacaatgcag

SEQ ID NO: 5551708 - DNA, 17 bp, Homo sapiens
acactaaccacgctgga

SEQ ID NO: 5551709 - DNA, 19 bp, Homo sapiens
acactaaccacgctggacc

SEQ ID NO: 5551710 - DNA, 21 bp, Homo sapiens
acactaacgaaatatcaaagt

SEQ ID NO: 5551711 - DNA, 17 bp, Homo sapiens
acactaagaaaatagca

SEQ ID NO: 5551712 - DNA, 19 bp, Homo sapiens
acactaagagagaatgaga

SEQ ID NO: 5551713 - DNA, 17 bp, Homo sapiens
acactaagaggaggcag

SEQ ID NO: 5551714 - DNA, 12 bp, Homo sapiens
acactaaggctg

SEQ ID NO: 5551715 - DNA, 23 bp, Homo sapiens
acactaagtgagagttggggaga

SEQ ID NO: 5551716 - DNA, 13 bp, Homo sapiens
acactaatacact

SEQ ID NO: 5551717 - DNA, 17 bp, Homo sapiens
acactaatatatggacc

SEQ ID NO: 5551718 - DNA, 23 bp, Homo sapiens
acactaatatatggacctagctt

SEQ ID NO: 5551719 - DNA, 14 bp, Homo sapiens
acactaatatattt

SEQ ID NO: 5551720 - DNA, 17 bp, Homo sapiens
acactaatatatttaaa

SEQ ID NO: 5551721 - DNA, 21 bp, Homo sapiens
acactaatatatttaaaaata

SEQ ID NO: 5551722 - DNA, 22 bp, Homo sapiens
acactaatatatttaaaaataa

SEQ ID NO: 5551723 - DNA, 20 bp, Homo sapiens
acactaatgagtatttggta

SEQ ID NO: 5551724 - DNA, 13 bp, Homo sapiens
acactaatggcca

SEQ ID NO: 5551725 - DNA, 14 bp, Homo sapiens
acactaattcctta

SEQ ID NO: 5551726 - DNA, 15 bp, Homo sapiens
acactaattccttaa

SEQ ID NO: 5551727 - DNA, 18 bp, Homo sapiens
acactaattccttaaatg

SEQ ID NO: 5551728 - DNA, 19 bp, Homo sapiens
acactaattccttaaatga

SEQ ID NO: 5551729 - DNA, 19 bp, Homo sapiens
acacttagggtttggagct

SEQ ID NO: 5551730 - DNA, 20 bp, Homo sapiens
acacttagtgatcatttaaa

SEQ ID NO: 5551731 - DNA, 23 bp, Homo sapiens
acacttataaatatcctgctcac

SEQ ID NO: 5551732 - DNA, 15 bp, Homo sapiens
acacttatattttat

SEQ ID NO: 5551733 - DNA, 24 bp, Homo sapiens
acacttatattttatgaacattgt

SEQ ID NO: 5551734 - DNA, 15 bp, Homo sapiens
acacttatcagcagc

SEQ ID NO: 5551735 - DNA, 14 bp, Homo sapiens
acacttatcttctg

SEQ ID NO: 5551736 - DNA, 19 bp, Homo sapiens
acacttatggggacagcat

SEQ ID NO: 5551737 - DNA, 14 bp, Homo sapiens
acacttatttatga

SEQ ID NO: 5551738 - DNA, 16 bp, Homo sapiens
acacttatttatgaat

SEQ ID NO: 5551739 - DNA, 15 bp, Homo sapiens
acacttatttgtcaa

SEQ ID NO: 5551740 - DNA, 23 bp, Homo sapiens
acacttattttacacagcaattt

SEQ ID NO: 5551741 - DNA, 15 bp, Homo sapiens
acacttattttctga

SEQ ID NO: 5551742 - DNA, 18 bp, Homo sapiens
acacttattttctgaatt

SEQ ID NO: 5551743 - DNA, 21 bp, Homo sapiens
acacttcacaaagccaagcct

SEQ ID NO: 5551744 - DNA, 16 bp, Homo sapiens
acacttcacctccttc

SEQ ID NO: 5551745 - DNA, 18 bp, Homo sapiens
acacttcacgtattcttg

SEQ ID NO: 5551746 - DNA, 18 bp, Homo sapiens
acacttcagagagctggt

SEQ ID NO: 5551747 - DNA, 14 bp, Homo sapiens
acacttcagagtaa

SEQ ID NO: 5551748 - DNA, 19 bp, Homo sapiens
acacttcagatctgaggtt

SEQ ID NO: 5551749 - DNA, 18 bp, Homo sapiens
acacttcagcctgtgcag

SEQ ID NO: 5551750 - DNA, 22 bp, Homo sapiens
acacttcaggctcttctccttt

SEQ ID NO: 5551751 - DNA, 16 bp, Homo sapiens
acacttcatggaccaa

SEQ ID NO: 5551752 - DNA, 18 bp, Homo sapiens
acacttcatggaccaaga

SEQ ID NO: 5551753 - DNA, 13 bp, Homo sapiens
acacttcattgta

SEQ ID NO: 5551754 - DNA, 12 bp, Homo sapiens
acacttcatttt

SEQ ID NO: 5551755 - DNA, 23 bp, Homo sapiens
acacttccaaagactccctccat

SEQ ID NO: 5551756 - DNA, 16 bp, Homo sapiens
acacttccaccagcct

SEQ ID NO: 5551757 - DNA, 15 bp, Homo sapiens
acacttccagtctgg

SEQ ID NO: 5551758 - DNA, 20 bp, Homo sapiens
acacttccagtctggagagc

SEQ ID NO: 5551759 - DNA, 15 bp, Homo sapiens
acacttcccaccccc

SEQ ID NO: 5551760 - DNA, 17 bp, Homo sapiens
acacttcccacccccag

SEQ ID NO: 5551761 - DNA, 17 bp, Homo sapiens
acacttccccatctttg

SEQ ID NO: 5551762 - DNA, 20 bp, Homo sapiens
acacttccccatctttgatc

SEQ ID NO: 5551763 - DNA, 13 bp, Homo sapiens
acacttcctgcct

SEQ ID NO: 5551764 - DNA, 14 bp, Homo sapiens
acacttcctgtcca

SEQ ID NO: 5551765 - DNA, 16 bp, Homo sapiens
acacttcctgtccaga

SEQ ID NO: 5551766 - DNA, 15 bp, Homo sapiens
acacttcctgtcctt

SEQ ID NO: 5551767 - DNA, 18 bp, Homo sapiens
acacttcctgtgccatgt

SEQ ID NO: 5551768 - DNA, 15 bp, Homo sapiens
acacttcgctcttga

SEQ ID NO: 5551769 - DNA, 17 bp, Homo sapiens
acacttcgctcttgagg

SEQ ID NO: 5551770 - DNA, 16 bp, Homo sapiens
acacttcgttcgcaga

SEQ ID NO: 5551771 - DNA, 16 bp, Homo sapiens
acacttctcaggaaat

SEQ ID NO: 5551772 - DNA, 14 bp, Homo sapiens
acacttctcaggac

SEQ ID NO: 5551773 - DNA, 16 bp, Homo sapiens
acacttctcaggacac

SEQ ID NO: 5551774 - DNA, 23 bp, Homo sapiens
acacttctcaggacacaggcctg

SEQ ID NO: 5551775 - DNA, 24 bp, Homo sapiens
acacttctcaggacacaggcctgt

SEQ ID NO: 5551776 - DNA, 19 bp, Homo sapiens
acacttctcatcatattgt

SEQ ID NO: 5551777 - DNA, 14 bp, Homo sapiens
acacttctccttaa

SEQ ID NO: 5551778 - DNA, 18 bp, Homo sapiens
acacttctccttatcttt

SEQ ID NO: 5551779 - DNA, 20 bp, Homo sapiens
acacttctcttaagtggtct

SEQ ID NO: 5551780 - DNA, 12 bp, Homo sapiens
acacttctgctt

SEQ ID NO: 5551781 - DNA, 19 bp, Homo sapiens
acacttctggctcacagga

SEQ ID NO: 5551782 - DNA, 12 bp, Homo sapiens
acacttctgtat

SEQ ID NO: 5551783 - DNA, 23 bp, Homo sapiens
acacttctgtgagacccccacac

SEQ ID NO: 5551784 - DNA, 13 bp, Homo sapiens
acacttcttaaat

SEQ ID NO: 5551785 - DNA, 17 bp, Homo sapiens
acacttcttaccccagc

SEQ ID NO: 5551786 - DNA, 19 bp, Homo sapiens
acacttcttgaaacagcct

SEQ ID NO: 5551787 - DNA, 21 bp, Homo sapiens
acacttcttgaaacagcctgg

SEQ ID NO: 5551788 - DNA, 13 bp, Homo sapiens
acacttgaaacct

SEQ ID NO: 5551789 - DNA, 14 bp, Homo sapiens
acacttgagaggat

SEQ ID NO: 5551790 - DNA, 16 bp, Homo sapiens
acacttgagatgattt

SEQ ID NO: 5551791 - DNA, 17 bp, Homo sapiens
acacttgagttaacttt

SEQ ID NO: 5551792 - DNA, 20 bp, Homo sapiens
acacttgcatacatatatat

SEQ ID NO: 5551793 - DNA, 13 bp, Homo sapiens
acacttgccctgc

SEQ ID NO: 5551794 - DNA, 15 bp, Homo sapiens
acacttggagcccgt

SEQ ID NO: 5551795 - DNA, 14 bp, Homo sapiens
acacttggattttt

SEQ ID NO: 5551796 - DNA, 22 bp, Homo sapiens
acacttggcccaagtggcagag

SEQ ID NO: 5551797 - DNA, 17 bp, Homo sapiens
acacttgggctggcacc

SEQ ID NO: 5551798 - DNA, 18 bp, Homo sapiens
acacttgggctggcaccc

SEQ ID NO: 5551799 - DNA, 20 bp, Homo sapiens
acacttggggagatttgcca

SEQ ID NO: 5551800 - DNA, 14 bp, Homo sapiens
acacttggtaattg

SEQ ID NO: 5551801 - DNA, 16 bp, Homo sapiens
acacttggtgctggga

SEQ ID NO: 5551802 - DNA, 16 bp, Homo sapiens
acacttgtataaatgt

SEQ ID NO: 5551803 - DNA, 17 bp, Homo sapiens
acacttgtataaatgta

SEQ ID NO: 5551804 - DNA, 19 bp, Homo sapiens
acacttgtccccaaatccg

SEQ ID NO: 5551805 - DNA, 12 bp, Homo sapiens
acacttgtgaat

SEQ ID NO: 5551806 - DNA, 13 bp, Homo sapiens
acacttgtgaata

SEQ ID NO: 5551807 - DNA, 19 bp, Homo sapiens
acacttgtgattataaaat

SEQ ID NO: 5551808 - DNA, 14 bp, Homo sapiens
acacttgtgccagc

SEQ ID NO: 5551809 - DNA, 22 bp, Homo sapiens
acacttgttcaacagtttctca

SEQ ID NO: 5551810 - DNA, 23 bp, Homo sapiens
acacttgttgattaatggaaatg

SEQ ID NO: 5551811 - DNA, 13 bp, Homo sapiens
acactttacctct

SEQ ID NO: 5551812 - DNA, 20 bp, Homo sapiens
acactttagttatattcact

SEQ ID NO: 5551813 - DNA, 15 bp, Homo sapiens
acactttatacttgc

SEQ ID NO: 5551814 - DNA, 22 bp, Homo sapiens
acactttatgccggatgtgctt

SEQ ID NO: 5551815 - DNA, 23 bp, Homo sapiens
acactttatgccggatgtgcttt

SEQ ID NO: 5551816 - DNA, 14 bp, Homo sapiens
acactttattcttt

SEQ ID NO: 5551817 - DNA, 18 bp, Homo sapiens
acactttcactggggatc

SEQ ID NO: 5551818 - DNA, 16 bp, Homo sapiens
acactttcatttagta

SEQ ID NO: 5551819 - DNA, 15 bp, Homo sapiens
acactttccatctct

SEQ ID NO: 5551820 - DNA, 15 bp, Homo sapiens
acactttcctcttct

SEQ ID NO: 5551821 - DNA, 12 bp, Homo sapiens
acactttctctt

SEQ ID NO: 5551822 - DNA, 19 bp, Homo sapiens
acactttctgactgcaact

SEQ ID NO: 5551823 - DNA, 13 bp, Homo sapiens
acactttctggca

SEQ ID NO: 5551824 - DNA, 20 bp, Homo sapiens
acactttgaaatgtgtttct

SEQ ID NO: 5551825 - DNA, 21 bp, Homo sapiens
acactttgaaatgtgtttctg

SEQ ID NO: 5551826 - DNA, 23 bp, Homo sapiens
acactttgaaatgtgtttctgta

SEQ ID NO: 5551827 - DNA, 22 bp, Homo sapiens
acactttgcactgatatatcat

SEQ ID NO: 5551828 - DNA, 18 bp, Homo sapiens
acactttgccaaggctct

SEQ ID NO: 5551829 - DNA, 20 bp, Homo sapiens
acactttgccaaggctctcc

SEQ ID NO: 5551830 - DNA, 19 bp, Homo sapiens
acactttgcctcctgtgta

SEQ ID NO: 5551831 - DNA, 17 bp, Homo sapiens
acactttgctttctgaa

SEQ ID NO: 5551832 - DNA, 22 bp, Homo sapiens
acactttggaagtttgtgttct

SEQ ID NO: 5551833 - DNA, 22 bp, Homo sapiens
acactttggccaagcaagaggt

SEQ ID NO: 5551834 - DNA, 17 bp, Homo sapiens
acactttggcccagggt

SEQ ID NO: 5551835 - DNA, 16 bp, Homo sapiens
acactttggtaccaga

SEQ ID NO: 5551836 - DNA, 16 bp, Homo sapiens
acactttggtcatttc

SEQ ID NO: 5551837 - DNA, 23 bp, Homo sapiens
acactttgttgcaagatgtgaat

SEQ ID NO: 5551838 - DNA, 16 bp, Homo sapiens
acacttttaaaataaa

SEQ ID NO: 5551839 - DNA, 19 bp, Homo sapiens
acacttttaaaataaattc

SEQ ID NO: 5551840 - DNA, 22 bp, Homo sapiens
acacttttatatttgaaaaaat

SEQ ID NO: 5551841 - DNA, 20 bp, Homo sapiens
acacttttcatgtgtgattt

SEQ ID NO: 5551842 - DNA, 13 bp, Homo sapiens
acacttttgcaca

SEQ ID NO: 5551843 - DNA, 17 bp, Homo sapiens
acacttttggaaccatg

SEQ ID NO: 5551844 - DNA, 18 bp, Homo sapiens
acactttttacagcagca

SEQ ID NO: 5551845 - DNA, 21 bp, Homo sapiens
acactttttgtattttttcct

SEQ ID NO: 5551846 - DNA, 23 bp, Homo sapiens
acactttttgtattttttcctta

SEQ ID NO: 5551847 - DNA, 22 bp, Homo sapiens
acacttttttggggatatgctt

SEQ ID NO: 5551848 - DNA, 23 bp, Homo sapiens
acagaaaaaataaactgagttta

SEQ ID NO: 5551849 - DNA, 11 bp, Homo sapiens
acagaaaaacc

SEQ ID NO: 5551850 - DNA, 21 bp, Homo sapiens
acagaaaaaccttgggttaga

SEQ ID NO: 5551851 - DNA, 15 bp, Homo sapiens
acagaaaaagacttt

SEQ ID NO: 5551852 - DNA, 16 bp, Homo sapiens
acagaaaaataagtca

SEQ ID NO: 5551853 - DNA, 23 bp, Homo sapiens
acagaaaaataagtcaaaaggaa

SEQ ID NO: 5551854 - DNA, 15 bp, Homo sapiens
acagaaaaatcttgt

SEQ ID NO: 5551855 - DNA, 21 bp, Homo sapiens
acagaaaacaaaagagagaat

SEQ ID NO: 5551856 - DNA, 12 bp, Homo sapiens
acagaaaacaac

SEQ ID NO: 5551857 - DNA, 14 bp, Homo sapiens
acagaaaacaacaa

SEQ ID NO: 5551858 - DNA, 18 bp, Homo sapiens
acagaaaacaacaaaaaa

SEQ ID NO: 5551859 - DNA, 18 bp, Homo sapiens
acagaaaacaacaaaaga

SEQ ID NO: 5551860 - DNA, 22 bp, Homo sapiens
acagaaaacattctgatttgga

SEQ ID NO: 5551861 - DNA, 20 bp, Homo sapiens
acagaaaacggttaaaactg

SEQ ID NO: 5551862 - DNA, 17 bp, Homo sapiens
acagaaaactagaattt

SEQ ID NO: 5551863 - DNA, 14 bp, Homo sapiens
acagaaaagaaagc

SEQ ID NO: 5551864 - DNA, 16 bp, Homo sapiens
acagaaaagaaagctg

SEQ ID NO: 5551865 - DNA, 18 bp, Homo sapiens
acagaaaagacaaacagt

SEQ ID NO: 5551866 - DNA, 12 bp, Homo sapiens
acagaaaagaga

SEQ ID NO: 5551867 - DNA, 16 bp, Homo sapiens
acagaaaagagaagaa

SEQ ID NO: 5551868 - DNA, 21 bp, Homo sapiens
acagaaaagagaagaaagaag

SEQ ID NO: 5551869 - DNA, 12 bp, Homo sapiens
acagaaaatata

SEQ ID NO: 5551870 - DNA, 18 bp, Homo sapiens
acagaaaatatactgtaa

SEQ ID NO: 5551871 - DNA, 20 bp, Homo sapiens
acagaaaatatactgtaaag

SEQ ID NO: 5551872 - DNA, 19 bp, Homo sapiens
acagaaaatgaaagaaact

SEQ ID NO: 5551873 - DNA, 12 bp, Homo sapiens
acagaaaatgct

SEQ ID NO: 5551874 - DNA, 13 bp, Homo sapiens
acagaaaatgctg

SEQ ID NO: 5551875 - DNA, 18 bp, Homo sapiens
acagaaaattcttctcca

SEQ ID NO: 5551876 - DNA, 21 bp, Homo sapiens
acagaaaattgttgtgcttag

SEQ ID NO: 5551877 - DNA, 12 bp, Homo sapiens
acagaaaattta

SEQ ID NO: 5551878 - DNA, 13 bp, Homo sapiens
acagaaaatttaa

SEQ ID NO: 5551879 - DNA, 16 bp, Homo sapiens
acagaaacaactgcca

SEQ ID NO: 5551880 - DNA, 15 bp, Homo sapiens
acagaaacacaaacg

SEQ ID NO: 5551881 - DNA, 14 bp, Homo sapiens
acagaaacactgcc

SEQ ID NO: 5551882 - DNA, 15 bp, Homo sapiens
acagaaacactgcct

SEQ ID NO: 5551883 - DNA, 19 bp, Homo sapiens
acagaaacactgccttttt

SEQ ID NO: 5551884 - DNA, 15 bp, Homo sapiens
acagaaacagagaga

SEQ ID NO: 5551885 - DNA, 17 bp, Homo sapiens
acagaaacatgccagaa

SEQ ID NO: 5551886 - DNA, 22 bp, Homo sapiens
acagaaacatgtcttgactgtt

SEQ ID NO: 5551887 - DNA, 21 bp, Homo sapiens
acagaaaccaagagacacaat

SEQ ID NO: 5551888 - DNA, 19 bp, Homo sapiens
acagaaaccaagccattaa

SEQ ID NO: 5551889 - DNA, 16 bp, Homo sapiens
acagaaaccagaaaag

SEQ ID NO: 5551890 - DNA, 17 bp, Homo sapiens
acagaaaccagaaaagc

SEQ ID NO: 5551891 - DNA, 22 bp, Homo sapiens
acagaaacctatcctcactgcc

SEQ ID NO: 5551892 - DNA, 18 bp, Homo sapiens
acagaaaccttttatttt

SEQ ID NO: 5551893 - DNA, 19 bp, Homo sapiens
acagaaaccttttattttt

SEQ ID NO: 5551894 - DNA, 18 bp, Homo sapiens
acagaaacgcatccagca

SEQ ID NO: 5551895 - DNA, 20 bp, Homo sapiens
acagaaacggtctttatgaa

SEQ ID NO: 5551896 - DNA, 22 bp, Homo sapiens
acagaaacggtctttatgaatt

SEQ ID NO: 5551897 - DNA, 16 bp, Homo sapiens
acagaaactatatgca

SEQ ID NO: 5551898 - DNA, 20 bp, Homo sapiens
acagaaagagactccgtctc

SEQ ID NO: 5551899 - DNA, 17 bp, Homo sapiens
acagaaagagagcactg

SEQ ID NO: 5551900 - DNA, 18 bp, Homo sapiens
acagaaagagagcactga

SEQ ID NO: 5551901 - DNA, 15 bp, Homo sapiens
acagaaagagggaca

SEQ ID NO: 5551902 - DNA, 16 bp, Homo sapiens
acagaaagcaaatcag

SEQ ID NO: 5551903 - DNA, 20 bp, Homo sapiens
acagaaagcaaatcagacac

SEQ ID NO: 5551904 - DNA, 23 bp, Homo sapiens
acagaaagccaggagcagccctg

SEQ ID NO: 5551905 - DNA, 22 bp, Homo sapiens
acagaaaggcaggtttcatttc

SEQ ID NO: 5551906 - DNA, 15 bp, Homo sapiens
acagaccccagctgg

SEQ ID NO: 5551907 - DNA, 15 bp, Homo sapiens
acagacccccgtcct

SEQ ID NO: 5551908 - DNA, 14 bp, Homo sapiens
acagacccctgcct

SEQ ID NO: 5551909 - DNA, 17 bp, Homo sapiens
acagacccctgggggag

SEQ ID NO: 5551910 - DNA, 13 bp, Homo sapiens
acagaccctgccc

SEQ ID NO: 5551911 - DNA, 14 bp, Homo sapiens
acagaccctgccct

SEQ ID NO: 5551912 - DNA, 21 bp, Homo sapiens
acagaccgagaggccagttga

SEQ ID NO: 5551913 - DNA, 22 bp, Homo sapiens
acagacctaatatcattttatt

SEQ ID NO: 5551914 - DNA, 17 bp, Homo sapiens
acagacctgagatgaag

SEQ ID NO: 5551915 - DNA, 14 bp, Homo sapiens
acagacctgcagtg

SEQ ID NO: 5551916 - DNA, 19 bp, Homo sapiens
acagacctggagcccctgg

SEQ ID NO: 5551917 - DNA, 20 bp, Homo sapiens
acagacctggagcccctggg

SEQ ID NO: 5551918 - DNA, 14 bp, Homo sapiens
acagacctggctct

SEQ ID NO: 5551919 - DNA, 18 bp, Homo sapiens
acagaccttcacagatgc

SEQ ID NO: 5551920 - DNA, 22 bp, Homo sapiens
acagacgaagagtttaaagaga

SEQ ID NO: 5551921 - DNA, 21 bp, Homo sapiens
acagacggaagggtaaacaat

SEQ ID NO: 5551922 - DNA, 18 bp, Homo sapiens
acagacggacgggacagc

SEQ ID NO: 5551923 - DNA, 17 bp, Homo sapiens
acagacgtctcaagact

SEQ ID NO: 5551924 - DNA, 19 bp, Homo sapiens
acagacgtctcaagactga

SEQ ID NO: 5551925 - DNA, 21 bp, Homo sapiens
acagacgttaggcatttcctg

SEQ ID NO: 5551926 - DNA, 22 bp, Homo sapiens
acagacgttaggcatttcctgc

SEQ ID NO: 5551927 - DNA, 16 bp, Homo sapiens
acagactatttgctaa

SEQ ID NO: 5551928 - DNA, 14 bp, Homo sapiens
acagactattttta

SEQ ID NO: 5551929 - DNA, 22 bp, Homo sapiens
acagactcacaacctgaaccta

SEQ ID NO: 5551930 - DNA, 15 bp, Homo sapiens
acagactcatcctga

SEQ ID NO: 5551931 - DNA, 23 bp, Homo sapiens
acagactcatcctgaacagcatg

SEQ ID NO: 5551932 - DNA, 14 bp, Homo sapiens
acagactccatctc

SEQ ID NO: 5551933 - DNA, 22 bp, Homo sapiens
acagactgaaaggtgtgaacag

SEQ ID NO: 5551934 - DNA, 17 bp, Homo sapiens
acagactgcagacattc

SEQ ID NO: 5551935 - DNA, 22 bp, Homo sapiens
acagactgcagacattctcaaa

SEQ ID NO: 5551936 - DNA, 23 bp, Homo sapiens
acagactgcagacattctcaaag

SEQ ID NO: 5551937 - DNA, 14 bp, Homo sapiens
acagactgccccag

SEQ ID NO: 5551938 - DNA, 18 bp, Homo sapiens
acagactgccttatatta

SEQ ID NO: 5551939 - DNA, 16 bp, Homo sapiens
acagactgctgtctta

SEQ ID NO: 5551940 - DNA, 18 bp, Homo sapiens
acagactgctgtcttact

SEQ ID NO: 5551941 - DNA, 14 bp, Homo sapiens
acagactggaagca

SEQ ID NO: 5551942 - DNA, 19 bp, Homo sapiens
acagactggaagcacagct

SEQ ID NO: 5551943 - DNA, 15 bp, Homo sapiens
acagactgttaatta

SEQ ID NO: 5551944 - DNA, 16 bp, Homo sapiens
acagactgttccctcc

SEQ ID NO: 5551945 - DNA, 19 bp, Homo sapiens
acagactgttgtccctgca

SEQ ID NO: 5551946 - DNA, 17 bp, Homo sapiens
acagacttagaacctga

SEQ ID NO: 5551947 - DNA, 20 bp, Homo sapiens
acagacttctggaaggctgg

SEQ ID NO: 5551948 - DNA, 21 bp, Homo sapiens
acagacttctggaaggctggc

SEQ ID NO: 5551949 - DNA, 22 bp, Homo sapiens
acagacttctggaaggctggct

SEQ ID NO: 5551950 - DNA, 17 bp, Homo sapiens
acagacttgagaacttg

SEQ ID NO: 5551951 - DNA, 18 bp, Homo sapiens
acagacttgagaacttga

SEQ ID NO: 5551952 - DNA, 19 bp, Homo sapiens
acagacttgcactgaagcc

SEQ ID NO: 5551953 - DNA, 16 bp, Homo sapiens
acagactttggacagt

SEQ ID NO: 5551954 - DNA, 20 bp, Homo sapiens
acagactttggacagtggcc

SEQ ID NO: 5551955 - DNA, 23 bp, Homo sapiens
acagactttggacagtggcctct

SEQ ID NO: 5551956 - DNA, 20 bp, Homo sapiens
acagagaaaccagcttcctt

SEQ ID NO: 5551957 - DNA, 13 bp, Homo sapiens
acagagaaagaaa

SEQ ID NO: 5551958 - DNA, 17 bp, Homo sapiens
acagagaaagaaaaggc

SEQ ID NO: 5551959 - DNA, 21 bp, Homo sapiens
acagagaaagggtaatttcct

SEQ ID NO: 5551960 - DNA, 18 bp, Homo sapiens
acagagaaagtacttctc

SEQ ID NO: 5551961 - DNA, 19 bp, Homo sapiens
acagagaaatacaaaataa

SEQ ID NO: 5551962 - DNA, 15 bp, Homo sapiens
acagagaagccagct

SEQ ID NO: 5551963 - DNA, 16 bp, Homo sapiens
acagagaagccagctt

SEQ ID NO: 5551964 - DNA, 15 bp, Homo sapiens
acagagaagccatca

SEQ ID NO: 5551965 - DNA, 20 bp, Homo sapiens
acagagaagccatcacctca

SEQ ID NO: 5551966 - DNA, 12 bp, Homo sapiens
acagagaagcct

SEQ ID NO: 5551967 - DNA, 13 bp, Homo sapiens
acagagaagcctt

SEQ ID NO: 5551968 - DNA, 14 bp, Homo sapiens
acagagaagccttc

SEQ ID NO: 5551969 - DNA, 15 bp, Homo sapiens
acagagaagctcctg

SEQ ID NO: 5551970 - DNA, 17 bp, Homo sapiens
acagagaagctcctgct

SEQ ID NO: 5551971 - DNA, 19 bp, Homo sapiens
acagagaaggaatgtcttt

SEQ ID NO: 5551972 - DNA, 22 bp, Homo sapiens
acagagaaggaatgtctttggt

SEQ ID NO: 5551973 - DNA, 13 bp, Homo sapiens
acagagaaggcta

SEQ ID NO: 5551974 - DNA, 19 bp, Homo sapiens
acagagaagtcacagggca

SEQ ID NO: 5551975 - DNA, 21 bp, Homo sapiens
acagagaagtcacagggcagt

SEQ ID NO: 5551976 - DNA, 20 bp, Homo sapiens
acagagaagtttgtagccag

SEQ ID NO: 5551977 - DNA, 18 bp, Homo sapiens
acagagaatctgaagcta

SEQ ID NO: 5551978 - DNA, 14 bp, Homo sapiens
acagagacacctgc

SEQ ID NO: 5551979 - DNA, 15 bp, Homo sapiens
acagagacacctgca

SEQ ID NO: 5551980 - DNA, 17 bp, Homo sapiens
acagagacagaaacaga

SEQ ID NO: 5551981 - DNA, 17 bp, Homo sapiens
acagagacagagagaga

SEQ ID NO: 5551982 - DNA, 21 bp, Homo sapiens
acagagacaggcccaagagat

SEQ ID NO: 5551983 - DNA, 14 bp, Homo sapiens
acagagaccaagat

SEQ ID NO: 5551984 - DNA, 20 bp, Homo sapiens
acagagacccagatctcatg

SEQ ID NO: 5551985 - DNA, 14 bp, Homo sapiens
acagagacctcctg

SEQ ID NO: 5551986 - DNA, 14 bp, Homo sapiens
acagagactctatt

SEQ ID NO: 5551987 - DNA, 19 bp, Homo sapiens
acagagactctggaagccc

SEQ ID NO: 5551988 - DNA, 18 bp, Homo sapiens
acagagactgtttgaatg

SEQ ID NO: 5551989 - DNA, 12 bp, Homo sapiens
acagagagaacc

SEQ ID NO: 5551990 - DNA, 14 bp, Homo sapiens
acagagagaaccag

SEQ ID NO: 5551991 - DNA, 23 bp, Homo sapiens
acagagagacaacttgctccttt

SEQ ID NO: 5551992 - DNA, 20 bp, Homo sapiens
acagagagacagacttgaga

SEQ ID NO: 5551993 - DNA, 16 bp, Homo sapiens
acagagaggactgtag

SEQ ID NO: 5551994 - DNA, 14 bp, Homo sapiens
acagagaggagaaa

SEQ ID NO: 5551995 - DNA, 22 bp, Homo sapiens
acagagagggacacatgcccct

SEQ ID NO: 5551996 - DNA, 24 bp, Homo sapiens
acagagagggagagcagagaaaga

SEQ ID NO: 5551997 - DNA, 21 bp, Homo sapiens
acagagagggcaccatcacaa

SEQ ID NO: 5551998 - DNA, 20 bp, Homo sapiens
acagagaggggcagggaagg

SEQ ID NO: 5551999 - DNA, 17 bp, Homo sapiens
acagagagtcctttggg

SEQ ID NO: 5552000 - DNA, 14 bp, Homo sapiens
acagagagtctgga

SEQ ID NO: 5552001 - DNA, 16 bp, Homo sapiens
acagagataccattca

SEQ ID NO: 5552002 - DNA, 14 bp, Homo sapiens
acagagatataaat

SEQ ID NO: 5552003 - DNA, 17 bp, Homo sapiens
acagagatataaatgaa

SEQ ID NO: 5552004 - DNA, 17 bp, Homo sapiens
acagagatatacaaata

SEQ ID NO: 5552005 - DNA, 17 bp, Homo sapiens
acagagatgaacaactt

SEQ ID NO: 5552006 - DNA, 19 bp, Homo sapiens
acagagatgcatgcgcagg

SEQ ID NO: 5552007 - DNA, 23 bp, Homo sapiens
acagagatgcatgcgcaggctca

SEQ ID NO: 5552008 - DNA, 15 bp, Homo sapiens
acagagatgtctctt

SEQ ID NO: 5552009 - DNA, 21 bp, Homo sapiens
acagagattctggatctcctg

SEQ ID NO: 5552010 - DNA, 17 bp, Homo sapiens
acagagattgaactcca

SEQ ID NO: 5552011 - DNA, 20 bp, Homo sapiens
acagagattgaactccaaga

SEQ ID NO: 5552012 - DNA, 23 bp, Homo sapiens
acagagcaacccctggaccccag

SEQ ID NO: 5552013 - DNA, 18 bp, Homo sapiens
acagagcaagtcctcact

SEQ ID NO: 5552014 - DNA, 19 bp, Homo sapiens
acagagcacacttatttat

SEQ ID NO: 5552015 - DNA, 18 bp, Homo sapiens
acagagcacctgtagctg

SEQ ID NO: 5552016 - DNA, 16 bp, Homo sapiens
acagagcacgcctgcc

SEQ ID NO: 5552017 - DNA, 19 bp, Homo sapiens
acagagcacgcctgccatc

SEQ ID NO: 5552018 - DNA, 20 bp, Homo sapiens
acagagcactaggttcaatt

SEQ ID NO: 5552019 - DNA, 14 bp, Homo sapiens
acagagcagctccc

SEQ ID NO: 5552020 - DNA, 16 bp, Homo sapiens
acagagcagctcccca

SEQ ID NO: 5552021 - DNA, 18 bp, Homo sapiens
acagagcagctccccagg

SEQ ID NO: 5552022 - DNA, 19 bp, Homo sapiens
acagagcagctccccagga

SEQ ID NO: 5552023 - DNA, 12 bp, Homo sapiens
acagagcaggct

SEQ ID NO: 5552024 - DNA, 15 bp, Homo sapiens
acagagcaggctttg

SEQ ID NO: 5552025 - DNA, 18 bp, Homo sapiens
acagagcaggctttgtga

SEQ ID NO: 5552026 - DNA, 19 bp, Homo sapiens
acagagcaggctttgtgag

SEQ ID NO: 5552027 - DNA, 20 bp, Homo sapiens
acagagcaggggctccagca

SEQ ID NO: 5552028 - DNA, 23 bp, Homo sapiens
acagagcaggtctgcaggccacc

SEQ ID NO: 5552029 - DNA, 19 bp, Homo sapiens
acagagcatcaaaaacatc

SEQ ID NO: 5552030 - DNA, 12 bp, Homo sapiens
acagagcatccg

SEQ ID NO: 5552031 - DNA, 16 bp, Homo sapiens
acagagccaaaatgcc

SEQ ID NO: 5552032 - DNA, 16 bp, Homo sapiens
acagagccaagcactg

SEQ ID NO: 5552033 - DNA, 18 bp, Homo sapiens
acagagccaccccatgag

SEQ ID NO: 5552034 - DNA, 19 bp, Homo sapiens
acagagccaccccatgagc

SEQ ID NO: 5552035 - DNA, 15 bp, Homo sapiens
acagagccagaggca

SEQ ID NO: 5552036 - DNA, 20 bp, Homo sapiens
acagagccaggagaagctca

SEQ ID NO: 5552037 - DNA, 11 bp, Homo sapiens
acagagccatg

SEQ ID NO: 5552038 - DNA, 14 bp, Homo sapiens
acagagcccacgcc

SEQ ID NO: 5552039 - DNA, 15 bp, Homo sapiens
acagagcccagggag

SEQ ID NO: 5552040 - DNA, 19 bp, Homo sapiens
acagagccctatctatgtc

SEQ ID NO: 5552041 - DNA, 21 bp, Homo sapiens
acagagccctatctatgtcct

SEQ ID NO: 5552042 - DNA, 23 bp, Homo sapiens
acagagccctatctatgtcctgg

SEQ ID NO: 5552043 - DNA, 17 bp, Homo sapiens
acagagccgcaaatcaa

SEQ ID NO: 5552044 - DNA, 19 bp, Homo sapiens
acagagccggtttccgtgg

SEQ ID NO: 5552045 - DNA, 17 bp, Homo sapiens
acagagcctcgctctgt

SEQ ID NO: 5552046 - DNA, 12 bp, Homo sapiens
acagagcctgcc

SEQ ID NO: 5552047 - DNA, 12 bp, Homo sapiens
acagagcctggc

SEQ ID NO: 5552048 - DNA, 14 bp, Homo sapiens
acagagcctgtttt

SEQ ID NO: 5552049 - DNA, 15 bp, Homo sapiens
acagagcctgtttta

SEQ ID NO: 5552050 - DNA, 16 bp, Homo sapiens
acagagcctgttttaa

SEQ ID NO: 5552051 - DNA, 22 bp, Homo sapiens
acagagcctgttttaaaaaata

SEQ ID NO: 5552052 - DNA, 21 bp, Homo sapiens
acagagccttgagagacccag

SEQ ID NO: 5552053 - DNA, 16 bp, Homo sapiens
acagagcgacagagca

SEQ ID NO: 5552054 - DNA, 19 bp, Homo sapiens
acagagcgagactccatct

SEQ ID NO: 5552055 - DNA, 13 bp, Homo sapiens
acagagcgggcct

SEQ ID NO: 5552056 - DNA, 15 bp, Homo sapiens
acagagcgggcctct

SEQ ID NO: 5552057 - DNA, 15 bp, Homo sapiens
acagagctaaggcca

SEQ ID NO: 5552058 - DNA, 18 bp, Homo sapiens
acagagctctccagctcc

SEQ ID NO: 5552059 - DNA, 22 bp, Homo sapiens
acagagctgaggatttcctgga

SEQ ID NO: 5552060 - DNA, 21 bp, Homo sapiens
acagagctggttgggaagaca

SEQ ID NO: 5552061 - DNA, 12 bp, Homo sapiens
acagagctgtgg

SEQ ID NO: 5552062 - DNA, 22 bp, Homo sapiens
acagagctgtggaggattgcta

SEQ ID NO: 5552063 - DNA, 18 bp, Homo sapiens
acagagcttgaagcctcc

SEQ ID NO: 5552064 - DNA, 19 bp, Homo sapiens
acagaggaagaatttgtta

SEQ ID NO: 5552065 - DNA, 14 bp, Homo sapiens
acagaggaagagca

SEQ ID NO: 5552066 - DNA, 16 bp, Homo sapiens
acagaggaagagcagg

SEQ ID NO: 5552067 - DNA, 18 bp, Homo sapiens
acagaggaagagcaggca

SEQ ID NO: 5552068 - DNA, 20 bp, Homo sapiens
acagaggaatctacctgtgg

SEQ ID NO: 5552069 - DNA, 21 bp, Homo sapiens
acagaggaatctacctgtggt

SEQ ID NO: 5552070 - DNA, 16 bp, Homo sapiens
acagaggacacagaga

SEQ ID NO: 5552071 - DNA, 12 bp, Homo sapiens
acagaggaccag

SEQ ID NO: 5552072 - DNA, 20 bp, Homo sapiens
acagaggaccagcacactcc

SEQ ID NO: 5552073 - DNA, 17 bp, Homo sapiens
acagaggagcttttctg

SEQ ID NO: 5552074 - DNA, 12 bp, Homo sapiens
acagaggaggcc

SEQ ID NO: 5552075 - DNA, 15 bp, Homo sapiens
acagaggagtgcagc

SEQ ID NO: 5552076 - DNA, 20 bp, Homo sapiens
acagaggatgagctctaccc

SEQ ID NO: 5552077 - DNA, 19 bp, Homo sapiens
acagaggcagccccattct

SEQ ID NO: 5552078 - DNA, 15 bp, Homo sapiens
acagaggcaggagtg

SEQ ID NO: 5552079 - DNA, 16 bp, Homo sapiens
acagaggcagtggcag

SEQ ID NO: 5552080 - DNA, 18 bp, Homo sapiens
acagaggcagtggcagca

SEQ ID NO: 5552081 - DNA, 14 bp, Homo sapiens
acagaggccaagga

SEQ ID NO: 5552082 - DNA, 13 bp, Homo sapiens
acagaggccaggc

SEQ ID NO: 5552083 - DNA, 17 bp, Homo sapiens
acagcaggaggcacagc

SEQ ID NO: 5552084 - DNA, 19 bp, Homo sapiens
acagcaggaggcacagcag

SEQ ID NO: 5552085 - DNA, 20 bp, Homo sapiens
acagcaggaggcacagcagt

SEQ ID NO: 5552086 - DNA, 22 bp, Homo sapiens
acagcaggatcgaagggttttt

SEQ ID NO: 5552087 - DNA, 22 bp, Homo sapiens
acagcaggattggatgttgtgt

SEQ ID NO: 5552088 - DNA, 22 bp, Homo sapiens
acagcaggccaggtccagagag

SEQ ID NO: 5552089 - DNA, 20 bp, Homo sapiens
acagcaggccatctttttat

SEQ ID NO: 5552090 - DNA, 18 bp, Homo sapiens
acagcaggctgccagtgc

SEQ ID NO: 5552091 - DNA, 12 bp, Homo sapiens
acagcagggcct

SEQ ID NO: 5552092 - DNA, 20 bp, Homo sapiens
acagcagggtacctgaaaga

SEQ ID NO: 5552093 - DNA, 17 bp, Homo sapiens
acagcagggtttgagca

SEQ ID NO: 5552094 - DNA, 15 bp, Homo sapiens
acagcagtacttgct

SEQ ID NO: 5552095 - DNA, 23 bp, Homo sapiens
acagcagtacttgctcaataaag

SEQ ID NO: 5552096 - DNA, 15 bp, Homo sapiens
acagcagtagacatt

SEQ ID NO: 5552097 - DNA, 20 bp, Homo sapiens
acagcagtagacattttaac

SEQ ID NO: 5552098 - DNA, 21 bp, Homo sapiens
acagcagtcccagtattctca

SEQ ID NO: 5552099 - DNA, 14 bp, Homo sapiens
acagcagtctcctt

SEQ ID NO: 5552100 - DNA, 16 bp, Homo sapiens
acagcagtctccttca

SEQ ID NO: 5552101 - DNA, 20 bp, Homo sapiens
acagcagtctccttcagcac

SEQ ID NO: 5552102 - DNA, 21 bp, Homo sapiens
acagcagtctccttcagcacg

SEQ ID NO: 5552103 - DNA, 22 bp, Homo sapiens
acagcagtcttatgcttccaga

SEQ ID NO: 5552104 - DNA, 23 bp, Homo sapiens
acagcagtgatctcagggcagac

SEQ ID NO: 5552105 - DNA, 17 bp, Homo sapiens
acagcagtgtcccctgc

SEQ ID NO: 5552106 - DNA, 15 bp, Homo sapiens
acagcagtgtgaggg

SEQ ID NO: 5552107 - DNA, 15 bp, Homo sapiens
acagcagtgtggtct

SEQ ID NO: 5552108 - DNA, 13 bp, Homo sapiens
acagcagtgttcc

SEQ ID NO: 5552109 - DNA, 17 bp, Homo sapiens
acagcagtgttctcaca

SEQ ID NO: 5552110 - DNA, 21 bp, Homo sapiens
acagcagttgaaaagactcca

SEQ ID NO: 5552111 - DNA, 23 bp, Homo sapiens
acagcagttgaaaagactccaaa

SEQ ID NO: 5552112 - DNA, 18 bp, Homo sapiens
acagcagtttcaccatct

SEQ ID NO: 5552113 - DNA, 14 bp, Homo sapiens
acagcagtttccag

SEQ ID NO: 5552114 - DNA, 21 bp, Homo sapiens
acagcataaatctgttagcat

SEQ ID NO: 5552115 - DNA, 15 bp, Homo sapiens
acagcataagggaat

SEQ ID NO: 5552116 - DNA, 17 bp, Homo sapiens
acagcatcaaaatacaa

SEQ ID NO: 5552117 - DNA, 14 bp, Homo sapiens
acagcatcagctca

SEQ ID NO: 5552118 - DNA, 17 bp, Homo sapiens
acagcatcattttgcat

SEQ ID NO: 5552119 - DNA, 20 bp, Homo sapiens
acagcatcattttgcattca

SEQ ID NO: 5552120 - DNA, 22 bp, Homo sapiens
acagcatccccaaaacaaagtc

SEQ ID NO: 5552121 - DNA, 15 bp, Homo sapiens
acagcatcccttccc

SEQ ID NO: 5552122 - DNA, 19 bp, Homo sapiens
acagcatcccttcccacat

SEQ ID NO: 5552123 - DNA, 18 bp, Homo sapiens
acagcatcgggagcaccc

SEQ ID NO: 5552124 - DNA, 20 bp, Homo sapiens
acagcatcgggagcacccag

SEQ ID NO: 5552125 - DNA, 15 bp, Homo sapiens
acagcatctcagctc

SEQ ID NO: 5552126 - DNA, 14 bp, Homo sapiens
acagcatctccaag

SEQ ID NO: 5552127 - DNA, 20 bp, Homo sapiens
acagcatctccaagcagctt

SEQ ID NO: 5552128 - DNA, 21 bp, Homo sapiens
acagcatctgcctctattcaa

SEQ ID NO: 5552129 - DNA, 21 bp, Homo sapiens
acagcatgactggacagcggt

SEQ ID NO: 5552130 - DNA, 14 bp, Homo sapiens
acagcatgcagact

SEQ ID NO: 5552131 - DNA, 13 bp, Homo sapiens
acagcatgcattt

SEQ ID NO: 5552132 - DNA, 16 bp, Homo sapiens
acagcatggcactccc

SEQ ID NO: 5552133 - DNA, 16 bp, Homo sapiens
acagcatggcctctcg

SEQ ID NO: 5552134 - DNA, 22 bp, Homo sapiens
acagcatgtacggattttcagt

SEQ ID NO: 5552135 - DNA, 12 bp, Homo sapiens
acagcatgtgcc

SEQ ID NO: 5552136 - DNA, 16 bp, Homo sapiens
acagcatgtgttaatc

SEQ ID NO: 5552137 - DNA, 20 bp, Homo sapiens
acagcattaaaattttacct

SEQ ID NO: 5552138 - DNA, 17 bp, Homo sapiens
acagcattcctccatct

SEQ ID NO: 5552139 - DNA, 14 bp, Homo sapiens
acagcattggcctg

SEQ ID NO: 5552140 - DNA, 20 bp, Homo sapiens
acagcattgtctttgctgta

SEQ ID NO: 5552141 - DNA, 15 bp, Homo sapiens
acagcattgtgtgga

SEQ ID NO: 5552142 - DNA, 16 bp, Homo sapiens
acagcattgtgtggaa

SEQ ID NO: 5552143 - DNA, 16 bp, Homo sapiens
acagcatttattacct

SEQ ID NO: 5552144 - DNA, 18 bp, Homo sapiens
acagcatttcagctgtga

SEQ ID NO: 5552145 - DNA, 14 bp, Homo sapiens
acagcatttctttg

SEQ ID NO: 5552146 - DNA, 19 bp, Homo sapiens
acagcatttctttggaaac

SEQ ID NO: 5552147 - DNA, 14 bp, Homo sapiens
acagcatttgccaa

SEQ ID NO: 5552148 - DNA, 17 bp, Homo sapiens
acagcatttgtgtgtta

SEQ ID NO: 5552149 - DNA, 18 bp, Homo sapiens
acagcattttcctctgct

SEQ ID NO: 5552150 - DNA, 16 bp, Homo sapiens
acagccaaagaaactc

SEQ ID NO: 5552151 - DNA, 17 bp, Homo sapiens
acagccaaagaaactca

SEQ ID NO: 5552152 - DNA, 16 bp, Homo sapiens
acagccaaaggctggc

SEQ ID NO: 5552153 - DNA, 22 bp, Homo sapiens
acagccaaattgcagaagaaac

SEQ ID NO: 5552154 - DNA, 14 bp, Homo sapiens
acagccaaatttaa

SEQ ID NO: 5552155 - DNA, 23 bp, Homo sapiens
acagccaacaggtggcaggacca

SEQ ID NO: 5552156 - DNA, 17 bp, Homo sapiens
acagccaacgagacaca

SEQ ID NO: 5552157 - DNA, 16 bp, Homo sapiens
acagccaactagcccc

SEQ ID NO: 5552158 - DNA, 19 bp, Homo sapiens
acagccaactagcccctgg

SEQ ID NO: 5552159 - DNA, 17 bp, Homo sapiens
acagccaactatggcct

SEQ ID NO: 5552160 - DNA, 18 bp, Homo sapiens
acagccaagcccaccctg

SEQ ID NO: 5552161 - DNA, 14 bp, Homo sapiens
acagccaagttgtg

SEQ ID NO: 5552162 - DNA, 19 bp, Homo sapiens
acagccacacacacagaaa

SEQ ID NO: 5552163 - DNA, 18 bp, Homo sapiens
acagccaccacctggatg

SEQ ID NO: 5552164 - DNA, 23 bp, Homo sapiens
acagccacccgtggggtgctgcc

SEQ ID NO: 5552165 - DNA, 21 bp, Homo sapiens
acagccaccctgcccagtctg

SEQ ID NO: 5552166 - DNA, 18 bp, Homo sapiens
acagccacctccaccccc

SEQ ID NO: 5552167 - DNA, 15 bp, Homo sapiens
acagccacctccgcc

SEQ ID NO: 5552168 - DNA, 19 bp, Homo sapiens
acagccacctccgccagac

SEQ ID NO: 5552169 - DNA, 19 bp, Homo sapiens
acagccacggccaggccag

SEQ ID NO: 5552170 - DNA, 12 bp, Homo sapiens
acagccactcag

SEQ ID NO: 5552171 - DNA, 21 bp, Homo sapiens
acagccagaaggggctgcttg

SEQ ID NO: 5552172 - DNA, 15 bp, Homo sapiens
acagccagactggca

SEQ ID NO: 5552173 - DNA, 16 bp, Homo sapiens
acagccagacttgctt

SEQ ID NO: 5552174 - DNA, 13 bp, Homo sapiens
acagccagagctg

SEQ ID NO: 5552175 - DNA, 19 bp, Homo sapiens
acagccagaggaaccagca

SEQ ID NO: 5552176 - DNA, 15 bp, Homo sapiens
acagccagaggaggg

SEQ ID NO: 5552177 - DNA, 14 bp, Homo sapiens
acagccagcagcag

SEQ ID NO: 5552178 - DNA, 16 bp, Homo sapiens
acagccagcccagctc

SEQ ID NO: 5552179 - DNA, 17 bp, Homo sapiens
acagccagggcagggct

SEQ ID NO: 5552180 - DNA, 17 bp, Homo sapiens
acagccaggtgccttgg

SEQ ID NO: 5552181 - DNA, 22 bp, Homo sapiens
acagccagtttagagaaataca

SEQ ID NO: 5552182 - DNA, 22 bp, Homo sapiens
acagccatagacctacagacct

SEQ ID NO: 5552183 - DNA, 15 bp, Homo sapiens
acagccatgattctt

SEQ ID NO: 5552184 - DNA, 16 bp, Homo sapiens
acagccatgcccgcat

SEQ ID NO: 5552185 - DNA, 20 bp, Homo sapiens
acagccattgcggccccagg

SEQ ID NO: 5552186 - DNA, 14 bp, Homo sapiens
acagccatttgtaa

SEQ ID NO: 5552187 - DNA, 13 bp, Homo sapiens
acagccattttcc

SEQ ID NO: 5552188 - DNA, 17 bp, Homo sapiens
acagccattttccaaca

SEQ ID NO: 5552189 - DNA, 14 bp, Homo sapiens
acagcccaaccagg

SEQ ID NO: 5552190 - DNA, 17 bp, Homo sapiens
acagcccaaccaggagg

SEQ ID NO: 5552191 - DNA, 19 bp, Homo sapiens
acagcccaagaggactgag

SEQ ID NO: 5552192 - DNA, 20 bp, Homo sapiens
acagcccacggtctggaggc

SEQ ID NO: 5552193 - DNA, 15 bp, Homo sapiens
acagcccacgtcctg

SEQ ID NO: 5552194 - DNA, 17 bp, Homo sapiens
acagcccacgtcctgtc

SEQ ID NO: 5552195 - DNA, 10 bp, Homo sapiens
acagcccaga

SEQ ID NO: 5552196 - DNA, 19 bp, Homo sapiens
acagcccagaaccacagat

SEQ ID NO: 5552197 - DNA, 14 bp, Homo sapiens
acagcccagaaggc

SEQ ID NO: 5552198 - DNA, 17 bp, Homo sapiens
acagcccagaaggccag

SEQ ID NO: 5552199 - DNA, 14 bp, Homo sapiens
acagcccagagact

SEQ ID NO: 5552200 - DNA, 17 bp, Homo sapiens
acagcccagagactgaa

SEQ ID NO: 5552201 - DNA, 17 bp, Homo sapiens
acagcccagccacggac

SEQ ID NO: 5552202 - DNA, 13 bp, Homo sapiens
acagcccagccta

SEQ ID NO: 5552203 - DNA, 19 bp, Homo sapiens
acagcccaggcatctcctt

SEQ ID NO: 5552204 - DNA, 13 bp, Homo sapiens
acagcccaggcct

SEQ ID NO: 5552205 - DNA, 12 bp, Homo sapiens
acagcccaggcg

SEQ ID NO: 5552206 - DNA, 14 bp, Homo sapiens
acagcccaggtcct

SEQ ID NO: 5552207 - DNA, 21 bp, Homo sapiens
acagccccaaacaagcgccac

SEQ ID NO: 5552208 - DNA, 14 bp, Homo sapiens
acagccccaacctc

SEQ ID NO: 5552209 - DNA, 18 bp, Homo sapiens
acagccccaagcttctga

SEQ ID NO: 5552210 - DNA, 19 bp, Homo sapiens
acagccccacagcacccag

SEQ ID NO: 5552211 - DNA, 13 bp, Homo sapiens
acagccccaccct

SEQ ID NO: 5552212 - DNA, 15 bp, Homo sapiens
acagccccaccctgg

SEQ ID NO: 5552213 - DNA, 14 bp, Homo sapiens
acagccccagagca

SEQ ID NO: 5552214 - DNA, 15 bp, Homo sapiens
acagccccagagcag

SEQ ID NO: 5552215 - DNA, 17 bp, Homo sapiens
acagccccagagcaggg

SEQ ID NO: 5552216 - DNA, 13 bp, Homo sapiens
acagccccagggc

SEQ ID NO: 5552217 - DNA, 15 bp, Homo sapiens
acagccccagggccc

SEQ ID NO: 5552218 - DNA, 15 bp, Homo sapiens
acagccccagggttg

SEQ ID NO: 5552219 - DNA, 16 bp, Homo sapiens
acagcccccaccccag

SEQ ID NO: 5552220 - DNA, 17 bp, Homo sapiens
acagcccccctgctgct

SEQ ID NO: 5552221 - DNA, 14 bp, Homo sapiens
acagccccctgccc

SEQ ID NO: 5552222 - DNA, 17 bp, Homo sapiens
acagcccccttgccctc

SEQ ID NO: 5552223 - DNA, 24 bp, Homo sapiens
acagccccggggccccctggtcac

SEQ ID NO: 5552224 - DNA, 20 bp, Homo sapiens
acagcccctatagcactgag

SEQ ID NO: 5552225 - DNA, 17 bp, Homo sapiens
acagcccctcaaagact

SEQ ID NO: 5552226 - DNA, 19 bp, Homo sapiens
acagcccctcaaagacttt

SEQ ID NO: 5552227 - DNA, 16 bp, Homo sapiens
acagcccctccctcct

SEQ ID NO: 5552228 - DNA, 18 bp, Homo sapiens
acagcccctccctcctct

SEQ ID NO: 5552229 - DNA, 19 bp, Homo sapiens
acagcccctccctcctctg

SEQ ID NO: 5552230 - DNA, 13 bp, Homo sapiens
acagcccctggag

SEQ ID NO: 5552231 - DNA, 18 bp, Homo sapiens
acagcccctggagcctca

SEQ ID NO: 5552232 - DNA, 20 bp, Homo sapiens
acagcccctggagcctcaga

SEQ ID NO: 5552233 - DNA, 12 bp, Homo sapiens
acagcccctggc

SEQ ID NO: 5552234 - DNA, 14 bp, Homo sapiens
acagcccctggcac

SEQ ID NO: 5552235 - DNA, 23 bp, Homo sapiens
acagccccttaagcatgcttcta

SEQ ID NO: 5552236 - DNA, 16 bp, Homo sapiens
acagcccgagcccctt

SEQ ID NO: 5552237 - DNA, 17 bp, Homo sapiens
acagcccgcaggatcag

SEQ ID NO: 5552238 - DNA, 20 bp, Homo sapiens
acagcccgctctctggctgt

SEQ ID NO: 5552239 - DNA, 20 bp, Homo sapiens
acagcccgggctctgcctcc

SEQ ID NO: 5552240 - DNA, 23 bp, Homo sapiens
acagcccgggtgtgcctgccctg

SEQ ID NO: 5552241 - DNA, 18 bp, Homo sapiens
acagccctccactccagc

SEQ ID NO: 5552242 - DNA, 14 bp, Homo sapiens
acagccctcccgcc

SEQ ID NO: 5552243 - DNA, 22 bp, Homo sapiens
acagccctcccgccccttcccc

SEQ ID NO: 5552244 - DNA, 15 bp, Homo sapiens
acagccctcggcctc

SEQ ID NO: 5552245 - DNA, 13 bp, Homo sapiens
acagccctgaaac

SEQ ID NO: 5552246 - DNA, 18 bp, Homo sapiens
acagccctgagtgtccca

SEQ ID NO: 5552247 - DNA, 19 bp, Homo sapiens
acagccctgagtgtcccaa

SEQ ID NO: 5552248 - DNA, 12 bp, Homo sapiens
acagccctgcct

SEQ ID NO: 5552249 - DNA, 21 bp, Homo sapiens
acagccctgcctatcctctgt

SEQ ID NO: 5552250 - DNA, 16 bp, Homo sapiens
acagccctgcctgaga

SEQ ID NO: 5552251 - DNA, 23 bp, Homo sapiens
acagccctggaggccgctgctga

SEQ ID NO: 5552252 - DNA, 14 bp, Homo sapiens
acagccctgtcagc

SEQ ID NO: 5552253 - DNA, 23 bp, Homo sapiens
acagcccttatgcggttaatttt

SEQ ID NO: 5552254 - DNA, 14 bp, Homo sapiens
acagcccttccttg

SEQ ID NO: 5552255 - DNA, 19 bp, Homo sapiens
acagcccttctttccacag

SEQ ID NO: 5552256 - DNA, 21 bp, Homo sapiens
acagcccttctttccacagaa

SEQ ID NO: 5552257 - DNA, 22 bp, Homo sapiens
acagccgagtggatagatgccc

SEQ ID NO: 5552258 - DNA, 23 bp, Homo sapiens
acagccgcagcctccctctgacc

SEQ ID NO: 5552259 - DNA, 20 bp, Homo sapiens
acagccgcgggccaggaggc

SEQ ID NO: 5552260 - DNA, 14 bp, Homo sapiens
acagccgctccaga

SEQ ID NO: 5552261 - DNA, 13 bp, Homo sapiens
acaggaaaggagc

SEQ ID NO: 5552262 - DNA, 14 bp, Homo sapiens
acaggaaaggagca

SEQ ID NO: 5552263 - DNA, 16 bp, Homo sapiens
acaggaaagggaaggc

SEQ ID NO: 5552264 - DNA, 18 bp, Homo sapiens
acaggaacacccagcccc

SEQ ID NO: 5552265 - DNA, 22 bp, Homo sapiens
acaggaaccacaagactgcaca

SEQ ID NO: 5552266 - DNA, 19 bp, Homo sapiens
acaggaacccatcactgtg

SEQ ID NO: 5552267 - DNA, 23 bp, Homo sapiens
acaggaacggccctgcaggagca

SEQ ID NO: 5552268 - DNA, 19 bp, Homo sapiens
acaggaacggctctggggg

SEQ ID NO: 5552269 - DNA, 22 bp, Homo sapiens
acaggaactagattataagcct

SEQ ID NO: 5552270 - DNA, 15 bp, Homo sapiens
acaggaactctgtgt

SEQ ID NO: 5552271 - DNA, 21 bp, Homo sapiens
acaggaactctgtgtgagaga

SEQ ID NO: 5552272 - DNA, 22 bp, Homo sapiens
acaggaactctgtgtgagagag

SEQ ID NO: 5552273 - DNA, 14 bp, Homo sapiens
acaggaagaaagca

SEQ ID NO: 5552274 - DNA, 17 bp, Homo sapiens
acaggaagactggagac

SEQ ID NO: 5552275 - DNA, 16 bp, Homo sapiens
acaggaagatgggagg

SEQ ID NO: 5552276 - DNA, 19 bp, Homo sapiens
acaggaagatgggaggtgg

SEQ ID NO: 5552277 - DNA, 14 bp, Homo sapiens
acaggaagcctctc

SEQ ID NO: 5552278 - DNA, 14 bp, Homo sapiens
acaggaagctcagc

SEQ ID NO: 5552279 - DNA, 15 bp, Homo sapiens
acaggaagctggcag

SEQ ID NO: 5552280 - DNA, 12 bp, Homo sapiens
acaggaaggaag

SEQ ID NO: 5552281 - DNA, 17 bp, Homo sapiens
acaggaaggaggggaga

SEQ ID NO: 5552282 - DNA, 13 bp, Homo sapiens
acaggaaggcttg

SEQ ID NO: 5552283 - DNA, 18 bp, Homo sapiens
acaggaagtagttctaaa

SEQ ID NO: 5552284 - DNA, 13 bp, Homo sapiens
acaggaagttgga

SEQ ID NO: 5552285 - DNA, 16 bp, Homo sapiens
acaggaatagatgtgg

SEQ ID NO: 5552286 - DNA, 17 bp, Homo sapiens
acaggaatctcagagac

SEQ ID NO: 5552287 - DNA, 14 bp, Homo sapiens
acaggaatgaagaa

SEQ ID NO: 5552288 - DNA, 15 bp, Homo sapiens
acaggaattttaaaa

SEQ ID NO: 5552289 - DNA, 14 bp, Homo sapiens
acaggaattttatt

SEQ ID NO: 5552290 - DNA, 16 bp, Homo sapiens
acaggacacctggccg

SEQ ID NO: 5552291 - DNA, 19 bp, Homo sapiens
acaggacacctggccgcct

SEQ ID NO: 5552292 - DNA, 15 bp, Homo sapiens
acaggacagaatgtg

SEQ ID NO: 5552293 - DNA, 13 bp, Homo sapiens
acaggacagagtt

SEQ ID NO: 5552294 - DNA, 23 bp, Homo sapiens
acaggacagagttcacaggaggc

SEQ ID NO: 5552295 - DNA, 22 bp, Homo sapiens
acaggacagcatggtgcatgcc

SEQ ID NO: 5552296 - DNA, 14 bp, Homo sapiens
acaggacagcggga

SEQ ID NO: 5552297 - DNA, 18 bp, Homo sapiens
acaggacaggggttcctt

SEQ ID NO: 5552298 - DNA, 20 bp, Homo sapiens
acaggacagtgcttcagcct

SEQ ID NO: 5552299 - DNA, 21 bp, Homo sapiens
acaggacagttgatggagccc

SEQ ID NO: 5552300 - DNA, 22 bp, Homo sapiens
acaggacagttgatggagcccc

SEQ ID NO: 5552301 - DNA, 14 bp, Homo sapiens
acaggacatatatt

SEQ ID NO: 5552302 - DNA, 22 bp, Homo sapiens
acaggacatgcggtagccagca

SEQ ID NO: 5552303 - DNA, 17 bp, Homo sapiens
acaggaccaggagccag

SEQ ID NO: 5552304 - DNA, 23 bp, Homo sapiens
acaggaccagggatttccatgat

SEQ ID NO: 5552305 - DNA, 12 bp, Homo sapiens
acaggaccccag

SEQ ID NO: 5552306 - DNA, 13 bp, Homo sapiens
acaggaccccagc

SEQ ID NO: 5552307 - DNA, 14 bp, Homo sapiens
acaggaccccagct

SEQ ID NO: 5552308 - DNA, 18 bp, Homo sapiens
acaggaccccagctctgc

SEQ ID NO: 5552309 - DNA, 19 bp, Homo sapiens
acaggaccccagctctgcg

SEQ ID NO: 5552310 - DNA, 14 bp, Homo sapiens
acaggacccccttc

SEQ ID NO: 5552311 - DNA, 15 bp, Homo sapiens
acaggacccctgcag

SEQ ID NO: 5552312 - DNA, 16 bp, Homo sapiens
acaggaccctcaggaa

SEQ ID NO: 5552313 - DNA, 17 bp, Homo sapiens
acaggaccctcaggaat

SEQ ID NO: 5552314 - DNA, 15 bp, Homo sapiens
acaggacgaatgcat

SEQ ID NO: 5552315 - DNA, 18 bp, Homo sapiens
acaggactaacactcaga

SEQ ID NO: 5552316 - DNA, 19 bp, Homo sapiens
acaggactaacactcagaa

SEQ ID NO: 5552317 - DNA, 15 bp, Homo sapiens
acaggactgaaaagg

SEQ ID NO: 5552318 - DNA, 16 bp, Homo sapiens
acaggactgagccctc

SEQ ID NO: 5552319 - DNA, 18 bp, Homo sapiens
acaggactgagccctctc

SEQ ID NO: 5552320 - DNA, 18 bp, Homo sapiens
acaggactggttccttcc

SEQ ID NO: 5552321 - DNA, 22 bp, Homo sapiens
acaggactggttccttccttag

SEQ ID NO: 5552322 - DNA, 18 bp, Homo sapiens
acaggacttaaaatgaca

SEQ ID NO: 5552323 - DNA, 16 bp, Homo sapiens
acaggacttattatat

SEQ ID NO: 5552324 - DNA, 17 bp, Homo sapiens
acaggagacccaacaat

SEQ ID NO: 5552325 - DNA, 18 bp, Homo sapiens
acaggagagaaaggggat

SEQ ID NO: 5552326 - DNA, 19 bp, Homo sapiens
acaggagagaaaggggatg

SEQ ID NO: 5552327 - DNA, 14 bp, Homo sapiens
acaggagagacagg

SEQ ID NO: 5552328 - DNA, 17 bp, Homo sapiens
acaggagaggcagcatg

SEQ ID NO: 5552329 - DNA, 17 bp, Homo sapiens
acaggagcaatcacagg

SEQ ID NO: 5552330 - DNA, 19 bp, Homo sapiens
acaggagcaatcacaggaa

SEQ ID NO: 5552331 - DNA, 12 bp, Homo sapiens
acaggagcactg

SEQ ID NO: 5552332 - DNA, 13 bp, Homo sapiens
acaggagcagaca

SEQ ID NO: 5552333 - DNA, 22 bp, Homo sapiens
acaggagccccacccccatgca

SEQ ID NO: 5552334 - DNA, 13 bp, Homo sapiens
acaggagccctgc

SEQ ID NO: 5552335 - DNA, 20 bp, Homo sapiens
acaggagccgcagaggcccg

SEQ ID NO: 5552336 - DNA, 17 bp, Homo sapiens
acaggagcctagcggag

SEQ ID NO: 5552337 - DNA, 14 bp, Homo sapiens
acaggagctacctg

SEQ ID NO: 5552338 - DNA, 15 bp, Homo sapiens
acaggaggaactggt

SEQ ID NO: 5552339 - DNA, 17 bp, Homo sapiens
acaggaggacaattcat

SEQ ID NO: 5552340 - DNA, 14 bp, Homo sapiens
acaggaggaggaga

SEQ ID NO: 5552341 - DNA, 20 bp, Homo sapiens
acaggaggagtgggacagac

SEQ ID NO: 5552342 - DNA, 21 bp, Homo sapiens
acaggaggcaggcatggccct

SEQ ID NO: 5552343 - DNA, 13 bp, Homo sapiens
acaggaggccagt

SEQ ID NO: 5552344 - DNA, 16 bp, Homo sapiens
acaggaggccatgccc

SEQ ID NO: 5552345 - DNA, 13 bp, Homo sapiens
acaggaggcggcc

SEQ ID NO: 5552346 - DNA, 21 bp, Homo sapiens
acaggaggcggcccggccagc

SEQ ID NO: 5552347 - DNA, 21 bp, Homo sapiens
acaggaggctccgtgagccct

SEQ ID NO: 5552348 - DNA, 12 bp, Homo sapiens
acaggagggcca

SEQ ID NO: 5552349 - DNA, 21 bp, Homo sapiens
acaggaggggcccacaatgga

SEQ ID NO: 5552350 - DNA, 20 bp, Homo sapiens
acaggagggggtcgtggaga

SEQ ID NO: 5552351 - DNA, 15 bp, Homo sapiens
acaggaggggtctca

SEQ ID NO: 5552352 - DNA, 23 bp, Homo sapiens
acaggaggtggatttggagaccg

SEQ ID NO: 5552353 - DNA, 19 bp, Homo sapiens
acaggaggtgtgaatgcac

SEQ ID NO: 5552354 - DNA, 19 bp, Homo sapiens
acaggagtcagtgtctggc

SEQ ID NO: 5552355 - DNA, 20 bp, Homo sapiens
acaggagtcagtgtctggct

SEQ ID NO: 5552356 - DNA, 21 bp, Homo sapiens
acaggagtgtcctcttccctc

SEQ ID NO: 5552357 - DNA, 23 bp, Homo sapiens
acaggagtgtcctcttccctctc

SEQ ID NO: 5552358 - DNA, 15 bp, Homo sapiens
acaggatacaggtga

SEQ ID NO: 5552359 - DNA, 16 bp, Homo sapiens
acaggatatcacctga

SEQ ID NO: 5552360 - DNA, 23 bp, Homo sapiens
acaggatatgctttaagacagaa

SEQ ID NO: 5552361 - DNA, 23 bp, Homo sapiens
acaggatattaaacgtgtaaatt

SEQ ID NO: 5552362 - DNA, 15 bp, Homo sapiens
acaggatcagtctga

SEQ ID NO: 5552363 - DNA, 22 bp, Homo sapiens
acaggatcatcatttaaaaaaa

SEQ ID NO: 5552364 - DNA, 13 bp, Homo sapiens
acaggatccaggc

SEQ ID NO: 5552365 - DNA, 18 bp, Homo sapiens
acaggatccaggccggct

SEQ ID NO: 5552366 - DNA, 22 bp, Homo sapiens
acaggatcctattctcaccagg

SEQ ID NO: 5552367 - DNA, 17 bp, Homo sapiens
acaggatgaaagttccc

SEQ ID NO: 5552368 - DNA, 17 bp, Homo sapiens
acaggatgaactagcca

SEQ ID NO: 5552369 - DNA, 19 bp, Homo sapiens
acaggatgaactagccatg

SEQ ID NO: 5552370 - DNA, 16 bp, Homo sapiens
acaggatgaggacaga

SEQ ID NO: 5552371 - DNA, 21 bp, Homo sapiens
acaggatgaggtggtggagtg

SEQ ID NO: 5552372 - DNA, 22 bp, Homo sapiens
acaggatgcatattaaagaaag

SEQ ID NO: 5552373 - DNA, 15 bp, Homo sapiens
acaggatgccagccc

SEQ ID NO: 5552374 - DNA, 18 bp, Homo sapiens
acaggatgccagcccctg

SEQ ID NO: 5552375 - DNA, 22 bp, Homo sapiens
acaggatgccagcccctgcctg

SEQ ID NO: 5552376 - DNA, 24 bp, Homo sapiens
acaggatgccagcccctgcctggg

SEQ ID NO: 5552377 - DNA, 19 bp, Homo sapiens
acaggatgggggctggcct

SEQ ID NO: 5552378 - DNA, 21 bp, Homo sapiens
acaggatggtgggcaggatct

SEQ ID NO: 5552379 - DNA, 22 bp, Homo sapiens
acaggatggttcccttgatgaa

SEQ ID NO: 5552380 - DNA, 19 bp, Homo sapiens
acaggatgtgtttgctttc

SEQ ID NO: 5552381 - DNA, 20 bp, Homo sapiens
acaggatgtgtttgctttct

SEQ ID NO: 5552382 - DNA, 21 bp, Homo sapiens
acaggatgtgtttgctttctg

SEQ ID NO: 5552383 - DNA, 14 bp, Homo sapiens
acaggattattgga

SEQ ID NO: 5552384 - DNA, 23 bp, Homo sapiens
acaggattccagttgcgtgtctg

SEQ ID NO: 5552385 - DNA, 16 bp, Homo sapiens
acaggattctgacaga

SEQ ID NO: 5552386 - DNA, 16 bp, Homo sapiens
acaggattgtctgctg

SEQ ID NO: 5552387 - DNA, 17 bp, Homo sapiens
acaggattgtctgctgc

SEQ ID NO: 5552388 - DNA, 14 bp, Homo sapiens
acaggattttcaag

SEQ ID NO: 5552389 - DNA, 15 bp, Homo sapiens
acaggcaaacatttt

SEQ ID NO: 5552390 - DNA, 14 bp, Homo sapiens
acaggcaaatgcat

SEQ ID NO: 5552391 - DNA, 20 bp, Homo sapiens
acaggcaacattacaaacaa

SEQ ID NO: 5552392 - DNA, 12 bp, Homo sapiens
acaggcaagcac

SEQ ID NO: 5552393 - DNA, 19 bp, Homo sapiens
acaggcaagcacctcctgc

SEQ ID NO: 5552394 - DNA, 23 bp, Homo sapiens
acaggcaagcacctcctgcctcg

SEQ ID NO: 5552395 - DNA, 16 bp, Homo sapiens
acaggcaatgctggct

SEQ ID NO: 5552396 - DNA, 13 bp, Homo sapiens
acaggcacaaaat

SEQ ID NO: 5552397 - DNA, 14 bp, Homo sapiens
acaggcacaaaatg

SEQ ID NO: 5552398 - DNA, 17 bp, Homo sapiens
acaggcacacaccacca

SEQ ID NO: 5552399 - DNA, 15 bp, Homo sapiens
acaggcaccatgctg

SEQ ID NO: 5552400 - DNA, 14 bp, Homo sapiens
acaggcaccgagaa

SEQ ID NO: 5552401 - DNA, 16 bp, Homo sapiens
acaggcactgccctgg

SEQ ID NO: 5552402 - DNA, 15 bp, Homo sapiens
acaggcactttgaga

SEQ ID NO: 5552403 - DNA, 16 bp, Homo sapiens
acaggcagaaatataa

SEQ ID NO: 5552404 - DNA, 13 bp, Homo sapiens
acaggcagaatca

SEQ ID NO: 5552405 - DNA, 13 bp, Homo sapiens
acaggcagcacag

SEQ ID NO: 5552406 - DNA, 23 bp, Homo sapiens
acaggcagccagccgtggccaga

SEQ ID NO: 5552407 - DNA, 15 bp, Homo sapiens
acaggcagccagtgc

SEQ ID NO: 5552408 - DNA, 17 bp, Homo sapiens
acaggcagcccagcagt

SEQ ID NO: 5552409 - DNA, 22 bp, Homo sapiens
acaggcagcctggacatagaga

SEQ ID NO: 5552410 - DNA, 18 bp, Homo sapiens
acaggcagctctgagccg

SEQ ID NO: 5552411 - DNA, 21 bp, Homo sapiens
acaggcagctggatgagactt

SEQ ID NO: 5552412 - DNA, 15 bp, Homo sapiens
acaggcagctttcta

SEQ ID NO: 5552413 - DNA, 19 bp, Homo sapiens
acaggcaggaagagagaga

SEQ ID NO: 5552414 - DNA, 22 bp, Homo sapiens
acaggcaggccagatggcccct

SEQ ID NO: 5552415 - DNA, 22 bp, Homo sapiens
acaggcagggcaggaccagccc

SEQ ID NO: 5552416 - DNA, 23 bp, Homo sapiens
acaggcagggcaggaccagccca

SEQ ID NO: 5552417 - DNA, 16 bp, Homo sapiens
acaggcagggcctggc

SEQ ID NO: 5552418 - DNA, 20 bp, Homo sapiens
acaggcaggggtgagagcac

SEQ ID NO: 5552419 - DNA, 14 bp, Homo sapiens
acaggcaggtacag

SEQ ID NO: 5552420 - DNA, 13 bp, Homo sapiens
acaggcaggtcca

SEQ ID NO: 5552421 - DNA, 16 bp, Homo sapiens
acaggcaggtccaggg

SEQ ID NO: 5552422 - DNA, 20 bp, Homo sapiens
acaggcagtctctctcttcc

SEQ ID NO: 5552423 - DNA, 13 bp, Homo sapiens
acaggcagtgcat

SEQ ID NO: 5552424 - DNA, 19 bp, Homo sapiens
acaggcagttacttctgag

SEQ ID NO: 5552425 - DNA, 18 bp, Homo sapiens
acaggcagttaggtgctg

SEQ ID NO: 5552426 - DNA, 23 bp, Homo sapiens
acaggcagttaggtgctgaatga

SEQ ID NO: 5552427 - DNA, 15 bp, Homo sapiens
acaggcatagagtga

SEQ ID NO: 5552428 - DNA, 20 bp, Homo sapiens
acaggcatattccctgcaca

SEQ ID NO: 5552429 - DNA, 22 bp, Homo sapiens
acaggcatccgctgcgctccca

SEQ ID NO: 5552430 - DNA, 18 bp, Homo sapiens
acaggcatctacacagcc

SEQ ID NO: 5552431 - DNA, 19 bp, Homo sapiens
acaggcatctacacagcct

SEQ ID NO: 5552432 - DNA, 21 bp, Homo sapiens
acaggcatgggtgcaaggaaa

SEQ ID NO: 5552433 - DNA, 18 bp, Homo sapiens
acaggcatgttctctgag

SEQ ID NO: 5552434 - DNA, 17 bp, Homo sapiens
acaggccacacgctgcc

SEQ ID NO: 5552435 - DNA, 20 bp, Homo sapiens
acaggccacacgctgcccag

SEQ ID NO: 5552436 - DNA, 19 bp, Homo sapiens
acaggccaccctgtgcaga

SEQ ID NO: 5552437 - DNA, 19 bp, Homo sapiens
acaggccactgcaaaccct

SEQ ID NO: 5552438 - DNA, 17 bp, Homo sapiens
acaggccagccccatct

SEQ ID NO: 5552439 - DNA, 18 bp, Homo sapiens
acaggccagccccatctt

SEQ ID NO: 5552440 - DNA, 19 bp, Homo sapiens
acaggccagccccatcttg

SEQ ID NO: 5552441 - DNA, 17 bp, Homo sapiens
acaggccaggctccagc

SEQ ID NO: 5552442 - DNA, 18 bp, Homo sapiens
acaggccatgtgagccac

SEQ ID NO: 5552443 - DNA, 19 bp, Homo sapiens
acaggccattgtgaaccaa

SEQ ID NO: 5552444 - DNA, 15 bp, Homo sapiens
acaggccatttcatt

SEQ ID NO: 5552445 - DNA, 12 bp, Homo sapiens
acaggcccagag

SEQ ID NO: 5552446 - DNA, 11 bp, Homo sapiens
acaggcccagc

SEQ ID NO: 5552447 - DNA, 18 bp, Homo sapiens
acaggcccagcattgctg

SEQ ID NO: 5552448 - DNA, 20 bp, Homo sapiens
acaggcccagcgcggccagc

SEQ ID NO: 5552449 - DNA, 21 bp, Homo sapiens
acaggcccaggaaggcggcag

SEQ ID NO: 5552450 - DNA, 16 bp, Homo sapiens
acaggcccatgccctc

SEQ ID NO: 5552451 - DNA, 17 bp, Homo sapiens
acaggccccacgccctc

SEQ ID NO: 5552452 - DNA, 16 bp, Homo sapiens
acaggccccttttgtg

SEQ ID NO: 5552453 - DNA, 21 bp, Homo sapiens
acaggcccgccctctgcctcc

SEQ ID NO: 5552454 - DNA, 23 bp, Homo sapiens
acaggccctcctccctcccagct

SEQ ID NO: 5552455 - DNA, 20 bp, Homo sapiens
acaggccctggagaagcagc

SEQ ID NO: 5552456 - DNA, 13 bp, Homo sapiens
acaggcccttcct

SEQ ID NO: 5552457 - DNA, 22 bp, Homo sapiens
acaggcccttggggttccccca

SEQ ID NO: 5552458 - DNA, 23 bp, Homo sapiens
acaggcccttggggttcccccag

SEQ ID NO: 5552459 - DNA, 21 bp, Homo sapiens
acaggccctttcctcaggcaa

SEQ ID NO: 5552460 - DNA, 20 bp, Homo sapiens
acaggccgcacatctcactt

SEQ ID NO: 5552461 - DNA, 16 bp, Homo sapiens
acaggccgccctgcgg

SEQ ID NO: 5552462 - DNA, 18 bp, Homo sapiens
acaggccgtcaccctggg

SEQ ID NO: 5552463 - DNA, 21 bp, Homo sapiens
acaggccgtgggacccaggct

SEQ ID NO: 5552464 - DNA, 17 bp, Homo sapiens
acaggcctatttaacaa

SEQ ID NO: 5552465 - DNA, 17 bp, Homo sapiens
acaggcctcaagcgtgg

SEQ ID NO: 5552466 - DNA, 15 bp, Homo sapiens
acaggcctcagggct

SEQ ID NO: 5552467 - DNA, 11 bp, Homo sapiens
acaggcctccc

SEQ ID NO: 5552468 - DNA, 13 bp, Homo sapiens
acaggcctccctg

SEQ ID NO: 5552469 - DNA, 16 bp, Homo sapiens
acaggcctccctgttt

SEQ ID NO: 5552470 - DNA, 19 bp, Homo sapiens
acaggcctctcttttcccc

SEQ ID NO: 5552471 - DNA, 12 bp, Homo sapiens
acaggcctggcc

SEQ ID NO: 5552472 - DNA, 14 bp, Homo sapiens
acaggcctggccca

SEQ ID NO: 5552473 - DNA, 16 bp, Homo sapiens
acaggcctggcccagc

SEQ ID NO: 5552474 - DNA, 20 bp, Homo sapiens
acaggcctggcccagccagc

SEQ ID NO: 5552475 - DNA, 14 bp, Homo sapiens
acaggcctggcctc

SEQ ID NO: 5552476 - DNA, 19 bp, Homo sapiens
acaggcctgtgtagctgtg

SEQ ID NO: 5552477 - DNA, 23 bp, Homo sapiens
acaggcctgtgtagctgtgacct

SEQ ID NO: 5552478 - DNA, 19 bp, Homo sapiens
acaggccttcctcctctca

SEQ ID NO: 5552479 - DNA, 11 bp, Homo sapiens
acaggccttct

SEQ ID NO: 5552480 - DNA, 17 bp, Homo sapiens
acaggccttctgtgggg

SEQ ID NO: 5552481 - DNA, 12 bp, Homo sapiens
acaggccttgct

SEQ ID NO: 5552482 - DNA, 23 bp, Homo sapiens
acaggcctttccctgccggcccc

SEQ ID NO: 5552483 - DNA, 13 bp, Homo sapiens
acaggcgagagag

SEQ ID NO: 5552484 - DNA, 15 bp, Homo sapiens
acaggcgcacaccac

SEQ ID NO: 5552485 - DNA, 19 bp, Homo sapiens
acaggcgcacaccaccaca

SEQ ID NO: 5552486 - DNA, 13 bp, Homo sapiens
acaggcgctccag

SEQ ID NO: 5552487 - DNA, 19 bp, Homo sapiens
acaggctacaaagcagaga

SEQ ID NO: 5552488 - DNA, 18 bp, Homo sapiens
acaggctactctcctcgg

SEQ ID NO: 5552489 - DNA, 15 bp, Homo sapiens
acaggctcaggcagg

SEQ ID NO: 5552490 - DNA, 18 bp, Homo sapiens
acaggctccaagaggctg

SEQ ID NO: 5552491 - DNA, 16 bp, Homo sapiens
acaggctcgtcagcca

SEQ ID NO: 5552492 - DNA, 22 bp, Homo sapiens
acaggctctagagagagggaga

SEQ ID NO: 5552493 - DNA, 14 bp, Homo sapiens
acaggctctgaggg

SEQ ID NO: 5552494 - DNA, 13 bp, Homo sapiens
acaggctcttagc

SEQ ID NO: 5552495 - DNA, 23 bp, Homo sapiens
acaggctgaaatatccacccagc

SEQ ID NO: 5552496 - DNA, 15 bp, Homo sapiens
acaggctgagaactc

SEQ ID NO: 5552497 - DNA, 15 bp, Homo sapiens
acaggctgagtgcag

SEQ ID NO: 5552498 - DNA, 17 bp, Homo sapiens
acaggctgagtgcaggc

SEQ ID NO: 5552499 - DNA, 19 bp, Homo sapiens
acaggctgagtgcaggccc

SEQ ID NO: 5552500 - DNA, 21 bp, Homo sapiens
acaggctgagtgcaggcccac

SEQ ID NO: 5552501 - DNA, 17 bp, Homo sapiens
acaggctgatttggagt

SEQ ID NO: 5552502 - DNA, 18 bp, Homo sapiens
acaggctgcaagctgcag

SEQ ID NO: 5552503 - DNA, 12 bp, Homo sapiens
acaggctgcccc

SEQ ID NO: 5552504 - DNA, 19 bp, Homo sapiens
acaggctgccccacccctc

SEQ ID NO: 5552505 - DNA, 22 bp, Homo sapiens
acaggctgccccacccctccat

SEQ ID NO: 5552506 - DNA, 23 bp, Homo sapiens
acaggctgccccacccctccatg

SEQ ID NO: 5552507 - DNA, 22 bp, Homo sapiens
acaggctgccgctgctctccca

SEQ ID NO: 5552508 - DNA, 18 bp, Homo sapiens
acaggctgcggcccctcc

SEQ ID NO: 5552509 - DNA, 24 bp, Homo sapiens
acaggctgcggcccctcccccgtc

SEQ ID NO: 5552510 - DNA, 20 bp, Homo sapiens
acaggctggaagatagctgt

SEQ ID NO: 5552511 - DNA, 15 bp, Homo sapiens
acaggctgggctggg

SEQ ID NO: 5552512 - DNA, 14 bp, Homo sapiens
acaggctgggcttc

SEQ ID NO: 5552513 - DNA, 21 bp, Homo sapiens
acaggctgggcttcagtggca

SEQ ID NO: 5552514 - DNA, 13 bp, Homo sapiens
acaggctggggcc

SEQ ID NO: 5552515 - DNA, 22 bp, Homo sapiens
acaggctgggtcctgccagctg

SEQ ID NO: 5552516 - DNA, 15 bp, Homo sapiens
acaggctgtaaattg

SEQ ID NO: 5552517 - DNA, 22 bp, Homo sapiens
acaggctgtaaattgaacttcc

SEQ ID NO: 5552518 - DNA, 19 bp, Homo sapiens
acaggctgtgactcttctc

SEQ ID NO: 5552519 - DNA, 23 bp, Homo sapiens
acaggctgtgactcttctctcaa

SEQ ID NO: 5552520 - DNA, 15 bp, Homo sapiens
acaggctgtgccttg

SEQ ID NO: 5552521 - DNA, 19 bp, Homo sapiens
acaggctgttctgcactga

SEQ ID NO: 5552522 - DNA, 21 bp, Homo sapiens
acaggctgttctgcactgaaa

SEQ ID NO: 5552523 - DNA, 20 bp, Homo sapiens
acaggcttagtgatgtaatt

SEQ ID NO: 5552524 - DNA, 17 bp, Homo sapiens
acaggcttcgtctcaga

SEQ ID NO: 5552525 - DNA, 19 bp, Homo sapiens
acaggcttcgtctcagaag

SEQ ID NO: 5552526 - DNA, 19 bp, Homo sapiens
acagggaaaaaaagaaaaa

SEQ ID NO: 5552527 - DNA, 17 bp, Homo sapiens
acagggaaaatgaagct

SEQ ID NO: 5552528 - DNA, 18 bp, Homo sapiens
acagggaaatactgtatt

SEQ ID NO: 5552529 - DNA, 19 bp, Homo sapiens
acagggaacacattccttt

SEQ ID NO: 5552530 - DNA, 23 bp, Homo sapiens
acagggaaccctgcttgcacttt

SEQ ID NO: 5552531 - DNA, 22 bp, Homo sapiens
acagggaacgtgattagtgaaa

SEQ ID NO: 5552532 - DNA, 14 bp, Homo sapiens
acagggaagaaatc

SEQ ID NO: 5552533 - DNA, 14 bp, Homo sapiens
acagggaagcatgt

SEQ ID NO: 5552534 - DNA, 15 bp, Homo sapiens
acagggaagctacag

SEQ ID NO: 5552535 - DNA, 14 bp, Homo sapiens
acagggaagctcac

SEQ ID NO: 5552536 - DNA, 14 bp, Homo sapiens
acagggaaggcagg

SEQ ID NO: 5552537 - DNA, 15 bp, Homo sapiens
acagggaaggcaggc

SEQ ID NO: 5552538 - DNA, 21 bp, Homo sapiens
acagggaaggcaggcagggct

SEQ ID NO: 5552539 - DNA, 15 bp, Homo sapiens
acagggacaaagaaa

SEQ ID NO: 5552540 - DNA, 16 bp, Homo sapiens
acagggaccagctccc

SEQ ID NO: 5552541 - DNA, 21 bp, Homo sapiens
acagggacttgtttagagagc

SEQ ID NO: 5552542 - DNA, 21 bp, Homo sapiens
acagggagccggcggcctctc

SEQ ID NO: 5552543 - DNA, 23 bp, Homo sapiens
acagggagccggcggcctctcga

SEQ ID NO: 5552544 - DNA, 16 bp, Homo sapiens
acagggagcctcctgc

SEQ ID NO: 5552545 - DNA, 14 bp, Homo sapiens
acagggagctggca

SEQ ID NO: 5552546 - DNA, 20 bp, Homo sapiens
acagggaggctcccggggcc

SEQ ID NO: 5552547 - DNA, 20 bp, Homo sapiens
acagggagggaacagacctc

SEQ ID NO: 5552548 - DNA, 22 bp, Homo sapiens
acagggagggccggcggctctg

SEQ ID NO: 5552549 - DNA, 12 bp, Homo sapiens
acagggagggga

SEQ ID NO: 5552550 - DNA, 14 bp, Homo sapiens
acagggaggggatg

SEQ ID NO: 5552551 - DNA, 21 bp, Homo sapiens
acagggagggggacctgtccc

SEQ ID NO: 5552552 - DNA, 22 bp, Homo sapiens
acagggataaggcctgtggggg

SEQ ID NO: 5552553 - DNA, 19 bp, Homo sapiens
acagggatctgtttgaaca

SEQ ID NO: 5552554 - DNA, 13 bp, Homo sapiens
acagggatgctgg

SEQ ID NO: 5552555 - DNA, 23 bp, Homo sapiens
acagggcaaaatcgccataggcc

SEQ ID NO: 5552556 - DNA, 14 bp, Homo sapiens
acagggcaaaatga

SEQ ID NO: 5552557 - DNA, 23 bp, Homo sapiens
acagggcaaaatgaactaactgc

SEQ ID NO: 5552558 - DNA, 15 bp, Homo sapiens
acagggcaaggacac

SEQ ID NO: 5552559 - DNA, 20 bp, Homo sapiens
acagggcacaccgggcactc

SEQ ID NO: 5552560 - DNA, 16 bp, Homo sapiens
acagggcaccagaggc

SEQ ID NO: 5552561 - DNA, 15 bp, Homo sapiens
acagggcacctgcca

SEQ ID NO: 5552562 - DNA, 12 bp, Homo sapiens
acagggcactga

SEQ ID NO: 5552563 - DNA, 20 bp, Homo sapiens
acagggcagagcaggaagga

SEQ ID NO: 5552564 - DNA, 16 bp, Homo sapiens
acagggcagagccggg

SEQ ID NO: 5552565 - DNA, 11 bp, Homo sapiens
acagggcagca

SEQ ID NO: 5552566 - DNA, 17 bp, Homo sapiens
acagggcagcagtgggg

SEQ ID NO: 5552567 - DNA, 18 bp, Homo sapiens
acagggcagctgggccca

SEQ ID NO: 5552568 - DNA, 16 bp, Homo sapiens
acagggcaggagctgc

SEQ ID NO: 5552569 - DNA, 23 bp, Homo sapiens
acagggcaggccttgctggggtc

SEQ ID NO: 5552570 - DNA, 21 bp, Homo sapiens
acagggcagtccttactcccc

SEQ ID NO: 5552571 - DNA, 22 bp, Homo sapiens
acagggcagtccttactccccc

SEQ ID NO: 5552572 - DNA, 17 bp, Homo sapiens
acagggcatctccagga

SEQ ID NO: 5552573 - DNA, 15 bp, Homo sapiens
acagggccacataga

SEQ ID NO: 5552574 - DNA, 18 bp, Homo sapiens
acagggccagtggggcct

SEQ ID NO: 5552575 - DNA, 15 bp, Homo sapiens
acagggcccaggcct

SEQ ID NO: 5552576 - DNA, 18 bp, Homo sapiens
acagggcccaggcctgga

SEQ ID NO: 5552577 - DNA, 20 bp, Homo sapiens
acagggcccaggcctggagc

SEQ ID NO: 5552578 - DNA, 21 bp, Homo sapiens
acagggcccgggcccaggcag

SEQ ID NO: 5552579 - DNA, 24 bp, Homo sapiens
acagggccctctgaggctcagccc

SEQ ID NO: 5552580 - DNA, 12 bp, Homo sapiens
acagggcctctg

SEQ ID NO: 5552581 - DNA, 17 bp, Homo sapiens
acagggctccagcctgt

SEQ ID NO: 5552582 - DNA, 18 bp, Homo sapiens
acagggctccagcctgtc

SEQ ID NO: 5552583 - DNA, 23 bp, Homo sapiens
acagggctccagcctgtcggcca

SEQ ID NO: 5552584 - DNA, 23 bp, Homo sapiens
acagggctgatagagtgattttg

SEQ ID NO: 5552585 - DNA, 23 bp, Homo sapiens
acagggctggcccagccctgctg

SEQ ID NO: 5552586 - DNA, 13 bp, Homo sapiens
acagggcttctcc

SEQ ID NO: 5552587 - DNA, 16 bp, Homo sapiens
acagggcttggggagc

SEQ ID NO: 5552588 - DNA, 23 bp, Homo sapiens
acaggggaaggaaataacattgc

SEQ ID NO: 5552589 - DNA, 17 bp, Homo sapiens
acaggggaatattttat

SEQ ID NO: 5552590 - DNA, 20 bp, Homo sapiens
acaggggaatattttattca

SEQ ID NO: 5552591 - DNA, 22 bp, Homo sapiens
acaggggaatattttattcaag

SEQ ID NO: 5552592 - DNA, 18 bp, Homo sapiens
acaggggacactgaacct

SEQ ID NO: 5552593 - DNA, 20 bp, Homo sapiens
acaggggaggaaaaaagaac

SEQ ID NO: 5552594 - DNA, 22 bp, Homo sapiens
acaggggaggtgatagcattgc

SEQ ID NO: 5552595 - DNA, 15 bp, Homo sapiens
acaggggatcaaagt

SEQ ID NO: 5552596 - DNA, 14 bp, Homo sapiens
acaggggccagaag

SEQ ID NO: 5552597 - DNA, 23 bp, Homo sapiens
acaggggccagaagatgaacaga

SEQ ID NO: 5552598 - DNA, 16 bp, Homo sapiens
acaggggccatgcccc

SEQ ID NO: 5552599 - DNA, 22 bp, Homo sapiens
acaggggccctgtacagtgaat

SEQ ID NO: 5552600 - DNA, 15 bp, Homo sapiens
acaggggctcaggat

SEQ ID NO: 5552601 - DNA, 21 bp, Homo sapiens
acagggggaagttcagaaggt

SEQ ID NO: 5552602 - DNA, 18 bp, Homo sapiens
acagggggattctgagca

SEQ ID NO: 5552603 - DNA, 16 bp, Homo sapiens
acagggggccagaaca

SEQ ID NO: 5552604 - DNA, 23 bp, Homo sapiens
acaggggggtcggaagcctgtcc

SEQ ID NO: 5552605 - DNA, 15 bp, Homo sapiens
acagggggtctggct

SEQ ID NO: 5552606 - DNA, 16 bp, Homo sapiens
acaggggttccttctg

SEQ ID NO: 5552607 - DNA, 22 bp, Homo sapiens
acagggtaactaactaaaacaa

SEQ ID NO: 5552608 - DNA, 17 bp, Homo sapiens
acagggtactaaaagaa

SEQ ID NO: 5552609 - DNA, 17 bp, Homo sapiens
acagggtagcaggtacc

SEQ ID NO: 5552610 - DNA, 14 bp, Homo sapiens
acagggtcaactgg

SEQ ID NO: 5552611 - DNA, 18 bp, Homo sapiens
acagggtcccacagccac

SEQ ID NO: 5552612 - DNA, 14 bp, Homo sapiens
acagggtccctgga

SEQ ID NO: 5552613 - DNA, 18 bp, Homo sapiens
acagggtctcactatgtt

SEQ ID NO: 5552614 - DNA, 12 bp, Homo sapiens
acagtgagagac

SEQ ID NO: 5552615 - DNA, 22 bp, Homo sapiens
acagtgagaggggagggctcct

SEQ ID NO: 5552616 - DNA, 12 bp, Homo sapiens
acagtgagcctg

SEQ ID NO: 5552617 - DNA, 18 bp, Homo sapiens
acagtgagcctgaatttt

SEQ ID NO: 5552618 - DNA, 13 bp, Homo sapiens
acagtgagctcta

SEQ ID NO: 5552619 - DNA, 23 bp, Homo sapiens
acagtgagcttggaaaggaccag

SEQ ID NO: 5552620 - DNA, 17 bp, Homo sapiens
acagtgaggcaggagaa

SEQ ID NO: 5552621 - DNA, 15 bp, Homo sapiens
acagtgataggccca

SEQ ID NO: 5552622 - DNA, 18 bp, Homo sapiens
acagtgatctccatatgt

SEQ ID NO: 5552623 - DNA, 19 bp, Homo sapiens
acagtgatctccatatgtt

SEQ ID NO: 5552624 - DNA, 15 bp, Homo sapiens
acagtgatgattgaa

SEQ ID NO: 5552625 - DNA, 15 bp, Homo sapiens
acagtgatgccgggc

SEQ ID NO: 5552626 - DNA, 14 bp, Homo sapiens
acagtgatgcctgc

SEQ ID NO: 5552627 - DNA, 24 bp, Homo sapiens
acagtgatgctgtgctatgaattt

SEQ ID NO: 5552628 - DNA, 21 bp, Homo sapiens
acagtgattaaagcaagagaa

SEQ ID NO: 5552629 - DNA, 20 bp, Homo sapiens
acagtgattaccagggactg

SEQ ID NO: 5552630 - DNA, 21 bp, Homo sapiens
acagtgattaccagggactga

SEQ ID NO: 5552631 - DNA, 13 bp, Homo sapiens
acagtgatttttt

SEQ ID NO: 5552632 - DNA, 21 bp, Homo sapiens
acagtgcaagtgagtataact

SEQ ID NO: 5552633 - DNA, 14 bp, Homo sapiens
acagtgcacatgaa

SEQ ID NO: 5552634 - DNA, 15 bp, Homo sapiens
acagtgcacatgaac

SEQ ID NO: 5552635 - DNA, 16 bp, Homo sapiens
acagtgcactcagagc

SEQ ID NO: 5552636 - DNA, 13 bp, Homo sapiens
acagtgcagacag

SEQ ID NO: 5552637 - DNA, 21 bp, Homo sapiens
acagtgcagagccttctcaga

SEQ ID NO: 5552638 - DNA, 22 bp, Homo sapiens
acagtgcagagccttctcagaa

SEQ ID NO: 5552639 - DNA, 14 bp, Homo sapiens
acagtgcagaggct

SEQ ID NO: 5552640 - DNA, 18 bp, Homo sapiens
acagtgcagcttgcagtc

SEQ ID NO: 5552641 - DNA, 19 bp, Homo sapiens
acagtgcagttgaggtctg

SEQ ID NO: 5552642 - DNA, 20 bp, Homo sapiens
acagtgcatattcctttcta

SEQ ID NO: 5552643 - DNA, 11 bp, Homo sapiens
acagtgccaaa

SEQ ID NO: 5552644 - DNA, 19 bp, Homo sapiens
acagtgccatccccacctt

SEQ ID NO: 5552645 - DNA, 21 bp, Homo sapiens
acagtgccatccccaccttca

SEQ ID NO: 5552646 - DNA, 23 bp, Homo sapiens
acagtgcccaccgccctcctcca

SEQ ID NO: 5552647 - DNA, 18 bp, Homo sapiens
acagtgcccagctaattt

SEQ ID NO: 5552648 - DNA, 15 bp, Homo sapiens
acagtgccctgagac

SEQ ID NO: 5552649 - DNA, 15 bp, Homo sapiens
acagtgcctcttcca

SEQ ID NO: 5552650 - DNA, 17 bp, Homo sapiens
acagtgcctcttccagt

SEQ ID NO: 5552651 - DNA, 24 bp, Homo sapiens
acagtgcctgatgggagtaggctc

SEQ ID NO: 5552652 - DNA, 11 bp, Homo sapiens
acagtgcctgc

SEQ ID NO: 5552653 - DNA, 21 bp, Homo sapiens
acagtgccttcaataaatggt

SEQ ID NO: 5552654 - DNA, 14 bp, Homo sapiens
acagtgctaaaaat

SEQ ID NO: 5552655 - DNA, 17 bp, Homo sapiens
acagtgctactgaaagg

SEQ ID NO: 5552656 - DNA, 15 bp, Homo sapiens
acagtgctcagttgt

SEQ ID NO: 5552657 - DNA, 19 bp, Homo sapiens
acagtgctctaggctgccc

SEQ ID NO: 5552658 - DNA, 13 bp, Homo sapiens
acagtgctctgcc

SEQ ID NO: 5552659 - DNA, 14 bp, Homo sapiens
acagtgctctgcct

SEQ ID NO: 5552660 - DNA, 17 bp, Homo sapiens
acagtgctctgcctcta

SEQ ID NO: 5552661 - DNA, 12 bp, Homo sapiens
acagtgctgacc

SEQ ID NO: 5552662 - DNA, 19 bp, Homo sapiens
acagtgctgaccccaggaa

SEQ ID NO: 5552663 - DNA, 22 bp, Homo sapiens
acagtgctgaccccaggaagtg

SEQ ID NO: 5552664 - DNA, 21 bp, Homo sapiens
acagtgctgcagctccctggc

SEQ ID NO: 5552665 - DNA, 22 bp, Homo sapiens
acagtgctgccacttaaaaaga

SEQ ID NO: 5552666 - DNA, 15 bp, Homo sapiens
acagtgctgcccctt

SEQ ID NO: 5552667 - DNA, 13 bp, Homo sapiens
acagtgctgttct

SEQ ID NO: 5552668 - DNA, 17 bp, Homo sapiens
acagtgctgttgaagat

SEQ ID NO: 5552669 - DNA, 15 bp, Homo sapiens
acagtgctgttggtg

SEQ ID NO: 5552670 - DNA, 18 bp, Homo sapiens
acagtgcttcagcctgag

SEQ ID NO: 5552671 - DNA, 22 bp, Homo sapiens
acagtgcttcagcctgaggctg

SEQ ID NO: 5552672 - DNA, 21 bp, Homo sapiens
acagtgcttgccacagagcgg

SEQ ID NO: 5552673 - DNA, 18 bp, Homo sapiens
acagtggaaccagcccag

SEQ ID NO: 5552674 - DNA, 16 bp, Homo sapiens
acagtggactcagcag

SEQ ID NO: 5552675 - DNA, 21 bp, Homo sapiens
acagtggactcagcagtgacc

SEQ ID NO: 5552676 - DNA, 15 bp, Homo sapiens
acagtggagaaatat

SEQ ID NO: 5552677 - DNA, 17 bp, Homo sapiens
acagtggagaaatattt

SEQ ID NO: 5552678 - DNA, 12 bp, Homo sapiens
acagtggaggga

SEQ ID NO: 5552679 - DNA, 16 bp, Homo sapiens
acagtggagggagact

SEQ ID NO: 5552680 - DNA, 19 bp, Homo sapiens
acagtggagggagactgac

SEQ ID NO: 5552681 - DNA, 14 bp, Homo sapiens
acagtggagtgaga

SEQ ID NO: 5552682 - DNA, 16 bp, Homo sapiens
acagtggagtgagatc

SEQ ID NO: 5552683 - DNA, 15 bp, Homo sapiens
acagtggatcacaaa

SEQ ID NO: 5552684 - DNA, 18 bp, Homo sapiens
acagtggatcacaaagtg

SEQ ID NO: 5552685 - DNA, 12 bp, Homo sapiens
acagtggatgcc

SEQ ID NO: 5552686 - DNA, 20 bp, Homo sapiens
acagtggatgcccatctaaa

SEQ ID NO: 5552687 - DNA, 19 bp, Homo sapiens
acagtggattgtttatact

SEQ ID NO: 5552688 - DNA, 18 bp, Homo sapiens
acagtggcacaaaaaaat

SEQ ID NO: 5552689 - DNA, 19 bp, Homo sapiens
acagtggcacggagagaag

SEQ ID NO: 5552690 - DNA, 16 bp, Homo sapiens
acagtggcactaaaat

SEQ ID NO: 5552691 - DNA, 14 bp, Homo sapiens
acagtggcagtatt

SEQ ID NO: 5552692 - DNA, 12 bp, Homo sapiens
acagtggccttg

SEQ ID NO: 5552693 - DNA, 15 bp, Homo sapiens
acagtggcgggccca

SEQ ID NO: 5552694 - DNA, 17 bp, Homo sapiens
acagtggcgggcccact

SEQ ID NO: 5552695 - DNA, 16 bp, Homo sapiens
acagtggctcacgcct

SEQ ID NO: 5552696 - DNA, 14 bp, Homo sapiens
acagtggctgctct

SEQ ID NO: 5552697 - DNA, 16 bp, Homo sapiens
acagtggctgctctgg

SEQ ID NO: 5552698 - DNA, 22 bp, Homo sapiens
acagtggctgggtgggcccaga

SEQ ID NO: 5552699 - DNA, 15 bp, Homo sapiens
acagtgggaaatatt

SEQ ID NO: 5552700 - DNA, 18 bp, Homo sapiens
acagtgggaactctgaca

SEQ ID NO: 5552701 - DNA, 17 bp, Homo sapiens
acagtgggaagaatagc

SEQ ID NO: 5552702 - DNA, 15 bp, Homo sapiens
acagtgggagccagg

SEQ ID NO: 5552703 - DNA, 14 bp, Homo sapiens
acagtgggagccct

SEQ ID NO: 5552704 - DNA, 23 bp, Homo sapiens
acagtgggcagcacctttctagc

SEQ ID NO: 5552705 - DNA, 22 bp, Homo sapiens
acagtgggcaggaggccccagg

SEQ ID NO: 5552706 - DNA, 13 bp, Homo sapiens
acagtgggcatca

SEQ ID NO: 5552707 - DNA, 15 bp, Homo sapiens
acagtgggcatcagc

SEQ ID NO: 5552708 - DNA, 18 bp, Homo sapiens
acagtgggcatcagcagc

SEQ ID NO: 5552709 - DNA, 20 bp, Homo sapiens
acagtgggccggccccaggc

SEQ ID NO: 5552710 - DNA, 21 bp, Homo sapiens
acagtgggccggccccaggct

SEQ ID NO: 5552711 - DNA, 11 bp, Homo sapiens
acagtgggcct

SEQ ID NO: 5552712 - DNA, 19 bp, Homo sapiens
acagtgggcctgtgtgtgt

SEQ ID NO: 5552713 - DNA, 15 bp, Homo sapiens
acagtggggcccatg

SEQ ID NO: 5552714 - DNA, 18 bp, Homo sapiens
acagtggggcccatggcc

SEQ ID NO: 5552715 - DNA, 21 bp, Homo sapiens
acagtggggcccatggcccca

SEQ ID NO: 5552716 - DNA, 17 bp, Homo sapiens
acagtggggctgcaggc

SEQ ID NO: 5552717 - DNA, 20 bp, Homo sapiens
acagtggggctgcaggcagg

SEQ ID NO: 5552718 - DNA, 23 bp, Homo sapiens
acagtgggggtgcctggtgcgct

SEQ ID NO: 5552719 - DNA, 21 bp, Homo sapiens
acagtgggtgccccccttgcc

SEQ ID NO: 5552720 - DNA, 14 bp, Homo sapiens
acagtgggtggcac

SEQ ID NO: 5552721 - DNA, 21 bp, Homo sapiens
acagtgggtggcacctcctga

SEQ ID NO: 5552722 - DNA, 22 bp, Homo sapiens
acagtggtaaatatagaaccat

SEQ ID NO: 5552723 - DNA, 19 bp, Homo sapiens
acagtggtcagcgattcct

SEQ ID NO: 5552724 - DNA, 17 bp, Homo sapiens
acagtggtggcaacatt

SEQ ID NO: 5552725 - DNA, 21 bp, Homo sapiens
acagtggtggcaacattcatt

SEQ ID NO: 5552726 - DNA, 23 bp, Homo sapiens
acagtggtggcagggcctagctg

SEQ ID NO: 5552727 - DNA, 17 bp, Homo sapiens
acagtggtgggcgggga

SEQ ID NO: 5552728 - DNA, 18 bp, Homo sapiens
acagtggttatatttcaa

SEQ ID NO: 5552729 - DNA, 19 bp, Homo sapiens
acagtggttctacaatcta

SEQ ID NO: 5552730 - DNA, 23 bp, Homo sapiens
acagtggttctacaatctattta

SEQ ID NO: 5552731 - DNA, 20 bp, Homo sapiens
acagtggttttatactgaag

SEQ ID NO: 5552732 - DNA, 19 bp, Homo sapiens
acagtgtaaagttaatcag

SEQ ID NO: 5552733 - DNA, 17 bp, Homo sapiens
acagtgtaaatcccaga

SEQ ID NO: 5552734 - DNA, 23 bp, Homo sapiens
acagtgtaagcttagattttctg

SEQ ID NO: 5552735 - DNA, 21 bp, Homo sapiens
acagtgtaatccaggggtgta

SEQ ID NO: 5552736 - DNA, 15 bp, Homo sapiens
acagtgtacaaaact

SEQ ID NO: 5552737 - DNA, 12 bp, Homo sapiens
acagtgtacagt

SEQ ID NO: 5552738 - DNA, 12 bp, Homo sapiens
acagtgtacatg

SEQ ID NO: 5552739 - DNA, 19 bp, Homo sapiens
acagtgtacatgtacatag

SEQ ID NO: 5552740 - DNA, 23 bp, Homo sapiens
acagtgtaccattaaaatatgca

SEQ ID NO: 5552741 - DNA, 16 bp, Homo sapiens
acagtgtagcttgccc

SEQ ID NO: 5552742 - DNA, 20 bp, Homo sapiens
acagtgtatctcgaagtctt

SEQ ID NO: 5552743 - DNA, 13 bp, Homo sapiens
acagtgtatgggg

SEQ ID NO: 5552744 - DNA, 13 bp, Homo sapiens
acagtgtatgtag

SEQ ID NO: 5552745 - DNA, 19 bp, Homo sapiens
acagtgtatgtagaagcat

SEQ ID NO: 5552746 - DNA, 22 bp, Homo sapiens
acagtgtcctaccactctaatc

SEQ ID NO: 5552747 - DNA, 16 bp, Homo sapiens
acagtgtctgggctga

SEQ ID NO: 5552748 - DNA, 19 bp, Homo sapiens
acagtgtctgggctgactg

SEQ ID NO: 5552749 - DNA, 21 bp, Homo sapiens
acagtgtctgggctgactggg

SEQ ID NO: 5552750 - DNA, 14 bp, Homo sapiens
acagtgtctgtaaa

SEQ ID NO: 5552751 - DNA, 23 bp, Homo sapiens
acagtgtctgtatcggagacagt

SEQ ID NO: 5552752 - DNA, 17 bp, Homo sapiens
acagtgtctgtgtgtgt

SEQ ID NO: 5552753 - DNA, 12 bp, Homo sapiens
acagtgtctgtt

SEQ ID NO: 5552754 - DNA, 18 bp, Homo sapiens
acagtgtctgttcagcaa

SEQ ID NO: 5552755 - DNA, 14 bp, Homo sapiens
acagtgtctttttt

SEQ ID NO: 5552756 - DNA, 21 bp, Homo sapiens
acagtgtctttttttgtatag

SEQ ID NO: 5552757 - DNA, 13 bp, Homo sapiens
acagtgtgggaca

SEQ ID NO: 5552758 - DNA, 19 bp, Homo sapiens
acagtgtgggacaggctct

SEQ ID NO: 5552759 - DNA, 20 bp, Homo sapiens
acagtgtgggcgctctccct

SEQ ID NO: 5552760 - DNA, 20 bp, Homo sapiens
acagtgtggtagttaataaa

SEQ ID NO: 5552761 - DNA, 14 bp, Homo sapiens
acagtgtgtaaaca

SEQ ID NO: 5552762 - DNA, 18 bp, Homo sapiens
acagtgtgtaaacaaaat

SEQ ID NO: 5552763 - DNA, 22 bp, Homo sapiens
acagtgtgtgtgggtgaaatgg

SEQ ID NO: 5552764 - DNA, 18 bp, Homo sapiens
acagtgtgttggtgcttt

SEQ ID NO: 5552765 - DNA, 18 bp, Homo sapiens
acagtgttaaaagaaaat

SEQ ID NO: 5552766 - DNA, 14 bp, Homo sapiens
acagtgttaaatga

SEQ ID NO: 5552767 - DNA, 17 bp, Homo sapiens
acagtgttaggcctggc

SEQ ID NO: 5552768 - DNA, 21 bp, Homo sapiens
acagtgttaggcctggcacag

SEQ ID NO: 5552769 - DNA, 21 bp, Homo sapiens
acagtgttagtgctggtcaga

SEQ ID NO: 5552770 - DNA, 15 bp, Homo sapiens
acagtgttcaaattc

SEQ ID NO: 5552771 - DNA, 21 bp, Homo sapiens
acagtgttcaaattctgatta

SEQ ID NO: 5552772 - DNA, 17 bp, Homo sapiens
acagtgttctgagcccc

SEQ ID NO: 5552773 - DNA, 21 bp, Homo sapiens
acagtgttggagaacaacaaa

SEQ ID NO: 5552774 - DNA, 18 bp, Homo sapiens
acagtgtttatcctttca

SEQ ID NO: 5552775 - DNA, 12 bp, Homo sapiens
acagtgtttcaa

SEQ ID NO: 5552776 - DNA, 13 bp, Homo sapiens
acagtgtttcaat

SEQ ID NO: 5552777 - DNA, 14 bp, Homo sapiens
acagtgtttccagt

SEQ ID NO: 5552778 - DNA, 16 bp, Homo sapiens
acagtgtttcccataa

SEQ ID NO: 5552779 - DNA, 18 bp, Homo sapiens
acagtgtttcccataatt

SEQ ID NO: 5552780 - DNA, 16 bp, Homo sapiens
acagtgtttcctgagt

SEQ ID NO: 5552781 - DNA, 13 bp, Homo sapiens
acagtgtttgccc

SEQ ID NO: 5552782 - DNA, 15 bp, Homo sapiens
acagtgtttggacag

SEQ ID NO: 5552783 - DNA, 20 bp, Homo sapiens
acagtgtttggacaggaggg

SEQ ID NO: 5552784 - DNA, 18 bp, Homo sapiens
acagtgtttttgtaaagt

SEQ ID NO: 5552785 - DNA, 13 bp, Homo sapiens
acagtgtttttta

SEQ ID NO: 5552786 - DNA, 22 bp, Homo sapiens
acagtgttttttaggaaaagca

SEQ ID NO: 5552787 - DNA, 16 bp, Homo sapiens
acagttaactctccca

SEQ ID NO: 5552788 - DNA, 14 bp, Homo sapiens
acagttaactttct

SEQ ID NO: 5552789 - DNA, 21 bp, Homo sapiens
acagttaagaagccctgcaga

SEQ ID NO: 5552790 - DNA, 19 bp, Homo sapiens
acagttacataattcactc

SEQ ID NO: 5552791 - DNA, 21 bp, Homo sapiens
acagttacctctgcctcagaa

SEQ ID NO: 5552792 - DNA, 16 bp, Homo sapiens
acatacgggaagttta

SEQ ID NO: 5552793 - DNA, 17 bp, Homo sapiens
acatacgggaagtttat

SEQ ID NO: 5552794 - DNA, 20 bp, Homo sapiens
acatacggtcaggtttaaca

SEQ ID NO: 5552795 - DNA, 21 bp, Homo sapiens
acatacggtcaggtttaacat

SEQ ID NO: 5552796 - DNA, 16 bp, Homo sapiens
acatacggttctgtta

SEQ ID NO: 5552797 - DNA, 15 bp, Homo sapiens
acatacgtgcacagg

SEQ ID NO: 5552798 - DNA, 22 bp, Homo sapiens
acatacgtgtgcatgtgtcttt

SEQ ID NO: 5552799 - DNA, 13 bp, Homo sapiens
acatactaaccag

SEQ ID NO: 5552800 - DNA, 22 bp, Homo sapiens
acatactaaccagcagaaatgc

SEQ ID NO: 5552801 - DNA, 14 bp, Homo sapiens
acatactcattttt

SEQ ID NO: 5552802 - DNA, 16 bp, Homo sapiens
acatactcatttttca

SEQ ID NO: 5552803 - DNA, 14 bp, Homo sapiens
acatactctgctta

SEQ ID NO: 5552804 - DNA, 14 bp, Homo sapiens
acatactgcatgta

SEQ ID NO: 5552805 - DNA, 15 bp, Homo sapiens
acatactgctggagt

SEQ ID NO: 5552806 - DNA, 16 bp, Homo sapiens
acatactgctggagtc

SEQ ID NO: 5552807 - DNA, 15 bp, Homo sapiens
acatactgtgttcca

SEQ ID NO: 5552808 - DNA, 16 bp, Homo sapiens
acatacttacatttca

SEQ ID NO: 5552809 - DNA, 17 bp, Homo sapiens
acatacttcaaaaatgt

SEQ ID NO: 5552810 - DNA, 18 bp, Homo sapiens
acatacttgaagggccag

SEQ ID NO: 5552811 - DNA, 19 bp, Homo sapiens
acatacttgaagggccaga

SEQ ID NO: 5552812 - DNA, 21 bp, Homo sapiens
acatacttgaagggccagagc

SEQ ID NO: 5552813 - DNA, 23 bp, Homo sapiens
acatacttgaagggccagagcca

SEQ ID NO: 5552814 - DNA, 18 bp, Homo sapiens
acatacttttcctaaagt

SEQ ID NO: 5552815 - DNA, 14 bp, Homo sapiens
acatacttttgcaa

SEQ ID NO: 5552816 - DNA, 11 bp, Homo sapiens
acatacttttt

SEQ ID NO: 5552817 - DNA, 17 bp, Homo sapiens
acatactttttgggttt

SEQ ID NO: 5552818 - DNA, 13 bp, Homo sapiens
acatagaaaaatg

SEQ ID NO: 5552819 - DNA, 18 bp, Homo sapiens
acatagaaaaatgatgtc

SEQ ID NO: 5552820 - DNA, 13 bp, Homo sapiens
acatagaaacttt

SEQ ID NO: 5552821 - DNA, 12 bp, Homo sapiens
acatagaaagac

SEQ ID NO: 5552822 - DNA, 13 bp, Homo sapiens
acatagaaagaca

SEQ ID NO: 5552823 - DNA, 13 bp, Homo sapiens
acatagaaagagt

SEQ ID NO: 5552824 - DNA, 12 bp, Homo sapiens
acatagaaatgg

SEQ ID NO: 5552825 - DNA, 20 bp, Homo sapiens
acatagaaatggaaattttg

SEQ ID NO: 5552826 - DNA, 16 bp, Homo sapiens
acatagaaattgcctg

SEQ ID NO: 5552827 - DNA, 21 bp, Homo sapiens
acatagaaattgcctgacgaa

SEQ ID NO: 5552828 - DNA, 21 bp, Homo sapiens
acatagaacacttcagacaca

SEQ ID NO: 5552829 - DNA, 16 bp, Homo sapiens
acatagaacatgtgtc

SEQ ID NO: 5552830 - DNA, 14 bp, Homo sapiens
acatagaattaaca

SEQ ID NO: 5552831 - DNA, 18 bp, Homo sapiens
acatagaattaacacatg

SEQ ID NO: 5552832 - DNA, 13 bp, Homo sapiens
acatagacagatg

SEQ ID NO: 5552833 - DNA, 20 bp, Homo sapiens
acatagacatttcaaaatta

SEQ ID NO: 5552834 - DNA, 22 bp, Homo sapiens
acatagaccctctttcttgttt

SEQ ID NO: 5552835 - DNA, 18 bp, Homo sapiens
acatagactgaagattta

SEQ ID NO: 5552836 - DNA, 23 bp, Homo sapiens
acatagagaactgtcaccctgag

SEQ ID NO: 5552837 - DNA, 15 bp, Homo sapiens
acatagagcaatgtt

SEQ ID NO: 5552838 - DNA, 19 bp, Homo sapiens
acatagagcaatgttggtt

SEQ ID NO: 5552839 - DNA, 21 bp, Homo sapiens
acatagagcaatgttggtttt

SEQ ID NO: 5552840 - DNA, 21 bp, Homo sapiens
acatagagccgggtgtcccca

SEQ ID NO: 5552841 - DNA, 18 bp, Homo sapiens
acatagagctttttaata

SEQ ID NO: 5552842 - DNA, 21 bp, Homo sapiens
acatagaggtatattggaaga

SEQ ID NO: 5552843 - DNA, 22 bp, Homo sapiens
acatagagtgactccaagaaca

SEQ ID NO: 5552844 - DNA, 16 bp, Homo sapiens
acatagataaaacatc

SEQ ID NO: 5552845 - DNA, 18 bp, Homo sapiens
acatagatcagccattaa

SEQ ID NO: 5552846 - DNA, 19 bp, Homo sapiens
acatagatcagccattaaa

SEQ ID NO: 5552847 - DNA, 21 bp, Homo sapiens
acatagatcctctgatataca

SEQ ID NO: 5552848 - DNA, 14 bp, Homo sapiens
acatagatgcctgg

SEQ ID NO: 5552849 - DNA, 15 bp, Homo sapiens
acatagatgcctggg

SEQ ID NO: 5552850 - DNA, 18 bp, Homo sapiens
acatagattaatggcact

SEQ ID NO: 5552851 - DNA, 20 bp, Homo sapiens
acatagattaatggcactga

SEQ ID NO: 5552852 - DNA, 17 bp, Homo sapiens
acatagattcacctgta

SEQ ID NO: 5552853 - DNA, 22 bp, Homo sapiens
acatagattcacctgtaaaact

SEQ ID NO: 5552854 - DNA, 22 bp, Homo sapiens
acatagcacagtatttactgtg

SEQ ID NO: 5552855 - DNA, 17 bp, Homo sapiens
acatagcactagcattc

SEQ ID NO: 5552856 - DNA, 21 bp, Homo sapiens
acatagcactagcattcaggg

SEQ ID NO: 5552857 - DNA, 18 bp, Homo sapiens
acatagcatgacatttct

SEQ ID NO: 5552858 - DNA, 21 bp, Homo sapiens
acatagcatgacatttctttg

SEQ ID NO: 5552859 - DNA, 21 bp, Homo sapiens
acatagcatgcttcctttctc

SEQ ID NO: 5552860 - DNA, 22 bp, Homo sapiens
acatagcatttgtgtaaagact

SEQ ID NO: 5552861 - DNA, 16 bp, Homo sapiens
acatagccaaaatgtg

SEQ ID NO: 5552862 - DNA, 19 bp, Homo sapiens
acatagcccaagaacagaa

SEQ ID NO: 5552863 - DNA, 19 bp, Homo sapiens
acatagcccacttacattt

SEQ ID NO: 5552864 - DNA, 21 bp, Homo sapiens
acatagcccacttacatttac

SEQ ID NO: 5552865 - DNA, 18 bp, Homo sapiens
acatagcccatccctgcc

SEQ ID NO: 5552866 - DNA, 19 bp, Homo sapiens
acatagcccatccctgcct

SEQ ID NO: 5552867 - DNA, 15 bp, Homo sapiens
acatagcccctgccc

SEQ ID NO: 5552868 - DNA, 16 bp, Homo sapiens
acatagccctaactcc

SEQ ID NO: 5552869 - DNA, 13 bp, Homo sapiens
acatagccctgtt

SEQ ID NO: 5552870 - DNA, 21 bp, Homo sapiens
acatagccctgttgacctgcc

SEQ ID NO: 5552871 - DNA, 13 bp, Homo sapiens
acatagcctatat

SEQ ID NO: 5552872 - DNA, 19 bp, Homo sapiens
acatagcctatatttacag

SEQ ID NO: 5552873 - DNA, 15 bp, Homo sapiens
acatagcctttgtgc

SEQ ID NO: 5552874 - DNA, 21 bp, Homo sapiens
acatagcgccgtgctgtaaat

SEQ ID NO: 5552875 - DNA, 23 bp, Homo sapiens
acatagctttagagaagccataa

SEQ ID NO: 5552876 - DNA, 20 bp, Homo sapiens
acataggaagggatctgaga

SEQ ID NO: 5552877 - DNA, 11 bp, Homo sapiens
acataggaatt

SEQ ID NO: 5552878 - DNA, 17 bp, Homo sapiens
acataggcaaattggaa

SEQ ID NO: 5552879 - DNA, 14 bp, Homo sapiens
acataggccaaggc

SEQ ID NO: 5552880 - DNA, 20 bp, Homo sapiens
acataggccgagctgtggac

SEQ ID NO: 5552881 - DNA, 19 bp, Homo sapiens
acataggctctcaggtgcc

SEQ ID NO: 5552882 - DNA, 19 bp, Homo sapiens
acataggctggtggccttg

SEQ ID NO: 5552883 - DNA, 20 bp, Homo sapiens
acataggctggtggccttgg

SEQ ID NO: 5552884 - DNA, 21 bp, Homo sapiens
acataggcttatacaaattta

SEQ ID NO: 5552885 - DNA, 22 bp, Homo sapiens
acataggcttatacaaatttaa

SEQ ID NO: 5552886 - DNA, 21 bp, Homo sapiens
acataggcttctattacctat

SEQ ID NO: 5552887 - DNA, 23 bp, Homo sapiens
acataggtaggtatctttatagt

SEQ ID NO: 5552888 - DNA, 15 bp, Homo sapiens
acataggtgctcttc

SEQ ID NO: 5552889 - DNA, 20 bp, Homo sapiens
acataggttttgatttatat

SEQ ID NO: 5552890 - DNA, 20 bp, Homo sapiens
acataggtttttaaagacta

SEQ ID NO: 5552891 - DNA, 15 bp, Homo sapiens
acatagtaaagtatt

SEQ ID NO: 5552892 - DNA, 15 bp, Homo sapiens
acatagtaaatggta

SEQ ID NO: 5552893 - DNA, 14 bp, Homo sapiens
acatagtattcatg

SEQ ID NO: 5552894 - DNA, 19 bp, Homo sapiens
acatagtattcatgactat

SEQ ID NO: 5552895 - DNA, 13 bp, Homo sapiens
acatagtcacaaa

SEQ ID NO: 5552896 - DNA, 16 bp, Homo sapiens
acatagtcacaaaaat

SEQ ID NO: 5552897 - DNA, 16 bp, Homo sapiens
acatagtcctcagggc

SEQ ID NO: 5552898 - DNA, 18 bp, Homo sapiens
acatagtctgaagtgaag

SEQ ID NO: 5552899 - DNA, 14 bp, Homo sapiens
acatagtctggctg

SEQ ID NO: 5552900 - DNA, 20 bp, Homo sapiens
acatagtctggctgtaccca

SEQ ID NO: 5552901 - DNA, 19 bp, Homo sapiens
acatagtgaaataaattct

SEQ ID NO: 5552902 - DNA, 13 bp, Homo sapiens
acatagtgaattt

SEQ ID NO: 5552903 - DNA, 16 bp, Homo sapiens
acatagtgaattttaa

SEQ ID NO: 5552904 - DNA, 16 bp, Homo sapiens
acatagtgatggttcc

SEQ ID NO: 5552905 - DNA, 20 bp, Homo sapiens
acatagtgctaacatgaaga

SEQ ID NO: 5552906 - DNA, 22 bp, Homo sapiens
acatagtggatggacagatgga

SEQ ID NO: 5552907 - DNA, 20 bp, Homo sapiens
acatagtgggaccctgtctc

SEQ ID NO: 5552908 - DNA, 14 bp, Homo sapiens
acatagtgtcctgc

SEQ ID NO: 5552909 - DNA, 19 bp, Homo sapiens
acatagttatttttctctt

SEQ ID NO: 5552910 - DNA, 17 bp, Homo sapiens
acatagttctccagttg

SEQ ID NO: 5552911 - DNA, 17 bp, Homo sapiens
acatagtttgtaaaggc

SEQ ID NO: 5552912 - DNA, 17 bp, Homo sapiens
acatagttttaaactca

SEQ ID NO: 5552913 - DNA, 15 bp, Homo sapiens
acatagtttttcagt

SEQ ID NO: 5552914 - DNA, 23 bp, Homo sapiens
acatataaaaacaatatatttgt

SEQ ID NO: 5552915 - DNA, 14 bp, Homo sapiens
acatataaaagtta

SEQ ID NO: 5552916 - DNA, 16 bp, Homo sapiens
acatataaacacagta

SEQ ID NO: 5552917 - DNA, 19 bp, Homo sapiens
acatataaagattaacact

SEQ ID NO: 5552918 - DNA, 18 bp, Homo sapiens
acatataaattaatacat

SEQ ID NO: 5552919 - DNA, 16 bp, Homo sapiens
acatataaattgtctt

SEQ ID NO: 5552920 - DNA, 22 bp, Homo sapiens
acatataaattgtcttaatgga

SEQ ID NO: 5552921 - DNA, 17 bp, Homo sapiens
acatataacacttaact

SEQ ID NO: 5552922 - DNA, 16 bp, Homo sapiens
acatataatatatgtt

SEQ ID NO: 5552923 - DNA, 17 bp, Homo sapiens
acatatacacaaagata

SEQ ID NO: 5552924 - DNA, 15 bp, Homo sapiens
acatatacagaaaaa

SEQ ID NO: 5552925 - DNA, 17 bp, Homo sapiens
acatatacatatatata

SEQ ID NO: 5552926 - DNA, 20 bp, Homo sapiens
acatatacctataatgtgtg

SEQ ID NO: 5552927 - DNA, 18 bp, Homo sapiens
acatatagaataagggtt

SEQ ID NO: 5552928 - DNA, 19 bp, Homo sapiens
acatatataacaatgctgt

SEQ ID NO: 5552929 - DNA, 15 bp, Homo sapiens
acatatatacacaca

SEQ ID NO: 5552930 - DNA, 19 bp, Homo sapiens
acatatatataacaaataa

SEQ ID NO: 5552931 - DNA, 18 bp, Homo sapiens
acatatatatatacacat

SEQ ID NO: 5552932 - DNA, 21 bp, Homo sapiens
acatatatatatacacataca

SEQ ID NO: 5552933 - DNA, 16 bp, Homo sapiens
acatatatatatttgt

SEQ ID NO: 5552934 - DNA, 18 bp, Homo sapiens
acatatatatatttgtaa

SEQ ID NO: 5552935 - DNA, 21 bp, Homo sapiens
acatatatatatttgtaacat

SEQ ID NO: 5552936 - DNA, 17 bp, Homo sapiens
acatatatatctgataa

SEQ ID NO: 5552937 - DNA, 20 bp, Homo sapiens
acatatatatctgataaaat

SEQ ID NO: 5552938 - DNA, 15 bp, Homo sapiens
acatatatatttatt

SEQ ID NO: 5552939 - DNA, 16 bp, Homo sapiens
acatatatctacacat

SEQ ID NO: 5552940 - DNA, 21 bp, Homo sapiens
acatatatctacacatacaga

SEQ ID NO: 5552941 - DNA, 14 bp, Homo sapiens
acatatatctgatg

SEQ ID NO: 5552942 - DNA, 13 bp, Homo sapiens
acatatatgtata

SEQ ID NO: 5552943 - DNA, 14 bp, Homo sapiens
acatatatgtataa

SEQ ID NO: 5552944 - DNA, 15 bp, Homo sapiens
acatatatgtataat

SEQ ID NO: 5552945 - DNA, 21 bp, Homo sapiens
acatatatgtataatatatat

SEQ ID NO: 5552946 - DNA, 18 bp, Homo sapiens
acatatatgtatacgcac

SEQ ID NO: 5552947 - DNA, 17 bp, Homo sapiens
acatatatgtatatgta

SEQ ID NO: 5552948 - DNA, 23 bp, Homo sapiens
acatatatgtatatgtatatcta

SEQ ID NO: 5552949 - DNA, 13 bp, Homo sapiens
acatatattatat

SEQ ID NO: 5552950 - DNA, 16 bp, Homo sapiens
acatatattatatata

SEQ ID NO: 5552951 - DNA, 14 bp, Homo sapiens
acatatatttattg

SEQ ID NO: 5552952 - DNA, 15 bp, Homo sapiens
acatatatttattga

SEQ ID NO: 5552953 - DNA, 18 bp, Homo sapiens
acatatattttttaaaat

SEQ ID NO: 5552954 - DNA, 19 bp, Homo sapiens
acatatattttttaaaata

SEQ ID NO: 5552955 - DNA, 16 bp, Homo sapiens
acatatattttttaca

SEQ ID NO: 5552956 - DNA, 13 bp, Homo sapiens
acatatcaaatag

SEQ ID NO: 5552957 - DNA, 18 bp, Homo sapiens
acatatcaagtcccgagg

SEQ ID NO: 5552958 - DNA, 15 bp, Homo sapiens
acatatcaattcaac

SEQ ID NO: 5552959 - DNA, 12 bp, Homo sapiens
acatatcagaaa

SEQ ID NO: 5552960 - DNA, 16 bp, Homo sapiens
acatatcagaaaagta

SEQ ID NO: 5552961 - DNA, 13 bp, Homo sapiens
acatatcagactt

SEQ ID NO: 5552962 - DNA, 16 bp, Homo sapiens
acatatcatctgtgga

SEQ ID NO: 5552963 - DNA, 19 bp, Homo sapiens
acatatcatggtaatgaca

SEQ ID NO: 5552964 - DNA, 20 bp, Homo sapiens
acatatcatggtaatgacag

SEQ ID NO: 5552965 - DNA, 17 bp, Homo sapiens
acatatcatgtgtgaga

SEQ ID NO: 5552966 - DNA, 16 bp, Homo sapiens
acatatcattcagaat

SEQ ID NO: 5552967 - DNA, 15 bp, Homo sapiens
acatatcattctgtg

SEQ ID NO: 5552968 - DNA, 13 bp, Homo sapiens
acatatcatttgt

SEQ ID NO: 5552969 - DNA, 16 bp, Homo sapiens
acatatcatttgtgaa

SEQ ID NO: 5552970 - DNA, 21 bp, Homo sapiens
acatcatgtaagatggcaact

SEQ ID NO: 5552971 - DNA, 19 bp, Homo sapiens
acatcattacagattctgc

SEQ ID NO: 5552972 - DNA, 18 bp, Homo sapiens
acatcattactataagaa

SEQ ID NO: 5552973 - DNA, 21 bp, Homo sapiens
acatcattactataagaactt

SEQ ID NO: 5552974 - DNA, 13 bp, Homo sapiens
acatcattattgt

SEQ ID NO: 5552975 - DNA, 13 bp, Homo sapiens
acatcattcattc

SEQ ID NO: 5552976 - DNA, 21 bp, Homo sapiens
acatcattcattcactgtata

SEQ ID NO: 5552977 - DNA, 19 bp, Homo sapiens
acatcattccaaaaagaac

SEQ ID NO: 5552978 - DNA, 20 bp, Homo sapiens
acatcattccaaaaagaaca

SEQ ID NO: 5552979 - DNA, 21 bp, Homo sapiens
acatcattcctgtcagagctt

SEQ ID NO: 5552980 - DNA, 13 bp, Homo sapiens
acatcattccttt

SEQ ID NO: 5552981 - DNA, 21 bp, Homo sapiens
acatcattcctttttatttat

SEQ ID NO: 5552982 - DNA, 16 bp, Homo sapiens
acatcattctacataa

SEQ ID NO: 5552983 - DNA, 15 bp, Homo sapiens
acatcattcttgaga

SEQ ID NO: 5552984 - DNA, 19 bp, Homo sapiens
acatcattggaatacagga

SEQ ID NO: 5552985 - DNA, 16 bp, Homo sapiens
acatcattgtcagcct

SEQ ID NO: 5552986 - DNA, 18 bp, Homo sapiens
acatcattgtcagccttg

SEQ ID NO: 5552987 - DNA, 22 bp, Homo sapiens
acatcatttcaatcgtaaaatt

SEQ ID NO: 5552988 - DNA, 12 bp, Homo sapiens
acatcatttctt

SEQ ID NO: 5552989 - DNA, 13 bp, Homo sapiens
acatcatttcttt

SEQ ID NO: 5552990 - DNA, 22 bp, Homo sapiens
acatcatttctttttgggagag

SEQ ID NO: 5552991 - DNA, 19 bp, Homo sapiens
acatcatttgtattatgtt

SEQ ID NO: 5552992 - DNA, 12 bp, Homo sapiens
acatcatttttt

SEQ ID NO: 5552993 - DNA, 16 bp, Homo sapiens
acatccaaagcagaca

SEQ ID NO: 5552994 - DNA, 19 bp, Homo sapiens
acatccaaagcagacagct

SEQ ID NO: 5552995 - DNA, 13 bp, Homo sapiens
acatccaaatcta

SEQ ID NO: 5552996 - DNA, 21 bp, Homo sapiens
acatccaacatttcctcaggc

SEQ ID NO: 5552997 - DNA, 19 bp, Homo sapiens
acatccaactccagcaact

SEQ ID NO: 5552998 - DNA, 16 bp, Homo sapiens
acatccaagcttcctt

SEQ ID NO: 5552999 - DNA, 14 bp, Homo sapiens
acatccaaggagaa

SEQ ID NO: 5553000 - DNA, 23 bp, Homo sapiens
acatccaaggagaaacagagaca

SEQ ID NO: 5553001 - DNA, 15 bp, Homo sapiens
acatccacacacagt

SEQ ID NO: 5553002 - DNA, 19 bp, Homo sapiens
acatccacagtctccccca

SEQ ID NO: 5553003 - DNA, 14 bp, Homo sapiens
acatccacatgcac

SEQ ID NO: 5553004 - DNA, 13 bp, Homo sapiens
acatccaccccag

SEQ ID NO: 5553005 - DNA, 15 bp, Homo sapiens
acatccagaaagctg

SEQ ID NO: 5553006 - DNA, 16 bp, Homo sapiens
acatccagaaagctga

SEQ ID NO: 5553007 - DNA, 12 bp, Homo sapiens
acatccagcaga

SEQ ID NO: 5553008 - DNA, 13 bp, Homo sapiens
acatccagctcct

SEQ ID NO: 5553009 - DNA, 15 bp, Homo sapiens
acatccagctcctct

SEQ ID NO: 5553010 - DNA, 14 bp, Homo sapiens
acatccagctgccc

SEQ ID NO: 5553011 - DNA, 15 bp, Homo sapiens
acatccataaagaag

SEQ ID NO: 5553012 - DNA, 17 bp, Homo sapiens
acatccataaagaagca

SEQ ID NO: 5553013 - DNA, 15 bp, Homo sapiens
acatccatatacata

SEQ ID NO: 5553014 - DNA, 19 bp, Homo sapiens
acatccatcgtaattgttc

SEQ ID NO: 5553015 - DNA, 13 bp, Homo sapiens
acatccatgtcct

SEQ ID NO: 5553016 - DNA, 21 bp, Homo sapiens
acatccatgtcctatgtgtga

SEQ ID NO: 5553017 - DNA, 18 bp, Homo sapiens
acatccattccagagctg

SEQ ID NO: 5553018 - DNA, 22 bp, Homo sapiens
acatccattccagagctgcaga

SEQ ID NO: 5553019 - DNA, 17 bp, Homo sapiens
acatccattcccaagaa

SEQ ID NO: 5553020 - DNA, 18 bp, Homo sapiens
acatccattcccaagaaa

SEQ ID NO: 5553021 - DNA, 20 bp, Homo sapiens
acatccatttcatctatttc

SEQ ID NO: 5553022 - DNA, 23 bp, Homo sapiens
acatcccaaactttaaaatgcga

SEQ ID NO: 5553023 - DNA, 16 bp, Homo sapiens
acatcccaataaagtc

SEQ ID NO: 5553024 - DNA, 20 bp, Homo sapiens
acatcccactcacaacagct

SEQ ID NO: 5553025 - DNA, 14 bp, Homo sapiens
acatcccactgcca

SEQ ID NO: 5553026 - DNA, 23 bp, Homo sapiens
acatcccaggaggggcctctgaa

SEQ ID NO: 5553027 - DNA, 21 bp, Homo sapiens
acatcccagtagtgtttggaa

SEQ ID NO: 5553028 - DNA, 20 bp, Homo sapiens
acatcccagtttctcagaag

SEQ ID NO: 5553029 - DNA, 20 bp, Homo sapiens
acatcccatgtaacagaaag

SEQ ID NO: 5553030 - DNA, 16 bp, Homo sapiens
acatcccattgccctg

SEQ ID NO: 5553031 - DNA, 17 bp, Homo sapiens
acatcccattgccctgg

SEQ ID NO: 5553032 - DNA, 20 bp, Homo sapiens
acatccccaagcccaccagg

SEQ ID NO: 5553033 - DNA, 23 bp, Homo sapiens
acatccccaccctcccctctcct

SEQ ID NO: 5553034 - DNA, 14 bp, Homo sapiens
acatccccaccctt

SEQ ID NO: 5553035 - DNA, 13 bp, Homo sapiens
acatccccacctg

SEQ ID NO: 5553036 - DNA, 18 bp, Homo sapiens
acatccccaccttccaag

SEQ ID NO: 5553037 - DNA, 14 bp, Homo sapiens
acatccccagagcc

SEQ ID NO: 5553038 - DNA, 19 bp, Homo sapiens
acatccccagagcccagct

SEQ ID NO: 5553039 - DNA, 20 bp, Homo sapiens
acatccccagagcccagctc

SEQ ID NO: 5553040 - DNA, 15 bp, Homo sapiens
acatccccaggtctc

SEQ ID NO: 5553041 - DNA, 17 bp, Homo sapiens
acatcccccaatgacct

SEQ ID NO: 5553042 - DNA, 18 bp, Homo sapiens
acatcccggcctcttcca

SEQ ID NO: 5553043 - DNA, 18 bp, Homo sapiens
acatcccgggcctcagtg

SEQ ID NO: 5553044 - DNA, 17 bp, Homo sapiens
acatccctaacatcatg

SEQ ID NO: 5553045 - DNA, 15 bp, Homo sapiens
acatccctctctgct

SEQ ID NO: 5553046 - DNA, 17 bp, Homo sapiens
acatccctgccagctct

SEQ ID NO: 5553047 - DNA, 18 bp, Homo sapiens
acatccctgggcctgctg

SEQ ID NO: 5553048 - DNA, 19 bp, Homo sapiens
acatccctgggcctgctgc

SEQ ID NO: 5553049 - DNA, 21 bp, Homo sapiens
acatcccttattagttacaaa

SEQ ID NO: 5553050 - DNA, 12 bp, Homo sapiens
acatcccttcct

SEQ ID NO: 5553051 - DNA, 14 bp, Homo sapiens
acatcccttcctgg

SEQ ID NO: 5553052 - DNA, 15 bp, Homo sapiens
acatcccttcctgga

SEQ ID NO: 5553053 - DNA, 20 bp, Homo sapiens
acatcccttcctggaaacag

SEQ ID NO: 5553054 - DNA, 21 bp, Homo sapiens
acatcccttcctggaaacagc

SEQ ID NO: 5553055 - DNA, 18 bp, Homo sapiens
acatccgccttttgtata

SEQ ID NO: 5553056 - DNA, 16 bp, Homo sapiens
acatccgcgtgtgcct

SEQ ID NO: 5553057 - DNA, 17 bp, Homo sapiens
acatccgcgtgtgcctg

SEQ ID NO: 5553058 - DNA, 21 bp, Homo sapiens
acatccgcgtgtgcctgtgtg

SEQ ID NO: 5553059 - DNA, 16 bp, Homo sapiens
acatccggaacagcca

SEQ ID NO: 5553060 - DNA, 19 bp, Homo sapiens
acatccgtcattgctgctg

SEQ ID NO: 5553061 - DNA, 17 bp, Homo sapiens
acatccgtcccacatca

SEQ ID NO: 5553062 - DNA, 19 bp, Homo sapiens
acatcctaatagaaagaaa

SEQ ID NO: 5553063 - DNA, 17 bp, Homo sapiens
acatcctagccccaccc

SEQ ID NO: 5553064 - DNA, 16 bp, Homo sapiens
acatcctcaaaagaaa

SEQ ID NO: 5553065 - DNA, 13 bp, Homo sapiens
acatcctcattca

SEQ ID NO: 5553066 - DNA, 14 bp, Homo sapiens
acatcctccgtcca

SEQ ID NO: 5553067 - DNA, 13 bp, Homo sapiens
acatcctcctccc

SEQ ID NO: 5553068 - DNA, 11 bp, Homo sapiens
acatcctctcc

SEQ ID NO: 5553069 - DNA, 12 bp, Homo sapiens
acatcctctcca
